United States Patent 7,687,616 (SMALL MOLECULES MODULATING ACTIVITY OF MICRO RNA OLIGONUCLEOTIDES AND MICRO RNA TARGETS AND USES THEREOF) - sequence listing, part 20

SEQ ID NO: 816098 - DNA, 13 bp, Homo sapiens
cagaagagcagct

SEQ ID NO: 816099 - DNA, 15 bp, Homo sapiens
cagaagataacttga

SEQ ID NO: 816100 - DNA, 16 bp, Homo sapiens
cagaagcaagccagac

SEQ ID NO: 816101 - DNA, 17 bp, Homo sapiens
cagaagcagcccctcga

SEQ ID NO: 816102 - DNA, 14 bp, Homo sapiens
cagaagcaggctgg

SEQ ID NO: 816103 - DNA, 16 bp, Homo sapiens
cagaagcaggctggag

SEQ ID NO: 816104 - DNA, 21 bp, Homo sapiens
cagaagcagggtaccctttgg

SEQ ID NO: 816105 - DNA, 16 bp, Homo sapiens
cagaagcaggttcttg

SEQ ID NO: 816106 - DNA, 19 bp, Homo sapiens
cagaagcatattttgctgg

SEQ ID NO: 816107 - DNA, 20 bp, Homo sapiens
cagaagcatattttgctggt

SEQ ID NO: 816108 - DNA, 23 bp, Homo sapiens
cagaagccaagctccctggagcc

SEQ ID NO: 816109 - DNA, 13 bp, Homo sapiens
cagaagccagaag

SEQ ID NO: 816110 - DNA, 14 bp, Homo sapiens
cagaagccagaagg

SEQ ID NO: 816111 - DNA, 17 bp, Homo sapiens
cagaagcccatgtcttc

SEQ ID NO: 816112 - DNA, 15 bp, Homo sapiens
cagaagccccacagc

SEQ ID NO: 816113 - DNA, 17 bp, Homo sapiens
cagacaagcactatttt

SEQ ID NO: 816114 - DNA, 17 bp, Homo sapiens
cagacaaggagagcgga

SEQ ID NO: 816115 - DNA, 11 bp, Homo sapiens
cagacaaggtt

SEQ ID NO: 816116 - DNA, 15 bp, Homo sapiens
cagacaattccattc

SEQ ID NO: 816117 - DNA, 18 bp, Homo sapiens
cagacacaatatgtatgc

SEQ ID NO: 816118 - DNA, 16 bp, Homo sapiens
cagacacacacacgca

SEQ ID NO: 816119 - DNA, 21 bp, Homo sapiens
cagacacacacacgcacgcac

SEQ ID NO: 816120 - DNA, 22 bp, Homo sapiens
cagacacacacacgcacgcaca

SEQ ID NO: 816121 - DNA, 15 bp, Homo sapiens
cagacacacagcctc

SEQ ID NO: 816122 - DNA, 13 bp, Homo sapiens
cagacacagctct

SEQ ID NO: 816123 - DNA, 17 bp, Homo sapiens
cagacacagctcttcca

SEQ ID NO: 816124 - DNA, 20 bp, Homo sapiens
cagacacagctcttccaggg

SEQ ID NO: 816125 - DNA, 19 bp, Homo sapiens
cagacacaggaaaaataaa

SEQ ID NO: 816126 - DNA, 20 bp, Homo sapiens
cagacacagggacttgaagt

SEQ ID NO: 816127 - DNA, 15 bp, Homo sapiens
cagacaccctcaacc

SEQ ID NO: 816128 - DNA, 21 bp, Homo sapiens
cagacaccctcaacctcttct

SEQ ID NO: 816129 - DNA, 22 bp, Homo sapiens
cagacacctccccctacccata

SEQ ID NO: 816130 - DNA, 14 bp, Homo sapiens
cagacacctggact

SEQ ID NO: 816131 - DNA, 15 bp, Homo sapiens
cagacacctggactg

SEQ ID NO: 816132 - DNA, 19 bp, Homo sapiens
cagacacctgttcacagaa

SEQ ID NO: 816133 - DNA, 17 bp, Homo sapiens
cagacacggatctgaga

SEQ ID NO: 816134 - DNA, 17 bp, Homo sapiens
cagacactaaatgcaga

SEQ ID NO: 816135 - DNA, 12 bp, Homo sapiens
cagacactaagt

SEQ ID NO: 816136 - DNA, 18 bp, Homo sapiens
cagacactaagttatagt

SEQ ID NO: 816137 - DNA, 13 bp, Homo sapiens
cagacactctgct

SEQ ID NO: 816138 - DNA, 14 bp, Homo sapiens
cagacactctgctc

SEQ ID NO: 816139 - DNA, 16 bp, Homo sapiens
cagacactctgctctg

SEQ ID NO: 816140 - DNA, 20 bp, Homo sapiens
cagacactctgctctgccct

SEQ ID NO: 816141 - DNA, 14 bp, Homo sapiens
cagacactgagctt

SEQ ID NO: 816142 - DNA, 19 bp, Homo sapiens
cagacactttggaagtttg

SEQ ID NO: 816143 - DNA, 22 bp, Homo sapiens
cagacacttttcaaaagaagac

SEQ ID NO: 816144 - DNA, 20 bp, Homo sapiens
cagacagaacttgaatgtgt

SEQ ID NO: 816145 - DNA, 15 bp, Homo sapiens
cagacagacacacac

SEQ ID NO: 816146 - DNA, 16 bp, Homo sapiens
cagacagacacacaca

SEQ ID NO: 816147 - DNA, 23 bp, Homo sapiens
cagacagacctcaagggacaggg

SEQ ID NO: 816148 - DNA, 13 bp, Homo sapiens
cagacagagccag

SEQ ID NO: 816149 - DNA, 16 bp, Homo sapiens
cagacagagccaggag

SEQ ID NO: 816150 - DNA, 18 bp, Homo sapiens
cagacagagccaggagaa

SEQ ID NO: 816151 - DNA, 13 bp, Homo sapiens
cagacagagggga

SEQ ID NO: 816152 - DNA, 15 bp, Homo sapiens
cagacagcagctcag

SEQ ID NO: 816153 - DNA, 18 bp, Homo sapiens
cagacagcagctcaggca

SEQ ID NO: 816154 - DNA, 14 bp, Homo sapiens
cagacagcaggcag

SEQ ID NO: 816155 - DNA, 21 bp, Homo sapiens
cagacagccctccactccagc

SEQ ID NO: 816156 - DNA, 21 bp, Homo sapiens
cagacagctccaccctggccg

SEQ ID NO: 816157 - DNA, 13 bp, Homo sapiens
cagacaggagaaa

SEQ ID NO: 816158 - DNA, 18 bp, Homo sapiens
cagacaggcaaataaaag

SEQ ID NO: 816159 - DNA, 20 bp, Homo sapiens
cagacaggccatgtgagcca

SEQ ID NO: 816160 - DNA, 15 bp, Homo sapiens
cagacaggccccgtg

SEQ ID NO: 816161 - DNA, 13 bp, Homo sapiens
cagacaggccctc

SEQ ID NO: 816162 - DNA, 15 bp, Homo sapiens
cagacaggccctccc

SEQ ID NO: 816163 - DNA, 18 bp, Homo sapiens
cagacaggctcttagcag

SEQ ID NO: 816164 - DNA, 20 bp, Homo sapiens
cagacagtcgctcagtctgt

SEQ ID NO: 816165 - DNA, 15 bp, Homo sapiens
cagacagtctgttat

SEQ ID NO: 816166 - DNA, 19 bp, Homo sapiens
cagacagtctgttatgcac

SEQ ID NO: 816167 - DNA, 18 bp, Homo sapiens
cagacagtggatgagaca

SEQ ID NO: 816168 - DNA, 19 bp, Homo sapiens
cagacagtgttttctggga

SEQ ID NO: 816169 - DNA, 13 bp, Homo sapiens
cagacatacagct

SEQ ID NO: 816170 - DNA, 19 bp, Homo sapiens
cagacatactaaccagcag

SEQ ID NO: 816171 - DNA, 22 bp, Homo sapiens
cagacatagaagagccaagagt

SEQ ID NO: 816172 - DNA, 19 bp, Homo sapiens
cagacatccatgtttgtaa

SEQ ID NO: 816173 - DNA, 17 bp, Homo sapiens
cagacatctccagtgtg

SEQ ID NO: 816174 - DNA, 17 bp, Homo sapiens
cagacatctctgcaccc

SEQ ID NO: 816175 - DNA, 17 bp, Homo sapiens
cagacatctctggagcc

SEQ ID NO: 816176 - DNA, 20 bp, Homo sapiens
cagacatctctggagccaga

SEQ ID NO: 816177 - DNA, 22 bp, Homo sapiens
cagacatctctggagccagaga

SEQ ID NO: 816178 - DNA, 15 bp, Homo sapiens
cagacatgccttggt

SEQ ID NO: 816179 - DNA, 23 bp, Homo sapiens
cagacatgccttggtgccggtca

SEQ ID NO: 816180 - DNA, 18 bp, Homo sapiens
cagacatgtggtgggaca

SEQ ID NO: 816181 - DNA, 18 bp, Homo sapiens
cagacatgttttccgtga

SEQ ID NO: 816182 - DNA, 19 bp, Homo sapiens
cagacattctcaaagcctc

SEQ ID NO: 816183 - DNA, 20 bp, Homo sapiens
cagacattctcaaagcctct

SEQ ID NO: 816184 - DNA, 19 bp, Homo sapiens
cagaccaaccctgggacct

SEQ ID NO: 816185 - DNA, 16 bp, Homo sapiens
cagaccacattgcttt

SEQ ID NO: 816186 - DNA, 23 bp, Homo sapiens
cagaccaccagccgccccagccc

SEQ ID NO: 816187 - DNA, 15 bp, Homo sapiens
cagaccaccccgcct

SEQ ID NO: 816188 - DNA, 24 bp, Homo sapiens
cagaccacgcccgtcctgcctgtg

SEQ ID NO: 816189 - DNA, 14 bp, Homo sapiens
cagaccacttgcca

SEQ ID NO: 816190 - DNA, 17 bp, Homo sapiens
cagaccagagctgtctg

SEQ ID NO: 816191 - DNA, 12 bp, Homo sapiens
cagaccaggcct

SEQ ID NO: 816192 - DNA, 14 bp, Homo sapiens
cagaccaggccttt

SEQ ID NO: 816193 - DNA, 17 bp, Homo sapiens
cagaccagtactgggaa

SEQ ID NO: 816194 - DNA, 13 bp, Homo sapiens
cagacccacctgg

SEQ ID NO: 816195 - DNA, 15 bp, Homo sapiens
cagacccacctggag

SEQ ID NO: 816196 - DNA, 16 bp, Homo sapiens
cagacccacctggagc

SEQ ID NO: 816197 - DNA, 17 bp, Homo sapiens
cagacccacctggagcc

SEQ ID NO: 816198 - DNA, 21 bp, Homo sapiens
cagacccacctggagcccgct

SEQ ID NO: 816199 - DNA, 12 bp, Homo sapiens
cagacccactct

SEQ ID NO: 816200 - DNA, 16 bp, Homo sapiens
cagacccagagaagga

SEQ ID NO: 816201 - DNA, 13 bp, Homo sapiens
cagacccagtccc

SEQ ID NO: 816202 - DNA, 13 bp, Homo sapiens
cagacccagtgag

SEQ ID NO: 816203 - DNA, 18 bp, Homo sapiens
cagaccccacaacttcag

SEQ ID NO: 816204 - DNA, 15 bp, Homo sapiens
cagaccccagcggct

SEQ ID NO: 816205 - DNA, 14 bp, Homo sapiens
cagaccccagggca

SEQ ID NO: 816206 - DNA, 19 bp, Homo sapiens
cagacccccaccccttccc

SEQ ID NO: 816207 - DNA, 23 bp, Homo sapiens
cagacccccaccccttccccact

SEQ ID NO: 816208 - DNA, 17 bp, Homo sapiens
cagacccccagcaaccc

SEQ ID NO: 816209 - DNA, 12 bp, Homo sapiens
cagaccccgccc

SEQ ID NO: 816210 - DNA, 18 bp, Homo sapiens
cagaccccgtggctctgg

SEQ ID NO: 816211 - DNA, 21 bp, Homo sapiens
cagaccccgtggctctgggag

SEQ ID NO: 816212 - DNA, 21 bp, Homo sapiens
cagacccctcccctcgtgtca

SEQ ID NO: 816213 - DNA, 18 bp, Homo sapiens
cagacccctctggccagg

SEQ ID NO: 816214 - DNA, 21 bp, Homo sapiens
cagacccctctggccaggatg

SEQ ID NO: 816215 - DNA, 14 bp, Homo sapiens
cagacccctgcctg

SEQ ID NO: 816216 - DNA, 18 bp, Homo sapiens
cagacccctggcttttca

SEQ ID NO: 816217 - DNA, 21 bp, Homo sapiens
cagacccctggcttttcactg

SEQ ID NO: 816218 - DNA, 15 bp, Homo sapiens
cagaccctaccccac

SEQ ID NO: 816219 - DNA, 18 bp, Homo sapiens
cagaccctaccccaccac

SEQ ID NO: 816220 - DNA, 14 bp, Homo sapiens
cagaccctctgccg

SEQ ID NO: 816221 - DNA, 14 bp, Homo sapiens
cagaccctgaaccc

SEQ ID NO: 816222 - DNA, 13 bp, Homo sapiens
cagaccctggagg

SEQ ID NO: 816223 - DNA, 14 bp, Homo sapiens
cagaccctggaggc

SEQ ID NO: 816224 - DNA, 14 bp, Homo sapiens
cagacctaagccct

SEQ ID NO: 816225 - DNA, 22 bp, Homo sapiens
cagacctaggatttcatgattt

SEQ ID NO: 816226 - DNA, 17 bp, Homo sapiens
cagacctcatgcccagc

SEQ ID NO: 816227 - DNA, 21 bp, Homo sapiens
cagacctgacaccgtccctca

SEQ ID NO: 816228 - DNA, 13 bp, Homo sapiens
cagacctgcagtg

SEQ ID NO: 816229 - DNA, 14 bp, Homo sapiens
cagacctgcagtga

SEQ ID NO: 816230 - DNA, 16 bp, Homo sapiens
cagacctgcagtgagg

SEQ ID NO: 816231 - DNA, 18 bp, Homo sapiens
cagacctgcgaaggatga

SEQ ID NO: 816232 - DNA, 13 bp, Homo sapiens
cagacctggagcc

SEQ ID NO: 816233 - DNA, 13 bp, Homo sapiens
cagacctgtcttc

SEQ ID NO: 816234 - DNA, 19 bp, Homo sapiens
cagacctgttagcagacag

SEQ ID NO: 816235 - DNA, 20 bp, Homo sapiens
cagaccttactcaggggatg

SEQ ID NO: 816236 - DNA, 14 bp, Homo sapiens
cagagcccagctct

SEQ ID NO: 816237 - DNA, 16 bp, Homo sapiens
cagagcccagctcttg

SEQ ID NO: 816238 - DNA, 21 bp, Homo sapiens
cagagcccagctcttgctctc

SEQ ID NO: 816239 - DNA, 14 bp, Homo sapiens
cagagcccagggga

SEQ ID NO: 816240 - DNA, 16 bp, Homo sapiens
cagagcccaggggaga

SEQ ID NO: 816241 - DNA, 14 bp, Homo sapiens
cagagccccaagca

SEQ ID NO: 816242 - DNA, 23 bp, Homo sapiens
cagagccccacacggaggcatct

SEQ ID NO: 816243 - DNA, 17 bp, Homo sapiens
cagagcccccagccctg

SEQ ID NO: 816244 - DNA, 16 bp, Homo sapiens
cagagcccctcctcca

SEQ ID NO: 816245 - DNA, 21 bp, Homo sapiens
cagagcccctcctccagcccc

SEQ ID NO: 816246 - DNA, 21 bp, Homo sapiens
cagagcccctttaaccctgat

SEQ ID NO: 816247 - DNA, 23 bp, Homo sapiens
cagagcccggccccacctccctg

SEQ ID NO: 816248 - DNA, 18 bp, Homo sapiens
cagagccctgaggggctg

SEQ ID NO: 816249 - DNA, 22 bp, Homo sapiens
cagagccctgaggggctgggct

SEQ ID NO: 816250 - DNA, 23 bp, Homo sapiens
cagagccctgaggggctgggctg

SEQ ID NO: 816251 - DNA, 15 bp, Homo sapiens
cagagccctgccctg

SEQ ID NO: 816252 - DNA, 16 bp, Homo sapiens
cagagccctgccctgc

SEQ ID NO: 816253 - DNA, 22 bp, Homo sapiens
cagagccctgccctgcaccctt

SEQ ID NO: 816254 - DNA, 15 bp, Homo sapiens
cagagcccttcactg

SEQ ID NO: 816255 - DNA, 16 bp, Homo sapiens
cagagcccttcactgc

SEQ ID NO: 816256 - DNA, 17 bp, Homo sapiens
cagagcccttcactgcc

SEQ ID NO: 816257 - DNA, 20 bp, Homo sapiens
cagagcccttcactgccatg

SEQ ID NO: 816258 - DNA, 15 bp, Homo sapiens
cagagccggcatcct

SEQ ID NO: 816259 - DNA, 22 bp, Homo sapiens
cagagccggcatccttgcctgt

SEQ ID NO: 816260 - DNA, 20 bp, Homo sapiens
cagagccggccgccttctcc

SEQ ID NO: 816261 - DNA, 19 bp, Homo sapiens
cagagccgtggtcctttgg

SEQ ID NO: 816262 - DNA, 21 bp, Homo sapiens
cagagcctacagaagggcagt

SEQ ID NO: 816263 - DNA, 18 bp, Homo sapiens
cagagcctaccttcacca

SEQ ID NO: 816264 - DNA, 21 bp, Homo sapiens
cagagcctaccttcaccacct

SEQ ID NO: 816265 - DNA, 13 bp, Homo sapiens
cagagcctcctgg

SEQ ID NO: 816266 - DNA, 15 bp, Homo sapiens
cagagcctctcccac

SEQ ID NO: 816267 - DNA, 12 bp, Homo sapiens
cagagcctctgg

SEQ ID NO: 816268 - DNA, 16 bp, Homo sapiens
cagagcctctggcccc

SEQ ID NO: 816269 - DNA, 16 bp, Homo sapiens
cagagcctgacctgag

SEQ ID NO: 816270 - DNA, 18 bp, Homo sapiens
cagagcctgacctgagag

SEQ ID NO: 816271 - DNA, 16 bp, Homo sapiens
cagagcctggccccag

SEQ ID NO: 816272 - DNA, 19 bp, Homo sapiens
cagagcctggccccaggcc

SEQ ID NO: 816273 - DNA, 20 bp, Homo sapiens
cagagcctggggtgttctct

SEQ ID NO: 816274 - DNA, 23 bp, Homo sapiens
cagagcctgtccccgccttccct

SEQ ID NO: 816275 - DNA, 16 bp, Homo sapiens
cagagccttctcagaa

SEQ ID NO: 816276 - DNA, 19 bp, Homo sapiens
cagagccttctcagaagca

SEQ ID NO: 816277 - DNA, 13 bp, Homo sapiens
cagagccttgaga

SEQ ID NO: 816278 - DNA, 13 bp, Homo sapiens
cagagcgcacagg

SEQ ID NO: 816279 - DNA, 13 bp, Homo sapiens
cagagcgccagga

SEQ ID NO: 816280 - DNA, 15 bp, Homo sapiens
cagagcgccaggaag

SEQ ID NO: 816281 - DNA, 16 bp, Homo sapiens
cagagcgccaggaagc

SEQ ID NO: 816282 - DNA, 19 bp, Homo sapiens
cagagcgccaggaagccag

SEQ ID NO: 816283 - DNA, 15 bp, Homo sapiens
cagagcggaactatg

SEQ ID NO: 816284 - DNA, 21 bp, Homo sapiens
cagagcggatgggcacacaca

SEQ ID NO: 816285 - DNA, 16 bp, Homo sapiens
cagagcgggagggagt

SEQ ID NO: 816286 - DNA, 21 bp, Homo sapiens
cagagctaaactccttcctgg

SEQ ID NO: 816287 - DNA, 21 bp, Homo sapiens
cagagctaagggtgggtgctc

SEQ ID NO: 816288 - DNA, 23 bp, Homo sapiens
cagagctagggctgctgcttctg

SEQ ID NO: 816289 - DNA, 22 bp, Homo sapiens
cagagctcatcccccctgctgc

SEQ ID NO: 816290 - DNA, 18 bp, Homo sapiens
cagagctctcccctcctg

SEQ ID NO: 816291 - DNA, 22 bp, Homo sapiens
cagagctctcccctcctgctgg

SEQ ID NO: 816292 - DNA, 15 bp, Homo sapiens
cagagctctcgagga

SEQ ID NO: 816293 - DNA, 20 bp, Homo sapiens
cagagctcttcaagctgtcc

SEQ ID NO: 816294 - DNA, 12 bp, Homo sapiens
cagagctgaccc

SEQ ID NO: 816295 - DNA, 13 bp, Homo sapiens
cagagctgaccca

SEQ ID NO: 816296 - DNA, 12 bp, Homo sapiens
cagagctgagga

SEQ ID NO: 816297 - DNA, 14 bp, Homo sapiens
cagagctgaggatt

SEQ ID NO: 816298 - DNA, 15 bp, Homo sapiens
cagagctgaggcttt

SEQ ID NO: 816299 - DNA, 13 bp, Homo sapiens
cagagctgagggc

SEQ ID NO: 816300 - DNA, 17 bp, Homo sapiens
cagagctgagggccctg

SEQ ID NO: 816301 - DNA, 19 bp, Homo sapiens
cagagctgagggccctgtg

SEQ ID NO: 816302 - DNA, 19 bp, Homo sapiens
cagagctggaaggcagggc

SEQ ID NO: 816303 - DNA, 17 bp, Homo sapiens
cagagctggagatgagg

SEQ ID NO: 816304 - DNA, 21 bp, Homo sapiens
cagagctggagatgaggccag

SEQ ID NO: 816305 - DNA, 12 bp, Homo sapiens
cagagctggcct

SEQ ID NO: 816306 - DNA, 13 bp, Homo sapiens
cagagctggcctc

SEQ ID NO: 816307 - DNA, 18 bp, Homo sapiens
cagagctggcctccccca

SEQ ID NO: 816308 - DNA, 13 bp, Homo sapiens
cagagctggctct

SEQ ID NO: 816309 - DNA, 19 bp, Homo sapiens
cagagctggggctgccagc

SEQ ID NO: 816310 - DNA, 17 bp, Homo sapiens
cagagctgggtggggac

SEQ ID NO: 816311 - DNA, 15 bp, Homo sapiens
cagagctgtgccagc

SEQ ID NO: 816312 - DNA, 18 bp, Homo sapiens
cagagctgtgccagcagg

SEQ ID NO: 816313 - DNA, 18 bp, Homo sapiens
cagagctgtgcctgctca

SEQ ID NO: 816314 - DNA, 19 bp, Homo sapiens
cagagctgtgcctgctcag

SEQ ID NO: 816315 - DNA, 19 bp, Homo sapiens
cagagctgtttatggcctc

SEQ ID NO: 816316 - DNA, 18 bp, Homo sapiens
cagagctgtttggataca

SEQ ID NO: 816317 - DNA, 14 bp, Homo sapiens
cagagcttccctga

SEQ ID NO: 816318 - DNA, 18 bp, Homo sapiens
cagagcttccctgactca

SEQ ID NO: 816319 - DNA, 23 bp, Homo sapiens
cagagcttgtgctcctcttgatt

SEQ ID NO: 816320 - DNA, 18 bp, Homo sapiens
cagagcttgttgtctcca

SEQ ID NO: 816321 - DNA, 22 bp, Homo sapiens
cagagctttaaaagtatcttta

SEQ ID NO: 816322 - DNA, 14 bp, Homo sapiens
cagagctttgtcac

SEQ ID NO: 816323 - DNA, 17 bp, Homo sapiens
cagagcttttgcatttc

SEQ ID NO: 816324 - DNA, 21 bp, Homo sapiens
cagaggaaagggctggctccc

SEQ ID NO: 816325 - DNA, 21 bp, Homo sapiens
cagaggaacaagcatgtctct

SEQ ID NO: 816326 - DNA, 16 bp, Homo sapiens
cagaggaagagcaggc

SEQ ID NO: 816327 - DNA, 18 bp, Homo sapiens
cagaggaatcctggcagc

SEQ ID NO: 816328 - DNA, 20 bp, Homo sapiens
cagaggaatcctggcagccc

SEQ ID NO: 816329 - DNA, 21 bp, Homo sapiens
cagaggaatcctggcagccca

SEQ ID NO: 816330 - DNA, 21 bp, Homo sapiens
cagaggaatgatgggcttttg

SEQ ID NO: 816331 - DNA, 19 bp, Homo sapiens
cagaggaatgtagggcctg

SEQ ID NO: 816332 - DNA, 19 bp, Homo sapiens
cagaggaatttggctgctt

SEQ ID NO: 816333 - DNA, 15 bp, Homo sapiens
cagaggacacagaga

SEQ ID NO: 816334 - DNA, 15 bp, Homo sapiens
cagaggacagctctg

SEQ ID NO: 816335 - DNA, 17 bp, Homo sapiens
cagaggacagctctggg

SEQ ID NO: 816336 - DNA, 12 bp, Homo sapiens
cagaggaccaca

SEQ ID NO: 816337 - DNA, 21 bp, Homo sapiens
cagaggaccacagtgggtggc

SEQ ID NO: 816338 - DNA, 16 bp, Homo sapiens
cagaggaccccagggt

SEQ ID NO: 816339 - DNA, 23 bp, Homo sapiens
cagaggacgcacgctcgctgcca

SEQ ID NO: 816340 - DNA, 22 bp, Homo sapiens
cagaggactcccaaccctggct

SEQ ID NO: 816341 - DNA, 22 bp, Homo sapiens
cagaggactctgcttaaacaaa

SEQ ID NO: 816342 - DNA, 19 bp, Homo sapiens
cagaggagccaccagttct

SEQ ID NO: 816343 - DNA, 20 bp, Homo sapiens
cagaggagccaccagttctc

SEQ ID NO: 816344 - DNA, 17 bp, Homo sapiens
cagaggagcccagtggg

SEQ ID NO: 816345 - DNA, 19 bp, Homo sapiens
cagaggaggcctcaaagca

SEQ ID NO: 816346 - DNA, 15 bp, Homo sapiens
cagaggagggcagag

SEQ ID NO: 816347 - DNA, 13 bp, Homo sapiens
cagaggaggggcc

SEQ ID NO: 816348 - DNA, 13 bp, Homo sapiens
cagaggaggtcag

SEQ ID NO: 816349 - DNA, 15 bp, Homo sapiens
cagaggaggtcagca

SEQ ID NO: 816350 - DNA, 20 bp, Homo sapiens
cagaggagtgcagccttctc

SEQ ID NO: 816351 - DNA, 22 bp, Homo sapiens
cagaggagtgcagccttctcca

SEQ ID NO: 816352 - DNA, 17 bp, Homo sapiens
cagaggatgccttttct

SEQ ID NO: 816353 - DNA, 20 bp, Homo sapiens
cagaggatgccttttctgtg

SEQ ID NO: 816354 - DNA, 22 bp, Homo sapiens
cagaggatgccttttctgtgat

SEQ ID NO: 816355 - DNA, 14 bp, Homo sapiens
cagaggcaataggt

SEQ ID NO: 816356 - DNA, 13 bp, Homo sapiens
cagaggcaggctg

SEQ ID NO: 816357 - DNA, 12 bp, Homo sapiens
cagatgcttctg

SEQ ID NO: 816358 - DNA, 13 bp, Homo sapiens
cagatgcttctgg

SEQ ID NO: 816359 - DNA, 22 bp, Homo sapiens
cagatgcttgcggcaaaaggaa

SEQ ID NO: 816360 - DNA, 16 bp, Homo sapiens
cagatggacgcaggcc

SEQ ID NO: 816361 - DNA, 18 bp, Homo sapiens
cagatggacgcaggccct

SEQ ID NO: 816362 - DNA, 19 bp, Homo sapiens
cagatggactccagcctgc

SEQ ID NO: 816363 - DNA, 12 bp, Homo sapiens
cagatggagacc

SEQ ID NO: 816364 - DNA, 19 bp, Homo sapiens
cagatggaggttctcagag

SEQ ID NO: 816365 - DNA, 15 bp, Homo sapiens
cagatggatttgcct

SEQ ID NO: 816366 - DNA, 13 bp, Homo sapiens
cagatggcccaag

SEQ ID NO: 816367 - DNA, 18 bp, Homo sapiens
cagatggcttcggagggc

SEQ ID NO: 816368 - DNA, 21 bp, Homo sapiens
cagatggggctcccgcccgtg

SEQ ID NO: 816369 - DNA, 16 bp, Homo sapiens
cagatggggtctgtga

SEQ ID NO: 816370 - DNA, 20 bp, Homo sapiens
cagatggggtctgtgactgg

SEQ ID NO: 816371 - DNA, 16 bp, Homo sapiens
cagatgggtattaaac

SEQ ID NO: 816372 - DNA, 17 bp, Homo sapiens
cagatgggtattaaact

SEQ ID NO: 816373 - DNA, 22 bp, Homo sapiens
cagatggtactgctgaggtccc

SEQ ID NO: 816374 - DNA, 18 bp, Homo sapiens
cagatgtcccccactgct

SEQ ID NO: 816375 - DNA, 14 bp, Homo sapiens
cagatgtctctggg

SEQ ID NO: 816376 - DNA, 22 bp, Homo sapiens
cagatgtctctggggcagatcc

SEQ ID NO: 816377 - DNA, 18 bp, Homo sapiens
cagatgtcttccctgggc

SEQ ID NO: 816378 - DNA, 18 bp, Homo sapiens
cagatgtcttctgcctgt

SEQ ID NO: 816379 - DNA, 19 bp, Homo sapiens
cagatgtgcaataatttgt

SEQ ID NO: 816380 - DNA, 20 bp, Homo sapiens
cagatgtgcaataatttgta

SEQ ID NO: 816381 - DNA, 20 bp, Homo sapiens
cagatgtgctataatctgtt

SEQ ID NO: 816382 - DNA, 15 bp, Homo sapiens
cagatgtggggctga

SEQ ID NO: 816383 - DNA, 21 bp, Homo sapiens
cagatgtggggctgagctggg

SEQ ID NO: 816384 - DNA, 18 bp, Homo sapiens
cagatgtgtcccccccag

SEQ ID NO: 816385 - DNA, 15 bp, Homo sapiens
cagatgttaaaataa

SEQ ID NO: 816386 - DNA, 16 bp, Homo sapiens
cagatgttaaaataaa

SEQ ID NO: 816387 - DNA, 17 bp, Homo sapiens
cagatgttaatttactt

SEQ ID NO: 816388 - DNA, 23 bp, Homo sapiens
cagatgttgaatgcccacaggca

SEQ ID NO: 816389 - DNA, 18 bp, Homo sapiens
cagatgtttccagacttc

SEQ ID NO: 816390 - DNA, 21 bp, Homo sapiens
cagatgttttacgcaaggaag

SEQ ID NO: 816391 - DNA, 23 bp, Homo sapiens
cagatgttttacgcaaggaagga

SEQ ID NO: 816392 - DNA, 14 bp, Homo sapiens
cagatgttttgatg

SEQ ID NO: 816393 - DNA, 19 bp, Homo sapiens
cagattaggtttgtcccag

SEQ ID NO: 816394 - DNA, 13 bp, Homo sapiens
cagattcaatttt

SEQ ID NO: 816395 - DNA, 22 bp, Homo sapiens
cagattcactttgtttatgcat

SEQ ID NO: 816396 - DNA, 16 bp, Homo sapiens
cagattcaggccagcc

SEQ ID NO: 816397 - DNA, 18 bp, Homo sapiens
cagattcaggccagccca

SEQ ID NO: 816398 - DNA, 22 bp, Homo sapiens
cagattcaggccagcccagcca

SEQ ID NO: 816399 - DNA, 15 bp, Homo sapiens
cagattcataaagta

SEQ ID NO: 816400 - DNA, 23 bp, Homo sapiens
cagattcataaagtaatgatgaa

SEQ ID NO: 816401 - DNA, 14 bp, Homo sapiens
cagattccacagga

SEQ ID NO: 816402 - DNA, 15 bp, Homo sapiens
cagattccacaggac

SEQ ID NO: 816403 - DNA, 17 bp, Homo sapiens
cagattccacaggacac

SEQ ID NO: 816404 - DNA, 19 bp, Homo sapiens
cagattcccagaccttaag

SEQ ID NO: 816405 - DNA, 18 bp, Homo sapiens
cagattcctatgatggat

SEQ ID NO: 816406 - DNA, 14 bp, Homo sapiens
cagattcctgggcc

SEQ ID NO: 816407 - DNA, 19 bp, Homo sapiens
cagattcctgggcctgtcc

SEQ ID NO: 816408 - DNA, 16 bp, Homo sapiens
cagattctatattatt

SEQ ID NO: 816409 - DNA, 16 bp, Homo sapiens
cagattctgacattta

SEQ ID NO: 816410 - DNA, 15 bp, Homo sapiens
cagattctgatgcat

SEQ ID NO: 816411 - DNA, 14 bp, Homo sapiens
cagattgaaaagga

SEQ ID NO: 816412 - DNA, 13 bp, Homo sapiens
cagattgaagaat

SEQ ID NO: 816413 - DNA, 18 bp, Homo sapiens
cagattgactaaataaaa

SEQ ID NO: 816414 - DNA, 14 bp, Homo sapiens
cagattgctctgcc

SEQ ID NO: 816415 - DNA, 23 bp, Homo sapiens
cagattgctgaatcccatcaggc

SEQ ID NO: 816416 - DNA, 18 bp, Homo sapiens
cagattgtcttgcaactt

SEQ ID NO: 816417 - DNA, 18 bp, Homo sapiens
cagattgtggaatgttgg

SEQ ID NO: 816418 - DNA, 13 bp, Homo sapiens
cagattgtggggt

SEQ ID NO: 816419 - DNA, 15 bp, Homo sapiens
cagattgtggggtgc

SEQ ID NO: 816420 - DNA, 22 bp, Homo sapiens
cagattgttaagggcattttta

SEQ ID NO: 816421 - DNA, 23 bp, Homo sapiens
cagattgttaagggcatttttat

SEQ ID NO: 816422 - DNA, 14 bp, Homo sapiens
cagatttacactgg

SEQ ID NO: 816423 - DNA, 17 bp, Homo sapiens
cagatttacactgggag

SEQ ID NO: 816424 - DNA, 17 bp, Homo sapiens
cagatttagtgaaagct

SEQ ID NO: 816425 - DNA, 20 bp, Homo sapiens
cagatttagtgaaagctaga

SEQ ID NO: 816426 - DNA, 19 bp, Homo sapiens
cagatttatttttgaaaca

SEQ ID NO: 816427 - DNA, 16 bp, Homo sapiens
cagatttcatacctca

SEQ ID NO: 816428 - DNA, 14 bp, Homo sapiens
cagatttctgagga

SEQ ID NO: 816429 - DNA, 16 bp, Homo sapiens
cagatttctggttgat

SEQ ID NO: 816430 - DNA, 22 bp, Homo sapiens
cagatttctggttgatttgtaa

SEQ ID NO: 816431 - DNA, 19 bp, Homo sapiens
cagatttgaactcttcaat

SEQ ID NO: 816432 - DNA, 20 bp, Homo sapiens
cagatttgctaatttatcct

SEQ ID NO: 816433 - DNA, 13 bp, Homo sapiens
cagatttggaaag

SEQ ID NO: 816434 - DNA, 19 bp, Homo sapiens
cagattttaagggggaaaa

SEQ ID NO: 816435 - DNA, 22 bp, Homo sapiens
cagattttaagggggaaaactg

SEQ ID NO: 816436 - DNA, 19 bp, Homo sapiens
cagattttacaaaagatgt

SEQ ID NO: 816437 - DNA, 13 bp, Homo sapiens
cagattttatatt

SEQ ID NO: 816438 - DNA, 17 bp, Homo sapiens
cagattttatttatgcg

SEQ ID NO: 816439 - DNA, 20 bp, Homo sapiens
cagattttcttaaggaattt

SEQ ID NO: 816440 - DNA, 19 bp, Homo sapiens
cagattttgctgtatattt

SEQ ID NO: 816441 - DNA, 19 bp, Homo sapiens
cagatttttatgttttctt

SEQ ID NO: 816442 - DNA, 22 bp, Homo sapiens
cagatttttatgttttctttct

SEQ ID NO: 816443 - DNA, 22 bp, Homo sapiens
cagattttttacagctgcctgc

SEQ ID NO: 816444 - DNA, 20 bp, Homo sapiens
cagcaaaaagcaaaatcatt

SEQ ID NO: 816445 - DNA, 19 bp, Homo sapiens
cagcaaaaccattgcttca

SEQ ID NO: 816446 - DNA, 13 bp, Homo sapiens
cagcaaaagacca

SEQ ID NO: 816447 - DNA, 13 bp, Homo sapiens
cagcaaaatgttg

SEQ ID NO: 816448 - DNA, 15 bp, Homo sapiens
cagcaaaatgttgaa

SEQ ID NO: 816449 - DNA, 12 bp, Homo sapiens
cagcaaacagct

SEQ ID NO: 816450 - DNA, 12 bp, Homo sapiens
cagcaaaccatt

SEQ ID NO: 816451 - DNA, 23 bp, Homo sapiens
cagcaaactaaccagcattccct

SEQ ID NO: 816452 - DNA, 13 bp, Homo sapiens
cagcaaaggaact

SEQ ID NO: 816453 - DNA, 22 bp, Homo sapiens
cagcaaagggaccaggggagag

SEQ ID NO: 816454 - DNA, 22 bp, Homo sapiens
cagcaaatgcaaaaactctttg

SEQ ID NO: 816455 - DNA, 14 bp, Homo sapiens
cagcaaattttcag

SEQ ID NO: 816456 - DNA, 13 bp, Homo sapiens
cagcaacaagact

SEQ ID NO: 816457 - DNA, 18 bp, Homo sapiens
cagcaacaagactgccag

SEQ ID NO: 816458 - DNA, 14 bp, Homo sapiens
cagcaacaataaat

SEQ ID NO: 816459 - DNA, 20 bp, Homo sapiens
cagcaacaataaatagacac

SEQ ID NO: 816460 - DNA, 17 bp, Homo sapiens
cagcaacacaagctgga

SEQ ID NO: 816461 - DNA, 23 bp, Homo sapiens
cagcaacactccggtcagcccct

SEQ ID NO: 816462 - DNA, 13 bp, Homo sapiens
cagcaacagaaaa

SEQ ID NO: 816463 - DNA, 18 bp, Homo sapiens
cagcaacatctcgagccc

SEQ ID NO: 816464 - DNA, 17 bp, Homo sapiens
cagcaacgcttgtagaa

SEQ ID NO: 816465 - DNA, 12 bp, Homo sapiens
cagcaactgaat

SEQ ID NO: 816466 - DNA, 20 bp, Homo sapiens
cagcaactgaataaatacct

SEQ ID NO: 816467 - DNA, 17 bp, Homo sapiens
cagcaactgcccttcca

SEQ ID NO: 816468 - DNA, 18 bp, Homo sapiens
cagcaactgcccttccag

SEQ ID NO: 816469 - DNA, 20 bp, Homo sapiens
cagcaacttgtctttttctg

SEQ ID NO: 816470 - DNA, 19 bp, Homo sapiens
cagcaagaagcagcctgtt

SEQ ID NO: 816471 - DNA, 14 bp, Homo sapiens
cagcaagaataaaa

SEQ ID NO: 816472 - DNA, 23 bp, Homo sapiens
cagcaagacctcatctgtggagc

SEQ ID NO: 816473 - DNA, 18 bp, Homo sapiens
cagcaagagtaagcagtg

SEQ ID NO: 816474 - DNA, 12 bp, Homo sapiens
cagcaaggcagg

SEQ ID NO: 816475 - DNA, 20 bp, Homo sapiens
cagcaaggcaggttggatgg

SEQ ID NO: 816476 - DNA, 22 bp, Homo sapiens
cagcaaggcaggttggatggga

SEQ ID NO: 816477 - DNA, 20 bp, Homo sapiens
cagcaaggcgcctgccttgg

SEQ ID NO: 816478 - DNA, 16 bp, Homo sapiens
cagcaaggctgctgcc

SEQ ID NO: 816479 - DNA, 13 bp, Homo sapiens
cagcatgcccaga

SEQ ID NO: 816480 - DNA, 15 bp, Homo sapiens
cagcatgcccagatt

SEQ ID NO: 816481 - DNA, 17 bp, Homo sapiens
cagcatgccccttggct

SEQ ID NO: 816482 - DNA, 13 bp, Homo sapiens
cagcatggaggag

SEQ ID NO: 816483 - DNA, 15 bp, Homo sapiens
cagcatggcatagcc

SEQ ID NO: 816484 - DNA, 23 bp, Homo sapiens
cagcatggggtttttattatttt

SEQ ID NO: 816485 - DNA, 18 bp, Homo sapiens
cagcatgggtccttgatg

SEQ ID NO: 816486 - DNA, 21 bp, Homo sapiens
cagcatgggtccttgatgcca

SEQ ID NO: 816487 - DNA, 23 bp, Homo sapiens
cagcatggtccctgccttaggcc

SEQ ID NO: 816488 - DNA, 13 bp, Homo sapiens
cagcatgtgccaa

SEQ ID NO: 816489 - DNA, 14 bp, Homo sapiens
cagcatgtgccctc

SEQ ID NO: 816490 - DNA, 20 bp, Homo sapiens
cagcatgtgttaatcttaat

SEQ ID NO: 816491 - DNA, 19 bp, Homo sapiens
cagcattaaaattttacct

SEQ ID NO: 816492 - DNA, 12 bp, Homo sapiens
cagcattccagc

SEQ ID NO: 816493 - DNA, 14 bp, Homo sapiens
cagcattcccacca

SEQ ID NO: 816494 - DNA, 14 bp, Homo sapiens
cagcattctggagg

SEQ ID NO: 816495 - DNA, 20 bp, Homo sapiens
cagcattcttgtcacaataa

SEQ ID NO: 816496 - DNA, 22 bp, Homo sapiens
cagcattcttgtcacaataaat

SEQ ID NO: 816497 - DNA, 14 bp, Homo sapiens
cagcattgaagaga

SEQ ID NO: 816498 - DNA, 14 bp, Homo sapiens
cagcattgctggtt

SEQ ID NO: 816499 - DNA, 16 bp, Homo sapiens
cagcattgctggttct

SEQ ID NO: 816500 - DNA, 13 bp, Homo sapiens
cagcattgctttc

SEQ ID NO: 816501 - DNA, 10 bp, Homo sapiens
cagcattgtc

SEQ ID NO: 816502 - DNA, 15 bp, Homo sapiens
cagcattgtctttgc

SEQ ID NO: 816503 - DNA, 16 bp, Homo sapiens
cagcattgtctttgct

SEQ ID NO: 816504 - DNA, 18 bp, Homo sapiens
cagcattgtctttgctgt

SEQ ID NO: 816505 - DNA, 14 bp, Homo sapiens
cagcattgtgactt

SEQ ID NO: 816506 - DNA, 16 bp, Homo sapiens
cagcatttcttttctg

SEQ ID NO: 816507 - DNA, 20 bp, Homo sapiens
cagcatttgattaacatttg

SEQ ID NO: 816508 - DNA, 12 bp, Homo sapiens
cagcatttgtcc

SEQ ID NO: 816509 - DNA, 23 bp, Homo sapiens
cagcatttgtccttttgtgaaat

SEQ ID NO: 816510 - DNA, 13 bp, Homo sapiens
cagcattttagaa

SEQ ID NO: 816511 - DNA, 21 bp, Homo sapiens
cagcattttagaaactacaaa

SEQ ID NO: 816512 - DNA, 16 bp, Homo sapiens
cagccaaaaaggacca

SEQ ID NO: 816513 - DNA, 17 bp, Homo sapiens
cagccaaacccatgagg

SEQ ID NO: 816514 - DNA, 15 bp, Homo sapiens
cagccaaaccctgtc

SEQ ID NO: 816515 - DNA, 17 bp, Homo sapiens
cagccaaaccctgtctg

SEQ ID NO: 816516 - DNA, 19 bp, Homo sapiens
cagccaaagaaatgggcct

SEQ ID NO: 816517 - DNA, 18 bp, Homo sapiens
cagccaaagcctcctcca

SEQ ID NO: 816518 - DNA, 21 bp, Homo sapiens
cagccaaagcctcctccagcc

SEQ ID NO: 816519 - DNA, 17 bp, Homo sapiens
cagccaaaggggagcca

SEQ ID NO: 816520 - DNA, 20 bp, Homo sapiens
cagccaaaggggagccagaa

SEQ ID NO: 816521 - DNA, 18 bp, Homo sapiens
cagccaaatgcagggagg

SEQ ID NO: 816522 - DNA, 14 bp, Homo sapiens
cagccaaatttaaa

SEQ ID NO: 816523 - DNA, 20 bp, Homo sapiens
cagccaacacgcacctgcct

SEQ ID NO: 816524 - DNA, 19 bp, Homo sapiens
cagccaacaggtggcagga

SEQ ID NO: 816525 - DNA, 22 bp, Homo sapiens
cagccaacgagacacattgcct

SEQ ID NO: 816526 - DNA, 23 bp, Homo sapiens
cagccaacgagacacattgcctt

SEQ ID NO: 816527 - DNA, 20 bp, Homo sapiens
cagccaactagcccctgggg

SEQ ID NO: 816528 - DNA, 22 bp, Homo sapiens
cagccaactagcccctggggtg

SEQ ID NO: 816529 - DNA, 17 bp, Homo sapiens
cagccaagaagcctgca

SEQ ID NO: 816530 - DNA, 20 bp, Homo sapiens
cagccaagattttcctcttg

SEQ ID NO: 816531 - DNA, 22 bp, Homo sapiens
cagccaagattttcctcttgtg

SEQ ID NO: 816532 - DNA, 13 bp, Homo sapiens
cagccaaggaatg

SEQ ID NO: 816533 - DNA, 14 bp, Homo sapiens
cagccaaggggctg

SEQ ID NO: 816534 - DNA, 15 bp, Homo sapiens
cagccaaggggctgc

SEQ ID NO: 816535 - DNA, 16 bp, Homo sapiens
cagccaatttgtctcc

SEQ ID NO: 816536 - DNA, 18 bp, Homo sapiens
cagccaatttgtctccta

SEQ ID NO: 816537 - DNA, 21 bp, Homo sapiens
cagccacacctggactgaccc

SEQ ID NO: 816538 - DNA, 16 bp, Homo sapiens
cagccacacgcaggcg

SEQ ID NO: 816539 - DNA, 17 bp, Homo sapiens
cagccacacgcaggcgg

SEQ ID NO: 816540 - DNA, 18 bp, Homo sapiens
cagccacacgcaggcggc

SEQ ID NO: 816541 - DNA, 21 bp, Homo sapiens
cagccacactgggcctggagc

SEQ ID NO: 816542 - DNA, 18 bp, Homo sapiens
cagccacaggactgagcc

SEQ ID NO: 816543 - DNA, 22 bp, Homo sapiens
cagccacaggactgagccctct

SEQ ID NO: 816544 - DNA, 18 bp, Homo sapiens
cagccaccaccctcaggt

SEQ ID NO: 816545 - DNA, 22 bp, Homo sapiens
cagccaccaccctcaggtgcct

SEQ ID NO: 816546 - DNA, 15 bp, Homo sapiens
cagccaccagtggac

SEQ ID NO: 816547 - DNA, 23 bp, Homo sapiens
cagccaccagtggacctagcctg

SEQ ID NO: 816548 - DNA, 24 bp, Homo sapiens
cagccaccagtggacctagcctgg

SEQ ID NO: 816549 - DNA, 14 bp, Homo sapiens
cagccacccaagcc

SEQ ID NO: 816550 - DNA, 22 bp, Homo sapiens
cagccacccaagcctgctggct

SEQ ID NO: 816551 - DNA, 15 bp, Homo sapiens
cagccacccccaggc

SEQ ID NO: 816552 - DNA, 17 bp, Homo sapiens
cagccacccccaggcat

SEQ ID NO: 816553 - DNA, 12 bp, Homo sapiens
cagccacccctg

SEQ ID NO: 816554 - DNA, 13 bp, Homo sapiens
cagccacccctgc

SEQ ID NO: 816555 - DNA, 21 bp, Homo sapiens
cagccaccgaagccgcctgtg

SEQ ID NO: 816556 - DNA, 22 bp, Homo sapiens
cagccaccgtttcttcctgcca

SEQ ID NO: 816557 - DNA, 17 bp, Homo sapiens
cagccacctaaaaacat

SEQ ID NO: 816558 - DNA, 12 bp, Homo sapiens
cagccacctccg

SEQ ID NO: 816559 - DNA, 22 bp, Homo sapiens
cagccacctgggaacacagttc

SEQ ID NO: 816560 - DNA, 17 bp, Homo sapiens
cagccacgaacagcccg

SEQ ID NO: 816561 - DNA, 15 bp, Homo sapiens
cagccacgactgcca

SEQ ID NO: 816562 - DNA, 15 bp, Homo sapiens
cagccacgattggag

SEQ ID NO: 816563 - DNA, 17 bp, Homo sapiens
cagccacgattggagaa

SEQ ID NO: 816564 - DNA, 14 bp, Homo sapiens
cagccacggaggga

SEQ ID NO: 816565 - DNA, 23 bp, Homo sapiens
cagccacggagggaggcaccatg

SEQ ID NO: 816566 - DNA, 15 bp, Homo sapiens
cagccactaagaacc

SEQ ID NO: 816567 - DNA, 16 bp, Homo sapiens
cagccactccaagccc

SEQ ID NO: 816568 - DNA, 20 bp, Homo sapiens
cagccactccaagccccctg

SEQ ID NO: 816569 - DNA, 14 bp, Homo sapiens
cagccactcgggag

SEQ ID NO: 816570 - DNA, 15 bp, Homo sapiens
cagccactgccaagc

SEQ ID NO: 816571 - DNA, 23 bp, Homo sapiens
cagccagaaagcactacaatcat

SEQ ID NO: 816572 - DNA, 20 bp, Homo sapiens
cagccagaacgtggctctgc

SEQ ID NO: 816573 - DNA, 23 bp, Homo sapiens
cagccagaacgtggctctgctgg

SEQ ID NO: 816574 - DNA, 16 bp, Homo sapiens
cagccagacccagagc

SEQ ID NO: 816575 - DNA, 18 bp, Homo sapiens
cagccagaccccacgctg

SEQ ID NO: 816576 - DNA, 14 bp, Homo sapiens
cagccagagctggg

SEQ ID NO: 816577 - DNA, 22 bp, Homo sapiens
cagccagaggagggcagaggga

SEQ ID NO: 816578 - DNA, 22 bp, Homo sapiens
cagccagatggactccagcctg

SEQ ID NO: 816579 - DNA, 20 bp, Homo sapiens
cagccagcaatgatgtccag

SEQ ID NO: 816580 - DNA, 22 bp, Homo sapiens
cagccagcaatgatgtccagaa

SEQ ID NO: 816581 - DNA, 23 bp, Homo sapiens
cagccagcaatgatgtccagaag

SEQ ID NO: 816582 - DNA, 12 bp, Homo sapiens
cagccagcacca

SEQ ID NO: 816583 - DNA, 12 bp, Homo sapiens
cagccagcagag

SEQ ID NO: 816584 - DNA, 15 bp, Homo sapiens
cagccagcagagggg

SEQ ID NO: 816585 - DNA, 14 bp, Homo sapiens
cagccagccacccc

SEQ ID NO: 816586 - DNA, 14 bp, Homo sapiens
cagccagccagtct

SEQ ID NO: 816587 - DNA, 12 bp, Homo sapiens
cagccagcccag

SEQ ID NO: 816588 - DNA, 20 bp, Homo sapiens
cagccagcccagcccagctg

SEQ ID NO: 816589 - DNA, 13 bp, Homo sapiens
cagccagccctgg

SEQ ID NO: 816590 - DNA, 14 bp, Homo sapiens
cagccagccctggc

SEQ ID NO: 816591 - DNA, 15 bp, Homo sapiens
cagccagccctggcc

SEQ ID NO: 816592 - DNA, 18 bp, Homo sapiens
cagccagccctggcccac

SEQ ID NO: 816593 - DNA, 20 bp, Homo sapiens
cagccagccctggcccaccc

SEQ ID NO: 816594 - DNA, 16 bp, Homo sapiens
cagccagccgccctgg

SEQ ID NO: 816595 - DNA, 18 bp, Homo sapiens
cagccagccggtgcctgg

SEQ ID NO: 816596 - DNA, 22 bp, Homo sapiens
cagccagcctcagaaggcccca

SEQ ID NO: 816597 - DNA, 14 bp, Homo sapiens
cagccagccttccc

SEQ ID NO: 816598 - DNA, 17 bp, Homo sapiens
cagccagcgcctccctc

SEQ ID NO: 816599 - DNA, 22 bp, Homo sapiens
cagccagcgcctccctccaccc

SEQ ID NO: 816600 - DNA, 12 bp, Homo sapiens
cagccagctctc

SEQ ID NO: 816601 - DNA, 15 bp, Homo sapiens
cagccagctctcagc

SEQ ID NO: 816602 - DNA, 17 bp, Homo sapiens
cagccagctctcagcca

SEQ ID NO: 816603 - DNA, 14 bp, Homo sapiens
cagccagctgcagg

SEQ ID NO: 816604 - DNA, 13 bp, Homo sapiens
cagccagcttaaa

SEQ ID NO: 816605 - DNA, 22 bp, Homo sapiens
cagccaggacagtcagctctct

SEQ ID NO: 816606 - DNA, 12 bp, Homo sapiens
cagccaggaccc

SEQ ID NO: 816607 - DNA, 17 bp, Homo sapiens
cagccaggacccgcctg

SEQ ID NO: 816608 - DNA, 17 bp, Homo sapiens
cagccaggagaaggtca

SEQ ID NO: 816609 - DNA, 22 bp, Homo sapiens
cagccaggagaaggtcagcgag

SEQ ID NO: 816610 - DNA, 13 bp, Homo sapiens
cagccaggagcag

SEQ ID NO: 816611 - DNA, 14 bp, Homo sapiens
cagccaggagcaga

SEQ ID NO: 816612 - DNA, 12 bp, Homo sapiens
cagccaggcaga

SEQ ID NO: 816613 - DNA, 13 bp, Homo sapiens
cagccaggcccag

SEQ ID NO: 816614 - DNA, 15 bp, Homo sapiens
cagccaggcccaggc

SEQ ID NO: 816615 - DNA, 18 bp, Homo sapiens
cagccaggcccaggccag

SEQ ID NO: 816616 - DNA, 21 bp, Homo sapiens
cagccaggcccaggccagccc

SEQ ID NO: 816617 - DNA, 15 bp, Homo sapiens
cagccaggccccagg

SEQ ID NO: 816618 - DNA, 15 bp, Homo sapiens
cagccaggcgggctc

SEQ ID NO: 816619 - DNA, 16 bp, Homo sapiens
cagccaggcgggctca

SEQ ID NO: 816620 - DNA, 11 bp, Homo sapiens
cagccaggcta

SEQ ID NO: 816621 - DNA, 22 bp, Homo sapiens
cagccaggctatggttgccacc

SEQ ID NO: 816622 - DNA, 23 bp, Homo sapiens
cagccaggctatggttgccaccc

SEQ ID NO: 816623 - DNA, 13 bp, Homo sapiens
cagccaggctgcc

SEQ ID NO: 816624 - DNA, 16 bp, Homo sapiens
cagccaggctgccaag

SEQ ID NO: 816625 - DNA, 23 bp, Homo sapiens
cagccaggctgctaacctggaaa

SEQ ID NO: 816626 - DNA, 17 bp, Homo sapiens
cagccagggagcttgcc

SEQ ID NO: 816627 - DNA, 19 bp, Homo sapiens
cagccagggagcttgccac

SEQ ID NO: 816628 - DNA, 12 bp, Homo sapiens
cagccagggcca

SEQ ID NO: 816629 - DNA, 22 bp, Homo sapiens
cagccaggggtccagcacagcc

SEQ ID NO: 816630 - DNA, 12 bp, Homo sapiens
cagccagggtgt

SEQ ID NO: 816631 - DNA, 13 bp, Homo sapiens
cagccaggtgcat

SEQ ID NO: 816632 - DNA, 22 bp, Homo sapiens
cagccagtaaatgggggtgcat

SEQ ID NO: 816633 - DNA, 19 bp, Homo sapiens
cagccagtctcagagacca

SEQ ID NO: 816634 - DNA, 20 bp, Homo sapiens
cagccagtctcagagaccag

SEQ ID NO: 816635 - DNA, 22 bp, Homo sapiens
cagccagtctcagagaccagca

SEQ ID NO: 816636 - DNA, 23 bp, Homo sapiens
cagccagtctcagagaccagcac

SEQ ID NO: 816637 - DNA, 18 bp, Homo sapiens
cagccagtcttgcctagg

SEQ ID NO: 816638 - DNA, 19 bp, Homo sapiens
cagccagtcttgcctaggc

SEQ ID NO: 816639 - DNA, 20 bp, Homo sapiens
cagccagtcttgcctaggcc

SEQ ID NO: 816640 - DNA, 16 bp, Homo sapiens
cagccagtgacctttg

SEQ ID NO: 816641 - DNA, 15 bp, Homo sapiens
cagccataaaagcat

SEQ ID NO: 816642 - DNA, 20 bp, Homo sapiens
cagccataaaagcattgtct

SEQ ID NO: 816643 - DNA, 16 bp, Homo sapiens
cagccatcaaaatgct

SEQ ID NO: 816644 - DNA, 18 bp, Homo sapiens
cagccatcccgcttagcc

SEQ ID NO: 816645 - DNA, 15 bp, Homo sapiens
cagccatccgcagac

SEQ ID NO: 816646 - DNA, 15 bp, Homo sapiens
cagccatcctccctc

SEQ ID NO: 816647 - DNA, 17 bp, Homo sapiens
cagccatcctccctcca

SEQ ID NO: 816648 - DNA, 20 bp, Homo sapiens
cagccatcgtcctgggactc

SEQ ID NO: 816649 - DNA, 23 bp, Homo sapiens
cagccatctcatgaggggagagg

SEQ ID NO: 816650 - DNA, 21 bp, Homo sapiens
cagccatctgcccaggggtgc

SEQ ID NO: 816651 - DNA, 17 bp, Homo sapiens
cagccatgcctcatgcc

SEQ ID NO: 816652 - DNA, 18 bp, Homo sapiens
cagccatgcctcatgcca

SEQ ID NO: 816653 - DNA, 17 bp, Homo sapiens
cagccatgggaacctca

SEQ ID NO: 816654 - DNA, 21 bp, Homo sapiens
cagccatgggaacctcatatg

SEQ ID NO: 816655 - DNA, 15 bp, Homo sapiens
cagccatgtccaagt

SEQ ID NO: 816656 - DNA, 16 bp, Homo sapiens
cagccatgtccaagtt

SEQ ID NO: 816657 - DNA, 13 bp, Homo sapiens
cagccattaaaat

SEQ ID NO: 816658 - DNA, 14 bp, Homo sapiens
cagccattaaaata

SEQ ID NO: 816659 - DNA, 19 bp, Homo sapiens
cagccattaaaataaaaca

SEQ ID NO: 816660 - DNA, 14 bp, Homo sapiens
cagccattcttcag

SEQ ID NO: 816661 - DNA, 16 bp, Homo sapiens
cagccattcttcaggt

SEQ ID NO: 816662 - DNA, 22 bp, Homo sapiens
cagccattggctatttaaaact

SEQ ID NO: 816663 - DNA, 18 bp, Homo sapiens
cagccattgtaatttgaa

SEQ ID NO: 816664 - DNA, 18 bp, Homo sapiens
cagccatttccccctcct

SEQ ID NO: 816665 - DNA, 18 bp, Homo sapiens
cagcccaaaacccagggc

SEQ ID NO: 816666 - DNA, 17 bp, Homo sapiens
cagcccaacagaaggaa

SEQ ID NO: 816667 - DNA, 19 bp, Homo sapiens
cagcccaacccggcccaac

SEQ ID NO: 816668 - DNA, 21 bp, Homo sapiens
cagcccaagaggactgagact

SEQ ID NO: 816669 - DNA, 14 bp, Homo sapiens
cagcccacagagcc

SEQ ID NO: 816670 - DNA, 17 bp, Homo sapiens
cagcccacagagcctga

SEQ ID NO: 816671 - DNA, 24 bp, Homo sapiens
cagcccacattggattcatcagca

SEQ ID NO: 816672 - DNA, 14 bp, Homo sapiens
cagcccaccaggag

SEQ ID NO: 816673 - DNA, 16 bp, Homo sapiens
cagcccaccaggagca

SEQ ID NO: 816674 - DNA, 17 bp, Homo sapiens
cagcccacccccctcat

SEQ ID NO: 816675 - DNA, 13 bp, Homo sapiens
cagcccagaacca

SEQ ID NO: 816676 - DNA, 11 bp, Homo sapiens
cagcccagagc

SEQ ID NO: 816677 - DNA, 19 bp, Homo sapiens
cagcccagagccacctgga

SEQ ID NO: 816678 - DNA, 14 bp, Homo sapiens
cagcccagagcctg

SEQ ID NO: 816679 - DNA, 19 bp, Homo sapiens
cagcccagattcccctgtg

SEQ ID NO: 816680 - DNA, 22 bp, Homo sapiens
cagcccagattcccctgtgtca

SEQ ID NO: 816681 - DNA, 23 bp, Homo sapiens
cagcccagcacatagcttgccta

SEQ ID NO: 816682 - DNA, 12 bp, Homo sapiens
cagcccagccag

SEQ ID NO: 816683 - DNA, 13 bp, Homo sapiens
cagcccagcccag

SEQ ID NO: 816684 - DNA, 15 bp, Homo sapiens
cagcccagcccagct

SEQ ID NO: 816685 - DNA, 11 bp, Homo sapiens
cagcccagctt

SEQ ID NO: 816686 - DNA, 16 bp, Homo sapiens
cagcccagcttcctgg

SEQ ID NO: 816687 - DNA, 12 bp, Homo sapiens
cagcccaggctt

SEQ ID NO: 816688 - DNA, 19 bp, Homo sapiens
cagcccagggcctgcatgg

SEQ ID NO: 816689 - DNA, 19 bp, Homo sapiens
cagcccagggctcctgcac

SEQ ID NO: 816690 - DNA, 18 bp, Homo sapiens
cagcccagggttccccca

SEQ ID NO: 816691 - DNA, 16 bp, Homo sapiens
cagcccatcacctcta

SEQ ID NO: 816692 - DNA, 22 bp, Homo sapiens
cagcccatccattaggccagca

SEQ ID NO: 816693 - DNA, 15 bp, Homo sapiens
cagcccatgcccacc

SEQ ID NO: 816694 - DNA, 16 bp, Homo sapiens
cagcccatgcccacct

SEQ ID NO: 816695 - DNA, 17 bp, Homo sapiens
cagcccatgcccacctg

SEQ ID NO: 816696 - DNA, 21 bp, Homo sapiens
cagcccatgcccacctgccca

SEQ ID NO: 816697 - DNA, 15 bp, Homo sapiens
cagcccattggccga

SEQ ID NO: 816698 - DNA, 23 bp, Homo sapiens
cagccccaactccaggggcacct

SEQ ID NO: 816699 - DNA, 17 bp, Homo sapiens
cagccccaagctgggcc

SEQ ID NO: 816700 - DNA, 21 bp, Homo sapiens
cagccccaagctgggccgagg

SEQ ID NO: 816701 - DNA, 20 bp, Homo sapiens
cagccccaagcttctgagtc

SEQ ID NO: 816702 - DNA, 15 bp, Homo sapiens
cagccccaagggctg

SEQ ID NO: 816703 - DNA, 22 bp, Homo sapiens
cagccccaagggctggggcgga

SEQ ID NO: 816704 - DNA, 11 bp, Homo sapiens
cagccccaccc

SEQ ID NO: 816705 - DNA, 15 bp, Homo sapiens
cagccccacccagga

SEQ ID NO: 816706 - DNA, 15 bp, Homo sapiens
cagccccacccccag

SEQ ID NO: 816707 - DNA, 15 bp, Homo sapiens
cagccccaccctggc

SEQ ID NO: 816708 - DNA, 17 bp, Homo sapiens
cagccccaccctggcct

SEQ ID NO: 816709 - DNA, 18 bp, Homo sapiens
cagccccactcctctgct

SEQ ID NO: 816710 - DNA, 19 bp, Homo sapiens
cagccccactgccagcagc

SEQ ID NO: 816711 - DNA, 13 bp, Homo sapiens
cagccccacttca

SEQ ID NO: 816712 - DNA, 17 bp, Homo sapiens
cagccccacttctgggt

SEQ ID NO: 816713 - DNA, 18 bp, Homo sapiens
cagccccacttctgggtc

SEQ ID NO: 816714 - DNA, 23 bp, Homo sapiens
cagccccagacaacagcccaggc

SEQ ID NO: 816715 - DNA, 12 bp, Homo sapiens
cagccccagcaa

SEQ ID NO: 816716 - DNA, 14 bp, Homo sapiens
cagccccaggcctg

SEQ ID NO: 816717 - DNA, 15 bp, Homo sapiens
cagccccagggcctg

SEQ ID NO: 816718 - DNA, 21 bp, Homo sapiens
cagccccatcagaacctgagc

SEQ ID NO: 816719 - DNA, 23 bp, Homo sapiens
cagccccatcagaacctgagcta

SEQ ID NO: 816720 - DNA, 13 bp, Homo sapiens
cagcccccaccag

SEQ ID NO: 816721 - DNA, 14 bp, Homo sapiens
cagcccccaccagg

SEQ ID NO: 816722 - DNA, 18 bp, Homo sapiens
cagcccccacccccaagg

SEQ ID NO: 816723 - DNA, 21 bp, Homo sapiens
cagcctcggggatggggaggg

SEQ ID NO: 816724 - DNA, 22 bp, Homo sapiens
cagcctcgttggaagaggaaca

SEQ ID NO: 816725 - DNA, 16 bp, Homo sapiens
cagcctcgttggagag

SEQ ID NO: 816726 - DNA, 18 bp, Homo sapiens
cagcctcgttggagagca

SEQ ID NO: 816727 - DNA, 21 bp, Homo sapiens
cagcctcgttggagagcagca

SEQ ID NO: 816728 - DNA, 15 bp, Homo sapiens
cagcctctcagtgcc

SEQ ID NO: 816729 - DNA, 19 bp, Homo sapiens
cagcctctcagtgccctcc

SEQ ID NO: 816730 - DNA, 22 bp, Homo sapiens
cagcctctcagtgccctccagc

SEQ ID NO: 816731 - DNA, 20 bp, Homo sapiens
cagcctctccccaggtccag

SEQ ID NO: 816732 - DNA, 20 bp, Homo sapiens
cagcctctccccgctctgga

SEQ ID NO: 816733 - DNA, 13 bp, Homo sapiens
cagcctctcccgg

SEQ ID NO: 816734 - DNA, 14 bp, Homo sapiens
cagcctctcccggc

SEQ ID NO: 816735 - DNA, 20 bp, Homo sapiens
cagcctctcccggctgcctg

SEQ ID NO: 816736 - DNA, 23 bp, Homo sapiens
cagcctctcccggctgcctgccg

SEQ ID NO: 816737 - DNA, 14 bp, Homo sapiens
cagcctctctgcta

SEQ ID NO: 816738 - DNA, 15 bp, Homo sapiens
cagcctctctgctat

SEQ ID NO: 816739 - DNA, 20 bp, Homo sapiens
cagcctctgcaactgcaaga

SEQ ID NO: 816740 - DNA, 17 bp, Homo sapiens
cagcctctggacagcca

SEQ ID NO: 816741 - DNA, 15 bp, Homo sapiens
cagcctcttaaagct

SEQ ID NO: 816742 - DNA, 19 bp, Homo sapiens
cagcctcttaaagctgcct

SEQ ID NO: 816743 - DNA, 20 bp, Homo sapiens
cagcctcttaaagctgcctg

SEQ ID NO: 816744 - DNA, 11 bp, Homo sapiens
cagcctcttct

SEQ ID NO: 816745 - DNA, 14 bp, Homo sapiens
cagcctcttctctg

SEQ ID NO: 816746 - DNA, 12 bp, Homo sapiens
cagcctcttgcc

SEQ ID NO: 816747 - DNA, 15 bp, Homo sapiens
cagcctcttgcccgt

SEQ ID NO: 816748 - DNA, 12 bp, Homo sapiens
cagcctctttcc

SEQ ID NO: 816749 - DNA, 23 bp, Homo sapiens
cagcctgaaagatacaggggatc

SEQ ID NO: 816750 - DNA, 13 bp, Homo sapiens
cagcctgaagcct

SEQ ID NO: 816751 - DNA, 14 bp, Homo sapiens
cagcctgaagcctg

SEQ ID NO: 816752 - DNA, 18 bp, Homo sapiens
cagcctgaatcatttctt

SEQ ID NO: 816753 - DNA, 19 bp, Homo sapiens
cagcctgacctgagactgt

SEQ ID NO: 816754 - DNA, 15 bp, Homo sapiens
cagcctgaccttcct

SEQ ID NO: 816755 - DNA, 16 bp, Homo sapiens
cagcctgagcctctgc

SEQ ID NO: 816756 - DNA, 15 bp, Homo sapiens
cagcctgagtctcct

SEQ ID NO: 816757 - DNA, 16 bp, Homo sapiens
cagcctgagtctcctg

SEQ ID NO: 816758 - DNA, 20 bp, Homo sapiens
cagcctgagtctcctgtgcc

SEQ ID NO: 816759 - DNA, 22 bp, Homo sapiens
cagcctgagtctcctgtgccca

SEQ ID NO: 816760 - DNA, 12 bp, Homo sapiens
cagcctgcagga

SEQ ID NO: 816761 - DNA, 13 bp, Homo sapiens
cagcctgcccacc

SEQ ID NO: 816762 - DNA, 14 bp, Homo sapiens
cagcctgcccacct

SEQ ID NO: 816763 - DNA, 21 bp, Homo sapiens
cagcctgcccacctctccctg

SEQ ID NO: 816764 - DNA, 21 bp, Homo sapiens
cagcctgctctagtgggacag

SEQ ID NO: 816765 - DNA, 10 bp, Homo sapiens
cagcctgctg

SEQ ID NO: 816766 - DNA, 12 bp, Homo sapiens
cagcctgctgac

SEQ ID NO: 816767 - DNA, 16 bp, Homo sapiens
cagcctgctgagagcc

SEQ ID NO: 816768 - DNA, 15 bp, Homo sapiens
cagcctgctggcagg

SEQ ID NO: 816769 - DNA, 19 bp, Homo sapiens
cagcctgctggcagggcca

SEQ ID NO: 816770 - DNA, 20 bp, Homo sapiens
cagcctgctggcagggccag

SEQ ID NO: 816771 - DNA, 22 bp, Homo sapiens
cagcctgctggcagggccaggg

SEQ ID NO: 816772 - DNA, 13 bp, Homo sapiens
cagcctgctgggg

SEQ ID NO: 816773 - DNA, 18 bp, Homo sapiens
cagcctgctttggccttt

SEQ ID NO: 816774 - DNA, 19 bp, Homo sapiens
cagcctggaccctgtggat

SEQ ID NO: 816775 - DNA, 12 bp, Homo sapiens
cagcctggagag

SEQ ID NO: 816776 - DNA, 15 bp, Homo sapiens
cagcctggagaggcc

SEQ ID NO: 816777 - DNA, 16 bp, Homo sapiens
cagcctggagaggcct

SEQ ID NO: 816778 - DNA, 17 bp, Homo sapiens
cagcctggagaggcctg

SEQ ID NO: 816779 - DNA, 21 bp, Homo sapiens
cagcctggagaggcctggggt

SEQ ID NO: 816780 - DNA, 19 bp, Homo sapiens
cagcctggatccctgccct

SEQ ID NO: 816781 - DNA, 21 bp, Homo sapiens
cagcctggcacagggcagtgg

SEQ ID NO: 816782 - DNA, 20 bp, Homo sapiens
cagcctggcatctgtgcgtg

SEQ ID NO: 816783 - DNA, 22 bp, Homo sapiens
cagcctggcatctgtgcgtgtg

SEQ ID NO: 816784 - DNA, 15 bp, Homo sapiens
cagcctggccagaca

SEQ ID NO: 816785 - DNA, 22 bp, Homo sapiens
cagcctggctctgccccctccc

SEQ ID NO: 816786 - DNA, 11 bp, Homo sapiens
cagcctgggac

SEQ ID NO: 816787 - DNA, 18 bp, Homo sapiens
cagcctgggacacacaca

SEQ ID NO: 816788 - DNA, 21 bp, Homo sapiens
cagcctgggactcccagtgaa

SEQ ID NO: 816789 - DNA, 13 bp, Homo sapiens
cagcctgggagcc

SEQ ID NO: 816790 - DNA, 18 bp, Homo sapiens
cagcctgggagcccagag

SEQ ID NO: 816791 - DNA, 19 bp, Homo sapiens
cagcctgggcaacagagca

SEQ ID NO: 816792 - DNA, 20 bp, Homo sapiens
cagcctgggcaacagagcaa

SEQ ID NO: 816793 - DNA, 18 bp, Homo sapiens
cagcctgggcagccaggc

SEQ ID NO: 816794 - DNA, 21 bp, Homo sapiens
cagcctgggcagccaggctgc

SEQ ID NO: 816795 - DNA, 12 bp, Homo sapiens
cagcctgggccc

SEQ ID NO: 816796 - DNA, 16 bp, Homo sapiens
cagcctggggctccct

SEQ ID NO: 816797 - DNA, 23 bp, Homo sapiens
cagcctggggctccctctctggt

SEQ ID NO: 816798 - DNA, 16 bp, Homo sapiens
cagcctggggctctct

SEQ ID NO: 816799 - DNA, 17 bp, Homo sapiens
cagcctggggctctctg

SEQ ID NO: 816800 - DNA, 19 bp, Homo sapiens
cagcctggggctctctgac

SEQ ID NO: 816801 - DNA, 17 bp, Homo sapiens
cagcctggggctggcct

SEQ ID NO: 816802 - DNA, 18 bp, Homo sapiens
cagcctggggctggcctc

SEQ ID NO: 816803 - DNA, 22 bp, Homo sapiens
cagcctgggtctggatgggagg

SEQ ID NO: 816804 - DNA, 23 bp, Homo sapiens
cagcctgggtctggatgggagga

SEQ ID NO: 816805 - DNA, 19 bp, Homo sapiens
cagcctgggtgacagagcg

SEQ ID NO: 816806 - DNA, 18 bp, Homo sapiens
cagcctggtagaattggg

SEQ ID NO: 816807 - DNA, 18 bp, Homo sapiens
cagcctggtgggcctcct

SEQ ID NO: 816808 - DNA, 23 bp, Homo sapiens
cagcctggtgggcctcctctgtc

SEQ ID NO: 816809 - DNA, 23 bp, Homo sapiens
cagcctgtaaacggtgctatttc

SEQ ID NO: 816810 - DNA, 21 bp, Homo sapiens
cagcctgtaccttgctgtggg

SEQ ID NO: 816811 - DNA, 15 bp, Homo sapiens
cagcctgtatgtggt

SEQ ID NO: 816812 - DNA, 22 bp, Homo sapiens
cagcctgtcctggtacagcagg

SEQ ID NO: 816813 - DNA, 14 bp, Homo sapiens
cagcctgtgaggga

SEQ ID NO: 816814 - DNA, 16 bp, Homo sapiens
cagcctgtgctgcccg

SEQ ID NO: 816815 - DNA, 19 bp, Homo sapiens
cagcctgtggcatctttgc

SEQ ID NO: 816816 - DNA, 23 bp, Homo sapiens
cagcctgtggcttggagtggcca

SEQ ID NO: 816817 - DNA, 12 bp, Homo sapiens
cagcctgtggtt

SEQ ID NO: 816818 - DNA, 20 bp, Homo sapiens
cagcctgtggttacagtgca

SEQ ID NO: 816819 - DNA, 23 bp, Homo sapiens
cagcctgttgcccctgcctccca

SEQ ID NO: 816820 - DNA, 15 bp, Homo sapiens
cagccttaatagact

SEQ ID NO: 816821 - DNA, 23 bp, Homo sapiens
cagccttatttttgtatgccttt

SEQ ID NO: 816822 - DNA, 18 bp, Homo sapiens
cagccttcacttttctga

SEQ ID NO: 816823 - DNA, 19 bp, Homo sapiens
cagccttcacttttctgag

SEQ ID NO: 816824 - DNA, 21 bp, Homo sapiens
cagccttccccagctccagca

SEQ ID NO: 816825 - DNA, 22 bp, Homo sapiens
cagccttccccagctccagcag

SEQ ID NO: 816826 - DNA, 14 bp, Homo sapiens
cagccttccccctc

SEQ ID NO: 816827 - DNA, 20 bp, Homo sapiens
cagccttccccctcccaggg

SEQ ID NO: 816828 - DNA, 21 bp, Homo sapiens
cagccttccccctcccagggc

SEQ ID NO: 816829 - DNA, 14 bp, Homo sapiens
cagccttcccctcc

SEQ ID NO: 816830 - DNA, 19 bp, Homo sapiens
cagccttccgggaactgga

SEQ ID NO: 816831 - DNA, 14 bp, Homo sapiens
cagccttcctctgc

SEQ ID NO: 816832 - DNA, 18 bp, Homo sapiens
cagccttcctctgcagct

SEQ ID NO: 816833 - DNA, 20 bp, Homo sapiens
cagccttcctctgcagctga

SEQ ID NO: 816834 - DNA, 21 bp, Homo sapiens
cagccttcctctgcagctgac

SEQ ID NO: 816835 - DNA, 23 bp, Homo sapiens
cagccttcctctgcagctgacct

SEQ ID NO: 816836 - DNA, 16 bp, Homo sapiens
cagccttccttctgct

SEQ ID NO: 816837 - DNA, 18 bp, Homo sapiens
cagccttccttctgctcc

SEQ ID NO: 816838 - DNA, 20 bp, Homo sapiens
cagccttccttctgctccca

SEQ ID NO: 816839 - DNA, 16 bp, Homo sapiens
cagccttcgtgtggct

SEQ ID NO: 816840 - DNA, 18 bp, Homo sapiens
cagccttcgtgtggctcc

SEQ ID NO: 816841 - DNA, 22 bp, Homo sapiens
cagccttcgtgtggctcctggt

SEQ ID NO: 816842 - DNA, 23 bp, Homo sapiens
cagccttctccatatctccatgg

SEQ ID NO: 816843 - DNA, 15 bp, Homo sapiens
cagccttgaactcct

SEQ ID NO: 816844 - DNA, 13 bp, Homo sapiens
cagctctcagcca

SEQ ID NO: 816845 - DNA, 11 bp, Homo sapiens
cagctctccag

SEQ ID NO: 816846 - DNA, 14 bp, Homo sapiens
cagctctccagtca

SEQ ID NO: 816847 - DNA, 22 bp, Homo sapiens
cagctctcccacatcccactgg

SEQ ID NO: 816848 - DNA, 14 bp, Homo sapiens
cagctctccccagg

SEQ ID NO: 816849 - DNA, 20 bp, Homo sapiens
cagctctccccaggcatttg

SEQ ID NO: 816850 - DNA, 21 bp, Homo sapiens
cagctctccccaggcatttgc

SEQ ID NO: 816851 - DNA, 15 bp, Homo sapiens
cagctctcctggctc

SEQ ID NO: 816852 - DNA, 16 bp, Homo sapiens
cagctctcgttctcct

SEQ ID NO: 816853 - DNA, 15 bp, Homo sapiens
cagctctctctaccc

SEQ ID NO: 816854 - DNA, 16 bp, Homo sapiens
cagctctctctacccg

SEQ ID NO: 816855 - DNA, 12 bp, Homo sapiens
cagctctctgac

SEQ ID NO: 816856 - DNA, 16 bp, Homo sapiens
cagctctctgacgctt

SEQ ID NO: 816857 - DNA, 19 bp, Homo sapiens
cagctctctgccctgtgta

SEQ ID NO: 816858 - DNA, 15 bp, Homo sapiens
cagctctctgctggg

SEQ ID NO: 816859 - DNA, 13 bp, Homo sapiens
cagctctctggga

SEQ ID NO: 816860 - DNA, 20 bp, Homo sapiens
cagctctctgggacctcctt

SEQ ID NO: 816861 - DNA, 18 bp, Homo sapiens
cagctctgaaaccagtgt

SEQ ID NO: 816862 - DNA, 19 bp, Homo sapiens
cagctctgaaaccagtgtt

SEQ ID NO: 816863 - DNA, 15 bp, Homo sapiens
cagctctgacatccc

SEQ ID NO: 816864 - DNA, 21 bp, Homo sapiens
cagctctgacatcccttcctg

SEQ ID NO: 816865 - DNA, 18 bp, Homo sapiens
cagctctgaggggaggca

SEQ ID NO: 816866 - DNA, 15 bp, Homo sapiens
cagctctgcaagaat

SEQ ID NO: 816867 - DNA, 20 bp, Homo sapiens
cagctctgcccccgcgggtt

SEQ ID NO: 816868 - DNA, 22 bp, Homo sapiens
cagctctgcccccgcgggttct

SEQ ID NO: 816869 - DNA, 20 bp, Homo sapiens
cagctctgccgtctctggag

SEQ ID NO: 816870 - DNA, 11 bp, Homo sapiens
cagctctggag

SEQ ID NO: 816871 - DNA, 16 bp, Homo sapiens
cagctctggatgaagg

SEQ ID NO: 816872 - DNA, 18 bp, Homo sapiens
cagctctggatgaaggca

SEQ ID NO: 816873 - DNA, 12 bp, Homo sapiens
cagctctggctt

SEQ ID NO: 816874 - DNA, 15 bp, Homo sapiens
cagctctgggagagg

SEQ ID NO: 816875 - DNA, 12 bp, Homo sapiens
cagctctgggcc

SEQ ID NO: 816876 - DNA, 23 bp, Homo sapiens
cagctctggtccaggccctgtgg

SEQ ID NO: 816877 - DNA, 18 bp, Homo sapiens
cagctctgtggcctgtgt

SEQ ID NO: 816878 - DNA, 19 bp, Homo sapiens
cagctctgtggcctgtgtc

SEQ ID NO: 816879 - DNA, 20 bp, Homo sapiens
cagctctgtggcctgtgtcc

SEQ ID NO: 816880 - DNA, 20 bp, Homo sapiens
cagctcttaaaaagacactt

SEQ ID NO: 816881 - DNA, 22 bp, Homo sapiens
cagctcttccagggcagcggct

SEQ ID NO: 816882 - DNA, 14 bp, Homo sapiens
cagctcttctggag

SEQ ID NO: 816883 - DNA, 16 bp, Homo sapiens
cagctcttctggagtt

SEQ ID NO: 816884 - DNA, 13 bp, Homo sapiens
cagctcttctggg

SEQ ID NO: 816885 - DNA, 23 bp, Homo sapiens
cagctcttctgggcagagcctgt

SEQ ID NO: 816886 - DNA, 17 bp, Homo sapiens
cagctcttgcccttccc

SEQ ID NO: 816887 - DNA, 20 bp, Homo sapiens
cagctcttgcccttccctgt

SEQ ID NO: 816888 - DNA, 21 bp, Homo sapiens
cagctcttgcccttccctgtc

SEQ ID NO: 816889 - DNA, 15 bp, Homo sapiens
cagctcttgctctct

SEQ ID NO: 816890 - DNA, 16 bp, Homo sapiens
cagctcttgctctctt

SEQ ID NO: 816891 - DNA, 19 bp, Homo sapiens
cagctcttggcattttcct

SEQ ID NO: 816892 - DNA, 16 bp, Homo sapiens
cagctcttggctccac

SEQ ID NO: 816893 - DNA, 23 bp, Homo sapiens
cagctctttccaaattaaaacaa

SEQ ID NO: 816894 - DNA, 20 bp, Homo sapiens
cagctgaagtctctttttct

SEQ ID NO: 816895 - DNA, 20 bp, Homo sapiens
cagctgaatgcctcctgtgg

SEQ ID NO: 816896 - DNA, 13 bp, Homo sapiens
cagctgactaaac

SEQ ID NO: 816897 - DNA, 13 bp, Homo sapiens
cagctgactgtgg

SEQ ID NO: 816898 - DNA, 16 bp, Homo sapiens
cagctgactgtggccc

SEQ ID NO: 816899 - DNA, 19 bp, Homo sapiens
cagctgactgtggccccct

SEQ ID NO: 816900 - DNA, 15 bp, Homo sapiens
cagctgactgttggc

SEQ ID NO: 816901 - DNA, 21 bp, Homo sapiens
cagctgacttttctgtccgag

SEQ ID NO: 816902 - DNA, 15 bp, Homo sapiens
cagctgagaccaggg

SEQ ID NO: 816903 - DNA, 18 bp, Homo sapiens
cagctgagtgaaaaatct

SEQ ID NO: 816904 - DNA, 23 bp, Homo sapiens
cagctgagtgaaaaatctgtgga

SEQ ID NO: 816905 - DNA, 18 bp, Homo sapiens
cagctgatgttggaagag

SEQ ID NO: 816906 - DNA, 16 bp, Homo sapiens
cagctgcaagggagtt

SEQ ID NO: 816907 - DNA, 20 bp, Homo sapiens
cagctgcaaggtactctggt

SEQ ID NO: 816908 - DNA, 15 bp, Homo sapiens
cagctgcacattcct

SEQ ID NO: 816909 - DNA, 16 bp, Homo sapiens
cagctgcaccagagca

SEQ ID NO: 816910 - DNA, 20 bp, Homo sapiens
cagctgcaccccagcgtcag

SEQ ID NO: 816911 - DNA, 16 bp, Homo sapiens
cagctgcacctgccag

SEQ ID NO: 816912 - DNA, 20 bp, Homo sapiens
cagctgcacctgccagcctg

SEQ ID NO: 816913 - DNA, 22 bp, Homo sapiens
cagctgcacctgccagcctggc

SEQ ID NO: 816914 - DNA, 19 bp, Homo sapiens
cagctgcagatgccacacc

SEQ ID NO: 816915 - DNA, 16 bp, Homo sapiens
cagctgcagctgggcc

SEQ ID NO: 816916 - DNA, 12 bp, Homo sapiens
cagctgcagggc

SEQ ID NO: 816917 - DNA, 18 bp, Homo sapiens
cagctgccaggcggccct

SEQ ID NO: 816918 - DNA, 22 bp, Homo sapiens
cagctgccaggcggccctgggg

SEQ ID NO: 816919 - DNA, 17 bp, Homo sapiens
cagctgccccggcccct

SEQ ID NO: 816920 - DNA, 13 bp, Homo sapiens
cagctgcccctcc

SEQ ID NO: 816921 - DNA, 18 bp, Homo sapiens
cagctgcccctcctggag

SEQ ID NO: 816922 - DNA, 14 bp, Homo sapiens
cagctgccctagct

SEQ ID NO: 816923 - DNA, 15 bp, Homo sapiens
cagctgccctagctg

SEQ ID NO: 816924 - DNA, 19 bp, Homo sapiens
cagctgccctagctgaccc

SEQ ID NO: 816925 - DNA, 20 bp, Homo sapiens
cagctgccctagctgacccc

SEQ ID NO: 816926 - DNA, 12 bp, Homo sapiens
cagctgccctgc

SEQ ID NO: 816927 - DNA, 14 bp, Homo sapiens
cagctgccctgctg

SEQ ID NO: 816928 - DNA, 15 bp, Homo sapiens
cagctgccctgctgc

SEQ ID NO: 816929 - DNA, 17 bp, Homo sapiens
cagctgccctgctgcca

SEQ ID NO: 816930 - DNA, 12 bp, Homo sapiens
cagctgcctctg

SEQ ID NO: 816931 - DNA, 13 bp, Homo sapiens
cagctgcctctgc

SEQ ID NO: 816932 - DNA, 17 bp, Homo sapiens
cagctgcctctgctccc

SEQ ID NO: 816933 - DNA, 20 bp, Homo sapiens
cagctgcctgaaacagccat

SEQ ID NO: 816934 - DNA, 19 bp, Homo sapiens
cagctgcctggccatgctg

SEQ ID NO: 816935 - DNA, 14 bp, Homo sapiens
cagctgcctgggcc

SEQ ID NO: 816936 - DNA, 15 bp, Homo sapiens
cagctgcctgggccc

SEQ ID NO: 816937 - DNA, 16 bp, Homo sapiens
cagctgcctggggccc

SEQ ID NO: 816938 - DNA, 13 bp, Homo sapiens
cagctgccttcct

SEQ ID NO: 816939 - DNA, 18 bp, Homo sapiens
cagctgccttcctcatcc

SEQ ID NO: 816940 - DNA, 17 bp, Homo sapiens
cagctgcgcttgctttt

SEQ ID NO: 816941 - DNA, 16 bp, Homo sapiens
cagctgctatccccat

SEQ ID NO: 816942 - DNA, 14 bp, Homo sapiens
cagctgctcccaca

SEQ ID NO: 816943 - DNA, 20 bp, Homo sapiens
cagctgctcccctgccacgc

SEQ ID NO: 816944 - DNA, 15 bp, Homo sapiens
cagctgctcccctgg

SEQ ID NO: 816945 - DNA, 19 bp, Homo sapiens
cagctgctcctagagggag

SEQ ID NO: 816946 - DNA, 15 bp, Homo sapiens
cagctgctctgcccc

SEQ ID NO: 816947 - DNA, 20 bp, Homo sapiens
cagctgctgaagttctgagc

SEQ ID NO: 816948 - DNA, 20 bp, Homo sapiens
cagctgctgactggcagggc

SEQ ID NO: 816949 - DNA, 14 bp, Homo sapiens
cagctgctgtcttc

SEQ ID NO: 816950 - DNA, 22 bp, Homo sapiens
cagctgcttctccccccatccc

SEQ ID NO: 816951 - DNA, 23 bp, Homo sapiens
cagctgcttctccccccatccca

SEQ ID NO: 816952 - DNA, 22 bp, Homo sapiens
cagctgcttgacctagctcttt

SEQ ID NO: 816953 - DNA, 13 bp, Homo sapiens
cagctgcttgtcc

SEQ ID NO: 816954 - DNA, 21 bp, Homo sapiens
cagctgcttgtcctgctctct

SEQ ID NO: 816955 - DNA, 16 bp, Homo sapiens
cagctgctttacttaa

SEQ ID NO: 816956 - DNA, 14 bp, Homo sapiens
cagctggacagagg

SEQ ID NO: 816957 - DNA, 16 bp, Homo sapiens
cagctggacagagggg

SEQ ID NO: 816958 - DNA, 20 bp, Homo sapiens
cagctggacatactgctgga

SEQ ID NO: 816959 - DNA, 22 bp, Homo sapiens
cagctggacatactgctggagt

SEQ ID NO: 816960 - DNA, 17 bp, Homo sapiens
cagctggactctgcatc

SEQ ID NO: 816961 - DNA, 13 bp, Homo sapiens
cagctggccccca

SEQ ID NO: 816962 - DNA, 19 bp, Homo sapiens
cagctggcccccagccctg

SEQ ID NO: 816963 - DNA, 21 bp, Homo sapiens
cagctggcccccagccctggg

SEQ ID NO: 816964 - DNA, 13 bp, Homo sapiens
cagctggcctgga

SEQ ID NO: 816965 - DNA, 16 bp, Homo sapiens
cagctggcctttgtaa

SEQ ID NO: 816966 - DNA, 23 bp, Homo sapiens
cagctggctagcattcctcagga

SEQ ID NO: 816967 - DNA, 24 bp, Homo sapiens
cagctggctagcattcctcaggaa

SEQ ID NO: 816968 - DNA, 16 bp, Homo sapiens
cagctggctatctact

SEQ ID NO: 816969 - DNA, 22 bp, Homo sapiens
cagctggctatctactaccaga

SEQ ID NO: 816970 - DNA, 14 bp, Homo sapiens
cagctggctctcca

SEQ ID NO: 816971 - DNA, 16 bp, Homo sapiens
cagctgggaagccctt

SEQ ID NO: 816972 - DNA, 18 bp, Homo sapiens
cagctgggacccctccca

SEQ ID NO: 816973 - DNA, 21 bp, Homo sapiens
cagctgggagccagtgtgccc

SEQ ID NO: 816974 - DNA, 13 bp, Homo sapiens
cagctgggaggca

SEQ ID NO: 816975 - DNA, 23 bp, Homo sapiens
cagctgggaggcaagaggggtgg

SEQ ID NO: 816976 - DNA, 11 bp, Homo sapiens
cagctgggcaa

SEQ ID NO: 816977 - DNA, 19 bp, Homo sapiens
cagctgggcagtgccagcc

SEQ ID NO: 816978 - DNA, 18 bp, Homo sapiens
cagctgggccccatgctc

SEQ ID NO: 816979 - DNA, 11 bp, Homo sapiens
cagctgggctc

SEQ ID NO: 816980 - DNA, 15 bp, Homo sapiens
cagctgggctctgca

SEQ ID NO: 816981 - DNA, 18 bp, Homo sapiens
cagctgggctctgccacc

SEQ ID NO: 816982 - DNA, 14 bp, Homo sapiens
cagctgggcttggc

SEQ ID NO: 816983 - DNA, 22 bp, Homo sapiens
cagctgggcttggcctggagag

SEQ ID NO: 816984 - DNA, 23 bp, Homo sapiens
cagctgggcttggcctggagagg

SEQ ID NO: 816985 - DNA, 14 bp, Homo sapiens
cagctggggagatg

SEQ ID NO: 816986 - DNA, 17 bp, Homo sapiens
cagctggggccagaggc

SEQ ID NO: 816987 - DNA, 19 bp, Homo sapiens
cagctggggcgtggggagg

SEQ ID NO: 816988 - DNA, 11 bp, Homo sapiens
cagctgggtgg

SEQ ID NO: 816989 - DNA, 13 bp, Homo sapiens
cagctgggtgggg

SEQ ID NO: 816990 - DNA, 22 bp, Homo sapiens
cagctggtcagtctttgctcag

SEQ ID NO: 816991 - DNA, 14 bp, Homo sapiens
cagctggtccagac

SEQ ID NO: 816992 - DNA, 22 bp, Homo sapiens
cagctggtcctccactttgctg

SEQ ID NO: 816993 - DNA, 16 bp, Homo sapiens
cagctggtcttttctc

SEQ ID NO: 816994 - DNA, 18 bp, Homo sapiens
cagctggtcttttctcct

SEQ ID NO: 816995 - DNA, 20 bp, Homo sapiens
cagctggtgcaaattcagaa

SEQ ID NO: 816996 - DNA, 24 bp, Homo sapiens
cagctggtgccaaatagccccaga

SEQ ID NO: 816997 - DNA, 18 bp, Homo sapiens
cagctggttgaggtttca

SEQ ID NO: 816998 - DNA, 21 bp, Homo sapiens
cagctgtaagaagagactggg

SEQ ID NO: 816999 - DNA, 22 bp, Homo sapiens
cagctgtaagaagagactggga

SEQ ID NO: 817000 - DNA, 16 bp, Homo sapiens
cagctgtaatctatga

SEQ ID NO: 817001 - DNA, 14 bp, Homo sapiens
cagctgtagccatg

SEQ ID NO: 817002 - DNA, 21 bp, Homo sapiens
cagctgtagccatggctcagg

SEQ ID NO: 817003 - DNA, 18 bp, Homo sapiens
cagctgtagctcccgagc

SEQ ID NO: 817004 - DNA, 23 bp, Homo sapiens
cagctgtatttatataagtctgt

SEQ ID NO: 817005 - DNA, 16 bp, Homo sapiens
cagctgtcacctgctc

SEQ ID NO: 817006 - DNA, 18 bp, Homo sapiens
cagctgtcacctgctcac

SEQ ID NO: 817007 - DNA, 21 bp, Homo sapiens
cagctgtcagaacactccaag

SEQ ID NO: 817008 - DNA, 18 bp, Homo sapiens
cagctgtcccctctccct

SEQ ID NO: 817009 - DNA, 13 bp, Homo sapiens
cagctgtccctgt

SEQ ID NO: 817010 - DNA, 17 bp, Homo sapiens
cagctgtccctgtcacc

SEQ ID NO: 817011 - DNA, 18 bp, Homo sapiens
cagctgtccctgtcacca

SEQ ID NO: 817012 - DNA, 12 bp, Homo sapiens
cagctgtcctga

SEQ ID NO: 817013 - DNA, 21 bp, Homo sapiens
cagctgtcctgaaccgactga

SEQ ID NO: 817014 - DNA, 14 bp, Homo sapiens
cagctgtctgccag

SEQ ID NO: 817015 - DNA, 18 bp, Homo sapiens
cagctgtgagccatgcct

SEQ ID NO: 817016 - DNA, 21 bp, Homo sapiens
cagctgtgagccatgcctccc

SEQ ID NO: 817017 - DNA, 23 bp, Homo sapiens
cagctgtgagccatgcctccctg

SEQ ID NO: 817018 - DNA, 23 bp, Homo sapiens
cagctgtgagtgcgtgtgtgtga

SEQ ID NO: 817019 - DNA, 15 bp, Homo sapiens
cagctgtgtctgaca

SEQ ID NO: 817020 - DNA, 21 bp, Homo sapiens
cagctgtgtctgccaaacaca

SEQ ID NO: 817021 - DNA, 23 bp, Homo sapiens
cagctgtgtgacatttggagagg

SEQ ID NO: 817022 - DNA, 14 bp, Homo sapiens
cagctgttcctgtg

SEQ ID NO: 817023 - DNA, 13 bp, Homo sapiens
cagctgttgagaa

SEQ ID NO: 817024 - DNA, 16 bp, Homo sapiens
cagctgtttaagcctg

SEQ ID NO: 817025 - DNA, 11 bp, Homo sapiens
cagctgtttct

SEQ ID NO: 817026 - DNA, 14 bp, Homo sapiens
cagctgtttgtcat

SEQ ID NO: 817027 - DNA, 15 bp, Homo sapiens
cagctgttttcaaag

SEQ ID NO: 817028 - DNA, 17 bp, Homo sapiens
cagctgttttcaaagcc

SEQ ID NO: 817029 - DNA, 15 bp, Homo sapiens
cagctgttttgttga

SEQ ID NO: 817030 - DNA, 16 bp, Homo sapiens
cagctgttttgttgac

SEQ ID NO: 817031 - DNA, 17 bp, Homo sapiens
cagctgttttgttgaca

SEQ ID NO: 817032 - DNA, 19 bp, Homo sapiens
cagctgttttgttgacatt

SEQ ID NO: 817033 - DNA, 13 bp, Homo sapiens
cagcttaaaccca

SEQ ID NO: 817034 - DNA, 22 bp, Homo sapiens
cagcttaaacccatacaatgta

SEQ ID NO: 817035 - DNA, 18 bp, Homo sapiens
cagcttaacattgacttc

SEQ ID NO: 817036 - DNA, 18 bp, Homo sapiens
cagcttaagcgttcatat

SEQ ID NO: 817037 - DNA, 18 bp, Homo sapiens
cagcttaattctccttcc

SEQ ID NO: 817038 - DNA, 14 bp, Homo sapiens
cagcttagatttca

SEQ ID NO: 817039 - DNA, 14 bp, Homo sapiens
cagcttagggccct

SEQ ID NO: 817040 - DNA, 15 bp, Homo sapiens
cagcttagggccctg

SEQ ID NO: 817041 - DNA, 16 bp, Homo sapiens
cagcttagggccctgg

SEQ ID NO: 817042 - DNA, 19 bp, Homo sapiens
cagcttagggccctggagg

SEQ ID NO: 817043 - DNA, 18 bp, Homo sapiens
cagcttataatgggctct

SEQ ID NO: 817044 - DNA, 13 bp, Homo sapiens
cagcttatacgaa

SEQ ID NO: 817045 - DNA, 19 bp, Homo sapiens
cagcttatacgaaataatt

SEQ ID NO: 817046 - DNA, 21 bp, Homo sapiens
cagcttatctcttttatattt

SEQ ID NO: 817047 - DNA, 23 bp, Homo sapiens
cagcttatctcttttatatttgt

SEQ ID NO: 817048 - DNA, 21 bp, Homo sapiens
cagcttcaacttttctcttta

SEQ ID NO: 817049 - DNA, 13 bp, Homo sapiens
cagcttcaccaga

SEQ ID NO: 817050 - DNA, 22 bp, Homo sapiens
cagcttcactctctccgtctgt

SEQ ID NO: 817051 - DNA, 13 bp, Homo sapiens
cagcttcagctca

SEQ ID NO: 817052 - DNA, 17 bp, Homo sapiens
cagcttcagctcaactc

SEQ ID NO: 817053 - DNA, 13 bp, Homo sapiens
cagcttcagtgat

SEQ ID NO: 817054 - DNA, 18 bp, Homo sapiens
cagcttcatgcctttgta

SEQ ID NO: 817055 - DNA, 15 bp, Homo sapiens
cagcttcatttgtgt

SEQ ID NO: 817056 - DNA, 14 bp, Homo sapiens
cagcttccaaagcc

SEQ ID NO: 817057 - DNA, 19 bp, Homo sapiens
cagcttcctcacacccctg

SEQ ID NO: 817058 - DNA, 21 bp, Homo sapiens
cagcttcctgtctgtttatat

SEQ ID NO: 817059 - DNA, 17 bp, Homo sapiens
cagcttccttctgggac

SEQ ID NO: 817060 - DNA, 22 bp, Homo sapiens
cagcttcgaggacaggaaaggc

SEQ ID NO: 817061 - DNA, 23 bp, Homo sapiens
cagcttcggagggcccctgcgtg

SEQ ID NO: 817062 - DNA, 12 bp, Homo sapiens
cagcttcggggc

SEQ ID NO: 817063 - DNA, 21 bp, Homo sapiens
cagcttcggggccggtgaggg

SEQ ID NO: 817064 - DNA, 18 bp, Homo sapiens
cagcttcggtgtgcagat

SEQ ID NO: 817065 - DNA, 14 bp, Homo sapiens
cagcttcgtgctgg

SEQ ID NO: 817066 - DNA, 12 bp, Homo sapiens
cagcttctccaa

SEQ ID NO: 817067 - DNA, 15 bp, Homo sapiens
cagcttctccaggct

SEQ ID NO: 817068 - DNA, 14 bp, Homo sapiens
cagcttctctctcc

SEQ ID NO: 817069 - DNA, 17 bp, Homo sapiens
cagcttctctctccagg

SEQ ID NO: 817070 - DNA, 18 bp, Homo sapiens
cagcttctctctccaggg

SEQ ID NO: 817071 - DNA, 22 bp, Homo sapiens
cagcttctggtactctcctaga

SEQ ID NO: 817072 - DNA, 15 bp, Homo sapiens
cagcttcttgggctg

SEQ ID NO: 817073 - DNA, 16 bp, Homo sapiens
cagcttcttgggctga

SEQ ID NO: 817074 - DNA, 15 bp, Homo sapiens
cagcttcttttgcca

SEQ ID NO: 817075 - DNA, 19 bp, Homo sapiens
cagcttcttttgtctccca

SEQ ID NO: 817076 - DNA, 15 bp, Homo sapiens
cagcttgaacctgct

SEQ ID NO: 817077 - DNA, 23 bp, Homo sapiens
cagcttgaacctgcttcctggct

SEQ ID NO: 817078 - DNA, 17 bp, Homo sapiens
cagcttgacctgaggct

SEQ ID NO: 817079 - DNA, 20 bp, Homo sapiens
cagcttgacctgaggctgtg

SEQ ID NO: 817080 - DNA, 14 bp, Homo sapiens
cagcttgcccccgc

SEQ ID NO: 817081 - DNA, 16 bp, Homo sapiens
cagcttgccccggccc

SEQ ID NO: 817082 - DNA, 22 bp, Homo sapiens
cagcttgctcagatagatctgt

SEQ ID NO: 817083 - DNA, 15 bp, Homo sapiens
cagcttgctgagggg

SEQ ID NO: 817084 - DNA, 13 bp, Homo sapiens
cagcttgggccca

SEQ ID NO: 817085 - DNA, 23 bp, Homo sapiens
cagcttgggcccagctgggctct

SEQ ID NO: 817086 - DNA, 18 bp, Homo sapiens
cagcttgggtcaggttct

SEQ ID NO: 817087 - DNA, 21 bp, Homo sapiens
cagcttgggtcaggttcttgc

SEQ ID NO: 817088 - DNA, 18 bp, Homo sapiens
caggagctgatggcagct

SEQ ID NO: 817089 - DNA, 19 bp, Homo sapiens
caggagctgatggcagctg

SEQ ID NO: 817090 - DNA, 20 bp, Homo sapiens
caggagctgatggcagctgg

SEQ ID NO: 817091 - DNA, 22 bp, Homo sapiens
caggagctgcccagagttgctg

SEQ ID NO: 817092 - DNA, 22 bp, Homo sapiens
caggagctgtcaccaaggaaac

SEQ ID NO: 817093 - DNA, 15 bp, Homo sapiens
caggaggaatactga

SEQ ID NO: 817094 - DNA, 14 bp, Homo sapiens
caggaggagctgcc

SEQ ID NO: 817095 - DNA, 20 bp, Homo sapiens
caggaggcagaggttgcagt

SEQ ID NO: 817096 - DNA, 18 bp, Homo sapiens
caggaggcaggaccttcg

SEQ ID NO: 817097 - DNA, 14 bp, Homo sapiens
caggaggccaataa

SEQ ID NO: 817098 - DNA, 16 bp, Homo sapiens
caggaggccaataaaa

SEQ ID NO: 817099 - DNA, 20 bp, Homo sapiens
caggaggccaataaaaagtt

SEQ ID NO: 817100 - DNA, 21 bp, Homo sapiens
caggaggccaataaaaagttc

SEQ ID NO: 817101 - DNA, 14 bp, Homo sapiens
caggaggcccctgg

SEQ ID NO: 817102 - DNA, 18 bp, Homo sapiens
caggaggcccctggccca

SEQ ID NO: 817103 - DNA, 22 bp, Homo sapiens
caggaggccctggtcctggcct

SEQ ID NO: 817104 - DNA, 23 bp, Homo sapiens
caggaggccctggtgtcaggcag

SEQ ID NO: 817105 - DNA, 13 bp, Homo sapiens
caggaggcccttg

SEQ ID NO: 817106 - DNA, 17 bp, Homo sapiens
caggaggccgaggcagg

SEQ ID NO: 817107 - DNA, 22 bp, Homo sapiens
caggaggcgcccttggcttctg

SEQ ID NO: 817108 - DNA, 19 bp, Homo sapiens
caggaggcggcagctcttc

SEQ ID NO: 817109 - DNA, 21 bp, Homo sapiens
caggaggctccggcccacagg

SEQ ID NO: 817110 - DNA, 15 bp, Homo sapiens
caggaggctgaggca

SEQ ID NO: 817111 - DNA, 16 bp, Homo sapiens
caggaggctgaggcac

SEQ ID NO: 817112 - DNA, 17 bp, Homo sapiens
caggaggctgaggcaga

SEQ ID NO: 817113 - DNA, 20 bp, Homo sapiens
caggaggctgaggcagaaga

SEQ ID NO: 817114 - DNA, 14 bp, Homo sapiens
caggaggctgaggt

SEQ ID NO: 817115 - DNA, 21 bp, Homo sapiens
caggagggaggcaggggaggg

SEQ ID NO: 817116 - DNA, 13 bp, Homo sapiens
caggagggaggcg

SEQ ID NO: 817117 - DNA, 12 bp, Homo sapiens
caggagggaggt

SEQ ID NO: 817118 - DNA, 12 bp, Homo sapiens
caggagggcact

SEQ ID NO: 817119 - DNA, 16 bp, Homo sapiens
caggagggcaggctga

SEQ ID NO: 817120 - DNA, 17 bp, Homo sapiens
caggagggcaggctgag

SEQ ID NO: 817121 - DNA, 22 bp, Homo sapiens
caggagggcaggctgaggtggg

SEQ ID NO: 817122 - DNA, 16 bp, Homo sapiens
caggaggggaaacatc

SEQ ID NO: 817123 - DNA, 22 bp, Homo sapiens
caggaggggcctgggcagcccc

SEQ ID NO: 817124 - DNA, 15 bp, Homo sapiens
caggaggtggagaaa

SEQ ID NO: 817125 - DNA, 17 bp, Homo sapiens
caggaggttctgggcct

SEQ ID NO: 817126 - DNA, 20 bp, Homo sapiens
caggaggttctgggcctctg

SEQ ID NO: 817127 - DNA, 20 bp, Homo sapiens
caggaggttggtgactgaaa

SEQ ID NO: 817128 - DNA, 19 bp, Homo sapiens
caggaggtttttttgtcaa

SEQ ID NO: 817129 - DNA, 18 bp, Homo sapiens
caggagtccactttgttt

SEQ ID NO: 817130 - DNA, 19 bp, Homo sapiens
caggagtctctgccaccca

SEQ ID NO: 817131 - DNA, 22 bp, Homo sapiens
caggagtctctgccacccactc

SEQ ID NO: 817132 - DNA, 14 bp, Homo sapiens
caggagtctgccac

SEQ ID NO: 817133 - DNA, 17 bp, Homo sapiens
caggagtctgtgctctt

SEQ ID NO: 817134 - DNA, 16 bp, Homo sapiens
caggagtcttcagacc

SEQ ID NO: 817135 - DNA, 14 bp, Homo sapiens
caggagtgccagga

SEQ ID NO: 817136 - DNA, 17 bp, Homo sapiens
caggagtgccaggacca

SEQ ID NO: 817137 - DNA, 19 bp, Homo sapiens
caggagtgccaggaccagc

SEQ ID NO: 817138 - DNA, 20 bp, Homo sapiens
caggagtgccaggaccagcc

SEQ ID NO: 817139 - DNA, 21 bp, Homo sapiens
caggagtgccaggaccagcct

SEQ ID NO: 817140 - DNA, 17 bp, Homo sapiens
caggagtgcccccggga

SEQ ID NO: 817141 - DNA, 17 bp, Homo sapiens
caggagtgggttgattt

SEQ ID NO: 817142 - DNA, 17 bp, Homo sapiens
caggagtggtgcagaca

SEQ ID NO: 817143 - DNA, 17 bp, Homo sapiens
caggagtgtcctcttcc

SEQ ID NO: 817144 - DNA, 19 bp, Homo sapiens
caggagtgtcctgcccatg

SEQ ID NO: 817145 - DNA, 23 bp, Homo sapiens
caggagtgtcctgcccatgcccc

SEQ ID NO: 817146 - DNA, 19 bp, Homo sapiens
caggagttaaaaagggcag

SEQ ID NO: 817147 - DNA, 23 bp, Homo sapiens
caggagttagtggagtatttgga

SEQ ID NO: 817148 - DNA, 17 bp, Homo sapiens
caggagttcgagaccag

SEQ ID NO: 817149 - DNA, 19 bp, Homo sapiens
caggagttcgaggctgcag

SEQ ID NO: 817150 - DNA, 20 bp, Homo sapiens
caggagttgtttctgaccca

SEQ ID NO: 817151 - DNA, 20 bp, Homo sapiens
caggagtttgagacaagccc

SEQ ID NO: 817152 - DNA, 20 bp, Homo sapiens
caggagtttgaggctgcagc

SEQ ID NO: 817153 - DNA, 22 bp, Homo sapiens
caggagtttgaggctgcagcga

SEQ ID NO: 817154 - DNA, 16 bp, Homo sapiens
caggataataaaacat

SEQ ID NO: 817155 - DNA, 18 bp, Homo sapiens
caggataataaagtgttt

SEQ ID NO: 817156 - DNA, 17 bp, Homo sapiens
caggatactctgtcaga

SEQ ID NO: 817157 - DNA, 18 bp, Homo sapiens
caggatactctgtcagat

SEQ ID NO: 817158 - DNA, 15 bp, Homo sapiens
caggatactggcaca

SEQ ID NO: 817159 - DNA, 18 bp, Homo sapiens
caggatactggcacagag

SEQ ID NO: 817160 - DNA, 19 bp, Homo sapiens
caggatactggcacagagg

SEQ ID NO: 817161 - DNA, 20 bp, Homo sapiens
caggatatccttatcagagc

SEQ ID NO: 817162 - DNA, 21 bp, Homo sapiens
caggatatccttatcagagct

SEQ ID NO: 817163 - DNA, 21 bp, Homo sapiens
caggatattaaacgtgtaaat

SEQ ID NO: 817164 - DNA, 19 bp, Homo sapiens
caggatattggttcttccc

SEQ ID NO: 817165 - DNA, 17 bp, Homo sapiens
caggatcagccccgctc

SEQ ID NO: 817166 - DNA, 13 bp, Homo sapiens
caggatccaggcc

SEQ ID NO: 817167 - DNA, 17 bp, Homo sapiens
caggatccagtgacatg

SEQ ID NO: 817168 - DNA, 14 bp, Homo sapiens
caggatccccctct

SEQ ID NO: 817169 - DNA, 17 bp, Homo sapiens
caggatccgctgccacc

SEQ ID NO: 817170 - DNA, 22 bp, Homo sapiens
caggatcctattctcaccagga

SEQ ID NO: 817171 - DNA, 14 bp, Homo sapiens
caggatcctgcagg

SEQ ID NO: 817172 - DNA, 17 bp, Homo sapiens
caggatcctgcaggaac

SEQ ID NO: 817173 - DNA, 17 bp, Homo sapiens
caggatctcaagccagc

SEQ ID NO: 817174 - DNA, 23 bp, Homo sapiens
caggatgaaagttcccccatcag

SEQ ID NO: 817175 - DNA, 16 bp, Homo sapiens
caggatgacctggata

SEQ ID NO: 817176 - DNA, 13 bp, Homo sapiens
caggatgcccaga

SEQ ID NO: 817177 - DNA, 23 bp, Homo sapiens
caggatgctaacatctaaaaata

SEQ ID NO: 817178 - DNA, 23 bp, Homo sapiens
caggatggaattcttcctcctct

SEQ ID NO: 817179 - DNA, 13 bp, Homo sapiens
caggatggagggt

SEQ ID NO: 817180 - DNA, 17 bp, Homo sapiens
caggatggcagcaatgg

SEQ ID NO: 817181 - DNA, 22 bp, Homo sapiens
caggatggcagcaatggcgctg

SEQ ID NO: 817182 - DNA, 13 bp, Homo sapiens
caggatggccttt

SEQ ID NO: 817183 - DNA, 13 bp, Homo sapiens
caggatgggctga

SEQ ID NO: 817184 - DNA, 17 bp, Homo sapiens
caggatgggctgagcta

SEQ ID NO: 817185 - DNA, 16 bp, Homo sapiens
caggatggtgggcagg

SEQ ID NO: 817186 - DNA, 20 bp, Homo sapiens
caggatgtgtgggccaggat

SEQ ID NO: 817187 - DNA, 22 bp, Homo sapiens
caggatgtgtgggccaggatcc

SEQ ID NO: 817188 - DNA, 23 bp, Homo sapiens
caggatgttagaaagtgctgata

SEQ ID NO: 817189 - DNA, 14 bp, Homo sapiens
caggattcccccag

SEQ ID NO: 817190 - DNA, 15 bp, Homo sapiens
caggattcccccagc

SEQ ID NO: 817191 - DNA, 17 bp, Homo sapiens
caggattcccccagcca

SEQ ID NO: 817192 - DNA, 20 bp, Homo sapiens
caggattcccttctgggctt

SEQ ID NO: 817193 - DNA, 15 bp, Homo sapiens
caggattgaagagca

SEQ ID NO: 817194 - DNA, 12 bp, Homo sapiens
caggatttataa

SEQ ID NO: 817195 - DNA, 14 bp, Homo sapiens
caggattttaaaca

SEQ ID NO: 817196 - DNA, 22 bp, Homo sapiens
caggattttaacaaaagcaaga

SEQ ID NO: 817197 - DNA, 22 bp, Homo sapiens
caggattttaatttcaggaaaa

SEQ ID NO: 817198 - DNA, 17 bp, Homo sapiens
caggattttgtgttttt

SEQ ID NO: 817199 - DNA, 21 bp, Homo sapiens
caggcaaaaaagggacagcat

SEQ ID NO: 817200 - DNA, 17 bp, Homo sapiens
caggcaaagaaaatgaa

SEQ ID NO: 817201 - DNA, 16 bp, Homo sapiens
caggcaactgaggcag

SEQ ID NO: 817202 - DNA, 19 bp, Homo sapiens
caggcaactgaggcagaca

SEQ ID NO: 817203 - DNA, 20 bp, Homo sapiens
caggcaagcccctcagccct

SEQ ID NO: 817204 - DNA, 22 bp, Homo sapiens
caggcaagcccctcagcccttg

SEQ ID NO: 817205 - DNA, 23 bp, Homo sapiens
caggcaagcccctcagcccttgc

SEQ ID NO: 817206 - DNA, 22 bp, Homo sapiens
caggcaaggctgacttctctga

SEQ ID NO: 817207 - DNA, 23 bp, Homo sapiens
caggcaaggctgacttctctgaa

SEQ ID NO: 817208 - DNA, 18 bp, Homo sapiens
caggcctgatcttgcctg

SEQ ID NO: 817209 - DNA, 19 bp, Homo sapiens
caggcctgcagacagacct

SEQ ID NO: 817210 - DNA, 16 bp, Homo sapiens
caggcctgcctcccac

SEQ ID NO: 817211 - DNA, 14 bp, Homo sapiens
caggcctgctggca

SEQ ID NO: 817212 - DNA, 18 bp, Homo sapiens
caggcctgctggcatcag

SEQ ID NO: 817213 - DNA, 17 bp, Homo sapiens
caggcctggacgggccc

SEQ ID NO: 817214 - DNA, 20 bp, Homo sapiens
caggcctggacgggccctcc

SEQ ID NO: 817215 - DNA, 12 bp, Homo sapiens
caggcctggagc

SEQ ID NO: 817216 - DNA, 15 bp, Homo sapiens
caggcctggagggca

SEQ ID NO: 817217 - DNA, 18 bp, Homo sapiens
caggcctggctccccgag

SEQ ID NO: 817218 - DNA, 19 bp, Homo sapiens
caggcctggctccccgagg

SEQ ID NO: 817219 - DNA, 18 bp, Homo sapiens
caggcctgggacccagct

SEQ ID NO: 817220 - DNA, 17 bp, Homo sapiens
caggcctgggatgcagt

SEQ ID NO: 817221 - DNA, 18 bp, Homo sapiens
caggcctgggcaggaccc

SEQ ID NO: 817222 - DNA, 20 bp, Homo sapiens
caggcctgggcaggaccctg

SEQ ID NO: 817223 - DNA, 16 bp, Homo sapiens
caggcctgggtctgtg

SEQ ID NO: 817224 - DNA, 20 bp, Homo sapiens
caggcctgggtctgtgtctc

SEQ ID NO: 817225 - DNA, 12 bp, Homo sapiens
caggcctgtcca

SEQ ID NO: 817226 - DNA, 13 bp, Homo sapiens
caggcctgttccc

SEQ ID NO: 817227 - DNA, 23 bp, Homo sapiens
caggcctgttcccttgtggcttg

SEQ ID NO: 817228 - DNA, 18 bp, Homo sapiens
caggccttacatctggct

SEQ ID NO: 817229 - DNA, 14 bp, Homo sapiens
caggccttctgtgg

SEQ ID NO: 817230 - DNA, 23 bp, Homo sapiens
caggccttctgtggggctgggca

SEQ ID NO: 817231 - DNA, 16 bp, Homo sapiens
caggccttgctggggt

SEQ ID NO: 817232 - DNA, 13 bp, Homo sapiens
caggcctttggag

SEQ ID NO: 817233 - DNA, 14 bp, Homo sapiens
caggcgagcctgac

SEQ ID NO: 817234 - DNA, 15 bp, Homo sapiens
caggcgcagaggtcc

SEQ ID NO: 817235 - DNA, 18 bp, Homo sapiens
caggcgcagaggtcccag

SEQ ID NO: 817236 - DNA, 13 bp, Homo sapiens
caggcgcatgtct

SEQ ID NO: 817237 - DNA, 16 bp, Homo sapiens
caggcgcatgtctgca

SEQ ID NO: 817238 - DNA, 22 bp, Homo sapiens
caggcgcatgtctgcacctccg

SEQ ID NO: 817239 - DNA, 15 bp, Homo sapiens
caggcgccccttccc

SEQ ID NO: 817240 - DNA, 17 bp, Homo sapiens
caggcgccccttccccc

SEQ ID NO: 817241 - DNA, 15 bp, Homo sapiens
caggcgctaattcaa

SEQ ID NO: 817242 - DNA, 22 bp, Homo sapiens
caggcgcttctccaatgctctg

SEQ ID NO: 817243 - DNA, 16 bp, Homo sapiens
caggcggccagggcgg

SEQ ID NO: 817244 - DNA, 17 bp, Homo sapiens
caggcggccagggcggc

SEQ ID NO: 817245 - DNA, 13 bp, Homo sapiens
caggcggccctca

SEQ ID NO: 817246 - DNA, 23 bp, Homo sapiens
caggcggccctggggaggggtgg

SEQ ID NO: 817247 - DNA, 13 bp, Homo sapiens
caggcggctcctc

SEQ ID NO: 817248 - DNA, 18 bp, Homo sapiens
caggcggctcctcctcac

SEQ ID NO: 817249 - DNA, 16 bp, Homo sapiens
caggcgggaggaggtg

SEQ ID NO: 817250 - DNA, 18 bp, Homo sapiens
caggcgggcaagtcatcc

SEQ ID NO: 817251 - DNA, 17 bp, Homo sapiens
caggcgggcccatgaag

SEQ ID NO: 817252 - DNA, 23 bp, Homo sapiens
caggcggggcagtatgtgatgga

SEQ ID NO: 817253 - DNA, 21 bp, Homo sapiens
caggcggtgggcacccaccct

SEQ ID NO: 817254 - DNA, 23 bp, Homo sapiens
caggcggtttcacgccccacact

SEQ ID NO: 817255 - DNA, 15 bp, Homo sapiens
caggcgtgtggcagc

SEQ ID NO: 817256 - DNA, 17 bp, Homo sapiens
caggcgtgtggcagcca

SEQ ID NO: 817257 - DNA, 18 bp, Homo sapiens
caggcgttggtgccactt

SEQ ID NO: 817258 - DNA, 20 bp, Homo sapiens
caggcgtttctgaagtgctc

SEQ ID NO: 817259 - DNA, 23 bp, Homo sapiens
caggctaaacatccaatattttc

SEQ ID NO: 817260 - DNA, 21 bp, Homo sapiens
caggctaaatgcaccaagaaa

SEQ ID NO: 817261 - DNA, 22 bp, Homo sapiens
caggctaatttttttgtatttt

SEQ ID NO: 817262 - DNA, 14 bp, Homo sapiens
caggctactctcct

SEQ ID NO: 817263 - DNA, 15 bp, Homo sapiens
caggctactctcctc

SEQ ID NO: 817264 - DNA, 21 bp, Homo sapiens
caggctatggttgccacccca

SEQ ID NO: 817265 - DNA, 22 bp, Homo sapiens
caggctatggttgccaccccaa

SEQ ID NO: 817266 - DNA, 15 bp, Homo sapiens
caggctcactgccag

SEQ ID NO: 817267 - DNA, 21 bp, Homo sapiens
caggctcactgccaggccagc

SEQ ID NO: 817268 - DNA, 22 bp, Homo sapiens
caggctcactgccaggccagcc

SEQ ID NO: 817269 - DNA, 23 bp, Homo sapiens
caggctcactgccaggccagcct

SEQ ID NO: 817270 - DNA, 13 bp, Homo sapiens
caggctccccaga

SEQ ID NO: 817271 - DNA, 16 bp, Homo sapiens
caggctccctttctct

SEQ ID NO: 817272 - DNA, 20 bp, Homo sapiens
caggctccctttctcttctt

SEQ ID NO: 817273 - DNA, 17 bp, Homo sapiens
caggctcctggctgtgc

SEQ ID NO: 817274 - DNA, 19 bp, Homo sapiens
caggctcctggctgtgccc

SEQ ID NO: 817275 - DNA, 20 bp, Homo sapiens
caggctcctggctgtgccca

SEQ ID NO: 817276 - DNA, 21 bp, Homo sapiens
caggctcctggctgtgcccag

SEQ ID NO: 817277 - DNA, 24 bp, Homo sapiens
caggctcctggctgtgcccagcag

SEQ ID NO: 817278 - DNA, 16 bp, Homo sapiens
caggctcgtcagccac

SEQ ID NO: 817279 - DNA, 14 bp, Homo sapiens
caggctctagagag

SEQ ID NO: 817280 - DNA, 13 bp, Homo sapiens
caggctctcaaca

SEQ ID NO: 817281 - DNA, 14 bp, Homo sapiens
caggctctcaacag

SEQ ID NO: 817282 - DNA, 14 bp, Homo sapiens
caggctctccgggc

SEQ ID NO: 817283 - DNA, 11 bp, Homo sapiens
caggctctctc

SEQ ID NO: 817284 - DNA, 13 bp, Homo sapiens
caggctctctcct

SEQ ID NO: 817285 - DNA, 17 bp, Homo sapiens
caggctctggagccaga

SEQ ID NO: 817286 - DNA, 12 bp, Homo sapiens
caggctctgggc

SEQ ID NO: 817287 - DNA, 13 bp, Homo sapiens
caggctctgggca

SEQ ID NO: 817288 - DNA, 17 bp, Homo sapiens
caggctctgggcacagt

SEQ ID NO: 817289 - DNA, 15 bp, Homo sapiens
caggctctgggctca

SEQ ID NO: 817290 - DNA, 18 bp, Homo sapiens
caggctctgggctcaggg

SEQ ID NO: 817291 - DNA, 19 bp, Homo sapiens
caggctctgggctcagggc

SEQ ID NO: 817292 - DNA, 21 bp, Homo sapiens
caggctctgggctcagggctg

SEQ ID NO: 817293 - DNA, 22 bp, Homo sapiens
caggctctgggctcagggctgg

SEQ ID NO: 817294 - DNA, 21 bp, Homo sapiens
caggctcttagcagcttccag

SEQ ID NO: 817295 - DNA, 17 bp, Homo sapiens
caggctcttcctggacc

SEQ ID NO: 817296 - DNA, 12 bp, Homo sapiens
caggctgaagag

SEQ ID NO: 817297 - DNA, 16 bp, Homo sapiens
caggctgaagagaggg

SEQ ID NO: 817298 - DNA, 20 bp, Homo sapiens
caggctgaagagagggacag

SEQ ID NO: 817299 - DNA, 14 bp, Homo sapiens
caggctgacatctg

SEQ ID NO: 817300 - DNA, 14 bp, Homo sapiens
caggctgaccacag

SEQ ID NO: 817301 - DNA, 20 bp, Homo sapiens
caggctgaccacagcacagc

SEQ ID NO: 817302 - DNA, 21 bp, Homo sapiens
caggctgaccacagcacagcc

SEQ ID NO: 817303 - DNA, 17 bp, Homo sapiens
caggctgacgttccggg

SEQ ID NO: 817304 - DNA, 14 bp, Homo sapiens
caggctgaggtggg

SEQ ID NO: 817305 - DNA, 22 bp, Homo sapiens
caggctgagtccagagcttgtg

SEQ ID NO: 817306 - DNA, 23 bp, Homo sapiens
caggctgatgcttgaagtaactg

SEQ ID NO: 817307 - DNA, 22 bp, Homo sapiens
caggctgcagagcccggcccca

SEQ ID NO: 817308 - DNA, 15 bp, Homo sapiens
caggctgcagaggca

SEQ ID NO: 817309 - DNA, 19 bp, Homo sapiens
caggctgcagctggacaga

SEQ ID NO: 817310 - DNA, 15 bp, Homo sapiens
caggctgcaggaggg

SEQ ID NO: 817311 - DNA, 16 bp, Homo sapiens
caggctgcaggagggc

SEQ ID NO: 817312 - DNA, 18 bp, Homo sapiens
caggctgcaggagggcac

SEQ ID NO: 817313 - DNA, 21 bp, Homo sapiens
caggctgccaaggccagagtg

SEQ ID NO: 817314 - DNA, 22 bp, Homo sapiens
caggctgccaaggccagagtgg

SEQ ID NO: 817315 - DNA, 16 bp, Homo sapiens
caggctgcctcccttg

SEQ ID NO: 817316 - DNA, 21 bp, Homo sapiens
caggctgcctcggactccatg

SEQ ID NO: 817317 - DNA, 17 bp, Homo sapiens
caggctgcgtccctccg

SEQ ID NO: 817318 - DNA, 23 bp, Homo sapiens
caggctgctggggcctcagacga

SEQ ID NO: 817319 - DNA, 12 bp, Homo sapiens
caggctgcttgg

SEQ ID NO: 817320 - DNA, 21 bp, Homo sapiens
caggctggaatgagggaggcg

SEQ ID NO: 817321 - DNA, 22 bp, Homo sapiens
caggctggagataacagcctct

SEQ ID NO: 817322 - DNA, 23 bp, Homo sapiens
caggctggagataacagcctctt

SEQ ID NO: 817323 - DNA, 16 bp, Homo sapiens
caggctggagtgcaat

SEQ ID NO: 817324 - DNA, 20 bp, Homo sapiens
caggctggagtgtagtggcg

SEQ ID NO: 817325 - DNA, 13 bp, Homo sapiens
caggctggcagct

SEQ ID NO: 817326 - DNA, 15 bp, Homo sapiens
caggctggcagctct

SEQ ID NO: 817327 - DNA, 14 bp, Homo sapiens
caggctggccagtc

SEQ ID NO: 817328 - DNA, 16 bp, Homo sapiens
caggctggccagtcca

SEQ ID NO: 817329 - DNA, 21 bp, Homo sapiens
caggctggccagtccaggctg

SEQ ID NO: 817330 - DNA, 13 bp, Homo sapiens
caggctggcgcag

SEQ ID NO: 817331 - DNA, 21 bp, Homo sapiens
caggctggcgcagccaaggcc

SEQ ID NO: 817332 - DNA, 17 bp, Homo sapiens
caggctggctccagatg

SEQ ID NO: 817333 - DNA, 18 bp, Homo sapiens
caggctgggaactcatct

SEQ ID NO: 817334 - DNA, 13 bp, Homo sapiens
caggctgggacag

SEQ ID NO: 817335 - DNA, 23 bp, Homo sapiens
caggctgggacggaccagcatct

SEQ ID NO: 817336 - DNA, 20 bp, Homo sapiens
caggctgggccatgtccaaa

SEQ ID NO: 817337 - DNA, 12 bp, Homo sapiens
caggctgggccg

SEQ ID NO: 817338 - DNA, 19 bp, Homo sapiens
caggctgggccgcaagggc

SEQ ID NO: 817339 - DNA, 18 bp, Homo sapiens
caggctgggctctgcctg

SEQ ID NO: 817340 - DNA, 22 bp, Homo sapiens
caggctgggctctgcctgtctg

SEQ ID NO: 817341 - DNA, 23 bp, Homo sapiens
caggctgggctctgcctgtctgg

SEQ ID NO: 817342 - DNA, 22 bp, Homo sapiens
caggctggggaggccagtgttg

SEQ ID NO: 817343 - DNA, 14 bp, Homo sapiens
caggctggtctcaa

SEQ ID NO: 817344 - DNA, 22 bp, Homo sapiens
caggctggtctcgaactcctga

SEQ ID NO: 817345 - DNA, 24 bp, Homo sapiens
caggctggtcttgaactgggctca

SEQ ID NO: 817346 - DNA, 23 bp, Homo sapiens
caggctgtaagcattctgagctg

SEQ ID NO: 817347 - DNA, 22 bp, Homo sapiens
caggctgtgcgctgacaaccac

SEQ ID NO: 817348 - DNA, 14 bp, Homo sapiens
caggctgtggggtg

SEQ ID NO: 817349 - DNA, 16 bp, Homo sapiens
caggctgttattatga

SEQ ID NO: 817350 - DNA, 17 bp, Homo sapiens
caggctgttattatgaa

SEQ ID NO: 817351 - DNA, 22 bp, Homo sapiens
caggctgttctcgaactcctga

SEQ ID NO: 817352 - DNA, 22 bp, Homo sapiens
caggctgttggaaaatccagaa

SEQ ID NO: 817353 - DNA, 13 bp, Homo sapiens
caggctgtttcag

SEQ ID NO: 817354 - DNA, 15 bp, Homo sapiens
caggctgtttcagcc

SEQ ID NO: 817355 - DNA, 21 bp, Homo sapiens
caggcttatgaatatatttaa

SEQ ID NO: 817356 - DNA, 22 bp, Homo sapiens
caggcttcaccctgaatggttc

SEQ ID NO: 817357 - DNA, 16 bp, Homo sapiens
caggcttgagggaggg

SEQ ID NO: 817358 - DNA, 14 bp, Homo sapiens
caggcttgcctggg

SEQ ID NO: 817359 - DNA, 11 bp, Homo sapiens
caggcttgggg

SEQ ID NO: 817360 - DNA, 20 bp, Homo sapiens
caggcttggggaaaatggcc

SEQ ID NO: 817361 - DNA, 23 bp, Homo sapiens
caggcttgggggttttcaatgtg

SEQ ID NO: 817362 - DNA, 15 bp, Homo sapiens
cagggaaaataggca

SEQ ID NO: 817363 - DNA, 18 bp, Homo sapiens
cagggaaaataggcagga

SEQ ID NO: 817364 - DNA, 15 bp, Homo sapiens
cagggaaagctccac

SEQ ID NO: 817365 - DNA, 16 bp, Homo sapiens
cagggaaagctccacg

SEQ ID NO: 817366 - DNA, 14 bp, Homo sapiens
cagggaaaggaaaa

SEQ ID NO: 817367 - DNA, 17 bp, Homo sapiens
cagggaaaggaaaagaa

SEQ ID NO: 817368 - DNA, 23 bp, Homo sapiens
cagggaaaggctctgaaagccag

SEQ ID NO: 817369 - DNA, 13 bp, Homo sapiens
cagggaaattaat

SEQ ID NO: 817370 - DNA, 15 bp, Homo sapiens
cagggaaattaatca

SEQ ID NO: 817371 - DNA, 22 bp, Homo sapiens
cagggaaccctgcttgcacttt

SEQ ID NO: 817372 - DNA, 14 bp, Homo sapiens
cagggaactgcttg

SEQ ID NO: 817373 - DNA, 20 bp, Homo sapiens
cagggaactgcttgcccagg

SEQ ID NO: 817374 - DNA, 16 bp, Homo sapiens
cagggaagagaaagtg

SEQ ID NO: 817375 - DNA, 17 bp, Homo sapiens
cagggaagagcagaacg

SEQ ID NO: 817376 - DNA, 15 bp, Homo sapiens
cagggaagagggcag

SEQ ID NO: 817377 - DNA, 17 bp, Homo sapiens
cagggaagagggcagta

SEQ ID NO: 817378 - DNA, 23 bp, Homo sapiens
cagggaagaggggtgcagaggct

SEQ ID NO: 817379 - DNA, 22 bp, Homo sapiens
cagggaaggtggccacagcaag

SEQ ID NO: 817380 - DNA, 14 bp, Homo sapiens
cagggaatccaagc

SEQ ID NO: 817381 - DNA, 17 bp, Homo sapiens
cagggaatgcagcagga

SEQ ID NO: 817382 - DNA, 18 bp, Homo sapiens
cagggaatgcagcaggaa

SEQ ID NO: 817383 - DNA, 17 bp, Homo sapiens
cagggaatgcctggagg

SEQ ID NO: 817384 - DNA, 18 bp, Homo sapiens
cagggaatgcctggaggg

SEQ ID NO: 817385 - DNA, 20 bp, Homo sapiens
cagggaatgcctggagggta

SEQ ID NO: 817386 - DNA, 16 bp, Homo sapiens
cagggaatgctgaggc

SEQ ID NO: 817387 - DNA, 21 bp, Homo sapiens
cagggaatgctgaggcctcga

SEQ ID NO: 817388 - DNA, 15 bp, Homo sapiens
cagggacacacagcc

SEQ ID NO: 817389 - DNA, 17 bp, Homo sapiens
cagggacacatcccctt

SEQ ID NO: 817390 - DNA, 21 bp, Homo sapiens
cagggacagaaaccaaggccc

SEQ ID NO: 817391 - DNA, 17 bp, Homo sapiens
cagggacagagacacct

SEQ ID NO: 817392 - DNA, 18 bp, Homo sapiens
cagggacagagacacctg

SEQ ID NO: 817393 - DNA, 14 bp, Homo sapiens
cagggacagagcca

SEQ ID NO: 817394 - DNA, 15 bp, Homo sapiens
cagggacagaggcca

SEQ ID NO: 817395 - DNA, 18 bp, Homo sapiens
cagggacagaggccaagg

SEQ ID NO: 817396 - DNA, 22 bp, Homo sapiens
cagggacagaggccaaggactg

SEQ ID NO: 817397 - DNA, 23 bp, Homo sapiens
cagggacatgccctgtgtggctg

SEQ ID NO: 817398 - DNA, 18 bp, Homo sapiens
cagggacatggggcaagc

SEQ ID NO: 817399 - DNA, 19 bp, Homo sapiens
cagggacatggggcaagcc

SEQ ID NO: 817400 - DNA, 14 bp, Homo sapiens
cagggaccaaggac

SEQ ID NO: 817401 - DNA, 15 bp, Homo sapiens
cagggaccaaggacc

SEQ ID NO: 817402 - DNA, 18 bp, Homo sapiens
cagggaccaaggacccct

SEQ ID NO: 817403 - DNA, 16 bp, Homo sapiens
cagggaccacaccctg

SEQ ID NO: 817404 - DNA, 22 bp, Homo sapiens
cagggaccacaccctgtactgt

SEQ ID NO: 817405 - DNA, 10 bp, Homo sapiens
cagggaccag

SEQ ID NO: 817406 - DNA, 15 bp, Homo sapiens
cagggaccagcacct

SEQ ID NO: 817407 - DNA, 19 bp, Homo sapiens
cagggacccggggtctcct

SEQ ID NO: 817408 - DNA, 20 bp, Homo sapiens
cagggacccggggtctcctg

SEQ ID NO: 817409 - DNA, 21 bp, Homo sapiens
cagggacccggggtctcctgg

SEQ ID NO: 817410 - DNA, 22 bp, Homo sapiens
cagggacccggggtctcctgga

SEQ ID NO: 817411 - DNA, 21 bp, Homo sapiens
cagggacccttgcctgcctcc

SEQ ID NO: 817412 - DNA, 19 bp, Homo sapiens
cagggacctcaggggcacc

SEQ ID NO: 817413 - DNA, 23 bp, Homo sapiens
cagggacctcaggggcacctccg

SEQ ID NO: 817414 - DNA, 23 bp, Homo sapiens
cagggactgaaaacctctcctca

SEQ ID NO: 817415 - DNA, 15 bp, Homo sapiens
cagggactgcagctg

SEQ ID NO: 817416 - DNA, 14 bp, Homo sapiens
cagggacttgaagt

SEQ ID NO: 817417 - DNA, 17 bp, Homo sapiens
cagggacttgcctccac

SEQ ID NO: 817418 - DNA, 21 bp, Homo sapiens
cagggagacaggcagggaggg

SEQ ID NO: 817419 - DNA, 19 bp, Homo sapiens
cagggagacatctgcaccc

SEQ ID NO: 817420 - DNA, 22 bp, Homo sapiens
cagggagaccgagcgctttctg

SEQ ID NO: 817421 - DNA, 22 bp, Homo sapiens
cagggagactgggtaggaaaga

SEQ ID NO: 817422 - DNA, 18 bp, Homo sapiens
cagggagagcgcctcttc

SEQ ID NO: 817423 - DNA, 21 bp, Homo sapiens
cagggagaggtcaccagctgc

SEQ ID NO: 817424 - DNA, 20 bp, Homo sapiens
cagggagagttggggaaggc

SEQ ID NO: 817425 - DNA, 22 bp, Homo sapiens
cagggagagttggggaaggcaa

SEQ ID NO: 817426 - DNA, 17 bp, Homo sapiens
cagggagcaactctcca

SEQ ID NO: 817427 - DNA, 18 bp, Homo sapiens
cagggagcacctgtctgg

SEQ ID NO: 817428 - DNA, 18 bp, Homo sapiens
cagggagcagggaaggcc

SEQ ID NO: 817429 - DNA, 20 bp, Homo sapiens
cagggagcagggaaggcctg

SEQ ID NO: 817430 - DNA, 23 bp, Homo sapiens
cagggagcatttaatggcagcta

SEQ ID NO: 817431 - DNA, 19 bp, Homo sapiens
cagggagcctagaagctgg

SEQ ID NO: 817432 - DNA, 23 bp, Homo sapiens
cagggagcctccccatctgtcca

SEQ ID NO: 817433 - DNA, 22 bp, Homo sapiens
cagggagcctttggttctggcc

SEQ ID NO: 817434 - DNA, 19 bp, Homo sapiens
cagggagcgatccagggga

SEQ ID NO: 817435 - DNA, 17 bp, Homo sapiens
cagggagcggccggcca

SEQ ID NO: 817436 - DNA, 15 bp, Homo sapiens
cagggagctctgggg

SEQ ID NO: 817437 - DNA, 19 bp, Homo sapiens
cagggagctctggggacag

SEQ ID NO: 817438 - DNA, 23 bp, Homo sapiens
cagggagctctggggacagcttc

SEQ ID NO: 817439 - DNA, 18 bp, Homo sapiens
cagggagcttcctggctc

SEQ ID NO: 817440 - DNA, 12 bp, Homo sapiens
cagggaggagag

SEQ ID NO: 817441 - DNA, 20 bp, Homo sapiens
cagggaggaggtggcagccc

SEQ ID NO: 817442 - DNA, 22 bp, Homo sapiens
cagggaggcaacactgctgtcc

SEQ ID NO: 817443 - DNA, 23 bp, Homo sapiens
cagggaggcaacactgctgtcca

SEQ ID NO: 817444 - DNA, 16 bp, Homo sapiens
cagggaggcgcaggga

SEQ ID NO: 817445 - DNA, 20 bp, Homo sapiens
cagggaggcgcagggacatg

SEQ ID NO: 817446 - DNA, 14 bp, Homo sapiens
cagggagggaaggg

SEQ ID NO: 817447 - DNA, 17 bp, Homo sapiens
cagggagggaaggggat

SEQ ID NO: 817448 - DNA, 21 bp, Homo sapiens
cagggagggaaggggatggag

SEQ ID NO: 817449 - DNA, 16 bp, Homo sapiens
caggggcaggcctggg

SEQ ID NO: 817450 - DNA, 14 bp, Homo sapiens
caggggcaggcgca

SEQ ID NO: 817451 - DNA, 23 bp, Homo sapiens
caggggcaggcgcagaggtccca

SEQ ID NO: 817452 - DNA, 17 bp, Homo sapiens
caggggcaggtggtgga

SEQ ID NO: 817453 - DNA, 22 bp, Homo sapiens
caggggcagtcagtggagggcg

SEQ ID NO: 817454 - DNA, 22 bp, Homo sapiens
caggggcagttttagcagcact

SEQ ID NO: 817455 - DNA, 16 bp, Homo sapiens
caggggcatctgtctg

SEQ ID NO: 817456 - DNA, 17 bp, Homo sapiens
caggggcatctgtctgt

SEQ ID NO: 817457 - DNA, 14 bp, Homo sapiens
caggggccagagag

SEQ ID NO: 817458 - DNA, 15 bp, Homo sapiens
caggggccagagagc

SEQ ID NO: 817459 - DNA, 21 bp, Homo sapiens
caggggccagtgagggctggg

SEQ ID NO: 817460 - DNA, 19 bp, Homo sapiens
caggggccatgccccaccc

SEQ ID NO: 817461 - DNA, 19 bp, Homo sapiens
caggggcccacttggggcc

SEQ ID NO: 817462 - DNA, 20 bp, Homo sapiens
caggggcccacttggggcct

SEQ ID NO: 817463 - DNA, 16 bp, Homo sapiens
caggggccccagatct

SEQ ID NO: 817464 - DNA, 23 bp, Homo sapiens
caggggccccagatctgcctggg

SEQ ID NO: 817465 - DNA, 11 bp, Homo sapiens
caggggccctg

SEQ ID NO: 817466 - DNA, 16 bp, Homo sapiens
caggggccctgtacag

SEQ ID NO: 817467 - DNA, 18 bp, Homo sapiens
caggggcccttgggacag

SEQ ID NO: 817468 - DNA, 22 bp, Homo sapiens
caggggccggccagtggccttc

SEQ ID NO: 817469 - DNA, 17 bp, Homo sapiens
caggggcctctctcctg

SEQ ID NO: 817470 - DNA, 14 bp, Homo sapiens
caggggcctggagg

SEQ ID NO: 817471 - DNA, 12 bp, Homo sapiens
caggggcctggg

SEQ ID NO: 817472 - DNA, 14 bp, Homo sapiens
caggggcctgggcc

SEQ ID NO: 817473 - DNA, 14 bp, Homo sapiens
caggggcggggcag

SEQ ID NO: 817474 - DNA, 23 bp, Homo sapiens
caggggctacgttagcagcccag

SEQ ID NO: 817475 - DNA, 12 bp, Homo sapiens
caggggctccag

SEQ ID NO: 817476 - DNA, 19 bp, Homo sapiens
caggggctcctgggttgga

SEQ ID NO: 817477 - DNA, 23 bp, Homo sapiens
caggggctcctgggttggaggga

SEQ ID NO: 817478 - DNA, 12 bp, Homo sapiens
caggggctctgt

SEQ ID NO: 817479 - DNA, 13 bp, Homo sapiens
caggggctctgtg

SEQ ID NO: 817480 - DNA, 15 bp, Homo sapiens
caggggctgctgcct

SEQ ID NO: 817481 - DNA, 18 bp, Homo sapiens
caggggctgcttcctcct

SEQ ID NO: 817482 - DNA, 12 bp, Homo sapiens
caggggctgggc

SEQ ID NO: 817483 - DNA, 23 bp, Homo sapiens
caggggctgggcatcccagcttg

SEQ ID NO: 817484 - DNA, 20 bp, Homo sapiens
caggggctgtggccgtctcc

SEQ ID NO: 817485 - DNA, 19 bp, Homo sapiens
caggggcttcccactttgg

SEQ ID NO: 817486 - DNA, 15 bp, Homo sapiens
caggggctttgggcc

SEQ ID NO: 817487 - DNA, 20 bp, Homo sapiens
caggggctttgggcccaaga

SEQ ID NO: 817488 - DNA, 22 bp, Homo sapiens
caggggctttgggcccaagaac

SEQ ID NO: 817489 - DNA, 14 bp, Homo sapiens
cagggggaagaagc

SEQ ID NO: 817490 - DNA, 20 bp, Homo sapiens
cagggggaagaagcagagag

SEQ ID NO: 817491 - DNA, 23 bp, Homo sapiens
cagggggaaggccaaggggagtc

SEQ ID NO: 817492 - DNA, 22 bp, Homo sapiens
cagggggaggaggacttggagg

SEQ ID NO: 817493 - DNA, 21 bp, Homo sapiens
cagggggatatgggtcctctg

SEQ ID NO: 817494 - DNA, 22 bp, Homo sapiens
cagggggatgccactcctccct

SEQ ID NO: 817495 - DNA, 15 bp, Homo sapiens
cagggggcaagagga

SEQ ID NO: 817496 - DNA, 12 bp, Homo sapiens
cagggggccagc

SEQ ID NO: 817497 - DNA, 13 bp, Homo sapiens
cagggggccagct

SEQ ID NO: 817498 - DNA, 15 bp, Homo sapiens
cagggggccagctgg

SEQ ID NO: 817499 - DNA, 18 bp, Homo sapiens
cagggggccagctgggga

SEQ ID NO: 817500 - DNA, 20 bp, Homo sapiens
cagggggccagctggggaga

SEQ ID NO: 817501 - DNA, 24 bp, Homo sapiens
cagggggccagctggggagatggg

SEQ ID NO: 817502 - DNA, 14 bp, Homo sapiens
cagggggccctgcc

SEQ ID NO: 817503 - DNA, 20 bp, Homo sapiens
cagggggccctgccccaccc

SEQ ID NO: 817504 - DNA, 20 bp, Homo sapiens
caggggggtcggaagcctgt

SEQ ID NO: 817505 - DNA, 22 bp, Homo sapiens
caggggggtcggaagcctgtcc

SEQ ID NO: 817506 - DNA, 19 bp, Homo sapiens
caggggggttgtgaggcct

SEQ ID NO: 817507 - DNA, 18 bp, Homo sapiens
cagggggtgggaagggga

SEQ ID NO: 817508 - DNA, 16 bp, Homo sapiens
cagggggtgtgtctgc

SEQ ID NO: 817509 - DNA, 16 bp, Homo sapiens
caggggtaacctggcc

SEQ ID NO: 817510 - DNA, 19 bp, Homo sapiens
caggggtcaggtgtcaggc

SEQ ID NO: 817511 - DNA, 18 bp, Homo sapiens
caggggtcccagccaccc

SEQ ID NO: 817512 - DNA, 16 bp, Homo sapiens
caggggtcccccctca

SEQ ID NO: 817513 - DNA, 14 bp, Homo sapiens
caggggtccctgct

SEQ ID NO: 817514 - DNA, 17 bp, Homo sapiens
caggggtctccctggag

SEQ ID NO: 817515 - DNA, 19 bp, Homo sapiens
caggggtctccctggctcc

SEQ ID NO: 817516 - DNA, 21 bp, Homo sapiens
caggggtctccctggctccct

SEQ ID NO: 817517 - DNA, 22 bp, Homo sapiens
caggggtctccctggctccctc

SEQ ID NO: 817518 - DNA, 16 bp, Homo sapiens
caggggtgagagcacc

SEQ ID NO: 817519 - DNA, 18 bp, Homo sapiens
caggggtgagagcaccca

SEQ ID NO: 817520 - DNA, 19 bp, Homo sapiens
caggggtgagagcacccac

SEQ ID NO: 817521 - DNA, 20 bp, Homo sapiens
caggggtgagagcacccact

SEQ ID NO: 817522 - DNA, 17 bp, Homo sapiens
caggggtgccccctcct

SEQ ID NO: 817523 - DNA, 22 bp, Homo sapiens
caggggtgccccctcctctccc

SEQ ID NO: 817524 - DNA, 13 bp, Homo sapiens
caggggtgggaga

SEQ ID NO: 817525 - DNA, 17 bp, Homo sapiens
caggggtgggagagcca

SEQ ID NO: 817526 - DNA, 21 bp, Homo sapiens
caggggtgggagagccagctc

SEQ ID NO: 817527 - DNA, 23 bp, Homo sapiens
caggggtgggagagccagctctc

SEQ ID NO: 817528 - DNA, 17 bp, Homo sapiens
caggggttcgagaccag

SEQ ID NO: 817529 - DNA, 19 bp, Homo sapiens
caggggttcttgagccagc

SEQ ID NO: 817530 - DNA, 15 bp, Homo sapiens
caggggttgcagtga

SEQ ID NO: 817531 - DNA, 22 bp, Homo sapiens
caggggttgcagtgagcggaga

SEQ ID NO: 817532 - DNA, 13 bp, Homo sapiens
caggggtttctcg

SEQ ID NO: 817533 - DNA, 23 bp, Homo sapiens
caggggtttgggtgggggctgtg

SEQ ID NO: 817534 - DNA, 17 bp, Homo sapiens
cagggtacctcaagccc

SEQ ID NO: 817535 - DNA, 15 bp, Homo sapiens
cagggtagagcaaag

SEQ ID NO: 817536 - DNA, 17 bp, Homo sapiens
cagggtagagcaaagga

SEQ ID NO: 817537 - DNA, 18 bp, Homo sapiens
cagggtagagcaaaggag

SEQ ID NO: 817538 - DNA, 23 bp, Homo sapiens
cagggtagataacctgtacttca

SEQ ID NO: 817539 - DNA, 13 bp, Homo sapiens
cagggtagcaggt

SEQ ID NO: 817540 - DNA, 15 bp, Homo sapiens
cagggtaggaaaggg

SEQ ID NO: 817541 - DNA, 23 bp, Homo sapiens
cagggtatggactatctgtctgg

SEQ ID NO: 817542 - DNA, 17 bp, Homo sapiens
cagggtcaaagacagaa

SEQ ID NO: 817543 - DNA, 19 bp, Homo sapiens
cagggtccaaaggccagcg

SEQ ID NO: 817544 - DNA, 13 bp, Homo sapiens
cagggtcccagga

SEQ ID NO: 817545 - DNA, 19 bp, Homo sapiens
cagggtccccgagtgccta

SEQ ID NO: 817546 - DNA, 14 bp, Homo sapiens
cagggtcccctccc

SEQ ID NO: 817547 - DNA, 17 bp, Homo sapiens
cagggtcccctgccacc

SEQ ID NO: 817548 - DNA, 12 bp, Homo sapiens
cagggtccctgg

SEQ ID NO: 817549 - DNA, 19 bp, Homo sapiens
cagggtccgcaccagctgc

SEQ ID NO: 817550 - DNA, 21 bp, Homo sapiens
cagggtccgcaccagctgctc

SEQ ID NO: 817551 - DNA, 22 bp, Homo sapiens
cagggtccgcaccagctgctct

SEQ ID NO: 817552 - DNA, 13 bp, Homo sapiens
cagggtcctgccc

SEQ ID NO: 817553 - DNA, 14 bp, Homo sapiens
cagggtcctgccct

SEQ ID NO: 817554 - DNA, 12 bp, Homo sapiens
cagggtcctgtg

SEQ ID NO: 817555 - DNA, 14 bp, Homo sapiens
cagggtccttttga

SEQ ID NO: 817556 - DNA, 21 bp, Homo sapiens
cagggtccttttgacactgct

SEQ ID NO: 817557 - DNA, 23 bp, Homo sapiens
cagggtctctagtgctgtgaaaa

SEQ ID NO: 817558 - DNA, 20 bp, Homo sapiens
cagggtctctccctcaggtg

SEQ ID NO: 817559 - DNA, 14 bp, Homo sapiens
cagggtctgctctt

SEQ ID NO: 817560 - DNA, 17 bp, Homo sapiens
cagggtctgctctttct

SEQ ID NO: 817561 - DNA, 13 bp, Homo sapiens
cagggtctggcag

SEQ ID NO: 817562 - DNA, 14 bp, Homo sapiens
cagggtctggcaga

SEQ ID NO: 817563 - DNA, 21 bp, Homo sapiens
cagggtctggcagagcctctg

SEQ ID NO: 817564 - DNA, 20 bp, Homo sapiens
cagggtcttacctctctggg

SEQ ID NO: 817565 - DNA, 13 bp, Homo sapiens
cagggtcttccct

SEQ ID NO: 817566 - DNA, 16 bp, Homo sapiens
cagggtcttgctctgt

SEQ ID NO: 817567 - DNA, 18 bp, Homo sapiens
cagggtcttgctctgtcc

SEQ ID NO: 817568 - DNA, 17 bp, Homo sapiens
cagggtcttgggctact

SEQ ID NO: 817569 - DNA, 22 bp, Homo sapiens
cagggtcttgggctactggcag

SEQ ID NO: 817570 - DNA, 14 bp, Homo sapiens
cagtaaatttgcta

SEQ ID NO: 817571 - DNA, 17 bp, Homo sapiens
cagtaacatttctgttc

SEQ ID NO: 817572 - DNA, 19 bp, Homo sapiens
cagtaacgcgtcttcctga

SEQ ID NO: 817573 - DNA, 18 bp, Homo sapiens
cagtaacgtgctgctcaa

SEQ ID NO: 817574 - DNA, 14 bp, Homo sapiens
cagtaactaatttt

SEQ ID NO: 817575 - DNA, 21 bp, Homo sapiens
cagtaactaattttgttgaaa

SEQ ID NO: 817576 - DNA, 10 bp, Homo sapiens
cagtaactgt

SEQ ID NO: 817577 - DNA, 16 bp, Homo sapiens
cagtaacttttttgtg

SEQ ID NO: 817578 - DNA, 22 bp, Homo sapiens
cagtaacttttttgtgtatgta

SEQ ID NO: 817579 - DNA, 22 bp, Homo sapiens
cagtaagtctcataggttaaaa

SEQ ID NO: 817580 - DNA, 21 bp, Homo sapiens
cagtaagtgttagagggaaca

SEQ ID NO: 817581 - DNA, 13 bp, Homo sapiens
cagtaagttccta

SEQ ID NO: 817582 - DNA, 19 bp, Homo sapiens
cagtaagtttattgttaat

SEQ ID NO: 817583 - DNA, 17 bp, Homo sapiens
cagtaataaatgaatgt

SEQ ID NO: 817584 - DNA, 23 bp, Homo sapiens
cagtaatctatgtgtttctgtaa

SEQ ID NO: 817585 - DNA, 18 bp, Homo sapiens
cagtaatctttatactgg

SEQ ID NO: 817586 - DNA, 18 bp, Homo sapiens
cagtaatgctgcaggaaa

SEQ ID NO: 817587 - DNA, 18 bp, Homo sapiens
cagtaatgtcataaagtg

SEQ ID NO: 817588 - DNA, 21 bp, Homo sapiens
cagtaattggtccgatctttg

SEQ ID NO: 817589 - DNA, 21 bp, Homo sapiens
cagtacacttggtgtactggg

SEQ ID NO: 817590 - DNA, 14 bp, Homo sapiens
cagtacagaaggca

SEQ ID NO: 817591 - DNA, 19 bp, Homo sapiens
cagtacatacgtctgccag

SEQ ID NO: 817592 - DNA, 15 bp, Homo sapiens
cagtacatttaaatt

SEQ ID NO: 817593 - DNA, 16 bp, Homo sapiens
cagtacatttaaattt

SEQ ID NO: 817594 - DNA, 17 bp, Homo sapiens
cagtacatttaaatttt

SEQ ID NO: 817595 - DNA, 22 bp, Homo sapiens
cagtaccctctcagctccaggt

SEQ ID NO: 817596 - DNA, 20 bp, Homo sapiens
cagtacctagctggctctgt

SEQ ID NO: 817597 - DNA, 18 bp, Homo sapiens
cagtacctatgacttttt

SEQ ID NO: 817598 - DNA, 16 bp, Homo sapiens
cagtacctccaagcaa

SEQ ID NO: 817599 - DNA, 16 bp, Homo sapiens
cagtacctctcaagct

SEQ ID NO: 817600 - DNA, 23 bp, Homo sapiens
cagtaccttcaaactagggccaa

SEQ ID NO: 817601 - DNA, 15 bp, Homo sapiens
cagtacgatttgcag

SEQ ID NO: 817602 - DNA, 21 bp, Homo sapiens
cagtacgtcccgctgctgtgc

SEQ ID NO: 817603 - DNA, 21 bp, Homo sapiens
cagtactaagggaacaatcca

SEQ ID NO: 817604 - DNA, 17 bp, Homo sapiens
cagtactgactttctga

SEQ ID NO: 817605 - DNA, 12 bp, Homo sapiens
cagtactgggaa

SEQ ID NO: 817606 - DNA, 13 bp, Homo sapiens
cagtacttgtcat

SEQ ID NO: 817607 - DNA, 20 bp, Homo sapiens
cagtactttattgtacagac

SEQ ID NO: 817608 - DNA, 19 bp, Homo sapiens
cagtactttggaggcccct

SEQ ID NO: 817609 - DNA, 21 bp, Homo sapiens
cagtacttttttaaatatttt

SEQ ID NO: 817610 - DNA, 23 bp, Homo sapiens
cagtacttttttaaatattttct

SEQ ID NO: 817611 - DNA, 22 bp, Homo sapiens
cagtagaactccaggccctcct

SEQ ID NO: 817612 - DNA, 15 bp, Homo sapiens
cagtagaactgtctg

SEQ ID NO: 817613 - DNA, 16 bp, Homo sapiens
cagtagaattttagtc

SEQ ID NO: 817614 - DNA, 20 bp, Homo sapiens
cagtagaccttgttacttct

SEQ ID NO: 817615 - DNA, 13 bp, Homo sapiens
cagtagagccagc

SEQ ID NO: 817616 - DNA, 17 bp, Homo sapiens
cagtagagccagcttgg

SEQ ID NO: 817617 - DNA, 21 bp, Homo sapiens
cagtagagtagggtagaagga

SEQ ID NO: 817618 - DNA, 16 bp, Homo sapiens
cagtagagtcatctcc

SEQ ID NO: 817619 - DNA, 17 bp, Homo sapiens
cagtagagtcatctcca

SEQ ID NO: 817620 - DNA, 18 bp, Homo sapiens
cagtagatgtgcttctga

SEQ ID NO: 817621 - DNA, 16 bp, Homo sapiens
cagtagattgcagaaa

SEQ ID NO: 817622 - DNA, 23 bp, Homo sapiens
cagtagcacaagttatttaaatc

SEQ ID NO: 817623 - DNA, 20 bp, Homo sapiens
cagtaggaacaagctggctt

SEQ ID NO: 817624 - DNA, 21 bp, Homo sapiens
cagtaggaacaagctggcttc

SEQ ID NO: 817625 - DNA, 17 bp, Homo sapiens
cagtaggactccttatt

SEQ ID NO: 817626 - DNA, 14 bp, Homo sapiens
cagtaggagcccag

SEQ ID NO: 817627 - DNA, 21 bp, Homo sapiens
cagtaggagcccagctctgaa

SEQ ID NO: 817628 - DNA, 22 bp, Homo sapiens
cagtaggagcccagctctgaaa

SEQ ID NO: 817629 - DNA, 19 bp, Homo sapiens
cagtaggggcttataataa

SEQ ID NO: 817630 - DNA, 17 bp, Homo sapiens
cagtagtcacaaactga

SEQ ID NO: 817631 - DNA, 14 bp, Homo sapiens
cagtagtgtacatt

SEQ ID NO: 817632 - DNA, 14 bp, Homo sapiens
cagtagttcacata

SEQ ID NO: 817633 - DNA, 15 bp, Homo sapiens
cagtataaaagacaa

SEQ ID NO: 817634 - DNA, 22 bp, Homo sapiens
cagtataatctcctctgctcat

SEQ ID NO: 817635 - DNA, 23 bp, Homo sapiens
cagtataattgagttttcagtgg

SEQ ID NO: 817636 - DNA, 15 bp, Homo sapiens
cagtatactgtgtgg

SEQ ID NO: 817637 - DNA, 22 bp, Homo sapiens
cagtatagcattgaacatttct

SEQ ID NO: 817638 - DNA, 16 bp, Homo sapiens
cagtatataataactt

SEQ ID NO: 817639 - DNA, 15 bp, Homo sapiens
cagtatatttaaact

SEQ ID NO: 817640 - DNA, 14 bp, Homo sapiens
cagtatatttgaaa

SEQ ID NO: 817641 - DNA, 18 bp, Homo sapiens
cagtatattttatttcaa

SEQ ID NO: 817642 - DNA, 19 bp, Homo sapiens
cagtatattttatttcaat

SEQ ID NO: 817643 - DNA, 22 bp, Homo sapiens
cagtatattttatttcaatgta

SEQ ID NO: 817644 - DNA, 13 bp, Homo sapiens
cagtatcatctcc

SEQ ID NO: 817645 - DNA, 15 bp, Homo sapiens
cagtatcatgaagcc

SEQ ID NO: 817646 - DNA, 13 bp, Homo sapiens
cagtatcatgccc

SEQ ID NO: 817647 - DNA, 17 bp, Homo sapiens
cagtatccaatgtcttt

SEQ ID NO: 817648 - DNA, 12 bp, Homo sapiens
cagtatcccaca

SEQ ID NO: 817649 - DNA, 19 bp, Homo sapiens
cagtatctatatatgtgta

SEQ ID NO: 817650 - DNA, 17 bp, Homo sapiens
cagtatgatgaaaataa

SEQ ID NO: 817651 - DNA, 19 bp, Homo sapiens
cagtatgatgaaaataatt

SEQ ID NO: 817652 - DNA, 21 bp, Homo sapiens
cagtatgctttccctgaggaa

SEQ ID NO: 817653 - DNA, 21 bp, Homo sapiens
cagtatgtgatggactgggga

SEQ ID NO: 817654 - DNA, 18 bp, Homo sapiens
cagtatgtttttacataa

SEQ ID NO: 817655 - DNA, 21 bp, Homo sapiens
cagtattaaaggggggagggg

SEQ ID NO: 817656 - DNA, 18 bp, Homo sapiens
cagtattactgctgctgt

SEQ ID NO: 817657 - DNA, 16 bp, Homo sapiens
cagtattactttctgc

SEQ ID NO: 817658 - DNA, 15 bp, Homo sapiens
cagtattatctaaat

SEQ ID NO: 817659 - DNA, 16 bp, Homo sapiens
cagtattcagagtctc

SEQ ID NO: 817660 - DNA, 21 bp, Homo sapiens
cagtattccatttctggacat

SEQ ID NO: 817661 - DNA, 21 bp, Homo sapiens
cagtattctaaagttttgcaa

SEQ ID NO: 817662 - DNA, 12 bp, Homo sapiens
cagtattctgcc

SEQ ID NO: 817663 - DNA, 13 bp, Homo sapiens
cagtattcttgtc

SEQ ID NO: 817664 - DNA, 19 bp, Homo sapiens
cagtattcttgtcaaaaaa

SEQ ID NO: 817665 - DNA, 15 bp, Homo sapiens
cagtattcttttaaa

SEQ ID NO: 817666 - DNA, 15 bp, Homo sapiens
cagtattgaaaactt

SEQ ID NO: 817667 - DNA, 17 bp, Homo sapiens
cagtattgaaaacttca

SEQ ID NO: 817668 - DNA, 14 bp, Homo sapiens
cagtattgccacct

SEQ ID NO: 817669 - DNA, 13 bp, Homo sapiens
cagtattgctgat

SEQ ID NO: 817670 - DNA, 23 bp, Homo sapiens
cagtattgctgattttaaaggca

SEQ ID NO: 817671 - DNA, 23 bp, Homo sapiens
cagtattggacggtttctagcct

SEQ ID NO: 817672 - DNA, 15 bp, Homo sapiens
cagtatttcagactg

SEQ ID NO: 817673 - DNA, 17 bp, Homo sapiens
cagtatttccttccact

SEQ ID NO: 817674 - DNA, 18 bp, Homo sapiens
cagtatttccttccactg

SEQ ID NO: 817675 - DNA, 19 bp, Homo sapiens
cagtatttccttccactgt

SEQ ID NO: 817676 - DNA, 15 bp, Homo sapiens
cagtatttgtaatta

SEQ ID NO: 817677 - DNA, 20 bp, Homo sapiens
cagtattttaaatgaagtga

SEQ ID NO: 817678 - DNA, 18 bp, Homo sapiens
cagtattttccagcctta

SEQ ID NO: 817679 - DNA, 18 bp, Homo sapiens
cagtattttggagaaatt

SEQ ID NO: 817680 - DNA, 21 bp, Homo sapiens
cagtattttggagaaattatt

SEQ ID NO: 817681 - DNA, 23 bp, Homo sapiens
cagtattttggagaaattattta

SEQ ID NO: 817682 - DNA, 17 bp, Homo sapiens
cagtatttttaaaggca

SEQ ID NO: 817683 - DNA, 13 bp, Homo sapiens
cagtatttttata

SEQ ID NO: 817684 - DNA, 21 bp, Homo sapiens
cagtatttttatacggaaaaa

SEQ ID NO: 817685 - DNA, 14 bp, Homo sapiens
cagtatttttgctg

SEQ ID NO: 817686 - DNA, 19 bp, Homo sapiens
cagtatttttgctgcttct

SEQ ID NO: 817687 - DNA, 16 bp, Homo sapiens
cagtcaaatctgggct

SEQ ID NO: 817688 - DNA, 22 bp, Homo sapiens
cagtcaacctgggcaaagccta

SEQ ID NO: 817689 - DNA, 22 bp, Homo sapiens
cagtcaagctgttgaagtctca

SEQ ID NO: 817690 - DNA, 21 bp, Homo sapiens
cagtcaatggaagaaatggct

SEQ ID NO: 817691 - DNA, 19 bp, Homo sapiens
cagtcacaacagagtgaaa

SEQ ID NO: 817692 - DNA, 23 bp, Homo sapiens
cagtcacccctccctccctcttt

SEQ ID NO: 817693 - DNA, 16 bp, Homo sapiens
cagtcacccttctggg

SEQ ID NO: 817694 - DNA, 12 bp, Homo sapiens
cagtcaccttct

SEQ ID NO: 817695 - DNA, 14 bp, Homo sapiens
cagtcaccttctgg

SEQ ID NO: 817696 - DNA, 16 bp, Homo sapiens
cagtcaccttctgggc

SEQ ID NO: 817697 - DNA, 17 bp, Homo sapiens
cagtcaccttctgggca

SEQ ID NO: 817698 - DNA, 23 bp, Homo sapiens
cagtcactcctctctagggcaga

SEQ ID NO: 817699 - DNA, 12 bp, Homo sapiens
cagtcactgtga

SEQ ID NO: 817700 - DNA, 13 bp, Homo sapiens
cagtcagagtcca

SEQ ID NO: 817701 - DNA, 15 bp, Homo sapiens
cagtcagagtccagt

SEQ ID NO: 817702 - DNA, 21 bp, Homo sapiens
cagtcagagtccagtgctctg

SEQ ID NO: 817703 - DNA, 21 bp, Homo sapiens
cagtcaggaaaggaatcattt

SEQ ID NO: 817704 - DNA, 16 bp, Homo sapiens
cagtcaggggctgggc

SEQ ID NO: 817705 - DNA, 18 bp, Homo sapiens
cagtcagtgtttctttta

SEQ ID NO: 817706 - DNA, 17 bp, Homo sapiens
cagtcagttcccggagc

SEQ ID NO: 817707 - DNA, 18 bp, Homo sapiens
cagtcagttcccggagca

SEQ ID NO: 817708 - DNA, 13 bp, Homo sapiens
cagtcatcatcag

SEQ ID NO: 817709 - DNA, 14 bp, Homo sapiens
cagtcatcatcagg

SEQ ID NO: 817710 - DNA, 15 bp, Homo sapiens
cagtcatcatcaggg

SEQ ID NO: 817711 - DNA, 17 bp, Homo sapiens
cagtcatcatcagggcc

SEQ ID NO: 817712 - DNA, 23 bp, Homo sapiens
cagtcatcatcagggcctggggc

SEQ ID NO: 817713 - DNA, 16 bp, Homo sapiens
cagtcatcctgccctg

SEQ ID NO: 817714 - DNA, 21 bp, Homo sapiens
cagtcatcctgccctgcagca

SEQ ID NO: 817715 - DNA, 16 bp, Homo sapiens
cagtcatctgtaagag

SEQ ID NO: 817716 - DNA, 20 bp, Homo sapiens
cagtcatctgtctttcactg

SEQ ID NO: 817717 - DNA, 14 bp, Homo sapiens
cagtcatgtatgca

SEQ ID NO: 817718 - DNA, 23 bp, Homo sapiens
cagtcattatgagaggcaatgat

SEQ ID NO: 817719 - DNA, 13 bp, Homo sapiens
cagtcattggctg

SEQ ID NO: 817720 - DNA, 15 bp, Homo sapiens
cagtcatttgtggtt

SEQ ID NO: 817721 - DNA, 22 bp, Homo sapiens
cagtccaaatgtcctccagaag

SEQ ID NO: 817722 - DNA, 23 bp, Homo sapiens
cagtccaaatgtcctccagaagc

SEQ ID NO: 817723 - DNA, 14 bp, Homo sapiens
cagtccaaccagaa

SEQ ID NO: 817724 - DNA, 15 bp, Homo sapiens
cagtccacagctgaa

SEQ ID NO: 817725 - DNA, 13 bp, Homo sapiens
cagtccacagggg

SEQ ID NO: 817726 - DNA, 18 bp, Homo sapiens
cagtccacaggggccacc

SEQ ID NO: 817727 - DNA, 21 bp, Homo sapiens
cagtccactgttgagccccag

SEQ ID NO: 817728 - DNA, 17 bp, Homo sapiens
cagtccagacccaagtc

SEQ ID NO: 817729 - DNA, 21 bp, Homo sapiens
cagtccaggcctctctctgct

SEQ ID NO: 817730 - DNA, 15 bp, Homo sapiens
cagtccaggctgccg

SEQ ID NO: 817731 - DNA, 17 bp, Homo sapiens
cagtcccacactgtgca

SEQ ID NO: 817732 - DNA, 23 bp, Homo sapiens
cagtcccacactgtgcagaccca

SEQ ID NO: 817733 - DNA, 24 bp, Homo sapiens
cagtcccacactgtgcagacccag

SEQ ID NO: 817734 - DNA, 22 bp, Homo sapiens
cagtcccacactgtggccaggc

SEQ ID NO: 817735 - DNA, 17 bp, Homo sapiens
cagtcccagggaaggtg

SEQ ID NO: 817736 - DNA, 19 bp, Homo sapiens
cagtcccattcctccactc

SEQ ID NO: 817737 - DNA, 13 bp, Homo sapiens
cagtccccacccc

SEQ ID NO: 817738 - DNA, 16 bp, Homo sapiens
cagtccccacccctgc

SEQ ID NO: 817739 - DNA, 17 bp, Homo sapiens
cagtccccagccctggg

SEQ ID NO: 817740 - DNA, 18 bp, Homo sapiens
cagtccccagccctgggc

SEQ ID NO: 817741 - DNA, 19 bp, Homo sapiens
cagtccccagccctgggct

SEQ ID NO: 817742 - DNA, 19 bp, Homo sapiens
cagtccccatttctgcctc

SEQ ID NO: 817743 - DNA, 17 bp, Homo sapiens
cagtcccccacccacct

SEQ ID NO: 817744 - DNA, 22 bp, Homo sapiens
cagtccccgaggagctgggccc

SEQ ID NO: 817745 - DNA, 23 bp, Homo sapiens
cagtccccgtgaaggagagccct

SEQ ID NO: 817746 - DNA, 16 bp, Homo sapiens
cagtcccctcccatct

SEQ ID NO: 817747 - DNA, 16 bp, Homo sapiens
cagtcccctctctctg

SEQ ID NO: 817748 - DNA, 21 bp, Homo sapiens
cagtcccgtcgtgcagtcagg

SEQ ID NO: 817749 - DNA, 15 bp, Homo sapiens
cagtccctatgtatt

SEQ ID NO: 817750 - DNA, 19 bp, Homo sapiens
cagtcctaagaaagaggag

SEQ ID NO: 817751 - DNA, 17 bp, Homo sapiens
cagtcctagaatgtttc

SEQ ID NO: 817752 - DNA, 18 bp, Homo sapiens
cagtcctagctcttacac

SEQ ID NO: 817753 - DNA, 16 bp, Homo sapiens
cagtcctatgtacaga

SEQ ID NO: 817754 - DNA, 20 bp, Homo sapiens
cagtcctatgtacagagctt

SEQ ID NO: 817755 - DNA, 15 bp, Homo sapiens
cagtcctcactgtcc

SEQ ID NO: 817756 - DNA, 18 bp, Homo sapiens
cagtcctccagaccacca

SEQ ID NO: 817757 - DNA, 15 bp, Homo sapiens
cagtcctcctgggag

SEQ ID NO: 817758 - DNA, 15 bp, Homo sapiens
cagtcctgcctggcc

SEQ ID NO: 817759 - DNA, 14 bp, Homo sapiens
cagtcctgctccag

SEQ ID NO: 817760 - DNA, 13 bp, Homo sapiens
cagtcctgggaga

SEQ ID NO: 817761 - DNA, 23 bp, Homo sapiens
cagtcctgggagaacctcaggct

SEQ ID NO: 817762 - DNA, 22 bp, Homo sapiens
cagtcctgggttgtttccagga

SEQ ID NO: 817763 - DNA, 13 bp, Homo sapiens
cagtcctggtcct

SEQ ID NO: 817764 - DNA, 16 bp, Homo sapiens
cagtcctgtgtgagga

SEQ ID NO: 817765 - DNA, 14 bp, Homo sapiens
cagtcctgttcaaa

SEQ ID NO: 817766 - DNA, 16 bp, Homo sapiens
cagtcctgttcaaatt

SEQ ID NO: 817767 - DNA, 21 bp, Homo sapiens
cagtccttattatcccagctt

SEQ ID NO: 817768 - DNA, 12 bp, Homo sapiens
cagtccttccac

SEQ ID NO: 817769 - DNA, 14 bp, Homo sapiens
cagtcctttgtaaa

SEQ ID NO: 817770 - DNA, 20 bp, Homo sapiens
cagtcctttgtaaacagtgt

SEQ ID NO: 817771 - DNA, 20 bp, Homo sapiens
cagtcgcaggatccgctgcc

SEQ ID NO: 817772 - DNA, 22 bp, Homo sapiens
cagtcgcaggatccgctgccac

SEQ ID NO: 817773 - DNA, 23 bp, Homo sapiens
cagtcgcaggatccgctgccacc

SEQ ID NO: 817774 - DNA, 19 bp, Homo sapiens
cagtcgctcagtctgttca

SEQ ID NO: 817775 - DNA, 14 bp, Homo sapiens
cagtcggcatgcca

SEQ ID NO: 817776 - DNA, 17 bp, Homo sapiens
cagtcggcatgccagga

SEQ ID NO: 817777 - DNA, 14 bp, Homo sapiens
cagtcggccccatc

SEQ ID NO: 817778 - DNA, 13 bp, Homo sapiens
cagtcgggggctg

SEQ ID NO: 817779 - DNA, 16 bp, Homo sapiens
cagtcgggggctggcc

SEQ ID NO: 817780 - DNA, 19 bp, Homo sapiens
cagtcgggggctggcctag

SEQ ID NO: 817781 - DNA, 15 bp, Homo sapiens
cagtcggtgacccca

SEQ ID NO: 817782 - DNA, 15 bp, Homo sapiens
cagtcgtgatgtgga

SEQ ID NO: 817783 - DNA, 20 bp, Homo sapiens
cagtcgtgtaattggcccaa

SEQ ID NO: 817784 - DNA, 15 bp, Homo sapiens
cagtcgttatttctg

SEQ ID NO: 817785 - DNA, 22 bp, Homo sapiens
cagtctaggaatggagtctccc

SEQ ID NO: 817786 - DNA, 15 bp, Homo sapiens
cagtctatttccact

SEQ ID NO: 817787 - DNA, 23 bp, Homo sapiens
cagtctatttccactgaacaaaa

SEQ ID NO: 817788 - DNA, 21 bp, Homo sapiens
cagtctcaagaggcagagttc

SEQ ID NO: 817789 - DNA, 14 bp, Homo sapiens
cagtctcaggagca

SEQ ID NO: 817790 - DNA, 19 bp, Homo sapiens
cagtctcagttctcttgct

SEQ ID NO: 817791 - DNA, 16 bp, Homo sapiens
cagtctcatctcctga

SEQ ID NO: 817792 - DNA, 24 bp, Homo sapiens
cagtctccagggacccttgcctgc

SEQ ID NO: 817793 - DNA, 18 bp, Homo sapiens
cagtctcccaggccccct

SEQ ID NO: 817794 - DNA, 18 bp, Homo sapiens
cagtctccccactccacc

SEQ ID NO: 817795 - DNA, 23 bp, Homo sapiens
cagtctccccactccaccctgtt

SEQ ID NO: 817796 - DNA, 12 bp, Homo sapiens
cagtctccctga

SEQ ID NO: 817797 - DNA, 12 bp, Homo sapiens
cagtctcctcac

SEQ ID NO: 817798 - DNA, 14 bp, Homo sapiens
cagtctcctcactc

SEQ ID NO: 817799 - DNA, 13 bp, Homo sapiens
cagtctcctctcc

SEQ ID NO: 817800 - DNA, 14 bp, Homo sapiens
cagtctcctctcca

SEQ ID NO: 817801 - DNA, 18 bp, Homo sapiens
cagtctcctctccatttt

SEQ ID NO: 817802 - DNA, 22 bp, Homo sapiens
cagtctctcttctctccagctg

SEQ ID NO: 817803 - DNA, 12 bp, Homo sapiens
cagtctctgagc

SEQ ID NO: 817804 - DNA, 15 bp, Homo sapiens
cagtctctttaatct

SEQ ID NO: 817805 - DNA, 22 bp, Homo sapiens
cagtctctttaatcttcagttt

SEQ ID NO: 817806 - DNA, 15 bp, Homo sapiens
cagtctctttcttcc

SEQ ID NO: 817807 - DNA, 19 bp, Homo sapiens
cagtctctttcttcctttc

SEQ ID NO: 817808 - DNA, 20 bp, Homo sapiens
cagtctgaatgctgccacaa

SEQ ID NO: 817809 - DNA, 13 bp, Homo sapiens
cagtctgctccac

SEQ ID NO: 817810 - DNA, 14 bp, Homo sapiens
cagtctgctccacc

SEQ ID NO: 817811 - DNA, 16 bp, Homo sapiens
cagtctgctccaccaa

SEQ ID NO: 817812 - DNA, 12 bp, Homo sapiens
cagtctgctctg

SEQ ID NO: 817813 - DNA, 17 bp, Homo sapiens
cagttatcctttgtgag

SEQ ID NO: 817814 - DNA, 23 bp, Homo sapiens
cagttatcctttgtgagcctatg

SEQ ID NO: 817815 - DNA, 14 bp, Homo sapiens
cagttattttgata

SEQ ID NO: 817816 - DNA, 17 bp, Homo sapiens
cagttcaaagtgtatat

SEQ ID NO: 817817 - DNA, 15 bp, Homo sapiens
cagttcaaatcctca

SEQ ID NO: 817818 - DNA, 16 bp, Homo sapiens
cagttcaacctggtgg

SEQ ID NO: 817819 - DNA, 16 bp, Homo sapiens
cagttcaactttcaga

SEQ ID NO: 817820 - DNA, 20 bp, Homo sapiens
cagttcaactttcagaagtg

SEQ ID NO: 817821 - DNA, 23 bp, Homo sapiens
cagttcaatctcccgctgctgct

SEQ ID NO: 817822 - DNA, 21 bp, Homo sapiens
cagttcacttctttgcagagc

SEQ ID NO: 817823 - DNA, 23 bp, Homo sapiens
cagttcacttctttgcagagcct

SEQ ID NO: 817824 - DNA, 13 bp, Homo sapiens
cagttcagcacca

SEQ ID NO: 817825 - DNA, 17 bp, Homo sapiens
cagttcaggagtcccaa

SEQ ID NO: 817826 - DNA, 20 bp, Homo sapiens
cagttcaggagtcccaagga

SEQ ID NO: 817827 - DNA, 16 bp, Homo sapiens
cagttcatatgcagaa

SEQ ID NO: 817828 - DNA, 16 bp, Homo sapiens
cagttcatcgattttc

SEQ ID NO: 817829 - DNA, 18 bp, Homo sapiens
cagttcatgtttgcttca

SEQ ID NO: 817830 - DNA, 15 bp, Homo sapiens
cagttcattattttg

SEQ ID NO: 817831 - DNA, 18 bp, Homo sapiens
cagttcccacattaaaga

SEQ ID NO: 817832 - DNA, 18 bp, Homo sapiens
cagttcccccaacctcag

SEQ ID NO: 817833 - DNA, 19 bp, Homo sapiens
cagttcccccaacctcaga

SEQ ID NO: 817834 - DNA, 22 bp, Homo sapiens
cagttcccccagtacctccaag

SEQ ID NO: 817835 - DNA, 19 bp, Homo sapiens
cagttcccggagcacagcc

SEQ ID NO: 817836 - DNA, 18 bp, Homo sapiens
cagttccctcctgcccag

SEQ ID NO: 817837 - DNA, 18 bp, Homo sapiens
cagttcctcgccctgggt

SEQ ID NO: 817838 - DNA, 19 bp, Homo sapiens
cagttcctgctctctgctc

SEQ ID NO: 817839 - DNA, 14 bp, Homo sapiens
cagttcctggccca

SEQ ID NO: 817840 - DNA, 22 bp, Homo sapiens
cagttcctttgtgtgtactcac

SEQ ID NO: 817841 - DNA, 23 bp, Homo sapiens
cagttcgttggtagagccctcag

SEQ ID NO: 817842 - DNA, 18 bp, Homo sapiens
cagttctaacctcctaag

SEQ ID NO: 817843 - DNA, 14 bp, Homo sapiens
cagttctcactcct

SEQ ID NO: 817844 - DNA, 16 bp, Homo sapiens
cagttctcccagggag

SEQ ID NO: 817845 - DNA, 17 bp, Homo sapiens
cagttctcccagggagt

SEQ ID NO: 817846 - DNA, 18 bp, Homo sapiens
cagttctcccagggagtg

SEQ ID NO: 817847 - DNA, 23 bp, Homo sapiens
cagttctcccagggagtgagcag

SEQ ID NO: 817848 - DNA, 17 bp, Homo sapiens
cagttctctcccttcct

SEQ ID NO: 817849 - DNA, 18 bp, Homo sapiens
cagttctctcccttcctc

SEQ ID NO: 817850 - DNA, 11 bp, Homo sapiens
cagttctgcaa

SEQ ID NO: 817851 - DNA, 17 bp, Homo sapiens
cagttctgcaaatagaa

SEQ ID NO: 817852 - DNA, 20 bp, Homo sapiens
cagttctgcaaatagaaaac

SEQ ID NO: 817853 - DNA, 13 bp, Homo sapiens
cagttctgctcct

SEQ ID NO: 817854 - DNA, 18 bp, Homo sapiens
cagttctgggcaaagagg

SEQ ID NO: 817855 - DNA, 18 bp, Homo sapiens
cagttcttggacccctga

SEQ ID NO: 817856 - DNA, 23 bp, Homo sapiens
cagttcttggtgactgtcccacc

SEQ ID NO: 817857 - DNA, 17 bp, Homo sapiens
cagttcttggtgctctg

SEQ ID NO: 817858 - DNA, 18 bp, Homo sapiens
cagttcttggtgctctgt

SEQ ID NO: 817859 - DNA, 19 bp, Homo sapiens
cagttcttggtgctctgtg

SEQ ID NO: 817860 - DNA, 21 bp, Homo sapiens
cagttcttggtgctctgtgtt

SEQ ID NO: 817861 - DNA, 12 bp, Homo sapiens
cagttctttact

SEQ ID NO: 817862 - DNA, 14 bp, Homo sapiens
cagttctttcctct

SEQ ID NO: 817863 - DNA, 22 bp, Homo sapiens
cagttctttcctctttctgctc

SEQ ID NO: 817864 - DNA, 12 bp, Homo sapiens
cagttgaaaaac

SEQ ID NO: 817865 - DNA, 19 bp, Homo sapiens
cagttgaaaaacagctgag

SEQ ID NO: 817866 - DNA, 17 bp, Homo sapiens
cagttgaaaacttgtaa

SEQ ID NO: 817867 - DNA, 18 bp, Homo sapiens
cagttgaaaacttgtaat

SEQ ID NO: 817868 - DNA, 14 bp, Homo sapiens
cagttgaacagact

SEQ ID NO: 817869 - DNA, 14 bp, Homo sapiens
cagttgaacagagg

SEQ ID NO: 817870 - DNA, 16 bp, Homo sapiens
cagttgacagcaggtg

SEQ ID NO: 817871 - DNA, 19 bp, Homo sapiens
cagttgcatgtagtaacac

SEQ ID NO: 817872 - DNA, 20 bp, Homo sapiens
cagttgcatgtagtaacact

SEQ ID NO: 817873 - DNA, 21 bp, Homo sapiens
cagttgcatgtagtaacacta

SEQ ID NO: 817874 - DNA, 12 bp, Homo sapiens
cagttgccctag

SEQ ID NO: 817875 - DNA, 20 bp, Homo sapiens
cagttgccctagcccagact

SEQ ID NO: 817876 - DNA, 22 bp, Homo sapiens
cagttgccttttatcccaaagt

SEQ ID NO: 817877 - DNA, 19 bp, Homo sapiens
cagttgctcaaaaagaaat

SEQ ID NO: 817878 - DNA, 19 bp, Homo sapiens
cagttggactctcagggat

SEQ ID NO: 817879 - DNA, 17 bp, Homo sapiens
cagttggatctctggtt

SEQ ID NO: 817880 - DNA, 22 bp, Homo sapiens
cagttggatctctggttgtcta

SEQ ID NO: 817881 - DNA, 13 bp, Homo sapiens
cagttggcagaga

SEQ ID NO: 817882 - DNA, 20 bp, Homo sapiens
cagttggcagagaaggcctc

SEQ ID NO: 817883 - DNA, 16 bp, Homo sapiens
cagttggccttcagaa

SEQ ID NO: 817884 - DNA, 15 bp, Homo sapiens
cagttgggactcagg

SEQ ID NO: 817885 - DNA, 16 bp, Homo sapiens
cagttgggactcagga

SEQ ID NO: 817886 - DNA, 14 bp, Homo sapiens
cagttgggagcact

SEQ ID NO: 817887 - DNA, 17 bp, Homo sapiens
cagttgggagcactgga

SEQ ID NO: 817888 - DNA, 18 bp, Homo sapiens
cagttgggagcactggag

SEQ ID NO: 817889 - DNA, 21 bp, Homo sapiens
cagttgggagcactggagtgc

SEQ ID NO: 817890 - DNA, 13 bp, Homo sapiens
cagttggggccct

SEQ ID NO: 817891 - DNA, 15 bp, Homo sapiens
cagttggggccctct

SEQ ID NO: 817892 - DNA, 18 bp, Homo sapiens
cagttggggccctcttgc

SEQ ID NO: 817893 - DNA, 22 bp, Homo sapiens
cagttggggccctcttgccagc

SEQ ID NO: 817894 - DNA, 16 bp, Homo sapiens
cagttgtacttctgct

SEQ ID NO: 817895 - DNA, 23 bp, Homo sapiens
cagttgtagcaggtttcactatt

SEQ ID NO: 817896 - DNA, 21 bp, Homo sapiens
cagttgtatgtttgctgatta

SEQ ID NO: 817897 - DNA, 21 bp, Homo sapiens
cagttgtatttaacagaaatt

SEQ ID NO: 817898 - DNA, 19 bp, Homo sapiens
cagttgtccttaaatttgt

SEQ ID NO: 817899 - DNA, 19 bp, Homo sapiens
cagttgtctattctgagcc

SEQ ID NO: 817900 - DNA, 21 bp, Homo sapiens
cagttgtctattctgagcctt

SEQ ID NO: 817901 - DNA, 22 bp, Homo sapiens
cagttgtctattctgagccttg

SEQ ID NO: 817902 - DNA, 17 bp, Homo sapiens
cagttgtctctgatgca

SEQ ID NO: 817903 - DNA, 21 bp, Homo sapiens
cagttgtcttatgtgaaaaat

SEQ ID NO: 817904 - DNA, 23 bp, Homo sapiens
cagttgtcttatgtgaaaaatta

SEQ ID NO: 817905 - DNA, 16 bp, Homo sapiens
cagttgtgtcataaat

SEQ ID NO: 817906 - DNA, 14 bp, Homo sapiens
cagttgttatttag

SEQ ID NO: 817907 - DNA, 12 bp, Homo sapiens
cagttgttcttt

SEQ ID NO: 817908 - DNA, 21 bp, Homo sapiens
cagttgttctttagaggcttt

SEQ ID NO: 817909 - DNA, 20 bp, Homo sapiens
cagttgttggcctccggcct

SEQ ID NO: 817910 - DNA, 16 bp, Homo sapiens
cagttgtttgcttctt

SEQ ID NO: 817911 - DNA, 16 bp, Homo sapiens
cagtttaaaaaaattg

SEQ ID NO: 817912 - DNA, 18 bp, Homo sapiens
cagtttaaaaaaattggt

SEQ ID NO: 817913 - DNA, 13 bp, Homo sapiens
cagtttaaaaaat

SEQ ID NO: 817914 - DNA, 19 bp, Homo sapiens
cagtttaagtaattgccta

SEQ ID NO: 817915 - DNA, 23 bp, Homo sapiens
cagtttaccagttgccttttatc

SEQ ID NO: 817916 - DNA, 18 bp, Homo sapiens
cagtttagaacagaggga

SEQ ID NO: 817917 - DNA, 15 bp, Homo sapiens
cagtttagtgcttta

SEQ ID NO: 817918 - DNA, 18 bp, Homo sapiens
cagtttatattgtggaat

SEQ ID NO: 817919 - DNA, 18 bp, Homo sapiens
cagtttattctgtggttc

SEQ ID NO: 817920 - DNA, 14 bp, Homo sapiens
cagtttattgatat

SEQ ID NO: 817921 - DNA, 20 bp, Homo sapiens
cagtttatttccactatttt

SEQ ID NO: 817922 - DNA, 21 bp, Homo sapiens
cagtttatttttaaagataga

SEQ ID NO: 817923 - DNA, 17 bp, Homo sapiens
cagtttcacagaaaata

SEQ ID NO: 817924 - DNA, 20 bp, Homo sapiens
cagtttcactccctcttggt

SEQ ID NO: 817925 - DNA, 15 bp, Homo sapiens
cagtttcatgtatgt

SEQ ID NO: 817926 - DNA, 18 bp, Homo sapiens
cagtttcatgtatgtata

SEQ ID NO: 817927 - DNA, 12 bp, Homo sapiens
cagtttccaaat

SEQ ID NO: 817928 - DNA, 13 bp, Homo sapiens
cagtttccaaatt

SEQ ID NO: 817929 - DNA, 12 bp, Homo sapiens
cagtttcccctc

SEQ ID NO: 817930 - DNA, 15 bp, Homo sapiens
cagtttcccctctcg

SEQ ID NO: 817931 - DNA, 20 bp, Homo sapiens
cagtttccgaatctctttcc

SEQ ID NO: 817932 - DNA, 17 bp, Homo sapiens
cagtttctccatcagct

SEQ ID NO: 817933 - DNA, 14 bp, Homo sapiens
cagtttctccttga

SEQ ID NO: 817934 - DNA, 19 bp, Homo sapiens
cataatgataaaataaata

SEQ ID NO: 817935 - DNA, 23 bp, Homo sapiens
cataatgcgtgcataccactttt

SEQ ID NO: 817936 - DNA, 16 bp, Homo sapiens
cataatgctactgtct

SEQ ID NO: 817937 - DNA, 19 bp, Homo sapiens
cataatgctcccatctcct

SEQ ID NO: 817938 - DNA, 21 bp, Homo sapiens
cataatgctcccatctcctga

SEQ ID NO: 817939 - DNA, 22 bp, Homo sapiens
cataatgctcccatctcctgat

SEQ ID NO: 817940 - DNA, 21 bp, Homo sapiens
cataatgggccactgaaatct

SEQ ID NO: 817941 - DNA, 18 bp, Homo sapiens
cataatggttgtgaaatg

SEQ ID NO: 817942 - DNA, 20 bp, Homo sapiens
cataatggttgtgaaatgta

SEQ ID NO: 817943 - DNA, 18 bp, Homo sapiens
cataatgttacattatta

SEQ ID NO: 817944 - DNA, 23 bp, Homo sapiens
cataatgtttctggatttcatac

SEQ ID NO: 817945 - DNA, 16 bp, Homo sapiens
cataattacattccta

SEQ ID NO: 817946 - DNA, 17 bp, Homo sapiens
cataattacattcctaa

SEQ ID NO: 817947 - DNA, 19 bp, Homo sapiens
cataattacattcctaact

SEQ ID NO: 817948 - DNA, 21 bp, Homo sapiens
cataattatccaggaagggaa

SEQ ID NO: 817949 - DNA, 15 bp, Homo sapiens
cataattatgaaaac

SEQ ID NO: 817950 - DNA, 14 bp, Homo sapiens
cataattatgacag

SEQ ID NO: 817951 - DNA, 17 bp, Homo sapiens
cataattatgacagtta

SEQ ID NO: 817952 - DNA, 19 bp, Homo sapiens
cataattatgacagttata

SEQ ID NO: 817953 - DNA, 20 bp, Homo sapiens
cataattcagaactaaattt

SEQ ID NO: 817954 - DNA, 18 bp, Homo sapiens
cataattcagcacttaac

SEQ ID NO: 817955 - DNA, 22 bp, Homo sapiens
cataattccgaaacaaaactgt

SEQ ID NO: 817956 - DNA, 23 bp, Homo sapiens
cataattccgaaacaaaactgtg

SEQ ID NO: 817957 - DNA, 11 bp, Homo sapiens
cataattccta

SEQ ID NO: 817958 - DNA, 19 bp, Homo sapiens
cataattcctacagcacta

SEQ ID NO: 817959 - DNA, 17 bp, Homo sapiens
cataattcttgtatatt

SEQ ID NO: 817960 - DNA, 16 bp, Homo sapiens
cataattgattaaaat

SEQ ID NO: 817961 - DNA, 22 bp, Homo sapiens
cataattgattaaaatctcttg

SEQ ID NO: 817962 - DNA, 12 bp, Homo sapiens
cataattggaat

SEQ ID NO: 817963 - DNA, 13 bp, Homo sapiens
cataattgtggat

SEQ ID NO: 817964 - DNA, 17 bp, Homo sapiens
cataattgtggattata

SEQ ID NO: 817965 - DNA, 18 bp, Homo sapiens
cataatttaaaaatatat

SEQ ID NO: 817966 - DNA, 23 bp, Homo sapiens
cataatttgctggagaagtgtgt

SEQ ID NO: 817967 - DNA, 21 bp, Homo sapiens
cataatttgtacatatgtaaa

SEQ ID NO: 817968 - DNA, 23 bp, Homo sapiens
cataatttgtacatatgtaaaat

SEQ ID NO: 817969 - DNA, 14 bp, Homo sapiens
cataatttgtctta

SEQ ID NO: 817970 - DNA, 15 bp, Homo sapiens
cataatttgtttaaa

SEQ ID NO: 817971 - DNA, 23 bp, Homo sapiens
cataattttagtaatttcctaga

SEQ ID NO: 817972 - DNA, 17 bp, Homo sapiens
cataatttttgtacatc

SEQ ID NO: 817973 - DNA, 20 bp, Homo sapiens
cataatttttgtacatccca

SEQ ID NO: 817974 - DNA, 21 bp, Homo sapiens
cataatttttgtacatcccaa

SEQ ID NO: 817975 - DNA, 19 bp, Homo sapiens
cataattttttttaaagaa

SEQ ID NO: 817976 - DNA, 17 bp, Homo sapiens
catacaacacaaagaga

SEQ ID NO: 817977 - DNA, 17 bp, Homo sapiens
catacaagaaaatgtat

SEQ ID NO: 817978 - DNA, 20 bp, Homo sapiens
catacaaggacattcactgc

SEQ ID NO: 817979 - DNA, 22 bp, Homo sapiens
catacaaggacattcactgctg

SEQ ID NO: 817980 - DNA, 17 bp, Homo sapiens
catacaataaaagagct

SEQ ID NO: 817981 - DNA, 19 bp, Homo sapiens
catacaataaaagagcttt

SEQ ID NO: 817982 - DNA, 20 bp, Homo sapiens
catacaataaaagagcttta

SEQ ID NO: 817983 - DNA, 15 bp, Homo sapiens
catacaatgtatgta

SEQ ID NO: 817984 - DNA, 18 bp, Homo sapiens
catacaatgtatgtacaa

SEQ ID NO: 817985 - DNA, 20 bp, Homo sapiens
catacaatgtatgtacaata

SEQ ID NO: 817986 - DNA, 10 bp, Homo sapiens
catacacaca

SEQ ID NO: 817987 - DNA, 15 bp, Homo sapiens
catacacacagcagt

SEQ ID NO: 817988 - DNA, 19 bp, Homo sapiens
catacacacatgccctcct

SEQ ID NO: 817989 - DNA, 21 bp, Homo sapiens
catacacacatgccctcctgg

SEQ ID NO: 817990 - DNA, 13 bp, Homo sapiens
catacaccagcat

SEQ ID NO: 817991 - DNA, 20 bp, Homo sapiens
catacaccagcattcctttt

SEQ ID NO: 817992 - DNA, 14 bp, Homo sapiens
catacacctcgtca

SEQ ID NO: 817993 - DNA, 18 bp, Homo sapiens
catacacgcaaatacact

SEQ ID NO: 817994 - DNA, 23 bp, Homo sapiens
catacacttattggaactctgct

SEQ ID NO: 817995 - DNA, 16 bp, Homo sapiens
catacagaaagaagca

SEQ ID NO: 817996 - DNA, 13 bp, Homo sapiens
catacagacacat

SEQ ID NO: 817997 - DNA, 19 bp, Homo sapiens
catacagaggatgcctttt

SEQ ID NO: 817998 - DNA, 22 bp, Homo sapiens
catacagaggatgccttttctg

SEQ ID NO: 817999 - DNA, 13 bp, Homo sapiens
catacagttttca

SEQ ID NO: 818000 - DNA, 23 bp, Homo sapiens
catacagttttcattgattatat

SEQ ID NO: 818001 - DNA, 13 bp, Homo sapiens
catacagttttct

SEQ ID NO: 818002 - DNA, 13 bp, Homo sapiens
catacataaaaga

SEQ ID NO: 818003 - DNA, 14 bp, Homo sapiens
catacataaaagaa

SEQ ID NO: 818004 - DNA, 15 bp, Homo sapiens
catacataaaagaaa

SEQ ID NO: 818005 - DNA, 20 bp, Homo sapiens
catacatacacatacataca

SEQ ID NO: 818006 - DNA, 11 bp, Homo sapiens
catacatacat

SEQ ID NO: 818007 - DNA, 14 bp, Homo sapiens
catacatacataca

SEQ ID NO: 818008 - DNA, 18 bp, Homo sapiens
catacatacatacatata

SEQ ID NO: 818009 - DNA, 14 bp, Homo sapiens
catacatacatata

SEQ ID NO: 818010 - DNA, 20 bp, Homo sapiens
catacatatatatatttgta

SEQ ID NO: 818011 - DNA, 16 bp, Homo sapiens
catacatatatatctg

SEQ ID NO: 818012 - DNA, 18 bp, Homo sapiens
catacatgatacattttt

SEQ ID NO: 818013 - DNA, 21 bp, Homo sapiens
catacattccctctaatttga

SEQ ID NO: 818014 - DNA, 23 bp, Homo sapiens
catacattgtataggccatctgt

SEQ ID NO: 818015 - DNA, 14 bp, Homo sapiens
cataccacttttgt

SEQ ID NO: 818016 - DNA, 15 bp, Homo sapiens
cataccacttttgtt

SEQ ID NO: 818017 - DNA, 19 bp, Homo sapiens
cataccacttttgttcttg

SEQ ID NO: 818018 - DNA, 18 bp, Homo sapiens
catacccacacattccag

SEQ ID NO: 818019 - DNA, 22 bp, Homo sapiens
cataccccttattgctgccaaa

SEQ ID NO: 818020 - DNA, 19 bp, Homo sapiens
catacccgcctagctgctg

SEQ ID NO: 818021 - DNA, 22 bp, Homo sapiens
catacccgcctagctgctgtca

SEQ ID NO: 818022 - DNA, 22 bp, Homo sapiens
cataccgaccatcgtccagccc

SEQ ID NO: 818023 - DNA, 16 bp, Homo sapiens
catacctaccagtatt

SEQ ID NO: 818024 - DNA, 15 bp, Homo sapiens
catacctgcccctgc

SEQ ID NO: 818025 - DNA, 23 bp, Homo sapiens
cataccttccttccctgggctgt

SEQ ID NO: 818026 - DNA, 22 bp, Homo sapiens
cataccttctggttgcttcaga

SEQ ID NO: 818027 - DNA, 22 bp, Homo sapiens
catacctttccagggtcaaagt

SEQ ID NO: 818028 - DNA, 18 bp, Homo sapiens
catacgtacacattttat

SEQ ID NO: 818029 - DNA, 13 bp, Homo sapiens
catacgtctgcca

SEQ ID NO: 818030 - DNA, 14 bp, Homo sapiens
catacgtgcacagg

SEQ ID NO: 818031 - DNA, 16 bp, Homo sapiens
catacgtgcacagggt

SEQ ID NO: 818032 - DNA, 14 bp, Homo sapiens
catactaaccagca

SEQ ID NO: 818033 - DNA, 21 bp, Homo sapiens
catactaatgatgagcattta

SEQ ID NO: 818034 - DNA, 17 bp, Homo sapiens
catactaccctttgctg

SEQ ID NO: 818035 - DNA, 23 bp, Homo sapiens
catactaccctttgctggaagaa

SEQ ID NO: 818036 - DNA, 14 bp, Homo sapiens
catactcaaatggt

SEQ ID NO: 818037 - DNA, 18 bp, Homo sapiens
catactcaaatggtgtca

SEQ ID NO: 818038 - DNA, 14 bp, Homo sapiens
catactcagcctgc

SEQ ID NO: 818039 - DNA, 17 bp, Homo sapiens
catactcagcctgctgc

SEQ ID NO: 818040 - DNA, 18 bp, Homo sapiens
catactcagcctgctgcc

SEQ ID NO: 818041 - DNA, 19 bp, Homo sapiens
catactcagcctgctgccc

SEQ ID NO: 818042 - DNA, 21 bp, Homo sapiens
catactcagcctgctgcccag

SEQ ID NO: 818043 - DNA, 22 bp, Homo sapiens
catactcatttttcatgataat

SEQ ID NO: 818044 - DNA, 17 bp, Homo sapiens
catactgaaaatccaat

SEQ ID NO: 818045 - DNA, 19 bp, Homo sapiens
catactgagccaagtataa

SEQ ID NO: 818046 - DNA, 12 bp, Homo sapiens
catactgagcct

SEQ ID NO: 818047 - DNA, 13 bp, Homo sapiens
catactgagcctg

SEQ ID NO: 818048 - DNA, 14 bp, Homo sapiens
catactgagcctgc

SEQ ID NO: 818049 - DNA, 20 bp, Homo sapiens
catactgattgggaggtgcg

SEQ ID NO: 818050 - DNA, 23 bp, Homo sapiens
catactgattgggaggtgcgtgt

SEQ ID NO: 818051 - DNA, 16 bp, Homo sapiens
catactgcctactgtt

SEQ ID NO: 818052 - DNA, 15 bp, Homo sapiens
catactggcctctgt

SEQ ID NO: 818053 - DNA, 18 bp, Homo sapiens
catactggcctctgtgat

SEQ ID NO: 818054 - DNA, 23 bp, Homo sapiens
catactggcctctgtgattacat

SEQ ID NO: 818055 - DNA, 23 bp, Homo sapiens
catcaaagaggctgaggctggca

SEQ ID NO: 818056 - DNA, 22 bp, Homo sapiens
catcaaaggaatataagaaaag

SEQ ID NO: 818057 - DNA, 23 bp, Homo sapiens
catcaaagtggtaaatactgtga

SEQ ID NO: 818058 - DNA, 13 bp, Homo sapiens
catcaaataaatt

SEQ ID NO: 818059 - DNA, 12 bp, Homo sapiens
catcaactgaat

SEQ ID NO: 818060 - DNA, 14 bp, Homo sapiens
catcaacttaaaag

SEQ ID NO: 818061 - DNA, 13 bp, Homo sapiens
catcaagaagggc

SEQ ID NO: 818062 - DNA, 20 bp, Homo sapiens
catcaagaagggctgcatga

SEQ ID NO: 818063 - DNA, 22 bp, Homo sapiens
catcaagaagggctgcatgatg

SEQ ID NO: 818064 - DNA, 17 bp, Homo sapiens
catcaagactatctaca

SEQ ID NO: 818065 - DNA, 23 bp, Homo sapiens
catcaagcatgcaataatgtgca

SEQ ID NO: 818066 - DNA, 16 bp, Homo sapiens
catcaaggtccagtgg

SEQ ID NO: 818067 - DNA, 19 bp, Homo sapiens
catcaatcaaataagtatt

SEQ ID NO: 818068 - DNA, 12 bp, Homo sapiens
catcaatcttgt

SEQ ID NO: 818069 - DNA, 19 bp, Homo sapiens
catcaatcttgttactgct

SEQ ID NO: 818070 - DNA, 11 bp, Homo sapiens
catcaatgttc

SEQ ID NO: 818071 - DNA, 18 bp, Homo sapiens
catcaatgttcattgtaa

SEQ ID NO: 818072 - DNA, 18 bp, Homo sapiens
catcaattaacatcgtgg

SEQ ID NO: 818073 - DNA, 15 bp, Homo sapiens
catcacacctgccct

SEQ ID NO: 818074 - DNA, 13 bp, Homo sapiens
catcacagcccag

SEQ ID NO: 818075 - DNA, 16 bp, Homo sapiens
catcacagcccagccc

SEQ ID NO: 818076 - DNA, 17 bp, Homo sapiens
catcacagcccagcccg

SEQ ID NO: 818077 - DNA, 13 bp, Homo sapiens
catcacagggcag

SEQ ID NO: 818078 - DNA, 15 bp, Homo sapiens
catcacagggcagag

SEQ ID NO: 818079 - DNA, 19 bp, Homo sapiens
catcacagggttgggccca

SEQ ID NO: 818080 - DNA, 22 bp, Homo sapiens
catcacagggttgggcccagat

SEQ ID NO: 818081 - DNA, 22 bp, Homo sapiens
catcacattccagtctgaagtg

SEQ ID NO: 818082 - DNA, 15 bp, Homo sapiens
catcaccaccgcctc

SEQ ID NO: 818083 - DNA, 13 bp, Homo sapiens
catcaccaggtgc

SEQ ID NO: 818084 - DNA, 19 bp, Homo sapiens
catcaccaggtgcatctgc

SEQ ID NO: 818085 - DNA, 22 bp, Homo sapiens
catcaccatcgtgtttgcaaag

SEQ ID NO: 818086 - DNA, 15 bp, Homo sapiens
catcaccccagaggc

SEQ ID NO: 818087 - DNA, 23 bp, Homo sapiens
catcacccgcccctggacttctt

SEQ ID NO: 818088 - DNA, 21 bp, Homo sapiens
catcaccctgggagtttcctg

SEQ ID NO: 818089 - DNA, 16 bp, Homo sapiens
catcaccgctgggtgg

SEQ ID NO: 818090 - DNA, 11 bp, Homo sapiens
catcacctcac

SEQ ID NO: 818091 - DNA, 12 bp, Homo sapiens
catcacctcagg

SEQ ID NO: 818092 - DNA, 13 bp, Homo sapiens
catcacctcaggc

SEQ ID NO: 818093 - DNA, 16 bp, Homo sapiens
catcacctgaaacact

SEQ ID NO: 818094 - DNA, 21 bp, Homo sapiens
catcacctgaaacactggacc

SEQ ID NO: 818095 - DNA, 16 bp, Homo sapiens
catcaccttcctgaat

SEQ ID NO: 818096 - DNA, 21 bp, Homo sapiens
catcacggatggtgcatgggc

SEQ ID NO: 818097 - DNA, 18 bp, Homo sapiens
catcacgtaccccactgg

SEQ ID NO: 818098 - DNA, 16 bp, Homo sapiens
catcacgtcagtgctc

SEQ ID NO: 818099 - DNA, 15 bp, Homo sapiens
catcactagaagaaa

SEQ ID NO: 818100 - DNA, 23 bp, Homo sapiens
catcactagaagaaaagcccatt

SEQ ID NO: 818101 - DNA, 16 bp, Homo sapiens
catcactcagccccta

SEQ ID NO: 818102 - DNA, 16 bp, Homo sapiens
catcactctgctgctt

SEQ ID NO: 818103 - DNA, 16 bp, Homo sapiens
catcactgcgccactg

SEQ ID NO: 818104 - DNA, 20 bp, Homo sapiens
catcactgcttgatgaagca

SEQ ID NO: 818105 - DNA, 19 bp, Homo sapiens
catcactggagcaccaggc

SEQ ID NO: 818106 - DNA, 23 bp, Homo sapiens
catcactggtccaggtcttcagt

SEQ ID NO: 818107 - DNA, 12 bp, Homo sapiens
catcacttccct

SEQ ID NO: 818108 - DNA, 17 bp, Homo sapiens
catcacttcttccactg

SEQ ID NO: 818109 - DNA, 11 bp, Homo sapiens
catcagaagga

SEQ ID NO: 818110 - DNA, 16 bp, Homo sapiens
catcagaatgttaatt

SEQ ID NO: 818111 - DNA, 18 bp, Homo sapiens
catcagaatgttaattta

SEQ ID NO: 818112 - DNA, 12 bp, Homo sapiens
catcagacctgt

SEQ ID NO: 818113 - DNA, 20 bp, Homo sapiens
catcagacctgtcttccaag

SEQ ID NO: 818114 - DNA, 21 bp, Homo sapiens
catcagagagtgtacatcatg

SEQ ID NO: 818115 - DNA, 17 bp, Homo sapiens
catcagataacaactgt

SEQ ID NO: 818116 - DNA, 16 bp, Homo sapiens
catcagatgtgttcct

SEQ ID NO: 818117 - DNA, 14 bp, Homo sapiens
catcagattgttaa

SEQ ID NO: 818118 - DNA, 17 bp, Homo sapiens
catcagcacgatttctg

SEQ ID NO: 818119 - DNA, 23 bp, Homo sapiens
catcagccagctaccccttgtgg

SEQ ID NO: 818120 - DNA, 21 bp, Homo sapiens
catcagccagtgaatctgttt

SEQ ID NO: 818121 - DNA, 16 bp, Homo sapiens
catcagccccacagga

SEQ ID NO: 818122 - DNA, 15 bp, Homo sapiens
catcagcccctggga

SEQ ID NO: 818123 - DNA, 13 bp, Homo sapiens
catcagcctgctt

SEQ ID NO: 818124 - DNA, 15 bp, Homo sapiens
catcagcctgcttct

SEQ ID NO: 818125 - DNA, 16 bp, Homo sapiens
catcagcgtagtgttt

SEQ ID NO: 818126 - DNA, 15 bp, Homo sapiens
catcagctcaaaatt

SEQ ID NO: 818127 - DNA, 13 bp, Homo sapiens
catcagctcccaa

SEQ ID NO: 818128 - DNA, 13 bp, Homo sapiens
catcaggcactgg

SEQ ID NO: 818129 - DNA, 14 bp, Homo sapiens
catcaggcactggt

SEQ ID NO: 818130 - DNA, 16 bp, Homo sapiens
catcaggcactggtgg

SEQ ID NO: 818131 - DNA, 16 bp, Homo sapiens
catcaggctctgttcc

SEQ ID NO: 818132 - DNA, 18 bp, Homo sapiens
catcaggctgttattatg

SEQ ID NO: 818133 - DNA, 12 bp, Homo sapiens
catcagggacag

SEQ ID NO: 818134 - DNA, 13 bp, Homo sapiens
catcagggccctg

SEQ ID NO: 818135 - DNA, 14 bp, Homo sapiens
catcagggccctgc

SEQ ID NO: 818136 - DNA, 23 bp, Homo sapiens
catcagggccctgccccaggcct

SEQ ID NO: 818137 - DNA, 13 bp, Homo sapiens
catcagggcctgg

SEQ ID NO: 818138 - DNA, 22 bp, Homo sapiens
catcagggcctggggcctgaga

SEQ ID NO: 818139 - DNA, 19 bp, Homo sapiens
catcagggcctttctcctc

SEQ ID NO: 818140 - DNA, 18 bp, Homo sapiens
catcagggggaagaagca

SEQ ID NO: 818141 - DNA, 21 bp, Homo sapiens
catcagggggaagaagcagag

SEQ ID NO: 818142 - DNA, 12 bp, Homo sapiens
catcagggtggg

SEQ ID NO: 818143 - DNA, 23 bp, Homo sapiens
catcagggtgggccactctcccc

SEQ ID NO: 818144 - DNA, 15 bp, Homo sapiens
catcaggtgaggtgt

SEQ ID NO: 818145 - DNA, 17 bp, Homo sapiens
catcaggttccatcccg

SEQ ID NO: 818146 - DNA, 20 bp, Homo sapiens
catcagtagcatttttctaa

SEQ ID NO: 818147 - DNA, 15 bp, Homo sapiens
catcagtattctgcc

SEQ ID NO: 818148 - DNA, 17 bp, Homo sapiens
catcagtctccaacatg

SEQ ID NO: 818149 - DNA, 16 bp, Homo sapiens
catcagtgctccctca

SEQ ID NO: 818150 - DNA, 23 bp, Homo sapiens
catcagtgtctgtttcagaatct

SEQ ID NO: 818151 - DNA, 16 bp, Homo sapiens
catcagtgtgtaaata

SEQ ID NO: 818152 - DNA, 15 bp, Homo sapiens
catcagtgttaaaaa

SEQ ID NO: 818153 - DNA, 18 bp, Homo sapiens
catcagtgttaaaaaatt

SEQ ID NO: 818154 - DNA, 12 bp, Homo sapiens
catcataaaata

SEQ ID NO: 818155 - DNA, 13 bp, Homo sapiens
catcataaaataa

SEQ ID NO: 818156 - DNA, 19 bp, Homo sapiens
catcataaggaagttatta

SEQ ID NO: 818157 - DNA, 22 bp, Homo sapiens
catcatataaaaagcagcagag

SEQ ID NO: 818158 - DNA, 14 bp, Homo sapiens
catcatatgcctga

SEQ ID NO: 818159 - DNA, 14 bp, Homo sapiens
catcatattataca

SEQ ID NO: 818160 - DNA, 20 bp, Homo sapiens
catcatattctattgtttac

SEQ ID NO: 818161 - DNA, 12 bp, Homo sapiens
catcatattgta

SEQ ID NO: 818162 - DNA, 12 bp, Homo sapiens
catcatcagagc

SEQ ID NO: 818163 - DNA, 13 bp, Homo sapiens
catcatcagggcc

SEQ ID NO: 818164 - DNA, 16 bp, Homo sapiens
catcatccagatgtgg

SEQ ID NO: 818165 - DNA, 17 bp, Homo sapiens
catcatccagatgtggc

SEQ ID NO: 818166 - DNA, 15 bp, Homo sapiens
catcatcccagctgc

SEQ ID NO: 818167 - DNA, 20 bp, Homo sapiens
catcatctcctgccttcctc

SEQ ID NO: 818168 - DNA, 21 bp, Homo sapiens
catcatcttagactttgcaag

SEQ ID NO: 818169 - DNA, 16 bp, Homo sapiens
catcatgcatcttact

SEQ ID NO: 818170 - DNA, 13 bp, Homo sapiens
catcatgcctgac

SEQ ID NO: 818171 - DNA, 16 bp, Homo sapiens
catcatgcttatgtta

SEQ ID NO: 818172 - DNA, 16 bp, Homo sapiens
catcatggaccaaatg

SEQ ID NO: 818173 - DNA, 21 bp, Homo sapiens
catcatggattcattacagct

SEQ ID NO: 818174 - DNA, 12 bp, Homo sapiens
catcatgtctgt

SEQ ID NO: 818175 - DNA, 22 bp, Homo sapiens
catcatgtggccccacccaatc

SEQ ID NO: 818176 - DNA, 17 bp, Homo sapiens
catcattacccttccct

SEQ ID NO: 818177 - DNA, 20 bp, Homo sapiens
catcattacccttccctgca

SEQ ID NO: 818178 - DNA, 18 bp, Homo sapiens
catccccctctcacgcca

SEQ ID NO: 818179 - DNA, 12 bp, Homo sapiens
catccccctgcc

SEQ ID NO: 818180 - DNA, 13 bp, Homo sapiens
catccccctgccc

SEQ ID NO: 818181 - DNA, 19 bp, Homo sapiens
catccccctgccctcgtgg

SEQ ID NO: 818182 - DNA, 19 bp, Homo sapiens
catccccgcagtgtgcact

SEQ ID NO: 818183 - DNA, 20 bp, Homo sapiens
catcccctcaacaccctgct

SEQ ID NO: 818184 - DNA, 14 bp, Homo sapiens
catcccctccctgc

SEQ ID NO: 818185 - DNA, 17 bp, Homo sapiens
catcccctccctgcctg

SEQ ID NO: 818186 - DNA, 14 bp, Homo sapiens
catcccctggactg

SEQ ID NO: 818187 - DNA, 14 bp, Homo sapiens
catccccttccccc

SEQ ID NO: 818188 - DNA, 15 bp, Homo sapiens
catccccttccccca

SEQ ID NO: 818189 - DNA, 21 bp, Homo sapiens
catccccttcccccatcccta

SEQ ID NO: 818190 - DNA, 15 bp, Homo sapiens
catcccctttcctcc

SEQ ID NO: 818191 - DNA, 21 bp, Homo sapiens
catcccgaagccatcacttct

SEQ ID NO: 818192 - DNA, 15 bp, Homo sapiens
catcccgcttagcct

SEQ ID NO: 818193 - DNA, 17 bp, Homo sapiens
catcccgcttagcctgc

SEQ ID NO: 818194 - DNA, 18 bp, Homo sapiens
catcccgcttagcctgcc

SEQ ID NO: 818195 - DNA, 20 bp, Homo sapiens
catcccgcttagcctgcctc

SEQ ID NO: 818196 - DNA, 22 bp, Homo sapiens
catcccgcttagcctgcctcac

SEQ ID NO: 818197 - DNA, 15 bp, Homo sapiens
catcccggaggaaat

SEQ ID NO: 818198 - DNA, 16 bp, Homo sapiens
catcccggcctcttcc

SEQ ID NO: 818199 - DNA, 14 bp, Homo sapiens
catccctaccactg

SEQ ID NO: 818200 - DNA, 14 bp, Homo sapiens
catccctaccccct

SEQ ID NO: 818201 - DNA, 20 bp, Homo sapiens
catccctagaagagcacaga

SEQ ID NO: 818202 - DNA, 13 bp, Homo sapiens
catccctccccag

SEQ ID NO: 818203 - DNA, 16 bp, Homo sapiens
catccctcccccagca

SEQ ID NO: 818204 - DNA, 24 bp, Homo sapiens
catccctgagcaggaaagtttacc

SEQ ID NO: 818205 - DNA, 17 bp, Homo sapiens
catccctgaggagccag

SEQ ID NO: 818206 - DNA, 18 bp, Homo sapiens
catccctgaggagccagg

SEQ ID NO: 818207 - DNA, 15 bp, Homo sapiens
catccctgctctggt

SEQ ID NO: 818208 - DNA, 18 bp, Homo sapiens
catccctgcttgcccgct

SEQ ID NO: 818209 - DNA, 18 bp, Homo sapiens
catccctggagcaggagc

SEQ ID NO: 818210 - DNA, 20 bp, Homo sapiens
catccctgggggccttgggt

SEQ ID NO: 818211 - DNA, 13 bp, Homo sapiens
catcccttcctgg

SEQ ID NO: 818212 - DNA, 20 bp, Homo sapiens
catcccttcctggaaacagc

SEQ ID NO: 818213 - DNA, 15 bp, Homo sapiens
catccctttctccca

SEQ ID NO: 818214 - DNA, 22 bp, Homo sapiens
catcccttttcctttctggccc

SEQ ID NO: 818215 - DNA, 16 bp, Homo sapiens
catccctttttgaagt

SEQ ID NO: 818216 - DNA, 16 bp, Homo sapiens
catccctttttttaca

SEQ ID NO: 818217 - DNA, 15 bp, Homo sapiens
catccgactgcccct

SEQ ID NO: 818218 - DNA, 15 bp, Homo sapiens
catccgaggcagggt

SEQ ID NO: 818219 - DNA, 22 bp, Homo sapiens
catccgaggcagggtcaggaga

SEQ ID NO: 818220 - DNA, 23 bp, Homo sapiens
catccgaggcagggtcaggagag

SEQ ID NO: 818221 - DNA, 20 bp, Homo sapiens
catccggtcccctgcctgga

SEQ ID NO: 818222 - DNA, 18 bp, Homo sapiens
catccggtggcctattcc

SEQ ID NO: 818223 - DNA, 16 bp, Homo sapiens
catccgtagttccctg

SEQ ID NO: 818224 - DNA, 19 bp, Homo sapiens
catccgtcattgctgctgc

SEQ ID NO: 818225 - DNA, 14 bp, Homo sapiens
catccgtcctgggc

SEQ ID NO: 818226 - DNA, 16 bp, Homo sapiens
catcctaaaagccacc

SEQ ID NO: 818227 - DNA, 18 bp, Homo sapiens
catcctacaagacacagt

SEQ ID NO: 818228 - DNA, 14 bp, Homo sapiens
catcctaccaatgc

SEQ ID NO: 818229 - DNA, 16 bp, Homo sapiens
catcctacccagcgtg

SEQ ID NO: 818230 - DNA, 19 bp, Homo sapiens
catcctacccagcgtggcc

SEQ ID NO: 818231 - DNA, 13 bp, Homo sapiens
catcctaccctcg

SEQ ID NO: 818232 - DNA, 15 bp, Homo sapiens
catcctaccctcggg

SEQ ID NO: 818233 - DNA, 21 bp, Homo sapiens
catcctaccctcgggcccacc

SEQ ID NO: 818234 - DNA, 14 bp, Homo sapiens
catcctatttggtg

SEQ ID NO: 818235 - DNA, 14 bp, Homo sapiens
catcctcaaagaaa

SEQ ID NO: 818236 - DNA, 20 bp, Homo sapiens
catcctcaaagaaagtgtat

SEQ ID NO: 818237 - DNA, 18 bp, Homo sapiens
catcctcacccagatcag

SEQ ID NO: 818238 - DNA, 19 bp, Homo sapiens
catcctcacccagatcagg

SEQ ID NO: 818239 - DNA, 23 bp, Homo sapiens
catcctcacccagatcaggaacc

SEQ ID NO: 818240 - DNA, 15 bp, Homo sapiens
catcctcagaggctg

SEQ ID NO: 818241 - DNA, 23 bp, Homo sapiens
catcctcagaggctgagccctgt

SEQ ID NO: 818242 - DNA, 16 bp, Homo sapiens
catcctcatccctgac

SEQ ID NO: 818243 - DNA, 18 bp, Homo sapiens
catcctcattgcctcctg

SEQ ID NO: 818244 - DNA, 18 bp, Homo sapiens
catcctccacgttctgct

SEQ ID NO: 818245 - DNA, 21 bp, Homo sapiens
catcctccacgttctgctcat

SEQ ID NO: 818246 - DNA, 16 bp, Homo sapiens
catcctccagcaggga

SEQ ID NO: 818247 - DNA, 17 bp, Homo sapiens
catcctccagccctgcc

SEQ ID NO: 818248 - DNA, 12 bp, Homo sapiens
catcctccagct

SEQ ID NO: 818249 - DNA, 17 bp, Homo sapiens
catcctccagcttctgg

SEQ ID NO: 818250 - DNA, 22 bp, Homo sapiens
catcctccccagcgccatctgt

SEQ ID NO: 818251 - DNA, 14 bp, Homo sapiens
catcctccccttcc

SEQ ID NO: 818252 - DNA, 20 bp, Homo sapiens
catcctccccttccctgcaa

SEQ ID NO: 818253 - DNA, 12 bp, Homo sapiens
catcctccctcc

SEQ ID NO: 818254 - DNA, 20 bp, Homo sapiens
catcctcccttgccccaggc

SEQ ID NO: 818255 - DNA, 18 bp, Homo sapiens
catcctcctcagccccca

SEQ ID NO: 818256 - DNA, 14 bp, Homo sapiens
catcctcctgccca

SEQ ID NO: 818257 - DNA, 21 bp, Homo sapiens
catcctcctggaaccttgctg

SEQ ID NO: 818258 - DNA, 14 bp, Homo sapiens
catcctcctttcag

SEQ ID NO: 818259 - DNA, 19 bp, Homo sapiens
catcctctaaagcagaggc

SEQ ID NO: 818260 - DNA, 19 bp, Homo sapiens
catcctgaccaagactgag

SEQ ID NO: 818261 - DNA, 19 bp, Homo sapiens
catcctgaccagctgctcc

SEQ ID NO: 818262 - DNA, 12 bp, Homo sapiens
catcctgagccc

SEQ ID NO: 818263 - DNA, 19 bp, Homo sapiens
catcctgagccccgccctc

SEQ ID NO: 818264 - DNA, 20 bp, Homo sapiens
catcctgagccccgccctct

SEQ ID NO: 818265 - DNA, 13 bp, Homo sapiens
catcctgaggcca

SEQ ID NO: 818266 - DNA, 15 bp, Homo sapiens
catcctgcaaaggcc

SEQ ID NO: 818267 - DNA, 17 bp, Homo sapiens
catcctgcaaaggccct

SEQ ID NO: 818268 - DNA, 11 bp, Homo sapiens
catcctgcaag

SEQ ID NO: 818269 - DNA, 16 bp, Homo sapiens
catcctgcaaggtgaa

SEQ ID NO: 818270 - DNA, 12 bp, Homo sapiens
catcctgcagcc

SEQ ID NO: 818271 - DNA, 17 bp, Homo sapiens
catcctgccatcctcaa

SEQ ID NO: 818272 - DNA, 20 bp, Homo sapiens
catcctgctcttttgtgatg

SEQ ID NO: 818273 - DNA, 10 bp, Homo sapiens
catcctgctg

SEQ ID NO: 818274 - DNA, 18 bp, Homo sapiens
catcctgcttctcttttc

SEQ ID NO: 818275 - DNA, 15 bp, Homo sapiens
catcctggcacgccc

SEQ ID NO: 818276 - DNA, 17 bp, Homo sapiens
catcctggcacgcccta

SEQ ID NO: 818277 - DNA, 21 bp, Homo sapiens
catcctggcacgccctactcc

SEQ ID NO: 818278 - DNA, 12 bp, Homo sapiens
catcctggccaa

SEQ ID NO: 818279 - DNA, 13 bp, Homo sapiens
catcctggccaac

SEQ ID NO: 818280 - DNA, 15 bp, Homo sapiens
catcctggcccctcc

SEQ ID NO: 818281 - DNA, 15 bp, Homo sapiens
catcctggggcagca

SEQ ID NO: 818282 - DNA, 17 bp, Homo sapiens
catcctggggcagcact

SEQ ID NO: 818283 - DNA, 20 bp, Homo sapiens
catcctggggcagcactccc

SEQ ID NO: 818284 - DNA, 18 bp, Homo sapiens
catcctgtagggcaccca

SEQ ID NO: 818285 - DNA, 12 bp, Homo sapiens
catcctgtgtcc

SEQ ID NO: 818286 - DNA, 21 bp, Homo sapiens
catcctgtgtcccctgacctg

SEQ ID NO: 818287 - DNA, 15 bp, Homo sapiens
catcctgtgtttcta

SEQ ID NO: 818288 - DNA, 22 bp, Homo sapiens
catcctgtgtttctagggaaat

SEQ ID NO: 818289 - DNA, 12 bp, Homo sapiens
catcctgtttga

SEQ ID NO: 818290 - DNA, 23 bp, Homo sapiens
catcctgtttgtatgaaattata

SEQ ID NO: 818291 - DNA, 14 bp, Homo sapiens
catcctgttttctc

SEQ ID NO: 818292 - DNA, 16 bp, Homo sapiens
catccttacaatgtaa

SEQ ID NO: 818293 - DNA, 17 bp, Homo sapiens
catccttacaatgtaaa

SEQ ID NO: 818294 - DNA, 21 bp, Homo sapiens
catccttcaagaactctgggc

SEQ ID NO: 818295 - DNA, 22 bp, Homo sapiens
catccttcaagaactctgggct

SEQ ID NO: 818296 - DNA, 12 bp, Homo sapiens
catccttcccca

SEQ ID NO: 818297 - DNA, 15 bp, Homo sapiens
catccttccccaact

SEQ ID NO: 818298 - DNA, 15 bp, Homo sapiens
catccttccttccca

SEQ ID NO: 818299 - DNA, 15 bp, Homo sapiens
catccttctcactgc

SEQ ID NO: 818300 - DNA, 16 bp, Homo sapiens
catccttctcactgcc

SEQ ID NO: 818301 - DNA, 12 bp, Homo sapiens
catcttgctacc

SEQ ID NO: 818302 - DNA, 14 bp, Homo sapiens
catcttgctaccag

SEQ ID NO: 818303 - DNA, 17 bp, Homo sapiens
catcttgctaccagtat

SEQ ID NO: 818304 - DNA, 14 bp, Homo sapiens
catcttgctctgca

SEQ ID NO: 818305 - DNA, 13 bp, Homo sapiens
catcttgctggct

SEQ ID NO: 818306 - DNA, 15 bp, Homo sapiens
catcttgcttcccta

SEQ ID NO: 818307 - DNA, 16 bp, Homo sapiens
catcttggagggacca

SEQ ID NO: 818308 - DNA, 20 bp, Homo sapiens
catcttgttggtacctttct

SEQ ID NO: 818309 - DNA, 21 bp, Homo sapiens
catcttgttggtacctttcta

SEQ ID NO: 818310 - DNA, 22 bp, Homo sapiens
catctttaaggtattgtgcatc

SEQ ID NO: 818311 - DNA, 15 bp, Homo sapiens
catctttacgtactg

SEQ ID NO: 818312 - DNA, 17 bp, Homo sapiens
catctttacgtactgta

SEQ ID NO: 818313 - DNA, 12 bp, Homo sapiens
catctttcacat

SEQ ID NO: 818314 - DNA, 12 bp, Homo sapiens
catctttccctg

SEQ ID NO: 818315 - DNA, 15 bp, Homo sapiens
catctttgccatatg

SEQ ID NO: 818316 - DNA, 15 bp, Homo sapiens
catctttgccttggg

SEQ ID NO: 818317 - DNA, 22 bp, Homo sapiens
catctttgccttgggctgctcc

SEQ ID NO: 818318 - DNA, 17 bp, Homo sapiens
catctttgtttttaaaa

SEQ ID NO: 818319 - DNA, 18 bp, Homo sapiens
catctttgtttttaaaat

SEQ ID NO: 818320 - DNA, 13 bp, Homo sapiens
catcttttacatt

SEQ ID NO: 818321 - DNA, 21 bp, Homo sapiens
catcttttatagacgctcttt

SEQ ID NO: 818322 - DNA, 13 bp, Homo sapiens
catcttttctaat

SEQ ID NO: 818323 - DNA, 14 bp, Homo sapiens
catcttttgaagag

SEQ ID NO: 818324 - DNA, 15 bp, Homo sapiens
catcttttgtattaa

SEQ ID NO: 818325 - DNA, 14 bp, Homo sapiens
catcttttgtgaga

SEQ ID NO: 818326 - DNA, 21 bp, Homo sapiens
catcttttgtgagatgtaatt

SEQ ID NO: 818327 - DNA, 21 bp, Homo sapiens
catctttttctagagttatct

SEQ ID NO: 818328 - DNA, 22 bp, Homo sapiens
catctttttctttttaacccta

SEQ ID NO: 818329 - DNA, 14 bp, Homo sapiens
catgaaaaacaaac

SEQ ID NO: 818330 - DNA, 20 bp, Homo sapiens
catgaaaaatcatgggccag

SEQ ID NO: 818331 - DNA, 14 bp, Homo sapiens
catgaaaacacatt

SEQ ID NO: 818332 - DNA, 16 bp, Homo sapiens
catgaaaacacatttt

SEQ ID NO: 818333 - DNA, 19 bp, Homo sapiens
catgaaaattttaaaaata

SEQ ID NO: 818334 - DNA, 13 bp, Homo sapiens
catgaaacaaagc

SEQ ID NO: 818335 - DNA, 23 bp, Homo sapiens
catgaaacggaggcagatggaga

SEQ ID NO: 818336 - DNA, 19 bp, Homo sapiens
catgaaaggttaaaaaagc

SEQ ID NO: 818337 - DNA, 16 bp, Homo sapiens
catgaaagttttgcaa

SEQ ID NO: 818338 - DNA, 20 bp, Homo sapiens
catgaaagttttgcaaaggg

SEQ ID NO: 818339 - DNA, 18 bp, Homo sapiens
catgaaataaaatatatc

SEQ ID NO: 818340 - DNA, 13 bp, Homo sapiens
catgaaatgccct

SEQ ID NO: 818341 - DNA, 23 bp, Homo sapiens
catgaaatgccctcctaaatgtc

SEQ ID NO: 818342 - DNA, 17 bp, Homo sapiens
catgaaatgtggaagtc

SEQ ID NO: 818343 - DNA, 16 bp, Homo sapiens
catgaacacactgtgt

SEQ ID NO: 818344 - DNA, 12 bp, Homo sapiens
catgaacagctc

SEQ ID NO: 818345 - DNA, 13 bp, Homo sapiens
catgaacagctct

SEQ ID NO: 818346 - DNA, 14 bp, Homo sapiens
catgaacagctctg

SEQ ID NO: 818347 - DNA, 19 bp, Homo sapiens
catgaacagctctgagatc

SEQ ID NO: 818348 - DNA, 20 bp, Homo sapiens
catgaacagctctgagatcc

SEQ ID NO: 818349 - DNA, 15 bp, Homo sapiens
catgaaccaaatggt

SEQ ID NO: 818350 - DNA, 23 bp, Homo sapiens
catgaaccaaatggttcttactt

SEQ ID NO: 818351 - DNA, 23 bp, Homo sapiens
catgaactacgtgacctctgcaa

SEQ ID NO: 818352 - DNA, 17 bp, Homo sapiens
catgaagaatgtttctg

SEQ ID NO: 818353 - DNA, 17 bp, Homo sapiens
catgaagacaggacagt

SEQ ID NO: 818354 - DNA, 17 bp, Homo sapiens
catgaagaccacatcca

SEQ ID NO: 818355 - DNA, 21 bp, Homo sapiens
catgaagagaagcaattttgg

SEQ ID NO: 818356 - DNA, 13 bp, Homo sapiens
catgaagagcttg

SEQ ID NO: 818357 - DNA, 14 bp, Homo sapiens
catgaagagcttgt

SEQ ID NO: 818358 - DNA, 17 bp, Homo sapiens
catgaagcaaactaact

SEQ ID NO: 818359 - DNA, 14 bp, Homo sapiens
catgaagcaggagg

SEQ ID NO: 818360 - DNA, 15 bp, Homo sapiens
catgaagcaggaggc

SEQ ID NO: 818361 - DNA, 19 bp, Homo sapiens
catgaagcaggaggccctt

SEQ ID NO: 818362 - DNA, 13 bp, Homo sapiens
catgaagccttgc

SEQ ID NO: 818363 - DNA, 22 bp, Homo sapiens
catgaagggaccctttgggggt

SEQ ID NO: 818364 - DNA, 13 bp, Homo sapiens
catgaagggctgg

SEQ ID NO: 818365 - DNA, 14 bp, Homo sapiens
catgaaggtaaata

SEQ ID NO: 818366 - DNA, 15 bp, Homo sapiens
catgaagtaatatgc

SEQ ID NO: 818367 - DNA, 19 bp, Homo sapiens
catgaagtaatatgcacac

SEQ ID NO: 818368 - DNA, 22 bp, Homo sapiens
catgaagtaatatgcacacatt

SEQ ID NO: 818369 - DNA, 13 bp, Homo sapiens
catgaataaaaca

SEQ ID NO: 818370 - DNA, 17 bp, Homo sapiens
catgaataacatttaaa

SEQ ID NO: 818371 - DNA, 22 bp, Homo sapiens
catgaataacatttaaattcca

SEQ ID NO: 818372 - DNA, 21 bp, Homo sapiens
catgaatatggttggagagcc

SEQ ID NO: 818373 - DNA, 23 bp, Homo sapiens
catgaatatggttggagagccct

SEQ ID NO: 818374 - DNA, 24 bp, Homo sapiens
catgaatatggttggagagccctg

SEQ ID NO: 818375 - DNA, 22 bp, Homo sapiens
catgaatggtatggaactctct

SEQ ID NO: 818376 - DNA, 18 bp, Homo sapiens
catgaattcccttttaat

SEQ ID NO: 818377 - DNA, 18 bp, Homo sapiens
catgaatttagaaatatt

SEQ ID NO: 818378 - DNA, 14 bp, Homo sapiens
catgaattttaaag

SEQ ID NO: 818379 - DNA, 14 bp, Homo sapiens
catgacaaaaataa

SEQ ID NO: 818380 - DNA, 20 bp, Homo sapiens
catgacaaaaataacactgt

SEQ ID NO: 818381 - DNA, 16 bp, Homo sapiens
catgacaacatgaaac

SEQ ID NO: 818382 - DNA, 13 bp, Homo sapiens
catgacaactttt

SEQ ID NO: 818383 - DNA, 15 bp, Homo sapiens
catgacaagccccag

SEQ ID NO: 818384 - DNA, 16 bp, Homo sapiens
catgacaagccccagg

SEQ ID NO: 818385 - DNA, 17 bp, Homo sapiens
catgacaagccccaggc

SEQ ID NO: 818386 - DNA, 14 bp, Homo sapiens
catgacagaggctg

SEQ ID NO: 818387 - DNA, 16 bp, Homo sapiens
catgacagatatttta

SEQ ID NO: 818388 - DNA, 14 bp, Homo sapiens
catgacagcctgca

SEQ ID NO: 818389 - DNA, 16 bp, Homo sapiens
catgacatgttatata

SEQ ID NO: 818390 - DNA, 17 bp, Homo sapiens
catgacatgttatatat

SEQ ID NO: 818391 - DNA, 17 bp, Homo sapiens
catgacatttcatctgg

SEQ ID NO: 818392 - DNA, 18 bp, Homo sapiens
catgacatttcatctggg

SEQ ID NO: 818393 - DNA, 19 bp, Homo sapiens
catgacatttcatctgggt

SEQ ID NO: 818394 - DNA, 15 bp, Homo sapiens
catgaccacatagaa

SEQ ID NO: 818395 - DNA, 21 bp, Homo sapiens
catgaccactgggcctgctag

SEQ ID NO: 818396 - DNA, 15 bp, Homo sapiens
catgaccagcaaata

SEQ ID NO: 818397 - DNA, 13 bp, Homo sapiens
catgacccacccc

SEQ ID NO: 818398 - DNA, 14 bp, Homo sapiens
catgacccacccct

SEQ ID NO: 818399 - DNA, 15 bp, Homo sapiens
catgacccacccctg

SEQ ID NO: 818400 - DNA, 19 bp, Homo sapiens
catgaccccttctctctcc

SEQ ID NO: 818401 - DNA, 20 bp, Homo sapiens
catgaccccttctctctcca

SEQ ID NO: 818402 - DNA, 13 bp, Homo sapiens
catgaccctctgt

SEQ ID NO: 818403 - DNA, 15 bp, Homo sapiens
catgaccctctgtcc

SEQ ID NO: 818404 - DNA, 17 bp, Homo sapiens
catgaccctctgtcccc

SEQ ID NO: 818405 - DNA, 22 bp, Homo sapiens
catgaccctctgtccccaggcc

SEQ ID NO: 818406 - DNA, 19 bp, Homo sapiens
catgacctaccaggacaga

SEQ ID NO: 818407 - DNA, 23 bp, Homo sapiens
catgacctaccaggacagaactt

SEQ ID NO: 818408 - DNA, 18 bp, Homo sapiens
catgacctagttttccat

SEQ ID NO: 818409 - DNA, 19 bp, Homo sapiens
catgacctagttttccatg

SEQ ID NO: 818410 - DNA, 15 bp, Homo sapiens
catgacctcattccg

SEQ ID NO: 818411 - DNA, 14 bp, Homo sapiens
catgacctccaggg

SEQ ID NO: 818412 - DNA, 14 bp, Homo sapiens
catgacctgtgacc

SEQ ID NO: 818413 - DNA, 17 bp, Homo sapiens
catgacctgtgaccagc

SEQ ID NO: 818414 - DNA, 18 bp, Homo sapiens
catgacctgtgaccagca

SEQ ID NO: 818415 - DNA, 22 bp, Homo sapiens
catgacgccagataaaatgttc

SEQ ID NO: 818416 - DNA, 20 bp, Homo sapiens
catgactcgtatatgtctca

SEQ ID NO: 818417 - DNA, 23 bp, Homo sapiens
catgactcgtatatgtctcaggt

SEQ ID NO: 818418 - DNA, 14 bp, Homo sapiens
catgactcttggag

SEQ ID NO: 818419 - DNA, 16 bp, Homo sapiens
catgactgcacccagc

SEQ ID NO: 818420 - DNA, 20 bp, Homo sapiens
catgactgcacccagctcca

SEQ ID NO: 818421 - DNA, 23 bp, Homo sapiens
catgactgcacccagctccaggg

SEQ ID NO: 818422 - DNA, 13 bp, Homo sapiens
catgactggctgt

SEQ ID NO: 818423 - DNA, 15 bp, Homo sapiens
catgctgtgctcttt

SEQ ID NO: 818424 - DNA, 22 bp, Homo sapiens
catgctgtgctctttgaagaga

SEQ ID NO: 818425 - DNA, 18 bp, Homo sapiens
catgcttaccttctgctg

SEQ ID NO: 818426 - DNA, 18 bp, Homo sapiens
catgcttactttttaatt

SEQ ID NO: 818427 - DNA, 17 bp, Homo sapiens
catgcttagagcatgtt

SEQ ID NO: 818428 - DNA, 12 bp, Homo sapiens
catgcttagctt

SEQ ID NO: 818429 - DNA, 18 bp, Homo sapiens
catgcttagcttatcttt

SEQ ID NO: 818430 - DNA, 22 bp, Homo sapiens
catgcttagcttatctttcttt

SEQ ID NO: 818431 - DNA, 16 bp, Homo sapiens
catgcttagtcactgc

SEQ ID NO: 818432 - DNA, 17 bp, Homo sapiens
catgcttagtcactgcc

SEQ ID NO: 818433 - DNA, 18 bp, Homo sapiens
catgcttagtcactgcct

SEQ ID NO: 818434 - DNA, 17 bp, Homo sapiens
catgcttatgttaaact

SEQ ID NO: 818435 - DNA, 16 bp, Homo sapiens
catgcttcctttctct

SEQ ID NO: 818436 - DNA, 23 bp, Homo sapiens
catgcttcctttctctcctggct

SEQ ID NO: 818437 - DNA, 14 bp, Homo sapiens
catgcttcttcctt

SEQ ID NO: 818438 - DNA, 17 bp, Homo sapiens
catgcttgcctgaagct

SEQ ID NO: 818439 - DNA, 21 bp, Homo sapiens
catgcttgggctgacccagca

SEQ ID NO: 818440 - DNA, 22 bp, Homo sapiens
catgcttgggctgacccagcat

SEQ ID NO: 818441 - DNA, 23 bp, Homo sapiens
catgcttgggctgacccagcatc

SEQ ID NO: 818442 - DNA, 17 bp, Homo sapiens
catgctttgtgaacaag

SEQ ID NO: 818443 - DNA, 15 bp, Homo sapiens
catgcttttctgcca

SEQ ID NO: 818444 - DNA, 19 bp, Homo sapiens
catgcttttgccactttgg

SEQ ID NO: 818445 - DNA, 15 bp, Homo sapiens
catgctttttggtga

SEQ ID NO: 818446 - DNA, 15 bp, Homo sapiens
catggaaaaatgcca

SEQ ID NO: 818447 - DNA, 15 bp, Homo sapiens
catggaaaaatggtt

SEQ ID NO: 818448 - DNA, 16 bp, Homo sapiens
catggaaaatgtcctg

SEQ ID NO: 818449 - DNA, 18 bp, Homo sapiens
catggaaaatgtcctgtg

SEQ ID NO: 818450 - DNA, 18 bp, Homo sapiens
catggaaatgaagcaggg

SEQ ID NO: 818451 - DNA, 15 bp, Homo sapiens
catggaacacttcga

SEQ ID NO: 818452 - DNA, 22 bp, Homo sapiens
catggaaggtgccagaaggaag

SEQ ID NO: 818453 - DNA, 20 bp, Homo sapiens
catggaatcttgctgcaggc

SEQ ID NO: 818454 - DNA, 19 bp, Homo sapiens
catggacaatataaactga

SEQ ID NO: 818455 - DNA, 22 bp, Homo sapiens
catggacaatataaactgaaaa

SEQ ID NO: 818456 - DNA, 14 bp, Homo sapiens
catggacacccctt

SEQ ID NO: 818457 - DNA, 16 bp, Homo sapiens
catggacactacaccc

SEQ ID NO: 818458 - DNA, 17 bp, Homo sapiens
catggacactacaccca

SEQ ID NO: 818459 - DNA, 23 bp, Homo sapiens
catggacactacacccagcaata

SEQ ID NO: 818460 - DNA, 14 bp, Homo sapiens
catggacactccag

SEQ ID NO: 818461 - DNA, 21 bp, Homo sapiens
catggacagggccagggttgc

SEQ ID NO: 818462 - DNA, 18 bp, Homo sapiens
catggacatgatcttctt

SEQ ID NO: 818463 - DNA, 15 bp, Homo sapiens
catggacatttagaa

SEQ ID NO: 818464 - DNA, 15 bp, Homo sapiens
catggaccagcatct

SEQ ID NO: 818465 - DNA, 16 bp, Homo sapiens
catggacgaatatgaa

SEQ ID NO: 818466 - DNA, 19 bp, Homo sapiens
catggacgaatatgaatgt

SEQ ID NO: 818467 - DNA, 21 bp, Homo sapiens
catggactctacactgtgaac

SEQ ID NO: 818468 - DNA, 19 bp, Homo sapiens
catggactgagctggggga

SEQ ID NO: 818469 - DNA, 14 bp, Homo sapiens
catggacttcacat

SEQ ID NO: 818470 - DNA, 15 bp, Homo sapiens
catggacttcacata

SEQ ID NO: 818471 - DNA, 15 bp, Homo sapiens
catggacttccactg

SEQ ID NO: 818472 - DNA, 12 bp, Homo sapiens
catggacttgta

SEQ ID NO: 818473 - DNA, 17 bp, Homo sapiens
catggacttgtatattt

SEQ ID NO: 818474 - DNA, 11 bp, Homo sapiens
catggagaaac

SEQ ID NO: 818475 - DNA, 17 bp, Homo sapiens
catggagaaaccctgtc

SEQ ID NO: 818476 - DNA, 20 bp, Homo sapiens
catggagaaaccctgtctct

SEQ ID NO: 818477 - DNA, 23 bp, Homo sapiens
catggagaagggttctgccctgc

SEQ ID NO: 818478 - DNA, 20 bp, Homo sapiens
catggagaatctgctgcata

SEQ ID NO: 818479 - DNA, 15 bp, Homo sapiens
catggagactcctgc

SEQ ID NO: 818480 - DNA, 17 bp, Homo sapiens
catggagattctcataa

SEQ ID NO: 818481 - DNA, 14 bp, Homo sapiens
catggagccagctc

SEQ ID NO: 818482 - DNA, 17 bp, Homo sapiens
catggagccagctccct

SEQ ID NO: 818483 - DNA, 18 bp, Homo sapiens
catggagccccctctgcc

SEQ ID NO: 818484 - DNA, 22 bp, Homo sapiens
catggagctataactaagcatc

SEQ ID NO: 818485 - DNA, 18 bp, Homo sapiens
catggagctcttgttgca

SEQ ID NO: 818486 - DNA, 23 bp, Homo sapiens
catggaggaggagggaggcgctg

SEQ ID NO: 818487 - DNA, 13 bp, Homo sapiens
catggaggccctc

SEQ ID NO: 818488 - DNA, 16 bp, Homo sapiens
catggagtatatgtca

SEQ ID NO: 818489 - DNA, 17 bp, Homo sapiens
catggatacttcctggg

SEQ ID NO: 818490 - DNA, 19 bp, Homo sapiens
catggatacttcctgggtc

SEQ ID NO: 818491 - DNA, 21 bp, Homo sapiens
catggattaatagagttggag

SEQ ID NO: 818492 - DNA, 23 bp, Homo sapiens
catggattaatagagttggagtt

SEQ ID NO: 818493 - DNA, 18 bp, Homo sapiens
catggattgccacagctc

SEQ ID NO: 818494 - DNA, 12 bp, Homo sapiens
catggatttctt

SEQ ID NO: 818495 - DNA, 14 bp, Homo sapiens
catggattttggat

SEQ ID NO: 818496 - DNA, 23 bp, Homo sapiens
catggattttggataaatcattt

SEQ ID NO: 818497 - DNA, 16 bp, Homo sapiens
catggcaaatcagggg

SEQ ID NO: 818498 - DNA, 17 bp, Homo sapiens
catggcaaatcaggggc

SEQ ID NO: 818499 - DNA, 19 bp, Homo sapiens
catggcaaatcaggggcca

SEQ ID NO: 818500 - DNA, 18 bp, Homo sapiens
catggcaaatgggcagct

SEQ ID NO: 818501 - DNA, 19 bp, Homo sapiens
catggcaaatgggcagctc

SEQ ID NO: 818502 - DNA, 16 bp, Homo sapiens
catggcaattgcactc

SEQ ID NO: 818503 - DNA, 13 bp, Homo sapiens
catggcacaggcc

SEQ ID NO: 818504 - DNA, 17 bp, Homo sapiens
catggcaccagccccct

SEQ ID NO: 818505 - DNA, 20 bp, Homo sapiens
catggcaccagccccctgga

SEQ ID NO: 818506 - DNA, 22 bp, Homo sapiens
catggcactaaaccacttctct

SEQ ID NO: 818507 - DNA, 22 bp, Homo sapiens
catggcagaataatctttgggt

SEQ ID NO: 818508 - DNA, 17 bp, Homo sapiens
catggcagagtttgtgt

SEQ ID NO: 818509 - DNA, 20 bp, Homo sapiens
catggcagcatggagagcct

SEQ ID NO: 818510 - DNA, 17 bp, Homo sapiens
catggcagctgtttctc

SEQ ID NO: 818511 - DNA, 15 bp, Homo sapiens
catggcagggcctca

SEQ ID NO: 818512 - DNA, 18 bp, Homo sapiens
catggcagggcctcatct

SEQ ID NO: 818513 - DNA, 19 bp, Homo sapiens
catggcagggcctcatctc

SEQ ID NO: 818514 - DNA, 19 bp, Homo sapiens
catggccaccccgtgccac

SEQ ID NO: 818515 - DNA, 22 bp, Homo sapiens
catggccacttgggtcttccct

SEQ ID NO: 818516 - DNA, 15 bp, Homo sapiens
catggccaggtggcc

SEQ ID NO: 818517 - DNA, 20 bp, Homo sapiens
catggccatagaggcccagg

SEQ ID NO: 818518 - DNA, 23 bp, Homo sapiens
catggccatagaggcccaggcac

SEQ ID NO: 818519 - DNA, 23 bp, Homo sapiens
catggcccattggagcacctggg

SEQ ID NO: 818520 - DNA, 13 bp, Homo sapiens
catggcccccaat

SEQ ID NO: 818521 - DNA, 15 bp, Homo sapiens
catggcccccaataa

SEQ ID NO: 818522 - DNA, 17 bp, Homo sapiens
catggcccccaataaag

SEQ ID NO: 818523 - DNA, 18 bp, Homo sapiens
catggcccccaataaagg

SEQ ID NO: 818524 - DNA, 15 bp, Homo sapiens
catggccccccactc

SEQ ID NO: 818525 - DNA, 12 bp, Homo sapiens
catggcccctct

SEQ ID NO: 818526 - DNA, 18 bp, Homo sapiens
catggcccctctgacctg

SEQ ID NO: 818527 - DNA, 22 bp, Homo sapiens
catggcctcttcagatctctaa

SEQ ID NO: 818528 - DNA, 20 bp, Homo sapiens
catggcctgagatgcaggtg

SEQ ID NO: 818529 - DNA, 19 bp, Homo sapiens
catggccttatgaggcagg

SEQ ID NO: 818530 - DNA, 20 bp, Homo sapiens
catggcgccctgcctcctgg

SEQ ID NO: 818531 - DNA, 20 bp, Homo sapiens
catggcgtaatgggcctgcc

SEQ ID NO: 818532 - DNA, 14 bp, Homo sapiens
catggctaactggc

SEQ ID NO: 818533 - DNA, 15 bp, Homo sapiens
catggctcagagctt

SEQ ID NO: 818534 - DNA, 20 bp, Homo sapiens
catggctccagtctgctgcc

SEQ ID NO: 818535 - DNA, 22 bp, Homo sapiens
catggctccagtctgctgccct

SEQ ID NO: 818536 - DNA, 17 bp, Homo sapiens
catggctcctgtctggc

SEQ ID NO: 818537 - DNA, 15 bp, Homo sapiens
catggctgaagctgg

SEQ ID NO: 818538 - DNA, 20 bp, Homo sapiens
catggctgaagctggagcag

SEQ ID NO: 818539 - DNA, 13 bp, Homo sapiens
catggctgtctgc

SEQ ID NO: 818540 - DNA, 15 bp, Homo sapiens
catggctgtctgcac

SEQ ID NO: 818541 - DNA, 20 bp, Homo sapiens
catggctgtctgcacagagg

SEQ ID NO: 818542 - DNA, 21 bp, Homo sapiens
catggctgtctgcacagaggg

SEQ ID NO: 818543 - DNA, 17 bp, Homo sapiens
catggctgtgtttgcag

SEQ ID NO: 818544 - DNA, 21 bp, Homo sapiens
catgtaattaagtactatgta

SEQ ID NO: 818545 - DNA, 17 bp, Homo sapiens
catgtaccatcaataaa

SEQ ID NO: 818546 - DNA, 19 bp, Homo sapiens
catgtacctcccctgcctt

SEQ ID NO: 818547 - DNA, 20 bp, Homo sapiens
catgtacctcccctgccttg

SEQ ID NO: 818548 - DNA, 21 bp, Homo sapiens
catgtacctcccctgccttgc

SEQ ID NO: 818549 - DNA, 21 bp, Homo sapiens
catgtactagtcctctagaaa

SEQ ID NO: 818550 - DNA, 22 bp, Homo sapiens
catgtactagttttagttttct

SEQ ID NO: 818551 - DNA, 20 bp, Homo sapiens
catgtactccagagggacag

SEQ ID NO: 818552 - DNA, 23 bp, Homo sapiens
catgtactgagccttgtaattct

SEQ ID NO: 818553 - DNA, 16 bp, Homo sapiens
catgtacttcctgtgt

SEQ ID NO: 818554 - DNA, 21 bp, Homo sapiens
catgtacttgtttgcaagcag

SEQ ID NO: 818555 - DNA, 15 bp, Homo sapiens
catgtactttggcat

SEQ ID NO: 818556 - DNA, 19 bp, Homo sapiens
catgtactttggcatcttt

SEQ ID NO: 818557 - DNA, 17 bp, Homo sapiens
catgtagaataaatgaa

SEQ ID NO: 818558 - DNA, 12 bp, Homo sapiens
catgtagagaaa

SEQ ID NO: 818559 - DNA, 17 bp, Homo sapiens
catgtagccacccaact

SEQ ID NO: 818560 - DNA, 21 bp, Homo sapiens
catgtagccacccaactttgt

SEQ ID NO: 818561 - DNA, 13 bp, Homo sapiens
catgtagccccct

SEQ ID NO: 818562 - DNA, 20 bp, Homo sapiens
catgtagccccctggcctct

SEQ ID NO: 818563 - DNA, 21 bp, Homo sapiens
catgtagccccctggcctctg

SEQ ID NO: 818564 - DNA, 14 bp, Homo sapiens
catgtagctgagtt

SEQ ID NO: 818565 - DNA, 18 bp, Homo sapiens
catgtaggaagtaggaag

SEQ ID NO: 818566 - DNA, 19 bp, Homo sapiens
catgtagtaacactaatat

SEQ ID NO: 818567 - DNA, 21 bp, Homo sapiens
catgtataaatataagtctat

SEQ ID NO: 818568 - DNA, 19 bp, Homo sapiens
catgtatcataattaccaa

SEQ ID NO: 818569 - DNA, 15 bp, Homo sapiens
catgtatgaatgtaa

SEQ ID NO: 818570 - DNA, 22 bp, Homo sapiens
catgtatggaatcccactgtat

SEQ ID NO: 818571 - DNA, 18 bp, Homo sapiens
catgtatgttatgatatt

SEQ ID NO: 818572 - DNA, 15 bp, Homo sapiens
catgtattatcacat

SEQ ID NO: 818573 - DNA, 14 bp, Homo sapiens
catgtattatgaaa

SEQ ID NO: 818574 - DNA, 18 bp, Homo sapiens
catgtattatgaaaaaga

SEQ ID NO: 818575 - DNA, 22 bp, Homo sapiens
catgtattatgaaaaagattat

SEQ ID NO: 818576 - DNA, 14 bp, Homo sapiens
catgtattccctta

SEQ ID NO: 818577 - DNA, 17 bp, Homo sapiens
catgtattgcacattgt

SEQ ID NO: 818578 - DNA, 18 bp, Homo sapiens
catgtattgcacattgta

SEQ ID NO: 818579 - DNA, 16 bp, Homo sapiens
catgtattggcctgga

SEQ ID NO: 818580 - DNA, 18 bp, Homo sapiens
catgtattggcctggagg

SEQ ID NO: 818581 - DNA, 19 bp, Homo sapiens
catgtattggcctggaggt

SEQ ID NO: 818582 - DNA, 15 bp, Homo sapiens
catgtatttatctct

SEQ ID NO: 818583 - DNA, 20 bp, Homo sapiens
catgtatttatctctattta

SEQ ID NO: 818584 - DNA, 23 bp, Homo sapiens
catgtatttatctctatttaata

SEQ ID NO: 818585 - DNA, 17 bp, Homo sapiens
catgtatttcagggacc

SEQ ID NO: 818586 - DNA, 21 bp, Homo sapiens
catgtatttcagggacctcag

SEQ ID NO: 818587 - DNA, 18 bp, Homo sapiens
catgtcaacttctggctc

SEQ ID NO: 818588 - DNA, 20 bp, Homo sapiens
catgtcaccggtcagtgcct

SEQ ID NO: 818589 - DNA, 13 bp, Homo sapiens
catgtcacctcag

SEQ ID NO: 818590 - DNA, 14 bp, Homo sapiens
catgtcacctcagc

SEQ ID NO: 818591 - DNA, 17 bp, Homo sapiens
catgtcacctcagctga

SEQ ID NO: 818592 - DNA, 13 bp, Homo sapiens
catgtcactgcag

SEQ ID NO: 818593 - DNA, 16 bp, Homo sapiens
catgtcactgtggtcc

SEQ ID NO: 818594 - DNA, 14 bp, Homo sapiens
catgtcagacacag

SEQ ID NO: 818595 - DNA, 21 bp, Homo sapiens
catgtcagaggaccccagggt

SEQ ID NO: 818596 - DNA, 17 bp, Homo sapiens
catgtcagcaaaaagca

SEQ ID NO: 818597 - DNA, 18 bp, Homo sapiens
catgtcagcaaaaagcaa

SEQ ID NO: 818598 - DNA, 13 bp, Homo sapiens
catgtcaggccag

SEQ ID NO: 818599 - DNA, 14 bp, Homo sapiens
catgtccaaagagg

SEQ ID NO: 818600 - DNA, 21 bp, Homo sapiens
catgtccaaagaggctgcccc

SEQ ID NO: 818601 - DNA, 19 bp, Homo sapiens
catgtccaagtccaacctg

SEQ ID NO: 818602 - DNA, 24 bp, Homo sapiens
catgtccaagtccaacctgcctgt

SEQ ID NO: 818603 - DNA, 17 bp, Homo sapiens
catgtccaagttcttca

SEQ ID NO: 818604 - DNA, 17 bp, Homo sapiens
catgtcccacccacccg

SEQ ID NO: 818605 - DNA, 14 bp, Homo sapiens
catgtccccttcct

SEQ ID NO: 818606 - DNA, 15 bp, Homo sapiens
catgtccccttcctg

SEQ ID NO: 818607 - DNA, 20 bp, Homo sapiens
catgtccccttcctgttctt

SEQ ID NO: 818608 - DNA, 21 bp, Homo sapiens
catgtccctgtccccaggccc

SEQ ID NO: 818609 - DNA, 22 bp, Homo sapiens
catgtcctgcctattatctgtc

SEQ ID NO: 818610 - DNA, 19 bp, Homo sapiens
catgtcctttgcgcctgtg

SEQ ID NO: 818611 - DNA, 21 bp, Homo sapiens
catgtcctttgcgcctgtgac

SEQ ID NO: 818612 - DNA, 15 bp, Homo sapiens
catgtcgcacaatgt

SEQ ID NO: 818613 - DNA, 14 bp, Homo sapiens
catgtcgcctctgc

SEQ ID NO: 818614 - DNA, 18 bp, Homo sapiens
catgtcgcctctgcattc

SEQ ID NO: 818615 - DNA, 19 bp, Homo sapiens
catgtcgcgctcagcatgc

SEQ ID NO: 818616 - DNA, 13 bp, Homo sapiens
catgtctactttt

SEQ ID NO: 818617 - DNA, 14 bp, Homo sapiens
catgtctacttttt

SEQ ID NO: 818618 - DNA, 17 bp, Homo sapiens
catgtctactttttaat

SEQ ID NO: 818619 - DNA, 18 bp, Homo sapiens
catgtctactttttaatt

SEQ ID NO: 818620 - DNA, 16 bp, Homo sapiens
catgtctcctatcctg

SEQ ID NO: 818621 - DNA, 14 bp, Homo sapiens
catgtctctctgcc

SEQ ID NO: 818622 - DNA, 12 bp, Homo sapiens
catgtctgcacc

SEQ ID NO: 818623 - DNA, 15 bp, Homo sapiens
catgtctgcatttcg

SEQ ID NO: 818624 - DNA, 21 bp, Homo sapiens
catgtctgtatactcctgtca

SEQ ID NO: 818625 - DNA, 16 bp, Homo sapiens
catgtctgtcctcaga

SEQ ID NO: 818626 - DNA, 17 bp, Homo sapiens
catgtctgtcctcagag

SEQ ID NO: 818627 - DNA, 20 bp, Homo sapiens
catgtctgtcctcagagcag

SEQ ID NO: 818628 - DNA, 14 bp, Homo sapiens
catgtctgttcttc

SEQ ID NO: 818629 - DNA, 15 bp, Homo sapiens
catgtcttaaatgct

SEQ ID NO: 818630 - DNA, 11 bp, Homo sapiens
catgtcttctg

SEQ ID NO: 818631 - DNA, 21 bp, Homo sapiens
catgtgaagcatgctttgctg

SEQ ID NO: 818632 - DNA, 13 bp, Homo sapiens
catgtgacattta

SEQ ID NO: 818633 - DNA, 16 bp, Homo sapiens
catgtgaccattctgc

SEQ ID NO: 818634 - DNA, 21 bp, Homo sapiens
catgtgactagcgcctggcct

SEQ ID NO: 818635 - DNA, 18 bp, Homo sapiens
catgtgagaaagctaaaa

SEQ ID NO: 818636 - DNA, 12 bp, Homo sapiens
catgtgagccac

SEQ ID NO: 818637 - DNA, 17 bp, Homo sapiens
catgtgagccaccgctg

SEQ ID NO: 818638 - DNA, 23 bp, Homo sapiens
catgtgagccaccgctgccagca

SEQ ID NO: 818639 - DNA, 14 bp, Homo sapiens
catgtgaggaggaa

SEQ ID NO: 818640 - DNA, 15 bp, Homo sapiens
catgtgaggaggaaa

SEQ ID NO: 818641 - DNA, 18 bp, Homo sapiens
catgtgaggaggaaaagg

SEQ ID NO: 818642 - DNA, 18 bp, Homo sapiens
catgtgatggacactcca

SEQ ID NO: 818643 - DNA, 14 bp, Homo sapiens
catgtgatgtcatg

SEQ ID NO: 818644 - DNA, 14 bp, Homo sapiens
catgtgcatataaa

SEQ ID NO: 818645 - DNA, 17 bp, Homo sapiens
catgtgcatctggtgta

SEQ ID NO: 818646 - DNA, 11 bp, Homo sapiens
catgtgccaag

SEQ ID NO: 818647 - DNA, 19 bp, Homo sapiens
catgtgccaagattctact

SEQ ID NO: 818648 - DNA, 17 bp, Homo sapiens
catgtgccatctgtaca

SEQ ID NO: 818649 - DNA, 13 bp, Homo sapiens
catgtgccatttt

SEQ ID NO: 818650 - DNA, 17 bp, Homo sapiens
catgtgccccctctacc

SEQ ID NO: 818651 - DNA, 14 bp, Homo sapiens
catgtgccctcctg

SEQ ID NO: 818652 - DNA, 16 bp, Homo sapiens
catgtgccgaatgtgc

SEQ ID NO: 818653 - DNA, 17 bp, Homo sapiens
catgtgccttgtccagg

SEQ ID NO: 818654 - DNA, 19 bp, Homo sapiens
catgtgccttgtccaggaa

SEQ ID NO: 818655 - DNA, 15 bp, Homo sapiens
catgtgcggctgaac

SEQ ID NO: 818656 - DNA, 24 bp, Homo sapiens
catgtgctgccctacagcaccctg

SEQ ID NO: 818657 - DNA, 21 bp, Homo sapiens
catgtgctgggaaatgcagaa

SEQ ID NO: 818658 - DNA, 18 bp, Homo sapiens
catgtggaaagtgaattt

SEQ ID NO: 818659 - DNA, 21 bp, Homo sapiens
catgtggaaagtgaatttgaa

SEQ ID NO: 818660 - DNA, 15 bp, Homo sapiens
catgtggagaaagga

SEQ ID NO: 818661 - DNA, 17 bp, Homo sapiens
catgtggcaaaatatgg

SEQ ID NO: 818662 - DNA, 12 bp, Homo sapiens
catgtggcagcc

SEQ ID NO: 818663 - DNA, 13 bp, Homo sapiens
catgtggcagccc

SEQ ID NO: 818664 - DNA, 15 bp, Homo sapiens
catgtggcagcccat

SEQ ID NO: 818665 - DNA, 19 bp, Homo sapiens
catgtggccatggcctctg

SEQ ID NO: 818666 - DNA, 17 bp, Homo sapiens
cattcacatttgatgta

SEQ ID NO: 818667 - DNA, 19 bp, Homo sapiens
cattcacctgccccaactc

SEQ ID NO: 818668 - DNA, 14 bp, Homo sapiens
cattcactcttcca

SEQ ID NO: 818669 - DNA, 16 bp, Homo sapiens
cattcactcttccaga

SEQ ID NO: 818670 - DNA, 20 bp, Homo sapiens
cattcactcttccagaatcc

SEQ ID NO: 818671 - DNA, 11 bp, Homo sapiens
cattcacttca

SEQ ID NO: 818672 - DNA, 14 bp, Homo sapiens
cattcacttcataa

SEQ ID NO: 818673 - DNA, 14 bp, Homo sapiens
cattcacttttgtt

SEQ ID NO: 818674 - DNA, 12 bp, Homo sapiens
cattcagcacac

SEQ ID NO: 818675 - DNA, 20 bp, Homo sapiens
cattcagcagcaaattttca

SEQ ID NO: 818676 - DNA, 16 bp, Homo sapiens
cattcagcatgggtcc

SEQ ID NO: 818677 - DNA, 20 bp, Homo sapiens
cattcaggaaaactgacaga

SEQ ID NO: 818678 - DNA, 19 bp, Homo sapiens
cattcaggaattcttggag

SEQ ID NO: 818679 - DNA, 19 bp, Homo sapiens
cattcagtgattactgtca

SEQ ID NO: 818680 - DNA, 23 bp, Homo sapiens
cattcagtgcacctgcctcagct

SEQ ID NO: 818681 - DNA, 15 bp, Homo sapiens
cattcatacttaaaa

SEQ ID NO: 818682 - DNA, 14 bp, Homo sapiens
cattcatattaaga

SEQ ID NO: 818683 - DNA, 21 bp, Homo sapiens
cattcatattaagacagtgta

SEQ ID NO: 818684 - DNA, 20 bp, Homo sapiens
cattcatatttgtctttgaa

SEQ ID NO: 818685 - DNA, 21 bp, Homo sapiens
cattcatatttgtctttgaat

SEQ ID NO: 818686 - DNA, 23 bp, Homo sapiens
cattcatcaatatccctcttgta

SEQ ID NO: 818687 - DNA, 14 bp, Homo sapiens
cattcatcttgcaa

SEQ ID NO: 818688 - DNA, 21 bp, Homo sapiens
cattcattagtcatgtttatc

SEQ ID NO: 818689 - DNA, 15 bp, Homo sapiens
cattccaaaatacaa

SEQ ID NO: 818690 - DNA, 16 bp, Homo sapiens
cattccaacagtgagt

SEQ ID NO: 818691 - DNA, 13 bp, Homo sapiens
cattccagaatct

SEQ ID NO: 818692 - DNA, 13 bp, Homo sapiens
cattccagagtgc

SEQ ID NO: 818693 - DNA, 14 bp, Homo sapiens
cattccagccaggc

SEQ ID NO: 818694 - DNA, 15 bp, Homo sapiens
cattccagccaggcc

SEQ ID NO: 818695 - DNA, 16 bp, Homo sapiens
cattccagccaggccc

SEQ ID NO: 818696 - DNA, 18 bp, Homo sapiens
cattccagccaggcccag

SEQ ID NO: 818697 - DNA, 19 bp, Homo sapiens
cattccagccaggcccagg

SEQ ID NO: 818698 - DNA, 18 bp, Homo sapiens
cattccagcccctctggt

SEQ ID NO: 818699 - DNA, 22 bp, Homo sapiens
cattccagcccctctggtcgct

SEQ ID NO: 818700 - DNA, 12 bp, Homo sapiens
cattccagctct

SEQ ID NO: 818701 - DNA, 14 bp, Homo sapiens
cattccagctctgc

SEQ ID NO: 818702 - DNA, 15 bp, Homo sapiens
cattccagctctgcc

SEQ ID NO: 818703 - DNA, 17 bp, Homo sapiens
cattccagctctgcccc

SEQ ID NO: 818704 - DNA, 12 bp, Homo sapiens
cattccagggct

SEQ ID NO: 818705 - DNA, 13 bp, Homo sapiens
cattccagggctg

SEQ ID NO: 818706 - DNA, 19 bp, Homo sapiens
cattccaggtagctcggca

SEQ ID NO: 818707 - DNA, 17 bp, Homo sapiens
cattccagtacagtatt

SEQ ID NO: 818708 - DNA, 23 bp, Homo sapiens
cattccagtacagtattctttta

SEQ ID NO: 818709 - DNA, 13 bp, Homo sapiens
cattccagtgcta

SEQ ID NO: 818710 - DNA, 20 bp, Homo sapiens
cattccagtgctagaaaatt

SEQ ID NO: 818711 - DNA, 20 bp, Homo sapiens
cattccagtggaccctggac

SEQ ID NO: 818712 - DNA, 17 bp, Homo sapiens
cattccatattgggaat

SEQ ID NO: 818713 - DNA, 13 bp, Homo sapiens
cattccattgcct

SEQ ID NO: 818714 - DNA, 16 bp, Homo sapiens
cattccattgcctagc

SEQ ID NO: 818715 - DNA, 12 bp, Homo sapiens
cattcccagcgt

SEQ ID NO: 818716 - DNA, 21 bp, Homo sapiens
cattccccaacggggtgggga

SEQ ID NO: 818717 - DNA, 23 bp, Homo sapiens
cattccccaacggggtggggagg

SEQ ID NO: 818718 - DNA, 18 bp, Homo sapiens
cattcccccatgtggctg

SEQ ID NO: 818719 - DNA, 23 bp, Homo sapiens
cattcccctcccacctctccttt

SEQ ID NO: 818720 - DNA, 20 bp, Homo sapiens
cattcccctcgtgtgactct

SEQ ID NO: 818721 - DNA, 20 bp, Homo sapiens
cattcccctgctgccagccc

SEQ ID NO: 818722 - DNA, 20 bp, Homo sapiens
cattccctacagcctagggc

SEQ ID NO: 818723 - DNA, 14 bp, Homo sapiens
cattccctctcctg

SEQ ID NO: 818724 - DNA, 17 bp, Homo sapiens
cattccctgagtcacca

SEQ ID NO: 818725 - DNA, 21 bp, Homo sapiens
cattccctgagtcaccaggaa

SEQ ID NO: 818726 - DNA, 20 bp, Homo sapiens
cattcccttggatgtagtct

SEQ ID NO: 818727 - DNA, 23 bp, Homo sapiens
cattcccttggatgtagtctgag

SEQ ID NO: 818728 - DNA, 22 bp, Homo sapiens
cattccgacaaccgatgctcca

SEQ ID NO: 818729 - DNA, 20 bp, Homo sapiens
cattccgcagcccccacccc

SEQ ID NO: 818730 - DNA, 22 bp, Homo sapiens
cattcctaaagaaaaatatctt

SEQ ID NO: 818731 - DNA, 18 bp, Homo sapiens
cattcctaactagaatta

SEQ ID NO: 818732 - DNA, 19 bp, Homo sapiens
cattcctaactagaattag

SEQ ID NO: 818733 - DNA, 19 bp, Homo sapiens
cattcctaagagtggagga

SEQ ID NO: 818734 - DNA, 14 bp, Homo sapiens
cattcctcagctgc

SEQ ID NO: 818735 - DNA, 17 bp, Homo sapiens
cattcctcagctgccaa

SEQ ID NO: 818736 - DNA, 16 bp, Homo sapiens
cattcctcagggacag

SEQ ID NO: 818737 - DNA, 16 bp, Homo sapiens
cattcctccactctgt

SEQ ID NO: 818738 - DNA, 18 bp, Homo sapiens
cattcctccagcctcccc

SEQ ID NO: 818739 - DNA, 12 bp, Homo sapiens
cattcctccctc

SEQ ID NO: 818740 - DNA, 23 bp, Homo sapiens
cattcctggtacccagccatctg

SEQ ID NO: 818741 - DNA, 24 bp, Homo sapiens
cattcctggtacccagccatctgc

SEQ ID NO: 818742 - DNA, 11 bp, Homo sapiens
cattcctgtcc

SEQ ID NO: 818743 - DNA, 13 bp, Homo sapiens
cattcctgtccct

SEQ ID NO: 818744 - DNA, 17 bp, Homo sapiens
cattcctgtgccctaga

SEQ ID NO: 818745 - DNA, 21 bp, Homo sapiens
cattcctgttgatgggaaaag

SEQ ID NO: 818746 - DNA, 15 bp, Homo sapiens
cattccttacttgca

SEQ ID NO: 818747 - DNA, 15 bp, Homo sapiens
cattccttcaaataa

SEQ ID NO: 818748 - DNA, 11 bp, Homo sapiens
cattccttctc

SEQ ID NO: 818749 - DNA, 19 bp, Homo sapiens
cattccttgcgcctcagcc

SEQ ID NO: 818750 - DNA, 23 bp, Homo sapiens
cattcctttcttgtgccctgggc

SEQ ID NO: 818751 - DNA, 16 bp, Homo sapiens
cattcgacctataaga

SEQ ID NO: 818752 - DNA, 22 bp, Homo sapiens
cattcgacctataagaagcctt

SEQ ID NO: 818753 - DNA, 18 bp, Homo sapiens
cattcggctccctggagc

SEQ ID NO: 818754 - DNA, 21 bp, Homo sapiens
cattcggggaagctgcacatg

SEQ ID NO: 818755 - DNA, 16 bp, Homo sapiens
cattcggtgtggtgca

SEQ ID NO: 818756 - DNA, 15 bp, Homo sapiens
cattcgtctgtccca

SEQ ID NO: 818757 - DNA, 17 bp, Homo sapiens
cattctaaaccaaaaca

SEQ ID NO: 818758 - DNA, 19 bp, Homo sapiens
cattctaaaccaaaacaga

SEQ ID NO: 818759 - DNA, 22 bp, Homo sapiens
cattctacacagagcaggactg

SEQ ID NO: 818760 - DNA, 18 bp, Homo sapiens
cattctacacctggacca

SEQ ID NO: 818761 - DNA, 15 bp, Homo sapiens
cattctacagaataa

SEQ ID NO: 818762 - DNA, 16 bp, Homo sapiens
cattctagattacttt

SEQ ID NO: 818763 - DNA, 23 bp, Homo sapiens
cattctagattacttttcttact

SEQ ID NO: 818764 - DNA, 15 bp, Homo sapiens
cattctaggatgtgg

SEQ ID NO: 818765 - DNA, 23 bp, Homo sapiens
cattctaggtaggggcccacttc

SEQ ID NO: 818766 - DNA, 15 bp, Homo sapiens
cattctatctactga

SEQ ID NO: 818767 - DNA, 21 bp, Homo sapiens
cattctattgactttcttaaa

SEQ ID NO: 818768 - DNA, 16 bp, Homo sapiens
cattctcactcctacc

SEQ ID NO: 818769 - DNA, 21 bp, Homo sapiens
cattctcataattcctacagc

SEQ ID NO: 818770 - DNA, 20 bp, Homo sapiens
cattctcatctgcacccttc

SEQ ID NO: 818771 - DNA, 21 bp, Homo sapiens
cattctcatctgcacccttct

SEQ ID NO: 818772 - DNA, 15 bp, Homo sapiens
cattctccacagcaa

SEQ ID NO: 818773 - DNA, 17 bp, Homo sapiens
cattctccacagcaacc

SEQ ID NO: 818774 - DNA, 18 bp, Homo sapiens
cattctccacagcaaccc

SEQ ID NO: 818775 - DNA, 21 bp, Homo sapiens
cattctccagttgattatttc

SEQ ID NO: 818776 - DNA, 22 bp, Homo sapiens
cattctcctgcctgtagcagtg

SEQ ID NO: 818777 - DNA, 16 bp, Homo sapiens
cattctctcccatcct

SEQ ID NO: 818778 - DNA, 16 bp, Homo sapiens
cattctctctcctgtc

SEQ ID NO: 818779 - DNA, 20 bp, Homo sapiens
cattctctctcctgtccaac

SEQ ID NO: 818780 - DNA, 14 bp, Homo sapiens
cattctcttcccag

SEQ ID NO: 818781 - DNA, 13 bp, Homo sapiens
cattctcttttaa

SEQ ID NO: 818782 - DNA, 14 bp, Homo sapiens
cattctcttttaat

SEQ ID NO: 818783 - DNA, 13 bp, Homo sapiens
cattctgaatcaa

SEQ ID NO: 818784 - DNA, 16 bp, Homo sapiens
cattctgaatgcttct

SEQ ID NO: 818785 - DNA, 21 bp, Homo sapiens
cattctgaattaattaatttg

SEQ ID NO: 818786 - DNA, 12 bp, Homo sapiens
cattctgactcg

SEQ ID NO: 818787 - DNA, 19 bp, Homo sapiens
cattctgactcggtttctc

SEQ ID NO: 818788 - DNA, 16 bp, Homo sapiens
catttacatgttttaa

SEQ ID NO: 818789 - DNA, 20 bp, Homo sapiens
catttaccaaattgcttgag

SEQ ID NO: 818790 - DNA, 13 bp, Homo sapiens
catttactgacca

SEQ ID NO: 818791 - DNA, 15 bp, Homo sapiens
catttacttaagact

SEQ ID NO: 818792 - DNA, 12 bp, Homo sapiens
catttactttta

SEQ ID NO: 818793 - DNA, 15 bp, Homo sapiens
catttagaaaataga

SEQ ID NO: 818794 - DNA, 13 bp, Homo sapiens
catttagaagaaa

SEQ ID NO: 818795 - DNA, 16 bp, Homo sapiens
catttagaagaaagat

SEQ ID NO: 818796 - DNA, 20 bp, Homo sapiens
catttagaagaaagatgttt

SEQ ID NO: 818797 - DNA, 23 bp, Homo sapiens
catttagagaactgtggccgtta

SEQ ID NO: 818798 - DNA, 12 bp, Homo sapiens
catttagataat

SEQ ID NO: 818799 - DNA, 18 bp, Homo sapiens
catttagataatttgaaa

SEQ ID NO: 818800 - DNA, 19 bp, Homo sapiens
catttagataatttgaaaa

SEQ ID NO: 818801 - DNA, 21 bp, Homo sapiens
catttagataatttgaaaaag

SEQ ID NO: 818802 - DNA, 16 bp, Homo sapiens
catttagcatgttgtt

SEQ ID NO: 818803 - DNA, 14 bp, Homo sapiens
catttagttttatg

SEQ ID NO: 818804 - DNA, 17 bp, Homo sapiens
catttataatgtttgct

SEQ ID NO: 818805 - DNA, 21 bp, Homo sapiens
catttataatgtttgctattg

SEQ ID NO: 818806 - DNA, 18 bp, Homo sapiens
catttatacaaattagaa

SEQ ID NO: 818807 - DNA, 20 bp, Homo sapiens
catttatacaaattagaaaa

SEQ ID NO: 818808 - DNA, 13 bp, Homo sapiens
catttatatattg

SEQ ID NO: 818809 - DNA, 15 bp, Homo sapiens
catttatatattgga

SEQ ID NO: 818810 - DNA, 21 bp, Homo sapiens
catttatctcttttgtggact

SEQ ID NO: 818811 - DNA, 16 bp, Homo sapiens
catttatgaagcaagc

SEQ ID NO: 818812 - DNA, 19 bp, Homo sapiens
catttatgacctaagtcag

SEQ ID NO: 818813 - DNA, 21 bp, Homo sapiens
catttatggtcaacacttaag

SEQ ID NO: 818814 - DNA, 13 bp, Homo sapiens
catttatgtctca

SEQ ID NO: 818815 - DNA, 16 bp, Homo sapiens
catttatgtctcatgt

SEQ ID NO: 818816 - DNA, 14 bp, Homo sapiens
catttatgtttatt

SEQ ID NO: 818817 - DNA, 15 bp, Homo sapiens
catttattgtttgaa

SEQ ID NO: 818818 - DNA, 22 bp, Homo sapiens
catttatttatgaaaaaatatg

SEQ ID NO: 818819 - DNA, 15 bp, Homo sapiens
catttatttattact

SEQ ID NO: 818820 - DNA, 16 bp, Homo sapiens
catttatttattactg

SEQ ID NO: 818821 - DNA, 14 bp, Homo sapiens
catttatttcatga

SEQ ID NO: 818822 - DNA, 15 bp, Homo sapiens
catttattttataac

SEQ ID NO: 818823 - DNA, 21 bp, Homo sapiens
catttatttttagttaaaaat

SEQ ID NO: 818824 - DNA, 20 bp, Homo sapiens
catttattttttttaaagaa

SEQ ID NO: 818825 - DNA, 21 bp, Homo sapiens
catttattttttttaaagaaa

SEQ ID NO: 818826 - DNA, 22 bp, Homo sapiens
catttcaaaaccaaggaagcag

SEQ ID NO: 818827 - DNA, 15 bp, Homo sapiens
catttcaaaattaat

SEQ ID NO: 818828 - DNA, 17 bp, Homo sapiens
catttcaaaattaatag

SEQ ID NO: 818829 - DNA, 18 bp, Homo sapiens
catttcaaagccctgcct

SEQ ID NO: 818830 - DNA, 20 bp, Homo sapiens
catttcaaagccctgcctct

SEQ ID NO: 818831 - DNA, 22 bp, Homo sapiens
catttcaaagccctgcctctgt

SEQ ID NO: 818832 - DNA, 18 bp, Homo sapiens
catttcaaatgtgctgtc

SEQ ID NO: 818833 - DNA, 20 bp, Homo sapiens
catttcaaattgaatttgca

SEQ ID NO: 818834 - DNA, 15 bp, Homo sapiens
catttcaactgtttg

SEQ ID NO: 818835 - DNA, 16 bp, Homo sapiens
catttcaatcattgaa

SEQ ID NO: 818836 - DNA, 20 bp, Homo sapiens
catttcaatgtgtataaatt

SEQ ID NO: 818837 - DNA, 19 bp, Homo sapiens
catttcaattcctggccct

SEQ ID NO: 818838 - DNA, 16 bp, Homo sapiens
catttcaattctcaaa

SEQ ID NO: 818839 - DNA, 16 bp, Homo sapiens
catttcacattattct

SEQ ID NO: 818840 - DNA, 18 bp, Homo sapiens
catttcacctgtgacaaa

SEQ ID NO: 818841 - DNA, 16 bp, Homo sapiens
catttcacgaactgtt

SEQ ID NO: 818842 - DNA, 14 bp, Homo sapiens
catttcactgtcta

SEQ ID NO: 818843 - DNA, 20 bp, Homo sapiens
catttcagagggtaagtaaa

SEQ ID NO: 818844 - DNA, 17 bp, Homo sapiens
catttcagccaaagtcc

SEQ ID NO: 818845 - DNA, 17 bp, Homo sapiens
catttcagcttgaacct

SEQ ID NO: 818846 - DNA, 21 bp, Homo sapiens
catttcataaggcctgccctc

SEQ ID NO: 818847 - DNA, 19 bp, Homo sapiens
catttcatcattgtttctg

SEQ ID NO: 818848 - DNA, 22 bp, Homo sapiens
catttcatccgtgtgtatgtgt

SEQ ID NO: 818849 - DNA, 17 bp, Homo sapiens
catttcatctatttctg

SEQ ID NO: 818850 - DNA, 14 bp, Homo sapiens
catttcatgaaaaa

SEQ ID NO: 818851 - DNA, 17 bp, Homo sapiens
catttcatgaaaaagct

SEQ ID NO: 818852 - DNA, 21 bp, Homo sapiens
catttcatgaaaaagctgctt

SEQ ID NO: 818853 - DNA, 18 bp, Homo sapiens
catttcatgtccataaaa

SEQ ID NO: 818854 - DNA, 15 bp, Homo sapiens
catttcattcctaac

SEQ ID NO: 818855 - DNA, 17 bp, Homo sapiens
catttcattgtacaagt

SEQ ID NO: 818856 - DNA, 13 bp, Homo sapiens
catttcattgtat

SEQ ID NO: 818857 - DNA, 18 bp, Homo sapiens
catttcattgtatgatgt

SEQ ID NO: 818858 - DNA, 20 bp, Homo sapiens
catttcattgtatgatgtgt

SEQ ID NO: 818859 - DNA, 17 bp, Homo sapiens
catttccaaacttgaaa

SEQ ID NO: 818860 - DNA, 22 bp, Homo sapiens
catttccaaatgtggcctccat

SEQ ID NO: 818861 - DNA, 20 bp, Homo sapiens
catttccaacaccacagaca

SEQ ID NO: 818862 - DNA, 21 bp, Homo sapiens
catttccaccaggccgtgcct

SEQ ID NO: 818863 - DNA, 20 bp, Homo sapiens
catttccagggcagcagccg

SEQ ID NO: 818864 - DNA, 18 bp, Homo sapiens
catttcccaaagtcctct

SEQ ID NO: 818865 - DNA, 19 bp, Homo sapiens
catttcccaaagtcctctg

SEQ ID NO: 818866 - DNA, 22 bp, Homo sapiens
catttcccaaagtcctctgctc

SEQ ID NO: 818867 - DNA, 17 bp, Homo sapiens
catttcccacatctttc

SEQ ID NO: 818868 - DNA, 17 bp, Homo sapiens
catttcccatctgcacc

SEQ ID NO: 818869 - DNA, 15 bp, Homo sapiens
catttccccctcctc

SEQ ID NO: 818870 - DNA, 17 bp, Homo sapiens
catttccccctcctcag

SEQ ID NO: 818871 - DNA, 23 bp, Homo sapiens
catttcccctctgcacccagaac

SEQ ID NO: 818872 - DNA, 14 bp, Homo sapiens
catttcctcacgtg

SEQ ID NO: 818873 - DNA, 20 bp, Homo sapiens
catttcctgacagaaggact

SEQ ID NO: 818874 - DNA, 11 bp, Homo sapiens
catttcctgat

SEQ ID NO: 818875 - DNA, 21 bp, Homo sapiens
catttcctgcccttcctcagt

SEQ ID NO: 818876 - DNA, 12 bp, Homo sapiens
catttcctgctg

SEQ ID NO: 818877 - DNA, 15 bp, Homo sapiens
catttcggtggctag

SEQ ID NO: 818878 - DNA, 21 bp, Homo sapiens
catttcggtggctagtcaagc

SEQ ID NO: 818879 - DNA, 23 bp, Homo sapiens
catttctaattaaccttactaat

SEQ ID NO: 818880 - DNA, 19 bp, Homo sapiens
catttctactatgatcaga

SEQ ID NO: 818881 - DNA, 12 bp, Homo sapiens
catttctagact

SEQ ID NO: 818882 - DNA, 20 bp, Homo sapiens
catttctagcgcatggcctg

SEQ ID NO: 818883 - DNA, 14 bp, Homo sapiens
catttctatttatt

SEQ ID NO: 818884 - DNA, 19 bp, Homo sapiens
catttctatttctcctcca

SEQ ID NO: 818885 - DNA, 22 bp, Homo sapiens
catttctccatgggccaccgcc

SEQ ID NO: 818886 - DNA, 11 bp, Homo sapiens
catttctctgc

SEQ ID NO: 818887 - DNA, 14 bp, Homo sapiens
catttctcttctca

SEQ ID NO: 818888 - DNA, 21 bp, Homo sapiens
catttctcttctcagctcttc

SEQ ID NO: 818889 - DNA, 23 bp, Homo sapiens
catttctcttctcagctcttcca

SEQ ID NO: 818890 - DNA, 13 bp, Homo sapiens
catttctctttaa

SEQ ID NO: 818891 - DNA, 12 bp, Homo sapiens
catttctgcaga

SEQ ID NO: 818892 - DNA, 12 bp, Homo sapiens
catttctgcctc

SEQ ID NO: 818893 - DNA, 16 bp, Homo sapiens
catttctgtatactgt

SEQ ID NO: 818894 - DNA, 10 bp, Homo sapiens
catttctgtc

SEQ ID NO: 818895 - DNA, 11 bp, Homo sapiens
catttctgttc

SEQ ID NO: 818896 - DNA, 13 bp, Homo sapiens
catttcttatcac

SEQ ID NO: 818897 - DNA, 15 bp, Homo sapiens
catttcttatgattt

SEQ ID NO: 818898 - DNA, 16 bp, Homo sapiens
catttcttatgatttt

SEQ ID NO: 818899 - DNA, 15 bp, Homo sapiens
catttcttcctctgc

SEQ ID NO: 818900 - DNA, 17 bp, Homo sapiens
catttcttctctctgtt

SEQ ID NO: 818901 - DNA, 17 bp, Homo sapiens
catttcttgaaaagcct

SEQ ID NO: 818902 - DNA, 15 bp, Homo sapiens
catttcttgctagct

SEQ ID NO: 818903 - DNA, 12 bp, Homo sapiens
catttctttctt

SEQ ID NO: 818904 - DNA, 14 bp, Homo sapiens
catttctttcttgc

SEQ ID NO: 818905 - DNA, 19 bp, Homo sapiens
catttctttcttgctggct

SEQ ID NO: 818906 - DNA, 19 bp, Homo sapiens
catttctttgtctttttcc

SEQ ID NO: 818907 - DNA, 22 bp, Homo sapiens
catttctttgtctttttcctac

SEQ ID NO: 818908 - DNA, 13 bp, Homo sapiens
catttcttttctg

SEQ ID NO: 818909 - DNA, 20 bp, Homo sapiens
catttgaaaattttgatgtt

SEQ ID NO: 818910 - DNA, 20 bp, Homo sapiens
cattttatgaatatcattga

SEQ ID NO: 818911 - DNA, 17 bp, Homo sapiens
cattttatgctgtttat

SEQ ID NO: 818912 - DNA, 23 bp, Homo sapiens
cattttattaagctttttggaat

SEQ ID NO: 818913 - DNA, 14 bp, Homo sapiens
cattttattgactg

SEQ ID NO: 818914 - DNA, 19 bp, Homo sapiens
cattttattttattatgca

SEQ ID NO: 818915 - DNA, 19 bp, Homo sapiens
cattttattttttgggcca

SEQ ID NO: 818916 - DNA, 16 bp, Homo sapiens
cattttcaccccaccc

SEQ ID NO: 818917 - DNA, 17 bp, Homo sapiens
cattttcagtcttgtag

SEQ ID NO: 818918 - DNA, 15 bp, Homo sapiens
cattttcatcactgg

SEQ ID NO: 818919 - DNA, 16 bp, Homo sapiens
cattttcatcctgagc

SEQ ID NO: 818920 - DNA, 12 bp, Homo sapiens
cattttcatgtg

SEQ ID NO: 818921 - DNA, 14 bp, Homo sapiens
cattttcattccta

SEQ ID NO: 818922 - DNA, 19 bp, Homo sapiens
cattttcccatcatccttt

SEQ ID NO: 818923 - DNA, 23 bp, Homo sapiens
cattttcccatcatcctttgttc

SEQ ID NO: 818924 - DNA, 17 bp, Homo sapiens
cattttccccccactct

SEQ ID NO: 818925 - DNA, 11 bp, Homo sapiens
cattttcctcc

SEQ ID NO: 818926 - DNA, 15 bp, Homo sapiens
cattttcctcctctg

SEQ ID NO: 818927 - DNA, 19 bp, Homo sapiens
cattttcctcctctgccta

SEQ ID NO: 818928 - DNA, 22 bp, Homo sapiens
cattttcctcgcctaggcctgt

SEQ ID NO: 818929 - DNA, 22 bp, Homo sapiens
cattttcctcttgtcctggccc

SEQ ID NO: 818930 - DNA, 12 bp, Homo sapiens
cattttcctgtt

SEQ ID NO: 818931 - DNA, 15 bp, Homo sapiens
cattttcctgttcag

SEQ ID NO: 818932 - DNA, 19 bp, Homo sapiens
cattttctacgtcatgtat

SEQ ID NO: 818933 - DNA, 17 bp, Homo sapiens
cattttctagatacaat

SEQ ID NO: 818934 - DNA, 23 bp, Homo sapiens
cattttctagatacaataaattg

SEQ ID NO: 818935 - DNA, 18 bp, Homo sapiens
cattttctggtttggcat

SEQ ID NO: 818936 - DNA, 23 bp, Homo sapiens
cattttcttattgcgctgctacc

SEQ ID NO: 818937 - DNA, 15 bp, Homo sapiens
cattttcttcagaat

SEQ ID NO: 818938 - DNA, 18 bp, Homo sapiens
cattttcttctctgtgaa

SEQ ID NO: 818939 - DNA, 11 bp, Homo sapiens
cattttgaaaa

SEQ ID NO: 818940 - DNA, 13 bp, Homo sapiens
cattttgaaacaa

SEQ ID NO: 818941 - DNA, 12 bp, Homo sapiens
cattttgaaagt

SEQ ID NO: 818942 - DNA, 12 bp, Homo sapiens
cattttgaagtg

SEQ ID NO: 818943 - DNA, 15 bp, Homo sapiens
cattttgaatcacat

SEQ ID NO: 818944 - DNA, 23 bp, Homo sapiens
cattttgaatcacatgaattatt

SEQ ID NO: 818945 - DNA, 18 bp, Homo sapiens
cattttgacaaagtgcct

SEQ ID NO: 818946 - DNA, 12 bp, Homo sapiens
cattttgcaaaa

SEQ ID NO: 818947 - DNA, 16 bp, Homo sapiens
cattttgcagaaggaa

SEQ ID NO: 818948 - DNA, 18 bp, Homo sapiens
cattttgcagaaggaaat

SEQ ID NO: 818949 - DNA, 20 bp, Homo sapiens
cattttgcagcagtgagtct

SEQ ID NO: 818950 - DNA, 13 bp, Homo sapiens
cattttgcattca

SEQ ID NO: 818951 - DNA, 18 bp, Homo sapiens
cattttgctaaatgtgaa

SEQ ID NO: 818952 - DNA, 24 bp, Homo sapiens
cattttgctaaatgtgaatgatga

SEQ ID NO: 818953 - DNA, 18 bp, Homo sapiens
cattttggaagttttcag

SEQ ID NO: 818954 - DNA, 23 bp, Homo sapiens
cattttgggatccttcagcacag

SEQ ID NO: 818955 - DNA, 20 bp, Homo sapiens
cattttgggggtttttaatc

SEQ ID NO: 818956 - DNA, 17 bp, Homo sapiens
cattttggggttttata

SEQ ID NO: 818957 - DNA, 14 bp, Homo sapiens
cattttggtacttt

SEQ ID NO: 818958 - DNA, 19 bp, Homo sapiens
cattttgtaaaatattatg

SEQ ID NO: 818959 - DNA, 22 bp, Homo sapiens
cattttgtaatatttgaatttt

SEQ ID NO: 818960 - DNA, 13 bp, Homo sapiens
catttttaaatgt

SEQ ID NO: 818961 - DNA, 19 bp, Homo sapiens
catttttaatgatctcgga

SEQ ID NO: 818962 - DNA, 13 bp, Homo sapiens
catttttaatgta

SEQ ID NO: 818963 - DNA, 19 bp, Homo sapiens
catttttaatgtatctatt

SEQ ID NO: 818964 - DNA, 14 bp, Homo sapiens
catttttacaagtt

SEQ ID NO: 818965 - DNA, 15 bp, Homo sapiens
catttttacaataaa

SEQ ID NO: 818966 - DNA, 17 bp, Homo sapiens
catttttacaataaata

SEQ ID NO: 818967 - DNA, 23 bp, Homo sapiens
catttttacaccaatttggtaaa

SEQ ID NO: 818968 - DNA, 17 bp, Homo sapiens
catttttacactattgt

SEQ ID NO: 818969 - DNA, 21 bp, Homo sapiens
catttttagattggttctgtt

SEQ ID NO: 818970 - DNA, 16 bp, Homo sapiens
catttttatgcagaca

SEQ ID NO: 818971 - DNA, 17 bp, Homo sapiens
catttttcactgtacat

SEQ ID NO: 818972 - DNA, 15 bp, Homo sapiens
catttttcacttttg

SEQ ID NO: 818973 - DNA, 18 bp, Homo sapiens
catttttcagatataaaa

SEQ ID NO: 818974 - DNA, 20 bp, Homo sapiens
catttttcagatataaaaga

SEQ ID NO: 818975 - DNA, 20 bp, Homo sapiens
catttttccaggactctttg

SEQ ID NO: 818976 - DNA, 16 bp, Homo sapiens
catttttccgtaaaaa

SEQ ID NO: 818977 - DNA, 23 bp, Homo sapiens
catttttcttagggaaggataca

SEQ ID NO: 818978 - DNA, 13 bp, Homo sapiens
catttttgggggg

SEQ ID NO: 818979 - DNA, 15 bp, Homo sapiens
catttttgtgagcct

SEQ ID NO: 818980 - DNA, 23 bp, Homo sapiens
catttttgtgagcctctttgtaa

SEQ ID NO: 818981 - DNA, 15 bp, Homo sapiens
catttttgtgcacag

SEQ ID NO: 818982 - DNA, 20 bp, Homo sapiens
catttttgttttgaaagttt

SEQ ID NO: 818983 - DNA, 20 bp, Homo sapiens
cattttttaggacatcttaa

SEQ ID NO: 818984 - DNA, 23 bp, Homo sapiens
cattttttagtctgtaatacact

SEQ ID NO: 818985 - DNA, 14 bp, Homo sapiens
cattttttcttccc

SEQ ID NO: 818986 - DNA, 19 bp, Homo sapiens
cattttttgggcagcaatt

SEQ ID NO: 818987 - DNA, 23 bp, Homo sapiens
cattttttgtattttaactactt

SEQ ID NO: 818988 - DNA, 23 bp, Homo sapiens
cattttttttaagaaaaaggatg

SEQ ID NO: 818989 - DNA, 14 bp, Homo sapiens
cattttttttcaag

SEQ ID NO: 818990 - DNA, 18 bp, Homo sapiens
catttttttttcaatcaa

SEQ ID NO: 818991 - DNA, 16 bp, Homo sapiens
ccaaaaaaaaaaaagg

SEQ ID NO: 818992 - DNA, 19 bp, Homo sapiens
ccaaaaaaaaatacatgct

SEQ ID NO: 818993 - DNA, 15 bp, Homo sapiens
ccaaaaaaaggaaaa

SEQ ID NO: 818994 - DNA, 16 bp, Homo sapiens
ccaaaaaaaggaaaaa

SEQ ID NO: 818995 - DNA, 18 bp, Homo sapiens
ccaaaaaggcaaataatg

SEQ ID NO: 818996 - DNA, 22 bp, Homo sapiens
ccaaaaaggttgctgtttcaca

SEQ ID NO: 818997 - DNA, 12 bp, Homo sapiens
ccaaaacaaaca

SEQ ID NO: 818998 - DNA, 18 bp, Homo sapiens
ccaaaacaagccaaagag

SEQ ID NO: 818999 - DNA, 19 bp, Homo sapiens
ccaaaacaagccaaagagc

SEQ ID NO: 819000 - DNA, 19 bp, Homo sapiens
ccaaaacataaaaaccaaa

SEQ ID NO: 819001 - DNA, 16 bp, Homo sapiens
ccaaaaccaatgctga

SEQ ID NO: 819002 - DNA, 13 bp, Homo sapiens
ccaaaaccacatg

SEQ ID NO: 819003 - DNA, 20 bp, Homo sapiens
ccaaaaccacatgggctggg

SEQ ID NO: 819004 - DNA, 15 bp, Homo sapiens
ccaaaacccatgtgg

SEQ ID NO: 819005 - DNA, 15 bp, Homo sapiens
ccaaaacctgcttcc

SEQ ID NO: 819006 - DNA, 12 bp, Homo sapiens
ccaaaactgctc

SEQ ID NO: 819007 - DNA, 13 bp, Homo sapiens
ccaaaacttccaa

SEQ ID NO: 819008 - DNA, 15 bp, Homo sapiens
ccaaaagaaactgac

SEQ ID NO: 819009 - DNA, 16 bp, Homo sapiens
ccaaaagattgctgaa

SEQ ID NO: 819010 - DNA, 23 bp, Homo sapiens
ccaaaagccatgtatttcaggga

SEQ ID NO: 819011 - DNA, 21 bp, Homo sapiens
ccaaaaggattcctctttgtt

SEQ ID NO: 819012 - DNA, 17 bp, Homo sapiens
ccaaaagttacatgttt

SEQ ID NO: 819013 - DNA, 21 bp, Homo sapiens
ccaaaataaaactttttaaaa

SEQ ID NO: 819014 - DNA, 17 bp, Homo sapiens
ccaaaataagaaaagat

SEQ ID NO: 819015 - DNA, 19 bp, Homo sapiens
ccaaaataccaaatgcctg

SEQ ID NO: 819016 - DNA, 12 bp, Homo sapiens
ccaaaatattaa

SEQ ID NO: 819017 - DNA, 18 bp, Homo sapiens
ccaaaatccaaaacttct

SEQ ID NO: 819018 - DNA, 14 bp, Homo sapiens
ccaaaatcccctca

SEQ ID NO: 819019 - DNA, 15 bp, Homo sapiens
ccaaaatcccctcag

SEQ ID NO: 819020 - DNA, 16 bp, Homo sapiens
ccaaaatcccctcagc

SEQ ID NO: 819021 - DNA, 17 bp, Homo sapiens
ccaaaatgttgaaatat

SEQ ID NO: 819022 - DNA, 15 bp, Homo sapiens
ccaaacaccttccag

SEQ ID NO: 819023 - DNA, 22 bp, Homo sapiens
ccaaacaccttccagctcctgt

SEQ ID NO: 819024 - DNA, 14 bp, Homo sapiens
ccaaacaggacagc

SEQ ID NO: 819025 - DNA, 12 bp, Homo sapiens
ccaaacatgcat

SEQ ID NO: 819026 - DNA, 16 bp, Homo sapiens
ccaaaccaggaccctg

SEQ ID NO: 819027 - DNA, 21 bp, Homo sapiens
ccaaaccagtttattctgtgg

SEQ ID NO: 819028 - DNA, 22 bp, Homo sapiens
ccaaaccagtttattctgtggt

SEQ ID NO: 819029 - DNA, 23 bp, Homo sapiens
ccaaaccagtttattctgtggtt

SEQ ID NO: 819030 - DNA, 15 bp, Homo sapiens
ccaaaccatgagaat

SEQ ID NO: 819031 - DNA, 21 bp, Homo sapiens
ccaaacccacttctggcctcc

SEQ ID NO: 819032 - DNA, 23 bp, Homo sapiens
ccaactctccccagtgcctgcca

SEQ ID NO: 819033 - DNA, 19 bp, Homo sapiens
ccaactctcctggcctggc

SEQ ID NO: 819034 - DNA, 23 bp, Homo sapiens
ccaactctcctggcctggccatc

SEQ ID NO: 819035 - DNA, 20 bp, Homo sapiens
ccaactctgcactccatggc

SEQ ID NO: 819036 - DNA, 12 bp, Homo sapiens
ccaactcttcct

SEQ ID NO: 819037 - DNA, 16 bp, Homo sapiens
ccaactgacctgccag

SEQ ID NO: 819038 - DNA, 13 bp, Homo sapiens
ccaactgtatata

SEQ ID NO: 819039 - DNA, 13 bp, Homo sapiens
ccaactgtgagca

SEQ ID NO: 819040 - DNA, 13 bp, Homo sapiens
ccaactgtgttgt

SEQ ID NO: 819041 - DNA, 16 bp, Homo sapiens
ccaacttcaccacccc

SEQ ID NO: 819042 - DNA, 13 bp, Homo sapiens
ccaacttcccagt

SEQ ID NO: 819043 - DNA, 19 bp, Homo sapiens
ccaacttctcttgctttct

SEQ ID NO: 819044 - DNA, 13 bp, Homo sapiens
ccaacttgaagga

SEQ ID NO: 819045 - DNA, 19 bp, Homo sapiens
ccaacttgagggcccagag

SEQ ID NO: 819046 - DNA, 20 bp, Homo sapiens
ccaacttgccaaaatgttgg

SEQ ID NO: 819047 - DNA, 14 bp, Homo sapiens
ccaacttgccacat

SEQ ID NO: 819048 - DNA, 14 bp, Homo sapiens
ccaacttggcagct

SEQ ID NO: 819049 - DNA, 21 bp, Homo sapiens
ccaacttggcagctttttctg

SEQ ID NO: 819050 - DNA, 21 bp, Homo sapiens
ccaacttggttctgcttcaat

SEQ ID NO: 819051 - DNA, 11 bp, Homo sapiens
ccaacttgtaa

SEQ ID NO: 819052 - DNA, 23 bp, Homo sapiens
ccaacttgtattaaagacagagg

SEQ ID NO: 819053 - DNA, 14 bp, Homo sapiens
ccaactttctgtaa

SEQ ID NO: 819054 - DNA, 15 bp, Homo sapiens
ccaagaaaatcacat

SEQ ID NO: 819055 - DNA, 14 bp, Homo sapiens
ccaagaaaatgaag

SEQ ID NO: 819056 - DNA, 19 bp, Homo sapiens
ccaagaaacactgcctgcc

SEQ ID NO: 819057 - DNA, 14 bp, Homo sapiens
ccaagaaagatcca

SEQ ID NO: 819058 - DNA, 22 bp, Homo sapiens
ccaagaaagatgaatacatttt

SEQ ID NO: 819059 - DNA, 21 bp, Homo sapiens
ccaagaaagctcactgtagct

SEQ ID NO: 819060 - DNA, 20 bp, Homo sapiens
ccaagaatagatgctgactg

SEQ ID NO: 819061 - DNA, 21 bp, Homo sapiens
ccaagacacttccccttgtct

SEQ ID NO: 819062 - DNA, 18 bp, Homo sapiens
ccaagacagatggacact

SEQ ID NO: 819063 - DNA, 21 bp, Homo sapiens
ccaagacatgtctgttctaca

SEQ ID NO: 819064 - DNA, 11 bp, Homo sapiens
ccaagacattg

SEQ ID NO: 819065 - DNA, 16 bp, Homo sapiens
ccaagacattgtcaat

SEQ ID NO: 819066 - DNA, 17 bp, Homo sapiens
ccaagacattgtcaata

SEQ ID NO: 819067 - DNA, 14 bp, Homo sapiens
ccaagacctggtgt

SEQ ID NO: 819068 - DNA, 22 bp, Homo sapiens
ccaagacttggcaacagaagca

SEQ ID NO: 819069 - DNA, 20 bp, Homo sapiens
ccaagagaactaaagctgga

SEQ ID NO: 819070 - DNA, 12 bp, Homo sapiens
ccaagagaccag

SEQ ID NO: 819071 - DNA, 13 bp, Homo sapiens
ccaagagagaaag

SEQ ID NO: 819072 - DNA, 22 bp, Homo sapiens
ccaagagaggaaggacccctca

SEQ ID NO: 819073 - DNA, 14 bp, Homo sapiens
ccaagagatgaaga

SEQ ID NO: 819074 - DNA, 15 bp, Homo sapiens
ccaagagcagagtct

SEQ ID NO: 819075 - DNA, 20 bp, Homo sapiens
ccaagagcagagtctgggcc

SEQ ID NO: 819076 - DNA, 18 bp, Homo sapiens
ccaagaggactgagactg

SEQ ID NO: 819077 - DNA, 11 bp, Homo sapiens
ccaagaggctg

SEQ ID NO: 819078 - DNA, 12 bp, Homo sapiens
ccaagaggctgg

SEQ ID NO: 819079 - DNA, 14 bp, Homo sapiens
ccaagaggctggtt

SEQ ID NO: 819080 - DNA, 21 bp, Homo sapiens
ccaagaggggcgggctcagag

SEQ ID NO: 819081 - DNA, 15 bp, Homo sapiens
ccaagaggtctgagc

SEQ ID NO: 819082 - DNA, 16 bp, Homo sapiens
ccaagaggtctgagcc

SEQ ID NO: 819083 - DNA, 15 bp, Homo sapiens
ccaagataggacctt

SEQ ID NO: 819084 - DNA, 22 bp, Homo sapiens
ccaagatggaagtcacctttct

SEQ ID NO: 819085 - DNA, 23 bp, Homo sapiens
ccaagatggcatgaatcgggcta

SEQ ID NO: 819086 - DNA, 18 bp, Homo sapiens
ccaagatgggcatctttt

SEQ ID NO: 819087 - DNA, 22 bp, Homo sapiens
ccaagatgggcatcttttgtat

SEQ ID NO: 819088 - DNA, 10 bp, Homo sapiens
ccaagcaaac

SEQ ID NO: 819089 - DNA, 20 bp, Homo sapiens
ccaagcaaaggtgaagagac

SEQ ID NO: 819090 - DNA, 22 bp, Homo sapiens
ccaagcaagtagctttccacat

SEQ ID NO: 819091 - DNA, 14 bp, Homo sapiens
ccaagcacagagcc

SEQ ID NO: 819092 - DNA, 14 bp, Homo sapiens
ccaagcacagcagc

SEQ ID NO: 819093 - DNA, 18 bp, Homo sapiens
ccaagcacagcagcctgg

SEQ ID NO: 819094 - DNA, 13 bp, Homo sapiens
ccaagcagactcc

SEQ ID NO: 819095 - DNA, 22 bp, Homo sapiens
ccaagcagactccagcccctgg

SEQ ID NO: 819096 - DNA, 14 bp, Homo sapiens
ccaagcagccagcc

SEQ ID NO: 819097 - DNA, 16 bp, Homo sapiens
ccaagcagccagccag

SEQ ID NO: 819098 - DNA, 20 bp, Homo sapiens
ccaagcaggacgaaaaagag

SEQ ID NO: 819099 - DNA, 20 bp, Homo sapiens
ccaagcagtggcctttttct

SEQ ID NO: 819100 - DNA, 21 bp, Homo sapiens
ccaagcatagagaagagtctg

SEQ ID NO: 819101 - DNA, 18 bp, Homo sapiens
ccaagccaagggaacctg

SEQ ID NO: 819102 - DNA, 23 bp, Homo sapiens
ccaagccaagggaacctgtgtcc

SEQ ID NO: 819103 - DNA, 13 bp, Homo sapiens
ccaagccccatct

SEQ ID NO: 819104 - DNA, 14 bp, Homo sapiens
ccaagccccctggc

SEQ ID NO: 819105 - DNA, 18 bp, Homo sapiens
ccaagccccctggcagct

SEQ ID NO: 819106 - DNA, 19 bp, Homo sapiens
ccaagccccctggcagctg

SEQ ID NO: 819107 - DNA, 21 bp, Homo sapiens
ccaagcccctgccctggggag

SEQ ID NO: 819108 - DNA, 17 bp, Homo sapiens
ccaagccctaagcctgt

SEQ ID NO: 819109 - DNA, 18 bp, Homo sapiens
ccaagccctaagcctgtc

SEQ ID NO: 819110 - DNA, 19 bp, Homo sapiens
ccaagccctaagcctgtcc

SEQ ID NO: 819111 - DNA, 20 bp, Homo sapiens
ccaagccctaagcctgtccc

SEQ ID NO: 819112 - DNA, 15 bp, Homo sapiens
ccaagccctcctttg

SEQ ID NO: 819113 - DNA, 13 bp, Homo sapiens
ccaagccgtggct

SEQ ID NO: 819114 - DNA, 15 bp, Homo sapiens
ccaagccgtggcttc

SEQ ID NO: 819115 - DNA, 16 bp, Homo sapiens
ccaagccgtggcttcc

SEQ ID NO: 819116 - DNA, 17 bp, Homo sapiens
ccaagccgtggcttccc

SEQ ID NO: 819117 - DNA, 21 bp, Homo sapiens
ccaagccgtggcttcccgctc

SEQ ID NO: 819118 - DNA, 13 bp, Homo sapiens
ccaagcctccaca

SEQ ID NO: 819119 - DNA, 16 bp, Homo sapiens
ccaagcctccacagcg

SEQ ID NO: 819120 - DNA, 20 bp, Homo sapiens
ccaagcctccacagcgaggg

SEQ ID NO: 819121 - DNA, 13 bp, Homo sapiens
ccaagcctgacca

SEQ ID NO: 819122 - DNA, 13 bp, Homo sapiens
ccaagcctgcctc

SEQ ID NO: 819123 - DNA, 14 bp, Homo sapiens
ccaagcctggcacc

SEQ ID NO: 819124 - DNA, 16 bp, Homo sapiens
ccaagcctggcaccca

SEQ ID NO: 819125 - DNA, 17 bp, Homo sapiens
ccaagcctggcacccac

SEQ ID NO: 819126 - DNA, 11 bp, Homo sapiens
ccaagccttgg

SEQ ID NO: 819127 - DNA, 21 bp, Homo sapiens
ccaagcgaggtcaacagagaa

SEQ ID NO: 819128 - DNA, 22 bp, Homo sapiens
ccaagcgttcctggccttctga

SEQ ID NO: 819129 - DNA, 15 bp, Homo sapiens
ccaagctatctaaag

SEQ ID NO: 819130 - DNA, 22 bp, Homo sapiens
ccaagctcacagttcctcgccc

SEQ ID NO: 819131 - DNA, 14 bp, Homo sapiens
ccaagctccaaatc

SEQ ID NO: 819132 - DNA, 17 bp, Homo sapiens
ccaagctccaagcccca

SEQ ID NO: 819133 - DNA, 17 bp, Homo sapiens
ccaagctccctggagcc

SEQ ID NO: 819134 - DNA, 19 bp, Homo sapiens
ccaagctccctggagccct

SEQ ID NO: 819135 - DNA, 15 bp, Homo sapiens
ccaagctgagtttcc

SEQ ID NO: 819136 - DNA, 11 bp, Homo sapiens
ccaagctgcac

SEQ ID NO: 819137 - DNA, 16 bp, Homo sapiens
ccaagctgcacaattt

SEQ ID NO: 819138 - DNA, 18 bp, Homo sapiens
ccaagctgcctctgggcc

SEQ ID NO: 819139 - DNA, 20 bp, Homo sapiens
ccaagctgcctctgggccat

SEQ ID NO: 819140 - DNA, 23 bp, Homo sapiens
ccaagctggtcttaaactcctgg

SEQ ID NO: 819141 - DNA, 17 bp, Homo sapiens
ccaagctgtggcagccg

SEQ ID NO: 819142 - DNA, 22 bp, Homo sapiens
ccaagctgtggcagccgtccca

SEQ ID NO: 819143 - DNA, 13 bp, Homo sapiens
ccaagcttcctgt

SEQ ID NO: 819144 - DNA, 14 bp, Homo sapiens
ccaagcttcctgtg

SEQ ID NO: 819145 - DNA, 18 bp, Homo sapiens
ccaagcttcctgtgccct

SEQ ID NO: 819146 - DNA, 15 bp, Homo sapiens
ccaagcttggcagcc

SEQ ID NO: 819147 - DNA, 15 bp, Homo sapiens
ccaagctttaaatta

SEQ ID NO: 819148 - DNA, 21 bp, Homo sapiens
ccaagctttgaggctctgtca

SEQ ID NO: 819149 - DNA, 23 bp, Homo sapiens
ccaaggaaataaggacagtctag

SEQ ID NO: 819150 - DNA, 13 bp, Homo sapiens
ccaaggaagcagc

SEQ ID NO: 819151 - DNA, 21 bp, Homo sapiens
ccaaggaagcagcctcagagt

SEQ ID NO: 819152 - DNA, 19 bp, Homo sapiens
ccaaggaagctccagatcc

SEQ ID NO: 819153 - DNA, 15 bp, Homo sapiens
ccaaggaaggagccc

SEQ ID NO: 819154 - DNA, 21 bp, Homo sapiens
ccacaaaacttcagtgtggta

SEQ ID NO: 819155 - DNA, 12 bp, Homo sapiens
ccacaaaatata

SEQ ID NO: 819156 - DNA, 18 bp, Homo sapiens
ccacaaaattagaaagga

SEQ ID NO: 819157 - DNA, 21 bp, Homo sapiens
ccacaaacctggattttttat

SEQ ID NO: 819158 - DNA, 16 bp, Homo sapiens
ccacaaacggagcccc

SEQ ID NO: 819159 - DNA, 22 bp, Homo sapiens
ccacaaagccttatcaagtgtc

SEQ ID NO: 819160 - DNA, 17 bp, Homo sapiens
ccacaaataaatgacaa

SEQ ID NO: 819161 - DNA, 20 bp, Homo sapiens
ccacaaatcaaagcaagggc

SEQ ID NO: 819162 - DNA, 23 bp, Homo sapiens
ccacaaatcaaagcaagggctcc

SEQ ID NO: 819163 - DNA, 22 bp, Homo sapiens
ccacaaatgggaaaaccagact

SEQ ID NO: 819164 - DNA, 15 bp, Homo sapiens
ccacaacagcctggg

SEQ ID NO: 819165 - DNA, 14 bp, Homo sapiens
ccacaaccttgcag

SEQ ID NO: 819166 - DNA, 15 bp, Homo sapiens
ccacaaccttgcagt

SEQ ID NO: 819167 - DNA, 19 bp, Homo sapiens
ccacaactgctgtggcccc

SEQ ID NO: 819168 - DNA, 15 bp, Homo sapiens
ccacaagaaatttga

SEQ ID NO: 819169 - DNA, 20 bp, Homo sapiens
ccacaagattcccagagaca

SEQ ID NO: 819170 - DNA, 24 bp, Homo sapiens
ccacaagattcccagagacaggaa

SEQ ID NO: 819171 - DNA, 23 bp, Homo sapiens
ccacaagcccgtgacagatgcca

SEQ ID NO: 819172 - DNA, 17 bp, Homo sapiens
ccacaagctgagcagga

SEQ ID NO: 819173 - DNA, 17 bp, Homo sapiens
ccacaagctgcactgtg

SEQ ID NO: 819174 - DNA, 21 bp, Homo sapiens
ccacaagctgcactgtgaacc

SEQ ID NO: 819175 - DNA, 18 bp, Homo sapiens
ccacaaggaaccctcagg

SEQ ID NO: 819176 - DNA, 24 bp, Homo sapiens
ccacaaggaataaatgagagggaa

SEQ ID NO: 819177 - DNA, 18 bp, Homo sapiens
ccacaaggctggccagca

SEQ ID NO: 819178 - DNA, 23 bp, Homo sapiens
ccacaaggtccccccaccgctca

SEQ ID NO: 819179 - DNA, 15 bp, Homo sapiens
ccacaagtcttccag

SEQ ID NO: 819180 - DNA, 21 bp, Homo sapiens
ccacaagtgaatctttctcct

SEQ ID NO: 819181 - DNA, 22 bp, Homo sapiens
ccacaagtgaatctttctcctg

SEQ ID NO: 819182 - DNA, 21 bp, Homo sapiens
ccacaagtgccgcaaattgta

SEQ ID NO: 819183 - DNA, 16 bp, Homo sapiens
ccacaatgcagttctg

SEQ ID NO: 819184 - DNA, 16 bp, Homo sapiens
ccacacacagaggaag

SEQ ID NO: 819185 - DNA, 18 bp, Homo sapiens
ccacacacagaggaagag

SEQ ID NO: 819186 - DNA, 14 bp, Homo sapiens
ccacacacaggcct

SEQ ID NO: 819187 - DNA, 15 bp, Homo sapiens
ccacacacaggcctt

SEQ ID NO: 819188 - DNA, 18 bp, Homo sapiens
ccacacacaggccttctg

SEQ ID NO: 819189 - DNA, 22 bp, Homo sapiens
ccacacacttagccattgaaat

SEQ ID NO: 819190 - DNA, 23 bp, Homo sapiens
ccacacacttagccattgaaatg

SEQ ID NO: 819191 - DNA, 16 bp, Homo sapiens
ccacacagctgcccta

SEQ ID NO: 819192 - DNA, 14 bp, Homo sapiens
ccacacaggctggc

SEQ ID NO: 819193 - DNA, 15 bp, Homo sapiens
ccacacagggcactg

SEQ ID NO: 819194 - DNA, 16 bp, Homo sapiens
ccacacagggcactga

SEQ ID NO: 819195 - DNA, 13 bp, Homo sapiens
ccacacattccag

SEQ ID NO: 819196 - DNA, 17 bp, Homo sapiens
ccacacattccagccag

SEQ ID NO: 819197 - DNA, 20 bp, Homo sapiens
ccacacattccagccaggcc

SEQ ID NO: 819198 - DNA, 17 bp, Homo sapiens
ccacacattccagggct

SEQ ID NO: 819199 - DNA, 18 bp, Homo sapiens
ccacacattccagggctg

SEQ ID NO: 819200 - DNA, 20 bp, Homo sapiens
ccacacattccagggctggg

SEQ ID NO: 819201 - DNA, 16 bp, Homo sapiens
ccacaccaatcagaga

SEQ ID NO: 819202 - DNA, 17 bp, Homo sapiens
ccacaccaatcagagag

SEQ ID NO: 819203 - DNA, 20 bp, Homo sapiens
ccacaccacagcaagccggc

SEQ ID NO: 819204 - DNA, 17 bp, Homo sapiens
ccacacccaggaaggga

SEQ ID NO: 819205 - DNA, 15 bp, Homo sapiens
ccacacccagggcta

SEQ ID NO: 819206 - DNA, 13 bp, Homo sapiens
ccacacccaggtc

SEQ ID NO: 819207 - DNA, 14 bp, Homo sapiens
ccacaccccagccc

SEQ ID NO: 819208 - DNA, 14 bp, Homo sapiens
ccacaccgcagaag

SEQ ID NO: 819209 - DNA, 18 bp, Homo sapiens
ccacacctcagttccctt

SEQ ID NO: 819210 - DNA, 20 bp, Homo sapiens
ccacacctccccctgctgct

SEQ ID NO: 819211 - DNA, 17 bp, Homo sapiens
ccacacctccctgaacc

SEQ ID NO: 819212 - DNA, 12 bp, Homo sapiens
ccacacctgagc

SEQ ID NO: 819213 - DNA, 22 bp, Homo sapiens
ccacacctgagcgctgtggact

SEQ ID NO: 819214 - DNA, 22 bp, Homo sapiens
ccacacctggccttaaagaggg

SEQ ID NO: 819215 - DNA, 16 bp, Homo sapiens
ccacacgcaggcggcc

SEQ ID NO: 819216 - DNA, 19 bp, Homo sapiens
ccacacggactcccgggcc

SEQ ID NO: 819217 - DNA, 16 bp, Homo sapiens
ccacacggcagccccc

SEQ ID NO: 819218 - DNA, 23 bp, Homo sapiens
ccacactaacctgggttcccttt

SEQ ID NO: 819219 - DNA, 14 bp, Homo sapiens
ccacactacacagc

SEQ ID NO: 819220 - DNA, 15 bp, Homo sapiens
ccacactacacagca

SEQ ID NO: 819221 - DNA, 16 bp, Homo sapiens
ccacactacacagcac

SEQ ID NO: 819222 - DNA, 22 bp, Homo sapiens
ccacactagaattcatgtgaga

SEQ ID NO: 819223 - DNA, 20 bp, Homo sapiens
ccacactattaccatgagaa

SEQ ID NO: 819224 - DNA, 12 bp, Homo sapiens
ccacactccact

SEQ ID NO: 819225 - DNA, 13 bp, Homo sapiens
ccacactctccat

SEQ ID NO: 819226 - DNA, 18 bp, Homo sapiens
ccacactgaaaccaaaac

SEQ ID NO: 819227 - DNA, 12 bp, Homo sapiens
ccacactgaggc

SEQ ID NO: 819228 - DNA, 19 bp, Homo sapiens
ccacactgatggctcaaga

SEQ ID NO: 819229 - DNA, 22 bp, Homo sapiens
ccacactgggtgcgtctccagt

SEQ ID NO: 819230 - DNA, 18 bp, Homo sapiens
ccacactgtgcagaccca

SEQ ID NO: 819231 - DNA, 16 bp, Homo sapiens
ccacacttcaggctct

SEQ ID NO: 819232 - DNA, 22 bp, Homo sapiens
ccacacttcaggctcttctcct

SEQ ID NO: 819233 - DNA, 15 bp, Homo sapiens
ccacacttccctggc

SEQ ID NO: 819234 - DNA, 16 bp, Homo sapiens
ccacacttcctgtcca

SEQ ID NO: 819235 - DNA, 22 bp, Homo sapiens
ccacacttcttgaaacagcctg

SEQ ID NO: 819236 - DNA, 17 bp, Homo sapiens
ccacacttgagaggatg

SEQ ID NO: 819237 - DNA, 19 bp, Homo sapiens
ccacacttgagaggatgaa

SEQ ID NO: 819238 - DNA, 16 bp, Homo sapiens
ccacacttgtgccagc

SEQ ID NO: 819239 - DNA, 12 bp, Homo sapiens
ccacagaacctt

SEQ ID NO: 819240 - DNA, 20 bp, Homo sapiens
ccacagaagccaggagcaaa

SEQ ID NO: 819241 - DNA, 11 bp, Homo sapiens
ccacagacaca

SEQ ID NO: 819242 - DNA, 14 bp, Homo sapiens
ccacagacacacac

SEQ ID NO: 819243 - DNA, 15 bp, Homo sapiens
ccacagacacacaca

SEQ ID NO: 819244 - DNA, 14 bp, Homo sapiens
ccacagacctgcag

SEQ ID NO: 819245 - DNA, 16 bp, Homo sapiens
ccacagacctgcagtg

SEQ ID NO: 819246 - DNA, 23 bp, Homo sapiens
ccacagacctgcagtgaggggcc

SEQ ID NO: 819247 - DNA, 23 bp, Homo sapiens
ccacagacgggcacacagactgg

SEQ ID NO: 819248 - DNA, 19 bp, Homo sapiens
ccacagactccggcctgta

SEQ ID NO: 819249 - DNA, 15 bp, Homo sapiens
ccacagactgcccca

SEQ ID NO: 819250 - DNA, 19 bp, Homo sapiens
ccacagactgccccagcca

SEQ ID NO: 819251 - DNA, 17 bp, Homo sapiens
ccacagagaggagggga

SEQ ID NO: 819252 - DNA, 22 bp, Homo sapiens
ccacagatgatgaagaaatgat

SEQ ID NO: 819253 - DNA, 20 bp, Homo sapiens
ccacagatggctttcagggc

SEQ ID NO: 819254 - DNA, 22 bp, Homo sapiens
ccacagatggctttcagggcag

SEQ ID NO: 819255 - DNA, 15 bp, Homo sapiens
ccacagatgtctctg

SEQ ID NO: 819256 - DNA, 19 bp, Homo sapiens
ccacagatgtgtctgggag

SEQ ID NO: 819257 - DNA, 22 bp, Homo sapiens
ccacagatgtgtctgggagagc

SEQ ID NO: 819258 - DNA, 20 bp, Homo sapiens
ccacagcaaccccaggctga

SEQ ID NO: 819259 - DNA, 21 bp, Homo sapiens
ccacagcaagccatcatcctc

SEQ ID NO: 819260 - DNA, 19 bp, Homo sapiens
ccacagcacaaccggtccc

SEQ ID NO: 819261 - DNA, 14 bp, Homo sapiens
ccacagcacagcca

SEQ ID NO: 819262 - DNA, 18 bp, Homo sapiens
ccacagcagcagaacaag

SEQ ID NO: 819263 - DNA, 14 bp, Homo sapiens
ccacagcagctgaa

SEQ ID NO: 819264 - DNA, 14 bp, Homo sapiens
ccacagcaggatcg

SEQ ID NO: 819265 - DNA, 14 bp, Homo sapiens
ccacagcaggtcct

SEQ ID NO: 819266 - DNA, 14 bp, Homo sapiens
ccacagccagagga

SEQ ID NO: 819267 - DNA, 15 bp, Homo sapiens
ccacagccagaggag

SEQ ID NO: 819268 - DNA, 17 bp, Homo sapiens
ccacagccagaggaggg

SEQ ID NO: 819269 - DNA, 17 bp, Homo sapiens
ccacagccagcacctgg

SEQ ID NO: 819270 - DNA, 19 bp, Homo sapiens
ccacagccagcacctggca

SEQ ID NO: 819271 - DNA, 22 bp, Homo sapiens
ccacagccagcacctggcatcg

SEQ ID NO: 819272 - DNA, 11 bp, Homo sapiens
ccacagccccc

SEQ ID NO: 819273 - DNA, 21 bp, Homo sapiens
ccacagcccccttgccctccg

SEQ ID NO: 819274 - DNA, 18 bp, Homo sapiens
ccacagccgcagcctccc

SEQ ID NO: 819275 - DNA, 16 bp, Homo sapiens
ccaccacgtctgccag

SEQ ID NO: 819276 - DNA, 15 bp, Homo sapiens
ccaccactcaggcca

SEQ ID NO: 819277 - DNA, 19 bp, Homo sapiens
ccaccactcaggccacagt

SEQ ID NO: 819278 - DNA, 15 bp, Homo sapiens
ccaccactccactcc

SEQ ID NO: 819279 - DNA, 17 bp, Homo sapiens
ccaccactgcctgactg

SEQ ID NO: 819280 - DNA, 15 bp, Homo sapiens
ccaccactggccacc

SEQ ID NO: 819281 - DNA, 20 bp, Homo sapiens
ccaccactggccaccaggct

SEQ ID NO: 819282 - DNA, 12 bp, Homo sapiens
ccaccagaccca

SEQ ID NO: 819283 - DNA, 14 bp, Homo sapiens
ccaccagagccggg

SEQ ID NO: 819284 - DNA, 18 bp, Homo sapiens
ccaccagatagcagaggg

SEQ ID NO: 819285 - DNA, 12 bp, Homo sapiens
ccaccagcagca

SEQ ID NO: 819286 - DNA, 18 bp, Homo sapiens
ccaccagccagccctggc

SEQ ID NO: 819287 - DNA, 22 bp, Homo sapiens
ccaccagccagccctggcccac

SEQ ID NO: 819288 - DNA, 13 bp, Homo sapiens
ccaccagccatcc

SEQ ID NO: 819289 - DNA, 11 bp, Homo sapiens
ccaccagcccc

SEQ ID NO: 819290 - DNA, 16 bp, Homo sapiens
ccaccagccccagcaa

SEQ ID NO: 819291 - DNA, 12 bp, Homo sapiens
ccaccagccccg

SEQ ID NO: 819292 - DNA, 13 bp, Homo sapiens
ccaccagccgccc

SEQ ID NO: 819293 - DNA, 14 bp, Homo sapiens
ccaccagcctgctg

SEQ ID NO: 819294 - DNA, 22 bp, Homo sapiens
ccaccagcgttcccttctcccc

SEQ ID NO: 819295 - DNA, 11 bp, Homo sapiens
ccaccagctcc

SEQ ID NO: 819296 - DNA, 15 bp, Homo sapiens
ccaccagctccacac

SEQ ID NO: 819297 - DNA, 15 bp, Homo sapiens
ccaccaggactgaaa

SEQ ID NO: 819298 - DNA, 13 bp, Homo sapiens
ccaccaggagaac

SEQ ID NO: 819299 - DNA, 16 bp, Homo sapiens
ccaccaggagcacctg

SEQ ID NO: 819300 - DNA, 19 bp, Homo sapiens
ccaccaggagcacctggac

SEQ ID NO: 819301 - DNA, 20 bp, Homo sapiens
ccaccaggagcacctggacc

SEQ ID NO: 819302 - DNA, 21 bp, Homo sapiens
ccaccaggagcagcagccagc

SEQ ID NO: 819303 - DNA, 19 bp, Homo sapiens
ccaccaggccacctcccca

SEQ ID NO: 819304 - DNA, 21 bp, Homo sapiens
ccaccaggccacctccccagc

SEQ ID NO: 819305 - DNA, 12 bp, Homo sapiens
ccaccaggctgg

SEQ ID NO: 819306 - DNA, 23 bp, Homo sapiens
ccaccaggctggcgcagccaagg

SEQ ID NO: 819307 - DNA, 13 bp, Homo sapiens
ccaccagggagct

SEQ ID NO: 819308 - DNA, 22 bp, Homo sapiens
ccaccagggagcttcctggctc

SEQ ID NO: 819309 - DNA, 16 bp, Homo sapiens
ccaccagggtcccagg

SEQ ID NO: 819310 - DNA, 17 bp, Homo sapiens
ccaccagggtcccagga

SEQ ID NO: 819311 - DNA, 20 bp, Homo sapiens
ccaccagggtcccaggaagc

SEQ ID NO: 819312 - DNA, 13 bp, Homo sapiens
ccaccagggtgga

SEQ ID NO: 819313 - DNA, 20 bp, Homo sapiens
ccaccaggtgcctttcaaat

SEQ ID NO: 819314 - DNA, 14 bp, Homo sapiens
ccaccagtggacct

SEQ ID NO: 819315 - DNA, 21 bp, Homo sapiens
ccaccagtggacctagcctgg

SEQ ID NO: 819316 - DNA, 21 bp, Homo sapiens
ccaccagtgtagcatcttcct

SEQ ID NO: 819317 - DNA, 22 bp, Homo sapiens
ccaccagtgtagcatcttcctc

SEQ ID NO: 819318 - DNA, 18 bp, Homo sapiens
ccaccagtgtgtggggga

SEQ ID NO: 819319 - DNA, 12 bp, Homo sapiens
ccaccagttctc

SEQ ID NO: 819320 - DNA, 23 bp, Homo sapiens
ccaccatattcagtgctgtggcc

SEQ ID NO: 819321 - DNA, 13 bp, Homo sapiens
ccaccatccccac

SEQ ID NO: 819322 - DNA, 14 bp, Homo sapiens
ccaccatccccacc

SEQ ID NO: 819323 - DNA, 20 bp, Homo sapiens
ccaccatgcagcccctgggc

SEQ ID NO: 819324 - DNA, 16 bp, Homo sapiens
ccaccatgcctcacta

SEQ ID NO: 819325 - DNA, 19 bp, Homo sapiens
ccaccatgcttgcctgaag

SEQ ID NO: 819326 - DNA, 21 bp, Homo sapiens
ccaccatggaccagcccattg

SEQ ID NO: 819327 - DNA, 17 bp, Homo sapiens
ccaccatggccagccaa

SEQ ID NO: 819328 - DNA, 21 bp, Homo sapiens
ccaccatggccagccaacttt

SEQ ID NO: 819329 - DNA, 13 bp, Homo sapiens
ccaccattcacat

SEQ ID NO: 819330 - DNA, 19 bp, Homo sapiens
ccaccattcctgcctttaa

SEQ ID NO: 819331 - DNA, 23 bp, Homo sapiens
ccaccattcctgcctttaagcca

SEQ ID NO: 819332 - DNA, 20 bp, Homo sapiens
ccaccatttaaaaatgttag

SEQ ID NO: 819333 - DNA, 19 bp, Homo sapiens
ccacccaaaccccttccca

SEQ ID NO: 819334 - DNA, 20 bp, Homo sapiens
ccacccaaaccccttcccac

SEQ ID NO: 819335 - DNA, 19 bp, Homo sapiens
ccacccaagccctcctttg

SEQ ID NO: 819336 - DNA, 12 bp, Homo sapiens
ccacccaagcct

SEQ ID NO: 819337 - DNA, 14 bp, Homo sapiens
ccacccaagcttgg

SEQ ID NO: 819338 - DNA, 16 bp, Homo sapiens
ccacccacacagctgc

SEQ ID NO: 819339 - DNA, 21 bp, Homo sapiens
ccacccacacagctgccctag

SEQ ID NO: 819340 - DNA, 19 bp, Homo sapiens
ccacccacccccaggcctc

SEQ ID NO: 819341 - DNA, 13 bp, Homo sapiens
ccacccacctcca

SEQ ID NO: 819342 - DNA, 17 bp, Homo sapiens
ccacccacctccctgcc

SEQ ID NO: 819343 - DNA, 18 bp, Homo sapiens
ccacccacctcggcctcc

SEQ ID NO: 819344 - DNA, 13 bp, Homo sapiens
ccacccactcagg

SEQ ID NO: 819345 - DNA, 15 bp, Homo sapiens
ccacccactgtccgc

SEQ ID NO: 819346 - DNA, 11 bp, Homo sapiens
ccacccagagg

SEQ ID NO: 819347 - DNA, 12 bp, Homo sapiens
ccacccagcagg

SEQ ID NO: 819348 - DNA, 13 bp, Homo sapiens
ccacccagcaggc

SEQ ID NO: 819349 - DNA, 14 bp, Homo sapiens
ccacccagcccctc

SEQ ID NO: 819350 - DNA, 15 bp, Homo sapiens
ccacccagcccctct

SEQ ID NO: 819351 - DNA, 20 bp, Homo sapiens
ccacccagcccctctcccct

SEQ ID NO: 819352 - DNA, 13 bp, Homo sapiens
ccacccagccctt

SEQ ID NO: 819353 - DNA, 15 bp, Homo sapiens
ccacccagcccttcc

SEQ ID NO: 819354 - DNA, 17 bp, Homo sapiens
ccacccagctccaggcc

SEQ ID NO: 819355 - DNA, 22 bp, Homo sapiens
ccacccaggctgcactgcagtg

SEQ ID NO: 819356 - DNA, 13 bp, Homo sapiens
ccacccagggagc

SEQ ID NO: 819357 - DNA, 15 bp, Homo sapiens
ccacccagggctccc

SEQ ID NO: 819358 - DNA, 23 bp, Homo sapiens
ccacccagggctccctcctggag

SEQ ID NO: 819359 - DNA, 18 bp, Homo sapiens
ccacccaggtcccccgac

SEQ ID NO: 819360 - DNA, 17 bp, Homo sapiens
ccacccagtgctgccat

SEQ ID NO: 819361 - DNA, 18 bp, Homo sapiens
ccacccagttacaggggc

SEQ ID NO: 819362 - DNA, 18 bp, Homo sapiens
ccacccatcttcctgctg

SEQ ID NO: 819363 - DNA, 22 bp, Homo sapiens
ccacccatcttcctgctgctgt

SEQ ID NO: 819364 - DNA, 18 bp, Homo sapiens
ccaccccaaaccccagcc

SEQ ID NO: 819365 - DNA, 21 bp, Homo sapiens
ccaccccaaaccccagcccca

SEQ ID NO: 819366 - DNA, 17 bp, Homo sapiens
ccaccccacagactccg

SEQ ID NO: 819367 - DNA, 17 bp, Homo sapiens
ccaccccacccccttca

SEQ ID NO: 819368 - DNA, 13 bp, Homo sapiens
ccaccccagaaat

SEQ ID NO: 819369 - DNA, 19 bp, Homo sapiens
ccaccccagaaatcactgt

SEQ ID NO: 819370 - DNA, 22 bp, Homo sapiens
ccaccccagaaatcactgtgaa

SEQ ID NO: 819371 - DNA, 17 bp, Homo sapiens
ccaccccagcacagcca

SEQ ID NO: 819372 - DNA, 16 bp, Homo sapiens
ccaccccatccagcca

SEQ ID NO: 819373 - DNA, 14 bp, Homo sapiens
ccacccccagagga

SEQ ID NO: 819374 - DNA, 12 bp, Homo sapiens
ccacccccagcc

SEQ ID NO: 819375 - DNA, 13 bp, Homo sapiens
ccacccccagcca

SEQ ID NO: 819376 - DNA, 15 bp, Homo sapiens
ccacccccagccagg

SEQ ID NO: 819377 - DNA, 13 bp, Homo sapiens
ccacccccagctc

SEQ ID NO: 819378 - DNA, 12 bp, Homo sapiens
ccacccccaggc

SEQ ID NO: 819379 - DNA, 16 bp, Homo sapiens
ccacccccaggcctcc

SEQ ID NO: 819380 - DNA, 19 bp, Homo sapiens
ccacccccaggtcttcctg

SEQ ID NO: 819381 - DNA, 22 bp, Homo sapiens
ccacccccaggtcttcctgctt

SEQ ID NO: 819382 - DNA, 15 bp, Homo sapiens
ccacccccaggtgca

SEQ ID NO: 819383 - DNA, 18 bp, Homo sapiens
ccacccccagtctccagg

SEQ ID NO: 819384 - DNA, 15 bp, Homo sapiens
ccacccccagttcct

SEQ ID NO: 819385 - DNA, 16 bp, Homo sapiens
ccaccccccactcagt

SEQ ID NO: 819386 - DNA, 14 bp, Homo sapiens
ccacccccgccatg

SEQ ID NO: 819387 - DNA, 15 bp, Homo sapiens
ccaccccctcaagcc

SEQ ID NO: 819388 - DNA, 16 bp, Homo sapiens
ccaccccctccccagg

SEQ ID NO: 819389 - DNA, 17 bp, Homo sapiens
ccaccccctccccaggg

SEQ ID NO: 819390 - DNA, 15 bp, Homo sapiens
ccaccccctcctccc

SEQ ID NO: 819391 - DNA, 13 bp, Homo sapiens
ccaccccctgccc

SEQ ID NO: 819392 - DNA, 16 bp, Homo sapiens
ccaccccctgccctgc

SEQ ID NO: 819393 - DNA, 17 bp, Homo sapiens
ccaccccctgccctgca

SEQ ID NO: 819394 - DNA, 18 bp, Homo sapiens
ccaccccctgccctgcac

SEQ ID NO: 819395 - DNA, 13 bp, Homo sapiens
ccaccccctgggc

SEQ ID NO: 819396 - DNA, 22 bp, Homo sapiens
ccaccccctgtcccattctaga

SEQ ID NO: 819397 - DNA, 15 bp, Homo sapiens
ccaccccctgttccc

SEQ ID NO: 819398 - DNA, 17 bp, Homo sapiens
ccacctcagcctcccag

SEQ ID NO: 819399 - DNA, 21 bp, Homo sapiens
ccacctccaccacatctgcca

SEQ ID NO: 819400 - DNA, 19 bp, Homo sapiens
ccacctccacccagcccct

SEQ ID NO: 819401 - DNA, 23 bp, Homo sapiens
ccacctccacccccgccacggcc

SEQ ID NO: 819402 - DNA, 14 bp, Homo sapiens
ccacctccagaaac

SEQ ID NO: 819403 - DNA, 13 bp, Homo sapiens
ccacctccagccc

SEQ ID NO: 819404 - DNA, 14 bp, Homo sapiens
ccacctccctgcct

SEQ ID NO: 819405 - DNA, 17 bp, Homo sapiens
ccacctccctgcgccct

SEQ ID NO: 819406 - DNA, 18 bp, Homo sapiens
ccacctccgccagacccc

SEQ ID NO: 819407 - DNA, 15 bp, Homo sapiens
ccacctcctacccct

SEQ ID NO: 819408 - DNA, 20 bp, Homo sapiens
ccacctcctaccccttcctg

SEQ ID NO: 819409 - DNA, 13 bp, Homo sapiens
ccacctcctcccc

SEQ ID NO: 819410 - DNA, 14 bp, Homo sapiens
ccacctcctgcggc

SEQ ID NO: 819411 - DNA, 20 bp, Homo sapiens
ccacctcgctcccctctgga

SEQ ID NO: 819412 - DNA, 14 bp, Homo sapiens
ccacctcggcctcc

SEQ ID NO: 819413 - DNA, 18 bp, Homo sapiens
ccacctcggcctcccaga

SEQ ID NO: 819414 - DNA, 12 bp, Homo sapiens
ccacctctccaa

SEQ ID NO: 819415 - DNA, 17 bp, Homo sapiens
ccacctctccaagggct

SEQ ID NO: 819416 - DNA, 21 bp, Homo sapiens
ccacctctccaagtctctctg

SEQ ID NO: 819417 - DNA, 13 bp, Homo sapiens
ccacctctccctg

SEQ ID NO: 819418 - DNA, 15 bp, Homo sapiens
ccacctctccctgca

SEQ ID NO: 819419 - DNA, 16 bp, Homo sapiens
ccacctctccctgcat

SEQ ID NO: 819420 - DNA, 21 bp, Homo sapiens
ccacctctccctgcatcctga

SEQ ID NO: 819421 - DNA, 14 bp, Homo sapiens
ccacctctgtggca

SEQ ID NO: 819422 - DNA, 16 bp, Homo sapiens
ccacctcttctcttcc

SEQ ID NO: 819423 - DNA, 18 bp, Homo sapiens
ccacctcttctcttcctg

SEQ ID NO: 819424 - DNA, 14 bp, Homo sapiens
ccacctcttgtgca

SEQ ID NO: 819425 - DNA, 22 bp, Homo sapiens
ccacctcttgtgcaaggtggcc

SEQ ID NO: 819426 - DNA, 15 bp, Homo sapiens
ccacctgaaagcctg

SEQ ID NO: 819427 - DNA, 20 bp, Homo sapiens
ccacctgaaagcctgtctct

SEQ ID NO: 819428 - DNA, 20 bp, Homo sapiens
ccacctgacaatggcagcta

SEQ ID NO: 819429 - DNA, 17 bp, Homo sapiens
ccacctgacacaccagg

SEQ ID NO: 819430 - DNA, 22 bp, Homo sapiens
ccacctgacggctggggaccca

SEQ ID NO: 819431 - DNA, 21 bp, Homo sapiens
ccacctgaggtgggcccagga

SEQ ID NO: 819432 - DNA, 21 bp, Homo sapiens
ccacctgaggtgggctggggc

SEQ ID NO: 819433 - DNA, 18 bp, Homo sapiens
ccacctgccacccccagg

SEQ ID NO: 819434 - DNA, 14 bp, Homo sapiens
ccacctgcccaacc

SEQ ID NO: 819435 - DNA, 14 bp, Homo sapiens
ccacctgcccatca

SEQ ID NO: 819436 - DNA, 16 bp, Homo sapiens
ccacctgcccatcaca

SEQ ID NO: 819437 - DNA, 20 bp, Homo sapiens
ccacctgcccatcacagggt

SEQ ID NO: 819438 - DNA, 23 bp, Homo sapiens
ccacctgcccatcacagggttgg

SEQ ID NO: 819439 - DNA, 18 bp, Homo sapiens
ccacctgcccccttctcc

SEQ ID NO: 819440 - DNA, 22 bp, Homo sapiens
ccacctgcccccttctcccaca

SEQ ID NO: 819441 - DNA, 23 bp, Homo sapiens
ccacctgcccccttctcccacac

SEQ ID NO: 819442 - DNA, 11 bp, Homo sapiens
ccacctgcctg

SEQ ID NO: 819443 - DNA, 20 bp, Homo sapiens
ccacctgcctgcgtcttccg

SEQ ID NO: 819444 - DNA, 21 bp, Homo sapiens
ccacctgcctgcgtcttccgc

SEQ ID NO: 819445 - DNA, 23 bp, Homo sapiens
ccacctgccttggcctcccaaag

SEQ ID NO: 819446 - DNA, 21 bp, Homo sapiens
ccacctgcgcttctgctggag

SEQ ID NO: 819447 - DNA, 19 bp, Homo sapiens
ccacctgctagtgtgaatt

SEQ ID NO: 819448 - DNA, 23 bp, Homo sapiens
ccacctgctgagagacccaagga

SEQ ID NO: 819449 - DNA, 16 bp, Homo sapiens
ccacctggacacacac

SEQ ID NO: 819450 - DNA, 17 bp, Homo sapiens
ccacctggacacacact

SEQ ID NO: 819451 - DNA, 21 bp, Homo sapiens
ccacctggacacacactcacc

SEQ ID NO: 819452 - DNA, 14 bp, Homo sapiens
ccacctggagcccg

SEQ ID NO: 819453 - DNA, 19 bp, Homo sapiens
ccacctggagcccgcttca

SEQ ID NO: 819454 - DNA, 23 bp, Homo sapiens
ccacctggcagggctcacactcc

SEQ ID NO: 819455 - DNA, 12 bp, Homo sapiens
ccacctggccac

SEQ ID NO: 819456 - DNA, 21 bp, Homo sapiens
ccacctggccccatgtctctc

SEQ ID NO: 819457 - DNA, 13 bp, Homo sapiens
ccacctggctccc

SEQ ID NO: 819458 - DNA, 22 bp, Homo sapiens
ccacctgggcatatccaccacc

SEQ ID NO: 819459 - DNA, 14 bp, Homo sapiens
ccacctgggctggg

SEQ ID NO: 819460 - DNA, 13 bp, Homo sapiens
ccacctgtagctg

SEQ ID NO: 819461 - DNA, 19 bp, Homo sapiens
ccacctgtccggcccagtg

SEQ ID NO: 819462 - DNA, 11 bp, Homo sapiens
ccacctgtctc

SEQ ID NO: 819463 - DNA, 15 bp, Homo sapiens
ccacctgtctcagcc

SEQ ID NO: 819464 - DNA, 23 bp, Homo sapiens
ccacctgtctcagcctcccagag

SEQ ID NO: 819465 - DNA, 14 bp, Homo sapiens
ccacctgtgctgct

SEQ ID NO: 819466 - DNA, 18 bp, Homo sapiens
ccaccttcaattcctggg

SEQ ID NO: 819467 - DNA, 19 bp, Homo sapiens
ccaccttcaattcctgggc

SEQ ID NO: 819468 - DNA, 19 bp, Homo sapiens
ccaccttcccagctctccc

SEQ ID NO: 819469 - DNA, 14 bp, Homo sapiens
ccaccttcccatgc

SEQ ID NO: 819470 - DNA, 11 bp, Homo sapiens
ccaccttcccc

SEQ ID NO: 819471 - DNA, 22 bp, Homo sapiens
ccaccttccccagactcagctc

SEQ ID NO: 819472 - DNA, 13 bp, Homo sapiens
ccaccttgccagg

SEQ ID NO: 819473 - DNA, 16 bp, Homo sapiens
ccaccttgccagggca

SEQ ID NO: 819474 - DNA, 19 bp, Homo sapiens
ccaccttgccagggcaggg

SEQ ID NO: 819475 - DNA, 13 bp, Homo sapiens
ccaccttgcttga

SEQ ID NO: 819476 - DNA, 16 bp, Homo sapiens
ccaccttggaccctgg

SEQ ID NO: 819477 - DNA, 20 bp, Homo sapiens
ccaccttggaccctggtgac

SEQ ID NO: 819478 - DNA, 16 bp, Homo sapiens
ccaccttggactcctc

SEQ ID NO: 819479 - DNA, 19 bp, Homo sapiens
ccaccttggactcctccca

SEQ ID NO: 819480 - DNA, 23 bp, Homo sapiens
ccaccttggactcctcccacaat

SEQ ID NO: 819481 - DNA, 13 bp, Homo sapiens
ccaccttggagga

SEQ ID NO: 819482 - DNA, 15 bp, Homo sapiens
ccaccttggaggagg

SEQ ID NO: 819483 - DNA, 23 bp, Homo sapiens
ccaccttggtccctctcagatac

SEQ ID NO: 819484 - DNA, 17 bp, Homo sapiens
ccaccttgttggagcct

SEQ ID NO: 819485 - DNA, 18 bp, Homo sapiens
ccaccttgttggagcctg

SEQ ID NO: 819486 - DNA, 21 bp, Homo sapiens
ccaccttgttggagcctgcag

SEQ ID NO: 819487 - DNA, 13 bp, Homo sapiens
ccacctttactgt

SEQ ID NO: 819488 - DNA, 14 bp, Homo sapiens
ccacctttactgtg

SEQ ID NO: 819489 - DNA, 13 bp, Homo sapiens
ccacctttgtgca

SEQ ID NO: 819490 - DNA, 16 bp, Homo sapiens
ccacgacccctgcctc

SEQ ID NO: 819491 - DNA, 22 bp, Homo sapiens
ccacgacccctgcctcgagggc

SEQ ID NO: 819492 - DNA, 23 bp, Homo sapiens
ccacgacccctgcctcgagggcc

SEQ ID NO: 819493 - DNA, 15 bp, Homo sapiens
ccacgactgccatgt

SEQ ID NO: 819494 - DNA, 18 bp, Homo sapiens
ccacgactggccagggcc

SEQ ID NO: 819495 - DNA, 19 bp, Homo sapiens
ccacgaggaaaagaacaaa

SEQ ID NO: 819496 - DNA, 14 bp, Homo sapiens
ccacgaggctgccc

SEQ ID NO: 819497 - DNA, 12 bp, Homo sapiens
ccacgagggctg

SEQ ID NO: 819498 - DNA, 15 bp, Homo sapiens
ccacgagggctggct

SEQ ID NO: 819499 - DNA, 17 bp, Homo sapiens
ccacgaggggacccatg

SEQ ID NO: 819500 - DNA, 18 bp, Homo sapiens
ccacgaggggacccatgg

SEQ ID NO: 819501 - DNA, 20 bp, Homo sapiens
ccacgaggggacccatgggg

SEQ ID NO: 819502 - DNA, 13 bp, Homo sapiens
ccacgagggtctc

SEQ ID NO: 819503 - DNA, 15 bp, Homo sapiens
ccacgagtcacctgc

SEQ ID NO: 819504 - DNA, 21 bp, Homo sapiens
ccacgagtcacctgcaagccc

SEQ ID NO: 819505 - DNA, 23 bp, Homo sapiens
ccacgagtcacctgcaagcccca

SEQ ID NO: 819506 - DNA, 14 bp, Homo sapiens
ccacgattggagaa

SEQ ID NO: 819507 - DNA, 17 bp, Homo sapiens
ccacgattttctccagc

SEQ ID NO: 819508 - DNA, 19 bp, Homo sapiens
ccacgattttctccagctc

SEQ ID NO: 819509 - DNA, 22 bp, Homo sapiens
ccacgattttctccagctcaga

SEQ ID NO: 819510 - DNA, 18 bp, Homo sapiens
ccacgcacctccacgcca

SEQ ID NO: 819511 - DNA, 13 bp, Homo sapiens
ccacgcactccat

SEQ ID NO: 819512 - DNA, 14 bp, Homo sapiens
ccacgcacttcctc

SEQ ID NO: 819513 - DNA, 15 bp, Homo sapiens
ccacgcacttcctct

SEQ ID NO: 819514 - DNA, 13 bp, Homo sapiens
ccacgcagaggac

SEQ ID NO: 819515 - DNA, 21 bp, Homo sapiens
ccacgcaggggccctgagcca

SEQ ID NO: 819516 - DNA, 13 bp, Homo sapiens
ccacgcagtgcct

SEQ ID NO: 819517 - DNA, 13 bp, Homo sapiens
ccacgccccagcc

SEQ ID NO: 819518 - DNA, 14 bp, Homo sapiens
ccacgccccagccc

SEQ ID NO: 819519 - DNA, 15 bp, Homo sapiens
ccacgccccagcccg

SEQ ID NO: 819520 - DNA, 19 bp, Homo sapiens
ccactccgagaggtgggcc

SEQ ID NO: 819521 - DNA, 16 bp, Homo sapiens
ccactcctccaaagga

SEQ ID NO: 819522 - DNA, 15 bp, Homo sapiens
ccactcctccctccg

SEQ ID NO: 819523 - DNA, 14 bp, Homo sapiens
ccactcctctaaga

SEQ ID NO: 819524 - DNA, 20 bp, Homo sapiens
ccactcctctgactcagggc

SEQ ID NO: 819525 - DNA, 13 bp, Homo sapiens
ccactcctgtccc

SEQ ID NO: 819526 - DNA, 14 bp, Homo sapiens
ccactcctgtcccg

SEQ ID NO: 819527 - DNA, 14 bp, Homo sapiens
ccactcctgtccct

SEQ ID NO: 819528 - DNA, 19 bp, Homo sapiens
ccactccttccttcaggac

SEQ ID NO: 819529 - DNA, 22 bp, Homo sapiens
ccactccttccttcaggactct

SEQ ID NO: 819530 - DNA, 23 bp, Homo sapiens
ccactcgacccagaatggagcct

SEQ ID NO: 819531 - DNA, 15 bp, Homo sapiens
ccactcgaggcctgc

SEQ ID NO: 819532 - DNA, 17 bp, Homo sapiens
ccactcgaggcctgcaa

SEQ ID NO: 819533 - DNA, 22 bp, Homo sapiens
ccactctaggggtcaggctcca

SEQ ID NO: 819534 - DNA, 15 bp, Homo sapiens
ccactctagttctag

SEQ ID NO: 819535 - DNA, 14 bp, Homo sapiens
ccactctcattccc

SEQ ID NO: 819536 - DNA, 12 bp, Homo sapiens
ccactctcccca

SEQ ID NO: 819537 - DNA, 15 bp, Homo sapiens
ccactctccccacac

SEQ ID NO: 819538 - DNA, 17 bp, Homo sapiens
ccactctccccacacta

SEQ ID NO: 819539 - DNA, 23 bp, Homo sapiens
ccactctcccctccctcttcctt

SEQ ID NO: 819540 - DNA, 11 bp, Homo sapiens
ccactctctca

SEQ ID NO: 819541 - DNA, 19 bp, Homo sapiens
ccactctctcacccaccag

SEQ ID NO: 819542 - DNA, 14 bp, Homo sapiens
ccactctctgggac

SEQ ID NO: 819543 - DNA, 20 bp, Homo sapiens
ccactctctgggactctcct

SEQ ID NO: 819544 - DNA, 22 bp, Homo sapiens
ccactctctgggactctcctcc

SEQ ID NO: 819545 - DNA, 19 bp, Homo sapiens
ccactctgcccagccggag

SEQ ID NO: 819546 - DNA, 14 bp, Homo sapiens
ccactctgcttctc

SEQ ID NO: 819547 - DNA, 17 bp, Homo sapiens
ccactctgcttctctga

SEQ ID NO: 819548 - DNA, 19 bp, Homo sapiens
ccactctgcttctctgact

SEQ ID NO: 819549 - DNA, 23 bp, Homo sapiens
ccactctggagcatttctcatca

SEQ ID NO: 819550 - DNA, 19 bp, Homo sapiens
ccactctggattcagcctt

SEQ ID NO: 819551 - DNA, 20 bp, Homo sapiens
ccactctggattcagccttc

SEQ ID NO: 819552 - DNA, 23 bp, Homo sapiens
ccactctggattcagccttcttt

SEQ ID NO: 819553 - DNA, 22 bp, Homo sapiens
ccactctggtggccacttcatt

SEQ ID NO: 819554 - DNA, 12 bp, Homo sapiens
ccactcttctct

SEQ ID NO: 819555 - DNA, 23 bp, Homo sapiens
ccactcttctctcctttctccct

SEQ ID NO: 819556 - DNA, 17 bp, Homo sapiens
ccactcttttgctgtgc

SEQ ID NO: 819557 - DNA, 15 bp, Homo sapiens
ccactgaaaaaatat

SEQ ID NO: 819558 - DNA, 17 bp, Homo sapiens
ccactgaaaaaatatat

SEQ ID NO: 819559 - DNA, 13 bp, Homo sapiens
ccactgaacaaaa

SEQ ID NO: 819560 - DNA, 15 bp, Homo sapiens
ccactgaagctggga

SEQ ID NO: 819561 - DNA, 12 bp, Homo sapiens
ccactgacccac

SEQ ID NO: 819562 - DNA, 18 bp, Homo sapiens
ccactgacccacctgcgc

SEQ ID NO: 819563 - DNA, 22 bp, Homo sapiens
ccactgcaacttgtgaactcca

SEQ ID NO: 819564 - DNA, 18 bp, Homo sapiens
ccactgcacacacctcag

SEQ ID NO: 819565 - DNA, 14 bp, Homo sapiens
ccactgcactccag

SEQ ID NO: 819566 - DNA, 17 bp, Homo sapiens
ccactgcactccagcct

SEQ ID NO: 819567 - DNA, 21 bp, Homo sapiens
ccactgcactccagcctgggc

SEQ ID NO: 819568 - DNA, 14 bp, Homo sapiens
ccactgcaggcccc

SEQ ID NO: 819569 - DNA, 17 bp, Homo sapiens
ccactgcaggccccgct

SEQ ID NO: 819570 - DNA, 21 bp, Homo sapiens
ccactgcatcgtttcatcttc

SEQ ID NO: 819571 - DNA, 16 bp, Homo sapiens
ccactgccagcagcag

SEQ ID NO: 819572 - DNA, 21 bp, Homo sapiens
ccactgccaggcacctggcct

SEQ ID NO: 819573 - DNA, 24 bp, Homo sapiens
ccactgccaggcacctggcctgct

SEQ ID NO: 819574 - DNA, 16 bp, Homo sapiens
ccactgcccaccccct

SEQ ID NO: 819575 - DNA, 19 bp, Homo sapiens
ccactgcccaccccctcaa

SEQ ID NO: 819576 - DNA, 21 bp, Homo sapiens
ccactgccccgtgtgaatgta

SEQ ID NO: 819577 - DNA, 15 bp, Homo sapiens
ccactgcccgagctg

SEQ ID NO: 819578 - DNA, 15 bp, Homo sapiens
ccactgccctgcctg

SEQ ID NO: 819579 - DNA, 16 bp, Homo sapiens
ccactgccctgcctgc

SEQ ID NO: 819580 - DNA, 13 bp, Homo sapiens
ccactgcctctcc

SEQ ID NO: 819581 - DNA, 19 bp, Homo sapiens
ccactgcctctccctctgg

SEQ ID NO: 819582 - DNA, 20 bp, Homo sapiens
ccactgcctctggaattgct

SEQ ID NO: 819583 - DNA, 13 bp, Homo sapiens
ccactgcctcttc

SEQ ID NO: 819584 - DNA, 12 bp, Homo sapiens
ccactgcctgcc

SEQ ID NO: 819585 - DNA, 13 bp, Homo sapiens
ccactgcctgccc

SEQ ID NO: 819586 - DNA, 12 bp, Homo sapiens
ccactgccttcg

SEQ ID NO: 819587 - DNA, 15 bp, Homo sapiens
ccactgccttcgctt

SEQ ID NO: 819588 - DNA, 16 bp, Homo sapiens
ccactgccttcgcttc

SEQ ID NO: 819589 - DNA, 23 bp, Homo sapiens
ccactgcggggagacagaagcct

SEQ ID NO: 819590 - DNA, 13 bp, Homo sapiens
ccactgcgttgtc

SEQ ID NO: 819591 - DNA, 19 bp, Homo sapiens
ccactgctaaggctgctgg

SEQ ID NO: 819592 - DNA, 17 bp, Homo sapiens
ccactgctatgccattt

SEQ ID NO: 819593 - DNA, 14 bp, Homo sapiens
ccactgctccattt

SEQ ID NO: 819594 - DNA, 24 bp, Homo sapiens
ccactgctccctaagccagcctgg

SEQ ID NO: 819595 - DNA, 19 bp, Homo sapiens
ccactgctccgtggaggag

SEQ ID NO: 819596 - DNA, 13 bp, Homo sapiens
ccactgctgagct

SEQ ID NO: 819597 - DNA, 18 bp, Homo sapiens
ccactgctgatattttct

SEQ ID NO: 819598 - DNA, 19 bp, Homo sapiens
ccactgctgcttctccatg

SEQ ID NO: 819599 - DNA, 14 bp, Homo sapiens
ccactgctggacat

SEQ ID NO: 819600 - DNA, 15 bp, Homo sapiens
ccactgcttctcttt

SEQ ID NO: 819601 - DNA, 15 bp, Homo sapiens
ccactggacaacact

SEQ ID NO: 819602 - DNA, 23 bp, Homo sapiens
ccactggacaacactgattcctg

SEQ ID NO: 819603 - DNA, 11 bp, Homo sapiens
ccactggaggt

SEQ ID NO: 819604 - DNA, 20 bp, Homo sapiens
ccactggcatcgcagcttcc

SEQ ID NO: 819605 - DNA, 13 bp, Homo sapiens
ccactggccacca

SEQ ID NO: 819606 - DNA, 16 bp, Homo sapiens
ccactggccaccaggc

SEQ ID NO: 819607 - DNA, 20 bp, Homo sapiens
ccactggccgctgagcgccc

SEQ ID NO: 819608 - DNA, 21 bp, Homo sapiens
ccactggctgagaatctgggg

SEQ ID NO: 819609 - DNA, 16 bp, Homo sapiens
ccactggcttttgcct

SEQ ID NO: 819610 - DNA, 16 bp, Homo sapiens
ccactgggaccaaccc

SEQ ID NO: 819611 - DNA, 18 bp, Homo sapiens
ccactgggaccaaccctg

SEQ ID NO: 819612 - DNA, 15 bp, Homo sapiens
ccactgggactccca

SEQ ID NO: 819613 - DNA, 18 bp, Homo sapiens
ccactgggactcccagca

SEQ ID NO: 819614 - DNA, 22 bp, Homo sapiens
ccactgggactcccagcagagc

SEQ ID NO: 819615 - DNA, 11 bp, Homo sapiens
ccactgggcac

SEQ ID NO: 819616 - DNA, 17 bp, Homo sapiens
ccactgggcacctgcgc

SEQ ID NO: 819617 - DNA, 13 bp, Homo sapiens
ccactgggccagc

SEQ ID NO: 819618 - DNA, 13 bp, Homo sapiens
ccactgggcctgc

SEQ ID NO: 819619 - DNA, 17 bp, Homo sapiens
ccactgggcctgctagt

SEQ ID NO: 819620 - DNA, 18 bp, Homo sapiens
ccactgggtctcactcct

SEQ ID NO: 819621 - DNA, 17 bp, Homo sapiens
ccactgggtgagagagg

SEQ ID NO: 819622 - DNA, 19 bp, Homo sapiens
ccactgggtgtaaacacat

SEQ ID NO: 819623 - DNA, 14 bp, Homo sapiens
ccactgtatatttt

SEQ ID NO: 819624 - DNA, 16 bp, Homo sapiens
ccactgtatatttttt

SEQ ID NO: 819625 - DNA, 14 bp, Homo sapiens
ccactgtcaccctc

SEQ ID NO: 819626 - DNA, 13 bp, Homo sapiens
ccactgtccctgt

SEQ ID NO: 819627 - DNA, 15 bp, Homo sapiens
ccactgtccctgtcc

SEQ ID NO: 819628 - DNA, 22 bp, Homo sapiens
ccactgtccctgtccttctaca

SEQ ID NO: 819629 - DNA, 22 bp, Homo sapiens
ccactgtccgcctctgcccgca

SEQ ID NO: 819630 - DNA, 23 bp, Homo sapiens
ccactgtccgcctctgcccgcag

SEQ ID NO: 819631 - DNA, 17 bp, Homo sapiens
ccactgtcctccttggc

SEQ ID NO: 819632 - DNA, 21 bp, Homo sapiens
ccactgtcctccttggcggca

SEQ ID NO: 819633 - DNA, 15 bp, Homo sapiens
ccactgtgcctttgc

SEQ ID NO: 819634 - DNA, 17 bp, Homo sapiens
ccactgtgctgaattct

SEQ ID NO: 819635 - DNA, 19 bp, Homo sapiens
ccactgtgctgaattctgc

SEQ ID NO: 819636 - DNA, 19 bp, Homo sapiens
ccactgtggccccaagagg

SEQ ID NO: 819637 - DNA, 12 bp, Homo sapiens
ccactgtgggtg

SEQ ID NO: 819638 - DNA, 13 bp, Homo sapiens
ccactgtggtggc

SEQ ID NO: 819639 - DNA, 15 bp, Homo sapiens
ccactgtgtctctgt

SEQ ID NO: 819640 - DNA, 18 bp, Homo sapiens
ccactgtgtctctgtttc

SEQ ID NO: 819641 - DNA, 11 bp, Homo sapiens
ccactgtgtgc

SEQ ID NO: 819642 - DNA, 14 bp, Homo sapiens
ccactgtgtgcctt

SEQ ID NO: 819643 - DNA, 10 bp, Homo sapiens
ccagaatctt

SEQ ID NO: 819644 - DNA, 16 bp, Homo sapiens
ccagaatgctgtacat

SEQ ID NO: 819645 - DNA, 21 bp, Homo sapiens
ccagaatgctgtacatctatt

SEQ ID NO: 819646 - DNA, 17 bp, Homo sapiens
ccagaatggagtctttt

SEQ ID NO: 819647 - DNA, 23 bp, Homo sapiens
ccagaatggtctttctaatgtgt

SEQ ID NO: 819648 - DNA, 16 bp, Homo sapiens
ccagaattaaagacct

SEQ ID NO: 819649 - DNA, 13 bp, Homo sapiens
ccagaattcacta

SEQ ID NO: 819650 - DNA, 15 bp, Homo sapiens
ccagaattgtcctca

SEQ ID NO: 819651 - DNA, 18 bp, Homo sapiens
ccagaattgtcctcaagg

SEQ ID NO: 819652 - DNA, 15 bp, Homo sapiens
ccagaatttggaaat

SEQ ID NO: 819653 - DNA, 16 bp, Homo sapiens
ccagaatttggaaatc

SEQ ID NO: 819654 - DNA, 17 bp, Homo sapiens
ccagaatttggaaatcc

SEQ ID NO: 819655 - DNA, 23 bp, Homo sapiens
ccagacaacgggcccatggcctt

SEQ ID NO: 819656 - DNA, 16 bp, Homo sapiens
ccagacaaggagagcg

SEQ ID NO: 819657 - DNA, 18 bp, Homo sapiens
ccagacaaggagagcgga

SEQ ID NO: 819658 - DNA, 15 bp, Homo sapiens
ccagacacagactgg

SEQ ID NO: 819659 - DNA, 20 bp, Homo sapiens
ccagacacagactggcaata

SEQ ID NO: 819660 - DNA, 21 bp, Homo sapiens
ccagacacagactggcaataa

SEQ ID NO: 819661 - DNA, 23 bp, Homo sapiens
ccagacacagactggcaataaac

SEQ ID NO: 819662 - DNA, 17 bp, Homo sapiens
ccagacaccatgtgcaa

SEQ ID NO: 819663 - DNA, 21 bp, Homo sapiens
ccagacactgagcttctgaga

SEQ ID NO: 819664 - DNA, 14 bp, Homo sapiens
ccagacactgcgcc

SEQ ID NO: 819665 - DNA, 18 bp, Homo sapiens
ccagacagacatctctgc

SEQ ID NO: 819666 - DNA, 18 bp, Homo sapiens
ccagacagccccaagctt

SEQ ID NO: 819667 - DNA, 20 bp, Homo sapiens
ccagacagccccaagcttct

SEQ ID NO: 819668 - DNA, 20 bp, Homo sapiens
ccagacaggccctccctgtc

SEQ ID NO: 819669 - DNA, 23 bp, Homo sapiens
ccagacatgtggtgggacaggga

SEQ ID NO: 819670 - DNA, 22 bp, Homo sapiens
ccagacattctcgcttccctga

SEQ ID NO: 819671 - DNA, 19 bp, Homo sapiens
ccagaccaaccctgggacc

SEQ ID NO: 819672 - DNA, 23 bp, Homo sapiens
ccagaccaacgttactcagggct

SEQ ID NO: 819673 - DNA, 14 bp, Homo sapiens
ccagaccatggaca

SEQ ID NO: 819674 - DNA, 16 bp, Homo sapiens
ccagacccacctggag

SEQ ID NO: 819675 - DNA, 18 bp, Homo sapiens
ccagacccacctggagcc

SEQ ID NO: 819676 - DNA, 13 bp, Homo sapiens
ccagacccactct

SEQ ID NO: 819677 - DNA, 10 bp, Homo sapiens
ccagacccag

SEQ ID NO: 819678 - DNA, 13 bp, Homo sapiens
ccagacccagagg

SEQ ID NO: 819679 - DNA, 20 bp, Homo sapiens
ccagacccagaggccctgaa

SEQ ID NO: 819680 - DNA, 14 bp, Homo sapiens
ccagaccccagggc

SEQ ID NO: 819681 - DNA, 12 bp, Homo sapiens
ccagacccccac

SEQ ID NO: 819682 - DNA, 19 bp, Homo sapiens
ccagacccccagcaaccct

SEQ ID NO: 819683 - DNA, 20 bp, Homo sapiens
ccagaccccgtggctctggg

SEQ ID NO: 819684 - DNA, 17 bp, Homo sapiens
ccagacccctctggcca

SEQ ID NO: 819685 - DNA, 22 bp, Homo sapiens
ccagacccctctggccaggatg

SEQ ID NO: 819686 - DNA, 24 bp, Homo sapiens
ccagacccctctggccaggatgga

SEQ ID NO: 819687 - DNA, 14 bp, Homo sapiens
ccagacccctggct

SEQ ID NO: 819688 - DNA, 17 bp, Homo sapiens
ccagacccctggctttt

SEQ ID NO: 819689 - DNA, 12 bp, Homo sapiens
ccagaccctgcc

SEQ ID NO: 819690 - DNA, 14 bp, Homo sapiens
ccagaccctgcctg

SEQ ID NO: 819691 - DNA, 17 bp, Homo sapiens
ccagaccctgcctgagc

SEQ ID NO: 819692 - DNA, 19 bp, Homo sapiens
ccagaccctgcctgagccc

SEQ ID NO: 819693 - DNA, 19 bp, Homo sapiens
ccagaccgtcgcacccaca

SEQ ID NO: 819694 - DNA, 15 bp, Homo sapiens
ccagaccttaataaa

SEQ ID NO: 819695 - DNA, 15 bp, Homo sapiens
ccagacggggctgga

SEQ ID NO: 819696 - DNA, 17 bp, Homo sapiens
ccagacgtcaggccctg

SEQ ID NO: 819697 - DNA, 14 bp, Homo sapiens
ccagactacagggc

SEQ ID NO: 819698 - DNA, 22 bp, Homo sapiens
ccagactagatgtagtattttt

SEQ ID NO: 819699 - DNA, 13 bp, Homo sapiens
ccagactcagctc

SEQ ID NO: 819700 - DNA, 14 bp, Homo sapiens
ccagactcaggttc

SEQ ID NO: 819701 - DNA, 17 bp, Homo sapiens
ccagactcaggttccag

SEQ ID NO: 819702 - DNA, 19 bp, Homo sapiens
ccagactcctttcctctga

SEQ ID NO: 819703 - DNA, 15 bp, Homo sapiens
ccagactctaggtta

SEQ ID NO: 819704 - DNA, 15 bp, Homo sapiens
ccagactcttgcctg

SEQ ID NO: 819705 - DNA, 18 bp, Homo sapiens
ccagactctttttttgag

SEQ ID NO: 819706 - DNA, 14 bp, Homo sapiens
ccagactgagctct

SEQ ID NO: 819707 - DNA, 20 bp, Homo sapiens
ccagactgagctctccaggc

SEQ ID NO: 819708 - DNA, 21 bp, Homo sapiens
ccagactgagctctccaggcc

SEQ ID NO: 819709 - DNA, 14 bp, Homo sapiens
ccagactgatgagc

SEQ ID NO: 819710 - DNA, 11 bp, Homo sapiens
ccagactggaa

SEQ ID NO: 819711 - DNA, 18 bp, Homo sapiens
ccagactgggcccaggca

SEQ ID NO: 819712 - DNA, 19 bp, Homo sapiens
ccagactgggcccaggcag

SEQ ID NO: 819713 - DNA, 21 bp, Homo sapiens
ccagactgggcccaggcaggt

SEQ ID NO: 819714 - DNA, 18 bp, Homo sapiens
ccagactgtaagatgttg

SEQ ID NO: 819715 - DNA, 13 bp, Homo sapiens
ccagactgtagag

SEQ ID NO: 819716 - DNA, 12 bp, Homo sapiens
ccagactgtgga

SEQ ID NO: 819717 - DNA, 15 bp, Homo sapiens
ccagactgttagaaa

SEQ ID NO: 819718 - DNA, 15 bp, Homo sapiens
ccagacttccttgag

SEQ ID NO: 819719 - DNA, 13 bp, Homo sapiens
ccagacttttgct

SEQ ID NO: 819720 - DNA, 15 bp, Homo sapiens
ccagagaaaattaat

SEQ ID NO: 819721 - DNA, 19 bp, Homo sapiens
ccagagaacaatcactatt

SEQ ID NO: 819722 - DNA, 12 bp, Homo sapiens
ccagagaagcta

SEQ ID NO: 819723 - DNA, 14 bp, Homo sapiens
ccagagacaggaaa

SEQ ID NO: 819724 - DNA, 15 bp, Homo sapiens
ccagagacaggaaaa

SEQ ID NO: 819725 - DNA, 21 bp, Homo sapiens
ccagagacagggaaaggtcag

SEQ ID NO: 819726 - DNA, 16 bp, Homo sapiens
ccagagaccacaccac

SEQ ID NO: 819727 - DNA, 22 bp, Homo sapiens
ccagagaccccttcctttcctc

SEQ ID NO: 819728 - DNA, 14 bp, Homo sapiens
ccagagactttagg

SEQ ID NO: 819729 - DNA, 21 bp, Homo sapiens
ccagagagaacaacaggcagg

SEQ ID NO: 819730 - DNA, 18 bp, Homo sapiens
ccagagagagaagtgccc

SEQ ID NO: 819731 - DNA, 22 bp, Homo sapiens
ccagagagagaagtgcccctgc

SEQ ID NO: 819732 - DNA, 19 bp, Homo sapiens
ccagagagaggagggactg

SEQ ID NO: 819733 - DNA, 20 bp, Homo sapiens
ccagagagcaggcaggggca

SEQ ID NO: 819734 - DNA, 14 bp, Homo sapiens
ccagagagcagggg

SEQ ID NO: 819735 - DNA, 15 bp, Homo sapiens
ccagagagcagggga

SEQ ID NO: 819736 - DNA, 21 bp, Homo sapiens
ccagagagcaggggagcttgg

SEQ ID NO: 819737 - DNA, 20 bp, Homo sapiens
ccagagaggagcacctgaac

SEQ ID NO: 819738 - DNA, 13 bp, Homo sapiens
ccagagagggccc

SEQ ID NO: 819739 - DNA, 16 bp, Homo sapiens
ccagagagggcccagc

SEQ ID NO: 819740 - DNA, 15 bp, Homo sapiens
ccagagagtcctctg

SEQ ID NO: 819741 - DNA, 18 bp, Homo sapiens
ccagagagtggctcctcc

SEQ ID NO: 819742 - DNA, 14 bp, Homo sapiens
ccagagatgcctcc

SEQ ID NO: 819743 - DNA, 16 bp, Homo sapiens
ccagagatgcctccac

SEQ ID NO: 819744 - DNA, 15 bp, Homo sapiens
ccagagattcatttt

SEQ ID NO: 819745 - DNA, 15 bp, Homo sapiens
ccagagcaacctctc

SEQ ID NO: 819746 - DNA, 16 bp, Homo sapiens
ccagagcacaggagct

SEQ ID NO: 819747 - DNA, 13 bp, Homo sapiens
ccagagcagagcc

SEQ ID NO: 819748 - DNA, 14 bp, Homo sapiens
ccagagcaggaagc

SEQ ID NO: 819749 - DNA, 14 bp, Homo sapiens
ccagagcaggaggc

SEQ ID NO: 819750 - DNA, 23 bp, Homo sapiens
ccagagcatttccaacaccacag

SEQ ID NO: 819751 - DNA, 12 bp, Homo sapiens
ccagagccacct

SEQ ID NO: 819752 - DNA, 13 bp, Homo sapiens
ccagagccagcct

SEQ ID NO: 819753 - DNA, 18 bp, Homo sapiens
ccagagccagcctgggac

SEQ ID NO: 819754 - DNA, 20 bp, Homo sapiens
ccagagccagcctgggactc

SEQ ID NO: 819755 - DNA, 11 bp, Homo sapiens
ccagagccagg

SEQ ID NO: 819756 - DNA, 12 bp, Homo sapiens
ccagagccaggg

SEQ ID NO: 819757 - DNA, 13 bp, Homo sapiens
ccagagccagggc

SEQ ID NO: 819758 - DNA, 14 bp, Homo sapiens
ccagagccagggct

SEQ ID NO: 819759 - DNA, 15 bp, Homo sapiens
ccagagccagggctg

SEQ ID NO: 819760 - DNA, 16 bp, Homo sapiens
ccagagccagggctgt

SEQ ID NO: 819761 - DNA, 23 bp, Homo sapiens
ccagagccagggctgtccttaga

SEQ ID NO: 819762 - DNA, 13 bp, Homo sapiens
ccagagcccaagg

SEQ ID NO: 819763 - DNA, 16 bp, Homo sapiens
ccagagccccaagcag

SEQ ID NO: 819764 - DNA, 15 bp, Homo sapiens
ccagagccccactcc

SEQ ID NO: 819765 - DNA, 17 bp, Homo sapiens
ccagagccctctgagcc

SEQ ID NO: 819766 - DNA, 19 bp, Homo sapiens
ccagcatcgggggcctgca

SEQ ID NO: 819767 - DNA, 16 bp, Homo sapiens
ccagcatctcccagca

SEQ ID NO: 819768 - DNA, 13 bp, Homo sapiens
ccagcattccagc

SEQ ID NO: 819769 - DNA, 19 bp, Homo sapiens
ccagcattccagcccctct

SEQ ID NO: 819770 - DNA, 18 bp, Homo sapiens
ccagcattccagctctgc

SEQ ID NO: 819771 - DNA, 19 bp, Homo sapiens
ccagcattccagctctgcc

SEQ ID NO: 819772 - DNA, 22 bp, Homo sapiens
ccagcattccagctctgccccc

SEQ ID NO: 819773 - DNA, 14 bp, Homo sapiens
ccagcattcctttt

SEQ ID NO: 819774 - DNA, 22 bp, Homo sapiens
ccagcatttgtccttttgtgaa

SEQ ID NO: 819775 - DNA, 19 bp, Homo sapiens
ccagccaaaccctgtctga

SEQ ID NO: 819776 - DNA, 21 bp, Homo sapiens
ccagccaaagaaatgggcctg

SEQ ID NO: 819777 - DNA, 23 bp, Homo sapiens
ccagccaaagaaatgggcctgcc

SEQ ID NO: 819778 - DNA, 18 bp, Homo sapiens
ccagccaacccctgtgga

SEQ ID NO: 819779 - DNA, 19 bp, Homo sapiens
ccagccaacccctgtggag

SEQ ID NO: 819780 - DNA, 22 bp, Homo sapiens
ccagccaacttttgcatgtttt

SEQ ID NO: 819781 - DNA, 18 bp, Homo sapiens
ccagccaagggtcctcac

SEQ ID NO: 819782 - DNA, 22 bp, Homo sapiens
ccagccaagggtcctcacccct

SEQ ID NO: 819783 - DNA, 16 bp, Homo sapiens
ccagccacccccaggc

SEQ ID NO: 819784 - DNA, 14 bp, Homo sapiens
ccagccacccctca

SEQ ID NO: 819785 - DNA, 15 bp, Homo sapiens
ccagccacccctgcc

SEQ ID NO: 819786 - DNA, 19 bp, Homo sapiens
ccagccacccctgccactc

SEQ ID NO: 819787 - DNA, 17 bp, Homo sapiens
ccagccacgactgccat

SEQ ID NO: 819788 - DNA, 13 bp, Homo sapiens
ccagccacggagg

SEQ ID NO: 819789 - DNA, 22 bp, Homo sapiens
ccagccacggagggaggcacca

SEQ ID NO: 819790 - DNA, 23 bp, Homo sapiens
ccagccacggagggaggcaccat

SEQ ID NO: 819791 - DNA, 13 bp, Homo sapiens
ccagccactccaa

SEQ ID NO: 819792 - DNA, 20 bp, Homo sapiens
ccagccactccaagccccct

SEQ ID NO: 819793 - DNA, 21 bp, Homo sapiens
ccagccactccaagccccctg

SEQ ID NO: 819794 - DNA, 23 bp, Homo sapiens
ccagccactgccaagcttcctgt

SEQ ID NO: 819795 - DNA, 23 bp, Homo sapiens
ccagccagaacgtggctctgctg

SEQ ID NO: 819796 - DNA, 19 bp, Homo sapiens
ccagccagagttcctgcgg

SEQ ID NO: 819797 - DNA, 14 bp, Homo sapiens
ccagccagcagcag

SEQ ID NO: 819798 - DNA, 16 bp, Homo sapiens
ccagccagcagcagcc

SEQ ID NO: 819799 - DNA, 19 bp, Homo sapiens
ccagccagcagcagcccaa

SEQ ID NO: 819800 - DNA, 13 bp, Homo sapiens
ccagccagcagcc

SEQ ID NO: 819801 - DNA, 14 bp, Homo sapiens
ccagccagccaccc

SEQ ID NO: 819802 - DNA, 16 bp, Homo sapiens
ccagccagccctggcc

SEQ ID NO: 819803 - DNA, 17 bp, Homo sapiens
ccagccagcgcctccct

SEQ ID NO: 819804 - DNA, 22 bp, Homo sapiens
ccagccagcgcctccctccacc

SEQ ID NO: 819805 - DNA, 18 bp, Homo sapiens
ccagccagctgcagggca

SEQ ID NO: 819806 - DNA, 19 bp, Homo sapiens
ccagccagctgcagggcac

SEQ ID NO: 819807 - DNA, 13 bp, Homo sapiens
ccagccaggccca

SEQ ID NO: 819808 - DNA, 15 bp, Homo sapiens
ccagccaggcccagg

SEQ ID NO: 819809 - DNA, 16 bp, Homo sapiens
ccagccaggcccaggc

SEQ ID NO: 819810 - DNA, 17 bp, Homo sapiens
ccagccaggcccaggcc

SEQ ID NO: 819811 - DNA, 21 bp, Homo sapiens
ccagccaggcccaggccagcc

SEQ ID NO: 819812 - DNA, 13 bp, Homo sapiens
ccagccaggtgca

SEQ ID NO: 819813 - DNA, 22 bp, Homo sapiens
ccagccagtgaggatgacagtg

SEQ ID NO: 819814 - DNA, 16 bp, Homo sapiens
ccagccataaaagcat

SEQ ID NO: 819815 - DNA, 20 bp, Homo sapiens
ccagccatcaagagactgag

SEQ ID NO: 819816 - DNA, 15 bp, Homo sapiens
ccagccatctgccca

SEQ ID NO: 819817 - DNA, 17 bp, Homo sapiens
ccagccatctgcccagg

SEQ ID NO: 819818 - DNA, 16 bp, Homo sapiens
ccagccatgccagctg

SEQ ID NO: 819819 - DNA, 17 bp, Homo sapiens
ccagccatgccagctgg

SEQ ID NO: 819820 - DNA, 18 bp, Homo sapiens
ccagccatgccagctggc

SEQ ID NO: 819821 - DNA, 16 bp, Homo sapiens
ccagcccaccctgctc

SEQ ID NO: 819822 - DNA, 13 bp, Homo sapiens
ccagcccactgcc

SEQ ID NO: 819823 - DNA, 17 bp, Homo sapiens
ccagcccagagccacct

SEQ ID NO: 819824 - DNA, 10 bp, Homo sapiens
ccagcccagc

SEQ ID NO: 819825 - DNA, 11 bp, Homo sapiens
ccagcccagcc

SEQ ID NO: 819826 - DNA, 13 bp, Homo sapiens
ccagcccagccag

SEQ ID NO: 819827 - DNA, 14 bp, Homo sapiens
ccagcccagcccag

SEQ ID NO: 819828 - DNA, 16 bp, Homo sapiens
ccagcccagcccagct

SEQ ID NO: 819829 - DNA, 18 bp, Homo sapiens
ccagcccagcccagctgg

SEQ ID NO: 819830 - DNA, 16 bp, Homo sapiens
ccagcccagccccact

SEQ ID NO: 819831 - DNA, 14 bp, Homo sapiens
ccagcccagggctc

SEQ ID NO: 819832 - DNA, 15 bp, Homo sapiens
ccagcccagggctcc

SEQ ID NO: 819833 - DNA, 19 bp, Homo sapiens
ccagcccagggctcctgca

SEQ ID NO: 819834 - DNA, 21 bp, Homo sapiens
ccagcccagggctcctgcact

SEQ ID NO: 819835 - DNA, 12 bp, Homo sapiens
ccagcccagggt

SEQ ID NO: 819836 - DNA, 18 bp, Homo sapiens
ccagcccagggttccccc

SEQ ID NO: 819837 - DNA, 22 bp, Homo sapiens
ccagcccatccattaggccagc

SEQ ID NO: 819838 - DNA, 16 bp, Homo sapiens
ccagcccatctcggag

SEQ ID NO: 819839 - DNA, 17 bp, Homo sapiens
ccagcccatctcggagc

SEQ ID NO: 819840 - DNA, 20 bp, Homo sapiens
ccagcccatctcggagcatc

SEQ ID NO: 819841 - DNA, 20 bp, Homo sapiens
ccagcccatggcccccaata

SEQ ID NO: 819842 - DNA, 23 bp, Homo sapiens
ccagcccatggcccccaataaag

SEQ ID NO: 819843 - DNA, 19 bp, Homo sapiens
ccagcccattctctctcct

SEQ ID NO: 819844 - DNA, 19 bp, Homo sapiens
ccagcccattggccgagct

SEQ ID NO: 819845 - DNA, 22 bp, Homo sapiens
ccagcccattggccgagctcct

SEQ ID NO: 819846 - DNA, 15 bp, Homo sapiens
ccagccccaagctgg

SEQ ID NO: 819847 - DNA, 14 bp, Homo sapiens
ccagccccacccag

SEQ ID NO: 819848 - DNA, 16 bp, Homo sapiens
ccagccccacccagga

SEQ ID NO: 819849 - DNA, 19 bp, Homo sapiens
ccagccccacccccagcca

SEQ ID NO: 819850 - DNA, 17 bp, Homo sapiens
ccagccccactgccagc

SEQ ID NO: 819851 - DNA, 18 bp, Homo sapiens
ccagccccactgccagca

SEQ ID NO: 819852 - DNA, 19 bp, Homo sapiens
ccagccccactgccagcag

SEQ ID NO: 819853 - DNA, 23 bp, Homo sapiens
ccagccccactgccagcagcagc

SEQ ID NO: 819854 - DNA, 23 bp, Homo sapiens
ccagccccagacaacagcccagg

SEQ ID NO: 819855 - DNA, 22 bp, Homo sapiens
ccagccccagcaagagcacaag

SEQ ID NO: 819856 - DNA, 17 bp, Homo sapiens
ccagccccagccccttc

SEQ ID NO: 819857 - DNA, 15 bp, Homo sapiens
ccagccccaggcctg

SEQ ID NO: 819858 - DNA, 17 bp, Homo sapiens
ccagccccaggcctggc

SEQ ID NO: 819859 - DNA, 13 bp, Homo sapiens
ccagcccccaggg

SEQ ID NO: 819860 - DNA, 14 bp, Homo sapiens
ccagcccccagggc

SEQ ID NO: 819861 - DNA, 18 bp, Homo sapiens
ccagcccccagtgcgctc

SEQ ID NO: 819862 - DNA, 14 bp, Homo sapiens
ccagcccccccacc

SEQ ID NO: 819863 - DNA, 17 bp, Homo sapiens
ccagcccccccacccac

SEQ ID NO: 819864 - DNA, 18 bp, Homo sapiens
ccagcccccccacccacc

SEQ ID NO: 819865 - DNA, 19 bp, Homo sapiens
ccagcccccccacccaccc

SEQ ID NO: 819866 - DNA, 15 bp, Homo sapiens
ccagccccctccagc

SEQ ID NO: 819867 - DNA, 20 bp, Homo sapiens
ccagccccctccagctcatg

SEQ ID NO: 819868 - DNA, 14 bp, Homo sapiens
ccagccccctggat

SEQ ID NO: 819869 - DNA, 22 bp, Homo sapiens
ccagccccctggatgggcattg

SEQ ID NO: 819870 - DNA, 14 bp, Homo sapiens
ccagccccgactcc

SEQ ID NO: 819871 - DNA, 18 bp, Homo sapiens
ccagccccgactccagcc

SEQ ID NO: 819872 - DNA, 17 bp, Homo sapiens
ccagccccgctcaggcc

SEQ ID NO: 819873 - DNA, 14 bp, Homo sapiens
ccagccccgctccc

SEQ ID NO: 819874 - DNA, 16 bp, Homo sapiens
ccagccccgctcccac

SEQ ID NO: 819875 - DNA, 24 bp, Homo sapiens
ccagccccgctcccacctagtgcc

SEQ ID NO: 819876 - DNA, 19 bp, Homo sapiens
ccagccccggcaagccaca

SEQ ID NO: 819877 - DNA, 15 bp, Homo sapiens
ccagcccctactgct

SEQ ID NO: 819878 - DNA, 12 bp, Homo sapiens
ccagcccctccc

SEQ ID NO: 819879 - DNA, 13 bp, Homo sapiens
ccagcccctccca

SEQ ID NO: 819880 - DNA, 14 bp, Homo sapiens
ccagcccctcccac

SEQ ID NO: 819881 - DNA, 15 bp, Homo sapiens
ccagcccctcccacc

SEQ ID NO: 819882 - DNA, 13 bp, Homo sapiens
ccagcccctctgg

SEQ ID NO: 819883 - DNA, 13 bp, Homo sapiens
ccagcccctcttg

SEQ ID NO: 819884 - DNA, 20 bp, Homo sapiens
ccagcccctcttggagaagt

SEQ ID NO: 819885 - DNA, 12 bp, Homo sapiens
ccagcccctgga

SEQ ID NO: 819886 - DNA, 13 bp, Homo sapiens
ccagcccctggac

SEQ ID NO: 819887 - DNA, 20 bp, Homo sapiens
ccagcccctggacccctggg

SEQ ID NO: 819888 - DNA, 16 bp, Homo sapiens
ccagctgcaccagagc

SEQ ID NO: 819889 - DNA, 22 bp, Homo sapiens
ccagctgcacctgccagcctgg

SEQ ID NO: 819890 - DNA, 11 bp, Homo sapiens
ccagctgcact

SEQ ID NO: 819891 - DNA, 12 bp, Homo sapiens
ccagctgcaggg

SEQ ID NO: 819892 - DNA, 13 bp, Homo sapiens
ccagctgcagggc

SEQ ID NO: 819893 - DNA, 16 bp, Homo sapiens
ccagctgcagggcacg

SEQ ID NO: 819894 - DNA, 13 bp, Homo sapiens
ccagctgccaggc

SEQ ID NO: 819895 - DNA, 21 bp, Homo sapiens
ccagctgccaggcggccctgg

SEQ ID NO: 819896 - DNA, 20 bp, Homo sapiens
ccagctgccctatgggcctg

SEQ ID NO: 819897 - DNA, 20 bp, Homo sapiens
ccagctgcccttccgcagtg

SEQ ID NO: 819898 - DNA, 20 bp, Homo sapiens
ccagctgccgaccagagccc

SEQ ID NO: 819899 - DNA, 12 bp, Homo sapiens
ccagctgcctcc

SEQ ID NO: 819900 - DNA, 16 bp, Homo sapiens
ccagctgcctgggccc

SEQ ID NO: 819901 - DNA, 19 bp, Homo sapiens
ccagctgccttcctcatcc

SEQ ID NO: 819902 - DNA, 16 bp, Homo sapiens
ccagctgcgcttgctt

SEQ ID NO: 819903 - DNA, 21 bp, Homo sapiens
ccagctgctcccctgccacgc

SEQ ID NO: 819904 - DNA, 17 bp, Homo sapiens
ccagctgctcccctgga

SEQ ID NO: 819905 - DNA, 12 bp, Homo sapiens
ccagctgctctg

SEQ ID NO: 819906 - DNA, 16 bp, Homo sapiens
ccagctgctctgcccc

SEQ ID NO: 819907 - DNA, 21 bp, Homo sapiens
ccagctgctctgccccttggg

SEQ ID NO: 819908 - DNA, 17 bp, Homo sapiens
ccagctgctgtgcccca

SEQ ID NO: 819909 - DNA, 18 bp, Homo sapiens
ccagctgctgtgccccac

SEQ ID NO: 819910 - DNA, 20 bp, Homo sapiens
ccagctgctgtgccccacca

SEQ ID NO: 819911 - DNA, 12 bp, Homo sapiens
ccagctgctttt

SEQ ID NO: 819912 - DNA, 23 bp, Homo sapiens
ccagctggaaggtactatgccag

SEQ ID NO: 819913 - DNA, 12 bp, Homo sapiens
ccagctggccgg

SEQ ID NO: 819914 - DNA, 14 bp, Homo sapiens
ccagctggccggga

SEQ ID NO: 819915 - DNA, 20 bp, Homo sapiens
ccagctggccgggagcctga

SEQ ID NO: 819916 - DNA, 12 bp, Homo sapiens
ccagctggcctg

SEQ ID NO: 819917 - DNA, 13 bp, Homo sapiens
ccagctggccttt

SEQ ID NO: 819918 - DNA, 20 bp, Homo sapiens
ccagctgggaagcccttttt

SEQ ID NO: 819919 - DNA, 12 bp, Homo sapiens
ccagctgggagg

SEQ ID NO: 819920 - DNA, 16 bp, Homo sapiens
ccagctgggaggcaag

SEQ ID NO: 819921 - DNA, 16 bp, Homo sapiens
ccagctgggctctgca

SEQ ID NO: 819922 - DNA, 18 bp, Homo sapiens
ccagctgggctctgcaat

SEQ ID NO: 819923 - DNA, 22 bp, Homo sapiens
ccagctgggctctgccacccta

SEQ ID NO: 819924 - DNA, 23 bp, Homo sapiens
ccagctgggctctgccaccctac

SEQ ID NO: 819925 - DNA, 12 bp, Homo sapiens
ccagctggggag

SEQ ID NO: 819926 - DNA, 19 bp, Homo sapiens
ccagctggggagatggggg

SEQ ID NO: 819927 - DNA, 20 bp, Homo sapiens
ccagctggggagatgggggc

SEQ ID NO: 819928 - DNA, 12 bp, Homo sapiens
ccagctggggcc

SEQ ID NO: 819929 - DNA, 17 bp, Homo sapiens
ccagctggggccagagg

SEQ ID NO: 819930 - DNA, 19 bp, Homo sapiens
ccagctggggccagaggct

SEQ ID NO: 819931 - DNA, 16 bp, Homo sapiens
ccagctggggcgtggg

SEQ ID NO: 819932 - DNA, 12 bp, Homo sapiens
ccagctggtcct

SEQ ID NO: 819933 - DNA, 15 bp, Homo sapiens
ccagctggtcctgtg

SEQ ID NO: 819934 - DNA, 18 bp, Homo sapiens
ccagctgtagccatggct

SEQ ID NO: 819935 - DNA, 19 bp, Homo sapiens
ccagctgtagccatggctc

SEQ ID NO: 819936 - DNA, 15 bp, Homo sapiens
ccagctgtcaagggc

SEQ ID NO: 819937 - DNA, 20 bp, Homo sapiens
ccagctgtcgtctgactctg

SEQ ID NO: 819938 - DNA, 22 bp, Homo sapiens
ccagctgtcgtctgactctggg

SEQ ID NO: 819939 - DNA, 23 bp, Homo sapiens
ccagcttaaacccatacaatgta

SEQ ID NO: 819940 - DNA, 12 bp, Homo sapiens
ccagcttcactc

SEQ ID NO: 819941 - DNA, 12 bp, Homo sapiens
ccagcttcagct

SEQ ID NO: 819942 - DNA, 19 bp, Homo sapiens
ccagcttcatgtggcttcc

SEQ ID NO: 819943 - DNA, 14 bp, Homo sapiens
ccagcttcctggtg

SEQ ID NO: 819944 - DNA, 21 bp, Homo sapiens
ccagcttcggagggcccctgc

SEQ ID NO: 819945 - DNA, 20 bp, Homo sapiens
ccagcttcgtgctggaggaa

SEQ ID NO: 819946 - DNA, 16 bp, Homo sapiens
ccagcttctccaggct

SEQ ID NO: 819947 - DNA, 17 bp, Homo sapiens
ccagcttctccaggctc

SEQ ID NO: 819948 - DNA, 14 bp, Homo sapiens
ccagcttctctctc

SEQ ID NO: 819949 - DNA, 20 bp, Homo sapiens
ccagcttctctctccagggt

SEQ ID NO: 819950 - DNA, 21 bp, Homo sapiens
ccagcttctctctccctgtca

SEQ ID NO: 819951 - DNA, 21 bp, Homo sapiens
ccagcttctggtactctccta

SEQ ID NO: 819952 - DNA, 22 bp, Homo sapiens
ccagcttctggtactctcctag

SEQ ID NO: 819953 - DNA, 16 bp, Homo sapiens
ccagcttgctcttcag

SEQ ID NO: 819954 - DNA, 15 bp, Homo sapiens
ccagcttgctgaggg

SEQ ID NO: 819955 - DNA, 16 bp, Homo sapiens
ccagcttgctgagggg

SEQ ID NO: 819956 - DNA, 22 bp, Homo sapiens
ccagcttggctcgatgtttgcc

SEQ ID NO: 819957 - DNA, 24 bp, Homo sapiens
ccagcttgggcccagctgggctct

SEQ ID NO: 819958 - DNA, 14 bp, Homo sapiens
ccagcttggggcca

SEQ ID NO: 819959 - DNA, 19 bp, Homo sapiens
ccagcttggggccaccaaa

SEQ ID NO: 819960 - DNA, 16 bp, Homo sapiens
ccagcttgttatttat

SEQ ID NO: 819961 - DNA, 17 bp, Homo sapiens
ccagcttgttatttata

SEQ ID NO: 819962 - DNA, 17 bp, Homo sapiens
ccagcttttactgtttt

SEQ ID NO: 819963 - DNA, 13 bp, Homo sapiens
ccagcttttcaaa

SEQ ID NO: 819964 - DNA, 18 bp, Homo sapiens
ccagcttttcctcccttg

SEQ ID NO: 819965 - DNA, 15 bp, Homo sapiens
ccaggaaaaaataaa

SEQ ID NO: 819966 - DNA, 20 bp, Homo sapiens
ccaggaaaaaataaaaagag

SEQ ID NO: 819967 - DNA, 21 bp, Homo sapiens
ccaggaaaactgggacatagg

SEQ ID NO: 819968 - DNA, 20 bp, Homo sapiens
ccaggaaactccacatctgc

SEQ ID NO: 819969 - DNA, 20 bp, Homo sapiens
ccaggaaagccacacggaga

SEQ ID NO: 819970 - DNA, 13 bp, Homo sapiens
ccaggaacaagct

SEQ ID NO: 819971 - DNA, 21 bp, Homo sapiens
ccaggaacaatcgatggcctt

SEQ ID NO: 819972 - DNA, 19 bp, Homo sapiens
ccaggaacgctctcctcga

SEQ ID NO: 819973 - DNA, 15 bp, Homo sapiens
ccaggaactgcctgg

SEQ ID NO: 819974 - DNA, 17 bp, Homo sapiens
ccaggaagatcccccag

SEQ ID NO: 819975 - DNA, 15 bp, Homo sapiens
ccaggaagccagagc

SEQ ID NO: 819976 - DNA, 11 bp, Homo sapiens
ccaggaagccg

SEQ ID NO: 819977 - DNA, 18 bp, Homo sapiens
ccaggaaggcagctgctc

SEQ ID NO: 819978 - DNA, 23 bp, Homo sapiens
ccaggaaggccaaaatcaagagt

SEQ ID NO: 819979 - DNA, 21 bp, Homo sapiens
ccaggaagggaaagcgggcag

SEQ ID NO: 819980 - DNA, 21 bp, Homo sapiens
ccaggaagggggtccacccag

SEQ ID NO: 819981 - DNA, 22 bp, Homo sapiens
ccaggaagggggtccacccagc

SEQ ID NO: 819982 - DNA, 14 bp, Homo sapiens
ccaggaatagtgga

SEQ ID NO: 819983 - DNA, 18 bp, Homo sapiens
ccaggaatagtggacatg

SEQ ID NO: 819984 - DNA, 15 bp, Homo sapiens
ccaggaatgctgggc

SEQ ID NO: 819985 - DNA, 16 bp, Homo sapiens
ccaggaatgctgggcc

SEQ ID NO: 819986 - DNA, 17 bp, Homo sapiens
ccaggaatgctgggccc

SEQ ID NO: 819987 - DNA, 23 bp, Homo sapiens
ccaggacaatgaaatactccagc

SEQ ID NO: 819988 - DNA, 21 bp, Homo sapiens
ccaggacacctttctctgccg

SEQ ID NO: 819989 - DNA, 16 bp, Homo sapiens
ccaggacagcagcact

SEQ ID NO: 819990 - DNA, 17 bp, Homo sapiens
ccaggacaggcccggcg

SEQ ID NO: 819991 - DNA, 13 bp, Homo sapiens
ccaggacagttta

SEQ ID NO: 819992 - DNA, 14 bp, Homo sapiens
ccaggaccaagcca

SEQ ID NO: 819993 - DNA, 12 bp, Homo sapiens
ccaggaccagcc

SEQ ID NO: 819994 - DNA, 15 bp, Homo sapiens
ccaggaccagcctgt

SEQ ID NO: 819995 - DNA, 23 bp, Homo sapiens
ccaggaccagtcaacctgggcaa

SEQ ID NO: 819996 - DNA, 12 bp, Homo sapiens
ccaggacccagg

SEQ ID NO: 819997 - DNA, 13 bp, Homo sapiens
ccaggacccaggg

SEQ ID NO: 819998 - DNA, 15 bp, Homo sapiens
ccaggacccagggtc

SEQ ID NO: 819999 - DNA, 16 bp, Homo sapiens
ccaggacccagggtcc

SEQ ID NO: 820000 - DNA, 17 bp, Homo sapiens
ccaggacccagggtccc

SEQ ID NO: 820001 - DNA, 13 bp, Homo sapiens
ccaggaccccagg

SEQ ID NO: 820002 - DNA, 17 bp, Homo sapiens
ccaggacccctgtccag

SEQ ID NO: 820003 - DNA, 15 bp, Homo sapiens
ccaggacccgccagc

SEQ ID NO: 820004 - DNA, 20 bp, Homo sapiens
ccaggacccgccagccccgc

SEQ ID NO: 820005 - DNA, 17 bp, Homo sapiens
ccaggacccgcctgctc

SEQ ID NO: 820006 - DNA, 21 bp, Homo sapiens
ccaggaccctgacctccgccc

SEQ ID NO: 820007 - DNA, 14 bp, Homo sapiens
ccaggacgccactc

SEQ ID NO: 820008 - DNA, 22 bp, Homo sapiens
ccaggacgccactcatttcatc

SEQ ID NO: 820009 - DNA, 20 bp, Homo sapiens
ccaggacgtctggggtgtgg

SEQ ID NO: 820010 - DNA, 19 bp, Homo sapiens
ccaggccatgtggcctgcc

SEQ ID NO: 820011 - DNA, 24 bp, Homo sapiens
ccaggccatgtggcctgcccagcc

SEQ ID NO: 820012 - DNA, 15 bp, Homo sapiens
ccaggccattctgcc

SEQ ID NO: 820013 - DNA, 15 bp, Homo sapiens
ccaggcccaaggctc

SEQ ID NO: 820014 - DNA, 17 bp, Homo sapiens
ccaggcccaccatcacc

SEQ ID NO: 820015 - DNA, 23 bp, Homo sapiens
ccaggcccaccatcaccaccgcc

SEQ ID NO: 820016 - DNA, 18 bp, Homo sapiens
ccaggcccacgaggagca

SEQ ID NO: 820017 - DNA, 21 bp, Homo sapiens
ccaggcccacgaggagcagca

SEQ ID NO: 820018 - DNA, 15 bp, Homo sapiens
ccaggcccagccctc

SEQ ID NO: 820019 - DNA, 17 bp, Homo sapiens
ccaggcccagccctcct

SEQ ID NO: 820020 - DNA, 21 bp, Homo sapiens
ccaggcccagccctccttcag

SEQ ID NO: 820021 - DNA, 17 bp, Homo sapiens
ccaggcccaggccagcc

SEQ ID NO: 820022 - DNA, 13 bp, Homo sapiens
ccaggcccatctc

SEQ ID NO: 820023 - DNA, 19 bp, Homo sapiens
ccaggcccatctcaggtgc

SEQ ID NO: 820024 - DNA, 21 bp, Homo sapiens
ccaggcccatctcaggtgcca

SEQ ID NO: 820025 - DNA, 23 bp, Homo sapiens
ccaggcccatctcaggtgccact

SEQ ID NO: 820026 - DNA, 21 bp, Homo sapiens
ccaggccccaaaaccacagcc

SEQ ID NO: 820027 - DNA, 13 bp, Homo sapiens
ccaggccccagac

SEQ ID NO: 820028 - DNA, 16 bp, Homo sapiens
ccaggccccagacagg

SEQ ID NO: 820029 - DNA, 15 bp, Homo sapiens
ccaggccccagcctc

SEQ ID NO: 820030 - DNA, 15 bp, Homo sapiens
ccaggcccccaactc

SEQ ID NO: 820031 - DNA, 22 bp, Homo sapiens
ccaggcccccggctttcctccg

SEQ ID NO: 820032 - DNA, 17 bp, Homo sapiens
ccaggccccctgcatct

SEQ ID NO: 820033 - DNA, 12 bp, Homo sapiens
ccaggcccctga

SEQ ID NO: 820034 - DNA, 16 bp, Homo sapiens
ccaggcccctgaggac

SEQ ID NO: 820035 - DNA, 17 bp, Homo sapiens
ccaggcccctgaggact

SEQ ID NO: 820036 - DNA, 19 bp, Homo sapiens
ccaggcccctgaggactgg

SEQ ID NO: 820037 - DNA, 16 bp, Homo sapiens
ccaggcccgcgggcac

SEQ ID NO: 820038 - DNA, 18 bp, Homo sapiens
ccaggcccgcgggcacag

SEQ ID NO: 820039 - DNA, 23 bp, Homo sapiens
ccaggcccgcgggcacagccagc

SEQ ID NO: 820040 - DNA, 15 bp, Homo sapiens
ccaggcccggggctg

SEQ ID NO: 820041 - DNA, 20 bp, Homo sapiens
ccaggcccggggctggcggc

SEQ ID NO: 820042 - DNA, 21 bp, Homo sapiens
ccaggcccggggctggcggct

SEQ ID NO: 820043 - DNA, 12 bp, Homo sapiens
ccaggcccgtgg

SEQ ID NO: 820044 - DNA, 17 bp, Homo sapiens
ccaggcccgtgggcgca

SEQ ID NO: 820045 - DNA, 13 bp, Homo sapiens
ccaggccctacaa

SEQ ID NO: 820046 - DNA, 17 bp, Homo sapiens
ccaggccctccatgggc

SEQ ID NO: 820047 - DNA, 12 bp, Homo sapiens
ccaggccctccc

SEQ ID NO: 820048 - DNA, 16 bp, Homo sapiens
ccaggccctcccacca

SEQ ID NO: 820049 - DNA, 21 bp, Homo sapiens
ccaggccctcccaccacccca

SEQ ID NO: 820050 - DNA, 19 bp, Homo sapiens
ccaggccctcctctcccat

SEQ ID NO: 820051 - DNA, 14 bp, Homo sapiens
ccaggccctgccag

SEQ ID NO: 820052 - DNA, 20 bp, Homo sapiens
ccaggccctgccattggcct

SEQ ID NO: 820053 - DNA, 21 bp, Homo sapiens
ccaggccctgccattggcctc

SEQ ID NO: 820054 - DNA, 17 bp, Homo sapiens
ccaggccctgtggcagg

SEQ ID NO: 820055 - DNA, 18 bp, Homo sapiens
ccaggcccttggctgcag

SEQ ID NO: 820056 - DNA, 16 bp, Homo sapiens
ccaggccgcagctctt

SEQ ID NO: 820057 - DNA, 21 bp, Homo sapiens
ccaggccgcagctcttgccct

SEQ ID NO: 820058 - DNA, 14 bp, Homo sapiens
ccaggccggagccc

SEQ ID NO: 820059 - DNA, 18 bp, Homo sapiens
ccaggccggagcccagat

SEQ ID NO: 820060 - DNA, 16 bp, Homo sapiens
ccaggccggcccagat

SEQ ID NO: 820061 - DNA, 15 bp, Homo sapiens
ccaggccgtcctccc

SEQ ID NO: 820062 - DNA, 13 bp, Homo sapiens
ccaggcctcactg

SEQ ID NO: 820063 - DNA, 15 bp, Homo sapiens
ccaggcctcactggc

SEQ ID NO: 820064 - DNA, 16 bp, Homo sapiens
ccaggcctcactggct

SEQ ID NO: 820065 - DNA, 13 bp, Homo sapiens
ccaggcctccagc

SEQ ID NO: 820066 - DNA, 14 bp, Homo sapiens
ccaggcctccagcc

SEQ ID NO: 820067 - DNA, 15 bp, Homo sapiens
ccaggcctccagcct

SEQ ID NO: 820068 - DNA, 12 bp, Homo sapiens
ccaggcctccta

SEQ ID NO: 820069 - DNA, 13 bp, Homo sapiens
ccaggcctcctag

SEQ ID NO: 820070 - DNA, 20 bp, Homo sapiens
ccaggcctcctaggggaagg

SEQ ID NO: 820071 - DNA, 21 bp, Homo sapiens
ccaggcctcctaggggaaggg

SEQ ID NO: 820072 - DNA, 13 bp, Homo sapiens
ccaggcctcgcac

SEQ ID NO: 820073 - DNA, 13 bp, Homo sapiens
ccaggcctctgtg

SEQ ID NO: 820074 - DNA, 15 bp, Homo sapiens
ccaggcctctgtgtc

SEQ ID NO: 820075 - DNA, 14 bp, Homo sapiens
ccaggcctgcagca

SEQ ID NO: 820076 - DNA, 16 bp, Homo sapiens
ccaggcctgcagcagg

SEQ ID NO: 820077 - DNA, 13 bp, Homo sapiens
ccaggcctggagc

SEQ ID NO: 820078 - DNA, 15 bp, Homo sapiens
ccaggcctggcctcg

SEQ ID NO: 820079 - DNA, 13 bp, Homo sapiens
ccaggcctggctc

SEQ ID NO: 820080 - DNA, 14 bp, Homo sapiens
ccaggcctggctcc

SEQ ID NO: 820081 - DNA, 19 bp, Homo sapiens
ccaggcctgggtctgtgtc

SEQ ID NO: 820082 - DNA, 19 bp, Homo sapiens
ccaggcctgtccaccctgc

SEQ ID NO: 820083 - DNA, 13 bp, Homo sapiens
ccaggcctgttgc

SEQ ID NO: 820084 - DNA, 18 bp, Homo sapiens
ccaggccttatctccaag

SEQ ID NO: 820085 - DNA, 11 bp, Homo sapiens
ccaggccttgc

SEQ ID NO: 820086 - DNA, 17 bp, Homo sapiens
ccaggccttgctgactc

SEQ ID NO: 820087 - DNA, 19 bp, Homo sapiens
ccaggccttgctgactctc

SEQ ID NO: 820088 - DNA, 19 bp, Homo sapiens
ccaggcctttggaggggaa

SEQ ID NO: 820089 - DNA, 13 bp, Homo sapiens
ccaggcgagcctg

SEQ ID NO: 820090 - DNA, 15 bp, Homo sapiens
ccaggcgagcctgac

SEQ ID NO: 820091 - DNA, 19 bp, Homo sapiens
ccaggcgagcctgactctg

SEQ ID NO: 820092 - DNA, 18 bp, Homo sapiens
ccaggcgcaggggctcac

SEQ ID NO: 820093 - DNA, 12 bp, Homo sapiens
ccaggcgcatgt

SEQ ID NO: 820094 - DNA, 18 bp, Homo sapiens
ccaggcgcatgtctgcac

SEQ ID NO: 820095 - DNA, 19 bp, Homo sapiens
ccaggcgccccttccccct

SEQ ID NO: 820096 - DNA, 16 bp, Homo sapiens
ccaggcgctaattcaa

SEQ ID NO: 820097 - DNA, 14 bp, Homo sapiens
ccaggcggccctgg

SEQ ID NO: 820098 - DNA, 17 bp, Homo sapiens
ccaggcggccctgggga

SEQ ID NO: 820099 - DNA, 15 bp, Homo sapiens
ccaggcgggcggcac

SEQ ID NO: 820100 - DNA, 23 bp, Homo sapiens
ccaggcgggcggcacgccaacag

SEQ ID NO: 820101 - DNA, 14 bp, Homo sapiens
ccaggcgggctcaa

SEQ ID NO: 820102 - DNA, 18 bp, Homo sapiens
ccaggcggtttcacgccc

SEQ ID NO: 820103 - DNA, 19 bp, Homo sapiens
ccaggctagagtgcaatgg

SEQ ID NO: 820104 - DNA, 22 bp, Homo sapiens
ccaggctatggttgccacccca

SEQ ID NO: 820105 - DNA, 21 bp, Homo sapiens
ccaggctccctttctcttctt

SEQ ID NO: 820106 - DNA, 14 bp, Homo sapiens
ccaggctccgccct

SEQ ID NO: 820107 - DNA, 15 bp, Homo sapiens
ccaggctctccgggc

SEQ ID NO: 820108 - DNA, 23 bp, Homo sapiens
ccaggctctcgcacacctctgca

SEQ ID NO: 820109 - DNA, 20 bp, Homo sapiens
ccaggctctggagccagaga

SEQ ID NO: 820110 - DNA, 13 bp, Homo sapiens
ccaggctctgggc

SEQ ID NO: 820111 - DNA, 14 bp, Homo sapiens
ccaggctctgggca

SEQ ID NO: 820112 - DNA, 19 bp, Homo sapiens
ccaggctcttcctggacct

SEQ ID NO: 820113 - DNA, 20 bp, Homo sapiens
ccaggctcttcctggacctg

SEQ ID NO: 820114 - DNA, 23 bp, Homo sapiens
ccaggctcttcctggacctgagt

SEQ ID NO: 820115 - DNA, 13 bp, Homo sapiens
ccaggctgatgct

SEQ ID NO: 820116 - DNA, 13 bp, Homo sapiens
ccaggctgcactg

SEQ ID NO: 820117 - DNA, 14 bp, Homo sapiens
ccaggctgcactgc

SEQ ID NO: 820118 - DNA, 20 bp, Homo sapiens
ccaggctgcagatgatcagg

SEQ ID NO: 820119 - DNA, 21 bp, Homo sapiens
ccaggctgcagatgatcaggg

SEQ ID NO: 820120 - DNA, 20 bp, Homo sapiens
ccaggctgccaaggccagag

SEQ ID NO: 820121 - DNA, 14 bp, Homo sapiens
ccaggctgctggac

SEQ ID NO: 820122 - DNA, 15 bp, Homo sapiens
ccaggctggagtgca

SEQ ID NO: 820123 - DNA, 15 bp, Homo sapiens
ccaggctggcgcagc

SEQ ID NO: 820124 - DNA, 17 bp, Homo sapiens
ccaggctggcgcagcca

SEQ ID NO: 820125 - DNA, 11 bp, Homo sapiens
ccaggctggga

SEQ ID NO: 820126 - DNA, 22 bp, Homo sapiens
ccaggctgtaagcattctgagc

SEQ ID NO: 820127 - DNA, 20 bp, Homo sapiens
ccaggctgtgcagcgcagct

SEQ ID NO: 820128 - DNA, 21 bp, Homo sapiens
ccaggctgtgggcctcaagga

SEQ ID NO: 820129 - DNA, 22 bp, Homo sapiens
ccaggctgtgggcctcaaggac

SEQ ID NO: 820130 - DNA, 18 bp, Homo sapiens
ccaggcttcaccctgaat

SEQ ID NO: 820131 - DNA, 17 bp, Homo sapiens
ccaggcttgcctcaagt

SEQ ID NO: 820132 - DNA, 14 bp, Homo sapiens
ccaggcttgcctgg

SEQ ID NO: 820133 - DNA, 22 bp, Homo sapiens
ccagggtcccctccccagctcc

SEQ ID NO: 820134 - DNA, 14 bp, Homo sapiens
ccagggtcccctgc

SEQ ID NO: 820135 - DNA, 18 bp, Homo sapiens
ccagggtcccctgccacc

SEQ ID NO: 820136 - DNA, 19 bp, Homo sapiens
ccagggtcccctgccaccg

SEQ ID NO: 820137 - DNA, 17 bp, Homo sapiens
ccagggtccctctgtgt

SEQ ID NO: 820138 - DNA, 14 bp, Homo sapiens
ccagggtccgcacc

SEQ ID NO: 820139 - DNA, 16 bp, Homo sapiens
ccagggtccgcaccag

SEQ ID NO: 820140 - DNA, 17 bp, Homo sapiens
ccagggtccgcaccagc

SEQ ID NO: 820141 - DNA, 19 bp, Homo sapiens
ccagggtccgcaccagctg

SEQ ID NO: 820142 - DNA, 15 bp, Homo sapiens
ccagggtcctctagc

SEQ ID NO: 820143 - DNA, 14 bp, Homo sapiens
ccagggtctggcag

SEQ ID NO: 820144 - DNA, 19 bp, Homo sapiens
ccagggtctggcagagcct

SEQ ID NO: 820145 - DNA, 20 bp, Homo sapiens
ccagggtctggcagagcctc

SEQ ID NO: 820146 - DNA, 22 bp, Homo sapiens
ccagggtctggcagagcctctg

SEQ ID NO: 820147 - DNA, 18 bp, Homo sapiens
ccagggtcttacctctct

SEQ ID NO: 820148 - DNA, 20 bp, Homo sapiens
ccagggtcttacctctctgg

SEQ ID NO: 820149 - DNA, 15 bp, Homo sapiens
ccagggtgagcaggg

SEQ ID NO: 820150 - DNA, 14 bp, Homo sapiens
ccagggtggaccag

SEQ ID NO: 820151 - DNA, 15 bp, Homo sapiens
ccagggtggaccagg

SEQ ID NO: 820152 - DNA, 17 bp, Homo sapiens
ccagggtggcagcaaca

SEQ ID NO: 820153 - DNA, 17 bp, Homo sapiens
ccagggtgggctgggga

SEQ ID NO: 820154 - DNA, 18 bp, Homo sapiens
ccagggtgggctggggac

SEQ ID NO: 820155 - DNA, 19 bp, Homo sapiens
ccagggtgggctggggact

SEQ ID NO: 820156 - DNA, 15 bp, Homo sapiens
ccagggtggttagag

SEQ ID NO: 820157 - DNA, 19 bp, Homo sapiens
ccagggtgtggccctgcca

SEQ ID NO: 820158 - DNA, 21 bp, Homo sapiens
ccagggtgtggccctgccatc

SEQ ID NO: 820159 - DNA, 21 bp, Homo sapiens
ccagggttgaccccagaggat

SEQ ID NO: 820160 - DNA, 13 bp, Homo sapiens
ccagggttttgcc

SEQ ID NO: 820161 - DNA, 15 bp, Homo sapiens
ccaggtaccagctgc

SEQ ID NO: 820162 - DNA, 19 bp, Homo sapiens
ccaggtaccagctgcgctt

SEQ ID NO: 820163 - DNA, 22 bp, Homo sapiens
ccaggtactgcattctctccca

SEQ ID NO: 820164 - DNA, 14 bp, Homo sapiens
ccaggtatggctct

SEQ ID NO: 820165 - DNA, 17 bp, Homo sapiens
ccaggtcaccatcctca

SEQ ID NO: 820166 - DNA, 23 bp, Homo sapiens
ccaggtcaccatcctcagaggct

SEQ ID NO: 820167 - DNA, 12 bp, Homo sapiens
ccaggtcagccc

SEQ ID NO: 820168 - DNA, 18 bp, Homo sapiens
ccaggtcagccctgtgtc

SEQ ID NO: 820169 - DNA, 22 bp, Homo sapiens
ccaggtcagccctgtgtctgtc

SEQ ID NO: 820170 - DNA, 16 bp, Homo sapiens
ccaggtcaggggctcc

SEQ ID NO: 820171 - DNA, 21 bp, Homo sapiens
ccaggtcatgcagttcctggc

SEQ ID NO: 820172 - DNA, 21 bp, Homo sapiens
ccaggtccaaacccttcaact

SEQ ID NO: 820173 - DNA, 19 bp, Homo sapiens
ccaggtcctcagatgggaa

SEQ ID NO: 820174 - DNA, 13 bp, Homo sapiens
ccaggtcctctga

SEQ ID NO: 820175 - DNA, 16 bp, Homo sapiens
ccaggtcctgtctctg

SEQ ID NO: 820176 - DNA, 23 bp, Homo sapiens
ccaggtctcacgggcatgggcac

SEQ ID NO: 820177 - DNA, 20 bp, Homo sapiens
ccaggtcttcctgctttcca

SEQ ID NO: 820178 - DNA, 23 bp, Homo sapiens
ccaggtcttgactcatggcagct

SEQ ID NO: 820179 - DNA, 19 bp, Homo sapiens
ccaggtcttggagctgagc

SEQ ID NO: 820180 - DNA, 19 bp, Homo sapiens
ccaggtgaggtccaccggc

SEQ ID NO: 820181 - DNA, 14 bp, Homo sapiens
ccaggtgagtgtga

SEQ ID NO: 820182 - DNA, 19 bp, Homo sapiens
ccaggtgagtgtgagggca

SEQ ID NO: 820183 - DNA, 14 bp, Homo sapiens
ccaggtgatttcct

SEQ ID NO: 820184 - DNA, 16 bp, Homo sapiens
ccaggtgcctttcaaa

SEQ ID NO: 820185 - DNA, 20 bp, Homo sapiens
ccaggtgcctttcaaattta

SEQ ID NO: 820186 - DNA, 22 bp, Homo sapiens
ccaggtgcgtgtgtctctgtct

SEQ ID NO: 820187 - DNA, 15 bp, Homo sapiens
ccaggtggaaggcag

SEQ ID NO: 820188 - DNA, 19 bp, Homo sapiens
ccaggtggaaggcagacag

SEQ ID NO: 820189 - DNA, 17 bp, Homo sapiens
ccaggtggcaaagtact

SEQ ID NO: 820190 - DNA, 21 bp, Homo sapiens
ccaggtggccactccagaccc

SEQ ID NO: 820191 - DNA, 19 bp, Homo sapiens
ccaggtggcctcctggccc

SEQ ID NO: 820192 - DNA, 17 bp, Homo sapiens
ccaggtggctgacccag

SEQ ID NO: 820193 - DNA, 19 bp, Homo sapiens
ccaggtggctgacccagtc

SEQ ID NO: 820194 - DNA, 23 bp, Homo sapiens
ccaggtggctgacccagtccctg

SEQ ID NO: 820195 - DNA, 14 bp, Homo sapiens
ccaggtgtgcctgg

SEQ ID NO: 820196 - DNA, 17 bp, Homo sapiens
ccaggtgttactgtaat

SEQ ID NO: 820197 - DNA, 15 bp, Homo sapiens
ccaggtgttgccatt

SEQ ID NO: 820198 - DNA, 17 bp, Homo sapiens
ccaggttaggaaggcag

SEQ ID NO: 820199 - DNA, 20 bp, Homo sapiens
ccaggttcaacccacagcta

SEQ ID NO: 820200 - DNA, 21 bp, Homo sapiens
ccaggttccccagccgcccac

SEQ ID NO: 820201 - DNA, 16 bp, Homo sapiens
ccaggttcccccagca

SEQ ID NO: 820202 - DNA, 19 bp, Homo sapiens
ccaggttcccccagcaagc

SEQ ID NO: 820203 - DNA, 21 bp, Homo sapiens
ccagtaaatgggggtgcattt

SEQ ID NO: 820204 - DNA, 23 bp, Homo sapiens
ccagtaaatgggggtgcatttga

SEQ ID NO: 820205 - DNA, 19 bp, Homo sapiens
ccagtaacgcgtcttcctg

SEQ ID NO: 820206 - DNA, 21 bp, Homo sapiens
ccagtaacgcgtcttcctgag

SEQ ID NO: 820207 - DNA, 22 bp, Homo sapiens
ccagtacagagaaattctgtgg

SEQ ID NO: 820208 - DNA, 15 bp, Homo sapiens
ccagtacctccaagc

SEQ ID NO: 820209 - DNA, 20 bp, Homo sapiens
ccagtacgtcccgctgctgt

SEQ ID NO: 820210 - DNA, 13 bp, Homo sapiens
ccagtactgggaa

SEQ ID NO: 820211 - DNA, 17 bp, Homo sapiens
ccagtactgggaaggag

SEQ ID NO: 820212 - DNA, 15 bp, Homo sapiens
ccagtacttgtcata

SEQ ID NO: 820213 - DNA, 15 bp, Homo sapiens
ccagtagctcctgga

SEQ ID NO: 820214 - DNA, 13 bp, Homo sapiens
ccagtagtcagaa

SEQ ID NO: 820215 - DNA, 23 bp, Homo sapiens
ccagtattactgctgctgtgctt

SEQ ID NO: 820216 - DNA, 21 bp, Homo sapiens
ccagtcaacatcgtggatgta

SEQ ID NO: 820217 - DNA, 14 bp, Homo sapiens
ccagtcacactccc

SEQ ID NO: 820218 - DNA, 16 bp, Homo sapiens
ccagtcacagtttttg

SEQ ID NO: 820219 - DNA, 14 bp, Homo sapiens
ccagtcaccttctg

SEQ ID NO: 820220 - DNA, 12 bp, Homo sapiens
ccagtcactgct

SEQ ID NO: 820221 - DNA, 13 bp, Homo sapiens
ccagtcactgctg

SEQ ID NO: 820222 - DNA, 18 bp, Homo sapiens
ccagtcactgctgcaagg

SEQ ID NO: 820223 - DNA, 17 bp, Homo sapiens
ccagtcagatgaggcaa

SEQ ID NO: 820224 - DNA, 18 bp, Homo sapiens
ccagtcatcctgccctgc

SEQ ID NO: 820225 - DNA, 19 bp, Homo sapiens
ccagtcatggaatcttgct

SEQ ID NO: 820226 - DNA, 21 bp, Homo sapiens
ccagtcatggtactaccccag

SEQ ID NO: 820227 - DNA, 14 bp, Homo sapiens
ccagtccactcctg

SEQ ID NO: 820228 - DNA, 14 bp, Homo sapiens
ccagtccaggctgc

SEQ ID NO: 820229 - DNA, 16 bp, Homo sapiens
ccagtccaggctgccg

SEQ ID NO: 820230 - DNA, 14 bp, Homo sapiens
ccagtccatttcca

SEQ ID NO: 820231 - DNA, 19 bp, Homo sapiens
ccagtcccacactgtggcc

SEQ ID NO: 820232 - DNA, 19 bp, Homo sapiens
ccagtcccagacaattcca

SEQ ID NO: 820233 - DNA, 23 bp, Homo sapiens
ccagtcccagggaaggtggggcc

SEQ ID NO: 820234 - DNA, 18 bp, Homo sapiens
ccagtccccacccctgcc

SEQ ID NO: 820235 - DNA, 13 bp, Homo sapiens
ccagtccccagcc

SEQ ID NO: 820236 - DNA, 16 bp, Homo sapiens
ccagtccccagccctg

SEQ ID NO: 820237 - DNA, 17 bp, Homo sapiens
ccagtccccagccctgg

SEQ ID NO: 820238 - DNA, 22 bp, Homo sapiens
ccagtccccagccctgggcttg

SEQ ID NO: 820239 - DNA, 21 bp, Homo sapiens
ccagtccccatttctgcctcg

SEQ ID NO: 820240 - DNA, 14 bp, Homo sapiens
ccagtccccgagga

SEQ ID NO: 820241 - DNA, 17 bp, Homo sapiens
ccagtccccgaggagct

SEQ ID NO: 820242 - DNA, 22 bp, Homo sapiens
ccagtccccgaggagctgggcc

SEQ ID NO: 820243 - DNA, 15 bp, Homo sapiens
ccagtccccgtgccc

SEQ ID NO: 820244 - DNA, 15 bp, Homo sapiens
ccagtccctggggga

SEQ ID NO: 820245 - DNA, 19 bp, Homo sapiens
ccagtccctgggggaagcc

SEQ ID NO: 820246 - DNA, 23 bp, Homo sapiens
ccagtccctgggggaagccctgg

SEQ ID NO: 820247 - DNA, 15 bp, Homo sapiens
ccagtcctcctggga

SEQ ID NO: 820248 - DNA, 16 bp, Homo sapiens
ccagtcctcctgggag

SEQ ID NO: 820249 - DNA, 22 bp, Homo sapiens
ccagtcctctcccaagtccaca

SEQ ID NO: 820250 - DNA, 14 bp, Homo sapiens
ccagtcctgcctgg

SEQ ID NO: 820251 - DNA, 16 bp, Homo sapiens
ccagtcctgcctggcc

SEQ ID NO: 820252 - DNA, 18 bp, Homo sapiens
ccagtcctgcctggccag

SEQ ID NO: 820253 - DNA, 19 bp, Homo sapiens
ccagtcctgcctggccagg

SEQ ID NO: 820254 - DNA, 15 bp, Homo sapiens
cccaccccctgccct

SEQ ID NO: 820255 - DNA, 19 bp, Homo sapiens
cccacccccttctctgctc

SEQ ID NO: 820256 - DNA, 13 bp, Homo sapiens
cccaccccgggga

SEQ ID NO: 820257 - DNA, 17 bp, Homo sapiens
cccaccccggggaccct

SEQ ID NO: 820258 - DNA, 18 bp, Homo sapiens
cccaccccggggaccctg

SEQ ID NO: 820259 - DNA, 21 bp, Homo sapiens
cccaccccggggaccctgtga

SEQ ID NO: 820260 - DNA, 13 bp, Homo sapiens
cccacccctagga

SEQ ID NO: 820261 - DNA, 14 bp, Homo sapiens
cccacccctcactc

SEQ ID NO: 820262 - DNA, 17 bp, Homo sapiens
cccacccctcactcccc

SEQ ID NO: 820263 - DNA, 16 bp, Homo sapiens
cccacccctgccccca

SEQ ID NO: 820264 - DNA, 12 bp, Homo sapiens
cccacccctggg

SEQ ID NO: 820265 - DNA, 12 bp, Homo sapiens
cccaccccttcc

SEQ ID NO: 820266 - DNA, 14 bp, Homo sapiens
cccacccgacttct

SEQ ID NO: 820267 - DNA, 18 bp, Homo sapiens
cccacccgagtacctcca

SEQ ID NO: 820268 - DNA, 16 bp, Homo sapiens
cccacccgatgctgct

SEQ ID NO: 820269 - DNA, 15 bp, Homo sapiens
cccacccgcccgagg

SEQ ID NO: 820270 - DNA, 21 bp, Homo sapiens
cccacccggccacagctgctg

SEQ ID NO: 820271 - DNA, 19 bp, Homo sapiens
cccaccctaccagctcctc

SEQ ID NO: 820272 - DNA, 12 bp, Homo sapiens
cccaccctcagc

SEQ ID NO: 820273 - DNA, 18 bp, Homo sapiens
cccaccctcagcacccct

SEQ ID NO: 820274 - DNA, 21 bp, Homo sapiens
cccaccctcagcaccccttcc

SEQ ID NO: 820275 - DNA, 19 bp, Homo sapiens
cccaccctccacctctcac

SEQ ID NO: 820276 - DNA, 16 bp, Homo sapiens
cccaccctccatgctc

SEQ ID NO: 820277 - DNA, 18 bp, Homo sapiens
cccaccctccatgctcct

SEQ ID NO: 820278 - DNA, 18 bp, Homo sapiens
cccaccctcctcttggaa

SEQ ID NO: 820279 - DNA, 12 bp, Homo sapiens
cccaccctctgg

SEQ ID NO: 820280 - DNA, 13 bp, Homo sapiens
cccaccctgggcc

SEQ ID NO: 820281 - DNA, 21 bp, Homo sapiens
cccacccttacttcctggcct

SEQ ID NO: 820282 - DNA, 13 bp, Homo sapiens
cccaccgccccca

SEQ ID NO: 820283 - DNA, 16 bp, Homo sapiens
cccaccgccctcctcc

SEQ ID NO: 820284 - DNA, 19 bp, Homo sapiens
cccaccggatgctgtgcct

SEQ ID NO: 820285 - DNA, 16 bp, Homo sapiens
cccaccgggagcctcc

SEQ ID NO: 820286 - DNA, 16 bp, Homo sapiens
cccaccggtccagctg

SEQ ID NO: 820287 - DNA, 21 bp, Homo sapiens
cccaccggtccagctggcctg

SEQ ID NO: 820288 - DNA, 15 bp, Homo sapiens
cccaccgtccgccct

SEQ ID NO: 820289 - DNA, 24 bp, Homo sapiens
cccaccgtctcggccctgaaccac

SEQ ID NO: 820290 - DNA, 15 bp, Homo sapiens
cccaccgtgggcagg

SEQ ID NO: 820291 - DNA, 19 bp, Homo sapiens
cccaccgtgggcagggagc

SEQ ID NO: 820292 - DNA, 13 bp, Homo sapiens
cccacctccaccc

SEQ ID NO: 820293 - DNA, 18 bp, Homo sapiens
cccacctccacccagccc

SEQ ID NO: 820294 - DNA, 14 bp, Homo sapiens
cccacctccacccc

SEQ ID NO: 820295 - DNA, 12 bp, Homo sapiens
cccacctccagc

SEQ ID NO: 820296 - DNA, 15 bp, Homo sapiens
cccacctccccacac

SEQ ID NO: 820297 - DNA, 18 bp, Homo sapiens
cccacctcccgccctcac

SEQ ID NO: 820298 - DNA, 13 bp, Homo sapiens
cccacctcgctcc

SEQ ID NO: 820299 - DNA, 21 bp, Homo sapiens
cccacctcgctcccctctgga

SEQ ID NO: 820300 - DNA, 14 bp, Homo sapiens
cccacctcggcctc

SEQ ID NO: 820301 - DNA, 14 bp, Homo sapiens
cccacctctccctg

SEQ ID NO: 820302 - DNA, 15 bp, Homo sapiens
cccacctctccctgc

SEQ ID NO: 820303 - DNA, 18 bp, Homo sapiens
cccacctcttgtgcaagg

SEQ ID NO: 820304 - DNA, 16 bp, Homo sapiens
cccacctgaaagcctg

SEQ ID NO: 820305 - DNA, 19 bp, Homo sapiens
cccacctgaaagcctgtct

SEQ ID NO: 820306 - DNA, 19 bp, Homo sapiens
cccacctgctgagagaccc

SEQ ID NO: 820307 - DNA, 13 bp, Homo sapiens
cccacctgggacc

SEQ ID NO: 820308 - DNA, 16 bp, Homo sapiens
cccacctgggctgggc

SEQ ID NO: 820309 - DNA, 16 bp, Homo sapiens
cccacctgtagctgaa

SEQ ID NO: 820310 - DNA, 16 bp, Homo sapiens
cccacctgtttctgga

SEQ ID NO: 820311 - DNA, 21 bp, Homo sapiens
cccaccttcaattcctgggcc

SEQ ID NO: 820312 - DNA, 14 bp, Homo sapiens
cccaccttccccag

SEQ ID NO: 820313 - DNA, 17 bp, Homo sapiens
cccaccttccccagact

SEQ ID NO: 820314 - DNA, 14 bp, Homo sapiens
cccaccttgccagg

SEQ ID NO: 820315 - DNA, 15 bp, Homo sapiens
cccaccttgccaggg

SEQ ID NO: 820316 - DNA, 17 bp, Homo sapiens
cccaccttgttggagcc

SEQ ID NO: 820317 - DNA, 18 bp, Homo sapiens
cccaccttgttggagcct

SEQ ID NO: 820318 - DNA, 13 bp, Homo sapiens
cccacgacccctg

SEQ ID NO: 820319 - DNA, 20 bp, Homo sapiens
cccacgactgcccggcaggg

SEQ ID NO: 820320 - DNA, 14 bp, Homo sapiens
cccacgagggctgg

SEQ ID NO: 820321 - DNA, 17 bp, Homo sapiens
cccacgagggtgccgtg

SEQ ID NO: 820322 - DNA, 14 bp, Homo sapiens
cccacgagtcacct

SEQ ID NO: 820323 - DNA, 16 bp, Homo sapiens
cccacgagtcacctgc

SEQ ID NO: 820324 - DNA, 17 bp, Homo sapiens
cccacgagtcacctgca

SEQ ID NO: 820325 - DNA, 13 bp, Homo sapiens
cccacgatcccct

SEQ ID NO: 820326 - DNA, 13 bp, Homo sapiens
cccacgcagagga

SEQ ID NO: 820327 - DNA, 15 bp, Homo sapiens
cccacgcagaggacg

SEQ ID NO: 820328 - DNA, 20 bp, Homo sapiens
cccacgccggcctctgctgc

SEQ ID NO: 820329 - DNA, 13 bp, Homo sapiens
cccacgctcctgc

SEQ ID NO: 820330 - DNA, 22 bp, Homo sapiens
cccacgctcctgccctcgtctc

SEQ ID NO: 820331 - DNA, 15 bp, Homo sapiens
cccacggagacagag

SEQ ID NO: 820332 - DNA, 17 bp, Homo sapiens
cccacggagacagagga

SEQ ID NO: 820333 - DNA, 23 bp, Homo sapiens
cccacggcacctcggggacacca

SEQ ID NO: 820334 - DNA, 16 bp, Homo sapiens
cccacggggatcacag

SEQ ID NO: 820335 - DNA, 17 bp, Homo sapiens
cccacggtctgagctag

SEQ ID NO: 820336 - DNA, 18 bp, Homo sapiens
cccacgtgagagaatctg

SEQ ID NO: 820337 - DNA, 18 bp, Homo sapiens
cccacgtgtcttccactt

SEQ ID NO: 820338 - DNA, 15 bp, Homo sapiens
cccacgttctcacac

SEQ ID NO: 820339 - DNA, 23 bp, Homo sapiens
cccacgtttgttcgcttcctgag

SEQ ID NO: 820340 - DNA, 16 bp, Homo sapiens
cccactagagggccca

SEQ ID NO: 820341 - DNA, 17 bp, Homo sapiens
cccactagagggcccat

SEQ ID NO: 820342 - DNA, 12 bp, Homo sapiens
cccactcaccag

SEQ ID NO: 820343 - DNA, 16 bp, Homo sapiens
cccactcaccagggtc

SEQ ID NO: 820344 - DNA, 17 bp, Homo sapiens
cccactcaccagggtcc

SEQ ID NO: 820345 - DNA, 15 bp, Homo sapiens
cccactcagtgcctc

SEQ ID NO: 820346 - DNA, 16 bp, Homo sapiens
cccactccagcccgca

SEQ ID NO: 820347 - DNA, 13 bp, Homo sapiens
cccactccccagc

SEQ ID NO: 820348 - DNA, 17 bp, Homo sapiens
cccactcccccacccat

SEQ ID NO: 820349 - DNA, 22 bp, Homo sapiens
cccactccctggctctcagaag

SEQ ID NO: 820350 - DNA, 14 bp, Homo sapiens
cccactcccttggt

SEQ ID NO: 820351 - DNA, 23 bp, Homo sapiens
cccactcctctgctgacctgctg

SEQ ID NO: 820352 - DNA, 22 bp, Homo sapiens
cccactcgggtctgcagacctg

SEQ ID NO: 820353 - DNA, 14 bp, Homo sapiens
cccactctcattcc

SEQ ID NO: 820354 - DNA, 19 bp, Homo sapiens
cccactctcattccccagg

SEQ ID NO: 820355 - DNA, 15 bp, Homo sapiens
cccactctccccaca

SEQ ID NO: 820356 - DNA, 13 bp, Homo sapiens
cccactctctcac

SEQ ID NO: 820357 - DNA, 21 bp, Homo sapiens
cccactctctcacccaccagc

SEQ ID NO: 820358 - DNA, 14 bp, Homo sapiens
cccactctggtggc

SEQ ID NO: 820359 - DNA, 15 bp, Homo sapiens
cccactgcaatcctg

SEQ ID NO: 820360 - DNA, 15 bp, Homo sapiens
cccactgcaggcccc

SEQ ID NO: 820361 - DNA, 14 bp, Homo sapiens
cccactgccagcag

SEQ ID NO: 820362 - DNA, 17 bp, Homo sapiens
cccactgccataaaaca

SEQ ID NO: 820363 - DNA, 20 bp, Homo sapiens
cccactgccccgtgtgaatg

SEQ ID NO: 820364 - DNA, 15 bp, Homo sapiens
cccactgcctgccca

SEQ ID NO: 820365 - DNA, 23 bp, Homo sapiens
cccactgcggggagacagaagcc

SEQ ID NO: 820366 - DNA, 13 bp, Homo sapiens
cccactgctcccc

SEQ ID NO: 820367 - DNA, 23 bp, Homo sapiens
cccactgctcgtggactgtgctg

SEQ ID NO: 820368 - DNA, 14 bp, Homo sapiens
cccactgctgagct

SEQ ID NO: 820369 - DNA, 16 bp, Homo sapiens
cccactggacaacact

SEQ ID NO: 820370 - DNA, 23 bp, Homo sapiens
cccactggacaacactgattcct

SEQ ID NO: 820371 - DNA, 17 bp, Homo sapiens
cccactggatctggctt

SEQ ID NO: 820372 - DNA, 16 bp, Homo sapiens
cccactggccgctgag

SEQ ID NO: 820373 - DNA, 14 bp, Homo sapiens
cccactggctgaga

SEQ ID NO: 820374 - DNA, 18 bp, Homo sapiens
cccactgggccagccctg

SEQ ID NO: 820375 - DNA, 23 bp, Homo sapiens
cccactgggccagccctgcagcc

SEQ ID NO: 820376 - DNA, 14 bp, Homo sapiens
cccactggtgagac

SEQ ID NO: 820377 - DNA, 15 bp, Homo sapiens
cccagatagagctgg

SEQ ID NO: 820378 - DNA, 16 bp, Homo sapiens
cccagatcaggaacca

SEQ ID NO: 820379 - DNA, 12 bp, Homo sapiens
cccagatcctca

SEQ ID NO: 820380 - DNA, 20 bp, Homo sapiens
cccagatctgcctgggcctg

SEQ ID NO: 820381 - DNA, 21 bp, Homo sapiens
cccagatctgcctgggcctgt

SEQ ID NO: 820382 - DNA, 23 bp, Homo sapiens
cccagatctgcctgggcctgtgc

SEQ ID NO: 820383 - DNA, 18 bp, Homo sapiens
cccagatctggtcccttg

SEQ ID NO: 820384 - DNA, 23 bp, Homo sapiens
cccagatgccctttggaaagcca

SEQ ID NO: 820385 - DNA, 21 bp, Homo sapiens
cccagatgttttacgtctggg

SEQ ID NO: 820386 - DNA, 13 bp, Homo sapiens
cccagattcccag

SEQ ID NO: 820387 - DNA, 15 bp, Homo sapiens
cccagcaacacaagc

SEQ ID NO: 820388 - DNA, 22 bp, Homo sapiens
cccagcaacacaagctggaagc

SEQ ID NO: 820389 - DNA, 22 bp, Homo sapiens
cccagcaacactccggtcagcc

SEQ ID NO: 820390 - DNA, 19 bp, Homo sapiens
cccagcaaccctcctatca

SEQ ID NO: 820391 - DNA, 21 bp, Homo sapiens
cccagcaaccctcctatcacc

SEQ ID NO: 820392 - DNA, 18 bp, Homo sapiens
cccagcaacgcccctcca

SEQ ID NO: 820393 - DNA, 19 bp, Homo sapiens
cccagcaagacctcatctg

SEQ ID NO: 820394 - DNA, 23 bp, Homo sapiens
cccagcaagacctcatctgtgga

SEQ ID NO: 820395 - DNA, 15 bp, Homo sapiens
cccagcaagcgggag

SEQ ID NO: 820396 - DNA, 15 bp, Homo sapiens
cccagcacagccacc

SEQ ID NO: 820397 - DNA, 20 bp, Homo sapiens
cccagcacagccacctccgc

SEQ ID NO: 820398 - DNA, 16 bp, Homo sapiens
cccagcacatggccat

SEQ ID NO: 820399 - DNA, 17 bp, Homo sapiens
cccagcacctgcctcct

SEQ ID NO: 820400 - DNA, 13 bp, Homo sapiens
cccagcactgtct

SEQ ID NO: 820401 - DNA, 18 bp, Homo sapiens
cccagcactttgggaggc

SEQ ID NO: 820402 - DNA, 22 bp, Homo sapiens
cccagcactttgggaggccaag

SEQ ID NO: 820403 - DNA, 23 bp, Homo sapiens
cccagcactttgggaggccgagg

SEQ ID NO: 820404 - DNA, 12 bp, Homo sapiens
cccagcagagcc

SEQ ID NO: 820405 - DNA, 13 bp, Homo sapiens
cccagcagagccc

SEQ ID NO: 820406 - DNA, 14 bp, Homo sapiens
cccagcagagccca

SEQ ID NO: 820407 - DNA, 13 bp, Homo sapiens
cccagcagaggca

SEQ ID NO: 820408 - DNA, 15 bp, Homo sapiens
cccagcagaggcagg

SEQ ID NO: 820409 - DNA, 13 bp, Homo sapiens
cccagcagcagca

SEQ ID NO: 820410 - DNA, 15 bp, Homo sapiens
cccagcagcccaagc

SEQ ID NO: 820411 - DNA, 22 bp, Homo sapiens
cccagcagccctaaggatctct

SEQ ID NO: 820412 - DNA, 12 bp, Homo sapiens
cccagcagctca

SEQ ID NO: 820413 - DNA, 23 bp, Homo sapiens
cccagcaggcaggcactgtggcc

SEQ ID NO: 820414 - DNA, 18 bp, Homo sapiens
cccagcaggcccagcatg

SEQ ID NO: 820415 - DNA, 16 bp, Homo sapiens
cccagcagtttgggag

SEQ ID NO: 820416 - DNA, 17 bp, Homo sapiens
cccagcatatgggggcc

SEQ ID NO: 820417 - DNA, 18 bp, Homo sapiens
cccagcatccctggagca

SEQ ID NO: 820418 - DNA, 21 bp, Homo sapiens
cccagcatccttttctgcaga

SEQ ID NO: 820419 - DNA, 16 bp, Homo sapiens
cccagcatcgggggcc

SEQ ID NO: 820420 - DNA, 19 bp, Homo sapiens
cccagcatcgggggcctgc

SEQ ID NO: 820421 - DNA, 23 bp, Homo sapiens
cccagcatgcaccacgggcccgg

SEQ ID NO: 820422 - DNA, 18 bp, Homo sapiens
cccagcattccagctctg

SEQ ID NO: 820423 - DNA, 13 bp, Homo sapiens
cccagcatttcca

SEQ ID NO: 820424 - DNA, 17 bp, Homo sapiens
cccagccaccaccctca

SEQ ID NO: 820425 - DNA, 21 bp, Homo sapiens
cccagccaccaccctcaggtg

SEQ ID NO: 820426 - DNA, 14 bp, Homo sapiens
cccagccaccccgg

SEQ ID NO: 820427 - DNA, 18 bp, Homo sapiens
cccagccacgactgccat

SEQ ID NO: 820428 - DNA, 23 bp, Homo sapiens
cccagccactccaagccccctgg

SEQ ID NO: 820429 - DNA, 12 bp, Homo sapiens
cccagccagaaa

SEQ ID NO: 820430 - DNA, 17 bp, Homo sapiens
cccagccagagttcctg

SEQ ID NO: 820431 - DNA, 18 bp, Homo sapiens
cccagccagagttcctgc

SEQ ID NO: 820432 - DNA, 17 bp, Homo sapiens
cccagccagccacccct

SEQ ID NO: 820433 - DNA, 22 bp, Homo sapiens
cccagccagccacccctgccac

SEQ ID NO: 820434 - DNA, 23 bp, Homo sapiens
cccagccagccacccctgccact

SEQ ID NO: 820435 - DNA, 12 bp, Homo sapiens
cccagccagccc

SEQ ID NO: 820436 - DNA, 17 bp, Homo sapiens
cccagccagctgcaggg

SEQ ID NO: 820437 - DNA, 14 bp, Homo sapiens
cccagccaggccaa

SEQ ID NO: 820438 - DNA, 18 bp, Homo sapiens
cccagccaggccaacagc

SEQ ID NO: 820439 - DNA, 18 bp, Homo sapiens
cccagccagggagcttgc

SEQ ID NO: 820440 - DNA, 13 bp, Homo sapiens
cccagccagggtg

SEQ ID NO: 820441 - DNA, 13 bp, Homo sapiens
cccagccatccag

SEQ ID NO: 820442 - DNA, 22 bp, Homo sapiens
cccagccatgccagctggcctt

SEQ ID NO: 820443 - DNA, 14 bp, Homo sapiens
cccagccatggggt

SEQ ID NO: 820444 - DNA, 9 bp, Homo sapiens
cccagccca

SEQ ID NO: 820445 - DNA, 15 bp, Homo sapiens
cccagcccacagagc

SEQ ID NO: 820446 - DNA, 17 bp, Homo sapiens
cccagcccacagagcct

SEQ ID NO: 820447 - DNA, 15 bp, Homo sapiens
cccagcccaccctgc

SEQ ID NO: 820448 - DNA, 20 bp, Homo sapiens
cccagcccaccctgctcctc

SEQ ID NO: 820449 - DNA, 11 bp, Homo sapiens
cccagcccaga

SEQ ID NO: 820450 - DNA, 12 bp, Homo sapiens
cccagcccagag

SEQ ID NO: 820451 - DNA, 22 bp, Homo sapiens
cccagcccattctctctcctgt

SEQ ID NO: 820452 - DNA, 16 bp, Homo sapiens
cccagccccactcctc

SEQ ID NO: 820453 - DNA, 15 bp, Homo sapiens
cccagccccagcccc

SEQ ID NO: 820454 - DNA, 15 bp, Homo sapiens
cccagccccaggcct

SEQ ID NO: 820455 - DNA, 16 bp, Homo sapiens
cccagccccaggcctg

SEQ ID NO: 820456 - DNA, 22 bp, Homo sapiens
cccagcccccagggcccccctc

SEQ ID NO: 820457 - DNA, 22 bp, Homo sapiens
cccagccccgccccgttgtgag

SEQ ID NO: 820458 - DNA, 15 bp, Homo sapiens
cccagcccctactgc

SEQ ID NO: 820459 - DNA, 18 bp, Homo sapiens
cccagcccctactgctgt

SEQ ID NO: 820460 - DNA, 16 bp, Homo sapiens
cccagcccctagaaac

SEQ ID NO: 820461 - DNA, 18 bp, Homo sapiens
cccagccccttctcccag

SEQ ID NO: 820462 - DNA, 22 bp, Homo sapiens
cccagccccttctcccagcaca

SEQ ID NO: 820463 - DNA, 14 bp, Homo sapiens
cccagccctcagtc

SEQ ID NO: 820464 - DNA, 16 bp, Homo sapiens
cccagccctcatcccg

SEQ ID NO: 820465 - DNA, 11 bp, Homo sapiens
cccagccctgg

SEQ ID NO: 820466 - DNA, 12 bp, Homo sapiens
cccagccctggc

SEQ ID NO: 820467 - DNA, 14 bp, Homo sapiens
cccagccctgggaa

SEQ ID NO: 820468 - DNA, 13 bp, Homo sapiens
cccagccctgggc

SEQ ID NO: 820469 - DNA, 15 bp, Homo sapiens
cccagccctgggctt

SEQ ID NO: 820470 - DNA, 21 bp, Homo sapiens
cccagccctgggcttggctct

SEQ ID NO: 820471 - DNA, 20 bp, Homo sapiens
cccagccctgggggattcct

SEQ ID NO: 820472 - DNA, 17 bp, Homo sapiens
cccagccctgtcctggt

SEQ ID NO: 820473 - DNA, 20 bp, Homo sapiens
cccagccctgtcctggttcc

SEQ ID NO: 820474 - DNA, 15 bp, Homo sapiens
cccagcccttccttg

SEQ ID NO: 820475 - DNA, 14 bp, Homo sapiens
cccagcccttctgc

SEQ ID NO: 820476 - DNA, 15 bp, Homo sapiens
cccagcccttctgcc

SEQ ID NO: 820477 - DNA, 16 bp, Homo sapiens
cccagcccttctgcct

SEQ ID NO: 820478 - DNA, 18 bp, Homo sapiens
cccagcccttctgccttt

SEQ ID NO: 820479 - DNA, 21 bp, Homo sapiens
cccagccctttgggaggctga

SEQ ID NO: 820480 - DNA, 13 bp, Homo sapiens
cccagccgcagga

SEQ ID NO: 820481 - DNA, 23 bp, Homo sapiens
cccagccggcctctctggcctcc

SEQ ID NO: 820482 - DNA, 16 bp, Homo sapiens
cccagcctagtcaggg

SEQ ID NO: 820483 - DNA, 12 bp, Homo sapiens
cccagcctatga

SEQ ID NO: 820484 - DNA, 19 bp, Homo sapiens
cccagcctcaatgtcactt

SEQ ID NO: 820485 - DNA, 15 bp, Homo sapiens
cccagcctcagccca

SEQ ID NO: 820486 - DNA, 12 bp, Homo sapiens
cccagcctcatt

SEQ ID NO: 820487 - DNA, 14 bp, Homo sapiens
cccagcctcattgt

SEQ ID NO: 820488 - DNA, 19 bp, Homo sapiens
cccagcctcattgtgccaa

SEQ ID NO: 820489 - DNA, 18 bp, Homo sapiens
cccagcctccagagaagc

SEQ ID NO: 820490 - DNA, 16 bp, Homo sapiens
cccagcctcgttggag

SEQ ID NO: 820491 - DNA, 18 bp, Homo sapiens
cccagcctcgttggagag

SEQ ID NO: 820492 - DNA, 16 bp, Homo sapiens
cccagcctgacctgag

SEQ ID NO: 820493 - DNA, 19 bp, Homo sapiens
cccagcctgacctgagact

SEQ ID NO: 820494 - DNA, 15 bp, Homo sapiens
cccagcctgctgaga

SEQ ID NO: 820495 - DNA, 15 bp, Homo sapiens
cccagcctggccccg

SEQ ID NO: 820496 - DNA, 18 bp, Homo sapiens
cccagcctgggagcccag

SEQ ID NO: 820497 - DNA, 20 bp, Homo sapiens
cccagcctgggagcccagag

SEQ ID NO: 820498 - DNA, 12 bp, Homo sapiens
cccagcctgggc

SEQ ID NO: 820499 - DNA, 18 bp, Homo sapiens
cccagcctgggccatctc

SEQ ID NO: 820500 - DNA, 18 bp, Homo sapiens
cccaggttcccccagcaa

SEQ ID NO: 820501 - DNA, 21 bp, Homo sapiens
cccagtacctagctggctctg

SEQ ID NO: 820502 - DNA, 16 bp, Homo sapiens
cccagtacctccaagc

SEQ ID NO: 820503 - DNA, 18 bp, Homo sapiens
cccagtattactgctgct

SEQ ID NO: 820504 - DNA, 15 bp, Homo sapiens
cccagtcccacactg

SEQ ID NO: 820505 - DNA, 21 bp, Homo sapiens
cccagtcccacactgtggcca

SEQ ID NO: 820506 - DNA, 14 bp, Homo sapiens
cccagtcccaggga

SEQ ID NO: 820507 - DNA, 21 bp, Homo sapiens
cccagtcccagggaaggtggg

SEQ ID NO: 820508 - DNA, 13 bp, Homo sapiens
cccagtccccacc

SEQ ID NO: 820509 - DNA, 14 bp, Homo sapiens
cccagtccccaccc

SEQ ID NO: 820510 - DNA, 20 bp, Homo sapiens
cccagtccccacccctgccc

SEQ ID NO: 820511 - DNA, 12 bp, Homo sapiens
cccagtccctgg

SEQ ID NO: 820512 - DNA, 14 bp, Homo sapiens
cccagtccctgggg

SEQ ID NO: 820513 - DNA, 16 bp, Homo sapiens
cccagtccctggggga

SEQ ID NO: 820514 - DNA, 23 bp, Homo sapiens
cccagtccctgggggaagccctg

SEQ ID NO: 820515 - DNA, 14 bp, Homo sapiens
cccagtcctgggtt

SEQ ID NO: 820516 - DNA, 14 bp, Homo sapiens
cccagtccttccac

SEQ ID NO: 820517 - DNA, 14 bp, Homo sapiens
cccagtctcagaca

SEQ ID NO: 820518 - DNA, 17 bp, Homo sapiens
cccagtctcatctcctg

SEQ ID NO: 820519 - DNA, 13 bp, Homo sapiens
cccagtctccagg

SEQ ID NO: 820520 - DNA, 18 bp, Homo sapiens
cccagtgaactcctgcca

SEQ ID NO: 820521 - DNA, 17 bp, Homo sapiens
cccagtgaagcctctga

SEQ ID NO: 820522 - DNA, 20 bp, Homo sapiens
cccagtgaatccctgggagc

SEQ ID NO: 820523 - DNA, 20 bp, Homo sapiens
cccagtgacaaagactcctc

SEQ ID NO: 820524 - DNA, 15 bp, Homo sapiens
cccagtgacaacatc

SEQ ID NO: 820525 - DNA, 22 bp, Homo sapiens
cccagtgacacttcagagagct

SEQ ID NO: 820526 - DNA, 15 bp, Homo sapiens
cccagtgacagctag

SEQ ID NO: 820527 - DNA, 17 bp, Homo sapiens
cccagtgagactgcccc

SEQ ID NO: 820528 - DNA, 19 bp, Homo sapiens
cccagtgagattacagagg

SEQ ID NO: 820529 - DNA, 16 bp, Homo sapiens
cccagtgcaaaccact

SEQ ID NO: 820530 - DNA, 12 bp, Homo sapiens
cccagtgccact

SEQ ID NO: 820531 - DNA, 15 bp, Homo sapiens
cccagtgccagctcc

SEQ ID NO: 820532 - DNA, 16 bp, Homo sapiens
cccagtgccagctcca

SEQ ID NO: 820533 - DNA, 15 bp, Homo sapiens
cccagtgccgagaag

SEQ ID NO: 820534 - DNA, 17 bp, Homo sapiens
cccagtgccgagaagga

SEQ ID NO: 820535 - DNA, 20 bp, Homo sapiens
cccagtgcctcctagcccct

SEQ ID NO: 820536 - DNA, 14 bp, Homo sapiens
cccagtgctcacca

SEQ ID NO: 820537 - DNA, 16 bp, Homo sapiens
cccagtgctcaccagc

SEQ ID NO: 820538 - DNA, 17 bp, Homo sapiens
cccagtgctgccatgcc

SEQ ID NO: 820539 - DNA, 18 bp, Homo sapiens
cccagtgctgccatgcca

SEQ ID NO: 820540 - DNA, 21 bp, Homo sapiens
cccagtgctgccatgccactg

SEQ ID NO: 820541 - DNA, 14 bp, Homo sapiens
cccagtgcttctcc

SEQ ID NO: 820542 - DNA, 22 bp, Homo sapiens
cccagtgcttctccaacactga

SEQ ID NO: 820543 - DNA, 22 bp, Homo sapiens
cccagtggaacagtcacccttc

SEQ ID NO: 820544 - DNA, 23 bp, Homo sapiens
cccagtggaattccaacttgaag

SEQ ID NO: 820545 - DNA, 12 bp, Homo sapiens
cccagtgggagg

SEQ ID NO: 820546 - DNA, 18 bp, Homo sapiens
cccagtgggctgcacgct

SEQ ID NO: 820547 - DNA, 14 bp, Homo sapiens
cccagtgggctgtg

SEQ ID NO: 820548 - DNA, 15 bp, Homo sapiens
cccagtgggctgtgt

SEQ ID NO: 820549 - DNA, 21 bp, Homo sapiens
cccagtggggacagggagggg

SEQ ID NO: 820550 - DNA, 16 bp, Homo sapiens
cccagtgggtctggga

SEQ ID NO: 820551 - DNA, 17 bp, Homo sapiens
cccagtgggtctgggat

SEQ ID NO: 820552 - DNA, 16 bp, Homo sapiens
cccagtgggtgatgct

SEQ ID NO: 820553 - DNA, 21 bp, Homo sapiens
cccagtgggtgatgcttttgc

SEQ ID NO: 820554 - DNA, 19 bp, Homo sapiens
cccagtgtcccctttcttc

SEQ ID NO: 820555 - DNA, 16 bp, Homo sapiens
cccagtgttgtttgta

SEQ ID NO: 820556 - DNA, 21 bp, Homo sapiens
cccagtgttgtttgtaaataa

SEQ ID NO: 820557 - DNA, 14 bp, Homo sapiens
cccagttaaagatt

SEQ ID NO: 820558 - DNA, 14 bp, Homo sapiens
cccagttagctctc

SEQ ID NO: 820559 - DNA, 18 bp, Homo sapiens
cccagttcctatgacaca

SEQ ID NO: 820560 - DNA, 16 bp, Homo sapiens
cccagttcctgtggct

SEQ ID NO: 820561 - DNA, 21 bp, Homo sapiens
cccagttctacaagcatattt

SEQ ID NO: 820562 - DNA, 13 bp, Homo sapiens
cccagttctgctc

SEQ ID NO: 820563 - DNA, 14 bp, Homo sapiens
cccagttctgctcc

SEQ ID NO: 820564 - DNA, 23 bp, Homo sapiens
cccagttctgctcctctccaggc

SEQ ID NO: 820565 - DNA, 22 bp, Homo sapiens
cccagtttcttcttacacttct

SEQ ID NO: 820566 - DNA, 15 bp, Homo sapiens
cccagtttgcagaaa

SEQ ID NO: 820567 - DNA, 17 bp, Homo sapiens
cccataaaatgatcctg

SEQ ID NO: 820568 - DNA, 18 bp, Homo sapiens
cccataaagtctgagaaa

SEQ ID NO: 820569 - DNA, 19 bp, Homo sapiens
cccataaagtctgagaaat

SEQ ID NO: 820570 - DNA, 23 bp, Homo sapiens
cccataaggggtcaaaatttgct

SEQ ID NO: 820571 - DNA, 21 bp, Homo sapiens
cccataataaccctgccagtg

SEQ ID NO: 820572 - DNA, 20 bp, Homo sapiens
cccatacaatgtatgtacaa

SEQ ID NO: 820573 - DNA, 13 bp, Homo sapiens
cccatacacacac

SEQ ID NO: 820574 - DNA, 19 bp, Homo sapiens
cccatacacacacaaacca

SEQ ID NO: 820575 - DNA, 17 bp, Homo sapiens
cccataccccttattgc

SEQ ID NO: 820576 - DNA, 20 bp, Homo sapiens
cccataccccttattgctgc

SEQ ID NO: 820577 - DNA, 22 bp, Homo sapiens
cccataccccttattgctgcca

SEQ ID NO: 820578 - DNA, 13 bp, Homo sapiens
cccatactcagcc

SEQ ID NO: 820579 - DNA, 15 bp, Homo sapiens
cccatactgagcctg

SEQ ID NO: 820580 - DNA, 18 bp, Homo sapiens
cccatacttttggctcct

SEQ ID NO: 820581 - DNA, 24 bp, Homo sapiens
cccatagcaccctgccctcatggg

SEQ ID NO: 820582 - DNA, 17 bp, Homo sapiens
cccatagctattttcct

SEQ ID NO: 820583 - DNA, 18 bp, Homo sapiens
cccatagctattttcctt

SEQ ID NO: 820584 - DNA, 21 bp, Homo sapiens
cccatagctattttccttgct

SEQ ID NO: 820585 - DNA, 13 bp, Homo sapiens
cccatagggagct

SEQ ID NO: 820586 - DNA, 19 bp, Homo sapiens
cccatagtggggcctggga

SEQ ID NO: 820587 - DNA, 17 bp, Homo sapiens
cccatatcttgccttca

SEQ ID NO: 820588 - DNA, 16 bp, Homo sapiens
cccatattttccccct

SEQ ID NO: 820589 - DNA, 21 bp, Homo sapiens
cccatcacctctactgtctcc

SEQ ID NO: 820590 - DNA, 20 bp, Homo sapiens
cccatcactggagcaccagg

SEQ ID NO: 820591 - DNA, 18 bp, Homo sapiens
cccatcagaacctgagct

SEQ ID NO: 820592 - DNA, 13 bp, Homo sapiens
cccatcagctccc

SEQ ID NO: 820593 - DNA, 12 bp, Homo sapiens
cccatcatccca

SEQ ID NO: 820594 - DNA, 14 bp, Homo sapiens
cccatcatcccagc

SEQ ID NO: 820595 - DNA, 13 bp, Homo sapiens
cccatcatccttt

SEQ ID NO: 820596 - DNA, 16 bp, Homo sapiens
cccatccagccagacc

SEQ ID NO: 820597 - DNA, 13 bp, Homo sapiens
cccatccaggcag

SEQ ID NO: 820598 - DNA, 14 bp, Homo sapiens
cccatccaggcagt

SEQ ID NO: 820599 - DNA, 18 bp, Homo sapiens
cccatccagtggactctg

SEQ ID NO: 820600 - DNA, 15 bp, Homo sapiens
cccatccattaggcc

SEQ ID NO: 820601 - DNA, 15 bp, Homo sapiens
cccatcccaccagcc

SEQ ID NO: 820602 - DNA, 12 bp, Homo sapiens
cccatcccaggg

SEQ ID NO: 820603 - DNA, 15 bp, Homo sapiens
cccatccccaccagc

SEQ ID NO: 820604 - DNA, 16 bp, Homo sapiens
cccatccccaccagct

SEQ ID NO: 820605 - DNA, 15 bp, Homo sapiens
cccatccccctgccc

SEQ ID NO: 820606 - DNA, 16 bp, Homo sapiens
cccatccccctgccct

SEQ ID NO: 820607 - DNA, 21 bp, Homo sapiens
cccatcccctggactgggagg

SEQ ID NO: 820608 - DNA, 14 bp, Homo sapiens
cccatcccctttcc

SEQ ID NO: 820609 - DNA, 23 bp, Homo sapiens
cccatcccctttcctccccacct

SEQ ID NO: 820610 - DNA, 22 bp, Homo sapiens
cccatcccgcttagcgctctgg

SEQ ID NO: 820611 - DNA, 15 bp, Homo sapiens
cccatccctccccag

SEQ ID NO: 820612 - DNA, 17 bp, Homo sapiens
cccatcctaccaatgca

SEQ ID NO: 820613 - DNA, 18 bp, Homo sapiens
cccatcctcatccctgac

SEQ ID NO: 820614 - DNA, 15 bp, Homo sapiens
cccatcctccagctt

SEQ ID NO: 820615 - DNA, 16 bp, Homo sapiens
cccatcctccagcttc

SEQ ID NO: 820616 - DNA, 17 bp, Homo sapiens
cccatcctccagcttct

SEQ ID NO: 820617 - DNA, 22 bp, Homo sapiens
cccatcctccccttccctgcaa

SEQ ID NO: 820618 - DNA, 15 bp, Homo sapiens
cccatcctgaccagc

SEQ ID NO: 820619 - DNA, 16 bp, Homo sapiens
cccatcctggggcagc

SEQ ID NO: 820620 - DNA, 13 bp, Homo sapiens
cccatcgccccac

SEQ ID NO: 820621 - DNA, 19 bp, Homo sapiens
cccatcggccctgtcccct

SEQ ID NO: 820622 - DNA, 13 bp, Homo sapiens
ccccaaaatccaa

SEQ ID NO: 820623 - DNA, 17 bp, Homo sapiens
ccccaaaatccaaaact

SEQ ID NO: 820624 - DNA, 22 bp, Homo sapiens
ccccaaaatccaaaacttctct

SEQ ID NO: 820625 - DNA, 15 bp, Homo sapiens
ccccaaacacaaaac

SEQ ID NO: 820626 - DNA, 22 bp, Homo sapiens
ccccaaacaccttccagctcct

SEQ ID NO: 820627 - DNA, 15 bp, Homo sapiens
ccccaaacaggacag

SEQ ID NO: 820628 - DNA, 15 bp, Homo sapiens
ccccaaacatagccc

SEQ ID NO: 820629 - DNA, 17 bp, Homo sapiens
ccccaaacatagcccct

SEQ ID NO: 820630 - DNA, 15 bp, Homo sapiens
ccccaaaccccagcc

SEQ ID NO: 820631 - DNA, 15 bp, Homo sapiens
ccccaaagagcctgg

SEQ ID NO: 820632 - DNA, 23 bp, Homo sapiens
ccccaaagcagcaggcctctggt

SEQ ID NO: 820633 - DNA, 16 bp, Homo sapiens
ccccaaagtgctggga

SEQ ID NO: 820634 - DNA, 17 bp, Homo sapiens
ccccaacactgtgccct

SEQ ID NO: 820635 - DNA, 18 bp, Homo sapiens
ccccaacactgtgccctg

SEQ ID NO: 820636 - DNA, 20 bp, Homo sapiens
ccccaacactgtgccctggt

SEQ ID NO: 820637 - DNA, 22 bp, Homo sapiens
ccccaacactgtgccctggtgg

SEQ ID NO: 820638 - DNA, 19 bp, Homo sapiens
ccccaacatctccctccca

SEQ ID NO: 820639 - DNA, 21 bp, Homo sapiens
ccccaacccacctctcttccc

SEQ ID NO: 820640 - DNA, 15 bp, Homo sapiens
ccccaacccccagag

SEQ ID NO: 820641 - DNA, 12 bp, Homo sapiens
ccccaaccccgt

SEQ ID NO: 820642 - DNA, 13 bp, Homo sapiens
ccccaaccctgcc

SEQ ID NO: 820643 - DNA, 17 bp, Homo sapiens
ccccaaccctgcccctg

SEQ ID NO: 820644 - DNA, 23 bp, Homo sapiens
ccccaaccctgcccctgccccgt

SEQ ID NO: 820645 - DNA, 13 bp, Homo sapiens
ccccaacctcagg

SEQ ID NO: 820646 - DNA, 20 bp, Homo sapiens
ccccaacctcagggctccca

SEQ ID NO: 820647 - DNA, 19 bp, Homo sapiens
ccccaacctttccctcacc

SEQ ID NO: 820648 - DNA, 23 bp, Homo sapiens
ccccaactccaggggcacctatg

SEQ ID NO: 820649 - DNA, 15 bp, Homo sapiens
ccccaactcctggaa

SEQ ID NO: 820650 - DNA, 18 bp, Homo sapiens
ccccaactctccccagtg

SEQ ID NO: 820651 - DNA, 20 bp, Homo sapiens
ccccaactctccccagtgcc

SEQ ID NO: 820652 - DNA, 16 bp, Homo sapiens
ccccaactctgagccc

SEQ ID NO: 820653 - DNA, 16 bp, Homo sapiens
ccccaagaaagcctca

SEQ ID NO: 820654 - DNA, 14 bp, Homo sapiens
ccccaagacacttc

SEQ ID NO: 820655 - DNA, 19 bp, Homo sapiens
ccccaagaccccctggggt

SEQ ID NO: 820656 - DNA, 21 bp, Homo sapiens
ccccaagaggggcgggctcag

SEQ ID NO: 820657 - DNA, 21 bp, Homo sapiens
ccccaagatgagctgcagccc

SEQ ID NO: 820658 - DNA, 14 bp, Homo sapiens
ccccaagcagccag

SEQ ID NO: 820659 - DNA, 16 bp, Homo sapiens
ccccaagcagccagcc

SEQ ID NO: 820660 - DNA, 14 bp, Homo sapiens
ccccaagctgtttt

SEQ ID NO: 820661 - DNA, 13 bp, Homo sapiens
ccccaagcttctg

SEQ ID NO: 820662 - DNA, 13 bp, Homo sapiens
ccccaaggctgcg

SEQ ID NO: 820663 - DNA, 20 bp, Homo sapiens
ccccaagggccaaacccact

SEQ ID NO: 820664 - DNA, 16 bp, Homo sapiens
ccccaaggttccagag

SEQ ID NO: 820665 - DNA, 20 bp, Homo sapiens
ccccaaggttttggagtcag

SEQ ID NO: 820666 - DNA, 13 bp, Homo sapiens
ccccaagtcctca

SEQ ID NO: 820667 - DNA, 19 bp, Homo sapiens
ccccaataaaggcagctgc

SEQ ID NO: 820668 - DNA, 20 bp, Homo sapiens
ccccaataaaggcagctgcc

SEQ ID NO: 820669 - DNA, 21 bp, Homo sapiens
ccccaataaaggcagctgcct

SEQ ID NO: 820670 - DNA, 22 bp, Homo sapiens
ccccaataaaggcagctgcctc

SEQ ID NO: 820671 - DNA, 16 bp, Homo sapiens
ccccaatccctgccac

SEQ ID NO: 820672 - DNA, 20 bp, Homo sapiens
ccccaatccctgccactggg

SEQ ID NO: 820673 - DNA, 21 bp, Homo sapiens
ccccaatccctgccactgggc

SEQ ID NO: 820674 - DNA, 22 bp, Homo sapiens
ccccaatccctgccactgggct

SEQ ID NO: 820675 - DNA, 23 bp, Homo sapiens
ccccaatccctgccactgggctc

SEQ ID NO: 820676 - DNA, 20 bp, Homo sapiens
ccccaatcggactgccaaat

SEQ ID NO: 820677 - DNA, 21 bp, Homo sapiens
ccccaatgtatgtgtggctgt

SEQ ID NO: 820678 - DNA, 22 bp, Homo sapiens
ccccaattactattccctttga

SEQ ID NO: 820679 - DNA, 15 bp, Homo sapiens
ccccacaatgccaga

SEQ ID NO: 820680 - DNA, 19 bp, Homo sapiens
ccccacacacaggccttct

SEQ ID NO: 820681 - DNA, 15 bp, Homo sapiens
ccccacacccagggc

SEQ ID NO: 820682 - DNA, 16 bp, Homo sapiens
ccccacacccagggct

SEQ ID NO: 820683 - DNA, 17 bp, Homo sapiens
ccccacaccccagccca

SEQ ID NO: 820684 - DNA, 18 bp, Homo sapiens
ccccacaccccagcccac

SEQ ID NO: 820685 - DNA, 19 bp, Homo sapiens
ccccacaccccagcccacc

SEQ ID NO: 820686 - DNA, 12 bp, Homo sapiens
ccccacactcca

SEQ ID NO: 820687 - DNA, 14 bp, Homo sapiens
ccccacactccact

SEQ ID NO: 820688 - DNA, 23 bp, Homo sapiens
ccccacacttgttccagctcttt

SEQ ID NO: 820689 - DNA, 21 bp, Homo sapiens
ccccacagactgccccagcca

SEQ ID NO: 820690 - DNA, 15 bp, Homo sapiens
ccccacagttttaat

SEQ ID NO: 820691 - DNA, 22 bp, Homo sapiens
ccccaccacgtctggctccctg

SEQ ID NO: 820692 - DNA, 20 bp, Homo sapiens
ccccaccatgcagcccctgg

SEQ ID NO: 820693 - DNA, 22 bp, Homo sapiens
ccccaccatgcagcccctgggc

SEQ ID NO: 820694 - DNA, 18 bp, Homo sapiens
ccccacccacccccaggc

SEQ ID NO: 820695 - DNA, 21 bp, Homo sapiens
ccccacccaccctctggtcct

SEQ ID NO: 820696 - DNA, 12 bp, Homo sapiens
ccccacccacct

SEQ ID NO: 820697 - DNA, 13 bp, Homo sapiens
ccccacccacctc

SEQ ID NO: 820698 - DNA, 15 bp, Homo sapiens
ccccacccacctcct

SEQ ID NO: 820699 - DNA, 16 bp, Homo sapiens
ccccacccatggggag

SEQ ID NO: 820700 - DNA, 17 bp, Homo sapiens
ccccaccccaccccacc

SEQ ID NO: 820701 - DNA, 13 bp, Homo sapiens
ccccaccccagcc

SEQ ID NO: 820702 - DNA, 18 bp, Homo sapiens
ccccaccccagtgggaac

SEQ ID NO: 820703 - DNA, 14 bp, Homo sapiens
ccccaccccatcca

SEQ ID NO: 820704 - DNA, 14 bp, Homo sapiens
ccccacccccaagg

SEQ ID NO: 820705 - DNA, 13 bp, Homo sapiens
ccccacccccagc

SEQ ID NO: 820706 - DNA, 15 bp, Homo sapiens
ccccacccccagcca

SEQ ID NO: 820707 - DNA, 14 bp, Homo sapiens
ccccacccccagtg

SEQ ID NO: 820708 - DNA, 17 bp, Homo sapiens
ccccaccccctccccag

SEQ ID NO: 820709 - DNA, 15 bp, Homo sapiens
ccccaccccctgggc

SEQ ID NO: 820710 - DNA, 13 bp, Homo sapiens
ccccacccctacc

SEQ ID NO: 820711 - DNA, 23 bp, Homo sapiens
ccccacccctgcccccagccccg

SEQ ID NO: 820712 - DNA, 12 bp, Homo sapiens
ccccacccctgg

SEQ ID NO: 820713 - DNA, 20 bp, Homo sapiens
ccccacccctgggggctctc

SEQ ID NO: 820714 - DNA, 13 bp, Homo sapiens
ccccaccccttcg

SEQ ID NO: 820715 - DNA, 13 bp, Homo sapiens
ccccaccctcagc

SEQ ID NO: 820716 - DNA, 15 bp, Homo sapiens
ccccaccctcctctt

SEQ ID NO: 820717 - DNA, 14 bp, Homo sapiens
ccccaccctgggcc

SEQ ID NO: 820718 - DNA, 23 bp, Homo sapiens
ccccaccgaggttcccagggctg

SEQ ID NO: 820719 - DNA, 13 bp, Homo sapiens
ccccaccgctcag

SEQ ID NO: 820720 - DNA, 15 bp, Homo sapiens
ccccaccgctcagtg

SEQ ID NO: 820721 - DNA, 21 bp, Homo sapiens
ccccaccgggctgcaggtgct

SEQ ID NO: 820722 - DNA, 19 bp, Homo sapiens
ccccaccggtccagctggc

SEQ ID NO: 820723 - DNA, 17 bp, Homo sapiens
ccccacctccctgcgcc

SEQ ID NO: 820724 - DNA, 12 bp, Homo sapiens
ccccacctctcc

SEQ ID NO: 820725 - DNA, 12 bp, Homo sapiens
ccccacctgcca

SEQ ID NO: 820726 - DNA, 14 bp, Homo sapiens
ccccacctggacac

SEQ ID NO: 820727 - DNA, 19 bp, Homo sapiens
ccccacctggacacacact

SEQ ID NO: 820728 - DNA, 11 bp, Homo sapiens
ccccacctgta

SEQ ID NO: 820729 - DNA, 19 bp, Homo sapiens
ccccaccttggtccctctc

SEQ ID NO: 820730 - DNA, 22 bp, Homo sapiens
ccccaccttggtccctctcaga

SEQ ID NO: 820731 - DNA, 14 bp, Homo sapiens
ccccacctttggga

SEQ ID NO: 820732 - DNA, 18 bp, Homo sapiens
ccccacgacccctgcctc

SEQ ID NO: 820733 - DNA, 22 bp, Homo sapiens
ccccacgacccctgcctcgagg

SEQ ID NO: 820734 - DNA, 23 bp, Homo sapiens
ccccacgacccctgcctcgaggg

SEQ ID NO: 820735 - DNA, 17 bp, Homo sapiens
ccccacgaggggaccca

SEQ ID NO: 820736 - DNA, 19 bp, Homo sapiens
ccccacgagtcacctgcaa

SEQ ID NO: 820737 - DNA, 22 bp, Homo sapiens
ccccacgagtcacctgcaagcc

SEQ ID NO: 820738 - DNA, 23 bp, Homo sapiens
ccccacgagtcacctgcaagccc

SEQ ID NO: 820739 - DNA, 19 bp, Homo sapiens
ccccacgcccacccccagt

SEQ ID NO: 820740 - DNA, 19 bp, Homo sapiens
ccccacggagacagaggaa

SEQ ID NO: 820741 - DNA, 21 bp, Homo sapiens
ccccactactgcagcacctcc

SEQ ID NO: 820742 - DNA, 18 bp, Homo sapiens
ccccactcaccagtgtcc

SEQ ID NO: 820743 - DNA, 15 bp, Homo sapiens
ccccactcaccccct

SEQ ID NO: 820744 - DNA, 13 bp, Homo sapiens
cccccaatccatg

SEQ ID NO: 820745 - DNA, 19 bp, Homo sapiens
cccccaatcggactgccaa

SEQ ID NO: 820746 - DNA, 17 bp, Homo sapiens
cccccacacttccctgg

SEQ ID NO: 820747 - DNA, 15 bp, Homo sapiens
cccccaccactcagg

SEQ ID NO: 820748 - DNA, 21 bp, Homo sapiens
cccccaccactcaggccacag

SEQ ID NO: 820749 - DNA, 14 bp, Homo sapiens
cccccaccagcagc

SEQ ID NO: 820750 - DNA, 14 bp, Homo sapiens
cccccaccagtgta

SEQ ID NO: 820751 - DNA, 13 bp, Homo sapiens
cccccacccaccc

SEQ ID NO: 820752 - DNA, 17 bp, Homo sapiens
cccccacccccagctca

SEQ ID NO: 820753 - DNA, 12 bp, Homo sapiens
cccccaccccct

SEQ ID NO: 820754 - DNA, 13 bp, Homo sapiens
cccccaccgggct

SEQ ID NO: 820755 - DNA, 19 bp, Homo sapiens
cccccactctctcacccac

SEQ ID NO: 820756 - DNA, 18 bp, Homo sapiens
cccccacttcccacttgc

SEQ ID NO: 820757 - DNA, 15 bp, Homo sapiens
cccccagaccccgcc

SEQ ID NO: 820758 - DNA, 18 bp, Homo sapiens
cccccagagagagctctg

SEQ ID NO: 820759 - DNA, 13 bp, Homo sapiens
cccccagagccag

SEQ ID NO: 820760 - DNA, 16 bp, Homo sapiens
cccccagagccagggc

SEQ ID NO: 820761 - DNA, 17 bp, Homo sapiens
cccccagagccagggct

SEQ ID NO: 820762 - DNA, 18 bp, Homo sapiens
cccccagagccagggctg

SEQ ID NO: 820763 - DNA, 20 bp, Homo sapiens
cccccagcaacgcccctcca

SEQ ID NO: 820764 - DNA, 23 bp, Homo sapiens
cccccagcactaaggccgtgtct

SEQ ID NO: 820765 - DNA, 19 bp, Homo sapiens
cccccagcccacagagcct

SEQ ID NO: 820766 - DNA, 13 bp, Homo sapiens
cccccagccccgg

SEQ ID NO: 820767 - DNA, 15 bp, Homo sapiens
cccccagcctatgag

SEQ ID NO: 820768 - DNA, 14 bp, Homo sapiens
cccccagcctcagc

SEQ ID NO: 820769 - DNA, 14 bp, Homo sapiens
cccccagcctccag

SEQ ID NO: 820770 - DNA, 13 bp, Homo sapiens
cccccagcctggc

SEQ ID NO: 820771 - DNA, 18 bp, Homo sapiens
cccccagcctggccagac

SEQ ID NO: 820772 - DNA, 18 bp, Homo sapiens
cccccagccttgtttctg

SEQ ID NO: 820773 - DNA, 12 bp, Homo sapiens
cccccagctggc

SEQ ID NO: 820774 - DNA, 23 bp, Homo sapiens
cccccagctttgctaccaaagca

SEQ ID NO: 820775 - DNA, 12 bp, Homo sapiens
cccccaggcagc

SEQ ID NO: 820776 - DNA, 13 bp, Homo sapiens
cccccaggcagcc

SEQ ID NO: 820777 - DNA, 19 bp, Homo sapiens
cccccaggcagccaccagt

SEQ ID NO: 820778 - DNA, 20 bp, Homo sapiens
cccccaggccctcccaccac

SEQ ID NO: 820779 - DNA, 11 bp, Homo sapiens
cccccaggcct

SEQ ID NO: 820780 - DNA, 15 bp, Homo sapiens
cccccaggcctccta

SEQ ID NO: 820781 - DNA, 16 bp, Homo sapiens
cccccaggctgctgga

SEQ ID NO: 820782 - DNA, 20 bp, Homo sapiens
cccccaggctggagtgcagt

SEQ ID NO: 820783 - DNA, 15 bp, Homo sapiens
cccccagggcctcca

SEQ ID NO: 820784 - DNA, 16 bp, Homo sapiens
cccccagggcctccag

SEQ ID NO: 820785 - DNA, 18 bp, Homo sapiens
cccccagggcctccaggg

SEQ ID NO: 820786 - DNA, 20 bp, Homo sapiens
cccccagggcctccagggcc

SEQ ID NO: 820787 - DNA, 14 bp, Homo sapiens
cccccagtcctcac

SEQ ID NO: 820788 - DNA, 16 bp, Homo sapiens
cccccagtcctcactg

SEQ ID NO: 820789 - DNA, 21 bp, Homo sapiens
cccccagtcctcactgtcctg

SEQ ID NO: 820790 - DNA, 15 bp, Homo sapiens
cccccagtctccagg

SEQ ID NO: 820791 - DNA, 15 bp, Homo sapiens
cccccagtggggaca

SEQ ID NO: 820792 - DNA, 11 bp, Homo sapiens
cccccagtgtg

SEQ ID NO: 820793 - DNA, 16 bp, Homo sapiens
cccccatcacctctac

SEQ ID NO: 820794 - DNA, 15 bp, Homo sapiens
cccccatcatgtggc

SEQ ID NO: 820795 - DNA, 18 bp, Homo sapiens
cccccatccagccacgga

SEQ ID NO: 820796 - DNA, 11 bp, Homo sapiens
cccccatcccc

SEQ ID NO: 820797 - DNA, 18 bp, Homo sapiens
cccccatctccccaggcc

SEQ ID NO: 820798 - DNA, 18 bp, Homo sapiens
cccccatctgtcttcagc

SEQ ID NO: 820799 - DNA, 20 bp, Homo sapiens
cccccatgctgccttcaggg

SEQ ID NO: 820800 - DNA, 18 bp, Homo sapiens
cccccatgggctgtgtcc

SEQ ID NO: 820801 - DNA, 23 bp, Homo sapiens
cccccatggggtccttggagtga

SEQ ID NO: 820802 - DNA, 17 bp, Homo sapiens
cccccattagaatgtga

SEQ ID NO: 820803 - DNA, 18 bp, Homo sapiens
cccccattctcccagtct

SEQ ID NO: 820804 - DNA, 20 bp, Homo sapiens
cccccattctcccagtctct

SEQ ID NO: 820805 - DNA, 22 bp, Homo sapiens
cccccattctcccagtctctgt

SEQ ID NO: 820806 - DNA, 15 bp, Homo sapiens
cccccatttcccgca

SEQ ID NO: 820807 - DNA, 12 bp, Homo sapiens
ccccccacccct

SEQ ID NO: 820808 - DNA, 13 bp, Homo sapiens
ccccccacccctg

SEQ ID NO: 820809 - DNA, 11 bp, Homo sapiens
ccccccactcc

SEQ ID NO: 820810 - DNA, 12 bp, Homo sapiens
ccccccactctc

SEQ ID NO: 820811 - DNA, 12 bp, Homo sapiens
ccccccagcact

SEQ ID NO: 820812 - DNA, 12 bp, Homo sapiens
ccccccagcctc

SEQ ID NO: 820813 - DNA, 12 bp, Homo sapiens
ccccccagctcc

SEQ ID NO: 820814 - DNA, 16 bp, Homo sapiens
ccccccagctccctgc

SEQ ID NO: 820815 - DNA, 13 bp, Homo sapiens
ccccccaggccct

SEQ ID NO: 820816 - DNA, 14 bp, Homo sapiens
ccccccagggtcct

SEQ ID NO: 820817 - DNA, 12 bp, Homo sapiens
ccccccccaggc

SEQ ID NO: 820818 - DNA, 11 bp, Homo sapiens
cccccccctta

SEQ ID NO: 820819 - DNA, 12 bp, Homo sapiens
cccccctcctcc

SEQ ID NO: 820820 - DNA, 13 bp, Homo sapiens
cccccctcctgct

SEQ ID NO: 820821 - DNA, 21 bp, Homo sapiens
cccccctctcctcccagctgc

SEQ ID NO: 820822 - DNA, 12 bp, Homo sapiens
cccccctctgtc

SEQ ID NO: 820823 - DNA, 12 bp, Homo sapiens
cccccctgctca

SEQ ID NO: 820824 - DNA, 13 bp, Homo sapiens
cccccctgctgcc

SEQ ID NO: 820825 - DNA, 13 bp, Homo sapiens
ccccccttccact

SEQ ID NO: 820826 - DNA, 11 bp, Homo sapiens
ccccccttgaa

SEQ ID NO: 820827 - DNA, 13 bp, Homo sapiens
cccccgacactgc

SEQ ID NO: 820828 - DNA, 23 bp, Homo sapiens
cccccgacactgctgcaccagag

SEQ ID NO: 820829 - DNA, 20 bp, Homo sapiens
cccccgaccaggttggggag

SEQ ID NO: 820830 - DNA, 16 bp, Homo sapiens
cccccgacggcctcca

SEQ ID NO: 820831 - DNA, 15 bp, Homo sapiens
cccccgactgcctgt

SEQ ID NO: 820832 - DNA, 15 bp, Homo sapiens
cccccgagctggggg

SEQ ID NO: 820833 - DNA, 16 bp, Homo sapiens
cccccgcacagccacc

SEQ ID NO: 820834 - DNA, 11 bp, Homo sapiens
cccccgcccca

SEQ ID NO: 820835 - DNA, 12 bp, Homo sapiens
cccccgccccca

SEQ ID NO: 820836 - DNA, 18 bp, Homo sapiens
cccccgcccctcgcccgc

SEQ ID NO: 820837 - DNA, 21 bp, Homo sapiens
cccccgcgcgcgtccccctgc

SEQ ID NO: 820838 - DNA, 20 bp, Homo sapiens
cccccgcgctcgcccagcag

SEQ ID NO: 820839 - DNA, 16 bp, Homo sapiens
cccccgcgggttctag

SEQ ID NO: 820840 - DNA, 17 bp, Homo sapiens
cccccgcgggttctaga

SEQ ID NO: 820841 - DNA, 18 bp, Homo sapiens
cccccgcgggttctagac

SEQ ID NO: 820842 - DNA, 19 bp, Homo sapiens
cccccggctttcctccgga

SEQ ID NO: 820843 - DNA, 20 bp, Homo sapiens
cccccggctttcctccggag

SEQ ID NO: 820844 - DNA, 17 bp, Homo sapiens
cccccgggatcctgccc

SEQ ID NO: 820845 - DNA, 20 bp, Homo sapiens
cccccgggatcctgccccca

SEQ ID NO: 820846 - DNA, 15 bp, Homo sapiens
cccccgggcctgcac

SEQ ID NO: 820847 - DNA, 16 bp, Homo sapiens
cccccgggcctgcaca

SEQ ID NO: 820848 - DNA, 22 bp, Homo sapiens
ccccctaacctctaaccctcat

SEQ ID NO: 820849 - DNA, 15 bp, Homo sapiens
ccccctacccaccga

SEQ ID NO: 820850 - DNA, 17 bp, Homo sapiens
ccccctatcttgtcctg

SEQ ID NO: 820851 - DNA, 19 bp, Homo sapiens
ccccctcaaacctcctctt

SEQ ID NO: 820852 - DNA, 12 bp, Homo sapiens
ccccctcatccc

SEQ ID NO: 820853 - DNA, 11 bp, Homo sapiens
ccccctcattc

SEQ ID NO: 820854 - DNA, 14 bp, Homo sapiens
ccccctccagctca

SEQ ID NO: 820855 - DNA, 16 bp, Homo sapiens
ccccctcccaccctgc

SEQ ID NO: 820856 - DNA, 13 bp, Homo sapiens
ccccctcccaggg

SEQ ID NO: 820857 - DNA, 12 bp, Homo sapiens
ccccctccctgc

SEQ ID NO: 820858 - DNA, 20 bp, Homo sapiens
ccccctccctgtcccagggc

SEQ ID NO: 820859 - DNA, 13 bp, Homo sapiens
ccccctcccttca

SEQ ID NO: 820860 - DNA, 16 bp, Homo sapiens
ccccctcctagggggt

SEQ ID NO: 820861 - DNA, 17 bp, Homo sapiens
ccccctcctgctcctcc

SEQ ID NO: 820862 - DNA, 18 bp, Homo sapiens
ccccctcctgctcctccc

SEQ ID NO: 820863 - DNA, 13 bp, Homo sapiens
ccccctcggagcc

SEQ ID NO: 820864 - DNA, 17 bp, Homo sapiens
ccccctctcctcccagc

SEQ ID NO: 820865 - DNA, 11 bp, Homo sapiens
ccccctctgct

SEQ ID NO: 820866 - DNA, 12 bp, Homo sapiens
ccccctctgctt

SEQ ID NO: 820867 - DNA, 12 bp, Homo sapiens
ccccctctgtct

SEQ ID NO: 820868 - DNA, 16 bp, Homo sapiens
ccccctctgtcttgtg

SEQ ID NO: 820869 - DNA, 14 bp, Homo sapiens
ccccgtttctggtg

SEQ ID NO: 820870 - DNA, 17 bp, Homo sapiens
cccctaaacccctgtcc

SEQ ID NO: 820871 - DNA, 17 bp, Homo sapiens
cccctaacccccagtcc

SEQ ID NO: 820872 - DNA, 18 bp, Homo sapiens
cccctaacctctaaccct

SEQ ID NO: 820873 - DNA, 23 bp, Homo sapiens
cccctaacctctaaccctcattg

SEQ ID NO: 820874 - DNA, 14 bp, Homo sapiens
cccctaagccccgt

SEQ ID NO: 820875 - DNA, 16 bp, Homo sapiens
cccctacccaccgatg

SEQ ID NO: 820876 - DNA, 13 bp, Homo sapiens
cccctaccccaca

SEQ ID NO: 820877 - DNA, 17 bp, Homo sapiens
cccctagaaacccaagc

SEQ ID NO: 820878 - DNA, 13 bp, Homo sapiens
cccctagacctcc

SEQ ID NO: 820879 - DNA, 23 bp, Homo sapiens
cccctagctttatatatggacat

SEQ ID NO: 820880 - DNA, 18 bp, Homo sapiens
cccctaggatgctgcagc

SEQ ID NO: 820881 - DNA, 20 bp, Homo sapiens
cccctagtgctattctgtgt

SEQ ID NO: 820882 - DNA, 14 bp, Homo sapiens
cccctatccaccca

SEQ ID NO: 820883 - DNA, 20 bp, Homo sapiens
cccctcaacaccctgcttct

SEQ ID NO: 820884 - DNA, 21 bp, Homo sapiens
cccctcaacaccctgcttctc

SEQ ID NO: 820885 - DNA, 20 bp, Homo sapiens
cccctcaaggggcagggagg

SEQ ID NO: 820886 - DNA, 16 bp, Homo sapiens
cccctcacatcctcct

SEQ ID NO: 820887 - DNA, 18 bp, Homo sapiens
cccctcacatcctcctgc

SEQ ID NO: 820888 - DNA, 15 bp, Homo sapiens
cccctcacatcctct

SEQ ID NO: 820889 - DNA, 12 bp, Homo sapiens
cccctcaccctc

SEQ ID NO: 820890 - DNA, 13 bp, Homo sapiens
cccctcaccctct

SEQ ID NO: 820891 - DNA, 13 bp, Homo sapiens
cccctcaccctgc

SEQ ID NO: 820892 - DNA, 16 bp, Homo sapiens
cccctcaccctgcctt

SEQ ID NO: 820893 - DNA, 15 bp, Homo sapiens
cccctcacctgggca

SEQ ID NO: 820894 - DNA, 17 bp, Homo sapiens
cccctcacctgggcctt

SEQ ID NO: 820895 - DNA, 15 bp, Homo sapiens
cccctcaccttgcaa

SEQ ID NO: 820896 - DNA, 15 bp, Homo sapiens
cccctcactccccag

SEQ ID NO: 820897 - DNA, 14 bp, Homo sapiens
cccctcactctggc

SEQ ID NO: 820898 - DNA, 20 bp, Homo sapiens
cccctcagatgatctctcca

SEQ ID NO: 820899 - DNA, 11 bp, Homo sapiens
cccctcagcct

SEQ ID NO: 820900 - DNA, 19 bp, Homo sapiens
cccctcagcgcaggctgca

SEQ ID NO: 820901 - DNA, 13 bp, Homo sapiens
cccctccaaacct

SEQ ID NO: 820902 - DNA, 23 bp, Homo sapiens
cccctccaatcccaccaaccctc

SEQ ID NO: 820903 - DNA, 20 bp, Homo sapiens
cccctccacagctgcagctg

SEQ ID NO: 820904 - DNA, 23 bp, Homo sapiens
cccctccacggtccgcggcctgc

SEQ ID NO: 820905 - DNA, 12 bp, Homo sapiens
cccctccactgg

SEQ ID NO: 820906 - DNA, 15 bp, Homo sapiens
cccctccagaccctg

SEQ ID NO: 820907 - DNA, 16 bp, Homo sapiens
cccctccagaccctgc

SEQ ID NO: 820908 - DNA, 17 bp, Homo sapiens
cccctccagaccctgcc

SEQ ID NO: 820909 - DNA, 13 bp, Homo sapiens
cccctccagctca

SEQ ID NO: 820910 - DNA, 22 bp, Homo sapiens
cccctccagctcatgacactgt

SEQ ID NO: 820911 - DNA, 13 bp, Homo sapiens
cccctccaggaga

SEQ ID NO: 820912 - DNA, 15 bp, Homo sapiens
cccctccatccaccc

SEQ ID NO: 820913 - DNA, 12 bp, Homo sapiens
cccctccatccc

SEQ ID NO: 820914 - DNA, 12 bp, Homo sapiens
cccctcccaccc

SEQ ID NO: 820915 - DNA, 14 bp, Homo sapiens
cccctcccagacag

SEQ ID NO: 820916 - DNA, 15 bp, Homo sapiens
cccctcccagacagg

SEQ ID NO: 820917 - DNA, 11 bp, Homo sapiens
cccctcccagc

SEQ ID NO: 820918 - DNA, 14 bp, Homo sapiens
cccctcccagggcc

SEQ ID NO: 820919 - DNA, 13 bp, Homo sapiens
cccctcccatctg

SEQ ID NO: 820920 - DNA, 18 bp, Homo sapiens
cccctccccaaaagaaac

SEQ ID NO: 820921 - DNA, 15 bp, Homo sapiens
cccctccccagccag

SEQ ID NO: 820922 - DNA, 15 bp, Homo sapiens
cccctccccagggga

SEQ ID NO: 820923 - DNA, 14 bp, Homo sapiens
cccctcccccactc

SEQ ID NO: 820924 - DNA, 16 bp, Homo sapiens
cccctcccccagctgc

SEQ ID NO: 820925 - DNA, 18 bp, Homo sapiens
cccctcccccatgggctg

SEQ ID NO: 820926 - DNA, 14 bp, Homo sapiens
cccctccccccaga

SEQ ID NO: 820927 - DNA, 21 bp, Homo sapiens
cccctccccggccctaccagc

SEQ ID NO: 820928 - DNA, 14 bp, Homo sapiens
cccctccccgtccc

SEQ ID NO: 820929 - DNA, 12 bp, Homo sapiens
cccctcccctca

SEQ ID NO: 820930 - DNA, 14 bp, Homo sapiens
cccctcccctcaga

SEQ ID NO: 820931 - DNA, 16 bp, Homo sapiens
cccctcccctcagagc

SEQ ID NO: 820932 - DNA, 17 bp, Homo sapiens
cccctcccctcagcctg

SEQ ID NO: 820933 - DNA, 13 bp, Homo sapiens
cccctcccctgaa

SEQ ID NO: 820934 - DNA, 19 bp, Homo sapiens
cccctcccgacagcccatc

SEQ ID NO: 820935 - DNA, 17 bp, Homo sapiens
cccctccctcagggagc

SEQ ID NO: 820936 - DNA, 15 bp, Homo sapiens
cccctccctcccaca

SEQ ID NO: 820937 - DNA, 13 bp, Homo sapiens
cccctccctcgtg

SEQ ID NO: 820938 - DNA, 16 bp, Homo sapiens
cccctccctcgtgggc

SEQ ID NO: 820939 - DNA, 14 bp, Homo sapiens
cccctccctctgcc

SEQ ID NO: 820940 - DNA, 15 bp, Homo sapiens
cccctccctggcctg

SEQ ID NO: 820941 - DNA, 16 bp, Homo sapiens
cccctccctggcctgt

SEQ ID NO: 820942 - DNA, 13 bp, Homo sapiens
cccctccctggct

SEQ ID NO: 820943 - DNA, 22 bp, Homo sapiens
cccctccctggctcccatgacc

SEQ ID NO: 820944 - DNA, 15 bp, Homo sapiens
cccctcccttcacag

SEQ ID NO: 820945 - DNA, 16 bp, Homo sapiens
cccctccgccctgcca

SEQ ID NO: 820946 - DNA, 15 bp, Homo sapiens
cccctcctagggggt

SEQ ID NO: 820947 - DNA, 13 bp, Homo sapiens
cccctcctccagg

SEQ ID NO: 820948 - DNA, 13 bp, Homo sapiens
cccctcctctctg

SEQ ID NO: 820949 - DNA, 20 bp, Homo sapiens
cccctcctgaaccgcacagc

SEQ ID NO: 820950 - DNA, 13 bp, Homo sapiens
cccctcctgcaca

SEQ ID NO: 820951 - DNA, 15 bp, Homo sapiens
cccctcctgctcctc

SEQ ID NO: 820952 - DNA, 20 bp, Homo sapiens
cccctcctgctcctccctgc

SEQ ID NO: 820953 - DNA, 14 bp, Homo sapiens
cccctcctgctggg

SEQ ID NO: 820954 - DNA, 12 bp, Homo sapiens
cccctccttctc

SEQ ID NO: 820955 - DNA, 19 bp, Homo sapiens
cccctccttgcaaccaggc

SEQ ID NO: 820956 - DNA, 20 bp, Homo sapiens
cccctccttgcaaccaggca

SEQ ID NO: 820957 - DNA, 18 bp, Homo sapiens
cccctccttgcctcctgt

SEQ ID NO: 820958 - DNA, 18 bp, Homo sapiens
cccctcgactcagcacca

SEQ ID NO: 820959 - DNA, 21 bp, Homo sapiens
cccctcgaggcctacagagga

SEQ ID NO: 820960 - DNA, 21 bp, Homo sapiens
cccctcgcttggacggctggg

SEQ ID NO: 820961 - DNA, 13 bp, Homo sapiens
cccctcggagcct

SEQ ID NO: 820962 - DNA, 18 bp, Homo sapiens
cccctcggagcctgtgtt

SEQ ID NO: 820963 - DNA, 16 bp, Homo sapiens
cccctcggctctggag

SEQ ID NO: 820964 - DNA, 18 bp, Homo sapiens
cccctcgtcccatccagc

SEQ ID NO: 820965 - DNA, 17 bp, Homo sapiens
cccctcgtgtgactctc

SEQ ID NO: 820966 - DNA, 12 bp, Homo sapiens
cccctctcacca

SEQ ID NO: 820967 - DNA, 13 bp, Homo sapiens
cccctctcacgcc

SEQ ID NO: 820968 - DNA, 20 bp, Homo sapiens
cccctctcacgccacccccg

SEQ ID NO: 820969 - DNA, 11 bp, Homo sapiens
cccctctcaga

SEQ ID NO: 820970 - DNA, 14 bp, Homo sapiens
cccctctcaggaga

SEQ ID NO: 820971 - DNA, 21 bp, Homo sapiens
cccctctcatccccctgtgga

SEQ ID NO: 820972 - DNA, 14 bp, Homo sapiens
cccctctccccttg

SEQ ID NO: 820973 - DNA, 14 bp, Homo sapiens
cccctctccctggg

SEQ ID NO: 820974 - DNA, 13 bp, Homo sapiens
cccctctcccttc

SEQ ID NO: 820975 - DNA, 19 bp, Homo sapiens
cccctctcctcccagctgc

SEQ ID NO: 820976 - DNA, 13 bp, Homo sapiens
cccctctcctgcc

SEQ ID NO: 820977 - DNA, 19 bp, Homo sapiens
cccctctccttcctgtgtg

SEQ ID NO: 820978 - DNA, 17 bp, Homo sapiens
cccctctccttctccta

SEQ ID NO: 820979 - DNA, 13 bp, Homo sapiens
cccctctctcaca

SEQ ID NO: 820980 - DNA, 18 bp, Homo sapiens
cccctctgcccagcttgg

SEQ ID NO: 820981 - DNA, 22 bp, Homo sapiens
cccctctgcccagcttgggccc

SEQ ID NO: 820982 - DNA, 16 bp, Homo sapiens
cccctctggccaggat

SEQ ID NO: 820983 - DNA, 19 bp, Homo sapiens
cccctctggctccagctgg

SEQ ID NO: 820984 - DNA, 20 bp, Homo sapiens
cccctctggtcgctcctgcc

SEQ ID NO: 820985 - DNA, 20 bp, Homo sapiens
cccctctggttatttatttc

SEQ ID NO: 820986 - DNA, 21 bp, Homo sapiens
cccctctgtcatcactccctg

SEQ ID NO: 820987 - DNA, 19 bp, Homo sapiens
cccctctgttctctcccct

SEQ ID NO: 820988 - DNA, 21 bp, Homo sapiens
cccctctgttctctcccctca

SEQ ID NO: 820989 - DNA, 15 bp, Homo sapiens
cccctcttcaaagca

SEQ ID NO: 820990 - DNA, 19 bp, Homo sapiens
cccctcttccagcttcttt

SEQ ID NO: 820991 - DNA, 13 bp, Homo sapiens
cccctcttcctct

SEQ ID NO: 820992 - DNA, 12 bp, Homo sapiens
cccctctttctc

SEQ ID NO: 820993 - DNA, 19 bp, Homo sapiens
cccctgtcccattctagat

SEQ ID NO: 820994 - DNA, 17 bp, Homo sapiens
cccctgtccccagtccc

SEQ ID NO: 820995 - DNA, 20 bp, Homo sapiens
cccctgtcgcccacccagct

SEQ ID NO: 820996 - DNA, 18 bp, Homo sapiens
cccctgtctagagaggga

SEQ ID NO: 820997 - DNA, 22 bp, Homo sapiens
cccctgtctctaaggagcagcg

SEQ ID NO: 820998 - DNA, 19 bp, Homo sapiens
cccctgtgcagccgctgag

SEQ ID NO: 820999 - DNA, 21 bp, Homo sapiens
cccctgtgctcccctgccaca

SEQ ID NO: 821000 - DNA, 13 bp, Homo sapiens
cccctgtggccaa

SEQ ID NO: 821001 - DNA, 20 bp, Homo sapiens
cccctgtggggaacaggtct

SEQ ID NO: 821002 - DNA, 19 bp, Homo sapiens
cccctgttcccctctccct

SEQ ID NO: 821003 - DNA, 17 bp, Homo sapiens
ccccttaaacttccaaa

SEQ ID NO: 821004 - DNA, 20 bp, Homo sapiens
ccccttaaacttccaaagct

SEQ ID NO: 821005 - DNA, 22 bp, Homo sapiens
ccccttaaagaaaattgcatga

SEQ ID NO: 821006 - DNA, 15 bp, Homo sapiens
ccccttattgctgcc

SEQ ID NO: 821007 - DNA, 18 bp, Homo sapiens
ccccttattgctgccaaa

SEQ ID NO: 821008 - DNA, 14 bp, Homo sapiens
ccccttcacaaagc

SEQ ID NO: 821009 - DNA, 13 bp, Homo sapiens
ccccttcagctcc

SEQ ID NO: 821010 - DNA, 14 bp, Homo sapiens
ccccttcagtgccc

SEQ ID NO: 821011 - DNA, 23 bp, Homo sapiens
ccccttccatggtactgtagcag

SEQ ID NO: 821012 - DNA, 11 bp, Homo sapiens
ccccttcccac

SEQ ID NO: 821013 - DNA, 14 bp, Homo sapiens
ccccttcccagcca

SEQ ID NO: 821014 - DNA, 15 bp, Homo sapiens
ccccttccccactgc

SEQ ID NO: 821015 - DNA, 14 bp, Homo sapiens
ccccttccccagcc

SEQ ID NO: 821016 - DNA, 14 bp, Homo sapiens
ccccttccccaggc

SEQ ID NO: 821017 - DNA, 13 bp, Homo sapiens
ccccttccctgca

SEQ ID NO: 821018 - DNA, 17 bp, Homo sapiens
ccccttccctggggagc

SEQ ID NO: 821019 - DNA, 13 bp, Homo sapiens
ccccttccctgtc

SEQ ID NO: 821020 - DNA, 15 bp, Homo sapiens
ccccttcccttggag

SEQ ID NO: 821021 - DNA, 17 bp, Homo sapiens
ccccttcccttggaggg

SEQ ID NO: 821022 - DNA, 20 bp, Homo sapiens
ccccttcctaattccacagc

SEQ ID NO: 821023 - DNA, 14 bp, Homo sapiens
ccccttcctggaca

SEQ ID NO: 821024 - DNA, 19 bp, Homo sapiens
ccccttcctggacacactc

SEQ ID NO: 821025 - DNA, 22 bp, Homo sapiens
ccccttcctgtcccacctcttc

SEQ ID NO: 821026 - DNA, 17 bp, Homo sapiens
ccccttcctgtcctgcc

SEQ ID NO: 821027 - DNA, 21 bp, Homo sapiens
ccccttcctgtcctgcctcct

SEQ ID NO: 821028 - DNA, 12 bp, Homo sapiens
ccccttcctgtt

SEQ ID NO: 821029 - DNA, 19 bp, Homo sapiens
ccccttccttgctctgcac

SEQ ID NO: 821030 - DNA, 20 bp, Homo sapiens
ccccttccttgctctgcacc

SEQ ID NO: 821031 - DNA, 15 bp, Homo sapiens
ccccttcgctcctcc

SEQ ID NO: 821032 - DNA, 16 bp, Homo sapiens
ccccttctccccttcc

SEQ ID NO: 821033 - DNA, 19 bp, Homo sapiens
ccccttctctcctccccaa

SEQ ID NO: 821034 - DNA, 14 bp, Homo sapiens
ccccttctctgctc

SEQ ID NO: 821035 - DNA, 16 bp, Homo sapiens
ccccttctctgctcca

SEQ ID NO: 821036 - DNA, 14 bp, Homo sapiens
ccccttctgctcag

SEQ ID NO: 821037 - DNA, 20 bp, Homo sapiens
ccccttctgctcagctctgg

SEQ ID NO: 821038 - DNA, 13 bp, Homo sapiens
ccccttcttcctc

SEQ ID NO: 821039 - DNA, 13 bp, Homo sapiens
ccccttcttgggc

SEQ ID NO: 821040 - DNA, 14 bp, Homo sapiens
ccccttgaagcaat

SEQ ID NO: 821041 - DNA, 18 bp, Homo sapiens
ccccttgaatctgcaggg

SEQ ID NO: 821042 - DNA, 20 bp, Homo sapiens
ccccttgatcgacttcttgg

SEQ ID NO: 821043 - DNA, 12 bp, Homo sapiens
ccccttgcaagc

SEQ ID NO: 821044 - DNA, 13 bp, Homo sapiens
ccccttgcagcct

SEQ ID NO: 821045 - DNA, 23 bp, Homo sapiens
ccccttgcccagggctcagcctg

SEQ ID NO: 821046 - DNA, 14 bp, Homo sapiens
ccccttgccctccg

SEQ ID NO: 821047 - DNA, 18 bp, Homo sapiens
ccccttgcccttgccctg

SEQ ID NO: 821048 - DNA, 23 bp, Homo sapiens
ccccttgcccttgccctgacctc

SEQ ID NO: 821049 - DNA, 22 bp, Homo sapiens
ccccttgctctcccctgccctg

SEQ ID NO: 821050 - DNA, 23 bp, Homo sapiens
ccccttgctgatgctcctccggg

SEQ ID NO: 821051 - DNA, 18 bp, Homo sapiens
ccccttggacctccaggg

SEQ ID NO: 821052 - DNA, 13 bp, Homo sapiens
ccccttgggcatc

SEQ ID NO: 821053 - DNA, 23 bp, Homo sapiens
ccccttgggcatccacccagtgc

SEQ ID NO: 821054 - DNA, 13 bp, Homo sapiens
ccccttgggcggc

SEQ ID NO: 821055 - DNA, 24 bp, Homo sapiens
ccccttggttctgcactgttgcca

SEQ ID NO: 821056 - DNA, 21 bp, Homo sapiens
ccccttgtcgcgcgtctccca

SEQ ID NO: 821057 - DNA, 18 bp, Homo sapiens
ccccttgtcttcccccct

SEQ ID NO: 821058 - DNA, 23 bp, Homo sapiens
ccccttgtgggcaaaggcagggc

SEQ ID NO: 821059 - DNA, 20 bp, Homo sapiens
ccccttgtttgtcccttcta

SEQ ID NO: 821060 - DNA, 24 bp, Homo sapiens
cccctttcagatgtcttctgcctg

SEQ ID NO: 821061 - DNA, 14 bp, Homo sapiens
cccctttcccgggc

SEQ ID NO: 821062 - DNA, 18 bp, Homo sapiens
cccctttcccgggctgtc

SEQ ID NO: 821063 - DNA, 22 bp, Homo sapiens
cccctttcctaaagccatcatg

SEQ ID NO: 821064 - DNA, 14 bp, Homo sapiens
cccctttcctcccc

SEQ ID NO: 821065 - DNA, 13 bp, Homo sapiens
cccctttgcctct

SEQ ID NO: 821066 - DNA, 23 bp, Homo sapiens
ccccttttccagttgctgtggac

SEQ ID NO: 821067 - DNA, 22 bp, Homo sapiens
ccccttttcggccccatgtatc

SEQ ID NO: 821068 - DNA, 14 bp, Homo sapiens
ccccttttctatgt

SEQ ID NO: 821069 - DNA, 14 bp, Homo sapiens
ccccttttctctgc

SEQ ID NO: 821070 - DNA, 17 bp, Homo sapiens
ccccttttcttttctac

SEQ ID NO: 821071 - DNA, 19 bp, Homo sapiens
ccccttttcttttctaccc

SEQ ID NO: 821072 - DNA, 20 bp, Homo sapiens
ccccttttcttttctaccct

SEQ ID NO: 821073 - DNA, 17 bp, Homo sapiens
ccccttttgcctggctg

SEQ ID NO: 821074 - DNA, 17 bp, Homo sapiens
cccgaaaaatgtgtggt

SEQ ID NO: 821075 - DNA, 18 bp, Homo sapiens
cccgaaatcagcccccag

SEQ ID NO: 821076 - DNA, 18 bp, Homo sapiens
cccgaagggagcatctgt

SEQ ID NO: 821077 - DNA, 17 bp, Homo sapiens
cccgaagtcctgtcact

SEQ ID NO: 821078 - DNA, 19 bp, Homo sapiens
cccgaagtcctgtcactga

SEQ ID NO: 821079 - DNA, 13 bp, Homo sapiens
cccgaatgcctgt

SEQ ID NO: 821080 - DNA, 15 bp, Homo sapiens
cccgacactgctgca

SEQ ID NO: 821081 - DNA, 14 bp, Homo sapiens
cccgacagcccatc

SEQ ID NO: 821082 - DNA, 18 bp, Homo sapiens
cccgacagcctggcacag

SEQ ID NO: 821083 - DNA, 15 bp, Homo sapiens
cccgacaggtgggcc

SEQ ID NO: 821084 - DNA, 18 bp, Homo sapiens
cccgacaggtgggcctgg

SEQ ID NO: 821085 - DNA, 20 bp, Homo sapiens
cccgacaggtgggcctggga

SEQ ID NO: 821086 - DNA, 19 bp, Homo sapiens
cccgacagtgccatcccca

SEQ ID NO: 821087 - DNA, 23 bp, Homo sapiens
cccgacatggacccggagctaac

SEQ ID NO: 821088 - DNA, 14 bp, Homo sapiens
cccgacccagccag

SEQ ID NO: 821089 - DNA, 23 bp, Homo sapiens
cccgacccagccagctgcagggc

SEQ ID NO: 821090 - DNA, 16 bp, Homo sapiens
cccgacccccctaccc

SEQ ID NO: 821091 - DNA, 18 bp, Homo sapiens
cccgacggcctccaggag

SEQ ID NO: 821092 - DNA, 15 bp, Homo sapiens
cccgactccagccag

SEQ ID NO: 821093 - DNA, 16 bp, Homo sapiens
cccgactccagccagc

SEQ ID NO: 821094 - DNA, 16 bp, Homo sapiens
cccgactgcctgtctc

SEQ ID NO: 821095 - DNA, 14 bp, Homo sapiens
cccgagaagtgctc

SEQ ID NO: 821096 - DNA, 19 bp, Homo sapiens
cccgagaagtgctcttggc

SEQ ID NO: 821097 - DNA, 14 bp, Homo sapiens
cccgagacctcact

SEQ ID NO: 821098 - DNA, 13 bp, Homo sapiens
cccgagcccagct

SEQ ID NO: 821099 - DNA, 14 bp, Homo sapiens
cccgagccctgact

SEQ ID NO: 821100 - DNA, 23 bp, Homo sapiens
cccgagctactctcttgccagca

SEQ ID NO: 821101 - DNA, 20 bp, Homo sapiens
cccgagctgggggccatgag

SEQ ID NO: 821102 - DNA, 23 bp, Homo sapiens
cccgagctgggggccatgagctc

SEQ ID NO: 821103 - DNA, 22 bp, Homo sapiens
cccgagctggtgcattacagag

SEQ ID NO: 821104 - DNA, 16 bp, Homo sapiens
cccgaggagctgggcc

SEQ ID NO: 821105 - DNA, 19 bp, Homo sapiens
cccgaggccgcgtgcgtga

SEQ ID NO: 821106 - DNA, 15 bp, Homo sapiens
cccgaggctgcccca

SEQ ID NO: 821107 - DNA, 16 bp, Homo sapiens
cccgaggctgccccag

SEQ ID NO: 821108 - DNA, 17 bp, Homo sapiens
cccgaggctgccccagg

SEQ ID NO: 821109 - DNA, 21 bp, Homo sapiens
cccgaggctgccccaggccgg

SEQ ID NO: 821110 - DNA, 15 bp, Homo sapiens
cccgaggctgctaga

SEQ ID NO: 821111 - DNA, 18 bp, Homo sapiens
cccgagggctgaggagca

SEQ ID NO: 821112 - DNA, 20 bp, Homo sapiens
cccgagggctgaggagcagc

SEQ ID NO: 821113 - DNA, 17 bp, Homo sapiens
cccgaggggagggcagg

SEQ ID NO: 821114 - DNA, 15 bp, Homo sapiens
cccgagtacagtctg

SEQ ID NO: 821115 - DNA, 16 bp, Homo sapiens
ccctagaaaggagaga

SEQ ID NO: 821116 - DNA, 17 bp, Homo sapiens
ccctagaaaggagagaa

SEQ ID NO: 821117 - DNA, 21 bp, Homo sapiens
ccctagaagagcacagagccc

SEQ ID NO: 821118 - DNA, 19 bp, Homo sapiens
ccctagaataatctcatcc

SEQ ID NO: 821119 - DNA, 22 bp, Homo sapiens
ccctagcccttccagcctggga

SEQ ID NO: 821120 - DNA, 11 bp, Homo sapiens
ccctagccttg

SEQ ID NO: 821121 - DNA, 21 bp, Homo sapiens
ccctagctttacgctcatcac

SEQ ID NO: 821122 - DNA, 21 bp, Homo sapiens
ccctagctttatatatggaca

SEQ ID NO: 821123 - DNA, 22 bp, Homo sapiens
ccctagctttatatatggacat

SEQ ID NO: 821124 - DNA, 14 bp, Homo sapiens
ccctaggagaccaa

SEQ ID NO: 821125 - DNA, 20 bp, Homo sapiens
ccctaggagtatatttccgc

SEQ ID NO: 821126 - DNA, 21 bp, Homo sapiens
ccctaggatgctgcagcagag

SEQ ID NO: 821127 - DNA, 22 bp, Homo sapiens
ccctaggattccccctgccctg

SEQ ID NO: 821128 - DNA, 23 bp, Homo sapiens
ccctaggattccccctgccctgt

SEQ ID NO: 821129 - DNA, 16 bp, Homo sapiens
ccctaggcagcctgca

SEQ ID NO: 821130 - DNA, 15 bp, Homo sapiens
ccctagggaattcct

SEQ ID NO: 821131 - DNA, 17 bp, Homo sapiens
ccctagtccccctgttt

SEQ ID NO: 821132 - DNA, 13 bp, Homo sapiens
ccctatagagagg

SEQ ID NO: 821133 - DNA, 14 bp, Homo sapiens
ccctatccacccag

SEQ ID NO: 821134 - DNA, 16 bp, Homo sapiens
ccctatccacccagcc

SEQ ID NO: 821135 - DNA, 12 bp, Homo sapiens
ccctatcctccc

SEQ ID NO: 821136 - DNA, 14 bp, Homo sapiens
ccctatcctcccct

SEQ ID NO: 821137 - DNA, 14 bp, Homo sapiens
ccctatctcctgac

SEQ ID NO: 821138 - DNA, 16 bp, Homo sapiens
ccctatctcctgacag

SEQ ID NO: 821139 - DNA, 17 bp, Homo sapiens
ccctatctcctgacaga

SEQ ID NO: 821140 - DNA, 18 bp, Homo sapiens
ccctatcttgtcctggaa

SEQ ID NO: 821141 - DNA, 21 bp, Homo sapiens
ccctatgggcctgccgggctg

SEQ ID NO: 821142 - DNA, 18 bp, Homo sapiens
ccctattagagaagagat

SEQ ID NO: 821143 - DNA, 21 bp, Homo sapiens
ccctatttaacagggtctcta

SEQ ID NO: 821144 - DNA, 11 bp, Homo sapiens
ccctatttcta

SEQ ID NO: 821145 - DNA, 17 bp, Homo sapiens
ccctcaacaagggagag

SEQ ID NO: 821146 - DNA, 18 bp, Homo sapiens
ccctcaacaagggagaga

SEQ ID NO: 821147 - DNA, 19 bp, Homo sapiens
ccctcaacaagggagagac

SEQ ID NO: 821148 - DNA, 21 bp, Homo sapiens
ccctcaagccaatcccctcct

SEQ ID NO: 821149 - DNA, 20 bp, Homo sapiens
ccctcacacacacagctggg

SEQ ID NO: 821150 - DNA, 16 bp, Homo sapiens
ccctcacatcctcctg

SEQ ID NO: 821151 - DNA, 18 bp, Homo sapiens
ccctcacatcctcctgcc

SEQ ID NO: 821152 - DNA, 13 bp, Homo sapiens
ccctcacccactc

SEQ ID NO: 821153 - DNA, 14 bp, Homo sapiens
ccctcaccccaatc

SEQ ID NO: 821154 - DNA, 15 bp, Homo sapiens
ccctcaccccaatcc

SEQ ID NO: 821155 - DNA, 22 bp, Homo sapiens
ccctcaccccaatccctgccac

SEQ ID NO: 821156 - DNA, 12 bp, Homo sapiens
ccctcaccccag

SEQ ID NO: 821157 - DNA, 21 bp, Homo sapiens
ccctcacccccaggtgttgcc

SEQ ID NO: 821158 - DNA, 19 bp, Homo sapiens
ccctcaccccctcctggca

SEQ ID NO: 821159 - DNA, 20 bp, Homo sapiens
ccctcaccccctcctggcaa

SEQ ID NO: 821160 - DNA, 22 bp, Homo sapiens
ccctcaccccctcctggcaatc

SEQ ID NO: 821161 - DNA, 16 bp, Homo sapiens
ccctcacctctgagga

SEQ ID NO: 821162 - DNA, 19 bp, Homo sapiens
ccctcacctctgaggacag

SEQ ID NO: 821163 - DNA, 17 bp, Homo sapiens
ccctcacctgggcacct

SEQ ID NO: 821164 - DNA, 23 bp, Homo sapiens
ccctcacctgggcacctggggag

SEQ ID NO: 821165 - DNA, 14 bp, Homo sapiens
ccctcacctgggcc

SEQ ID NO: 821166 - DNA, 21 bp, Homo sapiens
ccctcaccttgcaacacacag

SEQ ID NO: 821167 - DNA, 14 bp, Homo sapiens
ccctcactctggcc

SEQ ID NO: 821168 - DNA, 16 bp, Homo sapiens
ccctcactctggcctc

SEQ ID NO: 821169 - DNA, 17 bp, Homo sapiens
ccctcactctgtcagcc

SEQ ID NO: 821170 - DNA, 23 bp, Homo sapiens
ccctcactctgtcagccagccgc

SEQ ID NO: 821171 - DNA, 15 bp, Homo sapiens
ccctcactgagcctc

SEQ ID NO: 821172 - DNA, 14 bp, Homo sapiens
ccctcactggatga

SEQ ID NO: 821173 - DNA, 9 bp, Homo sapiens
ccctcagaa

SEQ ID NO: 821174 - DNA, 18 bp, Homo sapiens
ccctcagacatttatata

SEQ ID NO: 821175 - DNA, 13 bp, Homo sapiens
ccctcagagccac

SEQ ID NO: 821176 - DNA, 14 bp, Homo sapiens
ccctcagagccctg

SEQ ID NO: 821177 - DNA, 19 bp, Homo sapiens
ccctcagagccctgccctg

SEQ ID NO: 821178 - DNA, 20 bp, Homo sapiens
ccctcagagccctgccctgc

SEQ ID NO: 821179 - DNA, 18 bp, Homo sapiens
ccctcagatgatctctcc

SEQ ID NO: 821180 - DNA, 16 bp, Homo sapiens
ccctcagatgtccctt

SEQ ID NO: 821181 - DNA, 17 bp, Homo sapiens
ccctcagattttatatt

SEQ ID NO: 821182 - DNA, 12 bp, Homo sapiens
ccctcagcccct

SEQ ID NO: 821183 - DNA, 13 bp, Homo sapiens
ccctcagcccctc

SEQ ID NO: 821184 - DNA, 14 bp, Homo sapiens
ccctcagcccctct

SEQ ID NO: 821185 - DNA, 17 bp, Homo sapiens
ccctcagcccctcttgc

SEQ ID NO: 821186 - DNA, 23 bp, Homo sapiens
ccctcagcccctcttgcccccca

SEQ ID NO: 821187 - DNA, 14 bp, Homo sapiens
ccctcagccctggc

SEQ ID NO: 821188 - DNA, 19 bp, Homo sapiens
ccctcagccctggcctttt

SEQ ID NO: 821189 - DNA, 12 bp, Homo sapiens
ccctcagccctt

SEQ ID NO: 821190 - DNA, 14 bp, Homo sapiens
ccctcagcccttgc

SEQ ID NO: 821191 - DNA, 19 bp, Homo sapiens
ccctcagcccttgccccca

SEQ ID NO: 821192 - DNA, 19 bp, Homo sapiens
ccctcagccgtcagccatc

SEQ ID NO: 821193 - DNA, 16 bp, Homo sapiens
ccctcagcctcccctt

SEQ ID NO: 821194 - DNA, 12 bp, Homo sapiens
ccctcagcctct

SEQ ID NO: 821195 - DNA, 13 bp, Homo sapiens
ccctcagcctctt

SEQ ID NO: 821196 - DNA, 13 bp, Homo sapiens
ccctcagcctgcc

SEQ ID NO: 821197 - DNA, 14 bp, Homo sapiens
ccctcagcctgccc

SEQ ID NO: 821198 - DNA, 19 bp, Homo sapiens
ccctcagcctgcccacctc

SEQ ID NO: 821199 - DNA, 19 bp, Homo sapiens
ccctcagcgcaggctgcag

SEQ ID NO: 821200 - DNA, 16 bp, Homo sapiens
ccctcagctccccggc

SEQ ID NO: 821201 - DNA, 16 bp, Homo sapiens
ccctcagctctctggg

SEQ ID NO: 821202 - DNA, 21 bp, Homo sapiens
ccctcagctgtcacctgctca

SEQ ID NO: 821203 - DNA, 22 bp, Homo sapiens
ccctcagctgtcacctgctcac

SEQ ID NO: 821204 - DNA, 21 bp, Homo sapiens
ccctcaggcataggcctgggt

SEQ ID NO: 821205 - DNA, 11 bp, Homo sapiens
ccctcaggcca

SEQ ID NO: 821206 - DNA, 16 bp, Homo sapiens
ccctcaggccaccctc

SEQ ID NO: 821207 - DNA, 16 bp, Homo sapiens
ccctcaggctccccag

SEQ ID NO: 821208 - DNA, 19 bp, Homo sapiens
ccctcagggactgcaccct

SEQ ID NO: 821209 - DNA, 14 bp, Homo sapiens
ccctcagggagcct

SEQ ID NO: 821210 - DNA, 21 bp, Homo sapiens
ccctcagggagcgatccaggg

SEQ ID NO: 821211 - DNA, 16 bp, Homo sapiens
ccctcagggggccagc

SEQ ID NO: 821212 - DNA, 17 bp, Homo sapiens
ccctcagggggccagct

SEQ ID NO: 821213 - DNA, 20 bp, Homo sapiens
ccctcagggggccagctggg

SEQ ID NO: 821214 - DNA, 21 bp, Homo sapiens
ccctcagggggccagctgggg

SEQ ID NO: 821215 - DNA, 13 bp, Homo sapiens
ccctcaggtgcct

SEQ ID NO: 821216 - DNA, 19 bp, Homo sapiens
ccctcaggtgtagctgagc

SEQ ID NO: 821217 - DNA, 22 bp, Homo sapiens
ccctcaggtgtagctgagctgt

SEQ ID NO: 821218 - DNA, 22 bp, Homo sapiens
ccctcagtcagttcccggagca

SEQ ID NO: 821219 - DNA, 14 bp, Homo sapiens
ccctcagtgcatcc

SEQ ID NO: 821220 - DNA, 20 bp, Homo sapiens
ccctcagtttggtagtgccc

SEQ ID NO: 821221 - DNA, 17 bp, Homo sapiens
ccctcatcccgagcacc

SEQ ID NO: 821222 - DNA, 13 bp, Homo sapiens
ccctcatctgtcc

SEQ ID NO: 821223 - DNA, 21 bp, Homo sapiens
ccctcatggcccctctgacct

SEQ ID NO: 821224 - DNA, 17 bp, Homo sapiens
ccctcattcaggaaaac

SEQ ID NO: 821225 - DNA, 22 bp, Homo sapiens
ccctcattccaccttcccatgc

SEQ ID NO: 821226 - DNA, 15 bp, Homo sapiens
ccctcattgctgtct

SEQ ID NO: 821227 - DNA, 18 bp, Homo sapiens
ccctcattgctgtcttgc

SEQ ID NO: 821228 - DNA, 15 bp, Homo sapiens
ccctccaaaagcact

SEQ ID NO: 821229 - DNA, 18 bp, Homo sapiens
ccctccaaacctccagcc

SEQ ID NO: 821230 - DNA, 24 bp, Homo sapiens
ccctccaaacctccagcctccctg

SEQ ID NO: 821231 - DNA, 18 bp, Homo sapiens
ccctccaaaggaaggggt

SEQ ID NO: 821232 - DNA, 12 bp, Homo sapiens
ccctccaacaca

SEQ ID NO: 821233 - DNA, 17 bp, Homo sapiens
ccctccaagcctggcac

SEQ ID NO: 821234 - DNA, 21 bp, Homo sapiens
ccctccaagcctggcacccac

SEQ ID NO: 821235 - DNA, 22 bp, Homo sapiens
ccctccaagcctggcacccacc

SEQ ID NO: 821236 - DNA, 21 bp, Homo sapiens
ccctccacaaagcaaaggcag

SEQ ID NO: 821237 - DNA, 13 bp, Homo sapiens
ccctctggatcaa

SEQ ID NO: 821238 - DNA, 13 bp, Homo sapiens
ccctctggccagg

SEQ ID NO: 821239 - DNA, 13 bp, Homo sapiens
ccctctggccctg

SEQ ID NO: 821240 - DNA, 14 bp, Homo sapiens
ccctctggccctgc

SEQ ID NO: 821241 - DNA, 16 bp, Homo sapiens
ccctctggctccagct

SEQ ID NO: 821242 - DNA, 17 bp, Homo sapiens
ccctctggctccagctg

SEQ ID NO: 821243 - DNA, 22 bp, Homo sapiens
ccctctggctccagctggccgg

SEQ ID NO: 821244 - DNA, 14 bp, Homo sapiens
ccctctggcttccc

SEQ ID NO: 821245 - DNA, 14 bp, Homo sapiens
ccctctgggaacct

SEQ ID NO: 821246 - DNA, 20 bp, Homo sapiens
ccctctgggaacctcccaga

SEQ ID NO: 821247 - DNA, 21 bp, Homo sapiens
ccctctgggaacctcccagag

SEQ ID NO: 821248 - DNA, 22 bp, Homo sapiens
ccctctgggaacctcccagagg

SEQ ID NO: 821249 - DNA, 12 bp, Homo sapiens
ccctctgggagt

SEQ ID NO: 821250 - DNA, 22 bp, Homo sapiens
ccctctgggcacgcctgctggc

SEQ ID NO: 821251 - DNA, 17 bp, Homo sapiens
ccctctggtccttctga

SEQ ID NO: 821252 - DNA, 18 bp, Homo sapiens
ccctctggtcgctcctgc

SEQ ID NO: 821253 - DNA, 21 bp, Homo sapiens
ccctctgtcatcactccctgg

SEQ ID NO: 821254 - DNA, 20 bp, Homo sapiens
ccctctgtccaggcactgag

SEQ ID NO: 821255 - DNA, 12 bp, Homo sapiens
ccctctgtcccc

SEQ ID NO: 821256 - DNA, 13 bp, Homo sapiens
ccctctgtcccca

SEQ ID NO: 821257 - DNA, 14 bp, Homo sapiens
ccctctgtccccag

SEQ ID NO: 821258 - DNA, 17 bp, Homo sapiens
ccctctgtccccaggcc

SEQ ID NO: 821259 - DNA, 22 bp, Homo sapiens
ccctctgtccccaggcctggct

SEQ ID NO: 821260 - DNA, 10 bp, Homo sapiens
ccctctgtct

SEQ ID NO: 821261 - DNA, 14 bp, Homo sapiens
ccctctgtctagga

SEQ ID NO: 821262 - DNA, 22 bp, Homo sapiens
ccctctgtctaggactgcagtg

SEQ ID NO: 821263 - DNA, 21 bp, Homo sapiens
ccctctgtcttttctcctccg

SEQ ID NO: 821264 - DNA, 22 bp, Homo sapiens
ccctctgtcttttctcctccgc

SEQ ID NO: 821265 - DNA, 22 bp, Homo sapiens
ccctctgtgcttcgactactgc

SEQ ID NO: 821266 - DNA, 14 bp, Homo sapiens
ccctctgtggcctg

SEQ ID NO: 821267 - DNA, 21 bp, Homo sapiens
ccctctgttaggtccattttc

SEQ ID NO: 821268 - DNA, 17 bp, Homo sapiens
ccctctgttctctcccc

SEQ ID NO: 821269 - DNA, 22 bp, Homo sapiens
ccctctgttctctcccctcaca

SEQ ID NO: 821270 - DNA, 21 bp, Homo sapiens
ccctctgttctgcacacagca

SEQ ID NO: 821271 - DNA, 16 bp, Homo sapiens
ccctcttaagatctga

SEQ ID NO: 821272 - DNA, 14 bp, Homo sapiens
ccctcttccagctt

SEQ ID NO: 821273 - DNA, 12 bp, Homo sapiens
ccctcttcctct

SEQ ID NO: 821274 - DNA, 23 bp, Homo sapiens
ccctcttcctcttgaccctgcac

SEQ ID NO: 821275 - DNA, 11 bp, Homo sapiens
ccctcttcctg

SEQ ID NO: 821276 - DNA, 15 bp, Homo sapiens
ccctcttcctgacga

SEQ ID NO: 821277 - DNA, 14 bp, Homo sapiens
ccctcttccttccc

SEQ ID NO: 821278 - DNA, 16 bp, Homo sapiens
ccctcttccttccccc

SEQ ID NO: 821279 - DNA, 13 bp, Homo sapiens
ccctcttctcctt

SEQ ID NO: 821280 - DNA, 15 bp, Homo sapiens
ccctcttctccttgc

SEQ ID NO: 821281 - DNA, 14 bp, Homo sapiens
ccctcttctctcct

SEQ ID NO: 821282 - DNA, 23 bp, Homo sapiens
ccctcttgaggtggtgccttctc

SEQ ID NO: 821283 - DNA, 11 bp, Homo sapiens
ccctcttgcca

SEQ ID NO: 821284 - DNA, 14 bp, Homo sapiens
ccctcttgccagcc

SEQ ID NO: 821285 - DNA, 18 bp, Homo sapiens
ccctcttgccagcctcct

SEQ ID NO: 821286 - DNA, 23 bp, Homo sapiens
ccctcttgccagcctccttgctg

SEQ ID NO: 821287 - DNA, 15 bp, Homo sapiens
ccctcttgccatcct

SEQ ID NO: 821288 - DNA, 16 bp, Homo sapiens
ccctcttgccatcctg

SEQ ID NO: 821289 - DNA, 17 bp, Homo sapiens
ccctcttgccatcctga

SEQ ID NO: 821290 - DNA, 16 bp, Homo sapiens
ccctcttgcccatcct

SEQ ID NO: 821291 - DNA, 22 bp, Homo sapiens
ccctcttgcccatcctgactga

SEQ ID NO: 821292 - DNA, 16 bp, Homo sapiens
ccctcttgccccccac

SEQ ID NO: 821293 - DNA, 23 bp, Homo sapiens
ccctcttggtgtgattgcacaga

SEQ ID NO: 821294 - DNA, 12 bp, Homo sapiens
ccctctttccct

SEQ ID NO: 821295 - DNA, 13 bp, Homo sapiens
ccctctttctctt

SEQ ID NO: 821296 - DNA, 15 bp, Homo sapiens
ccctctttctctttc

SEQ ID NO: 821297 - DNA, 18 bp, Homo sapiens
ccctctttctctttcttc

SEQ ID NO: 821298 - DNA, 16 bp, Homo sapiens
ccctctttgcacagca

SEQ ID NO: 821299 - DNA, 17 bp, Homo sapiens
ccctctttggctcccct

SEQ ID NO: 821300 - DNA, 16 bp, Homo sapiens
ccctcttttaccaact

SEQ ID NO: 821301 - DNA, 16 bp, Homo sapiens
ccctcttttcttactc

SEQ ID NO: 821302 - DNA, 21 bp, Homo sapiens
ccctcttttcttactcctcct

SEQ ID NO: 821303 - DNA, 16 bp, Homo sapiens
ccctgaaagccctgag

SEQ ID NO: 821304 - DNA, 18 bp, Homo sapiens
ccctgaaagccctgagct

SEQ ID NO: 821305 - DNA, 18 bp, Homo sapiens
ccctgaaagcctcacgta

SEQ ID NO: 821306 - DNA, 19 bp, Homo sapiens
ccctgaaaggaacactggc

SEQ ID NO: 821307 - DNA, 14 bp, Homo sapiens
ccctgaacaagaat

SEQ ID NO: 821308 - DNA, 17 bp, Homo sapiens
ccctgaaccacgaggct

SEQ ID NO: 821309 - DNA, 13 bp, Homo sapiens
ccctgaaccatcc

SEQ ID NO: 821310 - DNA, 18 bp, Homo sapiens
ccctgaacccctggccag

SEQ ID NO: 821311 - DNA, 24 bp, Homo sapiens
ccctgaacccctggccagctctga

SEQ ID NO: 821312 - DNA, 18 bp, Homo sapiens
ccctgaacgttttcttct

SEQ ID NO: 821313 - DNA, 19 bp, Homo sapiens
ccctgaacgttttcttctt

SEQ ID NO: 821314 - DNA, 13 bp, Homo sapiens
ccctgaagcctcc

SEQ ID NO: 821315 - DNA, 14 bp, Homo sapiens
ccctgaagcctccg

SEQ ID NO: 821316 - DNA, 16 bp, Homo sapiens
ccctgaatcctcagag

SEQ ID NO: 821317 - DNA, 16 bp, Homo sapiens
ccctgacagggccagt

SEQ ID NO: 821318 - DNA, 20 bp, Homo sapiens
ccctgacatgctaacctctc

SEQ ID NO: 821319 - DNA, 18 bp, Homo sapiens
ccctgacctcccaactct

SEQ ID NO: 821320 - DNA, 15 bp, Homo sapiens
ccctgacctcccagc

SEQ ID NO: 821321 - DNA, 17 bp, Homo sapiens
ccctgacctccctctaa

SEQ ID NO: 821322 - DNA, 18 bp, Homo sapiens
ccctgaccttagcgttct

SEQ ID NO: 821323 - DNA, 22 bp, Homo sapiens
ccctgaccttagcgttctggac

SEQ ID NO: 821324 - DNA, 14 bp, Homo sapiens
ccctgaccttggct

SEQ ID NO: 821325 - DNA, 20 bp, Homo sapiens
ccctgaccttggctgactgg

SEQ ID NO: 821326 - DNA, 12 bp, Homo sapiens
ccctgactcctc

SEQ ID NO: 821327 - DNA, 15 bp, Homo sapiens
ccctgactcctctgg

SEQ ID NO: 821328 - DNA, 15 bp, Homo sapiens
ccctgactcctggac

SEQ ID NO: 821329 - DNA, 16 bp, Homo sapiens
ccctgactcctggact

SEQ ID NO: 821330 - DNA, 18 bp, Homo sapiens
ccctgactctctgtgacc

SEQ ID NO: 821331 - DNA, 18 bp, Homo sapiens
ccctgactgtcagggagg

SEQ ID NO: 821332 - DNA, 19 bp, Homo sapiens
ccctgactgtcagggaggg

SEQ ID NO: 821333 - DNA, 20 bp, Homo sapiens
ccctgactgtcagggagggc

SEQ ID NO: 821334 - DNA, 13 bp, Homo sapiens
ccctgacttctcc

SEQ ID NO: 821335 - DNA, 16 bp, Homo sapiens
ccctgacttctccccc

SEQ ID NO: 821336 - DNA, 15 bp, Homo sapiens
ccctgacttgcttta

SEQ ID NO: 821337 - DNA, 14 bp, Homo sapiens
ccctgacttttctg

SEQ ID NO: 821338 - DNA, 16 bp, Homo sapiens
ccctgagaagctgctc

SEQ ID NO: 821339 - DNA, 20 bp, Homo sapiens
ccctgagaagctgctccagg

SEQ ID NO: 821340 - DNA, 16 bp, Homo sapiens
ccctgagactccagaa

SEQ ID NO: 821341 - DNA, 22 bp, Homo sapiens
ccctgagagagaatagagctgc

SEQ ID NO: 821342 - DNA, 19 bp, Homo sapiens
ccctgagagtggtgccctg

SEQ ID NO: 821343 - DNA, 20 bp, Homo sapiens
ccctgagagtttcctcagaa

SEQ ID NO: 821344 - DNA, 19 bp, Homo sapiens
ccctgagatcccctgagcc

SEQ ID NO: 821345 - DNA, 23 bp, Homo sapiens
ccctgagcagaatactggtctca

SEQ ID NO: 821346 - DNA, 15 bp, Homo sapiens
ccctgagcccagaga

SEQ ID NO: 821347 - DNA, 15 bp, Homo sapiens
ccctgagccccttcc

SEQ ID NO: 821348 - DNA, 17 bp, Homo sapiens
ccctgagccccttcctt

SEQ ID NO: 821349 - DNA, 21 bp, Homo sapiens
ccctgagccccttccttgctc

SEQ ID NO: 821350 - DNA, 16 bp, Homo sapiens
ccctgagcccggccct

SEQ ID NO: 821351 - DNA, 19 bp, Homo sapiens
ccctgagcctgcattctgc

SEQ ID NO: 821352 - DNA, 16 bp, Homo sapiens
ccctgagctgaggcag

SEQ ID NO: 821353 - DNA, 17 bp, Homo sapiens
ccctgagctgaggcagc

SEQ ID NO: 821354 - DNA, 13 bp, Homo sapiens
ccctgagctttgg

SEQ ID NO: 821355 - DNA, 15 bp, Homo sapiens
ccctgaggacctctc

SEQ ID NO: 821356 - DNA, 13 bp, Homo sapiens
ccctgaggactgg

SEQ ID NO: 821357 - DNA, 16 bp, Homo sapiens
ccctgaggactggaga

SEQ ID NO: 821358 - DNA, 18 bp, Homo sapiens
ccctgaggactggagacc

SEQ ID NO: 821359 - DNA, 19 bp, Homo sapiens
ccctgaggagccaggccgg

SEQ ID NO: 821360 - DNA, 20 bp, Homo sapiens
ccctggcagcacagcccagg

SEQ ID NO: 821361 - DNA, 14 bp, Homo sapiens
ccctggcagctgcc

SEQ ID NO: 821362 - DNA, 19 bp, Homo sapiens
ccctggcagctgcccctcc

SEQ ID NO: 821363 - DNA, 20 bp, Homo sapiens
ccctggcaggatgaccctgc

SEQ ID NO: 821364 - DNA, 22 bp, Homo sapiens
ccctggcaggatgaccctgcga

SEQ ID NO: 821365 - DNA, 23 bp, Homo sapiens
ccctggcattatgtccactgtgt

SEQ ID NO: 821366 - DNA, 17 bp, Homo sapiens
ccctggcccacccccca

SEQ ID NO: 821367 - DNA, 22 bp, Homo sapiens
ccctggcccaccccccagcctc

SEQ ID NO: 821368 - DNA, 13 bp, Homo sapiens
ccctggccccagg

SEQ ID NO: 821369 - DNA, 15 bp, Homo sapiens
ccctggcccctgtgg

SEQ ID NO: 821370 - DNA, 20 bp, Homo sapiens
ccctggcccgcccctcgctg

SEQ ID NO: 821371 - DNA, 17 bp, Homo sapiens
ccctggccctgaggtgt

SEQ ID NO: 821372 - DNA, 15 bp, Homo sapiens
ccctggccgccccct

SEQ ID NO: 821373 - DNA, 16 bp, Homo sapiens
ccctggcctagaccag

SEQ ID NO: 821374 - DNA, 18 bp, Homo sapiens
ccctggcctctgtgcctt

SEQ ID NO: 821375 - DNA, 19 bp, Homo sapiens
ccctggcctctgtgccttc

SEQ ID NO: 821376 - DNA, 18 bp, Homo sapiens
ccctggcctgaactgagg

SEQ ID NO: 821377 - DNA, 13 bp, Homo sapiens
ccctggcctgccg

SEQ ID NO: 821378 - DNA, 13 bp, Homo sapiens
ccctggcctgctg

SEQ ID NO: 821379 - DNA, 21 bp, Homo sapiens
ccctggcctgctgggctctcc

SEQ ID NO: 821380 - DNA, 22 bp, Homo sapiens
ccctggcctgctgggctctcca

SEQ ID NO: 821381 - DNA, 15 bp, Homo sapiens
ccctggcctggctgg

SEQ ID NO: 821382 - DNA, 20 bp, Homo sapiens
ccctggccttaaaaggggcc

SEQ ID NO: 821383 - DNA, 17 bp, Homo sapiens
ccctggctcccacaggc

SEQ ID NO: 821384 - DNA, 14 bp, Homo sapiens
ccctggctcccatg

SEQ ID NO: 821385 - DNA, 13 bp, Homo sapiens
ccctggctccctc

SEQ ID NO: 821386 - DNA, 15 bp, Homo sapiens
ccctggctccctcct

SEQ ID NO: 821387 - DNA, 14 bp, Homo sapiens
ccctggctcctccg

SEQ ID NO: 821388 - DNA, 14 bp, Homo sapiens
ccctggctccttgc

SEQ ID NO: 821389 - DNA, 20 bp, Homo sapiens
ccctggctccttgcagcagg

SEQ ID NO: 821390 - DNA, 15 bp, Homo sapiens
ccctggctctgcccc

SEQ ID NO: 821391 - DNA, 19 bp, Homo sapiens
ccctggctgaccccaaaga

SEQ ID NO: 821392 - DNA, 14 bp, Homo sapiens
ccctggctgccctg

SEQ ID NO: 821393 - DNA, 15 bp, Homo sapiens
ccctggctgtactgc

SEQ ID NO: 821394 - DNA, 17 bp, Homo sapiens
ccctggctgtactgctc

SEQ ID NO: 821395 - DNA, 16 bp, Homo sapiens
ccctggcttgcttgcc

SEQ ID NO: 821396 - DNA, 19 bp, Homo sapiens
ccctggcttgtaactccac

SEQ ID NO: 821397 - DNA, 20 bp, Homo sapiens
ccctggcttgtaactccacc

SEQ ID NO: 821398 - DNA, 18 bp, Homo sapiens
ccctggcttttcactgct

SEQ ID NO: 821399 - DNA, 17 bp, Homo sapiens
ccctgggaacaggcccc

SEQ ID NO: 821400 - DNA, 18 bp, Homo sapiens
ccctgggaaccactccca

SEQ ID NO: 821401 - DNA, 16 bp, Homo sapiens
ccctgggaaggctaag

SEQ ID NO: 821402 - DNA, 22 bp, Homo sapiens
ccctgggacctatacagaacag

SEQ ID NO: 821403 - DNA, 20 bp, Homo sapiens
ccctgggagacaactggaca

SEQ ID NO: 821404 - DNA, 18 bp, Homo sapiens
ccctgggagccgcctgct

SEQ ID NO: 821405 - DNA, 20 bp, Homo sapiens
ccctgggatgctgacccagg

SEQ ID NO: 821406 - DNA, 22 bp, Homo sapiens
ccctgggatgctgacccaggaa

SEQ ID NO: 821407 - DNA, 17 bp, Homo sapiens
ccctgggatggaacctc

SEQ ID NO: 821408 - DNA, 19 bp, Homo sapiens
ccctgggcacccacctcca

SEQ ID NO: 821409 - DNA, 13 bp, Homo sapiens
ccctgggcagatg

SEQ ID NO: 821410 - DNA, 16 bp, Homo sapiens
ccctgggcagatgtcc

SEQ ID NO: 821411 - DNA, 23 bp, Homo sapiens
ccctgggcagatgtcccccactg

SEQ ID NO: 821412 - DNA, 11 bp, Homo sapiens
ccctgggcagg

SEQ ID NO: 821413 - DNA, 13 bp, Homo sapiens
ccctgggcaggcg

SEQ ID NO: 821414 - DNA, 22 bp, Homo sapiens
ccctgggcaggcggtccccatc

SEQ ID NO: 821415 - DNA, 13 bp, Homo sapiens
ccctgggcagggc

SEQ ID NO: 821416 - DNA, 16 bp, Homo sapiens
ccctgggcagtgagtg

SEQ ID NO: 821417 - DNA, 16 bp, Homo sapiens
ccctgggccaccgggc

SEQ ID NO: 821418 - DNA, 13 bp, Homo sapiens
ccctgggccacct

SEQ ID NO: 821419 - DNA, 13 bp, Homo sapiens
ccctgggccaggc

SEQ ID NO: 821420 - DNA, 15 bp, Homo sapiens
ccctgggccaggcag

SEQ ID NO: 821421 - DNA, 20 bp, Homo sapiens
ccctgggccaggcaggcgat

SEQ ID NO: 821422 - DNA, 16 bp, Homo sapiens
ccctgggccagggtct

SEQ ID NO: 821423 - DNA, 22 bp, Homo sapiens
ccctgggccagggtctgtgtga

SEQ ID NO: 821424 - DNA, 14 bp, Homo sapiens
ccctgggccccacc

SEQ ID NO: 821425 - DNA, 14 bp, Homo sapiens
ccctgggcccctcc

SEQ ID NO: 821426 - DNA, 22 bp, Homo sapiens
ccctgggcccctccacgcctcc

SEQ ID NO: 821427 - DNA, 18 bp, Homo sapiens
ccctgggccctgggctgg

SEQ ID NO: 821428 - DNA, 18 bp, Homo sapiens
ccctgggcccttgtgctc

SEQ ID NO: 821429 - DNA, 13 bp, Homo sapiens
ccctgggcctcag

SEQ ID NO: 821430 - DNA, 17 bp, Homo sapiens
ccctgggctaagcaggg

SEQ ID NO: 821431 - DNA, 16 bp, Homo sapiens
ccctgggctctgcccc

SEQ ID NO: 821432 - DNA, 21 bp, Homo sapiens
ccctgggctgccaccagcccc

SEQ ID NO: 821433 - DNA, 13 bp, Homo sapiens
ccctgggctggaa

SEQ ID NO: 821434 - DNA, 15 bp, Homo sapiens
ccctgggctggggag

SEQ ID NO: 821435 - DNA, 18 bp, Homo sapiens
ccctgggctggggaggag

SEQ ID NO: 821436 - DNA, 19 bp, Homo sapiens
ccctgggctggggaggagg

SEQ ID NO: 821437 - DNA, 19 bp, Homo sapiens
ccctgggcttggcctgctg

SEQ ID NO: 821438 - DNA, 19 bp, Homo sapiens
ccctggggaaggagccagt

SEQ ID NO: 821439 - DNA, 19 bp, Homo sapiens
ccctggggacagagccacc

SEQ ID NO: 821440 - DNA, 22 bp, Homo sapiens
ccctggggacagagccacccca

SEQ ID NO: 821441 - DNA, 11 bp, Homo sapiens
ccctggggagc

SEQ ID NO: 821442 - DNA, 18 bp, Homo sapiens
ccctggggagccctcagg

SEQ ID NO: 821443 - DNA, 19 bp, Homo sapiens
ccctggggagccctcaggc

SEQ ID NO: 821444 - DNA, 21 bp, Homo sapiens
ccctggggagccctcaggctc

SEQ ID NO: 821445 - DNA, 12 bp, Homo sapiens
ccctggggaggg

SEQ ID NO: 821446 - DNA, 13 bp, Homo sapiens
ccctggggcccag

SEQ ID NO: 821447 - DNA, 13 bp, Homo sapiens
ccctggggcctgg

SEQ ID NO: 821448 - DNA, 17 bp, Homo sapiens
ccctggggcctggacct

SEQ ID NO: 821449 - DNA, 18 bp, Homo sapiens
ccctggggcctggacctg

SEQ ID NO: 821450 - DNA, 21 bp, Homo sapiens
ccctggggcctggacctgcct

SEQ ID NO: 821451 - DNA, 23 bp, Homo sapiens
ccctggggcctggacctgcctcc

SEQ ID NO: 821452 - DNA, 19 bp, Homo sapiens
ccctgggggaagccctgga

SEQ ID NO: 821453 - DNA, 13 bp, Homo sapiens
ccctgggggtctg

SEQ ID NO: 821454 - DNA, 13 bp, Homo sapiens
ccctggggtggcc

SEQ ID NO: 821455 - DNA, 19 bp, Homo sapiens
ccctggggtggccagggct

SEQ ID NO: 821456 - DNA, 14 bp, Homo sapiens
ccctgggtgccatt

SEQ ID NO: 821457 - DNA, 19 bp, Homo sapiens
ccctgggtgccattcccag

SEQ ID NO: 821458 - DNA, 18 bp, Homo sapiens
ccctggtaagcagaggct

SEQ ID NO: 821459 - DNA, 21 bp, Homo sapiens
ccctggtcaccaaggcagtgc

SEQ ID NO: 821460 - DNA, 16 bp, Homo sapiens
ccctggtccagggaag

SEQ ID NO: 821461 - DNA, 15 bp, Homo sapiens
ccctggtcctgaggg

SEQ ID NO: 821462 - DNA, 23 bp, Homo sapiens
ccctggtcctggcctccttcccc

SEQ ID NO: 821463 - DNA, 17 bp, Homo sapiens
ccctggtcttctctaca

SEQ ID NO: 821464 - DNA, 21 bp, Homo sapiens
ccctggtgacctcctgtcact

SEQ ID NO: 821465 - DNA, 21 bp, Homo sapiens
ccctggtgcctctgtgcacag

SEQ ID NO: 821466 - DNA, 15 bp, Homo sapiens
ccctggtgctcctgc

SEQ ID NO: 821467 - DNA, 13 bp, Homo sapiens
ccctggtgctgcc

SEQ ID NO: 821468 - DNA, 18 bp, Homo sapiens
ccctggtggacagtcctg

SEQ ID NO: 821469 - DNA, 23 bp, Homo sapiens
ccctggtggacagtcctgggaga

SEQ ID NO: 821470 - DNA, 17 bp, Homo sapiens
ccctggtgtcaggcagg

SEQ ID NO: 821471 - DNA, 14 bp, Homo sapiens
ccctggtgtgtttc

SEQ ID NO: 821472 - DNA, 18 bp, Homo sapiens
ccctggttatattctcac

SEQ ID NO: 821473 - DNA, 16 bp, Homo sapiens
ccctggttgcctctct

SEQ ID NO: 821474 - DNA, 18 bp, Homo sapiens
ccctggttgcctctcttg

SEQ ID NO: 821475 - DNA, 20 bp, Homo sapiens
ccctgtacagtgttaccatc

SEQ ID NO: 821476 - DNA, 14 bp, Homo sapiens
ccctgtacccaccc

SEQ ID NO: 821477 - DNA, 17 bp, Homo sapiens
ccctgtacccaccccag

SEQ ID NO: 821478 - DNA, 16 bp, Homo sapiens
ccctgtacccagctcc

SEQ ID NO: 821479 - DNA, 13 bp, Homo sapiens
ccctgtagctcag

SEQ ID NO: 821480 - DNA, 13 bp, Homo sapiens
ccctgtagctctg

SEQ ID NO: 821481 - DNA, 19 bp, Homo sapiens
ccctgtagggaaaccttgg

SEQ ID NO: 821482 - DNA, 12 bp, Homo sapiens
cccttgctgccc

SEQ ID NO: 821483 - DNA, 15 bp, Homo sapiens
cccttgctgtgaatt

SEQ ID NO: 821484 - DNA, 17 bp, Homo sapiens
cccttgctttcctgggc

SEQ ID NO: 821485 - DNA, 22 bp, Homo sapiens
cccttgctttcctgggcctttg

SEQ ID NO: 821486 - DNA, 19 bp, Homo sapiens
cccttgctttgttttaata

SEQ ID NO: 821487 - DNA, 14 bp, Homo sapiens
cccttgcttttccc

SEQ ID NO: 821488 - DNA, 18 bp, Homo sapiens
cccttgcttttccctctt

SEQ ID NO: 821489 - DNA, 18 bp, Homo sapiens
cccttggaaacctgccct

SEQ ID NO: 821490 - DNA, 19 bp, Homo sapiens
cccttggaaacctgccctg

SEQ ID NO: 821491 - DNA, 18 bp, Homo sapiens
cccttggagctgccgtgc

SEQ ID NO: 821492 - DNA, 15 bp, Homo sapiens
cccttggagggagag

SEQ ID NO: 821493 - DNA, 20 bp, Homo sapiens
cccttggagggagaggtggc

SEQ ID NO: 821494 - DNA, 15 bp, Homo sapiens
cccttggccccagag

SEQ ID NO: 821495 - DNA, 14 bp, Homo sapiens
cccttggcttcctc

SEQ ID NO: 821496 - DNA, 16 bp, Homo sapiens
cccttgggacagccag

SEQ ID NO: 821497 - DNA, 15 bp, Homo sapiens
cccttgggcatccac

SEQ ID NO: 821498 - DNA, 23 bp, Homo sapiens
cccttgggcatccacccagtgct

SEQ ID NO: 821499 - DNA, 20 bp, Homo sapiens
cccttggggaagggtgggga

SEQ ID NO: 821500 - DNA, 23 bp, Homo sapiens
cccttggggaagggtggggagaa

SEQ ID NO: 821501 - DNA, 14 bp, Homo sapiens
cccttggggcctgg

SEQ ID NO: 821502 - DNA, 16 bp, Homo sapiens
cccttggggcctggct

SEQ ID NO: 821503 - DNA, 17 bp, Homo sapiens
cccttggggcctggctt

SEQ ID NO: 821504 - DNA, 23 bp, Homo sapiens
cccttggggcctggcttgctcca

SEQ ID NO: 821505 - DNA, 15 bp, Homo sapiens
cccttgggttctgat

SEQ ID NO: 821506 - DNA, 19 bp, Homo sapiens
cccttggtagcagcctggg

SEQ ID NO: 821507 - DNA, 22 bp, Homo sapiens
cccttgtacagtgtctgtgcca

SEQ ID NO: 821508 - DNA, 21 bp, Homo sapiens
cccttgtattttgttaaagct

SEQ ID NO: 821509 - DNA, 14 bp, Homo sapiens
cccttgtcctgcca

SEQ ID NO: 821510 - DNA, 21 bp, Homo sapiens
cccttgtcctgccagctgcct

SEQ ID NO: 821511 - DNA, 22 bp, Homo sapiens
cccttgtcctgccagctgcctt

SEQ ID NO: 821512 - DNA, 16 bp, Homo sapiens
cccttgtctccctggt

SEQ ID NO: 821513 - DNA, 14 bp, Homo sapiens
cccttgtcttcccc

SEQ ID NO: 821514 - DNA, 20 bp, Homo sapiens
cccttgtcttcccccctctc

SEQ ID NO: 821515 - DNA, 19 bp, Homo sapiens
cccttgtgtgtgccctggg

SEQ ID NO: 821516 - DNA, 14 bp, Homo sapiens
cccttgttgcactg

SEQ ID NO: 821517 - DNA, 17 bp, Homo sapiens
cccttgttgcactgccc

SEQ ID NO: 821518 - DNA, 19 bp, Homo sapiens
cccttgttgcactgccccc

SEQ ID NO: 821519 - DNA, 21 bp, Homo sapiens
cccttgttgcactgccccctg

SEQ ID NO: 821520 - DNA, 20 bp, Homo sapiens
ccctttcatagagaggcctg

SEQ ID NO: 821521 - DNA, 21 bp, Homo sapiens
ccctttcatcggtgcctggta

SEQ ID NO: 821522 - DNA, 14 bp, Homo sapiens
ccctttcccgggct

SEQ ID NO: 821523 - DNA, 20 bp, Homo sapiens
ccctttcctaggcccaggcc

SEQ ID NO: 821524 - DNA, 20 bp, Homo sapiens
ccctttcctccccatacaca

SEQ ID NO: 821525 - DNA, 23 bp, Homo sapiens
ccctttcctccccatacacacac

SEQ ID NO: 821526 - DNA, 17 bp, Homo sapiens
ccctttcctcctcaggc

SEQ ID NO: 821527 - DNA, 12 bp, Homo sapiens
ccctttcctgtc

SEQ ID NO: 821528 - DNA, 20 bp, Homo sapiens
ccctttccttcactgcccca

SEQ ID NO: 821529 - DNA, 15 bp, Homo sapiens
ccctttccttccatc

SEQ ID NO: 821530 - DNA, 17 bp, Homo sapiens
ccctttctagaccaata

SEQ ID NO: 821531 - DNA, 17 bp, Homo sapiens
ccctttcttggccagtt

SEQ ID NO: 821532 - DNA, 15 bp, Homo sapiens
ccctttgaagcctca

SEQ ID NO: 821533 - DNA, 18 bp, Homo sapiens
ccctttgagatctgggga

SEQ ID NO: 821534 - DNA, 19 bp, Homo sapiens
ccctttgagatctggggag

SEQ ID NO: 821535 - DNA, 12 bp, Homo sapiens
ccctttgagtgc

SEQ ID NO: 821536 - DNA, 16 bp, Homo sapiens
ccctttgcctctgtcc

SEQ ID NO: 821537 - DNA, 14 bp, Homo sapiens
ccctttgccttcat

SEQ ID NO: 821538 - DNA, 22 bp, Homo sapiens
ccctttgctctgatttccttcc

SEQ ID NO: 821539 - DNA, 13 bp, Homo sapiens
ccctttgctctgg

SEQ ID NO: 821540 - DNA, 16 bp, Homo sapiens
ccctttggcactggat

SEQ ID NO: 821541 - DNA, 18 bp, Homo sapiens
ccctttggccaacagggt

SEQ ID NO: 821542 - DNA, 15 bp, Homo sapiens
ccctttgtattataa

SEQ ID NO: 821543 - DNA, 18 bp, Homo sapiens
cccttttcctttctggcc

SEQ ID NO: 821544 - DNA, 16 bp, Homo sapiens
cccttttctacagtta

SEQ ID NO: 821545 - DNA, 13 bp, Homo sapiens
cccttttctatgt

SEQ ID NO: 821546 - DNA, 14 bp, Homo sapiens
cccttttctcccca

SEQ ID NO: 821547 - DNA, 15 bp, Homo sapiens
cccttttctctgctc

SEQ ID NO: 821548 - DNA, 17 bp, Homo sapiens
cccttttctctgctctt

SEQ ID NO: 821549 - DNA, 13 bp, Homo sapiens
cccttttctgatc

SEQ ID NO: 821550 - DNA, 14 bp, Homo sapiens
cccttttctttgac

SEQ ID NO: 821551 - DNA, 23 bp, Homo sapiens
cccttttcttttctaccctagcc

SEQ ID NO: 821552 - DNA, 15 bp, Homo sapiens
cccttttgcctggct

SEQ ID NO: 821553 - DNA, 21 bp, Homo sapiens
ccctttttatgtgggatatag

SEQ ID NO: 821554 - DNA, 17 bp, Homo sapiens
ccgaaaaatcctcttcc

SEQ ID NO: 821555 - DNA, 11 bp, Homo sapiens
ccgaaaaatgt

SEQ ID NO: 821556 - DNA, 24 bp, Homo sapiens
ccgaaacaggctactctcctcggc

SEQ ID NO: 821557 - DNA, 15 bp, Homo sapiens
ccgaaagaagacaca

SEQ ID NO: 821558 - DNA, 17 bp, Homo sapiens
ccgaaagcatcactgcc

SEQ ID NO: 821559 - DNA, 19 bp, Homo sapiens
ccgaaagcatcactgcctt

SEQ ID NO: 821560 - DNA, 23 bp, Homo sapiens
ccgaaaggcaattatatctatta

SEQ ID NO: 821561 - DNA, 16 bp, Homo sapiens
ccgaaatcagccccca

SEQ ID NO: 821562 - DNA, 19 bp, Homo sapiens
ccgaaatcagcccccagcc

SEQ ID NO: 821563 - DNA, 17 bp, Homo sapiens
ccgaagcccaggggccg

SEQ ID NO: 821564 - DNA, 16 bp, Homo sapiens
ccgaagccccttggag

SEQ ID NO: 821565 - DNA, 20 bp, Homo sapiens
ccgaatatattactgattta

SEQ ID NO: 821566 - DNA, 19 bp, Homo sapiens
ccgaatcccctccctgtca

SEQ ID NO: 821567 - DNA, 16 bp, Homo sapiens
ccgaatctctttccct

SEQ ID NO: 821568 - DNA, 23 bp, Homo sapiens
ccgaatctctttttgctttcgaa

SEQ ID NO: 821569 - DNA, 19 bp, Homo sapiens
ccgaatgactatgtccaga

SEQ ID NO: 821570 - DNA, 13 bp, Homo sapiens
ccgaatgtgcagg

SEQ ID NO: 821571 - DNA, 15 bp, Homo sapiens
ccgacaaccgatgct

SEQ ID NO: 821572 - DNA, 14 bp, Homo sapiens
ccgacagcctggca

SEQ ID NO: 821573 - DNA, 15 bp, Homo sapiens
ccgacagcctggcac

SEQ ID NO: 821574 - DNA, 12 bp, Homo sapiens
ccgacaggtggg

SEQ ID NO: 821575 - DNA, 17 bp, Homo sapiens
ccgacagtggctctcca

SEQ ID NO: 821576 - DNA, 14 bp, Homo sapiens
ccgacattgtctcc

SEQ ID NO: 821577 - DNA, 14 bp, Homo sapiens
ccgaccaactgccc

SEQ ID NO: 821578 - DNA, 15 bp, Homo sapiens
ccgaccaatccccag

SEQ ID NO: 821579 - DNA, 17 bp, Homo sapiens
ccgaccacttccagggg

SEQ ID NO: 821580 - DNA, 17 bp, Homo sapiens
ccgaccatcgtccagcc

SEQ ID NO: 821581 - DNA, 18 bp, Homo sapiens
ccgaccatcgtccagccc

SEQ ID NO: 821582 - DNA, 20 bp, Homo sapiens
ccgaccatcgtccagccctc

SEQ ID NO: 821583 - DNA, 13 bp, Homo sapiens
ccgacccagccag

SEQ ID NO: 821584 - DNA, 16 bp, Homo sapiens
ccgaccccgggccgga

SEQ ID NO: 821585 - DNA, 18 bp, Homo sapiens
ccgaccctcctggccttc

SEQ ID NO: 821586 - DNA, 19 bp, Homo sapiens
ccgaccctctgggaacctc

SEQ ID NO: 821587 - DNA, 16 bp, Homo sapiens
ccgaccctgcggcctc

SEQ ID NO: 821588 - DNA, 19 bp, Homo sapiens
ccgaccgaggctggagctg

SEQ ID NO: 821589 - DNA, 15 bp, Homo sapiens
ccgacctcagccttc

SEQ ID NO: 821590 - DNA, 19 bp, Homo sapiens
ccgacctcgtcctccccct

SEQ ID NO: 821591 - DNA, 23 bp, Homo sapiens
ccgacctcgtcctccccctgcca

SEQ ID NO: 821592 - DNA, 19 bp, Homo sapiens
ccgacctctctcagcccca

SEQ ID NO: 821593 - DNA, 13 bp, Homo sapiens
ccgacctggccgc

SEQ ID NO: 821594 - DNA, 17 bp, Homo sapiens
ccgacgcgtctcctgtt

SEQ ID NO: 821595 - DNA, 13 bp, Homo sapiens
ccgacggcctcca

SEQ ID NO: 821596 - DNA, 18 bp, Homo sapiens
ccgacggcctccaggagg

SEQ ID NO: 821597 - DNA, 20 bp, Homo sapiens
ccgacggcctccaggagggg

SEQ ID NO: 821598 - DNA, 22 bp, Homo sapiens
ccgacggcctccaggaggggcc

SEQ ID NO: 821599 - DNA, 12 bp, Homo sapiens
ccgactccagcc

SEQ ID NO: 821600 - DNA, 13 bp, Homo sapiens
ccgactcccccaa

SEQ ID NO: 821601 - DNA, 21 bp, Homo sapiens
ccgactccctgagtctggacc

SEQ ID NO: 821602 - DNA, 12 bp, Homo sapiens
ccgactgaccct

SEQ ID NO: 821603 - DNA, 15 bp, Homo sapiens
ccgactgaccctgag

SEQ ID NO: 821604 - DNA, 22 bp, Homo sapiens
ccgctcccacctagtgccccag

SEQ ID NO: 821605 - DNA, 13 bp, Homo sapiens
ccgctccccagcc

SEQ ID NO: 821606 - DNA, 20 bp, Homo sapiens
ccgctcccctctcctccgcc

SEQ ID NO: 821607 - DNA, 13 bp, Homo sapiens
ccgctccctggat

SEQ ID NO: 821608 - DNA, 21 bp, Homo sapiens
ccgctccgtctctgtcctcga

SEQ ID NO: 821609 - DNA, 21 bp, Homo sapiens
ccgctcctccctgctcctcat

SEQ ID NO: 821610 - DNA, 14 bp, Homo sapiens
ccgctcctgcttcc

SEQ ID NO: 821611 - DNA, 15 bp, Homo sapiens
ccgctcctgcttccc

SEQ ID NO: 821612 - DNA, 16 bp, Homo sapiens
ccgctcgatgcctttg

SEQ ID NO: 821613 - DNA, 18 bp, Homo sapiens
ccgctctacatcttctgc

SEQ ID NO: 821614 - DNA, 20 bp, Homo sapiens
ccgctctacatcttctgcct

SEQ ID NO: 821615 - DNA, 14 bp, Homo sapiens
ccgctctcttcctg

SEQ ID NO: 821616 - DNA, 15 bp, Homo sapiens
ccgctctcttcctgc

SEQ ID NO: 821617 - DNA, 16 bp, Homo sapiens
ccgctctcttcctgcc

SEQ ID NO: 821618 - DNA, 19 bp, Homo sapiens
ccgctctcttcctgcccct

SEQ ID NO: 821619 - DNA, 18 bp, Homo sapiens
ccgctctgaggcaacccc

SEQ ID NO: 821620 - DNA, 13 bp, Homo sapiens
ccgctgagcttgg

SEQ ID NO: 821621 - DNA, 18 bp, Homo sapiens
ccgctgaggggtctcgga

SEQ ID NO: 821622 - DNA, 18 bp, Homo sapiens
ccgctgcaatgcctagac

SEQ ID NO: 821623 - DNA, 13 bp, Homo sapiens
ccgctgcaccacg

SEQ ID NO: 821624 - DNA, 15 bp, Homo sapiens
ccgctgcaccacggc

SEQ ID NO: 821625 - DNA, 15 bp, Homo sapiens
ccgctgcaggaaaca

SEQ ID NO: 821626 - DNA, 20 bp, Homo sapiens
ccgctgccaccacgtctgcc

SEQ ID NO: 821627 - DNA, 14 bp, Homo sapiens
ccgctgccacccac

SEQ ID NO: 821628 - DNA, 20 bp, Homo sapiens
ccgctgccacccacctccct

SEQ ID NO: 821629 - DNA, 15 bp, Homo sapiens
ccgctgccagccttg

SEQ ID NO: 821630 - DNA, 16 bp, Homo sapiens
ccgctgccctttggcc

SEQ ID NO: 821631 - DNA, 17 bp, Homo sapiens
ccgctgccctttggcca

SEQ ID NO: 821632 - DNA, 19 bp, Homo sapiens
ccgctgcctaagtggctgc

SEQ ID NO: 821633 - DNA, 13 bp, Homo sapiens
ccgctgcctcctg

SEQ ID NO: 821634 - DNA, 14 bp, Homo sapiens
ccgctgcctcttgg

SEQ ID NO: 821635 - DNA, 23 bp, Homo sapiens
ccgctgcctcttggcttctcagc

SEQ ID NO: 821636 - DNA, 11 bp, Homo sapiens
ccgctgctgct

SEQ ID NO: 821637 - DNA, 14 bp, Homo sapiens
ccgctgctgtgctc

SEQ ID NO: 821638 - DNA, 21 bp, Homo sapiens
ccgctgctgtgctctggggat

SEQ ID NO: 821639 - DNA, 17 bp, Homo sapiens
ccgctggagcccacagc

SEQ ID NO: 821640 - DNA, 21 bp, Homo sapiens
ccgctggagcccacagcgagc

SEQ ID NO: 821641 - DNA, 23 bp, Homo sapiens
ccgctggagcccacagcgagcct

SEQ ID NO: 821642 - DNA, 14 bp, Homo sapiens
ccgctggcccttag

SEQ ID NO: 821643 - DNA, 19 bp, Homo sapiens
ccgctgggctgagccccta

SEQ ID NO: 821644 - DNA, 21 bp, Homo sapiens
ccgctgggctgagcccctacc

SEQ ID NO: 821645 - DNA, 22 bp, Homo sapiens
ccgctgtcaaggccgagggcca

SEQ ID NO: 821646 - DNA, 15 bp, Homo sapiens
ccgctgtcgccccag

SEQ ID NO: 821647 - DNA, 20 bp, Homo sapiens
ccgctgtcgccccaggccct

SEQ ID NO: 821648 - DNA, 17 bp, Homo sapiens
ccgctgtgtcctccctc

SEQ ID NO: 821649 - DNA, 19 bp, Homo sapiens
ccgctgtgtcctccctccc

SEQ ID NO: 821650 - DNA, 16 bp, Homo sapiens
ccgctgttcacccaca

SEQ ID NO: 821651 - DNA, 21 bp, Homo sapiens
ccgctgttcacccacagggct

SEQ ID NO: 821652 - DNA, 18 bp, Homo sapiens
ccgcttagcgctctggac

SEQ ID NO: 821653 - DNA, 14 bp, Homo sapiens
ccgcttcacccctg

SEQ ID NO: 821654 - DNA, 17 bp, Homo sapiens
ccgcttcacccctgcac

SEQ ID NO: 821655 - DNA, 19 bp, Homo sapiens
ccgcttgaaaagctagtgt

SEQ ID NO: 821656 - DNA, 23 bp, Homo sapiens
ccgcttgtggggacccaggctcc

SEQ ID NO: 821657 - DNA, 15 bp, Homo sapiens
ccgcttttgcagcag

SEQ ID NO: 821658 - DNA, 23 bp, Homo sapiens
ccgcttttgcagcagaggagctg

SEQ ID NO: 821659 - DNA, 14 bp, Homo sapiens
ccggaatagagcct

SEQ ID NO: 821660 - DNA, 16 bp, Homo sapiens
ccggaatagagcctcg

SEQ ID NO: 821661 - DNA, 19 bp, Homo sapiens
ccggacaggtggggcctca

SEQ ID NO: 821662 - DNA, 20 bp, Homo sapiens
ccggacccccgtcagctgct

SEQ ID NO: 821663 - DNA, 15 bp, Homo sapiens
ccggacctacctccc

SEQ ID NO: 821664 - DNA, 22 bp, Homo sapiens
ccggactcaccaacttgccaca

SEQ ID NO: 821665 - DNA, 16 bp, Homo sapiens
ccggacttttctgcaa

SEQ ID NO: 821666 - DNA, 14 bp, Homo sapiens
ccggagaggaccgg

SEQ ID NO: 821667 - DNA, 17 bp, Homo sapiens
ccggagatgtagcaaaa

SEQ ID NO: 821668 - DNA, 18 bp, Homo sapiens
ccggagcaaactctgctg

SEQ ID NO: 821669 - DNA, 16 bp, Homo sapiens
ccggagcagcaggaag

SEQ ID NO: 821670 - DNA, 23 bp, Homo sapiens
ccggagcctcatgttctcttccc

SEQ ID NO: 821671 - DNA, 19 bp, Homo sapiens
ccggagctaacactggccc

SEQ ID NO: 821672 - DNA, 20 bp, Homo sapiens
ccggagctaacactggcccc

SEQ ID NO: 821673 - DNA, 15 bp, Homo sapiens
ccggagctttcaaag

SEQ ID NO: 821674 - DNA, 16 bp, Homo sapiens
ccggaggactgagccc

SEQ ID NO: 821675 - DNA, 17 bp, Homo sapiens
ccggaggactgagcccc

SEQ ID NO: 821676 - DNA, 17 bp, Homo sapiens
ccggagggaggcactag

SEQ ID NO: 821677 - DNA, 15 bp, Homo sapiens
ccggaggggacccag

SEQ ID NO: 821678 - DNA, 16 bp, Homo sapiens
ccggaggggacccagc

SEQ ID NO: 821679 - DNA, 21 bp, Homo sapiens
ccggatcagagcaggacctcc

SEQ ID NO: 821680 - DNA, 17 bp, Homo sapiens
ccggcaaccccagttct

SEQ ID NO: 821681 - DNA, 21 bp, Homo sapiens
ccggcaaccccagttctgctc

SEQ ID NO: 821682 - DNA, 15 bp, Homo sapiens
ccggcaagccacagg

SEQ ID NO: 821683 - DNA, 13 bp, Homo sapiens
ccggcagaaggga

SEQ ID NO: 821684 - DNA, 17 bp, Homo sapiens
ccggcaggcctgagaat

SEQ ID NO: 821685 - DNA, 21 bp, Homo sapiens
ccggcagggcgggcagagggc

SEQ ID NO: 821686 - DNA, 23 bp, Homo sapiens
ccggcagggcgggcagagggctg

SEQ ID NO: 821687 - DNA, 18 bp, Homo sapiens
ccggcatccttgcctgtc

SEQ ID NO: 821688 - DNA, 18 bp, Homo sapiens
ccggcatgtttccagcag

SEQ ID NO: 821689 - DNA, 16 bp, Homo sapiens
ccggccaatggaaacc

SEQ ID NO: 821690 - DNA, 20 bp, Homo sapiens
ccggcccagagaccccttcc

SEQ ID NO: 821691 - DNA, 12 bp, Homo sapiens
ccggcccagatg

SEQ ID NO: 821692 - DNA, 12 bp, Homo sapiens
ccggcccagtgc

SEQ ID NO: 821693 - DNA, 15 bp, Homo sapiens
ccggcccagtgccag

SEQ ID NO: 821694 - DNA, 13 bp, Homo sapiens
ccggccccacccc

SEQ ID NO: 821695 - DNA, 14 bp, Homo sapiens
ccggccccagccag

SEQ ID NO: 821696 - DNA, 23 bp, Homo sapiens
ccggccccccctcttttggcctt

SEQ ID NO: 821697 - DNA, 23 bp, Homo sapiens
ccggccccctccccccagactct

SEQ ID NO: 821698 - DNA, 19 bp, Homo sapiens
ccggccccggccccagcca

SEQ ID NO: 821699 - DNA, 20 bp, Homo sapiens
ccggcccctcaccctctgtc

SEQ ID NO: 821700 - DNA, 12 bp, Homo sapiens
ccggcccctggc

SEQ ID NO: 821701 - DNA, 14 bp, Homo sapiens
ccggcccctggcag

SEQ ID NO: 821702 - DNA, 15 bp, Homo sapiens
ccggcccgcctgccc

SEQ ID NO: 821703 - DNA, 12 bp, Homo sapiens
ccggccctcact

SEQ ID NO: 821704 - DNA, 18 bp, Homo sapiens
ccggccctcccccagctc

SEQ ID NO: 821705 - DNA, 20 bp, Homo sapiens
ccggccctcccccagctcct

SEQ ID NO: 821706 - DNA, 21 bp, Homo sapiens
ccggccctcccccagctcctt

SEQ ID NO: 821707 - DNA, 21 bp, Homo sapiens
ccggccctcctaccctgcgcc

SEQ ID NO: 821708 - DNA, 20 bp, Homo sapiens
ccggccgccttctcccctct

SEQ ID NO: 821709 - DNA, 23 bp, Homo sapiens
ccggccgccttctcccctctccc

SEQ ID NO: 821710 - DNA, 12 bp, Homo sapiens
ccggcctctctg

SEQ ID NO: 821711 - DNA, 15 bp, Homo sapiens
ccggcctctctggcc

SEQ ID NO: 821712 - DNA, 20 bp, Homo sapiens
ccggcctctctggcctccca

SEQ ID NO: 821713 - DNA, 17 bp, Homo sapiens
ccggcctctgctgcccc

SEQ ID NO: 821714 - DNA, 18 bp, Homo sapiens
ccggcctctgctgccccc

SEQ ID NO: 821715 - DNA, 20 bp, Homo sapiens
ccggcctgctcccagcagcc

SEQ ID NO: 821716 - DNA, 20 bp, Homo sapiens
ccggcctgtgggtctctgaa

SEQ ID NO: 821717 - DNA, 16 bp, Homo sapiens
ccggcgagggggccgg

SEQ ID NO: 821718 - DNA, 21 bp, Homo sapiens
ccggcgagggggccgggggga

SEQ ID NO: 821719 - DNA, 23 bp, Homo sapiens
ccggcgagggggccggggggagg

SEQ ID NO: 821720 - DNA, 13 bp, Homo sapiens
ccggcgccccgca

SEQ ID NO: 821721 - DNA, 13 bp, Homo sapiens
ccggcgccgggca

SEQ ID NO: 821722 - DNA, 22 bp, Homo sapiens
ccggcgcctgccctgcccaagt

SEQ ID NO: 821723 - DNA, 19 bp, Homo sapiens
ccggcgctgattcctcgtg

SEQ ID NO: 821724 - DNA, 15 bp, Homo sapiens
ccggcgctgcaggta

SEQ ID NO: 821725 - DNA, 12 bp, Homo sapiens
ccggcggctctg

SEQ ID NO: 821726 - DNA, 14 bp, Homo sapiens
ccggtgtccctgga

SEQ ID NO: 821727 - DNA, 15 bp, Homo sapiens
ccggtgtgcctgcag

SEQ ID NO: 821728 - DNA, 16 bp, Homo sapiens
ccggtgtgcctgcagc

SEQ ID NO: 821729 - DNA, 18 bp, Homo sapiens
ccggttattcgcccaccc

SEQ ID NO: 821730 - DNA, 15 bp, Homo sapiens
ccggttcaggaccac

SEQ ID NO: 821731 - DNA, 20 bp, Homo sapiens
ccggttcttccagtggtttg

SEQ ID NO: 821732 - DNA, 17 bp, Homo sapiens
ccggttgcagtcactgt

SEQ ID NO: 821733 - DNA, 19 bp, Homo sapiens
ccggttgcagtcactgtga

SEQ ID NO: 821734 - DNA, 15 bp, Homo sapiens
ccggttgctggtcag

SEQ ID NO: 821735 - DNA, 20 bp, Homo sapiens
ccggtttcgaagttgatgca

SEQ ID NO: 821736 - DNA, 21 bp, Homo sapiens
ccggtttcgaagttgatgcaa

SEQ ID NO: 821737 - DNA, 16 bp, Homo sapiens
ccgtaacccaccccca

SEQ ID NO: 821738 - DNA, 13 bp, Homo sapiens
ccgtaatttaact

SEQ ID NO: 821739 - DNA, 13 bp, Homo sapiens
ccgtaccccaccc

SEQ ID NO: 821740 - DNA, 14 bp, Homo sapiens
ccgtacctgtcatg

SEQ ID NO: 821741 - DNA, 23 bp, Homo sapiens
ccgtactaggttggacagccccc

SEQ ID NO: 821742 - DNA, 13 bp, Homo sapiens
ccgtactccctgc

SEQ ID NO: 821743 - DNA, 17 bp, Homo sapiens
ccgtactcggcttcctg

SEQ ID NO: 821744 - DNA, 12 bp, Homo sapiens
ccgtactctcac

SEQ ID NO: 821745 - DNA, 15 bp, Homo sapiens
ccgtaggcagcctct

SEQ ID NO: 821746 - DNA, 21 bp, Homo sapiens
ccgtaggcagcctctctgcta

SEQ ID NO: 821747 - DNA, 15 bp, Homo sapiens
ccgtagggtctttct

SEQ ID NO: 821748 - DNA, 20 bp, Homo sapiens
ccgtagggtctttcttggga

SEQ ID NO: 821749 - DNA, 22 bp, Homo sapiens
ccgtagtatcagagatgtccat

SEQ ID NO: 821750 - DNA, 15 bp, Homo sapiens
ccgtatacttaaaat

SEQ ID NO: 821751 - DNA, 18 bp, Homo sapiens
ccgtataggatgtcagac

SEQ ID NO: 821752 - DNA, 15 bp, Homo sapiens
ccgtatcacagtgtt

SEQ ID NO: 821753 - DNA, 21 bp, Homo sapiens
ccgtatctgcagaatgggcca

SEQ ID NO: 821754 - DNA, 15 bp, Homo sapiens
ccgtcaccaccaccc

SEQ ID NO: 821755 - DNA, 20 bp, Homo sapiens
ccgtcaccaccacccctacc

SEQ ID NO: 821756 - DNA, 19 bp, Homo sapiens
ccgtcaccacgactggcca

SEQ ID NO: 821757 - DNA, 21 bp, Homo sapiens
ccgtcaccacgactggccagg

SEQ ID NO: 821758 - DNA, 19 bp, Homo sapiens
ccgtcacgctttcatgacc

SEQ ID NO: 821759 - DNA, 17 bp, Homo sapiens
ccgtcagccaaatgtaa

SEQ ID NO: 821760 - DNA, 13 bp, Homo sapiens
ccgtcagggagag

SEQ ID NO: 821761 - DNA, 21 bp, Homo sapiens
ccgtcagggagaggtcaccag

SEQ ID NO: 821762 - DNA, 12 bp, Homo sapiens
ccgtcagggccc

SEQ ID NO: 821763 - DNA, 17 bp, Homo sapiens
ccgtcatgttcctcaaa

SEQ ID NO: 821764 - DNA, 14 bp, Homo sapiens
ccgtcattgctgct

SEQ ID NO: 821765 - DNA, 14 bp, Homo sapiens
ccgtccacccaggc

SEQ ID NO: 821766 - DNA, 15 bp, Homo sapiens
ccgtccacccaggct

SEQ ID NO: 821767 - DNA, 24 bp, Homo sapiens
ccgtccacccaggctgcactgcag

SEQ ID NO: 821768 - DNA, 15 bp, Homo sapiens
ccgtccaggggagat

SEQ ID NO: 821769 - DNA, 19 bp, Homo sapiens
ccgtccatcccccttcttc

SEQ ID NO: 821770 - DNA, 20 bp, Homo sapiens
ccgtccatccgactgcccct

SEQ ID NO: 821771 - DNA, 16 bp, Homo sapiens
ccgtccatggcaccag

SEQ ID NO: 821772 - DNA, 24 bp, Homo sapiens
ccgtcccctaacccccagtcctca

SEQ ID NO: 821773 - DNA, 13 bp, Homo sapiens
ccgtcccctctcc

SEQ ID NO: 821774 - DNA, 18 bp, Homo sapiens
ccgtcccctgcagcctgg

SEQ ID NO: 821775 - DNA, 17 bp, Homo sapiens
ccgtcccgcgttcaaga

SEQ ID NO: 821776 - DNA, 13 bp, Homo sapiens
ccgtcctccctca

SEQ ID NO: 821777 - DNA, 15 bp, Homo sapiens
ccgtcctccctcagc

SEQ ID NO: 821778 - DNA, 19 bp, Homo sapiens
ccgtcctccctcagcctcc

SEQ ID NO: 821779 - DNA, 13 bp, Homo sapiens
ccgtcctgcctgt

SEQ ID NO: 821780 - DNA, 17 bp, Homo sapiens
ccgtcctgctgtccctg

SEQ ID NO: 821781 - DNA, 21 bp, Homo sapiens
ccgtcgaggggctctcagctc

SEQ ID NO: 821782 - DNA, 22 bp, Homo sapiens
ccgtcgaggggctctcagctca

SEQ ID NO: 821783 - DNA, 15 bp, Homo sapiens
ccgtcggaatggtaa

SEQ ID NO: 821784 - DNA, 18 bp, Homo sapiens
ccgtcggactgcccccag

SEQ ID NO: 821785 - DNA, 15 bp, Homo sapiens
ccgtcggagctgcct

SEQ ID NO: 821786 - DNA, 16 bp, Homo sapiens
ccgtcggagctgcctg

SEQ ID NO: 821787 - DNA, 20 bp, Homo sapiens
ccgtcggagctgcctgcagc

SEQ ID NO: 821788 - DNA, 13 bp, Homo sapiens
ccgtcgtgtgctg

SEQ ID NO: 821789 - DNA, 17 bp, Homo sapiens
ccgtctcctccctcagc

SEQ ID NO: 821790 - DNA, 16 bp, Homo sapiens
ccgtctcggccctgaa

SEQ ID NO: 821791 - DNA, 19 bp, Homo sapiens
ccgtctcggccctgaacca

SEQ ID NO: 821792 - DNA, 11 bp, Homo sapiens
ccgtctctcct

SEQ ID NO: 821793 - DNA, 14 bp, Homo sapiens
ccgtctgactccag

SEQ ID NO: 821794 - DNA, 16 bp, Homo sapiens
ccgtctgcaggggcct

SEQ ID NO: 821795 - DNA, 20 bp, Homo sapiens
ccgtctgcaggggcctggag

SEQ ID NO: 821796 - DNA, 13 bp, Homo sapiens
ccgtctgtcctca

SEQ ID NO: 821797 - DNA, 17 bp, Homo sapiens
ccgtcttcaatctctgt

SEQ ID NO: 821798 - DNA, 21 bp, Homo sapiens
ccgtcttcaatctctgttctg

SEQ ID NO: 821799 - DNA, 19 bp, Homo sapiens
ccgtctttcttttatactg

SEQ ID NO: 821800 - DNA, 15 bp, Homo sapiens
ccgtgaaccagaggg

SEQ ID NO: 821801 - DNA, 17 bp, Homo sapiens
ccgtgaagcagtgcctc

SEQ ID NO: 821802 - DNA, 20 bp, Homo sapiens
ccgtgacagactcctgagga

SEQ ID NO: 821803 - DNA, 13 bp, Homo sapiens
ccgtgacagcccg

SEQ ID NO: 821804 - DNA, 18 bp, Homo sapiens
ccgtgacagtggctgaca

SEQ ID NO: 821805 - DNA, 21 bp, Homo sapiens
ccgtgacctattcaccctcca

SEQ ID NO: 821806 - DNA, 17 bp, Homo sapiens
ccgtgatgctcaggctt

SEQ ID NO: 821807 - DNA, 23 bp, Homo sapiens
ccgtgatggagaggacagagcag

SEQ ID NO: 821808 - DNA, 24 bp, Homo sapiens
ccgtgatggagaggacagagcagg

SEQ ID NO: 821809 - DNA, 22 bp, Homo sapiens
ccgtgatttggaagagaggcac

SEQ ID NO: 821810 - DNA, 16 bp, Homo sapiens
ccgtgcagtacaggca

SEQ ID NO: 821811 - DNA, 21 bp, Homo sapiens
ccgtgcatcccccctgctcag

SEQ ID NO: 821812 - DNA, 22 bp, Homo sapiens
ccgtgcatcccccctgctcagc

SEQ ID NO: 821813 - DNA, 14 bp, Homo sapiens
ccgtgccaacccca

SEQ ID NO: 821814 - DNA, 17 bp, Homo sapiens
ccgtgccattgtactcc

SEQ ID NO: 821815 - DNA, 13 bp, Homo sapiens
ccgtgccccacct

SEQ ID NO: 821816 - DNA, 15 bp, Homo sapiens
ccgtgccccacctcc

SEQ ID NO: 821817 - DNA, 20 bp, Homo sapiens
ccgtgcccccgcctgccacc

SEQ ID NO: 821818 - DNA, 15 bp, Homo sapiens
ccgtgcccctttcct

SEQ ID NO: 821819 - DNA, 18 bp, Homo sapiens
ccgtgcccctttccttca

SEQ ID NO: 821820 - DNA, 19 bp, Homo sapiens
ccgtgcccttgcccttgga

SEQ ID NO: 821821 - DNA, 14 bp, Homo sapiens
ccgtgcctggccag

SEQ ID NO: 821822 - DNA, 15 bp, Homo sapiens
ccgtgcctggccaga

SEQ ID NO: 821823 - DNA, 16 bp, Homo sapiens
ccgtgcctggccagat

SEQ ID NO: 821824 - DNA, 14 bp, Homo sapiens
ccgtgcctgggccc

SEQ ID NO: 821825 - DNA, 14 bp, Homo sapiens
ccgtgccttcagct

SEQ ID NO: 821826 - DNA, 15 bp, Homo sapiens
ccgtgccttcagctc

SEQ ID NO: 821827 - DNA, 14 bp, Homo sapiens
ccgtgcgagctgcc

SEQ ID NO: 821828 - DNA, 16 bp, Homo sapiens
ccgtgctgacagctgc

SEQ ID NO: 821829 - DNA, 17 bp, Homo sapiens
ccgtgctgacagctgct

SEQ ID NO: 821830 - DNA, 12 bp, Homo sapiens
ccgtgctgggca

SEQ ID NO: 821831 - DNA, 18 bp, Homo sapiens
ccgtggaacattctggat

SEQ ID NO: 821832 - DNA, 17 bp, Homo sapiens
ccgtggaccttcctgcc

SEQ ID NO: 821833 - DNA, 16 bp, Homo sapiens
ccgtggaggaggaagg

SEQ ID NO: 821834 - DNA, 20 bp, Homo sapiens
ccgtggaggaggttgggagg

SEQ ID NO: 821835 - DNA, 23 bp, Homo sapiens
ccgtggattgcacgtggcctctt

SEQ ID NO: 821836 - DNA, 16 bp, Homo sapiens
ccgtggcctggcatct

SEQ ID NO: 821837 - DNA, 18 bp, Homo sapiens
ccgtggcctggcatctgt

SEQ ID NO: 821838 - DNA, 20 bp, Homo sapiens
ccgtggcctggcatctgtgt

SEQ ID NO: 821839 - DNA, 12 bp, Homo sapiens
ccgtggcctggg

SEQ ID NO: 821840 - DNA, 13 bp, Homo sapiens
ccgtggcctgggc

SEQ ID NO: 821841 - DNA, 12 bp, Homo sapiens
ccgtggctctgg

SEQ ID NO: 821842 - DNA, 13 bp, Homo sapiens
ccgtggctctggg

SEQ ID NO: 821843 - DNA, 11 bp, Homo sapiens
ccgtggcttcc

SEQ ID NO: 821844 - DNA, 14 bp, Homo sapiens
ccgtggcttcccgc

SEQ ID NO: 821845 - DNA, 18 bp, Homo sapiens
ccgtggcttggcatctgt

SEQ ID NO: 821846 - DNA, 20 bp, Homo sapiens
ccgtggcttggcatctgtgt

SEQ ID NO: 821847 - DNA, 21 bp, Homo sapiens
ccgtggcttggcatctgtgtg

SEQ ID NO: 821848 - DNA, 20 bp, Homo sapiens
ccgtgggccgtatctgtcac

SEQ ID NO: 821849 - DNA, 18 bp, Homo sapiens
cctacaagagcagcctgt

SEQ ID NO: 821850 - DNA, 21 bp, Homo sapiens
cctacaagagcagcctgtggc

SEQ ID NO: 821851 - DNA, 16 bp, Homo sapiens
cctacaataaaaagaa

SEQ ID NO: 821852 - DNA, 16 bp, Homo sapiens
cctacacacacagcct

SEQ ID NO: 821853 - DNA, 21 bp, Homo sapiens
cctacacacataccttcatgt

SEQ ID NO: 821854 - DNA, 14 bp, Homo sapiens
cctacacactgtca

SEQ ID NO: 821855 - DNA, 14 bp, Homo sapiens
cctacacaggagtc

SEQ ID NO: 821856 - DNA, 15 bp, Homo sapiens
cctacacccctgtgc

SEQ ID NO: 821857 - DNA, 17 bp, Homo sapiens
cctacagaaatactgct

SEQ ID NO: 821858 - DNA, 20 bp, Homo sapiens
cctacagaacttcagaaaga

SEQ ID NO: 821859 - DNA, 11 bp, Homo sapiens
cctacagaatt

SEQ ID NO: 821860 - DNA, 20 bp, Homo sapiens
cctacagacagacatacata

SEQ ID NO: 821861 - DNA, 23 bp, Homo sapiens
cctacagactaagaaggaaaaga

SEQ ID NO: 821862 - DNA, 16 bp, Homo sapiens
cctacagaggaggcct

SEQ ID NO: 821863 - DNA, 17 bp, Homo sapiens
cctacagaggaggcctc

SEQ ID NO: 821864 - DNA, 18 bp, Homo sapiens
cctacagaggaggcctca

SEQ ID NO: 821865 - DNA, 12 bp, Homo sapiens
cctacagcacta

SEQ ID NO: 821866 - DNA, 20 bp, Homo sapiens
cctacagcactactgggtgt

SEQ ID NO: 821867 - DNA, 22 bp, Homo sapiens
cctacagcactactgggtgtca

SEQ ID NO: 821868 - DNA, 19 bp, Homo sapiens
cctacagcctagggcagac

SEQ ID NO: 821869 - DNA, 20 bp, Homo sapiens
cctacagctttgatccctga

SEQ ID NO: 821870 - DNA, 13 bp, Homo sapiens
cctacagtacaat

SEQ ID NO: 821871 - DNA, 20 bp, Homo sapiens
cctacagtgactccctggga

SEQ ID NO: 821872 - DNA, 22 bp, Homo sapiens
cctacagtgactccctgggagc

SEQ ID NO: 821873 - DNA, 16 bp, Homo sapiens
cctacagtgtacagtc

SEQ ID NO: 821874 - DNA, 20 bp, Homo sapiens
cctacagtgttgttccctcc

SEQ ID NO: 821875 - DNA, 19 bp, Homo sapiens
cctacatgaaacagaaaca

SEQ ID NO: 821876 - DNA, 17 bp, Homo sapiens
cctacatgctttgtgaa

SEQ ID NO: 821877 - DNA, 18 bp, Homo sapiens
cctacatgctttgtgaac

SEQ ID NO: 821878 - DNA, 15 bp, Homo sapiens
cctacattccccaga

SEQ ID NO: 821879 - DNA, 12 bp, Homo sapiens
cctacattcttt

SEQ ID NO: 821880 - DNA, 17 bp, Homo sapiens
cctacattctttattct

SEQ ID NO: 821881 - DNA, 12 bp, Homo sapiens
cctaccaatgca

SEQ ID NO: 821882 - DNA, 13 bp, Homo sapiens
cctaccacagtgt

SEQ ID NO: 821883 - DNA, 15 bp, Homo sapiens
cctaccaccagggcc

SEQ ID NO: 821884 - DNA, 23 bp, Homo sapiens
cctaccactgtggccccaagagg

SEQ ID NO: 821885 - DNA, 16 bp, Homo sapiens
cctaccagcgcccgct

SEQ ID NO: 821886 - DNA, 20 bp, Homo sapiens
cctaccagcgcccgctgggc

SEQ ID NO: 821887 - DNA, 21 bp, Homo sapiens
cctaccagcgcccgctgggct

SEQ ID NO: 821888 - DNA, 22 bp, Homo sapiens
cctaccagcgcccgctgggctg

SEQ ID NO: 821889 - DNA, 20 bp, Homo sapiens
cctaccagctcctccagccc

SEQ ID NO: 821890 - DNA, 21 bp, Homo sapiens
cctaccagctcctccagccct

SEQ ID NO: 821891 - DNA, 23 bp, Homo sapiens
cctaccagctcctccagccctgc

SEQ ID NO: 821892 - DNA, 13 bp, Homo sapiens
cctaccaggactc

SEQ ID NO: 821893 - DNA, 15 bp, Homo sapiens
cctaccagttgccct

SEQ ID NO: 821894 - DNA, 19 bp, Homo sapiens
cctaccagttgccctagcc

SEQ ID NO: 821895 - DNA, 13 bp, Homo sapiens
cctacccatatcc

SEQ ID NO: 821896 - DNA, 11 bp, Homo sapiens
cctaccccaca

SEQ ID NO: 821897 - DNA, 12 bp, Homo sapiens
cctaccccacac

SEQ ID NO: 821898 - DNA, 18 bp, Homo sapiens
cctaccccacaccaggcc

SEQ ID NO: 821899 - DNA, 13 bp, Homo sapiens
cctaccccctcat

SEQ ID NO: 821900 - DNA, 19 bp, Homo sapiens
cctaccccctcctctctgc

SEQ ID NO: 821901 - DNA, 18 bp, Homo sapiens
cctacccctcttccagct

SEQ ID NO: 821902 - DNA, 14 bp, Homo sapiens
cctacccctgccct

SEQ ID NO: 821903 - DNA, 15 bp, Homo sapiens
cctacccctgccctg

SEQ ID NO: 821904 - DNA, 16 bp, Homo sapiens
cctacccctgccctgc

SEQ ID NO: 821905 - DNA, 15 bp, Homo sapiens
cctacccctggctgt

SEQ ID NO: 821906 - DNA, 22 bp, Homo sapiens
cctaccccttggaaatgtctgc

SEQ ID NO: 821907 - DNA, 23 bp, Homo sapiens
cctaccccttggaaatgtctgct

SEQ ID NO: 821908 - DNA, 22 bp, Homo sapiens
cctacccgcccgcgtccaaccc

SEQ ID NO: 821909 - DNA, 13 bp, Homo sapiens
cctaccctcccac

SEQ ID NO: 821910 - DNA, 17 bp, Homo sapiens
cctaccgagtctcttct

SEQ ID NO: 821911 - DNA, 21 bp, Homo sapiens
cctaccgagtctcttctccac

SEQ ID NO: 821912 - DNA, 23 bp, Homo sapiens
cctaccgagtctcttctccactg

SEQ ID NO: 821913 - DNA, 22 bp, Homo sapiens
cctaccgtactccctgcaccgt

SEQ ID NO: 821914 - DNA, 19 bp, Homo sapiens
cctacctcaagttcttgga

SEQ ID NO: 821915 - DNA, 12 bp, Homo sapiens
cctacctcagcc

SEQ ID NO: 821916 - DNA, 18 bp, Homo sapiens
cctacctcagcctagacc

SEQ ID NO: 821917 - DNA, 13 bp, Homo sapiens
cctacctccctcc

SEQ ID NO: 821918 - DNA, 17 bp, Homo sapiens
cctacctccctccctct

SEQ ID NO: 821919 - DNA, 14 bp, Homo sapiens
cctacctccctcct

SEQ ID NO: 821920 - DNA, 12 bp, Homo sapiens
cctacctgctgc

SEQ ID NO: 821921 - DNA, 12 bp, Homo sapiens
cctacctgcttc

SEQ ID NO: 821922 - DNA, 17 bp, Homo sapiens
cctacctggggactcct

SEQ ID NO: 821923 - DNA, 18 bp, Homo sapiens
cctacctggggactcctc

SEQ ID NO: 821924 - DNA, 15 bp, Homo sapiens
cctacctgtgcctga

SEQ ID NO: 821925 - DNA, 16 bp, Homo sapiens
cctacctgtgcctgac

SEQ ID NO: 821926 - DNA, 13 bp, Homo sapiens
cctacctgttcag

SEQ ID NO: 821927 - DNA, 17 bp, Homo sapiens
cctacctgttcagtgtc

SEQ ID NO: 821928 - DNA, 23 bp, Homo sapiens
cctacctgttcagtgtcccgggc

SEQ ID NO: 821929 - DNA, 18 bp, Homo sapiens
cctaccttactatttaaa

SEQ ID NO: 821930 - DNA, 13 bp, Homo sapiens
cctaccttgcttt

SEQ ID NO: 821931 - DNA, 13 bp, Homo sapiens
cctacgctgaaga

SEQ ID NO: 821932 - DNA, 13 bp, Homo sapiens
cctacgtccaagg

SEQ ID NO: 821933 - DNA, 24 bp, Homo sapiens
cctactacccattgttcccttcct

SEQ ID NO: 821934 - DNA, 14 bp, Homo sapiens
cctactatacatta

SEQ ID NO: 821935 - DNA, 14 bp, Homo sapiens
cctactatgtgctg

SEQ ID NO: 821936 - DNA, 17 bp, Homo sapiens
cctactatgtgctgggt

SEQ ID NO: 821937 - DNA, 21 bp, Homo sapiens
cctactatgtgctgggtgcct

SEQ ID NO: 821938 - DNA, 23 bp, Homo sapiens
cctactcaagcgggtggctctgg

SEQ ID NO: 821939 - DNA, 17 bp, Homo sapiens
cctactccactgccctg

SEQ ID NO: 821940 - DNA, 15 bp, Homo sapiens
cctactccctgcaga

SEQ ID NO: 821941 - DNA, 16 bp, Homo sapiens
cctactgaagtggctg

SEQ ID NO: 821942 - DNA, 13 bp, Homo sapiens
cctactgaatgct

SEQ ID NO: 821943 - DNA, 18 bp, Homo sapiens
cctactgagcatttgcac

SEQ ID NO: 821944 - DNA, 22 bp, Homo sapiens
cctactgcactttcccccttcc

SEQ ID NO: 821945 - DNA, 13 bp, Homo sapiens
cctactgcccaca

SEQ ID NO: 821946 - DNA, 12 bp, Homo sapiens
cctactgctgtg

SEQ ID NO: 821947 - DNA, 19 bp, Homo sapiens
cctactggacgctgccctg

SEQ ID NO: 821948 - DNA, 20 bp, Homo sapiens
cctactggggggctttggcc

SEQ ID NO: 821949 - DNA, 19 bp, Homo sapiens
cctactgtaatttgtgata

SEQ ID NO: 821950 - DNA, 14 bp, Homo sapiens
cctactgtcctgga

SEQ ID NO: 821951 - DNA, 12 bp, Homo sapiens
cctactgtgggg

SEQ ID NO: 821952 - DNA, 18 bp, Homo sapiens
cctactgtggggagagat

SEQ ID NO: 821953 - DNA, 13 bp, Homo sapiens
cctactgtgtctt

SEQ ID NO: 821954 - DNA, 17 bp, Homo sapiens
cctacttagggaagaaa

SEQ ID NO: 821955 - DNA, 20 bp, Homo sapiens
cctacttagggaagaaaaag

SEQ ID NO: 821956 - DNA, 22 bp, Homo sapiens
cctacttagggaagaaaaagca

SEQ ID NO: 821957 - DNA, 23 bp, Homo sapiens
cctacttagggaagaaaaagcaa

SEQ ID NO: 821958 - DNA, 15 bp, Homo sapiens
cctacttccaggatg

SEQ ID NO: 821959 - DNA, 15 bp, Homo sapiens
cctacttcctgtgac

SEQ ID NO: 821960 - DNA, 17 bp, Homo sapiens
cctacttctgactttac

SEQ ID NO: 821961 - DNA, 19 bp, Homo sapiens
cctacttgtgactgaaggg

SEQ ID NO: 821962 - DNA, 13 bp, Homo sapiens
cctactttcttca

SEQ ID NO: 821963 - DNA, 21 bp, Homo sapiens
cctactttgactttttgcatt

SEQ ID NO: 821964 - DNA, 13 bp, Homo sapiens
cctacttttcttt

SEQ ID NO: 821965 - DNA, 23 bp, Homo sapiens
cctagaaacccaagctcctcctc

SEQ ID NO: 821966 - DNA, 13 bp, Homo sapiens
cctagaaagccat

SEQ ID NO: 821967 - DNA, 17 bp, Homo sapiens
cctagaaagccatattc

SEQ ID NO: 821968 - DNA, 19 bp, Homo sapiens
cctagaaagccatattcca

SEQ ID NO: 821969 - DNA, 20 bp, Homo sapiens
cctagaaagccatattccag

SEQ ID NO: 821970 - DNA, 13 bp, Homo sapiens
cctagaaatatct

SEQ ID NO: 821971 - DNA, 14 bp, Homo sapiens
cctcacactgctgt

SEQ ID NO: 821972 - DNA, 15 bp, Homo sapiens
cctcacactgctgtc

SEQ ID NO: 821973 - DNA, 17 bp, Homo sapiens
cctcacactgctgtcct

SEQ ID NO: 821974 - DNA, 19 bp, Homo sapiens
cctcacactgctgtcctct

SEQ ID NO: 821975 - DNA, 15 bp, Homo sapiens
cctcacaggccccag

SEQ ID NO: 821976 - DNA, 15 bp, Homo sapiens
cctcacatcctcctg

SEQ ID NO: 821977 - DNA, 17 bp, Homo sapiens
cctcaccaaggaccttg

SEQ ID NO: 821978 - DNA, 16 bp, Homo sapiens
cctcaccacccccact

SEQ ID NO: 821979 - DNA, 13 bp, Homo sapiens
cctcacccacacc

SEQ ID NO: 821980 - DNA, 16 bp, Homo sapiens
cctcacccacccctgc

SEQ ID NO: 821981 - DNA, 19 bp, Homo sapiens
cctcacccacccctgcaca

SEQ ID NO: 821982 - DNA, 21 bp, Homo sapiens
cctcaccccaatccctgccac

SEQ ID NO: 821983 - DNA, 22 bp, Homo sapiens
cctcaccccaatccctgccact

SEQ ID NO: 821984 - DNA, 14 bp, Homo sapiens
cctcaccccagctc

SEQ ID NO: 821985 - DNA, 15 bp, Homo sapiens
cctcaccccagctcc

SEQ ID NO: 821986 - DNA, 24 bp, Homo sapiens
cctcaccccctcctggcaatcaat

SEQ ID NO: 821987 - DNA, 16 bp, Homo sapiens
cctcaccccgtctggg

SEQ ID NO: 821988 - DNA, 17 bp, Homo sapiens
cctcaccccgtctgggg

SEQ ID NO: 821989 - DNA, 22 bp, Homo sapiens
cctcacccctcgccacctttca

SEQ ID NO: 821990 - DNA, 16 bp, Homo sapiens
cctcaccctctgtccc

SEQ ID NO: 821991 - DNA, 17 bp, Homo sapiens
cctcaccctctgtcccc

SEQ ID NO: 821992 - DNA, 20 bp, Homo sapiens
cctcaccctctgtccccacg

SEQ ID NO: 821993 - DNA, 23 bp, Homo sapiens
cctcaccctgagccccttccttg

SEQ ID NO: 821994 - DNA, 14 bp, Homo sapiens
cctcaccctgtggg

SEQ ID NO: 821995 - DNA, 12 bp, Homo sapiens
cctcacctcatg

SEQ ID NO: 821996 - DNA, 23 bp, Homo sapiens
cctcacctcatgcccaccccctg

SEQ ID NO: 821997 - DNA, 14 bp, Homo sapiens
cctcacctcctcta

SEQ ID NO: 821998 - DNA, 13 bp, Homo sapiens
cctcacctctacc

SEQ ID NO: 821999 - DNA, 15 bp, Homo sapiens
cctcacctctgagga

SEQ ID NO: 822000 - DNA, 16 bp, Homo sapiens
cctcacctctgaggac

SEQ ID NO: 822001 - DNA, 18 bp, Homo sapiens
cctcacctctgaggacag

SEQ ID NO: 822002 - DNA, 18 bp, Homo sapiens
cctcacctctggactggc

SEQ ID NO: 822003 - DNA, 14 bp, Homo sapiens
cctcacctctttgt

SEQ ID NO: 822004 - DNA, 13 bp, Homo sapiens
cctcacctgcccc

SEQ ID NO: 822005 - DNA, 12 bp, Homo sapiens
cctcacctgggc

SEQ ID NO: 822006 - DNA, 14 bp, Homo sapiens
cctcacctgggcac

SEQ ID NO: 822007 - DNA, 23 bp, Homo sapiens
cctcacctgggcctttcctgtgc

SEQ ID NO: 822008 - DNA, 15 bp, Homo sapiens
cctcacctgtagcag

SEQ ID NO: 822009 - DNA, 14 bp, Homo sapiens
cctcacctgtctag

SEQ ID NO: 822010 - DNA, 17 bp, Homo sapiens
cctcaccttgcaacaca

SEQ ID NO: 822011 - DNA, 21 bp, Homo sapiens
cctcaccttgcaacacacaga

SEQ ID NO: 822012 - DNA, 19 bp, Homo sapiens
cctcacgccccctgtgact

SEQ ID NO: 822013 - DNA, 17 bp, Homo sapiens
cctcacggggttggctg

SEQ ID NO: 822014 - DNA, 20 bp, Homo sapiens
cctcacgtatttcacagagc

SEQ ID NO: 822015 - DNA, 19 bp, Homo sapiens
cctcactaaaaaggaaact

SEQ ID NO: 822016 - DNA, 21 bp, Homo sapiens
cctcactatggtatgctggcc

SEQ ID NO: 822017 - DNA, 13 bp, Homo sapiens
cctcactccacag

SEQ ID NO: 822018 - DNA, 14 bp, Homo sapiens
cctcactccctctg

SEQ ID NO: 822019 - DNA, 13 bp, Homo sapiens
cctcactcctgtt

SEQ ID NO: 822020 - DNA, 17 bp, Homo sapiens
cctcactctggcctcag

SEQ ID NO: 822021 - DNA, 14 bp, Homo sapiens
cctcactctgtcag

SEQ ID NO: 822022 - DNA, 15 bp, Homo sapiens
cctcactctgtcagc

SEQ ID NO: 822023 - DNA, 19 bp, Homo sapiens
cctcactctgtcagccagc

SEQ ID NO: 822024 - DNA, 20 bp, Homo sapiens
cctcactcttcctcatcctg

SEQ ID NO: 822025 - DNA, 20 bp, Homo sapiens
cctcactgaaaacatctgga

SEQ ID NO: 822026 - DNA, 21 bp, Homo sapiens
cctcactgagaggcctggagc

SEQ ID NO: 822027 - DNA, 20 bp, Homo sapiens
cctcactgccctccctcggc

SEQ ID NO: 822028 - DNA, 18 bp, Homo sapiens
cctcactggaggagcagc

SEQ ID NO: 822029 - DNA, 14 bp, Homo sapiens
cctcactggatgaa

SEQ ID NO: 822030 - DNA, 12 bp, Homo sapiens
cctcactggctc

SEQ ID NO: 822031 - DNA, 16 bp, Homo sapiens
cctcactggctcatgc

SEQ ID NO: 822032 - DNA, 20 bp, Homo sapiens
cctcactggctcatgcccct

SEQ ID NO: 822033 - DNA, 20 bp, Homo sapiens
cctcactggggtcctggggc

SEQ ID NO: 822034 - DNA, 13 bp, Homo sapiens
cctcactgtcagg

SEQ ID NO: 822035 - DNA, 23 bp, Homo sapiens
cctcacttacataaagctccctt

SEQ ID NO: 822036 - DNA, 14 bp, Homo sapiens
cctcacttgaatgt

SEQ ID NO: 822037 - DNA, 23 bp, Homo sapiens
cctcactttccaccaagtgtcta

SEQ ID NO: 822038 - DNA, 14 bp, Homo sapiens
cctcactttcttct

SEQ ID NO: 822039 - DNA, 18 bp, Homo sapiens
cctcacttttaatgaaca

SEQ ID NO: 822040 - DNA, 16 bp, Homo sapiens
cctcagaagcctcgac

SEQ ID NO: 822041 - DNA, 15 bp, Homo sapiens
cctcagaaggcccca

SEQ ID NO: 822042 - DNA, 18 bp, Homo sapiens
cctcagaaggccccagag

SEQ ID NO: 822043 - DNA, 21 bp, Homo sapiens
cctcagaaggccccagagaga

SEQ ID NO: 822044 - DNA, 23 bp, Homo sapiens
cctcagacgagacccaagggcag

SEQ ID NO: 822045 - DNA, 17 bp, Homo sapiens
cctcagacttaccagga

SEQ ID NO: 822046 - DNA, 19 bp, Homo sapiens
cctcagacttaccaggaag

SEQ ID NO: 822047 - DNA, 16 bp, Homo sapiens
cctcagagaagtccag

SEQ ID NO: 822048 - DNA, 15 bp, Homo sapiens
cctcagagcaggctc

SEQ ID NO: 822049 - DNA, 16 bp, Homo sapiens
cctcagagccacccct

SEQ ID NO: 822050 - DNA, 16 bp, Homo sapiens
cctcagagcccatggt

SEQ ID NO: 822051 - DNA, 20 bp, Homo sapiens
cctcagagccctgccctgca

SEQ ID NO: 822052 - DNA, 13 bp, Homo sapiens
cctcagagcctga

SEQ ID NO: 822053 - DNA, 17 bp, Homo sapiens
cctcagagcgccaggaa

SEQ ID NO: 822054 - DNA, 11 bp, Homo sapiens
cctcagagctc

SEQ ID NO: 822055 - DNA, 12 bp, Homo sapiens
cctcagagctct

SEQ ID NO: 822056 - DNA, 16 bp, Homo sapiens
cctcagaggctgagcc

SEQ ID NO: 822057 - DNA, 20 bp, Homo sapiens
cctcagaggctgagccctgt

SEQ ID NO: 822058 - DNA, 21 bp, Homo sapiens
cctcagaggctgagccctgta

SEQ ID NO: 822059 - DNA, 15 bp, Homo sapiens
cctcagagtccaggc

SEQ ID NO: 822060 - DNA, 18 bp, Homo sapiens
cctcagagtccaggcccc

SEQ ID NO: 822061 - DNA, 19 bp, Homo sapiens
cctcagagtccaggcccca

SEQ ID NO: 822062 - DNA, 21 bp, Homo sapiens
cctcagagtgcaagcccctgc

SEQ ID NO: 822063 - DNA, 19 bp, Homo sapiens
cctcagatgggaattgcac

SEQ ID NO: 822064 - DNA, 16 bp, Homo sapiens
cctcagatgtcccttg

SEQ ID NO: 822065 - DNA, 17 bp, Homo sapiens
cctcagatgtcccttga

SEQ ID NO: 822066 - DNA, 19 bp, Homo sapiens
cctcagattcaataatgag

SEQ ID NO: 822067 - DNA, 20 bp, Homo sapiens
cctcagattcaataatgaga

SEQ ID NO: 822068 - DNA, 14 bp, Homo sapiens
cctcagattgctga

SEQ ID NO: 822069 - DNA, 13 bp, Homo sapiens
cctcagatttcca

SEQ ID NO: 822070 - DNA, 15 bp, Homo sapiens
cctcagcaccccttc

SEQ ID NO: 822071 - DNA, 18 bp, Homo sapiens
cctcagcaccccttccat

SEQ ID NO: 822072 - DNA, 11 bp, Homo sapiens
cctcagcactg

SEQ ID NO: 822073 - DNA, 13 bp, Homo sapiens
cctcagccaggcc

SEQ ID NO: 822074 - DNA, 11 bp, Homo sapiens
cctcagccagt

SEQ ID NO: 822075 - DNA, 12 bp, Homo sapiens
cctcagcccaac

SEQ ID NO: 822076 - DNA, 17 bp, Homo sapiens
cctcagcccaacttctt

SEQ ID NO: 822077 - DNA, 21 bp, Homo sapiens
cctcagcccaacttcttaccc

SEQ ID NO: 822078 - DNA, 18 bp, Homo sapiens
cctcagcccccaggccag

SEQ ID NO: 822079 - DNA, 19 bp, Homo sapiens
cctcagcccccaggccagg

SEQ ID NO: 822080 - DNA, 17 bp, Homo sapiens
cctcagcccctccagtc

SEQ ID NO: 822081 - DNA, 14 bp, Homo sapiens
cctcagcccctctt

SEQ ID NO: 822082 - DNA, 18 bp, Homo sapiens
cctcagcccctcttgccc

SEQ ID NO: 822083 - DNA, 19 bp, Homo sapiens
cctcagcccgccaaggtag

SEQ ID NO: 822084 - DNA, 14 bp, Homo sapiens
cctcagccctcaga

SEQ ID NO: 822085 - DNA, 18 bp, Homo sapiens
cctcagccctgaccctgt

SEQ ID NO: 822086 - DNA, 21 bp, Homo sapiens
cctcagccctggcctttttct

SEQ ID NO: 822087 - DNA, 22 bp, Homo sapiens
cctcagcccttgcccccatccc

SEQ ID NO: 822088 - DNA, 17 bp, Homo sapiens
cctcagccgtcagccat

SEQ ID NO: 822089 - DNA, 18 bp, Homo sapiens
cctcagcctccaaagtgg

SEQ ID NO: 822090 - DNA, 22 bp, Homo sapiens
cctcagcctcccaagtagctgg

SEQ ID NO: 822091 - DNA, 17 bp, Homo sapiens
cctcagcctccccttct

SEQ ID NO: 822092 - DNA, 19 bp, Homo sapiens
cctcagcctccccttcttc

SEQ ID NO: 822093 - DNA, 14 bp, Homo sapiens
cctcagcctcctga

SEQ ID NO: 822094 - DNA, 12 bp, Homo sapiens
cctccaggacca

SEQ ID NO: 822095 - DNA, 16 bp, Homo sapiens
cctccaggaccagggg

SEQ ID NO: 822096 - DNA, 14 bp, Homo sapiens
cctccaggagagag

SEQ ID NO: 822097 - DNA, 18 bp, Homo sapiens
cctccaggagagagccag

SEQ ID NO: 822098 - DNA, 19 bp, Homo sapiens
cctccaggagagagccagg

SEQ ID NO: 822099 - DNA, 12 bp, Homo sapiens
cctccaggaggg

SEQ ID NO: 822100 - DNA, 13 bp, Homo sapiens
cctccaggagggg

SEQ ID NO: 822101 - DNA, 21 bp, Homo sapiens
cctccaggaggggcctgggca

SEQ ID NO: 822102 - DNA, 22 bp, Homo sapiens
cctccaggaggggcctgggcag

SEQ ID NO: 822103 - DNA, 23 bp, Homo sapiens
cctccaggaggggcctgggcagc

SEQ ID NO: 822104 - DNA, 16 bp, Homo sapiens
cctccagggaaggtgg

SEQ ID NO: 822105 - DNA, 14 bp, Homo sapiens
cctccagggccacg

SEQ ID NO: 822106 - DNA, 21 bp, Homo sapiens
cctccagggccacgtgccagg

SEQ ID NO: 822107 - DNA, 16 bp, Homo sapiens
cctccagggcccccca

SEQ ID NO: 822108 - DNA, 20 bp, Homo sapiens
cctccagggtggcagcaaca

SEQ ID NO: 822109 - DNA, 17 bp, Homo sapiens
cctccagggtgtgtgct

SEQ ID NO: 822110 - DNA, 15 bp, Homo sapiens
cctccagtcacactc

SEQ ID NO: 822111 - DNA, 21 bp, Homo sapiens
cctccagtcgttatttctgtt

SEQ ID NO: 822112 - DNA, 18 bp, Homo sapiens
cctccagttgtagcaggt

SEQ ID NO: 822113 - DNA, 15 bp, Homo sapiens
cctccataagtttaa

SEQ ID NO: 822114 - DNA, 23 bp, Homo sapiens
cctccatcacctgaaacactgga

SEQ ID NO: 822115 - DNA, 20 bp, Homo sapiens
cctccatccccatcggccct

SEQ ID NO: 822116 - DNA, 18 bp, Homo sapiens
cctccatccgtgctgcat

SEQ ID NO: 822117 - DNA, 15 bp, Homo sapiens
cctccatcttcattg

SEQ ID NO: 822118 - DNA, 14 bp, Homo sapiens
cctccatgctcctc

SEQ ID NO: 822119 - DNA, 19 bp, Homo sapiens
cctccatgctcctcacctg

SEQ ID NO: 822120 - DNA, 20 bp, Homo sapiens
cctccatgctcctcacctgt

SEQ ID NO: 822121 - DNA, 14 bp, Homo sapiens
cctccatgctgcct

SEQ ID NO: 822122 - DNA, 16 bp, Homo sapiens
cctccatgctgcctcc

SEQ ID NO: 822123 - DNA, 16 bp, Homo sapiens
cctccatggtcctgtc

SEQ ID NO: 822124 - DNA, 23 bp, Homo sapiens
cctccatggtcctgtctgtcctt

SEQ ID NO: 822125 - DNA, 21 bp, Homo sapiens
cctccattaaagtctgaatca

SEQ ID NO: 822126 - DNA, 20 bp, Homo sapiens
cctccattctattttagaat

SEQ ID NO: 822127 - DNA, 20 bp, Homo sapiens
cctccattgggcacagtcca

SEQ ID NO: 822128 - DNA, 21 bp, Homo sapiens
cctccatttcccaaagtcctc

SEQ ID NO: 822129 - DNA, 14 bp, Homo sapiens
cctccatttctgtc

SEQ ID NO: 822130 - DNA, 17 bp, Homo sapiens
cctccatttgagaaaat

SEQ ID NO: 822131 - DNA, 18 bp, Homo sapiens
cctcccaaagtgctggga

SEQ ID NO: 822132 - DNA, 23 bp, Homo sapiens
cctcccaaagtgctgggattaca

SEQ ID NO: 822133 - DNA, 16 bp, Homo sapiens
cctcccaaccaaccag

SEQ ID NO: 822134 - DNA, 12 bp, Homo sapiens
cctcccaactct

SEQ ID NO: 822135 - DNA, 18 bp, Homo sapiens
cctcccaagcgttcctgg

SEQ ID NO: 822136 - DNA, 15 bp, Homo sapiens
cctcccaaggtcctc

SEQ ID NO: 822137 - DNA, 11 bp, Homo sapiens
cctcccaattc

SEQ ID NO: 822138 - DNA, 16 bp, Homo sapiens
cctcccacactcccaa

SEQ ID NO: 822139 - DNA, 14 bp, Homo sapiens
cctcccaccagagc

SEQ ID NO: 822140 - DNA, 14 bp, Homo sapiens
cctcccacccccag

SEQ ID NO: 822141 - DNA, 12 bp, Homo sapiens
cctcccacccga

SEQ ID NO: 822142 - DNA, 16 bp, Homo sapiens
cctcccacggtgccca

SEQ ID NO: 822143 - DNA, 19 bp, Homo sapiens
cctcccactcccatctcct

SEQ ID NO: 822144 - DNA, 21 bp, Homo sapiens
cctcccactcccatctcctta

SEQ ID NO: 822145 - DNA, 16 bp, Homo sapiens
cctcccactgggactc

SEQ ID NO: 822146 - DNA, 13 bp, Homo sapiens
cctcccactgggg

SEQ ID NO: 822147 - DNA, 15 bp, Homo sapiens
cctcccactggggtc

SEQ ID NO: 822148 - DNA, 16 bp, Homo sapiens
cctcccacttcactgc

SEQ ID NO: 822149 - DNA, 20 bp, Homo sapiens
cctcccagaaaaactggctc

SEQ ID NO: 822150 - DNA, 21 bp, Homo sapiens
cctcccagaaacatctctggc

SEQ ID NO: 822151 - DNA, 23 bp, Homo sapiens
cctcccagacaggccctccctgt

SEQ ID NO: 822152 - DNA, 19 bp, Homo sapiens
cctcccagaggtccagccc

SEQ ID NO: 822153 - DNA, 22 bp, Homo sapiens
cctcccagaggtccagcccatc

SEQ ID NO: 822154 - DNA, 19 bp, Homo sapiens
cctcccagccctatggatg

SEQ ID NO: 822155 - DNA, 14 bp, Homo sapiens
cctcccagctgcac

SEQ ID NO: 822156 - DNA, 16 bp, Homo sapiens
cctcccagctgcttta

SEQ ID NO: 822157 - DNA, 19 bp, Homo sapiens
cctcccaggaccctccact

SEQ ID NO: 822158 - DNA, 12 bp, Homo sapiens
cctcccaggcaa

SEQ ID NO: 822159 - DNA, 18 bp, Homo sapiens
cctcccaggctcaagcta

SEQ ID NO: 822160 - DNA, 12 bp, Homo sapiens
cctcccagggcc

SEQ ID NO: 822161 - DNA, 16 bp, Homo sapiens
cctcccagggcctcct

SEQ ID NO: 822162 - DNA, 17 bp, Homo sapiens
cctcccagggcctcctg

SEQ ID NO: 822163 - DNA, 19 bp, Homo sapiens
cctcccaggggactgttcc

SEQ ID NO: 822164 - DNA, 17 bp, Homo sapiens
cctcccaggggagccag

SEQ ID NO: 822165 - DNA, 20 bp, Homo sapiens
cctcccaggggagccagctg

SEQ ID NO: 822166 - DNA, 23 bp, Homo sapiens
cctcccaggggagccagctgctt

SEQ ID NO: 822167 - DNA, 20 bp, Homo sapiens
cctcccagtctcatctcctg

SEQ ID NO: 822168 - DNA, 21 bp, Homo sapiens
cctcccagtgagactgcccca

SEQ ID NO: 822169 - DNA, 15 bp, Homo sapiens
cctcccatccagcgt

SEQ ID NO: 822170 - DNA, 17 bp, Homo sapiens
cctcccatccagcgtct

SEQ ID NO: 822171 - DNA, 19 bp, Homo sapiens
cctcccatccagcgtctgc

SEQ ID NO: 822172 - DNA, 15 bp, Homo sapiens
cctcccatcccctca

SEQ ID NO: 822173 - DNA, 14 bp, Homo sapiens
cctcccatcccctg

SEQ ID NO: 822174 - DNA, 21 bp, Homo sapiens
cctcccatctgggagtcccct

SEQ ID NO: 822175 - DNA, 23 bp, Homo sapiens
cctcccatcttggcctcccagag

SEQ ID NO: 822176 - DNA, 18 bp, Homo sapiens
cctcccatgtcactgcag

SEQ ID NO: 822177 - DNA, 19 bp, Homo sapiens
cctcccatgttgcatgcct

SEQ ID NO: 822178 - DNA, 18 bp, Homo sapiens
cctcccatttctgttgct

SEQ ID NO: 822179 - DNA, 13 bp, Homo sapiens
cctccccaaatgg

SEQ ID NO: 822180 - DNA, 21 bp, Homo sapiens
cctccccaaccctgcccctgc

SEQ ID NO: 822181 - DNA, 22 bp, Homo sapiens
cctccccaaggatgaccacacc

SEQ ID NO: 822182 - DNA, 18 bp, Homo sapiens
cctccccacacacaggcc

SEQ ID NO: 822183 - DNA, 21 bp, Homo sapiens
cctccccacacacaggccttc

SEQ ID NO: 822184 - DNA, 23 bp, Homo sapiens
cctccccacacacaggccttctg

SEQ ID NO: 822185 - DNA, 17 bp, Homo sapiens
cctccccacactccact

SEQ ID NO: 822186 - DNA, 18 bp, Homo sapiens
cctccccacactccactc

SEQ ID NO: 822187 - DNA, 12 bp, Homo sapiens
cctccccaccca

SEQ ID NO: 822188 - DNA, 16 bp, Homo sapiens
cctccccacctgtagc

SEQ ID NO: 822189 - DNA, 14 bp, Homo sapiens
cctccccaccttcc

SEQ ID NO: 822190 - DNA, 19 bp, Homo sapiens
cctccccactcctctccca

SEQ ID NO: 822191 - DNA, 12 bp, Homo sapiens
cctccccagcag

SEQ ID NO: 822192 - DNA, 14 bp, Homo sapiens
cctccccagtagct

SEQ ID NO: 822193 - DNA, 14 bp, Homo sapiens
cctccccatacaca

SEQ ID NO: 822194 - DNA, 16 bp, Homo sapiens
cctccccatacacaca

SEQ ID NO: 822195 - DNA, 18 bp, Homo sapiens
cctccccatacacacaca

SEQ ID NO: 822196 - DNA, 16 bp, Homo sapiens
cctccccatctgtcca

SEQ ID NO: 822197 - DNA, 19 bp, Homo sapiens
cctccccatgggcacagtg

SEQ ID NO: 822198 - DNA, 14 bp, Homo sapiens
cctccccatttccc

SEQ ID NO: 822199 - DNA, 21 bp, Homo sapiens
cctccccatttcccatctgca

SEQ ID NO: 822200 - DNA, 18 bp, Homo sapiens
cctcccccaaacagactc

SEQ ID NO: 822201 - DNA, 20 bp, Homo sapiens
cctcccccaacacctgctgc

SEQ ID NO: 822202 - DNA, 19 bp, Homo sapiens
cctcccccaacccccaccc

SEQ ID NO: 822203 - DNA, 15 bp, Homo sapiens
cctcccccactcctc

SEQ ID NO: 822204 - DNA, 15 bp, Homo sapiens
cctcccccactgcca

SEQ ID NO: 822205 - DNA, 14 bp, Homo sapiens
cctcccccagcaca

SEQ ID NO: 822206 - DNA, 13 bp, Homo sapiens
cctcccccagcag

SEQ ID NO: 822207 - DNA, 13 bp, Homo sapiens
cctcccccagctc

SEQ ID NO: 822208 - DNA, 19 bp, Homo sapiens
cctcccccagctccttggc

SEQ ID NO: 822209 - DNA, 11 bp, Homo sapiens
cctccccccac

SEQ ID NO: 822210 - DNA, 20 bp, Homo sapiens
cctccccccactgcaggccc

SEQ ID NO: 822211 - DNA, 14 bp, Homo sapiens
cctccccccagacc

SEQ ID NO: 822212 - DNA, 16 bp, Homo sapiens
cctcccccgccactcc

SEQ ID NO: 822213 - DNA, 17 bp, Homo sapiens
cctcccccgccactcct

SEQ ID NO: 822214 - DNA, 18 bp, Homo sapiens
cctcccccggctgggcct

SEQ ID NO: 822215 - DNA, 19 bp, Homo sapiens
cctccccctacccatatcc

SEQ ID NO: 822216 - DNA, 15 bp, Homo sapiens
cctcctctgtccagg

SEQ ID NO: 822217 - DNA, 22 bp, Homo sapiens
cctcctctgtgaccaatgtctt

SEQ ID NO: 822218 - DNA, 15 bp, Homo sapiens
cctcctcttggaatt

SEQ ID NO: 822219 - DNA, 12 bp, Homo sapiens
cctcctctttct

SEQ ID NO: 822220 - DNA, 15 bp, Homo sapiens
cctcctctttctctc

SEQ ID NO: 822221 - DNA, 21 bp, Homo sapiens
cctcctctttctctccccaac

SEQ ID NO: 822222 - DNA, 20 bp, Homo sapiens
cctcctgaaccgcacagctc

SEQ ID NO: 822223 - DNA, 22 bp, Homo sapiens
cctcctgaaccgcacagctcag

SEQ ID NO: 822224 - DNA, 15 bp, Homo sapiens
cctcctgaagcctct

SEQ ID NO: 822225 - DNA, 16 bp, Homo sapiens
cctcctgaagcctctg

SEQ ID NO: 822226 - DNA, 17 bp, Homo sapiens
cctcctgaagcctctgc

SEQ ID NO: 822227 - DNA, 13 bp, Homo sapiens
cctcctgagcctg

SEQ ID NO: 822228 - DNA, 16 bp, Homo sapiens
cctcctgagcctgtgg

SEQ ID NO: 822229 - DNA, 17 bp, Homo sapiens
cctcctgagcctgtggg

SEQ ID NO: 822230 - DNA, 16 bp, Homo sapiens
cctcctgagggaggac

SEQ ID NO: 822231 - DNA, 14 bp, Homo sapiens
cctcctgagggctc

SEQ ID NO: 822232 - DNA, 16 bp, Homo sapiens
cctcctgagggctcca

SEQ ID NO: 822233 - DNA, 20 bp, Homo sapiens
cctcctgagtgccccacttc

SEQ ID NO: 822234 - DNA, 20 bp, Homo sapiens
cctcctgatggccaagagca

SEQ ID NO: 822235 - DNA, 15 bp, Homo sapiens
cctcctgcacacagg

SEQ ID NO: 822236 - DNA, 19 bp, Homo sapiens
cctcctgcacacagggcag

SEQ ID NO: 822237 - DNA, 23 bp, Homo sapiens
cctcctgcagacacctggactga

SEQ ID NO: 822238 - DNA, 12 bp, Homo sapiens
cctcctgccacc

SEQ ID NO: 822239 - DNA, 18 bp, Homo sapiens
cctcctgccaccccttcc

SEQ ID NO: 822240 - DNA, 21 bp, Homo sapiens
cctcctgcccacgcagacctg

SEQ ID NO: 822241 - DNA, 15 bp, Homo sapiens
cctcctgcccagctc

SEQ ID NO: 822242 - DNA, 16 bp, Homo sapiens
cctcctgcccaggact

SEQ ID NO: 822243 - DNA, 21 bp, Homo sapiens
cctcctgcccaggagagccag

SEQ ID NO: 822244 - DNA, 14 bp, Homo sapiens
cctcctgccccctg

SEQ ID NO: 822245 - DNA, 18 bp, Homo sapiens
cctcctgccccctgccag

SEQ ID NO: 822246 - DNA, 23 bp, Homo sapiens
cctcctgccctgtccctgtcccc

SEQ ID NO: 822247 - DNA, 21 bp, Homo sapiens
cctcctgcggctcagccttgc

SEQ ID NO: 822248 - DNA, 11 bp, Homo sapiens
cctcctgctcc

SEQ ID NO: 822249 - DNA, 16 bp, Homo sapiens
cctcctgctcctccct

SEQ ID NO: 822250 - DNA, 18 bp, Homo sapiens
cctcctggaaccttgctg

SEQ ID NO: 822251 - DNA, 21 bp, Homo sapiens
cctcctggacattttttcagt

SEQ ID NO: 822252 - DNA, 23 bp, Homo sapiens
cctcctggagctctgtgggtctc

SEQ ID NO: 822253 - DNA, 11 bp, Homo sapiens
cctcctggcca

SEQ ID NO: 822254 - DNA, 16 bp, Homo sapiens
cctcctggccagacgc

SEQ ID NO: 822255 - DNA, 17 bp, Homo sapiens
cctcctggccagacgct

SEQ ID NO: 822256 - DNA, 22 bp, Homo sapiens
cctcctggccagacgctgccgc

SEQ ID NO: 822257 - DNA, 16 bp, Homo sapiens
cctcctggccttcctc

SEQ ID NO: 822258 - DNA, 18 bp, Homo sapiens
cctcctgggaacacatct

SEQ ID NO: 822259 - DNA, 21 bp, Homo sapiens
cctcctgggccctctctgctc

SEQ ID NO: 822260 - DNA, 14 bp, Homo sapiens
cctcctgggggctg

SEQ ID NO: 822261 - DNA, 23 bp, Homo sapiens
cctcctggtcctggacacctccc

SEQ ID NO: 822262 - DNA, 20 bp, Homo sapiens
cctcctggtttcctttctca

SEQ ID NO: 822263 - DNA, 17 bp, Homo sapiens
cctcctgtacctcagtg

SEQ ID NO: 822264 - DNA, 19 bp, Homo sapiens
cctcctgtacctcagtgga

SEQ ID NO: 822265 - DNA, 17 bp, Homo sapiens
cctcctgtcactcactg

SEQ ID NO: 822266 - DNA, 18 bp, Homo sapiens
cctcctgtctaatttgca

SEQ ID NO: 822267 - DNA, 14 bp, Homo sapiens
cctcctgtgcccca

SEQ ID NO: 822268 - DNA, 19 bp, Homo sapiens
cctcctgtgcctccctttt

SEQ ID NO: 822269 - DNA, 23 bp, Homo sapiens
cctcctgtgcctggccccagcct

SEQ ID NO: 822270 - DNA, 19 bp, Homo sapiens
cctcctgttttctccctct

SEQ ID NO: 822271 - DNA, 13 bp, Homo sapiens
cctccttcagaca

SEQ ID NO: 822272 - DNA, 15 bp, Homo sapiens
cctccttcagacacc

SEQ ID NO: 822273 - DNA, 16 bp, Homo sapiens
cctccttccacctccc

SEQ ID NO: 822274 - DNA, 18 bp, Homo sapiens
cctccttccacctccctc

SEQ ID NO: 822275 - DNA, 19 bp, Homo sapiens
cctccttccacctccctcc

SEQ ID NO: 822276 - DNA, 16 bp, Homo sapiens
cctccttccctcctgt

SEQ ID NO: 822277 - DNA, 11 bp, Homo sapiens
cctccttcctg

SEQ ID NO: 822278 - DNA, 23 bp, Homo sapiens
cctccttcctggcgggggtgggc

SEQ ID NO: 822279 - DNA, 13 bp, Homo sapiens
cctccttcctggg

SEQ ID NO: 822280 - DNA, 20 bp, Homo sapiens
cctccttccttgctgtccta

SEQ ID NO: 822281 - DNA, 17 bp, Homo sapiens
cctccttctcccttttt

SEQ ID NO: 822282 - DNA, 15 bp, Homo sapiens
cctccttgcaaccag

SEQ ID NO: 822283 - DNA, 21 bp, Homo sapiens
cctccttgcaaccaggcagct

SEQ ID NO: 822284 - DNA, 12 bp, Homo sapiens
cctccttgccta

SEQ ID NO: 822285 - DNA, 13 bp, Homo sapiens
cctccttgcctag

SEQ ID NO: 822286 - DNA, 14 bp, Homo sapiens
cctccttgctgacc

SEQ ID NO: 822287 - DNA, 21 bp, Homo sapiens
cctccttgctgaccccaggtc

SEQ ID NO: 822288 - DNA, 22 bp, Homo sapiens
cctccttgctgaccccaggtca

SEQ ID NO: 822289 - DNA, 12 bp, Homo sapiens
cctccttgggca

SEQ ID NO: 822290 - DNA, 19 bp, Homo sapiens
cctcctttcatcacactgg

SEQ ID NO: 822291 - DNA, 18 bp, Homo sapiens
cctcctttcccttattgc

SEQ ID NO: 822292 - DNA, 13 bp, Homo sapiens
cctcctttctgtg

SEQ ID NO: 822293 - DNA, 14 bp, Homo sapiens
cctcctttctgtgc

SEQ ID NO: 822294 - DNA, 13 bp, Homo sapiens
cctcctttgtctt

SEQ ID NO: 822295 - DNA, 13 bp, Homo sapiens
cctcctttttcca

SEQ ID NO: 822296 - DNA, 16 bp, Homo sapiens
cctcgaaccaaggcag

SEQ ID NO: 822297 - DNA, 22 bp, Homo sapiens
cctcgaaccaaggcagcctcca

SEQ ID NO: 822298 - DNA, 15 bp, Homo sapiens
cctcgaattctcaga

SEQ ID NO: 822299 - DNA, 23 bp, Homo sapiens
cctcgacacgtgggctcccctct

SEQ ID NO: 822300 - DNA, 15 bp, Homo sapiens
cctcgactcagcacc

SEQ ID NO: 822301 - DNA, 16 bp, Homo sapiens
cctcgagcagatgatg

SEQ ID NO: 822302 - DNA, 22 bp, Homo sapiens
cctcgaggcaccggcgctgcag

SEQ ID NO: 822303 - DNA, 16 bp, Homo sapiens
cctcgaggcctacaga

SEQ ID NO: 822304 - DNA, 16 bp, Homo sapiens
cctcgaggctggtggt

SEQ ID NO: 822305 - DNA, 13 bp, Homo sapiens
cctcgagggccgc

SEQ ID NO: 822306 - DNA, 19 bp, Homo sapiens
cctcgagggccgcctgcct

SEQ ID NO: 822307 - DNA, 20 bp, Homo sapiens
cctcgagggccgcctgcctt

SEQ ID NO: 822308 - DNA, 24 bp, Homo sapiens
cctcgagggccgcctgccttagca

SEQ ID NO: 822309 - DNA, 13 bp, Homo sapiens
cctcgaggggcct

SEQ ID NO: 822310 - DNA, 13 bp, Homo sapiens
cctcgcacacact

SEQ ID NO: 822311 - DNA, 16 bp, Homo sapiens
cctcgcacacagggct

SEQ ID NO: 822312 - DNA, 18 bp, Homo sapiens
cctcgcacacagggctca

SEQ ID NO: 822313 - DNA, 22 bp, Homo sapiens
cctcgcacttgcagaggagccc

SEQ ID NO: 822314 - DNA, 12 bp, Homo sapiens
cctcgcagacct

SEQ ID NO: 822315 - DNA, 13 bp, Homo sapiens
cctcgccagcttg

SEQ ID NO: 822316 - DNA, 13 bp, Homo sapiens
cctcgcccccacc

SEQ ID NO: 822317 - DNA, 13 bp, Homo sapiens
cctcgcccctcca

SEQ ID NO: 822318 - DNA, 22 bp, Homo sapiens
cctcgcccgcccacacggcccc

SEQ ID NO: 822319 - DNA, 20 bp, Homo sapiens
cctcgcctccccaccctcct

SEQ ID NO: 822320 - DNA, 13 bp, Homo sapiens
cctcgcctgacaa

SEQ ID NO: 822321 - DNA, 13 bp, Homo sapiens
cctcgcctgtgga

SEQ ID NO: 822322 - DNA, 18 bp, Homo sapiens
cctcgctcaccgctggcc

SEQ ID NO: 822323 - DNA, 19 bp, Homo sapiens
cctcgctcaccgctggccc

SEQ ID NO: 822324 - DNA, 20 bp, Homo sapiens
cctcgctcccctctggaatc

SEQ ID NO: 822325 - DNA, 15 bp, Homo sapiens
cctcgctcctccttc

SEQ ID NO: 822326 - DNA, 17 bp, Homo sapiens
cctcgctcctccttccc

SEQ ID NO: 822327 - DNA, 16 bp, Homo sapiens
cctcgctgctgctact

SEQ ID NO: 822328 - DNA, 13 bp, Homo sapiens
cctcgctgcttct

SEQ ID NO: 822329 - DNA, 18 bp, Homo sapiens
cctcgctggactctcagt

SEQ ID NO: 822330 - DNA, 21 bp, Homo sapiens
cctcggaaccgctcacctaga

SEQ ID NO: 822331 - DNA, 22 bp, Homo sapiens
cctcggaagccgtctgactcca

SEQ ID NO: 822332 - DNA, 18 bp, Homo sapiens
cctcggagagcagcagca

SEQ ID NO: 822333 - DNA, 14 bp, Homo sapiens
cctcggagcctcat

SEQ ID NO: 822334 - DNA, 12 bp, Homo sapiens
cctcggagcctg

SEQ ID NO: 822335 - DNA, 12 bp, Homo sapiens
cctcggagctgg

SEQ ID NO: 822336 - DNA, 15 bp, Homo sapiens
cctcggagctggctg

SEQ ID NO: 822337 - DNA, 14 bp, Homo sapiens
cctcggcagaactc

SEQ ID NO: 822338 - DNA, 18 bp, Homo sapiens
cctcggcgttagtcccta

SEQ ID NO: 822339 - DNA, 19 bp, Homo sapiens
cctctgcctgtccctctca

SEQ ID NO: 822340 - DNA, 12 bp, Homo sapiens
cctctgccttgg

SEQ ID NO: 822341 - DNA, 14 bp, Homo sapiens
cctctgccttggac

SEQ ID NO: 822342 - DNA, 20 bp, Homo sapiens
cctctgcggccactgcgcca

SEQ ID NO: 822343 - DNA, 11 bp, Homo sapiens
cctctgctacg

SEQ ID NO: 822344 - DNA, 19 bp, Homo sapiens
cctctgctatgcattttct

SEQ ID NO: 822345 - DNA, 18 bp, Homo sapiens
cctctgctcaccgcccat

SEQ ID NO: 822346 - DNA, 23 bp, Homo sapiens
cctctgctcaccgcccatcaggg

SEQ ID NO: 822347 - DNA, 18 bp, Homo sapiens
cctctgctcaggcctccc

SEQ ID NO: 822348 - DNA, 20 bp, Homo sapiens
cctctgctcattaaactgat

SEQ ID NO: 822349 - DNA, 14 bp, Homo sapiens
cctctgctccagca

SEQ ID NO: 822350 - DNA, 15 bp, Homo sapiens
cctctgctccagcaa

SEQ ID NO: 822351 - DNA, 23 bp, Homo sapiens
cctctgctccagcaactgccctt

SEQ ID NO: 822352 - DNA, 11 bp, Homo sapiens
cctctgctccc

SEQ ID NO: 822353 - DNA, 14 bp, Homo sapiens
cctctgctccctct

SEQ ID NO: 822354 - DNA, 13 bp, Homo sapiens
cctctgctcctgg

SEQ ID NO: 822355 - DNA, 14 bp, Homo sapiens
cctctgctctgcct

SEQ ID NO: 822356 - DNA, 17 bp, Homo sapiens
cctctgctctgcctgga

SEQ ID NO: 822357 - DNA, 18 bp, Homo sapiens
cctctgctctgcctggag

SEQ ID NO: 822358 - DNA, 14 bp, Homo sapiens
cctctgctctgtcc

SEQ ID NO: 822359 - DNA, 13 bp, Homo sapiens
cctctgctgagtg

SEQ ID NO: 822360 - DNA, 15 bp, Homo sapiens
cctctgctgagtgct

SEQ ID NO: 822361 - DNA, 21 bp, Homo sapiens
cctctgctgagtgctgggcac

SEQ ID NO: 822362 - DNA, 23 bp, Homo sapiens
cctctgctgagtgctgggcactg

SEQ ID NO: 822363 - DNA, 15 bp, Homo sapiens
cctctgctgccatgg

SEQ ID NO: 822364 - DNA, 15 bp, Homo sapiens
cctctgctgccccct

SEQ ID NO: 822365 - DNA, 15 bp, Homo sapiens
cctctgctgctgccc

SEQ ID NO: 822366 - DNA, 16 bp, Homo sapiens
cctctgctgctgcccg

SEQ ID NO: 822367 - DNA, 20 bp, Homo sapiens
cctctgctgctgtccctccc

SEQ ID NO: 822368 - DNA, 12 bp, Homo sapiens
cctctgcttctc

SEQ ID NO: 822369 - DNA, 14 bp, Homo sapiens
cctctgcttctcat

SEQ ID NO: 822370 - DNA, 22 bp, Homo sapiens
cctctgctttctcctttaattg

SEQ ID NO: 822371 - DNA, 15 bp, Homo sapiens
cctctgcttttatct

SEQ ID NO: 822372 - DNA, 17 bp, Homo sapiens
cctctggaaaactattg

SEQ ID NO: 822373 - DNA, 16 bp, Homo sapiens
cctctggaaagcaaag

SEQ ID NO: 822374 - DNA, 12 bp, Homo sapiens
cctctggaaccc

SEQ ID NO: 822375 - DNA, 16 bp, Homo sapiens
cctctggaacccccca

SEQ ID NO: 822376 - DNA, 15 bp, Homo sapiens
cctctggacggcagg

SEQ ID NO: 822377 - DNA, 23 bp, Homo sapiens
cctctggacggcaggctcactgc

SEQ ID NO: 822378 - DNA, 13 bp, Homo sapiens
cctctggaggcct

SEQ ID NO: 822379 - DNA, 15 bp, Homo sapiens
cctctggaggcctct

SEQ ID NO: 822380 - DNA, 17 bp, Homo sapiens
cctctggaggcctctgg

SEQ ID NO: 822381 - DNA, 20 bp, Homo sapiens
cctctggaggcctctggccc

SEQ ID NO: 822382 - DNA, 16 bp, Homo sapiens
cctctggatggcacca

SEQ ID NO: 822383 - DNA, 14 bp, Homo sapiens
cctctggattccct

SEQ ID NO: 822384 - DNA, 13 bp, Homo sapiens
cctctggcaggct

SEQ ID NO: 822385 - DNA, 18 bp, Homo sapiens
cctctggcaggcttcccc

SEQ ID NO: 822386 - DNA, 23 bp, Homo sapiens
cctctggcattagaattatttaa

SEQ ID NO: 822387 - DNA, 20 bp, Homo sapiens
cctctggccaaatatgcact

SEQ ID NO: 822388 - DNA, 13 bp, Homo sapiens
cctctggccctcg

SEQ ID NO: 822389 - DNA, 21 bp, Homo sapiens
cctctggccctcggtggctgc

SEQ ID NO: 822390 - DNA, 18 bp, Homo sapiens
cctctggccctgccttct

SEQ ID NO: 822391 - DNA, 22 bp, Homo sapiens
cctctggccctggggtgtgtct

SEQ ID NO: 822392 - DNA, 13 bp, Homo sapiens
cctctggcccttg

SEQ ID NO: 822393 - DNA, 19 bp, Homo sapiens
cctctggcccttggaataa

SEQ ID NO: 822394 - DNA, 22 bp, Homo sapiens
cctctggctggctaactggaag

SEQ ID NO: 822395 - DNA, 14 bp, Homo sapiens
cctctggcttccca

SEQ ID NO: 822396 - DNA, 19 bp, Homo sapiens
cctctggctttcccaggag

SEQ ID NO: 822397 - DNA, 12 bp, Homo sapiens
cctctgggaacc

SEQ ID NO: 822398 - DNA, 14 bp, Homo sapiens
cctctgggaacctc

SEQ ID NO: 822399 - DNA, 22 bp, Homo sapiens
cctctgggaacctcccagaggt

SEQ ID NO: 822400 - DNA, 23 bp, Homo sapiens
cctctgggaacctcccagaggtc

SEQ ID NO: 822401 - DNA, 12 bp, Homo sapiens
cctctgggactg

SEQ ID NO: 822402 - DNA, 17 bp, Homo sapiens
cctctgggagtccccat

SEQ ID NO: 822403 - DNA, 12 bp, Homo sapiens
cctctgggcagc

SEQ ID NO: 822404 - DNA, 15 bp, Homo sapiens
cctctgggcagcctg

SEQ ID NO: 822405 - DNA, 16 bp, Homo sapiens
cctctgggcagcctgc

SEQ ID NO: 822406 - DNA, 15 bp, Homo sapiens
cctctgggcagcgct

SEQ ID NO: 822407 - DNA, 14 bp, Homo sapiens
cctctgggtttcta

SEQ ID NO: 822408 - DNA, 21 bp, Homo sapiens
cctctggtaaacattcctcca

SEQ ID NO: 822409 - DNA, 12 bp, Homo sapiens
cctctggtcctt

SEQ ID NO: 822410 - DNA, 19 bp, Homo sapiens
cctctggtcgctcctgccc

SEQ ID NO: 822411 - DNA, 20 bp, Homo sapiens
cctctggtcgctcctgccca

SEQ ID NO: 822412 - DNA, 22 bp, Homo sapiens
cctctggtggctcctcctagga

SEQ ID NO: 822413 - DNA, 20 bp, Homo sapiens
cctctgtcatcactccctgg

SEQ ID NO: 822414 - DNA, 20 bp, Homo sapiens
cctctgtccaaacatttcat

SEQ ID NO: 822415 - DNA, 21 bp, Homo sapiens
cctctgtccagggccctgagc

SEQ ID NO: 822416 - DNA, 23 bp, Homo sapiens
cctctgtccagggccctgagctc

SEQ ID NO: 822417 - DNA, 14 bp, Homo sapiens
cctctgtcctccca

SEQ ID NO: 822418 - DNA, 15 bp, Homo sapiens
cctctgtcctcccat

SEQ ID NO: 822419 - DNA, 10 bp, Homo sapiens
cctctgtcta

SEQ ID NO: 822420 - DNA, 22 bp, Homo sapiens
cctctgtctaggactgcagtgt

SEQ ID NO: 822421 - DNA, 14 bp, Homo sapiens
cctctgtctcatcc

SEQ ID NO: 822422 - DNA, 18 bp, Homo sapiens
cctctgtctcatcctcct

SEQ ID NO: 822423 - DNA, 22 bp, Homo sapiens
cctctgtctcatcctcctggaa

SEQ ID NO: 822424 - DNA, 23 bp, Homo sapiens
cctctgtctcatcctcctggaac

SEQ ID NO: 822425 - DNA, 24 bp, Homo sapiens
cctctgtctcatcctcctggaacc

SEQ ID NO: 822426 - DNA, 20 bp, Homo sapiens
cctctgtcttcagcaccctc

SEQ ID NO: 822427 - DNA, 23 bp, Homo sapiens
cctctgtcttctctatcctctct

SEQ ID NO: 822428 - DNA, 20 bp, Homo sapiens
cctctgtcttggctttcatg

SEQ ID NO: 822429 - DNA, 19 bp, Homo sapiens
cctctgtgcacagtggctt

SEQ ID NO: 822430 - DNA, 13 bp, Homo sapiens
cctctgtgctgtg

SEQ ID NO: 822431 - DNA, 16 bp, Homo sapiens
cctctgtgctgtgtgt

SEQ ID NO: 822432 - DNA, 23 bp, Homo sapiens
cctctgtggcattgaaatgagca

SEQ ID NO: 822433 - DNA, 13 bp, Homo sapiens
cctctgtggcctg

SEQ ID NO: 822434 - DNA, 13 bp, Homo sapiens
cctctgtgtcctt

SEQ ID NO: 822435 - DNA, 23 bp, Homo sapiens
cctctgttaggtccattttctaa

SEQ ID NO: 822436 - DNA, 16 bp, Homo sapiens
cctctgttcaaagctg

SEQ ID NO: 822437 - DNA, 20 bp, Homo sapiens
cctctgttcacaaactacct

SEQ ID NO: 822438 - DNA, 15 bp, Homo sapiens
cctctgttctctccc

SEQ ID NO: 822439 - DNA, 20 bp, Homo sapiens
cctctgttctctcccctcac

SEQ ID NO: 822440 - DNA, 17 bp, Homo sapiens
cctcttaaagctgcctg

SEQ ID NO: 822441 - DNA, 23 bp, Homo sapiens
cctcttaaggaaaccactgtaca

SEQ ID NO: 822442 - DNA, 18 bp, Homo sapiens
cctcttaccgtagcctcc

SEQ ID NO: 822443 - DNA, 17 bp, Homo sapiens
cctcttactttgcttga

SEQ ID NO: 822444 - DNA, 21 bp, Homo sapiens
cctcttagaagaatattgtat

SEQ ID NO: 822445 - DNA, 17 bp, Homo sapiens
cctcttagctgagtgga

SEQ ID NO: 822446 - DNA, 19 bp, Homo sapiens
cctcttagtgattgtgtct

SEQ ID NO: 822447 - DNA, 18 bp, Homo sapiens
cctcttcaaaaagcagag

SEQ ID NO: 822448 - DNA, 14 bp, Homo sapiens
cctcttcaaagcag

SEQ ID NO: 822449 - DNA, 19 bp, Homo sapiens
cctcttcaaagcagagtgg

SEQ ID NO: 822450 - DNA, 21 bp, Homo sapiens
cctcttcaaagcagagtggga

SEQ ID NO: 822451 - DNA, 14 bp, Homo sapiens
cctcttcactcccc

SEQ ID NO: 822452 - DNA, 14 bp, Homo sapiens
cctcttcagaactt

SEQ ID NO: 822453 - DNA, 19 bp, Homo sapiens
cctcttccactccttctct

SEQ ID NO: 822454 - DNA, 14 bp, Homo sapiens
cctcttccagcttc

SEQ ID NO: 822455 - DNA, 14 bp, Homo sapiens
cctcttccagtctt

SEQ ID NO: 822456 - DNA, 17 bp, Homo sapiens
cctcttccagtgaacat

SEQ ID NO: 822457 - DNA, 23 bp, Homo sapiens
cctcttcccttagcctctcccac

SEQ ID NO: 822458 - DNA, 16 bp, Homo sapiens
cctcttcccttcctcc

SEQ ID NO: 822459 - DNA, 20 bp, Homo sapiens
cctcttcccttcctccattg

SEQ ID NO: 822460 - DNA, 19 bp, Homo sapiens
cctcttccggagatgtagc

SEQ ID NO: 822461 - DNA, 22 bp, Homo sapiens
cctgaagcctctgccctgcctc

SEQ ID NO: 822462 - DNA, 14 bp, Homo sapiens
cctgaagcctggat

SEQ ID NO: 822463 - DNA, 14 bp, Homo sapiens
cctgaagctgctgt

SEQ ID NO: 822464 - DNA, 17 bp, Homo sapiens
cctgaagctgctgtgtc

SEQ ID NO: 822465 - DNA, 23 bp, Homo sapiens
cctgaagcttcggccgcgccacc

SEQ ID NO: 822466 - DNA, 13 bp, Homo sapiens
cctgaagggaact

SEQ ID NO: 822467 - DNA, 17 bp, Homo sapiens
cctgaagggaaggcaaa

SEQ ID NO: 822468 - DNA, 16 bp, Homo sapiens
cctgaataaaccagta

SEQ ID NO: 822469 - DNA, 15 bp, Homo sapiens
cctgaataaagagcc

SEQ ID NO: 822470 - DNA, 17 bp, Homo sapiens
cctgaatcatgagcctg

SEQ ID NO: 822471 - DNA, 22 bp, Homo sapiens
cctgaatcatgagcctgctgga

SEQ ID NO: 822472 - DNA, 20 bp, Homo sapiens
cctgaatccaaactaatcca

SEQ ID NO: 822473 - DNA, 15 bp, Homo sapiens
cctgaatctgatctt

SEQ ID NO: 822474 - DNA, 13 bp, Homo sapiens
cctgaatcttttt

SEQ ID NO: 822475 - DNA, 20 bp, Homo sapiens
cctgaatcttttttttatat

SEQ ID NO: 822476 - DNA, 21 bp, Homo sapiens
cctgaatgtttaaagatcatg

SEQ ID NO: 822477 - DNA, 18 bp, Homo sapiens
cctgaattctatttgctg

SEQ ID NO: 822478 - DNA, 21 bp, Homo sapiens
cctgaattctatttgctgggc

SEQ ID NO: 822479 - DNA, 18 bp, Homo sapiens
cctgacaaccactggtct

SEQ ID NO: 822480 - DNA, 19 bp, Homo sapiens
cctgacaaccactggtctg

SEQ ID NO: 822481 - DNA, 19 bp, Homo sapiens
cctgacaagcactgctagg

SEQ ID NO: 822482 - DNA, 20 bp, Homo sapiens
cctgacaagcactgctaggc

SEQ ID NO: 822483 - DNA, 13 bp, Homo sapiens
cctgacaatggca

SEQ ID NO: 822484 - DNA, 16 bp, Homo sapiens
cctgacaatggcagct

SEQ ID NO: 822485 - DNA, 17 bp, Homo sapiens
cctgacaatggcagcta

SEQ ID NO: 822486 - DNA, 23 bp, Homo sapiens
cctgacacactaaccaagctgag

SEQ ID NO: 822487 - DNA, 12 bp, Homo sapiens
cctgacaccccc

SEQ ID NO: 822488 - DNA, 16 bp, Homo sapiens
cctgacaccccctccc

SEQ ID NO: 822489 - DNA, 15 bp, Homo sapiens
cctgacactgagccc

SEQ ID NO: 822490 - DNA, 17 bp, Homo sapiens
cctgacactgagcccca

SEQ ID NO: 822491 - DNA, 18 bp, Homo sapiens
cctgacactgagccccac

SEQ ID NO: 822492 - DNA, 21 bp, Homo sapiens
cctgacactgagccccacctc

SEQ ID NO: 822493 - DNA, 16 bp, Homo sapiens
cctgacagaaggactc

SEQ ID NO: 822494 - DNA, 15 bp, Homo sapiens
cctgacagccttccc

SEQ ID NO: 822495 - DNA, 15 bp, Homo sapiens
cctgacatgctaacc

SEQ ID NO: 822496 - DNA, 21 bp, Homo sapiens
cctgacatgtaccccctttcc

SEQ ID NO: 822497 - DNA, 17 bp, Homo sapiens
cctgacatgtccttctg

SEQ ID NO: 822498 - DNA, 20 bp, Homo sapiens
cctgaccaccctcccctctc

SEQ ID NO: 822499 - DNA, 22 bp, Homo sapiens
cctgaccagctgctccgaggac

SEQ ID NO: 822500 - DNA, 18 bp, Homo sapiens
cctgacccaacacccccg

SEQ ID NO: 822501 - DNA, 13 bp, Homo sapiens
cctgacccaggcc

SEQ ID NO: 822502 - DNA, 15 bp, Homo sapiens
cctgacccaggccgc

SEQ ID NO: 822503 - DNA, 13 bp, Homo sapiens
cctgacccctccc

SEQ ID NO: 822504 - DNA, 16 bp, Homo sapiens
cctgacccctccctgc

SEQ ID NO: 822505 - DNA, 20 bp, Homo sapiens
cctgacccctccctgcaggg

SEQ ID NO: 822506 - DNA, 21 bp, Homo sapiens
cctgacccctccctgcagggg

SEQ ID NO: 822507 - DNA, 22 bp, Homo sapiens
cctgacccctccctgcaggggc

SEQ ID NO: 822508 - DNA, 23 bp, Homo sapiens
cctgacccctccctgcaggggct

SEQ ID NO: 822509 - DNA, 14 bp, Homo sapiens
cctgacccctgctc

SEQ ID NO: 822510 - DNA, 15 bp, Homo sapiens
cctgacccctgctca

SEQ ID NO: 822511 - DNA, 19 bp, Homo sapiens
cctgaccccttgctccctt

SEQ ID NO: 822512 - DNA, 14 bp, Homo sapiens
cctgaccctcccac

SEQ ID NO: 822513 - DNA, 17 bp, Homo sapiens
cctgaccctcccactcc

SEQ ID NO: 822514 - DNA, 18 bp, Homo sapiens
cctgaccctcccactccc

SEQ ID NO: 822515 - DNA, 14 bp, Homo sapiens
cctgacctcccagc

SEQ ID NO: 822516 - DNA, 17 bp, Homo sapiens
cctgacctccgcccctg

SEQ ID NO: 822517 - DNA, 12 bp, Homo sapiens
cctgacctcttg

SEQ ID NO: 822518 - DNA, 13 bp, Homo sapiens
cctgacctcttgc

SEQ ID NO: 822519 - DNA, 15 bp, Homo sapiens
cctgacctcttgctg

SEQ ID NO: 822520 - DNA, 19 bp, Homo sapiens
cctgacctcttgctgtctc

SEQ ID NO: 822521 - DNA, 12 bp, Homo sapiens
cctgacctgaga

SEQ ID NO: 822522 - DNA, 13 bp, Homo sapiens
cctgacctgagag

SEQ ID NO: 822523 - DNA, 13 bp, Homo sapiens
cctgacctgtcca

SEQ ID NO: 822524 - DNA, 15 bp, Homo sapiens
cctgacctgtccagg

SEQ ID NO: 822525 - DNA, 19 bp, Homo sapiens
cctgacctgtgagcccagc

SEQ ID NO: 822526 - DNA, 20 bp, Homo sapiens
cctgaccttagcgttctgga

SEQ ID NO: 822527 - DNA, 16 bp, Homo sapiens
cctgacgaaactggcc

SEQ ID NO: 822528 - DNA, 14 bp, Homo sapiens
cctgacgccctgcg

SEQ ID NO: 822529 - DNA, 13 bp, Homo sapiens
cctgacggctggg

SEQ ID NO: 822530 - DNA, 14 bp, Homo sapiens
cctgacgtgggcat

SEQ ID NO: 822531 - DNA, 10 bp, Homo sapiens
cctgactcaa

SEQ ID NO: 822532 - DNA, 16 bp, Homo sapiens
cctgactcatcatttg

SEQ ID NO: 822533 - DNA, 15 bp, Homo sapiens
cctgactccctgtgg

SEQ ID NO: 822534 - DNA, 16 bp, Homo sapiens
cctgactccctgtggg

SEQ ID NO: 822535 - DNA, 15 bp, Homo sapiens
cctgactcctctaag

SEQ ID NO: 822536 - DNA, 14 bp, Homo sapiens
cctgactcctctgg

SEQ ID NO: 822537 - DNA, 16 bp, Homo sapiens
cctgactcctctggct

SEQ ID NO: 822538 - DNA, 18 bp, Homo sapiens
cctgactcctctggcttt

SEQ ID NO: 822539 - DNA, 13 bp, Homo sapiens
cctgactcctgga

SEQ ID NO: 822540 - DNA, 15 bp, Homo sapiens
cctgactcctggact

SEQ ID NO: 822541 - DNA, 16 bp, Homo sapiens
cctgactcctgggtgg

SEQ ID NO: 822542 - DNA, 19 bp, Homo sapiens
cctgactctcacctgtact

SEQ ID NO: 822543 - DNA, 13 bp, Homo sapiens
cctgactctgaaa

SEQ ID NO: 822544 - DNA, 14 bp, Homo sapiens
cctgactgctcaga

SEQ ID NO: 822545 - DNA, 21 bp, Homo sapiens
cctgactggtgctataggctg

SEQ ID NO: 822546 - DNA, 17 bp, Homo sapiens
cctgactggttgtcaga

SEQ ID NO: 822547 - DNA, 16 bp, Homo sapiens
cctgactgttgccccc

SEQ ID NO: 822548 - DNA, 13 bp, Homo sapiens
cctgacttctccc

SEQ ID NO: 822549 - DNA, 11 bp, Homo sapiens
cctgacttgag

SEQ ID NO: 822550 - DNA, 14 bp, Homo sapiens
cctgacttgagcca

SEQ ID NO: 822551 - DNA, 12 bp, Homo sapiens
cctgactttctc

SEQ ID NO: 822552 - DNA, 19 bp, Homo sapiens
cctgactttgcccccttgc

SEQ ID NO: 822553 - DNA, 23 bp, Homo sapiens
cctgactttgcccccttgcccat

SEQ ID NO: 822554 - DNA, 17 bp, Homo sapiens
cctgagaaagctcaaag

SEQ ID NO: 822555 - DNA, 15 bp, Homo sapiens
cctgagaagctgctc

SEQ ID NO: 822556 - DNA, 17 bp, Homo sapiens
cctgagaagctgctcca

SEQ ID NO: 822557 - DNA, 22 bp, Homo sapiens
cctgagaagtgtctaaaaacac

SEQ ID NO: 822558 - DNA, 20 bp, Homo sapiens
cctgagaatgagtgggaatc

SEQ ID NO: 822559 - DNA, 21 bp, Homo sapiens
cctgagacagacacacagcct

SEQ ID NO: 822560 - DNA, 21 bp, Homo sapiens
cctgagacagcaccactgctg

SEQ ID NO: 822561 - DNA, 20 bp, Homo sapiens
cctgagacgggcatcgcagg

SEQ ID NO: 822562 - DNA, 22 bp, Homo sapiens
cctgagacgggcatcgcaggag

SEQ ID NO: 822563 - DNA, 22 bp, Homo sapiens
cctgagactcacactctctgca

SEQ ID NO: 822564 - DNA, 14 bp, Homo sapiens
cctgagactccaga

SEQ ID NO: 822565 - DNA, 15 bp, Homo sapiens
cctgagactccagaa

SEQ ID NO: 822566 - DNA, 22 bp, Homo sapiens
cctgagactgtcggagaggctg

SEQ ID NO: 822567 - DNA, 15 bp, Homo sapiens
cctgagagaattggc

SEQ ID NO: 822568 - DNA, 20 bp, Homo sapiens
cctgagagagaatagagctg

SEQ ID NO: 822569 - DNA, 22 bp, Homo sapiens
cctgagagagaatagagctgcc

SEQ ID NO: 822570 - DNA, 18 bp, Homo sapiens
cctgagagatttaacatt

SEQ ID NO: 822571 - DNA, 13 bp, Homo sapiens
cctgagaggcagg

SEQ ID NO: 822572 - DNA, 15 bp, Homo sapiens
cctgagaggcaggca

SEQ ID NO: 822573 - DNA, 18 bp, Homo sapiens
cctgagaggcaggcatag

SEQ ID NO: 822574 - DNA, 22 bp, Homo sapiens
cctgagagtttcctcagaaccc

SEQ ID NO: 822575 - DNA, 18 bp, Homo sapiens
cctgagatacttcccaaa

SEQ ID NO: 822576 - DNA, 17 bp, Homo sapiens
cctgagatcccctgagc

SEQ ID NO: 822577 - DNA, 16 bp, Homo sapiens
cctgagatgcaggtga

SEQ ID NO: 822578 - DNA, 15 bp, Homo sapiens
cctgagcaactcttg

SEQ ID NO: 822579 - DNA, 18 bp, Homo sapiens
cctgagcaactcttgatt

SEQ ID NO: 822580 - DNA, 18 bp, Homo sapiens
cctgagcagaatactggt

SEQ ID NO: 822581 - DNA, 20 bp, Homo sapiens
cctgagcccaaccaggccct

SEQ ID NO: 822582 - DNA, 14 bp, Homo sapiens
cctgagcccaggag

SEQ ID NO: 822583 - DNA, 21 bp, Homo sapiens
cctgagccccagggtgcccag

SEQ ID NO: 822584 - DNA, 18 bp, Homo sapiens
cctgcatctctgtgaagc

SEQ ID NO: 822585 - DNA, 19 bp, Homo sapiens
cctgcatctgaccagcagc

SEQ ID NO: 822586 - DNA, 20 bp, Homo sapiens
cctgcatcttcttgcatcta

SEQ ID NO: 822587 - DNA, 14 bp, Homo sapiens
cctgcatgctgccc

SEQ ID NO: 822588 - DNA, 17 bp, Homo sapiens
cctgcatgctgcccagc

SEQ ID NO: 822589 - DNA, 21 bp, Homo sapiens
cctgcatgctgcccagccact

SEQ ID NO: 822590 - DNA, 22 bp, Homo sapiens
cctgcatggggcagaggcttcc

SEQ ID NO: 822591 - DNA, 19 bp, Homo sapiens
cctgcatgggggcaccggg

SEQ ID NO: 822592 - DNA, 20 bp, Homo sapiens
cctgcatgggggcaccgggc

SEQ ID NO: 822593 - DNA, 22 bp, Homo sapiens
cctgcatggtgtttatgcacac

SEQ ID NO: 822594 - DNA, 10 bp, Homo sapiens
cctgcatgtt

SEQ ID NO: 822595 - DNA, 15 bp, Homo sapiens
cctgcatgttctgtg

SEQ ID NO: 822596 - DNA, 16 bp, Homo sapiens
cctgcattcccaggaa

SEQ ID NO: 822597 - DNA, 18 bp, Homo sapiens
cctgcattcccaggaaaa

SEQ ID NO: 822598 - DNA, 16 bp, Homo sapiens
cctgcattttcctctt

SEQ ID NO: 822599 - DNA, 21 bp, Homo sapiens
cctgccaaagtagtcctggca

SEQ ID NO: 822600 - DNA, 23 bp, Homo sapiens
cctgccaaagtagtcctggcagc

SEQ ID NO: 822601 - DNA, 18 bp, Homo sapiens
cctgccaaagtgcctggg

SEQ ID NO: 822602 - DNA, 19 bp, Homo sapiens
cctgccaaagtgcctggga

SEQ ID NO: 822603 - DNA, 15 bp, Homo sapiens
cctgccaagactcct

SEQ ID NO: 822604 - DNA, 17 bp, Homo sapiens
cctgccaagactcctca

SEQ ID NO: 822605 - DNA, 18 bp, Homo sapiens
cctgccaatgctccagct

SEQ ID NO: 822606 - DNA, 15 bp, Homo sapiens
cctgccacactcagt

SEQ ID NO: 822607 - DNA, 20 bp, Homo sapiens
cctgccacactcagtccccc

SEQ ID NO: 822608 - DNA, 14 bp, Homo sapiens
cctgccacactgat

SEQ ID NO: 822609 - DNA, 15 bp, Homo sapiens
cctgccacactgatg

SEQ ID NO: 822610 - DNA, 16 bp, Homo sapiens
cctgccacagccagag

SEQ ID NO: 822611 - DNA, 16 bp, Homo sapiens
cctgccacatccagct

SEQ ID NO: 822612 - DNA, 17 bp, Homo sapiens
cctgccacatggagccc

SEQ ID NO: 822613 - DNA, 16 bp, Homo sapiens
cctgccaccagcatcc

SEQ ID NO: 822614 - DNA, 13 bp, Homo sapiens
cctgccaccaggc

SEQ ID NO: 822615 - DNA, 15 bp, Homo sapiens
cctgccaccaggcca

SEQ ID NO: 822616 - DNA, 19 bp, Homo sapiens
cctgccaccaggccacctc

SEQ ID NO: 822617 - DNA, 15 bp, Homo sapiens
cctgccacccccagg

SEQ ID NO: 822618 - DNA, 17 bp, Homo sapiens
cctgccacccccaggtc

SEQ ID NO: 822619 - DNA, 16 bp, Homo sapiens
cctgccaccccttcct

SEQ ID NO: 822620 - DNA, 17 bp, Homo sapiens
cctgccaccgactgccc

SEQ ID NO: 822621 - DNA, 21 bp, Homo sapiens
cctgccaccgactgcccagcc

SEQ ID NO: 822622 - DNA, 22 bp, Homo sapiens
cctgccaccgactgcccagcca

SEQ ID NO: 822623 - DNA, 22 bp, Homo sapiens
cctgccacgtcccgctgcctcc

SEQ ID NO: 822624 - DNA, 13 bp, Homo sapiens
cctgccactcact

SEQ ID NO: 822625 - DNA, 15 bp, Homo sapiens
cctgccactcactag

SEQ ID NO: 822626 - DNA, 21 bp, Homo sapiens
cctgccactcactaggccccc

SEQ ID NO: 822627 - DNA, 22 bp, Homo sapiens
cctgccactcactaggccccca

SEQ ID NO: 822628 - DNA, 15 bp, Homo sapiens
cctgccactctctgg

SEQ ID NO: 822629 - DNA, 17 bp, Homo sapiens
cctgccactctctggga

SEQ ID NO: 822630 - DNA, 18 bp, Homo sapiens
cctgccactctctgggac

SEQ ID NO: 822631 - DNA, 13 bp, Homo sapiens
cctgccactgggc

SEQ ID NO: 822632 - DNA, 19 bp, Homo sapiens
cctgccactgggctctgga

SEQ ID NO: 822633 - DNA, 23 bp, Homo sapiens
cctgccactttggtacatggcca

SEQ ID NO: 822634 - DNA, 14 bp, Homo sapiens
cctgccagcctggc

SEQ ID NO: 822635 - DNA, 16 bp, Homo sapiens
cctgccagcctggctt

SEQ ID NO: 822636 - DNA, 15 bp, Homo sapiens
cctgccagctgcctt

SEQ ID NO: 822637 - DNA, 19 bp, Homo sapiens
cctgccaggcacacacagc

SEQ ID NO: 822638 - DNA, 13 bp, Homo sapiens
cctgccaggcagg

SEQ ID NO: 822639 - DNA, 15 bp, Homo sapiens
cctgccaggcagggg

SEQ ID NO: 822640 - DNA, 16 bp, Homo sapiens
cctgccaggcatggtg

SEQ ID NO: 822641 - DNA, 17 bp, Homo sapiens
cctgccagggcagggcc

SEQ ID NO: 822642 - DNA, 15 bp, Homo sapiens
cctgccagggtgagc

SEQ ID NO: 822643 - DNA, 14 bp, Homo sapiens
cctgccagtcccag

SEQ ID NO: 822644 - DNA, 13 bp, Homo sapiens
cctgccagtgcca

SEQ ID NO: 822645 - DNA, 15 bp, Homo sapiens
cctgccagtgccagg

SEQ ID NO: 822646 - DNA, 17 bp, Homo sapiens
cctgccagtgccagggt

SEQ ID NO: 822647 - DNA, 14 bp, Homo sapiens
cctgccagtgcctt

SEQ ID NO: 822648 - DNA, 22 bp, Homo sapiens
cctgccagtgccttacctcctg

SEQ ID NO: 822649 - DNA, 16 bp, Homo sapiens
cctgccatcatgcctg

SEQ ID NO: 822650 - DNA, 14 bp, Homo sapiens
cctgccatccccct

SEQ ID NO: 822651 - DNA, 14 bp, Homo sapiens
cctgccatcttccc

SEQ ID NO: 822652 - DNA, 15 bp, Homo sapiens
cctgccatgccagga

SEQ ID NO: 822653 - DNA, 22 bp, Homo sapiens
cctgccatgggtgcagaccctg

SEQ ID NO: 822654 - DNA, 17 bp, Homo sapiens
cctgccatgtttagtga

SEQ ID NO: 822655 - DNA, 15 bp, Homo sapiens
cctgccattggcctc

SEQ ID NO: 822656 - DNA, 18 bp, Homo sapiens
cctgccattggcctcttg

SEQ ID NO: 822657 - DNA, 20 bp, Homo sapiens
cctgccattggcctcttgtc

SEQ ID NO: 822658 - DNA, 21 bp, Homo sapiens
cctgcccaaacccttaactga

SEQ ID NO: 822659 - DNA, 18 bp, Homo sapiens
cctgcccaaactcccctt

SEQ ID NO: 822660 - DNA, 20 bp, Homo sapiens
cctgcccaaactccccttcc

SEQ ID NO: 822661 - DNA, 15 bp, Homo sapiens
cctgcccaagggcct

SEQ ID NO: 822662 - DNA, 17 bp, Homo sapiens
cctgcccaagtgaccag

SEQ ID NO: 822663 - DNA, 22 bp, Homo sapiens
cctgcccaatgctttgggaggc

SEQ ID NO: 822664 - DNA, 13 bp, Homo sapiens
cctgcccacccgt

SEQ ID NO: 822665 - DNA, 22 bp, Homo sapiens
cctgcccacccgtggagatggg

SEQ ID NO: 822666 - DNA, 12 bp, Homo sapiens
cctgcccaccct

SEQ ID NO: 822667 - DNA, 19 bp, Homo sapiens
cctgcccaccctaccagct

SEQ ID NO: 822668 - DNA, 15 bp, Homo sapiens
cctgcccacgggagg

SEQ ID NO: 822669 - DNA, 17 bp, Homo sapiens
cctgcccagactgatga

SEQ ID NO: 822670 - DNA, 18 bp, Homo sapiens
cctgcccagactgatgag

SEQ ID NO: 822671 - DNA, 19 bp, Homo sapiens
cctgcccagactgatgagc

SEQ ID NO: 822672 - DNA, 14 bp, Homo sapiens
cctgcccagatgcc

SEQ ID NO: 822673 - DNA, 12 bp, Homo sapiens
cctgcccagcca

SEQ ID NO: 822674 - DNA, 15 bp, Homo sapiens
cctgcccagcctgtg

SEQ ID NO: 822675 - DNA, 16 bp, Homo sapiens
cctgcccagctcctca

SEQ ID NO: 822676 - DNA, 22 bp, Homo sapiens
cctgcccaggagagccagccct

SEQ ID NO: 822677 - DNA, 23 bp, Homo sapiens
cctgcccaggagagccagccctc

SEQ ID NO: 822678 - DNA, 11 bp, Homo sapiens
cctgcccagtg

SEQ ID NO: 822679 - DNA, 13 bp, Homo sapiens
cctgcccagtgtt

SEQ ID NO: 822680 - DNA, 23 bp, Homo sapiens
cctgcccagtgttgtttgtaaat

SEQ ID NO: 822681 - DNA, 16 bp, Homo sapiens
cctgcccagttgcact

SEQ ID NO: 822682 - DNA, 20 bp, Homo sapiens
cctgcccatactgagcctgc

SEQ ID NO: 822683 - DNA, 16 bp, Homo sapiens
cctgcccatgccccag

SEQ ID NO: 822684 - DNA, 22 bp, Homo sapiens
cctgcccatgtcgcgctcagca

SEQ ID NO: 822685 - DNA, 16 bp, Homo sapiens
cctgcccatgtgtccc

SEQ ID NO: 822686 - DNA, 19 bp, Homo sapiens
cctgcccatgtgtcccctc

SEQ ID NO: 822687 - DNA, 17 bp, Homo sapiens
cctgccccacacggact

SEQ ID NO: 822688 - DNA, 23 bp, Homo sapiens
cctgccccaccccatccagccag

SEQ ID NO: 822689 - DNA, 16 bp, Homo sapiens
cctgccccaggcctga

SEQ ID NO: 822690 - DNA, 15 bp, Homo sapiens
cctgcccccaagtca

SEQ ID NO: 822691 - DNA, 14 bp, Homo sapiens
cctgcccccacttc

SEQ ID NO: 822692 - DNA, 15 bp, Homo sapiens
cctgcccccacttcc

SEQ ID NO: 822693 - DNA, 13 bp, Homo sapiens
cctgcccccatct

SEQ ID NO: 822694 - DNA, 19 bp, Homo sapiens
cctgcccccatctccccag

SEQ ID NO: 822695 - DNA, 23 bp, Homo sapiens
cctgcccccatctccccaggcct

SEQ ID NO: 822696 - DNA, 14 bp, Homo sapiens
cctgccccccaagg

SEQ ID NO: 822697 - DNA, 21 bp, Homo sapiens
cctgccccccaaggttctggt

SEQ ID NO: 822698 - DNA, 18 bp, Homo sapiens
cctgccccccagtctccc

SEQ ID NO: 822699 - DNA, 19 bp, Homo sapiens
cctgccccccagtctcccc

SEQ ID NO: 822700 - DNA, 20 bp, Homo sapiens
cctgccccccagtctcccca

SEQ ID NO: 822701 - DNA, 22 bp, Homo sapiens
cctgccccctcgggggcctgtg

SEQ ID NO: 822702 - DNA, 14 bp, Homo sapiens
cctgccccctgggc

SEQ ID NO: 822703 - DNA, 15 bp, Homo sapiens
cctgccccctgggct

SEQ ID NO: 822704 - DNA, 12 bp, Homo sapiens
cctgcccccttc

SEQ ID NO: 822705 - DNA, 18 bp, Homo sapiens
cctgcccccttctcccac

SEQ ID NO: 822706 - DNA, 23 bp, Homo sapiens
cctgccttgaagccactgaagct

SEQ ID NO: 822707 - DNA, 15 bp, Homo sapiens
cctgccttgccgctc

SEQ ID NO: 822708 - DNA, 15 bp, Homo sapiens
cctgccttggcctcc

SEQ ID NO: 822709 - DNA, 20 bp, Homo sapiens
cctgcctttaagccaaagaa

SEQ ID NO: 822710 - DNA, 22 bp, Homo sapiens
cctgcctttaagccaaagaaac

SEQ ID NO: 822711 - DNA, 13 bp, Homo sapiens
cctgcctttgtat

SEQ ID NO: 822712 - DNA, 16 bp, Homo sapiens
cctgcctttgtatgtg

SEQ ID NO: 822713 - DNA, 17 bp, Homo sapiens
cctgccttttaagtttg

SEQ ID NO: 822714 - DNA, 13 bp, Homo sapiens
cctgcgagaccca

SEQ ID NO: 822715 - DNA, 20 bp, Homo sapiens
cctgcgagacgcacacagct

SEQ ID NO: 822716 - DNA, 23 bp, Homo sapiens
cctgcgagacgcacacagctgag

SEQ ID NO: 822717 - DNA, 20 bp, Homo sapiens
cctgcgagggccgcccgctc

SEQ ID NO: 822718 - DNA, 16 bp, Homo sapiens
cctgcgcacaggtggg

SEQ ID NO: 822719 - DNA, 18 bp, Homo sapiens
cctgcgcccagagctggc

SEQ ID NO: 822720 - DNA, 19 bp, Homo sapiens
cctgcgcccagagctggcc

SEQ ID NO: 822721 - DNA, 21 bp, Homo sapiens
cctgcgcccagagctggcctc

SEQ ID NO: 822722 - DNA, 22 bp, Homo sapiens
cctgcgcccagagctggcctcc

SEQ ID NO: 822723 - DNA, 20 bp, Homo sapiens
cctgcgcccagtccttccac

SEQ ID NO: 822724 - DNA, 20 bp, Homo sapiens
cctgcgcccttgaggggccc

SEQ ID NO: 822725 - DNA, 15 bp, Homo sapiens
cctgcgcctccagag

SEQ ID NO: 822726 - DNA, 17 bp, Homo sapiens
cctgcgctctctttgca

SEQ ID NO: 822727 - DNA, 16 bp, Homo sapiens
cctgcggagtgaagag

SEQ ID NO: 822728 - DNA, 19 bp, Homo sapiens
cctgcggagtgaagagggg

SEQ ID NO: 822729 - DNA, 20 bp, Homo sapiens
cctgcggagtgaagaggggc

SEQ ID NO: 822730 - DNA, 23 bp, Homo sapiens
cctgcggagtgaagaggggcagc

SEQ ID NO: 822731 - DNA, 14 bp, Homo sapiens
cctgcggccgcccc

SEQ ID NO: 822732 - DNA, 15 bp, Homo sapiens
cctgcggcgccagcc

SEQ ID NO: 822733 - DNA, 17 bp, Homo sapiens
cctgcggcgccagcctc

SEQ ID NO: 822734 - DNA, 23 bp, Homo sapiens
cctgcggctcagccttgcacacc

SEQ ID NO: 822735 - DNA, 14 bp, Homo sapiens
cctgcgggccacag

SEQ ID NO: 822736 - DNA, 17 bp, Homo sapiens
cctgcgggccaggcact

SEQ ID NO: 822737 - DNA, 17 bp, Homo sapiens
cctgcgggccagggtcc

SEQ ID NO: 822738 - DNA, 20 bp, Homo sapiens
cctgcgggcgcgggcagcca

SEQ ID NO: 822739 - DNA, 23 bp, Homo sapiens
cctgcgggcgcgggcagccaccc

SEQ ID NO: 822740 - DNA, 19 bp, Homo sapiens
cctgcgggcttttccccgg

SEQ ID NO: 822741 - DNA, 20 bp, Homo sapiens
cctgcgggtcctcagctgct

SEQ ID NO: 822742 - DNA, 23 bp, Homo sapiens
cctgcggtagatgggagggaggc

SEQ ID NO: 822743 - DNA, 13 bp, Homo sapiens
cctgcgtcctcct

SEQ ID NO: 822744 - DNA, 16 bp, Homo sapiens
cctgcgtcctcctcac

SEQ ID NO: 822745 - DNA, 20 bp, Homo sapiens
cctgcgtcctgacgccctgc

SEQ ID NO: 822746 - DNA, 17 bp, Homo sapiens
cctgcgtcggccctggg

SEQ ID NO: 822747 - DNA, 14 bp, Homo sapiens
cctgcgtcttccgc

SEQ ID NO: 822748 - DNA, 18 bp, Homo sapiens
cctgcgtcttccgcccct

SEQ ID NO: 822749 - DNA, 12 bp, Homo sapiens
cctgcgtggggg

SEQ ID NO: 822750 - DNA, 15 bp, Homo sapiens
cctgcgttggagcca

SEQ ID NO: 822751 - DNA, 16 bp, Homo sapiens
cctgcgttggagccac

SEQ ID NO: 822752 - DNA, 18 bp, Homo sapiens
cctgcgttggagccactc

SEQ ID NO: 822753 - DNA, 19 bp, Homo sapiens
cctgcgttggagccactcc

SEQ ID NO: 822754 - DNA, 23 bp, Homo sapiens
cctgcgttggagccactcctgtc

SEQ ID NO: 822755 - DNA, 17 bp, Homo sapiens
cctgcgttggtccagag

SEQ ID NO: 822756 - DNA, 18 bp, Homo sapiens
cctgcgttggtccagagc

SEQ ID NO: 822757 - DNA, 19 bp, Homo sapiens
cctgctaaggctcctcctt

SEQ ID NO: 822758 - DNA, 19 bp, Homo sapiens
cctgctacttaaatttgaa

SEQ ID NO: 822759 - DNA, 14 bp, Homo sapiens
cctgctagagcaac

SEQ ID NO: 822760 - DNA, 21 bp, Homo sapiens
cctgctagcaggccccctagg

SEQ ID NO: 822761 - DNA, 16 bp, Homo sapiens
cctgctagctgtagaa

SEQ ID NO: 822762 - DNA, 22 bp, Homo sapiens
cctgctagttagcgccccaccg

SEQ ID NO: 822763 - DNA, 20 bp, Homo sapiens
cctgctatattaacatcatc

SEQ ID NO: 822764 - DNA, 18 bp, Homo sapiens
cctgctatgacagctggc

SEQ ID NO: 822765 - DNA, 15 bp, Homo sapiens
cctgctatttgaagt

SEQ ID NO: 822766 - DNA, 19 bp, Homo sapiens
cctgctcaatccctgagga

SEQ ID NO: 822767 - DNA, 15 bp, Homo sapiens
cctgctcacagggat

SEQ ID NO: 822768 - DNA, 16 bp, Homo sapiens
cctgctcacagggatg

SEQ ID NO: 822769 - DNA, 20 bp, Homo sapiens
cctgctcagcaattcagacc

SEQ ID NO: 822770 - DNA, 21 bp, Homo sapiens
cctgctcagcagccagtctca

SEQ ID NO: 822771 - DNA, 13 bp, Homo sapiens
cctgctcaggtgc

SEQ ID NO: 822772 - DNA, 14 bp, Homo sapiens
cctgctcaggtgct

SEQ ID NO: 822773 - DNA, 15 bp, Homo sapiens
cctgctcagtgcttg

SEQ ID NO: 822774 - DNA, 20 bp, Homo sapiens
cctgctcagtgcttgggctc

SEQ ID NO: 822775 - DNA, 13 bp, Homo sapiens
cctgctcatccac

SEQ ID NO: 822776 - DNA, 17 bp, Homo sapiens
cctgctcattatgccac

SEQ ID NO: 822777 - DNA, 23 bp, Homo sapiens
cctgctcattatgccacttcctt

SEQ ID NO: 822778 - DNA, 22 bp, Homo sapiens
cctgctccacgaagccttaagc

SEQ ID NO: 822779 - DNA, 12 bp, Homo sapiens
cctgctccagaa

SEQ ID NO: 822780 - DNA, 18 bp, Homo sapiens
cctgctccagaagatgcc

SEQ ID NO: 822781 - DNA, 22 bp, Homo sapiens
cctgctccagaagatgccagct

SEQ ID NO: 822782 - DNA, 13 bp, Homo sapiens
cctgctcccagca

SEQ ID NO: 822783 - DNA, 20 bp, Homo sapiens
cctgctcccattcctccctc

SEQ ID NO: 822784 - DNA, 11 bp, Homo sapiens
cctgctcccct

SEQ ID NO: 822785 - DNA, 22 bp, Homo sapiens
cctgctcccctgagaccacccc

SEQ ID NO: 822786 - DNA, 17 bp, Homo sapiens
cctgctccgctgctcct

SEQ ID NO: 822787 - DNA, 20 bp, Homo sapiens
cctgctccgtggactgcagt

SEQ ID NO: 822788 - DNA, 19 bp, Homo sapiens
cctgctccgttggtcagcg

SEQ ID NO: 822789 - DNA, 14 bp, Homo sapiens
cctgctcctaaggg

SEQ ID NO: 822790 - DNA, 20 bp, Homo sapiens
cctgctcctcacccctgtag

SEQ ID NO: 822791 - DNA, 19 bp, Homo sapiens
cctgctcctcactggagga

SEQ ID NO: 822792 - DNA, 14 bp, Homo sapiens
cctgctcctcatgg

SEQ ID NO: 822793 - DNA, 15 bp, Homo sapiens
cctgctcctccctgc

SEQ ID NO: 822794 - DNA, 18 bp, Homo sapiens
cctgctcctccctggctg

SEQ ID NO: 822795 - DNA, 19 bp, Homo sapiens
cctgctcctccctggctgc

SEQ ID NO: 822796 - DNA, 14 bp, Homo sapiens
cctgctcctgcagc

SEQ ID NO: 822797 - DNA, 20 bp, Homo sapiens
cctgctccttggcaccccca

SEQ ID NO: 822798 - DNA, 23 bp, Homo sapiens
cctgctccttttgtatcttcctt

SEQ ID NO: 822799 - DNA, 21 bp, Homo sapiens
cctgctcgatgctcacagggc

SEQ ID NO: 822800 - DNA, 16 bp, Homo sapiens
cctgctctacccatga

SEQ ID NO: 822801 - DNA, 23 bp, Homo sapiens
cctgctctacccatgagcctgcc

SEQ ID NO: 822802 - DNA, 17 bp, Homo sapiens
cctgctctagtgggaca

SEQ ID NO: 822803 - DNA, 19 bp, Homo sapiens
cctgctctagtgggacagc

SEQ ID NO: 822804 - DNA, 22 bp, Homo sapiens
cctgctctagtgggacagccca

SEQ ID NO: 822805 - DNA, 16 bp, Homo sapiens
cctgctctcctcttgc

SEQ ID NO: 822806 - DNA, 18 bp, Homo sapiens
cctgctctcctcttgcca

SEQ ID NO: 822807 - DNA, 22 bp, Homo sapiens
cctgctctcctcttgccactgc

SEQ ID NO: 822808 - DNA, 16 bp, Homo sapiens
cctgctctctgctcat

SEQ ID NO: 822809 - DNA, 19 bp, Homo sapiens
cctgctctctgctcatggg

SEQ ID NO: 822810 - DNA, 20 bp, Homo sapiens
cctgctctcttcaggaggcc

SEQ ID NO: 822811 - DNA, 23 bp, Homo sapiens
cctgctctcttcaggaggccctg

SEQ ID NO: 822812 - DNA, 14 bp, Homo sapiens
cctgctctggagcc

SEQ ID NO: 822813 - DNA, 19 bp, Homo sapiens
cctgctgaacacagtgtct

SEQ ID NO: 822814 - DNA, 20 bp, Homo sapiens
cctgctgacagacactaact

SEQ ID NO: 822815 - DNA, 16 bp, Homo sapiens
cctgctgacctgtgca

SEQ ID NO: 822816 - DNA, 14 bp, Homo sapiens
cctgctgaccttgg

SEQ ID NO: 822817 - DNA, 22 bp, Homo sapiens
cctgctgaccttggaggaatga

SEQ ID NO: 822818 - DNA, 21 bp, Homo sapiens
cctgctgagagacccaaggag

SEQ ID NO: 822819 - DNA, 18 bp, Homo sapiens
cctgctgagagcccccac

SEQ ID NO: 822820 - DNA, 20 bp, Homo sapiens
cctgctgagagcccccacct

SEQ ID NO: 822821 - DNA, 20 bp, Homo sapiens
cctgctgagcctcacagcag

SEQ ID NO: 822822 - DNA, 13 bp, Homo sapiens
cctgctgaggagg

SEQ ID NO: 822823 - DNA, 15 bp, Homo sapiens
cctgctgaggccttc

SEQ ID NO: 822824 - DNA, 17 bp, Homo sapiens
cctgctgaggccttctc

SEQ ID NO: 822825 - DNA, 18 bp, Homo sapiens
cctgctgaggccttctct

SEQ ID NO: 822826 - DNA, 14 bp, Homo sapiens
cctgctgcaccctg

SEQ ID NO: 822827 - DNA, 21 bp, Homo sapiens
cctggcagggctcacactcct

SEQ ID NO: 822828 - DNA, 22 bp, Homo sapiens
cctggcagggtcatcctgtgct

SEQ ID NO: 822829 - DNA, 23 bp, Homo sapiens
cctggcagggtcatcctgtgctc

SEQ ID NO: 822830 - DNA, 18 bp, Homo sapiens
cctggcagtggctctcag

SEQ ID NO: 822831 - DNA, 19 bp, Homo sapiens
cctggcagtggctctcaga

SEQ ID NO: 822832 - DNA, 17 bp, Homo sapiens
cctggcatgacactcta

SEQ ID NO: 822833 - DNA, 19 bp, Homo sapiens
cctggcatgatggacaaag

SEQ ID NO: 822834 - DNA, 17 bp, Homo sapiens
cctggcattcttgtaca

SEQ ID NO: 822835 - DNA, 18 bp, Homo sapiens
cctggcattcttgtacag

SEQ ID NO: 822836 - DNA, 19 bp, Homo sapiens
cctggccaccagccatcct

SEQ ID NO: 822837 - DNA, 21 bp, Homo sapiens
cctggccaccagccatcctcc

SEQ ID NO: 822838 - DNA, 13 bp, Homo sapiens
cctggccacctct

SEQ ID NO: 822839 - DNA, 18 bp, Homo sapiens
cctggccacctctctcct

SEQ ID NO: 822840 - DNA, 13 bp, Homo sapiens
cctggccacctga

SEQ ID NO: 822841 - DNA, 16 bp, Homo sapiens
cctggccacctgaggt

SEQ ID NO: 822842 - DNA, 13 bp, Homo sapiens
cctggccagacaa

SEQ ID NO: 822843 - DNA, 14 bp, Homo sapiens
cctggccaggagca

SEQ ID NO: 822844 - DNA, 16 bp, Homo sapiens
cctggccaggagctct

SEQ ID NO: 822845 - DNA, 13 bp, Homo sapiens
cctggccaggcac

SEQ ID NO: 822846 - DNA, 22 bp, Homo sapiens
cctggccaggcagatctgtgcc

SEQ ID NO: 822847 - DNA, 14 bp, Homo sapiens
cctggccatcccac

SEQ ID NO: 822848 - DNA, 17 bp, Homo sapiens
cctggccatcccacaag

SEQ ID NO: 822849 - DNA, 14 bp, Homo sapiens
cctggccatgctgt

SEQ ID NO: 822850 - DNA, 20 bp, Homo sapiens
cctggccatgctgtccctgc

SEQ ID NO: 822851 - DNA, 21 bp, Homo sapiens
cctggccatttggccccaggg

SEQ ID NO: 822852 - DNA, 19 bp, Homo sapiens
cctggcccaccccccagcc

SEQ ID NO: 822853 - DNA, 23 bp, Homo sapiens
cctggcccaccccccagcctcca

SEQ ID NO: 822854 - DNA, 16 bp, Homo sapiens
cctggcccactgcatc

SEQ ID NO: 822855 - DNA, 17 bp, Homo sapiens
cctggcccatcaactgt

SEQ ID NO: 822856 - DNA, 14 bp, Homo sapiens
cctggcccatctca

SEQ ID NO: 822857 - DNA, 17 bp, Homo sapiens
cctggcccatctcagcc

SEQ ID NO: 822858 - DNA, 22 bp, Homo sapiens
cctggcccatctcagcctcctg

SEQ ID NO: 822859 - DNA, 17 bp, Homo sapiens
cctggcccattcttgag

SEQ ID NO: 822860 - DNA, 19 bp, Homo sapiens
cctggcccattcttgagtt

SEQ ID NO: 822861 - DNA, 18 bp, Homo sapiens
cctggccccaggccccag

SEQ ID NO: 822862 - DNA, 19 bp, Homo sapiens
cctggccccaggccccaga

SEQ ID NO: 822863 - DNA, 22 bp, Homo sapiens
cctggccccaggccccagacag

SEQ ID NO: 822864 - DNA, 20 bp, Homo sapiens
cctggccccatgtctctcag

SEQ ID NO: 822865 - DNA, 15 bp, Homo sapiens
cctggccccgcctgc

SEQ ID NO: 822866 - DNA, 18 bp, Homo sapiens
cctggccccgcctgcctg

SEQ ID NO: 822867 - DNA, 22 bp, Homo sapiens
cctggccccgcctgcctgccac

SEQ ID NO: 822868 - DNA, 21 bp, Homo sapiens
cctggccccgggctctggcca

SEQ ID NO: 822869 - DNA, 12 bp, Homo sapiens
cctggcccctcc

SEQ ID NO: 822870 - DNA, 21 bp, Homo sapiens
cctggcccctccagaccctgc

SEQ ID NO: 822871 - DNA, 23 bp, Homo sapiens
cctggcccctccagaccctgcct

SEQ ID NO: 822872 - DNA, 16 bp, Homo sapiens
cctggcccgccctcac

SEQ ID NO: 822873 - DNA, 22 bp, Homo sapiens
cctggcccgccctcacctctga

SEQ ID NO: 822874 - DNA, 12 bp, Homo sapiens
cctggccctccc

SEQ ID NO: 822875 - DNA, 21 bp, Homo sapiens
cctggccctccctccctagcc

SEQ ID NO: 822876 - DNA, 13 bp, Homo sapiens
cctggccctgctt

SEQ ID NO: 822877 - DNA, 13 bp, Homo sapiens
cctggccctgggg

SEQ ID NO: 822878 - DNA, 13 bp, Homo sapiens
cctggcccttcag

SEQ ID NO: 822879 - DNA, 17 bp, Homo sapiens
cctggcccttcagtctg

SEQ ID NO: 822880 - DNA, 22 bp, Homo sapiens
cctggcccttcagtctgctcca

SEQ ID NO: 822881 - DNA, 12 bp, Homo sapiens
cctggccgcccc

SEQ ID NO: 822882 - DNA, 17 bp, Homo sapiens
cctggccgctaagttgc

SEQ ID NO: 822883 - DNA, 19 bp, Homo sapiens
cctggccggcaaccccagt

SEQ ID NO: 822884 - DNA, 19 bp, Homo sapiens
cctggccgggtcaccctgt

SEQ ID NO: 822885 - DNA, 16 bp, Homo sapiens
cctggcctagaccagc

SEQ ID NO: 822886 - DNA, 17 bp, Homo sapiens
cctggcctagaccagca

SEQ ID NO: 822887 - DNA, 20 bp, Homo sapiens
cctggcctagaccagcagac

SEQ ID NO: 822888 - DNA, 23 bp, Homo sapiens
cctggcctatccgctgccagcct

SEQ ID NO: 822889 - DNA, 17 bp, Homo sapiens
cctggcctcagttccca

SEQ ID NO: 822890 - DNA, 22 bp, Homo sapiens
cctggcctcagttcccagctcc

SEQ ID NO: 822891 - DNA, 19 bp, Homo sapiens
cctggcctcccctgccacc

SEQ ID NO: 822892 - DNA, 16 bp, Homo sapiens
cctggcctcttctggg

SEQ ID NO: 822893 - DNA, 19 bp, Homo sapiens
cctggcctgaactgaggag

SEQ ID NO: 822894 - DNA, 17 bp, Homo sapiens
cctggcctgagctgggg

SEQ ID NO: 822895 - DNA, 15 bp, Homo sapiens
cctggcctgccagac

SEQ ID NO: 822896 - DNA, 12 bp, Homo sapiens
cctggcctgctg

SEQ ID NO: 822897 - DNA, 14 bp, Homo sapiens
cctggcctgctggg

SEQ ID NO: 822898 - DNA, 18 bp, Homo sapiens
cctggcctgctgggaacc

SEQ ID NO: 822899 - DNA, 13 bp, Homo sapiens
cctggcctggctc

SEQ ID NO: 822900 - DNA, 14 bp, Homo sapiens
cctggcctggctgg

SEQ ID NO: 822901 - DNA, 11 bp, Homo sapiens
cctggcctgtt

SEQ ID NO: 822902 - DNA, 17 bp, Homo sapiens
cctggccttaaaagggg

SEQ ID NO: 822903 - DNA, 20 bp, Homo sapiens
cctggccttctgaactccat

SEQ ID NO: 822904 - DNA, 19 bp, Homo sapiens
cctggccttgtcctcagcc

SEQ ID NO: 822905 - DNA, 21 bp, Homo sapiens
cctggccttgtcctcagccag

SEQ ID NO: 822906 - DNA, 15 bp, Homo sapiens
cctggcgcaggtggg

SEQ ID NO: 822907 - DNA, 19 bp, Homo sapiens
cctggcgggggtgggccgt

SEQ ID NO: 822908 - DNA, 21 bp, Homo sapiens
cctggcggggttggcccttgt

SEQ ID NO: 822909 - DNA, 18 bp, Homo sapiens
cctggcgtcggccagagg

SEQ ID NO: 822910 - DNA, 17 bp, Homo sapiens
cctggcgtgctcagacc

SEQ ID NO: 822911 - DNA, 18 bp, Homo sapiens
cctggctacatcccagcc

SEQ ID NO: 822912 - DNA, 23 bp, Homo sapiens
cctggctacatcccagcctgtgg

SEQ ID NO: 822913 - DNA, 12 bp, Homo sapiens
cctggctcccac

SEQ ID NO: 822914 - DNA, 15 bp, Homo sapiens
cctggctcccacctg

SEQ ID NO: 822915 - DNA, 13 bp, Homo sapiens
cctggctccccac

SEQ ID NO: 822916 - DNA, 18 bp, Homo sapiens
cctggctccccacgagtc

SEQ ID NO: 822917 - DNA, 12 bp, Homo sapiens
cctggctccctc

SEQ ID NO: 822918 - DNA, 21 bp, Homo sapiens
cctggctccgtccaggagcct

SEQ ID NO: 822919 - DNA, 16 bp, Homo sapiens
cctggctccttgcagc

SEQ ID NO: 822920 - DNA, 10 bp, Homo sapiens
cctggctctg

SEQ ID NO: 822921 - DNA, 18 bp, Homo sapiens
cctggctctgccccctcc

SEQ ID NO: 822922 - DNA, 15 bp, Homo sapiens
cctggctctgcccct

SEQ ID NO: 822923 - DNA, 16 bp, Homo sapiens
cctggctctgcccctc

SEQ ID NO: 822924 - DNA, 19 bp, Homo sapiens
cctggctctgcccctcagg

SEQ ID NO: 822925 - DNA, 23 bp, Homo sapiens
cctggctctgggccgggcctggg

SEQ ID NO: 822926 - DNA, 18 bp, Homo sapiens
cctggctgagcctggctg

SEQ ID NO: 822927 - DNA, 19 bp, Homo sapiens
cctggctgagcctggctgg

SEQ ID NO: 822928 - DNA, 21 bp, Homo sapiens
cctggctgaggttcctctgcc

SEQ ID NO: 822929 - DNA, 22 bp, Homo sapiens
cctggctgatgatccagaacag

SEQ ID NO: 822930 - DNA, 12 bp, Homo sapiens
cctggctgccag

SEQ ID NO: 822931 - DNA, 13 bp, Homo sapiens
cctggctgccctg

SEQ ID NO: 822932 - DNA, 19 bp, Homo sapiens
cctggctgccctggccctg

SEQ ID NO: 822933 - DNA, 14 bp, Homo sapiens
cctggctgctaggc

SEQ ID NO: 822934 - DNA, 16 bp, Homo sapiens
cctggctgctaggcca

SEQ ID NO: 822935 - DNA, 19 bp, Homo sapiens
cctggctgctaggccagag

SEQ ID NO: 822936 - DNA, 18 bp, Homo sapiens
cctggctgctgcccccac

SEQ ID NO: 822937 - DNA, 20 bp, Homo sapiens
cctggctgctgcccccaccc

SEQ ID NO: 822938 - DNA, 21 bp, Homo sapiens
cctggctgctgcccccacccc

SEQ ID NO: 822939 - DNA, 22 bp, Homo sapiens
cctggctgctgcccccaccccg

SEQ ID NO: 822940 - DNA, 20 bp, Homo sapiens
cctggctgctgcttcttgct

SEQ ID NO: 822941 - DNA, 22 bp, Homo sapiens
cctggctgggacgtggctcagc

SEQ ID NO: 822942 - DNA, 24 bp, Homo sapiens
cctggctgggacgtggctcagcca

SEQ ID NO: 822943 - DNA, 18 bp, Homo sapiens
cctggctgtgcccagcag

SEQ ID NO: 822944 - DNA, 20 bp, Homo sapiens
cctggctgtgcccagcaggc

SEQ ID NO: 822945 - DNA, 15 bp, Homo sapiens
cctggctgtggaggc

SEQ ID NO: 822946 - DNA, 16 bp, Homo sapiens
cctggctgtggaggcc

SEQ ID NO: 822947 - DNA, 17 bp, Homo sapiens
cctggctgtggaggcct

SEQ ID NO: 822948 - DNA, 12 bp, Homo sapiens
cctgtccagcct

SEQ ID NO: 822949 - DNA, 16 bp, Homo sapiens
cctgtccagcctgggc

SEQ ID NO: 822950 - DNA, 18 bp, Homo sapiens
cctgtccatcagccagga

SEQ ID NO: 822951 - DNA, 19 bp, Homo sapiens
cctgtcccaccaactctgc

SEQ ID NO: 822952 - DNA, 21 bp, Homo sapiens
cctgtcccaccaactctgcac

SEQ ID NO: 822953 - DNA, 15 bp, Homo sapiens
cctgtcccaccccca

SEQ ID NO: 822954 - DNA, 13 bp, Homo sapiens
cctgtcccacctc

SEQ ID NO: 822955 - DNA, 15 bp, Homo sapiens
cctgtcccacctggc

SEQ ID NO: 822956 - DNA, 17 bp, Homo sapiens
cctgtcccacctggctc

SEQ ID NO: 822957 - DNA, 12 bp, Homo sapiens
cctgtcccagga

SEQ ID NO: 822958 - DNA, 21 bp, Homo sapiens
cctgtcccaggccggcccaga

SEQ ID NO: 822959 - DNA, 15 bp, Homo sapiens
cctgtcccagggccc

SEQ ID NO: 822960 - DNA, 16 bp, Homo sapiens
cctgtcccagggccct

SEQ ID NO: 822961 - DNA, 23 bp, Homo sapiens
cctgtcccagggccctcccagcc

SEQ ID NO: 822962 - DNA, 19 bp, Homo sapiens
cctgtcccatggacactcc

SEQ ID NO: 822963 - DNA, 20 bp, Homo sapiens
cctgtccccaaacaggacag

SEQ ID NO: 822964 - DNA, 23 bp, Homo sapiens
cctgtccccaagacacttcccct

SEQ ID NO: 822965 - DNA, 12 bp, Homo sapiens
cctgtccccaga

SEQ ID NO: 822966 - DNA, 14 bp, Homo sapiens
cctgtccccagacc

SEQ ID NO: 822967 - DNA, 14 bp, Homo sapiens
cctgtccccaggcc

SEQ ID NO: 822968 - DNA, 12 bp, Homo sapiens
cctgtccccagt

SEQ ID NO: 822969 - DNA, 20 bp, Homo sapiens
cctgtccccagtccccagcc

SEQ ID NO: 822970 - DNA, 13 bp, Homo sapiens
cctgtccccatgc

SEQ ID NO: 822971 - DNA, 12 bp, Homo sapiens
cctgtcccccag

SEQ ID NO: 822972 - DNA, 15 bp, Homo sapiens
cctgtcccccagcat

SEQ ID NO: 822973 - DNA, 16 bp, Homo sapiens
cctgtcccccagcatc

SEQ ID NO: 822974 - DNA, 19 bp, Homo sapiens
cctgtcccccagctctggt

SEQ ID NO: 822975 - DNA, 16 bp, Homo sapiens
cctgtccccctcccct

SEQ ID NO: 822976 - DNA, 21 bp, Homo sapiens
cctgtccccctcccctcccag

SEQ ID NO: 822977 - DNA, 23 bp, Homo sapiens
cctgtccccctcccctcccagtc

SEQ ID NO: 822978 - DNA, 16 bp, Homo sapiens
cctgtccccgccgggc

SEQ ID NO: 822979 - DNA, 14 bp, Homo sapiens
cctgtcccgccttc

SEQ ID NO: 822980 - DNA, 22 bp, Homo sapiens
cctgtccctctcaggcatgcct

SEQ ID NO: 822981 - DNA, 14 bp, Homo sapiens
cctgtccctgaggt

SEQ ID NO: 822982 - DNA, 16 bp, Homo sapiens
cctgtccctgccccgc

SEQ ID NO: 822983 - DNA, 23 bp, Homo sapiens
cctgtcccttctcttaatttaat

SEQ ID NO: 822984 - DNA, 14 bp, Homo sapiens
cctgtccggcccag

SEQ ID NO: 822985 - DNA, 20 bp, Homo sapiens
cctgtccggcccagtgccac

SEQ ID NO: 822986 - DNA, 17 bp, Homo sapiens
cctgtcctaaggaacct

SEQ ID NO: 822987 - DNA, 12 bp, Homo sapiens
cctgtcctcacc

SEQ ID NO: 822988 - DNA, 15 bp, Homo sapiens
cctgtcctcaccgtc

SEQ ID NO: 822989 - DNA, 17 bp, Homo sapiens
cctgtcctcaccgtctc

SEQ ID NO: 822990 - DNA, 14 bp, Homo sapiens
cctgtcctcctcgg

SEQ ID NO: 822991 - DNA, 12 bp, Homo sapiens
cctgtcctcttt

SEQ ID NO: 822992 - DNA, 22 bp, Homo sapiens
cctgtcctgatggtcagctccc

SEQ ID NO: 822993 - DNA, 23 bp, Homo sapiens
cctgtcctgatggtcagctccct

SEQ ID NO: 822994 - DNA, 13 bp, Homo sapiens
cctgtcctgcctc

SEQ ID NO: 822995 - DNA, 16 bp, Homo sapiens
cctgtcctgcctcctc

SEQ ID NO: 822996 - DNA, 20 bp, Homo sapiens
cctgtcctggtacagcaggg

SEQ ID NO: 822997 - DNA, 15 bp, Homo sapiens
cctgtcctggtggta

SEQ ID NO: 822998 - DNA, 13 bp, Homo sapiens
cctgtccttccct

SEQ ID NO: 822999 - DNA, 18 bp, Homo sapiens
cctgtccttgaaaaacaa

SEQ ID NO: 823000 - DNA, 15 bp, Homo sapiens
cctgtcctttcttgc

SEQ ID NO: 823001 - DNA, 14 bp, Homo sapiens
cctgtcgagacact

SEQ ID NO: 823002 - DNA, 15 bp, Homo sapiens
cctgtcgagacactt

SEQ ID NO: 823003 - DNA, 17 bp, Homo sapiens
cctgtcgagacacttgc

SEQ ID NO: 823004 - DNA, 20 bp, Homo sapiens
cctgtcgagacacttgcctt

SEQ ID NO: 823005 - DNA, 18 bp, Homo sapiens
cctgtcgcccacccagct

SEQ ID NO: 823006 - DNA, 21 bp, Homo sapiens
cctgtcgcccacccagctggt

SEQ ID NO: 823007 - DNA, 18 bp, Homo sapiens
cctgtcggtggctgcctt

SEQ ID NO: 823008 - DNA, 14 bp, Homo sapiens
cctgtcgtgccagt

SEQ ID NO: 823009 - DNA, 23 bp, Homo sapiens
cctgtctaaagccttaactaaga

SEQ ID NO: 823010 - DNA, 20 bp, Homo sapiens
cctgtctataagagaattat

SEQ ID NO: 823011 - DNA, 15 bp, Homo sapiens
cctgtctcacctgga

SEQ ID NO: 823012 - DNA, 13 bp, Homo sapiens
cctgtctcagcct

SEQ ID NO: 823013 - DNA, 16 bp, Homo sapiens
cctgtctcagcctccc

SEQ ID NO: 823014 - DNA, 16 bp, Homo sapiens
cctgtctccactgtgc

SEQ ID NO: 823015 - DNA, 23 bp, Homo sapiens
cctgtctccactgtgcctttgca

SEQ ID NO: 823016 - DNA, 18 bp, Homo sapiens
cctgtctccagctgcctg

SEQ ID NO: 823017 - DNA, 20 bp, Homo sapiens
cctgtctccagctgcctggg

SEQ ID NO: 823018 - DNA, 13 bp, Homo sapiens
cctgtctccaggg

SEQ ID NO: 823019 - DNA, 12 bp, Homo sapiens
cctgtctccctt

SEQ ID NO: 823020 - DNA, 12 bp, Homo sapiens
cctgtctccttt

SEQ ID NO: 823021 - DNA, 13 bp, Homo sapiens
cctgtctcctttc

SEQ ID NO: 823022 - DNA, 19 bp, Homo sapiens
cctgtctcgggctgaccct

SEQ ID NO: 823023 - DNA, 22 bp, Homo sapiens
cctgtctcgggctgaccctttt

SEQ ID NO: 823024 - DNA, 14 bp, Homo sapiens
cctgtctcggggct

SEQ ID NO: 823025 - DNA, 14 bp, Homo sapiens
cctgtctctgcaca

SEQ ID NO: 823026 - DNA, 13 bp, Homo sapiens
cctgtctctgccc

SEQ ID NO: 823027 - DNA, 14 bp, Homo sapiens
cctgtctctttcca

SEQ ID NO: 823028 - DNA, 14 bp, Homo sapiens
cctgtctgccagcc

SEQ ID NO: 823029 - DNA, 12 bp, Homo sapiens
cctgtctgcccc

SEQ ID NO: 823030 - DNA, 14 bp, Homo sapiens
cctgtctgccccag

SEQ ID NO: 823031 - DNA, 19 bp, Homo sapiens
cctgtctgccccagcccag

SEQ ID NO: 823032 - DNA, 14 bp, Homo sapiens
cctgtctggctcag

SEQ ID NO: 823033 - DNA, 21 bp, Homo sapiens
cctgtctggctcggacccacc

SEQ ID NO: 823034 - DNA, 20 bp, Homo sapiens
cctgtctggcttctagagat

SEQ ID NO: 823035 - DNA, 14 bp, Homo sapiens
cctgtctgtttata

SEQ ID NO: 823036 - DNA, 19 bp, Homo sapiens
cctgtcttatggtccagaa

SEQ ID NO: 823037 - DNA, 14 bp, Homo sapiens
cctgtcttccaagg

SEQ ID NO: 823038 - DNA, 14 bp, Homo sapiens
cctgtctttaagga

SEQ ID NO: 823039 - DNA, 20 bp, Homo sapiens
cctgtgaataaaaaccctgt

SEQ ID NO: 823040 - DNA, 17 bp, Homo sapiens
cctgtgaatgccactgc

SEQ ID NO: 823041 - DNA, 21 bp, Homo sapiens
cctgtgaatgccactgccttc

SEQ ID NO: 823042 - DNA, 22 bp, Homo sapiens
cctgtgaatgccactgccttcg

SEQ ID NO: 823043 - DNA, 15 bp, Homo sapiens
cctgtgaatggaggc

SEQ ID NO: 823044 - DNA, 18 bp, Homo sapiens
cctgtgaatggaggcaga

SEQ ID NO: 823045 - DNA, 17 bp, Homo sapiens
cctgtgaccagcactgt

SEQ ID NO: 823046 - DNA, 19 bp, Homo sapiens
cctgtgaccagtctgaccc

SEQ ID NO: 823047 - DNA, 15 bp, Homo sapiens
cctgtgaccctctca

SEQ ID NO: 823048 - DNA, 14 bp, Homo sapiens
cctgtgaccttggg

SEQ ID NO: 823049 - DNA, 15 bp, Homo sapiens
cctgtgaccttggga

SEQ ID NO: 823050 - DNA, 17 bp, Homo sapiens
cctgtgaccttgggacc

SEQ ID NO: 823051 - DNA, 16 bp, Homo sapiens
cctgtgactgtctcac

SEQ ID NO: 823052 - DNA, 14 bp, Homo sapiens
cctgtgagatgtgt

SEQ ID NO: 823053 - DNA, 13 bp, Homo sapiens
cctgtgaggcagg

SEQ ID NO: 823054 - DNA, 14 bp, Homo sapiens
cctgtgaggcaggg

SEQ ID NO: 823055 - DNA, 17 bp, Homo sapiens
cctgtgaggcaggggcg

SEQ ID NO: 823056 - DNA, 14 bp, Homo sapiens
cctgtgcactgggc

SEQ ID NO: 823057 - DNA, 17 bp, Homo sapiens
cctgtgcagatgctgct

SEQ ID NO: 823058 - DNA, 16 bp, Homo sapiens
cctgtgcagcagccca

SEQ ID NO: 823059 - DNA, 17 bp, Homo sapiens
cctgtgcagcagcccag

SEQ ID NO: 823060 - DNA, 19 bp, Homo sapiens
cctgtgcagcagcccagct

SEQ ID NO: 823061 - DNA, 20 bp, Homo sapiens
cctgtgcagcagcccagctt

SEQ ID NO: 823062 - DNA, 18 bp, Homo sapiens
cctgtgcagccgctgagc

SEQ ID NO: 823063 - DNA, 15 bp, Homo sapiens
cctgtgccaacctga

SEQ ID NO: 823064 - DNA, 20 bp, Homo sapiens
cctgtgccaacctgatgccc

SEQ ID NO: 823065 - DNA, 12 bp, Homo sapiens
cctgtgccaata

SEQ ID NO: 823066 - DNA, 12 bp, Homo sapiens
cctgtgccagca

SEQ ID NO: 823067 - DNA, 15 bp, Homo sapiens
cctgtgccaggctga

SEQ ID NO: 823068 - DNA, 14 bp, Homo sapiens
cctgtgccatgccc

SEQ ID NO: 823069 - DNA, 13 bp, Homo sapiens
cctgtgccccagc

SEQ ID NO: 823070 - DNA, 15 bp, Homo sapiens
cctgtgccccagctg

SEQ ID NO: 823071 - DNA, 20 bp, Homo sapiens
cctgtgccccagctgccagg

SEQ ID NO: 823072 - DNA, 13 bp, Homo sapiens
ccttatcctctga

SEQ ID NO: 823073 - DNA, 18 bp, Homo sapiens
ccttatcctctgatctcc

SEQ ID NO: 823074 - DNA, 15 bp, Homo sapiens
ccttatgctacacag

SEQ ID NO: 823075 - DNA, 17 bp, Homo sapiens
ccttatgggatcatttt

SEQ ID NO: 823076 - DNA, 22 bp, Homo sapiens
ccttatgggatcatttttccag

SEQ ID NO: 823077 - DNA, 17 bp, Homo sapiens
ccttattaaggccccag

SEQ ID NO: 823078 - DNA, 22 bp, Homo sapiens
ccttattacacggaaaacggtg

SEQ ID NO: 823079 - DNA, 21 bp, Homo sapiens
ccttattagagtgtctttcca

SEQ ID NO: 823080 - DNA, 16 bp, Homo sapiens
ccttattcttctcata

SEQ ID NO: 823081 - DNA, 12 bp, Homo sapiens
ccttattgctgc

SEQ ID NO: 823082 - DNA, 18 bp, Homo sapiens
ccttattgctgccaaaac

SEQ ID NO: 823083 - DNA, 21 bp, Homo sapiens
ccttattgctgccaaaaccac

SEQ ID NO: 823084 - DNA, 18 bp, Homo sapiens
ccttattgctgtcctgga

SEQ ID NO: 823085 - DNA, 14 bp, Homo sapiens
ccttatttccctat

SEQ ID NO: 823086 - DNA, 21 bp, Homo sapiens
ccttatttctctctcctggtg

SEQ ID NO: 823087 - DNA, 22 bp, Homo sapiens
ccttatttgctaatcaaagcca

SEQ ID NO: 823088 - DNA, 20 bp, Homo sapiens
ccttatttgtctgtaaaaaa

SEQ ID NO: 823089 - DNA, 23 bp, Homo sapiens
ccttatttgtctgtaaaaaatgg

SEQ ID NO: 823090 - DNA, 14 bp, Homo sapiens
ccttattttcaaga

SEQ ID NO: 823091 - DNA, 20 bp, Homo sapiens
ccttattttgagtaaatatt

SEQ ID NO: 823092 - DNA, 22 bp, Homo sapiens
ccttatttttagccataatttt

SEQ ID NO: 823093 - DNA, 20 bp, Homo sapiens
ccttatttttgtatgccttt

SEQ ID NO: 823094 - DNA, 16 bp, Homo sapiens
ccttattttttcccaa

SEQ ID NO: 823095 - DNA, 21 bp, Homo sapiens
ccttcaaaatgttctatttaa

SEQ ID NO: 823096 - DNA, 15 bp, Homo sapiens
ccttcaacccagtgg

SEQ ID NO: 823097 - DNA, 16 bp, Homo sapiens
ccttcaactcctggct

SEQ ID NO: 823098 - DNA, 19 bp, Homo sapiens
ccttcaagaactctgggct

SEQ ID NO: 823099 - DNA, 21 bp, Homo sapiens
ccttcaaggactgtttcagtg

SEQ ID NO: 823100 - DNA, 22 bp, Homo sapiens
ccttcaaggactgtttcagtgt

SEQ ID NO: 823101 - DNA, 13 bp, Homo sapiens
ccttcaaggcctc

SEQ ID NO: 823102 - DNA, 19 bp, Homo sapiens
ccttcaagttagctcagga

SEQ ID NO: 823103 - DNA, 14 bp, Homo sapiens
ccttcaattcctgg

SEQ ID NO: 823104 - DNA, 15 bp, Homo sapiens
ccttcaattcctggg

SEQ ID NO: 823105 - DNA, 11 bp, Homo sapiens
ccttcacaaat

SEQ ID NO: 823106 - DNA, 12 bp, Homo sapiens
ccttcacagtgt

SEQ ID NO: 823107 - DNA, 14 bp, Homo sapiens
ccttcacctcggag

SEQ ID NO: 823108 - DNA, 12 bp, Homo sapiens
ccttcactgcca

SEQ ID NO: 823109 - DNA, 15 bp, Homo sapiens
ccttcactgccatga

SEQ ID NO: 823110 - DNA, 19 bp, Homo sapiens
ccttcactgtcaccaccct

SEQ ID NO: 823111 - DNA, 20 bp, Homo sapiens
ccttcacttctgaccacact

SEQ ID NO: 823112 - DNA, 22 bp, Homo sapiens
ccttcacttctgaccacacttc

SEQ ID NO: 823113 - DNA, 17 bp, Homo sapiens
ccttcagaacagaggca

SEQ ID NO: 823114 - DNA, 19 bp, Homo sapiens
ccttcagaatgctcctgag

SEQ ID NO: 823115 - DNA, 20 bp, Homo sapiens
ccttcagacaccctcaacct

SEQ ID NO: 823116 - DNA, 11 bp, Homo sapiens
ccttcagaggc

SEQ ID NO: 823117 - DNA, 14 bp, Homo sapiens
ccttcagcacagga

SEQ ID NO: 823118 - DNA, 13 bp, Homo sapiens
ccttcagccctgg

SEQ ID NO: 823119 - DNA, 19 bp, Homo sapiens
ccttcagccctggccaagc

SEQ ID NO: 823120 - DNA, 21 bp, Homo sapiens
ccttcagccctggccaagctt

SEQ ID NO: 823121 - DNA, 13 bp, Homo sapiens
ccttcagccttaa

SEQ ID NO: 823122 - DNA, 14 bp, Homo sapiens
ccttcagctcctga

SEQ ID NO: 823123 - DNA, 22 bp, Homo sapiens
ccttcagctcctgagtagctgg

SEQ ID NO: 823124 - DNA, 13 bp, Homo sapiens
ccttcagggccag

SEQ ID NO: 823125 - DNA, 15 bp, Homo sapiens
ccttcagggccagaa

SEQ ID NO: 823126 - DNA, 21 bp, Homo sapiens
ccttcagtaggaacaagctgg

SEQ ID NO: 823127 - DNA, 23 bp, Homo sapiens
ccttcagtaggaacaagctggct

SEQ ID NO: 823128 - DNA, 18 bp, Homo sapiens
ccttcagtctgctccacc

SEQ ID NO: 823129 - DNA, 16 bp, Homo sapiens
ccttcagtgagcccct

SEQ ID NO: 823130 - DNA, 17 bp, Homo sapiens
ccttcagtgagcccctc

SEQ ID NO: 823131 - DNA, 12 bp, Homo sapiens
ccttcagtgccc

SEQ ID NO: 823132 - DNA, 14 bp, Homo sapiens
ccttcagtgcccac

SEQ ID NO: 823133 - DNA, 16 bp, Homo sapiens
ccttcagtgcccacca

SEQ ID NO: 823134 - DNA, 18 bp, Homo sapiens
ccttcagtgcccaccaac

SEQ ID NO: 823135 - DNA, 16 bp, Homo sapiens
ccttcagtttgtaaag

SEQ ID NO: 823136 - DNA, 15 bp, Homo sapiens
ccttcataccgcctc

SEQ ID NO: 823137 - DNA, 21 bp, Homo sapiens
ccttcataccgcctcgtgcca

SEQ ID NO: 823138 - DNA, 21 bp, Homo sapiens
ccttcataggcggtcatgtgt

SEQ ID NO: 823139 - DNA, 17 bp, Homo sapiens
ccttcatctccagggag

SEQ ID NO: 823140 - DNA, 15 bp, Homo sapiens
ccttcatctgaaacc

SEQ ID NO: 823141 - DNA, 17 bp, Homo sapiens
ccttcatctgggacaaa

SEQ ID NO: 823142 - DNA, 15 bp, Homo sapiens
ccttcatcttcctgt

SEQ ID NO: 823143 - DNA, 19 bp, Homo sapiens
ccttcatcttcctgtgtcc

SEQ ID NO: 823144 - DNA, 20 bp, Homo sapiens
ccttcatcttcctgtgtcct

SEQ ID NO: 823145 - DNA, 14 bp, Homo sapiens
ccttcatgaatctt

SEQ ID NO: 823146 - DNA, 17 bp, Homo sapiens
ccttcatttccaccagg

SEQ ID NO: 823147 - DNA, 21 bp, Homo sapiens
ccttcatttgcaattcatgta

SEQ ID NO: 823148 - DNA, 12 bp, Homo sapiens
ccttcattttta

SEQ ID NO: 823149 - DNA, 19 bp, Homo sapiens
ccttccaaaacctgcttcc

SEQ ID NO: 823150 - DNA, 22 bp, Homo sapiens
ccttccaaaacctgcttccttc

SEQ ID NO: 823151 - DNA, 21 bp, Homo sapiens
ccttccaactagctgggacta

SEQ ID NO: 823152 - DNA, 16 bp, Homo sapiens
ccttccaagactgaag

SEQ ID NO: 823153 - DNA, 18 bp, Homo sapiens
ccttccacagttatctta

SEQ ID NO: 823154 - DNA, 13 bp, Homo sapiens
ccttccacctcag

SEQ ID NO: 823155 - DNA, 19 bp, Homo sapiens
ccttccacgctgtctccag

SEQ ID NO: 823156 - DNA, 17 bp, Homo sapiens
ccttccactgagggcag

SEQ ID NO: 823157 - DNA, 17 bp, Homo sapiens
ccttccagagcccaagg

SEQ ID NO: 823158 - DNA, 13 bp, Homo sapiens
ccttccagatcac

SEQ ID NO: 823159 - DNA, 14 bp, Homo sapiens
ccttccagcccaga

SEQ ID NO: 823160 - DNA, 14 bp, Homo sapiens
ccttccagcctggg

SEQ ID NO: 823161 - DNA, 15 bp, Homo sapiens
ccttccagcctggga

SEQ ID NO: 823162 - DNA, 17 bp, Homo sapiens
ccttccagctcctgtaa

SEQ ID NO: 823163 - DNA, 14 bp, Homo sapiens
ccttccagctgctg

SEQ ID NO: 823164 - DNA, 19 bp, Homo sapiens
ccttccaggaatgctgggc

SEQ ID NO: 823165 - DNA, 21 bp, Homo sapiens
ccttccaggaatgctgggccc

SEQ ID NO: 823166 - DNA, 13 bp, Homo sapiens
ccttccaggcccc

SEQ ID NO: 823167 - DNA, 22 bp, Homo sapiens
ccttccagtggctcgctccctg

SEQ ID NO: 823168 - DNA, 15 bp, Homo sapiens
ccttccataattatg

SEQ ID NO: 823169 - DNA, 14 bp, Homo sapiens
ccttccatacattt

SEQ ID NO: 823170 - DNA, 22 bp, Homo sapiens
ccttccatcagcgggtctcctc

SEQ ID NO: 823171 - DNA, 16 bp, Homo sapiens
ccttccatcttgtggg

SEQ ID NO: 823172 - DNA, 15 bp, Homo sapiens
ccttccatgccctgg

SEQ ID NO: 823173 - DNA, 24 bp, Homo sapiens
ccttccatgtcaggccagcctgtc

SEQ ID NO: 823174 - DNA, 20 bp, Homo sapiens
ccttccatgtcgcctctgca

SEQ ID NO: 823175 - DNA, 21 bp, Homo sapiens
ccttccatgtcgcctctgcat

SEQ ID NO: 823176 - DNA, 12 bp, Homo sapiens
ccttcccagctc

SEQ ID NO: 823177 - DNA, 19 bp, Homo sapiens
ccttcccagctctccctct

SEQ ID NO: 823178 - DNA, 14 bp, Homo sapiens
ccttcccaggaccc

SEQ ID NO: 823179 - DNA, 15 bp, Homo sapiens
ccttcccagggacca

SEQ ID NO: 823180 - DNA, 13 bp, Homo sapiens
ccttcccagtggg

SEQ ID NO: 823181 - DNA, 17 bp, Homo sapiens
ccttcccagtgggctgt

SEQ ID NO: 823182 - DNA, 22 bp, Homo sapiens
ccttcccagtgggctgtgttga

SEQ ID NO: 823183 - DNA, 15 bp, Homo sapiens
ccttcccatgccctg

SEQ ID NO: 823184 - DNA, 14 bp, Homo sapiens
ccttcccatggcca

SEQ ID NO: 823185 - DNA, 13 bp, Homo sapiens
ccttccccaagaa

SEQ ID NO: 823186 - DNA, 12 bp, Homo sapiens
ccttccccactg

SEQ ID NO: 823187 - DNA, 20 bp, Homo sapiens
ccttccccactgcctgccca

SEQ ID NO: 823188 - DNA, 13 bp, Homo sapiens
ccttccccagact

SEQ ID NO: 823189 - DNA, 12 bp, Homo sapiens
ccttccccagca

SEQ ID NO: 823190 - DNA, 13 bp, Homo sapiens
ccttccccagccc

SEQ ID NO: 823191 - DNA, 14 bp, Homo sapiens
ccttccccagccct

SEQ ID NO: 823192 - DNA, 15 bp, Homo sapiens
ccttccccagcgtcc

SEQ ID NO: 823193 - DNA, 15 bp, Homo sapiens
ccttccccagctcca

SEQ ID NO: 823194 - DNA, 19 bp, Homo sapiens
ccttccccagctccagcag

SEQ ID NO: 823195 - DNA, 12 bp, Homo sapiens
ccttgagctgag

SEQ ID NO: 823196 - DNA, 15 bp, Homo sapiens
ccttgagctgttgtg

SEQ ID NO: 823197 - DNA, 21 bp, Homo sapiens
ccttgaggaaacaacagcttt

SEQ ID NO: 823198 - DNA, 15 bp, Homo sapiens
ccttgagggctgcag

SEQ ID NO: 823199 - DNA, 16 bp, Homo sapiens
ccttgagggctgcagt

SEQ ID NO: 823200 - DNA, 16 bp, Homo sapiens
ccttgaggggccccag

SEQ ID NO: 823201 - DNA, 21 bp, Homo sapiens
ccttgaggggccccagcgtct

SEQ ID NO: 823202 - DNA, 22 bp, Homo sapiens
ccttgaggggccccagcgtctg

SEQ ID NO: 823203 - DNA, 21 bp, Homo sapiens
ccttgagggtgcttgttccct

SEQ ID NO: 823204 - DNA, 17 bp, Homo sapiens
ccttgagggtgggccag

SEQ ID NO: 823205 - DNA, 13 bp, Homo sapiens
ccttgaggtcttt

SEQ ID NO: 823206 - DNA, 16 bp, Homo sapiens
ccttgagtccccaggg

SEQ ID NO: 823207 - DNA, 14 bp, Homo sapiens
ccttgagtggggtt

SEQ ID NO: 823208 - DNA, 22 bp, Homo sapiens
ccttgagtggggttatctctgt

SEQ ID NO: 823209 - DNA, 19 bp, Homo sapiens
ccttgataatacttgacct

SEQ ID NO: 823210 - DNA, 22 bp, Homo sapiens
ccttgatataaaaaatctttag

SEQ ID NO: 823211 - DNA, 19 bp, Homo sapiens
ccttgatcgacttcttggt

SEQ ID NO: 823212 - DNA, 14 bp, Homo sapiens
ccttgatgcacaga

SEQ ID NO: 823213 - DNA, 13 bp, Homo sapiens
ccttgatgccaga

SEQ ID NO: 823214 - DNA, 23 bp, Homo sapiens
ccttgatgccagagggccagcag

SEQ ID NO: 823215 - DNA, 19 bp, Homo sapiens
ccttgattgattagataaa

SEQ ID NO: 823216 - DNA, 17 bp, Homo sapiens
ccttgcaacacacagac

SEQ ID NO: 823217 - DNA, 17 bp, Homo sapiens
ccttgcaaccaggcagc

SEQ ID NO: 823218 - DNA, 18 bp, Homo sapiens
ccttgcaaccaggcagct

SEQ ID NO: 823219 - DNA, 21 bp, Homo sapiens
ccttgcaaccaggcagctgag

SEQ ID NO: 823220 - DNA, 13 bp, Homo sapiens
ccttgcaagccat

SEQ ID NO: 823221 - DNA, 15 bp, Homo sapiens
ccttgcaagccataa

SEQ ID NO: 823222 - DNA, 21 bp, Homo sapiens
ccttgcaagccataacgtgcc

SEQ ID NO: 823223 - DNA, 15 bp, Homo sapiens
ccttgcacacccact

SEQ ID NO: 823224 - DNA, 16 bp, Homo sapiens
ccttgcacacccactg

SEQ ID NO: 823225 - DNA, 19 bp, Homo sapiens
ccttgcacacccactgccc

SEQ ID NO: 823226 - DNA, 14 bp, Homo sapiens
ccttgcacatagta

SEQ ID NO: 823227 - DNA, 12 bp, Homo sapiens
ccttgcacctgc

SEQ ID NO: 823228 - DNA, 13 bp, Homo sapiens
ccttgcacctgca

SEQ ID NO: 823229 - DNA, 15 bp, Homo sapiens
ccttgcacggctgct

SEQ ID NO: 823230 - DNA, 13 bp, Homo sapiens
ccttgcagaactg

SEQ ID NO: 823231 - DNA, 14 bp, Homo sapiens
ccttgcagaactgc

SEQ ID NO: 823232 - DNA, 17 bp, Homo sapiens
ccttgcagaactgccat

SEQ ID NO: 823233 - DNA, 21 bp, Homo sapiens
ccttgcagcactcacacagga

SEQ ID NO: 823234 - DNA, 13 bp, Homo sapiens
ccttgcagcctgg

SEQ ID NO: 823235 - DNA, 17 bp, Homo sapiens
ccttgcagttcagcacc

SEQ ID NO: 823236 - DNA, 21 bp, Homo sapiens
ccttgcatccattgttgtgtc

SEQ ID NO: 823237 - DNA, 17 bp, Homo sapiens
ccttgcatgtacttgaa

SEQ ID NO: 823238 - DNA, 23 bp, Homo sapiens
ccttgcatgtacttgaaggatgg

SEQ ID NO: 823239 - DNA, 21 bp, Homo sapiens
ccttgccacccattcttcccg

SEQ ID NO: 823240 - DNA, 13 bp, Homo sapiens
ccttgccagacat

SEQ ID NO: 823241 - DNA, 11 bp, Homo sapiens
ccttgcccaga

SEQ ID NO: 823242 - DNA, 13 bp, Homo sapiens
ccttgcccagaga

SEQ ID NO: 823243 - DNA, 20 bp, Homo sapiens
ccttgcccagggctcagcct

SEQ ID NO: 823244 - DNA, 21 bp, Homo sapiens
ccttgcccagggctcagcctg

SEQ ID NO: 823245 - DNA, 24 bp, Homo sapiens
ccttgccccactcctctccaccag

SEQ ID NO: 823246 - DNA, 18 bp, Homo sapiens
ccttgccccaggccaggt

SEQ ID NO: 823247 - DNA, 20 bp, Homo sapiens
ccttgcccccatccctcgga

SEQ ID NO: 823248 - DNA, 18 bp, Homo sapiens
ccttgcccgccagcctca

SEQ ID NO: 823249 - DNA, 18 bp, Homo sapiens
ccttgcccggattctggg

SEQ ID NO: 823250 - DNA, 20 bp, Homo sapiens
ccttgcccgtcgtgtgctga

SEQ ID NO: 823251 - DNA, 23 bp, Homo sapiens
ccttgccctgacctcccagccct

SEQ ID NO: 823252 - DNA, 15 bp, Homo sapiens
ccttgcccttgccct

SEQ ID NO: 823253 - DNA, 17 bp, Homo sapiens
ccttgcccttgccctga

SEQ ID NO: 823254 - DNA, 13 bp, Homo sapiens
ccttgcccttgga

SEQ ID NO: 823255 - DNA, 23 bp, Homo sapiens
ccttgccgctccccttggacctc

SEQ ID NO: 823256 - DNA, 12 bp, Homo sapiens
ccttgcctcccc

SEQ ID NO: 823257 - DNA, 15 bp, Homo sapiens
ccttgcctcctgtgt

SEQ ID NO: 823258 - DNA, 16 bp, Homo sapiens
ccttgcctcctgtgta

SEQ ID NO: 823259 - DNA, 12 bp, Homo sapiens
ccttgcctgcct

SEQ ID NO: 823260 - DNA, 14 bp, Homo sapiens
ccttgcctgcctcc

SEQ ID NO: 823261 - DNA, 18 bp, Homo sapiens
ccttgcctgcctcctagg

SEQ ID NO: 823262 - DNA, 23 bp, Homo sapiens
ccttgcctgcctcctaggctgga

SEQ ID NO: 823263 - DNA, 12 bp, Homo sapiens
ccttgcctggcc

SEQ ID NO: 823264 - DNA, 17 bp, Homo sapiens
ccttgcctgtctaaagc

SEQ ID NO: 823265 - DNA, 12 bp, Homo sapiens
ccttgccttaat

SEQ ID NO: 823266 - DNA, 17 bp, Homo sapiens
ccttgccttgcttctcc

SEQ ID NO: 823267 - DNA, 19 bp, Homo sapiens
ccttgcctttcgaggcctg

SEQ ID NO: 823268 - DNA, 21 bp, Homo sapiens
ccttgcgcctcagccctcagt

SEQ ID NO: 823269 - DNA, 18 bp, Homo sapiens
ccttgcgctgtcccaggc

SEQ ID NO: 823270 - DNA, 16 bp, Homo sapiens
ccttgcggaagccata

SEQ ID NO: 823271 - DNA, 17 bp, Homo sapiens
ccttgcggaagccatag

SEQ ID NO: 823272 - DNA, 22 bp, Homo sapiens
ccttgcgtcccatgaggtcttc

SEQ ID NO: 823273 - DNA, 18 bp, Homo sapiens
ccttgctagctagccagc

SEQ ID NO: 823274 - DNA, 19 bp, Homo sapiens
ccttgctagctagccagcc

SEQ ID NO: 823275 - DNA, 21 bp, Homo sapiens
ccttgctagctagccagccaa

SEQ ID NO: 823276 - DNA, 23 bp, Homo sapiens
ccttgctcaaccatggctgaagg

SEQ ID NO: 823277 - DNA, 15 bp, Homo sapiens
ccttgctcactcact

SEQ ID NO: 823278 - DNA, 16 bp, Homo sapiens
ccttgctcactcactc

SEQ ID NO: 823279 - DNA, 20 bp, Homo sapiens
ccttgctcagtgcctcctgg

SEQ ID NO: 823280 - DNA, 17 bp, Homo sapiens
ccttgctcattcttgag

SEQ ID NO: 823281 - DNA, 17 bp, Homo sapiens
ccttgctctccctcttc

SEQ ID NO: 823282 - DNA, 11 bp, Homo sapiens
ccttgctctga

SEQ ID NO: 823283 - DNA, 22 bp, Homo sapiens
ccttgctctgagcacaggtgac

SEQ ID NO: 823284 - DNA, 17 bp, Homo sapiens
ccttgctcttctttctg

SEQ ID NO: 823285 - DNA, 20 bp, Homo sapiens
ccttgctcttctttctgaga

SEQ ID NO: 823286 - DNA, 22 bp, Homo sapiens
ccttgctgcaagcacagccctt

SEQ ID NO: 823287 - DNA, 16 bp, Homo sapiens
ccttgctggccccagc

SEQ ID NO: 823288 - DNA, 15 bp, Homo sapiens
ccttgctgggccagg

SEQ ID NO: 823289 - DNA, 19 bp, Homo sapiens
ccttgctgggccagggaaa

SEQ ID NO: 823290 - DNA, 22 bp, Homo sapiens
ccttgctgggccagggaaacaa

SEQ ID NO: 823291 - DNA, 12 bp, Homo sapiens
ccttgctggggt

SEQ ID NO: 823292 - DNA, 15 bp, Homo sapiens
ccttgctggggtcca

SEQ ID NO: 823293 - DNA, 17 bp, Homo sapiens
ccttgctggggtccagg

SEQ ID NO: 823294 - DNA, 22 bp, Homo sapiens
ccttgctggggtccagggctgt

SEQ ID NO: 823295 - DNA, 20 bp, Homo sapiens
ccttgctgtatgctgatcat

SEQ ID NO: 823296 - DNA, 14 bp, Homo sapiens
ccttgcttctccca

SEQ ID NO: 823297 - DNA, 15 bp, Homo sapiens
ccttgcttctcccat

SEQ ID NO: 823298 - DNA, 18 bp, Homo sapiens
ccttgcttctcccatttc

SEQ ID NO: 823299 - DNA, 12 bp, Homo sapiens
ccttgcttctct

SEQ ID NO: 823300 - DNA, 12 bp, Homo sapiens
ccttgcttgtta

SEQ ID NO: 823301 - DNA, 17 bp, Homo sapiens
ccttgctttcctgggcc

SEQ ID NO: 823302 - DNA, 20 bp, Homo sapiens
ccttgctttgtctggcctca

SEQ ID NO: 823303 - DNA, 15 bp, Homo sapiens
ccttgcttttccctc

SEQ ID NO: 823304 - DNA, 16 bp, Homo sapiens
ccttgcttttccctct

SEQ ID NO: 823305 - DNA, 22 bp, Homo sapiens
ccttggaaacctgccctgcctg

SEQ ID NO: 823306 - DNA, 23 bp, Homo sapiens
ccttggaaatagaaagaagccat

SEQ ID NO: 823307 - DNA, 17 bp, Homo sapiens
ccttggaaccagcccca

SEQ ID NO: 823308 - DNA, 22 bp, Homo sapiens
ccttggaaccagccccatcaga

SEQ ID NO: 823309 - DNA, 11 bp, Homo sapiens
ccttggaaggg

SEQ ID NO: 823310 - DNA, 16 bp, Homo sapiens
ccttggacatcctcct

SEQ ID NO: 823311 - DNA, 17 bp, Homo sapiens
ccttggacatcctcctc

SEQ ID NO: 823312 - DNA, 22 bp, Homo sapiens
ccttggaccactcctgtccctg

SEQ ID NO: 823313 - DNA, 23 bp, Homo sapiens
ccttggacctccaggggctcctg

SEQ ID NO: 823314 - DNA, 11 bp, Homo sapiens
ccttggactcc

SEQ ID NO: 823315 - DNA, 16 bp, Homo sapiens
ccttggactcctccca

SEQ ID NO: 823316 - DNA, 22 bp, Homo sapiens
ccttggagagagaggctgcctc

SEQ ID NO: 823317 - DNA, 17 bp, Homo sapiens
cctttgcctctgtcctc

SEQ ID NO: 823318 - DNA, 21 bp, Homo sapiens
cctttgccttaaacctgaaga

SEQ ID NO: 823319 - DNA, 16 bp, Homo sapiens
cctttgcgcctgtgac

SEQ ID NO: 823320 - DNA, 20 bp, Homo sapiens
cctttgcgtggatcaagctt

SEQ ID NO: 823321 - DNA, 14 bp, Homo sapiens
cctttgctatgtaa

SEQ ID NO: 823322 - DNA, 17 bp, Homo sapiens
cctttgctatgtaaggg

SEQ ID NO: 823323 - DNA, 19 bp, Homo sapiens
cctttgctgaggcctccag

SEQ ID NO: 823324 - DNA, 17 bp, Homo sapiens
cctttgctgtgaggctg

SEQ ID NO: 823325 - DNA, 19 bp, Homo sapiens
cctttgcttatgaatattt

SEQ ID NO: 823326 - DNA, 23 bp, Homo sapiens
cctttggaacaagacagccttca

SEQ ID NO: 823327 - DNA, 13 bp, Homo sapiens
cctttggacccag

SEQ ID NO: 823328 - DNA, 19 bp, Homo sapiens
cctttggacccagggcctg

SEQ ID NO: 823329 - DNA, 20 bp, Homo sapiens
cctttggagatgctgagggt

SEQ ID NO: 823330 - DNA, 23 bp, Homo sapiens
cctttggaggggaaatggggaaa

SEQ ID NO: 823331 - DNA, 16 bp, Homo sapiens
cctttggctggtagca

SEQ ID NO: 823332 - DNA, 21 bp, Homo sapiens
cctttggctggtagcagcagg

SEQ ID NO: 823333 - DNA, 19 bp, Homo sapiens
cctttgggaggctgaggcg

SEQ ID NO: 823334 - DNA, 16 bp, Homo sapiens
cctttggggaagttta

SEQ ID NO: 823335 - DNA, 12 bp, Homo sapiens
cctttgggggtt

SEQ ID NO: 823336 - DNA, 18 bp, Homo sapiens
cctttgggtcctgggcag

SEQ ID NO: 823337 - DNA, 16 bp, Homo sapiens
cctttggtgaattcct

SEQ ID NO: 823338 - DNA, 15 bp, Homo sapiens
cctttggttctggcc

SEQ ID NO: 823339 - DNA, 16 bp, Homo sapiens
cctttgtaagacattt

SEQ ID NO: 823340 - DNA, 19 bp, Homo sapiens
cctttgtaagacatttgta

SEQ ID NO: 823341 - DNA, 22 bp, Homo sapiens
cctttgtaagacatttgtatat

SEQ ID NO: 823342 - DNA, 12 bp, Homo sapiens
cctttgtattat

SEQ ID NO: 823343 - DNA, 18 bp, Homo sapiens
cctttgtattataaaagc

SEQ ID NO: 823344 - DNA, 17 bp, Homo sapiens
cctttgtattataattg

SEQ ID NO: 823345 - DNA, 20 bp, Homo sapiens
cctttgtattataattgttg

SEQ ID NO: 823346 - DNA, 18 bp, Homo sapiens
cctttgtattctctcctg

SEQ ID NO: 823347 - DNA, 24 bp, Homo sapiens
cctttgtattctctcctgtacctc

SEQ ID NO: 823348 - DNA, 19 bp, Homo sapiens
cctttgtcatcattgtata

SEQ ID NO: 823349 - DNA, 19 bp, Homo sapiens
cctttgtctggatgcacac

SEQ ID NO: 823350 - DNA, 20 bp, Homo sapiens
cctttgtctgtcaatcacag

SEQ ID NO: 823351 - DNA, 16 bp, Homo sapiens
cctttgtcttgtactt

SEQ ID NO: 823352 - DNA, 23 bp, Homo sapiens
cctttgtcttgtacttctgtgtt

SEQ ID NO: 823353 - DNA, 13 bp, Homo sapiens
cctttgtcttttt

SEQ ID NO: 823354 - DNA, 18 bp, Homo sapiens
cctttgtgagcctatgat

SEQ ID NO: 823355 - DNA, 22 bp, Homo sapiens
cctttgtgcacatttatttcct

SEQ ID NO: 823356 - DNA, 23 bp, Homo sapiens
cctttgtgcagcttcgaggacag

SEQ ID NO: 823357 - DNA, 23 bp, Homo sapiens
cctttgtgtcagaaaaaggaaac

SEQ ID NO: 823358 - DNA, 13 bp, Homo sapiens
cctttgtgtggct

SEQ ID NO: 823359 - DNA, 14 bp, Homo sapiens
cctttgtgtggctc

SEQ ID NO: 823360 - DNA, 15 bp, Homo sapiens
cctttgtgtggctcc

SEQ ID NO: 823361 - DNA, 20 bp, Homo sapiens
cctttgtgtggctcctggta

SEQ ID NO: 823362 - DNA, 16 bp, Homo sapiens
cctttgtgtggctgcc

SEQ ID NO: 823363 - DNA, 20 bp, Homo sapiens
cctttgtgtgtactcactga

SEQ ID NO: 823364 - DNA, 21 bp, Homo sapiens
cctttgtgtgtgtgtcagctg

SEQ ID NO: 823365 - DNA, 19 bp, Homo sapiens
ccttttacagaattagaaa

SEQ ID NO: 823366 - DNA, 14 bp, Homo sapiens
ccttttatctggtg

SEQ ID NO: 823367 - DNA, 16 bp, Homo sapiens
ccttttatctggtgcc

SEQ ID NO: 823368 - DNA, 21 bp, Homo sapiens
ccttttatctggtgcctcctc

SEQ ID NO: 823369 - DNA, 13 bp, Homo sapiens
ccttttcagccct

SEQ ID NO: 823370 - DNA, 13 bp, Homo sapiens
ccttttcagggct

SEQ ID NO: 823371 - DNA, 18 bp, Homo sapiens
ccttttcagggctggctc

SEQ ID NO: 823372 - DNA, 19 bp, Homo sapiens
ccttttcataggtctgaaa

SEQ ID NO: 823373 - DNA, 16 bp, Homo sapiens
ccttttcatgatttta

SEQ ID NO: 823374 - DNA, 21 bp, Homo sapiens
ccttttccaaatgcccaagga

SEQ ID NO: 823375 - DNA, 20 bp, Homo sapiens
ccttttccagttgctgtgga

SEQ ID NO: 823376 - DNA, 12 bp, Homo sapiens
ccttttccatgc

SEQ ID NO: 823377 - DNA, 23 bp, Homo sapiens
ccttttcccaaaatgttgaaata

SEQ ID NO: 823378 - DNA, 18 bp, Homo sapiens
ccttttcccctacagaat

SEQ ID NO: 823379 - DNA, 16 bp, Homo sapiens
ccttttccttatactg

SEQ ID NO: 823380 - DNA, 15 bp, Homo sapiens
ccttttcctttctgg

SEQ ID NO: 823381 - DNA, 17 bp, Homo sapiens
ccttttcctttctggcc

SEQ ID NO: 823382 - DNA, 15 bp, Homo sapiens
ccttttctataagtt

SEQ ID NO: 823383 - DNA, 22 bp, Homo sapiens
ccttttctataagttgtaccaa

SEQ ID NO: 823384 - DNA, 16 bp, Homo sapiens
ccttttctatgttgct

SEQ ID NO: 823385 - DNA, 13 bp, Homo sapiens
ccttttctcccca

SEQ ID NO: 823386 - DNA, 14 bp, Homo sapiens
ccttttctggtccc

SEQ ID NO: 823387 - DNA, 21 bp, Homo sapiens
ccttttctggtccctcttctc

SEQ ID NO: 823388 - DNA, 14 bp, Homo sapiens
ccttttctgtggct

SEQ ID NO: 823389 - DNA, 14 bp, Homo sapiens
ccttttcttggttc

SEQ ID NO: 823390 - DNA, 18 bp, Homo sapiens
ccttttcttttctaccct

SEQ ID NO: 823391 - DNA, 16 bp, Homo sapiens
ccttttgaacttgtca

SEQ ID NO: 823392 - DNA, 15 bp, Homo sapiens
ccttttgacactgct

SEQ ID NO: 823393 - DNA, 21 bp, Homo sapiens
ccttttgaggagccccagcta

SEQ ID NO: 823394 - DNA, 19 bp, Homo sapiens
ccttttgatggggagaaag

SEQ ID NO: 823395 - DNA, 22 bp, Homo sapiens
ccttttgatggggagaaagggc

SEQ ID NO: 823396 - DNA, 21 bp, Homo sapiens
ccttttgatgttcagagtggc

SEQ ID NO: 823397 - DNA, 17 bp, Homo sapiens
ccttttgcaaacaattt

SEQ ID NO: 823398 - DNA, 12 bp, Homo sapiens
ccttttgcaccc

SEQ ID NO: 823399 - DNA, 15 bp, Homo sapiens
ccttttgcaggctcc

SEQ ID NO: 823400 - DNA, 17 bp, Homo sapiens
ccttttgcataagatta

SEQ ID NO: 823401 - DNA, 18 bp, Homo sapiens
ccttttgcataagattaa

SEQ ID NO: 823402 - DNA, 12 bp, Homo sapiens
ccttttgccaat

SEQ ID NO: 823403 - DNA, 18 bp, Homo sapiens
ccttttgcctggctgtgg

SEQ ID NO: 823404 - DNA, 22 bp, Homo sapiens
ccttttgcgcttatttggaaat

SEQ ID NO: 823405 - DNA, 18 bp, Homo sapiens
ccttttgcttgaaaccaa

SEQ ID NO: 823406 - DNA, 20 bp, Homo sapiens
ccttttggcccccgagctgg

SEQ ID NO: 823407 - DNA, 18 bp, Homo sapiens
ccttttggtcttcagcct

SEQ ID NO: 823408 - DNA, 19 bp, Homo sapiens
ccttttgtaccatggtgtg

SEQ ID NO: 823409 - DNA, 18 bp, Homo sapiens
ccttttgtccccagggcc

SEQ ID NO: 823410 - DNA, 19 bp, Homo sapiens
ccttttgtccccagggccc

SEQ ID NO: 823411 - DNA, 21 bp, Homo sapiens
ccttttgtccccagggcccct

SEQ ID NO: 823412 - DNA, 13 bp, Homo sapiens
ccttttgttttct

SEQ ID NO: 823413 - DNA, 16 bp, Homo sapiens
cctttttaaatgtgaa

SEQ ID NO: 823414 - DNA, 23 bp, Homo sapiens
cctttttactccccttgagctga

SEQ ID NO: 823415 - DNA, 19 bp, Homo sapiens
cctttttatatttaaaaaa

SEQ ID NO: 823416 - DNA, 17 bp, Homo sapiens
cctttttatttgcatgt

SEQ ID NO: 823417 - DNA, 18 bp, Homo sapiens
cctttttatttgcatgtg

SEQ ID NO: 823418 - DNA, 17 bp, Homo sapiens
cctttttcactttgaaa

SEQ ID NO: 823419 - DNA, 20 bp, Homo sapiens
cctttttccaatgttttatt

SEQ ID NO: 823420 - DNA, 22 bp, Homo sapiens
cctttttccttatttcaagggt

SEQ ID NO: 823421 - DNA, 14 bp, Homo sapiens
cctttttctccagc

SEQ ID NO: 823422 - DNA, 20 bp, Homo sapiens
cctttttctttataaacttt

SEQ ID NO: 823423 - DNA, 13 bp, Homo sapiens
cctttttgaagtg

SEQ ID NO: 823424 - DNA, 14 bp, Homo sapiens
cctttttggggagt

SEQ ID NO: 823425 - DNA, 23 bp, Homo sapiens
cctttttggtacttattactgct

SEQ ID NO: 823426 - DNA, 14 bp, Homo sapiens
cctttttgtataaa

SEQ ID NO: 823427 - DNA, 16 bp, Homo sapiens
cctttttgttccccat

SEQ ID NO: 823428 - DNA, 14 bp, Homo sapiens
ccttttttcaatat

SEQ ID NO: 823429 - DNA, 20 bp, Homo sapiens
ccttttttcaatatgcaagc

SEQ ID NO: 823430 - DNA, 21 bp, Homo sapiens
ccttttttcaatatgcaagca

SEQ ID NO: 823431 - DNA, 24 bp, Homo sapiens
ccttttttcaatatgcaagcagct

SEQ ID NO: 823432 - DNA, 11 bp, Homo sapiens
ccttttttcct

SEQ ID NO: 823433 - DNA, 18 bp, Homo sapiens
ccttttttctatatcaaa

SEQ ID NO: 823434 - DNA, 21 bp, Homo sapiens
ccttttttctcttctgtccat

SEQ ID NO: 823435 - DNA, 22 bp, Homo sapiens
ccttttttgttttttcaaaata

SEQ ID NO: 823436 - DNA, 13 bp, Homo sapiens
cctttttttttga

SEQ ID NO: 823437 - DNA, 15 bp, Homo sapiens
cctttttttttgaaa

SEQ ID NO: 823438 - DNA, 20 bp, Homo sapiens
ccttttttttttttttaaga

SEQ ID NO: 823439 - DNA, 19 bp, Homo sapiens
cgaaaaaataattatttat

SEQ ID NO: 823440 - DNA, 17 bp, Homo sapiens
cgaaaaataaaaaggaa

SEQ ID NO: 823441 - DNA, 21 bp, Homo sapiens
cgaaaaatcctcttcctctga

SEQ ID NO: 823442 - DNA, 17 bp, Homo sapiens
cgaaaacaaccgtcctg

SEQ ID NO: 823443 - DNA, 12 bp, Homo sapiens
cgaaaacattgt

SEQ ID NO: 823444 - DNA, 13 bp, Homo sapiens
cgaaaaccaggcc

SEQ ID NO: 823445 - DNA, 18 bp, Homo sapiens
cgaaaagaaggtattttt

SEQ ID NO: 823446 - DNA, 17 bp, Homo sapiens
cgaaacacagaaacctt

SEQ ID NO: 823447 - DNA, 23 bp, Homo sapiens
cgaaacctcttttgttgtccttg

SEQ ID NO: 823448 - DNA, 15 bp, Homo sapiens
cgaaacttgttattg

SEQ ID NO: 823449 - DNA, 21 bp, Homo sapiens
cgaaacttgttattgtgaatg

SEQ ID NO: 823450 - DNA, 19 bp, Homo sapiens
cgaaagaaggcatggactt

SEQ ID NO: 823451 - DNA, 23 bp, Homo sapiens
cgaaagaaggcatggacttctgg

SEQ ID NO: 823452 - DNA, 17 bp, Homo sapiens
cgaaagcatcactgcct

SEQ ID NO: 823453 - DNA, 14 bp, Homo sapiens
cgaaaggccttcag

SEQ ID NO: 823454 - DNA, 21 bp, Homo sapiens
cgaaaggccttcagacacatg

SEQ ID NO: 823455 - DNA, 20 bp, Homo sapiens
cgaaatgttctcatgaacta

SEQ ID NO: 823456 - DNA, 17 bp, Homo sapiens
cgaaattccaaggccca

SEQ ID NO: 823457 - DNA, 20 bp, Homo sapiens
cgaaccaaggcagcctccag

SEQ ID NO: 823458 - DNA, 16 bp, Homo sapiens
cgaacccacctgctga

SEQ ID NO: 823459 - DNA, 23 bp, Homo sapiens
cgaacccacctgctgagagaccc

SEQ ID NO: 823460 - DNA, 21 bp, Homo sapiens
cgaacccctagaaaggagaga

SEQ ID NO: 823461 - DNA, 16 bp, Homo sapiens
cgaacgacaatagctt

SEQ ID NO: 823462 - DNA, 14 bp, Homo sapiens
cgaacgtatttctc

SEQ ID NO: 823463 - DNA, 21 bp, Homo sapiens
cgaacttcacataggaaggga

SEQ ID NO: 823464 - DNA, 23 bp, Homo sapiens
cgaagaccctcttgcccatcctg

SEQ ID NO: 823465 - DNA, 21 bp, Homo sapiens
cgaagagggaatggatgggga

SEQ ID NO: 823466 - DNA, 23 bp, Homo sapiens
cgaagagggaatggatggggaga

SEQ ID NO: 823467 - DNA, 21 bp, Homo sapiens
cgaagatggtggccacagact

SEQ ID NO: 823468 - DNA, 16 bp, Homo sapiens
cgaagccccttggaga

SEQ ID NO: 823469 - DNA, 20 bp, Homo sapiens
cgaagccccttggagagaga

SEQ ID NO: 823470 - DNA, 14 bp, Homo sapiens
cgaaggatgatcgc

SEQ ID NO: 823471 - DNA, 20 bp, Homo sapiens
cgaagtctttgccttctctg

SEQ ID NO: 823472 - DNA, 17 bp, Homo sapiens
cgaagtgtttatgtaat

SEQ ID NO: 823473 - DNA, 18 bp, Homo sapiens
cgaatcagctatttactg

SEQ ID NO: 823474 - DNA, 14 bp, Homo sapiens
cgaatcatttgttc

SEQ ID NO: 823475 - DNA, 17 bp, Homo sapiens
cgaatcatttgttcaaa

SEQ ID NO: 823476 - DNA, 15 bp, Homo sapiens
cgaatctcaaaatta

SEQ ID NO: 823477 - DNA, 16 bp, Homo sapiens
cgaatgacactgttca

SEQ ID NO: 823478 - DNA, 17 bp, Homo sapiens
cgaatgacggtaagtgt

SEQ ID NO: 823479 - DNA, 22 bp, Homo sapiens
cgaatgacggtaagtgttctca

SEQ ID NO: 823480 - DNA, 16 bp, Homo sapiens
cgaatgactatgtcca

SEQ ID NO: 823481 - DNA, 17 bp, Homo sapiens
cgaatgactatgtccag

SEQ ID NO: 823482 - DNA, 18 bp, Homo sapiens
cgaatgactatgtccaga

SEQ ID NO: 823483 - DNA, 17 bp, Homo sapiens
cgaatggtctttgctcc

SEQ ID NO: 823484 - DNA, 15 bp, Homo sapiens
cgaatgtaattggaa

SEQ ID NO: 823485 - DNA, 19 bp, Homo sapiens
cgaatgtaattggaatctt

SEQ ID NO: 823486 - DNA, 12 bp, Homo sapiens
cgaatgtcatac

SEQ ID NO: 823487 - DNA, 13 bp, Homo sapiens
cgaatgtgcaggt

SEQ ID NO: 823488 - DNA, 14 bp, Homo sapiens
cgaatgtgtcttta

SEQ ID NO: 823489 - DNA, 13 bp, Homo sapiens
cgaattatactcc

SEQ ID NO: 823490 - DNA, 20 bp, Homo sapiens
cgaatttgcacagtgatata

SEQ ID NO: 823491 - DNA, 18 bp, Homo sapiens
cgacaaccgatgctccag

SEQ ID NO: 823492 - DNA, 13 bp, Homo sapiens
cgacaagaatgtc

SEQ ID NO: 823493 - DNA, 20 bp, Homo sapiens
cgacaagagtgagactccac

SEQ ID NO: 823494 - DNA, 18 bp, Homo sapiens
cgacaatgccctgctggc

SEQ ID NO: 823495 - DNA, 23 bp, Homo sapiens
cgacaatgccctgctggcctgtc

SEQ ID NO: 823496 - DNA, 17 bp, Homo sapiens
cgacactcagggcagct

SEQ ID NO: 823497 - DNA, 21 bp, Homo sapiens
cgacactgctgcaccagagtg

SEQ ID NO: 823498 - DNA, 12 bp, Homo sapiens
cgacagcctggc

SEQ ID NO: 823499 - DNA, 15 bp, Homo sapiens
cgacagcggccttga

SEQ ID NO: 823500 - DNA, 16 bp, Homo sapiens
cgacagggcctggagc

SEQ ID NO: 823501 - DNA, 21 bp, Homo sapiens
cgacatccgtcattgctgctg

SEQ ID NO: 823502 - DNA, 20 bp, Homo sapiens
cgacatcttctcaaccttat

SEQ ID NO: 823503 - DNA, 13 bp, Homo sapiens
cgacatgctgcca

SEQ ID NO: 823504 - DNA, 14 bp, Homo sapiens
cgacatgctgccag

SEQ ID NO: 823505 - DNA, 13 bp, Homo sapiens
cgacattgtctcc

SEQ ID NO: 823506 - DNA, 14 bp, Homo sapiens
cgaccaactgccct

SEQ ID NO: 823507 - DNA, 15 bp, Homo sapiens
cgaccaactgcccta

SEQ ID NO: 823508 - DNA, 11 bp, Homo sapiens
cgaccaaggat

SEQ ID NO: 823509 - DNA, 16 bp, Homo sapiens
cgaccaatccccagcc

SEQ ID NO: 823510 - DNA, 18 bp, Homo sapiens
cgaccaatccccagccta

SEQ ID NO: 823511 - DNA, 18 bp, Homo sapiens
cgaccatcgtccagccct

SEQ ID NO: 823512 - DNA, 12 bp, Homo sapiens
cgacccagccag

SEQ ID NO: 823513 - DNA, 18 bp, Homo sapiens
cgacccagccagctgcag

SEQ ID NO: 823514 - DNA, 12 bp, Homo sapiens
cgaccccagact

SEQ ID NO: 823515 - DNA, 18 bp, Homo sapiens
cgacccccgcagaggcag

SEQ ID NO: 823516 - DNA, 15 bp, Homo sapiens
cgaccccgggccgga

SEQ ID NO: 823517 - DNA, 17 bp, Homo sapiens
cgacccctgcctcgagg

SEQ ID NO: 823518 - DNA, 19 bp, Homo sapiens
cgacccctgcctcgagggc

SEQ ID NO: 823519 - DNA, 19 bp, Homo sapiens
cgaccctcctggccttcct

SEQ ID NO: 823520 - DNA, 14 bp, Homo sapiens
cgaccctctgggaa

SEQ ID NO: 823521 - DNA, 17 bp, Homo sapiens
cgaccctctgggaacct

SEQ ID NO: 823522 - DNA, 21 bp, Homo sapiens
cgacccttggtgtttcccttc

SEQ ID NO: 823523 - DNA, 22 bp, Homo sapiens
cgacccttggtgtttcccttcc

SEQ ID NO: 823524 - DNA, 19 bp, Homo sapiens
cgacctctctcagccccat

SEQ ID NO: 823525 - DNA, 19 bp, Homo sapiens
cgacctggccgcggagcct

SEQ ID NO: 823526 - DNA, 19 bp, Homo sapiens
cgaccttgcaacctcacct

SEQ ID NO: 823527 - DNA, 15 bp, Homo sapiens
cgacgcgtctcctgt

SEQ ID NO: 823528 - DNA, 13 bp, Homo sapiens
cgacgctgcagag

SEQ ID NO: 823529 - DNA, 16 bp, Homo sapiens
cgactactgctcctgt

SEQ ID NO: 823530 - DNA, 14 bp, Homo sapiens
cgactccagccagc

SEQ ID NO: 823531 - DNA, 16 bp, Homo sapiens
cgactccagccagcgc

SEQ ID NO: 823532 - DNA, 18 bp, Homo sapiens
cgactccagccagcgcct

SEQ ID NO: 823533 - DNA, 21 bp, Homo sapiens
cgactccagccagcgcctccc

SEQ ID NO: 823534 - DNA, 20 bp, Homo sapiens
cgactcccccaaccaaggaa

SEQ ID NO: 823535 - DNA, 21 bp, Homo sapiens
cgactccctgagtctggacct

SEQ ID NO: 823536 - DNA, 16 bp, Homo sapiens
cgactccgttggccac

SEQ ID NO: 823537 - DNA, 10 bp, Homo sapiens
cgactctgct

SEQ ID NO: 823538 - DNA, 14 bp, Homo sapiens
cgactcttcctgca

SEQ ID NO: 823539 - DNA, 15 bp, Homo sapiens
cgactcttcctgcaa

SEQ ID NO: 823540 - DNA, 18 bp, Homo sapiens
cgactgaccctgaggagg

SEQ ID NO: 823541 - DNA, 14 bp, Homo sapiens
cgactgcccagcca

SEQ ID NO: 823542 - DNA, 17 bp, Homo sapiens
cgactgcccctgctgtg

SEQ ID NO: 823543 - DNA, 23 bp, Homo sapiens
cgactgcccctgctgtgctgctc

SEQ ID NO: 823544 - DNA, 17 bp, Homo sapiens
cgactggatgctcgcca

SEQ ID NO: 823545 - DNA, 17 bp, Homo sapiens
cgactggccagggccac

SEQ ID NO: 823546 - DNA, 13 bp, Homo sapiens
cgactggtccagc

SEQ ID NO: 823547 - DNA, 15 bp, Homo sapiens
cgactggtccagctc

SEQ ID NO: 823548 - DNA, 13 bp, Homo sapiens
cgactttattttc

SEQ ID NO: 823549 - DNA, 16 bp, Homo sapiens
cgactttctgcctgga

SEQ ID NO: 823550 - DNA, 17 bp, Homo sapiens
cgagaaagaggcaccag

SEQ ID NO: 823551 - DNA, 19 bp, Homo sapiens
cgagaaagaggcaccagga

SEQ ID NO: 823552 - DNA, 21 bp, Homo sapiens
cgagaaattcgtgtgtttttt

SEQ ID NO: 823553 - DNA, 13 bp, Homo sapiens
cgagaccagcctg

SEQ ID NO: 823554 - DNA, 13 bp, Homo sapiens
cgagaccatcctg

SEQ ID NO: 823555 - DNA, 15 bp, Homo sapiens
cgagaccatcctggc

SEQ ID NO: 823556 - DNA, 17 bp, Homo sapiens
cgagaccatcctggcca

SEQ ID NO: 823557 - DNA, 19 bp, Homo sapiens
cgagaccatcctggcccct

SEQ ID NO: 823558 - DNA, 19 bp, Homo sapiens
cgagacccaaggctcactg

SEQ ID NO: 823559 - DNA, 11 bp, Homo sapiens
cgagaccccag

SEQ ID NO: 823560 - DNA, 15 bp, Homo sapiens
cgcagccctgctttg

SEQ ID NO: 823561 - DNA, 22 bp, Homo sapiens
cgcagccgccgccgcccacgcc

SEQ ID NO: 823562 - DNA, 19 bp, Homo sapiens
cgcagcctgaagcctggat

SEQ ID NO: 823563 - DNA, 19 bp, Homo sapiens
cgcagcctggcatctgtgc

SEQ ID NO: 823564 - DNA, 21 bp, Homo sapiens
cgcagcgcccccatctgtctt

SEQ ID NO: 823565 - DNA, 14 bp, Homo sapiens
cgcagcggggtagg

SEQ ID NO: 823566 - DNA, 17 bp, Homo sapiens
cgcagcggtgggaagga

SEQ ID NO: 823567 - DNA, 21 bp, Homo sapiens
cgcagcggtgggaaggaaagg

SEQ ID NO: 823568 - DNA, 19 bp, Homo sapiens
cgcagctcttgcccttccc

SEQ ID NO: 823569 - DNA, 13 bp, Homo sapiens
cgcagctggactc

SEQ ID NO: 823570 - DNA, 21 bp, Homo sapiens
cgcagcttcctgtctgtttat

SEQ ID NO: 823571 - DNA, 15 bp, Homo sapiens
cgcaggaactcccag

SEQ ID NO: 823572 - DNA, 17 bp, Homo sapiens
cgcaggaactcccagca

SEQ ID NO: 823573 - DNA, 18 bp, Homo sapiens
cgcaggaactcccagcaa

SEQ ID NO: 823574 - DNA, 21 bp, Homo sapiens
cgcaggaactgggctgggcct

SEQ ID NO: 823575 - DNA, 11 bp, Homo sapiens
cgcaggaatgg

SEQ ID NO: 823576 - DNA, 21 bp, Homo sapiens
cgcaggagggaggcggggagg

SEQ ID NO: 823577 - DNA, 16 bp, Homo sapiens
cgcaggcagcgcaggg

SEQ ID NO: 823578 - DNA, 20 bp, Homo sapiens
cgcaggcagcgcagggctgg

SEQ ID NO: 823579 - DNA, 16 bp, Homo sapiens
cgcaggcagggagaag

SEQ ID NO: 823580 - DNA, 17 bp, Homo sapiens
cgcaggcagggagaagg

SEQ ID NO: 823581 - DNA, 22 bp, Homo sapiens
cgcaggccacccgggctgcctg

SEQ ID NO: 823582 - DNA, 12 bp, Homo sapiens
cgcaggcccagt

SEQ ID NO: 823583 - DNA, 13 bp, Homo sapiens
cgcaggcccagtg

SEQ ID NO: 823584 - DNA, 14 bp, Homo sapiens
cgcaggccctgtcc

SEQ ID NO: 823585 - DNA, 15 bp, Homo sapiens
cgcaggccctgtcca

SEQ ID NO: 823586 - DNA, 21 bp, Homo sapiens
cgcaggccctgtccagccccc

SEQ ID NO: 823587 - DNA, 13 bp, Homo sapiens
cgcaggcggccag

SEQ ID NO: 823588 - DNA, 14 bp, Homo sapiens
cgcaggcggccagg

SEQ ID NO: 823589 - DNA, 15 bp, Homo sapiens
cgcaggcggccaggg

SEQ ID NO: 823590 - DNA, 15 bp, Homo sapiens
cgcaggcgggcgagc

SEQ ID NO: 823591 - DNA, 18 bp, Homo sapiens
cgcaggctgagtccagag

SEQ ID NO: 823592 - DNA, 14 bp, Homo sapiens
cgcaggctgcagag

SEQ ID NO: 823593 - DNA, 16 bp, Homo sapiens
cgcagggacatggggc

SEQ ID NO: 823594 - DNA, 17 bp, Homo sapiens
cgcagggacatggggca

SEQ ID NO: 823595 - DNA, 20 bp, Homo sapiens
cgcagggacatggggcaagc

SEQ ID NO: 823596 - DNA, 21 bp, Homo sapiens
cgcagggacatggggcaagcc

SEQ ID NO: 823597 - DNA, 23 bp, Homo sapiens
cgcagggacatggggcaagccag

SEQ ID NO: 823598 - DNA, 19 bp, Homo sapiens
cgcagggcccaccttggac

SEQ ID NO: 823599 - DNA, 23 bp, Homo sapiens
cgcagggcccaccttggaccctg

SEQ ID NO: 823600 - DNA, 22 bp, Homo sapiens
cgcagggctggcacgtgacagg

SEQ ID NO: 823601 - DNA, 19 bp, Homo sapiens
cgcaggggccctgagccaa

SEQ ID NO: 823602 - DNA, 16 bp, Homo sapiens
cgcaggggttgcagtg

SEQ ID NO: 823603 - DNA, 16 bp, Homo sapiens
cgcagggtgcaggagc

SEQ ID NO: 823604 - DNA, 22 bp, Homo sapiens
cgcagggtggtggtattctgtc

SEQ ID NO: 823605 - DNA, 13 bp, Homo sapiens
cgcaggtgggctg

SEQ ID NO: 823606 - DNA, 14 bp, Homo sapiens
cgcaggtgggctgg

SEQ ID NO: 823607 - DNA, 21 bp, Homo sapiens
cgcagtccccagcccttctgc

SEQ ID NO: 823608 - DNA, 16 bp, Homo sapiens
cgcagtgcctggagtt

SEQ ID NO: 823609 - DNA, 23 bp, Homo sapiens
cgcagtgtgcactaaggggcccg

SEQ ID NO: 823610 - DNA, 21 bp, Homo sapiens
cgcatacacacatgccctcct

SEQ ID NO: 823611 - DNA, 13 bp, Homo sapiens
cgcatagactgag

SEQ ID NO: 823612 - DNA, 22 bp, Homo sapiens
cgcataggcccagccagggtgt

SEQ ID NO: 823613 - DNA, 12 bp, Homo sapiens
cgcatatgcatg

SEQ ID NO: 823614 - DNA, 17 bp, Homo sapiens
cgcatatgcatgccagg

SEQ ID NO: 823615 - DNA, 15 bp, Homo sapiens
cgcatccagacagtc

SEQ ID NO: 823616 - DNA, 17 bp, Homo sapiens
cgcatcccatctctccc

SEQ ID NO: 823617 - DNA, 14 bp, Homo sapiens
cgcatccgtcctgg

SEQ ID NO: 823618 - DNA, 16 bp, Homo sapiens
cgcatccgtcctgggc

SEQ ID NO: 823619 - DNA, 14 bp, Homo sapiens
cgcatcttctccat

SEQ ID NO: 823620 - DNA, 21 bp, Homo sapiens
cgcatcttctccatctggcag

SEQ ID NO: 823621 - DNA, 14 bp, Homo sapiens
cgcatgggcattgc

SEQ ID NO: 823622 - DNA, 15 bp, Homo sapiens
cgcatgggcattgca

SEQ ID NO: 823623 - DNA, 16 bp, Homo sapiens
cgcatgggcattgcag

SEQ ID NO: 823624 - DNA, 11 bp, Homo sapiens
cgcattaagca

SEQ ID NO: 823625 - DNA, 14 bp, Homo sapiens
cgcattaagcacac

SEQ ID NO: 823626 - DNA, 18 bp, Homo sapiens
cgcattaagcacacacat

SEQ ID NO: 823627 - DNA, 18 bp, Homo sapiens
cgcattctcgtatccaac

SEQ ID NO: 823628 - DNA, 15 bp, Homo sapiens
cgcattctcttgtgt

SEQ ID NO: 823629 - DNA, 17 bp, Homo sapiens
cgcattggaagagcccg

SEQ ID NO: 823630 - DNA, 14 bp, Homo sapiens
cgccaaatgttcat

SEQ ID NO: 823631 - DNA, 17 bp, Homo sapiens
cgccaacttctcccacc

SEQ ID NO: 823632 - DNA, 18 bp, Homo sapiens
cgccaacttctcccaccc

SEQ ID NO: 823633 - DNA, 13 bp, Homo sapiens
cgccaaggctggg

SEQ ID NO: 823634 - DNA, 16 bp, Homo sapiens
cgccaaggctggggga

SEQ ID NO: 823635 - DNA, 21 bp, Homo sapiens
cgccacatggtgtggccatca

SEQ ID NO: 823636 - DNA, 16 bp, Homo sapiens
cgccacccccatcttc

SEQ ID NO: 823637 - DNA, 19 bp, Homo sapiens
cgccacccgggcaagggtc

SEQ ID NO: 823638 - DNA, 16 bp, Homo sapiens
cgccacctcagggcac

SEQ ID NO: 823639 - DNA, 18 bp, Homo sapiens
cgccacctttcaccctca

SEQ ID NO: 823640 - DNA, 17 bp, Homo sapiens
cgccacgggtttccctc

SEQ ID NO: 823641 - DNA, 21 bp, Homo sapiens
cgccactcatttcatctcatt

SEQ ID NO: 823642 - DNA, 13 bp, Homo sapiens
cgccactgcactc

SEQ ID NO: 823643 - DNA, 21 bp, Homo sapiens
cgccactgcactccagcctgg

SEQ ID NO: 823644 - DNA, 20 bp, Homo sapiens
cgccactgcactccggcctg

SEQ ID NO: 823645 - DNA, 22 bp, Homo sapiens
cgccactgcctcccccgaatgc

SEQ ID NO: 823646 - DNA, 11 bp, Homo sapiens
cgccagacccc

SEQ ID NO: 823647 - DNA, 16 bp, Homo sapiens
cgccagcctcagtgcc

SEQ ID NO: 823648 - DNA, 19 bp, Homo sapiens
cgccagcctcagtgccact

SEQ ID NO: 823649 - DNA, 14 bp, Homo sapiens
cgccagcctcctct

SEQ ID NO: 823650 - DNA, 15 bp, Homo sapiens
cgccagcctcctctg

SEQ ID NO: 823651 - DNA, 16 bp, Homo sapiens
cgccagcctcctctgg

SEQ ID NO: 823652 - DNA, 23 bp, Homo sapiens
cgccagcctcctctggacggcag

SEQ ID NO: 823653 - DNA, 23 bp, Homo sapiens
cgccagcgacctctctgcctctc

SEQ ID NO: 823654 - DNA, 18 bp, Homo sapiens
cgccagcgtgtggagcag

SEQ ID NO: 823655 - DNA, 22 bp, Homo sapiens
cgccagcgtgtggagcagagct

SEQ ID NO: 823656 - DNA, 18 bp, Homo sapiens
cgccagctcctctctgaa

SEQ ID NO: 823657 - DNA, 22 bp, Homo sapiens
cgccagctcctctctgaagcga

SEQ ID NO: 823658 - DNA, 14 bp, Homo sapiens
cgccagctgggagc

SEQ ID NO: 823659 - DNA, 20 bp, Homo sapiens
cgccagctgggagcactggt

SEQ ID NO: 823660 - DNA, 14 bp, Homo sapiens
cgccaggaagccag

SEQ ID NO: 823661 - DNA, 15 bp, Homo sapiens
cgccaggaagccaga

SEQ ID NO: 823662 - DNA, 18 bp, Homo sapiens
cgccaggacagcagcact

SEQ ID NO: 823663 - DNA, 19 bp, Homo sapiens
cgccaggacagcagcactc

SEQ ID NO: 823664 - DNA, 11 bp, Homo sapiens
cgccaggcgca

SEQ ID NO: 823665 - DNA, 21 bp, Homo sapiens
cgccaggctgaccacagcaca

SEQ ID NO: 823666 - DNA, 23 bp, Homo sapiens
cgccaggctgaccacagcacagc

SEQ ID NO: 823667 - DNA, 15 bp, Homo sapiens
cgccagggcccaggc

SEQ ID NO: 823668 - DNA, 22 bp, Homo sapiens
cgccaggggaaaatcagcctgc

SEQ ID NO: 823669 - DNA, 19 bp, Homo sapiens
cgccaggggcgggggacct

SEQ ID NO: 823670 - DNA, 17 bp, Homo sapiens
cgccagtcactgctgca

SEQ ID NO: 823671 - DNA, 13 bp, Homo sapiens
cgccataggccaa

SEQ ID NO: 823672 - DNA, 14 bp, Homo sapiens
cgccatccagggtc

SEQ ID NO: 823673 - DNA, 16 bp, Homo sapiens
cgccatccagggtctg

SEQ ID NO: 823674 - DNA, 17 bp, Homo sapiens
cgccatctgcgcagggt

SEQ ID NO: 823675 - DNA, 22 bp, Homo sapiens
cgccatctgtgtgcagcaacca

SEQ ID NO: 823676 - DNA, 14 bp, Homo sapiens
cgccatcttcttcc

SEQ ID NO: 823677 - DNA, 16 bp, Homo sapiens
cgccatcttcttccct

SEQ ID NO: 823678 - DNA, 21 bp, Homo sapiens
cgccatggggtcggctcctga

SEQ ID NO: 823679 - DNA, 22 bp, Homo sapiens
cgccatggggtcggctcctgat

SEQ ID NO: 823680 - DNA, 14 bp, Homo sapiens
cgccatggtgtccc

SEQ ID NO: 823681 - DNA, 14 bp, Homo sapiens
cgccattgccacca

SEQ ID NO: 823682 - DNA, 16 bp, Homo sapiens
cgctccatcgcccagg

SEQ ID NO: 823683 - DNA, 23 bp, Homo sapiens
cgctcccaggttcccccagcaag

SEQ ID NO: 823684 - DNA, 18 bp, Homo sapiens
cgctcccccgcagtcccc

SEQ ID NO: 823685 - DNA, 20 bp, Homo sapiens
cgctcccccgcagtccccag

SEQ ID NO: 823686 - DNA, 22 bp, Homo sapiens
cgctcccccgcagtccccagcc

SEQ ID NO: 823687 - DNA, 17 bp, Homo sapiens
cgctcccctctcctccg

SEQ ID NO: 823688 - DNA, 14 bp, Homo sapiens
cgctcccctctgga

SEQ ID NO: 823689 - DNA, 15 bp, Homo sapiens
cgctcccctctggaa

SEQ ID NO: 823690 - DNA, 13 bp, Homo sapiens
cgctccccttgga

SEQ ID NO: 823691 - DNA, 20 bp, Homo sapiens
cgctcccgcatttctcatgc

SEQ ID NO: 823692 - DNA, 15 bp, Homo sapiens
cgctcccgctcccag

SEQ ID NO: 823693 - DNA, 20 bp, Homo sapiens
cgctcccgggccgcgcgtct

SEQ ID NO: 823694 - DNA, 18 bp, Homo sapiens
cgctccctgacttctccc

SEQ ID NO: 823695 - DNA, 12 bp, Homo sapiens
cgctccctggat

SEQ ID NO: 823696 - DNA, 17 bp, Homo sapiens
cgctcccttcctgccac

SEQ ID NO: 823697 - DNA, 19 bp, Homo sapiens
cgctccgtgttcctcggtg

SEQ ID NO: 823698 - DNA, 12 bp, Homo sapiens
cgctcctcccag

SEQ ID NO: 823699 - DNA, 12 bp, Homo sapiens
cgctcctccctg

SEQ ID NO: 823700 - DNA, 14 bp, Homo sapiens
cgctcctccctgct

SEQ ID NO: 823701 - DNA, 20 bp, Homo sapiens
cgctcctccctgctcctcat

SEQ ID NO: 823702 - DNA, 18 bp, Homo sapiens
cgctcctccttcccaggg

SEQ ID NO: 823703 - DNA, 19 bp, Homo sapiens
cgctcctccttcccaggga

SEQ ID NO: 823704 - DNA, 14 bp, Homo sapiens
cgctcctgcagccc

SEQ ID NO: 823705 - DNA, 14 bp, Homo sapiens
cgctcctgcttccc

SEQ ID NO: 823706 - DNA, 16 bp, Homo sapiens
cgctcctgcttcccct

SEQ ID NO: 823707 - DNA, 24 bp, Homo sapiens
cgctcctgcttcccctccctaccc

SEQ ID NO: 823708 - DNA, 14 bp, Homo sapiens
cgctcctgtctgcc

SEQ ID NO: 823709 - DNA, 16 bp, Homo sapiens
cgctcctgtctgccag

SEQ ID NO: 823710 - DNA, 20 bp, Homo sapiens
cgctcctgtctgccagccag

SEQ ID NO: 823711 - DNA, 15 bp, Homo sapiens
cgctcgctgccatca

SEQ ID NO: 823712 - DNA, 17 bp, Homo sapiens
cgctcggcccggagcag

SEQ ID NO: 823713 - DNA, 19 bp, Homo sapiens
cgctcggcccggagcagca

SEQ ID NO: 823714 - DNA, 15 bp, Homo sapiens
cgctctcttcctgcc

SEQ ID NO: 823715 - DNA, 15 bp, Homo sapiens
cgctctctttgcaac

SEQ ID NO: 823716 - DNA, 17 bp, Homo sapiens
cgctctgctggcctggc

SEQ ID NO: 823717 - DNA, 12 bp, Homo sapiens
cgctctggacag

SEQ ID NO: 823718 - DNA, 18 bp, Homo sapiens
cgctctggacagatggac

SEQ ID NO: 823719 - DNA, 18 bp, Homo sapiens
cgctctggatcctgcact

SEQ ID NO: 823720 - DNA, 22 bp, Homo sapiens
cgctctgttgcccaggctggag

SEQ ID NO: 823721 - DNA, 21 bp, Homo sapiens
cgctcttggcaggtactcagc

SEQ ID NO: 823722 - DNA, 17 bp, Homo sapiens
cgctcttttccactcca

SEQ ID NO: 823723 - DNA, 23 bp, Homo sapiens
cgctgacaaccaccgctccccag

SEQ ID NO: 823724 - DNA, 12 bp, Homo sapiens
cgctgactgcac

SEQ ID NO: 823725 - DNA, 14 bp, Homo sapiens
cgctgagcttggag

SEQ ID NO: 823726 - DNA, 18 bp, Homo sapiens
cgctgaggggtctcggat

SEQ ID NO: 823727 - DNA, 16 bp, Homo sapiens
cgctgagtggcagggg

SEQ ID NO: 823728 - DNA, 15 bp, Homo sapiens
cgctgattcctcgtg

SEQ ID NO: 823729 - DNA, 15 bp, Homo sapiens
cgctgcacacagacg

SEQ ID NO: 823730 - DNA, 22 bp, Homo sapiens
cgctgcacacagacggcctagg

SEQ ID NO: 823731 - DNA, 16 bp, Homo sapiens
cgctgcagcctctgcc

SEQ ID NO: 823732 - DNA, 16 bp, Homo sapiens
cgctgcagggctccca

SEQ ID NO: 823733 - DNA, 17 bp, Homo sapiens
cgctgcagggctcccat

SEQ ID NO: 823734 - DNA, 21 bp, Homo sapiens
cgctgccaccacgtctgccag

SEQ ID NO: 823735 - DNA, 23 bp, Homo sapiens
cgctgccaccacgtctgccaggc

SEQ ID NO: 823736 - DNA, 18 bp, Homo sapiens
cgctgccatcaccgctgg

SEQ ID NO: 823737 - DNA, 20 bp, Homo sapiens
cgctgcccgctcagcccagc

SEQ ID NO: 823738 - DNA, 13 bp, Homo sapiens
cgctgccgcaccc

SEQ ID NO: 823739 - DNA, 20 bp, Homo sapiens
cgctgccgcaccccagagtg

SEQ ID NO: 823740 - DNA, 15 bp, Homo sapiens
cgctgccgctgccgc

SEQ ID NO: 823741 - DNA, 20 bp, Homo sapiens
cgctgcctaagtggctgctg

SEQ ID NO: 823742 - DNA, 13 bp, Homo sapiens
cgctgcctcaggc

SEQ ID NO: 823743 - DNA, 13 bp, Homo sapiens
cgctgcctcttgg

SEQ ID NO: 823744 - DNA, 19 bp, Homo sapiens
cgctgcgcggactcgcccc

SEQ ID NO: 823745 - DNA, 22 bp, Homo sapiens
cgctgcgcggactcgcccccag

SEQ ID NO: 823746 - DNA, 16 bp, Homo sapiens
cgctgctagagaaggg

SEQ ID NO: 823747 - DNA, 15 bp, Homo sapiens
cgctgctccttggct

SEQ ID NO: 823748 - DNA, 16 bp, Homo sapiens
cgctgctctagctggc

SEQ ID NO: 823749 - DNA, 19 bp, Homo sapiens
cgctgctctagctggcagg

SEQ ID NO: 823750 - DNA, 13 bp, Homo sapiens
cgctgctgtcaca

SEQ ID NO: 823751 - DNA, 17 bp, Homo sapiens
cgctgctgtgctctggg

SEQ ID NO: 823752 - DNA, 20 bp, Homo sapiens
cgctggactctcagtctctg

SEQ ID NO: 823753 - DNA, 20 bp, Homo sapiens
cgctggagcccacagcgagc

SEQ ID NO: 823754 - DNA, 21 bp, Homo sapiens
cgctggaggatgtgggcagct

SEQ ID NO: 823755 - DNA, 13 bp, Homo sapiens
cgctggcccagcc

SEQ ID NO: 823756 - DNA, 23 bp, Homo sapiens
cgctggggaagtacgtcccagcg

SEQ ID NO: 823757 - DNA, 12 bp, Homo sapiens
cgctgggtgcct

SEQ ID NO: 823758 - DNA, 14 bp, Homo sapiens
cgctgggtggtacc

SEQ ID NO: 823759 - DNA, 22 bp, Homo sapiens
cgctgggtggtaccctctggag

SEQ ID NO: 823760 - DNA, 21 bp, Homo sapiens
cgctgtaccctttaagatatc

SEQ ID NO: 823761 - DNA, 14 bp, Homo sapiens
cgctgtcaaggccg

SEQ ID NO: 823762 - DNA, 20 bp, Homo sapiens
cgctgtcaaggccgagggcc

SEQ ID NO: 823763 - DNA, 19 bp, Homo sapiens
cgctgtcctctcgagccca

SEQ ID NO: 823764 - DNA, 12 bp, Homo sapiens
cgctgtcctgcg

SEQ ID NO: 823765 - DNA, 22 bp, Homo sapiens
cgctgtcctgcgttcagcccct

SEQ ID NO: 823766 - DNA, 17 bp, Homo sapiens
cgctgtcgccccaggcc

SEQ ID NO: 823767 - DNA, 15 bp, Homo sapiens
cgctgtctccagacc

SEQ ID NO: 823768 - DNA, 16 bp, Homo sapiens
cgctgtgagcccctgg

SEQ ID NO: 823769 - DNA, 17 bp, Homo sapiens
cgctgtgatgctgtgtg

SEQ ID NO: 823770 - DNA, 18 bp, Homo sapiens
cgctgtgatgctgtgtgc

SEQ ID NO: 823771 - DNA, 20 bp, Homo sapiens
cgctgtgtgttagttcccaa

SEQ ID NO: 823772 - DNA, 13 bp, Homo sapiens
cgcttagcctgcc

SEQ ID NO: 823773 - DNA, 14 bp, Homo sapiens
cgcttagcctgcct

SEQ ID NO: 823774 - DNA, 17 bp, Homo sapiens
cgcttagcgctctggac

SEQ ID NO: 823775 - DNA, 15 bp, Homo sapiens
cgcttcacccctgca

SEQ ID NO: 823776 - DNA, 17 bp, Homo sapiens
cgcttcacccctgcact

SEQ ID NO: 823777 - DNA, 15 bp, Homo sapiens
cgcttccccttgcca

SEQ ID NO: 823778 - DNA, 17 bp, Homo sapiens
cgcttccccttgccacg

SEQ ID NO: 823779 - DNA, 17 bp, Homo sapiens
cgcttcctcagcctcca

SEQ ID NO: 823780 - DNA, 16 bp, Homo sapiens
cgcttcgaactccagg

SEQ ID NO: 823781 - DNA, 12 bp, Homo sapiens
cgcttctgactg

SEQ ID NO: 823782 - DNA, 13 bp, Homo sapiens
cgcttctgctgga

SEQ ID NO: 823783 - DNA, 19 bp, Homo sapiens
cgcttcttgcctctgtgct

SEQ ID NO: 823784 - DNA, 15 bp, Homo sapiens
cgcttgagcccagga

SEQ ID NO: 823785 - DNA, 17 bp, Homo sapiens
cgcttgccagaggccct

SEQ ID NO: 823786 - DNA, 22 bp, Homo sapiens
cgcttgggcgccgtgctgggca

SEQ ID NO: 823787 - DNA, 23 bp, Homo sapiens
cgcttgtagaactcactctgggc

SEQ ID NO: 823788 - DNA, 18 bp, Homo sapiens
cgcttgtggggacccagg

SEQ ID NO: 823789 - DNA, 21 bp, Homo sapiens
cgcttgtggggacccaggctc

SEQ ID NO: 823790 - DNA, 22 bp, Homo sapiens
cgctttctagctgttgagctgt

SEQ ID NO: 823791 - DNA, 15 bp, Homo sapiens
cgctttctcctgtgc

SEQ ID NO: 823792 - DNA, 16 bp, Homo sapiens
cgctttctcctgtgcc

SEQ ID NO: 823793 - DNA, 17 bp, Homo sapiens
cgctttctcctgtgccc

SEQ ID NO: 823794 - DNA, 17 bp, Homo sapiens
cgcttttgcagcagagg

SEQ ID NO: 823795 - DNA, 17 bp, Homo sapiens
cgcttttgttctcgcaa

SEQ ID NO: 823796 - DNA, 15 bp, Homo sapiens
cggaaaacatgctac

SEQ ID NO: 823797 - DNA, 20 bp, Homo sapiens
cggaaaacatgctacacact

SEQ ID NO: 823798 - DNA, 14 bp, Homo sapiens
cggaaacagaactc

SEQ ID NO: 823799 - DNA, 12 bp, Homo sapiens
cggaaagaagag

SEQ ID NO: 823800 - DNA, 14 bp, Homo sapiens
cggaagcagtgcct

SEQ ID NO: 823801 - DNA, 21 bp, Homo sapiens
cggaagccatagggggctgca

SEQ ID NO: 823802 - DNA, 22 bp, Homo sapiens
cggaagccgtctgactccagag

SEQ ID NO: 823803 - DNA, 13 bp, Homo sapiens
cggaagcctgtcc

SEQ ID NO: 823804 - DNA, 14 bp, Homo sapiens
cggaagcctgtcct

SEQ ID NO: 823805 - DNA, 13 bp, Homo sapiens
cggaaggaggcca

SEQ ID NO: 823806 - DNA, 21 bp, Homo sapiens
cggaagggttggtgggctggc

SEQ ID NO: 823807 - DNA, 17 bp, Homo sapiens
cggaaggtttttaaaca

SEQ ID NO: 823808 - DNA, 15 bp, Homo sapiens
cggaatagagcctcg

SEQ ID NO: 823809 - DNA, 21 bp, Homo sapiens
cggaatcctgtcgattagact

SEQ ID NO: 823810 - DNA, 20 bp, Homo sapiens
cggaattcaccagtgttcct

SEQ ID NO: 823811 - DNA, 17 bp, Homo sapiens
cggacaaaagggccagg

SEQ ID NO: 823812 - DNA, 18 bp, Homo sapiens
cggacaaaagggccaggt

SEQ ID NO: 823813 - DNA, 18 bp, Homo sapiens
cggacaagacccccagca

SEQ ID NO: 823814 - DNA, 12 bp, Homo sapiens
cggacaccccct

SEQ ID NO: 823815 - DNA, 19 bp, Homo sapiens
cggaccactcgaggcctgc

SEQ ID NO: 823816 - DNA, 20 bp, Homo sapiens
cggacccaccaaactgcaca

SEQ ID NO: 823817 - DNA, 13 bp, Homo sapiens
cggacccacccca

SEQ ID NO: 823818 - DNA, 16 bp, Homo sapiens
cggacccaccccaact

SEQ ID NO: 823819 - DNA, 19 bp, Homo sapiens
cggacccttcccagccctc

SEQ ID NO: 823820 - DNA, 20 bp, Homo sapiens
cggacccttcccagccctca

SEQ ID NO: 823821 - DNA, 17 bp, Homo sapiens
cggaccgcgtagagagc

SEQ ID NO: 823822 - DNA, 18 bp, Homo sapiens
cggaccgcgtagagagcc

SEQ ID NO: 823823 - DNA, 18 bp, Homo sapiens
cggacctacctccctccc

SEQ ID NO: 823824 - DNA, 11 bp, Homo sapiens
cggacctctga

SEQ ID NO: 823825 - DNA, 21 bp, Homo sapiens
cggacctgagcccgcagccca

SEQ ID NO: 823826 - DNA, 21 bp, Homo sapiens
cggaccttggcagcccaggcc

SEQ ID NO: 823827 - DNA, 12 bp, Homo sapiens
cggacgggctgt

SEQ ID NO: 823828 - DNA, 19 bp, Homo sapiens
cggacgttggttctgcact

SEQ ID NO: 823829 - DNA, 15 bp, Homo sapiens
cggacgtttccatca

SEQ ID NO: 823830 - DNA, 15 bp, Homo sapiens
cggactgaggtgcct

SEQ ID NO: 823831 - DNA, 18 bp, Homo sapiens
cggactgcccccagaaag

SEQ ID NO: 823832 - DNA, 15 bp, Homo sapiens
cggacttttctgcaa

SEQ ID NO: 823833 - DNA, 16 bp, Homo sapiens
cggacttttctgcaaa

SEQ ID NO: 823834 - DNA, 13 bp, Homo sapiens
cggagaaactcat

SEQ ID NO: 823835 - DNA, 16 bp, Homo sapiens
cggagaaactgaggta

SEQ ID NO: 823836 - DNA, 21 bp, Homo sapiens
cggagacagaggaaagggctg

SEQ ID NO: 823837 - DNA, 15 bp, Homo sapiens
cggagacctcctgac

SEQ ID NO: 823838 - DNA, 17 bp, Homo sapiens
cggagactatggcctcg

SEQ ID NO: 823839 - DNA, 13 bp, Homo sapiens
cggagagaaaaaa

SEQ ID NO: 823840 - DNA, 12 bp, Homo sapiens
cggagaggctgt

SEQ ID NO: 823841 - DNA, 17 bp, Homo sapiens
cggagaggctgtctggg

SEQ ID NO: 823842 - DNA, 21 bp, Homo sapiens
cggagaggctgtctggggcct

SEQ ID NO: 823843 - DNA, 21 bp, Homo sapiens
cggagagtacagtgagccaag

SEQ ID NO: 823844 - DNA, 14 bp, Homo sapiens
cggagcacagccct

SEQ ID NO: 823845 - DNA, 16 bp, Homo sapiens
cggagcacagccctgg

SEQ ID NO: 823846 - DNA, 19 bp, Homo sapiens
cggagcacagccctgggag

SEQ ID NO: 823847 - DNA, 15 bp, Homo sapiens
cggagcagcaggaag

SEQ ID NO: 823848 - DNA, 11 bp, Homo sapiens
cggagccactc

SEQ ID NO: 823849 - DNA, 18 bp, Homo sapiens
cggagccactcctctgac

SEQ ID NO: 823850 - DNA, 21 bp, Homo sapiens
cggagccactcctctgactca

SEQ ID NO: 823851 - DNA, 18 bp, Homo sapiens
cggagccatcaccctcac

SEQ ID NO: 823852 - DNA, 20 bp, Homo sapiens
cggagccatcaccctcaccc

SEQ ID NO: 823853 - DNA, 19 bp, Homo sapiens
cggagcccacactgccacc

SEQ ID NO: 823854 - DNA, 11 bp, Homo sapiens
cggagcccaga

SEQ ID NO: 823855 - DNA, 14 bp, Homo sapiens
cggagccccaggcc

SEQ ID NO: 823856 - DNA, 13 bp, Homo sapiens
cggagcccctgaa

SEQ ID NO: 823857 - DNA, 18 bp, Homo sapiens
cggagcccctgaaagcct

SEQ ID NO: 823858 - DNA, 21 bp, Homo sapiens
cggagcccgatattctccctg

SEQ ID NO: 823859 - DNA, 20 bp, Homo sapiens
cggagctaacactggcccct

SEQ ID NO: 823860 - DNA, 21 bp, Homo sapiens
cggagctggccccgccgcctg

SEQ ID NO: 823861 - DNA, 19 bp, Homo sapiens
cggagctggctgtgcctgc

SEQ ID NO: 823862 - DNA, 18 bp, Homo sapiens
cggagctggggtctgggc

SEQ ID NO: 823863 - DNA, 19 bp, Homo sapiens
cggagctggggtctgggca

SEQ ID NO: 823864 - DNA, 21 bp, Homo sapiens
cggagctggttcctctctccc

SEQ ID NO: 823865 - DNA, 20 bp, Homo sapiens
cggaggaaggaggacccagg

SEQ ID NO: 823866 - DNA, 23 bp, Homo sapiens
cggaggaaggaggacccaggaca

SEQ ID NO: 823867 - DNA, 15 bp, Homo sapiens
cggaggactgagccc

SEQ ID NO: 823868 - DNA, 22 bp, Homo sapiens
cggaggagcagcctcgaggctg

SEQ ID NO: 823869 - DNA, 14 bp, Homo sapiens
cggaggaggaagag

SEQ ID NO: 823870 - DNA, 23 bp, Homo sapiens
cggaggaggagatgttgagggga

SEQ ID NO: 823871 - DNA, 12 bp, Homo sapiens
cggaggccttgg

SEQ ID NO: 823872 - DNA, 13 bp, Homo sapiens
cggaggctgggcc

SEQ ID NO: 823873 - DNA, 22 bp, Homo sapiens
cggaggctgggcccctgggatg

SEQ ID NO: 823874 - DNA, 21 bp, Homo sapiens
cggaggctgtgctccgccatg

SEQ ID NO: 823875 - DNA, 19 bp, Homo sapiens
cggagggaattgaggtctg

SEQ ID NO: 823876 - DNA, 11 bp, Homo sapiens
cggagggaggc

SEQ ID NO: 823877 - DNA, 19 bp, Homo sapiens
cggagggagtcccagagcc

SEQ ID NO: 823878 - DNA, 17 bp, Homo sapiens
cggagggccgcagggcc

SEQ ID NO: 823879 - DNA, 18 bp, Homo sapiens
cggagggccgcagggccc

SEQ ID NO: 823880 - DNA, 15 bp, Homo sapiens
cggaggggacccagc

SEQ ID NO: 823881 - DNA, 19 bp, Homo sapiens
cggagtaatcaggcagcct

SEQ ID NO: 823882 - DNA, 19 bp, Homo sapiens
cggagtcagccaggagctg

SEQ ID NO: 823883 - DNA, 23 bp, Homo sapiens
cggagtcctgtgtttgtgagtcg

SEQ ID NO: 823884 - DNA, 15 bp, Homo sapiens
cggagtcgtggggtg

SEQ ID NO: 823885 - DNA, 18 bp, Homo sapiens
cggagtgaagaggggcag

SEQ ID NO: 823886 - DNA, 23 bp, Homo sapiens
cggagtgaagaggggcagccctt

SEQ ID NO: 823887 - DNA, 16 bp, Homo sapiens
cggagtggacaccgct

SEQ ID NO: 823888 - DNA, 18 bp, Homo sapiens
cggagtggggggacagag

SEQ ID NO: 823889 - DNA, 23 bp, Homo sapiens
cggagttcggaaaccgtcctgtg

SEQ ID NO: 823890 - DNA, 13 bp, Homo sapiens
cggatcagagcag

SEQ ID NO: 823891 - DNA, 19 bp, Homo sapiens
cggatcagagcaggacctc

SEQ ID NO: 823892 - DNA, 22 bp, Homo sapiens
cggatcagagcaggacctccct

SEQ ID NO: 823893 - DNA, 17 bp, Homo sapiens
cggatcctgtgagtagg

SEQ ID NO: 823894 - DNA, 19 bp, Homo sapiens
cggatctcacaggctgaga

SEQ ID NO: 823895 - DNA, 17 bp, Homo sapiens
cggatgacaccctggcc

SEQ ID NO: 823896 - DNA, 21 bp, Homo sapiens
cggatgaccaaaccagccttc

SEQ ID NO: 823897 - DNA, 13 bp, Homo sapiens
cggatgagttatt

SEQ ID NO: 823898 - DNA, 12 bp, Homo sapiens
cggatgctccga

SEQ ID NO: 823899 - DNA, 17 bp, Homo sapiens
cggatgctgtgcctggc

SEQ ID NO: 823900 - DNA, 15 bp, Homo sapiens
cggatgtataaatgt

SEQ ID NO: 823901 - DNA, 24 bp, Homo sapiens
cggattccaaagagtagaattgca

SEQ ID NO: 823902 - DNA, 11 bp, Homo sapiens
cggatttctaa

SEQ ID NO: 823903 - DNA, 13 bp, Homo sapiens
cggcaaaaggaaa

SEQ ID NO: 823904 - DNA, 20 bp, Homo sapiens
cggcaaccccagttctgctc

SEQ ID NO: 823905 - DNA, 22 bp, Homo sapiens
cggcaaccccagttctgctcct

SEQ ID NO: 823906 - DNA, 23 bp, Homo sapiens
cggcaaccccagttctgctcctc

SEQ ID NO: 823907 - DNA, 17 bp, Homo sapiens
cggcaacgtagcctggg

SEQ ID NO: 823908 - DNA, 18 bp, Homo sapiens
cggcacagatgctccagg

SEQ ID NO: 823909 - DNA, 21 bp, Homo sapiens
cggcaccctggtctgtggaga

SEQ ID NO: 823910 - DNA, 23 bp, Homo sapiens
cggcacgccaacagcccccccct

SEQ ID NO: 823911 - DNA, 14 bp, Homo sapiens
cggcagaactctct

SEQ ID NO: 823912 - DNA, 15 bp, Homo sapiens
cggcagaactctctg

SEQ ID NO: 823913 - DNA, 14 bp, Homo sapiens
cggcagcagccatc

SEQ ID NO: 823914 - DNA, 15 bp, Homo sapiens
cggcagcatggagct

SEQ ID NO: 823915 - DNA, 13 bp, Homo sapiens
cggcagccccact

SEQ ID NO: 823916 - DNA, 14 bp, Homo sapiens
cggcagccccactt

SEQ ID NO: 823917 - DNA, 15 bp, Homo sapiens
cggcagccccacttc

SEQ ID NO: 823918 - DNA, 16 bp, Homo sapiens
cggcagccccacttca

SEQ ID NO: 823919 - DNA, 19 bp, Homo sapiens
cggcagcccccccctcaag

SEQ ID NO: 823920 - DNA, 22 bp, Homo sapiens
cggcagctcttctgggcagagc

SEQ ID NO: 823921 - DNA, 20 bp, Homo sapiens
cggcagctgaaccctgctcc

SEQ ID NO: 823922 - DNA, 10 bp, Homo sapiens
cggcagctgt

SEQ ID NO: 823923 - DNA, 14 bp, Homo sapiens
cggcagctgtagct

SEQ ID NO: 823924 - DNA, 21 bp, Homo sapiens
cggcaggagagtgtgtgggca

SEQ ID NO: 823925 - DNA, 21 bp, Homo sapiens
cggcaggcgtgtggcagccac

SEQ ID NO: 823926 - DNA, 16 bp, Homo sapiens
cgggccgaccctgcgg

SEQ ID NO: 823927 - DNA, 17 bp, Homo sapiens
cgggccgaccctgcggc

SEQ ID NO: 823928 - DNA, 15 bp, Homo sapiens
cgggccggggcaggg

SEQ ID NO: 823929 - DNA, 18 bp, Homo sapiens
cgggcctgcacagatacc

SEQ ID NO: 823930 - DNA, 24 bp, Homo sapiens
cgggcctgcacagatacctcatca

SEQ ID NO: 823931 - DNA, 13 bp, Homo sapiens
cgggcctggacaa

SEQ ID NO: 823932 - DNA, 15 bp, Homo sapiens
cgggcgcccgcggcg

SEQ ID NO: 823933 - DNA, 20 bp, Homo sapiens
cgggcgcgatcccacacagg

SEQ ID NO: 823934 - DNA, 18 bp, Homo sapiens
cgggcgtcaggggtgcac

SEQ ID NO: 823935 - DNA, 18 bp, Homo sapiens
cgggctaaggtccctggg

SEQ ID NO: 823936 - DNA, 20 bp, Homo sapiens
cgggctaaggtccctggggg

SEQ ID NO: 823937 - DNA, 11 bp, Homo sapiens
cgggctcagca

SEQ ID NO: 823938 - DNA, 12 bp, Homo sapiens
cgggctccctcc

SEQ ID NO: 823939 - DNA, 14 bp, Homo sapiens
cgggctccctcctc

SEQ ID NO: 823940 - DNA, 13 bp, Homo sapiens
cgggctccttccc

SEQ ID NO: 823941 - DNA, 15 bp, Homo sapiens
cgggctccttcccct

SEQ ID NO: 823942 - DNA, 22 bp, Homo sapiens
cgggctccttcccctgcacctg

SEQ ID NO: 823943 - DNA, 23 bp, Homo sapiens
cgggctccttcccctgcacctgg

SEQ ID NO: 823944 - DNA, 21 bp, Homo sapiens
cgggctctctcacccagcctg

SEQ ID NO: 823945 - DNA, 14 bp, Homo sapiens
cgggctctctgctg

SEQ ID NO: 823946 - DNA, 15 bp, Homo sapiens
cgggctctctgctgt

SEQ ID NO: 823947 - DNA, 14 bp, Homo sapiens
cgggctctggccac

SEQ ID NO: 823948 - DNA, 15 bp, Homo sapiens
cgggctctggccacc

SEQ ID NO: 823949 - DNA, 16 bp, Homo sapiens
cgggctctggccaccc

SEQ ID NO: 823950 - DNA, 18 bp, Homo sapiens
cgggctctggccaccctg

SEQ ID NO: 823951 - DNA, 23 bp, Homo sapiens
cgggctctggccaccctggcccg

SEQ ID NO: 823952 - DNA, 17 bp, Homo sapiens
cgggctgactgggccac

SEQ ID NO: 823953 - DNA, 16 bp, Homo sapiens
cgggctgaggccagag

SEQ ID NO: 823954 - DNA, 17 bp, Homo sapiens
cgggctgaggccagagt

SEQ ID NO: 823955 - DNA, 14 bp, Homo sapiens
cgggctgagggcct

SEQ ID NO: 823956 - DNA, 19 bp, Homo sapiens
cgggctgagggcctgctgg

SEQ ID NO: 823957 - DNA, 22 bp, Homo sapiens
cgggctgcctgcccctgctgct

SEQ ID NO: 823958 - DNA, 15 bp, Homo sapiens
cgggctgcctgggct

SEQ ID NO: 823959 - DNA, 16 bp, Homo sapiens
cgggctgcctgggctg

SEQ ID NO: 823960 - DNA, 12 bp, Homo sapiens
cgggctggccct

SEQ ID NO: 823961 - DNA, 15 bp, Homo sapiens
cgggctggccctgtg

SEQ ID NO: 823962 - DNA, 16 bp, Homo sapiens
cgggctggccctgtgc

SEQ ID NO: 823963 - DNA, 21 bp, Homo sapiens
cgggctggccctgtgcagacc

SEQ ID NO: 823964 - DNA, 21 bp, Homo sapiens
cgggctggctgcttgcagcca

SEQ ID NO: 823965 - DNA, 20 bp, Homo sapiens
cgggctgggagctctgcaga

SEQ ID NO: 823966 - DNA, 20 bp, Homo sapiens
cgggctgggggtagcctgga

SEQ ID NO: 823967 - DNA, 12 bp, Homo sapiens
cgggctgtgccc

SEQ ID NO: 823968 - DNA, 14 bp, Homo sapiens
cggggaactcctgg

SEQ ID NO: 823969 - DNA, 15 bp, Homo sapiens
cggggaactcctgga

SEQ ID NO: 823970 - DNA, 16 bp, Homo sapiens
cggggacaccagagct

SEQ ID NO: 823971 - DNA, 16 bp, Homo sapiens
cggggacaggctggaa

SEQ ID NO: 823972 - DNA, 13 bp, Homo sapiens
cggggaccctgcc

SEQ ID NO: 823973 - DNA, 16 bp, Homo sapiens
cggggaccctgccgag

SEQ ID NO: 823974 - DNA, 18 bp, Homo sapiens
cggggagaaataatgcat

SEQ ID NO: 823975 - DNA, 20 bp, Homo sapiens
cggggagaagatagggaaca

SEQ ID NO: 823976 - DNA, 13 bp, Homo sapiens
cggggagaggggg

SEQ ID NO: 823977 - DNA, 15 bp, Homo sapiens
cggggagagggggag

SEQ ID NO: 823978 - DNA, 19 bp, Homo sapiens
cggggagagggggaggttg

SEQ ID NO: 823979 - DNA, 16 bp, Homo sapiens
cggggagcccccgccc

SEQ ID NO: 823980 - DNA, 21 bp, Homo sapiens
cggggaggccaagtgcaggct

SEQ ID NO: 823981 - DNA, 21 bp, Homo sapiens
cggggagggggcacggcaggc

SEQ ID NO: 823982 - DNA, 22 bp, Homo sapiens
cggggagggggcacggcaggcg

SEQ ID NO: 823983 - DNA, 17 bp, Homo sapiens
cggggcatgctggggca

SEQ ID NO: 823984 - DNA, 21 bp, Homo sapiens
cggggcatggacagggccagg

SEQ ID NO: 823985 - DNA, 22 bp, Homo sapiens
cggggcatggacagggccaggg

SEQ ID NO: 823986 - DNA, 15 bp, Homo sapiens
cggggccccagggct

SEQ ID NO: 823987 - DNA, 18 bp, Homo sapiens
cggggcccttggggcctg

SEQ ID NO: 823988 - DNA, 17 bp, Homo sapiens
cggggccgacattgtct

SEQ ID NO: 823989 - DNA, 14 bp, Homo sapiens
cggggccggtgagg

SEQ ID NO: 823990 - DNA, 17 bp, Homo sapiens
cggggccggtgagggga

SEQ ID NO: 823991 - DNA, 23 bp, Homo sapiens
cggggcctcgcgagggtcacgct

SEQ ID NO: 823992 - DNA, 19 bp, Homo sapiens
cggggctggcaagcaggga

SEQ ID NO: 823993 - DNA, 20 bp, Homo sapiens
cgggggagcagagagagcca

SEQ ID NO: 823994 - DNA, 20 bp, Homo sapiens
cgggggcccaagtggggtgc

SEQ ID NO: 823995 - DNA, 19 bp, Homo sapiens
cgggggccccacctcggca

SEQ ID NO: 823996 - DNA, 11 bp, Homo sapiens
cgggggctctt

SEQ ID NO: 823997 - DNA, 16 bp, Homo sapiens
cgggggctgctgggcg

SEQ ID NO: 823998 - DNA, 18 bp, Homo sapiens
cgggggctgtgactctgg

SEQ ID NO: 823999 - DNA, 23 bp, Homo sapiens
cgggggctgtgactctgggcagg

SEQ ID NO: 824000 - DNA, 13 bp, Homo sapiens
cggggggagggga

SEQ ID NO: 824001 - DNA, 22 bp, Homo sapiens
cggggggaggggacagagctga

SEQ ID NO: 824002 - DNA, 13 bp, Homo sapiens
cggggggagggtt

SEQ ID NO: 824003 - DNA, 22 bp, Homo sapiens
cggggggagggttggggagggg

SEQ ID NO: 824004 - DNA, 20 bp, Homo sapiens
cggggggggtaggagaggag

SEQ ID NO: 824005 - DNA, 13 bp, Homo sapiens
cggggggtggacc

SEQ ID NO: 824006 - DNA, 14 bp, Homo sapiens
cgggggtgctgggg

SEQ ID NO: 824007 - DNA, 19 bp, Homo sapiens
cgggggtgctggggccagg

SEQ ID NO: 824008 - DNA, 15 bp, Homo sapiens
cggggtatcctgggg

SEQ ID NO: 824009 - DNA, 21 bp, Homo sapiens
cggggtatcctgggggaccca

SEQ ID NO: 824010 - DNA, 14 bp, Homo sapiens
cggggtatgaagag

SEQ ID NO: 824011 - DNA, 21 bp, Homo sapiens
cggggtccaccagtgtgtggg

SEQ ID NO: 824012 - DNA, 18 bp, Homo sapiens
cggggtcggacggggcag

SEQ ID NO: 824013 - DNA, 17 bp, Homo sapiens
cggggtctgtgctgtgc

SEQ ID NO: 824014 - DNA, 20 bp, Homo sapiens
cggggtctgtgctgtgcctg

SEQ ID NO: 824015 - DNA, 21 bp, Homo sapiens
cggggtctgtgctgtgcctgc

SEQ ID NO: 824016 - DNA, 22 bp, Homo sapiens
cggggtctgtgctgtgcctgct

SEQ ID NO: 824017 - DNA, 23 bp, Homo sapiens
cggggtctgtgctgtgcctgcta

SEQ ID NO: 824018 - DNA, 23 bp, Homo sapiens
cggggtgagtccattctcccagg

SEQ ID NO: 824019 - DNA, 12 bp, Homo sapiens
cggggtggggag

SEQ ID NO: 824020 - DNA, 13 bp, Homo sapiens
cggggtggggagg

SEQ ID NO: 824021 - DNA, 22 bp, Homo sapiens
cggggtgggtgggtgggcaggg

SEQ ID NO: 824022 - DNA, 22 bp, Homo sapiens
cggggtgtaacttcctgctgca

SEQ ID NO: 824023 - DNA, 17 bp, Homo sapiens
cgggtcaccctgtgacc

SEQ ID NO: 824024 - DNA, 13 bp, Homo sapiens
cgggtcactgctg

SEQ ID NO: 824025 - DNA, 17 bp, Homo sapiens
cgggtccagagaccaca

SEQ ID NO: 824026 - DNA, 22 bp, Homo sapiens
cgggtctcacttataccaaagg

SEQ ID NO: 824027 - DNA, 14 bp, Homo sapiens
cgggtctcctccca

SEQ ID NO: 824028 - DNA, 16 bp, Homo sapiens
cgggtctcgcagcctg

SEQ ID NO: 824029 - DNA, 17 bp, Homo sapiens
cgggtctcgcagcctga

SEQ ID NO: 824030 - DNA, 22 bp, Homo sapiens
cgggtctcgcagcctgaagcct

SEQ ID NO: 824031 - DNA, 21 bp, Homo sapiens
cgggtgcacagagacggtctg

SEQ ID NO: 824032 - DNA, 15 bp, Homo sapiens
cgggtgccaggacaa

SEQ ID NO: 824033 - DNA, 18 bp, Homo sapiens
cgggtggatcacctgagg

SEQ ID NO: 824034 - DNA, 19 bp, Homo sapiens
cgggtgggcctggcctgag

SEQ ID NO: 824035 - DNA, 22 bp, Homo sapiens
cgggtgggcctggcctgagctg

SEQ ID NO: 824036 - DNA, 21 bp, Homo sapiens
cgggtggggaaaggaggtggg

SEQ ID NO: 824037 - DNA, 16 bp, Homo sapiens
cgggtggggcttgggg

SEQ ID NO: 824038 - DNA, 14 bp, Homo sapiens
cgggtggtccccgt

SEQ ID NO: 824039 - DNA, 22 bp, Homo sapiens
cgggtgtgcaatgtctgagtga

SEQ ID NO: 824040 - DNA, 17 bp, Homo sapiens
cgggtgtggcctcagcc

SEQ ID NO: 824041 - DNA, 22 bp, Homo sapiens
cgggttcgcaccattctcctgc

SEQ ID NO: 824042 - DNA, 21 bp, Homo sapiens
cgggttctagacgcccctccc

SEQ ID NO: 824043 - DNA, 13 bp, Homo sapiens
cggtaactgtcct

SEQ ID NO: 824044 - DNA, 14 bp, Homo sapiens
cggtaactgtcctg

SEQ ID NO: 824045 - DNA, 15 bp, Homo sapiens
cggtagccagcacac

SEQ ID NO: 824046 - DNA, 18 bp, Homo sapiens
cggtatccccccatcttg

SEQ ID NO: 824047 - DNA, 12 bp, Homo sapiens
cggtatcctaaa

SEQ ID NO: 824048 - DNA, 18 bp, Homo sapiens
cgtcttttcctgtttcct

SEQ ID NO: 824049 - DNA, 17 bp, Homo sapiens
cgtgaaaacggagctga

SEQ ID NO: 824050 - DNA, 18 bp, Homo sapiens
cgtgaaagaattattttt

SEQ ID NO: 824051 - DNA, 19 bp, Homo sapiens
cgtgaaagaattatttttg

SEQ ID NO: 824052 - DNA, 16 bp, Homo sapiens
cgtgaaagcagatgag

SEQ ID NO: 824053 - DNA, 16 bp, Homo sapiens
cgtgaaatttgcctct

SEQ ID NO: 824054 - DNA, 18 bp, Homo sapiens
cgtgaaatttgcctctgt

SEQ ID NO: 824055 - DNA, 17 bp, Homo sapiens
cgtgaacccaggaggcg

SEQ ID NO: 824056 - DNA, 16 bp, Homo sapiens
cgtgaagaaataaatg

SEQ ID NO: 824057 - DNA, 22 bp, Homo sapiens
cgtgaagaaataaatgaaactt

SEQ ID NO: 824058 - DNA, 13 bp, Homo sapiens
cgtgaagcagtgc

SEQ ID NO: 824059 - DNA, 20 bp, Homo sapiens
cgtgaagcagtgcctcgagg

SEQ ID NO: 824060 - DNA, 17 bp, Homo sapiens
cgtgaagtatactgtat

SEQ ID NO: 824061 - DNA, 22 bp, Homo sapiens
cgtgacagatgccaacttccca

SEQ ID NO: 824062 - DNA, 18 bp, Homo sapiens
cgtgacccgacctggccg

SEQ ID NO: 824063 - DNA, 20 bp, Homo sapiens
cgtgacccttcagggccaga

SEQ ID NO: 824064 - DNA, 20 bp, Homo sapiens
cgtgaccggacttttctgca

SEQ ID NO: 824065 - DNA, 20 bp, Homo sapiens
cgtgacctattcaccctcca

SEQ ID NO: 824066 - DNA, 13 bp, Homo sapiens
cgtgactcaccca

SEQ ID NO: 824067 - DNA, 13 bp, Homo sapiens
cgtgactgcccca

SEQ ID NO: 824068 - DNA, 22 bp, Homo sapiens
cgtgagaaatagctgaaaaggg

SEQ ID NO: 824069 - DNA, 18 bp, Homo sapiens
cgtgagagaatctgcctg

SEQ ID NO: 824070 - DNA, 17 bp, Homo sapiens
cgtgagccactgctcgt

SEQ ID NO: 824071 - DNA, 12 bp, Homo sapiens
cgtgagccaggt

SEQ ID NO: 824072 - DNA, 13 bp, Homo sapiens
cgtgagccaggta

SEQ ID NO: 824073 - DNA, 12 bp, Homo sapiens
cgtgagctgccc

SEQ ID NO: 824074 - DNA, 20 bp, Homo sapiens
cgtgagctgcccggcgcctg

SEQ ID NO: 824075 - DNA, 19 bp, Homo sapiens
cgtgagctggggactcagg

SEQ ID NO: 824076 - DNA, 22 bp, Homo sapiens
cgtgagctggggactcagggac

SEQ ID NO: 824077 - DNA, 20 bp, Homo sapiens
cgtgagggcaagagggggac

SEQ ID NO: 824078 - DNA, 20 bp, Homo sapiens
cgtgagttgggggagggaag

SEQ ID NO: 824079 - DNA, 15 bp, Homo sapiens
cgtgatagaaaaaaa

SEQ ID NO: 824080 - DNA, 17 bp, Homo sapiens
cgtgatcactgagccat

SEQ ID NO: 824081 - DNA, 18 bp, Homo sapiens
cgtgatccacccacctcg

SEQ ID NO: 824082 - DNA, 20 bp, Homo sapiens
cgtgatggagaggacagagc

SEQ ID NO: 824083 - DNA, 13 bp, Homo sapiens
cgtgatgtgccac

SEQ ID NO: 824084 - DNA, 15 bp, Homo sapiens
cgtgatgtgccacta

SEQ ID NO: 824085 - DNA, 17 bp, Homo sapiens
cgtgatgtggaggaaga

SEQ ID NO: 824086 - DNA, 18 bp, Homo sapiens
cgtgatgtggaggaagag

SEQ ID NO: 824087 - DNA, 13 bp, Homo sapiens
cgtgattgaccct

SEQ ID NO: 824088 - DNA, 16 bp, Homo sapiens
cgtgattgacccttta

SEQ ID NO: 824089 - DNA, 21 bp, Homo sapiens
cgtgattgattcagtatctta

SEQ ID NO: 824090 - DNA, 20 bp, Homo sapiens
cgtgatttggaagagaggca

SEQ ID NO: 824091 - DNA, 21 bp, Homo sapiens
cgtgcaaacaacctgaatctt

SEQ ID NO: 824092 - DNA, 10 bp, Homo sapiens
cgtgcacagg

SEQ ID NO: 824093 - DNA, 12 bp, Homo sapiens
cgtgcacagggt

SEQ ID NO: 824094 - DNA, 15 bp, Homo sapiens
cgtgcacctgtactc

SEQ ID NO: 824095 - DNA, 17 bp, Homo sapiens
cgtgcacgtggagagct

SEQ ID NO: 824096 - DNA, 22 bp, Homo sapiens
cgtgcactgtgaatcctggcaa

SEQ ID NO: 824097 - DNA, 12 bp, Homo sapiens
cgtgcaggacag

SEQ ID NO: 824098 - DNA, 19 bp, Homo sapiens
cgtgcaggacagctcttga

SEQ ID NO: 824099 - DNA, 17 bp, Homo sapiens
cgtgcagggacaaagag

SEQ ID NO: 824100 - DNA, 20 bp, Homo sapiens
cgtgcatcccccctgctcag

SEQ ID NO: 824101 - DNA, 21 bp, Homo sapiens
cgtgcatcccccctgctcagc

SEQ ID NO: 824102 - DNA, 17 bp, Homo sapiens
cgtgcatccctgagaca

SEQ ID NO: 824103 - DNA, 22 bp, Homo sapiens
cgtgcatggctcctgtctggct

SEQ ID NO: 824104 - DNA, 13 bp, Homo sapiens
cgtgcatgtgcac

SEQ ID NO: 824105 - DNA, 22 bp, Homo sapiens
cgtgcattggaagaccccaccc

SEQ ID NO: 824106 - DNA, 23 bp, Homo sapiens
cgtgcatttgaggggccaggggc

SEQ ID NO: 824107 - DNA, 15 bp, Homo sapiens
cgtgccaccccgagg

SEQ ID NO: 824108 - DNA, 17 bp, Homo sapiens
cgtgccagatataactg

SEQ ID NO: 824109 - DNA, 22 bp, Homo sapiens
cgtgccagatataactgtcttg

SEQ ID NO: 824110 - DNA, 16 bp, Homo sapiens
cgtgccagcagcctcg

SEQ ID NO: 824111 - DNA, 19 bp, Homo sapiens
cgtgccagcagcctcgcac

SEQ ID NO: 824112 - DNA, 19 bp, Homo sapiens
cgtgccaggcccggggctg

SEQ ID NO: 824113 - DNA, 16 bp, Homo sapiens
cgtgccatgatctgta

SEQ ID NO: 824114 - DNA, 19 bp, Homo sapiens
cgtgccattgtactccagc

SEQ ID NO: 824115 - DNA, 14 bp, Homo sapiens
cgtgcccaggccct

SEQ ID NO: 824116 - DNA, 13 bp, Homo sapiens
cgtgcccccagag

SEQ ID NO: 824117 - DNA, 14 bp, Homo sapiens
cgtgcccccagagt

SEQ ID NO: 824118 - DNA, 16 bp, Homo sapiens
cgtgcccccctcctcc

SEQ ID NO: 824119 - DNA, 20 bp, Homo sapiens
cgtgcccctttccttcactg

SEQ ID NO: 824120 - DNA, 23 bp, Homo sapiens
cgtgcccctttccttcactgccc

SEQ ID NO: 824121 - DNA, 15 bp, Homo sapiens
cgtgcccgcaggaac

SEQ ID NO: 824122 - DNA, 14 bp, Homo sapiens
cgtgcccggggcag

SEQ ID NO: 824123 - DNA, 16 bp, Homo sapiens
cgtgcccggggcagca

SEQ ID NO: 824124 - DNA, 21 bp, Homo sapiens
cgtgccctggaggctgacaca

SEQ ID NO: 824125 - DNA, 15 bp, Homo sapiens
cgtgccgcctgctcc

SEQ ID NO: 824126 - DNA, 21 bp, Homo sapiens
cgtgccggcggcagccccact

SEQ ID NO: 824127 - DNA, 18 bp, Homo sapiens
cgtgcctccaccaccact

SEQ ID NO: 824128 - DNA, 20 bp, Homo sapiens
cgtgcctccaccaccactgg

SEQ ID NO: 824129 - DNA, 21 bp, Homo sapiens
cgtgcctccaccaccactggc

SEQ ID NO: 824130 - DNA, 20 bp, Homo sapiens
cgtgcctccttccacctccc

SEQ ID NO: 824131 - DNA, 15 bp, Homo sapiens
cgtgcctggccagat

SEQ ID NO: 824132 - DNA, 22 bp, Homo sapiens
cgtgcctgggcccctcccctca

SEQ ID NO: 824133 - DNA, 17 bp, Homo sapiens
cgtgcctgggggagaga

SEQ ID NO: 824134 - DNA, 12 bp, Homo sapiens
cgtgcctgtgtc

SEQ ID NO: 824135 - DNA, 17 bp, Homo sapiens
cgtgccttttgcacccc

SEQ ID NO: 824136 - DNA, 20 bp, Homo sapiens
cgtgccttttgcacccctcc

SEQ ID NO: 824137 - DNA, 19 bp, Homo sapiens
cgtgcgtgttagtgtgtgt

SEQ ID NO: 824138 - DNA, 14 bp, Homo sapiens
cgtgctaaattttc

SEQ ID NO: 824139 - DNA, 17 bp, Homo sapiens
cgtgctactgcactcca

SEQ ID NO: 824140 - DNA, 15 bp, Homo sapiens
cgtgctgacatcaga

SEQ ID NO: 824141 - DNA, 12 bp, Homo sapiens
cgtgctggagga

SEQ ID NO: 824142 - DNA, 13 bp, Homo sapiens
cgtgctggaggaa

SEQ ID NO: 824143 - DNA, 13 bp, Homo sapiens
cgtgctggccttg

SEQ ID NO: 824144 - DNA, 16 bp, Homo sapiens
cgtgctggcgacactc

SEQ ID NO: 824145 - DNA, 19 bp, Homo sapiens
cgtgctggcgacactcagg

SEQ ID NO: 824146 - DNA, 12 bp, Homo sapiens
cgtgctgggcag

SEQ ID NO: 824147 - DNA, 18 bp, Homo sapiens
cgtgctgtgggcctcagg

SEQ ID NO: 824148 - DNA, 21 bp, Homo sapiens
cgtggaaagggtgctgcttcc

SEQ ID NO: 824149 - DNA, 23 bp, Homo sapiens
cgtggaacattctggatctgacc

SEQ ID NO: 824150 - DNA, 17 bp, Homo sapiens
cgtggaacctctgtctc

SEQ ID NO: 824151 - DNA, 15 bp, Homo sapiens
cgtggaacgtttttc

SEQ ID NO: 824152 - DNA, 13 bp, Homo sapiens
cgtggacagcgct

SEQ ID NO: 824153 - DNA, 15 bp, Homo sapiens
cgtggacagcgctgt

SEQ ID NO: 824154 - DNA, 14 bp, Homo sapiens
cgtggaccacctag

SEQ ID NO: 824155 - DNA, 14 bp, Homo sapiens
cgtggaccttcctg

SEQ ID NO: 824156 - DNA, 14 bp, Homo sapiens
cgtggactgtgctg

SEQ ID NO: 824157 - DNA, 20 bp, Homo sapiens
cgtggagagctggtgcccgg

SEQ ID NO: 824158 - DNA, 13 bp, Homo sapiens
cgtggagatagtg

SEQ ID NO: 824159 - DNA, 15 bp, Homo sapiens
cgtggagatagtgcc

SEQ ID NO: 824160 - DNA, 18 bp, Homo sapiens
cgtggagatagtgccagg

SEQ ID NO: 824161 - DNA, 14 bp, Homo sapiens
cgtggagctcgccc

SEQ ID NO: 824162 - DNA, 21 bp, Homo sapiens
cgtggagctcgcccctcccct

SEQ ID NO: 824163 - DNA, 22 bp, Homo sapiens
cgtggaggaatgctcccccatc

SEQ ID NO: 824164 - DNA, 16 bp, Homo sapiens
cgtggaggagaggaga

SEQ ID NO: 824165 - DNA, 23 bp, Homo sapiens
cgtggaggttctgtattttaaga

SEQ ID NO: 824166 - DNA, 20 bp, Homo sapiens
cgtggatcgagtgtagctgt

SEQ ID NO: 824167 - DNA, 22 bp, Homo sapiens
cgtggatcgagtgtagctgtga

SEQ ID NO: 824168 - DNA, 23 bp, Homo sapiens
cgtggatcgagtgtagctgtgaa

SEQ ID NO: 824169 - DNA, 18 bp, Homo sapiens
cgtggcacagctgggagc

SEQ ID NO: 824170 - DNA, 18 bp, Homo sapiens
cgttctcaagaatctaga

SEQ ID NO: 824171 - DNA, 12 bp, Homo sapiens
cgttctcccagc

SEQ ID NO: 824172 - DNA, 13 bp, Homo sapiens
cgttctccttccc

SEQ ID NO: 824173 - DNA, 19 bp, Homo sapiens
cgttctctctttgcatgga

SEQ ID NO: 824174 - DNA, 16 bp, Homo sapiens
cgttctctgtcctact

SEQ ID NO: 824175 - DNA, 17 bp, Homo sapiens
cgttctctgtcctactt

SEQ ID NO: 824176 - DNA, 17 bp, Homo sapiens
cgttctgatttctgccc

SEQ ID NO: 824177 - DNA, 16 bp, Homo sapiens
cgttcttacaagctta

SEQ ID NO: 824178 - DNA, 15 bp, Homo sapiens
cgttcttgtaatttt

SEQ ID NO: 824179 - DNA, 18 bp, Homo sapiens
cgttgaagaggaagggca

SEQ ID NO: 824180 - DNA, 16 bp, Homo sapiens
cgttgaatctgggagg

SEQ ID NO: 824181 - DNA, 19 bp, Homo sapiens
cgttgaggatgaggccgct

SEQ ID NO: 824182 - DNA, 12 bp, Homo sapiens
cgttgccagggg

SEQ ID NO: 824183 - DNA, 14 bp, Homo sapiens
cgttgccgcagcgg

SEQ ID NO: 824184 - DNA, 18 bp, Homo sapiens
cgttggacttttcgttaa

SEQ ID NO: 824185 - DNA, 23 bp, Homo sapiens
cgttggacttttcgttaacattg

SEQ ID NO: 824186 - DNA, 16 bp, Homo sapiens
cgttggagaagcccgt

SEQ ID NO: 824187 - DNA, 11 bp, Homo sapiens
cgttggagcca

SEQ ID NO: 824188 - DNA, 12 bp, Homo sapiens
cgttggagccac

SEQ ID NO: 824189 - DNA, 13 bp, Homo sapiens
cgttggagccact

SEQ ID NO: 824190 - DNA, 20 bp, Homo sapiens
cgttggagccactcctgtcc

SEQ ID NO: 824191 - DNA, 20 bp, Homo sapiens
cgttggtagagccctcagaa

SEQ ID NO: 824192 - DNA, 14 bp, Homo sapiens
cgttggtttgtgtt

SEQ ID NO: 824193 - DNA, 24 bp, Homo sapiens
cgttgtaaaatatagctgtacaaa

SEQ ID NO: 824194 - DNA, 20 bp, Homo sapiens
cgttgtattcaccccacacc

SEQ ID NO: 824195 - DNA, 17 bp, Homo sapiens
cgttgtctgtggatggt

SEQ ID NO: 824196 - DNA, 18 bp, Homo sapiens
cgttgtgttttttaagat

SEQ ID NO: 824197 - DNA, 20 bp, Homo sapiens
cgttgttgcatgtttgaaat

SEQ ID NO: 824198 - DNA, 22 bp, Homo sapiens
cgtttaagccaaaacaatgttt

SEQ ID NO: 824199 - DNA, 21 bp, Homo sapiens
cgtttaaggtgagcataaatc

SEQ ID NO: 824200 - DNA, 23 bp, Homo sapiens
cgtttactttttaactggcttca

SEQ ID NO: 824201 - DNA, 19 bp, Homo sapiens
cgtttagtttctagaggcc

SEQ ID NO: 824202 - DNA, 23 bp, Homo sapiens
cgtttcaggaacgttgccacacc

SEQ ID NO: 824203 - DNA, 22 bp, Homo sapiens
cgtttcatttagtcatgtgacc

SEQ ID NO: 824204 - DNA, 15 bp, Homo sapiens
cgtttccatcatgtc

SEQ ID NO: 824205 - DNA, 20 bp, Homo sapiens
cgtttcctgagaagtgtcta

SEQ ID NO: 824206 - DNA, 22 bp, Homo sapiens
cgtttctccacctagactgtaa

SEQ ID NO: 824207 - DNA, 20 bp, Homo sapiens
cgtttctgtgtagaaactgg

SEQ ID NO: 824208 - DNA, 12 bp, Homo sapiens
cgtttcttccct

SEQ ID NO: 824209 - DNA, 13 bp, Homo sapiens
cgtttcttccctg

SEQ ID NO: 824210 - DNA, 12 bp, Homo sapiens
cgtttgcctcct

SEQ ID NO: 824211 - DNA, 19 bp, Homo sapiens
cgtttgctgtgccaggagg

SEQ ID NO: 824212 - DNA, 15 bp, Homo sapiens
cgtttggggccctct

SEQ ID NO: 824213 - DNA, 16 bp, Homo sapiens
cgtttggggccctcta

SEQ ID NO: 824214 - DNA, 18 bp, Homo sapiens
cgtttggggccctctatg

SEQ ID NO: 824215 - DNA, 18 bp, Homo sapiens
cgtttgtgaacgctgtga

SEQ ID NO: 824216 - DNA, 20 bp, Homo sapiens
cgtttgtgaacgctgtgatg

SEQ ID NO: 824217 - DNA, 23 bp, Homo sapiens
cgtttgtgcatatctgcctcccc

SEQ ID NO: 824218 - DNA, 12 bp, Homo sapiens
cgttttattgtg

SEQ ID NO: 824219 - DNA, 14 bp, Homo sapiens
cgttttattgtgtt

SEQ ID NO: 824220 - DNA, 18 bp, Homo sapiens
cgttttattgtgttttta

SEQ ID NO: 824221 - DNA, 17 bp, Homo sapiens
cgttttcctcatccttt

SEQ ID NO: 824222 - DNA, 23 bp, Homo sapiens
cgttttcttctttccctggacag

SEQ ID NO: 824223 - DNA, 13 bp, Homo sapiens
cgttttctttatc

SEQ ID NO: 824224 - DNA, 12 bp, Homo sapiens
cgttttgtatag

SEQ ID NO: 824225 - DNA, 11 bp, Homo sapiens
cgttttgtcac

SEQ ID NO: 824226 - DNA, 19 bp, Homo sapiens
cgttttgtgtatatttgct

SEQ ID NO: 824227 - DNA, 22 bp, Homo sapiens
cgtttttagctttgtgtttact

SEQ ID NO: 824228 - DNA, 15 bp, Homo sapiens
cgtttttatattact

SEQ ID NO: 824229 - DNA, 20 bp, Homo sapiens
cgttttttacacgagatttc

SEQ ID NO: 824230 - DNA, 16 bp, Homo sapiens
cgttttttcctcagtg

SEQ ID NO: 824231 - DNA, 21 bp, Homo sapiens
cgtttttttggtcactccagt

SEQ ID NO: 824232 - DNA, 19 bp, Homo sapiens
ctaaaaaaaaaaaggccgc

SEQ ID NO: 824233 - DNA, 14 bp, Homo sapiens
ctaaaaaaaagatg

SEQ ID NO: 824234 - DNA, 11 bp, Homo sapiens
ctaaaaaagat

SEQ ID NO: 824235 - DNA, 22 bp, Homo sapiens
ctaaaaaagatatattaaaaat

SEQ ID NO: 824236 - DNA, 20 bp, Homo sapiens
ctaaaaaagctgaatcagac

SEQ ID NO: 824237 - DNA, 11 bp, Homo sapiens
ctaaaaataaa

SEQ ID NO: 824238 - DNA, 14 bp, Homo sapiens
ctaaaaataaatta

SEQ ID NO: 824239 - DNA, 15 bp, Homo sapiens
ctaaaaataaattaa

SEQ ID NO: 824240 - DNA, 15 bp, Homo sapiens
ctaaaaatatagcaa

SEQ ID NO: 824241 - DNA, 20 bp, Homo sapiens
ctaaaaatatagcaaatgca

SEQ ID NO: 824242 - DNA, 22 bp, Homo sapiens
ctaaaaatattataacttaaaa

SEQ ID NO: 824243 - DNA, 22 bp, Homo sapiens
ctaaaaatggctaactgatgaa

SEQ ID NO: 824244 - DNA, 15 bp, Homo sapiens
ctaaaaattgataga

SEQ ID NO: 824245 - DNA, 17 bp, Homo sapiens
ctaaaacaaaatctgaa

SEQ ID NO: 824246 - DNA, 18 bp, Homo sapiens
ctaaaacaaaatctgaac

SEQ ID NO: 824247 - DNA, 11 bp, Homo sapiens
ctaaaaccatt

SEQ ID NO: 824248 - DNA, 13 bp, Homo sapiens
ctaaaactatggt

SEQ ID NO: 824249 - DNA, 17 bp, Homo sapiens
ctaaaactctttcggta

SEQ ID NO: 824250 - DNA, 16 bp, Homo sapiens
ctaaaacttggatgga

SEQ ID NO: 824251 - DNA, 20 bp, Homo sapiens
ctaaaacttggatggacttg

SEQ ID NO: 824252 - DNA, 13 bp, Homo sapiens
ctaaaagaaactt

SEQ ID NO: 824253 - DNA, 19 bp, Homo sapiens
ctaaaagagatctgggcat

SEQ ID NO: 824254 - DNA, 12 bp, Homo sapiens
ctaaaagcacac

SEQ ID NO: 824255 - DNA, 15 bp, Homo sapiens
ctaaaagtaaacatt

SEQ ID NO: 824256 - DNA, 16 bp, Homo sapiens
ctaaaagtgcatttaa

SEQ ID NO: 824257 - DNA, 17 bp, Homo sapiens
ctaaaagtgcatttaag

SEQ ID NO: 824258 - DNA, 23 bp, Homo sapiens
ctaaaagtgggcttgattctgca

SEQ ID NO: 824259 - DNA, 16 bp, Homo sapiens
ctaaaagttttctaat

SEQ ID NO: 824260 - DNA, 22 bp, Homo sapiens
ctaaaagttttctaatttgcac

SEQ ID NO: 824261 - DNA, 15 bp, Homo sapiens
ctaaaataattttgt

SEQ ID NO: 824262 - DNA, 14 bp, Homo sapiens
ctaaaatatttatt

SEQ ID NO: 824263 - DNA, 12 bp, Homo sapiens
ctaaaatgattg

SEQ ID NO: 824264 - DNA, 23 bp, Homo sapiens
ctaaaatgattttatctgtgaat

SEQ ID NO: 824265 - DNA, 18 bp, Homo sapiens
ctaaaatggacattttct

SEQ ID NO: 824266 - DNA, 13 bp, Homo sapiens
ctaaaatgtatct

SEQ ID NO: 824267 - DNA, 17 bp, Homo sapiens
ctaaaatgtttattcct

SEQ ID NO: 824268 - DNA, 21 bp, Homo sapiens
ctaaaattgttctcttaaata

SEQ ID NO: 824269 - DNA, 13 bp, Homo sapiens
ctaaaatttcata

SEQ ID NO: 824270 - DNA, 20 bp, Homo sapiens
ctaaaatttcataattctga

SEQ ID NO: 824271 - DNA, 23 bp, Homo sapiens
ctaaaatttcataattctgaaac

SEQ ID NO: 824272 - DNA, 16 bp, Homo sapiens
ctaaacagatgtaatg

SEQ ID NO: 824273 - DNA, 12 bp, Homo sapiens
ctaaacataatt

SEQ ID NO: 824274 - DNA, 23 bp, Homo sapiens
ctaaacatcattcatttttgttg

SEQ ID NO: 824275 - DNA, 13 bp, Homo sapiens
ctaaaccaaaaca

SEQ ID NO: 824276 - DNA, 16 bp, Homo sapiens
ctaaaccaaggactga

SEQ ID NO: 824277 - DNA, 15 bp, Homo sapiens
ctaaacccaatccaa

SEQ ID NO: 824278 - DNA, 12 bp, Homo sapiens
ctaaacccaatg

SEQ ID NO: 824279 - DNA, 14 bp, Homo sapiens
ctaaacccaatgac

SEQ ID NO: 824280 - DNA, 19 bp, Homo sapiens
ctaaaccccagattcttca

SEQ ID NO: 824281 - DNA, 15 bp, Homo sapiens
ctaaacggttcagtt

SEQ ID NO: 824282 - DNA, 20 bp, Homo sapiens
ctaaacggttcagtttcttc

SEQ ID NO: 824283 - DNA, 17 bp, Homo sapiens
ctaaacgtggtcacctt

SEQ ID NO: 824284 - DNA, 22 bp, Homo sapiens
ctaaactcaagatttgaccaaa

SEQ ID NO: 824285 - DNA, 18 bp, Homo sapiens
ctaaactccaggatttat

SEQ ID NO: 824286 - DNA, 20 bp, Homo sapiens
ctaaactgaatctatggctt

SEQ ID NO: 824287 - DNA, 13 bp, Homo sapiens
ctaaactgcagcc

SEQ ID NO: 824288 - DNA, 19 bp, Homo sapiens
ctaaactggtgtttttccc

SEQ ID NO: 824289 - DNA, 16 bp, Homo sapiens
ctaaacttccccatct

SEQ ID NO: 824290 - DNA, 13 bp, Homo sapiens
ctaaactttattt

SEQ ID NO: 824291 - DNA, 23 bp, Homo sapiens
ctaaactttatttgtaaaccatt

SEQ ID NO: 824292 - DNA, 14 bp, Homo sapiens
ctaattctatttct

SEQ ID NO: 824293 - DNA, 16 bp, Homo sapiens
ctaattctatttctct

SEQ ID NO: 824294 - DNA, 17 bp, Homo sapiens
ctaattctatttctcta

SEQ ID NO: 824295 - DNA, 15 bp, Homo sapiens
ctaattctgggaagg

SEQ ID NO: 824296 - DNA, 12 bp, Homo sapiens
ctaattgacttt

SEQ ID NO: 824297 - DNA, 13 bp, Homo sapiens
ctaattgacttta

SEQ ID NO: 824298 - DNA, 17 bp, Homo sapiens
ctaattgactttagaaa

SEQ ID NO: 824299 - DNA, 20 bp, Homo sapiens
ctaattgactttagaaagct

SEQ ID NO: 824300 - DNA, 16 bp, Homo sapiens
ctaattgcatctcaaa

SEQ ID NO: 824301 - DNA, 20 bp, Homo sapiens
ctaattgcatctcaaaatta

SEQ ID NO: 824302 - DNA, 22 bp, Homo sapiens
ctaattggaagaaattcctgta

SEQ ID NO: 824303 - DNA, 15 bp, Homo sapiens
ctaattggaagaaga

SEQ ID NO: 824304 - DNA, 18 bp, Homo sapiens
ctaattgtaagtgaaatt

SEQ ID NO: 824305 - DNA, 14 bp, Homo sapiens
ctaatttataaaaa

SEQ ID NO: 824306 - DNA, 15 bp, Homo sapiens
ctaatttatgtgcta

SEQ ID NO: 824307 - DNA, 19 bp, Homo sapiens
ctaatttcaaaatgctttt

SEQ ID NO: 824308 - DNA, 15 bp, Homo sapiens
ctaatttcttcttta

SEQ ID NO: 824309 - DNA, 15 bp, Homo sapiens
ctaatttgatgttta

SEQ ID NO: 824310 - DNA, 13 bp, Homo sapiens
ctaatttgcatta

SEQ ID NO: 824311 - DNA, 14 bp, Homo sapiens
ctaatttgcattaa

SEQ ID NO: 824312 - DNA, 20 bp, Homo sapiens
ctaattttacatgtttataa

SEQ ID NO: 824313 - DNA, 15 bp, Homo sapiens
ctaattttagtattc

SEQ ID NO: 824314 - DNA, 17 bp, Homo sapiens
ctaattttagtattcat

SEQ ID NO: 824315 - DNA, 15 bp, Homo sapiens
ctaattttggatgga

SEQ ID NO: 824316 - DNA, 15 bp, Homo sapiens
ctaattttgtacgta

SEQ ID NO: 824317 - DNA, 23 bp, Homo sapiens
ctaattttgtacgtatgaatgat

SEQ ID NO: 824318 - DNA, 22 bp, Homo sapiens
ctaatttttaagaattgagtaa

SEQ ID NO: 824319 - DNA, 18 bp, Homo sapiens
ctaatttttatttttgct

SEQ ID NO: 824320 - DNA, 21 bp, Homo sapiens
ctaatttttatttttgctgag

SEQ ID NO: 824321 - DNA, 12 bp, Homo sapiens
ctaatttttcca

SEQ ID NO: 824322 - DNA, 19 bp, Homo sapiens
ctaatttttggtgctgatt

SEQ ID NO: 824323 - DNA, 15 bp, Homo sapiens
ctaatttttgtattt

SEQ ID NO: 824324 - DNA, 16 bp, Homo sapiens
ctaatttttgtatttt

SEQ ID NO: 824325 - DNA, 17 bp, Homo sapiens
ctaattttttgtacttt

SEQ ID NO: 824326 - DNA, 18 bp, Homo sapiens
ctaatttttttttgtagt

SEQ ID NO: 824327 - DNA, 10 bp, Homo sapiens
ctacaaaaac

SEQ ID NO: 824328 - DNA, 13 bp, Homo sapiens
ctacaaaagtgaa

SEQ ID NO: 824329 - DNA, 17 bp, Homo sapiens
ctacaaaatttgaaatt

SEQ ID NO: 824330 - DNA, 21 bp, Homo sapiens
ctacaaacaaaagcagccctc

SEQ ID NO: 824331 - DNA, 17 bp, Homo sapiens
ctacaaatttatgcatt

SEQ ID NO: 824332 - DNA, 18 bp, Homo sapiens
ctacaaatttatgcattt

SEQ ID NO: 824333 - DNA, 16 bp, Homo sapiens
ctacaacaagagttta

SEQ ID NO: 824334 - DNA, 13 bp, Homo sapiens
ctacaaccaagct

SEQ ID NO: 824335 - DNA, 14 bp, Homo sapiens
ctacaacttcagca

SEQ ID NO: 824336 - DNA, 18 bp, Homo sapiens
ctacaagagcagcctgtg

SEQ ID NO: 824337 - DNA, 21 bp, Homo sapiens
ctacaagagcagcctgtggca

SEQ ID NO: 824338 - DNA, 22 bp, Homo sapiens
ctacaagagcagcctgtggcat

SEQ ID NO: 824339 - DNA, 15 bp, Homo sapiens
ctacaagatttagaa

SEQ ID NO: 824340 - DNA, 12 bp, Homo sapiens
ctacaagatttc

SEQ ID NO: 824341 - DNA, 19 bp, Homo sapiens
ctacaagatttccttaaaa

SEQ ID NO: 824342 - DNA, 22 bp, Homo sapiens
ctacaagccaaaagtccctccc

SEQ ID NO: 824343 - DNA, 19 bp, Homo sapiens
ctacaagctaaaattagat

SEQ ID NO: 824344 - DNA, 22 bp, Homo sapiens
ctacaaggtaggctgcaaaatt

SEQ ID NO: 824345 - DNA, 15 bp, Homo sapiens
ctacaataaaaagaa

SEQ ID NO: 824346 - DNA, 19 bp, Homo sapiens
ctacaatcagttgacttta

SEQ ID NO: 824347 - DNA, 11 bp, Homo sapiens
ctacaatcatg

SEQ ID NO: 824348 - DNA, 22 bp, Homo sapiens
ctacaatttgttaattcctatg

SEQ ID NO: 824349 - DNA, 21 bp, Homo sapiens
ctacaatttgtttttgcattt

SEQ ID NO: 824350 - DNA, 22 bp, Homo sapiens
ctacaatttgtttttgcatttt

SEQ ID NO: 824351 - DNA, 22 bp, Homo sapiens
ctacacacagatgacaaattat

SEQ ID NO: 824352 - DNA, 12 bp, Homo sapiens
ctacacaccctg

SEQ ID NO: 824353 - DNA, 18 bp, Homo sapiens
ctacacagacattaagaa

SEQ ID NO: 824354 - DNA, 17 bp, Homo sapiens
ctacacaggagtcttca

SEQ ID NO: 824355 - DNA, 21 bp, Homo sapiens
ctacacaggggccctgtacag

SEQ ID NO: 824356 - DNA, 17 bp, Homo sapiens
ctacacccctgtgctcc

SEQ ID NO: 824357 - DNA, 16 bp, Homo sapiens
ctacacccttttccag

SEQ ID NO: 824358 - DNA, 12 bp, Homo sapiens
ctacacctggct

SEQ ID NO: 824359 - DNA, 15 bp, Homo sapiens
ctacactcacctgca

SEQ ID NO: 824360 - DNA, 13 bp, Homo sapiens
ctacactgaggag

SEQ ID NO: 824361 - DNA, 23 bp, Homo sapiens
ctacacttcgcaccggagtgtct

SEQ ID NO: 824362 - DNA, 22 bp, Homo sapiens
ctacagaaaaacaatggtaaca

SEQ ID NO: 824363 - DNA, 20 bp, Homo sapiens
ctacagaaataacagctggg

SEQ ID NO: 824364 - DNA, 22 bp, Homo sapiens
ctacagaaatactgctctgaat

SEQ ID NO: 824365 - DNA, 17 bp, Homo sapiens
ctacagaacctgagggc

SEQ ID NO: 824366 - DNA, 13 bp, Homo sapiens
ctacagaataatc

SEQ ID NO: 824367 - DNA, 17 bp, Homo sapiens
ctacagaataatgtgtt

SEQ ID NO: 824368 - DNA, 17 bp, Homo sapiens
ctacagacattaaataa

SEQ ID NO: 824369 - DNA, 19 bp, Homo sapiens
ctacagacattaaataatc

SEQ ID NO: 824370 - DNA, 11 bp, Homo sapiens
ctacagagaaa

SEQ ID NO: 824371 - DNA, 18 bp, Homo sapiens
ctacagagcttccctgac

SEQ ID NO: 824372 - DNA, 14 bp, Homo sapiens
ctacagatgagtca

SEQ ID NO: 824373 - DNA, 19 bp, Homo sapiens
ctacagctaatcagcattc

SEQ ID NO: 824374 - DNA, 22 bp, Homo sapiens
ctacagctaatcagcattctca

SEQ ID NO: 824375 - DNA, 11 bp, Homo sapiens
ctacagctctt

SEQ ID NO: 824376 - DNA, 18 bp, Homo sapiens
ctacaggagagggaagag

SEQ ID NO: 824377 - DNA, 18 bp, Homo sapiens
ctacaggcctcttcctgt

SEQ ID NO: 824378 - DNA, 22 bp, Homo sapiens
ctacaggggaaggtggcctctg

SEQ ID NO: 824379 - DNA, 17 bp, Homo sapiens
ctacaggtcaagaaata

SEQ ID NO: 824380 - DNA, 22 bp, Homo sapiens
ctacaggtgaaggctctcaccc

SEQ ID NO: 824381 - DNA, 16 bp, Homo sapiens
ctacagtaatgaaatg

SEQ ID NO: 824382 - DNA, 14 bp, Homo sapiens
ctacagtcaggaaa

SEQ ID NO: 824383 - DNA, 15 bp, Homo sapiens
ctacagtgactccct

SEQ ID NO: 824384 - DNA, 20 bp, Homo sapiens
ctacagtgactccctgggag

SEQ ID NO: 824385 - DNA, 11 bp, Homo sapiens
ctacagtgcca

SEQ ID NO: 824386 - DNA, 12 bp, Homo sapiens
ctacagtgccaa

SEQ ID NO: 824387 - DNA, 18 bp, Homo sapiens
ctacagtgccaactcctc

SEQ ID NO: 824388 - DNA, 15 bp, Homo sapiens
ctacagtgtacagtc

SEQ ID NO: 824389 - DNA, 17 bp, Homo sapiens
ctacagtgtacagtctt

SEQ ID NO: 824390 - DNA, 23 bp, Homo sapiens
ctacagttagggttgagttactt

SEQ ID NO: 824391 - DNA, 21 bp, Homo sapiens
ctacagttatgttcagtcaca

SEQ ID NO: 824392 - DNA, 23 bp, Homo sapiens
ctacagttcacagaggtctttca

SEQ ID NO: 824393 - DNA, 20 bp, Homo sapiens
ctacagttgttttttgaaaa

SEQ ID NO: 824394 - DNA, 19 bp, Homo sapiens
ctacagttttaactgtgga

SEQ ID NO: 824395 - DNA, 12 bp, Homo sapiens
ctacataaactg

SEQ ID NO: 824396 - DNA, 18 bp, Homo sapiens
ctacataaactgacttta

SEQ ID NO: 824397 - DNA, 18 bp, Homo sapiens
ctacatacaattccaaac

SEQ ID NO: 824398 - DNA, 16 bp, Homo sapiens
ctacatatgatctgtc

SEQ ID NO: 824399 - DNA, 19 bp, Homo sapiens
ctacatccagctcctctag

SEQ ID NO: 824400 - DNA, 14 bp, Homo sapiens
ctacatcttctgcc

SEQ ID NO: 824401 - DNA, 15 bp, Homo sapiens
ctacatcttctgcct

SEQ ID NO: 824402 - DNA, 16 bp, Homo sapiens
ctacatgactgggcct

SEQ ID NO: 824403 - DNA, 13 bp, Homo sapiens
ctacatgagaaca

SEQ ID NO: 824404 - DNA, 14 bp, Homo sapiens
ctacatgagaacaa

SEQ ID NO: 824405 - DNA, 17 bp, Homo sapiens
ctacatgagaacaaaca

SEQ ID NO: 824406 - DNA, 17 bp, Homo sapiens
ctacatgatgctaaagg

SEQ ID NO: 824407 - DNA, 23 bp, Homo sapiens
ctacatgcagcccatgcccacct

SEQ ID NO: 824408 - DNA, 14 bp, Homo sapiens
ctacatgctgaaaa

SEQ ID NO: 824409 - DNA, 16 bp, Homo sapiens
ctacatgctgaaaaat

SEQ ID NO: 824410 - DNA, 20 bp, Homo sapiens
ctacatggagtatatgtcaa

SEQ ID NO: 824411 - DNA, 18 bp, Homo sapiens
ctacatgtattgcacatt

SEQ ID NO: 824412 - DNA, 13 bp, Homo sapiens
ctacattaaacaa

SEQ ID NO: 824413 - DNA, 18 bp, Homo sapiens
ctacattccccagagtgg

SEQ ID NO: 824414 - DNA, 19 bp, Homo sapiens
ctactacccgagcccagct

SEQ ID NO: 824415 - DNA, 18 bp, Homo sapiens
ctactaggagaggggggc

SEQ ID NO: 824416 - DNA, 14 bp, Homo sapiens
ctactatgatcaga

SEQ ID NO: 824417 - DNA, 13 bp, Homo sapiens
ctactcaaagcat

SEQ ID NO: 824418 - DNA, 15 bp, Homo sapiens
ctactcacagtctct

SEQ ID NO: 824419 - DNA, 21 bp, Homo sapiens
ctactcagaaatggacaaaga

SEQ ID NO: 824420 - DNA, 22 bp, Homo sapiens
ctactcagatgaccccagaaac

SEQ ID NO: 824421 - DNA, 17 bp, Homo sapiens
ctactcagcatttgatt

SEQ ID NO: 824422 - DNA, 15 bp, Homo sapiens
ctactcaggaggctg

SEQ ID NO: 824423 - DNA, 16 bp, Homo sapiens
ctactcaggaggctga

SEQ ID NO: 824424 - DNA, 13 bp, Homo sapiens
ctactccactgcc

SEQ ID NO: 824425 - DNA, 17 bp, Homo sapiens
ctactccactgccctgg

SEQ ID NO: 824426 - DNA, 18 bp, Homo sapiens
ctactccactgccctggc

SEQ ID NO: 824427 - DNA, 19 bp, Homo sapiens
ctactccactgccctggca

SEQ ID NO: 824428 - DNA, 23 bp, Homo sapiens
ctactccctccaattccccctta

SEQ ID NO: 824429 - DNA, 16 bp, Homo sapiens
ctactccctcttcact

SEQ ID NO: 824430 - DNA, 17 bp, Homo sapiens
ctactccctcttccaaa

SEQ ID NO: 824431 - DNA, 16 bp, Homo sapiens
ctactccgttcctggc

SEQ ID NO: 824432 - DNA, 17 bp, Homo sapiens
ctactcctacctcagcc

SEQ ID NO: 824433 - DNA, 18 bp, Homo sapiens
ctactcctacctcagcct

SEQ ID NO: 824434 - DNA, 14 bp, Homo sapiens
ctactcctctgcag

SEQ ID NO: 824435 - DNA, 16 bp, Homo sapiens
ctactcctgtgctctg

SEQ ID NO: 824436 - DNA, 17 bp, Homo sapiens
ctactctagttctgttg

SEQ ID NO: 824437 - DNA, 21 bp, Homo sapiens
ctactctccccacgagggctg

SEQ ID NO: 824438 - DNA, 15 bp, Homo sapiens
ctactctgaagacct

SEQ ID NO: 824439 - DNA, 13 bp, Homo sapiens
ctactctgccaat

SEQ ID NO: 824440 - DNA, 13 bp, Homo sapiens
ctactctgtccag

SEQ ID NO: 824441 - DNA, 17 bp, Homo sapiens
ctactctgtccaggcca

SEQ ID NO: 824442 - DNA, 19 bp, Homo sapiens
ctactctgtccaggccact

SEQ ID NO: 824443 - DNA, 14 bp, Homo sapiens
ctactctgtgccag

SEQ ID NO: 824444 - DNA, 13 bp, Homo sapiens
ctactctgtgtaa

SEQ ID NO: 824445 - DNA, 15 bp, Homo sapiens
ctactctgttccttc

SEQ ID NO: 824446 - DNA, 16 bp, Homo sapiens
ctactcttcctgtcct

SEQ ID NO: 824447 - DNA, 15 bp, Homo sapiens
ctactcttgtcattt

SEQ ID NO: 824448 - DNA, 14 bp, Homo sapiens
ctactgaaccagcc

SEQ ID NO: 824449 - DNA, 15 bp, Homo sapiens
ctactgaaccagcca

SEQ ID NO: 824450 - DNA, 15 bp, Homo sapiens
ctactgaagtggctg

SEQ ID NO: 824451 - DNA, 20 bp, Homo sapiens
ctactgacatgtggggccag

SEQ ID NO: 824452 - DNA, 15 bp, Homo sapiens
ctactgacccaactg

SEQ ID NO: 824453 - DNA, 13 bp, Homo sapiens
ctactgagtaggc

SEQ ID NO: 824454 - DNA, 15 bp, Homo sapiens
ctactgcaaatggca

SEQ ID NO: 824455 - DNA, 18 bp, Homo sapiens
ctactgcactccagcctg

SEQ ID NO: 824456 - DNA, 15 bp, Homo sapiens
ctactgcactgagtt

SEQ ID NO: 824457 - DNA, 21 bp, Homo sapiens
ctactgcactttcccccttcc

SEQ ID NO: 824458 - DNA, 18 bp, Homo sapiens
ctactgcagcacctccag

SEQ ID NO: 824459 - DNA, 19 bp, Homo sapiens
ctactgcagcacctccagg

SEQ ID NO: 824460 - DNA, 20 bp, Homo sapiens
ctactgcagcacctccaggc

SEQ ID NO: 824461 - DNA, 14 bp, Homo sapiens
ctactgcagcttta

SEQ ID NO: 824462 - DNA, 22 bp, Homo sapiens
ctactgccaagggcaggaccaa

SEQ ID NO: 824463 - DNA, 22 bp, Homo sapiens
ctactgcccacatttgggctca

SEQ ID NO: 824464 - DNA, 15 bp, Homo sapiens
ctactgcccctctcc

SEQ ID NO: 824465 - DNA, 16 bp, Homo sapiens
ctactgcctttagaaa

SEQ ID NO: 824466 - DNA, 17 bp, Homo sapiens
ctactgctcctgtggca

SEQ ID NO: 824467 - DNA, 21 bp, Homo sapiens
ctactgctcctgtggcaggag

SEQ ID NO: 824468 - DNA, 15 bp, Homo sapiens
ctactggacgctgcc

SEQ ID NO: 824469 - DNA, 17 bp, Homo sapiens
ctactggacttgaatgg

SEQ ID NO: 824470 - DNA, 15 bp, Homo sapiens
ctactggattcttat

SEQ ID NO: 824471 - DNA, 12 bp, Homo sapiens
ctactggcagct

SEQ ID NO: 824472 - DNA, 16 bp, Homo sapiens
ctactggcagctcctc

SEQ ID NO: 824473 - DNA, 18 bp, Homo sapiens
ctactggggggctttggc

SEQ ID NO: 824474 - DNA, 18 bp, Homo sapiens
ctactgtaacttttttaa

SEQ ID NO: 824475 - DNA, 21 bp, Homo sapiens
ctactgtaatttgtgatacaa

SEQ ID NO: 824476 - DNA, 19 bp, Homo sapiens
ctactgtaattttatatga

SEQ ID NO: 824477 - DNA, 12 bp, Homo sapiens
ctactgtacatt

SEQ ID NO: 824478 - DNA, 21 bp, Homo sapiens
ctactgtactttgccattttt

SEQ ID NO: 824479 - DNA, 18 bp, Homo sapiens
ctactgtcaaatgatgtg

SEQ ID NO: 824480 - DNA, 13 bp, Homo sapiens
ctactgtcctgga

SEQ ID NO: 824481 - DNA, 20 bp, Homo sapiens
ctactgtctcctccctgggc

SEQ ID NO: 824482 - DNA, 21 bp, Homo sapiens
ctactgtctcctccctgggct

SEQ ID NO: 824483 - DNA, 13 bp, Homo sapiens
ctactgtgactga

SEQ ID NO: 824484 - DNA, 14 bp, Homo sapiens
ctactgtggggaga

SEQ ID NO: 824485 - DNA, 12 bp, Homo sapiens
ctactgtgttcc

SEQ ID NO: 824486 - DNA, 14 bp, Homo sapiens
ctactgtgttcctg

SEQ ID NO: 824487 - DNA, 21 bp, Homo sapiens
ctactgttactctaaatagaa

SEQ ID NO: 824488 - DNA, 18 bp, Homo sapiens
ctactgttgcacagccag

SEQ ID NO: 824489 - DNA, 14 bp, Homo sapiens
ctacttaatgtaat

SEQ ID NO: 824490 - DNA, 16 bp, Homo sapiens
ctacttagtaaaaatt

SEQ ID NO: 824491 - DNA, 13 bp, Homo sapiens
ctacttatcattt

SEQ ID NO: 824492 - DNA, 12 bp, Homo sapiens
ctacttcagctt

SEQ ID NO: 824493 - DNA, 16 bp, Homo sapiens
ctacttcatagctcct

SEQ ID NO: 824494 - DNA, 16 bp, Homo sapiens
ctacttccaaactaat

SEQ ID NO: 824495 - DNA, 19 bp, Homo sapiens
ctacttccaaactaatttt

SEQ ID NO: 824496 - DNA, 11 bp, Homo sapiens
ctacttcccct

SEQ ID NO: 824497 - DNA, 14 bp, Homo sapiens
ctacttcccctggg

SEQ ID NO: 824498 - DNA, 15 bp, Homo sapiens
ctacttcccctggga

SEQ ID NO: 824499 - DNA, 14 bp, Homo sapiens
ctacttccccttcc

SEQ ID NO: 824500 - DNA, 19 bp, Homo sapiens
ctacttcctcctccccact

SEQ ID NO: 824501 - DNA, 20 bp, Homo sapiens
ctacttcctgtgacttcagc

SEQ ID NO: 824502 - DNA, 12 bp, Homo sapiens
ctacttctctgt

SEQ ID NO: 824503 - DNA, 13 bp, Homo sapiens
ctacttctgactt

SEQ ID NO: 824504 - DNA, 15 bp, Homo sapiens
ctacttgagaggctg

SEQ ID NO: 824505 - DNA, 15 bp, Homo sapiens
ctacttgggagcctg

SEQ ID NO: 824506 - DNA, 12 bp, Homo sapiens
ctacttgggagg

SEQ ID NO: 824507 - DNA, 20 bp, Homo sapiens
ctacttgggaggctgaggca

SEQ ID NO: 824508 - DNA, 23 bp, Homo sapiens
ctacttggtggtttgcttgctct

SEQ ID NO: 824509 - DNA, 15 bp, Homo sapiens
ctactttaagcacta

SEQ ID NO: 824510 - DNA, 14 bp, Homo sapiens
ctactttataacta

SEQ ID NO: 824511 - DNA, 18 bp, Homo sapiens
ctactttataactaacat

SEQ ID NO: 824512 - DNA, 21 bp, Homo sapiens
ctactttcatcttaaactaat

SEQ ID NO: 824513 - DNA, 16 bp, Homo sapiens
ctactttctcctgaaa

SEQ ID NO: 824514 - DNA, 22 bp, Homo sapiens
ctactttgaaaacaattcagtg

SEQ ID NO: 824515 - DNA, 18 bp, Homo sapiens
ctactttgactttttgca

SEQ ID NO: 824516 - DNA, 21 bp, Homo sapiens
ctactttgatatgactgtttt

SEQ ID NO: 824517 - DNA, 16 bp, Homo sapiens
ctactttgattctgat

SEQ ID NO: 824518 - DNA, 16 bp, Homo sapiens
ctactttgcttccgcc

SEQ ID NO: 824519 - DNA, 17 bp, Homo sapiens
ctactttgtggcaatct

SEQ ID NO: 824520 - DNA, 20 bp, Homo sapiens
ctactttgttaggattttca

SEQ ID NO: 824521 - DNA, 21 bp, Homo sapiens
ctacttttagttgactcacag

SEQ ID NO: 824522 - DNA, 15 bp, Homo sapiens
ctacttttctttatt

SEQ ID NO: 824523 - DNA, 16 bp, Homo sapiens
ctactttttatactcc

SEQ ID NO: 824524 - DNA, 21 bp, Homo sapiens
ctactttttgaacttttcatt

SEQ ID NO: 824525 - DNA, 16 bp, Homo sapiens
ctactttttgtattta

SEQ ID NO: 824526 - DNA, 18 bp, Homo sapiens
ctacttttttatccacct

SEQ ID NO: 824527 - DNA, 21 bp, Homo sapiens
ctacttttttatccacctccc

SEQ ID NO: 824528 - DNA, 18 bp, Homo sapiens
ctagaaaaaaaaaacact

SEQ ID NO: 824529 - DNA, 22 bp, Homo sapiens
ctagaaaacttgactccatttc

SEQ ID NO: 824530 - DNA, 21 bp, Homo sapiens
ctagaaacccaagctcctcct

SEQ ID NO: 824531 - DNA, 23 bp, Homo sapiens
ctagaaacccaagctcctcctcg

SEQ ID NO: 824532 - DNA, 13 bp, Homo sapiens
ctagaaactctgg

SEQ ID NO: 824533 - DNA, 18 bp, Homo sapiens
ctagaaactctggctcag

SEQ ID NO: 824534 - DNA, 16 bp, Homo sapiens
ctagaaacttccaaat

SEQ ID NO: 824535 - DNA, 20 bp, Homo sapiens
ctagaaagccatattccagc

SEQ ID NO: 824536 - DNA, 13 bp, Homo sapiens
ctagaaaggagag

SEQ ID NO: 824537 - DNA, 19 bp, Homo sapiens
ctaggagatatctgaggga

SEQ ID NO: 824538 - DNA, 13 bp, Homo sapiens
ctaggagcactgt

SEQ ID NO: 824539 - DNA, 15 bp, Homo sapiens
ctaggagctgggagg

SEQ ID NO: 824540 - DNA, 16 bp, Homo sapiens
ctaggaggctggccaa

SEQ ID NO: 824541 - DNA, 23 bp, Homo sapiens
ctaggagggagacactggcccct

SEQ ID NO: 824542 - DNA, 19 bp, Homo sapiens
ctaggagggagccttgtga

SEQ ID NO: 824543 - DNA, 21 bp, Homo sapiens
ctaggagggagccttgtgaga

SEQ ID NO: 824544 - DNA, 19 bp, Homo sapiens
ctaggataaaaagccaggg

SEQ ID NO: 824545 - DNA, 22 bp, Homo sapiens
ctaggataacttgctttcttct

SEQ ID NO: 824546 - DNA, 23 bp, Homo sapiens
ctaggatgtatattttatataaa

SEQ ID NO: 824547 - DNA, 12 bp, Homo sapiens
ctaggcagcctg

SEQ ID NO: 824548 - DNA, 15 bp, Homo sapiens
ctaggcaggtaataa

SEQ ID NO: 824549 - DNA, 15 bp, Homo sapiens
ctaggcatcccaggg

SEQ ID NO: 824550 - DNA, 21 bp, Homo sapiens
ctaggcatgtcagaggacccc

SEQ ID NO: 824551 - DNA, 12 bp, Homo sapiens
ctaggcatttca

SEQ ID NO: 824552 - DNA, 22 bp, Homo sapiens
ctaggccaaatgcacaagctca

SEQ ID NO: 824553 - DNA, 13 bp, Homo sapiens
ctaggcccaggcc

SEQ ID NO: 824554 - DNA, 21 bp, Homo sapiens
ctaggcccattgtcctccttt

SEQ ID NO: 824555 - DNA, 15 bp, Homo sapiens
ctaggcccccacttg

SEQ ID NO: 824556 - DNA, 17 bp, Homo sapiens
ctaggcccccacttgcc

SEQ ID NO: 824557 - DNA, 19 bp, Homo sapiens
ctaggcccccacttgcctc

SEQ ID NO: 824558 - DNA, 23 bp, Homo sapiens
ctaggcccccacttgcctcttcc

SEQ ID NO: 824559 - DNA, 21 bp, Homo sapiens
ctaggccccccagaaagctgc

SEQ ID NO: 824560 - DNA, 12 bp, Homo sapiens
ctaggccgggcg

SEQ ID NO: 824561 - DNA, 16 bp, Homo sapiens
ctaggcctcagccaga

SEQ ID NO: 824562 - DNA, 15 bp, Homo sapiens
ctaggcctctccagt

SEQ ID NO: 824563 - DNA, 12 bp, Homo sapiens
ctaggcctgggg

SEQ ID NO: 824564 - DNA, 20 bp, Homo sapiens
ctaggctacaattttctccc

SEQ ID NO: 824565 - DNA, 13 bp, Homo sapiens
ctaggctccaccc

SEQ ID NO: 824566 - DNA, 17 bp, Homo sapiens
ctaggctcgccttccct

SEQ ID NO: 824567 - DNA, 22 bp, Homo sapiens
ctaggctcttatgtgtgccttt

SEQ ID NO: 824568 - DNA, 23 bp, Homo sapiens
ctaggctgttgaatcaaagtgat

SEQ ID NO: 824569 - DNA, 21 bp, Homo sapiens
ctaggcttcagcatatttata

SEQ ID NO: 824570 - DNA, 23 bp, Homo sapiens
ctaggcttcccaggctgggctct

SEQ ID NO: 824571 - DNA, 16 bp, Homo sapiens
ctagggaaatttttca

SEQ ID NO: 824572 - DNA, 13 bp, Homo sapiens
ctagggaattcct

SEQ ID NO: 824573 - DNA, 15 bp, Homo sapiens
ctagggagagaccct

SEQ ID NO: 824574 - DNA, 21 bp, Homo sapiens
ctagggaggaccttatctgtg

SEQ ID NO: 824575 - DNA, 16 bp, Homo sapiens
ctagggagtggtcttt

SEQ ID NO: 824576 - DNA, 13 bp, Homo sapiens
ctagggatccctc

SEQ ID NO: 824577 - DNA, 15 bp, Homo sapiens
ctagggattcaggct

SEQ ID NO: 824578 - DNA, 17 bp, Homo sapiens
ctagggattcaggctgc

SEQ ID NO: 824579 - DNA, 18 bp, Homo sapiens
ctagggcacaaagacttc

SEQ ID NO: 824580 - DNA, 15 bp, Homo sapiens
ctagggcagggtggg

SEQ ID NO: 824581 - DNA, 23 bp, Homo sapiens
ctagggctgaggggcctgcgccc

SEQ ID NO: 824582 - DNA, 16 bp, Homo sapiens
ctaggggaagggcttt

SEQ ID NO: 824583 - DNA, 17 bp, Homo sapiens
ctaggggaagggctttg

SEQ ID NO: 824584 - DNA, 16 bp, Homo sapiens
ctaggggagaagagcc

SEQ ID NO: 824585 - DNA, 12 bp, Homo sapiens
ctaggggcagcc

SEQ ID NO: 824586 - DNA, 22 bp, Homo sapiens
ctaggggcagcctccgtcatcc

SEQ ID NO: 824587 - DNA, 18 bp, Homo sapiens
ctagggggacggggctga

SEQ ID NO: 824588 - DNA, 12 bp, Homo sapiens
ctaggggtagct

SEQ ID NO: 824589 - DNA, 17 bp, Homo sapiens
ctaggggtagctggtgg

SEQ ID NO: 824590 - DNA, 12 bp, Homo sapiens
ctaggggtggcg

SEQ ID NO: 824591 - DNA, 17 bp, Homo sapiens
ctaggggtggcgctcag

SEQ ID NO: 824592 - DNA, 16 bp, Homo sapiens
ctagggtcttgggggt

SEQ ID NO: 824593 - DNA, 13 bp, Homo sapiens
ctagggtggccct

SEQ ID NO: 824594 - DNA, 17 bp, Homo sapiens
ctaggtaggaaatgtgg

SEQ ID NO: 824595 - DNA, 14 bp, Homo sapiens
ctaggtaggaagag

SEQ ID NO: 824596 - DNA, 16 bp, Homo sapiens
ctaggtaggaagagcc

SEQ ID NO: 824597 - DNA, 22 bp, Homo sapiens
ctaggtaggcaccacagagaag

SEQ ID NO: 824598 - DNA, 20 bp, Homo sapiens
ctaggtattgtctactctga

SEQ ID NO: 824599 - DNA, 21 bp, Homo sapiens
ctaggtcccttcccgacccag

SEQ ID NO: 824600 - DNA, 15 bp, Homo sapiens
ctaggtgacatatac

SEQ ID NO: 824601 - DNA, 23 bp, Homo sapiens
ctaggtgggccagcccctcccac

SEQ ID NO: 824602 - DNA, 19 bp, Homo sapiens
ctaggtgggttgaaagcca

SEQ ID NO: 824603 - DNA, 13 bp, Homo sapiens
ctaggtgtcccca

SEQ ID NO: 824604 - DNA, 14 bp, Homo sapiens
ctaggtgtccccaa

SEQ ID NO: 824605 - DNA, 16 bp, Homo sapiens
ctaggttaaagctaaa

SEQ ID NO: 824606 - DNA, 18 bp, Homo sapiens
ctaggttaaagctaaact

SEQ ID NO: 824607 - DNA, 18 bp, Homo sapiens
ctaggttatacaataacc

SEQ ID NO: 824608 - DNA, 19 bp, Homo sapiens
ctaggttcaaaagaagttg

SEQ ID NO: 824609 - DNA, 19 bp, Homo sapiens
ctaggttcccggtcccgag

SEQ ID NO: 824610 - DNA, 16 bp, Homo sapiens
ctaggttccctgttct

SEQ ID NO: 824611 - DNA, 21 bp, Homo sapiens
ctaggttccctgttcttcctc

SEQ ID NO: 824612 - DNA, 19 bp, Homo sapiens
ctaggttggacagccccct

SEQ ID NO: 824613 - DNA, 20 bp, Homo sapiens
ctaggttggacagccccctt

SEQ ID NO: 824614 - DNA, 17 bp, Homo sapiens
ctagtaacaatacatga

SEQ ID NO: 824615 - DNA, 13 bp, Homo sapiens
ctagtaagatgca

SEQ ID NO: 824616 - DNA, 16 bp, Homo sapiens
ctagtacataattgat

SEQ ID NO: 824617 - DNA, 19 bp, Homo sapiens
ctagtaccctatagagagg

SEQ ID NO: 824618 - DNA, 21 bp, Homo sapiens
ctagtaccctatagagagggg

SEQ ID NO: 824619 - DNA, 19 bp, Homo sapiens
ctagtactctctgctctag

SEQ ID NO: 824620 - DNA, 12 bp, Homo sapiens
ctagtactgtat

SEQ ID NO: 824621 - DNA, 14 bp, Homo sapiens
ctagtagaactgga

SEQ ID NO: 824622 - DNA, 14 bp, Homo sapiens
ctagtagcaatgtg

SEQ ID NO: 824623 - DNA, 22 bp, Homo sapiens
ctagtaggcagcaaaagaccaa

SEQ ID NO: 824624 - DNA, 18 bp, Homo sapiens
ctagtagtatatttaatt

SEQ ID NO: 824625 - DNA, 16 bp, Homo sapiens
ctagtagtgtggcctg

SEQ ID NO: 824626 - DNA, 21 bp, Homo sapiens
ctagtatcttcaaactttcac

SEQ ID NO: 824627 - DNA, 23 bp, Homo sapiens
ctagtcaagctcctcctccctgc

SEQ ID NO: 824628 - DNA, 14 bp, Homo sapiens
ctagtcaccagaga

SEQ ID NO: 824629 - DNA, 16 bp, Homo sapiens
ctagtcagagagagtg

SEQ ID NO: 824630 - DNA, 17 bp, Homo sapiens
ctagtcagggcacagct

SEQ ID NO: 824631 - DNA, 22 bp, Homo sapiens
ctagtcagggcacagctgccct

SEQ ID NO: 824632 - DNA, 14 bp, Homo sapiens
ctagtcattgtcat

SEQ ID NO: 824633 - DNA, 16 bp, Homo sapiens
ctagtcccctttcctc

SEQ ID NO: 824634 - DNA, 20 bp, Homo sapiens
ctagtcccttcccctccctg

SEQ ID NO: 824635 - DNA, 22 bp, Homo sapiens
ctagtcccttcccctccctggc

SEQ ID NO: 824636 - DNA, 18 bp, Homo sapiens
ctagtcctattctattgc

SEQ ID NO: 824637 - DNA, 12 bp, Homo sapiens
ctagtccttgtt

SEQ ID NO: 824638 - DNA, 21 bp, Homo sapiens
ctagtcctttctgtgaagcta

SEQ ID NO: 824639 - DNA, 23 bp, Homo sapiens
ctagtcctttctgtgaagctaat

SEQ ID NO: 824640 - DNA, 19 bp, Homo sapiens
ctagtcgggacttgtaaca

SEQ ID NO: 824641 - DNA, 15 bp, Homo sapiens
ctagtctcctttgca

SEQ ID NO: 824642 - DNA, 23 bp, Homo sapiens
ctagtctcctttgcactgagggc

SEQ ID NO: 824643 - DNA, 14 bp, Homo sapiens
ctagtctctctggg

SEQ ID NO: 824644 - DNA, 13 bp, Homo sapiens
ctagtcttaagaa

SEQ ID NO: 824645 - DNA, 13 bp, Homo sapiens
ctagtcttttgct

SEQ ID NO: 824646 - DNA, 14 bp, Homo sapiens
ctagtcttttgctt

SEQ ID NO: 824647 - DNA, 14 bp, Homo sapiens
ctagtgaatgaatc

SEQ ID NO: 824648 - DNA, 19 bp, Homo sapiens
ctagtgaatgtaggctggc

SEQ ID NO: 824649 - DNA, 21 bp, Homo sapiens
ctagtgaatgtaggctggctt

SEQ ID NO: 824650 - DNA, 19 bp, Homo sapiens
ctagtgaatttctgaaaga

SEQ ID NO: 824651 - DNA, 22 bp, Homo sapiens
ctagtgaccatcttcataattt

SEQ ID NO: 824652 - DNA, 19 bp, Homo sapiens
ctagtgaccccttccctgt

SEQ ID NO: 824653 - DNA, 17 bp, Homo sapiens
ctagtgagcctgggcca

SEQ ID NO: 824654 - DNA, 18 bp, Homo sapiens
ctagtgagcctgggccag

SEQ ID NO: 824655 - DNA, 15 bp, Homo sapiens
ctagtgagtcagcac

SEQ ID NO: 824656 - DNA, 20 bp, Homo sapiens
ctagtgcaattccaagaaaa

SEQ ID NO: 824657 - DNA, 19 bp, Homo sapiens
ctagtgcatttcaaggaat

SEQ ID NO: 824658 - DNA, 19 bp, Homo sapiens
ctagtgccaaataattgat

SEQ ID NO: 824659 - DNA, 18 bp, Homo sapiens
ctatatccagttcctgct

SEQ ID NO: 824660 - DNA, 19 bp, Homo sapiens
ctatatccagttcctgctc

SEQ ID NO: 824661 - DNA, 12 bp, Homo sapiens
ctatatccatgt

SEQ ID NO: 824662 - DNA, 13 bp, Homo sapiens
ctatatccatgta

SEQ ID NO: 824663 - DNA, 19 bp, Homo sapiens
ctatatccatgtactgtag

SEQ ID NO: 824664 - DNA, 18 bp, Homo sapiens
ctatatcctgatgctgga

SEQ ID NO: 824665 - DNA, 17 bp, Homo sapiens
ctatatcctgtgactgt

SEQ ID NO: 824666 - DNA, 16 bp, Homo sapiens
ctatatctgtttgtat

SEQ ID NO: 824667 - DNA, 17 bp, Homo sapiens
ctatatctgtttgtata

SEQ ID NO: 824668 - DNA, 16 bp, Homo sapiens
ctatatgaatttaaat

SEQ ID NO: 824669 - DNA, 23 bp, Homo sapiens
ctatatgaatttaaatataattc

SEQ ID NO: 824670 - DNA, 13 bp, Homo sapiens
ctatatggcaaga

SEQ ID NO: 824671 - DNA, 19 bp, Homo sapiens
ctatatggcaagaaagctg

SEQ ID NO: 824672 - DNA, 17 bp, Homo sapiens
ctatatgtagtgcattt

SEQ ID NO: 824673 - DNA, 19 bp, Homo sapiens
ctatatgtagtgcattttt

SEQ ID NO: 824674 - DNA, 12 bp, Homo sapiens
ctatatgtgaat

SEQ ID NO: 824675 - DNA, 18 bp, Homo sapiens
ctatatgtgaatcctctt

SEQ ID NO: 824676 - DNA, 17 bp, Homo sapiens
ctatatgtttacacaat

SEQ ID NO: 824677 - DNA, 17 bp, Homo sapiens
ctatattagctgaaaca

SEQ ID NO: 824678 - DNA, 17 bp, Homo sapiens
ctatattattatatata

SEQ ID NO: 824679 - DNA, 16 bp, Homo sapiens
ctatattcctttttct

SEQ ID NO: 824680 - DNA, 22 bp, Homo sapiens
ctatattcctttttctatgaaa

SEQ ID NO: 824681 - DNA, 18 bp, Homo sapiens
ctatattgattgtccttt

SEQ ID NO: 824682 - DNA, 14 bp, Homo sapiens
ctatattgcccagg

SEQ ID NO: 824683 - DNA, 23 bp, Homo sapiens
ctatattggtttatgtagtcagt

SEQ ID NO: 824684 - DNA, 13 bp, Homo sapiens
ctatatttacaaa

SEQ ID NO: 824685 - DNA, 17 bp, Homo sapiens
ctatatttgtatatatt

SEQ ID NO: 824686 - DNA, 22 bp, Homo sapiens
ctatatttgtatatattttata

SEQ ID NO: 824687 - DNA, 16 bp, Homo sapiens
ctatatttgtcttccg

SEQ ID NO: 824688 - DNA, 16 bp, Homo sapiens
ctatcaaatgaaactc

SEQ ID NO: 824689 - DNA, 15 bp, Homo sapiens
ctatcaacaataaaa

SEQ ID NO: 824690 - DNA, 21 bp, Homo sapiens
ctatcaaccccagacactggt

SEQ ID NO: 824691 - DNA, 20 bp, Homo sapiens
ctatcaagtattataccttt

SEQ ID NO: 824692 - DNA, 20 bp, Homo sapiens
ctatcaattcttgagaccca

SEQ ID NO: 824693 - DNA, 20 bp, Homo sapiens
ctatcacacactttctcttc

SEQ ID NO: 824694 - DNA, 20 bp, Homo sapiens
ctatcagagcctctcccaca

SEQ ID NO: 824695 - DNA, 14 bp, Homo sapiens
ctatcagcaatact

SEQ ID NO: 824696 - DNA, 19 bp, Homo sapiens
ctatcagttatcctttgtg

SEQ ID NO: 824697 - DNA, 22 bp, Homo sapiens
ctatcatactactgaaacagat

SEQ ID NO: 824698 - DNA, 12 bp, Homo sapiens
ctatcattccaa

SEQ ID NO: 824699 - DNA, 20 bp, Homo sapiens
ctatcattccaattctaaat

SEQ ID NO: 824700 - DNA, 18 bp, Homo sapiens
ctatcatttttacactat

SEQ ID NO: 824701 - DNA, 22 bp, Homo sapiens
ctatccaagtgttataccaact

SEQ ID NO: 824702 - DNA, 16 bp, Homo sapiens
ctatccacccagccca

SEQ ID NO: 824703 - DNA, 19 bp, Homo sapiens
ctatccacccagcccattc

SEQ ID NO: 824704 - DNA, 15 bp, Homo sapiens
ctatccatctcctgg

SEQ ID NO: 824705 - DNA, 16 bp, Homo sapiens
ctatccatctcctggt

SEQ ID NO: 824706 - DNA, 22 bp, Homo sapiens
ctatccatggcactaaaccact

SEQ ID NO: 824707 - DNA, 19 bp, Homo sapiens
ctatccccaaactccttta

SEQ ID NO: 824708 - DNA, 14 bp, Homo sapiens
ctatccccatccag

SEQ ID NO: 824709 - DNA, 17 bp, Homo sapiens
ctatccccatctccctg

SEQ ID NO: 824710 - DNA, 18 bp, Homo sapiens
ctatcccccttaaagaaa

SEQ ID NO: 824711 - DNA, 14 bp, Homo sapiens
ctatccgctgccag

SEQ ID NO: 824712 - DNA, 22 bp, Homo sapiens
ctatccgctgccagccttgagc

SEQ ID NO: 824713 - DNA, 18 bp, Homo sapiens
ctatcctctctctctcta

SEQ ID NO: 824714 - DNA, 18 bp, Homo sapiens
ctatcctgattccaaata

SEQ ID NO: 824715 - DNA, 19 bp, Homo sapiens
ctatccttccagtggctcg

SEQ ID NO: 824716 - DNA, 12 bp, Homo sapiens
ctatccttggct

SEQ ID NO: 824717 - DNA, 16 bp, Homo sapiens
ctatccttttgcctgc

SEQ ID NO: 824718 - DNA, 14 bp, Homo sapiens
ctatcgagtttgca

SEQ ID NO: 824719 - DNA, 18 bp, Homo sapiens
ctatcgagtttgcaatgt

SEQ ID NO: 824720 - DNA, 15 bp, Homo sapiens
ctatcgccctccttt

SEQ ID NO: 824721 - DNA, 21 bp, Homo sapiens
ctatcgccctcctttccctta

SEQ ID NO: 824722 - DNA, 20 bp, Homo sapiens
ctatcgttctctctttgcat

SEQ ID NO: 824723 - DNA, 13 bp, Homo sapiens
ctatctaaagttt

SEQ ID NO: 824724 - DNA, 14 bp, Homo sapiens
ctatctacaaaaat

SEQ ID NO: 824725 - DNA, 18 bp, Homo sapiens
ctatctatacctgccttt

SEQ ID NO: 824726 - DNA, 19 bp, Homo sapiens
ctatctatacctgcctttt

SEQ ID NO: 824727 - DNA, 15 bp, Homo sapiens
ctatctatcttccaa

SEQ ID NO: 824728 - DNA, 19 bp, Homo sapiens
ctatctccagcggccctgt

SEQ ID NO: 824729 - DNA, 12 bp, Homo sapiens
ctatctcctgac

SEQ ID NO: 824730 - DNA, 17 bp, Homo sapiens
ctatctcgtgggagagc

SEQ ID NO: 824731 - DNA, 17 bp, Homo sapiens
ctatctctgtgtgcaca

SEQ ID NO: 824732 - DNA, 17 bp, Homo sapiens
ctatctgattttgtgca

SEQ ID NO: 824733 - DNA, 18 bp, Homo sapiens
ctatctgccaaattgaga

SEQ ID NO: 824734 - DNA, 23 bp, Homo sapiens
ctatctggaggccttccagctgc

SEQ ID NO: 824735 - DNA, 21 bp, Homo sapiens
ctatctggggagctcctggcc

SEQ ID NO: 824736 - DNA, 16 bp, Homo sapiens
ctatctggtattaaat

SEQ ID NO: 824737 - DNA, 22 bp, Homo sapiens
ctatctggtcaacctcctggac

SEQ ID NO: 824738 - DNA, 17 bp, Homo sapiens
ctatctggtgatttcta

SEQ ID NO: 824739 - DNA, 22 bp, Homo sapiens
ctatctgtcatctctctggggc

SEQ ID NO: 824740 - DNA, 15 bp, Homo sapiens
ctatctgtggaaagc

SEQ ID NO: 824741 - DNA, 14 bp, Homo sapiens
ctatctgttgaaaa

SEQ ID NO: 824742 - DNA, 17 bp, Homo sapiens
ctatcttcatgtaaatt

SEQ ID NO: 824743 - DNA, 13 bp, Homo sapiens
ctatgaaaatgag

SEQ ID NO: 824744 - DNA, 15 bp, Homo sapiens
ctatgaaaatgagcc

SEQ ID NO: 824745 - DNA, 18 bp, Homo sapiens
ctatgaaaatgagccctg

SEQ ID NO: 824746 - DNA, 14 bp, Homo sapiens
ctatgaacactgtc

SEQ ID NO: 824747 - DNA, 17 bp, Homo sapiens
ctatgaacttctctcag

SEQ ID NO: 824748 - DNA, 20 bp, Homo sapiens
ctatgaagagctagagaaat

SEQ ID NO: 824749 - DNA, 21 bp, Homo sapiens
ctatgaagttgctgtttattt

SEQ ID NO: 824750 - DNA, 22 bp, Homo sapiens
ctatgaagttgctgtttatttt

SEQ ID NO: 824751 - DNA, 19 bp, Homo sapiens
ctatgaagttggcacattt

SEQ ID NO: 824752 - DNA, 17 bp, Homo sapiens
ctatgacaaattcaaga

SEQ ID NO: 824753 - DNA, 14 bp, Homo sapiens
ctatgacacatgca

SEQ ID NO: 824754 - DNA, 21 bp, Homo sapiens
ctatgacctcgccctccacaa

SEQ ID NO: 824755 - DNA, 14 bp, Homo sapiens
ctatgactggagta

SEQ ID NO: 824756 - DNA, 13 bp, Homo sapiens
ctatgactttttt

SEQ ID NO: 824757 - DNA, 17 bp, Homo sapiens
ctatgagaacaagtcac

SEQ ID NO: 824758 - DNA, 23 bp, Homo sapiens
ctatgagaacaagtcacagctgc

SEQ ID NO: 824759 - DNA, 14 bp, Homo sapiens
ctatgagcatcctg

SEQ ID NO: 824760 - DNA, 18 bp, Homo sapiens
ctatgagcatcctgagcc

SEQ ID NO: 824761 - DNA, 19 bp, Homo sapiens
ctatgagcatcctgagccc

SEQ ID NO: 824762 - DNA, 12 bp, Homo sapiens
ctatgaggaaag

SEQ ID NO: 824763 - DNA, 20 bp, Homo sapiens
ctatgataaagttgtaaata

SEQ ID NO: 824764 - DNA, 20 bp, Homo sapiens
ctatgatagataataaacaa

SEQ ID NO: 824765 - DNA, 14 bp, Homo sapiens
ctatgatcacagtg

SEQ ID NO: 824766 - DNA, 20 bp, Homo sapiens
ctatgatggaagtgttcaga

SEQ ID NO: 824767 - DNA, 14 bp, Homo sapiens
ctatgatgggcttc

SEQ ID NO: 824768 - DNA, 15 bp, Homo sapiens
ctatgatgggcttct

SEQ ID NO: 824769 - DNA, 14 bp, Homo sapiens
ctatgattattaac

SEQ ID NO: 824770 - DNA, 13 bp, Homo sapiens
ctatgcaaaaaat

SEQ ID NO: 824771 - DNA, 12 bp, Homo sapiens
ctatgcaaaatg

SEQ ID NO: 824772 - DNA, 17 bp, Homo sapiens
ctatgcaaaatgtctgt

SEQ ID NO: 824773 - DNA, 18 bp, Homo sapiens
ctatgcaaaatgtctgtt

SEQ ID NO: 824774 - DNA, 18 bp, Homo sapiens
ctatgcaaaccagcttta

SEQ ID NO: 824775 - DNA, 17 bp, Homo sapiens
ctatgcagaggcctggg

SEQ ID NO: 824776 - DNA, 18 bp, Homo sapiens
ctatgcagaggcctgggg

SEQ ID NO: 824777 - DNA, 18 bp, Homo sapiens
ctatgcataaaaaaatga

SEQ ID NO: 824778 - DNA, 19 bp, Homo sapiens
ctatgcataaaaaaatgat

SEQ ID NO: 824779 - DNA, 12 bp, Homo sapiens
ctatgcatttga

SEQ ID NO: 824780 - DNA, 14 bp, Homo sapiens
ctatgcatttgaaa

SEQ ID NO: 824781 - DNA, 12 bp, Homo sapiens
ctcaaatttatt

SEQ ID NO: 824782 - DNA, 21 bp, Homo sapiens
ctcaaatttattttaatgtaa

SEQ ID NO: 824783 - DNA, 22 bp, Homo sapiens
ctcaacaagggagagacctcat

SEQ ID NO: 824784 - DNA, 21 bp, Homo sapiens
ctcaacaccctgcttctcccg

SEQ ID NO: 824785 - DNA, 23 bp, Homo sapiens
ctcaacaccctgcttctcccggg

SEQ ID NO: 824786 - DNA, 20 bp, Homo sapiens
ctcaacatgttactgaccag

SEQ ID NO: 824787 - DNA, 16 bp, Homo sapiens
ctcaacattgcatggt

SEQ ID NO: 824788 - DNA, 15 bp, Homo sapiens
ctcaaccagagtcac

SEQ ID NO: 824789 - DNA, 13 bp, Homo sapiens
ctcaacccagagg

SEQ ID NO: 824790 - DNA, 16 bp, Homo sapiens
ctcaacccattgttgt

SEQ ID NO: 824791 - DNA, 18 bp, Homo sapiens
ctcaacccccctcccaga

SEQ ID NO: 824792 - DNA, 22 bp, Homo sapiens
ctcaacctaccaccccttcctg

SEQ ID NO: 824793 - DNA, 13 bp, Homo sapiens
ctcaacctcttct

SEQ ID NO: 824794 - DNA, 21 bp, Homo sapiens
ctcaacctcttctggctcaaa

SEQ ID NO: 824795 - DNA, 13 bp, Homo sapiens
ctcaacctgtgat

SEQ ID NO: 824796 - DNA, 18 bp, Homo sapiens
ctcaacgttgctccccat

SEQ ID NO: 824797 - DNA, 17 bp, Homo sapiens
ctcaactcacagcttct

SEQ ID NO: 824798 - DNA, 22 bp, Homo sapiens
ctcaactcgggggcgcctggag

SEQ ID NO: 824799 - DNA, 20 bp, Homo sapiens
ctcaactctacccctgctcc

SEQ ID NO: 824800 - DNA, 22 bp, Homo sapiens
ctcaagaaataaaaggaagcca

SEQ ID NO: 824801 - DNA, 22 bp, Homo sapiens
ctcaagaatctagaagatgtgt

SEQ ID NO: 824802 - DNA, 14 bp, Homo sapiens
ctcaagacaaggct

SEQ ID NO: 824803 - DNA, 13 bp, Homo sapiens
ctcaagactttag

SEQ ID NO: 824804 - DNA, 22 bp, Homo sapiens
ctcaagactttagcttttcctt

SEQ ID NO: 824805 - DNA, 17 bp, Homo sapiens
ctcaagactttgatcct

SEQ ID NO: 824806 - DNA, 15 bp, Homo sapiens
ctcaagagcaaagta

SEQ ID NO: 824807 - DNA, 17 bp, Homo sapiens
ctcaagagggcactggt

SEQ ID NO: 824808 - DNA, 17 bp, Homo sapiens
ctcaagatactgctact

SEQ ID NO: 824809 - DNA, 16 bp, Homo sapiens
ctcaagatgaaggcaa

SEQ ID NO: 824810 - DNA, 20 bp, Homo sapiens
ctcaagatgggggcagggct

SEQ ID NO: 824811 - DNA, 17 bp, Homo sapiens
ctcaagcaagatgagct

SEQ ID NO: 824812 - DNA, 12 bp, Homo sapiens
ctcaagcaataa

SEQ ID NO: 824813 - DNA, 19 bp, Homo sapiens
ctcaagcaatccttctgcc

SEQ ID NO: 824814 - DNA, 21 bp, Homo sapiens
ctcaagcaatccttctgcctt

SEQ ID NO: 824815 - DNA, 24 bp, Homo sapiens
ctcaagcaatccttctgccttggc

SEQ ID NO: 824816 - DNA, 18 bp, Homo sapiens
ctcaagccaatcccctcc

SEQ ID NO: 824817 - DNA, 13 bp, Homo sapiens
ctcaagccagccc

SEQ ID NO: 824818 - DNA, 16 bp, Homo sapiens
ctcaagccagccccct

SEQ ID NO: 824819 - DNA, 14 bp, Homo sapiens
ctcaagccagcctg

SEQ ID NO: 824820 - DNA, 16 bp, Homo sapiens
ctcaagcgattctcct

SEQ ID NO: 824821 - DNA, 19 bp, Homo sapiens
ctcaagctagtgtttctag

SEQ ID NO: 824822 - DNA, 22 bp, Homo sapiens
ctcaagctggtggcctctgcag

SEQ ID NO: 824823 - DNA, 15 bp, Homo sapiens
ctcaaggaagggaca

SEQ ID NO: 824824 - DNA, 16 bp, Homo sapiens
ctcaaggacaggagcc

SEQ ID NO: 824825 - DNA, 13 bp, Homo sapiens
ctcaaggccacct

SEQ ID NO: 824826 - DNA, 22 bp, Homo sapiens
ctcaaggccaccttggaggagg

SEQ ID NO: 824827 - DNA, 12 bp, Homo sapiens
ctcaaggccctc

SEQ ID NO: 824828 - DNA, 16 bp, Homo sapiens
ctcaaggctgggagga

SEQ ID NO: 824829 - DNA, 16 bp, Homo sapiens
ctcaagggggtgacag

SEQ ID NO: 824830 - DNA, 18 bp, Homo sapiens
ctcaagggtccagaagtc

SEQ ID NO: 824831 - DNA, 18 bp, Homo sapiens
ctcaaggttctcatttct

SEQ ID NO: 824832 - DNA, 20 bp, Homo sapiens
ctcaagtagaaaagcagtcc

SEQ ID NO: 824833 - DNA, 16 bp, Homo sapiens
ctcaagtgatcctcac

SEQ ID NO: 824834 - DNA, 9 bp, Homo sapiens
ctcaagtgc

SEQ ID NO: 824835 - DNA, 18 bp, Homo sapiens
ctcaagtgtagaagaaaa

SEQ ID NO: 824836 - DNA, 15 bp, Homo sapiens
ctcaagtgttttgga

SEQ ID NO: 824837 - DNA, 21 bp, Homo sapiens
ctcaagtgttttggagaaaaa

SEQ ID NO: 824838 - DNA, 20 bp, Homo sapiens
ctcaagttatttcatgcgca

SEQ ID NO: 824839 - DNA, 18 bp, Homo sapiens
ctcaataaattgcaacat

SEQ ID NO: 824840 - DNA, 13 bp, Homo sapiens
ctcaatcagtgca

SEQ ID NO: 824841 - DNA, 14 bp, Homo sapiens
ctcaatcagtgcag

SEQ ID NO: 824842 - DNA, 16 bp, Homo sapiens
ctcaatcagtgcagtg

SEQ ID NO: 824843 - DNA, 18 bp, Homo sapiens
ctcaatcccagctactca

SEQ ID NO: 824844 - DNA, 22 bp, Homo sapiens
ctcaatcctaatttctcctccc

SEQ ID NO: 824845 - DNA, 15 bp, Homo sapiens
ctcaatctaaggcct

SEQ ID NO: 824846 - DNA, 13 bp, Homo sapiens
ctcaatctgcagc

SEQ ID NO: 824847 - DNA, 14 bp, Homo sapiens
ctcaatctgcagcc

SEQ ID NO: 824848 - DNA, 13 bp, Homo sapiens
ctcaatgccctgc

SEQ ID NO: 824849 - DNA, 14 bp, Homo sapiens
ctcaatgccctgcc

SEQ ID NO: 824850 - DNA, 15 bp, Homo sapiens
ctcaatgccctgcca

SEQ ID NO: 824851 - DNA, 18 bp, Homo sapiens
ctcaatgccctgccatta

SEQ ID NO: 824852 - DNA, 15 bp, Homo sapiens
ctcaatgcctggaga

SEQ ID NO: 824853 - DNA, 16 bp, Homo sapiens
ctcaatgcttaggaga

SEQ ID NO: 824854 - DNA, 15 bp, Homo sapiens
ctcaatgctttattt

SEQ ID NO: 824855 - DNA, 20 bp, Homo sapiens
ctcaatgctttatttgtaaa

SEQ ID NO: 824856 - DNA, 17 bp, Homo sapiens
ctcaatggactggaagg

SEQ ID NO: 824857 - DNA, 23 bp, Homo sapiens
ctcaatggcctaaaactggcctg

SEQ ID NO: 824858 - DNA, 21 bp, Homo sapiens
ctcaatgtgaatcagacccta

SEQ ID NO: 824859 - DNA, 16 bp, Homo sapiens
ctcaatgtgaccaggg

SEQ ID NO: 824860 - DNA, 14 bp, Homo sapiens
ctcaattagtgtgg

SEQ ID NO: 824861 - DNA, 21 bp, Homo sapiens
ctcaatttttggttgaataaa

SEQ ID NO: 824862 - DNA, 21 bp, Homo sapiens
ctcacaaaaaggcaaatattg

SEQ ID NO: 824863 - DNA, 16 bp, Homo sapiens
ctcacaacctgaacct

SEQ ID NO: 824864 - DNA, 22 bp, Homo sapiens
ctcacaagggctctcaaagtat

SEQ ID NO: 824865 - DNA, 23 bp, Homo sapiens
ctcacaatgttgctagttttttg

SEQ ID NO: 824866 - DNA, 22 bp, Homo sapiens
ctcacaatttaaaatatttccc

SEQ ID NO: 824867 - DNA, 18 bp, Homo sapiens
ctcacacacacagctggg

SEQ ID NO: 824868 - DNA, 17 bp, Homo sapiens
ctcacacaccctgaggt

SEQ ID NO: 824869 - DNA, 21 bp, Homo sapiens
ctcacacaggacccccttccc

SEQ ID NO: 824870 - DNA, 22 bp, Homo sapiens
ctcacacaggacccccttcccc

SEQ ID NO: 824871 - DNA, 13 bp, Homo sapiens
ctcacaccaaatt

SEQ ID NO: 824872 - DNA, 16 bp, Homo sapiens
ctcacactctctgcag

SEQ ID NO: 824873 - DNA, 14 bp, Homo sapiens
ctcacactgatggg

SEQ ID NO: 824874 - DNA, 23 bp, Homo sapiens
ctcacactgatgggctggggcag

SEQ ID NO: 824875 - DNA, 20 bp, Homo sapiens
ctcacactgctgtcctctcc

SEQ ID NO: 824876 - DNA, 21 bp, Homo sapiens
ctcacactgctgtcctctccc

SEQ ID NO: 824877 - DNA, 19 bp, Homo sapiens
ctcacactggtctgctgtc

SEQ ID NO: 824878 - DNA, 23 bp, Homo sapiens
ctcacactggttctcaatgaaaa

SEQ ID NO: 824879 - DNA, 23 bp, Homo sapiens
ctcacagacctggagcccctggg

SEQ ID NO: 824880 - DNA, 19 bp, Homo sapiens
ctcacagcagtgagactgg

SEQ ID NO: 824881 - DNA, 16 bp, Homo sapiens
ctcacagctgtaataa

SEQ ID NO: 824882 - DNA, 14 bp, Homo sapiens
ctcacagcttctcc

SEQ ID NO: 824883 - DNA, 14 bp, Homo sapiens
ctcacaggctgaga

SEQ ID NO: 824884 - DNA, 15 bp, Homo sapiens
ctcacagggcaggcc

SEQ ID NO: 824885 - DNA, 18 bp, Homo sapiens
ctcacagggcaggccttg

SEQ ID NO: 824886 - DNA, 23 bp, Homo sapiens
ctcacagggcaggccttgctggg

SEQ ID NO: 824887 - DNA, 21 bp, Homo sapiens
ctcacaggtgtttgaggccaa

SEQ ID NO: 824888 - DNA, 20 bp, Homo sapiens
ctcacagtacagcatgtgcc

SEQ ID NO: 824889 - DNA, 16 bp, Homo sapiens
ctcacagttcctcgcc

SEQ ID NO: 824890 - DNA, 20 bp, Homo sapiens
ctcacatagcttacaagcca

SEQ ID NO: 824891 - DNA, 16 bp, Homo sapiens
ctcacatcctcctgcc

SEQ ID NO: 824892 - DNA, 19 bp, Homo sapiens
ctcacatgctgtttttcct

SEQ ID NO: 824893 - DNA, 16 bp, Homo sapiens
ctcacattagatctag

SEQ ID NO: 824894 - DNA, 12 bp, Homo sapiens
ctcaccaaacta

SEQ ID NO: 824895 - DNA, 23 bp, Homo sapiens
ctcaccaaggatcggactctgcc

SEQ ID NO: 824896 - DNA, 14 bp, Homo sapiens
ctcaccacaagctg

SEQ ID NO: 824897 - DNA, 15 bp, Homo sapiens
ctcaccaccacacta

SEQ ID NO: 824898 - DNA, 15 bp, Homo sapiens
ctcaccacccccact

SEQ ID NO: 824899 - DNA, 16 bp, Homo sapiens
ctcaccacccccactg

SEQ ID NO: 824900 - DNA, 20 bp, Homo sapiens
ctcaccacccccactggtga

SEQ ID NO: 824901 - DNA, 18 bp, Homo sapiens
ctcaccactaccagccag

SEQ ID NO: 824902 - DNA, 14 bp, Homo sapiens
ctcactctggcctc

SEQ ID NO: 824903 - DNA, 15 bp, Homo sapiens
ctcactctggcctca

SEQ ID NO: 824904 - DNA, 15 bp, Homo sapiens
ctcactctgggctgt

SEQ ID NO: 824905 - DNA, 13 bp, Homo sapiens
ctcactctgtcag

SEQ ID NO: 824906 - DNA, 18 bp, Homo sapiens
ctcactctgtcagccagc

SEQ ID NO: 824907 - DNA, 23 bp, Homo sapiens
ctcactctgtcgctcaggctgga

SEQ ID NO: 824908 - DNA, 13 bp, Homo sapiens
ctcactgaaaaca

SEQ ID NO: 824909 - DNA, 21 bp, Homo sapiens
ctcactgaaaacatctggaag

SEQ ID NO: 824910 - DNA, 15 bp, Homo sapiens
ctcactgaactccac

SEQ ID NO: 824911 - DNA, 16 bp, Homo sapiens
ctcactgaactccacc

SEQ ID NO: 824912 - DNA, 22 bp, Homo sapiens
ctcactgagaagattgtgaata

SEQ ID NO: 824913 - DNA, 13 bp, Homo sapiens
ctcactgagcctc

SEQ ID NO: 824914 - DNA, 14 bp, Homo sapiens
ctcactgaggccat

SEQ ID NO: 824915 - DNA, 11 bp, Homo sapiens
ctcactgcagc

SEQ ID NO: 824916 - DNA, 12 bp, Homo sapiens
ctcactgcagcc

SEQ ID NO: 824917 - DNA, 14 bp, Homo sapiens
ctcactgcagcctc

SEQ ID NO: 824918 - DNA, 13 bp, Homo sapiens
ctcactgcagcgc

SEQ ID NO: 824919 - DNA, 22 bp, Homo sapiens
ctcactgcatcctctgcctccc

SEQ ID NO: 824920 - DNA, 10 bp, Homo sapiens
ctcactgcca

SEQ ID NO: 824921 - DNA, 11 bp, Homo sapiens
ctcactgccag

SEQ ID NO: 824922 - DNA, 18 bp, Homo sapiens
ctcactgccaggccagcc

SEQ ID NO: 824923 - DNA, 22 bp, Homo sapiens
ctcactgccaggccagcctccg

SEQ ID NO: 824924 - DNA, 19 bp, Homo sapiens
ctcactgccatgccagctt

SEQ ID NO: 824925 - DNA, 22 bp, Homo sapiens
ctcactgccatgccagcttatc

SEQ ID NO: 824926 - DNA, 22 bp, Homo sapiens
ctcactgccatggaattccctc

SEQ ID NO: 824927 - DNA, 13 bp, Homo sapiens
ctcactgccctcc

SEQ ID NO: 824928 - DNA, 17 bp, Homo sapiens
ctcactgccctccctcg

SEQ ID NO: 824929 - DNA, 16 bp, Homo sapiens
ctcactgcctggtaaa

SEQ ID NO: 824930 - DNA, 20 bp, Homo sapiens
ctcactgctcaagaagacat

SEQ ID NO: 824931 - DNA, 18 bp, Homo sapiens
ctcactgcttgaactagg

SEQ ID NO: 824932 - DNA, 18 bp, Homo sapiens
ctcactggaggagcagct

SEQ ID NO: 824933 - DNA, 15 bp, Homo sapiens
ctcactggctcatgc

SEQ ID NO: 824934 - DNA, 19 bp, Homo sapiens
ctcactggctctcctggcc

SEQ ID NO: 824935 - DNA, 14 bp, Homo sapiens
ctcactggctggga

SEQ ID NO: 824936 - DNA, 16 bp, Homo sapiens
ctcactggctgggagt

SEQ ID NO: 824937 - DNA, 22 bp, Homo sapiens
ctcactgggaagctcccacccc

SEQ ID NO: 824938 - DNA, 22 bp, Homo sapiens
ctcactggggtcctggggcctc

SEQ ID NO: 824939 - DNA, 13 bp, Homo sapiens
ctcactgggtggg

SEQ ID NO: 824940 - DNA, 10 bp, Homo sapiens
ctcactgtga

SEQ ID NO: 824941 - DNA, 24 bp, Homo sapiens
ctcactgtgggaaggccagctgcc

SEQ ID NO: 824942 - DNA, 12 bp, Homo sapiens
ctcactgtgtgt

SEQ ID NO: 824943 - DNA, 18 bp, Homo sapiens
ctcactgtgttactgctt

SEQ ID NO: 824944 - DNA, 18 bp, Homo sapiens
ctcactgttccctctgct

SEQ ID NO: 824945 - DNA, 20 bp, Homo sapiens
ctcactgttccctctgctcc

SEQ ID NO: 824946 - DNA, 21 bp, Homo sapiens
ctcactgttccctctgctcct

SEQ ID NO: 824947 - DNA, 16 bp, Homo sapiens
ctcactgttctgcaaa

SEQ ID NO: 824948 - DNA, 21 bp, Homo sapiens
ctcactgtttgtttttattta

SEQ ID NO: 824949 - DNA, 21 bp, Homo sapiens
ctcacttacataaagctccct

SEQ ID NO: 824950 - DNA, 23 bp, Homo sapiens
ctcacttacataaagctcccttg

SEQ ID NO: 824951 - DNA, 14 bp, Homo sapiens
ctcacttagtcctt

SEQ ID NO: 824952 - DNA, 17 bp, Homo sapiens
ctcacttataccaaagg

SEQ ID NO: 824953 - DNA, 21 bp, Homo sapiens
ctcacttataccaaagggaaa

SEQ ID NO: 824954 - DNA, 16 bp, Homo sapiens
ctcacttatctgatac

SEQ ID NO: 824955 - DNA, 16 bp, Homo sapiens
ctcacttcaatgtgtc

SEQ ID NO: 824956 - DNA, 13 bp, Homo sapiens
ctcacttccagtg

SEQ ID NO: 824957 - DNA, 14 bp, Homo sapiens
ctcacttctaaatt

SEQ ID NO: 824958 - DNA, 14 bp, Homo sapiens
ctcacttgattcat

SEQ ID NO: 824959 - DNA, 16 bp, Homo sapiens
ctcacttgattcatct

SEQ ID NO: 824960 - DNA, 19 bp, Homo sapiens
ctcacttgattcatctctg

SEQ ID NO: 824961 - DNA, 20 bp, Homo sapiens
ctcacttgattcatctctgg

SEQ ID NO: 824962 - DNA, 14 bp, Homo sapiens
ctcacttgggggaa

SEQ ID NO: 824963 - DNA, 21 bp, Homo sapiens
ctcactttattacaagatctt

SEQ ID NO: 824964 - DNA, 21 bp, Homo sapiens
ctcacttttaatgaacaaatg

SEQ ID NO: 824965 - DNA, 14 bp, Homo sapiens
ctcacttttcactt

SEQ ID NO: 824966 - DNA, 16 bp, Homo sapiens
ctcacttttcacttgt

SEQ ID NO: 824967 - DNA, 18 bp, Homo sapiens
ctcacttttcacttgtct

SEQ ID NO: 824968 - DNA, 22 bp, Homo sapiens
ctcacttttcacttgtcttgct

SEQ ID NO: 824969 - DNA, 16 bp, Homo sapiens
ctcacttttcatcctt

SEQ ID NO: 824970 - DNA, 21 bp, Homo sapiens
ctcacttttcatccttcccca

SEQ ID NO: 824971 - DNA, 21 bp, Homo sapiens
ctcagaaactcccctgggggt

SEQ ID NO: 824972 - DNA, 16 bp, Homo sapiens
ctcagaaagtgcctga

SEQ ID NO: 824973 - DNA, 17 bp, Homo sapiens
ctcagaaagtgcctgac

SEQ ID NO: 824974 - DNA, 22 bp, Homo sapiens
ctcagaaagtgcctgacacact

SEQ ID NO: 824975 - DNA, 17 bp, Homo sapiens
ctcagaaatgctgtccc

SEQ ID NO: 824976 - DNA, 17 bp, Homo sapiens
ctcagaaatttttattt

SEQ ID NO: 824977 - DNA, 20 bp, Homo sapiens
ctcagaacataaaaaggaac

SEQ ID NO: 824978 - DNA, 16 bp, Homo sapiens
ctcagaacatactgat

SEQ ID NO: 824979 - DNA, 22 bp, Homo sapiens
ctcagaaccttgtcccagccag

SEQ ID NO: 824980 - DNA, 14 bp, Homo sapiens
ctcagaacttgctg

SEQ ID NO: 824981 - DNA, 22 bp, Homo sapiens
ctcagaagagaaatacagctgg

SEQ ID NO: 824982 - DNA, 23 bp, Homo sapiens
ctcagaagagaaatacagctggc

SEQ ID NO: 824983 - DNA, 15 bp, Homo sapiens
ctcagaagcctcgac

SEQ ID NO: 824984 - DNA, 13 bp, Homo sapiens
ctcagaagcctga

SEQ ID NO: 824985 - DNA, 19 bp, Homo sapiens
ctcagaaggtattcctttt

SEQ ID NO: 824986 - DNA, 22 bp, Homo sapiens
ctcagaagtgaaaatcttggag

SEQ ID NO: 824987 - DNA, 19 bp, Homo sapiens
ctcagaataaggcaggcat

SEQ ID NO: 824988 - DNA, 21 bp, Homo sapiens
ctcagaatctaaacgtggtca

SEQ ID NO: 824989 - DNA, 15 bp, Homo sapiens
ctcagaatgttggca

SEQ ID NO: 824990 - DNA, 11 bp, Homo sapiens
ctcagaattcg

SEQ ID NO: 824991 - DNA, 20 bp, Homo sapiens
ctcagaattcggtgtgctgc

SEQ ID NO: 824992 - DNA, 22 bp, Homo sapiens
ctcagaattcggtgtgctgcca

SEQ ID NO: 824993 - DNA, 23 bp, Homo sapiens
ctcagaattcggtgtgctgccaa

SEQ ID NO: 824994 - DNA, 22 bp, Homo sapiens
ctcagacactgccgacatcagc

SEQ ID NO: 824995 - DNA, 14 bp, Homo sapiens
ctcagacatttata

SEQ ID NO: 824996 - DNA, 14 bp, Homo sapiens
ctcagacccaacag

SEQ ID NO: 824997 - DNA, 12 bp, Homo sapiens
ctcagaccccac

SEQ ID NO: 824998 - DNA, 16 bp, Homo sapiens
ctcagaccccacccta

SEQ ID NO: 824999 - DNA, 13 bp, Homo sapiens
ctcagacccccac

SEQ ID NO: 825000 - DNA, 14 bp, Homo sapiens
ctcagacccccact

SEQ ID NO: 825001 - DNA, 15 bp, Homo sapiens
ctcagacccccactc

SEQ ID NO: 825002 - DNA, 13 bp, Homo sapiens
ctcagaccccctc

SEQ ID NO: 825003 - DNA, 20 bp, Homo sapiens
ctcagaccccctcagccttg

SEQ ID NO: 825004 - DNA, 16 bp, Homo sapiens
ctcagactgatttctt

SEQ ID NO: 825005 - DNA, 17 bp, Homo sapiens
ctcagactgatttcttg

SEQ ID NO: 825006 - DNA, 21 bp, Homo sapiens
ctcagacttctattttttaaa

SEQ ID NO: 825007 - DNA, 23 bp, Homo sapiens
ctcagagaatttctaccatttca

SEQ ID NO: 825008 - DNA, 15 bp, Homo sapiens
ctcagagaccagcac

SEQ ID NO: 825009 - DNA, 13 bp, Homo sapiens
ctcagagaccagg

SEQ ID NO: 825010 - DNA, 16 bp, Homo sapiens
ctcagagaccagggct

SEQ ID NO: 825011 - DNA, 11 bp, Homo sapiens
ctcagagccaa

SEQ ID NO: 825012 - DNA, 15 bp, Homo sapiens
ctcagagccacccct

SEQ ID NO: 825013 - DNA, 12 bp, Homo sapiens
ctcagagcccat

SEQ ID NO: 825014 - DNA, 13 bp, Homo sapiens
ctcagagcccatg

SEQ ID NO: 825015 - DNA, 15 bp, Homo sapiens
ctcagagccctgccc

SEQ ID NO: 825016 - DNA, 16 bp, Homo sapiens
ctcagagccctgccct

SEQ ID NO: 825017 - DNA, 16 bp, Homo sapiens
ctcagagcctgacctg

SEQ ID NO: 825018 - DNA, 18 bp, Homo sapiens
ctcagagcctgacctgag

SEQ ID NO: 825019 - DNA, 19 bp, Homo sapiens
ctcagagcctgacctgaga

SEQ ID NO: 825020 - DNA, 15 bp, Homo sapiens
ctcagagccttccat

SEQ ID NO: 825021 - DNA, 18 bp, Homo sapiens
ctcagagcgccaggaagc

SEQ ID NO: 825022 - DNA, 22 bp, Homo sapiens
ctcagagcgccaggaagccaga

SEQ ID NO: 825023 - DNA, 11 bp, Homo sapiens
ctcagagcttt

SEQ ID NO: 825024 - DNA, 22 bp, Homo sapiens
ctcagagctttaaaagtatctt

SEQ ID NO: 825025 - DNA, 21 bp, Homo sapiens
ctcaggaccaaagctttcatg

SEQ ID NO: 825026 - DNA, 13 bp, Homo sapiens
ctcaggacccagg

SEQ ID NO: 825027 - DNA, 15 bp, Homo sapiens
ctcaggacccaggcc

SEQ ID NO: 825028 - DNA, 14 bp, Homo sapiens
ctcaggaccctcag

SEQ ID NO: 825029 - DNA, 14 bp, Homo sapiens
ctcaggacctctgt

SEQ ID NO: 825030 - DNA, 21 bp, Homo sapiens
ctcaggacctctgtaggcagc

SEQ ID NO: 825031 - DNA, 15 bp, Homo sapiens
ctcaggaccttttgg

SEQ ID NO: 825032 - DNA, 16 bp, Homo sapiens
ctcaggactcctctcc

SEQ ID NO: 825033 - DNA, 18 bp, Homo sapiens
ctcaggagagtgtgcaac

SEQ ID NO: 825034 - DNA, 20 bp, Homo sapiens
ctcaggagatggagggcttg

SEQ ID NO: 825035 - DNA, 14 bp, Homo sapiens
ctcaggagcacagg

SEQ ID NO: 825036 - DNA, 18 bp, Homo sapiens
ctcaggagcacaggcagc

SEQ ID NO: 825037 - DNA, 23 bp, Homo sapiens
ctcaggagccgaagcccaggggc

SEQ ID NO: 825038 - DNA, 16 bp, Homo sapiens
ctcaggagcctctgct

SEQ ID NO: 825039 - DNA, 14 bp, Homo sapiens
ctcaggagcttggg

SEQ ID NO: 825040 - DNA, 12 bp, Homo sapiens
ctcaggaggagg

SEQ ID NO: 825041 - DNA, 13 bp, Homo sapiens
ctcaggaggaggc

SEQ ID NO: 825042 - DNA, 24 bp, Homo sapiens
ctcaggaggaggctgccctgaggg

SEQ ID NO: 825043 - DNA, 17 bp, Homo sapiens
ctcaggaggcaggacct

SEQ ID NO: 825044 - DNA, 18 bp, Homo sapiens
ctcaggaggcaggacctt

SEQ ID NO: 825045 - DNA, 19 bp, Homo sapiens
ctcaggaggcgcccttggc

SEQ ID NO: 825046 - DNA, 13 bp, Homo sapiens
ctcaggaggctga

SEQ ID NO: 825047 - DNA, 18 bp, Homo sapiens
ctcaggaggctgaggcac

SEQ ID NO: 825048 - DNA, 14 bp, Homo sapiens
ctcaggagggcagg

SEQ ID NO: 825049 - DNA, 15 bp, Homo sapiens
ctcaggagggcaggc

SEQ ID NO: 825050 - DNA, 24 bp, Homo sapiens
ctcaggagggcaggctgaggtggg

SEQ ID NO: 825051 - DNA, 23 bp, Homo sapiens
ctcaggaggtcaagaccagcctg

SEQ ID NO: 825052 - DNA, 18 bp, Homo sapiens
ctcaggagtttgagacca

SEQ ID NO: 825053 - DNA, 16 bp, Homo sapiens
ctcaggatccagtgac

SEQ ID NO: 825054 - DNA, 14 bp, Homo sapiens
ctcaggcaagcccc

SEQ ID NO: 825055 - DNA, 19 bp, Homo sapiens
ctcaggcaagcccctcagc

SEQ ID NO: 825056 - DNA, 20 bp, Homo sapiens
ctcaggcaagcccctcagcc

SEQ ID NO: 825057 - DNA, 13 bp, Homo sapiens
ctcaggcacacag

SEQ ID NO: 825058 - DNA, 14 bp, Homo sapiens
ctcaggcacacagc

SEQ ID NO: 825059 - DNA, 14 bp, Homo sapiens
ctcaggcagacaag

SEQ ID NO: 825060 - DNA, 19 bp, Homo sapiens
ctcaggcagacaagagctg

SEQ ID NO: 825061 - DNA, 22 bp, Homo sapiens
ctcaggcagcgtgtgggtcccg

SEQ ID NO: 825062 - DNA, 15 bp, Homo sapiens
ctcaggcagctcaag

SEQ ID NO: 825063 - DNA, 20 bp, Homo sapiens
ctcaggcataggcctgggtg

SEQ ID NO: 825064 - DNA, 21 bp, Homo sapiens
ctcaggcataggcctgggtgc

SEQ ID NO: 825065 - DNA, 18 bp, Homo sapiens
ctcaggcatgcctgtgtg

SEQ ID NO: 825066 - DNA, 19 bp, Homo sapiens
ctcaggccacctgccccct

SEQ ID NO: 825067 - DNA, 14 bp, Homo sapiens
ctcaggccattccc

SEQ ID NO: 825068 - DNA, 17 bp, Homo sapiens
ctcaggccattccccaa

SEQ ID NO: 825069 - DNA, 18 bp, Homo sapiens
ctcaggcccagctgctcc

SEQ ID NO: 825070 - DNA, 19 bp, Homo sapiens
ctcaggcccagctgctccc

SEQ ID NO: 825071 - DNA, 17 bp, Homo sapiens
ctcaggcctaggaggcc

SEQ ID NO: 825072 - DNA, 23 bp, Homo sapiens
ctcaggcctataaccccagctcc

SEQ ID NO: 825073 - DNA, 16 bp, Homo sapiens
ctcaggcctccctagc

SEQ ID NO: 825074 - DNA, 15 bp, Homo sapiens
ctcaggctccccaga

SEQ ID NO: 825075 - DNA, 23 bp, Homo sapiens
ctcaggctgcagctggacagagg

SEQ ID NO: 825076 - DNA, 17 bp, Homo sapiens
ctcaggcttccttggca

SEQ ID NO: 825077 - DNA, 19 bp, Homo sapiens
ctcaggcttgagggagggc

SEQ ID NO: 825078 - DNA, 20 bp, Homo sapiens
ctcaggcttgagggagggct

SEQ ID NO: 825079 - DNA, 20 bp, Homo sapiens
ctcagggaaaagcagctctc

SEQ ID NO: 825080 - DNA, 23 bp, Homo sapiens
ctcagggaaaagcagctctcccc

SEQ ID NO: 825081 - DNA, 23 bp, Homo sapiens
ctcagggacagagacacctgcac

SEQ ID NO: 825082 - DNA, 14 bp, Homo sapiens
ctcagggacagagc

SEQ ID NO: 825083 - DNA, 15 bp, Homo sapiens
ctcagggacagagcc

SEQ ID NO: 825084 - DNA, 18 bp, Homo sapiens
ctcagggacagagccatg

SEQ ID NO: 825085 - DNA, 19 bp, Homo sapiens
ctcagggacagagccatgc

SEQ ID NO: 825086 - DNA, 11 bp, Homo sapiens
ctcagggaccg

SEQ ID NO: 825087 - DNA, 17 bp, Homo sapiens
ctcagggaccggtgctg

SEQ ID NO: 825088 - DNA, 21 bp, Homo sapiens
ctcagggaccggtgctgcagg

SEQ ID NO: 825089 - DNA, 19 bp, Homo sapiens
ctcagggagcagggaaggc

SEQ ID NO: 825090 - DNA, 23 bp, Homo sapiens
ctcagggagcagggaaggcctga

SEQ ID NO: 825091 - DNA, 15 bp, Homo sapiens
ctcagggagcctccc

SEQ ID NO: 825092 - DNA, 18 bp, Homo sapiens
ctcagggattctgggctt

SEQ ID NO: 825093 - DNA, 14 bp, Homo sapiens
ctcagggcagacag

SEQ ID NO: 825094 - DNA, 11 bp, Homo sapiens
ctcagggcagc

SEQ ID NO: 825095 - DNA, 20 bp, Homo sapiens
ctcagggcagcgccaggctg

SEQ ID NO: 825096 - DNA, 15 bp, Homo sapiens
ctcagggcagctgcc

SEQ ID NO: 825097 - DNA, 18 bp, Homo sapiens
ctcagggcagctgcctgg

SEQ ID NO: 825098 - DNA, 20 bp, Homo sapiens
ctcagggcagctgcctggcc

SEQ ID NO: 825099 - DNA, 22 bp, Homo sapiens
ctcagggcagctgcctggccat

SEQ ID NO: 825100 - DNA, 15 bp, Homo sapiens
ctcagggccatgctg

SEQ ID NO: 825101 - DNA, 13 bp, Homo sapiens
ctcagggccccag

SEQ ID NO: 825102 - DNA, 16 bp, Homo sapiens
ctcagggccccagcac

SEQ ID NO: 825103 - DNA, 14 bp, Homo sapiens
ctcagggcctggtc

SEQ ID NO: 825104 - DNA, 18 bp, Homo sapiens
ctcagggctcctcccagc

SEQ ID NO: 825105 - DNA, 19 bp, Homo sapiens
ctcagggctcctcccagct

SEQ ID NO: 825106 - DNA, 15 bp, Homo sapiens
ctcagggctcctggg

SEQ ID NO: 825107 - DNA, 10 bp, Homo sapiens
ctcagggctg

SEQ ID NO: 825108 - DNA, 12 bp, Homo sapiens
ctcagggctgga

SEQ ID NO: 825109 - DNA, 19 bp, Homo sapiens
ctcagggctggagcctggg

SEQ ID NO: 825110 - DNA, 15 bp, Homo sapiens
ctcagggctggagtg

SEQ ID NO: 825111 - DNA, 16 bp, Homo sapiens
ctcagggctggagtgc

SEQ ID NO: 825112 - DNA, 22 bp, Homo sapiens
ctcagggctggagtgcgctctt

SEQ ID NO: 825113 - DNA, 13 bp, Homo sapiens
ctcagggctgtcc

SEQ ID NO: 825114 - DNA, 15 bp, Homo sapiens
ctcagggctgtccca

SEQ ID NO: 825115 - DNA, 22 bp, Homo sapiens
ctcagggctgtcccagccccgg

SEQ ID NO: 825116 - DNA, 20 bp, Homo sapiens
ctcaggggacactggcccca

SEQ ID NO: 825117 - DNA, 12 bp, Homo sapiens
ctcaggggaccc

SEQ ID NO: 825118 - DNA, 19 bp, Homo sapiens
ctcaggggaccccactccc

SEQ ID NO: 825119 - DNA, 20 bp, Homo sapiens
ctcaggggaccccactcccc

SEQ ID NO: 825120 - DNA, 14 bp, Homo sapiens
ctcaggggatgttt

SEQ ID NO: 825121 - DNA, 13 bp, Homo sapiens
ctcaggggcacct

SEQ ID NO: 825122 - DNA, 14 bp, Homo sapiens
ctcaggggcacctc

SEQ ID NO: 825123 - DNA, 15 bp, Homo sapiens
ctcaggggcacctcc

SEQ ID NO: 825124 - DNA, 19 bp, Homo sapiens
ctcaggggcacctccggct

SEQ ID NO: 825125 - DNA, 20 bp, Homo sapiens
ctcaggggcacctccggctg

SEQ ID NO: 825126 - DNA, 23 bp, Homo sapiens
ctcaggggcacctccggctgcct

SEQ ID NO: 825127 - DNA, 13 bp, Homo sapiens
ctcaggggcaggt

SEQ ID NO: 825128 - DNA, 15 bp, Homo sapiens
ctcaggggcaggtgg

SEQ ID NO: 825129 - DNA, 15 bp, Homo sapiens
ctcaggggcctctct

SEQ ID NO: 825130 - DNA, 20 bp, Homo sapiens
ctcaggggcctctctcctgc

SEQ ID NO: 825131 - DNA, 17 bp, Homo sapiens
ctcaggggcgtgtggct

SEQ ID NO: 825132 - DNA, 15 bp, Homo sapiens
ctcaggggctgtttg

SEQ ID NO: 825133 - DNA, 13 bp, Homo sapiens
ctcagggggccag

SEQ ID NO: 825134 - DNA, 23 bp, Homo sapiens
ctcagggggccagctggggagat

SEQ ID NO: 825135 - DNA, 20 bp, Homo sapiens
ctcagggggtcagcagagtt

SEQ ID NO: 825136 - DNA, 18 bp, Homo sapiens
ctcaggggtggagaagtg

SEQ ID NO: 825137 - DNA, 16 bp, Homo sapiens
ctcaggggtgtgcctg

SEQ ID NO: 825138 - DNA, 22 bp, Homo sapiens
ctcagggtcaaagacagaatgg

SEQ ID NO: 825139 - DNA, 14 bp, Homo sapiens
ctcagggtcactga

SEQ ID NO: 825140 - DNA, 14 bp, Homo sapiens
ctcagggtcctgcc

SEQ ID NO: 825141 - DNA, 18 bp, Homo sapiens
ctcagggtcctgccctcc

SEQ ID NO: 825142 - DNA, 14 bp, Homo sapiens
ctcagggttggcca

SEQ ID NO: 825143 - DNA, 18 bp, Homo sapiens
ctcaggtagtactgggaa

SEQ ID NO: 825144 - DNA, 13 bp, Homo sapiens
ctcaggtcagctg

SEQ ID NO: 825145 - DNA, 14 bp, Homo sapiens
ctcaggtcagctgg

SEQ ID NO: 825146 - DNA, 19 bp, Homo sapiens
ctcaggtcagctgggagcc

SEQ ID NO: 825147 - DNA, 16 bp, Homo sapiens
ctcatcccacttcctt

SEQ ID NO: 825148 - DNA, 14 bp, Homo sapiens
ctcatccccagggg

SEQ ID NO: 825149 - DNA, 14 bp, Homo sapiens
ctcatccccccacc

SEQ ID NO: 825150 - DNA, 14 bp, Homo sapiens
ctcatcccccctgc

SEQ ID NO: 825151 - DNA, 16 bp, Homo sapiens
ctcatcccccctgctg

SEQ ID NO: 825152 - DNA, 17 bp, Homo sapiens
ctcatcccccctgctgc

SEQ ID NO: 825153 - DNA, 18 bp, Homo sapiens
ctcatcccccctgctgcc

SEQ ID NO: 825154 - DNA, 22 bp, Homo sapiens
ctcatcccctcgtcctgtccca

SEQ ID NO: 825155 - DNA, 22 bp, Homo sapiens
ctcatcccgagcacctccacat

SEQ ID NO: 825156 - DNA, 15 bp, Homo sapiens
ctcatccctcggaag

SEQ ID NO: 825157 - DNA, 18 bp, Homo sapiens
ctcatccctgactggcca

SEQ ID NO: 825158 - DNA, 17 bp, Homo sapiens
ctcatccgaggcagggt

SEQ ID NO: 825159 - DNA, 12 bp, Homo sapiens
ctcatcctcctt

SEQ ID NO: 825160 - DNA, 14 bp, Homo sapiens
ctcatcctcctttc

SEQ ID NO: 825161 - DNA, 15 bp, Homo sapiens
ctcatcctgctcttt

SEQ ID NO: 825162 - DNA, 23 bp, Homo sapiens
ctcatcctgctcttttgtgatga

SEQ ID NO: 825163 - DNA, 15 bp, Homo sapiens
ctcatcctgcttctc

SEQ ID NO: 825164 - DNA, 14 bp, Homo sapiens
ctcatcctttcctc

SEQ ID NO: 825165 - DNA, 14 bp, Homo sapiens
ctcatcgggcccag

SEQ ID NO: 825166 - DNA, 18 bp, Homo sapiens
ctcatcgggcccagggac

SEQ ID NO: 825167 - DNA, 15 bp, Homo sapiens
ctcatctatgaggaa

SEQ ID NO: 825168 - DNA, 12 bp, Homo sapiens
ctcatctcacct

SEQ ID NO: 825169 - DNA, 14 bp, Homo sapiens
ctcatctccaagga

SEQ ID NO: 825170 - DNA, 14 bp, Homo sapiens
ctcatctcctgacc

SEQ ID NO: 825171 - DNA, 16 bp, Homo sapiens
ctcatctcctgaccct

SEQ ID NO: 825172 - DNA, 19 bp, Homo sapiens
ctcatctcctgaccctccc

SEQ ID NO: 825173 - DNA, 12 bp, Homo sapiens
ctcatctctgaa

SEQ ID NO: 825174 - DNA, 14 bp, Homo sapiens
ctcatctctgaaaa

SEQ ID NO: 825175 - DNA, 21 bp, Homo sapiens
ctcatctctggaaggggcagc

SEQ ID NO: 825176 - DNA, 13 bp, Homo sapiens
ctcatctcttcag

SEQ ID NO: 825177 - DNA, 16 bp, Homo sapiens
ctcatctgagaggctc

SEQ ID NO: 825178 - DNA, 21 bp, Homo sapiens
ctcatctgcacccttcttttc

SEQ ID NO: 825179 - DNA, 15 bp, Homo sapiens
ctcatctgctggtcc

SEQ ID NO: 825180 - DNA, 16 bp, Homo sapiens
ctcatctgctggtccg

SEQ ID NO: 825181 - DNA, 15 bp, Homo sapiens
ctcatctgggtctcc

SEQ ID NO: 825182 - DNA, 12 bp, Homo sapiens
ctcatctgtgat

SEQ ID NO: 825183 - DNA, 17 bp, Homo sapiens
ctcatctgtggagctgc

SEQ ID NO: 825184 - DNA, 22 bp, Homo sapiens
ctcatctgtggagctgccacag

SEQ ID NO: 825185 - DNA, 17 bp, Homo sapiens
ctcatcttgttcttccc

SEQ ID NO: 825186 - DNA, 21 bp, Homo sapiens
ctcatgacactgtttggcctt

SEQ ID NO: 825187 - DNA, 10 bp, Homo sapiens
ctcatgagaa

SEQ ID NO: 825188 - DNA, 15 bp, Homo sapiens
ctcatgaggaccagg

SEQ ID NO: 825189 - DNA, 20 bp, Homo sapiens
ctcatgaggaccagggtgga

SEQ ID NO: 825190 - DNA, 22 bp, Homo sapiens
ctcatgatcaagatatatgtgt

SEQ ID NO: 825191 - DNA, 19 bp, Homo sapiens
ctcatgcaaatcaattact

SEQ ID NO: 825192 - DNA, 12 bp, Homo sapiens
ctcatgccacac

SEQ ID NO: 825193 - DNA, 14 bp, Homo sapiens
ctcatgccacacct

SEQ ID NO: 825194 - DNA, 18 bp, Homo sapiens
ctcatgccacaccttctt

SEQ ID NO: 825195 - DNA, 20 bp, Homo sapiens
ctcatgccatggtctttgct

SEQ ID NO: 825196 - DNA, 16 bp, Homo sapiens
ctcatgcccaccccct

SEQ ID NO: 825197 - DNA, 19 bp, Homo sapiens
ctcatgcccaccccctgcc

SEQ ID NO: 825198 - DNA, 23 bp, Homo sapiens
ctcatgccccctttcagatgtct

SEQ ID NO: 825199 - DNA, 16 bp, Homo sapiens
ctcatgcccctggctg

SEQ ID NO: 825200 - DNA, 20 bp, Homo sapiens
ctcatgcttagaaagttcca

SEQ ID NO: 825201 - DNA, 23 bp, Homo sapiens
ctcatgcttcttctcatggggtg

SEQ ID NO: 825202 - DNA, 16 bp, Homo sapiens
ctcatggattgccaca

SEQ ID NO: 825203 - DNA, 18 bp, Homo sapiens
ctcatggattgccacagc

SEQ ID NO: 825204 - DNA, 19 bp, Homo sapiens
ctcatggattgccacagct

SEQ ID NO: 825205 - DNA, 15 bp, Homo sapiens
ctcatggcagctgtt

SEQ ID NO: 825206 - DNA, 21 bp, Homo sapiens
ctcatggcagctgtttctcat

SEQ ID NO: 825207 - DNA, 17 bp, Homo sapiens
ctcatggcccctctgac

SEQ ID NO: 825208 - DNA, 20 bp, Homo sapiens
ctcatggcccctctgacctg

SEQ ID NO: 825209 - DNA, 18 bp, Homo sapiens
ctcatgggacctgccctc

SEQ ID NO: 825210 - DNA, 16 bp, Homo sapiens
ctcatggggtccaagt

SEQ ID NO: 825211 - DNA, 23 bp, Homo sapiens
ctcatgggtcctagcccttccct

SEQ ID NO: 825212 - DNA, 14 bp, Homo sapiens
ctcatgggtggcac

SEQ ID NO: 825213 - DNA, 19 bp, Homo sapiens
ctcatgggtggcactcagt

SEQ ID NO: 825214 - DNA, 17 bp, Homo sapiens
ctcatgtaacattggtg

SEQ ID NO: 825215 - DNA, 18 bp, Homo sapiens
ctcatgtaacattggtga

SEQ ID NO: 825216 - DNA, 17 bp, Homo sapiens
ctcatgtaatgtggtca

SEQ ID NO: 825217 - DNA, 14 bp, Homo sapiens
ctcatgtaatttgc

SEQ ID NO: 825218 - DNA, 16 bp, Homo sapiens
ctcatgtaatttgcat

SEQ ID NO: 825219 - DNA, 19 bp, Homo sapiens
ctcatgtaggtgagcctgg

SEQ ID NO: 825220 - DNA, 21 bp, Homo sapiens
ctcatgtaggtgagcctgggc

SEQ ID NO: 825221 - DNA, 16 bp, Homo sapiens
ctcatgtccctccagg

SEQ ID NO: 825222 - DNA, 19 bp, Homo sapiens
ctcatgtccctgtccccag

SEQ ID NO: 825223 - DNA, 21 bp, Homo sapiens
ctcatgtccctgtccccaggc

SEQ ID NO: 825224 - DNA, 23 bp, Homo sapiens
ctcatgtccctgtccccaggccc

SEQ ID NO: 825225 - DNA, 15 bp, Homo sapiens
ctcatgtggactggg

SEQ ID NO: 825226 - DNA, 12 bp, Homo sapiens
ctcatgtggctg

SEQ ID NO: 825227 - DNA, 14 bp, Homo sapiens
ctcatgtggctgga

SEQ ID NO: 825228 - DNA, 17 bp, Homo sapiens
ctcatgttctcttccca

SEQ ID NO: 825229 - DNA, 23 bp, Homo sapiens
ctcatgttctcttcccaggcctt

SEQ ID NO: 825230 - DNA, 15 bp, Homo sapiens
ctcatgttctgcttt

SEQ ID NO: 825231 - DNA, 12 bp, Homo sapiens
ctcatgttctta

SEQ ID NO: 825232 - DNA, 14 bp, Homo sapiens
ctcatgttgagcca

SEQ ID NO: 825233 - DNA, 20 bp, Homo sapiens
ctcatgttgctgaatttgta

SEQ ID NO: 825234 - DNA, 18 bp, Homo sapiens
ctcatgttttcaactgcc

SEQ ID NO: 825235 - DNA, 21 bp, Homo sapiens
ctcatgttttttccttttcac

SEQ ID NO: 825236 - DNA, 19 bp, Homo sapiens
ctcattaaactctaaagat

SEQ ID NO: 825237 - DNA, 20 bp, Homo sapiens
ctcattaaactctaaagatt

SEQ ID NO: 825238 - DNA, 22 bp, Homo sapiens
ctcattacagttctttcctctt

SEQ ID NO: 825239 - DNA, 17 bp, Homo sapiens
ctcattacttttgaagt

SEQ ID NO: 825240 - DNA, 21 bp, Homo sapiens
ctcattagcattttgctaaat

SEQ ID NO: 825241 - DNA, 16 bp, Homo sapiens
ctcattatgaaaaaca

SEQ ID NO: 825242 - DNA, 18 bp, Homo sapiens
ctcattatgccacttcct

SEQ ID NO: 825243 - DNA, 15 bp, Homo sapiens
ctcattatttgtgtg

SEQ ID NO: 825244 - DNA, 19 bp, Homo sapiens
ctcattcaaaagttgaaat

SEQ ID NO: 825245 - DNA, 19 bp, Homo sapiens
ctcattcagagactgccct

SEQ ID NO: 825246 - DNA, 21 bp, Homo sapiens
ctcattccaccttcccatgcc

SEQ ID NO: 825247 - DNA, 12 bp, Homo sapiens
ctcattccccag

SEQ ID NO: 825248 - DNA, 13 bp, Homo sapiens
ctcattcccctcg

SEQ ID NO: 825249 - DNA, 12 bp, Homo sapiens
ctcattcctgta

SEQ ID NO: 825250 - DNA, 22 bp, Homo sapiens
ctcattcgcctttgtcttgtac

SEQ ID NO: 825251 - DNA, 20 bp, Homo sapiens
ctcattcgtggcatgttttg

SEQ ID NO: 825252 - DNA, 17 bp, Homo sapiens
ctcattctatcggccag

SEQ ID NO: 825253 - DNA, 19 bp, Homo sapiens
ctcattctgaaggagcccc

SEQ ID NO: 825254 - DNA, 19 bp, Homo sapiens
ctcattctttgaacatgaa

SEQ ID NO: 825255 - DNA, 18 bp, Homo sapiens
ctcattgacaagaactga

SEQ ID NO: 825256 - DNA, 15 bp, Homo sapiens
ctcattgcctcctgt

SEQ ID NO: 825257 - DNA, 18 bp, Homo sapiens
ctcattgcctcctgttct

SEQ ID NO: 825258 - DNA, 19 bp, Homo sapiens
ctcattgcctcctgttctg

SEQ ID NO: 825259 - DNA, 16 bp, Homo sapiens
ctcattgctgagcctc

SEQ ID NO: 825260 - DNA, 14 bp, Homo sapiens
ctcattgctgtctt

SEQ ID NO: 825261 - DNA, 18 bp, Homo sapiens
ctcattgctgtcttgccc

SEQ ID NO: 825262 - DNA, 22 bp, Homo sapiens
ctcattgctgtcttgccccagt

SEQ ID NO: 825263 - DNA, 13 bp, Homo sapiens
ctcattgcttctg

SEQ ID NO: 825264 - DNA, 13 bp, Homo sapiens
ctcattggaccct

SEQ ID NO: 825265 - DNA, 21 bp, Homo sapiens
ctcattgtgccaagccttctg

SEQ ID NO: 825266 - DNA, 22 bp, Homo sapiens
ctcattgtgccaagccttctgt

SEQ ID NO: 825267 - DNA, 22 bp, Homo sapiens
ctcatttaagggaaaaatatat

SEQ ID NO: 825268 - DNA, 16 bp, Homo sapiens
ctcatttaatcccagg

SEQ ID NO: 825269 - DNA, 13 bp, Homo sapiens
ctccaccttctca

SEQ ID NO: 825270 - DNA, 16 bp, Homo sapiens
ctccaccttgctcttc

SEQ ID NO: 825271 - DNA, 14 bp, Homo sapiens
ctccacgccactgc

SEQ ID NO: 825272 - DNA, 15 bp, Homo sapiens
ctccacgccactgcc

SEQ ID NO: 825273 - DNA, 18 bp, Homo sapiens
ctccacgccactgcctcc

SEQ ID NO: 825274 - DNA, 16 bp, Homo sapiens
ctccacgcctcctggc

SEQ ID NO: 825275 - DNA, 21 bp, Homo sapiens
ctccacggtagcacttgacct

SEQ ID NO: 825276 - DNA, 23 bp, Homo sapiens
ctccacggtgcgtggctgtggca

SEQ ID NO: 825277 - DNA, 14 bp, Homo sapiens
ctccacgtctttcc

SEQ ID NO: 825278 - DNA, 21 bp, Homo sapiens
ctccacgtgatttccagtgag

SEQ ID NO: 825279 - DNA, 24 bp, Homo sapiens
ctccacgtgtccgtccacccttcc

SEQ ID NO: 825280 - DNA, 17 bp, Homo sapiens
ctccacgttctgctcat

SEQ ID NO: 825281 - DNA, 18 bp, Homo sapiens
ctccacgttctgctcatc

SEQ ID NO: 825282 - DNA, 17 bp, Homo sapiens
ctccactcactccagcc

SEQ ID NO: 825283 - DNA, 14 bp, Homo sapiens
ctccactcagctgt

SEQ ID NO: 825284 - DNA, 15 bp, Homo sapiens
ctccactcagctgtc

SEQ ID NO: 825285 - DNA, 13 bp, Homo sapiens
ctccactccccca

SEQ ID NO: 825286 - DNA, 13 bp, Homo sapiens
ctccactcctctc

SEQ ID NO: 825287 - DNA, 15 bp, Homo sapiens
ctccactcctctcaa

SEQ ID NO: 825288 - DNA, 20 bp, Homo sapiens
ctccactcctctcaactgcc

SEQ ID NO: 825289 - DNA, 18 bp, Homo sapiens
ctccactctagttctaga

SEQ ID NO: 825290 - DNA, 13 bp, Homo sapiens
ctccactctcctt

SEQ ID NO: 825291 - DNA, 22 bp, Homo sapiens
ctccactctccttcgtgtctct

SEQ ID NO: 825292 - DNA, 19 bp, Homo sapiens
ctccactctgattcacctc

SEQ ID NO: 825293 - DNA, 12 bp, Homo sapiens
ctccactctgct

SEQ ID NO: 825294 - DNA, 14 bp, Homo sapiens
ctccactctgcttc

SEQ ID NO: 825295 - DNA, 20 bp, Homo sapiens
ctccactctgcttctctgac

SEQ ID NO: 825296 - DNA, 19 bp, Homo sapiens
ctccactctgtatctatgc

SEQ ID NO: 825297 - DNA, 13 bp, Homo sapiens
ctccactcttctc

SEQ ID NO: 825298 - DNA, 15 bp, Homo sapiens
ctccactcttctctc

SEQ ID NO: 825299 - DNA, 17 bp, Homo sapiens
ctccactcttctctcct

SEQ ID NO: 825300 - DNA, 12 bp, Homo sapiens
ctccactgccct

SEQ ID NO: 825301 - DNA, 14 bp, Homo sapiens
ctccactgccctgg

SEQ ID NO: 825302 - DNA, 15 bp, Homo sapiens
ctccactgccctggc

SEQ ID NO: 825303 - DNA, 17 bp, Homo sapiens
ctccactgccctggcag

SEQ ID NO: 825304 - DNA, 19 bp, Homo sapiens
ctccactgccctggcagca

SEQ ID NO: 825305 - DNA, 21 bp, Homo sapiens
ctccactgccctggcagcagc

SEQ ID NO: 825306 - DNA, 11 bp, Homo sapiens
ctccactgcct

SEQ ID NO: 825307 - DNA, 16 bp, Homo sapiens
ctccactgcctctgga

SEQ ID NO: 825308 - DNA, 13 bp, Homo sapiens
ctccactgtcacc

SEQ ID NO: 825309 - DNA, 18 bp, Homo sapiens
ctccactgtcaccctcca

SEQ ID NO: 825310 - DNA, 21 bp, Homo sapiens
ctccacttcttgttccccact

SEQ ID NO: 825311 - DNA, 15 bp, Homo sapiens
ctccacttgaagcac

SEQ ID NO: 825312 - DNA, 15 bp, Homo sapiens
ctccagaagatagct

SEQ ID NO: 825313 - DNA, 17 bp, Homo sapiens
ctccagaagatgccagc

SEQ ID NO: 825314 - DNA, 22 bp, Homo sapiens
ctccagaagatgccagcttctc

SEQ ID NO: 825315 - DNA, 15 bp, Homo sapiens
ctccagaagcctctg

SEQ ID NO: 825316 - DNA, 16 bp, Homo sapiens
ctccagaagcctctgg

SEQ ID NO: 825317 - DNA, 21 bp, Homo sapiens
ctccagaagcctctggctaga

SEQ ID NO: 825318 - DNA, 13 bp, Homo sapiens
ctccagaagctgc

SEQ ID NO: 825319 - DNA, 15 bp, Homo sapiens
ctccagaagctgctc

SEQ ID NO: 825320 - DNA, 21 bp, Homo sapiens
ctccagaataccttcttcgct

SEQ ID NO: 825321 - DNA, 15 bp, Homo sapiens
ctccagaatctgctg

SEQ ID NO: 825322 - DNA, 16 bp, Homo sapiens
ctccagaatctgctgt

SEQ ID NO: 825323 - DNA, 20 bp, Homo sapiens
ctccagaatctgctgttgcc

SEQ ID NO: 825324 - DNA, 21 bp, Homo sapiens
ctccagaatctgctgttgcca

SEQ ID NO: 825325 - DNA, 17 bp, Homo sapiens
ctccagaatttggaaat

SEQ ID NO: 825326 - DNA, 18 bp, Homo sapiens
ctccagaatttggaaatc

SEQ ID NO: 825327 - DNA, 19 bp, Homo sapiens
ctccagaatttggaaatcc

SEQ ID NO: 825328 - DNA, 20 bp, Homo sapiens
ctccagaatttggaaatcct

SEQ ID NO: 825329 - DNA, 16 bp, Homo sapiens
ctccagaccaccagcc

SEQ ID NO: 825330 - DNA, 12 bp, Homo sapiens
ctccagacccag

SEQ ID NO: 825331 - DNA, 13 bp, Homo sapiens
ctccagacccaga

SEQ ID NO: 825332 - DNA, 21 bp, Homo sapiens
ctccagacccagaggccctga

SEQ ID NO: 825333 - DNA, 19 bp, Homo sapiens
ctccagacccctggctttt

SEQ ID NO: 825334 - DNA, 23 bp, Homo sapiens
ctccagactaacatgtcagtttt

SEQ ID NO: 825335 - DNA, 16 bp, Homo sapiens
ctccagactcacttgc

SEQ ID NO: 825336 - DNA, 13 bp, Homo sapiens
ctccagagaagcc

SEQ ID NO: 825337 - DNA, 14 bp, Homo sapiens
ctccagagaagccc

SEQ ID NO: 825338 - DNA, 18 bp, Homo sapiens
ctccagagaagccccgca

SEQ ID NO: 825339 - DNA, 18 bp, Homo sapiens
ctccagagaagtttcgag

SEQ ID NO: 825340 - DNA, 18 bp, Homo sapiens
ctccagagacagggaaag

SEQ ID NO: 825341 - DNA, 13 bp, Homo sapiens
ctccagagccagc

SEQ ID NO: 825342 - DNA, 14 bp, Homo sapiens
ctccagagccagcc

SEQ ID NO: 825343 - DNA, 16 bp, Homo sapiens
ctccagagccagcctg

SEQ ID NO: 825344 - DNA, 14 bp, Homo sapiens
ctccagaggtcctc

SEQ ID NO: 825345 - DNA, 17 bp, Homo sapiens
ctccagaggtggaggtg

SEQ ID NO: 825346 - DNA, 17 bp, Homo sapiens
ctccagagtctgagccc

SEQ ID NO: 825347 - DNA, 19 bp, Homo sapiens
ctccagagtctgagccccc

SEQ ID NO: 825348 - DNA, 17 bp, Homo sapiens
ctccagataactctctt

SEQ ID NO: 825349 - DNA, 18 bp, Homo sapiens
ctccagataactctcttt

SEQ ID NO: 825350 - DNA, 19 bp, Homo sapiens
ctccagataactctctttc

SEQ ID NO: 825351 - DNA, 21 bp, Homo sapiens
ctccagataactctctttcct

SEQ ID NO: 825352 - DNA, 15 bp, Homo sapiens
ctccagatagagaaa

SEQ ID NO: 825353 - DNA, 21 bp, Homo sapiens
ctccagatagctcatttcatt

SEQ ID NO: 825354 - DNA, 17 bp, Homo sapiens
ctccagatgcagggcag

SEQ ID NO: 825355 - DNA, 18 bp, Homo sapiens
ctccagatgcagggcagt

SEQ ID NO: 825356 - DNA, 19 bp, Homo sapiens
ctccagatgtttccagact

SEQ ID NO: 825357 - DNA, 22 bp, Homo sapiens
ctccagattagagcctgtaaac

SEQ ID NO: 825358 - DNA, 13 bp, Homo sapiens
ctccagattctga

SEQ ID NO: 825359 - DNA, 15 bp, Homo sapiens
ctccagattctgatg

SEQ ID NO: 825360 - DNA, 16 bp, Homo sapiens
ctccagattctgatgc

SEQ ID NO: 825361 - DNA, 17 bp, Homo sapiens
ctccagattctgatgca

SEQ ID NO: 825362 - DNA, 17 bp, Homo sapiens
ctccagcaactgccctt

SEQ ID NO: 825363 - DNA, 19 bp, Homo sapiens
ctccagcaactgcccttcc

SEQ ID NO: 825364 - DNA, 20 bp, Homo sapiens
ctccagcaactgcccttcca

SEQ ID NO: 825365 - DNA, 21 bp, Homo sapiens
ctccagcaacttcttctccat

SEQ ID NO: 825366 - DNA, 20 bp, Homo sapiens
ctccagcacctgtggctgac

SEQ ID NO: 825367 - DNA, 13 bp, Homo sapiens
ctccagcaccttc

SEQ ID NO: 825368 - DNA, 16 bp, Homo sapiens
ctccagcatccagcct

SEQ ID NO: 825369 - DNA, 13 bp, Homo sapiens
ctccagccaaaga

SEQ ID NO: 825370 - DNA, 20 bp, Homo sapiens
ctccagccaaagaaatgggc

SEQ ID NO: 825371 - DNA, 13 bp, Homo sapiens
ctccagccaaccc

SEQ ID NO: 825372 - DNA, 17 bp, Homo sapiens
ctccagccaacccctgt

SEQ ID NO: 825373 - DNA, 18 bp, Homo sapiens
ctccagccaacccctgtg

SEQ ID NO: 825374 - DNA, 23 bp, Homo sapiens
ctccagccagcaatgatgtccag

SEQ ID NO: 825375 - DNA, 13 bp, Homo sapiens
ctccagccagcgc

SEQ ID NO: 825376 - DNA, 20 bp, Homo sapiens
ctccagccagcgcctccctc

SEQ ID NO: 825377 - DNA, 20 bp, Homo sapiens
ctccagccatcaagagactg

SEQ ID NO: 825378 - DNA, 21 bp, Homo sapiens
ctccagccatcaagagactga

SEQ ID NO: 825379 - DNA, 22 bp, Homo sapiens
ctccagcccctcttggagaagt

SEQ ID NO: 825380 - DNA, 22 bp, Homo sapiens
ctccagcccctggacccctggg

SEQ ID NO: 825381 - DNA, 17 bp, Homo sapiens
ctccagcccctgtccca

SEQ ID NO: 825382 - DNA, 16 bp, Homo sapiens
ctccagcccgggagcc

SEQ ID NO: 825383 - DNA, 13 bp, Homo sapiens
ctccagccctgcc

SEQ ID NO: 825384 - DNA, 18 bp, Homo sapiens
ctccagcccttcagacga

SEQ ID NO: 825385 - DNA, 13 bp, Homo sapiens
ctccagcctcccc

SEQ ID NO: 825386 - DNA, 16 bp, Homo sapiens
ctccagcctcccctcc

SEQ ID NO: 825387 - DNA, 23 bp, Homo sapiens
ctccagcctcccctcccctgggg

SEQ ID NO: 825388 - DNA, 14 bp, Homo sapiens
ctccagcctccctg

SEQ ID NO: 825389 - DNA, 19 bp, Homo sapiens
ctccagcctccctgtctcc

SEQ ID NO: 825390 - DNA, 20 bp, Homo sapiens
ctccagcctctcccggctgc

SEQ ID NO: 825391 - DNA, 14 bp, Homo sapiens
ctcccagctgcact

SEQ ID NO: 825392 - DNA, 15 bp, Homo sapiens
ctcccagctgcttta

SEQ ID NO: 825393 - DNA, 17 bp, Homo sapiens
ctcccagctgctttact

SEQ ID NO: 825394 - DNA, 17 bp, Homo sapiens
ctcccagctgtgctgtg

SEQ ID NO: 825395 - DNA, 18 bp, Homo sapiens
ctcccagcttgtaggagc

SEQ ID NO: 825396 - DNA, 20 bp, Homo sapiens
ctcccagcttgtaggagctg

SEQ ID NO: 825397 - DNA, 19 bp, Homo sapiens
ctcccaggcgccccttccc

SEQ ID NO: 825398 - DNA, 12 bp, Homo sapiens
ctcccagggagt

SEQ ID NO: 825399 - DNA, 16 bp, Homo sapiens
ctcccagggagtgagc

SEQ ID NO: 825400 - DNA, 20 bp, Homo sapiens
ctcccagggagtgagcagct

SEQ ID NO: 825401 - DNA, 22 bp, Homo sapiens
ctcccagggagtgagcagctac

SEQ ID NO: 825402 - DNA, 24 bp, Homo sapiens
ctcccagggagtgagcagctactg

SEQ ID NO: 825403 - DNA, 11 bp, Homo sapiens
ctcccagggat

SEQ ID NO: 825404 - DNA, 17 bp, Homo sapiens
ctcccagggcctcctgg

SEQ ID NO: 825405 - DNA, 22 bp, Homo sapiens
ctcccaggggagccagctgctt

SEQ ID NO: 825406 - DNA, 20 bp, Homo sapiens
ctcccaggggtctccctggc

SEQ ID NO: 825407 - DNA, 21 bp, Homo sapiens
ctcccaggggtctccctggct

SEQ ID NO: 825408 - DNA, 23 bp, Homo sapiens
ctcccaggggtctccctggctcc

SEQ ID NO: 825409 - DNA, 10 bp, Homo sapiens
ctcccagggt

SEQ ID NO: 825410 - DNA, 12 bp, Homo sapiens
ctcccagggtgg

SEQ ID NO: 825411 - DNA, 13 bp, Homo sapiens
ctcccagggtgga

SEQ ID NO: 825412 - DNA, 22 bp, Homo sapiens
ctcccaggtggattttgtggag

SEQ ID NO: 825413 - DNA, 19 bp, Homo sapiens
ctcccagtcctccagacca

SEQ ID NO: 825414 - DNA, 13 bp, Homo sapiens
ctcccagtctctg

SEQ ID NO: 825415 - DNA, 15 bp, Homo sapiens
ctcccagtgaactcc

SEQ ID NO: 825416 - DNA, 13 bp, Homo sapiens
ctcccagtgggtg

SEQ ID NO: 825417 - DNA, 23 bp, Homo sapiens
ctcccatcattacccttccctgc

SEQ ID NO: 825418 - DNA, 14 bp, Homo sapiens
ctcccatccagcgt

SEQ ID NO: 825419 - DNA, 17 bp, Homo sapiens
ctcccatccagcgtctg

SEQ ID NO: 825420 - DNA, 22 bp, Homo sapiens
ctcccatccagggcccccatct

SEQ ID NO: 825421 - DNA, 12 bp, Homo sapiens
ctcccatccccc

SEQ ID NO: 825422 - DNA, 18 bp, Homo sapiens
ctcccatccccctgccct

SEQ ID NO: 825423 - DNA, 24 bp, Homo sapiens
ctcccatccccctgccctcgtggc

SEQ ID NO: 825424 - DNA, 17 bp, Homo sapiens
ctcccatcccctcaaca

SEQ ID NO: 825425 - DNA, 13 bp, Homo sapiens
ctcccatcccctg

SEQ ID NO: 825426 - DNA, 13 bp, Homo sapiens
ctcccatcctcca

SEQ ID NO: 825427 - DNA, 15 bp, Homo sapiens
ctcccatcctccagc

SEQ ID NO: 825428 - DNA, 15 bp, Homo sapiens
ctcccatcctgatcc

SEQ ID NO: 825429 - DNA, 19 bp, Homo sapiens
ctcccatcctgatcccaga

SEQ ID NO: 825430 - DNA, 17 bp, Homo sapiens
ctcccatcctggggcag

SEQ ID NO: 825431 - DNA, 18 bp, Homo sapiens
ctcccatcctggggcagc

SEQ ID NO: 825432 - DNA, 12 bp, Homo sapiens
ctcccatctcct

SEQ ID NO: 825433 - DNA, 20 bp, Homo sapiens
ctcccatcttggcctcccag

SEQ ID NO: 825434 - DNA, 16 bp, Homo sapiens
ctcccatgaccatact

SEQ ID NO: 825435 - DNA, 15 bp, Homo sapiens
ctcccatgcctggtc

SEQ ID NO: 825436 - DNA, 21 bp, Homo sapiens
ctcccatgcctggtcccaaga

SEQ ID NO: 825437 - DNA, 21 bp, Homo sapiens
ctcccatgttgcatgcctatg

SEQ ID NO: 825438 - DNA, 19 bp, Homo sapiens
ctcccattcactcttccag

SEQ ID NO: 825439 - DNA, 22 bp, Homo sapiens
ctccccaaaagaaaccatgaca

SEQ ID NO: 825440 - DNA, 16 bp, Homo sapiens
ctccccaaatggctgc

SEQ ID NO: 825441 - DNA, 17 bp, Homo sapiens
ctccccaaatggctgct

SEQ ID NO: 825442 - DNA, 21 bp, Homo sapiens
ctccccaacacctgcctctga

SEQ ID NO: 825443 - DNA, 23 bp, Homo sapiens
ctccccaacacctgcctctgacc

SEQ ID NO: 825444 - DNA, 14 bp, Homo sapiens
ctccccaaccctgc

SEQ ID NO: 825445 - DNA, 18 bp, Homo sapiens
ctccccaacttgagcctg

SEQ ID NO: 825446 - DNA, 20 bp, Homo sapiens
ctccccaaggatgaccacac

SEQ ID NO: 825447 - DNA, 13 bp, Homo sapiens
ctccccaatcacg

SEQ ID NO: 825448 - DNA, 19 bp, Homo sapiens
ctccccaatccatgcttca

SEQ ID NO: 825449 - DNA, 17 bp, Homo sapiens
ctccccacacacaggcc

SEQ ID NO: 825450 - DNA, 21 bp, Homo sapiens
ctccccacactaacctgggtt

SEQ ID NO: 825451 - DNA, 20 bp, Homo sapiens
ctccccacactccactctga

SEQ ID NO: 825452 - DNA, 11 bp, Homo sapiens
ctccccacagc

SEQ ID NO: 825453 - DNA, 19 bp, Homo sapiens
ctccccacagctttgcacc

SEQ ID NO: 825454 - DNA, 20 bp, Homo sapiens
ctccccacagctttgcaccc

SEQ ID NO: 825455 - DNA, 16 bp, Homo sapiens
ctccccacccaagaga

SEQ ID NO: 825456 - DNA, 20 bp, Homo sapiens
ctccccacccaagagaggaa

SEQ ID NO: 825457 - DNA, 17 bp, Homo sapiens
ctccccaccccagtggg

SEQ ID NO: 825458 - DNA, 12 bp, Homo sapiens
ctccccacccct

SEQ ID NO: 825459 - DNA, 20 bp, Homo sapiens
ctccccaccctcctcttgga

SEQ ID NO: 825460 - DNA, 11 bp, Homo sapiens
ctccccacctg

SEQ ID NO: 825461 - DNA, 13 bp, Homo sapiens
ctccccacctgga

SEQ ID NO: 825462 - DNA, 19 bp, Homo sapiens
ctccccacctggacacaca

SEQ ID NO: 825463 - DNA, 21 bp, Homo sapiens
ctccccaccttcaattcctgg

SEQ ID NO: 825464 - DNA, 23 bp, Homo sapiens
ctccccaccttcaattcctgggc

SEQ ID NO: 825465 - DNA, 24 bp, Homo sapiens
ctccccacgagtcacctgcaagcc

SEQ ID NO: 825466 - DNA, 14 bp, Homo sapiens
ctccccactccacc

SEQ ID NO: 825467 - DNA, 18 bp, Homo sapiens
ctccccactccaccctgt

SEQ ID NO: 825468 - DNA, 13 bp, Homo sapiens
ctccccagaactg

SEQ ID NO: 825469 - DNA, 17 bp, Homo sapiens
ctccccagagcactggg

SEQ ID NO: 825470 - DNA, 22 bp, Homo sapiens
ctccccagagctgtgccagcag

SEQ ID NO: 825471 - DNA, 23 bp, Homo sapiens
ctccccagagctgtgccagcagg

SEQ ID NO: 825472 - DNA, 14 bp, Homo sapiens
ctccccagccagcc

SEQ ID NO: 825473 - DNA, 16 bp, Homo sapiens
ctccccagccagccct

SEQ ID NO: 825474 - DNA, 15 bp, Homo sapiens
ctccccagcccaggg

SEQ ID NO: 825475 - DNA, 13 bp, Homo sapiens
ctccccagccctg

SEQ ID NO: 825476 - DNA, 16 bp, Homo sapiens
ctccccagccctggct

SEQ ID NO: 825477 - DNA, 17 bp, Homo sapiens
ctccccagctcccttgg

SEQ ID NO: 825478 - DNA, 12 bp, Homo sapiens
ctccccaggcca

SEQ ID NO: 825479 - DNA, 15 bp, Homo sapiens
ctccccaggccaggc

SEQ ID NO: 825480 - DNA, 17 bp, Homo sapiens
ctccccaggccaggcca

SEQ ID NO: 825481 - DNA, 21 bp, Homo sapiens
ctccccaggccaggccaccag

SEQ ID NO: 825482 - DNA, 18 bp, Homo sapiens
ctccccaggcctccagcc

SEQ ID NO: 825483 - DNA, 20 bp, Homo sapiens
ctccccaggcctccagcctc

SEQ ID NO: 825484 - DNA, 16 bp, Homo sapiens
ctccccaggctggaga

SEQ ID NO: 825485 - DNA, 22 bp, Homo sapiens
ctccccagggagctctggggac

SEQ ID NO: 825486 - DNA, 11 bp, Homo sapiens
ctccccagggg

SEQ ID NO: 825487 - DNA, 21 bp, Homo sapiens
ctccccaggtccagctctgga

SEQ ID NO: 825488 - DNA, 15 bp, Homo sapiens
ctccccagtgcctgc

SEQ ID NO: 825489 - DNA, 16 bp, Homo sapiens
ctccccagtgcctgcc

SEQ ID NO: 825490 - DNA, 20 bp, Homo sapiens
ctccccagtgcctgccactc

SEQ ID NO: 825491 - DNA, 21 bp, Homo sapiens
ctccccagtgcctgccactct

SEQ ID NO: 825492 - DNA, 12 bp, Homo sapiens
ctccccatacac

SEQ ID NO: 825493 - DNA, 15 bp, Homo sapiens
ctccccatacacaca

SEQ ID NO: 825494 - DNA, 21 bp, Homo sapiens
ctccccatacacacacaaacc

SEQ ID NO: 825495 - DNA, 14 bp, Homo sapiens
ctccccatcccatg

SEQ ID NO: 825496 - DNA, 22 bp, Homo sapiens
ctccccatctcggggctgctgt

SEQ ID NO: 825497 - DNA, 15 bp, Homo sapiens
ctccccatctgtcca

SEQ ID NO: 825498 - DNA, 21 bp, Homo sapiens
ctccccattagagtcagcctt

SEQ ID NO: 825499 - DNA, 18 bp, Homo sapiens
ctccccatttcccatctg

SEQ ID NO: 825500 - DNA, 20 bp, Homo sapiens
ctccccatttcccatctgca

SEQ ID NO: 825501 - DNA, 18 bp, Homo sapiens
ctcccccaaccccctgca

SEQ ID NO: 825502 - DNA, 19 bp, Homo sapiens
ctcccccaccactcaggcc

SEQ ID NO: 825503 - DNA, 19 bp, Homo sapiens
ctcccccaccccctcccca

SEQ ID NO: 825504 - DNA, 11 bp, Homo sapiens
ctcccccagag

SEQ ID NO: 825505 - DNA, 13 bp, Homo sapiens
ctcccccagcaca

SEQ ID NO: 825506 - DNA, 12 bp, Homo sapiens
ctcccccagcag

SEQ ID NO: 825507 - DNA, 12 bp, Homo sapiens
ctcccccagctc

SEQ ID NO: 825508 - DNA, 16 bp, Homo sapiens
ctcccccagctccttg

SEQ ID NO: 825509 - DNA, 19 bp, Homo sapiens
ctcccccatagcaccctgc

SEQ ID NO: 825510 - DNA, 15 bp, Homo sapiens
ctcccccatgggctg

SEQ ID NO: 825511 - DNA, 23 bp, Homo sapiens
ctcccccatgggggtgagaccct

SEQ ID NO: 825512 - DNA, 14 bp, Homo sapiens
ctccccccactgca

SEQ ID NO: 825513 - DNA, 19 bp, Homo sapiens
ctcccgtagtctcctgggt

SEQ ID NO: 825514 - DNA, 19 bp, Homo sapiens
ctcccgtcagggcccaagt

SEQ ID NO: 825515 - DNA, 20 bp, Homo sapiens
ctccctaaactttggccttt

SEQ ID NO: 825516 - DNA, 18 bp, Homo sapiens
ctccctaatttatgtgct

SEQ ID NO: 825517 - DNA, 18 bp, Homo sapiens
ctccctacattccccaga

SEQ ID NO: 825518 - DNA, 22 bp, Homo sapiens
ctccctaccaaaaattgccaag

SEQ ID NO: 825519 - DNA, 15 bp, Homo sapiens
ctccctaccctcgga

SEQ ID NO: 825520 - DNA, 16 bp, Homo sapiens
ctccctaccctcggaa

SEQ ID NO: 825521 - DNA, 19 bp, Homo sapiens
ctccctacctccctcctca

SEQ ID NO: 825522 - DNA, 18 bp, Homo sapiens
ctccctactcccctgggc

SEQ ID NO: 825523 - DNA, 14 bp, Homo sapiens
ctccctagcccttc

SEQ ID NO: 825524 - DNA, 22 bp, Homo sapiens
ctccctagcccttccagcctgg

SEQ ID NO: 825525 - DNA, 22 bp, Homo sapiens
ctccctatatgcacccctggaa

SEQ ID NO: 825526 - DNA, 17 bp, Homo sapiens
ctccctcacccccaggt

SEQ ID NO: 825527 - DNA, 18 bp, Homo sapiens
ctccctcacccccaggtg

SEQ ID NO: 825528 - DNA, 13 bp, Homo sapiens
ctccctcagcccc

SEQ ID NO: 825529 - DNA, 19 bp, Homo sapiens
ctccctcagcccccaggat

SEQ ID NO: 825530 - DNA, 21 bp, Homo sapiens
ctccctcagccgtcagccatc

SEQ ID NO: 825531 - DNA, 13 bp, Homo sapiens
ctccctcagcctc

SEQ ID NO: 825532 - DNA, 15 bp, Homo sapiens
ctccctcagcctccc

SEQ ID NO: 825533 - DNA, 14 bp, Homo sapiens
ctccctcagcggag

SEQ ID NO: 825534 - DNA, 10 bp, Homo sapiens
ctccctcagg

SEQ ID NO: 825535 - DNA, 14 bp, Homo sapiens
ctccctcagtgccc

SEQ ID NO: 825536 - DNA, 23 bp, Homo sapiens
ctccctcagtgccctcattttat

SEQ ID NO: 825537 - DNA, 14 bp, Homo sapiens
ctccctcatggctc

SEQ ID NO: 825538 - DNA, 13 bp, Homo sapiens
ctccctcattcat

SEQ ID NO: 825539 - DNA, 19 bp, Homo sapiens
ctccctcattcatcttgca

SEQ ID NO: 825540 - DNA, 12 bp, Homo sapiens
ctccctccaagc

SEQ ID NO: 825541 - DNA, 16 bp, Homo sapiens
ctccctccaagcctgg

SEQ ID NO: 825542 - DNA, 18 bp, Homo sapiens
ctccctccaattccccct

SEQ ID NO: 825543 - DNA, 23 bp, Homo sapiens
ctccctccaattcccccttaaac

SEQ ID NO: 825544 - DNA, 13 bp, Homo sapiens
ctccctccaccag

SEQ ID NO: 825545 - DNA, 14 bp, Homo sapiens
ctccctccaccagc

SEQ ID NO: 825546 - DNA, 16 bp, Homo sapiens
ctccctccaccagcct

SEQ ID NO: 825547 - DNA, 13 bp, Homo sapiens
ctccctccacccc

SEQ ID NO: 825548 - DNA, 14 bp, Homo sapiens
ctccctccacccca

SEQ ID NO: 825549 - DNA, 19 bp, Homo sapiens
ctccctccaccccaggacg

SEQ ID NO: 825550 - DNA, 15 bp, Homo sapiens
ctccctccacctcaa

SEQ ID NO: 825551 - DNA, 16 bp, Homo sapiens
ctccctccacctcaag

SEQ ID NO: 825552 - DNA, 12 bp, Homo sapiens
ctccctcccagc

SEQ ID NO: 825553 - DNA, 20 bp, Homo sapiens
ctccctcccagcgctctggg

SEQ ID NO: 825554 - DNA, 17 bp, Homo sapiens
ctccctccccagctccg

SEQ ID NO: 825555 - DNA, 17 bp, Homo sapiens
ctccctcccctctcaga

SEQ ID NO: 825556 - DNA, 18 bp, Homo sapiens
ctccctcccctctcagaa

SEQ ID NO: 825557 - DNA, 14 bp, Homo sapiens
ctccctcccctgcc

SEQ ID NO: 825558 - DNA, 18 bp, Homo sapiens
ctccctcccctgccattt

SEQ ID NO: 825559 - DNA, 18 bp, Homo sapiens
ctccctcccctgccctgg

SEQ ID NO: 825560 - DNA, 21 bp, Homo sapiens
ctccctcccctgccctggtcc

SEQ ID NO: 825561 - DNA, 23 bp, Homo sapiens
ctccctcccctgccctggtccag

SEQ ID NO: 825562 - DNA, 13 bp, Homo sapiens
ctccctccctagc

SEQ ID NO: 825563 - DNA, 16 bp, Homo sapiens
ctccctccctagccct

SEQ ID NO: 825564 - DNA, 17 bp, Homo sapiens
ctccctccctagccctt

SEQ ID NO: 825565 - DNA, 21 bp, Homo sapiens
ctccctccgatccttcctccc

SEQ ID NO: 825566 - DNA, 14 bp, Homo sapiens
ctccctccgcctcc

SEQ ID NO: 825567 - DNA, 19 bp, Homo sapiens
ctccctccgcctcccatcc

SEQ ID NO: 825568 - DNA, 14 bp, Homo sapiens
ctccctcctcacct

SEQ ID NO: 825569 - DNA, 17 bp, Homo sapiens
ctccctcctcacctctg

SEQ ID NO: 825570 - DNA, 19 bp, Homo sapiens
ctccctcctcacctctgga

SEQ ID NO: 825571 - DNA, 13 bp, Homo sapiens
ctccctcctcagg

SEQ ID NO: 825572 - DNA, 14 bp, Homo sapiens
ctccctcctccagg

SEQ ID NO: 825573 - DNA, 12 bp, Homo sapiens
ctccctcctgga

SEQ ID NO: 825574 - DNA, 22 bp, Homo sapiens
ctccctcctggagcatcccagg

SEQ ID NO: 825575 - DNA, 15 bp, Homo sapiens
ctccctcggccccac

SEQ ID NO: 825576 - DNA, 17 bp, Homo sapiens
ctccctcgggggctctt

SEQ ID NO: 825577 - DNA, 11 bp, Homo sapiens
ctccctcgtgg

SEQ ID NO: 825578 - DNA, 22 bp, Homo sapiens
ctccctctactcttcctgtcct

SEQ ID NO: 825579 - DNA, 16 bp, Homo sapiens
ctccctctcatgtccc

SEQ ID NO: 825580 - DNA, 21 bp, Homo sapiens
ctccctctcatgtccctccag

SEQ ID NO: 825581 - DNA, 22 bp, Homo sapiens
ctccctctcatgtccctccagg

SEQ ID NO: 825582 - DNA, 12 bp, Homo sapiens
ctccctctcctg

SEQ ID NO: 825583 - DNA, 13 bp, Homo sapiens
ctccctctcctgc

SEQ ID NO: 825584 - DNA, 14 bp, Homo sapiens
ctccctctcctgcc

SEQ ID NO: 825585 - DNA, 11 bp, Homo sapiens
ctccctctctc

SEQ ID NO: 825586 - DNA, 18 bp, Homo sapiens
ctccctctcttccgggag

SEQ ID NO: 825587 - DNA, 20 bp, Homo sapiens
ctccctctcttccgggagct

SEQ ID NO: 825588 - DNA, 13 bp, Homo sapiens
ctccctctgacct

SEQ ID NO: 825589 - DNA, 14 bp, Homo sapiens
ctccctctgacctg

SEQ ID NO: 825590 - DNA, 23 bp, Homo sapiens
ctccctctgccccaagcagccag

SEQ ID NO: 825591 - DNA, 11 bp, Homo sapiens
ctccctctgga

SEQ ID NO: 825592 - DNA, 15 bp, Homo sapiens
ctccctctggccctg

SEQ ID NO: 825593 - DNA, 18 bp, Homo sapiens
ctccctctggccctgcct

SEQ ID NO: 825594 - DNA, 12 bp, Homo sapiens
ctccctctgtct

SEQ ID NO: 825595 - DNA, 20 bp, Homo sapiens
ctccctctgtcttttctcct

SEQ ID NO: 825596 - DNA, 12 bp, Homo sapiens
ctccctcttcca

SEQ ID NO: 825597 - DNA, 13 bp, Homo sapiens
ctccctcttccaa

SEQ ID NO: 825598 - DNA, 14 bp, Homo sapiens
ctccctcttccaaa

SEQ ID NO: 825599 - DNA, 15 bp, Homo sapiens
ctccctcttccttcc

SEQ ID NO: 825600 - DNA, 14 bp, Homo sapiens
ctccctcttctcaa

SEQ ID NO: 825601 - DNA, 15 bp, Homo sapiens
ctccctcttctcaag

SEQ ID NO: 825602 - DNA, 20 bp, Homo sapiens
ctccctcttctcaagtgcct

SEQ ID NO: 825603 - DNA, 13 bp, Homo sapiens
ctccctcttggtt

SEQ ID NO: 825604 - DNA, 13 bp, Homo sapiens
ctccctcttgtgg

SEQ ID NO: 825605 - DNA, 12 bp, Homo sapiens
ctccctctttcc

SEQ ID NO: 825606 - DNA, 20 bp, Homo sapiens
ctccctgaaacactgcttct

SEQ ID NO: 825607 - DNA, 19 bp, Homo sapiens
ctccctgaaccatccctga

SEQ ID NO: 825608 - DNA, 21 bp, Homo sapiens
ctccctgacatttctaacata

SEQ ID NO: 825609 - DNA, 17 bp, Homo sapiens
ctccctgaccctgtata

SEQ ID NO: 825610 - DNA, 23 bp, Homo sapiens
ctccctgaccctgtatatagccc

SEQ ID NO: 825611 - DNA, 16 bp, Homo sapiens
ctccctgacttttctg

SEQ ID NO: 825612 - DNA, 12 bp, Homo sapiens
ctccctgagcct

SEQ ID NO: 825613 - DNA, 13 bp, Homo sapiens
ctccctgagcctg

SEQ ID NO: 825614 - DNA, 16 bp, Homo sapiens
ctccctgagcctgcat

SEQ ID NO: 825615 - DNA, 21 bp, Homo sapiens
ctccctgagcctgcattctgc

SEQ ID NO: 825616 - DNA, 17 bp, Homo sapiens
ctccctgagtctggacc

SEQ ID NO: 825617 - DNA, 19 bp, Homo sapiens
ctccctgagtctggacctc

SEQ ID NO: 825618 - DNA, 12 bp, Homo sapiens
ctccctgcaccg

SEQ ID NO: 825619 - DNA, 15 bp, Homo sapiens
ctccctgcagatgcc

SEQ ID NO: 825620 - DNA, 13 bp, Homo sapiens
ctccctgcagcca

SEQ ID NO: 825621 - DNA, 18 bp, Homo sapiens
ctccctgcagccaccaga

SEQ ID NO: 825622 - DNA, 15 bp, Homo sapiens
ctccctgcagccttt

SEQ ID NO: 825623 - DNA, 21 bp, Homo sapiens
ctccctgccatccccctctca

SEQ ID NO: 825624 - DNA, 14 bp, Homo sapiens
ctccctgcccccca

SEQ ID NO: 825625 - DNA, 18 bp, Homo sapiens
ctccctgcccctcccttc

SEQ ID NO: 825626 - DNA, 18 bp, Homo sapiens
ctccctgccgcctcaatg

SEQ ID NO: 825627 - DNA, 19 bp, Homo sapiens
ctccctgccgcctcaatgt

SEQ ID NO: 825628 - DNA, 10 bp, Homo sapiens
ctccctgcct

SEQ ID NO: 825629 - DNA, 15 bp, Homo sapiens
ctccctgcctccagg

SEQ ID NO: 825630 - DNA, 13 bp, Homo sapiens
ctccctgcctgag

SEQ ID NO: 825631 - DNA, 17 bp, Homo sapiens
ctccctgcgcccttgag

SEQ ID NO: 825632 - DNA, 20 bp, Homo sapiens
ctccctgcgggccaggcact

SEQ ID NO: 825633 - DNA, 13 bp, Homo sapiens
ctccctgctcagt

SEQ ID NO: 825634 - DNA, 15 bp, Homo sapiens
ctccctgctcagtgc

SEQ ID NO: 825635 - DNA, 19 bp, Homo sapiens
ctccctgctcagtgcttgg

SEQ ID NO: 825636 - DNA, 14 bp, Homo sapiens
ctccctgctccacg

SEQ ID NO: 825637 - DNA, 16 bp, Homo sapiens
ctccgctcccaccgcc

SEQ ID NO: 825638 - DNA, 12 bp, Homo sapiens
ctccgctgctcc

SEQ ID NO: 825639 - DNA, 16 bp, Homo sapiens
ctccgctgctccttgg

SEQ ID NO: 825640 - DNA, 18 bp, Homo sapiens
ctccgctgctccttggct

SEQ ID NO: 825641 - DNA, 16 bp, Homo sapiens
ctccggaggactgagc

SEQ ID NO: 825642 - DNA, 18 bp, Homo sapiens
ctccggaggactgagccc

SEQ ID NO: 825643 - DNA, 16 bp, Homo sapiens
ctccggaggagcagcc

SEQ ID NO: 825644 - DNA, 18 bp, Homo sapiens
ctccggaggggacccagc

SEQ ID NO: 825645 - DNA, 23 bp, Homo sapiens
ctccggaggggacccagctcctc

SEQ ID NO: 825646 - DNA, 19 bp, Homo sapiens
ctccggccatactgccttt

SEQ ID NO: 825647 - DNA, 15 bp, Homo sapiens
ctccggcctcccctc

SEQ ID NO: 825648 - DNA, 22 bp, Homo sapiens
ctccggcctgatgacagagcga

SEQ ID NO: 825649 - DNA, 15 bp, Homo sapiens
ctccggcctgcgtct

SEQ ID NO: 825650 - DNA, 16 bp, Homo sapiens
ctccggcctgtaatca

SEQ ID NO: 825651 - DNA, 18 bp, Homo sapiens
ctccggcgtcttgcccag

SEQ ID NO: 825652 - DNA, 22 bp, Homo sapiens
ctccggcgtcttgcccagcagc

SEQ ID NO: 825653 - DNA, 14 bp, Homo sapiens
ctccggctgcctag

SEQ ID NO: 825654 - DNA, 18 bp, Homo sapiens
ctccggcttgacctgttt

SEQ ID NO: 825655 - DNA, 23 bp, Homo sapiens
ctccgggaccattgacctcagct

SEQ ID NO: 825656 - DNA, 14 bp, Homo sapiens
ctccgggagagggg

SEQ ID NO: 825657 - DNA, 18 bp, Homo sapiens
ctccgggcaaatggctga

SEQ ID NO: 825658 - DNA, 15 bp, Homo sapiens
ctccgggcaggggag

SEQ ID NO: 825659 - DNA, 14 bp, Homo sapiens
ctccggggccattt

SEQ ID NO: 825660 - DNA, 19 bp, Homo sapiens
ctccggggccatttgcaat

SEQ ID NO: 825661 - DNA, 21 bp, Homo sapiens
ctccggggtctgtgctgtgcc

SEQ ID NO: 825662 - DNA, 16 bp, Homo sapiens
ctccgggtcctcctaa

SEQ ID NO: 825663 - DNA, 23 bp, Homo sapiens
ctccggtgtgcctgcagccccgc

SEQ ID NO: 825664 - DNA, 17 bp, Homo sapiens
ctccgtccacccaggct

SEQ ID NO: 825665 - DNA, 18 bp, Homo sapiens
ctccgtccacccaggctg

SEQ ID NO: 825666 - DNA, 22 bp, Homo sapiens
ctccgtccacccaggctgcact

SEQ ID NO: 825667 - DNA, 18 bp, Homo sapiens
ctccgtccaggagcctgg

SEQ ID NO: 825668 - DNA, 21 bp, Homo sapiens
ctccgtccatccgactgcccc

SEQ ID NO: 825669 - DNA, 22 bp, Homo sapiens
ctccgtccatccgactgcccct

SEQ ID NO: 825670 - DNA, 17 bp, Homo sapiens
ctccgtcccccaaacat

SEQ ID NO: 825671 - DNA, 21 bp, Homo sapiens
ctccgtcctgtcactgatgga

SEQ ID NO: 825672 - DNA, 15 bp, Homo sapiens
ctccgtctctgtcct

SEQ ID NO: 825673 - DNA, 19 bp, Homo sapiens
ctccgtctgaccctctgcg

SEQ ID NO: 825674 - DNA, 13 bp, Homo sapiens
ctccgtcttccca

SEQ ID NO: 825675 - DNA, 18 bp, Homo sapiens
ctccgtcttcccagcggt

SEQ ID NO: 825676 - DNA, 21 bp, Homo sapiens
ctccgtgatccatccatctcc

SEQ ID NO: 825677 - DNA, 16 bp, Homo sapiens
ctccgtgcctccacca

SEQ ID NO: 825678 - DNA, 21 bp, Homo sapiens
ctccgtgcctccaccaccact

SEQ ID NO: 825679 - DNA, 21 bp, Homo sapiens
ctccgtggaacattctggatc

SEQ ID NO: 825680 - DNA, 13 bp, Homo sapiens
ctccgtggaggag

SEQ ID NO: 825681 - DNA, 17 bp, Homo sapiens
ctccgtggaggaggttg

SEQ ID NO: 825682 - DNA, 22 bp, Homo sapiens
ctccgtggccaaaaagtaccat

SEQ ID NO: 825683 - DNA, 23 bp, Homo sapiens
ctccgtgtctcgcgcgactgaga

SEQ ID NO: 825684 - DNA, 15 bp, Homo sapiens
ctccgtgtggactgt

SEQ ID NO: 825685 - DNA, 14 bp, Homo sapiens
ctccgttcctggca

SEQ ID NO: 825686 - DNA, 23 bp, Homo sapiens
ctccgttcctggcatttgctgat

SEQ ID NO: 825687 - DNA, 17 bp, Homo sapiens
ctccgttggtcagcgtt

SEQ ID NO: 825688 - DNA, 15 bp, Homo sapiens
ctccgtttatgggcc

SEQ ID NO: 825689 - DNA, 18 bp, Homo sapiens
ctcctaactttggaccta

SEQ ID NO: 825690 - DNA, 22 bp, Homo sapiens
ctcctaagcaactaggccttca

SEQ ID NO: 825691 - DNA, 15 bp, Homo sapiens
ctcctaaggctcccc

SEQ ID NO: 825692 - DNA, 20 bp, Homo sapiens
ctcctaaggctccccacccc

SEQ ID NO: 825693 - DNA, 21 bp, Homo sapiens
ctcctaaggctccccaccccg

SEQ ID NO: 825694 - DNA, 17 bp, Homo sapiens
ctcctaagtcccttcct

SEQ ID NO: 825695 - DNA, 14 bp, Homo sapiens
ctcctaccagcaaa

SEQ ID NO: 825696 - DNA, 20 bp, Homo sapiens
ctcctacccactggtctgct

SEQ ID NO: 825697 - DNA, 21 bp, Homo sapiens
ctcctaccccttcctgtcctg

SEQ ID NO: 825698 - DNA, 17 bp, Homo sapiens
ctcctaccctcccacca

SEQ ID NO: 825699 - DNA, 15 bp, Homo sapiens
ctcctaccctgcgcc

SEQ ID NO: 825700 - DNA, 11 bp, Homo sapiens
ctcctacctca

SEQ ID NO: 825701 - DNA, 13 bp, Homo sapiens
ctcctacctcagc

SEQ ID NO: 825702 - DNA, 15 bp, Homo sapiens
ctcctacctgctgct

SEQ ID NO: 825703 - DNA, 22 bp, Homo sapiens
ctcctacctggggactcctcaa

SEQ ID NO: 825704 - DNA, 13 bp, Homo sapiens
ctcctacctggta

SEQ ID NO: 825705 - DNA, 14 bp, Homo sapiens
ctcctactttgaaa

SEQ ID NO: 825706 - DNA, 19 bp, Homo sapiens
ctcctagaagaaccaaata

SEQ ID NO: 825707 - DNA, 17 bp, Homo sapiens
ctcctagagacagaagc

SEQ ID NO: 825708 - DNA, 23 bp, Homo sapiens
ctcctagagacagaagcaggctg

SEQ ID NO: 825709 - DNA, 23 bp, Homo sapiens
ctcctagagggaggggcctaggc

SEQ ID NO: 825710 - DNA, 22 bp, Homo sapiens
ctcctagagtgcagggattaca

SEQ ID NO: 825711 - DNA, 18 bp, Homo sapiens
ctcctaggaaaccagctc

SEQ ID NO: 825712 - DNA, 19 bp, Homo sapiens
ctcctagtgtttctttgtg

SEQ ID NO: 825713 - DNA, 14 bp, Homo sapiens
ctcctataatctgt

SEQ ID NO: 825714 - DNA, 22 bp, Homo sapiens
ctcctataatctgtcaaaacac

SEQ ID NO: 825715 - DNA, 23 bp, Homo sapiens
ctcctataatctgtcaaaacact

SEQ ID NO: 825716 - DNA, 14 bp, Homo sapiens
ctcctatatatttc

SEQ ID NO: 825717 - DNA, 17 bp, Homo sapiens
ctcctatcacctcccct

SEQ ID NO: 825718 - DNA, 18 bp, Homo sapiens
ctcctatcacctcccctc

SEQ ID NO: 825719 - DNA, 19 bp, Homo sapiens
ctcctatcacctcccctcc

SEQ ID NO: 825720 - DNA, 22 bp, Homo sapiens
ctcctatcagaagtttctcagc

SEQ ID NO: 825721 - DNA, 14 bp, Homo sapiens
ctcctatcctggtt

SEQ ID NO: 825722 - DNA, 18 bp, Homo sapiens
ctcctatctgtgttttga

SEQ ID NO: 825723 - DNA, 14 bp, Homo sapiens
ctcctatctttcct

SEQ ID NO: 825724 - DNA, 22 bp, Homo sapiens
ctcctatggaaaagggtcttct

SEQ ID NO: 825725 - DNA, 16 bp, Homo sapiens
ctcctatgtgtgcctc

SEQ ID NO: 825726 - DNA, 15 bp, Homo sapiens
ctcctcaaaccactt

SEQ ID NO: 825727 - DNA, 22 bp, Homo sapiens
ctcctcaaacccagtctcagac

SEQ ID NO: 825728 - DNA, 16 bp, Homo sapiens
ctcctcaagcctgtgg

SEQ ID NO: 825729 - DNA, 17 bp, Homo sapiens
ctcctcacacaccctga

SEQ ID NO: 825730 - DNA, 19 bp, Homo sapiens
ctcctcacaccccagcacc

SEQ ID NO: 825731 - DNA, 23 bp, Homo sapiens
ctcctcacagacctctgcttgga

SEQ ID NO: 825732 - DNA, 17 bp, Homo sapiens
ctcctcacccacctctg

SEQ ID NO: 825733 - DNA, 12 bp, Homo sapiens
ctcctcacctca

SEQ ID NO: 825734 - DNA, 15 bp, Homo sapiens
ctcctcacctcatgc

SEQ ID NO: 825735 - DNA, 15 bp, Homo sapiens
ctcctcacctctgga

SEQ ID NO: 825736 - DNA, 22 bp, Homo sapiens
ctcctcacctctggactggcta

SEQ ID NO: 825737 - DNA, 23 bp, Homo sapiens
ctcctcactctgtccctgtcctt

SEQ ID NO: 825738 - DNA, 16 bp, Homo sapiens
ctcctcactggaggag

SEQ ID NO: 825739 - DNA, 16 bp, Homo sapiens
ctcctcactgtatcca

SEQ ID NO: 825740 - DNA, 15 bp, Homo sapiens
ctcctcagatggggc

SEQ ID NO: 825741 - DNA, 18 bp, Homo sapiens
ctcctcagcctctgcaac

SEQ ID NO: 825742 - DNA, 20 bp, Homo sapiens
ctcctcagcgagaggcagca

SEQ ID NO: 825743 - DNA, 23 bp, Homo sapiens
ctcctcagcgagaggcagcaagg

SEQ ID NO: 825744 - DNA, 21 bp, Homo sapiens
ctcctcaggacaaggccttgc

SEQ ID NO: 825745 - DNA, 15 bp, Homo sapiens
ctcctcagggtgggg

SEQ ID NO: 825746 - DNA, 16 bp, Homo sapiens
ctcctcagggtggggg

SEQ ID NO: 825747 - DNA, 15 bp, Homo sapiens
ctcctcagtttacat

SEQ ID NO: 825748 - DNA, 20 bp, Homo sapiens
ctcctcatcagtgtgtaaat

SEQ ID NO: 825749 - DNA, 21 bp, Homo sapiens
ctcctcatcagtgtgtaaata

SEQ ID NO: 825750 - DNA, 15 bp, Homo sapiens
ctcctcatcccgtgt

SEQ ID NO: 825751 - DNA, 11 bp, Homo sapiens
ctcctcatgta

SEQ ID NO: 825752 - DNA, 23 bp, Homo sapiens
ctcctccaaaggaagtctaggag

SEQ ID NO: 825753 - DNA, 17 bp, Homo sapiens
ctcctccaatgtcctga

SEQ ID NO: 825754 - DNA, 16 bp, Homo sapiens
ctcctccacagtgctg

SEQ ID NO: 825755 - DNA, 17 bp, Homo sapiens
ctcctccacagtgctgc

SEQ ID NO: 825756 - DNA, 19 bp, Homo sapiens
ctcctccacagtgctgctt

SEQ ID NO: 825757 - DNA, 20 bp, Homo sapiens
ctcctccacagtgctgcttc

SEQ ID NO: 825758 - DNA, 16 bp, Homo sapiens
ctcctgacccagtccc

SEQ ID NO: 825759 - DNA, 18 bp, Homo sapiens
ctcctgaccctcccactc

SEQ ID NO: 825760 - DNA, 20 bp, Homo sapiens
ctcctgaccctcccactccc

SEQ ID NO: 825761 - DNA, 14 bp, Homo sapiens
ctcctgacctcaag

SEQ ID NO: 825762 - DNA, 20 bp, Homo sapiens
ctcctgagaaaaaaggttcc

SEQ ID NO: 825763 - DNA, 17 bp, Homo sapiens
ctcctgagaaggcgagg

SEQ ID NO: 825764 - DNA, 18 bp, Homo sapiens
ctcctgagaaggcgagga

SEQ ID NO: 825765 - DNA, 21 bp, Homo sapiens
ctcctgagaaggcgaggagag

SEQ ID NO: 825766 - DNA, 20 bp, Homo sapiens
ctcctgagctaggaagagtc

SEQ ID NO: 825767 - DNA, 18 bp, Homo sapiens
ctcctgaggacagctgtc

SEQ ID NO: 825768 - DNA, 17 bp, Homo sapiens
ctcctgaggctttggat

SEQ ID NO: 825769 - DNA, 20 bp, Homo sapiens
ctcctgaggggcatctgccc

SEQ ID NO: 825770 - DNA, 21 bp, Homo sapiens
ctcctgaggggcatctgcccc

SEQ ID NO: 825771 - DNA, 18 bp, Homo sapiens
ctcctgagtagctgggcc

SEQ ID NO: 825772 - DNA, 18 bp, Homo sapiens
ctcctgagtgccccactt

SEQ ID NO: 825773 - DNA, 23 bp, Homo sapiens
ctcctgcacacagaatgctcagg

SEQ ID NO: 825774 - DNA, 14 bp, Homo sapiens
ctcctgcacacagg

SEQ ID NO: 825775 - DNA, 18 bp, Homo sapiens
ctcctgcacttacttgct

SEQ ID NO: 825776 - DNA, 18 bp, Homo sapiens
ctcctgcagacacctgga

SEQ ID NO: 825777 - DNA, 21 bp, Homo sapiens
ctcctgcagacacctggactg

SEQ ID NO: 825778 - DNA, 14 bp, Homo sapiens
ctcctgcagcatgg

SEQ ID NO: 825779 - DNA, 18 bp, Homo sapiens
ctcctgcagtttgggaga

SEQ ID NO: 825780 - DNA, 12 bp, Homo sapiens
ctcctgccaacc

SEQ ID NO: 825781 - DNA, 14 bp, Homo sapiens
ctcctgccaggcac

SEQ ID NO: 825782 - DNA, 18 bp, Homo sapiens
ctcctgccagtgtggaac

SEQ ID NO: 825783 - DNA, 14 bp, Homo sapiens
ctcctgccatgggt

SEQ ID NO: 825784 - DNA, 22 bp, Homo sapiens
ctcctgccatgggtgcagaccc

SEQ ID NO: 825785 - DNA, 20 bp, Homo sapiens
ctcctgcccacgcagacctg

SEQ ID NO: 825786 - DNA, 22 bp, Homo sapiens
ctcctgcccagccacccctcag

SEQ ID NO: 825787 - DNA, 19 bp, Homo sapiens
ctcctgcccagctcctcac

SEQ ID NO: 825788 - DNA, 12 bp, Homo sapiens
ctcctgcccagg

SEQ ID NO: 825789 - DNA, 14 bp, Homo sapiens
ctcctgcccaggag

SEQ ID NO: 825790 - DNA, 20 bp, Homo sapiens
ctcctgcccaggagagccag

SEQ ID NO: 825791 - DNA, 20 bp, Homo sapiens
ctcctgccctctgctctgcc

SEQ ID NO: 825792 - DNA, 16 bp, Homo sapiens
ctcctgccctgtccct

SEQ ID NO: 825793 - DNA, 17 bp, Homo sapiens
ctcctgccgactcctgg

SEQ ID NO: 825794 - DNA, 12 bp, Homo sapiens
ctcctgcctcag

SEQ ID NO: 825795 - DNA, 14 bp, Homo sapiens
ctcctgcctcagcc

SEQ ID NO: 825796 - DNA, 22 bp, Homo sapiens
ctcctgcctgagtttccagcct

SEQ ID NO: 825797 - DNA, 14 bp, Homo sapiens
ctcctgcctggggt

SEQ ID NO: 825798 - DNA, 18 bp, Homo sapiens
ctcctgcctgtgctgtga

SEQ ID NO: 825799 - DNA, 16 bp, Homo sapiens
ctcctgccttcctcct

SEQ ID NO: 825800 - DNA, 18 bp, Homo sapiens
ctcctgccttcctcctgg

SEQ ID NO: 825801 - DNA, 11 bp, Homo sapiens
ctcctgctcct

SEQ ID NO: 825802 - DNA, 23 bp, Homo sapiens
ctcctgctcctccctgcccccca

SEQ ID NO: 825803 - DNA, 21 bp, Homo sapiens
ctcctgctgaccttctgcggc

SEQ ID NO: 825804 - DNA, 14 bp, Homo sapiens
ctcctgctgctcct

SEQ ID NO: 825805 - DNA, 14 bp, Homo sapiens
ctcctgctggctct

SEQ ID NO: 825806 - DNA, 14 bp, Homo sapiens
ctcctgcttcccct

SEQ ID NO: 825807 - DNA, 15 bp, Homo sapiens
ctcctgcttcccctc

SEQ ID NO: 825808 - DNA, 13 bp, Homo sapiens
ctcctgcttttct

SEQ ID NO: 825809 - DNA, 23 bp, Homo sapiens
ctcctgcttttctgtcctgggca

SEQ ID NO: 825810 - DNA, 18 bp, Homo sapiens
ctcctggaaaggctcagt

SEQ ID NO: 825811 - DNA, 19 bp, Homo sapiens
ctcctggaaaggctcagtc

SEQ ID NO: 825812 - DNA, 24 bp, Homo sapiens
ctcctggaaaggctcagtctcagg

SEQ ID NO: 825813 - DNA, 18 bp, Homo sapiens
ctcctggaaccttgctgt

SEQ ID NO: 825814 - DNA, 21 bp, Homo sapiens
ctcctggaaccttgctgtcct

SEQ ID NO: 825815 - DNA, 22 bp, Homo sapiens
ctcctggaaccttgctgtcctg

SEQ ID NO: 825816 - DNA, 23 bp, Homo sapiens
ctcctggaaccttgctgtcctga

SEQ ID NO: 825817 - DNA, 20 bp, Homo sapiens
ctcctggacacattggaatg

SEQ ID NO: 825818 - DNA, 17 bp, Homo sapiens
ctcctggaccttgacag

SEQ ID NO: 825819 - DNA, 22 bp, Homo sapiens
ctcctggaccttgacagagcag

SEQ ID NO: 825820 - DNA, 12 bp, Homo sapiens
ctcctggactcc

SEQ ID NO: 825821 - DNA, 18 bp, Homo sapiens
ctcctggagatagctggg

SEQ ID NO: 825822 - DNA, 20 bp, Homo sapiens
ctcctggagatagctggggc

SEQ ID NO: 825823 - DNA, 18 bp, Homo sapiens
ctcctggagcagaaagtg

SEQ ID NO: 825824 - DNA, 20 bp, Homo sapiens
ctcctggagcagaaagtgcc

SEQ ID NO: 825825 - DNA, 12 bp, Homo sapiens
ctcctggagcct

SEQ ID NO: 825826 - DNA, 19 bp, Homo sapiens
ctcctggagctctgtgggt

SEQ ID NO: 825827 - DNA, 15 bp, Homo sapiens
ctcctggaggaccag

SEQ ID NO: 825828 - DNA, 10 bp, Homo sapiens
ctcctggcaa

SEQ ID NO: 825829 - DNA, 21 bp, Homo sapiens
ctcctggcagggccacctgca

SEQ ID NO: 825830 - DNA, 12 bp, Homo sapiens
ctcctggccaga

SEQ ID NO: 825831 - DNA, 15 bp, Homo sapiens
ctcctggccagacgc

SEQ ID NO: 825832 - DNA, 23 bp, Homo sapiens
ctcctggcccgccctcacctctg

SEQ ID NO: 825833 - DNA, 22 bp, Homo sapiens
ctcctggcctatccgctgccag

SEQ ID NO: 825834 - DNA, 18 bp, Homo sapiens
ctcctggcctcaagggat

SEQ ID NO: 825835 - DNA, 20 bp, Homo sapiens
ctcctggcctggccatctcc

SEQ ID NO: 825836 - DNA, 13 bp, Homo sapiens
ctcctggccttcc

SEQ ID NO: 825837 - DNA, 14 bp, Homo sapiens
ctcctggccttcct

SEQ ID NO: 825838 - DNA, 12 bp, Homo sapiens
ctcctggctccc

SEQ ID NO: 825839 - DNA, 14 bp, Homo sapiens
ctcctggctccctc

SEQ ID NO: 825840 - DNA, 19 bp, Homo sapiens
ctcctggctccgcaggggt

SEQ ID NO: 825841 - DNA, 13 bp, Homo sapiens
ctcctggctgtgc

SEQ ID NO: 825842 - DNA, 17 bp, Homo sapiens
ctcctggctgtgcccag

SEQ ID NO: 825843 - DNA, 17 bp, Homo sapiens
ctcctgggaacacatct

SEQ ID NO: 825844 - DNA, 19 bp, Homo sapiens
ctcctgggacccttggcta

SEQ ID NO: 825845 - DNA, 20 bp, Homo sapiens
ctcctgggacccttggctat

SEQ ID NO: 825846 - DNA, 23 bp, Homo sapiens
ctcctgggattggctgtgaactg

SEQ ID NO: 825847 - DNA, 15 bp, Homo sapiens
ctcctgggcagccgt

SEQ ID NO: 825848 - DNA, 23 bp, Homo sapiens
ctcctgggcagccgttttcctca

SEQ ID NO: 825849 - DNA, 19 bp, Homo sapiens
ctcctgggccctctctgct

SEQ ID NO: 825850 - DNA, 20 bp, Homo sapiens
ctcctgggccctctctgctc

SEQ ID NO: 825851 - DNA, 19 bp, Homo sapiens
ctcctgggctctgaacaca

SEQ ID NO: 825852 - DNA, 9 bp, Homo sapiens
ctcctgggg

SEQ ID NO: 825853 - DNA, 11 bp, Homo sapiens
ctcctggggca

SEQ ID NO: 825854 - DNA, 14 bp, Homo sapiens
ctcctgggggtggc

SEQ ID NO: 825855 - DNA, 15 bp, Homo sapiens
ctcctgggggtggca

SEQ ID NO: 825856 - DNA, 16 bp, Homo sapiens
ctcctgggggtggcag

SEQ ID NO: 825857 - DNA, 22 bp, Homo sapiens
ctcctgggggttctttcttcct

SEQ ID NO: 825858 - DNA, 23 bp, Homo sapiens
ctcctgggggttctttcttcctc

SEQ ID NO: 825859 - DNA, 23 bp, Homo sapiens
ctcctgggtgggtggggtacagg

SEQ ID NO: 825860 - DNA, 15 bp, Homo sapiens
ctcctgggttgagct

SEQ ID NO: 825861 - DNA, 22 bp, Homo sapiens
ctcctgggttgagctgttgcct

SEQ ID NO: 825862 - DNA, 15 bp, Homo sapiens
ctcctgggttggagg

SEQ ID NO: 825863 - DNA, 20 bp, Homo sapiens
ctcctggtcctggacacctc

SEQ ID NO: 825864 - DNA, 14 bp, Homo sapiens
ctcctggtctgtga

SEQ ID NO: 825865 - DNA, 16 bp, Homo sapiens
ctcctggtctgtgaag

SEQ ID NO: 825866 - DNA, 15 bp, Homo sapiens
ctcctggtgtgggta

SEQ ID NO: 825867 - DNA, 16 bp, Homo sapiens
ctcctgtaattcctac

SEQ ID NO: 825868 - DNA, 21 bp, Homo sapiens
ctcctgtcactcactgaggcc

SEQ ID NO: 825869 - DNA, 22 bp, Homo sapiens
ctcctgtcactcactgaggcca

SEQ ID NO: 825870 - DNA, 17 bp, Homo sapiens
ctcctgtccctgtagct

SEQ ID NO: 825871 - DNA, 15 bp, Homo sapiens
ctcctgtcctcccat

SEQ ID NO: 825872 - DNA, 21 bp, Homo sapiens
ctcctgtcctcccatcccctg

SEQ ID NO: 825873 - DNA, 14 bp, Homo sapiens
ctcctgtctgccag

SEQ ID NO: 825874 - DNA, 15 bp, Homo sapiens
ctcctgtctgccagc

SEQ ID NO: 825875 - DNA, 19 bp, Homo sapiens
ctcctgtctgccagccagc

SEQ ID NO: 825876 - DNA, 19 bp, Homo sapiens
ctcctgtctgccctctggg

SEQ ID NO: 825877 - DNA, 13 bp, Homo sapiens
ctcctgtctggct

SEQ ID NO: 825878 - DNA, 19 bp, Homo sapiens
ctcctgtcttatggtccag

SEQ ID NO: 825879 - DNA, 20 bp, Homo sapiens
ctcctgtgcatgggtgaagg

SEQ ID NO: 825880 - DNA, 16 bp, Homo sapiens
ctcggggaggcagaga

SEQ ID NO: 825881 - DNA, 16 bp, Homo sapiens
ctcgggggcctgtggt

SEQ ID NO: 825882 - DNA, 16 bp, Homo sapiens
ctcgggggcgcctgga

SEQ ID NO: 825883 - DNA, 17 bp, Homo sapiens
ctcgggggcgcctggag

SEQ ID NO: 825884 - DNA, 16 bp, Homo sapiens
ctcgggggctcttccc

SEQ ID NO: 825885 - DNA, 21 bp, Homo sapiens
ctcggggtaaaaagtggctgc

SEQ ID NO: 825886 - DNA, 13 bp, Homo sapiens
ctcggggtccacc

SEQ ID NO: 825887 - DNA, 19 bp, Homo sapiens
ctcggggtccaccagtgtg

SEQ ID NO: 825888 - DNA, 22 bp, Homo sapiens
ctcggggtccaccagtgtgtgg

SEQ ID NO: 825889 - DNA, 14 bp, Homo sapiens
ctcggggtccagtg

SEQ ID NO: 825890 - DNA, 15 bp, Homo sapiens
ctcggtctcccaaag

SEQ ID NO: 825891 - DNA, 22 bp, Homo sapiens
ctcggtctcccaaagtgctggg

SEQ ID NO: 825892 - DNA, 23 bp, Homo sapiens
ctcggtctcccaaagtgctggga

SEQ ID NO: 825893 - DNA, 18 bp, Homo sapiens
ctcggtgagccggggccg

SEQ ID NO: 825894 - DNA, 14 bp, Homo sapiens
ctcggtggacccag

SEQ ID NO: 825895 - DNA, 19 bp, Homo sapiens
ctcggtggctctggggtat

SEQ ID NO: 825896 - DNA, 18 bp, Homo sapiens
ctcggtgggccagagctg

SEQ ID NO: 825897 - DNA, 16 bp, Homo sapiens
ctcggtgtggagaagc

SEQ ID NO: 825898 - DNA, 23 bp, Homo sapiens
ctcggtgtggagaagcggctggc

SEQ ID NO: 825899 - DNA, 22 bp, Homo sapiens
ctcggttaagtacccgaggcct

SEQ ID NO: 825900 - DNA, 23 bp, Homo sapiens
ctcggttaagtacccgaggcctc

SEQ ID NO: 825901 - DNA, 15 bp, Homo sapiens
ctcggtttgccaaaa

SEQ ID NO: 825902 - DNA, 14 bp, Homo sapiens
ctcgtaactggttt

SEQ ID NO: 825903 - DNA, 20 bp, Homo sapiens
ctcgtatatgtctcaggtcc

SEQ ID NO: 825904 - DNA, 17 bp, Homo sapiens
ctcgtcagccacctggg

SEQ ID NO: 825905 - DNA, 18 bp, Homo sapiens
ctcgtccacaggggcagg

SEQ ID NO: 825906 - DNA, 19 bp, Homo sapiens
ctcgtccacaggggcaggc

SEQ ID NO: 825907 - DNA, 23 bp, Homo sapiens
ctcgtccacaggggcaggcctgg

SEQ ID NO: 825908 - DNA, 15 bp, Homo sapiens
ctcgtcccagccctc

SEQ ID NO: 825909 - DNA, 17 bp, Homo sapiens
ctcgtccccctccctgc

SEQ ID NO: 825910 - DNA, 19 bp, Homo sapiens
ctcgtccccctccctgccc

SEQ ID NO: 825911 - DNA, 20 bp, Homo sapiens
ctcgtccccctccctgccca

SEQ ID NO: 825912 - DNA, 22 bp, Homo sapiens
ctcgtcctccccctgccagtgc

SEQ ID NO: 825913 - DNA, 14 bp, Homo sapiens
ctcgtcctgtccca

SEQ ID NO: 825914 - DNA, 15 bp, Homo sapiens
ctcgtgatctgccct

SEQ ID NO: 825915 - DNA, 22 bp, Homo sapiens
ctcgtgatctgcccttctctgc

SEQ ID NO: 825916 - DNA, 13 bp, Homo sapiens
ctcgtgcagagct

SEQ ID NO: 825917 - DNA, 16 bp, Homo sapiens
ctcgtgccagcagcct

SEQ ID NO: 825918 - DNA, 20 bp, Homo sapiens
ctcgtgccagcagcctcgca

SEQ ID NO: 825919 - DNA, 22 bp, Homo sapiens
ctcgtgccagcagcctcgcaca

SEQ ID NO: 825920 - DNA, 15 bp, Homo sapiens
ctcgtggactgtgct

SEQ ID NO: 825921 - DNA, 15 bp, Homo sapiens
ctcgtggagctcgcc

SEQ ID NO: 825922 - DNA, 19 bp, Homo sapiens
ctcgtggagctcgcccctc

SEQ ID NO: 825923 - DNA, 13 bp, Homo sapiens
ctcgtggccagcc

SEQ ID NO: 825924 - DNA, 14 bp, Homo sapiens
ctcgtggccagccc

SEQ ID NO: 825925 - DNA, 23 bp, Homo sapiens
ctcgtggccttccccttttgcct

SEQ ID NO: 825926 - DNA, 16 bp, Homo sapiens
ctcgtggtaggactgt

SEQ ID NO: 825927 - DNA, 21 bp, Homo sapiens
ctcgtggttattagcaaggct

SEQ ID NO: 825928 - DNA, 14 bp, Homo sapiens
ctcgtgtatcctgg

SEQ ID NO: 825929 - DNA, 16 bp, Homo sapiens
ctcgtgtatcctgggg

SEQ ID NO: 825930 - DNA, 14 bp, Homo sapiens
ctcgtgtgtttcta

SEQ ID NO: 825931 - DNA, 21 bp, Homo sapiens
ctcgttccggtccccacagac

SEQ ID NO: 825932 - DNA, 20 bp, Homo sapiens
ctcgttctctgggtggccgg

SEQ ID NO: 825933 - DNA, 13 bp, Homo sapiens
ctcgttgcccagc

SEQ ID NO: 825934 - DNA, 19 bp, Homo sapiens
ctcgtttttcagcaccccc

SEQ ID NO: 825935 - DNA, 22 bp, Homo sapiens
ctctaaactgcaaacagaaatc

SEQ ID NO: 825936 - DNA, 16 bp, Homo sapiens
ctctaaagaaacttgg

SEQ ID NO: 825937 - DNA, 21 bp, Homo sapiens
ctctaaagagtttattttaag

SEQ ID NO: 825938 - DNA, 22 bp, Homo sapiens
ctctaaatgaggggcctcaggt

SEQ ID NO: 825939 - DNA, 14 bp, Homo sapiens
ctctaacagccctc

SEQ ID NO: 825940 - DNA, 14 bp, Homo sapiens
ctctaaccctcatt

SEQ ID NO: 825941 - DNA, 16 bp, Homo sapiens
ctctaaccctgtggaa

SEQ ID NO: 825942 - DNA, 17 bp, Homo sapiens
ctctaaccctgtggaag

SEQ ID NO: 825943 - DNA, 17 bp, Homo sapiens
ctctaactgtatatttg

SEQ ID NO: 825944 - DNA, 21 bp, Homo sapiens
ctctaagccacagcttcttca

SEQ ID NO: 825945 - DNA, 13 bp, Homo sapiens
ctctaagccactc

SEQ ID NO: 825946 - DNA, 21 bp, Homo sapiens
ctctaagcgtgctgacatcag

SEQ ID NO: 825947 - DNA, 18 bp, Homo sapiens
ctctaagttccactgagc

SEQ ID NO: 825948 - DNA, 14 bp, Homo sapiens
ctctaataataaat

SEQ ID NO: 825949 - DNA, 16 bp, Homo sapiens
ctctaataataaatag

SEQ ID NO: 825950 - DNA, 18 bp, Homo sapiens
ctctaataataaatagtt

SEQ ID NO: 825951 - DNA, 17 bp, Homo sapiens
ctctaatagaggcagtg

SEQ ID NO: 825952 - DNA, 17 bp, Homo sapiens
ctctaattagagaactg

SEQ ID NO: 825953 - DNA, 17 bp, Homo sapiens
ctctaattggaagaaat

SEQ ID NO: 825954 - DNA, 14 bp, Homo sapiens
ctctacaattcctc

SEQ ID NO: 825955 - DNA, 17 bp, Homo sapiens
ctctacaattggaagat

SEQ ID NO: 825956 - DNA, 20 bp, Homo sapiens
ctctacacggactgaggtgc

SEQ ID NO: 825957 - DNA, 22 bp, Homo sapiens
ctctacacggactgaggtgcct

SEQ ID NO: 825958 - DNA, 14 bp, Homo sapiens
ctctacactgtgaa

SEQ ID NO: 825959 - DNA, 17 bp, Homo sapiens
ctctacagagcttccct

SEQ ID NO: 825960 - DNA, 22 bp, Homo sapiens
ctctacagagcttccctgactc

SEQ ID NO: 825961 - DNA, 15 bp, Homo sapiens
ctctacagccgtccc

SEQ ID NO: 825962 - DNA, 18 bp, Homo sapiens
ctctacaggcctcttcct

SEQ ID NO: 825963 - DNA, 17 bp, Homo sapiens
ctctacatcttctgcct

SEQ ID NO: 825964 - DNA, 18 bp, Homo sapiens
ctctacatcttctgcctt

SEQ ID NO: 825965 - DNA, 16 bp, Homo sapiens
ctctaccagtctattt

SEQ ID NO: 825966 - DNA, 19 bp, Homo sapiens
ctctacccatattacagat

SEQ ID NO: 825967 - DNA, 17 bp, Homo sapiens
ctctacccatgagcctg

SEQ ID NO: 825968 - DNA, 19 bp, Homo sapiens
ctctacccatgagcctgcc

SEQ ID NO: 825969 - DNA, 23 bp, Homo sapiens
ctctaccccaaagaattcctgaa

SEQ ID NO: 825970 - DNA, 22 bp, Homo sapiens
ctctacccctgctcccattcct

SEQ ID NO: 825971 - DNA, 14 bp, Homo sapiens
ctctacccctttct

SEQ ID NO: 825972 - DNA, 18 bp, Homo sapiens
ctctacccggcccagaga

SEQ ID NO: 825973 - DNA, 21 bp, Homo sapiens
ctctacccggcccagagaccc

SEQ ID NO: 825974 - DNA, 14 bp, Homo sapiens
ctctaccctcccac

SEQ ID NO: 825975 - DNA, 15 bp, Homo sapiens
ctctaccctcccacc

SEQ ID NO: 825976 - DNA, 16 bp, Homo sapiens
ctctaccctcccaccc

SEQ ID NO: 825977 - DNA, 12 bp, Homo sapiens
ctctaccctgtc

SEQ ID NO: 825978 - DNA, 15 bp, Homo sapiens
ctctaccctgtctgt

SEQ ID NO: 825979 - DNA, 21 bp, Homo sapiens
ctctaccctgtctgtcccttt

SEQ ID NO: 825980 - DNA, 17 bp, Homo sapiens
ctctacctccaccctgc

SEQ ID NO: 825981 - DNA, 12 bp, Homo sapiens
ctctacctctct

SEQ ID NO: 825982 - DNA, 14 bp, Homo sapiens
ctctacctctctcc

SEQ ID NO: 825983 - DNA, 16 bp, Homo sapiens
ctctacctctctcctc

SEQ ID NO: 825984 - DNA, 19 bp, Homo sapiens
ctctacctctctcctctcc

SEQ ID NO: 825985 - DNA, 16 bp, Homo sapiens
ctctacctctctttct

SEQ ID NO: 825986 - DNA, 22 bp, Homo sapiens
ctctacctgacactcccttggg

SEQ ID NO: 825987 - DNA, 12 bp, Homo sapiens
ctctaccttcct

SEQ ID NO: 825988 - DNA, 19 bp, Homo sapiens
ctctaccttcctgtccctg

SEQ ID NO: 825989 - DNA, 21 bp, Homo sapiens
ctctaccttcctgtccctgag

SEQ ID NO: 825990 - DNA, 14 bp, Homo sapiens
ctctacgccaaagt

SEQ ID NO: 825991 - DNA, 23 bp, Homo sapiens
ctctacgccaaagtgcagccctt

SEQ ID NO: 825992 - DNA, 20 bp, Homo sapiens
ctctacgtggcaaattaact

SEQ ID NO: 825993 - DNA, 19 bp, Homo sapiens
ctctactaaaaagaaggaa

SEQ ID NO: 825994 - DNA, 19 bp, Homo sapiens
ctctactaaaaatacagaa

SEQ ID NO: 825995 - DNA, 20 bp, Homo sapiens
ctctactaccacaaggaaaa

SEQ ID NO: 825996 - DNA, 20 bp, Homo sapiens
ctctactgaatgtcattgaa

SEQ ID NO: 825997 - DNA, 12 bp, Homo sapiens
ctctactgccaa

SEQ ID NO: 825998 - DNA, 19 bp, Homo sapiens
ctctactgccaagcccctg

SEQ ID NO: 825999 - DNA, 12 bp, Homo sapiens
ctctactgtctc

SEQ ID NO: 826000 - DNA, 14 bp, Homo sapiens
ctctactgtctcct

SEQ ID NO: 826001 - DNA, 22 bp, Homo sapiens
ctctactgtctcctccctgggc

SEQ ID NO: 826002 - DNA, 13 bp, Homo sapiens
ctctcctttttct

SEQ ID NO: 826003 - DNA, 20 bp, Homo sapiens
ctctcctttttctcttcaca

SEQ ID NO: 826004 - DNA, 20 bp, Homo sapiens
ctctcgcaagagggtctctt

SEQ ID NO: 826005 - DNA, 17 bp, Homo sapiens
ctctcgcacaatgcatg

SEQ ID NO: 826006 - DNA, 17 bp, Homo sapiens
ctctcggagccctcaga

SEQ ID NO: 826007 - DNA, 15 bp, Homo sapiens
ctctcggccaggcat

SEQ ID NO: 826008 - DNA, 22 bp, Homo sapiens
ctctcggccaggttgtgtccca

SEQ ID NO: 826009 - DNA, 21 bp, Homo sapiens
ctctcgggactagctgccttc

SEQ ID NO: 826010 - DNA, 22 bp, Homo sapiens
ctctcgggactagctgccttcg

SEQ ID NO: 826011 - DNA, 21 bp, Homo sapiens
ctctcggggcccttggggcct

SEQ ID NO: 826012 - DNA, 19 bp, Homo sapiens
ctctcgggttcaagcaatt

SEQ ID NO: 826013 - DNA, 17 bp, Homo sapiens
ctctcgtaactggtttc

SEQ ID NO: 826014 - DNA, 13 bp, Homo sapiens
ctctcgttctcct

SEQ ID NO: 826015 - DNA, 18 bp, Homo sapiens
ctctctaccccccacctt

SEQ ID NO: 826016 - DNA, 17 bp, Homo sapiens
ctctctacctccaccct

SEQ ID NO: 826017 - DNA, 19 bp, Homo sapiens
ctctctactcctacctcag

SEQ ID NO: 826018 - DNA, 20 bp, Homo sapiens
ctctctactcctacctcagc

SEQ ID NO: 826019 - DNA, 13 bp, Homo sapiens
ctctctagcacaa

SEQ ID NO: 826020 - DNA, 15 bp, Homo sapiens
ctctctagctcccca

SEQ ID NO: 826021 - DNA, 11 bp, Homo sapiens
ctctctagctt

SEQ ID NO: 826022 - DNA, 14 bp, Homo sapiens
ctctctatcctctc

SEQ ID NO: 826023 - DNA, 13 bp, Homo sapiens
ctctctattgtca

SEQ ID NO: 826024 - DNA, 14 bp, Homo sapiens
ctctctattgtcat

SEQ ID NO: 826025 - DNA, 21 bp, Homo sapiens
ctctctcaatttttggttgaa

SEQ ID NO: 826026 - DNA, 12 bp, Homo sapiens
ctctctcaccca

SEQ ID NO: 826027 - DNA, 15 bp, Homo sapiens
ctctctcacccacca

SEQ ID NO: 826028 - DNA, 15 bp, Homo sapiens
ctctctcacccagcc

SEQ ID NO: 826029 - DNA, 19 bp, Homo sapiens
ctctctcagttatgtagtt

SEQ ID NO: 826030 - DNA, 15 bp, Homo sapiens
ctctctcatcttgtt

SEQ ID NO: 826031 - DNA, 20 bp, Homo sapiens
ctctctcatgagaagccaag

SEQ ID NO: 826032 - DNA, 17 bp, Homo sapiens
ctctctccagatgtttc

SEQ ID NO: 826033 - DNA, 12 bp, Homo sapiens
ctctctccagga

SEQ ID NO: 826034 - DNA, 15 bp, Homo sapiens
ctctctccagggtgc

SEQ ID NO: 826035 - DNA, 14 bp, Homo sapiens
ctctctcccaccct

SEQ ID NO: 826036 - DNA, 20 bp, Homo sapiens
ctctctcccaccctaagggc

SEQ ID NO: 826037 - DNA, 12 bp, Homo sapiens
ctctctccctct

SEQ ID NO: 826038 - DNA, 14 bp, Homo sapiens
ctctctccctctgt

SEQ ID NO: 826039 - DNA, 13 bp, Homo sapiens
ctctctccctgcc

SEQ ID NO: 826040 - DNA, 15 bp, Homo sapiens
ctctctccctgcctt

SEQ ID NO: 826041 - DNA, 15 bp, Homo sapiens
ctctctccctggtct

SEQ ID NO: 826042 - DNA, 20 bp, Homo sapiens
ctctctccctgtcacacact

SEQ ID NO: 826043 - DNA, 16 bp, Homo sapiens
ctctctcctcaggacc

SEQ ID NO: 826044 - DNA, 17 bp, Homo sapiens
ctctctcctctctgctt

SEQ ID NO: 826045 - DNA, 11 bp, Homo sapiens
ctctctcctgg

SEQ ID NO: 826046 - DNA, 15 bp, Homo sapiens
ctctctcctgtactt

SEQ ID NO: 826047 - DNA, 16 bp, Homo sapiens
ctctctccttggccac

SEQ ID NO: 826048 - DNA, 15 bp, Homo sapiens
ctctctcggagccct

SEQ ID NO: 826049 - DNA, 22 bp, Homo sapiens
ctctctctacccggcccagaga

SEQ ID NO: 826050 - DNA, 14 bp, Homo sapiens
ctctctctcctcag

SEQ ID NO: 826051 - DNA, 15 bp, Homo sapiens
ctctctctcctcagg

SEQ ID NO: 826052 - DNA, 18 bp, Homo sapiens
ctctctcttctgctccac

SEQ ID NO: 826053 - DNA, 18 bp, Homo sapiens
ctctctgaactgcaacac

SEQ ID NO: 826054 - DNA, 20 bp, Homo sapiens
ctctctgaactgcaacactg

SEQ ID NO: 826055 - DNA, 12 bp, Homo sapiens
ctctctgacccg

SEQ ID NO: 826056 - DNA, 16 bp, Homo sapiens
ctctctgatgtcccag

SEQ ID NO: 826057 - DNA, 19 bp, Homo sapiens
ctctctgatgtcccagtgc

SEQ ID NO: 826058 - DNA, 21 bp, Homo sapiens
ctctctgatgtcccagtgctc

SEQ ID NO: 826059 - DNA, 19 bp, Homo sapiens
ctctctgcagccagcccag

SEQ ID NO: 826060 - DNA, 13 bp, Homo sapiens
ctctctgcagccc

SEQ ID NO: 826061 - DNA, 15 bp, Homo sapiens
ctctctgcagcccag

SEQ ID NO: 826062 - DNA, 16 bp, Homo sapiens
ctctctgcagctgccg

SEQ ID NO: 826063 - DNA, 19 bp, Homo sapiens
ctctctgcagtcctccggg

SEQ ID NO: 826064 - DNA, 17 bp, Homo sapiens
ctctctgccctgtgtac

SEQ ID NO: 826065 - DNA, 17 bp, Homo sapiens
ctctctgcccttgatca

SEQ ID NO: 826066 - DNA, 20 bp, Homo sapiens
ctctctgcctctcttcttcc

SEQ ID NO: 826067 - DNA, 19 bp, Homo sapiens
ctctctgcggcagagtcct

SEQ ID NO: 826068 - DNA, 17 bp, Homo sapiens
ctctctgctccagactc

SEQ ID NO: 826069 - DNA, 14 bp, Homo sapiens
ctctctgctccttc

SEQ ID NO: 826070 - DNA, 14 bp, Homo sapiens
ctctctgctctgcg

SEQ ID NO: 826071 - DNA, 15 bp, Homo sapiens
ctctctgctgagctg

SEQ ID NO: 826072 - DNA, 21 bp, Homo sapiens
ctctctgctgagctgggccca

SEQ ID NO: 826073 - DNA, 19 bp, Homo sapiens
ctctctggaaagaggctct

SEQ ID NO: 826074 - DNA, 20 bp, Homo sapiens
ctctctggaaagaggctctg

SEQ ID NO: 826075 - DNA, 20 bp, Homo sapiens
ctctctggaagccctggaga

SEQ ID NO: 826076 - DNA, 16 bp, Homo sapiens
ctctctggagcccctc

SEQ ID NO: 826077 - DNA, 20 bp, Homo sapiens
ctctctggagcccctcctcc

SEQ ID NO: 826078 - DNA, 14 bp, Homo sapiens
ctctctggcctccc

SEQ ID NO: 826079 - DNA, 15 bp, Homo sapiens
ctctctggctggtct

SEQ ID NO: 826080 - DNA, 23 bp, Homo sapiens
ctctctggcttctgaagagcctg

SEQ ID NO: 826081 - DNA, 20 bp, Homo sapiens
ctctctgggacctaggggga

SEQ ID NO: 826082 - DNA, 16 bp, Homo sapiens
ctctctgggactctcc

SEQ ID NO: 826083 - DNA, 21 bp, Homo sapiens
ctctctgggactctcctcctc

SEQ ID NO: 826084 - DNA, 13 bp, Homo sapiens
ctctctgggcctt

SEQ ID NO: 826085 - DNA, 14 bp, Homo sapiens
ctctctggggaagt

SEQ ID NO: 826086 - DNA, 18 bp, Homo sapiens
ctctctggggccacacag

SEQ ID NO: 826087 - DNA, 19 bp, Homo sapiens
ctctctggggccacacaga

SEQ ID NO: 826088 - DNA, 20 bp, Homo sapiens
ctctctggggccacacagaa

SEQ ID NO: 826089 - DNA, 17 bp, Homo sapiens
ctctctggggccctggg

SEQ ID NO: 826090 - DNA, 20 bp, Homo sapiens
ctctctggggccctgggcct

SEQ ID NO: 826091 - DNA, 23 bp, Homo sapiens
ctctctggggccctgggcctcag

SEQ ID NO: 826092 - DNA, 23 bp, Homo sapiens
ctctctgggggaggcagggctgg

SEQ ID NO: 826093 - DNA, 16 bp, Homo sapiens
ctctctgtcttctctc

SEQ ID NO: 826094 - DNA, 20 bp, Homo sapiens
ctctctgtcttctctccact

SEQ ID NO: 826095 - DNA, 17 bp, Homo sapiens
ctctctgtgaatacaat

SEQ ID NO: 826096 - DNA, 13 bp, Homo sapiens
ctctctgtggggc

SEQ ID NO: 826097 - DNA, 15 bp, Homo sapiens
ctctctgtggggctg

SEQ ID NO: 826098 - DNA, 16 bp, Homo sapiens
ctctctgtggggctga

SEQ ID NO: 826099 - DNA, 23 bp, Homo sapiens
ctctctgtggggctgaattgcca

SEQ ID NO: 826100 - DNA, 12 bp, Homo sapiens
ctctctgttccc

SEQ ID NO: 826101 - DNA, 15 bp, Homo sapiens
ctctctgttcccttc

SEQ ID NO: 826102 - DNA, 16 bp, Homo sapiens
ctctctgttcccttcc

SEQ ID NO: 826103 - DNA, 18 bp, Homo sapiens
ctctctgttcccttcctc

SEQ ID NO: 826104 - DNA, 23 bp, Homo sapiens
ctctcttatagaatatttattac

SEQ ID NO: 826105 - DNA, 11 bp, Homo sapiens
ctctcttcagc

SEQ ID NO: 826106 - DNA, 24 bp, Homo sapiens
ctctcttccagaagatgccctcca

SEQ ID NO: 826107 - DNA, 13 bp, Homo sapiens
ctctcttccctat

SEQ ID NO: 826108 - DNA, 16 bp, Homo sapiens
ctctcttccgggagct

SEQ ID NO: 826109 - DNA, 20 bp, Homo sapiens
ctctcttccgggagctggtg

SEQ ID NO: 826110 - DNA, 11 bp, Homo sapiens
ctctcttcctg

SEQ ID NO: 826111 - DNA, 12 bp, Homo sapiens
ctctcttcctgc

SEQ ID NO: 826112 - DNA, 15 bp, Homo sapiens
ctctcttcctgcccc

SEQ ID NO: 826113 - DNA, 21 bp, Homo sapiens
ctctcttcctgcccctctttc

SEQ ID NO: 826114 - DNA, 16 bp, Homo sapiens
ctctcttctctccagc

SEQ ID NO: 826115 - DNA, 16 bp, Homo sapiens
ctctcttctgctccac

SEQ ID NO: 826116 - DNA, 14 bp, Homo sapiens
ctctcttgcacccg

SEQ ID NO: 826117 - DNA, 14 bp, Homo sapiens
ctctcttgccagca

SEQ ID NO: 826118 - DNA, 13 bp, Homo sapiens
ctctcttgcccct

SEQ ID NO: 826119 - DNA, 18 bp, Homo sapiens
ctctctttatacagctgt

SEQ ID NO: 826120 - DNA, 19 bp, Homo sapiens
ctctctttatacagctgta

SEQ ID NO: 826121 - DNA, 14 bp, Homo sapiens
ctctctttctctgg

SEQ ID NO: 826122 - DNA, 16 bp, Homo sapiens
ctctctttgcatggat

SEQ ID NO: 826123 - DNA, 16 bp, Homo sapiens
ctctcttttcctctct

SEQ ID NO: 826124 - DNA, 20 bp, Homo sapiens
ctctcttttcctctctgtct

SEQ ID NO: 826125 - DNA, 23 bp, Homo sapiens
ctctgcactccatggccaccccg

SEQ ID NO: 826126 - DNA, 20 bp, Homo sapiens
ctctgcactcccacctgaca

SEQ ID NO: 826127 - DNA, 17 bp, Homo sapiens
ctctgcagacttcccag

SEQ ID NO: 826128 - DNA, 19 bp, Homo sapiens
ctctgcagcaataaagcag

SEQ ID NO: 826129 - DNA, 23 bp, Homo sapiens
ctctgcagcaataaagcagcgtt

SEQ ID NO: 826130 - DNA, 12 bp, Homo sapiens
ctctgcagccca

SEQ ID NO: 826131 - DNA, 13 bp, Homo sapiens
ctctgcagccctc

SEQ ID NO: 826132 - DNA, 12 bp, Homo sapiens
ctctgcagctgc

SEQ ID NO: 826133 - DNA, 20 bp, Homo sapiens
ctctgcaggccactgtgagc

SEQ ID NO: 826134 - DNA, 17 bp, Homo sapiens
ctctgcaggctggggag

SEQ ID NO: 826135 - DNA, 18 bp, Homo sapiens
ctctgcaggctggggagg

SEQ ID NO: 826136 - DNA, 19 bp, Homo sapiens
ctctgcaggctggggaggt

SEQ ID NO: 826137 - DNA, 13 bp, Homo sapiens
ctctgcagtaaaa

SEQ ID NO: 826138 - DNA, 20 bp, Homo sapiens
ctctgcagtcctactcaagc

SEQ ID NO: 826139 - DNA, 13 bp, Homo sapiens
ctctgcagtgcct

SEQ ID NO: 826140 - DNA, 14 bp, Homo sapiens
ctctgcatccagag

SEQ ID NO: 826141 - DNA, 15 bp, Homo sapiens
ctctgcatcccagca

SEQ ID NO: 826142 - DNA, 18 bp, Homo sapiens
ctctgcatcccagcacct

SEQ ID NO: 826143 - DNA, 19 bp, Homo sapiens
ctctgcatcccagcacctg

SEQ ID NO: 826144 - DNA, 23 bp, Homo sapiens
ctctgcatcccagcacctgcctc

SEQ ID NO: 826145 - DNA, 20 bp, Homo sapiens
ctctgcatctactcccaagt

SEQ ID NO: 826146 - DNA, 13 bp, Homo sapiens
ctctgcatctgac

SEQ ID NO: 826147 - DNA, 21 bp, Homo sapiens
ctctgccaaaggatgtgatat

SEQ ID NO: 826148 - DNA, 23 bp, Homo sapiens
ctctgccaatcggctacccctcg

SEQ ID NO: 826149 - DNA, 23 bp, Homo sapiens
ctctgccaatgtgggctgcccct

SEQ ID NO: 826150 - DNA, 14 bp, Homo sapiens
ctctgccacccact

SEQ ID NO: 826151 - DNA, 15 bp, Homo sapiens
ctctgccacccactc

SEQ ID NO: 826152 - DNA, 17 bp, Homo sapiens
ctctgccacccactcag

SEQ ID NO: 826153 - DNA, 20 bp, Homo sapiens
ctctgccacccactcaggat

SEQ ID NO: 826154 - DNA, 12 bp, Homo sapiens
ctctgccacctc

SEQ ID NO: 826155 - DNA, 13 bp, Homo sapiens
ctctgccagtgac

SEQ ID NO: 826156 - DNA, 14 bp, Homo sapiens
ctctgccagtgaca

SEQ ID NO: 826157 - DNA, 15 bp, Homo sapiens
ctctgcccacctggg

SEQ ID NO: 826158 - DNA, 19 bp, Homo sapiens
ctctgcccacctggggtct

SEQ ID NO: 826159 - DNA, 15 bp, Homo sapiens
ctctgcccagggagt

SEQ ID NO: 826160 - DNA, 15 bp, Homo sapiens
ctctgccccaagcag

SEQ ID NO: 826161 - DNA, 17 bp, Homo sapiens
ctctgccccaagcagcc

SEQ ID NO: 826162 - DNA, 21 bp, Homo sapiens
ctctgccccaagcagccagcc

SEQ ID NO: 826163 - DNA, 14 bp, Homo sapiens
ctctgccccaagcc

SEQ ID NO: 826164 - DNA, 15 bp, Homo sapiens
ctctgccccaagccc

SEQ ID NO: 826165 - DNA, 19 bp, Homo sapiens
ctctgccccagctctggct

SEQ ID NO: 826166 - DNA, 15 bp, Homo sapiens
ctctgccccaggccc

SEQ ID NO: 826167 - DNA, 17 bp, Homo sapiens
ctctgccccagtcgtta

SEQ ID NO: 826168 - DNA, 20 bp, Homo sapiens
ctctgcccccgcgggttcta

SEQ ID NO: 826169 - DNA, 14 bp, Homo sapiens
ctctgccccctccc

SEQ ID NO: 826170 - DNA, 17 bp, Homo sapiens
ctctgccccctccccca

SEQ ID NO: 826171 - DNA, 19 bp, Homo sapiens
ctctgccccctcccccatg

SEQ ID NO: 826172 - DNA, 19 bp, Homo sapiens
ctctgccccgtttcttgcc

SEQ ID NO: 826173 - DNA, 13 bp, Homo sapiens
ctctgcccctcag

SEQ ID NO: 826174 - DNA, 19 bp, Homo sapiens
ctctgcccctcagggggcc

SEQ ID NO: 826175 - DNA, 23 bp, Homo sapiens
ctctgcccctcccccagccatgc

SEQ ID NO: 826176 - DNA, 14 bp, Homo sapiens
ctctgccccttggg

SEQ ID NO: 826177 - DNA, 22 bp, Homo sapiens
ctctgccccttgggcatccacc

SEQ ID NO: 826178 - DNA, 20 bp, Homo sapiens
ctctgcccgggccccttgct

SEQ ID NO: 826179 - DNA, 23 bp, Homo sapiens
ctctgccctcattactgggcctt

SEQ ID NO: 826180 - DNA, 17 bp, Homo sapiens
ctctgccctctccctgt

SEQ ID NO: 826181 - DNA, 12 bp, Homo sapiens
ctctgccctctg

SEQ ID NO: 826182 - DNA, 16 bp, Homo sapiens
ctctgccctctgctgc

SEQ ID NO: 826183 - DNA, 16 bp, Homo sapiens
ctctgccctgcctccc

SEQ ID NO: 826184 - DNA, 13 bp, Homo sapiens
ctctgccctgtgt

SEQ ID NO: 826185 - DNA, 14 bp, Homo sapiens
ctctgccctgtgta

SEQ ID NO: 826186 - DNA, 13 bp, Homo sapiens
ctctgcccttccc

SEQ ID NO: 826187 - DNA, 15 bp, Homo sapiens
ctctgcccttcccct

SEQ ID NO: 826188 - DNA, 17 bp, Homo sapiens
ctctgcccttcccctcc

SEQ ID NO: 826189 - DNA, 21 bp, Homo sapiens
ctctgccgctacctccctccc

SEQ ID NO: 826190 - DNA, 23 bp, Homo sapiens
ctctgccggctctttccttgctc

SEQ ID NO: 826191 - DNA, 23 bp, Homo sapiens
ctctgccggtcgggcagccagca

SEQ ID NO: 826192 - DNA, 18 bp, Homo sapiens
ctctgccgtctctggagc

SEQ ID NO: 826193 - DNA, 17 bp, Homo sapiens
ctctgcctacagccagg

SEQ ID NO: 826194 - DNA, 14 bp, Homo sapiens
ctctgcctcctccc

SEQ ID NO: 826195 - DNA, 16 bp, Homo sapiens
ctctgcctcctcccca

SEQ ID NO: 826196 - DNA, 16 bp, Homo sapiens
ctctgcctcctcttca

SEQ ID NO: 826197 - DNA, 21 bp, Homo sapiens
ctctgcctctcccaggctgtc

SEQ ID NO: 826198 - DNA, 15 bp, Homo sapiens
ctctgcctctcttct

SEQ ID NO: 826199 - DNA, 12 bp, Homo sapiens
ctctgcctctgg

SEQ ID NO: 826200 - DNA, 15 bp, Homo sapiens
ctctgcctctgggca

SEQ ID NO: 826201 - DNA, 16 bp, Homo sapiens
ctctgcctctgggcag

SEQ ID NO: 826202 - DNA, 13 bp, Homo sapiens
ctctgcctgcact

SEQ ID NO: 826203 - DNA, 24 bp, Homo sapiens
ctctgcctgcactccctggccttg

SEQ ID NO: 826204 - DNA, 13 bp, Homo sapiens
ctctgcctgcccc

SEQ ID NO: 826205 - DNA, 12 bp, Homo sapiens
ctctgcctgcct

SEQ ID NO: 826206 - DNA, 12 bp, Homo sapiens
ctctgcctgggc

SEQ ID NO: 826207 - DNA, 15 bp, Homo sapiens
ctctgcctgggctct

SEQ ID NO: 826208 - DNA, 20 bp, Homo sapiens
ctctgcctgtccctctcagg

SEQ ID NO: 826209 - DNA, 14 bp, Homo sapiens
ctctgcctgtctgg

SEQ ID NO: 826210 - DNA, 12 bp, Homo sapiens
ctctgccttctt

SEQ ID NO: 826211 - DNA, 21 bp, Homo sapiens
ctctgcctttatgatgctaag

SEQ ID NO: 826212 - DNA, 13 bp, Homo sapiens
ctctgcgccaggc

SEQ ID NO: 826213 - DNA, 18 bp, Homo sapiens
ctctgcgccaggcagagc

SEQ ID NO: 826214 - DNA, 19 bp, Homo sapiens
ctctgcgccaggcagagct

SEQ ID NO: 826215 - DNA, 21 bp, Homo sapiens
ctctgcgccaggcagagctga

SEQ ID NO: 826216 - DNA, 20 bp, Homo sapiens
ctctgcggatagcatttggt

SEQ ID NO: 826217 - DNA, 15 bp, Homo sapiens
ctctgcggcccgggc

SEQ ID NO: 826218 - DNA, 19 bp, Homo sapiens
ctctgcggcccgggccgac

SEQ ID NO: 826219 - DNA, 22 bp, Homo sapiens
ctctgcgtcggtcctggtgccc

SEQ ID NO: 826220 - DNA, 22 bp, Homo sapiens
ctctgcgtgtcacctgtgcttc

SEQ ID NO: 826221 - DNA, 15 bp, Homo sapiens
ctctgctatgagtgt

SEQ ID NO: 826222 - DNA, 19 bp, Homo sapiens
ctctgctatgcattttctt

SEQ ID NO: 826223 - DNA, 21 bp, Homo sapiens
ctctgctatgcattttcttca

SEQ ID NO: 826224 - DNA, 12 bp, Homo sapiens
ctctgctccacc

SEQ ID NO: 826225 - DNA, 19 bp, Homo sapiens
ctctgctccaccacatcct

SEQ ID NO: 826226 - DNA, 13 bp, Homo sapiens
ctctgctccagca

SEQ ID NO: 826227 - DNA, 13 bp, Homo sapiens
ctctgctccccag

SEQ ID NO: 826228 - DNA, 13 bp, Homo sapiens
ctctgctccctct

SEQ ID NO: 826229 - DNA, 14 bp, Homo sapiens
ctctgctctagcca

SEQ ID NO: 826230 - DNA, 17 bp, Homo sapiens
ctctgctctagccagga

SEQ ID NO: 826231 - DNA, 15 bp, Homo sapiens
ctctgctctgaggct

SEQ ID NO: 826232 - DNA, 15 bp, Homo sapiens
ctctgctctgccctt

SEQ ID NO: 826233 - DNA, 13 bp, Homo sapiens
ctctgctctgcct

SEQ ID NO: 826234 - DNA, 12 bp, Homo sapiens
ctctgctcttgt

SEQ ID NO: 826235 - DNA, 14 bp, Homo sapiens
ctctgctgaatgca

SEQ ID NO: 826236 - DNA, 23 bp, Homo sapiens
ctctgctgagcggtactaaacgg

SEQ ID NO: 826237 - DNA, 19 bp, Homo sapiens
ctctgctgagctgggccca

SEQ ID NO: 826238 - DNA, 15 bp, Homo sapiens
ctctgctgccatggc

SEQ ID NO: 826239 - DNA, 16 bp, Homo sapiens
ctctgctgcccccttc

SEQ ID NO: 826240 - DNA, 23 bp, Homo sapiens
ctctgctgcccccttccccagcc

SEQ ID NO: 826241 - DNA, 15 bp, Homo sapiens
ctctgctgcctctgt

SEQ ID NO: 826242 - DNA, 17 bp, Homo sapiens
ctctgctgcctctgtgg

SEQ ID NO: 826243 - DNA, 15 bp, Homo sapiens
ctctgctgctcatgg

SEQ ID NO: 826244 - DNA, 18 bp, Homo sapiens
ctctgctggcccagccaa

SEQ ID NO: 826245 - DNA, 15 bp, Homo sapiens
ctctgctggcctggc

SEQ ID NO: 826246 - DNA, 16 bp, Homo sapiens
ctctgctggcctggcc

SEQ ID NO: 826247 - DNA, 21 bp, Homo sapiens
ctctgctggcctggccggcaa

SEQ ID NO: 826248 - DNA, 12 bp, Homo sapiens
ctcttaaaatat

SEQ ID NO: 826249 - DNA, 17 bp, Homo sapiens
ctcttaaaatatcttcc

SEQ ID NO: 826250 - DNA, 18 bp, Homo sapiens
ctcttaaagttggaattt

SEQ ID NO: 826251 - DNA, 22 bp, Homo sapiens
ctcttaaagttggaatttacca

SEQ ID NO: 826252 - DNA, 17 bp, Homo sapiens
ctcttaaataaaaataa

SEQ ID NO: 826253 - DNA, 18 bp, Homo sapiens
ctcttaaatactttttca

SEQ ID NO: 826254 - DNA, 18 bp, Homo sapiens
ctcttaaatattctgaat

SEQ ID NO: 826255 - DNA, 13 bp, Homo sapiens
ctcttaaatcatt

SEQ ID NO: 826256 - DNA, 12 bp, Homo sapiens
ctcttaagaaac

SEQ ID NO: 826257 - DNA, 19 bp, Homo sapiens
ctcttaagatgtccagggc

SEQ ID NO: 826258 - DNA, 15 bp, Homo sapiens
ctcttaagcagcatg

SEQ ID NO: 826259 - DNA, 21 bp, Homo sapiens
ctcttaagtggtctagtcaag

SEQ ID NO: 826260 - DNA, 17 bp, Homo sapiens
ctcttaatattgagaat

SEQ ID NO: 826261 - DNA, 20 bp, Homo sapiens
ctcttaattttaaagaccca

SEQ ID NO: 826262 - DNA, 14 bp, Homo sapiens
ctcttacaaaagct

SEQ ID NO: 826263 - DNA, 18 bp, Homo sapiens
ctcttacgcccaaccctt

SEQ ID NO: 826264 - DNA, 14 bp, Homo sapiens
ctcttacttgccaa

SEQ ID NO: 826265 - DNA, 15 bp, Homo sapiens
ctcttagaaaaacca

SEQ ID NO: 826266 - DNA, 15 bp, Homo sapiens
ctcttagaaatactt

SEQ ID NO: 826267 - DNA, 15 bp, Homo sapiens
ctcttagaacattgt

SEQ ID NO: 826268 - DNA, 18 bp, Homo sapiens
ctcttagaagaatattgt

SEQ ID NO: 826269 - DNA, 22 bp, Homo sapiens
ctcttagaagaatattgtattg

SEQ ID NO: 826270 - DNA, 15 bp, Homo sapiens
ctcttagaagccatg

SEQ ID NO: 826271 - DNA, 17 bp, Homo sapiens
ctcttagcagcttccag

SEQ ID NO: 826272 - DNA, 16 bp, Homo sapiens
ctcttagctactgtat

SEQ ID NO: 826273 - DNA, 19 bp, Homo sapiens
ctcttagcttacaggaagc

SEQ ID NO: 826274 - DNA, 13 bp, Homo sapiens
ctcttaggcacat

SEQ ID NO: 826275 - DNA, 21 bp, Homo sapiens
ctcttaggtctaatgatattt

SEQ ID NO: 826276 - DNA, 15 bp, Homo sapiens
ctcttagtgcccgcc

SEQ ID NO: 826277 - DNA, 16 bp, Homo sapiens
ctcttagtgcccgcct

SEQ ID NO: 826278 - DNA, 21 bp, Homo sapiens
ctcttagtgcccgcctaggag

SEQ ID NO: 826279 - DNA, 17 bp, Homo sapiens
ctcttatagaatattta

SEQ ID NO: 826280 - DNA, 18 bp, Homo sapiens
ctcttatagaatatttat

SEQ ID NO: 826281 - DNA, 20 bp, Homo sapiens
ctcttatagaatatttatta

SEQ ID NO: 826282 - DNA, 22 bp, Homo sapiens
ctcttatctcatcctttcctct

SEQ ID NO: 826283 - DNA, 21 bp, Homo sapiens
ctcttattgggatatcatttt

SEQ ID NO: 826284 - DNA, 15 bp, Homo sapiens
ctcttattgtccttc

SEQ ID NO: 826285 - DNA, 14 bp, Homo sapiens
ctcttcaaagcaga

SEQ ID NO: 826286 - DNA, 16 bp, Homo sapiens
ctcttcaaagcagagt

SEQ ID NO: 826287 - DNA, 18 bp, Homo sapiens
ctcttcaagtactgtttt

SEQ ID NO: 826288 - DNA, 17 bp, Homo sapiens
ctcttcaccccccactc

SEQ ID NO: 826289 - DNA, 11 bp, Homo sapiens
ctcttcagaaa

SEQ ID NO: 826290 - DNA, 17 bp, Homo sapiens
ctcttcaggcctccctc

SEQ ID NO: 826291 - DNA, 20 bp, Homo sapiens
ctcttcaggcctccctctct

SEQ ID NO: 826292 - DNA, 15 bp, Homo sapiens
ctcttcaggttctca

SEQ ID NO: 826293 - DNA, 15 bp, Homo sapiens
ctcttcaggttctta

SEQ ID NO: 826294 - DNA, 13 bp, Homo sapiens
ctcttcatacttt

SEQ ID NO: 826295 - DNA, 14 bp, Homo sapiens
ctcttcatctaata

SEQ ID NO: 826296 - DNA, 13 bp, Homo sapiens
ctcttcatctgcc

SEQ ID NO: 826297 - DNA, 15 bp, Homo sapiens
ctcttcatctgcctg

SEQ ID NO: 826298 - DNA, 16 bp, Homo sapiens
ctcttcatctgcctgc

SEQ ID NO: 826299 - DNA, 17 bp, Homo sapiens
ctcttcatgcttgacat

SEQ ID NO: 826300 - DNA, 18 bp, Homo sapiens
ctcttcatttttttttca

SEQ ID NO: 826301 - DNA, 14 bp, Homo sapiens
ctcttccaaagctc

SEQ ID NO: 826302 - DNA, 18 bp, Homo sapiens
ctcttccagaagatgccc

SEQ ID NO: 826303 - DNA, 13 bp, Homo sapiens
ctcttccagaatc

SEQ ID NO: 826304 - DNA, 18 bp, Homo sapiens
ctcttccagaatcccaag

SEQ ID NO: 826305 - DNA, 24 bp, Homo sapiens
ctcttccaggagccaccttgccac

SEQ ID NO: 826306 - DNA, 18 bp, Homo sapiens
ctcttcccagttcagctt

SEQ ID NO: 826307 - DNA, 13 bp, Homo sapiens
ctcttccccagag

SEQ ID NO: 826308 - DNA, 16 bp, Homo sapiens
ctcttccccagagagg

SEQ ID NO: 826309 - DNA, 14 bp, Homo sapiens
ctcttcccccaaga

SEQ ID NO: 826310 - DNA, 16 bp, Homo sapiens
ctcttcccctagacct

SEQ ID NO: 826311 - DNA, 22 bp, Homo sapiens
ctcttcccctccctcccacact

SEQ ID NO: 826312 - DNA, 23 bp, Homo sapiens
ctcttcccctccctcccacactt

SEQ ID NO: 826313 - DNA, 17 bp, Homo sapiens
ctcttccccttcctgtt

SEQ ID NO: 826314 - DNA, 20 bp, Homo sapiens
ctcttccccttcctgtttca

SEQ ID NO: 826315 - DNA, 21 bp, Homo sapiens
ctcttccccttcctgtttcag

SEQ ID NO: 826316 - DNA, 15 bp, Homo sapiens
ctcttccccttgccc

SEQ ID NO: 826317 - DNA, 20 bp, Homo sapiens
ctcttccctgaacgttttct

SEQ ID NO: 826318 - DNA, 22 bp, Homo sapiens
ctcttccctgaacgttttcttc

SEQ ID NO: 826319 - DNA, 16 bp, Homo sapiens
ctcttcccttagcctc

SEQ ID NO: 826320 - DNA, 21 bp, Homo sapiens
ctcttcccttagcctctccca

SEQ ID NO: 826321 - DNA, 23 bp, Homo sapiens
ctcttcccttagcctctcccacc

SEQ ID NO: 826322 - DNA, 12 bp, Homo sapiens
ctcttcccttcc

SEQ ID NO: 826323 - DNA, 15 bp, Homo sapiens
ctcttcccttcctcc

SEQ ID NO: 826324 - DNA, 18 bp, Homo sapiens
ctcttcccttcctccatt

SEQ ID NO: 826325 - DNA, 20 bp, Homo sapiens
ctcttccgaaaaatcctctt

SEQ ID NO: 826326 - DNA, 22 bp, Homo sapiens
ctcttccgaaaaatcctcttcc

SEQ ID NO: 826327 - DNA, 16 bp, Homo sapiens
ctcttccgagctgctt

SEQ ID NO: 826328 - DNA, 19 bp, Homo sapiens
ctcttccggagatgtagca

SEQ ID NO: 826329 - DNA, 18 bp, Homo sapiens
ctcttccgggagctggtg

SEQ ID NO: 826330 - DNA, 15 bp, Homo sapiens
ctcttcctacccaac

SEQ ID NO: 826331 - DNA, 19 bp, Homo sapiens
ctcttcctacccaaccact

SEQ ID NO: 826332 - DNA, 18 bp, Homo sapiens
ctcttcctaccctgcctc

SEQ ID NO: 826333 - DNA, 17 bp, Homo sapiens
ctcttcctcatcctgct

SEQ ID NO: 826334 - DNA, 15 bp, Homo sapiens
ctcttcctctgggca

SEQ ID NO: 826335 - DNA, 20 bp, Homo sapiens
ctcttcctctggttcctttc

SEQ ID NO: 826336 - DNA, 21 bp, Homo sapiens
ctcttcctctggttcctttca

SEQ ID NO: 826337 - DNA, 12 bp, Homo sapiens
ctcttcctcttg

SEQ ID NO: 826338 - DNA, 16 bp, Homo sapiens
ctcttcctcttgaccc

SEQ ID NO: 826339 - DNA, 19 bp, Homo sapiens
ctcttcctgcccctctttc

SEQ ID NO: 826340 - DNA, 21 bp, Homo sapiens
ctcttcctgcccctctttctc

SEQ ID NO: 826341 - DNA, 22 bp, Homo sapiens
ctcttcctgcccctctttctct

SEQ ID NO: 826342 - DNA, 14 bp, Homo sapiens
ctcttcctgccctt

SEQ ID NO: 826343 - DNA, 19 bp, Homo sapiens
ctcttcctggacctgagtc

SEQ ID NO: 826344 - DNA, 13 bp, Homo sapiens
ctcttcctgtgat

SEQ ID NO: 826345 - DNA, 20 bp, Homo sapiens
ctcttccttcccccatcccc

SEQ ID NO: 826346 - DNA, 22 bp, Homo sapiens
ctcttccttcccccatcccctt

SEQ ID NO: 826347 - DNA, 19 bp, Homo sapiens
ctcttcctttgctctgagg

SEQ ID NO: 826348 - DNA, 13 bp, Homo sapiens
ctcttcggccctc

SEQ ID NO: 826349 - DNA, 15 bp, Homo sapiens
ctcttctaagaggat

SEQ ID NO: 826350 - DNA, 23 bp, Homo sapiens
ctcttctactacccccacagacc

SEQ ID NO: 826351 - DNA, 19 bp, Homo sapiens
ctcttctattttgtaaact

SEQ ID NO: 826352 - DNA, 17 bp, Homo sapiens
ctcttctccactggatg

SEQ ID NO: 826353 - DNA, 13 bp, Homo sapiens
ctcttctccttgc

SEQ ID NO: 826354 - DNA, 21 bp, Homo sapiens
ctcttctccttgccttgcttc

SEQ ID NO: 826355 - DNA, 16 bp, Homo sapiens
ctcttctcctttcaca

SEQ ID NO: 826356 - DNA, 13 bp, Homo sapiens
ctcttctctccag

SEQ ID NO: 826357 - DNA, 22 bp, Homo sapiens
ctcttctctccagctgactaaa

SEQ ID NO: 826358 - DNA, 17 bp, Homo sapiens
ctcttctctcctcagtt

SEQ ID NO: 826359 - DNA, 22 bp, Homo sapiens
ctcttctgagctatttcatcta

SEQ ID NO: 826360 - DNA, 18 bp, Homo sapiens
ctcttctgctccaccctt

SEQ ID NO: 826361 - DNA, 15 bp, Homo sapiens
ctcttctgctcctta

SEQ ID NO: 826362 - DNA, 20 bp, Homo sapiens
ctcttctgcttaggagagac

SEQ ID NO: 826363 - DNA, 22 bp, Homo sapiens
ctcttctgggagggcagcaggg

SEQ ID NO: 826364 - DNA, 14 bp, Homo sapiens
ctcttctgggcaga

SEQ ID NO: 826365 - DNA, 15 bp, Homo sapiens
ctcttctgggcagag

SEQ ID NO: 826366 - DNA, 20 bp, Homo sapiens
ctcttctgggcagagcctgt

SEQ ID NO: 826367 - DNA, 18 bp, Homo sapiens
ctcttctgggctactgcc

SEQ ID NO: 826368 - DNA, 21 bp, Homo sapiens
ctcttctggggcaggctgggc

SEQ ID NO: 826369 - DNA, 19 bp, Homo sapiens
ctcttctgtccatcagtgc

SEQ ID NO: 826370 - DNA, 22 bp, Homo sapiens
ctgaaagccaaggcagctcttc

SEQ ID NO: 826371 - DNA, 23 bp, Homo sapiens
ctgaaagccatttgttggggcag

SEQ ID NO: 826372 - DNA, 15 bp, Homo sapiens
ctgaaagccctgagc

SEQ ID NO: 826373 - DNA, 18 bp, Homo sapiens
ctgaaagccctgagcttt

SEQ ID NO: 826374 - DNA, 16 bp, Homo sapiens
ctgaaagcctgtctct

SEQ ID NO: 826375 - DNA, 20 bp, Homo sapiens
ctgaaaggaaatacacttct

SEQ ID NO: 826376 - DNA, 21 bp, Homo sapiens
ctgaaaggaaatacacttctt

SEQ ID NO: 826377 - DNA, 19 bp, Homo sapiens
ctgaaaggatgtggaagag

SEQ ID NO: 826378 - DNA, 23 bp, Homo sapiens
ctgaaagggcacttaatttgtaa

SEQ ID NO: 826379 - DNA, 19 bp, Homo sapiens
ctgaaagggcccttcccct

SEQ ID NO: 826380 - DNA, 16 bp, Homo sapiens
ctgaaaggttaattct

SEQ ID NO: 826381 - DNA, 16 bp, Homo sapiens
ctgaaagtagggggct

SEQ ID NO: 826382 - DNA, 16 bp, Homo sapiens
ctgaaagtcctgcttt

SEQ ID NO: 826383 - DNA, 14 bp, Homo sapiens
ctgaaagtgtttta

SEQ ID NO: 826384 - DNA, 15 bp, Homo sapiens
ctgaaagttttgtaa

SEQ ID NO: 826385 - DNA, 22 bp, Homo sapiens
ctgaaataaatgtttcaaatgc

SEQ ID NO: 826386 - DNA, 19 bp, Homo sapiens
ctgaaatctcagaattcct

SEQ ID NO: 826387 - DNA, 14 bp, Homo sapiens
ctgaaatctccttt

SEQ ID NO: 826388 - DNA, 18 bp, Homo sapiens
ctgaaatgaaacaaataa

SEQ ID NO: 826389 - DNA, 17 bp, Homo sapiens
ctgaaatgaccaagaca

SEQ ID NO: 826390 - DNA, 13 bp, Homo sapiens
ctgaaatgtcagt

SEQ ID NO: 826391 - DNA, 20 bp, Homo sapiens
ctgaaatgtcagttctgata

SEQ ID NO: 826392 - DNA, 14 bp, Homo sapiens
ctgaaatgtttgga

SEQ ID NO: 826393 - DNA, 13 bp, Homo sapiens
ctgaaattaaaga

SEQ ID NO: 826394 - DNA, 20 bp, Homo sapiens
ctgaaattaaagaaatgaaa

SEQ ID NO: 826395 - DNA, 18 bp, Homo sapiens
ctgaaattaatttgtgaa

SEQ ID NO: 826396 - DNA, 22 bp, Homo sapiens
ctgaaattcagagcaagttcct

SEQ ID NO: 826397 - DNA, 18 bp, Homo sapiens
ctgaaattctcctggagg

SEQ ID NO: 826398 - DNA, 19 bp, Homo sapiens
ctgaaattgcttatttttg

SEQ ID NO: 826399 - DNA, 22 bp, Homo sapiens
ctgaaattgttttaccagctcc

SEQ ID NO: 826400 - DNA, 13 bp, Homo sapiens
ctgaaatttcaga

SEQ ID NO: 826401 - DNA, 13 bp, Homo sapiens
ctgaaattttaga

SEQ ID NO: 826402 - DNA, 22 bp, Homo sapiens
ctgaaattttagaaatattcac

SEQ ID NO: 826403 - DNA, 13 bp, Homo sapiens
ctgaaattttata

SEQ ID NO: 826404 - DNA, 19 bp, Homo sapiens
ctgaaattttatatgctta

SEQ ID NO: 826405 - DNA, 19 bp, Homo sapiens
ctgaaatttttcttcttga

SEQ ID NO: 826406 - DNA, 20 bp, Homo sapiens
ctgaaatttttcttcttgag

SEQ ID NO: 826407 - DNA, 17 bp, Homo sapiens
ctgaaatttttttccta

SEQ ID NO: 826408 - DNA, 19 bp, Homo sapiens
ctgaaatttttttcctaag

SEQ ID NO: 826409 - DNA, 18 bp, Homo sapiens
ctgaacaaaacctacgca

SEQ ID NO: 826410 - DNA, 22 bp, Homo sapiens
ctgaacaaacactgaatcatgt

SEQ ID NO: 826411 - DNA, 21 bp, Homo sapiens
ctgaacaaagtgctagacttt

SEQ ID NO: 826412 - DNA, 19 bp, Homo sapiens
ctgaacaataggctgttcc

SEQ ID NO: 826413 - DNA, 20 bp, Homo sapiens
ctgaacacacacgccagctc

SEQ ID NO: 826414 - DNA, 22 bp, Homo sapiens
ctgaacacacacgccagctcct

SEQ ID NO: 826415 - DNA, 15 bp, Homo sapiens
ctgaacacagtgtct

SEQ ID NO: 826416 - DNA, 19 bp, Homo sapiens
ctgaacacatgtgtatgat

SEQ ID NO: 826417 - DNA, 11 bp, Homo sapiens
ctgaacaccat

SEQ ID NO: 826418 - DNA, 19 bp, Homo sapiens
ctgaacacttttgttgtaa

SEQ ID NO: 826419 - DNA, 14 bp, Homo sapiens
ctgaacagaattaa

SEQ ID NO: 826420 - DNA, 21 bp, Homo sapiens
ctgaacagcagtaatcctggg

SEQ ID NO: 826421 - DNA, 22 bp, Homo sapiens
ctgaacagcagtaatcctgggg

SEQ ID NO: 826422 - DNA, 14 bp, Homo sapiens
ctgaacaggctggg

SEQ ID NO: 826423 - DNA, 12 bp, Homo sapiens
ctgaacatgcct

SEQ ID NO: 826424 - DNA, 16 bp, Homo sapiens
ctgaacatgcctgcca

SEQ ID NO: 826425 - DNA, 14 bp, Homo sapiens
ctgaacattgcata

SEQ ID NO: 826426 - DNA, 16 bp, Homo sapiens
ctgaaccacaaaaaaa

SEQ ID NO: 826427 - DNA, 23 bp, Homo sapiens
ctgaaccacgaggctgcccccat

SEQ ID NO: 826428 - DNA, 14 bp, Homo sapiens
ctgaaccactgctt

SEQ ID NO: 826429 - DNA, 22 bp, Homo sapiens
ctgaaccactgcttctcttttg

SEQ ID NO: 826430 - DNA, 14 bp, Homo sapiens
ctgaaccatccctg

SEQ ID NO: 826431 - DNA, 16 bp, Homo sapiens
ctgaaccatccctgat

SEQ ID NO: 826432 - DNA, 12 bp, Homo sapiens
ctgaaccatgtg

SEQ ID NO: 826433 - DNA, 13 bp, Homo sapiens
ctgaacccagctg

SEQ ID NO: 826434 - DNA, 15 bp, Homo sapiens
ctgaaccccatgggc

SEQ ID NO: 826435 - DNA, 18 bp, Homo sapiens
ctgaaccccatgggcttg

SEQ ID NO: 826436 - DNA, 14 bp, Homo sapiens
ctgaacccctggcc

SEQ ID NO: 826437 - DNA, 22 bp, Homo sapiens
ctgaacccgtccattcagaaag

SEQ ID NO: 826438 - DNA, 14 bp, Homo sapiens
ctgaaccctgtgct

SEQ ID NO: 826439 - DNA, 15 bp, Homo sapiens
ctgaaccctgtgctg

SEQ ID NO: 826440 - DNA, 23 bp, Homo sapiens
ctgaaccctgtgctggtgtcctg

SEQ ID NO: 826441 - DNA, 22 bp, Homo sapiens
ctgaaccgactgaccctgagga

SEQ ID NO: 826442 - DNA, 21 bp, Homo sapiens
ctgaacctgggtaactaggga

SEQ ID NO: 826443 - DNA, 18 bp, Homo sapiens
ctgaaccttaggctttgt

SEQ ID NO: 826444 - DNA, 14 bp, Homo sapiens
ctgaaccttgagca

SEQ ID NO: 826445 - DNA, 18 bp, Homo sapiens
ctgaaccttgagcaaatt

SEQ ID NO: 826446 - DNA, 19 bp, Homo sapiens
ctgaacgatccttcaaagt

SEQ ID NO: 826447 - DNA, 20 bp, Homo sapiens
ctgaacgatccttcaaagtc

SEQ ID NO: 826448 - DNA, 23 bp, Homo sapiens
ctgaacgtttccccgaagagtca

SEQ ID NO: 826449 - DNA, 20 bp, Homo sapiens
ctgaacgttttcttctttcc

SEQ ID NO: 826450 - DNA, 15 bp, Homo sapiens
ctgaactcaaactga

SEQ ID NO: 826451 - DNA, 18 bp, Homo sapiens
ctgaactcaaactgagga

SEQ ID NO: 826452 - DNA, 13 bp, Homo sapiens
ctgaactcacttt

SEQ ID NO: 826453 - DNA, 17 bp, Homo sapiens
ctgaactcagaccactt

SEQ ID NO: 826454 - DNA, 11 bp, Homo sapiens
ctgaactcagc

SEQ ID NO: 826455 - DNA, 21 bp, Homo sapiens
ctgaactccaccgaccaactg

SEQ ID NO: 826456 - DNA, 12 bp, Homo sapiens
ctgaactccaga

SEQ ID NO: 826457 - DNA, 20 bp, Homo sapiens
ctgaactccatacagcctct

SEQ ID NO: 826458 - DNA, 14 bp, Homo sapiens
ctgaactcctggct

SEQ ID NO: 826459 - DNA, 12 bp, Homo sapiens
ctgaactctcaa

SEQ ID NO: 826460 - DNA, 13 bp, Homo sapiens
ctgaactgaggag

SEQ ID NO: 826461 - DNA, 13 bp, Homo sapiens
ctgaactgaggcc

SEQ ID NO: 826462 - DNA, 16 bp, Homo sapiens
ctgaactgcaacactg

SEQ ID NO: 826463 - DNA, 20 bp, Homo sapiens
ctgaacttaataactgtgta

SEQ ID NO: 826464 - DNA, 17 bp, Homo sapiens
ctgaacttgcattgtga

SEQ ID NO: 826465 - DNA, 19 bp, Homo sapiens
ctgaactttctccctcatc

SEQ ID NO: 826466 - DNA, 22 bp, Homo sapiens
ctgaacttttaatgaactttga

SEQ ID NO: 826467 - DNA, 16 bp, Homo sapiens
ctgaacttttgtggag

SEQ ID NO: 826468 - DNA, 17 bp, Homo sapiens
ctgaacttttgtggagt

SEQ ID NO: 826469 - DNA, 18 bp, Homo sapiens
ctgaacttttgtggagtt

SEQ ID NO: 826470 - DNA, 13 bp, Homo sapiens
ctgaagaacagta

SEQ ID NO: 826471 - DNA, 17 bp, Homo sapiens
ctgaagaactctctgga

SEQ ID NO: 826472 - DNA, 17 bp, Homo sapiens
ctgaagaagatgagcct

SEQ ID NO: 826473 - DNA, 15 bp, Homo sapiens
ctgaagaattaagat

SEQ ID NO: 826474 - DNA, 15 bp, Homo sapiens
ctgaagactgagaac

SEQ ID NO: 826475 - DNA, 15 bp, Homo sapiens
ctgaagactgaggac

SEQ ID NO: 826476 - DNA, 12 bp, Homo sapiens
ctgaagactgca

SEQ ID NO: 826477 - DNA, 20 bp, Homo sapiens
ctgaagagaccttggctgct

SEQ ID NO: 826478 - DNA, 20 bp, Homo sapiens
ctgaagagagggacaggcac

SEQ ID NO: 826479 - DNA, 16 bp, Homo sapiens
ctgaagagcaaggttt

SEQ ID NO: 826480 - DNA, 12 bp, Homo sapiens
ctgaagagcatt

SEQ ID NO: 826481 - DNA, 20 bp, Homo sapiens
ctgaagagcgctcctctgcc

SEQ ID NO: 826482 - DNA, 21 bp, Homo sapiens
ctgaagagcgctcctctgcct

SEQ ID NO: 826483 - DNA, 22 bp, Homo sapiens
ctgaagagcgctcctctgcctt

SEQ ID NO: 826484 - DNA, 15 bp, Homo sapiens
ctgaagagtcctctg

SEQ ID NO: 826485 - DNA, 20 bp, Homo sapiens
ctgaagagtgggtttcacaa

SEQ ID NO: 826486 - DNA, 22 bp, Homo sapiens
ctgaagatgaaatatatattgt

SEQ ID NO: 826487 - DNA, 23 bp, Homo sapiens
ctgaagatgcccctgctccctct

SEQ ID NO: 826488 - DNA, 20 bp, Homo sapiens
ctgaagatggcatcctgtga

SEQ ID NO: 826489 - DNA, 13 bp, Homo sapiens
ctgaagatggctt

SEQ ID NO: 826490 - DNA, 17 bp, Homo sapiens
ctgaagatgtctcctca

SEQ ID NO: 826491 - DNA, 24 bp, Homo sapiens
ctgaagatgtctcctcaagcctgt

SEQ ID NO: 826492 - DNA, 22 bp, Homo sapiens
ctgacctgtaggtcaggaccat

SEQ ID NO: 826493 - DNA, 20 bp, Homo sapiens
ctgacctgtcatgcccccct

SEQ ID NO: 826494 - DNA, 23 bp, Homo sapiens
ctgacctgtcatgcccccctcaa

SEQ ID NO: 826495 - DNA, 12 bp, Homo sapiens
ctgacctgtcca

SEQ ID NO: 826496 - DNA, 17 bp, Homo sapiens
ctgacctgtgagcccag

SEQ ID NO: 826497 - DNA, 20 bp, Homo sapiens
ctgacctgtgagcccagctg

SEQ ID NO: 826498 - DNA, 18 bp, Homo sapiens
ctgacctgttgccagcag

SEQ ID NO: 826499 - DNA, 20 bp, Homo sapiens
ctgaccttccagagcccaag

SEQ ID NO: 826500 - DNA, 13 bp, Homo sapiens
ctgaccttctgcg

SEQ ID NO: 826501 - DNA, 22 bp, Homo sapiens
ctgaccttctgcggctccgggc

SEQ ID NO: 826502 - DNA, 15 bp, Homo sapiens
ctgaccttgctgcca

SEQ ID NO: 826503 - DNA, 16 bp, Homo sapiens
ctgaccttggaggaat

SEQ ID NO: 826504 - DNA, 18 bp, Homo sapiens
ctgaccttggctgactgg

SEQ ID NO: 826505 - DNA, 16 bp, Homo sapiens
ctgacgcaacccacgt

SEQ ID NO: 826506 - DNA, 14 bp, Homo sapiens
ctgacgcaccactg

SEQ ID NO: 826507 - DNA, 19 bp, Homo sapiens
ctgacgcaccactgccaat

SEQ ID NO: 826508 - DNA, 18 bp, Homo sapiens
ctgacgctggagatgcaa

SEQ ID NO: 826509 - DNA, 19 bp, Homo sapiens
ctgacgcttgtgacagtgc

SEQ ID NO: 826510 - DNA, 21 bp, Homo sapiens
ctgacgcttgtgacagtgcct

SEQ ID NO: 826511 - DNA, 21 bp, Homo sapiens
ctgacgtctgaagcttgactc

SEQ ID NO: 826512 - DNA, 22 bp, Homo sapiens
ctgacgtctgaagcttgactcc

SEQ ID NO: 826513 - DNA, 20 bp, Homo sapiens
ctgacgtgccttttgcaccc

SEQ ID NO: 826514 - DNA, 23 bp, Homo sapiens
ctgacgtgccttttgcacccctc

SEQ ID NO: 826515 - DNA, 12 bp, Homo sapiens
ctgacgtgggca

SEQ ID NO: 826516 - DNA, 14 bp, Homo sapiens
ctgactaaactttt

SEQ ID NO: 826517 - DNA, 19 bp, Homo sapiens
ctgactaaactttttttct

SEQ ID NO: 826518 - DNA, 14 bp, Homo sapiens
ctgactaagaaatt

SEQ ID NO: 826519 - DNA, 20 bp, Homo sapiens
ctgactactactctgccaat

SEQ ID NO: 826520 - DNA, 18 bp, Homo sapiens
ctgactcaacatgttact

SEQ ID NO: 826521 - DNA, 15 bp, Homo sapiens
ctgactcacaagaag

SEQ ID NO: 826522 - DNA, 22 bp, Homo sapiens
ctgactcacacctgaactgaac

SEQ ID NO: 826523 - DNA, 16 bp, Homo sapiens
ctgactcagggctcct

SEQ ID NO: 826524 - DNA, 16 bp, Homo sapiens
ctgactcatcatttgt

SEQ ID NO: 826525 - DNA, 19 bp, Homo sapiens
ctgactcatccccacagct

SEQ ID NO: 826526 - DNA, 16 bp, Homo sapiens
ctgactcattctgaag

SEQ ID NO: 826527 - DNA, 13 bp, Homo sapiens
ctgactccagagt

SEQ ID NO: 826528 - DNA, 22 bp, Homo sapiens
ctgactccagagtctgagcccc

SEQ ID NO: 826529 - DNA, 20 bp, Homo sapiens
ctgactccctccccacccaa

SEQ ID NO: 826530 - DNA, 15 bp, Homo sapiens
ctgactccctctcag

SEQ ID NO: 826531 - DNA, 15 bp, Homo sapiens
ctgactccctgtggg

SEQ ID NO: 826532 - DNA, 21 bp, Homo sapiens
ctgactccctgtgggggtggc

SEQ ID NO: 826533 - DNA, 23 bp, Homo sapiens
ctgactccctgtgggggtggcca

SEQ ID NO: 826534 - DNA, 22 bp, Homo sapiens
ctgactcctctggctttcccag

SEQ ID NO: 826535 - DNA, 15 bp, Homo sapiens
ctgactcctgggtgg

SEQ ID NO: 826536 - DNA, 13 bp, Homo sapiens
ctgactccttaga

SEQ ID NO: 826537 - DNA, 15 bp, Homo sapiens
ctgactctctgagct

SEQ ID NO: 826538 - DNA, 14 bp, Homo sapiens
ctgactctctgtga

SEQ ID NO: 826539 - DNA, 15 bp, Homo sapiens
ctgactctgaaatct

SEQ ID NO: 826540 - DNA, 20 bp, Homo sapiens
ctgactctgaaatctgaaga

SEQ ID NO: 826541 - DNA, 16 bp, Homo sapiens
ctgactctgttattga

SEQ ID NO: 826542 - DNA, 14 bp, Homo sapiens
ctgactgaaggaaa

SEQ ID NO: 826543 - DNA, 17 bp, Homo sapiens
ctgactgagcaggctgt

SEQ ID NO: 826544 - DNA, 20 bp, Homo sapiens
ctgactggattcattctcat

SEQ ID NO: 826545 - DNA, 16 bp, Homo sapiens
ctgactggccaaaccc

SEQ ID NO: 826546 - DNA, 12 bp, Homo sapiens
ctgactggggct

SEQ ID NO: 826547 - DNA, 22 bp, Homo sapiens
ctgactggtgctataggctgga

SEQ ID NO: 826548 - DNA, 15 bp, Homo sapiens
ctgactggttgtcag

SEQ ID NO: 826549 - DNA, 17 bp, Homo sapiens
ctgactggttgtcagaa

SEQ ID NO: 826550 - DNA, 19 bp, Homo sapiens
ctgactggttgtcagaatg

SEQ ID NO: 826551 - DNA, 17 bp, Homo sapiens
ctgactgtcagggaggg

SEQ ID NO: 826552 - DNA, 18 bp, Homo sapiens
ctgactgtcagggagggc

SEQ ID NO: 826553 - DNA, 23 bp, Homo sapiens
ctgactgtcagggagggccaggg

SEQ ID NO: 826554 - DNA, 16 bp, Homo sapiens
ctgactgtccctgcca

SEQ ID NO: 826555 - DNA, 17 bp, Homo sapiens
ctgactgtccctgccaa

SEQ ID NO: 826556 - DNA, 18 bp, Homo sapiens
ctgactgtccctgccaat

SEQ ID NO: 826557 - DNA, 15 bp, Homo sapiens
ctgactgtgcccaag

SEQ ID NO: 826558 - DNA, 13 bp, Homo sapiens
ctgactgtggccc

SEQ ID NO: 826559 - DNA, 17 bp, Homo sapiens
ctgactgtggccccctc

SEQ ID NO: 826560 - DNA, 17 bp, Homo sapiens
ctgactgttgcccccca

SEQ ID NO: 826561 - DNA, 16 bp, Homo sapiens
ctgactgttttctctt

SEQ ID NO: 826562 - DNA, 18 bp, Homo sapiens
ctgactgttttctcttga

SEQ ID NO: 826563 - DNA, 24 bp, Homo sapiens
ctgacttaagcaaaagaaaaagat

SEQ ID NO: 826564 - DNA, 22 bp, Homo sapiens
ctgacttcatggaatggacatc

SEQ ID NO: 826565 - DNA, 16 bp, Homo sapiens
ctgacttcatttgtgc

SEQ ID NO: 826566 - DNA, 17 bp, Homo sapiens
ctgacttcatttgtgcc

SEQ ID NO: 826567 - DNA, 19 bp, Homo sapiens
ctgacttcatttgtgccac

SEQ ID NO: 826568 - DNA, 12 bp, Homo sapiens
ctgacttctccc

SEQ ID NO: 826569 - DNA, 14 bp, Homo sapiens
ctgacttctccccc

SEQ ID NO: 826570 - DNA, 16 bp, Homo sapiens
ctgacttctcccccgc

SEQ ID NO: 826571 - DNA, 14 bp, Homo sapiens
ctgacttctctgaa

SEQ ID NO: 826572 - DNA, 11 bp, Homo sapiens
ctgacttctgc

SEQ ID NO: 826573 - DNA, 14 bp, Homo sapiens
ctgacttctggaga

SEQ ID NO: 826574 - DNA, 13 bp, Homo sapiens
ctgacttgagcca

SEQ ID NO: 826575 - DNA, 16 bp, Homo sapiens
ctgacttgagccactc

SEQ ID NO: 826576 - DNA, 16 bp, Homo sapiens
ctgacttgctgtgtga

SEQ ID NO: 826577 - DNA, 12 bp, Homo sapiens
ctgacttgcttt

SEQ ID NO: 826578 - DNA, 14 bp, Homo sapiens
ctgacttggcactt

SEQ ID NO: 826579 - DNA, 22 bp, Homo sapiens
ctgacttggcacttaagtgcac

SEQ ID NO: 826580 - DNA, 13 bp, Homo sapiens
ctgacttggggga

SEQ ID NO: 826581 - DNA, 17 bp, Homo sapiens
ctgacttggttctgaag

SEQ ID NO: 826582 - DNA, 15 bp, Homo sapiens
ctgacttgtttgtct

SEQ ID NO: 826583 - DNA, 14 bp, Homo sapiens
ctgactttctcccc

SEQ ID NO: 826584 - DNA, 21 bp, Homo sapiens
ctgactttctgattactgtcc

SEQ ID NO: 826585 - DNA, 14 bp, Homo sapiens
ctgactttgcttgc

SEQ ID NO: 826586 - DNA, 11 bp, Homo sapiens
ctgagaaaagt

SEQ ID NO: 826587 - DNA, 20 bp, Homo sapiens
ctgagaaaatgcgagactct

SEQ ID NO: 826588 - DNA, 12 bp, Homo sapiens
ctgagaaactct

SEQ ID NO: 826589 - DNA, 18 bp, Homo sapiens
ctgagaaagcccacctgg

SEQ ID NO: 826590 - DNA, 14 bp, Homo sapiens
ctgagaaatgcaga

SEQ ID NO: 826591 - DNA, 18 bp, Homo sapiens
ctgagaacacgttgccag

SEQ ID NO: 826592 - DNA, 23 bp, Homo sapiens
ctgagaacacgttgccaggggct

SEQ ID NO: 826593 - DNA, 18 bp, Homo sapiens
ctgagaactgactttctc

SEQ ID NO: 826594 - DNA, 20 bp, Homo sapiens
ctgagaagaagtggctgcca

SEQ ID NO: 826595 - DNA, 20 bp, Homo sapiens
ctgagaagaatgaaaatgca

SEQ ID NO: 826596 - DNA, 15 bp, Homo sapiens
ctgagaagaggagga

SEQ ID NO: 826597 - DNA, 19 bp, Homo sapiens
ctgagaagatctaccccag

SEQ ID NO: 826598 - DNA, 14 bp, Homo sapiens
ctgagaagctgctc

SEQ ID NO: 826599 - DNA, 23 bp, Homo sapiens
ctgagaagctgctccaggcctgc

SEQ ID NO: 826600 - DNA, 19 bp, Homo sapiens
ctgagaaggcaggcctccg

SEQ ID NO: 826601 - DNA, 20 bp, Homo sapiens
ctgagaaggcaggcctccgt

SEQ ID NO: 826602 - DNA, 18 bp, Homo sapiens
ctgagaaggcgaggagag

SEQ ID NO: 826603 - DNA, 23 bp, Homo sapiens
ctgagaatataatactgtatttg

SEQ ID NO: 826604 - DNA, 18 bp, Homo sapiens
ctgagaatatatgctttt

SEQ ID NO: 826605 - DNA, 16 bp, Homo sapiens
ctgagaatcagactga

SEQ ID NO: 826606 - DNA, 16 bp, Homo sapiens
ctgagaatgagtggga

SEQ ID NO: 826607 - DNA, 13 bp, Homo sapiens
ctgagacactgaa

SEQ ID NO: 826608 - DNA, 13 bp, Homo sapiens
ctgagacagcacc

SEQ ID NO: 826609 - DNA, 17 bp, Homo sapiens
ctgagacagcaccactg

SEQ ID NO: 826610 - DNA, 20 bp, Homo sapiens
ctgagacatccctgattctc

SEQ ID NO: 826611 - DNA, 23 bp, Homo sapiens
ctgagacatcttgcctacttttc

SEQ ID NO: 826612 - DNA, 22 bp, Homo sapiens
ctgagaccaaggctttctctac

SEQ ID NO: 826613 - DNA, 22 bp, Homo sapiens
ctgagaccacagtttacctcag

SEQ ID NO: 826614 - DNA, 17 bp, Homo sapiens
ctgaggcctcatccctc

SEQ ID NO: 826615 - DNA, 15 bp, Homo sapiens
ctgaggcctccagct

SEQ ID NO: 826616 - DNA, 21 bp, Homo sapiens
ctgaggcctgccccctgggct

SEQ ID NO: 826617 - DNA, 19 bp, Homo sapiens
ctgaggcctggactttcct

SEQ ID NO: 826618 - DNA, 23 bp, Homo sapiens
ctgaggcctgggccgctgccacg

SEQ ID NO: 826619 - DNA, 21 bp, Homo sapiens
ctgaggccttgtgtgtcaggc

SEQ ID NO: 826620 - DNA, 23 bp, Homo sapiens
ctgaggctctgacccagtgagat

SEQ ID NO: 826621 - DNA, 16 bp, Homo sapiens
ctgaggctctttctgg

SEQ ID NO: 826622 - DNA, 20 bp, Homo sapiens
ctgaggctctttctgggcca

SEQ ID NO: 826623 - DNA, 12 bp, Homo sapiens
ctgaggctgagg

SEQ ID NO: 826624 - DNA, 13 bp, Homo sapiens
ctgaggctggcac

SEQ ID NO: 826625 - DNA, 20 bp, Homo sapiens
ctgaggctggcacaggacat

SEQ ID NO: 826626 - DNA, 20 bp, Homo sapiens
ctgaggctgtggtcacagcg

SEQ ID NO: 826627 - DNA, 17 bp, Homo sapiens
ctgaggcttaggcctct

SEQ ID NO: 826628 - DNA, 18 bp, Homo sapiens
ctgaggctttggatttga

SEQ ID NO: 826629 - DNA, 16 bp, Homo sapiens
ctgagggaaagtgcat

SEQ ID NO: 826630 - DNA, 16 bp, Homo sapiens
ctgagggaaatgtttt

SEQ ID NO: 826631 - DNA, 18 bp, Homo sapiens
ctgagggaaatgttttgt

SEQ ID NO: 826632 - DNA, 22 bp, Homo sapiens
ctgagggaaatgttttgtaaac

SEQ ID NO: 826633 - DNA, 23 bp, Homo sapiens
ctgagggaaatgttttgtaaaca

SEQ ID NO: 826634 - DNA, 18 bp, Homo sapiens
ctgagggaccaactgggc

SEQ ID NO: 826635 - DNA, 13 bp, Homo sapiens
ctgagggagcctg

SEQ ID NO: 826636 - DNA, 17 bp, Homo sapiens
ctgagggagcctggccc

SEQ ID NO: 826637 - DNA, 22 bp, Homo sapiens
ctgagggaggacctggggcaca

SEQ ID NO: 826638 - DNA, 15 bp, Homo sapiens
ctgagggaggaggcc

SEQ ID NO: 826639 - DNA, 14 bp, Homo sapiens
ctgagggagggagc

SEQ ID NO: 826640 - DNA, 15 bp, Homo sapiens
ctgagggagggagcc

SEQ ID NO: 826641 - DNA, 17 bp, Homo sapiens
ctgagggagggagccat

SEQ ID NO: 826642 - DNA, 14 bp, Homo sapiens
ctgagggatctgag

SEQ ID NO: 826643 - DNA, 22 bp, Homo sapiens
ctgagggatctgagtaggtctg

SEQ ID NO: 826644 - DNA, 22 bp, Homo sapiens
ctgagggattgaggggccctgg

SEQ ID NO: 826645 - DNA, 19 bp, Homo sapiens
ctgagggattttagcctct

SEQ ID NO: 826646 - DNA, 20 bp, Homo sapiens
ctgagggattttagcctctt

SEQ ID NO: 826647 - DNA, 19 bp, Homo sapiens
ctgagggcagactggggca

SEQ ID NO: 826648 - DNA, 20 bp, Homo sapiens
ctgagggcagactggggcat

SEQ ID NO: 826649 - DNA, 16 bp, Homo sapiens
ctgagggcagtcgata

SEQ ID NO: 826650 - DNA, 19 bp, Homo sapiens
ctgagggcagtgccctttg

SEQ ID NO: 826651 - DNA, 13 bp, Homo sapiens
ctgagggccacac

SEQ ID NO: 826652 - DNA, 13 bp, Homo sapiens
ctgagggcccctc

SEQ ID NO: 826653 - DNA, 15 bp, Homo sapiens
ctgagggcccctctg

SEQ ID NO: 826654 - DNA, 17 bp, Homo sapiens
ctgagggcccctctgcc

SEQ ID NO: 826655 - DNA, 16 bp, Homo sapiens
ctgagggccctgtgga

SEQ ID NO: 826656 - DNA, 19 bp, Homo sapiens
ctgagggcctgctggaggc

SEQ ID NO: 826657 - DNA, 22 bp, Homo sapiens
ctgagggctaattctgggaagg

SEQ ID NO: 826658 - DNA, 17 bp, Homo sapiens
ctgaggggacgggcaag

SEQ ID NO: 826659 - DNA, 14 bp, Homo sapiens
ctgaggggaggcac

SEQ ID NO: 826660 - DNA, 20 bp, Homo sapiens
ctgaggggaggcacctccag

SEQ ID NO: 826661 - DNA, 21 bp, Homo sapiens
ctgaggggaggcacctccagg

SEQ ID NO: 826662 - DNA, 15 bp, Homo sapiens
ctgaggggattctct

SEQ ID NO: 826663 - DNA, 19 bp, Homo sapiens
ctgaggggcaacgaagaaa

SEQ ID NO: 826664 - DNA, 16 bp, Homo sapiens
ctgaggggcatctgcc

SEQ ID NO: 826665 - DNA, 17 bp, Homo sapiens
ctgaggggcatctgccc

SEQ ID NO: 826666 - DNA, 19 bp, Homo sapiens
ctgaggggcatctgcccct

SEQ ID NO: 826667 - DNA, 19 bp, Homo sapiens
ctgaggggcctgcgcccag

SEQ ID NO: 826668 - DNA, 14 bp, Homo sapiens
ctgaggggctgggc

SEQ ID NO: 826669 - DNA, 18 bp, Homo sapiens
ctgaggggctgggctggg

SEQ ID NO: 826670 - DNA, 19 bp, Homo sapiens
ctgaggggctggggagggg

SEQ ID NO: 826671 - DNA, 20 bp, Homo sapiens
ctgaggggctggggaggggg

SEQ ID NO: 826672 - DNA, 13 bp, Homo sapiens
ctgagggggagcc

SEQ ID NO: 826673 - DNA, 16 bp, Homo sapiens
ctgaggggggccgtgc

SEQ ID NO: 826674 - DNA, 21 bp, Homo sapiens
ctgaggggtgtccgagaggct

SEQ ID NO: 826675 - DNA, 22 bp, Homo sapiens
ctgaggggtgtccgagaggctg

SEQ ID NO: 826676 - DNA, 16 bp, Homo sapiens
ctgagggtctgggcgg

SEQ ID NO: 826677 - DNA, 15 bp, Homo sapiens
ctgagggtggagact

SEQ ID NO: 826678 - DNA, 19 bp, Homo sapiens
ctgagggtgtttcttcctg

SEQ ID NO: 826679 - DNA, 14 bp, Homo sapiens
ctgaggtataaaga

SEQ ID NO: 826680 - DNA, 14 bp, Homo sapiens
ctgaggtcagggag

SEQ ID NO: 826681 - DNA, 15 bp, Homo sapiens
ctgaggtcagggagt

SEQ ID NO: 826682 - DNA, 17 bp, Homo sapiens
ctgaggtcagggagtgc

SEQ ID NO: 826683 - DNA, 19 bp, Homo sapiens
ctgaggtcagggagtgctg

SEQ ID NO: 826684 - DNA, 12 bp, Homo sapiens
ctgaggtccaag

SEQ ID NO: 826685 - DNA, 19 bp, Homo sapiens
ctgaggtcccttcaaggcc

SEQ ID NO: 826686 - DNA, 21 bp, Homo sapiens
ctgaggtcccttcaaggcctc

SEQ ID NO: 826687 - DNA, 19 bp, Homo sapiens
ctgaggtctcttgagggag

SEQ ID NO: 826688 - DNA, 21 bp, Homo sapiens
ctgaggtctcttgagggagct

SEQ ID NO: 826689 - DNA, 16 bp, Homo sapiens
ctgaggtgcctgctca

SEQ ID NO: 826690 - DNA, 13 bp, Homo sapiens
ctgaggtgggagg

SEQ ID NO: 826691 - DNA, 22 bp, Homo sapiens
ctgaggtgggaggatctcttga

SEQ ID NO: 826692 - DNA, 15 bp, Homo sapiens
ctgaggtgggcccag

SEQ ID NO: 826693 - DNA, 15 bp, Homo sapiens
ctgaggtgggctggg

SEQ ID NO: 826694 - DNA, 22 bp, Homo sapiens
ctgaggtgggctggggctgctc

SEQ ID NO: 826695 - DNA, 12 bp, Homo sapiens
ctgaggtgggga

SEQ ID NO: 826696 - DNA, 15 bp, Homo sapiens
ctgaggtggggaagg

SEQ ID NO: 826697 - DNA, 17 bp, Homo sapiens
ctgaggtggggaaggag

SEQ ID NO: 826698 - DNA, 19 bp, Homo sapiens
ctgaggtggggaaggaggg

SEQ ID NO: 826699 - DNA, 17 bp, Homo sapiens
ctgaggtgtgggggctg

SEQ ID NO: 826700 - DNA, 18 bp, Homo sapiens
ctgaggtgtgggggctgc

SEQ ID NO: 826701 - DNA, 19 bp, Homo sapiens
ctgaggtgtgggggctgca

SEQ ID NO: 826702 - DNA, 21 bp, Homo sapiens
ctgaggtgtgggggctgcagc

SEQ ID NO: 826703 - DNA, 19 bp, Homo sapiens
ctgaggttcctctgcctgc

SEQ ID NO: 826704 - DNA, 21 bp, Homo sapiens
ctgaggttcctctgcctgccc

SEQ ID NO: 826705 - DNA, 21 bp, Homo sapiens
ctgaggtttcacccttaaccc

SEQ ID NO: 826706 - DNA, 16 bp, Homo sapiens
ctgaggttttgaataa

SEQ ID NO: 826707 - DNA, 23 bp, Homo sapiens
ctgaggttttgaataaaaagtga

SEQ ID NO: 826708 - DNA, 22 bp, Homo sapiens
ctgagtaactggttgctgtgtc

SEQ ID NO: 826709 - DNA, 20 bp, Homo sapiens
ctgagtaattaataaagaaa

SEQ ID NO: 826710 - DNA, 22 bp, Homo sapiens
ctgagtaattaataaagaaaaa

SEQ ID NO: 826711 - DNA, 15 bp, Homo sapiens
ctgagtaccttctac

SEQ ID NO: 826712 - DNA, 21 bp, Homo sapiens
ctgagtaccttctacaggccc

SEQ ID NO: 826713 - DNA, 21 bp, Homo sapiens
ctgagtacgttgtgcatttgg

SEQ ID NO: 826714 - DNA, 20 bp, Homo sapiens
ctgagtactggaataaacag

SEQ ID NO: 826715 - DNA, 22 bp, Homo sapiens
ctgagtactggaataaacagtg

SEQ ID NO: 826716 - DNA, 17 bp, Homo sapiens
ctgagtagctctcctga

SEQ ID NO: 826717 - DNA, 18 bp, Homo sapiens
ctgagtatgtaacttgca

SEQ ID NO: 826718 - DNA, 13 bp, Homo sapiens
ctgagtatttttt

SEQ ID NO: 826719 - DNA, 17 bp, Homo sapiens
ctgagtattttttataa

SEQ ID NO: 826720 - DNA, 22 bp, Homo sapiens
ctgagtcacccatgaagacagg

SEQ ID NO: 826721 - DNA, 17 bp, Homo sapiens
ctgagtcacctcctcca

SEQ ID NO: 826722 - DNA, 14 bp, Homo sapiens
ctgagtcagtgctc

SEQ ID NO: 826723 - DNA, 19 bp, Homo sapiens
ctgagtcagtgctctcagc

SEQ ID NO: 826724 - DNA, 21 bp, Homo sapiens
ctgagtcatgatctccctgcc

SEQ ID NO: 826725 - DNA, 14 bp, Homo sapiens
ctgagtccagagct

SEQ ID NO: 826726 - DNA, 20 bp, Homo sapiens
ctgagtccagagcttgtgct

SEQ ID NO: 826727 - DNA, 14 bp, Homo sapiens
ctgagtccagctcc

SEQ ID NO: 826728 - DNA, 15 bp, Homo sapiens
ctgagtccagctccc

SEQ ID NO: 826729 - DNA, 17 bp, Homo sapiens
ctgagtccatgaaaata

SEQ ID NO: 826730 - DNA, 18 bp, Homo sapiens
ctgagtccatgaaaatac

SEQ ID NO: 826731 - DNA, 21 bp, Homo sapiens
ctgagtccatgaaaataccat

SEQ ID NO: 826732 - DNA, 21 bp, Homo sapiens
ctgagtcccaggagctgccca

SEQ ID NO: 826733 - DNA, 20 bp, Homo sapiens
ctgagtcccaggctgagcct

SEQ ID NO: 826734 - DNA, 19 bp, Homo sapiens
ctgagtccgcctgcgcctc

SEQ ID NO: 826735 - DNA, 14 bp, Homo sapiens
ctgcaacaaaaagt

SEQ ID NO: 826736 - DNA, 15 bp, Homo sapiens
ctgcaacaaaatgta

SEQ ID NO: 826737 - DNA, 22 bp, Homo sapiens
ctgcaacctccgcctctcaggt

SEQ ID NO: 826738 - DNA, 20 bp, Homo sapiens
ctgcaacctccgccttccgg

SEQ ID NO: 826739 - DNA, 16 bp, Homo sapiens
ctgcaacctctgcctc

SEQ ID NO: 826740 - DNA, 17 bp, Homo sapiens
ctgcaacggcttagact

SEQ ID NO: 826741 - DNA, 13 bp, Homo sapiens
ctgcaactagcca

SEQ ID NO: 826742 - DNA, 18 bp, Homo sapiens
ctgcaactagccaaggct

SEQ ID NO: 826743 - DNA, 21 bp, Homo sapiens
ctgcaactagccaaggctagt

SEQ ID NO: 826744 - DNA, 19 bp, Homo sapiens
ctgcaacttccgctgaggg

SEQ ID NO: 826745 - DNA, 23 bp, Homo sapiens
ctgcaacttccgctgaggggtct

SEQ ID NO: 826746 - DNA, 15 bp, Homo sapiens
ctgcaacttctgcct

SEQ ID NO: 826747 - DNA, 19 bp, Homo sapiens
ctgcaagaaaggggaccca

SEQ ID NO: 826748 - DNA, 14 bp, Homo sapiens
ctgcaagaattaaa

SEQ ID NO: 826749 - DNA, 18 bp, Homo sapiens
ctgcaagaattaaaactg

SEQ ID NO: 826750 - DNA, 22 bp, Homo sapiens
ctgcaagaattaaaactgagtc

SEQ ID NO: 826751 - DNA, 18 bp, Homo sapiens
ctgcaagaattgaagcag

SEQ ID NO: 826752 - DNA, 14 bp, Homo sapiens
ctgcaagagccttg

SEQ ID NO: 826753 - DNA, 21 bp, Homo sapiens
ctgcaagatggacacgagcca

SEQ ID NO: 826754 - DNA, 22 bp, Homo sapiens
ctgcaagcccgttaaataattc

SEQ ID NO: 826755 - DNA, 13 bp, Homo sapiens
ctgcaaggtggcc

SEQ ID NO: 826756 - DNA, 20 bp, Homo sapiens
ctgcaaggtttaggctggtg

SEQ ID NO: 826757 - DNA, 23 bp, Homo sapiens
ctgcaaggtttaggctggtggcc

SEQ ID NO: 826758 - DNA, 19 bp, Homo sapiens
ctgcaagtgtatctccttt

SEQ ID NO: 826759 - DNA, 21 bp, Homo sapiens
ctgcaatagagactgtagatt

SEQ ID NO: 826760 - DNA, 15 bp, Homo sapiens
ctgcaatcctgtctt

SEQ ID NO: 826761 - DNA, 15 bp, Homo sapiens
ctgcaatgttttcct

SEQ ID NO: 826762 - DNA, 15 bp, Homo sapiens
ctgcaattcccctct

SEQ ID NO: 826763 - DNA, 16 bp, Homo sapiens
ctgcaattcccctctg

SEQ ID NO: 826764 - DNA, 17 bp, Homo sapiens
ctgcaattcccctctgc

SEQ ID NO: 826765 - DNA, 20 bp, Homo sapiens
ctgcaattgcttaggatgtt

SEQ ID NO: 826766 - DNA, 12 bp, Homo sapiens
ctgcaatttcta

SEQ ID NO: 826767 - DNA, 19 bp, Homo sapiens
ctgcaatttgtttaaagaa

SEQ ID NO: 826768 - DNA, 21 bp, Homo sapiens
ctgcacaaagcccttccatgt

SEQ ID NO: 826769 - DNA, 13 bp, Homo sapiens
ctgcacaagctgc

SEQ ID NO: 826770 - DNA, 16 bp, Homo sapiens
ctgcacaagctgcacc

SEQ ID NO: 826771 - DNA, 22 bp, Homo sapiens
ctgcacaataaaaatgtttaac

SEQ ID NO: 826772 - DNA, 17 bp, Homo sapiens
ctgcacaatttaatata

SEQ ID NO: 826773 - DNA, 13 bp, Homo sapiens
ctgcacacacagc

SEQ ID NO: 826774 - DNA, 14 bp, Homo sapiens
ctgcacacacagct

SEQ ID NO: 826775 - DNA, 15 bp, Homo sapiens
ctgcacacagacggc

SEQ ID NO: 826776 - DNA, 11 bp, Homo sapiens
ctgcacacagg

SEQ ID NO: 826777 - DNA, 15 bp, Homo sapiens
ctgcacacaggacag

SEQ ID NO: 826778 - DNA, 13 bp, Homo sapiens
ctgcacaccagcc

SEQ ID NO: 826779 - DNA, 20 bp, Homo sapiens
ctgcacaccctccagagaca

SEQ ID NO: 826780 - DNA, 22 bp, Homo sapiens
ctgcacagaaacttgaactcca

SEQ ID NO: 826781 - DNA, 13 bp, Homo sapiens
ctgcacagaaggg

SEQ ID NO: 826782 - DNA, 19 bp, Homo sapiens
ctgcacagcaggacctgtg

SEQ ID NO: 826783 - DNA, 22 bp, Homo sapiens
ctgcacaggcacacagggcccg

SEQ ID NO: 826784 - DNA, 14 bp, Homo sapiens
ctgcacagtgactt

SEQ ID NO: 826785 - DNA, 16 bp, Homo sapiens
ctgcacagtgacttct

SEQ ID NO: 826786 - DNA, 18 bp, Homo sapiens
ctgcacagtgacttctga

SEQ ID NO: 826787 - DNA, 19 bp, Homo sapiens
ctgcacagtgacttctgag

SEQ ID NO: 826788 - DNA, 12 bp, Homo sapiens
ctgcacagtgct

SEQ ID NO: 826789 - DNA, 21 bp, Homo sapiens
ctgcacagttttctggctgga

SEQ ID NO: 826790 - DNA, 16 bp, Homo sapiens
ctgcacatctacacac

SEQ ID NO: 826791 - DNA, 12 bp, Homo sapiens
ctgcacatgtgc

SEQ ID NO: 826792 - DNA, 13 bp, Homo sapiens
ctgcacatgtgcc

SEQ ID NO: 826793 - DNA, 12 bp, Homo sapiens
ctgcacattcct

SEQ ID NO: 826794 - DNA, 13 bp, Homo sapiens
ctgcacattcctg

SEQ ID NO: 826795 - DNA, 16 bp, Homo sapiens
ctgcacattcctggcc

SEQ ID NO: 826796 - DNA, 15 bp, Homo sapiens
ctgcacattgcctgt

SEQ ID NO: 826797 - DNA, 20 bp, Homo sapiens
ctgcacattgcctgttctgc

SEQ ID NO: 826798 - DNA, 17 bp, Homo sapiens
ctgcaccacacctggca

SEQ ID NO: 826799 - DNA, 12 bp, Homo sapiens
ctgcaccagagc

SEQ ID NO: 826800 - DNA, 14 bp, Homo sapiens
ctgcaccagagtga

SEQ ID NO: 826801 - DNA, 22 bp, Homo sapiens
ctgcaccagagtgaaagggcta

SEQ ID NO: 826802 - DNA, 13 bp, Homo sapiens
ctgcaccagcagg

SEQ ID NO: 826803 - DNA, 18 bp, Homo sapiens
ctgcaccagcgcccccag

SEQ ID NO: 826804 - DNA, 18 bp, Homo sapiens
ctgcacccagaacagtgg

SEQ ID NO: 826805 - DNA, 12 bp, Homo sapiens
ctgcacccagct

SEQ ID NO: 826806 - DNA, 13 bp, Homo sapiens
ctgcacccagctc

SEQ ID NO: 826807 - DNA, 11 bp, Homo sapiens
ctgcacccagg

SEQ ID NO: 826808 - DNA, 12 bp, Homo sapiens
ctgcacccaggg

SEQ ID NO: 826809 - DNA, 13 bp, Homo sapiens
ctgcacccagggg

SEQ ID NO: 826810 - DNA, 22 bp, Homo sapiens
ctgcaccccagcgtcaggccta

SEQ ID NO: 826811 - DNA, 23 bp, Homo sapiens
ctgcacccctgagttgggcagcc

SEQ ID NO: 826812 - DNA, 13 bp, Homo sapiens
ctgcacccctggg

SEQ ID NO: 826813 - DNA, 13 bp, Homo sapiens
ctgcaccctcagg

SEQ ID NO: 826814 - DNA, 12 bp, Homo sapiens
ctgcaccctcca

SEQ ID NO: 826815 - DNA, 16 bp, Homo sapiens
ctgcaccctccaccct

SEQ ID NO: 826816 - DNA, 20 bp, Homo sapiens
ctgcaccctccaccctgtcc

SEQ ID NO: 826817 - DNA, 21 bp, Homo sapiens
ctgcaccctccaccctgtccc

SEQ ID NO: 826818 - DNA, 19 bp, Homo sapiens
ctgcaccctgcgcctccag

SEQ ID NO: 826819 - DNA, 16 bp, Homo sapiens
ctgcaccctggggcct

SEQ ID NO: 826820 - DNA, 17 bp, Homo sapiens
ctgcacccttcttttct

SEQ ID NO: 826821 - DNA, 19 bp, Homo sapiens
ctgcacccttcttttctca

SEQ ID NO: 826822 - DNA, 18 bp, Homo sapiens
ctgcaccgacccgaggcc

SEQ ID NO: 826823 - DNA, 19 bp, Homo sapiens
ctgcaccgacccgaggccc

SEQ ID NO: 826824 - DNA, 22 bp, Homo sapiens
ctgcaccgacccgaggcccaga

SEQ ID NO: 826825 - DNA, 24 bp, Homo sapiens
ctgcaccgacccgaggcccagatc

SEQ ID NO: 826826 - DNA, 20 bp, Homo sapiens
ctgcaccgccgccaccctgc

SEQ ID NO: 826827 - DNA, 19 bp, Homo sapiens
ctgcacctccccccactgc

SEQ ID NO: 826828 - DNA, 21 bp, Homo sapiens
ctgcacctccccccactgcag

SEQ ID NO: 826829 - DNA, 19 bp, Homo sapiens
ctgcacctccgcttgccag

SEQ ID NO: 826830 - DNA, 15 bp, Homo sapiens
ctgcacctcctaccc

SEQ ID NO: 826831 - DNA, 21 bp, Homo sapiens
ctgcacctcctaccctcccac

SEQ ID NO: 826832 - DNA, 17 bp, Homo sapiens
ctgcacctgacctgctg

SEQ ID NO: 826833 - DNA, 18 bp, Homo sapiens
ctgcacctgccagcctgg

SEQ ID NO: 826834 - DNA, 19 bp, Homo sapiens
ctgcacctgccagcctggc

SEQ ID NO: 826835 - DNA, 13 bp, Homo sapiens
ctgcacctgcctg

SEQ ID NO: 826836 - DNA, 21 bp, Homo sapiens
ctgcacctgctgcgtccccac

SEQ ID NO: 826837 - DNA, 23 bp, Homo sapiens
ctgcacctgctgcgtccccactc

SEQ ID NO: 826838 - DNA, 12 bp, Homo sapiens
ctgcacctggcc

SEQ ID NO: 826839 - DNA, 17 bp, Homo sapiens
ctgcacctggcctgggc

SEQ ID NO: 826840 - DNA, 19 bp, Homo sapiens
ctgcacctggcctgggcca

SEQ ID NO: 826841 - DNA, 17 bp, Homo sapiens
ctgcacctgggcagctc

SEQ ID NO: 826842 - DNA, 19 bp, Homo sapiens
ctgcacctgggcagctcct

SEQ ID NO: 826843 - DNA, 20 bp, Homo sapiens
ctgcacctgggcagctcctc

SEQ ID NO: 826844 - DNA, 14 bp, Homo sapiens
ctgcacctgtgcag

SEQ ID NO: 826845 - DNA, 13 bp, Homo sapiens
ctgcacgctgccc

SEQ ID NO: 826846 - DNA, 19 bp, Homo sapiens
ctgcacgctgcccaggggc

SEQ ID NO: 826847 - DNA, 20 bp, Homo sapiens
ctgcacgctgcccaggggct

SEQ ID NO: 826848 - DNA, 21 bp, Homo sapiens
ctgcacgggatgcgtgggagg

SEQ ID NO: 826849 - DNA, 23 bp, Homo sapiens
ctgcacgggatgcgtgggaggca

SEQ ID NO: 826850 - DNA, 17 bp, Homo sapiens
ctgcacgttgctgaagg

SEQ ID NO: 826851 - DNA, 22 bp, Homo sapiens
ctgcactaaagccagcctgacc

SEQ ID NO: 826852 - DNA, 16 bp, Homo sapiens
ctgcactactcctctg

SEQ ID NO: 826853 - DNA, 18 bp, Homo sapiens
ctgcactactcctctgca

SEQ ID NO: 826854 - DNA, 20 bp, Homo sapiens
ctgcactactcctctgcagt

SEQ ID NO: 826855 - DNA, 14 bp, Homo sapiens
ctgcactcaagctt

SEQ ID NO: 826856 - DNA, 19 bp, Homo sapiens
ctgcactcatagggtgctc

SEQ ID NO: 826857 - DNA, 15 bp, Homo sapiens
ctgcaggcaccgggc

SEQ ID NO: 826858 - DNA, 12 bp, Homo sapiens
ctgcaggcaggc

SEQ ID NO: 826859 - DNA, 20 bp, Homo sapiens
ctgcaggcaggcggctcctc

SEQ ID NO: 826860 - DNA, 15 bp, Homo sapiens
ctgcaggccaagagc

SEQ ID NO: 826861 - DNA, 21 bp, Homo sapiens
ctgcaggccaagagcagaggc

SEQ ID NO: 826862 - DNA, 24 bp, Homo sapiens
ctgcaggccaagagcagaggcagc

SEQ ID NO: 826863 - DNA, 16 bp, Homo sapiens
ctgcaggccactgtga

SEQ ID NO: 826864 - DNA, 17 bp, Homo sapiens
ctgcaggccaggccagc

SEQ ID NO: 826865 - DNA, 11 bp, Homo sapiens
ctgcaggcccc

SEQ ID NO: 826866 - DNA, 20 bp, Homo sapiens
ctgcaggccccgcttgtcca

SEQ ID NO: 826867 - DNA, 14 bp, Homo sapiens
ctgcaggccctccc

SEQ ID NO: 826868 - DNA, 16 bp, Homo sapiens
ctgcaggccctccctc

SEQ ID NO: 826869 - DNA, 14 bp, Homo sapiens
ctgcaggccctggc

SEQ ID NO: 826870 - DNA, 17 bp, Homo sapiens
ctgcaggccctggcctc

SEQ ID NO: 826871 - DNA, 18 bp, Homo sapiens
ctgcaggctgcaggaggg

SEQ ID NO: 826872 - DNA, 16 bp, Homo sapiens
ctgcaggctggggagg

SEQ ID NO: 826873 - DNA, 15 bp, Homo sapiens
ctgcaggctttgcca

SEQ ID NO: 826874 - DNA, 23 bp, Homo sapiens
ctgcagggaaaattatttgcata

SEQ ID NO: 826875 - DNA, 17 bp, Homo sapiens
ctgcagggactgccagt

SEQ ID NO: 826876 - DNA, 22 bp, Homo sapiens
ctgcagggcacggggacctgga

SEQ ID NO: 826877 - DNA, 17 bp, Homo sapiens
ctgcagggcgcccctgg

SEQ ID NO: 826878 - DNA, 19 bp, Homo sapiens
ctgcagggcgcccctggga

SEQ ID NO: 826879 - DNA, 21 bp, Homo sapiens
ctgcagggcgcccctgggaga

SEQ ID NO: 826880 - DNA, 14 bp, Homo sapiens
ctgcagggcttctc

SEQ ID NO: 826881 - DNA, 11 bp, Homo sapiens
ctgcaggggcc

SEQ ID NO: 826882 - DNA, 22 bp, Homo sapiens
ctgcaggggccactccaaactc

SEQ ID NO: 826883 - DNA, 15 bp, Homo sapiens
ctgcagggggaggag

SEQ ID NO: 826884 - DNA, 23 bp, Homo sapiens
ctgcagggggaggaggacttgga

SEQ ID NO: 826885 - DNA, 20 bp, Homo sapiens
ctgcagggggtgtgtctgct

SEQ ID NO: 826886 - DNA, 20 bp, Homo sapiens
ctgcagggtgacgcctgaga

SEQ ID NO: 826887 - DNA, 16 bp, Homo sapiens
ctgcagggtggtgctg

SEQ ID NO: 826888 - DNA, 18 bp, Homo sapiens
ctgcagggtggtgctggg

SEQ ID NO: 826889 - DNA, 21 bp, Homo sapiens
ctgcagggtggtgctgggact

SEQ ID NO: 826890 - DNA, 22 bp, Homo sapiens
ctgcagggtggtgctgggactg

SEQ ID NO: 826891 - DNA, 20 bp, Homo sapiens
ctgcaggtacttcctcctga

SEQ ID NO: 826892 - DNA, 20 bp, Homo sapiens
ctgcaggtcagttgtaataa

SEQ ID NO: 826893 - DNA, 14 bp, Homo sapiens
ctgcaggtgggctg

SEQ ID NO: 826894 - DNA, 18 bp, Homo sapiens
ctgcaggtgggctgggcc

SEQ ID NO: 826895 - DNA, 21 bp, Homo sapiens
ctgcaggttcttcttcctgaa

SEQ ID NO: 826896 - DNA, 23 bp, Homo sapiens
ctgcagtacatacgtctgccagg

SEQ ID NO: 826897 - DNA, 21 bp, Homo sapiens
ctgcagtcatctcccctcctg

SEQ ID NO: 826898 - DNA, 17 bp, Homo sapiens
ctgcagtcccacactgt

SEQ ID NO: 826899 - DNA, 22 bp, Homo sapiens
ctgcagtcccacactgtgcaga

SEQ ID NO: 826900 - DNA, 18 bp, Homo sapiens
ctgcagtcctactcaagc

SEQ ID NO: 826901 - DNA, 14 bp, Homo sapiens
ctgcagtcctccgg

SEQ ID NO: 826902 - DNA, 19 bp, Homo sapiens
ctgcagtcctccggggtgg

SEQ ID NO: 826903 - DNA, 13 bp, Homo sapiens
ctgcagtcctgga

SEQ ID NO: 826904 - DNA, 16 bp, Homo sapiens
ctgcagtcggcatgcc

SEQ ID NO: 826905 - DNA, 18 bp, Homo sapiens
ctgcagtcggcatgccag

SEQ ID NO: 826906 - DNA, 20 bp, Homo sapiens
ctgcagtcggcatgccagga

SEQ ID NO: 826907 - DNA, 23 bp, Homo sapiens
ctgcagtcggcatgccaggaccc

SEQ ID NO: 826908 - DNA, 13 bp, Homo sapiens
ctgcagtctgcag

SEQ ID NO: 826909 - DNA, 18 bp, Homo sapiens
ctgcagtgaggggccctc

SEQ ID NO: 826910 - DNA, 22 bp, Homo sapiens
ctgcagtgaggggccctccatg

SEQ ID NO: 826911 - DNA, 18 bp, Homo sapiens
ctgcagtgatggcgcggg

SEQ ID NO: 826912 - DNA, 18 bp, Homo sapiens
ctgcagtggtgtgaaaca

SEQ ID NO: 826913 - DNA, 19 bp, Homo sapiens
ctgcagttaccacagcaac

SEQ ID NO: 826914 - DNA, 23 bp, Homo sapiens
ctgcagttctactcaggctggtg

SEQ ID NO: 826915 - DNA, 15 bp, Homo sapiens
ctgcagtttggccct

SEQ ID NO: 826916 - DNA, 16 bp, Homo sapiens
ctgcagtttggccctg

SEQ ID NO: 826917 - DNA, 16 bp, Homo sapiens
ctgcagttttgctatc

SEQ ID NO: 826918 - DNA, 15 bp, Homo sapiens
ctgcagtttttcagg

SEQ ID NO: 826919 - DNA, 18 bp, Homo sapiens
ctgcagtttttcaggagc

SEQ ID NO: 826920 - DNA, 24 bp, Homo sapiens
ctgcagtttttcaggagcgcaaga

SEQ ID NO: 826921 - DNA, 16 bp, Homo sapiens
ctgcagtttttcccaa

SEQ ID NO: 826922 - DNA, 17 bp, Homo sapiens
ctgcagtttttcccaag

SEQ ID NO: 826923 - DNA, 22 bp, Homo sapiens
ctgcatactttgacaaggaaaa

SEQ ID NO: 826924 - DNA, 16 bp, Homo sapiens
ctgcatagctctattt

SEQ ID NO: 826925 - DNA, 21 bp, Homo sapiens
ctgcatatgttgaatactttt

SEQ ID NO: 826926 - DNA, 14 bp, Homo sapiens
ctgcatatttctgt

SEQ ID NO: 826927 - DNA, 16 bp, Homo sapiens
ctgcatatttctgtat

SEQ ID NO: 826928 - DNA, 14 bp, Homo sapiens
ctgcatcatctgta

SEQ ID NO: 826929 - DNA, 18 bp, Homo sapiens
ctgcatcatctgtagata

SEQ ID NO: 826930 - DNA, 21 bp, Homo sapiens
ctgcatccagagattcatttt

SEQ ID NO: 826931 - DNA, 22 bp, Homo sapiens
ctgcatccagagattcattttc

SEQ ID NO: 826932 - DNA, 15 bp, Homo sapiens
ctgcatcccagcacc

SEQ ID NO: 826933 - DNA, 22 bp, Homo sapiens
ctgcatccccttggctgtgagg

SEQ ID NO: 826934 - DNA, 21 bp, Homo sapiens
ctgcatcccttcgcctgcagc

SEQ ID NO: 826935 - DNA, 13 bp, Homo sapiens
ctgcatcctgagg

SEQ ID NO: 826936 - DNA, 17 bp, Homo sapiens
ctgcatcctgaggccag

SEQ ID NO: 826937 - DNA, 18 bp, Homo sapiens
ctgcatcctgaggccagt

SEQ ID NO: 826938 - DNA, 17 bp, Homo sapiens
ctgcatctactcccaag

SEQ ID NO: 826939 - DNA, 21 bp, Homo sapiens
ctgcatctgggattcccacca

SEQ ID NO: 826940 - DNA, 15 bp, Homo sapiens
ctgcatcttcttgca

SEQ ID NO: 826941 - DNA, 16 bp, Homo sapiens
ctgcatcttcttgcat

SEQ ID NO: 826942 - DNA, 13 bp, Homo sapiens
ctgcatcttgggg

SEQ ID NO: 826943 - DNA, 19 bp, Homo sapiens
ctgcatcttggggacatct

SEQ ID NO: 826944 - DNA, 13 bp, Homo sapiens
ctgcatgaaaaat

SEQ ID NO: 826945 - DNA, 16 bp, Homo sapiens
ctgcatgaatatcata

SEQ ID NO: 826946 - DNA, 13 bp, Homo sapiens
ctgcatgatgttt

SEQ ID NO: 826947 - DNA, 16 bp, Homo sapiens
ctgcatgatgtttgcc

SEQ ID NO: 826948 - DNA, 13 bp, Homo sapiens
ctgcatggagaag

SEQ ID NO: 826949 - DNA, 19 bp, Homo sapiens
ctgcatggcatcagactag

SEQ ID NO: 826950 - DNA, 16 bp, Homo sapiens
ctgcatggggaggcag

SEQ ID NO: 826951 - DNA, 19 bp, Homo sapiens
ctgcatggggaggcagcag

SEQ ID NO: 826952 - DNA, 20 bp, Homo sapiens
ctgcatggggaggcagcaga

SEQ ID NO: 826953 - DNA, 12 bp, Homo sapiens
ctgcatgtacta

SEQ ID NO: 826954 - DNA, 17 bp, Homo sapiens
ctgcatgtgacttctcc

SEQ ID NO: 826955 - DNA, 14 bp, Homo sapiens
ctgcatgtggcttc

SEQ ID NO: 826956 - DNA, 17 bp, Homo sapiens
ctgcatgttaagtgcca

SEQ ID NO: 826957 - DNA, 13 bp, Homo sapiens
ctgcatgttacat

SEQ ID NO: 826958 - DNA, 23 bp, Homo sapiens
ctgcattaccgcgttgtaaaata

SEQ ID NO: 826959 - DNA, 14 bp, Homo sapiens
ctgcattagaaaaa

SEQ ID NO: 826960 - DNA, 23 bp, Homo sapiens
ctgcattattggaatataattgt

SEQ ID NO: 826961 - DNA, 16 bp, Homo sapiens
ctgcattcctgtgccc

SEQ ID NO: 826962 - DNA, 13 bp, Homo sapiens
ctgcattctctcc

SEQ ID NO: 826963 - DNA, 14 bp, Homo sapiens
ctgcattctctccc

SEQ ID NO: 826964 - DNA, 22 bp, Homo sapiens
ctgcattctctcccatcctggg

SEQ ID NO: 826965 - DNA, 22 bp, Homo sapiens
ctgcattcttctgagcactgtt

SEQ ID NO: 826966 - DNA, 17 bp, Homo sapiens
ctgcattgctagataaa

SEQ ID NO: 826967 - DNA, 18 bp, Homo sapiens
ctgcattgctagataaaa

SEQ ID NO: 826968 - DNA, 21 bp, Homo sapiens
ctgcattgctagataaaagct

SEQ ID NO: 826969 - DNA, 17 bp, Homo sapiens
ctgcatttaaaagatac

SEQ ID NO: 826970 - DNA, 22 bp, Homo sapiens
ctgcatttaaaagatacagtta

SEQ ID NO: 826971 - DNA, 18 bp, Homo sapiens
ctgcatttaaatttgatt

SEQ ID NO: 826972 - DNA, 14 bp, Homo sapiens
ctgcatttctgagt

SEQ ID NO: 826973 - DNA, 14 bp, Homo sapiens
ctgcatttgtgaaa

SEQ ID NO: 826974 - DNA, 21 bp, Homo sapiens
ctgcattttaacaagcacccc

SEQ ID NO: 826975 - DNA, 20 bp, Homo sapiens
ctgcattttaattttaacca

SEQ ID NO: 826976 - DNA, 18 bp, Homo sapiens
ctgcattttcaccccacc

SEQ ID NO: 826977 - DNA, 14 bp, Homo sapiens
ctgcattttcctct

SEQ ID NO: 826978 - DNA, 13 bp, Homo sapiens
ctgccataaaaca

SEQ ID NO: 826979 - DNA, 19 bp, Homo sapiens
ctgccatagggtctgcagc

SEQ ID NO: 826980 - DNA, 13 bp, Homo sapiens
ctgccatccccct

SEQ ID NO: 826981 - DNA, 24 bp, Homo sapiens
ctgccatccccctctcacgccacc

SEQ ID NO: 826982 - DNA, 14 bp, Homo sapiens
ctgccatctagcca

SEQ ID NO: 826983 - DNA, 13 bp, Homo sapiens
ctgccatcttcag

SEQ ID NO: 826984 - DNA, 16 bp, Homo sapiens
ctgccatcttcccagc

SEQ ID NO: 826985 - DNA, 17 bp, Homo sapiens
ctgccatcttcccagca

SEQ ID NO: 826986 - DNA, 18 bp, Homo sapiens
ctgccatcttctccccga

SEQ ID NO: 826987 - DNA, 16 bp, Homo sapiens
ctgccatgacagaggc

SEQ ID NO: 826988 - DNA, 23 bp, Homo sapiens
ctgccatgacagaggctgcaccc

SEQ ID NO: 826989 - DNA, 21 bp, Homo sapiens
ctgccatgcaccaggactggc

SEQ ID NO: 826990 - DNA, 13 bp, Homo sapiens
ctgccatgccact

SEQ ID NO: 826991 - DNA, 18 bp, Homo sapiens
ctgccatgccactgccag

SEQ ID NO: 826992 - DNA, 19 bp, Homo sapiens
ctgccatgccagcttatct

SEQ ID NO: 826993 - DNA, 22 bp, Homo sapiens
ctgccatggaattccctcctga

SEQ ID NO: 826994 - DNA, 14 bp, Homo sapiens
ctgccatggcgtgt

SEQ ID NO: 826995 - DNA, 21 bp, Homo sapiens
ctgccatggcgtgtccctctc

SEQ ID NO: 826996 - DNA, 18 bp, Homo sapiens
ctgccatgtacctcccct

SEQ ID NO: 826997 - DNA, 21 bp, Homo sapiens
ctgccatgtacctcccctgcc

SEQ ID NO: 826998 - DNA, 16 bp, Homo sapiens
ctgccatgttgcccct

SEQ ID NO: 826999 - DNA, 17 bp, Homo sapiens
ctgccattcacttcata

SEQ ID NO: 827000 - DNA, 20 bp, Homo sapiens
ctgccattggtccacccttt

SEQ ID NO: 827001 - DNA, 13 bp, Homo sapiens
ctgccatttcatg

SEQ ID NO: 827002 - DNA, 23 bp, Homo sapiens
ctgccatttcccttctggacact

SEQ ID NO: 827003 - DNA, 15 bp, Homo sapiens
ctgccatttctgaga

SEQ ID NO: 827004 - DNA, 21 bp, Homo sapiens
ctgccatttgatttttctaac

SEQ ID NO: 827005 - DNA, 17 bp, Homo sapiens
ctgcccaaaaatatggt

SEQ ID NO: 827006 - DNA, 17 bp, Homo sapiens
ctgcccaaactcccctt

SEQ ID NO: 827007 - DNA, 23 bp, Homo sapiens
ctgcccaaactccccttccctgg

SEQ ID NO: 827008 - DNA, 20 bp, Homo sapiens
ctgcccaaataggaggaaaa

SEQ ID NO: 827009 - DNA, 18 bp, Homo sapiens
ctgcccaaattatgtgaa

SEQ ID NO: 827010 - DNA, 14 bp, Homo sapiens
ctgcccaagcagcc

SEQ ID NO: 827011 - DNA, 22 bp, Homo sapiens
ctgcccaagcagcctggagact

SEQ ID NO: 827012 - DNA, 15 bp, Homo sapiens
ctgcccaagtgacca

SEQ ID NO: 827013 - DNA, 22 bp, Homo sapiens
ctgcccaagtgaccagggaagt

SEQ ID NO: 827014 - DNA, 16 bp, Homo sapiens
ctgcccaatgctttgg

SEQ ID NO: 827015 - DNA, 19 bp, Homo sapiens
ctgcccacagtctttccgt

SEQ ID NO: 827016 - DNA, 17 bp, Homo sapiens
ctgcccacattggaccc

SEQ ID NO: 827017 - DNA, 20 bp, Homo sapiens
ctgcccacatttgggctcag

SEQ ID NO: 827018 - DNA, 21 bp, Homo sapiens
ctgcccacatttgggctcagg

SEQ ID NO: 827019 - DNA, 22 bp, Homo sapiens
ctgcccacatttgggctcaggg

SEQ ID NO: 827020 - DNA, 16 bp, Homo sapiens
ctgcccaccaaaggtc

SEQ ID NO: 827021 - DNA, 16 bp, Homo sapiens
ctgcccaccccctcaa

SEQ ID NO: 827022 - DNA, 12 bp, Homo sapiens
ctgcccacccgt

SEQ ID NO: 827023 - DNA, 19 bp, Homo sapiens
ctgcccaccctaccagctc

SEQ ID NO: 827024 - DNA, 14 bp, Homo sapiens
ctgcccaccctcct

SEQ ID NO: 827025 - DNA, 19 bp, Homo sapiens
ctgcccaccctcctgtacc

SEQ ID NO: 827026 - DNA, 16 bp, Homo sapiens
ctgcccacctccttcc

SEQ ID NO: 827027 - DNA, 18 bp, Homo sapiens
ctgcccacctctccctgc

SEQ ID NO: 827028 - DNA, 20 bp, Homo sapiens
ctgcccacctctccctgcat

SEQ ID NO: 827029 - DNA, 13 bp, Homo sapiens
ctgcccacctggg

SEQ ID NO: 827030 - DNA, 22 bp, Homo sapiens
ctgcccacctggggtctctctc

SEQ ID NO: 827031 - DNA, 23 bp, Homo sapiens
ctgcccacctggggtctctctcc

SEQ ID NO: 827032 - DNA, 20 bp, Homo sapiens
ctgcccacgatcccctcccc

SEQ ID NO: 827033 - DNA, 17 bp, Homo sapiens
ctgcccacgcagacctg

SEQ ID NO: 827034 - DNA, 21 bp, Homo sapiens
ctgcccacgcagacctgcagc

SEQ ID NO: 827035 - DNA, 16 bp, Homo sapiens
ctgcccacgcagagga

SEQ ID NO: 827036 - DNA, 15 bp, Homo sapiens
ctgcccacgggagga

SEQ ID NO: 827037 - DNA, 22 bp, Homo sapiens
ctgcccactgtttctcttgagc

SEQ ID NO: 827038 - DNA, 19 bp, Homo sapiens
ctgcccacttagccgtcca

SEQ ID NO: 827039 - DNA, 24 bp, Homo sapiens
ctgcccacttagccgtccatggca

SEQ ID NO: 827040 - DNA, 15 bp, Homo sapiens
ctgcccacttcccct

SEQ ID NO: 827041 - DNA, 18 bp, Homo sapiens
ctgcccagacccctctgg

SEQ ID NO: 827042 - DNA, 22 bp, Homo sapiens
ctgcccagacccctctggccag

SEQ ID NO: 827043 - DNA, 18 bp, Homo sapiens
ctgcccagactgatgagc

SEQ ID NO: 827044 - DNA, 22 bp, Homo sapiens
ctgcccagagttgctgggagct

SEQ ID NO: 827045 - DNA, 12 bp, Homo sapiens
ctgcccagcccc

SEQ ID NO: 827046 - DNA, 19 bp, Homo sapiens
ctgcccagccccgctcagg

SEQ ID NO: 827047 - DNA, 13 bp, Homo sapiens
ctgcccagcccct

SEQ ID NO: 827048 - DNA, 14 bp, Homo sapiens
ctgcccagcccctt

SEQ ID NO: 827049 - DNA, 18 bp, Homo sapiens
ctgcccagccccttttct

SEQ ID NO: 827050 - DNA, 22 bp, Homo sapiens
ctgcccagccccttttctctgc

SEQ ID NO: 827051 - DNA, 16 bp, Homo sapiens
ctgcccagcctcaatg

SEQ ID NO: 827052 - DNA, 21 bp, Homo sapiens
ctgcccagcctcaatgtcact

SEQ ID NO: 827053 - DNA, 13 bp, Homo sapiens
ctgcccagcctgt

SEQ ID NO: 827054 - DNA, 12 bp, Homo sapiens
ctgcccagctcc

SEQ ID NO: 827055 - DNA, 13 bp, Homo sapiens
ctgcccagctccc

SEQ ID NO: 827056 - DNA, 16 bp, Homo sapiens
ctgcccagctcctcac

SEQ ID NO: 827057 - DNA, 17 bp, Homo sapiens
ctgcccagctctgaggc

SEQ ID NO: 827058 - DNA, 14 bp, Homo sapiens
ctgcccagcttggg

SEQ ID NO: 827059 - DNA, 21 bp, Homo sapiens
ctgcccagcttgggcccagct

SEQ ID NO: 827060 - DNA, 11 bp, Homo sapiens
ctgcccaggag

SEQ ID NO: 827061 - DNA, 12 bp, Homo sapiens
ctgcccaggaga

SEQ ID NO: 827062 - DNA, 17 bp, Homo sapiens
ctgcccaggagagccag

SEQ ID NO: 827063 - DNA, 18 bp, Homo sapiens
ctgcccaggagagccagc

SEQ ID NO: 827064 - DNA, 19 bp, Homo sapiens
ctgcccaggcctgcctgtt

SEQ ID NO: 827065 - DNA, 13 bp, Homo sapiens
ctgcccagggagt

SEQ ID NO: 827066 - DNA, 14 bp, Homo sapiens
ctgcccaggggtgc

SEQ ID NO: 827067 - DNA, 12 bp, Homo sapiens
ctgcccagtgca

SEQ ID NO: 827068 - DNA, 19 bp, Homo sapiens
ctgcccagtgcaaaccact

SEQ ID NO: 827069 - DNA, 11 bp, Homo sapiens
ctgcccagtgt

SEQ ID NO: 827070 - DNA, 12 bp, Homo sapiens
ctgcccagtgtt

SEQ ID NO: 827071 - DNA, 23 bp, Homo sapiens
ctgcccagtgttgtttgtaaata

SEQ ID NO: 827072 - DNA, 18 bp, Homo sapiens
ctgcccatcacagggttg

SEQ ID NO: 827073 - DNA, 22 bp, Homo sapiens
ctgcccatcacagggttgggcc

SEQ ID NO: 827074 - DNA, 18 bp, Homo sapiens
ctgcccatggacaggctg

SEQ ID NO: 827075 - DNA, 21 bp, Homo sapiens
ctgcccatgtcgcgctcagca

SEQ ID NO: 827076 - DNA, 21 bp, Homo sapiens
ctgcccattcaccaaaattat

SEQ ID NO: 827077 - DNA, 20 bp, Homo sapiens
ctgccccaactcctggaagc

SEQ ID NO: 827078 - DNA, 15 bp, Homo sapiens
ctgccccaagcagcc

SEQ ID NO: 827079 - DNA, 19 bp, Homo sapiens
ctgccccaagcagccagcc

SEQ ID NO: 827080 - DNA, 20 bp, Homo sapiens
ctgccccaagcagccagcca

SEQ ID NO: 827081 - DNA, 22 bp, Homo sapiens
ctgccccaagcagccagccagt

SEQ ID NO: 827082 - DNA, 16 bp, Homo sapiens
ctgccccaagccccca

SEQ ID NO: 827083 - DNA, 19 bp, Homo sapiens
ctgccccaaggccccaggg

SEQ ID NO: 827084 - DNA, 13 bp, Homo sapiens
ctgccccaagttg

SEQ ID NO: 827085 - DNA, 22 bp, Homo sapiens
ctgccccaatcgggtccagaga

SEQ ID NO: 827086 - DNA, 22 bp, Homo sapiens
ctgccccacacctcctctcact

SEQ ID NO: 827087 - DNA, 22 bp, Homo sapiens
ctgccccacacggactcccggg

SEQ ID NO: 827088 - DNA, 21 bp, Homo sapiens
ctgccccacatgtggccatgg

SEQ ID NO: 827089 - DNA, 16 bp, Homo sapiens
ctgccccacccacccc

SEQ ID NO: 827090 - DNA, 17 bp, Homo sapiens
ctgccccacccacccca

SEQ ID NO: 827091 - DNA, 21 bp, Homo sapiens
ctgccccacccaccccacaga

SEQ ID NO: 827092 - DNA, 23 bp, Homo sapiens
ctgccccaccccatccagccaga

SEQ ID NO: 827093 - DNA, 15 bp, Homo sapiens
ctgccccacctgccg

SEQ ID NO: 827094 - DNA, 18 bp, Homo sapiens
ctgccccaccttgccagg

SEQ ID NO: 827095 - DNA, 18 bp, Homo sapiens
ctgccccacggagacaga

SEQ ID NO: 827096 - DNA, 17 bp, Homo sapiens
ctgccccacttctggca

SEQ ID NO: 827097 - DNA, 11 bp, Homo sapiens
ctgccccagcc

SEQ ID NO: 827098 - DNA, 21 bp, Homo sapiens
ctgccccagctgactgtggcc

SEQ ID NO: 827099 - DNA, 16 bp, Homo sapiens
ctgcctctaagctgct

SEQ ID NO: 827100 - DNA, 21 bp, Homo sapiens
ctgcctctaagctgctctaaa

SEQ ID NO: 827101 - DNA, 15 bp, Homo sapiens
ctgcctctatgccct

SEQ ID NO: 827102 - DNA, 20 bp, Homo sapiens
ctgcctctatgccctgcaga

SEQ ID NO: 827103 - DNA, 11 bp, Homo sapiens
ctgcctctccc

SEQ ID NO: 827104 - DNA, 18 bp, Homo sapiens
ctgcctctcccaggctgt

SEQ ID NO: 827105 - DNA, 23 bp, Homo sapiens
ctgcctctcccatcacttcccta

SEQ ID NO: 827106 - DNA, 14 bp, Homo sapiens
ctgcctctccctgg

SEQ ID NO: 827107 - DNA, 17 bp, Homo sapiens
ctgcctctccctgggtc

SEQ ID NO: 827108 - DNA, 12 bp, Homo sapiens
ctgcctctcttc

SEQ ID NO: 827109 - DNA, 18 bp, Homo sapiens
ctgcctctcttcttcccc

SEQ ID NO: 827110 - DNA, 22 bp, Homo sapiens
ctgcctctgacagcagcctgtg

SEQ ID NO: 827111 - DNA, 14 bp, Homo sapiens
ctgcctctgacccc

SEQ ID NO: 827112 - DNA, 14 bp, Homo sapiens
ctgcctctgctccc

SEQ ID NO: 827113 - DNA, 17 bp, Homo sapiens
ctgcctctgctccctct

SEQ ID NO: 827114 - DNA, 15 bp, Homo sapiens
ctgcctctgggcagc

SEQ ID NO: 827115 - DNA, 18 bp, Homo sapiens
ctgcctctgggcagcctg

SEQ ID NO: 827116 - DNA, 14 bp, Homo sapiens
ctgcctctgggcca

SEQ ID NO: 827117 - DNA, 19 bp, Homo sapiens
ctgcctctgtggaagagat

SEQ ID NO: 827118 - DNA, 12 bp, Homo sapiens
ctgcctctgtgt

SEQ ID NO: 827119 - DNA, 22 bp, Homo sapiens
ctgcctcttctgggagggcagc

SEQ ID NO: 827120 - DNA, 14 bp, Homo sapiens
ctgcctcttggcct

SEQ ID NO: 827121 - DNA, 18 bp, Homo sapiens
ctgcctcttggcttctca

SEQ ID NO: 827122 - DNA, 21 bp, Homo sapiens
ctgcctcttggcttctcagcc

SEQ ID NO: 827123 - DNA, 22 bp, Homo sapiens
ctgcctcttgggttcaagtgat

SEQ ID NO: 827124 - DNA, 11 bp, Homo sapiens
ctgcctcttgt

SEQ ID NO: 827125 - DNA, 13 bp, Homo sapiens
ctgcctgaataaa

SEQ ID NO: 827126 - DNA, 20 bp, Homo sapiens
ctgcctgacactgagcccca

SEQ ID NO: 827127 - DNA, 22 bp, Homo sapiens
ctgcctgacagccttccccagc

SEQ ID NO: 827128 - DNA, 14 bp, Homo sapiens
ctgcctgagcccag

SEQ ID NO: 827129 - DNA, 19 bp, Homo sapiens
ctgcctgagcccaggagct

SEQ ID NO: 827130 - DNA, 12 bp, Homo sapiens
ctgcctgaggag

SEQ ID NO: 827131 - DNA, 14 bp, Homo sapiens
ctgcctgaggagga

SEQ ID NO: 827132 - DNA, 20 bp, Homo sapiens
ctgcctgaggaggaggacac

SEQ ID NO: 827133 - DNA, 22 bp, Homo sapiens
ctgcctgaggaggaggacacag

SEQ ID NO: 827134 - DNA, 14 bp, Homo sapiens
ctgcctgagggcag

SEQ ID NO: 827135 - DNA, 15 bp, Homo sapiens
ctgcctgagggcagt

SEQ ID NO: 827136 - DNA, 16 bp, Homo sapiens
ctgcctgagggcccct

SEQ ID NO: 827137 - DNA, 23 bp, Homo sapiens
ctgcctgagggcccctctgccca

SEQ ID NO: 827138 - DNA, 17 bp, Homo sapiens
ctgcctgatccctgaac

SEQ ID NO: 827139 - DNA, 20 bp, Homo sapiens
ctgcctgcaatatttgaatt

SEQ ID NO: 827140 - DNA, 21 bp, Homo sapiens
ctgcctgcagaggtctgtgct

SEQ ID NO: 827141 - DNA, 12 bp, Homo sapiens
ctgcctgcagca

SEQ ID NO: 827142 - DNA, 14 bp, Homo sapiens
ctgcctgccaaagt

SEQ ID NO: 827143 - DNA, 17 bp, Homo sapiens
ctgcctgccatgtacct

SEQ ID NO: 827144 - DNA, 13 bp, Homo sapiens
ctgcctgcccacc

SEQ ID NO: 827145 - DNA, 14 bp, Homo sapiens
ctgcctgcccaccc

SEQ ID NO: 827146 - DNA, 17 bp, Homo sapiens
ctgcctgccccacacgg

SEQ ID NO: 827147 - DNA, 20 bp, Homo sapiens
ctgcctgccccccagtctcc

SEQ ID NO: 827148 - DNA, 18 bp, Homo sapiens
ctgcctgccccgccccca

SEQ ID NO: 827149 - DNA, 19 bp, Homo sapiens
ctgcctgccccgcccccag

SEQ ID NO: 827150 - DNA, 19 bp, Homo sapiens
ctgcctgccctgcctcagc

SEQ ID NO: 827151 - DNA, 17 bp, Homo sapiens
ctgcctgccgctgcacc

SEQ ID NO: 827152 - DNA, 18 bp, Homo sapiens
ctgcctgccgctgcacct

SEQ ID NO: 827153 - DNA, 17 bp, Homo sapiens
ctgcctgcctcctccct

SEQ ID NO: 827154 - DNA, 15 bp, Homo sapiens
ctgcctgcctcttgg

SEQ ID NO: 827155 - DNA, 14 bp, Homo sapiens
ctgcctgcctgtct

SEQ ID NO: 827156 - DNA, 16 bp, Homo sapiens
ctgcctgcctgtctgt

SEQ ID NO: 827157 - DNA, 15 bp, Homo sapiens
ctgcctgcggcccag

SEQ ID NO: 827158 - DNA, 14 bp, Homo sapiens
ctgcctgctccatc

SEQ ID NO: 827159 - DNA, 24 bp, Homo sapiens
ctgcctgctccttggcacccccat

SEQ ID NO: 827160 - DNA, 14 bp, Homo sapiens
ctgcctgctgtgct

SEQ ID NO: 827161 - DNA, 15 bp, Homo sapiens
ctgcctgctgtgctg

SEQ ID NO: 827162 - DNA, 12 bp, Homo sapiens
ctgcctgctttg

SEQ ID NO: 827163 - DNA, 13 bp, Homo sapiens
ctgcctgctttgg

SEQ ID NO: 827164 - DNA, 22 bp, Homo sapiens
ctgcctggagacaaggtgctaa

SEQ ID NO: 827165 - DNA, 13 bp, Homo sapiens
ctgcctggcacag

SEQ ID NO: 827166 - DNA, 14 bp, Homo sapiens
ctgcctggccactg

SEQ ID NO: 827167 - DNA, 18 bp, Homo sapiens
ctgcctggccactgctcc

SEQ ID NO: 827168 - DNA, 17 bp, Homo sapiens
ctgcctggccaggcaga

SEQ ID NO: 827169 - DNA, 11 bp, Homo sapiens
ctgcctggccc

SEQ ID NO: 827170 - DNA, 15 bp, Homo sapiens
ctgcctggcccccaa

SEQ ID NO: 827171 - DNA, 16 bp, Homo sapiens
ctgcctggcctggctc

SEQ ID NO: 827172 - DNA, 19 bp, Homo sapiens
ctgcctgggaacacgtgtg

SEQ ID NO: 827173 - DNA, 13 bp, Homo sapiens
ctgcctgggaagg

SEQ ID NO: 827174 - DNA, 16 bp, Homo sapiens
ctgcctgggagccagg

SEQ ID NO: 827175 - DNA, 15 bp, Homo sapiens
ctgcctgggccatgc

SEQ ID NO: 827176 - DNA, 22 bp, Homo sapiens
ctgcctgggcccggaagggctt

SEQ ID NO: 827177 - DNA, 22 bp, Homo sapiens
ctgcctgggccgtggcacagct

SEQ ID NO: 827178 - DNA, 17 bp, Homo sapiens
ctgcctgggcctgtgca

SEQ ID NO: 827179 - DNA, 19 bp, Homo sapiens
ctgcctgggcctgtgcagc

SEQ ID NO: 827180 - DNA, 23 bp, Homo sapiens
ctgcctgggcctgtgcagcagcc

SEQ ID NO: 827181 - DNA, 15 bp, Homo sapiens
ctgcctgggctgttg

SEQ ID NO: 827182 - DNA, 17 bp, Homo sapiens
ctgcctgggctgttggc

SEQ ID NO: 827183 - DNA, 19 bp, Homo sapiens
ctgcctggggcccaagttg

SEQ ID NO: 827184 - DNA, 20 bp, Homo sapiens
ctgcctggggcctccagaag

SEQ ID NO: 827185 - DNA, 13 bp, Homo sapiens
ctgcctggtaaaa

SEQ ID NO: 827186 - DNA, 20 bp, Homo sapiens
ctgcctggtctgtctggatc

SEQ ID NO: 827187 - DNA, 15 bp, Homo sapiens
ctgcctggttttatt

SEQ ID NO: 827188 - DNA, 21 bp, Homo sapiens
ctgcctgtagcaatggccaga

SEQ ID NO: 827189 - DNA, 19 bp, Homo sapiens
ctgcctgtagttaggaaat

SEQ ID NO: 827190 - DNA, 20 bp, Homo sapiens
ctgcctgtagttaggaaata

SEQ ID NO: 827191 - DNA, 23 bp, Homo sapiens
ctgcctgtccccaaacaggacag

SEQ ID NO: 827192 - DNA, 14 bp, Homo sapiens
ctgcctgtccccat

SEQ ID NO: 827193 - DNA, 21 bp, Homo sapiens
ctgcctgtccccccgcacttt

SEQ ID NO: 827194 - DNA, 24 bp, Homo sapiens
ctgcctgtccctaccccatggtgc

SEQ ID NO: 827195 - DNA, 18 bp, Homo sapiens
ctgcctgtccctctcagg

SEQ ID NO: 827196 - DNA, 15 bp, Homo sapiens
ctgcctgtctccatg

SEQ ID NO: 827197 - DNA, 15 bp, Homo sapiens
ctgcctgtctgcccc

SEQ ID NO: 827198 - DNA, 13 bp, Homo sapiens
ctgcctgtctgtc

SEQ ID NO: 827199 - DNA, 19 bp, Homo sapiens
ctgcctgtgcatgacctga

SEQ ID NO: 827200 - DNA, 21 bp, Homo sapiens
ctgcctgtgcccgcatgtgtg

SEQ ID NO: 827201 - DNA, 13 bp, Homo sapiens
ctgcctgtggagt

SEQ ID NO: 827202 - DNA, 12 bp, Homo sapiens
ctgcctgtggcg

SEQ ID NO: 827203 - DNA, 13 bp, Homo sapiens
ctgcctgtgggct

SEQ ID NO: 827204 - DNA, 15 bp, Homo sapiens
ctgcctgtgggcttc

SEQ ID NO: 827205 - DNA, 21 bp, Homo sapiens
ctgcctgttataactctgcac

SEQ ID NO: 827206 - DNA, 19 bp, Homo sapiens
ctgcctgttcccattcttg

SEQ ID NO: 827207 - DNA, 20 bp, Homo sapiens
ctgcctgttggcaggcccac

SEQ ID NO: 827208 - DNA, 21 bp, Homo sapiens
ctgccttaatgacattcccct

SEQ ID NO: 827209 - DNA, 22 bp, Homo sapiens
ctgccttaatgacattcccctc

SEQ ID NO: 827210 - DNA, 20 bp, Homo sapiens
ctgccttacccgccatacat

SEQ ID NO: 827211 - DNA, 22 bp, Homo sapiens
ctgccttactggtttccccagg

SEQ ID NO: 827212 - DNA, 12 bp, Homo sapiens
ctgccttagcct

SEQ ID NO: 827213 - DNA, 17 bp, Homo sapiens
ctgccttaggcctacct

SEQ ID NO: 827214 - DNA, 23 bp, Homo sapiens
ctgccttagtctcagtttgtgtg

SEQ ID NO: 827215 - DNA, 15 bp, Homo sapiens
ctgccttatcttgca

SEQ ID NO: 827216 - DNA, 21 bp, Homo sapiens
ctgccttcaaggactgtttca

SEQ ID NO: 827217 - DNA, 13 bp, Homo sapiens
ctgccttcaggga

SEQ ID NO: 827218 - DNA, 24 bp, Homo sapiens
ctgccttcagtaggaacaagctgg

SEQ ID NO: 827219 - DNA, 15 bp, Homo sapiens
ctgccttccagccca

SEQ ID NO: 827220 - DNA, 11 bp, Homo sapiens
ctgccttccct

SEQ ID NO: 827221 - DNA, 17 bp, Homo sapiens
ctgctctcatataagac

SEQ ID NO: 827222 - DNA, 21 bp, Homo sapiens
ctgctctcctcttgccactgc

SEQ ID NO: 827223 - DNA, 12 bp, Homo sapiens
ctgctctctgct

SEQ ID NO: 827224 - DNA, 16 bp, Homo sapiens
ctgctctctgctcatg

SEQ ID NO: 827225 - DNA, 13 bp, Homo sapiens
ctgctctctggag

SEQ ID NO: 827226 - DNA, 12 bp, Homo sapiens
ctgctctgagaa

SEQ ID NO: 827227 - DNA, 14 bp, Homo sapiens
ctgctctgagcatc

SEQ ID NO: 827228 - DNA, 18 bp, Homo sapiens
ctgctctgaggcttccag

SEQ ID NO: 827229 - DNA, 20 bp, Homo sapiens
ctgctctgaggcttccagag

SEQ ID NO: 827230 - DNA, 22 bp, Homo sapiens
ctgctctgaggcttccagagag

SEQ ID NO: 827231 - DNA, 13 bp, Homo sapiens
ctgctctgcccct

SEQ ID NO: 827232 - DNA, 14 bp, Homo sapiens
ctgctctgcctgga

SEQ ID NO: 827233 - DNA, 17 bp, Homo sapiens
ctgctctgcctggagtg

SEQ ID NO: 827234 - DNA, 20 bp, Homo sapiens
ctgctctgcgtgtcacctgt

SEQ ID NO: 827235 - DNA, 22 bp, Homo sapiens
ctgctctgcgtgtcacctgtgc

SEQ ID NO: 827236 - DNA, 17 bp, Homo sapiens
ctgctctgctgctctga

SEQ ID NO: 827237 - DNA, 13 bp, Homo sapiens
ctgctctggaaaa

SEQ ID NO: 827238 - DNA, 22 bp, Homo sapiens
ctgctctggaataaagttgcag

SEQ ID NO: 827239 - DNA, 15 bp, Homo sapiens
ctgctctggtgcacg

SEQ ID NO: 827240 - DNA, 18 bp, Homo sapiens
ctgctctggttgtttctg

SEQ ID NO: 827241 - DNA, 15 bp, Homo sapiens
ctgctcttaagaaac

SEQ ID NO: 827242 - DNA, 19 bp, Homo sapiens
ctgctcttagtgcccgcct

SEQ ID NO: 827243 - DNA, 18 bp, Homo sapiens
ctgctcttctgtgcccag

SEQ ID NO: 827244 - DNA, 14 bp, Homo sapiens
ctgctcttgaacat

SEQ ID NO: 827245 - DNA, 14 bp, Homo sapiens
ctgctcttgtttca

SEQ ID NO: 827246 - DNA, 21 bp, Homo sapiens
ctgctctttctacatgactgg

SEQ ID NO: 827247 - DNA, 14 bp, Homo sapiens
ctgctctttctctg

SEQ ID NO: 827248 - DNA, 15 bp, Homo sapiens
ctgctctttctctgc

SEQ ID NO: 827249 - DNA, 21 bp, Homo sapiens
ctgctctttctctgccagtga

SEQ ID NO: 827250 - DNA, 22 bp, Homo sapiens
ctgctctttctctgccagtgac

SEQ ID NO: 827251 - DNA, 19 bp, Homo sapiens
ctgctcttttgtgatgaac

SEQ ID NO: 827252 - DNA, 20 bp, Homo sapiens
ctgctgaaagtcctgctttc

SEQ ID NO: 827253 - DNA, 17 bp, Homo sapiens
ctgctgaacacagtgtc

SEQ ID NO: 827254 - DNA, 21 bp, Homo sapiens
ctgctgaacacagtgtctgtt

SEQ ID NO: 827255 - DNA, 18 bp, Homo sapiens
ctgctgaagttctgagcc

SEQ ID NO: 827256 - DNA, 22 bp, Homo sapiens
ctgctgaatgatttccaaagag

SEQ ID NO: 827257 - DNA, 23 bp, Homo sapiens
ctgctgaatgatttccaaagaga

SEQ ID NO: 827258 - DNA, 16 bp, Homo sapiens
ctgctgaatgcaggga

SEQ ID NO: 827259 - DNA, 9 bp, Homo sapiens
ctgctgacc

SEQ ID NO: 827260 - DNA, 23 bp, Homo sapiens
ctgctgaccaattgtgctgccat

SEQ ID NO: 827261 - DNA, 15 bp, Homo sapiens
ctgctgacctgtgca

SEQ ID NO: 827262 - DNA, 19 bp, Homo sapiens
ctgctgaccttctgcggct

SEQ ID NO: 827263 - DNA, 13 bp, Homo sapiens
ctgctgactgttt

SEQ ID NO: 827264 - DNA, 22 bp, Homo sapiens
ctgctgagagacccaaggagga

SEQ ID NO: 827265 - DNA, 13 bp, Homo sapiens
ctgctgagagccc

SEQ ID NO: 827266 - DNA, 22 bp, Homo sapiens
ctgctgagccactcgcagtcgc

SEQ ID NO: 827267 - DNA, 22 bp, Homo sapiens
ctgctgagcctcacagcagtga

SEQ ID NO: 827268 - DNA, 16 bp, Homo sapiens
ctgctgagctggccct

SEQ ID NO: 827269 - DNA, 14 bp, Homo sapiens
ctgctgagctgggc

SEQ ID NO: 827270 - DNA, 18 bp, Homo sapiens
ctgctgagctgggcccag

SEQ ID NO: 827271 - DNA, 15 bp, Homo sapiens
ctgctgaggagtctg

SEQ ID NO: 827272 - DNA, 19 bp, Homo sapiens
ctgctgaggagtctgagga

SEQ ID NO: 827273 - DNA, 14 bp, Homo sapiens
ctgctgaggcagtg

SEQ ID NO: 827274 - DNA, 11 bp, Homo sapiens
ctgctgaggcc

SEQ ID NO: 827275 - DNA, 14 bp, Homo sapiens
ctgctgaggcccag

SEQ ID NO: 827276 - DNA, 12 bp, Homo sapiens
ctgctgaggcct

SEQ ID NO: 827277 - DNA, 15 bp, Homo sapiens
ctgctgagtgctggg

SEQ ID NO: 827278 - DNA, 16 bp, Homo sapiens
ctgctgatgcgctggg

SEQ ID NO: 827279 - DNA, 20 bp, Homo sapiens
ctgctgcaaggtggcctctg

SEQ ID NO: 827280 - DNA, 21 bp, Homo sapiens
ctgctgcaaggtggcctctgc

SEQ ID NO: 827281 - DNA, 23 bp, Homo sapiens
ctgctgcaccaacctcactgccc

SEQ ID NO: 827282 - DNA, 16 bp, Homo sapiens
ctgctgcaccagagtg

SEQ ID NO: 827283 - DNA, 11 bp, Homo sapiens
ctgctgcaccc

SEQ ID NO: 827284 - DNA, 14 bp, Homo sapiens
ctgctgcagttacc

SEQ ID NO: 827285 - DNA, 18 bp, Homo sapiens
ctgctgcagttaccacag

SEQ ID NO: 827286 - DNA, 16 bp, Homo sapiens
ctgctgcatagctcta

SEQ ID NO: 827287 - DNA, 19 bp, Homo sapiens
ctgctgccacagcaaggaa

SEQ ID NO: 827288 - DNA, 17 bp, Homo sapiens
ctgctgccagggcttcc

SEQ ID NO: 827289 - DNA, 19 bp, Homo sapiens
ctgctgccagtgcagccac

SEQ ID NO: 827290 - DNA, 12 bp, Homo sapiens
ctgctgcccagc

SEQ ID NO: 827291 - DNA, 16 bp, Homo sapiens
ctgctgccccagctga

SEQ ID NO: 827292 - DNA, 14 bp, Homo sapiens
ctgctgcccccacc

SEQ ID NO: 827293 - DNA, 15 bp, Homo sapiens
ctgctgcccccaccc

SEQ ID NO: 827294 - DNA, 21 bp, Homo sapiens
ctgctgcccccaccccgggga

SEQ ID NO: 827295 - DNA, 22 bp, Homo sapiens
ctgctgcccccttccccagccc

SEQ ID NO: 827296 - DNA, 15 bp, Homo sapiens
ctgctgccgcaggag

SEQ ID NO: 827297 - DNA, 17 bp, Homo sapiens
ctgctgccgcctcccag

SEQ ID NO: 827298 - DNA, 19 bp, Homo sapiens
ctgctgccgcctcccagcc

SEQ ID NO: 827299 - DNA, 19 bp, Homo sapiens
ctgctgcctccccaaccct

SEQ ID NO: 827300 - DNA, 11 bp, Homo sapiens
ctgctgcctgg

SEQ ID NO: 827301 - DNA, 20 bp, Homo sapiens
ctgctgcgcccttaccttcc

SEQ ID NO: 827302 - DNA, 21 bp, Homo sapiens
ctgctgcgcccttaccttccc

SEQ ID NO: 827303 - DNA, 19 bp, Homo sapiens
ctgctgcgtccccactccc

SEQ ID NO: 827304 - DNA, 16 bp, Homo sapiens
ctgctgctattgctgt

SEQ ID NO: 827305 - DNA, 18 bp, Homo sapiens
ctgctgctattgctgtct

SEQ ID NO: 827306 - DNA, 21 bp, Homo sapiens
ctgctgctattgctgtctggt

SEQ ID NO: 827307 - DNA, 12 bp, Homo sapiens
ctgctgctcccc

SEQ ID NO: 827308 - DNA, 14 bp, Homo sapiens
ctgctgctcctctt

SEQ ID NO: 827309 - DNA, 17 bp, Homo sapiens
ctgctgctcctctttcc

SEQ ID NO: 827310 - DNA, 13 bp, Homo sapiens
ctgctgctcctgt

SEQ ID NO: 827311 - DNA, 14 bp, Homo sapiens
ctgctgctctgacc

SEQ ID NO: 827312 - DNA, 13 bp, Homo sapiens
ctgctgctgcccg

SEQ ID NO: 827313 - DNA, 16 bp, Homo sapiens
ctgctgctgctgcgcc

SEQ ID NO: 827314 - DNA, 22 bp, Homo sapiens
ctgctgctgtaactgctgagcc

SEQ ID NO: 827315 - DNA, 13 bp, Homo sapiens
ctgctgctgtgtt

SEQ ID NO: 827316 - DNA, 22 bp, Homo sapiens
ctgctgcttaatcctaccccct

SEQ ID NO: 827317 - DNA, 18 bp, Homo sapiens
ctgctgcttctgctccag

SEQ ID NO: 827318 - DNA, 22 bp, Homo sapiens
ctgctgcttctgctccagcccc

SEQ ID NO: 827319 - DNA, 14 bp, Homo sapiens
ctgctgcttgggac

SEQ ID NO: 827320 - DNA, 19 bp, Homo sapiens
ctgctggaaacacagtcac

SEQ ID NO: 827321 - DNA, 15 bp, Homo sapiens
ctgctggaaacagac

SEQ ID NO: 827322 - DNA, 14 bp, Homo sapiens
ctgctggaaaccac

SEQ ID NO: 827323 - DNA, 17 bp, Homo sapiens
ctgctggaaggggcagc

SEQ ID NO: 827324 - DNA, 20 bp, Homo sapiens
ctgctggaggaggggaagct

SEQ ID NO: 827325 - DNA, 17 bp, Homo sapiens
ctgctggaggcctcagg

SEQ ID NO: 827326 - DNA, 19 bp, Homo sapiens
ctgctggagtccagtgctt

SEQ ID NO: 827327 - DNA, 20 bp, Homo sapiens
ctgctggagtccagtgcttt

SEQ ID NO: 827328 - DNA, 21 bp, Homo sapiens
ctgctggatcacagctgcttt

SEQ ID NO: 827329 - DNA, 15 bp, Homo sapiens
ctgctggcagggcca

SEQ ID NO: 827330 - DNA, 19 bp, Homo sapiens
ctgctggcagggccagggc

SEQ ID NO: 827331 - DNA, 23 bp, Homo sapiens
ctgctggcagggccagggcaatg

SEQ ID NO: 827332 - DNA, 20 bp, Homo sapiens
ctgctggccaaatagcaaag

SEQ ID NO: 827333 - DNA, 11 bp, Homo sapiens
ctgctggccat

SEQ ID NO: 827334 - DNA, 22 bp, Homo sapiens
ctgctggccatgaatctctgcc

SEQ ID NO: 827335 - DNA, 22 bp, Homo sapiens
ctgctggcccagccaaaccctg

SEQ ID NO: 827336 - DNA, 14 bp, Homo sapiens
ctgctggcccctca

SEQ ID NO: 827337 - DNA, 15 bp, Homo sapiens
ctgctggcccctcac

SEQ ID NO: 827338 - DNA, 17 bp, Homo sapiens
ctgctggcccctcacct

SEQ ID NO: 827339 - DNA, 23 bp, Homo sapiens
ctgctggcccctcacctgggcac

SEQ ID NO: 827340 - DNA, 15 bp, Homo sapiens
ctgctggccggagca

SEQ ID NO: 827341 - DNA, 20 bp, Homo sapiens
ctgctggcctggccggcaac

SEQ ID NO: 827342 - DNA, 11 bp, Homo sapiens
ctgctggctca

SEQ ID NO: 827343 - DNA, 15 bp, Homo sapiens
ctgcttgtgcctccc

SEQ ID NO: 827344 - DNA, 13 bp, Homo sapiens
ctgcttgtgggcc

SEQ ID NO: 827345 - DNA, 20 bp, Homo sapiens
ctgctttaaagggcctgcct

SEQ ID NO: 827346 - DNA, 22 bp, Homo sapiens
ctgctttaaagggcctgcctgg

SEQ ID NO: 827347 - DNA, 15 bp, Homo sapiens
ctgctttacaaaatt

SEQ ID NO: 827348 - DNA, 15 bp, Homo sapiens
ctgctttcacttaag

SEQ ID NO: 827349 - DNA, 19 bp, Homo sapiens
ctgctttccatgggcccgc

SEQ ID NO: 827350 - DNA, 16 bp, Homo sapiens
ctgctttccttttctc

SEQ ID NO: 827351 - DNA, 16 bp, Homo sapiens
ctgctttctccattgt

SEQ ID NO: 827352 - DNA, 22 bp, Homo sapiens
ctgctttctccattgtaaacca

SEQ ID NO: 827353 - DNA, 14 bp, Homo sapiens
ctgctttctccttt

SEQ ID NO: 827354 - DNA, 19 bp, Homo sapiens
ctgctttgaataaatgtgt

SEQ ID NO: 827355 - DNA, 23 bp, Homo sapiens
ctgctttgccaagttgctgtcac

SEQ ID NO: 827356 - DNA, 20 bp, Homo sapiens
ctgctttgcgtgcccggggc

SEQ ID NO: 827357 - DNA, 14 bp, Homo sapiens
ctgctttggcagtg

SEQ ID NO: 827358 - DNA, 18 bp, Homo sapiens
ctgctttggcctttcctt

SEQ ID NO: 827359 - DNA, 21 bp, Homo sapiens
ctgctttggcctttccttgta

SEQ ID NO: 827360 - DNA, 23 bp, Homo sapiens
ctgctttgggatttaatttccag

SEQ ID NO: 827361 - DNA, 17 bp, Homo sapiens
ctgctttgggctgccct

SEQ ID NO: 827362 - DNA, 20 bp, Homo sapiens
ctgctttgggctgccctggt

SEQ ID NO: 827363 - DNA, 21 bp, Homo sapiens
ctgctttgggctgccctggtg

SEQ ID NO: 827364 - DNA, 23 bp, Homo sapiens
ctgctttgggctgccctggtgct

SEQ ID NO: 827365 - DNA, 12 bp, Homo sapiens
ctgctttgtcca

SEQ ID NO: 827366 - DNA, 15 bp, Homo sapiens
ctgctttgtgcatat

SEQ ID NO: 827367 - DNA, 19 bp, Homo sapiens
ctgcttttaactctagaat

SEQ ID NO: 827368 - DNA, 17 bp, Homo sapiens
ctgcttttaccatgccc

SEQ ID NO: 827369 - DNA, 21 bp, Homo sapiens
ctgcttttagttcatatatac

SEQ ID NO: 827370 - DNA, 17 bp, Homo sapiens
ctgcttttatctcagat

SEQ ID NO: 827371 - DNA, 14 bp, Homo sapiens
ctgcttttccagga

SEQ ID NO: 827372 - DNA, 17 bp, Homo sapiens
ctgcttttccaggatcc

SEQ ID NO: 827373 - DNA, 23 bp, Homo sapiens
ctgcttttccaggatcctgcagg

SEQ ID NO: 827374 - DNA, 16 bp, Homo sapiens
ctgcttttctgccctg

SEQ ID NO: 827375 - DNA, 17 bp, Homo sapiens
ctgcttttctgccctgg

SEQ ID NO: 827376 - DNA, 21 bp, Homo sapiens
ctgcttttctgccctggctgc

SEQ ID NO: 827377 - DNA, 17 bp, Homo sapiens
ctgcttttctgtcctgg

SEQ ID NO: 827378 - DNA, 20 bp, Homo sapiens
ctgcttttctgtcctgggca

SEQ ID NO: 827379 - DNA, 18 bp, Homo sapiens
ctgcttttcttttctaac

SEQ ID NO: 827380 - DNA, 14 bp, Homo sapiens
ctgcttttgatgat

SEQ ID NO: 827381 - DNA, 22 bp, Homo sapiens
ctgcttttggtgctctcacctt

SEQ ID NO: 827382 - DNA, 14 bp, Homo sapiens
ctgctttttggaaa

SEQ ID NO: 827383 - DNA, 18 bp, Homo sapiens
ctgctttttggaaagtca

SEQ ID NO: 827384 - DNA, 19 bp, Homo sapiens
ctggaaaaaaaatatatat

SEQ ID NO: 827385 - DNA, 21 bp, Homo sapiens
ctggaaaaaaatacaaaaagc

SEQ ID NO: 827386 - DNA, 16 bp, Homo sapiens
ctggaaaaaacaaaat

SEQ ID NO: 827387 - DNA, 14 bp, Homo sapiens
ctggaaaacctcct

SEQ ID NO: 827388 - DNA, 23 bp, Homo sapiens
ctggaaaactattgagccttgca

SEQ ID NO: 827389 - DNA, 13 bp, Homo sapiens
ctggaaaagaaga

SEQ ID NO: 827390 - DNA, 23 bp, Homo sapiens
ctggaaacaagtgaccccagggc

SEQ ID NO: 827391 - DNA, 13 bp, Homo sapiens
ctggaaacagcat

SEQ ID NO: 827392 - DNA, 15 bp, Homo sapiens
ctggaaacagcatga

SEQ ID NO: 827393 - DNA, 16 bp, Homo sapiens
ctggaaacagcatgaa

SEQ ID NO: 827394 - DNA, 17 bp, Homo sapiens
ctggaaacagcatgaat

SEQ ID NO: 827395 - DNA, 17 bp, Homo sapiens
ctggaaaccaagtcagg

SEQ ID NO: 827396 - DNA, 20 bp, Homo sapiens
ctggaaaccacacttcttga

SEQ ID NO: 827397 - DNA, 18 bp, Homo sapiens
ctggaaagaggctctgga

SEQ ID NO: 827398 - DNA, 20 bp, Homo sapiens
ctggaaagcagagcctcctg

SEQ ID NO: 827399 - DNA, 16 bp, Homo sapiens
ctggaaaggaaacatt

SEQ ID NO: 827400 - DNA, 15 bp, Homo sapiens
ctggaaaggctcagt

SEQ ID NO: 827401 - DNA, 13 bp, Homo sapiens
ctggaaaggggag

SEQ ID NO: 827402 - DNA, 20 bp, Homo sapiens
ctggaaaggggagagcctgc

SEQ ID NO: 827403 - DNA, 22 bp, Homo sapiens
ctggaaaggggagagcctgctg

SEQ ID NO: 827404 - DNA, 20 bp, Homo sapiens
ctggaaatgtaaaattgaaa

SEQ ID NO: 827405 - DNA, 17 bp, Homo sapiens
ctggaaatgtagcactt

SEQ ID NO: 827406 - DNA, 22 bp, Homo sapiens
ctggaaattccaggaaccaaaa

SEQ ID NO: 827407 - DNA, 22 bp, Homo sapiens
ctggaacaaatcgtttctcaga

SEQ ID NO: 827408 - DNA, 18 bp, Homo sapiens
ctggaacaacttgtagca

SEQ ID NO: 827409 - DNA, 22 bp, Homo sapiens
ctggaaccaatcccgtgaaaga

SEQ ID NO: 827410 - DNA, 17 bp, Homo sapiens
ctggaaccacattgaag

SEQ ID NO: 827411 - DNA, 21 bp, Homo sapiens
ctggaaccagcaagtcccaga

SEQ ID NO: 827412 - DNA, 13 bp, Homo sapiens
ctggaaccaggga

SEQ ID NO: 827413 - DNA, 19 bp, Homo sapiens
ctggaaccagggaggagag

SEQ ID NO: 827414 - DNA, 16 bp, Homo sapiens
ctggaaccccccaggc

SEQ ID NO: 827415 - DNA, 17 bp, Homo sapiens
ctggaaccccccaggcc

SEQ ID NO: 827416 - DNA, 14 bp, Homo sapiens
ctggaacctgactt

SEQ ID NO: 827417 - DNA, 18 bp, Homo sapiens
ctggaacctgcaaaaaat

SEQ ID NO: 827418 - DNA, 20 bp, Homo sapiens
ctggaaccttgctgtcctga

SEQ ID NO: 827419 - DNA, 16 bp, Homo sapiens
ctggaacggtgaaggt

SEQ ID NO: 827420 - DNA, 18 bp, Homo sapiens
ctggaactggctgtgaag

SEQ ID NO: 827421 - DNA, 20 bp, Homo sapiens
ctggaacttgaactgattca

SEQ ID NO: 827422 - DNA, 17 bp, Homo sapiens
ctggaactttagtgaaa

SEQ ID NO: 827423 - DNA, 17 bp, Homo sapiens
ctggaagaacatcaaga

SEQ ID NO: 827424 - DNA, 17 bp, Homo sapiens
ctggaagacacttcaga

SEQ ID NO: 827425 - DNA, 19 bp, Homo sapiens
ctggaagacgtggctctgg

SEQ ID NO: 827426 - DNA, 21 bp, Homo sapiens
ctggaagacgtggctctgggt

SEQ ID NO: 827427 - DNA, 14 bp, Homo sapiens
ctggaagaggtggg

SEQ ID NO: 827428 - DNA, 22 bp, Homo sapiens
ctggaagatataacattcagtt

SEQ ID NO: 827429 - DNA, 14 bp, Homo sapiens
ctggaagcaggtgc

SEQ ID NO: 827430 - DNA, 22 bp, Homo sapiens
ctggaagccaaaatgtaggctt

SEQ ID NO: 827431 - DNA, 22 bp, Homo sapiens
ctggaagccatcctgcccttct

SEQ ID NO: 827432 - DNA, 14 bp, Homo sapiens
ctggaagcccagcc

SEQ ID NO: 827433 - DNA, 17 bp, Homo sapiens
ctggaagcccagcccct

SEQ ID NO: 827434 - DNA, 21 bp, Homo sapiens
ctggaagcccagcccctactg

SEQ ID NO: 827435 - DNA, 21 bp, Homo sapiens
ctggaagcccctgggcccagt

SEQ ID NO: 827436 - DNA, 14 bp, Homo sapiens
ctggaagccctgga

SEQ ID NO: 827437 - DNA, 16 bp, Homo sapiens
ctggaagccctggaga

SEQ ID NO: 827438 - DNA, 18 bp, Homo sapiens
ctggaagccggcggccca

SEQ ID NO: 827439 - DNA, 22 bp, Homo sapiens
ctggaagccggcggcccaagcc

SEQ ID NO: 827440 - DNA, 16 bp, Homo sapiens
ctggaagcctggactc

SEQ ID NO: 827441 - DNA, 18 bp, Homo sapiens
ctggaagctaatttgcat

SEQ ID NO: 827442 - DNA, 22 bp, Homo sapiens
ctggaagctaatttgcattaaa

SEQ ID NO: 827443 - DNA, 16 bp, Homo sapiens
ctggaagctgtgtcct

SEQ ID NO: 827444 - DNA, 13 bp, Homo sapiens
ctggaaggacaca

SEQ ID NO: 827445 - DNA, 15 bp, Homo sapiens
ctggaaggacacagt

SEQ ID NO: 827446 - DNA, 18 bp, Homo sapiens
ctggaaggacacagtgat

SEQ ID NO: 827447 - DNA, 14 bp, Homo sapiens
ctggaaggcagggc

SEQ ID NO: 827448 - DNA, 19 bp, Homo sapiens
ctggaaggcagggcagagg

SEQ ID NO: 827449 - DNA, 13 bp, Homo sapiens
ctggaaggctggc

SEQ ID NO: 827450 - DNA, 15 bp, Homo sapiens
ctggaaggctggctg

SEQ ID NO: 827451 - DNA, 18 bp, Homo sapiens
ctggaaggctggctgagt

SEQ ID NO: 827452 - DNA, 19 bp, Homo sapiens
ctggaaggggcagcaggag

SEQ ID NO: 827453 - DNA, 17 bp, Homo sapiens
ctggaagttttgcattt

SEQ ID NO: 827454 - DNA, 20 bp, Homo sapiens
ctggaataaaatataaaact

SEQ ID NO: 827455 - DNA, 16 bp, Homo sapiens
ctggaataactcttac

SEQ ID NO: 827456 - DNA, 17 bp, Homo sapiens
ctggaataatttgtaaa

SEQ ID NO: 827457 - DNA, 21 bp, Homo sapiens
ctggaataatttgtaaatgat

SEQ ID NO: 827458 - DNA, 20 bp, Homo sapiens
ctggaatataaaacagtcat

SEQ ID NO: 827459 - DNA, 17 bp, Homo sapiens
ctggaatattgtgattc

SEQ ID NO: 827460 - DNA, 20 bp, Homo sapiens
ctggaatcagctcaggactg

SEQ ID NO: 827461 - DNA, 19 bp, Homo sapiens
ctggaatcagtatttcctt

SEQ ID NO: 827462 - DNA, 23 bp, Homo sapiens
ctggaatcagtatttccttccac

SEQ ID NO: 827463 - DNA, 17 bp, Homo sapiens
ctggaatctacaagcca

SEQ ID NO: 827464 - DNA, 19 bp, Homo sapiens
ctggagaggaagccagtgg

SEQ ID NO: 827465 - DNA, 22 bp, Homo sapiens
ctggagaggacggccctgcctg

SEQ ID NO: 827466 - DNA, 22 bp, Homo sapiens
ctggagaggccctctggagtgg

SEQ ID NO: 827467 - DNA, 13 bp, Homo sapiens
ctggagaggcctg

SEQ ID NO: 827468 - DNA, 14 bp, Homo sapiens
ctggagaggcctgg

SEQ ID NO: 827469 - DNA, 15 bp, Homo sapiens
ctggagatagctggg

SEQ ID NO: 827470 - DNA, 16 bp, Homo sapiens
ctggagatcctcctgc

SEQ ID NO: 827471 - DNA, 18 bp, Homo sapiens
ctggagatcctcctgcag

SEQ ID NO: 827472 - DNA, 20 bp, Homo sapiens
ctggagatgaggccagacca

SEQ ID NO: 827473 - DNA, 20 bp, Homo sapiens
ctggagatgcaaggtgctgg

SEQ ID NO: 827474 - DNA, 14 bp, Homo sapiens
ctggagatgcagct

SEQ ID NO: 827475 - DNA, 14 bp, Homo sapiens
ctggagcaagaagg

SEQ ID NO: 827476 - DNA, 23 bp, Homo sapiens
ctggagcaagaaggaaggaggca

SEQ ID NO: 827477 - DNA, 23 bp, Homo sapiens
ctggagcaccaggcacgaaccca

SEQ ID NO: 827478 - DNA, 18 bp, Homo sapiens
ctggagcagaaagtgcct

SEQ ID NO: 827479 - DNA, 13 bp, Homo sapiens
ctggagcagacca

SEQ ID NO: 827480 - DNA, 15 bp, Homo sapiens
ctggagcagaccacc

SEQ ID NO: 827481 - DNA, 22 bp, Homo sapiens
ctggagcagaccaccccgcctg

SEQ ID NO: 827482 - DNA, 13 bp, Homo sapiens
ctggagcagccaa

SEQ ID NO: 827483 - DNA, 23 bp, Homo sapiens
ctggagcagccaaggccgccagc

SEQ ID NO: 827484 - DNA, 21 bp, Homo sapiens
ctggagcagcggattgctctg

SEQ ID NO: 827485 - DNA, 16 bp, Homo sapiens
ctggagcatctgactc

SEQ ID NO: 827486 - DNA, 17 bp, Homo sapiens
ctggagcatctgactca

SEQ ID NO: 827487 - DNA, 14 bp, Homo sapiens
ctggagccacaggc

SEQ ID NO: 827488 - DNA, 12 bp, Homo sapiens
ctggagccagag

SEQ ID NO: 827489 - DNA, 16 bp, Homo sapiens
ctggagccagggcaga

SEQ ID NO: 827490 - DNA, 20 bp, Homo sapiens
ctggagccagggcagaggaa

SEQ ID NO: 827491 - DNA, 22 bp, Homo sapiens
ctggagccatcccttcggagcc

SEQ ID NO: 827492 - DNA, 15 bp, Homo sapiens
ctggagcccacagcg

SEQ ID NO: 827493 - DNA, 18 bp, Homo sapiens
ctggagcccacagcgagc

SEQ ID NO: 827494 - DNA, 16 bp, Homo sapiens
ctggagcccccagcag

SEQ ID NO: 827495 - DNA, 14 bp, Homo sapiens
ctggagcccgcttc

SEQ ID NO: 827496 - DNA, 24 bp, Homo sapiens
ctggagcctccgacgctgcctctc

SEQ ID NO: 827497 - DNA, 17 bp, Homo sapiens
ctggagcctgcagatga

SEQ ID NO: 827498 - DNA, 19 bp, Homo sapiens
ctggagcctgcagatgaga

SEQ ID NO: 827499 - DNA, 12 bp, Homo sapiens
ctggagcctggg

SEQ ID NO: 827500 - DNA, 13 bp, Homo sapiens
ctggagcctgggg

SEQ ID NO: 827501 - DNA, 14 bp, Homo sapiens
ctggagcctggggt

SEQ ID NO: 827502 - DNA, 15 bp, Homo sapiens
ctggagcggagatga

SEQ ID NO: 827503 - DNA, 22 bp, Homo sapiens
ctggagcggagatgaggggcca

SEQ ID NO: 827504 - DNA, 23 bp, Homo sapiens
ctggagcgtttgctgtgccagga

SEQ ID NO: 827505 - DNA, 18 bp, Homo sapiens
ctggagctcttggaagag

SEQ ID NO: 827506 - DNA, 19 bp, Homo sapiens
ctggagctggcgtctgtct

SEQ ID NO: 827507 - DNA, 17 bp, Homo sapiens
ctggagctgggagacaa

SEQ ID NO: 827508 - DNA, 14 bp, Homo sapiens
ctggagctgggagg

SEQ ID NO: 827509 - DNA, 18 bp, Homo sapiens
ctggaggaaagggaggag

SEQ ID NO: 827510 - DNA, 15 bp, Homo sapiens
ctggaggaacttgct

SEQ ID NO: 827511 - DNA, 22 bp, Homo sapiens
ctggaggaacttgctgctgtgc

SEQ ID NO: 827512 - DNA, 20 bp, Homo sapiens
ctggaggaagtggggtctgg

SEQ ID NO: 827513 - DNA, 22 bp, Homo sapiens
ctggaggaatacattttattct

SEQ ID NO: 827514 - DNA, 19 bp, Homo sapiens
ctggaggaattcagctcag

SEQ ID NO: 827515 - DNA, 13 bp, Homo sapiens
ctggaggaccaga

SEQ ID NO: 827516 - DNA, 14 bp, Homo sapiens
ctggaggagagaag

SEQ ID NO: 827517 - DNA, 14 bp, Homo sapiens
ctggaggagcagca

SEQ ID NO: 827518 - DNA, 16 bp, Homo sapiens
ctggaggagcagcagc

SEQ ID NO: 827519 - DNA, 18 bp, Homo sapiens
ctggaggagcagcttcct

SEQ ID NO: 827520 - DNA, 15 bp, Homo sapiens
ctggaggaggggaag

SEQ ID NO: 827521 - DNA, 17 bp, Homo sapiens
ctggaggaggggaagct

SEQ ID NO: 827522 - DNA, 18 bp, Homo sapiens
ctggaggatgtgggcagc

SEQ ID NO: 827523 - DNA, 17 bp, Homo sapiens
ctggaggattttccagt

SEQ ID NO: 827524 - DNA, 17 bp, Homo sapiens
ctggaggcaagagggag

SEQ ID NO: 827525 - DNA, 19 bp, Homo sapiens
ctggaggcaagagggaggg

SEQ ID NO: 827526 - DNA, 23 bp, Homo sapiens
ctggaggcaagagggaggggaca

SEQ ID NO: 827527 - DNA, 12 bp, Homo sapiens
ctggaggcaggg

SEQ ID NO: 827528 - DNA, 13 bp, Homo sapiens
ctggaggcagggc

SEQ ID NO: 827529 - DNA, 20 bp, Homo sapiens
ctggaggcagggccttgccc

SEQ ID NO: 827530 - DNA, 18 bp, Homo sapiens
ctggaggcaggggctgct

SEQ ID NO: 827531 - DNA, 15 bp, Homo sapiens
ctggaggcccaggct

SEQ ID NO: 827532 - DNA, 13 bp, Homo sapiens
ctggaggcccctg

SEQ ID NO: 827533 - DNA, 16 bp, Homo sapiens
ctggaggcctctggcc

SEQ ID NO: 827534 - DNA, 17 bp, Homo sapiens
ctggaggcctctggccc

SEQ ID NO: 827535 - DNA, 16 bp, Homo sapiens
ctggaggccttccagc

SEQ ID NO: 827536 - DNA, 18 bp, Homo sapiens
ctggaggcggtgcggcag

SEQ ID NO: 827537 - DNA, 11 bp, Homo sapiens
ctggaggctgc

SEQ ID NO: 827538 - DNA, 14 bp, Homo sapiens
ctggagggaggctc

SEQ ID NO: 827539 - DNA, 17 bp, Homo sapiens
ctggagggatgccccca

SEQ ID NO: 827540 - DNA, 18 bp, Homo sapiens
ctggagggatgcccccag

SEQ ID NO: 827541 - DNA, 20 bp, Homo sapiens
ctggagggcacttcctccac

SEQ ID NO: 827542 - DNA, 17 bp, Homo sapiens
ctggaggggagagcttt

SEQ ID NO: 827543 - DNA, 18 bp, Homo sapiens
ctggaggggagagctttg

SEQ ID NO: 827544 - DNA, 22 bp, Homo sapiens
ctggaggggagagctttgtgct

SEQ ID NO: 827545 - DNA, 19 bp, Homo sapiens
ctggaggggctgtcctcct

SEQ ID NO: 827546 - DNA, 23 bp, Homo sapiens
ctggagggtaactggggggccac

SEQ ID NO: 827547 - DNA, 16 bp, Homo sapiens
ctggaggtaaggcctt

SEQ ID NO: 827548 - DNA, 21 bp, Homo sapiens
ctggaggtactgagacagggt

SEQ ID NO: 827549 - DNA, 14 bp, Homo sapiens
ctggaggtcagcat

SEQ ID NO: 827550 - DNA, 20 bp, Homo sapiens
ctggaggtggctgagcccct

SEQ ID NO: 827551 - DNA, 19 bp, Homo sapiens
ctggaggttgaagccaagt

SEQ ID NO: 827552 - DNA, 13 bp, Homo sapiens
ctggagtccagtg

SEQ ID NO: 827553 - DNA, 14 bp, Homo sapiens
ctggagtcccaccc

SEQ ID NO: 827554 - DNA, 15 bp, Homo sapiens
ctggagtcccacccg

SEQ ID NO: 827555 - DNA, 19 bp, Homo sapiens
ctggagtcccacccggaca

SEQ ID NO: 827556 - DNA, 22 bp, Homo sapiens
ctggagtcccacccggacaggt

SEQ ID NO: 827557 - DNA, 20 bp, Homo sapiens
ctggagtgaggcttccaggc

SEQ ID NO: 827558 - DNA, 17 bp, Homo sapiens
ctggagtgagggcctca

SEQ ID NO: 827559 - DNA, 18 bp, Homo sapiens
ctggagtgagggcctcag

SEQ ID NO: 827560 - DNA, 13 bp, Homo sapiens
ctggagtgcagtt

SEQ ID NO: 827561 - DNA, 14 bp, Homo sapiens
ctggagtgccctgc

SEQ ID NO: 827562 - DNA, 22 bp, Homo sapiens
ctggagtgccctgcaggcacag

SEQ ID NO: 827563 - DNA, 16 bp, Homo sapiens
ctggagtgctgcttgt

SEQ ID NO: 827564 - DNA, 19 bp, Homo sapiens
ctggagtgctgcttgtgcc

SEQ ID NO: 827565 - DNA, 23 bp, Homo sapiens
ctggagtggccactaagcagagg

SEQ ID NO: 827566 - DNA, 20 bp, Homo sapiens
ctggagtgtcggatcctgtg

SEQ ID NO: 827567 - DNA, 17 bp, Homo sapiens
ctggagtgtgtcagagc

SEQ ID NO: 827568 - DNA, 22 bp, Homo sapiens
ctggagttacattaatgttaat

SEQ ID NO: 827569 - DNA, 19 bp, Homo sapiens
ctggagttcagcagtgatg

SEQ ID NO: 827570 - DNA, 20 bp, Homo sapiens
ctggagttccggcctgggca

SEQ ID NO: 827571 - DNA, 17 bp, Homo sapiens
ctggagttgactgactg

SEQ ID NO: 827572 - DNA, 20 bp, Homo sapiens
ctggagttgactgactgagc

SEQ ID NO: 827573 - DNA, 18 bp, Homo sapiens
ctggagtttcatgtacaa

SEQ ID NO: 827574 - DNA, 22 bp, Homo sapiens
ctggagtttcatgtacaagatg

SEQ ID NO: 827575 - DNA, 18 bp, Homo sapiens
ctggagtttctctaaagt

SEQ ID NO: 827576 - DNA, 16 bp, Homo sapiens
ctggagttttgatttg

SEQ ID NO: 827577 - DNA, 20 bp, Homo sapiens
ctggataaaccaccctctgg

SEQ ID NO: 827578 - DNA, 14 bp, Homo sapiens
ctggataacttagg

SEQ ID NO: 827579 - DNA, 15 bp, Homo sapiens
ctggataacttaggt

SEQ ID NO: 827580 - DNA, 16 bp, Homo sapiens
ctggatactggacaca

SEQ ID NO: 827581 - DNA, 14 bp, Homo sapiens
ctggatagacgagt

SEQ ID NO: 827582 - DNA, 16 bp, Homo sapiens
ctggatagttaagggc

SEQ ID NO: 827583 - DNA, 21 bp, Homo sapiens
ctggatataatgtattttcag

SEQ ID NO: 827584 - DNA, 22 bp, Homo sapiens
ctggatatgtccagtcatcctg

SEQ ID NO: 827585 - DNA, 23 bp, Homo sapiens
ctggatatgtccagtcatcctgc

SEQ ID NO: 827586 - DNA, 17 bp, Homo sapiens
ctggcccttcagtctgc

SEQ ID NO: 827587 - DNA, 19 bp, Homo sapiens
ctggcccttcagtctgctc

SEQ ID NO: 827588 - DNA, 20 bp, Homo sapiens
ctggcccttcagtctgctcc

SEQ ID NO: 827589 - DNA, 21 bp, Homo sapiens
ctggcccttgcttacctctca

SEQ ID NO: 827590 - DNA, 12 bp, Homo sapiens
ctggcccttgga

SEQ ID NO: 827591 - DNA, 15 bp, Homo sapiens
ctggcccttggggag

SEQ ID NO: 827592 - DNA, 17 bp, Homo sapiens
ctggccgagggtcctgg

SEQ ID NO: 827593 - DNA, 20 bp, Homo sapiens
ctggccgagggtcctggctc

SEQ ID NO: 827594 - DNA, 21 bp, Homo sapiens
ctggccgagggtcctggctcc

SEQ ID NO: 827595 - DNA, 23 bp, Homo sapiens
ctggccgagtccaagctgggaga

SEQ ID NO: 827596 - DNA, 13 bp, Homo sapiens
ctggccgcagagg

SEQ ID NO: 827597 - DNA, 12 bp, Homo sapiens
ctggccgccacc

SEQ ID NO: 827598 - DNA, 13 bp, Homo sapiens
ctggccgccaccc

SEQ ID NO: 827599 - DNA, 15 bp, Homo sapiens
ctggccgccaccccc

SEQ ID NO: 827600 - DNA, 18 bp, Homo sapiens
ctggccgccacccccatc

SEQ ID NO: 827601 - DNA, 13 bp, Homo sapiens
ctggccgccccct

SEQ ID NO: 827602 - DNA, 18 bp, Homo sapiens
ctggccgcggagcctgca

SEQ ID NO: 827603 - DNA, 21 bp, Homo sapiens
ctggccgctgagcgcccccga

SEQ ID NO: 827604 - DNA, 21 bp, Homo sapiens
ctggccggagcaaactctgct

SEQ ID NO: 827605 - DNA, 22 bp, Homo sapiens
ctggccggagcaaactctgctg

SEQ ID NO: 827606 - DNA, 16 bp, Homo sapiens
ctggccgggagcctga

SEQ ID NO: 827607 - DNA, 17 bp, Homo sapiens
ctggccggggcccctca

SEQ ID NO: 827608 - DNA, 19 bp, Homo sapiens
ctggccgggtcaccctgtg

SEQ ID NO: 827609 - DNA, 22 bp, Homo sapiens
ctggccgggtcaccctgtgacc

SEQ ID NO: 827610 - DNA, 19 bp, Homo sapiens
ctggcctaatcactctgag

SEQ ID NO: 827611 - DNA, 21 bp, Homo sapiens
ctggcctaatcactctgagtc

SEQ ID NO: 827612 - DNA, 22 bp, Homo sapiens
ctggcctagaccagcagacaga

SEQ ID NO: 827613 - DNA, 23 bp, Homo sapiens
ctggcctagcatacgtacacatt

SEQ ID NO: 827614 - DNA, 22 bp, Homo sapiens
ctggcctcacccacccctgcac

SEQ ID NO: 827615 - DNA, 18 bp, Homo sapiens
ctggcctcactggctggg

SEQ ID NO: 827616 - DNA, 19 bp, Homo sapiens
ctggcctcactggctgggg

SEQ ID NO: 827617 - DNA, 21 bp, Homo sapiens
ctggcctcactggctggggca

SEQ ID NO: 827618 - DNA, 22 bp, Homo sapiens
ctggcctcagttcccagctccc

SEQ ID NO: 827619 - DNA, 23 bp, Homo sapiens
ctggcctcagttcccagctcccc

SEQ ID NO: 827620 - DNA, 21 bp, Homo sapiens
ctggcctccaaaatattaaca

SEQ ID NO: 827621 - DNA, 12 bp, Homo sapiens
ctggcctccagc

SEQ ID NO: 827622 - DNA, 14 bp, Homo sapiens
ctggcctcccacag

SEQ ID NO: 827623 - DNA, 13 bp, Homo sapiens
ctggcctcccacc

SEQ ID NO: 827624 - DNA, 17 bp, Homo sapiens
ctggcctcccacccgat

SEQ ID NO: 827625 - DNA, 13 bp, Homo sapiens
ctggcctccccca

SEQ ID NO: 827626 - DNA, 15 bp, Homo sapiens
ctggcctcccccaac

SEQ ID NO: 827627 - DNA, 22 bp, Homo sapiens
ctggcctcccccaacacctgct

SEQ ID NO: 827628 - DNA, 21 bp, Homo sapiens
ctggcctcccctgccaccagg

SEQ ID NO: 827629 - DNA, 18 bp, Homo sapiens
ctggcctccgatgcctgg

SEQ ID NO: 827630 - DNA, 20 bp, Homo sapiens
ctggcctccgatgcctggcc

SEQ ID NO: 827631 - DNA, 16 bp, Homo sapiens
ctggcctctctagcac

SEQ ID NO: 827632 - DNA, 18 bp, Homo sapiens
ctggcctctgcttacttt

SEQ ID NO: 827633 - DNA, 14 bp, Homo sapiens
ctggcctctgcttt

SEQ ID NO: 827634 - DNA, 15 bp, Homo sapiens
ctggcctctgctttc

SEQ ID NO: 827635 - DNA, 17 bp, Homo sapiens
ctggcctctggctctca

SEQ ID NO: 827636 - DNA, 11 bp, Homo sapiens
ctggcctctgt

SEQ ID NO: 827637 - DNA, 13 bp, Homo sapiens
ctggcctctgtga

SEQ ID NO: 827638 - DNA, 15 bp, Homo sapiens
ctggcctctgtgatt

SEQ ID NO: 827639 - DNA, 24 bp, Homo sapiens
ctggcctctgtgattacatagatc

SEQ ID NO: 827640 - DNA, 14 bp, Homo sapiens
ctggcctctgtgcc

SEQ ID NO: 827641 - DNA, 19 bp, Homo sapiens
ctggcctcttctgggctac

SEQ ID NO: 827642 - DNA, 21 bp, Homo sapiens
ctggcctgaactgaggagatg

SEQ ID NO: 827643 - DNA, 21 bp, Homo sapiens
ctggcctgactggttgtcaga

SEQ ID NO: 827644 - DNA, 19 bp, Homo sapiens
ctggcctgagagtcagctc

SEQ ID NO: 827645 - DNA, 23 bp, Homo sapiens
ctggcctgagagtcagctctctg

SEQ ID NO: 827646 - DNA, 13 bp, Homo sapiens
ctggcctgagcaa

SEQ ID NO: 827647 - DNA, 14 bp, Homo sapiens
ctggcctgagctgg

SEQ ID NO: 827648 - DNA, 19 bp, Homo sapiens
ctggcctgctgggctctcc

SEQ ID NO: 827649 - DNA, 21 bp, Homo sapiens
ctggcctggaccattcctgtc

SEQ ID NO: 827650 - DNA, 14 bp, Homo sapiens
ctggcctggactgt

SEQ ID NO: 827651 - DNA, 14 bp, Homo sapiens
ctggcctggaggct

SEQ ID NO: 827652 - DNA, 14 bp, Homo sapiens
ctggcctggatctc

SEQ ID NO: 827653 - DNA, 19 bp, Homo sapiens
ctggcctggccatactgtg

SEQ ID NO: 827654 - DNA, 14 bp, Homo sapiens
ctggcctggccggc

SEQ ID NO: 827655 - DNA, 15 bp, Homo sapiens
ctggcctggccggca

SEQ ID NO: 827656 - DNA, 12 bp, Homo sapiens
ctggcctggctc

SEQ ID NO: 827657 - DNA, 17 bp, Homo sapiens
ctggcctggctccccac

SEQ ID NO: 827658 - DNA, 19 bp, Homo sapiens
ctggcctggctccccacga

SEQ ID NO: 827659 - DNA, 13 bp, Homo sapiens
ctggcctggctgg

SEQ ID NO: 827660 - DNA, 16 bp, Homo sapiens
ctggcctgggccacac

SEQ ID NO: 827661 - DNA, 17 bp, Homo sapiens
ctggcctgggccacacc

SEQ ID NO: 827662 - DNA, 20 bp, Homo sapiens
ctggcctggggtccctctga

SEQ ID NO: 827663 - DNA, 21 bp, Homo sapiens
ctggccttaaaaggggcccaa

SEQ ID NO: 827664 - DNA, 23 bp, Homo sapiens
ctggccttgcccgtcgtgtgctg

SEQ ID NO: 827665 - DNA, 18 bp, Homo sapiens
ctggccttggtatgtgcc

SEQ ID NO: 827666 - DNA, 22 bp, Homo sapiens
ctggccttggtatgtgccaggc

SEQ ID NO: 827667 - DNA, 13 bp, Homo sapiens
ctggccttttcct

SEQ ID NO: 827668 - DNA, 17 bp, Homo sapiens
ctggcctttttcattta

SEQ ID NO: 827669 - DNA, 19 bp, Homo sapiens
ctggcctttttcatttatc

SEQ ID NO: 827670 - DNA, 20 bp, Homo sapiens
ctggcctttttcatttatct

SEQ ID NO: 827671 - DNA, 15 bp, Homo sapiens
ctggcgacactcagg

SEQ ID NO: 827672 - DNA, 17 bp, Homo sapiens
ctggcgacactcagggc

SEQ ID NO: 827673 - DNA, 19 bp, Homo sapiens
ctggcgacactcagggcag

SEQ ID NO: 827674 - DNA, 16 bp, Homo sapiens
ctggcgcagccaaggc

SEQ ID NO: 827675 - DNA, 13 bp, Homo sapiens
ctggcgcaggtgg

SEQ ID NO: 827676 - DNA, 17 bp, Homo sapiens
ctggcgcccctgcctgt

SEQ ID NO: 827677 - DNA, 17 bp, Homo sapiens
ctggcgcttggatctgg

SEQ ID NO: 827678 - DNA, 12 bp, Homo sapiens
ctggcggcccca

SEQ ID NO: 827679 - DNA, 16 bp, Homo sapiens
ctggcggcctgtgggt

SEQ ID NO: 827680 - DNA, 20 bp, Homo sapiens
ctggcggctactcagcagcc

SEQ ID NO: 827681 - DNA, 15 bp, Homo sapiens
ctggcggcttcctgt

SEQ ID NO: 827682 - DNA, 18 bp, Homo sapiens
ctggcggcttcctgtcca

SEQ ID NO: 827683 - DNA, 20 bp, Homo sapiens
ctggcggcttcctgtccact

SEQ ID NO: 827684 - DNA, 17 bp, Homo sapiens
ctggcggggttggccct

SEQ ID NO: 827685 - DNA, 13 bp, Homo sapiens
ctggcggtggcca

SEQ ID NO: 827686 - DNA, 16 bp, Homo sapiens
ctggcgtcggccagag

SEQ ID NO: 827687 - DNA, 13 bp, Homo sapiens
ctggcgtgtgggt

SEQ ID NO: 827688 - DNA, 20 bp, Homo sapiens
ctggctaaagataattgcta

SEQ ID NO: 827689 - DNA, 16 bp, Homo sapiens
ctggctaacagtctag

SEQ ID NO: 827690 - DNA, 21 bp, Homo sapiens
ctggctaacagtctagtgcaa

SEQ ID NO: 827691 - DNA, 17 bp, Homo sapiens
ctggctagagtcctcac

SEQ ID NO: 827692 - DNA, 18 bp, Homo sapiens
ctggctagagtcctcact

SEQ ID NO: 827693 - DNA, 19 bp, Homo sapiens
ctggctagagtcctcactc

SEQ ID NO: 827694 - DNA, 15 bp, Homo sapiens
ctggctagcattcct

SEQ ID NO: 827695 - DNA, 15 bp, Homo sapiens
ctggctagtgtggaa

SEQ ID NO: 827696 - DNA, 19 bp, Homo sapiens
ctggctatagatgtctttt

SEQ ID NO: 827697 - DNA, 23 bp, Homo sapiens
ctggctatagatgtcttttccca

SEQ ID NO: 827698 - DNA, 19 bp, Homo sapiens
ctggctatctactaccaga

SEQ ID NO: 827699 - DNA, 23 bp, Homo sapiens
ctggctatctactaccagaaggg

SEQ ID NO: 827700 - DNA, 22 bp, Homo sapiens
ctggctatgcatttgaaaattt

SEQ ID NO: 827701 - DNA, 19 bp, Homo sapiens
ctggctcacgccccgctgt

SEQ ID NO: 827702 - DNA, 20 bp, Homo sapiens
ctggctcacgccccgctgtg

SEQ ID NO: 827703 - DNA, 22 bp, Homo sapiens
ctggctcacgccccgctgtgtc

SEQ ID NO: 827704 - DNA, 22 bp, Homo sapiens
ctggctcacgcgttctgggagc

SEQ ID NO: 827705 - DNA, 20 bp, Homo sapiens
ctggctccagatgcagggca

SEQ ID NO: 827706 - DNA, 13 bp, Homo sapiens
ctggctccagctg

SEQ ID NO: 827707 - DNA, 13 bp, Homo sapiens
ctgggaacaggcc

SEQ ID NO: 827708 - DNA, 18 bp, Homo sapiens
ctgggaaccactcccacc

SEQ ID NO: 827709 - DNA, 18 bp, Homo sapiens
ctgggaacctagcacacc

SEQ ID NO: 827710 - DNA, 13 bp, Homo sapiens
ctgggaacctccc

SEQ ID NO: 827711 - DNA, 19 bp, Homo sapiens
ctgggaagaagcaagggca

SEQ ID NO: 827712 - DNA, 22 bp, Homo sapiens
ctgggaagagaagagggcccag

SEQ ID NO: 827713 - DNA, 23 bp, Homo sapiens
ctgggaagagaagagggcccagc

SEQ ID NO: 827714 - DNA, 14 bp, Homo sapiens
ctgggaagagctcc

SEQ ID NO: 827715 - DNA, 17 bp, Homo sapiens
ctgggaagataggctct

SEQ ID NO: 827716 - DNA, 21 bp, Homo sapiens
ctgggaagataggctctgcac

SEQ ID NO: 827717 - DNA, 22 bp, Homo sapiens
ctgggaagataggctctgcaca

SEQ ID NO: 827718 - DNA, 14 bp, Homo sapiens
ctgggaagcccacc

SEQ ID NO: 827719 - DNA, 16 bp, Homo sapiens
ctgggaagcccaccca

SEQ ID NO: 827720 - DNA, 17 bp, Homo sapiens
ctgggaagcccacccag

SEQ ID NO: 827721 - DNA, 21 bp, Homo sapiens
ctgggaagctcccaccccact

SEQ ID NO: 827722 - DNA, 19 bp, Homo sapiens
ctgggaagctgtactcaga

SEQ ID NO: 827723 - DNA, 22 bp, Homo sapiens
ctgggaagctgtactcagagca

SEQ ID NO: 827724 - DNA, 23 bp, Homo sapiens
ctgggaagctgtactcagagcag

SEQ ID NO: 827725 - DNA, 13 bp, Homo sapiens
ctgggaaggaaac

SEQ ID NO: 827726 - DNA, 22 bp, Homo sapiens
ctgggaaggaaacaaatgtgta

SEQ ID NO: 827727 - DNA, 13 bp, Homo sapiens
ctgggaaggagga

SEQ ID NO: 827728 - DNA, 14 bp, Homo sapiens
ctgggaaggctaag

SEQ ID NO: 827729 - DNA, 13 bp, Homo sapiens
ctgggaagggaag

SEQ ID NO: 827730 - DNA, 14 bp, Homo sapiens
ctgggaagggagag

SEQ ID NO: 827731 - DNA, 23 bp, Homo sapiens
ctgggaatggggacacggtgtcc

SEQ ID NO: 827732 - DNA, 13 bp, Homo sapiens
ctgggaatgtatt

SEQ ID NO: 827733 - DNA, 19 bp, Homo sapiens
ctgggaatgtattattctg

SEQ ID NO: 827734 - DNA, 16 bp, Homo sapiens
ctgggacacaaaactc

SEQ ID NO: 827735 - DNA, 14 bp, Homo sapiens
ctgggacacacaca

SEQ ID NO: 827736 - DNA, 19 bp, Homo sapiens
ctgggacatcaggagactg

SEQ ID NO: 827737 - DNA, 20 bp, Homo sapiens
ctgggacatcaggagactgg

SEQ ID NO: 827738 - DNA, 23 bp, Homo sapiens
ctgggacccagctactctgtcca

SEQ ID NO: 827739 - DNA, 21 bp, Homo sapiens
ctgggaccccctcgccagctt

SEQ ID NO: 827740 - DNA, 23 bp, Homo sapiens
ctgggaccccctcgccagcttgg

SEQ ID NO: 827741 - DNA, 18 bp, Homo sapiens
ctgggacccctcccaacc

SEQ ID NO: 827742 - DNA, 23 bp, Homo sapiens
ctgggacccctcccaacctcaat

SEQ ID NO: 827743 - DNA, 13 bp, Homo sapiens
ctgggacccttgg

SEQ ID NO: 827744 - DNA, 23 bp, Homo sapiens
ctgggacccttgttggggagtgg

SEQ ID NO: 827745 - DNA, 20 bp, Homo sapiens
ctgggaccctttccttcctt

SEQ ID NO: 827746 - DNA, 23 bp, Homo sapiens
ctgggaccctttccttccttccc

SEQ ID NO: 827747 - DNA, 21 bp, Homo sapiens
ctgggacctaatgctggcctg

SEQ ID NO: 827748 - DNA, 16 bp, Homo sapiens
ctgggacctcccctga

SEQ ID NO: 827749 - DNA, 17 bp, Homo sapiens
ctgggacctgccaggca

SEQ ID NO: 827750 - DNA, 15 bp, Homo sapiens
ctgggactcagcctt

SEQ ID NO: 827751 - DNA, 16 bp, Homo sapiens
ctgggactcccagcag

SEQ ID NO: 827752 - DNA, 21 bp, Homo sapiens
ctgggactcccagcagagccc

SEQ ID NO: 827753 - DNA, 22 bp, Homo sapiens
ctgggactcccagcagagccca

SEQ ID NO: 827754 - DNA, 14 bp, Homo sapiens
ctgggactgagcca

SEQ ID NO: 827755 - DNA, 20 bp, Homo sapiens
ctgggactgagccagtccca

SEQ ID NO: 827756 - DNA, 17 bp, Homo sapiens
ctgggacttccatgcct

SEQ ID NO: 827757 - DNA, 20 bp, Homo sapiens
ctgggacttccttgctctcc

SEQ ID NO: 827758 - DNA, 21 bp, Homo sapiens
ctgggacttccttgctctccc

SEQ ID NO: 827759 - DNA, 16 bp, Homo sapiens
ctgggacttcttaccc

SEQ ID NO: 827760 - DNA, 18 bp, Homo sapiens
ctgggagaaattgacaga

SEQ ID NO: 827761 - DNA, 14 bp, Homo sapiens
ctgggagagccagc

SEQ ID NO: 827762 - DNA, 13 bp, Homo sapiens
ctgggagagcctg

SEQ ID NO: 827763 - DNA, 15 bp, Homo sapiens
ctgggagagcctggc

SEQ ID NO: 827764 - DNA, 21 bp, Homo sapiens
ctgggagagcctggcaaggca

SEQ ID NO: 827765 - DNA, 19 bp, Homo sapiens
ctgggagaggtgccagcaa

SEQ ID NO: 827766 - DNA, 15 bp, Homo sapiens
ctgggagcagaacag

SEQ ID NO: 827767 - DNA, 18 bp, Homo sapiens
ctgggagccacttctccc

SEQ ID NO: 827768 - DNA, 19 bp, Homo sapiens
ctgggagccacttctcccc

SEQ ID NO: 827769 - DNA, 20 bp, Homo sapiens
ctgggagccacttctcccca

SEQ ID NO: 827770 - DNA, 22 bp, Homo sapiens
ctgggagccacttctccccaga

SEQ ID NO: 827771 - DNA, 14 bp, Homo sapiens
ctgggagccagtcc

SEQ ID NO: 827772 - DNA, 15 bp, Homo sapiens
ctgggagccagtcct

SEQ ID NO: 827773 - DNA, 20 bp, Homo sapiens
ctgggagccagtgtgcccaa

SEQ ID NO: 827774 - DNA, 13 bp, Homo sapiens
ctgggagcccaga

SEQ ID NO: 827775 - DNA, 22 bp, Homo sapiens
ctgggagcccccaccacaaact

SEQ ID NO: 827776 - DNA, 15 bp, Homo sapiens
ctgggagcctcgccc

SEQ ID NO: 827777 - DNA, 17 bp, Homo sapiens
ctgggagcctctcctgt

SEQ ID NO: 827778 - DNA, 22 bp, Homo sapiens
ctgggagcctggttcagacaca

SEQ ID NO: 827779 - DNA, 16 bp, Homo sapiens
ctgggagctccactct

SEQ ID NO: 827780 - DNA, 23 bp, Homo sapiens
ctgggagctccactctgcttctc

SEQ ID NO: 827781 - DNA, 22 bp, Homo sapiens
ctgggagctgcgccggacagag

SEQ ID NO: 827782 - DNA, 13 bp, Homo sapiens
ctgggaggaaaag

SEQ ID NO: 827783 - DNA, 22 bp, Homo sapiens
ctgggaggaaggacttccctgt

SEQ ID NO: 827784 - DNA, 14 bp, Homo sapiens
ctgggaggacaggc

SEQ ID NO: 827785 - DNA, 15 bp, Homo sapiens
ctgggaggacaggca

SEQ ID NO: 827786 - DNA, 17 bp, Homo sapiens
ctgggaggacaggcagg

SEQ ID NO: 827787 - DNA, 16 bp, Homo sapiens
ctgggaggagggagag

SEQ ID NO: 827788 - DNA, 23 bp, Homo sapiens
ctgggaggagggagagggaggtc

SEQ ID NO: 827789 - DNA, 22 bp, Homo sapiens
ctgggaggatcctgagctgctg

SEQ ID NO: 827790 - DNA, 18 bp, Homo sapiens
ctgggaggcaagaaaagg

SEQ ID NO: 827791 - DNA, 21 bp, Homo sapiens
ctgggaggcaagaggggtgga

SEQ ID NO: 827792 - DNA, 22 bp, Homo sapiens
ctgggaggcaagaggggtggag

SEQ ID NO: 827793 - DNA, 15 bp, Homo sapiens
ctgggaggcagaggt

SEQ ID NO: 827794 - DNA, 22 bp, Homo sapiens
ctgggaggcagaggttgcagtg

SEQ ID NO: 827795 - DNA, 12 bp, Homo sapiens
ctgggagggaag

SEQ ID NO: 827796 - DNA, 15 bp, Homo sapiens
ctgggagggcagcag

SEQ ID NO: 827797 - DNA, 17 bp, Homo sapiens
ctgggagggcagcaggg

SEQ ID NO: 827798 - DNA, 22 bp, Homo sapiens
ctgggagggcagcagggctacc

SEQ ID NO: 827799 - DNA, 12 bp, Homo sapiens
ctgggagggggt

SEQ ID NO: 827800 - DNA, 22 bp, Homo sapiens
ctgggagggggtgagaggcagg

SEQ ID NO: 827801 - DNA, 22 bp, Homo sapiens
ctgggaggggttttcgaagctc

SEQ ID NO: 827802 - DNA, 20 bp, Homo sapiens
ctgggagggttcccctggcc

SEQ ID NO: 827803 - DNA, 21 bp, Homo sapiens
ctgggagggttcccctggcct

SEQ ID NO: 827804 - DNA, 12 bp, Homo sapiens
ctgggaggtaga

SEQ ID NO: 827805 - DNA, 15 bp, Homo sapiens
ctgggaggtagaagg

SEQ ID NO: 827806 - DNA, 18 bp, Homo sapiens
ctgggaggtcaaggctgc

SEQ ID NO: 827807 - DNA, 16 bp, Homo sapiens
ctgggaggttgggagg

SEQ ID NO: 827808 - DNA, 18 bp, Homo sapiens
ctgggaggttgggaggct

SEQ ID NO: 827809 - DNA, 14 bp, Homo sapiens
ctgggagtcacaca

SEQ ID NO: 827810 - DNA, 16 bp, Homo sapiens
ctgggagtcacacagt

SEQ ID NO: 827811 - DNA, 17 bp, Homo sapiens
ctgggagtcagagccct

SEQ ID NO: 827812 - DNA, 23 bp, Homo sapiens
ctgggagttgatcgcctttccca

SEQ ID NO: 827813 - DNA, 22 bp, Homo sapiens
ctgggatatatggaggattctt

SEQ ID NO: 827814 - DNA, 15 bp, Homo sapiens
ctgggatatggctgc

SEQ ID NO: 827815 - DNA, 19 bp, Homo sapiens
ctgggatatggctgcccag

SEQ ID NO: 827816 - DNA, 21 bp, Homo sapiens
ctgggatatggctgcccagga

SEQ ID NO: 827817 - DNA, 15 bp, Homo sapiens
ctgggatccagtgta

SEQ ID NO: 827818 - DNA, 16 bp, Homo sapiens
ctgggatccagtgtat

SEQ ID NO: 827819 - DNA, 22 bp, Homo sapiens
ctgggatccagtgtataaatcc

SEQ ID NO: 827820 - DNA, 17 bp, Homo sapiens
ctgggatcgtgcatttg

SEQ ID NO: 827821 - DNA, 21 bp, Homo sapiens
ctgggatctggcacactccct

SEQ ID NO: 827822 - DNA, 21 bp, Homo sapiens
ctgggatgacaggtgtgagcc

SEQ ID NO: 827823 - DNA, 24 bp, Homo sapiens
ctgggatgacaggtgtgagccact

SEQ ID NO: 827824 - DNA, 15 bp, Homo sapiens
ctgggatgaggggtg

SEQ ID NO: 827825 - DNA, 14 bp, Homo sapiens
ctgggatgcagtga

SEQ ID NO: 827826 - DNA, 17 bp, Homo sapiens
ctgggatgctgacccag

SEQ ID NO: 827827 - DNA, 18 bp, Homo sapiens
ctgggatgctgacccagg

SEQ ID NO: 827828 - DNA, 14 bp, Homo sapiens
ctggggagctcctg

SEQ ID NO: 827829 - DNA, 22 bp, Homo sapiens
ctggggagctcctgggaccctt

SEQ ID NO: 827830 - DNA, 21 bp, Homo sapiens
ctggggaggaccagggccctg

SEQ ID NO: 827831 - DNA, 18 bp, Homo sapiens
ctggggaggaggagagag

SEQ ID NO: 827832 - DNA, 22 bp, Homo sapiens
ctggggaggccctaggggagca

SEQ ID NO: 827833 - DNA, 17 bp, Homo sapiens
ctggggagggctgcagt

SEQ ID NO: 827834 - DNA, 13 bp, Homo sapiens
ctggggagggggt

SEQ ID NO: 827835 - DNA, 17 bp, Homo sapiens
ctggggaggtgggaggc

SEQ ID NO: 827836 - DNA, 17 bp, Homo sapiens
ctggggagtgggacaga

SEQ ID NO: 827837 - DNA, 20 bp, Homo sapiens
ctggggatcttcccacagga

SEQ ID NO: 827838 - DNA, 22 bp, Homo sapiens
ctggggatggtggcacaggcac

SEQ ID NO: 827839 - DNA, 16 bp, Homo sapiens
ctggggatttctggga

SEQ ID NO: 827840 - DNA, 21 bp, Homo sapiens
ctggggcaagtccctgactct

SEQ ID NO: 827841 - DNA, 19 bp, Homo sapiens
ctggggcacagtccaggaa

SEQ ID NO: 827842 - DNA, 12 bp, Homo sapiens
ctggggcacggc

SEQ ID NO: 827843 - DNA, 14 bp, Homo sapiens
ctggggcagagaag

SEQ ID NO: 827844 - DNA, 17 bp, Homo sapiens
ctggggcagaggggcag

SEQ ID NO: 827845 - DNA, 14 bp, Homo sapiens
ctggggcaggctgg

SEQ ID NO: 827846 - DNA, 21 bp, Homo sapiens
ctggggcaggctgggccatgt

SEQ ID NO: 827847 - DNA, 14 bp, Homo sapiens
ctggggcaggggcc

SEQ ID NO: 827848 - DNA, 15 bp, Homo sapiens
ctggggcaggggcct

SEQ ID NO: 827849 - DNA, 19 bp, Homo sapiens
ctggggcaggggcctgggc

SEQ ID NO: 827850 - DNA, 14 bp, Homo sapiens
ctggggcatggcag

SEQ ID NO: 827851 - DNA, 17 bp, Homo sapiens
ctggggcatgtgtgcct

SEQ ID NO: 827852 - DNA, 20 bp, Homo sapiens
ctggggcatgtgtgcctgtg

SEQ ID NO: 827853 - DNA, 21 bp, Homo sapiens
ctggggcatgtgtgcctgtgg

SEQ ID NO: 827854 - DNA, 23 bp, Homo sapiens
ctggggcatgtgtgcctgtggca

SEQ ID NO: 827855 - DNA, 22 bp, Homo sapiens
ctggggccacaaatcaaagcaa

SEQ ID NO: 827856 - DNA, 13 bp, Homo sapiens
ctggggcccaagt

SEQ ID NO: 827857 - DNA, 13 bp, Homo sapiens
ctggggccccatc

SEQ ID NO: 827858 - DNA, 12 bp, Homo sapiens
ctggggcccctt

SEQ ID NO: 827859 - DNA, 20 bp, Homo sapiens
ctggggccctgggcctcagt

SEQ ID NO: 827860 - DNA, 12 bp, Homo sapiens
ctggggccgcct

SEQ ID NO: 827861 - DNA, 14 bp, Homo sapiens
ctggggccgcctgc

SEQ ID NO: 827862 - DNA, 13 bp, Homo sapiens
ctggggcctcaga

SEQ ID NO: 827863 - DNA, 12 bp, Homo sapiens
ctggggcctcca

SEQ ID NO: 827864 - DNA, 21 bp, Homo sapiens
ctggggcctccagaagctgct

SEQ ID NO: 827865 - DNA, 23 bp, Homo sapiens
ctggggcctccagaagctgctcc

SEQ ID NO: 827866 - DNA, 20 bp, Homo sapiens
ctggggcctcggagcctcat

SEQ ID NO: 827867 - DNA, 23 bp, Homo sapiens
ctggggcctcggagcctcatccg

SEQ ID NO: 827868 - DNA, 12 bp, Homo sapiens
ctggggcctgag

SEQ ID NO: 827869 - DNA, 14 bp, Homo sapiens
ctggggcctgagag

SEQ ID NO: 827870 - DNA, 16 bp, Homo sapiens
ctggggcctggacctg

SEQ ID NO: 827871 - DNA, 13 bp, Homo sapiens
ctggggcgggcag

SEQ ID NO: 827872 - DNA, 17 bp, Homo sapiens
ctggggcgggcagccag

SEQ ID NO: 827873 - DNA, 12 bp, Homo sapiens
ctggggctccct

SEQ ID NO: 827874 - DNA, 13 bp, Homo sapiens
ctggggctccctc

SEQ ID NO: 827875 - DNA, 18 bp, Homo sapiens
ctggggctctctgacccg

SEQ ID NO: 827876 - DNA, 15 bp, Homo sapiens
ctggggctgccagcc

SEQ ID NO: 827877 - DNA, 18 bp, Homo sapiens
ctggggctgccagcctga

SEQ ID NO: 827878 - DNA, 16 bp, Homo sapiens
ctggggctgctcccct

SEQ ID NO: 827879 - DNA, 15 bp, Homo sapiens
ctggggctggcctcc

SEQ ID NO: 827880 - DNA, 23 bp, Homo sapiens
ctggggctggggtgagagaggaa

SEQ ID NO: 827881 - DNA, 14 bp, Homo sapiens
ctggggctgtgtta

SEQ ID NO: 827882 - DNA, 18 bp, Homo sapiens
ctggggcttatgggtggc

SEQ ID NO: 827883 - DNA, 20 bp, Homo sapiens
ctggggcttcaccagtctgt

SEQ ID NO: 827884 - DNA, 22 bp, Homo sapiens
ctggggcttcaccagtctgtct

SEQ ID NO: 827885 - DNA, 16 bp, Homo sapiens
ctggggcttctcctga

SEQ ID NO: 827886 - DNA, 19 bp, Homo sapiens
ctggggcttctcctgaccc

SEQ ID NO: 827887 - DNA, 21 bp, Homo sapiens
ctggggcttgtcctgtgcttg

SEQ ID NO: 827888 - DNA, 16 bp, Homo sapiens
ctgggggaagccctgg

SEQ ID NO: 827889 - DNA, 20 bp, Homo sapiens
ctgggggacccaatgtagga

SEQ ID NO: 827890 - DNA, 23 bp, Homo sapiens
ctgggggacccctggctctgggc

SEQ ID NO: 827891 - DNA, 12 bp, Homo sapiens
ctgggggagaga

SEQ ID NO: 827892 - DNA, 19 bp, Homo sapiens
ctgggggagagaggcagca

SEQ ID NO: 827893 - DNA, 14 bp, Homo sapiens
ctgggggaggcagg

SEQ ID NO: 827894 - DNA, 15 bp, Homo sapiens
ctgggggaggcaggg

SEQ ID NO: 827895 - DNA, 16 bp, Homo sapiens
ctgggggaggcagggc

SEQ ID NO: 827896 - DNA, 19 bp, Homo sapiens
ctgggggaggcagggctgg

SEQ ID NO: 827897 - DNA, 19 bp, Homo sapiens
ctgggggaggtccaagcag

SEQ ID NO: 827898 - DNA, 18 bp, Homo sapiens
ctgggggcaaaggtttga

SEQ ID NO: 827899 - DNA, 14 bp, Homo sapiens
ctgggggcacagct

SEQ ID NO: 827900 - DNA, 12 bp, Homo sapiens
ctgggggcagct

SEQ ID NO: 827901 - DNA, 14 bp, Homo sapiens
ctgggggcagctgt

SEQ ID NO: 827902 - DNA, 12 bp, Homo sapiens
ctgggggcagga

SEQ ID NO: 827903 - DNA, 19 bp, Homo sapiens
ctgggggccagggctggat

SEQ ID NO: 827904 - DNA, 18 bp, Homo sapiens
ctgggggccatgagctcc

SEQ ID NO: 827905 - DNA, 22 bp, Homo sapiens
ctgggggccatgagctccagac

SEQ ID NO: 827906 - DNA, 20 bp, Homo sapiens
ctgggggctgccgagccacc

SEQ ID NO: 827907 - DNA, 13 bp, Homo sapiens
ctgggggctggct

SEQ ID NO: 827908 - DNA, 14 bp, Homo sapiens
ctgggggctggctc

SEQ ID NO: 827909 - DNA, 15 bp, Homo sapiens
ctgggggctggctcc

SEQ ID NO: 827910 - DNA, 14 bp, Homo sapiens
ctggggggaacgga

SEQ ID NO: 827911 - DNA, 21 bp, Homo sapiens
ctggggggagggacagggcag

SEQ ID NO: 827912 - DNA, 23 bp, Homo sapiens
ctggggggagggacagggcaggc

SEQ ID NO: 827913 - DNA, 19 bp, Homo sapiens
ctgggggtagccccgcccc

SEQ ID NO: 827914 - DNA, 23 bp, Homo sapiens
ctgggggttctttcttcctctgc

SEQ ID NO: 827915 - DNA, 12 bp, Homo sapiens
ctggggtacagg

SEQ ID NO: 827916 - DNA, 21 bp, Homo sapiens
ctggggtatgtgtgtgtgggt

SEQ ID NO: 827917 - DNA, 22 bp, Homo sapiens
ctggggtcaggtgccactgacc

SEQ ID NO: 827918 - DNA, 15 bp, Homo sapiens
ctggggtccctctga

SEQ ID NO: 827919 - DNA, 15 bp, Homo sapiens
ctggggtcctggggc

SEQ ID NO: 827920 - DNA, 18 bp, Homo sapiens
ctggggtcctggggcctc

SEQ ID NO: 827921 - DNA, 19 bp, Homo sapiens
ctggggtcctggggcctcg

SEQ ID NO: 827922 - DNA, 14 bp, Homo sapiens
ctggggtctgagca

SEQ ID NO: 827923 - DNA, 18 bp, Homo sapiens
ctggggtctgagcatgat

SEQ ID NO: 827924 - DNA, 16 bp, Homo sapiens
ctggggtctgggcagt

SEQ ID NO: 827925 - DNA, 18 bp, Homo sapiens
ctggggtctgggcagtgc

SEQ ID NO: 827926 - DNA, 13 bp, Homo sapiens
ctggggtgaatac

SEQ ID NO: 827927 - DNA, 19 bp, Homo sapiens
ctggggtgagagaggaaag

SEQ ID NO: 827928 - DNA, 17 bp, Homo sapiens
ctggggtgcatcctcct

SEQ ID NO: 827929 - DNA, 16 bp, Homo sapiens
ctggggtgggacaggg

SEQ ID NO: 827930 - DNA, 18 bp, Homo sapiens
ctggggtgggacagggag

SEQ ID NO: 827931 - DNA, 19 bp, Homo sapiens
ctggggtgggacagggagg

SEQ ID NO: 827932 - DNA, 23 bp, Homo sapiens
ctggggtgggagtaacagggcag

SEQ ID NO: 827933 - DNA, 18 bp, Homo sapiens
ctggggtgggatctgagc

SEQ ID NO: 827934 - DNA, 16 bp, Homo sapiens
ctggggtgggcagttt

SEQ ID NO: 827935 - DNA, 18 bp, Homo sapiens
ctggggtgggcagttttt

SEQ ID NO: 827936 - DNA, 20 bp, Homo sapiens
ctggggtggggatagggagc

SEQ ID NO: 827937 - DNA, 13 bp, Homo sapiens
ctggggtggggtc

SEQ ID NO: 827938 - DNA, 20 bp, Homo sapiens
ctggggtggggtcatgccct

SEQ ID NO: 827939 - DNA, 16 bp, Homo sapiens
ctggggttctctacag

SEQ ID NO: 827940 - DNA, 19 bp, Homo sapiens
ctggggtttactgaggtga

SEQ ID NO: 827941 - DNA, 17 bp, Homo sapiens
ctgggtaagagcacagg

SEQ ID NO: 827942 - DNA, 16 bp, Homo sapiens
ctgggtaataaaagtg

SEQ ID NO: 827943 - DNA, 18 bp, Homo sapiens
ctgggtaatgaaacaaag

SEQ ID NO: 827944 - DNA, 15 bp, Homo sapiens
ctgggtaatgtgaag

SEQ ID NO: 827945 - DNA, 16 bp, Homo sapiens
ctgggtagtcccctgt

SEQ ID NO: 827946 - DNA, 19 bp, Homo sapiens
ctgggtataagcagagagg

SEQ ID NO: 827947 - DNA, 17 bp, Homo sapiens
ctgggtatgctctgtga

SEQ ID NO: 827948 - DNA, 14 bp, Homo sapiens
ctgggtcaaaagag

SEQ ID NO: 827949 - DNA, 16 bp, Homo sapiens
ctgggtcaaaagagcc

SEQ ID NO: 827950 - DNA, 18 bp, Homo sapiens
ctgggtcaaaagagccct

SEQ ID NO: 827951 - DNA, 22 bp, Homo sapiens
ctgggtcaaaagagccctggct

SEQ ID NO: 827952 - DNA, 18 bp, Homo sapiens
ctgggtcatgcactgagg

SEQ ID NO: 827953 - DNA, 16 bp, Homo sapiens
ctgggtcccagcctgg

SEQ ID NO: 827954 - DNA, 22 bp, Homo sapiens
ctgggtcccggggtgcatttgt

SEQ ID NO: 827955 - DNA, 20 bp, Homo sapiens
ctgggtccctcggagctgcc

SEQ ID NO: 827956 - DNA, 13 bp, Homo sapiens
ctgggtccctgct

SEQ ID NO: 827957 - DNA, 14 bp, Homo sapiens
ctgggtccctgctc

SEQ ID NO: 827958 - DNA, 17 bp, Homo sapiens
ctgggtccctgctcccc

SEQ ID NO: 827959 - DNA, 22 bp, Homo sapiens
ctgggtccctgctcccctttgg

SEQ ID NO: 827960 - DNA, 18 bp, Homo sapiens
ctgggtccttgcacccct

SEQ ID NO: 827961 - DNA, 18 bp, Homo sapiens
ctgggtccttggctcccg

SEQ ID NO: 827962 - DNA, 19 bp, Homo sapiens
ctgggtccttttcagaagt

SEQ ID NO: 827963 - DNA, 19 bp, Homo sapiens
ctgggtctcaccggctctc

SEQ ID NO: 827964 - DNA, 23 bp, Homo sapiens
ctgggtctccctttccatggcaa

SEQ ID NO: 827965 - DNA, 17 bp, Homo sapiens
ctgggtctgattttctc

SEQ ID NO: 827966 - DNA, 14 bp, Homo sapiens
ctgggtctgggttt

SEQ ID NO: 827967 - DNA, 23 bp, Homo sapiens
ctgggtgacagagcaagactctg

SEQ ID NO: 827968 - DNA, 14 bp, Homo sapiens
ctgggtgacatttg

SEQ ID NO: 827969 - DNA, 22 bp, Homo sapiens
ctgggtgaccgactaccccagt

SEQ ID NO: 827970 - DNA, 24 bp, Homo sapiens
ctgggtgagaatcctgcctctccc

SEQ ID NO: 827971 - DNA, 14 bp, Homo sapiens
ctgggtgcagctgg

SEQ ID NO: 827972 - DNA, 20 bp, Homo sapiens
ctgggtgcatgatcttgagc

SEQ ID NO: 827973 - DNA, 14 bp, Homo sapiens
ctgggtgccctctc

SEQ ID NO: 827974 - DNA, 14 bp, Homo sapiens
ctgggtgccctgaa

SEQ ID NO: 827975 - DNA, 16 bp, Homo sapiens
ctgggtgccctgaaag

SEQ ID NO: 827976 - DNA, 13 bp, Homo sapiens
ctgggtgcgagtg

SEQ ID NO: 827977 - DNA, 18 bp, Homo sapiens
ctgggtggcaccagcagc

SEQ ID NO: 827978 - DNA, 22 bp, Homo sapiens
ctgggtggcaccagcagcctgg

SEQ ID NO: 827979 - DNA, 22 bp, Homo sapiens
ctgggtggccatcctacccagc

SEQ ID NO: 827980 - DNA, 13 bp, Homo sapiens
ctgggtggcctcg

SEQ ID NO: 827981 - DNA, 23 bp, Homo sapiens
ctgggtggcctcgggacacctgc

SEQ ID NO: 827982 - DNA, 12 bp, Homo sapiens
ctgggtggcctg

SEQ ID NO: 827983 - DNA, 13 bp, Homo sapiens
ctgggtgggctct

SEQ ID NO: 827984 - DNA, 12 bp, Homo sapiens
ctgggtggggca

SEQ ID NO: 827985 - DNA, 21 bp, Homo sapiens
ctgggtggggcagcacacctc

SEQ ID NO: 827986 - DNA, 21 bp, Homo sapiens
ctgggtggggtgaggaccact

SEQ ID NO: 827987 - DNA, 16 bp, Homo sapiens
ctgggtggtaccctct

SEQ ID NO: 827988 - DNA, 19 bp, Homo sapiens
ctgggtggtaccctctgga

SEQ ID NO: 827989 - DNA, 20 bp, Homo sapiens
ctgggtggttttttccccct

SEQ ID NO: 827990 - DNA, 15 bp, Homo sapiens
ctgggtgtaaacaca

SEQ ID NO: 827991 - DNA, 13 bp, Homo sapiens
ctgggtgtcattt

SEQ ID NO: 827992 - DNA, 20 bp, Homo sapiens
ctgggtgtcatttcattcca

SEQ ID NO: 827993 - DNA, 21 bp, Homo sapiens
ctgggtgtcatttcattccat

SEQ ID NO: 827994 - DNA, 21 bp, Homo sapiens
ctgggtgtccgccatccaggg

SEQ ID NO: 827995 - DNA, 22 bp, Homo sapiens
ctgggtgtccgccatccagggt

SEQ ID NO: 827996 - DNA, 15 bp, Homo sapiens
ctgggtgttgaccac

SEQ ID NO: 827997 - DNA, 23 bp, Homo sapiens
ctgggttaatggctagtactgta

SEQ ID NO: 827998 - DNA, 18 bp, Homo sapiens
ctgggttaattcatttgg

SEQ ID NO: 827999 - DNA, 21 bp, Homo sapiens
ctgggttagggtgtgtgttca

SEQ ID NO: 828000 - DNA, 13 bp, Homo sapiens
ctgggttattcag

SEQ ID NO: 828001 - DNA, 15 bp, Homo sapiens
ctgggttattcagaa

SEQ ID NO: 828002 - DNA, 16 bp, Homo sapiens
ctgggttattcagaac

SEQ ID NO: 828003 - DNA, 21 bp, Homo sapiens
ctgggttccctttccttccat

SEQ ID NO: 828004 - DNA, 13 bp, Homo sapiens
ctgggttccggga

SEQ ID NO: 828005 - DNA, 16 bp, Homo sapiens
ctgggttcgttgggga

SEQ ID NO: 828006 - DNA, 15 bp, Homo sapiens
ctgggttctttggaa

SEQ ID NO: 828007 - DNA, 17 bp, Homo sapiens
ctgggttctttggaagc

SEQ ID NO: 828008 - DNA, 16 bp, Homo sapiens
ctgggttgcgggacag

SEQ ID NO: 828009 - DNA, 13 bp, Homo sapiens
ctgggttggaggg

SEQ ID NO: 828010 - DNA, 14 bp, Homo sapiens
ctgggttggaggga

SEQ ID NO: 828011 - DNA, 20 bp, Homo sapiens
ctgggttggagggaaccacc

SEQ ID NO: 828012 - DNA, 16 bp, Homo sapiens
ctgggttggtgcacag

SEQ ID NO: 828013 - DNA, 19 bp, Homo sapiens
ctgggttggtgcacagtga

SEQ ID NO: 828014 - DNA, 22 bp, Homo sapiens
ctgggttggtgcacagtgattt

SEQ ID NO: 828015 - DNA, 18 bp, Homo sapiens
ctgggtttctaagcagtt

SEQ ID NO: 828016 - DNA, 20 bp, Homo sapiens
ctgggtttctaagcagttat

SEQ ID NO: 828017 - DNA, 18 bp, Homo sapiens
ctgggtttctctgtatag

SEQ ID NO: 828018 - DNA, 23 bp, Homo sapiens
ctgggtttgcccagtcctgggtt

SEQ ID NO: 828019 - DNA, 19 bp, Homo sapiens
ctgggtttggaccccagct

SEQ ID NO: 828020 - DNA, 14 bp, Homo sapiens
ctgggttttctgaa

SEQ ID NO: 828021 - DNA, 20 bp, Homo sapiens
ctgggttttcttaaccatct

SEQ ID NO: 828022 - DNA, 22 bp, Homo sapiens
ctgggttttgtattctctgagc

SEQ ID NO: 828023 - DNA, 18 bp, Homo sapiens
ctggtaaaaagatccagg

SEQ ID NO: 828024 - DNA, 20 bp, Homo sapiens
ctggtaaaattaagcacact

SEQ ID NO: 828025 - DNA, 22 bp, Homo sapiens
ctggtaaaattaagcacactaa

SEQ ID NO: 828026 - DNA, 16 bp, Homo sapiens
ctggtaaactatttgt

SEQ ID NO: 828027 - DNA, 19 bp, Homo sapiens
ctggtaaactatttgtctt

SEQ ID NO: 828028 - DNA, 20 bp, Homo sapiens
ctggtaagattgttattaaa

SEQ ID NO: 828029 - DNA, 18 bp, Homo sapiens
ctggtaagcagaggcttt

SEQ ID NO: 828030 - DNA, 19 bp, Homo sapiens
ctggtaagcgatttgaaac

SEQ ID NO: 828031 - DNA, 19 bp, Homo sapiens
ctggtaatattgacttgta

SEQ ID NO: 828032 - DNA, 14 bp, Homo sapiens
ctggtaattaaaag

SEQ ID NO: 828033 - DNA, 23 bp, Homo sapiens
ctggtacagtatgggggttgtaa

SEQ ID NO: 828034 - DNA, 13 bp, Homo sapiens
ctggtacccagcc

SEQ ID NO: 828035 - DNA, 16 bp, Homo sapiens
ctggtacccagccatc

SEQ ID NO: 828036 - DNA, 17 bp, Homo sapiens
ctggtacccagccatct

SEQ ID NO: 828037 - DNA, 22 bp, Homo sapiens
ctggtacccagccatctgccca

SEQ ID NO: 828038 - DNA, 20 bp, Homo sapiens
ctggtacttagagtttctgt

SEQ ID NO: 828039 - DNA, 19 bp, Homo sapiens
ctggtagaaaaaggggcct

SEQ ID NO: 828040 - DNA, 18 bp, Homo sapiens
ctggtagaattgggaagc

SEQ ID NO: 828041 - DNA, 17 bp, Homo sapiens
ctggtagagacccccag

SEQ ID NO: 828042 - DNA, 22 bp, Homo sapiens
ctggtagagacccccaggcctg

SEQ ID NO: 828043 - DNA, 14 bp, Homo sapiens
ctggtagatagaaa

SEQ ID NO: 828044 - DNA, 23 bp, Homo sapiens
ctggtagatagaaataaatagct

SEQ ID NO: 828045 - DNA, 15 bp, Homo sapiens
ctggtagcagcaggc

SEQ ID NO: 828046 - DNA, 16 bp, Homo sapiens
ctggtagctgagggga

SEQ ID NO: 828047 - DNA, 17 bp, Homo sapiens
ctggtaggaccaagcat

SEQ ID NO: 828048 - DNA, 22 bp, Homo sapiens
ctggtaggttgggacaccaggg

SEQ ID NO: 828049 - DNA, 21 bp, Homo sapiens
ctggtagttagtagcatgttg

SEQ ID NO: 828050 - DNA, 21 bp, Homo sapiens
ctggtatacattgaattcatt

SEQ ID NO: 828051 - DNA, 18 bp, Homo sapiens
ctggtatatccaaaagct

SEQ ID NO: 828052 - DNA, 17 bp, Homo sapiens
ctggtatctcagaaagt

SEQ ID NO: 828053 - DNA, 14 bp, Homo sapiens
ctggtattcacaga

SEQ ID NO: 828054 - DNA, 13 bp, Homo sapiens
ctggtattctctc

SEQ ID NO: 828055 - DNA, 18 bp, Homo sapiens
ctggtattctctctatgc

SEQ ID NO: 828056 - DNA, 15 bp, Homo sapiens
ctggtattgtttacg

SEQ ID NO: 828057 - DNA, 14 bp, Homo sapiens
ctggtatttcccct

SEQ ID NO: 828058 - DNA, 17 bp, Homo sapiens
ctggtatttcccctgtc

SEQ ID NO: 828059 - DNA, 18 bp, Homo sapiens
ctggtatttcccctgtca

SEQ ID NO: 828060 - DNA, 14 bp, Homo sapiens
ctggtatttctaat

SEQ ID NO: 828061 - DNA, 19 bp, Homo sapiens
ctggtcaacctcctggaca

SEQ ID NO: 828062 - DNA, 22 bp, Homo sapiens
ctggtcaagttgagatttttaa

SEQ ID NO: 828063 - DNA, 18 bp, Homo sapiens
ctggtcacaggactctgc

SEQ ID NO: 828064 - DNA, 20 bp, Homo sapiens
ctggtcacaggactctgcct

SEQ ID NO: 828065 - DNA, 22 bp, Homo sapiens
ctggtcacaggactctgcctcc

SEQ ID NO: 828066 - DNA, 19 bp, Homo sapiens
ctggtcaccaaggcagtgc

SEQ ID NO: 828067 - DNA, 18 bp, Homo sapiens
ctggtcaccctggggctg

SEQ ID NO: 828068 - DNA, 15 bp, Homo sapiens
ctggtcaccttgcac

SEQ ID NO: 828069 - DNA, 18 bp, Homo sapiens
ctggtcaccttgcactcc

SEQ ID NO: 828070 - DNA, 12 bp, Homo sapiens
ctggtcactctg

SEQ ID NO: 828071 - DNA, 22 bp, Homo sapiens
ctgtaattcctacctccctgca

SEQ ID NO: 828072 - DNA, 19 bp, Homo sapiens
ctgtaattgaatattattc

SEQ ID NO: 828073 - DNA, 16 bp, Homo sapiens
ctgtaattgataatag

SEQ ID NO: 828074 - DNA, 13 bp, Homo sapiens
ctgtaatttagtt

SEQ ID NO: 828075 - DNA, 16 bp, Homo sapiens
ctgtaatttagttatt

SEQ ID NO: 828076 - DNA, 18 bp, Homo sapiens
ctgtaatttcgccttaaa

SEQ ID NO: 828077 - DNA, 20 bp, Homo sapiens
ctgtaatttcgccttaaact

SEQ ID NO: 828078 - DNA, 18 bp, Homo sapiens
ctgtaatttgcttgtttg

SEQ ID NO: 828079 - DNA, 17 bp, Homo sapiens
ctgtaatttgtgataca

SEQ ID NO: 828080 - DNA, 22 bp, Homo sapiens
ctgtaatttgtgatacaatgct

SEQ ID NO: 828081 - DNA, 15 bp, Homo sapiens
ctgtacaaagtagaa

SEQ ID NO: 828082 - DNA, 20 bp, Homo sapiens
ctgtacaaatataagaataa

SEQ ID NO: 828083 - DNA, 11 bp, Homo sapiens
ctgtacaataa

SEQ ID NO: 828084 - DNA, 19 bp, Homo sapiens
ctgtacactgaatatttat

SEQ ID NO: 828085 - DNA, 21 bp, Homo sapiens
ctgtacactgacttgagacca

SEQ ID NO: 828086 - DNA, 21 bp, Homo sapiens
ctgtacagaaagtatcacaaa

SEQ ID NO: 828087 - DNA, 18 bp, Homo sapiens
ctgtacagaatgctattt

SEQ ID NO: 828088 - DNA, 13 bp, Homo sapiens
ctgtacagagact

SEQ ID NO: 828089 - DNA, 15 bp, Homo sapiens
ctgtacagtgtcttt

SEQ ID NO: 828090 - DNA, 21 bp, Homo sapiens
ctgtacagtgtctttttttgt

SEQ ID NO: 828091 - DNA, 15 bp, Homo sapiens
ctgtacagtgttacc

SEQ ID NO: 828092 - DNA, 18 bp, Homo sapiens
ctgtacataaattccaga

SEQ ID NO: 828093 - DNA, 16 bp, Homo sapiens
ctgtacatacaaattc

SEQ ID NO: 828094 - DNA, 13 bp, Homo sapiens
ctgtacatacatt

SEQ ID NO: 828095 - DNA, 18 bp, Homo sapiens
ctgtacatactggcctct

SEQ ID NO: 828096 - DNA, 19 bp, Homo sapiens
ctgtacatattactgttgc

SEQ ID NO: 828097 - DNA, 23 bp, Homo sapiens
ctgtacatattactgttgcattt

SEQ ID NO: 828098 - DNA, 17 bp, Homo sapiens
ctgtacatgaaaacaca

SEQ ID NO: 828099 - DNA, 20 bp, Homo sapiens
ctgtacatgaaaacacattt

SEQ ID NO: 828100 - DNA, 21 bp, Homo sapiens
ctgtacatgaaaacacatttt

SEQ ID NO: 828101 - DNA, 22 bp, Homo sapiens
ctgtacatgaaaacacattttt

SEQ ID NO: 828102 - DNA, 22 bp, Homo sapiens
ctgtacatgacatcaaaatgag

SEQ ID NO: 828103 - DNA, 17 bp, Homo sapiens
ctgtacattgtgagctc

SEQ ID NO: 828104 - DNA, 19 bp, Homo sapiens
ctgtacattgtgagctctg

SEQ ID NO: 828105 - DNA, 13 bp, Homo sapiens
ctgtacatttaaa

SEQ ID NO: 828106 - DNA, 19 bp, Homo sapiens
ctgtacatttaaaattgct

SEQ ID NO: 828107 - DNA, 16 bp, Homo sapiens
ctgtacatttgtgctc

SEQ ID NO: 828108 - DNA, 14 bp, Homo sapiens
ctgtacccacccca

SEQ ID NO: 828109 - DNA, 20 bp, Homo sapiens
ctgtacccaccccagcacag

SEQ ID NO: 828110 - DNA, 22 bp, Homo sapiens
ctgtacccaccccagcacagcc

SEQ ID NO: 828111 - DNA, 13 bp, Homo sapiens
ctgtacccagctc

SEQ ID NO: 828112 - DNA, 17 bp, Homo sapiens
ctgtacccttccacctc

SEQ ID NO: 828113 - DNA, 15 bp, Homo sapiens
ctgtaccctttaaga

SEQ ID NO: 828114 - DNA, 23 bp, Homo sapiens
ctgtaccttttgaggagccccag

SEQ ID NO: 828115 - DNA, 17 bp, Homo sapiens
ctgtacgaaaaagagca

SEQ ID NO: 828116 - DNA, 14 bp, Homo sapiens
ctgtacgtactgca

SEQ ID NO: 828117 - DNA, 18 bp, Homo sapiens
ctgtacgtactgcatttg

SEQ ID NO: 828118 - DNA, 17 bp, Homo sapiens
ctgtactaaggagcatg

SEQ ID NO: 828119 - DNA, 23 bp, Homo sapiens
ctgtactatgatgggcttctgtt

SEQ ID NO: 828120 - DNA, 20 bp, Homo sapiens
ctgtactcagagcagagcaa

SEQ ID NO: 828121 - DNA, 15 bp, Homo sapiens
ctgtactcctcccag

SEQ ID NO: 828122 - DNA, 19 bp, Homo sapiens
ctgtactcctcccaggcgc

SEQ ID NO: 828123 - DNA, 12 bp, Homo sapiens
ctgtactgcatg

SEQ ID NO: 828124 - DNA, 14 bp, Homo sapiens
ctgtactgcatgtg

SEQ ID NO: 828125 - DNA, 15 bp, Homo sapiens
ctgtactgcatgtga

SEQ ID NO: 828126 - DNA, 16 bp, Homo sapiens
ctgtactgctcaggct

SEQ ID NO: 828127 - DNA, 22 bp, Homo sapiens
ctgtactggccagtgtcatttt

SEQ ID NO: 828128 - DNA, 14 bp, Homo sapiens
ctgtacttcactgt

SEQ ID NO: 828129 - DNA, 21 bp, Homo sapiens
ctgtacttcagtatgtgtcaa

SEQ ID NO: 828130 - DNA, 23 bp, Homo sapiens
ctgtacttcagtatgtgtcaact

SEQ ID NO: 828131 - DNA, 21 bp, Homo sapiens
ctgtacttgtcctcagcttgg

SEQ ID NO: 828132 - DNA, 13 bp, Homo sapiens
ctgtactttttta

SEQ ID NO: 828133 - DNA, 17 bp, Homo sapiens
ctgtagaaggaaatata

SEQ ID NO: 828134 - DNA, 14 bp, Homo sapiens
ctgtagaatcaatt

SEQ ID NO: 828135 - DNA, 16 bp, Homo sapiens
ctgtagaatcaattta

SEQ ID NO: 828136 - DNA, 15 bp, Homo sapiens
ctgtagactagtgcc

SEQ ID NO: 828137 - DNA, 23 bp, Homo sapiens
ctgtagacttctggttgtatttc

SEQ ID NO: 828138 - DNA, 19 bp, Homo sapiens
ctgtagagatttttatgtg

SEQ ID NO: 828139 - DNA, 23 bp, Homo sapiens
ctgtagagatttttatgtgtttg

SEQ ID NO: 828140 - DNA, 13 bp, Homo sapiens
ctgtagagtggga

SEQ ID NO: 828141 - DNA, 15 bp, Homo sapiens
ctgtagagtgggagc

SEQ ID NO: 828142 - DNA, 13 bp, Homo sapiens
ctgtagagttgct

SEQ ID NO: 828143 - DNA, 12 bp, Homo sapiens
ctgtagatcagg

SEQ ID NO: 828144 - DNA, 15 bp, Homo sapiens
ctgtagatcaggttt

SEQ ID NO: 828145 - DNA, 19 bp, Homo sapiens
ctgtagatggtgacctggg

SEQ ID NO: 828146 - DNA, 22 bp, Homo sapiens
ctgtagatggtgacctgggtat

SEQ ID NO: 828147 - DNA, 13 bp, Homo sapiens
ctgtagattctgt

SEQ ID NO: 828148 - DNA, 23 bp, Homo sapiens
ctgtagcaatggccagagcctct

SEQ ID NO: 828149 - DNA, 17 bp, Homo sapiens
ctgtagcatcttctgga

SEQ ID NO: 828150 - DNA, 18 bp, Homo sapiens
ctgtagcatcttctggag

SEQ ID NO: 828151 - DNA, 23 bp, Homo sapiens
ctgtagccacagctgctgttctc

SEQ ID NO: 828152 - DNA, 14 bp, Homo sapiens
ctgtagccatggct

SEQ ID NO: 828153 - DNA, 17 bp, Homo sapiens
ctgtagccccagtgaca

SEQ ID NO: 828154 - DNA, 21 bp, Homo sapiens
ctgtagccccagtgacagcta

SEQ ID NO: 828155 - DNA, 18 bp, Homo sapiens
ctgtagcctaaaacgaat

SEQ ID NO: 828156 - DNA, 15 bp, Homo sapiens
ctgtagcctcagatg

SEQ ID NO: 828157 - DNA, 15 bp, Homo sapiens
ctgtagcctcctttg

SEQ ID NO: 828158 - DNA, 14 bp, Homo sapiens
ctgtagctcagtca

SEQ ID NO: 828159 - DNA, 19 bp, Homo sapiens
ctgtagctcccgagctact

SEQ ID NO: 828160 - DNA, 18 bp, Homo sapiens
ctgtagctgtaagcaagt

SEQ ID NO: 828161 - DNA, 23 bp, Homo sapiens
ctgtaggagcaagggcacaaact

SEQ ID NO: 828162 - DNA, 22 bp, Homo sapiens
ctgtaggagcaggtgaataaag

SEQ ID NO: 828163 - DNA, 19 bp, Homo sapiens
ctgtaggcacagagctgca

SEQ ID NO: 828164 - DNA, 12 bp, Homo sapiens
ctgtaggcagca

SEQ ID NO: 828165 - DNA, 12 bp, Homo sapiens
ctgtaggcctca

SEQ ID NO: 828166 - DNA, 19 bp, Homo sapiens
ctgtagggagtgaagccac

SEQ ID NO: 828167 - DNA, 19 bp, Homo sapiens
ctgtagtagccctttctgt

SEQ ID NO: 828168 - DNA, 14 bp, Homo sapiens
ctgtagtcccagcc

SEQ ID NO: 828169 - DNA, 23 bp, Homo sapiens
ctgtagtcccagccactcgggag

SEQ ID NO: 828170 - DNA, 13 bp, Homo sapiens
ctgtagtctctga

SEQ ID NO: 828171 - DNA, 13 bp, Homo sapiens
ctgtagttaggaa

SEQ ID NO: 828172 - DNA, 17 bp, Homo sapiens
ctgtagttaggaaataa

SEQ ID NO: 828173 - DNA, 18 bp, Homo sapiens
ctgtagttaggaaataaa

SEQ ID NO: 828174 - DNA, 21 bp, Homo sapiens
ctgtagttaggaaataaaacc

SEQ ID NO: 828175 - DNA, 18 bp, Homo sapiens
ctgtagttgacaattctg

SEQ ID NO: 828176 - DNA, 19 bp, Homo sapiens
ctgtagttgacaattctgc

SEQ ID NO: 828177 - DNA, 15 bp, Homo sapiens
ctgtagtttagttct

SEQ ID NO: 828178 - DNA, 17 bp, Homo sapiens
ctgtagtttagttctgt

SEQ ID NO: 828179 - DNA, 22 bp, Homo sapiens
ctgtagttttccctgcactgtg

SEQ ID NO: 828180 - DNA, 21 bp, Homo sapiens
ctgtataagcactgaaaaaca

SEQ ID NO: 828181 - DNA, 12 bp, Homo sapiens
ctgtataagtaa

SEQ ID NO: 828182 - DNA, 14 bp, Homo sapiens
ctgtataagtaaga

SEQ ID NO: 828183 - DNA, 19 bp, Homo sapiens
ctgtataagtaagaaaata

SEQ ID NO: 828184 - DNA, 18 bp, Homo sapiens
ctgtataatagagataag

SEQ ID NO: 828185 - DNA, 17 bp, Homo sapiens
ctgtatactgtaaaagt

SEQ ID NO: 828186 - DNA, 13 bp, Homo sapiens
ctgtatagaaatc

SEQ ID NO: 828187 - DNA, 17 bp, Homo sapiens
ctgtatagaaatctaaa

SEQ ID NO: 828188 - DNA, 18 bp, Homo sapiens
ctgtataggtagatccag

SEQ ID NO: 828189 - DNA, 15 bp, Homo sapiens
ctgtatagtactggc

SEQ ID NO: 828190 - DNA, 21 bp, Homo sapiens
ctgtatagttaggatagcatt

SEQ ID NO: 828191 - DNA, 13 bp, Homo sapiens
ctgtatataaaca

SEQ ID NO: 828192 - DNA, 17 bp, Homo sapiens
ctgtatataagttgctg

SEQ ID NO: 828193 - DNA, 15 bp, Homo sapiens
ctgtcatctgtgcac

SEQ ID NO: 828194 - DNA, 14 bp, Homo sapiens
ctgtcatctttctt

SEQ ID NO: 828195 - DNA, 21 bp, Homo sapiens
ctgtcatgaaatcagcaagag

SEQ ID NO: 828196 - DNA, 20 bp, Homo sapiens
ctgtcatgaacatgttcctg

SEQ ID NO: 828197 - DNA, 13 bp, Homo sapiens
ctgtcatgccccc

SEQ ID NO: 828198 - DNA, 13 bp, Homo sapiens
ctgtcattagtct

SEQ ID NO: 828199 - DNA, 17 bp, Homo sapiens
ctgtcatttgaacctgg

SEQ ID NO: 828200 - DNA, 20 bp, Homo sapiens
ctgtccaaaagcgccctcac

SEQ ID NO: 828201 - DNA, 16 bp, Homo sapiens
ctgtccaaacatttca

SEQ ID NO: 828202 - DNA, 18 bp, Homo sapiens
ctgtccaaacatttcatc

SEQ ID NO: 828203 - DNA, 16 bp, Homo sapiens
ctgtccaaccagactt

SEQ ID NO: 828204 - DNA, 16 bp, Homo sapiens
ctgtccaacctaaccc

SEQ ID NO: 828205 - DNA, 16 bp, Homo sapiens
ctgtccacatccccag

SEQ ID NO: 828206 - DNA, 19 bp, Homo sapiens
ctgtccacatccccagagc

SEQ ID NO: 828207 - DNA, 22 bp, Homo sapiens
ctgtccacatccccagagccca

SEQ ID NO: 828208 - DNA, 23 bp, Homo sapiens
ctgtccacatccccagagcccag

SEQ ID NO: 828209 - DNA, 20 bp, Homo sapiens
ctgtccacatgacctccatt

SEQ ID NO: 828210 - DNA, 22 bp, Homo sapiens
ctgtccacatgacctccatttc

SEQ ID NO: 828211 - DNA, 16 bp, Homo sapiens
ctgtccaccctgccaa

SEQ ID NO: 828212 - DNA, 15 bp, Homo sapiens
ctgtccagcctgggc

SEQ ID NO: 828213 - DNA, 18 bp, Homo sapiens
ctgtccagcctgggcagc

SEQ ID NO: 828214 - DNA, 23 bp, Homo sapiens
ctgtccagctggggccagaggct

SEQ ID NO: 828215 - DNA, 19 bp, Homo sapiens
ctgtccaggcactgctgcc

SEQ ID NO: 828216 - DNA, 20 bp, Homo sapiens
ctgtccaggcactgctgccc

SEQ ID NO: 828217 - DNA, 23 bp, Homo sapiens
ctgtccaggcactgctgcccagc

SEQ ID NO: 828218 - DNA, 13 bp, Homo sapiens
ctgtccaggcagc

SEQ ID NO: 828219 - DNA, 14 bp, Homo sapiens
ctgtccaggcagct

SEQ ID NO: 828220 - DNA, 13 bp, Homo sapiens
ctgtccaggccac

SEQ ID NO: 828221 - DNA, 19 bp, Homo sapiens
ctgtccaggccactgtggc

SEQ ID NO: 828222 - DNA, 20 bp, Homo sapiens
ctgtccaggccactgtggcc

SEQ ID NO: 828223 - DNA, 19 bp, Homo sapiens
ctgtccagggccctgagct

SEQ ID NO: 828224 - DNA, 17 bp, Homo sapiens
ctgtccaggttctgtct

SEQ ID NO: 828225 - DNA, 21 bp, Homo sapiens
ctgtccatttatccacaggaa

SEQ ID NO: 828226 - DNA, 19 bp, Homo sapiens
ctgtcccaccaactctgca

SEQ ID NO: 828227 - DNA, 19 bp, Homo sapiens
ctgtcccacccacacagct

SEQ ID NO: 828228 - DNA, 14 bp, Homo sapiens
ctgtcccaccccca

SEQ ID NO: 828229 - DNA, 16 bp, Homo sapiens
ctgtcccacccccacc

SEQ ID NO: 828230 - DNA, 14 bp, Homo sapiens
ctgtcccacctctt

SEQ ID NO: 828231 - DNA, 20 bp, Homo sapiens
ctgtcccacctggctccccc

SEQ ID NO: 828232 - DNA, 13 bp, Homo sapiens
ctgtcccagagct

SEQ ID NO: 828233 - DNA, 23 bp, Homo sapiens
ctgtcccagaggttatctgcctg

SEQ ID NO: 828234 - DNA, 21 bp, Homo sapiens
ctgtcccaggactcaccctcc

SEQ ID NO: 828235 - DNA, 21 bp, Homo sapiens
ctgtcccaggcatgcagctgc

SEQ ID NO: 828236 - DNA, 18 bp, Homo sapiens
ctgtcccaggccggccca

SEQ ID NO: 828237 - DNA, 20 bp, Homo sapiens
ctgtcccaggccggcccaga

SEQ ID NO: 828238 - DNA, 20 bp, Homo sapiens
ctgtcccagggccctcccag

SEQ ID NO: 828239 - DNA, 14 bp, Homo sapiens
ctgtcccatcccca

SEQ ID NO: 828240 - DNA, 17 bp, Homo sapiens
ctgtcccatccccaggt

SEQ ID NO: 828241 - DNA, 18 bp, Homo sapiens
ctgtcccatccccaggtc

SEQ ID NO: 828242 - DNA, 19 bp, Homo sapiens
ctgtcccatggacactcca

SEQ ID NO: 828243 - DNA, 15 bp, Homo sapiens
ctgtcccattccctg

SEQ ID NO: 828244 - DNA, 14 bp, Homo sapiens
ctgtcccattctag

SEQ ID NO: 828245 - DNA, 16 bp, Homo sapiens
ctgtcccattctagat

SEQ ID NO: 828246 - DNA, 22 bp, Homo sapiens
ctgtccccaaacaggacagcac

SEQ ID NO: 828247 - DNA, 12 bp, Homo sapiens
ctgtccccaccc

SEQ ID NO: 828248 - DNA, 19 bp, Homo sapiens
ctgtccccaccctccactc

SEQ ID NO: 828249 - DNA, 12 bp, Homo sapiens
ctgtccccaggc

SEQ ID NO: 828250 - DNA, 18 bp, Homo sapiens
ctgtccccaggcccagcc

SEQ ID NO: 828251 - DNA, 17 bp, Homo sapiens
ctgtccccaggcctggc

SEQ ID NO: 828252 - DNA, 23 bp, Homo sapiens
ctgtccccaggtcctgtctctgc

SEQ ID NO: 828253 - DNA, 13 bp, Homo sapiens
ctgtccccagtcc

SEQ ID NO: 828254 - DNA, 21 bp, Homo sapiens
ctgtcccccactctctcaccc

SEQ ID NO: 828255 - DNA, 22 bp, Homo sapiens
ctgtcccccactctctcaccca

SEQ ID NO: 828256 - DNA, 12 bp, Homo sapiens
ctgtcccccagc

SEQ ID NO: 828257 - DNA, 13 bp, Homo sapiens
ctgtcccccagca

SEQ ID NO: 828258 - DNA, 15 bp, Homo sapiens
ctgtcccccagcatc

SEQ ID NO: 828259 - DNA, 16 bp, Homo sapiens
ctgtcccccagcatcg

SEQ ID NO: 828260 - DNA, 15 bp, Homo sapiens
ctgtcccccagctct

SEQ ID NO: 828261 - DNA, 16 bp, Homo sapiens
ctgtcccccagctctg

SEQ ID NO: 828262 - DNA, 17 bp, Homo sapiens
ctgtcccccagctctgg

SEQ ID NO: 828263 - DNA, 14 bp, Homo sapiens
ctgtcccccaggct

SEQ ID NO: 828264 - DNA, 15 bp, Homo sapiens
ctgtcccccaggctg

SEQ ID NO: 828265 - DNA, 17 bp, Homo sapiens
ctgtcccccaggctgga

SEQ ID NO: 828266 - DNA, 20 bp, Homo sapiens
ctgtccccctcccctcccag

SEQ ID NO: 828267 - DNA, 22 bp, Homo sapiens
ctgtccccctcccctcccagtc

SEQ ID NO: 828268 - DNA, 23 bp, Homo sapiens
ctgtccccctcctcccagggcct

SEQ ID NO: 828269 - DNA, 15 bp, Homo sapiens
ctgtccccctctcgc

SEQ ID NO: 828270 - DNA, 17 bp, Homo sapiens
ctgtccccgccttccct

SEQ ID NO: 828271 - DNA, 21 bp, Homo sapiens
ctgtccccgccttccctcact

SEQ ID NO: 828272 - DNA, 18 bp, Homo sapiens
ctgtccccgtgttgcatg

SEQ ID NO: 828273 - DNA, 15 bp, Homo sapiens
ctgtcccctctgtca

SEQ ID NO: 828274 - DNA, 16 bp, Homo sapiens
ctgtcccctctgtcat

SEQ ID NO: 828275 - DNA, 12 bp, Homo sapiens
ctgtcccctgga

SEQ ID NO: 828276 - DNA, 14 bp, Homo sapiens
ctgtcccgccttcc

SEQ ID NO: 828277 - DNA, 19 bp, Homo sapiens
ctgtcccggttcaccttgc

SEQ ID NO: 828278 - DNA, 22 bp, Homo sapiens
ctgtcccgttccccgctccaca

SEQ ID NO: 828279 - DNA, 14 bp, Homo sapiens
ctgtccctcatgga

SEQ ID NO: 828280 - DNA, 17 bp, Homo sapiens
ctgtccctctagtgcct

SEQ ID NO: 828281 - DNA, 16 bp, Homo sapiens
ctgtccctctcaggca

SEQ ID NO: 828282 - DNA, 13 bp, Homo sapiens
ctgtccctgaggt

SEQ ID NO: 828283 - DNA, 15 bp, Homo sapiens
ctgtccctgcactgt

SEQ ID NO: 828284 - DNA, 12 bp, Homo sapiens
ctgtccctgcca

SEQ ID NO: 828285 - DNA, 21 bp, Homo sapiens
ctgtccctgccccgcccccca

SEQ ID NO: 828286 - DNA, 15 bp, Homo sapiens
ctgtccctgtagctc

SEQ ID NO: 828287 - DNA, 18 bp, Homo sapiens
ctgtccctgtagctcagt

SEQ ID NO: 828288 - DNA, 19 bp, Homo sapiens
ctgtccctgtagctcagtc

SEQ ID NO: 828289 - DNA, 12 bp, Homo sapiens
ctgtccctgtca

SEQ ID NO: 828290 - DNA, 13 bp, Homo sapiens
ctgtccctgtccc

SEQ ID NO: 828291 - DNA, 14 bp, Homo sapiens
ctgtccctgtcccc

SEQ ID NO: 828292 - DNA, 16 bp, Homo sapiens
ctgtccctgtccttct

SEQ ID NO: 828293 - DNA, 17 bp, Homo sapiens
ctgtccctgtccttcta

SEQ ID NO: 828294 - DNA, 19 bp, Homo sapiens
ctgtcccttcccccataag

SEQ ID NO: 828295 - DNA, 16 bp, Homo sapiens
ctgtcccttgcctcaa

SEQ ID NO: 828296 - DNA, 21 bp, Homo sapiens
ctgtcccttgcctcaatgcca

SEQ ID NO: 828297 - DNA, 20 bp, Homo sapiens
ctgtccggcccagtgccagc

SEQ ID NO: 828298 - DNA, 19 bp, Homo sapiens
ctgtcctaccagttgccct

SEQ ID NO: 828299 - DNA, 20 bp, Homo sapiens
ctgtcctaccagttgcccta

SEQ ID NO: 828300 - DNA, 20 bp, Homo sapiens
ctgtcctacctccactctct

SEQ ID NO: 828301 - DNA, 15 bp, Homo sapiens
ctgtcctaggccaca

SEQ ID NO: 828302 - DNA, 13 bp, Homo sapiens
ctgtcctcaccct

SEQ ID NO: 828303 - DNA, 16 bp, Homo sapiens
ctgtcctcaccctgtg

SEQ ID NO: 828304 - DNA, 17 bp, Homo sapiens
ctgtcctcaccctgtgg

SEQ ID NO: 828305 - DNA, 20 bp, Homo sapiens
ctgtcctcaccctgtgggac

SEQ ID NO: 828306 - DNA, 14 bp, Homo sapiens
ctgtcctcaccgtc

SEQ ID NO: 828307 - DNA, 18 bp, Homo sapiens
ctgtcctcacgccccctg

SEQ ID NO: 828308 - DNA, 17 bp, Homo sapiens
ctgtcctcagagcaggg

SEQ ID NO: 828309 - DNA, 19 bp, Homo sapiens
ctgtcctcagagcaggggc

SEQ ID NO: 828310 - DNA, 17 bp, Homo sapiens
ctgtcctccaagccagc

SEQ ID NO: 828311 - DNA, 15 bp, Homo sapiens
ctgtcctcccatccc

SEQ ID NO: 828312 - DNA, 18 bp, Homo sapiens
ctgtcctcccatcccctc

SEQ ID NO: 828313 - DNA, 19 bp, Homo sapiens
ctgtcctcccatcccctca

SEQ ID NO: 828314 - DNA, 21 bp, Homo sapiens
ctgtcctcccatcccctggac

SEQ ID NO: 828315 - DNA, 18 bp, Homo sapiens
ctgtgatgagctgatctg

SEQ ID NO: 828316 - DNA, 22 bp, Homo sapiens
ctgtgatgagctgatctgcgga

SEQ ID NO: 828317 - DNA, 17 bp, Homo sapiens
ctgtgatgccgtcctgc

SEQ ID NO: 828318 - DNA, 20 bp, Homo sapiens
ctgtgatgccgtcctgctgg

SEQ ID NO: 828319 - DNA, 21 bp, Homo sapiens
ctgtgatgccgtcctgctgga

SEQ ID NO: 828320 - DNA, 14 bp, Homo sapiens
ctgtgatgctgggc

SEQ ID NO: 828321 - DNA, 17 bp, Homo sapiens
ctgtgatgctgtgtgcc

SEQ ID NO: 828322 - DNA, 20 bp, Homo sapiens
ctgtgattacatagatcagc

SEQ ID NO: 828323 - DNA, 23 bp, Homo sapiens
ctgtgattacatagatcagccat

SEQ ID NO: 828324 - DNA, 16 bp, Homo sapiens
ctgtgattagatcaca

SEQ ID NO: 828325 - DNA, 13 bp, Homo sapiens
ctgtgattcagaa

SEQ ID NO: 828326 - DNA, 15 bp, Homo sapiens
ctgtgatttcttctc

SEQ ID NO: 828327 - DNA, 15 bp, Homo sapiens
ctgtgattttgccct

SEQ ID NO: 828328 - DNA, 19 bp, Homo sapiens
ctgtgattttgccctcctg

SEQ ID NO: 828329 - DNA, 20 bp, Homo sapiens
ctgtgcaaagggctgccttg

SEQ ID NO: 828330 - DNA, 19 bp, Homo sapiens
ctgtgcacatctgtgtctt

SEQ ID NO: 828331 - DNA, 21 bp, Homo sapiens
ctgtgcacatctgtgtcttgt

SEQ ID NO: 828332 - DNA, 18 bp, Homo sapiens
ctgtgcactagcctgtga

SEQ ID NO: 828333 - DNA, 21 bp, Homo sapiens
ctgtgcactagcctgtgatta

SEQ ID NO: 828334 - DNA, 21 bp, Homo sapiens
ctgtgcactgggcaggttcct

SEQ ID NO: 828335 - DNA, 21 bp, Homo sapiens
ctgtgcagaataatggaaaca

SEQ ID NO: 828336 - DNA, 13 bp, Homo sapiens
ctgtgcagaccca

SEQ ID NO: 828337 - DNA, 18 bp, Homo sapiens
ctgtgcagacccagtccc

SEQ ID NO: 828338 - DNA, 12 bp, Homo sapiens
ctgtgcagacct

SEQ ID NO: 828339 - DNA, 20 bp, Homo sapiens
ctgtgcagagatgactgtcc

SEQ ID NO: 828340 - DNA, 13 bp, Homo sapiens
ctgtgcagcagcc

SEQ ID NO: 828341 - DNA, 15 bp, Homo sapiens
ctgtgcagcagccca

SEQ ID NO: 828342 - DNA, 17 bp, Homo sapiens
ctgtgcagcagcccagc

SEQ ID NO: 828343 - DNA, 18 bp, Homo sapiens
ctgtgcagcagcccagct

SEQ ID NO: 828344 - DNA, 20 bp, Homo sapiens
ctgtgcagcagcccagcttc

SEQ ID NO: 828345 - DNA, 19 bp, Homo sapiens
ctgtgcagccgctgagcga

SEQ ID NO: 828346 - DNA, 15 bp, Homo sapiens
ctgtgcagggaggag

SEQ ID NO: 828347 - DNA, 16 bp, Homo sapiens
ctgtgcatagtgctgg

SEQ ID NO: 828348 - DNA, 19 bp, Homo sapiens
ctgtgcatcaaccaggaag

SEQ ID NO: 828349 - DNA, 17 bp, Homo sapiens
ctgtgcatgggtgaagg

SEQ ID NO: 828350 - DNA, 20 bp, Homo sapiens
ctgtgcatgggtgaagggag

SEQ ID NO: 828351 - DNA, 16 bp, Homo sapiens
ctgtgccaacctgatg

SEQ ID NO: 828352 - DNA, 13 bp, Homo sapiens
ctgtgccacccac

SEQ ID NO: 828353 - DNA, 14 bp, Homo sapiens
ctgtgccactgact

SEQ ID NO: 828354 - DNA, 16 bp, Homo sapiens
ctgtgccagcaccaca

SEQ ID NO: 828355 - DNA, 20 bp, Homo sapiens
ctgtgccagcaccacagccg

SEQ ID NO: 828356 - DNA, 15 bp, Homo sapiens
ctgtgccaggaggcg

SEQ ID NO: 828357 - DNA, 18 bp, Homo sapiens
ctgtgccatgcccaaggc

SEQ ID NO: 828358 - DNA, 14 bp, Homo sapiens
ctgtgccatgctgg

SEQ ID NO: 828359 - DNA, 20 bp, Homo sapiens
ctgtgccatgctgggccact

SEQ ID NO: 828360 - DNA, 16 bp, Homo sapiens
ctgtgccatggccccc

SEQ ID NO: 828361 - DNA, 19 bp, Homo sapiens
ctgtgcccacatcccaggc

SEQ ID NO: 828362 - DNA, 14 bp, Homo sapiens
ctgtgcccagcagg

SEQ ID NO: 828363 - DNA, 19 bp, Homo sapiens
ctgtgcccagcaggcccag

SEQ ID NO: 828364 - DNA, 20 bp, Homo sapiens
ctgtgcccagcaggcccagc

SEQ ID NO: 828365 - DNA, 16 bp, Homo sapiens
ctgtgccccagctgcc

SEQ ID NO: 828366 - DNA, 17 bp, Homo sapiens
ctgtgccccatgcctgt

SEQ ID NO: 828367 - DNA, 15 bp, Homo sapiens
ctgtgcccccagcct

SEQ ID NO: 828368 - DNA, 16 bp, Homo sapiens
ctgtgcccccagcctc

SEQ ID NO: 828369 - DNA, 21 bp, Homo sapiens
ctgtgcccccagcctcagccc

SEQ ID NO: 828370 - DNA, 22 bp, Homo sapiens
ctgtgcccccagcctcagccca

SEQ ID NO: 828371 - DNA, 23 bp, Homo sapiens
ctgtgcccccagcctcagcccaa

SEQ ID NO: 828372 - DNA, 23 bp, Homo sapiens
ctgtgcccctgatgcagcctgtg

SEQ ID NO: 828373 - DNA, 18 bp, Homo sapiens
ctgtgcccgcatgtgtgc

SEQ ID NO: 828374 - DNA, 12 bp, Homo sapiens
ctgtgccctcac

SEQ ID NO: 828375 - DNA, 19 bp, Homo sapiens
ctgtgccctcaccaccaca

SEQ ID NO: 828376 - DNA, 14 bp, Homo sapiens
ctgtgccctcaccc

SEQ ID NO: 828377 - DNA, 16 bp, Homo sapiens
ctgtgccctcacccca

SEQ ID NO: 828378 - DNA, 22 bp, Homo sapiens
ctgtgccctcaccccaatccct

SEQ ID NO: 828379 - DNA, 12 bp, Homo sapiens
ctgtgccctggt

SEQ ID NO: 828380 - DNA, 13 bp, Homo sapiens
ctgtgccctggtg

SEQ ID NO: 828381 - DNA, 13 bp, Homo sapiens
ctgtgccgcactc

SEQ ID NO: 828382 - DNA, 16 bp, Homo sapiens
ctgtgcctcagagacc

SEQ ID NO: 828383 - DNA, 18 bp, Homo sapiens
ctgtgcctcagagaccag

SEQ ID NO: 828384 - DNA, 22 bp, Homo sapiens
ctgtgcctcagagaccagggct

SEQ ID NO: 828385 - DNA, 18 bp, Homo sapiens
ctgtgcctcaggccaggg

SEQ ID NO: 828386 - DNA, 19 bp, Homo sapiens
ctgtgcctcaggccagggc

SEQ ID NO: 828387 - DNA, 22 bp, Homo sapiens
ctgtgcctccaggaccaggggc

SEQ ID NO: 828388 - DNA, 15 bp, Homo sapiens
ctgtgcctcccccca

SEQ ID NO: 828389 - DNA, 13 bp, Homo sapiens
ctgtgcctcctca

SEQ ID NO: 828390 - DNA, 11 bp, Homo sapiens
ctgtgcctctg

SEQ ID NO: 828391 - DNA, 12 bp, Homo sapiens
ctgtgcctctgc

SEQ ID NO: 828392 - DNA, 13 bp, Homo sapiens
ctgtgcctctgcc

SEQ ID NO: 828393 - DNA, 16 bp, Homo sapiens
ctgtgcctctgcctgt

SEQ ID NO: 828394 - DNA, 18 bp, Homo sapiens
ctgtgcctctgggactgg

SEQ ID NO: 828395 - DNA, 12 bp, Homo sapiens
ctgtgcctgcta

SEQ ID NO: 828396 - DNA, 17 bp, Homo sapiens
ctgtgcctgctagagca

SEQ ID NO: 828397 - DNA, 19 bp, Homo sapiens
ctgtgcctgctagagcaac

SEQ ID NO: 828398 - DNA, 19 bp, Homo sapiens
ctgtgcctgctcagcagcc

SEQ ID NO: 828399 - DNA, 23 bp, Homo sapiens
ctgtgcctgctcagcagccagtc

SEQ ID NO: 828400 - DNA, 13 bp, Homo sapiens
ctgtgcctgcttc

SEQ ID NO: 828401 - DNA, 14 bp, Homo sapiens
ctgtgcctgcttct

SEQ ID NO: 828402 - DNA, 19 bp, Homo sapiens
ctgtgcctggccccagcct

SEQ ID NO: 828403 - DNA, 20 bp, Homo sapiens
ctgtgcctggccccagcctg

SEQ ID NO: 828404 - DNA, 21 bp, Homo sapiens
ctgtgcctggccccagcctgg

SEQ ID NO: 828405 - DNA, 13 bp, Homo sapiens
ctgtgcctgggat

SEQ ID NO: 828406 - DNA, 12 bp, Homo sapiens
ctgtgcctgggc

SEQ ID NO: 828407 - DNA, 14 bp, Homo sapiens
ctgtgcctgggccc

SEQ ID NO: 828408 - DNA, 23 bp, Homo sapiens
ctgtgccttgttttttgtttgtt

SEQ ID NO: 828409 - DNA, 14 bp, Homo sapiens
ctgtgcgcccaggg

SEQ ID NO: 828410 - DNA, 17 bp, Homo sapiens
ctgtgcgcccagggctg

SEQ ID NO: 828411 - DNA, 16 bp, Homo sapiens
ctgtgcgccttgtaga

SEQ ID NO: 828412 - DNA, 20 bp, Homo sapiens
ctgtgcgccttgtagaatgc

SEQ ID NO: 828413 - DNA, 16 bp, Homo sapiens
ctgtgcggcctcacca

SEQ ID NO: 828414 - DNA, 19 bp, Homo sapiens
ctgtgcgtcttggtgtaat

SEQ ID NO: 828415 - DNA, 21 bp, Homo sapiens
ctgtgcgtcttggtgtaattt

SEQ ID NO: 828416 - DNA, 22 bp, Homo sapiens
ctgtgcgtcttggtgtaatttg

SEQ ID NO: 828417 - DNA, 20 bp, Homo sapiens
ctgtgcgtgtggcgtggccc

SEQ ID NO: 828418 - DNA, 21 bp, Homo sapiens
ctgtgctagggaaacttcccg

SEQ ID NO: 828419 - DNA, 13 bp, Homo sapiens
ctgtgctatgaat

SEQ ID NO: 828420 - DNA, 22 bp, Homo sapiens
ctgtgctccgccatggtgtccc

SEQ ID NO: 828421 - DNA, 17 bp, Homo sapiens
ctgtgctccgtgcctcc

SEQ ID NO: 828422 - DNA, 22 bp, Homo sapiens
ctgtgctccgtgcctccaccac

SEQ ID NO: 828423 - DNA, 21 bp, Homo sapiens
ctgtgctcggaggccatctcg

SEQ ID NO: 828424 - DNA, 14 bp, Homo sapiens
ctgtgctctctgtg

SEQ ID NO: 828425 - DNA, 20 bp, Homo sapiens
ctgtgctctggaggctgcag

SEQ ID NO: 828426 - DNA, 20 bp, Homo sapiens
ctgtgctctggggatttctg

SEQ ID NO: 828427 - DNA, 18 bp, Homo sapiens
ctgtgctctttgaagaga

SEQ ID NO: 828428 - DNA, 16 bp, Homo sapiens
ctgtgctcttttggtg

SEQ ID NO: 828429 - DNA, 21 bp, Homo sapiens
ctgtgctcttttggtggggag

SEQ ID NO: 828430 - DNA, 12 bp, Homo sapiens
ctgtgctgctca

SEQ ID NO: 828431 - DNA, 18 bp, Homo sapiens
ctgtgctggaccagctgg

SEQ ID NO: 828432 - DNA, 22 bp, Homo sapiens
ctgtgctggaccagctggcctg

SEQ ID NO: 828433 - DNA, 11 bp, Homo sapiens
ctgtgctgtgt

SEQ ID NO: 828434 - DNA, 18 bp, Homo sapiens
ctgtgcttcaattaataa

SEQ ID NO: 828435 - DNA, 21 bp, Homo sapiens
ctgtgcttcgggcccttccca

SEQ ID NO: 828436 - DNA, 15 bp, Homo sapiens
ctgtgcttgaaggcc

SEQ ID NO: 828437 - DNA, 22 bp, Homo sapiens
ctgtgggtttgggtgcctcctg

SEQ ID NO: 828438 - DNA, 19 bp, Homo sapiens
ctgtggtctataaaataaa

SEQ ID NO: 828439 - DNA, 19 bp, Homo sapiens
ctgtggtgaagtgtggctg

SEQ ID NO: 828440 - DNA, 20 bp, Homo sapiens
ctgtggtgaagtgtggctgg

SEQ ID NO: 828441 - DNA, 16 bp, Homo sapiens
ctgtggtgacaggccc

SEQ ID NO: 828442 - DNA, 17 bp, Homo sapiens
ctgtggtgacaggccca

SEQ ID NO: 828443 - DNA, 18 bp, Homo sapiens
ctgtggtggctccccctc

SEQ ID NO: 828444 - DNA, 21 bp, Homo sapiens
ctgtggtggctccccctctgc

SEQ ID NO: 828445 - DNA, 22 bp, Homo sapiens
ctgtggtggctccccctctgct

SEQ ID NO: 828446 - DNA, 23 bp, Homo sapiens
ctgtggtggctccccctctgctt

SEQ ID NO: 828447 - DNA, 15 bp, Homo sapiens
ctgtggtgtgtcccc

SEQ ID NO: 828448 - DNA, 22 bp, Homo sapiens
ctgtggttacagtgcagacagg

SEQ ID NO: 828449 - DNA, 16 bp, Homo sapiens
ctgtggttcctctgct

SEQ ID NO: 828450 - DNA, 15 bp, Homo sapiens
ctgtggttgcctgcc

SEQ ID NO: 828451 - DNA, 19 bp, Homo sapiens
ctgtggttgcctgccctcc

SEQ ID NO: 828452 - DNA, 15 bp, Homo sapiens
ctgtggtttcagatg

SEQ ID NO: 828453 - DNA, 17 bp, Homo sapiens
ctgtggtttcagatgtg

SEQ ID NO: 828454 - DNA, 18 bp, Homo sapiens
ctgtggtttcagatgtgc

SEQ ID NO: 828455 - DNA, 15 bp, Homo sapiens
ctgtggtttcatgtt

SEQ ID NO: 828456 - DNA, 17 bp, Homo sapiens
ctgtggtttcatgttag

SEQ ID NO: 828457 - DNA, 19 bp, Homo sapiens
ctgtggtttggttggggct

SEQ ID NO: 828458 - DNA, 19 bp, Homo sapiens
ctgtggttttattacaaat

SEQ ID NO: 828459 - DNA, 20 bp, Homo sapiens
ctgtggttttattacaaatg

SEQ ID NO: 828460 - DNA, 18 bp, Homo sapiens
ctgtggttttcccctccc

SEQ ID NO: 828461 - DNA, 20 bp, Homo sapiens
ctgtggttttcccctccctg

SEQ ID NO: 828462 - DNA, 17 bp, Homo sapiens
ctgtgtaaatatatgtc

SEQ ID NO: 828463 - DNA, 23 bp, Homo sapiens
ctgtgtaaatatttttccctccg

SEQ ID NO: 828464 - DNA, 15 bp, Homo sapiens
ctgtgtaacactgtt

SEQ ID NO: 828465 - DNA, 16 bp, Homo sapiens
ctgtgtaaccttgggt

SEQ ID NO: 828466 - DNA, 21 bp, Homo sapiens
ctgtgtaactttctcttaaga

SEQ ID NO: 828467 - DNA, 19 bp, Homo sapiens
ctgtgtacataactgaaaa

SEQ ID NO: 828468 - DNA, 22 bp, Homo sapiens
ctgtgtacataactgaaaatgt

SEQ ID NO: 828469 - DNA, 16 bp, Homo sapiens
ctgtgtaccacttctg

SEQ ID NO: 828470 - DNA, 15 bp, Homo sapiens
ctgtgtactctttat

SEQ ID NO: 828471 - DNA, 15 bp, Homo sapiens
ctgtgtactgcagtt

SEQ ID NO: 828472 - DNA, 11 bp, Homo sapiens
ctgtgtactgt

SEQ ID NO: 828473 - DNA, 16 bp, Homo sapiens
ctgtgtacttcccggg

SEQ ID NO: 828474 - DNA, 15 bp, Homo sapiens
ctgtgtagagaatgt

SEQ ID NO: 828475 - DNA, 13 bp, Homo sapiens
ctgtgtagccgcc

SEQ ID NO: 828476 - DNA, 17 bp, Homo sapiens
ctgtgtagccgccctga

SEQ ID NO: 828477 - DNA, 21 bp, Homo sapiens
ctgtgtagccgccctgagaga

SEQ ID NO: 828478 - DNA, 17 bp, Homo sapiens
ctgtgtagtcaataaaa

SEQ ID NO: 828479 - DNA, 20 bp, Homo sapiens
ctgtgtatcattaaaatata

SEQ ID NO: 828480 - DNA, 21 bp, Homo sapiens
ctgtgtatcattaaaatatat

SEQ ID NO: 828481 - DNA, 15 bp, Homo sapiens
ctgtgtatggaaaaa

SEQ ID NO: 828482 - DNA, 19 bp, Homo sapiens
ctgtgtatggaaaaaccat

SEQ ID NO: 828483 - DNA, 13 bp, Homo sapiens
ctgtgtatgtaca

SEQ ID NO: 828484 - DNA, 14 bp, Homo sapiens
ctgtgtatgtacat

SEQ ID NO: 828485 - DNA, 15 bp, Homo sapiens
ctgtgtatgtacata

SEQ ID NO: 828486 - DNA, 13 bp, Homo sapiens
ctgtgtatgtttt

SEQ ID NO: 828487 - DNA, 13 bp, Homo sapiens
ctgtgtatttata

SEQ ID NO: 828488 - DNA, 17 bp, Homo sapiens
ctgtgtatttatataaa

SEQ ID NO: 828489 - DNA, 21 bp, Homo sapiens
ctgtgtatttatttaaaactc

SEQ ID NO: 828490 - DNA, 22 bp, Homo sapiens
ctgtgtatttatttaaaactct

SEQ ID NO: 828491 - DNA, 23 bp, Homo sapiens
ctgtgtatttatttaaaactctg

SEQ ID NO: 828492 - DNA, 16 bp, Homo sapiens
ctgtgtatttgctttt

SEQ ID NO: 828493 - DNA, 19 bp, Homo sapiens
ctgtgtattttttaaagct

SEQ ID NO: 828494 - DNA, 14 bp, Homo sapiens
ctgtgtcagagcct

SEQ ID NO: 828495 - DNA, 15 bp, Homo sapiens
ctgtgtcagagccta

SEQ ID NO: 828496 - DNA, 23 bp, Homo sapiens
ctgtgtcagagcctaccttcacc

SEQ ID NO: 828497 - DNA, 17 bp, Homo sapiens
ctgtgtcagcatagaag

SEQ ID NO: 828498 - DNA, 19 bp, Homo sapiens
ctgtgtcagcatagaagta

SEQ ID NO: 828499 - DNA, 20 bp, Homo sapiens
ctgtgtcagcatagaagtaa

SEQ ID NO: 828500 - DNA, 14 bp, Homo sapiens
ctgtgtccagcagc

SEQ ID NO: 828501 - DNA, 17 bp, Homo sapiens
ctgtgtccagcagctgc

SEQ ID NO: 828502 - DNA, 21 bp, Homo sapiens
ctgtgtccatgcgctcagggc

SEQ ID NO: 828503 - DNA, 23 bp, Homo sapiens
ctgtgtccatgcgctcagggcca

SEQ ID NO: 828504 - DNA, 13 bp, Homo sapiens
ctgtgtcccatga

SEQ ID NO: 828505 - DNA, 21 bp, Homo sapiens
ctgtgtcccatgacccacccc

SEQ ID NO: 828506 - DNA, 22 bp, Homo sapiens
ctgtgtcccatgacccacccct

SEQ ID NO: 828507 - DNA, 23 bp, Homo sapiens
ctgtgtcccatgacccacccctg

SEQ ID NO: 828508 - DNA, 15 bp, Homo sapiens
ctgtgtcccctgacc

SEQ ID NO: 828509 - DNA, 16 bp, Homo sapiens
ctgtgtcccttttgca

SEQ ID NO: 828510 - DNA, 19 bp, Homo sapiens
ctgtgtcctctgcctgggc

SEQ ID NO: 828511 - DNA, 20 bp, Homo sapiens
ctgtgtcctctgcctgggct

SEQ ID NO: 828512 - DNA, 17 bp, Homo sapiens
ctgtgtcctggtgctct

SEQ ID NO: 828513 - DNA, 23 bp, Homo sapiens
ctgtgtcctggtgctctctgcca

SEQ ID NO: 828514 - DNA, 19 bp, Homo sapiens
ctgtgtccttgcacctgca

SEQ ID NO: 828515 - DNA, 13 bp, Homo sapiens
ctgtgtctaaact

SEQ ID NO: 828516 - DNA, 15 bp, Homo sapiens
ctgtgtctcctctca

SEQ ID NO: 828517 - DNA, 13 bp, Homo sapiens
ctgtgtctctgtt

SEQ ID NO: 828518 - DNA, 16 bp, Homo sapiens
ctgtgtctctgtttcc

SEQ ID NO: 828519 - DNA, 20 bp, Homo sapiens
ctgtgtctctgtttcctgaa

SEQ ID NO: 828520 - DNA, 17 bp, Homo sapiens
ctgtgtctcttttctct

SEQ ID NO: 828521 - DNA, 20 bp, Homo sapiens
ctgtgtctttcacagctcct

SEQ ID NO: 828522 - DNA, 20 bp, Homo sapiens
ctgtgtgaaactttcattcc

SEQ ID NO: 828523 - DNA, 12 bp, Homo sapiens
ctgtgtgaaata

SEQ ID NO: 828524 - DNA, 18 bp, Homo sapiens
ctgtgtgaagttacacaa

SEQ ID NO: 828525 - DNA, 18 bp, Homo sapiens
ctgtgtgaatacctgctc

SEQ ID NO: 828526 - DNA, 17 bp, Homo sapiens
ctgtgtgaccagcggaa

SEQ ID NO: 828527 - DNA, 18 bp, Homo sapiens
ctgtgtgaccagcggaaa

SEQ ID NO: 828528 - DNA, 19 bp, Homo sapiens
ctgtgtgaccctgggcaag

SEQ ID NO: 828529 - DNA, 15 bp, Homo sapiens
ctgtgtgatgaactt

SEQ ID NO: 828530 - DNA, 22 bp, Homo sapiens
ctgtgtgattgacagctttgct

SEQ ID NO: 828531 - DNA, 21 bp, Homo sapiens
ctgtgtgattttcatacaggt

SEQ ID NO: 828532 - DNA, 21 bp, Homo sapiens
ctgtgtgcaactaactgactc

SEQ ID NO: 828533 - DNA, 15 bp, Homo sapiens
ctgtgtgcagtgaag

SEQ ID NO: 828534 - DNA, 14 bp, Homo sapiens
ctgtgtgcatcatg

SEQ ID NO: 828535 - DNA, 23 bp, Homo sapiens
ctgtgtgcccaagtgggcagtca

SEQ ID NO: 828536 - DNA, 21 bp, Homo sapiens
ctgtgtgcgtggcgtggcccg

SEQ ID NO: 828537 - DNA, 18 bp, Homo sapiens
ctgtgtgctgtttgaaaa

SEQ ID NO: 828538 - DNA, 20 bp, Homo sapiens
ctgtgtgctttttttgtgtg

SEQ ID NO: 828539 - DNA, 16 bp, Homo sapiens
ctgtgtggactgtgat

SEQ ID NO: 828540 - DNA, 20 bp, Homo sapiens
ctgtgtggatgctgagctgt

SEQ ID NO: 828541 - DNA, 21 bp, Homo sapiens
ctgtgtggatgctgagctgtg

SEQ ID NO: 828542 - DNA, 14 bp, Homo sapiens
ctgtgtggccaacc

SEQ ID NO: 828543 - DNA, 20 bp, Homo sapiens
ctgtgtggccaaccaggacc

SEQ ID NO: 828544 - DNA, 21 bp, Homo sapiens
ctgtgtggccaaccaggaccc

SEQ ID NO: 828545 - DNA, 23 bp, Homo sapiens
ctgtgtggccaaccaggacccag

SEQ ID NO: 828546 - DNA, 20 bp, Homo sapiens
ctgtgtggggttctcagtgc

SEQ ID NO: 828547 - DNA, 22 bp, Homo sapiens
ctgtgtggggttctcagtgccg

SEQ ID NO: 828548 - DNA, 20 bp, Homo sapiens
ctgtgtggtggagccagggc

SEQ ID NO: 828549 - DNA, 19 bp, Homo sapiens
ctgtgtgtatattgagaat

SEQ ID NO: 828550 - DNA, 15 bp, Homo sapiens
ctgtgtgtccaaaac

SEQ ID NO: 828551 - DNA, 16 bp, Homo sapiens
ctgtgtgtgagtgtga

SEQ ID NO: 828552 - DNA, 16 bp, Homo sapiens
ctgtgtgtgtgaatga

SEQ ID NO: 828553 - DNA, 17 bp, Homo sapiens
ctgtgtgtgtgaatgaa

SEQ ID NO: 828554 - DNA, 19 bp, Homo sapiens
ctgtgtgtgtggcgtggcc

SEQ ID NO: 828555 - DNA, 20 bp, Homo sapiens
ctgtgtgtgtggcgtggccc

SEQ ID NO: 828556 - DNA, 15 bp, Homo sapiens
ctgtgtgtgttgccc

SEQ ID NO: 828557 - DNA, 19 bp, Homo sapiens
ctgtgtgttagttcccaac

SEQ ID NO: 828558 - DNA, 12 bp, Homo sapiens
ctgtttcttgct

SEQ ID NO: 828559 - DNA, 13 bp, Homo sapiens
ctgtttcttgctc

SEQ ID NO: 828560 - DNA, 15 bp, Homo sapiens
ctgtttcttgctctc

SEQ ID NO: 828561 - DNA, 19 bp, Homo sapiens
ctgtttgacacctcttttt

SEQ ID NO: 828562 - DNA, 10 bp, Homo sapiens
ctgtttgatg

SEQ ID NO: 828563 - DNA, 15 bp, Homo sapiens
ctgtttgatgtatgt

SEQ ID NO: 828564 - DNA, 20 bp, Homo sapiens
ctgtttgatgtatgtgtgaa

SEQ ID NO: 828565 - DNA, 14 bp, Homo sapiens
ctgtttgattcttt

SEQ ID NO: 828566 - DNA, 14 bp, Homo sapiens
ctgtttgcatgaga

SEQ ID NO: 828567 - DNA, 18 bp, Homo sapiens
ctgtttggatacagctgc

SEQ ID NO: 828568 - DNA, 12 bp, Homo sapiens
ctgtttggcact

SEQ ID NO: 828569 - DNA, 13 bp, Homo sapiens
ctgtttggcactt

SEQ ID NO: 828570 - DNA, 16 bp, Homo sapiens
ctgtttggcacttgta

SEQ ID NO: 828571 - DNA, 15 bp, Homo sapiens
ctgtttggcttataa

SEQ ID NO: 828572 - DNA, 18 bp, Homo sapiens
ctgtttggcttataaaca

SEQ ID NO: 828573 - DNA, 16 bp, Homo sapiens
ctgtttgggagtgcgg

SEQ ID NO: 828574 - DNA, 20 bp, Homo sapiens
ctgtttgggcccctctccca

SEQ ID NO: 828575 - DNA, 21 bp, Homo sapiens
ctgtttggtggggtggcacct

SEQ ID NO: 828576 - DNA, 22 bp, Homo sapiens
ctgtttgtaaattatttgctaa

SEQ ID NO: 828577 - DNA, 17 bp, Homo sapiens
ctgtttgtatatttgca

SEQ ID NO: 828578 - DNA, 18 bp, Homo sapiens
ctgtttgtatatttgcaa

SEQ ID NO: 828579 - DNA, 19 bp, Homo sapiens
ctgtttgtatatttgcaaa

SEQ ID NO: 828580 - DNA, 18 bp, Homo sapiens
ctgtttgtctgaacaaag

SEQ ID NO: 828581 - DNA, 14 bp, Homo sapiens
ctgtttgtgggact

SEQ ID NO: 828582 - DNA, 13 bp, Homo sapiens
ctgtttgttacta

SEQ ID NO: 828583 - DNA, 13 bp, Homo sapiens
ctgtttgttattg

SEQ ID NO: 828584 - DNA, 17 bp, Homo sapiens
ctgtttgttccaggctc

SEQ ID NO: 828585 - DNA, 12 bp, Homo sapiens
ctgtttgtttaa

SEQ ID NO: 828586 - DNA, 13 bp, Homo sapiens
ctgtttgtttaag

SEQ ID NO: 828587 - DNA, 14 bp, Homo sapiens
ctgtttgtttcaag

SEQ ID NO: 828588 - DNA, 20 bp, Homo sapiens
ctgtttgtttgacaaagaaa

SEQ ID NO: 828589 - DNA, 23 bp, Homo sapiens
ctgtttgtttttaaaaagcaaat

SEQ ID NO: 828590 - DNA, 15 bp, Homo sapiens
ctgttttaattgtag

SEQ ID NO: 828591 - DNA, 19 bp, Homo sapiens
ctgttttaattgtagttct

SEQ ID NO: 828592 - DNA, 14 bp, Homo sapiens
ctgttttactgttt

SEQ ID NO: 828593 - DNA, 17 bp, Homo sapiens
ctgttttagaaattggt

SEQ ID NO: 828594 - DNA, 15 bp, Homo sapiens
ctgttttagctgagg

SEQ ID NO: 828595 - DNA, 11 bp, Homo sapiens
ctgttttcaag

SEQ ID NO: 828596 - DNA, 13 bp, Homo sapiens
ctgttttcaataa

SEQ ID NO: 828597 - DNA, 13 bp, Homo sapiens
ctgttttccccca

SEQ ID NO: 828598 - DNA, 15 bp, Homo sapiens
ctgttttcctccctt

SEQ ID NO: 828599 - DNA, 21 bp, Homo sapiens
ctgttttcctcccttctgcta

SEQ ID NO: 828600 - DNA, 16 bp, Homo sapiens
ctgttttctctgtgac

SEQ ID NO: 828601 - DNA, 13 bp, Homo sapiens
ctgttttctgaaa

SEQ ID NO: 828602 - DNA, 19 bp, Homo sapiens
ctgttttctgagcccgggc

SEQ ID NO: 828603 - DNA, 20 bp, Homo sapiens
ctgttttctgagcccgggct

SEQ ID NO: 828604 - DNA, 17 bp, Homo sapiens
ctgttttctgtttgtaa

SEQ ID NO: 828605 - DNA, 18 bp, Homo sapiens
ctgttttctgtttgtaaa

SEQ ID NO: 828606 - DNA, 18 bp, Homo sapiens
ctgttttcttctattcca

SEQ ID NO: 828607 - DNA, 21 bp, Homo sapiens
ctgttttctttatgtcttttg

SEQ ID NO: 828608 - DNA, 17 bp, Homo sapiens
ctgttttgaaggcaaaa

SEQ ID NO: 828609 - DNA, 12 bp, Homo sapiens
ctgttttgggcc

SEQ ID NO: 828610 - DNA, 13 bp, Homo sapiens
ctgttttgggcct

SEQ ID NO: 828611 - DNA, 18 bp, Homo sapiens
ctgttttgggcctccatg

SEQ ID NO: 828612 - DNA, 23 bp, Homo sapiens
ctgttttggtcccctccctcgtg

SEQ ID NO: 828613 - DNA, 15 bp, Homo sapiens
ctgttttgtatatga

SEQ ID NO: 828614 - DNA, 18 bp, Homo sapiens
ctgttttgttaatgctct

SEQ ID NO: 828615 - DNA, 19 bp, Homo sapiens
ctgttttgttatataattt

SEQ ID NO: 828616 - DNA, 21 bp, Homo sapiens
ctgttttgtttggcaaggaaa

SEQ ID NO: 828617 - DNA, 18 bp, Homo sapiens
ctgtttttattccttcca

SEQ ID NO: 828618 - DNA, 12 bp, Homo sapiens
ctgtttttcaca

SEQ ID NO: 828619 - DNA, 15 bp, Homo sapiens
ctgtttttcggacag

SEQ ID NO: 828620 - DNA, 16 bp, Homo sapiens
ctgtttttgtatcttt

SEQ ID NO: 828621 - DNA, 22 bp, Homo sapiens
ctgtttttgtatctttatgctg

SEQ ID NO: 828622 - DNA, 21 bp, Homo sapiens
ctgttttttaaaacctgcgac

SEQ ID NO: 828623 - DNA, 17 bp, Homo sapiens
ctgttttttcctgagct

SEQ ID NO: 828624 - DNA, 12 bp, Homo sapiens
cttaaaaaactt

SEQ ID NO: 828625 - DNA, 14 bp, Homo sapiens
cttaaaaaatgtcc

SEQ ID NO: 828626 - DNA, 12 bp, Homo sapiens
cttaaaaacaac

SEQ ID NO: 828627 - DNA, 14 bp, Homo sapiens
cttaaaaacaacga

SEQ ID NO: 828628 - DNA, 13 bp, Homo sapiens
cttaaaaactgtg

SEQ ID NO: 828629 - DNA, 21 bp, Homo sapiens
cttaaaaactgtgtatcatta

SEQ ID NO: 828630 - DNA, 15 bp, Homo sapiens
cttaaaaatacttct

SEQ ID NO: 828631 - DNA, 17 bp, Homo sapiens
cttaaaaatacttctat

SEQ ID NO: 828632 - DNA, 22 bp, Homo sapiens
cttaaaaatattttttctgtac

SEQ ID NO: 828633 - DNA, 18 bp, Homo sapiens
cttaaaaatgtaaatatt

SEQ ID NO: 828634 - DNA, 22 bp, Homo sapiens
cttaaaaatgttttttcatgtg

SEQ ID NO: 828635 - DNA, 14 bp, Homo sapiens
cttaaaaatttata

SEQ ID NO: 828636 - DNA, 20 bp, Homo sapiens
cttaaaaccagagaatctta

SEQ ID NO: 828637 - DNA, 13 bp, Homo sapiens
cttaaaagtactt

SEQ ID NO: 828638 - DNA, 22 bp, Homo sapiens
cttaaaagtactttaaaaagga

SEQ ID NO: 828639 - DNA, 15 bp, Homo sapiens
cttaaaagtattcat

SEQ ID NO: 828640 - DNA, 15 bp, Homo sapiens
cttaaaataagcagg

SEQ ID NO: 828641 - DNA, 14 bp, Homo sapiens
cttaaaatacaaga

SEQ ID NO: 828642 - DNA, 14 bp, Homo sapiens
cttaaaatatgtga

SEQ ID NO: 828643 - DNA, 18 bp, Homo sapiens
cttaaaatattcctgcat

SEQ ID NO: 828644 - DNA, 20 bp, Homo sapiens
cttaaaatattcctgcattt

SEQ ID NO: 828645 - DNA, 21 bp, Homo sapiens
cttaaaattcaagaaaataaa

SEQ ID NO: 828646 - DNA, 19 bp, Homo sapiens
cttaaacaaaaattaaaat

SEQ ID NO: 828647 - DNA, 15 bp, Homo sapiens
cttaaacaaagcagt

SEQ ID NO: 828648 - DNA, 13 bp, Homo sapiens
cttaaacaatgta

SEQ ID NO: 828649 - DNA, 14 bp, Homo sapiens
cttaaacaatgtat

SEQ ID NO: 828650 - DNA, 16 bp, Homo sapiens
cttaaacaatgtataa

SEQ ID NO: 828651 - DNA, 20 bp, Homo sapiens
cttaaacccatacaatgtat

SEQ ID NO: 828652 - DNA, 19 bp, Homo sapiens
cttaaacctgaagatgtct

SEQ ID NO: 828653 - DNA, 14 bp, Homo sapiens
cttaaacctgggag

SEQ ID NO: 828654 - DNA, 15 bp, Homo sapiens
cttaaactaaataat

SEQ ID NO: 828655 - DNA, 16 bp, Homo sapiens
cttaaactaaataatg

SEQ ID NO: 828656 - DNA, 17 bp, Homo sapiens
cttaaactaaataatga

SEQ ID NO: 828657 - DNA, 16 bp, Homo sapiens
cttaaactctggacac

SEQ ID NO: 828658 - DNA, 23 bp, Homo sapiens
cttaaactgtgtggactgtgatg

SEQ ID NO: 828659 - DNA, 19 bp, Homo sapiens
cttaaacttccaaagcttc

SEQ ID NO: 828660 - DNA, 16 bp, Homo sapiens
cttaaacttgacccag

SEQ ID NO: 828661 - DNA, 17 bp, Homo sapiens
cttaaagaaaattgcat

SEQ ID NO: 828662 - DNA, 12 bp, Homo sapiens
cttaaagaaagt

SEQ ID NO: 828663 - DNA, 15 bp, Homo sapiens
cttaaagcaaaatag

SEQ ID NO: 828664 - DNA, 16 bp, Homo sapiens
cttaaagcaaaatagt

SEQ ID NO: 828665 - DNA, 17 bp, Homo sapiens
cttaaagcaaaatagta

SEQ ID NO: 828666 - DNA, 19 bp, Homo sapiens
cttaaagcaaaatagtatt

SEQ ID NO: 828667 - DNA, 13 bp, Homo sapiens
cttaaagcagaag

SEQ ID NO: 828668 - DNA, 22 bp, Homo sapiens
cttaaagcagaagccccacagc

SEQ ID NO: 828669 - DNA, 13 bp, Homo sapiens
cttaaagcatttc

SEQ ID NO: 828670 - DNA, 13 bp, Homo sapiens
cttaaagccccct

SEQ ID NO: 828671 - DNA, 22 bp, Homo sapiens
cttaaagcccccttctccatgg

SEQ ID NO: 828672 - DNA, 17 bp, Homo sapiens
cttaaagcttgatttga

SEQ ID NO: 828673 - DNA, 13 bp, Homo sapiens
cttaaaggcctgg

SEQ ID NO: 828674 - DNA, 15 bp, Homo sapiens
cttaaaggcctggaa

SEQ ID NO: 828675 - DNA, 16 bp, Homo sapiens
cttaaaggcctggaac

SEQ ID NO: 828676 - DNA, 17 bp, Homo sapiens
cttaaagtgaaggaaat

SEQ ID NO: 828677 - DNA, 13 bp, Homo sapiens
cttaaataaaact

SEQ ID NO: 828678 - DNA, 20 bp, Homo sapiens
cttaaataaaactatttaaa

SEQ ID NO: 828679 - DNA, 17 bp, Homo sapiens
cttaaataagaaacttt

SEQ ID NO: 828680 - DNA, 22 bp, Homo sapiens
cttaaatacagataattcattt

SEQ ID NO: 828681 - DNA, 13 bp, Homo sapiens
cttaaatactttt

SEQ ID NO: 828682 - DNA, 15 bp, Homo sapiens
cttagatccaaggca

SEQ ID NO: 828683 - DNA, 13 bp, Homo sapiens
cttagatgtatat

SEQ ID NO: 828684 - DNA, 14 bp, Homo sapiens
cttagatgttaaat

SEQ ID NO: 828685 - DNA, 16 bp, Homo sapiens
cttagattagctctgg

SEQ ID NO: 828686 - DNA, 21 bp, Homo sapiens
cttagattagctctggaccag

SEQ ID NO: 828687 - DNA, 16 bp, Homo sapiens
cttagattcaggggaa

SEQ ID NO: 828688 - DNA, 18 bp, Homo sapiens
cttagattcaggggaagg

SEQ ID NO: 828689 - DNA, 19 bp, Homo sapiens
cttagattcaggggaaggg

SEQ ID NO: 828690 - DNA, 24 bp, Homo sapiens
cttagattcaggggaagggcaggc

SEQ ID NO: 828691 - DNA, 16 bp, Homo sapiens
cttagattcttaattc

SEQ ID NO: 828692 - DNA, 13 bp, Homo sapiens
cttagatttcata

SEQ ID NO: 828693 - DNA, 20 bp, Homo sapiens
cttagcaactgctggggaga

SEQ ID NO: 828694 - DNA, 22 bp, Homo sapiens
cttagcaactgctggggagaca

SEQ ID NO: 828695 - DNA, 15 bp, Homo sapiens
cttagcacagagagg

SEQ ID NO: 828696 - DNA, 21 bp, Homo sapiens
cttagcagtgagtattggaag

SEQ ID NO: 828697 - DNA, 17 bp, Homo sapiens
cttagcatgtgactcct

SEQ ID NO: 828698 - DNA, 13 bp, Homo sapiens
cttagccaagccc

SEQ ID NO: 828699 - DNA, 14 bp, Homo sapiens
cttagccaagccct

SEQ ID NO: 828700 - DNA, 18 bp, Homo sapiens
cttagccagttcaaagtg

SEQ ID NO: 828701 - DNA, 14 bp, Homo sapiens
cttagccattgaaa

SEQ ID NO: 828702 - DNA, 22 bp, Homo sapiens
cttagccatttttcaaagcaat

SEQ ID NO: 828703 - DNA, 15 bp, Homo sapiens
cttagcccaagaggt

SEQ ID NO: 828704 - DNA, 18 bp, Homo sapiens
cttagcccaagaggtctg

SEQ ID NO: 828705 - DNA, 23 bp, Homo sapiens
cttagcccaagaggtctgagccc

SEQ ID NO: 828706 - DNA, 14 bp, Homo sapiens
cttagccccgctga

SEQ ID NO: 828707 - DNA, 17 bp, Homo sapiens
cttagccgcaccctgca

SEQ ID NO: 828708 - DNA, 20 bp, Homo sapiens
cttagccgcaccctgcacct

SEQ ID NO: 828709 - DNA, 18 bp, Homo sapiens
cttagccgtccatggcac

SEQ ID NO: 828710 - DNA, 22 bp, Homo sapiens
cttagccgtccatggcaccagc

SEQ ID NO: 828711 - DNA, 11 bp, Homo sapiens
cttagcctccc

SEQ ID NO: 828712 - DNA, 14 bp, Homo sapiens
cttagcctctccca

SEQ ID NO: 828713 - DNA, 19 bp, Homo sapiens
cttagcctcttggaaatca

SEQ ID NO: 828714 - DNA, 11 bp, Homo sapiens
cttagccttgt

SEQ ID NO: 828715 - DNA, 18 bp, Homo sapiens
cttagccttgtgccctgc

SEQ ID NO: 828716 - DNA, 19 bp, Homo sapiens
cttagccttgtgccctgcc

SEQ ID NO: 828717 - DNA, 15 bp, Homo sapiens
cttagcgctctggac

SEQ ID NO: 828718 - DNA, 20 bp, Homo sapiens
cttagcgtcaagacatttgc

SEQ ID NO: 828719 - DNA, 19 bp, Homo sapiens
cttagctagttttattctt

SEQ ID NO: 828720 - DNA, 17 bp, Homo sapiens
cttagctatccttggct

SEQ ID NO: 828721 - DNA, 19 bp, Homo sapiens
cttagctatttatcccttt

SEQ ID NO: 828722 - DNA, 15 bp, Homo sapiens
cttagctcaggtgcc

SEQ ID NO: 828723 - DNA, 16 bp, Homo sapiens
cttagctcaggtgcct

SEQ ID NO: 828724 - DNA, 11 bp, Homo sapiens
cttagctgagt

SEQ ID NO: 828725 - DNA, 14 bp, Homo sapiens
cttagctgccagtg

SEQ ID NO: 828726 - DNA, 14 bp, Homo sapiens
cttagcttagacct

SEQ ID NO: 828727 - DNA, 22 bp, Homo sapiens
cttagcttagacctcagcctgt

SEQ ID NO: 828728 - DNA, 14 bp, Homo sapiens
cttagcttatcttt

SEQ ID NO: 828729 - DNA, 20 bp, Homo sapiens
cttagcttatctttctttcc

SEQ ID NO: 828730 - DNA, 23 bp, Homo sapiens
cttagcttctattatagccacat

SEQ ID NO: 828731 - DNA, 15 bp, Homo sapiens
cttagctttgaaact

SEQ ID NO: 828732 - DNA, 19 bp, Homo sapiens
cttaggaaaatgcttctgt

SEQ ID NO: 828733 - DNA, 17 bp, Homo sapiens
cttaggaagagaaacca

SEQ ID NO: 828734 - DNA, 21 bp, Homo sapiens
cttaggaatgacttgggttta

SEQ ID NO: 828735 - DNA, 23 bp, Homo sapiens
cttaggagacagatcactcctgg

SEQ ID NO: 828736 - DNA, 14 bp, Homo sapiens
cttaggatgtctgt

SEQ ID NO: 828737 - DNA, 16 bp, Homo sapiens
cttaggatgtgtgcat

SEQ ID NO: 828738 - DNA, 18 bp, Homo sapiens
cttaggcacatcaattaa

SEQ ID NO: 828739 - DNA, 17 bp, Homo sapiens
cttaggccttcctctct

SEQ ID NO: 828740 - DNA, 23 bp, Homo sapiens
cttaggccttcctctctccagat

SEQ ID NO: 828741 - DNA, 14 bp, Homo sapiens
cttagggaagaaaa

SEQ ID NO: 828742 - DNA, 19 bp, Homo sapiens
cttagggaagaaaaagcaa

SEQ ID NO: 828743 - DNA, 20 bp, Homo sapiens
cttagggaagctggcctgag

SEQ ID NO: 828744 - DNA, 23 bp, Homo sapiens
cttagggaagttgtctccttcca

SEQ ID NO: 828745 - DNA, 18 bp, Homo sapiens
cttagggacaggacccca

SEQ ID NO: 828746 - DNA, 13 bp, Homo sapiens
cttagggcactgg

SEQ ID NO: 828747 - DNA, 18 bp, Homo sapiens
cttagggcactgggctgt

SEQ ID NO: 828748 - DNA, 22 bp, Homo sapiens
cttaggtgagacagttgcccga

SEQ ID NO: 828749 - DNA, 17 bp, Homo sapiens
cttaggtgccaggctgt

SEQ ID NO: 828750 - DNA, 18 bp, Homo sapiens
cttaggtgccaggctgta

SEQ ID NO: 828751 - DNA, 21 bp, Homo sapiens
cttaggtggcaagctgtgact

SEQ ID NO: 828752 - DNA, 17 bp, Homo sapiens
cttaggttattttgctt

SEQ ID NO: 828753 - DNA, 18 bp, Homo sapiens
cttaggttattttgcttt

SEQ ID NO: 828754 - DNA, 19 bp, Homo sapiens
cttaggttattttgctttg

SEQ ID NO: 828755 - DNA, 22 bp, Homo sapiens
cttaggttattttgctttggtt

SEQ ID NO: 828756 - DNA, 19 bp, Homo sapiens
cttaggttgacattcagaa

SEQ ID NO: 828757 - DNA, 21 bp, Homo sapiens
cttaggttggcaaaaaggcag

SEQ ID NO: 828758 - DNA, 22 bp, Homo sapiens
cttagtaaaaattgattacaat

SEQ ID NO: 828759 - DNA, 17 bp, Homo sapiens
cttagtagggacttaat

SEQ ID NO: 828760 - DNA, 22 bp, Homo sapiens
cttagtagtcaaaaacaaagct

SEQ ID NO: 828761 - DNA, 16 bp, Homo sapiens
cttagtagtttttaca

SEQ ID NO: 828762 - DNA, 12 bp, Homo sapiens
cttagtatttct

SEQ ID NO: 828763 - DNA, 15 bp, Homo sapiens
cttagtatttctcag

SEQ ID NO: 828764 - DNA, 15 bp, Homo sapiens
cttagtcatggtgtt

SEQ ID NO: 828765 - DNA, 23 bp, Homo sapiens
cttagtccagttgtgttgacaca

SEQ ID NO: 828766 - DNA, 12 bp, Homo sapiens
cttagtctcagt

SEQ ID NO: 828767 - DNA, 14 bp, Homo sapiens
cttagtctgttttc

SEQ ID NO: 828768 - DNA, 22 bp, Homo sapiens
cttagtgatcatttaaaaagct

SEQ ID NO: 828769 - DNA, 21 bp, Homo sapiens
cttagtgattgagactcaaaa

SEQ ID NO: 828770 - DNA, 19 bp, Homo sapiens
cttagtgcccgcctaggag

SEQ ID NO: 828771 - DNA, 17 bp, Homo sapiens
cttagtgctgctttgct

SEQ ID NO: 828772 - DNA, 17 bp, Homo sapiens
cttagtgggccagggct

SEQ ID NO: 828773 - DNA, 23 bp, Homo sapiens
cttagtgggccagggctgccctg

SEQ ID NO: 828774 - DNA, 15 bp, Homo sapiens
cttagtggtatgtct

SEQ ID NO: 828775 - DNA, 20 bp, Homo sapiens
cttagtggtatgtctcttta

SEQ ID NO: 828776 - DNA, 11 bp, Homo sapiens
cttagtgtatg

SEQ ID NO: 828777 - DNA, 11 bp, Homo sapiens
cttagtgttca

SEQ ID NO: 828778 - DNA, 14 bp, Homo sapiens
cttagtgttcaaaa

SEQ ID NO: 828779 - DNA, 18 bp, Homo sapiens
cttagttaaaattgattt

SEQ ID NO: 828780 - DNA, 12 bp, Homo sapiens
cttagttcttga

SEQ ID NO: 828781 - DNA, 14 bp, Homo sapiens
cttagttcttgaat

SEQ ID NO: 828782 - DNA, 15 bp, Homo sapiens
cttagttcttgaatt

SEQ ID NO: 828783 - DNA, 18 bp, Homo sapiens
cttagttcttgaattgtt

SEQ ID NO: 828784 - DNA, 23 bp, Homo sapiens
cttagttgatattcaaggcttta

SEQ ID NO: 828785 - DNA, 20 bp, Homo sapiens
cttagttggctttgcccacc

SEQ ID NO: 828786 - DNA, 19 bp, Homo sapiens
cttagtttggattcttatg

SEQ ID NO: 828787 - DNA, 22 bp, Homo sapiens
cttagtttgtgtgttgtctctt

SEQ ID NO: 828788 - DNA, 18 bp, Homo sapiens
cttataaagtggaagtat

SEQ ID NO: 828789 - DNA, 20 bp, Homo sapiens
cttataagagagagttaaaa

SEQ ID NO: 828790 - DNA, 14 bp, Homo sapiens
cttataataaagga

SEQ ID NO: 828791 - DNA, 17 bp, Homo sapiens
cttataataaaggactg

SEQ ID NO: 828792 - DNA, 16 bp, Homo sapiens
cttataatactctgtt

SEQ ID NO: 828793 - DNA, 19 bp, Homo sapiens
cttataatactctgttgta

SEQ ID NO: 828794 - DNA, 19 bp, Homo sapiens
cttataatgaaatctgttt

SEQ ID NO: 828795 - DNA, 14 bp, Homo sapiens
cttataattgttct

SEQ ID NO: 828796 - DNA, 22 bp, Homo sapiens
cttatacaacagcaaaccctga

SEQ ID NO: 828797 - DNA, 15 bp, Homo sapiens
cttatacatttgata

SEQ ID NO: 828798 - DNA, 14 bp, Homo sapiens
cttataccaaaggg

SEQ ID NO: 828799 - DNA, 14 bp, Homo sapiens
cttataccttctga

SEQ ID NO: 828800 - DNA, 16 bp, Homo sapiens
cttatacgaaataatt

SEQ ID NO: 828801 - DNA, 17 bp, Homo sapiens
cttatacgaaataattg

SEQ ID NO: 828802 - DNA, 18 bp, Homo sapiens
cttatacgaaataattgt

SEQ ID NO: 828803 - DNA, 22 bp, Homo sapiens
cttatacgaaataattgttgtt

SEQ ID NO: 828804 - DNA, 19 bp, Homo sapiens
cttatacgcttttctttgt

SEQ ID NO: 828805 - DNA, 14 bp, Homo sapiens
cttatagaatattt

SEQ ID NO: 828806 - DNA, 15 bp, Homo sapiens
cttatagaatattta

SEQ ID NO: 828807 - DNA, 19 bp, Homo sapiens
cttatagacacttgctccc

SEQ ID NO: 828808 - DNA, 21 bp, Homo sapiens
cttataggtaacgtgattgat

SEQ ID NO: 828809 - DNA, 19 bp, Homo sapiens
cttatagtacatgataaat

SEQ ID NO: 828810 - DNA, 14 bp, Homo sapiens
cttatagttaatat

SEQ ID NO: 828811 - DNA, 15 bp, Homo sapiens
cttatagttactgtg

SEQ ID NO: 828812 - DNA, 16 bp, Homo sapiens
cttatagttactgtgt

SEQ ID NO: 828813 - DNA, 19 bp, Homo sapiens
cttatagttactgtgtaat

SEQ ID NO: 828814 - DNA, 13 bp, Homo sapiens
cttatatgccaag

SEQ ID NO: 828815 - DNA, 12 bp, Homo sapiens
cttatattattc

SEQ ID NO: 828816 - DNA, 18 bp, Homo sapiens
cttatatttctgtgtaca

SEQ ID NO: 828817 - DNA, 14 bp, Homo sapiens
cttatcaagtgtct

SEQ ID NO: 828818 - DNA, 15 bp, Homo sapiens
cttatcaagtgtctt

SEQ ID NO: 828819 - DNA, 13 bp, Homo sapiens
cttatcaccagct

SEQ ID NO: 828820 - DNA, 16 bp, Homo sapiens
cttatcaccagctgcc

SEQ ID NO: 828821 - DNA, 17 bp, Homo sapiens
cttatcaccagctgcct

SEQ ID NO: 828822 - DNA, 17 bp, Homo sapiens
cttatcagtttgctaat

SEQ ID NO: 828823 - DNA, 21 bp, Homo sapiens
cttatcatttttgtataaaaa

SEQ ID NO: 828824 - DNA, 16 bp, Homo sapiens
cttatccaaaatgctt

SEQ ID NO: 828825 - DNA, 12 bp, Homo sapiens
cttatccaggac

SEQ ID NO: 828826 - DNA, 13 bp, Homo sapiens
cttatccaggact

SEQ ID NO: 828827 - DNA, 18 bp, Homo sapiens
cttatcccccccagcctg

SEQ ID NO: 828828 - DNA, 20 bp, Homo sapiens
cttatcccccccagcctggc

SEQ ID NO: 828829 - DNA, 16 bp, Homo sapiens
cttatcccttcttttt

SEQ ID NO: 828830 - DNA, 20 bp, Homo sapiens
cttatcctacagtacaatca

SEQ ID NO: 828831 - DNA, 15 bp, Homo sapiens
cttatcctccaccgt

SEQ ID NO: 828832 - DNA, 16 bp, Homo sapiens
cttatcctctgatctc

SEQ ID NO: 828833 - DNA, 21 bp, Homo sapiens
cttatcctgctagcaggcccc

SEQ ID NO: 828834 - DNA, 16 bp, Homo sapiens
cttatcgggctccagc

SEQ ID NO: 828835 - DNA, 17 bp, Homo sapiens
cttatctcatcctttcc

SEQ ID NO: 828836 - DNA, 21 bp, Homo sapiens
cttatctgtgcgtgaaacaca

SEQ ID NO: 828837 - DNA, 17 bp, Homo sapiens
cttatcttacgaaaaaa

SEQ ID NO: 828838 - DNA, 15 bp, Homo sapiens
cttatctttctttcc

SEQ ID NO: 828839 - DNA, 16 bp, Homo sapiens
cttatctttctttcca

SEQ ID NO: 828840 - DNA, 12 bp, Homo sapiens
cttatcttttac

SEQ ID NO: 828841 - DNA, 17 bp, Homo sapiens
cttatcttttacttttt

SEQ ID NO: 828842 - DNA, 23 bp, Homo sapiens
cttatcttttactttttttctgt

SEQ ID NO: 828843 - DNA, 22 bp, Homo sapiens
cttatgacatcacttgtacaaa

SEQ ID NO: 828844 - DNA, 23 bp, Homo sapiens
cttatgacgcggctcaaaaggaa

SEQ ID NO: 828845 - DNA, 18 bp, Homo sapiens
cttatgacttgctacttt

SEQ ID NO: 828846 - DNA, 20 bp, Homo sapiens
cttatgagatctaatgtgaa

SEQ ID NO: 828847 - DNA, 20 bp, Homo sapiens
cttatgatgagccatattaa

SEQ ID NO: 828848 - DNA, 17 bp, Homo sapiens
cttatgatgttttccct

SEQ ID NO: 828849 - DNA, 18 bp, Homo sapiens
cttatgatgttttccctt

SEQ ID NO: 828850 - DNA, 16 bp, Homo sapiens
cttatgattttattac

SEQ ID NO: 828851 - DNA, 19 bp, Homo sapiens
cttatgattttattacaga

SEQ ID NO: 828852 - DNA, 22 bp, Homo sapiens
cttatgccacgggaagtttaga

SEQ ID NO: 828853 - DNA, 15 bp, Homo sapiens
cttatgctgatttat

SEQ ID NO: 828854 - DNA, 14 bp, Homo sapiens
cttatggaacaggg

SEQ ID NO: 828855 - DNA, 22 bp, Homo sapiens
cttatggacaaaattaatacat

SEQ ID NO: 828856 - DNA, 17 bp, Homo sapiens
cttatggacactgcctt

SEQ ID NO: 828857 - DNA, 16 bp, Homo sapiens
cttatggagctcacac

SEQ ID NO: 828858 - DNA, 16 bp, Homo sapiens
cttatgggtggctttc

SEQ ID NO: 828859 - DNA, 21 bp, Homo sapiens
cttatggtatgtagccagctg

SEQ ID NO: 828860 - DNA, 14 bp, Homo sapiens
cttatggtccagaa

SEQ ID NO: 828861 - DNA, 15 bp, Homo sapiens
cttatggtccagaaa

SEQ ID NO: 828862 - DNA, 12 bp, Homo sapiens
cttatgtaaagt

SEQ ID NO: 828863 - DNA, 14 bp, Homo sapiens
cttatgtaaagtat

SEQ ID NO: 828864 - DNA, 15 bp, Homo sapiens
cttatgtaaagtatg

SEQ ID NO: 828865 - DNA, 17 bp, Homo sapiens
cttatgtgttacattat

SEQ ID NO: 828866 - DNA, 16 bp, Homo sapiens
cttatgttgaaaaaat

SEQ ID NO: 828867 - DNA, 18 bp, Homo sapiens
cttattaaggaaatactt

SEQ ID NO: 828868 - DNA, 21 bp, Homo sapiens
cttattaatcatacaaactct

SEQ ID NO: 828869 - DNA, 23 bp, Homo sapiens
cttattaattcttcacctgttat

SEQ ID NO: 828870 - DNA, 20 bp, Homo sapiens
cttattagagtgtctttcca

SEQ ID NO: 828871 - DNA, 17 bp, Homo sapiens
cttattagggagaaaat

SEQ ID NO: 828872 - DNA, 16 bp, Homo sapiens
cttattcaaagagaaa

SEQ ID NO: 828873 - DNA, 19 bp, Homo sapiens
cttattcattttctctaat

SEQ ID NO: 828874 - DNA, 18 bp, Homo sapiens
cttattccaagtgcattt

SEQ ID NO: 828875 - DNA, 18 bp, Homo sapiens
cttattccctcatccttt

SEQ ID NO: 828876 - DNA, 14 bp, Homo sapiens
cttattccgagaat

SEQ ID NO: 828877 - DNA, 17 bp, Homo sapiens
cttattccgagcattcc

SEQ ID NO: 828878 - DNA, 23 bp, Homo sapiens
cttattctaataaatatactatg

SEQ ID NO: 828879 - DNA, 19 bp, Homo sapiens
cttattgatattctaagaa

SEQ ID NO: 828880 - DNA, 23 bp, Homo sapiens
cttattgatcccacatttccatg

SEQ ID NO: 828881 - DNA, 19 bp, Homo sapiens
cttattgcctcccaggcaa

SEQ ID NO: 828882 - DNA, 14 bp, Homo sapiens
cttattgcgctgct

SEQ ID NO: 828883 - DNA, 13 bp, Homo sapiens
cttattgctgcca

SEQ ID NO: 828884 - DNA, 16 bp, Homo sapiens
cttattgctgccaaaa

SEQ ID NO: 828885 - DNA, 18 bp, Homo sapiens
cttattgctgccaaaacc

SEQ ID NO: 828886 - DNA, 19 bp, Homo sapiens
cttattgctgccaaaacca

SEQ ID NO: 828887 - DNA, 18 bp, Homo sapiens
cttattgcttcatctgta

SEQ ID NO: 828888 - DNA, 19 bp, Homo sapiens
cttattgcttcatctgtaa

SEQ ID NO: 828889 - DNA, 16 bp, Homo sapiens
cttattggaaggtatt

SEQ ID NO: 828890 - DNA, 17 bp, Homo sapiens
cttattgggatatcatt

SEQ ID NO: 828891 - DNA, 19 bp, Homo sapiens
cttattgggatatcatttt

SEQ ID NO: 828892 - DNA, 13 bp, Homo sapiens
cttattgtacctc

SEQ ID NO: 828893 - DNA, 14 bp, Homo sapiens
cttattgtacctct

SEQ ID NO: 828894 - DNA, 22 bp, Homo sapiens
cttattgtatctgaattcctgt

SEQ ID NO: 828895 - DNA, 16 bp, Homo sapiens
cttatttaaaaatatt

SEQ ID NO: 828896 - DNA, 18 bp, Homo sapiens
cttatttaaaaatatttc

SEQ ID NO: 828897 - DNA, 22 bp, Homo sapiens
cttatttaatcttttcttattt

SEQ ID NO: 828898 - DNA, 23 bp, Homo sapiens
cttatttacctataaaatgagat

SEQ ID NO: 828899 - DNA, 19 bp, Homo sapiens
cttatttatgttaaaagat

SEQ ID NO: 828900 - DNA, 13 bp, Homo sapiens
cttatttattatt

SEQ ID NO: 828901 - DNA, 17 bp, Homo sapiens
cttatttattgttgcct

SEQ ID NO: 828902 - DNA, 20 bp, Homo sapiens
cttatttattgttgcctttt

SEQ ID NO: 828903 - DNA, 21 bp, Homo sapiens
cttatttattgttgccttttc

SEQ ID NO: 828904 - DNA, 16 bp, Homo sapiens
cttatttctatgacaa

SEQ ID NO: 828905 - DNA, 19 bp, Homo sapiens
cttatttctctctcctggt

SEQ ID NO: 828906 - DNA, 15 bp, Homo sapiens
cttatttggaaattt

SEQ ID NO: 828907 - DNA, 16 bp, Homo sapiens
cttatttgtatatggt

SEQ ID NO: 828908 - DNA, 21 bp, Homo sapiens
cttatttgtctgtaaaaaatg

SEQ ID NO: 828909 - DNA, 16 bp, Homo sapiens
cttattttaggaaatt

SEQ ID NO: 828910 - DNA, 18 bp, Homo sapiens
cttattttattatgagct

SEQ ID NO: 828911 - DNA, 20 bp, Homo sapiens
cttattttgcattccagaat

SEQ ID NO: 828912 - DNA, 16 bp, Homo sapiens
cttatttttagccata

SEQ ID NO: 828913 - DNA, 14 bp, Homo sapiens
cttatttttataat

SEQ ID NO: 828914 - DNA, 23 bp, Homo sapiens
cttatttttataattaaagatgc

SEQ ID NO: 828915 - DNA, 15 bp, Homo sapiens
cttattttttcccaa

SEQ ID NO: 828916 - DNA, 14 bp, Homo sapiens
cttcaaaatattga

SEQ ID NO: 828917 - DNA, 18 bp, Homo sapiens
cttcaaactttcactttg

SEQ ID NO: 828918 - DNA, 13 bp, Homo sapiens
cttcaaagattat

SEQ ID NO: 828919 - DNA, 11 bp, Homo sapiens
cttcaaagcag

SEQ ID NO: 828920 - DNA, 13 bp, Homo sapiens
cttcaaagcagag

SEQ ID NO: 828921 - DNA, 16 bp, Homo sapiens
cttcaaagtctcaatg

SEQ ID NO: 828922 - DNA, 20 bp, Homo sapiens
cttcaaagtctcaatgaaat

SEQ ID NO: 828923 - DNA, 22 bp, Homo sapiens
cttcaaagtctcaatgaaatag

SEQ ID NO: 828924 - DNA, 16 bp, Homo sapiens
cttcaaagtttaataa

SEQ ID NO: 828925 - DNA, 14 bp, Homo sapiens
cttcaaatccatcc

SEQ ID NO: 828926 - DNA, 15 bp, Homo sapiens
cttccaaaaaattaa

SEQ ID NO: 828927 - DNA, 22 bp, Homo sapiens
cttccaaaacctgcttccttca

SEQ ID NO: 828928 - DNA, 12 bp, Homo sapiens
cttccaaagaaa

SEQ ID NO: 828929 - DNA, 13 bp, Homo sapiens
cttccaaagccta

SEQ ID NO: 828930 - DNA, 12 bp, Homo sapiens
cttccaaagctt

SEQ ID NO: 828931 - DNA, 22 bp, Homo sapiens
cttccaaagcttcgtcttgtgt

SEQ ID NO: 828932 - DNA, 21 bp, Homo sapiens
cttccaaagtaaaattgctgt

SEQ ID NO: 828933 - DNA, 16 bp, Homo sapiens
cttccaaatcccctaa

SEQ ID NO: 828934 - DNA, 19 bp, Homo sapiens
cttccaaatcccctaagca

SEQ ID NO: 828935 - DNA, 23 bp, Homo sapiens
cttccaaatcctggaaggacaca

SEQ ID NO: 828936 - DNA, 15 bp, Homo sapiens
cttccaaatgtccct

SEQ ID NO: 828937 - DNA, 17 bp, Homo sapiens
cttccaagactgaagac

SEQ ID NO: 828938 - DNA, 13 bp, Homo sapiens
cttccaaggagac

SEQ ID NO: 828939 - DNA, 14 bp, Homo sapiens
cttccaaggagcag

SEQ ID NO: 828940 - DNA, 20 bp, Homo sapiens
cttccaaggagcagagaggt

SEQ ID NO: 828941 - DNA, 15 bp, Homo sapiens
cttccaaggccagaa

SEQ ID NO: 828942 - DNA, 15 bp, Homo sapiens
cttccaaggccctgc

SEQ ID NO: 828943 - DNA, 19 bp, Homo sapiens
cttccaaggtcactcttgg

SEQ ID NO: 828944 - DNA, 20 bp, Homo sapiens
cttccaaggtcactcttggt

SEQ ID NO: 828945 - DNA, 11 bp, Homo sapiens
cttccacaaac

SEQ ID NO: 828946 - DNA, 23 bp, Homo sapiens
cttccacaaagaaaattcctata

SEQ ID NO: 828947 - DNA, 17 bp, Homo sapiens
cttccacagcagcagaa

SEQ ID NO: 828948 - DNA, 16 bp, Homo sapiens
cttccacatgttactg

SEQ ID NO: 828949 - DNA, 13 bp, Homo sapiens
cttccaccacaga

SEQ ID NO: 828950 - DNA, 23 bp, Homo sapiens
cttccacccgtctctctgcccac

SEQ ID NO: 828951 - DNA, 16 bp, Homo sapiens
cttccacctcagcctc

SEQ ID NO: 828952 - DNA, 12 bp, Homo sapiens
cttccacctcat

SEQ ID NO: 828953 - DNA, 13 bp, Homo sapiens
cttccacctcatg

SEQ ID NO: 828954 - DNA, 23 bp, Homo sapiens
cttccacctcatggattgccaca

SEQ ID NO: 828955 - DNA, 17 bp, Homo sapiens
cttccacctcctagagg

SEQ ID NO: 828956 - DNA, 15 bp, Homo sapiens
cttccacctgtgccc

SEQ ID NO: 828957 - DNA, 17 bp, Homo sapiens
cttccacctgtgccctc

SEQ ID NO: 828958 - DNA, 16 bp, Homo sapiens
cttccacgctgtctcc

SEQ ID NO: 828959 - DNA, 17 bp, Homo sapiens
cttccacgctgtctcca

SEQ ID NO: 828960 - DNA, 22 bp, Homo sapiens
cttccacgctgtctccagaccc

SEQ ID NO: 828961 - DNA, 14 bp, Homo sapiens
cttccactgtagct

SEQ ID NO: 828962 - DNA, 16 bp, Homo sapiens
cttccactgtgcacct

SEQ ID NO: 828963 - DNA, 17 bp, Homo sapiens
cttccactgtgtgttga

SEQ ID NO: 828964 - DNA, 20 bp, Homo sapiens
cttccacttctccaagaatg

SEQ ID NO: 828965 - DNA, 20 bp, Homo sapiens
cttccacttttttttgtatg

SEQ ID NO: 828966 - DNA, 18 bp, Homo sapiens
cttccagaagatgccctc

SEQ ID NO: 828967 - DNA, 16 bp, Homo sapiens
cttccagaatcccaag

SEQ ID NO: 828968 - DNA, 23 bp, Homo sapiens
cttccagaatgctgaactccttg

SEQ ID NO: 828969 - DNA, 18 bp, Homo sapiens
cttccagagagtcctctg

SEQ ID NO: 828970 - DNA, 18 bp, Homo sapiens
cttccagaggacagctct

SEQ ID NO: 828971 - DNA, 15 bp, Homo sapiens
cttccagatcactgc

SEQ ID NO: 828972 - DNA, 18 bp, Homo sapiens
cttccagatcactgccac

SEQ ID NO: 828973 - DNA, 21 bp, Homo sapiens
cttccagcccagacccccagt

SEQ ID NO: 828974 - DNA, 12 bp, Homo sapiens
cttccagcctgg

SEQ ID NO: 828975 - DNA, 16 bp, Homo sapiens
cttccagcctgggaca

SEQ ID NO: 828976 - DNA, 14 bp, Homo sapiens
cttccagctgctgt

SEQ ID NO: 828977 - DNA, 18 bp, Homo sapiens
cttccaggaaactccaca

SEQ ID NO: 828978 - DNA, 21 bp, Homo sapiens
cttccaggaaactccacatct

SEQ ID NO: 828979 - DNA, 22 bp, Homo sapiens
cttccaggatggatgcatcaca

SEQ ID NO: 828980 - DNA, 17 bp, Homo sapiens
cttccaggctcttcctg

SEQ ID NO: 828981 - DNA, 15 bp, Homo sapiens
cttccaggctgggca

SEQ ID NO: 828982 - DNA, 14 bp, Homo sapiens
cttccaggtccaaa

SEQ ID NO: 828983 - DNA, 16 bp, Homo sapiens
cttccaggtgttactg

SEQ ID NO: 828984 - DNA, 20 bp, Homo sapiens
cttccaggtgttactgtaat

SEQ ID NO: 828985 - DNA, 20 bp, Homo sapiens
cttccagtctggagagctgt

SEQ ID NO: 828986 - DNA, 21 bp, Homo sapiens
cttccagtgttggctgtgtga

SEQ ID NO: 828987 - DNA, 23 bp, Homo sapiens
cttccagtgttggctgtgtgaca

SEQ ID NO: 828988 - DNA, 21 bp, Homo sapiens
cttccataatctggactcctc

SEQ ID NO: 828989 - DNA, 11 bp, Homo sapiens
cttccataatg

SEQ ID NO: 828990 - DNA, 18 bp, Homo sapiens
cttccataggacatactg

SEQ ID NO: 828991 - DNA, 23 bp, Homo sapiens
cttccataggacatactgcatgt

SEQ ID NO: 828992 - DNA, 20 bp, Homo sapiens
cttccatatccctgcccagc

SEQ ID NO: 828993 - DNA, 23 bp, Homo sapiens
cttccatcagcgggtctcctccc

SEQ ID NO: 828994 - DNA, 17 bp, Homo sapiens
cttccatcatcactgta

SEQ ID NO: 828995 - DNA, 18 bp, Homo sapiens
cttccatcatcactgtaa

SEQ ID NO: 828996 - DNA, 17 bp, Homo sapiens
cttccatccctaccccc

SEQ ID NO: 828997 - DNA, 19 bp, Homo sapiens
cttccatctagcagctggc

SEQ ID NO: 828998 - DNA, 13 bp, Homo sapiens
cttccatgaattt

SEQ ID NO: 828999 - DNA, 19 bp, Homo sapiens
cttccatgaattttaaaat

SEQ ID NO: 829000 - DNA, 14 bp, Homo sapiens
cttccatgacctcc

SEQ ID NO: 829001 - DNA, 15 bp, Homo sapiens
cttccatgacctccc

SEQ ID NO: 829002 - DNA, 17 bp, Homo sapiens
cttccatgacctcccct

SEQ ID NO: 829003 - DNA, 18 bp, Homo sapiens
cttccatgacctcccctc

SEQ ID NO: 829004 - DNA, 21 bp, Homo sapiens
cttccatgagaacagcagggt

SEQ ID NO: 829005 - DNA, 22 bp, Homo sapiens
cttccatgccctgggatgcctc

SEQ ID NO: 829006 - DNA, 13 bp, Homo sapiens
cttccatgcctta

SEQ ID NO: 829007 - DNA, 15 bp, Homo sapiens
cttccatgctgtgcg

SEQ ID NO: 829008 - DNA, 19 bp, Homo sapiens
cttccatgtatcttttgaa

SEQ ID NO: 829009 - DNA, 17 bp, Homo sapiens
cttccatgtcaggccag

SEQ ID NO: 829010 - DNA, 16 bp, Homo sapiens
cttccatgtcgcctct

SEQ ID NO: 829011 - DNA, 18 bp, Homo sapiens
cttccattggttcttcct

SEQ ID NO: 829012 - DNA, 14 bp, Homo sapiens
cttccatttgcaag

SEQ ID NO: 829013 - DNA, 23 bp, Homo sapiens
cttccattttcccccactactgc

SEQ ID NO: 829014 - DNA, 20 bp, Homo sapiens
cttcccaaacccagtctcct

SEQ ID NO: 829015 - DNA, 21 bp, Homo sapiens
cttcccacaaaagacagaccc

SEQ ID NO: 829016 - DNA, 13 bp, Homo sapiens
cttcccacaccag

SEQ ID NO: 829017 - DNA, 14 bp, Homo sapiens
cttcccacatgcct

SEQ ID NO: 829018 - DNA, 21 bp, Homo sapiens
cttcccacccatcgctgtgtg

SEQ ID NO: 829019 - DNA, 15 bp, Homo sapiens
cttcccacctactgc

SEQ ID NO: 829020 - DNA, 18 bp, Homo sapiens
cttcccacctactgcact

SEQ ID NO: 829021 - DNA, 22 bp, Homo sapiens
cttcccacctactgcactttcc

SEQ ID NO: 829022 - DNA, 20 bp, Homo sapiens
cttcccagaggagcagctct

SEQ ID NO: 829023 - DNA, 21 bp, Homo sapiens
cttcccagcagggccactccc

SEQ ID NO: 829024 - DNA, 14 bp, Homo sapiens
cttcccagctctcc

SEQ ID NO: 829025 - DNA, 21 bp, Homo sapiens
cttcccagctctccctctggc

SEQ ID NO: 829026 - DNA, 22 bp, Homo sapiens
cttcccagctctccctctggcc

SEQ ID NO: 829027 - DNA, 13 bp, Homo sapiens
cttcccagctctg

SEQ ID NO: 829028 - DNA, 22 bp, Homo sapiens
cttcccaggcctttggagggga

SEQ ID NO: 829029 - DNA, 19 bp, Homo sapiens
cttcccagtataagatttt

SEQ ID NO: 829030 - DNA, 23 bp, Homo sapiens
cttcccagtataagatttttgaa

SEQ ID NO: 829031 - DNA, 12 bp, Homo sapiens
cttcccatccta

SEQ ID NO: 829032 - DNA, 15 bp, Homo sapiens
cttcccatcctaccc

SEQ ID NO: 829033 - DNA, 17 bp, Homo sapiens
cttcccatctccaggga

SEQ ID NO: 829034 - DNA, 23 bp, Homo sapiens
cttcccatgactgcacccagctc

SEQ ID NO: 829035 - DNA, 14 bp, Homo sapiens
cttcccatgcctgt

SEQ ID NO: 829036 - DNA, 18 bp, Homo sapiens
cttcccattgtggctcct

SEQ ID NO: 829037 - DNA, 18 bp, Homo sapiens
cttccccaacttccctag

SEQ ID NO: 829038 - DNA, 22 bp, Homo sapiens
cttccccaagggccaaacccac

SEQ ID NO: 829039 - DNA, 16 bp, Homo sapiens
cttccccaccaagtct

SEQ ID NO: 829040 - DNA, 12 bp, Homo sapiens
cttccccagact

SEQ ID NO: 829041 - DNA, 13 bp, Homo sapiens
cttccccagccct

SEQ ID NO: 829042 - DNA, 10 bp, Homo sapiens
cttccccagg

SEQ ID NO: 829043 - DNA, 15 bp, Homo sapiens
cttccccaggcccac

SEQ ID NO: 829044 - DNA, 17 bp, Homo sapiens
cttccccatcagctccc

SEQ ID NO: 829045 - DNA, 12 bp, Homo sapiens
cttccccatccc

SEQ ID NO: 829046 - DNA, 18 bp, Homo sapiens
cttccccatttccactgt

SEQ ID NO: 829047 - DNA, 19 bp, Homo sapiens
cttcccccacccctccacg

SEQ ID NO: 829048 - DNA, 16 bp, Homo sapiens
cttcctgtttttcaca

SEQ ID NO: 829049 - DNA, 17 bp, Homo sapiens
cttcctgtttttcacat

SEQ ID NO: 829050 - DNA, 21 bp, Homo sapiens
cttccttaattcactcccaca

SEQ ID NO: 829051 - DNA, 14 bp, Homo sapiens
cttccttcaggact

SEQ ID NO: 829052 - DNA, 17 bp, Homo sapiens
cttccttcaggactctg

SEQ ID NO: 829053 - DNA, 22 bp, Homo sapiens
cttccttcaggactctgcggga

SEQ ID NO: 829054 - DNA, 12 bp, Homo sapiens
cttccttcccac

SEQ ID NO: 829055 - DNA, 13 bp, Homo sapiens
cttccttcccacc

SEQ ID NO: 829056 - DNA, 13 bp, Homo sapiens
cttccttccccca

SEQ ID NO: 829057 - DNA, 13 bp, Homo sapiens
cttccttccctgg

SEQ ID NO: 829058 - DNA, 18 bp, Homo sapiens
cttccttccctgggctgt

SEQ ID NO: 829059 - DNA, 13 bp, Homo sapiens
cttccttcctaga

SEQ ID NO: 829060 - DNA, 13 bp, Homo sapiens
cttccttcctgtt

SEQ ID NO: 829061 - DNA, 21 bp, Homo sapiens
cttccttctaccccaaggcca

SEQ ID NO: 829062 - DNA, 19 bp, Homo sapiens
cttccttctgctcccaccc

SEQ ID NO: 829063 - DNA, 23 bp, Homo sapiens
cttccttgacctgcattgtaaat

SEQ ID NO: 829064 - DNA, 15 bp, Homo sapiens
cttccttgctctgca

SEQ ID NO: 829065 - DNA, 17 bp, Homo sapiens
cttccttgctgtcctag

SEQ ID NO: 829066 - DNA, 19 bp, Homo sapiens
cttccttggcatcacaggg

SEQ ID NO: 829067 - DNA, 12 bp, Homo sapiens
cttccttgggcg

SEQ ID NO: 829068 - DNA, 13 bp, Homo sapiens
cttccttgtctct

SEQ ID NO: 829069 - DNA, 16 bp, Homo sapiens
cttcctttaaaaaact

SEQ ID NO: 829070 - DNA, 15 bp, Homo sapiens
cttcctttactttcc

SEQ ID NO: 829071 - DNA, 17 bp, Homo sapiens
cttcctttactttccct

SEQ ID NO: 829072 - DNA, 18 bp, Homo sapiens
cttcctttactttccctt

SEQ ID NO: 829073 - DNA, 21 bp, Homo sapiens
cttcctttactttcccttgct

SEQ ID NO: 829074 - DNA, 19 bp, Homo sapiens
cttcctttaggtctggttg

SEQ ID NO: 829075 - DNA, 14 bp, Homo sapiens
cttcctttcctact

SEQ ID NO: 829076 - DNA, 15 bp, Homo sapiens
cttcctttcctactg

SEQ ID NO: 829077 - DNA, 21 bp, Homo sapiens
cttcctttcctactgtcctgg

SEQ ID NO: 829078 - DNA, 12 bp, Homo sapiens
cttcctttcctc

SEQ ID NO: 829079 - DNA, 13 bp, Homo sapiens
cttcctttcctct

SEQ ID NO: 829080 - DNA, 14 bp, Homo sapiens
cttcctttcctctg

SEQ ID NO: 829081 - DNA, 19 bp, Homo sapiens
cttcctttctccaggacca

SEQ ID NO: 829082 - DNA, 19 bp, Homo sapiens
cttcctttctctcctggct

SEQ ID NO: 829083 - DNA, 17 bp, Homo sapiens
cttcctttcttgtcttt

SEQ ID NO: 829084 - DNA, 23 bp, Homo sapiens
cttcctttcttgtctttcctcct

SEQ ID NO: 829085 - DNA, 11 bp, Homo sapiens
cttcctttggg

SEQ ID NO: 829086 - DNA, 14 bp, Homo sapiens
cttccttttaactg

SEQ ID NO: 829087 - DNA, 21 bp, Homo sapiens
cttccttttagcctagttcat

SEQ ID NO: 829088 - DNA, 14 bp, Homo sapiens
cttccttttccctg

SEQ ID NO: 829089 - DNA, 17 bp, Homo sapiens
cttccttttccctgctt

SEQ ID NO: 829090 - DNA, 15 bp, Homo sapiens
cttcgaaacctggga

SEQ ID NO: 829091 - DNA, 20 bp, Homo sapiens
cttcgaaagcatcattattt

SEQ ID NO: 829092 - DNA, 16 bp, Homo sapiens
cttcgaaaggccttca

SEQ ID NO: 829093 - DNA, 18 bp, Homo sapiens
cttcgaaaggccttcaga

SEQ ID NO: 829094 - DNA, 20 bp, Homo sapiens
cttcgaaaggccttcagaca

SEQ ID NO: 829095 - DNA, 17 bp, Homo sapiens
cttcgacatgctgccag

SEQ ID NO: 829096 - DNA, 13 bp, Homo sapiens
cttcgactactgc

SEQ ID NO: 829097 - DNA, 18 bp, Homo sapiens
cttcgactactgctcctg

SEQ ID NO: 829098 - DNA, 22 bp, Homo sapiens
cttcgactactgctcctgtggc

SEQ ID NO: 829099 - DNA, 18 bp, Homo sapiens
cttcgactcaggatccag

SEQ ID NO: 829100 - DNA, 14 bp, Homo sapiens
cttcgaggacagga

SEQ ID NO: 829101 - DNA, 16 bp, Homo sapiens
cttcgagttcccaggg

SEQ ID NO: 829102 - DNA, 21 bp, Homo sapiens
cttcgatacaccgggcctgga

SEQ ID NO: 829103 - DNA, 16 bp, Homo sapiens
cttcgccctctgaaat

SEQ ID NO: 829104 - DNA, 18 bp, Homo sapiens
cttcgccctctgaaatta

SEQ ID NO: 829105 - DNA, 13 bp, Homo sapiens
cttcgcctgcagc

SEQ ID NO: 829106 - DNA, 19 bp, Homo sapiens
cttcgcgtgccctcgctgc

SEQ ID NO: 829107 - DNA, 16 bp, Homo sapiens
cttcgctcctcctctc

SEQ ID NO: 829108 - DNA, 20 bp, Homo sapiens
cttcgctgctagagaagggg

SEQ ID NO: 829109 - DNA, 17 bp, Homo sapiens
cttcgctgctctagctg

SEQ ID NO: 829110 - DNA, 20 bp, Homo sapiens
cttcgctgctctagctggca

SEQ ID NO: 829111 - DNA, 15 bp, Homo sapiens
cttcgcttcttgcct

SEQ ID NO: 829112 - DNA, 16 bp, Homo sapiens
cttcgcttcttgcctc

SEQ ID NO: 829113 - DNA, 18 bp, Homo sapiens
cttcgcttcttgcctctg

SEQ ID NO: 829114 - DNA, 14 bp, Homo sapiens
cttcggacaaaata

SEQ ID NO: 829115 - DNA, 14 bp, Homo sapiens
cttcggaccgcttg

SEQ ID NO: 829116 - DNA, 18 bp, Homo sapiens
cttcggagggcccctgcg

SEQ ID NO: 829117 - DNA, 14 bp, Homo sapiens
cttcggagggccgc

SEQ ID NO: 829118 - DNA, 20 bp, Homo sapiens
cttcggagggccgcagggcc

SEQ ID NO: 829119 - DNA, 13 bp, Homo sapiens
cttcggcatttga

SEQ ID NO: 829120 - DNA, 16 bp, Homo sapiens
cttcgggaccctgggg

SEQ ID NO: 829121 - DNA, 19 bp, Homo sapiens
cttcgggaggtcgaggcag

SEQ ID NO: 829122 - DNA, 17 bp, Homo sapiens
cttcgggcccttcccac

SEQ ID NO: 829123 - DNA, 14 bp, Homo sapiens
cttcgggctgtgcc

SEQ ID NO: 829124 - DNA, 15 bp, Homo sapiens
cttcgggctgtgccc

SEQ ID NO: 829125 - DNA, 15 bp, Homo sapiens
cttcggtgtgcagat

SEQ ID NO: 829126 - DNA, 21 bp, Homo sapiens
cttcgtaagaaggaatgcgag

SEQ ID NO: 829127 - DNA, 19 bp, Homo sapiens
cttcgtatcccgagtctgg

SEQ ID NO: 829128 - DNA, 21 bp, Homo sapiens
cttcgtatcccgagtctggga

SEQ ID NO: 829129 - DNA, 18 bp, Homo sapiens
cttcgtcttgtgtttgct

SEQ ID NO: 829130 - DNA, 13 bp, Homo sapiens
cttcgtgaacata

SEQ ID NO: 829131 - DNA, 17 bp, Homo sapiens
cttcgtgcccccccttc

SEQ ID NO: 829132 - DNA, 17 bp, Homo sapiens
cttcgtgctggaggaac

SEQ ID NO: 829133 - DNA, 22 bp, Homo sapiens
cttcgtgtctctcccaccccgg

SEQ ID NO: 829134 - DNA, 14 bp, Homo sapiens
cttcgtgtgctgct

SEQ ID NO: 829135 - DNA, 17 bp, Homo sapiens
cttcgtgtgctgctgct

SEQ ID NO: 829136 - DNA, 14 bp, Homo sapiens
cttcgtgtggctcc

SEQ ID NO: 829137 - DNA, 15 bp, Homo sapiens
cttcgtgtggctcct

SEQ ID NO: 829138 - DNA, 18 bp, Homo sapiens
cttcgttagaatgtctgc

SEQ ID NO: 829139 - DNA, 17 bp, Homo sapiens
cttcgttcgcagagctt

SEQ ID NO: 829140 - DNA, 15 bp, Homo sapiens
cttcgttctttttaa

SEQ ID NO: 829141 - DNA, 18 bp, Homo sapiens
cttcgtttattttcaaga

SEQ ID NO: 829142 - DNA, 14 bp, Homo sapiens
cttctaagaagaca

SEQ ID NO: 829143 - DNA, 20 bp, Homo sapiens
cttctaagaagacattttgt

SEQ ID NO: 829144 - DNA, 15 bp, Homo sapiens
cttctaagataaaaa

SEQ ID NO: 829145 - DNA, 16 bp, Homo sapiens
cttctaagataaaaat

SEQ ID NO: 829146 - DNA, 18 bp, Homo sapiens
cttctaagtaaatacaat

SEQ ID NO: 829147 - DNA, 21 bp, Homo sapiens
cttctaagtaaatacaatttt

SEQ ID NO: 829148 - DNA, 17 bp, Homo sapiens
cttctaataaagtcatt

SEQ ID NO: 829149 - DNA, 11 bp, Homo sapiens
cttctaatata

SEQ ID NO: 829150 - DNA, 18 bp, Homo sapiens
cttctaatatatttttat

SEQ ID NO: 829151 - DNA, 13 bp, Homo sapiens
cttctaattattt

SEQ ID NO: 829152 - DNA, 20 bp, Homo sapiens
cttctaatttatattatcca

SEQ ID NO: 829153 - DNA, 19 bp, Homo sapiens
cttctacatgatgctaaag

SEQ ID NO: 829154 - DNA, 18 bp, Homo sapiens
cttctacatttgagggcc

SEQ ID NO: 829155 - DNA, 19 bp, Homo sapiens
cttctaccccaaggccagt

SEQ ID NO: 829156 - DNA, 22 bp, Homo sapiens
cttctaccccaaggccagtagt

SEQ ID NO: 829157 - DNA, 14 bp, Homo sapiens
cttctacctgccct

SEQ ID NO: 829158 - DNA, 16 bp, Homo sapiens
cttctacctgccctca

SEQ ID NO: 829159 - DNA, 18 bp, Homo sapiens
cttctactgagccttcag

SEQ ID NO: 829160 - DNA, 16 bp, Homo sapiens
cttctagaaactctgg

SEQ ID NO: 829161 - DNA, 18 bp, Homo sapiens
cttctagaaactctggct

SEQ ID NO: 829162 - DNA, 19 bp, Homo sapiens
cttctagaaactctggctc

SEQ ID NO: 829163 - DNA, 19 bp, Homo sapiens
cttctagaatgtctgaagt

SEQ ID NO: 829164 - DNA, 23 bp, Homo sapiens
cttctagagatgtgcctgtggga

SEQ ID NO: 829165 - DNA, 12 bp, Homo sapiens
cttctagagcct

SEQ ID NO: 829166 - DNA, 16 bp, Homo sapiens
cttctagctgcagatg

SEQ ID NO: 829167 - DNA, 17 bp, Homo sapiens
cttctagctgtctgtga

SEQ ID NO: 829168 - DNA, 20 bp, Homo sapiens
cttctaggcccattgtcctc

SEQ ID NO: 829169 - DNA, 21 bp, Homo sapiens
cttctaggcccattgtcctcc

SEQ ID NO: 829170 - DNA, 22 bp, Homo sapiens
cttctaggcccattgtcctcct

SEQ ID NO: 829171 - DNA, 18 bp, Homo sapiens
cttctgaatattttatct

SEQ ID NO: 829172 - DNA, 12 bp, Homo sapiens
cttctgaatcac

SEQ ID NO: 829173 - DNA, 15 bp, Homo sapiens
cttctgaatgctgct

SEQ ID NO: 829174 - DNA, 19 bp, Homo sapiens
cttctgaatgctgctactt

SEQ ID NO: 829175 - DNA, 15 bp, Homo sapiens
cttctgacagcccaa

SEQ ID NO: 829176 - DNA, 19 bp, Homo sapiens
cttctgaccacacttcctg

SEQ ID NO: 829177 - DNA, 21 bp, Homo sapiens
cttctgaccacagcatcattt

SEQ ID NO: 829178 - DNA, 17 bp, Homo sapiens
cttctgacccaaagcaa

SEQ ID NO: 829179 - DNA, 18 bp, Homo sapiens
cttctgacccaaagcaaa

SEQ ID NO: 829180 - DNA, 17 bp, Homo sapiens
cttctgaccttgctgcc

SEQ ID NO: 829181 - DNA, 13 bp, Homo sapiens
cttctgactgctg

SEQ ID NO: 829182 - DNA, 14 bp, Homo sapiens
cttctgactgtcac

SEQ ID NO: 829183 - DNA, 14 bp, Homo sapiens
cttctgactttact

SEQ ID NO: 829184 - DNA, 16 bp, Homo sapiens
cttctgagctatttca

SEQ ID NO: 829185 - DNA, 17 bp, Homo sapiens
cttctgagctatttcat

SEQ ID NO: 829186 - DNA, 14 bp, Homo sapiens
cttctgagctccac

SEQ ID NO: 829187 - DNA, 15 bp, Homo sapiens
cttctgagctccacc

SEQ ID NO: 829188 - DNA, 22 bp, Homo sapiens
cttctgaggaccgctgataagc

SEQ ID NO: 829189 - DNA, 15 bp, Homo sapiens
cttctgagtattctc

SEQ ID NO: 829190 - DNA, 13 bp, Homo sapiens
cttctgagtggtg

SEQ ID NO: 829191 - DNA, 18 bp, Homo sapiens
cttctgcaccctccaccc

SEQ ID NO: 829192 - DNA, 15 bp, Homo sapiens
cttctgcagcctcgg

SEQ ID NO: 829193 - DNA, 19 bp, Homo sapiens
cttctgccctttcctaggc

SEQ ID NO: 829194 - DNA, 19 bp, Homo sapiens
cttctgcctaacttgtaaa

SEQ ID NO: 829195 - DNA, 21 bp, Homo sapiens
cttctgcctctaagctgctct

SEQ ID NO: 829196 - DNA, 15 bp, Homo sapiens
cttctgcctggagac

SEQ ID NO: 829197 - DNA, 16 bp, Homo sapiens
cttctgcctggagact

SEQ ID NO: 829198 - DNA, 13 bp, Homo sapiens
cttctgccttttc

SEQ ID NO: 829199 - DNA, 16 bp, Homo sapiens
cttctgcgcctcaggc

SEQ ID NO: 829200 - DNA, 17 bp, Homo sapiens
cttctgcgggctccctc

SEQ ID NO: 829201 - DNA, 19 bp, Homo sapiens
cttctgcgggctccctcct

SEQ ID NO: 829202 - DNA, 20 bp, Homo sapiens
cttctgcgtccaccaggcct

SEQ ID NO: 829203 - DNA, 21 bp, Homo sapiens
cttctgcgtccaccaggcctc

SEQ ID NO: 829204 - DNA, 13 bp, Homo sapiens
cttctgctactgg

SEQ ID NO: 829205 - DNA, 14 bp, Homo sapiens
cttctgctcagctc

SEQ ID NO: 829206 - DNA, 10 bp, Homo sapiens
cttctgctcc

SEQ ID NO: 829207 - DNA, 14 bp, Homo sapiens
cttctgctccaccc

SEQ ID NO: 829208 - DNA, 21 bp, Homo sapiens
cttctgctccacccttggcct

SEQ ID NO: 829209 - DNA, 23 bp, Homo sapiens
cttctgctccacccttggcctgt

SEQ ID NO: 829210 - DNA, 17 bp, Homo sapiens
cttctgctccagcccct

SEQ ID NO: 829211 - DNA, 22 bp, Homo sapiens
cttctgctccagcccctttgcc

SEQ ID NO: 829212 - DNA, 13 bp, Homo sapiens
cttctgctcccac

SEQ ID NO: 829213 - DNA, 17 bp, Homo sapiens
cttctgctcccacccca

SEQ ID NO: 829214 - DNA, 13 bp, Homo sapiens
cttctgctcctta

SEQ ID NO: 829215 - DNA, 15 bp, Homo sapiens
cttctgctggaggag

SEQ ID NO: 829216 - DNA, 18 bp, Homo sapiens
cttctgcttttctgccct

SEQ ID NO: 829217 - DNA, 20 bp, Homo sapiens
cttctgcttttctgccctgg

SEQ ID NO: 829218 - DNA, 17 bp, Homo sapiens
cttctggaaggctggct

SEQ ID NO: 829219 - DNA, 18 bp, Homo sapiens
cttctggaaggctggctg

SEQ ID NO: 829220 - DNA, 19 bp, Homo sapiens
cttctggaaggctggctga

SEQ ID NO: 829221 - DNA, 16 bp, Homo sapiens
cttctggaatttgttc

SEQ ID NO: 829222 - DNA, 19 bp, Homo sapiens
cttctggacactgagaggg

SEQ ID NO: 829223 - DNA, 18 bp, Homo sapiens
cttctggacaggctctgc

SEQ ID NO: 829224 - DNA, 21 bp, Homo sapiens
cttctggacaggctctgcttc

SEQ ID NO: 829225 - DNA, 15 bp, Homo sapiens
cttctggagctggga

SEQ ID NO: 829226 - DNA, 16 bp, Homo sapiens
cttctggagtctccag

SEQ ID NO: 829227 - DNA, 17 bp, Homo sapiens
cttctggagtttctcta

SEQ ID NO: 829228 - DNA, 17 bp, Homo sapiens
cttctggcatgggacag

SEQ ID NO: 829229 - DNA, 16 bp, Homo sapiens
cttctggccacatcag

SEQ ID NO: 829230 - DNA, 19 bp, Homo sapiens
cttctggccacatcagccc

SEQ ID NO: 829231 - DNA, 15 bp, Homo sapiens
cttctggcctccagc

SEQ ID NO: 829232 - DNA, 17 bp, Homo sapiens
cttctggcctccagcct

SEQ ID NO: 829233 - DNA, 12 bp, Homo sapiens
cttctggctcaa

SEQ ID NO: 829234 - DNA, 15 bp, Homo sapiens
cttctggctcacagg

SEQ ID NO: 829235 - DNA, 17 bp, Homo sapiens
cttctgggactggacag

SEQ ID NO: 829236 - DNA, 19 bp, Homo sapiens
cttctgggactggacagct

SEQ ID NO: 829237 - DNA, 16 bp, Homo sapiens
cttctgggcaaggggg

SEQ ID NO: 829238 - DNA, 16 bp, Homo sapiens
cttctgggctactgcc

SEQ ID NO: 829239 - DNA, 24 bp, Homo sapiens
cttctgggctactgccactgtgtg

SEQ ID NO: 829240 - DNA, 17 bp, Homo sapiens
cttctgggcttcattct

SEQ ID NO: 829241 - DNA, 15 bp, Homo sapiens
cttctgggctttttc

SEQ ID NO: 829242 - DNA, 21 bp, Homo sapiens
cttctggggcaggctgggcca

SEQ ID NO: 829243 - DNA, 18 bp, Homo sapiens
cttctggggtcaggtgcc

SEQ ID NO: 829244 - DNA, 24 bp, Homo sapiens
cttctgggtagtcccctgttgatt

SEQ ID NO: 829245 - DNA, 17 bp, Homo sapiens
cttctgggtcatgcact

SEQ ID NO: 829246 - DNA, 23 bp, Homo sapiens
cttctgggttccttcctctgagc

SEQ ID NO: 829247 - DNA, 19 bp, Homo sapiens
cttctggtactctcctaga

SEQ ID NO: 829248 - DNA, 15 bp, Homo sapiens
cttctggtatcttgt

SEQ ID NO: 829249 - DNA, 17 bp, Homo sapiens
cttctggttatttatgg

SEQ ID NO: 829250 - DNA, 19 bp, Homo sapiens
cttctggttgtatttctat

SEQ ID NO: 829251 - DNA, 15 bp, Homo sapiens
cttctgtaattgtgt

SEQ ID NO: 829252 - DNA, 18 bp, Homo sapiens
cttctgtaggaattcttt

SEQ ID NO: 829253 - DNA, 15 bp, Homo sapiens
cttctgtagtactcc

SEQ ID NO: 829254 - DNA, 16 bp, Homo sapiens
cttctgtccaccagac

SEQ ID NO: 829255 - DNA, 14 bp, Homo sapiens
cttctgtccaggac

SEQ ID NO: 829256 - DNA, 23 bp, Homo sapiens
cttctgtccaggacatgatactg

SEQ ID NO: 829257 - DNA, 16 bp, Homo sapiens
cttctgtccatcagtg

SEQ ID NO: 829258 - DNA, 14 bp, Homo sapiens
cttctgtccccagc

SEQ ID NO: 829259 - DNA, 15 bp, Homo sapiens
cttctgtccccagcc

SEQ ID NO: 829260 - DNA, 20 bp, Homo sapiens
cttctgtgagacccccacac

SEQ ID NO: 829261 - DNA, 16 bp, Homo sapiens
cttctgtgcccagggt

SEQ ID NO: 829262 - DNA, 14 bp, Homo sapiens
cttctgtgggcatg

SEQ ID NO: 829263 - DNA, 20 bp, Homo sapiens
cttctgtgggcatggccgct

SEQ ID NO: 829264 - DNA, 16 bp, Homo sapiens
cttctgtggggctggg

SEQ ID NO: 829265 - DNA, 19 bp, Homo sapiens
cttctgtgtaccacttctg

SEQ ID NO: 829266 - DNA, 22 bp, Homo sapiens
cttctgtgtatctctttcacat

SEQ ID NO: 829267 - DNA, 12 bp, Homo sapiens
cttctgtgttca

SEQ ID NO: 829268 - DNA, 15 bp, Homo sapiens
cttctgttaagaaag

SEQ ID NO: 829269 - DNA, 16 bp, Homo sapiens
cttctgttctctgctg

SEQ ID NO: 829270 - DNA, 14 bp, Homo sapiens
cttctgttgaaaca

SEQ ID NO: 829271 - DNA, 17 bp, Homo sapiens
cttctgttggcagagct

SEQ ID NO: 829272 - DNA, 14 bp, Homo sapiens
cttctgttgtaata

SEQ ID NO: 829273 - DNA, 16 bp, Homo sapiens
cttctgtttcttctct

SEQ ID NO: 829274 - DNA, 18 bp, Homo sapiens
cttctgtttcttctcttg

SEQ ID NO: 829275 - DNA, 15 bp, Homo sapiens
cttcttaaaggcctg

SEQ ID NO: 829276 - DNA, 15 bp, Homo sapiens
cttcttacccaaagc

SEQ ID NO: 829277 - DNA, 23 bp, Homo sapiens
cttcttacccgaaagcatcactg

SEQ ID NO: 829278 - DNA, 24 bp, Homo sapiens
cttcttagaaaattaaaataggca

SEQ ID NO: 829279 - DNA, 13 bp, Homo sapiens
cttcttatacatt

SEQ ID NO: 829280 - DNA, 16 bp, Homo sapiens
cttcttatacatttga

SEQ ID NO: 829281 - DNA, 22 bp, Homo sapiens
cttcttatggaattgatttgca

SEQ ID NO: 829282 - DNA, 17 bp, Homo sapiens
cttcttattctcactcc

SEQ ID NO: 829283 - DNA, 15 bp, Homo sapiens
cttcttcacccagct

SEQ ID NO: 829284 - DNA, 16 bp, Homo sapiens
cttcttcacccagcta

SEQ ID NO: 829285 - DNA, 18 bp, Homo sapiens
cttcttcacccagctaat

SEQ ID NO: 829286 - DNA, 23 bp, Homo sapiens
cttcttcacccagctaatctgta

SEQ ID NO: 829287 - DNA, 14 bp, Homo sapiens
cttcttcacctctt

SEQ ID NO: 829288 - DNA, 16 bp, Homo sapiens
cttcttcacctcttcc

SEQ ID NO: 829289 - DNA, 14 bp, Homo sapiens
cttcttcagagtga

SEQ ID NO: 829290 - DNA, 17 bp, Homo sapiens
cttcttcagcaggaagg

SEQ ID NO: 829291 - DNA, 22 bp, Homo sapiens
cttcttcatccaacttccaaga

SEQ ID NO: 829292 - DNA, 19 bp, Homo sapiens
cttcttcccctttgtcctg

SEQ ID NO: 829293 - DNA, 22 bp, Homo sapiens
cttgacattccttgtcaccagc

SEQ ID NO: 829294 - DNA, 20 bp, Homo sapiens
cttgacatttatcacctctg

SEQ ID NO: 829295 - DNA, 21 bp, Homo sapiens
cttgaccaggctgcctccctt

SEQ ID NO: 829296 - DNA, 22 bp, Homo sapiens
cttgaccatcgtccttcctctc

SEQ ID NO: 829297 - DNA, 13 bp, Homo sapiens
cttgaccctgcac

SEQ ID NO: 829298 - DNA, 14 bp, Homo sapiens
cttgaccctgcacc

SEQ ID NO: 829299 - DNA, 15 bp, Homo sapiens
cttgaccgtactctc

SEQ ID NO: 829300 - DNA, 18 bp, Homo sapiens
cttgaccgtactctcaca

SEQ ID NO: 829301 - DNA, 13 bp, Homo sapiens
cttgacctagctc

SEQ ID NO: 829302 - DNA, 14 bp, Homo sapiens
cttgacctctgtga

SEQ ID NO: 829303 - DNA, 17 bp, Homo sapiens
cttgacctgaggctgtg

SEQ ID NO: 829304 - DNA, 23 bp, Homo sapiens
cttgacctgaggctgtggtcaca

SEQ ID NO: 829305 - DNA, 20 bp, Homo sapiens
cttgactaaaaaaaaaagaa

SEQ ID NO: 829306 - DNA, 15 bp, Homo sapiens
cttgactcaggattt

SEQ ID NO: 829307 - DNA, 21 bp, Homo sapiens
cttgactcccaagtttccata

SEQ ID NO: 829308 - DNA, 16 bp, Homo sapiens
cttgactctaaatgca

SEQ ID NO: 829309 - DNA, 17 bp, Homo sapiens
cttgactctaaatgcag

SEQ ID NO: 829310 - DNA, 18 bp, Homo sapiens
cttgactctaaatgcagt

SEQ ID NO: 829311 - DNA, 19 bp, Homo sapiens
cttgactctactgatctga

SEQ ID NO: 829312 - DNA, 23 bp, Homo sapiens
cttgacttagacctatactgaaa

SEQ ID NO: 829313 - DNA, 13 bp, Homo sapiens
cttgactttctga

SEQ ID NO: 829314 - DNA, 14 bp, Homo sapiens
cttgactttctgat

SEQ ID NO: 829315 - DNA, 19 bp, Homo sapiens
cttgactttgctcctcaca

SEQ ID NO: 829316 - DNA, 11 bp, Homo sapiens
cttgagaaacc

SEQ ID NO: 829317 - DNA, 20 bp, Homo sapiens
cttgagaaccagtctcctca

SEQ ID NO: 829318 - DNA, 23 bp, Homo sapiens
cttgagaagacctcacctagaaa

SEQ ID NO: 829319 - DNA, 16 bp, Homo sapiens
cttgagacaatgtttt

SEQ ID NO: 829320 - DNA, 17 bp, Homo sapiens
cttgagacacggagccc

SEQ ID NO: 829321 - DNA, 16 bp, Homo sapiens
cttgagacctcagcca

SEQ ID NO: 829322 - DNA, 20 bp, Homo sapiens
cttgagagaaaaagtgcccc

SEQ ID NO: 829323 - DNA, 17 bp, Homo sapiens
cttgagagacccagctg

SEQ ID NO: 829324 - DNA, 21 bp, Homo sapiens
cttgagatctgtataaataag

SEQ ID NO: 829325 - DNA, 21 bp, Homo sapiens
cttgagatgtatgaaggcttt

SEQ ID NO: 829326 - DNA, 22 bp, Homo sapiens
cttgagatgtatgaaggctttt

SEQ ID NO: 829327 - DNA, 14 bp, Homo sapiens
cttgagcaataaag

SEQ ID NO: 829328 - DNA, 20 bp, Homo sapiens
cttgagcaataaagtggaaa

SEQ ID NO: 829329 - DNA, 23 bp, Homo sapiens
cttgagcatcaatcttgttactg

SEQ ID NO: 829330 - DNA, 21 bp, Homo sapiens
cttgagccacagtcactggat

SEQ ID NO: 829331 - DNA, 16 bp, Homo sapiens
cttgagccagtaattg

SEQ ID NO: 829332 - DNA, 15 bp, Homo sapiens
cttgagcccactcct

SEQ ID NO: 829333 - DNA, 11 bp, Homo sapiens
cttgagcccag

SEQ ID NO: 829334 - DNA, 20 bp, Homo sapiens
cttgagcccaggagtttgag

SEQ ID NO: 829335 - DNA, 13 bp, Homo sapiens
cttgagccctggc

SEQ ID NO: 829336 - DNA, 20 bp, Homo sapiens
cttgagccctggctgttctg

SEQ ID NO: 829337 - DNA, 20 bp, Homo sapiens
cttgagccgggcccctgggc

SEQ ID NO: 829338 - DNA, 18 bp, Homo sapiens
cttgagccttgaactttg

SEQ ID NO: 829339 - DNA, 19 bp, Homo sapiens
cttgagccttgaactttga

SEQ ID NO: 829340 - DNA, 16 bp, Homo sapiens
cttgagctgagatgga

SEQ ID NO: 829341 - DNA, 13 bp, Homo sapiens
cttgagctggcct

SEQ ID NO: 829342 - DNA, 17 bp, Homo sapiens
cttgagctggcctctct

SEQ ID NO: 829343 - DNA, 21 bp, Homo sapiens
cttgagctgttgtgagctttg

SEQ ID NO: 829344 - DNA, 12 bp, Homo sapiens
cttgagcttggc

SEQ ID NO: 829345 - DNA, 18 bp, Homo sapiens
cttgaggaaacaacagct

SEQ ID NO: 829346 - DNA, 13 bp, Homo sapiens
cttgaggacagac

SEQ ID NO: 829347 - DNA, 19 bp, Homo sapiens
cttgaggattgtggaaaac

SEQ ID NO: 829348 - DNA, 15 bp, Homo sapiens
cttgagggctgcagt

SEQ ID NO: 829349 - DNA, 15 bp, Homo sapiens
cttgaggggctaggt

SEQ ID NO: 829350 - DNA, 19 bp, Homo sapiens
cttgagggtgggccagcat

SEQ ID NO: 829351 - DNA, 21 bp, Homo sapiens
cttgagggtgggccagcatag

SEQ ID NO: 829352 - DNA, 14 bp, Homo sapiens
cttgaggtcttttg

SEQ ID NO: 829353 - DNA, 19 bp, Homo sapiens
cttgagtgagaagagcttg

SEQ ID NO: 829354 - DNA, 18 bp, Homo sapiens
cttgagttcctctgcagt

SEQ ID NO: 829355 - DNA, 20 bp, Homo sapiens
cttgagttgattcagctctg

SEQ ID NO: 829356 - DNA, 14 bp, Homo sapiens
cttgagttggctgt

SEQ ID NO: 829357 - DNA, 21 bp, Homo sapiens
cttgagtttgtcgctcatgtg

SEQ ID NO: 829358 - DNA, 19 bp, Homo sapiens
cttgagttttgataaagta

SEQ ID NO: 829359 - DNA, 13 bp, Homo sapiens
cttgataaatata

SEQ ID NO: 829360 - DNA, 16 bp, Homo sapiens
cttgataatacttgac

SEQ ID NO: 829361 - DNA, 18 bp, Homo sapiens
cttgataatattagtgat

SEQ ID NO: 829362 - DNA, 22 bp, Homo sapiens
cttgatacattcaaatttgtct

SEQ ID NO: 829363 - DNA, 16 bp, Homo sapiens
cttgatacccccctct

SEQ ID NO: 829364 - DNA, 22 bp, Homo sapiens
cttgatactaaaagttcttctc

SEQ ID NO: 829365 - DNA, 17 bp, Homo sapiens
cttgatataaaaaatct

SEQ ID NO: 829366 - DNA, 15 bp, Homo sapiens
cttgatcacagctcc

SEQ ID NO: 829367 - DNA, 17 bp, Homo sapiens
cttgatccagaagagcc

SEQ ID NO: 829368 - DNA, 18 bp, Homo sapiens
cttgatccagaagagccc

SEQ ID NO: 829369 - DNA, 17 bp, Homo sapiens
cttgatcctccaatgtc

SEQ ID NO: 829370 - DNA, 20 bp, Homo sapiens
cttgatcctccaatgtctaa

SEQ ID NO: 829371 - DNA, 17 bp, Homo sapiens
cttgatcgacttcttgg

SEQ ID NO: 829372 - DNA, 23 bp, Homo sapiens
cttgatcgacttcttggttttct

SEQ ID NO: 829373 - DNA, 19 bp, Homo sapiens
cttgatctgtgatttcttc

SEQ ID NO: 829374 - DNA, 18 bp, Homo sapiens
cttgatgactgctgattt

SEQ ID NO: 829375 - DNA, 13 bp, Homo sapiens
cttgatgatgtgg

SEQ ID NO: 829376 - DNA, 14 bp, Homo sapiens
cttgatgcacagag

SEQ ID NO: 829377 - DNA, 20 bp, Homo sapiens
cttgatgccaaaatgacttt

SEQ ID NO: 829378 - DNA, 13 bp, Homo sapiens
cttgatgccagag

SEQ ID NO: 829379 - DNA, 23 bp, Homo sapiens
cttgatgccagagggccagcagg

SEQ ID NO: 829380 - DNA, 16 bp, Homo sapiens
cttgatgggtgctgcc

SEQ ID NO: 829381 - DNA, 21 bp, Homo sapiens
cttgatgtcatgtacttcctg

SEQ ID NO: 829382 - DNA, 23 bp, Homo sapiens
cttgatgtgaagataatttgcat

SEQ ID NO: 829383 - DNA, 22 bp, Homo sapiens
cttgatgtgccattttaaaaaa

SEQ ID NO: 829384 - DNA, 18 bp, Homo sapiens
cttgatgtgttatctctt

SEQ ID NO: 829385 - DNA, 18 bp, Homo sapiens
cttgatgttccacctgcc

SEQ ID NO: 829386 - DNA, 21 bp, Homo sapiens
cttgatgttccacctgccaca

SEQ ID NO: 829387 - DNA, 23 bp, Homo sapiens
cttgatgttgcttagtcacttat

SEQ ID NO: 829388 - DNA, 15 bp, Homo sapiens
cttgattaaatcaac

SEQ ID NO: 829389 - DNA, 22 bp, Homo sapiens
cttgattataaatgtttggaaa

SEQ ID NO: 829390 - DNA, 16 bp, Homo sapiens
cttgattatccatatt

SEQ ID NO: 829391 - DNA, 22 bp, Homo sapiens
cttgattcaggaggtcatctga

SEQ ID NO: 829392 - DNA, 13 bp, Homo sapiens
cttgattcatctc

SEQ ID NO: 829393 - DNA, 17 bp, Homo sapiens
cttgattcatctctggt

SEQ ID NO: 829394 - DNA, 13 bp, Homo sapiens
cttgattcctggc

SEQ ID NO: 829395 - DNA, 16 bp, Homo sapiens
cttgattcctggctct

SEQ ID NO: 829396 - DNA, 21 bp, Homo sapiens
cttgattcctggtttgactca

SEQ ID NO: 829397 - DNA, 20 bp, Homo sapiens
cttgattctgcagtaaatct

SEQ ID NO: 829398 - DNA, 22 bp, Homo sapiens
cttgattctgcagtaaatcttt

SEQ ID NO: 829399 - DNA, 13 bp, Homo sapiens
cttgattgagaaa

SEQ ID NO: 829400 - DNA, 14 bp, Homo sapiens
cttgattgtacttg

SEQ ID NO: 829401 - DNA, 22 bp, Homo sapiens
cttgatttgatctttgtttaaa

SEQ ID NO: 829402 - DNA, 17 bp, Homo sapiens
cttgatttgcatggatt

SEQ ID NO: 829403 - DNA, 14 bp, Homo sapiens
cttgattttcaagc

SEQ ID NO: 829404 - DNA, 19 bp, Homo sapiens
cttgattttcaagctttca

SEQ ID NO: 829405 - DNA, 21 bp, Homo sapiens
cttgattttcaagctttcaaa

SEQ ID NO: 829406 - DNA, 12 bp, Homo sapiens
cttgcaaaaagt

SEQ ID NO: 829407 - DNA, 19 bp, Homo sapiens
cttgcaaagcgacagattc

SEQ ID NO: 829408 - DNA, 22 bp, Homo sapiens
cttgcaaagtatccctactgta

SEQ ID NO: 829409 - DNA, 18 bp, Homo sapiens
cttgcaaccaggcagctg

SEQ ID NO: 829410 - DNA, 21 bp, Homo sapiens
cttgcaacctcaccttcctgt

SEQ ID NO: 829411 - DNA, 19 bp, Homo sapiens
cttgcaactaaggacaaat

SEQ ID NO: 829412 - DNA, 20 bp, Homo sapiens
cttgcaactaaggacaaatt

SEQ ID NO: 829413 - DNA, 22 bp, Homo sapiens
cttgcaactaaggacaaattag

SEQ ID NO: 829414 - DNA, 21 bp, Homo sapiens
cttggacatctctctggcttc

SEQ ID NO: 829415 - DNA, 18 bp, Homo sapiens
cttggaccactcctgtcc

SEQ ID NO: 829416 - DNA, 21 bp, Homo sapiens
cttggaccactcctgtccctg

SEQ ID NO: 829417 - DNA, 16 bp, Homo sapiens
cttggaccagatctaa

SEQ ID NO: 829418 - DNA, 18 bp, Homo sapiens
cttggaccagtttgcaga

SEQ ID NO: 829419 - DNA, 19 bp, Homo sapiens
cttggaccagtttgcagag

SEQ ID NO: 829420 - DNA, 23 bp, Homo sapiens
cttggaccctggtgacctcctgt

SEQ ID NO: 829421 - DNA, 16 bp, Homo sapiens
cttggacccttggaaa

SEQ ID NO: 829422 - DNA, 13 bp, Homo sapiens
cttggacctctgc

SEQ ID NO: 829423 - DNA, 15 bp, Homo sapiens
cttggactcctccca

SEQ ID NO: 829424 - DNA, 18 bp, Homo sapiens
cttggactcctcccacaa

SEQ ID NO: 829425 - DNA, 14 bp, Homo sapiens
cttggactcttgct

SEQ ID NO: 829426 - DNA, 18 bp, Homo sapiens
cttggactcttgctcttt

SEQ ID NO: 829427 - DNA, 16 bp, Homo sapiens
cttggacttcctgggg

SEQ ID NO: 829428 - DNA, 18 bp, Homo sapiens
cttggacttcctggggcc

SEQ ID NO: 829429 - DNA, 14 bp, Homo sapiens
cttggagaaaataa

SEQ ID NO: 829430 - DNA, 16 bp, Homo sapiens
cttggagactcctggt

SEQ ID NO: 829431 - DNA, 19 bp, Homo sapiens
cttggagactcctggtctg

SEQ ID NO: 829432 - DNA, 17 bp, Homo sapiens
cttggagagagaggctg

SEQ ID NO: 829433 - DNA, 23 bp, Homo sapiens
cttggagagagaggctgcctcag

SEQ ID NO: 829434 - DNA, 15 bp, Homo sapiens
cttggagagcagctg

SEQ ID NO: 829435 - DNA, 16 bp, Homo sapiens
cttggagagcagctgg

SEQ ID NO: 829436 - DNA, 18 bp, Homo sapiens
cttggagaggagagtggc

SEQ ID NO: 829437 - DNA, 13 bp, Homo sapiens
cttggagcaggca

SEQ ID NO: 829438 - DNA, 18 bp, Homo sapiens
cttggagcgtggactggt

SEQ ID NO: 829439 - DNA, 13 bp, Homo sapiens
cttggagctgccg

SEQ ID NO: 829440 - DNA, 23 bp, Homo sapiens
cttggagctgtgagttctccctg

SEQ ID NO: 829441 - DNA, 12 bp, Homo sapiens
cttggaggaaat

SEQ ID NO: 829442 - DNA, 22 bp, Homo sapiens
cttggaggaagtatgagtgctg

SEQ ID NO: 829443 - DNA, 16 bp, Homo sapiens
cttggaggaatgacaa

SEQ ID NO: 829444 - DNA, 14 bp, Homo sapiens
cttggagggagagg

SEQ ID NO: 829445 - DNA, 20 bp, Homo sapiens
cttggagggagaggtggcag

SEQ ID NO: 829446 - DNA, 14 bp, Homo sapiens
cttggagggtctgg

SEQ ID NO: 829447 - DNA, 17 bp, Homo sapiens
cttggagggtctggggg

SEQ ID NO: 829448 - DNA, 23 bp, Homo sapiens
cttggagggtctgggggcagctg

SEQ ID NO: 829449 - DNA, 17 bp, Homo sapiens
cttggataccagctcag

SEQ ID NO: 829450 - DNA, 19 bp, Homo sapiens
cttggataccagctcaggg

SEQ ID NO: 829451 - DNA, 21 bp, Homo sapiens
cttggataccagctcagggga

SEQ ID NO: 829452 - DNA, 22 bp, Homo sapiens
cttggatcgctaagctggctct

SEQ ID NO: 829453 - DNA, 20 bp, Homo sapiens
cttggatgcgagcttggcct

SEQ ID NO: 829454 - DNA, 22 bp, Homo sapiens
cttggatgcgagcttggccttg

SEQ ID NO: 829455 - DNA, 16 bp, Homo sapiens
cttggattctttccat

SEQ ID NO: 829456 - DNA, 23 bp, Homo sapiens
cttggattggacaggagatcagc

SEQ ID NO: 829457 - DNA, 16 bp, Homo sapiens
cttggatttagtttca

SEQ ID NO: 829458 - DNA, 14 bp, Homo sapiens
cttggcaaatttta

SEQ ID NO: 829459 - DNA, 15 bp, Homo sapiens
cttggcaacagaagc

SEQ ID NO: 829460 - DNA, 20 bp, Homo sapiens
cttggcaattaaaaatgctg

SEQ ID NO: 829461 - DNA, 17 bp, Homo sapiens
cttggcaccaccagggt

SEQ ID NO: 829462 - DNA, 18 bp, Homo sapiens
cttggcaccaccagggtg

SEQ ID NO: 829463 - DNA, 22 bp, Homo sapiens
cttggcacccccatgctgcctt

SEQ ID NO: 829464 - DNA, 17 bp, Homo sapiens
cttggcacttaagtgca

SEQ ID NO: 829465 - DNA, 18 bp, Homo sapiens
cttggcacttattgaata

SEQ ID NO: 829466 - DNA, 20 bp, Homo sapiens
cttggcacttattgaatata

SEQ ID NO: 829467 - DNA, 10 bp, Homo sapiens
cttggcagct

SEQ ID NO: 829468 - DNA, 21 bp, Homo sapiens
cttggcagtgtcccagggccc

SEQ ID NO: 829469 - DNA, 15 bp, Homo sapiens
cttggcatctgtgtg

SEQ ID NO: 829470 - DNA, 12 bp, Homo sapiens
cttggcattaaa

SEQ ID NO: 829471 - DNA, 16 bp, Homo sapiens
cttggcattggaattc

SEQ ID NO: 829472 - DNA, 13 bp, Homo sapiens
cttggccacagac

SEQ ID NO: 829473 - DNA, 22 bp, Homo sapiens
cttggccagaagggggccatga

SEQ ID NO: 829474 - DNA, 18 bp, Homo sapiens
cttggccagttatccctt

SEQ ID NO: 829475 - DNA, 12 bp, Homo sapiens
cttggcccagga

SEQ ID NO: 829476 - DNA, 13 bp, Homo sapiens
cttggcccaggag

SEQ ID NO: 829477 - DNA, 15 bp, Homo sapiens
cttggcccaggagct

SEQ ID NO: 829478 - DNA, 18 bp, Homo sapiens
cttggcccaggagctctg

SEQ ID NO: 829479 - DNA, 21 bp, Homo sapiens
cttggcccaggagctctgcgc

SEQ ID NO: 829480 - DNA, 17 bp, Homo sapiens
cttggccccagaggacc

SEQ ID NO: 829481 - DNA, 20 bp, Homo sapiens
cttggccccccaaagtgctg

SEQ ID NO: 829482 - DNA, 15 bp, Homo sapiens
cttggcccgcggcct

SEQ ID NO: 829483 - DNA, 18 bp, Homo sapiens
cttggcccgcggcctgca

SEQ ID NO: 829484 - DNA, 20 bp, Homo sapiens
cttggccctttccttccaga

SEQ ID NO: 829485 - DNA, 19 bp, Homo sapiens
cttggccggctgtgctcag

SEQ ID NO: 829486 - DNA, 11 bp, Homo sapiens
cttggcctcag

SEQ ID NO: 829487 - DNA, 15 bp, Homo sapiens
cttggcctcatgctg

SEQ ID NO: 829488 - DNA, 15 bp, Homo sapiens
cttggcctccagctg

SEQ ID NO: 829489 - DNA, 18 bp, Homo sapiens
cttggcctccatttctgt

SEQ ID NO: 829490 - DNA, 22 bp, Homo sapiens
cttggcctcccaaagtgctgag

SEQ ID NO: 829491 - DNA, 12 bp, Homo sapiens
cttggcctgctg

SEQ ID NO: 829492 - DNA, 15 bp, Homo sapiens
cttggcctgtccacc

SEQ ID NO: 829493 - DNA, 23 bp, Homo sapiens
cttggcctgtctcatccccaggg

SEQ ID NO: 829494 - DNA, 16 bp, Homo sapiens
cttggccttggcatgg

SEQ ID NO: 829495 - DNA, 16 bp, Homo sapiens
cttggcgctctcagct

SEQ ID NO: 829496 - DNA, 17 bp, Homo sapiens
cttggcgctctcagctt

SEQ ID NO: 829497 - DNA, 14 bp, Homo sapiens
cttggcggcagcag

SEQ ID NO: 829498 - DNA, 17 bp, Homo sapiens
cttggcggcagcagcca

SEQ ID NO: 829499 - DNA, 18 bp, Homo sapiens
cttggcggcagcagccat

SEQ ID NO: 829500 - DNA, 17 bp, Homo sapiens
cttggcgtggagccagg

SEQ ID NO: 829501 - DNA, 22 bp, Homo sapiens
cttggctatgaaaatgagccct

SEQ ID NO: 829502 - DNA, 23 bp, Homo sapiens
cttggctatgaaaatgagccctg

SEQ ID NO: 829503 - DNA, 21 bp, Homo sapiens
cttggctcaatcctctaagct

SEQ ID NO: 829504 - DNA, 12 bp, Homo sapiens
cttggctcagac

SEQ ID NO: 829505 - DNA, 20 bp, Homo sapiens
cttggctcgaatctctgtgc

SEQ ID NO: 829506 - DNA, 19 bp, Homo sapiens
cttggctcttggtacctgt

SEQ ID NO: 829507 - DNA, 12 bp, Homo sapiens
cttggctgaccc

SEQ ID NO: 829508 - DNA, 14 bp, Homo sapiens
cttggctgacccct

SEQ ID NO: 829509 - DNA, 19 bp, Homo sapiens
cttggctgacccctctggt

SEQ ID NO: 829510 - DNA, 21 bp, Homo sapiens
cttggctgcctgtgggcttcc

SEQ ID NO: 829511 - DNA, 17 bp, Homo sapiens
cttggctgcttcctgtg

SEQ ID NO: 829512 - DNA, 14 bp, Homo sapiens
cttggctggggagg

SEQ ID NO: 829513 - DNA, 17 bp, Homo sapiens
cttggctgtccttcccc

SEQ ID NO: 829514 - DNA, 12 bp, Homo sapiens
cttggctgtctg

SEQ ID NO: 829515 - DNA, 19 bp, Homo sapiens
cttggcttaatcattttca

SEQ ID NO: 829516 - DNA, 15 bp, Homo sapiens
cttggcttacctgac

SEQ ID NO: 829517 - DNA, 17 bp, Homo sapiens
cttggcttacctgacct

SEQ ID NO: 829518 - DNA, 20 bp, Homo sapiens
cttggcttccagaaggcagc

SEQ ID NO: 829519 - DNA, 16 bp, Homo sapiens
cttggcttcctttctt

SEQ ID NO: 829520 - DNA, 14 bp, Homo sapiens
cttggcttctcagc

SEQ ID NO: 829521 - DNA, 15 bp, Homo sapiens
cttggcttctcagcc

SEQ ID NO: 829522 - DNA, 16 bp, Homo sapiens
cttggcttctcagccc

SEQ ID NO: 829523 - DNA, 16 bp, Homo sapiens
cttggcttcttaaaaa

SEQ ID NO: 829524 - DNA, 20 bp, Homo sapiens
cttggcttcttaaaaactgt

SEQ ID NO: 829525 - DNA, 22 bp, Homo sapiens
cttggcttcttaaaaactgtgt

SEQ ID NO: 829526 - DNA, 23 bp, Homo sapiens
cttggctttcagagccagcctgg

SEQ ID NO: 829527 - DNA, 14 bp, Homo sapiens
cttggctttcatgt

SEQ ID NO: 829528 - DNA, 22 bp, Homo sapiens
cttggctttcattattagtact

SEQ ID NO: 829529 - DNA, 15 bp, Homo sapiens
cttgggaaggacaca

SEQ ID NO: 829530 - DNA, 13 bp, Homo sapiens
cttgggaatttta

SEQ ID NO: 829531 - DNA, 15 bp, Homo sapiens
cttgggacagccaga

SEQ ID NO: 829532 - DNA, 16 bp, Homo sapiens
cttgggacgtgtacag

SEQ ID NO: 829533 - DNA, 17 bp, Homo sapiens
cttgggactcaggtctg

SEQ ID NO: 829534 - DNA, 19 bp, Homo sapiens
cttgggactcaggtctgta

SEQ ID NO: 829535 - DNA, 13 bp, Homo sapiens
cttgggagcctga

SEQ ID NO: 829536 - DNA, 17 bp, Homo sapiens
cttgtgctcacgctccc

SEQ ID NO: 829537 - DNA, 14 bp, Homo sapiens
cttgtgctttgctc

SEQ ID NO: 829538 - DNA, 16 bp, Homo sapiens
cttgtgctttgctctt

SEQ ID NO: 829539 - DNA, 19 bp, Homo sapiens
cttgtggaaaaaaagtgct

SEQ ID NO: 829540 - DNA, 18 bp, Homo sapiens
cttgtggaatgctgcctt

SEQ ID NO: 829541 - DNA, 24 bp, Homo sapiens
cttgtggactggctgtgcccctga

SEQ ID NO: 829542 - DNA, 16 bp, Homo sapiens
cttgtggcagcaacgg

SEQ ID NO: 829543 - DNA, 16 bp, Homo sapiens
cttgtgggagacagca

SEQ ID NO: 829544 - DNA, 17 bp, Homo sapiens
cttgtgggagacagcag

SEQ ID NO: 829545 - DNA, 22 bp, Homo sapiens
cttgtgggagacagcagcctgt

SEQ ID NO: 829546 - DNA, 21 bp, Homo sapiens
cttgtgggcaaaggcagggcc

SEQ ID NO: 829547 - DNA, 21 bp, Homo sapiens
cttgtgggctggtgccccaca

SEQ ID NO: 829548 - DNA, 22 bp, Homo sapiens
cttgtggtgtgaccatgttcat

SEQ ID NO: 829549 - DNA, 14 bp, Homo sapiens
cttgtgtagatttg

SEQ ID NO: 829550 - DNA, 17 bp, Homo sapiens
cttgtgtctctgtgctt

SEQ ID NO: 829551 - DNA, 21 bp, Homo sapiens
cttgtgtctctgtgcttttaa

SEQ ID NO: 829552 - DNA, 14 bp, Homo sapiens
cttgtgtgtcaggc

SEQ ID NO: 829553 - DNA, 15 bp, Homo sapiens
cttgtgtgtcaggcc

SEQ ID NO: 829554 - DNA, 16 bp, Homo sapiens
cttgtgtgtcaggccc

SEQ ID NO: 829555 - DNA, 22 bp, Homo sapiens
cttgtgtgtcaggccctctgcc

SEQ ID NO: 829556 - DNA, 14 bp, Homo sapiens
cttgtgtgtgccct

SEQ ID NO: 829557 - DNA, 15 bp, Homo sapiens
cttgtgtgtgccctg

SEQ ID NO: 829558 - DNA, 21 bp, Homo sapiens
cttgtgtgtgccctgggccag

SEQ ID NO: 829559 - DNA, 19 bp, Homo sapiens
cttgtgtgtgggctgtgag

SEQ ID NO: 829560 - DNA, 20 bp, Homo sapiens
cttgtgttgcactgaacagg

SEQ ID NO: 829561 - DNA, 21 bp, Homo sapiens
cttgtgtttctttagtttttg

SEQ ID NO: 829562 - DNA, 15 bp, Homo sapiens
cttgtgtttgagaac

SEQ ID NO: 829563 - DNA, 18 bp, Homo sapiens
cttgtgtttgcttaaaca

SEQ ID NO: 829564 - DNA, 22 bp, Homo sapiens
cttgtgtttgcttaaacaaagt

SEQ ID NO: 829565 - DNA, 21 bp, Homo sapiens
cttgttactgctgattcttgt

SEQ ID NO: 829566 - DNA, 23 bp, Homo sapiens
cttgttactgctgattcttgtaa

SEQ ID NO: 829567 - DNA, 15 bp, Homo sapiens
cttgttacttctgag

SEQ ID NO: 829568 - DNA, 23 bp, Homo sapiens
cttgttagaaaacaaaattttat

SEQ ID NO: 829569 - DNA, 19 bp, Homo sapiens
cttgttatggtagaaaaat

SEQ ID NO: 829570 - DNA, 12 bp, Homo sapiens
cttgttattaat

SEQ ID NO: 829571 - DNA, 17 bp, Homo sapiens
cttgttattaatgtttc

SEQ ID NO: 829572 - DNA, 15 bp, Homo sapiens
cttgttattaccaaa

SEQ ID NO: 829573 - DNA, 21 bp, Homo sapiens
cttgttattaccaaaacagga

SEQ ID NO: 829574 - DNA, 17 bp, Homo sapiens
cttgttattgaagtgtt

SEQ ID NO: 829575 - DNA, 15 bp, Homo sapiens
cttgttatttataac

SEQ ID NO: 829576 - DNA, 20 bp, Homo sapiens
cttgttcaaaatatgttctt

SEQ ID NO: 829577 - DNA, 19 bp, Homo sapiens
cttgttcatggagagctgt

SEQ ID NO: 829578 - DNA, 15 bp, Homo sapiens
cttgttccagctttg

SEQ ID NO: 829579 - DNA, 13 bp, Homo sapiens
cttgttctatttt

SEQ ID NO: 829580 - DNA, 17 bp, Homo sapiens
cttgttctatttttcaa

SEQ ID NO: 829581 - DNA, 19 bp, Homo sapiens
cttgttctatttttcaatc

SEQ ID NO: 829582 - DNA, 21 bp, Homo sapiens
cttgttctctggaacctgact

SEQ ID NO: 829583 - DNA, 16 bp, Homo sapiens
cttgttctgagattca

SEQ ID NO: 829584 - DNA, 19 bp, Homo sapiens
cttgttctgagattcaata

SEQ ID NO: 829585 - DNA, 12 bp, Homo sapiens
cttgttcttccc

SEQ ID NO: 829586 - DNA, 16 bp, Homo sapiens
cttgttcttggttcct

SEQ ID NO: 829587 - DNA, 12 bp, Homo sapiens
cttgttgcactg

SEQ ID NO: 829588 - DNA, 18 bp, Homo sapiens
cttgttgcactgccccct

SEQ ID NO: 829589 - DNA, 23 bp, Homo sapiens
cttgttgcactgccccctgcttg

SEQ ID NO: 829590 - DNA, 18 bp, Homo sapiens
cttgttgggattcctgac

SEQ ID NO: 829591 - DNA, 21 bp, Homo sapiens
cttgttgggattcctgaccca

SEQ ID NO: 829592 - DNA, 22 bp, Homo sapiens
cttgttgggattcctgacccag

SEQ ID NO: 829593 - DNA, 14 bp, Homo sapiens
cttgttggtcagag

SEQ ID NO: 829594 - DNA, 19 bp, Homo sapiens
cttgttgtcccaatgaaat

SEQ ID NO: 829595 - DNA, 15 bp, Homo sapiens
cttgttgtttcttgc

SEQ ID NO: 829596 - DNA, 16 bp, Homo sapiens
cttgttgtttcttgcc

SEQ ID NO: 829597 - DNA, 21 bp, Homo sapiens
cttgttgttttactaaagaaa

SEQ ID NO: 829598 - DNA, 21 bp, Homo sapiens
cttgttgtttttaagtcctgt

SEQ ID NO: 829599 - DNA, 16 bp, Homo sapiens
cttgtttaacatatat

SEQ ID NO: 829600 - DNA, 13 bp, Homo sapiens
cttgtttacaata

SEQ ID NO: 829601 - DNA, 12 bp, Homo sapiens
cttgtttcaatt

SEQ ID NO: 829602 - DNA, 20 bp, Homo sapiens
cttgtttctgggtccctgct

SEQ ID NO: 829603 - DNA, 14 bp, Homo sapiens
cttgtttgaatatt

SEQ ID NO: 829604 - DNA, 20 bp, Homo sapiens
cttgtttgagtttttcctcc

SEQ ID NO: 829605 - DNA, 20 bp, Homo sapiens
cttgtttgattttagctgca

SEQ ID NO: 829606 - DNA, 22 bp, Homo sapiens
cttgtttgattttagctgcaga

SEQ ID NO: 829607 - DNA, 22 bp, Homo sapiens
cttgttttataaaattttgctt

SEQ ID NO: 829608 - DNA, 17 bp, Homo sapiens
cttgttttcttgccaat

SEQ ID NO: 829609 - DNA, 19 bp, Homo sapiens
cttgtttttaatctcctgt

SEQ ID NO: 829610 - DNA, 19 bp, Homo sapiens
cttgttttttttttccact

SEQ ID NO: 829611 - DNA, 14 bp, Homo sapiens
ctttaaaaactgtt

SEQ ID NO: 829612 - DNA, 21 bp, Homo sapiens
ctttaaaaaggaaatttgttt

SEQ ID NO: 829613 - DNA, 20 bp, Homo sapiens
ctttaaaaagggaagaaact

SEQ ID NO: 829614 - DNA, 15 bp, Homo sapiens
ctttaaaacaagtgt

SEQ ID NO: 829615 - DNA, 18 bp, Homo sapiens
ctttaaaaccacagctgg

SEQ ID NO: 829616 - DNA, 14 bp, Homo sapiens
ctttaaaaccagta

SEQ ID NO: 829617 - DNA, 17 bp, Homo sapiens
ctttaaaacgcgtctgc

SEQ ID NO: 829618 - DNA, 22 bp, Homo sapiens
ctttaaaacgcgtctgcctggg

SEQ ID NO: 829619 - DNA, 23 bp, Homo sapiens
ctttaaaacgcgtctgcctgggc

SEQ ID NO: 829620 - DNA, 16 bp, Homo sapiens
ctttaaaagaatgact

SEQ ID NO: 829621 - DNA, 16 bp, Homo sapiens
ctttaaaagagagaga

SEQ ID NO: 829622 - DNA, 22 bp, Homo sapiens
ctttaaaagagagagagagaaa

SEQ ID NO: 829623 - DNA, 22 bp, Homo sapiens
ctttaaaagcattttttaacct

SEQ ID NO: 829624 - DNA, 12 bp, Homo sapiens
ctttaaaaggca

SEQ ID NO: 829625 - DNA, 21 bp, Homo sapiens
ctttaaaaggcaactcaaaga

SEQ ID NO: 829626 - DNA, 16 bp, Homo sapiens
ctttaaaagtatcttt

SEQ ID NO: 829627 - DNA, 19 bp, Homo sapiens
ctttaaaagtcattattcc

SEQ ID NO: 829628 - DNA, 22 bp, Homo sapiens
ctttaaaataaggataataatc

SEQ ID NO: 829629 - DNA, 21 bp, Homo sapiens
ctttaaaatgcgaaattattg

SEQ ID NO: 829630 - DNA, 19 bp, Homo sapiens
ctttaaacaaatatgaaaa

SEQ ID NO: 829631 - DNA, 21 bp, Homo sapiens
ctttaaacaaatatgaaaaat

SEQ ID NO: 829632 - DNA, 17 bp, Homo sapiens
ctttaaactaccctcca

SEQ ID NO: 829633 - DNA, 21 bp, Homo sapiens
ctttaaactaccctccagagt

SEQ ID NO: 829634 - DNA, 13 bp, Homo sapiens
ctttaaactcagg

SEQ ID NO: 829635 - DNA, 15 bp, Homo sapiens
ctttaaagaggctgt

SEQ ID NO: 829636 - DNA, 19 bp, Homo sapiens
ctttaaagaggctgtgtgg

SEQ ID NO: 829637 - DNA, 14 bp, Homo sapiens
ctttaaagataagt

SEQ ID NO: 829638 - DNA, 21 bp, Homo sapiens
ctttaaaggaaaaaatgttgg

SEQ ID NO: 829639 - DNA, 14 bp, Homo sapiens
ctttaaaggcccag

SEQ ID NO: 829640 - DNA, 20 bp, Homo sapiens
ctttaaaggcccagccccta

SEQ ID NO: 829641 - DNA, 18 bp, Homo sapiens
ctttaaagggcctgcctg

SEQ ID NO: 829642 - DNA, 19 bp, Homo sapiens
ctttaaagggcctgcctgg

SEQ ID NO: 829643 - DNA, 16 bp, Homo sapiens
ctttaaagtacctgta

SEQ ID NO: 829644 - DNA, 16 bp, Homo sapiens
ctttaaagtatgaatc

SEQ ID NO: 829645 - DNA, 15 bp, Homo sapiens
ctttaaatcattaga

SEQ ID NO: 829646 - DNA, 12 bp, Homo sapiens
ctttaaattatg

SEQ ID NO: 829647 - DNA, 19 bp, Homo sapiens
ctttaacaattgtcttaaa

SEQ ID NO: 829648 - DNA, 18 bp, Homo sapiens
ctttaacatacaagaaaa

SEQ ID NO: 829649 - DNA, 19 bp, Homo sapiens
ctttaaccctctcttccct

SEQ ID NO: 829650 - DNA, 17 bp, Homo sapiens
ctttaactcccattacc

SEQ ID NO: 829651 - DNA, 14 bp, Homo sapiens
ctttaactctgcgg

SEQ ID NO: 829652 - DNA, 17 bp, Homo sapiens
ctttaactctgcggata

SEQ ID NO: 829653 - DNA, 21 bp, Homo sapiens
ctttaactgccgtaatttaac

SEQ ID NO: 829654 - DNA, 20 bp, Homo sapiens
ctttaactgtatccttaacc

SEQ ID NO: 829655 - DNA, 18 bp, Homo sapiens
ctttaagaaaaatgaaaa

SEQ ID NO: 829656 - DNA, 20 bp, Homo sapiens
ctttaagaaccttaatgaca

SEQ ID NO: 829657 - DNA, 17 bp, Homo sapiens
ctttccaccccctccct

SEQ ID NO: 829658 - DNA, 22 bp, Homo sapiens
ctttccaccctattccctaact

SEQ ID NO: 829659 - DNA, 12 bp, Homo sapiens
ctttccactctg

SEQ ID NO: 829660 - DNA, 23 bp, Homo sapiens
ctttccactctggattcagcctt

SEQ ID NO: 829661 - DNA, 16 bp, Homo sapiens
ctttccacttctctgg

SEQ ID NO: 829662 - DNA, 9 bp, Homo sapiens
ctttccaga

SEQ ID NO: 829663 - DNA, 18 bp, Homo sapiens
ctttccagagaactgcag

SEQ ID NO: 829664 - DNA, 19 bp, Homo sapiens
ctttccagagaactgcaga

SEQ ID NO: 829665 - DNA, 15 bp, Homo sapiens
ctttccagcctcctg

SEQ ID NO: 829666 - DNA, 12 bp, Homo sapiens
ctttccaggcac

SEQ ID NO: 829667 - DNA, 18 bp, Homo sapiens
ctttccaggcaccctcag

SEQ ID NO: 829668 - DNA, 20 bp, Homo sapiens
ctttccaggcaccctcaggg

SEQ ID NO: 829669 - DNA, 18 bp, Homo sapiens
ctttccagggtcaaagta

SEQ ID NO: 829670 - DNA, 19 bp, Homo sapiens
ctttccagggtcaaagtac

SEQ ID NO: 829671 - DNA, 16 bp, Homo sapiens
ctttccatctgtccac

SEQ ID NO: 829672 - DNA, 19 bp, Homo sapiens
ctttccatggcaaatgggc

SEQ ID NO: 829673 - DNA, 22 bp, Homo sapiens
ctttccatggcaaatgggcagc

SEQ ID NO: 829674 - DNA, 21 bp, Homo sapiens
ctttccatgggcccgctgcct

SEQ ID NO: 829675 - DNA, 14 bp, Homo sapiens
ctttccatgttgct

SEQ ID NO: 829676 - DNA, 17 bp, Homo sapiens
ctttccatgttgctgcc

SEQ ID NO: 829677 - DNA, 12 bp, Homo sapiens
ctttccattaca

SEQ ID NO: 829678 - DNA, 16 bp, Homo sapiens
ctttccattcttcttg

SEQ ID NO: 829679 - DNA, 15 bp, Homo sapiens
ctttccatttacagt

SEQ ID NO: 829680 - DNA, 19 bp, Homo sapiens
ctttccatttacagtctct

SEQ ID NO: 829681 - DNA, 15 bp, Homo sapiens
ctttcccaaatgtat

SEQ ID NO: 829682 - DNA, 17 bp, Homo sapiens
ctttcccaaatgtattg

SEQ ID NO: 829683 - DNA, 21 bp, Homo sapiens
ctttcccaggtaatttaaatt

SEQ ID NO: 829684 - DNA, 17 bp, Homo sapiens
ctttcccagtctgtcga

SEQ ID NO: 829685 - DNA, 17 bp, Homo sapiens
ctttcccatggggaggg

SEQ ID NO: 829686 - DNA, 11 bp, Homo sapiens
ctttccccaga

SEQ ID NO: 829687 - DNA, 17 bp, Homo sapiens
ctttccccagaggctcc

SEQ ID NO: 829688 - DNA, 20 bp, Homo sapiens
ctttccccagaggctcccaa

SEQ ID NO: 829689 - DNA, 21 bp, Homo sapiens
ctttccccagaggctcccaat

SEQ ID NO: 829690 - DNA, 16 bp, Homo sapiens
ctttccccagatcaaa

SEQ ID NO: 829691 - DNA, 19 bp, Homo sapiens
ctttcccccaccagctaag

SEQ ID NO: 829692 - DNA, 17 bp, Homo sapiens
ctttcccccttctctta

SEQ ID NO: 829693 - DNA, 18 bp, Homo sapiens
ctttccccgggggaggaa

SEQ ID NO: 829694 - DNA, 17 bp, Homo sapiens
ctttcccctcagagctc

SEQ ID NO: 829695 - DNA, 18 bp, Homo sapiens
ctttcccctcctttgtct

SEQ ID NO: 829696 - DNA, 13 bp, Homo sapiens
ctttcccctgtgg

SEQ ID NO: 829697 - DNA, 17 bp, Homo sapiens
ctttcccgggctgtcca

SEQ ID NO: 829698 - DNA, 22 bp, Homo sapiens
ctttccctagaaagccatattc

SEQ ID NO: 829699 - DNA, 11 bp, Homo sapiens
ctttccctcac

SEQ ID NO: 829700 - DNA, 16 bp, Homo sapiens
ctttccctctcccagt

SEQ ID NO: 829701 - DNA, 13 bp, Homo sapiens
ctttccctgagga

SEQ ID NO: 829702 - DNA, 13 bp, Homo sapiens
ctttccctgcctc

SEQ ID NO: 829703 - DNA, 13 bp, Homo sapiens
ctttccctggagc

SEQ ID NO: 829704 - DNA, 23 bp, Homo sapiens
ctttcccttattgcctcccaggc

SEQ ID NO: 829705 - DNA, 15 bp, Homo sapiens
ctttcccttccagtt

SEQ ID NO: 829706 - DNA, 21 bp, Homo sapiens
ctttcccttcccctgtggtct

SEQ ID NO: 829707 - DNA, 12 bp, Homo sapiens
ctttcccttcct

SEQ ID NO: 829708 - DNA, 20 bp, Homo sapiens
ctttccgctgtcgccccagg

SEQ ID NO: 829709 - DNA, 22 bp, Homo sapiens
ctttccgtttttttctttcctg

SEQ ID NO: 829710 - DNA, 15 bp, Homo sapiens
ctttcctaaagccaa

SEQ ID NO: 829711 - DNA, 22 bp, Homo sapiens
ctttcctacatgccccctccct

SEQ ID NO: 829712 - DNA, 18 bp, Homo sapiens
ctttcctactgtcctgga

SEQ ID NO: 829713 - DNA, 18 bp, Homo sapiens
ctttcctaggcccaggcc

SEQ ID NO: 829714 - DNA, 20 bp, Homo sapiens
ctttcctaggcccaggcctg

SEQ ID NO: 829715 - DNA, 13 bp, Homo sapiens
ctttcctatcacc

SEQ ID NO: 829716 - DNA, 20 bp, Homo sapiens
ctttcctattttcttttcca

SEQ ID NO: 829717 - DNA, 22 bp, Homo sapiens
ctttcctcaagtatcttctatt

SEQ ID NO: 829718 - DNA, 17 bp, Homo sapiens
ctttcctccccaccttc

SEQ ID NO: 829719 - DNA, 21 bp, Homo sapiens
ctttcctccccaccttcccca

SEQ ID NO: 829720 - DNA, 17 bp, Homo sapiens
ctttcctccccatacac

SEQ ID NO: 829721 - DNA, 18 bp, Homo sapiens
ctttcctccccatacaca

SEQ ID NO: 829722 - DNA, 19 bp, Homo sapiens
ctttcctccccatacacac

SEQ ID NO: 829723 - DNA, 22 bp, Homo sapiens
ctttcctccccatacacacaca

SEQ ID NO: 829724 - DNA, 14 bp, Homo sapiens
ctttcctcccccag

SEQ ID NO: 829725 - DNA, 17 bp, Homo sapiens
ctttcctccccctgcaa

SEQ ID NO: 829726 - DNA, 18 bp, Homo sapiens
ctttcctccttcactgtt

SEQ ID NO: 829727 - DNA, 13 bp, Homo sapiens
ctttcctcggtct

SEQ ID NO: 829728 - DNA, 13 bp, Homo sapiens
ctttcctctccct

SEQ ID NO: 829729 - DNA, 18 bp, Homo sapiens
ctttcctctgcagcactt

SEQ ID NO: 829730 - DNA, 14 bp, Homo sapiens
ctttcctcttcccc

SEQ ID NO: 829731 - DNA, 20 bp, Homo sapiens
ctttcctctttctgctctgc

SEQ ID NO: 829732 - DNA, 19 bp, Homo sapiens
ctttcctgcatctctgtga

SEQ ID NO: 829733 - DNA, 23 bp, Homo sapiens
ctttcctgccataaaagctatga

SEQ ID NO: 829734 - DNA, 12 bp, Homo sapiens
ctttcctgcccc

SEQ ID NO: 829735 - DNA, 13 bp, Homo sapiens
ctttcctgggcct

SEQ ID NO: 829736 - DNA, 11 bp, Homo sapiens
ctttcctggtt

SEQ ID NO: 829737 - DNA, 15 bp, Homo sapiens
ctttccttcactgcc

SEQ ID NO: 829738 - DNA, 18 bp, Homo sapiens
ctttccttccctctctga

SEQ ID NO: 829739 - DNA, 13 bp, Homo sapiens
ctttccttctcca

SEQ ID NO: 829740 - DNA, 15 bp, Homo sapiens
ctttccttgctcaac

SEQ ID NO: 829741 - DNA, 16 bp, Homo sapiens
ctttccttggctccca

SEQ ID NO: 829742 - DNA, 17 bp, Homo sapiens
ctttccttggctcccat

SEQ ID NO: 829743 - DNA, 22 bp, Homo sapiens
ctttccttgttagaatgcaagc

SEQ ID NO: 829744 - DNA, 15 bp, Homo sapiens
ctttcctttactcct

SEQ ID NO: 829745 - DNA, 13 bp, Homo sapiens
ctttcctttttcc

SEQ ID NO: 829746 - DNA, 20 bp, Homo sapiens
ctttcgaggcctgaagccag

SEQ ID NO: 829747 - DNA, 16 bp, Homo sapiens
ctttctaactgtagct

SEQ ID NO: 829748 - DNA, 23 bp, Homo sapiens
ctttctagctgttgagctgtttt

SEQ ID NO: 829749 - DNA, 14 bp, Homo sapiens
ctttctagttgaaa

SEQ ID NO: 829750 - DNA, 20 bp, Homo sapiens
ctttctatataaaatgtatt

SEQ ID NO: 829751 - DNA, 15 bp, Homo sapiens
ctttctatcctgctc

SEQ ID NO: 829752 - DNA, 15 bp, Homo sapiens
ctttctattccaaag

SEQ ID NO: 829753 - DNA, 17 bp, Homo sapiens
ctttctatttgacttgt

SEQ ID NO: 829754 - DNA, 22 bp, Homo sapiens
ctttctcactaaatcttttata

SEQ ID NO: 829755 - DNA, 12 bp, Homo sapiens
ctttctcagaat

SEQ ID NO: 829756 - DNA, 21 bp, Homo sapiens
ctttctcagccgcttctgact

SEQ ID NO: 829757 - DNA, 15 bp, Homo sapiens
ctttctcagttttca

SEQ ID NO: 829758 - DNA, 15 bp, Homo sapiens
ctttctcatttcttt

SEQ ID NO: 829759 - DNA, 17 bp, Homo sapiens
ctttctcatttctttct

SEQ ID NO: 829760 - DNA, 18 bp, Homo sapiens
ctttctcatttctttcta

SEQ ID NO: 829761 - DNA, 20 bp, Homo sapiens
ctttctccagccagcaatga

SEQ ID NO: 829762 - DNA, 18 bp, Homo sapiens
ctttctcccactgagttt

SEQ ID NO: 829763 - DNA, 15 bp, Homo sapiens
ctttctccccatccc

SEQ ID NO: 829764 - DNA, 23 bp, Homo sapiens
ctttctcccccgacactgctgca

SEQ ID NO: 829765 - DNA, 14 bp, Homo sapiens
ctttctcccttttt

SEQ ID NO: 829766 - DNA, 20 bp, Homo sapiens
ctttctcctcatccatttct

SEQ ID NO: 829767 - DNA, 14 bp, Homo sapiens
ctttctcctcccca

SEQ ID NO: 829768 - DNA, 19 bp, Homo sapiens
ctttctcctctgctatgca

SEQ ID NO: 829769 - DNA, 23 bp, Homo sapiens
ctttctcctggagatagctgggg

SEQ ID NO: 829770 - DNA, 15 bp, Homo sapiens
ctttctcctgtgaat

SEQ ID NO: 829771 - DNA, 16 bp, Homo sapiens
ctttctcctgtgaatg

SEQ ID NO: 829772 - DNA, 23 bp, Homo sapiens
ctttctccttagtcttctcatag

SEQ ID NO: 829773 - DNA, 15 bp, Homo sapiens
ctttctccttgaata

SEQ ID NO: 829774 - DNA, 22 bp, Homo sapiens
ctttctctaataataaatagtt

SEQ ID NO: 829775 - DNA, 16 bp, Homo sapiens
ctttctctactttgag

SEQ ID NO: 829776 - DNA, 15 bp, Homo sapiens
ctttctctcagtgaa

SEQ ID NO: 829777 - DNA, 17 bp, Homo sapiens
ctttctctcccttcttt

SEQ ID NO: 829778 - DNA, 13 bp, Homo sapiens
ctttctctcctgg

SEQ ID NO: 829779 - DNA, 16 bp, Homo sapiens
ctttgatctggacaga

SEQ ID NO: 829780 - DNA, 18 bp, Homo sapiens
ctttgatgagcatttgtt

SEQ ID NO: 829781 - DNA, 15 bp, Homo sapiens
ctttgattatttgca

SEQ ID NO: 829782 - DNA, 17 bp, Homo sapiens
ctttgattatttgcatg

SEQ ID NO: 829783 - DNA, 15 bp, Homo sapiens
ctttgatttgtacca

SEQ ID NO: 829784 - DNA, 22 bp, Homo sapiens
ctttgatttttatccatttctt

SEQ ID NO: 829785 - DNA, 18 bp, Homo sapiens
ctttgatttttgaagttg

SEQ ID NO: 829786 - DNA, 15 bp, Homo sapiens
ctttgcaaagacccg

SEQ ID NO: 829787 - DNA, 21 bp, Homo sapiens
ctttgcaaattatttattact

SEQ ID NO: 829788 - DNA, 15 bp, Homo sapiens
ctttgcaagatgctt

SEQ ID NO: 829789 - DNA, 17 bp, Homo sapiens
ctttgcaagatgcttgg

SEQ ID NO: 829790 - DNA, 18 bp, Homo sapiens
ctttgcaattgctcttct

SEQ ID NO: 829791 - DNA, 16 bp, Homo sapiens
ctttgcaccaaagaca

SEQ ID NO: 829792 - DNA, 18 bp, Homo sapiens
ctttgcacgacgccctct

SEQ ID NO: 829793 - DNA, 22 bp, Homo sapiens
ctttgcacgtgctgtttgctgt

SEQ ID NO: 829794 - DNA, 22 bp, Homo sapiens
ctttgcactgagggccacacta

SEQ ID NO: 829795 - DNA, 12 bp, Homo sapiens
ctttgcacttaa

SEQ ID NO: 829796 - DNA, 18 bp, Homo sapiens
ctttgcacttaatggctg

SEQ ID NO: 829797 - DNA, 22 bp, Homo sapiens
ctttgcagccggcacagggtct

SEQ ID NO: 829798 - DNA, 14 bp, Homo sapiens
ctttgcagctaaaa

SEQ ID NO: 829799 - DNA, 16 bp, Homo sapiens
ctttgcaggctctggg

SEQ ID NO: 829800 - DNA, 18 bp, Homo sapiens
ctttgcaggctctgggct

SEQ ID NO: 829801 - DNA, 20 bp, Homo sapiens
ctttgcaggctctgggctca

SEQ ID NO: 829802 - DNA, 23 bp, Homo sapiens
ctttgcaggctctgggctcaggg

SEQ ID NO: 829803 - DNA, 16 bp, Homo sapiens
ctttgcagggcacaga

SEQ ID NO: 829804 - DNA, 21 bp, Homo sapiens
ctttgcagggcacagatgacc

SEQ ID NO: 829805 - DNA, 20 bp, Homo sapiens
ctttgcagtgtgcagggtgg

SEQ ID NO: 829806 - DNA, 18 bp, Homo sapiens
ctttgcatagctttcaca

SEQ ID NO: 829807 - DNA, 18 bp, Homo sapiens
ctttgcatatgagccgtg

SEQ ID NO: 829808 - DNA, 21 bp, Homo sapiens
ctttgcatatgagccgtgaac

SEQ ID NO: 829809 - DNA, 23 bp, Homo sapiens
ctttgcatattataaaggataaa

SEQ ID NO: 829810 - DNA, 16 bp, Homo sapiens
ctttgcatctcagtat

SEQ ID NO: 829811 - DNA, 22 bp, Homo sapiens
ctttgcatctcagtatgaatta

SEQ ID NO: 829812 - DNA, 20 bp, Homo sapiens
ctttgcatggcagggcctca

SEQ ID NO: 829813 - DNA, 20 bp, Homo sapiens
ctttgcattccttacttgca

SEQ ID NO: 829814 - DNA, 22 bp, Homo sapiens
ctttgcattccttacttgcact

SEQ ID NO: 829815 - DNA, 16 bp, Homo sapiens
ctttgccaaggctctc

SEQ ID NO: 829816 - DNA, 23 bp, Homo sapiens
ctttgccaaggctctcccctctc

SEQ ID NO: 829817 - DNA, 18 bp, Homo sapiens
ctttgccagaaagcataa

SEQ ID NO: 829818 - DNA, 19 bp, Homo sapiens
ctttgccagagcaggagcc

SEQ ID NO: 829819 - DNA, 20 bp, Homo sapiens
ctttgccagagcaggagccc

SEQ ID NO: 829820 - DNA, 19 bp, Homo sapiens
ctttgccagtcattcagca

SEQ ID NO: 829821 - DNA, 20 bp, Homo sapiens
ctttgccatttttctataaa

SEQ ID NO: 829822 - DNA, 16 bp, Homo sapiens
ctttgcccacccctca

SEQ ID NO: 829823 - DNA, 17 bp, Homo sapiens
ctttgcccacccctcac

SEQ ID NO: 829824 - DNA, 22 bp, Homo sapiens
ctttgcccagggtcctgtgcct

SEQ ID NO: 829825 - DNA, 13 bp, Homo sapiens
ctttgcctctgtc

SEQ ID NO: 829826 - DNA, 14 bp, Homo sapiens
ctttgcctctgtcc

SEQ ID NO: 829827 - DNA, 21 bp, Homo sapiens
ctttgccttaaacctgaagat

SEQ ID NO: 829828 - DNA, 23 bp, Homo sapiens
ctttgccttgggctgctcctcat

SEQ ID NO: 829829 - DNA, 15 bp, Homo sapiens
ctttgcggacgggct

SEQ ID NO: 829830 - DNA, 17 bp, Homo sapiens
ctttgcgtgcccggggc

SEQ ID NO: 829831 - DNA, 16 bp, Homo sapiens
ctttgcgtggatcaag

SEQ ID NO: 829832 - DNA, 14 bp, Homo sapiens
ctttgctatgtaag

SEQ ID NO: 829833 - DNA, 22 bp, Homo sapiens
ctttgctcagtgtccagcttcc

SEQ ID NO: 829834 - DNA, 15 bp, Homo sapiens
ctttgctccgctccc

SEQ ID NO: 829835 - DNA, 16 bp, Homo sapiens
ctttgctccgctccca

SEQ ID NO: 829836 - DNA, 18 bp, Homo sapiens
ctttgctccgctcccacc

SEQ ID NO: 829837 - DNA, 20 bp, Homo sapiens
ctttgctccgctcccaccgc

SEQ ID NO: 829838 - DNA, 23 bp, Homo sapiens
ctttgctctattaagattggaaa

SEQ ID NO: 829839 - DNA, 16 bp, Homo sapiens
ctttgctcttgtccca

SEQ ID NO: 829840 - DNA, 14 bp, Homo sapiens
ctttgctgagagct

SEQ ID NO: 829841 - DNA, 13 bp, Homo sapiens
ctttgctgcacag

SEQ ID NO: 829842 - DNA, 16 bp, Homo sapiens
ctttgctgcacagcag

SEQ ID NO: 829843 - DNA, 19 bp, Homo sapiens
ctttgctgcattttacaca

SEQ ID NO: 829844 - DNA, 15 bp, Homo sapiens
ctttgctgcccctgt

SEQ ID NO: 829845 - DNA, 17 bp, Homo sapiens
ctttgctgcccctgtct

SEQ ID NO: 829846 - DNA, 18 bp, Homo sapiens
ctttgctgcccctgtctg

SEQ ID NO: 829847 - DNA, 19 bp, Homo sapiens
ctttgctgctgaaggctca

SEQ ID NO: 829848 - DNA, 21 bp, Homo sapiens
ctttgctggaagaaactaaaa

SEQ ID NO: 829849 - DNA, 22 bp, Homo sapiens
ctttgctgtactcttgctgatg

SEQ ID NO: 829850 - DNA, 21 bp, Homo sapiens
ctttgctgtgaggctgtcctg

SEQ ID NO: 829851 - DNA, 20 bp, Homo sapiens
ctttgcttcaaatccatcca

SEQ ID NO: 829852 - DNA, 23 bp, Homo sapiens
ctttgcttcaaattcaaggcctt

SEQ ID NO: 829853 - DNA, 14 bp, Homo sapiens
ctttgcttgagaat

SEQ ID NO: 829854 - DNA, 18 bp, Homo sapiens
ctttgcttgctttgaagt

SEQ ID NO: 829855 - DNA, 13 bp, Homo sapiens
ctttgctttctgc

SEQ ID NO: 829856 - DNA, 15 bp, Homo sapiens
ctttgctttctgctc

SEQ ID NO: 829857 - DNA, 19 bp, Homo sapiens
ctttgctttctgctcagct

SEQ ID NO: 829858 - DNA, 21 bp, Homo sapiens
ctttgctttctgctcagcttc

SEQ ID NO: 829859 - DNA, 11 bp, Homo sapiens
ctttgctttgc

SEQ ID NO: 829860 - DNA, 16 bp, Homo sapiens
ctttggaaccagactc

SEQ ID NO: 829861 - DNA, 23 bp, Homo sapiens
ctttggaaccagactcttgcctg

SEQ ID NO: 829862 - DNA, 15 bp, Homo sapiens
ctttggaagcagccc

SEQ ID NO: 829863 - DNA, 17 bp, Homo sapiens
ctttggaatattttatc

SEQ ID NO: 829864 - DNA, 20 bp, Homo sapiens
ctttggaatgaaattcctcc

SEQ ID NO: 829865 - DNA, 17 bp, Homo sapiens
ctttggacagtggcctc

SEQ ID NO: 829866 - DNA, 24 bp, Homo sapiens
ctttggacccagggcctgacttga

SEQ ID NO: 829867 - DNA, 16 bp, Homo sapiens
ctttggacctaatcca

SEQ ID NO: 829868 - DNA, 20 bp, Homo sapiens
ctttggagaacgccagtctc

SEQ ID NO: 829869 - DNA, 16 bp, Homo sapiens
ctttggagcaaagaag

SEQ ID NO: 829870 - DNA, 14 bp, Homo sapiens
ctttggaggcccct

SEQ ID NO: 829871 - DNA, 21 bp, Homo sapiens
ctttggaggggaaatggggaa

SEQ ID NO: 829872 - DNA, 23 bp, Homo sapiens
ctttggaggggaaatggggaaag

SEQ ID NO: 829873 - DNA, 16 bp, Homo sapiens
ctttggagtcccctca

SEQ ID NO: 829874 - DNA, 17 bp, Homo sapiens
ctttggagttaaaatgc

SEQ ID NO: 829875 - DNA, 18 bp, Homo sapiens
ctttggataataggaatt

SEQ ID NO: 829876 - DNA, 18 bp, Homo sapiens
ctttggatgcaattaaaa

SEQ ID NO: 829877 - DNA, 17 bp, Homo sapiens
ctttggatttgacattg

SEQ ID NO: 829878 - DNA, 22 bp, Homo sapiens
ctttggcatcttttggaggaaa

SEQ ID NO: 829879 - DNA, 14 bp, Homo sapiens
ctttggccaacagg

SEQ ID NO: 829880 - DNA, 17 bp, Homo sapiens
ctttggccccactttga

SEQ ID NO: 829881 - DNA, 19 bp, Homo sapiens
ctttggccccactttgaag

SEQ ID NO: 829882 - DNA, 17 bp, Homo sapiens
ctttggcctgtgagcca

SEQ ID NO: 829883 - DNA, 14 bp, Homo sapiens
ctttggctgagacc

SEQ ID NO: 829884 - DNA, 15 bp, Homo sapiens
ctttggctggtagca

SEQ ID NO: 829885 - DNA, 18 bp, Homo sapiens
ctttggctggtagcagca

SEQ ID NO: 829886 - DNA, 21 bp, Homo sapiens
ctttggctggtagcagcaggc

SEQ ID NO: 829887 - DNA, 14 bp, Homo sapiens
ctttggcttctcct

SEQ ID NO: 829888 - DNA, 16 bp, Homo sapiens
ctttggcttctcctgt

SEQ ID NO: 829889 - DNA, 21 bp, Homo sapiens
ctttggcttctcctgtgaccc

SEQ ID NO: 829890 - DNA, 15 bp, Homo sapiens
ctttgggaaaggaga

SEQ ID NO: 829891 - DNA, 13 bp, Homo sapiens
ctttgggaatgtt

SEQ ID NO: 829892 - DNA, 23 bp, Homo sapiens
ctttgggagagcaggaatgaaaa

SEQ ID NO: 829893 - DNA, 15 bp, Homo sapiens
ctttgggaggccaag

SEQ ID NO: 829894 - DNA, 17 bp, Homo sapiens
ctttgggaggccaaggc

SEQ ID NO: 829895 - DNA, 12 bp, Homo sapiens
ctttgggagtcc

SEQ ID NO: 829896 - DNA, 20 bp, Homo sapiens
ctttgggatttaatttccag

SEQ ID NO: 829897 - DNA, 23 bp, Homo sapiens
ctttgggcccaagaactgcagat

SEQ ID NO: 829898 - DNA, 20 bp, Homo sapiens
ctttgggctgccctggtgct

SEQ ID NO: 829899 - DNA, 19 bp, Homo sapiens
ctttgggctttgcaggctc

SEQ ID NO: 829900 - DNA, 11 bp, Homo sapiens
cttttctcagg

SEQ ID NO: 829901 - DNA, 21 bp, Homo sapiens
cttttctccccacgatgatat

SEQ ID NO: 829902 - DNA, 16 bp, Homo sapiens
cttttctcctccgcct

SEQ ID NO: 829903 - DNA, 16 bp, Homo sapiens
cttttctcctttacca

SEQ ID NO: 829904 - DNA, 17 bp, Homo sapiens
cttttctcctttaccag

SEQ ID NO: 829905 - DNA, 13 bp, Homo sapiens
cttttctctgctc

SEQ ID NO: 829906 - DNA, 17 bp, Homo sapiens
cttttctctgctcttgt

SEQ ID NO: 829907 - DNA, 11 bp, Homo sapiens
cttttctcttt

SEQ ID NO: 829908 - DNA, 19 bp, Homo sapiens
cttttctcttttgctttct

SEQ ID NO: 829909 - DNA, 21 bp, Homo sapiens
cttttctgatcgtctcggccc

SEQ ID NO: 829910 - DNA, 17 bp, Homo sapiens
cttttctgattaatata

SEQ ID NO: 829911 - DNA, 12 bp, Homo sapiens
cttttctgcaga

SEQ ID NO: 829912 - DNA, 23 bp, Homo sapiens
cttttctgcatcatctgtagata

SEQ ID NO: 829913 - DNA, 20 bp, Homo sapiens
cttttctgcattttgctatt

SEQ ID NO: 829914 - DNA, 17 bp, Homo sapiens
cttttctgccctggctg

SEQ ID NO: 829915 - DNA, 15 bp, Homo sapiens
cttttctggtccctc

SEQ ID NO: 829916 - DNA, 14 bp, Homo sapiens
cttttctgtaattc

SEQ ID NO: 829917 - DNA, 21 bp, Homo sapiens
cttttctgtagatgttgtctt

SEQ ID NO: 829918 - DNA, 14 bp, Homo sapiens
cttttctgtcctgg

SEQ ID NO: 829919 - DNA, 18 bp, Homo sapiens
cttttctgtctctgcctc

SEQ ID NO: 829920 - DNA, 21 bp, Homo sapiens
cttttctgtctctgcctccct

SEQ ID NO: 829921 - DNA, 14 bp, Homo sapiens
cttttctgtgccag

SEQ ID NO: 829922 - DNA, 18 bp, Homo sapiens
cttttctgtggctggctc

SEQ ID NO: 829923 - DNA, 17 bp, Homo sapiens
cttttctgttctagttt

SEQ ID NO: 829924 - DNA, 14 bp, Homo sapiens
cttttctgttgtac

SEQ ID NO: 829925 - DNA, 15 bp, Homo sapiens
cttttcttactcctc

SEQ ID NO: 829926 - DNA, 17 bp, Homo sapiens
cttttcttactcctcct

SEQ ID NO: 829927 - DNA, 17 bp, Homo sapiens
cttttcttactctgaaa

SEQ ID NO: 829928 - DNA, 23 bp, Homo sapiens
cttttcttggttcttttttcagt

SEQ ID NO: 829929 - DNA, 14 bp, Homo sapiens
cttttctttctttt

SEQ ID NO: 829930 - DNA, 21 bp, Homo sapiens
cttttgaaagtagagctagct

SEQ ID NO: 829931 - DNA, 21 bp, Homo sapiens
cttttgaactgttagatgctg

SEQ ID NO: 829932 - DNA, 15 bp, Homo sapiens
cttttgaacttgtca

SEQ ID NO: 829933 - DNA, 19 bp, Homo sapiens
cttttgaatccatgcttgg

SEQ ID NO: 829934 - DNA, 17 bp, Homo sapiens
cttttgaattcttgata

SEQ ID NO: 829935 - DNA, 17 bp, Homo sapiens
cttttgacaaaggcaag

SEQ ID NO: 829936 - DNA, 15 bp, Homo sapiens
cttttgacggccttc

SEQ ID NO: 829937 - DNA, 15 bp, Homo sapiens
cttttgactaagaat

SEQ ID NO: 829938 - DNA, 18 bp, Homo sapiens
cttttgacttaaagcaga

SEQ ID NO: 829939 - DNA, 16 bp, Homo sapiens
cttttgaggcttctcc

SEQ ID NO: 829940 - DNA, 17 bp, Homo sapiens
cttttgagtatggctat

SEQ ID NO: 829941 - DNA, 15 bp, Homo sapiens
cttttgagtgggccc

SEQ ID NO: 829942 - DNA, 17 bp, Homo sapiens
cttttgagtgggccctg

SEQ ID NO: 829943 - DNA, 14 bp, Homo sapiens
cttttgatcacatt

SEQ ID NO: 829944 - DNA, 23 bp, Homo sapiens
cttttgatgatgtctacagaaaa

SEQ ID NO: 829945 - DNA, 20 bp, Homo sapiens
cttttgatgttcagagtggc

SEQ ID NO: 829946 - DNA, 22 bp, Homo sapiens
cttttgatgttcagagtggctc

SEQ ID NO: 829947 - DNA, 22 bp, Homo sapiens
cttttgcaaacaattttaatga

SEQ ID NO: 829948 - DNA, 20 bp, Homo sapiens
cttttgcaaagaaagaaaaa

SEQ ID NO: 829949 - DNA, 24 bp, Homo sapiens
cttttgcaaccaggaacagcaaat

SEQ ID NO: 829950 - DNA, 21 bp, Homo sapiens
cttttgcaataataataaatt

SEQ ID NO: 829951 - DNA, 16 bp, Homo sapiens
cttttgcacccctccc

SEQ ID NO: 829952 - DNA, 23 bp, Homo sapiens
cttttgcagaagagggtgtgttt

SEQ ID NO: 829953 - DNA, 21 bp, Homo sapiens
cttttgcatgtcgcacaatgt

SEQ ID NO: 829954 - DNA, 21 bp, Homo sapiens
cttttgcatttcctgtgtttg

SEQ ID NO: 829955 - DNA, 17 bp, Homo sapiens
cttttgcccattttgaa

SEQ ID NO: 829956 - DNA, 20 bp, Homo sapiens
cttttgcccttcacagtgtt

SEQ ID NO: 829957 - DNA, 21 bp, Homo sapiens
cttttgcccttcacagtgttt

SEQ ID NO: 829958 - DNA, 16 bp, Homo sapiens
cttttgcctgcaggtc

SEQ ID NO: 829959 - DNA, 13 bp, Homo sapiens
cttttgcctggct

SEQ ID NO: 829960 - DNA, 13 bp, Homo sapiens
cttttgcctgtaa

SEQ ID NO: 829961 - DNA, 19 bp, Homo sapiens
cttttgctacgtgcctccc

SEQ ID NO: 829962 - DNA, 18 bp, Homo sapiens
cttttgctgctgcttaat

SEQ ID NO: 829963 - DNA, 17 bp, Homo sapiens
cttttgctgtctttctc

SEQ ID NO: 829964 - DNA, 18 bp, Homo sapiens
cttttgctgtctttctct

SEQ ID NO: 829965 - DNA, 13 bp, Homo sapiens
cttttgctgttta

SEQ ID NO: 829966 - DNA, 17 bp, Homo sapiens
cttttgctgtttatact

SEQ ID NO: 829967 - DNA, 19 bp, Homo sapiens
cttttgcttaccttttcct

SEQ ID NO: 829968 - DNA, 14 bp, Homo sapiens
cttttgctttattc

SEQ ID NO: 829969 - DNA, 11 bp, Homo sapiens
cttttgctttt

SEQ ID NO: 829970 - DNA, 16 bp, Homo sapiens
cttttgcttttgccca

SEQ ID NO: 829971 - DNA, 18 bp, Homo sapiens
cttttgcttttgcccatt

SEQ ID NO: 829972 - DNA, 19 bp, Homo sapiens
cttttggaaccatgccttc

SEQ ID NO: 829973 - DNA, 15 bp, Homo sapiens
cttttggcactgaga

SEQ ID NO: 829974 - DNA, 12 bp, Homo sapiens
cttttggccttg

SEQ ID NO: 829975 - DNA, 15 bp, Homo sapiens
cttttggcttccatg

SEQ ID NO: 829976 - DNA, 21 bp, Homo sapiens
cttttggtcttcagcctccct

SEQ ID NO: 829977 - DNA, 15 bp, Homo sapiens
cttttggtgtgttgg

SEQ ID NO: 829978 - DNA, 19 bp, Homo sapiens
cttttggtttcaccttccc

SEQ ID NO: 829979 - DNA, 10 bp, Homo sapiens
cttttgtaaa

SEQ ID NO: 829980 - DNA, 15 bp, Homo sapiens
cttttgtaaatattc

SEQ ID NO: 829981 - DNA, 11 bp, Homo sapiens
cttttgtaatt

SEQ ID NO: 829982 - DNA, 21 bp, Homo sapiens
cttttgtaattgtgtaaaaaa

SEQ ID NO: 829983 - DNA, 15 bp, Homo sapiens
cttttgtaatttgaa

SEQ ID NO: 829984 - DNA, 18 bp, Homo sapiens
cttttgtaatttgaattg

SEQ ID NO: 829985 - DNA, 19 bp, Homo sapiens
cttttgtaatttgaattgg

SEQ ID NO: 829986 - DNA, 22 bp, Homo sapiens
cttttgtaggctgttccctttg

SEQ ID NO: 829987 - DNA, 18 bp, Homo sapiens
cttttgtatgtaaatgtg

SEQ ID NO: 829988 - DNA, 11 bp, Homo sapiens
cttttgtatta

SEQ ID NO: 829989 - DNA, 15 bp, Homo sapiens
cttttgtccccaggg

SEQ ID NO: 829990 - DNA, 17 bp, Homo sapiens
cttttgtccccagggcc

SEQ ID NO: 829991 - DNA, 14 bp, Homo sapiens
cttttgtgaacttt

SEQ ID NO: 829992 - DNA, 13 bp, Homo sapiens
cttttgtgatgaa

SEQ ID NO: 829993 - DNA, 15 bp, Homo sapiens
cttttgtgatgaaca

SEQ ID NO: 829994 - DNA, 20 bp, Homo sapiens
cttttgtgatggagtgctgt

SEQ ID NO: 829995 - DNA, 22 bp, Homo sapiens
cttttgtgatggagtgctgttt

SEQ ID NO: 829996 - DNA, 13 bp, Homo sapiens
cttttgtggagtt

SEQ ID NO: 829997 - DNA, 15 bp, Homo sapiens
cttttgtggtgtctt

SEQ ID NO: 829998 - DNA, 17 bp, Homo sapiens
cttttgtggtgtcttcc

SEQ ID NO: 829999 - DNA, 18 bp, Homo sapiens
cttttgtgtaataagaaa

SEQ ID NO: 830000 - DNA, 23 bp, Homo sapiens
cttttgtgtacagtgtgtaaagt

SEQ ID NO: 830001 - DNA, 23 bp, Homo sapiens
cttttgtgtcacttttttctgcc

SEQ ID NO: 830002 - DNA, 19 bp, Homo sapiens
cttttgtgtgaattgacta

SEQ ID NO: 830003 - DNA, 23 bp, Homo sapiens
cttttgtgtgatgcgccttgctg

SEQ ID NO: 830004 - DNA, 23 bp, Homo sapiens
cttttgtgtgcctggtagaaact

SEQ ID NO: 830005 - DNA, 20 bp, Homo sapiens
cttttgttaggaaaaaattg

SEQ ID NO: 830006 - DNA, 21 bp, Homo sapiens
cttttgttagggctgcttttc

SEQ ID NO: 830007 - DNA, 15 bp, Homo sapiens
cttttgttctagact

SEQ ID NO: 830008 - DNA, 22 bp, Homo sapiens
cttttgttctgctttatctttt

SEQ ID NO: 830009 - DNA, 11 bp, Homo sapiens
cttttgttctt

SEQ ID NO: 830010 - DNA, 20 bp, Homo sapiens
cttttgttcttggtttgtaa

SEQ ID NO: 830011 - DNA, 22 bp, Homo sapiens
cttttgttcttggtttgtaaat

SEQ ID NO: 830012 - DNA, 22 bp, Homo sapiens
cttttgttgcccaggctggagt

SEQ ID NO: 830013 - DNA, 15 bp, Homo sapiens
cttttgttgtccttg

SEQ ID NO: 830014 - DNA, 13 bp, Homo sapiens
cttttgtttccat

SEQ ID NO: 830015 - DNA, 21 bp, Homo sapiens
cttttgtttcccttgctttgt

SEQ ID NO: 830016 - DNA, 15 bp, Homo sapiens
cttttgtttcctttt

SEQ ID NO: 830017 - DNA, 19 bp, Homo sapiens
cttttgtttccttttttcc

SEQ ID NO: 830018 - DNA, 14 bp, Homo sapiens
cttttgttttttgg

SEQ ID NO: 830019 - DNA, 13 bp, Homo sapiens
cttttgttttttt

SEQ ID NO: 830020 - DNA, 12 bp, Homo sapiens
ctttttaaaaaa

SEQ ID NO: 830021 - DNA, 13 bp, Homo sapiens
ctttttaaaaaac

SEQ ID NO: 830022 - DNA, 14 bp, Homo sapiens
gaaaaaaaaaagaa

SEQ ID NO: 830023 - DNA, 20 bp, Homo sapiens
gaaaaaaaaaaggtgtttat

SEQ ID NO: 830024 - DNA, 18 bp, Homo sapiens
gaaaaaaaaaatgcattt

SEQ ID NO: 830025 - DNA, 20 bp, Homo sapiens
gaaaaaaaaaatgttgagaa

SEQ ID NO: 830026 - DNA, 12 bp, Homo sapiens
gaaaaaaaaaga

SEQ ID NO: 830027 - DNA, 18 bp, Homo sapiens
gaaaaaaaaagaaaaaag

SEQ ID NO: 830028 - DNA, 16 bp, Homo sapiens
gaaaaaaaacagtgga

SEQ ID NO: 830029 - DNA, 19 bp, Homo sapiens
gaaaaaaaactgaagatga

SEQ ID NO: 830030 - DNA, 22 bp, Homo sapiens
gaaaaaaaactgaagatgaaat

SEQ ID NO: 830031 - DNA, 12 bp, Homo sapiens
gaaaaaaaagaa

SEQ ID NO: 830032 - DNA, 14 bp, Homo sapiens
gaaaaaaaagaaaa

SEQ ID NO: 830033 - DNA, 16 bp, Homo sapiens
gaaaaaaaagaaaaaa

SEQ ID NO: 830034 - DNA, 19 bp, Homo sapiens
gaaaaaaaagtttcagaga

SEQ ID NO: 830035 - DNA, 13 bp, Homo sapiens
gaaaaaaaatata

SEQ ID NO: 830036 - DNA, 15 bp, Homo sapiens
gaaaaaaaatatata

SEQ ID NO: 830037 - DNA, 23 bp, Homo sapiens
gaaaaaaaatatatatatatatt

SEQ ID NO: 830038 - DNA, 14 bp, Homo sapiens
gaaaaaaaatgtac

SEQ ID NO: 830039 - DNA, 16 bp, Homo sapiens
gaaaaaaaccacacaa

SEQ ID NO: 830040 - DNA, 21 bp, Homo sapiens
gaaaaaaaccacacaaagaca

SEQ ID NO: 830041 - DNA, 17 bp, Homo sapiens
gaaaaaaagggagaata

SEQ ID NO: 830042 - DNA, 18 bp, Homo sapiens
gaaaaaaagtttgccaga

SEQ ID NO: 830043 - DNA, 19 bp, Homo sapiens
gaaaaaaataactattttg

SEQ ID NO: 830044 - DNA, 13 bp, Homo sapiens
gaaaaaaatgttg

SEQ ID NO: 830045 - DNA, 18 bp, Homo sapiens
gaaaaaaattgaaatgta

SEQ ID NO: 830046 - DNA, 12 bp, Homo sapiens
gaaaaaagaaag

SEQ ID NO: 830047 - DNA, 17 bp, Homo sapiens
gaaaaaagaaagaaaaa

SEQ ID NO: 830048 - DNA, 13 bp, Homo sapiens
gaaaaaagaacca

SEQ ID NO: 830049 - DNA, 21 bp, Homo sapiens
gaaaaaagaagtgtccgagaa

SEQ ID NO: 830050 - DNA, 17 bp, Homo sapiens
gaaaaaagagaaaagaa

SEQ ID NO: 830051 - DNA, 22 bp, Homo sapiens
gaaaaaatggtagcattttaaa

SEQ ID NO: 830052 - DNA, 21 bp, Homo sapiens
gaaaaaatgttggatttataa

SEQ ID NO: 830053 - DNA, 20 bp, Homo sapiens
gaaaaacaacaacacaataa

SEQ ID NO: 830054 - DNA, 15 bp, Homo sapiens
gaaaaacaatcttat

SEQ ID NO: 830055 - DNA, 22 bp, Homo sapiens
gaaaaacatcccaaactttaaa

SEQ ID NO: 830056 - DNA, 22 bp, Homo sapiens
gaaaaacatttaaactttttaa

SEQ ID NO: 830057 - DNA, 23 bp, Homo sapiens
gaaaaacatttaaactttttaaa

SEQ ID NO: 830058 - DNA, 15 bp, Homo sapiens
gaaaaaccatttgaa

SEQ ID NO: 830059 - DNA, 20 bp, Homo sapiens
gaaaaacttccatgaggcca

SEQ ID NO: 830060 - DNA, 20 bp, Homo sapiens
gaaaaagagcatatactggt

SEQ ID NO: 830061 - DNA, 21 bp, Homo sapiens
gaaaaagcatgatgggaaaat

SEQ ID NO: 830062 - DNA, 13 bp, Homo sapiens
gaaaaagcgaaaa

SEQ ID NO: 830063 - DNA, 23 bp, Homo sapiens
gaaaaaggatgcacagagttgtt

SEQ ID NO: 830064 - DNA, 13 bp, Homo sapiens
gaaaaaggcagtg

SEQ ID NO: 830065 - DNA, 15 bp, Homo sapiens
gaaaaagtacaatga

SEQ ID NO: 830066 - DNA, 14 bp, Homo sapiens
gaaaaagtttgttt

SEQ ID NO: 830067 - DNA, 20 bp, Homo sapiens
gaaaaataaatgtcactgcc

SEQ ID NO: 830068 - DNA, 22 bp, Homo sapiens
gaaaaataccatgtctctaagc

SEQ ID NO: 830069 - DNA, 15 bp, Homo sapiens
gaaaaatactttgat

SEQ ID NO: 830070 - DNA, 10 bp, Homo sapiens
gaaaaatatt

SEQ ID NO: 830071 - DNA, 17 bp, Homo sapiens
gaaaaatccagaaagaa

SEQ ID NO: 830072 - DNA, 19 bp, Homo sapiens
gaaaaatcgcgagtgtttc

SEQ ID NO: 830073 - DNA, 20 bp, Homo sapiens
gaaaaatctaagtgatataa

SEQ ID NO: 830074 - DNA, 18 bp, Homo sapiens
gaaaaatcttaagtacca

SEQ ID NO: 830075 - DNA, 21 bp, Homo sapiens
gaaaaatcttgtgctagaata

SEQ ID NO: 830076 - DNA, 22 bp, Homo sapiens
gaaaaatcttgtgctagaatac

SEQ ID NO: 830077 - DNA, 22 bp, Homo sapiens
gaaaaatgaaaacttttgtaaa

SEQ ID NO: 830078 - DNA, 23 bp, Homo sapiens
gaaaaatgaaaacttttgtaaat

SEQ ID NO: 830079 - DNA, 15 bp, Homo sapiens
gaaaaatgaaaagca

SEQ ID NO: 830080 - DNA, 16 bp, Homo sapiens
gaaaaatgaaaagcaa

SEQ ID NO: 830081 - DNA, 16 bp, Homo sapiens
gaaaaatgagcctggc

SEQ ID NO: 830082 - DNA, 20 bp, Homo sapiens
gaaaaatgcccatttttgct

SEQ ID NO: 830083 - DNA, 21 bp, Homo sapiens
gaaaaatggttgatggaaaat

SEQ ID NO: 830084 - DNA, 23 bp, Homo sapiens
gaaaaatggttgatggaaaataa

SEQ ID NO: 830085 - DNA, 18 bp, Homo sapiens
gaaaaatgtaaaacacat

SEQ ID NO: 830086 - DNA, 19 bp, Homo sapiens
gaaaaatgtaatttagaaa

SEQ ID NO: 830087 - DNA, 17 bp, Homo sapiens
gaaaaatgtgtggttct

SEQ ID NO: 830088 - DNA, 14 bp, Homo sapiens
gaaaaattaacttt

SEQ ID NO: 830089 - DNA, 12 bp, Homo sapiens
gaaaaattatta

SEQ ID NO: 830090 - DNA, 14 bp, Homo sapiens
gaaaacaaaatcta

SEQ ID NO: 830091 - DNA, 15 bp, Homo sapiens
gaaaacaaaatctaa

SEQ ID NO: 830092 - DNA, 19 bp, Homo sapiens
gaaaacaaaatctaaaaca

SEQ ID NO: 830093 - DNA, 13 bp, Homo sapiens
gaaaacaacaaaa

SEQ ID NO: 830094 - DNA, 14 bp, Homo sapiens
gaaaacaacaaaag

SEQ ID NO: 830095 - DNA, 15 bp, Homo sapiens
gaaaacaacaaaaga

SEQ ID NO: 830096 - DNA, 24 bp, Homo sapiens
gaaaacaaccgtcctgctgtccct

SEQ ID NO: 830097 - DNA, 18 bp, Homo sapiens
gaaaacaaggtttccata

SEQ ID NO: 830098 - DNA, 19 bp, Homo sapiens
gaaaacaatattgtatact

SEQ ID NO: 830099 - DNA, 12 bp, Homo sapiens
gaaaacaatgca

SEQ ID NO: 830100 - DNA, 18 bp, Homo sapiens
gaaaacacagcctccctg

SEQ ID NO: 830101 - DNA, 19 bp, Homo sapiens
gaaaacacatttttcttag

SEQ ID NO: 830102 - DNA, 15 bp, Homo sapiens
gaaaacagaacactt

SEQ ID NO: 830103 - DNA, 17 bp, Homo sapiens
gaaaacagagtatttct

SEQ ID NO: 830104 - DNA, 23 bp, Homo sapiens
gaaaacaggaaaaaaacttttat

SEQ ID NO: 830105 - DNA, 20 bp, Homo sapiens
gaaaacaggacttaaaatga

SEQ ID NO: 830106 - DNA, 17 bp, Homo sapiens
gaaaacagtacagaagg

SEQ ID NO: 830107 - DNA, 12 bp, Homo sapiens
gaaaacatgcta

SEQ ID NO: 830108 - DNA, 19 bp, Homo sapiens
gaaaacatgctacacactg

SEQ ID NO: 830109 - DNA, 18 bp, Homo sapiens
gaaaacattacatgctca

SEQ ID NO: 830110 - DNA, 19 bp, Homo sapiens
gaaaacattacatgctcag

SEQ ID NO: 830111 - DNA, 20 bp, Homo sapiens
gaaaacattctgatttggaa

SEQ ID NO: 830112 - DNA, 18 bp, Homo sapiens
gaaaacattgctttgtgg

SEQ ID NO: 830113 - DNA, 15 bp, Homo sapiens
gaaaacatttaacat

SEQ ID NO: 830114 - DNA, 16 bp, Homo sapiens
gaaaacatttaacata

SEQ ID NO: 830115 - DNA, 18 bp, Homo sapiens
gaaaacatttaacataat

SEQ ID NO: 830116 - DNA, 18 bp, Homo sapiens
gaaaacatttcaaagctg

SEQ ID NO: 830117 - DNA, 19 bp, Homo sapiens
gaaaaccaaattttaaaag

SEQ ID NO: 830118 - DNA, 16 bp, Homo sapiens
gaaaaccatcacatga

SEQ ID NO: 830119 - DNA, 13 bp, Homo sapiens
gaaaacccgaggg

SEQ ID NO: 830120 - DNA, 17 bp, Homo sapiens
gaaaacccttgggccag

SEQ ID NO: 830121 - DNA, 21 bp, Homo sapiens
gaaaacctaagtcctttatgt

SEQ ID NO: 830122 - DNA, 15 bp, Homo sapiens
gaaaacctttcttca

SEQ ID NO: 830123 - DNA, 21 bp, Homo sapiens
gaaaacgaagtctttttcatt

SEQ ID NO: 830124 - DNA, 14 bp, Homo sapiens
gaaaacgttttatt

SEQ ID NO: 830125 - DNA, 16 bp, Homo sapiens
gaaaacgttttattgt

SEQ ID NO: 830126 - DNA, 18 bp, Homo sapiens
gaaaacgttttattgtgt

SEQ ID NO: 830127 - DNA, 19 bp, Homo sapiens
gaaaactattgagccttgc

SEQ ID NO: 830128 - DNA, 21 bp, Homo sapiens
gaaaactattgagccttgcat

SEQ ID NO: 830129 - DNA, 19 bp, Homo sapiens
gaaaactcaaccagagtca

SEQ ID NO: 830130 - DNA, 22 bp, Homo sapiens
gaaaactcatgatcaagatata

SEQ ID NO: 830131 - DNA, 17 bp, Homo sapiens
gaaaactcattactttt

SEQ ID NO: 830132 - DNA, 21 bp, Homo sapiens
gaaaactccagggtcccctgc

SEQ ID NO: 830133 - DNA, 18 bp, Homo sapiens
gaaaactcccaatacaaa

SEQ ID NO: 830134 - DNA, 20 bp, Homo sapiens
gaaaactcctttagcaggtg

SEQ ID NO: 830135 - DNA, 22 bp, Homo sapiens
gaaaactgtgcaactttttaaa

SEQ ID NO: 830136 - DNA, 23 bp, Homo sapiens
gaaaactgtgcaactttttaaag

SEQ ID NO: 830137 - DNA, 16 bp, Homo sapiens
gaaaacttcagaagca

SEQ ID NO: 830138 - DNA, 16 bp, Homo sapiens
gaaaactttaaagcgt

SEQ ID NO: 830139 - DNA, 17 bp, Homo sapiens
gaaaacttttgtaaatt

SEQ ID NO: 830140 - DNA, 22 bp, Homo sapiens
gaaaacttttgtaaattattga

SEQ ID NO: 830141 - DNA, 10 bp, Homo sapiens
gaaaagaaaa

SEQ ID NO: 830142 - DNA, 12 bp, Homo sapiens
gaaaagaaaaaa

SEQ ID NO: 830143 - DNA, 14 bp, Homo sapiens
gaaaatgtccagga

SEQ ID NO: 830144 - DNA, 22 bp, Homo sapiens
gaaaatgtctgtaataatagac

SEQ ID NO: 830145 - DNA, 14 bp, Homo sapiens
gaaaatgtcttgtg

SEQ ID NO: 830146 - DNA, 20 bp, Homo sapiens
gaaaatgtgaccctccaaat

SEQ ID NO: 830147 - DNA, 21 bp, Homo sapiens
gaaaatgttctgtttgctgtg

SEQ ID NO: 830148 - DNA, 22 bp, Homo sapiens
gaaaatgttttacattccattt

SEQ ID NO: 830149 - DNA, 18 bp, Homo sapiens
gaaaattaattatatttc

SEQ ID NO: 830150 - DNA, 17 bp, Homo sapiens
gaaaattacatgttttt

SEQ ID NO: 830151 - DNA, 16 bp, Homo sapiens
gaaaattacgttctta

SEQ ID NO: 830152 - DNA, 22 bp, Homo sapiens
gaaaattaggatttcatgattt

SEQ ID NO: 830153 - DNA, 19 bp, Homo sapiens
gaaaattatgcaaaagcag

SEQ ID NO: 830154 - DNA, 23 bp, Homo sapiens
gaaaattatttaaaccgctaaaa

SEQ ID NO: 830155 - DNA, 17 bp, Homo sapiens
gaaaattatttgtatga

SEQ ID NO: 830156 - DNA, 17 bp, Homo sapiens
gaaaattcaaaaagtgt

SEQ ID NO: 830157 - DNA, 21 bp, Homo sapiens
gaaaattcaaaaagtgtttat

SEQ ID NO: 830158 - DNA, 14 bp, Homo sapiens
gaaaattcattttt

SEQ ID NO: 830159 - DNA, 14 bp, Homo sapiens
gaaaattccagaaa

SEQ ID NO: 830160 - DNA, 22 bp, Homo sapiens
gaaaattctaacccaggtatcc

SEQ ID NO: 830161 - DNA, 13 bp, Homo sapiens
gaaaattctgtgc

SEQ ID NO: 830162 - DNA, 12 bp, Homo sapiens
gaaaattctgtt

SEQ ID NO: 830163 - DNA, 21 bp, Homo sapiens
gaaaattgaaagtattcagaa

SEQ ID NO: 830164 - DNA, 16 bp, Homo sapiens
gaaaattgcatgaaac

SEQ ID NO: 830165 - DNA, 22 bp, Homo sapiens
gaaaattgctgtgcctcccaaa

SEQ ID NO: 830166 - DNA, 22 bp, Homo sapiens
gaaaatttagccctttaaaacg

SEQ ID NO: 830167 - DNA, 17 bp, Homo sapiens
gaaaatttgaaaatgtc

SEQ ID NO: 830168 - DNA, 18 bp, Homo sapiens
gaaaatttgaaaatgtcc

SEQ ID NO: 830169 - DNA, 14 bp, Homo sapiens
gaaaattttaaaaa

SEQ ID NO: 830170 - DNA, 18 bp, Homo sapiens
gaaaattttgatgtttta

SEQ ID NO: 830171 - DNA, 15 bp, Homo sapiens
gaaaatttttacatt

SEQ ID NO: 830172 - DNA, 14 bp, Homo sapiens
gaaacaaaaacact

SEQ ID NO: 830173 - DNA, 19 bp, Homo sapiens
gaaacaaaaacactaaaaa

SEQ ID NO: 830174 - DNA, 17 bp, Homo sapiens
gaaacaaaaagagcttt

SEQ ID NO: 830175 - DNA, 13 bp, Homo sapiens
gaaacaaagaagg

SEQ ID NO: 830176 - DNA, 22 bp, Homo sapiens
gaaacaagctgtgcaggcatgg

SEQ ID NO: 830177 - DNA, 16 bp, Homo sapiens
gaaacaagtctagtct

SEQ ID NO: 830178 - DNA, 21 bp, Homo sapiens
gaaacaagtctagtcttctgg

SEQ ID NO: 830179 - DNA, 14 bp, Homo sapiens
gaaacaatactgtt

SEQ ID NO: 830180 - DNA, 17 bp, Homo sapiens
gaaacaatgaaaacaaa

SEQ ID NO: 830181 - DNA, 16 bp, Homo sapiens
gaaacaatgaaatttt

SEQ ID NO: 830182 - DNA, 9 bp, Homo sapiens
gaaacacaa

SEQ ID NO: 830183 - DNA, 14 bp, Homo sapiens
gaaacacaatattt

SEQ ID NO: 830184 - DNA, 18 bp, Homo sapiens
gaaacacacaagcaacaa

SEQ ID NO: 830185 - DNA, 16 bp, Homo sapiens
gaaacacaccaggctg

SEQ ID NO: 830186 - DNA, 15 bp, Homo sapiens
gaaacacagagaagc

SEQ ID NO: 830187 - DNA, 14 bp, Homo sapiens
gaaacacatgccag

SEQ ID NO: 830188 - DNA, 23 bp, Homo sapiens
gaaacaccattataaaaacactt

SEQ ID NO: 830189 - DNA, 16 bp, Homo sapiens
gaaacacccctctgtc

SEQ ID NO: 830190 - DNA, 21 bp, Homo sapiens
gaaacacccctctgtctagga

SEQ ID NO: 830191 - DNA, 22 bp, Homo sapiens
gaaacacccctctgtctaggac

SEQ ID NO: 830192 - DNA, 18 bp, Homo sapiens
gaaacacgaaacttgtta

SEQ ID NO: 830193 - DNA, 14 bp, Homo sapiens
gaaacactaaggct

SEQ ID NO: 830194 - DNA, 13 bp, Homo sapiens
gaaacactcttat

SEQ ID NO: 830195 - DNA, 17 bp, Homo sapiens
gaaacactgactcctgt

SEQ ID NO: 830196 - DNA, 13 bp, Homo sapiens
gaaacactgcttc

SEQ ID NO: 830197 - DNA, 14 bp, Homo sapiens
gaaacactggacct

SEQ ID NO: 830198 - DNA, 16 bp, Homo sapiens
gaaacagagaaagaaa

SEQ ID NO: 830199 - DNA, 18 bp, Homo sapiens
gaaacagagaaagaaaag

SEQ ID NO: 830200 - DNA, 16 bp, Homo sapiens
gaaacagagtccaatt

SEQ ID NO: 830201 - DNA, 18 bp, Homo sapiens
gaaacagatgaaaagcct

SEQ ID NO: 830202 - DNA, 22 bp, Homo sapiens
gaaacagatgataaatatttat

SEQ ID NO: 830203 - DNA, 19 bp, Homo sapiens
gaaacagattcaggccagc

SEQ ID NO: 830204 - DNA, 20 bp, Homo sapiens
gaaacagattcaggccagcc

SEQ ID NO: 830205 - DNA, 12 bp, Homo sapiens
gaaacagcatga

SEQ ID NO: 830206 - DNA, 15 bp, Homo sapiens
gaaacagcatgaata

SEQ ID NO: 830207 - DNA, 16 bp, Homo sapiens
gaaacagcatgaataa

SEQ ID NO: 830208 - DNA, 12 bp, Homo sapiens
gaaacagcctgg

SEQ ID NO: 830209 - DNA, 14 bp, Homo sapiens
gaaacagctgcttc

SEQ ID NO: 830210 - DNA, 16 bp, Homo sapiens
gaaacagctgcttctc

SEQ ID NO: 830211 - DNA, 21 bp, Homo sapiens
gaaacagctgcttctcccccc

SEQ ID NO: 830212 - DNA, 19 bp, Homo sapiens
gaaacagctttaggggtgg

SEQ ID NO: 830213 - DNA, 21 bp, Homo sapiens
gaaacagctttcaagtgcctt

SEQ ID NO: 830214 - DNA, 13 bp, Homo sapiens
gaaacagggcagc

SEQ ID NO: 830215 - DNA, 23 bp, Homo sapiens
gaaacagggcagcagtggggtga

SEQ ID NO: 830216 - DNA, 19 bp, Homo sapiens
gaaacagtgcgttgagtgt

SEQ ID NO: 830217 - DNA, 12 bp, Homo sapiens
gaaacagttcca

SEQ ID NO: 830218 - DNA, 20 bp, Homo sapiens
gaaacagttgcatgtagtaa

SEQ ID NO: 830219 - DNA, 21 bp, Homo sapiens
gaaacagttgctgtgaacttt

SEQ ID NO: 830220 - DNA, 22 bp, Homo sapiens
gaaacataataataatgggttt

SEQ ID NO: 830221 - DNA, 19 bp, Homo sapiens
gaaacatcagttactctga

SEQ ID NO: 830222 - DNA, 16 bp, Homo sapiens
gaaacattacagttca

SEQ ID NO: 830223 - DNA, 19 bp, Homo sapiens
gaaacattcatttttacct

SEQ ID NO: 830224 - DNA, 18 bp, Homo sapiens
gaaacattgccatgtaac

SEQ ID NO: 830225 - DNA, 12 bp, Homo sapiens
gaaacattgtaa

SEQ ID NO: 830226 - DNA, 19 bp, Homo sapiens
gaaacatttacaataaata

SEQ ID NO: 830227 - DNA, 22 bp, Homo sapiens
gaaacatttacaataaatattc

SEQ ID NO: 830228 - DNA, 21 bp, Homo sapiens
gaaacattttatactgtacat

SEQ ID NO: 830229 - DNA, 17 bp, Homo sapiens
gaaaccaaaacataaaa

SEQ ID NO: 830230 - DNA, 22 bp, Homo sapiens
gaaaccaaagatatatacacag

SEQ ID NO: 830231 - DNA, 15 bp, Homo sapiens
gaaaccaaagtctgc

SEQ ID NO: 830232 - DNA, 18 bp, Homo sapiens
gaaaccaagtcaggccag

SEQ ID NO: 830233 - DNA, 20 bp, Homo sapiens
gaaaccaagtcaggccaggt

SEQ ID NO: 830234 - DNA, 15 bp, Homo sapiens
gaaaccaagtgggct

SEQ ID NO: 830235 - DNA, 18 bp, Homo sapiens
gaaaccacaaccttgcag

SEQ ID NO: 830236 - DNA, 19 bp, Homo sapiens
gaaaccagtgtagccttgc

SEQ ID NO: 830237 - DNA, 12 bp, Homo sapiens
gaaaccatgaca

SEQ ID NO: 830238 - DNA, 22 bp, Homo sapiens
gaaaccatgactgtgaccacct

SEQ ID NO: 830239 - DNA, 14 bp, Homo sapiens
gaaacccaagctcc

SEQ ID NO: 830240 - DNA, 19 bp, Homo sapiens
gaaaccccccaatgtctgt

SEQ ID NO: 830241 - DNA, 19 bp, Homo sapiens
gaaacccctgtaggcctca

SEQ ID NO: 830242 - DNA, 17 bp, Homo sapiens
gaaacccggcttcctgt

SEQ ID NO: 830243 - DNA, 14 bp, Homo sapiens
gaaaccctctgtca

SEQ ID NO: 830244 - DNA, 16 bp, Homo sapiens
gaaaccctggagccat

SEQ ID NO: 830245 - DNA, 18 bp, Homo sapiens
gaaacccttgctgcttta

SEQ ID NO: 830246 - DNA, 11 bp, Homo sapiens
gaaaccctttt

SEQ ID NO: 830247 - DNA, 21 bp, Homo sapiens
gaaaccgagtagaaaatgtga

SEQ ID NO: 830248 - DNA, 21 bp, Homo sapiens
gaaaccgcctagtttactgtt

SEQ ID NO: 830249 - DNA, 21 bp, Homo sapiens
gaaaccgggagaaggcatgag

SEQ ID NO: 830250 - DNA, 17 bp, Homo sapiens
gaaacctagtactgccc

SEQ ID NO: 830251 - DNA, 20 bp, Homo sapiens
gaaacctatctcagggaggg

SEQ ID NO: 830252 - DNA, 17 bp, Homo sapiens
gaaaccttattgtacct

SEQ ID NO: 830253 - DNA, 13 bp, Homo sapiens
gaaaccttatttt

SEQ ID NO: 830254 - DNA, 12 bp, Homo sapiens
gaaaccttggag

SEQ ID NO: 830255 - DNA, 13 bp, Homo sapiens
gaaaccttggaga

SEQ ID NO: 830256 - DNA, 16 bp, Homo sapiens
gaaacctttttttgat

SEQ ID NO: 830257 - DNA, 15 bp, Homo sapiens
gaaacgaaaaggaca

SEQ ID NO: 830258 - DNA, 19 bp, Homo sapiens
gaaacgactcaaaatgaca

SEQ ID NO: 830259 - DNA, 15 bp, Homo sapiens
gaaacgcacttacaa

SEQ ID NO: 830260 - DNA, 17 bp, Homo sapiens
gaaacgcacttacaagt

SEQ ID NO: 830261 - DNA, 20 bp, Homo sapiens
gaaacgctacctctctgtcc

SEQ ID NO: 830262 - DNA, 18 bp, Homo sapiens
gaaacggtatcctccctg

SEQ ID NO: 830263 - DNA, 21 bp, Homo sapiens
gaaacggtatcctccctgccc

SEQ ID NO: 830264 - DNA, 19 bp, Homo sapiens
gaaacgtatgtgtgcagga

SEQ ID NO: 830265 - DNA, 17 bp, Homo sapiens
gaaagcgtttctgtgta

SEQ ID NO: 830266 - DNA, 19 bp, Homo sapiens
gaaagctagatatgcctta

SEQ ID NO: 830267 - DNA, 19 bp, Homo sapiens
gaaagctatataagacaag

SEQ ID NO: 830268 - DNA, 18 bp, Homo sapiens
gaaagctgaggaacaggt

SEQ ID NO: 830269 - DNA, 20 bp, Homo sapiens
gaaagctgtgtttatatgga

SEQ ID NO: 830270 - DNA, 17 bp, Homo sapiens
gaaagcttcaaactgca

SEQ ID NO: 830271 - DNA, 18 bp, Homo sapiens
gaaaggaactgcaataat

SEQ ID NO: 830272 - DNA, 23 bp, Homo sapiens
gaaaggaagcattgtaaaataat

SEQ ID NO: 830273 - DNA, 22 bp, Homo sapiens
gaaaggaagctccactgtcacc

SEQ ID NO: 830274 - DNA, 13 bp, Homo sapiens
gaaaggacccacc

SEQ ID NO: 830275 - DNA, 22 bp, Homo sapiens
gaaaggagagaacgggcgtcag

SEQ ID NO: 830276 - DNA, 12 bp, Homo sapiens
gaaaggagatgt

SEQ ID NO: 830277 - DNA, 22 bp, Homo sapiens
gaaaggaggccctgttccctgg

SEQ ID NO: 830278 - DNA, 14 bp, Homo sapiens
gaaaggaggggaga

SEQ ID NO: 830279 - DNA, 15 bp, Homo sapiens
gaaaggaggtggggg

SEQ ID NO: 830280 - DNA, 15 bp, Homo sapiens
gaaaggagtagaaaa

SEQ ID NO: 830281 - DNA, 14 bp, Homo sapiens
gaaaggatatttaa

SEQ ID NO: 830282 - DNA, 20 bp, Homo sapiens
gaaaggatatttaagaaaat

SEQ ID NO: 830283 - DNA, 21 bp, Homo sapiens
gaaaggatggagtgttttagt

SEQ ID NO: 830284 - DNA, 20 bp, Homo sapiens
gaaaggcaggcctatttcat

SEQ ID NO: 830285 - DNA, 16 bp, Homo sapiens
gaaaggccccaatctt

SEQ ID NO: 830286 - DNA, 19 bp, Homo sapiens
gaaaggccccaatcttgcc

SEQ ID NO: 830287 - DNA, 18 bp, Homo sapiens
gaaaggcctcaagaacaa

SEQ ID NO: 830288 - DNA, 20 bp, Homo sapiens
gaaaggccttcagacacatg

SEQ ID NO: 830289 - DNA, 14 bp, Homo sapiens
gaaaggctcagtct

SEQ ID NO: 830290 - DNA, 19 bp, Homo sapiens
gaaaggctcagtctcagga

SEQ ID NO: 830291 - DNA, 16 bp, Homo sapiens
gaaagggaaactggct

SEQ ID NO: 830292 - DNA, 22 bp, Homo sapiens
gaaagggagctatcaggaacag

SEQ ID NO: 830293 - DNA, 23 bp, Homo sapiens
gaaagggcacttaatttgtaaac

SEQ ID NO: 830294 - DNA, 13 bp, Homo sapiens
gaaagggcctggc

SEQ ID NO: 830295 - DNA, 14 bp, Homo sapiens
gaaagggcctggcc

SEQ ID NO: 830296 - DNA, 18 bp, Homo sapiens
gaaagggctatggcaagg

SEQ ID NO: 830297 - DNA, 15 bp, Homo sapiens
gaaaggggaaagaaa

SEQ ID NO: 830298 - DNA, 18 bp, Homo sapiens
gaaaggggaaagaaaggg

SEQ ID NO: 830299 - DNA, 20 bp, Homo sapiens
gaaaggggagagcctgctgg

SEQ ID NO: 830300 - DNA, 17 bp, Homo sapiens
gaaaggggtcggctgac

SEQ ID NO: 830301 - DNA, 15 bp, Homo sapiens
gaaaggggtgctttt

SEQ ID NO: 830302 - DNA, 19 bp, Homo sapiens
gaaagggtgctgcttccct

SEQ ID NO: 830303 - DNA, 21 bp, Homo sapiens
gaaaggtactatatttgctag

SEQ ID NO: 830304 - DNA, 21 bp, Homo sapiens
gaaaggtcagcccgtttcaga

SEQ ID NO: 830305 - DNA, 18 bp, Homo sapiens
gaaaggtctcagcttgta

SEQ ID NO: 830306 - DNA, 13 bp, Homo sapiens
gaaaggtgctata

SEQ ID NO: 830307 - DNA, 22 bp, Homo sapiens
gaaaggttaaaaaagcgaggtg

SEQ ID NO: 830308 - DNA, 16 bp, Homo sapiens
gaaaggtttacattgt

SEQ ID NO: 830309 - DNA, 23 bp, Homo sapiens
gaaaggttttgtattttttaaaa

SEQ ID NO: 830310 - DNA, 13 bp, Homo sapiens
gaaaggttttttt

SEQ ID NO: 830311 - DNA, 21 bp, Homo sapiens
gaaagtagggggctttctggg

SEQ ID NO: 830312 - DNA, 20 bp, Homo sapiens
gaaagtattcagaaattaaa

SEQ ID NO: 830313 - DNA, 18 bp, Homo sapiens
gaaagtcaaaaaattatt

SEQ ID NO: 830314 - DNA, 16 bp, Homo sapiens
gaaagtcaccaggact

SEQ ID NO: 830315 - DNA, 23 bp, Homo sapiens
gaaagtcacccaaacacttctgc

SEQ ID NO: 830316 - DNA, 16 bp, Homo sapiens
gaaagtcctgctttcc

SEQ ID NO: 830317 - DNA, 14 bp, Homo sapiens
gaaagtctctgata

SEQ ID NO: 830318 - DNA, 20 bp, Homo sapiens
gaaagtctgtcaggtttggt

SEQ ID NO: 830319 - DNA, 13 bp, Homo sapiens
gaaagtgaatttg

SEQ ID NO: 830320 - DNA, 16 bp, Homo sapiens
gaaagtgaatttgaat

SEQ ID NO: 830321 - DNA, 17 bp, Homo sapiens
gaaagtgaatttgaatg

SEQ ID NO: 830322 - DNA, 15 bp, Homo sapiens
gaaagtgactttaaa

SEQ ID NO: 830323 - DNA, 18 bp, Homo sapiens
gaaagtgactttaaaaga

SEQ ID NO: 830324 - DNA, 22 bp, Homo sapiens
gaaagtgactttaaaagaaaat

SEQ ID NO: 830325 - DNA, 13 bp, Homo sapiens
gaaagtgaggaaa

SEQ ID NO: 830326 - DNA, 14 bp, Homo sapiens
gaaagtgcctttat

SEQ ID NO: 830327 - DNA, 17 bp, Homo sapiens
gaaagtgtgtgtgttct

SEQ ID NO: 830328 - DNA, 21 bp, Homo sapiens
gaaagtgtgtgtgttctgtag

SEQ ID NO: 830329 - DNA, 18 bp, Homo sapiens
gaaagttagggggttctt

SEQ ID NO: 830330 - DNA, 20 bp, Homo sapiens
gaaagttagggggttcttat

SEQ ID NO: 830331 - DNA, 21 bp, Homo sapiens
gaaagttagggggttcttatt

SEQ ID NO: 830332 - DNA, 19 bp, Homo sapiens
gaaagttccaaatgtttat

SEQ ID NO: 830333 - DNA, 17 bp, Homo sapiens
gaaagttgcaaggcaaa

SEQ ID NO: 830334 - DNA, 13 bp, Homo sapiens
gaaagttgctttt

SEQ ID NO: 830335 - DNA, 20 bp, Homo sapiens
gaaagtttacccatgaagat

SEQ ID NO: 830336 - DNA, 18 bp, Homo sapiens
gaaagttttgtaaaagaa

SEQ ID NO: 830337 - DNA, 20 bp, Homo sapiens
gaaagttttgtaaaagaaat

SEQ ID NO: 830338 - DNA, 16 bp, Homo sapiens
gaaataaaaagatcct

SEQ ID NO: 830339 - DNA, 23 bp, Homo sapiens
gaaataaaaagtatgttgtacat

SEQ ID NO: 830340 - DNA, 19 bp, Homo sapiens
gaaataaaacaactctgat

SEQ ID NO: 830341 - DNA, 16 bp, Homo sapiens
gaaataaaaggaagcc

SEQ ID NO: 830342 - DNA, 23 bp, Homo sapiens
gaaataaaaggaagccaaagagt

SEQ ID NO: 830343 - DNA, 12 bp, Homo sapiens
gaaataaaatta

SEQ ID NO: 830344 - DNA, 19 bp, Homo sapiens
gaaataaaccaaaggaaaa

SEQ ID NO: 830345 - DNA, 14 bp, Homo sapiens
gaaataaactgtgc

SEQ ID NO: 830346 - DNA, 18 bp, Homo sapiens
gaaataaagttggtgaca

SEQ ID NO: 830347 - DNA, 21 bp, Homo sapiens
gaaataaatagctatatccat

SEQ ID NO: 830348 - DNA, 12 bp, Homo sapiens
gaaataaatgaa

SEQ ID NO: 830349 - DNA, 20 bp, Homo sapiens
gaaataaatgtacctgatgt

SEQ ID NO: 830350 - DNA, 15 bp, Homo sapiens
gaaataaatgtttca

SEQ ID NO: 830351 - DNA, 22 bp, Homo sapiens
gaaataaattctgacttatgaa

SEQ ID NO: 830352 - DNA, 20 bp, Homo sapiens
gaaataacagaagaaaatag

SEQ ID NO: 830353 - DNA, 23 bp, Homo sapiens
gaaataacattgcactttataaa

SEQ ID NO: 830354 - DNA, 21 bp, Homo sapiens
gaaataagaaaaatcatgttt

SEQ ID NO: 830355 - DNA, 21 bp, Homo sapiens
gaaataagtttttgtttcaca

SEQ ID NO: 830356 - DNA, 14 bp, Homo sapiens
gaaataataaaatg

SEQ ID NO: 830357 - DNA, 21 bp, Homo sapiens
gaaataataaaatgcaaatga

SEQ ID NO: 830358 - DNA, 22 bp, Homo sapiens
gaaataataaaatgcaaatgaa

SEQ ID NO: 830359 - DNA, 18 bp, Homo sapiens
gaaataatagaatgagca

SEQ ID NO: 830360 - DNA, 16 bp, Homo sapiens
gaaataatagggaaaa

SEQ ID NO: 830361 - DNA, 13 bp, Homo sapiens
gaaataatatgca

SEQ ID NO: 830362 - DNA, 15 bp, Homo sapiens
gaaataatatgcatt

SEQ ID NO: 830363 - DNA, 19 bp, Homo sapiens
gaaataatgtacatctggc

SEQ ID NO: 830364 - DNA, 19 bp, Homo sapiens
gaaataattgttgattaat

SEQ ID NO: 830365 - DNA, 22 bp, Homo sapiens
gaaataattgttgttctgttaa

SEQ ID NO: 830366 - DNA, 17 bp, Homo sapiens
gaaataatttttaactt

SEQ ID NO: 830367 - DNA, 14 bp, Homo sapiens
gaaataatttttct

SEQ ID NO: 830368 - DNA, 18 bp, Homo sapiens
gaaatacacaagtaaaca

SEQ ID NO: 830369 - DNA, 13 bp, Homo sapiens
gaaatacagctgg

SEQ ID NO: 830370 - DNA, 14 bp, Homo sapiens
gaaatacagctggc

SEQ ID NO: 830371 - DNA, 16 bp, Homo sapiens
gaaatacagtcttcca

SEQ ID NO: 830372 - DNA, 16 bp, Homo sapiens
gaaatactactcctgt

SEQ ID NO: 830373 - DNA, 14 bp, Homo sapiens
gaaatactatttaa

SEQ ID NO: 830374 - DNA, 15 bp, Homo sapiens
gaaatactatttaaa

SEQ ID NO: 830375 - DNA, 15 bp, Homo sapiens
gaaatactcatgtgc

SEQ ID NO: 830376 - DNA, 20 bp, Homo sapiens
gaaatactgagatgctgggc

SEQ ID NO: 830377 - DNA, 20 bp, Homo sapiens
gaaatactttttaacaaaaa

SEQ ID NO: 830378 - DNA, 19 bp, Homo sapiens
gaaatagaaagaagccata

SEQ ID NO: 830379 - DNA, 12 bp, Homo sapiens
gaaatagaacac

SEQ ID NO: 830380 - DNA, 20 bp, Homo sapiens
gaaatagatatcctctcccc

SEQ ID NO: 830381 - DNA, 22 bp, Homo sapiens
gaaatagatatcctctccccct

SEQ ID NO: 830382 - DNA, 15 bp, Homo sapiens
gaaatagcagagcct

SEQ ID NO: 830383 - DNA, 19 bp, Homo sapiens
gaaatagtaccttcaatac

SEQ ID NO: 830384 - DNA, 13 bp, Homo sapiens
gaaatatacagtt

SEQ ID NO: 830385 - DNA, 23 bp, Homo sapiens
gaaatataggatagacactggac

SEQ ID NO: 830386 - DNA, 18 bp, Homo sapiens
gaacataaaaaggacatc

SEQ ID NO: 830387 - DNA, 22 bp, Homo sapiens
gaacataaaaaggacatcagca

SEQ ID NO: 830388 - DNA, 14 bp, Homo sapiens
gaacatacatgata

SEQ ID NO: 830389 - DNA, 16 bp, Homo sapiens
gaacatactgttcact

SEQ ID NO: 830390 - DNA, 22 bp, Homo sapiens
gaacatactgttcactcactct

SEQ ID NO: 830391 - DNA, 21 bp, Homo sapiens
gaacatacttcaaaaataatg

SEQ ID NO: 830392 - DNA, 16 bp, Homo sapiens
gaacatagacagaaga

SEQ ID NO: 830393 - DNA, 14 bp, Homo sapiens
gaacatatcatttg

SEQ ID NO: 830394 - DNA, 18 bp, Homo sapiens
gaacatatcatttgtgaa

SEQ ID NO: 830395 - DNA, 20 bp, Homo sapiens
gaacatatcatttgtgaaga

SEQ ID NO: 830396 - DNA, 22 bp, Homo sapiens
gaacatatcatttgtgaagaat

SEQ ID NO: 830397 - DNA, 14 bp, Homo sapiens
gaacatattcatga

SEQ ID NO: 830398 - DNA, 19 bp, Homo sapiens
gaacatcgatatgtatatc

SEQ ID NO: 830399 - DNA, 18 bp, Homo sapiens
gaacatcgttgttttgct

SEQ ID NO: 830400 - DNA, 20 bp, Homo sapiens
gaacatgaactatgcctatg

SEQ ID NO: 830401 - DNA, 19 bp, Homo sapiens
gaacatgacccagcctgaa

SEQ ID NO: 830402 - DNA, 16 bp, Homo sapiens
gaacatgcagttcatt

SEQ ID NO: 830403 - DNA, 19 bp, Homo sapiens
gaacatgtgagaggtttga

SEQ ID NO: 830404 - DNA, 20 bp, Homo sapiens
gaacatgtgccttttctgaa

SEQ ID NO: 830405 - DNA, 20 bp, Homo sapiens
gaacatgtttacaggtttga

SEQ ID NO: 830406 - DNA, 22 bp, Homo sapiens
gaacattaaaatatagagacag

SEQ ID NO: 830407 - DNA, 15 bp, Homo sapiens
gaacattaggaattg

SEQ ID NO: 830408 - DNA, 18 bp, Homo sapiens
gaacattattcatctctc

SEQ ID NO: 830409 - DNA, 16 bp, Homo sapiens
gaacattcacttttgt

SEQ ID NO: 830410 - DNA, 17 bp, Homo sapiens
gaacattcacttttgtt

SEQ ID NO: 830411 - DNA, 17 bp, Homo sapiens
gaacattgccttcctcg

SEQ ID NO: 830412 - DNA, 15 bp, Homo sapiens
gaacattggttcttt

SEQ ID NO: 830413 - DNA, 14 bp, Homo sapiens
gaacattgtactgt

SEQ ID NO: 830414 - DNA, 10 bp, Homo sapiens
gaacatttct

SEQ ID NO: 830415 - DNA, 22 bp, Homo sapiens
gaacatttcttatgatttttaa

SEQ ID NO: 830416 - DNA, 22 bp, Homo sapiens
gaacatttgatatttttccatt

SEQ ID NO: 830417 - DNA, 18 bp, Homo sapiens
gaacattttttaaggact

SEQ ID NO: 830418 - DNA, 19 bp, Homo sapiens
gaaccaaaaaaaaaaaagg

SEQ ID NO: 830419 - DNA, 13 bp, Homo sapiens
gaaccaaaacttc

SEQ ID NO: 830420 - DNA, 23 bp, Homo sapiens
gaaccaaaacttccaaggccctg

SEQ ID NO: 830421 - DNA, 16 bp, Homo sapiens
gaaccaaagtctaaac

SEQ ID NO: 830422 - DNA, 19 bp, Homo sapiens
gaaccaaatacctcaattt

SEQ ID NO: 830423 - DNA, 23 bp, Homo sapiens
gaaccaaatggttcttacttttc

SEQ ID NO: 830424 - DNA, 16 bp, Homo sapiens
gaaccaagatgtaaaa

SEQ ID NO: 830425 - DNA, 14 bp, Homo sapiens
gaaccaaggcagcc

SEQ ID NO: 830426 - DNA, 15 bp, Homo sapiens
gaaccaaggcagcct

SEQ ID NO: 830427 - DNA, 22 bp, Homo sapiens
gaaccaaggcagcctccagagc

SEQ ID NO: 830428 - DNA, 13 bp, Homo sapiens
gaaccacaagtga

SEQ ID NO: 830429 - DNA, 12 bp, Homo sapiens
gaaccacagaaa

SEQ ID NO: 830430 - DNA, 15 bp, Homo sapiens
gaaccaccagcgttc

SEQ ID NO: 830431 - DNA, 23 bp, Homo sapiens
gaaccaccagcgttcccttctcc

SEQ ID NO: 830432 - DNA, 16 bp, Homo sapiens
gaaccacgaggctgcc

SEQ ID NO: 830433 - DNA, 21 bp, Homo sapiens
gaaccacgcgggggccttgag

SEQ ID NO: 830434 - DNA, 13 bp, Homo sapiens
gaaccagagccac

SEQ ID NO: 830435 - DNA, 19 bp, Homo sapiens
gaaccagagccatggactc

SEQ ID NO: 830436 - DNA, 19 bp, Homo sapiens
gaaccagcagaaatgcccc

SEQ ID NO: 830437 - DNA, 13 bp, Homo sapiens
gaaccagcccagc

SEQ ID NO: 830438 - DNA, 18 bp, Homo sapiens
gaaccagcccagcctgcc

SEQ ID NO: 830439 - DNA, 20 bp, Homo sapiens
gaaccagccgtattttacat

SEQ ID NO: 830440 - DNA, 17 bp, Homo sapiens
gaaccaggagaagggct

SEQ ID NO: 830441 - DNA, 22 bp, Homo sapiens
gaaccaggagaagggctggggc

SEQ ID NO: 830442 - DNA, 23 bp, Homo sapiens
gaaccatgctcttgttctgttcc

SEQ ID NO: 830443 - DNA, 22 bp, Homo sapiens
gaaccatggtcggaaaacatgc

SEQ ID NO: 830444 - DNA, 17 bp, Homo sapiens
gaacccaccaaccagaa

SEQ ID NO: 830445 - DNA, 15 bp, Homo sapiens
gaacccacctgctga

SEQ ID NO: 830446 - DNA, 19 bp, Homo sapiens
gaacccacctgctgagaga

SEQ ID NO: 830447 - DNA, 17 bp, Homo sapiens
gaacccaggacgcttct

SEQ ID NO: 830448 - DNA, 14 bp, Homo sapiens
gaacccagggctct

SEQ ID NO: 830449 - DNA, 18 bp, Homo sapiens
gaacccagggctctgccc

SEQ ID NO: 830450 - DNA, 16 bp, Homo sapiens
gaaccccatgggcttg

SEQ ID NO: 830451 - DNA, 15 bp, Homo sapiens
gaaccccccaggccc

SEQ ID NO: 830452 - DNA, 14 bp, Homo sapiens
gaaccccctccctg

SEQ ID NO: 830453 - DNA, 18 bp, Homo sapiens
gaaccccctccctgtccc

SEQ ID NO: 830454 - DNA, 19 bp, Homo sapiens
gaaccccctccctgtccca

SEQ ID NO: 830455 - DNA, 14 bp, Homo sapiens
gaaccccgcagccc

SEQ ID NO: 830456 - DNA, 19 bp, Homo sapiens
gaaccccgtcgaggggctc

SEQ ID NO: 830457 - DNA, 20 bp, Homo sapiens
gaacccctggccagctctga

SEQ ID NO: 830458 - DNA, 17 bp, Homo sapiens
gaaccccttcatcctct

SEQ ID NO: 830459 - DNA, 20 bp, Homo sapiens
gaacccggtgctccctctgt

SEQ ID NO: 830460 - DNA, 17 bp, Homo sapiens
gaaccctagctgtgtca

SEQ ID NO: 830461 - DNA, 15 bp, Homo sapiens
gaaccctcctccttt

SEQ ID NO: 830462 - DNA, 14 bp, Homo sapiens
gaaccctcttgcca

SEQ ID NO: 830463 - DNA, 19 bp, Homo sapiens
gaaccctcttgccatcctg

SEQ ID NO: 830464 - DNA, 16 bp, Homo sapiens
gaaccctgcctcttgt

SEQ ID NO: 830465 - DNA, 17 bp, Homo sapiens
gaaccctggggcctgac

SEQ ID NO: 830466 - DNA, 22 bp, Homo sapiens
gaacccttgcatccattgttgt

SEQ ID NO: 830467 - DNA, 21 bp, Homo sapiens
gaaccgaacatatcatttgtg

SEQ ID NO: 830468 - DNA, 19 bp, Homo sapiens
gaaccgagcaaagatcaaa

SEQ ID NO: 830469 - DNA, 23 bp, Homo sapiens
gaaccgagcaaagatcaaaataa

SEQ ID NO: 830470 - DNA, 18 bp, Homo sapiens
gaaccgaggggctcagga

SEQ ID NO: 830471 - DNA, 14 bp, Homo sapiens
gaaccgcacagctc

SEQ ID NO: 830472 - DNA, 22 bp, Homo sapiens
gaaccgcaccccatcccaccag

SEQ ID NO: 830473 - DNA, 17 bp, Homo sapiens
gaaccgctcacctagag

SEQ ID NO: 830474 - DNA, 20 bp, Homo sapiens
gaaccgctcacctagagcca

SEQ ID NO: 830475 - DNA, 17 bp, Homo sapiens
gaaccgttttgaagcta

SEQ ID NO: 830476 - DNA, 19 bp, Homo sapiens
gaacctacagttttaactg

SEQ ID NO: 830477 - DNA, 20 bp, Homo sapiens
gaacctactgttcctttcag

SEQ ID NO: 830478 - DNA, 18 bp, Homo sapiens
gaacctattttcatttgt

SEQ ID NO: 830479 - DNA, 19 bp, Homo sapiens
gaacctattttcatttgta

SEQ ID NO: 830480 - DNA, 22 bp, Homo sapiens
gaacctattttcatttgtacaa

SEQ ID NO: 830481 - DNA, 14 bp, Homo sapiens
gaacctcaggcttc

SEQ ID NO: 830482 - DNA, 18 bp, Homo sapiens
gaacctcaggcttccttg

SEQ ID NO: 830483 - DNA, 12 bp, Homo sapiens
gaacctcccaga

SEQ ID NO: 830484 - DNA, 19 bp, Homo sapiens
gaacctcccagaggtccag

SEQ ID NO: 830485 - DNA, 22 bp, Homo sapiens
gaacctctgtctcatcctcctg

SEQ ID NO: 830486 - DNA, 13 bp, Homo sapiens
gaacctcttcccc

SEQ ID NO: 830487 - DNA, 18 bp, Homo sapiens
gaacctgcacacaggaca

SEQ ID NO: 830488 - DNA, 20 bp, Homo sapiens
gaacctgcacacaggacagc

SEQ ID NO: 830489 - DNA, 17 bp, Homo sapiens
gaacctgcttcctggct

SEQ ID NO: 830490 - DNA, 18 bp, Homo sapiens
gaacctggatccagcact

SEQ ID NO: 830491 - DNA, 19 bp, Homo sapiens
gaacctggatgtacttaag

SEQ ID NO: 830492 - DNA, 13 bp, Homo sapiens
gaacctgggaagt

SEQ ID NO: 830493 - DNA, 15 bp, Homo sapiens
gaacctgggaggcag

SEQ ID NO: 830494 - DNA, 13 bp, Homo sapiens
gaacctgggcact

SEQ ID NO: 830495 - DNA, 22 bp, Homo sapiens
gaacctgtctccattgtgtgat

SEQ ID NO: 830496 - DNA, 14 bp, Homo sapiens
gaaccttaatgaca

SEQ ID NO: 830497 - DNA, 23 bp, Homo sapiens
gaaccttacagtaaagtatagaa

SEQ ID NO: 830498 - DNA, 10 bp, Homo sapiens
gaaccttccc

SEQ ID NO: 830499 - DNA, 15 bp, Homo sapiens
gaaccttgctgtcct

SEQ ID NO: 830500 - DNA, 17 bp, Homo sapiens
gaaccttgctgtcctga

SEQ ID NO: 830501 - DNA, 20 bp, Homo sapiens
gaaccttggaccactcctgt

SEQ ID NO: 830502 - DNA, 17 bp, Homo sapiens
gaaccttgtcccagcca

SEQ ID NO: 830503 - DNA, 21 bp, Homo sapiens
gaaccttgtcccagccagtga

SEQ ID NO: 830504 - DNA, 23 bp, Homo sapiens
gaacctttttttttgaaacagca

SEQ ID NO: 830505 - DNA, 21 bp, Homo sapiens
gaacgacaatagctttaccct

SEQ ID NO: 830506 - DNA, 17 bp, Homo sapiens
gaacgaccttacaaatg

SEQ ID NO: 830507 - DNA, 13 bp, Homo sapiens
gaacttcattttt

SEQ ID NO: 830508 - DNA, 14 bp, Homo sapiens
gaacttctaatata

SEQ ID NO: 830509 - DNA, 14 bp, Homo sapiens
gaacttgagctctg

SEQ ID NO: 830510 - DNA, 13 bp, Homo sapiens
gaacttgatttgc

SEQ ID NO: 830511 - DNA, 12 bp, Homo sapiens
gaacttgcatgg

SEQ ID NO: 830512 - DNA, 16 bp, Homo sapiens
gaacttgcgagtccaa

SEQ ID NO: 830513 - DNA, 22 bp, Homo sapiens
gaacttgctgctgagtgcacca

SEQ ID NO: 830514 - DNA, 17 bp, Homo sapiens
gaacttggggaacaagg

SEQ ID NO: 830515 - DNA, 20 bp, Homo sapiens
gaacttgtgtccctaatgtg

SEQ ID NO: 830516 - DNA, 21 bp, Homo sapiens
gaactttaaagctcaggaggg

SEQ ID NO: 830517 - DNA, 22 bp, Homo sapiens
gaactttagtttgcctgcagtt

SEQ ID NO: 830518 - DNA, 16 bp, Homo sapiens
gaactttattaagtaa

SEQ ID NO: 830519 - DNA, 22 bp, Homo sapiens
gaactttgacctctgcagcaat

SEQ ID NO: 830520 - DNA, 15 bp, Homo sapiens
gaacttttctgtaat

SEQ ID NO: 830521 - DNA, 15 bp, Homo sapiens
gaacttttgtaattt

SEQ ID NO: 830522 - DNA, 17 bp, Homo sapiens
gaacttttgtaatttga

SEQ ID NO: 830523 - DNA, 17 bp, Homo sapiens
gaagaaaaaaaataaca

SEQ ID NO: 830524 - DNA, 21 bp, Homo sapiens
gaagaaaaagacctgcatttg

SEQ ID NO: 830525 - DNA, 17 bp, Homo sapiens
gaagaaaaagcaagtgt

SEQ ID NO: 830526 - DNA, 18 bp, Homo sapiens
gaagaaaaataaaatttc

SEQ ID NO: 830527 - DNA, 15 bp, Homo sapiens
gaagaaaacccgagg

SEQ ID NO: 830528 - DNA, 19 bp, Homo sapiens
gaagaaaacccgagggaca

SEQ ID NO: 830529 - DNA, 15 bp, Homo sapiens
gaagaaaaggaaatg

SEQ ID NO: 830530 - DNA, 17 bp, Homo sapiens
gaagaaaattgctgtgc

SEQ ID NO: 830531 - DNA, 21 bp, Homo sapiens
gaagaaagatttgttactgta

SEQ ID NO: 830532 - DNA, 13 bp, Homo sapiens
gaagaaagccaga

SEQ ID NO: 830533 - DNA, 12 bp, Homo sapiens
gaagaaagcctg

SEQ ID NO: 830534 - DNA, 21 bp, Homo sapiens
gaagaaagggtgtttttctgt

SEQ ID NO: 830535 - DNA, 15 bp, Homo sapiens
gaagaaagtggaaaa

SEQ ID NO: 830536 - DNA, 22 bp, Homo sapiens
gaagaaatcacagaatcatatg

SEQ ID NO: 830537 - DNA, 23 bp, Homo sapiens
gaagaaatctttctccctcaact

SEQ ID NO: 830538 - DNA, 21 bp, Homo sapiens
gaagaaatggctatgaacaga

SEQ ID NO: 830539 - DNA, 14 bp, Homo sapiens
gaagaaattcctgt

SEQ ID NO: 830540 - DNA, 13 bp, Homo sapiens
gaagaacacagca

SEQ ID NO: 830541 - DNA, 10 bp, Homo sapiens
gaagaacatc

SEQ ID NO: 830542 - DNA, 13 bp, Homo sapiens
gaagaacatcaag

SEQ ID NO: 830543 - DNA, 16 bp, Homo sapiens
gaagaaccaaatacct

SEQ ID NO: 830544 - DNA, 20 bp, Homo sapiens
gaagaaccaaatacctcaat

SEQ ID NO: 830545 - DNA, 15 bp, Homo sapiens
gaagaaccagcccag

SEQ ID NO: 830546 - DNA, 18 bp, Homo sapiens
gaagaaccagcccagcct

SEQ ID NO: 830547 - DNA, 22 bp, Homo sapiens
gaagaaccagcccagcctgccc

SEQ ID NO: 830548 - DNA, 15 bp, Homo sapiens
gaagaactgcacttt

SEQ ID NO: 830549 - DNA, 15 bp, Homo sapiens
gaagaactgcaggcc

SEQ ID NO: 830550 - DNA, 14 bp, Homo sapiens
gaagaactgcatgt

SEQ ID NO: 830551 - DNA, 18 bp, Homo sapiens
gaagaagaaccagcccag

SEQ ID NO: 830552 - DNA, 19 bp, Homo sapiens
gaagaagaaccagcccagc

SEQ ID NO: 830553 - DNA, 22 bp, Homo sapiens
gaagaagaaccagcccagcctg

SEQ ID NO: 830554 - DNA, 23 bp, Homo sapiens
gaagaagaattggccatcttaaa

SEQ ID NO: 830555 - DNA, 17 bp, Homo sapiens
gaagaagagaagctgct

SEQ ID NO: 830556 - DNA, 20 bp, Homo sapiens
gaagaagcgcggctaactta

SEQ ID NO: 830557 - DNA, 18 bp, Homo sapiens
gaagaagggagaagaaag

SEQ ID NO: 830558 - DNA, 16 bp, Homo sapiens
gaagaagggcacccta

SEQ ID NO: 830559 - DNA, 21 bp, Homo sapiens
gaagaagtcactgaacaaaac

SEQ ID NO: 830560 - DNA, 14 bp, Homo sapiens
gaagaagtcagaga

SEQ ID NO: 830561 - DNA, 13 bp, Homo sapiens
gaagaagtggctg

SEQ ID NO: 830562 - DNA, 14 bp, Homo sapiens
gaagaagtgggagc

SEQ ID NO: 830563 - DNA, 17 bp, Homo sapiens
gaagaagtgggagcagc

SEQ ID NO: 830564 - DNA, 15 bp, Homo sapiens
gaagaataaattcta

SEQ ID NO: 830565 - DNA, 14 bp, Homo sapiens
gaagaatctgcccc

SEQ ID NO: 830566 - DNA, 23 bp, Homo sapiens
gaagaatgcacaagaatggatca

SEQ ID NO: 830567 - DNA, 23 bp, Homo sapiens
gaagaatgctgttctgatttact

SEQ ID NO: 830568 - DNA, 12 bp, Homo sapiens
gaagaatggctt

SEQ ID NO: 830569 - DNA, 15 bp, Homo sapiens
gaagaatggctttca

SEQ ID NO: 830570 - DNA, 18 bp, Homo sapiens
gaagaatggctttcaata

SEQ ID NO: 830571 - DNA, 13 bp, Homo sapiens
gaagaattatgta

SEQ ID NO: 830572 - DNA, 18 bp, Homo sapiens
gaagaattgaacccagga

SEQ ID NO: 830573 - DNA, 18 bp, Homo sapiens
gaagaatttaatggactg

SEQ ID NO: 830574 - DNA, 19 bp, Homo sapiens
gaagaatttaatggactgt

SEQ ID NO: 830575 - DNA, 23 bp, Homo sapiens
gaagaatttaatggactgtgaat

SEQ ID NO: 830576 - DNA, 14 bp, Homo sapiens
gaagaatttgaaga

SEQ ID NO: 830577 - DNA, 14 bp, Homo sapiens
gaagaatttgttat

SEQ ID NO: 830578 - DNA, 18 bp, Homo sapiens
gaagaattttgagtgaat

SEQ ID NO: 830579 - DNA, 23 bp, Homo sapiens
gaagacaatactccctttaaaga

SEQ ID NO: 830580 - DNA, 18 bp, Homo sapiens
gaagacaatttgatacat

SEQ ID NO: 830581 - DNA, 14 bp, Homo sapiens
gaagacacagcctc

SEQ ID NO: 830582 - DNA, 18 bp, Homo sapiens
gaagacacagcctccccc

SEQ ID NO: 830583 - DNA, 17 bp, Homo sapiens
gaagacagaaacccagt

SEQ ID NO: 830584 - DNA, 14 bp, Homo sapiens
gaagacataaaact

SEQ ID NO: 830585 - DNA, 15 bp, Homo sapiens
gaagacataaaactt

SEQ ID NO: 830586 - DNA, 18 bp, Homo sapiens
gaagacatgaaccaagtg

SEQ ID NO: 830587 - DNA, 15 bp, Homo sapiens
gaagacatggagact

SEQ ID NO: 830588 - DNA, 18 bp, Homo sapiens
gaagacattttgttacat

SEQ ID NO: 830589 - DNA, 20 bp, Homo sapiens
gaagacattttgttacataa

SEQ ID NO: 830590 - DNA, 21 bp, Homo sapiens
gaagacattttttgctataat

SEQ ID NO: 830591 - DNA, 14 bp, Homo sapiens
gaagaccacatcca

SEQ ID NO: 830592 - DNA, 18 bp, Homo sapiens
gaagaccccacccaagct

SEQ ID NO: 830593 - DNA, 19 bp, Homo sapiens
gaagacctcacctagaaat

SEQ ID NO: 830594 - DNA, 20 bp, Homo sapiens
gaagacctcacctagaaatt

SEQ ID NO: 830595 - DNA, 23 bp, Homo sapiens
gaagacgagcatccccctcctct

SEQ ID NO: 830596 - DNA, 13 bp, Homo sapiens
gaagacgttttct

SEQ ID NO: 830597 - DNA, 18 bp, Homo sapiens
gaagactagaggccaggg

SEQ ID NO: 830598 - DNA, 23 bp, Homo sapiens
gaagactatcttactatttcaca

SEQ ID NO: 830599 - DNA, 21 bp, Homo sapiens
gaagactcacttctcagctga

SEQ ID NO: 830600 - DNA, 20 bp, Homo sapiens
gaagactcaggagtctgcca

SEQ ID NO: 830601 - DNA, 18 bp, Homo sapiens
gaagactctgcagccctc

SEQ ID NO: 830602 - DNA, 15 bp, Homo sapiens
gaagactgagaactt

SEQ ID NO: 830603 - DNA, 16 bp, Homo sapiens
gaagactgagaacttt

SEQ ID NO: 830604 - DNA, 14 bp, Homo sapiens
gaagactgctaaat

SEQ ID NO: 830605 - DNA, 19 bp, Homo sapiens
gaagactgctaaatgcact

SEQ ID NO: 830606 - DNA, 15 bp, Homo sapiens
gaagactggaagcta

SEQ ID NO: 830607 - DNA, 20 bp, Homo sapiens
gaagactgtcagcttccaaa

SEQ ID NO: 830608 - DNA, 11 bp, Homo sapiens
gaagactgtgg

SEQ ID NO: 830609 - DNA, 15 bp, Homo sapiens
gaagacttcccagct

SEQ ID NO: 830610 - DNA, 12 bp, Homo sapiens
gaagacttcctc

SEQ ID NO: 830611 - DNA, 21 bp, Homo sapiens
gaagacttgggttgatctctt

SEQ ID NO: 830612 - DNA, 20 bp, Homo sapiens
gaagactttaaaccacctag

SEQ ID NO: 830613 - DNA, 15 bp, Homo sapiens
gaagagaaaggactc

SEQ ID NO: 830614 - DNA, 18 bp, Homo sapiens
gaagagaaatacagctgg

SEQ ID NO: 830615 - DNA, 15 bp, Homo sapiens
gaagagacagcccag

SEQ ID NO: 830616 - DNA, 18 bp, Homo sapiens
gaagagacaggagggcaa

SEQ ID NO: 830617 - DNA, 15 bp, Homo sapiens
gaagagacaggcacc

SEQ ID NO: 830618 - DNA, 15 bp, Homo sapiens
gaagagagagaccct

SEQ ID NO: 830619 - DNA, 23 bp, Homo sapiens
gaagagaggaaataacagagaga

SEQ ID NO: 830620 - DNA, 12 bp, Homo sapiens
gaagagaggcac

SEQ ID NO: 830621 - DNA, 15 bp, Homo sapiens
gaagagagggacagg

SEQ ID NO: 830622 - DNA, 22 bp, Homo sapiens
gaagagagggacaggcactcca

SEQ ID NO: 830623 - DNA, 15 bp, Homo sapiens
gaagagaggggaaga

SEQ ID NO: 830624 - DNA, 18 bp, Homo sapiens
gaagagatgggcttgttt

SEQ ID NO: 830625 - DNA, 15 bp, Homo sapiens
gaagagatgtttaca

SEQ ID NO: 830626 - DNA, 12 bp, Homo sapiens
gaagagcacaga

SEQ ID NO: 830627 - DNA, 14 bp, Homo sapiens
gaagagcagcctga

SEQ ID NO: 830628 - DNA, 18 bp, Homo sapiens
gaagagcagcctgatggc

SEQ ID NO: 830629 - DNA, 16 bp, Homo sapiens
gaagcttcatgcactt

SEQ ID NO: 830630 - DNA, 15 bp, Homo sapiens
gaagcttgactccca

SEQ ID NO: 830631 - DNA, 19 bp, Homo sapiens
gaagcttggggaacccatg

SEQ ID NO: 830632 - DNA, 19 bp, Homo sapiens
gaaggaaagcatgtctctg

SEQ ID NO: 830633 - DNA, 14 bp, Homo sapiens
gaaggaaaggcaga

SEQ ID NO: 830634 - DNA, 19 bp, Homo sapiens
gaaggaaatgagtggccag

SEQ ID NO: 830635 - DNA, 15 bp, Homo sapiens
gaaggaacaaagaca

SEQ ID NO: 830636 - DNA, 15 bp, Homo sapiens
gaaggaactctggct

SEQ ID NO: 830637 - DNA, 23 bp, Homo sapiens
gaaggaactctggcttccaggta

SEQ ID NO: 830638 - DNA, 23 bp, Homo sapiens
gaaggaacttgtctcttcatcta

SEQ ID NO: 830639 - DNA, 13 bp, Homo sapiens
gaaggaagagaag

SEQ ID NO: 830640 - DNA, 14 bp, Homo sapiens
gaaggaagagaaga

SEQ ID NO: 830641 - DNA, 14 bp, Homo sapiens
gaaggaagggcaga

SEQ ID NO: 830642 - DNA, 18 bp, Homo sapiens
gaaggaagttatctgctg

SEQ ID NO: 830643 - DNA, 18 bp, Homo sapiens
gaaggaatagccagagag

SEQ ID NO: 830644 - DNA, 18 bp, Homo sapiens
gaaggaatcctggatttt

SEQ ID NO: 830645 - DNA, 19 bp, Homo sapiens
gaaggaatgtcagggccag

SEQ ID NO: 830646 - DNA, 14 bp, Homo sapiens
gaaggaattacatt

SEQ ID NO: 830647 - DNA, 15 bp, Homo sapiens
gaaggaattgacttc

SEQ ID NO: 830648 - DNA, 20 bp, Homo sapiens
gaaggaatttgattgctttg

SEQ ID NO: 830649 - DNA, 14 bp, Homo sapiens
gaaggacacagcag

SEQ ID NO: 830650 - DNA, 15 bp, Homo sapiens
gaaggacacagcagt

SEQ ID NO: 830651 - DNA, 16 bp, Homo sapiens
gaaggacacagcagta

SEQ ID NO: 830652 - DNA, 18 bp, Homo sapiens
gaaggacacagcagtatt

SEQ ID NO: 830653 - DNA, 19 bp, Homo sapiens
gaaggacacagcagtattg

SEQ ID NO: 830654 - DNA, 14 bp, Homo sapiens
gaaggacacagtga

SEQ ID NO: 830655 - DNA, 15 bp, Homo sapiens
gaaggacacttcctg

SEQ ID NO: 830656 - DNA, 16 bp, Homo sapiens
gaaggacaggaagctg

SEQ ID NO: 830657 - DNA, 16 bp, Homo sapiens
gaaggaccacatttta

SEQ ID NO: 830658 - DNA, 14 bp, Homo sapiens
gaaggaccccaggt

SEQ ID NO: 830659 - DNA, 22 bp, Homo sapiens
gaaggacccggaggggcctggc

SEQ ID NO: 830660 - DNA, 14 bp, Homo sapiens
gaaggacggtgcca

SEQ ID NO: 830661 - DNA, 17 bp, Homo sapiens
gaaggacggtgccaagg

SEQ ID NO: 830662 - DNA, 15 bp, Homo sapiens
gaaggactgaactcc

SEQ ID NO: 830663 - DNA, 20 bp, Homo sapiens
gaaggactggattggccaaa

SEQ ID NO: 830664 - DNA, 23 bp, Homo sapiens
gaaggagactcacctctgcctca

SEQ ID NO: 830665 - DNA, 15 bp, Homo sapiens
gaaggagagatgacc

SEQ ID NO: 830666 - DNA, 15 bp, Homo sapiens
gaaggagagcctgct

SEQ ID NO: 830667 - DNA, 16 bp, Homo sapiens
gaaggagagcctgctg

SEQ ID NO: 830668 - DNA, 15 bp, Homo sapiens
gaaggagcagtgtga

SEQ ID NO: 830669 - DNA, 21 bp, Homo sapiens
gaaggagccccattcctggga

SEQ ID NO: 830670 - DNA, 22 bp, Homo sapiens
gaaggagccccattcctgggaa

SEQ ID NO: 830671 - DNA, 14 bp, Homo sapiens
gaaggagcccctga

SEQ ID NO: 830672 - DNA, 18 bp, Homo sapiens
gaaggagcccctgagtcc

SEQ ID NO: 830673 - DNA, 12 bp, Homo sapiens
gaaggagctgag

SEQ ID NO: 830674 - DNA, 13 bp, Homo sapiens
gaaggaggaccca

SEQ ID NO: 830675 - DNA, 14 bp, Homo sapiens
gaaggaggacccag

SEQ ID NO: 830676 - DNA, 13 bp, Homo sapiens
gaaggaggcagac

SEQ ID NO: 830677 - DNA, 15 bp, Homo sapiens
gaaggagggcagagc

SEQ ID NO: 830678 - DNA, 21 bp, Homo sapiens
gaaggaggggagcctttgggg

SEQ ID NO: 830679 - DNA, 22 bp, Homo sapiens
gaaggagggggacaacccccca

SEQ ID NO: 830680 - DNA, 12 bp, Homo sapiens
gaaggatacaaa

SEQ ID NO: 830681 - DNA, 14 bp, Homo sapiens
gaaggatctgctga

SEQ ID NO: 830682 - DNA, 15 bp, Homo sapiens
gaaggatctgctgag

SEQ ID NO: 830683 - DNA, 16 bp, Homo sapiens
gaaggatgccaagaag

SEQ ID NO: 830684 - DNA, 20 bp, Homo sapiens
gaaggatggatgagtcagac

SEQ ID NO: 830685 - DNA, 23 bp, Homo sapiens
gaaggatgggatgggttccagag

SEQ ID NO: 830686 - DNA, 20 bp, Homo sapiens
gaaggatgtacatttccaaa

SEQ ID NO: 830687 - DNA, 17 bp, Homo sapiens
gaaggattgcatcctgc

SEQ ID NO: 830688 - DNA, 12 bp, Homo sapiens
gaaggcaaaaaa

SEQ ID NO: 830689 - DNA, 15 bp, Homo sapiens
gaaggcaaaggcaga

SEQ ID NO: 830690 - DNA, 19 bp, Homo sapiens
gaaggcaaaggcagaggaa

SEQ ID NO: 830691 - DNA, 14 bp, Homo sapiens
gaaggcaagagggg

SEQ ID NO: 830692 - DNA, 17 bp, Homo sapiens
gaaggcaagagggggtg

SEQ ID NO: 830693 - DNA, 23 bp, Homo sapiens
gaaggcaagagggggtggagggg

SEQ ID NO: 830694 - DNA, 16 bp, Homo sapiens
gaaggcaagattggaa

SEQ ID NO: 830695 - DNA, 14 bp, Homo sapiens
gaaggcagacagca

SEQ ID NO: 830696 - DNA, 19 bp, Homo sapiens
gaaggcagacagcaggcag

SEQ ID NO: 830697 - DNA, 13 bp, Homo sapiens
gaaggcagagaaa

SEQ ID NO: 830698 - DNA, 17 bp, Homo sapiens
gaaggcagaggctggca

SEQ ID NO: 830699 - DNA, 13 bp, Homo sapiens
gaaggcagctgct

SEQ ID NO: 830700 - DNA, 15 bp, Homo sapiens
gaaggcagctgctct

SEQ ID NO: 830701 - DNA, 23 bp, Homo sapiens
gaaggcaggcctccgtcttccca

SEQ ID NO: 830702 - DNA, 13 bp, Homo sapiens
gaaggcagggaaa

SEQ ID NO: 830703 - DNA, 19 bp, Homo sapiens
gaaggcagggaatgcctgg

SEQ ID NO: 830704 - DNA, 20 bp, Homo sapiens
gaaggcagggaatgcctgga

SEQ ID NO: 830705 - DNA, 16 bp, Homo sapiens
gaaggcatgagaaaga

SEQ ID NO: 830706 - DNA, 22 bp, Homo sapiens
gaaggccagctgccccagccag

SEQ ID NO: 830707 - DNA, 16 bp, Homo sapiens
gaaggccattgggttt

SEQ ID NO: 830708 - DNA, 17 bp, Homo sapiens
gaaggccccagagagac

SEQ ID NO: 830709 - DNA, 18 bp, Homo sapiens
gaaggccccagagagacc

SEQ ID NO: 830710 - DNA, 21 bp, Homo sapiens
gaaggccccagagagaccctg

SEQ ID NO: 830711 - DNA, 22 bp, Homo sapiens
gaaggcccctctgtggagcgcc

SEQ ID NO: 830712 - DNA, 16 bp, Homo sapiens
gaaggccctgctgagt

SEQ ID NO: 830713 - DNA, 20 bp, Homo sapiens
gaaggcctgacttctgctgg

SEQ ID NO: 830714 - DNA, 20 bp, Homo sapiens
gaaggcctttcttctgtgtt

SEQ ID NO: 830715 - DNA, 14 bp, Homo sapiens
gaaggcgaggagag

SEQ ID NO: 830716 - DNA, 16 bp, Homo sapiens
gaaggcgctgggtgcc

SEQ ID NO: 830717 - DNA, 22 bp, Homo sapiens
gaaggcggggtattcccactca

SEQ ID NO: 830718 - DNA, 14 bp, Homo sapiens
gaaggctaaaaagc

SEQ ID NO: 830719 - DNA, 13 bp, Homo sapiens
gaaggctctgtca

SEQ ID NO: 830720 - DNA, 18 bp, Homo sapiens
gaaggctctgtcactcca

SEQ ID NO: 830721 - DNA, 15 bp, Homo sapiens
gaaggctggctgagt

SEQ ID NO: 830722 - DNA, 13 bp, Homo sapiens
gaaggctggctgg

SEQ ID NO: 830723 - DNA, 17 bp, Homo sapiens
gaaggcttaagaactgc

SEQ ID NO: 830724 - DNA, 17 bp, Homo sapiens
gaaggcttgggatttgc

SEQ ID NO: 830725 - DNA, 23 bp, Homo sapiens
gaaggctttgccatgggcctgct

SEQ ID NO: 830726 - DNA, 17 bp, Homo sapiens
gaaggcttttggtctcc

SEQ ID NO: 830727 - DNA, 16 bp, Homo sapiens
gaagggaaagcgggca

SEQ ID NO: 830728 - DNA, 23 bp, Homo sapiens
gaagggaattgctcagagaagga

SEQ ID NO: 830729 - DNA, 23 bp, Homo sapiens
gaagggaccaagcgaccaaggat

SEQ ID NO: 830730 - DNA, 21 bp, Homo sapiens
gaagggaccaaggcaaggcag

SEQ ID NO: 830731 - DNA, 22 bp, Homo sapiens
gaagggaccaaggcaaggcagg

SEQ ID NO: 830732 - DNA, 20 bp, Homo sapiens
gaagggaccttgaagggtaa

SEQ ID NO: 830733 - DNA, 12 bp, Homo sapiens
gaagggagaagg

SEQ ID NO: 830734 - DNA, 21 bp, Homo sapiens
gaagggagaaggatctagaat

SEQ ID NO: 830735 - DNA, 15 bp, Homo sapiens
gaagggataatttat

SEQ ID NO: 830736 - DNA, 13 bp, Homo sapiens
gaagggatctgag

SEQ ID NO: 830737 - DNA, 12 bp, Homo sapiens
gaagggatgggg

SEQ ID NO: 830738 - DNA, 22 bp, Homo sapiens
gaagggcaggaaggagagcctg

SEQ ID NO: 830739 - DNA, 17 bp, Homo sapiens
gaagggcatgcacgggc

SEQ ID NO: 830740 - DNA, 18 bp, Homo sapiens
gaagggccaccctgctgc

SEQ ID NO: 830741 - DNA, 19 bp, Homo sapiens
gaagggccaccctgctgca

SEQ ID NO: 830742 - DNA, 11 bp, Homo sapiens
gaagggccagt

SEQ ID NO: 830743 - DNA, 16 bp, Homo sapiens
gaagggccagtcctgc

SEQ ID NO: 830744 - DNA, 18 bp, Homo sapiens
gaagggccagtcctgcct

SEQ ID NO: 830745 - DNA, 16 bp, Homo sapiens
gaagggcgttctaggt

SEQ ID NO: 830746 - DNA, 14 bp, Homo sapiens
gaagggctgcatga

SEQ ID NO: 830747 - DNA, 18 bp, Homo sapiens
gaagggctgcatgatgtt

SEQ ID NO: 830748 - DNA, 21 bp, Homo sapiens
gaagggctttggttccttctc

SEQ ID NO: 830749 - DNA, 18 bp, Homo sapiens
gaaggggaggacactggt

SEQ ID NO: 830750 - DNA, 22 bp, Homo sapiens
gaaggggcacaccactgccctg

SEQ ID NO: 830751 - DNA, 17 bp, Homo sapiens
gaagtgggagcagcttc

SEQ ID NO: 830752 - DNA, 15 bp, Homo sapiens
gaagtggggtgttct

SEQ ID NO: 830753 - DNA, 20 bp, Homo sapiens
gaagtggtttcctgataaca

SEQ ID NO: 830754 - DNA, 15 bp, Homo sapiens
gaagtgtaacagctg

SEQ ID NO: 830755 - DNA, 15 bp, Homo sapiens
gaagtgtaggcagac

SEQ ID NO: 830756 - DNA, 18 bp, Homo sapiens
gaagtgtaggcagacaca

SEQ ID NO: 830757 - DNA, 12 bp, Homo sapiens
gaagtgtcttct

SEQ ID NO: 830758 - DNA, 21 bp, Homo sapiens
gaagtgtcttctgttcccaag

SEQ ID NO: 830759 - DNA, 14 bp, Homo sapiens
gaagtgtggaaaaa

SEQ ID NO: 830760 - DNA, 17 bp, Homo sapiens
gaagtgtggctggtgtc

SEQ ID NO: 830761 - DNA, 21 bp, Homo sapiens
gaagtgtgggataaagattat

SEQ ID NO: 830762 - DNA, 15 bp, Homo sapiens
gaagtgtgtccatcc

SEQ ID NO: 830763 - DNA, 19 bp, Homo sapiens
gaagtgttcaagaaataaa

SEQ ID NO: 830764 - DNA, 13 bp, Homo sapiens
gaagtgttgcatg

SEQ ID NO: 830765 - DNA, 22 bp, Homo sapiens
gaagtgttgcatggatgtttta

SEQ ID NO: 830766 - DNA, 16 bp, Homo sapiens
gaagtgtttatgttgt

SEQ ID NO: 830767 - DNA, 19 bp, Homo sapiens
gaagttacacaattaattg

SEQ ID NO: 830768 - DNA, 17 bp, Homo sapiens
gaagttagctttaactt

SEQ ID NO: 830769 - DNA, 19 bp, Homo sapiens
gaagttagctttaacttaa

SEQ ID NO: 830770 - DNA, 15 bp, Homo sapiens
gaagttagtggaaat

SEQ ID NO: 830771 - DNA, 16 bp, Homo sapiens
gaagttagtttgtata

SEQ ID NO: 830772 - DNA, 17 bp, Homo sapiens
gaagttgcagtgagctg

SEQ ID NO: 830773 - DNA, 13 bp, Homo sapiens
gaagttggacagc

SEQ ID NO: 830774 - DNA, 16 bp, Homo sapiens
gaagttggacagcaaa

SEQ ID NO: 830775 - DNA, 22 bp, Homo sapiens
gaagttggagtgagtgtggctc

SEQ ID NO: 830776 - DNA, 14 bp, Homo sapiens
gaagttggcacatt

SEQ ID NO: 830777 - DNA, 21 bp, Homo sapiens
gaagttgtggatatcagggta

SEQ ID NO: 830778 - DNA, 22 bp, Homo sapiens
gaagttgttactaactaaactc

SEQ ID NO: 830779 - DNA, 17 bp, Homo sapiens
gaagttgtttatcaact

SEQ ID NO: 830780 - DNA, 18 bp, Homo sapiens
gaagtttaattgacttat

SEQ ID NO: 830781 - DNA, 14 bp, Homo sapiens
gaagtttatttgag

SEQ ID NO: 830782 - DNA, 17 bp, Homo sapiens
gaagtttcagtttctgt

SEQ ID NO: 830783 - DNA, 21 bp, Homo sapiens
gaagtttcatttatgatacaa

SEQ ID NO: 830784 - DNA, 17 bp, Homo sapiens
gaagtttggagattttt

SEQ ID NO: 830785 - DNA, 14 bp, Homo sapiens
gaagtttgtagcca

SEQ ID NO: 830786 - DNA, 16 bp, Homo sapiens
gaagtttgtggtataa

SEQ ID NO: 830787 - DNA, 13 bp, Homo sapiens
gaagttttacatt

SEQ ID NO: 830788 - DNA, 23 bp, Homo sapiens
gaagttttcaggacttggtctga

SEQ ID NO: 830789 - DNA, 17 bp, Homo sapiens
gaagttttgcatttatg

SEQ ID NO: 830790 - DNA, 14 bp, Homo sapiens
gaataaaaaagaaa

SEQ ID NO: 830791 - DNA, 19 bp, Homo sapiens
gaataaaaaagattctact

SEQ ID NO: 830792 - DNA, 22 bp, Homo sapiens
gaataaaaaatagacatgtagt

SEQ ID NO: 830793 - DNA, 18 bp, Homo sapiens
gaataaaaagtgaacttt

SEQ ID NO: 830794 - DNA, 19 bp, Homo sapiens
gaataaaaagtgaactttt

SEQ ID NO: 830795 - DNA, 23 bp, Homo sapiens
gaataaaaagtgaacttttgtaa

SEQ ID NO: 830796 - DNA, 14 bp, Homo sapiens
gaataaaagctata

SEQ ID NO: 830797 - DNA, 21 bp, Homo sapiens
gaataaaaggcttgaagctgt

SEQ ID NO: 830798 - DNA, 21 bp, Homo sapiens
gaataaaatataaaactgaaa

SEQ ID NO: 830799 - DNA, 22 bp, Homo sapiens
gaataaaatataaaactgaaat

SEQ ID NO: 830800 - DNA, 14 bp, Homo sapiens
gaataaaatcctaa

SEQ ID NO: 830801 - DNA, 23 bp, Homo sapiens
gaataaaatcctaagacacaaat

SEQ ID NO: 830802 - DNA, 15 bp, Homo sapiens
gaataaaatgttgaa

SEQ ID NO: 830803 - DNA, 18 bp, Homo sapiens
gaataaacagtgagcata

SEQ ID NO: 830804 - DNA, 22 bp, Homo sapiens
gaataaacagtgagcatatctg

SEQ ID NO: 830805 - DNA, 14 bp, Homo sapiens
gaataaacattaat

SEQ ID NO: 830806 - DNA, 12 bp, Homo sapiens
gaataaactgaa

SEQ ID NO: 830807 - DNA, 14 bp, Homo sapiens
gaataaagacacct

SEQ ID NO: 830808 - DNA, 16 bp, Homo sapiens
gaataaaggcagtttt

SEQ ID NO: 830809 - DNA, 17 bp, Homo sapiens
gaataaaggcagttttc

SEQ ID NO: 830810 - DNA, 19 bp, Homo sapiens
gaataaaggcagttttcta

SEQ ID NO: 830811 - DNA, 14 bp, Homo sapiens
gaataaagttctga

SEQ ID NO: 830812 - DNA, 20 bp, Homo sapiens
gaataaagttctgagtgttt

SEQ ID NO: 830813 - DNA, 16 bp, Homo sapiens
gaataaatgtgttggg

SEQ ID NO: 830814 - DNA, 23 bp, Homo sapiens
gaataaattatggcatttctatt

SEQ ID NO: 830815 - DNA, 18 bp, Homo sapiens
gaataaattccttcaacg

SEQ ID NO: 830816 - DNA, 21 bp, Homo sapiens
gaataaattttcaaatcctta

SEQ ID NO: 830817 - DNA, 14 bp, Homo sapiens
gaataacatgtaat

SEQ ID NO: 830818 - DNA, 18 bp, Homo sapiens
gaataacatgtaattaag

SEQ ID NO: 830819 - DNA, 19 bp, Homo sapiens
gaataacatgtaattaagt

SEQ ID NO: 830820 - DNA, 16 bp, Homo sapiens
gaataacatttaaatt

SEQ ID NO: 830821 - DNA, 23 bp, Homo sapiens
gaataaccacttaaaaaatgtcc

SEQ ID NO: 830822 - DNA, 22 bp, Homo sapiens
gaataactatctcacttccaga

SEQ ID NO: 830823 - DNA, 20 bp, Homo sapiens
gaataactcagaatattgtc

SEQ ID NO: 830824 - DNA, 13 bp, Homo sapiens
gaataacttgaag

SEQ ID NO: 830825 - DNA, 17 bp, Homo sapiens
gaataagaaagtttcac

SEQ ID NO: 830826 - DNA, 17 bp, Homo sapiens
gaataagaatttgcata

SEQ ID NO: 830827 - DNA, 17 bp, Homo sapiens
gaataaggtacaagaag

SEQ ID NO: 830828 - DNA, 14 bp, Homo sapiens
gaataataagcagg

SEQ ID NO: 830829 - DNA, 17 bp, Homo sapiens
gaataatacagtatctc

SEQ ID NO: 830830 - DNA, 18 bp, Homo sapiens
gaataatcacgctttcct

SEQ ID NO: 830831 - DNA, 19 bp, Homo sapiens
gaataatcacgctttcctg

SEQ ID NO: 830832 - DNA, 21 bp, Homo sapiens
gaataatcacgctttcctgaa

SEQ ID NO: 830833 - DNA, 19 bp, Homo sapiens
gaataatctcatcccccca

SEQ ID NO: 830834 - DNA, 23 bp, Homo sapiens
gaataatctcatccccccacccg

SEQ ID NO: 830835 - DNA, 22 bp, Homo sapiens
gaataatctttgggtaacttca

SEQ ID NO: 830836 - DNA, 13 bp, Homo sapiens
gaataatgaaaat

SEQ ID NO: 830837 - DNA, 15 bp, Homo sapiens
gaataatgaaaataa

SEQ ID NO: 830838 - DNA, 15 bp, Homo sapiens
gaataatggaaacat

SEQ ID NO: 830839 - DNA, 22 bp, Homo sapiens
gaataatgtaaaatgttgaata

SEQ ID NO: 830840 - DNA, 13 bp, Homo sapiens
gaataatttctat

SEQ ID NO: 830841 - DNA, 16 bp, Homo sapiens
gaataatttgtaaatg

SEQ ID NO: 830842 - DNA, 16 bp, Homo sapiens
gaatacaattaaaggt

SEQ ID NO: 830843 - DNA, 17 bp, Homo sapiens
gaatacaattaaaggtc

SEQ ID NO: 830844 - DNA, 20 bp, Homo sapiens
gaatacattaacggtgctaa

SEQ ID NO: 830845 - DNA, 15 bp, Homo sapiens
gaatacattgataca

SEQ ID NO: 830846 - DNA, 18 bp, Homo sapiens
gaatacattttataattt

SEQ ID NO: 830847 - DNA, 19 bp, Homo sapiens
gaatacattttataatttc

SEQ ID NO: 830848 - DNA, 21 bp, Homo sapiens
gaataccactctgtaattgca

SEQ ID NO: 830849 - DNA, 20 bp, Homo sapiens
gaataccattaaaactgctt

SEQ ID NO: 830850 - DNA, 13 bp, Homo sapiens
gaatacctgctca

SEQ ID NO: 830851 - DNA, 18 bp, Homo sapiens
gaatactatccatgtaat

SEQ ID NO: 830852 - DNA, 23 bp, Homo sapiens
gaatactatccatgtaataagca

SEQ ID NO: 830853 - DNA, 22 bp, Homo sapiens
gaatactgaacatctgagtcct

SEQ ID NO: 830854 - DNA, 15 bp, Homo sapiens
gaatactgggttctt

SEQ ID NO: 830855 - DNA, 13 bp, Homo sapiens
gaatactggtctc

SEQ ID NO: 830856 - DNA, 17 bp, Homo sapiens
gaatacttactataatt

SEQ ID NO: 830857 - DNA, 15 bp, Homo sapiens
gaatacttattttca

SEQ ID NO: 830858 - DNA, 14 bp, Homo sapiens
gaatacttgaagaa

SEQ ID NO: 830859 - DNA, 13 bp, Homo sapiens
gaatactttgctt

SEQ ID NO: 830860 - DNA, 14 bp, Homo sapiens
gaatactttgcttc

SEQ ID NO: 830861 - DNA, 17 bp, Homo sapiens
gaatactttgcttcata

SEQ ID NO: 830862 - DNA, 19 bp, Homo sapiens
gaatagaagttttcctgat

SEQ ID NO: 830863 - DNA, 16 bp, Homo sapiens
gaatagacatcaaact

SEQ ID NO: 830864 - DNA, 14 bp, Homo sapiens
gaatagagctgcca

SEQ ID NO: 830865 - DNA, 19 bp, Homo sapiens
gaatagagctgccactggg

SEQ ID NO: 830866 - DNA, 13 bp, Homo sapiens
gaatagaggaaga

SEQ ID NO: 830867 - DNA, 17 bp, Homo sapiens
gaatagatcagtatttc

SEQ ID NO: 830868 - DNA, 19 bp, Homo sapiens
gaatagatggaatttggaa

SEQ ID NO: 830869 - DNA, 19 bp, Homo sapiens
gaatagatgtgatcactga

SEQ ID NO: 830870 - DNA, 18 bp, Homo sapiens
gaatagccagagaggagc

SEQ ID NO: 830871 - DNA, 22 bp, Homo sapiens
gaatagcctggccaccagccat

SEQ ID NO: 830872 - DNA, 19 bp, Homo sapiens
gaatagctgttttgtgtat

SEQ ID NO: 830873 - DNA, 17 bp, Homo sapiens
gaatggcctgccttgaa

SEQ ID NO: 830874 - DNA, 17 bp, Homo sapiens
gaatggctatgttttta

SEQ ID NO: 830875 - DNA, 13 bp, Homo sapiens
gaatggctttcaa

SEQ ID NO: 830876 - DNA, 17 bp, Homo sapiens
gaatgggagacctgttg

SEQ ID NO: 830877 - DNA, 16 bp, Homo sapiens
gaatggggttcctgct

SEQ ID NO: 830878 - DNA, 18 bp, Homo sapiens
gaatggtaaccgagccag

SEQ ID NO: 830879 - DNA, 22 bp, Homo sapiens
gaatggtctttgctccagataa

SEQ ID NO: 830880 - DNA, 17 bp, Homo sapiens
gaatggtgcattgtata

SEQ ID NO: 830881 - DNA, 19 bp, Homo sapiens
gaatggtgtgaacccggga

SEQ ID NO: 830882 - DNA, 19 bp, Homo sapiens
gaatggttccatgcctgag

SEQ ID NO: 830883 - DNA, 20 bp, Homo sapiens
gaatggttccatgcctgagg

SEQ ID NO: 830884 - DNA, 14 bp, Homo sapiens
gaatgtaagaaaac

SEQ ID NO: 830885 - DNA, 13 bp, Homo sapiens
gaatgtactatgt

SEQ ID NO: 830886 - DNA, 16 bp, Homo sapiens
gaatgtagcttccacc

SEQ ID NO: 830887 - DNA, 13 bp, Homo sapiens
gaatgtagggcct

SEQ ID NO: 830888 - DNA, 15 bp, Homo sapiens
gaatgtatcaggaaa

SEQ ID NO: 830889 - DNA, 17 bp, Homo sapiens
gaatgtatcaggaaata

SEQ ID NO: 830890 - DNA, 15 bp, Homo sapiens
gaatgtatctcctcc

SEQ ID NO: 830891 - DNA, 16 bp, Homo sapiens
gaatgtatctgtgaag

SEQ ID NO: 830892 - DNA, 17 bp, Homo sapiens
gaatgtatgtaatgtgt

SEQ ID NO: 830893 - DNA, 19 bp, Homo sapiens
gaatgtattattctgcagc

SEQ ID NO: 830894 - DNA, 12 bp, Homo sapiens
gaatgtattttg

SEQ ID NO: 830895 - DNA, 17 bp, Homo sapiens
gaatgtcaccagtcctg

SEQ ID NO: 830896 - DNA, 17 bp, Homo sapiens
gaatgtgaaatttaaat

SEQ ID NO: 830897 - DNA, 15 bp, Homo sapiens
gaatgtgcaggtttg

SEQ ID NO: 830898 - DNA, 21 bp, Homo sapiens
gaatgtgccacctgtccggcc

SEQ ID NO: 830899 - DNA, 22 bp, Homo sapiens
gaatgtggataaaactgtgtaa

SEQ ID NO: 830900 - DNA, 21 bp, Homo sapiens
gaatgtgggtagtcattctta

SEQ ID NO: 830901 - DNA, 13 bp, Homo sapiens
gaatgtggtctca

SEQ ID NO: 830902 - DNA, 15 bp, Homo sapiens
gaatgtggtctcagg

SEQ ID NO: 830903 - DNA, 17 bp, Homo sapiens
gaatgtggtctcaggat

SEQ ID NO: 830904 - DNA, 14 bp, Homo sapiens
gaatgtgtctttag

SEQ ID NO: 830905 - DNA, 23 bp, Homo sapiens
gaatgtgtgtgtgtggcaggggg

SEQ ID NO: 830906 - DNA, 13 bp, Homo sapiens
gaatgtgttcttt

SEQ ID NO: 830907 - DNA, 14 bp, Homo sapiens
gaatgtgtttcaaa

SEQ ID NO: 830908 - DNA, 22 bp, Homo sapiens
gaatgtgtttcaaaaccatgcc

SEQ ID NO: 830909 - DNA, 22 bp, Homo sapiens
gaatgttaatttattttgctcc

SEQ ID NO: 830910 - DNA, 13 bp, Homo sapiens
gaatgttaatttt

SEQ ID NO: 830911 - DNA, 15 bp, Homo sapiens
gaatgttccctgcac

SEQ ID NO: 830912 - DNA, 16 bp, Homo sapiens
gaatgttccctgcacc

SEQ ID NO: 830913 - DNA, 20 bp, Homo sapiens
gaatgttccctgcaccctgg

SEQ ID NO: 830914 - DNA, 22 bp, Homo sapiens
gaatgttccctgcaccctggaa

SEQ ID NO: 830915 - DNA, 20 bp, Homo sapiens
gaatgttctgacattaacag

SEQ ID NO: 830916 - DNA, 20 bp, Homo sapiens
gaatgttggataaggaatta

SEQ ID NO: 830917 - DNA, 23 bp, Homo sapiens
gaatgttggttttaatacttgat

SEQ ID NO: 830918 - DNA, 20 bp, Homo sapiens
gaatgtttacactctttgta

SEQ ID NO: 830919 - DNA, 21 bp, Homo sapiens
gaatgtttacactctttgtaa

SEQ ID NO: 830920 - DNA, 17 bp, Homo sapiens
gaatgtttgtttcagtg

SEQ ID NO: 830921 - DNA, 16 bp, Homo sapiens
gaatgttttaaattct

SEQ ID NO: 830922 - DNA, 15 bp, Homo sapiens
gaatgtttttccctc

SEQ ID NO: 830923 - DNA, 16 bp, Homo sapiens
gaatgtttttccctcc

SEQ ID NO: 830924 - DNA, 22 bp, Homo sapiens
gaatgtttttccctccccagaa

SEQ ID NO: 830925 - DNA, 16 bp, Homo sapiens
gaattaaaaagaagat

SEQ ID NO: 830926 - DNA, 13 bp, Homo sapiens
gaattaaaactga

SEQ ID NO: 830927 - DNA, 22 bp, Homo sapiens
gaattaaaactgagtccatgaa

SEQ ID NO: 830928 - DNA, 14 bp, Homo sapiens
gaattaaagtactt

SEQ ID NO: 830929 - DNA, 20 bp, Homo sapiens
gaattaaataaacccttcct

SEQ ID NO: 830930 - DNA, 23 bp, Homo sapiens
gaattaaatcatcccttaataaa

SEQ ID NO: 830931 - DNA, 19 bp, Homo sapiens
gaattaacacagtgtttca

SEQ ID NO: 830932 - DNA, 23 bp, Homo sapiens
gaattaaccatttaataaagaaa

SEQ ID NO: 830933 - DNA, 15 bp, Homo sapiens
gaattaacctggtgc

SEQ ID NO: 830934 - DNA, 19 bp, Homo sapiens
gaattaacctggtgctgga

SEQ ID NO: 830935 - DNA, 22 bp, Homo sapiens
gaattaacctggtgctggatat

SEQ ID NO: 830936 - DNA, 22 bp, Homo sapiens
gaattaactgcatacgttttgg

SEQ ID NO: 830937 - DNA, 13 bp, Homo sapiens
gaattaagcagaa

SEQ ID NO: 830938 - DNA, 13 bp, Homo sapiens
gaattaagtttta

SEQ ID NO: 830939 - DNA, 22 bp, Homo sapiens
gaattaatatccctacatgtat

SEQ ID NO: 830940 - DNA, 17 bp, Homo sapiens
gaattaatgagaagata

SEQ ID NO: 830941 - DNA, 22 bp, Homo sapiens
gaattaccatagagtaatgatg

SEQ ID NO: 830942 - DNA, 15 bp, Homo sapiens
gaattacgtgctctg

SEQ ID NO: 830943 - DNA, 19 bp, Homo sapiens
gaattacgtgctctgtggg

SEQ ID NO: 830944 - DNA, 19 bp, Homo sapiens
gaattagaagtctttcagt

SEQ ID NO: 830945 - DNA, 21 bp, Homo sapiens
gaattagagggccttgcttct

SEQ ID NO: 830946 - DNA, 18 bp, Homo sapiens
gaattagattatttctgt

SEQ ID NO: 830947 - DNA, 17 bp, Homo sapiens
gaattaggctgtaacta

SEQ ID NO: 830948 - DNA, 19 bp, Homo sapiens
gaattaggctgtaactact

SEQ ID NO: 830949 - DNA, 15 bp, Homo sapiens
gaattataaatgtgt

SEQ ID NO: 830950 - DNA, 16 bp, Homo sapiens
gaattataaatgtgtt

SEQ ID NO: 830951 - DNA, 20 bp, Homo sapiens
gaattataacagttatattt

SEQ ID NO: 830952 - DNA, 14 bp, Homo sapiens
gaattataactgta

SEQ ID NO: 830953 - DNA, 22 bp, Homo sapiens
gaattatatatttctaactata

SEQ ID NO: 830954 - DNA, 17 bp, Homo sapiens
gaattatcagcaaagaa

SEQ ID NO: 830955 - DNA, 15 bp, Homo sapiens
gaattatccattacg

SEQ ID NO: 830956 - DNA, 14 bp, Homo sapiens
gaattatctaattt

SEQ ID NO: 830957 - DNA, 14 bp, Homo sapiens
gaattatgggaaac

SEQ ID NO: 830958 - DNA, 17 bp, Homo sapiens
gaattattcagtgaatt

SEQ ID NO: 830959 - DNA, 18 bp, Homo sapiens
gaattattcagtgaattt

SEQ ID NO: 830960 - DNA, 21 bp, Homo sapiens
gaattattcagtgaatttgtc

SEQ ID NO: 830961 - DNA, 14 bp, Homo sapiens
gaattattgacact

SEQ ID NO: 830962 - DNA, 15 bp, Homo sapiens
gaattattgacactg

SEQ ID NO: 830963 - DNA, 19 bp, Homo sapiens
gaattatttctttattaac

SEQ ID NO: 830964 - DNA, 19 bp, Homo sapiens
gaattcaaaagtgattatc

SEQ ID NO: 830965 - DNA, 16 bp, Homo sapiens
gaattcaaactggggc

SEQ ID NO: 830966 - DNA, 23 bp, Homo sapiens
gaattcagctcagcttcttccta

SEQ ID NO: 830967 - DNA, 20 bp, Homo sapiens
gaattcagttgctttgccca

SEQ ID NO: 830968 - DNA, 16 bp, Homo sapiens
gaattcatcccctccc

SEQ ID NO: 830969 - DNA, 16 bp, Homo sapiens
gaattcattataattt

SEQ ID NO: 830970 - DNA, 12 bp, Homo sapiens
gaattcattcat

SEQ ID NO: 830971 - DNA, 12 bp, Homo sapiens
gaattccaaagc

SEQ ID NO: 830972 - DNA, 16 bp, Homo sapiens
gaattccaaggagttc

SEQ ID NO: 830973 - DNA, 15 bp, Homo sapiens
gaattccctccccct

SEQ ID NO: 830974 - DNA, 16 bp, Homo sapiens
gaattccctccccctc

SEQ ID NO: 830975 - DNA, 21 bp, Homo sapiens
gaattcccttgaattgtgtat

SEQ ID NO: 830976 - DNA, 14 bp, Homo sapiens
gaattcctaaagct

SEQ ID NO: 830977 - DNA, 18 bp, Homo sapiens
gaattcctgaagccagat

SEQ ID NO: 830978 - DNA, 17 bp, Homo sapiens
gaattcctgtagcacac

SEQ ID NO: 830979 - DNA, 14 bp, Homo sapiens
gaattcctttacaa

SEQ ID NO: 830980 - DNA, 23 bp, Homo sapiens
gaattcctttacaactaaataac

SEQ ID NO: 830981 - DNA, 15 bp, Homo sapiens
gaattcgtgttatga

SEQ ID NO: 830982 - DNA, 18 bp, Homo sapiens
gaattcgtgttatgaatc

SEQ ID NO: 830983 - DNA, 20 bp, Homo sapiens
gaattcgtgttatgaatctg

SEQ ID NO: 830984 - DNA, 15 bp, Homo sapiens
gaattctatttgctg

SEQ ID NO: 830985 - DNA, 18 bp, Homo sapiens
gaattctgcaactagcca

SEQ ID NO: 830986 - DNA, 21 bp, Homo sapiens
gaattcttatgcttataatat

SEQ ID NO: 830987 - DNA, 15 bp, Homo sapiens
gaattcttcctctcc

SEQ ID NO: 830988 - DNA, 17 bp, Homo sapiens
gaattcttcctctcctt

SEQ ID NO: 830989 - DNA, 12 bp, Homo sapiens
gaattcttctgt

SEQ ID NO: 830990 - DNA, 14 bp, Homo sapiens
gaattcttctgtta

SEQ ID NO: 830991 - DNA, 17 bp, Homo sapiens
gaattcttgataaatga

SEQ ID NO: 830992 - DNA, 13 bp, Homo sapiens
gaattcttgatct

SEQ ID NO: 830993 - DNA, 23 bp, Homo sapiens
gaattcttgatctctaatgagct

SEQ ID NO: 830994 - DNA, 19 bp, Homo sapiens
gaattcttggttgaggaaa

SEQ ID NO: 830995 - DNA, 22 bp, Homo sapiens
gacaccaccgaatatattactg

SEQ ID NO: 830996 - DNA, 13 bp, Homo sapiens
gacaccagagctg

SEQ ID NO: 830997 - DNA, 15 bp, Homo sapiens
gacaccagagctgcc

SEQ ID NO: 830998 - DNA, 17 bp, Homo sapiens
gacaccatgtgcaataa

SEQ ID NO: 830999 - DNA, 15 bp, Homo sapiens
gacacccattttcac

SEQ ID NO: 831000 - DNA, 14 bp, Homo sapiens
gacaccccagacct

SEQ ID NO: 831001 - DNA, 21 bp, Homo sapiens
gacaccccccgccccccacct

SEQ ID NO: 831002 - DNA, 13 bp, Homo sapiens
gacaccccctcgc

SEQ ID NO: 831003 - DNA, 13 bp, Homo sapiens
gacacccctgctc

SEQ ID NO: 831004 - DNA, 21 bp, Homo sapiens
gacaccccttatccaggactc

SEQ ID NO: 831005 - DNA, 14 bp, Homo sapiens
gacaccctggcctg

SEQ ID NO: 831006 - DNA, 21 bp, Homo sapiens
gacaccctggcctgaactgag

SEQ ID NO: 831007 - DNA, 17 bp, Homo sapiens
gacaccgctcagtatta

SEQ ID NO: 831008 - DNA, 19 bp, Homo sapiens
gacaccgggccagtatcta

SEQ ID NO: 831009 - DNA, 17 bp, Homo sapiens
gacaccgtccctcagtg

SEQ ID NO: 831010 - DNA, 18 bp, Homo sapiens
gacaccgtccctcagtga

SEQ ID NO: 831011 - DNA, 16 bp, Homo sapiens
gacaccgtggggaagg

SEQ ID NO: 831012 - DNA, 18 bp, Homo sapiens
gacaccgtggggaagggg

SEQ ID NO: 831013 - DNA, 19 bp, Homo sapiens
gacaccgtggggaaggggt

SEQ ID NO: 831014 - DNA, 21 bp, Homo sapiens
gacaccgtggggaaggggtgc

SEQ ID NO: 831015 - DNA, 17 bp, Homo sapiens
gacacctactgagtggc

SEQ ID NO: 831016 - DNA, 12 bp, Homo sapiens
gacacctcccag

SEQ ID NO: 831017 - DNA, 15 bp, Homo sapiens
gacacctcccagggg

SEQ ID NO: 831018 - DNA, 14 bp, Homo sapiens
gacacctcccccta

SEQ ID NO: 831019 - DNA, 18 bp, Homo sapiens
gacacctccccctaccca

SEQ ID NO: 831020 - DNA, 20 bp, Homo sapiens
gacacctccccctacccata

SEQ ID NO: 831021 - DNA, 19 bp, Homo sapiens
gacacctccgagaggcagc

SEQ ID NO: 831022 - DNA, 15 bp, Homo sapiens
gacacctgcacctcc

SEQ ID NO: 831023 - DNA, 13 bp, Homo sapiens
gacacctggactg

SEQ ID NO: 831024 - DNA, 14 bp, Homo sapiens
gacacctggactga

SEQ ID NO: 831025 - DNA, 19 bp, Homo sapiens
gacacctggagactgtccc

SEQ ID NO: 831026 - DNA, 22 bp, Homo sapiens
gacaccttctgagtattctcat

SEQ ID NO: 831027 - DNA, 18 bp, Homo sapiens
gacacgaaggctgcccct

SEQ ID NO: 831028 - DNA, 19 bp, Homo sapiens
gacacgagccacaagctgc

SEQ ID NO: 831029 - DNA, 18 bp, Homo sapiens
gacacgccgtctgtcctc

SEQ ID NO: 831030 - DNA, 19 bp, Homo sapiens
gacacggatctgagaatct

SEQ ID NO: 831031 - DNA, 18 bp, Homo sapiens
gacacgtgggctcccctc

SEQ ID NO: 831032 - DNA, 23 bp, Homo sapiens
gacacgtgggctcccctcttcct

SEQ ID NO: 831033 - DNA, 17 bp, Homo sapiens
gacactaagttatagta

SEQ ID NO: 831034 - DNA, 15 bp, Homo sapiens
gacactaatgcagcc

SEQ ID NO: 831035 - DNA, 23 bp, Homo sapiens
gacactaatgcagccacgattgg

SEQ ID NO: 831036 - DNA, 14 bp, Homo sapiens
gacactacacccag

SEQ ID NO: 831037 - DNA, 16 bp, Homo sapiens
gacactacacccagca

SEQ ID NO: 831038 - DNA, 14 bp, Homo sapiens
gacactagaaaact

SEQ ID NO: 831039 - DNA, 18 bp, Homo sapiens
gacactagcccaatgaaa

SEQ ID NO: 831040 - DNA, 17 bp, Homo sapiens
gacactcagggcagctg

SEQ ID NO: 831041 - DNA, 20 bp, Homo sapiens
gacactcagggcagctgcct

SEQ ID NO: 831042 - DNA, 21 bp, Homo sapiens
gacactcagggcagctgcctg

SEQ ID NO: 831043 - DNA, 22 bp, Homo sapiens
gacactcagggcagctgcctgg

SEQ ID NO: 831044 - DNA, 21 bp, Homo sapiens
gacactccagggacacacagc

SEQ ID NO: 831045 - DNA, 15 bp, Homo sapiens
gacactcctagactt

SEQ ID NO: 831046 - DNA, 14 bp, Homo sapiens
gacactctatatgt

SEQ ID NO: 831047 - DNA, 19 bp, Homo sapiens
gacactctatatgtagtgc

SEQ ID NO: 831048 - DNA, 16 bp, Homo sapiens
gacactctgctctgcc

SEQ ID NO: 831049 - DNA, 20 bp, Homo sapiens
gacactgaaagttttgtaaa

SEQ ID NO: 831050 - DNA, 19 bp, Homo sapiens
gacactgacagcctttgat

SEQ ID NO: 831051 - DNA, 16 bp, Homo sapiens
gacactgagccccacc

SEQ ID NO: 831052 - DNA, 19 bp, Homo sapiens
gacactgccgacatcagca

SEQ ID NO: 831053 - DNA, 14 bp, Homo sapiens
gacactgctctaac

SEQ ID NO: 831054 - DNA, 20 bp, Homo sapiens
gacactgctctaacagccct

SEQ ID NO: 831055 - DNA, 21 bp, Homo sapiens
gacactgctctaacagccctc

SEQ ID NO: 831056 - DNA, 20 bp, Homo sapiens
gacactgctgcaccagagtg

SEQ ID NO: 831057 - DNA, 12 bp, Homo sapiens
gacactggacat

SEQ ID NO: 831058 - DNA, 17 bp, Homo sapiens
gacactggccccacagg

SEQ ID NO: 831059 - DNA, 18 bp, Homo sapiens
gacactggccccacagga

SEQ ID NO: 831060 - DNA, 14 bp, Homo sapiens
gacactgggcagca

SEQ ID NO: 831061 - DNA, 19 bp, Homo sapiens
gacactgtgagagttgtct

SEQ ID NO: 831062 - DNA, 18 bp, Homo sapiens
gacacttcagagagctgg

SEQ ID NO: 831063 - DNA, 20 bp, Homo sapiens
gacacttcagagagctggta

SEQ ID NO: 831064 - DNA, 16 bp, Homo sapiens
gacacttccccttgtc

SEQ ID NO: 831065 - DNA, 23 bp, Homo sapiens
gacacttccccttgtctccctgg

SEQ ID NO: 831066 - DNA, 19 bp, Homo sapiens
gacacttccctctgtttct

SEQ ID NO: 831067 - DNA, 21 bp, Homo sapiens
gacacttccctctgtttctct

SEQ ID NO: 831068 - DNA, 15 bp, Homo sapiens
gacacttccctgggc

SEQ ID NO: 831069 - DNA, 18 bp, Homo sapiens
gacacttccctgggcctc

SEQ ID NO: 831070 - DNA, 13 bp, Homo sapiens
gacacttcctgcc

SEQ ID NO: 831071 - DNA, 14 bp, Homo sapiens
gacacttcctgcct

SEQ ID NO: 831072 - DNA, 15 bp, Homo sapiens
gacacttcctgccta

SEQ ID NO: 831073 - DNA, 23 bp, Homo sapiens
gacactttaattaccaacctgtt

SEQ ID NO: 831074 - DNA, 19 bp, Homo sapiens
gacactttgaaatgtgttt

SEQ ID NO: 831075 - DNA, 21 bp, Homo sapiens
gacactttgaaatgtgtttct

SEQ ID NO: 831076 - DNA, 20 bp, Homo sapiens
gacactttgccaaggctctc

SEQ ID NO: 831077 - DNA, 18 bp, Homo sapiens
gacacttttaaaaaacaa

SEQ ID NO: 831078 - DNA, 19 bp, Homo sapiens
gacacttttaaaaaacaaa

SEQ ID NO: 831079 - DNA, 21 bp, Homo sapiens
gacacttttcatatcatttct

SEQ ID NO: 831080 - DNA, 13 bp, Homo sapiens
gacactttttgta

SEQ ID NO: 831081 - DNA, 21 bp, Homo sapiens
gacagaagcctggactctgcc

SEQ ID NO: 831082 - DNA, 16 bp, Homo sapiens
gacagaagtctcctca

SEQ ID NO: 831083 - DNA, 18 bp, Homo sapiens
gacagaatgtatctgtga

SEQ ID NO: 831084 - DNA, 20 bp, Homo sapiens
gacagaatgtatctgtgaag

SEQ ID NO: 831085 - DNA, 15 bp, Homo sapiens
gacagaatgtgttct

SEQ ID NO: 831086 - DNA, 11 bp, Homo sapiens
gacagacacct

SEQ ID NO: 831087 - DNA, 18 bp, Homo sapiens
gacagacactgttgcaaa

SEQ ID NO: 831088 - DNA, 14 bp, Homo sapiens
gacagacatacata

SEQ ID NO: 831089 - DNA, 14 bp, Homo sapiens
gacagacccagtga

SEQ ID NO: 831090 - DNA, 16 bp, Homo sapiens
gacagacccagtgagt

SEQ ID NO: 831091 - DNA, 16 bp, Homo sapiens
gacagacgcatgtggc

SEQ ID NO: 831092 - DNA, 17 bp, Homo sapiens
gacagacgcatgtggca

SEQ ID NO: 831093 - DNA, 14 bp, Homo sapiens
gacagactcactgg

SEQ ID NO: 831094 - DNA, 17 bp, Homo sapiens
gacagactcactgggaa

SEQ ID NO: 831095 - DNA, 17 bp, Homo sapiens
gacagactggattaaaa

SEQ ID NO: 831096 - DNA, 15 bp, Homo sapiens
gacagacttgagaac

SEQ ID NO: 831097 - DNA, 18 bp, Homo sapiens
gacagactttggacagtg

SEQ ID NO: 831098 - DNA, 19 bp, Homo sapiens
gacagagactcagatgagg

SEQ ID NO: 831099 - DNA, 20 bp, Homo sapiens
gacagagagaggggagagag

SEQ ID NO: 831100 - DNA, 16 bp, Homo sapiens
gacagagaggactgta

SEQ ID NO: 831101 - DNA, 19 bp, Homo sapiens
gacagagcaaagcgcccac

SEQ ID NO: 831102 - DNA, 21 bp, Homo sapiens
gacagagcaagtgagaccctg

SEQ ID NO: 831103 - DNA, 20 bp, Homo sapiens
gacagagccaccccatgagc

SEQ ID NO: 831104 - DNA, 16 bp, Homo sapiens
gacagagccaggagaa

SEQ ID NO: 831105 - DNA, 13 bp, Homo sapiens
gacagagccatgc

SEQ ID NO: 831106 - DNA, 10 bp, Homo sapiens
gacagagctg

SEQ ID NO: 831107 - DNA, 13 bp, Homo sapiens
gacagaggaaagg

SEQ ID NO: 831108 - DNA, 12 bp, Homo sapiens
gacagaggaggg

SEQ ID NO: 831109 - DNA, 22 bp, Homo sapiens
gacagaggccctgccacgtccc

SEQ ID NO: 831110 - DNA, 16 bp, Homo sapiens
gacagaggccggggtc

SEQ ID NO: 831111 - DNA, 19 bp, Homo sapiens
gacagaggccggggtccag

SEQ ID NO: 831112 - DNA, 19 bp, Homo sapiens
gacagaggggactctgggc

SEQ ID NO: 831113 - DNA, 22 bp, Homo sapiens
gacagaggggatggggatagag

SEQ ID NO: 831114 - DNA, 15 bp, Homo sapiens
gacagagtctgggtg

SEQ ID NO: 831115 - DNA, 18 bp, Homo sapiens
gacagagtgctgaggggc

SEQ ID NO: 831116 - DNA, 13 bp, Homo sapiens
gacagataactct

SEQ ID NO: 831117 - DNA, 16 bp, Homo sapiens
gacatggttgggggaa

SEQ ID NO: 831118 - DNA, 18 bp, Homo sapiens
gacatgtaagaaaatgtt

SEQ ID NO: 831119 - DNA, 12 bp, Homo sapiens
gacatgtgacat

SEQ ID NO: 831120 - DNA, 16 bp, Homo sapiens
gacatgtgacatttat

SEQ ID NO: 831121 - DNA, 13 bp, Homo sapiens
gacatgtggaaag

SEQ ID NO: 831122 - DNA, 18 bp, Homo sapiens
gacatgtggaaagtgaat

SEQ ID NO: 831123 - DNA, 23 bp, Homo sapiens
gacatgtggaaagtgaatttgaa

SEQ ID NO: 831124 - DNA, 17 bp, Homo sapiens
gacatgtggggccaggt

SEQ ID NO: 831125 - DNA, 22 bp, Homo sapiens
gacatgtggtgggacagggacc

SEQ ID NO: 831126 - DNA, 18 bp, Homo sapiens
gacatgttcctttaaggt

SEQ ID NO: 831127 - DNA, 18 bp, Homo sapiens
gacatgtttgtgctctgt

SEQ ID NO: 831128 - DNA, 12 bp, Homo sapiens
gacattaacagt

SEQ ID NO: 831129 - DNA, 14 bp, Homo sapiens
gacattaacagttt

SEQ ID NO: 831130 - DNA, 22 bp, Homo sapiens
gacattaacagttttccatgaa

SEQ ID NO: 831131 - DNA, 23 bp, Homo sapiens
gacattaacagttttccatgaaa

SEQ ID NO: 831132 - DNA, 18 bp, Homo sapiens
gacattaagcagccttaa

SEQ ID NO: 831133 - DNA, 23 bp, Homo sapiens
gacattcaaaacgtgatgttttg

SEQ ID NO: 831134 - DNA, 18 bp, Homo sapiens
gacattcacctgccccaa

SEQ ID NO: 831135 - DNA, 15 bp, Homo sapiens
gacattcactgctga

SEQ ID NO: 831136 - DNA, 19 bp, Homo sapiens
gacattcactgctgatttt

SEQ ID NO: 831137 - DNA, 23 bp, Homo sapiens
gacattcagtatataaaatatgt

SEQ ID NO: 831138 - DNA, 14 bp, Homo sapiens
gacattccaacaat

SEQ ID NO: 831139 - DNA, 17 bp, Homo sapiens
gacattccatgacgaca

SEQ ID NO: 831140 - DNA, 23 bp, Homo sapiens
gacattcctaagagtggaggagg

SEQ ID NO: 831141 - DNA, 18 bp, Homo sapiens
gacattctcaaagcctct

SEQ ID NO: 831142 - DNA, 13 bp, Homo sapiens
gacattctgattc

SEQ ID NO: 831143 - DNA, 23 bp, Homo sapiens
gacattctgattcgaatgacact

SEQ ID NO: 831144 - DNA, 14 bp, Homo sapiens
gacattgaaatcta

SEQ ID NO: 831145 - DNA, 22 bp, Homo sapiens
gacattgctctatgtctgcctt

SEQ ID NO: 831146 - DNA, 19 bp, Homo sapiens
gacattgctctcagtgctt

SEQ ID NO: 831147 - DNA, 16 bp, Homo sapiens
gacattgctctctggg

SEQ ID NO: 831148 - DNA, 17 bp, Homo sapiens
gacattgtatgcaggga

SEQ ID NO: 831149 - DNA, 23 bp, Homo sapiens
gacattgtatgcagggagcactg

SEQ ID NO: 831150 - DNA, 15 bp, Homo sapiens
gacattgtcaataaa

SEQ ID NO: 831151 - DNA, 12 bp, Homo sapiens
gacattgtctcc

SEQ ID NO: 831152 - DNA, 20 bp, Homo sapiens
gacattgtctcccgcccccc

SEQ ID NO: 831153 - DNA, 18 bp, Homo sapiens
gacattgttaaaataaag

SEQ ID NO: 831154 - DNA, 16 bp, Homo sapiens
gacatttacaggaggg

SEQ ID NO: 831155 - DNA, 17 bp, Homo sapiens
gacatttacaggagggc

SEQ ID NO: 831156 - DNA, 20 bp, Homo sapiens
gacatttacaggagggcccg

SEQ ID NO: 831157 - DNA, 18 bp, Homo sapiens
gacatttatatttgtgta

SEQ ID NO: 831158 - DNA, 16 bp, Homo sapiens
gacatttggagagggg

SEQ ID NO: 831159 - DNA, 14 bp, Homo sapiens
gacatttggtggta

SEQ ID NO: 831160 - DNA, 14 bp, Homo sapiens
gacatttgtatatt

SEQ ID NO: 831161 - DNA, 23 bp, Homo sapiens
gacattttaagtttgtagtaaaa

SEQ ID NO: 831162 - DNA, 22 bp, Homo sapiens
gacattttcttttattatcagt

SEQ ID NO: 831163 - DNA, 20 bp, Homo sapiens
gacattttttcagtcatata

SEQ ID NO: 831164 - DNA, 22 bp, Homo sapiens
gacatttttttctgatttgtcc

SEQ ID NO: 831165 - DNA, 19 bp, Homo sapiens
gaccaaaaaaggacgtaaa

SEQ ID NO: 831166 - DNA, 20 bp, Homo sapiens
gaccaaagggaagtgaggcc

SEQ ID NO: 831167 - DNA, 22 bp, Homo sapiens
gaccaaagggaagtgaggccca

SEQ ID NO: 831168 - DNA, 19 bp, Homo sapiens
gaccaaagtcccttcctgc

SEQ ID NO: 831169 - DNA, 18 bp, Homo sapiens
gaccaaatctcagttgtt

SEQ ID NO: 831170 - DNA, 23 bp, Homo sapiens
gaccaaatgtcggggttggggtg

SEQ ID NO: 831171 - DNA, 15 bp, Homo sapiens
gaccaaattgcttct

SEQ ID NO: 831172 - DNA, 18 bp, Homo sapiens
gaccaaattgcttctagg

SEQ ID NO: 831173 - DNA, 16 bp, Homo sapiens
gaccaacatggagaaa

SEQ ID NO: 831174 - DNA, 17 bp, Homo sapiens
gaccaaccctgggacct

SEQ ID NO: 831175 - DNA, 17 bp, Homo sapiens
gaccaaccctgtttcct

SEQ ID NO: 831176 - DNA, 14 bp, Homo sapiens
gaccaacctgacca

SEQ ID NO: 831177 - DNA, 13 bp, Homo sapiens
gaccaactgccct

SEQ ID NO: 831178 - DNA, 17 bp, Homo sapiens
gaccaactgccctaagc

SEQ ID NO: 831179 - DNA, 15 bp, Homo sapiens
gaccaactggcttct

SEQ ID NO: 831180 - DNA, 13 bp, Homo sapiens
gaccaactgggcc

SEQ ID NO: 831181 - DNA, 14 bp, Homo sapiens
gaccaactgggccc

SEQ ID NO: 831182 - DNA, 19 bp, Homo sapiens
gaccaactgggcccaagac

SEQ ID NO: 831183 - DNA, 15 bp, Homo sapiens
gaccaactgtgttgt

SEQ ID NO: 831184 - DNA, 18 bp, Homo sapiens
gaccaactgtgttgtatt

SEQ ID NO: 831185 - DNA, 14 bp, Homo sapiens
gaccaagagagaaa

SEQ ID NO: 831186 - DNA, 20 bp, Homo sapiens
gaccaagcatcttggggggg

SEQ ID NO: 831187 - DNA, 20 bp, Homo sapiens
gaccaagcggctcaagaata

SEQ ID NO: 831188 - DNA, 17 bp, Homo sapiens
gaccaaggcaaggcagg

SEQ ID NO: 831189 - DNA, 16 bp, Homo sapiens
gaccaagtcctggcta

SEQ ID NO: 831190 - DNA, 14 bp, Homo sapiens
gaccaagttataaa

SEQ ID NO: 831191 - DNA, 16 bp, Homo sapiens
gaccaatagcccacag

SEQ ID NO: 831192 - DNA, 20 bp, Homo sapiens
gaccaatatatagtgggtac

SEQ ID NO: 831193 - DNA, 20 bp, Homo sapiens
gaccaatattatactaagaa

SEQ ID NO: 831194 - DNA, 18 bp, Homo sapiens
gaccaatattgtacagtt

SEQ ID NO: 831195 - DNA, 12 bp, Homo sapiens
gaccaatcccca

SEQ ID NO: 831196 - DNA, 14 bp, Homo sapiens
gaccaatccccagc

SEQ ID NO: 831197 - DNA, 15 bp, Homo sapiens
gaccaatccccagcc

SEQ ID NO: 831198 - DNA, 15 bp, Homo sapiens
gaccaattctggaca

SEQ ID NO: 831199 - DNA, 17 bp, Homo sapiens
gaccaattgtgctgcca

SEQ ID NO: 831200 - DNA, 16 bp, Homo sapiens
gaccacaccctgtact

SEQ ID NO: 831201 - DNA, 12 bp, Homo sapiens
gaccacacctcc

SEQ ID NO: 831202 - DNA, 18 bp, Homo sapiens
gaccacacttcctgtcca

SEQ ID NO: 831203 - DNA, 23 bp, Homo sapiens
gaccacagcatcattttgcattc

SEQ ID NO: 831204 - DNA, 17 bp, Homo sapiens
gaccacagtgggtggca

SEQ ID NO: 831205 - DNA, 19 bp, Homo sapiens
gaccacagtgggtggcacc

SEQ ID NO: 831206 - DNA, 15 bp, Homo sapiens
gaccacatagaacat

SEQ ID NO: 831207 - DNA, 13 bp, Homo sapiens
gaccaccaaagtc

SEQ ID NO: 831208 - DNA, 13 bp, Homo sapiens
gaccaccagcccc

SEQ ID NO: 831209 - DNA, 16 bp, Homo sapiens
gaccaccagccccagc

SEQ ID NO: 831210 - DNA, 17 bp, Homo sapiens
gaccaccagccccagca

SEQ ID NO: 831211 - DNA, 19 bp, Homo sapiens
gaccaccagccccagcaag

SEQ ID NO: 831212 - DNA, 23 bp, Homo sapiens
gaccaccagccgccccagcccct

SEQ ID NO: 831213 - DNA, 19 bp, Homo sapiens
gaccaccccgcctgccctc

SEQ ID NO: 831214 - DNA, 20 bp, Homo sapiens
gaccaccccgcctgccctca

SEQ ID NO: 831215 - DNA, 14 bp, Homo sapiens
gaccaccctcactg

SEQ ID NO: 831216 - DNA, 17 bp, Homo sapiens
gaccaccctcccctctc

SEQ ID NO: 831217 - DNA, 20 bp, Homo sapiens
gaccaccttctgtccccagc

SEQ ID NO: 831218 - DNA, 19 bp, Homo sapiens
gaccacgcacctccacgcc

SEQ ID NO: 831219 - DNA, 17 bp, Homo sapiens
gaccacgcccgtcctgc

SEQ ID NO: 831220 - DNA, 20 bp, Homo sapiens
gaccacggacgtttccatca

SEQ ID NO: 831221 - DNA, 21 bp, Homo sapiens
gaccacggacgtttccatcag

SEQ ID NO: 831222 - DNA, 14 bp, Homo sapiens
gaccacggagggag

SEQ ID NO: 831223 - DNA, 13 bp, Homo sapiens
gaccacggctcga

SEQ ID NO: 831224 - DNA, 22 bp, Homo sapiens
gaccacgtgaaatttgcctctg

SEQ ID NO: 831225 - DNA, 15 bp, Homo sapiens
gaccactcagcccct

SEQ ID NO: 831226 - DNA, 14 bp, Homo sapiens
gaccactccagaga

SEQ ID NO: 831227 - DNA, 16 bp, Homo sapiens
gaccactcctgtccct

SEQ ID NO: 831228 - DNA, 20 bp, Homo sapiens
gaccactcctgtccctgtag

SEQ ID NO: 831229 - DNA, 15 bp, Homo sapiens
gaccactcttcttta

SEQ ID NO: 831230 - DNA, 12 bp, Homo sapiens
gaccactgcatg

SEQ ID NO: 831231 - DNA, 17 bp, Homo sapiens
gaccactgggcctgcta

SEQ ID NO: 831232 - DNA, 17 bp, Homo sapiens
gaccactgggtgagaga

SEQ ID NO: 831233 - DNA, 11 bp, Homo sapiens
gaccactgtct

SEQ ID NO: 831234 - DNA, 21 bp, Homo sapiens
gaccacttacagtgtgataag

SEQ ID NO: 831235 - DNA, 22 bp, Homo sapiens
gaccacttccaggggaacctgc

SEQ ID NO: 831236 - DNA, 16 bp, Homo sapiens
gaccacttgccacgct

SEQ ID NO: 831237 - DNA, 15 bp, Homo sapiens
gaccagaattccctt

SEQ ID NO: 831238 - DNA, 13 bp, Homo sapiens
gaccagcaaatac

SEQ ID NO: 831239 - DNA, 20 bp, Homo sapiens
gaccgggtgggcctggcctg

SEQ ID NO: 831240 - DNA, 21 bp, Homo sapiens
gaccgggtgggcctggcctga

SEQ ID NO: 831241 - DNA, 15 bp, Homo sapiens
gaccggtacagaaag

SEQ ID NO: 831242 - DNA, 20 bp, Homo sapiens
gaccggtttggagtaatcag

SEQ ID NO: 831243 - DNA, 20 bp, Homo sapiens
gaccgtactctcacatgtgg

SEQ ID NO: 831244 - DNA, 15 bp, Homo sapiens
gaccgtcagcatggg

SEQ ID NO: 831245 - DNA, 22 bp, Homo sapiens
gaccgtccaggggagatgggga

SEQ ID NO: 831246 - DNA, 23 bp, Homo sapiens
gaccgtgatttggaagagaggca

SEQ ID NO: 831247 - DNA, 23 bp, Homo sapiens
gaccgtgcccacgagggtctccc

SEQ ID NO: 831248 - DNA, 19 bp, Homo sapiens
gaccgttctctgtccccag

SEQ ID NO: 831249 - DNA, 18 bp, Homo sapiens
gaccgtttttatattact

SEQ ID NO: 831250 - DNA, 20 bp, Homo sapiens
gacctaaaaaggtctgttaa

SEQ ID NO: 831251 - DNA, 13 bp, Homo sapiens
gacctaaagcatt

SEQ ID NO: 831252 - DNA, 21 bp, Homo sapiens
gacctaaagtgcttgcttttt

SEQ ID NO: 831253 - DNA, 14 bp, Homo sapiens
gacctaagccctgc

SEQ ID NO: 831254 - DNA, 16 bp, Homo sapiens
gacctacagactaaga

SEQ ID NO: 831255 - DNA, 13 bp, Homo sapiens
gacctacaggctg

SEQ ID NO: 831256 - DNA, 16 bp, Homo sapiens
gacctacattccctct

SEQ ID NO: 831257 - DNA, 20 bp, Homo sapiens
gacctacctcaaagggcagt

SEQ ID NO: 831258 - DNA, 18 bp, Homo sapiens
gacctacctccctccctc

SEQ ID NO: 831259 - DNA, 22 bp, Homo sapiens
gacctacgttcctggccccctc

SEQ ID NO: 831260 - DNA, 13 bp, Homo sapiens
gacctactctcat

SEQ ID NO: 831261 - DNA, 13 bp, Homo sapiens
gacctagaagctt

SEQ ID NO: 831262 - DNA, 20 bp, Homo sapiens
gacctagcctggatggcccc

SEQ ID NO: 831263 - DNA, 16 bp, Homo sapiens
gacctagctatgttgg

SEQ ID NO: 831264 - DNA, 19 bp, Homo sapiens
gacctagctgttgtaaaga

SEQ ID NO: 831265 - DNA, 20 bp, Homo sapiens
gacctagggggacggggctg

SEQ ID NO: 831266 - DNA, 21 bp, Homo sapiens
gacctagggggacggggctga

SEQ ID NO: 831267 - DNA, 18 bp, Homo sapiens
gacctagtcccctttcct

SEQ ID NO: 831268 - DNA, 18 bp, Homo sapiens
gacctatactgaaagatc

SEQ ID NO: 831269 - DNA, 16 bp, Homo sapiens
gacctatgcagggagg

SEQ ID NO: 831270 - DNA, 17 bp, Homo sapiens
gacctatgcagggaggc

SEQ ID NO: 831271 - DNA, 14 bp, Homo sapiens
gacctcaagcaacc

SEQ ID NO: 831272 - DNA, 20 bp, Homo sapiens
gacctcaagggacagggaat

SEQ ID NO: 831273 - DNA, 24 bp, Homo sapiens
gacctcaagggacagggaatgctg

SEQ ID NO: 831274 - DNA, 20 bp, Homo sapiens
gacctcaagtgatctgtcca

SEQ ID NO: 831275 - DNA, 17 bp, Homo sapiens
gacctcagagtccaggc

SEQ ID NO: 831276 - DNA, 21 bp, Homo sapiens
gacctcagagtccaggcccca

SEQ ID NO: 831277 - DNA, 10 bp, Homo sapiens
gacctcagcc

SEQ ID NO: 831278 - DNA, 13 bp, Homo sapiens
gacctcagcctgt

SEQ ID NO: 831279 - DNA, 19 bp, Homo sapiens
gacctcagcctgtgctgcc

SEQ ID NO: 831280 - DNA, 15 bp, Homo sapiens
gacctcagctgcaca

SEQ ID NO: 831281 - DNA, 17 bp, Homo sapiens
gacctcagctgcacatt

SEQ ID NO: 831282 - DNA, 19 bp, Homo sapiens
gacctcagctgcacattcc

SEQ ID NO: 831283 - DNA, 19 bp, Homo sapiens
gacctcaggagggcaggct

SEQ ID NO: 831284 - DNA, 16 bp, Homo sapiens
gacctcaggggcacct

SEQ ID NO: 831285 - DNA, 13 bp, Homo sapiens
gacctcatcagga

SEQ ID NO: 831286 - DNA, 19 bp, Homo sapiens
gacctcatcaggatgaacc

SEQ ID NO: 831287 - DNA, 13 bp, Homo sapiens
gacctcatcctgc

SEQ ID NO: 831288 - DNA, 17 bp, Homo sapiens
gacctcatcctgctctt

SEQ ID NO: 831289 - DNA, 14 bp, Homo sapiens
gacctcatgcccag

SEQ ID NO: 831290 - DNA, 13 bp, Homo sapiens
gacctccaggggc

SEQ ID NO: 831291 - DNA, 17 bp, Homo sapiens
gacctccaggggctcct

SEQ ID NO: 831292 - DNA, 18 bp, Homo sapiens
gacctccaggggctcctg

SEQ ID NO: 831293 - DNA, 23 bp, Homo sapiens
gacctccaggggctcctgggttg

SEQ ID NO: 831294 - DNA, 14 bp, Homo sapiens
gacctccatttccc

SEQ ID NO: 831295 - DNA, 18 bp, Homo sapiens
gacctcccaactctaaag

SEQ ID NO: 831296 - DNA, 23 bp, Homo sapiens
gacctcccagccctatggatgtg

SEQ ID NO: 831297 - DNA, 12 bp, Homo sapiens
gacctcccttcc

SEQ ID NO: 831298 - DNA, 20 bp, Homo sapiens
gacctcccttccgaccctct

SEQ ID NO: 831299 - DNA, 12 bp, Homo sapiens
gacctcctccct

SEQ ID NO: 831300 - DNA, 20 bp, Homo sapiens
gacctccttagccctgtctg

SEQ ID NO: 831301 - DNA, 20 bp, Homo sapiens
gacctcgtcccatcttcact

SEQ ID NO: 831302 - DNA, 21 bp, Homo sapiens
gacctcgtcccatcttcactc

SEQ ID NO: 831303 - DNA, 18 bp, Homo sapiens
gacctcgtcctccccctg

SEQ ID NO: 831304 - DNA, 16 bp, Homo sapiens
gacctcgtttgggagt

SEQ ID NO: 831305 - DNA, 20 bp, Homo sapiens
gacctctcagcatagcctgc

SEQ ID NO: 831306 - DNA, 14 bp, Homo sapiens
gacctctctcagcc

SEQ ID NO: 831307 - DNA, 22 bp, Homo sapiens
gacctctctcagccccatcgcc

SEQ ID NO: 831308 - DNA, 11 bp, Homo sapiens
gacctctctcg

SEQ ID NO: 831309 - DNA, 14 bp, Homo sapiens
gacctctctgcctc

SEQ ID NO: 831310 - DNA, 19 bp, Homo sapiens
gacctctctgcctctcttc

SEQ ID NO: 831311 - DNA, 22 bp, Homo sapiens
gacctctgcagcaataaagcag

SEQ ID NO: 831312 - DNA, 15 bp, Homo sapiens
gacctctgctctgag

SEQ ID NO: 831313 - DNA, 13 bp, Homo sapiens
gacctctgctgag

SEQ ID NO: 831314 - DNA, 16 bp, Homo sapiens
gacctctgctgagtgc

SEQ ID NO: 831315 - DNA, 12 bp, Homo sapiens
gacctctgttgt

SEQ ID NO: 831316 - DNA, 14 bp, Homo sapiens
gacctctgttgtcc

SEQ ID NO: 831317 - DNA, 12 bp, Homo sapiens
gacctcttgctg

SEQ ID NO: 831318 - DNA, 13 bp, Homo sapiens
gacctcttgctgt

SEQ ID NO: 831319 - DNA, 15 bp, Homo sapiens
gacctcttgctgtct

SEQ ID NO: 831320 - DNA, 22 bp, Homo sapiens
gacctcttgctgtctctgctcg

SEQ ID NO: 831321 - DNA, 19 bp, Homo sapiens
gacctgaaggtattggcct

SEQ ID NO: 831322 - DNA, 21 bp, Homo sapiens
gacctgacaccgtccctcagt

SEQ ID NO: 831323 - DNA, 23 bp, Homo sapiens
gacctgacccaacacccccgacg

SEQ ID NO: 831324 - DNA, 18 bp, Homo sapiens
gacctgaggccctcactg

SEQ ID NO: 831325 - DNA, 19 bp, Homo sapiens
gacctgaggccctcactga

SEQ ID NO: 831326 - DNA, 15 bp, Homo sapiens
gacctgaggctgtgg

SEQ ID NO: 831327 - DNA, 17 bp, Homo sapiens
gacctgagtttgggaga

SEQ ID NO: 831328 - DNA, 17 bp, Homo sapiens
gacctgatttcagaaga

SEQ ID NO: 831329 - DNA, 18 bp, Homo sapiens
gacctgatttcagaagag

SEQ ID NO: 831330 - DNA, 18 bp, Homo sapiens
gacctgcagtgaggggcc

SEQ ID NO: 831331 - DNA, 15 bp, Homo sapiens
gacctgccaccaggg

SEQ ID NO: 831332 - DNA, 15 bp, Homo sapiens
gacctgccaggcagg

SEQ ID NO: 831333 - DNA, 18 bp, Homo sapiens
gacctgccaggcaggggt

SEQ ID NO: 831334 - DNA, 20 bp, Homo sapiens
gacctgccaggcaggggtgg

SEQ ID NO: 831335 - DNA, 18 bp, Homo sapiens
gacctgcctgcataggag

SEQ ID NO: 831336 - DNA, 15 bp, Homo sapiens
gacctgcgaaggatg

SEQ ID NO: 831337 - DNA, 16 bp, Homo sapiens
gacctgcgggtcctca

SEQ ID NO: 831338 - DNA, 20 bp, Homo sapiens
gacctgctccgccaggaaag

SEQ ID NO: 831339 - DNA, 17 bp, Homo sapiens
gacctgctccgctgctc

SEQ ID NO: 831340 - DNA, 23 bp, Homo sapiens
gacctgctccgctgctccttggc

SEQ ID NO: 831341 - DNA, 10 bp, Homo sapiens
gacctgctga

SEQ ID NO: 831342 - DNA, 13 bp, Homo sapiens
gacctgctgaatt

SEQ ID NO: 831343 - DNA, 16 bp, Homo sapiens
gacctggagcccctgg

SEQ ID NO: 831344 - DNA, 17 bp, Homo sapiens
gacctggataacttagg

SEQ ID NO: 831345 - DNA, 22 bp, Homo sapiens
gacctggatagttaagggcttt

SEQ ID NO: 831346 - DNA, 16 bp, Homo sapiens
gacctggcactgggag

SEQ ID NO: 831347 - DNA, 20 bp, Homo sapiens
gacctggcactgggaggcag

SEQ ID NO: 831348 - DNA, 15 bp, Homo sapiens
gacctggccccaggc

SEQ ID NO: 831349 - DNA, 16 bp, Homo sapiens
gacctggccccaggct

SEQ ID NO: 831350 - DNA, 17 bp, Homo sapiens
gacctggccccaggctg

SEQ ID NO: 831351 - DNA, 17 bp, Homo sapiens
gacctggcgtgctcaga

SEQ ID NO: 831352 - DNA, 18 bp, Homo sapiens
gacctgggaacgactgga

SEQ ID NO: 831353 - DNA, 16 bp, Homo sapiens
gacctgggcccacaga

SEQ ID NO: 831354 - DNA, 17 bp, Homo sapiens
gacctgggcccacagag

SEQ ID NO: 831355 - DNA, 23 bp, Homo sapiens
gacctgggcccacagagcctggc

SEQ ID NO: 831356 - DNA, 20 bp, Homo sapiens
gacctggggcacagtccagg

SEQ ID NO: 831357 - DNA, 22 bp, Homo sapiens
gacctggggcacagtccaggaa

SEQ ID NO: 831358 - DNA, 15 bp, Homo sapiens
gacctggggggaggg

SEQ ID NO: 831359 - DNA, 16 bp, Homo sapiens
gacctggggggaggga

SEQ ID NO: 831360 - DNA, 11 bp, Homo sapiens
gacctgggggt

SEQ ID NO: 831361 - DNA, 20 bp, Homo sapiens
gactcctctgggcctggggt

SEQ ID NO: 831362 - DNA, 14 bp, Homo sapiens
gactcctctgtcca

SEQ ID NO: 831363 - DNA, 15 bp, Homo sapiens
gactcctgaagggaa

SEQ ID NO: 831364 - DNA, 21 bp, Homo sapiens
gactcctgaggacagctgtcc

SEQ ID NO: 831365 - DNA, 13 bp, Homo sapiens
gactcctggcagg

SEQ ID NO: 831366 - DNA, 14 bp, Homo sapiens
gactcctggcaggg

SEQ ID NO: 831367 - DNA, 16 bp, Homo sapiens
gactcctgtgcaactt

SEQ ID NO: 831368 - DNA, 16 bp, Homo sapiens
gactcctttcctctga

SEQ ID NO: 831369 - DNA, 14 bp, Homo sapiens
gactcgaaactgac

SEQ ID NO: 831370 - DNA, 21 bp, Homo sapiens
gactcgcccccaggaacgctc

SEQ ID NO: 831371 - DNA, 14 bp, Homo sapiens
gactcgctagtcag

SEQ ID NO: 831372 - DNA, 20 bp, Homo sapiens
gactcggagactatggcctc

SEQ ID NO: 831373 - DNA, 15 bp, Homo sapiens
gactcggccactgtg

SEQ ID NO: 831374 - DNA, 16 bp, Homo sapiens
gactcggccactgtgt

SEQ ID NO: 831375 - DNA, 19 bp, Homo sapiens
gactcggccactgtgtctc

SEQ ID NO: 831376 - DNA, 21 bp, Homo sapiens
gactcggccactgtgtctctg

SEQ ID NO: 831377 - DNA, 15 bp, Homo sapiens
gactcgggagctgca

SEQ ID NO: 831378 - DNA, 17 bp, Homo sapiens
gactcgggagctgcaca

SEQ ID NO: 831379 - DNA, 15 bp, Homo sapiens
gactcggtgagccgg

SEQ ID NO: 831380 - DNA, 23 bp, Homo sapiens
gactcgtggcgcgggagctggga

SEQ ID NO: 831381 - DNA, 22 bp, Homo sapiens
gactctaaacaggaacttgaat

SEQ ID NO: 831382 - DNA, 19 bp, Homo sapiens
gactctacctcatatcagt

SEQ ID NO: 831383 - DNA, 17 bp, Homo sapiens
gactctaggttatacaa

SEQ ID NO: 831384 - DNA, 15 bp, Homo sapiens
gactctattctttaa

SEQ ID NO: 831385 - DNA, 16 bp, Homo sapiens
gactctattttaatgt

SEQ ID NO: 831386 - DNA, 16 bp, Homo sapiens
gactctcagtctctga

SEQ ID NO: 831387 - DNA, 13 bp, Homo sapiens
gactctcctcctc

SEQ ID NO: 831388 - DNA, 19 bp, Homo sapiens
gactctctgagctggggag

SEQ ID NO: 831389 - DNA, 12 bp, Homo sapiens
gactctctgtga

SEQ ID NO: 831390 - DNA, 19 bp, Homo sapiens
gactctctgtgacctgccc

SEQ ID NO: 831391 - DNA, 10 bp, Homo sapiens
gactctgagc

SEQ ID NO: 831392 - DNA, 14 bp, Homo sapiens
gactctgagccaag

SEQ ID NO: 831393 - DNA, 19 bp, Homo sapiens
gactctgagccaagggagg

SEQ ID NO: 831394 - DNA, 23 bp, Homo sapiens
gactctgagccaagggagggaag

SEQ ID NO: 831395 - DNA, 20 bp, Homo sapiens
gactctgagcgggaggcaga

SEQ ID NO: 831396 - DNA, 19 bp, Homo sapiens
gactctgaggctctttctg

SEQ ID NO: 831397 - DNA, 18 bp, Homo sapiens
gactctgagtccactgct

SEQ ID NO: 831398 - DNA, 20 bp, Homo sapiens
gactctgagtccactgctcc

SEQ ID NO: 831399 - DNA, 23 bp, Homo sapiens
gactctgatggaatgtgccacct

SEQ ID NO: 831400 - DNA, 19 bp, Homo sapiens
gactctgcagagtcactca

SEQ ID NO: 831401 - DNA, 15 bp, Homo sapiens
gactctgcagccctc

SEQ ID NO: 831402 - DNA, 21 bp, Homo sapiens
gactctgcatcccagcacctg

SEQ ID NO: 831403 - DNA, 21 bp, Homo sapiens
gactctgccttttttcacagc

SEQ ID NO: 831404 - DNA, 22 bp, Homo sapiens
gactctgccttttttcacagcc

SEQ ID NO: 831405 - DNA, 20 bp, Homo sapiens
gactctgcttaaacaaagca

SEQ ID NO: 831406 - DNA, 22 bp, Homo sapiens
gactctgcttaaacaaagcagt

SEQ ID NO: 831407 - DNA, 23 bp, Homo sapiens
gactctgcttaaacaaagcagta

SEQ ID NO: 831408 - DNA, 20 bp, Homo sapiens
gactctggactttctctaat

SEQ ID NO: 831409 - DNA, 12 bp, Homo sapiens
gactctggccct

SEQ ID NO: 831410 - DNA, 14 bp, Homo sapiens
gactctggccctgg

SEQ ID NO: 831411 - DNA, 16 bp, Homo sapiens
gactctggccctggcc

SEQ ID NO: 831412 - DNA, 17 bp, Homo sapiens
gactctggccctggccc

SEQ ID NO: 831413 - DNA, 18 bp, Homo sapiens
gactctggccctggccct

SEQ ID NO: 831414 - DNA, 13 bp, Homo sapiens
gactctgggcagg

SEQ ID NO: 831415 - DNA, 13 bp, Homo sapiens
gactctggggcgc

SEQ ID NO: 831416 - DNA, 21 bp, Homo sapiens
gactctgggtccctcggagct

SEQ ID NO: 831417 - DNA, 15 bp, Homo sapiens
gactctgtcacaaag

SEQ ID NO: 831418 - DNA, 19 bp, Homo sapiens
gactctgtctacctggtct

SEQ ID NO: 831419 - DNA, 18 bp, Homo sapiens
gactctgtggggccttgg

SEQ ID NO: 831420 - DNA, 20 bp, Homo sapiens
gactcttcactccaaaaaga

SEQ ID NO: 831421 - DNA, 14 bp, Homo sapiens
gactcttcccctcc

SEQ ID NO: 831422 - DNA, 10 bp, Homo sapiens
gactcttccg

SEQ ID NO: 831423 - DNA, 13 bp, Homo sapiens
gactcttcctgca

SEQ ID NO: 831424 - DNA, 15 bp, Homo sapiens
gactcttgctctttc

SEQ ID NO: 831425 - DNA, 12 bp, Homo sapiens
gactctttcaaa

SEQ ID NO: 831426 - DNA, 17 bp, Homo sapiens
gactcttttgccattaa

SEQ ID NO: 831427 - DNA, 22 bp, Homo sapiens
gactctttttagggccaggcag

SEQ ID NO: 831428 - DNA, 20 bp, Homo sapiens
gactgaaaacctctcctcat

SEQ ID NO: 831429 - DNA, 20 bp, Homo sapiens
gactgaaacaaaatgttttt

SEQ ID NO: 831430 - DNA, 17 bp, Homo sapiens
gactgaaacgccttgca

SEQ ID NO: 831431 - DNA, 17 bp, Homo sapiens
gactgaaagcagcagct

SEQ ID NO: 831432 - DNA, 15 bp, Homo sapiens
gactgaaagtagggg

SEQ ID NO: 831433 - DNA, 23 bp, Homo sapiens
gactgaaattgttttaccagctc

SEQ ID NO: 831434 - DNA, 13 bp, Homo sapiens
gactgaaatttag

SEQ ID NO: 831435 - DNA, 19 bp, Homo sapiens
gactgaagaagatgagcct

SEQ ID NO: 831436 - DNA, 16 bp, Homo sapiens
gactgaagactagccc

SEQ ID NO: 831437 - DNA, 14 bp, Homo sapiens
gactgaaggaaaag

SEQ ID NO: 831438 - DNA, 13 bp, Homo sapiens
gactgaaggggca

SEQ ID NO: 831439 - DNA, 23 bp, Homo sapiens
gactgaaggggcacaccactgcc

SEQ ID NO: 831440 - DNA, 19 bp, Homo sapiens
gactgaatgttttatttat

SEQ ID NO: 831441 - DNA, 14 bp, Homo sapiens
gactgaattctgcc

SEQ ID NO: 831442 - DNA, 15 bp, Homo sapiens
gactgaattctgcct

SEQ ID NO: 831443 - DNA, 19 bp, Homo sapiens
gactgaattctgccttggt

SEQ ID NO: 831444 - DNA, 22 bp, Homo sapiens
gactgaccaatattgtacagtt

SEQ ID NO: 831445 - DNA, 17 bp, Homo sapiens
gactgaccatgcactat

SEQ ID NO: 831446 - DNA, 16 bp, Homo sapiens
gactgacccccatctg

SEQ ID NO: 831447 - DNA, 20 bp, Homo sapiens
gactgacccccatctgagct

SEQ ID NO: 831448 - DNA, 23 bp, Homo sapiens
gactgacccccatctgagctggg

SEQ ID NO: 831449 - DNA, 13 bp, Homo sapiens
gactgaccctgag

SEQ ID NO: 831450 - DNA, 14 bp, Homo sapiens
gactgaccctgagg

SEQ ID NO: 831451 - DNA, 16 bp, Homo sapiens
gactgaccctgaggag

SEQ ID NO: 831452 - DNA, 15 bp, Homo sapiens
gactgagaggcagaa

SEQ ID NO: 831453 - DNA, 17 bp, Homo sapiens
gactgagcaccctctgg

SEQ ID NO: 831454 - DNA, 14 bp, Homo sapiens
gactgagcacctgc

SEQ ID NO: 831455 - DNA, 15 bp, Homo sapiens
gactgagcacctgct

SEQ ID NO: 831456 - DNA, 19 bp, Homo sapiens
gactgagcagccgccagct

SEQ ID NO: 831457 - DNA, 17 bp, Homo sapiens
gactgagccaaggaggc

SEQ ID NO: 831458 - DNA, 12 bp, Homo sapiens
gactgagccagt

SEQ ID NO: 831459 - DNA, 23 bp, Homo sapiens
gactgagcccccaccggaactgg

SEQ ID NO: 831460 - DNA, 14 bp, Homo sapiens
gactgagccctctc

SEQ ID NO: 831461 - DNA, 14 bp, Homo sapiens
gactgagctctcca

SEQ ID NO: 831462 - DNA, 15 bp, Homo sapiens
gactgagctggggga

SEQ ID NO: 831463 - DNA, 15 bp, Homo sapiens
gactgaggacaaagt

SEQ ID NO: 831464 - DNA, 18 bp, Homo sapiens
gactgaggtataaagaca

SEQ ID NO: 831465 - DNA, 18 bp, Homo sapiens
gactgaggtgcctgctca

SEQ ID NO: 831466 - DNA, 22 bp, Homo sapiens
gactgagtacgttgtgcatttg

SEQ ID NO: 831467 - DNA, 14 bp, Homo sapiens
gactgagtcagatg

SEQ ID NO: 831468 - DNA, 14 bp, Homo sapiens
gactgagtgggaag

SEQ ID NO: 831469 - DNA, 18 bp, Homo sapiens
gactgatcatccaggcct

SEQ ID NO: 831470 - DNA, 22 bp, Homo sapiens
gactgatgagcacatctctctg

SEQ ID NO: 831471 - DNA, 16 bp, Homo sapiens
gactgcaaactttttt

SEQ ID NO: 831472 - DNA, 19 bp, Homo sapiens
gactgcaagcatttttcca

SEQ ID NO: 831473 - DNA, 20 bp, Homo sapiens
gactgcaagcatttttccat

SEQ ID NO: 831474 - DNA, 20 bp, Homo sapiens
gactgcagacattctcaaag

SEQ ID NO: 831475 - DNA, 14 bp, Homo sapiens
gactgcagctgctg

SEQ ID NO: 831476 - DNA, 19 bp, Homo sapiens
gactgcaggtgggctgggc

SEQ ID NO: 831477 - DNA, 21 bp, Homo sapiens
gactgcaggtgggctgggccc

SEQ ID NO: 831478 - DNA, 20 bp, Homo sapiens
gactgcagtcggcatgccag

SEQ ID NO: 831479 - DNA, 15 bp, Homo sapiens
gactgcagtgtggag

SEQ ID NO: 831480 - DNA, 20 bp, Homo sapiens
gactgcagtgtggagttcac

SEQ ID NO: 831481 - DNA, 21 bp, Homo sapiens
gactgcagtgtggagttcacc

SEQ ID NO: 831482 - DNA, 22 bp, Homo sapiens
gactgcatggggaggcagcaga

SEQ ID NO: 831483 - DNA, 18 bp, Homo sapiens
gagaaaatcatcaagaag

SEQ ID NO: 831484 - DNA, 23 bp, Homo sapiens
gagaaaatcatcaagaagggctg

SEQ ID NO: 831485 - DNA, 19 bp, Homo sapiens
gagaaacagagacaggccc

SEQ ID NO: 831486 - DNA, 17 bp, Homo sapiens
gagaaacagttggtaac

SEQ ID NO: 831487 - DNA, 19 bp, Homo sapiens
gagaaacagttggtaactt

SEQ ID NO: 831488 - DNA, 22 bp, Homo sapiens
gagaaacgcgctccttggcgga

SEQ ID NO: 831489 - DNA, 17 bp, Homo sapiens
gagaaagaaaaggcaaa

SEQ ID NO: 831490 - DNA, 13 bp, Homo sapiens
gagaaagaagaga

SEQ ID NO: 831491 - DNA, 19 bp, Homo sapiens
gagaaagaggcaccaggaa

SEQ ID NO: 831492 - DNA, 20 bp, Homo sapiens
gagaaagcccacctgggctg

SEQ ID NO: 831493 - DNA, 19 bp, Homo sapiens
gagaaagccgggggagggg

SEQ ID NO: 831494 - DNA, 18 bp, Homo sapiens
gagaaagcttttattcct

SEQ ID NO: 831495 - DNA, 18 bp, Homo sapiens
gagaaaggagaaattttg

SEQ ID NO: 831496 - DNA, 18 bp, Homo sapiens
gagaaagggagaggaaga

SEQ ID NO: 831497 - DNA, 19 bp, Homo sapiens
gagaaagggcagaggaaga

SEQ ID NO: 831498 - DNA, 23 bp, Homo sapiens
gagaaagtaccctcttttaccaa

SEQ ID NO: 831499 - DNA, 20 bp, Homo sapiens
gagaaagtgatttctagaaa

SEQ ID NO: 831500 - DNA, 22 bp, Homo sapiens
gagaaataattgttgattaatt

SEQ ID NO: 831501 - DNA, 18 bp, Homo sapiens
gagaaatacaaaataaag

SEQ ID NO: 831502 - DNA, 13 bp, Homo sapiens
gagaaatagctga

SEQ ID NO: 831503 - DNA, 13 bp, Homo sapiens
gagaaatgcaata

SEQ ID NO: 831504 - DNA, 19 bp, Homo sapiens
gagaaatttttatttttga

SEQ ID NO: 831505 - DNA, 12 bp, Homo sapiens
gagaacaaagct

SEQ ID NO: 831506 - DNA, 17 bp, Homo sapiens
gagaacaacaggcaggg

SEQ ID NO: 831507 - DNA, 19 bp, Homo sapiens
gagaacaagaaagggccag

SEQ ID NO: 831508 - DNA, 14 bp, Homo sapiens
gagaacagaaaaca

SEQ ID NO: 831509 - DNA, 19 bp, Homo sapiens
gagaacagtttcatcagga

SEQ ID NO: 831510 - DNA, 17 bp, Homo sapiens
gagaaccaaatctggaa

SEQ ID NO: 831511 - DNA, 14 bp, Homo sapiens
gagaacctcaggct

SEQ ID NO: 831512 - DNA, 15 bp, Homo sapiens
gagaacgccagtctc

SEQ ID NO: 831513 - DNA, 20 bp, Homo sapiens
gagaacgggcgtcaggggtg

SEQ ID NO: 831514 - DNA, 21 bp, Homo sapiens
gagaacgggcgtcaggggtgc

SEQ ID NO: 831515 - DNA, 20 bp, Homo sapiens
gagaactgacaaaggagcct

SEQ ID NO: 831516 - DNA, 19 bp, Homo sapiens
gagaactgcatatgtttcg

SEQ ID NO: 831517 - DNA, 15 bp, Homo sapiens
gagaagaaatagact

SEQ ID NO: 831518 - DNA, 20 bp, Homo sapiens
gagaagaattttcagacccc

SEQ ID NO: 831519 - DNA, 21 bp, Homo sapiens
gagaagaattttcagacccca

SEQ ID NO: 831520 - DNA, 13 bp, Homo sapiens
gagaagaggagga

SEQ ID NO: 831521 - DNA, 21 bp, Homo sapiens
gagaagaggaggaggtggggg

SEQ ID NO: 831522 - DNA, 19 bp, Homo sapiens
gagaagagggcccagccca

SEQ ID NO: 831523 - DNA, 14 bp, Homo sapiens
gagaagagggcctg

SEQ ID NO: 831524 - DNA, 15 bp, Homo sapiens
gagaagagggcctgt

SEQ ID NO: 831525 - DNA, 20 bp, Homo sapiens
gagaagatctaccccaggga

SEQ ID NO: 831526 - DNA, 16 bp, Homo sapiens
gagaagcagaggaagg

SEQ ID NO: 831527 - DNA, 18 bp, Homo sapiens
gagaagcagtgagccgca

SEQ ID NO: 831528 - DNA, 15 bp, Homo sapiens
gagaagccaccttcc

SEQ ID NO: 831529 - DNA, 14 bp, Homo sapiens
gagaagccacgctg

SEQ ID NO: 831530 - DNA, 14 bp, Homo sapiens
gagaagccaggagg

SEQ ID NO: 831531 - DNA, 14 bp, Homo sapiens
gagaagcccgtgtg

SEQ ID NO: 831532 - DNA, 15 bp, Homo sapiens
gagaagcccgtgtga

SEQ ID NO: 831533 - DNA, 15 bp, Homo sapiens
gagaagcggctggca

SEQ ID NO: 831534 - DNA, 15 bp, Homo sapiens
gagaagcgggctggg

SEQ ID NO: 831535 - DNA, 16 bp, Homo sapiens
gagaagcggtcatgag

SEQ ID NO: 831536 - DNA, 20 bp, Homo sapiens
gagaagctagatgcccctgc

SEQ ID NO: 831537 - DNA, 13 bp, Homo sapiens
gagaagctgaagc

SEQ ID NO: 831538 - DNA, 13 bp, Homo sapiens
gagaagctgaggc

SEQ ID NO: 831539 - DNA, 11 bp, Homo sapiens
gagaagctgct

SEQ ID NO: 831540 - DNA, 13 bp, Homo sapiens
gagaagctgctga

SEQ ID NO: 831541 - DNA, 15 bp, Homo sapiens
gagaaggaaaaagaa

SEQ ID NO: 831542 - DNA, 14 bp, Homo sapiens
gagaaggaaggaga

SEQ ID NO: 831543 - DNA, 21 bp, Homo sapiens
gagaaggaaggagactcacct

SEQ ID NO: 831544 - DNA, 21 bp, Homo sapiens
gagaaggacggtgccaagggc

SEQ ID NO: 831545 - DNA, 12 bp, Homo sapiens
gagaaggaggag

SEQ ID NO: 831546 - DNA, 22 bp, Homo sapiens
gagaaggataggccttcattaa

SEQ ID NO: 831547 - DNA, 13 bp, Homo sapiens
gagaaggcaggaa

SEQ ID NO: 831548 - DNA, 18 bp, Homo sapiens
gagaaggcaggcctccgt

SEQ ID NO: 831549 - DNA, 14 bp, Homo sapiens
gagaaggcgaggag

SEQ ID NO: 831550 - DNA, 13 bp, Homo sapiens
gagaaggctatgt

SEQ ID NO: 831551 - DNA, 23 bp, Homo sapiens
gagaaggctcacgaagggcatcc

SEQ ID NO: 831552 - DNA, 17 bp, Homo sapiens
gagaagggcatggtatt

SEQ ID NO: 831553 - DNA, 15 bp, Homo sapiens
gagaagggggattgg

SEQ ID NO: 831554 - DNA, 21 bp, Homo sapiens
gagaagggggattggagggaa

SEQ ID NO: 831555 - DNA, 17 bp, Homo sapiens
gagaagggggtctctgt

SEQ ID NO: 831556 - DNA, 13 bp, Homo sapiens
gagaagggttctg

SEQ ID NO: 831557 - DNA, 18 bp, Homo sapiens
gagaagggttctgccctg

SEQ ID NO: 831558 - DNA, 20 bp, Homo sapiens
gagaagggttctgccctgcc

SEQ ID NO: 831559 - DNA, 22 bp, Homo sapiens
gagaagggttctgccctgcctg

SEQ ID NO: 831560 - DNA, 22 bp, Homo sapiens
gagaagtctcagctaagctcac

SEQ ID NO: 831561 - DNA, 23 bp, Homo sapiens
gagaagtcttagacttgaaatac

SEQ ID NO: 831562 - DNA, 19 bp, Homo sapiens
gagaagtgaatgctgggac

SEQ ID NO: 831563 - DNA, 20 bp, Homo sapiens
gagaagtgaatgctgggact

SEQ ID NO: 831564 - DNA, 20 bp, Homo sapiens
gagaagtgcccctgctgcct

SEQ ID NO: 831565 - DNA, 21 bp, Homo sapiens
gagaagtgctcttggctgacc

SEQ ID NO: 831566 - DNA, 12 bp, Homo sapiens
gagaagttctca

SEQ ID NO: 831567 - DNA, 18 bp, Homo sapiens
gagaagttctcaaagtta

SEQ ID NO: 831568 - DNA, 18 bp, Homo sapiens
gagaataagagaaagaaa

SEQ ID NO: 831569 - DNA, 13 bp, Homo sapiens
gagaatattcaaa

SEQ ID NO: 831570 - DNA, 16 bp, Homo sapiens
gagaatattcaaaatt

SEQ ID NO: 831571 - DNA, 19 bp, Homo sapiens
gagaatattttaagtattg

SEQ ID NO: 831572 - DNA, 21 bp, Homo sapiens
gagaatcacacaagtttgtgc

SEQ ID NO: 831573 - DNA, 20 bp, Homo sapiens
gagaatcagatcatttcaaa

SEQ ID NO: 831574 - DNA, 14 bp, Homo sapiens
gagaatcccttaaa

SEQ ID NO: 831575 - DNA, 21 bp, Homo sapiens
gagaatcctctcctttcttat

SEQ ID NO: 831576 - DNA, 21 bp, Homo sapiens
gagaatctacccccagatcca

SEQ ID NO: 831577 - DNA, 15 bp, Homo sapiens
gagaatctatattta

SEQ ID NO: 831578 - DNA, 18 bp, Homo sapiens
gagaatctcaagattcta

SEQ ID NO: 831579 - DNA, 20 bp, Homo sapiens
gagaatcttaaggtctaact

SEQ ID NO: 831580 - DNA, 13 bp, Homo sapiens
gagaatctttatt

SEQ ID NO: 831581 - DNA, 19 bp, Homo sapiens
gagaatctttattgagaaa

SEQ ID NO: 831582 - DNA, 22 bp, Homo sapiens
gagaatgagagcgacacagacg

SEQ ID NO: 831583 - DNA, 20 bp, Homo sapiens
gagaatggcgtgaacccggg

SEQ ID NO: 831584 - DNA, 18 bp, Homo sapiens
gagaatggggttcctgct

SEQ ID NO: 831585 - DNA, 23 bp, Homo sapiens
gagaatgtatcagccagccttcc

SEQ ID NO: 831586 - DNA, 14 bp, Homo sapiens
gagaatgtcactgt

SEQ ID NO: 831587 - DNA, 22 bp, Homo sapiens
gagaattaagttttaaataaac

SEQ ID NO: 831588 - DNA, 14 bp, Homo sapiens
gagaattcacagaa

SEQ ID NO: 831589 - DNA, 16 bp, Homo sapiens
gagaattcttacatgt

SEQ ID NO: 831590 - DNA, 15 bp, Homo sapiens
gagaattgcacacag

SEQ ID NO: 831591 - DNA, 18 bp, Homo sapiens
gagaattgcttgaaccca

SEQ ID NO: 831592 - DNA, 13 bp, Homo sapiens
gagaattggctca

SEQ ID NO: 831593 - DNA, 18 bp, Homo sapiens
gagaattgtatgtcatgt

SEQ ID NO: 831594 - DNA, 21 bp, Homo sapiens
gagaatttaagtagaaaagtt

SEQ ID NO: 831595 - DNA, 15 bp, Homo sapiens
gagaattttaaatta

SEQ ID NO: 831596 - DNA, 19 bp, Homo sapiens
gagacaaacacctcccagg

SEQ ID NO: 831597 - DNA, 14 bp, Homo sapiens
gagacaaagcagga

SEQ ID NO: 831598 - DNA, 15 bp, Homo sapiens
gagacaaagcaggag

SEQ ID NO: 831599 - DNA, 21 bp, Homo sapiens
gagacaaatcctttctgcccc

SEQ ID NO: 831600 - DNA, 22 bp, Homo sapiens
gagacaactggacaagatttcc

SEQ ID NO: 831601 - DNA, 17 bp, Homo sapiens
gagacaagaaatccctg

SEQ ID NO: 831602 - DNA, 15 bp, Homo sapiens
gagacaagccctggc

SEQ ID NO: 831603 - DNA, 15 bp, Homo sapiens
gagacaaggtgctaa

SEQ ID NO: 831604 - DNA, 16 bp, Homo sapiens
gagacaaggtgctaac

SEQ ID NO: 831605 - DNA, 18 bp, Homo sapiens
gagagggtctggagaagc

SEQ ID NO: 831606 - DNA, 13 bp, Homo sapiens
gagaggtgccagc

SEQ ID NO: 831607 - DNA, 23 bp, Homo sapiens
gagaggtgccggggaggggcaga

SEQ ID NO: 831608 - DNA, 14 bp, Homo sapiens
gagaggtggcagga

SEQ ID NO: 831609 - DNA, 22 bp, Homo sapiens
gagaggtgggccagtctgtgga

SEQ ID NO: 831610 - DNA, 20 bp, Homo sapiens
gagaggtttttcttgggaaa

SEQ ID NO: 831611 - DNA, 21 bp, Homo sapiens
gagaggtttttcttgggaaag

SEQ ID NO: 831612 - DNA, 13 bp, Homo sapiens
gagagtaaacaga

SEQ ID NO: 831613 - DNA, 18 bp, Homo sapiens
gagagtaaacagacagct

SEQ ID NO: 831614 - DNA, 18 bp, Homo sapiens
gagagtacagactgcaga

SEQ ID NO: 831615 - DNA, 16 bp, Homo sapiens
gagagtcaaagctgac

SEQ ID NO: 831616 - DNA, 23 bp, Homo sapiens
gagagtcagctctctgccctgtg

SEQ ID NO: 831617 - DNA, 19 bp, Homo sapiens
gagagtcccagagcaggag

SEQ ID NO: 831618 - DNA, 14 bp, Homo sapiens
gagagtctgtctca

SEQ ID NO: 831619 - DNA, 16 bp, Homo sapiens
gagagtgagcaaccag

SEQ ID NO: 831620 - DNA, 24 bp, Homo sapiens
gagagtggcaggtgggctgcctgc

SEQ ID NO: 831621 - DNA, 13 bp, Homo sapiens
gagagtggctcct

SEQ ID NO: 831622 - DNA, 14 bp, Homo sapiens
gagagtggtgccct

SEQ ID NO: 831623 - DNA, 16 bp, Homo sapiens
gagagttggctcaggc

SEQ ID NO: 831624 - DNA, 18 bp, Homo sapiens
gagagttggctcaggcag

SEQ ID NO: 831625 - DNA, 12 bp, Homo sapiens
gagagtttcaaa

SEQ ID NO: 831626 - DNA, 13 bp, Homo sapiens
gagagtttcaaaa

SEQ ID NO: 831627 - DNA, 15 bp, Homo sapiens
gagagttttgtcttg

SEQ ID NO: 831628 - DNA, 23 bp, Homo sapiens
gagataaaacagaatcttctggg

SEQ ID NO: 831629 - DNA, 19 bp, Homo sapiens
gagataaaagcaattctga

SEQ ID NO: 831630 - DNA, 21 bp, Homo sapiens
gagataaagtcaaatgccaaa

SEQ ID NO: 831631 - DNA, 18 bp, Homo sapiens
gagataaatagaaatttt

SEQ ID NO: 831632 - DNA, 15 bp, Homo sapiens
gagataatatgagaa

SEQ ID NO: 831633 - DNA, 15 bp, Homo sapiens
gagataccagcgagg

SEQ ID NO: 831634 - DNA, 21 bp, Homo sapiens
gagatactctccctgacattt

SEQ ID NO: 831635 - DNA, 15 bp, Homo sapiens
gagatacttcccaaa

SEQ ID NO: 831636 - DNA, 16 bp, Homo sapiens
gagatagaagaactgc

SEQ ID NO: 831637 - DNA, 15 bp, Homo sapiens
gagatagcattgtga

SEQ ID NO: 831638 - DNA, 23 bp, Homo sapiens
gagatagcattgtgaactgacag

SEQ ID NO: 831639 - DNA, 15 bp, Homo sapiens
gagatagctggggct

SEQ ID NO: 831640 - DNA, 16 bp, Homo sapiens
gagatagctggggctt

SEQ ID NO: 831641 - DNA, 12 bp, Homo sapiens
gagataggggag

SEQ ID NO: 831642 - DNA, 18 bp, Homo sapiens
gagataggggagggggga

SEQ ID NO: 831643 - DNA, 14 bp, Homo sapiens
gagatattataagg

SEQ ID NO: 831644 - DNA, 19 bp, Homo sapiens
gagatattcttatttcact

SEQ ID NO: 831645 - DNA, 20 bp, Homo sapiens
gagatcaaagatgaaaagta

SEQ ID NO: 831646 - DNA, 15 bp, Homo sapiens
gagatcacagcctcc

SEQ ID NO: 831647 - DNA, 17 bp, Homo sapiens
gagatcacagcctccag

SEQ ID NO: 831648 - DNA, 21 bp, Homo sapiens
gagatcacgccactgcactcc

SEQ ID NO: 831649 - DNA, 14 bp, Homo sapiens
gagatccccagggc

SEQ ID NO: 831650 - DNA, 16 bp, Homo sapiens
gagatccccagggcag

SEQ ID NO: 831651 - DNA, 17 bp, Homo sapiens
gagatccccagggcagc

SEQ ID NO: 831652 - DNA, 20 bp, Homo sapiens
gagatccctgcagaacccac

SEQ ID NO: 831653 - DNA, 13 bp, Homo sapiens
gagatcctcctgc

SEQ ID NO: 831654 - DNA, 14 bp, Homo sapiens
gagatcctcctgca

SEQ ID NO: 831655 - DNA, 20 bp, Homo sapiens
gagatcctctttactctggg

SEQ ID NO: 831656 - DNA, 17 bp, Homo sapiens
gagatccttcacaggca

SEQ ID NO: 831657 - DNA, 18 bp, Homo sapiens
gagatcgagaccatcctg

SEQ ID NO: 831658 - DNA, 21 bp, Homo sapiens
gagatcgagaccatcctggct

SEQ ID NO: 831659 - DNA, 21 bp, Homo sapiens
gagatcgcgccactgcactcc

SEQ ID NO: 831660 - DNA, 16 bp, Homo sapiens
gagatcgggaagcaga

SEQ ID NO: 831661 - DNA, 22 bp, Homo sapiens
gagatcgtgccgttactctcca

SEQ ID NO: 831662 - DNA, 20 bp, Homo sapiens
gagatctaagcctttccata

SEQ ID NO: 831663 - DNA, 16 bp, Homo sapiens
gagatctatatttttg

SEQ ID NO: 831664 - DNA, 16 bp, Homo sapiens
gagatctgaacccagc

SEQ ID NO: 831665 - DNA, 17 bp, Homo sapiens
gagatctggggaggcag

SEQ ID NO: 831666 - DNA, 13 bp, Homo sapiens
gagatcttccttc

SEQ ID NO: 831667 - DNA, 21 bp, Homo sapiens
gagatgaagagtgagagggca

SEQ ID NO: 831668 - DNA, 16 bp, Homo sapiens
gagatgaccagggatg

SEQ ID NO: 831669 - DNA, 13 bp, Homo sapiens
gagatgaccccta

SEQ ID NO: 831670 - DNA, 20 bp, Homo sapiens
gagatgactattacttttct

SEQ ID NO: 831671 - DNA, 20 bp, Homo sapiens
gagatgagaaagcttttatt

SEQ ID NO: 831672 - DNA, 18 bp, Homo sapiens
gagatgaggaggggagcg

SEQ ID NO: 831673 - DNA, 16 bp, Homo sapiens
gagatgaggagtaaaa

SEQ ID NO: 831674 - DNA, 20 bp, Homo sapiens
gagatgaggagtaaaattca

SEQ ID NO: 831675 - DNA, 15 bp, Homo sapiens
gagatgaggccagac

SEQ ID NO: 831676 - DNA, 20 bp, Homo sapiens
gagatgatcagtccaactga

SEQ ID NO: 831677 - DNA, 14 bp, Homo sapiens
gagatgcaaggtgc

SEQ ID NO: 831678 - DNA, 21 bp, Homo sapiens
gagatgcaccaccaagccaag

SEQ ID NO: 831679 - DNA, 20 bp, Homo sapiens
gagatgcagctactggaatg

SEQ ID NO: 831680 - DNA, 20 bp, Homo sapiens
gagatgcatgcgcaggctca

SEQ ID NO: 831681 - DNA, 16 bp, Homo sapiens
gagatgctgagggtgt

SEQ ID NO: 831682 - DNA, 12 bp, Homo sapiens
gagatgctgggc

SEQ ID NO: 831683 - DNA, 13 bp, Homo sapiens
gagatgctgggct

SEQ ID NO: 831684 - DNA, 17 bp, Homo sapiens
gagatgctgtaacttaa

SEQ ID NO: 831685 - DNA, 14 bp, Homo sapiens
gagatgcttctctc

SEQ ID NO: 831686 - DNA, 18 bp, Homo sapiens
gagatggacccctccctt

SEQ ID NO: 831687 - DNA, 14 bp, Homo sapiens
gagatggagggctt

SEQ ID NO: 831688 - DNA, 16 bp, Homo sapiens
gagatggagggcttgg

SEQ ID NO: 831689 - DNA, 18 bp, Homo sapiens
gagatggcagcagtgaag

SEQ ID NO: 831690 - DNA, 12 bp, Homo sapiens
gagatgggaagg

SEQ ID NO: 831691 - DNA, 21 bp, Homo sapiens
gagatgggacaagcagtccct

SEQ ID NO: 831692 - DNA, 19 bp, Homo sapiens
gagatgggggcttcttcct

SEQ ID NO: 831693 - DNA, 21 bp, Homo sapiens
gagatggggtttcaccatgtt

SEQ ID NO: 831694 - DNA, 13 bp, Homo sapiens
gagatgggtcctg

SEQ ID NO: 831695 - DNA, 15 bp, Homo sapiens
gagatggtgaggctg

SEQ ID NO: 831696 - DNA, 16 bp, Homo sapiens
gagatggttaaaaagg

SEQ ID NO: 831697 - DNA, 23 bp, Homo sapiens
gagatgtatgaaggcttttggtc

SEQ ID NO: 831698 - DNA, 15 bp, Homo sapiens
gagatgtcttggaac

SEQ ID NO: 831699 - DNA, 23 bp, Homo sapiens
gagatgtgagtcctgttgaagac

SEQ ID NO: 831700 - DNA, 15 bp, Homo sapiens
gagatgtgcctgtgg

SEQ ID NO: 831701 - DNA, 21 bp, Homo sapiens
gagatgtgcctgtgggagggg

SEQ ID NO: 831702 - DNA, 17 bp, Homo sapiens
gagatgtgtatcagtgt

SEQ ID NO: 831703 - DNA, 19 bp, Homo sapiens
gagatgtttttaaaagttt

SEQ ID NO: 831704 - DNA, 15 bp, Homo sapiens
gagattacctcctga

SEQ ID NO: 831705 - DNA, 23 bp, Homo sapiens
gagattatttacaagaagaactc

SEQ ID NO: 831706 - DNA, 23 bp, Homo sapiens
gagattcccgcgggttccgcagg

SEQ ID NO: 831707 - DNA, 20 bp, Homo sapiens
gagattctcataacttgaga

SEQ ID NO: 831708 - DNA, 19 bp, Homo sapiens
gagattctgggtttgccca

SEQ ID NO: 831709 - DNA, 18 bp, Homo sapiens
gagattgcaccactgcac

SEQ ID NO: 831710 - DNA, 13 bp, Homo sapiens
gagattgcactgc

SEQ ID NO: 831711 - DNA, 18 bp, Homo sapiens
gagattgccccagagccc

SEQ ID NO: 831712 - DNA, 19 bp, Homo sapiens
gagattggatcaagtatta

SEQ ID NO: 831713 - DNA, 17 bp, Homo sapiens
gagattggatttgctgt

SEQ ID NO: 831714 - DNA, 13 bp, Homo sapiens
gagattgggagaa

SEQ ID NO: 831715 - DNA, 14 bp, Homo sapiens
gagattgggagaaa

SEQ ID NO: 831716 - DNA, 17 bp, Homo sapiens
gagattgggagaaatca

SEQ ID NO: 831717 - DNA, 22 bp, Homo sapiens
gagatttaaatgcaaccagaat

SEQ ID NO: 831718 - DNA, 13 bp, Homo sapiens
gagatttacaact

SEQ ID NO: 831719 - DNA, 15 bp, Homo sapiens
gagatttactgctct

SEQ ID NO: 831720 - DNA, 20 bp, Homo sapiens
gagatttcccttcatttaaa

SEQ ID NO: 831721 - DNA, 18 bp, Homo sapiens
gagatttcttttttatgt

SEQ ID NO: 831722 - DNA, 20 bp, Homo sapiens
gagatttcttttttatgtga

SEQ ID NO: 831723 - DNA, 21 bp, Homo sapiens
gagatttcttttttatgtgat

SEQ ID NO: 831724 - DNA, 14 bp, Homo sapiens
gagatttgccagca

SEQ ID NO: 831725 - DNA, 18 bp, Homo sapiens
gagatttgccagcacagg

SEQ ID NO: 831726 - DNA, 15 bp, Homo sapiens
gagatttgggagctg

SEQ ID NO: 831727 - DNA, 17 bp, Homo sapiens
gagccatgcctccctgg

SEQ ID NO: 831728 - DNA, 22 bp, Homo sapiens
gagccatggaccacgcaggaag

SEQ ID NO: 831729 - DNA, 15 bp, Homo sapiens
gagccatgggcctgg

SEQ ID NO: 831730 - DNA, 16 bp, Homo sapiens
gagccatgggcctggg

SEQ ID NO: 831731 - DNA, 19 bp, Homo sapiens
gagccatgggcctgggcct

SEQ ID NO: 831732 - DNA, 16 bp, Homo sapiens
gagccattgaacagct

SEQ ID NO: 831733 - DNA, 20 bp, Homo sapiens
gagccatttatacctttgaa

SEQ ID NO: 831734 - DNA, 18 bp, Homo sapiens
gagcccaaccaggccctg

SEQ ID NO: 831735 - DNA, 13 bp, Homo sapiens
gagcccacaacct

SEQ ID NO: 831736 - DNA, 15 bp, Homo sapiens
gagcccacactgcca

SEQ ID NO: 831737 - DNA, 16 bp, Homo sapiens
gagcccacagtgcctg

SEQ ID NO: 831738 - DNA, 12 bp, Homo sapiens
gagcccaccagc

SEQ ID NO: 831739 - DNA, 23 bp, Homo sapiens
gagcccaccagccagccctggcc

SEQ ID NO: 831740 - DNA, 23 bp, Homo sapiens
gagcccacgcccgactagcaggc

SEQ ID NO: 831741 - DNA, 11 bp, Homo sapiens
gagcccactcc

SEQ ID NO: 831742 - DNA, 20 bp, Homo sapiens
gagcccactgcccaccccct

SEQ ID NO: 831743 - DNA, 14 bp, Homo sapiens
gagcccagagaaca

SEQ ID NO: 831744 - DNA, 22 bp, Homo sapiens
gagcccagctcttgctctcttg

SEQ ID NO: 831745 - DNA, 19 bp, Homo sapiens
gagcccagctgggtcaggc

SEQ ID NO: 831746 - DNA, 22 bp, Homo sapiens
gagcccagctgggtcaggcagg

SEQ ID NO: 831747 - DNA, 24 bp, Homo sapiens
gagcccaggagctgagtcacctcc

SEQ ID NO: 831748 - DNA, 20 bp, Homo sapiens
gagcccaggcagctatttca

SEQ ID NO: 831749 - DNA, 22 bp, Homo sapiens
gagcccaggggagaatgcagcc

SEQ ID NO: 831750 - DNA, 21 bp, Homo sapiens
gagcccagtcgagacctcaca

SEQ ID NO: 831751 - DNA, 20 bp, Homo sapiens
gagcccagtgaagcctctga

SEQ ID NO: 831752 - DNA, 15 bp, Homo sapiens
gagcccagtgggctg

SEQ ID NO: 831753 - DNA, 20 bp, Homo sapiens
gagcccagtgggctgcacgc

SEQ ID NO: 831754 - DNA, 13 bp, Homo sapiens
gagcccatactca

SEQ ID NO: 831755 - DNA, 18 bp, Homo sapiens
gagcccatactcagcctg

SEQ ID NO: 831756 - DNA, 19 bp, Homo sapiens
gagcccatactcagcctgc

SEQ ID NO: 831757 - DNA, 18 bp, Homo sapiens
gagcccatgttctgcccc

SEQ ID NO: 831758 - DNA, 16 bp, Homo sapiens
gagcccattcttctgg

SEQ ID NO: 831759 - DNA, 17 bp, Homo sapiens
gagccccaagtcctgaa

SEQ ID NO: 831760 - DNA, 14 bp, Homo sapiens
gagccccacacgga

SEQ ID NO: 831761 - DNA, 13 bp, Homo sapiens
gagccccagctga

SEQ ID NO: 831762 - DNA, 18 bp, Homo sapiens
gagccccaggcctctgtg

SEQ ID NO: 831763 - DNA, 13 bp, Homo sapiens
gagccccagggtc

SEQ ID NO: 831764 - DNA, 16 bp, Homo sapiens
gagcccccacattctc

SEQ ID NO: 831765 - DNA, 22 bp, Homo sapiens
gagcccccaccggaactgggct

SEQ ID NO: 831766 - DNA, 13 bp, Homo sapiens
gagcccccagcag

SEQ ID NO: 831767 - DNA, 19 bp, Homo sapiens
gagcccccagcagaggcag

SEQ ID NO: 831768 - DNA, 18 bp, Homo sapiens
gagcccccagccctggga

SEQ ID NO: 831769 - DNA, 13 bp, Homo sapiens
gagcccccccaac

SEQ ID NO: 831770 - DNA, 17 bp, Homo sapiens
gagcccccgccccgccc

SEQ ID NO: 831771 - DNA, 14 bp, Homo sapiens
gagccccctctgcc

SEQ ID NO: 831772 - DNA, 15 bp, Homo sapiens
gagccccgccctctt

SEQ ID NO: 831773 - DNA, 17 bp, Homo sapiens
gagccccgccctcttcc

SEQ ID NO: 831774 - DNA, 18 bp, Homo sapiens
gagccccgccctcttcct

SEQ ID NO: 831775 - DNA, 15 bp, Homo sapiens
gagcccctccccagc

SEQ ID NO: 831776 - DNA, 17 bp, Homo sapiens
gagcccctccccagcca

SEQ ID NO: 831777 - DNA, 18 bp, Homo sapiens
gagcccctccccagccag

SEQ ID NO: 831778 - DNA, 15 bp, Homo sapiens
gagcccctcctccag

SEQ ID NO: 831779 - DNA, 17 bp, Homo sapiens
gagcccctcctccagcc

SEQ ID NO: 831780 - DNA, 15 bp, Homo sapiens
gagcccctcggctct

SEQ ID NO: 831781 - DNA, 14 bp, Homo sapiens
gagcccctggtcct

SEQ ID NO: 831782 - DNA, 14 bp, Homo sapiens
gagcccctggtctt

SEQ ID NO: 831783 - DNA, 23 bp, Homo sapiens
gagccccttcatccgcctgtggg

SEQ ID NO: 831784 - DNA, 11 bp, Homo sapiens
gagccccttcc

SEQ ID NO: 831785 - DNA, 22 bp, Homo sapiens
gagccccttctgctcagctctg

SEQ ID NO: 831786 - DNA, 22 bp, Homo sapiens
gagcccgatattctccctgacc

SEQ ID NO: 831787 - DNA, 20 bp, Homo sapiens
gagcccgcacccccaccctt

SEQ ID NO: 831788 - DNA, 22 bp, Homo sapiens
gagcccgcagggccatgcagac

SEQ ID NO: 831789 - DNA, 16 bp, Homo sapiens
gagcccgcttcaagct

SEQ ID NO: 831790 - DNA, 22 bp, Homo sapiens
gagcccgcttcaagctctctgt

SEQ ID NO: 831791 - DNA, 17 bp, Homo sapiens
gagcccggatgcttctc

SEQ ID NO: 831792 - DNA, 17 bp, Homo sapiens
gagcccggccccacctc

SEQ ID NO: 831793 - DNA, 13 bp, Homo sapiens
gagcccggccctc

SEQ ID NO: 831794 - DNA, 17 bp, Homo sapiens
gagcccggcgcccctgc

SEQ ID NO: 831795 - DNA, 16 bp, Homo sapiens
gagccctaaccccttc

SEQ ID NO: 831796 - DNA, 21 bp, Homo sapiens
gagccctaaccccttccagat

SEQ ID NO: 831797 - DNA, 18 bp, Homo sapiens
gagccctactccctgcag

SEQ ID NO: 831798 - DNA, 22 bp, Homo sapiens
gagccctactccctgcagatgc

SEQ ID NO: 831799 - DNA, 22 bp, Homo sapiens
gagccctcaggctccccagaac

SEQ ID NO: 831800 - DNA, 13 bp, Homo sapiens
gagccctccccca

SEQ ID NO: 831801 - DNA, 14 bp, Homo sapiens
gagccctctcactc

SEQ ID NO: 831802 - DNA, 18 bp, Homo sapiens
gagccctctgagccgcca

SEQ ID NO: 831803 - DNA, 18 bp, Homo sapiens
gagccctgaccttggctg

SEQ ID NO: 831804 - DNA, 12 bp, Homo sapiens
gagccctgactc

SEQ ID NO: 831805 - DNA, 17 bp, Homo sapiens
gagccctgactcctgga

SEQ ID NO: 831806 - DNA, 18 bp, Homo sapiens
gagccctgactcctggac

SEQ ID NO: 831807 - DNA, 13 bp, Homo sapiens
gagccctgaggac

SEQ ID NO: 831808 - DNA, 21 bp, Homo sapiens
gagccctgaggggctgggctg

SEQ ID NO: 831809 - DNA, 17 bp, Homo sapiens
gagccctgctgtgggag

SEQ ID NO: 831810 - DNA, 20 bp, Homo sapiens
gagccctggaccttgggcct

SEQ ID NO: 831811 - DNA, 22 bp, Homo sapiens
gagccctggaccttgggcctag

SEQ ID NO: 831812 - DNA, 15 bp, Homo sapiens
gagccctggctctgc

SEQ ID NO: 831813 - DNA, 22 bp, Homo sapiens
gagccctggctctgcccctcag

SEQ ID NO: 831814 - DNA, 23 bp, Homo sapiens
gagccctggctctgcccctcagg

SEQ ID NO: 831815 - DNA, 13 bp, Homo sapiens
gagccctggctgg

SEQ ID NO: 831816 - DNA, 18 bp, Homo sapiens
gagccctggctgggttca

SEQ ID NO: 831817 - DNA, 19 bp, Homo sapiens
gagccctggctgggttcag

SEQ ID NO: 831818 - DNA, 20 bp, Homo sapiens
gagccctgggttccggttgt

SEQ ID NO: 831819 - DNA, 17 bp, Homo sapiens
gagccctgtacccaccc

SEQ ID NO: 831820 - DNA, 20 bp, Homo sapiens
gagccctgtggccgccacct

SEQ ID NO: 831821 - DNA, 13 bp, Homo sapiens
gagcccttctctt

SEQ ID NO: 831822 - DNA, 16 bp, Homo sapiens
gagcccttgcctcccc

SEQ ID NO: 831823 - DNA, 15 bp, Homo sapiens
gagccgaagcccagg

SEQ ID NO: 831824 - DNA, 14 bp, Homo sapiens
gagccgacctaaaa

SEQ ID NO: 831825 - DNA, 19 bp, Homo sapiens
gagccgagatcacgccact

SEQ ID NO: 831826 - DNA, 20 bp, Homo sapiens
gagccgagatcacgccactg

SEQ ID NO: 831827 - DNA, 22 bp, Homo sapiens
gagccgccactcccgggccaag

SEQ ID NO: 831828 - DNA, 17 bp, Homo sapiens
gagccgcggggaagctg

SEQ ID NO: 831829 - DNA, 14 bp, Homo sapiens
gagccggcatcctt

SEQ ID NO: 831830 - DNA, 22 bp, Homo sapiens
gagccggccgccttctcccctc

SEQ ID NO: 831831 - DNA, 19 bp, Homo sapiens
gagccgggaccctcaggtg

SEQ ID NO: 831832 - DNA, 22 bp, Homo sapiens
gagccgggtctgcctcttctgg

SEQ ID NO: 831833 - DNA, 17 bp, Homo sapiens
gagccgtgaactgtgca

SEQ ID NO: 831834 - DNA, 16 bp, Homo sapiens
gagccgtggtccctga

SEQ ID NO: 831835 - DNA, 17 bp, Homo sapiens
gagccgtggtcctttgg

SEQ ID NO: 831836 - DNA, 16 bp, Homo sapiens
gagcctaatgaaaggg

SEQ ID NO: 831837 - DNA, 20 bp, Homo sapiens
gagcctagcggagcccagcc

SEQ ID NO: 831838 - DNA, 15 bp, Homo sapiens
gagcctagctcctgc

SEQ ID NO: 831839 - DNA, 18 bp, Homo sapiens
gagcctcagtctccctcc

SEQ ID NO: 831840 - DNA, 17 bp, Homo sapiens
gagcctcatccgaggca

SEQ ID NO: 831841 - DNA, 19 bp, Homo sapiens
gagcctcatccgaggcagg

SEQ ID NO: 831842 - DNA, 20 bp, Homo sapiens
gagcctcatccgaggcaggg

SEQ ID NO: 831843 - DNA, 21 bp, Homo sapiens
gagcctcatgttctcttccca

SEQ ID NO: 831844 - DNA, 11 bp, Homo sapiens
gagcctcccca

SEQ ID NO: 831845 - DNA, 15 bp, Homo sapiens
gagcctccccctcag

SEQ ID NO: 831846 - DNA, 21 bp, Homo sapiens
gagcctccctgcagccaccag

SEQ ID NO: 831847 - DNA, 13 bp, Homo sapiens
gagcctcctcagg

SEQ ID NO: 831848 - DNA, 15 bp, Homo sapiens
gagcctcctcagggg

SEQ ID NO: 831849 - DNA, 20 bp, Homo sapiens
gagctctgcgccaggcagag

SEQ ID NO: 831850 - DNA, 19 bp, Homo sapiens
gagctctggggacagcttc

SEQ ID NO: 831851 - DNA, 19 bp, Homo sapiens
gagctctggttatttttct

SEQ ID NO: 831852 - DNA, 17 bp, Homo sapiens
gagctctgtaacttaca

SEQ ID NO: 831853 - DNA, 21 bp, Homo sapiens
gagctcttcaagctgtcccct

SEQ ID NO: 831854 - DNA, 16 bp, Homo sapiens
gagctcttcaggcctc

SEQ ID NO: 831855 - DNA, 17 bp, Homo sapiens
gagctcttcaggcctcc

SEQ ID NO: 831856 - DNA, 21 bp, Homo sapiens
gagctcttcggtttctgagca

SEQ ID NO: 831857 - DNA, 22 bp, Homo sapiens
gagctcttcggtttctgagcat

SEQ ID NO: 831858 - DNA, 12 bp, Homo sapiens
gagctcttggaa

SEQ ID NO: 831859 - DNA, 13 bp, Homo sapiens
gagctcttggaag

SEQ ID NO: 831860 - DNA, 20 bp, Homo sapiens
gagctgaaaaatcacatcct

SEQ ID NO: 831861 - DNA, 22 bp, Homo sapiens
gagctgaaaaatcacatcctgg

SEQ ID NO: 831862 - DNA, 22 bp, Homo sapiens
gagctgaaaaggatcgaggcat

SEQ ID NO: 831863 - DNA, 23 bp, Homo sapiens
gagctgaaaaggatcgaggcatg

SEQ ID NO: 831864 - DNA, 22 bp, Homo sapiens
gagctgaacccattttgagtga

SEQ ID NO: 831865 - DNA, 18 bp, Homo sapiens
gagctgagaagaggagga

SEQ ID NO: 831866 - DNA, 10 bp, Homo sapiens
gagctgagat

SEQ ID NO: 831867 - DNA, 13 bp, Homo sapiens
gagctgagatgga

SEQ ID NO: 831868 - DNA, 13 bp, Homo sapiens
gagctgagctgga

SEQ ID NO: 831869 - DNA, 13 bp, Homo sapiens
gagctgagggagg

SEQ ID NO: 831870 - DNA, 17 bp, Homo sapiens
gagctgagggccctgtg

SEQ ID NO: 831871 - DNA, 23 bp, Homo sapiens
gagctgaggtttcacccttaacc

SEQ ID NO: 831872 - DNA, 20 bp, Homo sapiens
gagctgagtcacctcctcca

SEQ ID NO: 831873 - DNA, 15 bp, Homo sapiens
gagctgagtggccag

SEQ ID NO: 831874 - DNA, 13 bp, Homo sapiens
gagctgatccaga

SEQ ID NO: 831875 - DNA, 15 bp, Homo sapiens
gagctgatccagagc

SEQ ID NO: 831876 - DNA, 20 bp, Homo sapiens
gagctgatccagagcacaga

SEQ ID NO: 831877 - DNA, 15 bp, Homo sapiens
gagctgatttccagg

SEQ ID NO: 831878 - DNA, 17 bp, Homo sapiens
gagctgatttccaggcc

SEQ ID NO: 831879 - DNA, 15 bp, Homo sapiens
gagctgcacacacct

SEQ ID NO: 831880 - DNA, 14 bp, Homo sapiens
gagctgcagagcag

SEQ ID NO: 831881 - DNA, 21 bp, Homo sapiens
gagctgcagagcagcagcacc

SEQ ID NO: 831882 - DNA, 14 bp, Homo sapiens
gagctgcagccccc

SEQ ID NO: 831883 - DNA, 12 bp, Homo sapiens
gagctgccactg

SEQ ID NO: 831884 - DNA, 13 bp, Homo sapiens
gagctgccactgg

SEQ ID NO: 831885 - DNA, 16 bp, Homo sapiens
gagctgccactgggca

SEQ ID NO: 831886 - DNA, 17 bp, Homo sapiens
gagctgccactgggcac

SEQ ID NO: 831887 - DNA, 20 bp, Homo sapiens
gagctgcccggcgcctgccc

SEQ ID NO: 831888 - DNA, 19 bp, Homo sapiens
gagctgccgacttggagac

SEQ ID NO: 831889 - DNA, 14 bp, Homo sapiens
gagctgccgtgtgg

SEQ ID NO: 831890 - DNA, 11 bp, Homo sapiens
gagctgcctgc

SEQ ID NO: 831891 - DNA, 13 bp, Homo sapiens
gagctgcctgcag

SEQ ID NO: 831892 - DNA, 17 bp, Homo sapiens
gagctgcctgcagcaca

SEQ ID NO: 831893 - DNA, 12 bp, Homo sapiens
gagctgcctggc

SEQ ID NO: 831894 - DNA, 15 bp, Homo sapiens
gagctgccttggctc

SEQ ID NO: 831895 - DNA, 22 bp, Homo sapiens
gagctgccttggctcagacatg

SEQ ID NO: 831896 - DNA, 21 bp, Homo sapiens
gagctgctatagcctggggtg

SEQ ID NO: 831897 - DNA, 18 bp, Homo sapiens
gagctgctcaccggagtc

SEQ ID NO: 831898 - DNA, 20 bp, Homo sapiens
gagctgctggctgacctggg

SEQ ID NO: 831899 - DNA, 22 bp, Homo sapiens
gagctgctggctgacctgggcc

SEQ ID NO: 831900 - DNA, 21 bp, Homo sapiens
gagctgctggcttgcagtgcg

SEQ ID NO: 831901 - DNA, 12 bp, Homo sapiens
gagctgctgtcc

SEQ ID NO: 831902 - DNA, 16 bp, Homo sapiens
gagctggaaggcaggg

SEQ ID NO: 831903 - DNA, 19 bp, Homo sapiens
gagctggaaggcagggcag

SEQ ID NO: 831904 - DNA, 20 bp, Homo sapiens
gagctggaaggcagggcaga

SEQ ID NO: 831905 - DNA, 13 bp, Homo sapiens
gagctggaagggg

SEQ ID NO: 831906 - DNA, 15 bp, Homo sapiens
gagctggaaggggcc

SEQ ID NO: 831907 - DNA, 13 bp, Homo sapiens
gagctggagcccc

SEQ ID NO: 831908 - DNA, 19 bp, Homo sapiens
gagctggatagacttggga

SEQ ID NO: 831909 - DNA, 18 bp, Homo sapiens
gagctggccaaagagcct

SEQ ID NO: 831910 - DNA, 20 bp, Homo sapiens
gagctggccaaagagccttt

SEQ ID NO: 831911 - DNA, 16 bp, Homo sapiens
gagctggccccgccgc

SEQ ID NO: 831912 - DNA, 17 bp, Homo sapiens
gagctggcctcccccaa

SEQ ID NO: 831913 - DNA, 12 bp, Homo sapiens
gagctggcctgt

SEQ ID NO: 831914 - DNA, 16 bp, Homo sapiens
gagctggcgtctgtct

SEQ ID NO: 831915 - DNA, 13 bp, Homo sapiens
gagctggctctga

SEQ ID NO: 831916 - DNA, 14 bp, Homo sapiens
gagctgggagccag

SEQ ID NO: 831917 - DNA, 17 bp, Homo sapiens
gagctgggaggcatggc

SEQ ID NO: 831918 - DNA, 18 bp, Homo sapiens
gagctgggaggcatggcc

SEQ ID NO: 831919 - DNA, 16 bp, Homo sapiens
gagctgggcccagccc

SEQ ID NO: 831920 - DNA, 17 bp, Homo sapiens
gagctgggcccagcccc

SEQ ID NO: 831921 - DNA, 18 bp, Homo sapiens
gagctgggcccagcccct

SEQ ID NO: 831922 - DNA, 13 bp, Homo sapiens
gagctgggcccct

SEQ ID NO: 831923 - DNA, 15 bp, Homo sapiens
gagctggggacctgg

SEQ ID NO: 831924 - DNA, 16 bp, Homo sapiens
gagctggggactcagg

SEQ ID NO: 831925 - DNA, 17 bp, Homo sapiens
gagctggggactcaggg

SEQ ID NO: 831926 - DNA, 12 bp, Homo sapiens
gagctggggagg

SEQ ID NO: 831927 - DNA, 18 bp, Homo sapiens
gagctggggaggtgggag

SEQ ID NO: 831928 - DNA, 20 bp, Homo sapiens
gagctggggaggtgggaggc

SEQ ID NO: 831929 - DNA, 19 bp, Homo sapiens
gagctgggggccatgagct

SEQ ID NO: 831930 - DNA, 15 bp, Homo sapiens
gagctggggtacagg

SEQ ID NO: 831931 - DNA, 16 bp, Homo sapiens
gagctggggtctgggc

SEQ ID NO: 831932 - DNA, 21 bp, Homo sapiens
gagctggggtctgggcagtgc

SEQ ID NO: 831933 - DNA, 23 bp, Homo sapiens
gagctggggtctgggcagtgcca

SEQ ID NO: 831934 - DNA, 18 bp, Homo sapiens
gagctggtgacagccttg

SEQ ID NO: 831935 - DNA, 14 bp, Homo sapiens
gagctggtgacttt

SEQ ID NO: 831936 - DNA, 11 bp, Homo sapiens
gagctggtgca

SEQ ID NO: 831937 - DNA, 18 bp, Homo sapiens
gagctggtgcattacaga

SEQ ID NO: 831938 - DNA, 15 bp, Homo sapiens
gagctggtgcccgga

SEQ ID NO: 831939 - DNA, 16 bp, Homo sapiens
gagctggtgcccggag

SEQ ID NO: 831940 - DNA, 15 bp, Homo sapiens
gagctggtggtttga

SEQ ID NO: 831941 - DNA, 22 bp, Homo sapiens
gagctggtggtttgatcatttc

SEQ ID NO: 831942 - DNA, 21 bp, Homo sapiens
gagctgtatcttgatgtttag

SEQ ID NO: 831943 - DNA, 18 bp, Homo sapiens
gagctgtattaagtgact

SEQ ID NO: 831944 - DNA, 17 bp, Homo sapiens
gagctgtcaccaaggaa

SEQ ID NO: 831945 - DNA, 19 bp, Homo sapiens
gagctgtcaccaaggaaac

SEQ ID NO: 831946 - DNA, 16 bp, Homo sapiens
gagctgtctgctgccg

SEQ ID NO: 831947 - DNA, 17 bp, Homo sapiens
gagctgtcttcccctga

SEQ ID NO: 831948 - DNA, 20 bp, Homo sapiens
gagctgtgagttctccctgt

SEQ ID NO: 831949 - DNA, 13 bp, Homo sapiens
gagctgtgccagc

SEQ ID NO: 831950 - DNA, 15 bp, Homo sapiens
gagctgtgccagcag

SEQ ID NO: 831951 - DNA, 21 bp, Homo sapiens
gagctgtgcctgctcagcagc

SEQ ID NO: 831952 - DNA, 15 bp, Homo sapiens
gagctgtgcgctgct

SEQ ID NO: 831953 - DNA, 17 bp, Homo sapiens
gagctgtgcgctgctct

SEQ ID NO: 831954 - DNA, 19 bp, Homo sapiens
gagctgttcgctcctccca

SEQ ID NO: 831955 - DNA, 16 bp, Homo sapiens
gagctgttgcctcagt

SEQ ID NO: 831956 - DNA, 18 bp, Homo sapiens
gagctgtttatggcctca

SEQ ID NO: 831957 - DNA, 22 bp, Homo sapiens
gagctgtttggatacagctgct

SEQ ID NO: 831958 - DNA, 17 bp, Homo sapiens
gagcttaagccactgcc

SEQ ID NO: 831959 - DNA, 22 bp, Homo sapiens
gagcttaagccactgcctctcc

SEQ ID NO: 831960 - DNA, 13 bp, Homo sapiens
gagcttacccaag

SEQ ID NO: 831961 - DNA, 15 bp, Homo sapiens
gagcttacccaagct

SEQ ID NO: 831962 - DNA, 16 bp, Homo sapiens
gagcttacccaagctg

SEQ ID NO: 831963 - DNA, 17 bp, Homo sapiens
gagcttagccttgtgcc

SEQ ID NO: 831964 - DNA, 21 bp, Homo sapiens
gagcttagccttgtgccctgc

SEQ ID NO: 831965 - DNA, 15 bp, Homo sapiens
gagcttattggccac

SEQ ID NO: 831966 - DNA, 17 bp, Homo sapiens
gagcttattggccactg

SEQ ID NO: 831967 - DNA, 14 bp, Homo sapiens
gagcttccaaatgt

SEQ ID NO: 831968 - DNA, 22 bp, Homo sapiens
gagcttcccttcctaaaggtaa

SEQ ID NO: 831969 - DNA, 16 bp, Homo sapiens
gagcttcggggcctcc

SEQ ID NO: 831970 - DNA, 20 bp, Homo sapiens
gagcttcggttctccagaat

SEQ ID NO: 831971 - DNA, 14 bp, Homo sapiens
gagcttctggcact

SEQ ID NO: 831972 - DNA, 13 bp, Homo sapiens
gaggccaaggcag

SEQ ID NO: 831973 - DNA, 17 bp, Homo sapiens
gaggccaaggtgggagg

SEQ ID NO: 831974 - DNA, 22 bp, Homo sapiens
gaggccaaggtgggaggattgc

SEQ ID NO: 831975 - DNA, 18 bp, Homo sapiens
gaggccaaggtgggcgga

SEQ ID NO: 831976 - DNA, 12 bp, Homo sapiens
gaggccaataaa

SEQ ID NO: 831977 - DNA, 13 bp, Homo sapiens
gaggccaataaaa

SEQ ID NO: 831978 - DNA, 20 bp, Homo sapiens
gaggccaataaaaagttcag

SEQ ID NO: 831979 - DNA, 14 bp, Homo sapiens
gaggccaccccaaa

SEQ ID NO: 831980 - DNA, 21 bp, Homo sapiens
gaggccaccccaaaccccagc

SEQ ID NO: 831981 - DNA, 10 bp, Homo sapiens
gaggccacct

SEQ ID NO: 831982 - DNA, 18 bp, Homo sapiens
gaggccacctctccaagg

SEQ ID NO: 831983 - DNA, 19 bp, Homo sapiens
gaggccacgtcccacccca

SEQ ID NO: 831984 - DNA, 17 bp, Homo sapiens
gaggccactcagaggcc

SEQ ID NO: 831985 - DNA, 18 bp, Homo sapiens
gaggccactcagaggccc

SEQ ID NO: 831986 - DNA, 20 bp, Homo sapiens
gaggccactcagaggccccc

SEQ ID NO: 831987 - DNA, 21 bp, Homo sapiens
gaggccagaggcccccagccc

SEQ ID NO: 831988 - DNA, 22 bp, Homo sapiens
gaggccagagtcaccttttctg

SEQ ID NO: 831989 - DNA, 14 bp, Homo sapiens
gaggccagccccac

SEQ ID NO: 831990 - DNA, 18 bp, Homo sapiens
gaggccagccccacccag

SEQ ID NO: 831991 - DNA, 21 bp, Homo sapiens
gaggccagccccacccaggag

SEQ ID NO: 831992 - DNA, 13 bp, Homo sapiens
gaggccagggata

SEQ ID NO: 831993 - DNA, 17 bp, Homo sapiens
gaggccatcagggccct

SEQ ID NO: 831994 - DNA, 21 bp, Homo sapiens
gaggccatcagggccctgccc

SEQ ID NO: 831995 - DNA, 17 bp, Homo sapiens
gaggccatccaagatgg

SEQ ID NO: 831996 - DNA, 17 bp, Homo sapiens
gaggccatctcaggaga

SEQ ID NO: 831997 - DNA, 13 bp, Homo sapiens
gaggcccaaatga

SEQ ID NO: 831998 - DNA, 18 bp, Homo sapiens
gaggcccactagagggcc

SEQ ID NO: 831999 - DNA, 21 bp, Homo sapiens
gaggcccactagagggcccat

SEQ ID NO: 832000 - DNA, 15 bp, Homo sapiens
gaggcccagccgcag

SEQ ID NO: 832001 - DNA, 16 bp, Homo sapiens
gaggcccagcctgtcc

SEQ ID NO: 832002 - DNA, 18 bp, Homo sapiens
gaggcccagcctgtcctg

SEQ ID NO: 832003 - DNA, 17 bp, Homo sapiens
gaggcccaggcaccacc

SEQ ID NO: 832004 - DNA, 16 bp, Homo sapiens
gaggcccaggctggga

SEQ ID NO: 832005 - DNA, 17 bp, Homo sapiens
gaggcccaggctgggaa

SEQ ID NO: 832006 - DNA, 16 bp, Homo sapiens
gaggcccccagcccag

SEQ ID NO: 832007 - DNA, 21 bp, Homo sapiens
gaggcccccagtggggacagg

SEQ ID NO: 832008 - DNA, 22 bp, Homo sapiens
gaggcccctatgtagtccgtgc

SEQ ID NO: 832009 - DNA, 13 bp, Homo sapiens
gaggcccctggac

SEQ ID NO: 832010 - DNA, 19 bp, Homo sapiens
gaggccctcctgtgctggg

SEQ ID NO: 832011 - DNA, 17 bp, Homo sapiens
gaggccctcgctgccag

SEQ ID NO: 832012 - DNA, 17 bp, Homo sapiens
gaggccctctggagtgg

SEQ ID NO: 832013 - DNA, 19 bp, Homo sapiens
gaggccctctggagtggcc

SEQ ID NO: 832014 - DNA, 16 bp, Homo sapiens
gaggccctgaagcctc

SEQ ID NO: 832015 - DNA, 17 bp, Homo sapiens
gaggccctgcctgaccc

SEQ ID NO: 832016 - DNA, 18 bp, Homo sapiens
gaggccctgggctgggtg

SEQ ID NO: 832017 - DNA, 20 bp, Homo sapiens
gaggccctggtgtcaggcag

SEQ ID NO: 832018 - DNA, 18 bp, Homo sapiens
gaggccctgttccctgga

SEQ ID NO: 832019 - DNA, 18 bp, Homo sapiens
gaggcccttgtcgtggga

SEQ ID NO: 832020 - DNA, 21 bp, Homo sapiens
gaggcccttgtcgtgggatgg

SEQ ID NO: 832021 - DNA, 15 bp, Homo sapiens
gaggccgaggcagga

SEQ ID NO: 832022 - DNA, 17 bp, Homo sapiens
gaggccggagagctggt

SEQ ID NO: 832023 - DNA, 15 bp, Homo sapiens
gaggccgtgcagtgg

SEQ ID NO: 832024 - DNA, 19 bp, Homo sapiens
gaggcctaaaagtaaacat

SEQ ID NO: 832025 - DNA, 16 bp, Homo sapiens
gaggcctatgcagaca

SEQ ID NO: 832026 - DNA, 12 bp, Homo sapiens
gaggcctcaggt

SEQ ID NO: 832027 - DNA, 16 bp, Homo sapiens
gaggcctcaggtgctg

SEQ ID NO: 832028 - DNA, 23 bp, Homo sapiens
gaggcctcagtttctccatcagc

SEQ ID NO: 832029 - DNA, 15 bp, Homo sapiens
gaggcctcatccctc

SEQ ID NO: 832030 - DNA, 18 bp, Homo sapiens
gaggcctctggaaagcaa

SEQ ID NO: 832031 - DNA, 17 bp, Homo sapiens
gaggcctctggccctcg

SEQ ID NO: 832032 - DNA, 18 bp, Homo sapiens
gaggcctcttggacctct

SEQ ID NO: 832033 - DNA, 9 bp, Homo sapiens
gaggcctga

SEQ ID NO: 832034 - DNA, 22 bp, Homo sapiens
gaggcctgaggatgagctggaa

SEQ ID NO: 832035 - DNA, 22 bp, Homo sapiens
gaggcctgcaaaccttcctggg

SEQ ID NO: 832036 - DNA, 23 bp, Homo sapiens
gaggcctgcaaaccttcctggga

SEQ ID NO: 832037 - DNA, 16 bp, Homo sapiens
gaggcctgccccctgg

SEQ ID NO: 832038 - DNA, 19 bp, Homo sapiens
gaggcctgccccctgggct

SEQ ID NO: 832039 - DNA, 20 bp, Homo sapiens
gaggcctgccctcagggatc

SEQ ID NO: 832040 - DNA, 20 bp, Homo sapiens
gaggcctgctgccagtgcag

SEQ ID NO: 832041 - DNA, 21 bp, Homo sapiens
gaggcctgctgccagtgcagc

SEQ ID NO: 832042 - DNA, 21 bp, Homo sapiens
gaggcctggaccgagatgtga

SEQ ID NO: 832043 - DNA, 20 bp, Homo sapiens
gaggcctggagcccacaacc

SEQ ID NO: 832044 - DNA, 16 bp, Homo sapiens
gaggcctggccaggca

SEQ ID NO: 832045 - DNA, 13 bp, Homo sapiens
gaggcctgggctg

SEQ ID NO: 832046 - DNA, 17 bp, Homo sapiens
gaggcctgggctgggaa

SEQ ID NO: 832047 - DNA, 16 bp, Homo sapiens
gaggcctggggtggga

SEQ ID NO: 832048 - DNA, 18 bp, Homo sapiens
gaggccttatcattcatt

SEQ ID NO: 832049 - DNA, 20 bp, Homo sapiens
gaggccttatcattcattct

SEQ ID NO: 832050 - DNA, 17 bp, Homo sapiens
gaggccttccagctgct

SEQ ID NO: 832051 - DNA, 20 bp, Homo sapiens
gaggccttccagctgctgtc

SEQ ID NO: 832052 - DNA, 15 bp, Homo sapiens
gaggcgcagggacat

SEQ ID NO: 832053 - DNA, 17 bp, Homo sapiens
gaggcgcagggacatgg

SEQ ID NO: 832054 - DNA, 20 bp, Homo sapiens
gaggcgcagggacatggggc

SEQ ID NO: 832055 - DNA, 14 bp, Homo sapiens
gaggcgcggagtga

SEQ ID NO: 832056 - DNA, 13 bp, Homo sapiens
gaggcgctgctgg

SEQ ID NO: 832057 - DNA, 20 bp, Homo sapiens
gaggcggagcttgcagtgag

SEQ ID NO: 832058 - DNA, 19 bp, Homo sapiens
gaggcggtggtagagagag

SEQ ID NO: 832059 - DNA, 17 bp, Homo sapiens
gaggcgtggaggagagg

SEQ ID NO: 832060 - DNA, 14 bp, Homo sapiens
gaggcgtgtgcagg

SEQ ID NO: 832061 - DNA, 17 bp, Homo sapiens
gaggcgttctcctgctt

SEQ ID NO: 832062 - DNA, 20 bp, Homo sapiens
gaggctattattttcactgt

SEQ ID NO: 832063 - DNA, 18 bp, Homo sapiens
gaggctcagcccaccctc

SEQ ID NO: 832064 - DNA, 21 bp, Homo sapiens
gaggctcaggtgatctgtttg

SEQ ID NO: 832065 - DNA, 16 bp, Homo sapiens
gaggctcatcctgtag

SEQ ID NO: 832066 - DNA, 14 bp, Homo sapiens
gaggctccagaggg

SEQ ID NO: 832067 - DNA, 20 bp, Homo sapiens
gaggctccccgcctccactc

SEQ ID NO: 832068 - DNA, 19 bp, Homo sapiens
gaggctccggcccacaggt

SEQ ID NO: 832069 - DNA, 14 bp, Homo sapiens
gaggctctggacag

SEQ ID NO: 832070 - DNA, 22 bp, Homo sapiens
gaggctctggacagcagaagcc

SEQ ID NO: 832071 - DNA, 20 bp, Homo sapiens
gaggctgaaagaggccaatg

SEQ ID NO: 832072 - DNA, 15 bp, Homo sapiens
gaggctgacacagcc

SEQ ID NO: 832073 - DNA, 16 bp, Homo sapiens
gaggctgagacaggag

SEQ ID NO: 832074 - DNA, 12 bp, Homo sapiens
gaggctgagccc

SEQ ID NO: 832075 - DNA, 14 bp, Homo sapiens
gaggctgagccctg

SEQ ID NO: 832076 - DNA, 13 bp, Homo sapiens
gaggctgaggcac

SEQ ID NO: 832077 - DNA, 14 bp, Homo sapiens
gaggctgaggcaga

SEQ ID NO: 832078 - DNA, 15 bp, Homo sapiens
gaggctgaggcagga

SEQ ID NO: 832079 - DNA, 17 bp, Homo sapiens
gaggctgaggcaggagg

SEQ ID NO: 832080 - DNA, 19 bp, Homo sapiens
gaggctgaggcctggactt

SEQ ID NO: 832081 - DNA, 16 bp, Homo sapiens
gaggctgaggctggca

SEQ ID NO: 832082 - DNA, 16 bp, Homo sapiens
gaggctgcacccctgg

SEQ ID NO: 832083 - DNA, 21 bp, Homo sapiens
gaggctgcacccctgggccag

SEQ ID NO: 832084 - DNA, 16 bp, Homo sapiens
gaggctgcagcaggtg

SEQ ID NO: 832085 - DNA, 11 bp, Homo sapiens
gaggctgcccc

SEQ ID NO: 832086 - DNA, 18 bp, Homo sapiens
gaggctgccccaggccgg

SEQ ID NO: 832087 - DNA, 22 bp, Homo sapiens
gaggctgccccaggccggagcc

SEQ ID NO: 832088 - DNA, 23 bp, Homo sapiens
gaggctgccccaggccggagccc

SEQ ID NO: 832089 - DNA, 13 bp, Homo sapiens
gaggctgccccca

SEQ ID NO: 832090 - DNA, 14 bp, Homo sapiens
gaggctgcccctct

SEQ ID NO: 832091 - DNA, 18 bp, Homo sapiens
gaggctgcccctctcacc

SEQ ID NO: 832092 - DNA, 18 bp, Homo sapiens
gaggctgccctgaggggc

SEQ ID NO: 832093 - DNA, 24 bp, Homo sapiens
gaggctgcctcagccagtggcaca

SEQ ID NO: 832094 - DNA, 18 bp, Homo sapiens
gagggtatgaagagctgt

SEQ ID NO: 832095 - DNA, 23 bp, Homo sapiens
gagggtcacgcttgcctggtcac

SEQ ID NO: 832096 - DNA, 20 bp, Homo sapiens
gagggtccaatcctaggaca

SEQ ID NO: 832097 - DNA, 13 bp, Homo sapiens
gagggtcccaggg

SEQ ID NO: 832098 - DNA, 14 bp, Homo sapiens
gagggtcccagggc

SEQ ID NO: 832099 - DNA, 15 bp, Homo sapiens
gagggtcccagggct

SEQ ID NO: 832100 - DNA, 16 bp, Homo sapiens
gagggtcccagggctg

SEQ ID NO: 832101 - DNA, 18 bp, Homo sapiens
gagggtcccagggctgca

SEQ ID NO: 832102 - DNA, 22 bp, Homo sapiens
gagggtcccggtgtatcctggc

SEQ ID NO: 832103 - DNA, 15 bp, Homo sapiens
gagggtcctggctcc

SEQ ID NO: 832104 - DNA, 17 bp, Homo sapiens
gagggtcctggctcctg

SEQ ID NO: 832105 - DNA, 21 bp, Homo sapiens
gagggtcctggctcctgaggg

SEQ ID NO: 832106 - DNA, 20 bp, Homo sapiens
gagggtctcccctcctgcac

SEQ ID NO: 832107 - DNA, 13 bp, Homo sapiens
gagggtctggggg

SEQ ID NO: 832108 - DNA, 17 bp, Homo sapiens
gagggtctgggggcagc

SEQ ID NO: 832109 - DNA, 21 bp, Homo sapiens
gagggtcttgaggggaagctg

SEQ ID NO: 832110 - DNA, 22 bp, Homo sapiens
gagggtcttttaccctgtgtca

SEQ ID NO: 832111 - DNA, 20 bp, Homo sapiens
gagggtgaaggaggtcaggc

SEQ ID NO: 832112 - DNA, 21 bp, Homo sapiens
gagggtgaagtgaagacaatg

SEQ ID NO: 832113 - DNA, 19 bp, Homo sapiens
gagggtgacgcccagctcc

SEQ ID NO: 832114 - DNA, 11 bp, Homo sapiens
gagggtgactg

SEQ ID NO: 832115 - DNA, 23 bp, Homo sapiens
gagggtgccgtgtcccctgacag

SEQ ID NO: 832116 - DNA, 14 bp, Homo sapiens
gagggtgggccagc

SEQ ID NO: 832117 - DNA, 19 bp, Homo sapiens
gagggtgggggccacctgc

SEQ ID NO: 832118 - DNA, 15 bp, Homo sapiens
gagggttagggaggg

SEQ ID NO: 832119 - DNA, 24 bp, Homo sapiens
gagggttcctcttaggtcagatgg

SEQ ID NO: 832120 - DNA, 13 bp, Homo sapiens
gagggtttctgat

SEQ ID NO: 832121 - DNA, 13 bp, Homo sapiens
gaggtaactgagg

SEQ ID NO: 832122 - DNA, 15 bp, Homo sapiens
gaggtactgagacag

SEQ ID NO: 832123 - DNA, 14 bp, Homo sapiens
gaggtactggtccc

SEQ ID NO: 832124 - DNA, 23 bp, Homo sapiens
gaggtagaaggggaggacactgg

SEQ ID NO: 832125 - DNA, 14 bp, Homo sapiens
gaggtagagagggg

SEQ ID NO: 832126 - DNA, 14 bp, Homo sapiens
gaggtagcgagctg

SEQ ID NO: 832127 - DNA, 13 bp, Homo sapiens
gaggtaggctgtg

SEQ ID NO: 832128 - DNA, 20 bp, Homo sapiens
gaggtatggccatgccctag

SEQ ID NO: 832129 - DNA, 21 bp, Homo sapiens
gaggtcaaatcccaaaccatt

SEQ ID NO: 832130 - DNA, 23 bp, Homo sapiens
gaggtcaacagagaaggcaggaa

SEQ ID NO: 832131 - DNA, 19 bp, Homo sapiens
gaggtcacattcaggaaga

SEQ ID NO: 832132 - DNA, 21 bp, Homo sapiens
gaggtcacattcaggaagatg

SEQ ID NO: 832133 - DNA, 21 bp, Homo sapiens
gaggtcactccaccatcccca

SEQ ID NO: 832134 - DNA, 16 bp, Homo sapiens
gaggtcactggaaagg

SEQ ID NO: 832135 - DNA, 18 bp, Homo sapiens
gaggtcactggaaagggg

SEQ ID NO: 832136 - DNA, 20 bp, Homo sapiens
gaggtcactggaaaggggag

SEQ ID NO: 832137 - DNA, 21 bp, Homo sapiens
gaggtcactggaaaggggaga

SEQ ID NO: 832138 - DNA, 14 bp, Homo sapiens
gaggtcagggagtg

SEQ ID NO: 832139 - DNA, 13 bp, Homo sapiens
gaggtccagccca

SEQ ID NO: 832140 - DNA, 14 bp, Homo sapiens
gaggtccagcccat

SEQ ID NO: 832141 - DNA, 12 bp, Homo sapiens
gaggtcccaggc

SEQ ID NO: 832142 - DNA, 14 bp, Homo sapiens
gaggtcccaggcag

SEQ ID NO: 832143 - DNA, 21 bp, Homo sapiens
gaggtcccttcaaggcctccc

SEQ ID NO: 832144 - DNA, 16 bp, Homo sapiens
gaggtcctcaggtcag

SEQ ID NO: 832145 - DNA, 19 bp, Homo sapiens
gaggtccttaggcctctga

SEQ ID NO: 832146 - DNA, 21 bp, Homo sapiens
gaggtccttaggcctctgaga

SEQ ID NO: 832147 - DNA, 22 bp, Homo sapiens
gaggtcgaccccaaagcccctt

SEQ ID NO: 832148 - DNA, 14 bp, Homo sapiens
gaggtctgagccct

SEQ ID NO: 832149 - DNA, 20 bp, Homo sapiens
gaggtctgagccctggtgtg

SEQ ID NO: 832150 - DNA, 13 bp, Homo sapiens
gaggtctgtgctg

SEQ ID NO: 832151 - DNA, 16 bp, Homo sapiens
gaggtctgtgctgagg

SEQ ID NO: 832152 - DNA, 13 bp, Homo sapiens
gaggtctttctcc

SEQ ID NO: 832153 - DNA, 18 bp, Homo sapiens
gaggtcttttgacatgtg

SEQ ID NO: 832154 - DNA, 17 bp, Homo sapiens
gaggtgaaagcataaca

SEQ ID NO: 832155 - DNA, 14 bp, Homo sapiens
gaggtgagaaaact

SEQ ID NO: 832156 - DNA, 17 bp, Homo sapiens
gaggtgagaactcagaa

SEQ ID NO: 832157 - DNA, 17 bp, Homo sapiens
gaggtgaggattccaaa

SEQ ID NO: 832158 - DNA, 19 bp, Homo sapiens
gaggtgcaagacctagtcc

SEQ ID NO: 832159 - DNA, 21 bp, Homo sapiens
gaggtgcaagacctagtcccc

SEQ ID NO: 832160 - DNA, 13 bp, Homo sapiens
gaggtgccagcaa

SEQ ID NO: 832161 - DNA, 22 bp, Homo sapiens
gaggtgccagcaactgaataaa

SEQ ID NO: 832162 - DNA, 21 bp, Homo sapiens
gaggtgcctgtcccaccccca

SEQ ID NO: 832163 - DNA, 21 bp, Homo sapiens
gaggtgctgggggagccctgg

SEQ ID NO: 832164 - DNA, 22 bp, Homo sapiens
gaggtgcttaagcagaagcatt

SEQ ID NO: 832165 - DNA, 15 bp, Homo sapiens
gaggtggaagccctc

SEQ ID NO: 832166 - DNA, 19 bp, Homo sapiens
gaggtggaggttgcagtga

SEQ ID NO: 832167 - DNA, 20 bp, Homo sapiens
gaggtggaggttgcagtgag

SEQ ID NO: 832168 - DNA, 18 bp, Homo sapiens
gaggtggcagccctgtag

SEQ ID NO: 832169 - DNA, 13 bp, Homo sapiens
gaggtggccaccg

SEQ ID NO: 832170 - DNA, 22 bp, Homo sapiens
gaggtggccaccgggggtggct

SEQ ID NO: 832171 - DNA, 19 bp, Homo sapiens
gaggtggccagagctggga

SEQ ID NO: 832172 - DNA, 20 bp, Homo sapiens
gaggtggctgagcccctgtc

SEQ ID NO: 832173 - DNA, 20 bp, Homo sapiens
gaggtggctgcgcccccagc

SEQ ID NO: 832174 - DNA, 14 bp, Homo sapiens
gaggtggcttcatg

SEQ ID NO: 832175 - DNA, 14 bp, Homo sapiens
gaggtgggcagctg

SEQ ID NO: 832176 - DNA, 16 bp, Homo sapiens
gaggtgggcagctggg

SEQ ID NO: 832177 - DNA, 17 bp, Homo sapiens
gaggtgggcagctgggc

SEQ ID NO: 832178 - DNA, 17 bp, Homo sapiens
gaggtgggccacaccca

SEQ ID NO: 832179 - DNA, 23 bp, Homo sapiens
gaggtgggccacacccaggaagg

SEQ ID NO: 832180 - DNA, 21 bp, Homo sapiens
gaggtgggccagtctgtggat

SEQ ID NO: 832181 - DNA, 15 bp, Homo sapiens
gaggtgggcccagga

SEQ ID NO: 832182 - DNA, 21 bp, Homo sapiens
gaggtgggctggggctgctcc

SEQ ID NO: 832183 - DNA, 24 bp, Homo sapiens
gaggtgggctggggctgctcccct

SEQ ID NO: 832184 - DNA, 14 bp, Homo sapiens
gaggtggggcctca

SEQ ID NO: 832185 - DNA, 23 bp, Homo sapiens
gaggtgggggcctcctcagcctc

SEQ ID NO: 832186 - DNA, 17 bp, Homo sapiens
gaggtgggtgggcctga

SEQ ID NO: 832187 - DNA, 20 bp, Homo sapiens
gaggtgggtgggcctgactg

SEQ ID NO: 832188 - DNA, 18 bp, Homo sapiens
gaggtgtcaccctgcaga

SEQ ID NO: 832189 - DNA, 16 bp, Homo sapiens
gaggtgtgggggctgc

SEQ ID NO: 832190 - DNA, 20 bp, Homo sapiens
gaggtgtgggtgtctgtttg

SEQ ID NO: 832191 - DNA, 16 bp, Homo sapiens
gaggtgttacagagga

SEQ ID NO: 832192 - DNA, 18 bp, Homo sapiens
gaggttaaagaagctgca

SEQ ID NO: 832193 - DNA, 19 bp, Homo sapiens
gaggttaaagaagctgcat

SEQ ID NO: 832194 - DNA, 22 bp, Homo sapiens
gaggttataggtcactcctggg

SEQ ID NO: 832195 - DNA, 14 bp, Homo sapiens
gaggttatctgcct

SEQ ID NO: 832196 - DNA, 15 bp, Homo sapiens
gaggttatctgcctg

SEQ ID NO: 832197 - DNA, 16 bp, Homo sapiens
gaggttcctctgcctg

SEQ ID NO: 832198 - DNA, 14 bp, Homo sapiens
gaggttctgggcct

SEQ ID NO: 832199 - DNA, 18 bp, Homo sapiens
gaggttgaaaaacaaaat

SEQ ID NO: 832200 - DNA, 13 bp, Homo sapiens
gaggttgcaggga

SEQ ID NO: 832201 - DNA, 19 bp, Homo sapiens
gaggttgcagggagccgag

SEQ ID NO: 832202 - DNA, 13 bp, Homo sapiens
gaggttgcagtgt

SEQ ID NO: 832203 - DNA, 12 bp, Homo sapiens
gaggttgggagg

SEQ ID NO: 832204 - DNA, 17 bp, Homo sapiens
gaggttgggggaaccag

SEQ ID NO: 832205 - DNA, 14 bp, Homo sapiens
gaggttggtgactg

SEQ ID NO: 832206 - DNA, 23 bp, Homo sapiens
gaggttggttccttggggggcca

SEQ ID NO: 832207 - DNA, 13 bp, Homo sapiens
gaggttgtgggga

SEQ ID NO: 832208 - DNA, 21 bp, Homo sapiens
gaggtttcacccttaacccaa

SEQ ID NO: 832209 - DNA, 15 bp, Homo sapiens
gaggttttaaagtga

SEQ ID NO: 832210 - DNA, 23 bp, Homo sapiens
gaggttttattctgacttcctct

SEQ ID NO: 832211 - DNA, 23 bp, Homo sapiens
gaggtttttttgtcaacattgtg

SEQ ID NO: 832212 - DNA, 15 bp, Homo sapiens
gagtaaaaactagaa

SEQ ID NO: 832213 - DNA, 15 bp, Homo sapiens
gagtaaaccatgtat

SEQ ID NO: 832214 - DNA, 14 bp, Homo sapiens
gagtaaacttgaaa

SEQ ID NO: 832215 - DNA, 10 bp, Homo sapiens
gagtaaagct

SEQ ID NO: 832216 - DNA, 21 bp, Homo sapiens
gagtaacaatacaaatggatt

SEQ ID NO: 832217 - DNA, 15 bp, Homo sapiens
gagtaacagggcaga

SEQ ID NO: 832218 - DNA, 15 bp, Homo sapiens
gagtaacatttgctg

SEQ ID NO: 832219 - DNA, 16 bp, Homo sapiens
gagtaacatttgctgt

SEQ ID NO: 832220 - DNA, 19 bp, Homo sapiens
gagtaactggttgctgtgt

SEQ ID NO: 832221 - DNA, 12 bp, Homo sapiens
gagtaagagctg

SEQ ID NO: 832222 - DNA, 14 bp, Homo sapiens
gagtaagtgtacaa

SEQ ID NO: 832223 - DNA, 23 bp, Homo sapiens
gagtaatcaatacagacaaggtt

SEQ ID NO: 832224 - DNA, 13 bp, Homo sapiens
gagtaatctgtgt

SEQ ID NO: 832225 - DNA, 13 bp, Homo sapiens
gagtaatgatgta

SEQ ID NO: 832226 - DNA, 19 bp, Homo sapiens
gagtaatggtgtagaacac

SEQ ID NO: 832227 - DNA, 16 bp, Homo sapiens
gagtaattaataaaga

SEQ ID NO: 832228 - DNA, 14 bp, Homo sapiens
gagtaatttattgt

SEQ ID NO: 832229 - DNA, 21 bp, Homo sapiens
gagtacaaaacaatctctcaa

SEQ ID NO: 832230 - DNA, 21 bp, Homo sapiens
gagtaccaaatccacaagcca

SEQ ID NO: 832231 - DNA, 23 bp, Homo sapiens
gagtacctccagtcacactcccc

SEQ ID NO: 832232 - DNA, 17 bp, Homo sapiens
gagtacctgctgcccca

SEQ ID NO: 832233 - DNA, 19 bp, Homo sapiens
gagtaccttctacaggccc

SEQ ID NO: 832234 - DNA, 23 bp, Homo sapiens
gagtacgttaaaagcaaaaagat

SEQ ID NO: 832235 - DNA, 16 bp, Homo sapiens
gagtacgttgtgcatt

SEQ ID NO: 832236 - DNA, 14 bp, Homo sapiens
gagtactatattta

SEQ ID NO: 832237 - DNA, 16 bp, Homo sapiens
gagtactatatttaca

SEQ ID NO: 832238 - DNA, 19 bp, Homo sapiens
gagtactggaataaacagt

SEQ ID NO: 832239 - DNA, 19 bp, Homo sapiens
gagtagaaactgcagggaa

SEQ ID NO: 832240 - DNA, 18 bp, Homo sapiens
gagtagcatggactctgg

SEQ ID NO: 832241 - DNA, 21 bp, Homo sapiens
gagtagccaggttctgccggt

SEQ ID NO: 832242 - DNA, 15 bp, Homo sapiens
gagtagctgggcctg

SEQ ID NO: 832243 - DNA, 18 bp, Homo sapiens
gagtagctgggcctgtgc

SEQ ID NO: 832244 - DNA, 22 bp, Homo sapiens
gagtagggtagaaggaaagcat

SEQ ID NO: 832245 - DNA, 18 bp, Homo sapiens
gagtaggtctgggatgga

SEQ ID NO: 832246 - DNA, 16 bp, Homo sapiens
gagtagtcttatgtaa

SEQ ID NO: 832247 - DNA, 21 bp, Homo sapiens
gagtagttgatgttgcatttt

SEQ ID NO: 832248 - DNA, 16 bp, Homo sapiens
gagtatccttccttca

SEQ ID NO: 832249 - DNA, 16 bp, Homo sapiens
gagtatgaacttgaga

SEQ ID NO: 832250 - DNA, 12 bp, Homo sapiens
gagtatgttgtc

SEQ ID NO: 832251 - DNA, 17 bp, Homo sapiens
gagtattaagaatgcag

SEQ ID NO: 832252 - DNA, 21 bp, Homo sapiens
gagtattctcataggagactg

SEQ ID NO: 832253 - DNA, 22 bp, Homo sapiens
gagtattctcataggagactgc

SEQ ID NO: 832254 - DNA, 20 bp, Homo sapiens
gagtatttaggcagattgaa

SEQ ID NO: 832255 - DNA, 16 bp, Homo sapiens
gagtatttattgtcag

SEQ ID NO: 832256 - DNA, 20 bp, Homo sapiens
gagtatttcccttccaaaga

SEQ ID NO: 832257 - DNA, 12 bp, Homo sapiens
gagtatttctgg

SEQ ID NO: 832258 - DNA, 20 bp, Homo sapiens
gagtattttaagaagacata

SEQ ID NO: 832259 - DNA, 20 bp, Homo sapiens
gagtcaaaggcatctccctt

SEQ ID NO: 832260 - DNA, 14 bp, Homo sapiens
gagtcaactggagc

SEQ ID NO: 832261 - DNA, 13 bp, Homo sapiens
gagtcaatacata

SEQ ID NO: 832262 - DNA, 15 bp, Homo sapiens
gagtcaatgtgcagt

SEQ ID NO: 832263 - DNA, 18 bp, Homo sapiens
gagtcaattggaaagact

SEQ ID NO: 832264 - DNA, 13 bp, Homo sapiens
gagtcaatttgct

SEQ ID NO: 832265 - DNA, 15 bp, Homo sapiens
gagtcaatttgctga

SEQ ID NO: 832266 - DNA, 14 bp, Homo sapiens
gagtcacaggtgtg

SEQ ID NO: 832267 - DNA, 15 bp, Homo sapiens
gagtcacaggtgtgg

SEQ ID NO: 832268 - DNA, 20 bp, Homo sapiens
gagtcacccatgaagacagg

SEQ ID NO: 832269 - DNA, 16 bp, Homo sapiens
gagtcacctgcaagcc

SEQ ID NO: 832270 - DNA, 17 bp, Homo sapiens
gagtcacctgcaagccc

SEQ ID NO: 832271 - DNA, 13 bp, Homo sapiens
gagtcacctgctc

SEQ ID NO: 832272 - DNA, 17 bp, Homo sapiens
gagtcacctgctccaga

SEQ ID NO: 832273 - DNA, 15 bp, Homo sapiens
gagtcaccttccctt

SEQ ID NO: 832274 - DNA, 20 bp, Homo sapiens
gagtcaccttttctgtggct

SEQ ID NO: 832275 - DNA, 22 bp, Homo sapiens
gagtcaccttttctgtggctgg

SEQ ID NO: 832276 - DNA, 15 bp, Homo sapiens
gagtcactgagacca

SEQ ID NO: 832277 - DNA, 17 bp, Homo sapiens
gagtcactgcagaggga

SEQ ID NO: 832278 - DNA, 15 bp, Homo sapiens
gagtcagagccctgg

SEQ ID NO: 832279 - DNA, 12 bp, Homo sapiens
gagtcagcacct

SEQ ID NO: 832280 - DNA, 13 bp, Homo sapiens
gagtcagcacctt

SEQ ID NO: 832281 - DNA, 21 bp, Homo sapiens
gagtcagccccgacttcctga

SEQ ID NO: 832282 - DNA, 14 bp, Homo sapiens
gagtcagctctctg

SEQ ID NO: 832283 - DNA, 21 bp, Homo sapiens
gagtcaggagttttactgcct

SEQ ID NO: 832284 - DNA, 14 bp, Homo sapiens
gagtcaggggctct

SEQ ID NO: 832285 - DNA, 15 bp, Homo sapiens
gagtcaggggctctg

SEQ ID NO: 832286 - DNA, 19 bp, Homo sapiens
gagtcagggtggagatgag

SEQ ID NO: 832287 - DNA, 14 bp, Homo sapiens
gagtcagtctcttg

SEQ ID NO: 832288 - DNA, 19 bp, Homo sapiens
gagtcatgatctccctgcc

SEQ ID NO: 832289 - DNA, 16 bp, Homo sapiens
gagtcattaccacgcc

SEQ ID NO: 832290 - DNA, 12 bp, Homo sapiens
gagtcattcata

SEQ ID NO: 832291 - DNA, 14 bp, Homo sapiens
gagtcattcatatt

SEQ ID NO: 832292 - DNA, 13 bp, Homo sapiens
gagtcatttaaat

SEQ ID NO: 832293 - DNA, 16 bp, Homo sapiens
gagtcatttaaatgtg

SEQ ID NO: 832294 - DNA, 18 bp, Homo sapiens
gagtcatttgagtctctt

SEQ ID NO: 832295 - DNA, 14 bp, Homo sapiens
gagtccaaggccag

SEQ ID NO: 832296 - DNA, 15 bp, Homo sapiens
gagtccactgctcca

SEQ ID NO: 832297 - DNA, 22 bp, Homo sapiens
gagtccactttgtttcgtgggg

SEQ ID NO: 832298 - DNA, 13 bp, Homo sapiens
gagtccagctccc

SEQ ID NO: 832299 - DNA, 14 bp, Homo sapiens
gagtccaggcacag

SEQ ID NO: 832300 - DNA, 15 bp, Homo sapiens
gagtccaggcacagg

SEQ ID NO: 832301 - DNA, 12 bp, Homo sapiens
gagtccagggaa

SEQ ID NO: 832302 - DNA, 19 bp, Homo sapiens
gagtccagggtttctctgc

SEQ ID NO: 832303 - DNA, 20 bp, Homo sapiens
gagtccagggtttctctgca

SEQ ID NO: 832304 - DNA, 17 bp, Homo sapiens
gagtccaggtaaatggt

SEQ ID NO: 832305 - DNA, 15 bp, Homo sapiens
gagtccagtgctctg

SEQ ID NO: 832306 - DNA, 19 bp, Homo sapiens
gagtccagtgctctgcctc

SEQ ID NO: 832307 - DNA, 22 bp, Homo sapiens
gagtccagtgctctgcctcaga

SEQ ID NO: 832308 - DNA, 21 bp, Homo sapiens
gagtccatttcccacatcttt

SEQ ID NO: 832309 - DNA, 16 bp, Homo sapiens
gagtcccaaggaaagc

SEQ ID NO: 832310 - DNA, 15 bp, Homo sapiens
gagtcccacccggac

SEQ ID NO: 832311 - DNA, 23 bp, Homo sapiens
gagtcccagagcaggaggcccct

SEQ ID NO: 832312 - DNA, 20 bp, Homo sapiens
gagtcccaggagctgcccag

SEQ ID NO: 832313 - DNA, 17 bp, Homo sapiens
gagtccccggggttccc

SEQ ID NO: 832314 - DNA, 16 bp, Homo sapiens
gagtcccctcacctcc

SEQ ID NO: 832315 - DNA, 17 bp, Homo sapiens
gagtcccctcacctcct

SEQ ID NO: 832316 - DNA, 20 bp, Homo sapiens
gagtccctatagtttcacca

SEQ ID NO: 832317 - DNA, 19 bp, Homo sapiens
gagtccctcgtctcttgtg

SEQ ID NO: 832318 - DNA, 15 bp, Homo sapiens
gagtccgcccatccc

SEQ ID NO: 832319 - DNA, 16 bp, Homo sapiens
gagtccgcccatccct

SEQ ID NO: 832320 - DNA, 14 bp, Homo sapiens
gagtccggaggcag

SEQ ID NO: 832321 - DNA, 14 bp, Homo sapiens
gagtccggatttct

SEQ ID NO: 832322 - DNA, 16 bp, Homo sapiens
gagtccggatttctaa

SEQ ID NO: 832323 - DNA, 23 bp, Homo sapiens
gagtccgtactcggcttcctgtg

SEQ ID NO: 832324 - DNA, 17 bp, Homo sapiens
gagtcctaggacttaaa

SEQ ID NO: 832325 - DNA, 15 bp, Homo sapiens
gagtcctgtctctgc

SEQ ID NO: 832326 - DNA, 16 bp, Homo sapiens
gagtcctgttgaagac

SEQ ID NO: 832327 - DNA, 18 bp, Homo sapiens
gagtccttacctcgggga

SEQ ID NO: 832328 - DNA, 22 bp, Homo sapiens
gagtcggagtggacaccgctca

SEQ ID NO: 832329 - DNA, 18 bp, Homo sapiens
gagtcggccccacatggg

SEQ ID NO: 832330 - DNA, 20 bp, Homo sapiens
gagtctagatacagaagccc

SEQ ID NO: 832331 - DNA, 16 bp, Homo sapiens
gagtctatgttcaaag

SEQ ID NO: 832332 - DNA, 21 bp, Homo sapiens
gagtctatgttcaaagactgt

SEQ ID NO: 832333 - DNA, 18 bp, Homo sapiens
gagtctctgatacacagt

SEQ ID NO: 832334 - DNA, 14 bp, Homo sapiens
gagtctcttctcca

SEQ ID NO: 832335 - DNA, 16 bp, Homo sapiens
gagtctcttctccact

SEQ ID NO: 832336 - DNA, 18 bp, Homo sapiens
gagtctcttctccactgg

SEQ ID NO: 832337 - DNA, 18 bp, Homo sapiens
gagtctgaggactgtcct

SEQ ID NO: 832338 - DNA, 15 bp, Homo sapiens
gataaacaccaaccc

SEQ ID NO: 832339 - DNA, 18 bp, Homo sapiens
gataaacatcacatgaga

SEQ ID NO: 832340 - DNA, 18 bp, Homo sapiens
gataaacattaaacactg

SEQ ID NO: 832341 - DNA, 14 bp, Homo sapiens
gataaaccaccctc

SEQ ID NO: 832342 - DNA, 14 bp, Homo sapiens
gataaactgagcct

SEQ ID NO: 832343 - DNA, 13 bp, Homo sapiens
gataaagactttt

SEQ ID NO: 832344 - DNA, 20 bp, Homo sapiens
gataaagacttttatgtgag

SEQ ID NO: 832345 - DNA, 15 bp, Homo sapiens
gataaagatatcaat

SEQ ID NO: 832346 - DNA, 13 bp, Homo sapiens
gataaagatgatc

SEQ ID NO: 832347 - DNA, 19 bp, Homo sapiens
gataaagattttttaataa

SEQ ID NO: 832348 - DNA, 15 bp, Homo sapiens
gataaagtaataatg

SEQ ID NO: 832349 - DNA, 14 bp, Homo sapiens
gataaagttcctta

SEQ ID NO: 832350 - DNA, 16 bp, Homo sapiens
gataaataactttttt

SEQ ID NO: 832351 - DNA, 13 bp, Homo sapiens
gataaatagaact

SEQ ID NO: 832352 - DNA, 15 bp, Homo sapiens
gataaatatatatga

SEQ ID NO: 832353 - DNA, 17 bp, Homo sapiens
gataaatcataaagtca

SEQ ID NO: 832354 - DNA, 15 bp, Homo sapiens
gataaatcatttcag

SEQ ID NO: 832355 - DNA, 12 bp, Homo sapiens
gataaattataa

SEQ ID NO: 832356 - DNA, 13 bp, Homo sapiens
gataaattataag

SEQ ID NO: 832357 - DNA, 16 bp, Homo sapiens
gataaattccactgga

SEQ ID NO: 832358 - DNA, 13 bp, Homo sapiens
gataacagaggca

SEQ ID NO: 832359 - DNA, 17 bp, Homo sapiens
gataacagcctcttgcc

SEQ ID NO: 832360 - DNA, 15 bp, Homo sapiens
gataaccagctgtaa

SEQ ID NO: 832361 - DNA, 19 bp, Homo sapiens
gataaccccaggcactgtt

SEQ ID NO: 832362 - DNA, 16 bp, Homo sapiens
gataaccttgaaaaaa

SEQ ID NO: 832363 - DNA, 11 bp, Homo sapiens
gataactctcc

SEQ ID NO: 832364 - DNA, 17 bp, Homo sapiens
gataactctctttcctt

SEQ ID NO: 832365 - DNA, 18 bp, Homo sapiens
gataactgcaattttaat

SEQ ID NO: 832366 - DNA, 15 bp, Homo sapiens
gataacttactgtat

SEQ ID NO: 832367 - DNA, 16 bp, Homo sapiens
gataagcttcaaagct

SEQ ID NO: 832368 - DNA, 17 bp, Homo sapiens
gataaggaaactttatt

SEQ ID NO: 832369 - DNA, 15 bp, Homo sapiens
gataaggcctgtggg

SEQ ID NO: 832370 - DNA, 12 bp, Homo sapiens
gataaggggcct

SEQ ID NO: 832371 - DNA, 14 bp, Homo sapiens
gataaggggccttg

SEQ ID NO: 832372 - DNA, 21 bp, Homo sapiens
gataaggggccttgctctgag

SEQ ID NO: 832373 - DNA, 13 bp, Homo sapiens
gataagtgtaaat

SEQ ID NO: 832374 - DNA, 13 bp, Homo sapiens
gataataaaaatt

SEQ ID NO: 832375 - DNA, 12 bp, Homo sapiens
gataataaaaca

SEQ ID NO: 832376 - DNA, 13 bp, Homo sapiens
gataataaaacat

SEQ ID NO: 832377 - DNA, 16 bp, Homo sapiens
gataataaaatttaga

SEQ ID NO: 832378 - DNA, 16 bp, Homo sapiens
gataataaattgattt

SEQ ID NO: 832379 - DNA, 21 bp, Homo sapiens
gataatacaccactacattct

SEQ ID NO: 832380 - DNA, 24 bp, Homo sapiens
gataatacaccactacattctgtt

SEQ ID NO: 832381 - DNA, 17 bp, Homo sapiens
gataatatataaacaat

SEQ ID NO: 832382 - DNA, 22 bp, Homo sapiens
gataatatttttgtatttctct

SEQ ID NO: 832383 - DNA, 15 bp, Homo sapiens
gataatcagcctctt

SEQ ID NO: 832384 - DNA, 13 bp, Homo sapiens
gataatcaggaaa

SEQ ID NO: 832385 - DNA, 15 bp, Homo sapiens
gataatcaggaaaaa

SEQ ID NO: 832386 - DNA, 15 bp, Homo sapiens
gataatcattgctta

SEQ ID NO: 832387 - DNA, 19 bp, Homo sapiens
gataatctcagtgctttcc

SEQ ID NO: 832388 - DNA, 20 bp, Homo sapiens
gataatctcagtgctttcct

SEQ ID NO: 832389 - DNA, 21 bp, Homo sapiens
gataatcttcaggtgaacact

SEQ ID NO: 832390 - DNA, 22 bp, Homo sapiens
gataatcttcaggtgaacactt

SEQ ID NO: 832391 - DNA, 20 bp, Homo sapiens
gataatgaaataatcagtga

SEQ ID NO: 832392 - DNA, 16 bp, Homo sapiens
gataatggagaatgta

SEQ ID NO: 832393 - DNA, 16 bp, Homo sapiens
gataatgtccccactc

SEQ ID NO: 832394 - DNA, 12 bp, Homo sapiens
gataattcattt

SEQ ID NO: 832395 - DNA, 14 bp, Homo sapiens
gataattcatttgt

SEQ ID NO: 832396 - DNA, 11 bp, Homo sapiens
gataattgcta

SEQ ID NO: 832397 - DNA, 16 bp, Homo sapiens
gataattgtgtatttt

SEQ ID NO: 832398 - DNA, 12 bp, Homo sapiens
gataatttgaaa

SEQ ID NO: 832399 - DNA, 13 bp, Homo sapiens
gataatttgaaaa

SEQ ID NO: 832400 - DNA, 13 bp, Homo sapiens
gataatttgcata

SEQ ID NO: 832401 - DNA, 12 bp, Homo sapiens
gataattttaaa

SEQ ID NO: 832402 - DNA, 16 bp, Homo sapiens
gatacaagattagaag

SEQ ID NO: 832403 - DNA, 19 bp, Homo sapiens
gatacaagtttcagacagg

SEQ ID NO: 832404 - DNA, 22 bp, Homo sapiens
gatacaagtttcagacagggtc

SEQ ID NO: 832405 - DNA, 19 bp, Homo sapiens
gatacacccaaagtatcag

SEQ ID NO: 832406 - DNA, 22 bp, Homo sapiens
gatacactgaagttaacagaga

SEQ ID NO: 832407 - DNA, 16 bp, Homo sapiens
gatacactgcactttg

SEQ ID NO: 832408 - DNA, 23 bp, Homo sapiens
gatacagaagcccatgtcttctg

SEQ ID NO: 832409 - DNA, 22 bp, Homo sapiens
gatacagggtgctccttgtcaa

SEQ ID NO: 832410 - DNA, 18 bp, Homo sapiens
gatacagtccctaaagaa

SEQ ID NO: 832411 - DNA, 19 bp, Homo sapiens
gatacagttactcagaatt

SEQ ID NO: 832412 - DNA, 23 bp, Homo sapiens
gatacagttactcagaattctct

SEQ ID NO: 832413 - DNA, 12 bp, Homo sapiens
gatacataaaaa

SEQ ID NO: 832414 - DNA, 16 bp, Homo sapiens
gatacataaaaattaa

SEQ ID NO: 832415 - DNA, 16 bp, Homo sapiens
gatacatcactgcttg

SEQ ID NO: 832416 - DNA, 23 bp, Homo sapiens
gatacatccaaagcagacagctc

SEQ ID NO: 832417 - DNA, 17 bp, Homo sapiens
gatacatctgctgtgtg

SEQ ID NO: 832418 - DNA, 13 bp, Homo sapiens
gatacatttaata

SEQ ID NO: 832419 - DNA, 15 bp, Homo sapiens
gataccagcgaggag

SEQ ID NO: 832420 - DNA, 22 bp, Homo sapiens
gataccagcgaggaggctccag

SEQ ID NO: 832421 - DNA, 16 bp, Homo sapiens
gataccagctcagggg

SEQ ID NO: 832422 - DNA, 18 bp, Homo sapiens
gatacccaacagtttatt

SEQ ID NO: 832423 - DNA, 15 bp, Homo sapiens
gatacctcatcatcc

SEQ ID NO: 832424 - DNA, 11 bp, Homo sapiens
gataccttcaa

SEQ ID NO: 832425 - DNA, 13 bp, Homo sapiens
gatacgactttat

SEQ ID NO: 832426 - DNA, 21 bp, Homo sapiens
gatacgtccgtgtgtcccaga

SEQ ID NO: 832427 - DNA, 15 bp, Homo sapiens
gatacgtgtcaatgt

SEQ ID NO: 832428 - DNA, 11 bp, Homo sapiens
gatactacagt

SEQ ID NO: 832429 - DNA, 13 bp, Homo sapiens
gatactattttca

SEQ ID NO: 832430 - DNA, 22 bp, Homo sapiens
gatactctccctgacatttcta

SEQ ID NO: 832431 - DNA, 17 bp, Homo sapiens
gatactctgtcagatgg

SEQ ID NO: 832432 - DNA, 15 bp, Homo sapiens
gatactgcaaaggct

SEQ ID NO: 832433 - DNA, 17 bp, Homo sapiens
gatactgcgactttctg

SEQ ID NO: 832434 - DNA, 20 bp, Homo sapiens
gatactgcgactttctgcct

SEQ ID NO: 832435 - DNA, 23 bp, Homo sapiens
gatactgctactgtaattttata

SEQ ID NO: 832436 - DNA, 14 bp, Homo sapiens
gatactgtttcttg

SEQ ID NO: 832437 - DNA, 16 bp, Homo sapiens
gatacttacatttcca

SEQ ID NO: 832438 - DNA, 17 bp, Homo sapiens
gatacttacatttccat

SEQ ID NO: 832439 - DNA, 20 bp, Homo sapiens
gatacttagtggtatgtctc

SEQ ID NO: 832440 - DNA, 21 bp, Homo sapiens
gatacttagtggtatgtctct

SEQ ID NO: 832441 - DNA, 18 bp, Homo sapiens
gatacttcatttaaaaaa

SEQ ID NO: 832442 - DNA, 19 bp, Homo sapiens
gatacttcccacaccacaa

SEQ ID NO: 832443 - DNA, 15 bp, Homo sapiens
gatacttcctgggtc

SEQ ID NO: 832444 - DNA, 21 bp, Homo sapiens
gatagaacacaaaacttgaaa

SEQ ID NO: 832445 - DNA, 14 bp, Homo sapiens
gatagaatgacagt

SEQ ID NO: 832446 - DNA, 20 bp, Homo sapiens
gatagaatgatgttttaaaa

SEQ ID NO: 832447 - DNA, 20 bp, Homo sapiens
gatagacacatatgaggggg

SEQ ID NO: 832448 - DNA, 19 bp, Homo sapiens
gatagacagtgctgccctg

SEQ ID NO: 832449 - DNA, 21 bp, Homo sapiens
gatagacgagttgatttcctc

SEQ ID NO: 832450 - DNA, 21 bp, Homo sapiens
gatagacttgggatggggagg

SEQ ID NO: 832451 - DNA, 14 bp, Homo sapiens
gatagactttgtga

SEQ ID NO: 832452 - DNA, 13 bp, Homo sapiens
gatagataagtat

SEQ ID NO: 832453 - DNA, 20 bp, Homo sapiens
gatagcaagtgaatttttct

SEQ ID NO: 832454 - DNA, 14 bp, Homo sapiens
gatagcactttcta

SEQ ID NO: 832455 - DNA, 15 bp, Homo sapiens
gatagcattgtgaac

SEQ ID NO: 832456 - DNA, 17 bp, Homo sapiens
gatagcattgtgaactg

SEQ ID NO: 832457 - DNA, 22 bp, Homo sapiens
gatagcatttttgatttatgca

SEQ ID NO: 832458 - DNA, 17 bp, Homo sapiens
gatagcccaggagcaac

SEQ ID NO: 832459 - DNA, 22 bp, Homo sapiens
gatagcccatagctattttcct

SEQ ID NO: 832460 - DNA, 23 bp, Homo sapiens
gatagcccatagctattttcctt

SEQ ID NO: 832461 - DNA, 20 bp, Homo sapiens
gatccctgcccttctcaaga

SEQ ID NO: 832462 - DNA, 18 bp, Homo sapiens
gatccctgtgttgtctct

SEQ ID NO: 832463 - DNA, 20 bp, Homo sapiens
gatccctgtgttgtctctag

SEQ ID NO: 832464 - DNA, 24 bp, Homo sapiens
gatccctgtgttgtctctagagca

SEQ ID NO: 832465 - DNA, 20 bp, Homo sapiens
gatccctgttacccagagaa

SEQ ID NO: 832466 - DNA, 13 bp, Homo sapiens
gatccctttagaa

SEQ ID NO: 832467 - DNA, 14 bp, Homo sapiens
gatccgactgcttt

SEQ ID NO: 832468 - DNA, 18 bp, Homo sapiens
gatccgactgctttggac

SEQ ID NO: 832469 - DNA, 23 bp, Homo sapiens
gatccgagtgtgatttgaattct

SEQ ID NO: 832470 - DNA, 18 bp, Homo sapiens
gatccgcaatgtggagca

SEQ ID NO: 832471 - DNA, 21 bp, Homo sapiens
gatccgcccacctcagcctcc

SEQ ID NO: 832472 - DNA, 18 bp, Homo sapiens
gatccgcggggaccctgc

SEQ ID NO: 832473 - DNA, 13 bp, Homo sapiens
gatccgctgccac

SEQ ID NO: 832474 - DNA, 14 bp, Homo sapiens
gatccgctgccacc

SEQ ID NO: 832475 - DNA, 20 bp, Homo sapiens
gatccggctgctcctccagc

SEQ ID NO: 832476 - DNA, 20 bp, Homo sapiens
gatcctaaactctctagctt

SEQ ID NO: 832477 - DNA, 19 bp, Homo sapiens
gatcctagggcacttctag

SEQ ID NO: 832478 - DNA, 22 bp, Homo sapiens
gatcctagggcacttctagttt

SEQ ID NO: 832479 - DNA, 19 bp, Homo sapiens
gatcctattctcaccagga

SEQ ID NO: 832480 - DNA, 16 bp, Homo sapiens
gatcctccacagagag

SEQ ID NO: 832481 - DNA, 17 bp, Homo sapiens
gatcctccacagagagg

SEQ ID NO: 832482 - DNA, 15 bp, Homo sapiens
gatcctcctgcagac

SEQ ID NO: 832483 - DNA, 21 bp, Homo sapiens
gatcctcctgcagaccacgcc

SEQ ID NO: 832484 - DNA, 20 bp, Homo sapiens
gatcctctattttgtgatga

SEQ ID NO: 832485 - DNA, 19 bp, Homo sapiens
gatcctctcacctcagcct

SEQ ID NO: 832486 - DNA, 22 bp, Homo sapiens
gatcctctccaccctcctctag

SEQ ID NO: 832487 - DNA, 19 bp, Homo sapiens
gatcctctccactccatgt

SEQ ID NO: 832488 - DNA, 17 bp, Homo sapiens
gatcctctttactctgg

SEQ ID NO: 832489 - DNA, 19 bp, Homo sapiens
gatcctctttactctgggc

SEQ ID NO: 832490 - DNA, 12 bp, Homo sapiens
gatcctgagctc

SEQ ID NO: 832491 - DNA, 15 bp, Homo sapiens
gatcctgagctgctg

SEQ ID NO: 832492 - DNA, 22 bp, Homo sapiens
gatcctgcaccccagcattcca

SEQ ID NO: 832493 - DNA, 21 bp, Homo sapiens
gatcctgcaggaacgagcact

SEQ ID NO: 832494 - DNA, 16 bp, Homo sapiens
gatcctgtctttaagg

SEQ ID NO: 832495 - DNA, 21 bp, Homo sapiens
gatccttagaggtcctctgga

SEQ ID NO: 832496 - DNA, 22 bp, Homo sapiens
gatccttagaggtcctctggag

SEQ ID NO: 832497 - DNA, 16 bp, Homo sapiens
gatccttcaaagtctc

SEQ ID NO: 832498 - DNA, 15 bp, Homo sapiens
gatccttcacaggca

SEQ ID NO: 832499 - DNA, 16 bp, Homo sapiens
gatccttccacctcag

SEQ ID NO: 832500 - DNA, 13 bp, Homo sapiens
gatccttggaaac

SEQ ID NO: 832501 - DNA, 24 bp, Homo sapiens
gatccttggaaaccgtgtgtccag

SEQ ID NO: 832502 - DNA, 15 bp, Homo sapiens
gatccttttttgtca

SEQ ID NO: 832503 - DNA, 17 bp, Homo sapiens
gatcgaaccgttttgaa

SEQ ID NO: 832504 - DNA, 19 bp, Homo sapiens
gatcgacaccatcctggct

SEQ ID NO: 832505 - DNA, 18 bp, Homo sapiens
gatcgagtgtagctgtga

SEQ ID NO: 832506 - DNA, 13 bp, Homo sapiens
gatcgatgtgctc

SEQ ID NO: 832507 - DNA, 14 bp, Homo sapiens
gatcgatgtgctca

SEQ ID NO: 832508 - DNA, 18 bp, Homo sapiens
gatcgcagtttgcctggt

SEQ ID NO: 832509 - DNA, 15 bp, Homo sapiens
gatcgcccaggctgg

SEQ ID NO: 832510 - DNA, 21 bp, Homo sapiens
gatcgcggcggagctggcccc

SEQ ID NO: 832511 - DNA, 14 bp, Homo sapiens
gatcgcttgagccc

SEQ ID NO: 832512 - DNA, 16 bp, Homo sapiens
gatcgcttgagcccag

SEQ ID NO: 832513 - DNA, 20 bp, Homo sapiens
gatcgcttgagcccaggagt

SEQ ID NO: 832514 - DNA, 17 bp, Homo sapiens
gatcggactctgcccct

SEQ ID NO: 832515 - DNA, 17 bp, Homo sapiens
gatcggagcctcctctc

SEQ ID NO: 832516 - DNA, 22 bp, Homo sapiens
gatcggaggcttgtcagagctg

SEQ ID NO: 832517 - DNA, 23 bp, Homo sapiens
gatcggtttcatattttaaatct

SEQ ID NO: 832518 - DNA, 14 bp, Homo sapiens
gatcgtagaaaatt

SEQ ID NO: 832519 - DNA, 16 bp, Homo sapiens
gatcgtagaaaatttg

SEQ ID NO: 832520 - DNA, 18 bp, Homo sapiens
gatcgtgctaaattttca

SEQ ID NO: 832521 - DNA, 16 bp, Homo sapiens
gatcgttcattgcctt

SEQ ID NO: 832522 - DNA, 18 bp, Homo sapiens
gatctaagaagggctgag

SEQ ID NO: 832523 - DNA, 18 bp, Homo sapiens
gatctaatacaaagatga

SEQ ID NO: 832524 - DNA, 19 bp, Homo sapiens
gatctaattaaactaaaga

SEQ ID NO: 832525 - DNA, 17 bp, Homo sapiens
gatctacctggagggaa

SEQ ID NO: 832526 - DNA, 21 bp, Homo sapiens
gatctagcactcctcaagact

SEQ ID NO: 832527 - DNA, 21 bp, Homo sapiens
gatctaggagaggagaaccag

SEQ ID NO: 832528 - DNA, 22 bp, Homo sapiens
gatctagttctcaatcactgct

SEQ ID NO: 832529 - DNA, 15 bp, Homo sapiens
gatctataggcagct

SEQ ID NO: 832530 - DNA, 21 bp, Homo sapiens
gatctatccctgcggcctcca

SEQ ID NO: 832531 - DNA, 15 bp, Homo sapiens
gatctatgcctttca

SEQ ID NO: 832532 - DNA, 17 bp, Homo sapiens
gatctatgtttgtgtga

SEQ ID NO: 832533 - DNA, 16 bp, Homo sapiens
gatctatttcatgttt

SEQ ID NO: 832534 - DNA, 21 bp, Homo sapiens
gatctcagctttgagaagcct

SEQ ID NO: 832535 - DNA, 13 bp, Homo sapiens
gatctcagggcag

SEQ ID NO: 832536 - DNA, 14 bp, Homo sapiens
gatctcaggggctg

SEQ ID NO: 832537 - DNA, 17 bp, Homo sapiens
gatctcaggggctgttt

SEQ ID NO: 832538 - DNA, 21 bp, Homo sapiens
gatctcattggacccttccat

SEQ ID NO: 832539 - DNA, 12 bp, Homo sapiens
gatctccactga

SEQ ID NO: 832540 - DNA, 20 bp, Homo sapiens
gatctccactgttgggtggg

SEQ ID NO: 832541 - DNA, 11 bp, Homo sapiens
gatctccagcg

SEQ ID NO: 832542 - DNA, 13 bp, Homo sapiens
gatctccctgccg

SEQ ID NO: 832543 - DNA, 20 bp, Homo sapiens
gatctccctgccgcctcaat

SEQ ID NO: 832544 - DNA, 13 bp, Homo sapiens
gatctcctgacct

SEQ ID NO: 832545 - DNA, 15 bp, Homo sapiens
gatctcctgctgcct

SEQ ID NO: 832546 - DNA, 16 bp, Homo sapiens
gatctcctgctgcctt

SEQ ID NO: 832547 - DNA, 20 bp, Homo sapiens
gatctctacattaatgtcct

SEQ ID NO: 832548 - DNA, 19 bp, Homo sapiens
gatctctcaggagcacagg

SEQ ID NO: 832549 - DNA, 14 bp, Homo sapiens
gatctctgacctct

SEQ ID NO: 832550 - DNA, 17 bp, Homo sapiens
gatctctgacctctgct

SEQ ID NO: 832551 - DNA, 18 bp, Homo sapiens
gatctctgacctctgctg

SEQ ID NO: 832552 - DNA, 11 bp, Homo sapiens
gatctctgctt

SEQ ID NO: 832553 - DNA, 12 bp, Homo sapiens
gatctctgctta

SEQ ID NO: 832554 - DNA, 21 bp, Homo sapiens
gatctcttagaagccatggga

SEQ ID NO: 832555 - DNA, 13 bp, Homo sapiens
gatctcttcctgt

SEQ ID NO: 832556 - DNA, 12 bp, Homo sapiens
gatctcttgagc

SEQ ID NO: 832557 - DNA, 17 bp, Homo sapiens
gatctcttgagcctggg

SEQ ID NO: 832558 - DNA, 18 bp, Homo sapiens
gatctcttgagcctggga

SEQ ID NO: 832559 - DNA, 19 bp, Homo sapiens
gatctcttgagcctgggag

SEQ ID NO: 832560 - DNA, 15 bp, Homo sapiens
gatctgaacccagct

SEQ ID NO: 832561 - DNA, 21 bp, Homo sapiens
gatctgaacccagctgtgccc

SEQ ID NO: 832562 - DNA, 16 bp, Homo sapiens
gatctgaattaaataa

SEQ ID NO: 832563 - DNA, 23 bp, Homo sapiens
gatctgagaacacgttgccaggg

SEQ ID NO: 832564 - DNA, 15 bp, Homo sapiens
gatctgagaatcttt

SEQ ID NO: 832565 - DNA, 13 bp, Homo sapiens
gatctgagctccc

SEQ ID NO: 832566 - DNA, 17 bp, Homo sapiens
gatctgagctcccacct

SEQ ID NO: 832567 - DNA, 22 bp, Homo sapiens
gatctgagtacatattgtggtg

SEQ ID NO: 832568 - DNA, 16 bp, Homo sapiens
gatctgagtaggtctg

SEQ ID NO: 832569 - DNA, 17 bp, Homo sapiens
gatctgagtaggtctgg

SEQ ID NO: 832570 - DNA, 20 bp, Homo sapiens
gatctgagtaggtctgggat

SEQ ID NO: 832571 - DNA, 20 bp, Homo sapiens
gatctgatagaaagcaagtg

SEQ ID NO: 832572 - DNA, 13 bp, Homo sapiens
gatctgatcaaga

SEQ ID NO: 832573 - DNA, 22 bp, Homo sapiens
gatctgatggtgagctgggaag

SEQ ID NO: 832574 - DNA, 16 bp, Homo sapiens
gatctgcatatttctg

SEQ ID NO: 832575 - DNA, 19 bp, Homo sapiens
gatctgcatatttctgtat

SEQ ID NO: 832576 - DNA, 20 bp, Homo sapiens
gatctgcatatttctgtata

SEQ ID NO: 832577 - DNA, 22 bp, Homo sapiens
gatctgcatatttctgtatatt

SEQ ID NO: 832578 - DNA, 23 bp, Homo sapiens
gatctgcccgcctcggtctccca

SEQ ID NO: 832579 - DNA, 19 bp, Homo sapiens
gatctgcccttctctgcct

SEQ ID NO: 832580 - DNA, 15 bp, Homo sapiens
gatctgcctgggcct

SEQ ID NO: 832581 - DNA, 18 bp, Homo sapiens
gatctgcctgggcctgtg

SEQ ID NO: 832582 - DNA, 21 bp, Homo sapiens
gatgcttttgtgagaaaggga

SEQ ID NO: 832583 - DNA, 12 bp, Homo sapiens
gatggaaaaaca

SEQ ID NO: 832584 - DNA, 22 bp, Homo sapiens
gatggaaaaaccacccccaaat

SEQ ID NO: 832585 - DNA, 13 bp, Homo sapiens
gatggaaaaataa

SEQ ID NO: 832586 - DNA, 14 bp, Homo sapiens
gatggaaaaataaa

SEQ ID NO: 832587 - DNA, 15 bp, Homo sapiens
gatggaaaataaaca

SEQ ID NO: 832588 - DNA, 19 bp, Homo sapiens
gatggaaacgcacttacaa

SEQ ID NO: 832589 - DNA, 21 bp, Homo sapiens
gatggaactgtgtatttattt

SEQ ID NO: 832590 - DNA, 17 bp, Homo sapiens
gatggaagtaaagcctc

SEQ ID NO: 832591 - DNA, 16 bp, Homo sapiens
gatggaagtgttcaga

SEQ ID NO: 832592 - DNA, 16 bp, Homo sapiens
gatggaatggaaaagc

SEQ ID NO: 832593 - DNA, 18 bp, Homo sapiens
gatggaatgtgccacctg

SEQ ID NO: 832594 - DNA, 20 bp, Homo sapiens
gatggaattcttcctcctct

SEQ ID NO: 832595 - DNA, 16 bp, Homo sapiens
gatggacacccccagc

SEQ ID NO: 832596 - DNA, 16 bp, Homo sapiens
gatggacacgagccac

SEQ ID NO: 832597 - DNA, 19 bp, Homo sapiens
gatggacacgagccacaag

SEQ ID NO: 832598 - DNA, 11 bp, Homo sapiens
gatggacagac

SEQ ID NO: 832599 - DNA, 14 bp, Homo sapiens
gatggacagacacc

SEQ ID NO: 832600 - DNA, 15 bp, Homo sapiens
gatggacagacacct

SEQ ID NO: 832601 - DNA, 16 bp, Homo sapiens
gatggacagacacctc

SEQ ID NO: 832602 - DNA, 18 bp, Homo sapiens
gatggaccaacctgctct

SEQ ID NO: 832603 - DNA, 19 bp, Homo sapiens
gatggaccgggtgggcctg

SEQ ID NO: 832604 - DNA, 17 bp, Homo sapiens
gatggacgcaggccctg

SEQ ID NO: 832605 - DNA, 21 bp, Homo sapiens
gatggactgggaaaaacatca

SEQ ID NO: 832606 - DNA, 14 bp, Homo sapiens
gatggactggggag

SEQ ID NO: 832607 - DNA, 16 bp, Homo sapiens
gatggactggggagca

SEQ ID NO: 832608 - DNA, 19 bp, Homo sapiens
gatggagaaagaagtggag

SEQ ID NO: 832609 - DNA, 23 bp, Homo sapiens
gatggagaaagggcagaggaaga

SEQ ID NO: 832610 - DNA, 22 bp, Homo sapiens
gatggagactccatgagaagcc

SEQ ID NO: 832611 - DNA, 14 bp, Homo sapiens
gatggagagagggg

SEQ ID NO: 832612 - DNA, 14 bp, Homo sapiens
gatggagaggacag

SEQ ID NO: 832613 - DNA, 15 bp, Homo sapiens
gatggagaggacaga

SEQ ID NO: 832614 - DNA, 16 bp, Homo sapiens
gatggagatgggaagg

SEQ ID NO: 832615 - DNA, 20 bp, Homo sapiens
gatggagccagctctgcatt

SEQ ID NO: 832616 - DNA, 14 bp, Homo sapiens
gatggagcccccag

SEQ ID NO: 832617 - DNA, 23 bp, Homo sapiens
gatggagcccccagatagagctg

SEQ ID NO: 832618 - DNA, 14 bp, Homo sapiens
gatggaggagaaga

SEQ ID NO: 832619 - DNA, 12 bp, Homo sapiens
gatggaggccag

SEQ ID NO: 832620 - DNA, 15 bp, Homo sapiens
gatggagggcttggc

SEQ ID NO: 832621 - DNA, 16 bp, Homo sapiens
gatggaggggagtgtt

SEQ ID NO: 832622 - DNA, 16 bp, Homo sapiens
gatggagggtggaaat

SEQ ID NO: 832623 - DNA, 16 bp, Homo sapiens
gatggaggtatttgaa

SEQ ID NO: 832624 - DNA, 17 bp, Homo sapiens
gatggaggttctcagag

SEQ ID NO: 832625 - DNA, 23 bp, Homo sapiens
gatggaggttctcagagccaagt

SEQ ID NO: 832626 - DNA, 18 bp, Homo sapiens
gatggagtccagggaaga

SEQ ID NO: 832627 - DNA, 15 bp, Homo sapiens
gatggagtgctgttt

SEQ ID NO: 832628 - DNA, 18 bp, Homo sapiens
gatggataacctatatga

SEQ ID NO: 832629 - DNA, 14 bp, Homo sapiens
gatggatcaccatt

SEQ ID NO: 832630 - DNA, 16 bp, Homo sapiens
gatggatgagtcagac

SEQ ID NO: 832631 - DNA, 15 bp, Homo sapiens
gatggatggcagact

SEQ ID NO: 832632 - DNA, 16 bp, Homo sapiens
gatggatggcagactc

SEQ ID NO: 832633 - DNA, 22 bp, Homo sapiens
gatggattcccccccctttcct

SEQ ID NO: 832634 - DNA, 23 bp, Homo sapiens
gatggattcccccccctttccta

SEQ ID NO: 832635 - DNA, 14 bp, Homo sapiens
gatggattctcaga

SEQ ID NO: 832636 - DNA, 22 bp, Homo sapiens
gatggattctcagatatttata

SEQ ID NO: 832637 - DNA, 19 bp, Homo sapiens
gatggatttgcctgtgcca

SEQ ID NO: 832638 - DNA, 15 bp, Homo sapiens
gatggcaaaaaaaaa

SEQ ID NO: 832639 - DNA, 21 bp, Homo sapiens
gatggcacttataaccaaagc

SEQ ID NO: 832640 - DNA, 18 bp, Homo sapiens
gatggcagactctttaat

SEQ ID NO: 832641 - DNA, 23 bp, Homo sapiens
gatggcagactctttaataaatt

SEQ ID NO: 832642 - DNA, 14 bp, Homo sapiens
gatggcagagccag

SEQ ID NO: 832643 - DNA, 21 bp, Homo sapiens
gatggcagatgttttggggga

SEQ ID NO: 832644 - DNA, 16 bp, Homo sapiens
gatggcagcagtgaag

SEQ ID NO: 832645 - DNA, 12 bp, Homo sapiens
gatggcagctgg

SEQ ID NO: 832646 - DNA, 22 bp, Homo sapiens
gatggcatttggtctcaggcag

SEQ ID NO: 832647 - DNA, 15 bp, Homo sapiens
gatggccaagagcat

SEQ ID NO: 832648 - DNA, 16 bp, Homo sapiens
gatggccaagagcatc

SEQ ID NO: 832649 - DNA, 12 bp, Homo sapiens
gatggccagagg

SEQ ID NO: 832650 - DNA, 13 bp, Homo sapiens
gatggccagcccc

SEQ ID NO: 832651 - DNA, 16 bp, Homo sapiens
gatggccagcccctgg

SEQ ID NO: 832652 - DNA, 13 bp, Homo sapiens
gatggccatgctc

SEQ ID NO: 832653 - DNA, 14 bp, Homo sapiens
gatggccatgctca

SEQ ID NO: 832654 - DNA, 16 bp, Homo sapiens
gatggcccaagggatg

SEQ ID NO: 832655 - DNA, 19 bp, Homo sapiens
gatggcccagcaggcaggc

SEQ ID NO: 832656 - DNA, 14 bp, Homo sapiens
gatggccccagcac

SEQ ID NO: 832657 - DNA, 15 bp, Homo sapiens
gatggccccagcaca

SEQ ID NO: 832658 - DNA, 17 bp, Homo sapiens
gatggcccctccttgca

SEQ ID NO: 832659 - DNA, 15 bp, Homo sapiens
gatggcccttcccac

SEQ ID NO: 832660 - DNA, 18 bp, Homo sapiens
gatggccgtggatggccg

SEQ ID NO: 832661 - DNA, 18 bp, Homo sapiens
gatggcctggctgcctgg

SEQ ID NO: 832662 - DNA, 14 bp, Homo sapiens
gatggccttaattt

SEQ ID NO: 832663 - DNA, 17 bp, Homo sapiens
gatggccttaatttcct

SEQ ID NO: 832664 - DNA, 18 bp, Homo sapiens
gatggccttaatttcctt

SEQ ID NO: 832665 - DNA, 14 bp, Homo sapiens
gatggcgaccacca

SEQ ID NO: 832666 - DNA, 16 bp, Homo sapiens
gatggcgcgggaggca

SEQ ID NO: 832667 - DNA, 20 bp, Homo sapiens
gatggcgcgggaggcaccag

SEQ ID NO: 832668 - DNA, 14 bp, Homo sapiens
gatggctcagaggg

SEQ ID NO: 832669 - DNA, 15 bp, Homo sapiens
gatggctcagagggg

SEQ ID NO: 832670 - DNA, 19 bp, Homo sapiens
gatggctggaaggggtcca

SEQ ID NO: 832671 - DNA, 17 bp, Homo sapiens
gatggctgtgcctctgc

SEQ ID NO: 832672 - DNA, 18 bp, Homo sapiens
gatggctgtgcctctgcc

SEQ ID NO: 832673 - DNA, 20 bp, Homo sapiens
gatggctgtgcctctgcctg

SEQ ID NO: 832674 - DNA, 18 bp, Homo sapiens
gatggcttgacatgtgca

SEQ ID NO: 832675 - DNA, 14 bp, Homo sapiens
gatggctttcaggg

SEQ ID NO: 832676 - DNA, 17 bp, Homo sapiens
gatgggaaatctgccta

SEQ ID NO: 832677 - DNA, 17 bp, Homo sapiens
gatgggaacagtaaaga

SEQ ID NO: 832678 - DNA, 23 bp, Homo sapiens
gatgggaatgaggtgggaggtgg

SEQ ID NO: 832679 - DNA, 19 bp, Homo sapiens
gatgggacaagcagtccct

SEQ ID NO: 832680 - DNA, 13 bp, Homo sapiens
gatgggacatcaa

SEQ ID NO: 832681 - DNA, 14 bp, Homo sapiens
gatgggaccaggga

SEQ ID NO: 832682 - DNA, 20 bp, Homo sapiens
gatgggactccatagctcct

SEQ ID NO: 832683 - DNA, 14 bp, Homo sapiens
gatgggagtgggca

SEQ ID NO: 832684 - DNA, 18 bp, Homo sapiens
gatgggcaaagcttgtca

SEQ ID NO: 832685 - DNA, 14 bp, Homo sapiens
gatgggctcgctga

SEQ ID NO: 832686 - DNA, 15 bp, Homo sapiens
gatgggctctacctc

SEQ ID NO: 832687 - DNA, 16 bp, Homo sapiens
gatgggctctacctct

SEQ ID NO: 832688 - DNA, 17 bp, Homo sapiens
gatgggctgagctagcc

SEQ ID NO: 832689 - DNA, 19 bp, Homo sapiens
gatgggctgagctagcctc

SEQ ID NO: 832690 - DNA, 20 bp, Homo sapiens
gatgggctgagctagcctcc

SEQ ID NO: 832691 - DNA, 12 bp, Homo sapiens
gatgggctgggg

SEQ ID NO: 832692 - DNA, 23 bp, Homo sapiens
gatgggctggggcaggggcctgg

SEQ ID NO: 832693 - DNA, 20 bp, Homo sapiens
gatgggcttctgttctctgc

SEQ ID NO: 832694 - DNA, 24 bp, Homo sapiens
gatgggcttctgttctctgctgag

SEQ ID NO: 832695 - DNA, 20 bp, Homo sapiens
gatgggcttttgttctgagg

SEQ ID NO: 832696 - DNA, 15 bp, Homo sapiens
gatggggctcccagc

SEQ ID NO: 832697 - DNA, 21 bp, Homo sapiens
gatggggctcccagctccttt

SEQ ID NO: 832698 - DNA, 21 bp, Homo sapiens
gatggggctggcatgttttct

SEQ ID NO: 832699 - DNA, 16 bp, Homo sapiens
gatgggggaactgtga

SEQ ID NO: 832700 - DNA, 16 bp, Homo sapiens
gatgggggcagggctg

SEQ ID NO: 832701 - DNA, 20 bp, Homo sapiens
gatgggggcagggctgtgct

SEQ ID NO: 832702 - DNA, 18 bp, Homo sapiens
gatgggggtttcaccata

SEQ ID NO: 832703 - DNA, 17 bp, Homo sapiens
gatggggtccagagagc

SEQ ID NO: 832704 - DNA, 12 bp, Homo sapiens
gcactattttat

SEQ ID NO: 832705 - DNA, 15 bp, Homo sapiens
gcactattttatatt

SEQ ID NO: 832706 - DNA, 17 bp, Homo sapiens
gcactattttatattta

SEQ ID NO: 832707 - DNA, 22 bp, Homo sapiens
gcactcacacaggacccccttc

SEQ ID NO: 832708 - DNA, 23 bp, Homo sapiens
gcactcacacaggacccccttcc

SEQ ID NO: 832709 - DNA, 17 bp, Homo sapiens
gcactcacagacctgga

SEQ ID NO: 832710 - DNA, 20 bp, Homo sapiens
gcactcacagacctggagcc

SEQ ID NO: 832711 - DNA, 19 bp, Homo sapiens
gcactcacccatgtgccaa

SEQ ID NO: 832712 - DNA, 20 bp, Homo sapiens
gcactcacccatgtgccaag

SEQ ID NO: 832713 - DNA, 23 bp, Homo sapiens
gcactcacccatgtgccaaggtg

SEQ ID NO: 832714 - DNA, 23 bp, Homo sapiens
gcactcagcctcattcagcatgg

SEQ ID NO: 832715 - DNA, 16 bp, Homo sapiens
gcactcatctactgaa

SEQ ID NO: 832716 - DNA, 21 bp, Homo sapiens
gcactcatgtggactgggacc

SEQ ID NO: 832717 - DNA, 17 bp, Homo sapiens
gcactccagcctggggg

SEQ ID NO: 832718 - DNA, 21 bp, Homo sapiens
gcactccatgcttagtcactg

SEQ ID NO: 832719 - DNA, 17 bp, Homo sapiens
gcactccatggccaccc

SEQ ID NO: 832720 - DNA, 17 bp, Homo sapiens
gcactcccacctgacac

SEQ ID NO: 832721 - DNA, 20 bp, Homo sapiens
gcactccccagagctgtgcc

SEQ ID NO: 832722 - DNA, 22 bp, Homo sapiens
gcactccccagagctgtgccag

SEQ ID NO: 832723 - DNA, 13 bp, Homo sapiens
gcactccctggcc

SEQ ID NO: 832724 - DNA, 22 bp, Homo sapiens
gcactccgcgccgatgccaccg

SEQ ID NO: 832725 - DNA, 16 bp, Homo sapiens
gcactcctcaagactt

SEQ ID NO: 832726 - DNA, 14 bp, Homo sapiens
gcactcctcacaca

SEQ ID NO: 832727 - DNA, 23 bp, Homo sapiens
gcactcctcacacagaattgcta

SEQ ID NO: 832728 - DNA, 15 bp, Homo sapiens
gcactcctttatctg

SEQ ID NO: 832729 - DNA, 16 bp, Homo sapiens
gcactcgagaccatcc

SEQ ID NO: 832730 - DNA, 17 bp, Homo sapiens
gcactcgagaccatcct

SEQ ID NO: 832731 - DNA, 17 bp, Homo sapiens
gcactctaaactgcaaa

SEQ ID NO: 832732 - DNA, 15 bp, Homo sapiens
gcactctagcctggc

SEQ ID NO: 832733 - DNA, 22 bp, Homo sapiens
gcactctcatatgccaccccat

SEQ ID NO: 832734 - DNA, 20 bp, Homo sapiens
gcactctcctgtctgaacct

SEQ ID NO: 832735 - DNA, 17 bp, Homo sapiens
gcactctctgcagtcct

SEQ ID NO: 832736 - DNA, 21 bp, Homo sapiens
gcactctctgcagtcctccgg

SEQ ID NO: 832737 - DNA, 22 bp, Homo sapiens
gcactctggatgatggattcca

SEQ ID NO: 832738 - DNA, 21 bp, Homo sapiens
gcactctggcggtggccacag

SEQ ID NO: 832739 - DNA, 20 bp, Homo sapiens
gcactgaaaacttagccaga

SEQ ID NO: 832740 - DNA, 12 bp, Homo sapiens
gcactgaacagg

SEQ ID NO: 832741 - DNA, 23 bp, Homo sapiens
gcactgaacaggctggggccttt

SEQ ID NO: 832742 - DNA, 21 bp, Homo sapiens
gcactgaagtggccctccctc

SEQ ID NO: 832743 - DNA, 22 bp, Homo sapiens
gcactgaagtggccctccctca

SEQ ID NO: 832744 - DNA, 21 bp, Homo sapiens
gcactgaatatataaacactc

SEQ ID NO: 832745 - DNA, 18 bp, Homo sapiens
gcactgacagccttgccc

SEQ ID NO: 832746 - DNA, 14 bp, Homo sapiens
gcactgactgatag

SEQ ID NO: 832747 - DNA, 15 bp, Homo sapiens
gcactgactgtgaaa

SEQ ID NO: 832748 - DNA, 14 bp, Homo sapiens
gcactgagagggca

SEQ ID NO: 832749 - DNA, 17 bp, Homo sapiens
gcactgagcctgcttgt

SEQ ID NO: 832750 - DNA, 19 bp, Homo sapiens
gcactgatggaaaatacca

SEQ ID NO: 832751 - DNA, 20 bp, Homo sapiens
gcactgatgttgtgttttta

SEQ ID NO: 832752 - DNA, 12 bp, Homo sapiens
gcactgatttca

SEQ ID NO: 832753 - DNA, 15 bp, Homo sapiens
gcactgatttcacaa

SEQ ID NO: 832754 - DNA, 20 bp, Homo sapiens
gcactgcagacgggaatgcc

SEQ ID NO: 832755 - DNA, 23 bp, Homo sapiens
gcactgcctctatgccctgcaga

SEQ ID NO: 832756 - DNA, 21 bp, Homo sapiens
gcactgcgcgctatcccctca

SEQ ID NO: 832757 - DNA, 22 bp, Homo sapiens
gcactgctaggcgagtgccagg

SEQ ID NO: 832758 - DNA, 20 bp, Homo sapiens
gcactgctccaagggacagg

SEQ ID NO: 832759 - DNA, 12 bp, Homo sapiens
gcactgctgccc

SEQ ID NO: 832760 - DNA, 20 bp, Homo sapiens
gcactgctgcccagcctcca

SEQ ID NO: 832761 - DNA, 17 bp, Homo sapiens
gcactgcttgaggaaaa

SEQ ID NO: 832762 - DNA, 16 bp, Homo sapiens
gcactggagccacagg

SEQ ID NO: 832763 - DNA, 18 bp, Homo sapiens
gcactggagccacaggca

SEQ ID NO: 832764 - DNA, 15 bp, Homo sapiens
gcactggagtgcagg

SEQ ID NO: 832765 - DNA, 12 bp, Homo sapiens
gcactggccaga

SEQ ID NO: 832766 - DNA, 14 bp, Homo sapiens
gcactggccagaga

SEQ ID NO: 832767 - DNA, 16 bp, Homo sapiens
gcactggccagagagg

SEQ ID NO: 832768 - DNA, 19 bp, Homo sapiens
gcactggccagagagggcc

SEQ ID NO: 832769 - DNA, 20 bp, Homo sapiens
gcactggccagagagggccc

SEQ ID NO: 832770 - DNA, 21 bp, Homo sapiens
gcactggccagagagggccca

SEQ ID NO: 832771 - DNA, 22 bp, Homo sapiens
gcactggccagagagggcccag

SEQ ID NO: 832772 - DNA, 12 bp, Homo sapiens
gcactggcccag

SEQ ID NO: 832773 - DNA, 16 bp, Homo sapiens
gcactggccttctgat

SEQ ID NO: 832774 - DNA, 21 bp, Homo sapiens
gcactggccttctgatgaaat

SEQ ID NO: 832775 - DNA, 15 bp, Homo sapiens
gcactggctctctcc

SEQ ID NO: 832776 - DNA, 17 bp, Homo sapiens
gcactggctctctccag

SEQ ID NO: 832777 - DNA, 16 bp, Homo sapiens
gcactgggaagctgga

SEQ ID NO: 832778 - DNA, 23 bp, Homo sapiens
gcactgggaagctggagtgctgc

SEQ ID NO: 832779 - DNA, 12 bp, Homo sapiens
gcactgggcagg

SEQ ID NO: 832780 - DNA, 13 bp, Homo sapiens
gcactgggcaggt

SEQ ID NO: 832781 - DNA, 19 bp, Homo sapiens
gcactgggcgtctgactcc

SEQ ID NO: 832782 - DNA, 23 bp, Homo sapiens
gcactgggcgtctgactccctcc

SEQ ID NO: 832783 - DNA, 12 bp, Homo sapiens
gcactgggctgt

SEQ ID NO: 832784 - DNA, 18 bp, Homo sapiens
gcactggggagcccgtct

SEQ ID NO: 832785 - DNA, 23 bp, Homo sapiens
gcactggggagcccgtctcagtg

SEQ ID NO: 832786 - DNA, 18 bp, Homo sapiens
gcactgggttgactttca

SEQ ID NO: 832787 - DNA, 22 bp, Homo sapiens
gcactggtggcccgacagcctg

SEQ ID NO: 832788 - DNA, 24 bp, Homo sapiens
gcactggtggcccgacagcctggc

SEQ ID NO: 832789 - DNA, 17 bp, Homo sapiens
gcactgtaaatatccct

SEQ ID NO: 832790 - DNA, 22 bp, Homo sapiens
gcactgtaagacgtatgtaaca

SEQ ID NO: 832791 - DNA, 16 bp, Homo sapiens
gcactgtattgctcct

SEQ ID NO: 832792 - DNA, 18 bp, Homo sapiens
gcactgtcactttgctct

SEQ ID NO: 832793 - DNA, 20 bp, Homo sapiens
gcactgtctcagtttcactt

SEQ ID NO: 832794 - DNA, 22 bp, Homo sapiens
gcactgtgaacctgggcactcc

SEQ ID NO: 832795 - DNA, 18 bp, Homo sapiens
gcactgtgaatcctggca

SEQ ID NO: 832796 - DNA, 19 bp, Homo sapiens
gcactgtgacccccagctc

SEQ ID NO: 832797 - DNA, 17 bp, Homo sapiens
gcactgttaatacacag

SEQ ID NO: 832798 - DNA, 21 bp, Homo sapiens
gcactgttacaagaggccatt

SEQ ID NO: 832799 - DNA, 15 bp, Homo sapiens
gcactgttccccctg

SEQ ID NO: 832800 - DNA, 18 bp, Homo sapiens
gcactgttccccctgtgc

SEQ ID NO: 832801 - DNA, 19 bp, Homo sapiens
gcactgttccccctgtgca

SEQ ID NO: 832802 - DNA, 19 bp, Homo sapiens
gcacttaagtcttccttaa

SEQ ID NO: 832803 - DNA, 18 bp, Homo sapiens
gcacttaagtgcactttt

SEQ ID NO: 832804 - DNA, 19 bp, Homo sapiens
gcacttaagtgcacttttt

SEQ ID NO: 832805 - DNA, 14 bp, Homo sapiens
gcacttaatggctg

SEQ ID NO: 832806 - DNA, 22 bp, Homo sapiens
gcacttactggtaggaccaagc

SEQ ID NO: 832807 - DNA, 19 bp, Homo sapiens
gcacttagctatcagaaga

SEQ ID NO: 832808 - DNA, 17 bp, Homo sapiens
gcacttattgaatatat

SEQ ID NO: 832809 - DNA, 18 bp, Homo sapiens
gcacttattgaatatatg

SEQ ID NO: 832810 - DNA, 21 bp, Homo sapiens
gcacttcagaattccatatct

SEQ ID NO: 832811 - DNA, 18 bp, Homo sapiens
gcacttcaggtccgtggg

SEQ ID NO: 832812 - DNA, 23 bp, Homo sapiens
gcacttcattgagagttttgtct

SEQ ID NO: 832813 - DNA, 21 bp, Homo sapiens
gcacttgagaaccagtctcct

SEQ ID NO: 832814 - DNA, 17 bp, Homo sapiens
gcacttgattcaggagg

SEQ ID NO: 832815 - DNA, 17 bp, Homo sapiens
gcacttgcagaggagcc

SEQ ID NO: 832816 - DNA, 21 bp, Homo sapiens
gcacttgcagaggagcccagt

SEQ ID NO: 832817 - DNA, 23 bp, Homo sapiens
gcacttgcagaggagcccagtgg

SEQ ID NO: 832818 - DNA, 14 bp, Homo sapiens
gcacttgcctggaa

SEQ ID NO: 832819 - DNA, 15 bp, Homo sapiens
gcacttgcgtcctgc

SEQ ID NO: 832820 - DNA, 18 bp, Homo sapiens
gcacttgcgtcctgcaga

SEQ ID NO: 832821 - DNA, 13 bp, Homo sapiens
gcacttggagcca

SEQ ID NO: 832822 - DNA, 22 bp, Homo sapiens
gcacttggagccaagggttcag

SEQ ID NO: 832823 - DNA, 17 bp, Homo sapiens
gcacttgtatttaattc

SEQ ID NO: 832824 - DNA, 22 bp, Homo sapiens
gcagagcacctttgcacaggat

SEQ ID NO: 832825 - DNA, 13 bp, Homo sapiens
gcagagcaggaag

SEQ ID NO: 832826 - DNA, 14 bp, Homo sapiens
gcagagcaggggca

SEQ ID NO: 832827 - DNA, 14 bp, Homo sapiens
gcagagccaaggcc

SEQ ID NO: 832828 - DNA, 16 bp, Homo sapiens
gcagagccaaggccac

SEQ ID NO: 832829 - DNA, 14 bp, Homo sapiens
gcagagccaggaag

SEQ ID NO: 832830 - DNA, 15 bp, Homo sapiens
gcagagccaggaaga

SEQ ID NO: 832831 - DNA, 12 bp, Homo sapiens
gcagagccaggc

SEQ ID NO: 832832 - DNA, 19 bp, Homo sapiens
gcagagcccaccagccagc

SEQ ID NO: 832833 - DNA, 20 bp, Homo sapiens
gcagagcccaccagccagcc

SEQ ID NO: 832834 - DNA, 23 bp, Homo sapiens
gcagagcccaccagccagccctg

SEQ ID NO: 832835 - DNA, 10 bp, Homo sapiens
gcagagccta

SEQ ID NO: 832836 - DNA, 12 bp, Homo sapiens
gcagagcctcct

SEQ ID NO: 832837 - DNA, 14 bp, Homo sapiens
gcagagcctgtccc

SEQ ID NO: 832838 - DNA, 19 bp, Homo sapiens
gcagagcctgtccccgcct

SEQ ID NO: 832839 - DNA, 14 bp, Homo sapiens
gcagagccttctca

SEQ ID NO: 832840 - DNA, 23 bp, Homo sapiens
gcagagccttctcagaagcacag

SEQ ID NO: 832841 - DNA, 21 bp, Homo sapiens
gcagagccttttacccctgca

SEQ ID NO: 832842 - DNA, 21 bp, Homo sapiens
gcagagcggggtcccctctgt

SEQ ID NO: 832843 - DNA, 22 bp, Homo sapiens
gcagagcggggtcccctctgtg

SEQ ID NO: 832844 - DNA, 19 bp, Homo sapiens
gcagagctctcccctcctg

SEQ ID NO: 832845 - DNA, 15 bp, Homo sapiens
gcagagctgagggcc

SEQ ID NO: 832846 - DNA, 18 bp, Homo sapiens
gcagagctgagggccctg

SEQ ID NO: 832847 - DNA, 19 bp, Homo sapiens
gcagagctgagggccctgt

SEQ ID NO: 832848 - DNA, 20 bp, Homo sapiens
gcagagctgagggccctgtg

SEQ ID NO: 832849 - DNA, 19 bp, Homo sapiens
gcagagctggagcccccag

SEQ ID NO: 832850 - DNA, 22 bp, Homo sapiens
gcagagctggagcccccagcag

SEQ ID NO: 832851 - DNA, 21 bp, Homo sapiens
gcagagctggggctgccagcc

SEQ ID NO: 832852 - DNA, 14 bp, Homo sapiens
gcagaggaccacag

SEQ ID NO: 832853 - DNA, 17 bp, Homo sapiens
gcagaggagcccagtgg

SEQ ID NO: 832854 - DNA, 21 bp, Homo sapiens
gcagaggaggggccgctgcca

SEQ ID NO: 832855 - DNA, 13 bp, Homo sapiens
gcagaggcagaat

SEQ ID NO: 832856 - DNA, 12 bp, Homo sapiens
gcagaggcagcg

SEQ ID NO: 832857 - DNA, 15 bp, Homo sapiens
gcagaggcaggctgg

SEQ ID NO: 832858 - DNA, 17 bp, Homo sapiens
gcagaggcaggctggga

SEQ ID NO: 832859 - DNA, 21 bp, Homo sapiens
gcagaggcaggctgggacgga

SEQ ID NO: 832860 - DNA, 14 bp, Homo sapiens
gcagaggcagtggc

SEQ ID NO: 832861 - DNA, 13 bp, Homo sapiens
gcagaggcctggg

SEQ ID NO: 832862 - DNA, 19 bp, Homo sapiens
gcagaggctggaggcaggg

SEQ ID NO: 832863 - DNA, 13 bp, Homo sapiens
gcagaggctggca

SEQ ID NO: 832864 - DNA, 14 bp, Homo sapiens
gcagaggctggcac

SEQ ID NO: 832865 - DNA, 15 bp, Homo sapiens
gcagaggctggcacc

SEQ ID NO: 832866 - DNA, 24 bp, Homo sapiens
gcagaggcttccgtgtcctctccc

SEQ ID NO: 832867 - DNA, 16 bp, Homo sapiens
gcagagggcgccacca

SEQ ID NO: 832868 - DNA, 22 bp, Homo sapiens
gcagagggcgccaccaccacct

SEQ ID NO: 832869 - DNA, 13 bp, Homo sapiens
gcagagggctgga

SEQ ID NO: 832870 - DNA, 14 bp, Homo sapiens
gcagagggctggag

SEQ ID NO: 832871 - DNA, 19 bp, Homo sapiens
gcagagggctggaggccca

SEQ ID NO: 832872 - DNA, 20 bp, Homo sapiens
gcagagggctggaggcccag

SEQ ID NO: 832873 - DNA, 21 bp, Homo sapiens
gcagagggctggaggcccagg

SEQ ID NO: 832874 - DNA, 19 bp, Homo sapiens
gcagaggggtaagagagga

SEQ ID NO: 832875 - DNA, 14 bp, Homo sapiens
gcagaggtcagact

SEQ ID NO: 832876 - DNA, 17 bp, Homo sapiens
gcagaggtcccagcccc

SEQ ID NO: 832877 - DNA, 18 bp, Homo sapiens
gcagaggtcccagcccca

SEQ ID NO: 832878 - DNA, 19 bp, Homo sapiens
gcagaggtcttcagggctc

SEQ ID NO: 832879 - DNA, 14 bp, Homo sapiens
gcagaggtggaaaa

SEQ ID NO: 832880 - DNA, 23 bp, Homo sapiens
gcagaggttttaatgtctgttta

SEQ ID NO: 832881 - DNA, 16 bp, Homo sapiens
gcagagtctgggcctc

SEQ ID NO: 832882 - DNA, 16 bp, Homo sapiens
gcagagtctgtctctt

SEQ ID NO: 832883 - DNA, 20 bp, Homo sapiens
gcagagtggcgtggcctccc

SEQ ID NO: 832884 - DNA, 21 bp, Homo sapiens
gcagagttaaatctcaaatag

SEQ ID NO: 832885 - DNA, 23 bp, Homo sapiens
gcagagttctcctggaggcaggg

SEQ ID NO: 832886 - DNA, 14 bp, Homo sapiens
gcagagttgtaaat

SEQ ID NO: 832887 - DNA, 23 bp, Homo sapiens
gcagagttgtaaatatataaata

SEQ ID NO: 832888 - DNA, 16 bp, Homo sapiens
gcagataatcagcctc

SEQ ID NO: 832889 - DNA, 18 bp, Homo sapiens
gcagataattctggacca

SEQ ID NO: 832890 - DNA, 22 bp, Homo sapiens
gcagataattctggaccagaga

SEQ ID NO: 832891 - DNA, 13 bp, Homo sapiens
gcagatagcccag

SEQ ID NO: 832892 - DNA, 22 bp, Homo sapiens
gcagatcatccgtctgtgtggg

SEQ ID NO: 832893 - DNA, 14 bp, Homo sapiens
gcagatctgtgccc

SEQ ID NO: 832894 - DNA, 20 bp, Homo sapiens
gcagatctgtgccccatgcc

SEQ ID NO: 832895 - DNA, 22 bp, Homo sapiens
gcagatctgtgccccatgcctg

SEQ ID NO: 832896 - DNA, 15 bp, Homo sapiens
gcagatctgtgcctg

SEQ ID NO: 832897 - DNA, 12 bp, Homo sapiens
gcagatcttttc

SEQ ID NO: 832898 - DNA, 13 bp, Homo sapiens
gcagatcttttct

SEQ ID NO: 832899 - DNA, 18 bp, Homo sapiens
gcagatcttttctttaaa

SEQ ID NO: 832900 - DNA, 14 bp, Homo sapiens
gcagatgactgaga

SEQ ID NO: 832901 - DNA, 14 bp, Homo sapiens
gcagatgaggggcc

SEQ ID NO: 832902 - DNA, 21 bp, Homo sapiens
gcagatgataaaaggaatctg

SEQ ID NO: 832903 - DNA, 14 bp, Homo sapiens
gcagatgccagtga

SEQ ID NO: 832904 - DNA, 17 bp, Homo sapiens
gcagatgctgctgaaga

SEQ ID NO: 832905 - DNA, 18 bp, Homo sapiens
gcagatgctgctgaagag

SEQ ID NO: 832906 - DNA, 22 bp, Homo sapiens
gcagatgctgtcactggcagag

SEQ ID NO: 832907 - DNA, 23 bp, Homo sapiens
gcagatggacagcgatgagggga

SEQ ID NO: 832908 - DNA, 12 bp, Homo sapiens
gcagatgggctg

SEQ ID NO: 832909 - DNA, 20 bp, Homo sapiens
gcagatgtcccccactgcta

SEQ ID NO: 832910 - DNA, 16 bp, Homo sapiens
gcagatgtcttccctg

SEQ ID NO: 832911 - DNA, 21 bp, Homo sapiens
gcagatgtcttccctgggctg

SEQ ID NO: 832912 - DNA, 22 bp, Homo sapiens
gcagatgtgagccaccgtgcct

SEQ ID NO: 832913 - DNA, 12 bp, Homo sapiens
gcagattccaca

SEQ ID NO: 832914 - DNA, 17 bp, Homo sapiens
gcagattgagacctaca

SEQ ID NO: 832915 - DNA, 20 bp, Homo sapiens
gcagattgtgtaacaatttt

SEQ ID NO: 832916 - DNA, 22 bp, Homo sapiens
gcagatttatttttgaaacaaa

SEQ ID NO: 832917 - DNA, 16 bp, Homo sapiens
gcagattttacagagc

SEQ ID NO: 832918 - DNA, 21 bp, Homo sapiens
gcagattttcagcaaactctt

SEQ ID NO: 832919 - DNA, 14 bp, Homo sapiens
gcagattttcttaa

SEQ ID NO: 832920 - DNA, 18 bp, Homo sapiens
gcagattttcttaaggaa

SEQ ID NO: 832921 - DNA, 21 bp, Homo sapiens
gcagcaaagaggggcgctgtc

SEQ ID NO: 832922 - DNA, 24 bp, Homo sapiens
gcagcaaagaggggcgctgtcctg

SEQ ID NO: 832923 - DNA, 15 bp, Homo sapiens
gcagcaagaagcagc

SEQ ID NO: 832924 - DNA, 11 bp, Homo sapiens
gcagcaaggct

SEQ ID NO: 832925 - DNA, 12 bp, Homo sapiens
gcagcaataaag

SEQ ID NO: 832926 - DNA, 23 bp, Homo sapiens
gcagcaatatattaccagcaaga

SEQ ID NO: 832927 - DNA, 12 bp, Homo sapiens
gcagcaatttaa

SEQ ID NO: 832928 - DNA, 13 bp, Homo sapiens
gcagcacaattct

SEQ ID NO: 832929 - DNA, 17 bp, Homo sapiens
gcagcacaattctgtcc

SEQ ID NO: 832930 - DNA, 16 bp, Homo sapiens
gcagcacacctctggg

SEQ ID NO: 832931 - DNA, 13 bp, Homo sapiens
gcagcacagccca

SEQ ID NO: 832932 - DNA, 15 bp, Homo sapiens
gcagcacagcccagg

SEQ ID NO: 832933 - DNA, 17 bp, Homo sapiens
gcagcacatgcgggctc

SEQ ID NO: 832934 - DNA, 17 bp, Homo sapiens
gcagcaccaaccacagc

SEQ ID NO: 832935 - DNA, 14 bp, Homo sapiens
gcagcaccacactg

SEQ ID NO: 832936 - DNA, 14 bp, Homo sapiens
gcagcaccaccaca

SEQ ID NO: 832937 - DNA, 17 bp, Homo sapiens
gcagcaccctataaatc

SEQ ID NO: 832938 - DNA, 15 bp, Homo sapiens
gcagcaccctccccc

SEQ ID NO: 832939 - DNA, 20 bp, Homo sapiens
gcagcaccctcccccgcagc

SEQ ID NO: 832940 - DNA, 21 bp, Homo sapiens
gcagcacccttctcggagacc

SEQ ID NO: 832941 - DNA, 19 bp, Homo sapiens
gcagcaccgttctgtgcac

SEQ ID NO: 832942 - DNA, 15 bp, Homo sapiens
gcagcacctccaggc

SEQ ID NO: 832943 - DNA, 12 bp, Homo sapiens
gcagcacctcct

SEQ ID NO: 832944 - DNA, 16 bp, Homo sapiens
gcagcacctctcagga

SEQ ID NO: 832945 - DNA, 15 bp, Homo sapiens
gcagcacctttctct

SEQ ID NO: 832946 - DNA, 16 bp, Homo sapiens
gcagggtcaagcctct

SEQ ID NO: 832947 - DNA, 15 bp, Homo sapiens
gcagggtcaggagag

SEQ ID NO: 832948 - DNA, 15 bp, Homo sapiens
gcagggtccacgcct

SEQ ID NO: 832949 - DNA, 21 bp, Homo sapiens
gcagggtcccatttctcactg

SEQ ID NO: 832950 - DNA, 16 bp, Homo sapiens
gcagggtctgggctgg

SEQ ID NO: 832951 - DNA, 13 bp, Homo sapiens
gcagggtcttgct

SEQ ID NO: 832952 - DNA, 19 bp, Homo sapiens
gcagggtgacgcctgagac

SEQ ID NO: 832953 - DNA, 14 bp, Homo sapiens
gcagggtgagaagc

SEQ ID NO: 832954 - DNA, 22 bp, Homo sapiens
gcagggtgcagtatcatgccct

SEQ ID NO: 832955 - DNA, 15 bp, Homo sapiens
gcagggtgggagccg

SEQ ID NO: 832956 - DNA, 21 bp, Homo sapiens
gcagggtggggtctgggaggg

SEQ ID NO: 832957 - DNA, 23 bp, Homo sapiens
gcagggtggggtctgggaggggg

SEQ ID NO: 832958 - DNA, 17 bp, Homo sapiens
gcagggtggtgctggga

SEQ ID NO: 832959 - DNA, 19 bp, Homo sapiens
gcagggtggtgctgggact

SEQ ID NO: 832960 - DNA, 21 bp, Homo sapiens
gcagggtggtggtattctgtc

SEQ ID NO: 832961 - DNA, 15 bp, Homo sapiens
gcagggtgtgtactg

SEQ ID NO: 832962 - DNA, 18 bp, Homo sapiens
gcagggttacacaaaaat

SEQ ID NO: 832963 - DNA, 15 bp, Homo sapiens
gcaggtaataataaa

SEQ ID NO: 832964 - DNA, 19 bp, Homo sapiens
gcaggtaataataaaggtt

SEQ ID NO: 832965 - DNA, 23 bp, Homo sapiens
gcaggtacttcctcctgatggcc

SEQ ID NO: 832966 - DNA, 22 bp, Homo sapiens
gcaggtagatcgcttgagccca

SEQ ID NO: 832967 - DNA, 23 bp, Homo sapiens
gcaggtagatcgcttgagcccag

SEQ ID NO: 832968 - DNA, 13 bp, Homo sapiens
gcaggtcacagaa

SEQ ID NO: 832969 - DNA, 16 bp, Homo sapiens
gcaggtcactgtcact

SEQ ID NO: 832970 - DNA, 14 bp, Homo sapiens
gcaggtcctgccca

SEQ ID NO: 832971 - DNA, 23 bp, Homo sapiens
gcaggtctgcaagggcccagagt

SEQ ID NO: 832972 - DNA, 17 bp, Homo sapiens
gcaggtgactgtgctgt

SEQ ID NO: 832973 - DNA, 18 bp, Homo sapiens
gcaggtgcagatgggctg

SEQ ID NO: 832974 - DNA, 17 bp, Homo sapiens
gcaggtgctggtcccgg

SEQ ID NO: 832975 - DNA, 17 bp, Homo sapiens
gcaggtgctgtgcgcct

SEQ ID NO: 832976 - DNA, 19 bp, Homo sapiens
gcaggtggatctatttcat

SEQ ID NO: 832977 - DNA, 20 bp, Homo sapiens
gcaggtggatctatttcatg

SEQ ID NO: 832978 - DNA, 17 bp, Homo sapiens
gcaggtggccgcccctg

SEQ ID NO: 832979 - DNA, 20 bp, Homo sapiens
gcaggtggccgcccctgagg

SEQ ID NO: 832980 - DNA, 22 bp, Homo sapiens
gcaggtggccgcccctgaggct

SEQ ID NO: 832981 - DNA, 21 bp, Homo sapiens
gcaggtggggagactgggctg

SEQ ID NO: 832982 - DNA, 13 bp, Homo sapiens
gcaggtggggagg

SEQ ID NO: 832983 - DNA, 19 bp, Homo sapiens
gcaggtgggggtgggctgc

SEQ ID NO: 832984 - DNA, 22 bp, Homo sapiens
gcaggtgggtgctgccctgtgt

SEQ ID NO: 832985 - DNA, 15 bp, Homo sapiens
gcaggtggtcctgag

SEQ ID NO: 832986 - DNA, 18 bp, Homo sapiens
gcaggtggtggaggggcg

SEQ ID NO: 832987 - DNA, 14 bp, Homo sapiens
gcaggtggtggcac

SEQ ID NO: 832988 - DNA, 13 bp, Homo sapiens
gcaggtgtcatat

SEQ ID NO: 832989 - DNA, 21 bp, Homo sapiens
gcaggtgtcatatgactgatt

SEQ ID NO: 832990 - DNA, 19 bp, Homo sapiens
gcaggtgtggtggctcatg

SEQ ID NO: 832991 - DNA, 14 bp, Homo sapiens
gcaggttagaagaa

SEQ ID NO: 832992 - DNA, 15 bp, Homo sapiens
gcaggttcccaagct

SEQ ID NO: 832993 - DNA, 22 bp, Homo sapiens
gcaggttcttcttcctgaagct

SEQ ID NO: 832994 - DNA, 14 bp, Homo sapiens
gcaggttcttgatg

SEQ ID NO: 832995 - DNA, 23 bp, Homo sapiens
gcaggttcttgatgtcatgtact

SEQ ID NO: 832996 - DNA, 13 bp, Homo sapiens
gcaggttcttgtt

SEQ ID NO: 832997 - DNA, 19 bp, Homo sapiens
gcaggttgaggggctcctg

SEQ ID NO: 832998 - DNA, 22 bp, Homo sapiens
gcaggttgaggggctcctggaa

SEQ ID NO: 832999 - DNA, 13 bp, Homo sapiens
gcaggttggatgg

SEQ ID NO: 833000 - DNA, 23 bp, Homo sapiens
gcaggttggatgggagtgggcac

SEQ ID NO: 833001 - DNA, 16 bp, Homo sapiens
gcaggtttcatttctt

SEQ ID NO: 833002 - DNA, 20 bp, Homo sapiens
gcaggtttgtaatgcaaaag

SEQ ID NO: 833003 - DNA, 15 bp, Homo sapiens
gcagtaaaacacatt

SEQ ID NO: 833004 - DNA, 13 bp, Homo sapiens
gcagtaaatactt

SEQ ID NO: 833005 - DNA, 20 bp, Homo sapiens
gcagtaaatacttgcagttg

SEQ ID NO: 833006 - DNA, 22 bp, Homo sapiens
gcagtaaatacttgcagttgtg

SEQ ID NO: 833007 - DNA, 18 bp, Homo sapiens
gcagtaagtcttttttga

SEQ ID NO: 833008 - DNA, 21 bp, Homo sapiens
gcagtaatattttaagatgga

SEQ ID NO: 833009 - DNA, 19 bp, Homo sapiens
gcagtagaaataatatgca

SEQ ID NO: 833010 - DNA, 20 bp, Homo sapiens
gcagtagaaataatatgcat

SEQ ID NO: 833011 - DNA, 21 bp, Homo sapiens
gcagtagaaataatatgcatt

SEQ ID NO: 833012 - DNA, 21 bp, Homo sapiens
gcagtagaggctatggacagg

SEQ ID NO: 833013 - DNA, 12 bp, Homo sapiens
gcagtatcatga

SEQ ID NO: 833014 - DNA, 15 bp, Homo sapiens
gcagtatcatgaagc

SEQ ID NO: 833015 - DNA, 12 bp, Homo sapiens
gcagtatgtgat

SEQ ID NO: 833016 - DNA, 18 bp, Homo sapiens
gcagtatgtgatggactg

SEQ ID NO: 833017 - DNA, 18 bp, Homo sapiens
gcagtcacaacagagtga

SEQ ID NO: 833018 - DNA, 17 bp, Homo sapiens
gcagtcaccacccagcc

SEQ ID NO: 833019 - DNA, 20 bp, Homo sapiens
gcagtcaccacccagccctt

SEQ ID NO: 833020 - DNA, 22 bp, Homo sapiens
gcagtcaccacccagcccttcc

SEQ ID NO: 833021 - DNA, 14 bp, Homo sapiens
gcagtcactggagg

SEQ ID NO: 833022 - DNA, 20 bp, Homo sapiens
gcagtcaggggtcaggtgtc

SEQ ID NO: 833023 - DNA, 19 bp, Homo sapiens
gcagtcagtgtttctttta

SEQ ID NO: 833024 - DNA, 17 bp, Homo sapiens
gcagtcatctacttttt

SEQ ID NO: 833025 - DNA, 14 bp, Homo sapiens
gcagtccagagctt

SEQ ID NO: 833026 - DNA, 20 bp, Homo sapiens
gcagtccaggcctctctctg

SEQ ID NO: 833027 - DNA, 14 bp, Homo sapiens
gcagtcccacactg

SEQ ID NO: 833028 - DNA, 20 bp, Homo sapiens
gcagtcccattcatattaag

SEQ ID NO: 833029 - DNA, 22 bp, Homo sapiens
gcagtccccagcccttctgcct

SEQ ID NO: 833030 - DNA, 17 bp, Homo sapiens
gcagtcctgaggagagg

SEQ ID NO: 833031 - DNA, 19 bp, Homo sapiens
gcagtcctgatcagagccg

SEQ ID NO: 833032 - DNA, 17 bp, Homo sapiens
gcagtcctgcctcagcc

SEQ ID NO: 833033 - DNA, 22 bp, Homo sapiens
gcagtcgcaggatccgctgcca

SEQ ID NO: 833034 - DNA, 23 bp, Homo sapiens
gcagtcgcaggatccgctgccac

SEQ ID NO: 833035 - DNA, 20 bp, Homo sapiens
gcagtcgggggctggcctag

SEQ ID NO: 833036 - DNA, 15 bp, Homo sapiens
gcagtcgtgcctgtg

SEQ ID NO: 833037 - DNA, 13 bp, Homo sapiens
gcagtctaccctg

SEQ ID NO: 833038 - DNA, 22 bp, Homo sapiens
gcagtctctatattatgtcttc

SEQ ID NO: 833039 - DNA, 14 bp, Homo sapiens
gcagtctgaaccct

SEQ ID NO: 833040 - DNA, 15 bp, Homo sapiens
gcagtctgctctgct

SEQ ID NO: 833041 - DNA, 16 bp, Homo sapiens
gcagtctgctctgctg

SEQ ID NO: 833042 - DNA, 14 bp, Homo sapiens
gcagtcttgctctg

SEQ ID NO: 833043 - DNA, 12 bp, Homo sapiens
gcagtgaaactt

SEQ ID NO: 833044 - DNA, 16 bp, Homo sapiens
gcagtgaaacttgtgc

SEQ ID NO: 833045 - DNA, 14 bp, Homo sapiens
gcagtgaattgtga

SEQ ID NO: 833046 - DNA, 21 bp, Homo sapiens
gcagtgaattgtgaccaagtt

SEQ ID NO: 833047 - DNA, 18 bp, Homo sapiens
gcagtgaatttgaataaa

SEQ ID NO: 833048 - DNA, 14 bp, Homo sapiens
gcagtgactggcag

SEQ ID NO: 833049 - DNA, 12 bp, Homo sapiens
gcagtgactttg

SEQ ID NO: 833050 - DNA, 15 bp, Homo sapiens
gcagtgactttgtat

SEQ ID NO: 833051 - DNA, 23 bp, Homo sapiens
gcagtgagaaaaagctcctgtcc

SEQ ID NO: 833052 - DNA, 15 bp, Homo sapiens
gcagtgagcagggtg

SEQ ID NO: 833053 - DNA, 21 bp, Homo sapiens
gcagtgagccgcatcttctcc

SEQ ID NO: 833054 - DNA, 22 bp, Homo sapiens
gcagtgagtcgagattgcactg

SEQ ID NO: 833055 - DNA, 19 bp, Homo sapiens
gcagtgagttacagcgaga

SEQ ID NO: 833056 - DNA, 18 bp, Homo sapiens
gcagtgatctcagggcag

SEQ ID NO: 833057 - DNA, 19 bp, Homo sapiens
gcagtgcaatgcttgtaga

SEQ ID NO: 833058 - DNA, 12 bp, Homo sapiens
gcagtgcatgca

SEQ ID NO: 833059 - DNA, 16 bp, Homo sapiens
gcagtgcatgcatgtt

SEQ ID NO: 833060 - DNA, 22 bp, Homo sapiens
gcagtgcatgtgaagcatgctt

SEQ ID NO: 833061 - DNA, 16 bp, Homo sapiens
gcagtgccacagcctg

SEQ ID NO: 833062 - DNA, 17 bp, Homo sapiens
gcagtgccacagcctgc

SEQ ID NO: 833063 - DNA, 18 bp, Homo sapiens
gcagtgccacagcctgct

SEQ ID NO: 833064 - DNA, 24 bp, Homo sapiens
gcagtgccacagcctgctggcagg

SEQ ID NO: 833065 - DNA, 15 bp, Homo sapiens
gcagtgccccaggga

SEQ ID NO: 833066 - DNA, 17 bp, Homo sapiens
gcagtgcctcgaggcac

SEQ ID NO: 833067 - DNA, 18 bp, Homo sapiens
gcatgagtatctgtggga

SEQ ID NO: 833068 - DNA, 23 bp, Homo sapiens
gcatgatagacacatatgagggg

SEQ ID NO: 833069 - DNA, 15 bp, Homo sapiens
gcatgatatcttcaa

SEQ ID NO: 833070 - DNA, 22 bp, Homo sapiens
gcatgatattgttctccaagga

SEQ ID NO: 833071 - DNA, 20 bp, Homo sapiens
gcatgatcttgttactgtga

SEQ ID NO: 833072 - DNA, 19 bp, Homo sapiens
gcatgatgggaaaatattt

SEQ ID NO: 833073 - DNA, 20 bp, Homo sapiens
gcatgatgttaaccagaata

SEQ ID NO: 833074 - DNA, 13 bp, Homo sapiens
gcatgatgtttgc

SEQ ID NO: 833075 - DNA, 18 bp, Homo sapiens
gcatgatgtttgcccaaa

SEQ ID NO: 833076 - DNA, 17 bp, Homo sapiens
gcatgattcttctcttg

SEQ ID NO: 833077 - DNA, 17 bp, Homo sapiens
gcatgatttatatatgg

SEQ ID NO: 833078 - DNA, 22 bp, Homo sapiens
gcatgatttatatatggcatat

SEQ ID NO: 833079 - DNA, 17 bp, Homo sapiens
gcatgcaataatgtgca

SEQ ID NO: 833080 - DNA, 17 bp, Homo sapiens
gcatgcacacggctggt

SEQ ID NO: 833081 - DNA, 21 bp, Homo sapiens
gcatgcacacggctggtcact

SEQ ID NO: 833082 - DNA, 16 bp, Homo sapiens
gcatgcacagctgctt

SEQ ID NO: 833083 - DNA, 22 bp, Homo sapiens
gcatgcacagctgcttgtcctg

SEQ ID NO: 833084 - DNA, 14 bp, Homo sapiens
gcatgcacagctgt

SEQ ID NO: 833085 - DNA, 18 bp, Homo sapiens
gcatgcacgggcatgcac

SEQ ID NO: 833086 - DNA, 21 bp, Homo sapiens
gcatgcactgttccccctgtg

SEQ ID NO: 833087 - DNA, 23 bp, Homo sapiens
gcatgcactgttccccctgtgca

SEQ ID NO: 833088 - DNA, 14 bp, Homo sapiens
gcatgcagctgcct

SEQ ID NO: 833089 - DNA, 20 bp, Homo sapiens
gcatgcagctgcctggggcc

SEQ ID NO: 833090 - DNA, 15 bp, Homo sapiens
gcatgcattttgcag

SEQ ID NO: 833091 - DNA, 21 bp, Homo sapiens
gcatgcattttgcagcagtga

SEQ ID NO: 833092 - DNA, 13 bp, Homo sapiens
gcatgccaccctc

SEQ ID NO: 833093 - DNA, 18 bp, Homo sapiens
gcatgccaccctcacaca

SEQ ID NO: 833094 - DNA, 13 bp, Homo sapiens
gcatgccaggacc

SEQ ID NO: 833095 - DNA, 11 bp, Homo sapiens
gcatgccaggc

SEQ ID NO: 833096 - DNA, 18 bp, Homo sapiens
gcatgccccttggctgga

SEQ ID NO: 833097 - DNA, 23 bp, Homo sapiens
gcatgccgggcccctccatccac

SEQ ID NO: 833098 - DNA, 14 bp, Homo sapiens
gcatgcgaaatgtt

SEQ ID NO: 833099 - DNA, 14 bp, Homo sapiens
gcatgcgcacaagg

SEQ ID NO: 833100 - DNA, 21 bp, Homo sapiens
gcatgcgccaccatgccctat

SEQ ID NO: 833101 - DNA, 17 bp, Homo sapiens
gcatgcggagccagcag

SEQ ID NO: 833102 - DNA, 15 bp, Homo sapiens
gcatgctcagtgcct

SEQ ID NO: 833103 - DNA, 22 bp, Homo sapiens
gcatgctctctgcagccagccc

SEQ ID NO: 833104 - DNA, 21 bp, Homo sapiens
gcatgctgcccagccactcca

SEQ ID NO: 833105 - DNA, 12 bp, Homo sapiens
gcatgcttcctt

SEQ ID NO: 833106 - DNA, 16 bp, Homo sapiens
gcatgcttcctttctc

SEQ ID NO: 833107 - DNA, 17 bp, Homo sapiens
gcatgcttcctttctct

SEQ ID NO: 833108 - DNA, 18 bp, Homo sapiens
gcatgcttcctttctctc

SEQ ID NO: 833109 - DNA, 20 bp, Homo sapiens
gcatgcttgggctgacccag

SEQ ID NO: 833110 - DNA, 14 bp, Homo sapiens
gcatgctttgctgc

SEQ ID NO: 833111 - DNA, 23 bp, Homo sapiens
gcatgctttgctgctatgaaaat

SEQ ID NO: 833112 - DNA, 16 bp, Homo sapiens
gcatggaaaaatggtt

SEQ ID NO: 833113 - DNA, 23 bp, Homo sapiens
gcatggaaaaatggttgatggaa

SEQ ID NO: 833114 - DNA, 13 bp, Homo sapiens
gcatggaaatcag

SEQ ID NO: 833115 - DNA, 23 bp, Homo sapiens
gcatggaaatttaaagcaggttc

SEQ ID NO: 833116 - DNA, 11 bp, Homo sapiens
gcatggaaggg

SEQ ID NO: 833117 - DNA, 11 bp, Homo sapiens
gcatggaagtt

SEQ ID NO: 833118 - DNA, 14 bp, Homo sapiens
gcatggagcctgga

SEQ ID NO: 833119 - DNA, 16 bp, Homo sapiens
gcatggaggccctcct

SEQ ID NO: 833120 - DNA, 23 bp, Homo sapiens
gcatggagtgtgtattgttccca

SEQ ID NO: 833121 - DNA, 20 bp, Homo sapiens
gcatggatatagttttactt

SEQ ID NO: 833122 - DNA, 15 bp, Homo sapiens
gcatggatttctttg

SEQ ID NO: 833123 - DNA, 16 bp, Homo sapiens
gcatggatttctttga

SEQ ID NO: 833124 - DNA, 18 bp, Homo sapiens
gcatggcaaatcaggggc

SEQ ID NO: 833125 - DNA, 19 bp, Homo sapiens
gcatggcaaatcaggggcc

SEQ ID NO: 833126 - DNA, 20 bp, Homo sapiens
gcatggcaaatcaggggcca

SEQ ID NO: 833127 - DNA, 22 bp, Homo sapiens
gcatggcaaatcaggggccaga

SEQ ID NO: 833128 - DNA, 16 bp, Homo sapiens
gcatggcaattctgga

SEQ ID NO: 833129 - DNA, 18 bp, Homo sapiens
gcatggcaattctggaag

SEQ ID NO: 833130 - DNA, 19 bp, Homo sapiens
gcatggcaattctggaagc

SEQ ID NO: 833131 - DNA, 16 bp, Homo sapiens
gcatggcagggcctca

SEQ ID NO: 833132 - DNA, 13 bp, Homo sapiens
gcatggccaggtg

SEQ ID NO: 833133 - DNA, 14 bp, Homo sapiens
gcatggccaggtgg

SEQ ID NO: 833134 - DNA, 17 bp, Homo sapiens
gcatggccaggtggcca

SEQ ID NO: 833135 - DNA, 15 bp, Homo sapiens
gcatggctattttat

SEQ ID NO: 833136 - DNA, 19 bp, Homo sapiens
gcatggctccagaaatgtc

SEQ ID NO: 833137 - DNA, 13 bp, Homo sapiens
gcatggctgtctg

SEQ ID NO: 833138 - DNA, 17 bp, Homo sapiens
gcatggctttatttgtt

SEQ ID NO: 833139 - DNA, 15 bp, Homo sapiens
gcatgggcattgcag

SEQ ID NO: 833140 - DNA, 18 bp, Homo sapiens
gcatgggcattgcagcct

SEQ ID NO: 833141 - DNA, 18 bp, Homo sapiens
gcatgggcctctctgggg

SEQ ID NO: 833142 - DNA, 19 bp, Homo sapiens
gcatgggcctctctggggg

SEQ ID NO: 833143 - DNA, 23 bp, Homo sapiens
gcatgggcctctctgggggaggc

SEQ ID NO: 833144 - DNA, 17 bp, Homo sapiens
gcatgggcgcaggccca

SEQ ID NO: 833145 - DNA, 15 bp, Homo sapiens
gcatggggaggcagc

SEQ ID NO: 833146 - DNA, 18 bp, Homo sapiens
gcatggggcagaggcttc

SEQ ID NO: 833147 - DNA, 16 bp, Homo sapiens
gcatggggcatgtcct

SEQ ID NO: 833148 - DNA, 21 bp, Homo sapiens
gcatgggggcaccgggctcca

SEQ ID NO: 833149 - DNA, 23 bp, Homo sapiens
gcatgggggcaccgggctccatg

SEQ ID NO: 833150 - DNA, 18 bp, Homo sapiens
gcatggggggtgggggga

SEQ ID NO: 833151 - DNA, 21 bp, Homo sapiens
gcatgggtgaagggagagcca

SEQ ID NO: 833152 - DNA, 15 bp, Homo sapiens
gcatgggtgtgccct

SEQ ID NO: 833153 - DNA, 15 bp, Homo sapiens
gcatggtcacacact

SEQ ID NO: 833154 - DNA, 19 bp, Homo sapiens
gcatggtggcgcaagcctg

SEQ ID NO: 833155 - DNA, 16 bp, Homo sapiens
gcatggtggctcatgc

SEQ ID NO: 833156 - DNA, 18 bp, Homo sapiens
gcatgtaccatttgcatg

SEQ ID NO: 833157 - DNA, 20 bp, Homo sapiens
gcatgtactctgttgagtaa

SEQ ID NO: 833158 - DNA, 23 bp, Homo sapiens
gcatgtacttgaaggatggatga

SEQ ID NO: 833159 - DNA, 19 bp, Homo sapiens
gcatgtattagctcactga

SEQ ID NO: 833160 - DNA, 19 bp, Homo sapiens
gcatgtattatcacatcaa

SEQ ID NO: 833161 - DNA, 16 bp, Homo sapiens
gcatgtattggcctgg

SEQ ID NO: 833162 - DNA, 20 bp, Homo sapiens
gcatgtattggcctggaggt

SEQ ID NO: 833163 - DNA, 18 bp, Homo sapiens
gcatgtatttttgtcaat

SEQ ID NO: 833164 - DNA, 16 bp, Homo sapiens
gcatgtcccacccacc

SEQ ID NO: 833165 - DNA, 23 bp, Homo sapiens
gcatgtccctaccgagtctcttc

SEQ ID NO: 833166 - DNA, 22 bp, Homo sapiens
gcatgtcctttccatctgtcca

SEQ ID NO: 833167 - DNA, 13 bp, Homo sapiens
gcatgtctctgct

SEQ ID NO: 833168 - DNA, 13 bp, Homo sapiens
gcatgtcttaaat

SEQ ID NO: 833169 - DNA, 19 bp, Homo sapiens
gcatgtcttaaatgctcat

SEQ ID NO: 833170 - DNA, 17 bp, Homo sapiens
gcatgtgaagcatgctt

SEQ ID NO: 833171 - DNA, 19 bp, Homo sapiens
gcatgtgaagcatgctttg

SEQ ID NO: 833172 - DNA, 13 bp, Homo sapiens
gcatgtgatctcc

SEQ ID NO: 833173 - DNA, 12 bp, Homo sapiens
gcatgtgccaag

SEQ ID NO: 833174 - DNA, 13 bp, Homo sapiens
gcatgtgccaaga

SEQ ID NO: 833175 - DNA, 21 bp, Homo sapiens
gcatgtgccaagattctactc

SEQ ID NO: 833176 - DNA, 22 bp, Homo sapiens
gcatgtgcggctgaactgagaa

SEQ ID NO: 833177 - DNA, 22 bp, Homo sapiens
gcatgtgctgtctccatgctgg

SEQ ID NO: 833178 - DNA, 12 bp, Homo sapiens
gcatgtggcctg

SEQ ID NO: 833179 - DNA, 14 bp, Homo sapiens
gcatgtggcttctc

SEQ ID NO: 833180 - DNA, 12 bp, Homo sapiens
gcatgtgtatgt

SEQ ID NO: 833181 - DNA, 13 bp, Homo sapiens
gcatgtgtgcctg

SEQ ID NO: 833182 - DNA, 14 bp, Homo sapiens
gcatgtgtgcctgt

SEQ ID NO: 833183 - DNA, 20 bp, Homo sapiens
gcatgtgtgcctgtggcaga

SEQ ID NO: 833184 - DNA, 19 bp, Homo sapiens
gcatgtgtgcgagtgtgtg

SEQ ID NO: 833185 - DNA, 19 bp, Homo sapiens
gcatgtgtgtgtctgtctt

SEQ ID NO: 833186 - DNA, 13 bp, Homo sapiens
gcatgtgtgtgtg

SEQ ID NO: 833187 - DNA, 19 bp, Homo sapiens
gcatgtgtttggttctggg

SEQ ID NO: 833188 - DNA, 18 bp, Homo sapiens
gcatgttacctcctataa

SEQ ID NO: 833189 - DNA, 13 bp, Homo sapiens
gccaaggagctgc

SEQ ID NO: 833190 - DNA, 14 bp, Homo sapiens
gccaaggagctgct

SEQ ID NO: 833191 - DNA, 16 bp, Homo sapiens
gccaaggagctgctat

SEQ ID NO: 833192 - DNA, 21 bp, Homo sapiens
gccaaggagctgctatagcct

SEQ ID NO: 833193 - DNA, 23 bp, Homo sapiens
gccaaggagctgctatagcctgg

SEQ ID NO: 833194 - DNA, 19 bp, Homo sapiens
gccaaggaggcctggggag

SEQ ID NO: 833195 - DNA, 20 bp, Homo sapiens
gccaaggaggtgaggagcag

SEQ ID NO: 833196 - DNA, 14 bp, Homo sapiens
gccaaggaggtggg

SEQ ID NO: 833197 - DNA, 21 bp, Homo sapiens
gccaaggagtcactgagacca

SEQ ID NO: 833198 - DNA, 16 bp, Homo sapiens
gccaaggcagaggcct

SEQ ID NO: 833199 - DNA, 18 bp, Homo sapiens
gccaaggccgaagctctg

SEQ ID NO: 833200 - DNA, 15 bp, Homo sapiens
gccaaggccgccagc

SEQ ID NO: 833201 - DNA, 14 bp, Homo sapiens
gccaaggccttctc

SEQ ID NO: 833202 - DNA, 18 bp, Homo sapiens
gccaaggccttctcctcc

SEQ ID NO: 833203 - DNA, 15 bp, Homo sapiens
gccaaggctctcccc

SEQ ID NO: 833204 - DNA, 17 bp, Homo sapiens
gccaaggctctcccctc

SEQ ID NO: 833205 - DNA, 21 bp, Homo sapiens
gccaaggctgggggaagaagc

SEQ ID NO: 833206 - DNA, 13 bp, Homo sapiens
gccaagggaggga

SEQ ID NO: 833207 - DNA, 17 bp, Homo sapiens
gccaagggagggaaggg

SEQ ID NO: 833208 - DNA, 21 bp, Homo sapiens
gccaagggagggaagggccac

SEQ ID NO: 833209 - DNA, 22 bp, Homo sapiens
gccaagggcaacagatcagtaa

SEQ ID NO: 833210 - DNA, 20 bp, Homo sapiens
gccaagggcccaaagaaaga

SEQ ID NO: 833211 - DNA, 14 bp, Homo sapiens
gccaagggccccag

SEQ ID NO: 833212 - DNA, 16 bp, Homo sapiens
gccaagggccccaggg

SEQ ID NO: 833213 - DNA, 21 bp, Homo sapiens
gccaaggggagtcaccttccc

SEQ ID NO: 833214 - DNA, 16 bp, Homo sapiens
gccaaggggctgcgct

SEQ ID NO: 833215 - DNA, 20 bp, Homo sapiens
gccaagggggtgactggaag

SEQ ID NO: 833216 - DNA, 22 bp, Homo sapiens
gccaaggtagccatcccatgaa

SEQ ID NO: 833217 - DNA, 20 bp, Homo sapiens
gccaaggtgaatagcacagg

SEQ ID NO: 833218 - DNA, 23 bp, Homo sapiens
gccaaggtgggaggattgcttga

SEQ ID NO: 833219 - DNA, 18 bp, Homo sapiens
gccaaggtgggctgagcc

SEQ ID NO: 833220 - DNA, 18 bp, Homo sapiens
gccaaggtgtccagggtc

SEQ ID NO: 833221 - DNA, 22 bp, Homo sapiens
gccaaggtgtccagggtcctct

SEQ ID NO: 833222 - DNA, 16 bp, Homo sapiens
gccaagtaaacagggt

SEQ ID NO: 833223 - DNA, 19 bp, Homo sapiens
gccaagtaaacagggtacc

SEQ ID NO: 833224 - DNA, 16 bp, Homo sapiens
gccaagtaagaaagtg

SEQ ID NO: 833225 - DNA, 22 bp, Homo sapiens
gccaagtcagctttgccttcca

SEQ ID NO: 833226 - DNA, 14 bp, Homo sapiens
gccaagtccagatt

SEQ ID NO: 833227 - DNA, 13 bp, Homo sapiens
gccaagtgcctgc

SEQ ID NO: 833228 - DNA, 18 bp, Homo sapiens
gccaagtgcgtgccgtgt

SEQ ID NO: 833229 - DNA, 23 bp, Homo sapiens
gccaagtgcgtgccgtgtgagtg

SEQ ID NO: 833230 - DNA, 22 bp, Homo sapiens
gccaagtggacagtctggccac

SEQ ID NO: 833231 - DNA, 19 bp, Homo sapiens
gccaagtggacttggagct

SEQ ID NO: 833232 - DNA, 13 bp, Homo sapiens
gccaagtggggtg

SEQ ID NO: 833233 - DNA, 18 bp, Homo sapiens
gccaagtggggtgctggg

SEQ ID NO: 833234 - DNA, 23 bp, Homo sapiens
gccaagtggggtgctgggaggag

SEQ ID NO: 833235 - DNA, 21 bp, Homo sapiens
gccaagttcctctagtgccct

SEQ ID NO: 833236 - DNA, 15 bp, Homo sapiens
gccaagttgctgtca

SEQ ID NO: 833237 - DNA, 18 bp, Homo sapiens
gccaagttgctgtcactg

SEQ ID NO: 833238 - DNA, 20 bp, Homo sapiens
gccaagttgctgtcactgtt

SEQ ID NO: 833239 - DNA, 17 bp, Homo sapiens
gccaagtttatatacaa

SEQ ID NO: 833240 - DNA, 15 bp, Homo sapiens
gccaataaaaagttc

SEQ ID NO: 833241 - DNA, 17 bp, Homo sapiens
gccaatatgtattgtaa

SEQ ID NO: 833242 - DNA, 18 bp, Homo sapiens
gccaatcccctccttggg

SEQ ID NO: 833243 - DNA, 21 bp, Homo sapiens
gccaatcccctccttgggcac

SEQ ID NO: 833244 - DNA, 17 bp, Homo sapiens
gccaatgatgtgaccct

SEQ ID NO: 833245 - DNA, 22 bp, Homo sapiens
gccaatgctgtacgtactgcat

SEQ ID NO: 833246 - DNA, 16 bp, Homo sapiens
gccaatggtgcttccc

SEQ ID NO: 833247 - DNA, 12 bp, Homo sapiens
gccaatgtgggc

SEQ ID NO: 833248 - DNA, 18 bp, Homo sapiens
gccaatgtgggctgcccc

SEQ ID NO: 833249 - DNA, 17 bp, Homo sapiens
gccaattcagacaggca

SEQ ID NO: 833250 - DNA, 16 bp, Homo sapiens
gccaatttcctctcca

SEQ ID NO: 833251 - DNA, 12 bp, Homo sapiens
gccaatttgtct

SEQ ID NO: 833252 - DNA, 22 bp, Homo sapiens
gccaatttgtctcctactctgt

SEQ ID NO: 833253 - DNA, 15 bp, Homo sapiens
gccacaaaaacaggt

SEQ ID NO: 833254 - DNA, 20 bp, Homo sapiens
gccacaaaccaccaggactg

SEQ ID NO: 833255 - DNA, 22 bp, Homo sapiens
gccacaaatcaaagcaagggct

SEQ ID NO: 833256 - DNA, 17 bp, Homo sapiens
gccacaagctgcactgt

SEQ ID NO: 833257 - DNA, 21 bp, Homo sapiens
gccacaagctgcactgtgaac

SEQ ID NO: 833258 - DNA, 20 bp, Homo sapiens
gccacaatgcagttctgagc

SEQ ID NO: 833259 - DNA, 19 bp, Homo sapiens
gccacacaaacgtttactt

SEQ ID NO: 833260 - DNA, 20 bp, Homo sapiens
gccacacattgtgcttggcc

SEQ ID NO: 833261 - DNA, 17 bp, Homo sapiens
gccacaccaatcagaga

SEQ ID NO: 833262 - DNA, 21 bp, Homo sapiens
gccacaccaatcagagagcct

SEQ ID NO: 833263 - DNA, 19 bp, Homo sapiens
gccacaccatctcctttca

SEQ ID NO: 833264 - DNA, 12 bp, Homo sapiens
gccacacccagc

SEQ ID NO: 833265 - DNA, 23 bp, Homo sapiens
gccacacccaggggaaggccctg

SEQ ID NO: 833266 - DNA, 22 bp, Homo sapiens
gccacacgcatgggcattgcag

SEQ ID NO: 833267 - DNA, 19 bp, Homo sapiens
gccacacggagaggccact

SEQ ID NO: 833268 - DNA, 20 bp, Homo sapiens
gccacacggagaggccactg

SEQ ID NO: 833269 - DNA, 19 bp, Homo sapiens
gccacactcagcacaaggc

SEQ ID NO: 833270 - DNA, 14 bp, Homo sapiens
gccacactcagtcc

SEQ ID NO: 833271 - DNA, 17 bp, Homo sapiens
gccacactcagtccccc

SEQ ID NO: 833272 - DNA, 19 bp, Homo sapiens
gccacactcagtcccccac

SEQ ID NO: 833273 - DNA, 11 bp, Homo sapiens
gccacactggg

SEQ ID NO: 833274 - DNA, 12 bp, Homo sapiens
gccacactgggc

SEQ ID NO: 833275 - DNA, 15 bp, Homo sapiens
gccacactgggcctg

SEQ ID NO: 833276 - DNA, 17 bp, Homo sapiens
gccacactgggcctgga

SEQ ID NO: 833277 - DNA, 14 bp, Homo sapiens
gccacagaagccag

SEQ ID NO: 833278 - DNA, 23 bp, Homo sapiens
gccacagagaagtttgtagccag

SEQ ID NO: 833279 - DNA, 13 bp, Homo sapiens
gccacagcaagga

SEQ ID NO: 833280 - DNA, 20 bp, Homo sapiens
gccacagcagcctctgaagt

SEQ ID NO: 833281 - DNA, 12 bp, Homo sapiens
gccacagccaga

SEQ ID NO: 833282 - DNA, 12 bp, Homo sapiens
gccacagccccc

SEQ ID NO: 833283 - DNA, 16 bp, Homo sapiens
gccacagcctcccctg

SEQ ID NO: 833284 - DNA, 21 bp, Homo sapiens
gccacagcctcccctgccagg

SEQ ID NO: 833285 - DNA, 15 bp, Homo sapiens
gccacagcctgctgg

SEQ ID NO: 833286 - DNA, 24 bp, Homo sapiens
gccacagcctgctggcagggccag

SEQ ID NO: 833287 - DNA, 23 bp, Homo sapiens
gccacagccttcggacagacata

SEQ ID NO: 833288 - DNA, 16 bp, Homo sapiens
gccacagcgccagcct

SEQ ID NO: 833289 - DNA, 14 bp, Homo sapiens
gccacagcgtgctg

SEQ ID NO: 833290 - DNA, 13 bp, Homo sapiens
gccacagctgctg

SEQ ID NO: 833291 - DNA, 17 bp, Homo sapiens
gccacagctgctgttct

SEQ ID NO: 833292 - DNA, 18 bp, Homo sapiens
gccacagcttttgcaact

SEQ ID NO: 833293 - DNA, 18 bp, Homo sapiens
gccacaggaacggccctg

SEQ ID NO: 833294 - DNA, 20 bp, Homo sapiens
gccacaggaacggccctgca

SEQ ID NO: 833295 - DNA, 15 bp, Homo sapiens
gccacaggaaggagg

SEQ ID NO: 833296 - DNA, 17 bp, Homo sapiens
gccacagtggggctgca

SEQ ID NO: 833297 - DNA, 20 bp, Homo sapiens
gccacagtggggctgcaggc

SEQ ID NO: 833298 - DNA, 16 bp, Homo sapiens
gccacagtgtcactgg

SEQ ID NO: 833299 - DNA, 12 bp, Homo sapiens
gccacagttgtt

SEQ ID NO: 833300 - DNA, 15 bp, Homo sapiens
gccacatcaaagagg

SEQ ID NO: 833301 - DNA, 15 bp, Homo sapiens
gccacatcattctgt

SEQ ID NO: 833302 - DNA, 20 bp, Homo sapiens
gccacatggtgtctcccaac

SEQ ID NO: 833303 - DNA, 22 bp, Homo sapiens
gccacatttggaatactttttg

SEQ ID NO: 833304 - DNA, 11 bp, Homo sapiens
gccacattttc

SEQ ID NO: 833305 - DNA, 14 bp, Homo sapiens
gccaccaccacctg

SEQ ID NO: 833306 - DNA, 21 bp, Homo sapiens
gccaccaccacctgacggctg

SEQ ID NO: 833307 - DNA, 20 bp, Homo sapiens
gccaccaccacgcagccgcc

SEQ ID NO: 833308 - DNA, 23 bp, Homo sapiens
gccaccaccacgcagccgccgcc

SEQ ID NO: 833309 - DNA, 22 bp, Homo sapiens
gccaccaccactctcactccac

SEQ ID NO: 833310 - DNA, 13 bp, Homo sapiens
gccacgtgccagg

SEQ ID NO: 833311 - DNA, 14 bp, Homo sapiens
gccacgtgccaggc

SEQ ID NO: 833312 - DNA, 16 bp, Homo sapiens
gccacgtgccaggccc

SEQ ID NO: 833313 - DNA, 23 bp, Homo sapiens
gccacgtgtttgtgctgtggtgt

SEQ ID NO: 833314 - DNA, 16 bp, Homo sapiens
gccacgttcagggagg

SEQ ID NO: 833315 - DNA, 21 bp, Homo sapiens
gccacgttccttactgcagaa

SEQ ID NO: 833316 - DNA, 22 bp, Homo sapiens
gccacgttggagaagcccgtgt

SEQ ID NO: 833317 - DNA, 17 bp, Homo sapiens
gccactaagcagaggag

SEQ ID NO: 833318 - DNA, 19 bp, Homo sapiens
gccactaagcagaggaggg

SEQ ID NO: 833319 - DNA, 23 bp, Homo sapiens
gccactaagcagaggaggggccg

SEQ ID NO: 833320 - DNA, 18 bp, Homo sapiens
gccactaattttagtatt

SEQ ID NO: 833321 - DNA, 17 bp, Homo sapiens
gccactacactccagcc

SEQ ID NO: 833322 - DNA, 18 bp, Homo sapiens
gccactacactccagcct

SEQ ID NO: 833323 - DNA, 16 bp, Homo sapiens
gccactaggtgtcccc

SEQ ID NO: 833324 - DNA, 19 bp, Homo sapiens
gccactcacccttcctggc

SEQ ID NO: 833325 - DNA, 21 bp, Homo sapiens
gccactcacccttcctggccc

SEQ ID NO: 833326 - DNA, 19 bp, Homo sapiens
gccactcagaggcccccag

SEQ ID NO: 833327 - DNA, 21 bp, Homo sapiens
gccactcaggaggctgaggca

SEQ ID NO: 833328 - DNA, 13 bp, Homo sapiens
gccactcatttca

SEQ ID NO: 833329 - DNA, 15 bp, Homo sapiens
gccactccaagcccc

SEQ ID NO: 833330 - DNA, 20 bp, Homo sapiens
gccactccaagccccctggc

SEQ ID NO: 833331 - DNA, 21 bp, Homo sapiens
gccactccagacccctggctt

SEQ ID NO: 833332 - DNA, 22 bp, Homo sapiens
gccactcccctaaactccagga

SEQ ID NO: 833333 - DNA, 12 bp, Homo sapiens
gccactccctcc

SEQ ID NO: 833334 - DNA, 16 bp, Homo sapiens
gccactccctcccaga

SEQ ID NO: 833335 - DNA, 14 bp, Homo sapiens
gccactccctgagc

SEQ ID NO: 833336 - DNA, 20 bp, Homo sapiens
gccactccctgagctttggg

SEQ ID NO: 833337 - DNA, 21 bp, Homo sapiens
gccactccgagaggtgggcca

SEQ ID NO: 833338 - DNA, 13 bp, Homo sapiens
gccactcctctga

SEQ ID NO: 833339 - DNA, 14 bp, Homo sapiens
gccactcctctgac

SEQ ID NO: 833340 - DNA, 17 bp, Homo sapiens
gccactcctctgactca

SEQ ID NO: 833341 - DNA, 15 bp, Homo sapiens
gccactcctgaaccc

SEQ ID NO: 833342 - DNA, 19 bp, Homo sapiens
gccactccttccttcagga

SEQ ID NO: 833343 - DNA, 22 bp, Homo sapiens
gccactccttccttcaggactc

SEQ ID NO: 833344 - DNA, 22 bp, Homo sapiens
gccactctcccctccctcttcc

SEQ ID NO: 833345 - DNA, 15 bp, Homo sapiens
gccactctctgggac

SEQ ID NO: 833346 - DNA, 22 bp, Homo sapiens
gccactctctgggactctcctc

SEQ ID NO: 833347 - DNA, 17 bp, Homo sapiens
gccactgaaaagctttc

SEQ ID NO: 833348 - DNA, 15 bp, Homo sapiens
gccactgaaatctgt

SEQ ID NO: 833349 - DNA, 19 bp, Homo sapiens
gccactgaagctgggattc

SEQ ID NO: 833350 - DNA, 17 bp, Homo sapiens
gccactgacccacctgc

SEQ ID NO: 833351 - DNA, 19 bp, Homo sapiens
gccactgcactccagcctg

SEQ ID NO: 833352 - DNA, 21 bp, Homo sapiens
gccactgcactccagcctggg

SEQ ID NO: 833353 - DNA, 18 bp, Homo sapiens
gccactgccaagcttcct

SEQ ID NO: 833354 - DNA, 20 bp, Homo sapiens
gccactgccaagcttcctgt

SEQ ID NO: 833355 - DNA, 15 bp, Homo sapiens
gccactgccaggcac

SEQ ID NO: 833356 - DNA, 18 bp, Homo sapiens
gccactgccaggcacctg

SEQ ID NO: 833357 - DNA, 24 bp, Homo sapiens
gccactgccaggcacctggcctgc

SEQ ID NO: 833358 - DNA, 17 bp, Homo sapiens
gccactgcccgagctgg

SEQ ID NO: 833359 - DNA, 19 bp, Homo sapiens
gccactgcccgagctggtg

SEQ ID NO: 833360 - DNA, 13 bp, Homo sapiens
gccactgcctccc

SEQ ID NO: 833361 - DNA, 12 bp, Homo sapiens
gccactgcctct

SEQ ID NO: 833362 - DNA, 15 bp, Homo sapiens
gccactgcctctccc

SEQ ID NO: 833363 - DNA, 13 bp, Homo sapiens
gccactgcctctt

SEQ ID NO: 833364 - DNA, 18 bp, Homo sapiens
gccactgccttcgcttct

SEQ ID NO: 833365 - DNA, 19 bp, Homo sapiens
gccactgcgcccagcctga

SEQ ID NO: 833366 - DNA, 12 bp, Homo sapiens
gccactgctccc

SEQ ID NO: 833367 - DNA, 21 bp, Homo sapiens
gccactgctccctaagccagc

SEQ ID NO: 833368 - DNA, 22 bp, Homo sapiens
gccactgctccctaagccagcc

SEQ ID NO: 833369 - DNA, 15 bp, Homo sapiens
gccactgggcacctg

SEQ ID NO: 833370 - DNA, 17 bp, Homo sapiens
gccactgggcacctgcg

SEQ ID NO: 833371 - DNA, 19 bp, Homo sapiens
gccactgggcacctgcgca

SEQ ID NO: 833372 - DNA, 19 bp, Homo sapiens
gccactgggcccctgtccc

SEQ ID NO: 833373 - DNA, 21 bp, Homo sapiens
gccactgggcccctgtcccca

SEQ ID NO: 833374 - DNA, 17 bp, Homo sapiens
gccactgggctctggac

SEQ ID NO: 833375 - DNA, 22 bp, Homo sapiens
gccactgggctctggacctcag

SEQ ID NO: 833376 - DNA, 17 bp, Homo sapiens
gccactgggtctcactc

SEQ ID NO: 833377 - DNA, 18 bp, Homo sapiens
gccactgtccctgtcctt

SEQ ID NO: 833378 - DNA, 14 bp, Homo sapiens
gccactgtgcttgg

SEQ ID NO: 833379 - DNA, 12 bp, Homo sapiens
gccactgtggcc

SEQ ID NO: 833380 - DNA, 13 bp, Homo sapiens
gccactgtggcca

SEQ ID NO: 833381 - DNA, 15 bp, Homo sapiens
gccactgtggccaga

SEQ ID NO: 833382 - DNA, 16 bp, Homo sapiens
gccactgtggccagag

SEQ ID NO: 833383 - DNA, 17 bp, Homo sapiens
gccactgtggccagagc

SEQ ID NO: 833384 - DNA, 15 bp, Homo sapiens
gccactgtgtctctg

SEQ ID NO: 833385 - DNA, 16 bp, Homo sapiens
gccactgtgtctctgt

SEQ ID NO: 833386 - DNA, 17 bp, Homo sapiens
gccactgtgtgccttct

SEQ ID NO: 833387 - DNA, 16 bp, Homo sapiens
gccacttaatgtatgt

SEQ ID NO: 833388 - DNA, 14 bp, Homo sapiens
gccacttcattcca

SEQ ID NO: 833389 - DNA, 18 bp, Homo sapiens
gccacttcattccagcag

SEQ ID NO: 833390 - DNA, 21 bp, Homo sapiens
gccacttcattccagcagctg

SEQ ID NO: 833391 - DNA, 15 bp, Homo sapiens
gccacttctccccag

SEQ ID NO: 833392 - DNA, 21 bp, Homo sapiens
gccacttctgcgggctccctc

SEQ ID NO: 833393 - DNA, 12 bp, Homo sapiens
gccacttctggc

SEQ ID NO: 833394 - DNA, 15 bp, Homo sapiens
gccacttgacattcc

SEQ ID NO: 833395 - DNA, 17 bp, Homo sapiens
gccacttgacattcctt

SEQ ID NO: 833396 - DNA, 23 bp, Homo sapiens
gccacttgatggggcctgggttt

SEQ ID NO: 833397 - DNA, 16 bp, Homo sapiens
gccacttggtttttgg

SEQ ID NO: 833398 - DNA, 20 bp, Homo sapiens
gccacttggtttttggctct

SEQ ID NO: 833399 - DNA, 21 bp, Homo sapiens
gccactttcacgtggcctccg

SEQ ID NO: 833400 - DNA, 23 bp, Homo sapiens
gccactttcagagcccccagccc

SEQ ID NO: 833401 - DNA, 14 bp, Homo sapiens
gccactttggctga

SEQ ID NO: 833402 - DNA, 22 bp, Homo sapiens
gccactttggtacatggccagt

SEQ ID NO: 833403 - DNA, 20 bp, Homo sapiens
gccagaaaaacgtgttgcct

SEQ ID NO: 833404 - DNA, 20 bp, Homo sapiens
gccagaaaccttcctgctga

SEQ ID NO: 833405 - DNA, 23 bp, Homo sapiens
gccagaaactccttttgctgtct

SEQ ID NO: 833406 - DNA, 13 bp, Homo sapiens
gccagaaagcact

SEQ ID NO: 833407 - DNA, 15 bp, Homo sapiens
gccagaaatgggcag

SEQ ID NO: 833408 - DNA, 13 bp, Homo sapiens
gccagaaggaagg

SEQ ID NO: 833409 - DNA, 17 bp, Homo sapiens
gccagaaggagggcaga

SEQ ID NO: 833410 - DNA, 20 bp, Homo sapiens
gccagaaggagggcagagcc

SEQ ID NO: 833411 - DNA, 22 bp, Homo sapiens
gccagaaggagggcagagccat

SEQ ID NO: 833412 - DNA, 14 bp, Homo sapiens
gccagaagtaccag

SEQ ID NO: 833413 - DNA, 18 bp, Homo sapiens
gccagaagtaccagacta

SEQ ID NO: 833414 - DNA, 17 bp, Homo sapiens
gccagacaaaatttgag

SEQ ID NO: 833415 - DNA, 13 bp, Homo sapiens
gccagacaacttc

SEQ ID NO: 833416 - DNA, 16 bp, Homo sapiens
gccagacaacttctgt

SEQ ID NO: 833417 - DNA, 18 bp, Homo sapiens
gccagaccagcaggctgg

SEQ ID NO: 833418 - DNA, 14 bp, Homo sapiens
gccagacccactga

SEQ ID NO: 833419 - DNA, 15 bp, Homo sapiens
gccagacccactgaa

SEQ ID NO: 833420 - DNA, 16 bp, Homo sapiens
gccagaccccacgctg

SEQ ID NO: 833421 - DNA, 13 bp, Homo sapiens
gccagaccgcaga

SEQ ID NO: 833422 - DNA, 19 bp, Homo sapiens
gccagaccgcagagaggct

SEQ ID NO: 833423 - DNA, 22 bp, Homo sapiens
gccagacctagcaggctgttcc

SEQ ID NO: 833424 - DNA, 19 bp, Homo sapiens
gccagaccttaataaaggc

SEQ ID NO: 833425 - DNA, 17 bp, Homo sapiens
gccagactctaggttat

SEQ ID NO: 833426 - DNA, 20 bp, Homo sapiens
gccagactctaggttataca

SEQ ID NO: 833427 - DNA, 15 bp, Homo sapiens
gccagactctggtct

SEQ ID NO: 833428 - DNA, 23 bp, Homo sapiens
gccagagaatagatcagtatttc

SEQ ID NO: 833429 - DNA, 14 bp, Homo sapiens
gccagagagcaggg

SEQ ID NO: 833430 - DNA, 16 bp, Homo sapiens
gccagagagcagggga

SEQ ID NO: 833431 - DNA, 18 bp, Homo sapiens
gccagagagcaggggagc

SEQ ID NO: 833432 - DNA, 12 bp, Homo sapiens
gccatccctggg

SEQ ID NO: 833433 - DNA, 16 bp, Homo sapiens
gccatccctgggcccc

SEQ ID NO: 833434 - DNA, 20 bp, Homo sapiens
gccatccctgggcccctcca

SEQ ID NO: 833435 - DNA, 22 bp, Homo sapiens
gccatccgcagactgcttggcc

SEQ ID NO: 833436 - DNA, 13 bp, Homo sapiens
gccatcctaccca

SEQ ID NO: 833437 - DNA, 15 bp, Homo sapiens
gccatcctacccagc

SEQ ID NO: 833438 - DNA, 23 bp, Homo sapiens
gccatcctacccagcgtggccca

SEQ ID NO: 833439 - DNA, 12 bp, Homo sapiens
gccatcctccct

SEQ ID NO: 833440 - DNA, 13 bp, Homo sapiens
gccatcctccctc

SEQ ID NO: 833441 - DNA, 18 bp, Homo sapiens
gccatccttgctgcagct

SEQ ID NO: 833442 - DNA, 17 bp, Homo sapiens
gccatcggacaggagga

SEQ ID NO: 833443 - DNA, 14 bp, Homo sapiens
gccatcgtcctggg

SEQ ID NO: 833444 - DNA, 15 bp, Homo sapiens
gccatcgtcctggga

SEQ ID NO: 833445 - DNA, 16 bp, Homo sapiens
gccatcgtcctgggac

SEQ ID NO: 833446 - DNA, 18 bp, Homo sapiens
gccatcgtcctgggactc

SEQ ID NO: 833447 - DNA, 23 bp, Homo sapiens
gccatctagccagcccctcttcc

SEQ ID NO: 833448 - DNA, 16 bp, Homo sapiens
gccatctcagattctg

SEQ ID NO: 833449 - DNA, 13 bp, Homo sapiens
gccatctcaggag

SEQ ID NO: 833450 - DNA, 17 bp, Homo sapiens
gccatctcaggagatgg

SEQ ID NO: 833451 - DNA, 22 bp, Homo sapiens
gccatctcaggagatggagggc

SEQ ID NO: 833452 - DNA, 22 bp, Homo sapiens
gccatctccctccccagaaaca

SEQ ID NO: 833453 - DNA, 13 bp, Homo sapiens
gccatctgacagc

SEQ ID NO: 833454 - DNA, 14 bp, Homo sapiens
gccatctgcccagg

SEQ ID NO: 833455 - DNA, 15 bp, Homo sapiens
gccatctgcgcaggg

SEQ ID NO: 833456 - DNA, 21 bp, Homo sapiens
gccatctgcgtgacaataaaa

SEQ ID NO: 833457 - DNA, 13 bp, Homo sapiens
gccatctgtaaat

SEQ ID NO: 833458 - DNA, 14 bp, Homo sapiens
gccatctgtaaata

SEQ ID NO: 833459 - DNA, 22 bp, Homo sapiens
gccatctgtaaatatcccagag

SEQ ID NO: 833460 - DNA, 12 bp, Homo sapiens
gccatctgtgtg

SEQ ID NO: 833461 - DNA, 13 bp, Homo sapiens
gccatcttcagga

SEQ ID NO: 833462 - DNA, 22 bp, Homo sapiens
gccatcttctccccgaggctgc

SEQ ID NO: 833463 - DNA, 15 bp, Homo sapiens
gccatcttcttccct

SEQ ID NO: 833464 - DNA, 17 bp, Homo sapiens
gccatgaatctctgcct

SEQ ID NO: 833465 - DNA, 11 bp, Homo sapiens
gccatgaatta

SEQ ID NO: 833466 - DNA, 16 bp, Homo sapiens
gccatgacagaggctg

SEQ ID NO: 833467 - DNA, 17 bp, Homo sapiens
gccatgacagaggctgc

SEQ ID NO: 833468 - DNA, 20 bp, Homo sapiens
gccatgacagaggctgcacc

SEQ ID NO: 833469 - DNA, 14 bp, Homo sapiens
gccatgacatttca

SEQ ID NO: 833470 - DNA, 15 bp, Homo sapiens
gccatgacatttcat

SEQ ID NO: 833471 - DNA, 16 bp, Homo sapiens
gccatgacttttctgc

SEQ ID NO: 833472 - DNA, 14 bp, Homo sapiens
gccatgagctccag

SEQ ID NO: 833473 - DNA, 15 bp, Homo sapiens
gccatgagctccaga

SEQ ID NO: 833474 - DNA, 16 bp, Homo sapiens
gccatgagctccagac

SEQ ID NO: 833475 - DNA, 18 bp, Homo sapiens
gccatgagctccagaccc

SEQ ID NO: 833476 - DNA, 22 bp, Homo sapiens
gccatgagctccagacccccag

SEQ ID NO: 833477 - DNA, 20 bp, Homo sapiens
gccatgaggagttgctgttt

SEQ ID NO: 833478 - DNA, 16 bp, Homo sapiens
gccatgatcagacata

SEQ ID NO: 833479 - DNA, 19 bp, Homo sapiens
gccatgatcagacatacag

SEQ ID NO: 833480 - DNA, 15 bp, Homo sapiens
gccatgatggcctta

SEQ ID NO: 833481 - DNA, 13 bp, Homo sapiens
gccatgatgtcct

SEQ ID NO: 833482 - DNA, 19 bp, Homo sapiens
gccatgatgtccttggact

SEQ ID NO: 833483 - DNA, 20 bp, Homo sapiens
gccatgatttgtcccagcct

SEQ ID NO: 833484 - DNA, 13 bp, Homo sapiens
gccatgcaggaag

SEQ ID NO: 833485 - DNA, 19 bp, Homo sapiens
gccatgcaggaagaggccc

SEQ ID NO: 833486 - DNA, 21 bp, Homo sapiens
gccatgcaggaagaggcccac

SEQ ID NO: 833487 - DNA, 13 bp, Homo sapiens
gccatgcaggagg

SEQ ID NO: 833488 - DNA, 21 bp, Homo sapiens
gccatgcaggaggtggagaaa

SEQ ID NO: 833489 - DNA, 14 bp, Homo sapiens
gccatgccaataaa

SEQ ID NO: 833490 - DNA, 12 bp, Homo sapiens
gccatgccactg

SEQ ID NO: 833491 - DNA, 16 bp, Homo sapiens
gccatgccactgccag

SEQ ID NO: 833492 - DNA, 18 bp, Homo sapiens
gccatgccactgccaggc

SEQ ID NO: 833493 - DNA, 13 bp, Homo sapiens
gccatgccagctt

SEQ ID NO: 833494 - DNA, 15 bp, Homo sapiens
gccatgccaggaacc

SEQ ID NO: 833495 - DNA, 20 bp, Homo sapiens
gccatgcccaaggcctaggt

SEQ ID NO: 833496 - DNA, 21 bp, Homo sapiens
gccatgccccacccccctcct

SEQ ID NO: 833497 - DNA, 14 bp, Homo sapiens
gccatgcctcagcc

SEQ ID NO: 833498 - DNA, 21 bp, Homo sapiens
gccatgcctcagccctgaccc

SEQ ID NO: 833499 - DNA, 15 bp, Homo sapiens
gccatgcctcatgcc

SEQ ID NO: 833500 - DNA, 17 bp, Homo sapiens
gccatgcctcatgccac

SEQ ID NO: 833501 - DNA, 14 bp, Homo sapiens
gccatgcctccctg

SEQ ID NO: 833502 - DNA, 15 bp, Homo sapiens
gccatgcctcctcag

SEQ ID NO: 833503 - DNA, 22 bp, Homo sapiens
gccatgcgaggggccagcagag

SEQ ID NO: 833504 - DNA, 21 bp, Homo sapiens
gccatgctcaacccccctccc

SEQ ID NO: 833505 - DNA, 14 bp, Homo sapiens
gccatgctgaaggg

SEQ ID NO: 833506 - DNA, 15 bp, Homo sapiens
gccatgctgaaggga

SEQ ID NO: 833507 - DNA, 14 bp, Homo sapiens
gccatgctgaggcc

SEQ ID NO: 833508 - DNA, 17 bp, Homo sapiens
gccatgctgaggcctgg

SEQ ID NO: 833509 - DNA, 13 bp, Homo sapiens
gccatgctgggcc

SEQ ID NO: 833510 - DNA, 15 bp, Homo sapiens
gccatgctgtccctg

SEQ ID NO: 833511 - DNA, 17 bp, Homo sapiens
gccatgctgtccctgca

SEQ ID NO: 833512 - DNA, 12 bp, Homo sapiens
gccatgcttttt

SEQ ID NO: 833513 - DNA, 18 bp, Homo sapiens
gccatggaaggtgccaga

SEQ ID NO: 833514 - DNA, 23 bp, Homo sapiens
gccatggactctacactgtgaac

SEQ ID NO: 833515 - DNA, 23 bp, Homo sapiens
gccatggccctcccagtgcctcc

SEQ ID NO: 833516 - DNA, 12 bp, Homo sapiens
gccatggcctct

SEQ ID NO: 833517 - DNA, 17 bp, Homo sapiens
gccatggctcaggcaag

SEQ ID NO: 833518 - DNA, 20 bp, Homo sapiens
gccatggctcaggcaagccc

SEQ ID NO: 833519 - DNA, 22 bp, Homo sapiens
gccatggctcaggcaagcccct

SEQ ID NO: 833520 - DNA, 23 bp, Homo sapiens
gccatggctcaggcaagcccctc

SEQ ID NO: 833521 - DNA, 18 bp, Homo sapiens
gccatgggcctgggcctg

SEQ ID NO: 833522 - DNA, 20 bp, Homo sapiens
gccatgggcctgggcctgct

SEQ ID NO: 833523 - DNA, 18 bp, Homo sapiens
gccatggggtcggctcct

SEQ ID NO: 833524 - DNA, 19 bp, Homo sapiens
gccatgggtggaaagtgct

SEQ ID NO: 833525 - DNA, 14 bp, Homo sapiens
gccatggtggaggg

SEQ ID NO: 833526 - DNA, 16 bp, Homo sapiens
gccatgtaaaggcctt

SEQ ID NO: 833527 - DNA, 21 bp, Homo sapiens
gccatgtaaatccccactggg

SEQ ID NO: 833528 - DNA, 19 bp, Homo sapiens
gccatgtaaggttgtgcag

SEQ ID NO: 833529 - DNA, 23 bp, Homo sapiens
gccatgtaaggttgtgcagggtg

SEQ ID NO: 833530 - DNA, 20 bp, Homo sapiens
gccatgtacctcccctgcct

SEQ ID NO: 833531 - DNA, 21 bp, Homo sapiens
gccatgtacctcccctgcctt

SEQ ID NO: 833532 - DNA, 22 bp, Homo sapiens
gccatgtatttcagggacctca

SEQ ID NO: 833533 - DNA, 22 bp, Homo sapiens
gccatgtcacctggctgctagg

SEQ ID NO: 833534 - DNA, 15 bp, Homo sapiens
gccatgtccaaagag

SEQ ID NO: 833535 - DNA, 18 bp, Homo sapiens
gccatgtccaaagaggct

SEQ ID NO: 833536 - DNA, 22 bp, Homo sapiens
gccatgtccaaagaggctgccc

SEQ ID NO: 833537 - DNA, 20 bp, Homo sapiens
gccatgtcgccaaaaataca

SEQ ID NO: 833538 - DNA, 12 bp, Homo sapiens
gccatgtctaca

SEQ ID NO: 833539 - DNA, 17 bp, Homo sapiens
gccatgtgcaccttggg

SEQ ID NO: 833540 - DNA, 16 bp, Homo sapiens
gccatgtggcctgccc

SEQ ID NO: 833541 - DNA, 18 bp, Homo sapiens
gccatgtggcctgcccag

SEQ ID NO: 833542 - DNA, 20 bp, Homo sapiens
gccatgtggcctgcccagcc

SEQ ID NO: 833543 - DNA, 22 bp, Homo sapiens
gccatgtggcctgcccagcctc

SEQ ID NO: 833544 - DNA, 15 bp, Homo sapiens
gccatgttaaatgac

SEQ ID NO: 833545 - DNA, 23 bp, Homo sapiens
gccatgttaaatgacttgattgt

SEQ ID NO: 833546 - DNA, 20 bp, Homo sapiens
gccatgtttggttgtaaatg

SEQ ID NO: 833547 - DNA, 17 bp, Homo sapiens
gccattaaaataaaaca

SEQ ID NO: 833548 - DNA, 19 bp, Homo sapiens
gccattaaaataaaacaag

SEQ ID NO: 833549 - DNA, 23 bp, Homo sapiens
gccattaaaataaaacaagcctt

SEQ ID NO: 833550 - DNA, 20 bp, Homo sapiens
gccattaccacctgacctct

SEQ ID NO: 833551 - DNA, 14 bp, Homo sapiens
gccattaccccata

SEQ ID NO: 833552 - DNA, 14 bp, Homo sapiens
gccattactactgt

SEQ ID NO: 833553 - DNA, 15 bp, Homo sapiens
gccattactactgta

SEQ ID NO: 833554 - DNA, 16 bp, Homo sapiens
gccattactactgtac

SEQ ID NO: 833555 - DNA, 14 bp, Homo sapiens
gccattagccaagg

SEQ ID NO: 833556 - DNA, 17 bp, Homo sapiens
gccattatatttgcatt

SEQ ID NO: 833557 - DNA, 12 bp, Homo sapiens
gccattattttc

SEQ ID NO: 833558 - DNA, 16 bp, Homo sapiens
gccattattttctgtc

SEQ ID NO: 833559 - DNA, 22 bp, Homo sapiens
gccattcacactttttatttaa

SEQ ID NO: 833560 - DNA, 18 bp, Homo sapiens
gccattcactgcccccag

SEQ ID NO: 833561 - DNA, 14 bp, Homo sapiens
gccattccactcca

SEQ ID NO: 833562 - DNA, 13 bp, Homo sapiens
gccattcccagcg

SEQ ID NO: 833563 - DNA, 22 bp, Homo sapiens
gccattcctggtacccagccat

SEQ ID NO: 833564 - DNA, 17 bp, Homo sapiens
gccattctccacagcaa

SEQ ID NO: 833565 - DNA, 20 bp, Homo sapiens
gccattctcctgcctcagcc

SEQ ID NO: 833566 - DNA, 15 bp, Homo sapiens
gccattctgattatt

SEQ ID NO: 833567 - DNA, 22 bp, Homo sapiens
gccattgagtgctgggggaggc

SEQ ID NO: 833568 - DNA, 18 bp, Homo sapiens
gccattgccaccaggaga

SEQ ID NO: 833569 - DNA, 20 bp, Homo sapiens
gccattggcctcttgtccct

SEQ ID NO: 833570 - DNA, 21 bp, Homo sapiens
gccattggcctcttgtccctt

SEQ ID NO: 833571 - DNA, 22 bp, Homo sapiens
gccattgggtttggggccatgg

SEQ ID NO: 833572 - DNA, 19 bp, Homo sapiens
gccattgtactccagcctg

SEQ ID NO: 833573 - DNA, 18 bp, Homo sapiens
gccatttcagtggcttcc

SEQ ID NO: 833574 - DNA, 14 bp, Homo sapiens
gccatttcatgtcc

SEQ ID NO: 833575 - DNA, 17 bp, Homo sapiens
gccatttccccctcctc

SEQ ID NO: 833576 - DNA, 20 bp, Homo sapiens
gccatttcctcacgtgcagg

SEQ ID NO: 833577 - DNA, 22 bp, Homo sapiens
gccatttcctcacgtgcaggac

SEQ ID NO: 833578 - DNA, 13 bp, Homo sapiens
gccatttctccat

SEQ ID NO: 833579 - DNA, 14 bp, Homo sapiens
gccatttcttctct

SEQ ID NO: 833580 - DNA, 20 bp, Homo sapiens
gccatttgcaataacagctg

SEQ ID NO: 833581 - DNA, 22 bp, Homo sapiens
gccatttgcaataacagctgca

SEQ ID NO: 833582 - DNA, 20 bp, Homo sapiens
gccatttgcaccctccgcct

SEQ ID NO: 833583 - DNA, 22 bp, Homo sapiens
gccatttgctagttctgctgcc

SEQ ID NO: 833584 - DNA, 15 bp, Homo sapiens
gccatttgctttttc

SEQ ID NO: 833585 - DNA, 14 bp, Homo sapiens
gccatttttaatga

SEQ ID NO: 833586 - DNA, 13 bp, Homo sapiens
gccatttttctgg

SEQ ID NO: 833587 - DNA, 18 bp, Homo sapiens
gccattttttaagagaca

SEQ ID NO: 833588 - DNA, 18 bp, Homo sapiens
gcccaaaaatatggttga

SEQ ID NO: 833589 - DNA, 16 bp, Homo sapiens
gcccaaaacccagggc

SEQ ID NO: 833590 - DNA, 17 bp, Homo sapiens
gcccaaaacccagggca

SEQ ID NO: 833591 - DNA, 14 bp, Homo sapiens
gcccaaaagccatg

SEQ ID NO: 833592 - DNA, 15 bp, Homo sapiens
gcccaaaagccatgt

SEQ ID NO: 833593 - DNA, 13 bp, Homo sapiens
gcccaaaatttat

SEQ ID NO: 833594 - DNA, 15 bp, Homo sapiens
gcccaaaatttattt

SEQ ID NO: 833595 - DNA, 21 bp, Homo sapiens
gcccaaaatttattttataag

SEQ ID NO: 833596 - DNA, 17 bp, Homo sapiens
gcccaaactccccttcc

SEQ ID NO: 833597 - DNA, 21 bp, Homo sapiens
gcccaaagagaaatcacaggg

SEQ ID NO: 833598 - DNA, 16 bp, Homo sapiens
gcccaaagccagacag

SEQ ID NO: 833599 - DNA, 20 bp, Homo sapiens
gcccaaaggcccagggaggc

SEQ ID NO: 833600 - DNA, 21 bp, Homo sapiens
gcccaaaggggacaggcctca

SEQ ID NO: 833601 - DNA, 17 bp, Homo sapiens
gcccaaagtctgtgtga

SEQ ID NO: 833602 - DNA, 17 bp, Homo sapiens
gcccaaattcatataaa

SEQ ID NO: 833603 - DNA, 23 bp, Homo sapiens
gcccaacagacaccatcttttgt

SEQ ID NO: 833604 - DNA, 17 bp, Homo sapiens
gcccaaccaggccctgc

SEQ ID NO: 833605 - DNA, 19 bp, Homo sapiens
gcccaaccaggttgcagta

SEQ ID NO: 833606 - DNA, 14 bp, Homo sapiens
gcccaacctgctct

SEQ ID NO: 833607 - DNA, 24 bp, Homo sapiens
gcccaacctgctctcctcttgcca

SEQ ID NO: 833608 - DNA, 14 bp, Homo sapiens
gcccaactggggtt

SEQ ID NO: 833609 - DNA, 13 bp, Homo sapiens
gcccaagaactgc

SEQ ID NO: 833610 - DNA, 20 bp, Homo sapiens
gcccaagaactgcagatagc

SEQ ID NO: 833611 - DNA, 19 bp, Homo sapiens
gcccaagacagatgcccca

SEQ ID NO: 833612 - DNA, 21 bp, Homo sapiens
gcccaagagcagagtctgggc

SEQ ID NO: 833613 - DNA, 19 bp, Homo sapiens
gcccaagagccctgtggcc

SEQ ID NO: 833614 - DNA, 13 bp, Homo sapiens
gcccaagagtggg

SEQ ID NO: 833615 - DNA, 23 bp, Homo sapiens
gcccaagccagaggctgggttca

SEQ ID NO: 833616 - DNA, 21 bp, Homo sapiens
gcccaagcttaatagccctcc

SEQ ID NO: 833617 - DNA, 14 bp, Homo sapiens
gcccaagcttccct

SEQ ID NO: 833618 - DNA, 15 bp, Homo sapiens
gcccaagcttccctc

SEQ ID NO: 833619 - DNA, 18 bp, Homo sapiens
gcccaagcttccctccat

SEQ ID NO: 833620 - DNA, 23 bp, Homo sapiens
gcccaaggagcttacccaagctg

SEQ ID NO: 833621 - DNA, 18 bp, Homo sapiens
gcccaaggagggtccagg

SEQ ID NO: 833622 - DNA, 18 bp, Homo sapiens
gcccaagggatctggtcc

SEQ ID NO: 833623 - DNA, 19 bp, Homo sapiens
gcccaagggatctggtcct

SEQ ID NO: 833624 - DNA, 19 bp, Homo sapiens
gcccaagggatggcaccac

SEQ ID NO: 833625 - DNA, 16 bp, Homo sapiens
gcccaaggtcccctcc

SEQ ID NO: 833626 - DNA, 14 bp, Homo sapiens
gcccaagtccctgt

SEQ ID NO: 833627 - DNA, 15 bp, Homo sapiens
gcccaagtccctgtt

SEQ ID NO: 833628 - DNA, 14 bp, Homo sapiens
gcccaagtgaccag

SEQ ID NO: 833629 - DNA, 15 bp, Homo sapiens
gcccaagtgaccagg

SEQ ID NO: 833630 - DNA, 13 bp, Homo sapiens
gcccaagtgggca

SEQ ID NO: 833631 - DNA, 16 bp, Homo sapiens
gcccaagtgggcagtc

SEQ ID NO: 833632 - DNA, 19 bp, Homo sapiens
gcccaagtgggcagtcacc

SEQ ID NO: 833633 - DNA, 21 bp, Homo sapiens
gcccaagtgggcagtcaccac

SEQ ID NO: 833634 - DNA, 20 bp, Homo sapiens
gcccaagtggggtgctctgg

SEQ ID NO: 833635 - DNA, 20 bp, Homo sapiens
gcccaagttcatgcagctgt

SEQ ID NO: 833636 - DNA, 13 bp, Homo sapiens
gcccaagttgcag

SEQ ID NO: 833637 - DNA, 18 bp, Homo sapiens
gcccaagttgcagtgagc

SEQ ID NO: 833638 - DNA, 12 bp, Homo sapiens
gcccaatattat

SEQ ID NO: 833639 - DNA, 21 bp, Homo sapiens
gcccaatgctttgggaggcca

SEQ ID NO: 833640 - DNA, 19 bp, Homo sapiens
gcccacaaccttcggctcc

SEQ ID NO: 833641 - DNA, 22 bp, Homo sapiens
gcccacaacttgtcacccaaag

SEQ ID NO: 833642 - DNA, 16 bp, Homo sapiens
gcccacacggcccctt

SEQ ID NO: 833643 - DNA, 11 bp, Homo sapiens
gcccacagagc

SEQ ID NO: 833644 - DNA, 17 bp, Homo sapiens
gcccacagagcctggct

SEQ ID NO: 833645 - DNA, 20 bp, Homo sapiens
gcccacagatgatgaagaaa

SEQ ID NO: 833646 - DNA, 16 bp, Homo sapiens
gcccacagcgagcctg

SEQ ID NO: 833647 - DNA, 22 bp, Homo sapiens
gcccacagcgagcctgtgcctt

SEQ ID NO: 833648 - DNA, 19 bp, Homo sapiens
gcccacagggaaccctgct

SEQ ID NO: 833649 - DNA, 13 bp, Homo sapiens
gcccacaggtgcg

SEQ ID NO: 833650 - DNA, 14 bp, Homo sapiens
gcccacagtctttc

SEQ ID NO: 833651 - DNA, 14 bp, Homo sapiens
gcccacagtgcctg

SEQ ID NO: 833652 - DNA, 14 bp, Homo sapiens
gcccacatttgatg

SEQ ID NO: 833653 - DNA, 18 bp, Homo sapiens
gcccacatttgggctcag

SEQ ID NO: 833654 - DNA, 20 bp, Homo sapiens
gcccacatttgggctcaggg

SEQ ID NO: 833655 - DNA, 12 bp, Homo sapiens
gcccaccaaagg

SEQ ID NO: 833656 - DNA, 18 bp, Homo sapiens
gcccaccaaaggtcaatg

SEQ ID NO: 833657 - DNA, 17 bp, Homo sapiens
gcccaccaacatcccat

SEQ ID NO: 833658 - DNA, 21 bp, Homo sapiens
gcccaccaacatcccattgcc

SEQ ID NO: 833659 - DNA, 17 bp, Homo sapiens
gcccaccaatctgccct

SEQ ID NO: 833660 - DNA, 15 bp, Homo sapiens
gcccaccagccagcc

SEQ ID NO: 833661 - DNA, 13 bp, Homo sapiens
gcccaccaggagc

SEQ ID NO: 833662 - DNA, 22 bp, Homo sapiens
gcccaccaggagcacctggacc

SEQ ID NO: 833663 - DNA, 16 bp, Homo sapiens
gcccaccagggactgc

SEQ ID NO: 833664 - DNA, 19 bp, Homo sapiens
gcccaccagggactgcagc

SEQ ID NO: 833665 - DNA, 16 bp, Homo sapiens
gcccaccatctgtttg

SEQ ID NO: 833666 - DNA, 18 bp, Homo sapiens
gcccacccagattctgaa

SEQ ID NO: 833667 - DNA, 14 bp, Homo sapiens
gcccacccagctgg

SEQ ID NO: 833668 - DNA, 18 bp, Homo sapiens
gcccacccagctggtcct

SEQ ID NO: 833669 - DNA, 23 bp, Homo sapiens
gcccacccagctggtcctgtgga

SEQ ID NO: 833670 - DNA, 14 bp, Homo sapiens
gcccacccaggtcc

SEQ ID NO: 833671 - DNA, 16 bp, Homo sapiens
gcccaccccccagcct

SEQ ID NO: 833672 - DNA, 13 bp, Homo sapiens
gcccacccccctc

SEQ ID NO: 833673 - DNA, 21 bp, Homo sapiens
gcccacccccgggatcctgcc

SEQ ID NO: 833674 - DNA, 17 bp, Homo sapiens
gcccaccccctgccctg

SEQ ID NO: 833675 - DNA, 16 bp, Homo sapiens
gcccacccctcactcc

SEQ ID NO: 833676 - DNA, 23 bp, Homo sapiens
gcccatctcggagcatcccggag

SEQ ID NO: 833677 - DNA, 14 bp, Homo sapiens
gcccatgcccacct

SEQ ID NO: 833678 - DNA, 12 bp, Homo sapiens
gcccatgccccc

SEQ ID NO: 833679 - DNA, 13 bp, Homo sapiens
gcccatgccccct

SEQ ID NO: 833680 - DNA, 14 bp, Homo sapiens
gcccatggccccca

SEQ ID NO: 833681 - DNA, 17 bp, Homo sapiens
gcccatggcccccaata

SEQ ID NO: 833682 - DNA, 20 bp, Homo sapiens
gcccatggcccccaataaag

SEQ ID NO: 833683 - DNA, 23 bp, Homo sapiens
gcccatggcccccaataaaggca

SEQ ID NO: 833684 - DNA, 22 bp, Homo sapiens
gcccatggccttgggctctgat

SEQ ID NO: 833685 - DNA, 15 bp, Homo sapiens
gcccatggctgggaa

SEQ ID NO: 833686 - DNA, 18 bp, Homo sapiens
gcccatgggatatgtggt

SEQ ID NO: 833687 - DNA, 20 bp, Homo sapiens
gcccatgtcgcgctcagcat

SEQ ID NO: 833688 - DNA, 16 bp, Homo sapiens
gcccatgtcttctgct

SEQ ID NO: 833689 - DNA, 14 bp, Homo sapiens
gcccatgtgtgagt

SEQ ID NO: 833690 - DNA, 14 bp, Homo sapiens
gcccatgttctgcc

SEQ ID NO: 833691 - DNA, 19 bp, Homo sapiens
gcccatgttctgcccccag

SEQ ID NO: 833692 - DNA, 23 bp, Homo sapiens
gcccatgttctgcccccagccca

SEQ ID NO: 833693 - DNA, 15 bp, Homo sapiens
gcccattaggtccct

SEQ ID NO: 833694 - DNA, 14 bp, Homo sapiens
gcccattctctctc

SEQ ID NO: 833695 - DNA, 17 bp, Homo sapiens
gcccattctctctcctg

SEQ ID NO: 833696 - DNA, 19 bp, Homo sapiens
gcccattctctctcctgtc

SEQ ID NO: 833697 - DNA, 14 bp, Homo sapiens
gcccattcttctgg

SEQ ID NO: 833698 - DNA, 15 bp, Homo sapiens
gcccattcttctggg

SEQ ID NO: 833699 - DNA, 23 bp, Homo sapiens
gcccattgaagaagaaccagccc

SEQ ID NO: 833700 - DNA, 15 bp, Homo sapiens
gcccattgctgccaa

SEQ ID NO: 833701 - DNA, 16 bp, Homo sapiens
gcccattggccgagct

SEQ ID NO: 833702 - DNA, 21 bp, Homo sapiens
gcccattggccgagctcctgg

SEQ ID NO: 833703 - DNA, 23 bp, Homo sapiens
gcccattggccgagctcctgggg

SEQ ID NO: 833704 - DNA, 19 bp, Homo sapiens
gcccatttcaattctcaaa

SEQ ID NO: 833705 - DNA, 16 bp, Homo sapiens
gcccatttttgctaat

SEQ ID NO: 833706 - DNA, 15 bp, Homo sapiens
gccccaaaaccacag

SEQ ID NO: 833707 - DNA, 20 bp, Homo sapiens
gccccaaaaccacagccctg

SEQ ID NO: 833708 - DNA, 22 bp, Homo sapiens
gccccaaaaccacagccctgtc

SEQ ID NO: 833709 - DNA, 19 bp, Homo sapiens
gccccaaacaaatatgcaa

SEQ ID NO: 833710 - DNA, 22 bp, Homo sapiens
gccccaaataacttcagtcctg

SEQ ID NO: 833711 - DNA, 15 bp, Homo sapiens
gccccaacctgctga

SEQ ID NO: 833712 - DNA, 21 bp, Homo sapiens
gccccaactccaacctctcgg

SEQ ID NO: 833713 - DNA, 18 bp, Homo sapiens
gccccaactccaggggca

SEQ ID NO: 833714 - DNA, 16 bp, Homo sapiens
gccccaactcctggaa

SEQ ID NO: 833715 - DNA, 17 bp, Homo sapiens
gccccaactcctggaag

SEQ ID NO: 833716 - DNA, 18 bp, Homo sapiens
gccccaagcagccagcca

SEQ ID NO: 833717 - DNA, 22 bp, Homo sapiens
gccccaagcagccagccagtct

SEQ ID NO: 833718 - DNA, 16 bp, Homo sapiens
gccccaagctgggccg

SEQ ID NO: 833719 - DNA, 13 bp, Homo sapiens
gccccaagggctg

SEQ ID NO: 833720 - DNA, 14 bp, Homo sapiens
gccccaagggctgg

SEQ ID NO: 833721 - DNA, 22 bp, Homo sapiens
gccccaagggctggggcggagc

SEQ ID NO: 833722 - DNA, 23 bp, Homo sapiens
gccccaagggctggggcggagct

SEQ ID NO: 833723 - DNA, 22 bp, Homo sapiens
gccccaaggttccagaggccct

SEQ ID NO: 833724 - DNA, 13 bp, Homo sapiens
gccccaagtcctg

SEQ ID NO: 833725 - DNA, 16 bp, Homo sapiens
gccccaagtcctgaag

SEQ ID NO: 833726 - DNA, 19 bp, Homo sapiens
gccccaagtcctgaagagg

SEQ ID NO: 833727 - DNA, 21 bp, Homo sapiens
gccccaatcgggtccagagac

SEQ ID NO: 833728 - DNA, 18 bp, Homo sapiens
gccccaatcttgcccact

SEQ ID NO: 833729 - DNA, 19 bp, Homo sapiens
gccccaatcttgcccactg

SEQ ID NO: 833730 - DNA, 22 bp, Homo sapiens
gccccaatgtatgtgtggctgt

SEQ ID NO: 833731 - DNA, 14 bp, Homo sapiens
gccccacacggact

SEQ ID NO: 833732 - DNA, 21 bp, Homo sapiens
gccccacacggactcccgggc

SEQ ID NO: 833733 - DNA, 23 bp, Homo sapiens
gccccacacggactcccgggcca

SEQ ID NO: 833734 - DNA, 19 bp, Homo sapiens
gccccacactttgtacaga

SEQ ID NO: 833735 - DNA, 10 bp, Homo sapiens
gccccacagc

SEQ ID NO: 833736 - DNA, 21 bp, Homo sapiens
gccccacagcctggcacgaag

SEQ ID NO: 833737 - DNA, 14 bp, Homo sapiens
gccccacagctacc

SEQ ID NO: 833738 - DNA, 16 bp, Homo sapiens
gccccacagggcaagg

SEQ ID NO: 833739 - DNA, 11 bp, Homo sapiens
gccccaccacc

SEQ ID NO: 833740 - DNA, 15 bp, Homo sapiens
gccccaccacctagg

SEQ ID NO: 833741 - DNA, 21 bp, Homo sapiens
gccccaccacgcatgctcagt

SEQ ID NO: 833742 - DNA, 19 bp, Homo sapiens
gccccacccaccctctggt

SEQ ID NO: 833743 - DNA, 21 bp, Homo sapiens
gccccaccccatccagccaga

SEQ ID NO: 833744 - DNA, 15 bp, Homo sapiens
gccccacccccagcc

SEQ ID NO: 833745 - DNA, 19 bp, Homo sapiens
gccccacccccagccaggc

SEQ ID NO: 833746 - DNA, 13 bp, Homo sapiens
gccccacccccct

SEQ ID NO: 833747 - DNA, 22 bp, Homo sapiens
gccccacccccctcctccccct

SEQ ID NO: 833748 - DNA, 17 bp, Homo sapiens
gccccaccccctgggca

SEQ ID NO: 833749 - DNA, 20 bp, Homo sapiens
gccccaccccctgggcagat

SEQ ID NO: 833750 - DNA, 12 bp, Homo sapiens
gccccaccctgg

SEQ ID NO: 833751 - DNA, 14 bp, Homo sapiens
gccccaccctgggc

SEQ ID NO: 833752 - DNA, 13 bp, Homo sapiens
gccccacctccca

SEQ ID NO: 833753 - DNA, 20 bp, Homo sapiens
gccccacctcccgccctcac

SEQ ID NO: 833754 - DNA, 20 bp, Homo sapiens
gccccacctccctgcgccct

SEQ ID NO: 833755 - DNA, 15 bp, Homo sapiens
gccccacctcggcac

SEQ ID NO: 833756 - DNA, 13 bp, Homo sapiens
gccccacctgccg

SEQ ID NO: 833757 - DNA, 15 bp, Homo sapiens
gccccaccttgccag

SEQ ID NO: 833758 - DNA, 19 bp, Homo sapiens
gccccaccttgccagggca

SEQ ID NO: 833759 - DNA, 21 bp, Homo sapiens
gccccacctttattaaaatct

SEQ ID NO: 833760 - DNA, 15 bp, Homo sapiens
gccccacgccctctc

SEQ ID NO: 833761 - DNA, 10 bp, Homo sapiens
gccccactcc

SEQ ID NO: 833762 - DNA, 20 bp, Homo sapiens
gccccactcccttgctggcc

SEQ ID NO: 833763 - DNA, 12 bp, Homo sapiens
gccccactcctc

SEQ ID NO: 833764 - DNA, 13 bp, Homo sapiens
gccccactcctct

SEQ ID NO: 833765 - DNA, 20 bp, Homo sapiens
gccccactcctctgctgacc

SEQ ID NO: 833766 - DNA, 14 bp, Homo sapiens
gccccactctgcct

SEQ ID NO: 833767 - DNA, 17 bp, Homo sapiens
gccccactctgcctgcc

SEQ ID NO: 833768 - DNA, 15 bp, Homo sapiens
gccccactgccagca

SEQ ID NO: 833769 - DNA, 11 bp, Homo sapiens
gccccactgga

SEQ ID NO: 833770 - DNA, 18 bp, Homo sapiens
gccccactggacaacact

SEQ ID NO: 833771 - DNA, 20 bp, Homo sapiens
gccccactggacaacactga

SEQ ID NO: 833772 - DNA, 14 bp, Homo sapiens
gccccactggctgg

SEQ ID NO: 833773 - DNA, 14 bp, Homo sapiens
gccccacttcaccc

SEQ ID NO: 833774 - DNA, 18 bp, Homo sapiens
gccccacttcacccccaa

SEQ ID NO: 833775 - DNA, 19 bp, Homo sapiens
gccccacttcacccccaac

SEQ ID NO: 833776 - DNA, 21 bp, Homo sapiens
gccccacttcacccccaactt

SEQ ID NO: 833777 - DNA, 17 bp, Homo sapiens
gccccacttctggcatg

SEQ ID NO: 833778 - DNA, 16 bp, Homo sapiens
gccccactttgaaggg

SEQ ID NO: 833779 - DNA, 18 bp, Homo sapiens
gccccactttgaagggca

SEQ ID NO: 833780 - DNA, 19 bp, Homo sapiens
gccccactttgaagggcaa

SEQ ID NO: 833781 - DNA, 16 bp, Homo sapiens
gccccagaaaggggaa

SEQ ID NO: 833782 - DNA, 13 bp, Homo sapiens
gccccagaagaaa

SEQ ID NO: 833783 - DNA, 12 bp, Homo sapiens
gccccagacagg

SEQ ID NO: 833784 - DNA, 17 bp, Homo sapiens
gccccagaccccagggc

SEQ ID NO: 833785 - DNA, 18 bp, Homo sapiens
gccccagaccccagggca

SEQ ID NO: 833786 - DNA, 16 bp, Homo sapiens
gccccagacctggaag

SEQ ID NO: 833787 - DNA, 18 bp, Homo sapiens
gccccagactgagctctc

SEQ ID NO: 833788 - DNA, 20 bp, Homo sapiens
gccccagactgagctctcca

SEQ ID NO: 833789 - DNA, 23 bp, Homo sapiens
gccccagactgagctctccaggc

SEQ ID NO: 833790 - DNA, 19 bp, Homo sapiens
gccccagactgggcccagg

SEQ ID NO: 833791 - DNA, 20 bp, Homo sapiens
gccccagactgggcccaggc

SEQ ID NO: 833792 - DNA, 17 bp, Homo sapiens
gccccagagacctgacc

SEQ ID NO: 833793 - DNA, 15 bp, Homo sapiens
gccccagagactcag

SEQ ID NO: 833794 - DNA, 12 bp, Homo sapiens
gccccagagaga

SEQ ID NO: 833795 - DNA, 12 bp, Homo sapiens
gccccagagctg

SEQ ID NO: 833796 - DNA, 13 bp, Homo sapiens
gccccagagctgt

SEQ ID NO: 833797 - DNA, 14 bp, Homo sapiens
gccccagagctgtt

SEQ ID NO: 833798 - DNA, 22 bp, Homo sapiens
gccccagagctgtttatggcct

SEQ ID NO: 833799 - DNA, 19 bp, Homo sapiens
gccccagataccagcccct

SEQ ID NO: 833800 - DNA, 17 bp, Homo sapiens
gccccagatctgcctgg

SEQ ID NO: 833801 - DNA, 21 bp, Homo sapiens
gccccagatctgcctgggcct

SEQ ID NO: 833802 - DNA, 23 bp, Homo sapiens
gccccagatctgcctgggcctgt

SEQ ID NO: 833803 - DNA, 21 bp, Homo sapiens
gccccagcaagagcacaagag

SEQ ID NO: 833804 - DNA, 12 bp, Homo sapiens
gccccagcacta

SEQ ID NO: 833805 - DNA, 19 bp, Homo sapiens
gccccagcactaacgtaaa

SEQ ID NO: 833806 - DNA, 11 bp, Homo sapiens
gccccagccag

SEQ ID NO: 833807 - DNA, 20 bp, Homo sapiens
gccccagccagagttcctgc

SEQ ID NO: 833808 - DNA, 23 bp, Homo sapiens
gccccagcccagccccactcctc

SEQ ID NO: 833809 - DNA, 11 bp, Homo sapiens
gccccagcccc

SEQ ID NO: 833810 - DNA, 13 bp, Homo sapiens
gccccagccccta

SEQ ID NO: 833811 - DNA, 21 bp, Homo sapiens
gccccagccccttctcccagc

SEQ ID NO: 833812 - DNA, 13 bp, Homo sapiens
gccccagccctca

SEQ ID NO: 833813 - DNA, 14 bp, Homo sapiens
gccccagccctcag

SEQ ID NO: 833814 - DNA, 22 bp, Homo sapiens
gccccagccctcagtcaccccc

SEQ ID NO: 833815 - DNA, 23 bp, Homo sapiens
gccccagccctcagtcaccccca

SEQ ID NO: 833816 - DNA, 17 bp, Homo sapiens
gccccagccctgctggg

SEQ ID NO: 833817 - DNA, 20 bp, Homo sapiens
gccccagccctgctggggat

SEQ ID NO: 833818 - DNA, 19 bp, Homo sapiens
gccccagcctaggtggagg

SEQ ID NO: 833819 - DNA, 16 bp, Homo sapiens
gccccagcctccaggc

SEQ ID NO: 833820 - DNA, 18 bp, Homo sapiens
gccccagcctgggccatc

SEQ ID NO: 833821 - DNA, 22 bp, Homo sapiens
gccccagcgtctgcagggtgac

SEQ ID NO: 833822 - DNA, 12 bp, Homo sapiens
gccccagctctg

SEQ ID NO: 833823 - DNA, 14 bp, Homo sapiens
gccccagctctgga

SEQ ID NO: 833824 - DNA, 22 bp, Homo sapiens
gccccagctgccaggcggccct

SEQ ID NO: 833825 - DNA, 15 bp, Homo sapiens
gccccaggaaaggcc

SEQ ID NO: 833826 - DNA, 16 bp, Homo sapiens
gccccaggactctggc

SEQ ID NO: 833827 - DNA, 20 bp, Homo sapiens
gccccaggcaggctgtgcgc

SEQ ID NO: 833828 - DNA, 21 bp, Homo sapiens
gccccaggcagggccaaccct

SEQ ID NO: 833829 - DNA, 20 bp, Homo sapiens
gccccaggcccgcgggcaca

SEQ ID NO: 833830 - DNA, 15 bp, Homo sapiens
gccccaggccctccc

SEQ ID NO: 833831 - DNA, 20 bp, Homo sapiens
gccccaggccctccctgact

SEQ ID NO: 833832 - DNA, 15 bp, Homo sapiens
gccccaggccggagc

SEQ ID NO: 833833 - DNA, 14 bp, Homo sapiens
gccccaggcctctg

SEQ ID NO: 833834 - DNA, 12 bp, Homo sapiens
gccccaggcctg

SEQ ID NO: 833835 - DNA, 13 bp, Homo sapiens
gccccaggcctgg

SEQ ID NO: 833836 - DNA, 23 bp, Homo sapiens
gccccaggcctggacgggccctc

SEQ ID NO: 833837 - DNA, 14 bp, Homo sapiens
gccccaggcctggc

SEQ ID NO: 833838 - DNA, 16 bp, Homo sapiens
gccccaggcctggcct

SEQ ID NO: 833839 - DNA, 19 bp, Homo sapiens
gccccaggctcgtggactg

SEQ ID NO: 833840 - DNA, 16 bp, Homo sapiens
gccccaggcttccgcg

SEQ ID NO: 833841 - DNA, 18 bp, Homo sapiens
gccccaggcttccgcgcc

SEQ ID NO: 833842 - DNA, 16 bp, Homo sapiens
gccccagggacagagg

SEQ ID NO: 833843 - DNA, 14 bp, Homo sapiens
gccccagggcctgg

SEQ ID NO: 833844 - DNA, 18 bp, Homo sapiens
gccccagggctaccctcc

SEQ ID NO: 833845 - DNA, 14 bp, Homo sapiens
gccccaggggacgt

SEQ ID NO: 833846 - DNA, 20 bp, Homo sapiens
gccccaggggcagcaaggcc

SEQ ID NO: 833847 - DNA, 16 bp, Homo sapiens
gccccagggtcttccc

SEQ ID NO: 833848 - DNA, 17 bp, Homo sapiens
gccccagtcggccccat

SEQ ID NO: 833849 - DNA, 20 bp, Homo sapiens
gccccagtcggccccatctc

SEQ ID NO: 833850 - DNA, 19 bp, Homo sapiens
gccccagtgcggttcctca

SEQ ID NO: 833851 - DNA, 18 bp, Homo sapiens
gccccagtggcactgaag

SEQ ID NO: 833852 - DNA, 15 bp, Homo sapiens
gccccagtttggggt

SEQ ID NO: 833853 - DNA, 16 bp, Homo sapiens
gccccatcagaacctg

SEQ ID NO: 833854 - DNA, 19 bp, Homo sapiens
gccccatcagaacctgagc

SEQ ID NO: 833855 - DNA, 20 bp, Homo sapiens
gccccatcagaacctgagct

SEQ ID NO: 833856 - DNA, 19 bp, Homo sapiens
gccccatccctgcttgccc

SEQ ID NO: 833857 - DNA, 12 bp, Homo sapiens
gccccatcctca

SEQ ID NO: 833858 - DNA, 18 bp, Homo sapiens
gccccatcctcatccctg

SEQ ID NO: 833859 - DNA, 20 bp, Homo sapiens
gccccatctcatcctggcac

SEQ ID NO: 833860 - DNA, 21 bp, Homo sapiens
gccccatcttgatctttgagc

SEQ ID NO: 833861 - DNA, 14 bp, Homo sapiens
gccccatgcctgtc

SEQ ID NO: 833862 - DNA, 16 bp, Homo sapiens
gccccatgcctgtcca

SEQ ID NO: 833863 - DNA, 23 bp, Homo sapiens
gccccatgcctgtccagcctggg

SEQ ID NO: 833864 - DNA, 13 bp, Homo sapiens
gccccatgctctg

SEQ ID NO: 833865 - DNA, 16 bp, Homo sapiens
gccccatgctctgccc

SEQ ID NO: 833866 - DNA, 17 bp, Homo sapiens
gccccatgctctgcccc

SEQ ID NO: 833867 - DNA, 21 bp, Homo sapiens
gccccatgtgccttgtccagg

SEQ ID NO: 833868 - DNA, 15 bp, Homo sapiens
gccccattcctggga

SEQ ID NO: 833869 - DNA, 19 bp, Homo sapiens
gccccattccttgcgcctc

SEQ ID NO: 833870 - DNA, 21 bp, Homo sapiens
gccccattccttgcgcctcag

SEQ ID NO: 833871 - DNA, 14 bp, Homo sapiens
gcccccaacacagg

SEQ ID NO: 833872 - DNA, 16 bp, Homo sapiens
gcccccaacctcaggg

SEQ ID NO: 833873 - DNA, 12 bp, Homo sapiens
gcccccaataaa

SEQ ID NO: 833874 - DNA, 16 bp, Homo sapiens
gcccccaataaaggca

SEQ ID NO: 833875 - DNA, 20 bp, Homo sapiens
gcccccaataaaggcagctg

SEQ ID NO: 833876 - DNA, 21 bp, Homo sapiens
gcccccaccccggggaccctg

SEQ ID NO: 833877 - DNA, 16 bp, Homo sapiens
gcccccaccccttccc

SEQ ID NO: 833878 - DNA, 20 bp, Homo sapiens
gcccccaccccttccccagg

SEQ ID NO: 833879 - DNA, 21 bp, Homo sapiens
gcccccaccccttccccaggc

SEQ ID NO: 833880 - DNA, 23 bp, Homo sapiens
gcccccaccccttccccaggccc

SEQ ID NO: 833881 - DNA, 21 bp, Homo sapiens
gcccccaccggaactgggctg

SEQ ID NO: 833882 - DNA, 15 bp, Homo sapiens
gcccccaccgggctg

SEQ ID NO: 833883 - DNA, 16 bp, Homo sapiens
gcccccacttgcctct

SEQ ID NO: 833884 - DNA, 17 bp, Homo sapiens
gcccccagaaagcctcc

SEQ ID NO: 833885 - DNA, 18 bp, Homo sapiens
gcccccagaaagcctcct

SEQ ID NO: 833886 - DNA, 19 bp, Homo sapiens
gcccccagatagagctggg

SEQ ID NO: 833887 - DNA, 17 bp, Homo sapiens
gcccccagcagaggcag

SEQ ID NO: 833888 - DNA, 13 bp, Homo sapiens
gcccccagcccaa

SEQ ID NO: 833889 - DNA, 15 bp, Homo sapiens
gcccccagcccaaag

SEQ ID NO: 833890 - DNA, 17 bp, Homo sapiens
gcccccagcccagggct

SEQ ID NO: 833891 - DNA, 22 bp, Homo sapiens
gcccccagcccagggctcctgc

SEQ ID NO: 833892 - DNA, 20 bp, Homo sapiens
gcccccagccccggggtgag

SEQ ID NO: 833893 - DNA, 12 bp, Homo sapiens
gcccccagccta

SEQ ID NO: 833894 - DNA, 14 bp, Homo sapiens
gcccccagcctatg

SEQ ID NO: 833895 - DNA, 13 bp, Homo sapiens
gcccccagcctgg

SEQ ID NO: 833896 - DNA, 15 bp, Homo sapiens
gcccccagcctggcc

SEQ ID NO: 833897 - DNA, 13 bp, Homo sapiens
gcccccagctggc

SEQ ID NO: 833898 - DNA, 18 bp, Homo sapiens
gcccccaggaagacatta

SEQ ID NO: 833899 - DNA, 16 bp, Homo sapiens
gcccccaggatctggg

SEQ ID NO: 833900 - DNA, 18 bp, Homo sapiens
gcccccaggattccccca

SEQ ID NO: 833901 - DNA, 19 bp, Homo sapiens
gcccccaggattcccccag

SEQ ID NO: 833902 - DNA, 12 bp, Homo sapiens
gcccccaggcag

SEQ ID NO: 833903 - DNA, 13 bp, Homo sapiens
gcccccaggcagc

SEQ ID NO: 833904 - DNA, 17 bp, Homo sapiens
gcccccaggcagccacc

SEQ ID NO: 833905 - DNA, 20 bp, Homo sapiens
gcccccaggcagccaccagt

SEQ ID NO: 833906 - DNA, 14 bp, Homo sapiens
gcccccaggccagg

SEQ ID NO: 833907 - DNA, 15 bp, Homo sapiens
gcccccaggccaggt

SEQ ID NO: 833908 - DNA, 16 bp, Homo sapiens
gcccccaggctgctgg

SEQ ID NO: 833909 - DNA, 11 bp, Homo sapiens
gcccccagggc

SEQ ID NO: 833910 - DNA, 16 bp, Homo sapiens
gcccccagggcctcca

SEQ ID NO: 833911 - DNA, 21 bp, Homo sapiens
gcccccagtccccacccctgc

SEQ ID NO: 833912 - DNA, 13 bp, Homo sapiens
gcccccagtgggg

SEQ ID NO: 833913 - DNA, 14 bp, Homo sapiens
gcccccatccctcg

SEQ ID NO: 833914 - DNA, 21 bp, Homo sapiens
gcccccatccctcggacccac

SEQ ID NO: 833915 - DNA, 21 bp, Homo sapiens
gcccccatctccccaggcctc

SEQ ID NO: 833916 - DNA, 23 bp, Homo sapiens
gcccccatctccccaggcctcca

SEQ ID NO: 833917 - DNA, 20 bp, Homo sapiens
gcccccatctgtcttcagca

SEQ ID NO: 833918 - DNA, 20 bp, Homo sapiens
gccccccaaatcccagggaa

SEQ ID NO: 833919 - DNA, 21 bp, Homo sapiens
gccccccaaggttctggttcc

SEQ ID NO: 833920 - DNA, 19 bp, Homo sapiens
gcccctgggcttggcctgc

SEQ ID NO: 833921 - DNA, 21 bp, Homo sapiens
gcccctgggcttggcctgctg

SEQ ID NO: 833922 - DNA, 12 bp, Homo sapiens
gcccctggggaa

SEQ ID NO: 833923 - DNA, 18 bp, Homo sapiens
gcccctggggacagagcc

SEQ ID NO: 833924 - DNA, 19 bp, Homo sapiens
gcccctggggacagagcca

SEQ ID NO: 833925 - DNA, 15 bp, Homo sapiens
gcccctggggcccag

SEQ ID NO: 833926 - DNA, 21 bp, Homo sapiens
gcccctggggtggccaccagt

SEQ ID NO: 833927 - DNA, 17 bp, Homo sapiens
gcccctgggtccttcta

SEQ ID NO: 833928 - DNA, 16 bp, Homo sapiens
gcccctggtcctgagg

SEQ ID NO: 833929 - DNA, 19 bp, Homo sapiens
gcccctggtcttctctaca

SEQ ID NO: 833930 - DNA, 17 bp, Homo sapiens
gcccctgtatggcactg

SEQ ID NO: 833931 - DNA, 12 bp, Homo sapiens
gcccctgtcccc

SEQ ID NO: 833932 - DNA, 14 bp, Homo sapiens
gcccctgtccccag

SEQ ID NO: 833933 - DNA, 16 bp, Homo sapiens
gcccctgtccccagtc

SEQ ID NO: 833934 - DNA, 18 bp, Homo sapiens
gcccctgtccccagtccc

SEQ ID NO: 833935 - DNA, 23 bp, Homo sapiens
gcccctgtccccagtccccagcc

SEQ ID NO: 833936 - DNA, 15 bp, Homo sapiens
gcccctgtctcgggg

SEQ ID NO: 833937 - DNA, 15 bp, Homo sapiens
gcccctgtggccaac

SEQ ID NO: 833938 - DNA, 17 bp, Homo sapiens
gcccctgtggccctggc

SEQ ID NO: 833939 - DNA, 21 bp, Homo sapiens
gcccctgtgtattcaccacca

SEQ ID NO: 833940 - DNA, 18 bp, Homo sapiens
gccccttaagggttgaag

SEQ ID NO: 833941 - DNA, 23 bp, Homo sapiens
gccccttaagggttgaaggcagt

SEQ ID NO: 833942 - DNA, 15 bp, Homo sapiens
gccccttcactcatt

SEQ ID NO: 833943 - DNA, 20 bp, Homo sapiens
gccccttcacttctgaccac

SEQ ID NO: 833944 - DNA, 21 bp, Homo sapiens
gccccttcacttctgaccaca

SEQ ID NO: 833945 - DNA, 17 bp, Homo sapiens
gccccttctcagaatct

SEQ ID NO: 833946 - DNA, 23 bp, Homo sapiens
gccccttctccccttcctggaca

SEQ ID NO: 833947 - DNA, 15 bp, Homo sapiens
gccccttctgctcag

SEQ ID NO: 833948 - DNA, 19 bp, Homo sapiens
gccccttctgctcagctct

SEQ ID NO: 833949 - DNA, 13 bp, Homo sapiens
gccccttggctgg

SEQ ID NO: 833950 - DNA, 18 bp, Homo sapiens
gccccttggctggatcag

SEQ ID NO: 833951 - DNA, 22 bp, Homo sapiens
gccccttgggcatccacccagt

SEQ ID NO: 833952 - DNA, 17 bp, Homo sapiens
gccccttgtcctgaagc

SEQ ID NO: 833953 - DNA, 20 bp, Homo sapiens
gcccctttacggacaccccc

SEQ ID NO: 833954 - DNA, 20 bp, Homo sapiens
gcccctttccttcactgccc

SEQ ID NO: 833955 - DNA, 22 bp, Homo sapiens
gcccctttccttcactgcccca

SEQ ID NO: 833956 - DNA, 15 bp, Homo sapiens
gcccctttgcctctg

SEQ ID NO: 833957 - DNA, 14 bp, Homo sapiens
gccccttttctctg

SEQ ID NO: 833958 - DNA, 16 bp, Homo sapiens
gccccttttctctgct

SEQ ID NO: 833959 - DNA, 19 bp, Homo sapiens
gccccttttctctgctctt

SEQ ID NO: 833960 - DNA, 16 bp, Homo sapiens
gcccctttttactccc

SEQ ID NO: 833961 - DNA, 21 bp, Homo sapiens
gcccctttttactccccttga

SEQ ID NO: 833962 - DNA, 18 bp, Homo sapiens
gcccgaaactaagccagg

SEQ ID NO: 833963 - DNA, 18 bp, Homo sapiens
gcccgacaggtgggcctg

SEQ ID NO: 833964 - DNA, 19 bp, Homo sapiens
gcccgacaggtgggcctgg

SEQ ID NO: 833965 - DNA, 14 bp, Homo sapiens
gcccgactagcagg

SEQ ID NO: 833966 - DNA, 15 bp, Homo sapiens
gcccgactagcaggc

SEQ ID NO: 833967 - DNA, 13 bp, Homo sapiens
gcccgacttgctg

SEQ ID NO: 833968 - DNA, 14 bp, Homo sapiens
gcccgataaagacg

SEQ ID NO: 833969 - DNA, 19 bp, Homo sapiens
gcccgataaagacggattc

SEQ ID NO: 833970 - DNA, 15 bp, Homo sapiens
gcccgatattctccc

SEQ ID NO: 833971 - DNA, 17 bp, Homo sapiens
gcccgatattctccctg

SEQ ID NO: 833972 - DNA, 21 bp, Homo sapiens
gcccgatattctccctgacct

SEQ ID NO: 833973 - DNA, 12 bp, Homo sapiens
gcccgcagagcc

SEQ ID NO: 833974 - DNA, 13 bp, Homo sapiens
gcccgcagagccc

SEQ ID NO: 833975 - DNA, 14 bp, Homo sapiens
gcccgcagcccaga

SEQ ID NO: 833976 - DNA, 13 bp, Homo sapiens
gcccgcagggcca

SEQ ID NO: 833977 - DNA, 19 bp, Homo sapiens
gcccgcagggccatgcaga

SEQ ID NO: 833978 - DNA, 22 bp, Homo sapiens
gcccgcagggccatgcagacct

SEQ ID NO: 833979 - DNA, 17 bp, Homo sapiens
gcccgcatgtgtgcctg

SEQ ID NO: 833980 - DNA, 21 bp, Homo sapiens
gcccgccaaggtagccatccc

SEQ ID NO: 833981 - DNA, 17 bp, Homo sapiens
gcccgccagcctcagtg

SEQ ID NO: 833982 - DNA, 14 bp, Homo sapiens
gcccgcccactgtc

SEQ ID NO: 833983 - DNA, 18 bp, Homo sapiens
gcccgccctcacctctga

SEQ ID NO: 833984 - DNA, 20 bp, Homo sapiens
gcccgccctctgcctcctca

SEQ ID NO: 833985 - DNA, 20 bp, Homo sapiens
gcccgccgcccgcccctcag

SEQ ID NO: 833986 - DNA, 15 bp, Homo sapiens
gcccgccgtctgcag

SEQ ID NO: 833987 - DNA, 17 bp, Homo sapiens
gcccgccgtctgcaggg

SEQ ID NO: 833988 - DNA, 12 bp, Homo sapiens
gcccgcctgccg

SEQ ID NO: 833989 - DNA, 19 bp, Homo sapiens
gcccgcctgccgtgcatgg

SEQ ID NO: 833990 - DNA, 13 bp, Homo sapiens
gcccgcctggcag

SEQ ID NO: 833991 - DNA, 14 bp, Homo sapiens
gcccgcctggcaga

SEQ ID NO: 833992 - DNA, 20 bp, Homo sapiens
gcccgccttcaggctgcccg

SEQ ID NO: 833993 - DNA, 20 bp, Homo sapiens
gcccgccttggctttctccc

SEQ ID NO: 833994 - DNA, 13 bp, Homo sapiens
gcccgcgcccgcg

SEQ ID NO: 833995 - DNA, 14 bp, Homo sapiens
gcccgcggcctgca

SEQ ID NO: 833996 - DNA, 18 bp, Homo sapiens
gcccgcggcctgcaccga

SEQ ID NO: 833997 - DNA, 20 bp, Homo sapiens
gcccgcggcctgcaccgacc

SEQ ID NO: 833998 - DNA, 14 bp, Homo sapiens
gcccgcggcctgga

SEQ ID NO: 833999 - DNA, 23 bp, Homo sapiens
gcccgcgggagacagcttctctg

SEQ ID NO: 834000 - DNA, 18 bp, Homo sapiens
gcccgcgggcacagccag

SEQ ID NO: 834001 - DNA, 20 bp, Homo sapiens
gcccgcgggcacagccagcc

SEQ ID NO: 834002 - DNA, 18 bp, Homo sapiens
gcccgcggggacattggg

SEQ ID NO: 834003 - DNA, 22 bp, Homo sapiens
gcccgctcccaacccccctcct

SEQ ID NO: 834004 - DNA, 13 bp, Homo sapiens
gcccgctcccaca

SEQ ID NO: 834005 - DNA, 21 bp, Homo sapiens
gcccgctcccttcctgccact

SEQ ID NO: 834006 - DNA, 20 bp, Homo sapiens
gcccgctgagctgagtggcc

SEQ ID NO: 834007 - DNA, 14 bp, Homo sapiens
gcccgctgcagcct

SEQ ID NO: 834008 - DNA, 13 bp, Homo sapiens
gcccgctgcctct

SEQ ID NO: 834009 - DNA, 15 bp, Homo sapiens
gcccgctgcctcttg

SEQ ID NO: 834010 - DNA, 18 bp, Homo sapiens
gcccgctgcctcttggct

SEQ ID NO: 834011 - DNA, 21 bp, Homo sapiens
gcccgctgcctcttggcttct

SEQ ID NO: 834012 - DNA, 13 bp, Homo sapiens
gcccgctgggctg

SEQ ID NO: 834013 - DNA, 15 bp, Homo sapiens
gcccgctgggctgag

SEQ ID NO: 834014 - DNA, 16 bp, Homo sapiens
gcccgctgggctgagc

SEQ ID NO: 834015 - DNA, 13 bp, Homo sapiens
gcccgcttcaagc

SEQ ID NO: 834016 - DNA, 15 bp, Homo sapiens
gcccgcttcaagctc

SEQ ID NO: 834017 - DNA, 20 bp, Homo sapiens
gcccggaagcgccaggctgg

SEQ ID NO: 834018 - DNA, 21 bp, Homo sapiens
gcccggaagcgccaggctgga

SEQ ID NO: 834019 - DNA, 17 bp, Homo sapiens
gcccggactcaccaact

SEQ ID NO: 834020 - DNA, 22 bp, Homo sapiens
gcccggactcaccaacttgcca

SEQ ID NO: 834021 - DNA, 19 bp, Homo sapiens
gcccggagattggacggcc

SEQ ID NO: 834022 - DNA, 16 bp, Homo sapiens
gcccggaggccgggcc

SEQ ID NO: 834023 - DNA, 18 bp, Homo sapiens
gcccggaggccgggccct

SEQ ID NO: 834024 - DNA, 15 bp, Homo sapiens
gcccggattctggga

SEQ ID NO: 834025 - DNA, 14 bp, Homo sapiens
gcccggccacaccc

SEQ ID NO: 834026 - DNA, 17 bp, Homo sapiens
gcccggcccctcaccct

SEQ ID NO: 834027 - DNA, 17 bp, Homo sapiens
gcccggcgcccctgcca

SEQ ID NO: 834028 - DNA, 16 bp, Homo sapiens
gcccggcgccgggcac

SEQ ID NO: 834029 - DNA, 17 bp, Homo sapiens
gcccggcgcctgccctg

SEQ ID NO: 834030 - DNA, 19 bp, Homo sapiens
gcccggcgcctgccctgcc

SEQ ID NO: 834031 - DNA, 21 bp, Homo sapiens
gcccggcgcggtggctcacgc

SEQ ID NO: 834032 - DNA, 20 bp, Homo sapiens
gcccggcgctgattcctcgt

SEQ ID NO: 834033 - DNA, 14 bp, Homo sapiens
gcccggctgctgct

SEQ ID NO: 834034 - DNA, 22 bp, Homo sapiens
gcccggctgctgcttggatgcg

SEQ ID NO: 834035 - DNA, 15 bp, Homo sapiens
gcccgggagcctagg

SEQ ID NO: 834036 - DNA, 15 bp, Homo sapiens
gcccgggcaggccag

SEQ ID NO: 834037 - DNA, 16 bp, Homo sapiens
gcccgggcaggccagc

SEQ ID NO: 834038 - DNA, 16 bp, Homo sapiens
gcccgggcccccgccc

SEQ ID NO: 834039 - DNA, 18 bp, Homo sapiens
gcccgggcccccgccccg

SEQ ID NO: 834040 - DNA, 20 bp, Homo sapiens
gcccgggcccccgccccgcc

SEQ ID NO: 834041 - DNA, 18 bp, Homo sapiens
gcccgggccgaccctgcg

SEQ ID NO: 834042 - DNA, 18 bp, Homo sapiens
gccctgcgtcggccctgg

SEQ ID NO: 834043 - DNA, 19 bp, Homo sapiens
gccctgcgttggagccact

SEQ ID NO: 834044 - DNA, 23 bp, Homo sapiens
gccctgcgttggagccactcctg

SEQ ID NO: 834045 - DNA, 14 bp, Homo sapiens
gccctgctcctaag

SEQ ID NO: 834046 - DNA, 15 bp, Homo sapiens
gccctgctcctccct

SEQ ID NO: 834047 - DNA, 16 bp, Homo sapiens
gccctgctcctccctg

SEQ ID NO: 834048 - DNA, 22 bp, Homo sapiens
gccctgctcctccctggctgcc

SEQ ID NO: 834049 - DNA, 23 bp, Homo sapiens
gccctgctcctccctggctgccc

SEQ ID NO: 834050 - DNA, 12 bp, Homo sapiens
gccctgctgagg

SEQ ID NO: 834051 - DNA, 16 bp, Homo sapiens
gccctgctgagtccca

SEQ ID NO: 834052 - DNA, 21 bp, Homo sapiens
gccctgctgagtcccaggctg

SEQ ID NO: 834053 - DNA, 22 bp, Homo sapiens
gccctgctgagtcccaggctga

SEQ ID NO: 834054 - DNA, 14 bp, Homo sapiens
gccctgctgccaca

SEQ ID NO: 834055 - DNA, 13 bp, Homo sapiens
gccctgctggcct

SEQ ID NO: 834056 - DNA, 16 bp, Homo sapiens
gccctgctggcctgtc

SEQ ID NO: 834057 - DNA, 16 bp, Homo sapiens
gccctgctttgggctg

SEQ ID NO: 834058 - DNA, 20 bp, Homo sapiens
gccctgctttgggctgccct

SEQ ID NO: 834059 - DNA, 18 bp, Homo sapiens
gccctgctttttttctta

SEQ ID NO: 834060 - DNA, 13 bp, Homo sapiens
gccctggacagat

SEQ ID NO: 834061 - DNA, 19 bp, Homo sapiens
gccctggaccttgggccta

SEQ ID NO: 834062 - DNA, 14 bp, Homo sapiens
gccctggagcagct

SEQ ID NO: 834063 - DNA, 14 bp, Homo sapiens
gccctggagccagg

SEQ ID NO: 834064 - DNA, 19 bp, Homo sapiens
gccctggagccagggcaga

SEQ ID NO: 834065 - DNA, 15 bp, Homo sapiens
gccctggaggcggtg

SEQ ID NO: 834066 - DNA, 13 bp, Homo sapiens
gccctggaggctg

SEQ ID NO: 834067 - DNA, 13 bp, Homo sapiens
gccctggaggtgg

SEQ ID NO: 834068 - DNA, 20 bp, Homo sapiens
gccctggaggtggctgagcc

SEQ ID NO: 834069 - DNA, 15 bp, Homo sapiens
gccctggcagcagca

SEQ ID NO: 834070 - DNA, 16 bp, Homo sapiens
gccctggcagcagcag

SEQ ID NO: 834071 - DNA, 21 bp, Homo sapiens
gccctggcagggtcatcctgt

SEQ ID NO: 834072 - DNA, 13 bp, Homo sapiens
gccctggcccacc

SEQ ID NO: 834073 - DNA, 14 bp, Homo sapiens
gccctggcctggct

SEQ ID NO: 834074 - DNA, 18 bp, Homo sapiens
gccctggctcccacctgt

SEQ ID NO: 834075 - DNA, 23 bp, Homo sapiens
gccctggctcccacctgtttctg

SEQ ID NO: 834076 - DNA, 14 bp, Homo sapiens
gccctggctccttg

SEQ ID NO: 834077 - DNA, 19 bp, Homo sapiens
gccctggctccttgcagca

SEQ ID NO: 834078 - DNA, 22 bp, Homo sapiens
gccctggctccttgcagcaggg

SEQ ID NO: 834079 - DNA, 13 bp, Homo sapiens
gccctggctctgc

SEQ ID NO: 834080 - DNA, 11 bp, Homo sapiens
gccctggctgc

SEQ ID NO: 834081 - DNA, 23 bp, Homo sapiens
gccctggctgttctgtggttcct

SEQ ID NO: 834082 - DNA, 17 bp, Homo sapiens
gccctgggaaccactcc

SEQ ID NO: 834083 - DNA, 18 bp, Homo sapiens
gccctgggaaccactccc

SEQ ID NO: 834084 - DNA, 21 bp, Homo sapiens
gccctgggaaccactcccacc

SEQ ID NO: 834085 - DNA, 16 bp, Homo sapiens
gccctgggatgcctca

SEQ ID NO: 834086 - DNA, 17 bp, Homo sapiens
gccctgggccacactga

SEQ ID NO: 834087 - DNA, 12 bp, Homo sapiens
gccctgggccag

SEQ ID NO: 834088 - DNA, 17 bp, Homo sapiens
gccctgggccaggcagg

SEQ ID NO: 834089 - DNA, 18 bp, Homo sapiens
gccctgggccccaccacc

SEQ ID NO: 834090 - DNA, 12 bp, Homo sapiens
gccctgggcctc

SEQ ID NO: 834091 - DNA, 23 bp, Homo sapiens
gccctgggctgtctgtcaccagc

SEQ ID NO: 834092 - DNA, 17 bp, Homo sapiens
gccctgggcttggctct

SEQ ID NO: 834093 - DNA, 19 bp, Homo sapiens
gccctgggcttggctcttg

SEQ ID NO: 834094 - DNA, 21 bp, Homo sapiens
gccctgggcttggctcttggc

SEQ ID NO: 834095 - DNA, 15 bp, Homo sapiens
gccctggggaggggt

SEQ ID NO: 834096 - DNA, 20 bp, Homo sapiens
gccctggggatcttcccaca

SEQ ID NO: 834097 - DNA, 16 bp, Homo sapiens
gccctgggggtctggg

SEQ ID NO: 834098 - DNA, 19 bp, Homo sapiens
gccctggggtaccatgtgg

SEQ ID NO: 834099 - DNA, 22 bp, Homo sapiens
gccctggtaaaagggatacaca

SEQ ID NO: 834100 - DNA, 13 bp, Homo sapiens
gccctggtccagg

SEQ ID NO: 834101 - DNA, 17 bp, Homo sapiens
gccctggtccagggaag

SEQ ID NO: 834102 - DNA, 20 bp, Homo sapiens
gccctggtccagggaagctg

SEQ ID NO: 834103 - DNA, 16 bp, Homo sapiens
gccctggtcctggcct

SEQ ID NO: 834104 - DNA, 15 bp, Homo sapiens
gccctggtccttcca

SEQ ID NO: 834105 - DNA, 18 bp, Homo sapiens
gccctggtgctcctgccc

SEQ ID NO: 834106 - DNA, 17 bp, Homo sapiens
gccctggtgctgccaca

SEQ ID NO: 834107 - DNA, 21 bp, Homo sapiens
gccctggtgctgccacacttc

SEQ ID NO: 834108 - DNA, 21 bp, Homo sapiens
gccctggtggagaaagcactg

SEQ ID NO: 834109 - DNA, 18 bp, Homo sapiens
gccctggtgtcaggcagg

SEQ ID NO: 834110 - DNA, 21 bp, Homo sapiens
gccctggttctggctgtggtc

SEQ ID NO: 834111 - DNA, 20 bp, Homo sapiens
gccctgtacccaccccagca

SEQ ID NO: 834112 - DNA, 20 bp, Homo sapiens
gccctgtccaaaagcgccct

SEQ ID NO: 834113 - DNA, 22 bp, Homo sapiens
gccctgtccaaaagcgccctca

SEQ ID NO: 834114 - DNA, 11 bp, Homo sapiens
gccctgtccag

SEQ ID NO: 834115 - DNA, 12 bp, Homo sapiens
gccctgtccagc

SEQ ID NO: 834116 - DNA, 14 bp, Homo sapiens
gccctgtccagccc

SEQ ID NO: 834117 - DNA, 16 bp, Homo sapiens
gccctgtcccaggccg

SEQ ID NO: 834118 - DNA, 15 bp, Homo sapiens
gccctgtcccctgga

SEQ ID NO: 834119 - DNA, 17 bp, Homo sapiens
gccctgtccctgtcccc

SEQ ID NO: 834120 - DNA, 20 bp, Homo sapiens
gccctgtgcagaccttactc

SEQ ID NO: 834121 - DNA, 14 bp, Homo sapiens
gccctgtgcctggg

SEQ ID NO: 834122 - DNA, 17 bp, Homo sapiens
gccctgtgcctgggccc

SEQ ID NO: 834123 - DNA, 16 bp, Homo sapiens
gccctgtggaagggac

SEQ ID NO: 834124 - DNA, 16 bp, Homo sapiens
gccctgtggagtccag

SEQ ID NO: 834125 - DNA, 19 bp, Homo sapiens
gccctgtggccgccacctg

SEQ ID NO: 834126 - DNA, 13 bp, Homo sapiens
gccctgtgtactt

SEQ ID NO: 834127 - DNA, 13 bp, Homo sapiens
gccctgtgtctgt

SEQ ID NO: 834128 - DNA, 19 bp, Homo sapiens
gccctgtgtctgtcacagg

SEQ ID NO: 834129 - DNA, 20 bp, Homo sapiens
gccctgtgtctgtcacaggc

SEQ ID NO: 834130 - DNA, 14 bp, Homo sapiens
gccctgttccctgg

SEQ ID NO: 834131 - DNA, 16 bp, Homo sapiens
gccctgttgacacagg

SEQ ID NO: 834132 - DNA, 18 bp, Homo sapiens
gccctgttggcagctcta

SEQ ID NO: 834133 - DNA, 17 bp, Homo sapiens
gccctgttgtgtataga

SEQ ID NO: 834134 - DNA, 14 bp, Homo sapiens
gcccttaccttccc

SEQ ID NO: 834135 - DNA, 16 bp, Homo sapiens
gcccttagtcccccaa

SEQ ID NO: 834136 - DNA, 23 bp, Homo sapiens
gcccttagtcccccaactctgag

SEQ ID NO: 834137 - DNA, 15 bp, Homo sapiens
gcccttatggagctc

SEQ ID NO: 834138 - DNA, 22 bp, Homo sapiens
gcccttcagacgagatcctgtt

SEQ ID NO: 834139 - DNA, 14 bp, Homo sapiens
gcccttcagattgt

SEQ ID NO: 834140 - DNA, 19 bp, Homo sapiens
gcccttcagtctgctccac

SEQ ID NO: 834141 - DNA, 14 bp, Homo sapiens
gcccttccagcctg

SEQ ID NO: 834142 - DNA, 23 bp, Homo sapiens
gcccttccccctgcaaaaagaaa

SEQ ID NO: 834143 - DNA, 18 bp, Homo sapiens
gcccttcccctcccccac

SEQ ID NO: 834144 - DNA, 22 bp, Homo sapiens
gcccttcccctcccccactcct

SEQ ID NO: 834145 - DNA, 15 bp, Homo sapiens
gcccttcccctcccg

SEQ ID NO: 834146 - DNA, 21 bp, Homo sapiens
gcccttcccctcccgacagcc

SEQ ID NO: 834147 - DNA, 13 bp, Homo sapiens
gcccttccctctg

SEQ ID NO: 834148 - DNA, 16 bp, Homo sapiens
gcccttccctctgggc

SEQ ID NO: 834149 - DNA, 19 bp, Homo sapiens
gcccttccctctgggcacg

SEQ ID NO: 834150 - DNA, 14 bp, Homo sapiens
gcccttccctgagt

SEQ ID NO: 834151 - DNA, 12 bp, Homo sapiens
gcccttccctgt

SEQ ID NO: 834152 - DNA, 16 bp, Homo sapiens
gcccttccctgtccct

SEQ ID NO: 834153 - DNA, 18 bp, Homo sapiens
gcccttccctgtccctct

SEQ ID NO: 834154 - DNA, 12 bp, Homo sapiens
gcccttcctcag

SEQ ID NO: 834155 - DNA, 21 bp, Homo sapiens
gcccttcctcagggcccctgg

SEQ ID NO: 834156 - DNA, 21 bp, Homo sapiens
gcccttcctcctgaagcctct

SEQ ID NO: 834157 - DNA, 22 bp, Homo sapiens
gcccttcctcctgaagcctctg

SEQ ID NO: 834158 - DNA, 23 bp, Homo sapiens
gcccttcctcctgaagcctctgc

SEQ ID NO: 834159 - DNA, 17 bp, Homo sapiens
gcccttcctcctgatgg

SEQ ID NO: 834160 - DNA, 12 bp, Homo sapiens
gcccttcctctc

SEQ ID NO: 834161 - DNA, 16 bp, Homo sapiens
gcccttcctctccact

SEQ ID NO: 834162 - DNA, 17 bp, Homo sapiens
gcccttcctctccactg

SEQ ID NO: 834163 - DNA, 18 bp, Homo sapiens
gcccttcctctccactgc

SEQ ID NO: 834164 - DNA, 19 bp, Homo sapiens
gcccttcctctccactgcc

SEQ ID NO: 834165 - DNA, 20 bp, Homo sapiens
gcccttcctctccactgcct

SEQ ID NO: 834166 - DNA, 15 bp, Homo sapiens
gcccttcctctttgg

SEQ ID NO: 834167 - DNA, 21 bp, Homo sapiens
gcccttccttccatttttgat

SEQ ID NO: 834168 - DNA, 19 bp, Homo sapiens
gcccttctcccggccctca

SEQ ID NO: 834169 - DNA, 20 bp, Homo sapiens
gcccttctcccggccctcac

SEQ ID NO: 834170 - DNA, 21 bp, Homo sapiens
gcccttctcccggccctcact

SEQ ID NO: 834171 - DNA, 11 bp, Homo sapiens
gcccttctctt

SEQ ID NO: 834172 - DNA, 19 bp, Homo sapiens
gcccttctgacccaaagca

SEQ ID NO: 834173 - DNA, 12 bp, Homo sapiens
gcccttctgcct

SEQ ID NO: 834174 - DNA, 15 bp, Homo sapiens
gcccttcttgctgcc

SEQ ID NO: 834175 - DNA, 16 bp, Homo sapiens
gcccttgaaccccctc

SEQ ID NO: 834176 - DNA, 21 bp, Homo sapiens
gcccttgactgtacagagact

SEQ ID NO: 834177 - DNA, 17 bp, Homo sapiens
gcccttgaggggcccca

SEQ ID NO: 834178 - DNA, 20 bp, Homo sapiens
gcccttgcaatcttctactt

SEQ ID NO: 834179 - DNA, 20 bp, Homo sapiens
gcccttgcagttcagcacca

SEQ ID NO: 834180 - DNA, 22 bp, Homo sapiens
gcccttgcagttcagcaccacc

SEQ ID NO: 834181 - DNA, 13 bp, Homo sapiens
gcccttgccccca

SEQ ID NO: 834182 - DNA, 20 bp, Homo sapiens
gcccttgcccccatccctcg

SEQ ID NO: 834183 - DNA, 13 bp, Homo sapiens
gcccttgccctga

SEQ ID NO: 834184 - DNA, 15 bp, Homo sapiens
gcccttgccctgacc

SEQ ID NO: 834185 - DNA, 16 bp, Homo sapiens
gcccttgccctgacct

SEQ ID NO: 834186 - DNA, 21 bp, Homo sapiens
gcccttgccctgacctcccag

SEQ ID NO: 834187 - DNA, 19 bp, Homo sapiens
gcccttgcccttggagctg

SEQ ID NO: 834188 - DNA, 14 bp, Homo sapiens
gcccttgctgcccg

SEQ ID NO: 834189 - DNA, 21 bp, Homo sapiens
gcccttggagcgtggactggt

SEQ ID NO: 834190 - DNA, 14 bp, Homo sapiens
gcccttgggacagc

SEQ ID NO: 834191 - DNA, 22 bp, Homo sapiens
gcccttgggacagccagagctg

SEQ ID NO: 834192 - DNA, 12 bp, Homo sapiens
gcccttgggcag

SEQ ID NO: 834193 - DNA, 13 bp, Homo sapiens
gcccttgggccac

SEQ ID NO: 834194 - DNA, 18 bp, Homo sapiens
gcccttgggccacgctct

SEQ ID NO: 834195 - DNA, 13 bp, Homo sapiens
gcccttggggcct

SEQ ID NO: 834196 - DNA, 21 bp, Homo sapiens
gcccttggggtaagccagagc

SEQ ID NO: 834197 - DNA, 16 bp, Homo sapiens
gcccttgtcattgcct

SEQ ID NO: 834198 - DNA, 13 bp, Homo sapiens
gcccttgtcctgc

SEQ ID NO: 834199 - DNA, 14 bp, Homo sapiens
gcccttgtcctgcc

SEQ ID NO: 834200 - DNA, 15 bp, Homo sapiens
gcccttgtcctgcca

SEQ ID NO: 834201 - DNA, 17 bp, Homo sapiens
gcccttgtcctgccagc

SEQ ID NO: 834202 - DNA, 22 bp, Homo sapiens
gcccttgtgtgtgccctgggcc

SEQ ID NO: 834203 - DNA, 14 bp, Homo sapiens
gcccttgttccagc

SEQ ID NO: 834204 - DNA, 20 bp, Homo sapiens
gccctttagggctgttgcta

SEQ ID NO: 834205 - DNA, 15 bp, Homo sapiens
gccctttcctcctca

SEQ ID NO: 834206 - DNA, 14 bp, Homo sapiens
gccctttcctttgg

SEQ ID NO: 834207 - DNA, 20 bp, Homo sapiens
gccctttgagatctggggag

SEQ ID NO: 834208 - DNA, 21 bp, Homo sapiens
gccctttgggaggctgaggcg

SEQ ID NO: 834209 - DNA, 17 bp, Homo sapiens
gcccttttacagctctt

SEQ ID NO: 834210 - DNA, 18 bp, Homo sapiens
gcccttttcaggaagctc

SEQ ID NO: 834211 - DNA, 17 bp, Homo sapiens
gcccttttcatatactt

SEQ ID NO: 834212 - DNA, 12 bp, Homo sapiens
gccgaagctctg

SEQ ID NO: 834213 - DNA, 14 bp, Homo sapiens
gccgaagctctggc

SEQ ID NO: 834214 - DNA, 20 bp, Homo sapiens
gccgacaatgccctgctggc

SEQ ID NO: 834215 - DNA, 21 bp, Homo sapiens
gccgacaatgccctgctggcc

SEQ ID NO: 834216 - DNA, 22 bp, Homo sapiens
gccgaccctgcggcctccacca

SEQ ID NO: 834217 - DNA, 13 bp, Homo sapiens
gccgacctcgtcc

SEQ ID NO: 834218 - DNA, 19 bp, Homo sapiens
gccgacctcgtcctccccc

SEQ ID NO: 834219 - DNA, 20 bp, Homo sapiens
gccgacctcgtcctccccct

SEQ ID NO: 834220 - DNA, 18 bp, Homo sapiens
gccgacgttttctccgca

SEQ ID NO: 834221 - DNA, 15 bp, Homo sapiens
gccgactcccccaac

SEQ ID NO: 834222 - DNA, 14 bp, Homo sapiens
gccgactctggccc

SEQ ID NO: 834223 - DNA, 19 bp, Homo sapiens
gccgagacagaccctctgc

SEQ ID NO: 834224 - DNA, 16 bp, Homo sapiens
gccgagaccgcagagg

SEQ ID NO: 834225 - DNA, 15 bp, Homo sapiens
gccgagatcacacca

SEQ ID NO: 834226 - DNA, 20 bp, Homo sapiens
gccgagatcacgccactgca

SEQ ID NO: 834227 - DNA, 17 bp, Homo sapiens
gccgagattgcaccact

SEQ ID NO: 834228 - DNA, 17 bp, Homo sapiens
gccgagccgggcctggg

SEQ ID NO: 834229 - DNA, 15 bp, Homo sapiens
gccgagctcctgggg

SEQ ID NO: 834230 - DNA, 20 bp, Homo sapiens
gccgagctcctggggagctc

SEQ ID NO: 834231 - DNA, 15 bp, Homo sapiens
gccgagctgcctggc

SEQ ID NO: 834232 - DNA, 15 bp, Homo sapiens
gccgagggccaggca

SEQ ID NO: 834233 - DNA, 16 bp, Homo sapiens
gccgagggccaggcag

SEQ ID NO: 834234 - DNA, 14 bp, Homo sapiens
gccgagtccaagct

SEQ ID NO: 834235 - DNA, 17 bp, Homo sapiens
gccgatatactctagat

SEQ ID NO: 834236 - DNA, 12 bp, Homo sapiens
gccgatgccacc

SEQ ID NO: 834237 - DNA, 13 bp, Homo sapiens
gccgatgccaccg

SEQ ID NO: 834238 - DNA, 15 bp, Homo sapiens
gccgatgccaccggc

SEQ ID NO: 834239 - DNA, 21 bp, Homo sapiens
gccgatgggagtctccctccg

SEQ ID NO: 834240 - DNA, 15 bp, Homo sapiens
gccgattctctgccc

SEQ ID NO: 834241 - DNA, 17 bp, Homo sapiens
gccgatttctgtaaact

SEQ ID NO: 834242 - DNA, 16 bp, Homo sapiens
gccgcaaaccacactg

SEQ ID NO: 834243 - DNA, 22 bp, Homo sapiens
gccgcaaattgtaccttttttg

SEQ ID NO: 834244 - DNA, 15 bp, Homo sapiens
gccgcaagggcctgg

SEQ ID NO: 834245 - DNA, 16 bp, Homo sapiens
gccgcaagggcctgga

SEQ ID NO: 834246 - DNA, 23 bp, Homo sapiens
gccgcaagggcctggacggggtc

SEQ ID NO: 834247 - DNA, 14 bp, Homo sapiens
gccgcaccctgcac

SEQ ID NO: 834248 - DNA, 12 bp, Homo sapiens
gccgcactctgg

SEQ ID NO: 834249 - DNA, 19 bp, Homo sapiens
gccgcagaagcagcccctc

SEQ ID NO: 834250 - DNA, 22 bp, Homo sapiens
gccgcagaagcagcccctcgag

SEQ ID NO: 834251 - DNA, 15 bp, Homo sapiens
gccgcagctcttgcc

SEQ ID NO: 834252 - DNA, 15 bp, Homo sapiens
gccgcaggaaggcag

SEQ ID NO: 834253 - DNA, 13 bp, Homo sapiens
gccgcaggaggga

SEQ ID NO: 834254 - DNA, 22 bp, Homo sapiens
gccgcagggcccaccttggacc

SEQ ID NO: 834255 - DNA, 18 bp, Homo sapiens
gccgcagggcggggctgg

SEQ ID NO: 834256 - DNA, 14 bp, Homo sapiens
gccgcaggtgggtg

SEQ ID NO: 834257 - DNA, 22 bp, Homo sapiens
gccgcaggtgggtgctgccctg

SEQ ID NO: 834258 - DNA, 15 bp, Homo sapiens
gccgcatcttctcca

SEQ ID NO: 834259 - DNA, 18 bp, Homo sapiens
gccgcatcttctccatct

SEQ ID NO: 834260 - DNA, 20 bp, Homo sapiens
gccgcatcttctccatctgg

SEQ ID NO: 834261 - DNA, 15 bp, Homo sapiens
gccgcattccctgag

SEQ ID NO: 834262 - DNA, 16 bp, Homo sapiens
gccgcattccctgagt

SEQ ID NO: 834263 - DNA, 14 bp, Homo sapiens
gccgcattggtgac

SEQ ID NO: 834264 - DNA, 15 bp, Homo sapiens
gccgccacccccatc

SEQ ID NO: 834265 - DNA, 16 bp, Homo sapiens
gccgccacccccatct

SEQ ID NO: 834266 - DNA, 21 bp, Homo sapiens
gccgccacccccatcttccac

SEQ ID NO: 834267 - DNA, 19 bp, Homo sapiens
gccgccactaggtgtcccc

SEQ ID NO: 834268 - DNA, 22 bp, Homo sapiens
gccgccactaggtgtccccaac

SEQ ID NO: 834269 - DNA, 17 bp, Homo sapiens
gccgccagtacttgtca

SEQ ID NO: 834270 - DNA, 17 bp, Homo sapiens
gccgccagttcatcttt

SEQ ID NO: 834271 - DNA, 16 bp, Homo sapiens
gccgccatctgcgcag

SEQ ID NO: 834272 - DNA, 18 bp, Homo sapiens
gccgccatctgcgcaggg

SEQ ID NO: 834273 - DNA, 16 bp, Homo sapiens
gccgccattgccacca

SEQ ID NO: 834274 - DNA, 22 bp, Homo sapiens
gccgcccacctcgctcccctct

SEQ ID NO: 834275 - DNA, 12 bp, Homo sapiens
gccgccccagcc

SEQ ID NO: 834276 - DNA, 15 bp, Homo sapiens
gccgccccctcctga

SEQ ID NO: 834277 - DNA, 17 bp, Homo sapiens
gccgccccctgcccccc

SEQ ID NO: 834278 - DNA, 11 bp, Homo sapiens
gccgcccctga

SEQ ID NO: 834279 - DNA, 14 bp, Homo sapiens
gccgcccgcccctc

SEQ ID NO: 834280 - DNA, 19 bp, Homo sapiens
gccgccctcaccctgccct

SEQ ID NO: 834281 - DNA, 13 bp, Homo sapiens
gccgccctgggct

SEQ ID NO: 834282 - DNA, 23 bp, Homo sapiens
gccgccctgggctgtctgtcacc

SEQ ID NO: 834283 - DNA, 17 bp, Homo sapiens
gccgccgggcaggcctg

SEQ ID NO: 834284 - DNA, 16 bp, Homo sapiens
gccgcctactggacgc

SEQ ID NO: 834285 - DNA, 23 bp, Homo sapiens
gccgcctactggacgctgccctg

SEQ ID NO: 834286 - DNA, 13 bp, Homo sapiens
gccgcctcaatgt

SEQ ID NO: 834287 - DNA, 23 bp, Homo sapiens
gcctcagctacccactatccttc

SEQ ID NO: 834288 - DNA, 14 bp, Homo sapiens
gcctcagctatgta

SEQ ID NO: 834289 - DNA, 16 bp, Homo sapiens
gcctcagctgcctcac

SEQ ID NO: 834290 - DNA, 19 bp, Homo sapiens
gcctcaggcactctcctgt

SEQ ID NO: 834291 - DNA, 21 bp, Homo sapiens
gcctcaggcgtttctgaagtg

SEQ ID NO: 834292 - DNA, 12 bp, Homo sapiens
gcctcaggctgc

SEQ ID NO: 834293 - DNA, 21 bp, Homo sapiens
gcctcaggcttgagggagggc

SEQ ID NO: 834294 - DNA, 18 bp, Homo sapiens
gcctcagggtcctgccct

SEQ ID NO: 834295 - DNA, 17 bp, Homo sapiens
gcctcagggtctaagga

SEQ ID NO: 834296 - DNA, 12 bp, Homo sapiens
gcctcaggtgct

SEQ ID NO: 834297 - DNA, 15 bp, Homo sapiens
gcctcagtatattta

SEQ ID NO: 834298 - DNA, 15 bp, Homo sapiens
gcctcagtctccctc

SEQ ID NO: 834299 - DNA, 18 bp, Homo sapiens
gcctcagtctccctccct

SEQ ID NO: 834300 - DNA, 14 bp, Homo sapiens
gcctcagtgccact

SEQ ID NO: 834301 - DNA, 16 bp, Homo sapiens
gcctcagtgccacttg

SEQ ID NO: 834302 - DNA, 14 bp, Homo sapiens
gcctcagtgtattt

SEQ ID NO: 834303 - DNA, 14 bp, Homo sapiens
gcctcagttcccag

SEQ ID NO: 834304 - DNA, 18 bp, Homo sapiens
gcctcagttcccagctcc

SEQ ID NO: 834305 - DNA, 19 bp, Homo sapiens
gcctcagttcccagctccc

SEQ ID NO: 834306 - DNA, 20 bp, Homo sapiens
gcctcagttcccagctcccc

SEQ ID NO: 834307 - DNA, 22 bp, Homo sapiens
gcctcagttcccagctcccccc

SEQ ID NO: 834308 - DNA, 19 bp, Homo sapiens
gcctcagtttctccatcag

SEQ ID NO: 834309 - DNA, 19 bp, Homo sapiens
gcctcagttttccttctgt

SEQ ID NO: 834310 - DNA, 16 bp, Homo sapiens
gcctcatactcctggg

SEQ ID NO: 834311 - DNA, 20 bp, Homo sapiens
gcctcatactcctgggctca

SEQ ID NO: 834312 - DNA, 15 bp, Homo sapiens
gcctcatatttaaag

SEQ ID NO: 834313 - DNA, 17 bp, Homo sapiens
gcctcatccctcggaag

SEQ ID NO: 834314 - DNA, 22 bp, Homo sapiens
gcctcatctataacatgcattt

SEQ ID NO: 834315 - DNA, 16 bp, Homo sapiens
gcctcatctcacctct

SEQ ID NO: 834316 - DNA, 12 bp, Homo sapiens
gcctcatctcct

SEQ ID NO: 834317 - DNA, 14 bp, Homo sapiens
gcctcatgccacac

SEQ ID NO: 834318 - DNA, 16 bp, Homo sapiens
gcctcatgtggctgga

SEQ ID NO: 834319 - DNA, 16 bp, Homo sapiens
gcctcatgttctcttc

SEQ ID NO: 834320 - DNA, 20 bp, Homo sapiens
gcctcatgttctcttcccag

SEQ ID NO: 834321 - DNA, 21 bp, Homo sapiens
gcctcatgttctcttcccagg

SEQ ID NO: 834322 - DNA, 14 bp, Homo sapiens
gcctcatgttctgt

SEQ ID NO: 834323 - DNA, 16 bp, Homo sapiens
gcctcatgttctgtgg

SEQ ID NO: 834324 - DNA, 21 bp, Homo sapiens
gcctcattcagcatgggtcct

SEQ ID NO: 834325 - DNA, 22 bp, Homo sapiens
gcctcattcagcatgggtcctt

SEQ ID NO: 834326 - DNA, 19 bp, Homo sapiens
gcctcattgtgccaagcct

SEQ ID NO: 834327 - DNA, 13 bp, Homo sapiens
gcctcatttccct

SEQ ID NO: 834328 - DNA, 15 bp, Homo sapiens
gcctcatttctttgt

SEQ ID NO: 834329 - DNA, 17 bp, Homo sapiens
gcctcatttctttgtct

SEQ ID NO: 834330 - DNA, 22 bp, Homo sapiens
gcctcatttctttgtctttttc

SEQ ID NO: 834331 - DNA, 22 bp, Homo sapiens
gcctccaaatgccaacttgtcc

SEQ ID NO: 834332 - DNA, 21 bp, Homo sapiens
gcctccaacgcccctgtggcc

SEQ ID NO: 834333 - DNA, 19 bp, Homo sapiens
gcctccaagcacagagcct

SEQ ID NO: 834334 - DNA, 16 bp, Homo sapiens
gcctccaagcctgcct

SEQ ID NO: 834335 - DNA, 17 bp, Homo sapiens
gcctccaagcctgcctc

SEQ ID NO: 834336 - DNA, 20 bp, Homo sapiens
gcctccaagcctgcctccca

SEQ ID NO: 834337 - DNA, 22 bp, Homo sapiens
gcctccaaggaggggctgtaaa

SEQ ID NO: 834338 - DNA, 15 bp, Homo sapiens
gcctccaagggtttc

SEQ ID NO: 834339 - DNA, 22 bp, Homo sapiens
gcctccacagcgagggcagctg

SEQ ID NO: 834340 - DNA, 12 bp, Homo sapiens
gcctccaccacc

SEQ ID NO: 834341 - DNA, 20 bp, Homo sapiens
gcctccaccaccactggcca

SEQ ID NO: 834342 - DNA, 21 bp, Homo sapiens
gcctccaccaccactggccac

SEQ ID NO: 834343 - DNA, 23 bp, Homo sapiens
gcctccacccgtcctccctcagc

SEQ ID NO: 834344 - DNA, 19 bp, Homo sapiens
gcctccactcccccacctg

SEQ ID NO: 834345 - DNA, 20 bp, Homo sapiens
gcctccactctagttctaga

SEQ ID NO: 834346 - DNA, 15 bp, Homo sapiens
gcctccagaagctgc

SEQ ID NO: 834347 - DNA, 20 bp, Homo sapiens
gcctccagaagctgctcctt

SEQ ID NO: 834348 - DNA, 14 bp, Homo sapiens
gcctccagagccag

SEQ ID NO: 834349 - DNA, 16 bp, Homo sapiens
gcctccagagccagcc

SEQ ID NO: 834350 - DNA, 20 bp, Homo sapiens
gcctccagagccagcctggg

SEQ ID NO: 834351 - DNA, 16 bp, Homo sapiens
gcctccagaggtcctc

SEQ ID NO: 834352 - DNA, 20 bp, Homo sapiens
gcctccagcaccaagggcgg

SEQ ID NO: 834353 - DNA, 16 bp, Homo sapiens
gcctccagcctctccc

SEQ ID NO: 834354 - DNA, 22 bp, Homo sapiens
gcctccagcctctcccggctgc

SEQ ID NO: 834355 - DNA, 16 bp, Homo sapiens
gcctccagcctttgct

SEQ ID NO: 834356 - DNA, 16 bp, Homo sapiens
gcctccagctgttctt

SEQ ID NO: 834357 - DNA, 19 bp, Homo sapiens
gcctccaggaaccacacca

SEQ ID NO: 834358 - DNA, 12 bp, Homo sapiens
gcctccaggacc

SEQ ID NO: 834359 - DNA, 18 bp, Homo sapiens
gcctccaggaccaggggc

SEQ ID NO: 834360 - DNA, 13 bp, Homo sapiens
gcctccaggaggg

SEQ ID NO: 834361 - DNA, 16 bp, Homo sapiens
gcctccaggaggggcc

SEQ ID NO: 834362 - DNA, 21 bp, Homo sapiens
gcctccaggcccccaactccg

SEQ ID NO: 834363 - DNA, 12 bp, Homo sapiens
gcctccagggcc

SEQ ID NO: 834364 - DNA, 12 bp, Homo sapiens
gcctccaggtgt

SEQ ID NO: 834365 - DNA, 14 bp, Homo sapiens
gcctccagtgcagt

SEQ ID NO: 834366 - DNA, 14 bp, Homo sapiens
gcctccatgcccca

SEQ ID NO: 834367 - DNA, 17 bp, Homo sapiens
gcctccatgccccagct

SEQ ID NO: 834368 - DNA, 11 bp, Homo sapiens
gcctccatgct

SEQ ID NO: 834369 - DNA, 17 bp, Homo sapiens
gcctccatttctgtctc

SEQ ID NO: 834370 - DNA, 18 bp, Homo sapiens
gcctcccaaagtgctagg

SEQ ID NO: 834371 - DNA, 16 bp, Homo sapiens
gcctcccaaagtgctg

SEQ ID NO: 834372 - DNA, 19 bp, Homo sapiens
gcctcccaaggtcctctca

SEQ ID NO: 834373 - DNA, 18 bp, Homo sapiens
gcctcccacacttgctgg

SEQ ID NO: 834374 - DNA, 20 bp, Homo sapiens
gcctcccacacttgctgggg

SEQ ID NO: 834375 - DNA, 23 bp, Homo sapiens
gcctcccacacttgctggggctc

SEQ ID NO: 834376 - DNA, 13 bp, Homo sapiens
gcctcccaccaga

SEQ ID NO: 834377 - DNA, 12 bp, Homo sapiens
gcctcccacccc

SEQ ID NO: 834378 - DNA, 18 bp, Homo sapiens
gcctcccacccgatgctg

SEQ ID NO: 834379 - DNA, 12 bp, Homo sapiens
gcctcccagagt

SEQ ID NO: 834380 - DNA, 14 bp, Homo sapiens
gcctcccagcctgg

SEQ ID NO: 834381 - DNA, 15 bp, Homo sapiens
gcctcccaggcaagc

SEQ ID NO: 834382 - DNA, 12 bp, Homo sapiens
gcctcccaggtt

SEQ ID NO: 834383 - DNA, 15 bp, Homo sapiens
gcctcccatccaggg

SEQ ID NO: 834384 - DNA, 12 bp, Homo sapiens
gcctcccatccc

SEQ ID NO: 834385 - DNA, 14 bp, Homo sapiens
gcctcccatcccgc

SEQ ID NO: 834386 - DNA, 16 bp, Homo sapiens
gcctcccatgcctggt

SEQ ID NO: 834387 - DNA, 23 bp, Homo sapiens
gcctcccatgcctggtcccaaga

SEQ ID NO: 834388 - DNA, 17 bp, Homo sapiens
gcctcccattctgcacc

SEQ ID NO: 834389 - DNA, 19 bp, Homo sapiens
gcctccccaacttgagcct

SEQ ID NO: 834390 - DNA, 19 bp, Homo sapiens
gcctccccaccccagtggg

SEQ ID NO: 834391 - DNA, 23 bp, Homo sapiens
gcctccccatttcccatctgcac

SEQ ID NO: 834392 - DNA, 12 bp, Homo sapiens
gcctcccccaac

SEQ ID NO: 834393 - DNA, 18 bp, Homo sapiens
gcctcccccaacacctgc

SEQ ID NO: 834394 - DNA, 22 bp, Homo sapiens
gcctcccccaacacctgctgcg

SEQ ID NO: 834395 - DNA, 16 bp, Homo sapiens
gcctcccccgccagcc

SEQ ID NO: 834396 - DNA, 17 bp, Homo sapiens
gcctcccccgccagccc

SEQ ID NO: 834397 - DNA, 20 bp, Homo sapiens
gcctcccccgccagccccaa

SEQ ID NO: 834398 - DNA, 22 bp, Homo sapiens
gcctcccccgccagccccaagc

SEQ ID NO: 834399 - DNA, 13 bp, Homo sapiens
gcctccccctcag

SEQ ID NO: 834400 - DNA, 14 bp, Homo sapiens
gcctccccctcaga

SEQ ID NO: 834401 - DNA, 21 bp, Homo sapiens
gcctcccctcccctggggacg

SEQ ID NO: 834402 - DNA, 22 bp, Homo sapiens
gcctcccctcccctggggacgc

SEQ ID NO: 834403 - DNA, 14 bp, Homo sapiens
gcctcccctgccag

SEQ ID NO: 834404 - DNA, 17 bp, Homo sapiens
gcctcccctgccagggc

SEQ ID NO: 834405 - DNA, 15 bp, Homo sapiens
gcctcccctgggcag

SEQ ID NO: 834406 - DNA, 17 bp, Homo sapiens
gcctccccttcttcccg

SEQ ID NO: 834407 - DNA, 19 bp, Homo sapiens
gcctcccggggcccaggac

SEQ ID NO: 834408 - DNA, 21 bp, Homo sapiens
gcctcccggggcccaggactc

SEQ ID NO: 834409 - DNA, 16 bp, Homo sapiens
gcctccctagccagca

SEQ ID NO: 834410 - DNA, 20 bp, Homo sapiens
gcctccctcagcccccagga

SEQ ID NO: 834411 - DNA, 14 bp, Homo sapiens
gcctccctccaccc

SEQ ID NO: 834412 - DNA, 20 bp, Homo sapiens
gcctccctccaccccaggac

SEQ ID NO: 834413 - DNA, 21 bp, Homo sapiens
gcctccctccaccccaggacg

SEQ ID NO: 834414 - DNA, 21 bp, Homo sapiens
gcctccctctcagaggcctgc

SEQ ID NO: 834415 - DNA, 22 bp, Homo sapiens
gcctccctctcagaggcctgct

SEQ ID NO: 834416 - DNA, 16 bp, Homo sapiens
gcctccctctctcttc

SEQ ID NO: 834417 - DNA, 21 bp, Homo sapiens
gcctccctctctcttctgctc

SEQ ID NO: 834418 - DNA, 12 bp, Homo sapiens
gcctccctctga

SEQ ID NO: 834419 - DNA, 14 bp, Homo sapiens
gcctccctctgacc

SEQ ID NO: 834420 - DNA, 21 bp, Homo sapiens
gcctccctgaaacactgcttc

SEQ ID NO: 834421 - DNA, 17 bp, Homo sapiens
gcctccctgagcctgca

SEQ ID NO: 834422 - DNA, 18 bp, Homo sapiens
gcctccctgagcctgcat

SEQ ID NO: 834423 - DNA, 12 bp, Homo sapiens
gcctccctgcac

SEQ ID NO: 834424 - DNA, 23 bp, Homo sapiens
gcctccctgctgtgccatgctgg

SEQ ID NO: 834425 - DNA, 16 bp, Homo sapiens
gcctccctggctcctc

SEQ ID NO: 834426 - DNA, 19 bp, Homo sapiens
gcctccctgggccacctcc

SEQ ID NO: 834427 - DNA, 16 bp, Homo sapiens
gcctccctgtctccag

SEQ ID NO: 834428 - DNA, 20 bp, Homo sapiens
gcctccctgtctccagctgc

SEQ ID NO: 834429 - DNA, 21 bp, Homo sapiens
gcctccctgtctccagctgcc

SEQ ID NO: 834430 - DNA, 22 bp, Homo sapiens
gcctccctgtctccagctgcct

SEQ ID NO: 834431 - DNA, 13 bp, Homo sapiens
gcctcccttccca

SEQ ID NO: 834432 - DNA, 18 bp, Homo sapiens
gcctcccttcccagtggg

SEQ ID NO: 834433 - DNA, 20 bp, Homo sapiens
gcctcccttcccagtgggct

SEQ ID NO: 834434 - DNA, 14 bp, Homo sapiens
gcctccctttctgg

SEQ ID NO: 834435 - DNA, 15 bp, Homo sapiens
gcctcccttttctcc

SEQ ID NO: 834436 - DNA, 16 bp, Homo sapiens
gcctccgagagggaga

SEQ ID NO: 834437 - DNA, 18 bp, Homo sapiens
gcctccgagagggagaga

SEQ ID NO: 834438 - DNA, 16 bp, Homo sapiens
gcctccgaggctcccc

SEQ ID NO: 834439 - DNA, 21 bp, Homo sapiens
gcctccgaggctccccgcctc

SEQ ID NO: 834440 - DNA, 22 bp, Homo sapiens
gcctccgcctgctgtgtggact

SEQ ID NO: 834441 - DNA, 21 bp, Homo sapiens
gcctccgcttatcctgctagc

SEQ ID NO: 834442 - DNA, 14 bp, Homo sapiens
gcctccggaagctg

SEQ ID NO: 834443 - DNA, 21 bp, Homo sapiens
gcctccgtttatgggccttgc

SEQ ID NO: 834444 - DNA, 22 bp, Homo sapiens
gcctccgtttatgggccttgct

SEQ ID NO: 834445 - DNA, 17 bp, Homo sapiens
gcctcctaaggctcccc

SEQ ID NO: 834446 - DNA, 20 bp, Homo sapiens
gcctcctaaggctccccacc

SEQ ID NO: 834447 - DNA, 21 bp, Homo sapiens
gcctcctaaggctccccaccc

SEQ ID NO: 834448 - DNA, 16 bp, Homo sapiens
gcctcctaggggaagg

SEQ ID NO: 834449 - DNA, 18 bp, Homo sapiens
gcctcctaggggaagggg

SEQ ID NO: 834450 - DNA, 17 bp, Homo sapiens
gcctcctcacccccagc

SEQ ID NO: 834451 - DNA, 15 bp, Homo sapiens
gcctcctcaggagcc

SEQ ID NO: 834452 - DNA, 19 bp, Homo sapiens
gcctcctcagtgaaggtgg

SEQ ID NO: 834453 - DNA, 12 bp, Homo sapiens
gcctcctcatcc

SEQ ID NO: 834454 - DNA, 14 bp, Homo sapiens
gcctcctcccactg

SEQ ID NO: 834455 - DNA, 17 bp, Homo sapiens
gcctcctcccactggga

SEQ ID NO: 834456 - DNA, 12 bp, Homo sapiens
gcctcctcccat

SEQ ID NO: 834457 - DNA, 14 bp, Homo sapiens
gcctcctcccatcc

SEQ ID NO: 834458 - DNA, 16 bp, Homo sapiens
gcctcctcccatccag

SEQ ID NO: 834459 - DNA, 21 bp, Homo sapiens
gcctcctcccatccagcgtct

SEQ ID NO: 834460 - DNA, 17 bp, Homo sapiens
gcctcctccctcccagc

SEQ ID NO: 834461 - DNA, 18 bp, Homo sapiens
gcctcctccctcccagct

SEQ ID NO: 834462 - DNA, 24 bp, Homo sapiens
gcctcctccctcccagctgcactt

SEQ ID NO: 834463 - DNA, 13 bp, Homo sapiens
gcctcctcctgac

SEQ ID NO: 834464 - DNA, 17 bp, Homo sapiens
gcctcctcggagagcag

SEQ ID NO: 834465 - DNA, 14 bp, Homo sapiens
gcctcctctggact

SEQ ID NO: 834466 - DNA, 17 bp, Homo sapiens
gcctcctgagcctgtgg

SEQ ID NO: 834467 - DNA, 18 bp, Homo sapiens
gcctcctgccccctgcca

SEQ ID NO: 834468 - DNA, 19 bp, Homo sapiens
gcctcctgccccctgccag

SEQ ID NO: 834469 - DNA, 17 bp, Homo sapiens
gcctcctgcctgcccct

SEQ ID NO: 834470 - DNA, 18 bp, Homo sapiens
gcctcctgctctctggag

SEQ ID NO: 834471 - DNA, 13 bp, Homo sapiens
gcctcctggccag

SEQ ID NO: 834472 - DNA, 14 bp, Homo sapiens
gcctcctggccaga

SEQ ID NO: 834473 - DNA, 12 bp, Homo sapiens
gcctcctgggaa

SEQ ID NO: 834474 - DNA, 14 bp, Homo sapiens
gcctcctgggaaca

SEQ ID NO: 834475 - DNA, 13 bp, Homo sapiens
gcctcctgtgcct

SEQ ID NO: 834476 - DNA, 16 bp, Homo sapiens
gcctcctgtgcctggc

SEQ ID NO: 834477 - DNA, 21 bp, Homo sapiens
gcctcctgtgcctggccccag

SEQ ID NO: 834478 - DNA, 17 bp, Homo sapiens
gcctcctgttctgccca

SEQ ID NO: 834479 - DNA, 18 bp, Homo sapiens
gcctcctgttttctccct

SEQ ID NO: 834480 - DNA, 20 bp, Homo sapiens
gcctccttcccatgcctgtc

SEQ ID NO: 834481 - DNA, 20 bp, Homo sapiens
gcctccttccttgctgtcct

SEQ ID NO: 834482 - DNA, 23 bp, Homo sapiens
gcctccttgctgaccccaggtca

SEQ ID NO: 834483 - DNA, 19 bp, Homo sapiens
gcctcgacacccccccaac

SEQ ID NO: 834484 - DNA, 15 bp, Homo sapiens
gcctcgacacgtggg

SEQ ID NO: 834485 - DNA, 17 bp, Homo sapiens
gcctcgagggccgcctg

SEQ ID NO: 834486 - DNA, 18 bp, Homo sapiens
gcctcgagggccgcctgc

SEQ ID NO: 834487 - DNA, 12 bp, Homo sapiens
gcctcgcccctc

SEQ ID NO: 834488 - DNA, 19 bp, Homo sapiens
gcctcgcccctccagtgtt

SEQ ID NO: 834489 - DNA, 17 bp, Homo sapiens
gcctcggactccatggc

SEQ ID NO: 834490 - DNA, 15 bp, Homo sapiens
gcctcggagcctcat

SEQ ID NO: 834491 - DNA, 23 bp, Homo sapiens
gcctcggagcctcatccgaggca

SEQ ID NO: 834492 - DNA, 17 bp, Homo sapiens
gcctcggcctcccaaag

SEQ ID NO: 834493 - DNA, 13 bp, Homo sapiens
gcctcgggacctc

SEQ ID NO: 834494 - DNA, 17 bp, Homo sapiens
gcctcggggatggggag

SEQ ID NO: 834495 - DNA, 12 bp, Homo sapiens
gcctcgtgccag

SEQ ID NO: 834496 - DNA, 15 bp, Homo sapiens
gcctcgtgccagcag

SEQ ID NO: 834497 - DNA, 13 bp, Homo sapiens
gcctcgtgccatg

SEQ ID NO: 834498 - DNA, 23 bp, Homo sapiens
gcctcgtggagctcgcccctccc

SEQ ID NO: 834499 - DNA, 14 bp, Homo sapiens
gcctcgtgtcatct

SEQ ID NO: 834500 - DNA, 20 bp, Homo sapiens
gcctcgttggaagaggaaca

SEQ ID NO: 834501 - DNA, 14 bp, Homo sapiens
gcctcgttggagag

SEQ ID NO: 834502 - DNA, 16 bp, Homo sapiens
gcctcgttggagagca

SEQ ID NO: 834503 - DNA, 17 bp, Homo sapiens
gcctctcaccccacttc

SEQ ID NO: 834504 - DNA, 21 bp, Homo sapiens
gcctctcaccccacttcccat

SEQ ID NO: 834505 - DNA, 14 bp, Homo sapiens
gcctctcaggttca

SEQ ID NO: 834506 - DNA, 17 bp, Homo sapiens
gcctctccaaccactgt

SEQ ID NO: 834507 - DNA, 21 bp, Homo sapiens
gcctctccaaccactgtgcca

SEQ ID NO: 834508 - DNA, 15 bp, Homo sapiens
gcctctcccatcact

SEQ ID NO: 834509 - DNA, 18 bp, Homo sapiens
gcctctccccgctctgga

SEQ ID NO: 834510 - DNA, 23 bp, Homo sapiens
gcctctcccggctgcctgccgcc

SEQ ID NO: 834511 - DNA, 18 bp, Homo sapiens
gcctctccctctggtccc

SEQ ID NO: 834512 - DNA, 19 bp, Homo sapiens
gcctctccctctggtccca

SEQ ID NO: 834513 - DNA, 24 bp, Homo sapiens
gcctctccctgcactccctcctgg

SEQ ID NO: 834514 - DNA, 12 bp, Homo sapiens
gcctctccctgg

SEQ ID NO: 834515 - DNA, 13 bp, Homo sapiens
gcctctccctggg

SEQ ID NO: 834516 - DNA, 19 bp, Homo sapiens
gcctctccctgggtctggg

SEQ ID NO: 834517 - DNA, 17 bp, Homo sapiens
gcctctcctgccctctg

SEQ ID NO: 834518 - DNA, 19 bp, Homo sapiens
gcctctcctgccctctgct

SEQ ID NO: 834519 - DNA, 22 bp, Homo sapiens
gcctctcctgccctctgctctg

SEQ ID NO: 834520 - DNA, 13 bp, Homo sapiens
gcctctctagcac

SEQ ID NO: 834521 - DNA, 21 bp, Homo sapiens
gcctctctatcctctcttcct

SEQ ID NO: 834522 - DNA, 13 bp, Homo sapiens
gcctctctcctgc

SEQ ID NO: 834523 - DNA, 22 bp, Homo sapiens
gcctctctccttggccacagac

SEQ ID NO: 834524 - DNA, 17 bp, Homo sapiens
gcctctctctctctcct

SEQ ID NO: 834525 - DNA, 20 bp, Homo sapiens
gcctctctctctctcctcag

SEQ ID NO: 834526 - DNA, 23 bp, Homo sapiens
gcctctctggaaagaggctctgg

SEQ ID NO: 834527 - DNA, 18 bp, Homo sapiens
gcctctctggcctcccac

SEQ ID NO: 834528 - DNA, 19 bp, Homo sapiens
gcctctctggcctcccacc

SEQ ID NO: 834529 - DNA, 13 bp, Homo sapiens
gcctctctggctg

SEQ ID NO: 834530 - DNA, 18 bp, Homo sapiens
gcctctctggctggtctt

SEQ ID NO: 834531 - DNA, 12 bp, Homo sapiens
gcctgctgccag

SEQ ID NO: 834532 - DNA, 16 bp, Homo sapiens
gcctgctgccagtgca

SEQ ID NO: 834533 - DNA, 21 bp, Homo sapiens
gcctgctgccagtgcagccac

SEQ ID NO: 834534 - DNA, 22 bp, Homo sapiens
gcctgctgccagtgcagccact

SEQ ID NO: 834535 - DNA, 15 bp, Homo sapiens
gcctgctggaggcct

SEQ ID NO: 834536 - DNA, 16 bp, Homo sapiens
gcctgctggcacccac

SEQ ID NO: 834537 - DNA, 13 bp, Homo sapiens
gcctgctggcagg

SEQ ID NO: 834538 - DNA, 14 bp, Homo sapiens
gcctgctggcatca

SEQ ID NO: 834539 - DNA, 20 bp, Homo sapiens
gcctgctggcatcaggtctg

SEQ ID NO: 834540 - DNA, 21 bp, Homo sapiens
gcctgctggcatcaggtctgg

SEQ ID NO: 834541 - DNA, 14 bp, Homo sapiens
gcctgctggctgcg

SEQ ID NO: 834542 - DNA, 21 bp, Homo sapiens
gcctgctgggaagagctcccc

SEQ ID NO: 834543 - DNA, 18 bp, Homo sapiens
gcctgctgggctctccac

SEQ ID NO: 834544 - DNA, 19 bp, Homo sapiens
gcctgctgggctctccacc

SEQ ID NO: 834545 - DNA, 21 bp, Homo sapiens
gcctgctgggctctccacctc

SEQ ID NO: 834546 - DNA, 23 bp, Homo sapiens
gcctgctgggctctccacctcag

SEQ ID NO: 834547 - DNA, 22 bp, Homo sapiens
gcctgctgtgattccactacac

SEQ ID NO: 834548 - DNA, 15 bp, Homo sapiens
gcctgctgtgctggg

SEQ ID NO: 834549 - DNA, 12 bp, Homo sapiens
gcctgctgtggg

SEQ ID NO: 834550 - DNA, 13 bp, Homo sapiens
gcctgctgtgggg

SEQ ID NO: 834551 - DNA, 16 bp, Homo sapiens
gcctgctgtgtccttc

SEQ ID NO: 834552 - DNA, 21 bp, Homo sapiens
gcctgctgtgtccttcctcca

SEQ ID NO: 834553 - DNA, 21 bp, Homo sapiens
gcctgctttgaataaatgtgt

SEQ ID NO: 834554 - DNA, 15 bp, Homo sapiens
gcctgcttttccagg

SEQ ID NO: 834555 - DNA, 22 bp, Homo sapiens
gcctgcttttccaggatcctgc

SEQ ID NO: 834556 - DNA, 13 bp, Homo sapiens
gcctgcttttgat

SEQ ID NO: 834557 - DNA, 15 bp, Homo sapiens
gcctggaaccaggga

SEQ ID NO: 834558 - DNA, 23 bp, Homo sapiens
gcctggaactgcatcagtgactg

SEQ ID NO: 834559 - DNA, 12 bp, Homo sapiens
gcctggaagcca

SEQ ID NO: 834560 - DNA, 14 bp, Homo sapiens
gcctggacaaaccc

SEQ ID NO: 834561 - DNA, 21 bp, Homo sapiens
gcctggacagtatcccacatc

SEQ ID NO: 834562 - DNA, 15 bp, Homo sapiens
gcctggaccattcct

SEQ ID NO: 834563 - DNA, 16 bp, Homo sapiens
gcctggaccattcctg

SEQ ID NO: 834564 - DNA, 15 bp, Homo sapiens
gcctggaccgagatg

SEQ ID NO: 834565 - DNA, 21 bp, Homo sapiens
gcctggacctatgcagggagg

SEQ ID NO: 834566 - DNA, 20 bp, Homo sapiens
gcctggacgggccctccttc

SEQ ID NO: 834567 - DNA, 23 bp, Homo sapiens
gcctggactctaagctggagctc

SEQ ID NO: 834568 - DNA, 14 bp, Homo sapiens
gcctggactctgcc

SEQ ID NO: 834569 - DNA, 24 bp, Homo sapiens
gcctggactctgccccacgctgtg

SEQ ID NO: 834570 - DNA, 15 bp, Homo sapiens
gcctggactttcctg

SEQ ID NO: 834571 - DNA, 17 bp, Homo sapiens
gcctggactttcctgca

SEQ ID NO: 834572 - DNA, 12 bp, Homo sapiens
gcctggagaagc

SEQ ID NO: 834573 - DNA, 21 bp, Homo sapiens
gcctggagacaaggtgctaac

SEQ ID NO: 834574 - DNA, 23 bp, Homo sapiens
gcctggagacttagggcaccagg

SEQ ID NO: 834575 - DNA, 12 bp, Homo sapiens
gcctggagaggc

SEQ ID NO: 834576 - DNA, 16 bp, Homo sapiens
gcctggagaggcctgg

SEQ ID NO: 834577 - DNA, 18 bp, Homo sapiens
gcctggagaggcctgggg

SEQ ID NO: 834578 - DNA, 18 bp, Homo sapiens
gcctggagatcctcctgc

SEQ ID NO: 834579 - DNA, 22 bp, Homo sapiens
gcctggagatcctcctgcagac

SEQ ID NO: 834580 - DNA, 13 bp, Homo sapiens
gcctggagcccca

SEQ ID NO: 834581 - DNA, 22 bp, Homo sapiens
gcctggaggaatcactggggat

SEQ ID NO: 834582 - DNA, 15 bp, Homo sapiens
gcctggagggatgcc

SEQ ID NO: 834583 - DNA, 18 bp, Homo sapiens
gcctggagggatgccccc

SEQ ID NO: 834584 - DNA, 19 bp, Homo sapiens
gcctggagggcacttcctc

SEQ ID NO: 834585 - DNA, 20 bp, Homo sapiens
gcctggagggcacttcctcc

SEQ ID NO: 834586 - DNA, 21 bp, Homo sapiens
gcctggagggcacttcctcca

SEQ ID NO: 834587 - DNA, 21 bp, Homo sapiens
gcctggatattattcttgtag

SEQ ID NO: 834588 - DNA, 14 bp, Homo sapiens
gcctggatggcccc

SEQ ID NO: 834589 - DNA, 18 bp, Homo sapiens
gcctggatggcccctcct

SEQ ID NO: 834590 - DNA, 21 bp, Homo sapiens
gcctggatgggggtgcaggca

SEQ ID NO: 834591 - DNA, 14 bp, Homo sapiens
gcctggattcattt

SEQ ID NO: 834592 - DNA, 14 bp, Homo sapiens
gcctggattccagc

SEQ ID NO: 834593 - DNA, 19 bp, Homo sapiens
gcctggattccagcagtga

SEQ ID NO: 834594 - DNA, 23 bp, Homo sapiens
gcctggattccagcagtgaatgc

SEQ ID NO: 834595 - DNA, 15 bp, Homo sapiens
gcctggcaacagagc

SEQ ID NO: 834596 - DNA, 17 bp, Homo sapiens
gcctggcaacagagcga

SEQ ID NO: 834597 - DNA, 18 bp, Homo sapiens
gcctggcacagggcagtg

SEQ ID NO: 834598 - DNA, 17 bp, Homo sapiens
gcctggcacccaccgtc

SEQ ID NO: 834599 - DNA, 14 bp, Homo sapiens
gcctggcaggctgt

SEQ ID NO: 834600 - DNA, 15 bp, Homo sapiens
gcctggcatctgtgt

SEQ ID NO: 834601 - DNA, 17 bp, Homo sapiens
gcctggcatctgtgtgc

SEQ ID NO: 834602 - DNA, 16 bp, Homo sapiens
gcctggccacctctct

SEQ ID NO: 834603 - DNA, 17 bp, Homo sapiens
gcctggccacctctctc

SEQ ID NO: 834604 - DNA, 18 bp, Homo sapiens
gcctggccacctctctcc

SEQ ID NO: 834605 - DNA, 21 bp, Homo sapiens
gcctggccagatttttctttt

SEQ ID NO: 834606 - DNA, 14 bp, Homo sapiens
gcctggccaggagc

SEQ ID NO: 834607 - DNA, 15 bp, Homo sapiens
gcctggccaggagct

SEQ ID NO: 834608 - DNA, 13 bp, Homo sapiens
gcctggccaggca

SEQ ID NO: 834609 - DNA, 23 bp, Homo sapiens
gcctggccagtcctggtcctggc

SEQ ID NO: 834610 - DNA, 21 bp, Homo sapiens
gcctggccatctccctcccca

SEQ ID NO: 834611 - DNA, 13 bp, Homo sapiens
gcctggccatgct

SEQ ID NO: 834612 - DNA, 14 bp, Homo sapiens
gcctggccatgctg

SEQ ID NO: 834613 - DNA, 23 bp, Homo sapiens
gcctggccatgtcacctggctgc

SEQ ID NO: 834614 - DNA, 14 bp, Homo sapiens
gcctggccatgtgg

SEQ ID NO: 834615 - DNA, 18 bp, Homo sapiens
gcctggccccaggcccca

SEQ ID NO: 834616 - DNA, 22 bp, Homo sapiens
gcctggccccaggccccagaca

SEQ ID NO: 834617 - DNA, 12 bp, Homo sapiens
gcctggccctcc

SEQ ID NO: 834618 - DNA, 14 bp, Homo sapiens
gcctggccctccct

SEQ ID NO: 834619 - DNA, 20 bp, Homo sapiens
gcctggccctccctccctag

SEQ ID NO: 834620 - DNA, 11 bp, Homo sapiens
gcctggcctga

SEQ ID NO: 834621 - DNA, 13 bp, Homo sapiens
gcctggcctgagc

SEQ ID NO: 834622 - DNA, 14 bp, Homo sapiens
gcctggcctgagct

SEQ ID NO: 834623 - DNA, 16 bp, Homo sapiens
gcctggcctgagctgg

SEQ ID NO: 834624 - DNA, 17 bp, Homo sapiens
gcctggcctgagctggg

SEQ ID NO: 834625 - DNA, 15 bp, Homo sapiens
gcctggcctgccaga

SEQ ID NO: 834626 - DNA, 12 bp, Homo sapiens
gcctggcctggc

SEQ ID NO: 834627 - DNA, 23 bp, Homo sapiens
gcctggccttgtcctcagccagt

SEQ ID NO: 834628 - DNA, 16 bp, Homo sapiens
gcctggccttgtgtgg

SEQ ID NO: 834629 - DNA, 19 bp, Homo sapiens
gcctggcgacagagcgaga

SEQ ID NO: 834630 - DNA, 12 bp, Homo sapiens
gcctggctcccc

SEQ ID NO: 834631 - DNA, 13 bp, Homo sapiens
gcctggctccccg

SEQ ID NO: 834632 - DNA, 14 bp, Homo sapiens
gcctggctccccga

SEQ ID NO: 834633 - DNA, 16 bp, Homo sapiens
gcctggctctgccccc

SEQ ID NO: 834634 - DNA, 21 bp, Homo sapiens
gcctggctgggtggtattctg

SEQ ID NO: 834635 - DNA, 10 bp, Homo sapiens
gcctggctgt

SEQ ID NO: 834636 - DNA, 12 bp, Homo sapiens
gcctggctgtgg

SEQ ID NO: 834637 - DNA, 13 bp, Homo sapiens
gcctggctgtgga

SEQ ID NO: 834638 - DNA, 21 bp, Homo sapiens
gcctggctgtggaggcctgat

SEQ ID NO: 834639 - DNA, 24 bp, Homo sapiens
gcctggctgtggaggcctgatgct

SEQ ID NO: 834640 - DNA, 15 bp, Homo sapiens
gcctggcttctggag

SEQ ID NO: 834641 - DNA, 16 bp, Homo sapiens
gcctggcttgctccag

SEQ ID NO: 834642 - DNA, 21 bp, Homo sapiens
gcctggctttggtccccagca

SEQ ID NO: 834643 - DNA, 22 bp, Homo sapiens
gcctgggacacttccctgggcc

SEQ ID NO: 834644 - DNA, 17 bp, Homo sapiens
gcctgggacccagctac

SEQ ID NO: 834645 - DNA, 17 bp, Homo sapiens
gcctgggacttccatgc

SEQ ID NO: 834646 - DNA, 17 bp, Homo sapiens
gcctgggagcccagagg

SEQ ID NO: 834647 - DNA, 12 bp, Homo sapiens
gcctgggagggt

SEQ ID NO: 834648 - DNA, 20 bp, Homo sapiens
gcctgggagggttcccctgg

SEQ ID NO: 834649 - DNA, 21 bp, Homo sapiens
gcctgggaggtcaaggctgca

SEQ ID NO: 834650 - DNA, 14 bp, Homo sapiens
gcctgggatgcagt

SEQ ID NO: 834651 - DNA, 20 bp, Homo sapiens
gcctgggcaacagagcaaga

SEQ ID NO: 834652 - DNA, 13 bp, Homo sapiens
gcctgggcagagg

SEQ ID NO: 834653 - DNA, 17 bp, Homo sapiens
gccttcctcctccacag

SEQ ID NO: 834654 - DNA, 13 bp, Homo sapiens
gccttcctcctgg

SEQ ID NO: 834655 - DNA, 16 bp, Homo sapiens
gccttcctcctgggcc

SEQ ID NO: 834656 - DNA, 18 bp, Homo sapiens
gccttcctcgtgcagagc

SEQ ID NO: 834657 - DNA, 14 bp, Homo sapiens
gccttcctctgagg

SEQ ID NO: 834658 - DNA, 16 bp, Homo sapiens
gccttcctctgaggac

SEQ ID NO: 834659 - DNA, 16 bp, Homo sapiens
gccttcctctgcagct

SEQ ID NO: 834660 - DNA, 17 bp, Homo sapiens
gccttcctctgcagctg

SEQ ID NO: 834661 - DNA, 20 bp, Homo sapiens
gccttcctctgcagctgacc

SEQ ID NO: 834662 - DNA, 21 bp, Homo sapiens
gccttcctctgcagctgacct

SEQ ID NO: 834663 - DNA, 13 bp, Homo sapiens
gccttccttctgc

SEQ ID NO: 834664 - DNA, 22 bp, Homo sapiens
gccttccttctgctcccacccc

SEQ ID NO: 834665 - DNA, 17 bp, Homo sapiens
gccttcctttctccagg

SEQ ID NO: 834666 - DNA, 22 bp, Homo sapiens
gccttcgatacaccgggcctgg

SEQ ID NO: 834667 - DNA, 19 bp, Homo sapiens
gccttcgcaccttgctgtg

SEQ ID NO: 834668 - DNA, 20 bp, Homo sapiens
gccttcgcttcttgcctctg

SEQ ID NO: 834669 - DNA, 21 bp, Homo sapiens
gccttcgcttcttgcctctgt

SEQ ID NO: 834670 - DNA, 19 bp, Homo sapiens
gccttcgtgtgctgctgct

SEQ ID NO: 834671 - DNA, 18 bp, Homo sapiens
gccttcgtgtggctcctg

SEQ ID NO: 834672 - DNA, 15 bp, Homo sapiens
gccttctccatatct

SEQ ID NO: 834673 - DNA, 14 bp, Homo sapiens
gccttctcccacat

SEQ ID NO: 834674 - DNA, 17 bp, Homo sapiens
gccttctgaactccata

SEQ ID NO: 834675 - DNA, 21 bp, Homo sapiens
gccttctgaactccatacagc

SEQ ID NO: 834676 - DNA, 17 bp, Homo sapiens
gccttctgatgaaatgt

SEQ ID NO: 834677 - DNA, 21 bp, Homo sapiens
gccttctgccaacgcctcctg

SEQ ID NO: 834678 - DNA, 19 bp, Homo sapiens
gccttctggttatttatgg

SEQ ID NO: 834679 - DNA, 22 bp, Homo sapiens
gccttctggtttcttccagcca

SEQ ID NO: 834680 - DNA, 19 bp, Homo sapiens
gccttctgtggggctgggc

SEQ ID NO: 834681 - DNA, 23 bp, Homo sapiens
gccttcttcggggaactcctgga

SEQ ID NO: 834682 - DNA, 18 bp, Homo sapiens
gccttcttctgccacttc

SEQ ID NO: 834683 - DNA, 15 bp, Homo sapiens
gccttcttttgatta

SEQ ID NO: 834684 - DNA, 20 bp, Homo sapiens
gccttgaagaaaatgacttt

SEQ ID NO: 834685 - DNA, 15 bp, Homo sapiens
gccttgaagacagag

SEQ ID NO: 834686 - DNA, 16 bp, Homo sapiens
gccttgaagacagagc

SEQ ID NO: 834687 - DNA, 14 bp, Homo sapiens
gccttgaagccact

SEQ ID NO: 834688 - DNA, 15 bp, Homo sapiens
gccttgaagccactg

SEQ ID NO: 834689 - DNA, 21 bp, Homo sapiens
gccttgacatcagttcctttg

SEQ ID NO: 834690 - DNA, 16 bp, Homo sapiens
gccttgagccctggct

SEQ ID NO: 834691 - DNA, 18 bp, Homo sapiens
gccttgataaatatatat

SEQ ID NO: 834692 - DNA, 19 bp, Homo sapiens
gccttgataatacttgacc

SEQ ID NO: 834693 - DNA, 21 bp, Homo sapiens
gccttgcacacccactgcccc

SEQ ID NO: 834694 - DNA, 15 bp, Homo sapiens
gccttgcagaactgc

SEQ ID NO: 834695 - DNA, 18 bp, Homo sapiens
gccttgcagaactgccat

SEQ ID NO: 834696 - DNA, 18 bp, Homo sapiens
gccttgcagatatctgca

SEQ ID NO: 834697 - DNA, 21 bp, Homo sapiens
gccttgcagatatctgcatgt

SEQ ID NO: 834698 - DNA, 22 bp, Homo sapiens
gccttgcagatatctgcatgtg

SEQ ID NO: 834699 - DNA, 16 bp, Homo sapiens
gccttgcatgtacttg

SEQ ID NO: 834700 - DNA, 18 bp, Homo sapiens
gccttgcatgtacttgaa

SEQ ID NO: 834701 - DNA, 14 bp, Homo sapiens
gccttgcccacagg

SEQ ID NO: 834702 - DNA, 15 bp, Homo sapiens
gccttgcccagagat

SEQ ID NO: 834703 - DNA, 16 bp, Homo sapiens
gccttgcccgccagcc

SEQ ID NO: 834704 - DNA, 22 bp, Homo sapiens
gccttgcccggattctgggagg

SEQ ID NO: 834705 - DNA, 17 bp, Homo sapiens
gccttgccgctcccctt

SEQ ID NO: 834706 - DNA, 22 bp, Homo sapiens
gccttgccgctccccttggacc

SEQ ID NO: 834707 - DNA, 23 bp, Homo sapiens
gccttgcctaaatttaatgctgc

SEQ ID NO: 834708 - DNA, 20 bp, Homo sapiens
gccttgcgctgtcccaggca

SEQ ID NO: 834709 - DNA, 22 bp, Homo sapiens
gccttgcgctgtcccaggcatg

SEQ ID NO: 834710 - DNA, 14 bp, Homo sapiens
gccttgcggaagcc

SEQ ID NO: 834711 - DNA, 17 bp, Homo sapiens
gccttgcggaagccata

SEQ ID NO: 834712 - DNA, 18 bp, Homo sapiens
gccttgctcattcttgag

SEQ ID NO: 834713 - DNA, 14 bp, Homo sapiens
gccttgctctgagc

SEQ ID NO: 834714 - DNA, 19 bp, Homo sapiens
gccttgctctgagcacagg

SEQ ID NO: 834715 - DNA, 13 bp, Homo sapiens
gccttgctgggcc

SEQ ID NO: 834716 - DNA, 15 bp, Homo sapiens
gccttgctgggccag

SEQ ID NO: 834717 - DNA, 18 bp, Homo sapiens
gccttgctggggtccagg

SEQ ID NO: 834718 - DNA, 21 bp, Homo sapiens
gccttgctggggtccagggct

SEQ ID NO: 834719 - DNA, 11 bp, Homo sapiens
gccttgcttct

SEQ ID NO: 834720 - DNA, 13 bp, Homo sapiens
gccttgcttctcc

SEQ ID NO: 834721 - DNA, 14 bp, Homo sapiens
gccttgcttctccc

SEQ ID NO: 834722 - DNA, 18 bp, Homo sapiens
gccttgcttctcccattt

SEQ ID NO: 834723 - DNA, 14 bp, Homo sapiens
gccttgcttctctt

SEQ ID NO: 834724 - DNA, 11 bp, Homo sapiens
gccttgcttgt

SEQ ID NO: 834725 - DNA, 13 bp, Homo sapiens
gccttggaaccag

SEQ ID NO: 834726 - DNA, 19 bp, Homo sapiens
gccttggagaactcggttt

SEQ ID NO: 834727 - DNA, 21 bp, Homo sapiens
gccttggccgcataggcccag

SEQ ID NO: 834728 - DNA, 14 bp, Homo sapiens
gccttggcctccca

SEQ ID NO: 834729 - DNA, 14 bp, Homo sapiens
gccttggctgggcc

SEQ ID NO: 834730 - DNA, 17 bp, Homo sapiens
gccttggctttctccct

SEQ ID NO: 834731 - DNA, 18 bp, Homo sapiens
gccttgggccggtgctgg

SEQ ID NO: 834732 - DNA, 20 bp, Homo sapiens
gccttgggccggtgctgggg

SEQ ID NO: 834733 - DNA, 13 bp, Homo sapiens
gccttgggccttg

SEQ ID NO: 834734 - DNA, 17 bp, Homo sapiens
gccttgggcctttcagt

SEQ ID NO: 834735 - DNA, 15 bp, Homo sapiens
gccttgggctgctcc

SEQ ID NO: 834736 - DNA, 18 bp, Homo sapiens
gccttggggaatttcctc

SEQ ID NO: 834737 - DNA, 19 bp, Homo sapiens
gccttgggggggctgcctt

SEQ ID NO: 834738 - DNA, 20 bp, Homo sapiens
gccttggggtgggggccagg

SEQ ID NO: 834739 - DNA, 21 bp, Homo sapiens
gccttggggtgggggccaggc

SEQ ID NO: 834740 - DNA, 14 bp, Homo sapiens
gccttggggttgga

SEQ ID NO: 834741 - DNA, 22 bp, Homo sapiens
gccttgggtggccccctctcct

SEQ ID NO: 834742 - DNA, 18 bp, Homo sapiens
gccttggtggagcagcca

SEQ ID NO: 834743 - DNA, 19 bp, Homo sapiens
gccttggtggagcagccag

SEQ ID NO: 834744 - DNA, 23 bp, Homo sapiens
gccttggtggagcagccagagct

SEQ ID NO: 834745 - DNA, 19 bp, Homo sapiens
gccttggttcatcagtgtt

SEQ ID NO: 834746 - DNA, 18 bp, Homo sapiens
gccttggttcccttgtgt

SEQ ID NO: 834747 - DNA, 20 bp, Homo sapiens
gccttgtaattctaaatgaa

SEQ ID NO: 834748 - DNA, 22 bp, Homo sapiens
gccttgtatgcaaatgagttca

SEQ ID NO: 834749 - DNA, 13 bp, Homo sapiens
gccttgtccagga

SEQ ID NO: 834750 - DNA, 15 bp, Homo sapiens
gccttgtccaggaac

SEQ ID NO: 834751 - DNA, 20 bp, Homo sapiens
gccttgtctgggtgcagctg

SEQ ID NO: 834752 - DNA, 21 bp, Homo sapiens
gccttgtctgggtgcagctgg

SEQ ID NO: 834753 - DNA, 12 bp, Homo sapiens
gccttgtgccct

SEQ ID NO: 834754 - DNA, 14 bp, Homo sapiens
gccttgtgccctgc

SEQ ID NO: 834755 - DNA, 19 bp, Homo sapiens
gccttgtgccctgccccca

SEQ ID NO: 834756 - DNA, 18 bp, Homo sapiens
gccttgtgtggcttggag

SEQ ID NO: 834757 - DNA, 16 bp, Homo sapiens
gccttgtgtgtcaggc

SEQ ID NO: 834758 - DNA, 19 bp, Homo sapiens
gccttgtgtgtcaggccct

SEQ ID NO: 834759 - DNA, 17 bp, Homo sapiens
gcctttaaatctgtgat

SEQ ID NO: 834760 - DNA, 17 bp, Homo sapiens
gcctttaagaaccttaa

SEQ ID NO: 834761 - DNA, 12 bp, Homo sapiens
gcctttaagcca

SEQ ID NO: 834762 - DNA, 19 bp, Homo sapiens
gcctttaatattttgtaat

SEQ ID NO: 834763 - DNA, 23 bp, Homo sapiens
gcctttatttttggcgtggctga

SEQ ID NO: 834764 - DNA, 15 bp, Homo sapiens
gcctttcaaatttag

SEQ ID NO: 834765 - DNA, 14 bp, Homo sapiens
gcctttcagtgtag

SEQ ID NO: 834766 - DNA, 23 bp, Homo sapiens
gcctttcagtgtagcgggaggaa

SEQ ID NO: 834767 - DNA, 14 bp, Homo sapiens
gcctttccagcctc

SEQ ID NO: 834768 - DNA, 12 bp, Homo sapiens
gcctttccaggg

SEQ ID NO: 834769 - DNA, 21 bp, Homo sapiens
gcctttccataaggaatgtag

SEQ ID NO: 834770 - DNA, 19 bp, Homo sapiens
gcctttcccaactctagct

SEQ ID NO: 834771 - DNA, 20 bp, Homo sapiens
gcctttcctcggtctccctt

SEQ ID NO: 834772 - DNA, 15 bp, Homo sapiens
gcctttcctgtgcca

SEQ ID NO: 834773 - DNA, 19 bp, Homo sapiens
gcctttcctgtgccaacct

SEQ ID NO: 834774 - DNA, 13 bp, Homo sapiens
gcctttccttccc

SEQ ID NO: 834775 - DNA, 15 bp, Homo sapiens
gcctttcgaggcctg

SEQ ID NO: 834776 - DNA, 19 bp, Homo sapiens
gcctttcgaggcctgaagc

SEQ ID NO: 834777 - DNA, 17 bp, Homo sapiens
gcctttctcctccccac

SEQ ID NO: 834778 - DNA, 20 bp, Homo sapiens
gcctttctcctccccacctg

SEQ ID NO: 834779 - DNA, 21 bp, Homo sapiens
gcctttctcctccccacctgt

SEQ ID NO: 834780 - DNA, 22 bp, Homo sapiens
gcctttctcctccccacctgta

SEQ ID NO: 834781 - DNA, 23 bp, Homo sapiens
gcctttctcgtggtagaagccag

SEQ ID NO: 834782 - DNA, 19 bp, Homo sapiens
gcctttctgcagtttttca

SEQ ID NO: 834783 - DNA, 16 bp, Homo sapiens
gcctttcttctgccct

SEQ ID NO: 834784 - DNA, 16 bp, Homo sapiens
gcctttcttctgtgtt

SEQ ID NO: 834785 - DNA, 20 bp, Homo sapiens
gcctttgaatgttaattttt

SEQ ID NO: 834786 - DNA, 12 bp, Homo sapiens
gcctttgaggtt

SEQ ID NO: 834787 - DNA, 18 bp, Homo sapiens
gcctttgcaaatcagtgt

SEQ ID NO: 834788 - DNA, 22 bp, Homo sapiens
gcctttgcagttggactctcag

SEQ ID NO: 834789 - DNA, 14 bp, Homo sapiens
gcctttgcctttag

SEQ ID NO: 834790 - DNA, 16 bp, Homo sapiens
gcctttgggtcctggg

SEQ ID NO: 834791 - DNA, 17 bp, Homo sapiens
gcctttgggtcctgggc

SEQ ID NO: 834792 - DNA, 20 bp, Homo sapiens
gcctttgggtcctgggcagg

SEQ ID NO: 834793 - DNA, 22 bp, Homo sapiens
gcctttgtatgtggaagtatac

SEQ ID NO: 834794 - DNA, 16 bp, Homo sapiens
gcctttgtgctgcgcc

SEQ ID NO: 834795 - DNA, 20 bp, Homo sapiens
gcctttgtggtgggcgctgg

SEQ ID NO: 834796 - DNA, 21 bp, Homo sapiens
gccttttccacacgcattaat

SEQ ID NO: 834797 - DNA, 15 bp, Homo sapiens
gccttttctggagtt

SEQ ID NO: 834798 - DNA, 16 bp, Homo sapiens
gccttttgcacccctc

SEQ ID NO: 834799 - DNA, 23 bp, Homo sapiens
gccttttggtttcaccttccctc

SEQ ID NO: 834800 - DNA, 11 bp, Homo sapiens
gccttttgtgt

SEQ ID NO: 834801 - DNA, 15 bp, Homo sapiens
gccttttgtgtgatg

SEQ ID NO: 834802 - DNA, 18 bp, Homo sapiens
gcctttttagatgtattt

SEQ ID NO: 834803 - DNA, 22 bp, Homo sapiens
gcctttttccttatttcaaggg

SEQ ID NO: 834804 - DNA, 14 bp, Homo sapiens
gccttttttataac

SEQ ID NO: 834805 - DNA, 17 bp, Homo sapiens
gccttttttataactaa

SEQ ID NO: 834806 - DNA, 20 bp, Homo sapiens
gccttttttcacggaagttt

SEQ ID NO: 834807 - DNA, 17 bp, Homo sapiens
gcgaaacaggtctgttt

SEQ ID NO: 834808 - DNA, 19 bp, Homo sapiens
gcgaaacaggtctgttttt

SEQ ID NO: 834809 - DNA, 18 bp, Homo sapiens
gcgaaaggcgagtccagg

SEQ ID NO: 834810 - DNA, 16 bp, Homo sapiens
gcgaaattattggttg

SEQ ID NO: 834811 - DNA, 21 bp, Homo sapiens
gcgaacggaacgttggacttt

SEQ ID NO: 834812 - DNA, 18 bp, Homo sapiens
gcgaacgtatttctccag

SEQ ID NO: 834813 - DNA, 20 bp, Homo sapiens
gcgaacgtatttctccagac

SEQ ID NO: 834814 - DNA, 22 bp, Homo sapiens
gcgaagaccctcttgcccatcc

SEQ ID NO: 834815 - DNA, 18 bp, Homo sapiens
gcgaatccaagctccctg

SEQ ID NO: 834816 - DNA, 18 bp, Homo sapiens
gcgacactcagggcagct

SEQ ID NO: 834817 - DNA, 19 bp, Homo sapiens
gcgacactcagggcagctg

SEQ ID NO: 834818 - DNA, 19 bp, Homo sapiens
gcgacagagcgagagtctg

SEQ ID NO: 834819 - DNA, 23 bp, Homo sapiens
gcgacagagcgagagtctgtctc

SEQ ID NO: 834820 - DNA, 22 bp, Homo sapiens
gcgacagcttgtgattcctacc

SEQ ID NO: 834821 - DNA, 12 bp, Homo sapiens
gcgaccaaggat

SEQ ID NO: 834822 - DNA, 22 bp, Homo sapiens
gcgaccaataaacagctcccag

SEQ ID NO: 834823 - DNA, 14 bp, Homo sapiens
gcgaccaccaaagt

SEQ ID NO: 834824 - DNA, 12 bp, Homo sapiens
gcgaccaccgcc

SEQ ID NO: 834825 - DNA, 13 bp, Homo sapiens
gcgaccgccccct

SEQ ID NO: 834826 - DNA, 10 bp, Homo sapiens
gcgacctcct

SEQ ID NO: 834827 - DNA, 15 bp, Homo sapiens
gcgaccttcctcatc

SEQ ID NO: 834828 - DNA, 13 bp, Homo sapiens
gcgactctgcaga

SEQ ID NO: 834829 - DNA, 19 bp, Homo sapiens
gcgactggatgctcgccat

SEQ ID NO: 834830 - DNA, 20 bp, Homo sapiens
gcgacttttgttctcttctg

SEQ ID NO: 834831 - DNA, 22 bp, Homo sapiens
gcgagacccaaggctcactgca

SEQ ID NO: 834832 - DNA, 12 bp, Homo sapiens
gcgagactctga

SEQ ID NO: 834833 - DNA, 17 bp, Homo sapiens
gcgagagagtttcaaaa

SEQ ID NO: 834834 - DNA, 19 bp, Homo sapiens
gcgagagatcaaagatgaa

SEQ ID NO: 834835 - DNA, 15 bp, Homo sapiens
gcgagaggcagagaa

SEQ ID NO: 834836 - DNA, 18 bp, Homo sapiens
gcgagaggcagcaaggtg

SEQ ID NO: 834837 - DNA, 15 bp, Homo sapiens
gcgagagtccctgca

SEQ ID NO: 834838 - DNA, 21 bp, Homo sapiens
gcgagatcggggtagaaatgc

SEQ ID NO: 834839 - DNA, 22 bp, Homo sapiens
gcgagattccgtctcaaaaaaa

SEQ ID NO: 834840 - DNA, 13 bp, Homo sapiens
gcgagcacacaca

SEQ ID NO: 834841 - DNA, 13 bp, Homo sapiens
gcgagcacccacg

SEQ ID NO: 834842 - DNA, 13 bp, Homo sapiens
gcgagccacagga

SEQ ID NO: 834843 - DNA, 22 bp, Homo sapiens
gcgagccacaggaacggccctg

SEQ ID NO: 834844 - DNA, 21 bp, Homo sapiens
gcgagcccctcggctctggag

SEQ ID NO: 834845 - DNA, 14 bp, Homo sapiens
gcgagcctgtgcct

SEQ ID NO: 834846 - DNA, 15 bp, Homo sapiens
gcgagctgctctgct

SEQ ID NO: 834847 - DNA, 14 bp, Homo sapiens
gcgagcttggcctt

SEQ ID NO: 834848 - DNA, 22 bp, Homo sapiens
gcgagcttggccttgggccggt

SEQ ID NO: 834849 - DNA, 15 bp, Homo sapiens
gcgaggaggctccag

SEQ ID NO: 834850 - DNA, 16 bp, Homo sapiens
gcgaggaggctccaga

SEQ ID NO: 834851 - DNA, 18 bp, Homo sapiens
gcgaggaggctccagagg

SEQ ID NO: 834852 - DNA, 19 bp, Homo sapiens
gcgaggcccttcctctttg

SEQ ID NO: 834853 - DNA, 23 bp, Homo sapiens
gcgaggcctctctcaggagcagg

SEQ ID NO: 834854 - DNA, 14 bp, Homo sapiens
gcgagggcagctgc

SEQ ID NO: 834855 - DNA, 17 bp, Homo sapiens
gcgagggcagctgctat

SEQ ID NO: 834856 - DNA, 20 bp, Homo sapiens
gcgagggccgcccgctccct

SEQ ID NO: 834857 - DNA, 19 bp, Homo sapiens
gcgagtcaccctcctcaca

SEQ ID NO: 834858 - DNA, 17 bp, Homo sapiens
gcgagtccaggagctca

SEQ ID NO: 834859 - DNA, 21 bp, Homo sapiens
gcgagtgtgctgtatggccca

SEQ ID NO: 834860 - DNA, 21 bp, Homo sapiens
gcgataaaactaaatatatgt

SEQ ID NO: 834861 - DNA, 20 bp, Homo sapiens
gcgatccccgcttccccttg

SEQ ID NO: 834862 - DNA, 22 bp, Homo sapiens
gcgatccccgcttccccttgcc

SEQ ID NO: 834863 - DNA, 17 bp, Homo sapiens
gcgatgaggtaattctc

SEQ ID NO: 834864 - DNA, 13 bp, Homo sapiens
gcgatggcaggcc

SEQ ID NO: 834865 - DNA, 18 bp, Homo sapiens
gcgatggcaggcctgacc

SEQ ID NO: 834866 - DNA, 18 bp, Homo sapiens
gcgatggggcaagacaga

SEQ ID NO: 834867 - DNA, 22 bp, Homo sapiens
gcgatgtggacgtcacgctccc

SEQ ID NO: 834868 - DNA, 21 bp, Homo sapiens
gcgatgtttcaggaggctgga

SEQ ID NO: 834869 - DNA, 13 bp, Homo sapiens
gcgatttgaaaca

SEQ ID NO: 834870 - DNA, 12 bp, Homo sapiens
gcgcaagcctgt

SEQ ID NO: 834871 - DNA, 21 bp, Homo sapiens
gcgcaagcctgtaatcccagc

SEQ ID NO: 834872 - DNA, 18 bp, Homo sapiens
gcgcacagagggaagcca

SEQ ID NO: 834873 - DNA, 21 bp, Homo sapiens
gcgcacccagagaaaattaat

SEQ ID NO: 834874 - DNA, 12 bp, Homo sapiens
gcgcacctgccc

SEQ ID NO: 834875 - DNA, 17 bp, Homo sapiens
gcgcacctgccccctgg

SEQ ID NO: 834876 - DNA, 19 bp, Homo sapiens
gcgcacctgccccctggtg

SEQ ID NO: 834877 - DNA, 22 bp, Homo sapiens
gcgcactgtgacccccagctcc

SEQ ID NO: 834878 - DNA, 18 bp, Homo sapiens
gcgcagatctgtgcctgg

SEQ ID NO: 834879 - DNA, 19 bp, Homo sapiens
gcgcagatctgtgcctggg

SEQ ID NO: 834880 - DNA, 21 bp, Homo sapiens
gcgcagatgaggggccactga

SEQ ID NO: 834881 - DNA, 12 bp, Homo sapiens
gcgcaggctgca

SEQ ID NO: 834882 - DNA, 13 bp, Homo sapiens
gcgcaggctgcag

SEQ ID NO: 834883 - DNA, 15 bp, Homo sapiens
gcgcaggctgcagag

SEQ ID NO: 834884 - DNA, 20 bp, Homo sapiens
gcgcagggacatggggcaag

SEQ ID NO: 834885 - DNA, 14 bp, Homo sapiens
gcgcagggctggca

SEQ ID NO: 834886 - DNA, 22 bp, Homo sapiens
gcgcagggtggtggtattctgt

SEQ ID NO: 834887 - DNA, 23 bp, Homo sapiens
gcgcagggtggtggtattctgtc

SEQ ID NO: 834888 - DNA, 18 bp, Homo sapiens
gcgcagtgcttctctaca

SEQ ID NO: 834889 - DNA, 17 bp, Homo sapiens
gcgcatgagtatctgtg

SEQ ID NO: 834890 - DNA, 16 bp, Homo sapiens
gcgcatgtctgcacct

SEQ ID NO: 834891 - DNA, 22 bp, Homo sapiens
gcgccaaaacaagccaaagagc

SEQ ID NO: 834892 - DNA, 15 bp, Homo sapiens
gcgccaccagctctg

SEQ ID NO: 834893 - DNA, 14 bp, Homo sapiens
gcgccaccgtgcct

SEQ ID NO: 834894 - DNA, 18 bp, Homo sapiens
gcgccaccgtgcctggct

SEQ ID NO: 834895 - DNA, 17 bp, Homo sapiens
gcgccagcacagaaaca

SEQ ID NO: 834896 - DNA, 11 bp, Homo sapiens
gcgtattctgt

SEQ ID NO: 834897 - DNA, 12 bp, Homo sapiens
gcgtattctgtg

SEQ ID NO: 834898 - DNA, 16 bp, Homo sapiens
gcgtattctgtggccg

SEQ ID NO: 834899 - DNA, 13 bp, Homo sapiens
gcgtcaagacatt

SEQ ID NO: 834900 - DNA, 12 bp, Homo sapiens
gcgtcactgccc

SEQ ID NO: 834901 - DNA, 21 bp, Homo sapiens
gcgtcactgcccaccaaaggt

SEQ ID NO: 834902 - DNA, 17 bp, Homo sapiens
gcgtcagctgctccctg

SEQ ID NO: 834903 - DNA, 18 bp, Homo sapiens
gcgtcaggggtgcacagt

SEQ ID NO: 834904 - DNA, 15 bp, Homo sapiens
gcgtccaaccccggg

SEQ ID NO: 834905 - DNA, 13 bp, Homo sapiens
gcgtccaccaggc

SEQ ID NO: 834906 - DNA, 21 bp, Homo sapiens
gcgtccaccaggcctcactgg

SEQ ID NO: 834907 - DNA, 16 bp, Homo sapiens
gcgtcccaagcagccg

SEQ ID NO: 834908 - DNA, 19 bp, Homo sapiens
gcgtcccagtctctggcag

SEQ ID NO: 834909 - DNA, 16 bp, Homo sapiens
gcgtcccatgaggtct

SEQ ID NO: 834910 - DNA, 12 bp, Homo sapiens
gcgtccctggcg

SEQ ID NO: 834911 - DNA, 20 bp, Homo sapiens
gcgtccgccgcgtgtgcgtg

SEQ ID NO: 834912 - DNA, 18 bp, Homo sapiens
gcgtcctgacgccctgcg

SEQ ID NO: 834913 - DNA, 17 bp, Homo sapiens
gcgtcctgacggcgccc

SEQ ID NO: 834914 - DNA, 16 bp, Homo sapiens
gcgtcctgaggaataa

SEQ ID NO: 834915 - DNA, 19 bp, Homo sapiens
gcgtcctgcagaggaccac

SEQ ID NO: 834916 - DNA, 14 bp, Homo sapiens
gcgtcctgccctgc

SEQ ID NO: 834917 - DNA, 15 bp, Homo sapiens
gcgtcctgccctgcc

SEQ ID NO: 834918 - DNA, 13 bp, Homo sapiens
gcgtcctgtccac

SEQ ID NO: 834919 - DNA, 19 bp, Homo sapiens
gcgtcctgtccacacccag

SEQ ID NO: 834920 - DNA, 24 bp, Homo sapiens
gcgtcctgtccacacccagctcag

SEQ ID NO: 834921 - DNA, 21 bp, Homo sapiens
gcgtccttccccctgtagact

SEQ ID NO: 834922 - DNA, 16 bp, Homo sapiens
gcgtcgccccagtggc

SEQ ID NO: 834923 - DNA, 12 bp, Homo sapiens
gcgtctcccatc

SEQ ID NO: 834924 - DNA, 23 bp, Homo sapiens
gcgtctcccccagagtgctgtcg

SEQ ID NO: 834925 - DNA, 12 bp, Homo sapiens
gcgtctccctcg

SEQ ID NO: 834926 - DNA, 11 bp, Homo sapiens
gcgtctcctgt

SEQ ID NO: 834927 - DNA, 21 bp, Homo sapiens
gcgtctcctgtttttctgggt

SEQ ID NO: 834928 - DNA, 23 bp, Homo sapiens
gcgtctctctttctccctcaccc

SEQ ID NO: 834929 - DNA, 14 bp, Homo sapiens
gcgtctgcagggtg

SEQ ID NO: 834930 - DNA, 16 bp, Homo sapiens
gcgtctgctctggtgg

SEQ ID NO: 834931 - DNA, 17 bp, Homo sapiens
gcgtctgttcccccttc

SEQ ID NO: 834932 - DNA, 21 bp, Homo sapiens
gcgtcttcatctccctgccat

SEQ ID NO: 834933 - DNA, 16 bp, Homo sapiens
gcgtcttccgcccctg

SEQ ID NO: 834934 - DNA, 21 bp, Homo sapiens
gcgtcttccgcccctgcctgc

SEQ ID NO: 834935 - DNA, 14 bp, Homo sapiens
gcgtcttcctgagt

SEQ ID NO: 834936 - DNA, 16 bp, Homo sapiens
gcgtcttgcccagcag

SEQ ID NO: 834937 - DNA, 11 bp, Homo sapiens
gcgtgaaacac

SEQ ID NO: 834938 - DNA, 12 bp, Homo sapiens
gcgtgaaacaca

SEQ ID NO: 834939 - DNA, 19 bp, Homo sapiens
gcgtgacccgacctggccg

SEQ ID NO: 834940 - DNA, 12 bp, Homo sapiens
gcgtgacggagc

SEQ ID NO: 834941 - DNA, 23 bp, Homo sapiens
gcgtgagcttaaaatacaagact

SEQ ID NO: 834942 - DNA, 20 bp, Homo sapiens
gcgtgatcaaagccacactc

SEQ ID NO: 834943 - DNA, 15 bp, Homo sapiens
gcgtgattgaccctt

SEQ ID NO: 834944 - DNA, 18 bp, Homo sapiens
gcgtgcagggacaaagag

SEQ ID NO: 834945 - DNA, 17 bp, Homo sapiens
gcgtgccgtgtgagtgt

SEQ ID NO: 834946 - DNA, 17 bp, Homo sapiens
gcgtggaagggggagga

SEQ ID NO: 834947 - DNA, 13 bp, Homo sapiens
gcgtggaggagag

SEQ ID NO: 834948 - DNA, 14 bp, Homo sapiens
gcgtggcccaggcc

SEQ ID NO: 834949 - DNA, 12 bp, Homo sapiens
gcgtggctgact

SEQ ID NO: 834950 - DNA, 12 bp, Homo sapiens
gcgtggctgtgg

SEQ ID NO: 834951 - DNA, 15 bp, Homo sapiens
gcgtggctgtggcac

SEQ ID NO: 834952 - DNA, 13 bp, Homo sapiens
gcgtgggctctgc

SEQ ID NO: 834953 - DNA, 19 bp, Homo sapiens
gcgtgtcgtgggtgtgtgt

SEQ ID NO: 834954 - DNA, 18 bp, Homo sapiens
gcgtgtgctcctctcctt

SEQ ID NO: 834955 - DNA, 17 bp, Homo sapiens
gcgtgtggcagccacac

SEQ ID NO: 834956 - DNA, 17 bp, Homo sapiens
gcgtgtggcgtggcccg

SEQ ID NO: 834957 - DNA, 14 bp, Homo sapiens
gcgtgtggctcacg

SEQ ID NO: 834958 - DNA, 21 bp, Homo sapiens
gcgtgtggctcacgtgtgtga

SEQ ID NO: 834959 - DNA, 17 bp, Homo sapiens
gcgtgtgtccatgtgtg

SEQ ID NO: 834960 - DNA, 13 bp, Homo sapiens
gcgtgtgtgacac

SEQ ID NO: 834961 - DNA, 19 bp, Homo sapiens
gcgtgtgtgacactgatga

SEQ ID NO: 834962 - DNA, 15 bp, Homo sapiens
gcgtgttcagcagaa

SEQ ID NO: 834963 - DNA, 18 bp, Homo sapiens
gcgttatgaagagctaat

SEQ ID NO: 834964 - DNA, 22 bp, Homo sapiens
gcgttattggtcggcagccttc

SEQ ID NO: 834965 - DNA, 13 bp, Homo sapiens
gcgttcacctccc

SEQ ID NO: 834966 - DNA, 13 bp, Homo sapiens
gcgttcccttctc

SEQ ID NO: 834967 - DNA, 19 bp, Homo sapiens
gcgttcccttctccccctt

SEQ ID NO: 834968 - DNA, 13 bp, Homo sapiens
gcgttcctttctt

SEQ ID NO: 834969 - DNA, 16 bp, Homo sapiens
gcgttcctttcttttc

SEQ ID NO: 834970 - DNA, 16 bp, Homo sapiens
gcgttcgcctctggcc

SEQ ID NO: 834971 - DNA, 20 bp, Homo sapiens
gcgttctcccagcactgcct

SEQ ID NO: 834972 - DNA, 11 bp, Homo sapiens
gcgttcttgta

SEQ ID NO: 834973 - DNA, 16 bp, Homo sapiens
gcgttcttgtaatttt

SEQ ID NO: 834974 - DNA, 17 bp, Homo sapiens
gcgttggagccactcct

SEQ ID NO: 834975 - DNA, 14 bp, Homo sapiens
gcgttggtgccact

SEQ ID NO: 834976 - DNA, 23 bp, Homo sapiens
gcgttggtgccacttcttaaagg

SEQ ID NO: 834977 - DNA, 14 bp, Homo sapiens
gcgttgtaaaatat

SEQ ID NO: 834978 - DNA, 15 bp, Homo sapiens
gcgttgtaaaatata

SEQ ID NO: 834979 - DNA, 15 bp, Homo sapiens
gcgttgttacaggaa

SEQ ID NO: 834980 - DNA, 19 bp, Homo sapiens
gcgttgttgcatgtttgaa

SEQ ID NO: 834981 - DNA, 20 bp, Homo sapiens
gcgtttgctgtgccaggagg

SEQ ID NO: 834982 - DNA, 16 bp, Homo sapiens
gctaaaaataaaacat

SEQ ID NO: 834983 - DNA, 12 bp, Homo sapiens
gctaaaaatatt

SEQ ID NO: 834984 - DNA, 12 bp, Homo sapiens
gctaaaagaaac

SEQ ID NO: 834985 - DNA, 15 bp, Homo sapiens
gctaaaagaaacttt

SEQ ID NO: 834986 - DNA, 12 bp, Homo sapiens
gctaaaagaaga

SEQ ID NO: 834987 - DNA, 18 bp, Homo sapiens
gctaaaagtgcatttaag

SEQ ID NO: 834988 - DNA, 22 bp, Homo sapiens
gctaaaagtgcatttaaggaga

SEQ ID NO: 834989 - DNA, 20 bp, Homo sapiens
gctaaacccagatggtttcc

SEQ ID NO: 834990 - DNA, 22 bp, Homo sapiens
gctaaactgaatctatggcttt

SEQ ID NO: 834991 - DNA, 23 bp, Homo sapiens
gctaaactgaatctatggcttta

SEQ ID NO: 834992 - DNA, 14 bp, Homo sapiens
gctaaagagccctt

SEQ ID NO: 834993 - DNA, 18 bp, Homo sapiens
gctaaagagcccttgcct

SEQ ID NO: 834994 - DNA, 19 bp, Homo sapiens
gctaaagcaatatgcattt

SEQ ID NO: 834995 - DNA, 14 bp, Homo sapiens
gctaaagcactttg

SEQ ID NO: 834996 - DNA, 18 bp, Homo sapiens
gctaaagccaaccagcct

SEQ ID NO: 834997 - DNA, 16 bp, Homo sapiens
gctaaagcctgaattt

SEQ ID NO: 834998 - DNA, 21 bp, Homo sapiens
gctaaagggaccatctgctgc

SEQ ID NO: 834999 - DNA, 21 bp, Homo sapiens
gctaaataaaatttgttgcat

SEQ ID NO: 835000 - DNA, 13 bp, Homo sapiens
gctaaatatttac

SEQ ID NO: 835001 - DNA, 19 bp, Homo sapiens
gctaaatcctttactgtta

SEQ ID NO: 835002 - DNA, 17 bp, Homo sapiens
gctaaatgccatgttta

SEQ ID NO: 835003 - DNA, 18 bp, Homo sapiens
gctaaatgtaacttattc

SEQ ID NO: 835004 - DNA, 16 bp, Homo sapiens
gctaaattctatgtta

SEQ ID NO: 835005 - DNA, 19 bp, Homo sapiens
gctaaattctatgttaaat

SEQ ID NO: 835006 - DNA, 13 bp, Homo sapiens
gctaaattttctg

SEQ ID NO: 835007 - DNA, 13 bp, Homo sapiens
gctaacaaacctg

SEQ ID NO: 835008 - DNA, 17 bp, Homo sapiens
gctaacaatttctcata

SEQ ID NO: 835009 - DNA, 17 bp, Homo sapiens
gctaacactggccccta

SEQ ID NO: 835010 - DNA, 22 bp, Homo sapiens
gctaacatctttacgtactgta

SEQ ID NO: 835011 - DNA, 23 bp, Homo sapiens
gctaacattttaaataaaagaaa

SEQ ID NO: 835012 - DNA, 22 bp, Homo sapiens
gctaacccccagcccacagagc

SEQ ID NO: 835013 - DNA, 18 bp, Homo sapiens
gctaacctggacctggaa

SEQ ID NO: 835014 - DNA, 19 bp, Homo sapiens
gctaactccgagagcagtg

SEQ ID NO: 835015 - DNA, 22 bp, Homo sapiens
gctaactccgagagcagtgggc

SEQ ID NO: 835016 - DNA, 14 bp, Homo sapiens
gctaagaaaagatt

SEQ ID NO: 835017 - DNA, 14 bp, Homo sapiens
gctaagagaagtag

SEQ ID NO: 835018 - DNA, 18 bp, Homo sapiens
gctaagagctagcgctgc

SEQ ID NO: 835019 - DNA, 17 bp, Homo sapiens
gctattttatttgtatt

SEQ ID NO: 835020 - DNA, 15 bp, Homo sapiens
gctattttcctctgg

SEQ ID NO: 835021 - DNA, 17 bp, Homo sapiens
gctattttctaaagact

SEQ ID NO: 835022 - DNA, 23 bp, Homo sapiens
gctatttttcttgttgcatcttt

SEQ ID NO: 835023 - DNA, 15 bp, Homo sapiens
gctcaaaaaatgagc

SEQ ID NO: 835024 - DNA, 20 bp, Homo sapiens
gctcaaaattttaaaaatac

SEQ ID NO: 835025 - DNA, 20 bp, Homo sapiens
gctcaaagcccttcctacct

SEQ ID NO: 835026 - DNA, 22 bp, Homo sapiens
gctcaaaggtttggaaggagca

SEQ ID NO: 835027 - DNA, 23 bp, Homo sapiens
gctcaaaggtttggaaggagcag

SEQ ID NO: 835028 - DNA, 20 bp, Homo sapiens
gctcaaatctattcagacaa

SEQ ID NO: 835029 - DNA, 18 bp, Homo sapiens
gctcaactcgggggcgcc

SEQ ID NO: 835030 - DNA, 19 bp, Homo sapiens
gctcaactctacccctgct

SEQ ID NO: 835031 - DNA, 13 bp, Homo sapiens
gctcaagaatgta

SEQ ID NO: 835032 - DNA, 16 bp, Homo sapiens
gctcaagacaaggctg

SEQ ID NO: 835033 - DNA, 17 bp, Homo sapiens
gctcaagcaatcctcct

SEQ ID NO: 835034 - DNA, 15 bp, Homo sapiens
gctcaagcagcgacc

SEQ ID NO: 835035 - DNA, 13 bp, Homo sapiens
gctcaagcttccc

SEQ ID NO: 835036 - DNA, 18 bp, Homo sapiens
gctcaaggccaccttgga

SEQ ID NO: 835037 - DNA, 20 bp, Homo sapiens
gctcaaggccaccttggagg

SEQ ID NO: 835038 - DNA, 13 bp, Homo sapiens
gctcaaggctgtg

SEQ ID NO: 835039 - DNA, 20 bp, Homo sapiens
gctcaagggaccctgggtgg

SEQ ID NO: 835040 - DNA, 18 bp, Homo sapiens
gctcaagggttctttcct

SEQ ID NO: 835041 - DNA, 17 bp, Homo sapiens
gctcaagtgatcctcac

SEQ ID NO: 835042 - DNA, 14 bp, Homo sapiens
gctcaataaagatt

SEQ ID NO: 835043 - DNA, 14 bp, Homo sapiens
gctcaatcctctaa

SEQ ID NO: 835044 - DNA, 13 bp, Homo sapiens
gctcaatttcagc

SEQ ID NO: 835045 - DNA, 15 bp, Homo sapiens
gctcaatttcagcac

SEQ ID NO: 835046 - DNA, 11 bp, Homo sapiens
gctcacactcc

SEQ ID NO: 835047 - DNA, 13 bp, Homo sapiens
gctcacactcctg

SEQ ID NO: 835048 - DNA, 17 bp, Homo sapiens
gctcacagggcaggcct

SEQ ID NO: 835049 - DNA, 18 bp, Homo sapiens
gctcacagggcaggcctt

SEQ ID NO: 835050 - DNA, 21 bp, Homo sapiens
gctcacagggcaggccttgct

SEQ ID NO: 835051 - DNA, 22 bp, Homo sapiens
gctcacagtacagcatgtgcct

SEQ ID NO: 835052 - DNA, 15 bp, Homo sapiens
gctcaccagccctgc

SEQ ID NO: 835053 - DNA, 16 bp, Homo sapiens
gctcacccccttctcc

SEQ ID NO: 835054 - DNA, 13 bp, Homo sapiens
gctcacccctggg

SEQ ID NO: 835055 - DNA, 20 bp, Homo sapiens
gctcaccctgcccgctccca

SEQ ID NO: 835056 - DNA, 21 bp, Homo sapiens
gctcaccctgcccgctcccaa

SEQ ID NO: 835057 - DNA, 19 bp, Homo sapiens
gctcaccgctggcccttag

SEQ ID NO: 835058 - DNA, 14 bp, Homo sapiens
gctcacctagagcc

SEQ ID NO: 835059 - DNA, 15 bp, Homo sapiens
gctcacctagagcca

SEQ ID NO: 835060 - DNA, 17 bp, Homo sapiens
gctcacctagagccaga

SEQ ID NO: 835061 - DNA, 20 bp, Homo sapiens
gctcacctagagccagacca

SEQ ID NO: 835062 - DNA, 14 bp, Homo sapiens
gctcacctctgaag

SEQ ID NO: 835063 - DNA, 16 bp, Homo sapiens
gctcacgactcttcct

SEQ ID NO: 835064 - DNA, 23 bp, Homo sapiens
gctcacgactcttcctgcaaagg

SEQ ID NO: 835065 - DNA, 17 bp, Homo sapiens
gctcacgccccgctgtg

SEQ ID NO: 835066 - DNA, 15 bp, Homo sapiens
gctcacgcctgtaat

SEQ ID NO: 835067 - DNA, 16 bp, Homo sapiens
gctcacgcgttctggg

SEQ ID NO: 835068 - DNA, 15 bp, Homo sapiens
gctcacgtgtgtgac

SEQ ID NO: 835069 - DNA, 13 bp, Homo sapiens
gctcactcacccc

SEQ ID NO: 835070 - DNA, 19 bp, Homo sapiens
gctcactcactcactccaa

SEQ ID NO: 835071 - DNA, 15 bp, Homo sapiens
gctcactcagccacc

SEQ ID NO: 835072 - DNA, 20 bp, Homo sapiens
gctcactcagccaccctgag

SEQ ID NO: 835073 - DNA, 22 bp, Homo sapiens
gctcactcccaagggacagcaa

SEQ ID NO: 835074 - DNA, 16 bp, Homo sapiens
gctcactcggcaccct

SEQ ID NO: 835075 - DNA, 22 bp, Homo sapiens
gctcactgaactccttccccac

SEQ ID NO: 835076 - DNA, 19 bp, Homo sapiens
gctcactgacctgcctgta

SEQ ID NO: 835077 - DNA, 19 bp, Homo sapiens
gctcactgcaacctctgcc

SEQ ID NO: 835078 - DNA, 12 bp, Homo sapiens
gctcactgcagc

SEQ ID NO: 835079 - DNA, 16 bp, Homo sapiens
gctcactgcagcctca

SEQ ID NO: 835080 - DNA, 18 bp, Homo sapiens
gctcactgcagcctcata

SEQ ID NO: 835081 - DNA, 12 bp, Homo sapiens
gctcactgccag

SEQ ID NO: 835082 - DNA, 19 bp, Homo sapiens
gctcactgccaggccagcc

SEQ ID NO: 835083 - DNA, 20 bp, Homo sapiens
gctcactgccaggccagcct

SEQ ID NO: 835084 - DNA, 21 bp, Homo sapiens
gctcactgccaggccagcctc

SEQ ID NO: 835085 - DNA, 13 bp, Homo sapiens
gctcactggctgg

SEQ ID NO: 835086 - DNA, 13 bp, Homo sapiens
gctcactgtccac

SEQ ID NO: 835087 - DNA, 14 bp, Homo sapiens
gctcacttgcctta

SEQ ID NO: 835088 - DNA, 22 bp, Homo sapiens
gctcacttttcatccttcccca

SEQ ID NO: 835089 - DNA, 14 bp, Homo sapiens
gctcagaacccagg

SEQ ID NO: 835090 - DNA, 17 bp, Homo sapiens
gctcagaacccagggct

SEQ ID NO: 835091 - DNA, 14 bp, Homo sapiens
gctcagaagagcag

SEQ ID NO: 835092 - DNA, 16 bp, Homo sapiens
gctcagaccagctctt

SEQ ID NO: 835093 - DNA, 19 bp, Homo sapiens
gctcagacccccactctca

SEQ ID NO: 835094 - DNA, 17 bp, Homo sapiens
gctcagacttgccaggc

SEQ ID NO: 835095 - DNA, 16 bp, Homo sapiens
gctcagagcttgaaga

SEQ ID NO: 835096 - DNA, 12 bp, Homo sapiens
gctcagagcttt

SEQ ID NO: 835097 - DNA, 14 bp, Homo sapiens
gctcagagctttaa

SEQ ID NO: 835098 - DNA, 18 bp, Homo sapiens
gctcagagctttaaaagt

SEQ ID NO: 835099 - DNA, 18 bp, Homo sapiens
gctcagagctttgtcact

SEQ ID NO: 835100 - DNA, 19 bp, Homo sapiens
gctcagagggggactgctg

SEQ ID NO: 835101 - DNA, 17 bp, Homo sapiens
gctcagagtgaccctca

SEQ ID NO: 835102 - DNA, 19 bp, Homo sapiens
gctcagagtgaccctcagc

SEQ ID NO: 835103 - DNA, 23 bp, Homo sapiens
gctcagagtgaccctcagctgtc

SEQ ID NO: 835104 - DNA, 20 bp, Homo sapiens
gctcagatcggccacagggc

SEQ ID NO: 835105 - DNA, 22 bp, Homo sapiens
gctcagatcggccacagggcgg

SEQ ID NO: 835106 - DNA, 23 bp, Homo sapiens
gctcagatgtcgtaatttgcact

SEQ ID NO: 835107 - DNA, 12 bp, Homo sapiens
gctcagcagcca

SEQ ID NO: 835108 - DNA, 14 bp, Homo sapiens
gctcagcagccagt

SEQ ID NO: 835109 - DNA, 17 bp, Homo sapiens
gctcagcagccagtctc

SEQ ID NO: 835110 - DNA, 15 bp, Homo sapiens
gctcagcccaccccc

SEQ ID NO: 835111 - DNA, 18 bp, Homo sapiens
gctcagcccacccccctc

SEQ ID NO: 835112 - DNA, 16 bp, Homo sapiens
gctcagccctccctgc

SEQ ID NO: 835113 - DNA, 19 bp, Homo sapiens
gctcagccctgactggtgc

SEQ ID NO: 835114 - DNA, 13 bp, Homo sapiens
gctcagccctggc

SEQ ID NO: 835115 - DNA, 21 bp, Homo sapiens
gctcagcctcccgagtagctg

SEQ ID NO: 835116 - DNA, 14 bp, Homo sapiens
gctcagcctggtgg

SEQ ID NO: 835117 - DNA, 14 bp, Homo sapiens
gctcagcctgtctc

SEQ ID NO: 835118 - DNA, 21 bp, Homo sapiens
gctcagcctgtctcgggctga

SEQ ID NO: 835119 - DNA, 12 bp, Homo sapiens
gctcagcttctc

SEQ ID NO: 835120 - DNA, 13 bp, Homo sapiens
gctcagcttctcc

SEQ ID NO: 835121 - DNA, 14 bp, Homo sapiens
gctcagcttcttcc

SEQ ID NO: 835122 - DNA, 19 bp, Homo sapiens
gctcagcttcttcctaggt

SEQ ID NO: 835123 - DNA, 23 bp, Homo sapiens
gctcagcttcttcctaggtccaa

SEQ ID NO: 835124 - DNA, 13 bp, Homo sapiens
gctcaggacccag

SEQ ID NO: 835125 - DNA, 17 bp, Homo sapiens
gctcaggacccaggccc

SEQ ID NO: 835126 - DNA, 16 bp, Homo sapiens
gctcaggaggcttgga

SEQ ID NO: 835127 - DNA, 21 bp, Homo sapiens
gctcaggagggtgacgcccag

SEQ ID NO: 835128 - DNA, 23 bp, Homo sapiens
gctcaggagggtgacgcccagct

SEQ ID NO: 835129 - DNA, 13 bp, Homo sapiens
gctcaggagtttg

SEQ ID NO: 835130 - DNA, 22 bp, Homo sapiens
gctcaggatatggcttaggaat

SEQ ID NO: 835131 - DNA, 13 bp, Homo sapiens
gctcaggcaagcc

SEQ ID NO: 835132 - DNA, 17 bp, Homo sapiens
gctcaggcaagcccctc

SEQ ID NO: 835133 - DNA, 19 bp, Homo sapiens
gctcaggcaagcccctcag

SEQ ID NO: 835134 - DNA, 20 bp, Homo sapiens
gctcaggcaagcccctcagc

SEQ ID NO: 835135 - DNA, 22 bp, Homo sapiens
gctcaggcaagcccctcagccc

SEQ ID NO: 835136 - DNA, 14 bp, Homo sapiens
gctcaggcctagga

SEQ ID NO: 835137 - DNA, 17 bp, Homo sapiens
gctcaggcctaggaggc

SEQ ID NO: 835138 - DNA, 23 bp, Homo sapiens
gctcaggcctccctagcacctcc

SEQ ID NO: 835139 - DNA, 19 bp, Homo sapiens
gctcaggcgatccacctgt

SEQ ID NO: 835140 - DNA, 14 bp, Homo sapiens
gctcaggctgcagc

SEQ ID NO: 835141 - DNA, 23 bp, Homo sapiens
gctcccaccccagaaatcactgt

SEQ ID NO: 835142 - DNA, 12 bp, Homo sapiens
gctcccaccctc

SEQ ID NO: 835143 - DNA, 18 bp, Homo sapiens
gctcccaccgcccccacc

SEQ ID NO: 835144 - DNA, 19 bp, Homo sapiens
gctcccaccgcccccaccc

SEQ ID NO: 835145 - DNA, 20 bp, Homo sapiens
gctcccaccgcccccacccc

SEQ ID NO: 835146 - DNA, 13 bp, Homo sapiens
gctcccacctagt

SEQ ID NO: 835147 - DNA, 20 bp, Homo sapiens
gctcccacctagtgccccag

SEQ ID NO: 835148 - DNA, 23 bp, Homo sapiens
gctcccacctagtgccccagact

SEQ ID NO: 835149 - DNA, 13 bp, Homo sapiens
gctcccacctccc

SEQ ID NO: 835150 - DNA, 17 bp, Homo sapiens
gctcccacctgtttctg

SEQ ID NO: 835151 - DNA, 19 bp, Homo sapiens
gctcccagcagccctaagg

SEQ ID NO: 835152 - DNA, 15 bp, Homo sapiens
gctcccagcctgctg

SEQ ID NO: 835153 - DNA, 17 bp, Homo sapiens
gctcccagcctgctgag

SEQ ID NO: 835154 - DNA, 15 bp, Homo sapiens
gctcccagctgtgct

SEQ ID NO: 835155 - DNA, 16 bp, Homo sapiens
gctcccaggggtctcc

SEQ ID NO: 835156 - DNA, 11 bp, Homo sapiens
gctcccagggt

SEQ ID NO: 835157 - DNA, 12 bp, Homo sapiens
gctcccagggtg

SEQ ID NO: 835158 - DNA, 22 bp, Homo sapiens
gctcccaggttcccccagcaag

SEQ ID NO: 835159 - DNA, 22 bp, Homo sapiens
gctcccatcattccttctggcc

SEQ ID NO: 835160 - DNA, 19 bp, Homo sapiens
gctcccatcctcacccaga

SEQ ID NO: 835161 - DNA, 20 bp, Homo sapiens
gctcccattcactcttccag

SEQ ID NO: 835162 - DNA, 17 bp, Homo sapiens
gctccccaacacctgcc

SEQ ID NO: 835163 - DNA, 19 bp, Homo sapiens
gctccccacagcgtccctg

SEQ ID NO: 835164 - DNA, 20 bp, Homo sapiens
gctccccacagctttgcacc

SEQ ID NO: 835165 - DNA, 12 bp, Homo sapiens
gctccccacctg

SEQ ID NO: 835166 - DNA, 13 bp, Homo sapiens
gctccccacctgg

SEQ ID NO: 835167 - DNA, 16 bp, Homo sapiens
gctccccacctggaca

SEQ ID NO: 835168 - DNA, 24 bp, Homo sapiens
gctccccacgagtcacctgcaagc

SEQ ID NO: 835169 - DNA, 15 bp, Homo sapiens
gctccccagcccagg

SEQ ID NO: 835170 - DNA, 16 bp, Homo sapiens
gctccccagcccaggg

SEQ ID NO: 835171 - DNA, 16 bp, Homo sapiens
gctccccagccctggc

SEQ ID NO: 835172 - DNA, 19 bp, Homo sapiens
gctccccagccctggctct

SEQ ID NO: 835173 - DNA, 21 bp, Homo sapiens
gctccccagccctggctctgc

SEQ ID NO: 835174 - DNA, 21 bp, Homo sapiens
gctccccatcaccatgggagg

SEQ ID NO: 835175 - DNA, 20 bp, Homo sapiens
gctcccccatcctccccttc

SEQ ID NO: 835176 - DNA, 17 bp, Homo sapiens
gctccccccgcccaccc

SEQ ID NO: 835177 - DNA, 20 bp, Homo sapiens
gctccccccgcccacccacg

SEQ ID NO: 835178 - DNA, 22 bp, Homo sapiens
gctccccccgcccacccacgca

SEQ ID NO: 835179 - DNA, 15 bp, Homo sapiens
gctcccccgcagtcc

SEQ ID NO: 835180 - DNA, 16 bp, Homo sapiens
gctcccccgcagtccc

SEQ ID NO: 835181 - DNA, 15 bp, Homo sapiens
gctccccctctgctt

SEQ ID NO: 835182 - DNA, 14 bp, Homo sapiens
gctccccgcctcca

SEQ ID NO: 835183 - DNA, 15 bp, Homo sapiens
gctccccgcctccac

SEQ ID NO: 835184 - DNA, 16 bp, Homo sapiens
gctccccgcctccact

SEQ ID NO: 835185 - DNA, 17 bp, Homo sapiens
gctccccggcactgcag

SEQ ID NO: 835186 - DNA, 15 bp, Homo sapiens
gctcccctccacagc

SEQ ID NO: 835187 - DNA, 14 bp, Homo sapiens
gctcccctccatcc

SEQ ID NO: 835188 - DNA, 16 bp, Homo sapiens
gctcccctccatcccc

SEQ ID NO: 835189 - DNA, 22 bp, Homo sapiens
gctcccctcccaggggagccag

SEQ ID NO: 835190 - DNA, 18 bp, Homo sapiens
gctcccctctgcttctca

SEQ ID NO: 835191 - DNA, 21 bp, Homo sapiens
gctcccctgagaccaccccca

SEQ ID NO: 835192 - DNA, 16 bp, Homo sapiens
gctcccctgctgaggc

SEQ ID NO: 835193 - DNA, 17 bp, Homo sapiens
gctcccctgctgaggca

SEQ ID NO: 835194 - DNA, 18 bp, Homo sapiens
gctcccctgctgaggcag

SEQ ID NO: 835195 - DNA, 19 bp, Homo sapiens
gctccccttggacctccag

SEQ ID NO: 835196 - DNA, 22 bp, Homo sapiens
gctcccgcatttctcatgcttc

SEQ ID NO: 835197 - DNA, 14 bp, Homo sapiens
gctcccgctgtggc

SEQ ID NO: 835198 - DNA, 17 bp, Homo sapiens
gctcccgggcctcaggg

SEQ ID NO: 835199 - DNA, 21 bp, Homo sapiens
gctcccgggcctcagggtcct

SEQ ID NO: 835200 - DNA, 20 bp, Homo sapiens
gctccctaaactttggcctt

SEQ ID NO: 835201 - DNA, 21 bp, Homo sapiens
gctccctaaactttggccttt

SEQ ID NO: 835202 - DNA, 19 bp, Homo sapiens
gctccctacattccccaga

SEQ ID NO: 835203 - DNA, 21 bp, Homo sapiens
gctccctacattccccagagt

SEQ ID NO: 835204 - DNA, 22 bp, Homo sapiens
gctccctcaaatgacagaccta

SEQ ID NO: 835205 - DNA, 19 bp, Homo sapiens
gctccctccccgctgccct

SEQ ID NO: 835206 - DNA, 19 bp, Homo sapiens
gctccctcccctgccctgg

SEQ ID NO: 835207 - DNA, 23 bp, Homo sapiens
gctccctcccctgccctggtcca

SEQ ID NO: 835208 - DNA, 22 bp, Homo sapiens
gctccctcccgtagtctcctgg

SEQ ID NO: 835209 - DNA, 19 bp, Homo sapiens
gctccctcctccaggcctg

SEQ ID NO: 835210 - DNA, 15 bp, Homo sapiens
gctccctcctctggc

SEQ ID NO: 835211 - DNA, 16 bp, Homo sapiens
gctccctcctctggca

SEQ ID NO: 835212 - DNA, 13 bp, Homo sapiens
gctccctcctgca

SEQ ID NO: 835213 - DNA, 15 bp, Homo sapiens
gctccctcctggagc

SEQ ID NO: 835214 - DNA, 13 bp, Homo sapiens
gctccctctctgg

SEQ ID NO: 835215 - DNA, 11 bp, Homo sapiens
gctccctctgt

SEQ ID NO: 835216 - DNA, 21 bp, Homo sapiens
gctccctctgttaggtccatt

SEQ ID NO: 835217 - DNA, 19 bp, Homo sapiens
gctccctcttcctctccat

SEQ ID NO: 835218 - DNA, 13 bp, Homo sapiens
gctccctcttgtg

SEQ ID NO: 835219 - DNA, 16 bp, Homo sapiens
gctccctgactgggag

SEQ ID NO: 835220 - DNA, 18 bp, Homo sapiens
gctccctgactgggagtt

SEQ ID NO: 835221 - DNA, 16 bp, Homo sapiens
gctccctgacttctcc

SEQ ID NO: 835222 - DNA, 19 bp, Homo sapiens
gctccctgacttctccccc

SEQ ID NO: 835223 - DNA, 12 bp, Homo sapiens
gctccctgcacc

SEQ ID NO: 835224 - DNA, 13 bp, Homo sapiens
gctccctgcccca

SEQ ID NO: 835225 - DNA, 14 bp, Homo sapiens
gctccctgccccaa

SEQ ID NO: 835226 - DNA, 15 bp, Homo sapiens
gctccctgccccaaa

SEQ ID NO: 835227 - DNA, 13 bp, Homo sapiens
gctccctggatat

SEQ ID NO: 835228 - DNA, 21 bp, Homo sapiens
gctccctgtaacctcttcaga

SEQ ID NO: 835229 - DNA, 19 bp, Homo sapiens
gctccctgtagctctgcct

SEQ ID NO: 835230 - DNA, 23 bp, Homo sapiens
gctccctgtagctctgcctccct

SEQ ID NO: 835231 - DNA, 18 bp, Homo sapiens
gctccctgtggggcagga

SEQ ID NO: 835232 - DNA, 21 bp, Homo sapiens
gctccctgtggggcaggagtg

SEQ ID NO: 835233 - DNA, 21 bp, Homo sapiens
gctccctgtgtccacctgtgg

SEQ ID NO: 835234 - DNA, 19 bp, Homo sapiens
gctcccttcaatgctagaa

SEQ ID NO: 835235 - DNA, 15 bp, Homo sapiens
gctcccttgggaagg

SEQ ID NO: 835236 - DNA, 13 bp, Homo sapiens
gctccctttctct

SEQ ID NO: 835237 - DNA, 21 bp, Homo sapiens
gctcccttttacattctgtgt

SEQ ID NO: 835238 - DNA, 15 bp, Homo sapiens
gctccgaaccccggg

SEQ ID NO: 835239 - DNA, 18 bp, Homo sapiens
gctccgaaccccgggccc

SEQ ID NO: 835240 - DNA, 21 bp, Homo sapiens
gctccgacctctctcagcccc

SEQ ID NO: 835241 - DNA, 13 bp, Homo sapiens
gctccgaggactg

SEQ ID NO: 835242 - DNA, 15 bp, Homo sapiens
gctccgaggactgga

SEQ ID NO: 835243 - DNA, 17 bp, Homo sapiens
gctccgaggactggact

SEQ ID NO: 835244 - DNA, 21 bp, Homo sapiens
gctccgaggactggactgttt

SEQ ID NO: 835245 - DNA, 12 bp, Homo sapiens
gctccgccagga

SEQ ID NO: 835246 - DNA, 13 bp, Homo sapiens
gctccgcctgctg

SEQ ID NO: 835247 - DNA, 15 bp, Homo sapiens
gctccgcctggcctg

SEQ ID NO: 835248 - DNA, 17 bp, Homo sapiens
gctccgctcccaccgcc

SEQ ID NO: 835249 - DNA, 19 bp, Homo sapiens
gctccgctgctccttggct

SEQ ID NO: 835250 - DNA, 14 bp, Homo sapiens
gctccggaatagat

SEQ ID NO: 835251 - DNA, 23 bp, Homo sapiens
gctccggaggggacccagctcct

SEQ ID NO: 835252 - DNA, 20 bp, Homo sapiens
gctccggagggggtcctcct

SEQ ID NO: 835253 - DNA, 16 bp, Homo sapiens
gctccgggtcactgct

SEQ ID NO: 835254 - DNA, 17 bp, Homo sapiens
gctccgtctctgtcctc

SEQ ID NO: 835255 - DNA, 13 bp, Homo sapiens
gctccgtgcctcc

SEQ ID NO: 835256 - DNA, 21 bp, Homo sapiens
gctccgtggactgcagtcggc

SEQ ID NO: 835257 - DNA, 13 bp, Homo sapiens
gctccgtggagga

SEQ ID NO: 835258 - DNA, 16 bp, Homo sapiens
gctccgtggaggaggt

SEQ ID NO: 835259 - DNA, 17 bp, Homo sapiens
gctcctaaagtaacatc

SEQ ID NO: 835260 - DNA, 19 bp, Homo sapiens
gctcctacatccagctcct

SEQ ID NO: 835261 - DNA, 15 bp, Homo sapiens
gctcctagagggagg

SEQ ID NO: 835262 - DNA, 16 bp, Homo sapiens
gctcctagagggaggg

SEQ ID NO: 835263 - DNA, 20 bp, Homo sapiens
gctctgcgccaggcagagct

SEQ ID NO: 835264 - DNA, 22 bp, Homo sapiens
gctctgctcccctaaagcctca

SEQ ID NO: 835265 - DNA, 13 bp, Homo sapiens
gctctgctggcct

SEQ ID NO: 835266 - DNA, 18 bp, Homo sapiens
gctctgctggcctggccg

SEQ ID NO: 835267 - DNA, 21 bp, Homo sapiens
gctctgctggcctggccggca

SEQ ID NO: 835268 - DNA, 21 bp, Homo sapiens
gctctggaaaatgtgacccag

SEQ ID NO: 835269 - DNA, 22 bp, Homo sapiens
gctctggaataaagttgcagat

SEQ ID NO: 835270 - DNA, 11 bp, Homo sapiens
gctctggacca

SEQ ID NO: 835271 - DNA, 15 bp, Homo sapiens
gctctggacctcagg

SEQ ID NO: 835272 - DNA, 21 bp, Homo sapiens
gctctggacctcaggagggca

SEQ ID NO: 835273 - DNA, 23 bp, Homo sapiens
gctctggacctcaggagggcagg

SEQ ID NO: 835274 - DNA, 14 bp, Homo sapiens
gctctggagccaga

SEQ ID NO: 835275 - DNA, 18 bp, Homo sapiens
gctctggaggaagttctc

SEQ ID NO: 835276 - DNA, 22 bp, Homo sapiens
gctctggaggaagttctccagc

SEQ ID NO: 835277 - DNA, 13 bp, Homo sapiens
gctctggagggga

SEQ ID NO: 835278 - DNA, 16 bp, Homo sapiens
gctctggaggggaggg

SEQ ID NO: 835279 - DNA, 17 bp, Homo sapiens
gctctggatgaaggcaa

SEQ ID NO: 835280 - DNA, 12 bp, Homo sapiens
gctctggccacc

SEQ ID NO: 835281 - DNA, 18 bp, Homo sapiens
gctctggccaccctggcc

SEQ ID NO: 835282 - DNA, 21 bp, Homo sapiens
gctctggccaccctggcccgc

SEQ ID NO: 835283 - DNA, 17 bp, Homo sapiens
gctctggcggcttcctg

SEQ ID NO: 835284 - DNA, 21 bp, Homo sapiens
gctctggctccagaggacctg

SEQ ID NO: 835285 - DNA, 11 bp, Homo sapiens
gctctggctct

SEQ ID NO: 835286 - DNA, 15 bp, Homo sapiens
gctctggctgaaccc

SEQ ID NO: 835287 - DNA, 19 bp, Homo sapiens
gctctggctgaaccctgtg

SEQ ID NO: 835288 - DNA, 20 bp, Homo sapiens
gctctggctgaaccctgtgc

SEQ ID NO: 835289 - DNA, 21 bp, Homo sapiens
gctctggctgaaccctgtgct

SEQ ID NO: 835290 - DNA, 22 bp, Homo sapiens
gctctggctgaaccctgtgctg

SEQ ID NO: 835291 - DNA, 13 bp, Homo sapiens
gctctggcttgcc

SEQ ID NO: 835292 - DNA, 15 bp, Homo sapiens
gctctggcttgcccc

SEQ ID NO: 835293 - DNA, 18 bp, Homo sapiens
gctctggcttgccccagg

SEQ ID NO: 835294 - DNA, 15 bp, Homo sapiens
gctctgggagagcca

SEQ ID NO: 835295 - DNA, 18 bp, Homo sapiens
gctctgggagagccagct

SEQ ID NO: 835296 - DNA, 19 bp, Homo sapiens
gctctgggagagccagctt

SEQ ID NO: 835297 - DNA, 16 bp, Homo sapiens
gctctgggcacagtgc

SEQ ID NO: 835298 - DNA, 23 bp, Homo sapiens
gctctgggcacagtgctgcccct

SEQ ID NO: 835299 - DNA, 20 bp, Homo sapiens
gctctgggccattctccaca

SEQ ID NO: 835300 - DNA, 21 bp, Homo sapiens
gctctgggccgggcctggggc

SEQ ID NO: 835301 - DNA, 19 bp, Homo sapiens
gctctggggacagcttcct

SEQ ID NO: 835302 - DNA, 19 bp, Homo sapiens
gctctggggatgggtgggg

SEQ ID NO: 835303 - DNA, 19 bp, Homo sapiens
gctctggggatttctggga

SEQ ID NO: 835304 - DNA, 16 bp, Homo sapiens
gctctgggggacccag

SEQ ID NO: 835305 - DNA, 19 bp, Homo sapiens
gctctggggtgggcagttt

SEQ ID NO: 835306 - DNA, 16 bp, Homo sapiens
gctctggtccaggccc

SEQ ID NO: 835307 - DNA, 13 bp, Homo sapiens
gctctggtcccct

SEQ ID NO: 835308 - DNA, 16 bp, Homo sapiens
gctctggtcctcggag

SEQ ID NO: 835309 - DNA, 17 bp, Homo sapiens
gctctggttatttttct

SEQ ID NO: 835310 - DNA, 21 bp, Homo sapiens
gctctggttgtttctgttcca

SEQ ID NO: 835311 - DNA, 21 bp, Homo sapiens
gctctgtaacttacacctgga

SEQ ID NO: 835312 - DNA, 19 bp, Homo sapiens
gctctgtatcaggacccag

SEQ ID NO: 835313 - DNA, 23 bp, Homo sapiens
gctctgtatcaggacccagagga

SEQ ID NO: 835314 - DNA, 16 bp, Homo sapiens
gctctgtcactccagg

SEQ ID NO: 835315 - DNA, 15 bp, Homo sapiens
gctctgtcactgagc

SEQ ID NO: 835316 - DNA, 14 bp, Homo sapiens
gctctgtccccaaa

SEQ ID NO: 835317 - DNA, 15 bp, Homo sapiens
gctctgtccccaaag

SEQ ID NO: 835318 - DNA, 16 bp, Homo sapiens
gctctgtccccaaagg

SEQ ID NO: 835319 - DNA, 15 bp, Homo sapiens
gctctgtcccccagg

SEQ ID NO: 835320 - DNA, 14 bp, Homo sapiens
gctctgtgcaggga

SEQ ID NO: 835321 - DNA, 14 bp, Homo sapiens
gctctgtgcagtca

SEQ ID NO: 835322 - DNA, 11 bp, Homo sapiens
gctctgtggcc

SEQ ID NO: 835323 - DNA, 12 bp, Homo sapiens
gctctgtggcct

SEQ ID NO: 835324 - DNA, 15 bp, Homo sapiens
gctctgtggcctgtg

SEQ ID NO: 835325 - DNA, 17 bp, Homo sapiens
gctctgtggcctgtgtc

SEQ ID NO: 835326 - DNA, 19 bp, Homo sapiens
gctctgtggcctgtgtcca

SEQ ID NO: 835327 - DNA, 17 bp, Homo sapiens
gctctgtgttcccagag

SEQ ID NO: 835328 - DNA, 18 bp, Homo sapiens
gctcttaaaatatcttcc

SEQ ID NO: 835329 - DNA, 18 bp, Homo sapiens
gctcttaagcagcatgga

SEQ ID NO: 835330 - DNA, 14 bp, Homo sapiens
gctcttactctttc

SEQ ID NO: 835331 - DNA, 23 bp, Homo sapiens
gctcttagcaaaaacatgtatgt

SEQ ID NO: 835332 - DNA, 16 bp, Homo sapiens
gctcttagcagcttcc

SEQ ID NO: 835333 - DNA, 15 bp, Homo sapiens
gctcttagtcccaag

SEQ ID NO: 835334 - DNA, 18 bp, Homo sapiens
gctcttagtcccaagcta

SEQ ID NO: 835335 - DNA, 15 bp, Homo sapiens
gctcttagtctcttt

SEQ ID NO: 835336 - DNA, 16 bp, Homo sapiens
gctcttagtgcccgcc

SEQ ID NO: 835337 - DNA, 22 bp, Homo sapiens
gctcttagtgcccgcctaggag

SEQ ID NO: 835338 - DNA, 12 bp, Homo sapiens
gctcttcacagt

SEQ ID NO: 835339 - DNA, 16 bp, Homo sapiens
gctcttcatctgcctg

SEQ ID NO: 835340 - DNA, 11 bp, Homo sapiens
gctcttcccct

SEQ ID NO: 835341 - DNA, 17 bp, Homo sapiens
gctcttcccctagacct

SEQ ID NO: 835342 - DNA, 16 bp, Homo sapiens
gctcttcctggacctg

SEQ ID NO: 835343 - DNA, 20 bp, Homo sapiens
gctcttcctggacctgagtc

SEQ ID NO: 835344 - DNA, 19 bp, Homo sapiens
gctcttcggtttctgagca

SEQ ID NO: 835345 - DNA, 14 bp, Homo sapiens
gctcttctggagtt

SEQ ID NO: 835346 - DNA, 12 bp, Homo sapiens
gctcttcttaaa

SEQ ID NO: 835347 - DNA, 15 bp, Homo sapiens
gctcttctttctgag

SEQ ID NO: 835348 - DNA, 19 bp, Homo sapiens
gctcttgaaatattcagaa

SEQ ID NO: 835349 - DNA, 22 bp, Homo sapiens
gctcttgaaatattcagaaatt

SEQ ID NO: 835350 - DNA, 18 bp, Homo sapiens
gctcttgaccttgtagag

SEQ ID NO: 835351 - DNA, 22 bp, Homo sapiens
gctcttgatacccccctctgtc

SEQ ID NO: 835352 - DNA, 19 bp, Homo sapiens
gctcttgcccttccctgtc

SEQ ID NO: 835353 - DNA, 22 bp, Homo sapiens
gctcttgcccttccctgtccct

SEQ ID NO: 835354 - DNA, 23 bp, Homo sapiens
gctcttgcccttccctgtccctc

SEQ ID NO: 835355 - DNA, 19 bp, Homo sapiens
gctcttggcaggtactcag

SEQ ID NO: 835356 - DNA, 13 bp, Homo sapiens
gctcttggcattt

SEQ ID NO: 835357 - DNA, 22 bp, Homo sapiens
gctcttggctgacccctctggt

SEQ ID NO: 835358 - DNA, 14 bp, Homo sapiens
gctcttggcttcca

SEQ ID NO: 835359 - DNA, 15 bp, Homo sapiens
gctcttggcttccag

SEQ ID NO: 835360 - DNA, 16 bp, Homo sapiens
gctcttggcttccaga

SEQ ID NO: 835361 - DNA, 19 bp, Homo sapiens
gctcttggtccctggtccc

SEQ ID NO: 835362 - DNA, 21 bp, Homo sapiens
gctcttggtccctggtccctc

SEQ ID NO: 835363 - DNA, 15 bp, Homo sapiens
gctcttgtcccacgt

SEQ ID NO: 835364 - DNA, 18 bp, Homo sapiens
gctcttgtttcactccac

SEQ ID NO: 835365 - DNA, 20 bp, Homo sapiens
gctcttgtttcactccacca

SEQ ID NO: 835366 - DNA, 15 bp, Homo sapiens
gctctttattcatta

SEQ ID NO: 835367 - DNA, 13 bp, Homo sapiens
gctctttcagaga

SEQ ID NO: 835368 - DNA, 17 bp, Homo sapiens
gctctttccaaattaaa

SEQ ID NO: 835369 - DNA, 19 bp, Homo sapiens
gctctttctacatgactgg

SEQ ID NO: 835370 - DNA, 23 bp, Homo sapiens
gctctttctacatgactgggcct

SEQ ID NO: 835371 - DNA, 17 bp, Homo sapiens
gctctttctactctgaa

SEQ ID NO: 835372 - DNA, 15 bp, Homo sapiens
gctctttctctgcca

SEQ ID NO: 835373 - DNA, 18 bp, Homo sapiens
gctctttctctgccagtg

SEQ ID NO: 835374 - DNA, 18 bp, Homo sapiens
gctctttctgggccaagt

SEQ ID NO: 835375 - DNA, 21 bp, Homo sapiens
gctctttgaaatagtctgtgt

SEQ ID NO: 835376 - DNA, 23 bp, Homo sapiens
gctctttgaaatagtctgtgtga

SEQ ID NO: 835377 - DNA, 19 bp, Homo sapiens
gctctttgactgtcagcaa

SEQ ID NO: 835378 - DNA, 21 bp, Homo sapiens
gctctttgactgtcagcaaga

SEQ ID NO: 835379 - DNA, 18 bp, Homo sapiens
gctctttggggtcagcca

SEQ ID NO: 835380 - DNA, 22 bp, Homo sapiens
gctctttggggtcagccagggc

SEQ ID NO: 835381 - DNA, 18 bp, Homo sapiens
gctctttggtctattttc

SEQ ID NO: 835382 - DNA, 15 bp, Homo sapiens
gctcttttaagcagt

SEQ ID NO: 835383 - DNA, 15 bp, Homo sapiens
gctcttttcaatgaa

SEQ ID NO: 835384 - DNA, 15 bp, Homo sapiens
gctcttttcacagct

SEQ ID NO: 835385 - DNA, 23 bp, Homo sapiens
gctgaggaacaggttcctgtgga

SEQ ID NO: 835386 - DNA, 18 bp, Homo sapiens
gctgaggagcagccagga

SEQ ID NO: 835387 - DNA, 18 bp, Homo sapiens
gctgaggagtctgaggac

SEQ ID NO: 835388 - DNA, 20 bp, Homo sapiens
gctgaggagtctgaggactg

SEQ ID NO: 835389 - DNA, 18 bp, Homo sapiens
gctgaggagtgaggaata

SEQ ID NO: 835390 - DNA, 18 bp, Homo sapiens
gctgaggatgattgaggt

SEQ ID NO: 835391 - DNA, 16 bp, Homo sapiens
gctgaggatttcctgg

SEQ ID NO: 835392 - DNA, 23 bp, Homo sapiens
gctgaggcagcagtgtgaggcca

SEQ ID NO: 835393 - DNA, 21 bp, Homo sapiens
gctgaggcaggagactggcgt

SEQ ID NO: 835394 - DNA, 14 bp, Homo sapiens
gctgaggccagagt

SEQ ID NO: 835395 - DNA, 13 bp, Homo sapiens
gctgaggcccagt

SEQ ID NO: 835396 - DNA, 15 bp, Homo sapiens
gctgaggcctgggcc

SEQ ID NO: 835397 - DNA, 16 bp, Homo sapiens
gctgaggcctgggccg

SEQ ID NO: 835398 - DNA, 23 bp, Homo sapiens
gctgaggcctgggccgctgccac

SEQ ID NO: 835399 - DNA, 13 bp, Homo sapiens
gctgaggctggca

SEQ ID NO: 835400 - DNA, 15 bp, Homo sapiens
gctgagggccctgtg

SEQ ID NO: 835401 - DNA, 21 bp, Homo sapiens
gctgagggccctgtggagtcc

SEQ ID NO: 835402 - DNA, 13 bp, Homo sapiens
gctgagggcctgc

SEQ ID NO: 835403 - DNA, 12 bp, Homo sapiens
gctgaggggacg

SEQ ID NO: 835404 - DNA, 11 bp, Homo sapiens
gctgaggggca

SEQ ID NO: 835405 - DNA, 20 bp, Homo sapiens
gctgaggggcctgcgcccag

SEQ ID NO: 835406 - DNA, 24 bp, Homo sapiens
gctgaggggcctgcgcccagagct

SEQ ID NO: 835407 - DNA, 17 bp, Homo sapiens
gctgaggggtctcggat

SEQ ID NO: 835408 - DNA, 19 bp, Homo sapiens
gctgaggtgagaggatcag

SEQ ID NO: 835409 - DNA, 15 bp, Homo sapiens
gctgaggtgggagga

SEQ ID NO: 835410 - DNA, 13 bp, Homo sapiens
gctgaggttcctc

SEQ ID NO: 835411 - DNA, 22 bp, Homo sapiens
gctgaggttcctctgcctgccc

SEQ ID NO: 835412 - DNA, 21 bp, Homo sapiens
gctgagtatgttaagctcttt

SEQ ID NO: 835413 - DNA, 17 bp, Homo sapiens
gctgagtcacctcctcc

SEQ ID NO: 835414 - DNA, 22 bp, Homo sapiens
gctgagtcacctcctccactca

SEQ ID NO: 835415 - DNA, 15 bp, Homo sapiens
gctgagtcatctgtt

SEQ ID NO: 835416 - DNA, 22 bp, Homo sapiens
gctgagtgaaaaatctgtggaa

SEQ ID NO: 835417 - DNA, 20 bp, Homo sapiens
gctgagtgacacaagcactt

SEQ ID NO: 835418 - DNA, 12 bp, Homo sapiens
gctgagtgcagc

SEQ ID NO: 835419 - DNA, 17 bp, Homo sapiens
gctgagtgcagccaaag

SEQ ID NO: 835420 - DNA, 13 bp, Homo sapiens
gctgagtgctggg

SEQ ID NO: 835421 - DNA, 20 bp, Homo sapiens
gctgagtggaatgcagggaa

SEQ ID NO: 835422 - DNA, 21 bp, Homo sapiens
gctgagtggcaggggacagga

SEQ ID NO: 835423 - DNA, 15 bp, Homo sapiens
gctgagtggggagca

SEQ ID NO: 835424 - DNA, 16 bp, Homo sapiens
gctgagtggggagcag

SEQ ID NO: 835425 - DNA, 22 bp, Homo sapiens
gctgagtggggggtcgtgggcc

SEQ ID NO: 835426 - DNA, 12 bp, Homo sapiens
gctgagttgttc

SEQ ID NO: 835427 - DNA, 16 bp, Homo sapiens
gctgagttgttctaac

SEQ ID NO: 835428 - DNA, 19 bp, Homo sapiens
gctgataaggaaactttat

SEQ ID NO: 835429 - DNA, 14 bp, Homo sapiens
gctgataattgtgt

SEQ ID NO: 835430 - DNA, 17 bp, Homo sapiens
gctgatatatgtgtttt

SEQ ID NO: 835431 - DNA, 17 bp, Homo sapiens
gctgatattttctctag

SEQ ID NO: 835432 - DNA, 12 bp, Homo sapiens
gctgatgaaact

SEQ ID NO: 835433 - DNA, 22 bp, Homo sapiens
gctgatgaaactcctgattttg

SEQ ID NO: 835434 - DNA, 20 bp, Homo sapiens
gctgatgatttgtttttgta

SEQ ID NO: 835435 - DNA, 16 bp, Homo sapiens
gctgatgccccttctc

SEQ ID NO: 835436 - DNA, 14 bp, Homo sapiens
gctgatgcttgaag

SEQ ID NO: 835437 - DNA, 17 bp, Homo sapiens
gctgatggagccttccc

SEQ ID NO: 835438 - DNA, 13 bp, Homo sapiens
gctgatggaggaa

SEQ ID NO: 835439 - DNA, 22 bp, Homo sapiens
gctgatggcctggctgcctggt

SEQ ID NO: 835440 - DNA, 19 bp, Homo sapiens
gctgatggcttgacatgtg

SEQ ID NO: 835441 - DNA, 20 bp, Homo sapiens
gctgatgtcaatttctgtgt

SEQ ID NO: 835442 - DNA, 23 bp, Homo sapiens
gctgatgtcaatttctgtgttgc

SEQ ID NO: 835443 - DNA, 14 bp, Homo sapiens
gctgatgtttacaa

SEQ ID NO: 835444 - DNA, 14 bp, Homo sapiens
gctgatgtttcctg

SEQ ID NO: 835445 - DNA, 13 bp, Homo sapiens
gctgattactgaa

SEQ ID NO: 835446 - DNA, 15 bp, Homo sapiens
gctgattactgaaat

SEQ ID NO: 835447 - DNA, 13 bp, Homo sapiens
gctgattatttag

SEQ ID NO: 835448 - DNA, 13 bp, Homo sapiens
gctgattatttat

SEQ ID NO: 835449 - DNA, 17 bp, Homo sapiens
gctgattatttatgacc

SEQ ID NO: 835450 - DNA, 18 bp, Homo sapiens
gctgatttccaggcccct

SEQ ID NO: 835451 - DNA, 22 bp, Homo sapiens
gctgatttccaggcccctgagg

SEQ ID NO: 835452 - DNA, 15 bp, Homo sapiens
gctgattttaacaat

SEQ ID NO: 835453 - DNA, 11 bp, Homo sapiens
gctgatttttt

SEQ ID NO: 835454 - DNA, 12 bp, Homo sapiens
gctgcaaagaga

SEQ ID NO: 835455 - DNA, 19 bp, Homo sapiens
gctgcaaagagaaaccgct

SEQ ID NO: 835456 - DNA, 14 bp, Homo sapiens
gctgcaaaggagaa

SEQ ID NO: 835457 - DNA, 20 bp, Homo sapiens
gctgcaaggtactctggtga

SEQ ID NO: 835458 - DNA, 23 bp, Homo sapiens
gctgcaaggtggcctctgcctgg

SEQ ID NO: 835459 - DNA, 24 bp, Homo sapiens
gctgcaaggtggcctctgcctggg

SEQ ID NO: 835460 - DNA, 19 bp, Homo sapiens
gctgcaaggtttaggctgg

SEQ ID NO: 835461 - DNA, 17 bp, Homo sapiens
gctgcaatgcctagact

SEQ ID NO: 835462 - DNA, 15 bp, Homo sapiens
gctgcaattccctgg

SEQ ID NO: 835463 - DNA, 18 bp, Homo sapiens
gctgcacaaaagcagata

SEQ ID NO: 835464 - DNA, 17 bp, Homo sapiens
gctgcacaacagccctg

SEQ ID NO: 835465 - DNA, 18 bp, Homo sapiens
gctgcacaacagccctgc

SEQ ID NO: 835466 - DNA, 14 bp, Homo sapiens
gctgcacacacctg

SEQ ID NO: 835467 - DNA, 13 bp, Homo sapiens
gctgcacagcagg

SEQ ID NO: 835468 - DNA, 16 bp, Homo sapiens
gctgcacagcaggacc

SEQ ID NO: 835469 - DNA, 13 bp, Homo sapiens
gctgcacattcct

SEQ ID NO: 835470 - DNA, 19 bp, Homo sapiens
gctgcacattcctggcccc

SEQ ID NO: 835471 - DNA, 13 bp, Homo sapiens
gctgcaccagagt

SEQ ID NO: 835472 - DNA, 21 bp, Homo sapiens
gctgcaccccagcgtcaggcc

SEQ ID NO: 835473 - DNA, 22 bp, Homo sapiens
gctgcaccccagcgtcaggcct

SEQ ID NO: 835474 - DNA, 20 bp, Homo sapiens
gctgcaccctgcgcctccag

SEQ ID NO: 835475 - DNA, 15 bp, Homo sapiens
gctgcacgggatgcg

SEQ ID NO: 835476 - DNA, 23 bp, Homo sapiens
gctgcacgggatgcgtgggaggc

SEQ ID NO: 835477 - DNA, 14 bp, Homo sapiens
gctgcactggagcc

SEQ ID NO: 835478 - DNA, 19 bp, Homo sapiens
gctgcactggagccacagg

SEQ ID NO: 835479 - DNA, 23 bp, Homo sapiens
gctgcactggagccacaggcagg

SEQ ID NO: 835480 - DNA, 11 bp, Homo sapiens
gctgcactgtg

SEQ ID NO: 835481 - DNA, 16 bp, Homo sapiens
gctgcagaaggccaag

SEQ ID NO: 835482 - DNA, 19 bp, Homo sapiens
gctgcagaaggccaagaat

SEQ ID NO: 835483 - DNA, 16 bp, Homo sapiens
gctgcagaccatgcca

SEQ ID NO: 835484 - DNA, 13 bp, Homo sapiens
gctgcagagaaac

SEQ ID NO: 835485 - DNA, 20 bp, Homo sapiens
gctgcagagcccggccccac

SEQ ID NO: 835486 - DNA, 22 bp, Homo sapiens
gctgcagagcccggccccacct

SEQ ID NO: 835487 - DNA, 15 bp, Homo sapiens
gctgcagaggccaga

SEQ ID NO: 835488 - DNA, 18 bp, Homo sapiens
gctgcagaggccagaggc

SEQ ID NO: 835489 - DNA, 15 bp, Homo sapiens
gctgcagccatcccg

SEQ ID NO: 835490 - DNA, 14 bp, Homo sapiens
gctgcagcctgcat

SEQ ID NO: 835491 - DNA, 17 bp, Homo sapiens
gctgcagctggacagag

SEQ ID NO: 835492 - DNA, 18 bp, Homo sapiens
gctgcagctggacagagg

SEQ ID NO: 835493 - DNA, 14 bp, Homo sapiens
gctgcagctgggcc

SEQ ID NO: 835494 - DNA, 15 bp, Homo sapiens
gctgcagctgggccc

SEQ ID NO: 835495 - DNA, 16 bp, Homo sapiens
gctgcagctgggcccc

SEQ ID NO: 835496 - DNA, 14 bp, Homo sapiens
gctgcaggagggca

SEQ ID NO: 835497 - DNA, 21 bp, Homo sapiens
gctgcaggagtgtcctgccca

SEQ ID NO: 835498 - DNA, 12 bp, Homo sapiens
gctgcaggcagg

SEQ ID NO: 835499 - DNA, 23 bp, Homo sapiens
gctgcaggcaggcggctcctcct

SEQ ID NO: 835500 - DNA, 13 bp, Homo sapiens
gctgcaggccctc

SEQ ID NO: 835501 - DNA, 17 bp, Homo sapiens
gctgcaggccctccctc

SEQ ID NO: 835502 - DNA, 17 bp, Homo sapiens
gctgcagggcacgggga

SEQ ID NO: 835503 - DNA, 21 bp, Homo sapiens
gctgcagggcacggggacctg

SEQ ID NO: 835504 - DNA, 20 bp, Homo sapiens
gctgcaggtacttcctcctg

SEQ ID NO: 835505 - DNA, 21 bp, Homo sapiens
gctgcagttctactcaggctg

SEQ ID NO: 835506 - DNA, 19 bp, Homo sapiens
gctgcagttggtctccctg

SEQ ID NO: 835507 - DNA, 15 bp, Homo sapiens
gctggaagatcctgc

SEQ ID NO: 835508 - DNA, 17 bp, Homo sapiens
gctggaagatcctgcgg

SEQ ID NO: 835509 - DNA, 14 bp, Homo sapiens
gctggaagcccagc

SEQ ID NO: 835510 - DNA, 22 bp, Homo sapiens
gctggaagcccagcccctactg

SEQ ID NO: 835511 - DNA, 14 bp, Homo sapiens
gctggaagcctgcc

SEQ ID NO: 835512 - DNA, 16 bp, Homo sapiens
gctggaaggcagggca

SEQ ID NO: 835513 - DNA, 20 bp, Homo sapiens
gctggaaggcagggcagagg

SEQ ID NO: 835514 - DNA, 22 bp, Homo sapiens
gctggaaggcagggcagaggga

SEQ ID NO: 835515 - DNA, 20 bp, Homo sapiens
gctggaagggaggaaggcct

SEQ ID NO: 835516 - DNA, 17 bp, Homo sapiens
gctggaaggggcagcag

SEQ ID NO: 835517 - DNA, 14 bp, Homo sapiens
gctggaaggggcca

SEQ ID NO: 835518 - DNA, 13 bp, Homo sapiens
gctggaagggtca

SEQ ID NO: 835519 - DNA, 19 bp, Homo sapiens
gctggaagtctccatgaag

SEQ ID NO: 835520 - DNA, 16 bp, Homo sapiens
gctggaatgagggagg

SEQ ID NO: 835521 - DNA, 13 bp, Homo sapiens
gctggaattaaaa

SEQ ID NO: 835522 - DNA, 17 bp, Homo sapiens
gctggaattaaaacaaa

SEQ ID NO: 835523 - DNA, 22 bp, Homo sapiens
gctggacagcggcagtgggcct

SEQ ID NO: 835524 - DNA, 23 bp, Homo sapiens
gctggacagcggcagtgggcctg

SEQ ID NO: 835525 - DNA, 18 bp, Homo sapiens
gctggacatactgctgga

SEQ ID NO: 835526 - DNA, 23 bp, Homo sapiens
gctggacatgagatggagaggct

SEQ ID NO: 835527 - DNA, 16 bp, Homo sapiens
gctggaccatctctgt

SEQ ID NO: 835528 - DNA, 19 bp, Homo sapiens
gctggaccatctctgtagg

SEQ ID NO: 835529 - DNA, 16 bp, Homo sapiens
gctggacggcattcct

SEQ ID NO: 835530 - DNA, 19 bp, Homo sapiens
gctggacggggactgggga

SEQ ID NO: 835531 - DNA, 21 bp, Homo sapiens
gctggactctcagtctctgag

SEQ ID NO: 835532 - DNA, 22 bp, Homo sapiens
gctggactggaggtgggcatgc

SEQ ID NO: 835533 - DNA, 14 bp, Homo sapiens
gctggactggccat

SEQ ID NO: 835534 - DNA, 13 bp, Homo sapiens
gctggactgtaga

SEQ ID NO: 835535 - DNA, 17 bp, Homo sapiens
gctggactgttccaggc

SEQ ID NO: 835536 - DNA, 21 bp, Homo sapiens
gctggacttctacctgccctc

SEQ ID NO: 835537 - DNA, 19 bp, Homo sapiens
gctggactttaaaaaaaca

SEQ ID NO: 835538 - DNA, 12 bp, Homo sapiens
gctggagaggtt

SEQ ID NO: 835539 - DNA, 13 bp, Homo sapiens
gctggagaggtta

SEQ ID NO: 835540 - DNA, 21 bp, Homo sapiens
gctggagataacagcctcttg

SEQ ID NO: 835541 - DNA, 19 bp, Homo sapiens
gctggagatctgaacccag

SEQ ID NO: 835542 - DNA, 20 bp, Homo sapiens
gctggagatgaggccagacc

SEQ ID NO: 835543 - DNA, 12 bp, Homo sapiens
gctggagcagcg

SEQ ID NO: 835544 - DNA, 23 bp, Homo sapiens
gctggagcagcggattgctctgg

SEQ ID NO: 835545 - DNA, 14 bp, Homo sapiens
gctggagcccacag

SEQ ID NO: 835546 - DNA, 22 bp, Homo sapiens
gctggagcccacagcgagcctg

SEQ ID NO: 835547 - DNA, 18 bp, Homo sapiens
gctggagcccccagcaga

SEQ ID NO: 835548 - DNA, 13 bp, Homo sapiens
gctggagctcttg

SEQ ID NO: 835549 - DNA, 14 bp, Homo sapiens
gctggagctcttgg

SEQ ID NO: 835550 - DNA, 17 bp, Homo sapiens
gctggagctcttggaag

SEQ ID NO: 835551 - DNA, 19 bp, Homo sapiens
gctggaggaggggaagctg

SEQ ID NO: 835552 - DNA, 19 bp, Homo sapiens
gctggaggatgtgggcagc

SEQ ID NO: 835553 - DNA, 12 bp, Homo sapiens
gctggaggccca

SEQ ID NO: 835554 - DNA, 13 bp, Homo sapiens
gctggaggcccag

SEQ ID NO: 835555 - DNA, 12 bp, Homo sapiens
gctggaggcctc

SEQ ID NO: 835556 - DNA, 10 bp, Homo sapiens
gctggagggg

SEQ ID NO: 835557 - DNA, 16 bp, Homo sapiens
gctggaggtaaggcct

SEQ ID NO: 835558 - DNA, 14 bp, Homo sapiens
gctggaggtgctgg

SEQ ID NO: 835559 - DNA, 15 bp, Homo sapiens
gctggagtaatcaga

SEQ ID NO: 835560 - DNA, 13 bp, Homo sapiens
gctggagtccagt

SEQ ID NO: 835561 - DNA, 22 bp, Homo sapiens
gctggagtcctctccagagagg

SEQ ID NO: 835562 - DNA, 18 bp, Homo sapiens
gctggagtgagggcctca

SEQ ID NO: 835563 - DNA, 21 bp, Homo sapiens
gctggagtgagggcctcagag

SEQ ID NO: 835564 - DNA, 12 bp, Homo sapiens
gctggagtgcag

SEQ ID NO: 835565 - DNA, 19 bp, Homo sapiens
gctggagtgcagtggcaca

SEQ ID NO: 835566 - DNA, 18 bp, Homo sapiens
gctggagtgcagtggtgc

SEQ ID NO: 835567 - DNA, 14 bp, Homo sapiens
gctggataaaatga

SEQ ID NO: 835568 - DNA, 17 bp, Homo sapiens
gctggatactggacaca

SEQ ID NO: 835569 - DNA, 23 bp, Homo sapiens
gctggatcacagctgctttctgt

SEQ ID NO: 835570 - DNA, 12 bp, Homo sapiens
gctggatggaca

SEQ ID NO: 835571 - DNA, 18 bp, Homo sapiens
gctggatggacagacacc

SEQ ID NO: 835572 - DNA, 19 bp, Homo sapiens
gctggatggacagacacct

SEQ ID NO: 835573 - DNA, 20 bp, Homo sapiens
gctggatggacagacacctc

SEQ ID NO: 835574 - DNA, 14 bp, Homo sapiens
gctggatgggactc

SEQ ID NO: 835575 - DNA, 22 bp, Homo sapiens
gctggcaaaccctcccagaaac

SEQ ID NO: 835576 - DNA, 14 bp, Homo sapiens
gctggcaacacaga

SEQ ID NO: 835577 - DNA, 21 bp, Homo sapiens
gctggcaacacagaggcagcc

SEQ ID NO: 835578 - DNA, 18 bp, Homo sapiens
gctggcaagataaacact

SEQ ID NO: 835579 - DNA, 14 bp, Homo sapiens
gctggcaagcaggg

SEQ ID NO: 835580 - DNA, 21 bp, Homo sapiens
gctggcacccaccgtggagga

SEQ ID NO: 835581 - DNA, 20 bp, Homo sapiens
gctggcacgtgacaggctcg

SEQ ID NO: 835582 - DNA, 13 bp, Homo sapiens
gctggcagctctc

SEQ ID NO: 835583 - DNA, 15 bp, Homo sapiens
gctggcagctctcca

SEQ ID NO: 835584 - DNA, 23 bp, Homo sapiens
gctggcagctctccagtcaggag

SEQ ID NO: 835585 - DNA, 19 bp, Homo sapiens
gctggcagctgagagccct

SEQ ID NO: 835586 - DNA, 13 bp, Homo sapiens
gctggcagggcca

SEQ ID NO: 835587 - DNA, 14 bp, Homo sapiens
gctggcagggccag

SEQ ID NO: 835588 - DNA, 22 bp, Homo sapiens
gctggcagggccagggcaatgc

SEQ ID NO: 835589 - DNA, 17 bp, Homo sapiens
gctggcagtcctggaag

SEQ ID NO: 835590 - DNA, 23 bp, Homo sapiens
gctggcatcaggtctgggcaagt

SEQ ID NO: 835591 - DNA, 14 bp, Homo sapiens
gctggcatgcagtg

SEQ ID NO: 835592 - DNA, 16 bp, Homo sapiens
gctggcatttgcacct

SEQ ID NO: 835593 - DNA, 19 bp, Homo sapiens
gctggccaaatagcaaaga

SEQ ID NO: 835594 - DNA, 21 bp, Homo sapiens
gctggccagcaccctctcctg

SEQ ID NO: 835595 - DNA, 16 bp, Homo sapiens
gctggcccagccggcc

SEQ ID NO: 835596 - DNA, 19 bp, Homo sapiens
gctggcccagccggcctct

SEQ ID NO: 835597 - DNA, 14 bp, Homo sapiens
gctggccccagccc

SEQ ID NO: 835598 - DNA, 16 bp, Homo sapiens
gctggccccagccctg

SEQ ID NO: 835599 - DNA, 22 bp, Homo sapiens
gctggccccagccctgctgggg

SEQ ID NO: 835600 - DNA, 18 bp, Homo sapiens
gctggcccccagccctgg

SEQ ID NO: 835601 - DNA, 22 bp, Homo sapiens
gctggccccgccgcctggtact

SEQ ID NO: 835602 - DNA, 20 bp, Homo sapiens
gctggcccctcacctgggca

SEQ ID NO: 835603 - DNA, 22 bp, Homo sapiens
gctggcccgtgacagactcctg

SEQ ID NO: 835604 - DNA, 19 bp, Homo sapiens
gctggccctggctcccaca

SEQ ID NO: 835605 - DNA, 13 bp, Homo sapiens
gctggccctgtgc

SEQ ID NO: 835606 - DNA, 14 bp, Homo sapiens
gctggccctgtgca

SEQ ID NO: 835607 - DNA, 19 bp, Homo sapiens
gctggccctgtgcagacct

SEQ ID NO: 835608 - DNA, 20 bp, Homo sapiens
gctggccgagggtcctggct

SEQ ID NO: 835609 - DNA, 20 bp, Homo sapiens
gctggcctaatcactctgag

SEQ ID NO: 835610 - DNA, 21 bp, Homo sapiens
gctggcctcacccacccctgc

SEQ ID NO: 835611 - DNA, 21 bp, Homo sapiens
gctggcctcccaaatgagcca

SEQ ID NO: 835612 - DNA, 12 bp, Homo sapiens
gctggcctgagc

SEQ ID NO: 835613 - DNA, 17 bp, Homo sapiens
gctggcctggccggcaa

SEQ ID NO: 835614 - DNA, 19 bp, Homo sapiens
gctggccttcctgccctac

SEQ ID NO: 835615 - DNA, 21 bp, Homo sapiens
gctggcctttgtaagtgcagg

SEQ ID NO: 835616 - DNA, 12 bp, Homo sapiens
gctggcgacact

SEQ ID NO: 835617 - DNA, 20 bp, Homo sapiens
gctggcgacactcagggcag

SEQ ID NO: 835618 - DNA, 14 bp, Homo sapiens
gctggcgcagccaa

SEQ ID NO: 835619 - DNA, 16 bp, Homo sapiens
gctggcggcgcagagg

SEQ ID NO: 835620 - DNA, 17 bp, Homo sapiens
gctggcggcgcagaggg

SEQ ID NO: 835621 - DNA, 17 bp, Homo sapiens
gctggctagcattcctc

SEQ ID NO: 835622 - DNA, 20 bp, Homo sapiens
gctggctatctactaccaga

SEQ ID NO: 835623 - DNA, 17 bp, Homo sapiens
gctggctcacgccccgc

SEQ ID NO: 835624 - DNA, 18 bp, Homo sapiens
gctggctcacgccccgct

SEQ ID NO: 835625 - DNA, 23 bp, Homo sapiens
gctggctcacgccccgctgtgtc

SEQ ID NO: 835626 - DNA, 21 bp, Homo sapiens
gctggctcacgcgttctggga

SEQ ID NO: 835627 - DNA, 14 bp, Homo sapiens
gctggctccagatg

SEQ ID NO: 835628 - DNA, 22 bp, Homo sapiens
gctggctccagatgcagggcag

SEQ ID NO: 835629 - DNA, 13 bp, Homo sapiens
gctgtccctcact

SEQ ID NO: 835630 - DNA, 15 bp, Homo sapiens
gctgtccctccccct

SEQ ID NO: 835631 - DNA, 20 bp, Homo sapiens
gctgtccctgcactgtgccc

SEQ ID NO: 835632 - DNA, 22 bp, Homo sapiens
gctgtccctgcactgtgccccg

SEQ ID NO: 835633 - DNA, 15 bp, Homo sapiens
gctgtccctgtcacc

SEQ ID NO: 835634 - DNA, 16 bp, Homo sapiens
gctgtccctgtcagga

SEQ ID NO: 835635 - DNA, 14 bp, Homo sapiens
gctgtcctctcccc

SEQ ID NO: 835636 - DNA, 15 bp, Homo sapiens
gctgtcctctccccc

SEQ ID NO: 835637 - DNA, 21 bp, Homo sapiens
gctgtcctctcccccttcagc

SEQ ID NO: 835638 - DNA, 17 bp, Homo sapiens
gctgtcctctcgagccc

SEQ ID NO: 835639 - DNA, 22 bp, Homo sapiens
gctgtcctgcgttcagcccctg

SEQ ID NO: 835640 - DNA, 15 bp, Homo sapiens
gctgtcctggagggg

SEQ ID NO: 835641 - DNA, 21 bp, Homo sapiens
gctgtccttagactccttctc

SEQ ID NO: 835642 - DNA, 18 bp, Homo sapiens
gctgtccttccccttccc

SEQ ID NO: 835643 - DNA, 23 bp, Homo sapiens
gctgtcgccccaggccctccctg

SEQ ID NO: 835644 - DNA, 14 bp, Homo sapiens
gctgtcgggaccac

SEQ ID NO: 835645 - DNA, 22 bp, Homo sapiens
gctgtcgggaccacatctgtcc

SEQ ID NO: 835646 - DNA, 19 bp, Homo sapiens
gctgtctaaaatgcagtgg

SEQ ID NO: 835647 - DNA, 21 bp, Homo sapiens
gctgtctacagtagctgctac

SEQ ID NO: 835648 - DNA, 22 bp, Homo sapiens
gctgtctccatgctggatactg

SEQ ID NO: 835649 - DNA, 14 bp, Homo sapiens
gctgtctgcacaga

SEQ ID NO: 835650 - DNA, 18 bp, Homo sapiens
gctgtctgcacagagggt

SEQ ID NO: 835651 - DNA, 15 bp, Homo sapiens
gctgtctgcctgtat

SEQ ID NO: 835652 - DNA, 17 bp, Homo sapiens
gctgtctggccaggcct

SEQ ID NO: 835653 - DNA, 14 bp, Homo sapiens
gctgtctggggcct

SEQ ID NO: 835654 - DNA, 18 bp, Homo sapiens
gctgtctggtgaggtggc

SEQ ID NO: 835655 - DNA, 12 bp, Homo sapiens
gctgtctgtcac

SEQ ID NO: 835656 - DNA, 12 bp, Homo sapiens
gctgtctgtgaa

SEQ ID NO: 835657 - DNA, 14 bp, Homo sapiens
gctgtctgtgccat

SEQ ID NO: 835658 - DNA, 22 bp, Homo sapiens
gctgtctgtgccatggcccccc

SEQ ID NO: 835659 - DNA, 16 bp, Homo sapiens
gctgtctgtgggccgc

SEQ ID NO: 835660 - DNA, 23 bp, Homo sapiens
gctgtctgttgtattcattgtgg

SEQ ID NO: 835661 - DNA, 17 bp, Homo sapiens
gctgtcttcccctgaga

SEQ ID NO: 835662 - DNA, 17 bp, Homo sapiens
gctgtcttgccccagtt

SEQ ID NO: 835663 - DNA, 23 bp, Homo sapiens
gctgtcttgttgcggatggatgg

SEQ ID NO: 835664 - DNA, 13 bp, Homo sapiens
gctgtgaaaaaaa

SEQ ID NO: 835665 - DNA, 12 bp, Homo sapiens
gctgtgaaatcc

SEQ ID NO: 835666 - DNA, 16 bp, Homo sapiens
gctgtgaaatggagaa

SEQ ID NO: 835667 - DNA, 19 bp, Homo sapiens
gctgtgaaccctggggcct

SEQ ID NO: 835668 - DNA, 18 bp, Homo sapiens
gctgtgaagacccaggag

SEQ ID NO: 835669 - DNA, 12 bp, Homo sapiens
gctgtgaatctg

SEQ ID NO: 835670 - DNA, 14 bp, Homo sapiens
gctgtgaatttttt

SEQ ID NO: 835671 - DNA, 15 bp, Homo sapiens
gctgtgacaaccctg

SEQ ID NO: 835672 - DNA, 18 bp, Homo sapiens
gctgtgacaataagtttg

SEQ ID NO: 835673 - DNA, 13 bp, Homo sapiens
gctgtgacatcta

SEQ ID NO: 835674 - DNA, 16 bp, Homo sapiens
gctgtgacattgctgg

SEQ ID NO: 835675 - DNA, 19 bp, Homo sapiens
gctgtgacattgctggtca

SEQ ID NO: 835676 - DNA, 18 bp, Homo sapiens
gctgtgacgcagccggag

SEQ ID NO: 835677 - DNA, 18 bp, Homo sapiens
gctgtgactctgggcagg

SEQ ID NO: 835678 - DNA, 21 bp, Homo sapiens
gctgtgactctgggcagggac

SEQ ID NO: 835679 - DNA, 18 bp, Homo sapiens
gctgtgagacagtgggaa

SEQ ID NO: 835680 - DNA, 17 bp, Homo sapiens
gctgtgagccatgcctc

SEQ ID NO: 835681 - DNA, 15 bp, Homo sapiens
gctgtgagcccctgg

SEQ ID NO: 835682 - DNA, 20 bp, Homo sapiens
gctgtgagcccctggtcctg

SEQ ID NO: 835683 - DNA, 18 bp, Homo sapiens
gctgtgaggcccctggac

SEQ ID NO: 835684 - DNA, 15 bp, Homo sapiens
gctgtgaggctgtcc

SEQ ID NO: 835685 - DNA, 16 bp, Homo sapiens
gctgtgaggctgtcct

SEQ ID NO: 835686 - DNA, 13 bp, Homo sapiens
gctgtgagggagg

SEQ ID NO: 835687 - DNA, 14 bp, Homo sapiens
gctgtgagggaggg

SEQ ID NO: 835688 - DNA, 18 bp, Homo sapiens
gctgtgagttctccctgt

SEQ ID NO: 835689 - DNA, 20 bp, Homo sapiens
gctgtgatacgatgcttcaa

SEQ ID NO: 835690 - DNA, 21 bp, Homo sapiens
gctgtgatgccgtcctgctgg

SEQ ID NO: 835691 - DNA, 20 bp, Homo sapiens
gctgtgatggcgggcactgg

SEQ ID NO: 835692 - DNA, 15 bp, Homo sapiens
gctgtgccacaggct

SEQ ID NO: 835693 - DNA, 14 bp, Homo sapiens
gctgtgccaggagg

SEQ ID NO: 835694 - DNA, 15 bp, Homo sapiens
gctgtgccaggaggc

SEQ ID NO: 835695 - DNA, 17 bp, Homo sapiens
gctgtgccatgctgggc

SEQ ID NO: 835696 - DNA, 13 bp, Homo sapiens
gctgtgcccagca

SEQ ID NO: 835697 - DNA, 16 bp, Homo sapiens
gctgtgcccagcaggc

SEQ ID NO: 835698 - DNA, 22 bp, Homo sapiens
gctgtgcccagcctccatgttt

SEQ ID NO: 835699 - DNA, 19 bp, Homo sapiens
gctgtgcctcgcatcctat

SEQ ID NO: 835700 - DNA, 20 bp, Homo sapiens
gctgtgcctgctcagcagcc

SEQ ID NO: 835701 - DNA, 21 bp, Homo sapiens
gctgtgcctgctcagcagcca

SEQ ID NO: 835702 - DNA, 23 bp, Homo sapiens
gctgtgcctgctcagcagccagt

SEQ ID NO: 835703 - DNA, 15 bp, Homo sapiens
gctgtgcctgcttct

SEQ ID NO: 835704 - DNA, 18 bp, Homo sapiens
gctgtgcgcccagggctg

SEQ ID NO: 835705 - DNA, 14 bp, Homo sapiens
gctgtgctatgaat

SEQ ID NO: 835706 - DNA, 17 bp, Homo sapiens
gctgtgctgccctgaag

SEQ ID NO: 835707 - DNA, 19 bp, Homo sapiens
gctgtgctgccctgaagaa

SEQ ID NO: 835708 - DNA, 13 bp, Homo sapiens
gctgtgctgtgga

SEQ ID NO: 835709 - DNA, 18 bp, Homo sapiens
gctgtgcttgaaggccct

SEQ ID NO: 835710 - DNA, 16 bp, Homo sapiens
gctgtggactgtcctg

SEQ ID NO: 835711 - DNA, 19 bp, Homo sapiens
gctgtggactgtcctgagg

SEQ ID NO: 835712 - DNA, 20 bp, Homo sapiens
gctgtggactgtcctgagga

SEQ ID NO: 835713 - DNA, 12 bp, Homo sapiens
gctgtggaggcc

SEQ ID NO: 835714 - DNA, 21 bp, Homo sapiens
gctgtggcagccgtcccaggc

SEQ ID NO: 835715 - DNA, 19 bp, Homo sapiens
gctgtggccagggtgagag

SEQ ID NO: 835716 - DNA, 22 bp, Homo sapiens
gctgtggccagggtgagagctg

SEQ ID NO: 835717 - DNA, 16 bp, Homo sapiens
gctgtggccctgccct

SEQ ID NO: 835718 - DNA, 18 bp, Homo sapiens
gctgtggccctgcccttg

SEQ ID NO: 835719 - DNA, 21 bp, Homo sapiens
gctgtggccgcacgcctctcc

SEQ ID NO: 835720 - DNA, 14 bp, Homo sapiens
gctgtgggcagcac

SEQ ID NO: 835721 - DNA, 15 bp, Homo sapiens
gctgtgggcagcacc

SEQ ID NO: 835722 - DNA, 16 bp, Homo sapiens
gctgtgggcagcaccc

SEQ ID NO: 835723 - DNA, 16 bp, Homo sapiens
gctgtggggctacagg

SEQ ID NO: 835724 - DNA, 19 bp, Homo sapiens
gctgtggggtatacagcat

SEQ ID NO: 835725 - DNA, 13 bp, Homo sapiens
gctgtggggtggg

SEQ ID NO: 835726 - DNA, 16 bp, Homo sapiens
gctgtggtcagcagat

SEQ ID NO: 835727 - DNA, 21 bp, Homo sapiens
gctgtggtctataaaataaac

SEQ ID NO: 835728 - DNA, 20 bp, Homo sapiens
gctgtggttcctaagcctgt

SEQ ID NO: 835729 - DNA, 18 bp, Homo sapiens
gctgtgtaagatttgttt

SEQ ID NO: 835730 - DNA, 18 bp, Homo sapiens
gctgtgtcctccctccct

SEQ ID NO: 835731 - DNA, 15 bp, Homo sapiens
gctgtgtccttcctc

SEQ ID NO: 835732 - DNA, 19 bp, Homo sapiens
gctgtgtccttgcacctgc

SEQ ID NO: 835733 - DNA, 20 bp, Homo sapiens
gctgtgtccttgcacctgca

SEQ ID NO: 835734 - DNA, 23 bp, Homo sapiens
gctgtgtccttgcacctgcatcc

SEQ ID NO: 835735 - DNA, 13 bp, Homo sapiens
gctgtgtctctgc

SEQ ID NO: 835736 - DNA, 15 bp, Homo sapiens
gctgtgtctctgcca

SEQ ID NO: 835737 - DNA, 14 bp, Homo sapiens
gctgtgtctgccaa

SEQ ID NO: 835738 - DNA, 20 bp, Homo sapiens
gctgtgtctgccaaacacat

SEQ ID NO: 835739 - DNA, 21 bp, Homo sapiens
gctgtgtctgccaaacacatt

SEQ ID NO: 835740 - DNA, 18 bp, Homo sapiens
gctgtgtgaatacctgct

SEQ ID NO: 835741 - DNA, 20 bp, Homo sapiens
gctgtgtgacagaatcttgt

SEQ ID NO: 835742 - DNA, 14 bp, Homo sapiens
gctgtgtgattaga

SEQ ID NO: 835743 - DNA, 21 bp, Homo sapiens
gctgtgtgcccaagtgggcag

SEQ ID NO: 835744 - DNA, 13 bp, Homo sapiens
gctgtgtggccaa

SEQ ID NO: 835745 - DNA, 13 bp, Homo sapiens
gctgtgtgtctgt

SEQ ID NO: 835746 - DNA, 22 bp, Homo sapiens
gctgtgtgttagttcccaacat

SEQ ID NO: 835747 - DNA, 20 bp, Homo sapiens
gctgtgttcgggggagcaga

SEQ ID NO: 835748 - DNA, 16 bp, Homo sapiens
gctgtgttgactgctg

SEQ ID NO: 835749 - DNA, 19 bp, Homo sapiens
gctgtgttgactgctgctc

SEQ ID NO: 835750 - DNA, 17 bp, Homo sapiens
gctgtgtttgcagcctg

SEQ ID NO: 835751 - DNA, 15 bp, Homo sapiens
gcttatatctggcct

SEQ ID NO: 835752 - DNA, 16 bp, Homo sapiens
gcttatgaatatttat

SEQ ID NO: 835753 - DNA, 18 bp, Homo sapiens
gcttatgagatactttgc

SEQ ID NO: 835754 - DNA, 22 bp, Homo sapiens
gcttatgagatctaatgtgaaa

SEQ ID NO: 835755 - DNA, 23 bp, Homo sapiens
gcttatgatagcaaatggcctca

SEQ ID NO: 835756 - DNA, 16 bp, Homo sapiens
gcttatgcttgtgtat

SEQ ID NO: 835757 - DNA, 16 bp, Homo sapiens
gcttatgggtggcttt

SEQ ID NO: 835758 - DNA, 21 bp, Homo sapiens
gcttatgtagctttttattat

SEQ ID NO: 835759 - DNA, 20 bp, Homo sapiens
gcttattcatctgtttttct

SEQ ID NO: 835760 - DNA, 16 bp, Homo sapiens
gcttattgatcccaca

SEQ ID NO: 835761 - DNA, 14 bp, Homo sapiens
gcttattggccact

SEQ ID NO: 835762 - DNA, 14 bp, Homo sapiens
gcttattgttccaa

SEQ ID NO: 835763 - DNA, 22 bp, Homo sapiens
gcttattgttccaagacattgt

SEQ ID NO: 835764 - DNA, 17 bp, Homo sapiens
gcttatttaatatgctt

SEQ ID NO: 835765 - DNA, 16 bp, Homo sapiens
gcttatttttataatt

SEQ ID NO: 835766 - DNA, 18 bp, Homo sapiens
gcttatttttataattaa

SEQ ID NO: 835767 - DNA, 23 bp, Homo sapiens
gcttatttttataattaaagatg

SEQ ID NO: 835768 - DNA, 18 bp, Homo sapiens
gcttatttttctgacttc

SEQ ID NO: 835769 - DNA, 19 bp, Homo sapiens
gcttcaaagattatctgat

SEQ ID NO: 835770 - DNA, 17 bp, Homo sapiens
gcttcaaattatagaaa

SEQ ID NO: 835771 - DNA, 23 bp, Homo sapiens
gcttcaaattcaaggccttccaa

SEQ ID NO: 835772 - DNA, 21 bp, Homo sapiens
gcttcaaattggtctgaaagg

SEQ ID NO: 835773 - DNA, 16 bp, Homo sapiens
gcttcaataaatcttt

SEQ ID NO: 835774 - DNA, 19 bp, Homo sapiens
gcttcaatataagaagcaa

SEQ ID NO: 835775 - DNA, 15 bp, Homo sapiens
gcttcaattaaaatt

SEQ ID NO: 835776 - DNA, 19 bp, Homo sapiens
gcttcacatagcatgtcaa

SEQ ID NO: 835777 - DNA, 17 bp, Homo sapiens
gcttcaccagtctgtct

SEQ ID NO: 835778 - DNA, 23 bp, Homo sapiens
gcttcaccagtctgtctactgtg

SEQ ID NO: 835779 - DNA, 19 bp, Homo sapiens
gcttcaccccaatcccagc

SEQ ID NO: 835780 - DNA, 20 bp, Homo sapiens
gcttcaccccaatcccagct

SEQ ID NO: 835781 - DNA, 17 bp, Homo sapiens
gcttcacccctgcactt

SEQ ID NO: 835782 - DNA, 19 bp, Homo sapiens
gcttcacggaagagccttg

SEQ ID NO: 835783 - DNA, 20 bp, Homo sapiens
gcttcacggaagagccttgc

SEQ ID NO: 835784 - DNA, 22 bp, Homo sapiens
gcttcactcatgcaaactgctt

SEQ ID NO: 835785 - DNA, 18 bp, Homo sapiens
gcttcactctctccgtct

SEQ ID NO: 835786 - DNA, 18 bp, Homo sapiens
gcttcagcccccaccagg

SEQ ID NO: 835787 - DNA, 12 bp, Homo sapiens
gcttcagccctg

SEQ ID NO: 835788 - DNA, 21 bp, Homo sapiens
gcttcagcctgaggctgagac

SEQ ID NO: 835789 - DNA, 23 bp, Homo sapiens
gcttcagcctgaggctgagactg

SEQ ID NO: 835790 - DNA, 24 bp, Homo sapiens
gcttcagctcaactcacagcttct

SEQ ID NO: 835791 - DNA, 12 bp, Homo sapiens
gcttcagttgtt

SEQ ID NO: 835792 - DNA, 17 bp, Homo sapiens
gcttcagttgttcttta

SEQ ID NO: 835793 - DNA, 22 bp, Homo sapiens
gcttcataaatgaagcagcttt

SEQ ID NO: 835794 - DNA, 17 bp, Homo sapiens
gcttcatagtattggag

SEQ ID NO: 835795 - DNA, 17 bp, Homo sapiens
gcttcatcattccctct

SEQ ID NO: 835796 - DNA, 19 bp, Homo sapiens
gcttcatcattccctctca

SEQ ID NO: 835797 - DNA, 19 bp, Homo sapiens
gcttcatctcatgaggatt

SEQ ID NO: 835798 - DNA, 16 bp, Homo sapiens
gcttcatctccttttg

SEQ ID NO: 835799 - DNA, 16 bp, Homo sapiens
gcttcatctgcaaagg

SEQ ID NO: 835800 - DNA, 19 bp, Homo sapiens
gcttcatgcacttaaagaa

SEQ ID NO: 835801 - DNA, 17 bp, Homo sapiens
gcttcatgcctttgtaa

SEQ ID NO: 835802 - DNA, 17 bp, Homo sapiens
gcttcatggcagaaggc

SEQ ID NO: 835803 - DNA, 14 bp, Homo sapiens
gcttcatgtgaaca

SEQ ID NO: 835804 - DNA, 17 bp, Homo sapiens
gcttcattatctgagtt

SEQ ID NO: 835805 - DNA, 17 bp, Homo sapiens
gcttcattcaatattga

SEQ ID NO: 835806 - DNA, 18 bp, Homo sapiens
gcttcattcaatattgac

SEQ ID NO: 835807 - DNA, 18 bp, Homo sapiens
gcttcattctggaaactt

SEQ ID NO: 835808 - DNA, 23 bp, Homo sapiens
gcttcattctggaaacttttgtt

SEQ ID NO: 835809 - DNA, 17 bp, Homo sapiens
gcttcattctttgcagg

SEQ ID NO: 835810 - DNA, 13 bp, Homo sapiens
gcttcatttcaat

SEQ ID NO: 835811 - DNA, 15 bp, Homo sapiens
gcttcattttggagc

SEQ ID NO: 835812 - DNA, 12 bp, Homo sapiens
gcttccaaagcc

SEQ ID NO: 835813 - DNA, 19 bp, Homo sapiens
gcttccaaagcctagacaa

SEQ ID NO: 835814 - DNA, 12 bp, Homo sapiens
gcttccaatttt

SEQ ID NO: 835815 - DNA, 21 bp, Homo sapiens
gcttccacaggcaaaactcag

SEQ ID NO: 835816 - DNA, 19 bp, Homo sapiens
gcttccagaaaaccccagc

SEQ ID NO: 835817 - DNA, 13 bp, Homo sapiens
gcttccagagagt

SEQ ID NO: 835818 - DNA, 22 bp, Homo sapiens
gcttccagattgacgacaagtg

SEQ ID NO: 835819 - DNA, 23 bp, Homo sapiens
gcttccagattgacgacaagtgc

SEQ ID NO: 835820 - DNA, 19 bp, Homo sapiens
gcttccaggataaggagac

SEQ ID NO: 835821 - DNA, 17 bp, Homo sapiens
gcttccatgagaacagc

SEQ ID NO: 835822 - DNA, 15 bp, Homo sapiens
gcttccatgattcta

SEQ ID NO: 835823 - DNA, 15 bp, Homo sapiens
gcttccatggcttcc

SEQ ID NO: 835824 - DNA, 19 bp, Homo sapiens
gcttccatggcttcctgag

SEQ ID NO: 835825 - DNA, 17 bp, Homo sapiens
gcttccatttgtgtgtg

SEQ ID NO: 835826 - DNA, 17 bp, Homo sapiens
gcttcccatcctaccct

SEQ ID NO: 835827 - DNA, 22 bp, Homo sapiens
gcttcccatcctaccctcgggc

SEQ ID NO: 835828 - DNA, 16 bp, Homo sapiens
gcttccccatcagctc

SEQ ID NO: 835829 - DNA, 17 bp, Homo sapiens
gcttccccatcagctcc

SEQ ID NO: 835830 - DNA, 14 bp, Homo sapiens
gcttcccccttgat

SEQ ID NO: 835831 - DNA, 18 bp, Homo sapiens
gcttccccttttgccaat

SEQ ID NO: 835832 - DNA, 23 bp, Homo sapiens
gcttcccgctcagccctccctgc

SEQ ID NO: 835833 - DNA, 14 bp, Homo sapiens
gcttccctaatcta

SEQ ID NO: 835834 - DNA, 17 bp, Homo sapiens
gcttccctccatccccc

SEQ ID NO: 835835 - DNA, 18 bp, Homo sapiens
gcttccctctcagctgct

SEQ ID NO: 835836 - DNA, 17 bp, Homo sapiens
gcttccctctgcctgtc

SEQ ID NO: 835837 - DNA, 18 bp, Homo sapiens
gcttccctgactcattct

SEQ ID NO: 835838 - DNA, 17 bp, Homo sapiens
gcttccctgacttgctt

SEQ ID NO: 835839 - DNA, 18 bp, Homo sapiens
gcttccctgacttgcttt

SEQ ID NO: 835840 - DNA, 19 bp, Homo sapiens
gcttccctgacttgcttta

SEQ ID NO: 835841 - DNA, 16 bp, Homo sapiens
gcttccgagacaccac

SEQ ID NO: 835842 - DNA, 23 bp, Homo sapiens
gcttccgagatccccagggcagc

SEQ ID NO: 835843 - DNA, 15 bp, Homo sapiens
gcttccgccactcag

SEQ ID NO: 835844 - DNA, 22 bp, Homo sapiens
gcttccgggaaaacagctatta

SEQ ID NO: 835845 - DNA, 17 bp, Homo sapiens
gcttcctcacacccctg

SEQ ID NO: 835846 - DNA, 18 bp, Homo sapiens
gcttcctcacacccctgt

SEQ ID NO: 835847 - DNA, 15 bp, Homo sapiens
gcttcctcagcctcc

SEQ ID NO: 835848 - DNA, 17 bp, Homo sapiens
gcttcctcagcctccaa

SEQ ID NO: 835849 - DNA, 14 bp, Homo sapiens
gcttcctccagagg

SEQ ID NO: 835850 - DNA, 17 bp, Homo sapiens
gcttcctccagaggagg

SEQ ID NO: 835851 - DNA, 14 bp, Homo sapiens
gcttcctcccaaca

SEQ ID NO: 835852 - DNA, 20 bp, Homo sapiens
gcttcctccgtccacccagg

SEQ ID NO: 835853 - DNA, 21 bp, Homo sapiens
gcttcctccgtccacccaggc

SEQ ID NO: 835854 - DNA, 22 bp, Homo sapiens
gcttcctccgtccacccaggct

SEQ ID NO: 835855 - DNA, 12 bp, Homo sapiens
gcttcctcctgg

SEQ ID NO: 835856 - DNA, 13 bp, Homo sapiens
gcttcctcctgga

SEQ ID NO: 835857 - DNA, 21 bp, Homo sapiens
gcttcctcttccgggcagaaa

SEQ ID NO: 835858 - DNA, 22 bp, Homo sapiens
gcttcctgagaaagcccacctg

SEQ ID NO: 835859 - DNA, 23 bp, Homo sapiens
gcttcctgagaaagcccacctgg

SEQ ID NO: 835860 - DNA, 13 bp, Homo sapiens
gcttcctgagggc

SEQ ID NO: 835861 - DNA, 15 bp, Homo sapiens
gcttcctgagggcta

SEQ ID NO: 835862 - DNA, 21 bp, Homo sapiens
gcttcctgcccttccctctgg

SEQ ID NO: 835863 - DNA, 13 bp, Homo sapiens
gcttcctggctct

SEQ ID NO: 835864 - DNA, 14 bp, Homo sapiens
gcttcctggctctg

SEQ ID NO: 835865 - DNA, 16 bp, Homo sapiens
gcttcctggctctggg

SEQ ID NO: 835866 - DNA, 19 bp, Homo sapiens
gcttcctggctctggggga

SEQ ID NO: 835867 - DNA, 11 bp, Homo sapiens
gcttcctgggt

SEQ ID NO: 835868 - DNA, 13 bp, Homo sapiens
gcttcctgtgccc

SEQ ID NO: 835869 - DNA, 20 bp, Homo sapiens
gcttcctgtgccctcacccc

SEQ ID NO: 835870 - DNA, 22 bp, Homo sapiens
gcttccttagaacttctacaga

SEQ ID NO: 835871 - DNA, 15 bp, Homo sapiens
gcttccttctgggac

SEQ ID NO: 835872 - DNA, 23 bp, Homo sapiens
gctttcatgaccactgggcctgc

SEQ ID NO: 835873 - DNA, 15 bp, Homo sapiens
gctttcatgtaaact

SEQ ID NO: 835874 - DNA, 23 bp, Homo sapiens
gctttccatgggcccgctgcctc

SEQ ID NO: 835875 - DNA, 16 bp, Homo sapiens
gctttccatgttgctg

SEQ ID NO: 835876 - DNA, 19 bp, Homo sapiens
gctttccatgttgctgcca

SEQ ID NO: 835877 - DNA, 21 bp, Homo sapiens
gctttccatgttgctgccaac

SEQ ID NO: 835878 - DNA, 22 bp, Homo sapiens
gctttccccgggggaggaaggg

SEQ ID NO: 835879 - DNA, 13 bp, Homo sapiens
gctttccctgagg

SEQ ID NO: 835880 - DNA, 18 bp, Homo sapiens
gctttccctgaggaatga

SEQ ID NO: 835881 - DNA, 16 bp, Homo sapiens
gctttcccttatcaaa

SEQ ID NO: 835882 - DNA, 14 bp, Homo sapiens
gctttcctatctag

SEQ ID NO: 835883 - DNA, 18 bp, Homo sapiens
gctttcctatctagcatt

SEQ ID NO: 835884 - DNA, 14 bp, Homo sapiens
gctttcctgcccca

SEQ ID NO: 835885 - DNA, 13 bp, Homo sapiens
gctttctcaatgt

SEQ ID NO: 835886 - DNA, 12 bp, Homo sapiens
gctttctcaggg

SEQ ID NO: 835887 - DNA, 23 bp, Homo sapiens
gctttctccggggtctgtgctgt

SEQ ID NO: 835888 - DNA, 21 bp, Homo sapiens
gctttctcctcatccatttct

SEQ ID NO: 835889 - DNA, 15 bp, Homo sapiens
gctttctcctgtgcc

SEQ ID NO: 835890 - DNA, 17 bp, Homo sapiens
gctttctctgcctctgg

SEQ ID NO: 835891 - DNA, 19 bp, Homo sapiens
gctttctctgcctctgggc

SEQ ID NO: 835892 - DNA, 17 bp, Homo sapiens
gctttctgccttagcct

SEQ ID NO: 835893 - DNA, 19 bp, Homo sapiens
gctttctgctcagcttctc

SEQ ID NO: 835894 - DNA, 19 bp, Homo sapiens
gctttctgggatgtcacag

SEQ ID NO: 835895 - DNA, 14 bp, Homo sapiens
gctttctggggcct

SEQ ID NO: 835896 - DNA, 16 bp, Homo sapiens
gctttctgttccaaat

SEQ ID NO: 835897 - DNA, 15 bp, Homo sapiens
gctttctgttgtcat

SEQ ID NO: 835898 - DNA, 22 bp, Homo sapiens
gctttctgtttcttaagggcac

SEQ ID NO: 835899 - DNA, 12 bp, Homo sapiens
gctttcttgctg

SEQ ID NO: 835900 - DNA, 17 bp, Homo sapiens
gctttcttgctggttgt

SEQ ID NO: 835901 - DNA, 21 bp, Homo sapiens
gctttcttgtcttttcagaag

SEQ ID NO: 835902 - DNA, 13 bp, Homo sapiens
gctttctttagaa

SEQ ID NO: 835903 - DNA, 23 bp, Homo sapiens
gctttctttagaatttttaccca

SEQ ID NO: 835904 - DNA, 22 bp, Homo sapiens
gctttctttccgtcaccctggg

SEQ ID NO: 835905 - DNA, 20 bp, Homo sapiens
gctttctttcgtttgtttgt

SEQ ID NO: 835906 - DNA, 16 bp, Homo sapiens
gctttgaaacctcagg

SEQ ID NO: 835907 - DNA, 16 bp, Homo sapiens
gctttgaactttagtt

SEQ ID NO: 835908 - DNA, 16 bp, Homo sapiens
gctttgaataaatgtg

SEQ ID NO: 835909 - DNA, 19 bp, Homo sapiens
gctttgaggctctgtcact

SEQ ID NO: 835910 - DNA, 22 bp, Homo sapiens
gctttgaggttgacctgtttct

SEQ ID NO: 835911 - DNA, 20 bp, Homo sapiens
gctttgattcatagtaactt

SEQ ID NO: 835912 - DNA, 19 bp, Homo sapiens
gctttgatttttgaagttg

SEQ ID NO: 835913 - DNA, 18 bp, Homo sapiens
gctttgcaaaatgagact

SEQ ID NO: 835914 - DNA, 14 bp, Homo sapiens
gctttgcaaagacc

SEQ ID NO: 835915 - DNA, 17 bp, Homo sapiens
gctttgcacccctttcc

SEQ ID NO: 835916 - DNA, 23 bp, Homo sapiens
gctttgcacccctttcctcccca

SEQ ID NO: 835917 - DNA, 15 bp, Homo sapiens
gctttgcaggctctg

SEQ ID NO: 835918 - DNA, 18 bp, Homo sapiens
gctttgcaggctctgggc

SEQ ID NO: 835919 - DNA, 22 bp, Homo sapiens
gctttgcaggctctgggctcag

SEQ ID NO: 835920 - DNA, 15 bp, Homo sapiens
gctttgccagagcag

SEQ ID NO: 835921 - DNA, 14 bp, Homo sapiens
gctttgccagctgc

SEQ ID NO: 835922 - DNA, 20 bp, Homo sapiens
gctttgccatgggcctgctg

SEQ ID NO: 835923 - DNA, 14 bp, Homo sapiens
gctttgcccacccc

SEQ ID NO: 835924 - DNA, 15 bp, Homo sapiens
gctttgccctggagc

SEQ ID NO: 835925 - DNA, 18 bp, Homo sapiens
gctttgccttccacgctg

SEQ ID NO: 835926 - DNA, 12 bp, Homo sapiens
gctttgcgcact

SEQ ID NO: 835927 - DNA, 16 bp, Homo sapiens
gctttgcgtgcccggg

SEQ ID NO: 835928 - DNA, 16 bp, Homo sapiens
gctttgctccgctccc

SEQ ID NO: 835929 - DNA, 23 bp, Homo sapiens
gctttgctgcacagcaggacctg

SEQ ID NO: 835930 - DNA, 24 bp, Homo sapiens
gctttgctgcacagcaggacctgt

SEQ ID NO: 835931 - DNA, 19 bp, Homo sapiens
gctttgctgctaccgccct

SEQ ID NO: 835932 - DNA, 22 bp, Homo sapiens
gctttgctgctaccgccctggg

SEQ ID NO: 835933 - DNA, 19 bp, Homo sapiens
gctttgctgctgaaggctc

SEQ ID NO: 835934 - DNA, 22 bp, Homo sapiens
gctttggacctaaatggcctca

SEQ ID NO: 835935 - DNA, 17 bp, Homo sapiens
gctttggacctaatcca

SEQ ID NO: 835936 - DNA, 15 bp, Homo sapiens
gctttggcagtgcca

SEQ ID NO: 835937 - DNA, 18 bp, Homo sapiens
gctttggcagtgttttgg

SEQ ID NO: 835938 - DNA, 17 bp, Homo sapiens
gctttggcctttccttg

SEQ ID NO: 835939 - DNA, 15 bp, Homo sapiens
gctttggctgagacc

SEQ ID NO: 835940 - DNA, 13 bp, Homo sapiens
gctttggcttctt

SEQ ID NO: 835941 - DNA, 15 bp, Homo sapiens
gctttgggagaatgt

SEQ ID NO: 835942 - DNA, 14 bp, Homo sapiens
gctttgggaggcca

SEQ ID NO: 835943 - DNA, 18 bp, Homo sapiens
gctttgggaggccaaggc

SEQ ID NO: 835944 - DNA, 19 bp, Homo sapiens
gctttgggcagttggccag

SEQ ID NO: 835945 - DNA, 20 bp, Homo sapiens
gctttgggcagttggccagg

SEQ ID NO: 835946 - DNA, 11 bp, Homo sapiens
gctttgggccc

SEQ ID NO: 835947 - DNA, 21 bp, Homo sapiens
gctttgggcccaagaactgca

SEQ ID NO: 835948 - DNA, 22 bp, Homo sapiens
gctttgggcccaagaactgcag

SEQ ID NO: 835949 - DNA, 14 bp, Homo sapiens
gctttgggctgccc

SEQ ID NO: 835950 - DNA, 15 bp, Homo sapiens
gctttgggctgccct

SEQ ID NO: 835951 - DNA, 16 bp, Homo sapiens
gctttgggctgccctg

SEQ ID NO: 835952 - DNA, 19 bp, Homo sapiens
gctttgggctgccctggtg

SEQ ID NO: 835953 - DNA, 20 bp, Homo sapiens
gctttgggctttgcaggctc

SEQ ID NO: 835954 - DNA, 13 bp, Homo sapiens
gctttggggaaaa

SEQ ID NO: 835955 - DNA, 20 bp, Homo sapiens
gctttggggacagttggcag

SEQ ID NO: 835956 - DNA, 23 bp, Homo sapiens
gctttggggacagttggcagaga

SEQ ID NO: 835957 - DNA, 21 bp, Homo sapiens
gctttggggggtgtgctgaca

SEQ ID NO: 835958 - DNA, 20 bp, Homo sapiens
gctttggggtcctagcccag

SEQ ID NO: 835959 - DNA, 23 bp, Homo sapiens
gctttgggtggctcactactgaa

SEQ ID NO: 835960 - DNA, 20 bp, Homo sapiens
gctttggttaagggctccct

SEQ ID NO: 835961 - DNA, 23 bp, Homo sapiens
gctttggttaagggctccctaaa

SEQ ID NO: 835962 - DNA, 22 bp, Homo sapiens
gctttggttccttctctgggtc

SEQ ID NO: 835963 - DNA, 15 bp, Homo sapiens
gctttggtttatatt

SEQ ID NO: 835964 - DNA, 20 bp, Homo sapiens
gctttgtcacttttcctttt

SEQ ID NO: 835965 - DNA, 14 bp, Homo sapiens
gctttgtccaggtg

SEQ ID NO: 835966 - DNA, 18 bp, Homo sapiens
gctttgtctacttcaaaa

SEQ ID NO: 835967 - DNA, 14 bp, Homo sapiens
gctttgtctgtcgt

SEQ ID NO: 835968 - DNA, 18 bp, Homo sapiens
gctttgtgggctccaggc

SEQ ID NO: 835969 - DNA, 12 bp, Homo sapiens
gcttttaaaaaa

SEQ ID NO: 835970 - DNA, 22 bp, Homo sapiens
gcttttaaaaaatattttaaga

SEQ ID NO: 835971 - DNA, 19 bp, Homo sapiens
gcttttaagaaacacaggg

SEQ ID NO: 835972 - DNA, 15 bp, Homo sapiens
gcttttaattctcat

SEQ ID NO: 835973 - DNA, 15 bp, Homo sapiens
gcttttaccatgccc

SEQ ID NO: 835974 - DNA, 14 bp, Homo sapiens
gcttttacttaaac

SEQ ID NO: 835975 - DNA, 21 bp, Homo sapiens
gcttttaggagaattcacaga

SEQ ID NO: 835976 - DNA, 19 bp, Homo sapiens
gcttttagtatccacagga

SEQ ID NO: 835977 - DNA, 20 bp, Homo sapiens
gcttttagttcatatataca

SEQ ID NO: 835978 - DNA, 22 bp, Homo sapiens
gcttttatagaggctagcttct

SEQ ID NO: 835979 - DNA, 13 bp, Homo sapiens
gcttttattcctt

SEQ ID NO: 835980 - DNA, 19 bp, Homo sapiens
gcttttattcctttgaata

SEQ ID NO: 835981 - DNA, 15 bp, Homo sapiens
gcttttattttttct

SEQ ID NO: 835982 - DNA, 12 bp, Homo sapiens
gcttttcactgc

SEQ ID NO: 835983 - DNA, 14 bp, Homo sapiens
gcttttcactgcct

SEQ ID NO: 835984 - DNA, 15 bp, Homo sapiens
gcttttcactttctg

SEQ ID NO: 835985 - DNA, 23 bp, Homo sapiens
gcttttcagattgtggaatgttg

SEQ ID NO: 835986 - DNA, 22 bp, Homo sapiens
gcttttcatggcccttcaaatt

SEQ ID NO: 835987 - DNA, 19 bp, Homo sapiens
gcttttccaggaagatcca

SEQ ID NO: 835988 - DNA, 19 bp, Homo sapiens
gcttttccaggatcctgca

SEQ ID NO: 835989 - DNA, 21 bp, Homo sapiens
gcttttccaggatcctgcagg

SEQ ID NO: 835990 - DNA, 12 bp, Homo sapiens
gcttttccctct

SEQ ID NO: 835991 - DNA, 16 bp, Homo sapiens
gcttttcctcaagcaa

SEQ ID NO: 835992 - DNA, 13 bp, Homo sapiens
gcttttctgccac

SEQ ID NO: 835993 - DNA, 15 bp, Homo sapiens
ggaaagcaataaatg

SEQ ID NO: 835994 - DNA, 18 bp, Homo sapiens
ggaaagcatcacctcagg

SEQ ID NO: 835995 - DNA, 19 bp, Homo sapiens
ggaaagcatcacctcaggc

SEQ ID NO: 835996 - DNA, 20 bp, Homo sapiens
ggaaagccacacggagaggc

SEQ ID NO: 835997 - DNA, 14 bp, Homo sapiens
ggaaagcctctgct

SEQ ID NO: 835998 - DNA, 16 bp, Homo sapiens
ggaaagcctctgctgc

SEQ ID NO: 835999 - DNA, 16 bp, Homo sapiens
ggaaagcggcgccaca

SEQ ID NO: 836000 - DNA, 15 bp, Homo sapiens
ggaaagcgggcagcc

SEQ ID NO: 836001 - DNA, 18 bp, Homo sapiens
ggaaagcgggcagccccg

SEQ ID NO: 836002 - DNA, 15 bp, Homo sapiens
ggaaagctaggcttc

SEQ ID NO: 836003 - DNA, 16 bp, Homo sapiens
ggaaaggatattttct

SEQ ID NO: 836004 - DNA, 12 bp, Homo sapiens
ggaaaggctcag

SEQ ID NO: 836005 - DNA, 20 bp, Homo sapiens
ggaaaggctcagtctcagga

SEQ ID NO: 836006 - DNA, 23 bp, Homo sapiens
ggaaaggctcagtctcaggagca

SEQ ID NO: 836007 - DNA, 17 bp, Homo sapiens
ggaaaggctcatttaaa

SEQ ID NO: 836008 - DNA, 20 bp, Homo sapiens
ggaaaggctcatttaaaaca

SEQ ID NO: 836009 - DNA, 12 bp, Homo sapiens
ggaaagggagga

SEQ ID NO: 836010 - DNA, 13 bp, Homo sapiens
ggaaagggaggaa

SEQ ID NO: 836011 - DNA, 18 bp, Homo sapiens
ggaaaggggagagcctgc

SEQ ID NO: 836012 - DNA, 20 bp, Homo sapiens
ggaaaggggtcggctgacca

SEQ ID NO: 836013 - DNA, 15 bp, Homo sapiens
ggaaaggtcagcccg

SEQ ID NO: 836014 - DNA, 14 bp, Homo sapiens
ggaaaggttttgta

SEQ ID NO: 836015 - DNA, 19 bp, Homo sapiens
ggaaaggttttgtattttt

SEQ ID NO: 836016 - DNA, 11 bp, Homo sapiens
ggaaagtcaga

SEQ ID NO: 836017 - DNA, 18 bp, Homo sapiens
ggaaagtgaatttgaatg

SEQ ID NO: 836018 - DNA, 22 bp, Homo sapiens
ggaaagtgaatttgaatgaaaa

SEQ ID NO: 836019 - DNA, 19 bp, Homo sapiens
ggaaataaaacctttcaaa

SEQ ID NO: 836020 - DNA, 20 bp, Homo sapiens
ggaaataaaacctttcaaat

SEQ ID NO: 836021 - DNA, 15 bp, Homo sapiens
ggaaataacagagag

SEQ ID NO: 836022 - DNA, 14 bp, Homo sapiens
ggaaataatttgaa

SEQ ID NO: 836023 - DNA, 18 bp, Homo sapiens
ggaaataatttgaatgta

SEQ ID NO: 836024 - DNA, 18 bp, Homo sapiens
ggaaatagaaagaagcca

SEQ ID NO: 836025 - DNA, 20 bp, Homo sapiens
ggaaatatttagcaaataat

SEQ ID NO: 836026 - DNA, 23 bp, Homo sapiens
ggaaatcagccaagttttataat

SEQ ID NO: 836027 - DNA, 17 bp, Homo sapiens
ggaaatccgagcggcta

SEQ ID NO: 836028 - DNA, 17 bp, Homo sapiens
ggaaatctgtaaagcca

SEQ ID NO: 836029 - DNA, 18 bp, Homo sapiens
ggaaatctgtaaagccag

SEQ ID NO: 836030 - DNA, 23 bp, Homo sapiens
ggaaatgaggttgggggaaccag

SEQ ID NO: 836031 - DNA, 12 bp, Homo sapiens
ggaaatgcagaa

SEQ ID NO: 836032 - DNA, 20 bp, Homo sapiens
ggaaatgtaaaattgaaaat

SEQ ID NO: 836033 - DNA, 16 bp, Homo sapiens
ggaaatgtaatactgg

SEQ ID NO: 836034 - DNA, 17 bp, Homo sapiens
ggaaatgtagcacttac

SEQ ID NO: 836035 - DNA, 13 bp, Homo sapiens
ggaaatgtcctgc

SEQ ID NO: 836036 - DNA, 14 bp, Homo sapiens
ggaaatgtctgctg

SEQ ID NO: 836037 - DNA, 15 bp, Homo sapiens
ggaaatgtctgctgg

SEQ ID NO: 836038 - DNA, 20 bp, Homo sapiens
ggaaattaaatccaataaaa

SEQ ID NO: 836039 - DNA, 19 bp, Homo sapiens
ggaaattaatgctgagatg

SEQ ID NO: 836040 - DNA, 21 bp, Homo sapiens
ggaaattagataaataaaaat

SEQ ID NO: 836041 - DNA, 21 bp, Homo sapiens
ggaaattgaagtgtcttctgt

SEQ ID NO: 836042 - DNA, 17 bp, Homo sapiens
ggaaattggaagagcac

SEQ ID NO: 836043 - DNA, 21 bp, Homo sapiens
ggaaatttaaagcaggttctt

SEQ ID NO: 836044 - DNA, 11 bp, Homo sapiens
ggaaatttttc

SEQ ID NO: 836045 - DNA, 17 bp, Homo sapiens
ggaacaaagacaggcaa

SEQ ID NO: 836046 - DNA, 19 bp, Homo sapiens
ggaacaaattagaggagac

SEQ ID NO: 836047 - DNA, 18 bp, Homo sapiens
ggaacaagacagccttca

SEQ ID NO: 836048 - DNA, 19 bp, Homo sapiens
ggaacaagatgctgatcca

SEQ ID NO: 836049 - DNA, 15 bp, Homo sapiens
ggaacaagcatgtct

SEQ ID NO: 836050 - DNA, 18 bp, Homo sapiens
ggaacaaggagtcagaca

SEQ ID NO: 836051 - DNA, 18 bp, Homo sapiens
ggaacaagtaatgtatta

SEQ ID NO: 836052 - DNA, 19 bp, Homo sapiens
ggaacaattgaagtaaact

SEQ ID NO: 836053 - DNA, 20 bp, Homo sapiens
ggaacactaaaggtggaaat

SEQ ID NO: 836054 - DNA, 11 bp, Homo sapiens
ggaacagaagg

SEQ ID NO: 836055 - DNA, 13 bp, Homo sapiens
ggaacagaaggat

SEQ ID NO: 836056 - DNA, 19 bp, Homo sapiens
ggaacagaaggatgaatga

SEQ ID NO: 836057 - DNA, 13 bp, Homo sapiens
ggaacagacagga

SEQ ID NO: 836058 - DNA, 17 bp, Homo sapiens
ggaacagacaggagaaa

SEQ ID NO: 836059 - DNA, 17 bp, Homo sapiens
ggaacagcactggggag

SEQ ID NO: 836060 - DNA, 23 bp, Homo sapiens
ggaacagctatgggagccccagg

SEQ ID NO: 836061 - DNA, 14 bp, Homo sapiens
ggaacagggcccag

SEQ ID NO: 836062 - DNA, 15 bp, Homo sapiens
ggaacaggtcttggg

SEQ ID NO: 836063 - DNA, 14 bp, Homo sapiens
ggaacatactgttc

SEQ ID NO: 836064 - DNA, 17 bp, Homo sapiens
ggaacatatgcacaggg

SEQ ID NO: 836065 - DNA, 18 bp, Homo sapiens
ggaacatgacccagcctg

SEQ ID NO: 836066 - DNA, 15 bp, Homo sapiens
ggaacatgccccctg

SEQ ID NO: 836067 - DNA, 18 bp, Homo sapiens
ggaacattatttttagat

SEQ ID NO: 836068 - DNA, 12 bp, Homo sapiens
ggaacatttctt

SEQ ID NO: 836069 - DNA, 22 bp, Homo sapiens
ggaacatttgatatttttccat

SEQ ID NO: 836070 - DNA, 14 bp, Homo sapiens
ggaaccaaaaagag

SEQ ID NO: 836071 - DNA, 22 bp, Homo sapiens
ggaaccactcccaccacaggca

SEQ ID NO: 836072 - DNA, 12 bp, Homo sapiens
ggaaccagactc

SEQ ID NO: 836073 - DNA, 19 bp, Homo sapiens
ggaaccagactcttgcctg

SEQ ID NO: 836074 - DNA, 19 bp, Homo sapiens
ggaaccagagccatggact

SEQ ID NO: 836075 - DNA, 17 bp, Homo sapiens
ggaaccagggagaccga

SEQ ID NO: 836076 - DNA, 16 bp, Homo sapiens
ggaaccagggaggaga

SEQ ID NO: 836077 - DNA, 18 bp, Homo sapiens
ggaaccagggcctccctg

SEQ ID NO: 836078 - DNA, 14 bp, Homo sapiens
ggaaccccccaggc

SEQ ID NO: 836079 - DNA, 23 bp, Homo sapiens
ggaaccgaacatatcatttgtga

SEQ ID NO: 836080 - DNA, 21 bp, Homo sapiens
ggaaccgtggtatgtctgcca

SEQ ID NO: 836081 - DNA, 19 bp, Homo sapiens
ggaacctagctacactgag

SEQ ID NO: 836082 - DNA, 22 bp, Homo sapiens
ggaacctcccagaggtccagcc

SEQ ID NO: 836083 - DNA, 15 bp, Homo sapiens
ggaaccttccctcca

SEQ ID NO: 836084 - DNA, 13 bp, Homo sapiens
ggaaccttgctgt

SEQ ID NO: 836085 - DNA, 16 bp, Homo sapiens
ggaaccttgctgtcct

SEQ ID NO: 836086 - DNA, 16 bp, Homo sapiens
ggaacgagcactggcc

SEQ ID NO: 836087 - DNA, 16 bp, Homo sapiens
ggaacgcagcctccag

SEQ ID NO: 836088 - DNA, 18 bp, Homo sapiens
ggaacgggcatgggcctc

SEQ ID NO: 836089 - DNA, 14 bp, Homo sapiens
ggaactaaagcaaa

SEQ ID NO: 836090 - DNA, 14 bp, Homo sapiens
ggaactccactctc

SEQ ID NO: 836091 - DNA, 13 bp, Homo sapiens
ggaactcccagca

SEQ ID NO: 836092 - DNA, 19 bp, Homo sapiens
ggaactctggcttccaggt

SEQ ID NO: 836093 - DNA, 14 bp, Homo sapiens
ggaactcttaagca

SEQ ID NO: 836094 - DNA, 19 bp, Homo sapiens
ggaactgaagacctccaca

SEQ ID NO: 836095 - DNA, 15 bp, Homo sapiens
ggaactgaccccctc

SEQ ID NO: 836096 - DNA, 12 bp, Homo sapiens
ggaactgggctg

SEQ ID NO: 836097 - DNA, 15 bp, Homo sapiens
ggaactgtagggcca

SEQ ID NO: 836098 - DNA, 14 bp, Homo sapiens
ggaactgtgcaaag

SEQ ID NO: 836099 - DNA, 16 bp, Homo sapiens
ggaactgtgtatttat

SEQ ID NO: 836100 - DNA, 15 bp, Homo sapiens
ggaacttctaatata

SEQ ID NO: 836101 - DNA, 18 bp, Homo sapiens
ggaacttgaactgattca

SEQ ID NO: 836102 - DNA, 21 bp, Homo sapiens
ggaacttgctgctgtgcctgc

SEQ ID NO: 836103 - DNA, 18 bp, Homo sapiens
ggaactttagggggtggg

SEQ ID NO: 836104 - DNA, 11 bp, Homo sapiens
ggaagaaaacg

SEQ ID NO: 836105 - DNA, 17 bp, Homo sapiens
ggaagaaactttctggt

SEQ ID NO: 836106 - DNA, 15 bp, Homo sapiens
ggaagaaagaatgtt

SEQ ID NO: 836107 - DNA, 14 bp, Homo sapiens
ggaagaaagatttg

SEQ ID NO: 836108 - DNA, 16 bp, Homo sapiens
ggaagaaattcaggta

SEQ ID NO: 836109 - DNA, 22 bp, Homo sapiens
ggaagaaattcaggtacagaaa

SEQ ID NO: 836110 - DNA, 16 bp, Homo sapiens
ggaagaaattcctgta

SEQ ID NO: 836111 - DNA, 14 bp, Homo sapiens
ggaagaagcaaggg

SEQ ID NO: 836112 - DNA, 19 bp, Homo sapiens
ggaagaagcaagggcaaga

SEQ ID NO: 836113 - DNA, 14 bp, Homo sapiens
ggaagaagggagaa

SEQ ID NO: 836114 - DNA, 16 bp, Homo sapiens
ggaagaatttaatgga

SEQ ID NO: 836115 - DNA, 14 bp, Homo sapiens
ggaagacaatgtga

SEQ ID NO: 836116 - DNA, 23 bp, Homo sapiens
ggaagggaagttcaggctctgag

SEQ ID NO: 836117 - DNA, 20 bp, Homo sapiens
ggaagggaccaaggcaaggc

SEQ ID NO: 836118 - DNA, 23 bp, Homo sapiens
ggaagggaccaaggcaaggcagg

SEQ ID NO: 836119 - DNA, 12 bp, Homo sapiens
ggaagggatctg

SEQ ID NO: 836120 - DNA, 14 bp, Homo sapiens
ggaagggcaaaacc

SEQ ID NO: 836121 - DNA, 12 bp, Homo sapiens
ggaagggcagga

SEQ ID NO: 836122 - DNA, 18 bp, Homo sapiens
ggaagggcatgcacgggc

SEQ ID NO: 836123 - DNA, 11 bp, Homo sapiens
ggaagggccac

SEQ ID NO: 836124 - DNA, 12 bp, Homo sapiens
ggaagggccagt

SEQ ID NO: 836125 - DNA, 17 bp, Homo sapiens
ggaaggggacccccgcc

SEQ ID NO: 836126 - DNA, 17 bp, Homo sapiens
ggaaggggatggacacc

SEQ ID NO: 836127 - DNA, 19 bp, Homo sapiens
ggaaggggatggacacccc

SEQ ID NO: 836128 - DNA, 21 bp, Homo sapiens
ggaaggggatggaggccagag

SEQ ID NO: 836129 - DNA, 11 bp, Homo sapiens
ggaaggggcag

SEQ ID NO: 836130 - DNA, 13 bp, Homo sapiens
ggaaggggcagcc

SEQ ID NO: 836131 - DNA, 17 bp, Homo sapiens
ggaaggggcagccctga

SEQ ID NO: 836132 - DNA, 13 bp, Homo sapiens
ggaaggggcctcc

SEQ ID NO: 836133 - DNA, 17 bp, Homo sapiens
ggaagggggtgcaaaga

SEQ ID NO: 836134 - DNA, 23 bp, Homo sapiens
ggaagggggtgcaaagactctga

SEQ ID NO: 836135 - DNA, 22 bp, Homo sapiens
ggaaggggttcctcaaattttt

SEQ ID NO: 836136 - DNA, 15 bp, Homo sapiens
ggaagggtgggaagg

SEQ ID NO: 836137 - DNA, 16 bp, Homo sapiens
ggaaggtgaccgccca

SEQ ID NO: 836138 - DNA, 17 bp, Homo sapiens
ggaaggtgccagaagga

SEQ ID NO: 836139 - DNA, 19 bp, Homo sapiens
ggaaggtgccagaaggaag

SEQ ID NO: 836140 - DNA, 20 bp, Homo sapiens
ggaaggtgccagaaggaagg

SEQ ID NO: 836141 - DNA, 15 bp, Homo sapiens
ggaaggtggggccct

SEQ ID NO: 836142 - DNA, 21 bp, Homo sapiens
ggaaggtggggccctgcccct

SEQ ID NO: 836143 - DNA, 20 bp, Homo sapiens
ggaaggttagaaaggcagcc

SEQ ID NO: 836144 - DNA, 16 bp, Homo sapiens
ggaaggttcttcatga

SEQ ID NO: 836145 - DNA, 16 bp, Homo sapiens
ggaagtaaaataaata

SEQ ID NO: 836146 - DNA, 16 bp, Homo sapiens
ggaagtacgtcccagc

SEQ ID NO: 836147 - DNA, 16 bp, Homo sapiens
ggaagtaggaagtaaa

SEQ ID NO: 836148 - DNA, 22 bp, Homo sapiens
ggaagtatacctggctttttaa

SEQ ID NO: 836149 - DNA, 13 bp, Homo sapiens
ggaagtcaaagca

SEQ ID NO: 836150 - DNA, 18 bp, Homo sapiens
ggaagtcacctttctggg

SEQ ID NO: 836151 - DNA, 15 bp, Homo sapiens
ggaagtcaggggaga

SEQ ID NO: 836152 - DNA, 19 bp, Homo sapiens
ggaagtcaggggagaagct

SEQ ID NO: 836153 - DNA, 16 bp, Homo sapiens
ggaagtccaatgtggc

SEQ ID NO: 836154 - DNA, 23 bp, Homo sapiens
ggaagtcctgggaggatcctgag

SEQ ID NO: 836155 - DNA, 14 bp, Homo sapiens
ggaagtctccatga

SEQ ID NO: 836156 - DNA, 16 bp, Homo sapiens
ggaagtctccatgaag

SEQ ID NO: 836157 - DNA, 14 bp, Homo sapiens
ggaagtgaggaagc

SEQ ID NO: 836158 - DNA, 19 bp, Homo sapiens
ggaagtgaggcccaaggag

SEQ ID NO: 836159 - DNA, 18 bp, Homo sapiens
ggaagtggcagtgaaaaa

SEQ ID NO: 836160 - DNA, 16 bp, Homo sapiens
ggaagtggctggtctg

SEQ ID NO: 836161 - DNA, 16 bp, Homo sapiens
ggaagtggggacagat

SEQ ID NO: 836162 - DNA, 19 bp, Homo sapiens
ggaagtggggtctggcctg

SEQ ID NO: 836163 - DNA, 15 bp, Homo sapiens
ggaagtgtgtttgcc

SEQ ID NO: 836164 - DNA, 23 bp, Homo sapiens
ggaagttattaacgggcatgtat

SEQ ID NO: 836165 - DNA, 17 bp, Homo sapiens
ggaagttcaggctctga

SEQ ID NO: 836166 - DNA, 13 bp, Homo sapiens
ggaagttctccag

SEQ ID NO: 836167 - DNA, 15 bp, Homo sapiens
ggaagttgtctcctt

SEQ ID NO: 836168 - DNA, 13 bp, Homo sapiens
ggaagttgtggat

SEQ ID NO: 836169 - DNA, 14 bp, Homo sapiens
ggaagtttatttga

SEQ ID NO: 836170 - DNA, 15 bp, Homo sapiens
ggaagtttatttgag

SEQ ID NO: 836171 - DNA, 16 bp, Homo sapiens
ggaagtttatttgaga

SEQ ID NO: 836172 - DNA, 19 bp, Homo sapiens
ggaagtttatttgagaaaa

SEQ ID NO: 836173 - DNA, 21 bp, Homo sapiens
ggaagtttatttgagaaaata

SEQ ID NO: 836174 - DNA, 17 bp, Homo sapiens
ggaagtttgtgttctgt

SEQ ID NO: 836175 - DNA, 17 bp, Homo sapiens
ggaagttttacagcaag

SEQ ID NO: 836176 - DNA, 11 bp, Homo sapiens
ggaataaaaaa

SEQ ID NO: 836177 - DNA, 15 bp, Homo sapiens
ggaataaaaggcttg

SEQ ID NO: 836178 - DNA, 22 bp, Homo sapiens
ggaataaaaggcttgaagctgt

SEQ ID NO: 836179 - DNA, 22 bp, Homo sapiens
ggaataaaatgatttgtggaaa

SEQ ID NO: 836180 - DNA, 20 bp, Homo sapiens
ggaataaacagtgagcatat

SEQ ID NO: 836181 - DNA, 13 bp, Homo sapiens
ggaataaacatta

SEQ ID NO: 836182 - DNA, 20 bp, Homo sapiens
ggaataaacattaattttgt

SEQ ID NO: 836183 - DNA, 17 bp, Homo sapiens
ggaataaagttgcagat

SEQ ID NO: 836184 - DNA, 22 bp, Homo sapiens
ggaataaattatggcatttcta

SEQ ID NO: 836185 - DNA, 22 bp, Homo sapiens
ggaataacaactttcagtggct

SEQ ID NO: 836186 - DNA, 21 bp, Homo sapiens
ggaataactatctcacttcca

SEQ ID NO: 836187 - DNA, 21 bp, Homo sapiens
ggaataacttttacacgacca

SEQ ID NO: 836188 - DNA, 13 bp, Homo sapiens
ggaataagacaga

SEQ ID NO: 836189 - DNA, 14 bp, Homo sapiens
ggaataattgcttt

SEQ ID NO: 836190 - DNA, 15 bp, Homo sapiens
ggaataatttgtaaa

SEQ ID NO: 836191 - DNA, 12 bp, Homo sapiens
ggaatacagtgt

SEQ ID NO: 836192 - DNA, 21 bp, Homo sapiens
ggaatagcaaaattcctgtgt

SEQ ID NO: 836193 - DNA, 16 bp, Homo sapiens
ggaatagccagagagg

SEQ ID NO: 836194 - DNA, 20 bp, Homo sapiens
ggaatagccagagaggagca

SEQ ID NO: 836195 - DNA, 20 bp, Homo sapiens
ggaatagggagacagggtag

SEQ ID NO: 836196 - DNA, 14 bp, Homo sapiens
ggaatataagaaaa

SEQ ID NO: 836197 - DNA, 22 bp, Homo sapiens
ggaatataagaaaagtaatgaa

SEQ ID NO: 836198 - DNA, 17 bp, Homo sapiens
ggaatatgggagaaata

SEQ ID NO: 836199 - DNA, 21 bp, Homo sapiens
ggaatattcattttactcaga

SEQ ID NO: 836200 - DNA, 14 bp, Homo sapiens
ggaatattgtgatt

SEQ ID NO: 836201 - DNA, 15 bp, Homo sapiens
ggaatatttgaataa

SEQ ID NO: 836202 - DNA, 16 bp, Homo sapiens
ggaatattttatcctg

SEQ ID NO: 836203 - DNA, 20 bp, Homo sapiens
ggaatatttttggggttgga

SEQ ID NO: 836204 - DNA, 21 bp, Homo sapiens
ggaatcagacttcacactgca

SEQ ID NO: 836205 - DNA, 18 bp, Homo sapiens
ggaatcagtatttccttc

SEQ ID NO: 836206 - DNA, 15 bp, Homo sapiens
ggaatcatgtcaggc

SEQ ID NO: 836207 - DNA, 18 bp, Homo sapiens
ggaatcatgtcaggcctg

SEQ ID NO: 836208 - DNA, 21 bp, Homo sapiens
ggaatcatgtcaggcctgtgt

SEQ ID NO: 836209 - DNA, 24 bp, Homo sapiens
ggaatcatttctatttctcctcca

SEQ ID NO: 836210 - DNA, 20 bp, Homo sapiens
ggaatccagctccctagact

SEQ ID NO: 836211 - DNA, 19 bp, Homo sapiens
ggaatccgggacacctggg

SEQ ID NO: 836212 - DNA, 14 bp, Homo sapiens
ggaatcctcctcca

SEQ ID NO: 836213 - DNA, 20 bp, Homo sapiens
ggaatcctgaaagggcactt

SEQ ID NO: 836214 - DNA, 23 bp, Homo sapiens
ggaatcctgaaagggcacttaat

SEQ ID NO: 836215 - DNA, 12 bp, Homo sapiens
ggaatcctggca

SEQ ID NO: 836216 - DNA, 18 bp, Homo sapiens
ggaatcctttgagaatgt

SEQ ID NO: 836217 - DNA, 20 bp, Homo sapiens
ggaatcgaggaaccagagcc

SEQ ID NO: 836218 - DNA, 17 bp, Homo sapiens
ggaatcgccccagactc

SEQ ID NO: 836219 - DNA, 22 bp, Homo sapiens
ggaatctaaccacttaaggacc

SEQ ID NO: 836220 - DNA, 13 bp, Homo sapiens
ggaatctgccttc

SEQ ID NO: 836221 - DNA, 18 bp, Homo sapiens
ggaatctgtttctctgct

SEQ ID NO: 836222 - DNA, 17 bp, Homo sapiens
ggaatcttcacctcaga

SEQ ID NO: 836223 - DNA, 23 bp, Homo sapiens
ggaatcttctcatcttttatcta

SEQ ID NO: 836224 - DNA, 21 bp, Homo sapiens
ggaatcttttataatgattca

SEQ ID NO: 836225 - DNA, 23 bp, Homo sapiens
ggaatgaaagagagctctaacca

SEQ ID NO: 836226 - DNA, 17 bp, Homo sapiens
ggaatgactgaaagaag

SEQ ID NO: 836227 - DNA, 21 bp, Homo sapiens
ggaatgagcccagagaacagc

SEQ ID NO: 836228 - DNA, 12 bp, Homo sapiens
ggaatgagggag

SEQ ID NO: 836229 - DNA, 14 bp, Homo sapiens
ggaatgagggaggc

SEQ ID NO: 836230 - DNA, 16 bp, Homo sapiens
ggaatgcacctcccca

SEQ ID NO: 836231 - DNA, 23 bp, Homo sapiens
ggaatgcattatttattgctgtg

SEQ ID NO: 836232 - DNA, 17 bp, Homo sapiens
ggaatgctgaggcctcg

SEQ ID NO: 836233 - DNA, 14 bp, Homo sapiens
ggaatgctggactg

SEQ ID NO: 836234 - DNA, 21 bp, Homo sapiens
ggaatggaaaaagcagaaggc

SEQ ID NO: 836235 - DNA, 21 bp, Homo sapiens
ggaatggaaggctttgccatg

SEQ ID NO: 836236 - DNA, 15 bp, Homo sapiens
ggaatgggggtcaga

SEQ ID NO: 836237 - DNA, 15 bp, Homo sapiens
ggaatgtcagggcca

SEQ ID NO: 836238 - DNA, 19 bp, Homo sapiens
ggaccattgacctcagctg

SEQ ID NO: 836239 - DNA, 21 bp, Homo sapiens
ggaccattgacctcagctgca

SEQ ID NO: 836240 - DNA, 22 bp, Homo sapiens
ggaccattgacctcagctgcac

SEQ ID NO: 836241 - DNA, 20 bp, Homo sapiens
ggacccaaaaaatcatctca

SEQ ID NO: 836242 - DNA, 19 bp, Homo sapiens
ggacccaaaacacaggaag

SEQ ID NO: 836243 - DNA, 10 bp, Homo sapiens
ggacccacca

SEQ ID NO: 836244 - DNA, 12 bp, Homo sapiens
ggacccacccag

SEQ ID NO: 836245 - DNA, 14 bp, Homo sapiens
ggacccacccagcc

SEQ ID NO: 836246 - DNA, 17 bp, Homo sapiens
ggacccacccagcccct

SEQ ID NO: 836247 - DNA, 11 bp, Homo sapiens
ggacccacccc

SEQ ID NO: 836248 - DNA, 12 bp, Homo sapiens
ggacccacccca

SEQ ID NO: 836249 - DNA, 15 bp, Homo sapiens
ggacccaccccaact

SEQ ID NO: 836250 - DNA, 22 bp, Homo sapiens
ggacccaccccaactctcccca

SEQ ID NO: 836251 - DNA, 17 bp, Homo sapiens
ggacccagcgggcaggt

SEQ ID NO: 836252 - DNA, 13 bp, Homo sapiens
ggacccagctact

SEQ ID NO: 836253 - DNA, 14 bp, Homo sapiens
ggacccagctactc

SEQ ID NO: 836254 - DNA, 23 bp, Homo sapiens
ggacccagctactctgtccaggc

SEQ ID NO: 836255 - DNA, 13 bp, Homo sapiens
ggacccagctcct

SEQ ID NO: 836256 - DNA, 14 bp, Homo sapiens
ggacccagctcctc

SEQ ID NO: 836257 - DNA, 22 bp, Homo sapiens
ggacccagctcctctgagccat

SEQ ID NO: 836258 - DNA, 10 bp, Homo sapiens
ggacccagga

SEQ ID NO: 836259 - DNA, 15 bp, Homo sapiens
ggacccagggcctga

SEQ ID NO: 836260 - DNA, 18 bp, Homo sapiens
ggacccagggcctgactt

SEQ ID NO: 836261 - DNA, 11 bp, Homo sapiens
ggacccagggt

SEQ ID NO: 836262 - DNA, 17 bp, Homo sapiens
ggacccagggtcccctc

SEQ ID NO: 836263 - DNA, 20 bp, Homo sapiens
ggacccagggtcccctcccc

SEQ ID NO: 836264 - DNA, 12 bp, Homo sapiens
ggaccccactgg

SEQ ID NO: 836265 - DNA, 12 bp, Homo sapiens
ggaccccagctc

SEQ ID NO: 836266 - DNA, 13 bp, Homo sapiens
ggaccccagctgg

SEQ ID NO: 836267 - DNA, 14 bp, Homo sapiens
ggaccccagctggg

SEQ ID NO: 836268 - DNA, 14 bp, Homo sapiens
ggaccccagggtgg

SEQ ID NO: 836269 - DNA, 18 bp, Homo sapiens
ggaccccatctgtgaata

SEQ ID NO: 836270 - DNA, 15 bp, Homo sapiens
ggacccccgccccct

SEQ ID NO: 836271 - DNA, 16 bp, Homo sapiens
ggacccccgccccctg

SEQ ID NO: 836272 - DNA, 19 bp, Homo sapiens
ggacccccgccccctgccc

SEQ ID NO: 836273 - DNA, 22 bp, Homo sapiens
ggacccccgccccctgccctcc

SEQ ID NO: 836274 - DNA, 18 bp, Homo sapiens
ggacccccgtcagctgct

SEQ ID NO: 836275 - DNA, 21 bp, Homo sapiens
ggaccccctcgccagcttggc

SEQ ID NO: 836276 - DNA, 13 bp, Homo sapiens
ggaccccctgccc

SEQ ID NO: 836277 - DNA, 14 bp, Homo sapiens
ggacccccttcccc

SEQ ID NO: 836278 - DNA, 18 bp, Homo sapiens
ggaccccgagggctgagg

SEQ ID NO: 836279 - DNA, 19 bp, Homo sapiens
ggaccccgagggctgagga

SEQ ID NO: 836280 - DNA, 20 bp, Homo sapiens
ggaccccgtttcatttttac

SEQ ID NO: 836281 - DNA, 12 bp, Homo sapiens
ggacccctcacc

SEQ ID NO: 836282 - DNA, 19 bp, Homo sapiens
ggacccctcaccaccccca

SEQ ID NO: 836283 - DNA, 13 bp, Homo sapiens
ggacccctcacct

SEQ ID NO: 836284 - DNA, 14 bp, Homo sapiens
ggacccctcccttg

SEQ ID NO: 836285 - DNA, 17 bp, Homo sapiens
ggacccctcccttgctc

SEQ ID NO: 836286 - DNA, 22 bp, Homo sapiens
ggacccctcgcaaccctgcctg

SEQ ID NO: 836287 - DNA, 16 bp, Homo sapiens
ggacccctgccttcct

SEQ ID NO: 836288 - DNA, 21 bp, Homo sapiens
ggacccctgccttcctctgag

SEQ ID NO: 836289 - DNA, 12 bp, Homo sapiens
ggacccctgggg

SEQ ID NO: 836290 - DNA, 20 bp, Homo sapiens
ggacccctggggtggccagg

SEQ ID NO: 836291 - DNA, 21 bp, Homo sapiens
ggacccctggggtggccaggg

SEQ ID NO: 836292 - DNA, 19 bp, Homo sapiens
ggacccctgtccaggatgg

SEQ ID NO: 836293 - DNA, 14 bp, Homo sapiens
ggacccgccagccc

SEQ ID NO: 836294 - DNA, 21 bp, Homo sapiens
ggacccgccagccccgctccc

SEQ ID NO: 836295 - DNA, 17 bp, Homo sapiens
ggacccgctctggacca

SEQ ID NO: 836296 - DNA, 13 bp, Homo sapiens
ggaccctgctgac

SEQ ID NO: 836297 - DNA, 17 bp, Homo sapiens
ggaccctgtcctgcagt

SEQ ID NO: 836298 - DNA, 21 bp, Homo sapiens
ggaccctgtcctgcagtccca

SEQ ID NO: 836299 - DNA, 16 bp, Homo sapiens
ggaccctgtgacatgg

SEQ ID NO: 836300 - DNA, 13 bp, Homo sapiens
ggaccctgtgagc

SEQ ID NO: 836301 - DNA, 15 bp, Homo sapiens
ggaccctgtgagccg

SEQ ID NO: 836302 - DNA, 14 bp, Homo sapiens
ggaccctgtttctg

SEQ ID NO: 836303 - DNA, 19 bp, Homo sapiens
ggacccttaggatggggct

SEQ ID NO: 836304 - DNA, 22 bp, Homo sapiens
ggacccttaggatggggctccc

SEQ ID NO: 836305 - DNA, 16 bp, Homo sapiens
ggaccctttccttcct

SEQ ID NO: 836306 - DNA, 21 bp, Homo sapiens
ggaccctttccttccttccct

SEQ ID NO: 836307 - DNA, 21 bp, Homo sapiens
ggaccgcctgccctgcctggg

SEQ ID NO: 836308 - DNA, 14 bp, Homo sapiens
ggaccgcctggccc

SEQ ID NO: 836309 - DNA, 18 bp, Homo sapiens
ggaccgcctggccctccc

SEQ ID NO: 836310 - DNA, 13 bp, Homo sapiens
ggaccgctttgcg

SEQ ID NO: 836311 - DNA, 17 bp, Homo sapiens
ggaccgggtgggcctgg

SEQ ID NO: 836312 - DNA, 19 bp, Homo sapiens
ggaccgggtgggcctggcc

SEQ ID NO: 836313 - DNA, 16 bp, Homo sapiens
ggaccggtgctgcagg

SEQ ID NO: 836314 - DNA, 17 bp, Homo sapiens
ggaccggtgctgcagga

SEQ ID NO: 836315 - DNA, 20 bp, Homo sapiens
ggaccggtgctgcaggagtg

SEQ ID NO: 836316 - DNA, 18 bp, Homo sapiens
ggaccgtcagcatgggct

SEQ ID NO: 836317 - DNA, 16 bp, Homo sapiens
ggaccgtgcgagctgc

SEQ ID NO: 836318 - DNA, 19 bp, Homo sapiens
ggacctaatgctggcctga

SEQ ID NO: 836319 - DNA, 11 bp, Homo sapiens
ggacctacctc

SEQ ID NO: 836320 - DNA, 15 bp, Homo sapiens
ggacctacctccctc

SEQ ID NO: 836321 - DNA, 22 bp, Homo sapiens
ggacctacctccctccctctcc

SEQ ID NO: 836322 - DNA, 23 bp, Homo sapiens
ggacctagcctggatggcccctc

SEQ ID NO: 836323 - DNA, 15 bp, Homo sapiens
ggacctagcttgagg

SEQ ID NO: 836324 - DNA, 21 bp, Homo sapiens
ggacctatacagaacagaggg

SEQ ID NO: 836325 - DNA, 17 bp, Homo sapiens
ggacctatgcagggagg

SEQ ID NO: 836326 - DNA, 18 bp, Homo sapiens
ggacctatgcagggaggc

SEQ ID NO: 836327 - DNA, 20 bp, Homo sapiens
ggacctatgcagggaggcca

SEQ ID NO: 836328 - DNA, 21 bp, Homo sapiens
ggacctatgtcctaaggacac

SEQ ID NO: 836329 - DNA, 19 bp, Homo sapiens
ggacctattatcagaaggt

SEQ ID NO: 836330 - DNA, 19 bp, Homo sapiens
ggacctcagagtccaggcc

SEQ ID NO: 836331 - DNA, 14 bp, Homo sapiens
ggacctcaggaggg

SEQ ID NO: 836332 - DNA, 15 bp, Homo sapiens
ggacctcaggagggc

SEQ ID NO: 836333 - DNA, 12 bp, Homo sapiens
ggacctcagggg

SEQ ID NO: 836334 - DNA, 13 bp, Homo sapiens
ggacctcaggggc

SEQ ID NO: 836335 - DNA, 17 bp, Homo sapiens
ggacctcaggggcacct

SEQ ID NO: 836336 - DNA, 22 bp, Homo sapiens
ggacctccaggggctcctgggt

SEQ ID NO: 836337 - DNA, 17 bp, Homo sapiens
ggacctccatccctgct

SEQ ID NO: 836338 - DNA, 14 bp, Homo sapiens
ggacctcccctgag

SEQ ID NO: 836339 - DNA, 15 bp, Homo sapiens
ggacctccctgtctc

SEQ ID NO: 836340 - DNA, 17 bp, Homo sapiens
ggacctcctccctcatt

SEQ ID NO: 836341 - DNA, 23 bp, Homo sapiens
ggacctcctccctcattcatctt

SEQ ID NO: 836342 - DNA, 11 bp, Homo sapiens
ggacctcctta

SEQ ID NO: 836343 - DNA, 23 bp, Homo sapiens
ggacctcgtcccatcttcactct

SEQ ID NO: 836344 - DNA, 22 bp, Homo sapiens
ggacctctcagcatagcctgcc

SEQ ID NO: 836345 - DNA, 12 bp, Homo sapiens
ggacctctgctc

SEQ ID NO: 836346 - DNA, 13 bp, Homo sapiens
ggacctctgctct

SEQ ID NO: 836347 - DNA, 14 bp, Homo sapiens
ggacctctgctctg

SEQ ID NO: 836348 - DNA, 20 bp, Homo sapiens
ggacctgaaggtattggcct

SEQ ID NO: 836349 - DNA, 21 bp, Homo sapiens
ggacctgaaggtattggcctg

SEQ ID NO: 836350 - DNA, 22 bp, Homo sapiens
ggacctgaaggtattggcctgt

SEQ ID NO: 836351 - DNA, 18 bp, Homo sapiens
ggacctgagactcacact

SEQ ID NO: 836352 - DNA, 15 bp, Homo sapiens
ggacctgccaccagg

SEQ ID NO: 836353 - DNA, 22 bp, Homo sapiens
ggacctgcctcctgcctgcccc

SEQ ID NO: 836354 - DNA, 22 bp, Homo sapiens
ggacctggatagttaagggctt

SEQ ID NO: 836355 - DNA, 13 bp, Homo sapiens
ggacctggggcac

SEQ ID NO: 836356 - DNA, 15 bp, Homo sapiens
ggacctggggcacag

SEQ ID NO: 836357 - DNA, 16 bp, Homo sapiens
ggacctggggcacagt

SEQ ID NO: 836358 - DNA, 17 bp, Homo sapiens
ggacctgtcccccactc

SEQ ID NO: 836359 - DNA, 22 bp, Homo sapiens
ggacctgtcccccactctctca

SEQ ID NO: 836360 - DNA, 13 bp, Homo sapiens
ggaccttcctgcc

SEQ ID NO: 836361 - DNA, 16 bp, Homo sapiens
ggactttccaccccct

SEQ ID NO: 836362 - DNA, 17 bp, Homo sapiens
ggactttccaccccctc

SEQ ID NO: 836363 - DNA, 17 bp, Homo sapiens
ggactttgcagccggca

SEQ ID NO: 836364 - DNA, 12 bp, Homo sapiens
ggactttgtaca

SEQ ID NO: 836365 - DNA, 18 bp, Homo sapiens
ggacttttcgttaacatt

SEQ ID NO: 836366 - DNA, 13 bp, Homo sapiens
ggacttttctgca

SEQ ID NO: 836367 - DNA, 23 bp, Homo sapiens
ggagaaaaaaaaccttgtaaaaa

SEQ ID NO: 836368 - DNA, 15 bp, Homo sapiens
ggagaaaaagatatg

SEQ ID NO: 836369 - DNA, 13 bp, Homo sapiens
ggagaaaacactt

SEQ ID NO: 836370 - DNA, 16 bp, Homo sapiens
ggagaaaacccctccc

SEQ ID NO: 836371 - DNA, 18 bp, Homo sapiens
ggagaaaacgccagtgtg

SEQ ID NO: 836372 - DNA, 17 bp, Homo sapiens
ggagaaaatccaggtca

SEQ ID NO: 836373 - DNA, 15 bp, Homo sapiens
ggagaaacagagaca

SEQ ID NO: 836374 - DNA, 18 bp, Homo sapiens
ggagaaactgaaagtgtt

SEQ ID NO: 836375 - DNA, 13 bp, Homo sapiens
ggagaaagagggg

SEQ ID NO: 836376 - DNA, 13 bp, Homo sapiens
ggagaaagggagc

SEQ ID NO: 836377 - DNA, 16 bp, Homo sapiens
ggagaaagggcaaatt

SEQ ID NO: 836378 - DNA, 19 bp, Homo sapiens
ggagaaagggcagaggaag

SEQ ID NO: 836379 - DNA, 22 bp, Homo sapiens
ggagaaagggcagaggaagaga

SEQ ID NO: 836380 - DNA, 16 bp, Homo sapiens
ggagaaataaattttg

SEQ ID NO: 836381 - DNA, 17 bp, Homo sapiens
ggagaaatgataagtga

SEQ ID NO: 836382 - DNA, 23 bp, Homo sapiens
ggagaaatgcaataactctggga

SEQ ID NO: 836383 - DNA, 23 bp, Homo sapiens
ggagaaatgcatccattcctcag

SEQ ID NO: 836384 - DNA, 15 bp, Homo sapiens
ggagaaattgacaga

SEQ ID NO: 836385 - DNA, 20 bp, Homo sapiens
ggagaaccaaatctggaagc

SEQ ID NO: 836386 - DNA, 11 bp, Homo sapiens
ggagaaccagg

SEQ ID NO: 836387 - DNA, 15 bp, Homo sapiens
ggagaacctcaggct

SEQ ID NO: 836388 - DNA, 17 bp, Homo sapiens
ggagaagaacaagaaat

SEQ ID NO: 836389 - DNA, 21 bp, Homo sapiens
ggagaagagtatttttaacac

SEQ ID NO: 836390 - DNA, 18 bp, Homo sapiens
ggagaagcacagctcctg

SEQ ID NO: 836391 - DNA, 18 bp, Homo sapiens
ggagaagcccgtgtgaga

SEQ ID NO: 836392 - DNA, 17 bp, Homo sapiens
ggagaagcggctggcag

SEQ ID NO: 836393 - DNA, 14 bp, Homo sapiens
ggagaagctgcagg

SEQ ID NO: 836394 - DNA, 14 bp, Homo sapiens
ggagaaggaaaaag

SEQ ID NO: 836395 - DNA, 20 bp, Homo sapiens
ggagaaggaaaaagaaagta

SEQ ID NO: 836396 - DNA, 19 bp, Homo sapiens
ggagaaggaagggcagaga

SEQ ID NO: 836397 - DNA, 19 bp, Homo sapiens
ggagaaggaggagagagag

SEQ ID NO: 836398 - DNA, 14 bp, Homo sapiens
ggagaagggatgga

SEQ ID NO: 836399 - DNA, 21 bp, Homo sapiens
ggagaagggatggaggtcaca

SEQ ID NO: 836400 - DNA, 13 bp, Homo sapiens
ggagaagggctgg

SEQ ID NO: 836401 - DNA, 14 bp, Homo sapiens
ggagaagggctggg

SEQ ID NO: 836402 - DNA, 22 bp, Homo sapiens
ggagaagggggctctgccccag

SEQ ID NO: 836403 - DNA, 17 bp, Homo sapiens
ggagaaggtctccaagg

SEQ ID NO: 836404 - DNA, 19 bp, Homo sapiens
ggagaatcatgtgaacccg

SEQ ID NO: 836405 - DNA, 16 bp, Homo sapiens
ggagaatgcagcccac

SEQ ID NO: 836406 - DNA, 22 bp, Homo sapiens
ggagaatggtgtgaacccggga

SEQ ID NO: 836407 - DNA, 22 bp, Homo sapiens
ggagaattgaattctggaaact

SEQ ID NO: 836408 - DNA, 20 bp, Homo sapiens
ggagaattgctggaacccag

SEQ ID NO: 836409 - DNA, 21 bp, Homo sapiens
ggagacaattagcagaatgga

SEQ ID NO: 836410 - DNA, 17 bp, Homo sapiens
ggagacactggcccctc

SEQ ID NO: 836411 - DNA, 16 bp, Homo sapiens
ggagacagaggaaagg

SEQ ID NO: 836412 - DNA, 20 bp, Homo sapiens
ggagacagaggaaagggctg

SEQ ID NO: 836413 - DNA, 19 bp, Homo sapiens
ggagacagatcactcctgg

SEQ ID NO: 836414 - DNA, 23 bp, Homo sapiens
ggagacagatcactcctggaggc

SEQ ID NO: 836415 - DNA, 11 bp, Homo sapiens
ggagacagcag

SEQ ID NO: 836416 - DNA, 18 bp, Homo sapiens
ggagacagcatcagggtt

SEQ ID NO: 836417 - DNA, 19 bp, Homo sapiens
ggagacagcttctctgcag

SEQ ID NO: 836418 - DNA, 20 bp, Homo sapiens
ggagacaggcagggagggct

SEQ ID NO: 836419 - DNA, 17 bp, Homo sapiens
ggagacagggctgctcc

SEQ ID NO: 836420 - DNA, 11 bp, Homo sapiens
ggagacagggt

SEQ ID NO: 836421 - DNA, 13 bp, Homo sapiens
ggagacagtgatc

SEQ ID NO: 836422 - DNA, 19 bp, Homo sapiens
ggagacatggaccagcatc

SEQ ID NO: 836423 - DNA, 20 bp, Homo sapiens
ggagacatggaccagcatct

SEQ ID NO: 836424 - DNA, 22 bp, Homo sapiens
ggagacattgctctatgtctgc

SEQ ID NO: 836425 - DNA, 17 bp, Homo sapiens
ggagaccaaggcgggag

SEQ ID NO: 836426 - DNA, 15 bp, Homo sapiens
ggagaccccccccca

SEQ ID NO: 836427 - DNA, 13 bp, Homo sapiens
ggagaccctgcaa

SEQ ID NO: 836428 - DNA, 23 bp, Homo sapiens
ggagaccctgcaaacagaacagg

SEQ ID NO: 836429 - DNA, 22 bp, Homo sapiens
ggagaccctgccacagccagag

SEQ ID NO: 836430 - DNA, 12 bp, Homo sapiens
ggagaccctgga

SEQ ID NO: 836431 - DNA, 19 bp, Homo sapiens
ggagaccgcttcacccctg

SEQ ID NO: 836432 - DNA, 22 bp, Homo sapiens
ggagaccgcttcacccctgcac

SEQ ID NO: 836433 - DNA, 23 bp, Homo sapiens
ggagaccgcttcacccctgcact

SEQ ID NO: 836434 - DNA, 20 bp, Homo sapiens
ggagaccggggtatcctggg

SEQ ID NO: 836435 - DNA, 16 bp, Homo sapiens
ggagacctgttggcct

SEQ ID NO: 836436 - DNA, 19 bp, Homo sapiens
ggagacgccatgtgatgga

SEQ ID NO: 836437 - DNA, 15 bp, Homo sapiens
ggagacgcctctccc

SEQ ID NO: 836438 - DNA, 18 bp, Homo sapiens
ggagacggccctgctggg

SEQ ID NO: 836439 - DNA, 9 bp, Homo sapiens
ggagactca

SEQ ID NO: 836440 - DNA, 17 bp, Homo sapiens
ggagactcacctctgcc

SEQ ID NO: 836441 - DNA, 18 bp, Homo sapiens
ggagactcacctctgcct

SEQ ID NO: 836442 - DNA, 13 bp, Homo sapiens
ggagactctgtgg

SEQ ID NO: 836443 - DNA, 16 bp, Homo sapiens
ggagactctgtggggc

SEQ ID NO: 836444 - DNA, 23 bp, Homo sapiens
ggagactgataacttggggaggc

SEQ ID NO: 836445 - DNA, 15 bp, Homo sapiens
ggagactgcttccca

SEQ ID NO: 836446 - DNA, 20 bp, Homo sapiens
ggagactgggctgagggagc

SEQ ID NO: 836447 - DNA, 12 bp, Homo sapiens
ggagactgtccc

SEQ ID NO: 836448 - DNA, 22 bp, Homo sapiens
ggagactgtggtaggggcaggg

SEQ ID NO: 836449 - DNA, 23 bp, Homo sapiens
ggagactgtggtaggggcaggga

SEQ ID NO: 836450 - DNA, 15 bp, Homo sapiens
ggagagaaaaaagaa

SEQ ID NO: 836451 - DNA, 18 bp, Homo sapiens
ggagagaacgggcgtcag

SEQ ID NO: 836452 - DNA, 14 bp, Homo sapiens
ggagagaagaaagt

SEQ ID NO: 836453 - DNA, 12 bp, Homo sapiens
ggagagaagaat

SEQ ID NO: 836454 - DNA, 20 bp, Homo sapiens
ggagagacaggcagcccagc

SEQ ID NO: 836455 - DNA, 18 bp, Homo sapiens
ggagagaccgagtgaacc

SEQ ID NO: 836456 - DNA, 13 bp, Homo sapiens
ggagagacctcat

SEQ ID NO: 836457 - DNA, 15 bp, Homo sapiens
ggagagacctcatca

SEQ ID NO: 836458 - DNA, 21 bp, Homo sapiens
ggagagactgaaagcagcagc

SEQ ID NO: 836459 - DNA, 17 bp, Homo sapiens
ggagagactgagcagcc

SEQ ID NO: 836460 - DNA, 19 bp, Homo sapiens
ggagagagagagagagagg

SEQ ID NO: 836461 - DNA, 13 bp, Homo sapiens
ggagagagaggct

SEQ ID NO: 836462 - DNA, 15 bp, Homo sapiens
ggagagagaggctgc

SEQ ID NO: 836463 - DNA, 22 bp, Homo sapiens
ggagagagaggctgcctcagcc

SEQ ID NO: 836464 - DNA, 19 bp, Homo sapiens
ggagagatgacccctaccc

SEQ ID NO: 836465 - DNA, 22 bp, Homo sapiens
ggagagatgacccctaccccct

SEQ ID NO: 836466 - DNA, 12 bp, Homo sapiens
ggagagcactgc

SEQ ID NO: 836467 - DNA, 15 bp, Homo sapiens
ggagagcactgcctc

SEQ ID NO: 836468 - DNA, 17 bp, Homo sapiens
ggagagcactgcctcta

SEQ ID NO: 836469 - DNA, 12 bp, Homo sapiens
ggagagcagcag

SEQ ID NO: 836470 - DNA, 23 bp, Homo sapiens
ggagagcagcagcaccaaccaca

SEQ ID NO: 836471 - DNA, 13 bp, Homo sapiens
ggagagcagcagg

SEQ ID NO: 836472 - DNA, 21 bp, Homo sapiens
ggagagcagcaggtgctgtgc

SEQ ID NO: 836473 - DNA, 11 bp, Homo sapiens
ggagagcagct

SEQ ID NO: 836474 - DNA, 12 bp, Homo sapiens
ggagagcagctg

SEQ ID NO: 836475 - DNA, 13 bp, Homo sapiens
ggagagcagctgg

SEQ ID NO: 836476 - DNA, 12 bp, Homo sapiens
ggagagcaggct

SEQ ID NO: 836477 - DNA, 13 bp, Homo sapiens
ggagagcaggctg

SEQ ID NO: 836478 - DNA, 14 bp, Homo sapiens
ggagagccaacctc

SEQ ID NO: 836479 - DNA, 17 bp, Homo sapiens
ggagagccaacctcggc

SEQ ID NO: 836480 - DNA, 19 bp, Homo sapiens
ggagagccaacctcggctt

SEQ ID NO: 836481 - DNA, 14 bp, Homo sapiens
ggagagccactggg

SEQ ID NO: 836482 - DNA, 16 bp, Homo sapiens
ggagagccactgggcc

SEQ ID NO: 836483 - DNA, 22 bp, Homo sapiens
ggagccatgcgccccctccgcc

SEQ ID NO: 836484 - DNA, 23 bp, Homo sapiens
ggagccatgcgccccctccgccc

SEQ ID NO: 836485 - DNA, 16 bp, Homo sapiens
ggagcccacagcgagc

SEQ ID NO: 836486 - DNA, 13 bp, Homo sapiens
ggagcccagggca

SEQ ID NO: 836487 - DNA, 15 bp, Homo sapiens
ggagcccagggcatc

SEQ ID NO: 836488 - DNA, 20 bp, Homo sapiens
ggagcccatactcagcctgc

SEQ ID NO: 836489 - DNA, 21 bp, Homo sapiens
ggagcccatactcagcctgct

SEQ ID NO: 836490 - DNA, 18 bp, Homo sapiens
ggagccccagctaccctt

SEQ ID NO: 836491 - DNA, 20 bp, Homo sapiens
ggagccccaggcctctgtgt

SEQ ID NO: 836492 - DNA, 12 bp, Homo sapiens
ggagccccaggg

SEQ ID NO: 836493 - DNA, 13 bp, Homo sapiens
ggagcccccacca

SEQ ID NO: 836494 - DNA, 15 bp, Homo sapiens
ggagcccccagcaga

SEQ ID NO: 836495 - DNA, 19 bp, Homo sapiens
ggagcccccagcagaggca

SEQ ID NO: 836496 - DNA, 13 bp, Homo sapiens
ggagcccccgccc

SEQ ID NO: 836497 - DNA, 21 bp, Homo sapiens
ggagcccctcctcccccggct

SEQ ID NO: 836498 - DNA, 10 bp, Homo sapiens
ggagcccctg

SEQ ID NO: 836499 - DNA, 21 bp, Homo sapiens
ggagcccctgaaagcctcacg

SEQ ID NO: 836500 - DNA, 14 bp, Homo sapiens
ggagcccctgagtc

SEQ ID NO: 836501 - DNA, 16 bp, Homo sapiens
ggagcccctgggtggg

SEQ ID NO: 836502 - DNA, 21 bp, Homo sapiens
ggagcccctgggtgggtggtg

SEQ ID NO: 836503 - DNA, 20 bp, Homo sapiens
ggagcccgatattctccctg

SEQ ID NO: 836504 - DNA, 14 bp, Homo sapiens
ggagcccgcacccc

SEQ ID NO: 836505 - DNA, 20 bp, Homo sapiens
ggagcccgcacccccaccct

SEQ ID NO: 836506 - DNA, 12 bp, Homo sapiens
ggagccctcagg

SEQ ID NO: 836507 - DNA, 22 bp, Homo sapiens
ggagccctcaggctccccagaa

SEQ ID NO: 836508 - DNA, 16 bp, Homo sapiens
ggagccctgaggacct

SEQ ID NO: 836509 - DNA, 20 bp, Homo sapiens
ggagccctgttggcagctct

SEQ ID NO: 836510 - DNA, 13 bp, Homo sapiens
ggagcccttctct

SEQ ID NO: 836511 - DNA, 20 bp, Homo sapiens
ggagccgctggcagaaggga

SEQ ID NO: 836512 - DNA, 16 bp, Homo sapiens
ggagcctagaagctgg

SEQ ID NO: 836513 - DNA, 16 bp, Homo sapiens
ggagcctagctcctgc

SEQ ID NO: 836514 - DNA, 21 bp, Homo sapiens
ggagcctcatgttctcttccc

SEQ ID NO: 836515 - DNA, 12 bp, Homo sapiens
ggagcctcccca

SEQ ID NO: 836516 - DNA, 14 bp, Homo sapiens
ggagcctccccctc

SEQ ID NO: 836517 - DNA, 22 bp, Homo sapiens
ggagcctccgacgctgcctctc

SEQ ID NO: 836518 - DNA, 18 bp, Homo sapiens
ggagcctgaggcaggaga

SEQ ID NO: 836519 - DNA, 13 bp, Homo sapiens
ggagcctgcaggg

SEQ ID NO: 836520 - DNA, 21 bp, Homo sapiens
ggagcctgcagggtggtgctg

SEQ ID NO: 836521 - DNA, 22 bp, Homo sapiens
ggagcctgcagggtggtgctgg

SEQ ID NO: 836522 - DNA, 12 bp, Homo sapiens
ggagcctggggt

SEQ ID NO: 836523 - DNA, 18 bp, Homo sapiens
ggagcctggtccttccct

SEQ ID NO: 836524 - DNA, 12 bp, Homo sapiens
ggagcctgtgtt

SEQ ID NO: 836525 - DNA, 13 bp, Homo sapiens
ggagccttcccaa

SEQ ID NO: 836526 - DNA, 23 bp, Homo sapiens
ggagccttcccaagttgtgcttg

SEQ ID NO: 836527 - DNA, 19 bp, Homo sapiens
ggagccttgctgggccagg

SEQ ID NO: 836528 - DNA, 19 bp, Homo sapiens
ggagcctttggggggccac

SEQ ID NO: 836529 - DNA, 22 bp, Homo sapiens
ggagcgagcatgtcgtggacac

SEQ ID NO: 836530 - DNA, 13 bp, Homo sapiens
ggagcgaggtcag

SEQ ID NO: 836531 - DNA, 15 bp, Homo sapiens
ggagcgcacctgccc

SEQ ID NO: 836532 - DNA, 23 bp, Homo sapiens
ggagcgcacctgccccctggtgg

SEQ ID NO: 836533 - DNA, 15 bp, Homo sapiens
ggagcgcaggcagcg

SEQ ID NO: 836534 - DNA, 15 bp, Homo sapiens
ggagcgctagtgcct

SEQ ID NO: 836535 - DNA, 17 bp, Homo sapiens
ggagcgctagtgccttg

SEQ ID NO: 836536 - DNA, 16 bp, Homo sapiens
ggagcgggaggcggtg

SEQ ID NO: 836537 - DNA, 15 bp, Homo sapiens
ggagcgtggactggt

SEQ ID NO: 836538 - DNA, 19 bp, Homo sapiens
ggagcgtggactggttggt

SEQ ID NO: 836539 - DNA, 18 bp, Homo sapiens
ggagcgtttgctgtgcca

SEQ ID NO: 836540 - DNA, 18 bp, Homo sapiens
ggagctaacactggcccc

SEQ ID NO: 836541 - DNA, 17 bp, Homo sapiens
ggagctactgacattcc

SEQ ID NO: 836542 - DNA, 14 bp, Homo sapiens
ggagctactgatga

SEQ ID NO: 836543 - DNA, 15 bp, Homo sapiens
ggagctatcaggaac

SEQ ID NO: 836544 - DNA, 14 bp, Homo sapiens
ggagctcaccctgc

SEQ ID NO: 836545 - DNA, 15 bp, Homo sapiens
ggagctcaccctgcc

SEQ ID NO: 836546 - DNA, 17 bp, Homo sapiens
ggagctcaccctgcccg

SEQ ID NO: 836547 - DNA, 20 bp, Homo sapiens
ggagctcaccctgcccgctc

SEQ ID NO: 836548 - DNA, 17 bp, Homo sapiens
ggagctcatctgcaaaa

SEQ ID NO: 836549 - DNA, 17 bp, Homo sapiens
ggagctccactctgctt

SEQ ID NO: 836550 - DNA, 11 bp, Homo sapiens
ggagctcctgg

SEQ ID NO: 836551 - DNA, 12 bp, Homo sapiens
ggagctcctggc

SEQ ID NO: 836552 - DNA, 18 bp, Homo sapiens
ggagctcctggccaggat

SEQ ID NO: 836553 - DNA, 14 bp, Homo sapiens
ggagctcctgggac

SEQ ID NO: 836554 - DNA, 15 bp, Homo sapiens
ggagctcgcccctcc

SEQ ID NO: 836555 - DNA, 16 bp, Homo sapiens
ggagctcgcccctccc

SEQ ID NO: 836556 - DNA, 22 bp, Homo sapiens
ggagctcgcccctcccctcagc

SEQ ID NO: 836557 - DNA, 11 bp, Homo sapiens
ggagctctgcg

SEQ ID NO: 836558 - DNA, 14 bp, Homo sapiens
ggagctctgcgcca

SEQ ID NO: 836559 - DNA, 15 bp, Homo sapiens
ggagctctgcgccag

SEQ ID NO: 836560 - DNA, 14 bp, Homo sapiens
ggagctctggggac

SEQ ID NO: 836561 - DNA, 21 bp, Homo sapiens
ggagctctgtgggtctctgga

SEQ ID NO: 836562 - DNA, 18 bp, Homo sapiens
ggagctcttcaggcctcc

SEQ ID NO: 836563 - DNA, 16 bp, Homo sapiens
ggagctgaaaaggatc

SEQ ID NO: 836564 - DNA, 22 bp, Homo sapiens
ggagctgaagacctaaagtgct

SEQ ID NO: 836565 - DNA, 19 bp, Homo sapiens
ggagctgagaagaggagga

SEQ ID NO: 836566 - DNA, 17 bp, Homo sapiens
ggagctgagcagcctct

SEQ ID NO: 836567 - DNA, 22 bp, Homo sapiens
ggagctgagctggaaggggcca

SEQ ID NO: 836568 - DNA, 13 bp, Homo sapiens
ggagctgagggag

SEQ ID NO: 836569 - DNA, 22 bp, Homo sapiens
ggagctgagggagggagccatg

SEQ ID NO: 836570 - DNA, 18 bp, Homo sapiens
ggagctgatttccaggcc

SEQ ID NO: 836571 - DNA, 19 bp, Homo sapiens
ggagctgatttccaggccc

SEQ ID NO: 836572 - DNA, 12 bp, Homo sapiens
ggagctgcacac

SEQ ID NO: 836573 - DNA, 19 bp, Homo sapiens
ggagctgcagagcagcagc

SEQ ID NO: 836574 - DNA, 12 bp, Homo sapiens
ggagctgccaca

SEQ ID NO: 836575 - DNA, 13 bp, Homo sapiens
ggagctgccacag

SEQ ID NO: 836576 - DNA, 18 bp, Homo sapiens
ggagctgccgtgcctgtg

SEQ ID NO: 836577 - DNA, 17 bp, Homo sapiens
ggagctgcctgcagcac

SEQ ID NO: 836578 - DNA, 18 bp, Homo sapiens
ggagctgccttggctcag

SEQ ID NO: 836579 - DNA, 19 bp, Homo sapiens
ggagctgcgcttccctgca

SEQ ID NO: 836580 - DNA, 13 bp, Homo sapiens
ggagctgctggct

SEQ ID NO: 836581 - DNA, 12 bp, Homo sapiens
ggagctggcccc

SEQ ID NO: 836582 - DNA, 15 bp, Homo sapiens
ggagctggccccgct

SEQ ID NO: 836583 - DNA, 12 bp, Homo sapiens
ggagctggctgt

SEQ ID NO: 836584 - DNA, 17 bp, Homo sapiens
ggagctggctgtgcctg

SEQ ID NO: 836585 - DNA, 22 bp, Homo sapiens
ggagctggctgtgcctgcttct

SEQ ID NO: 836586 - DNA, 21 bp, Homo sapiens
ggagctgggacacttaacaga

SEQ ID NO: 836587 - DNA, 12 bp, Homo sapiens
ggagctgggagg

SEQ ID NO: 836588 - DNA, 19 bp, Homo sapiens
ggagctggggtctgggcag

SEQ ID NO: 836589 - DNA, 18 bp, Homo sapiens
ggagctgtcaccaaggaa

SEQ ID NO: 836590 - DNA, 19 bp, Homo sapiens
ggagctgtcaccaaggaaa

SEQ ID NO: 836591 - DNA, 16 bp, Homo sapiens
ggagcttacccaagct

SEQ ID NO: 836592 - DNA, 20 bp, Homo sapiens
ggagcttcatggcagaaggc

SEQ ID NO: 836593 - DNA, 13 bp, Homo sapiens
ggagcttcctggc

SEQ ID NO: 836594 - DNA, 20 bp, Homo sapiens
ggagcttcctggctctgggg

SEQ ID NO: 836595 - DNA, 16 bp, Homo sapiens
ggagcttgggactcag

SEQ ID NO: 836596 - DNA, 21 bp, Homo sapiens
ggagcttgggcagtgccccag

SEQ ID NO: 836597 - DNA, 17 bp, Homo sapiens
ggagcttgtggagttga

SEQ ID NO: 836598 - DNA, 14 bp, Homo sapiens
ggagctttctcaat

SEQ ID NO: 836599 - DNA, 16 bp, Homo sapiens
ggaggaaaaaagaacc

SEQ ID NO: 836600 - DNA, 21 bp, Homo sapiens
ggaggaaaaccaagccgtggc

SEQ ID NO: 836601 - DNA, 13 bp, Homo sapiens
ggaggaaaaggaa

SEQ ID NO: 836602 - DNA, 16 bp, Homo sapiens
ggaggaaagggcctgg

SEQ ID NO: 836603 - DNA, 24 bp, Homo sapiens
ggaggaaagggcctggccagtcct

SEQ ID NO: 836604 - DNA, 22 bp, Homo sapiens
ggaggaacttgctgctgtgcct

SEQ ID NO: 836605 - DNA, 14 bp, Homo sapiens
ggaggaagagccac

SEQ ID NO: 836606 - DNA, 20 bp, Homo sapiens
ggaggcttgtcagagctggg

SEQ ID NO: 836607 - DNA, 22 bp, Homo sapiens
ggaggcttgtcagagctgggag

SEQ ID NO: 836608 - DNA, 17 bp, Homo sapiens
ggaggcttttcactgcc

SEQ ID NO: 836609 - DNA, 20 bp, Homo sapiens
ggagggaagagtggaggtgg

SEQ ID NO: 836610 - DNA, 21 bp, Homo sapiens
ggagggaaggataaagccact

SEQ ID NO: 836611 - DNA, 12 bp, Homo sapiens
ggagggagactg

SEQ ID NO: 836612 - DNA, 14 bp, Homo sapiens
ggagggagccatgg

SEQ ID NO: 836613 - DNA, 18 bp, Homo sapiens
ggagggaggccgggcggt

SEQ ID NO: 836614 - DNA, 14 bp, Homo sapiens
ggagggagggaagt

SEQ ID NO: 836615 - DNA, 20 bp, Homo sapiens
ggagggagtcccagagccct

SEQ ID NO: 836616 - DNA, 22 bp, Homo sapiens
ggagggagtgttcaaaatacta

SEQ ID NO: 836617 - DNA, 11 bp, Homo sapiens
ggagggatcag

SEQ ID NO: 836618 - DNA, 16 bp, Homo sapiens
ggagggatcagccccg

SEQ ID NO: 836619 - DNA, 22 bp, Homo sapiens
ggagggatcagccccgcctgtc

SEQ ID NO: 836620 - DNA, 19 bp, Homo sapiens
ggagggcactggagctggg

SEQ ID NO: 836621 - DNA, 23 bp, Homo sapiens
ggagggcactggagctgggaggt

SEQ ID NO: 836622 - DNA, 14 bp, Homo sapiens
ggagggcacttcag

SEQ ID NO: 836623 - DNA, 17 bp, Homo sapiens
ggagggcacttcaggtc

SEQ ID NO: 836624 - DNA, 12 bp, Homo sapiens
ggagggcagagc

SEQ ID NO: 836625 - DNA, 13 bp, Homo sapiens
ggagggcagagcc

SEQ ID NO: 836626 - DNA, 18 bp, Homo sapiens
ggagggcagagccatggg

SEQ ID NO: 836627 - DNA, 23 bp, Homo sapiens
ggagggcagagccatgggcctgg

SEQ ID NO: 836628 - DNA, 19 bp, Homo sapiens
ggagggccacatgggaggc

SEQ ID NO: 836629 - DNA, 21 bp, Homo sapiens
ggagggccagggaggcagagc

SEQ ID NO: 836630 - DNA, 16 bp, Homo sapiens
ggagggccctacctga

SEQ ID NO: 836631 - DNA, 20 bp, Homo sapiens
ggagggccgtaccccaccct

SEQ ID NO: 836632 - DNA, 20 bp, Homo sapiens
ggagggcggcaggggcctgg

SEQ ID NO: 836633 - DNA, 21 bp, Homo sapiens
ggagggcggcaggggcctgga

SEQ ID NO: 836634 - DNA, 15 bp, Homo sapiens
ggagggcgtcaggca

SEQ ID NO: 836635 - DNA, 16 bp, Homo sapiens
ggagggcgtcaggcag

SEQ ID NO: 836636 - DNA, 15 bp, Homo sapiens
ggagggctcctgggg

SEQ ID NO: 836637 - DNA, 19 bp, Homo sapiens
ggagggctcctggggcaga

SEQ ID NO: 836638 - DNA, 23 bp, Homo sapiens
ggagggctggtggccacgaggtt

SEQ ID NO: 836639 - DNA, 17 bp, Homo sapiens
ggagggcttggcccagc

SEQ ID NO: 836640 - DNA, 18 bp, Homo sapiens
ggaggggaaaaaaatgtt

SEQ ID NO: 836641 - DNA, 16 bp, Homo sapiens
ggaggggaaacaatga

SEQ ID NO: 836642 - DNA, 17 bp, Homo sapiens
ggaggggaaacaatgaa

SEQ ID NO: 836643 - DNA, 16 bp, Homo sapiens
ggaggggaagaggcct

SEQ ID NO: 836644 - DNA, 15 bp, Homo sapiens
ggaggggaaggggcc

SEQ ID NO: 836645 - DNA, 12 bp, Homo sapiens
ggaggggacaga

SEQ ID NO: 836646 - DNA, 13 bp, Homo sapiens
ggaggggacagag

SEQ ID NO: 836647 - DNA, 14 bp, Homo sapiens
ggaggggacagagc

SEQ ID NO: 836648 - DNA, 16 bp, Homo sapiens
ggaggggacagagctg

SEQ ID NO: 836649 - DNA, 17 bp, Homo sapiens
ggaggggacagagctga

SEQ ID NO: 836650 - DNA, 17 bp, Homo sapiens
ggaggggacagaggccc

SEQ ID NO: 836651 - DNA, 14 bp, Homo sapiens
ggaggggagggtaa

SEQ ID NO: 836652 - DNA, 13 bp, Homo sapiens
ggaggggcaggct

SEQ ID NO: 836653 - DNA, 12 bp, Homo sapiens
ggaggggccctc

SEQ ID NO: 836654 - DNA, 15 bp, Homo sapiens
ggaggggccctcagg

SEQ ID NO: 836655 - DNA, 18 bp, Homo sapiens
ggaggggccctcaggcca

SEQ ID NO: 836656 - DNA, 18 bp, Homo sapiens
ggaggggcctagggagcc

SEQ ID NO: 836657 - DNA, 12 bp, Homo sapiens
ggaggggcctgg

SEQ ID NO: 836658 - DNA, 15 bp, Homo sapiens
ggaggggcctgggca

SEQ ID NO: 836659 - DNA, 16 bp, Homo sapiens
ggaggggcctgggcag

SEQ ID NO: 836660 - DNA, 23 bp, Homo sapiens
ggaggggcctgggcagccccaca

SEQ ID NO: 836661 - DNA, 16 bp, Homo sapiens
ggaggggcgcccaggg

SEQ ID NO: 836662 - DNA, 20 bp, Homo sapiens
ggaggggcgctggcccagcc

SEQ ID NO: 836663 - DNA, 13 bp, Homo sapiens
ggaggggctgggg

SEQ ID NO: 836664 - DNA, 18 bp, Homo sapiens
ggagggggcacggcaggc

SEQ ID NO: 836665 - DNA, 21 bp, Homo sapiens
ggagggggctatttctctccc

SEQ ID NO: 836666 - DNA, 16 bp, Homo sapiens
ggagggggcttgaagc

SEQ ID NO: 836667 - DNA, 15 bp, Homo sapiens
ggaggggggtgctgg

SEQ ID NO: 836668 - DNA, 16 bp, Homo sapiens
ggagggggtcctcctc

SEQ ID NO: 836669 - DNA, 19 bp, Homo sapiens
ggagggggtgagaggcagg

SEQ ID NO: 836670 - DNA, 15 bp, Homo sapiens
ggaggggtgtggctc

SEQ ID NO: 836671 - DNA, 16 bp, Homo sapiens
ggaggggttgttttgg

SEQ ID NO: 836672 - DNA, 16 bp, Homo sapiens
ggaggggtttgggagt

SEQ ID NO: 836673 - DNA, 13 bp, Homo sapiens
ggagggtaaataa

SEQ ID NO: 836674 - DNA, 18 bp, Homo sapiens
ggagggtcttttaccctg

SEQ ID NO: 836675 - DNA, 20 bp, Homo sapiens
ggagggtgggggccacctgc

SEQ ID NO: 836676 - DNA, 16 bp, Homo sapiens
ggagggttagcctgca

SEQ ID NO: 836677 - DNA, 18 bp, Homo sapiens
ggagggttagcctgcacc

SEQ ID NO: 836678 - DNA, 19 bp, Homo sapiens
ggagggttggggaggggcg

SEQ ID NO: 836679 - DNA, 14 bp, Homo sapiens
ggaggtaatgacca

SEQ ID NO: 836680 - DNA, 20 bp, Homo sapiens
ggaggtcaaggctgcagtga

SEQ ID NO: 836681 - DNA, 17 bp, Homo sapiens
ggaggtcactggaaagg

SEQ ID NO: 836682 - DNA, 16 bp, Homo sapiens
ggaggtcatctgacct

SEQ ID NO: 836683 - DNA, 18 bp, Homo sapiens
ggaggtccaagcagagtg

SEQ ID NO: 836684 - DNA, 18 bp, Homo sapiens
ggaggtcgaggcaggagg

SEQ ID NO: 836685 - DNA, 17 bp, Homo sapiens
ggaggtctcgtcccagc

SEQ ID NO: 836686 - DNA, 14 bp, Homo sapiens
ggaggtgaagaggc

SEQ ID NO: 836687 - DNA, 18 bp, Homo sapiens
ggaggtgaagaggctgct

SEQ ID NO: 836688 - DNA, 22 bp, Homo sapiens
ggaggtgctgctctagggcagg

SEQ ID NO: 836689 - DNA, 14 bp, Homo sapiens
ggaggtgctggggg

SEQ ID NO: 836690 - DNA, 18 bp, Homo sapiens
ggaggtgctgggggagcc

SEQ ID NO: 836691 - DNA, 20 bp, Homo sapiens
ggaggtggaagaagggagaa

SEQ ID NO: 836692 - DNA, 19 bp, Homo sapiens
ggaggtggaggttgcagtg

SEQ ID NO: 836693 - DNA, 15 bp, Homo sapiens
ggaggtggcagccct

SEQ ID NO: 836694 - DNA, 18 bp, Homo sapiens
ggaggtggctatggccac

SEQ ID NO: 836695 - DNA, 17 bp, Homo sapiens
ggaggtgggaggccagg

SEQ ID NO: 836696 - DNA, 12 bp, Homo sapiens
ggaggtgggcat

SEQ ID NO: 836697 - DNA, 22 bp, Homo sapiens
ggaggtgggcatgccaccctca

SEQ ID NO: 836698 - DNA, 23 bp, Homo sapiens
ggaggtgggccacacccaggaag

SEQ ID NO: 836699 - DNA, 15 bp, Homo sapiens
ggaggtggggcctca

SEQ ID NO: 836700 - DNA, 21 bp, Homo sapiens
ggaggtgggggcctcctcagc

SEQ ID NO: 836701 - DNA, 18 bp, Homo sapiens
ggaggtgtggagccgagg

SEQ ID NO: 836702 - DNA, 14 bp, Homo sapiens
ggaggttctcagag

SEQ ID NO: 836703 - DNA, 14 bp, Homo sapiens
ggaggttgcagtga

SEQ ID NO: 836704 - DNA, 19 bp, Homo sapiens
ggaggttgctgtacaggaa

SEQ ID NO: 836705 - DNA, 16 bp, Homo sapiens
ggaggttggtgactga

SEQ ID NO: 836706 - DNA, 14 bp, Homo sapiens
ggaggttggttcct

SEQ ID NO: 836707 - DNA, 13 bp, Homo sapiens
ggaggttgtggat

SEQ ID NO: 836708 - DNA, 22 bp, Homo sapiens
ggaggtttaccggttgtttaga

SEQ ID NO: 836709 - DNA, 15 bp, Homo sapiens
ggaggtttgcctgtg

SEQ ID NO: 836710 - DNA, 15 bp, Homo sapiens
ggagtaagtgtacaa

SEQ ID NO: 836711 - DNA, 16 bp, Homo sapiens
ggagtaagtgtacaat

SEQ ID NO: 836712 - DNA, 16 bp, Homo sapiens
ggagtaatcaggcagc

SEQ ID NO: 836713 - DNA, 20 bp, Homo sapiens
ggagtatgttgtcataacat

SEQ ID NO: 836714 - DNA, 13 bp, Homo sapiens
ggagtattgaatg

SEQ ID NO: 836715 - DNA, 15 bp, Homo sapiens
ggagtcagccaggag

SEQ ID NO: 836716 - DNA, 15 bp, Homo sapiens
ggagtcaggggctct

SEQ ID NO: 836717 - DNA, 18 bp, Homo sapiens
ggagtcaggggctctgtg

SEQ ID NO: 836718 - DNA, 23 bp, Homo sapiens
ggagtcagtaggtccaagggcca

SEQ ID NO: 836719 - DNA, 15 bp, Homo sapiens
ggagtccaggcacag

SEQ ID NO: 836720 - DNA, 17 bp, Homo sapiens
ggagtcggagtggacac

SEQ ID NO: 836721 - DNA, 18 bp, Homo sapiens
ggagtcggagtggacacc

SEQ ID NO: 836722 - DNA, 23 bp, Homo sapiens
ggagtcggttagtcattgataga

SEQ ID NO: 836723 - DNA, 14 bp, Homo sapiens
ggagtctatgctta

SEQ ID NO: 836724 - DNA, 15 bp, Homo sapiens
ggagtctcaacatgt

SEQ ID NO: 836725 - DNA, 21 bp, Homo sapiens
ggagtctcaggaggaggctgc

SEQ ID NO: 836726 - DNA, 21 bp, Homo sapiens
ggagtctccagtggttgctgt

SEQ ID NO: 836727 - DNA, 14 bp, Homo sapiens
ggagtctccctccg

SEQ ID NO: 836728 - DNA, 22 bp, Homo sapiens
ggatggtggactacaaaataca

SEQ ID NO: 836729 - DNA, 20 bp, Homo sapiens
ggatggtggcacaggcactg

SEQ ID NO: 836730 - DNA, 12 bp, Homo sapiens
ggatggtgtctc

SEQ ID NO: 836731 - DNA, 11 bp, Homo sapiens
ggatggtttgt

SEQ ID NO: 836732 - DNA, 15 bp, Homo sapiens
ggatgtaaccaagct

SEQ ID NO: 836733 - DNA, 16 bp, Homo sapiens
ggatgtacatttccaa

SEQ ID NO: 836734 - DNA, 16 bp, Homo sapiens
ggatgtatggggaatc

SEQ ID NO: 836735 - DNA, 16 bp, Homo sapiens
ggatgtcacagggcca

SEQ ID NO: 836736 - DNA, 12 bp, Homo sapiens
ggatgtcacagt

SEQ ID NO: 836737 - DNA, 14 bp, Homo sapiens
ggatgtcacagtcc

SEQ ID NO: 836738 - DNA, 21 bp, Homo sapiens
ggatgtcatagccaaagccag

SEQ ID NO: 836739 - DNA, 17 bp, Homo sapiens
ggatgtcccctgtccca

SEQ ID NO: 836740 - DNA, 22 bp, Homo sapiens
ggatgtccctgggccagggtct

SEQ ID NO: 836741 - DNA, 13 bp, Homo sapiens
ggatgtgggcagc

SEQ ID NO: 836742 - DNA, 14 bp, Homo sapiens
ggatgtgggcagct

SEQ ID NO: 836743 - DNA, 18 bp, Homo sapiens
ggatgtgggtctttttct

SEQ ID NO: 836744 - DNA, 14 bp, Homo sapiens
ggatgtggttaccg

SEQ ID NO: 836745 - DNA, 17 bp, Homo sapiens
ggatgtgtgctttccca

SEQ ID NO: 836746 - DNA, 17 bp, Homo sapiens
ggatgtgtggggcatgg

SEQ ID NO: 836747 - DNA, 19 bp, Homo sapiens
ggatgttatgaacagctgt

SEQ ID NO: 836748 - DNA, 23 bp, Homo sapiens
ggatgttctgcctctccctgggt

SEQ ID NO: 836749 - DNA, 14 bp, Homo sapiens
ggatgttgctcaga

SEQ ID NO: 836750 - DNA, 22 bp, Homo sapiens
ggatgttgcttctgaatcactg

SEQ ID NO: 836751 - DNA, 23 bp, Homo sapiens
ggatgttgcttctgaatcactgt

SEQ ID NO: 836752 - DNA, 14 bp, Homo sapiens
ggatgttgtaaata

SEQ ID NO: 836753 - DNA, 16 bp, Homo sapiens
ggatgtttacctggtg

SEQ ID NO: 836754 - DNA, 20 bp, Homo sapiens
ggatgtttagcagtggctgg

SEQ ID NO: 836755 - DNA, 15 bp, Homo sapiens
ggatgtttggaaaaa

SEQ ID NO: 836756 - DNA, 18 bp, Homo sapiens
ggattacttctctataaa

SEQ ID NO: 836757 - DNA, 23 bp, Homo sapiens
ggattattactaattctatttct

SEQ ID NO: 836758 - DNA, 19 bp, Homo sapiens
ggattattagaatcaaaca

SEQ ID NO: 836759 - DNA, 20 bp, Homo sapiens
ggattcagtttctaaaattg

SEQ ID NO: 836760 - DNA, 16 bp, Homo sapiens
ggattcattacagctt

SEQ ID NO: 836761 - DNA, 22 bp, Homo sapiens
ggattcattctcataattccta

SEQ ID NO: 836762 - DNA, 22 bp, Homo sapiens
ggattccactcgtgtgtttcta

SEQ ID NO: 836763 - DNA, 21 bp, Homo sapiens
ggattccccctgccctgtgcc

SEQ ID NO: 836764 - DNA, 21 bp, Homo sapiens
ggattccttgtgttttgtcct

SEQ ID NO: 836765 - DNA, 23 bp, Homo sapiens
ggattctactttaagcactacat

SEQ ID NO: 836766 - DNA, 21 bp, Homo sapiens
ggattctcatgggaaggggag

SEQ ID NO: 836767 - DNA, 16 bp, Homo sapiens
ggattctctaaccttt

SEQ ID NO: 836768 - DNA, 18 bp, Homo sapiens
ggattctggttccagggt

SEQ ID NO: 836769 - DNA, 19 bp, Homo sapiens
ggattctggttccagggtc

SEQ ID NO: 836770 - DNA, 22 bp, Homo sapiens
ggattctgtgcctccaggacca

SEQ ID NO: 836771 - DNA, 12 bp, Homo sapiens
ggattctttaaa

SEQ ID NO: 836772 - DNA, 15 bp, Homo sapiens
ggattctttccccag

SEQ ID NO: 836773 - DNA, 17 bp, Homo sapiens
ggattctttccccagag

SEQ ID NO: 836774 - DNA, 20 bp, Homo sapiens
ggattctttgacatttggtg

SEQ ID NO: 836775 - DNA, 18 bp, Homo sapiens
ggattgcacgtggcctct

SEQ ID NO: 836776 - DNA, 16 bp, Homo sapiens
ggattgcatcctgctg

SEQ ID NO: 836777 - DNA, 17 bp, Homo sapiens
ggattgcatcctgctgg

SEQ ID NO: 836778 - DNA, 23 bp, Homo sapiens
ggattgccacagctcaactcggg

SEQ ID NO: 836779 - DNA, 17 bp, Homo sapiens
ggattgcctttaatatt

SEQ ID NO: 836780 - DNA, 20 bp, Homo sapiens
ggattgcgcctttgtattat

SEQ ID NO: 836781 - DNA, 22 bp, Homo sapiens
ggattggacaggagatcagcag

SEQ ID NO: 836782 - DNA, 18 bp, Homo sapiens
ggattggggaagactgtg

SEQ ID NO: 836783 - DNA, 19 bp, Homo sapiens
ggattggggaagactgtgg

SEQ ID NO: 836784 - DNA, 21 bp, Homo sapiens
ggattggggggaaagagggag

SEQ ID NO: 836785 - DNA, 12 bp, Homo sapiens
ggattgtggaaa

SEQ ID NO: 836786 - DNA, 15 bp, Homo sapiens
ggattgtgtatctgt

SEQ ID NO: 836787 - DNA, 17 bp, Homo sapiens
ggatttaaaaactggaa

SEQ ID NO: 836788 - DNA, 17 bp, Homo sapiens
ggatttaaaagcctgct

SEQ ID NO: 836789 - DNA, 16 bp, Homo sapiens
ggatttaacagaaatg

SEQ ID NO: 836790 - DNA, 21 bp, Homo sapiens
ggatttaacagtcatttaaaa

SEQ ID NO: 836791 - DNA, 20 bp, Homo sapiens
ggatttatctttaggccagg

SEQ ID NO: 836792 - DNA, 17 bp, Homo sapiens
ggatttatgtattttga

SEQ ID NO: 836793 - DNA, 11 bp, Homo sapiens
ggatttcattt

SEQ ID NO: 836794 - DNA, 13 bp, Homo sapiens
ggatttccctgca

SEQ ID NO: 836795 - DNA, 21 bp, Homo sapiens
ggatttctaacagtccttgct

SEQ ID NO: 836796 - DNA, 11 bp, Homo sapiens
ggatttcttca

SEQ ID NO: 836797 - DNA, 19 bp, Homo sapiens
ggatttcttcgctgctcta

SEQ ID NO: 836798 - DNA, 14 bp, Homo sapiens
ggatttgccccttc

SEQ ID NO: 836799 - DNA, 22 bp, Homo sapiens
ggatttgccccttcccatctct

SEQ ID NO: 836800 - DNA, 17 bp, Homo sapiens
ggattttaatttcagga

SEQ ID NO: 836801 - DNA, 20 bp, Homo sapiens
ggattttaatttcaggaaaa

SEQ ID NO: 836802 - DNA, 13 bp, Homo sapiens
ggattttaccaaa

SEQ ID NO: 836803 - DNA, 16 bp, Homo sapiens
ggatttttccatgtgt

SEQ ID NO: 836804 - DNA, 13 bp, Homo sapiens
ggatttttgagtc

SEQ ID NO: 836805 - DNA, 12 bp, Homo sapiens
ggattttttcca

SEQ ID NO: 836806 - DNA, 18 bp, Homo sapiens
ggcaaaactttggcactg

SEQ ID NO: 836807 - DNA, 23 bp, Homo sapiens
ggcaaaatgagagggcagtgttt

SEQ ID NO: 836808 - DNA, 13 bp, Homo sapiens
ggcaaaattgcaa

SEQ ID NO: 836809 - DNA, 13 bp, Homo sapiens
ggcaaacaggcag

SEQ ID NO: 836810 - DNA, 23 bp, Homo sapiens
ggcaaacaggcagttggccagag

SEQ ID NO: 836811 - DNA, 22 bp, Homo sapiens
ggcaaagccacaaggctggcca

SEQ ID NO: 836812 - DNA, 18 bp, Homo sapiens
ggcaaagcttttagaaat

SEQ ID NO: 836813 - DNA, 19 bp, Homo sapiens
ggcaaaggaaggtggatgg

SEQ ID NO: 836814 - DNA, 12 bp, Homo sapiens
ggcaaaggcaga

SEQ ID NO: 836815 - DNA, 15 bp, Homo sapiens
ggcaaaggcagagga

SEQ ID NO: 836816 - DNA, 14 bp, Homo sapiens
ggcaaaggcagggc

SEQ ID NO: 836817 - DNA, 16 bp, Homo sapiens
ggcaaaggcagggcca

SEQ ID NO: 836818 - DNA, 22 bp, Homo sapiens
ggcaaagtacaaaattgcctat

SEQ ID NO: 836819 - DNA, 21 bp, Homo sapiens
ggcaaagtacttgtcatagac

SEQ ID NO: 836820 - DNA, 16 bp, Homo sapiens
ggcaaatcagttacta

SEQ ID NO: 836821 - DNA, 14 bp, Homo sapiens
ggcaacacagaggc

SEQ ID NO: 836822 - DNA, 22 bp, Homo sapiens
ggcaacactgcaggacagtcaa

SEQ ID NO: 836823 - DNA, 18 bp, Homo sapiens
ggcaacagatcagtaaag

SEQ ID NO: 836824 - DNA, 20 bp, Homo sapiens
ggcaacagatcagtaaagaa

SEQ ID NO: 836825 - DNA, 19 bp, Homo sapiens
ggcaaccaactgccccagg

SEQ ID NO: 836826 - DNA, 17 bp, Homo sapiens
ggcaaccacatgtccca

SEQ ID NO: 836827 - DNA, 16 bp, Homo sapiens
ggcaaccactaagaat

SEQ ID NO: 836828 - DNA, 23 bp, Homo sapiens
ggcaaccccagttctgctcctct

SEQ ID NO: 836829 - DNA, 17 bp, Homo sapiens
ggcaacgacggtttcaa

SEQ ID NO: 836830 - DNA, 15 bp, Homo sapiens
ggcaacgtagcctgg

SEQ ID NO: 836831 - DNA, 20 bp, Homo sapiens
ggcaactgaggcagacagca

SEQ ID NO: 836832 - DNA, 12 bp, Homo sapiens
ggcaagaaaagg

SEQ ID NO: 836833 - DNA, 18 bp, Homo sapiens
ggcaagaacccaagtgcc

SEQ ID NO: 836834 - DNA, 16 bp, Homo sapiens
ggcaagagcagatact

SEQ ID NO: 836835 - DNA, 19 bp, Homo sapiens
ggcaagagcccccttgaca

SEQ ID NO: 836836 - DNA, 13 bp, Homo sapiens
ggcaagagggagg

SEQ ID NO: 836837 - DNA, 14 bp, Homo sapiens
ggcaagagggaggg

SEQ ID NO: 836838 - DNA, 15 bp, Homo sapiens
ggcaagagggggacc

SEQ ID NO: 836839 - DNA, 12 bp, Homo sapiens
ggcaagaggggt

SEQ ID NO: 836840 - DNA, 13 bp, Homo sapiens
ggcaagcagggaa

SEQ ID NO: 836841 - DNA, 13 bp, Homo sapiens
ggcaagccacagg

SEQ ID NO: 836842 - DNA, 16 bp, Homo sapiens
ggcaagccacaggaag

SEQ ID NO: 836843 - DNA, 18 bp, Homo sapiens
ggcaagccacaggaagga

SEQ ID NO: 836844 - DNA, 20 bp, Homo sapiens
ggcaagccacaggaaggagg

SEQ ID NO: 836845 - DNA, 13 bp, Homo sapiens
ggcaagccagggc

SEQ ID NO: 836846 - DNA, 15 bp, Homo sapiens
ggcaagccagggccc

SEQ ID NO: 836847 - DNA, 16 bp, Homo sapiens
ggcaagccagggccca

SEQ ID NO: 836848 - DNA, 17 bp, Homo sapiens
ggcaagccagggcccag

SEQ ID NO: 836849 - DNA, 19 bp, Homo sapiens
ggcaagccagggcccagag

SEQ ID NO: 836850 - DNA, 12 bp, Homo sapiens
ggcactgaggga

SEQ ID NO: 836851 - DNA, 19 bp, Homo sapiens
ggcactgcagtctgcagag

SEQ ID NO: 836852 - DNA, 21 bp, Homo sapiens
ggcactgccttctcctctctg

SEQ ID NO: 836853 - DNA, 18 bp, Homo sapiens
ggcactgcgatcaggaag

SEQ ID NO: 836854 - DNA, 21 bp, Homo sapiens
ggcactggccacccctcccca

SEQ ID NO: 836855 - DNA, 14 bp, Homo sapiens
ggcactggcccagg

SEQ ID NO: 836856 - DNA, 20 bp, Homo sapiens
ggcactgggaggcagggctc

SEQ ID NO: 836857 - DNA, 12 bp, Homo sapiens
ggcactgggctg

SEQ ID NO: 836858 - DNA, 13 bp, Homo sapiens
ggcactgggctgt

SEQ ID NO: 836859 - DNA, 18 bp, Homo sapiens
ggcactgggtacccaagt

SEQ ID NO: 836860 - DNA, 12 bp, Homo sapiens
ggcactggtggg

SEQ ID NO: 836861 - DNA, 12 bp, Homo sapiens
ggcactgttaat

SEQ ID NO: 836862 - DNA, 20 bp, Homo sapiens
ggcacttaatttgtaaactt

SEQ ID NO: 836863 - DNA, 22 bp, Homo sapiens
ggcacttagcccaagaggtctg

SEQ ID NO: 836864 - DNA, 21 bp, Homo sapiens
ggcacttctgccttgagtccc

SEQ ID NO: 836865 - DNA, 18 bp, Homo sapiens
ggcacttgtatttaattc

SEQ ID NO: 836866 - DNA, 23 bp, Homo sapiens
ggcagaaaacggagagtgcttgg

SEQ ID NO: 836867 - DNA, 17 bp, Homo sapiens
ggcagaaaagaggagac

SEQ ID NO: 836868 - DNA, 22 bp, Homo sapiens
ggcagaaaagaggagaccctgg

SEQ ID NO: 836869 - DNA, 14 bp, Homo sapiens
ggcagaaaggaaaa

SEQ ID NO: 836870 - DNA, 19 bp, Homo sapiens
ggcagaactctctgtcttc

SEQ ID NO: 836871 - DNA, 21 bp, Homo sapiens
ggcagaactgagctcctctgg

SEQ ID NO: 836872 - DNA, 17 bp, Homo sapiens
ggcagaagaattgaacc

SEQ ID NO: 836873 - DNA, 22 bp, Homo sapiens
ggcagaagaattgaacccagga

SEQ ID NO: 836874 - DNA, 15 bp, Homo sapiens
ggcagaagactagag

SEQ ID NO: 836875 - DNA, 14 bp, Homo sapiens
ggcagaagggaatt

SEQ ID NO: 836876 - DNA, 15 bp, Homo sapiens
ggcagaagggagaag

SEQ ID NO: 836877 - DNA, 15 bp, Homo sapiens
ggcagaagtgagccc

SEQ ID NO: 836878 - DNA, 18 bp, Homo sapiens
ggcagaagtgagcccccc

SEQ ID NO: 836879 - DNA, 20 bp, Homo sapiens
ggcagaagtgtcaccctgtg

SEQ ID NO: 836880 - DNA, 15 bp, Homo sapiens
ggcagacaaccttgt

SEQ ID NO: 836881 - DNA, 21 bp, Homo sapiens
ggcagacacggatctgagaat

SEQ ID NO: 836882 - DNA, 13 bp, Homo sapiens
ggcagacagcagc

SEQ ID NO: 836883 - DNA, 14 bp, Homo sapiens
ggcagacagcagct

SEQ ID NO: 836884 - DNA, 16 bp, Homo sapiens
ggcagacagcagctca

SEQ ID NO: 836885 - DNA, 17 bp, Homo sapiens
ggcagactacacaggat

SEQ ID NO: 836886 - DNA, 19 bp, Homo sapiens
ggcagactcaaggggctgg

SEQ ID NO: 836887 - DNA, 17 bp, Homo sapiens
ggcagagaaggcctctt

SEQ ID NO: 836888 - DNA, 18 bp, Homo sapiens
ggcagagaatctcttggg

SEQ ID NO: 836889 - DNA, 21 bp, Homo sapiens
ggcagagaatctcttgggagt

SEQ ID NO: 836890 - DNA, 23 bp, Homo sapiens
ggcagagaatctcttgggagtct

SEQ ID NO: 836891 - DNA, 21 bp, Homo sapiens
ggcagagaatggctgggtcag

SEQ ID NO: 836892 - DNA, 18 bp, Homo sapiens
ggcagagacctccaataa

SEQ ID NO: 836893 - DNA, 15 bp, Homo sapiens
ggcagagaggagtga

SEQ ID NO: 836894 - DNA, 17 bp, Homo sapiens
ggcagagccaggaagat

SEQ ID NO: 836895 - DNA, 16 bp, Homo sapiens
ggcagagccataatgg

SEQ ID NO: 836896 - DNA, 14 bp, Homo sapiens
ggcagagccatggg

SEQ ID NO: 836897 - DNA, 19 bp, Homo sapiens
ggcagagccatgggcctgg

SEQ ID NO: 836898 - DNA, 23 bp, Homo sapiens
ggcagagccatgggcctgggcct

SEQ ID NO: 836899 - DNA, 12 bp, Homo sapiens
ggcagagcctct

SEQ ID NO: 836900 - DNA, 22 bp, Homo sapiens
ggcagagcctttggatgaccag

SEQ ID NO: 836901 - DNA, 18 bp, Homo sapiens
ggcagagcgggagggagt

SEQ ID NO: 836902 - DNA, 16 bp, Homo sapiens
ggcagagctgagggcc

SEQ ID NO: 836903 - DNA, 19 bp, Homo sapiens
ggcagagctgagggccctg

SEQ ID NO: 836904 - DNA, 20 bp, Homo sapiens
ggcagagctggagcccccag

SEQ ID NO: 836905 - DNA, 19 bp, Homo sapiens
ggcagagctggctctgagc

SEQ ID NO: 836906 - DNA, 21 bp, Homo sapiens
ggcagaggaatttggctgctt

SEQ ID NO: 836907 - DNA, 20 bp, Homo sapiens
ggcagagggaatgttccctg

SEQ ID NO: 836908 - DNA, 23 bp, Homo sapiens
ggcagagggaatgttccctgcac

SEQ ID NO: 836909 - DNA, 20 bp, Homo sapiens
ggcagagggagaatccaagg

SEQ ID NO: 836910 - DNA, 19 bp, Homo sapiens
ggcagagggcagaggctgg

SEQ ID NO: 836911 - DNA, 13 bp, Homo sapiens
ggcagagggctgg

SEQ ID NO: 836912 - DNA, 14 bp, Homo sapiens
ggcagagggctgga

SEQ ID NO: 836913 - DNA, 20 bp, Homo sapiens
ggcagagggctggaggccca

SEQ ID NO: 836914 - DNA, 17 bp, Homo sapiens
ggcagaggggcagccgc

SEQ ID NO: 836915 - DNA, 19 bp, Homo sapiens
ggcagaggttgcagtgagc

SEQ ID NO: 836916 - DNA, 19 bp, Homo sapiens
ggcagagttacagttctgt

SEQ ID NO: 836917 - DNA, 14 bp, Homo sapiens
ggcagagttgtaaa

SEQ ID NO: 836918 - DNA, 21 bp, Homo sapiens
ggcagagtttgtgtgttgtct

SEQ ID NO: 836919 - DNA, 15 bp, Homo sapiens
ggcagatctgtgccc

SEQ ID NO: 836920 - DNA, 13 bp, Homo sapiens
ggcagatggagcc

SEQ ID NO: 836921 - DNA, 16 bp, Homo sapiens
ggcagatggagcccat

SEQ ID NO: 836922 - DNA, 22 bp, Homo sapiens
ggcagatgtaaatgatgtgttg

SEQ ID NO: 836923 - DNA, 15 bp, Homo sapiens
ggcagatgtccccca

SEQ ID NO: 836924 - DNA, 15 bp, Homo sapiens
ggcagatgtcttccc

SEQ ID NO: 836925 - DNA, 18 bp, Homo sapiens
ggcagatgtcttccctgg

SEQ ID NO: 836926 - DNA, 21 bp, Homo sapiens
ggcagatgtcttccctgggct

SEQ ID NO: 836927 - DNA, 16 bp, Homo sapiens
ggcagatgtggggctg

SEQ ID NO: 836928 - DNA, 19 bp, Homo sapiens
ggcagatgttttgggggaa

SEQ ID NO: 836929 - DNA, 16 bp, Homo sapiens
ggcagattcccactgc

SEQ ID NO: 836930 - DNA, 23 bp, Homo sapiens
ggcagatttccattttttgtatt

SEQ ID NO: 836931 - DNA, 21 bp, Homo sapiens
ggcagattttacagagcgcac

SEQ ID NO: 836932 - DNA, 16 bp, Homo sapiens
ggcagcaaagaggggc

SEQ ID NO: 836933 - DNA, 22 bp, Homo sapiens
ggcagcaacaataaatagacac

SEQ ID NO: 836934 - DNA, 13 bp, Homo sapiens
ggcagcaaggcct

SEQ ID NO: 836935 - DNA, 12 bp, Homo sapiens
ggcagcaaggct

SEQ ID NO: 836936 - DNA, 15 bp, Homo sapiens
ggcagcaaggctgct

SEQ ID NO: 836937 - DNA, 16 bp, Homo sapiens
ggcagcaagggacctg

SEQ ID NO: 836938 - DNA, 17 bp, Homo sapiens
ggcagcacacctctggg

SEQ ID NO: 836939 - DNA, 15 bp, Homo sapiens
ggcagcacagcccag

SEQ ID NO: 836940 - DNA, 17 bp, Homo sapiens
ggcagcaccacactggg

SEQ ID NO: 836941 - DNA, 16 bp, Homo sapiens
ggcagcaccaccacac

SEQ ID NO: 836942 - DNA, 12 bp, Homo sapiens
ggcagcaccctc

SEQ ID NO: 836943 - DNA, 13 bp, Homo sapiens
ggcagcaccctcc

SEQ ID NO: 836944 - DNA, 19 bp, Homo sapiens
ggcagcaccctcccccgca

SEQ ID NO: 836945 - DNA, 21 bp, Homo sapiens
ggcagcacctctggtcaggag

SEQ ID NO: 836946 - DNA, 22 bp, Homo sapiens
ggcagcacctctggtcaggagg

SEQ ID NO: 836947 - DNA, 14 bp, Homo sapiens
ggcagcactcccca

SEQ ID NO: 836948 - DNA, 24 bp, Homo sapiens
ggcagcactccccagagctgtgcc

SEQ ID NO: 836949 - DNA, 10 bp, Homo sapiens
ggcagcagca

SEQ ID NO: 836950 - DNA, 16 bp, Homo sapiens
ggcagcagcatcccag

SEQ ID NO: 836951 - DNA, 18 bp, Homo sapiens
ggcagcagcatcccagcc

SEQ ID NO: 836952 - DNA, 22 bp, Homo sapiens
ggcagcagcatcccagccttga

SEQ ID NO: 836953 - DNA, 11 bp, Homo sapiens
ggcagcagccg

SEQ ID NO: 836954 - DNA, 18 bp, Homo sapiens
ggcagcagggctaccctg

SEQ ID NO: 836955 - DNA, 21 bp, Homo sapiens
ggcagcagggctaccctgagc

SEQ ID NO: 836956 - DNA, 14 bp, Homo sapiens
ggcagcaggggctg

SEQ ID NO: 836957 - DNA, 20 bp, Homo sapiens
ggcagcaggggctgctgtga

SEQ ID NO: 836958 - DNA, 12 bp, Homo sapiens
ggcagcagtggg

SEQ ID NO: 836959 - DNA, 14 bp, Homo sapiens
ggcagcagtgtgag

SEQ ID NO: 836960 - DNA, 19 bp, Homo sapiens
ggcagcagtgtgaggccag

SEQ ID NO: 836961 - DNA, 17 bp, Homo sapiens
ggcagcatagcaagaca

SEQ ID NO: 836962 - DNA, 23 bp, Homo sapiens
ggcagcatgcttgggctgaccca

SEQ ID NO: 836963 - DNA, 20 bp, Homo sapiens
ggcagccaaacccatgaggc

SEQ ID NO: 836964 - DNA, 15 bp, Homo sapiens
ggcagccacacgcag

SEQ ID NO: 836965 - DNA, 20 bp, Homo sapiens
ggcagccacacgcaggcggc

SEQ ID NO: 836966 - DNA, 19 bp, Homo sapiens
ggcagccacaggactgagc

SEQ ID NO: 836967 - DNA, 22 bp, Homo sapiens
ggcagccacaggactgagccct

SEQ ID NO: 836968 - DNA, 20 bp, Homo sapiens
ggcagccaccagtggaccta

SEQ ID NO: 836969 - DNA, 14 bp, Homo sapiens
ggcagccacccaag

SEQ ID NO: 836970 - DNA, 11 bp, Homo sapiens
ggcagccagac

SEQ ID NO: 836971 - DNA, 14 bp, Homo sapiens
ggcagccagaccag

SEQ ID NO: 836972 - DNA, 20 bp, Homo sapiens
ggcagggctgcagagggaga

SEQ ID NO: 836973 - DNA, 24 bp, Homo sapiens
ggcagggctgcagagggagacggc

SEQ ID NO: 836974 - DNA, 11 bp, Homo sapiens
ggcagggctgt

SEQ ID NO: 836975 - DNA, 16 bp, Homo sapiens
ggcagggctgtgcttg

SEQ ID NO: 836976 - DNA, 19 bp, Homo sapiens
ggcaggggagacaggagcc

SEQ ID NO: 836977 - DNA, 22 bp, Homo sapiens
ggcaggggagacaggagcctag

SEQ ID NO: 836978 - DNA, 15 bp, Homo sapiens
ggcaggggagccagg

SEQ ID NO: 836979 - DNA, 15 bp, Homo sapiens
ggcaggggcccactt

SEQ ID NO: 836980 - DNA, 19 bp, Homo sapiens
ggcaggggcccacttgggg

SEQ ID NO: 836981 - DNA, 13 bp, Homo sapiens
ggcaggggcctgg

SEQ ID NO: 836982 - DNA, 17 bp, Homo sapiens
ggcaggggcctggagat

SEQ ID NO: 836983 - DNA, 23 bp, Homo sapiens
ggcagggggccccgccagggctg

SEQ ID NO: 836984 - DNA, 17 bp, Homo sapiens
ggcagggggccctgccc

SEQ ID NO: 836985 - DNA, 18 bp, Homo sapiens
ggcagggggccctgcccc

SEQ ID NO: 836986 - DNA, 23 bp, Homo sapiens
ggcagggggccctgccccacccc

SEQ ID NO: 836987 - DNA, 18 bp, Homo sapiens
ggcaggggtcagagcact

SEQ ID NO: 836988 - DNA, 18 bp, Homo sapiens
ggcaggggtgggagagcc

SEQ ID NO: 836989 - DNA, 13 bp, Homo sapiens
ggcaggggtgggg

SEQ ID NO: 836990 - DNA, 16 bp, Homo sapiens
ggcaggggtgggggtg

SEQ ID NO: 836991 - DNA, 15 bp, Homo sapiens
ggcagggtcaggaga

SEQ ID NO: 836992 - DNA, 17 bp, Homo sapiens
ggcagggtccacgcctc

SEQ ID NO: 836993 - DNA, 16 bp, Homo sapiens
ggcagggtgagaagct

SEQ ID NO: 836994 - DNA, 16 bp, Homo sapiens
ggcagggtgggatgga

SEQ ID NO: 836995 - DNA, 21 bp, Homo sapiens
ggcagggtgggatggaggaga

SEQ ID NO: 836996 - DNA, 22 bp, Homo sapiens
ggcaggtcctagtcgggcaggg

SEQ ID NO: 836997 - DNA, 23 bp, Homo sapiens
ggcaggtcctagtcgggcagggc

SEQ ID NO: 836998 - DNA, 12 bp, Homo sapiens
ggcaggtgcaga

SEQ ID NO: 836999 - DNA, 13 bp, Homo sapiens
ggcaggtgcagat

SEQ ID NO: 837000 - DNA, 19 bp, Homo sapiens
ggcaggtgcagatgggctg

SEQ ID NO: 837001 - DNA, 20 bp, Homo sapiens
ggcaggtgcctccaggtgtg

SEQ ID NO: 837002 - DNA, 23 bp, Homo sapiens
ggcaggtggccgcccctgaggct

SEQ ID NO: 837003 - DNA, 13 bp, Homo sapiens
ggcaggtgggggt

SEQ ID NO: 837004 - DNA, 17 bp, Homo sapiens
ggcaggtggtggagggg

SEQ ID NO: 837005 - DNA, 19 bp, Homo sapiens
ggcaggtggtggaggggcg

SEQ ID NO: 837006 - DNA, 13 bp, Homo sapiens
ggcaggttcctgg

SEQ ID NO: 837007 - DNA, 14 bp, Homo sapiens
ggcaggttcctggg

SEQ ID NO: 837008 - DNA, 13 bp, Homo sapiens
ggcagtacctggg

SEQ ID NO: 837009 - DNA, 21 bp, Homo sapiens
ggcagtagaactccaggccct

SEQ ID NO: 837010 - DNA, 16 bp, Homo sapiens
ggcagtatgtgatgga

SEQ ID NO: 837011 - DNA, 19 bp, Homo sapiens
ggcagtatgtgatggactg

SEQ ID NO: 837012 - DNA, 15 bp, Homo sapiens
ggcagtcaccaccca

SEQ ID NO: 837013 - DNA, 16 bp, Homo sapiens
ggcagtcaccacccag

SEQ ID NO: 837014 - DNA, 20 bp, Homo sapiens
ggcagtcaccacccagccct

SEQ ID NO: 837015 - DNA, 15 bp, Homo sapiens
ggcagtcagtggagg

SEQ ID NO: 837016 - DNA, 19 bp, Homo sapiens
ggcagtcagtggagggcga

SEQ ID NO: 837017 - DNA, 13 bp, Homo sapiens
ggcagtccaggcc

SEQ ID NO: 837018 - DNA, 22 bp, Homo sapiens
ggcagtccaggcctctctctgc

SEQ ID NO: 837019 - DNA, 13 bp, Homo sapiens
ggcagtcccggga

SEQ ID NO: 837020 - DNA, 19 bp, Homo sapiens
ggcagtcgggggctggcct

SEQ ID NO: 837021 - DNA, 22 bp, Homo sapiens
ggcagtcgggggctggcctagg

SEQ ID NO: 837022 - DNA, 23 bp, Homo sapiens
ggcagtcgggggctggcctagga

SEQ ID NO: 837023 - DNA, 19 bp, Homo sapiens
ggcagtctctatattatgt

SEQ ID NO: 837024 - DNA, 22 bp, Homo sapiens
ggcagtctctatattatgtctt

SEQ ID NO: 837025 - DNA, 17 bp, Homo sapiens
ggcagtcttgcaacagt

SEQ ID NO: 837026 - DNA, 13 bp, Homo sapiens
ggcagtgactggc

SEQ ID NO: 837027 - DNA, 16 bp, Homo sapiens
ggcagtgactggcagg

SEQ ID NO: 837028 - DNA, 18 bp, Homo sapiens
ggcagtgactggcaggtg

SEQ ID NO: 837029 - DNA, 21 bp, Homo sapiens
ggcagtgactggcaggtgcag

SEQ ID NO: 837030 - DNA, 20 bp, Homo sapiens
ggcagtgagtgccatgcttt

SEQ ID NO: 837031 - DNA, 20 bp, Homo sapiens
ggcagtgatgacttgctgtc

SEQ ID NO: 837032 - DNA, 22 bp, Homo sapiens
ggcagtgccacagcctgctggc

SEQ ID NO: 837033 - DNA, 24 bp, Homo sapiens
ggcagtgccacagcctgctggcag

SEQ ID NO: 837034 - DNA, 15 bp, Homo sapiens
ggcagtgccacccgc

SEQ ID NO: 837035 - DNA, 12 bp, Homo sapiens
ggcagtgccagc

SEQ ID NO: 837036 - DNA, 13 bp, Homo sapiens
ggcagtgccagcc

SEQ ID NO: 837037 - DNA, 15 bp, Homo sapiens
ggcagtgccagccaa

SEQ ID NO: 837038 - DNA, 14 bp, Homo sapiens
ggcagtgcccatgt

SEQ ID NO: 837039 - DNA, 20 bp, Homo sapiens
ggcagtgcccatgtgtacat

SEQ ID NO: 837040 - DNA, 13 bp, Homo sapiens
ggcagtgccccag

SEQ ID NO: 837041 - DNA, 18 bp, Homo sapiens
ggcagtgccccagggagt

SEQ ID NO: 837042 - DNA, 13 bp, Homo sapiens
ggcagtgcccttt

SEQ ID NO: 837043 - DNA, 12 bp, Homo sapiens
ggcagtggaggt

SEQ ID NO: 837044 - DNA, 20 bp, Homo sapiens
ggcagtggccaagcctgctg

SEQ ID NO: 837045 - DNA, 13 bp, Homo sapiens
ggcagtgtcccag

SEQ ID NO: 837046 - DNA, 21 bp, Homo sapiens
ggcagttagagcagcctcgtg

SEQ ID NO: 837047 - DNA, 23 bp, Homo sapiens
ggcagttctcactcctaggagag

SEQ ID NO: 837048 - DNA, 16 bp, Homo sapiens
ggcagttctcccaggg

SEQ ID NO: 837049 - DNA, 18 bp, Homo sapiens
ggcagttctcccagggag

SEQ ID NO: 837050 - DNA, 13 bp, Homo sapiens
ggcatacaaaata

SEQ ID NO: 837051 - DNA, 16 bp, Homo sapiens
ggcatacaatgaaaag

SEQ ID NO: 837052 - DNA, 22 bp, Homo sapiens
ggcatagaggcttctccgccag

SEQ ID NO: 837053 - DNA, 21 bp, Homo sapiens
ggcatcaagaggtgggagggc

SEQ ID NO: 837054 - DNA, 13 bp, Homo sapiens
ggcatcacagggc

SEQ ID NO: 837055 - DNA, 14 bp, Homo sapiens
ggcatcacagggca

SEQ ID NO: 837056 - DNA, 22 bp, Homo sapiens
ggcatcacagggcagagccggg

SEQ ID NO: 837057 - DNA, 14 bp, Homo sapiens
ggcatcagcacttt

SEQ ID NO: 837058 - DNA, 19 bp, Homo sapiens
ggcatcagggcctttctcc

SEQ ID NO: 837059 - DNA, 17 bp, Homo sapiens
ggcatcaggtctgggca

SEQ ID NO: 837060 - DNA, 13 bp, Homo sapiens
ggcatccacccag

SEQ ID NO: 837061 - DNA, 12 bp, Homo sapiens
ggcatcccagct

SEQ ID NO: 837062 - DNA, 13 bp, Homo sapiens
ggcatcccagctt

SEQ ID NO: 837063 - DNA, 21 bp, Homo sapiens
ggcatcccagtggcctcaacc

SEQ ID NO: 837064 - DNA, 15 bp, Homo sapiens
ggcatccttgcctgt

SEQ ID NO: 837065 - DNA, 18 bp, Homo sapiens
ggcatccttgtcttttga

SEQ ID NO: 837066 - DNA, 17 bp, Homo sapiens
ggcatcgcatccgtcct

SEQ ID NO: 837067 - DNA, 22 bp, Homo sapiens
ggcatcgtagaagagatgtggc

SEQ ID NO: 837068 - DNA, 16 bp, Homo sapiens
ggcatctccatgtaga

SEQ ID NO: 837069 - DNA, 17 bp, Homo sapiens
ggcatctcttccccaga

SEQ ID NO: 837070 - DNA, 16 bp, Homo sapiens
ggcatctgcccctccc

SEQ ID NO: 837071 - DNA, 13 bp, Homo sapiens
ggcatctgtctgt

SEQ ID NO: 837072 - DNA, 22 bp, Homo sapiens
ggcatctgtctgtctgtgggct

SEQ ID NO: 837073 - DNA, 13 bp, Homo sapiens
ggcatctgtgtgc

SEQ ID NO: 837074 - DNA, 16 bp, Homo sapiens
ggcatcttgctggcta

SEQ ID NO: 837075 - DNA, 16 bp, Homo sapiens
ggcatctttgccttgg

SEQ ID NO: 837076 - DNA, 23 bp, Homo sapiens
ggcatctttgccttgggctgctc

SEQ ID NO: 837077 - DNA, 22 bp, Homo sapiens
ggcatcttttctagagacacat

SEQ ID NO: 837078 - DNA, 17 bp, Homo sapiens
ggcatcttttgtattaa

SEQ ID NO: 837079 - DNA, 12 bp, Homo sapiens
ggcatgaaccct

SEQ ID NO: 837080 - DNA, 22 bp, Homo sapiens
ggcatgaaccctcttgccatcc

SEQ ID NO: 837081 - DNA, 15 bp, Homo sapiens
ggcatgacactctag

SEQ ID NO: 837082 - DNA, 17 bp, Homo sapiens
ggcatgatttatatatg

SEQ ID NO: 837083 - DNA, 18 bp, Homo sapiens
ggcatgcacacggctggt

SEQ ID NO: 837084 - DNA, 21 bp, Homo sapiens
ggcatgcacgggcatgcacac

SEQ ID NO: 837085 - DNA, 14 bp, Homo sapiens
ggcatgcagctgcc

SEQ ID NO: 837086 - DNA, 15 bp, Homo sapiens
ggcatgcagctgcct

SEQ ID NO: 837087 - DNA, 14 bp, Homo sapiens
ggcatgcctgtgtg

SEQ ID NO: 837088 - DNA, 19 bp, Homo sapiens
ggcatgcgcacaaggctga

SEQ ID NO: 837089 - DNA, 16 bp, Homo sapiens
ggcatgctggggcaag

SEQ ID NO: 837090 - DNA, 16 bp, Homo sapiens
ggcatggcaattctgg

SEQ ID NO: 837091 - DNA, 14 bp, Homo sapiens
ggcatggcaggctg

SEQ ID NO: 837092 - DNA, 17 bp, Homo sapiens
ggcatggccaggtggcc

SEQ ID NO: 837093 - DNA, 12 bp, Homo sapiens
ggcatggccctg

SEQ ID NO: 837094 - DNA, 15 bp, Homo sapiens
ggccaggtgggcgga

SEQ ID NO: 837095 - DNA, 17 bp, Homo sapiens
ggccaggttgtgtccca

SEQ ID NO: 837096 - DNA, 15 bp, Homo sapiens
ggccagtccaggctg

SEQ ID NO: 837097 - DNA, 16 bp, Homo sapiens
ggccagtccaggctgc

SEQ ID NO: 837098 - DNA, 21 bp, Homo sapiens
ggccagtccccatttctgcct

SEQ ID NO: 837099 - DNA, 15 bp, Homo sapiens
ggccagtccccgagg

SEQ ID NO: 837100 - DNA, 23 bp, Homo sapiens
ggccagtccccgaggagctgggc

SEQ ID NO: 837101 - DNA, 19 bp, Homo sapiens
ggccagtcctcctgggagc

SEQ ID NO: 837102 - DNA, 21 bp, Homo sapiens
ggccagtcctgcctggccagg

SEQ ID NO: 837103 - DNA, 17 bp, Homo sapiens
ggccagtcctggtcctg

SEQ ID NO: 837104 - DNA, 22 bp, Homo sapiens
ggccagtcctggtcctggctgc

SEQ ID NO: 837105 - DNA, 15 bp, Homo sapiens
ggccagtctgggctg

SEQ ID NO: 837106 - DNA, 19 bp, Homo sapiens
ggccagtgagaagctgagg

SEQ ID NO: 837107 - DNA, 20 bp, Homo sapiens
ggccagtgagaagctgaggc

SEQ ID NO: 837108 - DNA, 22 bp, Homo sapiens
ggccagtgagaagctgaggcct

SEQ ID NO: 837109 - DNA, 15 bp, Homo sapiens
ggccagtgatgatgt

SEQ ID NO: 837110 - DNA, 15 bp, Homo sapiens
ggccagtgctgcttc

SEQ ID NO: 837111 - DNA, 16 bp, Homo sapiens
ggccagtggaagaaac

SEQ ID NO: 837112 - DNA, 19 bp, Homo sapiens
ggccagtggccttccccag

SEQ ID NO: 837113 - DNA, 22 bp, Homo sapiens
ggccagtggccttccccagcat

SEQ ID NO: 837114 - DNA, 15 bp, Homo sapiens
ggccagtgggcctgg

SEQ ID NO: 837115 - DNA, 15 bp, Homo sapiens
ggccagtggggcctg

SEQ ID NO: 837116 - DNA, 16 bp, Homo sapiens
ggccagtggggcctgt

SEQ ID NO: 837117 - DNA, 19 bp, Homo sapiens
ggccagtgtgatcccaagt

SEQ ID NO: 837118 - DNA, 22 bp, Homo sapiens
ggccagtgttgtgggcttcctg

SEQ ID NO: 837119 - DNA, 18 bp, Homo sapiens
ggccagttgatctgctct

SEQ ID NO: 837120 - DNA, 21 bp, Homo sapiens
ggccagtttctctgccttctt

SEQ ID NO: 837121 - DNA, 19 bp, Homo sapiens
ggccatacttttgagaggg

SEQ ID NO: 837122 - DNA, 13 bp, Homo sapiens
ggccatagaggcc

SEQ ID NO: 837123 - DNA, 15 bp, Homo sapiens
ggccatagaggccca

SEQ ID NO: 837124 - DNA, 22 bp, Homo sapiens
ggccatatatgctgtatttctt

SEQ ID NO: 837125 - DNA, 14 bp, Homo sapiens
ggccatcactcagc

SEQ ID NO: 837126 - DNA, 16 bp, Homo sapiens
ggccatcactcagccc

SEQ ID NO: 837127 - DNA, 16 bp, Homo sapiens
ggccatcagggccctg

SEQ ID NO: 837128 - DNA, 19 bp, Homo sapiens
ggccatcagggccctgccc

SEQ ID NO: 837129 - DNA, 20 bp, Homo sapiens
ggccatcagggccctgcccc

SEQ ID NO: 837130 - DNA, 21 bp, Homo sapiens
ggccatcagggccctgcccca

SEQ ID NO: 837131 - DNA, 14 bp, Homo sapiens
ggccatcccacaag

SEQ ID NO: 837132 - DNA, 17 bp, Homo sapiens
ggccatccctgggcccc

SEQ ID NO: 837133 - DNA, 20 bp, Homo sapiens
ggccatccctgggcccctcc

SEQ ID NO: 837134 - DNA, 15 bp, Homo sapiens
ggccatctcaggaga

SEQ ID NO: 837135 - DNA, 17 bp, Homo sapiens
ggccatctcaggagatg

SEQ ID NO: 837136 - DNA, 18 bp, Homo sapiens
ggccatctccctccccag

SEQ ID NO: 837137 - DNA, 22 bp, Homo sapiens
ggccatgagactgatccctggc

SEQ ID NO: 837138 - DNA, 21 bp, Homo sapiens
ggccatgagctccagaccccc

SEQ ID NO: 837139 - DNA, 22 bp, Homo sapiens
ggccatgagctccagaccccca

SEQ ID NO: 837140 - DNA, 21 bp, Homo sapiens
ggccatgaggcctcagtggac

SEQ ID NO: 837141 - DNA, 11 bp, Homo sapiens
ggccatgcagg

SEQ ID NO: 837142 - DNA, 23 bp, Homo sapiens
ggccatgcaggaggtggagaaaa

SEQ ID NO: 837143 - DNA, 16 bp, Homo sapiens
ggccatgccccacccc

SEQ ID NO: 837144 - DNA, 21 bp, Homo sapiens
ggccatgccctagaccctccc

SEQ ID NO: 837145 - DNA, 14 bp, Homo sapiens
ggccatgcctcagc

SEQ ID NO: 837146 - DNA, 13 bp, Homo sapiens
ggccatgcctgcc

SEQ ID NO: 837147 - DNA, 11 bp, Homo sapiens
ggccatgctca

SEQ ID NO: 837148 - DNA, 16 bp, Homo sapiens
ggccatgctgaaggga

SEQ ID NO: 837149 - DNA, 14 bp, Homo sapiens
ggccatgctgaggc

SEQ ID NO: 837150 - DNA, 15 bp, Homo sapiens
ggccatgctgaggcc

SEQ ID NO: 837151 - DNA, 22 bp, Homo sapiens
ggccatgctgaggcctgggccg

SEQ ID NO: 837152 - DNA, 16 bp, Homo sapiens
ggccatgctgtccctg

SEQ ID NO: 837153 - DNA, 17 bp, Homo sapiens
ggccatgctgtccctgc

SEQ ID NO: 837154 - DNA, 20 bp, Homo sapiens
ggccatgctgtccctgcact

SEQ ID NO: 837155 - DNA, 13 bp, Homo sapiens
ggccatggcagaa

SEQ ID NO: 837156 - DNA, 16 bp, Homo sapiens
ggccatggcctctgca

SEQ ID NO: 837157 - DNA, 21 bp, Homo sapiens
ggccatggctttcatcctgtg

SEQ ID NO: 837158 - DNA, 22 bp, Homo sapiens
ggccatggctttcatcctgtgt

SEQ ID NO: 837159 - DNA, 15 bp, Homo sapiens
ggccatggtggaggg

SEQ ID NO: 837160 - DNA, 21 bp, Homo sapiens
ggccatggtggagggcacttc

SEQ ID NO: 837161 - DNA, 24 bp, Homo sapiens
ggccatggtggagggcacttcagg

SEQ ID NO: 837162 - DNA, 22 bp, Homo sapiens
ggccatgtattatgaaaaagat

SEQ ID NO: 837163 - DNA, 16 bp, Homo sapiens
ggccatgtccaaagag

SEQ ID NO: 837164 - DNA, 22 bp, Homo sapiens
ggccatgtccaaagaggctgcc

SEQ ID NO: 837165 - DNA, 23 bp, Homo sapiens
ggccatgtccaaagaggctgccc

SEQ ID NO: 837166 - DNA, 15 bp, Homo sapiens
ggccatgtgagccac

SEQ ID NO: 837167 - DNA, 15 bp, Homo sapiens
ggccatgtggcctgc

SEQ ID NO: 837168 - DNA, 16 bp, Homo sapiens
ggccatgtggcctgcc

SEQ ID NO: 837169 - DNA, 18 bp, Homo sapiens
ggccatgtggcctgccca

SEQ ID NO: 837170 - DNA, 19 bp, Homo sapiens
ggccatgttatgctggtgg

SEQ ID NO: 837171 - DNA, 11 bp, Homo sapiens
ggccattaccc

SEQ ID NO: 837172 - DNA, 12 bp, Homo sapiens
ggccattcagca

SEQ ID NO: 837173 - DNA, 23 bp, Homo sapiens
ggccattccccaacggggtgggg

SEQ ID NO: 837174 - DNA, 22 bp, Homo sapiens
ggccatttgcaataacagctgc

SEQ ID NO: 837175 - DNA, 15 bp, Homo sapiens
ggccatttttctggg

SEQ ID NO: 837176 - DNA, 12 bp, Homo sapiens
ggcccaaagcag

SEQ ID NO: 837177 - DNA, 16 bp, Homo sapiens
ggcccaaaggcccagg

SEQ ID NO: 837178 - DNA, 19 bp, Homo sapiens
ggcccaaaggcccagggag

SEQ ID NO: 837179 - DNA, 20 bp, Homo sapiens
ggcccaaaggcccagggagg

SEQ ID NO: 837180 - DNA, 16 bp, Homo sapiens
ggcccaagaactgcag

SEQ ID NO: 837181 - DNA, 17 bp, Homo sapiens
ggcccaagactgggctg

SEQ ID NO: 837182 - DNA, 15 bp, Homo sapiens
ggcccaagccccatc

SEQ ID NO: 837183 - DNA, 22 bp, Homo sapiens
ggcccaagccccatctcatcct

SEQ ID NO: 837184 - DNA, 20 bp, Homo sapiens
ggcccaagggatggcaccac

SEQ ID NO: 837185 - DNA, 14 bp, Homo sapiens
ggcccaagtccctg

SEQ ID NO: 837186 - DNA, 15 bp, Homo sapiens
ggcccaagtccctgt

SEQ ID NO: 837187 - DNA, 18 bp, Homo sapiens
ggcccaagttgcagtgag

SEQ ID NO: 837188 - DNA, 22 bp, Homo sapiens
ggcccaagttgcagtgagcagg

SEQ ID NO: 837189 - DNA, 15 bp, Homo sapiens
ggcccaatctgggca

SEQ ID NO: 837190 - DNA, 16 bp, Homo sapiens
ggcccaatgcctataa

SEQ ID NO: 837191 - DNA, 15 bp, Homo sapiens
ggcccacactgaggc

SEQ ID NO: 837192 - DNA, 13 bp, Homo sapiens
ggcccacagagcc

SEQ ID NO: 837193 - DNA, 18 bp, Homo sapiens
ggcccacagagcctggct

SEQ ID NO: 837194 - DNA, 22 bp, Homo sapiens
ggcccacagagcctggctttgg

SEQ ID NO: 837195 - DNA, 15 bp, Homo sapiens
ggcccacagctccca

SEQ ID NO: 837196 - DNA, 20 bp, Homo sapiens
ggcccaccatcaccaccgcc

SEQ ID NO: 837197 - DNA, 22 bp, Homo sapiens
ggcccaccatcaccaccgcctc

SEQ ID NO: 837198 - DNA, 17 bp, Homo sapiens
ggcccaccccccagcct

SEQ ID NO: 837199 - DNA, 18 bp, Homo sapiens
ggcccacctggccacctg

SEQ ID NO: 837200 - DNA, 22 bp, Homo sapiens
ggcccacctggccacctgaggt

SEQ ID NO: 837201 - DNA, 17 bp, Homo sapiens
ggcccacgaggagcagc

SEQ ID NO: 837202 - DNA, 17 bp, Homo sapiens
ggcccacgtggttgggg

SEQ ID NO: 837203 - DNA, 22 bp, Homo sapiens
ggcccacgtgtatagtatctgt

SEQ ID NO: 837204 - DNA, 16 bp, Homo sapiens
ggcccactagagggcc

SEQ ID NO: 837205 - DNA, 21 bp, Homo sapiens
ggcccactgtgcctcagagac

SEQ ID NO: 837206 - DNA, 18 bp, Homo sapiens
ggcccagaaagcctctct

SEQ ID NO: 837207 - DNA, 19 bp, Homo sapiens
ggcccagaactgcccccac

SEQ ID NO: 837208 - DNA, 17 bp, Homo sapiens
ggcccagaccactgtct

SEQ ID NO: 837209 - DNA, 23 bp, Homo sapiens
ggcccagacccagcccgcggcct

SEQ ID NO: 837210 - DNA, 16 bp, Homo sapiens
ggcccagagcccttga

SEQ ID NO: 837211 - DNA, 18 bp, Homo sapiens
ggcccagagcgaggaaag

SEQ ID NO: 837212 - DNA, 23 bp, Homo sapiens
ggcccagcacatggccatagagg

SEQ ID NO: 837213 - DNA, 19 bp, Homo sapiens
ggcccagcaggcaggcact

SEQ ID NO: 837214 - DNA, 13 bp, Homo sapiens
ggcccagccagga

SEQ ID NO: 837215 - DNA, 12 bp, Homo sapiens
ggcccagcccag

SEQ ID NO: 837216 - DNA, 12 bp, Homo sapiens
ggcccagccctc

SEQ ID NO: 837217 - DNA, 20 bp, Homo sapiens
ggcccagccggcctctctgg

SEQ ID NO: 837218 - DNA, 21 bp, Homo sapiens
ggcccagccggcctctctggc

SEQ ID NO: 837219 - DNA, 15 bp, Homo sapiens
ggcccagcctgtcct

SEQ ID NO: 837220 - DNA, 16 bp, Homo sapiens
ggcccagcgacctcgg

SEQ ID NO: 837221 - DNA, 16 bp, Homo sapiens
ggcccagcggcccctc

SEQ ID NO: 837222 - DNA, 18 bp, Homo sapiens
ggcccagcggcccctccc

SEQ ID NO: 837223 - DNA, 14 bp, Homo sapiens
ggcccagctgggct

SEQ ID NO: 837224 - DNA, 15 bp, Homo sapiens
ggcccagctgtagcc

SEQ ID NO: 837225 - DNA, 19 bp, Homo sapiens
ggcccagctgtagccatgg

SEQ ID NO: 837226 - DNA, 22 bp, Homo sapiens
ggcccagctgtagccatggctc

SEQ ID NO: 837227 - DNA, 14 bp, Homo sapiens
ggcccaggactctg

SEQ ID NO: 837228 - DNA, 17 bp, Homo sapiens
ggcccaggagagccccc

SEQ ID NO: 837229 - DNA, 17 bp, Homo sapiens
ggcccaggagctctgcg

SEQ ID NO: 837230 - DNA, 18 bp, Homo sapiens
ggcccaggagctctgcgc

SEQ ID NO: 837231 - DNA, 23 bp, Homo sapiens
ggcccaggagctctgcgccaggc

SEQ ID NO: 837232 - DNA, 15 bp, Homo sapiens
ggcccaggcaccacc

SEQ ID NO: 837233 - DNA, 18 bp, Homo sapiens
ggcccaggcaccaccagg

SEQ ID NO: 837234 - DNA, 23 bp, Homo sapiens
ggcccaggcagacaaccttgtcc

SEQ ID NO: 837235 - DNA, 13 bp, Homo sapiens
ggcccaggcagcc

SEQ ID NO: 837236 - DNA, 15 bp, Homo sapiens
ggcccaggcagcctc

SEQ ID NO: 837237 - DNA, 12 bp, Homo sapiens
ggcccaggcagg

SEQ ID NO: 837238 - DNA, 15 bp, Homo sapiens
ggcccaggcaggcca

SEQ ID NO: 837239 - DNA, 15 bp, Homo sapiens
ggcccaggcaggtct

SEQ ID NO: 837240 - DNA, 16 bp, Homo sapiens
ggcccaggcaggtctg

SEQ ID NO: 837241 - DNA, 21 bp, Homo sapiens
ggcccaggcaggtctgcaagg

SEQ ID NO: 837242 - DNA, 16 bp, Homo sapiens
ggcccaggcctggagc

SEQ ID NO: 837243 - DNA, 16 bp, Homo sapiens
ggcccaggcctgggtt

SEQ ID NO: 837244 - DNA, 21 bp, Homo sapiens
ggcccaggccttgctgactct

SEQ ID NO: 837245 - DNA, 20 bp, Homo sapiens
ggcccagggaggcagcgtgg

SEQ ID NO: 837246 - DNA, 21 bp, Homo sapiens
ggcccagtgacaaagactcct

SEQ ID NO: 837247 - DNA, 17 bp, Homo sapiens
ggcccagtgccactgcc

SEQ ID NO: 837248 - DNA, 16 bp, Homo sapiens
ggcccagtgccagctc

SEQ ID NO: 837249 - DNA, 19 bp, Homo sapiens
ggcccagtgccagctccag

SEQ ID NO: 837250 - DNA, 19 bp, Homo sapiens
ggcccagtgtcaagttgtg

SEQ ID NO: 837251 - DNA, 22 bp, Homo sapiens
ggcccagtgtcaagttgtgctt

SEQ ID NO: 837252 - DNA, 22 bp, Homo sapiens
ggcccataccttctggttgctt

SEQ ID NO: 837253 - DNA, 16 bp, Homo sapiens
ggcccatctcagcctc

SEQ ID NO: 837254 - DNA, 13 bp, Homo sapiens
ggcccatctcagg

SEQ ID NO: 837255 - DNA, 22 bp, Homo sapiens
ggcccatctcaggtgccactcc

SEQ ID NO: 837256 - DNA, 19 bp, Homo sapiens
ggcccatctccctgctttg

SEQ ID NO: 837257 - DNA, 20 bp, Homo sapiens
ggcccatgaagaaagcccct

SEQ ID NO: 837258 - DNA, 21 bp, Homo sapiens
ggcccatgaagaaagcccctc

SEQ ID NO: 837259 - DNA, 23 bp, Homo sapiens
ggcccatgcccccttcgctcctc

SEQ ID NO: 837260 - DNA, 11 bp, Homo sapiens
ggcccatggcc

SEQ ID NO: 837261 - DNA, 20 bp, Homo sapiens
ggcccattggagcacctggg

SEQ ID NO: 837262 - DNA, 21 bp, Homo sapiens
ggcccattggagcacctgggc

SEQ ID NO: 837263 - DNA, 18 bp, Homo sapiens
ggccccaacaagcacccc

SEQ ID NO: 837264 - DNA, 18 bp, Homo sapiens
ggccccaactcgggctcc

SEQ ID NO: 837265 - DNA, 13 bp, Homo sapiens
ggccccacatggg

SEQ ID NO: 837266 - DNA, 15 bp, Homo sapiens
ggccccaccacctag

SEQ ID NO: 837267 - DNA, 21 bp, Homo sapiens
ggccccacccaccctctggtc

SEQ ID NO: 837268 - DNA, 17 bp, Homo sapiens
ggccccaccctgggccc

SEQ ID NO: 837269 - DNA, 21 bp, Homo sapiens
ggccccacctacttgtgactg

SEQ ID NO: 837270 - DNA, 17 bp, Homo sapiens
ggccccacctccctgcg

SEQ ID NO: 837271 - DNA, 20 bp, Homo sapiens
ggccccacctcggcacacac

SEQ ID NO: 837272 - DNA, 21 bp, Homo sapiens
ggccccacctcggcacacact

SEQ ID NO: 837273 - DNA, 14 bp, Homo sapiens
ggccccactggaca

SEQ ID NO: 837274 - DNA, 14 bp, Homo sapiens
ggccccactggctg

SEQ ID NO: 837275 - DNA, 19 bp, Homo sapiens
ggccccactggctggagga

SEQ ID NO: 837276 - DNA, 11 bp, Homo sapiens
ggccccacttt

SEQ ID NO: 837277 - DNA, 16 bp, Homo sapiens
ggccccagaccccagg

SEQ ID NO: 837278 - DNA, 18 bp, Homo sapiens
ggccccagaccccagggc

SEQ ID NO: 837279 - DNA, 20 bp, Homo sapiens
ggccccagaccccagggcag

SEQ ID NO: 837280 - DNA, 23 bp, Homo sapiens
ggccccagagactcagagggagg

SEQ ID NO: 837281 - DNA, 13 bp, Homo sapiens
ggccccagatctg

SEQ ID NO: 837282 - DNA, 22 bp, Homo sapiens
ggccccagatctgcctgggcct

SEQ ID NO: 837283 - DNA, 23 bp, Homo sapiens
ggccccagatctgcctgggcctg

SEQ ID NO: 837284 - DNA, 16 bp, Homo sapiens
ggccccagcactaaag

SEQ ID NO: 837285 - DNA, 21 bp, Homo sapiens
ggccccagcactaaagcagtg

SEQ ID NO: 837286 - DNA, 12 bp, Homo sapiens
ggccccagccag

SEQ ID NO: 837287 - DNA, 14 bp, Homo sapiens
ggccccagccctgc

SEQ ID NO: 837288 - DNA, 15 bp, Homo sapiens
ggccccagccctgct

SEQ ID NO: 837289 - DNA, 22 bp, Homo sapiens
ggccccagccctgctggggatc

SEQ ID NO: 837290 - DNA, 11 bp, Homo sapiens
ggccccagcct

SEQ ID NO: 837291 - DNA, 17 bp, Homo sapiens
ggccccagcctccaggc

SEQ ID NO: 837292 - DNA, 21 bp, Homo sapiens
ggccccagcgtctgcagggtg

SEQ ID NO: 837293 - DNA, 21 bp, Homo sapiens
ggccccaggacctggctgcca

SEQ ID NO: 837294 - DNA, 14 bp, Homo sapiens
ggccccagggacag

SEQ ID NO: 837295 - DNA, 21 bp, Homo sapiens
ggccccaggggacgtgggccc

SEQ ID NO: 837296 - DNA, 20 bp, Homo sapiens
ggccccagtgcggttcctca

SEQ ID NO: 837297 - DNA, 21 bp, Homo sapiens
ggccccatcgccccaccgcag

SEQ ID NO: 837298 - DNA, 17 bp, Homo sapiens
ggccccatcttgatctt

SEQ ID NO: 837299 - DNA, 23 bp, Homo sapiens
ggccccatcttgatctttgagcc

SEQ ID NO: 837300 - DNA, 12 bp, Homo sapiens
ggccccatgctc

SEQ ID NO: 837301 - DNA, 15 bp, Homo sapiens
ggccccatgctctgc

SEQ ID NO: 837302 - DNA, 19 bp, Homo sapiens
ggccccatgctctgcccca

SEQ ID NO: 837303 - DNA, 23 bp, Homo sapiens
ggcccccaaacatagcccctgcc

SEQ ID NO: 837304 - DNA, 16 bp, Homo sapiens
ggcccccaataaaggc

SEQ ID NO: 837305 - DNA, 19 bp, Homo sapiens
ggcccccaataaaggcagc

SEQ ID NO: 837306 - DNA, 15 bp, Homo sapiens
ggcccccacttgcct

SEQ ID NO: 837307 - DNA, 16 bp, Homo sapiens
ggcccccacttgcctc

SEQ ID NO: 837308 - DNA, 18 bp, Homo sapiens
ggcccccagcccagggct

SEQ ID NO: 837309 - DNA, 20 bp, Homo sapiens
ggcccccagcccagggctcc

SEQ ID NO: 837310 - DNA, 13 bp, Homo sapiens
ggcccccagcctg

SEQ ID NO: 837311 - DNA, 16 bp, Homo sapiens
ggcccccagcctggcc

SEQ ID NO: 837312 - DNA, 19 bp, Homo sapiens
ggcccccaggattccccca

SEQ ID NO: 837313 - DNA, 20 bp, Homo sapiens
ggcccccaggattcccccag

SEQ ID NO: 837314 - DNA, 22 bp, Homo sapiens
ggcccccaggattcccccagcc

SEQ ID NO: 837315 - DNA, 11 bp, Homo sapiens
ggcccccagtg

SEQ ID NO: 837316 - DNA, 21 bp, Homo sapiens
ggcccccatctcatgcccctg

SEQ ID NO: 837317 - DNA, 18 bp, Homo sapiens
ggccccccaaagtgctgg

SEQ ID NO: 837318 - DNA, 19 bp, Homo sapiens
ggccccccagaaagctgcc

SEQ ID NO: 837319 - DNA, 21 bp, Homo sapiens
ggccccccagaaagctgccag

SEQ ID NO: 837320 - DNA, 21 bp, Homo sapiens
ggccccccgcgctcgcccagc

SEQ ID NO: 837321 - DNA, 22 bp, Homo sapiens
ggccccccgcgctcgcccagca

SEQ ID NO: 837322 - DNA, 16 bp, Homo sapiens
ggcccccgtgttcagg

SEQ ID NO: 837323 - DNA, 13 bp, Homo sapiens
ggccccctaggat

SEQ ID NO: 837324 - DNA, 22 bp, Homo sapiens
ggccccctaggattccccctgc

SEQ ID NO: 837325 - DNA, 19 bp, Homo sapiens
ggccccctcaccccagctc

SEQ ID NO: 837326 - DNA, 18 bp, Homo sapiens
ggccccctttcccgggct

SEQ ID NO: 837327 - DNA, 18 bp, Homo sapiens
ggccccgaatgtcactgg

SEQ ID NO: 837328 - DNA, 21 bp, Homo sapiens
ggccccgccagggctggggac

SEQ ID NO: 837329 - DNA, 18 bp, Homo sapiens
ggccccgccgcctggtac

SEQ ID NO: 837330 - DNA, 17 bp, Homo sapiens
ggccccggatcagagca

SEQ ID NO: 837331 - DNA, 23 bp, Homo sapiens
ggccccggatcagagcaggacct

SEQ ID NO: 837332 - DNA, 24 bp, Homo sapiens
ggccccggatcagagcaggacctc

SEQ ID NO: 837333 - DNA, 16 bp, Homo sapiens
ggccccggccccagcc

SEQ ID NO: 837334 - DNA, 17 bp, Homo sapiens
ggccccggccccagcca

SEQ ID NO: 837335 - DNA, 17 bp, Homo sapiens
ggccccgggctctggcc

SEQ ID NO: 837336 - DNA, 16 bp, Homo sapiens
ggccgtatctgtcaca

SEQ ID NO: 837337 - DNA, 23 bp, Homo sapiens
ggccgtcacgctttcatgaccac

SEQ ID NO: 837338 - DNA, 20 bp, Homo sapiens
ggccgtcctcccgggccctc

SEQ ID NO: 837339 - DNA, 21 bp, Homo sapiens
ggccgtcctcccgggccctcc

SEQ ID NO: 837340 - DNA, 20 bp, Homo sapiens
ggccgtcttcactcgccccc

SEQ ID NO: 837341 - DNA, 14 bp, Homo sapiens
ggccgtgcccttgc

SEQ ID NO: 837342 - DNA, 14 bp, Homo sapiens
ggccgtgccttgtt

SEQ ID NO: 837343 - DNA, 21 bp, Homo sapiens
ggccgtggagtcggagtggac

SEQ ID NO: 837344 - DNA, 19 bp, Homo sapiens
ggccgtggcttgggctggt

SEQ ID NO: 837345 - DNA, 14 bp, Homo sapiens
ggcctaagacatgt

SEQ ID NO: 837346 - DNA, 23 bp, Homo sapiens
ggcctaagacatgtgaggaggaa

SEQ ID NO: 837347 - DNA, 15 bp, Homo sapiens
ggcctaatcactctg

SEQ ID NO: 837348 - DNA, 13 bp, Homo sapiens
ggcctacagagga

SEQ ID NO: 837349 - DNA, 17 bp, Homo sapiens
ggcctacagaggaggcc

SEQ ID NO: 837350 - DNA, 23 bp, Homo sapiens
ggcctacatgctttgtgaacaag

SEQ ID NO: 837351 - DNA, 15 bp, Homo sapiens
ggcctacattcttta

SEQ ID NO: 837352 - DNA, 16 bp, Homo sapiens
ggcctacattctttat

SEQ ID NO: 837353 - DNA, 21 bp, Homo sapiens
ggcctacctcaagttcttgga

SEQ ID NO: 837354 - DNA, 23 bp, Homo sapiens
ggcctagatccacacacagagga

SEQ ID NO: 837355 - DNA, 22 bp, Homo sapiens
ggcctagcgatctctcctggcc

SEQ ID NO: 837356 - DNA, 13 bp, Homo sapiens
ggcctaggggtgg

SEQ ID NO: 837357 - DNA, 22 bp, Homo sapiens
ggcctaggtgcagctcctcagc

SEQ ID NO: 837358 - DNA, 18 bp, Homo sapiens
ggcctatatgccagcgcc

SEQ ID NO: 837359 - DNA, 18 bp, Homo sapiens
ggcctatctggaagccac

SEQ ID NO: 837360 - DNA, 22 bp, Homo sapiens
ggcctatgcagacatctctgga

SEQ ID NO: 837361 - DNA, 16 bp, Homo sapiens
ggcctattccaggaat

SEQ ID NO: 837362 - DNA, 23 bp, Homo sapiens
ggcctcaaagcaacccgctggag

SEQ ID NO: 837363 - DNA, 23 bp, Homo sapiens
ggcctcaaagcaagcattcagaa

SEQ ID NO: 837364 - DNA, 19 bp, Homo sapiens
ggcctcaaaggcccgctct

SEQ ID NO: 837365 - DNA, 16 bp, Homo sapiens
ggcctcaaccctccct

SEQ ID NO: 837366 - DNA, 18 bp, Homo sapiens
ggcctcaagaaaggcccg

SEQ ID NO: 837367 - DNA, 15 bp, Homo sapiens
ggcctcaaggacttg

SEQ ID NO: 837368 - DNA, 21 bp, Homo sapiens
ggcctcaatctaaggccttcc

SEQ ID NO: 837369 - DNA, 12 bp, Homo sapiens
ggcctcacccac

SEQ ID NO: 837370 - DNA, 17 bp, Homo sapiens
ggcctcacccacccctg

SEQ ID NO: 837371 - DNA, 18 bp, Homo sapiens
ggcctcacccacccctgc

SEQ ID NO: 837372 - DNA, 21 bp, Homo sapiens
ggcctcacctgcccctctgtt

SEQ ID NO: 837373 - DNA, 22 bp, Homo sapiens
ggcctcacctgcccctctgttc

SEQ ID NO: 837374 - DNA, 13 bp, Homo sapiens
ggcctcactggct

SEQ ID NO: 837375 - DNA, 14 bp, Homo sapiens
ggcctcactggctg

SEQ ID NO: 837376 - DNA, 15 bp, Homo sapiens
ggcctcactggctgg

SEQ ID NO: 837377 - DNA, 22 bp, Homo sapiens
ggcctcacttgattcatctctg

SEQ ID NO: 837378 - DNA, 16 bp, Homo sapiens
ggcctcagaccccctc

SEQ ID NO: 837379 - DNA, 15 bp, Homo sapiens
ggcctcagagcctga

SEQ ID NO: 837380 - DNA, 18 bp, Homo sapiens
ggcctcagagcctgacct

SEQ ID NO: 837381 - DNA, 22 bp, Homo sapiens
ggcctcagagcctgacctgaga

SEQ ID NO: 837382 - DNA, 12 bp, Homo sapiens
ggcctcagccct

SEQ ID NO: 837383 - DNA, 14 bp, Homo sapiens
ggcctcagccctca

SEQ ID NO: 837384 - DNA, 15 bp, Homo sapiens
ggcctcagccctcag

SEQ ID NO: 837385 - DNA, 15 bp, Homo sapiens
ggcctcagcctgggg

SEQ ID NO: 837386 - DNA, 16 bp, Homo sapiens
ggcctcagcctggggc

SEQ ID NO: 837387 - DNA, 20 bp, Homo sapiens
ggcctcagcctggggctctc

SEQ ID NO: 837388 - DNA, 22 bp, Homo sapiens
ggcctcagctgcctcacttcct

SEQ ID NO: 837389 - DNA, 11 bp, Homo sapiens
ggcctcagggt

SEQ ID NO: 837390 - DNA, 19 bp, Homo sapiens
ggcctcagggtctaaggag

SEQ ID NO: 837391 - DNA, 13 bp, Homo sapiens
ggcctcaggtgct

SEQ ID NO: 837392 - DNA, 12 bp, Homo sapiens
ggcctcatccag

SEQ ID NO: 837393 - DNA, 16 bp, Homo sapiens
ggcctcatccagggcc

SEQ ID NO: 837394 - DNA, 21 bp, Homo sapiens
ggcctcatccctcggaagccg

SEQ ID NO: 837395 - DNA, 16 bp, Homo sapiens
ggcctcatgtggctgg

SEQ ID NO: 837396 - DNA, 19 bp, Homo sapiens
ggcctccaacgcccctgtg

SEQ ID NO: 837397 - DNA, 20 bp, Homo sapiens
ggcctccaacgcccctgtgg

SEQ ID NO: 837398 - DNA, 21 bp, Homo sapiens
ggcctccaacgcccctgtggc

SEQ ID NO: 837399 - DNA, 12 bp, Homo sapiens
ggcctccactcc

SEQ ID NO: 837400 - DNA, 20 bp, Homo sapiens
ggcctccagaactcactggg

SEQ ID NO: 837401 - DNA, 14 bp, Homo sapiens
ggcctccagaagct

SEQ ID NO: 837402 - DNA, 18 bp, Homo sapiens
ggcctccagaagctgctc

SEQ ID NO: 837403 - DNA, 12 bp, Homo sapiens
ggcctccagcct

SEQ ID NO: 837404 - DNA, 16 bp, Homo sapiens
ggcctccagcctctcc

SEQ ID NO: 837405 - DNA, 17 bp, Homo sapiens
ggcctccagcctttgct

SEQ ID NO: 837406 - DNA, 11 bp, Homo sapiens
ggcctccagga

SEQ ID NO: 837407 - DNA, 15 bp, Homo sapiens
ggcctccaggagggg

SEQ ID NO: 837408 - DNA, 17 bp, Homo sapiens
ggcctccaggaggggcc

SEQ ID NO: 837409 - DNA, 20 bp, Homo sapiens
ggcctccatgccccagctct

SEQ ID NO: 837410 - DNA, 14 bp, Homo sapiens
ggcctccatttctg

SEQ ID NO: 837411 - DNA, 13 bp, Homo sapiens
ggcctcccaaagt

SEQ ID NO: 837412 - DNA, 18 bp, Homo sapiens
ggcctcccaaagtgctga

SEQ ID NO: 837413 - DNA, 14 bp, Homo sapiens
ggcctcccacagac

SEQ ID NO: 837414 - DNA, 17 bp, Homo sapiens
ggcctcccacagactca

SEQ ID NO: 837415 - DNA, 14 bp, Homo sapiens
ggcctcccacccga

SEQ ID NO: 837416 - DNA, 21 bp, Homo sapiens
ggcctcccacccgatgctgct

SEQ ID NO: 837417 - DNA, 17 bp, Homo sapiens
ggcctcccagagtgctg

SEQ ID NO: 837418 - DNA, 20 bp, Homo sapiens
ggcctccccaatccaggcca

SEQ ID NO: 837419 - DNA, 20 bp, Homo sapiens
ggcctcccccaacacctgct

SEQ ID NO: 837420 - DNA, 21 bp, Homo sapiens
ggcctcccccaacacctgctg

SEQ ID NO: 837421 - DNA, 22 bp, Homo sapiens
ggcctcccccaacacctgctgc

SEQ ID NO: 837422 - DNA, 22 bp, Homo sapiens
ggcctccccgaggttgtgggga

SEQ ID NO: 837423 - DNA, 17 bp, Homo sapiens
ggcctcccctgccacca

SEQ ID NO: 837424 - DNA, 19 bp, Homo sapiens
ggcctcccctgccaccagg

SEQ ID NO: 837425 - DNA, 22 bp, Homo sapiens
ggcctcccctgccaccaggcca

SEQ ID NO: 837426 - DNA, 11 bp, Homo sapiens
ggcctccctcc

SEQ ID NO: 837427 - DNA, 12 bp, Homo sapiens
ggcctccctccg

SEQ ID NO: 837428 - DNA, 15 bp, Homo sapiens
ggcctccctctctct

SEQ ID NO: 837429 - DNA, 23 bp, Homo sapiens
ggcctccctctctcttctgctcc

SEQ ID NO: 837430 - DNA, 21 bp, Homo sapiens
ggcctccgcttatcctgctag

SEQ ID NO: 837431 - DNA, 20 bp, Homo sapiens
ggcctccgtcctgtcactga

SEQ ID NO: 837432 - DNA, 24 bp, Homo sapiens
ggcctccgtcctgtcactgatgga

SEQ ID NO: 837433 - DNA, 21 bp, Homo sapiens
ggcctccgtcttcccagcggt

SEQ ID NO: 837434 - DNA, 17 bp, Homo sapiens
ggcctcctaggggaagg

SEQ ID NO: 837435 - DNA, 19 bp, Homo sapiens
ggcctcctaggggaagggg

SEQ ID NO: 837436 - DNA, 20 bp, Homo sapiens
ggcctcctaggggaaggggg

SEQ ID NO: 837437 - DNA, 20 bp, Homo sapiens
ggcctcctcagcctctgcaa

SEQ ID NO: 837438 - DNA, 15 bp, Homo sapiens
ggcctcgcctcccca

SEQ ID NO: 837439 - DNA, 23 bp, Homo sapiens
ggcctcgcctccccaccctcctc

SEQ ID NO: 837440 - DNA, 13 bp, Homo sapiens
ggcctcgcctgcc

SEQ ID NO: 837441 - DNA, 22 bp, Homo sapiens
ggcctcggagcctcatccgagg

SEQ ID NO: 837442 - DNA, 14 bp, Homo sapiens
ggcctcggcagaac

SEQ ID NO: 837443 - DNA, 20 bp, Homo sapiens
ggcctcggtgtggagaagcg

SEQ ID NO: 837444 - DNA, 12 bp, Homo sapiens
ggcctctccagt

SEQ ID NO: 837445 - DNA, 18 bp, Homo sapiens
ggcctctcctgccctctg

SEQ ID NO: 837446 - DNA, 22 bp, Homo sapiens
ggcctctctatcctctcttcct

SEQ ID NO: 837447 - DNA, 19 bp, Homo sapiens
ggcctctctctctctcctc

SEQ ID NO: 837448 - DNA, 22 bp, Homo sapiens
ggcctctctctctctcctcagg

SEQ ID NO: 837449 - DNA, 17 bp, Homo sapiens
ggcctctctctgctcca

SEQ ID NO: 837450 - DNA, 21 bp, Homo sapiens
ggcctctctggcctcccaccc

SEQ ID NO: 837451 - DNA, 13 bp, Homo sapiens
ggcctctctgggg

SEQ ID NO: 837452 - DNA, 23 bp, Homo sapiens
ggcctctctgggggaggcagggc

SEQ ID NO: 837453 - DNA, 17 bp, Homo sapiens
ggcctctgactctgagt

SEQ ID NO: 837454 - DNA, 23 bp, Homo sapiens
ggcctctgcaactgctcagctct

SEQ ID NO: 837455 - DNA, 13 bp, Homo sapiens
ggcctctgcctgg

SEQ ID NO: 837456 - DNA, 16 bp, Homo sapiens
ggcctctgcctggggc

SEQ ID NO: 837457 - DNA, 21 bp, Homo sapiens
ggcctgtgcagcagcccagct

SEQ ID NO: 837458 - DNA, 19 bp, Homo sapiens
ggcctgtgccagcaccaca

SEQ ID NO: 837459 - DNA, 23 bp, Homo sapiens
ggcctgtgccagcaccacagccg

SEQ ID NO: 837460 - DNA, 20 bp, Homo sapiens
ggcctgtgggtctctgaagg

SEQ ID NO: 837461 - DNA, 20 bp, Homo sapiens
ggcctgtggtggctccccct

SEQ ID NO: 837462 - DNA, 20 bp, Homo sapiens
ggcctgtgtccagcagctgc

SEQ ID NO: 837463 - DNA, 15 bp, Homo sapiens
ggcctgttgctatag

SEQ ID NO: 837464 - DNA, 21 bp, Homo sapiens
ggcctgttgctatagagccta

SEQ ID NO: 837465 - DNA, 19 bp, Homo sapiens
ggcctgtttctgcagccct

SEQ ID NO: 837466 - DNA, 20 bp, Homo sapiens
ggcctgtttctgcagccctt

SEQ ID NO: 837467 - DNA, 17 bp, Homo sapiens
ggcctgtttgaaagtaa

SEQ ID NO: 837468 - DNA, 22 bp, Homo sapiens
ggccttaaaaggggcccaagcc

SEQ ID NO: 837469 - DNA, 13 bp, Homo sapiens
ggccttaagaact

SEQ ID NO: 837470 - DNA, 17 bp, Homo sapiens
ggccttaatttcctttt

SEQ ID NO: 837471 - DNA, 20 bp, Homo sapiens
ggccttagggcactgggctg

SEQ ID NO: 837472 - DNA, 21 bp, Homo sapiens
ggccttatcgggctccagcca

SEQ ID NO: 837473 - DNA, 22 bp, Homo sapiens
ggccttccccttttgcctggct

SEQ ID NO: 837474 - DNA, 23 bp, Homo sapiens
ggccttccccttttgcctggctg

SEQ ID NO: 837475 - DNA, 12 bp, Homo sapiens
ggccttcctcgt

SEQ ID NO: 837476 - DNA, 14 bp, Homo sapiens
ggccttcctgccct

SEQ ID NO: 837477 - DNA, 11 bp, Homo sapiens
ggccttctgtg

SEQ ID NO: 837478 - DNA, 16 bp, Homo sapiens
ggccttctgtggggct

SEQ ID NO: 837479 - DNA, 19 bp, Homo sapiens
ggccttctgtggggctggg

SEQ ID NO: 837480 - DNA, 13 bp, Homo sapiens
ggccttgcccaga

SEQ ID NO: 837481 - DNA, 15 bp, Homo sapiens
ggccttgcccagaga

SEQ ID NO: 837482 - DNA, 21 bp, Homo sapiens
ggccttgcggaagccataggg

SEQ ID NO: 837483 - DNA, 15 bp, Homo sapiens
ggccttgctctgagc

SEQ ID NO: 837484 - DNA, 23 bp, Homo sapiens
ggccttgctctgagcacaggtga

SEQ ID NO: 837485 - DNA, 20 bp, Homo sapiens
ggccttgctgactctctgag

SEQ ID NO: 837486 - DNA, 21 bp, Homo sapiens
ggccttgctgactctctgagc

SEQ ID NO: 837487 - DNA, 14 bp, Homo sapiens
ggccttgcttctct

SEQ ID NO: 837488 - DNA, 15 bp, Homo sapiens
ggccttgcttctctt

SEQ ID NO: 837489 - DNA, 22 bp, Homo sapiens
ggccttggatcgctaagctggc

SEQ ID NO: 837490 - DNA, 20 bp, Homo sapiens
ggccttgggccggtgctggg

SEQ ID NO: 837491 - DNA, 20 bp, Homo sapiens
ggccttgggccttggggctc

SEQ ID NO: 837492 - DNA, 17 bp, Homo sapiens
ggccttggggtgggggc

SEQ ID NO: 837493 - DNA, 23 bp, Homo sapiens
ggccttggggtgggggccaggcc

SEQ ID NO: 837494 - DNA, 19 bp, Homo sapiens
ggccttggtatgtgccagg

SEQ ID NO: 837495 - DNA, 17 bp, Homo sapiens
ggccttggtggagcagc

SEQ ID NO: 837496 - DNA, 20 bp, Homo sapiens
ggccttggtggagcagccag

SEQ ID NO: 837497 - DNA, 13 bp, Homo sapiens
ggccttgtacttg

SEQ ID NO: 837498 - DNA, 20 bp, Homo sapiens
ggccttgtggataagggaga

SEQ ID NO: 837499 - DNA, 21 bp, Homo sapiens
ggcctttaagaaccttaatga

SEQ ID NO: 837500 - DNA, 24 bp, Homo sapiens
ggcctttaagaaccttaatgacaa

SEQ ID NO: 837501 - DNA, 19 bp, Homo sapiens
ggcctttccttccctctct

SEQ ID NO: 837502 - DNA, 15 bp, Homo sapiens
ggcctttctcctccc

SEQ ID NO: 837503 - DNA, 17 bp, Homo sapiens
ggcctttcttggggaga

SEQ ID NO: 837504 - DNA, 19 bp, Homo sapiens
ggcctttgagcccacaaag

SEQ ID NO: 837505 - DNA, 19 bp, Homo sapiens
ggcctttgcaagatgcttg

SEQ ID NO: 837506 - DNA, 23 bp, Homo sapiens
ggcctttgcttatgaatatttat

SEQ ID NO: 837507 - DNA, 12 bp, Homo sapiens
ggccttttccta

SEQ ID NO: 837508 - DNA, 21 bp, Homo sapiens
ggccttttgacggccttcttg

SEQ ID NO: 837509 - DNA, 15 bp, Homo sapiens
ggcctttttcattta

SEQ ID NO: 837510 - DNA, 17 bp, Homo sapiens
ggcgacaagagtgagac

SEQ ID NO: 837511 - DNA, 23 bp, Homo sapiens
ggcgacactcagggcagctgcct

SEQ ID NO: 837512 - DNA, 20 bp, Homo sapiens
ggcgacagagcgagactccg

SEQ ID NO: 837513 - DNA, 13 bp, Homo sapiens
ggcgaccaccaaa

SEQ ID NO: 837514 - DNA, 14 bp, Homo sapiens
ggcgaccaccaaag

SEQ ID NO: 837515 - DNA, 18 bp, Homo sapiens
ggcgacgtcttcagagtc

SEQ ID NO: 837516 - DNA, 14 bp, Homo sapiens
ggcgagcctgactc

SEQ ID NO: 837517 - DNA, 18 bp, Homo sapiens
ggcgaggcccttcctctt

SEQ ID NO: 837518 - DNA, 19 bp, Homo sapiens
ggcgagtcaccctcctcac

SEQ ID NO: 837519 - DNA, 22 bp, Homo sapiens
ggcgagtcaccctcctcacaga

SEQ ID NO: 837520 - DNA, 18 bp, Homo sapiens
ggcgagtccaggagctca

SEQ ID NO: 837521 - DNA, 19 bp, Homo sapiens
ggcgagttctctttggaaa

SEQ ID NO: 837522 - DNA, 19 bp, Homo sapiens
ggcgatggggactctgccg

SEQ ID NO: 837523 - DNA, 12 bp, Homo sapiens
ggcgcaggccca

SEQ ID NO: 837524 - DNA, 15 bp, Homo sapiens
ggcgcaggcccagtg

SEQ ID NO: 837525 - DNA, 16 bp, Homo sapiens
ggcgcaggcccagtga

SEQ ID NO: 837526 - DNA, 17 bp, Homo sapiens
ggcgcaggcccagtgac

SEQ ID NO: 837527 - DNA, 23 bp, Homo sapiens
ggcgcagggacatggggcaagcc

SEQ ID NO: 837528 - DNA, 14 bp, Homo sapiens
ggcgcaggtgggct

SEQ ID NO: 837529 - DNA, 18 bp, Homo sapiens
ggcgcatgagtatctgtg

SEQ ID NO: 837530 - DNA, 11 bp, Homo sapiens
ggcgcatgtct

SEQ ID NO: 837531 - DNA, 12 bp, Homo sapiens
ggcgcatgtctg

SEQ ID NO: 837532 - DNA, 17 bp, Homo sapiens
ggcgcatgtctgcacct

SEQ ID NO: 837533 - DNA, 18 bp, Homo sapiens
ggcgccaccagctctgcc

SEQ ID NO: 837534 - DNA, 14 bp, Homo sapiens
ggcgccagcctcac

SEQ ID NO: 837535 - DNA, 13 bp, Homo sapiens
ggcgccaggacag

SEQ ID NO: 837536 - DNA, 14 bp, Homo sapiens
ggcgccaggacagc

SEQ ID NO: 837537 - DNA, 13 bp, Homo sapiens
ggcgcccagggtc

SEQ ID NO: 837538 - DNA, 14 bp, Homo sapiens
ggcgcccccagtgt

SEQ ID NO: 837539 - DNA, 16 bp, Homo sapiens
ggcgcccccgccccag

SEQ ID NO: 837540 - DNA, 20 bp, Homo sapiens
ggcgccccgcacccccgcca

SEQ ID NO: 837541 - DNA, 22 bp, Homo sapiens
ggcgcccctgccacctccctga

SEQ ID NO: 837542 - DNA, 12 bp, Homo sapiens
ggcgccctgcct

SEQ ID NO: 837543 - DNA, 20 bp, Homo sapiens
ggcgccctgcctcctggagg

SEQ ID NO: 837544 - DNA, 21 bp, Homo sapiens
ggcgccctgcctcctggagga

SEQ ID NO: 837545 - DNA, 12 bp, Homo sapiens
ggcgccctggaa

SEQ ID NO: 837546 - DNA, 14 bp, Homo sapiens
ggcgccctggaagc

SEQ ID NO: 837547 - DNA, 16 bp, Homo sapiens
ggcgccctggaagccg

SEQ ID NO: 837548 - DNA, 20 bp, Homo sapiens
ggcgccgtctccaggggctg

SEQ ID NO: 837549 - DNA, 16 bp, Homo sapiens
ggcgccgtgctgggca

SEQ ID NO: 837550 - DNA, 18 bp, Homo sapiens
ggcgccgtgctgggcagc

SEQ ID NO: 837551 - DNA, 12 bp, Homo sapiens
ggcgcctgccct

SEQ ID NO: 837552 - DNA, 17 bp, Homo sapiens
ggcgcctgccctgccca

SEQ ID NO: 837553 - DNA, 19 bp, Homo sapiens
ggcgcctgccctgcccaag

SEQ ID NO: 837554 - DNA, 20 bp, Homo sapiens
ggcgcctgccctgcccaagt

SEQ ID NO: 837555 - DNA, 21 bp, Homo sapiens
ggcgcctggagggatgccccc

SEQ ID NO: 837556 - DNA, 20 bp, Homo sapiens
ggcgcctgtagtcccagcca

SEQ ID NO: 837557 - DNA, 13 bp, Homo sapiens
ggcgccttttcag

SEQ ID NO: 837558 - DNA, 18 bp, Homo sapiens
ggcgcgcaggcagggaga

SEQ ID NO: 837559 - DNA, 15 bp, Homo sapiens
ggcgcggagtgaacc

SEQ ID NO: 837560 - DNA, 19 bp, Homo sapiens
ggcgcgggaggcaccagct

SEQ ID NO: 837561 - DNA, 16 bp, Homo sapiens
ggcgcgggcagccacc

SEQ ID NO: 837562 - DNA, 15 bp, Homo sapiens
ggcgcggtggctcac

SEQ ID NO: 837563 - DNA, 14 bp, Homo sapiens
ggcgctcagacccc

SEQ ID NO: 837564 - DNA, 15 bp, Homo sapiens
ggcgctcagacccca

SEQ ID NO: 837565 - DNA, 14 bp, Homo sapiens
ggcgctcaggaccc

SEQ ID NO: 837566 - DNA, 21 bp, Homo sapiens
ggcgctgcgcggactcgcccc

SEQ ID NO: 837567 - DNA, 23 bp, Homo sapiens
ggcgctgcggacaccgtggcctg

SEQ ID NO: 837568 - DNA, 18 bp, Homo sapiens
ggcgctgctgggagcaga

SEQ ID NO: 837569 - DNA, 14 bp, Homo sapiens
ggcgcttggatctg

SEQ ID NO: 837570 - DNA, 15 bp, Homo sapiens
ggcgcttggatctgg

SEQ ID NO: 837571 - DNA, 16 bp, Homo sapiens
ggcgcttggatctggg

SEQ ID NO: 837572 - DNA, 17 bp, Homo sapiens
ggcgctttctcctgtgc

SEQ ID NO: 837573 - DNA, 23 bp, Homo sapiens
ggcggagctggggtctgggcagt

SEQ ID NO: 837574 - DNA, 21 bp, Homo sapiens
ggcggagcttgcagtgagccg

SEQ ID NO: 837575 - DNA, 12 bp, Homo sapiens
ggcggaggagga

SEQ ID NO: 837576 - DNA, 21 bp, Homo sapiens
ggcggagtccccggggttccc

SEQ ID NO: 837577 - DNA, 22 bp, Homo sapiens
ggcggatcacaaggtcaggagt

SEQ ID NO: 837578 - DNA, 18 bp, Homo sapiens
ggctcacagggcaggcct

SEQ ID NO: 837579 - DNA, 23 bp, Homo sapiens
ggctcacagtacagcatgtgcct

SEQ ID NO: 837580 - DNA, 19 bp, Homo sapiens
ggctcacccaagcaaggcc

SEQ ID NO: 837581 - DNA, 22 bp, Homo sapiens
ggctcacccccttctccatcca

SEQ ID NO: 837582 - DNA, 22 bp, Homo sapiens
ggctcacctttagaacaggaga

SEQ ID NO: 837583 - DNA, 16 bp, Homo sapiens
ggctcacgccccgctg

SEQ ID NO: 837584 - DNA, 18 bp, Homo sapiens
ggctcacgccccgctgtg

SEQ ID NO: 837585 - DNA, 20 bp, Homo sapiens
ggctcacgcctatgatccca

SEQ ID NO: 837586 - DNA, 21 bp, Homo sapiens
ggctcacgcctatgatcccag

SEQ ID NO: 837587 - DNA, 23 bp, Homo sapiens
ggctcacgcctatgatcccagca

SEQ ID NO: 837588 - DNA, 13 bp, Homo sapiens
ggctcacgcctgt

SEQ ID NO: 837589 - DNA, 17 bp, Homo sapiens
ggctcacgcctgtaatc

SEQ ID NO: 837590 - DNA, 23 bp, Homo sapiens
ggctcacgcctgtaatcccagca

SEQ ID NO: 837591 - DNA, 24 bp, Homo sapiens
ggctcacgcctgtaatcccagcag

SEQ ID NO: 837592 - DNA, 15 bp, Homo sapiens
ggctcactgcagcgc

SEQ ID NO: 837593 - DNA, 16 bp, Homo sapiens
ggctcactgccaggcc

SEQ ID NO: 837594 - DNA, 21 bp, Homo sapiens
ggctcactgccaggccagcct

SEQ ID NO: 837595 - DNA, 22 bp, Homo sapiens
ggctcactgccaggccagcctc

SEQ ID NO: 837596 - DNA, 16 bp, Homo sapiens
ggctcactggctggga

SEQ ID NO: 837597 - DNA, 13 bp, Homo sapiens
ggctcactgtgct

SEQ ID NO: 837598 - DNA, 14 bp, Homo sapiens
ggctcagagctttg

SEQ ID NO: 837599 - DNA, 16 bp, Homo sapiens
ggctcagagctttgtc

SEQ ID NO: 837600 - DNA, 21 bp, Homo sapiens
ggctcagagggggactgctgc

SEQ ID NO: 837601 - DNA, 16 bp, Homo sapiens
ggctcagagtgaccct

SEQ ID NO: 837602 - DNA, 19 bp, Homo sapiens
ggctcagagtgaccctcag

SEQ ID NO: 837603 - DNA, 19 bp, Homo sapiens
ggctcagcaaaagatgctt

SEQ ID NO: 837604 - DNA, 14 bp, Homo sapiens
ggctcagcccgctg

SEQ ID NO: 837605 - DNA, 12 bp, Homo sapiens
ggctcagcctgt

SEQ ID NO: 837606 - DNA, 16 bp, Homo sapiens
ggctcagccttgcaca

SEQ ID NO: 837607 - DNA, 15 bp, Homo sapiens
ggctcaggcaagccc

SEQ ID NO: 837608 - DNA, 21 bp, Homo sapiens
ggctcaggggagcaagcttac

SEQ ID NO: 837609 - DNA, 16 bp, Homo sapiens
ggctcagggttggcca

SEQ ID NO: 837610 - DNA, 22 bp, Homo sapiens
ggctcagggttggccatttgct

SEQ ID NO: 837611 - DNA, 14 bp, Homo sapiens
ggctcagtctcagg

SEQ ID NO: 837612 - DNA, 14 bp, Homo sapiens
ggctcagtgccacc

SEQ ID NO: 837613 - DNA, 23 bp, Homo sapiens
ggctcagtgccacctatgcctgt

SEQ ID NO: 837614 - DNA, 23 bp, Homo sapiens
ggctcatggcgtaatgggcctgc

SEQ ID NO: 837615 - DNA, 18 bp, Homo sapiens
ggctccagcatccagcct

SEQ ID NO: 837616 - DNA, 20 bp, Homo sapiens
ggctccagcatccagcctgt

SEQ ID NO: 837617 - DNA, 21 bp, Homo sapiens
ggctccagcatccagcctgtg

SEQ ID NO: 837618 - DNA, 15 bp, Homo sapiens
ggctccagtctgctg

SEQ ID NO: 837619 - DNA, 18 bp, Homo sapiens
ggctccagtctgctgccc

SEQ ID NO: 837620 - DNA, 22 bp, Homo sapiens
ggctccagtctgctgccctcca

SEQ ID NO: 837621 - DNA, 24 bp, Homo sapiens
ggctccagtctgctgccctccatc

SEQ ID NO: 837622 - DNA, 17 bp, Homo sapiens
ggctccatgcctctgga

SEQ ID NO: 837623 - DNA, 17 bp, Homo sapiens
ggctcccaatcagcttt

SEQ ID NO: 837624 - DNA, 11 bp, Homo sapiens
ggctcccaccc

SEQ ID NO: 837625 - DNA, 19 bp, Homo sapiens
ggctcccaccctcccctga

SEQ ID NO: 837626 - DNA, 22 bp, Homo sapiens
ggctcccagctcctttctcctg

SEQ ID NO: 837627 - DNA, 21 bp, Homo sapiens
ggctcccaggggtctccctgg

SEQ ID NO: 837628 - DNA, 22 bp, Homo sapiens
ggctcccattcactcttccaga

SEQ ID NO: 837629 - DNA, 21 bp, Homo sapiens
ggctcccattttcagttccct

SEQ ID NO: 837630 - DNA, 22 bp, Homo sapiens
ggctcccattttcagttccctc

SEQ ID NO: 837631 - DNA, 15 bp, Homo sapiens
ggctccccacctgga

SEQ ID NO: 837632 - DNA, 17 bp, Homo sapiens
ggctccccacctggaca

SEQ ID NO: 837633 - DNA, 18 bp, Homo sapiens
ggctccccacctggacac

SEQ ID NO: 837634 - DNA, 12 bp, Homo sapiens
ggctccccagaa

SEQ ID NO: 837635 - DNA, 20 bp, Homo sapiens
ggctccccagaactggctgg

SEQ ID NO: 837636 - DNA, 22 bp, Homo sapiens
ggctccccatgtgtcctggttc

SEQ ID NO: 837637 - DNA, 16 bp, Homo sapiens
ggctccccctccccag

SEQ ID NO: 837638 - DNA, 21 bp, Homo sapiens
ggctccccctccccaggctgg

SEQ ID NO: 837639 - DNA, 23 bp, Homo sapiens
ggctccccctccccaggctggag

SEQ ID NO: 837640 - DNA, 21 bp, Homo sapiens
ggctccccctgctggtgtcta

SEQ ID NO: 837641 - DNA, 23 bp, Homo sapiens
ggctcccctcccaggggagccag

SEQ ID NO: 837642 - DNA, 12 bp, Homo sapiens
ggctcccctcta

SEQ ID NO: 837643 - DNA, 12 bp, Homo sapiens
ggctcccctctt

SEQ ID NO: 837644 - DNA, 15 bp, Homo sapiens
ggctcccctcttcct

SEQ ID NO: 837645 - DNA, 17 bp, Homo sapiens
ggctcccctcttcctct

SEQ ID NO: 837646 - DNA, 15 bp, Homo sapiens
ggctcccggaattcc

SEQ ID NO: 837647 - DNA, 19 bp, Homo sapiens
ggctcccgggggccccacc

SEQ ID NO: 837648 - DNA, 17 bp, Homo sapiens
ggctcccgggtccttgg

SEQ ID NO: 837649 - DNA, 21 bp, Homo sapiens
ggctccctaaactttggcctt

SEQ ID NO: 837650 - DNA, 20 bp, Homo sapiens
ggctccctacattccccaga

SEQ ID NO: 837651 - DNA, 22 bp, Homo sapiens
ggctccctcccgtagtctcctg

SEQ ID NO: 837652 - DNA, 20 bp, Homo sapiens
ggctccctcctccaggcctg

SEQ ID NO: 837653 - DNA, 19 bp, Homo sapiens
ggctccctcctctggcagg

SEQ ID NO: 837654 - DNA, 16 bp, Homo sapiens
ggctccctcctggagc

SEQ ID NO: 837655 - DNA, 13 bp, Homo sapiens
ggctccctgcccc

SEQ ID NO: 837656 - DNA, 11 bp, Homo sapiens
ggctccctgga

SEQ ID NO: 837657 - DNA, 14 bp, Homo sapiens
ggctccctgggcag

SEQ ID NO: 837658 - DNA, 21 bp, Homo sapiens
ggctccctgtaacctcttcag

SEQ ID NO: 837659 - DNA, 21 bp, Homo sapiens
ggctcccttcatctccaggga

SEQ ID NO: 837660 - DNA, 20 bp, Homo sapiens
ggctccgaaattccaaggcc

SEQ ID NO: 837661 - DNA, 22 bp, Homo sapiens
ggctccgagggcggccagggac

SEQ ID NO: 837662 - DNA, 21 bp, Homo sapiens
ggctccgcccttagtccccca

SEQ ID NO: 837663 - DNA, 18 bp, Homo sapiens
ggctccgggctgtgtcct

SEQ ID NO: 837664 - DNA, 18 bp, Homo sapiens
ggctccgggtcactgctg

SEQ ID NO: 837665 - DNA, 14 bp, Homo sapiens
ggctcctaggctca

SEQ ID NO: 837666 - DNA, 14 bp, Homo sapiens
ggctcctccccgat

SEQ ID NO: 837667 - DNA, 21 bp, Homo sapiens
ggctcctccccgatccccgac

SEQ ID NO: 837668 - DNA, 12 bp, Homo sapiens
ggctcctccttg

SEQ ID NO: 837669 - DNA, 20 bp, Homo sapiens
ggctcctcgcccccaccagt

SEQ ID NO: 837670 - DNA, 12 bp, Homo sapiens
ggctcctctcag

SEQ ID NO: 837671 - DNA, 13 bp, Homo sapiens
ggctcctggaaag

SEQ ID NO: 837672 - DNA, 15 bp, Homo sapiens
ggctcctggctgcca

SEQ ID NO: 837673 - DNA, 18 bp, Homo sapiens
ggctcctggctgccaggc

SEQ ID NO: 837674 - DNA, 19 bp, Homo sapiens
ggctcctggctgtgcccag

SEQ ID NO: 837675 - DNA, 13 bp, Homo sapiens
ggctcctggggca

SEQ ID NO: 837676 - DNA, 16 bp, Homo sapiens
ggctcctggggcagag

SEQ ID NO: 837677 - DNA, 13 bp, Homo sapiens
ggctcctgggttg

SEQ ID NO: 837678 - DNA, 19 bp, Homo sapiens
ggctcctgggttggaggga

SEQ ID NO: 837679 - DNA, 20 bp, Homo sapiens
ggctcctgggttggagggaa

SEQ ID NO: 837680 - DNA, 13 bp, Homo sapiens
ggctcctgtctgg

SEQ ID NO: 837681 - DNA, 20 bp, Homo sapiens
ggctccttcccatcgctgtc

SEQ ID NO: 837682 - DNA, 13 bp, Homo sapiens
ggctccttcccct

SEQ ID NO: 837683 - DNA, 12 bp, Homo sapiens
ggctccttgcag

SEQ ID NO: 837684 - DNA, 12 bp, Homo sapiens
ggctcctttctc

SEQ ID NO: 837685 - DNA, 15 bp, Homo sapiens
ggctcgaatctctgt

SEQ ID NO: 837686 - DNA, 19 bp, Homo sapiens
ggctcgaatctctgtgcct

SEQ ID NO: 837687 - DNA, 20 bp, Homo sapiens
ggctcgaatctctgtgcctt

SEQ ID NO: 837688 - DNA, 21 bp, Homo sapiens
ggctcgatgtttgccatgagt

SEQ ID NO: 837689 - DNA, 19 bp, Homo sapiens
ggctcgattttgtatctgc

SEQ ID NO: 837690 - DNA, 13 bp, Homo sapiens
ggctcgcccatac

SEQ ID NO: 837691 - DNA, 18 bp, Homo sapiens
ggctcgcccatacccgtg

SEQ ID NO: 837692 - DNA, 15 bp, Homo sapiens
ggctcgccccaccca

SEQ ID NO: 837693 - DNA, 20 bp, Homo sapiens
ggctcgccccacccagggct

SEQ ID NO: 837694 - DNA, 15 bp, Homo sapiens
ggctcgccttccctc

SEQ ID NO: 837695 - DNA, 22 bp, Homo sapiens
ggctcgctccctgtagctctgc

SEQ ID NO: 837696 - DNA, 13 bp, Homo sapiens
ggctcggggaggc

SEQ ID NO: 837697 - DNA, 19 bp, Homo sapiens
ggctcggggtaaaaagtgg

SEQ ID NO: 837698 - DNA, 22 bp, Homo sapiens
ggctcggggtaaaaagtggctg

SEQ ID NO: 837699 - DNA, 19 bp, Homo sapiens
ggctggccctgtgcagacc

SEQ ID NO: 837700 - DNA, 21 bp, Homo sapiens
ggctggcctaggagatatctg

SEQ ID NO: 837701 - DNA, 23 bp, Homo sapiens
ggctggcctcacccacccctgca

SEQ ID NO: 837702 - DNA, 20 bp, Homo sapiens
ggctggcctcccaaatgagc

SEQ ID NO: 837703 - DNA, 17 bp, Homo sapiens
ggctggcctggaggctc

SEQ ID NO: 837704 - DNA, 14 bp, Homo sapiens
ggctggccttcctg

SEQ ID NO: 837705 - DNA, 22 bp, Homo sapiens
ggctggcctttcaggtccaggc

SEQ ID NO: 837706 - DNA, 14 bp, Homo sapiens
ggctggcgcagcca

SEQ ID NO: 837707 - DNA, 21 bp, Homo sapiens
ggctggcgcagccaaggccga

SEQ ID NO: 837708 - DNA, 19 bp, Homo sapiens
ggctggcgcttggatctgg

SEQ ID NO: 837709 - DNA, 20 bp, Homo sapiens
ggctggcggctactcagcag

SEQ ID NO: 837710 - DNA, 17 bp, Homo sapiens
ggctggctaactggaag

SEQ ID NO: 837711 - DNA, 11 bp, Homo sapiens
ggctggctccc

SEQ ID NO: 837712 - DNA, 15 bp, Homo sapiens
ggctggctcccaggg

SEQ ID NO: 837713 - DNA, 17 bp, Homo sapiens
ggctggctcccagggtg

SEQ ID NO: 837714 - DNA, 18 bp, Homo sapiens
ggctggctcccagggtgg

SEQ ID NO: 837715 - DNA, 15 bp, Homo sapiens
ggctggctccccctc

SEQ ID NO: 837716 - DNA, 21 bp, Homo sapiens
ggctggctccccctccccagg

SEQ ID NO: 837717 - DNA, 13 bp, Homo sapiens
ggctggctcctga

SEQ ID NO: 837718 - DNA, 23 bp, Homo sapiens
ggctggctctaccttcctgtccc

SEQ ID NO: 837719 - DNA, 13 bp, Homo sapiens
ggctggctgagtg

SEQ ID NO: 837720 - DNA, 15 bp, Homo sapiens
ggctggctgcagtga

SEQ ID NO: 837721 - DNA, 15 bp, Homo sapiens
ggctggctggcctca

SEQ ID NO: 837722 - DNA, 17 bp, Homo sapiens
ggctgggacttcttacc

SEQ ID NO: 837723 - DNA, 15 bp, Homo sapiens
ggctgggaggaaggg

SEQ ID NO: 837724 - DNA, 20 bp, Homo sapiens
ggctgggcaccgtgtcctcc

SEQ ID NO: 837725 - DNA, 13 bp, Homo sapiens
ggctgggcagcct

SEQ ID NO: 837726 - DNA, 13 bp, Homo sapiens
ggctgggcatccc

SEQ ID NO: 837727 - DNA, 14 bp, Homo sapiens
ggctgggcatccca

SEQ ID NO: 837728 - DNA, 16 bp, Homo sapiens
ggctgggcatcccagc

SEQ ID NO: 837729 - DNA, 17 bp, Homo sapiens
ggctgggcatcccagct

SEQ ID NO: 837730 - DNA, 19 bp, Homo sapiens
ggctgggcatcccagcttg

SEQ ID NO: 837731 - DNA, 13 bp, Homo sapiens
ggctgggcccaca

SEQ ID NO: 837732 - DNA, 14 bp, Homo sapiens
ggctgggcccctgg

SEQ ID NO: 837733 - DNA, 15 bp, Homo sapiens
ggctgggcccctggg

SEQ ID NO: 837734 - DNA, 18 bp, Homo sapiens
ggctgggcccctggggac

SEQ ID NO: 837735 - DNA, 20 bp, Homo sapiens
ggctgggcccctggggacag

SEQ ID NO: 837736 - DNA, 21 bp, Homo sapiens
ggctgggcccctggggacaga

SEQ ID NO: 837737 - DNA, 22 bp, Homo sapiens
ggctgggcccctggggacagag

SEQ ID NO: 837738 - DNA, 22 bp, Homo sapiens
ggctgggccgcaagggcctgga

SEQ ID NO: 837739 - DNA, 23 bp, Homo sapiens
ggctgggccgcaagggcctggac

SEQ ID NO: 837740 - DNA, 17 bp, Homo sapiens
ggctgggcctccttctt

SEQ ID NO: 837741 - DNA, 22 bp, Homo sapiens
ggctgggcctccttcttccact

SEQ ID NO: 837742 - DNA, 19 bp, Homo sapiens
ggctgggcctcgtgcgccc

SEQ ID NO: 837743 - DNA, 14 bp, Homo sapiens
ggctgggctgagcc

SEQ ID NO: 837744 - DNA, 23 bp, Homo sapiens
ggctgggctgagcccctggtctt

SEQ ID NO: 837745 - DNA, 15 bp, Homo sapiens
ggctgggctgggctg

SEQ ID NO: 837746 - DNA, 14 bp, Homo sapiens
ggctggggactctg

SEQ ID NO: 837747 - DNA, 23 bp, Homo sapiens
ggctggggaggaccagggccctg

SEQ ID NO: 837748 - DNA, 12 bp, Homo sapiens
ggctggggaggg

SEQ ID NO: 837749 - DNA, 15 bp, Homo sapiens
ggctggggagggggt

SEQ ID NO: 837750 - DNA, 15 bp, Homo sapiens
ggctggggaggtgct

SEQ ID NO: 837751 - DNA, 16 bp, Homo sapiens
ggctggggcaggggcc

SEQ ID NO: 837752 - DNA, 17 bp, Homo sapiens
ggctggggcaggggcct

SEQ ID NO: 837753 - DNA, 19 bp, Homo sapiens
ggctggggcaggggcctgg

SEQ ID NO: 837754 - DNA, 21 bp, Homo sapiens
ggctggggcaggggcctgggc

SEQ ID NO: 837755 - DNA, 19 bp, Homo sapiens
ggctggggccacctttgtg

SEQ ID NO: 837756 - DNA, 16 bp, Homo sapiens
ggctggggccttttga

SEQ ID NO: 837757 - DNA, 19 bp, Homo sapiens
ggctggggctgctccccta

SEQ ID NO: 837758 - DNA, 16 bp, Homo sapiens
ggctgggggagagccg

SEQ ID NO: 837759 - DNA, 19 bp, Homo sapiens
ggctgggggagagccgtgg

SEQ ID NO: 837760 - DNA, 19 bp, Homo sapiens
ggctgggggaggtccaagc

SEQ ID NO: 837761 - DNA, 18 bp, Homo sapiens
ggctgggggcaggagggc

SEQ ID NO: 837762 - DNA, 14 bp, Homo sapiens
ggctggggtgagag

SEQ ID NO: 837763 - DNA, 19 bp, Homo sapiens
ggctggggtgagcctgact

SEQ ID NO: 837764 - DNA, 20 bp, Homo sapiens
ggctgggtaatgtgaaggcc

SEQ ID NO: 837765 - DNA, 22 bp, Homo sapiens
ggctgggtgaccgactacccca

SEQ ID NO: 837766 - DNA, 14 bp, Homo sapiens
ggctgggtgccctc

SEQ ID NO: 837767 - DNA, 13 bp, Homo sapiens
ggctgggtgctgg

SEQ ID NO: 837768 - DNA, 15 bp, Homo sapiens
ggctgggtgctggga

SEQ ID NO: 837769 - DNA, 20 bp, Homo sapiens
ggctggtagaaaaaggggcc

SEQ ID NO: 837770 - DNA, 15 bp, Homo sapiens
ggctggtagcagcag

SEQ ID NO: 837771 - DNA, 16 bp, Homo sapiens
ggctggtagcagcagg

SEQ ID NO: 837772 - DNA, 16 bp, Homo sapiens
ggctggtatctcagaa

SEQ ID NO: 837773 - DNA, 22 bp, Homo sapiens
ggctggtattctctctatgcaa

SEQ ID NO: 837774 - DNA, 14 bp, Homo sapiens
ggctggtcactctg

SEQ ID NO: 837775 - DNA, 17 bp, Homo sapiens
ggctggtcactctgccc

SEQ ID NO: 837776 - DNA, 18 bp, Homo sapiens
ggctggtcactctgccct

SEQ ID NO: 837777 - DNA, 19 bp, Homo sapiens
ggctggtcactctgccctc

SEQ ID NO: 837778 - DNA, 20 bp, Homo sapiens
ggctggtcactctgccctct

SEQ ID NO: 837779 - DNA, 16 bp, Homo sapiens
ggctggtccttattta

SEQ ID NO: 837780 - DNA, 20 bp, Homo sapiens
ggctggtctcgaactcctga

SEQ ID NO: 837781 - DNA, 20 bp, Homo sapiens
ggctggtctggagtcccacc

SEQ ID NO: 837782 - DNA, 18 bp, Homo sapiens
ggctggtgccagccttcc

SEQ ID NO: 837783 - DNA, 16 bp, Homo sapiens
ggctggtgcccatgaa

SEQ ID NO: 837784 - DNA, 19 bp, Homo sapiens
ggctggtgctgtggccagg

SEQ ID NO: 837785 - DNA, 23 bp, Homo sapiens
ggctggttttgtaagatgctggg

SEQ ID NO: 837786 - DNA, 16 bp, Homo sapiens
ggctgtaaaatgcatg

SEQ ID NO: 837787 - DNA, 20 bp, Homo sapiens
ggctgtaactgagagaaaga

SEQ ID NO: 837788 - DNA, 21 bp, Homo sapiens
ggctgtaagcattctgagctg

SEQ ID NO: 837789 - DNA, 19 bp, Homo sapiens
ggctgtagatggtgacctg

SEQ ID NO: 837790 - DNA, 23 bp, Homo sapiens
ggctgtagttacattaatgccca

SEQ ID NO: 837791 - DNA, 23 bp, Homo sapiens
ggctgtcaccctccaccgagcca

SEQ ID NO: 837792 - DNA, 18 bp, Homo sapiens
ggctgtcagtatgacatt

SEQ ID NO: 837793 - DNA, 15 bp, Homo sapiens
ggctgtccaaccaga

SEQ ID NO: 837794 - DNA, 13 bp, Homo sapiens
ggctgtccagcct

SEQ ID NO: 837795 - DNA, 17 bp, Homo sapiens
ggctgtccctcatggag

SEQ ID NO: 837796 - DNA, 22 bp, Homo sapiens
ggctgtccctcatggagacctc

SEQ ID NO: 837797 - DNA, 16 bp, Homo sapiens
ggctgtcctccttcct

SEQ ID NO: 837798 - DNA, 19 bp, Homo sapiens
ggctgtcctccttcctggg

SEQ ID NO: 837799 - DNA, 21 bp, Homo sapiens
ggctgtcctccttcctgggac

SEQ ID NO: 837800 - DNA, 22 bp, Homo sapiens
ggctgtcctgtacattgtggga

SEQ ID NO: 837801 - DNA, 10 bp, Homo sapiens
ggctgtcctt

SEQ ID NO: 837802 - DNA, 19 bp, Homo sapiens
ggctgtccttccccttccc

SEQ ID NO: 837803 - DNA, 17 bp, Homo sapiens
ggctgtctctcccttcc

SEQ ID NO: 837804 - DNA, 18 bp, Homo sapiens
ggctgtctctcccttcca

SEQ ID NO: 837805 - DNA, 19 bp, Homo sapiens
ggctgtctgcacagagggt

SEQ ID NO: 837806 - DNA, 15 bp, Homo sapiens
ggctgtctgcctgta

SEQ ID NO: 837807 - DNA, 20 bp, Homo sapiens
ggctgtctgcctgtattttc

SEQ ID NO: 837808 - DNA, 13 bp, Homo sapiens
ggctgtctggggc

SEQ ID NO: 837809 - DNA, 14 bp, Homo sapiens
ggctgtctgtgcca

SEQ ID NO: 837810 - DNA, 18 bp, Homo sapiens
ggctgtctgtgccatggc

SEQ ID NO: 837811 - DNA, 20 bp, Homo sapiens
ggctgtgacaaccctggcct

SEQ ID NO: 837812 - DNA, 18 bp, Homo sapiens
ggctgtgactctgggcag

SEQ ID NO: 837813 - DNA, 22 bp, Homo sapiens
ggctgtgactctgggcagggac

SEQ ID NO: 837814 - DNA, 13 bp, Homo sapiens
ggctgtgaggccc

SEQ ID NO: 837815 - DNA, 11 bp, Homo sapiens
ggctgtgagtg

SEQ ID NO: 837816 - DNA, 18 bp, Homo sapiens
ggctgtgcccagcaggcc

SEQ ID NO: 837817 - DNA, 21 bp, Homo sapiens
ggctgtgcccagcaggcccag

SEQ ID NO: 837818 - DNA, 19 bp, Homo sapiens
ggctgtgcccctgatgcag

SEQ ID NO: 837819 - DNA, 22 bp, Homo sapiens
ggctgtgcccctgatgcagcct

SEQ ID NO: 837820 - DNA, 10 bp, Homo sapiens
ggctgtgcta

SEQ ID NO: 837821 - DNA, 14 bp, Homo sapiens
ggctgtgctgccct

SEQ ID NO: 837822 - DNA, 16 bp, Homo sapiens
ggctgtgctgccctga

SEQ ID NO: 837823 - DNA, 19 bp, Homo sapiens
ggctgtgcttgaaggccct

SEQ ID NO: 837824 - DNA, 21 bp, Homo sapiens
ggctgtgcttgaaggccctgc

SEQ ID NO: 837825 - DNA, 14 bp, Homo sapiens
ggctgtggaggcct

SEQ ID NO: 837826 - DNA, 15 bp, Homo sapiens
ggctgtggaggcctg

SEQ ID NO: 837827 - DNA, 15 bp, Homo sapiens
ggctgtggcatttcc

SEQ ID NO: 837828 - DNA, 14 bp, Homo sapiens
ggctgtggccctgc

SEQ ID NO: 837829 - DNA, 15 bp, Homo sapiens
ggctgtggccctgcc

SEQ ID NO: 837830 - DNA, 16 bp, Homo sapiens
ggctgtgggactccag

SEQ ID NO: 837831 - DNA, 17 bp, Homo sapiens
ggctgtggggtctggct

SEQ ID NO: 837832 - DNA, 21 bp, Homo sapiens
ggctgtggggtggagcactgg

SEQ ID NO: 837833 - DNA, 24 bp, Homo sapiens
ggctgtggggtggagcactggact

SEQ ID NO: 837834 - DNA, 15 bp, Homo sapiens
ggctgtggtcacagc

SEQ ID NO: 837835 - DNA, 13 bp, Homo sapiens
ggctgtggtccta

SEQ ID NO: 837836 - DNA, 12 bp, Homo sapiens
ggctgtggttcc

SEQ ID NO: 837837 - DNA, 14 bp, Homo sapiens
ggctgtgtctaaac

SEQ ID NO: 837838 - DNA, 16 bp, Homo sapiens
ggctgtgtctaaactg

SEQ ID NO: 837839 - DNA, 14 bp, Homo sapiens
ggctgtgtgacaga

SEQ ID NO: 837840 - DNA, 12 bp, Homo sapiens
ggctgtgtggcc

SEQ ID NO: 837841 - DNA, 16 bp, Homo sapiens
ggctgtgttatgaaaa

SEQ ID NO: 837842 - DNA, 19 bp, Homo sapiens
ggctgtgttgactgctgct

SEQ ID NO: 837843 - DNA, 20 bp, Homo sapiens
ggctgtgtttgcagcctgct

SEQ ID NO: 837844 - DNA, 16 bp, Homo sapiens
ggctgttccatgttct

SEQ ID NO: 837845 - DNA, 13 bp, Homo sapiens
ggctgttcccttt

SEQ ID NO: 837846 - DNA, 21 bp, Homo sapiens
ggctgttgagggccacttttt

SEQ ID NO: 837847 - DNA, 19 bp, Homo sapiens
ggctgttgctagggagagg

SEQ ID NO: 837848 - DNA, 13 bp, Homo sapiens
ggctgttggggac

SEQ ID NO: 837849 - DNA, 14 bp, Homo sapiens
ggcttaaagtgaag

SEQ ID NO: 837850 - DNA, 15 bp, Homo sapiens
ggcttaagaactgct

SEQ ID NO: 837851 - DNA, 14 bp, Homo sapiens
ggcttaatcatttt

SEQ ID NO: 837852 - DNA, 19 bp, Homo sapiens
ggcttacctgacctcttgc

SEQ ID NO: 837853 - DNA, 23 bp, Homo sapiens
ggcttacctgacctcttgctgtc

SEQ ID NO: 837854 - DNA, 15 bp, Homo sapiens
ggcttagccaagccc

SEQ ID NO: 837855 - DNA, 22 bp, Homo sapiens
ggcttagggacaggaccccagc

SEQ ID NO: 837856 - DNA, 16 bp, Homo sapiens
ggcttagtatttctca

SEQ ID NO: 837857 - DNA, 19 bp, Homo sapiens
ggcttagtatttctcagga

SEQ ID NO: 837858 - DNA, 22 bp, Homo sapiens
ggcttagtatttctcaggaaga

SEQ ID NO: 837859 - DNA, 22 bp, Homo sapiens
ggcttagtttgtgtgttgtctc

SEQ ID NO: 837860 - DNA, 18 bp, Homo sapiens
ggcttatatctggcctct

SEQ ID NO: 837861 - DNA, 22 bp, Homo sapiens
ggcttatattttcagcaaagaa

SEQ ID NO: 837862 - DNA, 13 bp, Homo sapiens
ggcttatttctat

SEQ ID NO: 837863 - DNA, 23 bp, Homo sapiens
ggcttcaaagatatagggtgtgg

SEQ ID NO: 837864 - DNA, 16 bp, Homo sapiens
ggcttcacagccacac

SEQ ID NO: 837865 - DNA, 18 bp, Homo sapiens
ggcttcaccagtctgtct

SEQ ID NO: 837866 - DNA, 21 bp, Homo sapiens
ggcttcaccagtctgtctact

SEQ ID NO: 837867 - DNA, 17 bp, Homo sapiens
ggcttcagcatatttat

SEQ ID NO: 837868 - DNA, 17 bp, Homo sapiens
ggcttcagcccccacca

SEQ ID NO: 837869 - DNA, 16 bp, Homo sapiens
ggcttcattctggaaa

SEQ ID NO: 837870 - DNA, 15 bp, Homo sapiens
ggcttcatttcaatc

SEQ ID NO: 837871 - DNA, 12 bp, Homo sapiens
ggcttccaggct

SEQ ID NO: 837872 - DNA, 13 bp, Homo sapiens
ggcttccaggctc

SEQ ID NO: 837873 - DNA, 17 bp, Homo sapiens
ggcttccaggctcttcc

SEQ ID NO: 837874 - DNA, 12 bp, Homo sapiens
ggcttccaggta

SEQ ID NO: 837875 - DNA, 20 bp, Homo sapiens
ggcttcccatagtggggcct

SEQ ID NO: 837876 - DNA, 21 bp, Homo sapiens
ggcttccccatcagctcccaa

SEQ ID NO: 837877 - DNA, 19 bp, Homo sapiens
ggcttcccgctcagccctc

SEQ ID NO: 837878 - DNA, 21 bp, Homo sapiens
ggcttcccgctcagccctccc

SEQ ID NO: 837879 - DNA, 17 bp, Homo sapiens
ggcttccctaaactgca

SEQ ID NO: 837880 - DNA, 16 bp, Homo sapiens
ggcttccctggcatga

SEQ ID NO: 837881 - DNA, 13 bp, Homo sapiens
ggcttccgcgccc

SEQ ID NO: 837882 - DNA, 16 bp, Homo sapiens
ggcttccgtgtcctct

SEQ ID NO: 837883 - DNA, 21 bp, Homo sapiens
ggcttcctctagaagccaagg

SEQ ID NO: 837884 - DNA, 23 bp, Homo sapiens
ggcttcctgagaaagcccacctg

SEQ ID NO: 837885 - DNA, 13 bp, Homo sapiens
ggcttcctgccct

SEQ ID NO: 837886 - DNA, 18 bp, Homo sapiens
ggcttcctgcccttccct

SEQ ID NO: 837887 - DNA, 19 bp, Homo sapiens
ggcttcctgcccttccctc

SEQ ID NO: 837888 - DNA, 20 bp, Homo sapiens
ggcttcctgcgtcctcctca

SEQ ID NO: 837889 - DNA, 14 bp, Homo sapiens
ggcttcggagggcc

SEQ ID NO: 837890 - DNA, 21 bp, Homo sapiens
ggcttctccgccagcctcctc

SEQ ID NO: 837891 - DNA, 13 bp, Homo sapiens
ggcttctcctgac

SEQ ID NO: 837892 - DNA, 16 bp, Homo sapiens
ggcttctcctgaccca

SEQ ID NO: 837893 - DNA, 21 bp, Homo sapiens
ggcttctccttctccttccca

SEQ ID NO: 837894 - DNA, 14 bp, Homo sapiens
ggcttctctctgtg

SEQ ID NO: 837895 - DNA, 13 bp, Homo sapiens
ggcttctgcaccc

SEQ ID NO: 837896 - DNA, 21 bp, Homo sapiens
ggcttctgcaccctccaccct

SEQ ID NO: 837897 - DNA, 18 bp, Homo sapiens
ggcttctgcgtccaccag

SEQ ID NO: 837898 - DNA, 19 bp, Homo sapiens
ggcttctgcgtccaccagg

SEQ ID NO: 837899 - DNA, 22 bp, Homo sapiens
ggcttctgcgtccaccaggcct

SEQ ID NO: 837900 - DNA, 16 bp, Homo sapiens
ggcttctggagccctt

SEQ ID NO: 837901 - DNA, 12 bp, Homo sapiens
ggcttctgtgca

SEQ ID NO: 837902 - DNA, 17 bp, Homo sapiens
ggcttctgttctctgct

SEQ ID NO: 837903 - DNA, 18 bp, Homo sapiens
ggcttcttaaaaactgtg

SEQ ID NO: 837904 - DNA, 19 bp, Homo sapiens
ggcttcttaaaaactgtgt

SEQ ID NO: 837905 - DNA, 17 bp, Homo sapiens
ggcttcttatccttaat

SEQ ID NO: 837906 - DNA, 13 bp, Homo sapiens
ggcttcttcctca

SEQ ID NO: 837907 - DNA, 20 bp, Homo sapiens
ggcttcttcctcacactgct

SEQ ID NO: 837908 - DNA, 16 bp, Homo sapiens
ggcttcttcctcctcc

SEQ ID NO: 837909 - DNA, 13 bp, Homo sapiens
ggcttgaagctgt

SEQ ID NO: 837910 - DNA, 15 bp, Homo sapiens
ggcttgactcaggat

SEQ ID NO: 837911 - DNA, 21 bp, Homo sapiens
ggcttgagaaatatggacact

SEQ ID NO: 837912 - DNA, 16 bp, Homo sapiens
ggcttgagctagagat

SEQ ID NO: 837913 - DNA, 15 bp, Homo sapiens
ggcttgagggagggc

SEQ ID NO: 837914 - DNA, 23 bp, Homo sapiens
ggcttgccccactctgcctgcct

SEQ ID NO: 837915 - DNA, 15 bp, Homo sapiens
ggcttgccccaggac

SEQ ID NO: 837916 - DNA, 19 bp, Homo sapiens
ggcttgcctgggctgggca

SEQ ID NO: 837917 - DNA, 22 bp, Homo sapiens
ggcttgcctggtgggggaaggg

SEQ ID NO: 837918 - DNA, 16 bp, Homo sapiens
ggcttgctccagggtc

SEQ ID NO: 837919 - DNA, 11 bp, Homo sapiens
ggcttgctgtt

SEQ ID NO: 837920 - DNA, 22 bp, Homo sapiens
ggcttggacttcctggggcccc

SEQ ID NO: 837921 - DNA, 19 bp, Homo sapiens
ggcttggatcctgggctgg

SEQ ID NO: 837922 - DNA, 13 bp, Homo sapiens
ggcttggcccagc

SEQ ID NO: 837923 - DNA, 15 bp, Homo sapiens
ggcttggcctgctgt

SEQ ID NO: 837924 - DNA, 14 bp, Homo sapiens
ggcttggcctggag

SEQ ID NO: 837925 - DNA, 15 bp, Homo sapiens
ggcttggccttggca

SEQ ID NO: 837926 - DNA, 17 bp, Homo sapiens
ggcttgggatttgctgt

SEQ ID NO: 837927 - DNA, 23 bp, Homo sapiens
ggcttgggcttccatttgtgtgt

SEQ ID NO: 837928 - DNA, 15 bp, Homo sapiens
ggcttgtaactccac

SEQ ID NO: 837929 - DNA, 20 bp, Homo sapiens
ggcttgtcctgtgcttgctt

SEQ ID NO: 837930 - DNA, 19 bp, Homo sapiens
ggcttgttcatcatccaga

SEQ ID NO: 837931 - DNA, 15 bp, Homo sapiens
ggctttaaagctgag

SEQ ID NO: 837932 - DNA, 17 bp, Homo sapiens
ggctttaagctccagct

SEQ ID NO: 837933 - DNA, 22 bp, Homo sapiens
ggctttcaaggctggggcatgg

SEQ ID NO: 837934 - DNA, 17 bp, Homo sapiens
ggctttcacgggcccca

SEQ ID NO: 837935 - DNA, 21 bp, Homo sapiens
ggctttcagagccagcctggc

SEQ ID NO: 837936 - DNA, 15 bp, Homo sapiens
ggctttcatcctgtg

SEQ ID NO: 837937 - DNA, 11 bp, Homo sapiens
ggctttcatgt

SEQ ID NO: 837938 - DNA, 14 bp, Homo sapiens
ggctttccaggcac

SEQ ID NO: 837939 - DNA, 12 bp, Homo sapiens
ggctttcccagg

SEQ ID NO: 837940 - DNA, 21 bp, Homo sapiens
ggctttcctccggagcctcat

SEQ ID NO: 837941 - DNA, 14 bp, Homo sapiens
ggctttctccctca

SEQ ID NO: 837942 - DNA, 13 bp, Homo sapiens
ggctttctcctgg

SEQ ID NO: 837943 - DNA, 12 bp, Homo sapiens
gggagagacctc

SEQ ID NO: 837944 - DNA, 21 bp, Homo sapiens
gggagagatccctgcagaacc

SEQ ID NO: 837945 - DNA, 12 bp, Homo sapiens
gggagagcaggc

SEQ ID NO: 837946 - DNA, 16 bp, Homo sapiens
gggagagcctgctggc

SEQ ID NO: 837947 - DNA, 21 bp, Homo sapiens
gggagaggatttttttctgag

SEQ ID NO: 837948 - DNA, 21 bp, Homo sapiens
gggagaggtgattctcagggc

SEQ ID NO: 837949 - DNA, 22 bp, Homo sapiens
gggagaggtgattctcagggct

SEQ ID NO: 837950 - DNA, 13 bp, Homo sapiens
gggagatactctc

SEQ ID NO: 837951 - DNA, 16 bp, Homo sapiens
gggagatactctccct

SEQ ID NO: 837952 - DNA, 14 bp, Homo sapiens
gggagatggggagg

SEQ ID NO: 837953 - DNA, 16 bp, Homo sapiens
gggagattctgggttt

SEQ ID NO: 837954 - DNA, 16 bp, Homo sapiens
gggagcactggagtgc

SEQ ID NO: 837955 - DNA, 20 bp, Homo sapiens
gggagcacttgcgtcctgca

SEQ ID NO: 837956 - DNA, 15 bp, Homo sapiens
gggagcagagagagc

SEQ ID NO: 837957 - DNA, 16 bp, Homo sapiens
gggagcagcttcttgg

SEQ ID NO: 837958 - DNA, 24 bp, Homo sapiens
gggagcaggcggtgggcacccacc

SEQ ID NO: 837959 - DNA, 15 bp, Homo sapiens
gggagcagggaaggc

SEQ ID NO: 837960 - DNA, 21 bp, Homo sapiens
gggagcagttttcccctggcc

SEQ ID NO: 837961 - DNA, 15 bp, Homo sapiens
gggagccagaaatgg

SEQ ID NO: 837962 - DNA, 20 bp, Homo sapiens
gggagccagaaatgggcagt

SEQ ID NO: 837963 - DNA, 23 bp, Homo sapiens
gggagccagaaatgggcagttct

SEQ ID NO: 837964 - DNA, 11 bp, Homo sapiens
gggagccagcc

SEQ ID NO: 837965 - DNA, 15 bp, Homo sapiens
gggagccagctgctt

SEQ ID NO: 837966 - DNA, 11 bp, Homo sapiens
gggagccaggg

SEQ ID NO: 837967 - DNA, 12 bp, Homo sapiens
gggagccagtgt

SEQ ID NO: 837968 - DNA, 19 bp, Homo sapiens
gggagccatgcgccccctc

SEQ ID NO: 837969 - DNA, 12 bp, Homo sapiens
gggagccccagg

SEQ ID NO: 837970 - DNA, 14 bp, Homo sapiens
gggagccccagggt

SEQ ID NO: 837971 - DNA, 12 bp, Homo sapiens
gggagcccccgc

SEQ ID NO: 837972 - DNA, 21 bp, Homo sapiens
gggagcctagctcctgccaca

SEQ ID NO: 837973 - DNA, 16 bp, Homo sapiens
gggagcctaggaccac

SEQ ID NO: 837974 - DNA, 23 bp, Homo sapiens
gggagcctccccatctgtccagc

SEQ ID NO: 837975 - DNA, 22 bp, Homo sapiens
gggagcctcgcccctccagtgt

SEQ ID NO: 837976 - DNA, 21 bp, Homo sapiens
gggagcctgatcacctgccct

SEQ ID NO: 837977 - DNA, 19 bp, Homo sapiens
gggagcgaggtcagaggag

SEQ ID NO: 837978 - DNA, 13 bp, Homo sapiens
gggagcggaggtt

SEQ ID NO: 837979 - DNA, 11 bp, Homo sapiens
gggagctcctg

SEQ ID NO: 837980 - DNA, 12 bp, Homo sapiens
gggagctcctgg

SEQ ID NO: 837981 - DNA, 15 bp, Homo sapiens
gggagctctggggac

SEQ ID NO: 837982 - DNA, 16 bp, Homo sapiens
gggagctctggggaca

SEQ ID NO: 837983 - DNA, 17 bp, Homo sapiens
gggagctctggggacag

SEQ ID NO: 837984 - DNA, 18 bp, Homo sapiens
gggagctgagcagcctct

SEQ ID NO: 837985 - DNA, 14 bp, Homo sapiens
gggagctgagctgg

SEQ ID NO: 837986 - DNA, 15 bp, Homo sapiens
gggagctgagctgga

SEQ ID NO: 837987 - DNA, 14 bp, Homo sapiens
gggagctgcagagc

SEQ ID NO: 837988 - DNA, 16 bp, Homo sapiens
gggagctgcagagcag

SEQ ID NO: 837989 - DNA, 12 bp, Homo sapiens
gggagctgccaa

SEQ ID NO: 837990 - DNA, 13 bp, Homo sapiens
gggagctgctggg

SEQ ID NO: 837991 - DNA, 15 bp, Homo sapiens
gggagctgctgggct

SEQ ID NO: 837992 - DNA, 16 bp, Homo sapiens
gggagctgggagccag

SEQ ID NO: 837993 - DNA, 13 bp, Homo sapiens
gggagctggtgac

SEQ ID NO: 837994 - DNA, 16 bp, Homo sapiens
gggagcttcctggctc

SEQ ID NO: 837995 - DNA, 21 bp, Homo sapiens
gggagcttcctggctctgggg

SEQ ID NO: 837996 - DNA, 15 bp, Homo sapiens
gggagcttgggactc

SEQ ID NO: 837997 - DNA, 22 bp, Homo sapiens
gggagcttgggactcaggtctg

SEQ ID NO: 837998 - DNA, 13 bp, Homo sapiens
gggaggaaaaaag

SEQ ID NO: 837999 - DNA, 14 bp, Homo sapiens
gggaggaaaaaaga

SEQ ID NO: 838000 - DNA, 16 bp, Homo sapiens
gggaggaaaagaaaag

SEQ ID NO: 838001 - DNA, 21 bp, Homo sapiens
gggaggaaagggcctggccag

SEQ ID NO: 838002 - DNA, 13 bp, Homo sapiens
gggaggaagcaga

SEQ ID NO: 838003 - DNA, 23 bp, Homo sapiens
gggaggaagcaggttgaggggct

SEQ ID NO: 838004 - DNA, 22 bp, Homo sapiens
gggaggaaggcctttcttctgt

SEQ ID NO: 838005 - DNA, 15 bp, Homo sapiens
gggaggacatcataa

SEQ ID NO: 838006 - DNA, 20 bp, Homo sapiens
gggaggacatgcgtgtgtca

SEQ ID NO: 838007 - DNA, 22 bp, Homo sapiens
gggaggacatgcgtgtgtcagg

SEQ ID NO: 838008 - DNA, 23 bp, Homo sapiens
gggaggacatgcgtgtgtcaggg

SEQ ID NO: 838009 - DNA, 13 bp, Homo sapiens
gggaggacctggg

SEQ ID NO: 838010 - DNA, 12 bp, Homo sapiens
gggaggactccg

SEQ ID NO: 838011 - DNA, 13 bp, Homo sapiens
gggaggagagagg

SEQ ID NO: 838012 - DNA, 21 bp, Homo sapiens
gggaggagaggggaagggcca

SEQ ID NO: 838013 - DNA, 14 bp, Homo sapiens
gggaggaggaaaga

SEQ ID NO: 838014 - DNA, 18 bp, Homo sapiens
gggaggaggaacgggcag

SEQ ID NO: 838015 - DNA, 20 bp, Homo sapiens
gggaggaggaacgggcagcc

SEQ ID NO: 838016 - DNA, 17 bp, Homo sapiens
gggaggaggccacctct

SEQ ID NO: 838017 - DNA, 19 bp, Homo sapiens
gggaggatcactggagccc

SEQ ID NO: 838018 - DNA, 20 bp, Homo sapiens
gggaggatcctgagctgctg

SEQ ID NO: 838019 - DNA, 16 bp, Homo sapiens
gggaggcaagaaaagg

SEQ ID NO: 838020 - DNA, 17 bp, Homo sapiens
gggaggcaagaaaagga

SEQ ID NO: 838021 - DNA, 12 bp, Homo sapiens
gggaggcagaga

SEQ ID NO: 838022 - DNA, 13 bp, Homo sapiens
gggaggcagagag

SEQ ID NO: 838023 - DNA, 14 bp, Homo sapiens
gggaggcagagagg

SEQ ID NO: 838024 - DNA, 19 bp, Homo sapiens
gggaggcagagcgggaggg

SEQ ID NO: 838025 - DNA, 20 bp, Homo sapiens
gggaggcagaggttgcagtg

SEQ ID NO: 838026 - DNA, 13 bp, Homo sapiens
gggaggcagcaga

SEQ ID NO: 838027 - DNA, 14 bp, Homo sapiens
gggaggcagcagag

SEQ ID NO: 838028 - DNA, 19 bp, Homo sapiens
gggaggcagcgtgggctct

SEQ ID NO: 838029 - DNA, 20 bp, Homo sapiens
gggaggcagcgtgggctctg

SEQ ID NO: 838030 - DNA, 17 bp, Homo sapiens
gggaggcagggctggaa

SEQ ID NO: 838031 - DNA, 16 bp, Homo sapiens
gggaggcatggccctg

SEQ ID NO: 838032 - DNA, 17 bp, Homo sapiens
gggaggcatggccctgg

SEQ ID NO: 838033 - DNA, 19 bp, Homo sapiens
gggaggccaaggtgggagg

SEQ ID NO: 838034 - DNA, 12 bp, Homo sapiens
gggaggccctgc

SEQ ID NO: 838035 - DNA, 13 bp, Homo sapiens
gggaggccctgcc

SEQ ID NO: 838036 - DNA, 15 bp, Homo sapiens
gggaggccgaggcgg

SEQ ID NO: 838037 - DNA, 16 bp, Homo sapiens
gggaggccgggcggtc

SEQ ID NO: 838038 - DNA, 13 bp, Homo sapiens
gggaggcgcaggg

SEQ ID NO: 838039 - DNA, 23 bp, Homo sapiens
gggaggcgcagggacatggggca

SEQ ID NO: 838040 - DNA, 20 bp, Homo sapiens
gggaggcggagagtacagtg

SEQ ID NO: 838041 - DNA, 15 bp, Homo sapiens
gggaggctcaggtcc

SEQ ID NO: 838042 - DNA, 18 bp, Homo sapiens
gggaggctgaggcagaag

SEQ ID NO: 838043 - DNA, 15 bp, Homo sapiens
gggaggctggggccc

SEQ ID NO: 838044 - DNA, 21 bp, Homo sapiens
gggagggaagggccaccctgc

SEQ ID NO: 838045 - DNA, 14 bp, Homo sapiens
gggagggaagggga

SEQ ID NO: 838046 - DNA, 16 bp, Homo sapiens
gggagggacagggcag

SEQ ID NO: 838047 - DNA, 15 bp, Homo sapiens
gggagggagccatgg

SEQ ID NO: 838048 - DNA, 11 bp, Homo sapiens
gggagggaggg

SEQ ID NO: 838049 - DNA, 11 bp, Homo sapiens
gggagggcagc

SEQ ID NO: 838050 - DNA, 20 bp, Homo sapiens
gggagggccggcggctctga

SEQ ID NO: 838051 - DNA, 22 bp, Homo sapiens
gggagggccggcggctctgagc

SEQ ID NO: 838052 - DNA, 23 bp, Homo sapiens
gggagggccggcggctctgagca

SEQ ID NO: 838053 - DNA, 16 bp, Homo sapiens
gggagggcgtcaggca

SEQ ID NO: 838054 - DNA, 20 bp, Homo sapiens
gggagggcgtcaggcagagg

SEQ ID NO: 838055 - DNA, 13 bp, Homo sapiens
gggagggctcctg

SEQ ID NO: 838056 - DNA, 16 bp, Homo sapiens
gggagggctcctgggg

SEQ ID NO: 838057 - DNA, 16 bp, Homo sapiens
gggaggggacagaggc

SEQ ID NO: 838058 - DNA, 16 bp, Homo sapiens
gggaggggcagagagg

SEQ ID NO: 838059 - DNA, 13 bp, Homo sapiens
gggaggggcaggc

SEQ ID NO: 838060 - DNA, 17 bp, Homo sapiens
gggaggggcaggctgac

SEQ ID NO: 838061 - DNA, 18 bp, Homo sapiens
gggaggggccctcaggcc

SEQ ID NO: 838062 - DNA, 19 bp, Homo sapiens
gggaggggccctcaggcca

SEQ ID NO: 838063 - DNA, 18 bp, Homo sapiens
gggaggggcgctggccca

SEQ ID NO: 838064 - DNA, 20 bp, Homo sapiens
gggaggggcgctggcccagc

SEQ ID NO: 838065 - DNA, 23 bp, Homo sapiens
gggaggggcggcaggagggaggt

SEQ ID NO: 838066 - DNA, 22 bp, Homo sapiens
gggcacctccggctgcctagcc

SEQ ID NO: 838067 - DNA, 22 bp, Homo sapiens
gggcacctgacttggctgggga

SEQ ID NO: 838068 - DNA, 23 bp, Homo sapiens
gggcacctgcttccacccgtctc

SEQ ID NO: 838069 - DNA, 16 bp, Homo sapiens
gggcacgcactgggtt

SEQ ID NO: 838070 - DNA, 14 bp, Homo sapiens
gggcacgcctgctg

SEQ ID NO: 838071 - DNA, 23 bp, Homo sapiens
gggcacggcaggcgtgtggcagc

SEQ ID NO: 838072 - DNA, 20 bp, Homo sapiens
gggcacggcgggatcctcca

SEQ ID NO: 838073 - DNA, 18 bp, Homo sapiens
gggcacggctccgagggc

SEQ ID NO: 838074 - DNA, 17 bp, Homo sapiens
gggcactcccaaccctg

SEQ ID NO: 838075 - DNA, 18 bp, Homo sapiens
gggcactccgcgccgatg

SEQ ID NO: 838076 - DNA, 14 bp, Homo sapiens
gggcactgaccagg

SEQ ID NO: 838077 - DNA, 20 bp, Homo sapiens
gggcactggagctgggaggt

SEQ ID NO: 838078 - DNA, 13 bp, Homo sapiens
gggcactggccca

SEQ ID NO: 838079 - DNA, 13 bp, Homo sapiens
gggcactggtggc

SEQ ID NO: 838080 - DNA, 23 bp, Homo sapiens
gggcacttcaggtccgtgggccg

SEQ ID NO: 838081 - DNA, 20 bp, Homo sapiens
gggcactttaaatgaagcta

SEQ ID NO: 838082 - DNA, 15 bp, Homo sapiens
gggcagaaagtggcc

SEQ ID NO: 838083 - DNA, 16 bp, Homo sapiens
gggcagaagggagaag

SEQ ID NO: 838084 - DNA, 18 bp, Homo sapiens
gggcagaagggagaagga

SEQ ID NO: 838085 - DNA, 22 bp, Homo sapiens
gggcagactgtgaacttgactg

SEQ ID NO: 838086 - DNA, 15 bp, Homo sapiens
gggcagagaggaagt

SEQ ID NO: 838087 - DNA, 16 bp, Homo sapiens
gggcagagaggaagtg

SEQ ID NO: 838088 - DNA, 13 bp, Homo sapiens
gggcagagccagg

SEQ ID NO: 838089 - DNA, 13 bp, Homo sapiens
gggcagagccggg

SEQ ID NO: 838090 - DNA, 14 bp, Homo sapiens
gggcagagccggga

SEQ ID NO: 838091 - DNA, 11 bp, Homo sapiens
gggcagagctg

SEQ ID NO: 838092 - DNA, 15 bp, Homo sapiens
gggcagaggctggag

SEQ ID NO: 838093 - DNA, 20 bp, Homo sapiens
gggcagagggcagaggctgg

SEQ ID NO: 838094 - DNA, 14 bp, Homo sapiens
gggcagagggctgg

SEQ ID NO: 838095 - DNA, 17 bp, Homo sapiens
gggcagagtgagaccca

SEQ ID NO: 838096 - DNA, 16 bp, Homo sapiens
gggcagatcttttctt

SEQ ID NO: 838097 - DNA, 21 bp, Homo sapiens
gggcagatgtcccccactgct

SEQ ID NO: 838098 - DNA, 13 bp, Homo sapiens
gggcagatgtggg

SEQ ID NO: 838099 - DNA, 13 bp, Homo sapiens
gggcagcaaggcc

SEQ ID NO: 838100 - DNA, 15 bp, Homo sapiens
gggcagcaagggacc

SEQ ID NO: 838101 - DNA, 17 bp, Homo sapiens
gggcagcacacctctgg

SEQ ID NO: 838102 - DNA, 16 bp, Homo sapiens
gggcagcactccccag

SEQ ID NO: 838103 - DNA, 21 bp, Homo sapiens
gggcagcactccccagagctg

SEQ ID NO: 838104 - DNA, 17 bp, Homo sapiens
gggcagcagcagccctg

SEQ ID NO: 838105 - DNA, 19 bp, Homo sapiens
gggcagcagcagccctgcc

SEQ ID NO: 838106 - DNA, 12 bp, Homo sapiens
gggcagccacag

SEQ ID NO: 838107 - DNA, 14 bp, Homo sapiens
gggcagccacagga

SEQ ID NO: 838108 - DNA, 15 bp, Homo sapiens
gggcagccacaggac

SEQ ID NO: 838109 - DNA, 18 bp, Homo sapiens
gggcagccacccaagcct

SEQ ID NO: 838110 - DNA, 14 bp, Homo sapiens
gggcagccaggctg

SEQ ID NO: 838111 - DNA, 16 bp, Homo sapiens
gggcagccaggctgcc

SEQ ID NO: 838112 - DNA, 19 bp, Homo sapiens
gggcagccaggctgggccg

SEQ ID NO: 838113 - DNA, 23 bp, Homo sapiens
gggcagccccacagtcccattcc

SEQ ID NO: 838114 - DNA, 21 bp, Homo sapiens
gggcagccctccatggtcctg

SEQ ID NO: 838115 - DNA, 13 bp, Homo sapiens
gggcagccctgag

SEQ ID NO: 838116 - DNA, 19 bp, Homo sapiens
gggcagcccttgcttgttg

SEQ ID NO: 838117 - DNA, 19 bp, Homo sapiens
gggcagccgctaggagaga

SEQ ID NO: 838118 - DNA, 22 bp, Homo sapiens
gggcagccgctaggagagactg

SEQ ID NO: 838119 - DNA, 23 bp, Homo sapiens
gggcagccgctaggagagactga

SEQ ID NO: 838120 - DNA, 15 bp, Homo sapiens
gggcagcctgtgcct

SEQ ID NO: 838121 - DNA, 14 bp, Homo sapiens
gggcagcctttcca

SEQ ID NO: 838122 - DNA, 19 bp, Homo sapiens
gggcagcctttccagcctc

SEQ ID NO: 838123 - DNA, 13 bp, Homo sapiens
gggcagcgccagg

SEQ ID NO: 838124 - DNA, 12 bp, Homo sapiens
gggcagctgagg

SEQ ID NO: 838125 - DNA, 12 bp, Homo sapiens
gggcagctgcca

SEQ ID NO: 838126 - DNA, 12 bp, Homo sapiens
gggcagctgcta

SEQ ID NO: 838127 - DNA, 18 bp, Homo sapiens
gggcagctggcccccagc

SEQ ID NO: 838128 - DNA, 17 bp, Homo sapiens
gggcagctgggccccac

SEQ ID NO: 838129 - DNA, 15 bp, Homo sapiens
gggcagctgtcctga

SEQ ID NO: 838130 - DNA, 20 bp, Homo sapiens
gggcagcttagggccctgga

SEQ ID NO: 838131 - DNA, 19 bp, Homo sapiens
gggcagcttgccccggccc

SEQ ID NO: 838132 - DNA, 16 bp, Homo sapiens
gggcaggaaggagagc

SEQ ID NO: 838133 - DNA, 21 bp, Homo sapiens
gggcaggaaggagagcctgct

SEQ ID NO: 838134 - DNA, 20 bp, Homo sapiens
gggcaggaccctgctgactc

SEQ ID NO: 838135 - DNA, 21 bp, Homo sapiens
gggcaggatctcaagccagcc

SEQ ID NO: 838136 - DNA, 13 bp, Homo sapiens
gggcaggcagggc

SEQ ID NO: 838137 - DNA, 22 bp, Homo sapiens
gggcaggccagcttcgtgctgg

SEQ ID NO: 838138 - DNA, 13 bp, Homo sapiens
gggcaggcctggg

SEQ ID NO: 838139 - DNA, 19 bp, Homo sapiens
gggcaggcctgggacccag

SEQ ID NO: 838140 - DNA, 12 bp, Homo sapiens
gggcaggcgcag

SEQ ID NO: 838141 - DNA, 19 bp, Homo sapiens
gggcaggcgcagaggtccc

SEQ ID NO: 838142 - DNA, 16 bp, Homo sapiens
gggcaggctctctcct

SEQ ID NO: 838143 - DNA, 13 bp, Homo sapiens
gggcaggctgaca

SEQ ID NO: 838144 - DNA, 12 bp, Homo sapiens
gggcaggcttgg

SEQ ID NO: 838145 - DNA, 18 bp, Homo sapiens
gggcagggagagcgcctc

SEQ ID NO: 838146 - DNA, 12 bp, Homo sapiens
gggcagggagcg

SEQ ID NO: 838147 - DNA, 12 bp, Homo sapiens
gggcagggaggc

SEQ ID NO: 838148 - DNA, 13 bp, Homo sapiens
gggcagggaggca

SEQ ID NO: 838149 - DNA, 13 bp, Homo sapiens
gggcagggagggg

SEQ ID NO: 838150 - DNA, 15 bp, Homo sapiens
gggcagggaggggct

SEQ ID NO: 838151 - DNA, 15 bp, Homo sapiens
gggcagggaggtggg

SEQ ID NO: 838152 - DNA, 16 bp, Homo sapiens
gggcagggagtgatga

SEQ ID NO: 838153 - DNA, 14 bp, Homo sapiens
gggcagggcccctg

SEQ ID NO: 838154 - DNA, 12 bp, Homo sapiens
gggcagggctgt

SEQ ID NO: 838155 - DNA, 16 bp, Homo sapiens
gggcagggctgtgctt

SEQ ID NO: 838156 - DNA, 21 bp, Homo sapiens
gggcaggggagccagggtaga

SEQ ID NO: 838157 - DNA, 16 bp, Homo sapiens
gggcagggtctgggct

SEQ ID NO: 838158 - DNA, 17 bp, Homo sapiens
gggcagggtctgggctg

SEQ ID NO: 838159 - DNA, 23 bp, Homo sapiens
gggcagggttaggaatctcttca

SEQ ID NO: 838160 - DNA, 18 bp, Homo sapiens
gggcaggtcctgcccatg

SEQ ID NO: 838161 - DNA, 16 bp, Homo sapiens
gggcaggtgggagctg

SEQ ID NO: 838162 - DNA, 11 bp, Homo sapiens
gggcaggtggt

SEQ ID NO: 838163 - DNA, 19 bp, Homo sapiens
gggcaggtggtggaggggc

SEQ ID NO: 838164 - DNA, 16 bp, Homo sapiens
gggcaggtggtggcac

SEQ ID NO: 838165 - DNA, 22 bp, Homo sapiens
gggcaggtggtggcactgagcc

SEQ ID NO: 838166 - DNA, 18 bp, Homo sapiens
gggcaggttcctggggcc

SEQ ID NO: 838167 - DNA, 17 bp, Homo sapiens
gggcagtatgtgatgga

SEQ ID NO: 838168 - DNA, 21 bp, Homo sapiens
gggcagtatgtgatggactgg

SEQ ID NO: 838169 - DNA, 23 bp, Homo sapiens
gggcagtatgtgatggactgggg

SEQ ID NO: 838170 - DNA, 15 bp, Homo sapiens
gggcagtcaccaccc

SEQ ID NO: 838171 - DNA, 20 bp, Homo sapiens
gggcagtccttactccccca

SEQ ID NO: 838172 - DNA, 14 bp, Homo sapiens
gggcagtctgctct

SEQ ID NO: 838173 - DNA, 17 bp, Homo sapiens
gggcagtctgctctgct

SEQ ID NO: 838174 - DNA, 17 bp, Homo sapiens
gggcagtgactggcagg

SEQ ID NO: 838175 - DNA, 11 bp, Homo sapiens
gggcagtgcca

SEQ ID NO: 838176 - DNA, 14 bp, Homo sapiens
gggcagtgccacag

SEQ ID NO: 838177 - DNA, 21 bp, Homo sapiens
gggcagtgccacagcctgctg

SEQ ID NO: 838178 - DNA, 14 bp, Homo sapiens
gggcagtggccaag

SEQ ID NO: 838179 - DNA, 18 bp, Homo sapiens
gggcagtggccaagcctg

SEQ ID NO: 838180 - DNA, 19 bp, Homo sapiens
gggcagtggccaagcctgc

SEQ ID NO: 838181 - DNA, 22 bp, Homo sapiens
gggcagtggtaagctctggctt

SEQ ID NO: 838182 - DNA, 10 bp, Homo sapiens
gggcagtgtc

SEQ ID NO: 838183 - DNA, 23 bp, Homo sapiens
gggcagtgtgaggacctccctgt

SEQ ID NO: 838184 - DNA, 18 bp, Homo sapiens
gggcagttagagcagcct

SEQ ID NO: 838185 - DNA, 23 bp, Homo sapiens
gggcagttctcactcctaggaga

SEQ ID NO: 838186 - DNA, 20 bp, Homo sapiens
gggcagttctcccagggagt

SEQ ID NO: 838187 - DNA, 14 bp, Homo sapiens
gggcataaagtaaa

SEQ ID NO: 838188 - DNA, 13 bp, Homo sapiens
gggcatcatgcat

SEQ ID NO: 838189 - DNA, 19 bp, Homo sapiens
gggccccagcgtctgcagg

SEQ ID NO: 838190 - DNA, 18 bp, Homo sapiens
gggccccatcagctgcca

SEQ ID NO: 838191 - DNA, 21 bp, Homo sapiens
gggccccatcctcatccctga

SEQ ID NO: 838192 - DNA, 12 bp, Homo sapiens
gggccccatgct

SEQ ID NO: 838193 - DNA, 20 bp, Homo sapiens
gggccccatgctctgcccca

SEQ ID NO: 838194 - DNA, 15 bp, Homo sapiens
gggcccccagcctgg

SEQ ID NO: 838195 - DNA, 16 bp, Homo sapiens
gggcccccagcctggc

SEQ ID NO: 838196 - DNA, 14 bp, Homo sapiens
gggcccccatctca

SEQ ID NO: 838197 - DNA, 13 bp, Homo sapiens
gggcccccgcccc

SEQ ID NO: 838198 - DNA, 19 bp, Homo sapiens
gggccccgccagggctggg

SEQ ID NO: 838199 - DNA, 16 bp, Homo sapiens
gggccccggggctggc

SEQ ID NO: 838200 - DNA, 13 bp, Homo sapiens
gggcccctccacg

SEQ ID NO: 838201 - DNA, 14 bp, Homo sapiens
gggcccctccatcc

SEQ ID NO: 838202 - DNA, 16 bp, Homo sapiens
gggcccctccctctgc

SEQ ID NO: 838203 - DNA, 17 bp, Homo sapiens
gggcccctccctctgcc

SEQ ID NO: 838204 - DNA, 19 bp, Homo sapiens
gggcccctccctctgcccc

SEQ ID NO: 838205 - DNA, 20 bp, Homo sapiens
gggcccctccctctgcccca

SEQ ID NO: 838206 - DNA, 12 bp, Homo sapiens
gggcccctctgc

SEQ ID NO: 838207 - DNA, 17 bp, Homo sapiens
gggcccctctgcccagc

SEQ ID NO: 838208 - DNA, 22 bp, Homo sapiens
gggcccctctgcccagcttggg

SEQ ID NO: 838209 - DNA, 14 bp, Homo sapiens
gggcccctgggatg

SEQ ID NO: 838210 - DNA, 12 bp, Homo sapiens
gggcccctgggg

SEQ ID NO: 838211 - DNA, 21 bp, Homo sapiens
gggcccctggggacagagcca

SEQ ID NO: 838212 - DNA, 22 bp, Homo sapiens
gggccccttccaaatgtccctc

SEQ ID NO: 838213 - DNA, 16 bp, Homo sapiens
gggccccttgagaatg

SEQ ID NO: 838214 - DNA, 12 bp, Homo sapiens
gggccccttgct

SEQ ID NO: 838215 - DNA, 23 bp, Homo sapiens
gggcccgcctggcagaactgagc

SEQ ID NO: 838216 - DNA, 22 bp, Homo sapiens
gggcccggagtaatcaggcagc

SEQ ID NO: 838217 - DNA, 16 bp, Homo sapiens
gggcccggccacaccc

SEQ ID NO: 838218 - DNA, 19 bp, Homo sapiens
gggccctccatgcgcagat

SEQ ID NO: 838219 - DNA, 13 bp, Homo sapiens
gggccctcccagc

SEQ ID NO: 838220 - DNA, 22 bp, Homo sapiens
gggccctccttccctcctgtgc

SEQ ID NO: 838221 - DNA, 18 bp, Homo sapiens
gggccctctatgctggct

SEQ ID NO: 838222 - DNA, 16 bp, Homo sapiens
gggccctctctctgcg

SEQ ID NO: 838223 - DNA, 21 bp, Homo sapiens
gggccctctctctgggcccag

SEQ ID NO: 838224 - DNA, 15 bp, Homo sapiens
gggccctcttgccag

SEQ ID NO: 838225 - DNA, 17 bp, Homo sapiens
gggccctcttgccagcc

SEQ ID NO: 838226 - DNA, 21 bp, Homo sapiens
gggccctcttgccagcctcct

SEQ ID NO: 838227 - DNA, 13 bp, Homo sapiens
gggccctctttcc

SEQ ID NO: 838228 - DNA, 12 bp, Homo sapiens
gggccctgagct

SEQ ID NO: 838229 - DNA, 18 bp, Homo sapiens
gggccctgcacctgtgca

SEQ ID NO: 838230 - DNA, 19 bp, Homo sapiens
gggccctgcacctgtgcag

SEQ ID NO: 838231 - DNA, 13 bp, Homo sapiens
gggccctgcccca

SEQ ID NO: 838232 - DNA, 20 bp, Homo sapiens
gggccctgccccagccccta

SEQ ID NO: 838233 - DNA, 18 bp, Homo sapiens
gggccctgcccggggagc

SEQ ID NO: 838234 - DNA, 14 bp, Homo sapiens
gggccctgccctgt

SEQ ID NO: 838235 - DNA, 11 bp, Homo sapiens
gggccctgggc

SEQ ID NO: 838236 - DNA, 15 bp, Homo sapiens
gggccctgggcctca

SEQ ID NO: 838237 - DNA, 14 bp, Homo sapiens
gggccctgggctgg

SEQ ID NO: 838238 - DNA, 15 bp, Homo sapiens
gggccctgggctgga

SEQ ID NO: 838239 - DNA, 23 bp, Homo sapiens
gggccctgtggagtccagctcta

SEQ ID NO: 838240 - DNA, 18 bp, Homo sapiens
gggcccttcttgctgccc

SEQ ID NO: 838241 - DNA, 20 bp, Homo sapiens
gggcccttggccccagagga

SEQ ID NO: 838242 - DNA, 19 bp, Homo sapiens
gggcccttgggacagccag

SEQ ID NO: 838243 - DNA, 17 bp, Homo sapiens
gggccctttgagtgcag

SEQ ID NO: 838244 - DNA, 20 bp, Homo sapiens
gggccgacattgtctcccgc

SEQ ID NO: 838245 - DNA, 16 bp, Homo sapiens
gggccgcaagggcctg

SEQ ID NO: 838246 - DNA, 20 bp, Homo sapiens
gggccgcaagggcctggacg

SEQ ID NO: 838247 - DNA, 14 bp, Homo sapiens
gggccgcaggaggg

SEQ ID NO: 838248 - DNA, 15 bp, Homo sapiens
gggccgcaggaggga

SEQ ID NO: 838249 - DNA, 18 bp, Homo sapiens
gggccgcaggagggaggc

SEQ ID NO: 838250 - DNA, 16 bp, Homo sapiens
gggccgcccgctccct

SEQ ID NO: 838251 - DNA, 17 bp, Homo sapiens
gggccgccgcctctttc

SEQ ID NO: 838252 - DNA, 14 bp, Homo sapiens
gggccgcctgccct

SEQ ID NO: 838253 - DNA, 14 bp, Homo sapiens
gggccgcctgcctt

SEQ ID NO: 838254 - DNA, 16 bp, Homo sapiens
gggccgcctgccttag

SEQ ID NO: 838255 - DNA, 14 bp, Homo sapiens
gggccgctgccacc

SEQ ID NO: 838256 - DNA, 21 bp, Homo sapiens
gggccgctgccacccacctcc

SEQ ID NO: 838257 - DNA, 14 bp, Homo sapiens
gggccggacctgag

SEQ ID NO: 838258 - DNA, 16 bp, Homo sapiens
gggccggacctgagcc

SEQ ID NO: 838259 - DNA, 20 bp, Homo sapiens
gggccggcggctctgagcag

SEQ ID NO: 838260 - DNA, 17 bp, Homo sapiens
gggccgggaggcagtgc

SEQ ID NO: 838261 - DNA, 13 bp, Homo sapiens
gggccgggcaggt

SEQ ID NO: 838262 - DNA, 21 bp, Homo sapiens
gggccggggggggtaggagag

SEQ ID NO: 838263 - DNA, 13 bp, Homo sapiens
gggccggtgaggg

SEQ ID NO: 838264 - DNA, 20 bp, Homo sapiens
gggccggtgaggggaggggc

SEQ ID NO: 838265 - DNA, 15 bp, Homo sapiens
gggccgtaccccacc

SEQ ID NO: 838266 - DNA, 16 bp, Homo sapiens
gggccgtaccccaccc

SEQ ID NO: 838267 - DNA, 22 bp, Homo sapiens
gggccgtaccccaccctcagca

SEQ ID NO: 838268 - DNA, 19 bp, Homo sapiens
gggccgtcccctctcccct

SEQ ID NO: 838269 - DNA, 16 bp, Homo sapiens
gggccgtggcacagct

SEQ ID NO: 838270 - DNA, 17 bp, Homo sapiens
gggcctaggcctcagcc

SEQ ID NO: 838271 - DNA, 16 bp, Homo sapiens
gggcctcagagcctga

SEQ ID NO: 838272 - DNA, 17 bp, Homo sapiens
gggcctcagcctggggc

SEQ ID NO: 838273 - DNA, 20 bp, Homo sapiens
gggcctcagtgtgcccatct

SEQ ID NO: 838274 - DNA, 14 bp, Homo sapiens
gggcctccagggcc

SEQ ID NO: 838275 - DNA, 13 bp, Homo sapiens
gggcctcccctgg

SEQ ID NO: 838276 - DNA, 12 bp, Homo sapiens
gggcctccctcc

SEQ ID NO: 838277 - DNA, 16 bp, Homo sapiens
gggcctccctgttcac

SEQ ID NO: 838278 - DNA, 17 bp, Homo sapiens
gggcctcccttgggctg

SEQ ID NO: 838279 - DNA, 21 bp, Homo sapiens
gggcctcctctgtccagggcc

SEQ ID NO: 838280 - DNA, 13 bp, Homo sapiens
gggcctcctgggg

SEQ ID NO: 838281 - DNA, 16 bp, Homo sapiens
gggcctcgggacctca

SEQ ID NO: 838282 - DNA, 19 bp, Homo sapiens
gggcctctcctgccctctg

SEQ ID NO: 838283 - DNA, 19 bp, Homo sapiens
gggcctctctgggggaggc

SEQ ID NO: 838284 - DNA, 21 bp, Homo sapiens
gggcctctctgggggaggcag

SEQ ID NO: 838285 - DNA, 23 bp, Homo sapiens
gggcctctctgggggaggcaggg

SEQ ID NO: 838286 - DNA, 22 bp, Homo sapiens
gggcctgaaacccgccctcagg

SEQ ID NO: 838287 - DNA, 18 bp, Homo sapiens
gggcctgacaccccctcc

SEQ ID NO: 838288 - DNA, 14 bp, Homo sapiens
gggcctgactgctc

SEQ ID NO: 838289 - DNA, 20 bp, Homo sapiens
gggcctgcacagatacctca

SEQ ID NO: 838290 - DNA, 12 bp, Homo sapiens
gggcctgcccaa

SEQ ID NO: 838291 - DNA, 13 bp, Homo sapiens
gggcctgcccctg

SEQ ID NO: 838292 - DNA, 15 bp, Homo sapiens
gggcctgccgggctg

SEQ ID NO: 838293 - DNA, 20 bp, Homo sapiens
gggcctgccgggctgagggc

SEQ ID NO: 838294 - DNA, 19 bp, Homo sapiens
gggcctgcctgcctccacc

SEQ ID NO: 838295 - DNA, 14 bp, Homo sapiens
gggcctgcctggcc

SEQ ID NO: 838296 - DNA, 19 bp, Homo sapiens
gggcctgcgccagtcctgc

SEQ ID NO: 838297 - DNA, 13 bp, Homo sapiens
gggcctgcgccca

SEQ ID NO: 838298 - DNA, 20 bp, Homo sapiens
gggcctgctgcgtcagacca

SEQ ID NO: 838299 - DNA, 12 bp, Homo sapiens
gggcctgctgga

SEQ ID NO: 838300 - DNA, 14 bp, Homo sapiens
gggcctgctggagg

SEQ ID NO: 838301 - DNA, 18 bp, Homo sapiens
gggcctgcttttccagga

SEQ ID NO: 838302 - DNA, 16 bp, Homo sapiens
gggcctggacaaggtc

SEQ ID NO: 838303 - DNA, 16 bp, Homo sapiens
gggcctggacctatgc

SEQ ID NO: 838304 - DNA, 13 bp, Homo sapiens
gggcctggacctg

SEQ ID NO: 838305 - DNA, 12 bp, Homo sapiens
gggcctggagat

SEQ ID NO: 838306 - DNA, 15 bp, Homo sapiens
gggcctggagcccca

SEQ ID NO: 838307 - DNA, 16 bp, Homo sapiens
gggcctggccagtcct

SEQ ID NO: 838308 - DNA, 12 bp, Homo sapiens
gggcctggcctg

SEQ ID NO: 838309 - DNA, 15 bp, Homo sapiens
gggcctggcctgagc

SEQ ID NO: 838310 - DNA, 16 bp, Homo sapiens
gggcctggcttgctcc

SEQ ID NO: 838311 - DNA, 17 bp, Homo sapiens
gggcctggcttgctcca

SEQ ID NO: 838312 - DNA, 22 bp, Homo sapiens
ggggagtcggttagtcattgat

SEQ ID NO: 838313 - DNA, 21 bp, Homo sapiens
ggggagttgagtcacaagagg

SEQ ID NO: 838314 - DNA, 21 bp, Homo sapiens
ggggataatgtccccactccc

SEQ ID NO: 838315 - DNA, 13 bp, Homo sapiens
ggggatctcaggg

SEQ ID NO: 838316 - DNA, 22 bp, Homo sapiens
ggggatctggggggtggggagg

SEQ ID NO: 838317 - DNA, 20 bp, Homo sapiens
ggggatcttcccacaggagg

SEQ ID NO: 838318 - DNA, 15 bp, Homo sapiens
ggggatggaggccag

SEQ ID NO: 838319 - DNA, 18 bp, Homo sapiens
ggggatggaggccagagt

SEQ ID NO: 838320 - DNA, 14 bp, Homo sapiens
ggggatggggaggg

SEQ ID NO: 838321 - DNA, 13 bp, Homo sapiens
ggggatgggtggg

SEQ ID NO: 838322 - DNA, 13 bp, Homo sapiens
ggggatggtggca

SEQ ID NO: 838323 - DNA, 18 bp, Homo sapiens
ggggatggtggcacaggc

SEQ ID NO: 838324 - DNA, 14 bp, Homo sapiens
ggggatgttctgcc

SEQ ID NO: 838325 - DNA, 19 bp, Homo sapiens
ggggatgtttacctggtgc

SEQ ID NO: 838326 - DNA, 15 bp, Homo sapiens
ggggattcaggggct

SEQ ID NO: 838327 - DNA, 23 bp, Homo sapiens
ggggattcaggggctttgggccc

SEQ ID NO: 838328 - DNA, 20 bp, Homo sapiens
ggggattggagggaagacag

SEQ ID NO: 838329 - DNA, 15 bp, Homo sapiens
ggggcaaagcctcct

SEQ ID NO: 838330 - DNA, 16 bp, Homo sapiens
ggggcaaagcctcctt

SEQ ID NO: 838331 - DNA, 15 bp, Homo sapiens
ggggcaactgtatga

SEQ ID NO: 838332 - DNA, 19 bp, Homo sapiens
ggggcaagacagaaaagtg

SEQ ID NO: 838333 - DNA, 22 bp, Homo sapiens
ggggcaagacagaaaagtgcct

SEQ ID NO: 838334 - DNA, 12 bp, Homo sapiens
ggggcaagccag

SEQ ID NO: 838335 - DNA, 15 bp, Homo sapiens
ggggcaagccagggc

SEQ ID NO: 838336 - DNA, 18 bp, Homo sapiens
ggggcaaggtctccttac

SEQ ID NO: 838337 - DNA, 16 bp, Homo sapiens
ggggcacaccactgcc

SEQ ID NO: 838338 - DNA, 19 bp, Homo sapiens
ggggcacagtccaggaaca

SEQ ID NO: 838339 - DNA, 21 bp, Homo sapiens
ggggcacgccctcctcagcga

SEQ ID NO: 838340 - DNA, 23 bp, Homo sapiens
ggggcacggcaggcgtgtggcag

SEQ ID NO: 838341 - DNA, 17 bp, Homo sapiens
ggggcactgaccaggcc

SEQ ID NO: 838342 - DNA, 13 bp, Homo sapiens
ggggcagaacagc

SEQ ID NO: 838343 - DNA, 17 bp, Homo sapiens
ggggcagaacagccgct

SEQ ID NO: 838344 - DNA, 17 bp, Homo sapiens
ggggcagagaagttcct

SEQ ID NO: 838345 - DNA, 13 bp, Homo sapiens
ggggcagcactcc

SEQ ID NO: 838346 - DNA, 16 bp, Homo sapiens
ggggcagcactcccca

SEQ ID NO: 838347 - DNA, 15 bp, Homo sapiens
ggggcagcagcagcc

SEQ ID NO: 838348 - DNA, 18 bp, Homo sapiens
ggggcagcagcagccctg

SEQ ID NO: 838349 - DNA, 20 bp, Homo sapiens
ggggcagcagcagccctgcc

SEQ ID NO: 838350 - DNA, 19 bp, Homo sapiens
ggggcagccgctaggagag

SEQ ID NO: 838351 - DNA, 14 bp, Homo sapiens
ggggcagctgccag

SEQ ID NO: 838352 - DNA, 16 bp, Homo sapiens
ggggcaggagtgccag

SEQ ID NO: 838353 - DNA, 12 bp, Homo sapiens
ggggcaggctga

SEQ ID NO: 838354 - DNA, 13 bp, Homo sapiens
ggggcaggctggg

SEQ ID NO: 838355 - DNA, 14 bp, Homo sapiens
ggggcaggctgggc

SEQ ID NO: 838356 - DNA, 15 bp, Homo sapiens
ggggcaggctgggcc

SEQ ID NO: 838357 - DNA, 10 bp, Homo sapiens
ggggcaggga

SEQ ID NO: 838358 - DNA, 13 bp, Homo sapiens
ggggcagggagag

SEQ ID NO: 838359 - DNA, 12 bp, Homo sapiens
ggggcagggctg

SEQ ID NO: 838360 - DNA, 19 bp, Homo sapiens
ggggcaggggcctgggccg

SEQ ID NO: 838361 - DNA, 18 bp, Homo sapiens
ggggcagtgactggcagg

SEQ ID NO: 838362 - DNA, 13 bp, Homo sapiens
ggggcagtggcaa

SEQ ID NO: 838363 - DNA, 13 bp, Homo sapiens
ggggcagtgtgag

SEQ ID NO: 838364 - DNA, 21 bp, Homo sapiens
ggggcagttagagcagcctcg

SEQ ID NO: 838365 - DNA, 18 bp, Homo sapiens
ggggcagttttagcagca

SEQ ID NO: 838366 - DNA, 20 bp, Homo sapiens
ggggcagttttagcagcact

SEQ ID NO: 838367 - DNA, 20 bp, Homo sapiens
ggggcatggacagggccagg

SEQ ID NO: 838368 - DNA, 18 bp, Homo sapiens
ggggcatggttccttccc

SEQ ID NO: 838369 - DNA, 18 bp, Homo sapiens
ggggcatgtattggcctg

SEQ ID NO: 838370 - DNA, 19 bp, Homo sapiens
ggggcatgtattggcctgg

SEQ ID NO: 838371 - DNA, 21 bp, Homo sapiens
ggggccaaagaaggcagggaa

SEQ ID NO: 838372 - DNA, 19 bp, Homo sapiens
ggggccaccaaagctgccc

SEQ ID NO: 838373 - DNA, 18 bp, Homo sapiens
ggggccaccatgacccct

SEQ ID NO: 838374 - DNA, 19 bp, Homo sapiens
ggggccacctcctccccct

SEQ ID NO: 838375 - DNA, 23 bp, Homo sapiens
ggggccactttcagagcccccag

SEQ ID NO: 838376 - DNA, 19 bp, Homo sapiens
ggggccacttttgactagg

SEQ ID NO: 838377 - DNA, 16 bp, Homo sapiens
ggggccagagagcagg

SEQ ID NO: 838378 - DNA, 12 bp, Homo sapiens
ggggccagagga

SEQ ID NO: 838379 - DNA, 16 bp, Homo sapiens
ggggccagaggctggg

SEQ ID NO: 838380 - DNA, 24 bp, Homo sapiens
ggggccagatgattttcctccctg

SEQ ID NO: 838381 - DNA, 13 bp, Homo sapiens
ggggccagctggg

SEQ ID NO: 838382 - DNA, 15 bp, Homo sapiens
ggggccagctgggga

SEQ ID NO: 838383 - DNA, 16 bp, Homo sapiens
ggggccagctggggag

SEQ ID NO: 838384 - DNA, 11 bp, Homo sapiens
ggggccaggac

SEQ ID NO: 838385 - DNA, 23 bp, Homo sapiens
ggggccaggcaggggtgggagag

SEQ ID NO: 838386 - DNA, 16 bp, Homo sapiens
ggggccaggggcaggc

SEQ ID NO: 838387 - DNA, 22 bp, Homo sapiens
ggggccagtggattcccacagc

SEQ ID NO: 838388 - DNA, 21 bp, Homo sapiens
ggggccatgagctccagaccc

SEQ ID NO: 838389 - DNA, 16 bp, Homo sapiens
ggggccatgaggcctc

SEQ ID NO: 838390 - DNA, 22 bp, Homo sapiens
ggggccatgccccacccccctc

SEQ ID NO: 838391 - DNA, 14 bp, Homo sapiens
ggggccatgcctcc

SEQ ID NO: 838392 - DNA, 13 bp, Homo sapiens
ggggccatggtgg

SEQ ID NO: 838393 - DNA, 17 bp, Homo sapiens
ggggcccaagttgcagt

SEQ ID NO: 838394 - DNA, 14 bp, Homo sapiens
ggggccccagatct

SEQ ID NO: 838395 - DNA, 15 bp, Homo sapiens
ggggccccagatctg

SEQ ID NO: 838396 - DNA, 18 bp, Homo sapiens
ggggccccagatctgcct

SEQ ID NO: 838397 - DNA, 20 bp, Homo sapiens
ggggccccagatctgcctgg

SEQ ID NO: 838398 - DNA, 22 bp, Homo sapiens
ggggccccagatctgcctgggc

SEQ ID NO: 838399 - DNA, 21 bp, Homo sapiens
ggggccccagcgtctgcaggg

SEQ ID NO: 838400 - DNA, 18 bp, Homo sapiens
ggggcccccgtgttcagg

SEQ ID NO: 838401 - DNA, 14 bp, Homo sapiens
ggggccccgccagg

SEQ ID NO: 838402 - DNA, 15 bp, Homo sapiens
ggggccccgccaggg

SEQ ID NO: 838403 - DNA, 18 bp, Homo sapiens
ggggccccgccagggctg

SEQ ID NO: 838404 - DNA, 10 bp, Homo sapiens
ggggcccctt

SEQ ID NO: 838405 - DNA, 21 bp, Homo sapiens
ggggcccgacaggtgggcctg

SEQ ID NO: 838406 - DNA, 22 bp, Homo sapiens
ggggcccgacaggtgggcctgg

SEQ ID NO: 838407 - DNA, 21 bp, Homo sapiens
ggggcccgcctggcagaactg

SEQ ID NO: 838408 - DNA, 16 bp, Homo sapiens
ggggccctcttgccag

SEQ ID NO: 838409 - DNA, 18 bp, Homo sapiens
ggggccctcttgccagcc

SEQ ID NO: 838410 - DNA, 14 bp, Homo sapiens
ggggccctgccctg

SEQ ID NO: 838411 - DNA, 16 bp, Homo sapiens
ggggccctggccagga

SEQ ID NO: 838412 - DNA, 18 bp, Homo sapiens
ggggcccttggagcgtgg

SEQ ID NO: 838413 - DNA, 22 bp, Homo sapiens
ggggcccttggccccagaggac

SEQ ID NO: 838414 - DNA, 22 bp, Homo sapiens
ggggcccttgggacagccagag

SEQ ID NO: 838415 - DNA, 21 bp, Homo sapiens
ggggcccttgggccacgctct

SEQ ID NO: 838416 - DNA, 18 bp, Homo sapiens
ggggcccttggggcctgg

SEQ ID NO: 838417 - DNA, 19 bp, Homo sapiens
ggggccggctggcctggag

SEQ ID NO: 838418 - DNA, 23 bp, Homo sapiens
ggggcctacagctttgatccctg

SEQ ID NO: 838419 - DNA, 21 bp, Homo sapiens
ggggcctagcgatctctcctg

SEQ ID NO: 838420 - DNA, 23 bp, Homo sapiens
ggggcctaggcctcagccagaga

SEQ ID NO: 838421 - DNA, 22 bp, Homo sapiens
ggggcctcagcctggggctctc

SEQ ID NO: 838422 - DNA, 12 bp, Homo sapiens
ggggcctcaggt

SEQ ID NO: 838423 - DNA, 21 bp, Homo sapiens
ggggcctggacctatgcaggg

SEQ ID NO: 838424 - DNA, 12 bp, Homo sapiens
ggggcctggcag

SEQ ID NO: 838425 - DNA, 11 bp, Homo sapiens
ggggcctggct

SEQ ID NO: 838426 - DNA, 19 bp, Homo sapiens
ggggcctggcttgctccag

SEQ ID NO: 838427 - DNA, 17 bp, Homo sapiens
ggggccttagggagccc

SEQ ID NO: 838428 - DNA, 16 bp, Homo sapiens
ggggccttgcggaagc

SEQ ID NO: 838429 - DNA, 22 bp, Homo sapiens
ggggccttgcggaagccatagg

SEQ ID NO: 838430 - DNA, 16 bp, Homo sapiens
ggggccttgctctgag

SEQ ID NO: 838431 - DNA, 18 bp, Homo sapiens
ggggccttgctctgagca

SEQ ID NO: 838432 - DNA, 13 bp, Homo sapiens
ggggcgcccaggg

SEQ ID NO: 838433 - DNA, 20 bp, Homo sapiens
ggggcgccctctctgctcct

SEQ ID NO: 838434 - DNA, 15 bp, Homo sapiens
ggggtcctagcccag

SEQ ID NO: 838435 - DNA, 12 bp, Homo sapiens
ggggtcctgcag

SEQ ID NO: 838436 - DNA, 14 bp, Homo sapiens
ggggtcctggccat

SEQ ID NO: 838437 - DNA, 12 bp, Homo sapiens
ggggtccttgga

SEQ ID NO: 838438 - DNA, 16 bp, Homo sapiens
ggggtcggacggggca

SEQ ID NO: 838439 - DNA, 14 bp, Homo sapiens
ggggtcggctcctg

SEQ ID NO: 838440 - DNA, 22 bp, Homo sapiens
ggggtctccctctcctgcctac

SEQ ID NO: 838441 - DNA, 16 bp, Homo sapiens
ggggtctcctggacct

SEQ ID NO: 838442 - DNA, 23 bp, Homo sapiens
ggggtctcgttttgttgccaaag

SEQ ID NO: 838443 - DNA, 16 bp, Homo sapiens
ggggtctgggcagtgc

SEQ ID NO: 838444 - DNA, 17 bp, Homo sapiens
ggggtctgtgctgtgcc

SEQ ID NO: 838445 - DNA, 20 bp, Homo sapiens
ggggtctgtgctgtgcctgc

SEQ ID NO: 838446 - DNA, 22 bp, Homo sapiens
ggggtctttgtgagagtgagct

SEQ ID NO: 838447 - DNA, 18 bp, Homo sapiens
ggggtgaatacttatttt

SEQ ID NO: 838448 - DNA, 11 bp, Homo sapiens
ggggtgacaga

SEQ ID NO: 838449 - DNA, 11 bp, Homo sapiens
ggggtgacagt

SEQ ID NO: 838450 - DNA, 18 bp, Homo sapiens
ggggtgacggccctcatc

SEQ ID NO: 838451 - DNA, 20 bp, Homo sapiens
ggggtgagaggcaggaatgg

SEQ ID NO: 838452 - DNA, 16 bp, Homo sapiens
ggggtgatggccagag

SEQ ID NO: 838453 - DNA, 17 bp, Homo sapiens
ggggtgcaaagactctg

SEQ ID NO: 838454 - DNA, 19 bp, Homo sapiens
ggggtgcaaagactctgag

SEQ ID NO: 838455 - DNA, 22 bp, Homo sapiens
ggggtgcacagtccacagctga

SEQ ID NO: 838456 - DNA, 15 bp, Homo sapiens
ggggtgcactcgcca

SEQ ID NO: 838457 - DNA, 14 bp, Homo sapiens
ggggtgcagctggg

SEQ ID NO: 838458 - DNA, 16 bp, Homo sapiens
ggggtgcccacaggcc

SEQ ID NO: 838459 - DNA, 19 bp, Homo sapiens
ggggtgcggcggtcccagc

SEQ ID NO: 838460 - DNA, 20 bp, Homo sapiens
ggggtgcggcggtcccagct

SEQ ID NO: 838461 - DNA, 20 bp, Homo sapiens
ggggtgcttttatagaggct

SEQ ID NO: 838462 - DNA, 13 bp, Homo sapiens
ggggtggccaggg

SEQ ID NO: 838463 - DNA, 16 bp, Homo sapiens
ggggtggccagggctt

SEQ ID NO: 838464 - DNA, 13 bp, Homo sapiens
ggggtggggaggg

SEQ ID NO: 838465 - DNA, 17 bp, Homo sapiens
ggggtgggggccaggcc

SEQ ID NO: 838466 - DNA, 22 bp, Homo sapiens
ggggtgggtgggtgggcaggga

SEQ ID NO: 838467 - DNA, 17 bp, Homo sapiens
ggggtggttcagtcact

SEQ ID NO: 838468 - DNA, 21 bp, Homo sapiens
ggggtgtgttccaactgcccc

SEQ ID NO: 838469 - DNA, 20 bp, Homo sapiens
ggggtgtttgggaggctgcg

SEQ ID NO: 838470 - DNA, 22 bp, Homo sapiens
ggggttagagccaagctgcaca

SEQ ID NO: 838471 - DNA, 17 bp, Homo sapiens
ggggttcataggggcag

SEQ ID NO: 838472 - DNA, 17 bp, Homo sapiens
ggggttccccacacagg

SEQ ID NO: 838473 - DNA, 22 bp, Homo sapiens
ggggttccctcctagctctccc

SEQ ID NO: 838474 - DNA, 21 bp, Homo sapiens
ggggttcgagaccagtctggc

SEQ ID NO: 838475 - DNA, 14 bp, Homo sapiens
ggggttctcagtgc

SEQ ID NO: 838476 - DNA, 15 bp, Homo sapiens
ggggttctggcagga

SEQ ID NO: 838477 - DNA, 20 bp, Homo sapiens
ggggttctttcttcctctgc

SEQ ID NO: 838478 - DNA, 18 bp, Homo sapiens
ggggttgggacagggagg

SEQ ID NO: 838479 - DNA, 22 bp, Homo sapiens
ggggttgggattgggggctggt

SEQ ID NO: 838480 - DNA, 13 bp, Homo sapiens
ggggttggggtgg

SEQ ID NO: 838481 - DNA, 23 bp, Homo sapiens
ggggttttttttttctgaataaa

SEQ ID NO: 838482 - DNA, 22 bp, Homo sapiens
gggtaaaattccttagcttaga

SEQ ID NO: 838483 - DNA, 18 bp, Homo sapiens
gggtaatgtgaaggccca

SEQ ID NO: 838484 - DNA, 17 bp, Homo sapiens
gggtacagaggggacaa

SEQ ID NO: 838485 - DNA, 23 bp, Homo sapiens
gggtaccttgaacactgggggag

SEQ ID NO: 838486 - DNA, 11 bp, Homo sapiens
gggtagaaaaa

SEQ ID NO: 838487 - DNA, 21 bp, Homo sapiens
gggtagaaaaattattagaac

SEQ ID NO: 838488 - DNA, 20 bp, Homo sapiens
gggtagaccttgagggtggg

SEQ ID NO: 838489 - DNA, 14 bp, Homo sapiens
gggtagagctgatc

SEQ ID NO: 838490 - DNA, 13 bp, Homo sapiens
gggtagcagctgg

SEQ ID NO: 838491 - DNA, 22 bp, Homo sapiens
gggtagcagctggactacccac

SEQ ID NO: 838492 - DNA, 22 bp, Homo sapiens
gggtagcaggtaccactgattt

SEQ ID NO: 838493 - DNA, 23 bp, Homo sapiens
gggtagctgtaaggcatgaagga

SEQ ID NO: 838494 - DNA, 19 bp, Homo sapiens
gggtaggagggtgggaagg

SEQ ID NO: 838495 - DNA, 12 bp, Homo sapiens
gggtaggcggga

SEQ ID NO: 838496 - DNA, 16 bp, Homo sapiens
gggtaggcgggaagga

SEQ ID NO: 838497 - DNA, 24 bp, Homo sapiens
gggtaggggaagaagagctatcag

SEQ ID NO: 838498 - DNA, 15 bp, Homo sapiens
gggtagggtaaatca

SEQ ID NO: 838499 - DNA, 18 bp, Homo sapiens
gggtataatgtgtctgtg

SEQ ID NO: 838500 - DNA, 22 bp, Homo sapiens
gggtataggtctcatctcttca

SEQ ID NO: 838501 - DNA, 17 bp, Homo sapiens
gggtatatttttgatac

SEQ ID NO: 838502 - DNA, 13 bp, Homo sapiens
gggtatcccctgc

SEQ ID NO: 838503 - DNA, 23 bp, Homo sapiens
gggtatcccctgcctcctgccac

SEQ ID NO: 838504 - DNA, 21 bp, Homo sapiens
gggtatgtgtgtgtgggtgtg

SEQ ID NO: 838505 - DNA, 23 bp, Homo sapiens
gggtattcccactcaccagccct

SEQ ID NO: 838506 - DNA, 16 bp, Homo sapiens
gggtcaaaagagccct

SEQ ID NO: 838507 - DNA, 18 bp, Homo sapiens
gggtcaaaagagccctgg

SEQ ID NO: 838508 - DNA, 18 bp, Homo sapiens
gggtcaaggacagggctg

SEQ ID NO: 838509 - DNA, 21 bp, Homo sapiens
gggtcactgaaccactgcttc

SEQ ID NO: 838510 - DNA, 12 bp, Homo sapiens
gggtcagccagg

SEQ ID NO: 838511 - DNA, 13 bp, Homo sapiens
gggtcagccaggg

SEQ ID NO: 838512 - DNA, 12 bp, Homo sapiens
gggtcagcccca

SEQ ID NO: 838513 - DNA, 13 bp, Homo sapiens
gggtcagccccaa

SEQ ID NO: 838514 - DNA, 19 bp, Homo sapiens
gggtcagccccaagggctg

SEQ ID NO: 838515 - DNA, 12 bp, Homo sapiens
gggtcagggggg

SEQ ID NO: 838516 - DNA, 13 bp, Homo sapiens
gggtcagtgctgc

SEQ ID NO: 838517 - DNA, 14 bp, Homo sapiens
gggtcatcagggag

SEQ ID NO: 838518 - DNA, 21 bp, Homo sapiens
gggtcatccttggtctatgtg

SEQ ID NO: 838519 - DNA, 21 bp, Homo sapiens
gggtcatgccctcctctccca

SEQ ID NO: 838520 - DNA, 12 bp, Homo sapiens
gggtccaccagt

SEQ ID NO: 838521 - DNA, 20 bp, Homo sapiens
gggtccacccagcaaagagt

SEQ ID NO: 838522 - DNA, 19 bp, Homo sapiens
gggtccaggaaggcagctg

SEQ ID NO: 838523 - DNA, 18 bp, Homo sapiens
gggtccaggagagcctgg

SEQ ID NO: 838524 - DNA, 17 bp, Homo sapiens
gggtccagggagcaggc

SEQ ID NO: 838525 - DNA, 13 bp, Homo sapiens
gggtcccaccccc

SEQ ID NO: 838526 - DNA, 11 bp, Homo sapiens
gggtcccagga

SEQ ID NO: 838527 - DNA, 13 bp, Homo sapiens
gggtcccagggct

SEQ ID NO: 838528 - DNA, 23 bp, Homo sapiens
gggtcccagtgggaggggcaggc

SEQ ID NO: 838529 - DNA, 13 bp, Homo sapiens
gggtcccattgtg

SEQ ID NO: 838530 - DNA, 19 bp, Homo sapiens
gggtcccctccccagctcc

SEQ ID NO: 838531 - DNA, 13 bp, Homo sapiens
gggtcccctctgt

SEQ ID NO: 838532 - DNA, 12 bp, Homo sapiens
gggtccctcctc

SEQ ID NO: 838533 - DNA, 17 bp, Homo sapiens
gggtccctgctcccctt

SEQ ID NO: 838534 - DNA, 19 bp, Homo sapiens
gggtccgcaccagctgctc

SEQ ID NO: 838535 - DNA, 21 bp, Homo sapiens
gggtccgcaccagctgctctg

SEQ ID NO: 838536 - DNA, 23 bp, Homo sapiens
gggtccgcaccagctgctctgcc

SEQ ID NO: 838537 - DNA, 23 bp, Homo sapiens
gggtcctaaaacttggatggact

SEQ ID NO: 838538 - DNA, 18 bp, Homo sapiens
gggtcctcctcgctcctc

SEQ ID NO: 838539 - DNA, 13 bp, Homo sapiens
gggtcctcttctg

SEQ ID NO: 838540 - DNA, 19 bp, Homo sapiens
gggtcctcttctgggcctg

SEQ ID NO: 838541 - DNA, 15 bp, Homo sapiens
gggtcctggccatcc

SEQ ID NO: 838542 - DNA, 16 bp, Homo sapiens
gggtcctggccatccc

SEQ ID NO: 838543 - DNA, 15 bp, Homo sapiens
gggtcctgggggcag

SEQ ID NO: 838544 - DNA, 15 bp, Homo sapiens
gggtccttctccaca

SEQ ID NO: 838545 - DNA, 16 bp, Homo sapiens
gggtccttgatgccag

SEQ ID NO: 838546 - DNA, 19 bp, Homo sapiens
gggtccttgatgccagagg

SEQ ID NO: 838547 - DNA, 22 bp, Homo sapiens
gggtccttttgacactgctcta

SEQ ID NO: 838548 - DNA, 16 bp, Homo sapiens
gggtcggaagcctgtc

SEQ ID NO: 838549 - DNA, 18 bp, Homo sapiens
gggtcggaagcctgtcct

SEQ ID NO: 838550 - DNA, 22 bp, Homo sapiens
gggtcggacggggcaggcgctg

SEQ ID NO: 838551 - DNA, 15 bp, Homo sapiens
gggtcggctgaccat

SEQ ID NO: 838552 - DNA, 22 bp, Homo sapiens
gggtcgtttgcttttcagggtt

SEQ ID NO: 838553 - DNA, 14 bp, Homo sapiens
gggtctcactctgt

SEQ ID NO: 838554 - DNA, 17 bp, Homo sapiens
gggtctcacttatacca

SEQ ID NO: 838555 - DNA, 16 bp, Homo sapiens
gggtctccctctcctg

SEQ ID NO: 838556 - DNA, 16 bp, Homo sapiens
ggtagaaaaaggggcc

SEQ ID NO: 838557 - DNA, 22 bp, Homo sapiens
ggtagaaatatctgaaaatgta

SEQ ID NO: 838558 - DNA, 16 bp, Homo sapiens
ggtagaaggggaggac

SEQ ID NO: 838559 - DNA, 15 bp, Homo sapiens
ggtagaagtgagagc

SEQ ID NO: 838560 - DNA, 16 bp, Homo sapiens
ggtagaattgggaagc

SEQ ID NO: 838561 - DNA, 23 bp, Homo sapiens
ggtagaattgggaagctggggga

SEQ ID NO: 838562 - DNA, 21 bp, Homo sapiens
ggtagaccttgagggtgggcc

SEQ ID NO: 838563 - DNA, 22 bp, Homo sapiens
ggtagaccttgagggtgggcca

SEQ ID NO: 838564 - DNA, 23 bp, Homo sapiens
ggtagaccttgagggtgggccag

SEQ ID NO: 838565 - DNA, 15 bp, Homo sapiens
ggtagactgagggat

SEQ ID NO: 838566 - DNA, 14 bp, Homo sapiens
ggtagagaccccca

SEQ ID NO: 838567 - DNA, 20 bp, Homo sapiens
ggtagagaggcgcggagtga

SEQ ID NO: 838568 - DNA, 15 bp, Homo sapiens
ggtagagctgatcca

SEQ ID NO: 838569 - DNA, 16 bp, Homo sapiens
ggtagatcgcttgagc

SEQ ID NO: 838570 - DNA, 21 bp, Homo sapiens
ggtagatcgcttgagcccagg

SEQ ID NO: 838571 - DNA, 15 bp, Homo sapiens
ggtagcaagagagca

SEQ ID NO: 838572 - DNA, 17 bp, Homo sapiens
ggtagcaagagagcagc

SEQ ID NO: 838573 - DNA, 20 bp, Homo sapiens
ggtagcacagattttgaatc

SEQ ID NO: 838574 - DNA, 13 bp, Homo sapiens
ggtagcagcaggc

SEQ ID NO: 838575 - DNA, 21 bp, Homo sapiens
ggtagcagccacacttccttt

SEQ ID NO: 838576 - DNA, 15 bp, Homo sapiens
ggtagcataaataaa

SEQ ID NO: 838577 - DNA, 23 bp, Homo sapiens
ggtagcatgggtccaagagacat

SEQ ID NO: 838578 - DNA, 16 bp, Homo sapiens
ggtagccagcacacag

SEQ ID NO: 838579 - DNA, 16 bp, Homo sapiens
ggtagccatcatggat

SEQ ID NO: 838580 - DNA, 23 bp, Homo sapiens
ggtagccatgatttgtcccagcc

SEQ ID NO: 838581 - DNA, 14 bp, Homo sapiens
ggtagccccgcccc

SEQ ID NO: 838582 - DNA, 18 bp, Homo sapiens
ggtagccccgccccagcc

SEQ ID NO: 838583 - DNA, 15 bp, Homo sapiens
ggtagcctgctgtgg

SEQ ID NO: 838584 - DNA, 17 bp, Homo sapiens
ggtagcctgctgtgggg

SEQ ID NO: 838585 - DNA, 15 bp, Homo sapiens
ggtagcgagctgctc

SEQ ID NO: 838586 - DNA, 19 bp, Homo sapiens
ggtagcgagctgctctgct

SEQ ID NO: 838587 - DNA, 20 bp, Homo sapiens
ggtagctctggcttagacac

SEQ ID NO: 838588 - DNA, 13 bp, Homo sapiens
ggtagctgagggg

SEQ ID NO: 838589 - DNA, 12 bp, Homo sapiens
ggtaggagagca

SEQ ID NO: 838590 - DNA, 15 bp, Homo sapiens
ggtaggagagcactg

SEQ ID NO: 838591 - DNA, 12 bp, Homo sapiens
ggtaggagagga

SEQ ID NO: 838592 - DNA, 20 bp, Homo sapiens
ggtaggagaggagaaaaaaa

SEQ ID NO: 838593 - DNA, 18 bp, Homo sapiens
ggtaggagcccttctctt

SEQ ID NO: 838594 - DNA, 16 bp, Homo sapiens
ggtaggaggcaaaggt

SEQ ID NO: 838595 - DNA, 17 bp, Homo sapiens
ggtaggagggtgggaag

SEQ ID NO: 838596 - DNA, 12 bp, Homo sapiens
ggtaggatgttg

SEQ ID NO: 838597 - DNA, 17 bp, Homo sapiens
ggtaggatgttgcttct

SEQ ID NO: 838598 - DNA, 23 bp, Homo sapiens
ggtaggcccttgtcctgccagct

SEQ ID NO: 838599 - DNA, 18 bp, Homo sapiens
ggtaggctgtctgtgcca

SEQ ID NO: 838600 - DNA, 19 bp, Homo sapiens
ggtaggctgtctgtgccat

SEQ ID NO: 838601 - DNA, 14 bp, Homo sapiens
ggtaggctgtgggg

SEQ ID NO: 838602 - DNA, 19 bp, Homo sapiens
ggtaggctgtggggtgggc

SEQ ID NO: 838603 - DNA, 14 bp, Homo sapiens
ggtagggtaaatca

SEQ ID NO: 838604 - DNA, 16 bp, Homo sapiens
ggtaggttcagccaag

SEQ ID NO: 838605 - DNA, 18 bp, Homo sapiens
ggtaggttgggacaccag

SEQ ID NO: 838606 - DNA, 13 bp, Homo sapiens
ggtagtactggga

SEQ ID NO: 838607 - DNA, 20 bp, Homo sapiens
ggtagtctcactgcttgaac

SEQ ID NO: 838608 - DNA, 17 bp, Homo sapiens
ggtagttctgtgcctcc

SEQ ID NO: 838609 - DNA, 20 bp, Homo sapiens
ggtataaaaaggaagtgggg

SEQ ID NO: 838610 - DNA, 12 bp, Homo sapiens
ggtataaagaca

SEQ ID NO: 838611 - DNA, 14 bp, Homo sapiens
ggtataattgaaac

SEQ ID NO: 838612 - DNA, 15 bp, Homo sapiens
ggtatacattgaatt

SEQ ID NO: 838613 - DNA, 13 bp, Homo sapiens
ggtataggtctca

SEQ ID NO: 838614 - DNA, 13 bp, Homo sapiens
ggtatatactttg

SEQ ID NO: 838615 - DNA, 18 bp, Homo sapiens
ggtatatcctctggaaaa

SEQ ID NO: 838616 - DNA, 15 bp, Homo sapiens
ggtatcaagaaagtc

SEQ ID NO: 838617 - DNA, 14 bp, Homo sapiens
ggtatcccctgcct

SEQ ID NO: 838618 - DNA, 15 bp, Homo sapiens
ggtatcccctgcctc

SEQ ID NO: 838619 - DNA, 21 bp, Homo sapiens
ggtatcctccctgcccatccg

SEQ ID NO: 838620 - DNA, 12 bp, Homo sapiens
ggtatcctgccc

SEQ ID NO: 838621 - DNA, 15 bp, Homo sapiens
ggtatcctgcccagt

SEQ ID NO: 838622 - DNA, 15 bp, Homo sapiens
ggtatctcagaaagt

SEQ ID NO: 838623 - DNA, 13 bp, Homo sapiens
ggtatctccagga

SEQ ID NO: 838624 - DNA, 14 bp, Homo sapiens
ggtatgagctgagg

SEQ ID NO: 838625 - DNA, 14 bp, Homo sapiens
ggtatgcaatcaaa

SEQ ID NO: 838626 - DNA, 13 bp, Homo sapiens
ggtatgctggcca

SEQ ID NO: 838627 - DNA, 18 bp, Homo sapiens
ggtatgctggccagcacc

SEQ ID NO: 838628 - DNA, 21 bp, Homo sapiens
ggtatggaagggtttgtggct

SEQ ID NO: 838629 - DNA, 16 bp, Homo sapiens
ggtatgtagccagctg

SEQ ID NO: 838630 - DNA, 18 bp, Homo sapiens
ggtatgtagccagctgtg

SEQ ID NO: 838631 - DNA, 13 bp, Homo sapiens
ggtatgtctgcca

SEQ ID NO: 838632 - DNA, 14 bp, Homo sapiens
ggtatgtgccaggc

SEQ ID NO: 838633 - DNA, 22 bp, Homo sapiens
ggtattaactttatacacttgg

SEQ ID NO: 838634 - DNA, 20 bp, Homo sapiens
ggtattacactgtatttgta

SEQ ID NO: 838635 - DNA, 14 bp, Homo sapiens
ggtattagaaagtg

SEQ ID NO: 838636 - DNA, 18 bp, Homo sapiens
ggtattattctgttttgc

SEQ ID NO: 838637 - DNA, 19 bp, Homo sapiens
ggtattcccactcaccagc

SEQ ID NO: 838638 - DNA, 19 bp, Homo sapiens
ggtattccttttgtgtaca

SEQ ID NO: 838639 - DNA, 15 bp, Homo sapiens
ggtattctctctatg

SEQ ID NO: 838640 - DNA, 20 bp, Homo sapiens
ggtattctctctatgcaaaa

SEQ ID NO: 838641 - DNA, 23 bp, Homo sapiens
ggtattggctagaggttcaaaga

SEQ ID NO: 838642 - DNA, 15 bp, Homo sapiens
ggtatttctttctcg

SEQ ID NO: 838643 - DNA, 14 bp, Homo sapiens
ggtcaaaagagccc

SEQ ID NO: 838644 - DNA, 17 bp, Homo sapiens
ggtcaaagtacagaata

SEQ ID NO: 838645 - DNA, 19 bp, Homo sapiens
ggtcaacatggtgaaaccc

SEQ ID NO: 838646 - DNA, 14 bp, Homo sapiens
ggtcaagaaacagc

SEQ ID NO: 838647 - DNA, 21 bp, Homo sapiens
ggtcaataaacttagaggaaa

SEQ ID NO: 838648 - DNA, 14 bp, Homo sapiens
ggtcacacactgat

SEQ ID NO: 838649 - DNA, 18 bp, Homo sapiens
ggtcacaggactctgcct

SEQ ID NO: 838650 - DNA, 21 bp, Homo sapiens
ggtcacattcaggaagatgaa

SEQ ID NO: 838651 - DNA, 16 bp, Homo sapiens
ggtcaccaagcagtgg

SEQ ID NO: 838652 - DNA, 19 bp, Homo sapiens
ggtcaccaaggcagtgcat

SEQ ID NO: 838653 - DNA, 23 bp, Homo sapiens
ggtcaccaaggcagtgcatgcat

SEQ ID NO: 838654 - DNA, 19 bp, Homo sapiens
ggtcaccagacggggctgg

SEQ ID NO: 838655 - DNA, 16 bp, Homo sapiens
ggtcaccatcctcaga

SEQ ID NO: 838656 - DNA, 22 bp, Homo sapiens
ggtcaccatcctcagaggctga

SEQ ID NO: 838657 - DNA, 12 bp, Homo sapiens
ggtcaccctgtg

SEQ ID NO: 838658 - DNA, 22 bp, Homo sapiens
ggtcaccgcggacgtgctggcc

SEQ ID NO: 838659 - DNA, 15 bp, Homo sapiens
ggtcactctgccctc

SEQ ID NO: 838660 - DNA, 19 bp, Homo sapiens
ggtcactctgccctctgct

SEQ ID NO: 838661 - DNA, 20 bp, Homo sapiens
ggtcactctgccctctgctg

SEQ ID NO: 838662 - DNA, 22 bp, Homo sapiens
ggtcactctgccctctgctgct

SEQ ID NO: 838663 - DNA, 21 bp, Homo sapiens
ggtcactcttcctgcaaggac

SEQ ID NO: 838664 - DNA, 13 bp, Homo sapiens
ggtcactggaaag

SEQ ID NO: 838665 - DNA, 13 bp, Homo sapiens
ggtcactggctct

SEQ ID NO: 838666 - DNA, 18 bp, Homo sapiens
ggtcactggctctccaag

SEQ ID NO: 838667 - DNA, 17 bp, Homo sapiens
ggtcactggtcagggca

SEQ ID NO: 838668 - DNA, 17 bp, Homo sapiens
ggtcactgtcactgccg

SEQ ID NO: 838669 - DNA, 21 bp, Homo sapiens
ggtcactgtccttgaacccaa

SEQ ID NO: 838670 - DNA, 18 bp, Homo sapiens
ggtcactgtttcctgggc

SEQ ID NO: 838671 - DNA, 15 bp, Homo sapiens
ggtcagaacatgtta

SEQ ID NO: 838672 - DNA, 20 bp, Homo sapiens
ggtcagaagaagtgggagca

SEQ ID NO: 838673 - DNA, 22 bp, Homo sapiens
ggtcagaagaagtgggagcagc

SEQ ID NO: 838674 - DNA, 20 bp, Homo sapiens
ggtcagagagacctcatcct

SEQ ID NO: 838675 - DNA, 21 bp, Homo sapiens
ggtcagaggagcgcaggcagc

SEQ ID NO: 838676 - DNA, 13 bp, Homo sapiens
ggtcagaggaggg

SEQ ID NO: 838677 - DNA, 22 bp, Homo sapiens
ggtcagatgtggcttctggctc

SEQ ID NO: 838678 - DNA, 15 bp, Homo sapiens
ggtctgggcagtgcc

SEQ ID NO: 838679 - DNA, 23 bp, Homo sapiens
ggtctgggcgtccagctcagccc

SEQ ID NO: 838680 - DNA, 21 bp, Homo sapiens
ggtctgggctgggcacctgac

SEQ ID NO: 838681 - DNA, 16 bp, Homo sapiens
ggtctgggggcagctg

SEQ ID NO: 838682 - DNA, 20 bp, Homo sapiens
ggtctgggggcagctgtcct

SEQ ID NO: 838683 - DNA, 16 bp, Homo sapiens
ggtctgtaactgccca

SEQ ID NO: 838684 - DNA, 19 bp, Homo sapiens
ggtctgtaactgcccagcc

SEQ ID NO: 838685 - DNA, 23 bp, Homo sapiens
ggtctgtctgttaccataagtct

SEQ ID NO: 838686 - DNA, 15 bp, Homo sapiens
ggtctgtgactggat

SEQ ID NO: 838687 - DNA, 16 bp, Homo sapiens
ggtctgtgactggatc

SEQ ID NO: 838688 - DNA, 15 bp, Homo sapiens
ggtctgtgctgtgcc

SEQ ID NO: 838689 - DNA, 16 bp, Homo sapiens
ggtctgtgctgtgcct

SEQ ID NO: 838690 - DNA, 19 bp, Homo sapiens
ggtctgtggagatggactc

SEQ ID NO: 838691 - DNA, 15 bp, Homo sapiens
ggtctgtgtgaatgt

SEQ ID NO: 838692 - DNA, 17 bp, Homo sapiens
ggtctgtgtgaatgtgg

SEQ ID NO: 838693 - DNA, 13 bp, Homo sapiens
ggtctgttcttga

SEQ ID NO: 838694 - DNA, 19 bp, Homo sapiens
ggtctgttctttccaaagt

SEQ ID NO: 838695 - DNA, 13 bp, Homo sapiens
ggtctgttgccca

SEQ ID NO: 838696 - DNA, 18 bp, Homo sapiens
ggtctgttggcaggctgg

SEQ ID NO: 838697 - DNA, 19 bp, Homo sapiens
ggtctgttggcaggctggc

SEQ ID NO: 838698 - DNA, 12 bp, Homo sapiens
ggtctgtttgca

SEQ ID NO: 838699 - DNA, 17 bp, Homo sapiens
ggtcttaaactcctggc

SEQ ID NO: 838700 - DNA, 23 bp, Homo sapiens
ggtcttaaatgctcattttctgg

SEQ ID NO: 838701 - DNA, 20 bp, Homo sapiens
ggtcttacctctctgggacc

SEQ ID NO: 838702 - DNA, 20 bp, Homo sapiens
ggtcttaggatgtctgtaat

SEQ ID NO: 838703 - DNA, 12 bp, Homo sapiens
ggtcttatgatt

SEQ ID NO: 838704 - DNA, 19 bp, Homo sapiens
ggtcttcactttcctcagt

SEQ ID NO: 838705 - DNA, 15 bp, Homo sapiens
ggtcttcagcctccc

SEQ ID NO: 838706 - DNA, 15 bp, Homo sapiens
ggtcttcagggctct

SEQ ID NO: 838707 - DNA, 22 bp, Homo sapiens
ggtcttcttacatgcatttgag

SEQ ID NO: 838708 - DNA, 21 bp, Homo sapiens
ggtcttgaactcctggactca

SEQ ID NO: 838709 - DNA, 22 bp, Homo sapiens
ggtcttgaatagattttctctg

SEQ ID NO: 838710 - DNA, 20 bp, Homo sapiens
ggtcttgactcatggcagct

SEQ ID NO: 838711 - DNA, 23 bp, Homo sapiens
ggtcttgagccagtaatctttat

SEQ ID NO: 838712 - DNA, 20 bp, Homo sapiens
ggtcttgggaaatatgaatg

SEQ ID NO: 838713 - DNA, 16 bp, Homo sapiens
ggtcttgggctactgg

SEQ ID NO: 838714 - DNA, 21 bp, Homo sapiens
ggtcttgggctactggcagct

SEQ ID NO: 838715 - DNA, 12 bp, Homo sapiens
ggtctttctcct

SEQ ID NO: 838716 - DNA, 14 bp, Homo sapiens
ggtctttctctcag

SEQ ID NO: 838717 - DNA, 22 bp, Homo sapiens
ggtctttgctaggcctcttgct

SEQ ID NO: 838718 - DNA, 18 bp, Homo sapiens
ggtcttttaccctgtgtc

SEQ ID NO: 838719 - DNA, 19 bp, Homo sapiens
ggtcttttaccctgtgtca

SEQ ID NO: 838720 - DNA, 19 bp, Homo sapiens
ggtcttttcatctgggaaa

SEQ ID NO: 838721 - DNA, 20 bp, Homo sapiens
ggtcttttcatctgggaaag

SEQ ID NO: 838722 - DNA, 21 bp, Homo sapiens
ggtcttttgacatgtggaaag

SEQ ID NO: 838723 - DNA, 13 bp, Homo sapiens
ggtgaaagggagc

SEQ ID NO: 838724 - DNA, 13 bp, Homo sapiens
ggtgaaataataa

SEQ ID NO: 838725 - DNA, 16 bp, Homo sapiens
ggtgaaataataaaat

SEQ ID NO: 838726 - DNA, 22 bp, Homo sapiens
ggtgaaataataaaatgcaaat

SEQ ID NO: 838727 - DNA, 15 bp, Homo sapiens
ggtgaacactgtgac

SEQ ID NO: 838728 - DNA, 17 bp, Homo sapiens
ggtgaactgcaaagctt

SEQ ID NO: 838729 - DNA, 21 bp, Homo sapiens
ggtgaaggaggtcaggcccca

SEQ ID NO: 838730 - DNA, 22 bp, Homo sapiens
ggtgaagtcgggtcaaaaataa

SEQ ID NO: 838731 - DNA, 18 bp, Homo sapiens
ggtgaagtgaagacaatg

SEQ ID NO: 838732 - DNA, 15 bp, Homo sapiens
ggtgaagtgtggctg

SEQ ID NO: 838733 - DNA, 20 bp, Homo sapiens
ggtgaagtgtggctggtgtc

SEQ ID NO: 838734 - DNA, 14 bp, Homo sapiens
ggtgaattttcaag

SEQ ID NO: 838735 - DNA, 23 bp, Homo sapiens
ggtgacaaaccatttccaacagc

SEQ ID NO: 838736 - DNA, 17 bp, Homo sapiens
ggtgacaagagcctgat

SEQ ID NO: 838737 - DNA, 17 bp, Homo sapiens
ggtgacaagatagagag

SEQ ID NO: 838738 - DNA, 19 bp, Homo sapiens
ggtgacacaggtcagggct

SEQ ID NO: 838739 - DNA, 20 bp, Homo sapiens
ggtgacacaggtcagggctc

SEQ ID NO: 838740 - DNA, 15 bp, Homo sapiens
ggtgacagagtgagt

SEQ ID NO: 838741 - DNA, 17 bp, Homo sapiens
ggtgacagcagtcggtt

SEQ ID NO: 838742 - DNA, 18 bp, Homo sapiens
ggtgacagtgccttctct

SEQ ID NO: 838743 - DNA, 23 bp, Homo sapiens
ggtgaccaccccctgttccctgt

SEQ ID NO: 838744 - DNA, 15 bp, Homo sapiens
ggtgacccacagctc

SEQ ID NO: 838745 - DNA, 16 bp, Homo sapiens
ggtgacccacagctct

SEQ ID NO: 838746 - DNA, 20 bp, Homo sapiens
ggtgacccacagctctgggc

SEQ ID NO: 838747 - DNA, 23 bp, Homo sapiens
ggtgaccccatcactcgcaggac

SEQ ID NO: 838748 - DNA, 14 bp, Homo sapiens
ggtgacctctagag

SEQ ID NO: 838749 - DNA, 15 bp, Homo sapiens
ggtgacgcccacctt

SEQ ID NO: 838750 - DNA, 13 bp, Homo sapiens
ggtgacgcccagc

SEQ ID NO: 838751 - DNA, 17 bp, Homo sapiens
ggtgacgcccagctccg

SEQ ID NO: 838752 - DNA, 20 bp, Homo sapiens
ggtgactcacttcaatgtgt

SEQ ID NO: 838753 - DNA, 22 bp, Homo sapiens
ggtgactcacttcaatgtgtca

SEQ ID NO: 838754 - DNA, 23 bp, Homo sapiens
ggtgactgtcccaccgggagcct

SEQ ID NO: 838755 - DNA, 12 bp, Homo sapiens
ggtgactgtgct

SEQ ID NO: 838756 - DNA, 21 bp, Homo sapiens
ggtgacttcaggtggagagca

SEQ ID NO: 838757 - DNA, 19 bp, Homo sapiens
ggtgactttggggacaggg

SEQ ID NO: 838758 - DNA, 12 bp, Homo sapiens
ggtgagaaaaaa

SEQ ID NO: 838759 - DNA, 13 bp, Homo sapiens
ggtgagaaaactc

SEQ ID NO: 838760 - DNA, 15 bp, Homo sapiens
ggtgagaactcagaa

SEQ ID NO: 838761 - DNA, 16 bp, Homo sapiens
ggtgagagaggaaaga

SEQ ID NO: 838762 - DNA, 18 bp, Homo sapiens
ggtgagatcacagcctcc

SEQ ID NO: 838763 - DNA, 13 bp, Homo sapiens
ggtgagccagtgg

SEQ ID NO: 838764 - DNA, 14 bp, Homo sapiens
ggtgagcctgggca

SEQ ID NO: 838765 - DNA, 23 bp, Homo sapiens
ggtgagcgatcatttatttcatg

SEQ ID NO: 838766 - DNA, 18 bp, Homo sapiens
ggtgagctgcacctgatt

SEQ ID NO: 838767 - DNA, 15 bp, Homo sapiens
ggtgaggcaataaaa

SEQ ID NO: 838768 - DNA, 20 bp, Homo sapiens
ggtgaggcgttctcctgctt

SEQ ID NO: 838769 - DNA, 12 bp, Homo sapiens
ggtgagggatgt

SEQ ID NO: 838770 - DNA, 13 bp, Homo sapiens
ggtgaggggaggg

SEQ ID NO: 838771 - DNA, 16 bp, Homo sapiens
ggtgaggggaggggcc

SEQ ID NO: 838772 - DNA, 14 bp, Homo sapiens
ggtgaggggcagga

SEQ ID NO: 838773 - DNA, 18 bp, Homo sapiens
ggtgaggggcaggacctg

SEQ ID NO: 838774 - DNA, 18 bp, Homo sapiens
ggtgaggggctttctctt

SEQ ID NO: 838775 - DNA, 14 bp, Homo sapiens
ggtgagggtgcccc

SEQ ID NO: 838776 - DNA, 19 bp, Homo sapiens
ggtgaggtggcccaggccc

SEQ ID NO: 838777 - DNA, 20 bp, Homo sapiens
ggtgaggtggcccaggcccc

SEQ ID NO: 838778 - DNA, 18 bp, Homo sapiens
ggtgagtccattctccca

SEQ ID NO: 838779 - DNA, 18 bp, Homo sapiens
ggtgagtcttggttctaa

SEQ ID NO: 838780 - DNA, 23 bp, Homo sapiens
ggtgagtggaagggaggagcagc

SEQ ID NO: 838781 - DNA, 16 bp, Homo sapiens
ggtgagtgtgagggca

SEQ ID NO: 838782 - DNA, 14 bp, Homo sapiens
ggtgataaaatttt

SEQ ID NO: 838783 - DNA, 22 bp, Homo sapiens
ggtgataaggggccttgctctg

SEQ ID NO: 838784 - DNA, 22 bp, Homo sapiens
ggtgatatttttatgtgcagcg

SEQ ID NO: 838785 - DNA, 12 bp, Homo sapiens
ggtgatcagtgc

SEQ ID NO: 838786 - DNA, 16 bp, Homo sapiens
ggtgatcctctatttt

SEQ ID NO: 838787 - DNA, 18 bp, Homo sapiens
ggtgatcctctattttgt

SEQ ID NO: 838788 - DNA, 15 bp, Homo sapiens
ggtgatgctctggct

SEQ ID NO: 838789 - DNA, 17 bp, Homo sapiens
ggtgatgctctggcttg

SEQ ID NO: 838790 - DNA, 21 bp, Homo sapiens
ggtgatgcttttgctgctgct

SEQ ID NO: 838791 - DNA, 14 bp, Homo sapiens
ggtgatggccagag

SEQ ID NO: 838792 - DNA, 16 bp, Homo sapiens
ggtgatggccagcccc

SEQ ID NO: 838793 - DNA, 13 bp, Homo sapiens
ggtgatgggcaga

SEQ ID NO: 838794 - DNA, 23 bp, Homo sapiens
ggtgatggggctgttgagatgcc

SEQ ID NO: 838795 - DNA, 18 bp, Homo sapiens
ggtgatgtagcccatcct

SEQ ID NO: 838796 - DNA, 14 bp, Homo sapiens
ggtgattcaccaaa

SEQ ID NO: 838797 - DNA, 18 bp, Homo sapiens
ggtgattctcagggctgg

SEQ ID NO: 838798 - DNA, 15 bp, Homo sapiens
ggtgatttcagagag

SEQ ID NO: 838799 - DNA, 12 bp, Homo sapiens
ggtgcaaaaaaa

SEQ ID NO: 838800 - DNA, 15 bp, Homo sapiens
ggtggttagaggaaa

SEQ ID NO: 838801 - DNA, 13 bp, Homo sapiens
ggtggttcctaag

SEQ ID NO: 838802 - DNA, 23 bp, Homo sapiens
ggtggttgctgttttcctccctt

SEQ ID NO: 838803 - DNA, 13 bp, Homo sapiens
ggtggttgtgcct

SEQ ID NO: 838804 - DNA, 18 bp, Homo sapiens
ggtggtttcagaaatgtg

SEQ ID NO: 838805 - DNA, 19 bp, Homo sapiens
ggtggtttgatcatttctg

SEQ ID NO: 838806 - DNA, 16 bp, Homo sapiens
ggtggttttcagagca

SEQ ID NO: 838807 - DNA, 18 bp, Homo sapiens
ggtgtactgggttaatgg

SEQ ID NO: 838808 - DNA, 22 bp, Homo sapiens
ggtgtagaacactaattcataa

SEQ ID NO: 838809 - DNA, 12 bp, Homo sapiens
ggtgtagccagg

SEQ ID NO: 838810 - DNA, 20 bp, Homo sapiens
ggtgtagccctcccactttg

SEQ ID NO: 838811 - DNA, 14 bp, Homo sapiens
ggtgtataaatgta

SEQ ID NO: 838812 - DNA, 18 bp, Homo sapiens
ggtgtatatcatgaagcc

SEQ ID NO: 838813 - DNA, 21 bp, Homo sapiens
ggtgtatgccacacctggcct

SEQ ID NO: 838814 - DNA, 14 bp, Homo sapiens
ggtgtattatcatt

SEQ ID NO: 838815 - DNA, 16 bp, Homo sapiens
ggtgtattatcatttt

SEQ ID NO: 838816 - DNA, 13 bp, Homo sapiens
ggtgtcaccctgc

SEQ ID NO: 838817 - DNA, 20 bp, Homo sapiens
ggtgtcaccctgcagagcta

SEQ ID NO: 838818 - DNA, 18 bp, Homo sapiens
ggtgtcagaccctggagg

SEQ ID NO: 838819 - DNA, 13 bp, Homo sapiens
ggtgtcaggcccg

SEQ ID NO: 838820 - DNA, 15 bp, Homo sapiens
ggtgtcatctgagga

SEQ ID NO: 838821 - DNA, 17 bp, Homo sapiens
ggtgtcatttcattcca

SEQ ID NO: 838822 - DNA, 15 bp, Homo sapiens
ggtgtccaccatccc

SEQ ID NO: 838823 - DNA, 20 bp, Homo sapiens
ggtgtcccctatcctcccct

SEQ ID NO: 838824 - DNA, 15 bp, Homo sapiens
ggtgtccccttcccc

SEQ ID NO: 838825 - DNA, 21 bp, Homo sapiens
ggtgtccccttcccctgctga

SEQ ID NO: 838826 - DNA, 16 bp, Homo sapiens
ggtgtccctggatgtg

SEQ ID NO: 838827 - DNA, 15 bp, Homo sapiens
ggtgtccgccatcca

SEQ ID NO: 838828 - DNA, 22 bp, Homo sapiens
ggtgtccgccatccagggtctg

SEQ ID NO: 838829 - DNA, 14 bp, Homo sapiens
ggtgtcctgaccac

SEQ ID NO: 838830 - DNA, 17 bp, Homo sapiens
ggtgtcctgaccaccct

SEQ ID NO: 838831 - DNA, 18 bp, Homo sapiens
ggtgtcctgcctgtctgc

SEQ ID NO: 838832 - DNA, 12 bp, Homo sapiens
ggtgtctcccaa

SEQ ID NO: 838833 - DNA, 14 bp, Homo sapiens
ggtgtctcccaaca

SEQ ID NO: 838834 - DNA, 18 bp, Homo sapiens
ggtgtctcccaacatggg

SEQ ID NO: 838835 - DNA, 19 bp, Homo sapiens
ggtgtctcccaacatggga

SEQ ID NO: 838836 - DNA, 12 bp, Homo sapiens
ggtgtctctggg

SEQ ID NO: 838837 - DNA, 13 bp, Homo sapiens
ggtgtctctgggc

SEQ ID NO: 838838 - DNA, 23 bp, Homo sapiens
ggtgtctgtgttccaaccactga

SEQ ID NO: 838839 - DNA, 21 bp, Homo sapiens
ggtgtcttttccactcctatg

SEQ ID NO: 838840 - DNA, 20 bp, Homo sapiens
ggtgtgaaagtcagatgccc

SEQ ID NO: 838841 - DNA, 16 bp, Homo sapiens
ggtgtgaacccgggag

SEQ ID NO: 838842 - DNA, 17 bp, Homo sapiens
ggtgtgaacccgggagc

SEQ ID NO: 838843 - DNA, 12 bp, Homo sapiens
ggtgtgaagaaa

SEQ ID NO: 838844 - DNA, 17 bp, Homo sapiens
ggtgtgaccatgttcat

SEQ ID NO: 838845 - DNA, 20 bp, Homo sapiens
ggtgtgactcgggagctgca

SEQ ID NO: 838846 - DNA, 16 bp, Homo sapiens
ggtgtgactgaatttc

SEQ ID NO: 838847 - DNA, 22 bp, Homo sapiens
ggtgtgaggaggacaaaataaa

SEQ ID NO: 838848 - DNA, 15 bp, Homo sapiens
ggtgtgatcgtctga

SEQ ID NO: 838849 - DNA, 15 bp, Homo sapiens
ggtgtgcctgcagcc

SEQ ID NO: 838850 - DNA, 14 bp, Homo sapiens
ggtgtgcctgccct

SEQ ID NO: 838851 - DNA, 15 bp, Homo sapiens
ggtgtgcctgccctg

SEQ ID NO: 838852 - DNA, 16 bp, Homo sapiens
ggtgtgcggaggcagg

SEQ ID NO: 838853 - DNA, 18 bp, Homo sapiens
ggtgtgcggaggcaggag

SEQ ID NO: 838854 - DNA, 14 bp, Homo sapiens
ggtgtggagaagcg

SEQ ID NO: 838855 - DNA, 19 bp, Homo sapiens
ggtgtggagttggggctgc

SEQ ID NO: 838856 - DNA, 18 bp, Homo sapiens
ggtgtggccctgccatct

SEQ ID NO: 838857 - DNA, 19 bp, Homo sapiens
ggtgtggccctgccatctt

SEQ ID NO: 838858 - DNA, 13 bp, Homo sapiens
ggtgtggcctcag

SEQ ID NO: 838859 - DNA, 18 bp, Homo sapiens
ggtgtggcctcagccctc

SEQ ID NO: 838860 - DNA, 19 bp, Homo sapiens
ggtgtggctcctaccagca

SEQ ID NO: 838861 - DNA, 15 bp, Homo sapiens
ggtgtggggctgccg

SEQ ID NO: 838862 - DNA, 13 bp, Homo sapiens
ggtgtgggggaag

SEQ ID NO: 838863 - DNA, 19 bp, Homo sapiens
ggtgtgggtgtcctgcctg

SEQ ID NO: 838864 - DNA, 18 bp, Homo sapiens
ggtgtggtggctcatggc

SEQ ID NO: 838865 - DNA, 23 bp, Homo sapiens
ggtgtgtccccctctgtccaggc

SEQ ID NO: 838866 - DNA, 20 bp, Homo sapiens
ggtgtgtcctctgtgcccac

SEQ ID NO: 838867 - DNA, 18 bp, Homo sapiens
ggtgtgtggagatgcaga

SEQ ID NO: 838868 - DNA, 14 bp, Homo sapiens
ggtgtgtgttcacc

SEQ ID NO: 838869 - DNA, 18 bp, Homo sapiens
ggtgtgttccaactgccc

SEQ ID NO: 838870 - DNA, 21 bp, Homo sapiens
ggtgttatcaccgtgggctcc

SEQ ID NO: 838871 - DNA, 17 bp, Homo sapiens
ggtgttcctggaagcag

SEQ ID NO: 838872 - DNA, 22 bp, Homo sapiens
ggtgttctttcctgccctgtcc

SEQ ID NO: 838873 - DNA, 16 bp, Homo sapiens
ggtgttgtcagcaggc

SEQ ID NO: 838874 - DNA, 17 bp, Homo sapiens
ggtgtttcccttcctcg

SEQ ID NO: 838875 - DNA, 19 bp, Homo sapiens
ggtgttttttatgaagtgc

SEQ ID NO: 838876 - DNA, 21 bp, Homo sapiens
ggttaaaactgtacatttaaa

SEQ ID NO: 838877 - DNA, 17 bp, Homo sapiens
ggttaaaagggaacaca

SEQ ID NO: 838878 - DNA, 22 bp, Homo sapiens
ggttaaacggtgcccatcctgc

SEQ ID NO: 838879 - DNA, 16 bp, Homo sapiens
ggttaaagctaaactg

SEQ ID NO: 838880 - DNA, 18 bp, Homo sapiens
ggttaaagctaaactgaa

SEQ ID NO: 838881 - DNA, 13 bp, Homo sapiens
ggttaaggcctga

SEQ ID NO: 838882 - DNA, 22 bp, Homo sapiens
ggttaatttttacatggagaaa

SEQ ID NO: 838883 - DNA, 20 bp, Homo sapiens
ggttaatttttcctgcatgt

SEQ ID NO: 838884 - DNA, 21 bp, Homo sapiens
ggttaatttttcctgcatgtt

SEQ ID NO: 838885 - DNA, 14 bp, Homo sapiens
ggttacaaactgca

SEQ ID NO: 838886 - DNA, 23 bp, Homo sapiens
ggttacaatcattgctgaaaatg

SEQ ID NO: 838887 - DNA, 19 bp, Homo sapiens
ggttacaggaaggcaggag

SEQ ID NO: 838888 - DNA, 21 bp, Homo sapiens
ggttacccagttagctctcaa

SEQ ID NO: 838889 - DNA, 12 bp, Homo sapiens
ggttacctccct

SEQ ID NO: 838890 - DNA, 19 bp, Homo sapiens
ggttactcagcagcagaga

SEQ ID NO: 838891 - DNA, 21 bp, Homo sapiens
ggttagacgccttccaggtca

SEQ ID NO: 838892 - DNA, 17 bp, Homo sapiens
ggttagagccaagctgc

SEQ ID NO: 838893 - DNA, 18 bp, Homo sapiens
ggttagagccaagctgca

SEQ ID NO: 838894 - DNA, 23 bp, Homo sapiens
ggttagggtgtgtgccacacccc

SEQ ID NO: 838895 - DNA, 22 bp, Homo sapiens
ggttaggtgactaaaagggctt

SEQ ID NO: 838896 - DNA, 14 bp, Homo sapiens
ggttagtcattgat

SEQ ID NO: 838897 - DNA, 19 bp, Homo sapiens
ggttagtcattgatagaac

SEQ ID NO: 838898 - DNA, 18 bp, Homo sapiens
ggttatcaaaaatttcat

SEQ ID NO: 838899 - DNA, 12 bp, Homo sapiens
ggttatctgaat

SEQ ID NO: 838900 - DNA, 14 bp, Homo sapiens
ggttatctgcctgg

SEQ ID NO: 838901 - DNA, 16 bp, Homo sapiens
ggttatctttttaaaa

SEQ ID NO: 838902 - DNA, 13 bp, Homo sapiens
ggttatggagagg

SEQ ID NO: 838903 - DNA, 17 bp, Homo sapiens
ggttatggagtcttgtg

SEQ ID NO: 838904 - DNA, 22 bp, Homo sapiens
ggttattcacaacctcaccaaa

SEQ ID NO: 838905 - DNA, 24 bp, Homo sapiens
ggttatttctcaacaaagcacagt

SEQ ID NO: 838906 - DNA, 11 bp, Homo sapiens
ggttattttaa

SEQ ID NO: 838907 - DNA, 19 bp, Homo sapiens
ggttatttttattaaatgt

SEQ ID NO: 838908 - DNA, 20 bp, Homo sapiens
ggttatttttattaaatgta

SEQ ID NO: 838909 - DNA, 16 bp, Homo sapiens
ggttatttttctcttg

SEQ ID NO: 838910 - DNA, 13 bp, Homo sapiens
ggttcaaagatat

SEQ ID NO: 838911 - DNA, 16 bp, Homo sapiens
ggttcaaggtcactgt

SEQ ID NO: 838912 - DNA, 18 bp, Homo sapiens
ggttcaaggtcactgttt

SEQ ID NO: 838913 - DNA, 14 bp, Homo sapiens
ggttcacccagcac

SEQ ID NO: 838914 - DNA, 15 bp, Homo sapiens
ggttcactaaagcag

SEQ ID NO: 838915 - DNA, 16 bp, Homo sapiens
ggttcagaaatgctgc

SEQ ID NO: 838916 - DNA, 18 bp, Homo sapiens
ggttcagaaatgctgcct

SEQ ID NO: 838917 - DNA, 19 bp, Homo sapiens
ggttcagaaatgctgcctg

SEQ ID NO: 838918 - DNA, 18 bp, Homo sapiens
ggttcagaattaaacttt

SEQ ID NO: 838919 - DNA, 18 bp, Homo sapiens
ggttcagacacagctctt

SEQ ID NO: 838920 - DNA, 14 bp, Homo sapiens
ggttcagcccctcc

SEQ ID NO: 838921 - DNA, 16 bp, Homo sapiens
ggttcagcccctcctc

SEQ ID NO: 838922 - DNA, 15 bp, Homo sapiens
ggtttcacctgggcc

SEQ ID NO: 838923 - DNA, 17 bp, Homo sapiens
ggtttcactattcctat

SEQ ID NO: 838924 - DNA, 21 bp, Homo sapiens
ggtttcactgagagctgcctc

SEQ ID NO: 838925 - DNA, 16 bp, Homo sapiens
ggtttcatgttagtta

SEQ ID NO: 838926 - DNA, 19 bp, Homo sapiens
ggtttccaaagaatatttt

SEQ ID NO: 838927 - DNA, 13 bp, Homo sapiens
ggtttccctgccc

SEQ ID NO: 838928 - DNA, 16 bp, Homo sapiens
ggtttcctgctccagt

SEQ ID NO: 838929 - DNA, 15 bp, Homo sapiens
ggtttccttttggaa

SEQ ID NO: 838930 - DNA, 15 bp, Homo sapiens
ggtttcgactggtcc

SEQ ID NO: 838931 - DNA, 16 bp, Homo sapiens
ggtttcgactggtcca

SEQ ID NO: 838932 - DNA, 18 bp, Homo sapiens
ggtttcgactggtccagc

SEQ ID NO: 838933 - DNA, 21 bp, Homo sapiens
ggtttctccatgttggtcagg

SEQ ID NO: 838934 - DNA, 23 bp, Homo sapiens
ggtttctccttgaagcaaatgtg

SEQ ID NO: 838935 - DNA, 12 bp, Homo sapiens
ggtttctctgtg

SEQ ID NO: 838936 - DNA, 13 bp, Homo sapiens
ggtttctgcttct

SEQ ID NO: 838937 - DNA, 20 bp, Homo sapiens
ggtttctttttttttccttt

SEQ ID NO: 838938 - DNA, 23 bp, Homo sapiens
ggtttgaagacacagcctccccc

SEQ ID NO: 838939 - DNA, 16 bp, Homo sapiens
ggtttgccagtgaaga

SEQ ID NO: 838940 - DNA, 20 bp, Homo sapiens
ggtttgccagtgaagacttc

SEQ ID NO: 838941 - DNA, 20 bp, Homo sapiens
ggtttgcccagtcctgggtt

SEQ ID NO: 838942 - DNA, 15 bp, Homo sapiens
ggtttgctcatgtaa

SEQ ID NO: 838943 - DNA, 16 bp, Homo sapiens
ggtttggaatattaaa

SEQ ID NO: 838944 - DNA, 12 bp, Homo sapiens
ggtttggccagg

SEQ ID NO: 838945 - DNA, 22 bp, Homo sapiens
ggtttggccagggaggcgcagg

SEQ ID NO: 838946 - DNA, 14 bp, Homo sapiens
ggtttggcccaaga

SEQ ID NO: 838947 - DNA, 22 bp, Homo sapiens
ggtttggcccaagactgggctg

SEQ ID NO: 838948 - DNA, 17 bp, Homo sapiens
ggtttggggccatggtg

SEQ ID NO: 838949 - DNA, 15 bp, Homo sapiens
ggtttggtctgggac

SEQ ID NO: 838950 - DNA, 14 bp, Homo sapiens
ggtttggtgctttt

SEQ ID NO: 838951 - DNA, 14 bp, Homo sapiens
ggtttgtttgctta

SEQ ID NO: 838952 - DNA, 15 bp, Homo sapiens
ggtttgtttgcttaa

SEQ ID NO: 838953 - DNA, 19 bp, Homo sapiens
ggtttgtttgcttaatttc

SEQ ID NO: 838954 - DNA, 14 bp, Homo sapiens
ggtttgttttttca

SEQ ID NO: 838955 - DNA, 13 bp, Homo sapiens
ggttttaaacttt

SEQ ID NO: 838956 - DNA, 14 bp, Homo sapiens
ggttttaaactttc

SEQ ID NO: 838957 - DNA, 15 bp, Homo sapiens
ggttttatattttta

SEQ ID NO: 838958 - DNA, 15 bp, Homo sapiens
ggttttcagagcagg

SEQ ID NO: 838959 - DNA, 13 bp, Homo sapiens
ggttttcctgaaa

SEQ ID NO: 838960 - DNA, 19 bp, Homo sapiens
ggttttcgaagctcagccc

SEQ ID NO: 838961 - DNA, 19 bp, Homo sapiens
ggttttctagcccctctgg

SEQ ID NO: 838962 - DNA, 21 bp, Homo sapiens
ggttttctctaacttctcaag

SEQ ID NO: 838963 - DNA, 14 bp, Homo sapiens
ggttttcttcccat

SEQ ID NO: 838964 - DNA, 13 bp, Homo sapiens
ggttttcttttct

SEQ ID NO: 838965 - DNA, 21 bp, Homo sapiens
ggttttggcaaacgctaaaga

SEQ ID NO: 838966 - DNA, 16 bp, Homo sapiens
ggttttggctctccca

SEQ ID NO: 838967 - DNA, 17 bp, Homo sapiens
ggttttgtaagatgctg

SEQ ID NO: 838968 - DNA, 19 bp, Homo sapiens
ggttttgtaagatgctggg

SEQ ID NO: 838969 - DNA, 13 bp, Homo sapiens
ggttttgtatttt

SEQ ID NO: 838970 - DNA, 19 bp, Homo sapiens
ggtttttaaattttgtaat

SEQ ID NO: 838971 - DNA, 21 bp, Homo sapiens
ggtttttaatctttgtgacag

SEQ ID NO: 838972 - DNA, 22 bp, Homo sapiens
ggtttttagagaatgtgtttca

SEQ ID NO: 838973 - DNA, 15 bp, Homo sapiens
ggtttttattagtac

SEQ ID NO: 838974 - DNA, 12 bp, Homo sapiens
ggtttttgctct

SEQ ID NO: 838975 - DNA, 13 bp, Homo sapiens
ggtttttgctctc

SEQ ID NO: 838976 - DNA, 9 bp, Homo sapiens
ggttttttt

SEQ ID NO: 838977 - DNA, 22 bp, Homo sapiens
ggttttttttcagttgttcttt

SEQ ID NO: 838978 - DNA, 21 bp, Homo sapiens
gtaaaaaatggaaaaaaacat

SEQ ID NO: 838979 - DNA, 17 bp, Homo sapiens
gtaaaaaattaaagccc

SEQ ID NO: 838980 - DNA, 22 bp, Homo sapiens
gtaaaaactagaaggcttctct

SEQ ID NO: 838981 - DNA, 12 bp, Homo sapiens
gtaaaaagtggc

SEQ ID NO: 838982 - DNA, 20 bp, Homo sapiens
gtaaaaataaaatactttga

SEQ ID NO: 838983 - DNA, 15 bp, Homo sapiens
gtaaaaatgatttca

SEQ ID NO: 838984 - DNA, 14 bp, Homo sapiens
gtaaaaatgctgct

SEQ ID NO: 838985 - DNA, 14 bp, Homo sapiens
gtaaaacaaaattt

SEQ ID NO: 838986 - DNA, 21 bp, Homo sapiens
gtaaaacacatacaaaagaat

SEQ ID NO: 838987 - DNA, 11 bp, Homo sapiens
gtaaaacagga

SEQ ID NO: 838988 - DNA, 15 bp, Homo sapiens
gtaaaacccaaaaca

SEQ ID NO: 838989 - DNA, 14 bp, Homo sapiens
gtaaaagaaatcat

SEQ ID NO: 838990 - DNA, 15 bp, Homo sapiens
gtaaaagactttttt

SEQ ID NO: 838991 - DNA, 22 bp, Homo sapiens
gtaaaagataaatttgttgaat

SEQ ID NO: 838992 - DNA, 23 bp, Homo sapiens
gtaaaagataaatttgttgaata

SEQ ID NO: 838993 - DNA, 12 bp, Homo sapiens
gtaaaagcaaaa

SEQ ID NO: 838994 - DNA, 21 bp, Homo sapiens
gtaaaagttataataactgaa

SEQ ID NO: 838995 - DNA, 22 bp, Homo sapiens
gtaaaagttataataactgaac

SEQ ID NO: 838996 - DNA, 14 bp, Homo sapiens
gtaaaataaaatta

SEQ ID NO: 838997 - DNA, 13 bp, Homo sapiens
gtaaaatactttt

SEQ ID NO: 838998 - DNA, 12 bp, Homo sapiens
gtaaaatatgta

SEQ ID NO: 838999 - DNA, 19 bp, Homo sapiens
gtaaaatattttgaatcaa

SEQ ID NO: 839000 - DNA, 21 bp, Homo sapiens
gtaaaatattttgaatcaata

SEQ ID NO: 839001 - DNA, 11 bp, Homo sapiens
gtaaaatcact

SEQ ID NO: 839002 - DNA, 16 bp, Homo sapiens
gtaaaatcacttcaga

SEQ ID NO: 839003 - DNA, 17 bp, Homo sapiens
gtaaaatcacttcagat

SEQ ID NO: 839004 - DNA, 13 bp, Homo sapiens
gtaaaatgaacat

SEQ ID NO: 839005 - DNA, 16 bp, Homo sapiens
gtaaaatgaacatttt

SEQ ID NO: 839006 - DNA, 14 bp, Homo sapiens
gtaaaatgtattat

SEQ ID NO: 839007 - DNA, 16 bp, Homo sapiens
gtaaaatgttgaataa

SEQ ID NO: 839008 - DNA, 20 bp, Homo sapiens
gtaaaattaagcacactaaa

SEQ ID NO: 839009 - DNA, 17 bp, Homo sapiens
gtaaaatttatttatat

SEQ ID NO: 839010 - DNA, 19 bp, Homo sapiens
gtaaaatttgtgtaaattt

SEQ ID NO: 839011 - DNA, 20 bp, Homo sapiens
gtaaaatttgtgtaaatttg

SEQ ID NO: 839012 - DNA, 19 bp, Homo sapiens
gtaaacaaactcttgaaga

SEQ ID NO: 839013 - DNA, 14 bp, Homo sapiens
gtaaacagaataaa

SEQ ID NO: 839014 - DNA, 12 bp, Homo sapiens
gtaaacagattt

SEQ ID NO: 839015 - DNA, 14 bp, Homo sapiens
gtaaacagggtacc

SEQ ID NO: 839016 - DNA, 21 bp, Homo sapiens
gtaaacaggtatttttttaaa

SEQ ID NO: 839017 - DNA, 22 bp, Homo sapiens
gtaaacaggtatttttttaaat

SEQ ID NO: 839018 - DNA, 18 bp, Homo sapiens
gtaaacagtgcctgctga

SEQ ID NO: 839019 - DNA, 22 bp, Homo sapiens
gtaaacatgtgttttaattcca

SEQ ID NO: 839020 - DNA, 19 bp, Homo sapiens
gtaaacattaagtaaatgc

SEQ ID NO: 839021 - DNA, 21 bp, Homo sapiens
gtaaacattaagtaaatgctg

SEQ ID NO: 839022 - DNA, 13 bp, Homo sapiens
gtaaaccactgaa

SEQ ID NO: 839023 - DNA, 14 bp, Homo sapiens
gtaaacgacactct

SEQ ID NO: 839024 - DNA, 15 bp, Homo sapiens
gtaaactacaaagta

SEQ ID NO: 839025 - DNA, 21 bp, Homo sapiens
gtaaactatttatctgtgttt

SEQ ID NO: 839026 - DNA, 22 bp, Homo sapiens
gtaaactcgggggtgctggggc

SEQ ID NO: 839027 - DNA, 21 bp, Homo sapiens
gtaaactgtatcaaatctgta

SEQ ID NO: 839028 - DNA, 16 bp, Homo sapiens
gtaaactgtggatgat

SEQ ID NO: 839029 - DNA, 20 bp, Homo sapiens
gtaaactgtgtattccaaga

SEQ ID NO: 839030 - DNA, 15 bp, Homo sapiens
gtaaacttgtgtatt

SEQ ID NO: 839031 - DNA, 16 bp, Homo sapiens
gtaaactttttcaatg

SEQ ID NO: 839032 - DNA, 16 bp, Homo sapiens
gtaaactttttgtgct

SEQ ID NO: 839033 - DNA, 14 bp, Homo sapiens
gtaaagaaaaccat

SEQ ID NO: 839034 - DNA, 21 bp, Homo sapiens
gtaaagaaatttaaaagacac

SEQ ID NO: 839035 - DNA, 22 bp, Homo sapiens
gtaaagaagggatattaagaat

SEQ ID NO: 839036 - DNA, 11 bp, Homo sapiens
gtaaagacaga

SEQ ID NO: 839037 - DNA, 17 bp, Homo sapiens
gtaaagacagagtgaat

SEQ ID NO: 839038 - DNA, 15 bp, Homo sapiens
gtaaagactggcttt

SEQ ID NO: 839039 - DNA, 19 bp, Homo sapiens
gtaaagatatttttatctt

SEQ ID NO: 839040 - DNA, 21 bp, Homo sapiens
gtaaagatgtttatttcaggc

SEQ ID NO: 839041 - DNA, 15 bp, Homo sapiens
gtaaagctagaaatg

SEQ ID NO: 839042 - DNA, 20 bp, Homo sapiens
gtaaagctgttcaaacccag

SEQ ID NO: 839043 - DNA, 18 bp, Homo sapiens
gtaaaggaaataagagca

SEQ ID NO: 839044 - DNA, 15 bp, Homo sapiens
gtaaaggcctttaat

SEQ ID NO: 839045 - DNA, 20 bp, Homo sapiens
gtaattaaaagcaaatcatt

SEQ ID NO: 839046 - DNA, 13 bp, Homo sapiens
gtaattaaactgt

SEQ ID NO: 839047 - DNA, 14 bp, Homo sapiens
gtaattaagtacta

SEQ ID NO: 839048 - DNA, 20 bp, Homo sapiens
gtaattaagtactatgtatc

SEQ ID NO: 839049 - DNA, 16 bp, Homo sapiens
gtaattaataaagaaa

SEQ ID NO: 839050 - DNA, 17 bp, Homo sapiens
gtaattacctggagaag

SEQ ID NO: 839051 - DNA, 23 bp, Homo sapiens
gtaattagtaacatgtgttaagt

SEQ ID NO: 839052 - DNA, 20 bp, Homo sapiens
gtaattagtgccacttaatg

SEQ ID NO: 839053 - DNA, 17 bp, Homo sapiens
gtaattcaggtttttcc

SEQ ID NO: 839054 - DNA, 23 bp, Homo sapiens
gtaattctaccaaggtcttctta

SEQ ID NO: 839055 - DNA, 18 bp, Homo sapiens
gtaattctatttgtatat

SEQ ID NO: 839056 - DNA, 12 bp, Homo sapiens
gtaattcttatg

SEQ ID NO: 839057 - DNA, 15 bp, Homo sapiens
gtaattgaacttatc

SEQ ID NO: 839058 - DNA, 19 bp, Homo sapiens
gtaattgcatgacaaacct

SEQ ID NO: 839059 - DNA, 17 bp, Homo sapiens
gtaattgcatttctgct

SEQ ID NO: 839060 - DNA, 20 bp, Homo sapiens
gtaattgcctacaataaaaa

SEQ ID NO: 839061 - DNA, 15 bp, Homo sapiens
gtaattgcttacatt

SEQ ID NO: 839062 - DNA, 17 bp, Homo sapiens
gtaattggaatcttcac

SEQ ID NO: 839063 - DNA, 23 bp, Homo sapiens
gtaattggcccaagtcattgttt

SEQ ID NO: 839064 - DNA, 18 bp, Homo sapiens
gtaattggtaattacctg

SEQ ID NO: 839065 - DNA, 13 bp, Homo sapiens
gtaattgtgaaaa

SEQ ID NO: 839066 - DNA, 14 bp, Homo sapiens
gtaattgtgaaaaa

SEQ ID NO: 839067 - DNA, 21 bp, Homo sapiens
gtaattgtgtggattctttaa

SEQ ID NO: 839068 - DNA, 23 bp, Homo sapiens
gtaattgttgtttgtatgtataa

SEQ ID NO: 839069 - DNA, 20 bp, Homo sapiens
gtaattgttttttaaagcaa

SEQ ID NO: 839070 - DNA, 20 bp, Homo sapiens
gtaatttaaacaggcccagc

SEQ ID NO: 839071 - DNA, 12 bp, Homo sapiens
gtaatttaactt

SEQ ID NO: 839072 - DNA, 19 bp, Homo sapiens
gtaatttagaaactgattt

SEQ ID NO: 839073 - DNA, 20 bp, Homo sapiens
gtaatttagaagatattatt

SEQ ID NO: 839074 - DNA, 17 bp, Homo sapiens
gtaatttagttattgat

SEQ ID NO: 839075 - DNA, 12 bp, Homo sapiens
gtaatttatgca

SEQ ID NO: 839076 - DNA, 13 bp, Homo sapiens
gtaatttatgcaa

SEQ ID NO: 839077 - DNA, 12 bp, Homo sapiens
gtaatttcaaaa

SEQ ID NO: 839078 - DNA, 19 bp, Homo sapiens
gtaatttcgccttaaactc

SEQ ID NO: 839079 - DNA, 13 bp, Homo sapiens
gtaatttgaattg

SEQ ID NO: 839080 - DNA, 23 bp, Homo sapiens
gtaatttgagagaaatatgaaga

SEQ ID NO: 839081 - DNA, 14 bp, Homo sapiens
gtaatttgtaaagt

SEQ ID NO: 839082 - DNA, 17 bp, Homo sapiens
gtaatttgtacaggggc

SEQ ID NO: 839083 - DNA, 19 bp, Homo sapiens
gtaatttgtacaggggcca

SEQ ID NO: 839084 - DNA, 21 bp, Homo sapiens
gtaatttgtacaggggccatg

SEQ ID NO: 839085 - DNA, 22 bp, Homo sapiens
gtaattttacacgcttttgtga

SEQ ID NO: 839086 - DNA, 18 bp, Homo sapiens
gtaattttatatgaagat

SEQ ID NO: 839087 - DNA, 19 bp, Homo sapiens
gtacaaaaaaaaagtttta

SEQ ID NO: 839088 - DNA, 22 bp, Homo sapiens
gtacaaaactgtaaataaaatg

SEQ ID NO: 839089 - DNA, 20 bp, Homo sapiens
gtacaaaatccagctatgaa

SEQ ID NO: 839090 - DNA, 23 bp, Homo sapiens
gtacaaaattgcctataatactt

SEQ ID NO: 839091 - DNA, 22 bp, Homo sapiens
gtacaaatataagaataaaatg

SEQ ID NO: 839092 - DNA, 18 bp, Homo sapiens
gtacaaatgtaagcaaag

SEQ ID NO: 839093 - DNA, 11 bp, Homo sapiens
gtacaaccctg

SEQ ID NO: 839094 - DNA, 16 bp, Homo sapiens
gtacaaggtaattgtt

SEQ ID NO: 839095 - DNA, 16 bp, Homo sapiens
gtacaagttttgtata

SEQ ID NO: 839096 - DNA, 13 bp, Homo sapiens
gtacaatacaatg

SEQ ID NO: 839097 - DNA, 14 bp, Homo sapiens
gtacaatacaatgt

SEQ ID NO: 839098 - DNA, 15 bp, Homo sapiens
gtacaatacaatgta

SEQ ID NO: 839099 - DNA, 18 bp, Homo sapiens
gtacaatacaatgtacaa

SEQ ID NO: 839100 - DNA, 21 bp, Homo sapiens
gtacaatacaatgtacaatta

SEQ ID NO: 839101 - DNA, 14 bp, Homo sapiens
gtacaatctcaaat

SEQ ID NO: 839102 - DNA, 14 bp, Homo sapiens
gtacaatggtttat

SEQ ID NO: 839103 - DNA, 20 bp, Homo sapiens
gtacaatggtttattcccaa

SEQ ID NO: 839104 - DNA, 21 bp, Homo sapiens
gtacaatggtttattcccaag

SEQ ID NO: 839105 - DNA, 23 bp, Homo sapiens
gtacaatggtttattcccaagta

SEQ ID NO: 839106 - DNA, 17 bp, Homo sapiens
gtacaattatgtctctt

SEQ ID NO: 839107 - DNA, 15 bp, Homo sapiens
gtacaattgatcttt

SEQ ID NO: 839108 - DNA, 18 bp, Homo sapiens
gtacaattttaaagttct

SEQ ID NO: 839109 - DNA, 23 bp, Homo sapiens
gtacaattttaaagttcttattt

SEQ ID NO: 839110 - DNA, 24 bp, Homo sapiens
gtacacacccgcctgacaccgtgg

SEQ ID NO: 839111 - DNA, 18 bp, Homo sapiens
gtacacagcaccagaatg

SEQ ID NO: 839112 - DNA, 14 bp, Homo sapiens
gtacacataagcca

SEQ ID NO: 839113 - DNA, 23 bp, Homo sapiens
gtacacatctattctcaaagcta

SEQ ID NO: 839114 - DNA, 15 bp, Homo sapiens
gtacacctgcggggc

SEQ ID NO: 839115 - DNA, 22 bp, Homo sapiens
gtacacggaccatcgcctctgt

SEQ ID NO: 839116 - DNA, 14 bp, Homo sapiens
gtacacgtgtaaca

SEQ ID NO: 839117 - DNA, 19 bp, Homo sapiens
gtacactgtttcaaacttt

SEQ ID NO: 839118 - DNA, 20 bp, Homo sapiens
gtacactgtttcaaacttta

SEQ ID NO: 839119 - DNA, 22 bp, Homo sapiens
gtacacttctcttaagtggtct

SEQ ID NO: 839120 - DNA, 18 bp, Homo sapiens
gtacacttggtgtactgg

SEQ ID NO: 839121 - DNA, 14 bp, Homo sapiens
gtacagaaaacatg

SEQ ID NO: 839122 - DNA, 14 bp, Homo sapiens
gtacagaaagctgc

SEQ ID NO: 839123 - DNA, 13 bp, Homo sapiens
gtacagaatagaa

SEQ ID NO: 839124 - DNA, 23 bp, Homo sapiens
gtacagaatgctatttcacttga

SEQ ID NO: 839125 - DNA, 20 bp, Homo sapiens
gtacagaattctgctacctc

SEQ ID NO: 839126 - DNA, 16 bp, Homo sapiens
gtacagacatatttaa

SEQ ID NO: 839127 - DNA, 17 bp, Homo sapiens
gtacagacatatttaac

SEQ ID NO: 839128 - DNA, 19 bp, Homo sapiens
gtacagaccgagaggccag

SEQ ID NO: 839129 - DNA, 20 bp, Homo sapiens
gtacagaccgagaggccagt

SEQ ID NO: 839130 - DNA, 20 bp, Homo sapiens
gtacagagctttcttttgta

SEQ ID NO: 839131 - DNA, 19 bp, Homo sapiens
gtacagagtggaataagac

SEQ ID NO: 839132 - DNA, 22 bp, Homo sapiens
gtacagagtggcccctcacctg

SEQ ID NO: 839133 - DNA, 12 bp, Homo sapiens
gtacagatcaag

SEQ ID NO: 839134 - DNA, 20 bp, Homo sapiens
gtacagattgctgcttctgc

SEQ ID NO: 839135 - DNA, 14 bp, Homo sapiens
gtacagattttatt

SEQ ID NO: 839136 - DNA, 12 bp, Homo sapiens
gtacagcagggt

SEQ ID NO: 839137 - DNA, 15 bp, Homo sapiens
gtacagcatgtgcct

SEQ ID NO: 839138 - DNA, 21 bp, Homo sapiens
gtacagcgcggaggaggaggg

SEQ ID NO: 839139 - DNA, 14 bp, Homo sapiens
gtacagcgggctgt

SEQ ID NO: 839140 - DNA, 20 bp, Homo sapiens
gtacaggaaggtgcctggcc

SEQ ID NO: 839141 - DNA, 15 bp, Homo sapiens
gtacaggacatatat

SEQ ID NO: 839142 - DNA, 23 bp, Homo sapiens
gtacaggacatatattttttaaa

SEQ ID NO: 839143 - DNA, 14 bp, Homo sapiens
gtacaggagaggca

SEQ ID NO: 839144 - DNA, 19 bp, Homo sapiens
gtacaggagaggcagcatg

SEQ ID NO: 839145 - DNA, 20 bp, Homo sapiens
gtacaggcagttaggtgctg

SEQ ID NO: 839146 - DNA, 15 bp, Homo sapiens
gtacagtattctttt

SEQ ID NO: 839147 - DNA, 15 bp, Homo sapiens
gtacagtgaggaggg

SEQ ID NO: 839148 - DNA, 20 bp, Homo sapiens
gtacagttatctaagttaat

SEQ ID NO: 839149 - DNA, 15 bp, Homo sapiens
gtacagtttctgctt

SEQ ID NO: 839150 - DNA, 16 bp, Homo sapiens
gtacagtttctgcttg

SEQ ID NO: 839151 - DNA, 16 bp, Homo sapiens
gtacataactctgtaa

SEQ ID NO: 839152 - DNA, 14 bp, Homo sapiens
gtacataactgaaa

SEQ ID NO: 839153 - DNA, 22 bp, Homo sapiens
gtacataattgattaaaatctc

SEQ ID NO: 839154 - DNA, 16 bp, Homo sapiens
gtacatactggcctct

SEQ ID NO: 839155 - DNA, 18 bp, Homo sapiens
gtacatactggcctctgt

SEQ ID NO: 839156 - DNA, 17 bp, Homo sapiens
gtacataggcttctatt

SEQ ID NO: 839157 - DNA, 21 bp, Homo sapiens
gtacatagtaggcactaaata

SEQ ID NO: 839158 - DNA, 17 bp, Homo sapiens
gtacatagtctgttcct

SEQ ID NO: 839159 - DNA, 16 bp, Homo sapiens
gtacatatgtgctgga

SEQ ID NO: 839160 - DNA, 13 bp, Homo sapiens
gtacatattgtta

SEQ ID NO: 839161 - DNA, 23 bp, Homo sapiens
gtacatattgttagggtcagcca

SEQ ID NO: 839162 - DNA, 20 bp, Homo sapiens
gtacatatttgtggaataat

SEQ ID NO: 839163 - DNA, 18 bp, Homo sapiens
gtacatcgtttacttttt

SEQ ID NO: 839164 - DNA, 19 bp, Homo sapiens
gtacatcgtttacttttta

SEQ ID NO: 839165 - DNA, 15 bp, Homo sapiens
gtacatctgcaatat

SEQ ID NO: 839166 - DNA, 20 bp, Homo sapiens
gtacttcccgggccagggct

SEQ ID NO: 839167 - DNA, 14 bp, Homo sapiens
gtacttcctcctga

SEQ ID NO: 839168 - DNA, 18 bp, Homo sapiens
gtacttcctcctgatggc

SEQ ID NO: 839169 - DNA, 20 bp, Homo sapiens
gtacttcctcctgatggcca

SEQ ID NO: 839170 - DNA, 15 bp, Homo sapiens
gtacttcctttctcc

SEQ ID NO: 839171 - DNA, 15 bp, Homo sapiens
gtacttctctgtgtg

SEQ ID NO: 839172 - DNA, 12 bp, Homo sapiens
gtacttctgtgt

SEQ ID NO: 839173 - DNA, 13 bp, Homo sapiens
gtacttctgtgtt

SEQ ID NO: 839174 - DNA, 15 bp, Homo sapiens
gtacttgaaggatgg

SEQ ID NO: 839175 - DNA, 21 bp, Homo sapiens
gtacttgaccgtttttatatt

SEQ ID NO: 839176 - DNA, 13 bp, Homo sapiens
gtacttgatttga

SEQ ID NO: 839177 - DNA, 22 bp, Homo sapiens
gtacttgccctgaccatgcatt

SEQ ID NO: 839178 - DNA, 18 bp, Homo sapiens
gtacttggagggctcagg

SEQ ID NO: 839179 - DNA, 21 bp, Homo sapiens
gtacttggagtattggggtct

SEQ ID NO: 839180 - DNA, 16 bp, Homo sapiens
gtacttgtcaaagaag

SEQ ID NO: 839181 - DNA, 23 bp, Homo sapiens
gtacttgtcctcagcttgggctt

SEQ ID NO: 839182 - DNA, 15 bp, Homo sapiens
gtacttgtgtttgct

SEQ ID NO: 839183 - DNA, 17 bp, Homo sapiens
gtacttgtgtttgctta

SEQ ID NO: 839184 - DNA, 12 bp, Homo sapiens
gtacttgtttgc

SEQ ID NO: 839185 - DNA, 17 bp, Homo sapiens
gtactttatatcttgtt

SEQ ID NO: 839186 - DNA, 20 bp, Homo sapiens
gtactttatatcttgtttac

SEQ ID NO: 839187 - DNA, 20 bp, Homo sapiens
gtactttatcatgaatgctt

SEQ ID NO: 839188 - DNA, 16 bp, Homo sapiens
gtactttattgtacag

SEQ ID NO: 839189 - DNA, 19 bp, Homo sapiens
gtactttatttttctgata

SEQ ID NO: 839190 - DNA, 22 bp, Homo sapiens
gtactttcatattttaaacaga

SEQ ID NO: 839191 - DNA, 22 bp, Homo sapiens
gtacttttatgatgtatattta

SEQ ID NO: 839192 - DNA, 16 bp, Homo sapiens
gtacttttcattctct

SEQ ID NO: 839193 - DNA, 21 bp, Homo sapiens
gtacttttcattctcttttaa

SEQ ID NO: 839194 - DNA, 11 bp, Homo sapiens
gtacttttctg

SEQ ID NO: 839195 - DNA, 17 bp, Homo sapiens
gtacttttctggttcca

SEQ ID NO: 839196 - DNA, 19 bp, Homo sapiens
gtacttttctggttccaaa

SEQ ID NO: 839197 - DNA, 12 bp, Homo sapiens
gtagaaaaattt

SEQ ID NO: 839198 - DNA, 16 bp, Homo sapiens
gtagaaaagaaaacat

SEQ ID NO: 839199 - DNA, 18 bp, Homo sapiens
gtagaaaagaaaacattt

SEQ ID NO: 839200 - DNA, 15 bp, Homo sapiens
gtagaaaagagactt

SEQ ID NO: 839201 - DNA, 20 bp, Homo sapiens
gtagaaaagagacttctctg

SEQ ID NO: 839202 - DNA, 15 bp, Homo sapiens
gtagaaaatgtgacc

SEQ ID NO: 839203 - DNA, 17 bp, Homo sapiens
gtagaaaatgtgaccct

SEQ ID NO: 839204 - DNA, 21 bp, Homo sapiens
gtagaaactggaagctgttca

SEQ ID NO: 839205 - DNA, 18 bp, Homo sapiens
gtagaaagacatctgcct

SEQ ID NO: 839206 - DNA, 19 bp, Homo sapiens
gtagaaatgccagaaacag

SEQ ID NO: 839207 - DNA, 18 bp, Homo sapiens
gtagaacgtaaccacgga

SEQ ID NO: 839208 - DNA, 20 bp, Homo sapiens
gtagaactcactctgggctg

SEQ ID NO: 839209 - DNA, 15 bp, Homo sapiens
gtagaactcagcagt

SEQ ID NO: 839210 - DNA, 17 bp, Homo sapiens
gtagaactccaggccct

SEQ ID NO: 839211 - DNA, 16 bp, Homo sapiens
gtagaactgtctgtga

SEQ ID NO: 839212 - DNA, 12 bp, Homo sapiens
gtagaagatggc

SEQ ID NO: 839213 - DNA, 21 bp, Homo sapiens
gtagaagtcttagatgtatat

SEQ ID NO: 839214 - DNA, 16 bp, Homo sapiens
gtagaatgtaaagctt

SEQ ID NO: 839215 - DNA, 22 bp, Homo sapiens
gtagaattatctaatttataaa

SEQ ID NO: 839216 - DNA, 17 bp, Homo sapiens
gtagaattgaaaatgca

SEQ ID NO: 839217 - DNA, 15 bp, Homo sapiens
gtagaattgcattga

SEQ ID NO: 839218 - DNA, 19 bp, Homo sapiens
gtagaatttttaaaaaagt

SEQ ID NO: 839219 - DNA, 18 bp, Homo sapiens
gtagacacgctcttctat

SEQ ID NO: 839220 - DNA, 20 bp, Homo sapiens
gtagacctagggaggacctt

SEQ ID NO: 839221 - DNA, 15 bp, Homo sapiens
gtagacctctttttc

SEQ ID NO: 839222 - DNA, 19 bp, Homo sapiens
gtagaccttgagggtgggc

SEQ ID NO: 839223 - DNA, 23 bp, Homo sapiens
gtagaccttgagggtgggccagc

SEQ ID NO: 839224 - DNA, 21 bp, Homo sapiens
gtagaccttgttacttctgag

SEQ ID NO: 839225 - DNA, 13 bp, Homo sapiens
gtagacgatatac

SEQ ID NO: 839226 - DNA, 13 bp, Homo sapiens
gtagactagtgcc

SEQ ID NO: 839227 - DNA, 18 bp, Homo sapiens
gtagactctaagatacac

SEQ ID NO: 839228 - DNA, 13 bp, Homo sapiens
gtagactttgctt

SEQ ID NO: 839229 - DNA, 21 bp, Homo sapiens
gtagagaatgtgtgtagatac

SEQ ID NO: 839230 - DNA, 18 bp, Homo sapiens
gtagagacggggtttctc

SEQ ID NO: 839231 - DNA, 19 bp, Homo sapiens
gtagagagagctgtattaa

SEQ ID NO: 839232 - DNA, 12 bp, Homo sapiens
gtagagccctca

SEQ ID NO: 839233 - DNA, 15 bp, Homo sapiens
gtagagccctcagaa

SEQ ID NO: 839234 - DNA, 18 bp, Homo sapiens
gtagagctagctgccact

SEQ ID NO: 839235 - DNA, 14 bp, Homo sapiens
gtagaggttttgtt

SEQ ID NO: 839236 - DNA, 15 bp, Homo sapiens
gtagagtcatctcca

SEQ ID NO: 839237 - DNA, 22 bp, Homo sapiens
gtagagtcttacaatcaaatct

SEQ ID NO: 839238 - DNA, 13 bp, Homo sapiens
gtagagtgggagc

SEQ ID NO: 839239 - DNA, 14 bp, Homo sapiens
gtagagttgctgag

SEQ ID NO: 839240 - DNA, 23 bp, Homo sapiens
gtagagttgctgagagggctcga

SEQ ID NO: 839241 - DNA, 15 bp, Homo sapiens
gtagataaatatttg

SEQ ID NO: 839242 - DNA, 16 bp, Homo sapiens
gtagataatttcaggg

SEQ ID NO: 839243 - DNA, 17 bp, Homo sapiens
gtagataatttcagggt

SEQ ID NO: 839244 - DNA, 18 bp, Homo sapiens
gtagataatttcagggtg

SEQ ID NO: 839245 - DNA, 16 bp, Homo sapiens
gtagatactaaagcaa

SEQ ID NO: 839246 - DNA, 13 bp, Homo sapiens
gtagatcaggttt

SEQ ID NO: 839247 - DNA, 15 bp, Homo sapiens
gtagatcctgagatg

SEQ ID NO: 839248 - DNA, 18 bp, Homo sapiens
gtagatcttcaatttgga

SEQ ID NO: 839249 - DNA, 17 bp, Homo sapiens
gtagatgtatgcacaca

SEQ ID NO: 839250 - DNA, 14 bp, Homo sapiens
gtagattaaaaatt

SEQ ID NO: 839251 - DNA, 19 bp, Homo sapiens
gtagattctgtggaacaag

SEQ ID NO: 839252 - DNA, 13 bp, Homo sapiens
gtagattgcagaa

SEQ ID NO: 839253 - DNA, 21 bp, Homo sapiens
gtagatttatttcatcatatt

SEQ ID NO: 839254 - DNA, 13 bp, Homo sapiens
gtagatttctctt

SEQ ID NO: 839255 - DNA, 16 bp, Homo sapiens
gtagatttttaacaaa

SEQ ID NO: 839256 - DNA, 19 bp, Homo sapiens
gtagatttttaacaaaaaa

SEQ ID NO: 839257 - DNA, 13 bp, Homo sapiens
gtagcaagatgca

SEQ ID NO: 839258 - DNA, 21 bp, Homo sapiens
gtagcaatggccagagcctct

SEQ ID NO: 839259 - DNA, 22 bp, Homo sapiens
gtagcaatggccagagcctctg

SEQ ID NO: 839260 - DNA, 23 bp, Homo sapiens
gtagcaatggccagagcctctgg

SEQ ID NO: 839261 - DNA, 22 bp, Homo sapiens
gtagcacagattttgaatctgt

SEQ ID NO: 839262 - DNA, 12 bp, Homo sapiens
gtagcactgagg

SEQ ID NO: 839263 - DNA, 13 bp, Homo sapiens
gtagcacttactg

SEQ ID NO: 839264 - DNA, 15 bp, Homo sapiens
gtagcagagttaaat

SEQ ID NO: 839265 - DNA, 16 bp, Homo sapiens
gtagcagcaggctcag

SEQ ID NO: 839266 - DNA, 21 bp, Homo sapiens
gtagcataaataaaactgaat

SEQ ID NO: 839267 - DNA, 14 bp, Homo sapiens
gtagcataactgta

SEQ ID NO: 839268 - DNA, 15 bp, Homo sapiens
gtagcataactgtag

SEQ ID NO: 839269 - DNA, 14 bp, Homo sapiens
gtagcatcttcctc

SEQ ID NO: 839270 - DNA, 20 bp, Homo sapiens
gtagcattgttccacacatt

SEQ ID NO: 839271 - DNA, 14 bp, Homo sapiens
gtagcattttcctg

SEQ ID NO: 839272 - DNA, 15 bp, Homo sapiens
gtagcattttcctgt

SEQ ID NO: 839273 - DNA, 12 bp, Homo sapiens
gtagccacagct

SEQ ID NO: 839274 - DNA, 15 bp, Homo sapiens
gtagccagcacacag

SEQ ID NO: 839275 - DNA, 21 bp, Homo sapiens
gtagccagcacacagggcagt

SEQ ID NO: 839276 - DNA, 14 bp, Homo sapiens
gtagccagctgtgc

SEQ ID NO: 839277 - DNA, 22 bp, Homo sapiens
gtagccaggtactgcattctct

SEQ ID NO: 839278 - DNA, 22 bp, Homo sapiens
gtagccatgatttgtcccagcc

SEQ ID NO: 839279 - DNA, 14 bp, Homo sapiens
gtagccatggctgg

SEQ ID NO: 839280 - DNA, 14 bp, Homo sapiens
gtagccctcccact

SEQ ID NO: 839281 - DNA, 15 bp, Homo sapiens
gtagccctcccactt

SEQ ID NO: 839282 - DNA, 17 bp, Homo sapiens
gtagccctcccactttg

SEQ ID NO: 839283 - DNA, 22 bp, Homo sapiens
gtagccctgggtttaatgtcaa

SEQ ID NO: 839284 - DNA, 19 bp, Homo sapiens
gtagccgagagcctgctcc

SEQ ID NO: 839285 - DNA, 21 bp, Homo sapiens
gtagcctcaatcgagtgagac

SEQ ID NO: 839286 - DNA, 22 bp, Homo sapiens
gtagcctcaatcgagtgagaca

SEQ ID NO: 839287 - DNA, 19 bp, Homo sapiens
gtagcctccgtttatgggc

SEQ ID NO: 839288 - DNA, 18 bp, Homo sapiens
gtatcaagtatagaaaat

SEQ ID NO: 839289 - DNA, 19 bp, Homo sapiens
gtatcaagtggcatgtgct

SEQ ID NO: 839290 - DNA, 15 bp, Homo sapiens
gtatcacgatttgca

SEQ ID NO: 839291 - DNA, 20 bp, Homo sapiens
gtatcactttaactcaggag

SEQ ID NO: 839292 - DNA, 20 bp, Homo sapiens
gtatcagaatacttgcactc

SEQ ID NO: 839293 - DNA, 22 bp, Homo sapiens
gtatcagagatgtccattttta

SEQ ID NO: 839294 - DNA, 17 bp, Homo sapiens
gtatcagccagccttcc

SEQ ID NO: 839295 - DNA, 16 bp, Homo sapiens
gtatcagctctctgct

SEQ ID NO: 839296 - DNA, 14 bp, Homo sapiens
gtatcaggacccag

SEQ ID NO: 839297 - DNA, 21 bp, Homo sapiens
gtatcaggacccagaggaagg

SEQ ID NO: 839298 - DNA, 22 bp, Homo sapiens
gtatcaggacccagaggaaggg

SEQ ID NO: 839299 - DNA, 15 bp, Homo sapiens
gtatcaggtctccca

SEQ ID NO: 839300 - DNA, 15 bp, Homo sapiens
gtatcatagaaatgt

SEQ ID NO: 839301 - DNA, 13 bp, Homo sapiens
gtatcatctccat

SEQ ID NO: 839302 - DNA, 11 bp, Homo sapiens
gtatcatgcat

SEQ ID NO: 839303 - DNA, 14 bp, Homo sapiens
gtatcattaaaata

SEQ ID NO: 839304 - DNA, 16 bp, Homo sapiens
gtatcattcaactctc

SEQ ID NO: 839305 - DNA, 16 bp, Homo sapiens
gtatcatttttgtgca

SEQ ID NO: 839306 - DNA, 20 bp, Homo sapiens
gtatccaaaaatagccctgc

SEQ ID NO: 839307 - DNA, 19 bp, Homo sapiens
gtatccaaccaacttggtt

SEQ ID NO: 839308 - DNA, 21 bp, Homo sapiens
gtatccaaggaaacattttat

SEQ ID NO: 839309 - DNA, 14 bp, Homo sapiens
gtatccaatgtctt

SEQ ID NO: 839310 - DNA, 14 bp, Homo sapiens
gtatccactttgca

SEQ ID NO: 839311 - DNA, 20 bp, Homo sapiens
gtatcccaaatctgtcagca

SEQ ID NO: 839312 - DNA, 19 bp, Homo sapiens
gtatcccaactcctataat

SEQ ID NO: 839313 - DNA, 17 bp, Homo sapiens
gtatcccagacccctct

SEQ ID NO: 839314 - DNA, 14 bp, Homo sapiens
gtatccccccatct

SEQ ID NO: 839315 - DNA, 20 bp, Homo sapiens
gtatcccccccctgtatagt

SEQ ID NO: 839316 - DNA, 16 bp, Homo sapiens
gtatcccctgcctcct

SEQ ID NO: 839317 - DNA, 18 bp, Homo sapiens
gtatcccctgcctcctgc

SEQ ID NO: 839318 - DNA, 18 bp, Homo sapiens
gtatcccgagtctgggac

SEQ ID NO: 839319 - DNA, 20 bp, Homo sapiens
gtatcccgagtctgggacac

SEQ ID NO: 839320 - DNA, 15 bp, Homo sapiens
gtatccctactgtaa

SEQ ID NO: 839321 - DNA, 13 bp, Homo sapiens
gtatcctaaactt

SEQ ID NO: 839322 - DNA, 14 bp, Homo sapiens
gtatcctccctgcc

SEQ ID NO: 839323 - DNA, 18 bp, Homo sapiens
gtatcctccctggcagac

SEQ ID NO: 839324 - DNA, 19 bp, Homo sapiens
gtatcctccctggcagaca

SEQ ID NO: 839325 - DNA, 20 bp, Homo sapiens
gtatcctccctggcagacac

SEQ ID NO: 839326 - DNA, 20 bp, Homo sapiens
gtatcctgataaacattaaa

SEQ ID NO: 839327 - DNA, 23 bp, Homo sapiens
gtatcctggaacaatattttatg

SEQ ID NO: 839328 - DNA, 18 bp, Homo sapiens
gtatcctggccctggggg

SEQ ID NO: 839329 - DNA, 13 bp, Homo sapiens
gtatcctggggct

SEQ ID NO: 839330 - DNA, 20 bp, Homo sapiens
gtatcctgtgacatgtaaca

SEQ ID NO: 839331 - DNA, 19 bp, Homo sapiens
gtatccttaaccaccgcat

SEQ ID NO: 839332 - DNA, 15 bp, Homo sapiens
gtatcggagacagtg

SEQ ID NO: 839333 - DNA, 17 bp, Homo sapiens
gtatcggagacagtgat

SEQ ID NO: 839334 - DNA, 14 bp, Homo sapiens
gtatctacaataca

SEQ ID NO: 839335 - DNA, 18 bp, Homo sapiens
gtatctacagtaatgaaa

SEQ ID NO: 839336 - DNA, 23 bp, Homo sapiens
gtatctagaaagagatcacccac

SEQ ID NO: 839337 - DNA, 24 bp, Homo sapiens
gtatctagcaatcacaacactggc

SEQ ID NO: 839338 - DNA, 15 bp, Homo sapiens
gtatctagtgcagct

SEQ ID NO: 839339 - DNA, 16 bp, Homo sapiens
gtatctagtgcagctg

SEQ ID NO: 839340 - DNA, 18 bp, Homo sapiens
gtatctatgcaaagcact

SEQ ID NO: 839341 - DNA, 16 bp, Homo sapiens
gtatctatttgtacaa

SEQ ID NO: 839342 - DNA, 13 bp, Homo sapiens
gtatctcagaaag

SEQ ID NO: 839343 - DNA, 14 bp, Homo sapiens
gtatctccaggatt

SEQ ID NO: 839344 - DNA, 15 bp, Homo sapiens
gtatctccctggaga

SEQ ID NO: 839345 - DNA, 19 bp, Homo sapiens
gtatctctgaagcatgttt

SEQ ID NO: 839346 - DNA, 19 bp, Homo sapiens
gtatctcttacatcagtag

SEQ ID NO: 839347 - DNA, 20 bp, Homo sapiens
gtatctcttggtatgcatct

SEQ ID NO: 839348 - DNA, 20 bp, Homo sapiens
gtatctctttcacattgttt

SEQ ID NO: 839349 - DNA, 12 bp, Homo sapiens
gtatctgagcag

SEQ ID NO: 839350 - DNA, 14 bp, Homo sapiens
gtatctgagttgcc

SEQ ID NO: 839351 - DNA, 15 bp, Homo sapiens
gtatctgagttgcca

SEQ ID NO: 839352 - DNA, 18 bp, Homo sapiens
gtatctgagttgccaaga

SEQ ID NO: 839353 - DNA, 16 bp, Homo sapiens
gtatctgcaggcagac

SEQ ID NO: 839354 - DNA, 17 bp, Homo sapiens
gtatctgggattattct

SEQ ID NO: 839355 - DNA, 18 bp, Homo sapiens
gtatctgggattattctt

SEQ ID NO: 839356 - DNA, 21 bp, Homo sapiens
gtatctgtatataagttgctg

SEQ ID NO: 839357 - DNA, 19 bp, Homo sapiens
gtatctgtcacaataaatg

SEQ ID NO: 839358 - DNA, 21 bp, Homo sapiens
gtatctgtcacaataaatggc

SEQ ID NO: 839359 - DNA, 15 bp, Homo sapiens
gtatctgtctttcca

SEQ ID NO: 839360 - DNA, 22 bp, Homo sapiens
gtatctgtctttccactctgga

SEQ ID NO: 839361 - DNA, 23 bp, Homo sapiens
gtatctgtctttccactctggat

SEQ ID NO: 839362 - DNA, 12 bp, Homo sapiens
gtatctgtggga

SEQ ID NO: 839363 - DNA, 22 bp, Homo sapiens
gtatcttaatatatacattttt

SEQ ID NO: 839364 - DNA, 15 bp, Homo sapiens
gtatcttagagttta

SEQ ID NO: 839365 - DNA, 19 bp, Homo sapiens
gtatcttagagtttacagt

SEQ ID NO: 839366 - DNA, 11 bp, Homo sapiens
gtatcttcctt

SEQ ID NO: 839367 - DNA, 17 bp, Homo sapiens
gtatcttctatttttat

SEQ ID NO: 839368 - DNA, 22 bp, Homo sapiens
gtatcttgggtgtattctctgt

SEQ ID NO: 839369 - DNA, 13 bp, Homo sapiens
gtatctttaacaa

SEQ ID NO: 839370 - DNA, 13 bp, Homo sapiens
gtatctttattaa

SEQ ID NO: 839371 - DNA, 15 bp, Homo sapiens
gtatctttattaaaa

SEQ ID NO: 839372 - DNA, 14 bp, Homo sapiens
gtatcttttctttc

SEQ ID NO: 839373 - DNA, 22 bp, Homo sapiens
gtatgaaagatggctgtgcctc

SEQ ID NO: 839374 - DNA, 19 bp, Homo sapiens
gtatgaagagcttgctttg

SEQ ID NO: 839375 - DNA, 18 bp, Homo sapiens
gtatgaaggaatcattcc

SEQ ID NO: 839376 - DNA, 18 bp, Homo sapiens
gtatgaataaagacacct

SEQ ID NO: 839377 - DNA, 21 bp, Homo sapiens
gtatgaatctatgccaaagat

SEQ ID NO: 839378 - DNA, 17 bp, Homo sapiens
gtatgaatgatatcttt

SEQ ID NO: 839379 - DNA, 15 bp, Homo sapiens
gtatgaatgcagtgg

SEQ ID NO: 839380 - DNA, 18 bp, Homo sapiens
gtatgaattattcaattt

SEQ ID NO: 839381 - DNA, 14 bp, Homo sapiens
gtatgaatttgagc

SEQ ID NO: 839382 - DNA, 19 bp, Homo sapiens
gtatgacataggccaaggc

SEQ ID NO: 839383 - DNA, 20 bp, Homo sapiens
gtatgaggcatttgtttgaa

SEQ ID NO: 839384 - DNA, 17 bp, Homo sapiens
gtatgaggtcctcaggt

SEQ ID NO: 839385 - DNA, 22 bp, Homo sapiens
gtatgaggtcctcaggtcagct

SEQ ID NO: 839386 - DNA, 20 bp, Homo sapiens
gtatgagttgcatttgtaaa

SEQ ID NO: 839387 - DNA, 15 bp, Homo sapiens
gtatgatactaaaga

SEQ ID NO: 839388 - DNA, 17 bp, Homo sapiens
gtatgatgtgttgtgat

SEQ ID NO: 839389 - DNA, 16 bp, Homo sapiens
gtatgcaaaataaaga

SEQ ID NO: 839390 - DNA, 18 bp, Homo sapiens
gtatgcatcagataacaa

SEQ ID NO: 839391 - DNA, 15 bp, Homo sapiens
gtatgcatgtgaaga

SEQ ID NO: 839392 - DNA, 18 bp, Homo sapiens
gtatgcatgtgaagaaag

SEQ ID NO: 839393 - DNA, 16 bp, Homo sapiens
gtatgcattattaaat

SEQ ID NO: 839394 - DNA, 18 bp, Homo sapiens
gtatgcattattaaattg

SEQ ID NO: 839395 - DNA, 17 bp, Homo sapiens
gtatgccacacctggcc

SEQ ID NO: 839396 - DNA, 20 bp, Homo sapiens
gtatgccaccaacttacaaa

SEQ ID NO: 839397 - DNA, 22 bp, Homo sapiens
gtatgcgaaaaggtttttagga

SEQ ID NO: 839398 - DNA, 13 bp, Homo sapiens
gtatgctctgtga

SEQ ID NO: 839399 - DNA, 13 bp, Homo sapiens
gtatgctgatcat

SEQ ID NO: 839400 - DNA, 21 bp, Homo sapiens
gtatgctgatcatcgccagag

SEQ ID NO: 839401 - DNA, 13 bp, Homo sapiens
gtatgctggccag

SEQ ID NO: 839402 - DNA, 14 bp, Homo sapiens
gtatgctggccagc

SEQ ID NO: 839403 - DNA, 15 bp, Homo sapiens
gtatgctggccagca

SEQ ID NO: 839404 - DNA, 20 bp, Homo sapiens
gtatgctggccagcaccctc

SEQ ID NO: 839405 - DNA, 17 bp, Homo sapiens
gtatggaatacagtgtt

SEQ ID NO: 839406 - DNA, 15 bp, Homo sapiens
gtatggaatattcat

SEQ ID NO: 839407 - DNA, 14 bp, Homo sapiens
gtatggccatgccc

SEQ ID NO: 839408 - DNA, 17 bp, Homo sapiens
gtatggccatgccctag

SEQ ID NO: 839409 - DNA, 23 bp, Homo sapiens
gtatggcccaggcagcctcaagg

SEQ ID NO: 839410 - DNA, 17 bp, Homo sapiens
gtattgtaaacatgtgt

SEQ ID NO: 839411 - DNA, 13 bp, Homo sapiens
gtattgtaaatta

SEQ ID NO: 839412 - DNA, 14 bp, Homo sapiens
gtattgtcagccat

SEQ ID NO: 839413 - DNA, 17 bp, Homo sapiens
gtattgtctactctgaa

SEQ ID NO: 839414 - DNA, 17 bp, Homo sapiens
gtattgtctgaacttgc

SEQ ID NO: 839415 - DNA, 20 bp, Homo sapiens
gtattgttgtccttttcata

SEQ ID NO: 839416 - DNA, 13 bp, Homo sapiens
gtatttaaaaaca

SEQ ID NO: 839417 - DNA, 22 bp, Homo sapiens
gtatttaaactatcttgtgtga

SEQ ID NO: 839418 - DNA, 14 bp, Homo sapiens
gtatttaaatgttc

SEQ ID NO: 839419 - DNA, 21 bp, Homo sapiens
gtatttaacagaaattgtata

SEQ ID NO: 839420 - DNA, 13 bp, Homo sapiens
gtatttaagactg

SEQ ID NO: 839421 - DNA, 17 bp, Homo sapiens
gtatttaagatgtacat

SEQ ID NO: 839422 - DNA, 21 bp, Homo sapiens
gtatttaagatgtacatttaa

SEQ ID NO: 839423 - DNA, 22 bp, Homo sapiens
gtatttaagatgtacatttaat

SEQ ID NO: 839424 - DNA, 17 bp, Homo sapiens
gtatttaaggaatcaaa

SEQ ID NO: 839425 - DNA, 14 bp, Homo sapiens
gtatttagaagcca

SEQ ID NO: 839426 - DNA, 13 bp, Homo sapiens
gtatttataaaaa

SEQ ID NO: 839427 - DNA, 21 bp, Homo sapiens
gtatttataaaaatataaatt

SEQ ID NO: 839428 - DNA, 13 bp, Homo sapiens
gtatttataaata

SEQ ID NO: 839429 - DNA, 12 bp, Homo sapiens
gtatttataata

SEQ ID NO: 839430 - DNA, 14 bp, Homo sapiens
gtatttataattta

SEQ ID NO: 839431 - DNA, 18 bp, Homo sapiens
gtatttataatttaaatg

SEQ ID NO: 839432 - DNA, 18 bp, Homo sapiens
gtatttatagtaaccatt

SEQ ID NO: 839433 - DNA, 15 bp, Homo sapiens
gtatttatatattta

SEQ ID NO: 839434 - DNA, 18 bp, Homo sapiens
gtatttatatttggaaag

SEQ ID NO: 839435 - DNA, 13 bp, Homo sapiens
gtatttatcttta

SEQ ID NO: 839436 - DNA, 13 bp, Homo sapiens
gtatttatggatt

SEQ ID NO: 839437 - DNA, 20 bp, Homo sapiens
gtatttatggattaaaaact

SEQ ID NO: 839438 - DNA, 12 bp, Homo sapiens
gtatttatgtaa

SEQ ID NO: 839439 - DNA, 18 bp, Homo sapiens
gtatttatttaaaactct

SEQ ID NO: 839440 - DNA, 19 bp, Homo sapiens
gtatttatttaaaactctg

SEQ ID NO: 839441 - DNA, 20 bp, Homo sapiens
gtatttatttaaaactctgg

SEQ ID NO: 839442 - DNA, 18 bp, Homo sapiens
gtatttattttcctcccc

SEQ ID NO: 839443 - DNA, 19 bp, Homo sapiens
gtatttattttcctcccca

SEQ ID NO: 839444 - DNA, 23 bp, Homo sapiens
gtatttattttcctccccagcag

SEQ ID NO: 839445 - DNA, 14 bp, Homo sapiens
gtatttcagggacc

SEQ ID NO: 839446 - DNA, 14 bp, Homo sapiens
gtatttcagtattt

SEQ ID NO: 839447 - DNA, 15 bp, Homo sapiens
gtatttcatgtggct

SEQ ID NO: 839448 - DNA, 18 bp, Homo sapiens
gtatttcatgtggctgta

SEQ ID NO: 839449 - DNA, 15 bp, Homo sapiens
gtatttcccctgtca

SEQ ID NO: 839450 - DNA, 20 bp, Homo sapiens
gtatttcctgaaataaatgt

SEQ ID NO: 839451 - DNA, 19 bp, Homo sapiens
gtatttccttccactgtag

SEQ ID NO: 839452 - DNA, 17 bp, Homo sapiens
gtatttctatatttatt

SEQ ID NO: 839453 - DNA, 14 bp, Homo sapiens
gtatttctccagac

SEQ ID NO: 839454 - DNA, 15 bp, Homo sapiens
gtatttctccagacc

SEQ ID NO: 839455 - DNA, 16 bp, Homo sapiens
gtatttctcttgtcct

SEQ ID NO: 839456 - DNA, 14 bp, Homo sapiens
gtatttctttctcg

SEQ ID NO: 839457 - DNA, 21 bp, Homo sapiens
gtatttgaaaattacatgttt

SEQ ID NO: 839458 - DNA, 11 bp, Homo sapiens
gtatttgagaa

SEQ ID NO: 839459 - DNA, 19 bp, Homo sapiens
gtatttgattcaaaatatt

SEQ ID NO: 839460 - DNA, 13 bp, Homo sapiens
gtatttgcagttc

SEQ ID NO: 839461 - DNA, 20 bp, Homo sapiens
gtatttggctgggctacaat

SEQ ID NO: 839462 - DNA, 12 bp, Homo sapiens
gtatttgtatta

SEQ ID NO: 839463 - DNA, 14 bp, Homo sapiens
gtatttgtattaat

SEQ ID NO: 839464 - DNA, 18 bp, Homo sapiens
gtatttgtattaataaag

SEQ ID NO: 839465 - DNA, 19 bp, Homo sapiens
gtatttgtattaataaagc

SEQ ID NO: 839466 - DNA, 18 bp, Homo sapiens
gtattttaaaatagcgtt

SEQ ID NO: 839467 - DNA, 17 bp, Homo sapiens
gtattttaagaagacat

SEQ ID NO: 839468 - DNA, 20 bp, Homo sapiens
gtattttaagtgatgtcatt

SEQ ID NO: 839469 - DNA, 12 bp, Homo sapiens
gtattttatctg

SEQ ID NO: 839470 - DNA, 13 bp, Homo sapiens
gtattttccagcc

SEQ ID NO: 839471 - DNA, 23 bp, Homo sapiens
gtattttccagccttatgtgtta

SEQ ID NO: 839472 - DNA, 18 bp, Homo sapiens
gtattttcctggatttat

SEQ ID NO: 839473 - DNA, 19 bp, Homo sapiens
gtattttcctggatttata

SEQ ID NO: 839474 - DNA, 19 bp, Homo sapiens
gtattttcgggattctttg

SEQ ID NO: 839475 - DNA, 13 bp, Homo sapiens
gtattttctttct

SEQ ID NO: 839476 - DNA, 13 bp, Homo sapiens
gtattttgaaatt

SEQ ID NO: 839477 - DNA, 11 bp, Homo sapiens
gtattttgaat

SEQ ID NO: 839478 - DNA, 15 bp, Homo sapiens
gtattttgaatacca

SEQ ID NO: 839479 - DNA, 13 bp, Homo sapiens
gtattttgacact

SEQ ID NO: 839480 - DNA, 18 bp, Homo sapiens
gtattttgtagatgtgat

SEQ ID NO: 839481 - DNA, 15 bp, Homo sapiens
gtattttgtgtcctc

SEQ ID NO: 839482 - DNA, 18 bp, Homo sapiens
gtattttgtgtgaccaac

SEQ ID NO: 839483 - DNA, 22 bp, Homo sapiens
gtattttgtttttgtcttaaaa

SEQ ID NO: 839484 - DNA, 13 bp, Homo sapiens
gtatttttaaagg

SEQ ID NO: 839485 - DNA, 22 bp, Homo sapiens
gtatttttaacacttaaatttc

SEQ ID NO: 839486 - DNA, 11 bp, Homo sapiens
gtatttttagt

SEQ ID NO: 839487 - DNA, 17 bp, Homo sapiens
gtatttttccaatcaca

SEQ ID NO: 839488 - DNA, 14 bp, Homo sapiens
gtatttttcttgct

SEQ ID NO: 839489 - DNA, 21 bp, Homo sapiens
gtattttttacttttcacact

SEQ ID NO: 839490 - DNA, 15 bp, Homo sapiens
gtattttttatttac

SEQ ID NO: 839491 - DNA, 16 bp, Homo sapiens
gtattttttatttaca

SEQ ID NO: 839492 - DNA, 15 bp, Homo sapiens
gtattttttccttaa

SEQ ID NO: 839493 - DNA, 16 bp, Homo sapiens
gtatttttttgcaagt

SEQ ID NO: 839494 - DNA, 16 bp, Homo sapiens
gtatttttttttctaa

SEQ ID NO: 839495 - DNA, 13 bp, Homo sapiens
gtcaaaaaaggaa

SEQ ID NO: 839496 - DNA, 20 bp, Homo sapiens
gtcaaaaaattatttgctat

SEQ ID NO: 839497 - DNA, 13 bp, Homo sapiens
gtcaaaacactgt

SEQ ID NO: 839498 - DNA, 15 bp, Homo sapiens
gtcaaaacactgtgg

SEQ ID NO: 839499 - DNA, 16 bp, Homo sapiens
gtcaaaacactgtgga

SEQ ID NO: 839500 - DNA, 21 bp, Homo sapiens
gtcaaaacactgtggaactaa

SEQ ID NO: 839501 - DNA, 14 bp, Homo sapiens
gtcaaaactttaaa

SEQ ID NO: 839502 - DNA, 18 bp, Homo sapiens
gtcaaaagagccctggct

SEQ ID NO: 839503 - DNA, 21 bp, Homo sapiens
gtcaaaataaaggataactct

SEQ ID NO: 839504 - DNA, 21 bp, Homo sapiens
gtcaaaccgcactcacccatg

SEQ ID NO: 839505 - DNA, 17 bp, Homo sapiens
gtcaaacttggatactt

SEQ ID NO: 839506 - DNA, 24 bp, Homo sapiens
gtcaaactttttccagcaaaatgg

SEQ ID NO: 839507 - DNA, 22 bp, Homo sapiens
gtcaaagaagcttccacaaaat

SEQ ID NO: 839508 - DNA, 19 bp, Homo sapiens
gtcaaagacagaatggtgg

SEQ ID NO: 839509 - DNA, 14 bp, Homo sapiens
gtcaaagtacagaa

SEQ ID NO: 839510 - DNA, 18 bp, Homo sapiens
gtcaaatatcatttactc

SEQ ID NO: 839511 - DNA, 18 bp, Homo sapiens
gtcaaatgaacttttaca

SEQ ID NO: 839512 - DNA, 17 bp, Homo sapiens
gtcaaatgatgtgcaaa

SEQ ID NO: 839513 - DNA, 19 bp, Homo sapiens
gtcaaatgggaaaaaaaca

SEQ ID NO: 839514 - DNA, 22 bp, Homo sapiens
gtcaaatggtaggcatttccta

SEQ ID NO: 839515 - DNA, 20 bp, Homo sapiens
gtcaaatgtttccttaaaca

SEQ ID NO: 839516 - DNA, 15 bp, Homo sapiens
gtcaaattatgtatt

SEQ ID NO: 839517 - DNA, 21 bp, Homo sapiens
gtcaacaagtatgaataaaga

SEQ ID NO: 839518 - DNA, 14 bp, Homo sapiens
gtcaacactcttct

SEQ ID NO: 839519 - DNA, 22 bp, Homo sapiens
gtcaacagagaaggcaggaatg

SEQ ID NO: 839520 - DNA, 23 bp, Homo sapiens
gtcaacagagaaggcaggaatgt

SEQ ID NO: 839521 - DNA, 14 bp, Homo sapiens
gtcaacctcctgga

SEQ ID NO: 839522 - DNA, 15 bp, Homo sapiens
gtcaacctcctggac

SEQ ID NO: 839523 - DNA, 19 bp, Homo sapiens
gtcaacctgggcaaagcct

SEQ ID NO: 839524 - DNA, 14 bp, Homo sapiens
gtcaactacacaaa

SEQ ID NO: 839525 - DNA, 13 bp, Homo sapiens
gtcaactggagca

SEQ ID NO: 839526 - DNA, 17 bp, Homo sapiens
gtcaactggagcaagaa

SEQ ID NO: 839527 - DNA, 19 bp, Homo sapiens
gtcaactggctggccagtc

SEQ ID NO: 839528 - DNA, 12 bp, Homo sapiens
gtcaagacattt

SEQ ID NO: 839529 - DNA, 15 bp, Homo sapiens
gtcaagacatttgct

SEQ ID NO: 839530 - DNA, 19 bp, Homo sapiens
gtcaagagatcgagaccat

SEQ ID NO: 839531 - DNA, 21 bp, Homo sapiens
gtcaagatcaacattccaggg

SEQ ID NO: 839532 - DNA, 16 bp, Homo sapiens
gtcaagcatgtatttt

SEQ ID NO: 839533 - DNA, 11 bp, Homo sapiens
gtcagctgtta

SEQ ID NO: 839534 - DNA, 17 bp, Homo sapiens
gtcagctttcagagcca

SEQ ID NO: 839535 - DNA, 17 bp, Homo sapiens
gtcagctttgccttcca

SEQ ID NO: 839536 - DNA, 18 bp, Homo sapiens
gtcagctttgccttccac

SEQ ID NO: 839537 - DNA, 18 bp, Homo sapiens
gtcagcttttgttgttta

SEQ ID NO: 839538 - DNA, 15 bp, Homo sapiens
gtcaggaacagaagg

SEQ ID NO: 839539 - DNA, 20 bp, Homo sapiens
gtcaggaacagtggctgggt

SEQ ID NO: 839540 - DNA, 20 bp, Homo sapiens
gtcaggaagtaaaataaata

SEQ ID NO: 839541 - DNA, 15 bp, Homo sapiens
gtcaggacggctcct

SEQ ID NO: 839542 - DNA, 19 bp, Homo sapiens
gtcaggacggctcctcaga

SEQ ID NO: 839543 - DNA, 13 bp, Homo sapiens
gtcaggagttcct

SEQ ID NO: 839544 - DNA, 13 bp, Homo sapiens
gtcaggcagggtg

SEQ ID NO: 839545 - DNA, 15 bp, Homo sapiens
gtcaggccaggtggg

SEQ ID NO: 839546 - DNA, 17 bp, Homo sapiens
gtcaggcccgtcggagc

SEQ ID NO: 839547 - DNA, 19 bp, Homo sapiens
gtcaggcccgtcggagctg

SEQ ID NO: 839548 - DNA, 15 bp, Homo sapiens
gtcaggccctctgcc

SEQ ID NO: 839549 - DNA, 17 bp, Homo sapiens
gtcaggccctctgcctg

SEQ ID NO: 839550 - DNA, 19 bp, Homo sapiens
gtcaggccctctgcctgca

SEQ ID NO: 839551 - DNA, 21 bp, Homo sapiens
gtcaggccctctgcctgcact

SEQ ID NO: 839552 - DNA, 21 bp, Homo sapiens
gtcaggcctgggcaggaccct

SEQ ID NO: 839553 - DNA, 15 bp, Homo sapiens
gtcaggcctgtgtgt

SEQ ID NO: 839554 - DNA, 12 bp, Homo sapiens
gtcaggctccat

SEQ ID NO: 839555 - DNA, 17 bp, Homo sapiens
gtcaggctccattagga

SEQ ID NO: 839556 - DNA, 12 bp, Homo sapiens
gtcaggctggga

SEQ ID NO: 839557 - DNA, 10 bp, Homo sapiens
gtcagggaca

SEQ ID NO: 839558 - DNA, 16 bp, Homo sapiens
gtcagggacacatccc

SEQ ID NO: 839559 - DNA, 13 bp, Homo sapiens
gtcagggaccaag

SEQ ID NO: 839560 - DNA, 22 bp, Homo sapiens
gtcagggagtgctggctcacag

SEQ ID NO: 839561 - DNA, 11 bp, Homo sapiens
gtcagggcaca

SEQ ID NO: 839562 - DNA, 14 bp, Homo sapiens
gtcagggcagtggc

SEQ ID NO: 839563 - DNA, 23 bp, Homo sapiens
gtcagggcagtggccaagcctgc

SEQ ID NO: 839564 - DNA, 14 bp, Homo sapiens
gtcagggccaggtg

SEQ ID NO: 839565 - DNA, 14 bp, Homo sapiens
gtcagggcccaagt

SEQ ID NO: 839566 - DNA, 15 bp, Homo sapiens
gtcagggcccaagtc

SEQ ID NO: 839567 - DNA, 19 bp, Homo sapiens
gtcagggcccaagtccctg

SEQ ID NO: 839568 - DNA, 15 bp, Homo sapiens
gtcagggctcagagt

SEQ ID NO: 839569 - DNA, 15 bp, Homo sapiens
gtcaggggctcccta

SEQ ID NO: 839570 - DNA, 22 bp, Homo sapiens
gtcaggggtcaggtgtcaggcc

SEQ ID NO: 839571 - DNA, 15 bp, Homo sapiens
gtcaggggtgcacag

SEQ ID NO: 839572 - DNA, 18 bp, Homo sapiens
gtcagggtccaggagagc

SEQ ID NO: 839573 - DNA, 15 bp, Homo sapiens
gtcagggtgggaaga

SEQ ID NO: 839574 - DNA, 22 bp, Homo sapiens
gtcagggttggtgtgctgaggt

SEQ ID NO: 839575 - DNA, 23 bp, Homo sapiens
gtcaggtaatatacctggtttac

SEQ ID NO: 839576 - DNA, 14 bp, Homo sapiens
gtcaggtcccagcg

SEQ ID NO: 839577 - DNA, 15 bp, Homo sapiens
gtcaggtcccagcga

SEQ ID NO: 839578 - DNA, 19 bp, Homo sapiens
gtcaggtcccagcgagcca

SEQ ID NO: 839579 - DNA, 14 bp, Homo sapiens
gtcaggtgaccctg

SEQ ID NO: 839580 - DNA, 19 bp, Homo sapiens
gtcaggtggactctgggat

SEQ ID NO: 839581 - DNA, 20 bp, Homo sapiens
gtcaggtggactctgggatg

SEQ ID NO: 839582 - DNA, 15 bp, Homo sapiens
gtcaggttcttgcct

SEQ ID NO: 839583 - DNA, 13 bp, Homo sapiens
gtcaggtttaaca

SEQ ID NO: 839584 - DNA, 16 bp, Homo sapiens
gtcaggtttaacattt

SEQ ID NO: 839585 - DNA, 22 bp, Homo sapiens
gtcagtacccctggtaaaccaa

SEQ ID NO: 839586 - DNA, 20 bp, Homo sapiens
gtcagtacgatcaagttgtt

SEQ ID NO: 839587 - DNA, 19 bp, Homo sapiens
gtcagtaggtccaagggcc

SEQ ID NO: 839588 - DNA, 16 bp, Homo sapiens
gtcagtatccaggctt

SEQ ID NO: 839589 - DNA, 21 bp, Homo sapiens
gtcagtatctgtatctctctc

SEQ ID NO: 839590 - DNA, 13 bp, Homo sapiens
gtcagtcacagcc

SEQ ID NO: 839591 - DNA, 14 bp, Homo sapiens
gtcagtcacagcca

SEQ ID NO: 839592 - DNA, 22 bp, Homo sapiens
gtcagtcatgatggcaccactg

SEQ ID NO: 839593 - DNA, 16 bp, Homo sapiens
gtcagtgctcagaaat

SEQ ID NO: 839594 - DNA, 19 bp, Homo sapiens
gtcagtgtggagaggggtg

SEQ ID NO: 839595 - DNA, 17 bp, Homo sapiens
gtcagttcccggagcac

SEQ ID NO: 839596 - DNA, 19 bp, Homo sapiens
gtcagttcccggagcacag

SEQ ID NO: 839597 - DNA, 15 bp, Homo sapiens
gtcagttcttggtgc

SEQ ID NO: 839598 - DNA, 19 bp, Homo sapiens
gtcagttcttggtgctctg

SEQ ID NO: 839599 - DNA, 21 bp, Homo sapiens
gtcagttgtaataaatctagg

SEQ ID NO: 839600 - DNA, 17 bp, Homo sapiens
gtcagttgtacttctgc

SEQ ID NO: 839601 - DNA, 19 bp, Homo sapiens
gtcagttgtgttttttaag

SEQ ID NO: 839602 - DNA, 22 bp, Homo sapiens
gtcataaagtgagaaaactgtg

SEQ ID NO: 839603 - DNA, 23 bp, Homo sapiens
gtcataaattacacaataaagca

SEQ ID NO: 839604 - DNA, 12 bp, Homo sapiens
gtcatagaaatt

SEQ ID NO: 839605 - DNA, 21 bp, Homo sapiens
gtcatagactcctttgctaat

SEQ ID NO: 839606 - DNA, 23 bp, Homo sapiens
gtcatagccaaagccaggcctga

SEQ ID NO: 839607 - DNA, 18 bp, Homo sapiens
gtcatagggattgtccct

SEQ ID NO: 839608 - DNA, 15 bp, Homo sapiens
gtcataggttaatat

SEQ ID NO: 839609 - DNA, 15 bp, Homo sapiens
gtcatagtttcctga

SEQ ID NO: 839610 - DNA, 20 bp, Homo sapiens
gtcatatacattagttttaa

SEQ ID NO: 839611 - DNA, 15 bp, Homo sapiens
gtcatatagtaaaca

SEQ ID NO: 839612 - DNA, 20 bp, Homo sapiens
gtcatatcatttcactgtct

SEQ ID NO: 839613 - DNA, 18 bp, Homo sapiens
gtcatatgtaggtgtctg

SEQ ID NO: 839614 - DNA, 21 bp, Homo sapiens
gtcatattttgccactgcctt

SEQ ID NO: 839615 - DNA, 20 bp, Homo sapiens
gtcatcaaacatttgccaag

SEQ ID NO: 839616 - DNA, 15 bp, Homo sapiens
gtcatcaaagcagaa

SEQ ID NO: 839617 - DNA, 15 bp, Homo sapiens
gtcatcagatatgct

SEQ ID NO: 839618 - DNA, 23 bp, Homo sapiens
gtcatcatcagggcctggggcct

SEQ ID NO: 839619 - DNA, 21 bp, Homo sapiens
gtcatcattgtatatatgtgt

SEQ ID NO: 839620 - DNA, 18 bp, Homo sapiens
gtcatccatgccctccca

SEQ ID NO: 839621 - DNA, 21 bp, Homo sapiens
gtcatcccatcattttccata

SEQ ID NO: 839622 - DNA, 19 bp, Homo sapiens
gtcatcctcaaagaaagtg

SEQ ID NO: 839623 - DNA, 18 bp, Homo sapiens
gtcatcctcacagtgaac

SEQ ID NO: 839624 - DNA, 14 bp, Homo sapiens
gtcatcctcccttg

SEQ ID NO: 839625 - DNA, 20 bp, Homo sapiens
gtcatcctcccttgccccag

SEQ ID NO: 839626 - DNA, 13 bp, Homo sapiens
gtcatcctgccct

SEQ ID NO: 839627 - DNA, 18 bp, Homo sapiens
gtcatcgttccccacccc

SEQ ID NO: 839628 - DNA, 15 bp, Homo sapiens
gtcatctacttaata

SEQ ID NO: 839629 - DNA, 22 bp, Homo sapiens
gtcatctctctggggccctggg

SEQ ID NO: 839630 - DNA, 19 bp, Homo sapiens
gtcatctgattggacaggc

SEQ ID NO: 839631 - DNA, 23 bp, Homo sapiens
gtcatctgtaagagcttgctcca

SEQ ID NO: 839632 - DNA, 17 bp, Homo sapiens
gtcatctgttagggcct

SEQ ID NO: 839633 - DNA, 14 bp, Homo sapiens
gtcatcttgctacc

SEQ ID NO: 839634 - DNA, 15 bp, Homo sapiens
gtcatcttgctacca

SEQ ID NO: 839635 - DNA, 14 bp, Homo sapiens
gtcatctttttcta

SEQ ID NO: 839636 - DNA, 20 bp, Homo sapiens
gtcatctttttctagagtta

SEQ ID NO: 839637 - DNA, 23 bp, Homo sapiens
gtcatgaaaacagcccctttacc

SEQ ID NO: 839638 - DNA, 17 bp, Homo sapiens
gtcatgaaattgttcat

SEQ ID NO: 839639 - DNA, 14 bp, Homo sapiens
gtcatgaagaatgt

SEQ ID NO: 839640 - DNA, 19 bp, Homo sapiens
gtcatgaagaatgtttctg

SEQ ID NO: 839641 - DNA, 14 bp, Homo sapiens
gtcatgaagcccaa

SEQ ID NO: 839642 - DNA, 16 bp, Homo sapiens
gtcatgaagggctgga

SEQ ID NO: 839643 - DNA, 19 bp, Homo sapiens
gtcatgacagtgcttgcat

SEQ ID NO: 839644 - DNA, 13 bp, Homo sapiens
gtcatgaggaaac

SEQ ID NO: 839645 - DNA, 14 bp, Homo sapiens
gtcatgatctccct

SEQ ID NO: 839646 - DNA, 19 bp, Homo sapiens
gtcatgatctccctgccgc

SEQ ID NO: 839647 - DNA, 18 bp, Homo sapiens
gtcatgcctcactttctt

SEQ ID NO: 839648 - DNA, 16 bp, Homo sapiens
gtcatgcggtttccaa

SEQ ID NO: 839649 - DNA, 22 bp, Homo sapiens
gtcatgcggtttccaaggtgca

SEQ ID NO: 839650 - DNA, 14 bp, Homo sapiens
gtcatgctggtggg

SEQ ID NO: 839651 - DNA, 12 bp, Homo sapiens
gtcatgcttcat

SEQ ID NO: 839652 - DNA, 14 bp, Homo sapiens
gtcatggcctgaga

SEQ ID NO: 839653 - DNA, 18 bp, Homo sapiens
gtcatgggaacgcagcct

SEQ ID NO: 839654 - DNA, 20 bp, Homo sapiens
gtcatggggatcaattttca

SEQ ID NO: 839655 - DNA, 14 bp, Homo sapiens
gtccagggcctgac

SEQ ID NO: 839656 - DNA, 11 bp, Homo sapiens
gtccagggctg

SEQ ID NO: 839657 - DNA, 16 bp, Homo sapiens
gtccaggggtctgtct

SEQ ID NO: 839658 - DNA, 20 bp, Homo sapiens
gtccagggtttctctgcaga

SEQ ID NO: 839659 - DNA, 16 bp, Homo sapiens
gtccagtctttttaaa

SEQ ID NO: 839660 - DNA, 22 bp, Homo sapiens
gtccagtgcattttgtttctgt

SEQ ID NO: 839661 - DNA, 23 bp, Homo sapiens
gtccagtgcattttgtttctgta

SEQ ID NO: 839662 - DNA, 12 bp, Homo sapiens
gtccagtgctct

SEQ ID NO: 839663 - DNA, 17 bp, Homo sapiens
gtccagtgctctgcctc

SEQ ID NO: 839664 - DNA, 19 bp, Homo sapiens
gtccagtgctctgcctcag

SEQ ID NO: 839665 - DNA, 20 bp, Homo sapiens
gtccagttataagcgtattt

SEQ ID NO: 839666 - DNA, 15 bp, Homo sapiens
gtccatacactttgt

SEQ ID NO: 839667 - DNA, 16 bp, Homo sapiens
gtccatcagtgcatga

SEQ ID NO: 839668 - DNA, 20 bp, Homo sapiens
gtccatcccccttcttcctc

SEQ ID NO: 839669 - DNA, 21 bp, Homo sapiens
gtccatcccccttcttcctcc

SEQ ID NO: 839670 - DNA, 12 bp, Homo sapiens
gtccatcctgac

SEQ ID NO: 839671 - DNA, 16 bp, Homo sapiens
gtccatcctgacctgc

SEQ ID NO: 839672 - DNA, 15 bp, Homo sapiens
gtccatctgacaaaa

SEQ ID NO: 839673 - DNA, 13 bp, Homo sapiens
gtccatctgtctg

SEQ ID NO: 839674 - DNA, 18 bp, Homo sapiens
gtccatctgtctgtccta

SEQ ID NO: 839675 - DNA, 17 bp, Homo sapiens
gtccatgaaaataccat

SEQ ID NO: 839676 - DNA, 21 bp, Homo sapiens
gtccatgcagggggctcctgg

SEQ ID NO: 839677 - DNA, 22 bp, Homo sapiens
gtccatgcagggggctcctggg

SEQ ID NO: 839678 - DNA, 18 bp, Homo sapiens
gtccatgctaacaaagac

SEQ ID NO: 839679 - DNA, 22 bp, Homo sapiens
gtccatggcaccagccccctgg

SEQ ID NO: 839680 - DNA, 13 bp, Homo sapiens
gtccatgggcaga

SEQ ID NO: 839681 - DNA, 18 bp, Homo sapiens
gtccatgggcagagccca

SEQ ID NO: 839682 - DNA, 15 bp, Homo sapiens
gtccatgggtctggc

SEQ ID NO: 839683 - DNA, 20 bp, Homo sapiens
gtccatgtttattgtttttt

SEQ ID NO: 839684 - DNA, 13 bp, Homo sapiens
gtccattcagatg

SEQ ID NO: 839685 - DNA, 12 bp, Homo sapiens
gtccattgtaaa

SEQ ID NO: 839686 - DNA, 21 bp, Homo sapiens
gtccattgtaaatctgaagaa

SEQ ID NO: 839687 - DNA, 21 bp, Homo sapiens
gtccattgtccaatcctatgt

SEQ ID NO: 839688 - DNA, 21 bp, Homo sapiens
gtccatttatccacaggaaag

SEQ ID NO: 839689 - DNA, 19 bp, Homo sapiens
gtccatttcccacatcttt

SEQ ID NO: 839690 - DNA, 19 bp, Homo sapiens
gtcccaaaatcccctcagc

SEQ ID NO: 839691 - DNA, 22 bp, Homo sapiens
gtcccaaatatgtattttccta

SEQ ID NO: 839692 - DNA, 21 bp, Homo sapiens
gtcccaaatgtagcaggtgta

SEQ ID NO: 839693 - DNA, 15 bp, Homo sapiens
gtcccaagcctgata

SEQ ID NO: 839694 - DNA, 16 bp, Homo sapiens
gtcccaaggagctgat

SEQ ID NO: 839695 - DNA, 23 bp, Homo sapiens
gtcccaaggagctgatttccagg

SEQ ID NO: 839696 - DNA, 22 bp, Homo sapiens
gtcccaatcttaccagatgcta

SEQ ID NO: 839697 - DNA, 15 bp, Homo sapiens
gtcccaatgaaatac

SEQ ID NO: 839698 - DNA, 16 bp, Homo sapiens
gtcccaattaaaatac

SEQ ID NO: 839699 - DNA, 23 bp, Homo sapiens
gtcccaattcggggcctgctgga

SEQ ID NO: 839700 - DNA, 18 bp, Homo sapiens
gtcccacaaatgggcgcc

SEQ ID NO: 839701 - DNA, 22 bp, Homo sapiens
gtcccacactgtgcagacccag

SEQ ID NO: 839702 - DNA, 20 bp, Homo sapiens
gtcccacactgtggccaggc

SEQ ID NO: 839703 - DNA, 22 bp, Homo sapiens
gtcccacactgtggccaggcct

SEQ ID NO: 839704 - DNA, 14 bp, Homo sapiens
gtcccacccacaca

SEQ ID NO: 839705 - DNA, 12 bp, Homo sapiens
gtcccacccacc

SEQ ID NO: 839706 - DNA, 13 bp, Homo sapiens
gtcccaccccacc

SEQ ID NO: 839707 - DNA, 15 bp, Homo sapiens
gtcccaccccacctc

SEQ ID NO: 839708 - DNA, 21 bp, Homo sapiens
gtcccacccccaacccccaga

SEQ ID NO: 839709 - DNA, 19 bp, Homo sapiens
gtcccacccccacccccag

SEQ ID NO: 839710 - DNA, 23 bp, Homo sapiens
gtcccacccccacccccagctca

SEQ ID NO: 839711 - DNA, 16 bp, Homo sapiens
gtcccacccggacagg

SEQ ID NO: 839712 - DNA, 19 bp, Homo sapiens
gtcccaccgggagcctccc

SEQ ID NO: 839713 - DNA, 22 bp, Homo sapiens
gtcccacctccagcccgggagc

SEQ ID NO: 839714 - DNA, 19 bp, Homo sapiens
gtcccacctcttctcttcc

SEQ ID NO: 839715 - DNA, 21 bp, Homo sapiens
gtcccacctcttctcttcctg

SEQ ID NO: 839716 - DNA, 20 bp, Homo sapiens
gtcccacgaatttgctgggg

SEQ ID NO: 839717 - DNA, 20 bp, Homo sapiens
gtcccacgtctggccaggca

SEQ ID NO: 839718 - DNA, 18 bp, Homo sapiens
gtcccacgtgtcttccac

SEQ ID NO: 839719 - DNA, 21 bp, Homo sapiens
gtcccacgtgtcttccacttt

SEQ ID NO: 839720 - DNA, 18 bp, Homo sapiens
gtcccagacaaggagagc

SEQ ID NO: 839721 - DNA, 22 bp, Homo sapiens
gtcccagaggttatctgcctgg

SEQ ID NO: 839722 - DNA, 15 bp, Homo sapiens
gtcccagagtggctg

SEQ ID NO: 839723 - DNA, 17 bp, Homo sapiens
gtcccagatgctgtcat

SEQ ID NO: 839724 - DNA, 17 bp, Homo sapiens
gtcccagcatccctgga

SEQ ID NO: 839725 - DNA, 16 bp, Homo sapiens
gtcccagccaccccgg

SEQ ID NO: 839726 - DNA, 22 bp, Homo sapiens
gtcccagccccggcaagccaca

SEQ ID NO: 839727 - DNA, 16 bp, Homo sapiens
gtcccagcctggggct

SEQ ID NO: 839728 - DNA, 14 bp, Homo sapiens
gtcccagcgagcca

SEQ ID NO: 839729 - DNA, 19 bp, Homo sapiens
gtcccagcgagccacagga

SEQ ID NO: 839730 - DNA, 20 bp, Homo sapiens
gtcccagcgagccacaggaa

SEQ ID NO: 839731 - DNA, 18 bp, Homo sapiens
gtcccagcggcctcaggg

SEQ ID NO: 839732 - DNA, 14 bp, Homo sapiens
gtcccagctactcg

SEQ ID NO: 839733 - DNA, 16 bp, Homo sapiens
gtcccaggaagcaggg

SEQ ID NO: 839734 - DNA, 18 bp, Homo sapiens
gtcccaggaagcagggag

SEQ ID NO: 839735 - DNA, 15 bp, Homo sapiens
gtcccaggaagccgg

SEQ ID NO: 839736 - DNA, 20 bp, Homo sapiens
gtcccaggagctgcccagag

SEQ ID NO: 839737 - DNA, 19 bp, Homo sapiens
gtcccaggcagcacagtgt

SEQ ID NO: 839738 - DNA, 17 bp, Homo sapiens
gtcccaggcatgcagct

SEQ ID NO: 839739 - DNA, 18 bp, Homo sapiens
gtcccaggcatgcagctg

SEQ ID NO: 839740 - DNA, 20 bp, Homo sapiens
gtcccaggcatgcagctgcc

SEQ ID NO: 839741 - DNA, 17 bp, Homo sapiens
gtcccaggccggcccag

SEQ ID NO: 839742 - DNA, 16 bp, Homo sapiens
gtcccaggctgagcct

SEQ ID NO: 839743 - DNA, 19 bp, Homo sapiens
gtcccaggctgagcctcag

SEQ ID NO: 839744 - DNA, 21 bp, Homo sapiens
gtcccaggctgagcctcagtc

SEQ ID NO: 839745 - DNA, 24 bp, Homo sapiens
gtcccagggaagaggaatcgcccc

SEQ ID NO: 839746 - DNA, 11 bp, Homo sapiens
gtcccagggct

SEQ ID NO: 839747 - DNA, 18 bp, Homo sapiens
gtcccagggctctgcagg

SEQ ID NO: 839748 - DNA, 19 bp, Homo sapiens
gtcccagggctctgcaggc

SEQ ID NO: 839749 - DNA, 12 bp, Homo sapiens
gtcccagggctg

SEQ ID NO: 839750 - DNA, 13 bp, Homo sapiens
gtcccagggctgc

SEQ ID NO: 839751 - DNA, 11 bp, Homo sapiens
gtcccagtggg

SEQ ID NO: 839752 - DNA, 15 bp, Homo sapiens
gtcccatatcctgcc

SEQ ID NO: 839753 - DNA, 13 bp, Homo sapiens
gtcccatccaggc

SEQ ID NO: 839754 - DNA, 14 bp, Homo sapiens
gtcccatccaggca

SEQ ID NO: 839755 - DNA, 22 bp, Homo sapiens
gtcccatccccaggtccccaaa

SEQ ID NO: 839756 - DNA, 22 bp, Homo sapiens
gtcccatgacccacccctgtgc

SEQ ID NO: 839757 - DNA, 14 bp, Homo sapiens
gtcccatgaggtct

SEQ ID NO: 839758 - DNA, 17 bp, Homo sapiens
gtcccatgatccctgtg

SEQ ID NO: 839759 - DNA, 16 bp, Homo sapiens
gtcccatgcaggccct

SEQ ID NO: 839760 - DNA, 21 bp, Homo sapiens
gtcccatggacactccagtgc

SEQ ID NO: 839761 - DNA, 18 bp, Homo sapiens
gtcccatggctgaagctg

SEQ ID NO: 839762 - DNA, 20 bp, Homo sapiens
gtcccatggctgaagctgga

SEQ ID NO: 839763 - DNA, 20 bp, Homo sapiens
gtcccattcatattaagaca

SEQ ID NO: 839764 - DNA, 16 bp, Homo sapiens
gtcccattccctggga

SEQ ID NO: 839765 - DNA, 16 bp, Homo sapiens
gtcccattctagatcc

SEQ ID NO: 839766 - DNA, 18 bp, Homo sapiens
gtcccattctagatcctg

SEQ ID NO: 839767 - DNA, 21 bp, Homo sapiens
gtcccattctagatcctgcac

SEQ ID NO: 839768 - DNA, 16 bp, Homo sapiens
gtcccatttctcactg

SEQ ID NO: 839769 - DNA, 12 bp, Homo sapiens
gtccccaaactt

SEQ ID NO: 839770 - DNA, 16 bp, Homo sapiens
gtccccaacgtcccct

SEQ ID NO: 839771 - DNA, 20 bp, Homo sapiens
gtccccaacgtcccctccgc

SEQ ID NO: 839772 - DNA, 16 bp, Homo sapiens
gtccccacacagcctc

SEQ ID NO: 839773 - DNA, 20 bp, Homo sapiens
gtccccacagactgccccag

SEQ ID NO: 839774 - DNA, 22 bp, Homo sapiens
gtccccacagactgccccagcc

SEQ ID NO: 839775 - DNA, 15 bp, Homo sapiens
gtccccacccctgcc

SEQ ID NO: 839776 - DNA, 12 bp, Homo sapiens
gtcctctgtagt

SEQ ID NO: 839777 - DNA, 19 bp, Homo sapiens
gtcctctgtcagtcacagc

SEQ ID NO: 839778 - DNA, 23 bp, Homo sapiens
gtcctctgtcagtcacagccacc

SEQ ID NO: 839779 - DNA, 15 bp, Homo sapiens
gtcctctgtgcccac

SEQ ID NO: 839780 - DNA, 18 bp, Homo sapiens
gtcctctgtgcccacggt

SEQ ID NO: 839781 - DNA, 19 bp, Homo sapiens
gtcctcttccctctctgca

SEQ ID NO: 839782 - DNA, 13 bp, Homo sapiens
gtcctcttctgca

SEQ ID NO: 839783 - DNA, 22 bp, Homo sapiens
gtcctcttttcctggcagctgc

SEQ ID NO: 839784 - DNA, 20 bp, Homo sapiens
gtcctgaaccgactgaccct

SEQ ID NO: 839785 - DNA, 22 bp, Homo sapiens
gtcctgaagaggcgggccagcc

SEQ ID NO: 839786 - DNA, 13 bp, Homo sapiens
gtcctgaccaccc

SEQ ID NO: 839787 - DNA, 15 bp, Homo sapiens
gtcctgacgccctgc

SEQ ID NO: 839788 - DNA, 21 bp, Homo sapiens
gtcctgacggcgcccccagtg

SEQ ID NO: 839789 - DNA, 13 bp, Homo sapiens
gtcctgactcaac

SEQ ID NO: 839790 - DNA, 12 bp, Homo sapiens
gtcctgaggaat

SEQ ID NO: 839791 - DNA, 17 bp, Homo sapiens
gtcctgaggagccctga

SEQ ID NO: 839792 - DNA, 18 bp, Homo sapiens
gtcctgagggtccccacc

SEQ ID NO: 839793 - DNA, 15 bp, Homo sapiens
gtcctgatcagagcc

SEQ ID NO: 839794 - DNA, 16 bp, Homo sapiens
gtcctgatccctccac

SEQ ID NO: 839795 - DNA, 17 bp, Homo sapiens
gtcctgatggtcagctc

SEQ ID NO: 839796 - DNA, 18 bp, Homo sapiens
gtcctgatggtcagctcc

SEQ ID NO: 839797 - DNA, 19 bp, Homo sapiens
gtcctgatggtcagctccc

SEQ ID NO: 839798 - DNA, 23 bp, Homo sapiens
gtcctgatggtcagctcccttct

SEQ ID NO: 839799 - DNA, 10 bp, Homo sapiens
gtcctgcagc

SEQ ID NO: 839800 - DNA, 11 bp, Homo sapiens
gtcctgcaggg

SEQ ID NO: 839801 - DNA, 12 bp, Homo sapiens
gtcctgccagct

SEQ ID NO: 839802 - DNA, 16 bp, Homo sapiens
gtcctgccagctgcct

SEQ ID NO: 839803 - DNA, 17 bp, Homo sapiens
gtcctgccagctgcctt

SEQ ID NO: 839804 - DNA, 21 bp, Homo sapiens
gtcctgccagctgccttcctc

SEQ ID NO: 839805 - DNA, 23 bp, Homo sapiens
gtcctgccctccggaggagcagc

SEQ ID NO: 839806 - DNA, 12 bp, Homo sapiens
gtcctgccctgc

SEQ ID NO: 839807 - DNA, 14 bp, Homo sapiens
gtcctgccctgccc

SEQ ID NO: 839808 - DNA, 15 bp, Homo sapiens
gtcctgccctgcccc

SEQ ID NO: 839809 - DNA, 17 bp, Homo sapiens
gtcctgccggtgggacc

SEQ ID NO: 839810 - DNA, 19 bp, Homo sapiens
gtcctgcctaaaatgaatt

SEQ ID NO: 839811 - DNA, 11 bp, Homo sapiens
gtcctgcctcc

SEQ ID NO: 839812 - DNA, 21 bp, Homo sapiens
gtcctgcctcttgtttctgtg

SEQ ID NO: 839813 - DNA, 11 bp, Homo sapiens
gtcctgcctgt

SEQ ID NO: 839814 - DNA, 12 bp, Homo sapiens
gtcctgcctgtc

SEQ ID NO: 839815 - DNA, 15 bp, Homo sapiens
gtcctgcctgtctgc

SEQ ID NO: 839816 - DNA, 18 bp, Homo sapiens
gtcctgcctgtctgcccc

SEQ ID NO: 839817 - DNA, 15 bp, Homo sapiens
gtcctgcctgtggcg

SEQ ID NO: 839818 - DNA, 22 bp, Homo sapiens
gtcctgcgttcagcccctgatc

SEQ ID NO: 839819 - DNA, 23 bp, Homo sapiens
gtcctgcgttcagcccctgatct

SEQ ID NO: 839820 - DNA, 11 bp, Homo sapiens
gtcctgctcca

SEQ ID NO: 839821 - DNA, 12 bp, Homo sapiens
gtcctgctccag

SEQ ID NO: 839822 - DNA, 22 bp, Homo sapiens
gtcctgctccagaatttggaaa

SEQ ID NO: 839823 - DNA, 19 bp, Homo sapiens
gtcctgctggagtgattta

SEQ ID NO: 839824 - DNA, 13 bp, Homo sapiens
gtcctgctgtccc

SEQ ID NO: 839825 - DNA, 16 bp, Homo sapiens
gtcctgctgtccctgt

SEQ ID NO: 839826 - DNA, 13 bp, Homo sapiens
gtcctggaggggc

SEQ ID NO: 839827 - DNA, 22 bp, Homo sapiens
gtcctggcagctggaccatctc

SEQ ID NO: 839828 - DNA, 17 bp, Homo sapiens
gtcctggccatcccaca

SEQ ID NO: 839829 - DNA, 18 bp, Homo sapiens
gtcctggcccttcagtct

SEQ ID NO: 839830 - DNA, 20 bp, Homo sapiens
gtcctggcccttcagtctgc

SEQ ID NO: 839831 - DNA, 22 bp, Homo sapiens
gtcctggcgcctggcagtccgt

SEQ ID NO: 839832 - DNA, 19 bp, Homo sapiens
gtcctgggagaacctcagg

SEQ ID NO: 839833 - DNA, 12 bp, Homo sapiens
gtcctgggagga

SEQ ID NO: 839834 - DNA, 14 bp, Homo sapiens
gtcctgggcaggtg

SEQ ID NO: 839835 - DNA, 16 bp, Homo sapiens
gtcctgggcaggtggg

SEQ ID NO: 839836 - DNA, 22 bp, Homo sapiens
gtcctgggcaggtgggagctga

SEQ ID NO: 839837 - DNA, 20 bp, Homo sapiens
gtcctgggcatgggtccagg

SEQ ID NO: 839838 - DNA, 16 bp, Homo sapiens
gtcctgggcctgcccc

SEQ ID NO: 839839 - DNA, 17 bp, Homo sapiens
gtcctgggcgccctgga

SEQ ID NO: 839840 - DNA, 14 bp, Homo sapiens
gtcctggggcctcg

SEQ ID NO: 839841 - DNA, 15 bp, Homo sapiens
gtcctggggctctgt

SEQ ID NO: 839842 - DNA, 16 bp, Homo sapiens
gtcctggggctctgtg

SEQ ID NO: 839843 - DNA, 18 bp, Homo sapiens
gtcctgggttctggggca

SEQ ID NO: 839844 - DNA, 18 bp, Homo sapiens
gtcctggtacagcagggt

SEQ ID NO: 839845 - DNA, 21 bp, Homo sapiens
gtcctggtacagcagggtctt

SEQ ID NO: 839846 - DNA, 14 bp, Homo sapiens
gtcctggtcctggc

SEQ ID NO: 839847 - DNA, 17 bp, Homo sapiens
gtcctggtcctggctgc

SEQ ID NO: 839848 - DNA, 11 bp, Homo sapiens
gtcctggtctt

SEQ ID NO: 839849 - DNA, 11 bp, Homo sapiens
gtcctggtgcc

SEQ ID NO: 839850 - DNA, 20 bp, Homo sapiens
gtcctggtgccctggatgcc

SEQ ID NO: 839851 - DNA, 14 bp, Homo sapiens
gtcctggtgctctc

SEQ ID NO: 839852 - DNA, 17 bp, Homo sapiens
gtcctggtgctctctgc

SEQ ID NO: 839853 - DNA, 19 bp, Homo sapiens
gtcctggtgctctctgcca

SEQ ID NO: 839854 - DNA, 20 bp, Homo sapiens
gtcctggtggtattttcaat

SEQ ID NO: 839855 - DNA, 22 bp, Homo sapiens
gtcctgtccacacccagctcag

SEQ ID NO: 839856 - DNA, 12 bp, Homo sapiens
gtcctgtcccag

SEQ ID NO: 839857 - DNA, 13 bp, Homo sapiens
gtcctgtcccaga

SEQ ID NO: 839858 - DNA, 14 bp, Homo sapiens
gtcctgtcccagag

SEQ ID NO: 839859 - DNA, 14 bp, Homo sapiens
gtcctgtctctgca

SEQ ID NO: 839860 - DNA, 15 bp, Homo sapiens
gtcctgtctgtcctt

SEQ ID NO: 839861 - DNA, 15 bp, Homo sapiens
gtcctgtgaatttct

SEQ ID NO: 839862 - DNA, 23 bp, Homo sapiens
gtcctgtgctttctgcatgctta

SEQ ID NO: 839863 - DNA, 19 bp, Homo sapiens
gtcctgtggtgacaggccc

SEQ ID NO: 839864 - DNA, 11 bp, Homo sapiens
gtcctgtgtct

SEQ ID NO: 839865 - DNA, 15 bp, Homo sapiens
gtcctgttccctacc

SEQ ID NO: 839866 - DNA, 16 bp, Homo sapiens
gtcctgttccctaccc

SEQ ID NO: 839867 - DNA, 15 bp, Homo sapiens
gtcctgttgaagact

SEQ ID NO: 839868 - DNA, 13 bp, Homo sapiens
gtccttacctcgg

SEQ ID NO: 839869 - DNA, 14 bp, Homo sapiens
gtccttacctcggg

SEQ ID NO: 839870 - DNA, 14 bp, Homo sapiens
gtccttactccccc

SEQ ID NO: 839871 - DNA, 17 bp, Homo sapiens
gtccttactcccccacc

SEQ ID NO: 839872 - DNA, 20 bp, Homo sapiens
gtccttactcccccaccact

SEQ ID NO: 839873 - DNA, 15 bp, Homo sapiens
gtccttatgttaagc

SEQ ID NO: 839874 - DNA, 18 bp, Homo sapiens
gtccttattatcccagct

SEQ ID NO: 839875 - DNA, 18 bp, Homo sapiens
gtccttattcttctcata

SEQ ID NO: 839876 - DNA, 14 bp, Homo sapiens
gtccttatttattt

SEQ ID NO: 839877 - DNA, 21 bp, Homo sapiens
gtccttcacctcactgaaaac

SEQ ID NO: 839878 - DNA, 15 bp, Homo sapiens
gtccttcagatggaa

SEQ ID NO: 839879 - DNA, 19 bp, Homo sapiens
gtccttccatatccctgcc

SEQ ID NO: 839880 - DNA, 16 bp, Homo sapiens
gtccttccctcaaaga

SEQ ID NO: 839881 - DNA, 15 bp, Homo sapiens
gtccttccctgatgg

SEQ ID NO: 839882 - DNA, 19 bp, Homo sapiens
gtccttccctgatggcctt

SEQ ID NO: 839883 - DNA, 17 bp, Homo sapiens
gtccttcctgtgccctg

SEQ ID NO: 839884 - DNA, 19 bp, Homo sapiens
gtccttccttgactgtcta

SEQ ID NO: 839885 - DNA, 23 bp, Homo sapiens
gtccttcctttaggtctggttgt

SEQ ID NO: 839886 - DNA, 16 bp, Homo sapiens
gtccttgaactgaggc

SEQ ID NO: 839887 - DNA, 18 bp, Homo sapiens
gtccttgaactgaggccc

SEQ ID NO: 839888 - DNA, 23 bp, Homo sapiens
gtccttgaactgaggccctgtga

SEQ ID NO: 839889 - DNA, 17 bp, Homo sapiens
gtccttgatgccagagg

SEQ ID NO: 839890 - DNA, 18 bp, Homo sapiens
gtccttgatgccagaggg

SEQ ID NO: 839891 - DNA, 22 bp, Homo sapiens
gtccttgatgccagagggccag

SEQ ID NO: 839892 - DNA, 23 bp, Homo sapiens
gtccttgatgccagagggccagc

SEQ ID NO: 839893 - DNA, 16 bp, Homo sapiens
gtccttgcacccctca

SEQ ID NO: 839894 - DNA, 19 bp, Homo sapiens
gtccttgcacccctcactc

SEQ ID NO: 839895 - DNA, 14 bp, Homo sapiens
gtccttgcacctgc

SEQ ID NO: 839896 - DNA, 16 bp, Homo sapiens
gtccttgcacctgcat

SEQ ID NO: 839897 - DNA, 17 bp, Homo sapiens
gtccttgcacctgcatc

SEQ ID NO: 839898 - DNA, 14 bp, Homo sapiens
gtccttgcctcctg

SEQ ID NO: 839899 - DNA, 19 bp, Homo sapiens
gtctctctccctctgtctt

SEQ ID NO: 839900 - DNA, 12 bp, Homo sapiens
gtctctctgtga

SEQ ID NO: 839901 - DNA, 13 bp, Homo sapiens
gtctctctgtgaa

SEQ ID NO: 839902 - DNA, 21 bp, Homo sapiens
gtctctctgtgaatacaatta

SEQ ID NO: 839903 - DNA, 16 bp, Homo sapiens
gtctctcttaaagttg

SEQ ID NO: 839904 - DNA, 23 bp, Homo sapiens
gtctctcttctctccagctgact

SEQ ID NO: 839905 - DNA, 10 bp, Homo sapiens
gtctctgaag

SEQ ID NO: 839906 - DNA, 17 bp, Homo sapiens
gtctctgaatacacagt

SEQ ID NO: 839907 - DNA, 15 bp, Homo sapiens
gtctctgatgcagct

SEQ ID NO: 839908 - DNA, 19 bp, Homo sapiens
gtctctgatgcagcttata

SEQ ID NO: 839909 - DNA, 18 bp, Homo sapiens
gtctctgccggctctttc

SEQ ID NO: 839910 - DNA, 22 bp, Homo sapiens
gtctctgctcgccctcctttct

SEQ ID NO: 839911 - DNA, 15 bp, Homo sapiens
gtctctgctggccca

SEQ ID NO: 839912 - DNA, 17 bp, Homo sapiens
gtctctgctggcccagc

SEQ ID NO: 839913 - DNA, 20 bp, Homo sapiens
gtctctgctttccttttctc

SEQ ID NO: 839914 - DNA, 17 bp, Homo sapiens
gtctctgggcctgtgtg

SEQ ID NO: 839915 - DNA, 19 bp, Homo sapiens
gtctctgggcctgtgtgtg

SEQ ID NO: 839916 - DNA, 11 bp, Homo sapiens
gtctctgggga

SEQ ID NO: 839917 - DNA, 17 bp, Homo sapiens
gtctctggtcttccagc

SEQ ID NO: 839918 - DNA, 23 bp, Homo sapiens
gtctctgtctctcctagcccctc

SEQ ID NO: 839919 - DNA, 20 bp, Homo sapiens
gtctctgtggaaaagccatc

SEQ ID NO: 839920 - DNA, 22 bp, Homo sapiens
gtctctgttaacatctagccta

SEQ ID NO: 839921 - DNA, 17 bp, Homo sapiens
gtctctgtttcctgaaa

SEQ ID NO: 839922 - DNA, 14 bp, Homo sapiens
gtctcttcctctgt

SEQ ID NO: 839923 - DNA, 21 bp, Homo sapiens
gtctcttcctttgctctgagg

SEQ ID NO: 839924 - DNA, 14 bp, Homo sapiens
gtctcttctccact

SEQ ID NO: 839925 - DNA, 18 bp, Homo sapiens
gtctcttctccactggat

SEQ ID NO: 839926 - DNA, 14 bp, Homo sapiens
gtctcttctcccag

SEQ ID NO: 839927 - DNA, 15 bp, Homo sapiens
gtctcttctcccaga

SEQ ID NO: 839928 - DNA, 16 bp, Homo sapiens
gtctcttctcccagaa

SEQ ID NO: 839929 - DNA, 23 bp, Homo sapiens
gtctcttctcccagaatcccagc

SEQ ID NO: 839930 - DNA, 21 bp, Homo sapiens
gtctcttgagcatcaatcttg

SEQ ID NO: 839931 - DNA, 23 bp, Homo sapiens
gtctcttgagggagcttagccaa

SEQ ID NO: 839932 - DNA, 20 bp, Homo sapiens
gtctcttggctttgtcactt

SEQ ID NO: 839933 - DNA, 13 bp, Homo sapiens
gtctcttgtaatc

SEQ ID NO: 839934 - DNA, 18 bp, Homo sapiens
gtctctttaagttttgat

SEQ ID NO: 839935 - DNA, 11 bp, Homo sapiens
gtctctttcca

SEQ ID NO: 839936 - DNA, 13 bp, Homo sapiens
gtctctttccact

SEQ ID NO: 839937 - DNA, 15 bp, Homo sapiens
gtctgaaacatttca

SEQ ID NO: 839938 - DNA, 16 bp, Homo sapiens
gtctgaaacatttcat

SEQ ID NO: 839939 - DNA, 15 bp, Homo sapiens
gtctgaaagacagaa

SEQ ID NO: 839940 - DNA, 23 bp, Homo sapiens
gtctgaaagacagaatgtcacca

SEQ ID NO: 839941 - DNA, 12 bp, Homo sapiens
gtctgaacaaag

SEQ ID NO: 839942 - DNA, 18 bp, Homo sapiens
gtctgaacccttgtgctt

SEQ ID NO: 839943 - DNA, 19 bp, Homo sapiens
gtctgaacccttgtgcttg

SEQ ID NO: 839944 - DNA, 15 bp, Homo sapiens
gtctgaagctcgcat

SEQ ID NO: 839945 - DNA, 21 bp, Homo sapiens
gtctgaaggacacttcctgcc

SEQ ID NO: 839946 - DNA, 22 bp, Homo sapiens
gtctgaaggacacttcctgcct

SEQ ID NO: 839947 - DNA, 21 bp, Homo sapiens
gtctgaaggactggattggcc

SEQ ID NO: 839948 - DNA, 22 bp, Homo sapiens
gtctgaaggactggattggcca

SEQ ID NO: 839949 - DNA, 19 bp, Homo sapiens
gtctgaagtacaaacatga

SEQ ID NO: 839950 - DNA, 19 bp, Homo sapiens
gtctgaagtcactgcacag

SEQ ID NO: 839951 - DNA, 17 bp, Homo sapiens
gtctgaatgttctgaca

SEQ ID NO: 839952 - DNA, 15 bp, Homo sapiens
gtctgactccagagt

SEQ ID NO: 839953 - DNA, 14 bp, Homo sapiens
gtctgactccctcc

SEQ ID NO: 839954 - DNA, 17 bp, Homo sapiens
gtctgactctccactcc

SEQ ID NO: 839955 - DNA, 19 bp, Homo sapiens
gtctgactgtgcccaagtg

SEQ ID NO: 839956 - DNA, 10 bp, Homo sapiens
gtctgagact

SEQ ID NO: 839957 - DNA, 19 bp, Homo sapiens
gtctgagatgccccgagcc

SEQ ID NO: 839958 - DNA, 16 bp, Homo sapiens
gtctgaggactgtcct

SEQ ID NO: 839959 - DNA, 19 bp, Homo sapiens
gtctgaggactgtcctccc

SEQ ID NO: 839960 - DNA, 19 bp, Homo sapiens
gtctgaggcctcatccctc

SEQ ID NO: 839961 - DNA, 16 bp, Homo sapiens
gtctgaggcctgcccc

SEQ ID NO: 839962 - DNA, 23 bp, Homo sapiens
gtctgagtcctgtctctgcctgc

SEQ ID NO: 839963 - DNA, 15 bp, Homo sapiens
gtctgagtctatgtt

SEQ ID NO: 839964 - DNA, 18 bp, Homo sapiens
gtctgagtctgagtcctg

SEQ ID NO: 839965 - DNA, 14 bp, Homo sapiens
gtctgagtgaacct

SEQ ID NO: 839966 - DNA, 18 bp, Homo sapiens
gtctgatattaatcaaaa

SEQ ID NO: 839967 - DNA, 16 bp, Homo sapiens
gtctgattttctcact

SEQ ID NO: 839968 - DNA, 15 bp, Homo sapiens
gtctgcaagggccca

SEQ ID NO: 839969 - DNA, 19 bp, Homo sapiens
gtctgcaagggcccagagt

SEQ ID NO: 839970 - DNA, 14 bp, Homo sapiens
gtctgcacctccgc

SEQ ID NO: 839971 - DNA, 15 bp, Homo sapiens
gtctgcacctccgct

SEQ ID NO: 839972 - DNA, 20 bp, Homo sapiens
gtctgcacctccgcttgcca

SEQ ID NO: 839973 - DNA, 13 bp, Homo sapiens
gtctgcagcctgc

SEQ ID NO: 839974 - DNA, 20 bp, Homo sapiens
gtctgcagcctgctggggct

SEQ ID NO: 839975 - DNA, 12 bp, Homo sapiens
gtctgcagctgt

SEQ ID NO: 839976 - DNA, 13 bp, Homo sapiens
gtctgcaggggcc

SEQ ID NO: 839977 - DNA, 20 bp, Homo sapiens
gtctgcaggggcctggagga

SEQ ID NO: 839978 - DNA, 22 bp, Homo sapiens
gtctgcagggtgacgcctgaga

SEQ ID NO: 839979 - DNA, 15 bp, Homo sapiens
gtctgcaggtgtctg

SEQ ID NO: 839980 - DNA, 19 bp, Homo sapiens
gtctgcaggtgtctgacac

SEQ ID NO: 839981 - DNA, 13 bp, Homo sapiens
gtctgccaaacac

SEQ ID NO: 839982 - DNA, 15 bp, Homo sapiens
gtctgccaaacacat

SEQ ID NO: 839983 - DNA, 19 bp, Homo sapiens
gtctgccaacctaaaactc

SEQ ID NO: 839984 - DNA, 21 bp, Homo sapiens
gtctgccaacctaaaactctt

SEQ ID NO: 839985 - DNA, 17 bp, Homo sapiens
gtctgccagaatactgg

SEQ ID NO: 839986 - DNA, 14 bp, Homo sapiens
gtctgccagccagc

SEQ ID NO: 839987 - DNA, 15 bp, Homo sapiens
gtctgccagccagca

SEQ ID NO: 839988 - DNA, 17 bp, Homo sapiens
gtctgccagccagcagc

SEQ ID NO: 839989 - DNA, 18 bp, Homo sapiens
gtctgccagccagcagcc

SEQ ID NO: 839990 - DNA, 11 bp, Homo sapiens
gtctgccaggc

SEQ ID NO: 839991 - DNA, 12 bp, Homo sapiens
gtctgccaggca

SEQ ID NO: 839992 - DNA, 17 bp, Homo sapiens
gtctgccaggcccatct

SEQ ID NO: 839993 - DNA, 17 bp, Homo sapiens
gtctgcccacgcagagg

SEQ ID NO: 839994 - DNA, 18 bp, Homo sapiens
gtctgcccacgcagagga

SEQ ID NO: 839995 - DNA, 15 bp, Homo sapiens
gtctgccccacatgt

SEQ ID NO: 839996 - DNA, 15 bp, Homo sapiens
gtctgccctgcccat

SEQ ID NO: 839997 - DNA, 19 bp, Homo sapiens
gtctgccgcccacctcgct

SEQ ID NO: 839998 - DNA, 22 bp, Homo sapiens
gtctgcctagatccacgtgtgg

SEQ ID NO: 839999 - DNA, 11 bp, Homo sapiens
gtctgcctggg

SEQ ID NO: 840000 - DNA, 15 bp, Homo sapiens
gtctgcctgtatttt

SEQ ID NO: 840001 - DNA, 15 bp, Homo sapiens
gtctgcctgtcccca

SEQ ID NO: 840002 - DNA, 22 bp, Homo sapiens
gtctgccttcacaaatgtcatt

SEQ ID NO: 840003 - DNA, 21 bp, Homo sapiens
gtctgcgtcgggcgtgggtct

SEQ ID NO: 840004 - DNA, 14 bp, Homo sapiens
gtctgctccaccaa

SEQ ID NO: 840005 - DNA, 13 bp, Homo sapiens
gtctgctctgctg

SEQ ID NO: 840006 - DNA, 20 bp, Homo sapiens
gtctgctctgctgctctgac

SEQ ID NO: 840007 - DNA, 14 bp, Homo sapiens
gtctgctctggtgg

SEQ ID NO: 840008 - DNA, 16 bp, Homo sapiens
gtctgctctggtggct

SEQ ID NO: 840009 - DNA, 15 bp, Homo sapiens
gtctgctctttctct

SEQ ID NO: 840010 - DNA, 20 bp, Homo sapiens
gtctgctctttctctgccag

SEQ ID NO: 840011 - DNA, 19 bp, Homo sapiens
gtctgctgaataataaact

SEQ ID NO: 840012 - DNA, 22 bp, Homo sapiens
gtctgctgactgtttcattcac

SEQ ID NO: 840013 - DNA, 13 bp, Homo sapiens
gtctgctgaggag

SEQ ID NO: 840014 - DNA, 13 bp, Homo sapiens
gtctgctgccctc

SEQ ID NO: 840015 - DNA, 18 bp, Homo sapiens
gtctgctgccgcaggagc

SEQ ID NO: 840016 - DNA, 17 bp, Homo sapiens
gtctgctggtatttcta

SEQ ID NO: 840017 - DNA, 18 bp, Homo sapiens
gtctgctggtatttctaa

SEQ ID NO: 840018 - DNA, 13 bp, Homo sapiens
gtctgctgtagaa

SEQ ID NO: 840019 - DNA, 17 bp, Homo sapiens
gtctgctgtctcatcac

SEQ ID NO: 840020 - DNA, 14 bp, Homo sapiens
gtctgcttagaaat

SEQ ID NO: 840021 - DNA, 22 bp, Homo sapiens
gtctgctttaaagggcctgcct

SEQ ID NO: 840022 - DNA, 15 bp, Homo sapiens
gtcttttcagaagca

SEQ ID NO: 840023 - DNA, 23 bp, Homo sapiens
gtcttttcagaagcaagccagac

SEQ ID NO: 840024 - DNA, 14 bp, Homo sapiens
gtcttttcatctgg

SEQ ID NO: 840025 - DNA, 23 bp, Homo sapiens
gtcttttctgttttttaaatgat

SEQ ID NO: 840026 - DNA, 14 bp, Homo sapiens
gtcttttgaatatt

SEQ ID NO: 840027 - DNA, 19 bp, Homo sapiens
gtcttttgaatattcccaa

SEQ ID NO: 840028 - DNA, 13 bp, Homo sapiens
gtcttttgacatt

SEQ ID NO: 840029 - DNA, 16 bp, Homo sapiens
gtcttttgacatttta

SEQ ID NO: 840030 - DNA, 20 bp, Homo sapiens
gtctttttcattttgcagaa

SEQ ID NO: 840031 - DNA, 12 bp, Homo sapiens
gtctttttccta

SEQ ID NO: 840032 - DNA, 13 bp, Homo sapiens
gtctttttcctac

SEQ ID NO: 840033 - DNA, 18 bp, Homo sapiens
gtctttttcctactccgt

SEQ ID NO: 840034 - DNA, 20 bp, Homo sapiens
gtctttttctcttctgttct

SEQ ID NO: 840035 - DNA, 21 bp, Homo sapiens
gtctttttctttttttggtaa

SEQ ID NO: 840036 - DNA, 22 bp, Homo sapiens
gtctttttctttttttggtaaa

SEQ ID NO: 840037 - DNA, 18 bp, Homo sapiens
gtctttttgtataaatga

SEQ ID NO: 840038 - DNA, 17 bp, Homo sapiens
gtctttttttgtatagt

SEQ ID NO: 840039 - DNA, 22 bp, Homo sapiens
gtctttttttgtatagttaaca

SEQ ID NO: 840040 - DNA, 15 bp, Homo sapiens
gtcttttttttcatc

SEQ ID NO: 840041 - DNA, 18 bp, Homo sapiens
gtcttttttttcatcctt

SEQ ID NO: 840042 - DNA, 18 bp, Homo sapiens
gtcttttttttttccaaa

SEQ ID NO: 840043 - DNA, 15 bp, Homo sapiens
gtgaaaaaaaaaatg

SEQ ID NO: 840044 - DNA, 13 bp, Homo sapiens
gtgaaaaaaagaa

SEQ ID NO: 840045 - DNA, 20 bp, Homo sapiens
gtgaaaaaagaaaatggcta

SEQ ID NO: 840046 - DNA, 13 bp, Homo sapiens
gtgaaaaatgtca

SEQ ID NO: 840047 - DNA, 14 bp, Homo sapiens
gtgaaaacaaatct

SEQ ID NO: 840048 - DNA, 12 bp, Homo sapiens
gtgaaaagaata

SEQ ID NO: 840049 - DNA, 22 bp, Homo sapiens
gtgaaaagagtatgtagtggct

SEQ ID NO: 840050 - DNA, 12 bp, Homo sapiens
gtgaaaatcttg

SEQ ID NO: 840051 - DNA, 15 bp, Homo sapiens
gtgaaaatggtccag

SEQ ID NO: 840052 - DNA, 15 bp, Homo sapiens
gtgaaaattctgttg

SEQ ID NO: 840053 - DNA, 20 bp, Homo sapiens
gtgaaaatttttacattcat

SEQ ID NO: 840054 - DNA, 22 bp, Homo sapiens
gtgaaacaatgttgtccaacaa

SEQ ID NO: 840055 - DNA, 16 bp, Homo sapiens
gtgaaacagagaaaga

SEQ ID NO: 840056 - DNA, 23 bp, Homo sapiens
gtgaaacagagaaagaaaaggca

SEQ ID NO: 840057 - DNA, 16 bp, Homo sapiens
gtgaaaccctgtctct

SEQ ID NO: 840058 - DNA, 22 bp, Homo sapiens
gtgaaacctttagggcagcttg

SEQ ID NO: 840059 - DNA, 22 bp, Homo sapiens
gtgaaacgactcaaaatgacag

SEQ ID NO: 840060 - DNA, 16 bp, Homo sapiens
gtgaaacggaagctca

SEQ ID NO: 840061 - DNA, 19 bp, Homo sapiens
gtgaaactaacagataagc

SEQ ID NO: 840062 - DNA, 22 bp, Homo sapiens
gtgaaacttttctagaattatt

SEQ ID NO: 840063 - DNA, 20 bp, Homo sapiens
gtgaaagaaagctgagaaga

SEQ ID NO: 840064 - DNA, 15 bp, Homo sapiens
gtgaaagaattattt

SEQ ID NO: 840065 - DNA, 22 bp, Homo sapiens
gtgaaagaattatttttgtgtt

SEQ ID NO: 840066 - DNA, 21 bp, Homo sapiens
gtgaaagagagtaccatgctg

SEQ ID NO: 840067 - DNA, 12 bp, Homo sapiens
gtgaaagggcta

SEQ ID NO: 840068 - DNA, 17 bp, Homo sapiens
gtgaaataataaaatgc

SEQ ID NO: 840069 - DNA, 22 bp, Homo sapiens
gtgaaataataaaatgcaaatg

SEQ ID NO: 840070 - DNA, 13 bp, Homo sapiens
gtgaaataatttg

SEQ ID NO: 840071 - DNA, 20 bp, Homo sapiens
gtgaaataatttttaacttt

SEQ ID NO: 840072 - DNA, 22 bp, Homo sapiens
gtgaaataccaacctgaagaca

SEQ ID NO: 840073 - DNA, 17 bp, Homo sapiens
gtgaaataccagtgtgg

SEQ ID NO: 840074 - DNA, 16 bp, Homo sapiens
gtgaaatagttctgcc

SEQ ID NO: 840075 - DNA, 12 bp, Homo sapiens
gtgaaatatcat

SEQ ID NO: 840076 - DNA, 20 bp, Homo sapiens
gtgaaatgtaacatgaagca

SEQ ID NO: 840077 - DNA, 14 bp, Homo sapiens
gtgaaatgtaactg

SEQ ID NO: 840078 - DNA, 17 bp, Homo sapiens
gtgaaatttacaaatca

SEQ ID NO: 840079 - DNA, 15 bp, Homo sapiens
gtgaaatttgcctct

SEQ ID NO: 840080 - DNA, 17 bp, Homo sapiens
gtgaaatttgcctctgt

SEQ ID NO: 840081 - DNA, 19 bp, Homo sapiens
gtgaacaaaagatgctctt

SEQ ID NO: 840082 - DNA, 17 bp, Homo sapiens
gtgaacacttagtgatc

SEQ ID NO: 840083 - DNA, 18 bp, Homo sapiens
gtgaacagcttgctgtca

SEQ ID NO: 840084 - DNA, 19 bp, Homo sapiens
gtgaaccatctcagacctt

SEQ ID NO: 840085 - DNA, 20 bp, Homo sapiens
gtgaaccatctcagaccttt

SEQ ID NO: 840086 - DNA, 16 bp, Homo sapiens
gtgaacctaccttcat

SEQ ID NO: 840087 - DNA, 15 bp, Homo sapiens
gtgaacgctgtgatg

SEQ ID NO: 840088 - DNA, 19 bp, Homo sapiens
gtgaacgctgtgatgctgt

SEQ ID NO: 840089 - DNA, 21 bp, Homo sapiens
gtgaacgctgtgatgctgtgt

SEQ ID NO: 840090 - DNA, 15 bp, Homo sapiens
gtgaactccatcatt

SEQ ID NO: 840091 - DNA, 17 bp, Homo sapiens
gtgaactgatcatgttt

SEQ ID NO: 840092 - DNA, 15 bp, Homo sapiens
gtgaactgcaaagct

SEQ ID NO: 840093 - DNA, 19 bp, Homo sapiens
gtgaacttgggccactgtg

SEQ ID NO: 840094 - DNA, 12 bp, Homo sapiens
gtgaacttttct

SEQ ID NO: 840095 - DNA, 12 bp, Homo sapiens
gtgaactttttt

SEQ ID NO: 840096 - DNA, 20 bp, Homo sapiens
gtgaagaaaaagacctgcat

SEQ ID NO: 840097 - DNA, 22 bp, Homo sapiens
gtgaagaaagcctgttgtttaa

SEQ ID NO: 840098 - DNA, 23 bp, Homo sapiens
gtgaagactcacttctcagctga

SEQ ID NO: 840099 - DNA, 18 bp, Homo sapiens
gtgaagactgggtgagga

SEQ ID NO: 840100 - DNA, 15 bp, Homo sapiens
gtgaagacttcttgg

SEQ ID NO: 840101 - DNA, 15 bp, Homo sapiens
gtgaagagccggtgg

SEQ ID NO: 840102 - DNA, 15 bp, Homo sapiens
gtgaagaggggcagc

SEQ ID NO: 840103 - DNA, 19 bp, Homo sapiens
gtgaagaggggcagccctt

SEQ ID NO: 840104 - DNA, 18 bp, Homo sapiens
gtgaagcaaacacagcat

SEQ ID NO: 840105 - DNA, 17 bp, Homo sapiens
gtgaagcagcactgtga

SEQ ID NO: 840106 - DNA, 18 bp, Homo sapiens
gtgaagcagcactgtgag

SEQ ID NO: 840107 - DNA, 22 bp, Homo sapiens
gtgaagccaattcagacaggca

SEQ ID NO: 840108 - DNA, 17 bp, Homo sapiens
gtgaagctcacactgat

SEQ ID NO: 840109 - DNA, 19 bp, Homo sapiens
gtgaagctcacactgatgg

SEQ ID NO: 840110 - DNA, 14 bp, Homo sapiens
gtgaaggcttctct

SEQ ID NO: 840111 - DNA, 17 bp, Homo sapiens
gtgaagggatgggggaa

SEQ ID NO: 840112 - DNA, 15 bp, Homo sapiens
gtgaaggggaaacac

SEQ ID NO: 840113 - DNA, 21 bp, Homo sapiens
gtgaaggtattttgtagatgt

SEQ ID NO: 840114 - DNA, 23 bp, Homo sapiens
gtgaaggtctttgttatgacagt

SEQ ID NO: 840115 - DNA, 17 bp, Homo sapiens
gtgaaggttcccaagga

SEQ ID NO: 840116 - DNA, 18 bp, Homo sapiens
gtgaaggttcccaaggac

SEQ ID NO: 840117 - DNA, 21 bp, Homo sapiens
gtgaaggttcccaaggacatg

SEQ ID NO: 840118 - DNA, 19 bp, Homo sapiens
gtgaagtatactgtatttt

SEQ ID NO: 840119 - DNA, 21 bp, Homo sapiens
gtgaagtcatgacctccaggg

SEQ ID NO: 840120 - DNA, 14 bp, Homo sapiens
gtgaagtgaagaca

SEQ ID NO: 840121 - DNA, 16 bp, Homo sapiens
gtgaagtgaatctgat

SEQ ID NO: 840122 - DNA, 17 bp, Homo sapiens
gtgaagtggcctcttgg

SEQ ID NO: 840123 - DNA, 23 bp, Homo sapiens
gtgaagtgtggctggtgtcccct

SEQ ID NO: 840124 - DNA, 22 bp, Homo sapiens
gtgaagttaaaacacctttcct

SEQ ID NO: 840125 - DNA, 15 bp, Homo sapiens
gtgaataaaaaccct

SEQ ID NO: 840126 - DNA, 18 bp, Homo sapiens
gtgaataaaaaccctgta

SEQ ID NO: 840127 - DNA, 24 bp, Homo sapiens
gtgaataataaatacacaatgaat

SEQ ID NO: 840128 - DNA, 23 bp, Homo sapiens
gtgaatacttattttcagtgcat

SEQ ID NO: 840129 - DNA, 16 bp, Homo sapiens
gtgaatataaatgtgt

SEQ ID NO: 840130 - DNA, 18 bp, Homo sapiens
gtgaatcacgtaaagcta

SEQ ID NO: 840131 - DNA, 15 bp, Homo sapiens
gtgaatcagacccta

SEQ ID NO: 840132 - DNA, 15 bp, Homo sapiens
gtgaatccctgggag

SEQ ID NO: 840133 - DNA, 15 bp, Homo sapiens
gtgaatctttctcct

SEQ ID NO: 840134 - DNA, 17 bp, Homo sapiens
gtgaatctttctcctgg

SEQ ID NO: 840135 - DNA, 18 bp, Homo sapiens
gtgaatctttctcctggt

SEQ ID NO: 840136 - DNA, 21 bp, Homo sapiens
gtgaatgatgatcctaggcat

SEQ ID NO: 840137 - DNA, 14 bp, Homo sapiens
gtgaatggaggcag

SEQ ID NO: 840138 - DNA, 17 bp, Homo sapiens
gtgaatggaggcagaga

SEQ ID NO: 840139 - DNA, 19 bp, Homo sapiens
gtgaatggccctagaactg

SEQ ID NO: 840140 - DNA, 18 bp, Homo sapiens
gtgaatgtagcttccacc

SEQ ID NO: 840141 - DNA, 23 bp, Homo sapiens
gtgaatgtgggcactggcccagg

SEQ ID NO: 840142 - DNA, 21 bp, Homo sapiens
gtgaattaggctgtaactact

SEQ ID NO: 840143 - DNA, 22 bp, Homo sapiens
gtgataattttatttataaact

SEQ ID NO: 840144 - DNA, 17 bp, Homo sapiens
gtgatacaatgctgtgc

SEQ ID NO: 840145 - DNA, 16 bp, Homo sapiens
gtgatacgtacagcca

SEQ ID NO: 840146 - DNA, 13 bp, Homo sapiens
gtgatagcacttt

SEQ ID NO: 840147 - DNA, 14 bp, Homo sapiens
gtgatagcactttc

SEQ ID NO: 840148 - DNA, 12 bp, Homo sapiens
gtgatagcattg

SEQ ID NO: 840149 - DNA, 16 bp, Homo sapiens
gtgataggcccaaggt

SEQ ID NO: 840150 - DNA, 22 bp, Homo sapiens
gtgatagtcttttgcttttggc

SEQ ID NO: 840151 - DNA, 14 bp, Homo sapiens
gtgatataaaggac

SEQ ID NO: 840152 - DNA, 19 bp, Homo sapiens
gtgatatcacctctcttca

SEQ ID NO: 840153 - DNA, 22 bp, Homo sapiens
gtgatatggcggcctgcagtgg

SEQ ID NO: 840154 - DNA, 18 bp, Homo sapiens
gtgatatttttatgtgca

SEQ ID NO: 840155 - DNA, 16 bp, Homo sapiens
gtgatcatgtgtggaa

SEQ ID NO: 840156 - DNA, 23 bp, Homo sapiens
gtgatccacccaaccctatctcc

SEQ ID NO: 840157 - DNA, 16 bp, Homo sapiens
gtgatccagccctggt

SEQ ID NO: 840158 - DNA, 13 bp, Homo sapiens
gtgatccatccat

SEQ ID NO: 840159 - DNA, 21 bp, Homo sapiens
gtgatcctctattttgtgatg

SEQ ID NO: 840160 - DNA, 16 bp, Homo sapiens
gtgatctcagggcaga

SEQ ID NO: 840161 - DNA, 22 bp, Homo sapiens
gtgatctgggcattttcctcct

SEQ ID NO: 840162 - DNA, 21 bp, Homo sapiens
gtgatcttaatatatttgaaa

SEQ ID NO: 840163 - DNA, 17 bp, Homo sapiens
gtgatcttaggtttgtt

SEQ ID NO: 840164 - DNA, 21 bp, Homo sapiens
gtgatcttaggtttgtttttt

SEQ ID NO: 840165 - DNA, 14 bp, Homo sapiens
gtgatcttggctca

SEQ ID NO: 840166 - DNA, 14 bp, Homo sapiens
gtgatgaatactgt

SEQ ID NO: 840167 - DNA, 21 bp, Homo sapiens
gtgatgaatcaatgaaaaatg

SEQ ID NO: 840168 - DNA, 22 bp, Homo sapiens
gtgatgaatgtactatgtctga

SEQ ID NO: 840169 - DNA, 15 bp, Homo sapiens
gtgatgatgctgtga

SEQ ID NO: 840170 - DNA, 15 bp, Homo sapiens
gtgatgccaaagatg

SEQ ID NO: 840171 - DNA, 19 bp, Homo sapiens
gtgatgccaaagatgtttg

SEQ ID NO: 840172 - DNA, 21 bp, Homo sapiens
gtgatgccatatcaagtccat

SEQ ID NO: 840173 - DNA, 16 bp, Homo sapiens
gtgatgccgtcctgct

SEQ ID NO: 840174 - DNA, 19 bp, Homo sapiens
gtgatgcgccttgctgatg

SEQ ID NO: 840175 - DNA, 16 bp, Homo sapiens
gtgatgctcaggcttg

SEQ ID NO: 840176 - DNA, 17 bp, Homo sapiens
gtgatggagaggacaga

SEQ ID NO: 840177 - DNA, 16 bp, Homo sapiens
gtgatggagtgctgtt

SEQ ID NO: 840178 - DNA, 18 bp, Homo sapiens
gtgatggagtgctgtttt

SEQ ID NO: 840179 - DNA, 23 bp, Homo sapiens
gtgatggagtgctgttttgttat

SEQ ID NO: 840180 - DNA, 14 bp, Homo sapiens
gtgatggccagagg

SEQ ID NO: 840181 - DNA, 15 bp, Homo sapiens
gtgatggccagagga

SEQ ID NO: 840182 - DNA, 17 bp, Homo sapiens
gtgatgggggagagggt

SEQ ID NO: 840183 - DNA, 15 bp, Homo sapiens
gtgatgggtgcagga

SEQ ID NO: 840184 - DNA, 17 bp, Homo sapiens
gtgatggtgtccttccc

SEQ ID NO: 840185 - DNA, 18 bp, Homo sapiens
gtgatggtgtccttccct

SEQ ID NO: 840186 - DNA, 14 bp, Homo sapiens
gtgatggttcccct

SEQ ID NO: 840187 - DNA, 15 bp, Homo sapiens
gtgatgtaaaaatgc

SEQ ID NO: 840188 - DNA, 16 bp, Homo sapiens
gtgatgtaaaaatgct

SEQ ID NO: 840189 - DNA, 16 bp, Homo sapiens
gtgatgtattttcata

SEQ ID NO: 840190 - DNA, 15 bp, Homo sapiens
gtgatgtcatgaaac

SEQ ID NO: 840191 - DNA, 14 bp, Homo sapiens
gtgatgtcatttga

SEQ ID NO: 840192 - DNA, 12 bp, Homo sapiens
gtgatgtgccac

SEQ ID NO: 840193 - DNA, 14 bp, Homo sapiens
gtgatgtgccacta

SEQ ID NO: 840194 - DNA, 22 bp, Homo sapiens
gtgatgtggaggaagagccacc

SEQ ID NO: 840195 - DNA, 15 bp, Homo sapiens
gtgatgtggtggccg

SEQ ID NO: 840196 - DNA, 22 bp, Homo sapiens
gtgatgttgaaatatgcatact

SEQ ID NO: 840197 - DNA, 14 bp, Homo sapiens
gtgatgtttgtcct

SEQ ID NO: 840198 - DNA, 14 bp, Homo sapiens
gtgattaaacgtgc

SEQ ID NO: 840199 - DNA, 19 bp, Homo sapiens
gtgattaaacgtgcagact

SEQ ID NO: 840200 - DNA, 15 bp, Homo sapiens
gtgattaactgtgaa

SEQ ID NO: 840201 - DNA, 17 bp, Homo sapiens
gtgattacataatctgt

SEQ ID NO: 840202 - DNA, 17 bp, Homo sapiens
gtgattacgtgtatgtt

SEQ ID NO: 840203 - DNA, 19 bp, Homo sapiens
gtgattatctctttgatct

SEQ ID NO: 840204 - DNA, 14 bp, Homo sapiens
gtgattcaatctgt

SEQ ID NO: 840205 - DNA, 16 bp, Homo sapiens
gtgattcaatctgtaa

SEQ ID NO: 840206 - DNA, 23 bp, Homo sapiens
gtgattccactacacctggctga

SEQ ID NO: 840207 - DNA, 23 bp, Homo sapiens
gtgattccttttgatggggagaa

SEQ ID NO: 840208 - DNA, 16 bp, Homo sapiens
gtgattctaatgtctt

SEQ ID NO: 840209 - DNA, 14 bp, Homo sapiens
gtgattctgatttc

SEQ ID NO: 840210 - DNA, 18 bp, Homo sapiens
gtgattctgatttcagtt

SEQ ID NO: 840211 - DNA, 17 bp, Homo sapiens
gtgattgacagaaccct

SEQ ID NO: 840212 - DNA, 24 bp, Homo sapiens
gtgattggcctgtagagttgctga

SEQ ID NO: 840213 - DNA, 21 bp, Homo sapiens
gtgatttagaactgtatgtca

SEQ ID NO: 840214 - DNA, 17 bp, Homo sapiens
gtgatttccatttctga

SEQ ID NO: 840215 - DNA, 16 bp, Homo sapiens
gtgatttcttctccct

SEQ ID NO: 840216 - DNA, 19 bp, Homo sapiens
gtgattttgccctcctgcc

SEQ ID NO: 840217 - DNA, 16 bp, Homo sapiens
gtgattttgctgtaga

SEQ ID NO: 840218 - DNA, 13 bp, Homo sapiens
gtgcaaaaaaaaa

SEQ ID NO: 840219 - DNA, 19 bp, Homo sapiens
gtgcaaaagcttcaaatta

SEQ ID NO: 840220 - DNA, 17 bp, Homo sapiens
gtgcaaacaacctgaat

SEQ ID NO: 840221 - DNA, 14 bp, Homo sapiens
gtgcaaagactctg

SEQ ID NO: 840222 - DNA, 21 bp, Homo sapiens
gtgcaaagactctgagccaag

SEQ ID NO: 840223 - DNA, 22 bp, Homo sapiens
gtgcaaagttccctacttcctg

SEQ ID NO: 840224 - DNA, 17 bp, Homo sapiens
gtgcaaattcagaactg

SEQ ID NO: 840225 - DNA, 18 bp, Homo sapiens
gtgcaaattcagaactga

SEQ ID NO: 840226 - DNA, 16 bp, Homo sapiens
gtgcaaattttgcatt

SEQ ID NO: 840227 - DNA, 13 bp, Homo sapiens
gtgcaacagacaa

SEQ ID NO: 840228 - DNA, 14 bp, Homo sapiens
gtgcaacagacaag

SEQ ID NO: 840229 - DNA, 12 bp, Homo sapiens
gtgcaacagcac

SEQ ID NO: 840230 - DNA, 14 bp, Homo sapiens
gtgcaacatctctg

SEQ ID NO: 840231 - DNA, 17 bp, Homo sapiens
gtgcaacatctctgaat

SEQ ID NO: 840232 - DNA, 22 bp, Homo sapiens
gtgcaacatttctgtatactgt

SEQ ID NO: 840233 - DNA, 23 bp, Homo sapiens
gtgcaacatttctgtatactgta

SEQ ID NO: 840234 - DNA, 23 bp, Homo sapiens
gtgcaacctcttggcctgatcag

SEQ ID NO: 840235 - DNA, 15 bp, Homo sapiens
gtgcaacctgtggct

SEQ ID NO: 840236 - DNA, 24 bp, Homo sapiens
gtgcaacctgtggctcaggggagc

SEQ ID NO: 840237 - DNA, 19 bp, Homo sapiens
gtgcaagactgaattaatg

SEQ ID NO: 840238 - DNA, 19 bp, Homo sapiens
gtgcaaggacctaaaacat

SEQ ID NO: 840239 - DNA, 22 bp, Homo sapiens
gtgcaaggtggcctttgtgctg

SEQ ID NO: 840240 - DNA, 18 bp, Homo sapiens
gtgcaagtgtctgtgtgc

SEQ ID NO: 840241 - DNA, 14 bp, Homo sapiens
gtgcaagtgtgtgc

SEQ ID NO: 840242 - DNA, 15 bp, Homo sapiens
gtgcaagtgtgtgca

SEQ ID NO: 840243 - DNA, 21 bp, Homo sapiens
gtgcaataatttgtacaatgg

SEQ ID NO: 840244 - DNA, 13 bp, Homo sapiens
gtgcaatgtaaat

SEQ ID NO: 840245 - DNA, 18 bp, Homo sapiens
gtgcaattccaagaaaat

SEQ ID NO: 840246 - DNA, 20 bp, Homo sapiens
gtgcaattccaagaaaatat

SEQ ID NO: 840247 - DNA, 21 bp, Homo sapiens
gtgcacaaatacaaagtggaa

SEQ ID NO: 840248 - DNA, 15 bp, Homo sapiens
gtgcacaaatattta

SEQ ID NO: 840249 - DNA, 20 bp, Homo sapiens
gtgcacaaatatttattttc

SEQ ID NO: 840250 - DNA, 20 bp, Homo sapiens
gtgcacaccccactcccaca

SEQ ID NO: 840251 - DNA, 12 bp, Homo sapiens
gtgcacagaaaa

SEQ ID NO: 840252 - DNA, 13 bp, Homo sapiens
gtgcacagaaaac

SEQ ID NO: 840253 - DNA, 18 bp, Homo sapiens
gtgcacatctgtgtcttg

SEQ ID NO: 840254 - DNA, 16 bp, Homo sapiens
gtgcaccatccctttt

SEQ ID NO: 840255 - DNA, 13 bp, Homo sapiens
gtgcacccacctg

SEQ ID NO: 840256 - DNA, 13 bp, Homo sapiens
gtgcacccactca

SEQ ID NO: 840257 - DNA, 19 bp, Homo sapiens
gtgcacccactcaccaggg

SEQ ID NO: 840258 - DNA, 21 bp, Homo sapiens
gtgcacccactcaccagggtc

SEQ ID NO: 840259 - DNA, 22 bp, Homo sapiens
gtgcacctccctccccagctcc

SEQ ID NO: 840260 - DNA, 18 bp, Homo sapiens
gtgcacctgtactcagga

SEQ ID NO: 840261 - DNA, 21 bp, Homo sapiens
gtgcacctgtactcaggaggc

SEQ ID NO: 840262 - DNA, 14 bp, Homo sapiens
gtgcacgcctgagc

SEQ ID NO: 840263 - DNA, 21 bp, Homo sapiens
gtgcacgcctgagcgtcctcc

SEQ ID NO: 840264 - DNA, 21 bp, Homo sapiens
gtgcacgtggagagctggtgc

SEQ ID NO: 840265 - DNA, 18 bp, Homo sapiens
gtgcacgtggcatgtggc

SEQ ID NO: 840266 - DNA, 12 bp, Homo sapiens
gtgcactgacag

SEQ ID NO: 840267 - DNA, 16 bp, Homo sapiens
gtgcactgacagcctt

SEQ ID NO: 840268 - DNA, 18 bp, Homo sapiens
gtgcactgacagccttgc

SEQ ID NO: 840269 - DNA, 14 bp, Homo sapiens
gtgcactgactgtg

SEQ ID NO: 840270 - DNA, 15 bp, Homo sapiens
gtgcactgcccatgg

SEQ ID NO: 840271 - DNA, 20 bp, Homo sapiens
gtgcactgcccatggacagg

SEQ ID NO: 840272 - DNA, 21 bp, Homo sapiens
gtgcactgcccatggacaggc

SEQ ID NO: 840273 - DNA, 15 bp, Homo sapiens
gtgcagaacacctgg

SEQ ID NO: 840274 - DNA, 19 bp, Homo sapiens
gtgcagaataatggaaaca

SEQ ID NO: 840275 - DNA, 16 bp, Homo sapiens
gtgcagacccagtccc

SEQ ID NO: 840276 - DNA, 19 bp, Homo sapiens
gtgcagacccagtcccaca

SEQ ID NO: 840277 - DNA, 17 bp, Homo sapiens
gtgcagactcaagactt

SEQ ID NO: 840278 - DNA, 17 bp, Homo sapiens
gtgcagagctggggctg

SEQ ID NO: 840279 - DNA, 14 bp, Homo sapiens
gtgcagaggctgtg

SEQ ID NO: 840280 - DNA, 22 bp, Homo sapiens
gtgcagaggctgtggctggtga

SEQ ID NO: 840281 - DNA, 20 bp, Homo sapiens
gtgcagagggtttgtgccca

SEQ ID NO: 840282 - DNA, 22 bp, Homo sapiens
gtgcagaggtcagactaagaaa

SEQ ID NO: 840283 - DNA, 22 bp, Homo sapiens
gtgcagatcatccgtctgtgtg

SEQ ID NO: 840284 - DNA, 18 bp, Homo sapiens
gtgcagatgctgctgaag

SEQ ID NO: 840285 - DNA, 22 bp, Homo sapiens
gtgcagatgctgctgaagagag

SEQ ID NO: 840286 - DNA, 20 bp, Homo sapiens
gtgcagatggtactgctgag

SEQ ID NO: 840287 - DNA, 16 bp, Homo sapiens
gtgcagcagcccagct

SEQ ID NO: 840288 - DNA, 21 bp, Homo sapiens
gtgcagccaaaggggagccag

SEQ ID NO: 840289 - DNA, 20 bp, Homo sapiens
gtgcagcccgtgtggcccct

SEQ ID NO: 840290 - DNA, 14 bp, Homo sapiens
gtgcagcccttcct

SEQ ID NO: 840291 - DNA, 19 bp, Homo sapiens
gtgcagcccttcctcctga

SEQ ID NO: 840292 - DNA, 14 bp, Homo sapiens
gtgcagccttctcc

SEQ ID NO: 840293 - DNA, 15 bp, Homo sapiens
gtgcagctcctcagc

SEQ ID NO: 840294 - DNA, 18 bp, Homo sapiens
gtgcagctgattttaaca

SEQ ID NO: 840295 - DNA, 21 bp, Homo sapiens
gtgcagctgggcttggcctgg

SEQ ID NO: 840296 - DNA, 14 bp, Homo sapiens
gtgcagctgggtgg

SEQ ID NO: 840297 - DNA, 15 bp, Homo sapiens
gtgcagcttgcagtc

SEQ ID NO: 840298 - DNA, 13 bp, Homo sapiens
gtgcaggagcctc

SEQ ID NO: 840299 - DNA, 23 bp, Homo sapiens
gtgcagggaggaggtggcagccc

SEQ ID NO: 840300 - DNA, 18 bp, Homo sapiens
gtgcagggatattgcctt

SEQ ID NO: 840301 - DNA, 21 bp, Homo sapiens
gtgcaggggccaggggtggga

SEQ ID NO: 840302 - DNA, 12 bp, Homo sapiens
gtgcagggtgga

SEQ ID NO: 840303 - DNA, 22 bp, Homo sapiens
gtgcaggtggggtgatggccag

SEQ ID NO: 840304 - DNA, 21 bp, Homo sapiens
gtgcagtcagcagatgctgtt

SEQ ID NO: 840305 - DNA, 23 bp, Homo sapiens
gtgcagtcaggtgggcggtgtgt

SEQ ID NO: 840306 - DNA, 16 bp, Homo sapiens
gtgcagtcctgatcag

SEQ ID NO: 840307 - DNA, 12 bp, Homo sapiens
gtgcagtctggg

SEQ ID NO: 840308 - DNA, 23 bp, Homo sapiens
gtgcagtctttgagataatttgt

SEQ ID NO: 840309 - DNA, 19 bp, Homo sapiens
gtgcagtgatacatgtact

SEQ ID NO: 840310 - DNA, 22 bp, Homo sapiens
gtgcagttcccccaacctcaga

SEQ ID NO: 840311 - DNA, 19 bp, Homo sapiens
gtgcagttgacagcaggtg

SEQ ID NO: 840312 - DNA, 17 bp, Homo sapiens
gtgcagttgctgtttac

SEQ ID NO: 840313 - DNA, 15 bp, Homo sapiens
gtgcagttttccagg

SEQ ID NO: 840314 - DNA, 13 bp, Homo sapiens
gtgcataccactt

SEQ ID NO: 840315 - DNA, 14 bp, Homo sapiens
gtgcataccacttt

SEQ ID NO: 840316 - DNA, 14 bp, Homo sapiens
gtgcatagcgtcct

SEQ ID NO: 840317 - DNA, 15 bp, Homo sapiens
gtgcatagcgtcctg

SEQ ID NO: 840318 - DNA, 20 bp, Homo sapiens
gtgcatagttgtagacaaag

SEQ ID NO: 840319 - DNA, 22 bp, Homo sapiens
gtgcatagttgtagacaaagta

SEQ ID NO: 840320 - DNA, 12 bp, Homo sapiens
gtgcatataaag

SEQ ID NO: 840321 - DNA, 17 bp, Homo sapiens
gtgcatatttgttactt

SEQ ID NO: 840322 - DNA, 17 bp, Homo sapiens
gtgcatcattactgttc

SEQ ID NO: 840323 - DNA, 12 bp, Homo sapiens
gtgcatcccaga

SEQ ID NO: 840324 - DNA, 13 bp, Homo sapiens
gtgcatcctcctc

SEQ ID NO: 840325 - DNA, 23 bp, Homo sapiens
gtgcatcctcctcagcccccagg

SEQ ID NO: 840326 - DNA, 20 bp, Homo sapiens
gtgcatccttgtaatacctg

SEQ ID NO: 840327 - DNA, 18 bp, Homo sapiens
gtgcatctcagcccacat

SEQ ID NO: 840328 - DNA, 15 bp, Homo sapiens
gtgcatgctctctgc

SEQ ID NO: 840329 - DNA, 16 bp, Homo sapiens
gtgcatgctgtagctg

SEQ ID NO: 840330 - DNA, 20 bp, Homo sapiens
gtgcatgggacccacgaaac

SEQ ID NO: 840331 - DNA, 18 bp, Homo sapiens
gtgcatgggtgaagggag

SEQ ID NO: 840332 - DNA, 17 bp, Homo sapiens
gtgcatgtctgttcttc

SEQ ID NO: 840333 - DNA, 18 bp, Homo sapiens
gtgcatgtgaagcatgct

SEQ ID NO: 840334 - DNA, 19 bp, Homo sapiens
gtgcatgtgagcacatgcg

SEQ ID NO: 840335 - DNA, 14 bp, Homo sapiens
gtgcatgtgtgtgc

SEQ ID NO: 840336 - DNA, 15 bp, Homo sapiens
gtgcatgtgtgtgct

SEQ ID NO: 840337 - DNA, 18 bp, Homo sapiens
gtgcatgtgtgtgctcag

SEQ ID NO: 840338 - DNA, 15 bp, Homo sapiens
gtgcattatctagat

SEQ ID NO: 840339 - DNA, 23 bp, Homo sapiens
gtgcattatctagatactgtatc

SEQ ID NO: 840340 - DNA, 16 bp, Homo sapiens
gtgcattatgtacaca

SEQ ID NO: 840341 - DNA, 20 bp, Homo sapiens
gtgcattctgtttcctcttg

SEQ ID NO: 840342 - DNA, 15 bp, Homo sapiens
gtgcattctttggta

SEQ ID NO: 840343 - DNA, 21 bp, Homo sapiens
gtgcattggaagaccccaccc

SEQ ID NO: 840344 - DNA, 16 bp, Homo sapiens
gtgcatttaaggagat

SEQ ID NO: 840345 - DNA, 22 bp, Homo sapiens
gtgcatttgaggtctgttcttt

SEQ ID NO: 840346 - DNA, 15 bp, Homo sapiens
gtgcatttggtggtt

SEQ ID NO: 840347 - DNA, 20 bp, Homo sapiens
gtgcattttgtttctgtata

SEQ ID NO: 840348 - DNA, 23 bp, Homo sapiens
gtgcatttttaaacttgaaatat

SEQ ID NO: 840349 - DNA, 20 bp, Homo sapiens
gtgcatttttggatcatttt

SEQ ID NO: 840350 - DNA, 16 bp, Homo sapiens
gtgcatttttgtgaaa

SEQ ID NO: 840351 - DNA, 22 bp, Homo sapiens
gtgcatttttgtgaaatgaaaa

SEQ ID NO: 840352 - DNA, 22 bp, Homo sapiens
gtgccaaacaaaaaggttctca

SEQ ID NO: 840353 - DNA, 21 bp, Homo sapiens
gtgccaaatagccccagactg

SEQ ID NO: 840354 - DNA, 18 bp, Homo sapiens
gtgccaaccccacccagc

SEQ ID NO: 840355 - DNA, 20 bp, Homo sapiens
gtgccaaccccacccagctc

SEQ ID NO: 840356 - DNA, 23 bp, Homo sapiens
gtgccaacctgatgccccttccc

SEQ ID NO: 840357 - DNA, 13 bp, Homo sapiens
gtgccaacctgtt

SEQ ID NO: 840358 - DNA, 12 bp, Homo sapiens
gtgccaagcctt

SEQ ID NO: 840359 - DNA, 14 bp, Homo sapiens
gtgccaagccttct

SEQ ID NO: 840360 - DNA, 21 bp, Homo sapiens
gtgccaagggccccaggggca

SEQ ID NO: 840361 - DNA, 17 bp, Homo sapiens
gtgccaatatgtattgt

SEQ ID NO: 840362 - DNA, 19 bp, Homo sapiens
gtgccaatatgtattgtaa

SEQ ID NO: 840363 - DNA, 20 bp, Homo sapiens
gtgccaatatgtattgtaaa

SEQ ID NO: 840364 - DNA, 21 bp, Homo sapiens
gtgccaatttcaagttccaag

SEQ ID NO: 840365 - DNA, 22 bp, Homo sapiens
gtgccacacagtgacttggccc

SEQ ID NO: 840366 - DNA, 16 bp, Homo sapiens
gtgccacagcctgctg

SEQ ID NO: 840367 - DNA, 19 bp, Homo sapiens
gtgccacagcctgctggca

SEQ ID NO: 840368 - DNA, 16 bp, Homo sapiens
gtgccaccatgcctca

SEQ ID NO: 840369 - DNA, 18 bp, Homo sapiens
gtgccacccaccagggcg

SEQ ID NO: 840370 - DNA, 12 bp, Homo sapiens
gtgccacccgca

SEQ ID NO: 840371 - DNA, 20 bp, Homo sapiens
gtgccacccgtaggcagcct

SEQ ID NO: 840372 - DNA, 21 bp, Homo sapiens
gtgccacccgtaggcagcctc

SEQ ID NO: 840373 - DNA, 18 bp, Homo sapiens
gtgccacctatgcctgtg

SEQ ID NO: 840374 - DNA, 13 bp, Homo sapiens
gtgccactccctg

SEQ ID NO: 840375 - DNA, 14 bp, Homo sapiens
gtgccactgacttg

SEQ ID NO: 840376 - DNA, 17 bp, Homo sapiens
gtgccactgccccccga

SEQ ID NO: 840377 - DNA, 22 bp, Homo sapiens
gtgccactgcccgagctggtgc

SEQ ID NO: 840378 - DNA, 23 bp, Homo sapiens
gtgccactgcccgagctggtgca

SEQ ID NO: 840379 - DNA, 15 bp, Homo sapiens
gtgccacttaatgta

SEQ ID NO: 840380 - DNA, 16 bp, Homo sapiens
gtgccagaaggaaggt

SEQ ID NO: 840381 - DNA, 23 bp, Homo sapiens
gtgccagacattgctctcagtgc

SEQ ID NO: 840382 - DNA, 18 bp, Homo sapiens
gtgccagaggtgggcagg

SEQ ID NO: 840383 - DNA, 21 bp, Homo sapiens
gtgccagaggtgggcaggtgg

SEQ ID NO: 840384 - DNA, 22 bp, Homo sapiens
gtgccagaggtgggcaggtggt

SEQ ID NO: 840385 - DNA, 12 bp, Homo sapiens
gtgccagcaact

SEQ ID NO: 840386 - DNA, 22 bp, Homo sapiens
gtgctgaggccttatcattcat

SEQ ID NO: 840387 - DNA, 22 bp, Homo sapiens
gtgctgagtgaccgggggctgc

SEQ ID NO: 840388 - DNA, 15 bp, Homo sapiens
gtgctgataattgtg

SEQ ID NO: 840389 - DNA, 14 bp, Homo sapiens
gtgctgatccggct

SEQ ID NO: 840390 - DNA, 19 bp, Homo sapiens
gtgctgatccggctgctcc

SEQ ID NO: 840391 - DNA, 20 bp, Homo sapiens
gtgctgatccggctgctcct

SEQ ID NO: 840392 - DNA, 20 bp, Homo sapiens
gtgctgatcgtgctaaattt

SEQ ID NO: 840393 - DNA, 16 bp, Homo sapiens
gtgctgatgggaagga

SEQ ID NO: 840394 - DNA, 11 bp, Homo sapiens
gtgctgcagga

SEQ ID NO: 840395 - DNA, 12 bp, Homo sapiens
gtgctgcaggag

SEQ ID NO: 840396 - DNA, 12 bp, Homo sapiens
gtgctgccacac

SEQ ID NO: 840397 - DNA, 13 bp, Homo sapiens
gtgctgccatgcc

SEQ ID NO: 840398 - DNA, 21 bp, Homo sapiens
gtgctgccatttgatttttct

SEQ ID NO: 840399 - DNA, 20 bp, Homo sapiens
gtgctgccccttgcaagcca

SEQ ID NO: 840400 - DNA, 18 bp, Homo sapiens
gtgctgcccgtcttcagc

SEQ ID NO: 840401 - DNA, 12 bp, Homo sapiens
gtgctgcctcta

SEQ ID NO: 840402 - DNA, 15 bp, Homo sapiens
gtgctgctgctgctg

SEQ ID NO: 840403 - DNA, 14 bp, Homo sapiens
gtgctgctgtaaat

SEQ ID NO: 840404 - DNA, 13 bp, Homo sapiens
gtgctgcttctct

SEQ ID NO: 840405 - DNA, 17 bp, Homo sapiens
gtgctgcttgtgcctcc

SEQ ID NO: 840406 - DNA, 19 bp, Homo sapiens
gtgctggaccagctggcct

SEQ ID NO: 840407 - DNA, 11 bp, Homo sapiens
gtgctggactg

SEQ ID NO: 840408 - DNA, 12 bp, Homo sapiens
gtgctggactgt

SEQ ID NO: 840409 - DNA, 14 bp, Homo sapiens
gtgctggaggaact

SEQ ID NO: 840410 - DNA, 14 bp, Homo sapiens
gtgctggcgacact

SEQ ID NO: 840411 - DNA, 17 bp, Homo sapiens
gtgctggcgacactcag

SEQ ID NO: 840412 - DNA, 14 bp, Homo sapiens
gtgctggctcacag

SEQ ID NO: 840413 - DNA, 22 bp, Homo sapiens
gtgctggctcacagtacagcat

SEQ ID NO: 840414 - DNA, 17 bp, Homo sapiens
gtgctgggaaatgcaga

SEQ ID NO: 840415 - DNA, 18 bp, Homo sapiens
gtgctgggaaatgcagaa

SEQ ID NO: 840416 - DNA, 20 bp, Homo sapiens
gtgctgggaaatgcagaaat

SEQ ID NO: 840417 - DNA, 20 bp, Homo sapiens
gtgctgggactgagccagtc

SEQ ID NO: 840418 - DNA, 22 bp, Homo sapiens
gtgctgggagctccactctgct

SEQ ID NO: 840419 - DNA, 19 bp, Homo sapiens
gtgctgggaggagggagag

SEQ ID NO: 840420 - DNA, 22 bp, Homo sapiens
gtgctgggataactggccagcc

SEQ ID NO: 840421 - DNA, 15 bp, Homo sapiens
gtgctgggcactgct

SEQ ID NO: 840422 - DNA, 14 bp, Homo sapiens
gtgctgggcagccc

SEQ ID NO: 840423 - DNA, 18 bp, Homo sapiens
gtgctgggcggctgtgct

SEQ ID NO: 840424 - DNA, 15 bp, Homo sapiens
gtgctgggctggact

SEQ ID NO: 840425 - DNA, 16 bp, Homo sapiens
gtgctgggctggactg

SEQ ID NO: 840426 - DNA, 16 bp, Homo sapiens
gtgctggggccagggc

SEQ ID NO: 840427 - DNA, 23 bp, Homo sapiens
gtgctggggccagggcagatgtg

SEQ ID NO: 840428 - DNA, 16 bp, Homo sapiens
gtgctgggtcccagcc

SEQ ID NO: 840429 - DNA, 17 bp, Homo sapiens
gtgctgggtgcctccca

SEQ ID NO: 840430 - DNA, 19 bp, Homo sapiens
gtgctggtcctaggtcctc

SEQ ID NO: 840431 - DNA, 15 bp, Homo sapiens
gtgctggtgaacact

SEQ ID NO: 840432 - DNA, 14 bp, Homo sapiens
gtgctggtgcatca

SEQ ID NO: 840433 - DNA, 22 bp, Homo sapiens
gtgctggtgggtctgagctgga

SEQ ID NO: 840434 - DNA, 23 bp, Homo sapiens
gtgctggtgggtctgagctggac

SEQ ID NO: 840435 - DNA, 15 bp, Homo sapiens
gtgctggtgtcctga

SEQ ID NO: 840436 - DNA, 20 bp, Homo sapiens
gtgctggtgtcctgaccacc

SEQ ID NO: 840437 - DNA, 18 bp, Homo sapiens
gtgctgtaatattgtaaa

SEQ ID NO: 840438 - DNA, 18 bp, Homo sapiens
gtgctgtacccttccacc

SEQ ID NO: 840439 - DNA, 15 bp, Homo sapiens
gtgctgtatggccca

SEQ ID NO: 840440 - DNA, 15 bp, Homo sapiens
gtgctgtgaccattt

SEQ ID NO: 840441 - DNA, 14 bp, Homo sapiens
gtgctgtgagggag

SEQ ID NO: 840442 - DNA, 15 bp, Homo sapiens
gtgctgtgcctgcta

SEQ ID NO: 840443 - DNA, 14 bp, Homo sapiens
gtgctgtggagaga

SEQ ID NO: 840444 - DNA, 14 bp, Homo sapiens
gtgctgtggccagg

SEQ ID NO: 840445 - DNA, 15 bp, Homo sapiens
gtgctgtggccaggc

SEQ ID NO: 840446 - DNA, 17 bp, Homo sapiens
gtgctgtggccaggcct

SEQ ID NO: 840447 - DNA, 12 bp, Homo sapiens
gtgctgtgggca

SEQ ID NO: 840448 - DNA, 18 bp, Homo sapiens
gtgctgtgggcagcaccc

SEQ ID NO: 840449 - DNA, 15 bp, Homo sapiens
gtgctgtttgaaaat

SEQ ID NO: 840450 - DNA, 16 bp, Homo sapiens
gtgctgttttgttata

SEQ ID NO: 840451 - DNA, 19 bp, Homo sapiens
gtgctgttttgttatataa

SEQ ID NO: 840452 - DNA, 21 bp, Homo sapiens
gtgcttattgatattctaaga

SEQ ID NO: 840453 - DNA, 16 bp, Homo sapiens
gtgcttcaacattctt

SEQ ID NO: 840454 - DNA, 18 bp, Homo sapiens
gtgcttcagagtttgtgt

SEQ ID NO: 840455 - DNA, 13 bp, Homo sapiens
gtgcttcagcctg

SEQ ID NO: 840456 - DNA, 15 bp, Homo sapiens
gtgcttcagcctgag

SEQ ID NO: 840457 - DNA, 19 bp, Homo sapiens
gtgcttcccccacccctcc

SEQ ID NO: 840458 - DNA, 23 bp, Homo sapiens
gtgcttcccccacccctccacgt

SEQ ID NO: 840459 - DNA, 17 bp, Homo sapiens
gtgcttcctcctcaggc

SEQ ID NO: 840460 - DNA, 17 bp, Homo sapiens
gtgcttcgggcccttcc

SEQ ID NO: 840461 - DNA, 18 bp, Homo sapiens
gtgcttctcaccacggga

SEQ ID NO: 840462 - DNA, 14 bp, Homo sapiens
gtgcttgaaggccc

SEQ ID NO: 840463 - DNA, 15 bp, Homo sapiens
gtgcttgaaggccct

SEQ ID NO: 840464 - DNA, 21 bp, Homo sapiens
gtgcttgaaggccctgctgag

SEQ ID NO: 840465 - DNA, 14 bp, Homo sapiens
gtgcttgagccagg

SEQ ID NO: 840466 - DNA, 21 bp, Homo sapiens
gtgcttgcttagagtgcccag

SEQ ID NO: 840467 - DNA, 16 bp, Homo sapiens
gtgcttgggctccacg

SEQ ID NO: 840468 - DNA, 17 bp, Homo sapiens
gtgcttgggctccacgg

SEQ ID NO: 840469 - DNA, 17 bp, Homo sapiens
gtgcttgttagagagaa

SEQ ID NO: 840470 - DNA, 18 bp, Homo sapiens
gtgcttgttagagagaaa

SEQ ID NO: 840471 - DNA, 19 bp, Homo sapiens
gtgctttattgaattagaa

SEQ ID NO: 840472 - DNA, 22 bp, Homo sapiens
gtgctttccgtggcactgcata

SEQ ID NO: 840473 - DNA, 14 bp, Homo sapiens
gtgctttgagaaaa

SEQ ID NO: 840474 - DNA, 18 bp, Homo sapiens
gtgctttttccttttcat

SEQ ID NO: 840475 - DNA, 18 bp, Homo sapiens
gtggaaaaatagcctgcc

SEQ ID NO: 840476 - DNA, 15 bp, Homo sapiens
gtggaaaaccaggaa

SEQ ID NO: 840477 - DNA, 12 bp, Homo sapiens
gtggaaactgtc

SEQ ID NO: 840478 - DNA, 13 bp, Homo sapiens
gtggaaagggtgc

SEQ ID NO: 840479 - DNA, 20 bp, Homo sapiens
gtggaaagggtgctgcttcc

SEQ ID NO: 840480 - DNA, 22 bp, Homo sapiens
gtggaaagggtgctgcttccct

SEQ ID NO: 840481 - DNA, 16 bp, Homo sapiens
gtggaaagtgaatttg

SEQ ID NO: 840482 - DNA, 20 bp, Homo sapiens
gtggaaatcaaccctctcct

SEQ ID NO: 840483 - DNA, 20 bp, Homo sapiens
gtggaacataaaaaggacat

SEQ ID NO: 840484 - DNA, 21 bp, Homo sapiens
gtggaacataaaaaggacatc

SEQ ID NO: 840485 - DNA, 20 bp, Homo sapiens
gtggaacctctgtctcatcc

SEQ ID NO: 840486 - DNA, 24 bp, Homo sapiens
gtggaacctctgtctcatcctcct

SEQ ID NO: 840487 - DNA, 17 bp, Homo sapiens
gtggaagagcagcctga

SEQ ID NO: 840488 - DNA, 14 bp, Homo sapiens
gtggaagccctcct

SEQ ID NO: 840489 - DNA, 16 bp, Homo sapiens
gtggaagccctccttc

SEQ ID NO: 840490 - DNA, 17 bp, Homo sapiens
gtggaagccctccttcc

SEQ ID NO: 840491 - DNA, 15 bp, Homo sapiens
gtggaaggcagacag

SEQ ID NO: 840492 - DNA, 20 bp, Homo sapiens
gtggaaggcagacagcaggc

SEQ ID NO: 840493 - DNA, 20 bp, Homo sapiens
gtggaaggcatcagtcccta

SEQ ID NO: 840494 - DNA, 16 bp, Homo sapiens
gtggaagggggtgtgc

SEQ ID NO: 840495 - DNA, 17 bp, Homo sapiens
gtggaagggggtgtgcg

SEQ ID NO: 840496 - DNA, 18 bp, Homo sapiens
gtggaagggggtgtgcgt

SEQ ID NO: 840497 - DNA, 15 bp, Homo sapiens
gtggaagttcttcaa

SEQ ID NO: 840498 - DNA, 21 bp, Homo sapiens
gtggaagttcttcaagaggaa

SEQ ID NO: 840499 - DNA, 14 bp, Homo sapiens
gtggaatgagtgtg

SEQ ID NO: 840500 - DNA, 18 bp, Homo sapiens
gtggaatgcagtcctcat

SEQ ID NO: 840501 - DNA, 16 bp, Homo sapiens
gtggaatgttggataa

SEQ ID NO: 840502 - DNA, 18 bp, Homo sapiens
gtggaattccaacttgaa

SEQ ID NO: 840503 - DNA, 21 bp, Homo sapiens
gtggacaccaggagtccctgg

SEQ ID NO: 840504 - DNA, 14 bp, Homo sapiens
gtggacaccgctca

SEQ ID NO: 840505 - DNA, 17 bp, Homo sapiens
gtggacaccgctcagta

SEQ ID NO: 840506 - DNA, 14 bp, Homo sapiens
gtggacagtcctgg

SEQ ID NO: 840507 - DNA, 18 bp, Homo sapiens
gtggaccaggacaggacc

SEQ ID NO: 840508 - DNA, 22 bp, Homo sapiens
gtggaccaggaggattgccttt

SEQ ID NO: 840509 - DNA, 17 bp, Homo sapiens
gtggctgacccagtccc

SEQ ID NO: 840510 - DNA, 14 bp, Homo sapiens
gtggctgcctttga

SEQ ID NO: 840511 - DNA, 19 bp, Homo sapiens
gtggctgcgcccccagctt

SEQ ID NO: 840512 - DNA, 18 bp, Homo sapiens
gtggctggcctttcaggt

SEQ ID NO: 840513 - DNA, 21 bp, Homo sapiens
gtggctggcctttcaggtcca

SEQ ID NO: 840514 - DNA, 14 bp, Homo sapiens
gtggctggctcacc

SEQ ID NO: 840515 - DNA, 22 bp, Homo sapiens
gtggctggctctaccttcctgt

SEQ ID NO: 840516 - DNA, 16 bp, Homo sapiens
gtggctgggggcagga

SEQ ID NO: 840517 - DNA, 12 bp, Homo sapiens
gtggctgggtgg

SEQ ID NO: 840518 - DNA, 19 bp, Homo sapiens
gtggctgggtgggcccaga

SEQ ID NO: 840519 - DNA, 13 bp, Homo sapiens
gtggctggtctgg

SEQ ID NO: 840520 - DNA, 17 bp, Homo sapiens
gtggctggtgagacccc

SEQ ID NO: 840521 - DNA, 16 bp, Homo sapiens
gtggctggtgagccgg

SEQ ID NO: 840522 - DNA, 18 bp, Homo sapiens
gtggctggtgcccatgaa

SEQ ID NO: 840523 - DNA, 19 bp, Homo sapiens
gtggctggtgcccatgaag

SEQ ID NO: 840524 - DNA, 13 bp, Homo sapiens
gtggctggtgtcc

SEQ ID NO: 840525 - DNA, 16 bp, Homo sapiens
gtggctggtgtcccct

SEQ ID NO: 840526 - DNA, 20 bp, Homo sapiens
gtggctggtgtccccttccc

SEQ ID NO: 840527 - DNA, 16 bp, Homo sapiens
gtggctgtccctgtgg

SEQ ID NO: 840528 - DNA, 18 bp, Homo sapiens
gtggctgtgacaaccctg

SEQ ID NO: 840529 - DNA, 21 bp, Homo sapiens
gtggctgtgacaaccctggcc

SEQ ID NO: 840530 - DNA, 16 bp, Homo sapiens
gtggctgttcatgctc

SEQ ID NO: 840531 - DNA, 18 bp, Homo sapiens
gtggctgttcatgctcca

SEQ ID NO: 840532 - DNA, 12 bp, Homo sapiens
gtggcttcatgt

SEQ ID NO: 840533 - DNA, 19 bp, Homo sapiens
gtggcttcccgctcagccc

SEQ ID NO: 840534 - DNA, 23 bp, Homo sapiens
gtggcttcccttttctttgttca

SEQ ID NO: 840535 - DNA, 22 bp, Homo sapiens
gtggcttgagaaatatggacac

SEQ ID NO: 840536 - DNA, 14 bp, Homo sapiens
gtggcttgtagaat

SEQ ID NO: 840537 - DNA, 23 bp, Homo sapiens
gtggctttccaggcaccctcagg

SEQ ID NO: 840538 - DNA, 17 bp, Homo sapiens
gtggcttttgccccaga

SEQ ID NO: 840539 - DNA, 19 bp, Homo sapiens
gtgggaaacattagtgaaa

SEQ ID NO: 840540 - DNA, 12 bp, Homo sapiens
gtgggaacattc

SEQ ID NO: 840541 - DNA, 14 bp, Homo sapiens
gtgggaactgtgca

SEQ ID NO: 840542 - DNA, 14 bp, Homo sapiens
gtgggaagaaagaa

SEQ ID NO: 840543 - DNA, 12 bp, Homo sapiens
gtgggaagagaa

SEQ ID NO: 840544 - DNA, 20 bp, Homo sapiens
gtgggaagcccatcctgacc

SEQ ID NO: 840545 - DNA, 15 bp, Homo sapiens
gtgggaaggaaaggc

SEQ ID NO: 840546 - DNA, 23 bp, Homo sapiens
gtgggaaggacttggcgcgccct

SEQ ID NO: 840547 - DNA, 14 bp, Homo sapiens
gtgggaaggccagc

SEQ ID NO: 840548 - DNA, 13 bp, Homo sapiens
gtgggaagggaga

SEQ ID NO: 840549 - DNA, 20 bp, Homo sapiens
gtgggacaaaccagagcaga

SEQ ID NO: 840550 - DNA, 18 bp, Homo sapiens
gtgggacagcccagagcc

SEQ ID NO: 840551 - DNA, 19 bp, Homo sapiens
gtgggaccctgtccggccc

SEQ ID NO: 840552 - DNA, 20 bp, Homo sapiens
gtgggacgggatggttctgg

SEQ ID NO: 840553 - DNA, 20 bp, Homo sapiens
gtgggacggtgcccaagcca

SEQ ID NO: 840554 - DNA, 17 bp, Homo sapiens
gtgggacttggagagca

SEQ ID NO: 840555 - DNA, 23 bp, Homo sapiens
gtgggacttggagagcaaaggcc

SEQ ID NO: 840556 - DNA, 15 bp, Homo sapiens
gtgggagaaggcagt

SEQ ID NO: 840557 - DNA, 14 bp, Homo sapiens
gtgggagacagcag

SEQ ID NO: 840558 - DNA, 17 bp, Homo sapiens
gtgggagacagcagcct

SEQ ID NO: 840559 - DNA, 13 bp, Homo sapiens
gtgggagagccca

SEQ ID NO: 840560 - DNA, 14 bp, Homo sapiens
gtgggagagcccag

SEQ ID NO: 840561 - DNA, 12 bp, Homo sapiens
gtgggagcagct

SEQ ID NO: 840562 - DNA, 20 bp, Homo sapiens
gtgggagcagcttcttgggc

SEQ ID NO: 840563 - DNA, 21 bp, Homo sapiens
gtgggagcagcttcttgggct

SEQ ID NO: 840564 - DNA, 22 bp, Homo sapiens
gtgggagcagcttcttgggctg

SEQ ID NO: 840565 - DNA, 23 bp, Homo sapiens
gtgggagcataggaggggtctgg

SEQ ID NO: 840566 - DNA, 17 bp, Homo sapiens
gtgggagctgaaaagga

SEQ ID NO: 840567 - DNA, 12 bp, Homo sapiens
gtgggagctgag

SEQ ID NO: 840568 - DNA, 19 bp, Homo sapiens
gtgggaggaaagggcctgg

SEQ ID NO: 840569 - DNA, 23 bp, Homo sapiens
gtgggaggatctcttgagcctgg

SEQ ID NO: 840570 - DNA, 13 bp, Homo sapiens
gtgggagggagca

SEQ ID NO: 840571 - DNA, 17 bp, Homo sapiens
gtgggagggcgtcaggc

SEQ ID NO: 840572 - DNA, 14 bp, Homo sapiens
gtgggaggggcagg

SEQ ID NO: 840573 - DNA, 13 bp, Homo sapiens
gtgggagggggag

SEQ ID NO: 840574 - DNA, 17 bp, Homo sapiens
gtgggaggtggaagaag

SEQ ID NO: 840575 - DNA, 17 bp, Homo sapiens
gtgggagtgtgtgcctg

SEQ ID NO: 840576 - DNA, 16 bp, Homo sapiens
gtgggatgaaccagcc

SEQ ID NO: 840577 - DNA, 17 bp, Homo sapiens
gtgggatgaaccagccg

SEQ ID NO: 840578 - DNA, 16 bp, Homo sapiens
gtgggatggaggagaa

SEQ ID NO: 840579 - DNA, 17 bp, Homo sapiens
gtgggatggaggagaag

SEQ ID NO: 840580 - DNA, 16 bp, Homo sapiens
gtgggcaaaggacatg

SEQ ID NO: 840581 - DNA, 13 bp, Homo sapiens
gtgggcacctcag

SEQ ID NO: 840582 - DNA, 19 bp, Homo sapiens
gtgggcagcagcatcccag

SEQ ID NO: 840583 - DNA, 20 bp, Homo sapiens
gtgggcagcagcatcccagc

SEQ ID NO: 840584 - DNA, 14 bp, Homo sapiens
gtgggcagctgagg

SEQ ID NO: 840585 - DNA, 15 bp, Homo sapiens
gtgggcagctgggcc

SEQ ID NO: 840586 - DNA, 17 bp, Homo sapiens
gtgggcagctgggcccc

SEQ ID NO: 840587 - DNA, 21 bp, Homo sapiens
gtgggcaggatctcaagccag

SEQ ID NO: 840588 - DNA, 22 bp, Homo sapiens
gtgggcaggatctcaagccagc

SEQ ID NO: 840589 - DNA, 17 bp, Homo sapiens
gtgggcagggaggggct

SEQ ID NO: 840590 - DNA, 22 bp, Homo sapiens
gtgggcagggaggggctggggc

SEQ ID NO: 840591 - DNA, 24 bp, Homo sapiens
gtgggcagggaggggctggggcag

SEQ ID NO: 840592 - DNA, 14 bp, Homo sapiens
gtgggcaggtggcc

SEQ ID NO: 840593 - DNA, 12 bp, Homo sapiens
gtgggcatggcc

SEQ ID NO: 840594 - DNA, 15 bp, Homo sapiens
gtgggcatggccgct

SEQ ID NO: 840595 - DNA, 19 bp, Homo sapiens
gtgggcatggccgcttcta

SEQ ID NO: 840596 - DNA, 20 bp, Homo sapiens
gtgggcatttcttgcgagcc

SEQ ID NO: 840597 - DNA, 22 bp, Homo sapiens
gtgggccaagtccactgtcctc

SEQ ID NO: 840598 - DNA, 17 bp, Homo sapiens
gtgggccactctcccct

SEQ ID NO: 840599 - DNA, 15 bp, Homo sapiens
gtgggccagagctga

SEQ ID NO: 840600 - DNA, 19 bp, Homo sapiens
gtgggccagcatagggggg

SEQ ID NO: 840601 - DNA, 21 bp, Homo sapiens
gtgggccagcataggggggag

SEQ ID NO: 840602 - DNA, 19 bp, Homo sapiens
gtgggccagccacagagca

SEQ ID NO: 840603 - DNA, 13 bp, Homo sapiens
gtgggccagcccc

SEQ ID NO: 840604 - DNA, 14 bp, Homo sapiens
gtgggccaggacag

SEQ ID NO: 840605 - DNA, 14 bp, Homo sapiens
gtgggccagggctg

SEQ ID NO: 840606 - DNA, 17 bp, Homo sapiens
gtgggccagtgtgggaa

SEQ ID NO: 840607 - DNA, 11 bp, Homo sapiens
gtgggcccagg

SEQ ID NO: 840608 - DNA, 14 bp, Homo sapiens
gtgggcccaggacc

SEQ ID NO: 840609 - DNA, 19 bp, Homo sapiens
gtgggcccaggaccagctg

SEQ ID NO: 840610 - DNA, 22 bp, Homo sapiens
gtgggcccaggaccagctgggg

SEQ ID NO: 840611 - DNA, 23 bp, Homo sapiens
gtgggcccataatagttagccct

SEQ ID NO: 840612 - DNA, 18 bp, Homo sapiens
gtgggccccttagcaatg

SEQ ID NO: 840613 - DNA, 18 bp, Homo sapiens
gtgggccctgcaggctgc

SEQ ID NO: 840614 - DNA, 18 bp, Homo sapiens
gtgggccctgcccgggga

SEQ ID NO: 840615 - DNA, 20 bp, Homo sapiens
gtgggccctgcccggggagc

SEQ ID NO: 840616 - DNA, 19 bp, Homo sapiens
gtgggcctcaaggacttga

SEQ ID NO: 840617 - DNA, 16 bp, Homo sapiens
gtgggcctcacctgcc

SEQ ID NO: 840618 - DNA, 20 bp, Homo sapiens
gtgggcctcctctgtccagg

SEQ ID NO: 840619 - DNA, 15 bp, Homo sapiens
gtgggcctggcctga

SEQ ID NO: 840620 - DNA, 19 bp, Homo sapiens
gtgggcctggcctgagctg

SEQ ID NO: 840621 - DNA, 14 bp, Homo sapiens
gtgggcctggcggc

SEQ ID NO: 840622 - DNA, 16 bp, Homo sapiens
gtgggcgcaaaggtgc

SEQ ID NO: 840623 - DNA, 21 bp, Homo sapiens
gtgggcgcaaaggtgcctcat

SEQ ID NO: 840624 - DNA, 22 bp, Homo sapiens
gtgggcggacaaaagggccagg

SEQ ID NO: 840625 - DNA, 23 bp, Homo sapiens
gtgggcggacaaaagggccaggt

SEQ ID NO: 840626 - DNA, 18 bp, Homo sapiens
gtgggcgttgggagccta

SEQ ID NO: 840627 - DNA, 17 bp, Homo sapiens
gtgggcgtttggggccc

SEQ ID NO: 840628 - DNA, 15 bp, Homo sapiens
gtgggctcccctctt

SEQ ID NO: 840629 - DNA, 14 bp, Homo sapiens
gtgggctccctgac

SEQ ID NO: 840630 - DNA, 13 bp, Homo sapiens
gtgggctgagccc

SEQ ID NO: 840631 - DNA, 15 bp, Homo sapiens
gtgtatatgtataaa

SEQ ID NO: 840632 - DNA, 21 bp, Homo sapiens
gtgtatattatataactcttt

SEQ ID NO: 840633 - DNA, 20 bp, Homo sapiens
gtgtatattggtgtatatta

SEQ ID NO: 840634 - DNA, 14 bp, Homo sapiens
gtgtatcagtgttt

SEQ ID NO: 840635 - DNA, 14 bp, Homo sapiens
gtgtatcattaaaa

SEQ ID NO: 840636 - DNA, 21 bp, Homo sapiens
gtgtatcccccccctgtatag

SEQ ID NO: 840637 - DNA, 20 bp, Homo sapiens
gtgtatcctggccctggggg

SEQ ID NO: 840638 - DNA, 19 bp, Homo sapiens
gtgtatctaaaggatggaa

SEQ ID NO: 840639 - DNA, 16 bp, Homo sapiens
gtgtatgactaaagag

SEQ ID NO: 840640 - DNA, 15 bp, Homo sapiens
gtgtatgagtgcgca

SEQ ID NO: 840641 - DNA, 14 bp, Homo sapiens
gtgtatgctgcttt

SEQ ID NO: 840642 - DNA, 15 bp, Homo sapiens
gtgtatgggggaagg

SEQ ID NO: 840643 - DNA, 22 bp, Homo sapiens
gtgtatgggggaaggcgctggg

SEQ ID NO: 840644 - DNA, 20 bp, Homo sapiens
gtgtatgtatacacacatat

SEQ ID NO: 840645 - DNA, 23 bp, Homo sapiens
gtgtatgtcagtggtttctactt

SEQ ID NO: 840646 - DNA, 16 bp, Homo sapiens
gtgtatgtgcgtgtgt

SEQ ID NO: 840647 - DNA, 18 bp, Homo sapiens
gtgtatgtgtctgctaat

SEQ ID NO: 840648 - DNA, 20 bp, Homo sapiens
gtgtatgtgtctgctaatgt

SEQ ID NO: 840649 - DNA, 15 bp, Homo sapiens
gtgtatgtttcttct

SEQ ID NO: 840650 - DNA, 23 bp, Homo sapiens
gtgtattacaacaatctggagat

SEQ ID NO: 840651 - DNA, 17 bp, Homo sapiens
gtgtattgatgcaatat

SEQ ID NO: 840652 - DNA, 17 bp, Homo sapiens
gtgtatttacgctttga

SEQ ID NO: 840653 - DNA, 21 bp, Homo sapiens
gtgtatttacgctttgattca

SEQ ID NO: 840654 - DNA, 18 bp, Homo sapiens
gtgtatttatttaaaact

SEQ ID NO: 840655 - DNA, 22 bp, Homo sapiens
gtgtatttattttcctccccag

SEQ ID NO: 840656 - DNA, 19 bp, Homo sapiens
gtgtatttccagtgcaatt

SEQ ID NO: 840657 - DNA, 15 bp, Homo sapiens
gtgtatttgtattaa

SEQ ID NO: 840658 - DNA, 22 bp, Homo sapiens
gtgtatttgtattaataaagca

SEQ ID NO: 840659 - DNA, 23 bp, Homo sapiens
gtgtatttgtattaataaagcat

SEQ ID NO: 840660 - DNA, 16 bp, Homo sapiens
gtgtattttcctggat

SEQ ID NO: 840661 - DNA, 17 bp, Homo sapiens
gtgtattttcctggatt

SEQ ID NO: 840662 - DNA, 17 bp, Homo sapiens
gtgtcaaaactggttta

SEQ ID NO: 840663 - DNA, 19 bp, Homo sapiens
gtgtcaactctttgttatt

SEQ ID NO: 840664 - DNA, 17 bp, Homo sapiens
gtgtcaagctgctctga

SEQ ID NO: 840665 - DNA, 18 bp, Homo sapiens
gtgtcaccatgagcacct

SEQ ID NO: 840666 - DNA, 14 bp, Homo sapiens
gtgtcaccctgcag

SEQ ID NO: 840667 - DNA, 17 bp, Homo sapiens
gtgtcaccctgcagagc

SEQ ID NO: 840668 - DNA, 16 bp, Homo sapiens
gtgtcaccctgtgggt

SEQ ID NO: 840669 - DNA, 14 bp, Homo sapiens
gtgtcacctgtgct

SEQ ID NO: 840670 - DNA, 23 bp, Homo sapiens
gtgtcactactcacagtctcttt

SEQ ID NO: 840671 - DNA, 18 bp, Homo sapiens
gtgtcagaataggaaaac

SEQ ID NO: 840672 - DNA, 21 bp, Homo sapiens
gtgtcagcgggtgcaccatgg

SEQ ID NO: 840673 - DNA, 14 bp, Homo sapiens
gtgtcagctgaggc

SEQ ID NO: 840674 - DNA, 18 bp, Homo sapiens
gtgtcagctgaggctggg

SEQ ID NO: 840675 - DNA, 14 bp, Homo sapiens
gtgtcaggcaggtt

SEQ ID NO: 840676 - DNA, 22 bp, Homo sapiens
gtgtcaggcccgtcggagctgc

SEQ ID NO: 840677 - DNA, 23 bp, Homo sapiens
gtgtcaggcccgtcggagctgcc

SEQ ID NO: 840678 - DNA, 17 bp, Homo sapiens
gtgtcaggccctctgcc

SEQ ID NO: 840679 - DNA, 20 bp, Homo sapiens
gtgtcaggccctctgcctgc

SEQ ID NO: 840680 - DNA, 13 bp, Homo sapiens
gtgtcagggatga

SEQ ID NO: 840681 - DNA, 15 bp, Homo sapiens
gtgtcaggtcccagc

SEQ ID NO: 840682 - DNA, 17 bp, Homo sapiens
gtgtcaggtcccagcga

SEQ ID NO: 840683 - DNA, 13 bp, Homo sapiens
gtgtcataaactt

SEQ ID NO: 840684 - DNA, 21 bp, Homo sapiens
gtgtcatataaactcatttat

SEQ ID NO: 840685 - DNA, 13 bp, Homo sapiens
gtgtcatggctga

SEQ ID NO: 840686 - DNA, 16 bp, Homo sapiens
gtgtcatggctgaagt

SEQ ID NO: 840687 - DNA, 17 bp, Homo sapiens
gtgtcatttcattccat

SEQ ID NO: 840688 - DNA, 13 bp, Homo sapiens
gtgtccacctggc

SEQ ID NO: 840689 - DNA, 16 bp, Homo sapiens
gtgtccacctgtgggt

SEQ ID NO: 840690 - DNA, 14 bp, Homo sapiens
gtgtccagcagctg

SEQ ID NO: 840691 - DNA, 19 bp, Homo sapiens
gtgtccagcagctgcgggt

SEQ ID NO: 840692 - DNA, 22 bp, Homo sapiens
gtgtccagcagctgcgggtctg

SEQ ID NO: 840693 - DNA, 14 bp, Homo sapiens
gtgtccaggctctg

SEQ ID NO: 840694 - DNA, 15 bp, Homo sapiens
gtgtccaggctctgg

SEQ ID NO: 840695 - DNA, 21 bp, Homo sapiens
gtgtccaggctctgggcacag

SEQ ID NO: 840696 - DNA, 22 bp, Homo sapiens
gtgtccaggctctgggcacagt

SEQ ID NO: 840697 - DNA, 19 bp, Homo sapiens
gtgtccagggtcctctagc

SEQ ID NO: 840698 - DNA, 21 bp, Homo sapiens
gtgtccataaataaagtttca

SEQ ID NO: 840699 - DNA, 16 bp, Homo sapiens
gtgtccatgtgtgtgc

SEQ ID NO: 840700 - DNA, 22 bp, Homo sapiens
gtgtcccaaaatcccctcagcc

SEQ ID NO: 840701 - DNA, 15 bp, Homo sapiens
gtgtcccagatgctg

SEQ ID NO: 840702 - DNA, 23 bp, Homo sapiens
gtgtcccaggcagcacagtgtgt

SEQ ID NO: 840703 - DNA, 22 bp, Homo sapiens
gtgtccccaacgtcccctccgc

SEQ ID NO: 840704 - DNA, 23 bp, Homo sapiens
gtgtccccccttgaagcaataac

SEQ ID NO: 840705 - DNA, 14 bp, Homo sapiens
gtgtccccctctgt

SEQ ID NO: 840706 - DNA, 21 bp, Homo sapiens
gtgtcccctgacctgtccagg

SEQ ID NO: 840707 - DNA, 14 bp, Homo sapiens
gtgtccctaatgtg

SEQ ID NO: 840708 - DNA, 15 bp, Homo sapiens
gtgtccctggatgtg

SEQ ID NO: 840709 - DNA, 14 bp, Homo sapiens
gtgtccggtccctg

SEQ ID NO: 840710 - DNA, 16 bp, Homo sapiens
gtgtcctaaggcccat

SEQ ID NO: 840711 - DNA, 12 bp, Homo sapiens
gtgtcctcctct

SEQ ID NO: 840712 - DNA, 14 bp, Homo sapiens
gtgtcctcctctga

SEQ ID NO: 840713 - DNA, 21 bp, Homo sapiens
gtgtcctcctctgaggaagca

SEQ ID NO: 840714 - DNA, 16 bp, Homo sapiens
gtgtcctgcctgtctg

SEQ ID NO: 840715 - DNA, 13 bp, Homo sapiens
gtgtcctggtgct

SEQ ID NO: 840716 - DNA, 23 bp, Homo sapiens
gtgtcctggtgctctctgccact

SEQ ID NO: 840717 - DNA, 16 bp, Homo sapiens
gtgtcctgtcctttct

SEQ ID NO: 840718 - DNA, 22 bp, Homo sapiens
gtgtcctgtgctttctgcatgc

SEQ ID NO: 840719 - DNA, 16 bp, Homo sapiens
gtgtccttagaacatt

SEQ ID NO: 840720 - DNA, 12 bp, Homo sapiens
gtgtccttccct

SEQ ID NO: 840721 - DNA, 13 bp, Homo sapiens
gtgtccttccctg

SEQ ID NO: 840722 - DNA, 14 bp, Homo sapiens
gtgtccttccctgc

SEQ ID NO: 840723 - DNA, 23 bp, Homo sapiens
gtgtccttccctgccccaccacg

SEQ ID NO: 840724 - DNA, 15 bp, Homo sapiens
gtgtccttcctccac

SEQ ID NO: 840725 - DNA, 17 bp, Homo sapiens
gtgtccttgcacctgca

SEQ ID NO: 840726 - DNA, 13 bp, Homo sapiens
gtgtcgggccctt

SEQ ID NO: 840727 - DNA, 19 bp, Homo sapiens
gtgtctaggcaggacctgt

SEQ ID NO: 840728 - DNA, 19 bp, Homo sapiens
gtgtctcaaaggagctttc

SEQ ID NO: 840729 - DNA, 20 bp, Homo sapiens
gtgtctcagcctctgccagc

SEQ ID NO: 840730 - DNA, 17 bp, Homo sapiens
gtgtctcccaacatggg

SEQ ID NO: 840731 - DNA, 14 bp, Homo sapiens
gtgtctcccagaac

SEQ ID NO: 840732 - DNA, 17 bp, Homo sapiens
gtgtctctgggcctgtg

SEQ ID NO: 840733 - DNA, 13 bp, Homo sapiens
gtgtctctggtct

SEQ ID NO: 840734 - DNA, 21 bp, Homo sapiens
gtgtctctgtttcctgaaata

SEQ ID NO: 840735 - DNA, 18 bp, Homo sapiens
gtgtctcttttctctttc

SEQ ID NO: 840736 - DNA, 23 bp, Homo sapiens
gtgtctgcattgttattgtggaa

SEQ ID NO: 840737 - DNA, 16 bp, Homo sapiens
gtgtctgccaaacaca

SEQ ID NO: 840738 - DNA, 20 bp, Homo sapiens
gtgtctgccaaacacattta

SEQ ID NO: 840739 - DNA, 20 bp, Homo sapiens
gtgtctggatgatgctgtgc

SEQ ID NO: 840740 - DNA, 23 bp, Homo sapiens
gtgtctggcgttctcaagaatct

SEQ ID NO: 840741 - DNA, 17 bp, Homo sapiens
gtgtctgggagagcctg

SEQ ID NO: 840742 - DNA, 21 bp, Homo sapiens
gtgtctgggagagcctggcaa

SEQ ID NO: 840743 - DNA, 22 bp, Homo sapiens
gtgtctgggagagcctggcaag

SEQ ID NO: 840744 - DNA, 18 bp, Homo sapiens
gtgtctgggtttggccca

SEQ ID NO: 840745 - DNA, 18 bp, Homo sapiens
gtgtctgtaaaagagcct

SEQ ID NO: 840746 - DNA, 22 bp, Homo sapiens
gtgtctgtaggtgtctctgggc

SEQ ID NO: 840747 - DNA, 13 bp, Homo sapiens
gtgtctgtattta

SEQ ID NO: 840748 - DNA, 14 bp, Homo sapiens
gtgtctgtatttat

SEQ ID NO: 840749 - DNA, 14 bp, Homo sapiens
gtgtctgtcacagg

SEQ ID NO: 840750 - DNA, 16 bp, Homo sapiens
gtgtctgtcacaggct

SEQ ID NO: 840751 - DNA, 21 bp, Homo sapiens
gtgtctgtcacaggctgggtc

SEQ ID NO: 840752 - DNA, 14 bp, Homo sapiens
gtgtctgtgccatg

SEQ ID NO: 840753 - DNA, 21 bp, Homo sapiens
gtgtctgtgccctccaaagag

SEQ ID NO: 840754 - DNA, 15 bp, Homo sapiens
gtgtctgtggggagg

SEQ ID NO: 840755 - DNA, 12 bp, Homo sapiens
gtgtcttccata

SEQ ID NO: 840756 - DNA, 18 bp, Homo sapiens
gtgtcttctgttcccaag

SEQ ID NO: 840757 - DNA, 17 bp, Homo sapiens
gtgtcttgggcagagct

SEQ ID NO: 840758 - DNA, 17 bp, Homo sapiens
gtgtctttatagatgta

SEQ ID NO: 840759 - DNA, 15 bp, Homo sapiens
gtgtctttctaagaa

SEQ ID NO: 840760 - DNA, 16 bp, Homo sapiens
gtgtctttctaagaaa

SEQ ID NO: 840761 - DNA, 21 bp, Homo sapiens
gtgtctttgtgattttgagta

SEQ ID NO: 840762 - DNA, 16 bp, Homo sapiens
gtgtctttttttgtat

SEQ ID NO: 840763 - DNA, 13 bp, Homo sapiens
gtgtgaaacaatg

SEQ ID NO: 840764 - DNA, 20 bp, Homo sapiens
gtgtgaaactttcattcctt

SEQ ID NO: 840765 - DNA, 19 bp, Homo sapiens
gtgtgaaatagttctgcca

SEQ ID NO: 840766 - DNA, 23 bp, Homo sapiens
gtgtgaactcaccctgggagcca

SEQ ID NO: 840767 - DNA, 16 bp, Homo sapiens
gtgtgaagaaagccag

SEQ ID NO: 840768 - DNA, 13 bp, Homo sapiens
gtgtgaaggtcct

SEQ ID NO: 840769 - DNA, 13 bp, Homo sapiens
gtgtgaatgaaca

SEQ ID NO: 840770 - DNA, 14 bp, Homo sapiens
gtgtgaatgaacac

SEQ ID NO: 840771 - DNA, 15 bp, Homo sapiens
gtgtgaatgaacact

SEQ ID NO: 840772 - DNA, 11 bp, Homo sapiens
gtgtgaatgta

SEQ ID NO: 840773 - DNA, 23 bp, Homo sapiens
gtgtgaatgtgggcactggccca

SEQ ID NO: 840774 - DNA, 17 bp, Homo sapiens
gtgtgacagtgtatggg

SEQ ID NO: 840775 - DNA, 18 bp, Homo sapiens
gtgtgacatttggagagg

SEQ ID NO: 840776 - DNA, 17 bp, Homo sapiens
gtgtgactactccccca

SEQ ID NO: 840777 - DNA, 15 bp, Homo sapiens
gtgtgagaacttcca

SEQ ID NO: 840778 - DNA, 22 bp, Homo sapiens
gtgtgagaagtgaatgctggga

SEQ ID NO: 840779 - DNA, 22 bp, Homo sapiens
gtgtgagcagggcttgctcctg

SEQ ID NO: 840780 - DNA, 14 bp, Homo sapiens
gtgtgagcagtgga

SEQ ID NO: 840781 - DNA, 13 bp, Homo sapiens
gtgtgagcgtggc

SEQ ID NO: 840782 - DNA, 21 bp, Homo sapiens
gtgtgagcgtggccttgggag

SEQ ID NO: 840783 - DNA, 16 bp, Homo sapiens
gtgtgagtggcagcca

SEQ ID NO: 840784 - DNA, 19 bp, Homo sapiens
gtgtgagtggcagccatgc

SEQ ID NO: 840785 - DNA, 21 bp, Homo sapiens
gtgtgagtggcagccatgcct

SEQ ID NO: 840786 - DNA, 14 bp, Homo sapiens
gtgtgagtgtgaca

SEQ ID NO: 840787 - DNA, 18 bp, Homo sapiens
gtgtgagtgtgacagggc

SEQ ID NO: 840788 - DNA, 14 bp, Homo sapiens
gtgtgagtgtgaga

SEQ ID NO: 840789 - DNA, 15 bp, Homo sapiens
gtgtgagtgtgtgtg

SEQ ID NO: 840790 - DNA, 14 bp, Homo sapiens
gtgtgatcgtctga

SEQ ID NO: 840791 - DNA, 16 bp, Homo sapiens
gtgtgattgacagctt

SEQ ID NO: 840792 - DNA, 21 bp, Homo sapiens
gtgtgattgacagctttgctg

SEQ ID NO: 840793 - DNA, 23 bp, Homo sapiens
gtgtgcaactaactgactctgtt

SEQ ID NO: 840794 - DNA, 14 bp, Homo sapiens
gtgtgcacacccat

SEQ ID NO: 840795 - DNA, 16 bp, Homo sapiens
gtgtgcacgcctgcag

SEQ ID NO: 840796 - DNA, 20 bp, Homo sapiens
gtgtgcacgcctgcaggctg

SEQ ID NO: 840797 - DNA, 22 bp, Homo sapiens
gtgtgcacgcctgcaggctgga

SEQ ID NO: 840798 - DNA, 14 bp, Homo sapiens
gtgtgcactccagc

SEQ ID NO: 840799 - DNA, 22 bp, Homo sapiens
gtgtgcagatcatccgtctgtg

SEQ ID NO: 840800 - DNA, 14 bp, Homo sapiens
gtgtgcagcaacca

SEQ ID NO: 840801 - DNA, 19 bp, Homo sapiens
gtgtgcaggagcctccctg

SEQ ID NO: 840802 - DNA, 12 bp, Homo sapiens
gtgtgcataata

SEQ ID NO: 840803 - DNA, 19 bp, Homo sapiens
gtgtgcatagcgtcctgcc

SEQ ID NO: 840804 - DNA, 20 bp, Homo sapiens
gtgtgcatgtgtgtgctcag

SEQ ID NO: 840805 - DNA, 19 bp, Homo sapiens
gtgtgccgttgctccggcc

SEQ ID NO: 840806 - DNA, 14 bp, Homo sapiens
gtgtgcctgcagcc

SEQ ID NO: 840807 - DNA, 15 bp, Homo sapiens
gtgtgcctgcagccc

SEQ ID NO: 840808 - DNA, 14 bp, Homo sapiens
gtgtgcctgccctg

SEQ ID NO: 840809 - DNA, 23 bp, Homo sapiens
gtgtgcctgccctggagggaggc

SEQ ID NO: 840810 - DNA, 19 bp, Homo sapiens
gtgtgcctggccgcagggc

SEQ ID NO: 840811 - DNA, 23 bp, Homo sapiens
gtgtgcctgggggagttttcctc

SEQ ID NO: 840812 - DNA, 16 bp, Homo sapiens
gtgtgcgcctgagtga

SEQ ID NO: 840813 - DNA, 17 bp, Homo sapiens
gtgtgcggaggcaggag

SEQ ID NO: 840814 - DNA, 15 bp, Homo sapiens
gtgtgctaaaaatga

SEQ ID NO: 840815 - DNA, 20 bp, Homo sapiens
gtgtgctgacaacttagctc

SEQ ID NO: 840816 - DNA, 22 bp, Homo sapiens
gtgtgctgacaacttagctcag

SEQ ID NO: 840817 - DNA, 18 bp, Homo sapiens
gtgtgctgatgtttcctg

SEQ ID NO: 840818 - DNA, 15 bp, Homo sapiens
gtgtgctgctgctgc

SEQ ID NO: 840819 - DNA, 12 bp, Homo sapiens
gtgtgctgggag

SEQ ID NO: 840820 - DNA, 20 bp, Homo sapiens
gtgtgctgtatggcccaggc

SEQ ID NO: 840821 - DNA, 24 bp, Homo sapiens
gtgtgctgtatggcccaggcagcc

SEQ ID NO: 840822 - DNA, 14 bp, Homo sapiens
gtgtgcttctgctc

SEQ ID NO: 840823 - DNA, 16 bp, Homo sapiens
gtgtgctttttttgtg

SEQ ID NO: 840824 - DNA, 22 bp, Homo sapiens
gtgtggaaaaatagctctgtgt

SEQ ID NO: 840825 - DNA, 19 bp, Homo sapiens
gtgtggaaattaagaagaa

SEQ ID NO: 840826 - DNA, 20 bp, Homo sapiens
gtgtggaaattaagaagaaa

SEQ ID NO: 840827 - DNA, 21 bp, Homo sapiens
gtgtggaagttattaacttta

SEQ ID NO: 840828 - DNA, 15 bp, Homo sapiens
gtgtggagcagagct

SEQ ID NO: 840829 - DNA, 15 bp, Homo sapiens
gtgtggattttctac

SEQ ID NO: 840830 - DNA, 17 bp, Homo sapiens
gtgtggcacgcacctgt

SEQ ID NO: 840831 - DNA, 13 bp, Homo sapiens
gtgtggccaacca

SEQ ID NO: 840832 - DNA, 22 bp, Homo sapiens
gtgtggccaaccaggacccagg

SEQ ID NO: 840833 - DNA, 20 bp, Homo sapiens
gtgtggccatcactcagccc

SEQ ID NO: 840834 - DNA, 17 bp, Homo sapiens
gtgtggcctcagccctc

SEQ ID NO: 840835 - DNA, 14 bp, Homo sapiens
gtgtggcctccctg

SEQ ID NO: 840836 - DNA, 15 bp, Homo sapiens
gtgtggcctggtggg

SEQ ID NO: 840837 - DNA, 13 bp, Homo sapiens
gtgtggctgcccc

SEQ ID NO: 840838 - DNA, 18 bp, Homo sapiens
gtgtgggacacctgggag

SEQ ID NO: 840839 - DNA, 22 bp, Homo sapiens
gtgtgggccgtggcttgggctg

SEQ ID NO: 840840 - DNA, 14 bp, Homo sapiens
gtgtgggctgtgtc

SEQ ID NO: 840841 - DNA, 21 bp, Homo sapiens
gtgtggggccatgcctcctca

SEQ ID NO: 840842 - DNA, 16 bp, Homo sapiens
gtgtgggggctgcagc

SEQ ID NO: 840843 - DNA, 19 bp, Homo sapiens
gtgtggggggctgggggag

SEQ ID NO: 840844 - DNA, 23 bp, Homo sapiens
gtgtgggtgatgggactcattgt

SEQ ID NO: 840845 - DNA, 23 bp, Homo sapiens
gtgtgggtgtcctgcctgtctgc

SEQ ID NO: 840846 - DNA, 18 bp, Homo sapiens
gtgtgggtttggttagag

SEQ ID NO: 840847 - DNA, 20 bp, Homo sapiens
gtgtggtgaggggctttctc

SEQ ID NO: 840848 - DNA, 19 bp, Homo sapiens
gtgtggtgcagtgtgaaaa

SEQ ID NO: 840849 - DNA, 16 bp, Homo sapiens
gtgtggtggagccagg

SEQ ID NO: 840850 - DNA, 17 bp, Homo sapiens
gtgtggtggagccaggg

SEQ ID NO: 840851 - DNA, 20 bp, Homo sapiens
gtgtggtggagccagggcct

SEQ ID NO: 840852 - DNA, 15 bp, Homo sapiens
gtgtggtggcctcag

SEQ ID NO: 840853 - DNA, 14 bp, Homo sapiens
gtgtggtggctcat

SEQ ID NO: 840854 - DNA, 23 bp, Homo sapiens
gtgtggtgggttctttggaagga

SEQ ID NO: 840855 - DNA, 15 bp, Homo sapiens
gtgtggtgtcttgcg

SEQ ID NO: 840856 - DNA, 15 bp, Homo sapiens
gtgtgtactctgtcc

SEQ ID NO: 840857 - DNA, 17 bp, Homo sapiens
gtgtgtagacaaatatt

SEQ ID NO: 840858 - DNA, 16 bp, Homo sapiens
gtgtgtagatagtatg

SEQ ID NO: 840859 - DNA, 12 bp, Homo sapiens
gtgtgtatatat

SEQ ID NO: 840860 - DNA, 11 bp, Homo sapiens
gtgtgtattaa

SEQ ID NO: 840861 - DNA, 14 bp, Homo sapiens
gtgtgtattaaaaa

SEQ ID NO: 840862 - DNA, 22 bp, Homo sapiens
gtgtgtattcagaggcagtgat

SEQ ID NO: 840863 - DNA, 21 bp, Homo sapiens
gtgtgtatttgtattaataaa

SEQ ID NO: 840864 - DNA, 12 bp, Homo sapiens
gtgtgtcagagc

SEQ ID NO: 840865 - DNA, 13 bp, Homo sapiens
gtgtgtcagagcc

SEQ ID NO: 840866 - DNA, 16 bp, Homo sapiens
gtgtgtcagagcccag

SEQ ID NO: 840867 - DNA, 18 bp, Homo sapiens
gtgtgtcagagcccaggg

SEQ ID NO: 840868 - DNA, 20 bp, Homo sapiens
gtgtgtcagagcccagggga

SEQ ID NO: 840869 - DNA, 16 bp, Homo sapiens
gtgtgtcaggccctct

SEQ ID NO: 840870 - DNA, 18 bp, Homo sapiens
gtgtgtcaggccctctgc

SEQ ID NO: 840871 - DNA, 20 bp, Homo sapiens
gtgtgtcaggccctctgcct

SEQ ID NO: 840872 - DNA, 16 bp, Homo sapiens
gtgtgtcagggatgag

SEQ ID NO: 840873 - DNA, 19 bp, Homo sapiens
gtgtgtccaaaactgcctc

SEQ ID NO: 840874 - DNA, 21 bp, Homo sapiens
gttacaaactgcaatagagac

SEQ ID NO: 840875 - DNA, 16 bp, Homo sapiens
gttacacaattaattg

SEQ ID NO: 840876 - DNA, 20 bp, Homo sapiens
gttacacattaagtaatcaa

SEQ ID NO: 840877 - DNA, 16 bp, Homo sapiens
gttacacatttttcag

SEQ ID NO: 840878 - DNA, 12 bp, Homo sapiens
gttacacccttt

SEQ ID NO: 840879 - DNA, 22 bp, Homo sapiens
gttacaccctttcttgacaaaa

SEQ ID NO: 840880 - DNA, 16 bp, Homo sapiens
gttacacgtgcctgta

SEQ ID NO: 840881 - DNA, 15 bp, Homo sapiens
gttacagcttcgctg

SEQ ID NO: 840882 - DNA, 15 bp, Homo sapiens
gttacagtgcagaca

SEQ ID NO: 840883 - DNA, 15 bp, Homo sapiens
gttacagttctgtgg

SEQ ID NO: 840884 - DNA, 19 bp, Homo sapiens
gttacataagataaatgtg

SEQ ID NO: 840885 - DNA, 18 bp, Homo sapiens
gttacataaggatgactt

SEQ ID NO: 840886 - DNA, 22 bp, Homo sapiens
gttacatgaagatgttaaaatc

SEQ ID NO: 840887 - DNA, 16 bp, Homo sapiens
gttacatgtttgcacc

SEQ ID NO: 840888 - DNA, 14 bp, Homo sapiens
gttacattaaagcc

SEQ ID NO: 840889 - DNA, 21 bp, Homo sapiens
gttacattaaagccctgtgtt

SEQ ID NO: 840890 - DNA, 13 bp, Homo sapiens
gttacattaatgt

SEQ ID NO: 840891 - DNA, 14 bp, Homo sapiens
gttacattaatgtt

SEQ ID NO: 840892 - DNA, 20 bp, Homo sapiens
gttaccacagcaactgacct

SEQ ID NO: 840893 - DNA, 17 bp, Homo sapiens
gttaccatactgtctct

SEQ ID NO: 840894 - DNA, 18 bp, Homo sapiens
gttaccatgtcactgtgg

SEQ ID NO: 840895 - DNA, 18 bp, Homo sapiens
gttaccattatttaattt

SEQ ID NO: 840896 - DNA, 21 bp, Homo sapiens
gttaccattttaacgctgcct

SEQ ID NO: 840897 - DNA, 22 bp, Homo sapiens
gttaccattttaacgctgccta

SEQ ID NO: 840898 - DNA, 16 bp, Homo sapiens
gttacccactgccatg

SEQ ID NO: 840899 - DNA, 17 bp, Homo sapiens
gttacccactgccatgc

SEQ ID NO: 840900 - DNA, 13 bp, Homo sapiens
gttacccagagaa

SEQ ID NO: 840901 - DNA, 20 bp, Homo sapiens
gttacccaggctggagtgca

SEQ ID NO: 840902 - DNA, 17 bp, Homo sapiens
gttaccctcctgtaaat

SEQ ID NO: 840903 - DNA, 14 bp, Homo sapiens
gttaccgagacatg

SEQ ID NO: 840904 - DNA, 15 bp, Homo sapiens
gttaccgagtatctg

SEQ ID NO: 840905 - DNA, 16 bp, Homo sapiens
gttacctactttgact

SEQ ID NO: 840906 - DNA, 17 bp, Homo sapiens
gttacctcctataaact

SEQ ID NO: 840907 - DNA, 22 bp, Homo sapiens
gttacctgaaaacactgtgcac

SEQ ID NO: 840908 - DNA, 23 bp, Homo sapiens
gttacgcacacgtacttaaatga

SEQ ID NO: 840909 - DNA, 22 bp, Homo sapiens
gttacggcatcacacttatatt

SEQ ID NO: 840910 - DNA, 17 bp, Homo sapiens
gttactaactaaactct

SEQ ID NO: 840911 - DNA, 15 bp, Homo sapiens
gttactaccctcacc

SEQ ID NO: 840912 - DNA, 13 bp, Homo sapiens
gttactactgatt

SEQ ID NO: 840913 - DNA, 18 bp, Homo sapiens
gttactatgtatgttttt

SEQ ID NO: 840914 - DNA, 17 bp, Homo sapiens
gttactcagatataaga

SEQ ID NO: 840915 - DNA, 14 bp, Homo sapiens
gttactcagccctg

SEQ ID NO: 840916 - DNA, 15 bp, Homo sapiens
gttactcagccctgg

SEQ ID NO: 840917 - DNA, 16 bp, Homo sapiens
gttactctaaatagaa

SEQ ID NO: 840918 - DNA, 17 bp, Homo sapiens
gttactctccaacctgg

SEQ ID NO: 840919 - DNA, 15 bp, Homo sapiens
gttactgagatgttt

SEQ ID NO: 840920 - DNA, 12 bp, Homo sapiens
gttactgagtga

SEQ ID NO: 840921 - DNA, 20 bp, Homo sapiens
gttactgctgattcttgtaa

SEQ ID NO: 840922 - DNA, 22 bp, Homo sapiens
gttactgctgattcttgtaaat

SEQ ID NO: 840923 - DNA, 14 bp, Homo sapiens
gttactgctttgca

SEQ ID NO: 840924 - DNA, 19 bp, Homo sapiens
gttactggcacctgaaatt

SEQ ID NO: 840925 - DNA, 22 bp, Homo sapiens
gttactggcacctgaaattaat

SEQ ID NO: 840926 - DNA, 14 bp, Homo sapiens
gttacttctgaggt

SEQ ID NO: 840927 - DNA, 19 bp, Homo sapiens
gttacttgaaataccagtg

SEQ ID NO: 840928 - DNA, 18 bp, Homo sapiens
gttacttgtctgaggcct

SEQ ID NO: 840929 - DNA, 19 bp, Homo sapiens
gttacttgtctgaggcctc

SEQ ID NO: 840930 - DNA, 20 bp, Homo sapiens
gttactttctttcagatgtt

SEQ ID NO: 840931 - DNA, 15 bp, Homo sapiens
gttagaatgcaagca

SEQ ID NO: 840932 - DNA, 20 bp, Homo sapiens
gttagagaactaaactagtt

SEQ ID NO: 840933 - DNA, 23 bp, Homo sapiens
gttagagagggaccatgtgtcac

SEQ ID NO: 840934 - DNA, 20 bp, Homo sapiens
gttagagaggtagcgagctg

SEQ ID NO: 840935 - DNA, 21 bp, Homo sapiens
gttagagaggtagcgagctgc

SEQ ID NO: 840936 - DNA, 22 bp, Homo sapiens
gttagagaggtagcgagctgct

SEQ ID NO: 840937 - DNA, 20 bp, Homo sapiens
gttagatgctgaatatctgt

SEQ ID NO: 840938 - DNA, 11 bp, Homo sapiens
gttagatgttt

SEQ ID NO: 840939 - DNA, 13 bp, Homo sapiens
gttagattaagaa

SEQ ID NO: 840940 - DNA, 18 bp, Homo sapiens
gttagcactgatagtcct

SEQ ID NO: 840941 - DNA, 20 bp, Homo sapiens
gttagcactgatagtccttt

SEQ ID NO: 840942 - DNA, 16 bp, Homo sapiens
gttagcactgttgatg

SEQ ID NO: 840943 - DNA, 21 bp, Homo sapiens
gttagcactgttgatgtatct

SEQ ID NO: 840944 - DNA, 21 bp, Homo sapiens
gttagcagagtctgtctcttg

SEQ ID NO: 840945 - DNA, 18 bp, Homo sapiens
gttagcatgtatgaatgt

SEQ ID NO: 840946 - DNA, 13 bp, Homo sapiens
gttagccctcagt

SEQ ID NO: 840947 - DNA, 21 bp, Homo sapiens
gttaggaaaaccacaaacgga

SEQ ID NO: 840948 - DNA, 14 bp, Homo sapiens
gttaggaaataaaa

SEQ ID NO: 840949 - DNA, 22 bp, Homo sapiens
gttaggaaataaaacctttcaa

SEQ ID NO: 840950 - DNA, 23 bp, Homo sapiens
gttaggaaataaaacctttcaaa

SEQ ID NO: 840951 - DNA, 19 bp, Homo sapiens
gttaggaggctgcatgctc

SEQ ID NO: 840952 - DNA, 13 bp, Homo sapiens
gttaggaggtcct

SEQ ID NO: 840953 - DNA, 20 bp, Homo sapiens
gttaggagtgggtgacaaga

SEQ ID NO: 840954 - DNA, 23 bp, Homo sapiens
gttaggatttaacagtcatttaa

SEQ ID NO: 840955 - DNA, 22 bp, Homo sapiens
gttagggagatgagttgcagtt

SEQ ID NO: 840956 - DNA, 13 bp, Homo sapiens
gttagggaggggt

SEQ ID NO: 840957 - DNA, 20 bp, Homo sapiens
gttaggtggccgctcctccc

SEQ ID NO: 840958 - DNA, 20 bp, Homo sapiens
gttagtaatctgtataatac

SEQ ID NO: 840959 - DNA, 17 bp, Homo sapiens
gttagtatgaggcattt

SEQ ID NO: 840960 - DNA, 18 bp, Homo sapiens
gttagtcattgatagaac

SEQ ID NO: 840961 - DNA, 22 bp, Homo sapiens
gttagtcatttgctgagcatgt

SEQ ID NO: 840962 - DNA, 21 bp, Homo sapiens
gttagtgtgtgtgcatgtgtg

SEQ ID NO: 840963 - DNA, 17 bp, Homo sapiens
gttagttaaaagcccat

SEQ ID NO: 840964 - DNA, 22 bp, Homo sapiens
gttagttaccttatagttactg

SEQ ID NO: 840965 - DNA, 17 bp, Homo sapiens
gttagttatagatgtct

SEQ ID NO: 840966 - DNA, 19 bp, Homo sapiens
gttagttatagatgtctag

SEQ ID NO: 840967 - DNA, 22 bp, Homo sapiens
gttagtttagtgtgtgtgcaga

SEQ ID NO: 840968 - DNA, 16 bp, Homo sapiens
gttagtttgtatatat

SEQ ID NO: 840969 - DNA, 17 bp, Homo sapiens
gttagtttgtatatatt

SEQ ID NO: 840970 - DNA, 11 bp, Homo sapiens
gttagttttgt

SEQ ID NO: 840971 - DNA, 11 bp, Homo sapiens
gttataaaatt

SEQ ID NO: 840972 - DNA, 21 bp, Homo sapiens
gttataacttaatgaaaacaa

SEQ ID NO: 840973 - DNA, 14 bp, Homo sapiens
gttataataactga

SEQ ID NO: 840974 - DNA, 18 bp, Homo sapiens
gttataataactgaactg

SEQ ID NO: 840975 - DNA, 12 bp, Homo sapiens
gttataattttt

SEQ ID NO: 840976 - DNA, 12 bp, Homo sapiens
gttatacaataa

SEQ ID NO: 840977 - DNA, 20 bp, Homo sapiens
gttatacagttataaaatta

SEQ ID NO: 840978 - DNA, 19 bp, Homo sapiens
gttatactgtcggtttttt

SEQ ID NO: 840979 - DNA, 23 bp, Homo sapiens
gttatagaatacttttttctagt

SEQ ID NO: 840980 - DNA, 22 bp, Homo sapiens
gttatagtgtttaactggcatg

SEQ ID NO: 840981 - DNA, 18 bp, Homo sapiens
gttatatatctcttttgg

SEQ ID NO: 840982 - DNA, 14 bp, Homo sapiens
gttatatcaacaga

SEQ ID NO: 840983 - DNA, 16 bp, Homo sapiens
gttatatcatatgtat

SEQ ID NO: 840984 - DNA, 17 bp, Homo sapiens
gttatatgtacagttta

SEQ ID NO: 840985 - DNA, 14 bp, Homo sapiens
gttatattcacagt

SEQ ID NO: 840986 - DNA, 23 bp, Homo sapiens
gttatattccaaggaaaattgaa

SEQ ID NO: 840987 - DNA, 12 bp, Homo sapiens
gttatatttcag

SEQ ID NO: 840988 - DNA, 23 bp, Homo sapiens
gttatatttcagatgtaatgttt

SEQ ID NO: 840989 - DNA, 14 bp, Homo sapiens
gttatattttgcag

SEQ ID NO: 840990 - DNA, 20 bp, Homo sapiens
gttatatttttgtgttttct

SEQ ID NO: 840991 - DNA, 21 bp, Homo sapiens
gttatcaaccaactgcacaat

SEQ ID NO: 840992 - DNA, 21 bp, Homo sapiens
gttatcacctaagcacttcta

SEQ ID NO: 840993 - DNA, 16 bp, Homo sapiens
gttatcactgtgcagt

SEQ ID NO: 840994 - DNA, 15 bp, Homo sapiens
gttatcactttaagt

SEQ ID NO: 840995 - DNA, 20 bp, Homo sapiens
gttcagaggcagcaccacca

SEQ ID NO: 840996 - DNA, 19 bp, Homo sapiens
gttcagagtggctcactgg

SEQ ID NO: 840997 - DNA, 22 bp, Homo sapiens
gttcagcaaactaaccagcatt

SEQ ID NO: 840998 - DNA, 16 bp, Homo sapiens
gttcagcaccacccta

SEQ ID NO: 840999 - DNA, 17 bp, Homo sapiens
gttcagcaccaccctag

SEQ ID NO: 841000 - DNA, 15 bp, Homo sapiens
gttcagcactgtccc

SEQ ID NO: 841001 - DNA, 12 bp, Homo sapiens
gttcagcagaac

SEQ ID NO: 841002 - DNA, 23 bp, Homo sapiens
gttcagccaccctgaggcctctg

SEQ ID NO: 841003 - DNA, 14 bp, Homo sapiens
gttcagcccctcct

SEQ ID NO: 841004 - DNA, 19 bp, Homo sapiens
gttcagcccctcctctgcc

SEQ ID NO: 841005 - DNA, 20 bp, Homo sapiens
gttcagcccctcctctgcca

SEQ ID NO: 841006 - DNA, 23 bp, Homo sapiens
gttcagcccctcctctgccacct

SEQ ID NO: 841007 - DNA, 20 bp, Homo sapiens
gttcagcccctgatctctga

SEQ ID NO: 841008 - DNA, 22 bp, Homo sapiens
gttcagcccctgatctctgacc

SEQ ID NO: 841009 - DNA, 18 bp, Homo sapiens
gttcagccttcgtgtggc

SEQ ID NO: 841010 - DNA, 19 bp, Homo sapiens
gttcagctaagctaggaat

SEQ ID NO: 841011 - DNA, 21 bp, Homo sapiens
gttcagcttcctgctgctggg

SEQ ID NO: 841012 - DNA, 18 bp, Homo sapiens
gttcaggagtcccaagga

SEQ ID NO: 841013 - DNA, 14 bp, Homo sapiens
gttcaggctctgag

SEQ ID NO: 841014 - DNA, 15 bp, Homo sapiens
gttcaggctctgaga

SEQ ID NO: 841015 - DNA, 23 bp, Homo sapiens
gttcagggaactgcttgcccagg

SEQ ID NO: 841016 - DNA, 18 bp, Homo sapiens
gttcaggggactcagccc

SEQ ID NO: 841017 - DNA, 22 bp, Homo sapiens
gttcaggtcccacgtctggcca

SEQ ID NO: 841018 - DNA, 15 bp, Homo sapiens
gttcagtagaattac

SEQ ID NO: 841019 - DNA, 17 bp, Homo sapiens
gttcagtagatttcctt

SEQ ID NO: 841020 - DNA, 13 bp, Homo sapiens
gttcagtgctttt

SEQ ID NO: 841021 - DNA, 17 bp, Homo sapiens
gttcagtgttaagtgat

SEQ ID NO: 841022 - DNA, 17 bp, Homo sapiens
gttcagttgccactaag

SEQ ID NO: 841023 - DNA, 17 bp, Homo sapiens
gttcataataaaagtga

SEQ ID NO: 841024 - DNA, 16 bp, Homo sapiens
gttcatacatttgagg

SEQ ID NO: 841025 - DNA, 17 bp, Homo sapiens
gttcatacgcatcccat

SEQ ID NO: 841026 - DNA, 18 bp, Homo sapiens
gttcatcaccatttcctc

SEQ ID NO: 841027 - DNA, 20 bp, Homo sapiens
gttcatcaccatttcctcct

SEQ ID NO: 841028 - DNA, 16 bp, Homo sapiens
gttcatcagtgttaaa

SEQ ID NO: 841029 - DNA, 14 bp, Homo sapiens
gttcatcatccaga

SEQ ID NO: 841030 - DNA, 21 bp, Homo sapiens
gttcatcatccagatgtggct

SEQ ID NO: 841031 - DNA, 20 bp, Homo sapiens
gttcatccaatcctcactgg

SEQ ID NO: 841032 - DNA, 16 bp, Homo sapiens
gttcatgcagctgtgg

SEQ ID NO: 841033 - DNA, 12 bp, Homo sapiens
gttcatgtagag

SEQ ID NO: 841034 - DNA, 16 bp, Homo sapiens
gttcattaaagcatga

SEQ ID NO: 841035 - DNA, 16 bp, Homo sapiens
gttcattagaaatatt

SEQ ID NO: 841036 - DNA, 20 bp, Homo sapiens
gttcattataatctcaaagg

SEQ ID NO: 841037 - DNA, 20 bp, Homo sapiens
gttcattcaagctatttaat

SEQ ID NO: 841038 - DNA, 16 bp, Homo sapiens
gttcattgcctttcca

SEQ ID NO: 841039 - DNA, 20 bp, Homo sapiens
gttcattgtaatgttactga

SEQ ID NO: 841040 - DNA, 22 bp, Homo sapiens
gttcattgtaatgttactgatc

SEQ ID NO: 841041 - DNA, 15 bp, Homo sapiens
gttcatttagataat

SEQ ID NO: 841042 - DNA, 20 bp, Homo sapiens
gttcatttggtgttcctgga

SEQ ID NO: 841043 - DNA, 13 bp, Homo sapiens
gttcattttgagt

SEQ ID NO: 841044 - DNA, 13 bp, Homo sapiens
gttccaagacatt

SEQ ID NO: 841045 - DNA, 16 bp, Homo sapiens
gttccaagacattgtc

SEQ ID NO: 841046 - DNA, 21 bp, Homo sapiens
gttccaagacattgtcaataa

SEQ ID NO: 841047 - DNA, 15 bp, Homo sapiens
gttccaccccaagag

SEQ ID NO: 841048 - DNA, 14 bp, Homo sapiens
gttccacctgccac

SEQ ID NO: 841049 - DNA, 15 bp, Homo sapiens
gttccacctgccaca

SEQ ID NO: 841050 - DNA, 13 bp, Homo sapiens
gttccactgagac

SEQ ID NO: 841051 - DNA, 14 bp, Homo sapiens
gttccactgagacc

SEQ ID NO: 841052 - DNA, 14 bp, Homo sapiens
gttccagaaagtaa

SEQ ID NO: 841053 - DNA, 21 bp, Homo sapiens
gttccagaacagccctcggcc

SEQ ID NO: 841054 - DNA, 14 bp, Homo sapiens
gttccagacattct

SEQ ID NO: 841055 - DNA, 22 bp, Homo sapiens
gttccagactcaggttccagaa

SEQ ID NO: 841056 - DNA, 18 bp, Homo sapiens
gttccagaggtattcctc

SEQ ID NO: 841057 - DNA, 19 bp, Homo sapiens
gttccagattcctatgatg

SEQ ID NO: 841058 - DNA, 20 bp, Homo sapiens
gttccagcagcagaatggaa

SEQ ID NO: 841059 - DNA, 14 bp, Homo sapiens
gttccagctctttg

SEQ ID NO: 841060 - DNA, 17 bp, Homo sapiens
gttccaggccctccagt

SEQ ID NO: 841061 - DNA, 21 bp, Homo sapiens
gttccaggcctgatcttgcct

SEQ ID NO: 841062 - DNA, 15 bp, Homo sapiens
gttccagtttctcct

SEQ ID NO: 841063 - DNA, 18 bp, Homo sapiens
gttccatagaaaaggcgt

SEQ ID NO: 841064 - DNA, 19 bp, Homo sapiens
gttccatgcagccttgggg

SEQ ID NO: 841065 - DNA, 14 bp, Homo sapiens
gttccatgcctgag

SEQ ID NO: 841066 - DNA, 20 bp, Homo sapiens
gttccatgttctatttttga

SEQ ID NO: 841067 - DNA, 21 bp, Homo sapiens
gttccattgaagccgactctg

SEQ ID NO: 841068 - DNA, 18 bp, Homo sapiens
gttccatttttcctctgt

SEQ ID NO: 841069 - DNA, 12 bp, Homo sapiens
gttcccaactga

SEQ ID NO: 841070 - DNA, 21 bp, Homo sapiens
gttcccacccaagccctcctt

SEQ ID NO: 841071 - DNA, 14 bp, Homo sapiens
gttcccacttggag

SEQ ID NO: 841072 - DNA, 21 bp, Homo sapiens
gttcccagtgacacttcagag

SEQ ID NO: 841073 - DNA, 19 bp, Homo sapiens
gttcccatgtagccccctg

SEQ ID NO: 841074 - DNA, 22 bp, Homo sapiens
gttccccacacagggcactgac

SEQ ID NO: 841075 - DNA, 11 bp, Homo sapiens
gttccccaccc

SEQ ID NO: 841076 - DNA, 13 bp, Homo sapiens
gttccccacccct

SEQ ID NO: 841077 - DNA, 22 bp, Homo sapiens
gttccccatccctgtcattttt

SEQ ID NO: 841078 - DNA, 19 bp, Homo sapiens
gttccccatctgggtcctt

SEQ ID NO: 841079 - DNA, 14 bp, Homo sapiens
gttcccccagccct

SEQ ID NO: 841080 - DNA, 15 bp, Homo sapiens
gttcccccagccctg

SEQ ID NO: 841081 - DNA, 16 bp, Homo sapiens
gttcccccagccctgt

SEQ ID NO: 841082 - DNA, 16 bp, Homo sapiens
gttcccccagcctgcc

SEQ ID NO: 841083 - DNA, 13 bp, Homo sapiens
gttcccctcactg

SEQ ID NO: 841084 - DNA, 12 bp, Homo sapiens
gttcccctctcc

SEQ ID NO: 841085 - DNA, 16 bp, Homo sapiens
gttcccctctcccttc

SEQ ID NO: 841086 - DNA, 20 bp, Homo sapiens
gttcccctctcccttccctc

SEQ ID NO: 841087 - DNA, 12 bp, Homo sapiens
gttcccctggcc

SEQ ID NO: 841088 - DNA, 15 bp, Homo sapiens
gttcccctgttcact

SEQ ID NO: 841089 - DNA, 18 bp, Homo sapiens
gttcccctgttcactcta

SEQ ID NO: 841090 - DNA, 13 bp, Homo sapiens
gttccccttggct

SEQ ID NO: 841091 - DNA, 14 bp, Homo sapiens
gttcccgagggagc

SEQ ID NO: 841092 - DNA, 22 bp, Homo sapiens
gttcccgagggagctgctggct

SEQ ID NO: 841093 - DNA, 18 bp, Homo sapiens
gttcccggagcacagccc

SEQ ID NO: 841094 - DNA, 16 bp, Homo sapiens
gttcccgtttctccac

SEQ ID NO: 841095 - DNA, 21 bp, Homo sapiens
gttccctaggggacacttccc

SEQ ID NO: 841096 - DNA, 15 bp, Homo sapiens
gttccctcctgccca

SEQ ID NO: 841097 - DNA, 16 bp, Homo sapiens
gttccctcctggtcct

SEQ ID NO: 841098 - DNA, 12 bp, Homo sapiens
gttccctctgag

SEQ ID NO: 841099 - DNA, 16 bp, Homo sapiens
gttccctctgctcctg

SEQ ID NO: 841100 - DNA, 15 bp, Homo sapiens
gttccctctggcttc

SEQ ID NO: 841101 - DNA, 16 bp, Homo sapiens
gttccctctggcttcc

SEQ ID NO: 841102 - DNA, 18 bp, Homo sapiens
gttccctctggcttccca

SEQ ID NO: 841103 - DNA, 17 bp, Homo sapiens
gttccctgaaaacccag

SEQ ID NO: 841104 - DNA, 20 bp, Homo sapiens
gttccctgaaaacccagaga

SEQ ID NO: 841105 - DNA, 21 bp, Homo sapiens
gttccctgaaaacccagagag

SEQ ID NO: 841106 - DNA, 11 bp, Homo sapiens
gttccctgcac

SEQ ID NO: 841107 - DNA, 15 bp, Homo sapiens
gttccctgcaccctg

SEQ ID NO: 841108 - DNA, 17 bp, Homo sapiens
gttccctgcaccctgga

SEQ ID NO: 841109 - DNA, 16 bp, Homo sapiens
gttccctgtcagaggc

SEQ ID NO: 841110 - DNA, 20 bp, Homo sapiens
gttccctgtcagaggctaag

SEQ ID NO: 841111 - DNA, 17 bp, Homo sapiens
gttccctgttcttcctc

SEQ ID NO: 841112 - DNA, 18 bp, Homo sapiens
gttccctgttcttcctcc

SEQ ID NO: 841113 - DNA, 15 bp, Homo sapiens
gttcccttcctcttc

SEQ ID NO: 841114 - DNA, 19 bp, Homo sapiens
gttcccttcctcttcctgc

SEQ ID NO: 841115 - DNA, 21 bp, Homo sapiens
gttcccttcctcttcctgccc

SEQ ID NO: 841116 - DNA, 22 bp, Homo sapiens
gttcccttcctcttcctgccct

SEQ ID NO: 841117 - DNA, 15 bp, Homo sapiens
gttctcttctctctt

SEQ ID NO: 841118 - DNA, 15 bp, Homo sapiens
gttctctttaaaata

SEQ ID NO: 841119 - DNA, 14 bp, Homo sapiens
gttctctttggaaa

SEQ ID NO: 841120 - DNA, 14 bp, Homo sapiens
gttctgaaattaaa

SEQ ID NO: 841121 - DNA, 17 bp, Homo sapiens
gttctgaatttcctttt

SEQ ID NO: 841122 - DNA, 16 bp, Homo sapiens
gttctgacattaacag

SEQ ID NO: 841123 - DNA, 17 bp, Homo sapiens
gttctgacattaacagt

SEQ ID NO: 841124 - DNA, 21 bp, Homo sapiens
gttctgacattaacagttttc

SEQ ID NO: 841125 - DNA, 20 bp, Homo sapiens
gttctgagaactgactttct

SEQ ID NO: 841126 - DNA, 20 bp, Homo sapiens
gttctgagctgtaatttcgc

SEQ ID NO: 841127 - DNA, 20 bp, Homo sapiens
gttctgagtaagtgtgttca

SEQ ID NO: 841128 - DNA, 14 bp, Homo sapiens
gttctgattagaaa

SEQ ID NO: 841129 - DNA, 22 bp, Homo sapiens
gttctgcaaaaatatttataaa

SEQ ID NO: 841130 - DNA, 15 bp, Homo sapiens
gttctgcaaatagaa

SEQ ID NO: 841131 - DNA, 19 bp, Homo sapiens
gttctgcaaatagaaaaca

SEQ ID NO: 841132 - DNA, 18 bp, Homo sapiens
gttctgcaagaattaaaa

SEQ ID NO: 841133 - DNA, 21 bp, Homo sapiens
gttctgcaagaattaaaactg

SEQ ID NO: 841134 - DNA, 23 bp, Homo sapiens
gttctgcaagaattaaaactgag

SEQ ID NO: 841135 - DNA, 20 bp, Homo sapiens
gttctgcccacgatcccctc

SEQ ID NO: 841136 - DNA, 16 bp, Homo sapiens
gttctgcccccagccc

SEQ ID NO: 841137 - DNA, 12 bp, Homo sapiens
gttctgccctgc

SEQ ID NO: 841138 - DNA, 17 bp, Homo sapiens
gttctgccctgcctgag

SEQ ID NO: 841139 - DNA, 11 bp, Homo sapiens
gttctgcctct

SEQ ID NO: 841140 - DNA, 18 bp, Homo sapiens
gttctgctagagcagaca

SEQ ID NO: 841141 - DNA, 20 bp, Homo sapiens
gttctgctagagcagacagg

SEQ ID NO: 841142 - DNA, 18 bp, Homo sapiens
gttctgctcatcattctc

SEQ ID NO: 841143 - DNA, 14 bp, Homo sapiens
gttctgctcctctc

SEQ ID NO: 841144 - DNA, 15 bp, Homo sapiens
gttctgctcctctcc

SEQ ID NO: 841145 - DNA, 16 bp, Homo sapiens
gttctgctcctctcca

SEQ ID NO: 841146 - DNA, 19 bp, Homo sapiens
gttctgctcctctccaggc

SEQ ID NO: 841147 - DNA, 14 bp, Homo sapiens
gttctgctcctgct

SEQ ID NO: 841148 - DNA, 22 bp, Homo sapiens
gttctgctctggttgtttctgt

SEQ ID NO: 841149 - DNA, 16 bp, Homo sapiens
gttctgctggcctgga

SEQ ID NO: 841150 - DNA, 22 bp, Homo sapiens
gttctggactacacccaagcct

SEQ ID NO: 841151 - DNA, 12 bp, Homo sapiens
gttctggcagga

SEQ ID NO: 841152 - DNA, 13 bp, Homo sapiens
gttctggccagaa

SEQ ID NO: 841153 - DNA, 15 bp, Homo sapiens
gttctggctgtggtc

SEQ ID NO: 841154 - DNA, 11 bp, Homo sapiens
gttctgggctg

SEQ ID NO: 841155 - DNA, 17 bp, Homo sapiens
gttctggggcatcagcc

SEQ ID NO: 841156 - DNA, 14 bp, Homo sapiens
gttctggggcccct

SEQ ID NO: 841157 - DNA, 16 bp, Homo sapiens
gttctgggttttctga

SEQ ID NO: 841158 - DNA, 16 bp, Homo sapiens
gttctggtatttcccc

SEQ ID NO: 841159 - DNA, 14 bp, Homo sapiens
gttctggttccatt

SEQ ID NO: 841160 - DNA, 21 bp, Homo sapiens
gttctgtaatggaactgaccc

SEQ ID NO: 841161 - DNA, 16 bp, Homo sapiens
gttctgtattttaaga

SEQ ID NO: 841162 - DNA, 18 bp, Homo sapiens
gttctgtctggtgcccct

SEQ ID NO: 841163 - DNA, 15 bp, Homo sapiens
gttctgtgaagagga

SEQ ID NO: 841164 - DNA, 11 bp, Homo sapiens
gttctgtgcac

SEQ ID NO: 841165 - DNA, 17 bp, Homo sapiens
gttctgtgcctcccccc

SEQ ID NO: 841166 - DNA, 23 bp, Homo sapiens
gttctgtgggggtcatcagggag

SEQ ID NO: 841167 - DNA, 21 bp, Homo sapiens
gttctgtggtttcatgttagt

SEQ ID NO: 841168 - DNA, 16 bp, Homo sapiens
gttctgtgtacttttt

SEQ ID NO: 841169 - DNA, 18 bp, Homo sapiens
gttctgtgtattttcagt

SEQ ID NO: 841170 - DNA, 17 bp, Homo sapiens
gttctgttaactgaata

SEQ ID NO: 841171 - DNA, 19 bp, Homo sapiens
gttctgttaactgaatacc

SEQ ID NO: 841172 - DNA, 15 bp, Homo sapiens
gttctgttctggggg

SEQ ID NO: 841173 - DNA, 17 bp, Homo sapiens
gttctgtttgttaaaac

SEQ ID NO: 841174 - DNA, 22 bp, Homo sapiens
gttctgtttgttattgttttgt

SEQ ID NO: 841175 - DNA, 23 bp, Homo sapiens
gttctgttttcgtaccttcccac

SEQ ID NO: 841176 - DNA, 15 bp, Homo sapiens
gttcttaaatgttta

SEQ ID NO: 841177 - DNA, 21 bp, Homo sapiens
gttcttaaatgtttatactgt

SEQ ID NO: 841178 - DNA, 13 bp, Homo sapiens
gttcttaattctt

SEQ ID NO: 841179 - DNA, 16 bp, Homo sapiens
gttcttaattgtgaac

SEQ ID NO: 841180 - DNA, 19 bp, Homo sapiens
gttcttagttgctgtatgt

SEQ ID NO: 841181 - DNA, 21 bp, Homo sapiens
gttcttatttgccagagccaa

SEQ ID NO: 841182 - DNA, 13 bp, Homo sapiens
gttcttcaagagg

SEQ ID NO: 841183 - DNA, 13 bp, Homo sapiens
gttcttcacctct

SEQ ID NO: 841184 - DNA, 18 bp, Homo sapiens
gttcttcacctctatcca

SEQ ID NO: 841185 - DNA, 17 bp, Homo sapiens
gttcttcacttctggga

SEQ ID NO: 841186 - DNA, 12 bp, Homo sapiens
gttcttcatgat

SEQ ID NO: 841187 - DNA, 22 bp, Homo sapiens
gttcttcccccacttcccctcc

SEQ ID NO: 841188 - DNA, 12 bp, Homo sapiens
gttcttccttcc

SEQ ID NO: 841189 - DNA, 13 bp, Homo sapiens
gttcttccttcct

SEQ ID NO: 841190 - DNA, 20 bp, Homo sapiens
gttcttcctttccctggagc

SEQ ID NO: 841191 - DNA, 14 bp, Homo sapiens
gttcttcgaggtgg

SEQ ID NO: 841192 - DNA, 17 bp, Homo sapiens
gttcttcttcctgaagc

SEQ ID NO: 841193 - DNA, 22 bp, Homo sapiens
gttcttcttgggagtatgttgt

SEQ ID NO: 841194 - DNA, 15 bp, Homo sapiens
gttcttgaagctggg

SEQ ID NO: 841195 - DNA, 23 bp, Homo sapiens
gttcttgaagctgggctgtctct

SEQ ID NO: 841196 - DNA, 16 bp, Homo sapiens
gttcttgaattgttat

SEQ ID NO: 841197 - DNA, 15 bp, Homo sapiens
gttcttgatgtcatg

SEQ ID NO: 841198 - DNA, 15 bp, Homo sapiens
gttcttgcctttctt

SEQ ID NO: 841199 - DNA, 15 bp, Homo sapiens
gttcttgctgagcac

SEQ ID NO: 841200 - DNA, 13 bp, Homo sapiens
gttcttggaccag

SEQ ID NO: 841201 - DNA, 15 bp, Homo sapiens
gttcttggaccagtt

SEQ ID NO: 841202 - DNA, 20 bp, Homo sapiens
gttcttgggtggttcctaag

SEQ ID NO: 841203 - DNA, 18 bp, Homo sapiens
gttcttggtgactgtccc

SEQ ID NO: 841204 - DNA, 18 bp, Homo sapiens
gttcttgtaattttacac

SEQ ID NO: 841205 - DNA, 12 bp, Homo sapiens
gttcttgtattt

SEQ ID NO: 841206 - DNA, 13 bp, Homo sapiens
gttcttgttggtg

SEQ ID NO: 841207 - DNA, 14 bp, Homo sapiens
gttcttgttggtgc

SEQ ID NO: 841208 - DNA, 18 bp, Homo sapiens
gttctttactcgtcccct

SEQ ID NO: 841209 - DNA, 20 bp, Homo sapiens
gttctttccaaagtacactg

SEQ ID NO: 841210 - DNA, 20 bp, Homo sapiens
gttctttccataataaaagg

SEQ ID NO: 841211 - DNA, 20 bp, Homo sapiens
gttctttcctccccctgcaa

SEQ ID NO: 841212 - DNA, 14 bp, Homo sapiens
gttctttcctcttt

SEQ ID NO: 841213 - DNA, 21 bp, Homo sapiens
gttctttcctctttctgctct

SEQ ID NO: 841214 - DNA, 17 bp, Homo sapiens
gttctttcctgccctgt

SEQ ID NO: 841215 - DNA, 15 bp, Homo sapiens
gttctttctggagtc

SEQ ID NO: 841216 - DNA, 17 bp, Homo sapiens
gttctttcttcctctgc

SEQ ID NO: 841217 - DNA, 19 bp, Homo sapiens
gttctttgatttgtaccat

SEQ ID NO: 841218 - DNA, 22 bp, Homo sapiens
gttctttgctgcccctgtctgg

SEQ ID NO: 841219 - DNA, 11 bp, Homo sapiens
gttctttggaa

SEQ ID NO: 841220 - DNA, 20 bp, Homo sapiens
gttcttttctcctttaccag

SEQ ID NO: 841221 - DNA, 15 bp, Homo sapiens
gttctttttaagtta

SEQ ID NO: 841222 - DNA, 15 bp, Homo sapiens
gttcttttttcagtt

SEQ ID NO: 841223 - DNA, 15 bp, Homo sapiens
gttcttttttgtact

SEQ ID NO: 841224 - DNA, 12 bp, Homo sapiens
gttgaaaaaatt

SEQ ID NO: 841225 - DNA, 21 bp, Homo sapiens
gttgaaaaaatttaaaagtaa

SEQ ID NO: 841226 - DNA, 19 bp, Homo sapiens
gttgaaaaaggaaatattc

SEQ ID NO: 841227 - DNA, 13 bp, Homo sapiens
gttgaaaaatcta

SEQ ID NO: 841228 - DNA, 15 bp, Homo sapiens
gttgaaaacttgtaa

SEQ ID NO: 841229 - DNA, 19 bp, Homo sapiens
gttgaaaattattttaaac

SEQ ID NO: 841230 - DNA, 18 bp, Homo sapiens
gttgaaaattcaaaaagt

SEQ ID NO: 841231 - DNA, 13 bp, Homo sapiens
gttgaaacaaacc

SEQ ID NO: 841232 - DNA, 18 bp, Homo sapiens
gttgaaaggcctcaagaa

SEQ ID NO: 841233 - DNA, 18 bp, Homo sapiens
gttgaactttttttaagg

SEQ ID NO: 841234 - DNA, 10 bp, Homo sapiens
gttgaagaaa

SEQ ID NO: 841235 - DNA, 13 bp, Homo sapiens
gttgaagaaaaca

SEQ ID NO: 841236 - DNA, 16 bp, Homo sapiens
gttgaagactttgttt

SEQ ID NO: 841237 - DNA, 19 bp, Homo sapiens
gttgaagagacagagacaa

SEQ ID NO: 841238 - DNA, 23 bp, Homo sapiens
gttgaagcaaatcgaatgaaatt

SEQ ID NO: 841239 - DNA, 21 bp, Homo sapiens
gttgaaggcagtctgaaccct

SEQ ID NO: 841240 - DNA, 13 bp, Homo sapiens
gttgttctgcctg

SEQ ID NO: 841241 - DNA, 12 bp, Homo sapiens
gttgttctgtta

SEQ ID NO: 841242 - DNA, 18 bp, Homo sapiens
gttgttctgttaactgaa

SEQ ID NO: 841243 - DNA, 23 bp, Homo sapiens
gttgttgatattgtttgctgttg

SEQ ID NO: 841244 - DNA, 19 bp, Homo sapiens
gttgttgcaccatctgctt

SEQ ID NO: 841245 - DNA, 20 bp, Homo sapiens
gttgttgccaactaagccct

SEQ ID NO: 841246 - DNA, 22 bp, Homo sapiens
gttgttgccaactaagccctcg

SEQ ID NO: 841247 - DNA, 14 bp, Homo sapiens
gttgttggcaagct

SEQ ID NO: 841248 - DNA, 18 bp, Homo sapiens
gttgttgtgtgtatatgt

SEQ ID NO: 841249 - DNA, 24 bp, Homo sapiens
gttgttgttaatgaaaatgtcaga

SEQ ID NO: 841250 - DNA, 20 bp, Homo sapiens
gttgtttagaaacagaaata

SEQ ID NO: 841251 - DNA, 18 bp, Homo sapiens
gttgtttataataaaaat

SEQ ID NO: 841252 - DNA, 15 bp, Homo sapiens
gttgtttctgaccca

SEQ ID NO: 841253 - DNA, 14 bp, Homo sapiens
gttgtttctgttcc

SEQ ID NO: 841254 - DNA, 20 bp, Homo sapiens
gttgtttgtaaataagagat

SEQ ID NO: 841255 - DNA, 13 bp, Homo sapiens
gttgtttgtatgt

SEQ ID NO: 841256 - DNA, 18 bp, Homo sapiens
gttgttttttcatagtgc

SEQ ID NO: 841257 - DNA, 16 bp, Homo sapiens
gttgttttttgttcaa

SEQ ID NO: 841258 - DNA, 16 bp, Homo sapiens
gtttaaaaagtttcac

SEQ ID NO: 841259 - DNA, 20 bp, Homo sapiens
gtttaaaaattgaaaaaagt

SEQ ID NO: 841260 - DNA, 10 bp, Homo sapiens
gtttaaaatt

SEQ ID NO: 841261 - DNA, 14 bp, Homo sapiens
gtttaaaattctct

SEQ ID NO: 841262 - DNA, 18 bp, Homo sapiens
gtttaaacaatctttcat

SEQ ID NO: 841263 - DNA, 21 bp, Homo sapiens
gtttaaactgattcataataa

SEQ ID NO: 841264 - DNA, 13 bp, Homo sapiens
gtttaaagaaagt

SEQ ID NO: 841265 - DNA, 15 bp, Homo sapiens
gtttaaagaaagtgt

SEQ ID NO: 841266 - DNA, 17 bp, Homo sapiens
gtttaaagaaagtgtat

SEQ ID NO: 841267 - DNA, 18 bp, Homo sapiens
gtttaaagaaagtgtatt

SEQ ID NO: 841268 - DNA, 16 bp, Homo sapiens
gtttaaagaataaagt

SEQ ID NO: 841269 - DNA, 21 bp, Homo sapiens
gtttaaagtgcagtcatttgt

SEQ ID NO: 841270 - DNA, 23 bp, Homo sapiens
gtttaaagtgcagtcatttgtgg

SEQ ID NO: 841271 - DNA, 13 bp, Homo sapiens
gtttaaataaagt

SEQ ID NO: 841272 - DNA, 17 bp, Homo sapiens
gtttaaataaagtatca

SEQ ID NO: 841273 - DNA, 23 bp, Homo sapiens
gtttaaataaagtatcatgcatt

SEQ ID NO: 841274 - DNA, 14 bp, Homo sapiens
gtttaaatgccaaa

SEQ ID NO: 841275 - DNA, 19 bp, Homo sapiens
gtttaaatgccaaaatgta

SEQ ID NO: 841276 - DNA, 13 bp, Homo sapiens
gtttaaattgtaa

SEQ ID NO: 841277 - DNA, 22 bp, Homo sapiens
gtttaacacttctgtatgcatc

SEQ ID NO: 841278 - DNA, 17 bp, Homo sapiens
gtttaacattcacagcc

SEQ ID NO: 841279 - DNA, 21 bp, Homo sapiens
gtttaacatttgccttgcaga

SEQ ID NO: 841280 - DNA, 18 bp, Homo sapiens
gtttaactttaaaactgt

SEQ ID NO: 841281 - DNA, 17 bp, Homo sapiens
gtttaagccaaaacaat

SEQ ID NO: 841282 - DNA, 20 bp, Homo sapiens
gtttaagccaaaacaatgtt

SEQ ID NO: 841283 - DNA, 15 bp, Homo sapiens
gtttaagctgagcca

SEQ ID NO: 841284 - DNA, 16 bp, Homo sapiens
gtttaagctgagccac

SEQ ID NO: 841285 - DNA, 21 bp, Homo sapiens
gtttaagctgagccacggata

SEQ ID NO: 841286 - DNA, 14 bp, Homo sapiens
gtttaagttgtatt

SEQ ID NO: 841287 - DNA, 15 bp, Homo sapiens
gtttaatagactgag

SEQ ID NO: 841288 - DNA, 19 bp, Homo sapiens
gtttaatattgagaaagaa

SEQ ID NO: 841289 - DNA, 14 bp, Homo sapiens
gtttaatttaaagc

SEQ ID NO: 841290 - DNA, 15 bp, Homo sapiens
gtttaatttaaagcc

SEQ ID NO: 841291 - DNA, 18 bp, Homo sapiens
gtttaatttttatttctt

SEQ ID NO: 841292 - DNA, 20 bp, Homo sapiens
gtttaatttttatttcttcc

SEQ ID NO: 841293 - DNA, 21 bp, Homo sapiens
gtttacaacttgattttttca

SEQ ID NO: 841294 - DNA, 22 bp, Homo sapiens
gtttacaacttgattttttcaa

SEQ ID NO: 841295 - DNA, 18 bp, Homo sapiens
gtttacaagccccccctt

SEQ ID NO: 841296 - DNA, 22 bp, Homo sapiens
gtttacaagcccccccttccac

SEQ ID NO: 841297 - DNA, 23 bp, Homo sapiens
gtttacaagtgtatatcagaaaa

SEQ ID NO: 841298 - DNA, 19 bp, Homo sapiens
gtttacaatttacaaagtg

SEQ ID NO: 841299 - DNA, 23 bp, Homo sapiens
gtttacaatttacaaagtgtgta

SEQ ID NO: 841300 - DNA, 16 bp, Homo sapiens
gtttacactctttgta

SEQ ID NO: 841301 - DNA, 18 bp, Homo sapiens
gtttacaggccctgctcc

SEQ ID NO: 841302 - DNA, 19 bp, Homo sapiens
gtttacaggccctgctcct

SEQ ID NO: 841303 - DNA, 14 bp, Homo sapiens
gtttacagggtata

SEQ ID NO: 841304 - DNA, 13 bp, Homo sapiens
gtttacagtgaag

SEQ ID NO: 841305 - DNA, 16 bp, Homo sapiens
gtttacccatgaagat

SEQ ID NO: 841306 - DNA, 23 bp, Homo sapiens
gtttaccggttgtttagaaacag

SEQ ID NO: 841307 - DNA, 16 bp, Homo sapiens
gtttacctgaataaat

SEQ ID NO: 841308 - DNA, 14 bp, Homo sapiens
gtttacctggtgct

SEQ ID NO: 841309 - DNA, 16 bp, Homo sapiens
gtttacctgtgaaata

SEQ ID NO: 841310 - DNA, 22 bp, Homo sapiens
gtttactagggatccctcatct

SEQ ID NO: 841311 - DNA, 13 bp, Homo sapiens
gtttactcccttc

SEQ ID NO: 841312 - DNA, 17 bp, Homo sapiens
gtttactcccttctgta

SEQ ID NO: 841313 - DNA, 12 bp, Homo sapiens
gtttactgcttt

SEQ ID NO: 841314 - DNA, 23 bp, Homo sapiens
gtttactgttttgaaatcaatgc

SEQ ID NO: 841315 - DNA, 18 bp, Homo sapiens
gtttacttatcttatgcc

SEQ ID NO: 841316 - DNA, 23 bp, Homo sapiens
gtttacttgtctgtcaaatgttt

SEQ ID NO: 841317 - DNA, 17 bp, Homo sapiens
gtttacttttcagggca

SEQ ID NO: 841318 - DNA, 16 bp, Homo sapiens
gtttactttttaactg

SEQ ID NO: 841319 - DNA, 22 bp, Homo sapiens
gtttagaaaaaaaactgaagat

SEQ ID NO: 841320 - DNA, 19 bp, Homo sapiens
gtttagagaatgagaaatg

SEQ ID NO: 841321 - DNA, 22 bp, Homo sapiens
gtttagatcccatgtcacctca

SEQ ID NO: 841322 - DNA, 23 bp, Homo sapiens
gtttagatcccatgtcacctcag

SEQ ID NO: 841323 - DNA, 20 bp, Homo sapiens
gtttagatttatggttgtta

SEQ ID NO: 841324 - DNA, 17 bp, Homo sapiens
gtttagcagcagccttt

SEQ ID NO: 841325 - DNA, 17 bp, Homo sapiens
gtttaggattacttaga

SEQ ID NO: 841326 - DNA, 17 bp, Homo sapiens
gtttaggcctcatttct

SEQ ID NO: 841327 - DNA, 15 bp, Homo sapiens
gtttaggctatttgt

SEQ ID NO: 841328 - DNA, 17 bp, Homo sapiens
gtttagggaacaatttg

SEQ ID NO: 841329 - DNA, 16 bp, Homo sapiens
gtttagtttgcattta

SEQ ID NO: 841330 - DNA, 13 bp, Homo sapiens
gtttataaatctt

SEQ ID NO: 841331 - DNA, 20 bp, Homo sapiens
gtttataactctagggatat

SEQ ID NO: 841332 - DNA, 18 bp, Homo sapiens
gtttataatctgaagata

SEQ ID NO: 841333 - DNA, 19 bp, Homo sapiens
gtttataatctgaagatat

SEQ ID NO: 841334 - DNA, 13 bp, Homo sapiens
gtttatacagaac

SEQ ID NO: 841335 - DNA, 23 bp, Homo sapiens
gtttatatactgggttcttgttt

SEQ ID NO: 841336 - DNA, 21 bp, Homo sapiens
gtttatatggaagaaagtaag

SEQ ID NO: 841337 - DNA, 20 bp, Homo sapiens
gtttatattactctcattct

SEQ ID NO: 841338 - DNA, 15 bp, Homo sapiens
gtttatattgtggaa

SEQ ID NO: 841339 - DNA, 16 bp, Homo sapiens
gtttatcagatacatc

SEQ ID NO: 841340 - DNA, 18 bp, Homo sapiens
gtttatcagatacatcac

SEQ ID NO: 841341 - DNA, 21 bp, Homo sapiens
gtttatcagatacatcactgc

SEQ ID NO: 841342 - DNA, 23 bp, Homo sapiens
gtttatcagatacatcactgctt

SEQ ID NO: 841343 - DNA, 14 bp, Homo sapiens
gtttatcagtaaat

SEQ ID NO: 841344 - DNA, 20 bp, Homo sapiens
gtttatcattcaagtgtaaa

SEQ ID NO: 841345 - DNA, 16 bp, Homo sapiens
gtttatcctcttggtg

SEQ ID NO: 841346 - DNA, 14 bp, Homo sapiens
gtttatcctgacat

SEQ ID NO: 841347 - DNA, 18 bp, Homo sapiens
gtttatgagatgctggtt

SEQ ID NO: 841348 - DNA, 12 bp, Homo sapiens
gtttatgattaa

SEQ ID NO: 841349 - DNA, 22 bp, Homo sapiens
gtttatgcacacagagatttga

SEQ ID NO: 841350 - DNA, 12 bp, Homo sapiens
gtttatgcatat

SEQ ID NO: 841351 - DNA, 16 bp, Homo sapiens
gtttatgcattgcctt

SEQ ID NO: 841352 - DNA, 14 bp, Homo sapiens
gtttatggcagaag

SEQ ID NO: 841353 - DNA, 16 bp, Homo sapiens
gtttatggcagaaggg

SEQ ID NO: 841354 - DNA, 18 bp, Homo sapiens
gtttatggccacatttaa

SEQ ID NO: 841355 - DNA, 23 bp, Homo sapiens
gtttatggccacatttaatatct

SEQ ID NO: 841356 - DNA, 22 bp, Homo sapiens
gtttatggcctcagctgcctca

SEQ ID NO: 841357 - DNA, 20 bp, Homo sapiens
gtttatggccttaatatact

SEQ ID NO: 841358 - DNA, 15 bp, Homo sapiens
gtttatgtaatttca

SEQ ID NO: 841359 - DNA, 19 bp, Homo sapiens
gtttatgtatcagctctct

SEQ ID NO: 841360 - DNA, 22 bp, Homo sapiens
gtttatgtgctattaatatttg

SEQ ID NO: 841361 - DNA, 16 bp, Homo sapiens
gtttgtaggctgtggg

SEQ ID NO: 841362 - DNA, 16 bp, Homo sapiens
gtttgtataacttctt

SEQ ID NO: 841363 - DNA, 13 bp, Homo sapiens
gtttgtatattgt

SEQ ID NO: 841364 - DNA, 12 bp, Homo sapiens
gtttgtatattt

SEQ ID NO: 841365 - DNA, 14 bp, Homo sapiens
gtttgtatatttgc

SEQ ID NO: 841366 - DNA, 19 bp, Homo sapiens
gtttgtatgagatggttaa

SEQ ID NO: 841367 - DNA, 14 bp, Homo sapiens
gtttgtatgtataa

SEQ ID NO: 841368 - DNA, 13 bp, Homo sapiens
gtttgtatgtgtg

SEQ ID NO: 841369 - DNA, 20 bp, Homo sapiens
gtttgtatgtgtgtagacaa

SEQ ID NO: 841370 - DNA, 16 bp, Homo sapiens
gtttgtcactgccaaa

SEQ ID NO: 841371 - DNA, 14 bp, Homo sapiens
gtttgtcctgggtt

SEQ ID NO: 841372 - DNA, 21 bp, Homo sapiens
gtttgtcctttttcactttga

SEQ ID NO: 841373 - DNA, 21 bp, Homo sapiens
gtttgtcttccattccattgt

SEQ ID NO: 841374 - DNA, 11 bp, Homo sapiens
gtttgtgagag

SEQ ID NO: 841375 - DNA, 23 bp, Homo sapiens
gtttgtgcctttttatttttgtt

SEQ ID NO: 841376 - DNA, 19 bp, Homo sapiens
gtttgtgctgtaaagagtt

SEQ ID NO: 841377 - DNA, 13 bp, Homo sapiens
gtttgtggctggg

SEQ ID NO: 841378 - DNA, 18 bp, Homo sapiens
gtttgtgtgatttcctaa

SEQ ID NO: 841379 - DNA, 19 bp, Homo sapiens
gtttgtgtgatttcctaaa

SEQ ID NO: 841380 - DNA, 17 bp, Homo sapiens
gtttgtgtgtatttgta

SEQ ID NO: 841381 - DNA, 13 bp, Homo sapiens
gtttgtgtgtctt

SEQ ID NO: 841382 - DNA, 15 bp, Homo sapiens
gtttgtgttttaaaa

SEQ ID NO: 841383 - DNA, 13 bp, Homo sapiens
gtttgttaaaact

SEQ ID NO: 841384 - DNA, 14 bp, Homo sapiens
gtttgttaaaactg

SEQ ID NO: 841385 - DNA, 17 bp, Homo sapiens
gtttgttacataggtat

SEQ ID NO: 841386 - DNA, 13 bp, Homo sapiens
gtttgttatttac

SEQ ID NO: 841387 - DNA, 22 bp, Homo sapiens
gtttgttatttacactggtcta

SEQ ID NO: 841388 - DNA, 16 bp, Homo sapiens
gtttgttcacttaaat

SEQ ID NO: 841389 - DNA, 14 bp, Homo sapiens
gtttgttcatctgt

SEQ ID NO: 841390 - DNA, 15 bp, Homo sapiens
gtttgttctgttctg

SEQ ID NO: 841391 - DNA, 21 bp, Homo sapiens
gtttgttggttgattgtttaa

SEQ ID NO: 841392 - DNA, 11 bp, Homo sapiens
gtttgtttaag

SEQ ID NO: 841393 - DNA, 18 bp, Homo sapiens
gtttgtttcaagaacctg

SEQ ID NO: 841394 - DNA, 21 bp, Homo sapiens
gtttgtttctccccctgggct

SEQ ID NO: 841395 - DNA, 14 bp, Homo sapiens
gtttgtttcttctt

SEQ ID NO: 841396 - DNA, 12 bp, Homo sapiens
gtttgtttcttt

SEQ ID NO: 841397 - DNA, 14 bp, Homo sapiens
gtttgtttgtctgt

SEQ ID NO: 841398 - DNA, 13 bp, Homo sapiens
gtttgtttgttgc

SEQ ID NO: 841399 - DNA, 20 bp, Homo sapiens
gtttgttttagaaccagccg

SEQ ID NO: 841400 - DNA, 18 bp, Homo sapiens
gtttgttttcttgtctgt

SEQ ID NO: 841401 - DNA, 15 bp, Homo sapiens
gtttgttttgtgaat

SEQ ID NO: 841402 - DNA, 14 bp, Homo sapiens
gtttgtttttgcgt

SEQ ID NO: 841403 - DNA, 14 bp, Homo sapiens
gtttgttttttcat

SEQ ID NO: 841404 - DNA, 16 bp, Homo sapiens
gttttaaaaaaactga

SEQ ID NO: 841405 - DNA, 23 bp, Homo sapiens
gttttaaaaaaactgaaggtttt

SEQ ID NO: 841406 - DNA, 22 bp, Homo sapiens
gttttaaacctttaatgagaaa

SEQ ID NO: 841407 - DNA, 14 bp, Homo sapiens
gttttaaatgtaca

SEQ ID NO: 841408 - DNA, 16 bp, Homo sapiens
gttttaactgtggata

SEQ ID NO: 841409 - DNA, 23 bp, Homo sapiens
gttttaagctaaagcctgaattt

SEQ ID NO: 841410 - DNA, 21 bp, Homo sapiens
gttttaataaaagatttacat

SEQ ID NO: 841411 - DNA, 20 bp, Homo sapiens
gttttaataccacagctatt

SEQ ID NO: 841412 - DNA, 14 bp, Homo sapiens
gttttaatctactt

SEQ ID NO: 841413 - DNA, 20 bp, Homo sapiens
gttttaattccaatatgatg

SEQ ID NO: 841414 - DNA, 12 bp, Homo sapiens
gttttaattgta

SEQ ID NO: 841415 - DNA, 14 bp, Homo sapiens
gttttaatttaaac

SEQ ID NO: 841416 - DNA, 16 bp, Homo sapiens
gttttacaatagttct

SEQ ID NO: 841417 - DNA, 20 bp, Homo sapiens
gttttacaatagttctgtgg

SEQ ID NO: 841418 - DNA, 17 bp, Homo sapiens
gttttacactaggaaac

SEQ ID NO: 841419 - DNA, 23 bp, Homo sapiens
gttttacagagaggatacattta

SEQ ID NO: 841420 - DNA, 16 bp, Homo sapiens
gttttaccaataaact

SEQ ID NO: 841421 - DNA, 23 bp, Homo sapiens
gttttacgtgcaaacaacctgaa

SEQ ID NO: 841422 - DNA, 13 bp, Homo sapiens
gttttacttttaa

SEQ ID NO: 841423 - DNA, 12 bp, Homo sapiens
gttttacttttt

SEQ ID NO: 841424 - DNA, 14 bp, Homo sapiens
gttttagaaattgg

SEQ ID NO: 841425 - DNA, 21 bp, Homo sapiens
gttttagttgcagaaacattt

SEQ ID NO: 841426 - DNA, 16 bp, Homo sapiens
gttttataatccttaa

SEQ ID NO: 841427 - DNA, 21 bp, Homo sapiens
gttttataatttaataaaaag

SEQ ID NO: 841428 - DNA, 21 bp, Homo sapiens
gttttatactgaaggaaaaac

SEQ ID NO: 841429 - DNA, 18 bp, Homo sapiens
gttttatactgtacttaa

SEQ ID NO: 841430 - DNA, 19 bp, Homo sapiens
gttttatatcaaatgcctt

SEQ ID NO: 841431 - DNA, 18 bp, Homo sapiens
gttttatgcgtgtgacag

SEQ ID NO: 841432 - DNA, 20 bp, Homo sapiens
gttttatggttacttcttct

SEQ ID NO: 841433 - DNA, 14 bp, Homo sapiens
gttttattcattgg

SEQ ID NO: 841434 - DNA, 21 bp, Homo sapiens
gttttattggggaattaaata

SEQ ID NO: 841435 - DNA, 13 bp, Homo sapiens
gttttatttacat

SEQ ID NO: 841436 - DNA, 23 bp, Homo sapiens
gttttatttatatcttgttatta

SEQ ID NO: 841437 - DNA, 15 bp, Homo sapiens
gttttatttgtcagt

SEQ ID NO: 841438 - DNA, 23 bp, Homo sapiens
gttttattttggaattggtgtat

SEQ ID NO: 841439 - DNA, 16 bp, Homo sapiens
gttttatttttaagaa

SEQ ID NO: 841440 - DNA, 13 bp, Homo sapiens
gttttatttttgc

SEQ ID NO: 841441 - DNA, 17 bp, Homo sapiens
gttttcaactcaggaac

SEQ ID NO: 841442 - DNA, 17 bp, Homo sapiens
gttttcaagtcaaatta

SEQ ID NO: 841443 - DNA, 20 bp, Homo sapiens
gttttcaattttaaacatat

SEQ ID NO: 841444 - DNA, 13 bp, Homo sapiens
gttttcacttgta

SEQ ID NO: 841445 - DNA, 14 bp, Homo sapiens
gttttcacttgtat

SEQ ID NO: 841446 - DNA, 19 bp, Homo sapiens
gttttcacttgtattgact

SEQ ID NO: 841447 - DNA, 21 bp, Homo sapiens
gttttcagaacctcttcccca

SEQ ID NO: 841448 - DNA, 14 bp, Homo sapiens
gttttcagactcag

SEQ ID NO: 841449 - DNA, 17 bp, Homo sapiens
gttttcagactcagact

SEQ ID NO: 841450 - DNA, 22 bp, Homo sapiens
gttttcaggttgcccatttata

SEQ ID NO: 841451 - DNA, 23 bp, Homo sapiens
gttttcataacttgctgaatttc

SEQ ID NO: 841452 - DNA, 22 bp, Homo sapiens
gttttcataataaaactttaaa

SEQ ID NO: 841453 - DNA, 15 bp, Homo sapiens
gttttcatcatttca

SEQ ID NO: 841454 - DNA, 20 bp, Homo sapiens
gttttcatcatttcagccaa

SEQ ID NO: 841455 - DNA, 18 bp, Homo sapiens
gttttcatccataactga

SEQ ID NO: 841456 - DNA, 15 bp, Homo sapiens
gttttcatcctggcc

SEQ ID NO: 841457 - DNA, 16 bp, Homo sapiens
gttttcatgtaaataa

SEQ ID NO: 841458 - DNA, 16 bp, Homo sapiens
gttttcatttggttca

SEQ ID NO: 841459 - DNA, 14 bp, Homo sapiens
gttttccaccctgg

SEQ ID NO: 841460 - DNA, 14 bp, Homo sapiens
gttttccactgtgc

SEQ ID NO: 841461 - DNA, 17 bp, Homo sapiens
gttttccattgtttgaa

SEQ ID NO: 841462 - DNA, 23 bp, Homo sapiens
gttttccccacattctatagcca

SEQ ID NO: 841463 - DNA, 12 bp, Homo sapiens
gttttcccctgg

SEQ ID NO: 841464 - DNA, 23 bp, Homo sapiens
gttttcccctggcctcagttccc

SEQ ID NO: 841465 - DNA, 13 bp, Homo sapiens
gttttcctccctt

SEQ ID NO: 841466 - DNA, 15 bp, Homo sapiens
gttttcctcccttct

SEQ ID NO: 841467 - DNA, 18 bp, Homo sapiens
gttttcctcccttctgct

SEQ ID NO: 841468 - DNA, 20 bp, Homo sapiens
gttttcctctatacatctct

SEQ ID NO: 841469 - DNA, 13 bp, Homo sapiens
gttttccttctgt

SEQ ID NO: 841470 - DNA, 15 bp, Homo sapiens
gttttccttgctatt

SEQ ID NO: 841471 - DNA, 23 bp, Homo sapiens
gttttcgaagctcagcccacccc

SEQ ID NO: 841472 - DNA, 16 bp, Homo sapiens
gttttctatcagacgt

SEQ ID NO: 841473 - DNA, 20 bp, Homo sapiens
gttttctccttcccttcttt

SEQ ID NO: 841474 - DNA, 19 bp, Homo sapiens
gttttctctcggctcccca

SEQ ID NO: 841475 - DNA, 13 bp, Homo sapiens
gttttctctctgg

SEQ ID NO: 841476 - DNA, 16 bp, Homo sapiens
gttttctgaaacacac

SEQ ID NO: 841477 - DNA, 17 bp, Homo sapiens
gttttctgaaacacacg

SEQ ID NO: 841478 - DNA, 14 bp, Homo sapiens
gttttctgagcccg

SEQ ID NO: 841479 - DNA, 15 bp, Homo sapiens
gttttctgagcccgg

SEQ ID NO: 841480 - DNA, 16 bp, Homo sapiens
gttttctgagggaaag

SEQ ID NO: 841481 - DNA, 22 bp, Homo sapiens
gttttctgatggccaaaatacc

SEQ ID NO: 841482 - DNA, 11 bp, Homo sapiens
gttttctgtag

SEQ ID NO: 841483 - DNA, 16 bp, Homo sapiens
gttttctgtagactct

SEQ ID NO: 841484 - DNA, 11 bp, Homo sapiens
taaaaaaactg

SEQ ID NO: 841485 - DNA, 12 bp, Homo sapiens
taaaaaaagcaa

SEQ ID NO: 841486 - DNA, 13 bp, Homo sapiens
taaaaaaagcaaa

SEQ ID NO: 841487 - DNA, 15 bp, Homo sapiens
taaaaaaataagaag

SEQ ID NO: 841488 - DNA, 13 bp, Homo sapiens
taaaaaaatgaca

SEQ ID NO: 841489 - DNA, 13 bp, Homo sapiens
taaaaaaatttga

SEQ ID NO: 841490 - DNA, 22 bp, Homo sapiens
taaaaaaatttttataaattac

SEQ ID NO: 841491 - DNA, 11 bp, Homo sapiens
taaaaaacaaa

SEQ ID NO: 841492 - DNA, 16 bp, Homo sapiens
taaaaaacagaaaccg

SEQ ID NO: 841493 - DNA, 20 bp, Homo sapiens
taaaaaagaagcactttgat

SEQ ID NO: 841494 - DNA, 13 bp, Homo sapiens
taaaaaagattct

SEQ ID NO: 841495 - DNA, 17 bp, Homo sapiens
taaaaaagattctacta

SEQ ID NO: 841496 - DNA, 22 bp, Homo sapiens
taaaaaagcctggtttttctca

SEQ ID NO: 841497 - DNA, 19 bp, Homo sapiens
taaaaaagcttaaaacttt

SEQ ID NO: 841498 - DNA, 20 bp, Homo sapiens
taaaaaagcttaaaactttg

SEQ ID NO: 841499 - DNA, 12 bp, Homo sapiens
taaaaaatacca

SEQ ID NO: 841500 - DNA, 16 bp, Homo sapiens
taaaaaatagacatgt

SEQ ID NO: 841501 - DNA, 18 bp, Homo sapiens
taaaaaatattttaagaa

SEQ ID NO: 841502 - DNA, 16 bp, Homo sapiens
taaaaaatattttctc

SEQ ID NO: 841503 - DNA, 18 bp, Homo sapiens
taaaaaatattttctctg

SEQ ID NO: 841504 - DNA, 17 bp, Homo sapiens
taaaaaatcaatcaatg

SEQ ID NO: 841505 - DNA, 22 bp, Homo sapiens
taaaaaatcatgccagtatttt

SEQ ID NO: 841506 - DNA, 23 bp, Homo sapiens
taaaaaatcctcaacactattgt

SEQ ID NO: 841507 - DNA, 12 bp, Homo sapiens
taaaaaatggaa

SEQ ID NO: 841508 - DNA, 15 bp, Homo sapiens
taaaaaatggaaaaa

SEQ ID NO: 841509 - DNA, 16 bp, Homo sapiens
taaaaaatggaaaaaa

SEQ ID NO: 841510 - DNA, 15 bp, Homo sapiens
taaaaaatggaaaga

SEQ ID NO: 841511 - DNA, 12 bp, Homo sapiens
taaaaaatggtt

SEQ ID NO: 841512 - DNA, 19 bp, Homo sapiens
taaaaaatggttcagaatt

SEQ ID NO: 841513 - DNA, 15 bp, Homo sapiens
taaaaaatgtaacat

SEQ ID NO: 841514 - DNA, 11 bp, Homo sapiens
taaaaaatgtc

SEQ ID NO: 841515 - DNA, 12 bp, Homo sapiens
taaaaaatgtct

SEQ ID NO: 841516 - DNA, 13 bp, Homo sapiens
taaaaaatgtctc

SEQ ID NO: 841517 - DNA, 15 bp, Homo sapiens
taaaaacaaccaaca

SEQ ID NO: 841518 - DNA, 18 bp, Homo sapiens
taaaaacaacgaaagaag

SEQ ID NO: 841519 - DNA, 18 bp, Homo sapiens
taaaaacagcagctcata

SEQ ID NO: 841520 - DNA, 20 bp, Homo sapiens
taaaaacagcattgctttct

SEQ ID NO: 841521 - DNA, 19 bp, Homo sapiens
taaaaacattgcctttgaa

SEQ ID NO: 841522 - DNA, 19 bp, Homo sapiens
taaaaacattttgaagtgt

SEQ ID NO: 841523 - DNA, 23 bp, Homo sapiens
taaaaaccatgctggtatatggc

SEQ ID NO: 841524 - DNA, 19 bp, Homo sapiens
taaaaacctgcttggtgtg

SEQ ID NO: 841525 - DNA, 17 bp, Homo sapiens
taaaaactaatttcata

SEQ ID NO: 841526 - DNA, 15 bp, Homo sapiens
taaaaactcttcagt

SEQ ID NO: 841527 - DNA, 17 bp, Homo sapiens
taaaaactgactcctta

SEQ ID NO: 841528 - DNA, 11 bp, Homo sapiens
taaaaactgat

SEQ ID NO: 841529 - DNA, 13 bp, Homo sapiens
taaaaactgctta

SEQ ID NO: 841530 - DNA, 20 bp, Homo sapiens
taaaaactgtgtatcattaa

SEQ ID NO: 841531 - DNA, 13 bp, Homo sapiens
taaaaactttatt

SEQ ID NO: 841532 - DNA, 14 bp, Homo sapiens
taaaaactttattg

SEQ ID NO: 841533 - DNA, 15 bp, Homo sapiens
taaaaagaaaatatt

SEQ ID NO: 841534 - DNA, 15 bp, Homo sapiens
taaaaagaaatccag

SEQ ID NO: 841535 - DNA, 16 bp, Homo sapiens
taaaaagaaatctggt

SEQ ID NO: 841536 - DNA, 12 bp, Homo sapiens
taaaaagataat

SEQ ID NO: 841537 - DNA, 13 bp, Homo sapiens
taaaaagatttgt

SEQ ID NO: 841538 - DNA, 12 bp, Homo sapiens
taaaaagcaaat

SEQ ID NO: 841539 - DNA, 16 bp, Homo sapiens
taaaaagcaaatcttt

SEQ ID NO: 841540 - DNA, 11 bp, Homo sapiens
taaaaagcaac

SEQ ID NO: 841541 - DNA, 15 bp, Homo sapiens
taaaaagcagaattt

SEQ ID NO: 841542 - DNA, 18 bp, Homo sapiens
taaaaagcagaattttaa

SEQ ID NO: 841543 - DNA, 20 bp, Homo sapiens
taaaaagcttccatgattct

SEQ ID NO: 841544 - DNA, 17 bp, Homo sapiens
taaaaaggaaaacccag

SEQ ID NO: 841545 - DNA, 15 bp, Homo sapiens
taaaaaggaaattag

SEQ ID NO: 841546 - DNA, 22 bp, Homo sapiens
taaaaaggaagtggggacagat

SEQ ID NO: 841547 - DNA, 11 bp, Homo sapiens
taaaaaggaca

SEQ ID NO: 841548 - DNA, 17 bp, Homo sapiens
taaaaaggccaaagata

SEQ ID NO: 841549 - DNA, 18 bp, Homo sapiens
taaaaaggccaaagataa

SEQ ID NO: 841550 - DNA, 20 bp, Homo sapiens
taaaaaggccaaagataaaa

SEQ ID NO: 841551 - DNA, 16 bp, Homo sapiens
taaaaaggcctcctgg

SEQ ID NO: 841552 - DNA, 17 bp, Homo sapiens
taaaaaggctaaatgga

SEQ ID NO: 841553 - DNA, 19 bp, Homo sapiens
taaaaagggagaaagaaaa

SEQ ID NO: 841554 - DNA, 22 bp, Homo sapiens
taaaaagggagaaagaaaactg

SEQ ID NO: 841555 - DNA, 19 bp, Homo sapiens
taaaaagtataaaatagta

SEQ ID NO: 841556 - DNA, 14 bp, Homo sapiens
taaaaagtattttt

SEQ ID NO: 841557 - DNA, 19 bp, Homo sapiens
taaaaagtcagatgtttga

SEQ ID NO: 841558 - DNA, 14 bp, Homo sapiens
taaaaagtgaactt

SEQ ID NO: 841559 - DNA, 17 bp, Homo sapiens
taaaaagtgaacttttg

SEQ ID NO: 841560 - DNA, 20 bp, Homo sapiens
taaaaagtgaacttttgtaa

SEQ ID NO: 841561 - DNA, 15 bp, Homo sapiens
taaaaagtgacacag

SEQ ID NO: 841562 - DNA, 17 bp, Homo sapiens
taaaaagtgacacagca

SEQ ID NO: 841563 - DNA, 17 bp, Homo sapiens
taaaaagtggattacaa

SEQ ID NO: 841564 - DNA, 11 bp, Homo sapiens
taaaaagtggc

SEQ ID NO: 841565 - DNA, 23 bp, Homo sapiens
taaaaagttaagctgctatagta

SEQ ID NO: 841566 - DNA, 20 bp, Homo sapiens
taaaaagttttagttttgat

SEQ ID NO: 841567 - DNA, 16 bp, Homo sapiens
taaaaataaattaata

SEQ ID NO: 841568 - DNA, 17 bp, Homo sapiens
taaaaataccttctatg

SEQ ID NO: 841569 - DNA, 20 bp, Homo sapiens
taaaaataccttctatgtat

SEQ ID NO: 841570 - DNA, 23 bp, Homo sapiens
taaaaatagatcaataaatgtca

SEQ ID NO: 841571 - DNA, 14 bp, Homo sapiens
taaaaatataaaac

SEQ ID NO: 841572 - DNA, 15 bp, Homo sapiens
taaaaatataaaact

SEQ ID NO: 841573 - DNA, 18 bp, Homo sapiens
taaaaatataaattgtac

SEQ ID NO: 841574 - DNA, 20 bp, Homo sapiens
taaaaatataaattgtacat

SEQ ID NO: 841575 - DNA, 19 bp, Homo sapiens
taaaaatatggaacttcta

SEQ ID NO: 841576 - DNA, 23 bp, Homo sapiens
taaaaatatggaacttctaatat

SEQ ID NO: 841577 - DNA, 15 bp, Homo sapiens
taaaaatatttcaga

SEQ ID NO: 841578 - DNA, 21 bp, Homo sapiens
taaaaatatttcagatatcaa

SEQ ID NO: 841579 - DNA, 19 bp, Homo sapiens
taaaaatattttttctgta

SEQ ID NO: 841580 - DNA, 17 bp, Homo sapiens
taaaaatcattgattgt

SEQ ID NO: 841581 - DNA, 19 bp, Homo sapiens
taaaaatcctaaaatatgt

SEQ ID NO: 841582 - DNA, 15 bp, Homo sapiens
taaaaatctcaaatt

SEQ ID NO: 841583 - DNA, 15 bp, Homo sapiens
taaaaatctcttttc

SEQ ID NO: 841584 - DNA, 23 bp, Homo sapiens
taaaaatctgagaaactctacat

SEQ ID NO: 841585 - DNA, 21 bp, Homo sapiens
taaaaatgaaggaattacatt

SEQ ID NO: 841586 - DNA, 14 bp, Homo sapiens
taaaaatgagactt

SEQ ID NO: 841587 - DNA, 16 bp, Homo sapiens
taaaaatgagactttt

SEQ ID NO: 841588 - DNA, 21 bp, Homo sapiens
taaaaatgagactttttcagt

SEQ ID NO: 841589 - DNA, 16 bp, Homo sapiens
taaaaatgatttcagt

SEQ ID NO: 841590 - DNA, 14 bp, Homo sapiens
taaaaatgctgctc

SEQ ID NO: 841591 - DNA, 22 bp, Homo sapiens
taaaaatggctcaagtagaaaa

SEQ ID NO: 841592 - DNA, 13 bp, Homo sapiens
taaaaatgtaaat

SEQ ID NO: 841593 - DNA, 18 bp, Homo sapiens
taaaaatgtaaatattct

SEQ ID NO: 841594 - DNA, 22 bp, Homo sapiens
taaaaatgtcttgctgttgaca

SEQ ID NO: 841595 - DNA, 20 bp, Homo sapiens
taaaaattacctttaatttt

SEQ ID NO: 841596 - DNA, 22 bp, Homo sapiens
taaaaattacctttaattttaa

SEQ ID NO: 841597 - DNA, 14 bp, Homo sapiens
taaaaattatcaaa

SEQ ID NO: 841598 - DNA, 16 bp, Homo sapiens
taaaaattatcaaaaa

SEQ ID NO: 841599 - DNA, 16 bp, Homo sapiens
taaaaattcccttcct

SEQ ID NO: 841600 - DNA, 20 bp, Homo sapiens
taaaaattgaactgtaaact

SEQ ID NO: 841601 - DNA, 12 bp, Homo sapiens
taaaaattgtta

SEQ ID NO: 841602 - DNA, 13 bp, Homo sapiens
taaaaattgtttc

SEQ ID NO: 841603 - DNA, 15 bp, Homo sapiens
taaaaattgtttctt

SEQ ID NO: 841604 - DNA, 19 bp, Homo sapiens
taaaaatttttacaaaact

SEQ ID NO: 841605 - DNA, 14 bp, Homo sapiens
taaaacaaaacaaa

SEQ ID NO: 841606 - DNA, 15 bp, Homo sapiens
taaaacaaaaccaag

SEQ ID NO: 841607 - DNA, 20 bp, Homo sapiens
taaacgtatgcatgtgaaga

SEQ ID NO: 841608 - DNA, 20 bp, Homo sapiens
taaacgtggattttaaaaaa

SEQ ID NO: 841609 - DNA, 15 bp, Homo sapiens
taaacgtggtcacct

SEQ ID NO: 841610 - DNA, 20 bp, Homo sapiens
taaacgtgtaaattgcacag

SEQ ID NO: 841611 - DNA, 20 bp, Homo sapiens
taaactaaaaaaaaaaaggc

SEQ ID NO: 841612 - DNA, 14 bp, Homo sapiens
taaactaaattact

SEQ ID NO: 841613 - DNA, 15 bp, Homo sapiens
taaactaatgaacaa

SEQ ID NO: 841614 - DNA, 17 bp, Homo sapiens
taaactaatgaacaaat

SEQ ID NO: 841615 - DNA, 15 bp, Homo sapiens
taaactaggtaaaat

SEQ ID NO: 841616 - DNA, 17 bp, Homo sapiens
taaactagtttaagggt

SEQ ID NO: 841617 - DNA, 17 bp, Homo sapiens
taaactataagcaagaa

SEQ ID NO: 841618 - DNA, 18 bp, Homo sapiens
taaactattagagtattt

SEQ ID NO: 841619 - DNA, 15 bp, Homo sapiens
taaactatttgtctt

SEQ ID NO: 841620 - DNA, 16 bp, Homo sapiens
taaactatttttttct

SEQ ID NO: 841621 - DNA, 18 bp, Homo sapiens
taaactatttttttctta

SEQ ID NO: 841622 - DNA, 19 bp, Homo sapiens
taaactcaaaactcttgaa

SEQ ID NO: 841623 - DNA, 20 bp, Homo sapiens
taaactcaagatttgaccaa

SEQ ID NO: 841624 - DNA, 14 bp, Homo sapiens
taaactcagatctg

SEQ ID NO: 841625 - DNA, 15 bp, Homo sapiens
taaactccaggattt

SEQ ID NO: 841626 - DNA, 20 bp, Homo sapiens
taaactccttcctggcctga

SEQ ID NO: 841627 - DNA, 14 bp, Homo sapiens
taaactctaaacat

SEQ ID NO: 841628 - DNA, 22 bp, Homo sapiens
taaactctaaacattaatcaat

SEQ ID NO: 841629 - DNA, 14 bp, Homo sapiens
taaactctctagct

SEQ ID NO: 841630 - DNA, 18 bp, Homo sapiens
taaactctctttgggaat

SEQ ID NO: 841631 - DNA, 17 bp, Homo sapiens
taaactctgcatccaga

SEQ ID NO: 841632 - DNA, 12 bp, Homo sapiens
taaactctgcca

SEQ ID NO: 841633 - DNA, 22 bp, Homo sapiens
taaactctggacactctatatg

SEQ ID NO: 841634 - DNA, 16 bp, Homo sapiens
taaactgaaaaatgtc

SEQ ID NO: 841635 - DNA, 17 bp, Homo sapiens
taaactgaatattttgg

SEQ ID NO: 841636 - DNA, 16 bp, Homo sapiens
taaactgactttatcc

SEQ ID NO: 841637 - DNA, 13 bp, Homo sapiens
taaactgaggccc

SEQ ID NO: 841638 - DNA, 16 bp, Homo sapiens
taaactgcaaacagaa

SEQ ID NO: 841639 - DNA, 21 bp, Homo sapiens
taaactgcagcctctctggct

SEQ ID NO: 841640 - DNA, 11 bp, Homo sapiens
taaactgccat

SEQ ID NO: 841641 - DNA, 11 bp, Homo sapiens
taaactgctgt

SEQ ID NO: 841642 - DNA, 21 bp, Homo sapiens
taaactgctgtcaataaatga

SEQ ID NO: 841643 - DNA, 23 bp, Homo sapiens
taaactgctgtcaataaatgaca

SEQ ID NO: 841644 - DNA, 20 bp, Homo sapiens
taaactgtatcaaatctgta

SEQ ID NO: 841645 - DNA, 22 bp, Homo sapiens
taaactgtatcaaatctgtata

SEQ ID NO: 841646 - DNA, 18 bp, Homo sapiens
taaactgtattaaatctt

SEQ ID NO: 841647 - DNA, 14 bp, Homo sapiens
taaactgtgcacca

SEQ ID NO: 841648 - DNA, 19 bp, Homo sapiens
taaactgttagcactgttg

SEQ ID NO: 841649 - DNA, 13 bp, Homo sapiens
taaactgttttca

SEQ ID NO: 841650 - DNA, 15 bp, Homo sapiens
taaactgttttcaag

SEQ ID NO: 841651 - DNA, 19 bp, Homo sapiens
taaacttaatctaaatgga

SEQ ID NO: 841652 - DNA, 17 bp, Homo sapiens
taaacttagaggaaaat

SEQ ID NO: 841653 - DNA, 19 bp, Homo sapiens
taaacttagaggaaaatga

SEQ ID NO: 841654 - DNA, 22 bp, Homo sapiens
taaacttagtgcggacaagttt

SEQ ID NO: 841655 - DNA, 18 bp, Homo sapiens
taaacttccccatcttct

SEQ ID NO: 841656 - DNA, 14 bp, Homo sapiens
taaacttctgaaga

SEQ ID NO: 841657 - DNA, 23 bp, Homo sapiens
taaacttctgaagactgagaact

SEQ ID NO: 841658 - DNA, 12 bp, Homo sapiens
taaacttcttaa

SEQ ID NO: 841659 - DNA, 12 bp, Homo sapiens
taaacttgaaaa

SEQ ID NO: 841660 - DNA, 16 bp, Homo sapiens
taaacttgaagcagtc

SEQ ID NO: 841661 - DNA, 16 bp, Homo sapiens
taaactttaccttttt

SEQ ID NO: 841662 - DNA, 11 bp, Homo sapiens
taaactttatt

SEQ ID NO: 841663 - DNA, 21 bp, Homo sapiens
taaactttatttgtaaaccat

SEQ ID NO: 841664 - DNA, 16 bp, Homo sapiens
taaactttgtgccttt

SEQ ID NO: 841665 - DNA, 16 bp, Homo sapiens
taaacttttaattcat

SEQ ID NO: 841666 - DNA, 11 bp, Homo sapiens
taaacttttta

SEQ ID NO: 841667 - DNA, 14 bp, Homo sapiens
taaactttttcaat

SEQ ID NO: 841668 - DNA, 17 bp, Homo sapiens
taaactttttgttctgg

SEQ ID NO: 841669 - DNA, 20 bp, Homo sapiens
taaactttttttctgtacca

SEQ ID NO: 841670 - DNA, 17 bp, Homo sapiens
taaagaaaaaaattgaa

SEQ ID NO: 841671 - DNA, 22 bp, Homo sapiens
taaagaaaaaaattgaaatgta

SEQ ID NO: 841672 - DNA, 16 bp, Homo sapiens
taaagaaaaatatgat

SEQ ID NO: 841673 - DNA, 16 bp, Homo sapiens
taaagaaaagatgaaa

SEQ ID NO: 841674 - DNA, 13 bp, Homo sapiens
taaagaaaattgc

SEQ ID NO: 841675 - DNA, 19 bp, Homo sapiens
taaagaaaattgcatgaaa

SEQ ID NO: 841676 - DNA, 13 bp, Homo sapiens
taaagaaacagct

SEQ ID NO: 841677 - DNA, 15 bp, Homo sapiens
taaagaaacagcttt

SEQ ID NO: 841678 - DNA, 19 bp, Homo sapiens
taaagaaacagctttcaag

SEQ ID NO: 841679 - DNA, 20 bp, Homo sapiens
taaagaaacttggctggaat

SEQ ID NO: 841680 - DNA, 14 bp, Homo sapiens
taaagaaagcagaa

SEQ ID NO: 841681 - DNA, 15 bp, Homo sapiens
taaagaaagtgaaaa

SEQ ID NO: 841682 - DNA, 16 bp, Homo sapiens
taaagaaagtgtattt

SEQ ID NO: 841683 - DNA, 20 bp, Homo sapiens
taaagaaagtgtatttggaa

SEQ ID NO: 841684 - DNA, 24 bp, Homo sapiens
taaagaaagtgtatttggaaataa

SEQ ID NO: 841685 - DNA, 17 bp, Homo sapiens
taaagaaatagaacaag

SEQ ID NO: 841686 - DNA, 14 bp, Homo sapiens
taaagaaatattta

SEQ ID NO: 841687 - DNA, 15 bp, Homo sapiens
taaagaaatatttac

SEQ ID NO: 841688 - DNA, 19 bp, Homo sapiens
taaagaacaccctatattt

SEQ ID NO: 841689 - DNA, 22 bp, Homo sapiens
taaagaacccctcgttagcctt

SEQ ID NO: 841690 - DNA, 23 bp, Homo sapiens
taaagaagagtgacttattttgt

SEQ ID NO: 841691 - DNA, 13 bp, Homo sapiens
taaagaagcaata

SEQ ID NO: 841692 - DNA, 14 bp, Homo sapiens
taaagaagctgcat

SEQ ID NO: 841693 - DNA, 16 bp, Homo sapiens
taaagaaggatgatgt

SEQ ID NO: 841694 - DNA, 20 bp, Homo sapiens
taaagaagggatattaagaa

SEQ ID NO: 841695 - DNA, 14 bp, Homo sapiens
taaagaagtatttt

SEQ ID NO: 841696 - DNA, 15 bp, Homo sapiens
taaagaagtattttt

SEQ ID NO: 841697 - DNA, 13 bp, Homo sapiens
taaagaagtttga

SEQ ID NO: 841698 - DNA, 15 bp, Homo sapiens
taaagaataatatgc

SEQ ID NO: 841699 - DNA, 16 bp, Homo sapiens
taaagaatatgacttt

SEQ ID NO: 841700 - DNA, 20 bp, Homo sapiens
taaagaatgccatttctcac

SEQ ID NO: 841701 - DNA, 13 bp, Homo sapiens
taaagaatgttag

SEQ ID NO: 841702 - DNA, 16 bp, Homo sapiens
taaagaattttcatcc

SEQ ID NO: 841703 - DNA, 19 bp, Homo sapiens
taaagacaaagacaaattc

SEQ ID NO: 841704 - DNA, 22 bp, Homo sapiens
taaagacaaagacaaattctgt

SEQ ID NO: 841705 - DNA, 21 bp, Homo sapiens
taaagacaaataaatgattat

SEQ ID NO: 841706 - DNA, 9 bp, Homo sapiens
taaagacag

SEQ ID NO: 841707 - DNA, 10 bp, Homo sapiens
taaagacaga

SEQ ID NO: 841708 - DNA, 15 bp, Homo sapiens
taaagacagaggcag

SEQ ID NO: 841709 - DNA, 14 bp, Homo sapiens
taaagacagggtct

SEQ ID NO: 841710 - DNA, 16 bp, Homo sapiens
taaagacagggtcttg

SEQ ID NO: 841711 - DNA, 21 bp, Homo sapiens
taaagaccaatttatgggaga

SEQ ID NO: 841712 - DNA, 22 bp, Homo sapiens
taaagaccaatttatgggagaa

SEQ ID NO: 841713 - DNA, 19 bp, Homo sapiens
taaagacccagggggagaa

SEQ ID NO: 841714 - DNA, 22 bp, Homo sapiens
taaagaccgtacaaactcagat

SEQ ID NO: 841715 - DNA, 14 bp, Homo sapiens
taaagactggcttt

SEQ ID NO: 841716 - DNA, 19 bp, Homo sapiens
taaagacttttatgtgaga

SEQ ID NO: 841717 - DNA, 12 bp, Homo sapiens
taaagagagaat

SEQ ID NO: 841718 - DNA, 12 bp, Homo sapiens
taaagagatttc

SEQ ID NO: 841719 - DNA, 18 bp, Homo sapiens
taaagagctgcacagcaa

SEQ ID NO: 841720 - DNA, 18 bp, Homo sapiens
taaagaggagaaggaaaa

SEQ ID NO: 841721 - DNA, 20 bp, Homo sapiens
taaagaggagaaggaaaaca

SEQ ID NO: 841722 - DNA, 22 bp, Homo sapiens
taaagaggagtgttattgcatg

SEQ ID NO: 841723 - DNA, 18 bp, Homo sapiens
taaagaggcatcttttct

SEQ ID NO: 841724 - DNA, 22 bp, Homo sapiens
taaagaggcatcttttctagag

SEQ ID NO: 841725 - DNA, 15 bp, Homo sapiens
taaagaggctgtgtg

SEQ ID NO: 841726 - DNA, 16 bp, Homo sapiens
taaagaggctgtgtgg

SEQ ID NO: 841727 - DNA, 15 bp, Homo sapiens
taaagagttattcaa

SEQ ID NO: 841728 - DNA, 17 bp, Homo sapiens
taaagataaagccagaa

SEQ ID NO: 841729 - DNA, 23 bp, Homo sapiens
taaagatacagaactctttcaaa

SEQ ID NO: 841730 - DNA, 20 bp, Homo sapiens
taaagtcggtgattatattt

SEQ ID NO: 841731 - DNA, 14 bp, Homo sapiens
taaagtgaaggaaa

SEQ ID NO: 841732 - DNA, 16 bp, Homo sapiens
taaagtgaaggaaata

SEQ ID NO: 841733 - DNA, 20 bp, Homo sapiens
taaagtgaaggaaataaagg

SEQ ID NO: 841734 - DNA, 12 bp, Homo sapiens
taaagtgacttt

SEQ ID NO: 841735 - DNA, 18 bp, Homo sapiens
taaagtgagaaaactgtg

SEQ ID NO: 841736 - DNA, 16 bp, Homo sapiens
taaagtgataatttct

SEQ ID NO: 841737 - DNA, 22 bp, Homo sapiens
taaagtgattaaacgtgcagac

SEQ ID NO: 841738 - DNA, 17 bp, Homo sapiens
taaagtgcagtcatttg

SEQ ID NO: 841739 - DNA, 13 bp, Homo sapiens
taaagtgccttct

SEQ ID NO: 841740 - DNA, 12 bp, Homo sapiens
taaagtgctgca

SEQ ID NO: 841741 - DNA, 24 bp, Homo sapiens
taaagtgctggaactttagtgaaa

SEQ ID NO: 841742 - DNA, 17 bp, Homo sapiens
taaagtgcttgcttttt

SEQ ID NO: 841743 - DNA, 14 bp, Homo sapiens
taaagtggttttgt

SEQ ID NO: 841744 - DNA, 18 bp, Homo sapiens
taaagtgtaagttcacaa

SEQ ID NO: 841745 - DNA, 17 bp, Homo sapiens
taaagtgtacttataaa

SEQ ID NO: 841746 - DNA, 14 bp, Homo sapiens
taaagtgtattttt

SEQ ID NO: 841747 - DNA, 20 bp, Homo sapiens
taaagtgtatttttttacta

SEQ ID NO: 841748 - DNA, 22 bp, Homo sapiens
taaagtgtatttttttactaat

SEQ ID NO: 841749 - DNA, 19 bp, Homo sapiens
taaagtgttacgttttatt

SEQ ID NO: 841750 - DNA, 13 bp, Homo sapiens
taaagtgtttagc

SEQ ID NO: 841751 - DNA, 16 bp, Homo sapiens
taaagttactttgtca

SEQ ID NO: 841752 - DNA, 18 bp, Homo sapiens
taaagttcaacatgttat

SEQ ID NO: 841753 - DNA, 17 bp, Homo sapiens
taaagttcattgcaatt

SEQ ID NO: 841754 - DNA, 13 bp, Homo sapiens
taaagttccttaa

SEQ ID NO: 841755 - DNA, 14 bp, Homo sapiens
taaagttccttaag

SEQ ID NO: 841756 - DNA, 23 bp, Homo sapiens
taaagttctgtactcaaatgtag

SEQ ID NO: 841757 - DNA, 20 bp, Homo sapiens
taaagttgataaagattttt

SEQ ID NO: 841758 - DNA, 20 bp, Homo sapiens
taaagttggttcacttcaaa

SEQ ID NO: 841759 - DNA, 17 bp, Homo sapiens
taaagttggttggataa

SEQ ID NO: 841760 - DNA, 17 bp, Homo sapiens
taaagttgtaaataatt

SEQ ID NO: 841761 - DNA, 18 bp, Homo sapiens
taaagttgtaaataattt

SEQ ID NO: 841762 - DNA, 22 bp, Homo sapiens
taaagttgtaaataattttcta

SEQ ID NO: 841763 - DNA, 14 bp, Homo sapiens
taaagttgttttat

SEQ ID NO: 841764 - DNA, 18 bp, Homo sapiens
taaagttgttttatcttt

SEQ ID NO: 841765 - DNA, 11 bp, Homo sapiens
taaagtttgtt

SEQ ID NO: 841766 - DNA, 14 bp, Homo sapiens
taaagtttgttcac

SEQ ID NO: 841767 - DNA, 15 bp, Homo sapiens
taaagtttgttcact

SEQ ID NO: 841768 - DNA, 19 bp, Homo sapiens
taaagtttgttcacttaaa

SEQ ID NO: 841769 - DNA, 12 bp, Homo sapiens
taaagtttgttg

SEQ ID NO: 841770 - DNA, 14 bp, Homo sapiens
taaagttttagggt

SEQ ID NO: 841771 - DNA, 21 bp, Homo sapiens
taaagtttttttccttaaaaa

SEQ ID NO: 841772 - DNA, 15 bp, Homo sapiens
taaataaaaataata

SEQ ID NO: 841773 - DNA, 17 bp, Homo sapiens
taaataaaaataataga

SEQ ID NO: 841774 - DNA, 13 bp, Homo sapiens
taaataaaaatat

SEQ ID NO: 841775 - DNA, 14 bp, Homo sapiens
taaataaaaatgga

SEQ ID NO: 841776 - DNA, 15 bp, Homo sapiens
taaataaaaatgtct

SEQ ID NO: 841777 - DNA, 16 bp, Homo sapiens
taaataaaaatttata

SEQ ID NO: 841778 - DNA, 14 bp, Homo sapiens
taaataaaaccctt

SEQ ID NO: 841779 - DNA, 12 bp, Homo sapiens
taaataaaactg

SEQ ID NO: 841780 - DNA, 13 bp, Homo sapiens
taaataaaactga

SEQ ID NO: 841781 - DNA, 15 bp, Homo sapiens
taaataaaactttcc

SEQ ID NO: 841782 - DNA, 13 bp, Homo sapiens
taaataaaagaaa

SEQ ID NO: 841783 - DNA, 13 bp, Homo sapiens
taaataaaagcac

SEQ ID NO: 841784 - DNA, 20 bp, Homo sapiens
taaataaaagcagcatctgc

SEQ ID NO: 841785 - DNA, 22 bp, Homo sapiens
taaataaaagctagatactgga

SEQ ID NO: 841786 - DNA, 11 bp, Homo sapiens
taaataaaata

SEQ ID NO: 841787 - DNA, 12 bp, Homo sapiens
taaataaaataa

SEQ ID NO: 841788 - DNA, 14 bp, Homo sapiens
taaataaaatgtgt

SEQ ID NO: 841789 - DNA, 15 bp, Homo sapiens
taaataaacagatgt

SEQ ID NO: 841790 - DNA, 19 bp, Homo sapiens
taaataaacagatgtatta

SEQ ID NO: 841791 - DNA, 13 bp, Homo sapiens
taaataaaccctt

SEQ ID NO: 841792 - DNA, 14 bp, Homo sapiens
taaataaagtatca

SEQ ID NO: 841793 - DNA, 15 bp, Homo sapiens
taaataaagtatcat

SEQ ID NO: 841794 - DNA, 21 bp, Homo sapiens
taaataaagtatcatgcattc

SEQ ID NO: 841795 - DNA, 13 bp, Homo sapiens
taaataaatagaa

SEQ ID NO: 841796 - DNA, 16 bp, Homo sapiens
taaataaatagaaaga

SEQ ID NO: 841797 - DNA, 16 bp, Homo sapiens
taaataaatcattaat

SEQ ID NO: 841798 - DNA, 16 bp, Homo sapiens
taaataaatgggtgta

SEQ ID NO: 841799 - DNA, 13 bp, Homo sapiens
taaataaattaag

SEQ ID NO: 841800 - DNA, 12 bp, Homo sapiens
taaataaatttc

SEQ ID NO: 841801 - DNA, 16 bp, Homo sapiens
taaataaatttgactt

SEQ ID NO: 841802 - DNA, 13 bp, Homo sapiens
taaataacacaga

SEQ ID NO: 841803 - DNA, 22 bp, Homo sapiens
taaataaccctgggctgtccag

SEQ ID NO: 841804 - DNA, 23 bp, Homo sapiens
taaataacctatttttttctcta

SEQ ID NO: 841805 - DNA, 19 bp, Homo sapiens
taaataacctctggccctt

SEQ ID NO: 841806 - DNA, 14 bp, Homo sapiens
taaataactggaaa

SEQ ID NO: 841807 - DNA, 14 bp, Homo sapiens
taaataactgtgtg

SEQ ID NO: 841808 - DNA, 13 bp, Homo sapiens
taaataagaaact

SEQ ID NO: 841809 - DNA, 15 bp, Homo sapiens
taaataagaaacttt

SEQ ID NO: 841810 - DNA, 13 bp, Homo sapiens
taaataagagatt

SEQ ID NO: 841811 - DNA, 18 bp, Homo sapiens
taaataaggaatttcctc

SEQ ID NO: 841812 - DNA, 21 bp, Homo sapiens
taaataatcatccctccttgc

SEQ ID NO: 841813 - DNA, 13 bp, Homo sapiens
taaataatgaaaa

SEQ ID NO: 841814 - DNA, 12 bp, Homo sapiens
taaataatgaat

SEQ ID NO: 841815 - DNA, 20 bp, Homo sapiens
taaataatgaataaactgaa

SEQ ID NO: 841816 - DNA, 19 bp, Homo sapiens
taaataatgtgaaactgga

SEQ ID NO: 841817 - DNA, 13 bp, Homo sapiens
taaataattggaa

SEQ ID NO: 841818 - DNA, 13 bp, Homo sapiens
taaataatttatt

SEQ ID NO: 841819 - DNA, 14 bp, Homo sapiens
taaataatttattt

SEQ ID NO: 841820 - DNA, 23 bp, Homo sapiens
taaataattttaaataacctctg

SEQ ID NO: 841821 - DNA, 14 bp, Homo sapiens
taaataattttcta

SEQ ID NO: 841822 - DNA, 16 bp, Homo sapiens
taaataattttctaag

SEQ ID NO: 841823 - DNA, 22 bp, Homo sapiens
taaataattttctaagacagtt

SEQ ID NO: 841824 - DNA, 19 bp, Homo sapiens
taaatacaattttttttat

SEQ ID NO: 841825 - DNA, 17 bp, Homo sapiens
taaatacactgaattga

SEQ ID NO: 841826 - DNA, 21 bp, Homo sapiens
taaatacactgaattgaatct

SEQ ID NO: 841827 - DNA, 14 bp, Homo sapiens
taaatacagacact

SEQ ID NO: 841828 - DNA, 17 bp, Homo sapiens
taaatacagataattca

SEQ ID NO: 841829 - DNA, 19 bp, Homo sapiens
taaatacagataattcatt

SEQ ID NO: 841830 - DNA, 20 bp, Homo sapiens
taaatacagcatacttcaaa

SEQ ID NO: 841831 - DNA, 14 bp, Homo sapiens
taaatacaggaaac

SEQ ID NO: 841832 - DNA, 13 bp, Homo sapiens
taaatacagtctt

SEQ ID NO: 841833 - DNA, 20 bp, Homo sapiens
taaatacagtcttccatttg

SEQ ID NO: 841834 - DNA, 22 bp, Homo sapiens
taaatacagtcttccatttgca

SEQ ID NO: 841835 - DNA, 23 bp, Homo sapiens
taaatacagtcttccatttgcaa

SEQ ID NO: 841836 - DNA, 16 bp, Homo sapiens
taaatacatatggatg

SEQ ID NO: 841837 - DNA, 15 bp, Homo sapiens
taaatacatgcatat

SEQ ID NO: 841838 - DNA, 20 bp, Homo sapiens
taaatacatgcatataatga

SEQ ID NO: 841839 - DNA, 22 bp, Homo sapiens
taaatacctcaacctatggtat

SEQ ID NO: 841840 - DNA, 13 bp, Homo sapiens
taaatactgcaaa

SEQ ID NO: 841841 - DNA, 17 bp, Homo sapiens
taaatactgcaaatcag

SEQ ID NO: 841842 - DNA, 22 bp, Homo sapiens
taaatactgcaaatcaggcttt

SEQ ID NO: 841843 - DNA, 23 bp, Homo sapiens
taaatactggactcaggaacttt

SEQ ID NO: 841844 - DNA, 19 bp, Homo sapiens
taaatactgtgcagaataa

SEQ ID NO: 841845 - DNA, 19 bp, Homo sapiens
taaatacttgcagttgtga

SEQ ID NO: 841846 - DNA, 16 bp, Homo sapiens
taaatactttttcagt

SEQ ID NO: 841847 - DNA, 18 bp, Homo sapiens
taaatagagtatatgcac

SEQ ID NO: 841848 - DNA, 16 bp, Homo sapiens
taaatagctatatcca

SEQ ID NO: 841849 - DNA, 22 bp, Homo sapiens
taaatagctatatccatgtact

SEQ ID NO: 841850 - DNA, 21 bp, Homo sapiens
taaatagctgaaaactaatgt

SEQ ID NO: 841851 - DNA, 22 bp, Homo sapiens
taaatagctgaaaactaatgta

SEQ ID NO: 841852 - DNA, 13 bp, Homo sapiens
taaataggaaagt

SEQ ID NO: 841853 - DNA, 12 bp, Homo sapiens
taacaaatctaa

SEQ ID NO: 841854 - DNA, 22 bp, Homo sapiens
taacaaattgggatctgtcttg

SEQ ID NO: 841855 - DNA, 20 bp, Homo sapiens
taacaaatttctttgtttaa

SEQ ID NO: 841856 - DNA, 14 bp, Homo sapiens
taacaacaacagtt

SEQ ID NO: 841857 - DNA, 22 bp, Homo sapiens
taacaacccacaccgtcttcct

SEQ ID NO: 841858 - DNA, 12 bp, Homo sapiens
taacaactgtga

SEQ ID NO: 841859 - DNA, 21 bp, Homo sapiens
taacaactttcagtggctttt

SEQ ID NO: 841860 - DNA, 15 bp, Homo sapiens
taacaagaaaacata

SEQ ID NO: 841861 - DNA, 16 bp, Homo sapiens
taacaagaaagtggtc

SEQ ID NO: 841862 - DNA, 15 bp, Homo sapiens
taacaagaagcccag

SEQ ID NO: 841863 - DNA, 16 bp, Homo sapiens
taacaagaagcccagt

SEQ ID NO: 841864 - DNA, 17 bp, Homo sapiens
taacaagatctttcagg

SEQ ID NO: 841865 - DNA, 20 bp, Homo sapiens
taacaaggaatgcctgtgcc

SEQ ID NO: 841866 - DNA, 20 bp, Homo sapiens
taacaagtcgatgaactatt

SEQ ID NO: 841867 - DNA, 21 bp, Homo sapiens
taacaataactactgtgttcc

SEQ ID NO: 841868 - DNA, 23 bp, Homo sapiens
taacaataactactgtgttcctg

SEQ ID NO: 841869 - DNA, 14 bp, Homo sapiens
taacaatacaaatg

SEQ ID NO: 841870 - DNA, 19 bp, Homo sapiens
taacaatacatgagaaaga

SEQ ID NO: 841871 - DNA, 22 bp, Homo sapiens
taacaatagataaggtttcctg

SEQ ID NO: 841872 - DNA, 23 bp, Homo sapiens
taacaatagataaggtttcctgc

SEQ ID NO: 841873 - DNA, 15 bp, Homo sapiens
taacaatagttctta

SEQ ID NO: 841874 - DNA, 23 bp, Homo sapiens
taacaatctatggcttatttcta

SEQ ID NO: 841875 - DNA, 21 bp, Homo sapiens
taacaatgacactagaaaact

SEQ ID NO: 841876 - DNA, 18 bp, Homo sapiens
taacaatgcctattgtaa

SEQ ID NO: 841877 - DNA, 20 bp, Homo sapiens
taacaattaattgtcttgca

SEQ ID NO: 841878 - DNA, 23 bp, Homo sapiens
taacaattcagtaacaaaggttt

SEQ ID NO: 841879 - DNA, 13 bp, Homo sapiens
taacaattgtctt

SEQ ID NO: 841880 - DNA, 14 bp, Homo sapiens
taacaattgtctta

SEQ ID NO: 841881 - DNA, 23 bp, Homo sapiens
taacaattgtgtagcctttttgt

SEQ ID NO: 841882 - DNA, 15 bp, Homo sapiens
taacaatttccttta

SEQ ID NO: 841883 - DNA, 17 bp, Homo sapiens
taacacaagtcctgtga

SEQ ID NO: 841884 - DNA, 20 bp, Homo sapiens
taacacactaccgaatgtgt

SEQ ID NO: 841885 - DNA, 13 bp, Homo sapiens
taacacagatatt

SEQ ID NO: 841886 - DNA, 17 bp, Homo sapiens
taacacagattattcat

SEQ ID NO: 841887 - DNA, 16 bp, Homo sapiens
taacacagccttcctt

SEQ ID NO: 841888 - DNA, 18 bp, Homo sapiens
taacacagccttccttct

SEQ ID NO: 841889 - DNA, 11 bp, Homo sapiens
taacacattat

SEQ ID NO: 841890 - DNA, 16 bp, Homo sapiens
taacacattctttata

SEQ ID NO: 841891 - DNA, 17 bp, Homo sapiens
taacacatttgattctg

SEQ ID NO: 841892 - DNA, 15 bp, Homo sapiens
taacacgctgcctgg

SEQ ID NO: 841893 - DNA, 18 bp, Homo sapiens
taacactaaaattttagg

SEQ ID NO: 841894 - DNA, 13 bp, Homo sapiens
taacactaatata

SEQ ID NO: 841895 - DNA, 16 bp, Homo sapiens
taacactaatatattt

SEQ ID NO: 841896 - DNA, 22 bp, Homo sapiens
taacactgtgatttatctttca

SEQ ID NO: 841897 - DNA, 12 bp, Homo sapiens
taacactgttgg

SEQ ID NO: 841898 - DNA, 13 bp, Homo sapiens
taacactgtttat

SEQ ID NO: 841899 - DNA, 15 bp, Homo sapiens
taacactttacaatg

SEQ ID NO: 841900 - DNA, 21 bp, Homo sapiens
taacactttagttatattcac

SEQ ID NO: 841901 - DNA, 13 bp, Homo sapiens
taacactttgtat

SEQ ID NO: 841902 - DNA, 13 bp, Homo sapiens
taacagaaattgt

SEQ ID NO: 841903 - DNA, 15 bp, Homo sapiens
taacagaaattgtat

SEQ ID NO: 841904 - DNA, 17 bp, Homo sapiens
taacagagagaatgaga

SEQ ID NO: 841905 - DNA, 15 bp, Homo sapiens
taacagatctttact

SEQ ID NO: 841906 - DNA, 12 bp, Homo sapiens
taacagatgcaa

SEQ ID NO: 841907 - DNA, 15 bp, Homo sapiens
taacagatgcaatgt

SEQ ID NO: 841908 - DNA, 14 bp, Homo sapiens
taacagcaaatgaa

SEQ ID NO: 841909 - DNA, 15 bp, Homo sapiens
taacagcatgctgct

SEQ ID NO: 841910 - DNA, 11 bp, Homo sapiens
taacagccctc

SEQ ID NO: 841911 - DNA, 14 bp, Homo sapiens
taacagcctcttgc

SEQ ID NO: 841912 - DNA, 12 bp, Homo sapiens
taacagctcctt

SEQ ID NO: 841913 - DNA, 12 bp, Homo sapiens
taacagctgagg

SEQ ID NO: 841914 - DNA, 23 bp, Homo sapiens
taacaggctcaatattcctgaat

SEQ ID NO: 841915 - DNA, 15 bp, Homo sapiens
taacagggagaagta

SEQ ID NO: 841916 - DNA, 18 bp, Homo sapiens
taacagggagaagtagct

SEQ ID NO: 841917 - DNA, 20 bp, Homo sapiens
taacagggagaagtagctag

SEQ ID NO: 841918 - DNA, 14 bp, Homo sapiens
taacaggtctcctc

SEQ ID NO: 841919 - DNA, 19 bp, Homo sapiens
taacagtcttactgcaggc

SEQ ID NO: 841920 - DNA, 17 bp, Homo sapiens
taacagtggacaaagtt

SEQ ID NO: 841921 - DNA, 12 bp, Homo sapiens
taacagtggctg

SEQ ID NO: 841922 - DNA, 14 bp, Homo sapiens
taacagttatattt

SEQ ID NO: 841923 - DNA, 17 bp, Homo sapiens
taacagttatatttttg

SEQ ID NO: 841924 - DNA, 23 bp, Homo sapiens
taacagttgtatttaacagaaat

SEQ ID NO: 841925 - DNA, 21 bp, Homo sapiens
taacagttgtgtcataaatta

SEQ ID NO: 841926 - DNA, 16 bp, Homo sapiens
taacagtttgcctgct

SEQ ID NO: 841927 - DNA, 14 bp, Homo sapiens
taacagttttccat

SEQ ID NO: 841928 - DNA, 16 bp, Homo sapiens
taacagttttccatga

SEQ ID NO: 841929 - DNA, 19 bp, Homo sapiens
taacagttttccatgaaaa

SEQ ID NO: 841930 - DNA, 21 bp, Homo sapiens
taacataaaatctgtgaatta

SEQ ID NO: 841931 - DNA, 22 bp, Homo sapiens
taacataactgcttcttggagc

SEQ ID NO: 841932 - DNA, 16 bp, Homo sapiens
taacataatttgtaca

SEQ ID NO: 841933 - DNA, 19 bp, Homo sapiens
taacataatttgtacatat

SEQ ID NO: 841934 - DNA, 23 bp, Homo sapiens
taacatacccgcctagctgctgt

SEQ ID NO: 841935 - DNA, 14 bp, Homo sapiens
taacatataatgtt

SEQ ID NO: 841936 - DNA, 23 bp, Homo sapiens
taacatataatgttgttatttaa

SEQ ID NO: 841937 - DNA, 12 bp, Homo sapiens
taacatatatat

SEQ ID NO: 841938 - DNA, 15 bp, Homo sapiens
taacatatctgatat

SEQ ID NO: 841939 - DNA, 21 bp, Homo sapiens
taacatatgcagtgttctaca

SEQ ID NO: 841940 - DNA, 23 bp, Homo sapiens
taacatattcaatgcaagtaaga

SEQ ID NO: 841941 - DNA, 14 bp, Homo sapiens
taacatattctaaa

SEQ ID NO: 841942 - DNA, 15 bp, Homo sapiens
taacatattctaaat

SEQ ID NO: 841943 - DNA, 13 bp, Homo sapiens
taacatatttact

SEQ ID NO: 841944 - DNA, 22 bp, Homo sapiens
taacatatttactaagccacaa

SEQ ID NO: 841945 - DNA, 17 bp, Homo sapiens
taacatcagccattttt

SEQ ID NO: 841946 - DNA, 18 bp, Homo sapiens
taacatcataattacatt

SEQ ID NO: 841947 - DNA, 15 bp, Homo sapiens
taacatcatcacttt

SEQ ID NO: 841948 - DNA, 17 bp, Homo sapiens
taacatcatcacttttt

SEQ ID NO: 841949 - DNA, 21 bp, Homo sapiens
taacatcatcactttttttga

SEQ ID NO: 841950 - DNA, 21 bp, Homo sapiens
taacatctttattgaaattct

SEQ ID NO: 841951 - DNA, 15 bp, Homo sapiens
taacatctttgtttt

SEQ ID NO: 841952 - DNA, 23 bp, Homo sapiens
taacatgaaaaacacggcagctg

SEQ ID NO: 841953 - DNA, 20 bp, Homo sapiens
taacatgaggggacattttg

SEQ ID NO: 841954 - DNA, 14 bp, Homo sapiens
taacatgctgccat

SEQ ID NO: 841955 - DNA, 12 bp, Homo sapiens
taacatgtaaaa

SEQ ID NO: 841956 - DNA, 13 bp, Homo sapiens
taacatgtaaaat

SEQ ID NO: 841957 - DNA, 17 bp, Homo sapiens
taacatgtaattaagta

SEQ ID NO: 841958 - DNA, 15 bp, Homo sapiens
taacatgtaggaagt

SEQ ID NO: 841959 - DNA, 14 bp, Homo sapiens
taacatgtcagttt

SEQ ID NO: 841960 - DNA, 22 bp, Homo sapiens
taacatgtcctgcctattatct

SEQ ID NO: 841961 - DNA, 10 bp, Homo sapiens
taacatgttt

SEQ ID NO: 841962 - DNA, 21 bp, Homo sapiens
taacattaatgcctgcttttt

SEQ ID NO: 841963 - DNA, 14 bp, Homo sapiens
taacattatttata

SEQ ID NO: 841964 - DNA, 15 bp, Homo sapiens
taacattatttatat

SEQ ID NO: 841965 - DNA, 15 bp, Homo sapiens
taacattcacagccc

SEQ ID NO: 841966 - DNA, 21 bp, Homo sapiens
taacattcaggaattcttgga

SEQ ID NO: 841967 - DNA, 15 bp, Homo sapiens
taacattcagttccc

SEQ ID NO: 841968 - DNA, 16 bp, Homo sapiens
taacattcccactgcc

SEQ ID NO: 841969 - DNA, 23 bp, Homo sapiens
taacattcgatctcattcagtat

SEQ ID NO: 841970 - DNA, 18 bp, Homo sapiens
taacattgaccaagaact

SEQ ID NO: 841971 - DNA, 13 bp, Homo sapiens
taacattggtgaa

SEQ ID NO: 841972 - DNA, 18 bp, Homo sapiens
taacattgtaaagtatgt

SEQ ID NO: 841973 - DNA, 20 bp, Homo sapiens
taacattgtaaagtatgtga

SEQ ID NO: 841974 - DNA, 17 bp, Homo sapiens
taacattgtttttgtat

SEQ ID NO: 841975 - DNA, 12 bp, Homo sapiens
taacatttaaat

SEQ ID NO: 841976 - DNA, 14 bp, Homo sapiens
taactactttataa

SEQ ID NO: 841977 - DNA, 19 bp, Homo sapiens
taactactttttatactcc

SEQ ID NO: 841978 - DNA, 20 bp, Homo sapiens
taactagaaccaccaaatat

SEQ ID NO: 841979 - DNA, 15 bp, Homo sapiens
taactagaattagta

SEQ ID NO: 841980 - DNA, 16 bp, Homo sapiens
taactagaattagtat

SEQ ID NO: 841981 - DNA, 17 bp, Homo sapiens
taactagaatttattca

SEQ ID NO: 841982 - DNA, 19 bp, Homo sapiens
taactagacatctgctgtt

SEQ ID NO: 841983 - DNA, 22 bp, Homo sapiens
taactagtcctgcagaggattt

SEQ ID NO: 841984 - DNA, 12 bp, Homo sapiens
taactatctcac

SEQ ID NO: 841985 - DNA, 19 bp, Homo sapiens
taactatctcacttccaga

SEQ ID NO: 841986 - DNA, 23 bp, Homo sapiens
taactattgcatttatatgtacc

SEQ ID NO: 841987 - DNA, 17 bp, Homo sapiens
taactattttgttttaa

SEQ ID NO: 841988 - DNA, 23 bp, Homo sapiens
taactcaagatggattaaagact

SEQ ID NO: 841989 - DNA, 13 bp, Homo sapiens
taactcacattct

SEQ ID NO: 841990 - DNA, 15 bp, Homo sapiens
taactcaccagcccc

SEQ ID NO: 841991 - DNA, 16 bp, Homo sapiens
taactcaccagcccca

SEQ ID NO: 841992 - DNA, 14 bp, Homo sapiens
taactcactggaat

SEQ ID NO: 841993 - DNA, 16 bp, Homo sapiens
taactcatcataaaat

SEQ ID NO: 841994 - DNA, 17 bp, Homo sapiens
taactcatcataaaata

SEQ ID NO: 841995 - DNA, 22 bp, Homo sapiens
taactccaagcagactccagcc

SEQ ID NO: 841996 - DNA, 11 bp, Homo sapiens
taactccacca

SEQ ID NO: 841997 - DNA, 14 bp, Homo sapiens
taactccctccacc

SEQ ID NO: 841998 - DNA, 16 bp, Homo sapiens
taactccctccaccag

SEQ ID NO: 841999 - DNA, 18 bp, Homo sapiens
taactccctccaccagcc

SEQ ID NO: 842000 - DNA, 19 bp, Homo sapiens
taactcctgagaaatgtta

SEQ ID NO: 842001 - DNA, 14 bp, Homo sapiens
taactccttcttgt

SEQ ID NO: 842002 - DNA, 14 bp, Homo sapiens
taactctaaaagat

SEQ ID NO: 842003 - DNA, 23 bp, Homo sapiens
taactctaaaagatcctttttaa

SEQ ID NO: 842004 - DNA, 18 bp, Homo sapiens
taactctaaccctgtgga

SEQ ID NO: 842005 - DNA, 20 bp, Homo sapiens
taactctcaagctaagtaaa

SEQ ID NO: 842006 - DNA, 14 bp, Homo sapiens
taactctctttcct

SEQ ID NO: 842007 - DNA, 19 bp, Homo sapiens
taactctgcaaaggcctgg

SEQ ID NO: 842008 - DNA, 16 bp, Homo sapiens
taactctgcccaccct

SEQ ID NO: 842009 - DNA, 20 bp, Homo sapiens
taactctggattttgaatta

SEQ ID NO: 842010 - DNA, 22 bp, Homo sapiens
taactctgtattacagctttca

SEQ ID NO: 842011 - DNA, 20 bp, Homo sapiens
taactcttacctaaactgag

SEQ ID NO: 842012 - DNA, 16 bp, Homo sapiens
taactgaaaatgtaaa

SEQ ID NO: 842013 - DNA, 18 bp, Homo sapiens
taactgaaaatgtaaatt

SEQ ID NO: 842014 - DNA, 14 bp, Homo sapiens
taactgaaaatgtg

SEQ ID NO: 842015 - DNA, 21 bp, Homo sapiens
taactgaaaatgtgctatact

SEQ ID NO: 842016 - DNA, 12 bp, Homo sapiens
taactgaagaaa

SEQ ID NO: 842017 - DNA, 16 bp, Homo sapiens
taactgaataccactc

SEQ ID NO: 842018 - DNA, 20 bp, Homo sapiens
taactgaatttggaatgttc

SEQ ID NO: 842019 - DNA, 20 bp, Homo sapiens
taactgacaagccatcttga

SEQ ID NO: 842020 - DNA, 19 bp, Homo sapiens
taactgcaaagtgaagttg

SEQ ID NO: 842021 - DNA, 19 bp, Homo sapiens
taactgcacctgggcagct

SEQ ID NO: 842022 - DNA, 13 bp, Homo sapiens
taactgcagacca

SEQ ID NO: 842023 - DNA, 17 bp, Homo sapiens
taactgcattgagaact

SEQ ID NO: 842024 - DNA, 13 bp, Homo sapiens
taactgcccagcc

SEQ ID NO: 842025 - DNA, 21 bp, Homo sapiens
taactgctcagagctttaaaa

SEQ ID NO: 842026 - DNA, 15 bp, Homo sapiens
taactgctgagccac

SEQ ID NO: 842027 - DNA, 18 bp, Homo sapiens
taactgcttcatctcctt

SEQ ID NO: 842028 - DNA, 17 bp, Homo sapiens
taactgctttctgttcc

SEQ ID NO: 842029 - DNA, 22 bp, Homo sapiens
taactggaaaacagaacactta

SEQ ID NO: 842030 - DNA, 22 bp, Homo sapiens
taactggaagcatgtaggagaa

SEQ ID NO: 842031 - DNA, 23 bp, Homo sapiens
taactggcagttttccattggtt

SEQ ID NO: 842032 - DNA, 16 bp, Homo sapiens
taactggccagccata

SEQ ID NO: 842033 - DNA, 15 bp, Homo sapiens
taactggggggccac

SEQ ID NO: 842034 - DNA, 17 bp, Homo sapiens
taactgggtaatgaaac

SEQ ID NO: 842035 - DNA, 21 bp, Homo sapiens
taactggtaagcgatttgaaa

SEQ ID NO: 842036 - DNA, 22 bp, Homo sapiens
taactggttaaaaaacaaatgt

SEQ ID NO: 842037 - DNA, 19 bp, Homo sapiens
taactggttgctgtgtcat

SEQ ID NO: 842038 - DNA, 21 bp, Homo sapiens
taactgtaaacttggaatcaa

SEQ ID NO: 842039 - DNA, 14 bp, Homo sapiens
taactgtaaatcat

SEQ ID NO: 842040 - DNA, 20 bp, Homo sapiens
taactgtagctcaagtttaa

SEQ ID NO: 842041 - DNA, 17 bp, Homo sapiens
taactgtgaataataaa

SEQ ID NO: 842042 - DNA, 15 bp, Homo sapiens
taactgtgtatgtac

SEQ ID NO: 842043 - DNA, 20 bp, Homo sapiens
taactgtgtatgtacatata

SEQ ID NO: 842044 - DNA, 17 bp, Homo sapiens
taactgttacagtaatg

SEQ ID NO: 842045 - DNA, 19 bp, Homo sapiens
taactgttttagaaattgg

SEQ ID NO: 842046 - DNA, 20 bp, Homo sapiens
taactgttttagaaattggt

SEQ ID NO: 842047 - DNA, 17 bp, Homo sapiens
taacttaaaaatgtaaa

SEQ ID NO: 842048 - DNA, 16 bp, Homo sapiens
taacttaaaatatttt

SEQ ID NO: 842049 - DNA, 16 bp, Homo sapiens
taacttaactgaaatg

SEQ ID NO: 842050 - DNA, 15 bp, Homo sapiens
taacttaatactcta

SEQ ID NO: 842051 - DNA, 16 bp, Homo sapiens
taacttaatagtattt

SEQ ID NO: 842052 - DNA, 13 bp, Homo sapiens
taacttacatttg

SEQ ID NO: 842053 - DNA, 17 bp, Homo sapiens
taacttacatttgtact

SEQ ID NO: 842054 - DNA, 19 bp, Homo sapiens
taacttacatttgtacttt

SEQ ID NO: 842055 - DNA, 13 bp, Homo sapiens
taacttactgtat

SEQ ID NO: 842056 - DNA, 15 bp, Homo sapiens
taacttagcatgtgt

SEQ ID NO: 842057 - DNA, 17 bp, Homo sapiens
taacttagctttatttt

SEQ ID NO: 842058 - DNA, 14 bp, Homo sapiens
taacttatattgaa

SEQ ID NO: 842059 - DNA, 18 bp, Homo sapiens
taacttatattgtaagaa

SEQ ID NO: 842060 - DNA, 14 bp, Homo sapiens
taacttattccaag

SEQ ID NO: 842061 - DNA, 23 bp, Homo sapiens
taacttatttatgttaaaagatt

SEQ ID NO: 842062 - DNA, 18 bp, Homo sapiens
taacttcacattaaaaaa

SEQ ID NO: 842063 - DNA, 14 bp, Homo sapiens
taacttcatagaaa

SEQ ID NO: 842064 - DNA, 19 bp, Homo sapiens
taacttccaaataaataat

SEQ ID NO: 842065 - DNA, 16 bp, Homo sapiens
taacttccagtggctg

SEQ ID NO: 842066 - DNA, 10 bp, Homo sapiens
taacttcctg

SEQ ID NO: 842067 - DNA, 13 bp, Homo sapiens
taacttcctgctg

SEQ ID NO: 842068 - DNA, 14 bp, Homo sapiens
taacttcctgctgc

SEQ ID NO: 842069 - DNA, 13 bp, Homo sapiens
taacttcctggct

SEQ ID NO: 842070 - DNA, 14 bp, Homo sapiens
taacttcctgtact

SEQ ID NO: 842071 - DNA, 18 bp, Homo sapiens
taacttctatattttaat

SEQ ID NO: 842072 - DNA, 18 bp, Homo sapiens
taacttcttatggaattg

SEQ ID NO: 842073 - DNA, 14 bp, Homo sapiens
taacttcttgaaaa

SEQ ID NO: 842074 - DNA, 17 bp, Homo sapiens
taacttcttgaaaaaga

SEQ ID NO: 842075 - DNA, 19 bp, Homo sapiens
taacttcttgcttctttct

SEQ ID NO: 842076 - DNA, 20 bp, Homo sapiens
taacttcttgcttctttcta

SEQ ID NO: 842077 - DNA, 12 bp, Homo sapiens
taacttctttct

SEQ ID NO: 842078 - DNA, 23 bp, Homo sapiens
taacttctttctatttgacttgt

SEQ ID NO: 842079 - DNA, 17 bp, Homo sapiens
taacttgaaaagaaaac

SEQ ID NO: 842080 - DNA, 18 bp, Homo sapiens
taacttgcaatgggcagc

SEQ ID NO: 842081 - DNA, 19 bp, Homo sapiens
taacttgcttaaatttctt

SEQ ID NO: 842082 - DNA, 14 bp, Homo sapiens
taacttggggaggc

SEQ ID NO: 842083 - DNA, 13 bp, Homo sapiens
taacttgtatatt

SEQ ID NO: 842084 - DNA, 16 bp, Homo sapiens
taacttgtatattcca

SEQ ID NO: 842085 - DNA, 21 bp, Homo sapiens
taacttgtattttgtcacttt

SEQ ID NO: 842086 - DNA, 21 bp, Homo sapiens
taactttactctgtgtttaaa

SEQ ID NO: 842087 - DNA, 17 bp, Homo sapiens
taactttatcacattat

SEQ ID NO: 842088 - DNA, 15 bp, Homo sapiens
taactttatgtgtaa

SEQ ID NO: 842089 - DNA, 16 bp, Homo sapiens
taactttatgtgtaaa

SEQ ID NO: 842090 - DNA, 18 bp, Homo sapiens
taactttatgtgtaaata

SEQ ID NO: 842091 - DNA, 17 bp, Homo sapiens
taactttattgcatata

SEQ ID NO: 842092 - DNA, 19 bp, Homo sapiens
taactttattgcatataga

SEQ ID NO: 842093 - DNA, 15 bp, Homo sapiens
taactttcagaggca

SEQ ID NO: 842094 - DNA, 13 bp, Homo sapiens
taactttctctta

SEQ ID NO: 842095 - DNA, 16 bp, Homo sapiens
taactttcttaccatt

SEQ ID NO: 842096 - DNA, 21 bp, Homo sapiens
taactttgtctcgttcctgtt

SEQ ID NO: 842097 - DNA, 11 bp, Homo sapiens
taacttttaat

SEQ ID NO: 842098 - DNA, 16 bp, Homo sapiens
taagaggatctcctgt

SEQ ID NO: 842099 - DNA, 18 bp, Homo sapiens
taagaggctttggcccaa

SEQ ID NO: 842100 - DNA, 15 bp, Homo sapiens
taagagggcagactg

SEQ ID NO: 842101 - DNA, 16 bp, Homo sapiens
taagagggctttttaa

SEQ ID NO: 842102 - DNA, 18 bp, Homo sapiens
taagaggtttttcctctt

SEQ ID NO: 842103 - DNA, 16 bp, Homo sapiens
taagagtggaggagga

SEQ ID NO: 842104 - DNA, 23 bp, Homo sapiens
taagagttgctttgccagagcag

SEQ ID NO: 842105 - DNA, 17 bp, Homo sapiens
taagataacttactgta

SEQ ID NO: 842106 - DNA, 23 bp, Homo sapiens
taagataatagtttacatgtagt

SEQ ID NO: 842107 - DNA, 12 bp, Homo sapiens
taagataattat

SEQ ID NO: 842108 - DNA, 13 bp, Homo sapiens
taagataattata

SEQ ID NO: 842109 - DNA, 16 bp, Homo sapiens
taagatagtgtaactt

SEQ ID NO: 842110 - DNA, 20 bp, Homo sapiens
taagatatccatctttttct

SEQ ID NO: 842111 - DNA, 21 bp, Homo sapiens
taagatatccatctttttctt

SEQ ID NO: 842112 - DNA, 23 bp, Homo sapiens
taagatatccctaatgttttgct

SEQ ID NO: 842113 - DNA, 15 bp, Homo sapiens
taagatcctaaactc

SEQ ID NO: 842114 - DNA, 16 bp, Homo sapiens
taagatcctaaactct

SEQ ID NO: 842115 - DNA, 17 bp, Homo sapiens
taagatctatagcctct

SEQ ID NO: 842116 - DNA, 13 bp, Homo sapiens
taagatctgactg

SEQ ID NO: 842117 - DNA, 17 bp, Homo sapiens
taagatgaaatgcactg

SEQ ID NO: 842118 - DNA, 19 bp, Homo sapiens
taagatgaaatgcactgta

SEQ ID NO: 842119 - DNA, 21 bp, Homo sapiens
taagatgaaatgcactgtatt

SEQ ID NO: 842120 - DNA, 15 bp, Homo sapiens
taagatgaaattgcc

SEQ ID NO: 842121 - DNA, 16 bp, Homo sapiens
taagatgaaattgcca

SEQ ID NO: 842122 - DNA, 14 bp, Homo sapiens
taagatgactctga

SEQ ID NO: 842123 - DNA, 15 bp, Homo sapiens
taagatgactctgag

SEQ ID NO: 842124 - DNA, 17 bp, Homo sapiens
taagatgagatttgcca

SEQ ID NO: 842125 - DNA, 13 bp, Homo sapiens
taagatgctgggt

SEQ ID NO: 842126 - DNA, 20 bp, Homo sapiens
taagatggattctcagatat

SEQ ID NO: 842127 - DNA, 21 bp, Homo sapiens
taagatggattctcagatatt

SEQ ID NO: 842128 - DNA, 16 bp, Homo sapiens
taagatggctgtggca

SEQ ID NO: 842129 - DNA, 21 bp, Homo sapiens
taagatggctgtggcatttcc

SEQ ID NO: 842130 - DNA, 22 bp, Homo sapiens
taagatggctgtggcatttcca

SEQ ID NO: 842131 - DNA, 17 bp, Homo sapiens
taagatgttcactgtgg

SEQ ID NO: 842132 - DNA, 13 bp, Homo sapiens
taagattaaagga

SEQ ID NO: 842133 - DNA, 14 bp, Homo sapiens
taagattcatattt

SEQ ID NO: 842134 - DNA, 15 bp, Homo sapiens
taagattcttttaaa

SEQ ID NO: 842135 - DNA, 23 bp, Homo sapiens
taagattggtgttcgtttccatc

SEQ ID NO: 842136 - DNA, 19 bp, Homo sapiens
taagattgttattaaatgt

SEQ ID NO: 842137 - DNA, 13 bp, Homo sapiens
taagatttactta

SEQ ID NO: 842138 - DNA, 23 bp, Homo sapiens
taagatttgtgtttttctttttc

SEQ ID NO: 842139 - DNA, 17 bp, Homo sapiens
taagattttatctgggg

SEQ ID NO: 842140 - DNA, 15 bp, Homo sapiens
taagcaaaagaaaaa

SEQ ID NO: 842141 - DNA, 21 bp, Homo sapiens
taagcaaagcacccatttcaa

SEQ ID NO: 842142 - DNA, 21 bp, Homo sapiens
taagcaaaggctctgaaataa

SEQ ID NO: 842143 - DNA, 19 bp, Homo sapiens
taagcaaaggggacagctg

SEQ ID NO: 842144 - DNA, 14 bp, Homo sapiens
taagcaagaaggca

SEQ ID NO: 842145 - DNA, 18 bp, Homo sapiens
taagcaatggtaattgtg

SEQ ID NO: 842146 - DNA, 16 bp, Homo sapiens
taagcactacataaac

SEQ ID NO: 842147 - DNA, 22 bp, Homo sapiens
taagcactacataaactgactt

SEQ ID NO: 842148 - DNA, 14 bp, Homo sapiens
taagcacttctaga

SEQ ID NO: 842149 - DNA, 23 bp, Homo sapiens
taagcacttgcctggaataaaat

SEQ ID NO: 842150 - DNA, 17 bp, Homo sapiens
taagcactttgaaaata

SEQ ID NO: 842151 - DNA, 22 bp, Homo sapiens
taagcactttgaaaatatttct

SEQ ID NO: 842152 - DNA, 23 bp, Homo sapiens
taagcactttgaaaatatttcta

SEQ ID NO: 842153 - DNA, 17 bp, Homo sapiens
taagcagaacaaatgtg

SEQ ID NO: 842154 - DNA, 21 bp, Homo sapiens
taagcagaacaaatgtgtttt

SEQ ID NO: 842155 - DNA, 16 bp, Homo sapiens
taagcagaggaggggc

SEQ ID NO: 842156 - DNA, 18 bp, Homo sapiens
taagcagattgctttaat

SEQ ID NO: 842157 - DNA, 15 bp, Homo sapiens
taagcagcatggaaa

SEQ ID NO: 842158 - DNA, 19 bp, Homo sapiens
taagcagcatggaaaaatg

SEQ ID NO: 842159 - DNA, 14 bp, Homo sapiens
taagcagccaggag

SEQ ID NO: 842160 - DNA, 16 bp, Homo sapiens
taagcagccaggaggg

SEQ ID NO: 842161 - DNA, 16 bp, Homo sapiens
taagcagctaaatttt

SEQ ID NO: 842162 - DNA, 17 bp, Homo sapiens
taagcagctaaattttc

SEQ ID NO: 842163 - DNA, 17 bp, Homo sapiens
taagcaggcattgcttt

SEQ ID NO: 842164 - DNA, 21 bp, Homo sapiens
taagcagtatattagtattat

SEQ ID NO: 842165 - DNA, 19 bp, Homo sapiens
taagcatactttgtaaata

SEQ ID NO: 842166 - DNA, 15 bp, Homo sapiens
taagcatctacttca

SEQ ID NO: 842167 - DNA, 20 bp, Homo sapiens
taagcattgtttgcttattg

SEQ ID NO: 842168 - DNA, 16 bp, Homo sapiens
taagcatttgtatatt

SEQ ID NO: 842169 - DNA, 17 bp, Homo sapiens
taagcattttgaaacaa

SEQ ID NO: 842170 - DNA, 19 bp, Homo sapiens
taagcattttgaaacaaag

SEQ ID NO: 842171 - DNA, 12 bp, Homo sapiens
taagccaaagaa

SEQ ID NO: 842172 - DNA, 15 bp, Homo sapiens
taagccaaagaaaca

SEQ ID NO: 842173 - DNA, 18 bp, Homo sapiens
taagccactgcctctccc

SEQ ID NO: 842174 - DNA, 17 bp, Homo sapiens
taagccacttaaaatgt

SEQ ID NO: 842175 - DNA, 17 bp, Homo sapiens
taagccagagtgtatta

SEQ ID NO: 842176 - DNA, 13 bp, Homo sapiens
taagccagcctgg

SEQ ID NO: 842177 - DNA, 14 bp, Homo sapiens
taagccagcctggt

SEQ ID NO: 842178 - DNA, 16 bp, Homo sapiens
taagccaggaccccaa

SEQ ID NO: 842179 - DNA, 17 bp, Homo sapiens
taagccaggcctggctg

SEQ ID NO: 842180 - DNA, 20 bp, Homo sapiens
taagccatagaccctgaggc

SEQ ID NO: 842181 - DNA, 18 bp, Homo sapiens
taagcccagtgcactgaa

SEQ ID NO: 842182 - DNA, 14 bp, Homo sapiens
taagcccccagggc

SEQ ID NO: 842183 - DNA, 21 bp, Homo sapiens
taagcccccagggcctccagg

SEQ ID NO: 842184 - DNA, 13 bp, Homo sapiens
taagcccccgctg

SEQ ID NO: 842185 - DNA, 16 bp, Homo sapiens
taagccctgcataatg

SEQ ID NO: 842186 - DNA, 18 bp, Homo sapiens
taagccctgcataatgtt

SEQ ID NO: 842187 - DNA, 11 bp, Homo sapiens
taagccctgtc

SEQ ID NO: 842188 - DNA, 22 bp, Homo sapiens
taagccctgtcgagacacttgc

SEQ ID NO: 842189 - DNA, 17 bp, Homo sapiens
taagccctttgctctgg

SEQ ID NO: 842190 - DNA, 16 bp, Homo sapiens
taagcctaaaagtggg

SEQ ID NO: 842191 - DNA, 16 bp, Homo sapiens
taagcctcatatttaa

SEQ ID NO: 842192 - DNA, 19 bp, Homo sapiens
taagcctccatttagttct

SEQ ID NO: 842193 - DNA, 22 bp, Homo sapiens
taagcctgcggcgccagcctca

SEQ ID NO: 842194 - DNA, 15 bp, Homo sapiens
taagcctggaagcca

SEQ ID NO: 842195 - DNA, 16 bp, Homo sapiens
taagccttcatttgca

SEQ ID NO: 842196 - DNA, 20 bp, Homo sapiens
taagccttcatttgcaattc

SEQ ID NO: 842197 - DNA, 16 bp, Homo sapiens
taagcctttccataag

SEQ ID NO: 842198 - DNA, 21 bp, Homo sapiens
taagcgaagtctttgccttct

SEQ ID NO: 842199 - DNA, 17 bp, Homo sapiens
taagcgatttgaaacac

SEQ ID NO: 842200 - DNA, 23 bp, Homo sapiens
taagcggtggaggaaggctctgt

SEQ ID NO: 842201 - DNA, 21 bp, Homo sapiens
taagctacttattcatagttt

SEQ ID NO: 842202 - DNA, 19 bp, Homo sapiens
taagctatccgtgttgcag

SEQ ID NO: 842203 - DNA, 15 bp, Homo sapiens
taagctcagaatcca

SEQ ID NO: 842204 - DNA, 15 bp, Homo sapiens
taagctcagtgatac

SEQ ID NO: 842205 - DNA, 14 bp, Homo sapiens
taagctccagcttt

SEQ ID NO: 842206 - DNA, 16 bp, Homo sapiens
taagctccatgtgcat

SEQ ID NO: 842207 - DNA, 18 bp, Homo sapiens
taagctccatgtgcatat

SEQ ID NO: 842208 - DNA, 21 bp, Homo sapiens
taagctccatgtgcatataaa

SEQ ID NO: 842209 - DNA, 17 bp, Homo sapiens
taagctctttgagaact

SEQ ID NO: 842210 - DNA, 18 bp, Homo sapiens
taagctgatattatttct

SEQ ID NO: 842211 - DNA, 20 bp, Homo sapiens
taagctgatattatttcttc

SEQ ID NO: 842212 - DNA, 10 bp, Homo sapiens
taagctgcaa

SEQ ID NO: 842213 - DNA, 16 bp, Homo sapiens
taagctggactagtgt

SEQ ID NO: 842214 - DNA, 18 bp, Homo sapiens
taagctggagctcttgga

SEQ ID NO: 842215 - DNA, 17 bp, Homo sapiens
taagctggctctgtttg

SEQ ID NO: 842216 - DNA, 22 bp, Homo sapiens
taagctggctgtacctgttcct

SEQ ID NO: 842217 - DNA, 13 bp, Homo sapiens
taagctgtgtctg

SEQ ID NO: 842218 - DNA, 22 bp, Homo sapiens
taagctgtgtctgcccaatgaa

SEQ ID NO: 842219 - DNA, 22 bp, Homo sapiens
taagctgttactgtcttcagta

SEQ ID NO: 842220 - DNA, 18 bp, Homo sapiens
taataccaccatttaaaa

SEQ ID NO: 842221 - DNA, 17 bp, Homo sapiens
taatacgtgccagatat

SEQ ID NO: 842222 - DNA, 15 bp, Homo sapiens
taatactaaaactca

SEQ ID NO: 842223 - DNA, 18 bp, Homo sapiens
taatactcaaatgagtaa

SEQ ID NO: 842224 - DNA, 14 bp, Homo sapiens
taatactctatttt

SEQ ID NO: 842225 - DNA, 16 bp, Homo sapiens
taatactggaataatt

SEQ ID NO: 842226 - DNA, 19 bp, Homo sapiens
taatacttaaataaacatg

SEQ ID NO: 842227 - DNA, 12 bp, Homo sapiens
taatacttgcaa

SEQ ID NO: 842228 - DNA, 15 bp, Homo sapiens
taatacttgcaacta

SEQ ID NO: 842229 - DNA, 20 bp, Homo sapiens
taatacttttttattttgtt

SEQ ID NO: 842230 - DNA, 15 bp, Homo sapiens
taatagaaaactgaa

SEQ ID NO: 842231 - DNA, 19 bp, Homo sapiens
taatagaaaactgaaaatc

SEQ ID NO: 842232 - DNA, 17 bp, Homo sapiens
taatagaaaagtatgtt

SEQ ID NO: 842233 - DNA, 21 bp, Homo sapiens
taatagaagaacatccaagga

SEQ ID NO: 842234 - DNA, 16 bp, Homo sapiens
taatagaataaaggca

SEQ ID NO: 842235 - DNA, 15 bp, Homo sapiens
taatagaatgataaa

SEQ ID NO: 842236 - DNA, 17 bp, Homo sapiens
taatagactaaatgaaa

SEQ ID NO: 842237 - DNA, 15 bp, Homo sapiens
taatagacttctctt

SEQ ID NO: 842238 - DNA, 18 bp, Homo sapiens
taatagagagattagtaa

SEQ ID NO: 842239 - DNA, 18 bp, Homo sapiens
taatagattatttcatat

SEQ ID NO: 842240 - DNA, 15 bp, Homo sapiens
taatagcaaagaatt

SEQ ID NO: 842241 - DNA, 21 bp, Homo sapiens
taatagcaacttttgtgtaat

SEQ ID NO: 842242 - DNA, 20 bp, Homo sapiens
taatagcatccactggaaaa

SEQ ID NO: 842243 - DNA, 16 bp, Homo sapiens
taatagcttttgatta

SEQ ID NO: 842244 - DNA, 21 bp, Homo sapiens
taatagcttttgattagtata

SEQ ID NO: 842245 - DNA, 20 bp, Homo sapiens
taataggaatcaccctccta

SEQ ID NO: 842246 - DNA, 13 bp, Homo sapiens
taataggaattca

SEQ ID NO: 842247 - DNA, 14 bp, Homo sapiens
taataggcatttta

SEQ ID NO: 842248 - DNA, 16 bp, Homo sapiens
taataggcattttaag

SEQ ID NO: 842249 - DNA, 18 bp, Homo sapiens
taataggcattttaagta

SEQ ID NO: 842250 - DNA, 21 bp, Homo sapiens
taataggcattttaagtaaaa

SEQ ID NO: 842251 - DNA, 14 bp, Homo sapiens
taatagggaatata

SEQ ID NO: 842252 - DNA, 16 bp, Homo sapiens
taatagggaatatatc

SEQ ID NO: 842253 - DNA, 21 bp, Homo sapiens
taataggtgggggaaaatgaa

SEQ ID NO: 842254 - DNA, 21 bp, Homo sapiens
taatagtaatttgtaaagttg

SEQ ID NO: 842255 - DNA, 19 bp, Homo sapiens
taatagtccaatatttggc

SEQ ID NO: 842256 - DNA, 14 bp, Homo sapiens
taatagtccatgga

SEQ ID NO: 842257 - DNA, 21 bp, Homo sapiens
taatagtgcttaaaaatcatt

SEQ ID NO: 842258 - DNA, 14 bp, Homo sapiens
taatagtgcttttt

SEQ ID NO: 842259 - DNA, 23 bp, Homo sapiens
taatagtgcttttttttttttga

SEQ ID NO: 842260 - DNA, 15 bp, Homo sapiens
taatagttagccctc

SEQ ID NO: 842261 - DNA, 14 bp, Homo sapiens
taatagttcagtag

SEQ ID NO: 842262 - DNA, 20 bp, Homo sapiens
taatagttcagtagaattac

SEQ ID NO: 842263 - DNA, 16 bp, Homo sapiens
taatagttctatcctt

SEQ ID NO: 842264 - DNA, 23 bp, Homo sapiens
taatagttctatccttttgcctg

SEQ ID NO: 842265 - DNA, 20 bp, Homo sapiens
taatagtttgtctattttaa

SEQ ID NO: 842266 - DNA, 18 bp, Homo sapiens
taatataaattcactttc

SEQ ID NO: 842267 - DNA, 15 bp, Homo sapiens
taatataacttgaaa

SEQ ID NO: 842268 - DNA, 16 bp, Homo sapiens
taatatactatattta

SEQ ID NO: 842269 - DNA, 12 bp, Homo sapiens
taatatagaaaa

SEQ ID NO: 842270 - DNA, 21 bp, Homo sapiens
taatatagtaggggttgaaga

SEQ ID NO: 842271 - DNA, 14 bp, Homo sapiens
taatatatatgaat

SEQ ID NO: 842272 - DNA, 18 bp, Homo sapiens
taatatatatgaataaag

SEQ ID NO: 842273 - DNA, 17 bp, Homo sapiens
taatatatcccagaaat

SEQ ID NO: 842274 - DNA, 16 bp, Homo sapiens
taatatattaaaattc

SEQ ID NO: 842275 - DNA, 14 bp, Homo sapiens
taatatatttaaaa

SEQ ID NO: 842276 - DNA, 22 bp, Homo sapiens
taatatatttttatatttagtt

SEQ ID NO: 842277 - DNA, 21 bp, Homo sapiens
taatatcaaataaaatatcat

SEQ ID NO: 842278 - DNA, 18 bp, Homo sapiens
taatatcaactctgaagc

SEQ ID NO: 842279 - DNA, 15 bp, Homo sapiens
taatatcaatagaag

SEQ ID NO: 842280 - DNA, 18 bp, Homo sapiens
taatatcactcattaatt

SEQ ID NO: 842281 - DNA, 18 bp, Homo sapiens
taatatccctacatgtat

SEQ ID NO: 842282 - DNA, 15 bp, Homo sapiens
taatatctaaagtta

SEQ ID NO: 842283 - DNA, 18 bp, Homo sapiens
taatatctggcactgtta

SEQ ID NO: 842284 - DNA, 17 bp, Homo sapiens
taatatcttcacattgt

SEQ ID NO: 842285 - DNA, 12 bp, Homo sapiens
taatatcttgct

SEQ ID NO: 842286 - DNA, 19 bp, Homo sapiens
taatatctttctgcacaca

SEQ ID NO: 842287 - DNA, 15 bp, Homo sapiens
taatatgaagccttt

SEQ ID NO: 842288 - DNA, 23 bp, Homo sapiens
taatatgagcttcaatataagaa

SEQ ID NO: 842289 - DNA, 21 bp, Homo sapiens
taatatgattctagtacataa

SEQ ID NO: 842290 - DNA, 16 bp, Homo sapiens
taatatgcaaagtcta

SEQ ID NO: 842291 - DNA, 15 bp, Homo sapiens
taatatgcacacatt

SEQ ID NO: 842292 - DNA, 18 bp, Homo sapiens
taatatgcacacattttt

SEQ ID NO: 842293 - DNA, 10 bp, Homo sapiens
taatatgcat

SEQ ID NO: 842294 - DNA, 21 bp, Homo sapiens
taatatgctgcaacaaaatgt

SEQ ID NO: 842295 - DNA, 16 bp, Homo sapiens
taatatgctgccaaat

SEQ ID NO: 842296 - DNA, 13 bp, Homo sapiens
taatatggaacct

SEQ ID NO: 842297 - DNA, 22 bp, Homo sapiens
taatatggaaccttccctccaa

SEQ ID NO: 842298 - DNA, 22 bp, Homo sapiens
taatatggccacagtagtcttg

SEQ ID NO: 842299 - DNA, 21 bp, Homo sapiens
taatatggctatgcttaaaag

SEQ ID NO: 842300 - DNA, 18 bp, Homo sapiens
taatatgtttaatgttca

SEQ ID NO: 842301 - DNA, 16 bp, Homo sapiens
taatattagtgattct

SEQ ID NO: 842302 - DNA, 19 bp, Homo sapiens
taatattcttttgtttcca

SEQ ID NO: 842303 - DNA, 20 bp, Homo sapiens
taatattgaaaattgaaaag

SEQ ID NO: 842304 - DNA, 21 bp, Homo sapiens
taatattgaaaattgaaaagt

SEQ ID NO: 842305 - DNA, 16 bp, Homo sapiens
taatattgacttgtat

SEQ ID NO: 842306 - DNA, 19 bp, Homo sapiens
taatattgagaaagaaact

SEQ ID NO: 842307 - DNA, 13 bp, Homo sapiens
taatattgagaat

SEQ ID NO: 842308 - DNA, 14 bp, Homo sapiens
taatatttactgtt

SEQ ID NO: 842309 - DNA, 18 bp, Homo sapiens
taatatttactgttagaa

SEQ ID NO: 842310 - DNA, 21 bp, Homo sapiens
taatatttcttaatttggata

SEQ ID NO: 842311 - DNA, 12 bp, Homo sapiens
taatattttgta

SEQ ID NO: 842312 - DNA, 13 bp, Homo sapiens
taatattttgtat

SEQ ID NO: 842313 - DNA, 19 bp, Homo sapiens
taatcaaaattgtctcttc

SEQ ID NO: 842314 - DNA, 20 bp, Homo sapiens
taatcaaagctcataatgga

SEQ ID NO: 842315 - DNA, 11 bp, Homo sapiens
taatcaagaga

SEQ ID NO: 842316 - DNA, 10 bp, Homo sapiens
taatcaagat

SEQ ID NO: 842317 - DNA, 22 bp, Homo sapiens
taatcaagcctttatggctgct

SEQ ID NO: 842318 - DNA, 23 bp, Homo sapiens
taatcaagtacctatattgattt

SEQ ID NO: 842319 - DNA, 17 bp, Homo sapiens
taatcaatatcccaaca

SEQ ID NO: 842320 - DNA, 23 bp, Homo sapiens
taatcaatatcccaacattctgc

SEQ ID NO: 842321 - DNA, 18 bp, Homo sapiens
taatcaatgtttcttcta

SEQ ID NO: 842322 - DNA, 13 bp, Homo sapiens
taatcaccaaagt

SEQ ID NO: 842323 - DNA, 15 bp, Homo sapiens
taatcaccatgtaag

SEQ ID NO: 842324 - DNA, 21 bp, Homo sapiens
taatcaccctaccaactttac

SEQ ID NO: 842325 - DNA, 15 bp, Homo sapiens
taatcacgctttcct

SEQ ID NO: 842326 - DNA, 17 bp, Homo sapiens
taatcacgctttcctga

SEQ ID NO: 842327 - DNA, 14 bp, Homo sapiens
taatcactactgta

SEQ ID NO: 842328 - DNA, 13 bp, Homo sapiens
taatcactctgag

SEQ ID NO: 842329 - DNA, 20 bp, Homo sapiens
taatcagaaaagtaattttg

SEQ ID NO: 842330 - DNA, 23 bp, Homo sapiens
taatcagaatgaaccctcctcct

SEQ ID NO: 842331 - DNA, 22 bp, Homo sapiens
taatcagatgatggccatttct

SEQ ID NO: 842332 - DNA, 20 bp, Homo sapiens
taatcagcaagaatttgatc

SEQ ID NO: 842333 - DNA, 20 bp, Homo sapiens
taatcagcaatattgcctgt

SEQ ID NO: 842334 - DNA, 19 bp, Homo sapiens
taatcagcatatgtgtaaa

SEQ ID NO: 842335 - DNA, 16 bp, Homo sapiens
taatcagccccagagt

SEQ ID NO: 842336 - DNA, 17 bp, Homo sapiens
taatcaggaaaaatgag

SEQ ID NO: 842337 - DNA, 19 bp, Homo sapiens
taatcaggtcctcagagaa

SEQ ID NO: 842338 - DNA, 15 bp, Homo sapiens
taatcatacaaactc

SEQ ID NO: 842339 - DNA, 15 bp, Homo sapiens
taatcatataataaa

SEQ ID NO: 842340 - DNA, 13 bp, Homo sapiens
taatcatatgtgt

SEQ ID NO: 842341 - DNA, 18 bp, Homo sapiens
taatcatcaagtaataca

SEQ ID NO: 842342 - DNA, 17 bp, Homo sapiens
taattatataactgtat

SEQ ID NO: 842343 - DNA, 14 bp, Homo sapiens
taattatccaggaa

SEQ ID NO: 842344 - DNA, 17 bp, Homo sapiens
taattatcggaagcagt

SEQ ID NO: 842345 - DNA, 20 bp, Homo sapiens
taattatcgggaacagtgtt

SEQ ID NO: 842346 - DNA, 14 bp, Homo sapiens
taattatgaaaact

SEQ ID NO: 842347 - DNA, 21 bp, Homo sapiens
taattatgacagttatactgt

SEQ ID NO: 842348 - DNA, 18 bp, Homo sapiens
taattattaataccaaat

SEQ ID NO: 842349 - DNA, 15 bp, Homo sapiens
taattattataaaaa

SEQ ID NO: 842350 - DNA, 14 bp, Homo sapiens
taattattattctt

SEQ ID NO: 842351 - DNA, 17 bp, Homo sapiens
taattattatttatata

SEQ ID NO: 842352 - DNA, 13 bp, Homo sapiens
taattatttaaat

SEQ ID NO: 842353 - DNA, 18 bp, Homo sapiens
taattatttaaataaaat

SEQ ID NO: 842354 - DNA, 20 bp, Homo sapiens
taattattttaaaatattta

SEQ ID NO: 842355 - DNA, 21 bp, Homo sapiens
taattattttggtacttttat

SEQ ID NO: 842356 - DNA, 18 bp, Homo sapiens
taattcaagcctctaaac

SEQ ID NO: 842357 - DNA, 19 bp, Homo sapiens
taattcaagcctctaaaca

SEQ ID NO: 842358 - DNA, 22 bp, Homo sapiens
taattcaaggaatttcttaact

SEQ ID NO: 842359 - DNA, 20 bp, Homo sapiens
taattcaaggagaatatgat

SEQ ID NO: 842360 - DNA, 17 bp, Homo sapiens
taattcacctatgttat

SEQ ID NO: 842361 - DNA, 14 bp, Homo sapiens
taattcacctcagc

SEQ ID NO: 842362 - DNA, 17 bp, Homo sapiens
taattcagatgttttac

SEQ ID NO: 842363 - DNA, 17 bp, Homo sapiens
taattcaggcatatttt

SEQ ID NO: 842364 - DNA, 19 bp, Homo sapiens
taattcaggcatattttaa

SEQ ID NO: 842365 - DNA, 21 bp, Homo sapiens
taattcagggtggtaaagtat

SEQ ID NO: 842366 - DNA, 13 bp, Homo sapiens
taattcaggtatg

SEQ ID NO: 842367 - DNA, 16 bp, Homo sapiens
taattcaggtttttcc

SEQ ID NO: 842368 - DNA, 13 bp, Homo sapiens
taattcagtacaa

SEQ ID NO: 842369 - DNA, 18 bp, Homo sapiens
taattcagtatgatttat

SEQ ID NO: 842370 - DNA, 14 bp, Homo sapiens
taattcatgtttct

SEQ ID NO: 842371 - DNA, 15 bp, Homo sapiens
taattcatgtttctt

SEQ ID NO: 842372 - DNA, 18 bp, Homo sapiens
taattcatttgtattgct

SEQ ID NO: 842373 - DNA, 14 bp, Homo sapiens
taattccacagctg

SEQ ID NO: 842374 - DNA, 20 bp, Homo sapiens
taattccatgtcagataagt

SEQ ID NO: 842375 - DNA, 22 bp, Homo sapiens
taattccatgtcagataagtgt

SEQ ID NO: 842376 - DNA, 19 bp, Homo sapiens
taattcccaacatttctta

SEQ ID NO: 842377 - DNA, 23 bp, Homo sapiens
taattcccattttgcaaaatttc

SEQ ID NO: 842378 - DNA, 15 bp, Homo sapiens
taattccctatcttt

SEQ ID NO: 842379 - DNA, 19 bp, Homo sapiens
taattcctacctccctgca

SEQ ID NO: 842380 - DNA, 18 bp, Homo sapiens
taattctaaatgaatgtt

SEQ ID NO: 842381 - DNA, 12 bp, Homo sapiens
taattctaagtt

SEQ ID NO: 842382 - DNA, 21 bp, Homo sapiens
taattctaagttatttacttt

SEQ ID NO: 842383 - DNA, 15 bp, Homo sapiens
taattctatttctct

SEQ ID NO: 842384 - DNA, 17 bp, Homo sapiens
taattctatttctctat

SEQ ID NO: 842385 - DNA, 18 bp, Homo sapiens
taattctcattaaaagaa

SEQ ID NO: 842386 - DNA, 14 bp, Homo sapiens
taattctccttccc

SEQ ID NO: 842387 - DNA, 16 bp, Homo sapiens
taattctctttcaaag

SEQ ID NO: 842388 - DNA, 12 bp, Homo sapiens
taattctgaaac

SEQ ID NO: 842389 - DNA, 15 bp, Homo sapiens
taattctgtaaatgt

SEQ ID NO: 842390 - DNA, 17 bp, Homo sapiens
taattcttatgactaaa

SEQ ID NO: 842391 - DNA, 17 bp, Homo sapiens
taattcttcacctgtta

SEQ ID NO: 842392 - DNA, 18 bp, Homo sapiens
taattcttcacctttgta

SEQ ID NO: 842393 - DNA, 19 bp, Homo sapiens
taattcttcacctttgtaa

SEQ ID NO: 842394 - DNA, 14 bp, Homo sapiens
taattcttccaaag

SEQ ID NO: 842395 - DNA, 16 bp, Homo sapiens
taattcttggattcca

SEQ ID NO: 842396 - DNA, 15 bp, Homo sapiens
taattcttgtatatt

SEQ ID NO: 842397 - DNA, 20 bp, Homo sapiens
taattgacaggattattgga

SEQ ID NO: 842398 - DNA, 21 bp, Homo sapiens
taattgatcagatgctgaatt

SEQ ID NO: 842399 - DNA, 23 bp, Homo sapiens
taattgatcagatgctgaattga

SEQ ID NO: 842400 - DNA, 22 bp, Homo sapiens
taattgatgcaaataacacaaa

SEQ ID NO: 842401 - DNA, 13 bp, Homo sapiens
taattgattaaaa

SEQ ID NO: 842402 - DNA, 14 bp, Homo sapiens
taattgattaaaat

SEQ ID NO: 842403 - DNA, 18 bp, Homo sapiens
taattgattaaaatctct

SEQ ID NO: 842404 - DNA, 23 bp, Homo sapiens
taattgcagataactttgacttt

SEQ ID NO: 842405 - DNA, 20 bp, Homo sapiens
taattgcatttaaaaatata

SEQ ID NO: 842406 - DNA, 18 bp, Homo sapiens
taattgcatttctgctct

SEQ ID NO: 842407 - DNA, 16 bp, Homo sapiens
taattgccagcaaata

SEQ ID NO: 842408 - DNA, 18 bp, Homo sapiens
taattgccagcaaataaa

SEQ ID NO: 842409 - DNA, 18 bp, Homo sapiens
taattgcctacaataaaa

SEQ ID NO: 842410 - DNA, 20 bp, Homo sapiens
taattgcctacaataaaaag

SEQ ID NO: 842411 - DNA, 23 bp, Homo sapiens
taattgcctagaaatatctttct

SEQ ID NO: 842412 - DNA, 21 bp, Homo sapiens
taattgcttacatttttacaa

SEQ ID NO: 842413 - DNA, 15 bp, Homo sapiens
taattgctttgaagc

SEQ ID NO: 842414 - DNA, 22 bp, Homo sapiens
taattggcccaagtcattgttt

SEQ ID NO: 842415 - DNA, 18 bp, Homo sapiens
taattgggtcatagaaat

SEQ ID NO: 842416 - DNA, 18 bp, Homo sapiens
taattggtccgatctttg

SEQ ID NO: 842417 - DNA, 18 bp, Homo sapiens
taattggtgctatttgaa

SEQ ID NO: 842418 - DNA, 22 bp, Homo sapiens
taattggtgctatttgaagaaa

SEQ ID NO: 842419 - DNA, 17 bp, Homo sapiens
taattggtttagttctt

SEQ ID NO: 842420 - DNA, 17 bp, Homo sapiens
taattgtaaatattttg

SEQ ID NO: 842421 - DNA, 20 bp, Homo sapiens
taattgtaattccaaaatcc

SEQ ID NO: 842422 - DNA, 21 bp, Homo sapiens
taattgtgaaaaagttaaaca

SEQ ID NO: 842423 - DNA, 11 bp, Homo sapiens
taattgtgtat

SEQ ID NO: 842424 - DNA, 14 bp, Homo sapiens
taattgtgtggatt

SEQ ID NO: 842425 - DNA, 14 bp, Homo sapiens
taattgttcctttt

SEQ ID NO: 842426 - DNA, 16 bp, Homo sapiens
taattgttctcagaat

SEQ ID NO: 842427 - DNA, 17 bp, Homo sapiens
taattgttctcagaatc

SEQ ID NO: 842428 - DNA, 16 bp, Homo sapiens
taattgttgatatttt

SEQ ID NO: 842429 - DNA, 16 bp, Homo sapiens
taattgttgctaatct

SEQ ID NO: 842430 - DNA, 20 bp, Homo sapiens
taattgttgttctgttaact

SEQ ID NO: 842431 - DNA, 23 bp, Homo sapiens
taattgttgttctgttaactgaa

SEQ ID NO: 842432 - DNA, 13 bp, Homo sapiens
taattgtttaaaa

SEQ ID NO: 842433 - DNA, 20 bp, Homo sapiens
taattgtttataaaacaatg

SEQ ID NO: 842434 - DNA, 12 bp, Homo sapiens
taattgtttcca

SEQ ID NO: 842435 - DNA, 15 bp, Homo sapiens
taattgtttccaact

SEQ ID NO: 842436 - DNA, 18 bp, Homo sapiens
taattgttttgcactttt

SEQ ID NO: 842437 - DNA, 14 bp, Homo sapiens
taattgttttttaa

SEQ ID NO: 842438 - DNA, 17 bp, Homo sapiens
taattgttttttaaagc

SEQ ID NO: 842439 - DNA, 19 bp, Homo sapiens
taattgttttttaaagcaa

SEQ ID NO: 842440 - DNA, 20 bp, Homo sapiens
taattgttttttaaagcaag

SEQ ID NO: 842441 - DNA, 19 bp, Homo sapiens
taatttaaacacctcctca

SEQ ID NO: 842442 - DNA, 20 bp, Homo sapiens
taatttaaacatttgttcct

SEQ ID NO: 842443 - DNA, 14 bp, Homo sapiens
taatttaaatgata

SEQ ID NO: 842444 - DNA, 16 bp, Homo sapiens
taatttaacccagctc

SEQ ID NO: 842445 - DNA, 11 bp, Homo sapiens
taatttaactt

SEQ ID NO: 842446 - DNA, 14 bp, Homo sapiens
taatttaatgcatg

SEQ ID NO: 842447 - DNA, 18 bp, Homo sapiens
taatttaatgtattaatc

SEQ ID NO: 842448 - DNA, 14 bp, Homo sapiens
taatttaattgctt

SEQ ID NO: 842449 - DNA, 22 bp, Homo sapiens
taatttacaaaaatataaaata

SEQ ID NO: 842450 - DNA, 22 bp, Homo sapiens
taatttacacacttgcatgaat

SEQ ID NO: 842451 - DNA, 12 bp, Homo sapiens
taatttaccaag

SEQ ID NO: 842452 - DNA, 13 bp, Homo sapiens
taatttagaaact

SEQ ID NO: 842453 - DNA, 21 bp, Homo sapiens
taatttagacttggattcttt

SEQ ID NO: 842454 - DNA, 15 bp, Homo sapiens
taatttagtaaatgt

SEQ ID NO: 842455 - DNA, 16 bp, Homo sapiens
taatttagtaaatgtt

SEQ ID NO: 842456 - DNA, 17 bp, Homo sapiens
taatttagtaaatgtta

SEQ ID NO: 842457 - DNA, 23 bp, Homo sapiens
taatttagtggatggaatatcag

SEQ ID NO: 842458 - DNA, 16 bp, Homo sapiens
taatttagttgtttct

SEQ ID NO: 842459 - DNA, 19 bp, Homo sapiens
taatttagttgtttctaga

SEQ ID NO: 842460 - DNA, 21 bp, Homo sapiens
taatttataaaagaataaaat

SEQ ID NO: 842461 - DNA, 12 bp, Homo sapiens
taatttataaag

SEQ ID NO: 842462 - DNA, 17 bp, Homo sapiens
taatttataatgtattt

SEQ ID NO: 842463 - DNA, 20 bp, Homo sapiens
taatttataatgtatttgaa

SEQ ID NO: 842464 - DNA, 21 bp, Homo sapiens
taatttataatgtatttgaaa

SEQ ID NO: 842465 - DNA, 20 bp, Homo sapiens
taatttatgagtttttgata

SEQ ID NO: 842466 - DNA, 15 bp, Homo sapiens
taatttattaatcta

SEQ ID NO: 842467 - DNA, 19 bp, Homo sapiens
taatttattaattgctttg

SEQ ID NO: 842468 - DNA, 18 bp, Homo sapiens
taatttattattgaaatt

SEQ ID NO: 842469 - DNA, 20 bp, Homo sapiens
taatttatttaatatttaat

SEQ ID NO: 842470 - DNA, 14 bp, Homo sapiens
taatttatttatta

SEQ ID NO: 842471 - DNA, 18 bp, Homo sapiens
taatttatttattaagat

SEQ ID NO: 842472 - DNA, 13 bp, Homo sapiens
taatttatttgtt

SEQ ID NO: 842473 - DNA, 15 bp, Homo sapiens
taatttattttgctc

SEQ ID NO: 842474 - DNA, 18 bp, Homo sapiens
taatttcaaaaatataac

SEQ ID NO: 842475 - DNA, 14 bp, Homo sapiens
taatttcaaaatac

SEQ ID NO: 842476 - DNA, 21 bp, Homo sapiens
taatttcaaaatacatttgta

SEQ ID NO: 842477 - DNA, 12 bp, Homo sapiens
taatttcaggaa

SEQ ID NO: 842478 - DNA, 21 bp, Homo sapiens
taatttcaggaggaatactga

SEQ ID NO: 842479 - DNA, 22 bp, Homo sapiens
taatttcagggaaattaatcaa

SEQ ID NO: 842480 - DNA, 16 bp, Homo sapiens
taatttcagtgtaaag

SEQ ID NO: 842481 - DNA, 22 bp, Homo sapiens
taatttcatactatttagattt

SEQ ID NO: 842482 - DNA, 20 bp, Homo sapiens
taatttcatgtaaaacagaa

SEQ ID NO: 842483 - DNA, 22 bp, Homo sapiens
taatttccatttacttaagact

SEQ ID NO: 842484 - DNA, 18 bp, Homo sapiens
taatttcctcactgcctg

SEQ ID NO: 842485 - DNA, 17 bp, Homo sapiens
taatttcctggtgtgaa

SEQ ID NO: 842486 - DNA, 15 bp, Homo sapiens
taatttccttctgtt

SEQ ID NO: 842487 - DNA, 17 bp, Homo sapiens
taatttccttctgttaa

SEQ ID NO: 842488 - DNA, 21 bp, Homo sapiens
taatttccttctgttaagaaa

SEQ ID NO: 842489 - DNA, 24 bp, Homo sapiens
taatttccttctgttaagaaagga

SEQ ID NO: 842490 - DNA, 17 bp, Homo sapiens
taatttcctttttgaca

SEQ ID NO: 842491 - DNA, 22 bp, Homo sapiens
taatttcctttttgacactgaa

SEQ ID NO: 842492 - DNA, 18 bp, Homo sapiens
taatttcgccttaaactc

SEQ ID NO: 842493 - DNA, 23 bp, Homo sapiens
taatttctgataaagttccttaa

SEQ ID NO: 842494 - DNA, 13 bp, Homo sapiens
taatttgaagatt

SEQ ID NO: 842495 - DNA, 14 bp, Homo sapiens
taatttgaagattg

SEQ ID NO: 842496 - DNA, 19 bp, Homo sapiens
taatttgaatgtatttgat

SEQ ID NO: 842497 - DNA, 13 bp, Homo sapiens
taatttgagaatt

SEQ ID NO: 842498 - DNA, 17 bp, Homo sapiens
taatttgatgaaagctg

SEQ ID NO: 842499 - DNA, 20 bp, Homo sapiens
taatttgatgaggtattttt

SEQ ID NO: 842500 - DNA, 14 bp, Homo sapiens
taatttgatgttta

SEQ ID NO: 842501 - DNA, 19 bp, Homo sapiens
taatttgcatattctattg

SEQ ID NO: 842502 - DNA, 20 bp, Homo sapiens
taatttgcattaaattcaca

SEQ ID NO: 842503 - DNA, 20 bp, Homo sapiens
taatttggataataaaaatt

SEQ ID NO: 842504 - DNA, 19 bp, Homo sapiens
taatttgtaaacttctgaa

SEQ ID NO: 842505 - DNA, 14 bp, Homo sapiens
taatttgtaaatga

SEQ ID NO: 842506 - DNA, 15 bp, Homo sapiens
taatttgtaaatgat

SEQ ID NO: 842507 - DNA, 21 bp, Homo sapiens
taatttgtaaatgattttaat

SEQ ID NO: 842508 - DNA, 13 bp, Homo sapiens
taatttgtacaat

SEQ ID NO: 842509 - DNA, 12 bp, Homo sapiens
taatttgtgaat

SEQ ID NO: 842510 - DNA, 18 bp, Homo sapiens
taatttgtgaatttgcaa

SEQ ID NO: 842511 - DNA, 15 bp, Homo sapiens
taatttgtgatacaa

SEQ ID NO: 842512 - DNA, 18 bp, Homo sapiens
taatttgtgatacaatgc

SEQ ID NO: 842513 - DNA, 19 bp, Homo sapiens
taatttgtgatacaatgct

SEQ ID NO: 842514 - DNA, 13 bp, Homo sapiens
taatttgtgtctg

SEQ ID NO: 842515 - DNA, 20 bp, Homo sapiens
taatttgtgtctgtgtttaa

SEQ ID NO: 842516 - DNA, 15 bp, Homo sapiens
taatttgtgtgtttt

SEQ ID NO: 842517 - DNA, 22 bp, Homo sapiens
taatttgttggggctttacata

SEQ ID NO: 842518 - DNA, 17 bp, Homo sapiens
taatttgtttaaaattc

SEQ ID NO: 842519 - DNA, 17 bp, Homo sapiens
taatttgttttggatat

SEQ ID NO: 842520 - DNA, 14 bp, Homo sapiens
taattttaaacaaa

SEQ ID NO: 842521 - DNA, 23 bp, Homo sapiens
taattttaaccaaaacatgtctc

SEQ ID NO: 842522 - DNA, 12 bp, Homo sapiens
taattttaatat

SEQ ID NO: 842523 - DNA, 15 bp, Homo sapiens
taattttaatgctgt

SEQ ID NO: 842524 - DNA, 14 bp, Homo sapiens
taattttacacatt

SEQ ID NO: 842525 - DNA, 20 bp, Homo sapiens
taattttacacgcttttgtg

SEQ ID NO: 842526 - DNA, 21 bp, Homo sapiens
taattttagtttttcattaaa

SEQ ID NO: 842527 - DNA, 19 bp, Homo sapiens
taattttatattcagtgaa

SEQ ID NO: 842528 - DNA, 18 bp, Homo sapiens
taattttatttataaact

SEQ ID NO: 842529 - DNA, 15 bp, Homo sapiens
taattttatttctat

SEQ ID NO: 842530 - DNA, 15 bp, Homo sapiens
taattttcaccgagc

SEQ ID NO: 842531 - DNA, 17 bp, Homo sapiens
taattttcctaataaag

SEQ ID NO: 842532 - DNA, 19 bp, Homo sapiens
taattttctaagacagttt

SEQ ID NO: 842533 - DNA, 18 bp, Homo sapiens
taattttctttatggaaa

SEQ ID NO: 842534 - DNA, 15 bp, Homo sapiens
taattttgaataaat

SEQ ID NO: 842535 - DNA, 18 bp, Homo sapiens
taattttgatatacattg

SEQ ID NO: 842536 - DNA, 14 bp, Homo sapiens
taattttgcatact

SEQ ID NO: 842537 - DNA, 17 bp, Homo sapiens
taattttgcatactgaa

SEQ ID NO: 842538 - DNA, 14 bp, Homo sapiens
taattttgtacata

SEQ ID NO: 842539 - DNA, 13 bp, Homo sapiens
taattttgtcttt

SEQ ID NO: 842540 - DNA, 13 bp, Homo sapiens
taattttgtgcat

SEQ ID NO: 842541 - DNA, 20 bp, Homo sapiens
taattttgtgcattctttgg

SEQ ID NO: 842542 - DNA, 13 bp, Homo sapiens
taattttgtgtaa

SEQ ID NO: 842543 - DNA, 19 bp, Homo sapiens
taattttgtgtaagaaata

SEQ ID NO: 842544 - DNA, 19 bp, Homo sapiens
taattttgttctagttttc

SEQ ID NO: 842545 - DNA, 13 bp, Homo sapiens
taattttgttgaa

SEQ ID NO: 842546 - DNA, 17 bp, Homo sapiens
taatttttatactgaca

SEQ ID NO: 842547 - DNA, 16 bp, Homo sapiens
taatttttatttcttc

SEQ ID NO: 842548 - DNA, 13 bp, Homo sapiens
taatttttccaac

SEQ ID NO: 842549 - DNA, 14 bp, Homo sapiens
taatttttccaact

SEQ ID NO: 842550 - DNA, 15 bp, Homo sapiens
taatttttgctttta

SEQ ID NO: 842551 - DNA, 18 bp, Homo sapiens
taatttttgcttttagaa

SEQ ID NO: 842552 - DNA, 15 bp, Homo sapiens
taatttttgtacatc

SEQ ID NO: 842553 - DNA, 17 bp, Homo sapiens
taatttttgtattattt

SEQ ID NO: 842554 - DNA, 18 bp, Homo sapiens
taatttttgtatttttag

SEQ ID NO: 842555 - DNA, 22 bp, Homo sapiens
taattttttaaatatttgagac

SEQ ID NO: 842556 - DNA, 13 bp, Homo sapiens
taattttttacta

SEQ ID NO: 842557 - DNA, 17 bp, Homo sapiens
taattttttattcaagt

SEQ ID NO: 842558 - DNA, 15 bp, Homo sapiens
taattttttcttaag

SEQ ID NO: 842559 - DNA, 15 bp, Homo sapiens
taattttttggtaca

SEQ ID NO: 842560 - DNA, 18 bp, Homo sapiens
taattttttggtacaaaa

SEQ ID NO: 842561 - DNA, 16 bp, Homo sapiens
taattttttgtaatgt

SEQ ID NO: 842562 - DNA, 16 bp, Homo sapiens
taatttttttaaattt

SEQ ID NO: 842563 - DNA, 20 bp, Homo sapiens
taatttttttaaccaaaggt

SEQ ID NO: 842564 - DNA, 22 bp, Homo sapiens
taatttttttaaccaaaggtga

SEQ ID NO: 842565 - DNA, 14 bp, Homo sapiens
taatttttttaatt

SEQ ID NO: 842566 - DNA, 17 bp, Homo sapiens
taatttttttatgtttt

SEQ ID NO: 842567 - DNA, 15 bp, Homo sapiens
taattttttttgttt

SEQ ID NO: 842568 - DNA, 20 bp, Homo sapiens
tacaaaaaaaaagttttatt

SEQ ID NO: 842569 - DNA, 15 bp, Homo sapiens
tacaaaaagcataaa

SEQ ID NO: 842570 - DNA, 13 bp, Homo sapiens
tacaaaaagtaac

SEQ ID NO: 842571 - DNA, 17 bp, Homo sapiens
tacaaaacaaactcatt

SEQ ID NO: 842572 - DNA, 13 bp, Homo sapiens
tacaaaactgctt

SEQ ID NO: 842573 - DNA, 19 bp, Homo sapiens
tacaaaactgctttgtgca

SEQ ID NO: 842574 - DNA, 20 bp, Homo sapiens
tacaaaactgctttgtgcat

SEQ ID NO: 842575 - DNA, 23 bp, Homo sapiens
tacaaaactgctttgtgcatatg

SEQ ID NO: 842576 - DNA, 18 bp, Homo sapiens
tacaaaactgtaaataaa

SEQ ID NO: 842577 - DNA, 20 bp, Homo sapiens
tacaaaatacaatcctgttt

SEQ ID NO: 842578 - DNA, 20 bp, Homo sapiens
tacaaaatatttaagtgaag

SEQ ID NO: 842579 - DNA, 12 bp, Homo sapiens
tacaaaatttat

SEQ ID NO: 842580 - DNA, 15 bp, Homo sapiens
tacaaaatttattct

SEQ ID NO: 842581 - DNA, 20 bp, Homo sapiens
tacaaacaaaagcagccctc

SEQ ID NO: 842582 - DNA, 23 bp, Homo sapiens
tacaaacaagtggatgtttttaa

SEQ ID NO: 842583 - DNA, 13 bp, Homo sapiens
tacaaacatgaaa

SEQ ID NO: 842584 - DNA, 15 bp, Homo sapiens
tacaaacctgcatgg

SEQ ID NO: 842585 - DNA, 17 bp, Homo sapiens
tacaaactcagatcctt

SEQ ID NO: 842586 - DNA, 15 bp, Homo sapiens
tacagagcacatttg

SEQ ID NO: 842587 - DNA, 19 bp, Homo sapiens
tacagagcacctgtagctg

SEQ ID NO: 842588 - DNA, 17 bp, Homo sapiens
tacagagccttgagaga

SEQ ID NO: 842589 - DNA, 13 bp, Homo sapiens
tacagagctgtgg

SEQ ID NO: 842590 - DNA, 13 bp, Homo sapiens
tacagagctttct

SEQ ID NO: 842591 - DNA, 12 bp, Homo sapiens
tacagaggagat

SEQ ID NO: 842592 - DNA, 19 bp, Homo sapiens
tacagaggaggcctcaaag

SEQ ID NO: 842593 - DNA, 18 bp, Homo sapiens
tacagaggatgccttttc

SEQ ID NO: 842594 - DNA, 23 bp, Homo sapiens
tacagaggtctctgccggctctt

SEQ ID NO: 842595 - DNA, 20 bp, Homo sapiens
tacagagtggaataagacag

SEQ ID NO: 842596 - DNA, 22 bp, Homo sapiens
tacagagtggaataagacagag

SEQ ID NO: 842597 - DNA, 18 bp, Homo sapiens
tacagatgaatgtattta

SEQ ID NO: 842598 - DNA, 14 bp, Homo sapiens
tacagatgcctttt

SEQ ID NO: 842599 - DNA, 17 bp, Homo sapiens
tacagattgctgcttct

SEQ ID NO: 842600 - DNA, 21 bp, Homo sapiens
tacagattgtcatagttgttt

SEQ ID NO: 842601 - DNA, 22 bp, Homo sapiens
tacagcaaggagatttacaact

SEQ ID NO: 842602 - DNA, 24 bp, Homo sapiens
tacagcaaggagatttacaactgg

SEQ ID NO: 842603 - DNA, 21 bp, Homo sapiens
tacagcagggtcttgctgtaa

SEQ ID NO: 842604 - DNA, 16 bp, Homo sapiens
tacagcattaaaattt

SEQ ID NO: 842605 - DNA, 10 bp, Homo sapiens
tacagcattg

SEQ ID NO: 842606 - DNA, 15 bp, Homo sapiens
tacagcattgtcttt

SEQ ID NO: 842607 - DNA, 20 bp, Homo sapiens
tacagcattgtctttgctgt

SEQ ID NO: 842608 - DNA, 22 bp, Homo sapiens
tacagccaaagataatctctca

SEQ ID NO: 842609 - DNA, 19 bp, Homo sapiens
tacagcctatagtaaatgt

SEQ ID NO: 842610 - DNA, 16 bp, Homo sapiens
tacagcgcggaggagg

SEQ ID NO: 842611 - DNA, 13 bp, Homo sapiens
tacagcgggctgt

SEQ ID NO: 842612 - DNA, 21 bp, Homo sapiens
tacagctcattaaactttttt

SEQ ID NO: 842613 - DNA, 18 bp, Homo sapiens
tacagctcccttccctgc

SEQ ID NO: 842614 - DNA, 22 bp, Homo sapiens
tacagctctcccctcccttgtc

SEQ ID NO: 842615 - DNA, 22 bp, Homo sapiens
tacagctgctttgagctacagg

SEQ ID NO: 842616 - DNA, 23 bp, Homo sapiens
tacagctgctttgagctacagga

SEQ ID NO: 842617 - DNA, 19 bp, Homo sapiens
tacagctgtattgtctgaa

SEQ ID NO: 842618 - DNA, 23 bp, Homo sapiens
tacagcttcattatctgagttgc

SEQ ID NO: 842619 - DNA, 22 bp, Homo sapiens
tacaggaaaaaaaattctgttg

SEQ ID NO: 842620 - DNA, 23 bp, Homo sapiens
tacaggaaaaaaaattctgttgt

SEQ ID NO: 842621 - DNA, 15 bp, Homo sapiens
tacaggaaacagttg

SEQ ID NO: 842622 - DNA, 21 bp, Homo sapiens
tacaggaaacagttgcatgta

SEQ ID NO: 842623 - DNA, 13 bp, Homo sapiens
tacaggaagtccc

SEQ ID NO: 842624 - DNA, 13 bp, Homo sapiens
tacaggactgtaa

SEQ ID NO: 842625 - DNA, 19 bp, Homo sapiens
tacaggagaggcagcatgc

SEQ ID NO: 842626 - DNA, 16 bp, Homo sapiens
tacaggagggcccgga

SEQ ID NO: 842627 - DNA, 18 bp, Homo sapiens
tacaggaggttgtggatg

SEQ ID NO: 842628 - DNA, 20 bp, Homo sapiens
tacaggcaaaacacgcaagg

SEQ ID NO: 842629 - DNA, 22 bp, Homo sapiens
tacaggcaaaacacgcaagggc

SEQ ID NO: 842630 - DNA, 20 bp, Homo sapiens
tacaggcaccgagaatgttg

SEQ ID NO: 842631 - DNA, 17 bp, Homo sapiens
tacaggcacctaccacc

SEQ ID NO: 842632 - DNA, 19 bp, Homo sapiens
tacaggcatgagccactgc

SEQ ID NO: 842633 - DNA, 15 bp, Homo sapiens
tacaggccctgctcc

SEQ ID NO: 842634 - DNA, 17 bp, Homo sapiens
tacagggaatttgtacg

SEQ ID NO: 842635 - DNA, 23 bp, Homo sapiens
tacagggcaaaagggcagctgtg

SEQ ID NO: 842636 - DNA, 21 bp, Homo sapiens
tacaggggggtcggaagcctg

SEQ ID NO: 842637 - DNA, 23 bp, Homo sapiens
tacaggggggtcggaagcctgtc

SEQ ID NO: 842638 - DNA, 21 bp, Homo sapiens
tacagggtggctgtggtccta

SEQ ID NO: 842639 - DNA, 15 bp, Homo sapiens
tacaggtgcatatta

SEQ ID NO: 842640 - DNA, 22 bp, Homo sapiens
tacagtaactaattttgttgaa

SEQ ID NO: 842641 - DNA, 16 bp, Homo sapiens
tacagtaactgtgact

SEQ ID NO: 842642 - DNA, 13 bp, Homo sapiens
tacagtaacttta

SEQ ID NO: 842643 - DNA, 18 bp, Homo sapiens
tacagtaagtaaagtggt

SEQ ID NO: 842644 - DNA, 13 bp, Homo sapiens
tacagtaataaat

SEQ ID NO: 842645 - DNA, 17 bp, Homo sapiens
tacagtaatatgtttaa

SEQ ID NO: 842646 - DNA, 14 bp, Homo sapiens
tacagtaatgaaat

SEQ ID NO: 842647 - DNA, 17 bp, Homo sapiens
tacagtaatgtcataaa

SEQ ID NO: 842648 - DNA, 18 bp, Homo sapiens
tacagtacacagatacct

SEQ ID NO: 842649 - DNA, 15 bp, Homo sapiens
tacagtaggagccca

SEQ ID NO: 842650 - DNA, 19 bp, Homo sapiens
tacagtatgatgaaaataa

SEQ ID NO: 842651 - DNA, 21 bp, Homo sapiens
tacagtatgggggttgtaaat

SEQ ID NO: 842652 - DNA, 13 bp, Homo sapiens
tacagtctctttc

SEQ ID NO: 842653 - DNA, 16 bp, Homo sapiens
tacagtctctttcttc

SEQ ID NO: 842654 - DNA, 18 bp, Homo sapiens
tacagtcttccatttgca

SEQ ID NO: 842655 - DNA, 13 bp, Homo sapiens
tacagtcttgtat

SEQ ID NO: 842656 - DNA, 19 bp, Homo sapiens
tacagtgaattgtctttta

SEQ ID NO: 842657 - DNA, 22 bp, Homo sapiens
tacagtgcatagttgtagacaa

SEQ ID NO: 842658 - DNA, 13 bp, Homo sapiens
tacagtgcccacc

SEQ ID NO: 842659 - DNA, 17 bp, Homo sapiens
tacagtgcccaccgccc

SEQ ID NO: 842660 - DNA, 22 bp, Homo sapiens
tacagtgcccaccgccctcctc

SEQ ID NO: 842661 - DNA, 22 bp, Homo sapiens
tacagtgtacagtcttgtatta

SEQ ID NO: 842662 - DNA, 18 bp, Homo sapiens
tacagtgtctgtgccatg

SEQ ID NO: 842663 - DNA, 14 bp, Homo sapiens
tacagtgtcttttt

SEQ ID NO: 842664 - DNA, 18 bp, Homo sapiens
tacagttaaggaatataa

SEQ ID NO: 842665 - DNA, 16 bp, Homo sapiens
tacagttacagttgat

SEQ ID NO: 842666 - DNA, 19 bp, Homo sapiens
tacagttactcagaattct

SEQ ID NO: 842667 - DNA, 13 bp, Homo sapiens
tacagttataaaa

SEQ ID NO: 842668 - DNA, 19 bp, Homo sapiens
tacagttatctaagttaat

SEQ ID NO: 842669 - DNA, 20 bp, Homo sapiens
tacagttctgctctggttgt

SEQ ID NO: 842670 - DNA, 14 bp, Homo sapiens
tacagttctgtggt

SEQ ID NO: 842671 - DNA, 15 bp, Homo sapiens
tacagttctgtggtt

SEQ ID NO: 842672 - DNA, 21 bp, Homo sapiens
tacagttctgtggtttcatgt

SEQ ID NO: 842673 - DNA, 13 bp, Homo sapiens
tacagttctttcc

SEQ ID NO: 842674 - DNA, 15 bp, Homo sapiens
tacagttctttcctc

SEQ ID NO: 842675 - DNA, 17 bp, Homo sapiens
tacagttctttcctctt

SEQ ID NO: 842676 - DNA, 22 bp, Homo sapiens
tacagttctttcctctttctgc

SEQ ID NO: 842677 - DNA, 23 bp, Homo sapiens
tacagttctttcctctttctgct

SEQ ID NO: 842678 - DNA, 19 bp, Homo sapiens
tacagttgaaaaacagctg

SEQ ID NO: 842679 - DNA, 19 bp, Homo sapiens
tacagttgaaataactgga

SEQ ID NO: 842680 - DNA, 15 bp, Homo sapiens
tacagttgaatttta

SEQ ID NO: 842681 - DNA, 20 bp, Homo sapiens
tacagttgtcctgatttctt

SEQ ID NO: 842682 - DNA, 21 bp, Homo sapiens
tacagttgtcctgatttctta

SEQ ID NO: 842683 - DNA, 22 bp, Homo sapiens
tacagttgtcctgatttcttat

SEQ ID NO: 842684 - DNA, 23 bp, Homo sapiens
tacagtttatttttaaagataga

SEQ ID NO: 842685 - DNA, 16 bp, Homo sapiens
tacagtttgacttttt

SEQ ID NO: 842686 - DNA, 13 bp, Homo sapiens
tacagtttgtgtt

SEQ ID NO: 842687 - DNA, 20 bp, Homo sapiens
tacagtttgtgttttaaaaa

SEQ ID NO: 842688 - DNA, 21 bp, Homo sapiens
tacagtttgttagtatgaggc

SEQ ID NO: 842689 - DNA, 20 bp, Homo sapiens
tacagttttaactgtggata

SEQ ID NO: 842690 - DNA, 14 bp, Homo sapiens
tacataaaaataga

SEQ ID NO: 842691 - DNA, 14 bp, Homo sapiens
tacataaaaattaa

SEQ ID NO: 842692 - DNA, 16 bp, Homo sapiens
tacataaaagaatttt

SEQ ID NO: 842693 - DNA, 11 bp, Homo sapiens
tacataaacaa

SEQ ID NO: 842694 - DNA, 23 bp, Homo sapiens
tacataaaccatttttgttactc

SEQ ID NO: 842695 - DNA, 16 bp, Homo sapiens
tacataaactgtcact

SEQ ID NO: 842696 - DNA, 14 bp, Homo sapiens
tacataaagactaa

SEQ ID NO: 842697 - DNA, 22 bp, Homo sapiens
tacataaagactgtgctgagaa

SEQ ID NO: 842698 - DNA, 15 bp, Homo sapiens
tacataactgaaaat

SEQ ID NO: 842699 - DNA, 17 bp, Homo sapiens
tacataaggatgacttt

SEQ ID NO: 842700 - DNA, 15 bp, Homo sapiens
tacataatgcgtgca

SEQ ID NO: 842701 - DNA, 17 bp, Homo sapiens
tacataatgcgtgcata

SEQ ID NO: 842702 - DNA, 23 bp, Homo sapiens
tacataatgggccactgaaatct

SEQ ID NO: 842703 - DNA, 20 bp, Homo sapiens
tacataatgtttttcctttc

SEQ ID NO: 842704 - DNA, 16 bp, Homo sapiens
tacatacacatacata

SEQ ID NO: 842705 - DNA, 14 bp, Homo sapiens
tacatacaccagca

SEQ ID NO: 842706 - DNA, 13 bp, Homo sapiens
tacatacactgta

SEQ ID NO: 842707 - DNA, 17 bp, Homo sapiens
taccatgtgtgctaata

SEQ ID NO: 842708 - DNA, 16 bp, Homo sapiens
taccattaacattttt

SEQ ID NO: 842709 - DNA, 22 bp, Homo sapiens
taccattaattacatacagatt

SEQ ID NO: 842710 - DNA, 18 bp, Homo sapiens
taccattacttgtataaa

SEQ ID NO: 842711 - DNA, 22 bp, Homo sapiens
taccattacttgtataaataca

SEQ ID NO: 842712 - DNA, 19 bp, Homo sapiens
taccattattatgtaaata

SEQ ID NO: 842713 - DNA, 14 bp, Homo sapiens
taccattcagtgat

SEQ ID NO: 842714 - DNA, 23 bp, Homo sapiens
taccattcagtgattactgtcaa

SEQ ID NO: 842715 - DNA, 22 bp, Homo sapiens
taccattcagttaattcaatgt

SEQ ID NO: 842716 - DNA, 22 bp, Homo sapiens
taccattccttcaaataaagaa

SEQ ID NO: 842717 - DNA, 17 bp, Homo sapiens
taccattgaaatcagca

SEQ ID NO: 842718 - DNA, 13 bp, Homo sapiens
taccatttacatg

SEQ ID NO: 842719 - DNA, 17 bp, Homo sapiens
taccatttacatgtttt

SEQ ID NO: 842720 - DNA, 15 bp, Homo sapiens
taccatttatacaaa

SEQ ID NO: 842721 - DNA, 18 bp, Homo sapiens
taccatttatacaaatta

SEQ ID NO: 842722 - DNA, 12 bp, Homo sapiens
taccatttcaga

SEQ ID NO: 842723 - DNA, 15 bp, Homo sapiens
taccatttcagagag

SEQ ID NO: 842724 - DNA, 15 bp, Homo sapiens
taccatttgcctccc

SEQ ID NO: 842725 - DNA, 17 bp, Homo sapiens
taccatttgtaataaag

SEQ ID NO: 842726 - DNA, 18 bp, Homo sapiens
taccatttgtaataaagt

SEQ ID NO: 842727 - DNA, 20 bp, Homo sapiens
taccattttaacgctgccta

SEQ ID NO: 842728 - DNA, 18 bp, Homo sapiens
taccattttacatttcta

SEQ ID NO: 842729 - DNA, 12 bp, Homo sapiens
taccattttcta

SEQ ID NO: 842730 - DNA, 16 bp, Homo sapiens
tacccaaaccctaggt

SEQ ID NO: 842731 - DNA, 14 bp, Homo sapiens
tacccaaactgctt

SEQ ID NO: 842732 - DNA, 14 bp, Homo sapiens
tacccaaagcacat

SEQ ID NO: 842733 - DNA, 19 bp, Homo sapiens
tacccaaaggaatagaaat

SEQ ID NO: 842734 - DNA, 13 bp, Homo sapiens
tacccaaccactc

SEQ ID NO: 842735 - DNA, 14 bp, Homo sapiens
tacccaagctgtgg

SEQ ID NO: 842736 - DNA, 23 bp, Homo sapiens
tacccaatacttatgttgtattg

SEQ ID NO: 842737 - DNA, 14 bp, Homo sapiens
tacccaatgtctcc

SEQ ID NO: 842738 - DNA, 13 bp, Homo sapiens
tacccaatttccc

SEQ ID NO: 842739 - DNA, 22 bp, Homo sapiens
tacccacacattccagggctgg

SEQ ID NO: 842740 - DNA, 23 bp, Homo sapiens
tacccacacattccagggctggg

SEQ ID NO: 842741 - DNA, 14 bp, Homo sapiens
tacccaccccagca

SEQ ID NO: 842742 - DNA, 19 bp, Homo sapiens
tacccaccccagcacagcc

SEQ ID NO: 842743 - DNA, 18 bp, Homo sapiens
tacccaccgatggagccc

SEQ ID NO: 842744 - DNA, 21 bp, Homo sapiens
tacccaccgatggagccccca

SEQ ID NO: 842745 - DNA, 23 bp, Homo sapiens
tacccaccgatggagcccccaga

SEQ ID NO: 842746 - DNA, 12 bp, Homo sapiens
tacccacctaga

SEQ ID NO: 842747 - DNA, 15 bp, Homo sapiens
tacccacctagaaca

SEQ ID NO: 842748 - DNA, 16 bp, Homo sapiens
tacccagagagtcctg

SEQ ID NO: 842749 - DNA, 16 bp, Homo sapiens
tacccagccatctgcc

SEQ ID NO: 842750 - DNA, 17 bp, Homo sapiens
tacccagccatctgccc

SEQ ID NO: 842751 - DNA, 23 bp, Homo sapiens
tacccagccatctgcccaggggt

SEQ ID NO: 842752 - DNA, 20 bp, Homo sapiens
tacccaggctggagtgcagt

SEQ ID NO: 842753 - DNA, 16 bp, Homo sapiens
tacccagtattactgc

SEQ ID NO: 842754 - DNA, 23 bp, Homo sapiens
tacccagtggaattccaacttga

SEQ ID NO: 842755 - DNA, 17 bp, Homo sapiens
tacccatccccgcagtg

SEQ ID NO: 842756 - DNA, 20 bp, Homo sapiens
tacccatcggtgtccattta

SEQ ID NO: 842757 - DNA, 18 bp, Homo sapiens
tacccatgactttatatg

SEQ ID NO: 842758 - DNA, 16 bp, Homo sapiens
tacccatgagcctgcc

SEQ ID NO: 842759 - DNA, 17 bp, Homo sapiens
tacccatgagcctgccc

SEQ ID NO: 842760 - DNA, 17 bp, Homo sapiens
tacccatgggacaaaat

SEQ ID NO: 842761 - DNA, 21 bp, Homo sapiens
tacccattcgtggtgatcaat

SEQ ID NO: 842762 - DNA, 21 bp, Homo sapiens
taccccaaattgtgtatatat

SEQ ID NO: 842763 - DNA, 22 bp, Homo sapiens
taccccaccacgatgtggccct

SEQ ID NO: 842764 - DNA, 13 bp, Homo sapiens
taccccaccctca

SEQ ID NO: 842765 - DNA, 21 bp, Homo sapiens
taccccactgggccagccctg

SEQ ID NO: 842766 - DNA, 20 bp, Homo sapiens
taccccagggcctactgcca

SEQ ID NO: 842767 - DNA, 12 bp, Homo sapiens
taccccataccc

SEQ ID NO: 842768 - DNA, 20 bp, Homo sapiens
taccccataccccttattgc

SEQ ID NO: 842769 - DNA, 18 bp, Homo sapiens
tacccccaaacccccaat

SEQ ID NO: 842770 - DNA, 22 bp, Homo sapiens
tacccccaggaaactagctttt

SEQ ID NO: 842771 - DNA, 16 bp, Homo sapiens
taccccctaagagcca

SEQ ID NO: 842772 - DNA, 17 bp, Homo sapiens
taccccctcctctctgc

SEQ ID NO: 842773 - DNA, 19 bp, Homo sapiens
taccccctgcaaagcccag

SEQ ID NO: 842774 - DNA, 16 bp, Homo sapiens
taccccctttcccttc

SEQ ID NO: 842775 - DNA, 16 bp, Homo sapiens
taccccgagacctcac

SEQ ID NO: 842776 - DNA, 15 bp, Homo sapiens
tacccctcaaactgc

SEQ ID NO: 842777 - DNA, 15 bp, Homo sapiens
tacccctcttccagc

SEQ ID NO: 842778 - DNA, 12 bp, Homo sapiens
tacccctgccct

SEQ ID NO: 842779 - DNA, 13 bp, Homo sapiens
tacccctgccctg

SEQ ID NO: 842780 - DNA, 12 bp, Homo sapiens
tacccctggctg

SEQ ID NO: 842781 - DNA, 13 bp, Homo sapiens
tacccctggctgt

SEQ ID NO: 842782 - DNA, 18 bp, Homo sapiens
taccccttattgctgcca

SEQ ID NO: 842783 - DNA, 21 bp, Homo sapiens
taccccttattgctgccaaaa

SEQ ID NO: 842784 - DNA, 15 bp, Homo sapiens
taccccttcctgtcc

SEQ ID NO: 842785 - DNA, 15 bp, Homo sapiens
tacccgaaagcatca

SEQ ID NO: 842786 - DNA, 21 bp, Homo sapiens
tacccgaaagcatcactgcct

SEQ ID NO: 842787 - DNA, 16 bp, Homo sapiens
tacccgagcccagcta

SEQ ID NO: 842788 - DNA, 13 bp, Homo sapiens
taccctactgtgg

SEQ ID NO: 842789 - DNA, 17 bp, Homo sapiens
taccctagaagaaaacc

SEQ ID NO: 842790 - DNA, 23 bp, Homo sapiens
taccctattctatccatctcctg

SEQ ID NO: 842791 - DNA, 13 bp, Homo sapiens
taccctccagagt

SEQ ID NO: 842792 - DNA, 14 bp, Homo sapiens
taccctccagagtg

SEQ ID NO: 842793 - DNA, 14 bp, Homo sapiens
taccctcccacccc

SEQ ID NO: 842794 - DNA, 18 bp, Homo sapiens
taccctcctctgctggga

SEQ ID NO: 842795 - DNA, 12 bp, Homo sapiens
taccctcctggc

SEQ ID NO: 842796 - DNA, 18 bp, Homo sapiens
taccctcgggcccacctg

SEQ ID NO: 842797 - DNA, 22 bp, Homo sapiens
taccctcgggcccacctggcca

SEQ ID NO: 842798 - DNA, 14 bp, Homo sapiens
taccctctggaggg

SEQ ID NO: 842799 - DNA, 17 bp, Homo sapiens
taccctgagctgaggca

SEQ ID NO: 842800 - DNA, 16 bp, Homo sapiens
taccctgatctggacc

SEQ ID NO: 842801 - DNA, 23 bp, Homo sapiens
taccctgcccctccccaaaagaa

SEQ ID NO: 842802 - DNA, 12 bp, Homo sapiens
taccctgcctcc

SEQ ID NO: 842803 - DNA, 21 bp, Homo sapiens
taccctgcgcccagtccttcc

SEQ ID NO: 842804 - DNA, 14 bp, Homo sapiens
taccctgtcctttg

SEQ ID NO: 842805 - DNA, 22 bp, Homo sapiens
taccctgtctgtcccttttctt

SEQ ID NO: 842806 - DNA, 22 bp, Homo sapiens
taccctgtgtcagagcctacct

SEQ ID NO: 842807 - DNA, 19 bp, Homo sapiens
tacccttccacctcctaga

SEQ ID NO: 842808 - DNA, 23 bp, Homo sapiens
tacccttgagacctggaaccaga

SEQ ID NO: 842809 - DNA, 21 bp, Homo sapiens
tacccttgtgagagcccattc

SEQ ID NO: 842810 - DNA, 18 bp, Homo sapiens
taccctttgctggaagaa

SEQ ID NO: 842811 - DNA, 17 bp, Homo sapiens
taccctttttctccagc

SEQ ID NO: 842812 - DNA, 17 bp, Homo sapiens
taccgaatgtgtcttta

SEQ ID NO: 842813 - DNA, 19 bp, Homo sapiens
taccgaccatcgtccagcc

SEQ ID NO: 842814 - DNA, 15 bp, Homo sapiens
taccgagtatctgta

SEQ ID NO: 842815 - DNA, 19 bp, Homo sapiens
taccgagtatctgtaaccc

SEQ ID NO: 842816 - DNA, 16 bp, Homo sapiens
taccgatgatactgtt

SEQ ID NO: 842817 - DNA, 20 bp, Homo sapiens
taccgccctgcgggccacag

SEQ ID NO: 842818 - DNA, 17 bp, Homo sapiens
taccgcctcgtgccagc

SEQ ID NO: 842819 - DNA, 21 bp, Homo sapiens
taccgcctcgtgccagcagcc

SEQ ID NO: 842820 - DNA, 16 bp, Homo sapiens
taccgcgttgtaaaat

SEQ ID NO: 842821 - DNA, 16 bp, Homo sapiens
taccgctcagtatttt

SEQ ID NO: 842822 - DNA, 14 bp, Homo sapiens
taccgcttccttag

SEQ ID NO: 842823 - DNA, 15 bp, Homo sapiens
taccggagagttatc

SEQ ID NO: 842824 - DNA, 17 bp, Homo sapiens
taccggttgtttagaaa

SEQ ID NO: 842825 - DNA, 14 bp, Homo sapiens
taccgtagcctccg

SEQ ID NO: 842826 - DNA, 20 bp, Homo sapiens
taccgtaggctttgtattca

SEQ ID NO: 842827 - DNA, 23 bp, Homo sapiens
tacctaaaaggaaatctcacccc

SEQ ID NO: 842828 - DNA, 14 bp, Homo sapiens
tacctaaacagata

SEQ ID NO: 842829 - DNA, 22 bp, Homo sapiens
tacctaaacagatataaatggc

SEQ ID NO: 842830 - DNA, 23 bp, Homo sapiens
tacctaaagacgtctctttttgg

SEQ ID NO: 842831 - DNA, 17 bp, Homo sapiens
tacctaagaagtacatt

SEQ ID NO: 842832 - DNA, 21 bp, Homo sapiens
tacctactttgactttttgca

SEQ ID NO: 842833 - DNA, 13 bp, Homo sapiens
tacctagaaatct

SEQ ID NO: 842834 - DNA, 17 bp, Homo sapiens
tacctagctaattattt

SEQ ID NO: 842835 - DNA, 22 bp, Homo sapiens
tacctaggctgaggttagagag

SEQ ID NO: 842836 - DNA, 18 bp, Homo sapiens
tacctagtgaaacttttc

SEQ ID NO: 842837 - DNA, 19 bp, Homo sapiens
tacctataaagtaaagcta

SEQ ID NO: 842838 - DNA, 20 bp, Homo sapiens
tacctatctgtggaaagcta

SEQ ID NO: 842839 - DNA, 15 bp, Homo sapiens
tacctatgacttttt

SEQ ID NO: 842840 - DNA, 21 bp, Homo sapiens
tacctatgacttttttaaact

SEQ ID NO: 842841 - DNA, 21 bp, Homo sapiens
tacctatggaagtggttctat

SEQ ID NO: 842842 - DNA, 18 bp, Homo sapiens
tacctatttctgatgatg

SEQ ID NO: 842843 - DNA, 19 bp, Homo sapiens
tacctcaaccatcctggct

SEQ ID NO: 842844 - DNA, 17 bp, Homo sapiens
tacctcaacctatggta

SEQ ID NO: 842845 - DNA, 21 bp, Homo sapiens
tacctcaagttcttggaccag

SEQ ID NO: 842846 - DNA, 15 bp, Homo sapiens
tacctcaatttttgt

SEQ ID NO: 842847 - DNA, 17 bp, Homo sapiens
tacctcagcctcctggg

SEQ ID NO: 842848 - DNA, 14 bp, Homo sapiens
tacctcaggcagct

SEQ ID NO: 842849 - DNA, 14 bp, Homo sapiens
tacctcaggcagga

SEQ ID NO: 842850 - DNA, 20 bp, Homo sapiens
tacctcagtggatcttcaga

SEQ ID NO: 842851 - DNA, 17 bp, Homo sapiens
tacctcatcatccaccc

SEQ ID NO: 842852 - DNA, 18 bp, Homo sapiens
tacctcatccatgcactt

SEQ ID NO: 842853 - DNA, 19 bp, Homo sapiens
tacctcatctctgaaaatt

SEQ ID NO: 842854 - DNA, 15 bp, Homo sapiens
tacctccaaccctgc

SEQ ID NO: 842855 - DNA, 11 bp, Homo sapiens
tacctccaccc

SEQ ID NO: 842856 - DNA, 18 bp, Homo sapiens
tacctccagtcacactcc

SEQ ID NO: 842857 - DNA, 14 bp, Homo sapiens
tacctcccacactc

SEQ ID NO: 842858 - DNA, 15 bp, Homo sapiens
tacctcccctgcctt

SEQ ID NO: 842859 - DNA, 17 bp, Homo sapiens
tacctcccctgccttgc

SEQ ID NO: 842860 - DNA, 14 bp, Homo sapiens
tacctcccctgcgt

SEQ ID NO: 842861 - DNA, 14 bp, Homo sapiens
tacctccccttttc

SEQ ID NO: 842862 - DNA, 18 bp, Homo sapiens
tacctccccttttctatg

SEQ ID NO: 842863 - DNA, 23 bp, Homo sapiens
tacctccccttttctatgttgct

SEQ ID NO: 842864 - DNA, 10 bp, Homo sapiens
tacctccctc

SEQ ID NO: 842865 - DNA, 16 bp, Homo sapiens
tacctccctccctctc

SEQ ID NO: 842866 - DNA, 13 bp, Homo sapiens
tacctccctcctc

SEQ ID NO: 842867 - DNA, 11 bp, Homo sapiens
tacctcctcct

SEQ ID NO: 842868 - DNA, 19 bp, Homo sapiens
tacctcctctcagtgtttt

SEQ ID NO: 842869 - DNA, 14 bp, Homo sapiens
tacctcctgagaaa

SEQ ID NO: 842870 - DNA, 16 bp, Homo sapiens
tacctcctgcccagga

SEQ ID NO: 842871 - DNA, 21 bp, Homo sapiens
tacctcctgtctttacaaata

SEQ ID NO: 842872 - DNA, 15 bp, Homo sapiens
tacctcggggagagg

SEQ ID NO: 842873 - DNA, 19 bp, Homo sapiens
tacctcggggagaggggga

SEQ ID NO: 842874 - DNA, 16 bp, Homo sapiens
tacctctatataccaa

SEQ ID NO: 842875 - DNA, 12 bp, Homo sapiens
tacctctctctg

SEQ ID NO: 842876 - DNA, 17 bp, Homo sapiens
tacctctctgggaccta

SEQ ID NO: 842877 - DNA, 12 bp, Homo sapiens
tacctctctgtc

SEQ ID NO: 842878 - DNA, 20 bp, Homo sapiens
tacctctctgtcccttgctg

SEQ ID NO: 842879 - DNA, 17 bp, Homo sapiens
tacctctcttatagaat

SEQ ID NO: 842880 - DNA, 15 bp, Homo sapiens
tacctctgatacctc

SEQ ID NO: 842881 - DNA, 16 bp, Homo sapiens
tacctctgctgggatg

SEQ ID NO: 842882 - DNA, 14 bp, Homo sapiens
tacctcttagctga

SEQ ID NO: 842883 - DNA, 15 bp, Homo sapiens
tacctcttagctgag

SEQ ID NO: 842884 - DNA, 22 bp, Homo sapiens
tacctcttgagccttgaacttt

SEQ ID NO: 842885 - DNA, 12 bp, Homo sapiens
tacctcttttgc

SEQ ID NO: 842886 - DNA, 13 bp, Homo sapiens
tacctgaaaacac

SEQ ID NO: 842887 - DNA, 13 bp, Homo sapiens
tacctgacctaaa

SEQ ID NO: 842888 - DNA, 21 bp, Homo sapiens
tacctgacctaaattagataa

SEQ ID NO: 842889 - DNA, 13 bp, Homo sapiens
tacctgaggccag

SEQ ID NO: 842890 - DNA, 22 bp, Homo sapiens
tacctgattgatcacacagtgt

SEQ ID NO: 842891 - DNA, 23 bp, Homo sapiens
tacctgattgatcacacagtgtt

SEQ ID NO: 842892 - DNA, 14 bp, Homo sapiens
tacctgattgtatt

SEQ ID NO: 842893 - DNA, 21 bp, Homo sapiens
tacctgatttcttcagggctg

SEQ ID NO: 842894 - DNA, 15 bp, Homo sapiens
tacctgccttttaag

SEQ ID NO: 842895 - DNA, 19 bp, Homo sapiens
tacctgccttttaagtttg

SEQ ID NO: 842896 - DNA, 18 bp, Homo sapiens
tacctgctgccccagctg

SEQ ID NO: 842897 - DNA, 13 bp, Homo sapiens
tacctgctgctgc

SEQ ID NO: 842898 - DNA, 17 bp, Homo sapiens
tacctggaaacagcttt

SEQ ID NO: 842899 - DNA, 21 bp, Homo sapiens
tacctggaatcaaataaaaat

SEQ ID NO: 842900 - DNA, 19 bp, Homo sapiens
tacctggagaagaatggct

SEQ ID NO: 842901 - DNA, 19 bp, Homo sapiens
tacctggatgttcttttta

SEQ ID NO: 842902 - DNA, 17 bp, Homo sapiens
tacctggggactcctca

SEQ ID NO: 842903 - DNA, 18 bp, Homo sapiens
tacctgggtgattacata

SEQ ID NO: 842904 - DNA, 18 bp, Homo sapiens
tacctggtccccactgct

SEQ ID NO: 842905 - DNA, 19 bp, Homo sapiens
tacctgtagattcaggtaa

SEQ ID NO: 842906 - DNA, 12 bp, Homo sapiens
tacctgtgcctg

SEQ ID NO: 842907 - DNA, 13 bp, Homo sapiens
tacctgtgtgctt

SEQ ID NO: 842908 - DNA, 20 bp, Homo sapiens
tacctgtgtttttttctaaa

SEQ ID NO: 842909 - DNA, 16 bp, Homo sapiens
tacctgttcagtgtcc

SEQ ID NO: 842910 - DNA, 20 bp, Homo sapiens
tacctgttcagtgtcccggg

SEQ ID NO: 842911 - DNA, 21 bp, Homo sapiens
tacctgttcagtgtcccgggc

SEQ ID NO: 842912 - DNA, 20 bp, Homo sapiens
tacctgttccattgttgtca

SEQ ID NO: 842913 - DNA, 12 bp, Homo sapiens
tacctgttctgt

SEQ ID NO: 842914 - DNA, 22 bp, Homo sapiens
tacctgttttgtggtcagctgt

SEQ ID NO: 842915 - DNA, 22 bp, Homo sapiens
taccttaactcacccctcagca

SEQ ID NO: 842916 - DNA, 21 bp, Homo sapiens
taccttagattagctctggac

SEQ ID NO: 842917 - DNA, 22 bp, Homo sapiens
taccttagattagctctggacc

SEQ ID NO: 842918 - DNA, 17 bp, Homo sapiens
taccttatagttactgt

SEQ ID NO: 842919 - DNA, 18 bp, Homo sapiens
taccttatagttactgtg

SEQ ID NO: 842920 - DNA, 16 bp, Homo sapiens
taccttcagccctggc

SEQ ID NO: 842921 - DNA, 19 bp, Homo sapiens
taccttccatacacagagg

SEQ ID NO: 842922 - DNA, 21 bp, Homo sapiens
taccttccatacacagaggag

SEQ ID NO: 842923 - DNA, 15 bp, Homo sapiens
taccttcctgtccct

SEQ ID NO: 842924 - DNA, 20 bp, Homo sapiens
taccttcctgtccctgaggt

SEQ ID NO: 842925 - DNA, 16 bp, Homo sapiens
taccttctatgtatta

SEQ ID NO: 842926 - DNA, 15 bp, Homo sapiens
taccttctggttgct

SEQ ID NO: 842927 - DNA, 17 bp, Homo sapiens
taccttctggttgcttc

SEQ ID NO: 842928 - DNA, 15 bp, Homo sapiens
taccttgaaaggaag

SEQ ID NO: 842929 - DNA, 15 bp, Homo sapiens
taccttgaccatcgt

SEQ ID NO: 842930 - DNA, 20 bp, Homo sapiens
taccttgaccatcgtccttc

SEQ ID NO: 842931 - DNA, 15 bp, Homo sapiens
taccttgaggtcttt

SEQ ID NO: 842932 - DNA, 20 bp, Homo sapiens
taccttgtatactgtaggca

SEQ ID NO: 842933 - DNA, 12 bp, Homo sapiens
tacctttcatac

SEQ ID NO: 842934 - DNA, 23 bp, Homo sapiens
tacctttcctgatgcccctgaca

SEQ ID NO: 842935 - DNA, 14 bp, Homo sapiens
tacctttgaaatat

SEQ ID NO: 842936 - DNA, 20 bp, Homo sapiens
tacctttgtattctctcctg

SEQ ID NO: 842937 - DNA, 12 bp, Homo sapiens
tacctttgtcac

SEQ ID NO: 842938 - DNA, 18 bp, Homo sapiens
taccttttcagggctggc

SEQ ID NO: 842939 - DNA, 21 bp, Homo sapiens
taccttttcctattctgttgc

SEQ ID NO: 842940 - DNA, 14 bp, Homo sapiens
taccttttctataa

SEQ ID NO: 842941 - DNA, 18 bp, Homo sapiens
taccttttctcacaaaaa

SEQ ID NO: 842942 - DNA, 22 bp, Homo sapiens
taccttttgatgttcagagtgg

SEQ ID NO: 842943 - DNA, 20 bp, Homo sapiens
tacctttttatttgcatgtg

SEQ ID NO: 842944 - DNA, 22 bp, Homo sapiens
taccttttttagagttgatact

SEQ ID NO: 842945 - DNA, 19 bp, Homo sapiens
taccttttttatacataaa

SEQ ID NO: 842946 - DNA, 22 bp, Homo sapiens
taccttttttgttttttcaaaa

SEQ ID NO: 842947 - DNA, 23 bp, Homo sapiens
taccttttttgttttttcaaaat

SEQ ID NO: 842948 - DNA, 20 bp, Homo sapiens
tacgaaataattgttgttct

SEQ ID NO: 842949 - DNA, 21 bp, Homo sapiens
tacgacacgggtggggaaagg

SEQ ID NO: 842950 - DNA, 19 bp, Homo sapiens
tacgacgtgggaatttcaa

SEQ ID NO: 842951 - DNA, 19 bp, Homo sapiens
tactgatgctgtcatgtgg

SEQ ID NO: 842952 - DNA, 18 bp, Homo sapiens
tactgattagagtggtta

SEQ ID NO: 842953 - DNA, 17 bp, Homo sapiens
tactgattgggaggtgc

SEQ ID NO: 842954 - DNA, 17 bp, Homo sapiens
tactgatttagaagcaa

SEQ ID NO: 842955 - DNA, 14 bp, Homo sapiens
tactgatttcagta

SEQ ID NO: 842956 - DNA, 19 bp, Homo sapiens
tactgatttcagtaagtct

SEQ ID NO: 842957 - DNA, 21 bp, Homo sapiens
tactgatttgggctgaatgta

SEQ ID NO: 842958 - DNA, 13 bp, Homo sapiens
tactgatttttgt

SEQ ID NO: 842959 - DNA, 18 bp, Homo sapiens
tactgcaaaggcttgtgg

SEQ ID NO: 842960 - DNA, 16 bp, Homo sapiens
tactgcaaagtcgcca

SEQ ID NO: 842961 - DNA, 19 bp, Homo sapiens
tactgcaattaaagtgata

SEQ ID NO: 842962 - DNA, 20 bp, Homo sapiens
tactgcactccagcctgggg

SEQ ID NO: 842963 - DNA, 14 bp, Homo sapiens
tactgcactgagtt

SEQ ID NO: 842964 - DNA, 15 bp, Homo sapiens
tactgcactttcccc

SEQ ID NO: 842965 - DNA, 22 bp, Homo sapiens
tactgcagaatacagtaagctg

SEQ ID NO: 842966 - DNA, 22 bp, Homo sapiens
tactgcagcctttgcctccccg

SEQ ID NO: 842967 - DNA, 22 bp, Homo sapiens
tactgcagctttacatgcaatt

SEQ ID NO: 842968 - DNA, 15 bp, Homo sapiens
tactgcatacttttt

SEQ ID NO: 842969 - DNA, 21 bp, Homo sapiens
tactgcatactttttaaatgt

SEQ ID NO: 842970 - DNA, 19 bp, Homo sapiens
tactgcattctctcccatc

SEQ ID NO: 842971 - DNA, 11 bp, Homo sapiens
tactgccaaag

SEQ ID NO: 842972 - DNA, 19 bp, Homo sapiens
tactgccatgtactagttt

SEQ ID NO: 842973 - DNA, 20 bp, Homo sapiens
tactgccattcacttcataa

SEQ ID NO: 842974 - DNA, 19 bp, Homo sapiens
tactgcccacatttgggct

SEQ ID NO: 842975 - DNA, 18 bp, Homo sapiens
tactgcctactgttactc

SEQ ID NO: 842976 - DNA, 22 bp, Homo sapiens
tactgcctataatcttatacaa

SEQ ID NO: 842977 - DNA, 15 bp, Homo sapiens
tactgcctttagaaa

SEQ ID NO: 842978 - DNA, 17 bp, Homo sapiens
tactgcgactttctgcc

SEQ ID NO: 842979 - DNA, 22 bp, Homo sapiens
tactgcgactttctgcctggag

SEQ ID NO: 842980 - DNA, 20 bp, Homo sapiens
tactgctacagcaatttcta

SEQ ID NO: 842981 - DNA, 14 bp, Homo sapiens
tactgctcaggctg

SEQ ID NO: 842982 - DNA, 12 bp, Homo sapiens
tactgctctgag

SEQ ID NO: 842983 - DNA, 10 bp, Homo sapiens
tactgctgag

SEQ ID NO: 842984 - DNA, 15 bp, Homo sapiens
tactgctgattcttg

SEQ ID NO: 842985 - DNA, 13 bp, Homo sapiens
tactgctgctgtg

SEQ ID NO: 842986 - DNA, 15 bp, Homo sapiens
tactgctgctgtgct

SEQ ID NO: 842987 - DNA, 17 bp, Homo sapiens
tactgctgtcttccaag

SEQ ID NO: 842988 - DNA, 17 bp, Homo sapiens
tactgcttctctttgtg

SEQ ID NO: 842989 - DNA, 22 bp, Homo sapiens
tactgcttgaccgtactctcac

SEQ ID NO: 842990 - DNA, 16 bp, Homo sapiens
tactgctttgcaaaga

SEQ ID NO: 842991 - DNA, 21 bp, Homo sapiens
tactggaagctgcagatcttt

SEQ ID NO: 842992 - DNA, 18 bp, Homo sapiens
tactggaagttttgcatt

SEQ ID NO: 842993 - DNA, 24 bp, Homo sapiens
tactggaataaacagtgagcatat

SEQ ID NO: 842994 - DNA, 18 bp, Homo sapiens
tactggaataatttgtaa

SEQ ID NO: 842995 - DNA, 19 bp, Homo sapiens
tactggacaatcttatgtt

SEQ ID NO: 842996 - DNA, 19 bp, Homo sapiens
tactggagcttcattttgg

SEQ ID NO: 842997 - DNA, 22 bp, Homo sapiens
tactggcaaaaggatctttgtg

SEQ ID NO: 842998 - DNA, 16 bp, Homo sapiens
tactggccagtgtcat

SEQ ID NO: 842999 - DNA, 16 bp, Homo sapiens
tactggcctctgtgat

SEQ ID NO: 843000 - DNA, 21 bp, Homo sapiens
tactggctctttattcattaa

SEQ ID NO: 843001 - DNA, 15 bp, Homo sapiens
tactgggagaatcac

SEQ ID NO: 843002 - DNA, 21 bp, Homo sapiens
tactgggagagaagaggactt

SEQ ID NO: 843003 - DNA, 12 bp, Homo sapiens
tactgggcctta

SEQ ID NO: 843004 - DNA, 17 bp, Homo sapiens
tactgggtgtcatttca

SEQ ID NO: 843005 - DNA, 22 bp, Homo sapiens
tactgggtgtcatttcattcca

SEQ ID NO: 843006 - DNA, 17 bp, Homo sapiens
tactgggttaatggcta

SEQ ID NO: 843007 - DNA, 17 bp, Homo sapiens
tactgggtttcaagaaa

SEQ ID NO: 843008 - DNA, 21 bp, Homo sapiens
tactggtaagattgttattaa

SEQ ID NO: 843009 - DNA, 23 bp, Homo sapiens
tactggtattagttaaaacacat

SEQ ID NO: 843010 - DNA, 13 bp, Homo sapiens
tactggtccaaaa

SEQ ID NO: 843011 - DNA, 18 bp, Homo sapiens
tactggtccaaaagattg

SEQ ID NO: 843012 - DNA, 18 bp, Homo sapiens
tactggttgcatggaaat

SEQ ID NO: 843013 - DNA, 17 bp, Homo sapiens
tactgtaaaagttataa

SEQ ID NO: 843014 - DNA, 14 bp, Homo sapiens
tactgtaaagaatt

SEQ ID NO: 843015 - DNA, 18 bp, Homo sapiens
tactgtaacactttacaa

SEQ ID NO: 843016 - DNA, 13 bp, Homo sapiens
tactgtaactttt

SEQ ID NO: 843017 - DNA, 13 bp, Homo sapiens
tactgtaattcct

SEQ ID NO: 843018 - DNA, 23 bp, Homo sapiens
tactgtaatttgtgatacaatgc

SEQ ID NO: 843019 - DNA, 19 bp, Homo sapiens
tactgtacaatgactttat

SEQ ID NO: 843020 - DNA, 17 bp, Homo sapiens
tactgtacataaattcc

SEQ ID NO: 843021 - DNA, 18 bp, Homo sapiens
tactgtacataaattcca

SEQ ID NO: 843022 - DNA, 21 bp, Homo sapiens
tactgtacataaattccagag

SEQ ID NO: 843023 - DNA, 11 bp, Homo sapiens
tactgtacatg

SEQ ID NO: 843024 - DNA, 16 bp, Homo sapiens
tactgtacatgctatg

SEQ ID NO: 843025 - DNA, 18 bp, Homo sapiens
tactgtacatgctatgct

SEQ ID NO: 843026 - DNA, 20 bp, Homo sapiens
tactgtactttgccattttt

SEQ ID NO: 843027 - DNA, 12 bp, Homo sapiens
tactgtagtttt

SEQ ID NO: 843028 - DNA, 15 bp, Homo sapiens
tactgtatataaact

SEQ ID NO: 843029 - DNA, 14 bp, Homo sapiens
tactgtatatgtat

SEQ ID NO: 843030 - DNA, 12 bp, Homo sapiens
tactgtatttga

SEQ ID NO: 843031 - DNA, 15 bp, Homo sapiens
tactgtcaaacaata

SEQ ID NO: 843032 - DNA, 15 bp, Homo sapiens
tactgtcaaatgatg

SEQ ID NO: 843033 - DNA, 20 bp, Homo sapiens
tactgtcaaatgatgtgcaa

SEQ ID NO: 843034 - DNA, 14 bp, Homo sapiens
tactgtcaataaac

SEQ ID NO: 843035 - DNA, 21 bp, Homo sapiens
tactgtccagcttatagtctt

SEQ ID NO: 843036 - DNA, 15 bp, Homo sapiens
tactgtctcctccct

SEQ ID NO: 843037 - DNA, 16 bp, Homo sapiens
tactgtctcctccctg

SEQ ID NO: 843038 - DNA, 14 bp, Homo sapiens
tactgtctctggag

SEQ ID NO: 843039 - DNA, 16 bp, Homo sapiens
tactgtctctggagtg

SEQ ID NO: 843040 - DNA, 23 bp, Homo sapiens
tactgtctctggcatttgtttcc

SEQ ID NO: 843041 - DNA, 18 bp, Homo sapiens
tactgtctgttatgattt

SEQ ID NO: 843042 - DNA, 19 bp, Homo sapiens
tactgtctttattcttatt

SEQ ID NO: 843043 - DNA, 13 bp, Homo sapiens
tactgtgcagaat

SEQ ID NO: 843044 - DNA, 15 bp, Homo sapiens
tactgtgcagaataa

SEQ ID NO: 843045 - DNA, 13 bp, Homo sapiens
tactgtgcctggt

SEQ ID NO: 843046 - DNA, 14 bp, Homo sapiens
tactgtggggagag

SEQ ID NO: 843047 - DNA, 16 bp, Homo sapiens
tactgtggggagagat

SEQ ID NO: 843048 - DNA, 16 bp, Homo sapiens
tactgtgtatgtttta

SEQ ID NO: 843049 - DNA, 23 bp, Homo sapiens
tactgtgtgtgagtgtgaatata

SEQ ID NO: 843050 - DNA, 22 bp, Homo sapiens
tactgtgtgtgtgaatgaacac

SEQ ID NO: 843051 - DNA, 13 bp, Homo sapiens
tactgtgttcctg

SEQ ID NO: 843052 - DNA, 22 bp, Homo sapiens
tactgtgttcctggcaatagtg

SEQ ID NO: 843053 - DNA, 15 bp, Homo sapiens
tactgttactctaaa

SEQ ID NO: 843054 - DNA, 13 bp, Homo sapiens
tactgttcctttc

SEQ ID NO: 843055 - DNA, 17 bp, Homo sapiens
tactgttcctttcagat

SEQ ID NO: 843056 - DNA, 18 bp, Homo sapiens
tactgttcctttcagatg

SEQ ID NO: 843057 - DNA, 17 bp, Homo sapiens
tactgttctatacgagt

SEQ ID NO: 843058 - DNA, 16 bp, Homo sapiens
tactgttgatacaaac

SEQ ID NO: 843059 - DNA, 20 bp, Homo sapiens
tactgttgatacaaaccact

SEQ ID NO: 843060 - DNA, 15 bp, Homo sapiens
tactgttgctttaat

SEQ ID NO: 843061 - DNA, 15 bp, Homo sapiens
tactgtttacagttt

SEQ ID NO: 843062 - DNA, 15 bp, Homo sapiens
tactgtttattactt

SEQ ID NO: 843063 - DNA, 16 bp, Homo sapiens
tactgttttaattgta

SEQ ID NO: 843064 - DNA, 14 bp, Homo sapiens
tactgttttatgtt

SEQ ID NO: 843065 - DNA, 16 bp, Homo sapiens
tactgttttatgttga

SEQ ID NO: 843066 - DNA, 19 bp, Homo sapiens
tactgttttgaagctgggc

SEQ ID NO: 843067 - DNA, 14 bp, Homo sapiens
tacttaaaatatct

SEQ ID NO: 843068 - DNA, 17 bp, Homo sapiens
tacttaaatgaaagcat

SEQ ID NO: 843069 - DNA, 12 bp, Homo sapiens
tacttaaatgag

SEQ ID NO: 843070 - DNA, 14 bp, Homo sapiens
tacttaacatatct

SEQ ID NO: 843071 - DNA, 16 bp, Homo sapiens
tacttaacatatctga

SEQ ID NO: 843072 - DNA, 19 bp, Homo sapiens
tacttaacatatctgatat

SEQ ID NO: 843073 - DNA, 16 bp, Homo sapiens
tacttttccagtctgt

SEQ ID NO: 843074 - DNA, 17 bp, Homo sapiens
tacttttcccctgttaa

SEQ ID NO: 843075 - DNA, 14 bp, Homo sapiens
tacttttctgttta

SEQ ID NO: 843076 - DNA, 17 bp, Homo sapiens
tacttttcttcagtcct

SEQ ID NO: 843077 - DNA, 20 bp, Homo sapiens
tacttttctttattagcttt

SEQ ID NO: 843078 - DNA, 13 bp, Homo sapiens
tacttttgagtgt

SEQ ID NO: 843079 - DNA, 17 bp, Homo sapiens
tacttttgctgtttata

SEQ ID NO: 843080 - DNA, 14 bp, Homo sapiens
tacttttgtaaata

SEQ ID NO: 843081 - DNA, 17 bp, Homo sapiens
tactttttatactccat

SEQ ID NO: 843082 - DNA, 13 bp, Homo sapiens
tactttttcagtt

SEQ ID NO: 843083 - DNA, 17 bp, Homo sapiens
tactttttcagttgttt

SEQ ID NO: 843084 - DNA, 19 bp, Homo sapiens
tactttttcagttgtttag

SEQ ID NO: 843085 - DNA, 16 bp, Homo sapiens
tactttttcattcttt

SEQ ID NO: 843086 - DNA, 16 bp, Homo sapiens
tactttttctaatgag

SEQ ID NO: 843087 - DNA, 23 bp, Homo sapiens
tactttttgaacttttcattccc

SEQ ID NO: 843088 - DNA, 13 bp, Homo sapiens
tactttttgtaga

SEQ ID NO: 843089 - DNA, 17 bp, Homo sapiens
tactttttgtatttagt

SEQ ID NO: 843090 - DNA, 13 bp, Homo sapiens
tactttttgttat

SEQ ID NO: 843091 - DNA, 16 bp, Homo sapiens
tacttttttaacatgt

SEQ ID NO: 843092 - DNA, 13 bp, Homo sapiens
tacttttttatag

SEQ ID NO: 843093 - DNA, 14 bp, Homo sapiens
tacttttttcttat

SEQ ID NO: 843094 - DNA, 15 bp, Homo sapiens
tagaaaaaaaactga

SEQ ID NO: 843095 - DNA, 15 bp, Homo sapiens
tagaaaaaaaattat

SEQ ID NO: 843096 - DNA, 13 bp, Homo sapiens
tagaaaaaaagaa

SEQ ID NO: 843097 - DNA, 18 bp, Homo sapiens
tagaaaaaagtttacaac

SEQ ID NO: 843098 - DNA, 13 bp, Homo sapiens
tagaaaaagcagt

SEQ ID NO: 843099 - DNA, 21 bp, Homo sapiens
tagaaaaaggggcctgagtgg

SEQ ID NO: 843100 - DNA, 19 bp, Homo sapiens
tagaaaaagtaaaagatca

SEQ ID NO: 843101 - DNA, 19 bp, Homo sapiens
tagaaaaagtcaatgtact

SEQ ID NO: 843102 - DNA, 16 bp, Homo sapiens
tagaaaaataaaatgt

SEQ ID NO: 843103 - DNA, 12 bp, Homo sapiens
tagaaaaatgta

SEQ ID NO: 843104 - DNA, 16 bp, Homo sapiens
tagaaaaatgtataaa

SEQ ID NO: 843105 - DNA, 18 bp, Homo sapiens
tagaaaaattattagaac

SEQ ID NO: 843106 - DNA, 19 bp, Homo sapiens
tagaaaaattattagaaca

SEQ ID NO: 843107 - DNA, 17 bp, Homo sapiens
tagaaaacaggaaaaaa

SEQ ID NO: 843108 - DNA, 16 bp, Homo sapiens
tagaaaacataatctt

SEQ ID NO: 843109 - DNA, 16 bp, Homo sapiens
tagaaaacctctcgct

SEQ ID NO: 843110 - DNA, 11 bp, Homo sapiens
tagaaaacttt

SEQ ID NO: 843111 - DNA, 21 bp, Homo sapiens
tagaaaagaaaaaaaaaatat

SEQ ID NO: 843112 - DNA, 16 bp, Homo sapiens
tagaaaagaaaacatt

SEQ ID NO: 843113 - DNA, 21 bp, Homo sapiens
tagaaaaggctaggtacacag

SEQ ID NO: 843114 - DNA, 14 bp, Homo sapiens
tagaaaagtgaatt

SEQ ID NO: 843115 - DNA, 17 bp, Homo sapiens
tagaaaagtgaattgaa

SEQ ID NO: 843116 - DNA, 17 bp, Homo sapiens
tagaaaagttgcagatg

SEQ ID NO: 843117 - DNA, 12 bp, Homo sapiens
tagaaaatggtc

SEQ ID NO: 843118 - DNA, 18 bp, Homo sapiens
tagaaaatgtgaccctcc

SEQ ID NO: 843119 - DNA, 21 bp, Homo sapiens
tagaaaatgtgaccctccaaa

SEQ ID NO: 843120 - DNA, 24 bp, Homo sapiens
tagaaaatgtgtcctatctatctt

SEQ ID NO: 843121 - DNA, 19 bp, Homo sapiens
tagaaaattagtgaccatt

SEQ ID NO: 843122 - DNA, 23 bp, Homo sapiens
tagaaaatttagccctttaaaac

SEQ ID NO: 843123 - DNA, 22 bp, Homo sapiens
tagaaaatttgttattttgcaa

SEQ ID NO: 843124 - DNA, 17 bp, Homo sapiens
tagaaacaatactgttc

SEQ ID NO: 843125 - DNA, 16 bp, Homo sapiens
tagaaacaccattcat

SEQ ID NO: 843126 - DNA, 17 bp, Homo sapiens
tagaaacccaaattggg

SEQ ID NO: 843127 - DNA, 18 bp, Homo sapiens
tagaaacccaagctcctc

SEQ ID NO: 843128 - DNA, 13 bp, Homo sapiens
tagaaactacaaa

SEQ ID NO: 843129 - DNA, 15 bp, Homo sapiens
tagaaactacaaata

SEQ ID NO: 843130 - DNA, 15 bp, Homo sapiens
tagaaacttccaaat

SEQ ID NO: 843131 - DNA, 13 bp, Homo sapiens
tagaaagaagcca

SEQ ID NO: 843132 - DNA, 16 bp, Homo sapiens
tagaaagaagccatat

SEQ ID NO: 843133 - DNA, 23 bp, Homo sapiens
tagaaagaagcccaatattataa

SEQ ID NO: 843134 - DNA, 18 bp, Homo sapiens
tagaaagacatctgcctg

SEQ ID NO: 843135 - DNA, 23 bp, Homo sapiens
tagaaagacatctgcctgtaatt

SEQ ID NO: 843136 - DNA, 15 bp, Homo sapiens
tagaaagaccaggcc

SEQ ID NO: 843137 - DNA, 17 bp, Homo sapiens
tagaaagaccaggccaa

SEQ ID NO: 843138 - DNA, 18 bp, Homo sapiens
tagaaagagatacagagg

SEQ ID NO: 843139 - DNA, 23 bp, Homo sapiens
tagaaagagatcacccactccta

SEQ ID NO: 843140 - DNA, 14 bp, Homo sapiens
tagaaagagttcta

SEQ ID NO: 843141 - DNA, 22 bp, Homo sapiens
tagaaagatcgtttaaaaacaa

SEQ ID NO: 843142 - DNA, 12 bp, Homo sapiens
tagaaagcattt

SEQ ID NO: 843143 - DNA, 18 bp, Homo sapiens
tagaaagccatattccag

SEQ ID NO: 843144 - DNA, 21 bp, Homo sapiens
tagaaagctgacattgccaaa

SEQ ID NO: 843145 - DNA, 20 bp, Homo sapiens
tagaaagctgtttatttatt

SEQ ID NO: 843146 - DNA, 20 bp, Homo sapiens
tagaaaggaactgcaataat

SEQ ID NO: 843147 - DNA, 18 bp, Homo sapiens
tagaaagtgccagaaagt

SEQ ID NO: 843148 - DNA, 20 bp, Homo sapiens
tagaaataaaggatgtgatt

SEQ ID NO: 843149 - DNA, 16 bp, Homo sapiens
tagaaataaattccta

SEQ ID NO: 843150 - DNA, 13 bp, Homo sapiens
tagaaataacaga

SEQ ID NO: 843151 - DNA, 12 bp, Homo sapiens
tagaaataagtg

SEQ ID NO: 843152 - DNA, 16 bp, Homo sapiens
tagaaataatatgcat

SEQ ID NO: 843153 - DNA, 20 bp, Homo sapiens
tagaaatatctgaaaatgta

SEQ ID NO: 843154 - DNA, 23 bp, Homo sapiens
tagaaatatctgaaaatgtatgt

SEQ ID NO: 843155 - DNA, 18 bp, Homo sapiens
tagaaatatctttctctt

SEQ ID NO: 843156 - DNA, 15 bp, Homo sapiens
tagaaatattcaaaa

SEQ ID NO: 843157 - DNA, 20 bp, Homo sapiens
tagaaatattttaaaatcag

SEQ ID NO: 843158 - DNA, 13 bp, Homo sapiens
tagaaatcaactt

SEQ ID NO: 843159 - DNA, 14 bp, Homo sapiens
tagaaatcatagaa

SEQ ID NO: 843160 - DNA, 16 bp, Homo sapiens
tagaaatcattttgca

SEQ ID NO: 843161 - DNA, 17 bp, Homo sapiens
tagaaatcattttgcaa

SEQ ID NO: 843162 - DNA, 20 bp, Homo sapiens
tagaaatctaaaagaatttt

SEQ ID NO: 843163 - DNA, 19 bp, Homo sapiens
tagaaatgatgatgtggaa

SEQ ID NO: 843164 - DNA, 18 bp, Homo sapiens
tagaaatgccagaaacag

SEQ ID NO: 843165 - DNA, 16 bp, Homo sapiens
tagaaatggaaatttt

SEQ ID NO: 843166 - DNA, 17 bp, Homo sapiens
tagaaatggaaattttg

SEQ ID NO: 843167 - DNA, 19 bp, Homo sapiens
tagaaatgtaacttttgta

SEQ ID NO: 843168 - DNA, 16 bp, Homo sapiens
tagaaattacctgtgg

SEQ ID NO: 843169 - DNA, 18 bp, Homo sapiens
tagaaattacctgtggat

SEQ ID NO: 843170 - DNA, 22 bp, Homo sapiens
tagaaattagaaaaaaattact

SEQ ID NO: 843171 - DNA, 14 bp, Homo sapiens
tagaaattctttat

SEQ ID NO: 843172 - DNA, 23 bp, Homo sapiens
tagaaattgaacaaaaatgtttc

SEQ ID NO: 843173 - DNA, 21 bp, Homo sapiens
tagaaattggtacataggctt

SEQ ID NO: 843174 - DNA, 16 bp, Homo sapiens
tagaaatttccagaga

SEQ ID NO: 843175 - DNA, 18 bp, Homo sapiens
tagaaatttggtttcaag

SEQ ID NO: 843176 - DNA, 14 bp, Homo sapiens
tagaaattttgtaa

SEQ ID NO: 843177 - DNA, 22 bp, Homo sapiens
tagaaattttgtaagaaggcaa

SEQ ID NO: 843178 - DNA, 16 bp, Homo sapiens
tagaacaaaggacaga

SEQ ID NO: 843179 - DNA, 22 bp, Homo sapiens
tagaacaaggcaccttcttaaa

SEQ ID NO: 843180 - DNA, 18 bp, Homo sapiens
tagaacacaaaacttgaa

SEQ ID NO: 843181 - DNA, 15 bp, Homo sapiens
tagaacacaggcaaa

SEQ ID NO: 843182 - DNA, 18 bp, Homo sapiens
tagaacactaattcataa

SEQ ID NO: 843183 - DNA, 19 bp, Homo sapiens
tagaacactaattcataat

SEQ ID NO: 843184 - DNA, 20 bp, Homo sapiens
tagaacactaattcataatc

SEQ ID NO: 843185 - DNA, 17 bp, Homo sapiens
tagaacatgcacattta

SEQ ID NO: 843186 - DNA, 20 bp, Homo sapiens
tagaacatgcacatttatat

SEQ ID NO: 843187 - DNA, 15 bp, Homo sapiens
tagaaccactatgaa

SEQ ID NO: 843188 - DNA, 23 bp, Homo sapiens
tagaacctaattcaattcaaagc

SEQ ID NO: 843189 - DNA, 21 bp, Homo sapiens
tagaacctatatcgagagtgt

SEQ ID NO: 843190 - DNA, 22 bp, Homo sapiens
tagaacgtgcatccttgtaata

SEQ ID NO: 843191 - DNA, 23 bp, Homo sapiens
tagaacgtgcatccttgtaatac

SEQ ID NO: 843192 - DNA, 16 bp, Homo sapiens
tagaacgttaaactat

SEQ ID NO: 843193 - DNA, 15 bp, Homo sapiens
tagaactatcatttt

SEQ ID NO: 843194 - DNA, 22 bp, Homo sapiens
tagaactatcatttttacacta

SEQ ID NO: 843195 - DNA, 16 bp, Homo sapiens
tagataaatatttgac

SEQ ID NO: 843196 - DNA, 17 bp, Homo sapiens
tagataacttcttgaaa

SEQ ID NO: 843197 - DNA, 20 bp, Homo sapiens
tagataacttcttgaaaaag

SEQ ID NO: 843198 - DNA, 17 bp, Homo sapiens
tagataaggtttcctgc

SEQ ID NO: 843199 - DNA, 21 bp, Homo sapiens
tagataaggtttcctgctcca

SEQ ID NO: 843200 - DNA, 21 bp, Homo sapiens
tagataatttattatacacct

SEQ ID NO: 843201 - DNA, 13 bp, Homo sapiens
tagataatttgaa

SEQ ID NO: 843202 - DNA, 14 bp, Homo sapiens
tagataatttgaaa

SEQ ID NO: 843203 - DNA, 17 bp, Homo sapiens
tagatacaataaattgc

SEQ ID NO: 843204 - DNA, 23 bp, Homo sapiens
tagataccctacgctgtccagaa

SEQ ID NO: 843205 - DNA, 22 bp, Homo sapiens
tagatagctgcatgtggctttt

SEQ ID NO: 843206 - DNA, 14 bp, Homo sapiens
tagatagttaaaag

SEQ ID NO: 843207 - DNA, 19 bp, Homo sapiens
tagatagttaaaagactgc

SEQ ID NO: 843208 - DNA, 17 bp, Homo sapiens
tagatagttagaacctg

SEQ ID NO: 843209 - DNA, 16 bp, Homo sapiens
tagatatgtatatata

SEQ ID NO: 843210 - DNA, 21 bp, Homo sapiens
tagatattaggtccattcatt

SEQ ID NO: 843211 - DNA, 13 bp, Homo sapiens
tagatcaaatact

SEQ ID NO: 843212 - DNA, 14 bp, Homo sapiens
tagatcaaatactt

SEQ ID NO: 843213 - DNA, 20 bp, Homo sapiens
tagatcaaatagttgcatag

SEQ ID NO: 843214 - DNA, 13 bp, Homo sapiens
tagatcagccatt

SEQ ID NO: 843215 - DNA, 14 bp, Homo sapiens
tagatcagccatta

SEQ ID NO: 843216 - DNA, 20 bp, Homo sapiens
tagatcagccattaaaataa

SEQ ID NO: 843217 - DNA, 17 bp, Homo sapiens
tagatcaggtttgccca

SEQ ID NO: 843218 - DNA, 13 bp, Homo sapiens
tagatcagtattt

SEQ ID NO: 843219 - DNA, 14 bp, Homo sapiens
tagatcagtatttc

SEQ ID NO: 843220 - DNA, 18 bp, Homo sapiens
tagatccacacacagagg

SEQ ID NO: 843221 - DNA, 20 bp, Homo sapiens
tagatccagatccagactgt

SEQ ID NO: 843222 - DNA, 19 bp, Homo sapiens
tagatcccatgtcacctca

SEQ ID NO: 843223 - DNA, 19 bp, Homo sapiens
tagatcctgcaccccagca

SEQ ID NO: 843224 - DNA, 15 bp, Homo sapiens
tagatcgcttgagcc

SEQ ID NO: 843225 - DNA, 17 bp, Homo sapiens
tagatcgcttgagccca

SEQ ID NO: 843226 - DNA, 16 bp, Homo sapiens
tagatcttcaatttgg

SEQ ID NO: 843227 - DNA, 12 bp, Homo sapiens
tagatcttctga

SEQ ID NO: 843228 - DNA, 14 bp, Homo sapiens
tagatcttctgaaa

SEQ ID NO: 843229 - DNA, 12 bp, Homo sapiens
tagatctttata

SEQ ID NO: 843230 - DNA, 21 bp, Homo sapiens
tagatgagattgttttatcat

SEQ ID NO: 843231 - DNA, 16 bp, Homo sapiens
tagatgagggtgactg

SEQ ID NO: 843232 - DNA, 20 bp, Homo sapiens
tagatgattgaataacagta

SEQ ID NO: 843233 - DNA, 21 bp, Homo sapiens
tagatgatttctagcaggcag

SEQ ID NO: 843234 - DNA, 19 bp, Homo sapiens
tagatgattttttgaaagt

SEQ ID NO: 843235 - DNA, 22 bp, Homo sapiens
tagatgcaagtaaaaaaaatca

SEQ ID NO: 843236 - DNA, 16 bp, Homo sapiens
tagatgcacttatgca

SEQ ID NO: 843237 - DNA, 16 bp, Homo sapiens
tagatggaatggaaaa

SEQ ID NO: 843238 - DNA, 17 bp, Homo sapiens
tagatggaatggaaaag

SEQ ID NO: 843239 - DNA, 20 bp, Homo sapiens
tagatggcaagcatgtaact

SEQ ID NO: 843240 - DNA, 15 bp, Homo sapiens
tagatggcgatgtgt

SEQ ID NO: 843241 - DNA, 20 bp, Homo sapiens
tagatgggtctggctgagct

SEQ ID NO: 843242 - DNA, 19 bp, Homo sapiens
tagatggtttgagcctgag

SEQ ID NO: 843243 - DNA, 16 bp, Homo sapiens
tagatgtagcattgtt

SEQ ID NO: 843244 - DNA, 15 bp, Homo sapiens
tagatgtagtatttt

SEQ ID NO: 843245 - DNA, 16 bp, Homo sapiens
tagatgtatgcacaca

SEQ ID NO: 843246 - DNA, 22 bp, Homo sapiens
tagatgtatgcacacacatata

SEQ ID NO: 843247 - DNA, 18 bp, Homo sapiens
tagatgtatgtgaataaa

SEQ ID NO: 843248 - DNA, 23 bp, Homo sapiens
tagatgtatttttgatgtatata

SEQ ID NO: 843249 - DNA, 12 bp, Homo sapiens
tagatgtcatga

SEQ ID NO: 843250 - DNA, 18 bp, Homo sapiens
tagatgtccctttcttgg

SEQ ID NO: 843251 - DNA, 23 bp, Homo sapiens
tagatgtccctttcttggccagt

SEQ ID NO: 843252 - DNA, 21 bp, Homo sapiens
tagatgtctaggtacttcagg

SEQ ID NO: 843253 - DNA, 14 bp, Homo sapiens
tagatgtcttcatc

SEQ ID NO: 843254 - DNA, 18 bp, Homo sapiens
tagatgtgcccttttata

SEQ ID NO: 843255 - DNA, 14 bp, Homo sapiens
tagatgttaaatgt

SEQ ID NO: 843256 - DNA, 15 bp, Homo sapiens
tagatgttaaatgtt

SEQ ID NO: 843257 - DNA, 12 bp, Homo sapiens
tagatgttacta

SEQ ID NO: 843258 - DNA, 15 bp, Homo sapiens
tagatgttactacct

SEQ ID NO: 843259 - DNA, 17 bp, Homo sapiens
tagatgttactacctta

SEQ ID NO: 843260 - DNA, 18 bp, Homo sapiens
tagatgttccagtaatct

SEQ ID NO: 843261 - DNA, 14 bp, Homo sapiens
tagatgtttaacaa

SEQ ID NO: 843262 - DNA, 22 bp, Homo sapiens
tagatgtttcaactgtgctctt

SEQ ID NO: 843263 - DNA, 18 bp, Homo sapiens
tagatgttttgggatcag

SEQ ID NO: 843264 - DNA, 15 bp, Homo sapiens
tagattagctctgga

SEQ ID NO: 843265 - DNA, 15 bp, Homo sapiens
tagattattataaac

SEQ ID NO: 843266 - DNA, 18 bp, Homo sapiens
tagattattataaactat

SEQ ID NO: 843267 - DNA, 12 bp, Homo sapiens
tagattcacctg

SEQ ID NO: 843268 - DNA, 13 bp, Homo sapiens
tagattcacctgt

SEQ ID NO: 843269 - DNA, 17 bp, Homo sapiens
tagattcacctgtaaaa

SEQ ID NO: 843270 - DNA, 21 bp, Homo sapiens
tagattcaggggaagggcagg

SEQ ID NO: 843271 - DNA, 12 bp, Homo sapiens
tagattccagga

SEQ ID NO: 843272 - DNA, 23 bp, Homo sapiens
tagattcctcttgcctctctcag

SEQ ID NO: 843273 - DNA, 15 bp, Homo sapiens
tagattgagaaatgt

SEQ ID NO: 843274 - DNA, 23 bp, Homo sapiens
tagattgattgtattgttgaaaa

SEQ ID NO: 843275 - DNA, 20 bp, Homo sapiens
tagattgcaaatattggtta

SEQ ID NO: 843276 - DNA, 16 bp, Homo sapiens
tagattgcttctgtag

SEQ ID NO: 843277 - DNA, 20 bp, Homo sapiens
tagattgtccttttgcaaag

SEQ ID NO: 843278 - DNA, 14 bp, Homo sapiens
tagatttatttcat

SEQ ID NO: 843279 - DNA, 20 bp, Homo sapiens
tagatttcatagttcagaat

SEQ ID NO: 843280 - DNA, 23 bp, Homo sapiens
tagatttcatagttcagaattta

SEQ ID NO: 843281 - DNA, 20 bp, Homo sapiens
tagatttctcttgggcaggc

SEQ ID NO: 843282 - DNA, 12 bp, Homo sapiens
tagatttgaaaa

SEQ ID NO: 843283 - DNA, 13 bp, Homo sapiens
tagatttgaaaaa

SEQ ID NO: 843284 - DNA, 15 bp, Homo sapiens
tagatttgaaaaact

SEQ ID NO: 843285 - DNA, 21 bp, Homo sapiens
tagatttgaaaattgtatacc

SEQ ID NO: 843286 - DNA, 17 bp, Homo sapiens
tagatttgtccttttat

SEQ ID NO: 843287 - DNA, 16 bp, Homo sapiens
tagattttaatttatt

SEQ ID NO: 843288 - DNA, 21 bp, Homo sapiens
tagattttagaaaaacattta

SEQ ID NO: 843289 - DNA, 22 bp, Homo sapiens
tagattttagaccctattgctg

SEQ ID NO: 843290 - DNA, 13 bp, Homo sapiens
tagattttatagt

SEQ ID NO: 843291 - DNA, 16 bp, Homo sapiens
tagattttattttact

SEQ ID NO: 843292 - DNA, 14 bp, Homo sapiens
tagattttctctgg

SEQ ID NO: 843293 - DNA, 15 bp, Homo sapiens
tagattttctctgga

SEQ ID NO: 843294 - DNA, 18 bp, Homo sapiens
tagatttttaacaaaaaa

SEQ ID NO: 843295 - DNA, 18 bp, Homo sapiens
tagatttttacaatctgt

SEQ ID NO: 843296 - DNA, 20 bp, Homo sapiens
tagatttttgattcagctca

SEQ ID NO: 843297 - DNA, 17 bp, Homo sapiens
tagattttttttaaagt

SEQ ID NO: 843298 - DNA, 18 bp, Homo sapiens
tagattttttttaaagtt

SEQ ID NO: 843299 - DNA, 19 bp, Homo sapiens
tagattttttttaaagttt

SEQ ID NO: 843300 - DNA, 12 bp, Homo sapiens
tagcaaaacaaa

SEQ ID NO: 843301 - DNA, 22 bp, Homo sapiens
tagcaaaacgcatggagtgtgt

SEQ ID NO: 843302 - DNA, 16 bp, Homo sapiens
tagcaaaataaaacat

SEQ ID NO: 843303 - DNA, 15 bp, Homo sapiens
tagcaaacagaggaa

SEQ ID NO: 843304 - DNA, 17 bp, Homo sapiens
tagcaaatgaaggatga

SEQ ID NO: 843305 - DNA, 16 bp, Homo sapiens
tagcaaatttctctct

SEQ ID NO: 843306 - DNA, 17 bp, Homo sapiens
tagcaacatatctctgc

SEQ ID NO: 843307 - DNA, 22 bp, Homo sapiens
tagcaactacagtctaaagctg

SEQ ID NO: 843308 - DNA, 13 bp, Homo sapiens
tagcaacttttgt

SEQ ID NO: 843309 - DNA, 17 bp, Homo sapiens
tagcaagacacatccct

SEQ ID NO: 843310 - DNA, 17 bp, Homo sapiens
tagcaagagtgtgaaat

SEQ ID NO: 843311 - DNA, 14 bp, Homo sapiens
tagcaagatgcaaa

SEQ ID NO: 843312 - DNA, 16 bp, Homo sapiens
tagcaaggcatgatgt

SEQ ID NO: 843313 - DNA, 18 bp, Homo sapiens
tagcaagtgaatttttct

SEQ ID NO: 843314 - DNA, 14 bp, Homo sapiens
tagcaatctcttca

SEQ ID NO: 843315 - DNA, 12 bp, Homo sapiens
tagcaatggcca

SEQ ID NO: 843316 - DNA, 21 bp, Homo sapiens
tagcaattcatgggctgtgtg

SEQ ID NO: 843317 - DNA, 23 bp, Homo sapiens
tagctgatgaacttattctgtag

SEQ ID NO: 843318 - DNA, 15 bp, Homo sapiens
tagctgcaaaaataa

SEQ ID NO: 843319 - DNA, 12 bp, Homo sapiens
tagctgcagaac

SEQ ID NO: 843320 - DNA, 16 bp, Homo sapiens
tagctgccactttcac

SEQ ID NO: 843321 - DNA, 17 bp, Homo sapiens
tagctgccactttcacg

SEQ ID NO: 843322 - DNA, 23 bp, Homo sapiens
tagctgccttcaaggactgtttc

SEQ ID NO: 843323 - DNA, 17 bp, Homo sapiens
tagctgctgtcacattt

SEQ ID NO: 843324 - DNA, 19 bp, Homo sapiens
tagctggatataatgtatt

SEQ ID NO: 843325 - DNA, 18 bp, Homo sapiens
tagctgggaaagcataaa

SEQ ID NO: 843326 - DNA, 14 bp, Homo sapiens
tagctgggattaca

SEQ ID NO: 843327 - DNA, 12 bp, Homo sapiens
tagctgggcctg

SEQ ID NO: 843328 - DNA, 13 bp, Homo sapiens
tagctgggcctgt

SEQ ID NO: 843329 - DNA, 14 bp, Homo sapiens
tagctggggcttca

SEQ ID NO: 843330 - DNA, 21 bp, Homo sapiens
tagctgggttccgggaggcag

SEQ ID NO: 843331 - DNA, 23 bp, Homo sapiens
tagctggtgtcagcccctcttcc

SEQ ID NO: 843332 - DNA, 12 bp, Homo sapiens
tagctgtaaggc

SEQ ID NO: 843333 - DNA, 17 bp, Homo sapiens
tagctgtaagggcagtg

SEQ ID NO: 843334 - DNA, 17 bp, Homo sapiens
tagctgtacttcttgaa

SEQ ID NO: 843335 - DNA, 23 bp, Homo sapiens
tagctgtacttcttgaatataaa

SEQ ID NO: 843336 - DNA, 21 bp, Homo sapiens
tagctgtcccatctggtcatt

SEQ ID NO: 843337 - DNA, 14 bp, Homo sapiens
tagctgtcccatgg

SEQ ID NO: 843338 - DNA, 12 bp, Homo sapiens
tagctgtctgtg

SEQ ID NO: 843339 - DNA, 11 bp, Homo sapiens
tagctgtgaaa

SEQ ID NO: 843340 - DNA, 18 bp, Homo sapiens
tagctgtggtgaggtggg

SEQ ID NO: 843341 - DNA, 22 bp, Homo sapiens
tagctgtgtgaatacctgctca

SEQ ID NO: 843342 - DNA, 14 bp, Homo sapiens
tagctgttactgca

SEQ ID NO: 843343 - DNA, 15 bp, Homo sapiens
tagctgtttcaaatg

SEQ ID NO: 843344 - DNA, 13 bp, Homo sapiens
tagctgttttgtg

SEQ ID NO: 843345 - DNA, 18 bp, Homo sapiens
tagctgttttgtgtatat

SEQ ID NO: 843346 - DNA, 20 bp, Homo sapiens
tagctgttttgtgtatattg

SEQ ID NO: 843347 - DNA, 19 bp, Homo sapiens
tagcttaactaatttgaat

SEQ ID NO: 843348 - DNA, 18 bp, Homo sapiens
tagcttacactgaggact

SEQ ID NO: 843349 - DNA, 20 bp, Homo sapiens
tagcttagacctcagcctgt

SEQ ID NO: 843350 - DNA, 19 bp, Homo sapiens
tagcttatctttctttcca

SEQ ID NO: 843351 - DNA, 20 bp, Homo sapiens
tagcttatctttctttccat

SEQ ID NO: 843352 - DNA, 19 bp, Homo sapiens
tagcttattgatcccacat

SEQ ID NO: 843353 - DNA, 14 bp, Homo sapiens
tagcttcagtcatt

SEQ ID NO: 843354 - DNA, 12 bp, Homo sapiens
tagcttccatga

SEQ ID NO: 843355 - DNA, 16 bp, Homo sapiens
tagcttctgcttttct

SEQ ID NO: 843356 - DNA, 19 bp, Homo sapiens
tagcttgggaggcttcccc

SEQ ID NO: 843357 - DNA, 13 bp, Homo sapiens
tagcttgtatagt

SEQ ID NO: 843358 - DNA, 19 bp, Homo sapiens
tagcttgtatagtgtaaaa

SEQ ID NO: 843359 - DNA, 15 bp, Homo sapiens
tagcttgtatcaaat

SEQ ID NO: 843360 - DNA, 18 bp, Homo sapiens
tagcttgtatcaaatgtt

SEQ ID NO: 843361 - DNA, 22 bp, Homo sapiens
tagcttgtttctgtcaagcata

SEQ ID NO: 843362 - DNA, 17 bp, Homo sapiens
tagctttaaaaccacag

SEQ ID NO: 843363 - DNA, 22 bp, Homo sapiens
tagctttaacttaaatagtatt

SEQ ID NO: 843364 - DNA, 23 bp, Homo sapiens
tagctttaatgatatgcttgtaa

SEQ ID NO: 843365 - DNA, 20 bp, Homo sapiens
tagctttacatattcctttg

SEQ ID NO: 843366 - DNA, 16 bp, Homo sapiens
tagctttagaccctgg

SEQ ID NO: 843367 - DNA, 18 bp, Homo sapiens
tagctttagaccctgggt

SEQ ID NO: 843368 - DNA, 13 bp, Homo sapiens
tagctttattctt

SEQ ID NO: 843369 - DNA, 19 bp, Homo sapiens
tagctttattttttaagta

SEQ ID NO: 843370 - DNA, 13 bp, Homo sapiens
tagctttccacat

SEQ ID NO: 843371 - DNA, 18 bp, Homo sapiens
tagctttccacatttgtc

SEQ ID NO: 843372 - DNA, 13 bp, Homo sapiens
tagctttctcagg

SEQ ID NO: 843373 - DNA, 11 bp, Homo sapiens
tagctttgctc

SEQ ID NO: 843374 - DNA, 15 bp, Homo sapiens
tagctttgctctttg

SEQ ID NO: 843375 - DNA, 14 bp, Homo sapiens
tagcttttaaaaaa

SEQ ID NO: 843376 - DNA, 17 bp, Homo sapiens
tagcttttaaaaaatat

SEQ ID NO: 843377 - DNA, 14 bp, Homo sapiens
tagcttttaggaaa

SEQ ID NO: 843378 - DNA, 18 bp, Homo sapiens
tagcttttattgtataaa

SEQ ID NO: 843379 - DNA, 13 bp, Homo sapiens
tagcttttccctt

SEQ ID NO: 843380 - DNA, 20 bp, Homo sapiens
tagcttttgccagtattatg

SEQ ID NO: 843381 - DNA, 20 bp, Homo sapiens
tagctttttaattaagcaaa

SEQ ID NO: 843382 - DNA, 15 bp, Homo sapiens
tagctttttattatt

SEQ ID NO: 843383 - DNA, 19 bp, Homo sapiens
taggaaaagtacatttaat

SEQ ID NO: 843384 - DNA, 18 bp, Homo sapiens
taggaaactaagcattgt

SEQ ID NO: 843385 - DNA, 17 bp, Homo sapiens
taggaaataaaaccttt

SEQ ID NO: 843386 - DNA, 23 bp, Homo sapiens
taggaaatggctttgtgattcaa

SEQ ID NO: 843387 - DNA, 18 bp, Homo sapiens
taggaacaagctggcttc

SEQ ID NO: 843388 - DNA, 22 bp, Homo sapiens
taggaacaagctggcttctgtg

SEQ ID NO: 843389 - DNA, 15 bp, Homo sapiens
taggaaccttctccc

SEQ ID NO: 843390 - DNA, 20 bp, Homo sapiens
taggaacggtaaatttctgt

SEQ ID NO: 843391 - DNA, 15 bp, Homo sapiens
taggaacttcagaga

SEQ ID NO: 843392 - DNA, 16 bp, Homo sapiens
taggaagacataaaac

SEQ ID NO: 843393 - DNA, 19 bp, Homo sapiens
taggaagacataaaacttt

SEQ ID NO: 843394 - DNA, 13 bp, Homo sapiens
taggaaggaaact

SEQ ID NO: 843395 - DNA, 20 bp, Homo sapiens
taggaaggctactggcatta

SEQ ID NO: 843396 - DNA, 15 bp, Homo sapiens
taggaagggaccaag

SEQ ID NO: 843397 - DNA, 15 bp, Homo sapiens
taggaaggttaatgt

SEQ ID NO: 843398 - DNA, 16 bp, Homo sapiens
taggaagtaaattata

SEQ ID NO: 843399 - DNA, 19 bp, Homo sapiens
taggaagtgtaacagctga

SEQ ID NO: 843400 - DNA, 20 bp, Homo sapiens
taggaagtgtaacagctgag

SEQ ID NO: 843401 - DNA, 12 bp, Homo sapiens
taggaataaata

SEQ ID NO: 843402 - DNA, 14 bp, Homo sapiens
taggaataataaat

SEQ ID NO: 843403 - DNA, 17 bp, Homo sapiens
taggaatagaggaagaa

SEQ ID NO: 843404 - DNA, 22 bp, Homo sapiens
taggaatatcaatataatgttt

SEQ ID NO: 843405 - DNA, 14 bp, Homo sapiens
taggaatcccagag

SEQ ID NO: 843406 - DNA, 13 bp, Homo sapiens
taggaatgtccac

SEQ ID NO: 843407 - DNA, 19 bp, Homo sapiens
taggaatgtccaccatgaa

SEQ ID NO: 843408 - DNA, 15 bp, Homo sapiens
taggaattctttgca

SEQ ID NO: 843409 - DNA, 16 bp, Homo sapiens
taggaattctttgcat

SEQ ID NO: 843410 - DNA, 15 bp, Homo sapiens
taggaccactcagcc

SEQ ID NO: 843411 - DNA, 21 bp, Homo sapiens
taggaccactcagcccctagg

SEQ ID NO: 843412 - DNA, 13 bp, Homo sapiens
taggaccttgggc

SEQ ID NO: 843413 - DNA, 14 bp, Homo sapiens
taggaccttgggcc

SEQ ID NO: 843414 - DNA, 21 bp, Homo sapiens
taggacctttccaccacagcc

SEQ ID NO: 843415 - DNA, 22 bp, Homo sapiens
taggacctttccaccacagcca

SEQ ID NO: 843416 - DNA, 18 bp, Homo sapiens
taggactaccgcaggccc

SEQ ID NO: 843417 - DNA, 19 bp, Homo sapiens
taggactaccgcaggcccg

SEQ ID NO: 843418 - DNA, 12 bp, Homo sapiens
taggagagcact

SEQ ID NO: 843419 - DNA, 22 bp, Homo sapiens
taggagagcactgcctctatgc

SEQ ID NO: 843420 - DNA, 22 bp, Homo sapiens
taggagaggagaaaaaaaaagt

SEQ ID NO: 843421 - DNA, 12 bp, Homo sapiens
taggagatttac

SEQ ID NO: 843422 - DNA, 18 bp, Homo sapiens
taggagctgccttggctc

SEQ ID NO: 843423 - DNA, 23 bp, Homo sapiens
taggagctgccttggctcagaca

SEQ ID NO: 843424 - DNA, 14 bp, Homo sapiens
taggagctgggagg

SEQ ID NO: 843425 - DNA, 18 bp, Homo sapiens
taggagctgggaggaaaa

SEQ ID NO: 843426 - DNA, 14 bp, Homo sapiens
taggaggctgcatg

SEQ ID NO: 843427 - DNA, 14 bp, Homo sapiens
taggagttctctga

SEQ ID NO: 843428 - DNA, 23 bp, Homo sapiens
taggataaaaagccagggctgga

SEQ ID NO: 843429 - DNA, 17 bp, Homo sapiens
taggataatataaaaag

SEQ ID NO: 843430 - DNA, 20 bp, Homo sapiens
taggataatataaaaagcag

SEQ ID NO: 843431 - DNA, 19 bp, Homo sapiens
taggatagacactggacat

SEQ ID NO: 843432 - DNA, 18 bp, Homo sapiens
taggatagctaactgtaa

SEQ ID NO: 843433 - DNA, 21 bp, Homo sapiens
taggatagctaactgtaaatc

SEQ ID NO: 843434 - DNA, 15 bp, Homo sapiens
taggatagttagttt

SEQ ID NO: 843435 - DNA, 15 bp, Homo sapiens
taggatatgtatatt

SEQ ID NO: 843436 - DNA, 16 bp, Homo sapiens
taggatcgtaaaaaaa

SEQ ID NO: 843437 - DNA, 23 bp, Homo sapiens
taggatctgcaaacaatgaagaa

SEQ ID NO: 843438 - DNA, 19 bp, Homo sapiens
taggatgcggctttctctg

SEQ ID NO: 843439 - DNA, 21 bp, Homo sapiens
tagtcaataaaatgaacctga

SEQ ID NO: 843440 - DNA, 16 bp, Homo sapiens
tagtcaatttctactt

SEQ ID NO: 843441 - DNA, 19 bp, Homo sapiens
tagtcaatttctacttctg

SEQ ID NO: 843442 - DNA, 14 bp, Homo sapiens
tagtcacaccatct

SEQ ID NO: 843443 - DNA, 15 bp, Homo sapiens
tagtcaccagagact

SEQ ID NO: 843444 - DNA, 19 bp, Homo sapiens
tagtcaccgacagcggcct

SEQ ID NO: 843445 - DNA, 15 bp, Homo sapiens
tagtcacttaaaatg

SEQ ID NO: 843446 - DNA, 16 bp, Homo sapiens
tagtcacttaaaatgt

SEQ ID NO: 843447 - DNA, 19 bp, Homo sapiens
tagtcagaagcaggttctt

SEQ ID NO: 843448 - DNA, 17 bp, Homo sapiens
tagtcagtaaagatatt

SEQ ID NO: 843449 - DNA, 18 bp, Homo sapiens
tagtcatcagagaacagt

SEQ ID NO: 843450 - DNA, 16 bp, Homo sapiens
tagtcatccaacaaga

SEQ ID NO: 843451 - DNA, 23 bp, Homo sapiens
tagtcatccaacaagaagaaata

SEQ ID NO: 843452 - DNA, 13 bp, Homo sapiens
tagtcatgtgacc

SEQ ID NO: 843453 - DNA, 19 bp, Homo sapiens
tagtccatcaccatttctt

SEQ ID NO: 843454 - DNA, 23 bp, Homo sapiens
tagtcccagctacttgggaggct

SEQ ID NO: 843455 - DNA, 15 bp, Homo sapiens
tagtcccttcccctc

SEQ ID NO: 843456 - DNA, 16 bp, Homo sapiens
tagtcccttcccctcc

SEQ ID NO: 843457 - DNA, 21 bp, Homo sapiens
tagtccgtgctgacagctgct

SEQ ID NO: 843458 - DNA, 22 bp, Homo sapiens
tagtccgtgctgacagctgctc

SEQ ID NO: 843459 - DNA, 23 bp, Homo sapiens
tagtcctagctgacgccaataat

SEQ ID NO: 843460 - DNA, 17 bp, Homo sapiens
tagtcctatggaaaaaa

SEQ ID NO: 843461 - DNA, 22 bp, Homo sapiens
tagtcctattctattgcagtta

SEQ ID NO: 843462 - DNA, 15 bp, Homo sapiens
tagtcctctagaaat

SEQ ID NO: 843463 - DNA, 10 bp, Homo sapiens
tagtccttgg

SEQ ID NO: 843464 - DNA, 19 bp, Homo sapiens
tagtcctttctgtgaagct

SEQ ID NO: 843465 - DNA, 13 bp, Homo sapiens
tagtcgggacttg

SEQ ID NO: 843466 - DNA, 14 bp, Homo sapiens
tagtcgtgaatctt

SEQ ID NO: 843467 - DNA, 18 bp, Homo sapiens
tagtctacagttgtcctg

SEQ ID NO: 843468 - DNA, 20 bp, Homo sapiens
tagtctagatggctcctctc

SEQ ID NO: 843469 - DNA, 20 bp, Homo sapiens
tagtctatcaaatgaaactc

SEQ ID NO: 843470 - DNA, 17 bp, Homo sapiens
tagtctcagtgaagact

SEQ ID NO: 843471 - DNA, 17 bp, Homo sapiens
tagtctcctttgcactg

SEQ ID NO: 843472 - DNA, 21 bp, Homo sapiens
tagtctcctttgcactgaggg

SEQ ID NO: 843473 - DNA, 22 bp, Homo sapiens
tagtctcctttgcactgagggc

SEQ ID NO: 843474 - DNA, 21 bp, Homo sapiens
tagtctcttgtattaaactct

SEQ ID NO: 843475 - DNA, 19 bp, Homo sapiens
tagtctgtgtaactttaaa

SEQ ID NO: 843476 - DNA, 22 bp, Homo sapiens
tagtctgtgtaactttaaacat

SEQ ID NO: 843477 - DNA, 18 bp, Homo sapiens
tagtctgtgtgaaggtga

SEQ ID NO: 843478 - DNA, 14 bp, Homo sapiens
tagtcttatgtaaa

SEQ ID NO: 843479 - DNA, 22 bp, Homo sapiens
tagtcttcaactggttagtgtg

SEQ ID NO: 843480 - DNA, 18 bp, Homo sapiens
tagtcttctcatagcatt

SEQ ID NO: 843481 - DNA, 16 bp, Homo sapiens
tagtcttttgcttttg

SEQ ID NO: 843482 - DNA, 16 bp, Homo sapiens
tagtgaaaattctgtt

SEQ ID NO: 843483 - DNA, 13 bp, Homo sapiens
tagtgaaactttt

SEQ ID NO: 843484 - DNA, 19 bp, Homo sapiens
tagtgaaacttttctagaa

SEQ ID NO: 843485 - DNA, 21 bp, Homo sapiens
tagtgaaggcttctctctgtg

SEQ ID NO: 843486 - DNA, 21 bp, Homo sapiens
tagtgacaagtgaagaacact

SEQ ID NO: 843487 - DNA, 20 bp, Homo sapiens
tagtgagccactcagtctct

SEQ ID NO: 843488 - DNA, 19 bp, Homo sapiens
tagtgatcaaattgtgcag

SEQ ID NO: 843489 - DNA, 15 bp, Homo sapiens
tagtgatcatttaaa

SEQ ID NO: 843490 - DNA, 19 bp, Homo sapiens
tagtgattaaatatatcta

SEQ ID NO: 843491 - DNA, 18 bp, Homo sapiens
tagtgattctgatttcag

SEQ ID NO: 843492 - DNA, 20 bp, Homo sapiens
tagtgattctgatttcagtt

SEQ ID NO: 843493 - DNA, 14 bp, Homo sapiens
tagtgcaaaatggt

SEQ ID NO: 843494 - DNA, 23 bp, Homo sapiens
tagtgcaattccaagaaaatatc

SEQ ID NO: 843495 - DNA, 18 bp, Homo sapiens
tagtgcagctgattttaa

SEQ ID NO: 843496 - DNA, 22 bp, Homo sapiens
tagtgcagctgattttaacaat

SEQ ID NO: 843497 - DNA, 17 bp, Homo sapiens
tagtgcatttttaaact

SEQ ID NO: 843498 - DNA, 19 bp, Homo sapiens
tagtgccaatgatgtgacc

SEQ ID NO: 843499 - DNA, 23 bp, Homo sapiens
tagtgccaggtggctcagtgcca

SEQ ID NO: 843500 - DNA, 13 bp, Homo sapiens
tagtgccccacct

SEQ ID NO: 843501 - DNA, 17 bp, Homo sapiens
tagtgccctccacagcc

SEQ ID NO: 843502 - DNA, 22 bp, Homo sapiens
tagtgccgaatgactatgtcca

SEQ ID NO: 843503 - DNA, 18 bp, Homo sapiens
tagtgcctaaaattgtat

SEQ ID NO: 843504 - DNA, 22 bp, Homo sapiens
tagtgcctgagagtatttaggc

SEQ ID NO: 843505 - DNA, 16 bp, Homo sapiens
tagtgccttctaaagg

SEQ ID NO: 843506 - DNA, 19 bp, Homo sapiens
tagtgccttctaaaggtgt

SEQ ID NO: 843507 - DNA, 11 bp, Homo sapiens
tagtgcctttt

SEQ ID NO: 843508 - DNA, 16 bp, Homo sapiens
tagtgcctttttcctt

SEQ ID NO: 843509 - DNA, 21 bp, Homo sapiens
tagtgcgatgtttcaggaggc

SEQ ID NO: 843510 - DNA, 14 bp, Homo sapiens
tagtgcggacaagt

SEQ ID NO: 843511 - DNA, 16 bp, Homo sapiens
tagtgctattctgtgt

SEQ ID NO: 843512 - DNA, 18 bp, Homo sapiens
tagtgctattctgtgttg

SEQ ID NO: 843513 - DNA, 12 bp, Homo sapiens
tagtgctgggat

SEQ ID NO: 843514 - DNA, 18 bp, Homo sapiens
tagtgctggtcagagaga

SEQ ID NO: 843515 - DNA, 18 bp, Homo sapiens
tagtgctggtcctaggtc

SEQ ID NO: 843516 - DNA, 16 bp, Homo sapiens
tagtgctgtgaaaaaa

SEQ ID NO: 843517 - DNA, 15 bp, Homo sapiens
tagtgcttaacattt

SEQ ID NO: 843518 - DNA, 22 bp, Homo sapiens
tagtgcttcagagtttgtgtgt

SEQ ID NO: 843519 - DNA, 16 bp, Homo sapiens
tagtggaagagcagcc

SEQ ID NO: 843520 - DNA, 22 bp, Homo sapiens
tagtggaccacttggaaataaa

SEQ ID NO: 843521 - DNA, 15 bp, Homo sapiens
tagtggatgttctga

SEQ ID NO: 843522 - DNA, 15 bp, Homo sapiens
tagtggctgttcatg

SEQ ID NO: 843523 - DNA, 21 bp, Homo sapiens
tagtggcttcttttgaactgt

SEQ ID NO: 843524 - DNA, 18 bp, Homo sapiens
tagtggggtctccctctc

SEQ ID NO: 843525 - DNA, 13 bp, Homo sapiens
tagtggtatgtct

SEQ ID NO: 843526 - DNA, 20 bp, Homo sapiens
tagtggtttatcagcaaaaa

SEQ ID NO: 843527 - DNA, 22 bp, Homo sapiens
tagtgtaaaataagaatgattt

SEQ ID NO: 843528 - DNA, 13 bp, Homo sapiens
tagtgtaagaact

SEQ ID NO: 843529 - DNA, 21 bp, Homo sapiens
tagtgtacctcctctcagtgt

SEQ ID NO: 843530 - DNA, 17 bp, Homo sapiens
tagtgtcacttacctag

SEQ ID NO: 843531 - DNA, 14 bp, Homo sapiens
tagtgtcccccctt

SEQ ID NO: 843532 - DNA, 16 bp, Homo sapiens
tagtgtccccccttga

SEQ ID NO: 843533 - DNA, 12 bp, Homo sapiens
tagtgtcctgcc

SEQ ID NO: 843534 - DNA, 23 bp, Homo sapiens
tagtgtctgggtttggcccaaga

SEQ ID NO: 843535 - DNA, 13 bp, Homo sapiens
tagtgtctgtcca

SEQ ID NO: 843536 - DNA, 11 bp, Homo sapiens
tagtgtgaaat

SEQ ID NO: 843537 - DNA, 22 bp, Homo sapiens
tagtgtgaatattaattagttt

SEQ ID NO: 843538 - DNA, 21 bp, Homo sapiens
tagtgtgacagtttccaaatt

SEQ ID NO: 843539 - DNA, 12 bp, Homo sapiens
tagtgtgtgtgc

SEQ ID NO: 843540 - DNA, 20 bp, Homo sapiens
tagtgtgtgtgcagagtcca

SEQ ID NO: 843541 - DNA, 16 bp, Homo sapiens
tagtgtgtgtgcatgt

SEQ ID NO: 843542 - DNA, 18 bp, Homo sapiens
tagtgtgtgtgcatgtgt

SEQ ID NO: 843543 - DNA, 18 bp, Homo sapiens
tagtgttaatgactcttt

SEQ ID NO: 843544 - DNA, 20 bp, Homo sapiens
tagtgttaatgactctttct

SEQ ID NO: 843545 - DNA, 14 bp, Homo sapiens
tagtgttattgcca

SEQ ID NO: 843546 - DNA, 15 bp, Homo sapiens
tagtgttcacaaact

SEQ ID NO: 843547 - DNA, 18 bp, Homo sapiens
tagtgttcacaaactgtg

SEQ ID NO: 843548 - DNA, 18 bp, Homo sapiens
tagtgttctgctcctgct

SEQ ID NO: 843549 - DNA, 24 bp, Homo sapiens
tagtgttctgctcctgcttttctg

SEQ ID NO: 843550 - DNA, 22 bp, Homo sapiens
tagtgttttcaattttaaacat

SEQ ID NO: 843551 - DNA, 15 bp, Homo sapiens
tagttaaaacacata

SEQ ID NO: 843552 - DNA, 23 bp, Homo sapiens
tagttaaaagactgcagctgctg

SEQ ID NO: 843553 - DNA, 17 bp, Homo sapiens
tagttaaataactgtgt

SEQ ID NO: 843554 - DNA, 19 bp, Homo sapiens
tagttaacctagaagtatt

SEQ ID NO: 843555 - DNA, 16 bp, Homo sapiens
tagttaaggagcctaa

SEQ ID NO: 843556 - DNA, 13 bp, Homo sapiens
tagttaatttatt

SEQ ID NO: 843557 - DNA, 20 bp, Homo sapiens
tagttacattaatgcccagc

SEQ ID NO: 843558 - DNA, 12 bp, Homo sapiens
tagttaccttat

SEQ ID NO: 843559 - DNA, 14 bp, Homo sapiens
tagttaccttatag

SEQ ID NO: 843560 - DNA, 15 bp, Homo sapiens
tataatctgaagata

SEQ ID NO: 843561 - DNA, 23 bp, Homo sapiens
tataatctgtcaaaacactgtgg

SEQ ID NO: 843562 - DNA, 17 bp, Homo sapiens
tataatcttataattgt

SEQ ID NO: 843563 - DNA, 20 bp, Homo sapiens
tataatcttccatacttctt

SEQ ID NO: 843564 - DNA, 18 bp, Homo sapiens
tataatcttggcttctta

SEQ ID NO: 843565 - DNA, 20 bp, Homo sapiens
tataatcttggcttcttaaa

SEQ ID NO: 843566 - DNA, 16 bp, Homo sapiens
tataatgaataaatca

SEQ ID NO: 843567 - DNA, 18 bp, Homo sapiens
tataatgaatgaaacatt

SEQ ID NO: 843568 - DNA, 12 bp, Homo sapiens
tataatgctttc

SEQ ID NO: 843569 - DNA, 13 bp, Homo sapiens
tataatgctttct

SEQ ID NO: 843570 - DNA, 19 bp, Homo sapiens
tataatgtaagctctactg

SEQ ID NO: 843571 - DNA, 14 bp, Homo sapiens
tataatgtatttga

SEQ ID NO: 843572 - DNA, 15 bp, Homo sapiens
tataatgtatttgaa

SEQ ID NO: 843573 - DNA, 20 bp, Homo sapiens
tataatgtatttgaaaatta

SEQ ID NO: 843574 - DNA, 21 bp, Homo sapiens
tataatgtattttcagctcaa

SEQ ID NO: 843575 - DNA, 23 bp, Homo sapiens
tataatgtattttcagctcaatt

SEQ ID NO: 843576 - DNA, 15 bp, Homo sapiens
tataatgtgaaatgt

SEQ ID NO: 843577 - DNA, 19 bp, Homo sapiens
tataatgtgaaatgtaact

SEQ ID NO: 843578 - DNA, 21 bp, Homo sapiens
tataatgtgtgctttattgaa

SEQ ID NO: 843579 - DNA, 15 bp, Homo sapiens
tataatgttattcat

SEQ ID NO: 843580 - DNA, 13 bp, Homo sapiens
tataatgtttaaa

SEQ ID NO: 843581 - DNA, 19 bp, Homo sapiens
tataattaaagatgccata

SEQ ID NO: 843582 - DNA, 21 bp, Homo sapiens
tataattcctatatcctgtga

SEQ ID NO: 843583 - DNA, 12 bp, Homo sapiens
tataattctgta

SEQ ID NO: 843584 - DNA, 13 bp, Homo sapiens
tataattctgtaa

SEQ ID NO: 843585 - DNA, 14 bp, Homo sapiens
tataattctgtaaa

SEQ ID NO: 843586 - DNA, 14 bp, Homo sapiens
tataattggaagtg

SEQ ID NO: 843587 - DNA, 20 bp, Homo sapiens
tataattggtgctatttgaa

SEQ ID NO: 843588 - DNA, 19 bp, Homo sapiens
tataattgttgatattttc

SEQ ID NO: 843589 - DNA, 22 bp, Homo sapiens
tataattgttttatctgaattt

SEQ ID NO: 843590 - DNA, 13 bp, Homo sapiens
tataatttaaatg

SEQ ID NO: 843591 - DNA, 19 bp, Homo sapiens
tataatttaataaaaagga

SEQ ID NO: 843592 - DNA, 17 bp, Homo sapiens
tataatttacctaagat

SEQ ID NO: 843593 - DNA, 21 bp, Homo sapiens
tataatttccatttacttaag

SEQ ID NO: 843594 - DNA, 13 bp, Homo sapiens
tataatttcctca

SEQ ID NO: 843595 - DNA, 14 bp, Homo sapiens
tataatttgacttg

SEQ ID NO: 843596 - DNA, 17 bp, Homo sapiens
tataattttatgaatgt

SEQ ID NO: 843597 - DNA, 22 bp, Homo sapiens
tataattttatgaatgtctttg

SEQ ID NO: 843598 - DNA, 15 bp, Homo sapiens
tataattttttaaag

SEQ ID NO: 843599 - DNA, 19 bp, Homo sapiens
tataattttttagagagct

SEQ ID NO: 843600 - DNA, 20 bp, Homo sapiens
tataatttttttattactga

SEQ ID NO: 843601 - DNA, 21 bp, Homo sapiens
tataatttttttcaatattta

SEQ ID NO: 843602 - DNA, 13 bp, Homo sapiens
tatacaaaacttt

SEQ ID NO: 843603 - DNA, 14 bp, Homo sapiens
tatacaaattagaa

SEQ ID NO: 843604 - DNA, 18 bp, Homo sapiens
tatacaactgtaaagcaa

SEQ ID NO: 843605 - DNA, 21 bp, Homo sapiens
tatacaatggaataaattatg

SEQ ID NO: 843606 - DNA, 13 bp, Homo sapiens
tatacaatgttct

SEQ ID NO: 843607 - DNA, 17 bp, Homo sapiens
tatacacaactttgcaa

SEQ ID NO: 843608 - DNA, 22 bp, Homo sapiens
tatacacacatatacatatata

SEQ ID NO: 843609 - DNA, 10 bp, Homo sapiens
tatacagcat

SEQ ID NO: 843610 - DNA, 20 bp, Homo sapiens
tatacagctgtattgtctga

SEQ ID NO: 843611 - DNA, 20 bp, Homo sapiens
tatacagtaactttatgtgt

SEQ ID NO: 843612 - DNA, 21 bp, Homo sapiens
tatacagtaactttatgtgta

SEQ ID NO: 843613 - DNA, 18 bp, Homo sapiens
tatacagtgcagagcctt

SEQ ID NO: 843614 - DNA, 14 bp, Homo sapiens
tatacatatatata

SEQ ID NO: 843615 - DNA, 19 bp, Homo sapiens
tatacatatgagaatatac

SEQ ID NO: 843616 - DNA, 14 bp, Homo sapiens
tatacatcaccttt

SEQ ID NO: 843617 - DNA, 22 bp, Homo sapiens
tatacatcacctttttgacttt

SEQ ID NO: 843618 - DNA, 21 bp, Homo sapiens
tatacatgaagaatagaaaca

SEQ ID NO: 843619 - DNA, 11 bp, Homo sapiens
tatacatgcca

SEQ ID NO: 843620 - DNA, 13 bp, Homo sapiens
tatacatgccagt

SEQ ID NO: 843621 - DNA, 13 bp, Homo sapiens
tatacatggaatc

SEQ ID NO: 843622 - DNA, 14 bp, Homo sapiens
tatacatggaatcg

SEQ ID NO: 843623 - DNA, 12 bp, Homo sapiens
tatacattgctt

SEQ ID NO: 843624 - DNA, 14 bp, Homo sapiens
tatacattgtgtga

SEQ ID NO: 843625 - DNA, 15 bp, Homo sapiens
tatacattgtgtgaa

SEQ ID NO: 843626 - DNA, 14 bp, Homo sapiens
tatacatttgataa

SEQ ID NO: 843627 - DNA, 19 bp, Homo sapiens
tatacattttctaaataaa

SEQ ID NO: 843628 - DNA, 21 bp, Homo sapiens
tatacattttgttatagaata

SEQ ID NO: 843629 - DNA, 16 bp, Homo sapiens
tataccaactaaaacc

SEQ ID NO: 843630 - DNA, 18 bp, Homo sapiens
tataccaatgtgttttct

SEQ ID NO: 843631 - DNA, 17 bp, Homo sapiens
tataccacctgtacata

SEQ ID NO: 843632 - DNA, 18 bp, Homo sapiens
tataccagatgaacattt

SEQ ID NO: 843633 - DNA, 20 bp, Homo sapiens
tataccatatgtctgcttct

SEQ ID NO: 843634 - DNA, 18 bp, Homo sapiens
tataccatgtgtgctaat

SEQ ID NO: 843635 - DNA, 14 bp, Homo sapiens
tataccatttcctc

SEQ ID NO: 843636 - DNA, 18 bp, Homo sapiens
tataccatttcctcagct

SEQ ID NO: 843637 - DNA, 16 bp, Homo sapiens
tataccccaaattgtg

SEQ ID NO: 843638 - DNA, 22 bp, Homo sapiens
tataccccaaattgtgtatata

SEQ ID NO: 843639 - DNA, 18 bp, Homo sapiens
tatacctgccttttaagt

SEQ ID NO: 843640 - DNA, 12 bp, Homo sapiens
tatacctggctt

SEQ ID NO: 843641 - DNA, 13 bp, Homo sapiens
tatacctggcttt

SEQ ID NO: 843642 - DNA, 21 bp, Homo sapiens
tatacctggctttttaaaata

SEQ ID NO: 843643 - DNA, 20 bp, Homo sapiens
tataccttactgacacattg

SEQ ID NO: 843644 - DNA, 20 bp, Homo sapiens
tataccttctgacagcccaa

SEQ ID NO: 843645 - DNA, 14 bp, Homo sapiens
tatacctttgaaat

SEQ ID NO: 843646 - DNA, 17 bp, Homo sapiens
tatacgaaataattgtt

SEQ ID NO: 843647 - DNA, 19 bp, Homo sapiens
tatacgagtgaccgattat

SEQ ID NO: 843648 - DNA, 18 bp, Homo sapiens
tatacgataaataacttt

SEQ ID NO: 843649 - DNA, 15 bp, Homo sapiens
tatacgcttttcttt

SEQ ID NO: 843650 - DNA, 19 bp, Homo sapiens
tatacgtataaatatcagt

SEQ ID NO: 843651 - DNA, 22 bp, Homo sapiens
tatacgtgaaaattatttgaaa

SEQ ID NO: 843652 - DNA, 17 bp, Homo sapiens
tatacgtttctgtggag

SEQ ID NO: 843653 - DNA, 23 bp, Homo sapiens
tatactaccatagtgagccatga

SEQ ID NO: 843654 - DNA, 20 bp, Homo sapiens
tatactagggagccatttga

SEQ ID NO: 843655 - DNA, 22 bp, Homo sapiens
tatactagggagccatttgaga

SEQ ID NO: 843656 - DNA, 17 bp, Homo sapiens
tatactatagtaccagt

SEQ ID NO: 843657 - DNA, 20 bp, Homo sapiens
tatactatagtaccagtagg

SEQ ID NO: 843658 - DNA, 15 bp, Homo sapiens
tatactcaagtttca

SEQ ID NO: 843659 - DNA, 23 bp, Homo sapiens
tatactccctgcccttccccctg

SEQ ID NO: 843660 - DNA, 17 bp, Homo sapiens
tatactcttttttcatg

SEQ ID NO: 843661 - DNA, 12 bp, Homo sapiens
tatactgaagga

SEQ ID NO: 843662 - DNA, 22 bp, Homo sapiens
tatactgaaggaaaaacacaag

SEQ ID NO: 843663 - DNA, 16 bp, Homo sapiens
tatactgaagtctttt

SEQ ID NO: 843664 - DNA, 18 bp, Homo sapiens
tatactggaaatgtaaaa

SEQ ID NO: 843665 - DNA, 18 bp, Homo sapiens
tatactgggttcttgttt

SEQ ID NO: 843666 - DNA, 16 bp, Homo sapiens
tatactgtaaaagtta

SEQ ID NO: 843667 - DNA, 19 bp, Homo sapiens
tatactgtaaaagttataa

SEQ ID NO: 843668 - DNA, 15 bp, Homo sapiens
tatactgtacaataa

SEQ ID NO: 843669 - DNA, 17 bp, Homo sapiens
tatactgtacaataaaa

SEQ ID NO: 843670 - DNA, 17 bp, Homo sapiens
tatactgtacatgctat

SEQ ID NO: 843671 - DNA, 13 bp, Homo sapiens
tatacttaaaatg

SEQ ID NO: 843672 - DNA, 18 bp, Homo sapiens
tatacttattttattttt

SEQ ID NO: 843673 - DNA, 21 bp, Homo sapiens
tatacttccttacttttaagg

SEQ ID NO: 843674 - DNA, 20 bp, Homo sapiens
tatactttatataaggcatt

SEQ ID NO: 843675 - DNA, 13 bp, Homo sapiens
tatacttttacaa

SEQ ID NO: 843676 - DNA, 19 bp, Homo sapiens
tatacttttcccctgttaa

SEQ ID NO: 843677 - DNA, 11 bp, Homo sapiens
tatactttttt

SEQ ID NO: 843678 - DNA, 21 bp, Homo sapiens
tatacttttttcttatttaac

SEQ ID NO: 843679 - DNA, 17 bp, Homo sapiens
tatactttttttgttat

SEQ ID NO: 843680 - DNA, 18 bp, Homo sapiens
tatagaaaacaaaggagc

SEQ ID NO: 843681 - DNA, 19 bp, Homo sapiens
tatagaaagctgtttattt

SEQ ID NO: 843682 - DNA, 15 bp, Homo sapiens
tatatatatgtatat

SEQ ID NO: 843683 - DNA, 11 bp, Homo sapiens
tatatatattt

SEQ ID NO: 843684 - DNA, 15 bp, Homo sapiens
tatatatatttgtaa

SEQ ID NO: 843685 - DNA, 16 bp, Homo sapiens
tatatatctattattc

SEQ ID NO: 843686 - DNA, 19 bp, Homo sapiens
tatatatgatgtggacata

SEQ ID NO: 843687 - DNA, 19 bp, Homo sapiens
tatatatggatcagaggag

SEQ ID NO: 843688 - DNA, 14 bp, Homo sapiens
tatatatggcatat

SEQ ID NO: 843689 - DNA, 14 bp, Homo sapiens
tatatatgtacagt

SEQ ID NO: 843690 - DNA, 19 bp, Homo sapiens
tatatatgtacagttatct

SEQ ID NO: 843691 - DNA, 14 bp, Homo sapiens
tatatatgtatatg

SEQ ID NO: 843692 - DNA, 22 bp, Homo sapiens
tatatatgtatctacaatacat

SEQ ID NO: 843693 - DNA, 13 bp, Homo sapiens
tatatatgtcaat

SEQ ID NO: 843694 - DNA, 14 bp, Homo sapiens
tatatatgtgtatg

SEQ ID NO: 843695 - DNA, 14 bp, Homo sapiens
tatatatgtgtgtg

SEQ ID NO: 843696 - DNA, 14 bp, Homo sapiens
tatatattataaaa

SEQ ID NO: 843697 - DNA, 17 bp, Homo sapiens
tatatattcttataaaa

SEQ ID NO: 843698 - DNA, 15 bp, Homo sapiens
tatatattgtaaaga

SEQ ID NO: 843699 - DNA, 15 bp, Homo sapiens
tatatatttacagaa

SEQ ID NO: 843700 - DNA, 17 bp, Homo sapiens
tatatatttacagaaga

SEQ ID NO: 843701 - DNA, 13 bp, Homo sapiens
tatatatttataa

SEQ ID NO: 843702 - DNA, 15 bp, Homo sapiens
tatatatttataact

SEQ ID NO: 843703 - DNA, 13 bp, Homo sapiens
tatatatttctaa

SEQ ID NO: 843704 - DNA, 19 bp, Homo sapiens
tatatatttctaactatat

SEQ ID NO: 843705 - DNA, 19 bp, Homo sapiens
tatatatttctttaaacct

SEQ ID NO: 843706 - DNA, 16 bp, Homo sapiens
tatatattttaagcct

SEQ ID NO: 843707 - DNA, 17 bp, Homo sapiens
tatatattttatatgtt

SEQ ID NO: 843708 - DNA, 20 bp, Homo sapiens
tatatatttttcaaatagat

SEQ ID NO: 843709 - DNA, 22 bp, Homo sapiens
tatatatttttcaaatagattt

SEQ ID NO: 843710 - DNA, 19 bp, Homo sapiens
tatatatttttctgagatt

SEQ ID NO: 843711 - DNA, 15 bp, Homo sapiens
tatatcaaacatgca

SEQ ID NO: 843712 - DNA, 13 bp, Homo sapiens
tatatcaaatgcc

SEQ ID NO: 843713 - DNA, 18 bp, Homo sapiens
tatatcagtttcatgaaa

SEQ ID NO: 843714 - DNA, 17 bp, Homo sapiens
tatatcatacagttttc

SEQ ID NO: 843715 - DNA, 14 bp, Homo sapiens
tatatcatatgtat

SEQ ID NO: 843716 - DNA, 15 bp, Homo sapiens
tatatcatatgtata

SEQ ID NO: 843717 - DNA, 17 bp, Homo sapiens
tatatcatgaagccttg

SEQ ID NO: 843718 - DNA, 13 bp, Homo sapiens
tatatcatgcaaa

SEQ ID NO: 843719 - DNA, 15 bp, Homo sapiens
tatatcattctacag

SEQ ID NO: 843720 - DNA, 17 bp, Homo sapiens
tatatccagttcctgct

SEQ ID NO: 843721 - DNA, 19 bp, Homo sapiens
tatatccagttcctgctct

SEQ ID NO: 843722 - DNA, 16 bp, Homo sapiens
tatatccatgtactgt

SEQ ID NO: 843723 - DNA, 17 bp, Homo sapiens
tatatccatgtactgta

SEQ ID NO: 843724 - DNA, 19 bp, Homo sapiens
tatatccatgtactgtagt

SEQ ID NO: 843725 - DNA, 21 bp, Homo sapiens
tatatcctgatgctggatggt

SEQ ID NO: 843726 - DNA, 15 bp, Homo sapiens
tatatcctgtgactg

SEQ ID NO: 843727 - DNA, 17 bp, Homo sapiens
tatatcctgtgactgtc

SEQ ID NO: 843728 - DNA, 18 bp, Homo sapiens
tatatctaattatttcca

SEQ ID NO: 843729 - DNA, 17 bp, Homo sapiens
tatatctacacatacag

SEQ ID NO: 843730 - DNA, 18 bp, Homo sapiens
tatatctacacatacaga

SEQ ID NO: 843731 - DNA, 14 bp, Homo sapiens
tatatctatctatt

SEQ ID NO: 843732 - DNA, 19 bp, Homo sapiens
tatatctatctatttgagg

SEQ ID NO: 843733 - DNA, 15 bp, Homo sapiens
tatatctattattca

SEQ ID NO: 843734 - DNA, 14 bp, Homo sapiens
tatatctctatttg

SEQ ID NO: 843735 - DNA, 16 bp, Homo sapiens
tatatctgaaccaaga

SEQ ID NO: 843736 - DNA, 13 bp, Homo sapiens
tatatctgataaa

SEQ ID NO: 843737 - DNA, 20 bp, Homo sapiens
tatatctgataaaattgtga

SEQ ID NO: 843738 - DNA, 14 bp, Homo sapiens
tatatctgtttgta

SEQ ID NO: 843739 - DNA, 15 bp, Homo sapiens
tatatctgtttgtat

SEQ ID NO: 843740 - DNA, 18 bp, Homo sapiens
tatatctgtttgtatatt

SEQ ID NO: 843741 - DNA, 16 bp, Homo sapiens
tatatcttataactgt

SEQ ID NO: 843742 - DNA, 17 bp, Homo sapiens
tatatcttataactgtt

SEQ ID NO: 843743 - DNA, 18 bp, Homo sapiens
tatatcttcccatttaac

SEQ ID NO: 843744 - DNA, 20 bp, Homo sapiens
tatatcttttggttattcta

SEQ ID NO: 843745 - DNA, 14 bp, Homo sapiens
tatatgaaaacctg

SEQ ID NO: 843746 - DNA, 18 bp, Homo sapiens
tatatgaagaaaatcact

SEQ ID NO: 843747 - DNA, 19 bp, Homo sapiens
tatatgaagaaaatcactt

SEQ ID NO: 843748 - DNA, 19 bp, Homo sapiens
tatatgaccagaagccttg

SEQ ID NO: 843749 - DNA, 18 bp, Homo sapiens
tatatgagactttatgtg

SEQ ID NO: 843750 - DNA, 19 bp, Homo sapiens
tatatgagagaatcacaca

SEQ ID NO: 843751 - DNA, 13 bp, Homo sapiens
tatatgatctaat

SEQ ID NO: 843752 - DNA, 20 bp, Homo sapiens
tatatgatgtggacatatgt

SEQ ID NO: 843753 - DNA, 16 bp, Homo sapiens
tatatgatttatagtt

SEQ ID NO: 843754 - DNA, 18 bp, Homo sapiens
tatatgcacccctggaac

SEQ ID NO: 843755 - DNA, 21 bp, Homo sapiens
tatatgcacttataattttcc

SEQ ID NO: 843756 - DNA, 17 bp, Homo sapiens
tatatgccaagctaatt

SEQ ID NO: 843757 - DNA, 16 bp, Homo sapiens
tatatgccatgatgga

SEQ ID NO: 843758 - DNA, 20 bp, Homo sapiens
tatatgctctgcatgttaca

SEQ ID NO: 843759 - DNA, 14 bp, Homo sapiens
tatatgcttactga

SEQ ID NO: 843760 - DNA, 17 bp, Homo sapiens
tatatgcttactgatat

SEQ ID NO: 843761 - DNA, 18 bp, Homo sapiens
tatatgcttcacatagca

SEQ ID NO: 843762 - DNA, 12 bp, Homo sapiens
tatatggaccta

SEQ ID NO: 843763 - DNA, 16 bp, Homo sapiens
tatatggatgattcag

SEQ ID NO: 843764 - DNA, 22 bp, Homo sapiens
tatatggatgattcagaaattg

SEQ ID NO: 843765 - DNA, 20 bp, Homo sapiens
tatatggcagagttgtaaat

SEQ ID NO: 843766 - DNA, 18 bp, Homo sapiens
tatatggttctccaagaa

SEQ ID NO: 843767 - DNA, 23 bp, Homo sapiens
tatatggttctccaagaaactga

SEQ ID NO: 843768 - DNA, 15 bp, Homo sapiens
tatatgtaaatgtgt

SEQ ID NO: 843769 - DNA, 19 bp, Homo sapiens
tatatgtacttgtcaaaga

SEQ ID NO: 843770 - DNA, 15 bp, Homo sapiens
tatatgtagatgtat

SEQ ID NO: 843771 - DNA, 11 bp, Homo sapiens
tatatgtatgt

SEQ ID NO: 843772 - DNA, 16 bp, Homo sapiens
tatatgtattatttat

SEQ ID NO: 843773 - DNA, 15 bp, Homo sapiens
tatatgtattccctt

SEQ ID NO: 843774 - DNA, 20 bp, Homo sapiens
tatatgtattcccttgtatt

SEQ ID NO: 843775 - DNA, 16 bp, Homo sapiens
tatatgtatttaagat

SEQ ID NO: 843776 - DNA, 12 bp, Homo sapiens
tatatgtatttt

SEQ ID NO: 843777 - DNA, 14 bp, Homo sapiens
tatatgtcattatt

SEQ ID NO: 843778 - DNA, 16 bp, Homo sapiens
tatatgtctatataca

SEQ ID NO: 843779 - DNA, 14 bp, Homo sapiens
tatatgtgtataca

SEQ ID NO: 843780 - DNA, 15 bp, Homo sapiens
tatatgtgtatacat

SEQ ID NO: 843781 - DNA, 14 bp, Homo sapiens
tatatgtgtatgta

SEQ ID NO: 843782 - DNA, 14 bp, Homo sapiens
tatatgtgtgccta

SEQ ID NO: 843783 - DNA, 13 bp, Homo sapiens
tatatgtgtgtgt

SEQ ID NO: 843784 - DNA, 19 bp, Homo sapiens
tatatgtgtgtgtatgttt

SEQ ID NO: 843785 - DNA, 15 bp, Homo sapiens
tatatgtgtgtttaa

SEQ ID NO: 843786 - DNA, 19 bp, Homo sapiens
tatatgtgtgtttaaataa

SEQ ID NO: 843787 - DNA, 14 bp, Homo sapiens
tatatgttctgcaa

SEQ ID NO: 843788 - DNA, 17 bp, Homo sapiens
tatatgttctgcaagaa

SEQ ID NO: 843789 - DNA, 20 bp, Homo sapiens
tatatgttctgcaagaatta

SEQ ID NO: 843790 - DNA, 14 bp, Homo sapiens
tatatgtttatata

SEQ ID NO: 843791 - DNA, 17 bp, Homo sapiens
tatattaaaaatataaa

SEQ ID NO: 843792 - DNA, 14 bp, Homo sapiens
tatattaaaatagc

SEQ ID NO: 843793 - DNA, 22 bp, Homo sapiens
tatattaaaattccaaattcat

SEQ ID NO: 843794 - DNA, 12 bp, Homo sapiens
tatattaaatga

SEQ ID NO: 843795 - DNA, 20 bp, Homo sapiens
tatattaagtgtgccaaatc

SEQ ID NO: 843796 - DNA, 13 bp, Homo sapiens
tatattaatagta

SEQ ID NO: 843797 - DNA, 12 bp, Homo sapiens
tatattacaatg

SEQ ID NO: 843798 - DNA, 13 bp, Homo sapiens
tatattacaatga

SEQ ID NO: 843799 - DNA, 17 bp, Homo sapiens
tatattacaatgatcac

SEQ ID NO: 843800 - DNA, 17 bp, Homo sapiens
tatattacagatatttg

SEQ ID NO: 843801 - DNA, 18 bp, Homo sapiens
tatattactactcctttg

SEQ ID NO: 843802 - DNA, 14 bp, Homo sapiens
tatattactgattt

SEQ ID NO: 843803 - DNA, 15 bp, Homo sapiens
tatattactgattta

SEQ ID NO: 843804 - DNA, 15 bp, Homo sapiens
tatattacttttgta

SEQ ID NO: 843805 - DNA, 23 bp, Homo sapiens
tatattaggatctgcaaacaatg

SEQ ID NO: 843806 - DNA, 20 bp, Homo sapiens
tatccccatctccctgcctg

SEQ ID NO: 843807 - DNA, 21 bp, Homo sapiens
tatccccatctccctgcctgg

SEQ ID NO: 843808 - DNA, 15 bp, Homo sapiens
tatccccccatcttg

SEQ ID NO: 843809 - DNA, 20 bp, Homo sapiens
tatccccccatcttgcttcc

SEQ ID NO: 843810 - DNA, 15 bp, Homo sapiens
tatcccccccagcct

SEQ ID NO: 843811 - DNA, 18 bp, Homo sapiens
tatcccccccagcctggc

SEQ ID NO: 843812 - DNA, 19 bp, Homo sapiens
tatcccccccctgtatagt

SEQ ID NO: 843813 - DNA, 21 bp, Homo sapiens
tatcccccccctgtatagtta

SEQ ID NO: 843814 - DNA, 11 bp, Homo sapiens
tatccccctta

SEQ ID NO: 843815 - DNA, 12 bp, Homo sapiens
tatcccctgcct

SEQ ID NO: 843816 - DNA, 20 bp, Homo sapiens
tatcccctgcctcctgccac

SEQ ID NO: 843817 - DNA, 19 bp, Homo sapiens
tatccctactgtaatttgt

SEQ ID NO: 843818 - DNA, 14 bp, Homo sapiens
tatcccttcctttt

SEQ ID NO: 843819 - DNA, 19 bp, Homo sapiens
tatcctacaacaagagttt

SEQ ID NO: 843820 - DNA, 20 bp, Homo sapiens
tatcctactgagcatttgca

SEQ ID NO: 843821 - DNA, 18 bp, Homo sapiens
tatcctcctgttctgaaa

SEQ ID NO: 843822 - DNA, 22 bp, Homo sapiens
tatcctcctgttctgaaacctt

SEQ ID NO: 843823 - DNA, 18 bp, Homo sapiens
tatcctctctctcttcta

SEQ ID NO: 843824 - DNA, 14 bp, Homo sapiens
tatcctctcttcct

SEQ ID NO: 843825 - DNA, 11 bp, Homo sapiens
tatcctctgat

SEQ ID NO: 843826 - DNA, 14 bp, Homo sapiens
tatcctctgatctc

SEQ ID NO: 843827 - DNA, 20 bp, Homo sapiens
tatcctctgatctccatggc

SEQ ID NO: 843828 - DNA, 14 bp, Homo sapiens
tatcctgaaatttc

SEQ ID NO: 843829 - DNA, 13 bp, Homo sapiens
tatcctgagccat

SEQ ID NO: 843830 - DNA, 16 bp, Homo sapiens
tatcctgattccaaat

SEQ ID NO: 843831 - DNA, 20 bp, Homo sapiens
tatcctgcctcagcccgcca

SEQ ID NO: 843832 - DNA, 19 bp, Homo sapiens
tatcctgctagctgtagaa

SEQ ID NO: 843833 - DNA, 20 bp, Homo sapiens
tatcctgctagctgtagaaa

SEQ ID NO: 843834 - DNA, 13 bp, Homo sapiens
tatcctgctgaaa

SEQ ID NO: 843835 - DNA, 21 bp, Homo sapiens
tatcctgctgaaagtcctgct

SEQ ID NO: 843836 - DNA, 12 bp, Homo sapiens
tatcctgtaata

SEQ ID NO: 843837 - DNA, 18 bp, Homo sapiens
tatcctgtaataaagctc

SEQ ID NO: 843838 - DNA, 17 bp, Homo sapiens
tatcctgtattcttgtt

SEQ ID NO: 843839 - DNA, 14 bp, Homo sapiens
tatcctgtgactgt

SEQ ID NO: 843840 - DNA, 17 bp, Homo sapiens
tatcctgtgactgtctc

SEQ ID NO: 843841 - DNA, 22 bp, Homo sapiens
tatccttaggaaaatgcttctg

SEQ ID NO: 843842 - DNA, 22 bp, Homo sapiens
tatccttatgccacccccgctg

SEQ ID NO: 843843 - DNA, 13 bp, Homo sapiens
tatccttccttca

SEQ ID NO: 843844 - DNA, 18 bp, Homo sapiens
tatccttgcacctcagcc

SEQ ID NO: 843845 - DNA, 16 bp, Homo sapiens
tatccttggagagcag

SEQ ID NO: 843846 - DNA, 19 bp, Homo sapiens
tatccttgggggctcccag

SEQ ID NO: 843847 - DNA, 22 bp, Homo sapiens
tatcctttattttattgaaatg

SEQ ID NO: 843848 - DNA, 19 bp, Homo sapiens
tatcctttcattaggcaaa

SEQ ID NO: 843849 - DNA, 21 bp, Homo sapiens
tatcctttgtgagcctatgat

SEQ ID NO: 843850 - DNA, 13 bp, Homo sapiens
tatcgaaatttgt

SEQ ID NO: 843851 - DNA, 20 bp, Homo sapiens
tatcgaatatagttctgtgt

SEQ ID NO: 843852 - DNA, 15 bp, Homo sapiens
tatcgatataaattg

SEQ ID NO: 843853 - DNA, 14 bp, Homo sapiens
tatcgctcctattg

SEQ ID NO: 843854 - DNA, 16 bp, Homo sapiens
tatcgggaacagtgtt

SEQ ID NO: 843855 - DNA, 14 bp, Homo sapiens
tatcgtgaaatcct

SEQ ID NO: 843856 - DNA, 14 bp, Homo sapiens
tatcgttactggca

SEQ ID NO: 843857 - DNA, 14 bp, Homo sapiens
tatctaaaagaaat

SEQ ID NO: 843858 - DNA, 22 bp, Homo sapiens
tatctaaaggatggaaaaataa

SEQ ID NO: 843859 - DNA, 21 bp, Homo sapiens
tatctaaatgaatgagccaaa

SEQ ID NO: 843860 - DNA, 15 bp, Homo sapiens
tatctaagaataata

SEQ ID NO: 843861 - DNA, 23 bp, Homo sapiens
tatctaagttaatttaaagttgt

SEQ ID NO: 843862 - DNA, 15 bp, Homo sapiens
tatctaatacaaaat

SEQ ID NO: 843863 - DNA, 20 bp, Homo sapiens
tatctaatatatatgaataa

SEQ ID NO: 843864 - DNA, 15 bp, Homo sapiens
tatctaattatttcc

SEQ ID NO: 843865 - DNA, 15 bp, Homo sapiens
tatctacaaaaattt

SEQ ID NO: 843866 - DNA, 15 bp, Homo sapiens
tatctacctggaaac

SEQ ID NO: 843867 - DNA, 16 bp, Homo sapiens
tatctacctggaaaca

SEQ ID NO: 843868 - DNA, 22 bp, Homo sapiens
tatctacctgttctgtagcttt

SEQ ID NO: 843869 - DNA, 17 bp, Homo sapiens
tatctacttccaaacta

SEQ ID NO: 843870 - DNA, 17 bp, Homo sapiens
tatctagaaagaaaaga

SEQ ID NO: 843871 - DNA, 18 bp, Homo sapiens
tatctagaaagaaaagac

SEQ ID NO: 843872 - DNA, 21 bp, Homo sapiens
tatctagaactatcattttta

SEQ ID NO: 843873 - DNA, 16 bp, Homo sapiens
tatctagatactgtat

SEQ ID NO: 843874 - DNA, 17 bp, Homo sapiens
tatctagcagtaaaaga

SEQ ID NO: 843875 - DNA, 18 bp, Homo sapiens
tatctaggcatttcatta

SEQ ID NO: 843876 - DNA, 23 bp, Homo sapiens
tatctaggcatttcattatgctt

SEQ ID NO: 843877 - DNA, 14 bp, Homo sapiens
tatctagtgcagct

SEQ ID NO: 843878 - DNA, 18 bp, Homo sapiens
tatctatacatatcttta

SEQ ID NO: 843879 - DNA, 15 bp, Homo sapiens
tatctatacctgcct

SEQ ID NO: 843880 - DNA, 23 bp, Homo sapiens
tatctatacctgccttttaagtt

SEQ ID NO: 843881 - DNA, 13 bp, Homo sapiens
tatctatataaaa

SEQ ID NO: 843882 - DNA, 18 bp, Homo sapiens
tatctatataaaataact

SEQ ID NO: 843883 - DNA, 17 bp, Homo sapiens
tatctatggaaatgtga

SEQ ID NO: 843884 - DNA, 19 bp, Homo sapiens
tatctatggccctgcaaaa

SEQ ID NO: 843885 - DNA, 17 bp, Homo sapiens
tatctattaatatatgt

SEQ ID NO: 843886 - DNA, 19 bp, Homo sapiens
tatctattaatatatgtat

SEQ ID NO: 843887 - DNA, 12 bp, Homo sapiens
tatctatttgag

SEQ ID NO: 843888 - DNA, 18 bp, Homo sapiens
tatctatttgtacaattt

SEQ ID NO: 843889 - DNA, 20 bp, Homo sapiens
tatctatttttttttctttt

SEQ ID NO: 843890 - DNA, 23 bp, Homo sapiens
tatctcaactttggttcctgtga

SEQ ID NO: 843891 - DNA, 13 bp, Homo sapiens
tatctcacttcca

SEQ ID NO: 843892 - DNA, 10 bp, Homo sapiens
tatctcagaa

SEQ ID NO: 843893 - DNA, 20 bp, Homo sapiens
tatctcagaaagtgcctgac

SEQ ID NO: 843894 - DNA, 16 bp, Homo sapiens
tatctcagccatccgc

SEQ ID NO: 843895 - DNA, 18 bp, Homo sapiens
tatctcagggagggaagg

SEQ ID NO: 843896 - DNA, 13 bp, Homo sapiens
tatctcagggcct

SEQ ID NO: 843897 - DNA, 15 bp, Homo sapiens
tatctcagggcctgg

SEQ ID NO: 843898 - DNA, 21 bp, Homo sapiens
tatctcagtctaaggtctcat

SEQ ID NO: 843899 - DNA, 17 bp, Homo sapiens
tatctcatactgtctgg

SEQ ID NO: 843900 - DNA, 20 bp, Homo sapiens
tatctcatactgtctgggat

SEQ ID NO: 843901 - DNA, 14 bp, Homo sapiens
tatctcatcctttc

SEQ ID NO: 843902 - DNA, 15 bp, Homo sapiens
tatctcatcctttcc

SEQ ID NO: 843903 - DNA, 18 bp, Homo sapiens
tatctcatcctttcctct

SEQ ID NO: 843904 - DNA, 16 bp, Homo sapiens
tatctccagcggccct

SEQ ID NO: 843905 - DNA, 23 bp, Homo sapiens
tatctccaggattgaagagcatt

SEQ ID NO: 843906 - DNA, 17 bp, Homo sapiens
tatctccatggccctgt

SEQ ID NO: 843907 - DNA, 22 bp, Homo sapiens
tatctccatggccctgtcccag

SEQ ID NO: 843908 - DNA, 13 bp, Homo sapiens
tatctcctcctat

SEQ ID NO: 843909 - DNA, 21 bp, Homo sapiens
tatctcctgacagaaggtgcc

SEQ ID NO: 843910 - DNA, 13 bp, Homo sapiens
tatctctaaaata

SEQ ID NO: 843911 - DNA, 21 bp, Homo sapiens
tatctctagatgcaaatacat

SEQ ID NO: 843912 - DNA, 17 bp, Homo sapiens
tatctctatttaatatt

SEQ ID NO: 843913 - DNA, 16 bp, Homo sapiens
tatctctatttgagaa

SEQ ID NO: 843914 - DNA, 17 bp, Homo sapiens
tatctctatttgagaat

SEQ ID NO: 843915 - DNA, 15 bp, Homo sapiens
tatctctgaagcatg

SEQ ID NO: 843916 - DNA, 23 bp, Homo sapiens
tatctctgaagcatgtttcatgt

SEQ ID NO: 843917 - DNA, 11 bp, Homo sapiens
tatctctgccg

SEQ ID NO: 843918 - DNA, 16 bp, Homo sapiens
tatctctgccgtctct

SEQ ID NO: 843919 - DNA, 11 bp, Homo sapiens
tatctctgtgt

SEQ ID NO: 843920 - DNA, 15 bp, Homo sapiens
tatctgaaaatgtat

SEQ ID NO: 843921 - DNA, 20 bp, Homo sapiens
tatctgaaaatgtatgtgta

SEQ ID NO: 843922 - DNA, 23 bp, Homo sapiens
tatctgagggaggaggccacctc

SEQ ID NO: 843923 - DNA, 23 bp, Homo sapiens
tatctgagttacagaaatgatta

SEQ ID NO: 843924 - DNA, 14 bp, Homo sapiens
tatctgagttgcca

SEQ ID NO: 843925 - DNA, 23 bp, Homo sapiens
tatctgataaaattgtgatgttt

SEQ ID NO: 843926 - DNA, 16 bp, Homo sapiens
tatctgattcctttaa

SEQ ID NO: 843927 - DNA, 20 bp, Homo sapiens
tatctgcactctaaactgca

SEQ ID NO: 843928 - DNA, 19 bp, Homo sapiens
tatgccacccccgctggag

SEQ ID NO: 843929 - DNA, 20 bp, Homo sapiens
tatgccacttccttttaact

SEQ ID NO: 843930 - DNA, 22 bp, Homo sapiens
tatgccatagcaagattgctta

SEQ ID NO: 843931 - DNA, 14 bp, Homo sapiens
tatgccatgatgga

SEQ ID NO: 843932 - DNA, 18 bp, Homo sapiens
tatgccatttcttctctc

SEQ ID NO: 843933 - DNA, 21 bp, Homo sapiens
tatgccatttcttctctctgt

SEQ ID NO: 843934 - DNA, 19 bp, Homo sapiens
tatgcccggcgccgggcac

SEQ ID NO: 843935 - DNA, 18 bp, Homo sapiens
tatgccctgcccttcctc

SEQ ID NO: 843936 - DNA, 23 bp, Homo sapiens
tatgccggatgtgcttttctcca

SEQ ID NO: 843937 - DNA, 18 bp, Homo sapiens
tatgcctgcactgggaag

SEQ ID NO: 843938 - DNA, 22 bp, Homo sapiens
tatgcctgcactgggaaggaaa

SEQ ID NO: 843939 - DNA, 23 bp, Homo sapiens
tatgcctgcactgggaaggaaac

SEQ ID NO: 843940 - DNA, 14 bp, Homo sapiens
tatgcctgctattt

SEQ ID NO: 843941 - DNA, 20 bp, Homo sapiens
tatgcctgtactaaggagca

SEQ ID NO: 843942 - DNA, 15 bp, Homo sapiens
tatgcctgtggtgaa

SEQ ID NO: 843943 - DNA, 19 bp, Homo sapiens
tatgcctgtggtgaagtgt

SEQ ID NO: 843944 - DNA, 16 bp, Homo sapiens
tatgccttaagcagaa

SEQ ID NO: 843945 - DNA, 16 bp, Homo sapiens
tatgcctttaaatctg

SEQ ID NO: 843946 - DNA, 22 bp, Homo sapiens
tatgcctttaaatctgtgatga

SEQ ID NO: 843947 - DNA, 14 bp, Homo sapiens
tatgcctttagtca

SEQ ID NO: 843948 - DNA, 18 bp, Homo sapiens
tatgcgaacagttattgt

SEQ ID NO: 843949 - DNA, 17 bp, Homo sapiens
tatgcgaacctatgtct

SEQ ID NO: 843950 - DNA, 22 bp, Homo sapiens
tatgctaaattaattacaatta

SEQ ID NO: 843951 - DNA, 13 bp, Homo sapiens
tatgctaatcagg

SEQ ID NO: 843952 - DNA, 21 bp, Homo sapiens
tatgctacccttaataacata

SEQ ID NO: 843953 - DNA, 20 bp, Homo sapiens
tatgctagtttattggaagt

SEQ ID NO: 843954 - DNA, 20 bp, Homo sapiens
tatgctgaagacattcaaaa

SEQ ID NO: 843955 - DNA, 15 bp, Homo sapiens
tatgctgatctttta

SEQ ID NO: 843956 - DNA, 20 bp, Homo sapiens
tatgctgatcttttaaaatc

SEQ ID NO: 843957 - DNA, 15 bp, Homo sapiens
tatgctgatttattt

SEQ ID NO: 843958 - DNA, 22 bp, Homo sapiens
tatgctgccaaattttggccaa

SEQ ID NO: 843959 - DNA, 15 bp, Homo sapiens
tatgctgctgtgaat

SEQ ID NO: 843960 - DNA, 12 bp, Homo sapiens
tatgctgctttt

SEQ ID NO: 843961 - DNA, 13 bp, Homo sapiens
tatgctggccagc

SEQ ID NO: 843962 - DNA, 19 bp, Homo sapiens
tatgctggccagcaccctc

SEQ ID NO: 843963 - DNA, 17 bp, Homo sapiens
tatgctggcttgtacat

SEQ ID NO: 843964 - DNA, 12 bp, Homo sapiens
tatgctggcttt

SEQ ID NO: 843965 - DNA, 12 bp, Homo sapiens
tatgctggtggt

SEQ ID NO: 843966 - DNA, 17 bp, Homo sapiens
tatgctgtatttctttg

SEQ ID NO: 843967 - DNA, 18 bp, Homo sapiens
tatgctgtatttctttgt

SEQ ID NO: 843968 - DNA, 19 bp, Homo sapiens
tatgctgtattttaacact

SEQ ID NO: 843969 - DNA, 16 bp, Homo sapiens
tatgcttaaaataagc

SEQ ID NO: 843970 - DNA, 17 bp, Homo sapiens
tatgcttaataaaagaa

SEQ ID NO: 843971 - DNA, 19 bp, Homo sapiens
tatgcttaataaaagaaca

SEQ ID NO: 843972 - DNA, 20 bp, Homo sapiens
tatgcttaataaaagaacat

SEQ ID NO: 843973 - DNA, 15 bp, Homo sapiens
tatgcttatacactt

SEQ ID NO: 843974 - DNA, 15 bp, Homo sapiens
tatgctttccctgag

SEQ ID NO: 843975 - DNA, 16 bp, Homo sapiens
tatgctttccctgagg

SEQ ID NO: 843976 - DNA, 18 bp, Homo sapiens
tatgctttccctgaggaa

SEQ ID NO: 843977 - DNA, 14 bp, Homo sapiens
tatgctttccttct

SEQ ID NO: 843978 - DNA, 14 bp, Homo sapiens
tatgctttgaactt

SEQ ID NO: 843979 - DNA, 19 bp, Homo sapiens
tatggaaaaaagcccagca

SEQ ID NO: 843980 - DNA, 15 bp, Homo sapiens
tatggaaaaataaaa

SEQ ID NO: 843981 - DNA, 20 bp, Homo sapiens
tatggaaaaataaaactgtc

SEQ ID NO: 843982 - DNA, 21 bp, Homo sapiens
tatggaaatcttttacatttt

SEQ ID NO: 843983 - DNA, 17 bp, Homo sapiens
tatggaactctctccac

SEQ ID NO: 843984 - DNA, 15 bp, Homo sapiens
tatggaacttctaat

SEQ ID NO: 843985 - DNA, 17 bp, Homo sapiens
tatggaacttctaatat

SEQ ID NO: 843986 - DNA, 13 bp, Homo sapiens
tatggaagaaagt

SEQ ID NO: 843987 - DNA, 16 bp, Homo sapiens
tatggaagcacccatt

SEQ ID NO: 843988 - DNA, 18 bp, Homo sapiens
tatggaagttgcataatt

SEQ ID NO: 843989 - DNA, 17 bp, Homo sapiens
tatggaatacagtgtta

SEQ ID NO: 843990 - DNA, 13 bp, Homo sapiens
tatggaatcaatt

SEQ ID NO: 843991 - DNA, 14 bp, Homo sapiens
tatggaattacatg

SEQ ID NO: 843992 - DNA, 18 bp, Homo sapiens
tatggaattacatgtaaa

SEQ ID NO: 843993 - DNA, 22 bp, Homo sapiens
tatggaattacatgtaaaacat

SEQ ID NO: 843994 - DNA, 17 bp, Homo sapiens
tatggacaaaattaata

SEQ ID NO: 843995 - DNA, 16 bp, Homo sapiens
tatggacaacttattt

SEQ ID NO: 843996 - DNA, 20 bp, Homo sapiens
tatggacactgccttagcct

SEQ ID NO: 843997 - DNA, 17 bp, Homo sapiens
tatggactatctgtctg

SEQ ID NO: 843998 - DNA, 18 bp, Homo sapiens
tatggactatctgtctgg

SEQ ID NO: 843999 - DNA, 17 bp, Homo sapiens
tatggagactttgctgt

SEQ ID NO: 844000 - DNA, 15 bp, Homo sapiens
tatggaggatggaga

SEQ ID NO: 844001 - DNA, 18 bp, Homo sapiens
tatggaggattctttccc

SEQ ID NO: 844002 - DNA, 22 bp, Homo sapiens
tatggaggattctttccccaga

SEQ ID NO: 844003 - DNA, 23 bp, Homo sapiens
tatggagtgagtcacctgctcca

SEQ ID NO: 844004 - DNA, 19 bp, Homo sapiens
tatggatgattcagaaatt

SEQ ID NO: 844005 - DNA, 19 bp, Homo sapiens
tatggatgtgtgtgtgtgc

SEQ ID NO: 844006 - DNA, 17 bp, Homo sapiens
tatggattaaaaactgc

SEQ ID NO: 844007 - DNA, 16 bp, Homo sapiens
tatggatttgaagttt

SEQ ID NO: 844008 - DNA, 19 bp, Homo sapiens
tatggcaaggaactttccc

SEQ ID NO: 844009 - DNA, 12 bp, Homo sapiens
tatggcacttct

SEQ ID NO: 844010 - DNA, 16 bp, Homo sapiens
tatggcagaggtgcaa

SEQ ID NO: 844011 - DNA, 20 bp, Homo sapiens
tatggcatatttatattgta

SEQ ID NO: 844012 - DNA, 16 bp, Homo sapiens
tatggccagtctgccc

SEQ ID NO: 844013 - DNA, 14 bp, Homo sapiens
tatggccatgccct

SEQ ID NO: 844014 - DNA, 18 bp, Homo sapiens
tatggcccagaaacaaca

SEQ ID NO: 844015 - DNA, 14 bp, Homo sapiens
tatggcccaggcag

SEQ ID NO: 844016 - DNA, 22 bp, Homo sapiens
tatggcccagtgtcaagttgtg

SEQ ID NO: 844017 - DNA, 21 bp, Homo sapiens
tatggccctggcctagcatac

SEQ ID NO: 844018 - DNA, 22 bp, Homo sapiens
tatggccctggcctagcatacg

SEQ ID NO: 844019 - DNA, 16 bp, Homo sapiens
tatggccgggcagggt

SEQ ID NO: 844020 - DNA, 23 bp, Homo sapiens
tatggcctcagctgcctcacttc

SEQ ID NO: 844021 - DNA, 15 bp, Homo sapiens
tatggcctcgcctcc

SEQ ID NO: 844022 - DNA, 20 bp, Homo sapiens
tatggcgtttttctcgtccc

SEQ ID NO: 844023 - DNA, 18 bp, Homo sapiens
tatggctgatttatttct

SEQ ID NO: 844024 - DNA, 14 bp, Homo sapiens
tatggcttatttct

SEQ ID NO: 844025 - DNA, 18 bp, Homo sapiens
tatgggaaaaaaactgaa

SEQ ID NO: 844026 - DNA, 17 bp, Homo sapiens
tatgggagatggcagca

SEQ ID NO: 844027 - DNA, 19 bp, Homo sapiens
tatgggatcatttttccag

SEQ ID NO: 844028 - DNA, 14 bp, Homo sapiens
tatgggatgtaaac

SEQ ID NO: 844029 - DNA, 15 bp, Homo sapiens
tatgggatgtaaaca

SEQ ID NO: 844030 - DNA, 17 bp, Homo sapiens
tatgggcattgtagtta

SEQ ID NO: 844031 - DNA, 17 bp, Homo sapiens
tatggggatggtagttt

SEQ ID NO: 844032 - DNA, 23 bp, Homo sapiens
tatgggggaaggcgctgggtgcc

SEQ ID NO: 844033 - DNA, 22 bp, Homo sapiens
tatgggggcatctcttccccag

SEQ ID NO: 844034 - DNA, 23 bp, Homo sapiens
tatgggggcatctcttccccaga

SEQ ID NO: 844035 - DNA, 18 bp, Homo sapiens
tatgggtagggtaaatca

SEQ ID NO: 844036 - DNA, 19 bp, Homo sapiens
tatgggtagggtaaatcag

SEQ ID NO: 844037 - DNA, 17 bp, Homo sapiens
tatgggtatatattcat

SEQ ID NO: 844038 - DNA, 19 bp, Homo sapiens
tatggtaactgctttctgt

SEQ ID NO: 844039 - DNA, 13 bp, Homo sapiens
tatggtataatgg

SEQ ID NO: 844040 - DNA, 16 bp, Homo sapiens
tatggtatgctggcca

SEQ ID NO: 844041 - DNA, 22 bp, Homo sapiens
tatggtatgctggccagcaccc

SEQ ID NO: 844042 - DNA, 21 bp, Homo sapiens
tatggtccagaaactcctgtt

SEQ ID NO: 844043 - DNA, 19 bp, Homo sapiens
tatggtcttgatcctccaa

SEQ ID NO: 844044 - DNA, 22 bp, Homo sapiens
tatggtcttgatcctccaatgt

SEQ ID NO: 844045 - DNA, 13 bp, Homo sapiens
tatggtgcttcct

SEQ ID NO: 844046 - DNA, 19 bp, Homo sapiens
tatggtgtagttctgagtc

SEQ ID NO: 844047 - DNA, 20 bp, Homo sapiens
tatggttacttcttctctta

SEQ ID NO: 844048 - DNA, 14 bp, Homo sapiens
tatggttatgtttt

SEQ ID NO: 844049 - DNA, 17 bp, Homo sapiens
tatgttctgtcttccca

SEQ ID NO: 844050 - DNA, 18 bp, Homo sapiens
tatgttctgtcttcccaa

SEQ ID NO: 844051 - DNA, 18 bp, Homo sapiens
tatgttgaatacttttta

SEQ ID NO: 844052 - DNA, 12 bp, Homo sapiens
tatgttgatact

SEQ ID NO: 844053 - DNA, 14 bp, Homo sapiens
tatgttgcctttat

SEQ ID NO: 844054 - DNA, 21 bp, Homo sapiens
tatgttgctattgtaaggtct

SEQ ID NO: 844055 - DNA, 14 bp, Homo sapiens
tatgttgctcagtc

SEQ ID NO: 844056 - DNA, 17 bp, Homo sapiens
tatgttggtttcagtgg

SEQ ID NO: 844057 - DNA, 12 bp, Homo sapiens
tatgttgtacat

SEQ ID NO: 844058 - DNA, 19 bp, Homo sapiens
tatgttgtatgattccaat

SEQ ID NO: 844059 - DNA, 16 bp, Homo sapiens
tatgttgtcaaagaga

SEQ ID NO: 844060 - DNA, 16 bp, Homo sapiens
tatgttgtcataacat

SEQ ID NO: 844061 - DNA, 17 bp, Homo sapiens
tatgttgtcataacatt

SEQ ID NO: 844062 - DNA, 16 bp, Homo sapiens
tatgttgtgttctaat

SEQ ID NO: 844063 - DNA, 19 bp, Homo sapiens
tatgtttaatctgttatgt

SEQ ID NO: 844064 - DNA, 13 bp, Homo sapiens
tatgtttattaca

SEQ ID NO: 844065 - DNA, 17 bp, Homo sapiens
tatgtttattacaattt

SEQ ID NO: 844066 - DNA, 23 bp, Homo sapiens
tatgtttattacaatttttaata

SEQ ID NO: 844067 - DNA, 18 bp, Homo sapiens
tatgtttatttactaatt

SEQ ID NO: 844068 - DNA, 18 bp, Homo sapiens
tatgtttccccatctctg

SEQ ID NO: 844069 - DNA, 14 bp, Homo sapiens
tatgtttccttgtt

SEQ ID NO: 844070 - DNA, 15 bp, Homo sapiens
tatgtttgatttctc

SEQ ID NO: 844071 - DNA, 13 bp, Homo sapiens
tatgtttgctgat

SEQ ID NO: 844072 - DNA, 22 bp, Homo sapiens
tatgtttgctgattatttatga

SEQ ID NO: 844073 - DNA, 20 bp, Homo sapiens
tatgtttgtcttttaatgct

SEQ ID NO: 844074 - DNA, 18 bp, Homo sapiens
tatgtttgtgtgatttcc

SEQ ID NO: 844075 - DNA, 16 bp, Homo sapiens
tatgttttagcatgtg

SEQ ID NO: 844076 - DNA, 18 bp, Homo sapiens
tatgttttcgaaaatcaa

SEQ ID NO: 844077 - DNA, 18 bp, Homo sapiens
tatgttttgtttctgaaa

SEQ ID NO: 844078 - DNA, 20 bp, Homo sapiens
tatgtttttatttatgaata

SEQ ID NO: 844079 - DNA, 13 bp, Homo sapiens
tatgtttttctgt

SEQ ID NO: 844080 - DNA, 15 bp, Homo sapiens
tatgtttttctgtgt

SEQ ID NO: 844081 - DNA, 14 bp, Homo sapiens
tatgtttttgaagg

SEQ ID NO: 844082 - DNA, 23 bp, Homo sapiens
tatgttttttagatcaaatactt

SEQ ID NO: 844083 - DNA, 15 bp, Homo sapiens
tatgttttttttctg

SEQ ID NO: 844084 - DNA, 21 bp, Homo sapiens
tattaaaaaaaaatactcttt

SEQ ID NO: 844085 - DNA, 18 bp, Homo sapiens
tattaaaaaacttcatgt

SEQ ID NO: 844086 - DNA, 18 bp, Homo sapiens
tattaaaaagtctgtatg

SEQ ID NO: 844087 - DNA, 14 bp, Homo sapiens
tattaaaaatataa

SEQ ID NO: 844088 - DNA, 21 bp, Homo sapiens
tattaaaaatataaaactgcg

SEQ ID NO: 844089 - DNA, 23 bp, Homo sapiens
tattaaaaatctcaaatttctaa

SEQ ID NO: 844090 - DNA, 19 bp, Homo sapiens
tattaaaatagcatactgt

SEQ ID NO: 844091 - DNA, 23 bp, Homo sapiens
tattaaaatagcatactgtgtat

SEQ ID NO: 844092 - DNA, 23 bp, Homo sapiens
tattaaaatatatttaatatgtt

SEQ ID NO: 844093 - DNA, 17 bp, Homo sapiens
tattaaaatatttcagg

SEQ ID NO: 844094 - DNA, 15 bp, Homo sapiens
tattaaaattccaaa

SEQ ID NO: 844095 - DNA, 21 bp, Homo sapiens
tattaaacaaaaacaaagaaa

SEQ ID NO: 844096 - DNA, 17 bp, Homo sapiens
tattaaacaaagtttca

SEQ ID NO: 844097 - DNA, 21 bp, Homo sapiens
tattaaacagatttttacaaa

SEQ ID NO: 844098 - DNA, 22 bp, Homo sapiens
tattaaacgtatgcatgtgaag

SEQ ID NO: 844099 - DNA, 17 bp, Homo sapiens
tattaaacgtgtaaatt

SEQ ID NO: 844100 - DNA, 23 bp, Homo sapiens
tattaaataaaatgcacaaaact

SEQ ID NO: 844101 - DNA, 14 bp, Homo sapiens
tattaaatcttaaa

SEQ ID NO: 844102 - DNA, 13 bp, Homo sapiens
tattaaatgtatt

SEQ ID NO: 844103 - DNA, 13 bp, Homo sapiens
tattaacaaaagt

SEQ ID NO: 844104 - DNA, 18 bp, Homo sapiens
tattaacaaaagttccct

SEQ ID NO: 844105 - DNA, 21 bp, Homo sapiens
tattaacacgctgcctggtct

SEQ ID NO: 844106 - DNA, 15 bp, Homo sapiens
tattaacgctgagat

SEQ ID NO: 844107 - DNA, 16 bp, Homo sapiens
tattaacgggcatgta

SEQ ID NO: 844108 - DNA, 14 bp, Homo sapiens
tattaactactgaa

SEQ ID NO: 844109 - DNA, 20 bp, Homo sapiens
tattaacttacggatttatt

SEQ ID NO: 844110 - DNA, 18 bp, Homo sapiens
tattaactttaatgtttt

SEQ ID NO: 844111 - DNA, 24 bp, Homo sapiens
tattaagaaagactatctaaatgt

SEQ ID NO: 844112 - DNA, 14 bp, Homo sapiens
tattaagaaaggaa

SEQ ID NO: 844113 - DNA, 18 bp, Homo sapiens
tattaagacaatagcact

SEQ ID NO: 844114 - DNA, 15 bp, Homo sapiens
tattaagatggattc

SEQ ID NO: 844115 - DNA, 19 bp, Homo sapiens
tattaagcagtaaaaactg

SEQ ID NO: 844116 - DNA, 21 bp, Homo sapiens
tattaagcctaccgtatttca

SEQ ID NO: 844117 - DNA, 19 bp, Homo sapiens
tattaagctttttggaatc

SEQ ID NO: 844118 - DNA, 14 bp, Homo sapiens
tattaaggaagaca

SEQ ID NO: 844119 - DNA, 24 bp, Homo sapiens
tattaaggtaactactgctaatgt

SEQ ID NO: 844120 - DNA, 21 bp, Homo sapiens
tattaagtctgggatgtagaa

SEQ ID NO: 844121 - DNA, 22 bp, Homo sapiens
tattaagtctgggatgtagaac

SEQ ID NO: 844122 - DNA, 13 bp, Homo sapiens
tattaataaaaag

SEQ ID NO: 844123 - DNA, 13 bp, Homo sapiens
tattaataaagca

SEQ ID NO: 844124 - DNA, 14 bp, Homo sapiens
tattaataaagcat

SEQ ID NO: 844125 - DNA, 18 bp, Homo sapiens
tattaataaagcattctt

SEQ ID NO: 844126 - DNA, 16 bp, Homo sapiens
tattaataatgaagta

SEQ ID NO: 844127 - DNA, 17 bp, Homo sapiens
tattaataccaaatatt

SEQ ID NO: 844128 - DNA, 17 bp, Homo sapiens
tattaatagtaatttgt

SEQ ID NO: 844129 - DNA, 14 bp, Homo sapiens
tattaatatatgta

SEQ ID NO: 844130 - DNA, 24 bp, Homo sapiens
tattaatatttaggagtctatttt

SEQ ID NO: 844131 - DNA, 14 bp, Homo sapiens
tattaatcaagaga

SEQ ID NO: 844132 - DNA, 19 bp, Homo sapiens
tattaatcaagagaaactt

SEQ ID NO: 844133 - DNA, 14 bp, Homo sapiens
tattaatcatagat

SEQ ID NO: 844134 - DNA, 18 bp, Homo sapiens
tattaatcttagtgtatg

SEQ ID NO: 844135 - DNA, 12 bp, Homo sapiens
tattaatcttgt

SEQ ID NO: 844136 - DNA, 18 bp, Homo sapiens
tattaatgaggtctttaa

SEQ ID NO: 844137 - DNA, 13 bp, Homo sapiens
tattaatgcactt

SEQ ID NO: 844138 - DNA, 14 bp, Homo sapiens
tattaatgcacttt

SEQ ID NO: 844139 - DNA, 13 bp, Homo sapiens
tattaatgccttt

SEQ ID NO: 844140 - DNA, 14 bp, Homo sapiens
tattaattgcctgt

SEQ ID NO: 844141 - DNA, 21 bp, Homo sapiens
tattaattgcctgttaaatat

SEQ ID NO: 844142 - DNA, 20 bp, Homo sapiens
tattaattgtcctgtgtcta

SEQ ID NO: 844143 - DNA, 21 bp, Homo sapiens
tattaatttatttgtcgtgtt

SEQ ID NO: 844144 - DNA, 14 bp, Homo sapiens
tattaattttagtt

SEQ ID NO: 844145 - DNA, 13 bp, Homo sapiens
tattacaaaacaa

SEQ ID NO: 844146 - DNA, 21 bp, Homo sapiens
tattacaaatattgtcatctt

SEQ ID NO: 844147 - DNA, 18 bp, Homo sapiens
tattacaaattttcactg

SEQ ID NO: 844148 - DNA, 21 bp, Homo sapiens
tattacaagtggctccccacc

SEQ ID NO: 844149 - DNA, 20 bp, Homo sapiens
tattacaataccgttaagat

SEQ ID NO: 844150 - DNA, 21 bp, Homo sapiens
tattacaataccgttaagata

SEQ ID NO: 844151 - DNA, 15 bp, Homo sapiens
tattacaatgtatct

SEQ ID NO: 844152 - DNA, 22 bp, Homo sapiens
tattacaccaccggccccctcc

SEQ ID NO: 844153 - DNA, 17 bp, Homo sapiens
tattacactgtatttgt

SEQ ID NO: 844154 - DNA, 15 bp, Homo sapiens
tattaccaactacat

SEQ ID NO: 844155 - DNA, 16 bp, Homo sapiens
tattaccacagacata

SEQ ID NO: 844156 - DNA, 13 bp, Homo sapiens
tattaccagcaag

SEQ ID NO: 844157 - DNA, 16 bp, Homo sapiens
tattaccagcaagaat

SEQ ID NO: 844158 - DNA, 19 bp, Homo sapiens
tattaccagcaagaataaa

SEQ ID NO: 844159 - DNA, 22 bp, Homo sapiens
tattaccagtggcgttgttgca

SEQ ID NO: 844160 - DNA, 15 bp, Homo sapiens
tattaccatgagaag

SEQ ID NO: 844161 - DNA, 22 bp, Homo sapiens
tattaccccctccttcagacac

SEQ ID NO: 844162 - DNA, 15 bp, Homo sapiens
tattaccccttttcg

SEQ ID NO: 844163 - DNA, 15 bp, Homo sapiens
tattacctattaggt

SEQ ID NO: 844164 - DNA, 11 bp, Homo sapiens
tattacctctg

SEQ ID NO: 844165 - DNA, 14 bp, Homo sapiens
tattacctctgata

SEQ ID NO: 844166 - DNA, 17 bp, Homo sapiens
tattactaaattgacct

SEQ ID NO: 844167 - DNA, 14 bp, Homo sapiens
tattactctacact

SEQ ID NO: 844168 - DNA, 21 bp, Homo sapiens
tattactctacactgaaacgt

SEQ ID NO: 844169 - DNA, 16 bp, Homo sapiens
tattactgaataatat

SEQ ID NO: 844170 - DNA, 22 bp, Homo sapiens
tattactgaataatatcaaata

SEQ ID NO: 844171 - DNA, 14 bp, Homo sapiens
tattcagaggcagt

SEQ ID NO: 844172 - DNA, 22 bp, Homo sapiens
tattcagagttagatattattt

SEQ ID NO: 844173 - DNA, 16 bp, Homo sapiens
tattcagccagcttaa

SEQ ID NO: 844174 - DNA, 18 bp, Homo sapiens
tattcagccagcttaaac

SEQ ID NO: 844175 - DNA, 14 bp, Homo sapiens
tattcagctagaat

SEQ ID NO: 844176 - DNA, 20 bp, Homo sapiens
tattcagctagaatttctgg

SEQ ID NO: 844177 - DNA, 14 bp, Homo sapiens
tattcagcttcatt

SEQ ID NO: 844178 - DNA, 12 bp, Homo sapiens
tattcaggactt

SEQ ID NO: 844179 - DNA, 20 bp, Homo sapiens
tattcaggagttggaatgtt

SEQ ID NO: 844180 - DNA, 17 bp, Homo sapiens
tattcagtagtttgagg

SEQ ID NO: 844181 - DNA, 14 bp, Homo sapiens
tattcagtgaattt

SEQ ID NO: 844182 - DNA, 14 bp, Homo sapiens
tattcataatgaat

SEQ ID NO: 844183 - DNA, 20 bp, Homo sapiens
tattcataatgaattataac

SEQ ID NO: 844184 - DNA, 16 bp, Homo sapiens
tattcatcagaatgtt

SEQ ID NO: 844185 - DNA, 17 bp, Homo sapiens
tattcattatttgtcaa

SEQ ID NO: 844186 - DNA, 18 bp, Homo sapiens
tattcattatttgtcaaa

SEQ ID NO: 844187 - DNA, 18 bp, Homo sapiens
tattcattgtggtcatag

SEQ ID NO: 844188 - DNA, 12 bp, Homo sapiens
tattcatttaaa

SEQ ID NO: 844189 - DNA, 14 bp, Homo sapiens
tattcatttaaaat

SEQ ID NO: 844190 - DNA, 19 bp, Homo sapiens
tattcatttaaaatgatta

SEQ ID NO: 844191 - DNA, 16 bp, Homo sapiens
tattcatttttgttat

SEQ ID NO: 844192 - DNA, 21 bp, Homo sapiens
tattccaaaccaaattttaat

SEQ ID NO: 844193 - DNA, 20 bp, Homo sapiens
tattccaaagttatttcata

SEQ ID NO: 844194 - DNA, 14 bp, Homo sapiens
tattccaaatgtct

SEQ ID NO: 844195 - DNA, 19 bp, Homo sapiens
tattccaagacatgtctgt

SEQ ID NO: 844196 - DNA, 13 bp, Homo sapiens
tattccaaggaaa

SEQ ID NO: 844197 - DNA, 20 bp, Homo sapiens
tattccaataccctagaaga

SEQ ID NO: 844198 - DNA, 19 bp, Homo sapiens
tattccaccattcacattt

SEQ ID NO: 844199 - DNA, 15 bp, Homo sapiens
tattccaccttaaat

SEQ ID NO: 844200 - DNA, 16 bp, Homo sapiens
tattccagaatgctgt

SEQ ID NO: 844201 - DNA, 17 bp, Homo sapiens
tattccagaatgctgta

SEQ ID NO: 844202 - DNA, 21 bp, Homo sapiens
tattccagaatgctgtacatc

SEQ ID NO: 844203 - DNA, 17 bp, Homo sapiens
tattccatatttattca

SEQ ID NO: 844204 - DNA, 20 bp, Homo sapiens
tattcccaagcccatgagtc

SEQ ID NO: 844205 - DNA, 16 bp, Homo sapiens
tattcccaagtatgcc

SEQ ID NO: 844206 - DNA, 19 bp, Homo sapiens
tattcccaagtatgcctta

SEQ ID NO: 844207 - DNA, 15 bp, Homo sapiens
tattcccactcacca

SEQ ID NO: 844208 - DNA, 21 bp, Homo sapiens
tattccctagaaacttccaaa

SEQ ID NO: 844209 - DNA, 13 bp, Homo sapiens
tattccctgccca

SEQ ID NO: 844210 - DNA, 23 bp, Homo sapiens
tattcccttaactctaaccctgt

SEQ ID NO: 844211 - DNA, 16 bp, Homo sapiens
tattcccttatctttt

SEQ ID NO: 844212 - DNA, 13 bp, Homo sapiens
tattcccttgtat

SEQ ID NO: 844213 - DNA, 21 bp, Homo sapiens
tattcccttgtattttgttaa

SEQ ID NO: 844214 - DNA, 11 bp, Homo sapiens
tattccctttg

SEQ ID NO: 844215 - DNA, 18 bp, Homo sapiens
tattccgtatttaaagtt

SEQ ID NO: 844216 - DNA, 18 bp, Homo sapiens
tattcctcagattgctga

SEQ ID NO: 844217 - DNA, 19 bp, Homo sapiens
tattcctgcatttgtgaaa

SEQ ID NO: 844218 - DNA, 20 bp, Homo sapiens
tattcctgcatttgtgaaat

SEQ ID NO: 844219 - DNA, 17 bp, Homo sapiens
tattcctggttaagcag

SEQ ID NO: 844220 - DNA, 14 bp, Homo sapiens
tattcctgtatgtt

SEQ ID NO: 844221 - DNA, 22 bp, Homo sapiens
tattcctttatacacagtggat

SEQ ID NO: 844222 - DNA, 15 bp, Homo sapiens
tattcctttattttg

SEQ ID NO: 844223 - DNA, 13 bp, Homo sapiens
tattcctttccct

SEQ ID NO: 844224 - DNA, 15 bp, Homo sapiens
tattcctttttctat

SEQ ID NO: 844225 - DNA, 22 bp, Homo sapiens
tattcgatactgcgactttctg

SEQ ID NO: 844226 - DNA, 13 bp, Homo sapiens
tattcgcccaccc

SEQ ID NO: 844227 - DNA, 13 bp, Homo sapiens
tattcgttacatc

SEQ ID NO: 844228 - DNA, 21 bp, Homo sapiens
tattctaaagttttgcaacaa

SEQ ID NO: 844229 - DNA, 21 bp, Homo sapiens
tattctaagccagttttcatt

SEQ ID NO: 844230 - DNA, 15 bp, Homo sapiens
tattctaataaatat

SEQ ID NO: 844231 - DNA, 14 bp, Homo sapiens
tattctaatagttt

SEQ ID NO: 844232 - DNA, 23 bp, Homo sapiens
tattctaatagtttttcactttg

SEQ ID NO: 844233 - DNA, 15 bp, Homo sapiens
tattctacacatgta

SEQ ID NO: 844234 - DNA, 14 bp, Homo sapiens
tattctacatttca

SEQ ID NO: 844235 - DNA, 17 bp, Homo sapiens
tattctacttctctgtt

SEQ ID NO: 844236 - DNA, 14 bp, Homo sapiens
tattctagtggctg

SEQ ID NO: 844237 - DNA, 15 bp, Homo sapiens
tattctatatgaatt

SEQ ID NO: 844238 - DNA, 12 bp, Homo sapiens
tattctattgca

SEQ ID NO: 844239 - DNA, 17 bp, Homo sapiens
tattctcaaacacagtt

SEQ ID NO: 844240 - DNA, 22 bp, Homo sapiens
tattctcaaacacagttacact

SEQ ID NO: 844241 - DNA, 13 bp, Homo sapiens
tattctcactcca

SEQ ID NO: 844242 - DNA, 15 bp, Homo sapiens
tattctcactccacc

SEQ ID NO: 844243 - DNA, 19 bp, Homo sapiens
tattctcactccaccaccc

SEQ ID NO: 844244 - DNA, 14 bp, Homo sapiens
tattctccactttt

SEQ ID NO: 844245 - DNA, 16 bp, Homo sapiens
tattctcctatgtttg

SEQ ID NO: 844246 - DNA, 15 bp, Homo sapiens
tattctcctccctgt

SEQ ID NO: 844247 - DNA, 17 bp, Homo sapiens
tattctcctgccatggg

SEQ ID NO: 844248 - DNA, 15 bp, Homo sapiens
tattctctctatgca

SEQ ID NO: 844249 - DNA, 15 bp, Homo sapiens
tattctctgcaattt

SEQ ID NO: 844250 - DNA, 17 bp, Homo sapiens
tattctctgcaatttgt

SEQ ID NO: 844251 - DNA, 13 bp, Homo sapiens
tattctctgtaag

SEQ ID NO: 844252 - DNA, 15 bp, Homo sapiens
tattctgaaaggaaa

SEQ ID NO: 844253 - DNA, 19 bp, Homo sapiens
tattctgacatgtaagaaa

SEQ ID NO: 844254 - DNA, 11 bp, Homo sapiens
tattctgagcc

SEQ ID NO: 844255 - DNA, 22 bp, Homo sapiens
tattctgctctattatataaac

SEQ ID NO: 844256 - DNA, 20 bp, Homo sapiens
tattctgggctcctggaacc

SEQ ID NO: 844257 - DNA, 22 bp, Homo sapiens
tattctgggctcctggaaccaa

SEQ ID NO: 844258 - DNA, 22 bp, Homo sapiens
tattctgtagattctgtggaac

SEQ ID NO: 844259 - DNA, 12 bp, Homo sapiens
tattctgtggcc

SEQ ID NO: 844260 - DNA, 15 bp, Homo sapiens
tattctgttggaagc

SEQ ID NO: 844261 - DNA, 12 bp, Homo sapiens
tattctgtttgc

SEQ ID NO: 844262 - DNA, 11 bp, Homo sapiens
tattctgtttt

SEQ ID NO: 844263 - DNA, 14 bp, Homo sapiens
tattctgttttgtt

SEQ ID NO: 844264 - DNA, 14 bp, Homo sapiens
tattcttaagcact

SEQ ID NO: 844265 - DNA, 15 bp, Homo sapiens
tattcttaagcactt

SEQ ID NO: 844266 - DNA, 14 bp, Homo sapiens
tattcttcataaca

SEQ ID NO: 844267 - DNA, 13 bp, Homo sapiens
tattcttccagaa

SEQ ID NO: 844268 - DNA, 20 bp, Homo sapiens
tattcttgagtttttgggtt

SEQ ID NO: 844269 - DNA, 16 bp, Homo sapiens
tattcttgctgggcat

SEQ ID NO: 844270 - DNA, 21 bp, Homo sapiens
tattcttgctgggcatacttt

SEQ ID NO: 844271 - DNA, 19 bp, Homo sapiens
tattcttttccaagctcct

SEQ ID NO: 844272 - DNA, 16 bp, Homo sapiens
tattgaaaaaaaaaat

SEQ ID NO: 844273 - DNA, 20 bp, Homo sapiens
tattgaaaaaaaaaatgttg

SEQ ID NO: 844274 - DNA, 21 bp, Homo sapiens
tattgaaaaatacgttttgtg

SEQ ID NO: 844275 - DNA, 15 bp, Homo sapiens
tattgaaaacttcaa

SEQ ID NO: 844276 - DNA, 17 bp, Homo sapiens
tattgaaaacttcaaag

SEQ ID NO: 844277 - DNA, 18 bp, Homo sapiens
tattgaaaacttcaaagc

SEQ ID NO: 844278 - DNA, 14 bp, Homo sapiens
tattgaaaattgaa

SEQ ID NO: 844279 - DNA, 21 bp, Homo sapiens
tattgaaagccaacaactctg

SEQ ID NO: 844280 - DNA, 20 bp, Homo sapiens
tattgaaaggggacacctgt

SEQ ID NO: 844281 - DNA, 15 bp, Homo sapiens
tattgaaatgtataa

SEQ ID NO: 844282 - DNA, 20 bp, Homo sapiens
tattgaagacaatttgatac

SEQ ID NO: 844283 - DNA, 16 bp, Homo sapiens
tattgaatctatttaa

SEQ ID NO: 844284 - DNA, 17 bp, Homo sapiens
tattgaatctatttaag

SEQ ID NO: 844285 - DNA, 15 bp, Homo sapiens
tattgaattagaaaa

SEQ ID NO: 844286 - DNA, 22 bp, Homo sapiens
tattgaatttgttagactagtt

SEQ ID NO: 844287 - DNA, 15 bp, Homo sapiens
tattgaatttttcct

SEQ ID NO: 844288 - DNA, 22 bp, Homo sapiens
tattgaatttttcctatgctat

SEQ ID NO: 844289 - DNA, 17 bp, Homo sapiens
tattgacaacagtttta

SEQ ID NO: 844290 - DNA, 20 bp, Homo sapiens
tattgacaataaaatattat

SEQ ID NO: 844291 - DNA, 18 bp, Homo sapiens
tattgacaataatttcag

SEQ ID NO: 844292 - DNA, 20 bp, Homo sapiens
tattgacacagaaaatgttg

SEQ ID NO: 844293 - DNA, 12 bp, Homo sapiens
tattgacactga

SEQ ID NO: 844294 - DNA, 12 bp, Homo sapiens
tatttatttaat

SEQ ID NO: 844295 - DNA, 11 bp, Homo sapiens
tatttatttac

SEQ ID NO: 844296 - DNA, 17 bp, Homo sapiens
tatttatttactgagct

SEQ ID NO: 844297 - DNA, 13 bp, Homo sapiens
tatttatttcaga

SEQ ID NO: 844298 - DNA, 13 bp, Homo sapiens
tatttatttcctg

SEQ ID NO: 844299 - DNA, 14 bp, Homo sapiens
tatttatttcctta

SEQ ID NO: 844300 - DNA, 14 bp, Homo sapiens
tatttatttctagt

SEQ ID NO: 844301 - DNA, 13 bp, Homo sapiens
tatttattttcag

SEQ ID NO: 844302 - DNA, 18 bp, Homo sapiens
tatttattttcctcccca

SEQ ID NO: 844303 - DNA, 18 bp, Homo sapiens
tatttatttttacaagaa

SEQ ID NO: 844304 - DNA, 20 bp, Homo sapiens
tatttattttttttaagtat

SEQ ID NO: 844305 - DNA, 15 bp, Homo sapiens
tatttcaaaatgtcc

SEQ ID NO: 844306 - DNA, 15 bp, Homo sapiens
tatttcaatgtaatt

SEQ ID NO: 844307 - DNA, 19 bp, Homo sapiens
tatttcaatgtaattaaac

SEQ ID NO: 844308 - DNA, 16 bp, Homo sapiens
tatttcaatgttagcc

SEQ ID NO: 844309 - DNA, 13 bp, Homo sapiens
tatttcacagagc

SEQ ID NO: 844310 - DNA, 19 bp, Homo sapiens
tatttcacttttgttctgc

SEQ ID NO: 844311 - DNA, 20 bp, Homo sapiens
tatttcagatatcaaaattc

SEQ ID NO: 844312 - DNA, 18 bp, Homo sapiens
tatttcagggacctcagg

SEQ ID NO: 844313 - DNA, 12 bp, Homo sapiens
tatttcagtgac

SEQ ID NO: 844314 - DNA, 20 bp, Homo sapiens
tatttcagttttaaatgtac

SEQ ID NO: 844315 - DNA, 20 bp, Homo sapiens
tatttcataaacaacttaat

SEQ ID NO: 844316 - DNA, 12 bp, Homo sapiens
tatttcattgcc

SEQ ID NO: 844317 - DNA, 17 bp, Homo sapiens
tatttccactaaaaata

SEQ ID NO: 844318 - DNA, 16 bp, Homo sapiens
tatttccactattttc

SEQ ID NO: 844319 - DNA, 20 bp, Homo sapiens
tatttccactattttcaaag

SEQ ID NO: 844320 - DNA, 21 bp, Homo sapiens
tatttccccaggggaaaatga

SEQ ID NO: 844321 - DNA, 22 bp, Homo sapiens
tatttccccaggggaaaatgaa

SEQ ID NO: 844322 - DNA, 19 bp, Homo sapiens
tatttcccctcttctgcta

SEQ ID NO: 844323 - DNA, 13 bp, Homo sapiens
tatttcccctgtc

SEQ ID NO: 844324 - DNA, 14 bp, Homo sapiens
tatttccccttgga

SEQ ID NO: 844325 - DNA, 21 bp, Homo sapiens
tatttccccttggacacttgg

SEQ ID NO: 844326 - DNA, 16 bp, Homo sapiens
tatttcccttccaaag

SEQ ID NO: 844327 - DNA, 23 bp, Homo sapiens
tatttcctatattgttttcagtg

SEQ ID NO: 844328 - DNA, 13 bp, Homo sapiens
tatttcctccctc

SEQ ID NO: 844329 - DNA, 18 bp, Homo sapiens
tatttcctggatgtttgg

SEQ ID NO: 844330 - DNA, 17 bp, Homo sapiens
tatttcctgtattgctt

SEQ ID NO: 844331 - DNA, 19 bp, Homo sapiens
tatttcctgtattgcttta

SEQ ID NO: 844332 - DNA, 20 bp, Homo sapiens
tatttccttagtgccaggag

SEQ ID NO: 844333 - DNA, 18 bp, Homo sapiens
tatttcctttatgtgaat

SEQ ID NO: 844334 - DNA, 16 bp, Homo sapiens
tatttctacagagaaa

SEQ ID NO: 844335 - DNA, 15 bp, Homo sapiens
tatttctagcagagt

SEQ ID NO: 844336 - DNA, 21 bp, Homo sapiens
tatttctagggaaatttttca

SEQ ID NO: 844337 - DNA, 21 bp, Homo sapiens
tatttctagtccaaaattaca

SEQ ID NO: 844338 - DNA, 16 bp, Homo sapiens
tatttctatgacaaat

SEQ ID NO: 844339 - DNA, 20 bp, Homo sapiens
tatttctatgacaaattcaa

SEQ ID NO: 844340 - DNA, 17 bp, Homo sapiens
tatttctatgtaaatta

SEQ ID NO: 844341 - DNA, 16 bp, Homo sapiens
tatttctattccttat

SEQ ID NO: 844342 - DNA, 19 bp, Homo sapiens
tatttctcaacaaagcaca

SEQ ID NO: 844343 - DNA, 13 bp, Homo sapiens
tatttctcaggaa

SEQ ID NO: 844344 - DNA, 12 bp, Homo sapiens
tatttctccaga

SEQ ID NO: 844345 - DNA, 14 bp, Homo sapiens
tatttctccagacc

SEQ ID NO: 844346 - DNA, 20 bp, Homo sapiens
tatttctccagacccagagg

SEQ ID NO: 844347 - DNA, 17 bp, Homo sapiens
tatttctccatcccctc

SEQ ID NO: 844348 - DNA, 23 bp, Homo sapiens
tatttctccatcccctccctgcc

SEQ ID NO: 844349 - DNA, 15 bp, Homo sapiens
tatttctccatcttt

SEQ ID NO: 844350 - DNA, 14 bp, Homo sapiens
tatttctctctcct

SEQ ID NO: 844351 - DNA, 19 bp, Homo sapiens
tatttctctgatttgcaaa

SEQ ID NO: 844352 - DNA, 16 bp, Homo sapiens
tatttctctggcaaac

SEQ ID NO: 844353 - DNA, 20 bp, Homo sapiens
tatttctctggcaaactttt

SEQ ID NO: 844354 - DNA, 23 bp, Homo sapiens
tatttctcttttattctgttata

SEQ ID NO: 844355 - DNA, 21 bp, Homo sapiens
tatttctgaaggtagcattct

SEQ ID NO: 844356 - DNA, 11 bp, Homo sapiens
tatttctgaga

SEQ ID NO: 844357 - DNA, 12 bp, Homo sapiens
tatttctgatga

SEQ ID NO: 844358 - DNA, 13 bp, Homo sapiens
tatttctgatgat

SEQ ID NO: 844359 - DNA, 14 bp, Homo sapiens
tatttctgatgatg

SEQ ID NO: 844360 - DNA, 16 bp, Homo sapiens
tatttctgatgatgtc

SEQ ID NO: 844361 - DNA, 15 bp, Homo sapiens
tatttctgtatataa

SEQ ID NO: 844362 - DNA, 18 bp, Homo sapiens
tatttctgtatatttgtc

SEQ ID NO: 844363 - DNA, 19 bp, Homo sapiens
tatttctgtatatttgtca

SEQ ID NO: 844364 - DNA, 21 bp, Homo sapiens
tatttctgtatatttgtcatg

SEQ ID NO: 844365 - DNA, 15 bp, Homo sapiens
tatttctgttatttt

SEQ ID NO: 844366 - DNA, 13 bp, Homo sapiens
tatttctgttctt

SEQ ID NO: 844367 - DNA, 17 bp, Homo sapiens
tatttctgtttgtttaa

SEQ ID NO: 844368 - DNA, 14 bp, Homo sapiens
tatttcttaatttg

SEQ ID NO: 844369 - DNA, 15 bp, Homo sapiens
tatttcttaatttgg

SEQ ID NO: 844370 - DNA, 14 bp, Homo sapiens
tatttcttcaaata

SEQ ID NO: 844371 - DNA, 23 bp, Homo sapiens
tatttcttgaagaataaattcta

SEQ ID NO: 844372 - DNA, 14 bp, Homo sapiens
tatttctttgttat

SEQ ID NO: 844373 - DNA, 19 bp, Homo sapiens
tatttgaaaacatataaag

SEQ ID NO: 844374 - DNA, 22 bp, Homo sapiens
tatttgaaaacatataaagcac

SEQ ID NO: 844375 - DNA, 14 bp, Homo sapiens
tatttgaaaattac

SEQ ID NO: 844376 - DNA, 21 bp, Homo sapiens
tatttgaagaaaaaaatgtac

SEQ ID NO: 844377 - DNA, 12 bp, Homo sapiens
tatttgaatgaa

SEQ ID NO: 844378 - DNA, 13 bp, Homo sapiens
tatttgaatgaaa

SEQ ID NO: 844379 - DNA, 17 bp, Homo sapiens
tatttgaatgaaaacat

SEQ ID NO: 844380 - DNA, 21 bp, Homo sapiens
tatttgacaacgtttcagcga

SEQ ID NO: 844381 - DNA, 19 bp, Homo sapiens
tatttgacttgcatgaaga

SEQ ID NO: 844382 - DNA, 23 bp, Homo sapiens
tatttgagacggggtctccctgt

SEQ ID NO: 844383 - DNA, 20 bp, Homo sapiens
tatttgagcaagtaacatta

SEQ ID NO: 844384 - DNA, 14 bp, Homo sapiens
tatttgatatgcac

SEQ ID NO: 844385 - DNA, 17 bp, Homo sapiens
tatttgattcaaaatat

SEQ ID NO: 844386 - DNA, 13 bp, Homo sapiens
tatttgatttcta

SEQ ID NO: 844387 - DNA, 21 bp, Homo sapiens
tatttgcataacaattcctct

SEQ ID NO: 844388 - DNA, 11 bp, Homo sapiens
tatttgcatgt

SEQ ID NO: 844389 - DNA, 15 bp, Homo sapiens
tatttgcatgttacc

SEQ ID NO: 844390 - DNA, 18 bp, Homo sapiens
tatttgcatgttatgttt

SEQ ID NO: 844391 - DNA, 14 bp, Homo sapiens
tatttgctaatttt

SEQ ID NO: 844392 - DNA, 15 bp, Homo sapiens
tatttgctgcaaaga

SEQ ID NO: 844393 - DNA, 18 bp, Homo sapiens
tatttgctgccagacact

SEQ ID NO: 844394 - DNA, 15 bp, Homo sapiens
tatttgcttcattgt

SEQ ID NO: 844395 - DNA, 16 bp, Homo sapiens
tatttggaatatttga

SEQ ID NO: 844396 - DNA, 19 bp, Homo sapiens
tatttggaatatttgaata

SEQ ID NO: 844397 - DNA, 14 bp, Homo sapiens
tatttgggaagtga

SEQ ID NO: 844398 - DNA, 20 bp, Homo sapiens
tatttgggggaactggacac

SEQ ID NO: 844399 - DNA, 15 bp, Homo sapiens
tatttgtaaaccatt

SEQ ID NO: 844400 - DNA, 20 bp, Homo sapiens
tatttgtaaatttagtgttt

SEQ ID NO: 844401 - DNA, 20 bp, Homo sapiens
tatttgtaacattgtaaagt

SEQ ID NO: 844402 - DNA, 22 bp, Homo sapiens
tatttgtaacattgtaaagtat

SEQ ID NO: 844403 - DNA, 13 bp, Homo sapiens
tatttgtaattaa

SEQ ID NO: 844404 - DNA, 23 bp, Homo sapiens
tatttgtactgtttaatgttctg

SEQ ID NO: 844405 - DNA, 18 bp, Homo sapiens
tatttgtataaaagtgtg

SEQ ID NO: 844406 - DNA, 15 bp, Homo sapiens
tatttgtataaatta

SEQ ID NO: 844407 - DNA, 22 bp, Homo sapiens
tatttgtatctctgaagcatgt

SEQ ID NO: 844408 - DNA, 15 bp, Homo sapiens
tatttgtattaataa

SEQ ID NO: 844409 - DNA, 22 bp, Homo sapiens
tatttgtattaataaagcattc

SEQ ID NO: 844410 - DNA, 15 bp, Homo sapiens
tatttgtattcatga

SEQ ID NO: 844411 - DNA, 10 bp, Homo sapiens
tatttgtcaa

SEQ ID NO: 844412 - DNA, 15 bp, Homo sapiens
tatttgtctgtaaaa

SEQ ID NO: 844413 - DNA, 13 bp, Homo sapiens
tatttgtcttaaa

SEQ ID NO: 844414 - DNA, 19 bp, Homo sapiens
tatttgtcttaaaaaatgt

SEQ ID NO: 844415 - DNA, 22 bp, Homo sapiens
tatttgtcttccgatcaacatt

SEQ ID NO: 844416 - DNA, 15 bp, Homo sapiens
tatttgtctttcagg

SEQ ID NO: 844417 - DNA, 14 bp, Homo sapiens
tcaaaccaggattt

SEQ ID NO: 844418 - DNA, 20 bp, Homo sapiens
tcaaaccgtggtaccccccc

SEQ ID NO: 844419 - DNA, 18 bp, Homo sapiens
tcaaacctggagctgagg

SEQ ID NO: 844420 - DNA, 23 bp, Homo sapiens
tcaaactaaattcaaagaagtac

SEQ ID NO: 844421 - DNA, 22 bp, Homo sapiens
tcaaactcaatgctttatttgt

SEQ ID NO: 844422 - DNA, 23 bp, Homo sapiens
tcaaactcaatgctttatttgta

SEQ ID NO: 844423 - DNA, 17 bp, Homo sapiens
tcaaactgtagaaatga

SEQ ID NO: 844424 - DNA, 18 bp, Homo sapiens
tcaaactgtgaagcattt

SEQ ID NO: 844425 - DNA, 15 bp, Homo sapiens
tcaaacttactattt

SEQ ID NO: 844426 - DNA, 14 bp, Homo sapiens
tcaaacttccagtc

SEQ ID NO: 844427 - DNA, 12 bp, Homo sapiens
tcaaacttggat

SEQ ID NO: 844428 - DNA, 19 bp, Homo sapiens
tcaaacttgtggcctcaag

SEQ ID NO: 844429 - DNA, 23 bp, Homo sapiens
tcaaactttttccagcaaaatgg

SEQ ID NO: 844430 - DNA, 16 bp, Homo sapiens
tcaaagaaaaacaatg

SEQ ID NO: 844431 - DNA, 14 bp, Homo sapiens
tcaaagaaagtgta

SEQ ID NO: 844432 - DNA, 23 bp, Homo sapiens
tcaaagaaatccaaatttctcat

SEQ ID NO: 844433 - DNA, 12 bp, Homo sapiens
tcaaagaaatgc

SEQ ID NO: 844434 - DNA, 17 bp, Homo sapiens
tcaaagaaattcagaac

SEQ ID NO: 844435 - DNA, 18 bp, Homo sapiens
tcaaagaaattcagaaca

SEQ ID NO: 844436 - DNA, 15 bp, Homo sapiens
tcaaagaaggtgctg

SEQ ID NO: 844437 - DNA, 18 bp, Homo sapiens
tcaaagaaggtgctgatc

SEQ ID NO: 844438 - DNA, 12 bp, Homo sapiens
tcaaagaattac

SEQ ID NO: 844439 - DNA, 14 bp, Homo sapiens
tcaaagaattacag

SEQ ID NO: 844440 - DNA, 15 bp, Homo sapiens
tcaaagacagaatgg

SEQ ID NO: 844441 - DNA, 16 bp, Homo sapiens
tcaaagagaaaactta

SEQ ID NO: 844442 - DNA, 18 bp, Homo sapiens
tcaaagagaagatgcctg

SEQ ID NO: 844443 - DNA, 21 bp, Homo sapiens
tcaaagagatgggccttttct

SEQ ID NO: 844444 - DNA, 15 bp, Homo sapiens
tcaaagagattcgaa

SEQ ID NO: 844445 - DNA, 21 bp, Homo sapiens
tcaaagaggctgaggctggca

SEQ ID NO: 844446 - DNA, 18 bp, Homo sapiens
tcaaagaggtaactgagg

SEQ ID NO: 844447 - DNA, 20 bp, Homo sapiens
tcaaagagtctgtcttgaga

SEQ ID NO: 844448 - DNA, 14 bp, Homo sapiens
tcaaagatttttat

SEQ ID NO: 844449 - DNA, 15 bp, Homo sapiens
tcaaagcaaggaaac

SEQ ID NO: 844450 - DNA, 15 bp, Homo sapiens
tcaaagcacaataac

SEQ ID NO: 844451 - DNA, 22 bp, Homo sapiens
tcaaagcaccaaaataagaaaa

SEQ ID NO: 844452 - DNA, 16 bp, Homo sapiens
tcaaagcagaagtctg

SEQ ID NO: 844453 - DNA, 14 bp, Homo sapiens
tcaaagcagagtgg

SEQ ID NO: 844454 - DNA, 16 bp, Homo sapiens
tcaaagcagcagccac

SEQ ID NO: 844455 - DNA, 22 bp, Homo sapiens
tcaaagcatggacatttagaag

SEQ ID NO: 844456 - DNA, 15 bp, Homo sapiens
tcaaagccacattat

SEQ ID NO: 844457 - DNA, 17 bp, Homo sapiens
tcaaagccacattattt

SEQ ID NO: 844458 - DNA, 12 bp, Homo sapiens
tcaaagccagcg

SEQ ID NO: 844459 - DNA, 23 bp, Homo sapiens
tcaaagccagcgtcctcctctgt

SEQ ID NO: 844460 - DNA, 12 bp, Homo sapiens
tcaaagcccaga

SEQ ID NO: 844461 - DNA, 13 bp, Homo sapiens
tcaaagccctgcc

SEQ ID NO: 844462 - DNA, 14 bp, Homo sapiens
tcaaagccctgcct

SEQ ID NO: 844463 - DNA, 16 bp, Homo sapiens
tcaaagccctgcctct

SEQ ID NO: 844464 - DNA, 19 bp, Homo sapiens
tcaaagccctgcctctgtg

SEQ ID NO: 844465 - DNA, 20 bp, Homo sapiens
tcaaagctgaatatttttta

SEQ ID NO: 844466 - DNA, 12 bp, Homo sapiens
tcaaagctgagt

SEQ ID NO: 844467 - DNA, 18 bp, Homo sapiens
tcaaagctgctttattca

SEQ ID NO: 844468 - DNA, 19 bp, Homo sapiens
tcaaagctgtgtgtttgga

SEQ ID NO: 844469 - DNA, 16 bp, Homo sapiens
tcaaagcttaaaaaga

SEQ ID NO: 844470 - DNA, 14 bp, Homo sapiens
tcaaagcttgaaga

SEQ ID NO: 844471 - DNA, 19 bp, Homo sapiens
tcaaaggaatataagaaaa

SEQ ID NO: 844472 - DNA, 23 bp, Homo sapiens
tcaaaggaatataagaaaagtaa

SEQ ID NO: 844473 - DNA, 14 bp, Homo sapiens
tcaaaggagaaaaa

SEQ ID NO: 844474 - DNA, 19 bp, Homo sapiens
tcaaagtaaaacttgctgc

SEQ ID NO: 844475 - DNA, 17 bp, Homo sapiens
tcaaagtataatctttc

SEQ ID NO: 844476 - DNA, 20 bp, Homo sapiens
tcaaagtataatctttctat

SEQ ID NO: 844477 - DNA, 14 bp, Homo sapiens
tcaaagtatgcaat

SEQ ID NO: 844478 - DNA, 20 bp, Homo sapiens
tcaaagtcccttgagactcc

SEQ ID NO: 844479 - DNA, 21 bp, Homo sapiens
tcaaagtctgctctcatataa

SEQ ID NO: 844480 - DNA, 20 bp, Homo sapiens
tcaaagtgtaaacaccatag

SEQ ID NO: 844481 - DNA, 14 bp, Homo sapiens
tcaaagtgtatatt

SEQ ID NO: 844482 - DNA, 15 bp, Homo sapiens
tcaaagtgtatattt

SEQ ID NO: 844483 - DNA, 21 bp, Homo sapiens
tcaaagtgttgtgttcctggc

SEQ ID NO: 844484 - DNA, 18 bp, Homo sapiens
tcaaagtgttttctctga

SEQ ID NO: 844485 - DNA, 15 bp, Homo sapiens
tcaaagttaattcac

SEQ ID NO: 844486 - DNA, 19 bp, Homo sapiens
tcaaagttaattcacctat

SEQ ID NO: 844487 - DNA, 18 bp, Homo sapiens
tcaaataaaatatcataa

SEQ ID NO: 844488 - DNA, 21 bp, Homo sapiens
tcaaataaagaaatttggtac

SEQ ID NO: 844489 - DNA, 17 bp, Homo sapiens
tcaaataagtatttata

SEQ ID NO: 844490 - DNA, 18 bp, Homo sapiens
tcaaataatccattccaa

SEQ ID NO: 844491 - DNA, 22 bp, Homo sapiens
tcaaatacatttaaaacattaa

SEQ ID NO: 844492 - DNA, 21 bp, Homo sapiens
tcaaatagatttttgattcag

SEQ ID NO: 844493 - DNA, 22 bp, Homo sapiens
tcaaatatagaaagttgatatt

SEQ ID NO: 844494 - DNA, 22 bp, Homo sapiens
tcaaatcaggttttcttttaag

SEQ ID NO: 844495 - DNA, 17 bp, Homo sapiens
tcaaatcagtgatctat

SEQ ID NO: 844496 - DNA, 19 bp, Homo sapiens
tcaaatcagtgatctatgt

SEQ ID NO: 844497 - DNA, 13 bp, Homo sapiens
tcaaatcctcacc

SEQ ID NO: 844498 - DNA, 15 bp, Homo sapiens
tcaaatctattcaga

SEQ ID NO: 844499 - DNA, 19 bp, Homo sapiens
tcaaatctcagcaaagcta

SEQ ID NO: 844500 - DNA, 17 bp, Homo sapiens
tcaaatctcctgctgat

SEQ ID NO: 844501 - DNA, 21 bp, Homo sapiens
tcaaatctgtaatcagcaata

SEQ ID NO: 844502 - DNA, 21 bp, Homo sapiens
tcaaatctgtatatgttgtaa

SEQ ID NO: 844503 - DNA, 13 bp, Homo sapiens
tcaaatcttacaa

SEQ ID NO: 844504 - DNA, 14 bp, Homo sapiens
tcaaatgaactttt

SEQ ID NO: 844505 - DNA, 21 bp, Homo sapiens
tcaaatgaacttttacagaat

SEQ ID NO: 844506 - DNA, 21 bp, Homo sapiens
tcaaatgaataatgcctttgt

SEQ ID NO: 844507 - DNA, 22 bp, Homo sapiens
tcaaatgaataatgcctttgta

SEQ ID NO: 844508 - DNA, 21 bp, Homo sapiens
tcaaatgacccaaagaccaat

SEQ ID NO: 844509 - DNA, 16 bp, Homo sapiens
tcaaatgagtaacatt

SEQ ID NO: 844510 - DNA, 15 bp, Homo sapiens
tcaaatgatgtgcaa

SEQ ID NO: 844511 - DNA, 21 bp, Homo sapiens
tcaaatgatgtgcaaaacctt

SEQ ID NO: 844512 - DNA, 20 bp, Homo sapiens
tcaaatgcagtatatttctt

SEQ ID NO: 844513 - DNA, 12 bp, Homo sapiens
tcaaatgccaaa

SEQ ID NO: 844514 - DNA, 21 bp, Homo sapiens
tcaaatgccttcatgaatctt

SEQ ID NO: 844515 - DNA, 17 bp, Homo sapiens
tcaaatgggaaaaaaac

SEQ ID NO: 844516 - DNA, 16 bp, Homo sapiens
tcaaatggtatctttt

SEQ ID NO: 844517 - DNA, 15 bp, Homo sapiens
tcaaatgtcagagct

SEQ ID NO: 844518 - DNA, 17 bp, Homo sapiens
tcaaatgtgcattttgt

SEQ ID NO: 844519 - DNA, 15 bp, Homo sapiens
tcaaatgtttcctta

SEQ ID NO: 844520 - DNA, 16 bp, Homo sapiens
tcaaatgtttccttaa

SEQ ID NO: 844521 - DNA, 22 bp, Homo sapiens
tcaaatgtttccttaaacatga

SEQ ID NO: 844522 - DNA, 16 bp, Homo sapiens
tcaaattagaagacat

SEQ ID NO: 844523 - DNA, 17 bp, Homo sapiens
tcaaattagaagacatt

SEQ ID NO: 844524 - DNA, 19 bp, Homo sapiens
tcaaattcaaggccttcca

SEQ ID NO: 844525 - DNA, 21 bp, Homo sapiens
tcaaattcttctgaactcaaa

SEQ ID NO: 844526 - DNA, 23 bp, Homo sapiens
tcaaattgaatttgcacggtttg

SEQ ID NO: 844527 - DNA, 12 bp, Homo sapiens
tcaaattgctgc

SEQ ID NO: 844528 - DNA, 18 bp, Homo sapiens
tcaaatttatttccaatg

SEQ ID NO: 844529 - DNA, 16 bp, Homo sapiens
tcaaatttattttaat

SEQ ID NO: 844530 - DNA, 21 bp, Homo sapiens
tcaaatttattttaatgtaaa

SEQ ID NO: 844531 - DNA, 13 bp, Homo sapiens
tcaaatttctaaa

SEQ ID NO: 844532 - DNA, 16 bp, Homo sapiens
tcaaatttctaaatct

SEQ ID NO: 844533 - DNA, 17 bp, Homo sapiens
tcaaatttctaaatctc

SEQ ID NO: 844534 - DNA, 15 bp, Homo sapiens
tcaaatttgccacca

SEQ ID NO: 844535 - DNA, 22 bp, Homo sapiens
tcaaatttgtacaggactgtaa

SEQ ID NO: 844536 - DNA, 22 bp, Homo sapiens
tcaaattttgccagagaaacta

SEQ ID NO: 844537 - DNA, 16 bp, Homo sapiens
tcaaattttttgactt

SEQ ID NO: 844538 - DNA, 15 bp, Homo sapiens
tcaacaaaaattgtc

SEQ ID NO: 844539 - DNA, 20 bp, Homo sapiens
tcaatatattgaacttttgt

SEQ ID NO: 844540 - DNA, 20 bp, Homo sapiens
tcaatatcccaacattctgc

SEQ ID NO: 844541 - DNA, 19 bp, Homo sapiens
tcaatatccctcttgtaag

SEQ ID NO: 844542 - DNA, 19 bp, Homo sapiens
tcaatatctaatatatatg

SEQ ID NO: 844543 - DNA, 17 bp, Homo sapiens
tcaatatgaatctataa

SEQ ID NO: 844544 - DNA, 17 bp, Homo sapiens
tcaatatgcaagcagct

SEQ ID NO: 844545 - DNA, 13 bp, Homo sapiens
tcaatatgcttac

SEQ ID NO: 844546 - DNA, 14 bp, Homo sapiens
tcaatattaaatac

SEQ ID NO: 844547 - DNA, 17 bp, Homo sapiens
tcaatattaaatacaga

SEQ ID NO: 844548 - DNA, 22 bp, Homo sapiens
tcaatattaaatacagacacta

SEQ ID NO: 844549 - DNA, 14 bp, Homo sapiens
tcaatattcctgaa

SEQ ID NO: 844550 - DNA, 18 bp, Homo sapiens
tcaatattcctgaatgaa

SEQ ID NO: 844551 - DNA, 15 bp, Homo sapiens
tcaatattgaatttt

SEQ ID NO: 844552 - DNA, 22 bp, Homo sapiens
tcaatattgaatttttcctatg

SEQ ID NO: 844553 - DNA, 17 bp, Homo sapiens
tcaatattgacatttgt

SEQ ID NO: 844554 - DNA, 17 bp, Homo sapiens
tcaatatttaaacatgg

SEQ ID NO: 844555 - DNA, 21 bp, Homo sapiens
tcaatatttagaaaattttgt

SEQ ID NO: 844556 - DNA, 12 bp, Homo sapiens
tcaatatttatt

SEQ ID NO: 844557 - DNA, 16 bp, Homo sapiens
tcaatatttttatatc

SEQ ID NO: 844558 - DNA, 22 bp, Homo sapiens
tcaatatttttatttttaactc

SEQ ID NO: 844559 - DNA, 21 bp, Homo sapiens
tcaatcaaataagtatttata

SEQ ID NO: 844560 - DNA, 14 bp, Homo sapiens
tcaatcaactttac

SEQ ID NO: 844561 - DNA, 18 bp, Homo sapiens
tcaatcaatggtgcaaaa

SEQ ID NO: 844562 - DNA, 15 bp, Homo sapiens
tcaatcactgctccc

SEQ ID NO: 844563 - DNA, 13 bp, Homo sapiens
tcaatcagccttt

SEQ ID NO: 844564 - DNA, 19 bp, Homo sapiens
tcaatcagtctcagaatgt

SEQ ID NO: 844565 - DNA, 22 bp, Homo sapiens
tcaatcagtctcagaatgtcat

SEQ ID NO: 844566 - DNA, 15 bp, Homo sapiens
tcaatcagtgcagtg

SEQ ID NO: 844567 - DNA, 16 bp, Homo sapiens
tcaatcatctgtgtga

SEQ ID NO: 844568 - DNA, 20 bp, Homo sapiens
tcaatcatctgtgtgaaaat

SEQ ID NO: 844569 - DNA, 13 bp, Homo sapiens
tcaatcattgaag

SEQ ID NO: 844570 - DNA, 22 bp, Homo sapiens
tcaatcattgaagtatattctt

SEQ ID NO: 844571 - DNA, 16 bp, Homo sapiens
tcaatcatttattcat

SEQ ID NO: 844572 - DNA, 15 bp, Homo sapiens
tcaatcccctcattc

SEQ ID NO: 844573 - DNA, 17 bp, Homo sapiens
tcaatcccctcattcag

SEQ ID NO: 844574 - DNA, 11 bp, Homo sapiens
tcaatctctgg

SEQ ID NO: 844575 - DNA, 20 bp, Homo sapiens
tcaatctctggaaaaataag

SEQ ID NO: 844576 - DNA, 13 bp, Homo sapiens
tcaatctgtaaac

SEQ ID NO: 844577 - DNA, 17 bp, Homo sapiens
tcaatctgtaaactgtg

SEQ ID NO: 844578 - DNA, 14 bp, Homo sapiens
tcaatcttgttact

SEQ ID NO: 844579 - DNA, 19 bp, Homo sapiens
tcaatcttgttactgctga

SEQ ID NO: 844580 - DNA, 12 bp, Homo sapiens
tcaatgaaaaat

SEQ ID NO: 844581 - DNA, 18 bp, Homo sapiens
tcaatgaaaaatgtaatt

SEQ ID NO: 844582 - DNA, 21 bp, Homo sapiens
tcaatgaagccagctcacagt

SEQ ID NO: 844583 - DNA, 16 bp, Homo sapiens
tcaatgaatccccgac

SEQ ID NO: 844584 - DNA, 17 bp, Homo sapiens
tcaatgaatccccgacc

SEQ ID NO: 844585 - DNA, 14 bp, Homo sapiens
tcaatgacctgtat

SEQ ID NO: 844586 - DNA, 15 bp, Homo sapiens
tcaatgacctgtatt

SEQ ID NO: 844587 - DNA, 13 bp, Homo sapiens
tcaatgagagcat

SEQ ID NO: 844588 - DNA, 14 bp, Homo sapiens
tcaatgagagcata

SEQ ID NO: 844589 - DNA, 19 bp, Homo sapiens
tcaatgagagcataattta

SEQ ID NO: 844590 - DNA, 16 bp, Homo sapiens
tcaatgaggtgtccaa

SEQ ID NO: 844591 - DNA, 20 bp, Homo sapiens
tcaatgcaagagtgattgca

SEQ ID NO: 844592 - DNA, 22 bp, Homo sapiens
tcaatgcatacaataaaagagc

SEQ ID NO: 844593 - DNA, 23 bp, Homo sapiens
tcaatgcatacaataaaagagct

SEQ ID NO: 844594 - DNA, 16 bp, Homo sapiens
tcaatgcattgtcttg

SEQ ID NO: 844595 - DNA, 16 bp, Homo sapiens
tcaatgccctgccatt

SEQ ID NO: 844596 - DNA, 22 bp, Homo sapiens
tcaatgcgttttgttgtagatg

SEQ ID NO: 844597 - DNA, 16 bp, Homo sapiens
tcaatgctgggccctc

SEQ ID NO: 844598 - DNA, 18 bp, Homo sapiens
tcaatgctgggccctctt

SEQ ID NO: 844599 - DNA, 20 bp, Homo sapiens
tcaatggatttgatgctgtt

SEQ ID NO: 844600 - DNA, 12 bp, Homo sapiens
tcaatggctttt

SEQ ID NO: 844601 - DNA, 14 bp, Homo sapiens
tcaatggggccagt

SEQ ID NO: 844602 - DNA, 11 bp, Homo sapiens
tcaatggtgca

SEQ ID NO: 844603 - DNA, 13 bp, Homo sapiens
tcaatggtgcaaa

SEQ ID NO: 844604 - DNA, 14 bp, Homo sapiens
tcaatggtgcaaaa

SEQ ID NO: 844605 - DNA, 22 bp, Homo sapiens
tcaatggtgcaaaaaaaaactt

SEQ ID NO: 844606 - DNA, 22 bp, Homo sapiens
tcaatgtacttgtttgaatatt

SEQ ID NO: 844607 - DNA, 15 bp, Homo sapiens
tcaatgtagtctgta

SEQ ID NO: 844608 - DNA, 12 bp, Homo sapiens
tcaatgtcttcc

SEQ ID NO: 844609 - DNA, 15 bp, Homo sapiens
tcaatgtcttcccac

SEQ ID NO: 844610 - DNA, 12 bp, Homo sapiens
tcaatgtgaaac

SEQ ID NO: 844611 - DNA, 15 bp, Homo sapiens
tcaatgtgattctaa

SEQ ID NO: 844612 - DNA, 16 bp, Homo sapiens
tcaatgtgattctaat

SEQ ID NO: 844613 - DNA, 16 bp, Homo sapiens
tcaatgtgtataaatt

SEQ ID NO: 844614 - DNA, 12 bp, Homo sapiens
tcaatgtgtgca

SEQ ID NO: 844615 - DNA, 17 bp, Homo sapiens
tcaatgtgttggaaact

SEQ ID NO: 844616 - DNA, 12 bp, Homo sapiens
tcaatgttcatt

SEQ ID NO: 844617 - DNA, 13 bp, Homo sapiens
tcaatgttcattg

SEQ ID NO: 844618 - DNA, 22 bp, Homo sapiens
tcaattaaaattacaaaagaga

SEQ ID NO: 844619 - DNA, 15 bp, Homo sapiens
tcaattaaagtctat

SEQ ID NO: 844620 - DNA, 19 bp, Homo sapiens
tcaattaaagtctattcaa

SEQ ID NO: 844621 - DNA, 12 bp, Homo sapiens
tcaattaaatgt

SEQ ID NO: 844622 - DNA, 16 bp, Homo sapiens
tcaattaaatgtaggt

SEQ ID NO: 844623 - DNA, 17 bp, Homo sapiens
tcaattaccagaaagat

SEQ ID NO: 844624 - DNA, 20 bp, Homo sapiens
tcaattagcgtttaaggtga

SEQ ID NO: 844625 - DNA, 21 bp, Homo sapiens
tcaattagtggtcataaaata

SEQ ID NO: 844626 - DNA, 19 bp, Homo sapiens
tcaattatattatgtttaa

SEQ ID NO: 844627 - DNA, 21 bp, Homo sapiens
tcaattattacatttatacat

SEQ ID NO: 844628 - DNA, 22 bp, Homo sapiens
tcaattcaaagctgtgtgtttg

SEQ ID NO: 844629 - DNA, 14 bp, Homo sapiens
tcaattcctctggg

SEQ ID NO: 844630 - DNA, 15 bp, Homo sapiens
tcaattcctctggga

SEQ ID NO: 844631 - DNA, 12 bp, Homo sapiens
tcaattctcaaa

SEQ ID NO: 844632 - DNA, 20 bp, Homo sapiens
tcaattctgtaattacatat

SEQ ID NO: 844633 - DNA, 13 bp, Homo sapiens
tcaattcttgaga

SEQ ID NO: 844634 - DNA, 14 bp, Homo sapiens
tcaattgacaaatg

SEQ ID NO: 844635 - DNA, 22 bp, Homo sapiens
tcaattgcatctcccagataat

SEQ ID NO: 844636 - DNA, 16 bp, Homo sapiens
tcaattggcagtgact

SEQ ID NO: 844637 - DNA, 18 bp, Homo sapiens
tcaattggcagtgacttt

SEQ ID NO: 844638 - DNA, 19 bp, Homo sapiens
tcaattggcagtgactttg

SEQ ID NO: 844639 - DNA, 23 bp, Homo sapiens
tcaattggcagtgactttgtata

SEQ ID NO: 844640 - DNA, 13 bp, Homo sapiens
tcaattgtaaatt

SEQ ID NO: 844641 - DNA, 13 bp, Homo sapiens
tcaattgtatttt

SEQ ID NO: 844642 - DNA, 14 bp, Homo sapiens
tcaattgtatttta

SEQ ID NO: 844643 - DNA, 17 bp, Homo sapiens
tcaattgtattttatat

SEQ ID NO: 844644 - DNA, 14 bp, Homo sapiens
tcaattgtcacttt

SEQ ID NO: 844645 - DNA, 15 bp, Homo sapiens
tcaattgttaatgtg

SEQ ID NO: 844646 - DNA, 15 bp, Homo sapiens
tcaatttaaataacc

SEQ ID NO: 844647 - DNA, 14 bp, Homo sapiens
tcaatttatttgaa

SEQ ID NO: 844648 - DNA, 17 bp, Homo sapiens
tcaatttcagtagtttg

SEQ ID NO: 844649 - DNA, 15 bp, Homo sapiens
tcaatttcattatca

SEQ ID NO: 844650 - DNA, 20 bp, Homo sapiens
tcaatttcctcatctgggtc

SEQ ID NO: 844651 - DNA, 12 bp, Homo sapiens
tcaatttggagc

SEQ ID NO: 844652 - DNA, 16 bp, Homo sapiens
tcaatttgtataaaat

SEQ ID NO: 844653 - DNA, 13 bp, Homo sapiens
tcaatttgtatat

SEQ ID NO: 844654 - DNA, 13 bp, Homo sapiens
tcaattttaaaca

SEQ ID NO: 844655 - DNA, 14 bp, Homo sapiens
tcaattttaaacat

SEQ ID NO: 844656 - DNA, 20 bp, Homo sapiens
tcaatttttcccagtatttt

SEQ ID NO: 844657 - DNA, 14 bp, Homo sapiens
tcacaaaaaagaag

SEQ ID NO: 844658 - DNA, 16 bp, Homo sapiens
tcacaaaaacaaaaaa

SEQ ID NO: 844659 - DNA, 20 bp, Homo sapiens
tcacaaaaacaaaaaaacta

SEQ ID NO: 844660 - DNA, 21 bp, Homo sapiens
tcacaaaaacaaaaaaactat

SEQ ID NO: 844661 - DNA, 16 bp, Homo sapiens
tcacaaaaatttgaac

SEQ ID NO: 844662 - DNA, 12 bp, Homo sapiens
tcacccatgtgc

SEQ ID NO: 844663 - DNA, 15 bp, Homo sapiens
tcacccattatctgg

SEQ ID NO: 844664 - DNA, 13 bp, Homo sapiens
tcaccccaatccc

SEQ ID NO: 844665 - DNA, 20 bp, Homo sapiens
tcaccccaatccctgccact

SEQ ID NO: 844666 - DNA, 12 bp, Homo sapiens
tcaccccacacc

SEQ ID NO: 844667 - DNA, 13 bp, Homo sapiens
tcaccccaccctt

SEQ ID NO: 844668 - DNA, 14 bp, Homo sapiens
tcaccccagaggac

SEQ ID NO: 844669 - DNA, 13 bp, Homo sapiens
tcaccccagcctc

SEQ ID NO: 844670 - DNA, 14 bp, Homo sapiens
tcaccccagcctca

SEQ ID NO: 844671 - DNA, 20 bp, Homo sapiens
tcaccccagctccgacctct

SEQ ID NO: 844672 - DNA, 12 bp, Homo sapiens
tcaccccatccc

SEQ ID NO: 844673 - DNA, 18 bp, Homo sapiens
tcacccccagctttgcta

SEQ ID NO: 844674 - DNA, 12 bp, Homo sapiens
tcacccccatcc

SEQ ID NO: 844675 - DNA, 15 bp, Homo sapiens
tcaccccctcccacc

SEQ ID NO: 844676 - DNA, 15 bp, Homo sapiens
tcaccccctcctggc

SEQ ID NO: 844677 - DNA, 13 bp, Homo sapiens
tcacccccttctc

SEQ ID NO: 844678 - DNA, 16 bp, Homo sapiens
tcacccccttctccat

SEQ ID NO: 844679 - DNA, 15 bp, Homo sapiens
tcacccctgggcagg

SEQ ID NO: 844680 - DNA, 15 bp, Homo sapiens
tcacccctgtttctg

SEQ ID NO: 844681 - DNA, 19 bp, Homo sapiens
tcacccgagttcctctggg

SEQ ID NO: 844682 - DNA, 15 bp, Homo sapiens
tcacccgcccctgga

SEQ ID NO: 844683 - DNA, 12 bp, Homo sapiens
tcaccctgcagg

SEQ ID NO: 844684 - DNA, 14 bp, Homo sapiens
tcaccctgcccgct

SEQ ID NO: 844685 - DNA, 23 bp, Homo sapiens
tcaccctggggatagtccttcct

SEQ ID NO: 844686 - DNA, 12 bp, Homo sapiens
tcaccctgtgac

SEQ ID NO: 844687 - DNA, 11 bp, Homo sapiens
tcaccctgtgg

SEQ ID NO: 844688 - DNA, 20 bp, Homo sapiens
tcaccctgtgggtgtctccc

SEQ ID NO: 844689 - DNA, 23 bp, Homo sapiens
tcaccctgtgggtgtctccctcg

SEQ ID NO: 844690 - DNA, 18 bp, Homo sapiens
tcacccttaacccaagga

SEQ ID NO: 844691 - DNA, 22 bp, Homo sapiens
tcacccttaacccaaggagcac

SEQ ID NO: 844692 - DNA, 23 bp, Homo sapiens
tcacccttaacccaaggagcaca

SEQ ID NO: 844693 - DNA, 19 bp, Homo sapiens
tcacccttcctggcccagg

SEQ ID NO: 844694 - DNA, 14 bp, Homo sapiens
tcacccttctgggc

SEQ ID NO: 844695 - DNA, 13 bp, Homo sapiens
tcaccctttgctg

SEQ ID NO: 844696 - DNA, 22 bp, Homo sapiens
tcaccctttgctgtgaggctgt

SEQ ID NO: 844697 - DNA, 19 bp, Homo sapiens
tcaccgacagcggccttga

SEQ ID NO: 844698 - DNA, 23 bp, Homo sapiens
tcaccgagagtagccgagagcct

SEQ ID NO: 844699 - DNA, 20 bp, Homo sapiens
tcaccgctggcccttagaga

SEQ ID NO: 844700 - DNA, 14 bp, Homo sapiens
tcaccgctgggtgg

SEQ ID NO: 844701 - DNA, 16 bp, Homo sapiens
tcaccggtcagtgcct

SEQ ID NO: 844702 - DNA, 19 bp, Homo sapiens
tcaccgtgggctccctgac

SEQ ID NO: 844703 - DNA, 17 bp, Homo sapiens
tcacctaagtctctgtg

SEQ ID NO: 844704 - DNA, 22 bp, Homo sapiens
tcacctaatgtttatgagccag

SEQ ID NO: 844705 - DNA, 22 bp, Homo sapiens
tcacctacatatgctgatcttt

SEQ ID NO: 844706 - DNA, 17 bp, Homo sapiens
tcacctagaacgtgcat

SEQ ID NO: 844707 - DNA, 13 bp, Homo sapiens
tcacctagagcca

SEQ ID NO: 844708 - DNA, 22 bp, Homo sapiens
tcacctagcaacatatctctgc

SEQ ID NO: 844709 - DNA, 16 bp, Homo sapiens
tcacctagcagcctca

SEQ ID NO: 844710 - DNA, 16 bp, Homo sapiens
tcacctatgttatttt

SEQ ID NO: 844711 - DNA, 13 bp, Homo sapiens
tcacctcagagtg

SEQ ID NO: 844712 - DNA, 18 bp, Homo sapiens
tcacctcagcctggagag

SEQ ID NO: 844713 - DNA, 17 bp, Homo sapiens
tcacctcagtagaaaag

SEQ ID NO: 844714 - DNA, 20 bp, Homo sapiens
tcacctcatgcccaccccct

SEQ ID NO: 844715 - DNA, 23 bp, Homo sapiens
tcacctcatgcccaccccctgcc

SEQ ID NO: 844716 - DNA, 15 bp, Homo sapiens
tcacctcattctgaa

SEQ ID NO: 844717 - DNA, 19 bp, Homo sapiens
tcacctccaagcatttcat

SEQ ID NO: 844718 - DNA, 15 bp, Homo sapiens
tcacctcccccatct

SEQ ID NO: 844719 - DNA, 18 bp, Homo sapiens
tcacctcccgaagccacc

SEQ ID NO: 844720 - DNA, 17 bp, Homo sapiens
tcacctccctgctcagt

SEQ ID NO: 844721 - DNA, 23 bp, Homo sapiens
tcacctccctgctcagtgcttgg

SEQ ID NO: 844722 - DNA, 11 bp, Homo sapiens
tcacctcctaa

SEQ ID NO: 844723 - DNA, 16 bp, Homo sapiens
tcacctcctccactca

SEQ ID NO: 844724 - DNA, 19 bp, Homo sapiens
tcacctcctccactcactc

SEQ ID NO: 844725 - DNA, 20 bp, Homo sapiens
tcacctcctccactcactcc

SEQ ID NO: 844726 - DNA, 21 bp, Homo sapiens
tcacctcctccactcactcca

SEQ ID NO: 844727 - DNA, 22 bp, Homo sapiens
tcacctcctctaaggttgggca

SEQ ID NO: 844728 - DNA, 22 bp, Homo sapiens
tcacctcgtctccctggtgcct

SEQ ID NO: 844729 - DNA, 18 bp, Homo sapiens
tcacctctacccaaaccc

SEQ ID NO: 844730 - DNA, 21 bp, Homo sapiens
tcacctctactgtctcctccc

SEQ ID NO: 844731 - DNA, 14 bp, Homo sapiens
tcacctctgaggac

SEQ ID NO: 844732 - DNA, 16 bp, Homo sapiens
tcacctctgaggacag

SEQ ID NO: 844733 - DNA, 23 bp, Homo sapiens
tcacctctgatagactttgtgaa

SEQ ID NO: 844734 - DNA, 14 bp, Homo sapiens
tcacctctgcctca

SEQ ID NO: 844735 - DNA, 16 bp, Homo sapiens
tcacctcttcctctgg

SEQ ID NO: 844736 - DNA, 20 bp, Homo sapiens
tcacctgaaacactggacct

SEQ ID NO: 844737 - DNA, 13 bp, Homo sapiens
tcacctgcaagcc

SEQ ID NO: 844738 - DNA, 15 bp, Homo sapiens
tcacctgcaagcccc

SEQ ID NO: 844739 - DNA, 17 bp, Homo sapiens
tcacctgcaagccccag

SEQ ID NO: 844740 - DNA, 18 bp, Homo sapiens
tcacctgcaagccccagg

SEQ ID NO: 844741 - DNA, 21 bp, Homo sapiens
tcacctgcaagccccagggcc

SEQ ID NO: 844742 - DNA, 23 bp, Homo sapiens
tcacctgcaagccccagggcctg

SEQ ID NO: 844743 - DNA, 13 bp, Homo sapiens
tcacctgcagaga

SEQ ID NO: 844744 - DNA, 15 bp, Homo sapiens
tcacctgcagagaaa

SEQ ID NO: 844745 - DNA, 16 bp, Homo sapiens
tcacctgcagagaaac

SEQ ID NO: 844746 - DNA, 16 bp, Homo sapiens
tcacctgccccaactc

SEQ ID NO: 844747 - DNA, 16 bp, Homo sapiens
tcacctgcccctctgt

SEQ ID NO: 844748 - DNA, 13 bp, Homo sapiens
tcacctgctcaca

SEQ ID NO: 844749 - DNA, 13 bp, Homo sapiens
tcacctgctccag

SEQ ID NO: 844750 - DNA, 21 bp, Homo sapiens
tcacctgctccagaagatgcc

SEQ ID NO: 844751 - DNA, 17 bp, Homo sapiens
tcacctgctggcccctc

SEQ ID NO: 844752 - DNA, 20 bp, Homo sapiens
tcacctgctggcccctcacc

SEQ ID NO: 844753 - DNA, 21 bp, Homo sapiens
tcacctgctggcccctcacct

SEQ ID NO: 844754 - DNA, 16 bp, Homo sapiens
tcacctggccctgctt

SEQ ID NO: 844755 - DNA, 19 bp, Homo sapiens
tcacctggctgctaggcca

SEQ ID NO: 844756 - DNA, 19 bp, Homo sapiens
tcacctgggccctggagga

SEQ ID NO: 844757 - DNA, 13 bp, Homo sapiens
tcacctgggcctt

SEQ ID NO: 844758 - DNA, 19 bp, Homo sapiens
tcacctgtaaacctgagtc

SEQ ID NO: 844759 - DNA, 18 bp, Homo sapiens
tcacctgtactcttccga

SEQ ID NO: 844760 - DNA, 21 bp, Homo sapiens
tcacctgtgcttcgggccctt

SEQ ID NO: 844761 - DNA, 20 bp, Homo sapiens
tcacctgtttttaagctgtt

SEQ ID NO: 844762 - DNA, 22 bp, Homo sapiens
tcacctgtttttaagctgtttc

SEQ ID NO: 844763 - DNA, 19 bp, Homo sapiens
tcaccttcaaaatgttcta

SEQ ID NO: 844764 - DNA, 12 bp, Homo sapiens
tcaccttccctt

SEQ ID NO: 844765 - DNA, 15 bp, Homo sapiens
tcaccttcctgtggg

SEQ ID NO: 844766 - DNA, 12 bp, Homo sapiens
tcaccttcgagt

SEQ ID NO: 844767 - DNA, 17 bp, Homo sapiens
tcaccttcgagtagaga

SEQ ID NO: 844768 - DNA, 20 bp, Homo sapiens
tcaccttgccgagagaggcg

SEQ ID NO: 844769 - DNA, 13 bp, Homo sapiens
tcaccttgtattc

SEQ ID NO: 844770 - DNA, 14 bp, Homo sapiens
tcacctttcccatc

SEQ ID NO: 844771 - DNA, 20 bp, Homo sapiens
tcacctttcctctccctcag

SEQ ID NO: 844772 - DNA, 21 bp, Homo sapiens
tcacctttcctctccctcagg

SEQ ID NO: 844773 - DNA, 20 bp, Homo sapiens
tcacctttctgggctttctc

SEQ ID NO: 844774 - DNA, 22 bp, Homo sapiens
tcacctttctgggctttctcct

SEQ ID NO: 844775 - DNA, 14 bp, Homo sapiens
tcacctttggtgca

SEQ ID NO: 844776 - DNA, 14 bp, Homo sapiens
tcacctttgtaaga

SEQ ID NO: 844777 - DNA, 22 bp, Homo sapiens
tcacctttgtaagacatttgta

SEQ ID NO: 844778 - DNA, 17 bp, Homo sapiens
tcaccttttctgtggct

SEQ ID NO: 844779 - DNA, 22 bp, Homo sapiens
tcaccttttctgtggctggctc

SEQ ID NO: 844780 - DNA, 16 bp, Homo sapiens
tcacgaagtgttgcat

SEQ ID NO: 844781 - DNA, 18 bp, Homo sapiens
tcacgacaggaaaaaggt

SEQ ID NO: 844782 - DNA, 14 bp, Homo sapiens
tcacgactcttcct

SEQ ID NO: 844783 - DNA, 23 bp, Homo sapiens
tcacgagcctttgtttttctcca

SEQ ID NO: 844784 - DNA, 10 bp, Homo sapiens
tcacttgagt

SEQ ID NO: 844785 - DNA, 14 bp, Homo sapiens
tcacttgatgatac

SEQ ID NO: 844786 - DNA, 19 bp, Homo sapiens
tcacttgatgtgccatttt

SEQ ID NO: 844787 - DNA, 15 bp, Homo sapiens
tcacttgattcatct

SEQ ID NO: 844788 - DNA, 20 bp, Homo sapiens
tcacttgattcatctctggt

SEQ ID NO: 844789 - DNA, 14 bp, Homo sapiens
tcacttgccatgca

SEQ ID NO: 844790 - DNA, 19 bp, Homo sapiens
tcacttgccattgccagga

SEQ ID NO: 844791 - DNA, 22 bp, Homo sapiens
tcacttgccattgccaggagat

SEQ ID NO: 844792 - DNA, 15 bp, Homo sapiens
tcacttgctctttga

SEQ ID NO: 844793 - DNA, 22 bp, Homo sapiens
tcacttgctgccagcagtttgt

SEQ ID NO: 844794 - DNA, 21 bp, Homo sapiens
tcacttgggagctgctgggct

SEQ ID NO: 844795 - DNA, 9 bp, Homo sapiens
tcacttgta

SEQ ID NO: 844796 - DNA, 13 bp, Homo sapiens
tcacttgtacaaa

SEQ ID NO: 844797 - DNA, 14 bp, Homo sapiens
tcacttgtacaaaa

SEQ ID NO: 844798 - DNA, 18 bp, Homo sapiens
tcacttgtattgacttta

SEQ ID NO: 844799 - DNA, 16 bp, Homo sapiens
tcacttgtcgggggcc

SEQ ID NO: 844800 - DNA, 13 bp, Homo sapiens
tcacttgtctcct

SEQ ID NO: 844801 - DNA, 17 bp, Homo sapiens
tcacttgtgcagtgttg

SEQ ID NO: 844802 - DNA, 18 bp, Homo sapiens
tcacttgtgctttgctct

SEQ ID NO: 844803 - DNA, 15 bp, Homo sapiens
tcacttgttgtttta

SEQ ID NO: 844804 - DNA, 21 bp, Homo sapiens
tcacttgttgttttactaaag

SEQ ID NO: 844805 - DNA, 22 bp, Homo sapiens
tcacttgttgttttactaaaga

SEQ ID NO: 844806 - DNA, 20 bp, Homo sapiens
tcactttattacaagatctt

SEQ ID NO: 844807 - DNA, 12 bp, Homo sapiens
tcactttcataa

SEQ ID NO: 844808 - DNA, 14 bp, Homo sapiens
tcactttcattttt

SEQ ID NO: 844809 - DNA, 14 bp, Homo sapiens
tcactttctgtcta

SEQ ID NO: 844810 - DNA, 20 bp, Homo sapiens
tcactttgccattatgcaaa

SEQ ID NO: 844811 - DNA, 16 bp, Homo sapiens
tcactttgctctgggt

SEQ ID NO: 844812 - DNA, 17 bp, Homo sapiens
tcactttggttggaact

SEQ ID NO: 844813 - DNA, 19 bp, Homo sapiens
tcactttgtctaactcaga

SEQ ID NO: 844814 - DNA, 13 bp, Homo sapiens
tcactttgtgaat

SEQ ID NO: 844815 - DNA, 23 bp, Homo sapiens
tcactttgtgtattaaatggttt

SEQ ID NO: 844816 - DNA, 16 bp, Homo sapiens
tcacttttagttggca

SEQ ID NO: 844817 - DNA, 15 bp, Homo sapiens
tcacttttcaatttg

SEQ ID NO: 844818 - DNA, 14 bp, Homo sapiens
tcacttttcacttg

SEQ ID NO: 844819 - DNA, 15 bp, Homo sapiens
tcacttttcacttgt

SEQ ID NO: 844820 - DNA, 15 bp, Homo sapiens
tcacttttcatcctt

SEQ ID NO: 844821 - DNA, 18 bp, Homo sapiens
tcacttttcctccctcag

SEQ ID NO: 844822 - DNA, 16 bp, Homo sapiens
tcacttttccttttct

SEQ ID NO: 844823 - DNA, 17 bp, Homo sapiens
tcacttttccttttctt

SEQ ID NO: 844824 - DNA, 21 bp, Homo sapiens
tcacttttgctccgaagctac

SEQ ID NO: 844825 - DNA, 18 bp, Homo sapiens
tcacttttgttgcccagg

SEQ ID NO: 844826 - DNA, 20 bp, Homo sapiens
tcacttttgttgcccaggct

SEQ ID NO: 844827 - DNA, 22 bp, Homo sapiens
tcacttttgttgcccaggctgg

SEQ ID NO: 844828 - DNA, 17 bp, Homo sapiens
tcactttttctgataaa

SEQ ID NO: 844829 - DNA, 23 bp, Homo sapiens
tcagaaaacaacttggcatttct

SEQ ID NO: 844830 - DNA, 15 bp, Homo sapiens
tcagaaaagctatta

SEQ ID NO: 844831 - DNA, 15 bp, Homo sapiens
tcagaaaatgttctg

SEQ ID NO: 844832 - DNA, 23 bp, Homo sapiens
tcagaaaatgttctgtttgctgt

SEQ ID NO: 844833 - DNA, 18 bp, Homo sapiens
tcagaaacagggcagcag

SEQ ID NO: 844834 - DNA, 18 bp, Homo sapiens
tcagaaacatcagttact

SEQ ID NO: 844835 - DNA, 18 bp, Homo sapiens
tcagaaacttgtgaagtg

SEQ ID NO: 844836 - DNA, 14 bp, Homo sapiens
tcagaaagagcaag

SEQ ID NO: 844837 - DNA, 23 bp, Homo sapiens
tcagaaagagcaagtctggatct

SEQ ID NO: 844838 - DNA, 18 bp, Homo sapiens
tcagaaaggggctcttct

SEQ ID NO: 844839 - DNA, 19 bp, Homo sapiens
tcagaaaggggctcttctg

SEQ ID NO: 844840 - DNA, 15 bp, Homo sapiens
tcagaaagtgcctga

SEQ ID NO: 844841 - DNA, 12 bp, Homo sapiens
tcagaaatatgt

SEQ ID NO: 844842 - DNA, 16 bp, Homo sapiens
tcagaaatgctgcctg

SEQ ID NO: 844843 - DNA, 17 bp, Homo sapiens
tcagaaatgctgcctgc

SEQ ID NO: 844844 - DNA, 19 bp, Homo sapiens
tcagaaatgctgcctgcct

SEQ ID NO: 844845 - DNA, 14 bp, Homo sapiens
tcagaaattaaaat

SEQ ID NO: 844846 - DNA, 16 bp, Homo sapiens
tcagaaattaaaatat

SEQ ID NO: 844847 - DNA, 21 bp, Homo sapiens
tcagaaattccaactcctgat

SEQ ID NO: 844848 - DNA, 22 bp, Homo sapiens
tcagaaattccaactcctgatg

SEQ ID NO: 844849 - DNA, 18 bp, Homo sapiens
tcagaaattggaacagaa

SEQ ID NO: 844850 - DNA, 21 bp, Homo sapiens
tcagaaattggaacagaatgt

SEQ ID NO: 844851 - DNA, 13 bp, Homo sapiens
tcagaacatgtta

SEQ ID NO: 844852 - DNA, 23 bp, Homo sapiens
tcagaaccagagggcatgctgaa

SEQ ID NO: 844853 - DNA, 12 bp, Homo sapiens
tcagaaccattt

SEQ ID NO: 844854 - DNA, 16 bp, Homo sapiens
tcagaacctcttcccc

SEQ ID NO: 844855 - DNA, 20 bp, Homo sapiens
tcagaacctcttccccagaa

SEQ ID NO: 844856 - DNA, 12 bp, Homo sapiens
tcagaaccttgt

SEQ ID NO: 844857 - DNA, 16 bp, Homo sapiens
tcagaactaactttgg

SEQ ID NO: 844858 - DNA, 18 bp, Homo sapiens
tcagaactatttaaaata

SEQ ID NO: 844859 - DNA, 21 bp, Homo sapiens
tcagaactatttaaaataaag

SEQ ID NO: 844860 - DNA, 17 bp, Homo sapiens
tcagaactgcagggcct

SEQ ID NO: 844861 - DNA, 15 bp, Homo sapiens
tcagaactgtcccat

SEQ ID NO: 844862 - DNA, 18 bp, Homo sapiens
tcagaactgtcccatccc

SEQ ID NO: 844863 - DNA, 14 bp, Homo sapiens
tcagaactgtgcca

SEQ ID NO: 844864 - DNA, 13 bp, Homo sapiens
tcagaacttgctg

SEQ ID NO: 844865 - DNA, 17 bp, Homo sapiens
tcagaacttgctgctgt

SEQ ID NO: 844866 - DNA, 19 bp, Homo sapiens
tcagaacttgctgctgtct

SEQ ID NO: 844867 - DNA, 23 bp, Homo sapiens
tcagaagaacatgattttacaag

SEQ ID NO: 844868 - DNA, 15 bp, Homo sapiens
tcagaagaagtggga

SEQ ID NO: 844869 - DNA, 17 bp, Homo sapiens
tcagaagaagtgggagc

SEQ ID NO: 844870 - DNA, 22 bp, Homo sapiens
tcagaagaagtgggagcagctt

SEQ ID NO: 844871 - DNA, 12 bp, Homo sapiens
tcagaagagact

SEQ ID NO: 844872 - DNA, 12 bp, Homo sapiens
tcagaagataac

SEQ ID NO: 844873 - DNA, 20 bp, Homo sapiens
tcagaagatagtcttggaag

SEQ ID NO: 844874 - DNA, 14 bp, Homo sapiens
tcagaagcaagcca

SEQ ID NO: 844875 - DNA, 17 bp, Homo sapiens
tcagaagcaagccagac

SEQ ID NO: 844876 - DNA, 19 bp, Homo sapiens
tcagaagcaagccagacct

SEQ ID NO: 844877 - DNA, 23 bp, Homo sapiens
tcagaagcctccaagcctgcctc

SEQ ID NO: 844878 - DNA, 13 bp, Homo sapiens
tcagaagcctgag

SEQ ID NO: 844879 - DNA, 23 bp, Homo sapiens
tcagaaggagaaggaaggagact

SEQ ID NO: 844880 - DNA, 22 bp, Homo sapiens
tcagaaggtatcagttatatga

SEQ ID NO: 844881 - DNA, 15 bp, Homo sapiens
tcagaagtcatcttg

SEQ ID NO: 844882 - DNA, 23 bp, Homo sapiens
tcagaagtgatttagttgtggaa

SEQ ID NO: 844883 - DNA, 19 bp, Homo sapiens
tcagaagtttctcagctcc

SEQ ID NO: 844884 - DNA, 17 bp, Homo sapiens
tcagaagtttggcaata

SEQ ID NO: 844885 - DNA, 23 bp, Homo sapiens
tcagaataaattgatcctttgat

SEQ ID NO: 844886 - DNA, 15 bp, Homo sapiens
tcagaataaggcagg

SEQ ID NO: 844887 - DNA, 21 bp, Homo sapiens
tcagaatagccacatttggaa

SEQ ID NO: 844888 - DNA, 15 bp, Homo sapiens
tcagaataggaaaac

SEQ ID NO: 844889 - DNA, 17 bp, Homo sapiens
tcagaatccttggctga

SEQ ID NO: 844890 - DNA, 18 bp, Homo sapiens
tcagaatctcaaataact

SEQ ID NO: 844891 - DNA, 19 bp, Homo sapiens
tcagaatctcaaataacta

SEQ ID NO: 844892 - DNA, 21 bp, Homo sapiens
tcagaatctctctactcagat

SEQ ID NO: 844893 - DNA, 16 bp, Homo sapiens
tcagaatctttgttaa

SEQ ID NO: 844894 - DNA, 21 bp, Homo sapiens
tcagaatgaaccctcctcctt

SEQ ID NO: 844895 - DNA, 13 bp, Homo sapiens
tcagaatgatttg

SEQ ID NO: 844896 - DNA, 20 bp, Homo sapiens
tcagaatggaatccatctgt

SEQ ID NO: 844897 - DNA, 19 bp, Homo sapiens
tcagaatgggggctttcgg

SEQ ID NO: 844898 - DNA, 23 bp, Homo sapiens
tcagaattaaacttttaattcat

SEQ ID NO: 844899 - DNA, 18 bp, Homo sapiens
tcagaattaagcagaaca

SEQ ID NO: 844900 - DNA, 19 bp, Homo sapiens
tcagaattatccattacgt

SEQ ID NO: 844901 - DNA, 22 bp, Homo sapiens
tcagaattatccattacgtgca

SEQ ID NO: 844902 - DNA, 16 bp, Homo sapiens
tcagaattatttttaa

SEQ ID NO: 844903 - DNA, 18 bp, Homo sapiens
tcagaattcggtgtgctg

SEQ ID NO: 844904 - DNA, 23 bp, Homo sapiens
tcagaattcggtgtgctgccaac

SEQ ID NO: 844905 - DNA, 20 bp, Homo sapiens
tcagaattggcataatttgt

SEQ ID NO: 844906 - DNA, 19 bp, Homo sapiens
tcagcccccaccaggggaa

SEQ ID NO: 844907 - DNA, 14 bp, Homo sapiens
tcagcccccagcct

SEQ ID NO: 844908 - DNA, 16 bp, Homo sapiens
tcagccccgacttcct

SEQ ID NO: 844909 - DNA, 22 bp, Homo sapiens
tcagccccgacttcctgactct

SEQ ID NO: 844910 - DNA, 16 bp, Homo sapiens
tcagccccgagctgtc

SEQ ID NO: 844911 - DNA, 19 bp, Homo sapiens
tcagccccgcctgtcacaa

SEQ ID NO: 844912 - DNA, 22 bp, Homo sapiens
tcagccccgcctgtcacaataa

SEQ ID NO: 844913 - DNA, 16 bp, Homo sapiens
tcagcccctacccctg

SEQ ID NO: 844914 - DNA, 22 bp, Homo sapiens
tcagcccctacccctgccctgc

SEQ ID NO: 844915 - DNA, 16 bp, Homo sapiens
tcagcccctagtgcta

SEQ ID NO: 844916 - DNA, 12 bp, Homo sapiens
tcagcccctcct

SEQ ID NO: 844917 - DNA, 13 bp, Homo sapiens
tcagcccctcctc

SEQ ID NO: 844918 - DNA, 18 bp, Homo sapiens
tcagcccctcctctgcca

SEQ ID NO: 844919 - DNA, 19 bp, Homo sapiens
tcagcccctcctctgccac

SEQ ID NO: 844920 - DNA, 21 bp, Homo sapiens
tcagcccctcctctgccacct

SEQ ID NO: 844921 - DNA, 22 bp, Homo sapiens
tcagcccctcttgccccccacc

SEQ ID NO: 844922 - DNA, 17 bp, Homo sapiens
tcagcccgaatgcctgt

SEQ ID NO: 844923 - DNA, 18 bp, Homo sapiens
tcagcccgtttcagaagg

SEQ ID NO: 844924 - DNA, 23 bp, Homo sapiens
tcagccctagggtggagagccac

SEQ ID NO: 844925 - DNA, 13 bp, Homo sapiens
tcagccctcagtt

SEQ ID NO: 844926 - DNA, 24 bp, Homo sapiens
tcagccctcagttccttcatttcc

SEQ ID NO: 844927 - DNA, 14 bp, Homo sapiens
tcagccctccctgc

SEQ ID NO: 844928 - DNA, 19 bp, Homo sapiens
tcagccctccctgcccctc

SEQ ID NO: 844929 - DNA, 13 bp, Homo sapiens
tcagccctgaggt

SEQ ID NO: 844930 - DNA, 13 bp, Homo sapiens
tcagccctggcca

SEQ ID NO: 844931 - DNA, 14 bp, Homo sapiens
tcagccctggcctt

SEQ ID NO: 844932 - DNA, 15 bp, Homo sapiens
tcagccctggccttt

SEQ ID NO: 844933 - DNA, 13 bp, Homo sapiens
tcagccctgtgtc

SEQ ID NO: 844934 - DNA, 14 bp, Homo sapiens
tcagccctgtgtct

SEQ ID NO: 844935 - DNA, 20 bp, Homo sapiens
tcagccctgtgtctgtcaca

SEQ ID NO: 844936 - DNA, 16 bp, Homo sapiens
tcagcccttatggcca

SEQ ID NO: 844937 - DNA, 18 bp, Homo sapiens
tcagcctagccgacctca

SEQ ID NO: 844938 - DNA, 22 bp, Homo sapiens
tcagcctagccgacctcagcct

SEQ ID NO: 844939 - DNA, 23 bp, Homo sapiens
tcagcctccaaagtggagctggg

SEQ ID NO: 844940 - DNA, 18 bp, Homo sapiens
tcagcctcccaaagtgct

SEQ ID NO: 844941 - DNA, 22 bp, Homo sapiens
tcagcctcccaaagtgctggga

SEQ ID NO: 844942 - DNA, 23 bp, Homo sapiens
tcagcctcccaagtagctgggat

SEQ ID NO: 844943 - DNA, 13 bp, Homo sapiens
tcagcctcccctt

SEQ ID NO: 844944 - DNA, 20 bp, Homo sapiens
tcagcctccccttcttcccg

SEQ ID NO: 844945 - DNA, 23 bp, Homo sapiens
tcagcctccccttcttcccgccc

SEQ ID NO: 844946 - DNA, 23 bp, Homo sapiens
tcagcctcccgagtagctgggat

SEQ ID NO: 844947 - DNA, 20 bp, Homo sapiens
tcagcctccggagtagctgg

SEQ ID NO: 844948 - DNA, 20 bp, Homo sapiens
tcagcctcctgagcctgtgg

SEQ ID NO: 844949 - DNA, 22 bp, Homo sapiens
tcagcctcctgagcctgtgggt

SEQ ID NO: 844950 - DNA, 13 bp, Homo sapiens
tcagcctctgcaa

SEQ ID NO: 844951 - DNA, 15 bp, Homo sapiens
tcagcctcttctctg

SEQ ID NO: 844952 - DNA, 17 bp, Homo sapiens
tcagcctcttctctgca

SEQ ID NO: 844953 - DNA, 10 bp, Homo sapiens
tcagcctgag

SEQ ID NO: 844954 - DNA, 13 bp, Homo sapiens
tcagcctgaggct

SEQ ID NO: 844955 - DNA, 18 bp, Homo sapiens
tcagcctgaggctgagac

SEQ ID NO: 844956 - DNA, 15 bp, Homo sapiens
tcagcctgagtctcc

SEQ ID NO: 844957 - DNA, 16 bp, Homo sapiens
tcagcctgagtctcct

SEQ ID NO: 844958 - DNA, 12 bp, Homo sapiens
tcagcctgccca

SEQ ID NO: 844959 - DNA, 14 bp, Homo sapiens
tcagcctgcccacc

SEQ ID NO: 844960 - DNA, 18 bp, Homo sapiens
tcagcctgctccagctgt

SEQ ID NO: 844961 - DNA, 22 bp, Homo sapiens
tcagcctgctgcccaggctgtg

SEQ ID NO: 844962 - DNA, 18 bp, Homo sapiens
tcagcctggagaggcctg

SEQ ID NO: 844963 - DNA, 19 bp, Homo sapiens
tcagcctggagaggcctgg

SEQ ID NO: 844964 - DNA, 22 bp, Homo sapiens
tcagcctggagaggcctggggt

SEQ ID NO: 844965 - DNA, 12 bp, Homo sapiens
tcagcctgggca

SEQ ID NO: 844966 - DNA, 12 bp, Homo sapiens
tcagcctggggc

SEQ ID NO: 844967 - DNA, 19 bp, Homo sapiens
tcagcctggggctctctga

SEQ ID NO: 844968 - DNA, 14 bp, Homo sapiens
tcagcctgtctcgg

SEQ ID NO: 844969 - DNA, 20 bp, Homo sapiens
tcagcctgtctcgggctgac

SEQ ID NO: 844970 - DNA, 23 bp, Homo sapiens
tcagccttccccttgcccagggc

SEQ ID NO: 844971 - DNA, 20 bp, Homo sapiens
tcagccttcgtgtggctcct

SEQ ID NO: 844972 - DNA, 20 bp, Homo sapiens
tcagccttctgagtagctgg

SEQ ID NO: 844973 - DNA, 19 bp, Homo sapiens
tcagccttctttttctgga

SEQ ID NO: 844974 - DNA, 20 bp, Homo sapiens
tcagccttctttttctggac

SEQ ID NO: 844975 - DNA, 21 bp, Homo sapiens
tcagccttctttttctggact

SEQ ID NO: 844976 - DNA, 13 bp, Homo sapiens
tcagccttgcaca

SEQ ID NO: 844977 - DNA, 22 bp, Homo sapiens
tcagccttggataatgctgttg

SEQ ID NO: 844978 - DNA, 15 bp, Homo sapiens
tcagcctttgttaac

SEQ ID NO: 844979 - DNA, 16 bp, Homo sapiens
tcagcctttgttaacc

SEQ ID NO: 844980 - DNA, 22 bp, Homo sapiens
tcagcgaagacgggaggaaaga

SEQ ID NO: 844981 - DNA, 19 bp, Homo sapiens
tcagcgactccgttggcca

SEQ ID NO: 844982 - DNA, 22 bp, Homo sapiens
tcagcgactggatgctcgccat

SEQ ID NO: 844983 - DNA, 14 bp, Homo sapiens
tcagcgagaggcag

SEQ ID NO: 844984 - DNA, 20 bp, Homo sapiens
tcagcgatgtatataagcca

SEQ ID NO: 844985 - DNA, 21 bp, Homo sapiens
tcagcgatgtatgcagctatc

SEQ ID NO: 844986 - DNA, 16 bp, Homo sapiens
tcagcgcaccaaaact

SEQ ID NO: 844987 - DNA, 15 bp, Homo sapiens
tcagcgcaggctgca

SEQ ID NO: 844988 - DNA, 14 bp, Homo sapiens
tcagcggctccagc

SEQ ID NO: 844989 - DNA, 17 bp, Homo sapiens
tcagcgggagccagtgg

SEQ ID NO: 844990 - DNA, 18 bp, Homo sapiens
tcagcgggcgctgctggg

SEQ ID NO: 844991 - DNA, 20 bp, Homo sapiens
tcagcgggtctcctcccagc

SEQ ID NO: 844992 - DNA, 16 bp, Homo sapiens
tcagctaaatgcaggg

SEQ ID NO: 844993 - DNA, 14 bp, Homo sapiens
tcagctaagctcac

SEQ ID NO: 844994 - DNA, 14 bp, Homo sapiens
tcagctactgattt

SEQ ID NO: 844995 - DNA, 19 bp, Homo sapiens
tcagctatttactgccaaa

SEQ ID NO: 844996 - DNA, 17 bp, Homo sapiens
tcagctcaggcagctcg

SEQ ID NO: 844997 - DNA, 19 bp, Homo sapiens
tcagctcaggcagctcgag

SEQ ID NO: 844998 - DNA, 24 bp, Homo sapiens
tcagctcatttaatcccaggaaag

SEQ ID NO: 844999 - DNA, 12 bp, Homo sapiens
tcagctccagct

SEQ ID NO: 845000 - DNA, 23 bp, Homo sapiens
tcagctccagggaatccaagcct

SEQ ID NO: 845001 - DNA, 14 bp, Homo sapiens
tcagctccaggtgg

SEQ ID NO: 845002 - DNA, 23 bp, Homo sapiens
tcagctcctgagtagctgggcct

SEQ ID NO: 845003 - DNA, 14 bp, Homo sapiens
tcagctctcctggc

SEQ ID NO: 845004 - DNA, 19 bp, Homo sapiens
tcagctctcctggctccct

SEQ ID NO: 845005 - DNA, 20 bp, Homo sapiens
tcagctctcctggctccctc

SEQ ID NO: 845006 - DNA, 15 bp, Homo sapiens
tcagctctctgccct

SEQ ID NO: 845007 - DNA, 15 bp, Homo sapiens
tcagctctctgctgg

SEQ ID NO: 845008 - DNA, 14 bp, Homo sapiens
tcagctctctggga

SEQ ID NO: 845009 - DNA, 16 bp, Homo sapiens
tcagctctgaaagaga

SEQ ID NO: 845010 - DNA, 21 bp, Homo sapiens
tcagctctgaaagagaaacac

SEQ ID NO: 845011 - DNA, 16 bp, Homo sapiens
tcagctctgacattct

SEQ ID NO: 845012 - DNA, 16 bp, Homo sapiens
tcagctctgggagagg

SEQ ID NO: 845013 - DNA, 17 bp, Homo sapiens
tcagctctgggagagga

SEQ ID NO: 845014 - DNA, 17 bp, Homo sapiens
tcagctctggtccaggc

SEQ ID NO: 845015 - DNA, 16 bp, Homo sapiens
tcagctcttccatgat

SEQ ID NO: 845016 - DNA, 15 bp, Homo sapiens
tcagctctttccaaa

SEQ ID NO: 845017 - DNA, 13 bp, Homo sapiens
tcagctctttttg

SEQ ID NO: 845018 - DNA, 15 bp, Homo sapiens
tcagctgaacctggg

SEQ ID NO: 845019 - DNA, 15 bp, Homo sapiens
tcagctgcacattcc

SEQ ID NO: 845020 - DNA, 16 bp, Homo sapiens
tcagctgcacattcct

SEQ ID NO: 845021 - DNA, 17 bp, Homo sapiens
tcagctgcacattcctg

SEQ ID NO: 845022 - DNA, 17 bp, Homo sapiens
tcagctgcatggagcct

SEQ ID NO: 845023 - DNA, 18 bp, Homo sapiens
tcagctgcatggagcctg

SEQ ID NO: 845024 - DNA, 14 bp, Homo sapiens
tcagctgcctcact

SEQ ID NO: 845025 - DNA, 15 bp, Homo sapiens
tcagctgcctgaaac

SEQ ID NO: 845026 - DNA, 17 bp, Homo sapiens
tcagctgcctgaaacag

SEQ ID NO: 845027 - DNA, 22 bp, Homo sapiens
tcagctgcctgaaacagccatg

SEQ ID NO: 845028 - DNA, 16 bp, Homo sapiens
tcaggccaggtgcagt

SEQ ID NO: 845029 - DNA, 17 bp, Homo sapiens
tcaggccaggtgcagtg

SEQ ID NO: 845030 - DNA, 13 bp, Homo sapiens
tcaggccaggtgg

SEQ ID NO: 845031 - DNA, 21 bp, Homo sapiens
tcaggccatattatcaatgtt

SEQ ID NO: 845032 - DNA, 12 bp, Homo sapiens
tcaggcccaggc

SEQ ID NO: 845033 - DNA, 18 bp, Homo sapiens
tcaggcccgtcggagctg

SEQ ID NO: 845034 - DNA, 23 bp, Homo sapiens
tcaggcccgtcggagctgcctgc

SEQ ID NO: 845035 - DNA, 13 bp, Homo sapiens
tcaggccctctgc

SEQ ID NO: 845036 - DNA, 18 bp, Homo sapiens
tcaggccctgactcctct

SEQ ID NO: 845037 - DNA, 20 bp, Homo sapiens
tcaggccctgactcctctgg

SEQ ID NO: 845038 - DNA, 22 bp, Homo sapiens
tcaggccctgactcctctggct

SEQ ID NO: 845039 - DNA, 17 bp, Homo sapiens
tcaggcctaggaggccc

SEQ ID NO: 845040 - DNA, 22 bp, Homo sapiens
tcaggcctataaccccagctcc

SEQ ID NO: 845041 - DNA, 18 bp, Homo sapiens
tcaggcctccctctctct

SEQ ID NO: 845042 - DNA, 21 bp, Homo sapiens
tcaggcctgggcaggaccctg

SEQ ID NO: 845043 - DNA, 13 bp, Homo sapiens
tcaggcctgtgtg

SEQ ID NO: 845044 - DNA, 23 bp, Homo sapiens
tcaggcgcttctccaatgctctg

SEQ ID NO: 845045 - DNA, 22 bp, Homo sapiens
tcaggctactataggtccagaa

SEQ ID NO: 845046 - DNA, 13 bp, Homo sapiens
tcaggctccccag

SEQ ID NO: 845047 - DNA, 14 bp, Homo sapiens
tcaggctccccaga

SEQ ID NO: 845048 - DNA, 23 bp, Homo sapiens
tcaggctccccagaactggctgg

SEQ ID NO: 845049 - DNA, 15 bp, Homo sapiens
tcaggctcctcagcc

SEQ ID NO: 845050 - DNA, 13 bp, Homo sapiens
tcaggctctgaga

SEQ ID NO: 845051 - DNA, 17 bp, Homo sapiens
tcaggctggagtgcagt

SEQ ID NO: 845052 - DNA, 18 bp, Homo sapiens
tcaggctggagtgcagtg

SEQ ID NO: 845053 - DNA, 11 bp, Homo sapiens
tcaggctggga

SEQ ID NO: 845054 - DNA, 14 bp, Homo sapiens
tcaggctggtctcg

SEQ ID NO: 845055 - DNA, 17 bp, Homo sapiens
tcaggcttgagggaggg

SEQ ID NO: 845056 - DNA, 20 bp, Homo sapiens
tcaggctttcactatttcct

SEQ ID NO: 845057 - DNA, 17 bp, Homo sapiens
tcagggaaattaatcaa

SEQ ID NO: 845058 - DNA, 18 bp, Homo sapiens
tcagggacagagacacct

SEQ ID NO: 845059 - DNA, 23 bp, Homo sapiens
tcagggacagagacacctgcacc

SEQ ID NO: 845060 - DNA, 14 bp, Homo sapiens
tcagggaccaagga

SEQ ID NO: 845061 - DNA, 16 bp, Homo sapiens
tcagggaccgtccagg

SEQ ID NO: 845062 - DNA, 15 bp, Homo sapiens
tcagggacctcaggg

SEQ ID NO: 845063 - DNA, 20 bp, Homo sapiens
tcagggagaggtcaccagct

SEQ ID NO: 845064 - DNA, 21 bp, Homo sapiens
tcagggagcagggaaggcctg

SEQ ID NO: 845065 - DNA, 13 bp, Homo sapiens
tcagggagcctcc

SEQ ID NO: 845066 - DNA, 18 bp, Homo sapiens
tcagggagggaaggggat

SEQ ID NO: 845067 - DNA, 17 bp, Homo sapiens
tcagggaggggcaacca

SEQ ID NO: 845068 - DNA, 13 bp, Homo sapiens
tcagggaggggcc

SEQ ID NO: 845069 - DNA, 23 bp, Homo sapiens
tcagggaggggccggctggcctg

SEQ ID NO: 845070 - DNA, 21 bp, Homo sapiens
tcagggagggttagcctgcac

SEQ ID NO: 845071 - DNA, 17 bp, Homo sapiens
tcagggagtgctggctc

SEQ ID NO: 845072 - DNA, 18 bp, Homo sapiens
tcagggattccctgtccc

SEQ ID NO: 845073 - DNA, 20 bp, Homo sapiens
tcagggattttttttttaaa

SEQ ID NO: 845074 - DNA, 21 bp, Homo sapiens
tcagggcacagctgccctgct

SEQ ID NO: 845075 - DNA, 18 bp, Homo sapiens
tcagggcagacagccctc

SEQ ID NO: 845076 - DNA, 20 bp, Homo sapiens
tcagggcagctgcctggcca

SEQ ID NO: 845077 - DNA, 16 bp, Homo sapiens
tcagggcagggctctg

SEQ ID NO: 845078 - DNA, 15 bp, Homo sapiens
tcagggcagtggcca

SEQ ID NO: 845079 - DNA, 21 bp, Homo sapiens
tcagggcagtggccaagcctg

SEQ ID NO: 845080 - DNA, 22 bp, Homo sapiens
tcagggcatcggcagctgaacc

SEQ ID NO: 845081 - DNA, 22 bp, Homo sapiens
tcagggccagaaggagggcaga

SEQ ID NO: 845082 - DNA, 15 bp, Homo sapiens
tcagggccagactgg

SEQ ID NO: 845083 - DNA, 18 bp, Homo sapiens
tcagggccagactggaag

SEQ ID NO: 845084 - DNA, 19 bp, Homo sapiens
tcagggccagactggaaga

SEQ ID NO: 845085 - DNA, 20 bp, Homo sapiens
tcagggccaggtgcagacct

SEQ ID NO: 845086 - DNA, 23 bp, Homo sapiens
tcagggccaggtgcagaccttgg

SEQ ID NO: 845087 - DNA, 14 bp, Homo sapiens
tcagggccatgcct

SEQ ID NO: 845088 - DNA, 17 bp, Homo sapiens
tcagggccatgctgagg

SEQ ID NO: 845089 - DNA, 18 bp, Homo sapiens
tcagggcccaagtccctg

SEQ ID NO: 845090 - DNA, 14 bp, Homo sapiens
tcagggccccagca

SEQ ID NO: 845091 - DNA, 17 bp, Homo sapiens
tcagggccctgccccag

SEQ ID NO: 845092 - DNA, 21 bp, Homo sapiens
tcagggccctgccccaggcct

SEQ ID NO: 845093 - DNA, 22 bp, Homo sapiens
tcagggccctgccccaggcctg

SEQ ID NO: 845094 - DNA, 18 bp, Homo sapiens
tcagggcctggggcctga

SEQ ID NO: 845095 - DNA, 18 bp, Homo sapiens
tcagggcctttctcctcc

SEQ ID NO: 845096 - DNA, 21 bp, Homo sapiens
tcagggcctttctcctcccca

SEQ ID NO: 845097 - DNA, 14 bp, Homo sapiens
tcagggctcagagt

SEQ ID NO: 845098 - DNA, 14 bp, Homo sapiens
tcagggctcccagg

SEQ ID NO: 845099 - DNA, 13 bp, Homo sapiens
tcagggctcctcc

SEQ ID NO: 845100 - DNA, 14 bp, Homo sapiens
tcagggctcctggg

SEQ ID NO: 845101 - DNA, 19 bp, Homo sapiens
tcagggctggctcctgatc

SEQ ID NO: 845102 - DNA, 13 bp, Homo sapiens
tcagggctgtccc

SEQ ID NO: 845103 - DNA, 14 bp, Homo sapiens
tcagggctgtccca

SEQ ID NO: 845104 - DNA, 17 bp, Homo sapiens
tcagggctgtcccagcc

SEQ ID NO: 845105 - DNA, 14 bp, Homo sapiens
tcaggggaagagaa

SEQ ID NO: 845106 - DNA, 22 bp, Homo sapiens
tcaggggaccccactcccctca

SEQ ID NO: 845107 - DNA, 14 bp, Homo sapiens
tcaggggagaaaaa

SEQ ID NO: 845108 - DNA, 16 bp, Homo sapiens
tcaggggagtcccgtc

SEQ ID NO: 845109 - DNA, 21 bp, Homo sapiens
tcaggggatcaaaaggacgga

SEQ ID NO: 845110 - DNA, 22 bp, Homo sapiens
tcaggggcaggtggtggagggg

SEQ ID NO: 845111 - DNA, 20 bp, Homo sapiens
tcaggggccagagagcaggg

SEQ ID NO: 845112 - DNA, 15 bp, Homo sapiens
tcaggggccagagga

SEQ ID NO: 845113 - DNA, 13 bp, Homo sapiens
tcaggggctctgt

SEQ ID NO: 845114 - DNA, 13 bp, Homo sapiens
tcaggggctgggc

SEQ ID NO: 845115 - DNA, 19 bp, Homo sapiens
tcaggggctgggcatccca

SEQ ID NO: 845116 - DNA, 20 bp, Homo sapiens
tcaggggctgggcatcccag

SEQ ID NO: 845117 - DNA, 13 bp, Homo sapiens
tcaggggctttgg

SEQ ID NO: 845118 - DNA, 16 bp, Homo sapiens
tcagggggaagaagca

SEQ ID NO: 845119 - DNA, 22 bp, Homo sapiens
tcagggggaagaagcagagaga

SEQ ID NO: 845120 - DNA, 13 bp, Homo sapiens
tcagggggccagc

SEQ ID NO: 845121 - DNA, 16 bp, Homo sapiens
tcagggggccagctgg

SEQ ID NO: 845122 - DNA, 19 bp, Homo sapiens
tcagggggccagctgggga

SEQ ID NO: 845123 - DNA, 20 bp, Homo sapiens
tcagggggccagctggggag

SEQ ID NO: 845124 - DNA, 23 bp, Homo sapiens
tcaggggtcaggtgtcaggcccg

SEQ ID NO: 845125 - DNA, 14 bp, Homo sapiens
tcaggggtgcacag

SEQ ID NO: 845126 - DNA, 19 bp, Homo sapiens
tcaggggtgtgcggccttt

SEQ ID NO: 845127 - DNA, 23 bp, Homo sapiens
tcaggggtgtgcggcctttggct

SEQ ID NO: 845128 - DNA, 18 bp, Homo sapiens
tcaggggttcgagaccag

SEQ ID NO: 845129 - DNA, 13 bp, Homo sapiens
tcagggtataaat

SEQ ID NO: 845130 - DNA, 18 bp, Homo sapiens
tcagggtatcccagaccc

SEQ ID NO: 845131 - DNA, 19 bp, Homo sapiens
tcagggtgaactgcaaagc

SEQ ID NO: 845132 - DNA, 15 bp, Homo sapiens
tcagggtgggaagaa

SEQ ID NO: 845133 - DNA, 23 bp, Homo sapiens
tcagggtgggccactctcccctc

SEQ ID NO: 845134 - DNA, 13 bp, Homo sapiens
tcaggtaactttc

SEQ ID NO: 845135 - DNA, 15 bp, Homo sapiens
tcaggtaatacaaac

SEQ ID NO: 845136 - DNA, 18 bp, Homo sapiens
tcaggtaatcattttaat

SEQ ID NO: 845137 - DNA, 22 bp, Homo sapiens
tcaggtacagaaaacatgttta

SEQ ID NO: 845138 - DNA, 19 bp, Homo sapiens
tcaggtagaccatattcta

SEQ ID NO: 845139 - DNA, 13 bp, Homo sapiens
tcaggtaggccct

SEQ ID NO: 845140 - DNA, 15 bp, Homo sapiens
tcaggtaggcccttg

SEQ ID NO: 845141 - DNA, 19 bp, Homo sapiens
tcaggtagttgcaattgaa

SEQ ID NO: 845142 - DNA, 13 bp, Homo sapiens
tcaggtcagctgg

SEQ ID NO: 845143 - DNA, 17 bp, Homo sapiens
tcaggtcagctgggagc

SEQ ID NO: 845144 - DNA, 14 bp, Homo sapiens
tcaggtccaggcca

SEQ ID NO: 845145 - DNA, 22 bp, Homo sapiens
tcaggtccaggccagtgggcct

SEQ ID NO: 845146 - DNA, 14 bp, Homo sapiens
tcaggtccccatgg

SEQ ID NO: 845147 - DNA, 15 bp, Homo sapiens
tcaggtccccatggc

SEQ ID NO: 845148 - DNA, 23 bp, Homo sapiens
tcaggtccgtgggccgtatctgt

SEQ ID NO: 845149 - DNA, 16 bp, Homo sapiens
tcaggtcctcagagaa

SEQ ID NO: 845150 - DNA, 22 bp, Homo sapiens
tcatagattattataaactata

SEQ ID NO: 845151 - DNA, 23 bp, Homo sapiens
tcatagattattataaactataa

SEQ ID NO: 845152 - DNA, 14 bp, Homo sapiens
tcatagcatgatat

SEQ ID NO: 845153 - DNA, 21 bp, Homo sapiens
tcatagcattaactaatctat

SEQ ID NO: 845154 - DNA, 18 bp, Homo sapiens
tcatagcccagatcagct

SEQ ID NO: 845155 - DNA, 14 bp, Homo sapiens
tcatagcccagtag

SEQ ID NO: 845156 - DNA, 18 bp, Homo sapiens
tcatagccctcagacatt

SEQ ID NO: 845157 - DNA, 18 bp, Homo sapiens
tcatagctcactgcagcc

SEQ ID NO: 845158 - DNA, 22 bp, Homo sapiens
tcatagctcactgcagcctcat

SEQ ID NO: 845159 - DNA, 12 bp, Homo sapiens
tcatagctgaga

SEQ ID NO: 845160 - DNA, 17 bp, Homo sapiens
tcatagctgagattcct

SEQ ID NO: 845161 - DNA, 21 bp, Homo sapiens
tcataggaagggaccaaggca

SEQ ID NO: 845162 - DNA, 21 bp, Homo sapiens
tcataggaagtggctggtctg

SEQ ID NO: 845163 - DNA, 15 bp, Homo sapiens
tcatagggaaaggtt

SEQ ID NO: 845164 - DNA, 14 bp, Homo sapiens
tcatagggatgctg

SEQ ID NO: 845165 - DNA, 23 bp, Homo sapiens
tcataggtcactggctctccaag

SEQ ID NO: 845166 - DNA, 16 bp, Homo sapiens
tcataggtctgaaatt

SEQ ID NO: 845167 - DNA, 17 bp, Homo sapiens
tcataggttgagcaatt

SEQ ID NO: 845168 - DNA, 16 bp, Homo sapiens
tcataggttgccaata

SEQ ID NO: 845169 - DNA, 20 bp, Homo sapiens
tcataggttgccaataatac

SEQ ID NO: 845170 - DNA, 18 bp, Homo sapiens
tcatagtaacttcttatg

SEQ ID NO: 845171 - DNA, 20 bp, Homo sapiens
tcatagtactctttgtagca

SEQ ID NO: 845172 - DNA, 14 bp, Homo sapiens
tcatagtagttttt

SEQ ID NO: 845173 - DNA, 16 bp, Homo sapiens
tcatagtagtttttac

SEQ ID NO: 845174 - DNA, 20 bp, Homo sapiens
tcatagtatccatattttat

SEQ ID NO: 845175 - DNA, 14 bp, Homo sapiens
tcatagtattggag

SEQ ID NO: 845176 - DNA, 19 bp, Homo sapiens
tcatagtgcctttttcctt

SEQ ID NO: 845177 - DNA, 12 bp, Homo sapiens
tcatagttttat

SEQ ID NO: 845178 - DNA, 13 bp, Homo sapiens
tcatataaaaaca

SEQ ID NO: 845179 - DNA, 16 bp, Homo sapiens
tcatataaaagctatg

SEQ ID NO: 845180 - DNA, 21 bp, Homo sapiens
tcatataaaagttgcgtttaa

SEQ ID NO: 845181 - DNA, 16 bp, Homo sapiens
tcatataaactcattt

SEQ ID NO: 845182 - DNA, 17 bp, Homo sapiens
tcatataaactcattta

SEQ ID NO: 845183 - DNA, 19 bp, Homo sapiens
tcatataaattttttgtga

SEQ ID NO: 845184 - DNA, 17 bp, Homo sapiens
tcatataccagcaatat

SEQ ID NO: 845185 - DNA, 20 bp, Homo sapiens
tcatatactataattgtaaa

SEQ ID NO: 845186 - DNA, 15 bp, Homo sapiens
tcatatactgccatg

SEQ ID NO: 845187 - DNA, 21 bp, Homo sapiens
tcatatagcattgataatctt

SEQ ID NO: 845188 - DNA, 17 bp, Homo sapiens
tcatatataataaatta

SEQ ID NO: 845189 - DNA, 13 bp, Homo sapiens
tcatatatacata

SEQ ID NO: 845190 - DNA, 14 bp, Homo sapiens
tcatatatcaagaa

SEQ ID NO: 845191 - DNA, 23 bp, Homo sapiens
tcatatatttaagccttttgtgt

SEQ ID NO: 845192 - DNA, 13 bp, Homo sapiens
tcatatcatttct

SEQ ID NO: 845193 - DNA, 18 bp, Homo sapiens
tcatatccagctgagtga

SEQ ID NO: 845194 - DNA, 12 bp, Homo sapiens
tcatatctggtc

SEQ ID NO: 845195 - DNA, 21 bp, Homo sapiens
tcatatgaggacctttatatc

SEQ ID NO: 845196 - DNA, 15 bp, Homo sapiens
tcatatgattctgct

SEQ ID NO: 845197 - DNA, 22 bp, Homo sapiens
tcatatgcagaacgtatttagc

SEQ ID NO: 845198 - DNA, 23 bp, Homo sapiens
tcatatgcagaacgtatttagcc

SEQ ID NO: 845199 - DNA, 18 bp, Homo sapiens
tcatatggagctcatgtc

SEQ ID NO: 845200 - DNA, 18 bp, Homo sapiens
tcatatggcccagtgtca

SEQ ID NO: 845201 - DNA, 21 bp, Homo sapiens
tcatatgtaccatgtacatga

SEQ ID NO: 845202 - DNA, 20 bp, Homo sapiens
tcatatgtagccttcacaca

SEQ ID NO: 845203 - DNA, 18 bp, Homo sapiens
tcatatgtgtctttatag

SEQ ID NO: 845204 - DNA, 13 bp, Homo sapiens
tcatatgttgctc

SEQ ID NO: 845205 - DNA, 18 bp, Homo sapiens
tcatatgttgctcagtct

SEQ ID NO: 845206 - DNA, 19 bp, Homo sapiens
tcatatgttgctcagtctc

SEQ ID NO: 845207 - DNA, 19 bp, Homo sapiens
tcatattccaacccagcca

SEQ ID NO: 845208 - DNA, 19 bp, Homo sapiens
tcatattctattgtttact

SEQ ID NO: 845209 - DNA, 12 bp, Homo sapiens
tcatattgaata

SEQ ID NO: 845210 - DNA, 19 bp, Homo sapiens
tcatattgaatgtttccaa

SEQ ID NO: 845211 - DNA, 14 bp, Homo sapiens
tcatattgtatgta

SEQ ID NO: 845212 - DNA, 15 bp, Homo sapiens
tcatatttattgatt

SEQ ID NO: 845213 - DNA, 15 bp, Homo sapiens
tcatattttaaatct

SEQ ID NO: 845214 - DNA, 21 bp, Homo sapiens
tcatattttgccactgccttt

SEQ ID NO: 845215 - DNA, 19 bp, Homo sapiens
tcatcaaaaagtaattata

SEQ ID NO: 845216 - DNA, 23 bp, Homo sapiens
tcatcaaacatttgccaagtgag

SEQ ID NO: 845217 - DNA, 22 bp, Homo sapiens
tcatcaactgaatgaggtcagc

SEQ ID NO: 845218 - DNA, 19 bp, Homo sapiens
tcatcaacttaaaagtcag

SEQ ID NO: 845219 - DNA, 13 bp, Homo sapiens
tcatcaagaaggg

SEQ ID NO: 845220 - DNA, 18 bp, Homo sapiens
tcatcaagaagggctgca

SEQ ID NO: 845221 - DNA, 21 bp, Homo sapiens
tcatcaagaagggctgcatga

SEQ ID NO: 845222 - DNA, 20 bp, Homo sapiens
tcatcaatatccctcttgta

SEQ ID NO: 845223 - DNA, 23 bp, Homo sapiens
tcatcaatcaaataagtatttat

SEQ ID NO: 845224 - DNA, 16 bp, Homo sapiens
tcatcaccatcgtgtt

SEQ ID NO: 845225 - DNA, 14 bp, Homo sapiens
tcatcaccccagag

SEQ ID NO: 845226 - DNA, 16 bp, Homo sapiens
tcatcacctgctagaa

SEQ ID NO: 845227 - DNA, 17 bp, Homo sapiens
tcatcactccaaaaaca

SEQ ID NO: 845228 - DNA, 18 bp, Homo sapiens
tcatcactccaaaaacag

SEQ ID NO: 845229 - DNA, 15 bp, Homo sapiens
tcatcactccctgga

SEQ ID NO: 845230 - DNA, 12 bp, Homo sapiens
tcatcactggac

SEQ ID NO: 845231 - DNA, 19 bp, Homo sapiens
tcatcactggactgcatgg

SEQ ID NO: 845232 - DNA, 17 bp, Homo sapiens
tcatcacttttcagtga

SEQ ID NO: 845233 - DNA, 15 bp, Homo sapiens
tcatcagaagataac

SEQ ID NO: 845234 - DNA, 13 bp, Homo sapiens
tcatcaggatgaa

SEQ ID NO: 845235 - DNA, 16 bp, Homo sapiens
tcatcaggctctgttc

SEQ ID NO: 845236 - DNA, 21 bp, Homo sapiens
tcatcaggctctgttcctcaa

SEQ ID NO: 845237 - DNA, 12 bp, Homo sapiens
tcatcagggcct

SEQ ID NO: 845238 - DNA, 23 bp, Homo sapiens
tcatcagggcctggggcctgaga

SEQ ID NO: 845239 - DNA, 17 bp, Homo sapiens
tcatcagtgtgtaaata

SEQ ID NO: 845240 - DNA, 19 bp, Homo sapiens
tcatcagtgtgtaaataat

SEQ ID NO: 845241 - DNA, 14 bp, Homo sapiens
tcatcataaaataa

SEQ ID NO: 845242 - DNA, 15 bp, Homo sapiens
tcatcataaaataaa

SEQ ID NO: 845243 - DNA, 19 bp, Homo sapiens
tcatcataaaataaagtat

SEQ ID NO: 845244 - DNA, 17 bp, Homo sapiens
tcatcatattatacaga

SEQ ID NO: 845245 - DNA, 14 bp, Homo sapiens
tcatcatattgtat

SEQ ID NO: 845246 - DNA, 17 bp, Homo sapiens
tcatcatattgtatgta

SEQ ID NO: 845247 - DNA, 14 bp, Homo sapiens
tcatcatcagagcc

SEQ ID NO: 845248 - DNA, 13 bp, Homo sapiens
tcatcatcagggc

SEQ ID NO: 845249 - DNA, 16 bp, Homo sapiens
tcatcatcagggcctg

SEQ ID NO: 845250 - DNA, 15 bp, Homo sapiens
tcatcatccacccgc

SEQ ID NO: 845251 - DNA, 17 bp, Homo sapiens
tcatcatccagatgtgg

SEQ ID NO: 845252 - DNA, 14 bp, Homo sapiens
tcatcatcctaagc

SEQ ID NO: 845253 - DNA, 16 bp, Homo sapiens
tcatcatgtctattgt

SEQ ID NO: 845254 - DNA, 18 bp, Homo sapiens
tcatcatgtctattgtcc

SEQ ID NO: 845255 - DNA, 17 bp, Homo sapiens
tcatcattccttgagaa

SEQ ID NO: 845256 - DNA, 20 bp, Homo sapiens
tcatcattctctgtctcatc

SEQ ID NO: 845257 - DNA, 22 bp, Homo sapiens
tcatcattcttgtgggagacag

SEQ ID NO: 845258 - DNA, 20 bp, Homo sapiens
tcatcattgtatatatgtgt

SEQ ID NO: 845259 - DNA, 14 bp, Homo sapiens
tcatcatttcagcc

SEQ ID NO: 845260 - DNA, 15 bp, Homo sapiens
tcatcatttcagcca

SEQ ID NO: 845261 - DNA, 19 bp, Homo sapiens
tcatccaaaatattttttg

SEQ ID NO: 845262 - DNA, 20 bp, Homo sapiens
tcatccaaaatattttttgc

SEQ ID NO: 845263 - DNA, 22 bp, Homo sapiens
tcatccaaaatattttttgcaa

SEQ ID NO: 845264 - DNA, 12 bp, Homo sapiens
tcatccaacaag

SEQ ID NO: 845265 - DNA, 18 bp, Homo sapiens
tcatccaacaagaagaaa

SEQ ID NO: 845266 - DNA, 17 bp, Homo sapiens
tcatccaacttatgttt

SEQ ID NO: 845267 - DNA, 15 bp, Homo sapiens
tcatccaatcctcac

SEQ ID NO: 845268 - DNA, 12 bp, Homo sapiens
tcatccacccca

SEQ ID NO: 845269 - DNA, 13 bp, Homo sapiens
tcatccacccgct

SEQ ID NO: 845270 - DNA, 18 bp, Homo sapiens
tcatccacccgctgcccc

SEQ ID NO: 845271 - DNA, 20 bp, Homo sapiens
tcatccagatgtggctactg

SEQ ID NO: 845272 - DNA, 14 bp, Homo sapiens
tcatgacattatgt

SEQ ID NO: 845273 - DNA, 14 bp, Homo sapiens
tcatgaccagtaaa

SEQ ID NO: 845274 - DNA, 15 bp, Homo sapiens
tcatgaccagtaaag

SEQ ID NO: 845275 - DNA, 16 bp, Homo sapiens
tcatgagcctgctgga

SEQ ID NO: 845276 - DNA, 18 bp, Homo sapiens
tcatgagtgaataaatgt

SEQ ID NO: 845277 - DNA, 17 bp, Homo sapiens
tcatgataatgaacaga

SEQ ID NO: 845278 - DNA, 21 bp, Homo sapiens
tcatgataatgaacagaacat

SEQ ID NO: 845279 - DNA, 22 bp, Homo sapiens
tcatgataccacctttactgtg

SEQ ID NO: 845280 - DNA, 15 bp, Homo sapiens
tcatgatctccctgc

SEQ ID NO: 845281 - DNA, 19 bp, Homo sapiens
tcatgatctccctgccgcc

SEQ ID NO: 845282 - DNA, 17 bp, Homo sapiens
tcatgatcttgtgacat

SEQ ID NO: 845283 - DNA, 23 bp, Homo sapiens
tcatgattagaaattacctgtgg

SEQ ID NO: 845284 - DNA, 13 bp, Homo sapiens
tcatgattagcaa

SEQ ID NO: 845285 - DNA, 14 bp, Homo sapiens
tcatgattagcaag

SEQ ID NO: 845286 - DNA, 22 bp, Homo sapiens
tcatgattttaagtttctctgc

SEQ ID NO: 845287 - DNA, 11 bp, Homo sapiens
tcatgattttt

SEQ ID NO: 845288 - DNA, 16 bp, Homo sapiens
tcatgcaatgacatct

SEQ ID NO: 845289 - DNA, 13 bp, Homo sapiens
tcatgcactgagg

SEQ ID NO: 845290 - DNA, 14 bp, Homo sapiens
tcatgcactgaggt

SEQ ID NO: 845291 - DNA, 17 bp, Homo sapiens
tcatgcacttaaagaag

SEQ ID NO: 845292 - DNA, 21 bp, Homo sapiens
tcatgcacttaaagaagtatt

SEQ ID NO: 845293 - DNA, 22 bp, Homo sapiens
tcatgcacttaaagaagtattt

SEQ ID NO: 845294 - DNA, 12 bp, Homo sapiens
tcatgcagctgt

SEQ ID NO: 845295 - DNA, 14 bp, Homo sapiens
tcatgcagctgtgg

SEQ ID NO: 845296 - DNA, 15 bp, Homo sapiens
tcatgcagttcctgg

SEQ ID NO: 845297 - DNA, 18 bp, Homo sapiens
tcatgcatagtcccagct

SEQ ID NO: 845298 - DNA, 12 bp, Homo sapiens
tcatgcattgtt

SEQ ID NO: 845299 - DNA, 15 bp, Homo sapiens
tcatgccagtatttt

SEQ ID NO: 845300 - DNA, 16 bp, Homo sapiens
tcatgccatctgtttt

SEQ ID NO: 845301 - DNA, 19 bp, Homo sapiens
tcatgccatctgttttcaa

SEQ ID NO: 845302 - DNA, 17 bp, Homo sapiens
tcatgcccaagccctga

SEQ ID NO: 845303 - DNA, 19 bp, Homo sapiens
tcatgcccaccccctgccc

SEQ ID NO: 845304 - DNA, 14 bp, Homo sapiens
tcatgcccagctct

SEQ ID NO: 845305 - DNA, 15 bp, Homo sapiens
tcatgccctcctctc

SEQ ID NO: 845306 - DNA, 18 bp, Homo sapiens
tcatgccttgataaatat

SEQ ID NO: 845307 - DNA, 13 bp, Homo sapiens
tcatgcctttgta

SEQ ID NO: 845308 - DNA, 15 bp, Homo sapiens
tcatgctatctctgt

SEQ ID NO: 845309 - DNA, 20 bp, Homo sapiens
tcatgctggagggaggctgg

SEQ ID NO: 845310 - DNA, 18 bp, Homo sapiens
tcatgctgggatttccaa

SEQ ID NO: 845311 - DNA, 19 bp, Homo sapiens
tcatgctgttgctgctact

SEQ ID NO: 845312 - DNA, 14 bp, Homo sapiens
tcatgcttaataaa

SEQ ID NO: 845313 - DNA, 18 bp, Homo sapiens
tcatgcttatgttaaact

SEQ ID NO: 845314 - DNA, 22 bp, Homo sapiens
tcatgcttatgttaaactctgt

SEQ ID NO: 845315 - DNA, 15 bp, Homo sapiens
tcatgcttgacatac

SEQ ID NO: 845316 - DNA, 21 bp, Homo sapiens
tcatggaaagactgggacagc

SEQ ID NO: 845317 - DNA, 20 bp, Homo sapiens
tcatggaagtggcagtgaaa

SEQ ID NO: 845318 - DNA, 14 bp, Homo sapiens
tcatggaatcttgc

SEQ ID NO: 845319 - DNA, 16 bp, Homo sapiens
tcatggaatcttgctg

SEQ ID NO: 845320 - DNA, 14 bp, Homo sapiens
tcatggacactttg

SEQ ID NO: 845321 - DNA, 22 bp, Homo sapiens
tcatggagaagtgaaggcatag

SEQ ID NO: 845322 - DNA, 13 bp, Homo sapiens
tcatggattactt

SEQ ID NO: 845323 - DNA, 19 bp, Homo sapiens
tcatggattgccacagctc

SEQ ID NO: 845324 - DNA, 23 bp, Homo sapiens
tcatggcagctgtttctcatgaa

SEQ ID NO: 845325 - DNA, 14 bp, Homo sapiens
tcatggcccctctg

SEQ ID NO: 845326 - DNA, 19 bp, Homo sapiens
tcatggccttgaaacagtt

SEQ ID NO: 845327 - DNA, 19 bp, Homo sapiens
tcatggcgtaatgggcctg

SEQ ID NO: 845328 - DNA, 22 bp, Homo sapiens
tcatggcgtaatgggcctgccc

SEQ ID NO: 845329 - DNA, 17 bp, Homo sapiens
tcatgggaaaagaccag

SEQ ID NO: 845330 - DNA, 19 bp, Homo sapiens
tcatgggaacgcagcctcc

SEQ ID NO: 845331 - DNA, 20 bp, Homo sapiens
tcatgggaacgcagcctcca

SEQ ID NO: 845332 - DNA, 21 bp, Homo sapiens
tcatgggaacgcagcctccag

SEQ ID NO: 845333 - DNA, 13 bp, Homo sapiens
tcatgggaagaac

SEQ ID NO: 845334 - DNA, 20 bp, Homo sapiens
tcatgggaagatgtctcaga

SEQ ID NO: 845335 - DNA, 23 bp, Homo sapiens
tcatgggaatgatagcccagaac

SEQ ID NO: 845336 - DNA, 19 bp, Homo sapiens
tcatggggatcaattttca

SEQ ID NO: 845337 - DNA, 21 bp, Homo sapiens
tcatggggatcaattttcatt

SEQ ID NO: 845338 - DNA, 15 bp, Homo sapiens
tcatgggtcctagcc

SEQ ID NO: 845339 - DNA, 22 bp, Homo sapiens
tcatgggtcctagcccttccct

SEQ ID NO: 845340 - DNA, 16 bp, Homo sapiens
tcatggtactacccca

SEQ ID NO: 845341 - DNA, 21 bp, Homo sapiens
tcatggtagatttttttcata

SEQ ID NO: 845342 - DNA, 19 bp, Homo sapiens
tcatggtgaaaatgtactg

SEQ ID NO: 845343 - DNA, 19 bp, Homo sapiens
tcatggtgatcagtgcaat

SEQ ID NO: 845344 - DNA, 15 bp, Homo sapiens
tcatggtttccattt

SEQ ID NO: 845345 - DNA, 15 bp, Homo sapiens
tcatgtaaaacagaa

SEQ ID NO: 845346 - DNA, 18 bp, Homo sapiens
tcatgtaaaacagaaaaa

SEQ ID NO: 845347 - DNA, 16 bp, Homo sapiens
tcatgtaaactgtgca

SEQ ID NO: 845348 - DNA, 23 bp, Homo sapiens
tcatgtaaattttgtatgaaaaa

SEQ ID NO: 845349 - DNA, 10 bp, Homo sapiens
tcatgtaaca

SEQ ID NO: 845350 - DNA, 16 bp, Homo sapiens
tcatgtaacagttgtg

SEQ ID NO: 845351 - DNA, 12 bp, Homo sapiens
tcatgtaacatt

SEQ ID NO: 845352 - DNA, 17 bp, Homo sapiens
tcatgtaatgtggtcac

SEQ ID NO: 845353 - DNA, 19 bp, Homo sapiens
tcatgtacagcattaaaat

SEQ ID NO: 845354 - DNA, 18 bp, Homo sapiens
tcatgtaccatcaataaa

SEQ ID NO: 845355 - DNA, 16 bp, Homo sapiens
tcatgtacttcctgtg

SEQ ID NO: 845356 - DNA, 17 bp, Homo sapiens
tcatgtacttcctgtgt

SEQ ID NO: 845357 - DNA, 18 bp, Homo sapiens
tcatgtacttcctgtgta

SEQ ID NO: 845358 - DNA, 23 bp, Homo sapiens
tcatgtacttcctgtgtactctt

SEQ ID NO: 845359 - DNA, 22 bp, Homo sapiens
tcatgtactttttagtaatttc

SEQ ID NO: 845360 - DNA, 22 bp, Homo sapiens
tcatgtagaactcagcagttga

SEQ ID NO: 845361 - DNA, 20 bp, Homo sapiens
tcatgtagagaaaagcacac

SEQ ID NO: 845362 - DNA, 19 bp, Homo sapiens
tcatgtaggtgagcctggg

SEQ ID NO: 845363 - DNA, 22 bp, Homo sapiens
tcatgtaggtgagcctgggcag

SEQ ID NO: 845364 - DNA, 21 bp, Homo sapiens
tcatgtatgtatataatcatg

SEQ ID NO: 845365 - DNA, 19 bp, Homo sapiens
tcatgtatgttcagaagaa

SEQ ID NO: 845366 - DNA, 19 bp, Homo sapiens
tcatgtcagccgtgtgggt

SEQ ID NO: 845367 - DNA, 13 bp, Homo sapiens
tcatgtctattgt

SEQ ID NO: 845368 - DNA, 15 bp, Homo sapiens
tcatgtcttgtgcat

SEQ ID NO: 845369 - DNA, 23 bp, Homo sapiens
tcatgtctttccacttctctggg

SEQ ID NO: 845370 - DNA, 22 bp, Homo sapiens
tcatgtgactagcgcctggcct

SEQ ID NO: 845371 - DNA, 20 bp, Homo sapiens
tcatgtgattcactgccttc

SEQ ID NO: 845372 - DNA, 16 bp, Homo sapiens
tcatgtggctggaaga

SEQ ID NO: 845373 - DNA, 21 bp, Homo sapiens
tcatgtggctggaagatcctg

SEQ ID NO: 845374 - DNA, 16 bp, Homo sapiens
tcatgtgggtgagcca

SEQ ID NO: 845375 - DNA, 13 bp, Homo sapiens
tcatgtgtgcatg

SEQ ID NO: 845376 - DNA, 16 bp, Homo sapiens
tcatgtgtgcatgtga

SEQ ID NO: 845377 - DNA, 13 bp, Homo sapiens
tcatgttaaatta

SEQ ID NO: 845378 - DNA, 16 bp, Homo sapiens
tcatgttactcagtgt

SEQ ID NO: 845379 - DNA, 15 bp, Homo sapiens
tcatgttagttacct

SEQ ID NO: 845380 - DNA, 19 bp, Homo sapiens
tcatgttagttaccttata

SEQ ID NO: 845381 - DNA, 20 bp, Homo sapiens
tcatgttatatttaatgcat

SEQ ID NO: 845382 - DNA, 18 bp, Homo sapiens
tcatgttcattcttcaaa

SEQ ID NO: 845383 - DNA, 16 bp, Homo sapiens
tcatgttccttttgaa

SEQ ID NO: 845384 - DNA, 24 bp, Homo sapiens
tcatgttccttttgaaattgtagt

SEQ ID NO: 845385 - DNA, 17 bp, Homo sapiens
tcatgttctcttcccag

SEQ ID NO: 845386 - DNA, 18 bp, Homo sapiens
tcatgttctcttcccagg

SEQ ID NO: 845387 - DNA, 13 bp, Homo sapiens
tcatgttgatgac

SEQ ID NO: 845388 - DNA, 20 bp, Homo sapiens
tcatgttggtttattttcac

SEQ ID NO: 845389 - DNA, 19 bp, Homo sapiens
tcatgttgttgtgtgtata

SEQ ID NO: 845390 - DNA, 11 bp, Homo sapiens
tcatgtttctt

SEQ ID NO: 845391 - DNA, 22 bp, Homo sapiens
tcatgttttccattgtttgaaa

SEQ ID NO: 845392 - DNA, 21 bp, Homo sapiens
tcatgttttgatgagaaaaaa

SEQ ID NO: 845393 - DNA, 13 bp, Homo sapiens
tccaaagaaagtt

SEQ ID NO: 845394 - DNA, 15 bp, Homo sapiens
tccaaagaacttgat

SEQ ID NO: 845395 - DNA, 21 bp, Homo sapiens
tccaaagaacttgatttgcat

SEQ ID NO: 845396 - DNA, 16 bp, Homo sapiens
tccaaagactgtactg

SEQ ID NO: 845397 - DNA, 18 bp, Homo sapiens
tccaaagactgtactggc

SEQ ID NO: 845398 - DNA, 18 bp, Homo sapiens
tccaaagaggctgcccct

SEQ ID NO: 845399 - DNA, 21 bp, Homo sapiens
tccaaagagggatgtttggaa

SEQ ID NO: 845400 - DNA, 22 bp, Homo sapiens
tccaaagagtagaattgcattg

SEQ ID NO: 845401 - DNA, 23 bp, Homo sapiens
tccaaaggaagtctaggagctgg

SEQ ID NO: 845402 - DNA, 13 bp, Homo sapiens
tccaaaggaggct

SEQ ID NO: 845403 - DNA, 21 bp, Homo sapiens
tccaaaggcattttattgctt

SEQ ID NO: 845404 - DNA, 14 bp, Homo sapiens
tccaaaggctctgt

SEQ ID NO: 845405 - DNA, 18 bp, Homo sapiens
tccaaaggggctgctggg

SEQ ID NO: 845406 - DNA, 14 bp, Homo sapiens
tccaaagtacactg

SEQ ID NO: 845407 - DNA, 16 bp, Homo sapiens
tccaaagtacactgtt

SEQ ID NO: 845408 - DNA, 19 bp, Homo sapiens
tccaaagtcagatctggtc

SEQ ID NO: 845409 - DNA, 21 bp, Homo sapiens
tccaaataaaacttgagccca

SEQ ID NO: 845410 - DNA, 22 bp, Homo sapiens
tccaaataaaacttgagcccac

SEQ ID NO: 845411 - DNA, 22 bp, Homo sapiens
tccaaatattattcaagtgcct

SEQ ID NO: 845412 - DNA, 13 bp, Homo sapiens
tccaaatatttcc

SEQ ID NO: 845413 - DNA, 15 bp, Homo sapiens
tccaaatcctggaag

SEQ ID NO: 845414 - DNA, 18 bp, Homo sapiens
tccaaatctgtcctctgt

SEQ ID NO: 845415 - DNA, 20 bp, Homo sapiens
tccaaatctgtcctctgtag

SEQ ID NO: 845416 - DNA, 23 bp, Homo sapiens
tccaaatctgtcctctgtagtat

SEQ ID NO: 845417 - DNA, 18 bp, Homo sapiens
tccaaatcttgaatttct

SEQ ID NO: 845418 - DNA, 16 bp, Homo sapiens
tccaaatgcccaagga

SEQ ID NO: 845419 - DNA, 21 bp, Homo sapiens
tccaaatggagaagctgcagg

SEQ ID NO: 845420 - DNA, 17 bp, Homo sapiens
tccaaatgtgtcagaat

SEQ ID NO: 845421 - DNA, 19 bp, Homo sapiens
tccaaattaaaacaaatat

SEQ ID NO: 845422 - DNA, 17 bp, Homo sapiens
tccaaattattaattgt

SEQ ID NO: 845423 - DNA, 21 bp, Homo sapiens
tccaaattattaattgtcctg

SEQ ID NO: 845424 - DNA, 15 bp, Homo sapiens
tccaaattatttctt

SEQ ID NO: 845425 - DNA, 17 bp, Homo sapiens
tccaaattatttcttaa

SEQ ID NO: 845426 - DNA, 15 bp, Homo sapiens
tccaaattgtttgta

SEQ ID NO: 845427 - DNA, 20 bp, Homo sapiens
tccaaattgtttgtacagta

SEQ ID NO: 845428 - DNA, 21 bp, Homo sapiens
tccaaatttttttttaaagca

SEQ ID NO: 845429 - DNA, 15 bp, Homo sapiens
tccaacaagaagaaa

SEQ ID NO: 845430 - DNA, 18 bp, Homo sapiens
tccaacaagaagaaatat

SEQ ID NO: 845431 - DNA, 20 bp, Homo sapiens
tccaacaagaagaaatatga

SEQ ID NO: 845432 - DNA, 23 bp, Homo sapiens
tccaacaagaagggactgagaga

SEQ ID NO: 845433 - DNA, 15 bp, Homo sapiens
tccaacaagaatgca

SEQ ID NO: 845434 - DNA, 16 bp, Homo sapiens
tccaacaagaatgcat

SEQ ID NO: 845435 - DNA, 12 bp, Homo sapiens
tccaacaataaa

SEQ ID NO: 845436 - DNA, 17 bp, Homo sapiens
tccaacaataaacagga

SEQ ID NO: 845437 - DNA, 21 bp, Homo sapiens
tccaacaccaagcacagcagc

SEQ ID NO: 845438 - DNA, 23 bp, Homo sapiens
tccaacaccaagcacagcagcct

SEQ ID NO: 845439 - DNA, 18 bp, Homo sapiens
tccaacattttttcccag

SEQ ID NO: 845440 - DNA, 16 bp, Homo sapiens
tccaaccactgtgcca

SEQ ID NO: 845441 - DNA, 18 bp, Homo sapiens
tccaaccactgtgccact

SEQ ID NO: 845442 - DNA, 21 bp, Homo sapiens
tccaaccagactttgagcctg

SEQ ID NO: 845443 - DNA, 23 bp, Homo sapiens
tccaacccaacccaatccctctc

SEQ ID NO: 845444 - DNA, 22 bp, Homo sapiens
tccaacccgtctggcccaccag

SEQ ID NO: 845445 - DNA, 12 bp, Homo sapiens
tccaaccctgcc

SEQ ID NO: 845446 - DNA, 21 bp, Homo sapiens
tccaaccctgccgtcaccacc

SEQ ID NO: 845447 - DNA, 15 bp, Homo sapiens
tccaacgcccctgtg

SEQ ID NO: 845448 - DNA, 16 bp, Homo sapiens
tccaacgcccctgtgg

SEQ ID NO: 845449 - DNA, 16 bp, Homo sapiens
tccaactcacttccag

SEQ ID NO: 845450 - DNA, 12 bp, Homo sapiens
tccaactccagc

SEQ ID NO: 845451 - DNA, 13 bp, Homo sapiens
tccaactccagca

SEQ ID NO: 845452 - DNA, 14 bp, Homo sapiens
tccaactccagcaa

SEQ ID NO: 845453 - DNA, 13 bp, Homo sapiens
tccaactccagga

SEQ ID NO: 845454 - DNA, 14 bp, Homo sapiens
tccaactcctgatg

SEQ ID NO: 845455 - DNA, 15 bp, Homo sapiens
tccaactcctgatgc

SEQ ID NO: 845456 - DNA, 18 bp, Homo sapiens
tccaactcgaatctgtgt

SEQ ID NO: 845457 - DNA, 19 bp, Homo sapiens
tccaactcgaatctgtgtg

SEQ ID NO: 845458 - DNA, 13 bp, Homo sapiens
tccaactggaaat

SEQ ID NO: 845459 - DNA, 23 bp, Homo sapiens
tccaactggccctatttagatga

SEQ ID NO: 845460 - DNA, 18 bp, Homo sapiens
tccaacttatgtttttaa

SEQ ID NO: 845461 - DNA, 20 bp, Homo sapiens
tccaacttatgtttttaaat

SEQ ID NO: 845462 - DNA, 14 bp, Homo sapiens
tccaacttgaagga

SEQ ID NO: 845463 - DNA, 16 bp, Homo sapiens
tccaacttgaaggatt

SEQ ID NO: 845464 - DNA, 23 bp, Homo sapiens
tccaacttgaaggattgcatcct

SEQ ID NO: 845465 - DNA, 16 bp, Homo sapiens
tccaacttgtctggga

SEQ ID NO: 845466 - DNA, 16 bp, Homo sapiens
tccaagaaagatgaat

SEQ ID NO: 845467 - DNA, 18 bp, Homo sapiens
tccaagacagaataatga

SEQ ID NO: 845468 - DNA, 11 bp, Homo sapiens
tccaagacatt

SEQ ID NO: 845469 - DNA, 17 bp, Homo sapiens
tccaagaccaccagggt

SEQ ID NO: 845470 - DNA, 13 bp, Homo sapiens
tccaagactgaag

SEQ ID NO: 845471 - DNA, 14 bp, Homo sapiens
tccaagactgaaga

SEQ ID NO: 845472 - DNA, 22 bp, Homo sapiens
tccaagactgaagactgcacag

SEQ ID NO: 845473 - DNA, 14 bp, Homo sapiens
tccaagaggctgag

SEQ ID NO: 845474 - DNA, 15 bp, Homo sapiens
tccaagaggctgagg

SEQ ID NO: 845475 - DNA, 14 bp, Homo sapiens
tccaagcacagagc

SEQ ID NO: 845476 - DNA, 14 bp, Homo sapiens
tccaagcacatctt

SEQ ID NO: 845477 - DNA, 20 bp, Homo sapiens
tccaagcagactccagcccc

SEQ ID NO: 845478 - DNA, 23 bp, Homo sapiens
tccaagcagactccagcccctgg

SEQ ID NO: 845479 - DNA, 16 bp, Homo sapiens
tccaagcagagtgttt

SEQ ID NO: 845480 - DNA, 15 bp, Homo sapiens
tccaagcatttcatg

SEQ ID NO: 845481 - DNA, 15 bp, Homo sapiens
tccaagccccatctt

SEQ ID NO: 845482 - DNA, 19 bp, Homo sapiens
tccaagccccatcttctaa

SEQ ID NO: 845483 - DNA, 14 bp, Homo sapiens
tccaagccccctgg

SEQ ID NO: 845484 - DNA, 13 bp, Homo sapiens
tccaagcctgcct

SEQ ID NO: 845485 - DNA, 14 bp, Homo sapiens
tccaagcctggcac

SEQ ID NO: 845486 - DNA, 20 bp, Homo sapiens
tccaagcctggcacccaccg

SEQ ID NO: 845487 - DNA, 22 bp, Homo sapiens
tccaagcgaggtcaacagagaa

SEQ ID NO: 845488 - DNA, 19 bp, Homo sapiens
tccaagcggccctgtgtgt

SEQ ID NO: 845489 - DNA, 14 bp, Homo sapiens
tccaaggaaaattg

SEQ ID NO: 845490 - DNA, 19 bp, Homo sapiens
tccaaggaaaattgaaagt

SEQ ID NO: 845491 - DNA, 14 bp, Homo sapiens
tccaaggaaacatg

SEQ ID NO: 845492 - DNA, 18 bp, Homo sapiens
tccaaggagaccaagtcc

SEQ ID NO: 845493 - DNA, 23 bp, Homo sapiens
tccaaggagaccaagtcctggct

SEQ ID NO: 845494 - DNA, 21 bp, Homo sapiens
tccaaggagttccatgaagac

SEQ ID NO: 845495 - DNA, 12 bp, Homo sapiens
tccaaggatcct

SEQ ID NO: 845496 - DNA, 16 bp, Homo sapiens
tccaaggatcctctcc

SEQ ID NO: 845497 - DNA, 14 bp, Homo sapiens
tccaaggcaaacaa

SEQ ID NO: 845498 - DNA, 15 bp, Homo sapiens
tccaaggcaaacaat

SEQ ID NO: 845499 - DNA, 16 bp, Homo sapiens
tccaaggccagaagga

SEQ ID NO: 845500 - DNA, 17 bp, Homo sapiens
tccaaggccagaaggag

SEQ ID NO: 845501 - DNA, 22 bp, Homo sapiens
tccaaggccagaaggaggggga

SEQ ID NO: 845502 - DNA, 23 bp, Homo sapiens
tccaaggccagaaggagggggac

SEQ ID NO: 845503 - DNA, 12 bp, Homo sapiens
tccaaggccctg

SEQ ID NO: 845504 - DNA, 23 bp, Homo sapiens
tccaaggccctgctttttttctt

SEQ ID NO: 845505 - DNA, 18 bp, Homo sapiens
tccaaggccgcggcccag

SEQ ID NO: 845506 - DNA, 14 bp, Homo sapiens
tccaaggctttaaa

SEQ ID NO: 845507 - DNA, 18 bp, Homo sapiens
tccaagggacaggtgggc

SEQ ID NO: 845508 - DNA, 22 bp, Homo sapiens
tccaagggacaggtgggcctgg

SEQ ID NO: 845509 - DNA, 23 bp, Homo sapiens
tccaagggacaggtgggcctggc

SEQ ID NO: 845510 - DNA, 20 bp, Homo sapiens
tccaaggggcagtcttgcaa

SEQ ID NO: 845511 - DNA, 20 bp, Homo sapiens
tccaagggtatgggaagcca

SEQ ID NO: 845512 - DNA, 23 bp, Homo sapiens
tccaagggtttcgactggtccag

SEQ ID NO: 845513 - DNA, 24 bp, Homo sapiens
tccaagggtttcgactggtccagc

SEQ ID NO: 845514 - DNA, 21 bp, Homo sapiens
tccccagagctgtgccagcag

SEQ ID NO: 845515 - DNA, 14 bp, Homo sapiens
tccccagaggctcc

SEQ ID NO: 845516 - DNA, 16 bp, Homo sapiens
tccccagaggctccca

SEQ ID NO: 845517 - DNA, 17 bp, Homo sapiens
tccccagatctcccact

SEQ ID NO: 845518 - DNA, 19 bp, Homo sapiens
tccccagcatgcaccacgg

SEQ ID NO: 845519 - DNA, 20 bp, Homo sapiens
tccccagcatgcaccacggg

SEQ ID NO: 845520 - DNA, 21 bp, Homo sapiens
tccccagcatgcaccacgggc

SEQ ID NO: 845521 - DNA, 20 bp, Homo sapiens
tccccagcattccagcccct

SEQ ID NO: 845522 - DNA, 15 bp, Homo sapiens
tccccagccagccct

SEQ ID NO: 845523 - DNA, 20 bp, Homo sapiens
tccccagccagggagcttgc

SEQ ID NO: 845524 - DNA, 23 bp, Homo sapiens
tccccagccagggagcttgccac

SEQ ID NO: 845525 - DNA, 13 bp, Homo sapiens
tccccagccctgg

SEQ ID NO: 845526 - DNA, 15 bp, Homo sapiens
tccccagccctggct

SEQ ID NO: 845527 - DNA, 14 bp, Homo sapiens
tccccagccctggg

SEQ ID NO: 845528 - DNA, 21 bp, Homo sapiens
tccccagccctgggcttggct

SEQ ID NO: 845529 - DNA, 19 bp, Homo sapiens
tccccagcccttagcacag

SEQ ID NO: 845530 - DNA, 17 bp, Homo sapiens
tccccagcccttctgcc

SEQ ID NO: 845531 - DNA, 20 bp, Homo sapiens
tccccagcctaggacgccaa

SEQ ID NO: 845532 - DNA, 15 bp, Homo sapiens
tccccagcctgggcc

SEQ ID NO: 845533 - DNA, 17 bp, Homo sapiens
tccccagcctgggccca

SEQ ID NO: 845534 - DNA, 21 bp, Homo sapiens
tccccagcctgggcccatctc

SEQ ID NO: 845535 - DNA, 22 bp, Homo sapiens
tccccagcgtcccagtctctgg

SEQ ID NO: 845536 - DNA, 14 bp, Homo sapiens
tccccagctggtgg

SEQ ID NO: 845537 - DNA, 15 bp, Homo sapiens
tccccagctggtggc

SEQ ID NO: 845538 - DNA, 15 bp, Homo sapiens
tccccagctttctcc

SEQ ID NO: 845539 - DNA, 12 bp, Homo sapiens
tccccaggaccc

SEQ ID NO: 845540 - DNA, 15 bp, Homo sapiens
tccccaggcatttgc

SEQ ID NO: 845541 - DNA, 12 bp, Homo sapiens
tccccaggccag

SEQ ID NO: 845542 - DNA, 22 bp, Homo sapiens
tccccaggccaggccaccagga

SEQ ID NO: 845543 - DNA, 23 bp, Homo sapiens
tccccaggccaggccaccaggat

SEQ ID NO: 845544 - DNA, 12 bp, Homo sapiens
tccccaggcctc

SEQ ID NO: 845545 - DNA, 14 bp, Homo sapiens
tccccaggcctggc

SEQ ID NO: 845546 - DNA, 16 bp, Homo sapiens
tccccaggctggagac

SEQ ID NO: 845547 - DNA, 13 bp, Homo sapiens
tccccagggagct

SEQ ID NO: 845548 - DNA, 15 bp, Homo sapiens
tccccagggagctct

SEQ ID NO: 845549 - DNA, 22 bp, Homo sapiens
tccccagggcccctccctctgc

SEQ ID NO: 845550 - DNA, 10 bp, Homo sapiens
tccccagggg

SEQ ID NO: 845551 - DNA, 14 bp, Homo sapiens
tccccaggggagag

SEQ ID NO: 845552 - DNA, 23 bp, Homo sapiens
tccccaggggagagggtctggag

SEQ ID NO: 845553 - DNA, 16 bp, Homo sapiens
tccccaggtccagctc

SEQ ID NO: 845554 - DNA, 15 bp, Homo sapiens
tccccaggtccccaa

SEQ ID NO: 845555 - DNA, 19 bp, Homo sapiens
tccccaggtccccaaactt

SEQ ID NO: 845556 - DNA, 18 bp, Homo sapiens
tccccaggtcctgtctct

SEQ ID NO: 845557 - DNA, 20 bp, Homo sapiens
tccccaggtcctgtctctgc

SEQ ID NO: 845558 - DNA, 15 bp, Homo sapiens
tccccaggtggctga

SEQ ID NO: 845559 - DNA, 19 bp, Homo sapiens
tccccaggtggctgaccca

SEQ ID NO: 845560 - DNA, 20 bp, Homo sapiens
tccccaggtggctgacccag

SEQ ID NO: 845561 - DNA, 14 bp, Homo sapiens
tccccagtccccag

SEQ ID NO: 845562 - DNA, 16 bp, Homo sapiens
tccccagtccccagcc

SEQ ID NO: 845563 - DNA, 11 bp, Homo sapiens
tccccagtgcc

SEQ ID NO: 845564 - DNA, 14 bp, Homo sapiens
tccccagtgcctgc

SEQ ID NO: 845565 - DNA, 15 bp, Homo sapiens
tccccagtgcctgcc

SEQ ID NO: 845566 - DNA, 17 bp, Homo sapiens
tccccataactcaatgg

SEQ ID NO: 845567 - DNA, 16 bp, Homo sapiens
tccccatacacacaca

SEQ ID NO: 845568 - DNA, 16 bp, Homo sapiens
tccccatcatcccagc

SEQ ID NO: 845569 - DNA, 16 bp, Homo sapiens
tccccatccccaccag

SEQ ID NO: 845570 - DNA, 17 bp, Homo sapiens
tccccatccccaccagc

SEQ ID NO: 845571 - DNA, 17 bp, Homo sapiens
tccccatccctgtcatt

SEQ ID NO: 845572 - DNA, 16 bp, Homo sapiens
tccccatcctccagct

SEQ ID NO: 845573 - DNA, 17 bp, Homo sapiens
tccccatcggccctgtc

SEQ ID NO: 845574 - DNA, 18 bp, Homo sapiens
tccccatcggccctgtcc

SEQ ID NO: 845575 - DNA, 20 bp, Homo sapiens
tccccatcggccctgtcccc

SEQ ID NO: 845576 - DNA, 16 bp, Homo sapiens
tccccatctccctgcc

SEQ ID NO: 845577 - DNA, 20 bp, Homo sapiens
tccccatctccctgcctggc

SEQ ID NO: 845578 - DNA, 14 bp, Homo sapiens
tccccatctgggtc

SEQ ID NO: 845579 - DNA, 17 bp, Homo sapiens
tccccatctgtccagct

SEQ ID NO: 845580 - DNA, 21 bp, Homo sapiens
tccccatgccacgttccacag

SEQ ID NO: 845581 - DNA, 13 bp, Homo sapiens
tccccatggagcc

SEQ ID NO: 845582 - DNA, 16 bp, Homo sapiens
tccccatggagccagc

SEQ ID NO: 845583 - DNA, 22 bp, Homo sapiens
tccccatggcttgttctctgga

SEQ ID NO: 845584 - DNA, 19 bp, Homo sapiens
tccccattagagtcagcct

SEQ ID NO: 845585 - DNA, 16 bp, Homo sapiens
tccccatttccactgt

SEQ ID NO: 845586 - DNA, 15 bp, Homo sapiens
tccccatttcccatc

SEQ ID NO: 845587 - DNA, 22 bp, Homo sapiens
tccccatttcctgtacaatcat

SEQ ID NO: 845588 - DNA, 15 bp, Homo sapiens
tccccatttctgcct

SEQ ID NO: 845589 - DNA, 16 bp, Homo sapiens
tccccatttctgcctc

SEQ ID NO: 845590 - DNA, 16 bp, Homo sapiens
tcccccaaacagactc

SEQ ID NO: 845591 - DNA, 17 bp, Homo sapiens
tcccccaaagttcacaa

SEQ ID NO: 845592 - DNA, 16 bp, Homo sapiens
tcccccaacacctgct

SEQ ID NO: 845593 - DNA, 18 bp, Homo sapiens
tcccccaacacctgctgc

SEQ ID NO: 845594 - DNA, 15 bp, Homo sapiens
tcccccaacccccac

SEQ ID NO: 845595 - DNA, 17 bp, Homo sapiens
tcccccaacccccaccc

SEQ ID NO: 845596 - DNA, 19 bp, Homo sapiens
tcccccaacccccacccca

SEQ ID NO: 845597 - DNA, 16 bp, Homo sapiens
tcccccaaccccctgc

SEQ ID NO: 845598 - DNA, 12 bp, Homo sapiens
tcccccaactct

SEQ ID NO: 845599 - DNA, 19 bp, Homo sapiens
tcccccaccactcaggcca

SEQ ID NO: 845600 - DNA, 22 bp, Homo sapiens
tcccccaccagctaaggacatt

SEQ ID NO: 845601 - DNA, 19 bp, Homo sapiens
tcccccacccatggggagg

SEQ ID NO: 845602 - DNA, 20 bp, Homo sapiens
tcccccaccccctccccagg

SEQ ID NO: 845603 - DNA, 15 bp, Homo sapiens
tcccccacccctcca

SEQ ID NO: 845604 - DNA, 13 bp, Homo sapiens
tcccccaccctcc

SEQ ID NO: 845605 - DNA, 20 bp, Homo sapiens
tcccccaccggtccagctgg

SEQ ID NO: 845606 - DNA, 22 bp, Homo sapiens
tcccccaccggtccagctggcc

SEQ ID NO: 845607 - DNA, 22 bp, Homo sapiens
tcccccacctgacaatggcagc

SEQ ID NO: 845608 - DNA, 18 bp, Homo sapiens
tcccccactactgcagca

SEQ ID NO: 845609 - DNA, 19 bp, Homo sapiens
tcccccactctctcaccca

SEQ ID NO: 845610 - DNA, 20 bp, Homo sapiens
tcccccagcaacgcccctcc

SEQ ID NO: 845611 - DNA, 13 bp, Homo sapiens
tcccccagcaagc

SEQ ID NO: 845612 - DNA, 12 bp, Homo sapiens
tcccccagcaca

SEQ ID NO: 845613 - DNA, 24 bp, Homo sapiens
tcccccagcacagatgaggagcag

SEQ ID NO: 845614 - DNA, 23 bp, Homo sapiens
tcccccagcagaatggaggcagg

SEQ ID NO: 845615 - DNA, 19 bp, Homo sapiens
tcccccagccaaactgtct

SEQ ID NO: 845616 - DNA, 22 bp, Homo sapiens
tcccccagccatgccagctggc

SEQ ID NO: 845617 - DNA, 12 bp, Homo sapiens
tcccccagccct

SEQ ID NO: 845618 - DNA, 14 bp, Homo sapiens
tcccccagccctgt

SEQ ID NO: 845619 - DNA, 18 bp, Homo sapiens
tcccccagctctggtgag

SEQ ID NO: 845620 - DNA, 13 bp, Homo sapiens
tcccccagctgcg

SEQ ID NO: 845621 - DNA, 17 bp, Homo sapiens
tcccccatagcaccctg

SEQ ID NO: 845622 - DNA, 18 bp, Homo sapiens
tcccccatcccctttcct

SEQ ID NO: 845623 - DNA, 15 bp, Homo sapiens
tcccccatgtggctg

SEQ ID NO: 845624 - DNA, 12 bp, Homo sapiens
tccccccactct

SEQ ID NO: 845625 - DNA, 19 bp, Homo sapiens
tccccccactgcaggcccc

SEQ ID NO: 845626 - DNA, 11 bp, Homo sapiens
tccccccactt

SEQ ID NO: 845627 - DNA, 21 bp, Homo sapiens
tccccccagaccccgcccctg

SEQ ID NO: 845628 - DNA, 12 bp, Homo sapiens
tccccccagact

SEQ ID NO: 845629 - DNA, 17 bp, Homo sapiens
tccccccagctccctgc

SEQ ID NO: 845630 - DNA, 14 bp, Homo sapiens
tccccccatcccag

SEQ ID NO: 845631 - DNA, 15 bp, Homo sapiens
tccccccatcttgct

SEQ ID NO: 845632 - DNA, 14 bp, Homo sapiens
tcccccccagcctg

SEQ ID NO: 845633 - DNA, 15 bp, Homo sapiens
tccccccccaggccc

SEQ ID NO: 845634 - DNA, 14 bp, Homo sapiens
tcccccccctttcc

SEQ ID NO: 845635 - DNA, 13 bp, Homo sapiens
tccccccgcccac

SEQ ID NO: 845636 - DNA, 16 bp, Homo sapiens
tccccccgcccaccca

SEQ ID NO: 845637 - DNA, 21 bp, Homo sapiens
tcccgggcccgttgaggatga

SEQ ID NO: 845638 - DNA, 15 bp, Homo sapiens
tcccgggctgtccac

SEQ ID NO: 845639 - DNA, 21 bp, Homo sapiens
tcccggggccagcacttccat

SEQ ID NO: 845640 - DNA, 14 bp, Homo sapiens
tcccggggcccagg

SEQ ID NO: 845641 - DNA, 15 bp, Homo sapiens
tcccgggtccttggc

SEQ ID NO: 845642 - DNA, 17 bp, Homo sapiens
tcccgggtccttggccc

SEQ ID NO: 845643 - DNA, 14 bp, Homo sapiens
tcccggtcccgagt

SEQ ID NO: 845644 - DNA, 23 bp, Homo sapiens
tcccggtgtatcctggccctggg

SEQ ID NO: 845645 - DNA, 16 bp, Homo sapiens
tcccggttcaccttgc

SEQ ID NO: 845646 - DNA, 20 bp, Homo sapiens
tcccggttcagacccctgcc

SEQ ID NO: 845647 - DNA, 16 bp, Homo sapiens
tcccggttcaggacca

SEQ ID NO: 845648 - DNA, 14 bp, Homo sapiens
tcccgtacctcttc

SEQ ID NO: 845649 - DNA, 15 bp, Homo sapiens
tcccgtatcacagtg

SEQ ID NO: 845650 - DNA, 16 bp, Homo sapiens
tcccgtatcacagtgt

SEQ ID NO: 845651 - DNA, 15 bp, Homo sapiens
tcccgtcgtgcagtc

SEQ ID NO: 845652 - DNA, 19 bp, Homo sapiens
tcccgtgaaagaattattt

SEQ ID NO: 845653 - DNA, 23 bp, Homo sapiens
tcccgtgaaagaattatttttgt

SEQ ID NO: 845654 - DNA, 18 bp, Homo sapiens
tcccgtgcccctttcctt

SEQ ID NO: 845655 - DNA, 16 bp, Homo sapiens
tcccgtggaacgtttt

SEQ ID NO: 845656 - DNA, 18 bp, Homo sapiens
tcccgtgtgtatttctaa

SEQ ID NO: 845657 - DNA, 18 bp, Homo sapiens
tcccgtgtgtggttggaa

SEQ ID NO: 845658 - DNA, 19 bp, Homo sapiens
tcccgttccccgctccaca

SEQ ID NO: 845659 - DNA, 20 bp, Homo sapiens
tcccgtttctccacctagac

SEQ ID NO: 845660 - DNA, 14 bp, Homo sapiens
tccctaaactgcag

SEQ ID NO: 845661 - DNA, 15 bp, Homo sapiens
tccctaaactgcagc

SEQ ID NO: 845662 - DNA, 16 bp, Homo sapiens
tccctaaactttggcc

SEQ ID NO: 845663 - DNA, 14 bp, Homo sapiens
tccctaactctcgg

SEQ ID NO: 845664 - DNA, 15 bp, Homo sapiens
tccctaaggaatctg

SEQ ID NO: 845665 - DNA, 16 bp, Homo sapiens
tccctaaggaatctga

SEQ ID NO: 845666 - DNA, 19 bp, Homo sapiens
tccctaagtaagtttcttc

SEQ ID NO: 845667 - DNA, 23 bp, Homo sapiens
tccctaatctatggtcgggagac

SEQ ID NO: 845668 - DNA, 17 bp, Homo sapiens
tccctaatgttttgctt

SEQ ID NO: 845669 - DNA, 16 bp, Homo sapiens
tccctacattccccag

SEQ ID NO: 845670 - DNA, 18 bp, Homo sapiens
tccctacattccccagag

SEQ ID NO: 845671 - DNA, 15 bp, Homo sapiens
tccctaccaaaaatt

SEQ ID NO: 845672 - DNA, 14 bp, Homo sapiens
tccctaccactgtg

SEQ ID NO: 845673 - DNA, 23 bp, Homo sapiens
tccctacccaatgtctcccacac

SEQ ID NO: 845674 - DNA, 19 bp, Homo sapiens
tccctaccgagtctcttct

SEQ ID NO: 845675 - DNA, 21 bp, Homo sapiens
tccctaccgagtctcttctcc

SEQ ID NO: 845676 - DNA, 22 bp, Homo sapiens
tccctaccgagtctcttctcca

SEQ ID NO: 845677 - DNA, 15 bp, Homo sapiens
tccctacctcaggca

SEQ ID NO: 845678 - DNA, 13 bp, Homo sapiens
tccctacctccct

SEQ ID NO: 845679 - DNA, 21 bp, Homo sapiens
tccctacctccctcctcaggg

SEQ ID NO: 845680 - DNA, 15 bp, Homo sapiens
tccctactgtaattt

SEQ ID NO: 845681 - DNA, 18 bp, Homo sapiens
tccctagaaacttccaaa

SEQ ID NO: 845682 - DNA, 20 bp, Homo sapiens
tccctagaaagccatattcc

SEQ ID NO: 845683 - DNA, 22 bp, Homo sapiens
tccctagaaagccatattccag

SEQ ID NO: 845684 - DNA, 23 bp, Homo sapiens
tccctagaaagccatattccagc

SEQ ID NO: 845685 - DNA, 22 bp, Homo sapiens
tccctagccagcacttgtatat

SEQ ID NO: 845686 - DNA, 12 bp, Homo sapiens
tccctagccctt

SEQ ID NO: 845687 - DNA, 23 bp, Homo sapiens
tccctagcccttccagcctggga

SEQ ID NO: 845688 - DNA, 20 bp, Homo sapiens
tccctagctttagaccctgg

SEQ ID NO: 845689 - DNA, 21 bp, Homo sapiens
tccctagtagctgggattaca

SEQ ID NO: 845690 - DNA, 22 bp, Homo sapiens
tccctagtccccctgttttctg

SEQ ID NO: 845691 - DNA, 18 bp, Homo sapiens
tccctattagagaagaga

SEQ ID NO: 845692 - DNA, 13 bp, Homo sapiens
tccctcaaatgac

SEQ ID NO: 845693 - DNA, 21 bp, Homo sapiens
tccctcaaatgcgcgtgtgca

SEQ ID NO: 845694 - DNA, 15 bp, Homo sapiens
tccctcaccccctcc

SEQ ID NO: 845695 - DNA, 20 bp, Homo sapiens
tccctcaccccctcccaccc

SEQ ID NO: 845696 - DNA, 15 bp, Homo sapiens
tccctcaccctgagc

SEQ ID NO: 845697 - DNA, 19 bp, Homo sapiens
tccctcaccctgagcccct

SEQ ID NO: 845698 - DNA, 20 bp, Homo sapiens
tccctcaccctgagcccctt

SEQ ID NO: 845699 - DNA, 19 bp, Homo sapiens
tccctcacgtttcttcccc

SEQ ID NO: 845700 - DNA, 20 bp, Homo sapiens
tccctcactccacagagtga

SEQ ID NO: 845701 - DNA, 20 bp, Homo sapiens
tccctcagccgtcagccatc

SEQ ID NO: 845702 - DNA, 21 bp, Homo sapiens
tccctcagcctccccttcttc

SEQ ID NO: 845703 - DNA, 17 bp, Homo sapiens
tccctcagctctctggg

SEQ ID NO: 845704 - DNA, 18 bp, Homo sapiens
tccctcagctctctggga

SEQ ID NO: 845705 - DNA, 15 bp, Homo sapiens
tccctcaggggcagg

SEQ ID NO: 845706 - DNA, 16 bp, Homo sapiens
tccctcaggggcaggt

SEQ ID NO: 845707 - DNA, 14 bp, Homo sapiens
tccctcatcctttc

SEQ ID NO: 845708 - DNA, 16 bp, Homo sapiens
tccctcatctgtccct

SEQ ID NO: 845709 - DNA, 15 bp, Homo sapiens
tccctcatggctctg

SEQ ID NO: 845710 - DNA, 19 bp, Homo sapiens
tccctcattcatcttgcaa

SEQ ID NO: 845711 - DNA, 15 bp, Homo sapiens
tccctccaagcctgg

SEQ ID NO: 845712 - DNA, 18 bp, Homo sapiens
tccctccaagcctggcac

SEQ ID NO: 845713 - DNA, 14 bp, Homo sapiens
tccctccaattccc

SEQ ID NO: 845714 - DNA, 17 bp, Homo sapiens
tccctccaattccccct

SEQ ID NO: 845715 - DNA, 13 bp, Homo sapiens
tccctccaccagc

SEQ ID NO: 845716 - DNA, 15 bp, Homo sapiens
tccctccaccagcct

SEQ ID NO: 845717 - DNA, 20 bp, Homo sapiens
tccctccaccagcctgctga

SEQ ID NO: 845718 - DNA, 21 bp, Homo sapiens
tccctccaccagcctgctgac

SEQ ID NO: 845719 - DNA, 11 bp, Homo sapiens
tccctccaccc

SEQ ID NO: 845720 - DNA, 13 bp, Homo sapiens
tccctccacccca

SEQ ID NO: 845721 - DNA, 14 bp, Homo sapiens
tccctccaccccag

SEQ ID NO: 845722 - DNA, 16 bp, Homo sapiens
tccctccaccccagga

SEQ ID NO: 845723 - DNA, 21 bp, Homo sapiens
tccctccacccccatgtggca

SEQ ID NO: 845724 - DNA, 13 bp, Homo sapiens
tccctccacctca

SEQ ID NO: 845725 - DNA, 14 bp, Homo sapiens
tccctccactcctc

SEQ ID NO: 845726 - DNA, 13 bp, Homo sapiens
tccctccatcccc

SEQ ID NO: 845727 - DNA, 18 bp, Homo sapiens
tccctcccacacttccca

SEQ ID NO: 845728 - DNA, 12 bp, Homo sapiens
tccctcccagaa

SEQ ID NO: 845729 - DNA, 21 bp, Homo sapiens
tccctcccagaaaaactggct

SEQ ID NO: 845730 - DNA, 12 bp, Homo sapiens
tccctcccagct

SEQ ID NO: 845731 - DNA, 16 bp, Homo sapiens
tccctcccagctgcac

SEQ ID NO: 845732 - DNA, 17 bp, Homo sapiens
tccctcccatcctccag

SEQ ID NO: 845733 - DNA, 14 bp, Homo sapiens
tccctccccaccca

SEQ ID NO: 845734 - DNA, 18 bp, Homo sapiens
tccctccccacccaagag

SEQ ID NO: 845735 - DNA, 14 bp, Homo sapiens
tccctcccccagca

SEQ ID NO: 845736 - DNA, 23 bp, Homo sapiens
tccctcccccagccaccaccctc

SEQ ID NO: 845737 - DNA, 12 bp, Homo sapiens
tccctccccctt

SEQ ID NO: 845738 - DNA, 14 bp, Homo sapiens
tccctcccccttgt

SEQ ID NO: 845739 - DNA, 18 bp, Homo sapiens
tccctccccgctgccctt

SEQ ID NO: 845740 - DNA, 13 bp, Homo sapiens
tccctcccctctc

SEQ ID NO: 845741 - DNA, 17 bp, Homo sapiens
tccctcccctctcagaa

SEQ ID NO: 845742 - DNA, 21 bp, Homo sapiens
tccctcccctctcagaacata

SEQ ID NO: 845743 - DNA, 16 bp, Homo sapiens
tccctcccctgccatt

SEQ ID NO: 845744 - DNA, 17 bp, Homo sapiens
tccctccctagcccttc

SEQ ID NO: 845745 - DNA, 19 bp, Homo sapiens
tccctccctagcccttcca

SEQ ID NO: 845746 - DNA, 20 bp, Homo sapiens
tccctccctagcccttccag

SEQ ID NO: 845747 - DNA, 22 bp, Homo sapiens
tccctccctagcccttccagcc

SEQ ID NO: 845748 - DNA, 12 bp, Homo sapiens
tccctccctctc

SEQ ID NO: 845749 - DNA, 14 bp, Homo sapiens
tccctccctgcctg

SEQ ID NO: 845750 - DNA, 17 bp, Homo sapiens
tccctccgactccagat

SEQ ID NO: 845751 - DNA, 14 bp, Homo sapiens
tccctccgagcttg

SEQ ID NO: 845752 - DNA, 19 bp, Homo sapiens
tccctccggcttgacctgt

SEQ ID NO: 845753 - DNA, 16 bp, Homo sapiens
tccctccgggcagggg

SEQ ID NO: 845754 - DNA, 22 bp, Homo sapiens
tccctccgggcaggggagccag

SEQ ID NO: 845755 - DNA, 12 bp, Homo sapiens
tccctcctcacc

SEQ ID NO: 845756 - DNA, 14 bp, Homo sapiens
tccctcctcacctc

SEQ ID NO: 845757 - DNA, 10 bp, Homo sapiens
tccctcctcc

SEQ ID NO: 845758 - DNA, 14 bp, Homo sapiens
tccctcctctggca

SEQ ID NO: 845759 - DNA, 18 bp, Homo sapiens
tccctggaagcttaaagt

SEQ ID NO: 845760 - DNA, 11 bp, Homo sapiens
tccctggacag

SEQ ID NO: 845761 - DNA, 22 bp, Homo sapiens
tccctggacaggcagcctcctt

SEQ ID NO: 845762 - DNA, 16 bp, Homo sapiens
tccctggaccccattc

SEQ ID NO: 845763 - DNA, 19 bp, Homo sapiens
tccctggagaagcaccagc

SEQ ID NO: 845764 - DNA, 14 bp, Homo sapiens
tccctggagccctg

SEQ ID NO: 845765 - DNA, 17 bp, Homo sapiens
tccctggagtcagggtg

SEQ ID NO: 845766 - DNA, 20 bp, Homo sapiens
tccctggatctacctggagg

SEQ ID NO: 845767 - DNA, 22 bp, Homo sapiens
tccctggatctacctggaggga

SEQ ID NO: 845768 - DNA, 14 bp, Homo sapiens
tccctggcactgaa

SEQ ID NO: 845769 - DNA, 16 bp, Homo sapiens
tccctggcatgatgga

SEQ ID NO: 845770 - DNA, 14 bp, Homo sapiens
tccctggccactga

SEQ ID NO: 845771 - DNA, 21 bp, Homo sapiens
tccctggcgcaggtgggctgg

SEQ ID NO: 845772 - DNA, 15 bp, Homo sapiens
tccctggcggcccca

SEQ ID NO: 845773 - DNA, 15 bp, Homo sapiens
tccctggctctcaga

SEQ ID NO: 845774 - DNA, 18 bp, Homo sapiens
tccctggctctcagaagg

SEQ ID NO: 845775 - DNA, 14 bp, Homo sapiens
tccctggctgccct

SEQ ID NO: 845776 - DNA, 21 bp, Homo sapiens
tccctggctgccctggccctg

SEQ ID NO: 845777 - DNA, 23 bp, Homo sapiens
tccctggctgccctggccctgag

SEQ ID NO: 845778 - DNA, 23 bp, Homo sapiens
tccctgggaagcctgtgccagca

SEQ ID NO: 845779 - DNA, 20 bp, Homo sapiens
tccctgggacacagacccag

SEQ ID NO: 845780 - DNA, 19 bp, Homo sapiens
tccctgggaggaaatttga

SEQ ID NO: 845781 - DNA, 23 bp, Homo sapiens
tccctgggcaagtggatggccca

SEQ ID NO: 845782 - DNA, 22 bp, Homo sapiens
tccctgggccacctcctacccc

SEQ ID NO: 845783 - DNA, 16 bp, Homo sapiens
tccctgggcccctcca

SEQ ID NO: 845784 - DNA, 13 bp, Homo sapiens
tccctgggcctca

SEQ ID NO: 845785 - DNA, 19 bp, Homo sapiens
tccctgggctgtgctacct

SEQ ID NO: 845786 - DNA, 20 bp, Homo sapiens
tccctggggagccctcaggc

SEQ ID NO: 845787 - DNA, 16 bp, Homo sapiens
tccctggggttctcta

SEQ ID NO: 845788 - DNA, 21 bp, Homo sapiens
tccctggtagtgtagctgtgt

SEQ ID NO: 845789 - DNA, 20 bp, Homo sapiens
tccctggtcaccaaggcagt

SEQ ID NO: 845790 - DNA, 22 bp, Homo sapiens
tccctggtcaccaaggcagtgc

SEQ ID NO: 845791 - DNA, 15 bp, Homo sapiens
tccctggtcccctcc

SEQ ID NO: 845792 - DNA, 14 bp, Homo sapiens
tccctggtcccttg

SEQ ID NO: 845793 - DNA, 22 bp, Homo sapiens
tccctggtgcctctgtgcacag

SEQ ID NO: 845794 - DNA, 17 bp, Homo sapiens
tccctggttgcctctct

SEQ ID NO: 845795 - DNA, 19 bp, Homo sapiens
tccctgtaacctcttcaga

SEQ ID NO: 845796 - DNA, 17 bp, Homo sapiens
tccctgtagctctgcct

SEQ ID NO: 845797 - DNA, 21 bp, Homo sapiens
tccctgtattttctttctcta

SEQ ID NO: 845798 - DNA, 20 bp, Homo sapiens
tccctgtcacacactggacc

SEQ ID NO: 845799 - DNA, 14 bp, Homo sapiens
tccctgtcagaggc

SEQ ID NO: 845800 - DNA, 17 bp, Homo sapiens
tccctgtcccagggccc

SEQ ID NO: 845801 - DNA, 15 bp, Homo sapiens
tccctgtccctgccc

SEQ ID NO: 845802 - DNA, 12 bp, Homo sapiens
tccctgtcctcc

SEQ ID NO: 845803 - DNA, 20 bp, Homo sapiens
tccctgtctccagctgcctg

SEQ ID NO: 845804 - DNA, 22 bp, Homo sapiens
tccctgtctccagctgcctggg

SEQ ID NO: 845805 - DNA, 14 bp, Homo sapiens
tccctgtctccagg

SEQ ID NO: 845806 - DNA, 18 bp, Homo sapiens
tccctgtgcccccagcct

SEQ ID NO: 845807 - DNA, 24 bp, Homo sapiens
tccctgtgcccccagcctcagccc

SEQ ID NO: 845808 - DNA, 19 bp, Homo sapiens
tccctgtggggcaggagtg

SEQ ID NO: 845809 - DNA, 23 bp, Homo sapiens
tccctgtggggcaggagtgccag

SEQ ID NO: 845810 - DNA, 12 bp, Homo sapiens
tccctgtgtgga

SEQ ID NO: 845811 - DNA, 22 bp, Homo sapiens
tccctgttcacggtgacacagg

SEQ ID NO: 845812 - DNA, 12 bp, Homo sapiens
tccctgttcatt

SEQ ID NO: 845813 - DNA, 15 bp, Homo sapiens
tccctgttctccctt

SEQ ID NO: 845814 - DNA, 17 bp, Homo sapiens
tccctgttctccctttc

SEQ ID NO: 845815 - DNA, 19 bp, Homo sapiens
tccctgttctccctttctc

SEQ ID NO: 845816 - DNA, 14 bp, Homo sapiens
tccctgttcttcct

SEQ ID NO: 845817 - DNA, 11 bp, Homo sapiens
tccctgtttaa

SEQ ID NO: 845818 - DNA, 14 bp, Homo sapiens
tccctgtttaatat

SEQ ID NO: 845819 - DNA, 21 bp, Homo sapiens
tccctgtttaatatttaaaca

SEQ ID NO: 845820 - DNA, 22 bp, Homo sapiens
tccctgtttaatatttaaacag

SEQ ID NO: 845821 - DNA, 17 bp, Homo sapiens
tccctgtttcaaactga

SEQ ID NO: 845822 - DNA, 19 bp, Homo sapiens
tccctgttttcccacgagg

SEQ ID NO: 845823 - DNA, 15 bp, Homo sapiens
tccctgttttctgag

SEQ ID NO: 845824 - DNA, 22 bp, Homo sapiens
tcccttaaaattaccagacaaa

SEQ ID NO: 845825 - DNA, 15 bp, Homo sapiens
tcccttaaacaaaaa

SEQ ID NO: 845826 - DNA, 16 bp, Homo sapiens
tcccttaacagttgta

SEQ ID NO: 845827 - DNA, 17 bp, Homo sapiens
tcccttaacagttgtat

SEQ ID NO: 845828 - DNA, 23 bp, Homo sapiens
tcccttaactctaaccctgtgga

SEQ ID NO: 845829 - DNA, 23 bp, Homo sapiens
tcccttaacttttccttgtatgt

SEQ ID NO: 845830 - DNA, 18 bp, Homo sapiens
tcccttaaggtctccaaa

SEQ ID NO: 845831 - DNA, 17 bp, Homo sapiens
tcccttaatatcctaaa

SEQ ID NO: 845832 - DNA, 21 bp, Homo sapiens
tcccttaatattgaggctgca

SEQ ID NO: 845833 - DNA, 17 bp, Homo sapiens
tcccttaccctcctctg

SEQ ID NO: 845834 - DNA, 22 bp, Homo sapiens
tcccttaccctcctctgctggg

SEQ ID NO: 845835 - DNA, 13 bp, Homo sapiens
tcccttacctcaa

SEQ ID NO: 845836 - DNA, 14 bp, Homo sapiens
tcccttacctcaaa

SEQ ID NO: 845837 - DNA, 16 bp, Homo sapiens
tcccttagaagagagc

SEQ ID NO: 845838 - DNA, 20 bp, Homo sapiens
tcccttagcctctcccaccc

SEQ ID NO: 845839 - DNA, 16 bp, Homo sapiens
tcccttaggcattatt

SEQ ID NO: 845840 - DNA, 23 bp, Homo sapiens
tcccttaggcattatttaatgtt

SEQ ID NO: 845841 - DNA, 18 bp, Homo sapiens
tcccttatccaaaatgct

SEQ ID NO: 845842 - DNA, 21 bp, Homo sapiens
tcccttattagttacaaagtt

SEQ ID NO: 845843 - DNA, 22 bp, Homo sapiens
tcccttcaaccattccccatgg

SEQ ID NO: 845844 - DNA, 16 bp, Homo sapiens
tcccttcaaggcctcc

SEQ ID NO: 845845 - DNA, 18 bp, Homo sapiens
tcccttcaaggcctcccc

SEQ ID NO: 845846 - DNA, 20 bp, Homo sapiens
tcccttcagtaccctctcag

SEQ ID NO: 845847 - DNA, 13 bp, Homo sapiens
tcccttccaaaga

SEQ ID NO: 845848 - DNA, 12 bp, Homo sapiens
tcccttccagtt

SEQ ID NO: 845849 - DNA, 14 bp, Homo sapiens
tcccttccatgccc

SEQ ID NO: 845850 - DNA, 16 bp, Homo sapiens
tcccttccatgccctg

SEQ ID NO: 845851 - DNA, 18 bp, Homo sapiens
tcccttccatgccctggg

SEQ ID NO: 845852 - DNA, 16 bp, Homo sapiens
tcccttcccacatgcc

SEQ ID NO: 845853 - DNA, 17 bp, Homo sapiens
tcccttcccacatgcct

SEQ ID NO: 845854 - DNA, 16 bp, Homo sapiens
tcccttcccagtgggc

SEQ ID NO: 845855 - DNA, 19 bp, Homo sapiens
tcccttcccagtgggctgt

SEQ ID NO: 845856 - DNA, 16 bp, Homo sapiens
tcccttcccgacccag

SEQ ID NO: 845857 - DNA, 18 bp, Homo sapiens
tcccttcccgacccagcc

SEQ ID NO: 845858 - DNA, 20 bp, Homo sapiens
tcccttcccgacccagccag

SEQ ID NO: 845859 - DNA, 15 bp, Homo sapiens
tcccttccctcaccc

SEQ ID NO: 845860 - DNA, 16 bp, Homo sapiens
tcccttccctcctccc

SEQ ID NO: 845861 - DNA, 15 bp, Homo sapiens
tcccttccctgcagg

SEQ ID NO: 845862 - DNA, 21 bp, Homo sapiens
tcccttccgaccctctgggaa

SEQ ID NO: 845863 - DNA, 22 bp, Homo sapiens
tcccttccgaccctctgggaac

SEQ ID NO: 845864 - DNA, 17 bp, Homo sapiens
tcccttccgtccatccc

SEQ ID NO: 845865 - DNA, 21 bp, Homo sapiens
tcccttccgtccatccccctt

SEQ ID NO: 845866 - DNA, 17 bp, Homo sapiens
tcccttcctattctcct

SEQ ID NO: 845867 - DNA, 12 bp, Homo sapiens
tcccttcctcca

SEQ ID NO: 845868 - DNA, 14 bp, Homo sapiens
tcccttcctccatt

SEQ ID NO: 845869 - DNA, 15 bp, Homo sapiens
tcccttcctccattg

SEQ ID NO: 845870 - DNA, 14 bp, Homo sapiens
tcccttcctctctc

SEQ ID NO: 845871 - DNA, 18 bp, Homo sapiens
tcccttcctcttcctgcc

SEQ ID NO: 845872 - DNA, 17 bp, Homo sapiens
tcccttcctcttcggcc

SEQ ID NO: 845873 - DNA, 19 bp, Homo sapiens
tcccttcctggaaacagca

SEQ ID NO: 845874 - DNA, 13 bp, Homo sapiens
tcccttcctggcc

SEQ ID NO: 845875 - DNA, 14 bp, Homo sapiens
tcccttcctggcct

SEQ ID NO: 845876 - DNA, 16 bp, Homo sapiens
tcccttcctggcctca

SEQ ID NO: 845877 - DNA, 14 bp, Homo sapiens
tcccttcctgttcc

SEQ ID NO: 845878 - DNA, 23 bp, Homo sapiens
tcccttcctgttccctcctggtc

SEQ ID NO: 845879 - DNA, 20 bp, Homo sapiens
tcccttccttttccctgctt

SEQ ID NO: 845880 - DNA, 14 bp, Homo sapiens
tcctaccaatgcat

SEQ ID NO: 845881 - DNA, 21 bp, Homo sapiens
tcctaccaatgcatgcagcca

SEQ ID NO: 845882 - DNA, 22 bp, Homo sapiens
tcctaccagttgccctagccca

SEQ ID NO: 845883 - DNA, 23 bp, Homo sapiens
tcctaccagttgccctagcccag

SEQ ID NO: 845884 - DNA, 16 bp, Homo sapiens
tcctacccaaccactc

SEQ ID NO: 845885 - DNA, 17 bp, Homo sapiens
tcctacccagcgtggcc

SEQ ID NO: 845886 - DNA, 23 bp, Homo sapiens
tcctacccagcgtggcccaggcc

SEQ ID NO: 845887 - DNA, 15 bp, Homo sapiens
tcctacccatccccg

SEQ ID NO: 845888 - DNA, 20 bp, Homo sapiens
tcctaccccttcctgtcctg

SEQ ID NO: 845889 - DNA, 21 bp, Homo sapiens
tcctaccccttcctgtcctgc

SEQ ID NO: 845890 - DNA, 22 bp, Homo sapiens
tcctacccgcccgcgtccaacc

SEQ ID NO: 845891 - DNA, 17 bp, Homo sapiens
tcctaccctcgggccca

SEQ ID NO: 845892 - DNA, 15 bp, Homo sapiens
tcctaccctgcgccc

SEQ ID NO: 845893 - DNA, 18 bp, Homo sapiens
tcctaccgtactccctgc

SEQ ID NO: 845894 - DNA, 22 bp, Homo sapiens
tcctacctattatccttctact

SEQ ID NO: 845895 - DNA, 12 bp, Homo sapiens
tcctacctcagc

SEQ ID NO: 845896 - DNA, 14 bp, Homo sapiens
tcctacctcagcct

SEQ ID NO: 845897 - DNA, 21 bp, Homo sapiens
tcctacctcagcctcctgggt

SEQ ID NO: 845898 - DNA, 18 bp, Homo sapiens
tcctacctgctgctgcta

SEQ ID NO: 845899 - DNA, 20 bp, Homo sapiens
tcctacctgctgctgctatt

SEQ ID NO: 845900 - DNA, 18 bp, Homo sapiens
tcctacctggggactcct

SEQ ID NO: 845901 - DNA, 20 bp, Homo sapiens
tcctactccgttcctggcat

SEQ ID NO: 845902 - DNA, 16 bp, Homo sapiens
tcctactcggctctgc

SEQ ID NO: 845903 - DNA, 23 bp, Homo sapiens
tcctacttagggaagaaaaagca

SEQ ID NO: 845904 - DNA, 14 bp, Homo sapiens
tcctacttcccctt

SEQ ID NO: 845905 - DNA, 18 bp, Homo sapiens
tcctacttctgactttac

SEQ ID NO: 845906 - DNA, 18 bp, Homo sapiens
tcctactttacatatgct

SEQ ID NO: 845907 - DNA, 16 bp, Homo sapiens
tcctagaaattcccca

SEQ ID NO: 845908 - DNA, 19 bp, Homo sapiens
tcctagaagcccctgtcgc

SEQ ID NO: 845909 - DNA, 22 bp, Homo sapiens
tcctagactaattaaaatctgg

SEQ ID NO: 845910 - DNA, 16 bp, Homo sapiens
tcctagacttgaaagt

SEQ ID NO: 845911 - DNA, 19 bp, Homo sapiens
tcctagaggtgggcagctg

SEQ ID NO: 845912 - DNA, 21 bp, Homo sapiens
tcctagaggtgggcagctggg

SEQ ID NO: 845913 - DNA, 22 bp, Homo sapiens
tcctagaggtgggcagctgggc

SEQ ID NO: 845914 - DNA, 23 bp, Homo sapiens
tcctagaggttctgggttttctg

SEQ ID NO: 845915 - DNA, 15 bp, Homo sapiens
tcctagcaaatttct

SEQ ID NO: 845916 - DNA, 22 bp, Homo sapiens
tcctagcaagtaagaatggcca

SEQ ID NO: 845917 - DNA, 22 bp, Homo sapiens
tcctagcagacagaaactggat

SEQ ID NO: 845918 - DNA, 16 bp, Homo sapiens
tcctagcccctctctc

SEQ ID NO: 845919 - DNA, 19 bp, Homo sapiens
tcctagcccctctctcaca

SEQ ID NO: 845920 - DNA, 12 bp, Homo sapiens
tcctagcccctt

SEQ ID NO: 845921 - DNA, 19 bp, Homo sapiens
tcctagcccttccctgagt

SEQ ID NO: 845922 - DNA, 20 bp, Homo sapiens
tcctagccttatcctctgat

SEQ ID NO: 845923 - DNA, 22 bp, Homo sapiens
tcctagccttatcctctgatct

SEQ ID NO: 845924 - DNA, 15 bp, Homo sapiens
tcctagctgacgcca

SEQ ID NO: 845925 - DNA, 21 bp, Homo sapiens
tcctagcttgggaggcttccc

SEQ ID NO: 845926 - DNA, 22 bp, Homo sapiens
tcctagcttgggaggcttcccc

SEQ ID NO: 845927 - DNA, 17 bp, Homo sapiens
tcctaggaaaccagctc

SEQ ID NO: 845928 - DNA, 13 bp, Homo sapiens
tcctaggcatttg

SEQ ID NO: 845929 - DNA, 14 bp, Homo sapiens
tcctaggcatttgc

SEQ ID NO: 845930 - DNA, 17 bp, Homo sapiens
tcctaggcccaggcctg

SEQ ID NO: 845931 - DNA, 15 bp, Homo sapiens
tcctaggtccaagcc

SEQ ID NO: 845932 - DNA, 16 bp, Homo sapiens
tcctaggtcctctgag

SEQ ID NO: 845933 - DNA, 19 bp, Homo sapiens
tcctaggtcctctgaggca

SEQ ID NO: 845934 - DNA, 20 bp, Homo sapiens
tcctataagcttaaatagga

SEQ ID NO: 845935 - DNA, 21 bp, Homo sapiens
tcctataagcttaaataggaa

SEQ ID NO: 845936 - DNA, 22 bp, Homo sapiens
tcctataataaaatggcacctt

SEQ ID NO: 845937 - DNA, 20 bp, Homo sapiens
tcctataatacaaatacaca

SEQ ID NO: 845938 - DNA, 20 bp, Homo sapiens
tcctataatataataaatat

SEQ ID NO: 845939 - DNA, 17 bp, Homo sapiens
tcctataatctgtcaaa

SEQ ID NO: 845940 - DNA, 19 bp, Homo sapiens
tcctatacgcagcgtgctt

SEQ ID NO: 845941 - DNA, 15 bp, Homo sapiens
tcctatatagtttat

SEQ ID NO: 845942 - DNA, 17 bp, Homo sapiens
tcctatatatttctatt

SEQ ID NO: 845943 - DNA, 13 bp, Homo sapiens
tcctatatcatta

SEQ ID NO: 845944 - DNA, 16 bp, Homo sapiens
tcctatatctgtttgt

SEQ ID NO: 845945 - DNA, 21 bp, Homo sapiens
tcctatattgttttcagtgta

SEQ ID NO: 845946 - DNA, 19 bp, Homo sapiens
tcctatcacctatttccat

SEQ ID NO: 845947 - DNA, 14 bp, Homo sapiens
tcctatcacctccc

SEQ ID NO: 845948 - DNA, 19 bp, Homo sapiens
tcctatcacctcccctcct

SEQ ID NO: 845949 - DNA, 23 bp, Homo sapiens
tcctatctagcatttatttctct

SEQ ID NO: 845950 - DNA, 23 bp, Homo sapiens
tcctatctccagcggccctgtca

SEQ ID NO: 845951 - DNA, 13 bp, Homo sapiens
tcctatctgcagg

SEQ ID NO: 845952 - DNA, 13 bp, Homo sapiens
tcctatctgtgtt

SEQ ID NO: 845953 - DNA, 23 bp, Homo sapiens
tcctatgatggatggcagactct

SEQ ID NO: 845954 - DNA, 21 bp, Homo sapiens
tcctatgcccaggtaccaccc

SEQ ID NO: 845955 - DNA, 20 bp, Homo sapiens
tcctatgctattgacaataa

SEQ ID NO: 845956 - DNA, 22 bp, Homo sapiens
tcctatgctattgacaataaaa

SEQ ID NO: 845957 - DNA, 13 bp, Homo sapiens
tcctatggaaaaa

SEQ ID NO: 845958 - DNA, 15 bp, Homo sapiens
tcctatggaaaaggg

SEQ ID NO: 845959 - DNA, 14 bp, Homo sapiens
tcctatggaaacat

SEQ ID NO: 845960 - DNA, 21 bp, Homo sapiens
tcctatggacaacttatttaa

SEQ ID NO: 845961 - DNA, 12 bp, Homo sapiens
tcctatgtacag

SEQ ID NO: 845962 - DNA, 24 bp, Homo sapiens
tcctatgtcaatttgtatatcatg

SEQ ID NO: 845963 - DNA, 15 bp, Homo sapiens
tcctatgtgtgcctc

SEQ ID NO: 845964 - DNA, 19 bp, Homo sapiens
tcctatgtgtgcctcctag

SEQ ID NO: 845965 - DNA, 16 bp, Homo sapiens
tcctattctcaccagg

SEQ ID NO: 845966 - DNA, 18 bp, Homo sapiens
tcctattctcaccaggaa

SEQ ID NO: 845967 - DNA, 12 bp, Homo sapiens
tcctattctcct

SEQ ID NO: 845968 - DNA, 13 bp, Homo sapiens
tcctattctcctg

SEQ ID NO: 845969 - DNA, 17 bp, Homo sapiens
tcctattctcctgccat

SEQ ID NO: 845970 - DNA, 16 bp, Homo sapiens
tcctattctgttgcca

SEQ ID NO: 845971 - DNA, 14 bp, Homo sapiens
tcctattgcaaagg

SEQ ID NO: 845972 - DNA, 17 bp, Homo sapiens
tcctattgtcattaaag

SEQ ID NO: 845973 - DNA, 17 bp, Homo sapiens
tcctatttgcagttact

SEQ ID NO: 845974 - DNA, 16 bp, Homo sapiens
tcctatttgttttcat

SEQ ID NO: 845975 - DNA, 17 bp, Homo sapiens
tcctatttgttttcatg

SEQ ID NO: 845976 - DNA, 19 bp, Homo sapiens
tcctcaaaccacttgcctg

SEQ ID NO: 845977 - DNA, 21 bp, Homo sapiens
tcctcaaaccacttgcctggg

SEQ ID NO: 845978 - DNA, 15 bp, Homo sapiens
tcctcaaagaaagtg

SEQ ID NO: 845979 - DNA, 16 bp, Homo sapiens
tcctcaaagaaagtgt

SEQ ID NO: 845980 - DNA, 15 bp, Homo sapiens
tcctcaacagtgttt

SEQ ID NO: 845981 - DNA, 23 bp, Homo sapiens
tcctcaagaaataaaaggaagcc

SEQ ID NO: 845982 - DNA, 18 bp, Homo sapiens
tcctcaagcaataattgt

SEQ ID NO: 845983 - DNA, 14 bp, Homo sapiens
tcctcaagcctgtg

SEQ ID NO: 845984 - DNA, 16 bp, Homo sapiens
tcctcaagcctgtggg

SEQ ID NO: 845985 - DNA, 17 bp, Homo sapiens
tcctcaagcctgtgggc

SEQ ID NO: 845986 - DNA, 20 bp, Homo sapiens
tcctcaagcctgtgggcagc

SEQ ID NO: 845987 - DNA, 21 bp, Homo sapiens
tcctcaagcctgtgggcagca

SEQ ID NO: 845988 - DNA, 14 bp, Homo sapiens
tcctcaagggaagg

SEQ ID NO: 845989 - DNA, 16 bp, Homo sapiens
tcctcacactgctgtc

SEQ ID NO: 845990 - DNA, 19 bp, Homo sapiens
tcctcacactgctgtcctc

SEQ ID NO: 845991 - DNA, 22 bp, Homo sapiens
tcctcacactgctgtcctctcc

SEQ ID NO: 845992 - DNA, 17 bp, Homo sapiens
tcctcacccagatcagg

SEQ ID NO: 845993 - DNA, 16 bp, Homo sapiens
tcctcacccctgtagg

SEQ ID NO: 845994 - DNA, 17 bp, Homo sapiens
tcctcaccctgtgggac

SEQ ID NO: 845995 - DNA, 18 bp, Homo sapiens
tcctcaccctgtgggacc

SEQ ID NO: 845996 - DNA, 20 bp, Homo sapiens
tcctcaccctgtgggaccgc

SEQ ID NO: 845997 - DNA, 16 bp, Homo sapiens
tcctcacctcatgccc

SEQ ID NO: 845998 - DNA, 21 bp, Homo sapiens
tcctcacctcatgcccacccc

SEQ ID NO: 845999 - DNA, 17 bp, Homo sapiens
tcctcacctgtctaggt

SEQ ID NO: 846000 - DNA, 22 bp, Homo sapiens
tcctcacgtgcaggacagctct

SEQ ID NO: 846001 - DNA, 14 bp, Homo sapiens
tcctccccctgcaa

SEQ ID NO: 846002 - DNA, 15 bp, Homo sapiens
tcctccccctgcaac

SEQ ID NO: 846003 - DNA, 14 bp, Homo sapiens
tcctccccctgcca

SEQ ID NO: 846004 - DNA, 17 bp, Homo sapiens
tcctccccctgccagtg

SEQ ID NO: 846005 - DNA, 20 bp, Homo sapiens
tcctccccctgccagtgcct

SEQ ID NO: 846006 - DNA, 23 bp, Homo sapiens
tcctccccctgccagtgccttac

SEQ ID NO: 846007 - DNA, 13 bp, Homo sapiens
tcctccccctttg

SEQ ID NO: 846008 - DNA, 17 bp, Homo sapiens
tcctccccctttggggt

SEQ ID NO: 846009 - DNA, 19 bp, Homo sapiens
tcctccccctttggggtag

SEQ ID NO: 846010 - DNA, 18 bp, Homo sapiens
tcctccccgatccccgac

SEQ ID NO: 846011 - DNA, 23 bp, Homo sapiens
tcctccccgatccccgacagtgg

SEQ ID NO: 846012 - DNA, 15 bp, Homo sapiens
tcctccccgctccgt

SEQ ID NO: 846013 - DNA, 21 bp, Homo sapiens
tcctccccgctccgtctctgt

SEQ ID NO: 846014 - DNA, 14 bp, Homo sapiens
tcctcccctactct

SEQ ID NO: 846015 - DNA, 18 bp, Homo sapiens
tcctcccctactctgccc

SEQ ID NO: 846016 - DNA, 13 bp, Homo sapiens
tcctcccctcctc

SEQ ID NO: 846017 - DNA, 16 bp, Homo sapiens
tcctcccctcctcttc

SEQ ID NO: 846018 - DNA, 20 bp, Homo sapiens
tcctcccctcctcttccctt

SEQ ID NO: 846019 - DNA, 12 bp, Homo sapiens
tcctcccctctc

SEQ ID NO: 846020 - DNA, 15 bp, Homo sapiens
tcctccccttccctg

SEQ ID NO: 846021 - DNA, 14 bp, Homo sapiens
tcctccccttgggc

SEQ ID NO: 846022 - DNA, 22 bp, Homo sapiens
tcctccccttttaccactccca

SEQ ID NO: 846023 - DNA, 20 bp, Homo sapiens
tcctcccgaaaaatgtgtgg

SEQ ID NO: 846024 - DNA, 15 bp, Homo sapiens
tcctcccgggccctc

SEQ ID NO: 846025 - DNA, 19 bp, Homo sapiens
tcctcccgggccctccctt

SEQ ID NO: 846026 - DNA, 22 bp, Homo sapiens
tcctcccgggccctcccttgga

SEQ ID NO: 846027 - DNA, 20 bp, Homo sapiens
tcctccctcagcctcccctt

SEQ ID NO: 846028 - DNA, 20 bp, Homo sapiens
tcctccctccaagcctggca

SEQ ID NO: 846029 - DNA, 21 bp, Homo sapiens
tcctccctccaagcctggcac

SEQ ID NO: 846030 - DNA, 24 bp, Homo sapiens
tcctccctccaagcctggcaccca

SEQ ID NO: 846031 - DNA, 14 bp, Homo sapiens
tcctccctcccagc

SEQ ID NO: 846032 - DNA, 15 bp, Homo sapiens
tcctccctccccttc

SEQ ID NO: 846033 - DNA, 13 bp, Homo sapiens
tcctccctccctc

SEQ ID NO: 846034 - DNA, 16 bp, Homo sapiens
tcctccctccctccct

SEQ ID NO: 846035 - DNA, 13 bp, Homo sapiens
tcctccctgccca

SEQ ID NO: 846036 - DNA, 13 bp, Homo sapiens
tcctccctgctcc

SEQ ID NO: 846037 - DNA, 14 bp, Homo sapiens
tcctccctgggggc

SEQ ID NO: 846038 - DNA, 20 bp, Homo sapiens
tcctccctggtttgcagctg

SEQ ID NO: 846039 - DNA, 21 bp, Homo sapiens
tcctccctgtgcccccagcct

SEQ ID NO: 846040 - DNA, 18 bp, Homo sapiens
tcctcccttacagagcat

SEQ ID NO: 846041 - DNA, 13 bp, Homo sapiens
tcctcccttctgc

SEQ ID NO: 846042 - DNA, 14 bp, Homo sapiens
tcctcccttctgct

SEQ ID NO: 846043 - DNA, 17 bp, Homo sapiens
tcctcccttctgctact

SEQ ID NO: 846044 - DNA, 21 bp, Homo sapiens
tcctcccttgccccaggccag

SEQ ID NO: 846045 - DNA, 23 bp, Homo sapiens
tcctcccttgccccaggccaggt

SEQ ID NO: 846046 - DNA, 19 bp, Homo sapiens
tcctcccttgggttctgat

SEQ ID NO: 846047 - DNA, 16 bp, Homo sapiens
tcctcccttgttctct

SEQ ID NO: 846048 - DNA, 15 bp, Homo sapiens
tcctccgaggccagt

SEQ ID NO: 846049 - DNA, 21 bp, Homo sapiens
tcctccggagcctcatgttct

SEQ ID NO: 846050 - DNA, 15 bp, Homo sapiens
tcctccgtagggtct

SEQ ID NO: 846051 - DNA, 15 bp, Homo sapiens
tcctccgtccaccca

SEQ ID NO: 846052 - DNA, 18 bp, Homo sapiens
tcctccgtccacccaggc

SEQ ID NO: 846053 - DNA, 21 bp, Homo sapiens
tcctccgtccacccaggctgc

SEQ ID NO: 846054 - DNA, 23 bp, Homo sapiens
tcctccgtccacccaggctgcac

SEQ ID NO: 846055 - DNA, 14 bp, Homo sapiens
tcctccgtccagcc

SEQ ID NO: 846056 - DNA, 18 bp, Homo sapiens
tcctccgtccagccgcca

SEQ ID NO: 846057 - DNA, 23 bp, Homo sapiens
tcctccgtgtctcgcgcgactga

SEQ ID NO: 846058 - DNA, 14 bp, Homo sapiens
tcctcctacctcag

SEQ ID NO: 846059 - DNA, 17 bp, Homo sapiens
tcctcctacctcagcct

SEQ ID NO: 846060 - DNA, 12 bp, Homo sapiens
tcctcctacctg

SEQ ID NO: 846061 - DNA, 16 bp, Homo sapiens
tcctcctacctgggga

SEQ ID NO: 846062 - DNA, 21 bp, Homo sapiens
tcctcctaggaaaccagctcg

SEQ ID NO: 846063 - DNA, 18 bp, Homo sapiens
tcctcctcacctcatgcc

SEQ ID NO: 846064 - DNA, 22 bp, Homo sapiens
tcctcctcagcccccaggccag

SEQ ID NO: 846065 - DNA, 23 bp, Homo sapiens
tcctcctcagcccccaggccagg

SEQ ID NO: 846066 - DNA, 15 bp, Homo sapiens
tcctcctccacagtg

SEQ ID NO: 846067 - DNA, 16 bp, Homo sapiens
tcctcctccacagtgc

SEQ ID NO: 846068 - DNA, 18 bp, Homo sapiens
tcctcctccatcacctga

SEQ ID NO: 846069 - DNA, 16 bp, Homo sapiens
tcctcctcccctcctc

SEQ ID NO: 846070 - DNA, 18 bp, Homo sapiens
tcctcctccctgcatctg

SEQ ID NO: 846071 - DNA, 12 bp, Homo sapiens
tcctcctcgctc

SEQ ID NO: 846072 - DNA, 14 bp, Homo sapiens
tcctcctcgctcct

SEQ ID NO: 846073 - DNA, 17 bp, Homo sapiens
tcctcctcgctcctcct

SEQ ID NO: 846074 - DNA, 23 bp, Homo sapiens
tcctcctcgctcctccttcccag

SEQ ID NO: 846075 - DNA, 23 bp, Homo sapiens
tcctcctcggaaccgctcaccta

SEQ ID NO: 846076 - DNA, 12 bp, Homo sapiens
tcctcctctgag

SEQ ID NO: 846077 - DNA, 12 bp, Homo sapiens
tcctcctctgcc

SEQ ID NO: 846078 - DNA, 13 bp, Homo sapiens
tcctcctctgcct

SEQ ID NO: 846079 - DNA, 12 bp, Homo sapiens
tcctcctctgtg

SEQ ID NO: 846080 - DNA, 14 bp, Homo sapiens
tcctcctctttctc

SEQ ID NO: 846081 - DNA, 17 bp, Homo sapiens
tcctcctgaagcctctg

SEQ ID NO: 846082 - DNA, 22 bp, Homo sapiens
tcctcctgaagcctctgccctg

SEQ ID NO: 846083 - DNA, 12 bp, Homo sapiens
tcctcctgatgg

SEQ ID NO: 846084 - DNA, 14 bp, Homo sapiens
tcctcctgcagaca

SEQ ID NO: 846085 - DNA, 20 bp, Homo sapiens
tcctcctgcagacacctgga

SEQ ID NO: 846086 - DNA, 15 bp, Homo sapiens
tcctcctgcagacca

SEQ ID NO: 846087 - DNA, 13 bp, Homo sapiens
tcctcctgccctg

SEQ ID NO: 846088 - DNA, 19 bp, Homo sapiens
tcctcctgccctgtccctg

SEQ ID NO: 846089 - DNA, 17 bp, Homo sapiens
tcctcctgcctcagcct

SEQ ID NO: 846090 - DNA, 20 bp, Homo sapiens
tcctcctgcctcagccttcc

SEQ ID NO: 846091 - DNA, 12 bp, Homo sapiens
tcctcctgctca

SEQ ID NO: 846092 - DNA, 16 bp, Homo sapiens
tcctcctgctcctcac

SEQ ID NO: 846093 - DNA, 11 bp, Homo sapiens
tcctcctggaa

SEQ ID NO: 846094 - DNA, 13 bp, Homo sapiens
tcctcctgggggc

SEQ ID NO: 846095 - DNA, 19 bp, Homo sapiens
tcctcctgggggctggctc

SEQ ID NO: 846096 - DNA, 10 bp, Homo sapiens
tcctccttcc

SEQ ID NO: 846097 - DNA, 12 bp, Homo sapiens
tcctccttcctg

SEQ ID NO: 846098 - DNA, 14 bp, Homo sapiens
tcctccttcctggg

SEQ ID NO: 846099 - DNA, 15 bp, Homo sapiens
tcctccttcctggga

SEQ ID NO: 846100 - DNA, 14 bp, Homo sapiens
tcctcgagccctcc

SEQ ID NO: 846101 - DNA, 18 bp, Homo sapiens
tcctcgagccctccccca

SEQ ID NO: 846102 - DNA, 14 bp, Homo sapiens
tcctcgcacacact

SEQ ID NO: 846103 - DNA, 19 bp, Homo sapiens
tcctcgcagcctctcagtg

SEQ ID NO: 846104 - DNA, 14 bp, Homo sapiens
tcctcgcccccacc

SEQ ID NO: 846105 - DNA, 14 bp, Homo sapiens
tcctcgcctaggcc

SEQ ID NO: 846106 - DNA, 13 bp, Homo sapiens
tcctcgcctgaca

SEQ ID NO: 846107 - DNA, 24 bp, Homo sapiens
tcctcgcctgacaaccactggtct

SEQ ID NO: 846108 - DNA, 19 bp, Homo sapiens
tcctcggccccctccatcg

SEQ ID NO: 846109 - DNA, 14 bp, Homo sapiens
tcctcggtctccct

SEQ ID NO: 846110 - DNA, 15 bp, Homo sapiens
tcctcggtctccctt

SEQ ID NO: 846111 - DNA, 15 bp, Homo sapiens
tcctcggtggctctg

SEQ ID NO: 846112 - DNA, 16 bp, Homo sapiens
tcctcggtggctctgg

SEQ ID NO: 846113 - DNA, 18 bp, Homo sapiens
tcctcggtgggccagagc

SEQ ID NO: 846114 - DNA, 18 bp, Homo sapiens
tcctctaactcactgcct

SEQ ID NO: 846115 - DNA, 15 bp, Homo sapiens
tcctctacctctctc

SEQ ID NO: 846116 - DNA, 22 bp, Homo sapiens
tcctctacctctctcctctccg

SEQ ID NO: 846117 - DNA, 17 bp, Homo sapiens
tcctctactaacaatca

SEQ ID NO: 846118 - DNA, 19 bp, Homo sapiens
tcctctactaacaatcagc

SEQ ID NO: 846119 - DNA, 22 bp, Homo sapiens
tcctctagaaataggttaaact

SEQ ID NO: 846120 - DNA, 22 bp, Homo sapiens
tcctctagaagccaagggaaag

SEQ ID NO: 846121 - DNA, 18 bp, Homo sapiens
tcctctagcccactccct

SEQ ID NO: 846122 - DNA, 22 bp, Homo sapiens
tcctctagcccactccctgcct

SEQ ID NO: 846123 - DNA, 21 bp, Homo sapiens
tcctctagctgtgggggtgag

SEQ ID NO: 846124 - DNA, 20 bp, Homo sapiens
tcctgccctcgtctccctgg

SEQ ID NO: 846125 - DNA, 22 bp, Homo sapiens
tcctgccctctgctctgcctgg

SEQ ID NO: 846126 - DNA, 11 bp, Homo sapiens
tcctgccctgc

SEQ ID NO: 846127 - DNA, 15 bp, Homo sapiens
tcctgccctgtccaa

SEQ ID NO: 846128 - DNA, 15 bp, Homo sapiens
tcctgccctgtccct

SEQ ID NO: 846129 - DNA, 21 bp, Homo sapiens
tcctgccctgtccctgtcccc

SEQ ID NO: 846130 - DNA, 12 bp, Homo sapiens
tcctgccctgtt

SEQ ID NO: 846131 - DNA, 23 bp, Homo sapiens
tcctgccggtgggaccctgtccg

SEQ ID NO: 846132 - DNA, 13 bp, Homo sapiens
tcctgcctcagcc

SEQ ID NO: 846133 - DNA, 19 bp, Homo sapiens
tcctgcctcagcctcccca

SEQ ID NO: 846134 - DNA, 16 bp, Homo sapiens
tcctgcctcctcatca

SEQ ID NO: 846135 - DNA, 21 bp, Homo sapiens
tcctgcctcttgtttctgtgc

SEQ ID NO: 846136 - DNA, 15 bp, Homo sapiens
tcctgcctgccctgc

SEQ ID NO: 846137 - DNA, 16 bp, Homo sapiens
tcctgcctggccaggc

SEQ ID NO: 846138 - DNA, 14 bp, Homo sapiens
tcctgcctgtctgc

SEQ ID NO: 846139 - DNA, 17 bp, Homo sapiens
tcctgcctgtctgcccc

SEQ ID NO: 846140 - DNA, 20 bp, Homo sapiens
tcctgcctgtctgccccagc

SEQ ID NO: 846141 - DNA, 13 bp, Homo sapiens
tcctgcctgtggc

SEQ ID NO: 846142 - DNA, 14 bp, Homo sapiens
tcctgcctgtggcg

SEQ ID NO: 846143 - DNA, 14 bp, Homo sapiens
tcctgccttcctcc

SEQ ID NO: 846144 - DNA, 19 bp, Homo sapiens
tcctgccttcctcctgggc

SEQ ID NO: 846145 - DNA, 18 bp, Homo sapiens
tcctgcctttaagccaaa

SEQ ID NO: 846146 - DNA, 19 bp, Homo sapiens
tcctgcctttaagccaaag

SEQ ID NO: 846147 - DNA, 20 bp, Homo sapiens
tcctgcctttaagccaaaga

SEQ ID NO: 846148 - DNA, 12 bp, Homo sapiens
tcctgcctttta

SEQ ID NO: 846149 - DNA, 21 bp, Homo sapiens
tcctgcgaccttgcaacctca

SEQ ID NO: 846150 - DNA, 21 bp, Homo sapiens
tcctgcggagtgaagaggggc

SEQ ID NO: 846151 - DNA, 23 bp, Homo sapiens
tcctgcggagtgaagaggggcag

SEQ ID NO: 846152 - DNA, 12 bp, Homo sapiens
tcctgcggctca

SEQ ID NO: 846153 - DNA, 21 bp, Homo sapiens
tcctgcggctcagccttgcac

SEQ ID NO: 846154 - DNA, 22 bp, Homo sapiens
tcctgcggctcagccttgcaca

SEQ ID NO: 846155 - DNA, 12 bp, Homo sapiens
tcctgcgggctt

SEQ ID NO: 846156 - DNA, 14 bp, Homo sapiens
tcctgcgtcctcct

SEQ ID NO: 846157 - DNA, 21 bp, Homo sapiens
tcctgcgtcctcctcacctca

SEQ ID NO: 846158 - DNA, 22 bp, Homo sapiens
tcctgcgttttctccgggtcct

SEQ ID NO: 846159 - DNA, 16 bp, Homo sapiens
tcctgctacaagtgtt

SEQ ID NO: 846160 - DNA, 18 bp, Homo sapiens
tcctgctactctgttcct

SEQ ID NO: 846161 - DNA, 23 bp, Homo sapiens
tcctgctagcaggccccctagga

SEQ ID NO: 846162 - DNA, 23 bp, Homo sapiens
tcctgctatattaacatcatctt

SEQ ID NO: 846163 - DNA, 17 bp, Homo sapiens
tcctgctatgacagctg

SEQ ID NO: 846164 - DNA, 20 bp, Homo sapiens
tcctgctatgacagctggct

SEQ ID NO: 846165 - DNA, 22 bp, Homo sapiens
tcctgctatgacagctggctag

SEQ ID NO: 846166 - DNA, 23 bp, Homo sapiens
tcctgctcaactctacccctgct

SEQ ID NO: 846167 - DNA, 12 bp, Homo sapiens
tcctgctccaga

SEQ ID NO: 846168 - DNA, 12 bp, Homo sapiens
tcctgctccagt

SEQ ID NO: 846169 - DNA, 14 bp, Homo sapiens
tcctgctccgtgga

SEQ ID NO: 846170 - DNA, 15 bp, Homo sapiens
tcctgctcctcaccc

SEQ ID NO: 846171 - DNA, 13 bp, Homo sapiens
tcctgctcctttt

SEQ ID NO: 846172 - DNA, 21 bp, Homo sapiens
tcctgctctctgctcatgggt

SEQ ID NO: 846173 - DNA, 18 bp, Homo sapiens
tcctgctctctggaggta

SEQ ID NO: 846174 - DNA, 15 bp, Homo sapiens
tcctgctctcttcag

SEQ ID NO: 846175 - DNA, 16 bp, Homo sapiens
tcctgctctcttcagg

SEQ ID NO: 846176 - DNA, 17 bp, Homo sapiens
tcctgctctcttcagga

SEQ ID NO: 846177 - DNA, 18 bp, Homo sapiens
tcctgctctgtttggtgg

SEQ ID NO: 846178 - DNA, 13 bp, Homo sapiens
tcctgctgcaccc

SEQ ID NO: 846179 - DNA, 23 bp, Homo sapiens
tcctgctgcaccctgcgcctcca

SEQ ID NO: 846180 - DNA, 24 bp, Homo sapiens
tcctgctgctgtaactgctgagcc

SEQ ID NO: 846181 - DNA, 14 bp, Homo sapiens
tcctgctgctgtgt

SEQ ID NO: 846182 - DNA, 14 bp, Homo sapiens
tcctgctgggcgtg

SEQ ID NO: 846183 - DNA, 14 bp, Homo sapiens
tcctgctgtggggc

SEQ ID NO: 846184 - DNA, 15 bp, Homo sapiens
tcctgcttcccctcc

SEQ ID NO: 846185 - DNA, 17 bp, Homo sapiens
tcctgcttcccctccct

SEQ ID NO: 846186 - DNA, 18 bp, Homo sapiens
tcctgcttcccctcccta

SEQ ID NO: 846187 - DNA, 19 bp, Homo sapiens
tcctgcttcccctccctac

SEQ ID NO: 846188 - DNA, 18 bp, Homo sapiens
tcctgcttctctcagcca

SEQ ID NO: 846189 - DNA, 16 bp, Homo sapiens
tcctgcttgccaaggc

SEQ ID NO: 846190 - DNA, 21 bp, Homo sapiens
tcctgcttgtactaagccagg

SEQ ID NO: 846191 - DNA, 17 bp, Homo sapiens
tcctgcttttctgtcct

SEQ ID NO: 846192 - DNA, 18 bp, Homo sapiens
tcctgcttttctgtcctg

SEQ ID NO: 846193 - DNA, 16 bp, Homo sapiens
tcctggaaaagaagaa

SEQ ID NO: 846194 - DNA, 16 bp, Homo sapiens
tcctggaaaggctcag

SEQ ID NO: 846195 - DNA, 22 bp, Homo sapiens
tcctggaaaggctcagtctcag

SEQ ID NO: 846196 - DNA, 16 bp, Homo sapiens
tcctggaacaatattt

SEQ ID NO: 846197 - DNA, 21 bp, Homo sapiens
tcctggaacaatattttatgg

SEQ ID NO: 846198 - DNA, 15 bp, Homo sapiens
tcctggaaccaatcc

SEQ ID NO: 846199 - DNA, 19 bp, Homo sapiens
tcctggaaccttgctgtcc

SEQ ID NO: 846200 - DNA, 20 bp, Homo sapiens
tcctggaaccttgctgtcct

SEQ ID NO: 846201 - DNA, 21 bp, Homo sapiens
tcctggaaccttgctgtcctg

SEQ ID NO: 846202 - DNA, 23 bp, Homo sapiens
tcctggaagaacaaatctaccag

SEQ ID NO: 846203 - DNA, 19 bp, Homo sapiens
tcctggaagacaacccagg

SEQ ID NO: 846204 - DNA, 21 bp, Homo sapiens
tcctggaagacaacccaggca

SEQ ID NO: 846205 - DNA, 14 bp, Homo sapiens
tcctggaagctgtg

SEQ ID NO: 846206 - DNA, 21 bp, Homo sapiens
tcctggaagctgtgtccttgc

SEQ ID NO: 846207 - DNA, 12 bp, Homo sapiens
tcctggacacac

SEQ ID NO: 846208 - DNA, 16 bp, Homo sapiens
tcctggacacctccca

SEQ ID NO: 846209 - DNA, 15 bp, Homo sapiens
tcctggacctgagtc

SEQ ID NO: 846210 - DNA, 20 bp, Homo sapiens
tcctggaccttgacagagca

SEQ ID NO: 846211 - DNA, 22 bp, Homo sapiens
tcctggaccttgacagagcagc

SEQ ID NO: 846212 - DNA, 23 bp, Homo sapiens
tcctggaccttgacagagcagct

SEQ ID NO: 846213 - DNA, 19 bp, Homo sapiens
tcctggactccggaggact

SEQ ID NO: 846214 - DNA, 17 bp, Homo sapiens
tcctggagatagctggg

SEQ ID NO: 846215 - DNA, 18 bp, Homo sapiens
tcctggagcagaccaccc

SEQ ID NO: 846216 - DNA, 14 bp, Homo sapiens
tcctggagcatccc

SEQ ID NO: 846217 - DNA, 16 bp, Homo sapiens
tcctggagctctgtgg

SEQ ID NO: 846218 - DNA, 13 bp, Homo sapiens
tcctggaggacca

SEQ ID NO: 846219 - DNA, 16 bp, Homo sapiens
tcctggaggtcttttc

SEQ ID NO: 846220 - DNA, 24 bp, Homo sapiens
tcctggagtgccctgcaggcacag

SEQ ID NO: 846221 - DNA, 13 bp, Homo sapiens
tcctggagttttg

SEQ ID NO: 846222 - DNA, 16 bp, Homo sapiens
tcctggagttttgatt

SEQ ID NO: 846223 - DNA, 18 bp, Homo sapiens
tcctggatgttgtgtgta

SEQ ID NO: 846224 - DNA, 11 bp, Homo sapiens
tcctggcagcc

SEQ ID NO: 846225 - DNA, 14 bp, Homo sapiens
tcctggcagctgct

SEQ ID NO: 846226 - DNA, 17 bp, Homo sapiens
tcctggcagggccacct

SEQ ID NO: 846227 - DNA, 17 bp, Homo sapiens
tcctggcagtttaaaaa

SEQ ID NO: 846228 - DNA, 14 bp, Homo sapiens
tcctggcatttgct

SEQ ID NO: 846229 - DNA, 18 bp, Homo sapiens
tcctggccagacgctgcc

SEQ ID NO: 846230 - DNA, 20 bp, Homo sapiens
tcctggccatcccacaagtg

SEQ ID NO: 846231 - DNA, 21 bp, Homo sapiens
tcctggcccaagtctcttcct

SEQ ID NO: 846232 - DNA, 17 bp, Homo sapiens
tcctggcccactgcatc

SEQ ID NO: 846233 - DNA, 12 bp, Homo sapiens
tcctggcccagg

SEQ ID NO: 846234 - DNA, 14 bp, Homo sapiens
tcctggccccgggc

SEQ ID NO: 846235 - DNA, 12 bp, Homo sapiens
tcctggcccctc

SEQ ID NO: 846236 - DNA, 18 bp, Homo sapiens
tcctggcccctccagacc

SEQ ID NO: 846237 - DNA, 17 bp, Homo sapiens
tcctggcccgccctcac

SEQ ID NO: 846238 - DNA, 13 bp, Homo sapiens
tcctggccctggg

SEQ ID NO: 846239 - DNA, 15 bp, Homo sapiens
tcctggccctggggg

SEQ ID NO: 846240 - DNA, 19 bp, Homo sapiens
tcctggccctgggggtctg

SEQ ID NO: 846241 - DNA, 15 bp, Homo sapiens
tcctggcccttcagt

SEQ ID NO: 846242 - DNA, 17 bp, Homo sapiens
tcctggcccttcagtct

SEQ ID NO: 846243 - DNA, 19 bp, Homo sapiens
tcctggcccttcagtctgc

SEQ ID NO: 846244 - DNA, 18 bp, Homo sapiens
tcctggcctatccgctgc

SEQ ID NO: 846245 - DNA, 23 bp, Homo sapiens
tcctggcctatccgctgccagcc

SEQ ID NO: 846246 - DNA, 19 bp, Homo sapiens
tcctggcctcactggctgg

SEQ ID NO: 846247 - DNA, 17 bp, Homo sapiens
tcctggcctccttcccc

SEQ ID NO: 846248 - DNA, 11 bp, Homo sapiens
tcctggcctct

SEQ ID NO: 846249 - DNA, 21 bp, Homo sapiens
tcctggcctcttctgggctac

SEQ ID NO: 846250 - DNA, 13 bp, Homo sapiens
tcctggcctggca

SEQ ID NO: 846251 - DNA, 15 bp, Homo sapiens
tcctggccttcctcg

SEQ ID NO: 846252 - DNA, 20 bp, Homo sapiens
tcctggctctaccctgtctg

SEQ ID NO: 846253 - DNA, 23 bp, Homo sapiens
tcctggctcttgatacccccctc

SEQ ID NO: 846254 - DNA, 19 bp, Homo sapiens
tcctggctgatgatccaga

SEQ ID NO: 846255 - DNA, 12 bp, Homo sapiens
tcctggctgcgg

SEQ ID NO: 846256 - DNA, 15 bp, Homo sapiens
tcctggctgtgccca

SEQ ID NO: 846257 - DNA, 20 bp, Homo sapiens
tcctggctgtgcccagcagg

SEQ ID NO: 846258 - DNA, 22 bp, Homo sapiens
tcctggctgtgcccagcaggcc

SEQ ID NO: 846259 - DNA, 22 bp, Homo sapiens
tcctgggaaacctgcctttgta

SEQ ID NO: 846260 - DNA, 16 bp, Homo sapiens
tcctgggaaatattcc

SEQ ID NO: 846261 - DNA, 15 bp, Homo sapiens
tcctgggaatggaat

SEQ ID NO: 846262 - DNA, 20 bp, Homo sapiens
tcctgggaatggaataacta

SEQ ID NO: 846263 - DNA, 15 bp, Homo sapiens
tcctgggaccccctc

SEQ ID NO: 846264 - DNA, 18 bp, Homo sapiens
tcctgggagaacctcagg

SEQ ID NO: 846265 - DNA, 19 bp, Homo sapiens
tcctgggagaacctcaggc

SEQ ID NO: 846266 - DNA, 11 bp, Homo sapiens
tcctgggagga

SEQ ID NO: 846267 - DNA, 14 bp, Homo sapiens
tcctgggaggacag

SEQ ID NO: 846268 - DNA, 16 bp, Homo sapiens
tcctgggaggacaggc

SEQ ID NO: 846269 - DNA, 20 bp, Homo sapiens
tcctgggaggacaggcaggc

SEQ ID NO: 846270 - DNA, 22 bp, Homo sapiens
tcctgggcagcctttccagcct

SEQ ID NO: 846271 - DNA, 14 bp, Homo sapiens
tcctgggcaggtgg

SEQ ID NO: 846272 - DNA, 21 bp, Homo sapiens
tcctgggcatgggtccagggc

SEQ ID NO: 846273 - DNA, 22 bp, Homo sapiens
tcctgggcatgggtccagggcc

SEQ ID NO: 846274 - DNA, 23 bp, Homo sapiens
tcctgggcatgggtccagggcct

SEQ ID NO: 846275 - DNA, 13 bp, Homo sapiens
tcctgggcctgcc

SEQ ID NO: 846276 - DNA, 18 bp, Homo sapiens
tcctgggcgccctggaag

SEQ ID NO: 846277 - DNA, 15 bp, Homo sapiens
tcctgggcgtgaccc

SEQ ID NO: 846278 - DNA, 22 bp, Homo sapiens
tcctgggcgtgacccgtccatt

SEQ ID NO: 846279 - DNA, 12 bp, Homo sapiens
tcctgggctcag

SEQ ID NO: 846280 - DNA, 19 bp, Homo sapiens
tcctgggcttggtaagtga

SEQ ID NO: 846281 - DNA, 15 bp, Homo sapiens
tcctggggatgtcat

SEQ ID NO: 846282 - DNA, 19 bp, Homo sapiens
tcctggggatgtcatagcc

SEQ ID NO: 846283 - DNA, 13 bp, Homo sapiens
tcctggggcagca

SEQ ID NO: 846284 - DNA, 17 bp, Homo sapiens
tcctggggcagcactcc

SEQ ID NO: 846285 - DNA, 19 bp, Homo sapiens
tcctggggccgcctgccct

SEQ ID NO: 846286 - DNA, 22 bp, Homo sapiens
tcctggggccgcctgccctgcc

SEQ ID NO: 846287 - DNA, 23 bp, Homo sapiens
tcctggggccgcctgccctgcct

SEQ ID NO: 846288 - DNA, 15 bp, Homo sapiens
tcctggggcctcttg

SEQ ID NO: 846289 - DNA, 14 bp, Homo sapiens
tcctggggctccct

SEQ ID NO: 846290 - DNA, 15 bp, Homo sapiens
tcctggggctctgtg

SEQ ID NO: 846291 - DNA, 16 bp, Homo sapiens
tcctggggctctgtgc

SEQ ID NO: 846292 - DNA, 17 bp, Homo sapiens
tcctgggggctggctcc

SEQ ID NO: 846293 - DNA, 15 bp, Homo sapiens
tcctgggggtggcag

SEQ ID NO: 846294 - DNA, 16 bp, Homo sapiens
tcctgggggtggcagg

SEQ ID NO: 846295 - DNA, 21 bp, Homo sapiens
tcctgggggttctttcttcct

SEQ ID NO: 846296 - DNA, 22 bp, Homo sapiens
tcctgggggttctttcttcctc

SEQ ID NO: 846297 - DNA, 23 bp, Homo sapiens
tcctggggtataaaactttcctc

SEQ ID NO: 846298 - DNA, 21 bp, Homo sapiens
tcctgggtctgtgtcagcggg

SEQ ID NO: 846299 - DNA, 17 bp, Homo sapiens
tcctgggttctggggca

SEQ ID NO: 846300 - DNA, 22 bp, Homo sapiens
tcctgggttctggggcatcagc

SEQ ID NO: 846301 - DNA, 20 bp, Homo sapiens
tcctgggttggagggaacca

SEQ ID NO: 846302 - DNA, 23 bp, Homo sapiens
tcctgggttttcttaaccatctt

SEQ ID NO: 846303 - DNA, 18 bp, Homo sapiens
tcctggtaacataacaac

SEQ ID NO: 846304 - DNA, 15 bp, Homo sapiens
tcctggtaattaaaa

SEQ ID NO: 846305 - DNA, 17 bp, Homo sapiens
tcctggtacccagccat

SEQ ID NO: 846306 - DNA, 16 bp, Homo sapiens
tcctggtcctggctgc

SEQ ID NO: 846307 - DNA, 13 bp, Homo sapiens
tcctggtctgtga

SEQ ID NO: 846308 - DNA, 15 bp, Homo sapiens
tcctggtgactcaaa

SEQ ID NO: 846309 - DNA, 18 bp, Homo sapiens
tcctggtgaggcccagcc

SEQ ID NO: 846310 - DNA, 21 bp, Homo sapiens
tcctggtgaggcccagcctgt

SEQ ID NO: 846311 - DNA, 20 bp, Homo sapiens
tcctggtgccaatttcaagt

SEQ ID NO: 846312 - DNA, 22 bp, Homo sapiens
tcctggtgccctggatgcccag

SEQ ID NO: 846313 - DNA, 19 bp, Homo sapiens
tcctggtggtattttcaat

SEQ ID NO: 846314 - DNA, 21 bp, Homo sapiens
tcctggtggtattttcaatag

SEQ ID NO: 846315 - DNA, 13 bp, Homo sapiens
tcctggtgtgggt

SEQ ID NO: 846316 - DNA, 15 bp, Homo sapiens
tcctggttcccgttt

SEQ ID NO: 846317 - DNA, 23 bp, Homo sapiens
tcctggttccttcctatgcccag

SEQ ID NO: 846318 - DNA, 23 bp, Homo sapiens
tcctggtttcataacttcctgta

SEQ ID NO: 846319 - DNA, 14 bp, Homo sapiens
tcctggtttccttt

SEQ ID NO: 846320 - DNA, 17 bp, Homo sapiens
tcctggtttcctttctc

SEQ ID NO: 846321 - DNA, 15 bp, Homo sapiens
tcctggtttgactca

SEQ ID NO: 846322 - DNA, 14 bp, Homo sapiens
tcctgtaaataaga

SEQ ID NO: 846323 - DNA, 15 bp, Homo sapiens
tcctgtaaataagag

SEQ ID NO: 846324 - DNA, 15 bp, Homo sapiens
tcctgtaaatatatc

SEQ ID NO: 846325 - DNA, 19 bp, Homo sapiens
tcctgtaaatggtgtacat

SEQ ID NO: 846326 - DNA, 15 bp, Homo sapiens
tcctgtaacaggtgt

SEQ ID NO: 846327 - DNA, 20 bp, Homo sapiens
tcctgtaactacaatgatgg

SEQ ID NO: 846328 - DNA, 18 bp, Homo sapiens
tcctgtaactgttacagt

SEQ ID NO: 846329 - DNA, 21 bp, Homo sapiens
tcctgtaactgttacagtaat

SEQ ID NO: 846330 - DNA, 17 bp, Homo sapiens
tcctgtaatgttaaact

SEQ ID NO: 846331 - DNA, 13 bp, Homo sapiens
tcctgtaattcct

SEQ ID NO: 846332 - DNA, 15 bp, Homo sapiens
tcctgtaattcctac

SEQ ID NO: 846333 - DNA, 16 bp, Homo sapiens
tcctgtaattcctacc

SEQ ID NO: 846334 - DNA, 14 bp, Homo sapiens
tcctgtacaatcat

SEQ ID NO: 846335 - DNA, 21 bp, Homo sapiens
tcctgtacactgaatatttat

SEQ ID NO: 846336 - DNA, 14 bp, Homo sapiens
tcctgtacattgtg

SEQ ID NO: 846337 - DNA, 16 bp, Homo sapiens
tcctgtacctcagtgg

SEQ ID NO: 846338 - DNA, 14 bp, Homo sapiens
tcctgtacttgtcc

SEQ ID NO: 846339 - DNA, 19 bp, Homo sapiens
tcctgtagcacgctgcctg

SEQ ID NO: 846340 - DNA, 14 bp, Homo sapiens
tcctgtagcatctt

SEQ ID NO: 846341 - DNA, 17 bp, Homo sapiens
tcctgtagcatcttctg

SEQ ID NO: 846342 - DNA, 21 bp, Homo sapiens
tcctgtagccttctgtaggaa

SEQ ID NO: 846343 - DNA, 24 bp, Homo sapiens
tcctgtagctttaaaaccacagct

SEQ ID NO: 846344 - DNA, 22 bp, Homo sapiens
tcctgtataagcactgaaaaac

SEQ ID NO: 846345 - DNA, 19 bp, Homo sapiens
tcctgtatacctcctccag

SEQ ID NO: 846346 - DNA, 16 bp, Homo sapiens
tcctgtcactcactga

SEQ ID NO: 846347 - DNA, 22 bp, Homo sapiens
tcctgtcactgatggaaggttt

SEQ ID NO: 846348 - DNA, 15 bp, Homo sapiens
tcctgtcattcctct

SEQ ID NO: 846349 - DNA, 16 bp, Homo sapiens
tcctgtcattcctcta

SEQ ID NO: 846350 - DNA, 19 bp, Homo sapiens
tcctgtccacacccagctc

SEQ ID NO: 846351 - DNA, 19 bp, Homo sapiens
tcctgtccactctcggggc

SEQ ID NO: 846352 - DNA, 21 bp, Homo sapiens
tcctgtccactctcggggccc

SEQ ID NO: 846353 - DNA, 14 bp, Homo sapiens
tcctgtccagagag

SEQ ID NO: 846354 - DNA, 10 bp, Homo sapiens
tcctgtccca

SEQ ID NO: 846355 - DNA, 11 bp, Homo sapiens
tcctgtccctg

SEQ ID NO: 846356 - DNA, 19 bp, Homo sapiens
tcctgtccctgtagctcag

SEQ ID NO: 846357 - DNA, 21 bp, Homo sapiens
tcctgtcccttctcttaattt

SEQ ID NO: 846358 - DNA, 15 bp, Homo sapiens
tcctgtccctttgtt

SEQ ID NO: 846359 - DNA, 17 bp, Homo sapiens
tcctgtccctttgttac

SEQ ID NO: 846360 - DNA, 15 bp, Homo sapiens
tcctgtcctgcctcc

SEQ ID NO: 846361 - DNA, 13 bp, Homo sapiens
tcctgtcctgctc

SEQ ID NO: 846362 - DNA, 19 bp, Homo sapiens
tcctgtcctttcttgcaga

SEQ ID NO: 846363 - DNA, 14 bp, Homo sapiens
tcctgtccttttaa

SEQ ID NO: 846364 - DNA, 22 bp, Homo sapiens
tcctgtcgattagactggacag

SEQ ID NO: 846365 - DNA, 17 bp, Homo sapiens
tcctgtctctgcacaga

SEQ ID NO: 846366 - DNA, 15 bp, Homo sapiens
tcctgtctctgcctg

SEQ ID NO: 846367 - DNA, 13 bp, Homo sapiens
tcctgtctgccag

SEQ ID NO: 846368 - DNA, 21 bp, Homo sapiens
tcctttcatctctctacctcc

SEQ ID NO: 846369 - DNA, 22 bp, Homo sapiens
tcctttcattaggcaaagtaca

SEQ ID NO: 846370 - DNA, 13 bp, Homo sapiens
tcctttccatctg

SEQ ID NO: 846371 - DNA, 14 bp, Homo sapiens
tcctttccatctgt

SEQ ID NO: 846372 - DNA, 14 bp, Homo sapiens
tcctttccctggag

SEQ ID NO: 846373 - DNA, 16 bp, Homo sapiens
tcctttccctggagct

SEQ ID NO: 846374 - DNA, 12 bp, Homo sapiens
tcctttcctctg

SEQ ID NO: 846375 - DNA, 13 bp, Homo sapiens
tcctttcctctga

SEQ ID NO: 846376 - DNA, 11 bp, Homo sapiens
tcctttctatc

SEQ ID NO: 846377 - DNA, 16 bp, Homo sapiens
tcctttctccagccag

SEQ ID NO: 846378 - DNA, 15 bp, Homo sapiens
tcctttctccctgca

SEQ ID NO: 846379 - DNA, 18 bp, Homo sapiens
tcctttctccctgcagcc

SEQ ID NO: 846380 - DNA, 16 bp, Homo sapiens
tcctttctctcctggc

SEQ ID NO: 846381 - DNA, 13 bp, Homo sapiens
tcctttctctttc

SEQ ID NO: 846382 - DNA, 23 bp, Homo sapiens
tcctttctctttctctcttccct

SEQ ID NO: 846383 - DNA, 15 bp, Homo sapiens
tcctttctgtgaagc

SEQ ID NO: 846384 - DNA, 19 bp, Homo sapiens
tcctttctgtgaagctaat

SEQ ID NO: 846385 - DNA, 13 bp, Homo sapiens
tcctttctgtgcc

SEQ ID NO: 846386 - DNA, 16 bp, Homo sapiens
tcctttcttaattttg

SEQ ID NO: 846387 - DNA, 22 bp, Homo sapiens
tcctttcttggttcataaatga

SEQ ID NO: 846388 - DNA, 13 bp, Homo sapiens
tcctttcttgtct

SEQ ID NO: 846389 - DNA, 19 bp, Homo sapiens
tcctttcttgtctttcctc

SEQ ID NO: 846390 - DNA, 14 bp, Homo sapiens
tcctttcttgtgcc

SEQ ID NO: 846391 - DNA, 13 bp, Homo sapiens
tcctttcttttcc

SEQ ID NO: 846392 - DNA, 14 bp, Homo sapiens
tcctttctttttct

SEQ ID NO: 846393 - DNA, 20 bp, Homo sapiens
tcctttctttttcttcttcc

SEQ ID NO: 846394 - DNA, 22 bp, Homo sapiens
tcctttgaacttgattgcctat

SEQ ID NO: 846395 - DNA, 12 bp, Homo sapiens
tcctttgaagat

SEQ ID NO: 846396 - DNA, 22 bp, Homo sapiens
tcctttgaagctttaggcagag

SEQ ID NO: 846397 - DNA, 16 bp, Homo sapiens
tcctttgacaaaagta

SEQ ID NO: 846398 - DNA, 19 bp, Homo sapiens
tcctttgagaatgtgattc

SEQ ID NO: 846399 - DNA, 17 bp, Homo sapiens
tcctttgcgcctgtgac

SEQ ID NO: 846400 - DNA, 22 bp, Homo sapiens
tcctttggaacaagacagcctt

SEQ ID NO: 846401 - DNA, 19 bp, Homo sapiens
tcctttggggaagtttatt

SEQ ID NO: 846402 - DNA, 21 bp, Homo sapiens
tcctttgtcttcaaactgtga

SEQ ID NO: 846403 - DNA, 19 bp, Homo sapiens
tcctttgtgagcctatgat

SEQ ID NO: 846404 - DNA, 18 bp, Homo sapiens
tcctttgtgtggctgccc

SEQ ID NO: 846405 - DNA, 13 bp, Homo sapiens
tccttttagccta

SEQ ID NO: 846406 - DNA, 14 bp, Homo sapiens
tccttttcataggt

SEQ ID NO: 846407 - DNA, 22 bp, Homo sapiens
tccttttccagaaatacctgtc

SEQ ID NO: 846408 - DNA, 14 bp, Homo sapiens
tccttttccctgct

SEQ ID NO: 846409 - DNA, 20 bp, Homo sapiens
tccttttcctaattcacaca

SEQ ID NO: 846410 - DNA, 12 bp, Homo sapiens
tccttttccttt

SEQ ID NO: 846411 - DNA, 19 bp, Homo sapiens
tccttttcttggcttgttt

SEQ ID NO: 846412 - DNA, 11 bp, Homo sapiens
tccttttgaac

SEQ ID NO: 846413 - DNA, 17 bp, Homo sapiens
tccttttgaacttgtca

SEQ ID NO: 846414 - DNA, 13 bp, Homo sapiens
tccttttgacact

SEQ ID NO: 846415 - DNA, 16 bp, Homo sapiens
tccttttgacactgct

SEQ ID NO: 846416 - DNA, 18 bp, Homo sapiens
tccttttgacactgctct

SEQ ID NO: 846417 - DNA, 20 bp, Homo sapiens
tccttttgacactgctctaa

SEQ ID NO: 846418 - DNA, 20 bp, Homo sapiens
tccttttgaccttcatttca

SEQ ID NO: 846419 - DNA, 23 bp, Homo sapiens
tccttttgaccttcatttcatgt

SEQ ID NO: 846420 - DNA, 21 bp, Homo sapiens
tccttttgtatcttcctttct

SEQ ID NO: 846421 - DNA, 18 bp, Homo sapiens
tccttttgtccccagggc

SEQ ID NO: 846422 - DNA, 19 bp, Homo sapiens
tccttttgtccccagggcc

SEQ ID NO: 846423 - DNA, 18 bp, Homo sapiens
tccttttgtgtacagtgt

SEQ ID NO: 846424 - DNA, 17 bp, Homo sapiens
tccttttgttttgaagc

SEQ ID NO: 846425 - DNA, 14 bp, Homo sapiens
tcctttttaaatgt

SEQ ID NO: 846426 - DNA, 19 bp, Homo sapiens
tcctttttaaccattccaa

SEQ ID NO: 846427 - DNA, 12 bp, Homo sapiens
tcctttttaagg

SEQ ID NO: 846428 - DNA, 13 bp, Homo sapiens
tcctttttattca

SEQ ID NO: 846429 - DNA, 17 bp, Homo sapiens
tcctttttccaacaaga

SEQ ID NO: 846430 - DNA, 17 bp, Homo sapiens
tcctttttccaatgttt

SEQ ID NO: 846431 - DNA, 12 bp, Homo sapiens
tcctttttctat

SEQ ID NO: 846432 - DNA, 14 bp, Homo sapiens
tcctttttctccct

SEQ ID NO: 846433 - DNA, 23 bp, Homo sapiens
tcctttttggtcgaggagtaaca

SEQ ID NO: 846434 - DNA, 19 bp, Homo sapiens
tccttttttcaatatgcaa

SEQ ID NO: 846435 - DNA, 11 bp, Homo sapiens
tccttttttcc

SEQ ID NO: 846436 - DNA, 13 bp, Homo sapiens
tccttttttgtca

SEQ ID NO: 846437 - DNA, 15 bp, Homo sapiens
tccttttttgtcatt

SEQ ID NO: 846438 - DNA, 14 bp, Homo sapiens
tccttttttgtcta

SEQ ID NO: 846439 - DNA, 15 bp, Homo sapiens
tccttttttgtctat

SEQ ID NO: 846440 - DNA, 16 bp, Homo sapiens
tccttttttgtctatg

SEQ ID NO: 846441 - DNA, 21 bp, Homo sapiens
tcctttttttccatctttaca

SEQ ID NO: 846442 - DNA, 17 bp, Homo sapiens
tcgaaaaaataattatt

SEQ ID NO: 846443 - DNA, 14 bp, Homo sapiens
tcgaaaatcaaatg

SEQ ID NO: 846444 - DNA, 18 bp, Homo sapiens
tcgaaacacagaaacctt

SEQ ID NO: 846445 - DNA, 22 bp, Homo sapiens
tcgaaacctacaagatttcctt

SEQ ID NO: 846446 - DNA, 17 bp, Homo sapiens
tcgaaactgacagtatt

SEQ ID NO: 846447 - DNA, 12 bp, Homo sapiens
tcgaaactgcca

SEQ ID NO: 846448 - DNA, 12 bp, Homo sapiens
tcgaaaggcctt

SEQ ID NO: 846449 - DNA, 22 bp, Homo sapiens
tcgaaatagatatcctctcccc

SEQ ID NO: 846450 - DNA, 12 bp, Homo sapiens
tcgaaccaaggc

SEQ ID NO: 846451 - DNA, 13 bp, Homo sapiens
tcgaaccaaggca

SEQ ID NO: 846452 - DNA, 22 bp, Homo sapiens
tcgaacccgggaggcagaggtt

SEQ ID NO: 846453 - DNA, 15 bp, Homo sapiens
tcgaaccgttttgaa

SEQ ID NO: 846454 - DNA, 18 bp, Homo sapiens
tcgaactccaggctttct

SEQ ID NO: 846455 - DNA, 16 bp, Homo sapiens
tcgaactcctgacctc

SEQ ID NO: 846456 - DNA, 19 bp, Homo sapiens
tcgaactcctgacctcagg

SEQ ID NO: 846457 - DNA, 21 bp, Homo sapiens
tcgaactcttctttgctgcat

SEQ ID NO: 846458 - DNA, 15 bp, Homo sapiens
tcgaagctcagccca

SEQ ID NO: 846459 - DNA, 16 bp, Homo sapiens
tcgaagctcagcccac

SEQ ID NO: 846460 - DNA, 14 bp, Homo sapiens
tcgaagtattcaat

SEQ ID NO: 846461 - DNA, 12 bp, Homo sapiens
tcgaagtgctga

SEQ ID NO: 846462 - DNA, 16 bp, Homo sapiens
tcgaatatagttctgt

SEQ ID NO: 846463 - DNA, 16 bp, Homo sapiens
tcgaatctctgtgcct

SEQ ID NO: 846464 - DNA, 21 bp, Homo sapiens
tcgaatcttaatttattattt

SEQ ID NO: 846465 - DNA, 12 bp, Homo sapiens
tcgaatgaaatt

SEQ ID NO: 846466 - DNA, 14 bp, Homo sapiens
tcgaatgacactgt

SEQ ID NO: 846467 - DNA, 15 bp, Homo sapiens
tcgaatgtaattgga

SEQ ID NO: 846468 - DNA, 19 bp, Homo sapiens
tcgaatgtaattggaatct

SEQ ID NO: 846469 - DNA, 17 bp, Homo sapiens
tcgaattttatctgtgg

SEQ ID NO: 846470 - DNA, 19 bp, Homo sapiens
tcgaattttatctgtggag

SEQ ID NO: 846471 - DNA, 14 bp, Homo sapiens
tcgacaagaatgtc

SEQ ID NO: 846472 - DNA, 19 bp, Homo sapiens
tcgacactcaccatgaagc

SEQ ID NO: 846473 - DNA, 15 bp, Homo sapiens
tcgacagggcctgga

SEQ ID NO: 846474 - DNA, 19 bp, Homo sapiens
tcgacccagaatggagcct

SEQ ID NO: 846475 - DNA, 20 bp, Homo sapiens
tcgacccagaatggagcctg

SEQ ID NO: 846476 - DNA, 16 bp, Homo sapiens
tcgactactgctcctg

SEQ ID NO: 846477 - DNA, 15 bp, Homo sapiens
tcgactctgctgctc

SEQ ID NO: 846478 - DNA, 17 bp, Homo sapiens
tcgactgtgacctgtgg

SEQ ID NO: 846479 - DNA, 22 bp, Homo sapiens
tcgacttcttggttttctctct

SEQ ID NO: 846480 - DNA, 23 bp, Homo sapiens
tcgacttcttggttttctctctg

SEQ ID NO: 846481 - DNA, 20 bp, Homo sapiens
tcgagaaagaggcaccagga

SEQ ID NO: 846482 - DNA, 14 bp, Homo sapiens
tcgagagctggcca

SEQ ID NO: 846483 - DNA, 15 bp, Homo sapiens
tcgagagctggccaa

SEQ ID NO: 846484 - DNA, 12 bp, Homo sapiens
tcgagagtgtgc

SEQ ID NO: 846485 - DNA, 23 bp, Homo sapiens
tcgagatgttcgctcgtgcagta

SEQ ID NO: 846486 - DNA, 18 bp, Homo sapiens
tcgagatttgggagctga

SEQ ID NO: 846487 - DNA, 22 bp, Homo sapiens
tcgagcagtcctgcctcagcct

SEQ ID NO: 846488 - DNA, 20 bp, Homo sapiens
tcgagcatgcggagccagca

SEQ ID NO: 846489 - DNA, 21 bp, Homo sapiens
tcgagcatgcggagccagcag

SEQ ID NO: 846490 - DNA, 21 bp, Homo sapiens
tcgagcatgttgttttttcat

SEQ ID NO: 846491 - DNA, 14 bp, Homo sapiens
tcgagccctccccc

SEQ ID NO: 846492 - DNA, 15 bp, Homo sapiens
tcgaggacaggaaag

SEQ ID NO: 846493 - DNA, 23 bp, Homo sapiens
tcgaggattctgtgcctccagga

SEQ ID NO: 846494 - DNA, 21 bp, Homo sapiens
tcgaggcatggggcatgtcct

SEQ ID NO: 846495 - DNA, 22 bp, Homo sapiens
tcgaggcctacagaggaggcct

SEQ ID NO: 846496 - DNA, 10 bp, Homo sapiens
tcgaggcctg

SEQ ID NO: 846497 - DNA, 15 bp, Homo sapiens
tcgaggcctgaagcc

SEQ ID NO: 846498 - DNA, 23 bp, Homo sapiens
tcgaggcctgcaaaccttcctgg

SEQ ID NO: 846499 - DNA, 17 bp, Homo sapiens
tcgagggccgcctgcct

SEQ ID NO: 846500 - DNA, 14 bp, Homo sapiens
tcgaggggctctca

SEQ ID NO: 846501 - DNA, 18 bp, Homo sapiens
tcgaggggctctcagctc

SEQ ID NO: 846502 - DNA, 23 bp, Homo sapiens
tcgaggtaggtggatcacctgag

SEQ ID NO: 846503 - DNA, 15 bp, Homo sapiens
tcgaggtgtcaccct

SEQ ID NO: 846504 - DNA, 17 bp, Homo sapiens
tcgaggtgtcaccctgc

SEQ ID NO: 846505 - DNA, 20 bp, Homo sapiens
tcgaggtgtcaccctgcaga

SEQ ID NO: 846506 - DNA, 16 bp, Homo sapiens
tcgagtaaacttgaaa

SEQ ID NO: 846507 - DNA, 14 bp, Homo sapiens
tcgagtcaaaatgt

SEQ ID NO: 846508 - DNA, 15 bp, Homo sapiens
tcgagtcacattctg

SEQ ID NO: 846509 - DNA, 17 bp, Homo sapiens
tcgagtcacattctgct

SEQ ID NO: 846510 - DNA, 13 bp, Homo sapiens
tcgagtctttgtg

SEQ ID NO: 846511 - DNA, 16 bp, Homo sapiens
tcgagtctttgtgtgt

SEQ ID NO: 846512 - DNA, 14 bp, Homo sapiens
tcgagtgagacaga

SEQ ID NO: 846513 - DNA, 23 bp, Homo sapiens
tcgagtgagacagactagaagtt

SEQ ID NO: 846514 - DNA, 18 bp, Homo sapiens
tcgagtgtagctgtgaaa

SEQ ID NO: 846515 - DNA, 20 bp, Homo sapiens
tcgatactgcgactttctgc

SEQ ID NO: 846516 - DNA, 23 bp, Homo sapiens
tcgatactgcgactttctgcctg

SEQ ID NO: 846517 - DNA, 21 bp, Homo sapiens
tcgatatgtatatcattctac

SEQ ID NO: 846518 - DNA, 19 bp, Homo sapiens
tcgatgaagcccaataaac

SEQ ID NO: 846519 - DNA, 23 bp, Homo sapiens
tcgatgaagcccaataaacctct

SEQ ID NO: 846520 - DNA, 12 bp, Homo sapiens
tcgatgcacagt

SEQ ID NO: 846521 - DNA, 12 bp, Homo sapiens
tcgatgcactga

SEQ ID NO: 846522 - DNA, 13 bp, Homo sapiens
tcgatgcactgac

SEQ ID NO: 846523 - DNA, 18 bp, Homo sapiens
tcgatgcgttcactccaa

SEQ ID NO: 846524 - DNA, 22 bp, Homo sapiens
tcgatgggggatgcttcatgtg

SEQ ID NO: 846525 - DNA, 16 bp, Homo sapiens
tcgatgtttgccatga

SEQ ID NO: 846526 - DNA, 13 bp, Homo sapiens
tcgattagactgg

SEQ ID NO: 846527 - DNA, 14 bp, Homo sapiens
tcgattagactgga

SEQ ID NO: 846528 - DNA, 18 bp, Homo sapiens
tcgattagactggacagc

SEQ ID NO: 846529 - DNA, 15 bp, Homo sapiens
tcgattcatattgaa

SEQ ID NO: 846530 - DNA, 23 bp, Homo sapiens
tcgattgaaggtgacctctgccc

SEQ ID NO: 846531 - DNA, 21 bp, Homo sapiens
tcgattgtgtagcaattgaca

SEQ ID NO: 846532 - DNA, 15 bp, Homo sapiens
tcgatttctccagga

SEQ ID NO: 846533 - DNA, 13 bp, Homo sapiens
tcgattttgtatc

SEQ ID NO: 846534 - DNA, 17 bp, Homo sapiens
tcgattttgtatctgca

SEQ ID NO: 846535 - DNA, 15 bp, Homo sapiens
tcgcaaccctgcctg

SEQ ID NO: 846536 - DNA, 23 bp, Homo sapiens
tcgcaatagttttttacttctct

SEQ ID NO: 846537 - DNA, 17 bp, Homo sapiens
tcgcacaggccctagct

SEQ ID NO: 846538 - DNA, 12 bp, Homo sapiens
tcgcacctacca

SEQ ID NO: 846539 - DNA, 18 bp, Homo sapiens
tcgcaccttgctgtgtga

SEQ ID NO: 846540 - DNA, 16 bp, Homo sapiens
tcgcaccttttatacc

SEQ ID NO: 846541 - DNA, 18 bp, Homo sapiens
tcgcagacctaagccctg

SEQ ID NO: 846542 - DNA, 19 bp, Homo sapiens
tcgcagagcttttcagatt

SEQ ID NO: 846543 - DNA, 14 bp, Homo sapiens
tcgcagatgataaa

SEQ ID NO: 846544 - DNA, 22 bp, Homo sapiens
tcgcagcacagagtcgctggca

SEQ ID NO: 846545 - DNA, 22 bp, Homo sapiens
tcgcaggagtctctgccaccca

SEQ ID NO: 846546 - DNA, 19 bp, Homo sapiens
tcgcaggatccgctgccac

SEQ ID NO: 846547 - DNA, 21 bp, Homo sapiens
tcgcaggatccgctgccacca

SEQ ID NO: 846548 - DNA, 17 bp, Homo sapiens
tcgcatccgtcctgggc

SEQ ID NO: 846549 - DNA, 19 bp, Homo sapiens
tcgcatccgtcctgggcgt

SEQ ID NO: 846550 - DNA, 20 bp, Homo sapiens
tcgcatggtcacacactgat

SEQ ID NO: 846551 - DNA, 13 bp, Homo sapiens
tcgcatttgtcaa

SEQ ID NO: 846552 - DNA, 21 bp, Homo sapiens
tcgccacctggcattccttct

SEQ ID NO: 846553 - DNA, 15 bp, Homo sapiens
tcgccagcttggctc

SEQ ID NO: 846554 - DNA, 17 bp, Homo sapiens
tcgccatcttcttccct

SEQ ID NO: 846555 - DNA, 20 bp, Homo sapiens
tcgcccacccagctggtcct

SEQ ID NO: 846556 - DNA, 11 bp, Homo sapiens
tcgcccaggag

SEQ ID NO: 846557 - DNA, 22 bp, Homo sapiens
tcgcccaggcctgggatgcagt

SEQ ID NO: 846558 - DNA, 19 bp, Homo sapiens
tcgcccaggctggagtgca

SEQ ID NO: 846559 - DNA, 14 bp, Homo sapiens
tcgccccacccagg

SEQ ID NO: 846560 - DNA, 15 bp, Homo sapiens
tcgccccagatcacc

SEQ ID NO: 846561 - DNA, 20 bp, Homo sapiens
tcgccccagatcaccagccc

SEQ ID NO: 846562 - DNA, 22 bp, Homo sapiens
tcgccccagatcaccagcccgg

SEQ ID NO: 846563 - DNA, 20 bp, Homo sapiens
tcgcccccaccagtgtagca

SEQ ID NO: 846564 - DNA, 18 bp, Homo sapiens
tcgcccccaggaacgctc

SEQ ID NO: 846565 - DNA, 19 bp, Homo sapiens
tcgcccccaggaacgctct

SEQ ID NO: 846566 - DNA, 23 bp, Homo sapiens
tcgcccccaggaacgctctcctc

SEQ ID NO: 846567 - DNA, 21 bp, Homo sapiens
tcgccccgcagggtccaaagg

SEQ ID NO: 846568 - DNA, 21 bp, Homo sapiens
tcgcccctcccctcagcctgc

SEQ ID NO: 846569 - DNA, 15 bp, Homo sapiens
tcgcccgataaagac

SEQ ID NO: 846570 - DNA, 13 bp, Homo sapiens
tcgcccgcccact

SEQ ID NO: 846571 - DNA, 15 bp, Homo sapiens
tcgcccgcccactgt

SEQ ID NO: 846572 - DNA, 19 bp, Homo sapiens
tcgcccgcccactgtcctg

SEQ ID NO: 846573 - DNA, 22 bp, Homo sapiens
tcgcccgcccactgtcctgggc

SEQ ID NO: 846574 - DNA, 12 bp, Homo sapiens
tcgccctccttt

SEQ ID NO: 846575 - DNA, 16 bp, Homo sapiens
tcgccctcctttccct

SEQ ID NO: 846576 - DNA, 18 bp, Homo sapiens
tcgccctcctttctgtgc

SEQ ID NO: 846577 - DNA, 13 bp, Homo sapiens
tcgccctctgaaa

SEQ ID NO: 846578 - DNA, 17 bp, Homo sapiens
tcgccggatctgaggga

SEQ ID NO: 846579 - DNA, 17 bp, Homo sapiens
tcgccgttgaagaggaa

SEQ ID NO: 846580 - DNA, 16 bp, Homo sapiens
tcgcctaggcctgtga

SEQ ID NO: 846581 - DNA, 20 bp, Homo sapiens
tcgcctgacaaccactggtc

SEQ ID NO: 846582 - DNA, 20 bp, Homo sapiens
tcgcctttgtcttgtacttc

SEQ ID NO: 846583 - DNA, 14 bp, Homo sapiens
tcgcgcccaaaaga

SEQ ID NO: 846584 - DNA, 15 bp, Homo sapiens
tcgcgcccaaaagat

SEQ ID NO: 846585 - DNA, 14 bp, Homo sapiens
tcgcgctcagtaaa

SEQ ID NO: 846586 - DNA, 18 bp, Homo sapiens
tcgcggcggagctggccc

SEQ ID NO: 846587 - DNA, 20 bp, Homo sapiens
tcgcggcggagctggccccg

SEQ ID NO: 846588 - DNA, 14 bp, Homo sapiens
tcgcggctgggagc

SEQ ID NO: 846589 - DNA, 14 bp, Homo sapiens
tcgctagtgtttaa

SEQ ID NO: 846590 - DNA, 13 bp, Homo sapiens
tcgctcagtctgt

SEQ ID NO: 846591 - DNA, 11 bp, Homo sapiens
tcgctcccctc

SEQ ID NO: 846592 - DNA, 17 bp, Homo sapiens
tcgctcccctctggaat

SEQ ID NO: 846593 - DNA, 11 bp, Homo sapiens
tcgctcctcct

SEQ ID NO: 846594 - DNA, 14 bp, Homo sapiens
tcgctcctcctctc

SEQ ID NO: 846595 - DNA, 14 bp, Homo sapiens
tcgctcctgcccac

SEQ ID NO: 846596 - DNA, 14 bp, Homo sapiens
tcgctgaaattgct

SEQ ID NO: 846597 - DNA, 17 bp, Homo sapiens
tcgctgacttcatggaa

SEQ ID NO: 846598 - DNA, 19 bp, Homo sapiens
tcgctgatatatgtgtttt

SEQ ID NO: 846599 - DNA, 20 bp, Homo sapiens
tcgctgccatcaccgctggg

SEQ ID NO: 846600 - DNA, 17 bp, Homo sapiens
tcgctgctctagctggc

SEQ ID NO: 846601 - DNA, 20 bp, Homo sapiens
tcgctggactctcagtctct

SEQ ID NO: 846602 - DNA, 22 bp, Homo sapiens
tcgctggactctcagtctctga

SEQ ID NO: 846603 - DNA, 23 bp, Homo sapiens
tcgctggactctcagtctctgag

SEQ ID NO: 846604 - DNA, 14 bp, Homo sapiens
tcgctgggtcagtg

SEQ ID NO: 846605 - DNA, 20 bp, Homo sapiens
tcgctgggtcagtgctggaa

SEQ ID NO: 846606 - DNA, 13 bp, Homo sapiens
tcgctgtgtgtta

SEQ ID NO: 846607 - DNA, 21 bp, Homo sapiens
tcgctgttggagcaaaccatt

SEQ ID NO: 846608 - DNA, 19 bp, Homo sapiens
tcgcttaggtagaaactat

SEQ ID NO: 846609 - DNA, 16 bp, Homo sapiens
tcgcttcctcagcctc

SEQ ID NO: 846610 - DNA, 18 bp, Homo sapiens
tcgcttcctcagcctcca

SEQ ID NO: 846611 - DNA, 22 bp, Homo sapiens
tcgcttctgtgtatctctttca

SEQ ID NO: 846612 - DNA, 22 bp, Homo sapiens
tcgcttcttagaacagtggaaa

SEQ ID NO: 846613 - DNA, 20 bp, Homo sapiens
tctaacctcatcttcttcac

SEQ ID NO: 846614 - DNA, 17 bp, Homo sapiens
tctaaccttgaatgctg

SEQ ID NO: 846615 - DNA, 19 bp, Homo sapiens
tctaaccttgaatgctgcc

SEQ ID NO: 846616 - DNA, 14 bp, Homo sapiens
tctaacctttacat

SEQ ID NO: 846617 - DNA, 16 bp, Homo sapiens
tctaactcactgccta

SEQ ID NO: 846618 - DNA, 17 bp, Homo sapiens
tctaactcactgcctag

SEQ ID NO: 846619 - DNA, 22 bp, Homo sapiens
tctaacttcaccatattaccac

SEQ ID NO: 846620 - DNA, 13 bp, Homo sapiens
tctaagaaaagca

SEQ ID NO: 846621 - DNA, 16 bp, Homo sapiens
tctaagaaaatgtagt

SEQ ID NO: 846622 - DNA, 12 bp, Homo sapiens
tctaagaaaccc

SEQ ID NO: 846623 - DNA, 21 bp, Homo sapiens
tctaagaccacgaaaaaaggc

SEQ ID NO: 846624 - DNA, 20 bp, Homo sapiens
tctaagagaacaatgtgcta

SEQ ID NO: 846625 - DNA, 15 bp, Homo sapiens
tctaagataaaaata

SEQ ID NO: 846626 - DNA, 24 bp, Homo sapiens
tctaagcaagtgagtctggtggag

SEQ ID NO: 846627 - DNA, 15 bp, Homo sapiens
tctaagcagccagga

SEQ ID NO: 846628 - DNA, 20 bp, Homo sapiens
tctaagcagctggtcttttc

SEQ ID NO: 846629 - DNA, 18 bp, Homo sapiens
tctaagcatgtagccagt

SEQ ID NO: 846630 - DNA, 23 bp, Homo sapiens
tctaagcctatacgtttctgtgg

SEQ ID NO: 846631 - DNA, 17 bp, Homo sapiens
tctaagcctttccataa

SEQ ID NO: 846632 - DNA, 15 bp, Homo sapiens
tctaagctggagctc

SEQ ID NO: 846633 - DNA, 17 bp, Homo sapiens
tctaagctggagctctt

SEQ ID NO: 846634 - DNA, 19 bp, Homo sapiens
tctaaggagcgctagtgcc

SEQ ID NO: 846635 - DNA, 23 bp, Homo sapiens
tctaaggagcgctagtgccttgc

SEQ ID NO: 846636 - DNA, 17 bp, Homo sapiens
tctaaggataatgaaat

SEQ ID NO: 846637 - DNA, 19 bp, Homo sapiens
tctaaggataatgaaataa

SEQ ID NO: 846638 - DNA, 19 bp, Homo sapiens
tctaaggatgtcacagggc

SEQ ID NO: 846639 - DNA, 18 bp, Homo sapiens
tctaaggtctcatgctgt

SEQ ID NO: 846640 - DNA, 15 bp, Homo sapiens
tctaagtaaatacaa

SEQ ID NO: 846641 - DNA, 20 bp, Homo sapiens
tctaagtaaatacaattttt

SEQ ID NO: 846642 - DNA, 19 bp, Homo sapiens
tctaagtatttaaatgttc

SEQ ID NO: 846643 - DNA, 20 bp, Homo sapiens
tctaagtcatgtatgtttct

SEQ ID NO: 846644 - DNA, 13 bp, Homo sapiens
tctaagtctttcc

SEQ ID NO: 846645 - DNA, 18 bp, Homo sapiens
tctaagtgtaacctcagt

SEQ ID NO: 846646 - DNA, 16 bp, Homo sapiens
tctaagttagactctt

SEQ ID NO: 846647 - DNA, 17 bp, Homo sapiens
tctaagttagactcttc

SEQ ID NO: 846648 - DNA, 17 bp, Homo sapiens
tctaagttccactgagc

SEQ ID NO: 846649 - DNA, 21 bp, Homo sapiens
tctaataaatatactatgaaa

SEQ ID NO: 846650 - DNA, 18 bp, Homo sapiens
tctaataagtttgtgtta

SEQ ID NO: 846651 - DNA, 14 bp, Homo sapiens
tctaataataaata

SEQ ID NO: 846652 - DNA, 15 bp, Homo sapiens
tctaataataaatag

SEQ ID NO: 846653 - DNA, 15 bp, Homo sapiens
tctaatagtttttca

SEQ ID NO: 846654 - DNA, 14 bp, Homo sapiens
tctaatatggccac

SEQ ID NO: 846655 - DNA, 17 bp, Homo sapiens
tctaatattaaaaatat

SEQ ID NO: 846656 - DNA, 16 bp, Homo sapiens
tctaatcacagtgttg

SEQ ID NO: 846657 - DNA, 21 bp, Homo sapiens
tctaatctcttattctaataa

SEQ ID NO: 846658 - DNA, 13 bp, Homo sapiens
tctaatctgaact

SEQ ID NO: 846659 - DNA, 15 bp, Homo sapiens
tctaatctgaactga

SEQ ID NO: 846660 - DNA, 14 bp, Homo sapiens
tctaatgaaaaaca

SEQ ID NO: 846661 - DNA, 16 bp, Homo sapiens
tctaatgagcatttcc

SEQ ID NO: 846662 - DNA, 21 bp, Homo sapiens
tctaatgagctagtgtcttat

SEQ ID NO: 846663 - DNA, 17 bp, Homo sapiens
tctaatgattcaaatgt

SEQ ID NO: 846664 - DNA, 19 bp, Homo sapiens
tctaatgattcaaatgttt

SEQ ID NO: 846665 - DNA, 20 bp, Homo sapiens
tctaatgcttgtttatgata

SEQ ID NO: 846666 - DNA, 21 bp, Homo sapiens
tctaatggggaaatgtagcta

SEQ ID NO: 846667 - DNA, 20 bp, Homo sapiens
tctaatgggtatttaaacaa

SEQ ID NO: 846668 - DNA, 14 bp, Homo sapiens
tctaatgtcttcat

SEQ ID NO: 846669 - DNA, 17 bp, Homo sapiens
tctaatgtcttcatttc

SEQ ID NO: 846670 - DNA, 16 bp, Homo sapiens
tctaatgtgaaaatca

SEQ ID NO: 846671 - DNA, 17 bp, Homo sapiens
tctaatgtgaaaatcat

SEQ ID NO: 846672 - DNA, 12 bp, Homo sapiens
tctaatgtttgt

SEQ ID NO: 846673 - DNA, 17 bp, Homo sapiens
tctaattaattgtaatc

SEQ ID NO: 846674 - DNA, 17 bp, Homo sapiens
tctaattagagaactgg

SEQ ID NO: 846675 - DNA, 21 bp, Homo sapiens
tctaattagtctatcaaatga

SEQ ID NO: 846676 - DNA, 23 bp, Homo sapiens
tctaattatttaaataaaatcac

SEQ ID NO: 846677 - DNA, 22 bp, Homo sapiens
tctaattcccattttgcaaaat

SEQ ID NO: 846678 - DNA, 15 bp, Homo sapiens
tctaattctctgtgg

SEQ ID NO: 846679 - DNA, 20 bp, Homo sapiens
tctaattggaagaaattcct

SEQ ID NO: 846680 - DNA, 21 bp, Homo sapiens
tctaattgtaagtgaaattaa

SEQ ID NO: 846681 - DNA, 13 bp, Homo sapiens
tctaatttataaa

SEQ ID NO: 846682 - DNA, 15 bp, Homo sapiens
tctaatttattaatc

SEQ ID NO: 846683 - DNA, 22 bp, Homo sapiens
tctaatttcaaaaatataactt

SEQ ID NO: 846684 - DNA, 22 bp, Homo sapiens
tctaatttctttagttttctat

SEQ ID NO: 846685 - DNA, 18 bp, Homo sapiens
tctacaaaaagtaaaaat

SEQ ID NO: 846686 - DNA, 13 bp, Homo sapiens
tctacaagccaaa

SEQ ID NO: 846687 - DNA, 14 bp, Homo sapiens
tctacaagtatatg

SEQ ID NO: 846688 - DNA, 15 bp, Homo sapiens
tctacaatacatata

SEQ ID NO: 846689 - DNA, 19 bp, Homo sapiens
tctacaatcagttgacttt

SEQ ID NO: 846690 - DNA, 19 bp, Homo sapiens
tctacaatgtgaactttat

SEQ ID NO: 846691 - DNA, 20 bp, Homo sapiens
tctacaatgtgaactttatt

SEQ ID NO: 846692 - DNA, 19 bp, Homo sapiens
tctacaattcctctgataa

SEQ ID NO: 846693 - DNA, 22 bp, Homo sapiens
tctacacaggggccctgtacag

SEQ ID NO: 846694 - DNA, 12 bp, Homo sapiens
tctacacctgga

SEQ ID NO: 846695 - DNA, 16 bp, Homo sapiens
tctacaccttgctttt

SEQ ID NO: 846696 - DNA, 13 bp, Homo sapiens
tctacactgtgaa

SEQ ID NO: 846697 - DNA, 21 bp, Homo sapiens
tctacagaaataacagctggg

SEQ ID NO: 846698 - DNA, 23 bp, Homo sapiens
tctacagaataatccagtattgc

SEQ ID NO: 846699 - DNA, 12 bp, Homo sapiens
tctacagactcc

SEQ ID NO: 846700 - DNA, 21 bp, Homo sapiens
tctacagagaaaatgaatttg

SEQ ID NO: 846701 - DNA, 22 bp, Homo sapiens
tctacagagaaaatgaatttgg

SEQ ID NO: 846702 - DNA, 19 bp, Homo sapiens
tctacagagcttccctgac

SEQ ID NO: 846703 - DNA, 22 bp, Homo sapiens
tctacaggcccggcccagccta

SEQ ID NO: 846704 - DNA, 15 bp, Homo sapiens
tctacagtaatgaaa

SEQ ID NO: 846705 - DNA, 16 bp, Homo sapiens
tctacagtaatgaaat

SEQ ID NO: 846706 - DNA, 12 bp, Homo sapiens
tctacagtggtt

SEQ ID NO: 846707 - DNA, 21 bp, Homo sapiens
tctacagtggttttatactga

SEQ ID NO: 846708 - DNA, 16 bp, Homo sapiens
tctacatatgatctgt

SEQ ID NO: 846709 - DNA, 17 bp, Homo sapiens
tctacatgactgggcct

SEQ ID NO: 846710 - DNA, 21 bp, Homo sapiens
tctacatgtaactatttcttc

SEQ ID NO: 846711 - DNA, 14 bp, Homo sapiens
tctacatgtgccac

SEQ ID NO: 846712 - DNA, 20 bp, Homo sapiens
tctacatgtgccaccaacat

SEQ ID NO: 846713 - DNA, 21 bp, Homo sapiens
tctacattcttggttgttaat

SEQ ID NO: 846714 - DNA, 18 bp, Homo sapiens
tctacattgagcatttga

SEQ ID NO: 846715 - DNA, 16 bp, Homo sapiens
tctacatttcacatta

SEQ ID NO: 846716 - DNA, 22 bp, Homo sapiens
tctacatttcacattattctgg

SEQ ID NO: 846717 - DNA, 23 bp, Homo sapiens
tctacatttcacctactttgtaa

SEQ ID NO: 846718 - DNA, 14 bp, Homo sapiens
tctacatttcttag

SEQ ID NO: 846719 - DNA, 21 bp, Homo sapiens
tctacattttttaaaactgaa

SEQ ID NO: 846720 - DNA, 17 bp, Homo sapiens
tctaccaaataatttca

SEQ ID NO: 846721 - DNA, 17 bp, Homo sapiens
tctaccaggcaaattca

SEQ ID NO: 846722 - DNA, 19 bp, Homo sapiens
tctaccatgaacagaaaac

SEQ ID NO: 846723 - DNA, 18 bp, Homo sapiens
tctaccatttcagagagg

SEQ ID NO: 846724 - DNA, 22 bp, Homo sapiens
tctacccaaaccctaggttccc

SEQ ID NO: 846725 - DNA, 13 bp, Homo sapiens
tctacccaaagga

SEQ ID NO: 846726 - DNA, 21 bp, Homo sapiens
tctacccagtgctccagtttc

SEQ ID NO: 846727 - DNA, 21 bp, Homo sapiens
tctacccatcttaaaaacaac

SEQ ID NO: 846728 - DNA, 18 bp, Homo sapiens
tctaccccagactagatg

SEQ ID NO: 846729 - DNA, 14 bp, Homo sapiens
tctacccctttctt

SEQ ID NO: 846730 - DNA, 17 bp, Homo sapiens
tctacccggcccagaga

SEQ ID NO: 846731 - DNA, 20 bp, Homo sapiens
tctacccgtgcctgggcccc

SEQ ID NO: 846732 - DNA, 15 bp, Homo sapiens
tctaccctcccaccc

SEQ ID NO: 846733 - DNA, 18 bp, Homo sapiens
tctaccctcccaccccct

SEQ ID NO: 846734 - DNA, 14 bp, Homo sapiens
tctatccccaagct

SEQ ID NO: 846735 - DNA, 15 bp, Homo sapiens
tctatccccaagctg

SEQ ID NO: 846736 - DNA, 14 bp, Homo sapiens
tctatcctctgtaa

SEQ ID NO: 846737 - DNA, 19 bp, Homo sapiens
tctatcgagtttgcaatgt

SEQ ID NO: 846738 - DNA, 14 bp, Homo sapiens
tctatctatttgag

SEQ ID NO: 846739 - DNA, 21 bp, Homo sapiens
tctatctggtattaaatgcca

SEQ ID NO: 846740 - DNA, 23 bp, Homo sapiens
tctatcttccaaatgcaatttga

SEQ ID NO: 846741 - DNA, 18 bp, Homo sapiens
tctatcttttgtttcctt

SEQ ID NO: 846742 - DNA, 16 bp, Homo sapiens
tctatgaacaacagta

SEQ ID NO: 846743 - DNA, 14 bp, Homo sapiens
tctatgaagttgct

SEQ ID NO: 846744 - DNA, 15 bp, Homo sapiens
tctatgaagttgctg

SEQ ID NO: 846745 - DNA, 17 bp, Homo sapiens
tctatgaagttgctgtt

SEQ ID NO: 846746 - DNA, 20 bp, Homo sapiens
tctatgaagttgctgtttat

SEQ ID NO: 846747 - DNA, 19 bp, Homo sapiens
tctatgatccttttttgtc

SEQ ID NO: 846748 - DNA, 13 bp, Homo sapiens
tctatgcagcatg

SEQ ID NO: 846749 - DNA, 17 bp, Homo sapiens
tctatgccaaagatcac

SEQ ID NO: 846750 - DNA, 15 bp, Homo sapiens
tctatgccctgcaga

SEQ ID NO: 846751 - DNA, 21 bp, Homo sapiens
tctatgccctgcagagcaata

SEQ ID NO: 846752 - DNA, 12 bp, Homo sapiens
tctatgctctcg

SEQ ID NO: 846753 - DNA, 14 bp, Homo sapiens
tctatggaaatgtg

SEQ ID NO: 846754 - DNA, 15 bp, Homo sapiens
tctatggaaatgtga

SEQ ID NO: 846755 - DNA, 20 bp, Homo sapiens
tctatggaaatgtgagaaat

SEQ ID NO: 846756 - DNA, 19 bp, Homo sapiens
tctatggagactttgctgt

SEQ ID NO: 846757 - DNA, 20 bp, Homo sapiens
tctatggagactttgctgtt

SEQ ID NO: 846758 - DNA, 16 bp, Homo sapiens
tctatggcttatttct

SEQ ID NO: 846759 - DNA, 17 bp, Homo sapiens
tctatggcttatttcta

SEQ ID NO: 846760 - DNA, 19 bp, Homo sapiens
tctatggcttatttctatg

SEQ ID NO: 846761 - DNA, 21 bp, Homo sapiens
tctatggcttatttctatgac

SEQ ID NO: 846762 - DNA, 18 bp, Homo sapiens
tctatggctttaaataaa

SEQ ID NO: 846763 - DNA, 12 bp, Homo sapiens
tctatgtaaatt

SEQ ID NO: 846764 - DNA, 13 bp, Homo sapiens
tctatgtaaatta

SEQ ID NO: 846765 - DNA, 15 bp, Homo sapiens
tctatgtaaattatt

SEQ ID NO: 846766 - DNA, 23 bp, Homo sapiens
tctatgtaaattattgtaaactt

SEQ ID NO: 846767 - DNA, 22 bp, Homo sapiens
tctatgtcatttttaatgtatc

SEQ ID NO: 846768 - DNA, 16 bp, Homo sapiens
tctatgtctgccttcg

SEQ ID NO: 846769 - DNA, 18 bp, Homo sapiens
tctatgtgtttctgtaac

SEQ ID NO: 846770 - DNA, 21 bp, Homo sapiens
tctatgttcaaagactgtgaa

SEQ ID NO: 846771 - DNA, 15 bp, Homo sapiens
tctatgttggtttca

SEQ ID NO: 846772 - DNA, 18 bp, Homo sapiens
tctatgtttgtatttgga

SEQ ID NO: 846773 - DNA, 13 bp, Homo sapiens
tctatgtttgtgt

SEQ ID NO: 846774 - DNA, 21 bp, Homo sapiens
tctatgtttgtgtgatttcct

SEQ ID NO: 846775 - DNA, 15 bp, Homo sapiens
tctattaaagtgact

SEQ ID NO: 846776 - DNA, 18 bp, Homo sapiens
tctattaagatttccaag

SEQ ID NO: 846777 - DNA, 22 bp, Homo sapiens
tctattaatatcaactctgaag

SEQ ID NO: 846778 - DNA, 23 bp, Homo sapiens
tctattaatcaagagaaacttca

SEQ ID NO: 846779 - DNA, 17 bp, Homo sapiens
tctattacattttcagt

SEQ ID NO: 846780 - DNA, 17 bp, Homo sapiens
tctattatggaaaactg

SEQ ID NO: 846781 - DNA, 20 bp, Homo sapiens
tctattatggaaaactgtgt

SEQ ID NO: 846782 - DNA, 15 bp, Homo sapiens
tctattatggaaata

SEQ ID NO: 846783 - DNA, 20 bp, Homo sapiens
tctattatgttatcatcctc

SEQ ID NO: 846784 - DNA, 13 bp, Homo sapiens
tctattcaaaagg

SEQ ID NO: 846785 - DNA, 18 bp, Homo sapiens
tctattccttatgggatc

SEQ ID NO: 846786 - DNA, 13 bp, Homo sapiens
tctattctgagcc

SEQ ID NO: 846787 - DNA, 16 bp, Homo sapiens
tctattctgagccttg

SEQ ID NO: 846788 - DNA, 16 bp, Homo sapiens
tctattgatgtacagt

SEQ ID NO: 846789 - DNA, 20 bp, Homo sapiens
tctattgatgtacagtctgt

SEQ ID NO: 846790 - DNA, 15 bp, Homo sapiens
tctattgcagagact

SEQ ID NO: 846791 - DNA, 23 bp, Homo sapiens
tctattgcagttatagaaaatct

SEQ ID NO: 846792 - DNA, 16 bp, Homo sapiens
tctattgcttcaccat

SEQ ID NO: 846793 - DNA, 16 bp, Homo sapiens
tctattgggttcatta

SEQ ID NO: 846794 - DNA, 17 bp, Homo sapiens
tctattgggttcattat

SEQ ID NO: 846795 - DNA, 18 bp, Homo sapiens
tctattgggttcattatt

SEQ ID NO: 846796 - DNA, 12 bp, Homo sapiens
tctattggtctc

SEQ ID NO: 846797 - DNA, 18 bp, Homo sapiens
tctattgtagcatttctt

SEQ ID NO: 846798 - DNA, 19 bp, Homo sapiens
tctattgtagcatttcttg

SEQ ID NO: 846799 - DNA, 21 bp, Homo sapiens
tctattgtgtggatgaccaca

SEQ ID NO: 846800 - DNA, 16 bp, Homo sapiens
tctattgtttattctt

SEQ ID NO: 846801 - DNA, 15 bp, Homo sapiens
tctatttaagtaaaa

SEQ ID NO: 846802 - DNA, 13 bp, Homo sapiens
tctatttaatatt

SEQ ID NO: 846803 - DNA, 23 bp, Homo sapiens
tctatttaattttgacactgaaa

SEQ ID NO: 846804 - DNA, 18 bp, Homo sapiens
tctatttccactgaacaa

SEQ ID NO: 846805 - DNA, 19 bp, Homo sapiens
tctatttccactgaacaaa

SEQ ID NO: 846806 - DNA, 20 bp, Homo sapiens
tctatttccactgaacaaaa

SEQ ID NO: 846807 - DNA, 21 bp, Homo sapiens
tctatttcccctcttctgcta

SEQ ID NO: 846808 - DNA, 17 bp, Homo sapiens
tctatttctatgagaaa

SEQ ID NO: 846809 - DNA, 15 bp, Homo sapiens
tctatttctctgtgt

SEQ ID NO: 846810 - DNA, 16 bp, Homo sapiens
tctatttctctgtgta

SEQ ID NO: 846811 - DNA, 12 bp, Homo sapiens
tctatttgtaca

SEQ ID NO: 846812 - DNA, 14 bp, Homo sapiens
tctatttgtacaat

SEQ ID NO: 846813 - DNA, 22 bp, Homo sapiens
tctatttgtacaattttaaagt

SEQ ID NO: 846814 - DNA, 12 bp, Homo sapiens
tctattttaaga

SEQ ID NO: 846815 - DNA, 23 bp, Homo sapiens
tctattttaatgtatatttgctg

SEQ ID NO: 846816 - DNA, 15 bp, Homo sapiens
tctattttaattact

SEQ ID NO: 846817 - DNA, 14 bp, Homo sapiens
tctattttagaata

SEQ ID NO: 846818 - DNA, 17 bp, Homo sapiens
tctattttgtaaactca

SEQ ID NO: 846819 - DNA, 15 bp, Homo sapiens
tctattttgtatatt

SEQ ID NO: 846820 - DNA, 16 bp, Homo sapiens
tctatttttacattta

SEQ ID NO: 846821 - DNA, 20 bp, Homo sapiens
tctatttttatcatgaattc

SEQ ID NO: 846822 - DNA, 15 bp, Homo sapiens
tctatttttatctga

SEQ ID NO: 846823 - DNA, 18 bp, Homo sapiens
tctatttttttaactgaa

SEQ ID NO: 846824 - DNA, 19 bp, Homo sapiens
tctatttttttaactgaaa

SEQ ID NO: 846825 - DNA, 16 bp, Homo sapiens
tctcaaaaaaagaaaa

SEQ ID NO: 846826 - DNA, 13 bp, Homo sapiens
tctcaaaaaataa

SEQ ID NO: 846827 - DNA, 16 bp, Homo sapiens
tctcaaaacagagggc

SEQ ID NO: 846828 - DNA, 18 bp, Homo sapiens
tctcaaaagtctattttt

SEQ ID NO: 846829 - DNA, 22 bp, Homo sapiens
tctcaaacacagttacacttgt

SEQ ID NO: 846830 - DNA, 23 bp, Homo sapiens
tctcaaacacagttacacttgtg

SEQ ID NO: 846831 - DNA, 14 bp, Homo sapiens
tctcaaactggggc

SEQ ID NO: 846832 - DNA, 18 bp, Homo sapiens
tctcaaacttgtggcctc

SEQ ID NO: 846833 - DNA, 19 bp, Homo sapiens
tctcaaagagggggctctg

SEQ ID NO: 846834 - DNA, 23 bp, Homo sapiens
tctcaaagatgcgtttgcctcct

SEQ ID NO: 846835 - DNA, 21 bp, Homo sapiens
tctcaaaggagctttctcaat

SEQ ID NO: 846836 - DNA, 18 bp, Homo sapiens
tctcaaagtataatcttt

SEQ ID NO: 846837 - DNA, 11 bp, Homo sapiens
tctcaaagtta

SEQ ID NO: 846838 - DNA, 17 bp, Homo sapiens
tctcaaataactaaaag

SEQ ID NO: 846839 - DNA, 20 bp, Homo sapiens
tctcaaataggctattaaaa

SEQ ID NO: 846840 - DNA, 21 bp, Homo sapiens
tctcaaattgtacttgtggga

SEQ ID NO: 846841 - DNA, 23 bp, Homo sapiens
tctcaacagaattaaaatgtcta

SEQ ID NO: 846842 - DNA, 19 bp, Homo sapiens
tctcaacatgtgtttctga

SEQ ID NO: 846843 - DNA, 21 bp, Homo sapiens
tctcaacctaccaccccttcc

SEQ ID NO: 846844 - DNA, 16 bp, Homo sapiens
tctcaacgcctctcct

SEQ ID NO: 846845 - DNA, 20 bp, Homo sapiens
tctcaacggaagccccctct

SEQ ID NO: 846846 - DNA, 15 bp, Homo sapiens
tctcaagaatctaga

SEQ ID NO: 846847 - DNA, 17 bp, Homo sapiens
tctcaagaatctagaag

SEQ ID NO: 846848 - DNA, 18 bp, Homo sapiens
tctcaagagggcactggt

SEQ ID NO: 846849 - DNA, 19 bp, Homo sapiens
tctcaagagggcactggtg

SEQ ID NO: 846850 - DNA, 14 bp, Homo sapiens
tctcaagccagccc

SEQ ID NO: 846851 - DNA, 22 bp, Homo sapiens
tctcaagccagccccctccagc

SEQ ID NO: 846852 - DNA, 15 bp, Homo sapiens
tctcaagctaagtaa

SEQ ID NO: 846853 - DNA, 20 bp, Homo sapiens
tctcaaggtgggccttgcta

SEQ ID NO: 846854 - DNA, 20 bp, Homo sapiens
tctcaagtgttttggagaaa

SEQ ID NO: 846855 - DNA, 21 bp, Homo sapiens
tctcaatacttgaatatggaa

SEQ ID NO: 846856 - DNA, 13 bp, Homo sapiens
tctcaatcagtgc

SEQ ID NO: 846857 - DNA, 14 bp, Homo sapiens
tctcaatcagtgca

SEQ ID NO: 846858 - DNA, 13 bp, Homo sapiens
tctcaatgaaaaa

SEQ ID NO: 846859 - DNA, 14 bp, Homo sapiens
tctcaatgaaaaat

SEQ ID NO: 846860 - DNA, 13 bp, Homo sapiens
tctcaatgaaata

SEQ ID NO: 846861 - DNA, 17 bp, Homo sapiens
tctcaatgaagccagct

SEQ ID NO: 846862 - DNA, 22 bp, Homo sapiens
tctcacaaaaaggcaaatattg

SEQ ID NO: 846863 - DNA, 24 bp, Homo sapiens
tctcacacatcacattcccatggt

SEQ ID NO: 846864 - DNA, 19 bp, Homo sapiens
tctcacactggttctcaat

SEQ ID NO: 846865 - DNA, 20 bp, Homo sapiens
tctcacactggttctcaatg

SEQ ID NO: 846866 - DNA, 16 bp, Homo sapiens
tctcacagatgtgact

SEQ ID NO: 846867 - DNA, 19 bp, Homo sapiens
tctcacaggctgagaactc

SEQ ID NO: 846868 - DNA, 19 bp, Homo sapiens
tctcacatccatctacttt

SEQ ID NO: 846869 - DNA, 14 bp, Homo sapiens
tctcacatgtggca

SEQ ID NO: 846870 - DNA, 17 bp, Homo sapiens
tctcaccacgggaaagc

SEQ ID NO: 846871 - DNA, 13 bp, Homo sapiens
tctcacccaccag

SEQ ID NO: 846872 - DNA, 17 bp, Homo sapiens
tctcacccaccagctcc

SEQ ID NO: 846873 - DNA, 18 bp, Homo sapiens
tctcacccaccagctcca

SEQ ID NO: 846874 - DNA, 17 bp, Homo sapiens
tctcaccccatcccaca

SEQ ID NO: 846875 - DNA, 19 bp, Homo sapiens
tctcaccccatcccacacc

SEQ ID NO: 846876 - DNA, 19 bp, Homo sapiens
tctcacccccatccctggg

SEQ ID NO: 846877 - DNA, 14 bp, Homo sapiens
tctcaccggctctc

SEQ ID NO: 846878 - DNA, 23 bp, Homo sapiens
tctcacctggaggcaagagggag

SEQ ID NO: 846879 - DNA, 19 bp, Homo sapiens
tctcacctggccctgcttc

SEQ ID NO: 846880 - DNA, 16 bp, Homo sapiens
tctcaccttccaaatc

SEQ ID NO: 846881 - DNA, 23 bp, Homo sapiens
tctcaccttgagcccacccccac

SEQ ID NO: 846882 - DNA, 14 bp, Homo sapiens
tctcacgccacccc

SEQ ID NO: 846883 - DNA, 15 bp, Homo sapiens
tctcacgggccctgc

SEQ ID NO: 846884 - DNA, 14 bp, Homo sapiens
tctcactaaatctt

SEQ ID NO: 846885 - DNA, 15 bp, Homo sapiens
tctcactagtgccaa

SEQ ID NO: 846886 - DNA, 14 bp, Homo sapiens
tctcactccaccac

SEQ ID NO: 846887 - DNA, 15 bp, Homo sapiens
tctcactccaccacc

SEQ ID NO: 846888 - DNA, 14 bp, Homo sapiens
tctcactccagcca

SEQ ID NO: 846889 - DNA, 18 bp, Homo sapiens
tctcactccagccaaaga

SEQ ID NO: 846890 - DNA, 15 bp, Homo sapiens
tctcactccccatgc

SEQ ID NO: 846891 - DNA, 16 bp, Homo sapiens
tctcactcctacctgg

SEQ ID NO: 846892 - DNA, 15 bp, Homo sapiens
tctcactcctaggag

SEQ ID NO: 846893 - DNA, 14 bp, Homo sapiens
tctcactcctgaat

SEQ ID NO: 846894 - DNA, 20 bp, Homo sapiens
tctcactctctggggaagtc

SEQ ID NO: 846895 - DNA, 14 bp, Homo sapiens
tctcactgaactcc

SEQ ID NO: 846896 - DNA, 20 bp, Homo sapiens
tctcactgccatgccagctt

SEQ ID NO: 846897 - DNA, 20 bp, Homo sapiens
tctcactgtgttactgcttt

SEQ ID NO: 846898 - DNA, 18 bp, Homo sapiens
tctcacttataccaaagg

SEQ ID NO: 846899 - DNA, 13 bp, Homo sapiens
tctcacttccaga

SEQ ID NO: 846900 - DNA, 13 bp, Homo sapiens
tctcacttctaaa

SEQ ID NO: 846901 - DNA, 17 bp, Homo sapiens
tctcagaaagtgcctga

SEQ ID NO: 846902 - DNA, 12 bp, Homo sapiens
tctcagaacctt

SEQ ID NO: 846903 - DNA, 14 bp, Homo sapiens
tctcagaagcacag

SEQ ID NO: 846904 - DNA, 16 bp, Homo sapiens
tctcagaagcacagaa

SEQ ID NO: 846905 - DNA, 19 bp, Homo sapiens
tctcagaaggtattccttt

SEQ ID NO: 846906 - DNA, 12 bp, Homo sapiens
tctcagaatcta

SEQ ID NO: 846907 - DNA, 20 bp, Homo sapiens
tctcagaatctacccaaagg

SEQ ID NO: 846908 - DNA, 21 bp, Homo sapiens
tctcagaatctcaaataacta

SEQ ID NO: 846909 - DNA, 16 bp, Homo sapiens
tctcagaatgttggca

SEQ ID NO: 846910 - DNA, 15 bp, Homo sapiens
tctcagaatttatct

SEQ ID NO: 846911 - DNA, 21 bp, Homo sapiens
tctcagacactaaatgcagac

SEQ ID NO: 846912 - DNA, 16 bp, Homo sapiens
tctcagacctttactg

SEQ ID NO: 846913 - DNA, 14 bp, Homo sapiens
tctcagacgacacc

SEQ ID NO: 846914 - DNA, 15 bp, Homo sapiens
tctcagacgacacct

SEQ ID NO: 846915 - DNA, 14 bp, Homo sapiens
tctcagagaccagc

SEQ ID NO: 846916 - DNA, 15 bp, Homo sapiens
tctcagagaccagca

SEQ ID NO: 846917 - DNA, 14 bp, Homo sapiens
tctcagagcagcag

SEQ ID NO: 846918 - DNA, 14 bp, Homo sapiens
tctcagagccaagt

SEQ ID NO: 846919 - DNA, 12 bp, Homo sapiens
tctcagagcctt

SEQ ID NO: 846920 - DNA, 17 bp, Homo sapiens
tctcagatacttatgaa

SEQ ID NO: 846921 - DNA, 14 bp, Homo sapiens
tctcagatatttat

SEQ ID NO: 846922 - DNA, 16 bp, Homo sapiens
tctcagatatttatat

SEQ ID NO: 846923 - DNA, 20 bp, Homo sapiens
tctcagatatttatattttt

SEQ ID NO: 846924 - DNA, 15 bp, Homo sapiens
tctcagatcttgaca

SEQ ID NO: 846925 - DNA, 15 bp, Homo sapiens
tctcagatgcagttt

SEQ ID NO: 846926 - DNA, 18 bp, Homo sapiens
tctcagatgccccaaagt

SEQ ID NO: 846927 - DNA, 14 bp, Homo sapiens
tctcagatgttaaa

SEQ ID NO: 846928 - DNA, 19 bp, Homo sapiens
tctcagattttaaggggga

SEQ ID NO: 846929 - DNA, 14 bp, Homo sapiens
tctcagcaaagcta

SEQ ID NO: 846930 - DNA, 23 bp, Homo sapiens
tctcagcaaagctacaggactgg

SEQ ID NO: 846931 - DNA, 15 bp, Homo sapiens
tctcagcatagcctg

SEQ ID NO: 846932 - DNA, 19 bp, Homo sapiens
tctcagcatagcctgcctg

SEQ ID NO: 846933 - DNA, 14 bp, Homo sapiens
tctcagcctcccac

SEQ ID NO: 846934 - DNA, 15 bp, Homo sapiens
tctcagcctcccaca

SEQ ID NO: 846935 - DNA, 12 bp, Homo sapiens
tctcagcctcct

SEQ ID NO: 846936 - DNA, 14 bp, Homo sapiens
tctcagctgaaatt

SEQ ID NO: 846937 - DNA, 19 bp, Homo sapiens
tctcagctggcagtgcaat

SEQ ID NO: 846938 - DNA, 19 bp, Homo sapiens
tctcagctttgagaagcct

SEQ ID NO: 846939 - DNA, 12 bp, Homo sapiens
tctcaggaagag

SEQ ID NO: 846940 - DNA, 22 bp, Homo sapiens
tctcaggacagcatcccttccc

SEQ ID NO: 846941 - DNA, 23 bp, Homo sapiens
tctcaggacagcatcccttccca

SEQ ID NO: 846942 - DNA, 18 bp, Homo sapiens
tctcaggagagtgtgcaa

SEQ ID NO: 846943 - DNA, 20 bp, Homo sapiens
tctcaggagagtgtgcaact

SEQ ID NO: 846944 - DNA, 23 bp, Homo sapiens
tctcaggagcacaggcagctgga

SEQ ID NO: 846945 - DNA, 20 bp, Homo sapiens
tctcaggatcaagaaagtgt

SEQ ID NO: 846946 - DNA, 11 bp, Homo sapiens
tctcaggcagc

SEQ ID NO: 846947 - DNA, 13 bp, Homo sapiens
tctcaggccacct

SEQ ID NO: 846948 - DNA, 18 bp, Homo sapiens
tctcaggccacctgcccc

SEQ ID NO: 846949 - DNA, 19 bp, Homo sapiens
tctcaggccacctgccccc

SEQ ID NO: 846950 - DNA, 11 bp, Homo sapiens
tctcagggcag

SEQ ID NO: 846951 - DNA, 12 bp, Homo sapiens
tctcagggcaga

SEQ ID NO: 846952 - DNA, 13 bp, Homo sapiens
tctcagggcctgg

SEQ ID NO: 846953 - DNA, 11 bp, Homo sapiens
tctcagggctg

SEQ ID NO: 846954 - DNA, 17 bp, Homo sapiens
tctcaggggccagagga

SEQ ID NO: 846955 - DNA, 22 bp, Homo sapiens
tctcaggggccagtgagggctg

SEQ ID NO: 846956 - DNA, 17 bp, Homo sapiens
tctcaggggctgtttga

SEQ ID NO: 846957 - DNA, 20 bp, Homo sapiens
tctcagggggtcagcagagt

SEQ ID NO: 846958 - DNA, 20 bp, Homo sapiens
tctcagggtcactgtccttg

SEQ ID NO: 846959 - DNA, 19 bp, Homo sapiens
tctcaggtgacgtgattct

SEQ ID NO: 846960 - DNA, 17 bp, Homo sapiens
tctcaggtgccactccc

SEQ ID NO: 846961 - DNA, 16 bp, Homo sapiens
tctcaggttcaagtgg

SEQ ID NO: 846962 - DNA, 22 bp, Homo sapiens
tctcaggttggcggcagacaca

SEQ ID NO: 846963 - DNA, 17 bp, Homo sapiens
tctcagtactttggagg

SEQ ID NO: 846964 - DNA, 13 bp, Homo sapiens
tctcagtctctga

SEQ ID NO: 846965 - DNA, 16 bp, Homo sapiens
tctcagtgaagactat

SEQ ID NO: 846966 - DNA, 20 bp, Homo sapiens
tctcagtgaagactatgaaa

SEQ ID NO: 846967 - DNA, 23 bp, Homo sapiens
tctcagtgcttcttactattaag

SEQ ID NO: 846968 - DNA, 13 bp, Homo sapiens
tctcagtgctttc

SEQ ID NO: 846969 - DNA, 18 bp, Homo sapiens
tctcagtgttgagccttt

SEQ ID NO: 846970 - DNA, 22 bp, Homo sapiens
tctcagtgttgagccttttccc

SEQ ID NO: 846971 - DNA, 16 bp, Homo sapiens
tctcagttctctccct

SEQ ID NO: 846972 - DNA, 16 bp, Homo sapiens
tctcagtttgtgtgtc

SEQ ID NO: 846973 - DNA, 16 bp, Homo sapiens
tctcagttttcataag

SEQ ID NO: 846974 - DNA, 15 bp, Homo sapiens
tctcataaaactgtg

SEQ ID NO: 846975 - DNA, 13 bp, Homo sapiens
tctcataaatctt

SEQ ID NO: 846976 - DNA, 17 bp, Homo sapiens
tctcataatgaagacat

SEQ ID NO: 846977 - DNA, 20 bp, Homo sapiens
tctcataattcctacagcac

SEQ ID NO: 846978 - DNA, 20 bp, Homo sapiens
tctcatagcattaactaatc

SEQ ID NO: 846979 - DNA, 19 bp, Homo sapiens
tctccctgcagccttttct

SEQ ID NO: 846980 - DNA, 19 bp, Homo sapiens
tctccctgcatcctgaggc

SEQ ID NO: 846981 - DNA, 21 bp, Homo sapiens
tctccctgccatccccctctc

SEQ ID NO: 846982 - DNA, 15 bp, Homo sapiens
tctccctgccgcctc

SEQ ID NO: 846983 - DNA, 12 bp, Homo sapiens
tctccctgcctg

SEQ ID NO: 846984 - DNA, 16 bp, Homo sapiens
tctccctgcctggccc

SEQ ID NO: 846985 - DNA, 13 bp, Homo sapiens
tctccctgccttt

SEQ ID NO: 846986 - DNA, 10 bp, Homo sapiens
tctccctgga

SEQ ID NO: 846987 - DNA, 20 bp, Homo sapiens
tctccctggccacccttggc

SEQ ID NO: 846988 - DNA, 22 bp, Homo sapiens
tctccctggccacccttggcct

SEQ ID NO: 846989 - DNA, 15 bp, Homo sapiens
tctccctggctccct

SEQ ID NO: 846990 - DNA, 13 bp, Homo sapiens
tctccctgggcct

SEQ ID NO: 846991 - DNA, 18 bp, Homo sapiens
tctccctggttgcctctc

SEQ ID NO: 846992 - DNA, 19 bp, Homo sapiens
tctccctggttgcctctct

SEQ ID NO: 846993 - DNA, 18 bp, Homo sapiens
tctccctgtacagtgtta

SEQ ID NO: 846994 - DNA, 18 bp, Homo sapiens
tctccctgtcacacactg

SEQ ID NO: 846995 - DNA, 19 bp, Homo sapiens
tctccctgtcacacactgg

SEQ ID NO: 846996 - DNA, 20 bp, Homo sapiens
tctccctgtcacacactgga

SEQ ID NO: 846997 - DNA, 19 bp, Homo sapiens
tctccctgtgttacccagg

SEQ ID NO: 846998 - DNA, 13 bp, Homo sapiens
tctccctgtgttc

SEQ ID NO: 846999 - DNA, 16 bp, Homo sapiens
tctcccttccctcctc

SEQ ID NO: 847000 - DNA, 12 bp, Homo sapiens
tctcccttcttg

SEQ ID NO: 847001 - DNA, 19 bp, Homo sapiens
tctcccttcttgggtaggg

SEQ ID NO: 847002 - DNA, 13 bp, Homo sapiens
tctcccttgaggg

SEQ ID NO: 847003 - DNA, 16 bp, Homo sapiens
tctcccttgtcctgct

SEQ ID NO: 847004 - DNA, 20 bp, Homo sapiens
tctcccttgtcctgcttggg

SEQ ID NO: 847005 - DNA, 15 bp, Homo sapiens
tctccctttctctct

SEQ ID NO: 847006 - DNA, 19 bp, Homo sapiens
tctccctttctctctcctc

SEQ ID NO: 847007 - DNA, 17 bp, Homo sapiens
tctccgactgctaggga

SEQ ID NO: 847008 - DNA, 17 bp, Homo sapiens
tctccgacttcccctgg

SEQ ID NO: 847009 - DNA, 18 bp, Homo sapiens
tctccgcgggagacccct

SEQ ID NO: 847010 - DNA, 17 bp, Homo sapiens
tctccggggtctgtgct

SEQ ID NO: 847011 - DNA, 21 bp, Homo sapiens
tctccggggtctgtgctgtgc

SEQ ID NO: 847012 - DNA, 22 bp, Homo sapiens
tctccggggtctgtgctgtgcc

SEQ ID NO: 847013 - DNA, 24 bp, Homo sapiens
tctccggggtggccacaggctaga

SEQ ID NO: 847014 - DNA, 17 bp, Homo sapiens
tctccgggtgtggcctc

SEQ ID NO: 847015 - DNA, 19 bp, Homo sapiens
tctccgggtgtggcctcag

SEQ ID NO: 847016 - DNA, 20 bp, Homo sapiens
tctccgttagctcctgtggc

SEQ ID NO: 847017 - DNA, 23 bp, Homo sapiens
tctccgttagctcctgtggcccc

SEQ ID NO: 847018 - DNA, 13 bp, Homo sapiens
tctcctagcccct

SEQ ID NO: 847019 - DNA, 18 bp, Homo sapiens
tctcctataatctgtcaa

SEQ ID NO: 847020 - DNA, 18 bp, Homo sapiens
tctcctatatatttctat

SEQ ID NO: 847021 - DNA, 23 bp, Homo sapiens
tctcctatatatttctattatta

SEQ ID NO: 847022 - DNA, 14 bp, Homo sapiens
tctcctcaagcctg

SEQ ID NO: 847023 - DNA, 17 bp, Homo sapiens
tctcctcactctgtccc

SEQ ID NO: 847024 - DNA, 15 bp, Homo sapiens
tctcctcactgtatc

SEQ ID NO: 847025 - DNA, 12 bp, Homo sapiens
tctcctcaggac

SEQ ID NO: 847026 - DNA, 14 bp, Homo sapiens
tctcctcaggacaa

SEQ ID NO: 847027 - DNA, 16 bp, Homo sapiens
tctcctcaggaccctc

SEQ ID NO: 847028 - DNA, 22 bp, Homo sapiens
tctcctcaggaccctcagccct

SEQ ID NO: 847029 - DNA, 17 bp, Homo sapiens
tctcctcagggtggggg

SEQ ID NO: 847030 - DNA, 15 bp, Homo sapiens
tctcctcagtttctc

SEQ ID NO: 847031 - DNA, 14 bp, Homo sapiens
tctcctcatccatt

SEQ ID NO: 847032 - DNA, 23 bp, Homo sapiens
tctcctccaagacactgtggact

SEQ ID NO: 847033 - DNA, 18 bp, Homo sapiens
tctcctccaatgtcctga

SEQ ID NO: 847034 - DNA, 12 bp, Homo sapiens
tctcctcccagc

SEQ ID NO: 847035 - DNA, 20 bp, Homo sapiens
tctcctcccagcggcctccg

SEQ ID NO: 847036 - DNA, 13 bp, Homo sapiens
tctcctcccagct

SEQ ID NO: 847037 - DNA, 14 bp, Homo sapiens
tctcctccccttcc

SEQ ID NO: 847038 - DNA, 11 bp, Homo sapiens
tctcctccctc

SEQ ID NO: 847039 - DNA, 13 bp, Homo sapiens
tctcctccctgtt

SEQ ID NO: 847040 - DNA, 14 bp, Homo sapiens
tctcctcccttcct

SEQ ID NO: 847041 - DNA, 12 bp, Homo sapiens
tctcctcctccc

SEQ ID NO: 847042 - DNA, 13 bp, Homo sapiens
tctcctcgagccc

SEQ ID NO: 847043 - DNA, 16 bp, Homo sapiens
tctcctcgagccctcc

SEQ ID NO: 847044 - DNA, 18 bp, Homo sapiens
tctcctcgagccctcccc

SEQ ID NO: 847045 - DNA, 20 bp, Homo sapiens
tctcctcgagccctccccca

SEQ ID NO: 847046 - DNA, 9 bp, Homo sapiens
tctcctctc

SEQ ID NO: 847047 - DNA, 16 bp, Homo sapiens
tctcctctcagagtga

SEQ ID NO: 847048 - DNA, 11 bp, Homo sapiens
tctcctctctg

SEQ ID NO: 847049 - DNA, 20 bp, Homo sapiens
tctcctctgctatgcatttt

SEQ ID NO: 847050 - DNA, 22 bp, Homo sapiens
tctcctctgctatgcattttct

SEQ ID NO: 847051 - DNA, 21 bp, Homo sapiens
tctcctctgctcattaaactg

SEQ ID NO: 847052 - DNA, 13 bp, Homo sapiens
tctcctctgcttc

SEQ ID NO: 847053 - DNA, 23 bp, Homo sapiens
tctcctcttaaaaaataaaaact

SEQ ID NO: 847054 - DNA, 21 bp, Homo sapiens
tctcctcttgtaaataaagcc

SEQ ID NO: 847055 - DNA, 23 bp, Homo sapiens
tctcctcttgtaaataaagccct

SEQ ID NO: 847056 - DNA, 17 bp, Homo sapiens
tctcctgaagttcagcc

SEQ ID NO: 847057 - DNA, 17 bp, Homo sapiens
tctcctgacccagtccc

SEQ ID NO: 847058 - DNA, 15 bp, Homo sapiens
tctcctgacccctgc

SEQ ID NO: 847059 - DNA, 21 bp, Homo sapiens
tctcctgaccctcccactccc

SEQ ID NO: 847060 - DNA, 14 bp, Homo sapiens
tctcctgactttta

SEQ ID NO: 847061 - DNA, 14 bp, Homo sapiens
tctcctgagctagg

SEQ ID NO: 847062 - DNA, 17 bp, Homo sapiens
tctcctgatttctctga

SEQ ID NO: 847063 - DNA, 14 bp, Homo sapiens
tctcctgccctctg

SEQ ID NO: 847064 - DNA, 21 bp, Homo sapiens
tctcctgccctctgctctgcc

SEQ ID NO: 847065 - DNA, 11 bp, Homo sapiens
tctcctgccta

SEQ ID NO: 847066 - DNA, 15 bp, Homo sapiens
tctcctgcctactca

SEQ ID NO: 847067 - DNA, 13 bp, Homo sapiens
tctcctgcctgta

SEQ ID NO: 847068 - DNA, 22 bp, Homo sapiens
tctcctgctgatttcactttgg

SEQ ID NO: 847069 - DNA, 13 bp, Homo sapiens
tctcctgctgcct

SEQ ID NO: 847070 - DNA, 17 bp, Homo sapiens
tctcctgctgccttttc

SEQ ID NO: 847071 - DNA, 18 bp, Homo sapiens
tctcctgctgctcctgtt

SEQ ID NO: 847072 - DNA, 21 bp, Homo sapiens
tctcctggaaatattaagaaa

SEQ ID NO: 847073 - DNA, 12 bp, Homo sapiens
tctcctggacct

SEQ ID NO: 847074 - DNA, 24 bp, Homo sapiens
tctcctggaccttgacagagcagc

SEQ ID NO: 847075 - DNA, 20 bp, Homo sapiens
tctcctggagatagctgggg

SEQ ID NO: 847076 - DNA, 22 bp, Homo sapiens
tctcctggagatagctggggct

SEQ ID NO: 847077 - DNA, 19 bp, Homo sapiens
tctcctgtacctcttgagc

SEQ ID NO: 847078 - DNA, 14 bp, Homo sapiens
tctcctgtccaacc

SEQ ID NO: 847079 - DNA, 16 bp, Homo sapiens
tctcctgtctgccctc

SEQ ID NO: 847080 - DNA, 12 bp, Homo sapiens
tctcctgtgaat

SEQ ID NO: 847081 - DNA, 23 bp, Homo sapiens
tctcctgtgaatggaggcagaga

SEQ ID NO: 847082 - DNA, 18 bp, Homo sapiens
tctcctgtgcccacatcc

SEQ ID NO: 847083 - DNA, 17 bp, Homo sapiens
tctcctgtgtgcttgtc

SEQ ID NO: 847084 - DNA, 14 bp, Homo sapiens
tctcctgtttttct

SEQ ID NO: 847085 - DNA, 20 bp, Homo sapiens
tctccttactctgagcccag

SEQ ID NO: 847086 - DNA, 23 bp, Homo sapiens
tctccttactctgagcccaggcc

SEQ ID NO: 847087 - DNA, 18 bp, Homo sapiens
tctccttagtcttctcat

SEQ ID NO: 847088 - DNA, 19 bp, Homo sapiens
tctccttagtcttctcata

SEQ ID NO: 847089 - DNA, 22 bp, Homo sapiens
tctccttccacaatgactgctt

SEQ ID NO: 847090 - DNA, 13 bp, Homo sapiens
tctccttcccaga

SEQ ID NO: 847091 - DNA, 18 bp, Homo sapiens
tctccttccccatttcca

SEQ ID NO: 847092 - DNA, 19 bp, Homo sapiens
tctccttccccatttccac

SEQ ID NO: 847093 - DNA, 18 bp, Homo sapiens
tctccttcccctacacct

SEQ ID NO: 847094 - DNA, 18 bp, Homo sapiens
tctccttcgtatcccgag

SEQ ID NO: 847095 - DNA, 23 bp, Homo sapiens
tctccttcgtatcccgagtctgg

SEQ ID NO: 847096 - DNA, 20 bp, Homo sapiens
tctccttcgtgtctctccca

SEQ ID NO: 847097 - DNA, 19 bp, Homo sapiens
tctccttctaaaaacttct

SEQ ID NO: 847098 - DNA, 19 bp, Homo sapiens
tctccttgaagcaaatgtg

SEQ ID NO: 847099 - DNA, 20 bp, Homo sapiens
tctccttgaagcaaatgtgt

SEQ ID NO: 847100 - DNA, 21 bp, Homo sapiens
tctccttgaagcaaatgtgtg

SEQ ID NO: 847101 - DNA, 22 bp, Homo sapiens
tctccttgccccccgccctcat

SEQ ID NO: 847102 - DNA, 17 bp, Homo sapiens
tctccttgggctgggac

SEQ ID NO: 847103 - DNA, 17 bp, Homo sapiens
tctccttggttatattt

SEQ ID NO: 847104 - DNA, 13 bp, Homo sapiens
tctccttgtgtta

SEQ ID NO: 847105 - DNA, 12 bp, Homo sapiens
tctcctttacca

SEQ ID NO: 847106 - DNA, 16 bp, Homo sapiens
tctcctttctccctgc

SEQ ID NO: 847107 - DNA, 16 bp, Homo sapiens
tctcctttctgactgt

SEQ ID NO: 847108 - DNA, 20 bp, Homo sapiens
tctcctttctgactgtccct

SEQ ID NO: 847109 - DNA, 20 bp, Homo sapiens
tctcctttctttttcttctt

SEQ ID NO: 847110 - DNA, 21 bp, Homo sapiens
tctcctttgcactgagggcca

SEQ ID NO: 847111 - DNA, 22 bp, Homo sapiens
tctcctttgcactgagggccac

SEQ ID NO: 847112 - DNA, 21 bp, Homo sapiens
tctccttttatctggtgcctc

SEQ ID NO: 847113 - DNA, 17 bp, Homo sapiens
tctccttttcctctctc

SEQ ID NO: 847114 - DNA, 19 bp, Homo sapiens
tctccttttcctctctccc

SEQ ID NO: 847115 - DNA, 15 bp, Homo sapiens
tctccttttgaggct

SEQ ID NO: 847116 - DNA, 23 bp, Homo sapiens
tctccttttgaggcttctccttc

SEQ ID NO: 847117 - DNA, 19 bp, Homo sapiens
tctccttttgcgcttattt

SEQ ID NO: 847118 - DNA, 15 bp, Homo sapiens
tctcgaactcctgac

SEQ ID NO: 847119 - DNA, 12 bp, Homo sapiens
tctcgactgctt

SEQ ID NO: 847120 - DNA, 13 bp, Homo sapiens
tctcgagcccaga

SEQ ID NO: 847121 - DNA, 18 bp, Homo sapiens
tctcgagcccagatggaa

SEQ ID NO: 847122 - DNA, 23 bp, Homo sapiens
tctcgagccccctggatgtcccc

SEQ ID NO: 847123 - DNA, 21 bp, Homo sapiens
tctcgcagcctgaagcctgga

SEQ ID NO: 847124 - DNA, 23 bp, Homo sapiens
tctcgcataggacctttccacca

SEQ ID NO: 847125 - DNA, 16 bp, Homo sapiens
tctcgcgccctccccc

SEQ ID NO: 847126 - DNA, 16 bp, Homo sapiens
tctcgcgcgactgaga

SEQ ID NO: 847127 - DNA, 15 bp, Homo sapiens
tctcgcttccctgaa

SEQ ID NO: 847128 - DNA, 17 bp, Homo sapiens
tctcgcttcctcagcct

SEQ ID NO: 847129 - DNA, 20 bp, Homo sapiens
tctcgcttcctcagcctcca

SEQ ID NO: 847130 - DNA, 21 bp, Homo sapiens
tctcgcttcctcagcctccaa

SEQ ID NO: 847131 - DNA, 20 bp, Homo sapiens
tctcggagcatcccggagga

SEQ ID NO: 847132 - DNA, 15 bp, Homo sapiens
tctcggatgaccaaa

SEQ ID NO: 847133 - DNA, 13 bp, Homo sapiens
tctcggccaggca

SEQ ID NO: 847134 - DNA, 17 bp, Homo sapiens
tctcggccccatcgccc

SEQ ID NO: 847135 - DNA, 19 bp, Homo sapiens
tctcggccccctcacccca

SEQ ID NO: 847136 - DNA, 16 bp, Homo sapiens
tctcggcccctctgat

SEQ ID NO: 847137 - DNA, 15 bp, Homo sapiens
tctcggccctgaacc

SEQ ID NO: 847138 - DNA, 20 bp, Homo sapiens
tctcggcttggatcctgggc

SEQ ID NO: 847139 - DNA, 16 bp, Homo sapiens
tctcggggtccagtgc

SEQ ID NO: 847140 - DNA, 17 bp, Homo sapiens
tctcggggtccagtgca

SEQ ID NO: 847141 - DNA, 21 bp, Homo sapiens
tctcgggtgcatttgagagaa

SEQ ID NO: 847142 - DNA, 18 bp, Homo sapiens
tctcgtccccctccctgc

SEQ ID NO: 847143 - DNA, 20 bp, Homo sapiens
tctcgtgagtcatttaaatg

SEQ ID NO: 847144 - DNA, 18 bp, Homo sapiens
tctcgtgggagagccatc

SEQ ID NO: 847145 - DNA, 20 bp, Homo sapiens
tctcgtgtcagtaatttata

SEQ ID NO: 847146 - DNA, 19 bp, Homo sapiens
tctcgtgtttgcttaaaat

SEQ ID NO: 847147 - DNA, 15 bp, Homo sapiens
tctcgttctccttcc

SEQ ID NO: 847148 - DNA, 14 bp, Homo sapiens
tctctaaagtcact

SEQ ID NO: 847149 - DNA, 18 bp, Homo sapiens
tctctaaatcaagtattt

SEQ ID NO: 847150 - DNA, 17 bp, Homo sapiens
tctctaaccattcaaat

SEQ ID NO: 847151 - DNA, 18 bp, Homo sapiens
tctctaaccattcaaatg

SEQ ID NO: 847152 - DNA, 20 bp, Homo sapiens
tctctaactcagaaacatca

SEQ ID NO: 847153 - DNA, 12 bp, Homo sapiens
tctctaacttca

SEQ ID NO: 847154 - DNA, 17 bp, Homo sapiens
tctctaacttctcaagt

SEQ ID NO: 847155 - DNA, 21 bp, Homo sapiens
tctctaagccacagcttcttc

SEQ ID NO: 847156 - DNA, 23 bp, Homo sapiens
tctctaagcctatacgtttctgt

SEQ ID NO: 847157 - DNA, 18 bp, Homo sapiens
tctctaagttccactgag

SEQ ID NO: 847158 - DNA, 22 bp, Homo sapiens
tctctaatagaggcattacttg

SEQ ID NO: 847159 - DNA, 21 bp, Homo sapiens
tctctacaggcctcttcctgt

SEQ ID NO: 847160 - DNA, 20 bp, Homo sapiens
tctctacattaatgtcctct

SEQ ID NO: 847161 - DNA, 19 bp, Homo sapiens
tctctacccatcttaaaaa

SEQ ID NO: 847162 - DNA, 20 bp, Homo sapiens
tctctacccatcttaaaaac

SEQ ID NO: 847163 - DNA, 22 bp, Homo sapiens
tctctactgaatgtcattgaaa

SEQ ID NO: 847164 - DNA, 13 bp, Homo sapiens
tctctagaatttt

SEQ ID NO: 847165 - DNA, 18 bp, Homo sapiens
tctctagagggttgctgc

SEQ ID NO: 847166 - DNA, 20 bp, Homo sapiens
tctctagagggttgctgcct

SEQ ID NO: 847167 - DNA, 23 bp, Homo sapiens
tctctagctccccaattctgcct

SEQ ID NO: 847168 - DNA, 19 bp, Homo sapiens
tctctaggcctctccagtt

SEQ ID NO: 847169 - DNA, 18 bp, Homo sapiens
tctctagtagtgtggcct

SEQ ID NO: 847170 - DNA, 20 bp, Homo sapiens
tctctagtgtagctgccaca

SEQ ID NO: 847171 - DNA, 17 bp, Homo sapiens
tctctagttccacgcct

SEQ ID NO: 847172 - DNA, 15 bp, Homo sapiens
tctctagtttgatta

SEQ ID NO: 847173 - DNA, 16 bp, Homo sapiens
tctctagtttgattaa

SEQ ID NO: 847174 - DNA, 13 bp, Homo sapiens
tctctatgtttat

SEQ ID NO: 847175 - DNA, 17 bp, Homo sapiens
tctctatgtttattcta

SEQ ID NO: 847176 - DNA, 14 bp, Homo sapiens
tctctattaaaatg

SEQ ID NO: 847177 - DNA, 14 bp, Homo sapiens
tctctatttaatat

SEQ ID NO: 847178 - DNA, 17 bp, Homo sapiens
tctctatttaatattta

SEQ ID NO: 847179 - DNA, 15 bp, Homo sapiens
tctctattttcataa

SEQ ID NO: 847180 - DNA, 23 bp, Homo sapiens
tctctattttcataatcagtaaa

SEQ ID NO: 847181 - DNA, 12 bp, Homo sapiens
tctctcacccag

SEQ ID NO: 847182 - DNA, 23 bp, Homo sapiens
tctctcactccctccctttctat

SEQ ID NO: 847183 - DNA, 13 bp, Homo sapiens
tctctcactgtgt

SEQ ID NO: 847184 - DNA, 15 bp, Homo sapiens
tctctcagccagctg

SEQ ID NO: 847185 - DNA, 12 bp, Homo sapiens
tctctcagcccc

SEQ ID NO: 847186 - DNA, 14 bp, Homo sapiens
tctctcagccccat

SEQ ID NO: 847187 - DNA, 13 bp, Homo sapiens
tctctcaggagca

SEQ ID NO: 847188 - DNA, 21 bp, Homo sapiens
tctctcaggagcacaggcagc

SEQ ID NO: 847189 - DNA, 16 bp, Homo sapiens
tctctcaggagtatct

SEQ ID NO: 847190 - DNA, 17 bp, Homo sapiens
tctctcaggagtatctt

SEQ ID NO: 847191 - DNA, 13 bp, Homo sapiens
tctctcatcttgt

SEQ ID NO: 847192 - DNA, 23 bp, Homo sapiens
tctctccagaaacagctgcttct

SEQ ID NO: 847193 - DNA, 14 bp, Homo sapiens
tctctcccaccccg

SEQ ID NO: 847194 - DNA, 19 bp, Homo sapiens
tctctcccatcctggggca

SEQ ID NO: 847195 - DNA, 19 bp, Homo sapiens
tctctccccctctgtcttc

SEQ ID NO: 847196 - DNA, 14 bp, Homo sapiens
tctctcccctcaca

SEQ ID NO: 847197 - DNA, 21 bp, Homo sapiens
tctctcccctcacatcctcct

SEQ ID NO: 847198 - DNA, 22 bp, Homo sapiens
tctctcccctcacatcctcctg

SEQ ID NO: 847199 - DNA, 19 bp, Homo sapiens
tctctccctacctccctcc

SEQ ID NO: 847200 - DNA, 20 bp, Homo sapiens
tctctccctacctccctcct

SEQ ID NO: 847201 - DNA, 21 bp, Homo sapiens
tctctccctacctccctcctc

SEQ ID NO: 847202 - DNA, 14 bp, Homo sapiens
tctctccctcccct

SEQ ID NO: 847203 - DNA, 15 bp, Homo sapiens
tctctccctccctct

SEQ ID NO: 847204 - DNA, 19 bp, Homo sapiens
tctctccctccctctctca

SEQ ID NO: 847205 - DNA, 14 bp, Homo sapiens
tctctcccttcctc

SEQ ID NO: 847206 - DNA, 20 bp, Homo sapiens
tctctcccttcctctctcct

SEQ ID NO: 847207 - DNA, 19 bp, Homo sapiens
tctctccgacttcccctgg

SEQ ID NO: 847208 - DNA, 13 bp, Homo sapiens
tctctcctcccca

SEQ ID NO: 847209 - DNA, 11 bp, Homo sapiens
tctctcctctc

SEQ ID NO: 847210 - DNA, 13 bp, Homo sapiens
tctctcctctctg

SEQ ID NO: 847211 - DNA, 12 bp, Homo sapiens
tctctcctggcc

SEQ ID NO: 847212 - DNA, 13 bp, Homo sapiens
tctctcctggcct

SEQ ID NO: 847213 - DNA, 11 bp, Homo sapiens
tctctcctggt

SEQ ID NO: 847214 - DNA, 17 bp, Homo sapiens
tctctcctgtacctctt

SEQ ID NO: 847215 - DNA, 18 bp, Homo sapiens
tctctcggttccacgtcc

SEQ ID NO: 847216 - DNA, 19 bp, Homo sapiens
tctctctactcctacctca

SEQ ID NO: 847217 - DNA, 22 bp, Homo sapiens
tctctctaggagggagccttgt

SEQ ID NO: 847218 - DNA, 21 bp, Homo sapiens
tctctctccagaaacagctgc

SEQ ID NO: 847219 - DNA, 13 bp, Homo sapiens
tctctctccaggg

SEQ ID NO: 847220 - DNA, 11 bp, Homo sapiens
tctctctccct

SEQ ID NO: 847221 - DNA, 12 bp, Homo sapiens
tctctctccctc

SEQ ID NO: 847222 - DNA, 14 bp, Homo sapiens
tctctctccctgcc

SEQ ID NO: 847223 - DNA, 16 bp, Homo sapiens
tctgaaatctgaagac

SEQ ID NO: 847224 - DNA, 13 bp, Homo sapiens
tctgaaattaaag

SEQ ID NO: 847225 - DNA, 17 bp, Homo sapiens
tctgaaattaaagtatg

SEQ ID NO: 847226 - DNA, 22 bp, Homo sapiens
tctgaaattaaagtatgcaaaa

SEQ ID NO: 847227 - DNA, 19 bp, Homo sapiens
tctgaaattcaaaatgctc

SEQ ID NO: 847228 - DNA, 11 bp, Homo sapiens
tctgaacaaag

SEQ ID NO: 847229 - DNA, 20 bp, Homo sapiens
tctgaacacacacgccagct

SEQ ID NO: 847230 - DNA, 23 bp, Homo sapiens
tctgaacacacacgccagctcct

SEQ ID NO: 847231 - DNA, 17 bp, Homo sapiens
tctgaacactttaggta

SEQ ID NO: 847232 - DNA, 21 bp, Homo sapiens
tctgaacccttgtgcttggtg

SEQ ID NO: 847233 - DNA, 21 bp, Homo sapiens
tctgaactcaaactgaggaat

SEQ ID NO: 847234 - DNA, 17 bp, Homo sapiens
tctgaactccatacagc

SEQ ID NO: 847235 - DNA, 20 bp, Homo sapiens
tctgaactccatacagcctc

SEQ ID NO: 847236 - DNA, 18 bp, Homo sapiens
tctgaacttgcattgtga

SEQ ID NO: 847237 - DNA, 19 bp, Homo sapiens
tctgaacttgcattgtgat

SEQ ID NO: 847238 - DNA, 12 bp, Homo sapiens
tctgaacttgcc

SEQ ID NO: 847239 - DNA, 17 bp, Homo sapiens
tctgaacttgccttaaa

SEQ ID NO: 847240 - DNA, 18 bp, Homo sapiens
tctgaagagaccttggct

SEQ ID NO: 847241 - DNA, 24 bp, Homo sapiens
tctgaagagcctgaagctggcctg

SEQ ID NO: 847242 - DNA, 19 bp, Homo sapiens
tctgaagagtatccttcct

SEQ ID NO: 847243 - DNA, 22 bp, Homo sapiens
tctgaagagtgggtttcacaag

SEQ ID NO: 847244 - DNA, 15 bp, Homo sapiens
tctgaagatatattt

SEQ ID NO: 847245 - DNA, 13 bp, Homo sapiens
tctgaagcatgtt

SEQ ID NO: 847246 - DNA, 20 bp, Homo sapiens
tctgaagcatgtttcatgtt

SEQ ID NO: 847247 - DNA, 13 bp, Homo sapiens
tctgaagccatgt

SEQ ID NO: 847248 - DNA, 21 bp, Homo sapiens
tctgaagccatgtagccaccc

SEQ ID NO: 847249 - DNA, 14 bp, Homo sapiens
tctgaagcttgact

SEQ ID NO: 847250 - DNA, 16 bp, Homo sapiens
tctgaagcttgactcc

SEQ ID NO: 847251 - DNA, 17 bp, Homo sapiens
tctgaagcttgactccc

SEQ ID NO: 847252 - DNA, 16 bp, Homo sapiens
tctgaaggaagagaag

SEQ ID NO: 847253 - DNA, 18 bp, Homo sapiens
tctgaaggaatagccaga

SEQ ID NO: 847254 - DNA, 16 bp, Homo sapiens
tctgaaggacacttcc

SEQ ID NO: 847255 - DNA, 18 bp, Homo sapiens
tctgaaggaccccaggta

SEQ ID NO: 847256 - DNA, 19 bp, Homo sapiens
tctgaagtacaaacatgaa

SEQ ID NO: 847257 - DNA, 22 bp, Homo sapiens
tctgaagtatggtattacaaaa

SEQ ID NO: 847258 - DNA, 22 bp, Homo sapiens
tctgaagtcacatcacaggaca

SEQ ID NO: 847259 - DNA, 16 bp, Homo sapiens
tctgaagtcactgcac

SEQ ID NO: 847260 - DNA, 22 bp, Homo sapiens
tctgaagtgggaaaaaatagac

SEQ ID NO: 847261 - DNA, 16 bp, Homo sapiens
tctgaagttggacagc

SEQ ID NO: 847262 - DNA, 16 bp, Homo sapiens
tctgaagtttcattta

SEQ ID NO: 847263 - DNA, 17 bp, Homo sapiens
tctgaagtttcatttat

SEQ ID NO: 847264 - DNA, 18 bp, Homo sapiens
tctgaataaaaaagattc

SEQ ID NO: 847265 - DNA, 16 bp, Homo sapiens
tctgaataacatttgt

SEQ ID NO: 847266 - DNA, 20 bp, Homo sapiens
tctgaatagtgtcaccaatt

SEQ ID NO: 847267 - DNA, 12 bp, Homo sapiens
tctgaatcactg

SEQ ID NO: 847268 - DNA, 19 bp, Homo sapiens
tctgaatcagaaaagctat

SEQ ID NO: 847269 - DNA, 13 bp, Homo sapiens
tctgaatgctgcc

SEQ ID NO: 847270 - DNA, 16 bp, Homo sapiens
tctgaatgctgctact

SEQ ID NO: 847271 - DNA, 22 bp, Homo sapiens
tctgaatgcttctaagtaaata

SEQ ID NO: 847272 - DNA, 16 bp, Homo sapiens
tctgaatgggagccag

SEQ ID NO: 847273 - DNA, 22 bp, Homo sapiens
tctgaatgggagccagaattca

SEQ ID NO: 847274 - DNA, 20 bp, Homo sapiens
tctgaatgggcaattccaga

SEQ ID NO: 847275 - DNA, 13 bp, Homo sapiens
tctgaatggtcca

SEQ ID NO: 847276 - DNA, 13 bp, Homo sapiens
tctgaatgttctg

SEQ ID NO: 847277 - DNA, 17 bp, Homo sapiens
tctgaatgttctgacat

SEQ ID NO: 847278 - DNA, 17 bp, Homo sapiens
tctgaatttttaaacaa

SEQ ID NO: 847279 - DNA, 14 bp, Homo sapiens
tctgacagcagcct

SEQ ID NO: 847280 - DNA, 15 bp, Homo sapiens
tctgacagcagcctg

SEQ ID NO: 847281 - DNA, 12 bp, Homo sapiens
tctgacagccca

SEQ ID NO: 847282 - DNA, 20 bp, Homo sapiens
tctgacagtttttctgtttt

SEQ ID NO: 847283 - DNA, 12 bp, Homo sapiens
tctgacatccct

SEQ ID NO: 847284 - DNA, 16 bp, Homo sapiens
tctgacatgtaagaaa

SEQ ID NO: 847285 - DNA, 20 bp, Homo sapiens
tctgacatgtaagaaaatgt

SEQ ID NO: 847286 - DNA, 15 bp, Homo sapiens
tctgacattaacagt

SEQ ID NO: 847287 - DNA, 19 bp, Homo sapiens
tctgacattaacagttttc

SEQ ID NO: 847288 - DNA, 15 bp, Homo sapiens
tctgacatttatatt

SEQ ID NO: 847289 - DNA, 12 bp, Homo sapiens
tctgaccacact

SEQ ID NO: 847290 - DNA, 13 bp, Homo sapiens
tctgaccacgtgc

SEQ ID NO: 847291 - DNA, 13 bp, Homo sapiens
tctgaccagcagc

SEQ ID NO: 847292 - DNA, 14 bp, Homo sapiens
tctgaccatttcag

SEQ ID NO: 847293 - DNA, 17 bp, Homo sapiens
tctgacccactgatctc

SEQ ID NO: 847294 - DNA, 15 bp, Homo sapiens
tctgacccagtgaga

SEQ ID NO: 847295 - DNA, 12 bp, Homo sapiens
tctgaccctccc

SEQ ID NO: 847296 - DNA, 20 bp, Homo sapiens
tctgaccctccttctatttt

SEQ ID NO: 847297 - DNA, 20 bp, Homo sapiens
tctgaccgattcctttatat

SEQ ID NO: 847298 - DNA, 22 bp, Homo sapiens
tctgacctctacggacctcaca

SEQ ID NO: 847299 - DNA, 19 bp, Homo sapiens
tctgacctctgctgagtgc

SEQ ID NO: 847300 - DNA, 14 bp, Homo sapiens
tctgaccttaaatg

SEQ ID NO: 847301 - DNA, 22 bp, Homo sapiens
tctgaccttccagagcccaagg

SEQ ID NO: 847302 - DNA, 17 bp, Homo sapiens
tctgacgcaccactgcc

SEQ ID NO: 847303 - DNA, 20 bp, Homo sapiens
tctgacgcttgtgacagtgc

SEQ ID NO: 847304 - DNA, 17 bp, Homo sapiens
tctgactagtagatttc

SEQ ID NO: 847305 - DNA, 15 bp, Homo sapiens
tctgactcagggctc

SEQ ID NO: 847306 - DNA, 15 bp, Homo sapiens
tctgactccagagtc

SEQ ID NO: 847307 - DNA, 20 bp, Homo sapiens
tctgactccagagtctgagc

SEQ ID NO: 847308 - DNA, 16 bp, Homo sapiens
tctgactccctcccca

SEQ ID NO: 847309 - DNA, 19 bp, Homo sapiens
tctgactccctccccaccc

SEQ ID NO: 847310 - DNA, 23 bp, Homo sapiens
tctgactccctccccacccaaga

SEQ ID NO: 847311 - DNA, 15 bp, Homo sapiens
tctgactctgggttc

SEQ ID NO: 847312 - DNA, 15 bp, Homo sapiens
tctgactgtccctgc

SEQ ID NO: 847313 - DNA, 17 bp, Homo sapiens
tctgactgtccctgcca

SEQ ID NO: 847314 - DNA, 23 bp, Homo sapiens
tctgacttaagcaaaagaaaaag

SEQ ID NO: 847315 - DNA, 17 bp, Homo sapiens
tctgacttctagctgtc

SEQ ID NO: 847316 - DNA, 22 bp, Homo sapiens
tctgacttctagctgtctgtga

SEQ ID NO: 847317 - DNA, 16 bp, Homo sapiens
tctgacttctgcctgg

SEQ ID NO: 847318 - DNA, 19 bp, Homo sapiens
tctgacttctgcctggaga

SEQ ID NO: 847319 - DNA, 20 bp, Homo sapiens
tctgacttctgcctggagac

SEQ ID NO: 847320 - DNA, 12 bp, Homo sapiens
tctgagaaatag

SEQ ID NO: 847321 - DNA, 21 bp, Homo sapiens
tctgagaaataggtatcaaaa

SEQ ID NO: 847322 - DNA, 16 bp, Homo sapiens
tctgagaactgacttt

SEQ ID NO: 847323 - DNA, 24 bp, Homo sapiens
tctgagaagctctgaagaactctc

SEQ ID NO: 847324 - DNA, 21 bp, Homo sapiens
tctgagaatcacggtggtaaa

SEQ ID NO: 847325 - DNA, 12 bp, Homo sapiens
tctgagaatctt

SEQ ID NO: 847326 - DNA, 22 bp, Homo sapiens
tctgagaatctttattgagaaa

SEQ ID NO: 847327 - DNA, 23 bp, Homo sapiens
tctgagaatctttattgagaaag

SEQ ID NO: 847328 - DNA, 19 bp, Homo sapiens
tctgagaggctctccgtgc

SEQ ID NO: 847329 - DNA, 18 bp, Homo sapiens
tctgagagttggctcagg

SEQ ID NO: 847330 - DNA, 22 bp, Homo sapiens
tctgagatctgttgattgatga

SEQ ID NO: 847331 - DNA, 17 bp, Homo sapiens
tctgagatgctaattta

SEQ ID NO: 847332 - DNA, 22 bp, Homo sapiens
tctgagatgctaatttatttcc

SEQ ID NO: 847333 - DNA, 16 bp, Homo sapiens
tctgagatgctcactt

SEQ ID NO: 847334 - DNA, 21 bp, Homo sapiens
tctgagatgctcactttatta

SEQ ID NO: 847335 - DNA, 23 bp, Homo sapiens
tctgagatttttttgtgtatgtt

SEQ ID NO: 847336 - DNA, 17 bp, Homo sapiens
tctgagcaagagctggc

SEQ ID NO: 847337 - DNA, 18 bp, Homo sapiens
tctgagcaataacttcta

SEQ ID NO: 847338 - DNA, 14 bp, Homo sapiens
tctgagcacaggtg

SEQ ID NO: 847339 - DNA, 15 bp, Homo sapiens
tctgagcacaggtga

SEQ ID NO: 847340 - DNA, 20 bp, Homo sapiens
tctgagcacatagtgtcctg

SEQ ID NO: 847341 - DNA, 21 bp, Homo sapiens
tctgagcacatagtgtcctgc

SEQ ID NO: 847342 - DNA, 16 bp, Homo sapiens
tctgagcaccccctca

SEQ ID NO: 847343 - DNA, 13 bp, Homo sapiens
tctgagcaggggc

SEQ ID NO: 847344 - DNA, 13 bp, Homo sapiens
tctgcaagaacac

SEQ ID NO: 847345 - DNA, 21 bp, Homo sapiens
tctgcaagaattaaaactgag

SEQ ID NO: 847346 - DNA, 20 bp, Homo sapiens
tctgcaagaattgaagcagg

SEQ ID NO: 847347 - DNA, 13 bp, Homo sapiens
tctgcaagacaaa

SEQ ID NO: 847348 - DNA, 20 bp, Homo sapiens
tctgcaagcacatctgcatt

SEQ ID NO: 847349 - DNA, 14 bp, Homo sapiens
tctgcaagggccca

SEQ ID NO: 847350 - DNA, 16 bp, Homo sapiens
tctgcaagggcccaga

SEQ ID NO: 847351 - DNA, 23 bp, Homo sapiens
tctgcaatggcagcattcccacc

SEQ ID NO: 847352 - DNA, 16 bp, Homo sapiens
tctgcaatgggcactg

SEQ ID NO: 847353 - DNA, 21 bp, Homo sapiens
tctgcaatgggcactgggatg

SEQ ID NO: 847354 - DNA, 15 bp, Homo sapiens
tctgcaatttctact

SEQ ID NO: 847355 - DNA, 17 bp, Homo sapiens
tctgcacacaaatatta

SEQ ID NO: 847356 - DNA, 14 bp, Homo sapiens
tctgcacacagcac

SEQ ID NO: 847357 - DNA, 22 bp, Homo sapiens
tctgcacaccctccagagacaa

SEQ ID NO: 847358 - DNA, 22 bp, Homo sapiens
tctgcacagagggtcccattgt

SEQ ID NO: 847359 - DNA, 17 bp, Homo sapiens
tctgcacagattctttt

SEQ ID NO: 847360 - DNA, 18 bp, Homo sapiens
tctgcaccacacctggca

SEQ ID NO: 847361 - DNA, 18 bp, Homo sapiens
tctgcaccaccatgccca

SEQ ID NO: 847362 - DNA, 15 bp, Homo sapiens
tctgcacccagaaca

SEQ ID NO: 847363 - DNA, 19 bp, Homo sapiens
tctgcaccccttctctcct

SEQ ID NO: 847364 - DNA, 20 bp, Homo sapiens
tctgcaccccttctctcctc

SEQ ID NO: 847365 - DNA, 12 bp, Homo sapiens
tctgcaccctcc

SEQ ID NO: 847366 - DNA, 16 bp, Homo sapiens
tctgcaccctccaccc

SEQ ID NO: 847367 - DNA, 19 bp, Homo sapiens
tctgcaccctccaccctgt

SEQ ID NO: 847368 - DNA, 23 bp, Homo sapiens
tctgcaccctggggcctggacct

SEQ ID NO: 847369 - DNA, 13 bp, Homo sapiens
tctgcacccttct

SEQ ID NO: 847370 - DNA, 18 bp, Homo sapiens
tctgcaccgtactgtgga

SEQ ID NO: 847371 - DNA, 22 bp, Homo sapiens
tctgcacctccgcttgccagag

SEQ ID NO: 847372 - DNA, 16 bp, Homo sapiens
tctgcacctcttggct

SEQ ID NO: 847373 - DNA, 15 bp, Homo sapiens
tctgcactccatggc

SEQ ID NO: 847374 - DNA, 20 bp, Homo sapiens
tctgcactccatggccaccc

SEQ ID NO: 847375 - DNA, 18 bp, Homo sapiens
tctgcactcccacctgac

SEQ ID NO: 847376 - DNA, 20 bp, Homo sapiens
tctgcactcctttatctgta

SEQ ID NO: 847377 - DNA, 18 bp, Homo sapiens
tctgcagacttcccagct

SEQ ID NO: 847378 - DNA, 19 bp, Homo sapiens
tctgcagacttcccagcta

SEQ ID NO: 847379 - DNA, 23 bp, Homo sapiens
tctgcagcactttaaccctctct

SEQ ID NO: 847380 - DNA, 20 bp, Homo sapiens
tctgcagcatgacctgtgac

SEQ ID NO: 847381 - DNA, 14 bp, Homo sapiens
tctgcagccagccc

SEQ ID NO: 847382 - DNA, 19 bp, Homo sapiens
tctgcagccattcttcagg

SEQ ID NO: 847383 - DNA, 14 bp, Homo sapiens
tctgcagcctgctg

SEQ ID NO: 847384 - DNA, 17 bp, Homo sapiens
tctgcagcctgctgggg

SEQ ID NO: 847385 - DNA, 18 bp, Homo sapiens
tctgcagcctgctggggc

SEQ ID NO: 847386 - DNA, 19 bp, Homo sapiens
tctgcagcctgctggggct

SEQ ID NO: 847387 - DNA, 13 bp, Homo sapiens
tctgcagctgacc

SEQ ID NO: 847388 - DNA, 12 bp, Homo sapiens
tctgcagctgcc

SEQ ID NO: 847389 - DNA, 14 bp, Homo sapiens
tctgcagctgccgg

SEQ ID NO: 847390 - DNA, 11 bp, Homo sapiens
tctgcagctgt

SEQ ID NO: 847391 - DNA, 19 bp, Homo sapiens
tctgcaggatgattgtaca

SEQ ID NO: 847392 - DNA, 15 bp, Homo sapiens
tctgcaggcagacac

SEQ ID NO: 847393 - DNA, 16 bp, Homo sapiens
tctgcaggcagacacg

SEQ ID NO: 847394 - DNA, 22 bp, Homo sapiens
tctgcaggcctaggtgcagctc

SEQ ID NO: 847395 - DNA, 17 bp, Homo sapiens
tctgcaggctggggagg

SEQ ID NO: 847396 - DNA, 19 bp, Homo sapiens
tctgcaggggcctggagga

SEQ ID NO: 847397 - DNA, 22 bp, Homo sapiens
tctgcaggggcctggaggaatc

SEQ ID NO: 847398 - DNA, 15 bp, Homo sapiens
tctgcagtaaatctt

SEQ ID NO: 847399 - DNA, 18 bp, Homo sapiens
tctgcatatgttgaatac

SEQ ID NO: 847400 - DNA, 21 bp, Homo sapiens
tctgcatatgttgaatacttt

SEQ ID NO: 847401 - DNA, 17 bp, Homo sapiens
tctgcatatttctgtat

SEQ ID NO: 847402 - DNA, 22 bp, Homo sapiens
tctgcatccagagattcatttt

SEQ ID NO: 847403 - DNA, 23 bp, Homo sapiens
tctgcatccagagattcattttc

SEQ ID NO: 847404 - DNA, 14 bp, Homo sapiens
tctgcatcccagca

SEQ ID NO: 847405 - DNA, 23 bp, Homo sapiens
tctgcatcccagcacctgcctcc

SEQ ID NO: 847406 - DNA, 13 bp, Homo sapiens
tctgcattatcta

SEQ ID NO: 847407 - DNA, 22 bp, Homo sapiens
tctgcattatctatgcagcatg

SEQ ID NO: 847408 - DNA, 16 bp, Homo sapiens
tctgcattcattttta

SEQ ID NO: 847409 - DNA, 17 bp, Homo sapiens
tctgccaacctaaaact

SEQ ID NO: 847410 - DNA, 22 bp, Homo sapiens
tctgccaatcggctacccctcg

SEQ ID NO: 847411 - DNA, 17 bp, Homo sapiens
tctgccaccatcctgct

SEQ ID NO: 847412 - DNA, 13 bp, Homo sapiens
tctgccacccact

SEQ ID NO: 847413 - DNA, 18 bp, Homo sapiens
tctgccacccactcagga

SEQ ID NO: 847414 - DNA, 14 bp, Homo sapiens
tctgccaccctacc

SEQ ID NO: 847415 - DNA, 17 bp, Homo sapiens
tctgccaccctacctgt

SEQ ID NO: 847416 - DNA, 17 bp, Homo sapiens
tctgccaccgtggggga

SEQ ID NO: 847417 - DNA, 15 bp, Homo sapiens
tctgccacctcccct

SEQ ID NO: 847418 - DNA, 23 bp, Homo sapiens
tctgccacctcccctatccaccc

SEQ ID NO: 847419 - DNA, 14 bp, Homo sapiens
tctgccactggaag

SEQ ID NO: 847420 - DNA, 15 bp, Homo sapiens
tctgccagccagcag

SEQ ID NO: 847421 - DNA, 16 bp, Homo sapiens
tctgccagccagcagc

SEQ ID NO: 847422 - DNA, 17 bp, Homo sapiens
tctgccagccagcagcc

SEQ ID NO: 847423 - DNA, 19 bp, Homo sapiens
tctgccagccagcagccag

SEQ ID NO: 847424 - DNA, 12 bp, Homo sapiens
tctgccaggccc

SEQ ID NO: 847425 - DNA, 13 bp, Homo sapiens
tctgccagggagc

SEQ ID NO: 847426 - DNA, 16 bp, Homo sapiens
tctgccaggggcttcc

SEQ ID NO: 847427 - DNA, 23 bp, Homo sapiens
tctgccaggggtaacctggccac

SEQ ID NO: 847428 - DNA, 13 bp, Homo sapiens
tctgccagtgaca

SEQ ID NO: 847429 - DNA, 21 bp, Homo sapiens
tctgccagtgacagacaggct

SEQ ID NO: 847430 - DNA, 23 bp, Homo sapiens
tctgccagtgacagacaggctct

SEQ ID NO: 847431 - DNA, 22 bp, Homo sapiens
tctgccatcatttttgatgact

SEQ ID NO: 847432 - DNA, 14 bp, Homo sapiens
tctgccatttcatg

SEQ ID NO: 847433 - DNA, 19 bp, Homo sapiens
tctgcccaaaaatatggtt

SEQ ID NO: 847434 - DNA, 15 bp, Homo sapiens
tctgcccaaattatg

SEQ ID NO: 847435 - DNA, 18 bp, Homo sapiens
tctgcccaccctcctgta

SEQ ID NO: 847436 - DNA, 16 bp, Homo sapiens
tctgcccacctggggt

SEQ ID NO: 847437 - DNA, 17 bp, Homo sapiens
tctgcccacgcagagga

SEQ ID NO: 847438 - DNA, 16 bp, Homo sapiens
tctgcccagcttgggc

SEQ ID NO: 847439 - DNA, 19 bp, Homo sapiens
tctgcccagcttgggccca

SEQ ID NO: 847440 - DNA, 19 bp, Homo sapiens
tctgcccaggggtgccccc

SEQ ID NO: 847441 - DNA, 22 bp, Homo sapiens
tctgcccaggggtgccccctcc

SEQ ID NO: 847442 - DNA, 19 bp, Homo sapiens
tctgccccaagcagccagc

SEQ ID NO: 847443 - DNA, 21 bp, Homo sapiens
tctgccccaagcagccagcca

SEQ ID NO: 847444 - DNA, 22 bp, Homo sapiens
tctgccccaagcagccagccag

SEQ ID NO: 847445 - DNA, 21 bp, Homo sapiens
tctgccccacgctgtggccct

SEQ ID NO: 847446 - DNA, 15 bp, Homo sapiens
tctgccccagcccag

SEQ ID NO: 847447 - DNA, 17 bp, Homo sapiens
tctgccccagcccagat

SEQ ID NO: 847448 - DNA, 13 bp, Homo sapiens
tctgccccagtag

SEQ ID NO: 847449 - DNA, 19 bp, Homo sapiens
tctgccccagtagtcagaa

SEQ ID NO: 847450 - DNA, 15 bp, Homo sapiens
tctgccccatcctcc

SEQ ID NO: 847451 - DNA, 19 bp, Homo sapiens
tctgccccatcctccagca

SEQ ID NO: 847452 - DNA, 13 bp, Homo sapiens
tctgcccccagcc

SEQ ID NO: 847453 - DNA, 15 bp, Homo sapiens
tctgcccccagccca

SEQ ID NO: 847454 - DNA, 16 bp, Homo sapiens
tctgcccccagcccaa

SEQ ID NO: 847455 - DNA, 18 bp, Homo sapiens
tctgccccccagggctag

SEQ ID NO: 847456 - DNA, 22 bp, Homo sapiens
tctgccccccagggctagtgaa

SEQ ID NO: 847457 - DNA, 21 bp, Homo sapiens
tctgcccccgcgggttctaga

SEQ ID NO: 847458 - DNA, 15 bp, Homo sapiens
tctgccccctccccc

SEQ ID NO: 847459 - DNA, 13 bp, Homo sapiens
tctgcccctcagg

SEQ ID NO: 847460 - DNA, 14 bp, Homo sapiens
tctgcccctcaggg

SEQ ID NO: 847461 - DNA, 16 bp, Homo sapiens
tctgcccctcaggggg

SEQ ID NO: 847462 - DNA, 21 bp, Homo sapiens
tctgcccctcagggggccagc

SEQ ID NO: 847463 - DNA, 22 bp, Homo sapiens
tctgcccctcagggggccagct

SEQ ID NO: 847464 - DNA, 23 bp, Homo sapiens
tctgcccctcagggggccagctg

SEQ ID NO: 847465 - DNA, 20 bp, Homo sapiens
tctggataaaccaccctctg

SEQ ID NO: 847466 - DNA, 14 bp, Homo sapiens
tctggatctcctgc

SEQ ID NO: 847467 - DNA, 16 bp, Homo sapiens
tctggatctcctgctg

SEQ ID NO: 847468 - DNA, 17 bp, Homo sapiens
tctggatctcctgctgc

SEQ ID NO: 847469 - DNA, 20 bp, Homo sapiens
tctggatctgaccctcccag

SEQ ID NO: 847470 - DNA, 13 bp, Homo sapiens
tctggatgaaggc

SEQ ID NO: 847471 - DNA, 23 bp, Homo sapiens
tctggattatgttatacaaggca

SEQ ID NO: 847472 - DNA, 16 bp, Homo sapiens
tctggattcagccttc

SEQ ID NO: 847473 - DNA, 15 bp, Homo sapiens
tctggattccctttt

SEQ ID NO: 847474 - DNA, 19 bp, Homo sapiens
tctggattcccttttgact

SEQ ID NO: 847475 - DNA, 22 bp, Homo sapiens
tctggattctgggaggcaagaa

SEQ ID NO: 847476 - DNA, 13 bp, Homo sapiens
tctggattgtggt

SEQ ID NO: 847477 - DNA, 14 bp, Homo sapiens
tctggattttgaat

SEQ ID NO: 847478 - DNA, 15 bp, Homo sapiens
tctggcaacatcttt

SEQ ID NO: 847479 - DNA, 18 bp, Homo sapiens
tctggcaagtcggggcct

SEQ ID NO: 847480 - DNA, 20 bp, Homo sapiens
tctggcacactccctctcct

SEQ ID NO: 847481 - DNA, 21 bp, Homo sapiens
tctggcacagtgatgccgggc

SEQ ID NO: 847482 - DNA, 16 bp, Homo sapiens
tctggcacttccattg

SEQ ID NO: 847483 - DNA, 18 bp, Homo sapiens
tctggcagagcctctgag

SEQ ID NO: 847484 - DNA, 19 bp, Homo sapiens
tctggcagagcctctgaga

SEQ ID NO: 847485 - DNA, 20 bp, Homo sapiens
tctggcaggacctgcctagc

SEQ ID NO: 847486 - DNA, 19 bp, Homo sapiens
tctggcagggtgggatgga

SEQ ID NO: 847487 - DNA, 18 bp, Homo sapiens
tctggcatgggacagggg

SEQ ID NO: 847488 - DNA, 23 bp, Homo sapiens
tctggcattctacacctggacca

SEQ ID NO: 847489 - DNA, 14 bp, Homo sapiens
tctggccaaatatg

SEQ ID NO: 847490 - DNA, 19 bp, Homo sapiens
tctggccagaaaaggcatt

SEQ ID NO: 847491 - DNA, 19 bp, Homo sapiens
tctggccaggatggagggg

SEQ ID NO: 847492 - DNA, 11 bp, Homo sapiens
tctggccaggc

SEQ ID NO: 847493 - DNA, 16 bp, Homo sapiens
tctggccccagcctag

SEQ ID NO: 847494 - DNA, 17 bp, Homo sapiens
tctggccccagcctagg

SEQ ID NO: 847495 - DNA, 22 bp, Homo sapiens
tctggccctcggtggctgcaca

SEQ ID NO: 847496 - DNA, 18 bp, Homo sapiens
tctggccctgacttctgg

SEQ ID NO: 847497 - DNA, 14 bp, Homo sapiens
tctggccctgcctt

SEQ ID NO: 847498 - DNA, 16 bp, Homo sapiens
tctggccctgccttct

SEQ ID NO: 847499 - DNA, 13 bp, Homo sapiens
tctggccctggcc

SEQ ID NO: 847500 - DNA, 14 bp, Homo sapiens
tctggccctggccc

SEQ ID NO: 847501 - DNA, 15 bp, Homo sapiens
tctggccctggccct

SEQ ID NO: 847502 - DNA, 12 bp, Homo sapiens
tctggccctggg

SEQ ID NO: 847503 - DNA, 21 bp, Homo sapiens
tctggccctggggatcttccc

SEQ ID NO: 847504 - DNA, 15 bp, Homo sapiens
tctggccgccacccc

SEQ ID NO: 847505 - DNA, 23 bp, Homo sapiens
tctggcctcccacccgatgctgc

SEQ ID NO: 847506 - DNA, 19 bp, Homo sapiens
tctggcctctgctgaatgc

SEQ ID NO: 847507 - DNA, 14 bp, Homo sapiens
tctggccttttcct

SEQ ID NO: 847508 - DNA, 18 bp, Homo sapiens
tctggcgacagttttcct

SEQ ID NO: 847509 - DNA, 21 bp, Homo sapiens
tctggcggcttcctgtccact

SEQ ID NO: 847510 - DNA, 17 bp, Homo sapiens
tctggctatgcatttga

SEQ ID NO: 847511 - DNA, 19 bp, Homo sapiens
tctggctccagaggacctg

SEQ ID NO: 847512 - DNA, 23 bp, Homo sapiens
tctggctcggacccaccccaact

SEQ ID NO: 847513 - DNA, 12 bp, Homo sapiens
tctggctctaat

SEQ ID NO: 847514 - DNA, 15 bp, Homo sapiens
tctggctctaattca

SEQ ID NO: 847515 - DNA, 16 bp, Homo sapiens
tctggctctaattcac

SEQ ID NO: 847516 - DNA, 20 bp, Homo sapiens
tctggctctaattcacagtg

SEQ ID NO: 847517 - DNA, 13 bp, Homo sapiens
tctggctgaaccc

SEQ ID NO: 847518 - DNA, 20 bp, Homo sapiens
tctggctgaaccctgtgctg

SEQ ID NO: 847519 - DNA, 21 bp, Homo sapiens
tctggctgaaccctgtgctgg

SEQ ID NO: 847520 - DNA, 22 bp, Homo sapiens
tctggctgccccaacctgctga

SEQ ID NO: 847521 - DNA, 17 bp, Homo sapiens
tctggctgtggtcagca

SEQ ID NO: 847522 - DNA, 15 bp, Homo sapiens
tctggcttccaggta

SEQ ID NO: 847523 - DNA, 22 bp, Homo sapiens
tctggcttccaggtatctccag

SEQ ID NO: 847524 - DNA, 18 bp, Homo sapiens
tctggcttcctgctgagt

SEQ ID NO: 847525 - DNA, 22 bp, Homo sapiens
tctggcttctagagatgtgcct

SEQ ID NO: 847526 - DNA, 18 bp, Homo sapiens
tctggcttctgaagagcc

SEQ ID NO: 847527 - DNA, 16 bp, Homo sapiens
tctggcttgccccagg

SEQ ID NO: 847528 - DNA, 23 bp, Homo sapiens
tctggcttgccccaggactctgg

SEQ ID NO: 847529 - DNA, 21 bp, Homo sapiens
tctggctttcccaggagatgg

SEQ ID NO: 847530 - DNA, 23 bp, Homo sapiens
tctggctttctccgactgctagg

SEQ ID NO: 847531 - DNA, 12 bp, Homo sapiens
tctggctttgct

SEQ ID NO: 847532 - DNA, 19 bp, Homo sapiens
tctggctttgctctattaa

SEQ ID NO: 847533 - DNA, 23 bp, Homo sapiens
tctgggaaattgaagtgtcttct

SEQ ID NO: 847534 - DNA, 16 bp, Homo sapiens
tctgggaacctcccag

SEQ ID NO: 847535 - DNA, 19 bp, Homo sapiens
tctgggaacctcccagagg

SEQ ID NO: 847536 - DNA, 22 bp, Homo sapiens
tctgggaacctcccagaggtcc

SEQ ID NO: 847537 - DNA, 20 bp, Homo sapiens
tctgggaactgaatcaggaa

SEQ ID NO: 847538 - DNA, 23 bp, Homo sapiens
tctgggaactgaatcaggaaact

SEQ ID NO: 847539 - DNA, 18 bp, Homo sapiens
tctgggaatgggagaggg

SEQ ID NO: 847540 - DNA, 14 bp, Homo sapiens
tctgggaattgtgt

SEQ ID NO: 847541 - DNA, 13 bp, Homo sapiens
tctgggacctcag

SEQ ID NO: 847542 - DNA, 21 bp, Homo sapiens
tctgggacttccttgctctcc

SEQ ID NO: 847543 - DNA, 14 bp, Homo sapiens
tctgggagagccag

SEQ ID NO: 847544 - DNA, 14 bp, Homo sapiens
tctgggagagcctg

SEQ ID NO: 847545 - DNA, 15 bp, Homo sapiens
tctgggagagcctgg

SEQ ID NO: 847546 - DNA, 17 bp, Homo sapiens
tctgggagagcctggca

SEQ ID NO: 847547 - DNA, 13 bp, Homo sapiens
tctgggagaggat

SEQ ID NO: 847548 - DNA, 18 bp, Homo sapiens
tctgggagctcaaggcca

SEQ ID NO: 847549 - DNA, 13 bp, Homo sapiens
tctgggagggaag

SEQ ID NO: 847550 - DNA, 15 bp, Homo sapiens
tctgggagggaagtg

SEQ ID NO: 847551 - DNA, 12 bp, Homo sapiens
tctgggaggggg

SEQ ID NO: 847552 - DNA, 18 bp, Homo sapiens
tctgggagggggtgagag

SEQ ID NO: 847553 - DNA, 19 bp, Homo sapiens
tctgggagggggtgagagg

SEQ ID NO: 847554 - DNA, 17 bp, Homo sapiens
tctgggagtcacacagt

SEQ ID NO: 847555 - DNA, 18 bp, Homo sapiens
tctgggataagtaagttt

SEQ ID NO: 847556 - DNA, 23 bp, Homo sapiens
tctgggatatggctgcccaggag

SEQ ID NO: 847557 - DNA, 13 bp, Homo sapiens
tctgggatattta

SEQ ID NO: 847558 - DNA, 22 bp, Homo sapiens
tctgggatgtagaacttcaaga

SEQ ID NO: 847559 - DNA, 15 bp, Homo sapiens
tctgggatgtcacag

SEQ ID NO: 847560 - DNA, 19 bp, Homo sapiens
tctgggatgtcacagtcca

SEQ ID NO: 847561 - DNA, 17 bp, Homo sapiens
tctgggattaagggcaa

SEQ ID NO: 847562 - DNA, 13 bp, Homo sapiens
tctgggcaagggc

SEQ ID NO: 847563 - DNA, 17 bp, Homo sapiens
tctgggcaagggctcct

SEQ ID NO: 847564 - DNA, 18 bp, Homo sapiens
tctgggcaagtagcagga

SEQ ID NO: 847565 - DNA, 18 bp, Homo sapiens
tctgggcagagcctgtcc

SEQ ID NO: 847566 - DNA, 14 bp, Homo sapiens
tctgggcagcacct

SEQ ID NO: 847567 - DNA, 20 bp, Homo sapiens
tctgggcagcacctctggtc

SEQ ID NO: 847568 - DNA, 14 bp, Homo sapiens
tctgggcagcctgc

SEQ ID NO: 847569 - DNA, 19 bp, Homo sapiens
tctgggcagcctgctttgg

SEQ ID NO: 847570 - DNA, 14 bp, Homo sapiens
tctgggcagcgcta

SEQ ID NO: 847571 - DNA, 19 bp, Homo sapiens
tctgggcaggacctcagag

SEQ ID NO: 847572 - DNA, 18 bp, Homo sapiens
tctgggcagtgccacagc

SEQ ID NO: 847573 - DNA, 22 bp, Homo sapiens
tctgggcagtgccacagcctgc

SEQ ID NO: 847574 - DNA, 18 bp, Homo sapiens
tctgggcattttcctcct

SEQ ID NO: 847575 - DNA, 18 bp, Homo sapiens
tctgggccccctcctccc

SEQ ID NO: 847576 - DNA, 15 bp, Homo sapiens
tctgggcctctgact

SEQ ID NO: 847577 - DNA, 15 bp, Homo sapiens
tctgggcctcttttt

SEQ ID NO: 847578 - DNA, 21 bp, Homo sapiens
tctgggcctctttttgccctt

SEQ ID NO: 847579 - DNA, 17 bp, Homo sapiens
tctgggcctggggtgca

SEQ ID NO: 847580 - DNA, 15 bp, Homo sapiens
tctgggctatggaca

SEQ ID NO: 847581 - DNA, 21 bp, Homo sapiens
tctgggctatggacacagggt

SEQ ID NO: 847582 - DNA, 15 bp, Homo sapiens
tctgggctcagggct

SEQ ID NO: 847583 - DNA, 21 bp, Homo sapiens
tctgggctcctggaaccaatc

SEQ ID NO: 847584 - DNA, 17 bp, Homo sapiens
tctgggctgggcacctg

SEQ ID NO: 847585 - DNA, 23 bp, Homo sapiens
tctgggctgtaacgtggcactgg

SEQ ID NO: 847586 - DNA, 19 bp, Homo sapiens
tctgtcttttggagaacca

SEQ ID NO: 847587 - DNA, 17 bp, Homo sapiens
tctgtgaacgatttaga

SEQ ID NO: 847588 - DNA, 21 bp, Homo sapiens
tctgtgaacgatttagaaaga

SEQ ID NO: 847589 - DNA, 20 bp, Homo sapiens
tctgtgaagaggaacagtgt

SEQ ID NO: 847590 - DNA, 14 bp, Homo sapiens
tctgtgaagctaat

SEQ ID NO: 847591 - DNA, 13 bp, Homo sapiens
tctgtgaataagc

SEQ ID NO: 847592 - DNA, 16 bp, Homo sapiens
tctgtgaataagccat

SEQ ID NO: 847593 - DNA, 13 bp, Homo sapiens
tctgtgaatacaa

SEQ ID NO: 847594 - DNA, 15 bp, Homo sapiens
tctgtgaatacaatt

SEQ ID NO: 847595 - DNA, 18 bp, Homo sapiens
tctgtgaattgagctgca

SEQ ID NO: 847596 - DNA, 16 bp, Homo sapiens
tctgtgacatcctgct

SEQ ID NO: 847597 - DNA, 16 bp, Homo sapiens
tctgtgaccaatgtct

SEQ ID NO: 847598 - DNA, 21 bp, Homo sapiens
tctgtgacgcagacagagggg

SEQ ID NO: 847599 - DNA, 11 bp, Homo sapiens
tctgtgactgg

SEQ ID NO: 847600 - DNA, 12 bp, Homo sapiens
tctgtgactgga

SEQ ID NO: 847601 - DNA, 13 bp, Homo sapiens
tctgtgactggat

SEQ ID NO: 847602 - DNA, 20 bp, Homo sapiens
tctgtgactggatcttctat

SEQ ID NO: 847603 - DNA, 21 bp, Homo sapiens
tctgtgagggtgctgactggc

SEQ ID NO: 847604 - DNA, 17 bp, Homo sapiens
tctgtgatacagaactc

SEQ ID NO: 847605 - DNA, 20 bp, Homo sapiens
tctgtgatcttttaaagtgt

SEQ ID NO: 847606 - DNA, 16 bp, Homo sapiens
tctgtgatgatcctca

SEQ ID NO: 847607 - DNA, 19 bp, Homo sapiens
tctgtgattacatagatca

SEQ ID NO: 847608 - DNA, 21 bp, Homo sapiens
tctgtgattacatagatcagc

SEQ ID NO: 847609 - DNA, 17 bp, Homo sapiens
tctgtgattatttgtgt

SEQ ID NO: 847610 - DNA, 15 bp, Homo sapiens
tctgtgatttcttct

SEQ ID NO: 847611 - DNA, 12 bp, Homo sapiens
tctgtgcaaaca

SEQ ID NO: 847612 - DNA, 16 bp, Homo sapiens
tctgtgcacagtggct

SEQ ID NO: 847613 - DNA, 17 bp, Homo sapiens
tctgtgcacagtggctt

SEQ ID NO: 847614 - DNA, 21 bp, Homo sapiens
tctgtgcactagcctgtgatt

SEQ ID NO: 847615 - DNA, 16 bp, Homo sapiens
tctgtgccatggcccc

SEQ ID NO: 847616 - DNA, 17 bp, Homo sapiens
tctgtgccatggccccc

SEQ ID NO: 847617 - DNA, 20 bp, Homo sapiens
tctgtgcccacggtctgagc

SEQ ID NO: 847618 - DNA, 24 bp, Homo sapiens
tctgtgcccacggtctgagctagc

SEQ ID NO: 847619 - DNA, 14 bp, Homo sapiens
tctgtgccccatgc

SEQ ID NO: 847620 - DNA, 17 bp, Homo sapiens
tctgtgccccatgcctg

SEQ ID NO: 847621 - DNA, 12 bp, Homo sapiens
tctgtgcctccc

SEQ ID NO: 847622 - DNA, 13 bp, Homo sapiens
tctgtgcctcccc

SEQ ID NO: 847623 - DNA, 20 bp, Homo sapiens
tctgtgcctccccccagacc

SEQ ID NO: 847624 - DNA, 21 bp, Homo sapiens
tctgtgcctccccccagaccc

SEQ ID NO: 847625 - DNA, 15 bp, Homo sapiens
tctgtgcctgaatat

SEQ ID NO: 847626 - DNA, 18 bp, Homo sapiens
tctgtgccttcttttgat

SEQ ID NO: 847627 - DNA, 16 bp, Homo sapiens
tctgtgcgtgaaacac

SEQ ID NO: 847628 - DNA, 12 bp, Homo sapiens
tctgtgcgtgtg

SEQ ID NO: 847629 - DNA, 22 bp, Homo sapiens
tctgtgctagggaaacttcccg

SEQ ID NO: 847630 - DNA, 19 bp, Homo sapiens
tctgtgctgactctggcct

SEQ ID NO: 847631 - DNA, 17 bp, Homo sapiens
tctgtgctgtgcctgct

SEQ ID NO: 847632 - DNA, 18 bp, Homo sapiens
tctgtgctgtgcctgcta

SEQ ID NO: 847633 - DNA, 17 bp, Homo sapiens
tctgtggaagagattcc

SEQ ID NO: 847634 - DNA, 12 bp, Homo sapiens
tctgtggaattc

SEQ ID NO: 847635 - DNA, 13 bp, Homo sapiens
tctgtggagcgcc

SEQ ID NO: 847636 - DNA, 17 bp, Homo sapiens
tctgtggagctgccaca

SEQ ID NO: 847637 - DNA, 21 bp, Homo sapiens
tctgtggagggagggcagctg

SEQ ID NO: 847638 - DNA, 18 bp, Homo sapiens
tctgtggatacagtgccc

SEQ ID NO: 847639 - DNA, 21 bp, Homo sapiens
tctgtggatcagcattttaga

SEQ ID NO: 847640 - DNA, 12 bp, Homo sapiens
tctgtggcctgt

SEQ ID NO: 847641 - DNA, 22 bp, Homo sapiens
tctgtggcctgtgtccagcagc

SEQ ID NO: 847642 - DNA, 23 bp, Homo sapiens
tctgtggctggctctaccttcct

SEQ ID NO: 847643 - DNA, 17 bp, Homo sapiens
tctgtgggcactggtgg

SEQ ID NO: 847644 - DNA, 23 bp, Homo sapiens
tctgtgggctacatgctggggtc

SEQ ID NO: 847645 - DNA, 15 bp, Homo sapiens
tctgtgggcttggcc

SEQ ID NO: 847646 - DNA, 20 bp, Homo sapiens
tctgtgggcttggccttgtg

SEQ ID NO: 847647 - DNA, 17 bp, Homo sapiens
tctgtggggctgggcac

SEQ ID NO: 847648 - DNA, 22 bp, Homo sapiens
tctgtgggggtcatcagggagg

SEQ ID NO: 847649 - DNA, 15 bp, Homo sapiens
tctgtgggtctctgg

SEQ ID NO: 847650 - DNA, 17 bp, Homo sapiens
tctgtgggtctctggaa

SEQ ID NO: 847651 - DNA, 16 bp, Homo sapiens
tctgtggttcctctgc

SEQ ID NO: 847652 - DNA, 20 bp, Homo sapiens
tctgtggttcctctgctcac

SEQ ID NO: 847653 - DNA, 19 bp, Homo sapiens
tctgtggttctataataag

SEQ ID NO: 847654 - DNA, 19 bp, Homo sapiens
tctgtggttttcccctccc

SEQ ID NO: 847655 - DNA, 23 bp, Homo sapiens
tctgtggttttcccctccctggg

SEQ ID NO: 847656 - DNA, 19 bp, Homo sapiens
tctgtggttttttttgaat

SEQ ID NO: 847657 - DNA, 22 bp, Homo sapiens
tctgtgtaactttaaacatcta

SEQ ID NO: 847658 - DNA, 14 bp, Homo sapiens
tctgtgtacaaaga

SEQ ID NO: 847659 - DNA, 15 bp, Homo sapiens
tctgtgtacaaagaa

SEQ ID NO: 847660 - DNA, 20 bp, Homo sapiens
tctgtgtaccacttctgtgg

SEQ ID NO: 847661 - DNA, 15 bp, Homo sapiens
tctgtgtagagaatg

SEQ ID NO: 847662 - DNA, 20 bp, Homo sapiens
tctgtgtagccgccctgaga

SEQ ID NO: 847663 - DNA, 18 bp, Homo sapiens
tctgtgtccttccctgca

SEQ ID NO: 847664 - DNA, 11 bp, Homo sapiens
tctgtgtctct

SEQ ID NO: 847665 - DNA, 12 bp, Homo sapiens
tctgtgtcttgt

SEQ ID NO: 847666 - DNA, 11 bp, Homo sapiens
tctgtgtcttt

SEQ ID NO: 847667 - DNA, 13 bp, Homo sapiens
tctgtgtgaaaat

SEQ ID NO: 847668 - DNA, 21 bp, Homo sapiens
tctgtgtgaaactttcattcc

SEQ ID NO: 847669 - DNA, 21 bp, Homo sapiens
tctgtgtgcacaaatatttat

SEQ ID NO: 847670 - DNA, 19 bp, Homo sapiens
tctgtgtgcaccttaccaa

SEQ ID NO: 847671 - DNA, 15 bp, Homo sapiens
tctgtgtgcagcaac

SEQ ID NO: 847672 - DNA, 23 bp, Homo sapiens
tctgtgtggggttctcagtgccg

SEQ ID NO: 847673 - DNA, 16 bp, Homo sapiens
tctgtgtggtggagcc

SEQ ID NO: 847674 - DNA, 21 bp, Homo sapiens
tctgtgtggtggagccagggc

SEQ ID NO: 847675 - DNA, 22 bp, Homo sapiens
tctgtgtggtggagccagggcc

SEQ ID NO: 847676 - DNA, 21 bp, Homo sapiens
tctgtgtgtatattgagaatc

SEQ ID NO: 847677 - DNA, 15 bp, Homo sapiens
tctgtgtgtcagttt

SEQ ID NO: 847678 - DNA, 15 bp, Homo sapiens
tctgtgttcccagag

SEQ ID NO: 847679 - DNA, 20 bp, Homo sapiens
tctgtgttcccagaggcagg

SEQ ID NO: 847680 - DNA, 12 bp, Homo sapiens
tctgtgttgctt

SEQ ID NO: 847681 - DNA, 18 bp, Homo sapiens
tctgtgttttgaaagaat

SEQ ID NO: 847682 - DNA, 16 bp, Homo sapiens
tctgtgtttttgaaat

SEQ ID NO: 847683 - DNA, 17 bp, Homo sapiens
tctgttaactgaatacc

SEQ ID NO: 847684 - DNA, 16 bp, Homo sapiens
tctgttaagaaaggat

SEQ ID NO: 847685 - DNA, 16 bp, Homo sapiens
tctgttagcagagtct

SEQ ID NO: 847686 - DNA, 14 bp, Homo sapiens
tctgttagggcctt

SEQ ID NO: 847687 - DNA, 20 bp, Homo sapiens
tctgttatcgaacacattca

SEQ ID NO: 847688 - DNA, 12 bp, Homo sapiens
tctgttatgcac

SEQ ID NO: 847689 - DNA, 22 bp, Homo sapiens
tctgttatgcactgtggtttca

SEQ ID NO: 847690 - DNA, 17 bp, Homo sapiens
tctgttatgctgtgaca

SEQ ID NO: 847691 - DNA, 15 bp, Homo sapiens
tctgttatttcctaa

SEQ ID NO: 847692 - DNA, 17 bp, Homo sapiens
tctgttcagatgtgcat

SEQ ID NO: 847693 - DNA, 13 bp, Homo sapiens
tctgttcagtgat

SEQ ID NO: 847694 - DNA, 22 bp, Homo sapiens
tctgttcatcaccagtctgtaa

SEQ ID NO: 847695 - DNA, 14 bp, Homo sapiens
tctgttccaaattc

SEQ ID NO: 847696 - DNA, 22 bp, Homo sapiens
tctgttcccaaggaagctcctt

SEQ ID NO: 847697 - DNA, 20 bp, Homo sapiens
tctgttcccccttcacaaag

SEQ ID NO: 847698 - DNA, 19 bp, Homo sapiens
tctgttcccttcctcaccc

SEQ ID NO: 847699 - DNA, 13 bp, Homo sapiens
tctgttccttcac

SEQ ID NO: 847700 - DNA, 18 bp, Homo sapiens
tctgttccttcctccact

SEQ ID NO: 847701 - DNA, 22 bp, Homo sapiens
tctgttccttttctctcctgtg

SEQ ID NO: 847702 - DNA, 15 bp, Homo sapiens
tctgttctagttttt

SEQ ID NO: 847703 - DNA, 14 bp, Homo sapiens
tctgttctctgctg

SEQ ID NO: 847704 - DNA, 18 bp, Homo sapiens
tctgttctgcacacagca

SEQ ID NO: 847705 - DNA, 19 bp, Homo sapiens
tctgttctgcacacagcac

SEQ ID NO: 847706 - DNA, 22 bp, Homo sapiens
tctgttctgctcccagatgcct

SEQ ID NO: 847707 - DNA, 13 bp, Homo sapiens
tctgttctggggg

SEQ ID NO: 847708 - DNA, 16 bp, Homo sapiens
tcttctatcattccaa

SEQ ID NO: 847709 - DNA, 19 bp, Homo sapiens
tcttctattaatcaagaga

SEQ ID NO: 847710 - DNA, 20 bp, Homo sapiens
tcttctattaatcaagagaa

SEQ ID NO: 847711 - DNA, 13 bp, Homo sapiens
tcttctattttgt

SEQ ID NO: 847712 - DNA, 20 bp, Homo sapiens
tcttctcatagcattaacta

SEQ ID NO: 847713 - DNA, 13 bp, Homo sapiens
tcttctcattgtt

SEQ ID NO: 847714 - DNA, 20 bp, Homo sapiens
tcttctccaattctgaaata

SEQ ID NO: 847715 - DNA, 16 bp, Homo sapiens
tcttctccaccagccc

SEQ ID NO: 847716 - DNA, 15 bp, Homo sapiens
tcttctccacgtctt

SEQ ID NO: 847717 - DNA, 20 bp, Homo sapiens
tcttctccacgtctttcctg

SEQ ID NO: 847718 - DNA, 21 bp, Homo sapiens
tcttctccacgtctttcctgc

SEQ ID NO: 847719 - DNA, 22 bp, Homo sapiens
tcttctccacgtctttcctgct

SEQ ID NO: 847720 - DNA, 13 bp, Homo sapiens
tcttctccactgg

SEQ ID NO: 847721 - DNA, 12 bp, Homo sapiens
tcttctcccaga

SEQ ID NO: 847722 - DNA, 17 bp, Homo sapiens
tcttctccccgaggctg

SEQ ID NO: 847723 - DNA, 17 bp, Homo sapiens
tcttctcctatgtgtaa

SEQ ID NO: 847724 - DNA, 14 bp, Homo sapiens
tcttctctatcctc

SEQ ID NO: 847725 - DNA, 13 bp, Homo sapiens
tcttctctccact

SEQ ID NO: 847726 - DNA, 13 bp, Homo sapiens
tcttctctccttt

SEQ ID NO: 847727 - DNA, 14 bp, Homo sapiens
tcttctctctgttc

SEQ ID NO: 847728 - DNA, 15 bp, Homo sapiens
tcttctctgcacgtt

SEQ ID NO: 847729 - DNA, 13 bp, Homo sapiens
tcttctctgttgt

SEQ ID NO: 847730 - DNA, 19 bp, Homo sapiens
tcttctcttccttttatca

SEQ ID NO: 847731 - DNA, 21 bp, Homo sapiens
tcttctcttggtgaaataata

SEQ ID NO: 847732 - DNA, 13 bp, Homo sapiens
tcttctgaaatga

SEQ ID NO: 847733 - DNA, 19 bp, Homo sapiens
tcttctgaactcaaactga

SEQ ID NO: 847734 - DNA, 21 bp, Homo sapiens
tcttctgaggaccgctgataa

SEQ ID NO: 847735 - DNA, 12 bp, Homo sapiens
tcttctgccctt

SEQ ID NO: 847736 - DNA, 15 bp, Homo sapiens
tcttctgcctgttat

SEQ ID NO: 847737 - DNA, 19 bp, Homo sapiens
tcttctgctaatacctctt

SEQ ID NO: 847738 - DNA, 17 bp, Homo sapiens
tcttctgctccaccctt

SEQ ID NO: 847739 - DNA, 22 bp, Homo sapiens
tcttctgctccacccttggcct

SEQ ID NO: 847740 - DNA, 11 bp, Homo sapiens
tcttctgctgt

SEQ ID NO: 847741 - DNA, 17 bp, Homo sapiens
tcttctggagtctccag

SEQ ID NO: 847742 - DNA, 18 bp, Homo sapiens
tcttctggagtttctcta

SEQ ID NO: 847743 - DNA, 12 bp, Homo sapiens
tcttctggctca

SEQ ID NO: 847744 - DNA, 20 bp, Homo sapiens
tcttctgggcagagcctgtc

SEQ ID NO: 847745 - DNA, 22 bp, Homo sapiens
tcttctgggcagagcctgtccc

SEQ ID NO: 847746 - DNA, 20 bp, Homo sapiens
tcttctggggcaggctgggc

SEQ ID NO: 847747 - DNA, 21 bp, Homo sapiens
tcttctggggcaggctgggcc

SEQ ID NO: 847748 - DNA, 22 bp, Homo sapiens
tcttctggggcaggctgggcca

SEQ ID NO: 847749 - DNA, 23 bp, Homo sapiens
tcttctggtagcatattcatggt

SEQ ID NO: 847750 - DNA, 15 bp, Homo sapiens
tcttctgtaatattt

SEQ ID NO: 847751 - DNA, 16 bp, Homo sapiens
tcttctgtatttctag

SEQ ID NO: 847752 - DNA, 19 bp, Homo sapiens
tcttctgtatttctaggca

SEQ ID NO: 847753 - DNA, 14 bp, Homo sapiens
tcttctgtattttt

SEQ ID NO: 847754 - DNA, 21 bp, Homo sapiens
tcttctgtgaaatataattgt

SEQ ID NO: 847755 - DNA, 15 bp, Homo sapiens
tcttctgtgttaatt

SEQ ID NO: 847756 - DNA, 14 bp, Homo sapiens
tcttctgttcccaa

SEQ ID NO: 847757 - DNA, 13 bp, Homo sapiens
tcttcttaactta

SEQ ID NO: 847758 - DNA, 17 bp, Homo sapiens
tcttcttacacttctta

SEQ ID NO: 847759 - DNA, 12 bp, Homo sapiens
tcttcttatgca

SEQ ID NO: 847760 - DNA, 13 bp, Homo sapiens
tcttcttcaccat

SEQ ID NO: 847761 - DNA, 16 bp, Homo sapiens
tcttcttcagaagaca

SEQ ID NO: 847762 - DNA, 22 bp, Homo sapiens
tcttcttccaaatgcagttcat

SEQ ID NO: 847763 - DNA, 22 bp, Homo sapiens
tcttcttccctccctatctaac

SEQ ID NO: 847764 - DNA, 18 bp, Homo sapiens
tcttcttctaagaagaca

SEQ ID NO: 847765 - DNA, 21 bp, Homo sapiens
tcttcttctaagaagacattt

SEQ ID NO: 847766 - DNA, 15 bp, Homo sapiens
tcttcttcttcagaa

SEQ ID NO: 847767 - DNA, 16 bp, Homo sapiens
tcttcttgcatctaat

SEQ ID NO: 847768 - DNA, 23 bp, Homo sapiens
tcttcttgggagtatgttgtcat

SEQ ID NO: 847769 - DNA, 16 bp, Homo sapiens
tcttctttaagccata

SEQ ID NO: 847770 - DNA, 20 bp, Homo sapiens
tcttctttagatgccaaacc

SEQ ID NO: 847771 - DNA, 15 bp, Homo sapiens
tcttctttattgcac

SEQ ID NO: 847772 - DNA, 20 bp, Homo sapiens
tcttctttattgcactagga

SEQ ID NO: 847773 - DNA, 16 bp, Homo sapiens
tcttctttccattctt

SEQ ID NO: 847774 - DNA, 17 bp, Homo sapiens
tcttctttccattcttc

SEQ ID NO: 847775 - DNA, 11 bp, Homo sapiens
tcttctttccc

SEQ ID NO: 847776 - DNA, 18 bp, Homo sapiens
tcttctttcctttactcc

SEQ ID NO: 847777 - DNA, 13 bp, Homo sapiens
tcttctttctgaa

SEQ ID NO: 847778 - DNA, 22 bp, Homo sapiens
tcttctttctgaagatcaattt

SEQ ID NO: 847779 - DNA, 16 bp, Homo sapiens
tcttcttttggcttcc

SEQ ID NO: 847780 - DNA, 19 bp, Homo sapiens
tcttcttttgtggtgtctt

SEQ ID NO: 847781 - DNA, 22 bp, Homo sapiens
tcttcttttttaagttgtcaaa

SEQ ID NO: 847782 - DNA, 17 bp, Homo sapiens
tcttctttttttgtgat

SEQ ID NO: 847783 - DNA, 18 bp, Homo sapiens
tcttgaaaaagatggctt

SEQ ID NO: 847784 - DNA, 14 bp, Homo sapiens
tcttgaaaactgtg

SEQ ID NO: 847785 - DNA, 15 bp, Homo sapiens
tcttgaaaagccttg

SEQ ID NO: 847786 - DNA, 16 bp, Homo sapiens
tcttgaaaagccttgg

SEQ ID NO: 847787 - DNA, 12 bp, Homo sapiens
tcttgaaaagtt

SEQ ID NO: 847788 - DNA, 15 bp, Homo sapiens
tcttgaaaagttcag

SEQ ID NO: 847789 - DNA, 13 bp, Homo sapiens
tcttgaaaatatt

SEQ ID NO: 847790 - DNA, 12 bp, Homo sapiens
tcttgaaatgaa

SEQ ID NO: 847791 - DNA, 14 bp, Homo sapiens
tcttgaaattaaga

SEQ ID NO: 847792 - DNA, 21 bp, Homo sapiens
tcttgaaattaagaaggcaaa

SEQ ID NO: 847793 - DNA, 22 bp, Homo sapiens
tcttgaaattaagaaggcaaaa

SEQ ID NO: 847794 - DNA, 14 bp, Homo sapiens
tcttgaacctgtgc

SEQ ID NO: 847795 - DNA, 18 bp, Homo sapiens
tcttgaagctgggctgtc

SEQ ID NO: 847796 - DNA, 21 bp, Homo sapiens
tcttgaatagattttctctgg

SEQ ID NO: 847797 - DNA, 22 bp, Homo sapiens
tcttgaatagattttctctgga

SEQ ID NO: 847798 - DNA, 22 bp, Homo sapiens
tcttgaatctagggagggggaa

SEQ ID NO: 847799 - DNA, 18 bp, Homo sapiens
tcttgaatgtggtctcag

SEQ ID NO: 847800 - DNA, 12 bp, Homo sapiens
tcttgacaagct

SEQ ID NO: 847801 - DNA, 14 bp, Homo sapiens
tcttgacagcagga

SEQ ID NO: 847802 - DNA, 20 bp, Homo sapiens
tcttgacagtatatttgaaa

SEQ ID NO: 847803 - DNA, 23 bp, Homo sapiens
tcttgacagtatatttgaaactg

SEQ ID NO: 847804 - DNA, 16 bp, Homo sapiens
tcttgacatttatcac

SEQ ID NO: 847805 - DNA, 15 bp, Homo sapiens
tcttgactctaaatg

SEQ ID NO: 847806 - DNA, 17 bp, Homo sapiens
tcttgactctaaatgca

SEQ ID NO: 847807 - DNA, 18 bp, Homo sapiens
tcttgactctaaatgcag

SEQ ID NO: 847808 - DNA, 14 bp, Homo sapiens
tcttgactttctga

SEQ ID NO: 847809 - DNA, 15 bp, Homo sapiens
tcttgactttctgat

SEQ ID NO: 847810 - DNA, 17 bp, Homo sapiens
tcttgagcaagttcctt

SEQ ID NO: 847811 - DNA, 14 bp, Homo sapiens
tcttgagcagtggc

SEQ ID NO: 847812 - DNA, 22 bp, Homo sapiens
tcttgagcagtggctggtccag

SEQ ID NO: 847813 - DNA, 17 bp, Homo sapiens
tcttgagcatcaatctt

SEQ ID NO: 847814 - DNA, 20 bp, Homo sapiens
tcttgagcatcaatcttgtt

SEQ ID NO: 847815 - DNA, 17 bp, Homo sapiens
tcttgagccacagtcac

SEQ ID NO: 847816 - DNA, 18 bp, Homo sapiens
tcttgagccagtaatctt

SEQ ID NO: 847817 - DNA, 19 bp, Homo sapiens
tcttgaggaagcccaggct

SEQ ID NO: 847818 - DNA, 16 bp, Homo sapiens
tcttgaggccaggagt

SEQ ID NO: 847819 - DNA, 16 bp, Homo sapiens
tcttgaggcctgtgct

SEQ ID NO: 847820 - DNA, 14 bp, Homo sapiens
tcttgagggacaat

SEQ ID NO: 847821 - DNA, 20 bp, Homo sapiens
tcttgagtttgtcgctcatg

SEQ ID NO: 847822 - DNA, 18 bp, Homo sapiens
tcttgagttttgataaag

SEQ ID NO: 847823 - DNA, 21 bp, Homo sapiens
tcttgagttttgttttaaaat

SEQ ID NO: 847824 - DNA, 15 bp, Homo sapiens
tcttgatctctaatg

SEQ ID NO: 847825 - DNA, 16 bp, Homo sapiens
tcttgatctctaatga

SEQ ID NO: 847826 - DNA, 13 bp, Homo sapiens
tcttgatcttaaa

SEQ ID NO: 847827 - DNA, 16 bp, Homo sapiens
tcttgatcttaaagat

SEQ ID NO: 847828 - DNA, 13 bp, Homo sapiens
tcttgatctttga

SEQ ID NO: 847829 - DNA, 18 bp, Homo sapiens
tcttgatctttgagccca

SEQ ID NO: 847830 - DNA, 13 bp, Homo sapiens
tcttgatgcatgc

SEQ ID NO: 847831 - DNA, 23 bp, Homo sapiens
tctttcacattgtttgctgctat

SEQ ID NO: 847832 - DNA, 20 bp, Homo sapiens
tctttcaccaagatgggtgg

SEQ ID NO: 847833 - DNA, 16 bp, Homo sapiens
tctttcacttgaaaga

SEQ ID NO: 847834 - DNA, 19 bp, Homo sapiens
tctttcacttgatgtttgt

SEQ ID NO: 847835 - DNA, 20 bp, Homo sapiens
tctttcagctgaattatatt

SEQ ID NO: 847836 - DNA, 23 bp, Homo sapiens
tctttcagtacttttttaaatat

SEQ ID NO: 847837 - DNA, 14 bp, Homo sapiens
tctttcatacatat

SEQ ID NO: 847838 - DNA, 15 bp, Homo sapiens
tctttcatacatata

SEQ ID NO: 847839 - DNA, 21 bp, Homo sapiens
tctttcatacatatatatatt

SEQ ID NO: 847840 - DNA, 23 bp, Homo sapiens
tctttcatccactagtgcaaatc

SEQ ID NO: 847841 - DNA, 14 bp, Homo sapiens
tctttcatgtcttg

SEQ ID NO: 847842 - DNA, 17 bp, Homo sapiens
tctttcatgtcttgtca

SEQ ID NO: 847843 - DNA, 15 bp, Homo sapiens
tctttcattcttctc

SEQ ID NO: 847844 - DNA, 18 bp, Homo sapiens
tctttccaaaacatttct

SEQ ID NO: 847845 - DNA, 13 bp, Homo sapiens
tctttccaaagta

SEQ ID NO: 847846 - DNA, 11 bp, Homo sapiens
tctttccaaat

SEQ ID NO: 847847 - DNA, 12 bp, Homo sapiens
tctttccaaatt

SEQ ID NO: 847848 - DNA, 18 bp, Homo sapiens
tctttccaaattatttct

SEQ ID NO: 847849 - DNA, 15 bp, Homo sapiens
tctttccactctgga

SEQ ID NO: 847850 - DNA, 12 bp, Homo sapiens
tctttccaggct

SEQ ID NO: 847851 - DNA, 13 bp, Homo sapiens
tctttccaggctt

SEQ ID NO: 847852 - DNA, 22 bp, Homo sapiens
tctttccaggcttccctgactt

SEQ ID NO: 847853 - DNA, 19 bp, Homo sapiens
tctttccattatgattctt

SEQ ID NO: 847854 - DNA, 20 bp, Homo sapiens
tctttccattcttcttgcta

SEQ ID NO: 847855 - DNA, 15 bp, Homo sapiens
tctttcccaccctcc

SEQ ID NO: 847856 - DNA, 16 bp, Homo sapiens
tctttcccaccctcca

SEQ ID NO: 847857 - DNA, 13 bp, Homo sapiens
tctttccccagag

SEQ ID NO: 847858 - DNA, 14 bp, Homo sapiens
tctttccccagagg

SEQ ID NO: 847859 - DNA, 22 bp, Homo sapiens
tctttccccagcagtttctgtc

SEQ ID NO: 847860 - DNA, 23 bp, Homo sapiens
tctttcccccaccctactccctc

SEQ ID NO: 847861 - DNA, 16 bp, Homo sapiens
tctttcccctcagagc

SEQ ID NO: 847862 - DNA, 18 bp, Homo sapiens
tctttcccctcagagctc

SEQ ID NO: 847863 - DNA, 13 bp, Homo sapiens
tctttcccctcct

SEQ ID NO: 847864 - DNA, 19 bp, Homo sapiens
tctttcccctcctttgtct

SEQ ID NO: 847865 - DNA, 11 bp, Homo sapiens
tctttccctgg

SEQ ID NO: 847866 - DNA, 12 bp, Homo sapiens
tctttccctgga

SEQ ID NO: 847867 - DNA, 14 bp, Homo sapiens
tctttccgacacat

SEQ ID NO: 847868 - DNA, 21 bp, Homo sapiens
tctttccgacacatttaccaa

SEQ ID NO: 847869 - DNA, 21 bp, Homo sapiens
tctttccgtcaccctggggat

SEQ ID NO: 847870 - DNA, 15 bp, Homo sapiens
tctttcctaaagcca

SEQ ID NO: 847871 - DNA, 16 bp, Homo sapiens
tctttcctaaagccaa

SEQ ID NO: 847872 - DNA, 23 bp, Homo sapiens
tctttcctaaggctgcaaggttt

SEQ ID NO: 847873 - DNA, 14 bp, Homo sapiens
tctttcctatttca

SEQ ID NO: 847874 - DNA, 24 bp, Homo sapiens
tctttcctatttcagtgttacctg

SEQ ID NO: 847875 - DNA, 14 bp, Homo sapiens
tctttcctcaagta

SEQ ID NO: 847876 - DNA, 21 bp, Homo sapiens
tctttcctcaagtatcttcta

SEQ ID NO: 847877 - DNA, 22 bp, Homo sapiens
tctttcctcttccccttgccct

SEQ ID NO: 847878 - DNA, 23 bp, Homo sapiens
tctttcctcttccccttgccctt

SEQ ID NO: 847879 - DNA, 17 bp, Homo sapiens
tctttcctctttctgct

SEQ ID NO: 847880 - DNA, 23 bp, Homo sapiens
tctttcctctttctgctctgcca

SEQ ID NO: 847881 - DNA, 12 bp, Homo sapiens
tctttcctgccc

SEQ ID NO: 847882 - DNA, 11 bp, Homo sapiens
tctttcctgtc

SEQ ID NO: 847883 - DNA, 10 bp, Homo sapiens
tctttccttg

SEQ ID NO: 847884 - DNA, 20 bp, Homo sapiens
tctttcctttactcctggct

SEQ ID NO: 847885 - DNA, 16 bp, Homo sapiens
tctttctaactgtagc

SEQ ID NO: 847886 - DNA, 17 bp, Homo sapiens
tctttctacatgactgg

SEQ ID NO: 847887 - DNA, 10 bp, Homo sapiens
tctttctata

SEQ ID NO: 847888 - DNA, 15 bp, Homo sapiens
tctttctattccaaa

SEQ ID NO: 847889 - DNA, 16 bp, Homo sapiens
tctttctcataaaact

SEQ ID NO: 847890 - DNA, 12 bp, Homo sapiens
tctttctcctgg

SEQ ID NO: 847891 - DNA, 15 bp, Homo sapiens
tctttctcctggtga

SEQ ID NO: 847892 - DNA, 15 bp, Homo sapiens
tctttctctcagtga

SEQ ID NO: 847893 - DNA, 15 bp, Homo sapiens
tctttctctcctttc

SEQ ID NO: 847894 - DNA, 15 bp, Homo sapiens
tctttctctgaggac

SEQ ID NO: 847895 - DNA, 13 bp, Homo sapiens
tctttctctgcca

SEQ ID NO: 847896 - DNA, 16 bp, Homo sapiens
tctttctctgccagtg

SEQ ID NO: 847897 - DNA, 14 bp, Homo sapiens
tctttctctggtgg

SEQ ID NO: 847898 - DNA, 16 bp, Homo sapiens
tctttctcttacctgt

SEQ ID NO: 847899 - DNA, 13 bp, Homo sapiens
tctttctgctttg

SEQ ID NO: 847900 - DNA, 18 bp, Homo sapiens
tctttctggcctgccttc

SEQ ID NO: 847901 - DNA, 19 bp, Homo sapiens
tctttctggctatgcattt

SEQ ID NO: 847902 - DNA, 23 bp, Homo sapiens
tctttctggtgttttatttccta

SEQ ID NO: 847903 - DNA, 10 bp, Homo sapiens
tctttctgta

SEQ ID NO: 847904 - DNA, 19 bp, Homo sapiens
tctttctgtgcttggattt

SEQ ID NO: 847905 - DNA, 16 bp, Homo sapiens
tctttcttccattcct

SEQ ID NO: 847906 - DNA, 13 bp, Homo sapiens
tctttcttcctct

SEQ ID NO: 847907 - DNA, 17 bp, Homo sapiens
tctttcttcctctgctg

SEQ ID NO: 847908 - DNA, 15 bp, Homo sapiens
tctttcttcctcttc

SEQ ID NO: 847909 - DNA, 12 bp, Homo sapiens
tctttcttcctt

SEQ ID NO: 847910 - DNA, 15 bp, Homo sapiens
tctttcttcctttct

SEQ ID NO: 847911 - DNA, 21 bp, Homo sapiens
tctttcttgctggctctgaga

SEQ ID NO: 847912 - DNA, 22 bp, Homo sapiens
tctttcttgctggctctgagaa

SEQ ID NO: 847913 - DNA, 22 bp, Homo sapiens
tctttcttgggatagtgttctg

SEQ ID NO: 847914 - DNA, 18 bp, Homo sapiens
tctttctttccaaaacat

SEQ ID NO: 847915 - DNA, 13 bp, Homo sapiens
tctttctttccat

SEQ ID NO: 847916 - DNA, 12 bp, Homo sapiens
tctttctttgga

SEQ ID NO: 847917 - DNA, 23 bp, Homo sapiens
tctttctttgtttctttcttcct

SEQ ID NO: 847918 - DNA, 18 bp, Homo sapiens
tctttgaaaacagatgac

SEQ ID NO: 847919 - DNA, 12 bp, Homo sapiens
tctttgaaataa

SEQ ID NO: 847920 - DNA, 14 bp, Homo sapiens
tctttgaacatgaa

SEQ ID NO: 847921 - DNA, 15 bp, Homo sapiens
tctttgaagaaaaga

SEQ ID NO: 847922 - DNA, 14 bp, Homo sapiens
tctttgaatgcttt

SEQ ID NO: 847923 - DNA, 19 bp, Homo sapiens
tctttgacaactaaaatta

SEQ ID NO: 847924 - DNA, 18 bp, Homo sapiens
tctttgacaattctgggt

SEQ ID NO: 847925 - DNA, 20 bp, Homo sapiens
tctttgacaattctgggtgc

SEQ ID NO: 847926 - DNA, 16 bp, Homo sapiens
tctttgaccagatctt

SEQ ID NO: 847927 - DNA, 17 bp, Homo sapiens
tctttgacctcaatgga

SEQ ID NO: 847928 - DNA, 20 bp, Homo sapiens
tctttgatacttgttcaaaa

SEQ ID NO: 847929 - DNA, 15 bp, Homo sapiens
tctttgatccttctc

SEQ ID NO: 847930 - DNA, 16 bp, Homo sapiens
tctttgatccttctga

SEQ ID NO: 847931 - DNA, 19 bp, Homo sapiens
tctttgatttgtaccattc

SEQ ID NO: 847932 - DNA, 18 bp, Homo sapiens
tctttgcaaaccctggtg

SEQ ID NO: 847933 - DNA, 21 bp, Homo sapiens
tctttgcaaagtattgtaaat

SEQ ID NO: 847934 - DNA, 22 bp, Homo sapiens
tctttgcaaagtattgtaaatt

SEQ ID NO: 847935 - DNA, 16 bp, Homo sapiens
tctttgcacaatgatt

SEQ ID NO: 847936 - DNA, 19 bp, Homo sapiens
tctttgcaccaaagacatc

SEQ ID NO: 847937 - DNA, 21 bp, Homo sapiens
tctttgcattccttacttgca

SEQ ID NO: 847938 - DNA, 13 bp, Homo sapiens
tctttgctgcaga

SEQ ID NO: 847939 - DNA, 13 bp, Homo sapiens
tctttgctgcccc

SEQ ID NO: 847940 - DNA, 15 bp, Homo sapiens
tctttgctgcccctg

SEQ ID NO: 847941 - DNA, 18 bp, Homo sapiens
tctttgctgcccctgtct

SEQ ID NO: 847942 - DNA, 21 bp, Homo sapiens
tctttgctgcccctgtctgga

SEQ ID NO: 847943 - DNA, 18 bp, Homo sapiens
tctttgctgctgctctca

SEQ ID NO: 847944 - DNA, 15 bp, Homo sapiens
tctttgctgtactct

SEQ ID NO: 847945 - DNA, 15 bp, Homo sapiens
tctttggaacagata

SEQ ID NO: 847946 - DNA, 15 bp, Homo sapiens
tctttggaagcagcc

SEQ ID NO: 847947 - DNA, 17 bp, Homo sapiens
tctttggaaggagtgag

SEQ ID NO: 847948 - DNA, 22 bp, Homo sapiens
tctttggagaaatgcttagaaa

SEQ ID NO: 847949 - DNA, 19 bp, Homo sapiens
tctttggataataggaatt

SEQ ID NO: 847950 - DNA, 20 bp, Homo sapiens
tctttgggcctctcctgccc

SEQ ID NO: 847951 - DNA, 18 bp, Homo sapiens
tctttggggtcagccagg

SEQ ID NO: 847952 - DNA, 21 bp, Homo sapiens
tctttggggtcagccagggcc

SEQ ID NO: 847953 - DNA, 17 bp, Homo sapiens
tctttggtgtacagact

SEQ ID NO: 847954 - DNA, 13 bp, Homo sapiens
tgaaaccaaaaag

SEQ ID NO: 847955 - DNA, 18 bp, Homo sapiens
tgaaaccccgtctctact

SEQ ID NO: 847956 - DNA, 11 bp, Homo sapiens
tgaaacccttt

SEQ ID NO: 847957 - DNA, 16 bp, Homo sapiens
tgaaacctcagggctg

SEQ ID NO: 847958 - DNA, 19 bp, Homo sapiens
tgaaacctgttaaaacaac

SEQ ID NO: 847959 - DNA, 18 bp, Homo sapiens
tgaaacctttagggcagc

SEQ ID NO: 847960 - DNA, 20 bp, Homo sapiens
tgaaacgactcaaaatgaca

SEQ ID NO: 847961 - DNA, 19 bp, Homo sapiens
tgaaactcctgattttgta

SEQ ID NO: 847962 - DNA, 13 bp, Homo sapiens
tgaaactctctgt

SEQ ID NO: 847963 - DNA, 17 bp, Homo sapiens
tgaaactggattaaact

SEQ ID NO: 847964 - DNA, 14 bp, Homo sapiens
tgaaacttttctaa

SEQ ID NO: 847965 - DNA, 15 bp, Homo sapiens
tgaaacttttctaaa

SEQ ID NO: 847966 - DNA, 17 bp, Homo sapiens
tgaaacttttctaaagt

SEQ ID NO: 847967 - DNA, 15 bp, Homo sapiens
tgaaacttttctaga

SEQ ID NO: 847968 - DNA, 17 bp, Homo sapiens
tgaaacttttctagaat

SEQ ID NO: 847969 - DNA, 22 bp, Homo sapiens
tgaaagaaacagttaactttca

SEQ ID NO: 847970 - DNA, 20 bp, Homo sapiens
tgaaagaaagctgagaagaa

SEQ ID NO: 847971 - DNA, 20 bp, Homo sapiens
tgaaagaacatggacttgta

SEQ ID NO: 847972 - DNA, 22 bp, Homo sapiens
tgaaagactgaagaaagtgtag

SEQ ID NO: 847973 - DNA, 15 bp, Homo sapiens
tgaaagactgtacaa

SEQ ID NO: 847974 - DNA, 13 bp, Homo sapiens
tgaaagagaacca

SEQ ID NO: 847975 - DNA, 16 bp, Homo sapiens
tgaaagagaaccagtt

SEQ ID NO: 847976 - DNA, 23 bp, Homo sapiens
tgaaagaggaggacccctgcctt

SEQ ID NO: 847977 - DNA, 21 bp, Homo sapiens
tgaaagaggctgaggcctgga

SEQ ID NO: 847978 - DNA, 19 bp, Homo sapiens
tgaaagatctctgtcacat

SEQ ID NO: 847979 - DNA, 18 bp, Homo sapiens
tgaaagatggctgtgcct

SEQ ID NO: 847980 - DNA, 22 bp, Homo sapiens
tgaaagatggctgtgcctctgc

SEQ ID NO: 847981 - DNA, 23 bp, Homo sapiens
tgaaagattatgatgcatacagt

SEQ ID NO: 847982 - DNA, 14 bp, Homo sapiens
tgaaagcagcagct

SEQ ID NO: 847983 - DNA, 17 bp, Homo sapiens
tgaaagcagcagctagg

SEQ ID NO: 847984 - DNA, 18 bp, Homo sapiens
tgaaagcagtaaccaaga

SEQ ID NO: 847985 - DNA, 17 bp, Homo sapiens
tgaaagcatccatgtgt

SEQ ID NO: 847986 - DNA, 23 bp, Homo sapiens
tgaaagccaaggcagctcttctg

SEQ ID NO: 847987 - DNA, 18 bp, Homo sapiens
tgaaagccctgagctttc

SEQ ID NO: 847988 - DNA, 12 bp, Homo sapiens
tgaaagcctcac

SEQ ID NO: 847989 - DNA, 15 bp, Homo sapiens
tgaaagcctctggaa

SEQ ID NO: 847990 - DNA, 13 bp, Homo sapiens
tgaaagcctgtct

SEQ ID NO: 847991 - DNA, 15 bp, Homo sapiens
tgaaagcctgtctct

SEQ ID NO: 847992 - DNA, 16 bp, Homo sapiens
tgaaagcctgtctctt

SEQ ID NO: 847993 - DNA, 16 bp, Homo sapiens
tgaaagctgaaaagca

SEQ ID NO: 847994 - DNA, 18 bp, Homo sapiens
tgaaagctgattactgtc

SEQ ID NO: 847995 - DNA, 22 bp, Homo sapiens
tgaaagctgattactgtcaata

SEQ ID NO: 847996 - DNA, 18 bp, Homo sapiens
tgaaaggaaatacacttc

SEQ ID NO: 847997 - DNA, 14 bp, Homo sapiens
tgaaaggagacatt

SEQ ID NO: 847998 - DNA, 21 bp, Homo sapiens
tgaaaggctatcctgctgaaa

SEQ ID NO: 847999 - DNA, 20 bp, Homo sapiens
tgaaagggcccttcccctcc

SEQ ID NO: 848000 - DNA, 19 bp, Homo sapiens
tgaaagggctatggcaagg

SEQ ID NO: 848001 - DNA, 22 bp, Homo sapiens
tgaaagggctatggcaaggggg

SEQ ID NO: 848002 - DNA, 21 bp, Homo sapiens
tgaaagggtttgatatggaga

SEQ ID NO: 848003 - DNA, 16 bp, Homo sapiens
tgaaaggtaatttgag

SEQ ID NO: 848004 - DNA, 18 bp, Homo sapiens
tgaaaggtagacttttat

SEQ ID NO: 848005 - DNA, 23 bp, Homo sapiens
tgaaaggtgctatataattgtga

SEQ ID NO: 848006 - DNA, 19 bp, Homo sapiens
tgaaagtaaaacaatttat

SEQ ID NO: 848007 - DNA, 21 bp, Homo sapiens
tgaaagtagagctagctgcca

SEQ ID NO: 848008 - DNA, 15 bp, Homo sapiens
tgaaagtagggggct

SEQ ID NO: 848009 - DNA, 16 bp, Homo sapiens
tgaaagtattcagaaa

SEQ ID NO: 848010 - DNA, 19 bp, Homo sapiens
tgaaagtcacggctgcgca

SEQ ID NO: 848011 - DNA, 20 bp, Homo sapiens
tgaaagtcagctgaaggatg

SEQ ID NO: 848012 - DNA, 18 bp, Homo sapiens
tgaaagtccagaaactgt

SEQ ID NO: 848013 - DNA, 17 bp, Homo sapiens
tgaaagtcctgctttcc

SEQ ID NO: 848014 - DNA, 16 bp, Homo sapiens
tgaaagtctgtccttg

SEQ ID NO: 848015 - DNA, 17 bp, Homo sapiens
tgaaagtctgtccttga

SEQ ID NO: 848016 - DNA, 23 bp, Homo sapiens
tgaaagtctgtccttgaaggact

SEQ ID NO: 848017 - DNA, 19 bp, Homo sapiens
tgaaagtgaggaaataaag

SEQ ID NO: 848018 - DNA, 12 bp, Homo sapiens
tgaaagttgctt

SEQ ID NO: 848019 - DNA, 20 bp, Homo sapiens
tgaaagttgcttttattgca

SEQ ID NO: 848020 - DNA, 15 bp, Homo sapiens
tgaaagtttaacaaa

SEQ ID NO: 848021 - DNA, 22 bp, Homo sapiens
tgaaagtttaacaaatgactgt

SEQ ID NO: 848022 - DNA, 18 bp, Homo sapiens
tgaaagttttcagaacct

SEQ ID NO: 848023 - DNA, 19 bp, Homo sapiens
tgaaagttttccagtattg

SEQ ID NO: 848024 - DNA, 22 bp, Homo sapiens
tgaaataaaactggctttggct

SEQ ID NO: 848025 - DNA, 19 bp, Homo sapiens
tgaaataaaattacacagt

SEQ ID NO: 848026 - DNA, 19 bp, Homo sapiens
tgaaataaacctgcactga

SEQ ID NO: 848027 - DNA, 21 bp, Homo sapiens
tgaaataaagaaattgcaata

SEQ ID NO: 848028 - DNA, 21 bp, Homo sapiens
tgaaataaagacccaggggga

SEQ ID NO: 848029 - DNA, 13 bp, Homo sapiens
tgaaataaatgtt

SEQ ID NO: 848030 - DNA, 22 bp, Homo sapiens
tgaaataaatgtttcaaatgca

SEQ ID NO: 848031 - DNA, 15 bp, Homo sapiens
tgaaataaattctga

SEQ ID NO: 848032 - DNA, 19 bp, Homo sapiens
tgaaataataaaatgcaaa

SEQ ID NO: 848033 - DNA, 14 bp, Homo sapiens
tgaaataataaatc

SEQ ID NO: 848034 - DNA, 11 bp, Homo sapiens
tgaaataattt

SEQ ID NO: 848035 - DNA, 18 bp, Homo sapiens
tgaaataatttttaactt

SEQ ID NO: 848036 - DNA, 23 bp, Homo sapiens
tgaaataccagtgaaccaaagag

SEQ ID NO: 848037 - DNA, 16 bp, Homo sapiens
tgaaataccagtgtgg

SEQ ID NO: 848038 - DNA, 17 bp, Homo sapiens
tgaaataccttttctca

SEQ ID NO: 848039 - DNA, 18 bp, Homo sapiens
tgaaatactttttaacaa

SEQ ID NO: 848040 - DNA, 22 bp, Homo sapiens
tgaaataggagggaaacctttg

SEQ ID NO: 848041 - DNA, 15 bp, Homo sapiens
tgaaatagttctgcc

SEQ ID NO: 848042 - DNA, 11 bp, Homo sapiens
tgaaatataat

SEQ ID NO: 848043 - DNA, 16 bp, Homo sapiens
tgaaatatatgtgaaa

SEQ ID NO: 848044 - DNA, 16 bp, Homo sapiens
tgaaatatgatgttaa

SEQ ID NO: 848045 - DNA, 20 bp, Homo sapiens
tgaaatatgatgttaaaaaa

SEQ ID NO: 848046 - DNA, 15 bp, Homo sapiens
tgaaatatgcatact

SEQ ID NO: 848047 - DNA, 19 bp, Homo sapiens
tgaaatatgcatactaatt

SEQ ID NO: 848048 - DNA, 14 bp, Homo sapiens
tgaaatcagcatga

SEQ ID NO: 848049 - DNA, 18 bp, Homo sapiens
tgaaatcagtatcagaat

SEQ ID NO: 848050 - DNA, 22 bp, Homo sapiens
tgaaatcagtatcagaatactt

SEQ ID NO: 848051 - DNA, 14 bp, Homo sapiens
tgaaatccaggaat

SEQ ID NO: 848052 - DNA, 18 bp, Homo sapiens
tgaaatcccatctctaca

SEQ ID NO: 848053 - DNA, 17 bp, Homo sapiens
tgaaatctaggaaaatt

SEQ ID NO: 848054 - DNA, 16 bp, Homo sapiens
tgaaatctcagaattc

SEQ ID NO: 848055 - DNA, 19 bp, Homo sapiens
tgaaatctcagatacttat

SEQ ID NO: 848056 - DNA, 23 bp, Homo sapiens
tgaaatctcagatacttatgaaa

SEQ ID NO: 848057 - DNA, 19 bp, Homo sapiens
tgaaatctgctagaaagtt

SEQ ID NO: 848058 - DNA, 15 bp, Homo sapiens
tgaaatctttctttc

SEQ ID NO: 848059 - DNA, 19 bp, Homo sapiens
tgaaatgaaaacatgtaat

SEQ ID NO: 848060 - DNA, 20 bp, Homo sapiens
tgaaatgaaaacatgtaata

SEQ ID NO: 848061 - DNA, 13 bp, Homo sapiens
tgaaatgaatgaa

SEQ ID NO: 848062 - DNA, 17 bp, Homo sapiens
tgaaatgagcacctcca

SEQ ID NO: 848063 - DNA, 21 bp, Homo sapiens
tgaaatgagcacctccattaa

SEQ ID NO: 848064 - DNA, 13 bp, Homo sapiens
tgaaatgagtaaa

SEQ ID NO: 848065 - DNA, 18 bp, Homo sapiens
tgaaatgagtaaaaacta

SEQ ID NO: 848066 - DNA, 19 bp, Homo sapiens
tgaaatgagtaaaaactag

SEQ ID NO: 848067 - DNA, 15 bp, Homo sapiens
tgaaatgataaagac

SEQ ID NO: 848068 - DNA, 16 bp, Homo sapiens
tgaaatgataaagact

SEQ ID NO: 848069 - DNA, 15 bp, Homo sapiens
tgaaatgattggaat

SEQ ID NO: 848070 - DNA, 13 bp, Homo sapiens
tgaaatgcactgt

SEQ ID NO: 848071 - DNA, 13 bp, Homo sapiens
tgaaatgcatatt

SEQ ID NO: 848072 - DNA, 22 bp, Homo sapiens
tgaaatgccaagtgcctgctta

SEQ ID NO: 848073 - DNA, 20 bp, Homo sapiens
tgaaatgccctcctaaatgt

SEQ ID NO: 848074 - DNA, 23 bp, Homo sapiens
tgaaatgcttatgcttgtgtata

SEQ ID NO: 848075 - DNA, 20 bp, Homo sapiens
tgaagaactgcaggccctgg

SEQ ID NO: 848076 - DNA, 23 bp, Homo sapiens
tgaagaagaaccagcccagcctg

SEQ ID NO: 848077 - DNA, 22 bp, Homo sapiens
tgaagaaggggctgttcttcca

SEQ ID NO: 848078 - DNA, 19 bp, Homo sapiens
tgaagaatacttctcattt

SEQ ID NO: 848079 - DNA, 16 bp, Homo sapiens
tgaagaatagaaacaa

SEQ ID NO: 848080 - DNA, 23 bp, Homo sapiens
tgaagaatcacgatttcatcctt

SEQ ID NO: 848081 - DNA, 20 bp, Homo sapiens
tgaagaatctacttaaccct

SEQ ID NO: 848082 - DNA, 12 bp, Homo sapiens
tgaagaatctta

SEQ ID NO: 848083 - DNA, 11 bp, Homo sapiens
tgaagaattaa

SEQ ID NO: 848084 - DNA, 12 bp, Homo sapiens
tgaagaattatt

SEQ ID NO: 848085 - DNA, 21 bp, Homo sapiens
tgaagacaatgacttactgta

SEQ ID NO: 848086 - DNA, 22 bp, Homo sapiens
tgaagacaatgacttactgtac

SEQ ID NO: 848087 - DNA, 21 bp, Homo sapiens
tgaagacaatttgatacataa

SEQ ID NO: 848088 - DNA, 21 bp, Homo sapiens
tgaagacagagcaaagcgccc

SEQ ID NO: 848089 - DNA, 14 bp, Homo sapiens
tgaagacagaggga

SEQ ID NO: 848090 - DNA, 14 bp, Homo sapiens
tgaagacaggacag

SEQ ID NO: 848091 - DNA, 13 bp, Homo sapiens
tgaagacccagga

SEQ ID NO: 848092 - DNA, 16 bp, Homo sapiens
tgaagacctaaagtgc

SEQ ID NO: 848093 - DNA, 20 bp, Homo sapiens
tgaagacgagcatccccctc

SEQ ID NO: 848094 - DNA, 18 bp, Homo sapiens
tgaagacgtggactcctc

SEQ ID NO: 848095 - DNA, 21 bp, Homo sapiens
tgaagactagccccttttctg

SEQ ID NO: 848096 - DNA, 17 bp, Homo sapiens
tgaagactatgaaaatg

SEQ ID NO: 848097 - DNA, 14 bp, Homo sapiens
tgaagactgaggac

SEQ ID NO: 848098 - DNA, 15 bp, Homo sapiens
tgaagactggaagct

SEQ ID NO: 848099 - DNA, 19 bp, Homo sapiens
tgaagagaagcaattttgg

SEQ ID NO: 848100 - DNA, 23 bp, Homo sapiens
tgaagagaccaagactctgaaat

SEQ ID NO: 848101 - DNA, 12 bp, Homo sapiens
tgaagagaggga

SEQ ID NO: 848102 - DNA, 23 bp, Homo sapiens
tgaagagagggacaggcactcca

SEQ ID NO: 848103 - DNA, 13 bp, Homo sapiens
tgaagagcgctcc

SEQ ID NO: 848104 - DNA, 20 bp, Homo sapiens
tgaagagcgctcctctgcct

SEQ ID NO: 848105 - DNA, 21 bp, Homo sapiens
tgaagagcgctcctctgcctt

SEQ ID NO: 848106 - DNA, 15 bp, Homo sapiens
tgaagagctagagaa

SEQ ID NO: 848107 - DNA, 14 bp, Homo sapiens
tgaagagctgtctt

SEQ ID NO: 848108 - DNA, 15 bp, Homo sapiens
tgaagagctgtcttc

SEQ ID NO: 848109 - DNA, 20 bp, Homo sapiens
tgaagagctgtcttcccctg

SEQ ID NO: 848110 - DNA, 21 bp, Homo sapiens
tgaagagctgtcttcccctga

SEQ ID NO: 848111 - DNA, 18 bp, Homo sapiens
tgaagaggaacagtgtgg

SEQ ID NO: 848112 - DNA, 20 bp, Homo sapiens
tgaagaggagattggccagt

SEQ ID NO: 848113 - DNA, 23 bp, Homo sapiens
tgaagaggagattggccagtgag

SEQ ID NO: 848114 - DNA, 23 bp, Homo sapiens
tgaagaggcctaagtcaaaactt

SEQ ID NO: 848115 - DNA, 19 bp, Homo sapiens
tgaagaggcgggccagcca

SEQ ID NO: 848116 - DNA, 17 bp, Homo sapiens
tgaagagggagaaggga

SEQ ID NO: 848117 - DNA, 12 bp, Homo sapiens
tgaagaggggca

SEQ ID NO: 848118 - DNA, 23 bp, Homo sapiens
tgaagagtaagtcaacctgcctg

SEQ ID NO: 848119 - DNA, 23 bp, Homo sapiens
tgaagagtaatcaatctactcaa

SEQ ID NO: 848120 - DNA, 15 bp, Homo sapiens
tgaagagtatccttc

SEQ ID NO: 848121 - DNA, 19 bp, Homo sapiens
tgaagagtatccttccttc

SEQ ID NO: 848122 - DNA, 12 bp, Homo sapiens
tgaagagtcaga

SEQ ID NO: 848123 - DNA, 20 bp, Homo sapiens
tgaagagtcagaactaactt

SEQ ID NO: 848124 - DNA, 23 bp, Homo sapiens
tgaagagtcctctgaatgaacct

SEQ ID NO: 848125 - DNA, 18 bp, Homo sapiens
tgaagagtcgattatttc

SEQ ID NO: 848126 - DNA, 16 bp, Homo sapiens
tgaagagtgagagggc

SEQ ID NO: 848127 - DNA, 17 bp, Homo sapiens
tgaagagtgagagggca

SEQ ID NO: 848128 - DNA, 15 bp, Homo sapiens
tgaagagtttcacaa

SEQ ID NO: 848129 - DNA, 21 bp, Homo sapiens
tgaagataagtgtatttttca

SEQ ID NO: 848130 - DNA, 16 bp, Homo sapiens
tgaagatatatttcac

SEQ ID NO: 848131 - DNA, 16 bp, Homo sapiens
tgaagatatcttgaaa

SEQ ID NO: 848132 - DNA, 22 bp, Homo sapiens
tgaagatatcttgaaatgaaag

SEQ ID NO: 848133 - DNA, 22 bp, Homo sapiens
tgaagatcaagccagttctcct

SEQ ID NO: 848134 - DNA, 12 bp, Homo sapiens
tgaagatgaaat

SEQ ID NO: 848135 - DNA, 17 bp, Homo sapiens
tgaagatggcatcctgt

SEQ ID NO: 848136 - DNA, 22 bp, Homo sapiens
tgaagatggcatcctgtgaagt

SEQ ID NO: 848137 - DNA, 15 bp, Homo sapiens
tgaagatggtttcaa

SEQ ID NO: 848138 - DNA, 19 bp, Homo sapiens
tgaagatgtctcctcaagc

SEQ ID NO: 848139 - DNA, 23 bp, Homo sapiens
tgaagatgtctcctcaagcctgt

SEQ ID NO: 848140 - DNA, 16 bp, Homo sapiens
tgaagatgttaaaatc

SEQ ID NO: 848141 - DNA, 18 bp, Homo sapiens
tgaagattatttcattcg

SEQ ID NO: 848142 - DNA, 18 bp, Homo sapiens
tgaagattctcctgtgct

SEQ ID NO: 848143 - DNA, 21 bp, Homo sapiens
tgaagattctttcccaattca

SEQ ID NO: 848144 - DNA, 22 bp, Homo sapiens
tgaagcaaactctaaaattata

SEQ ID NO: 848145 - DNA, 17 bp, Homo sapiens
tgaagcaaagcaccagc

SEQ ID NO: 848146 - DNA, 14 bp, Homo sapiens
tgaagcaagagtga

SEQ ID NO: 848147 - DNA, 14 bp, Homo sapiens
tgaagcaaggaaga

SEQ ID NO: 848148 - DNA, 18 bp, Homo sapiens
tgaagcaataactccaag

SEQ ID NO: 848149 - DNA, 23 bp, Homo sapiens
tgaagcacctactatgtgctggg

SEQ ID NO: 848150 - DNA, 19 bp, Homo sapiens
tgaagcagatttatttttg

SEQ ID NO: 848151 - DNA, 17 bp, Homo sapiens
tgaagcagcactgtgag

SEQ ID NO: 848152 - DNA, 18 bp, Homo sapiens
tgaagcagcagccaccag

SEQ ID NO: 848153 - DNA, 19 bp, Homo sapiens
tgaagcaggttcccaagct

SEQ ID NO: 848154 - DNA, 14 bp, Homo sapiens
tgaagcagtatttt

SEQ ID NO: 848155 - DNA, 15 bp, Homo sapiens
tgaagcagtattttg

SEQ ID NO: 848156 - DNA, 18 bp, Homo sapiens
tgaagcagtgcctcgagg

SEQ ID NO: 848157 - DNA, 23 bp, Homo sapiens
tgaagcagtgcctcgaggcaccg

SEQ ID NO: 848158 - DNA, 17 bp, Homo sapiens
tgaagcagttgtgtcag

SEQ ID NO: 848159 - DNA, 17 bp, Homo sapiens
tgaagcataatttgttt

SEQ ID NO: 848160 - DNA, 23 bp, Homo sapiens
tgaagcataatttgtttaaaatt

SEQ ID NO: 848161 - DNA, 23 bp, Homo sapiens
tgaagcatagctacaatttgttt

SEQ ID NO: 848162 - DNA, 19 bp, Homo sapiens
tgaagcatgctttgctgct

SEQ ID NO: 848163 - DNA, 18 bp, Homo sapiens
tgaagcatttcaaagccc

SEQ ID NO: 848164 - DNA, 11 bp, Homo sapiens
tgaagccaaag

SEQ ID NO: 848165 - DNA, 21 bp, Homo sapiens
tgaagccaagtggggtgctgg

SEQ ID NO: 848166 - DNA, 17 bp, Homo sapiens
tgaagccacttggccca

SEQ ID NO: 848167 - DNA, 11 bp, Homo sapiens
tgaagccagct

SEQ ID NO: 848168 - DNA, 16 bp, Homo sapiens
tgaagccatgtagcca

SEQ ID NO: 848169 - DNA, 16 bp, Homo sapiens
tgaagcccaagaagtt

SEQ ID NO: 848170 - DNA, 21 bp, Homo sapiens
tgaagcccaggctgatgcttg

SEQ ID NO: 848171 - DNA, 16 bp, Homo sapiens
tgaagccctccaaaag

SEQ ID NO: 848172 - DNA, 16 bp, Homo sapiens
tgaagccgccagttca

SEQ ID NO: 848173 - DNA, 19 bp, Homo sapiens
tgaagcctctctccttggc

SEQ ID NO: 848174 - DNA, 19 bp, Homo sapiens
tgaagcctctgccctgcct

SEQ ID NO: 848175 - DNA, 20 bp, Homo sapiens
tgaagcctggattccagcag

SEQ ID NO: 848176 - DNA, 15 bp, Homo sapiens
tgaagccttcttctg

SEQ ID NO: 848177 - DNA, 18 bp, Homo sapiens
tgaagccttcttctgcca

SEQ ID NO: 848178 - DNA, 19 bp, Homo sapiens
tgaagccttcttctgccac

SEQ ID NO: 848179 - DNA, 21 bp, Homo sapiens
tgaagcctttggtgaattcct

SEQ ID NO: 848180 - DNA, 21 bp, Homo sapiens
tgaagcgaaacacagagaagc

SEQ ID NO: 848181 - DNA, 13 bp, Homo sapiens
tgaagcgtgtttt

SEQ ID NO: 848182 - DNA, 10 bp, Homo sapiens
tgaagctaat

SEQ ID NO: 848183 - DNA, 14 bp, Homo sapiens
tgaagctactgtgt

SEQ ID NO: 848184 - DNA, 22 bp, Homo sapiens
tgaagctactgtgtgtgtgaat

SEQ ID NO: 848185 - DNA, 14 bp, Homo sapiens
tgaagctgcagtga

SEQ ID NO: 848186 - DNA, 12 bp, Homo sapiens
tgaagctgctgt

SEQ ID NO: 848187 - DNA, 16 bp, Homo sapiens
tgaagctgctgtgtcc

SEQ ID NO: 848188 - DNA, 19 bp, Homo sapiens
tgaagctggagcagcggat

SEQ ID NO: 848189 - DNA, 15 bp, Homo sapiens
tgaagctggcctgga

SEQ ID NO: 848190 - DNA, 11 bp, Homo sapiens
tgaagctgggc

SEQ ID NO: 848191 - DNA, 14 bp, Homo sapiens
tgaagctgggctgt

SEQ ID NO: 848192 - DNA, 19 bp, Homo sapiens
tgaagctgggctgtctctc

SEQ ID NO: 848193 - DNA, 14 bp, Homo sapiens
tgaagcttgactcc

SEQ ID NO: 848194 - DNA, 21 bp, Homo sapiens
tgaaggaaaaacacaagcaaa

SEQ ID NO: 848195 - DNA, 14 bp, Homo sapiens
tgaaggaagagaag

SEQ ID NO: 848196 - DNA, 12 bp, Homo sapiens
tgaatgtgtcag

SEQ ID NO: 848197 - DNA, 16 bp, Homo sapiens
tgaatgttaatttttt

SEQ ID NO: 848198 - DNA, 12 bp, Homo sapiens
tgaatgttctga

SEQ ID NO: 848199 - DNA, 15 bp, Homo sapiens
tgaatgttctgacat

SEQ ID NO: 848200 - DNA, 23 bp, Homo sapiens
tgaatgttctgacattaacagtt

SEQ ID NO: 848201 - DNA, 22 bp, Homo sapiens
tgaatgtttacactctttgtaa

SEQ ID NO: 848202 - DNA, 15 bp, Homo sapiens
tgaattaaataaata

SEQ ID NO: 848203 - DNA, 19 bp, Homo sapiens
tgaattaattaatttggag

SEQ ID NO: 848204 - DNA, 15 bp, Homo sapiens
tgaattaatttctaa

SEQ ID NO: 848205 - DNA, 18 bp, Homo sapiens
tgaattacagtgaaattt

SEQ ID NO: 848206 - DNA, 18 bp, Homo sapiens
tgaattaccatagagtaa

SEQ ID NO: 848207 - DNA, 23 bp, Homo sapiens
tgaattaccatagagtaatgatg

SEQ ID NO: 848208 - DNA, 20 bp, Homo sapiens
tgaattactgtatataaact

SEQ ID NO: 848209 - DNA, 13 bp, Homo sapiens
tgaattagaaaat

SEQ ID NO: 848210 - DNA, 19 bp, Homo sapiens
tgaattagattatttctgt

SEQ ID NO: 848211 - DNA, 21 bp, Homo sapiens
tgaattaggctgtaactactt

SEQ ID NO: 848212 - DNA, 13 bp, Homo sapiens
tgaattataacag

SEQ ID NO: 848213 - DNA, 16 bp, Homo sapiens
tgaattataacagtta

SEQ ID NO: 848214 - DNA, 22 bp, Homo sapiens
tgaattataacagttatatttt

SEQ ID NO: 848215 - DNA, 16 bp, Homo sapiens
tgaattataactagac

SEQ ID NO: 848216 - DNA, 20 bp, Homo sapiens
tgaattatcagcaaagaaaa

SEQ ID NO: 848217 - DNA, 21 bp, Homo sapiens
tgaattatcttggttgaaaat

SEQ ID NO: 848218 - DNA, 14 bp, Homo sapiens
tgaattattacagt

SEQ ID NO: 848219 - DNA, 18 bp, Homo sapiens
tgaattattgacactgaa

SEQ ID NO: 848220 - DNA, 17 bp, Homo sapiens
tgaattcaagaaaggaa

SEQ ID NO: 848221 - DNA, 12 bp, Homo sapiens
tgaattcattat

SEQ ID NO: 848222 - DNA, 15 bp, Homo sapiens
tgaattcctcctcta

SEQ ID NO: 848223 - DNA, 13 bp, Homo sapiens
tgaattctgcctt

SEQ ID NO: 848224 - DNA, 14 bp, Homo sapiens
tgaattcttcctct

SEQ ID NO: 848225 - DNA, 18 bp, Homo sapiens
tgaattcttcctctcctt

SEQ ID NO: 848226 - DNA, 22 bp, Homo sapiens
tgaattcttcctctccttccca

SEQ ID NO: 848227 - DNA, 23 bp, Homo sapiens
tgaattcttcctctccttcccac

SEQ ID NO: 848228 - DNA, 12 bp, Homo sapiens
tgaattgaagtt

SEQ ID NO: 848229 - DNA, 19 bp, Homo sapiens
tgaattgaagtttcaagtt

SEQ ID NO: 848230 - DNA, 12 bp, Homo sapiens
tgaattgtcttt

SEQ ID NO: 848231 - DNA, 18 bp, Homo sapiens
tgaattgtcttttagaca

SEQ ID NO: 848232 - DNA, 16 bp, Homo sapiens
tgaattgttatgaaaa

SEQ ID NO: 848233 - DNA, 13 bp, Homo sapiens
tgaattgttgggg

SEQ ID NO: 848234 - DNA, 16 bp, Homo sapiens
tgaattgtttataatg

SEQ ID NO: 848235 - DNA, 17 bp, Homo sapiens
tgaattgttttctttaa

SEQ ID NO: 848236 - DNA, 17 bp, Homo sapiens
tgaatttaaataaagtt

SEQ ID NO: 848237 - DNA, 18 bp, Homo sapiens
tgaatttaaataaagtta

SEQ ID NO: 848238 - DNA, 16 bp, Homo sapiens
tgaatttaaatataat

SEQ ID NO: 848239 - DNA, 19 bp, Homo sapiens
tgaatttaaatataattct

SEQ ID NO: 848240 - DNA, 16 bp, Homo sapiens
tgaatttaaggcaaaa

SEQ ID NO: 848241 - DNA, 18 bp, Homo sapiens
tgaatttaaggcaaaaaa

SEQ ID NO: 848242 - DNA, 16 bp, Homo sapiens
tgaatttagaaatatt

SEQ ID NO: 848243 - DNA, 21 bp, Homo sapiens
tgaatttagaaatattcaaaa

SEQ ID NO: 848244 - DNA, 15 bp, Homo sapiens
tgaatttatgagatt

SEQ ID NO: 848245 - DNA, 13 bp, Homo sapiens
tgaatttctaaat

SEQ ID NO: 848246 - DNA, 19 bp, Homo sapiens
tgaatttctaccagatgtg

SEQ ID NO: 848247 - DNA, 16 bp, Homo sapiens
tgaatttctagacagt

SEQ ID NO: 848248 - DNA, 11 bp, Homo sapiens
tgaatttctgc

SEQ ID NO: 848249 - DNA, 21 bp, Homo sapiens
tgaatttcttcactgttgaaa

SEQ ID NO: 848250 - DNA, 23 bp, Homo sapiens
tgaatttcttcactgttgaaaat

SEQ ID NO: 848251 - DNA, 21 bp, Homo sapiens
tgaatttcttcttttcctgca

SEQ ID NO: 848252 - DNA, 19 bp, Homo sapiens
tgaatttgaataaatgaga

SEQ ID NO: 848253 - DNA, 16 bp, Homo sapiens
tgaatttgaatgaaaa

SEQ ID NO: 848254 - DNA, 17 bp, Homo sapiens
tgaatttgaatgaaaaa

SEQ ID NO: 848255 - DNA, 19 bp, Homo sapiens
tgaatttgcacggtttgtg

SEQ ID NO: 848256 - DNA, 20 bp, Homo sapiens
tgaatttggcctgcactaat

SEQ ID NO: 848257 - DNA, 21 bp, Homo sapiens
tgaatttggcctgcactaatt

SEQ ID NO: 848258 - DNA, 22 bp, Homo sapiens
tgaatttgtaagcaacttgctt

SEQ ID NO: 848259 - DNA, 14 bp, Homo sapiens
tgaatttgtagttg

SEQ ID NO: 848260 - DNA, 16 bp, Homo sapiens
tgaattttaaagtatg

SEQ ID NO: 848261 - DNA, 22 bp, Homo sapiens
tgaattttaaagtatgcattat

SEQ ID NO: 848262 - DNA, 17 bp, Homo sapiens
tgaattttaaatctaaa

SEQ ID NO: 848263 - DNA, 17 bp, Homo sapiens
tgaattttaaatgttca

SEQ ID NO: 848264 - DNA, 17 bp, Homo sapiens
tgaattttcaaggcctt

SEQ ID NO: 848265 - DNA, 17 bp, Homo sapiens
tgaattttctaaaagct

SEQ ID NO: 848266 - DNA, 14 bp, Homo sapiens
tgaattttctgtgt

SEQ ID NO: 848267 - DNA, 14 bp, Homo sapiens
tgaattttgttgct

SEQ ID NO: 848268 - DNA, 16 bp, Homo sapiens
tgaattttgttgctgt

SEQ ID NO: 848269 - DNA, 18 bp, Homo sapiens
tgaattttgtttggactt

SEQ ID NO: 848270 - DNA, 19 bp, Homo sapiens
tgaatttttaaacaagtat

SEQ ID NO: 848271 - DNA, 13 bp, Homo sapiens
tgaatttttaagc

SEQ ID NO: 848272 - DNA, 15 bp, Homo sapiens
tgaatttttatttct

SEQ ID NO: 848273 - DNA, 15 bp, Homo sapiens
tgaatttttcctatg

SEQ ID NO: 848274 - DNA, 16 bp, Homo sapiens
tgaattttttgaaatg

SEQ ID NO: 848275 - DNA, 23 bp, Homo sapiens
tgaatttttttcatcttctctgg

SEQ ID NO: 848276 - DNA, 16 bp, Homo sapiens
tgaatttttttttcct

SEQ ID NO: 848277 - DNA, 23 bp, Homo sapiens
tgaattttttttttaaatgattc

SEQ ID NO: 848278 - DNA, 18 bp, Homo sapiens
tgacaaaaaatgttttaa

SEQ ID NO: 848279 - DNA, 19 bp, Homo sapiens
tgacaaaaaattaaagcat

SEQ ID NO: 848280 - DNA, 19 bp, Homo sapiens
tgacaaaaagtttccatat

SEQ ID NO: 848281 - DNA, 14 bp, Homo sapiens
tgacaaaagtaaat

SEQ ID NO: 848282 - DNA, 16 bp, Homo sapiens
tgacaaaagtaaatgg

SEQ ID NO: 848283 - DNA, 20 bp, Homo sapiens
tgacaaaagtaaatgggagg

SEQ ID NO: 848284 - DNA, 21 bp, Homo sapiens
tgacaaaatggggcagaagag

SEQ ID NO: 848285 - DNA, 16 bp, Homo sapiens
tgacaaaattcatttg

SEQ ID NO: 848286 - DNA, 19 bp, Homo sapiens
tgacaaaattcatttgctt

SEQ ID NO: 848287 - DNA, 18 bp, Homo sapiens
tgacaaaatttgttgaaa

SEQ ID NO: 848288 - DNA, 17 bp, Homo sapiens
tgacaaagaaacccaag

SEQ ID NO: 848289 - DNA, 18 bp, Homo sapiens
tgacaaagactcctctgg

SEQ ID NO: 848290 - DNA, 19 bp, Homo sapiens
tgacaaagactcctctggg

SEQ ID NO: 848291 - DNA, 22 bp, Homo sapiens
tgacaaagactcctctgggcct

SEQ ID NO: 848292 - DNA, 18 bp, Homo sapiens
tgacaaagatggctcaga

SEQ ID NO: 848293 - DNA, 19 bp, Homo sapiens
tgacaaagatggctcagag

SEQ ID NO: 848294 - DNA, 20 bp, Homo sapiens
tgacaaagccagaggagaag

SEQ ID NO: 848295 - DNA, 12 bp, Homo sapiens
tgacaaagccat

SEQ ID NO: 848296 - DNA, 15 bp, Homo sapiens
tgacaaagtgcctca

SEQ ID NO: 848297 - DNA, 12 bp, Homo sapiens
tgacaaagtgtt

SEQ ID NO: 848298 - DNA, 14 bp, Homo sapiens
tgacaaagttactg

SEQ ID NO: 848299 - DNA, 13 bp, Homo sapiens
tgacaacacaaat

SEQ ID NO: 848300 - DNA, 13 bp, Homo sapiens
tgacaacagaagc

SEQ ID NO: 848301 - DNA, 14 bp, Homo sapiens
tgacaacagaagct

SEQ ID NO: 848302 - DNA, 22 bp, Homo sapiens
tgacaacagaagcttcagaagt

SEQ ID NO: 848303 - DNA, 14 bp, Homo sapiens
tgacaacagactga

SEQ ID NO: 848304 - DNA, 16 bp, Homo sapiens
tgacaacatttctata

SEQ ID NO: 848305 - DNA, 23 bp, Homo sapiens
tgacaacatttctatagccaaaa

SEQ ID NO: 848306 - DNA, 17 bp, Homo sapiens
tgacaaccactggtctg

SEQ ID NO: 848307 - DNA, 19 bp, Homo sapiens
tgacaaccattaaagtcag

SEQ ID NO: 848308 - DNA, 20 bp, Homo sapiens
tgacaacctccattctattt

SEQ ID NO: 848309 - DNA, 21 bp, Homo sapiens
tgacaacctccattctatttt

SEQ ID NO: 848310 - DNA, 21 bp, Homo sapiens
tgacaacctgtgtgagagaat

SEQ ID NO: 848311 - DNA, 16 bp, Homo sapiens
tgacaacgtctcttca

SEQ ID NO: 848312 - DNA, 12 bp, Homo sapiens
tgacaactgtga

SEQ ID NO: 848313 - DNA, 15 bp, Homo sapiens
tgacaactgtgactg

SEQ ID NO: 848314 - DNA, 17 bp, Homo sapiens
tgacaacttagctcagg

SEQ ID NO: 848315 - DNA, 19 bp, Homo sapiens
tgacaactttgccagcttt

SEQ ID NO: 848316 - DNA, 18 bp, Homo sapiens
tgacaacttttaaagaaa

SEQ ID NO: 848317 - DNA, 23 bp, Homo sapiens
tgacaagaatggaatagaaatgt

SEQ ID NO: 848318 - DNA, 16 bp, Homo sapiens
tgaccatgttcattat

SEQ ID NO: 848319 - DNA, 12 bp, Homo sapiens
tgaccattctgc

SEQ ID NO: 848320 - DNA, 23 bp, Homo sapiens
tgaccattggctgcgctaacccc

SEQ ID NO: 848321 - DNA, 19 bp, Homo sapiens
tgacccaaaaatgttccct

SEQ ID NO: 848322 - DNA, 21 bp, Homo sapiens
tgacccacactgccagaagag

SEQ ID NO: 848323 - DNA, 13 bp, Homo sapiens
tgacccacagctc

SEQ ID NO: 848324 - DNA, 17 bp, Homo sapiens
tgacccacagctctggg

SEQ ID NO: 848325 - DNA, 12 bp, Homo sapiens
tgacccacccct

SEQ ID NO: 848326 - DNA, 23 bp, Homo sapiens
tgacccacccctgtgctccgtgc

SEQ ID NO: 848327 - DNA, 18 bp, Homo sapiens
tgacccagagtggagtct

SEQ ID NO: 848328 - DNA, 22 bp, Homo sapiens
tgacccagagtggagtctgagt

SEQ ID NO: 848329 - DNA, 20 bp, Homo sapiens
tgacccagcatctcccagca

SEQ ID NO: 848330 - DNA, 13 bp, Homo sapiens
tgacccagcctga

SEQ ID NO: 848331 - DNA, 16 bp, Homo sapiens
tgacccagcctgaaag

SEQ ID NO: 848332 - DNA, 13 bp, Homo sapiens
tgacccaggaata

SEQ ID NO: 848333 - DNA, 21 bp, Homo sapiens
tgacccaggccgcagctcttg

SEQ ID NO: 848334 - DNA, 16 bp, Homo sapiens
tgacccagtccctggg

SEQ ID NO: 848335 - DNA, 16 bp, Homo sapiens
tgacccatgttccctt

SEQ ID NO: 848336 - DNA, 18 bp, Homo sapiens
tgaccccacgatttgtct

SEQ ID NO: 848337 - DNA, 19 bp, Homo sapiens
tgaccccacttatgctgct

SEQ ID NO: 848338 - DNA, 21 bp, Homo sapiens
tgaccccacttatgctgctgt

SEQ ID NO: 848339 - DNA, 23 bp, Homo sapiens
tgaccccacttatgctgctgtga

SEQ ID NO: 848340 - DNA, 20 bp, Homo sapiens
tgaccccaggagggaggcag

SEQ ID NO: 848341 - DNA, 14 bp, Homo sapiens
tgaccccagggcct

SEQ ID NO: 848342 - DNA, 17 bp, Homo sapiens
tgaccccaggtcagccc

SEQ ID NO: 848343 - DNA, 19 bp, Homo sapiens
tgaccccaggtcagccctg

SEQ ID NO: 848344 - DNA, 23 bp, Homo sapiens
tgaccccagtttcttcttacact

SEQ ID NO: 848345 - DNA, 17 bp, Homo sapiens
tgacccccatctgagct

SEQ ID NO: 848346 - DNA, 21 bp, Homo sapiens
tgacccccatctgagctgggg

SEQ ID NO: 848347 - DNA, 21 bp, Homo sapiens
tgacccccttgattcccaccg

SEQ ID NO: 848348 - DNA, 20 bp, Homo sapiens
tgaccccgagaagtgctctt

SEQ ID NO: 848349 - DNA, 16 bp, Homo sapiens
tgacccctaccccctc

SEQ ID NO: 848350 - DNA, 15 bp, Homo sapiens
tgacccctctcctca

SEQ ID NO: 848351 - DNA, 12 bp, Homo sapiens
tgacccctctgg

SEQ ID NO: 848352 - DNA, 15 bp, Homo sapiens
tgaccccttccctgt

SEQ ID NO: 848353 - DNA, 17 bp, Homo sapiens
tgaccccttctctctcc

SEQ ID NO: 848354 - DNA, 21 bp, Homo sapiens
tgacccggctgggtcggccct

SEQ ID NO: 848355 - DNA, 18 bp, Homo sapiens
tgaccctagctctttcct

SEQ ID NO: 848356 - DNA, 11 bp, Homo sapiens
tgaccctcagc

SEQ ID NO: 848357 - DNA, 12 bp, Homo sapiens
tgaccctcccac

SEQ ID NO: 848358 - DNA, 22 bp, Homo sapiens
tgaccctcccggcctggcttca

SEQ ID NO: 848359 - DNA, 13 bp, Homo sapiens
tgaccctctcact

SEQ ID NO: 848360 - DNA, 23 bp, Homo sapiens
tgaccctctgaatggtccagggt

SEQ ID NO: 848361 - DNA, 20 bp, Homo sapiens
tgaccctctgtccccaggcc

SEQ ID NO: 848362 - DNA, 22 bp, Homo sapiens
tgaccctctgtccccaggcctg

SEQ ID NO: 848363 - DNA, 21 bp, Homo sapiens
tgaccctgaaaggaacactgg

SEQ ID NO: 848364 - DNA, 15 bp, Homo sapiens
tgaccctgggcaagt

SEQ ID NO: 848365 - DNA, 18 bp, Homo sapiens
tgaccctgtatatagccc

SEQ ID NO: 848366 - DNA, 19 bp, Homo sapiens
tgaccctgtatatagccca

SEQ ID NO: 848367 - DNA, 20 bp, Homo sapiens
tgacccttacagcctctgac

SEQ ID NO: 848368 - DNA, 13 bp, Homo sapiens
tgacccttcaggg

SEQ ID NO: 848369 - DNA, 17 bp, Homo sapiens
tgacccttcagggccag

SEQ ID NO: 848370 - DNA, 13 bp, Homo sapiens
tgacccttttcat

SEQ ID NO: 848371 - DNA, 14 bp, Homo sapiens
tgacccttttctga

SEQ ID NO: 848372 - DNA, 16 bp, Homo sapiens
tgacccttttctgatc

SEQ ID NO: 848373 - DNA, 20 bp, Homo sapiens
tgaccgatgtgtctcccaga

SEQ ID NO: 848374 - DNA, 16 bp, Homo sapiens
tgaccgcccagctctc

SEQ ID NO: 848375 - DNA, 19 bp, Homo sapiens
tgaccggacttttctgcaa

SEQ ID NO: 848376 - DNA, 15 bp, Homo sapiens
tgaccgggcactggc

SEQ ID NO: 848377 - DNA, 22 bp, Homo sapiens
tgaccgggggctgctgggcgtc

SEQ ID NO: 848378 - DNA, 15 bp, Homo sapiens
tgaccgtgtacaata

SEQ ID NO: 848379 - DNA, 20 bp, Homo sapiens
tgaccgttttcacttgtctc

SEQ ID NO: 848380 - DNA, 18 bp, Homo sapiens
tgaccgttttcatcctgg

SEQ ID NO: 848381 - DNA, 23 bp, Homo sapiens
tgaccgttttcatcctggcctcc

SEQ ID NO: 848382 - DNA, 13 bp, Homo sapiens
tgacctaaattag

SEQ ID NO: 848383 - DNA, 21 bp, Homo sapiens
tgacctacctcaaagggcagt

SEQ ID NO: 848384 - DNA, 13 bp, Homo sapiens
tgacctactctca

SEQ ID NO: 848385 - DNA, 22 bp, Homo sapiens
tgacctagaccagtttgcatga

SEQ ID NO: 848386 - DNA, 22 bp, Homo sapiens
tgacctagttttccatgcgtgt

SEQ ID NO: 848387 - DNA, 18 bp, Homo sapiens
tgacctattcaccctcca

SEQ ID NO: 848388 - DNA, 17 bp, Homo sapiens
tgacctcaactaaccct

SEQ ID NO: 848389 - DNA, 14 bp, Homo sapiens
tgacctcagctgca

SEQ ID NO: 848390 - DNA, 18 bp, Homo sapiens
tgacctcatgatctgccc

SEQ ID NO: 848391 - DNA, 14 bp, Homo sapiens
tgacctcccagccc

SEQ ID NO: 848392 - DNA, 15 bp, Homo sapiens
tgacctcccagccct

SEQ ID NO: 848393 - DNA, 16 bp, Homo sapiens
tgacctcccagcccta

SEQ ID NO: 848394 - DNA, 23 bp, Homo sapiens
tgacctcccagccctatggatgt

SEQ ID NO: 848395 - DNA, 13 bp, Homo sapiens
tgacctccctcta

SEQ ID NO: 848396 - DNA, 11 bp, Homo sapiens
tgacctcctgt

SEQ ID NO: 848397 - DNA, 14 bp, Homo sapiens
tgacctcctgtcac

SEQ ID NO: 848398 - DNA, 17 bp, Homo sapiens
tgacctcgtgatccgcc

SEQ ID NO: 848399 - DNA, 23 bp, Homo sapiens
tgacctctctacttccccttctt

SEQ ID NO: 848400 - DNA, 18 bp, Homo sapiens
tgacctctgcaagacaaa

SEQ ID NO: 848401 - DNA, 16 bp, Homo sapiens
tgacctctgcagcaat

SEQ ID NO: 848402 - DNA, 18 bp, Homo sapiens
tgacctctgcagcaataa

SEQ ID NO: 848403 - DNA, 13 bp, Homo sapiens
tgacctctgctga

SEQ ID NO: 848404 - DNA, 17 bp, Homo sapiens
tgacctctgctgagtgc

SEQ ID NO: 848405 - DNA, 19 bp, Homo sapiens
tgacctctgctgagtgctg

SEQ ID NO: 848406 - DNA, 22 bp, Homo sapiens
tgacctctgctgagtgctgggc

SEQ ID NO: 848407 - DNA, 23 bp, Homo sapiens
tgacctctgctgagtgctgggca

SEQ ID NO: 848408 - DNA, 20 bp, Homo sapiens
tgacctctgtgaccaactgt

SEQ ID NO: 848409 - DNA, 22 bp, Homo sapiens
tgacctctgtgaccaactgttg

SEQ ID NO: 848410 - DNA, 19 bp, Homo sapiens
tgacctctgttgtcctccc

SEQ ID NO: 848411 - DNA, 13 bp, Homo sapiens
tgacctcttgctg

SEQ ID NO: 848412 - DNA, 17 bp, Homo sapiens
tgacctcttgctgtctc

SEQ ID NO: 848413 - DNA, 18 bp, Homo sapiens
tgacctcttgctgtctct

SEQ ID NO: 848414 - DNA, 21 bp, Homo sapiens
tgacctcttgctgtctctgct

SEQ ID NO: 848415 - DNA, 20 bp, Homo sapiens
tgacctgaggccctcactga

SEQ ID NO: 848416 - DNA, 12 bp, Homo sapiens
tgacctgaggct

SEQ ID NO: 848417 - DNA, 11 bp, Homo sapiens
tgacctgcagg

SEQ ID NO: 848418 - DNA, 20 bp, Homo sapiens
tgacctgcaggccaagagca

SEQ ID NO: 848419 - DNA, 13 bp, Homo sapiens
tgacctgccagcc

SEQ ID NO: 848420 - DNA, 16 bp, Homo sapiens
tgacctgccagccggt

SEQ ID NO: 848421 - DNA, 13 bp, Homo sapiens
tgacctgccccgc

SEQ ID NO: 848422 - DNA, 19 bp, Homo sapiens
tgacctgccccgcccagct

SEQ ID NO: 848423 - DNA, 23 bp, Homo sapiens
tgacctgcgggtcctcagctgct

SEQ ID NO: 848424 - DNA, 15 bp, Homo sapiens
tgacctgctccgctg

SEQ ID NO: 848425 - DNA, 18 bp, Homo sapiens
tgacctgctccgctgctc

SEQ ID NO: 848426 - DNA, 19 bp, Homo sapiens
tgacctgctgaattgttta

SEQ ID NO: 848427 - DNA, 21 bp, Homo sapiens
tgacctgctgggtaaactgtg

SEQ ID NO: 848428 - DNA, 13 bp, Homo sapiens
tgacctgggccca

SEQ ID NO: 848429 - DNA, 19 bp, Homo sapiens
tgacctgggtatcccctgc

SEQ ID NO: 848430 - DNA, 15 bp, Homo sapiens
tgacctgtcatgccc

SEQ ID NO: 848431 - DNA, 16 bp, Homo sapiens
tgacctgtcatgcccc

SEQ ID NO: 848432 - DNA, 21 bp, Homo sapiens
tgacctgtcatgcccccctca

SEQ ID NO: 848433 - DNA, 14 bp, Homo sapiens
tgacctgtcctctt

SEQ ID NO: 848434 - DNA, 15 bp, Homo sapiens
tgacctgtgaccagc

SEQ ID NO: 848435 - DNA, 18 bp, Homo sapiens
tgacctgtgaccagcact

SEQ ID NO: 848436 - DNA, 21 bp, Homo sapiens
tgacctgtggggatttctccc

SEQ ID NO: 848437 - DNA, 14 bp, Homo sapiens
tgaccttaaatgca

SEQ ID NO: 848438 - DNA, 16 bp, Homo sapiens
tgaccttaaatgcaac

SEQ ID NO: 848439 - DNA, 20 bp, Homo sapiens
tgaccttcagagccagccgg

SEQ ID NO: 848440 - DNA, 20 bp, Homo sapiens
tgagaaagcccacctgggct

SEQ ID NO: 848441 - DNA, 23 bp, Homo sapiens
tgagaaagcccacctgggctggg

SEQ ID NO: 848442 - DNA, 21 bp, Homo sapiens
tgagaaagggagaggaagaga

SEQ ID NO: 848443 - DNA, 22 bp, Homo sapiens
tgagaaagggagaggaagagaa

SEQ ID NO: 848444 - DNA, 20 bp, Homo sapiens
tgagaaatagctgaaaaggg

SEQ ID NO: 848445 - DNA, 15 bp, Homo sapiens
tgagaaatatggaca

SEQ ID NO: 848446 - DNA, 17 bp, Homo sapiens
tgagaaatatggacact

SEQ ID NO: 848447 - DNA, 20 bp, Homo sapiens
tgagaaatcagaattggcat

SEQ ID NO: 848448 - DNA, 18 bp, Homo sapiens
tgagaaatgaaatattgt

SEQ ID NO: 848449 - DNA, 13 bp, Homo sapiens
tgagaaatgatga

SEQ ID NO: 848450 - DNA, 13 bp, Homo sapiens
tgagaaatttaaa

SEQ ID NO: 848451 - DNA, 12 bp, Homo sapiens
tgagaacaaagc

SEQ ID NO: 848452 - DNA, 15 bp, Homo sapiens
tgagaacaaagctgt

SEQ ID NO: 848453 - DNA, 20 bp, Homo sapiens
tgagaacaagtcacagctgc

SEQ ID NO: 848454 - DNA, 22 bp, Homo sapiens
tgagaacaagtcacagctgcag

SEQ ID NO: 848455 - DNA, 22 bp, Homo sapiens
tgagaaccttggaccactcctg

SEQ ID NO: 848456 - DNA, 13 bp, Homo sapiens
tgagaactcagaa

SEQ ID NO: 848457 - DNA, 19 bp, Homo sapiens
tgagaactctctccctggt

SEQ ID NO: 848458 - DNA, 14 bp, Homo sapiens
tgagaactgacttt

SEQ ID NO: 848459 - DNA, 17 bp, Homo sapiens
tgagaagaagtggctgc

SEQ ID NO: 848460 - DNA, 19 bp, Homo sapiens
tgagaagataatcattgct

SEQ ID NO: 848461 - DNA, 20 bp, Homo sapiens
tgagaagcagaggaaggaga

SEQ ID NO: 848462 - DNA, 12 bp, Homo sapiens
tgagaagccaag

SEQ ID NO: 848463 - DNA, 17 bp, Homo sapiens
tgagaagccaagcgctc

SEQ ID NO: 848464 - DNA, 17 bp, Homo sapiens
tgagaagccgtgggtgg

SEQ ID NO: 848465 - DNA, 14 bp, Homo sapiens
tgagaagccttcag

SEQ ID NO: 848466 - DNA, 15 bp, Homo sapiens
tgagaagccttcagc

SEQ ID NO: 848467 - DNA, 21 bp, Homo sapiens
tgagaagcgtttttaacctgt

SEQ ID NO: 848468 - DNA, 12 bp, Homo sapiens
tgagaagctctg

SEQ ID NO: 848469 - DNA, 16 bp, Homo sapiens
tgagaaggcgaggaga

SEQ ID NO: 848470 - DNA, 19 bp, Homo sapiens
tgagaaggttactgagtga

SEQ ID NO: 848471 - DNA, 22 bp, Homo sapiens
tgagaagtcaaacatttcaaag

SEQ ID NO: 848472 - DNA, 21 bp, Homo sapiens
tgagaagtgaatgctgggact

SEQ ID NO: 848473 - DNA, 16 bp, Homo sapiens
tgagaatataccttat

SEQ ID NO: 848474 - DNA, 21 bp, Homo sapiens
tgagaatataccttatttatt

SEQ ID NO: 848475 - DNA, 22 bp, Homo sapiens
tgagaatataccttatttattt

SEQ ID NO: 848476 - DNA, 16 bp, Homo sapiens
tgagaatcaaaactct

SEQ ID NO: 848477 - DNA, 22 bp, Homo sapiens
tgagaatcccaaatttgattga

SEQ ID NO: 848478 - DNA, 17 bp, Homo sapiens
tgagaatcccttaaaat

SEQ ID NO: 848479 - DNA, 18 bp, Homo sapiens
tgagaatcccttaaaatt

SEQ ID NO: 848480 - DNA, 20 bp, Homo sapiens
tgagaatcctctcctttctt

SEQ ID NO: 848481 - DNA, 22 bp, Homo sapiens
tgagaatcctctcctttcttat

SEQ ID NO: 848482 - DNA, 20 bp, Homo sapiens
tgagaatctttattgagaaa

SEQ ID NO: 848483 - DNA, 16 bp, Homo sapiens
tgagaatgtatcccca

SEQ ID NO: 848484 - DNA, 12 bp, Homo sapiens
tgagaatgtgac

SEQ ID NO: 848485 - DNA, 19 bp, Homo sapiens
tgagaattaagttttaaat

SEQ ID NO: 848486 - DNA, 20 bp, Homo sapiens
tgagaattattcctttccta

SEQ ID NO: 848487 - DNA, 14 bp, Homo sapiens
tgagaatttgcaac

SEQ ID NO: 848488 - DNA, 22 bp, Homo sapiens
tgagacaaatcctttctgcccc

SEQ ID NO: 848489 - DNA, 15 bp, Homo sapiens
tgagacaagccctgg

SEQ ID NO: 848490 - DNA, 13 bp, Homo sapiens
tgagacactgaag

SEQ ID NO: 848491 - DNA, 13 bp, Homo sapiens
tgagacagaatct

SEQ ID NO: 848492 - DNA, 19 bp, Homo sapiens
tgagacagacacacagcct

SEQ ID NO: 848493 - DNA, 18 bp, Homo sapiens
tgagacaggaaaaaccaa

SEQ ID NO: 848494 - DNA, 15 bp, Homo sapiens
tgagacagggtctca

SEQ ID NO: 848495 - DNA, 20 bp, Homo sapiens
tgagacagggtcttgctctg

SEQ ID NO: 848496 - DNA, 17 bp, Homo sapiens
tgagacagtgaatttgg

SEQ ID NO: 848497 - DNA, 16 bp, Homo sapiens
tgagacagtgggaaat

SEQ ID NO: 848498 - DNA, 21 bp, Homo sapiens
tgagacagtttactttgccaa

SEQ ID NO: 848499 - DNA, 14 bp, Homo sapiens
tgagaccaccccca

SEQ ID NO: 848500 - DNA, 14 bp, Homo sapiens
tgagaccactgtta

SEQ ID NO: 848501 - DNA, 12 bp, Homo sapiens
tgagaccagttg

SEQ ID NO: 848502 - DNA, 18 bp, Homo sapiens
tgagacccagccctcatc

SEQ ID NO: 848503 - DNA, 19 bp, Homo sapiens
tgagacccagtgcactccg

SEQ ID NO: 848504 - DNA, 13 bp, Homo sapiens
tgagacccccaca

SEQ ID NO: 848505 - DNA, 14 bp, Homo sapiens
tgagacccccacac

SEQ ID NO: 848506 - DNA, 17 bp, Homo sapiens
tgagacccccacacctc

SEQ ID NO: 848507 - DNA, 15 bp, Homo sapiens
tgagaccccgcactg

SEQ ID NO: 848508 - DNA, 17 bp, Homo sapiens
tgagaccccgcactgca

SEQ ID NO: 848509 - DNA, 19 bp, Homo sapiens
tgagaccccgcactgcaga

SEQ ID NO: 848510 - DNA, 15 bp, Homo sapiens
tgagacccctgtctc

SEQ ID NO: 848511 - DNA, 13 bp, Homo sapiens
tgagaccctactg

SEQ ID NO: 848512 - DNA, 15 bp, Homo sapiens
tgagaccctactgaa

SEQ ID NO: 848513 - DNA, 19 bp, Homo sapiens
tgagaccctgggagagaag

SEQ ID NO: 848514 - DNA, 12 bp, Homo sapiens
tgagaccctgtc

SEQ ID NO: 848515 - DNA, 15 bp, Homo sapiens
tgagaccctgtctct

SEQ ID NO: 848516 - DNA, 14 bp, Homo sapiens
tgagacccttttct

SEQ ID NO: 848517 - DNA, 17 bp, Homo sapiens
tgagacccttttctcag

SEQ ID NO: 848518 - DNA, 18 bp, Homo sapiens
tgagacccttttctcagg

SEQ ID NO: 848519 - DNA, 19 bp, Homo sapiens
tgagacctaatctctgtaa

SEQ ID NO: 848520 - DNA, 18 bp, Homo sapiens
tgagacctacaggctgac

SEQ ID NO: 848521 - DNA, 14 bp, Homo sapiens
tgagacctcagcca

SEQ ID NO: 848522 - DNA, 17 bp, Homo sapiens
tgagacctcagccatga

SEQ ID NO: 848523 - DNA, 19 bp, Homo sapiens
tgagacctcagccatgagg

SEQ ID NO: 848524 - DNA, 14 bp, Homo sapiens
tgagacctggaaca

SEQ ID NO: 848525 - DNA, 18 bp, Homo sapiens
tgagacctgggatttgag

SEQ ID NO: 848526 - DNA, 21 bp, Homo sapiens
tgagactaatcttattcattt

SEQ ID NO: 848527 - DNA, 19 bp, Homo sapiens
tgagactacaagtgtgtgc

SEQ ID NO: 848528 - DNA, 18 bp, Homo sapiens
tgagactcacactctctg

SEQ ID NO: 848529 - DNA, 17 bp, Homo sapiens
tgagactcacaggaagg

SEQ ID NO: 848530 - DNA, 13 bp, Homo sapiens
tgagactccagaa

SEQ ID NO: 848531 - DNA, 19 bp, Homo sapiens
tgagactgatccctggcca

SEQ ID NO: 848532 - DNA, 16 bp, Homo sapiens
tgagactgcaggtggg

SEQ ID NO: 848533 - DNA, 17 bp, Homo sapiens
tgagactgcaggtgggc

SEQ ID NO: 848534 - DNA, 15 bp, Homo sapiens
tgagactgccccacg

SEQ ID NO: 848535 - DNA, 21 bp, Homo sapiens
tgagactgggtaatttataaa

SEQ ID NO: 848536 - DNA, 15 bp, Homo sapiens
tgagactgtaaaaca

SEQ ID NO: 848537 - DNA, 19 bp, Homo sapiens
tgagactgtcggagaggct

SEQ ID NO: 848538 - DNA, 21 bp, Homo sapiens
tgagactgtgctgttgttctc

SEQ ID NO: 848539 - DNA, 20 bp, Homo sapiens
tgagacttgctctctggcct

SEQ ID NO: 848540 - DNA, 18 bp, Homo sapiens
tgagactttcttctagtg

SEQ ID NO: 848541 - DNA, 15 bp, Homo sapiens
tgagactttgcccag

SEQ ID NO: 848542 - DNA, 12 bp, Homo sapiens
tgagactttttc

SEQ ID NO: 848543 - DNA, 17 bp, Homo sapiens
tgagagaaaaagtgccc

SEQ ID NO: 848544 - DNA, 17 bp, Homo sapiens
tgagagaatctgcctgt

SEQ ID NO: 848545 - DNA, 14 bp, Homo sapiens
tgagagaatggaaa

SEQ ID NO: 848546 - DNA, 23 bp, Homo sapiens
tgagagaatggaaaacagactca

SEQ ID NO: 848547 - DNA, 14 bp, Homo sapiens
tgagagaattggct

SEQ ID NO: 848548 - DNA, 15 bp, Homo sapiens
tgagagaccctggcc

SEQ ID NO: 848549 - DNA, 20 bp, Homo sapiens
tgagagacgccactccctgg

SEQ ID NO: 848550 - DNA, 21 bp, Homo sapiens
tgagagagaatagagctgcca

SEQ ID NO: 848551 - DNA, 10 bp, Homo sapiens
tgagagagac

SEQ ID NO: 848552 - DNA, 15 bp, Homo sapiens
tgagagagacaagaa

SEQ ID NO: 848553 - DNA, 20 bp, Homo sapiens
tgagagagacaggcagctcg

SEQ ID NO: 848554 - DNA, 21 bp, Homo sapiens
tgagagatgcagaaatatttg

SEQ ID NO: 848555 - DNA, 21 bp, Homo sapiens
tgagagattctgtgatctttt

SEQ ID NO: 848556 - DNA, 12 bp, Homo sapiens
tgagagccccag

SEQ ID NO: 848557 - DNA, 12 bp, Homo sapiens
tgagagccccca

SEQ ID NO: 848558 - DNA, 16 bp, Homo sapiens
tgagagcccccacctt

SEQ ID NO: 848559 - DNA, 17 bp, Homo sapiens
tgagagccctgctgtgg

SEQ ID NO: 848560 - DNA, 20 bp, Homo sapiens
tgagagccctgctgtgggag

SEQ ID NO: 848561 - DNA, 15 bp, Homo sapiens
tgagagcgaggctga

SEQ ID NO: 848562 - DNA, 12 bp, Homo sapiens
tgagccaccacg

SEQ ID NO: 848563 - DNA, 23 bp, Homo sapiens
tgagccaccgctgccagcacaga

SEQ ID NO: 848564 - DNA, 20 bp, Homo sapiens
tgagccaccgtgcctggcca

SEQ ID NO: 848565 - DNA, 23 bp, Homo sapiens
tgagccaccgtgcctggccagat

SEQ ID NO: 848566 - DNA, 17 bp, Homo sapiens
tgagccactgcacctga

SEQ ID NO: 848567 - DNA, 23 bp, Homo sapiens
tgagccactgcacctgcccagct

SEQ ID NO: 848568 - DNA, 17 bp, Homo sapiens
tgagccactgcgcccag

SEQ ID NO: 848569 - DNA, 21 bp, Homo sapiens
tgagccactgcgcccagcctg

SEQ ID NO: 848570 - DNA, 13 bp, Homo sapiens
tgagccactgctc

SEQ ID NO: 848571 - DNA, 20 bp, Homo sapiens
tgagccagacaaatggagga

SEQ ID NO: 848572 - DNA, 20 bp, Homo sapiens
tgagccaggtaatgagggac

SEQ ID NO: 848573 - DNA, 21 bp, Homo sapiens
tgagccaggtaatgagggact

SEQ ID NO: 848574 - DNA, 17 bp, Homo sapiens
tgagccagtaatcttta

SEQ ID NO: 848575 - DNA, 17 bp, Homo sapiens
tgagccagtcccagggg

SEQ ID NO: 848576 - DNA, 14 bp, Homo sapiens
tgagccatattaat

SEQ ID NO: 848577 - DNA, 13 bp, Homo sapiens
tgagccatcacta

SEQ ID NO: 848578 - DNA, 15 bp, Homo sapiens
tgagccatcactaga

SEQ ID NO: 848579 - DNA, 18 bp, Homo sapiens
tgagccatgattttctaa

SEQ ID NO: 848580 - DNA, 15 bp, Homo sapiens
tgagccatgcctccc

SEQ ID NO: 848581 - DNA, 17 bp, Homo sapiens
tgagccatgcctccctg

SEQ ID NO: 848582 - DNA, 19 bp, Homo sapiens
tgagccatgcctccctggg

SEQ ID NO: 848583 - DNA, 17 bp, Homo sapiens
tgagcccaaccaggccc

SEQ ID NO: 848584 - DNA, 19 bp, Homo sapiens
tgagcccactgcccacccc

SEQ ID NO: 848585 - DNA, 20 bp, Homo sapiens
tgagcccactgcccaccccc

SEQ ID NO: 848586 - DNA, 13 bp, Homo sapiens
tgagcccaggagt

SEQ ID NO: 848587 - DNA, 14 bp, Homo sapiens
tgagcccaggccgt

SEQ ID NO: 848588 - DNA, 15 bp, Homo sapiens
tgagcccattcttct

SEQ ID NO: 848589 - DNA, 16 bp, Homo sapiens
tgagcccattcttctg

SEQ ID NO: 848590 - DNA, 18 bp, Homo sapiens
tgagcccattcttctggg

SEQ ID NO: 848591 - DNA, 11 bp, Homo sapiens
tgagccccacc

SEQ ID NO: 848592 - DNA, 19 bp, Homo sapiens
tgagccccagggtgcccag

SEQ ID NO: 848593 - DNA, 13 bp, Homo sapiens
tgagcccccccct

SEQ ID NO: 848594 - DNA, 21 bp, Homo sapiens
tgagcccctaccccacaccag

SEQ ID NO: 848595 - DNA, 15 bp, Homo sapiens
tgagcccctccccag

SEQ ID NO: 848596 - DNA, 21 bp, Homo sapiens
tgagcccctgtctagagaggg

SEQ ID NO: 848597 - DNA, 16 bp, Homo sapiens
tgagcccgcagcccag

SEQ ID NO: 848598 - DNA, 16 bp, Homo sapiens
tgagcccgggctgcct

SEQ ID NO: 848599 - DNA, 21 bp, Homo sapiens
tgagcccgggctgcctgggct

SEQ ID NO: 848600 - DNA, 22 bp, Homo sapiens
tgagcccgggctgcctgggctg

SEQ ID NO: 848601 - DNA, 14 bp, Homo sapiens
tgagccctctaggg

SEQ ID NO: 848602 - DNA, 15 bp, Homo sapiens
tgagccctctagggc

SEQ ID NO: 848603 - DNA, 13 bp, Homo sapiens
tgagccctctcac

SEQ ID NO: 848604 - DNA, 16 bp, Homo sapiens
tgagccctctcactcc

SEQ ID NO: 848605 - DNA, 18 bp, Homo sapiens
tgagccctctcactccag

SEQ ID NO: 848606 - DNA, 13 bp, Homo sapiens
tgagccctggctg

SEQ ID NO: 848607 - DNA, 18 bp, Homo sapiens
tgagccctgtacccaccc

SEQ ID NO: 848608 - DNA, 23 bp, Homo sapiens
tgagccgcggggaagctggcttt

SEQ ID NO: 848609 - DNA, 17 bp, Homo sapiens
tgagccgggcccctggg

SEQ ID NO: 848610 - DNA, 19 bp, Homo sapiens
tgagccggtcaggcacaca

SEQ ID NO: 848611 - DNA, 16 bp, Homo sapiens
tgagcctagccctggg

SEQ ID NO: 848612 - DNA, 17 bp, Homo sapiens
tgagcctagccctggga

SEQ ID NO: 848613 - DNA, 12 bp, Homo sapiens
tgagcctatgat

SEQ ID NO: 848614 - DNA, 13 bp, Homo sapiens
tgagcctatgata

SEQ ID NO: 848615 - DNA, 16 bp, Homo sapiens
tgagcctcacagcagt

SEQ ID NO: 848616 - DNA, 17 bp, Homo sapiens
tgagcctcctgtgcctg

SEQ ID NO: 848617 - DNA, 15 bp, Homo sapiens
tgagcctctcacctg

SEQ ID NO: 848618 - DNA, 16 bp, Homo sapiens
tgagcctctgctcccc

SEQ ID NO: 848619 - DNA, 17 bp, Homo sapiens
tgagcctgcatcttctt

SEQ ID NO: 848620 - DNA, 15 bp, Homo sapiens
tgagcctgcattctg

SEQ ID NO: 848621 - DNA, 23 bp, Homo sapiens
tgagcctgccaaagtgcctggga

SEQ ID NO: 848622 - DNA, 17 bp, Homo sapiens
tgagcctgctggaagcc

SEQ ID NO: 848623 - DNA, 16 bp, Homo sapiens
tgagcctggctgtcca

SEQ ID NO: 848624 - DNA, 18 bp, Homo sapiens
tgagcctggctgtccaac

SEQ ID NO: 848625 - DNA, 14 bp, Homo sapiens
tgagcctgggccag

SEQ ID NO: 848626 - DNA, 15 bp, Homo sapiens
tgagcctgggccagg

SEQ ID NO: 848627 - DNA, 11 bp, Homo sapiens
tgagcctggtc

SEQ ID NO: 848628 - DNA, 15 bp, Homo sapiens
tgagcctggtcctgg

SEQ ID NO: 848629 - DNA, 16 bp, Homo sapiens
tgagcctggtcctggc

SEQ ID NO: 848630 - DNA, 18 bp, Homo sapiens
tgagcctgtgaccttggg

SEQ ID NO: 848631 - DNA, 19 bp, Homo sapiens
tgagcctgtgaccttggga

SEQ ID NO: 848632 - DNA, 18 bp, Homo sapiens
tgagccttcgtgcccccc

SEQ ID NO: 848633 - DNA, 19 bp, Homo sapiens
tgagccttgaactttgacc

SEQ ID NO: 848634 - DNA, 15 bp, Homo sapiens
tgagccttgcagata

SEQ ID NO: 848635 - DNA, 22 bp, Homo sapiens
tgagccttgcatgtacttgaag

SEQ ID NO: 848636 - DNA, 19 bp, Homo sapiens
tgagccttggcccacactg

SEQ ID NO: 848637 - DNA, 18 bp, Homo sapiens
tgagcgaaattgtcttta

SEQ ID NO: 848638 - DNA, 22 bp, Homo sapiens
tgagcgacatctctgactttct

SEQ ID NO: 848639 - DNA, 22 bp, Homo sapiens
tgagcgaggagatgctccttgg

SEQ ID NO: 848640 - DNA, 21 bp, Homo sapiens
tgagcgatcatttatttcatg

SEQ ID NO: 848641 - DNA, 13 bp, Homo sapiens
tgagcgccacctc

SEQ ID NO: 848642 - DNA, 15 bp, Homo sapiens
tgagcgcccccgagc

SEQ ID NO: 848643 - DNA, 23 bp, Homo sapiens
tgagcgcccccgagccctgactc

SEQ ID NO: 848644 - DNA, 18 bp, Homo sapiens
tgagcgcctccatccaag

SEQ ID NO: 848645 - DNA, 18 bp, Homo sapiens
tgagcgctggctccctgg

SEQ ID NO: 848646 - DNA, 20 bp, Homo sapiens
tgagcgctggctccctgggc

SEQ ID NO: 848647 - DNA, 14 bp, Homo sapiens
tgagcgctgtggac

SEQ ID NO: 848648 - DNA, 22 bp, Homo sapiens
tgagcggaggctcggccgtggg

SEQ ID NO: 848649 - DNA, 16 bp, Homo sapiens
tgagcggcaccctggt

SEQ ID NO: 848650 - DNA, 12 bp, Homo sapiens
tgagcgggaggc

SEQ ID NO: 848651 - DNA, 13 bp, Homo sapiens
tgagcgggaggca

SEQ ID NO: 848652 - DNA, 14 bp, Homo sapiens
tgagcgggaggcag

SEQ ID NO: 848653 - DNA, 16 bp, Homo sapiens
tgagcgtcactgccca

SEQ ID NO: 848654 - DNA, 18 bp, Homo sapiens
tgagcgtggaagggggag

SEQ ID NO: 848655 - DNA, 13 bp, Homo sapiens
tgagcgtggcctt

SEQ ID NO: 848656 - DNA, 23 bp, Homo sapiens
tgagcgtggccttgggaggacat

SEQ ID NO: 848657 - DNA, 23 bp, Homo sapiens
tgagcgtgtagcgtcctgaggaa

SEQ ID NO: 848658 - DNA, 19 bp, Homo sapiens
tgagctactggattcttat

SEQ ID NO: 848659 - DNA, 16 bp, Homo sapiens
tgagctaggaagagtc

SEQ ID NO: 848660 - DNA, 16 bp, Homo sapiens
tgagctattgctgttc

SEQ ID NO: 848661 - DNA, 19 bp, Homo sapiens
tgagctatttccattccag

SEQ ID NO: 848662 - DNA, 17 bp, Homo sapiens
tgagctcagacccccac

SEQ ID NO: 848663 - DNA, 12 bp, Homo sapiens
tgagctcagccc

SEQ ID NO: 848664 - DNA, 14 bp, Homo sapiens
tgagctccacctct

SEQ ID NO: 848665 - DNA, 12 bp, Homo sapiens
tgagctccagac

SEQ ID NO: 848666 - DNA, 13 bp, Homo sapiens
tgagctccagacc

SEQ ID NO: 848667 - DNA, 16 bp, Homo sapiens
tgagctccagaccccc

SEQ ID NO: 848668 - DNA, 19 bp, Homo sapiens
tgagctccagacccccagc

SEQ ID NO: 848669 - DNA, 14 bp, Homo sapiens
tgagctcccacctc

SEQ ID NO: 848670 - DNA, 15 bp, Homo sapiens
tgagctcccacctcc

SEQ ID NO: 848671 - DNA, 22 bp, Homo sapiens
tgagctcccacctcccttccca

SEQ ID NO: 848672 - DNA, 16 bp, Homo sapiens
tgagctccccagatct

SEQ ID NO: 848673 - DNA, 13 bp, Homo sapiens
tgagctcctctgg

SEQ ID NO: 848674 - DNA, 18 bp, Homo sapiens
tgagctcgcagcccccgc

SEQ ID NO: 848675 - DNA, 14 bp, Homo sapiens
tgagctcggggtcc

SEQ ID NO: 848676 - DNA, 19 bp, Homo sapiens
tgagctctatttccccacc

SEQ ID NO: 848677 - DNA, 15 bp, Homo sapiens
tgagctctccaggcc

SEQ ID NO: 848678 - DNA, 21 bp, Homo sapiens
tgagctctccaggccaggtgg

SEQ ID NO: 848679 - DNA, 12 bp, Homo sapiens
tgagctctctgt

SEQ ID NO: 848680 - DNA, 20 bp, Homo sapiens
tgagctctgaacaaacactg

SEQ ID NO: 848681 - DNA, 21 bp, Homo sapiens
tgagctgaacacatttgccca

SEQ ID NO: 848682 - DNA, 19 bp, Homo sapiens
tgagctgagatcgtgccgt

SEQ ID NO: 848683 - DNA, 14 bp, Homo sapiens
tgagctgaggcagc

SEQ ID NO: 848684 - DNA, 12 bp, Homo sapiens
tgagctgcagcc

SEQ ID NO: 848685 - DNA, 12 bp, Homo sapiens
tgaggtggccca

SEQ ID NO: 848686 - DNA, 16 bp, Homo sapiens
tgaggtggcccaggcc

SEQ ID NO: 848687 - DNA, 16 bp, Homo sapiens
tgaggtggctgtagat

SEQ ID NO: 848688 - DNA, 21 bp, Homo sapiens
tgaggtgggaggatctcttga

SEQ ID NO: 848689 - DNA, 18 bp, Homo sapiens
tgaggtgggaggtggaag

SEQ ID NO: 848690 - DNA, 21 bp, Homo sapiens
tgaggtgggaggtggaagaag

SEQ ID NO: 848691 - DNA, 22 bp, Homo sapiens
tgaggtgggaggtggaagaagg

SEQ ID NO: 848692 - DNA, 13 bp, Homo sapiens
tgaggtggggaag

SEQ ID NO: 848693 - DNA, 18 bp, Homo sapiens
tgaggtgggtgggcctga

SEQ ID NO: 848694 - DNA, 20 bp, Homo sapiens
tgaggtgggtgggcctgact

SEQ ID NO: 848695 - DNA, 14 bp, Homo sapiens
tgaggtggtctgaa

SEQ ID NO: 848696 - DNA, 22 bp, Homo sapiens
tgaggtggtctgaatgttctga

SEQ ID NO: 848697 - DNA, 21 bp, Homo sapiens
tgaggtgtgggggctgcagca

SEQ ID NO: 848698 - DNA, 23 bp, Homo sapiens
tgaggttagagagattggccagc

SEQ ID NO: 848699 - DNA, 17 bp, Homo sapiens
tgaggttcctctgcctg

SEQ ID NO: 848700 - DNA, 19 bp, Homo sapiens
tgaggttcctctgcctgcc

SEQ ID NO: 848701 - DNA, 15 bp, Homo sapiens
tgaggttgctttgtt

SEQ ID NO: 848702 - DNA, 18 bp, Homo sapiens
tgaggtttgaaaagctga

SEQ ID NO: 848703 - DNA, 15 bp, Homo sapiens
tgaggttttgaataa

SEQ ID NO: 848704 - DNA, 16 bp, Homo sapiens
tgaggttttgaataaa

SEQ ID NO: 848705 - DNA, 15 bp, Homo sapiens
tgagtaaaacacata

SEQ ID NO: 848706 - DNA, 16 bp, Homo sapiens
tgagtaaatctaaaga

SEQ ID NO: 848707 - DNA, 18 bp, Homo sapiens
tgagtaaattggaaacat

SEQ ID NO: 848708 - DNA, 22 bp, Homo sapiens
tgagtaaattggaaacattttc

SEQ ID NO: 848709 - DNA, 14 bp, Homo sapiens
tgagtaagagctgg

SEQ ID NO: 848710 - DNA, 22 bp, Homo sapiens
tgagtaagccagttggcttcta

SEQ ID NO: 848711 - DNA, 15 bp, Homo sapiens
tgagtaagtgtgttc

SEQ ID NO: 848712 - DNA, 15 bp, Homo sapiens
tgagtaatggtgtag

SEQ ID NO: 848713 - DNA, 20 bp, Homo sapiens
tgagtaattaataaagaaaa

SEQ ID NO: 848714 - DNA, 22 bp, Homo sapiens
tgagtaattcaagcctctaaac

SEQ ID NO: 848715 - DNA, 21 bp, Homo sapiens
tgagtacagtgaggagggtgg

SEQ ID NO: 848716 - DNA, 22 bp, Homo sapiens
tgagtaccaaatccacaagcca

SEQ ID NO: 848717 - DNA, 16 bp, Homo sapiens
tgagtacgttgtgcat

SEQ ID NO: 848718 - DNA, 17 bp, Homo sapiens
tgagtacgttgtgcatt

SEQ ID NO: 848719 - DNA, 18 bp, Homo sapiens
tgagtacgttgtgcattt

SEQ ID NO: 848720 - DNA, 15 bp, Homo sapiens
tgagtactggaataa

SEQ ID NO: 848721 - DNA, 15 bp, Homo sapiens
tgagtactgtactat

SEQ ID NO: 848722 - DNA, 22 bp, Homo sapiens
tgagtagcctatgaatgaaatt

SEQ ID NO: 848723 - DNA, 12 bp, Homo sapiens
tgagtagctggg

SEQ ID NO: 848724 - DNA, 14 bp, Homo sapiens
tgagtagctgggcc

SEQ ID NO: 848725 - DNA, 22 bp, Homo sapiens
tgagtagctgggcctgtgcact

SEQ ID NO: 848726 - DNA, 15 bp, Homo sapiens
tgagtaggctgggcc

SEQ ID NO: 848727 - DNA, 19 bp, Homo sapiens
tgagtaggtctgggatgga

SEQ ID NO: 848728 - DNA, 17 bp, Homo sapiens
tgagtagtcttatgtaa

SEQ ID NO: 848729 - DNA, 20 bp, Homo sapiens
tgagtagtcttatgtaaagt

SEQ ID NO: 848730 - DNA, 16 bp, Homo sapiens
tgagtatctgtgggag

SEQ ID NO: 848731 - DNA, 20 bp, Homo sapiens
tgagtatgaacttgagatct

SEQ ID NO: 848732 - DNA, 15 bp, Homo sapiens
tgagtatttggtcca

SEQ ID NO: 848733 - DNA, 19 bp, Homo sapiens
tgagtatttggtccaaaaa

SEQ ID NO: 848734 - DNA, 15 bp, Homo sapiens
tgagtcaaaagcctg

SEQ ID NO: 848735 - DNA, 18 bp, Homo sapiens
tgagtcaaaagcctgggt

SEQ ID NO: 848736 - DNA, 18 bp, Homo sapiens
tgagtcaatcagccttta

SEQ ID NO: 848737 - DNA, 14 bp, Homo sapiens
tgagtcaattggaa

SEQ ID NO: 848738 - DNA, 19 bp, Homo sapiens
tgagtcacaggtgtgggat

SEQ ID NO: 848739 - DNA, 20 bp, Homo sapiens
tgagtcaccctacctgtgcc

SEQ ID NO: 848740 - DNA, 22 bp, Homo sapiens
tgagtcaccctacctgtgcctg

SEQ ID NO: 848741 - DNA, 13 bp, Homo sapiens
tgagtcacctgct

SEQ ID NO: 848742 - DNA, 15 bp, Homo sapiens
tgagtcacctgctcc

SEQ ID NO: 848743 - DNA, 16 bp, Homo sapiens
tgagtcacctgctcca

SEQ ID NO: 848744 - DNA, 18 bp, Homo sapiens
tgagtcacctgctccaga

SEQ ID NO: 848745 - DNA, 14 bp, Homo sapiens
tgagtcagaaaaca

SEQ ID NO: 848746 - DNA, 13 bp, Homo sapiens
tgagtcagaatgt

SEQ ID NO: 848747 - DNA, 17 bp, Homo sapiens
tgagtcagaatgtgaaa

SEQ ID NO: 848748 - DNA, 14 bp, Homo sapiens
tgagtcagcacctt

SEQ ID NO: 848749 - DNA, 21 bp, Homo sapiens
tgagtcagcaccttggcccag

SEQ ID NO: 848750 - DNA, 23 bp, Homo sapiens
tgagtcaggagcttattacagaa

SEQ ID NO: 848751 - DNA, 16 bp, Homo sapiens
tgagtcagtgatgagg

SEQ ID NO: 848752 - DNA, 13 bp, Homo sapiens
tgagtcagtgctc

SEQ ID NO: 848753 - DNA, 20 bp, Homo sapiens
tgagtcatctgttagggcct

SEQ ID NO: 848754 - DNA, 21 bp, Homo sapiens
tgagtcatctgttagggcctt

SEQ ID NO: 848755 - DNA, 13 bp, Homo sapiens
tgagtcatttaaa

SEQ ID NO: 848756 - DNA, 14 bp, Homo sapiens
tgagtccagagctt

SEQ ID NO: 848757 - DNA, 13 bp, Homo sapiens
tgagtccagctcc

SEQ ID NO: 848758 - DNA, 14 bp, Homo sapiens
tgagtccagctccc

SEQ ID NO: 848759 - DNA, 15 bp, Homo sapiens
tgagtccagctcccc

SEQ ID NO: 848760 - DNA, 20 bp, Homo sapiens
tgagtcccaggagctgccca

SEQ ID NO: 848761 - DNA, 15 bp, Homo sapiens
tgagtcccaggctga

SEQ ID NO: 848762 - DNA, 23 bp, Homo sapiens
tgagtccctcacgtttcttcccc

SEQ ID NO: 848763 - DNA, 16 bp, Homo sapiens
tgagtccctccatgca

SEQ ID NO: 848764 - DNA, 15 bp, Homo sapiens
tgagtcctaggactt

SEQ ID NO: 848765 - DNA, 17 bp, Homo sapiens
tgagtcctggatgatac

SEQ ID NO: 848766 - DNA, 19 bp, Homo sapiens
tgagtcctggatgatacta

SEQ ID NO: 848767 - DNA, 21 bp, Homo sapiens
tgagtcctggatgatactaat

SEQ ID NO: 848768 - DNA, 18 bp, Homo sapiens
tgagtcctgtctctgcct

SEQ ID NO: 848769 - DNA, 17 bp, Homo sapiens
tgagtcctgttgaagac

SEQ ID NO: 848770 - DNA, 23 bp, Homo sapiens
tgagtcggccccacatgggaacc

SEQ ID NO: 848771 - DNA, 15 bp, Homo sapiens
tgagtctgagtcctg

SEQ ID NO: 848772 - DNA, 21 bp, Homo sapiens
tgagtctgagtcctgtctctg

SEQ ID NO: 848773 - DNA, 18 bp, Homo sapiens
tgagtcttaactgtattt

SEQ ID NO: 848774 - DNA, 20 bp, Homo sapiens
tgagtcttaactgtatttca

SEQ ID NO: 848775 - DNA, 15 bp, Homo sapiens
tgagtcttggttcta

SEQ ID NO: 848776 - DNA, 17 bp, Homo sapiens
tgagtcttggttctaaa

SEQ ID NO: 848777 - DNA, 18 bp, Homo sapiens
tgagtcttggttctaaag

SEQ ID NO: 848778 - DNA, 12 bp, Homo sapiens
tgagtgaatcaa

SEQ ID NO: 848779 - DNA, 20 bp, Homo sapiens
tgagtgacagctttctggga

SEQ ID NO: 848780 - DNA, 16 bp, Homo sapiens
tgagtgacatgcggct

SEQ ID NO: 848781 - DNA, 18 bp, Homo sapiens
tgagtgacatgcggctgc

SEQ ID NO: 848782 - DNA, 22 bp, Homo sapiens
tgagtgaccgggggctgctggg

SEQ ID NO: 848783 - DNA, 14 bp, Homo sapiens
tgagtgagccggga

SEQ ID NO: 848784 - DNA, 17 bp, Homo sapiens
tgagtgaggttcttgta

SEQ ID NO: 848785 - DNA, 21 bp, Homo sapiens
tgagtgaggttcttgtaccac

SEQ ID NO: 848786 - DNA, 12 bp, Homo sapiens
tgagtgcagcca

SEQ ID NO: 848787 - DNA, 14 bp, Homo sapiens
tgagtgcagttggt

SEQ ID NO: 848788 - DNA, 17 bp, Homo sapiens
tgagtgccatgcttttt

SEQ ID NO: 848789 - DNA, 23 bp, Homo sapiens
tgagtgccccacttctggccaca

SEQ ID NO: 848790 - DNA, 17 bp, Homo sapiens
tgagtgccttttgcaga

SEQ ID NO: 848791 - DNA, 21 bp, Homo sapiens
tgagtgcgggctgaggccaga

SEQ ID NO: 848792 - DNA, 13 bp, Homo sapiens
tgagtgctctgat

SEQ ID NO: 848793 - DNA, 17 bp, Homo sapiens
tgagtgctgattcaaac

SEQ ID NO: 848794 - DNA, 23 bp, Homo sapiens
tgagtgctgggcactgctccaag

SEQ ID NO: 848795 - DNA, 22 bp, Homo sapiens
tgagtgcttgttagagagaaag

SEQ ID NO: 848796 - DNA, 16 bp, Homo sapiens
tgagtggaagggagga

SEQ ID NO: 848797 - DNA, 14 bp, Homo sapiens
tgagtggaatgcag

SEQ ID NO: 848798 - DNA, 19 bp, Homo sapiens
tgagtggaatgcagggaag

SEQ ID NO: 848799 - DNA, 15 bp, Homo sapiens
tgagtggcagccatg

SEQ ID NO: 848800 - DNA, 16 bp, Homo sapiens
tgagtggcagccatgc

SEQ ID NO: 848801 - DNA, 20 bp, Homo sapiens
tgagtggcagccatgcctca

SEQ ID NO: 848802 - DNA, 15 bp, Homo sapiens
tgagtggccagcgcc

SEQ ID NO: 848803 - DNA, 12 bp, Homo sapiens
tgagtgggagaa

SEQ ID NO: 848804 - DNA, 15 bp, Homo sapiens
tgagtgggagaaggc

SEQ ID NO: 848805 - DNA, 13 bp, Homo sapiens
tgagtgggccctg

SEQ ID NO: 848806 - DNA, 16 bp, Homo sapiens
tgagtgggccctgccc

SEQ ID NO: 848807 - DNA, 15 bp, Homo sapiens
tgatcctctattttg

SEQ ID NO: 848808 - DNA, 15 bp, Homo sapiens
tgatcctgccaatct

SEQ ID NO: 848809 - DNA, 15 bp, Homo sapiens
tgatccttacaagtt

SEQ ID NO: 848810 - DNA, 16 bp, Homo sapiens
tgatccttctgagctc

SEQ ID NO: 848811 - DNA, 16 bp, Homo sapiens
tgatcgaaaaaataat

SEQ ID NO: 848812 - DNA, 15 bp, Homo sapiens
tgatcgacttcttgg

SEQ ID NO: 848813 - DNA, 16 bp, Homo sapiens
tgatcgacttcttggt

SEQ ID NO: 848814 - DNA, 19 bp, Homo sapiens
tgatcgcccgataaagacg

SEQ ID NO: 848815 - DNA, 18 bp, Homo sapiens
tgatcggagcctcctctc

SEQ ID NO: 848816 - DNA, 17 bp, Homo sapiens
tgatctacccgtgcctg

SEQ ID NO: 848817 - DNA, 20 bp, Homo sapiens
tgatctacttctgtaattgt

SEQ ID NO: 848818 - DNA, 14 bp, Homo sapiens
tgatctacttgcct

SEQ ID NO: 848819 - DNA, 19 bp, Homo sapiens
tgatctacttgcctcattt

SEQ ID NO: 848820 - DNA, 14 bp, Homo sapiens
tgatctcagggcag

SEQ ID NO: 848821 - DNA, 19 bp, Homo sapiens
tgatctccatatgttacac

SEQ ID NO: 848822 - DNA, 20 bp, Homo sapiens
tgatctccatggcttcctcc

SEQ ID NO: 848823 - DNA, 15 bp, Homo sapiens
tgatctccctgccgc

SEQ ID NO: 848824 - DNA, 17 bp, Homo sapiens
tgatctccctgccgcct

SEQ ID NO: 848825 - DNA, 21 bp, Homo sapiens
tgatctctactaccacaagga

SEQ ID NO: 848826 - DNA, 20 bp, Homo sapiens
tgatctctcagccccaaaca

SEQ ID NO: 848827 - DNA, 18 bp, Homo sapiens
tgatctctgacctctgct

SEQ ID NO: 848828 - DNA, 14 bp, Homo sapiens
tgatctcttagaag

SEQ ID NO: 848829 - DNA, 17 bp, Homo sapiens
tgatctcttagaagcca

SEQ ID NO: 848830 - DNA, 23 bp, Homo sapiens
tgatctcttcttttggcttccat

SEQ ID NO: 848831 - DNA, 16 bp, Homo sapiens
tgatctgcatatttct

SEQ ID NO: 848832 - DNA, 20 bp, Homo sapiens
tgatctgctagtgctgtaat

SEQ ID NO: 848833 - DNA, 12 bp, Homo sapiens
tgatctgctctg

SEQ ID NO: 848834 - DNA, 13 bp, Homo sapiens
tgatctgctctgt

SEQ ID NO: 848835 - DNA, 16 bp, Homo sapiens
tgatctgctctgtttt

SEQ ID NO: 848836 - DNA, 19 bp, Homo sapiens
tgatctgggcattttcctc

SEQ ID NO: 848837 - DNA, 14 bp, Homo sapiens
tgatctgtactttg

SEQ ID NO: 848838 - DNA, 15 bp, Homo sapiens
tgatctgtatataca

SEQ ID NO: 848839 - DNA, 15 bp, Homo sapiens
tgatctgtatttaat

SEQ ID NO: 848840 - DNA, 23 bp, Homo sapiens
tgatctgtatttaatggttttta

SEQ ID NO: 848841 - DNA, 14 bp, Homo sapiens
tgatctgtctgtgg

SEQ ID NO: 848842 - DNA, 21 bp, Homo sapiens
tgatctgtgatagttcacccc

SEQ ID NO: 848843 - DNA, 16 bp, Homo sapiens
tgatctgtgatttctt

SEQ ID NO: 848844 - DNA, 18 bp, Homo sapiens
tgatctgtgatttcttct

SEQ ID NO: 848845 - DNA, 20 bp, Homo sapiens
tgatcttctgggagcaggaa

SEQ ID NO: 848846 - DNA, 14 bp, Homo sapiens
tgatcttcttcatc

SEQ ID NO: 848847 - DNA, 15 bp, Homo sapiens
tgatcttcttcatcc

SEQ ID NO: 848848 - DNA, 21 bp, Homo sapiens
tgatcttgcctgtctggctca

SEQ ID NO: 848849 - DNA, 15 bp, Homo sapiens
tgatcttgtgacata

SEQ ID NO: 848850 - DNA, 16 bp, Homo sapiens
tgatcttgtgctcagc

SEQ ID NO: 848851 - DNA, 18 bp, Homo sapiens
tgatcttgtgctcagcat

SEQ ID NO: 848852 - DNA, 19 bp, Homo sapiens
tgatctttgtttaaatgcc

SEQ ID NO: 848853 - DNA, 19 bp, Homo sapiens
tgatcttttaaaatcatga

SEQ ID NO: 848854 - DNA, 17 bp, Homo sapiens
tgatcttttaaagtgtt

SEQ ID NO: 848855 - DNA, 18 bp, Homo sapiens
tgatctttttatacacaa

SEQ ID NO: 848856 - DNA, 20 bp, Homo sapiens
tgatgaaaactaaggatttt

SEQ ID NO: 848857 - DNA, 20 bp, Homo sapiens
tgatgaaactcctgattttg

SEQ ID NO: 848858 - DNA, 16 bp, Homo sapiens
tgatgaaattcttgaa

SEQ ID NO: 848859 - DNA, 15 bp, Homo sapiens
tgatgaactttctct

SEQ ID NO: 848860 - DNA, 23 bp, Homo sapiens
tgatgaactttctcttcatactt

SEQ ID NO: 848861 - DNA, 13 bp, Homo sapiens
tgatgaagaaatg

SEQ ID NO: 848862 - DNA, 14 bp, Homo sapiens
tgatgaatactgta

SEQ ID NO: 848863 - DNA, 17 bp, Homo sapiens
tgatgaatcaatgaaaa

SEQ ID NO: 848864 - DNA, 15 bp, Homo sapiens
tgatgaattcttcct

SEQ ID NO: 848865 - DNA, 20 bp, Homo sapiens
tgatgaattcttcctctcct

SEQ ID NO: 848866 - DNA, 23 bp, Homo sapiens
tgatgaattcttcctctccttcc

SEQ ID NO: 848867 - DNA, 15 bp, Homo sapiens
tgatgacccttttca

SEQ ID NO: 848868 - DNA, 16 bp, Homo sapiens
tgatgacccttttcat

SEQ ID NO: 848869 - DNA, 22 bp, Homo sapiens
tgatgaccttatcagcttcctg

SEQ ID NO: 848870 - DNA, 16 bp, Homo sapiens
tgatgacgcctgtctg

SEQ ID NO: 848871 - DNA, 15 bp, Homo sapiens
tgatgactcgaaact

SEQ ID NO: 848872 - DNA, 14 bp, Homo sapiens
tgatgacttgctgt

SEQ ID NO: 848873 - DNA, 19 bp, Homo sapiens
tgatgactttctgttttct

SEQ ID NO: 848874 - DNA, 22 bp, Homo sapiens
tgatgagaattgtatgtcatgt

SEQ ID NO: 848875 - DNA, 18 bp, Homo sapiens
tgatgagccatattaatt

SEQ ID NO: 848876 - DNA, 21 bp, Homo sapiens
tgatgaggccgcggcctcccc

SEQ ID NO: 848877 - DNA, 15 bp, Homo sapiens
tgatgaggctggtga

SEQ ID NO: 848878 - DNA, 22 bp, Homo sapiens
tgatgaggtattttttcctttt

SEQ ID NO: 848879 - DNA, 15 bp, Homo sapiens
tgatgagtaaactga

SEQ ID NO: 848880 - DNA, 20 bp, Homo sapiens
tgatgagtaaactgaggccc

SEQ ID NO: 848881 - DNA, 13 bp, Homo sapiens
tgatgagttgtga

SEQ ID NO: 848882 - DNA, 17 bp, Homo sapiens
tgatgatacaatgaaca

SEQ ID NO: 848883 - DNA, 21 bp, Homo sapiens
tgatgatcagctgtttgtcat

SEQ ID NO: 848884 - DNA, 15 bp, Homo sapiens
tgatgatccagaaca

SEQ ID NO: 848885 - DNA, 15 bp, Homo sapiens
tgatgatgataatga

SEQ ID NO: 848886 - DNA, 16 bp, Homo sapiens
tgatgatgatgatgaa

SEQ ID NO: 848887 - DNA, 20 bp, Homo sapiens
tgatgatgtcggtcttgcaa

SEQ ID NO: 848888 - DNA, 18 bp, Homo sapiens
tgatgatgtctacagaaa

SEQ ID NO: 848889 - DNA, 21 bp, Homo sapiens
tgatgatgtctcttgtagaag

SEQ ID NO: 848890 - DNA, 13 bp, Homo sapiens
tgatgatgtggaa

SEQ ID NO: 848891 - DNA, 17 bp, Homo sapiens
tgatgatgttttgatat

SEQ ID NO: 848892 - DNA, 18 bp, Homo sapiens
tgatgattttgcaaaatg

SEQ ID NO: 848893 - DNA, 22 bp, Homo sapiens
tgatgattttgtaattcttatg

SEQ ID NO: 848894 - DNA, 20 bp, Homo sapiens
tgatgcacagagaagctggg

SEQ ID NO: 848895 - DNA, 17 bp, Homo sapiens
tgatgcagcctgtggct

SEQ ID NO: 848896 - DNA, 21 bp, Homo sapiens
tgatgcagcttatacgaaata

SEQ ID NO: 848897 - DNA, 21 bp, Homo sapiens
tgatgcagttagtatagcttt

SEQ ID NO: 848898 - DNA, 23 bp, Homo sapiens
tgatgcatgcactgttccccctg

SEQ ID NO: 848899 - DNA, 18 bp, Homo sapiens
tgatgccagagggccagc

SEQ ID NO: 848900 - DNA, 20 bp, Homo sapiens
tgatgccagagggccagcag

SEQ ID NO: 848901 - DNA, 21 bp, Homo sapiens
tgatgccagagggccagcagg

SEQ ID NO: 848902 - DNA, 15 bp, Homo sapiens
tgatgccaggtgcaa

SEQ ID NO: 848903 - DNA, 17 bp, Homo sapiens
tgatgccccttctcccc

SEQ ID NO: 848904 - DNA, 21 bp, Homo sapiens
tgatgccccttctccccttcc

SEQ ID NO: 848905 - DNA, 17 bp, Homo sapiens
tgatgccctcccctcag

SEQ ID NO: 848906 - DNA, 22 bp, Homo sapiens
tgatgccctcccctcagcgcag

SEQ ID NO: 848907 - DNA, 19 bp, Homo sapiens
tgatgccctcttctccttg

SEQ ID NO: 848908 - DNA, 21 bp, Homo sapiens
tgatgccctcttctccttgcc

SEQ ID NO: 848909 - DNA, 22 bp, Homo sapiens
tgatgccgaacattaggaattg

SEQ ID NO: 848910 - DNA, 16 bp, Homo sapiens
tgatgccgggcgccag

SEQ ID NO: 848911 - DNA, 21 bp, Homo sapiens
tgatgccgggcgccaggacag

SEQ ID NO: 848912 - DNA, 22 bp, Homo sapiens
tgatgccgggcgccaggacagc

SEQ ID NO: 848913 - DNA, 16 bp, Homo sapiens
tgatgctatttatgca

SEQ ID NO: 848914 - DNA, 15 bp, Homo sapiens
tgatgctccctcccc

SEQ ID NO: 848915 - DNA, 21 bp, Homo sapiens
tgatgctccctcccctgccct

SEQ ID NO: 848916 - DNA, 16 bp, Homo sapiens
tgatgctcccttgatg

SEQ ID NO: 848917 - DNA, 16 bp, Homo sapiens
tgatgctcctccgggt

SEQ ID NO: 848918 - DNA, 21 bp, Homo sapiens
tgatgctcctccgggtctgcg

SEQ ID NO: 848919 - DNA, 23 bp, Homo sapiens
tgatgctctggcttgccccagga

SEQ ID NO: 848920 - DNA, 14 bp, Homo sapiens
tgatgctggagagg

SEQ ID NO: 848921 - DNA, 17 bp, Homo sapiens
tgatgctggagaggtta

SEQ ID NO: 848922 - DNA, 16 bp, Homo sapiens
tgatgctgtgtgccca

SEQ ID NO: 848923 - DNA, 13 bp, Homo sapiens
tgatgctgttaac

SEQ ID NO: 848924 - DNA, 13 bp, Homo sapiens
tgatggaaaataa

SEQ ID NO: 848925 - DNA, 14 bp, Homo sapiens
tgatggaaaataaa

SEQ ID NO: 848926 - DNA, 23 bp, Homo sapiens
tgatggaccagtggtttccagtc

SEQ ID NO: 848927 - DNA, 12 bp, Homo sapiens
tgatggaccctc

SEQ ID NO: 848928 - DNA, 18 bp, Homo sapiens
tgatttgatctttgttta

SEQ ID NO: 848929 - DNA, 13 bp, Homo sapiens
tgatttgatgtga

SEQ ID NO: 848930 - DNA, 18 bp, Homo sapiens
tgatttgcattgaacaca

SEQ ID NO: 848931 - DNA, 18 bp, Homo sapiens
tgatttgccgacatgttt

SEQ ID NO: 848932 - DNA, 17 bp, Homo sapiens
tgatttgcctgtaattt

SEQ ID NO: 848933 - DNA, 19 bp, Homo sapiens
tgatttggaagagaggcac

SEQ ID NO: 848934 - DNA, 22 bp, Homo sapiens
tgatttggaagagaggcacctg

SEQ ID NO: 848935 - DNA, 22 bp, Homo sapiens
tgatttggtcagattgggataa

SEQ ID NO: 848936 - DNA, 13 bp, Homo sapiens
tgatttggtgacc

SEQ ID NO: 848937 - DNA, 23 bp, Homo sapiens
tgatttgtaccattccttcaaat

SEQ ID NO: 848938 - DNA, 18 bp, Homo sapiens
tgatttgtactgaaaaat

SEQ ID NO: 848939 - DNA, 18 bp, Homo sapiens
tgatttgtatgttaaagt

SEQ ID NO: 848940 - DNA, 14 bp, Homo sapiens
tgatttgtcccagc

SEQ ID NO: 848941 - DNA, 15 bp, Homo sapiens
tgatttgtcccagcc

SEQ ID NO: 848942 - DNA, 11 bp, Homo sapiens
tgatttgtcct

SEQ ID NO: 848943 - DNA, 20 bp, Homo sapiens
tgatttgttttgaattttgt

SEQ ID NO: 848944 - DNA, 19 bp, Homo sapiens
tgattttaacaataactac

SEQ ID NO: 848945 - DNA, 22 bp, Homo sapiens
tgattttaacaataactactgt

SEQ ID NO: 848946 - DNA, 19 bp, Homo sapiens
tgattttaagtttctctgc

SEQ ID NO: 848947 - DNA, 22 bp, Homo sapiens
tgattttaagtttctctgcaga

SEQ ID NO: 848948 - DNA, 14 bp, Homo sapiens
tgattttaatacat

SEQ ID NO: 848949 - DNA, 18 bp, Homo sapiens
tgattttagctgcagaac

SEQ ID NO: 848950 - DNA, 16 bp, Homo sapiens
tgattttattacagaa

SEQ ID NO: 848951 - DNA, 17 bp, Homo sapiens
tgattttatttttgcaa

SEQ ID NO: 848952 - DNA, 18 bp, Homo sapiens
tgattttatttttgcaaa

SEQ ID NO: 848953 - DNA, 20 bp, Homo sapiens
tgattttcaaagctttttcc

SEQ ID NO: 848954 - DNA, 15 bp, Homo sapiens
tgattttcattgctg

SEQ ID NO: 848955 - DNA, 16 bp, Homo sapiens
tgattttcatttcatg

SEQ ID NO: 848956 - DNA, 14 bp, Homo sapiens
tgattttctaaaaa

SEQ ID NO: 848957 - DNA, 12 bp, Homo sapiens
tgattttctgtt

SEQ ID NO: 848958 - DNA, 20 bp, Homo sapiens
tgattttgcaaaatgagttg

SEQ ID NO: 848959 - DNA, 18 bp, Homo sapiens
tgattttgccctcctgcc

SEQ ID NO: 848960 - DNA, 19 bp, Homo sapiens
tgattttgctgtagaagat

SEQ ID NO: 848961 - DNA, 16 bp, Homo sapiens
tgattttgtaattctt

SEQ ID NO: 848962 - DNA, 19 bp, Homo sapiens
tgattttgtatgtaaatac

SEQ ID NO: 848963 - DNA, 20 bp, Homo sapiens
tgattttgtttactgaaatt

SEQ ID NO: 848964 - DNA, 15 bp, Homo sapiens
tgatttttaatggaa

SEQ ID NO: 848965 - DNA, 23 bp, Homo sapiens
tgatttttaatttttttaaattt

SEQ ID NO: 848966 - DNA, 22 bp, Homo sapiens
tgatttttctaaccttgaatgc

SEQ ID NO: 848967 - DNA, 22 bp, Homo sapiens
tgatttttgcctcttccagtct

SEQ ID NO: 848968 - DNA, 23 bp, Homo sapiens
tgatttttgtttttgtaatgcac

SEQ ID NO: 848969 - DNA, 14 bp, Homo sapiens
tgattttttgaaag

SEQ ID NO: 848970 - DNA, 21 bp, Homo sapiens
tgatttttttaatagtgcttt

SEQ ID NO: 848971 - DNA, 16 bp, Homo sapiens
tgattttttttccttt

SEQ ID NO: 848972 - DNA, 20 bp, Homo sapiens
tgatttttttttttttttcc

SEQ ID NO: 848973 - DNA, 21 bp, Homo sapiens
tgatttttttttttttttcct

SEQ ID NO: 848974 - DNA, 15 bp, Homo sapiens
tgcaaaaaaaaactt

SEQ ID NO: 848975 - DNA, 18 bp, Homo sapiens
tgcaaaaaaaaacttaaa

SEQ ID NO: 848976 - DNA, 22 bp, Homo sapiens
tgcaaaaaaaaacttaaagcaa

SEQ ID NO: 848977 - DNA, 15 bp, Homo sapiens
tgcaaaaaaaattag

SEQ ID NO: 848978 - DNA, 14 bp, Homo sapiens
tgcaaaaaaagcct

SEQ ID NO: 848979 - DNA, 18 bp, Homo sapiens
tgcaaaaaaagcctccaa

SEQ ID NO: 848980 - DNA, 22 bp, Homo sapiens
tgcaaaaaaagcctccaagggt

SEQ ID NO: 848981 - DNA, 22 bp, Homo sapiens
tgcaaaaaatactttttctaat

SEQ ID NO: 848982 - DNA, 16 bp, Homo sapiens
tgcaaaaaattcttta

SEQ ID NO: 848983 - DNA, 17 bp, Homo sapiens
tgcaaaaagaaaaaaag

SEQ ID NO: 848984 - DNA, 18 bp, Homo sapiens
tgcaaaaatatttataaa

SEQ ID NO: 848985 - DNA, 17 bp, Homo sapiens
tgcaaaaccttttactg

SEQ ID NO: 848986 - DNA, 18 bp, Homo sapiens
tgcaaaaccttttactgg

SEQ ID NO: 848987 - DNA, 20 bp, Homo sapiens
tgcaaaagactaatttaaaa

SEQ ID NO: 848988 - DNA, 23 bp, Homo sapiens
tgcaaaagactaatttaaaaaat

SEQ ID NO: 848989 - DNA, 15 bp, Homo sapiens
tgcaaaagcttcaaa

SEQ ID NO: 848990 - DNA, 15 bp, Homo sapiens
tgcaaaataaagaat

SEQ ID NO: 848991 - DNA, 12 bp, Homo sapiens
tgcaaaatacat

SEQ ID NO: 848992 - DNA, 14 bp, Homo sapiens
tgcaaaatgtctgt

SEQ ID NO: 848993 - DNA, 22 bp, Homo sapiens
tgcaaaattagtacctcaaagt

SEQ ID NO: 848994 - DNA, 17 bp, Homo sapiens
tgcaaaattgttttcac

SEQ ID NO: 848995 - DNA, 15 bp, Homo sapiens
tgcaaaatttccagt

SEQ ID NO: 848996 - DNA, 22 bp, Homo sapiens
tgcaaaatttgatgccaggaca

SEQ ID NO: 848997 - DNA, 16 bp, Homo sapiens
tgcaaacaacctgaat

SEQ ID NO: 848998 - DNA, 19 bp, Homo sapiens
tgcaaacaacctgaatctt

SEQ ID NO: 848999 - DNA, 21 bp, Homo sapiens
tgcaaacaacctgaatctttt

SEQ ID NO: 849000 - DNA, 12 bp, Homo sapiens
tgcaaacaatga

SEQ ID NO: 849001 - DNA, 15 bp, Homo sapiens
tgcaaacagaaatca

SEQ ID NO: 849002 - DNA, 17 bp, Homo sapiens
tgcaaacagttcttgga

SEQ ID NO: 849003 - DNA, 22 bp, Homo sapiens
tgcaaacatggggttggctggg

SEQ ID NO: 849004 - DNA, 14 bp, Homo sapiens
tgcaaacattacct

SEQ ID NO: 849005 - DNA, 22 bp, Homo sapiens
tgcaaaccacttctccatgctg

SEQ ID NO: 849006 - DNA, 22 bp, Homo sapiens
tgcaaacctgacccctgctcag

SEQ ID NO: 849007 - DNA, 16 bp, Homo sapiens
tgcaaaccttcctggg

SEQ ID NO: 849008 - DNA, 16 bp, Homo sapiens
tgcaaactgctttatt

SEQ ID NO: 849009 - DNA, 16 bp, Homo sapiens
tgcaaagaaaatcaga

SEQ ID NO: 849010 - DNA, 15 bp, Homo sapiens
tgcaaagactctgag

SEQ ID NO: 849011 - DNA, 17 bp, Homo sapiens
tgcaaagactctgagcc

SEQ ID NO: 849012 - DNA, 21 bp, Homo sapiens
tgcaaagactctgagccaagg

SEQ ID NO: 849013 - DNA, 17 bp, Homo sapiens
tgcaaagcactctctgc

SEQ ID NO: 849014 - DNA, 19 bp, Homo sapiens
tgcaaagcactctctgcag

SEQ ID NO: 849015 - DNA, 15 bp, Homo sapiens
tgcaaagcgacagat

SEQ ID NO: 849016 - DNA, 13 bp, Homo sapiens
tgcaaaggagaag

SEQ ID NO: 849017 - DNA, 20 bp, Homo sapiens
tgcaaaggagaagcacagct

SEQ ID NO: 849018 - DNA, 12 bp, Homo sapiens
tgcaaaggccct

SEQ ID NO: 849019 - DNA, 14 bp, Homo sapiens
tgcaaaggcccttg

SEQ ID NO: 849020 - DNA, 12 bp, Homo sapiens
tgcaaagtattg

SEQ ID NO: 849021 - DNA, 16 bp, Homo sapiens
tgcaaagtattgtaaa

SEQ ID NO: 849022 - DNA, 20 bp, Homo sapiens
tgcaaagtattgtaaattat

SEQ ID NO: 849023 - DNA, 23 bp, Homo sapiens
tgcaaagtcgccagtcactgctg

SEQ ID NO: 849024 - DNA, 19 bp, Homo sapiens
tgcaaataaagccttttaa

SEQ ID NO: 849025 - DNA, 23 bp, Homo sapiens
tgcaaataagtgtattttgaaat

SEQ ID NO: 849026 - DNA, 23 bp, Homo sapiens
tgcaaatactgtatattcaggac

SEQ ID NO: 849027 - DNA, 16 bp, Homo sapiens
tgcaaatctgacaata

SEQ ID NO: 849028 - DNA, 15 bp, Homo sapiens
tgcaaatgaatcatt

SEQ ID NO: 849029 - DNA, 16 bp, Homo sapiens
tgcaaatgaatcattg

SEQ ID NO: 849030 - DNA, 21 bp, Homo sapiens
tgcaaatgctatgagatgcat

SEQ ID NO: 849031 - DNA, 22 bp, Homo sapiens
tgcaaatgggagctgagcagcc

SEQ ID NO: 849032 - DNA, 21 bp, Homo sapiens
tgcaaattaaaacatatttca

SEQ ID NO: 849033 - DNA, 19 bp, Homo sapiens
tgcaaattatttattactt

SEQ ID NO: 849034 - DNA, 12 bp, Homo sapiens
tgcaaatttcat

SEQ ID NO: 849035 - DNA, 16 bp, Homo sapiens
tgcaaatttctataaa

SEQ ID NO: 849036 - DNA, 16 bp, Homo sapiens
tgcaaattttgcattt

SEQ ID NO: 849037 - DNA, 17 bp, Homo sapiens
tgcaaattttgcattta

SEQ ID NO: 849038 - DNA, 14 bp, Homo sapiens
tgcaacacacagac

SEQ ID NO: 849039 - DNA, 17 bp, Homo sapiens
tgcaacaggggaggaaa

SEQ ID NO: 849040 - DNA, 15 bp, Homo sapiens
tgcaacagtaatcag

SEQ ID NO: 849041 - DNA, 16 bp, Homo sapiens
tgcaacagtaatcaga

SEQ ID NO: 849042 - DNA, 15 bp, Homo sapiens
tgcaacatctctgaa

SEQ ID NO: 849043 - DNA, 16 bp, Homo sapiens
tgcaacatctctgaat

SEQ ID NO: 849044 - DNA, 16 bp, Homo sapiens
tgcaacatttctgtat

SEQ ID NO: 849045 - DNA, 17 bp, Homo sapiens
tgcaacatttctgtata

SEQ ID NO: 849046 - DNA, 11 bp, Homo sapiens
tgcaaccactg

SEQ ID NO: 849047 - DNA, 15 bp, Homo sapiens
tgcaaccagaattgt

SEQ ID NO: 849048 - DNA, 18 bp, Homo sapiens
tgcaaccagaattgtcct

SEQ ID NO: 849049 - DNA, 12 bp, Homo sapiens
tgcaaccaggca

SEQ ID NO: 849050 - DNA, 13 bp, Homo sapiens
tgcaaccaggcag

SEQ ID NO: 849051 - DNA, 15 bp, Homo sapiens
tgcaaccaggcagct

SEQ ID NO: 849052 - DNA, 15 bp, Homo sapiens
tgcaacccttacccc

SEQ ID NO: 849053 - DNA, 16 bp, Homo sapiens
tgcaaccgggccctct

SEQ ID NO: 849054 - DNA, 16 bp, Homo sapiens
tgcaaccgtctgttat

SEQ ID NO: 849055 - DNA, 17 bp, Homo sapiens
tgcaacctcaccttcct

SEQ ID NO: 849056 - DNA, 23 bp, Homo sapiens
tgcaacctcaccttcctgtgggt

SEQ ID NO: 849057 - DNA, 14 bp, Homo sapiens
tgcaacctccgcct

SEQ ID NO: 849058 - DNA, 15 bp, Homo sapiens
tgcaacctccgcctc

SEQ ID NO: 849059 - DNA, 14 bp, Homo sapiens
tgcaacctgtggct

SEQ ID NO: 849060 - DNA, 18 bp, Homo sapiens
tgcaacctgtggctcagg

SEQ ID NO: 849061 - DNA, 24 bp, Homo sapiens
tgcaactaactgactctgttattg

SEQ ID NO: 849062 - DNA, 19 bp, Homo sapiens
tgcaactaattcaataaaa

SEQ ID NO: 849063 - DNA, 13 bp, Homo sapiens
tgcaactagccaa

SEQ ID NO: 849064 - DNA, 16 bp, Homo sapiens
tgcaactagccaaggc

SEQ ID NO: 849065 - DNA, 18 bp, Homo sapiens
tgcaactaggtatttcta

SEQ ID NO: 849066 - DNA, 19 bp, Homo sapiens
tgcaactaggtatttctaa

SEQ ID NO: 849067 - DNA, 13 bp, Homo sapiens
tgcaactggccag

SEQ ID NO: 849068 - DNA, 22 bp, Homo sapiens
tgcaacttagatctctcctgca

SEQ ID NO: 849069 - DNA, 21 bp, Homo sapiens
tgcaacttctttttattttct

SEQ ID NO: 849070 - DNA, 18 bp, Homo sapiens
tgcaacttgtgaactcca

SEQ ID NO: 849071 - DNA, 22 bp, Homo sapiens
tgcaagaaaggggacccaagaa

SEQ ID NO: 849072 - DNA, 22 bp, Homo sapiens
tgcaagaagccatttagggcag

SEQ ID NO: 849073 - DNA, 15 bp, Homo sapiens
tgcaagaagcgccga

SEQ ID NO: 849074 - DNA, 14 bp, Homo sapiens
tgcaagaattaaaa

SEQ ID NO: 849075 - DNA, 16 bp, Homo sapiens
tgcaagaattaaaact

SEQ ID NO: 849076 - DNA, 18 bp, Homo sapiens
tgcaagaattaaaactga

SEQ ID NO: 849077 - DNA, 21 bp, Homo sapiens
tgcaagaattaaaactgagtc

SEQ ID NO: 849078 - DNA, 14 bp, Homo sapiens
tgcaagagccttgg

SEQ ID NO: 849079 - DNA, 15 bp, Homo sapiens
tgcaagagtgattgc

SEQ ID NO: 849080 - DNA, 17 bp, Homo sapiens
tgcaagagtgattgcag

SEQ ID NO: 849081 - DNA, 22 bp, Homo sapiens
tgcaagcatttttccatctgtg

SEQ ID NO: 849082 - DNA, 11 bp, Homo sapiens
tgcaagccata

SEQ ID NO: 849083 - DNA, 22 bp, Homo sapiens
tgcaagccataacgtgccccca

SEQ ID NO: 849084 - DNA, 13 bp, Homo sapiens
tgcaagccccagg

SEQ ID NO: 849085 - DNA, 14 bp, Homo sapiens
tgcaagccccaggg

SEQ ID NO: 849086 - DNA, 15 bp, Homo sapiens
tgcaagccccagggc

SEQ ID NO: 849087 - DNA, 19 bp, Homo sapiens
tgcaagccccagggcctgg

SEQ ID NO: 849088 - DNA, 20 bp, Homo sapiens
tgcaagccccagggcctggg

SEQ ID NO: 849089 - DNA, 21 bp, Homo sapiens
tgcaagccccagggcctgggg

SEQ ID NO: 849090 - DNA, 19 bp, Homo sapiens
tgcaagcccctctttctgt

SEQ ID NO: 849091 - DNA, 18 bp, Homo sapiens
tgcaagcctgtctgagac

SEQ ID NO: 849092 - DNA, 19 bp, Homo sapiens
tgcaagcctgtctgagact

SEQ ID NO: 849093 - DNA, 19 bp, Homo sapiens
tgcaagcttggtcaaactt

SEQ ID NO: 849094 - DNA, 15 bp, Homo sapiens
tgcaaggaaggaaag

SEQ ID NO: 849095 - DNA, 13 bp, Homo sapiens
tgcaaggaccagg

SEQ ID NO: 849096 - DNA, 14 bp, Homo sapiens
tgcaaggaccagga

SEQ ID NO: 849097 - DNA, 17 bp, Homo sapiens
tgcaaggaccaggactc

SEQ ID NO: 849098 - DNA, 17 bp, Homo sapiens
tgcaaggacctaaaaca

SEQ ID NO: 849099 - DNA, 23 bp, Homo sapiens
tgcaaggcctggtgtttcttgat

SEQ ID NO: 849100 - DNA, 14 bp, Homo sapiens
tgcaagggcccaga

SEQ ID NO: 849101 - DNA, 18 bp, Homo sapiens
tgcaaggtactctggtga

SEQ ID NO: 849102 - DNA, 22 bp, Homo sapiens
tgcaaggtattacactctgtaa

SEQ ID NO: 849103 - DNA, 16 bp, Homo sapiens
tgcaaggtctttggtt

SEQ ID NO: 849104 - DNA, 18 bp, Homo sapiens
tgcaaggtgctggtgggt

SEQ ID NO: 849105 - DNA, 13 bp, Homo sapiens
tgcaaggtggcct

SEQ ID NO: 849106 - DNA, 20 bp, Homo sapiens
tgcaaggtggcctctgcctg

SEQ ID NO: 849107 - DNA, 22 bp, Homo sapiens
tgcaaggtggcctttgtgctgc

SEQ ID NO: 849108 - DNA, 19 bp, Homo sapiens
tgcaagtactgctgtaaat

SEQ ID NO: 849109 - DNA, 15 bp, Homo sapiens
tgcaagtatgtgagt

SEQ ID NO: 849110 - DNA, 23 bp, Homo sapiens
tgcaagtcagtccaggatgctaa

SEQ ID NO: 849111 - DNA, 23 bp, Homo sapiens
tgcaagtctggacaaatgtatag

SEQ ID NO: 849112 - DNA, 18 bp, Homo sapiens
tgcaagtgaaggtttaca

SEQ ID NO: 849113 - DNA, 12 bp, Homo sapiens
tgcaagtgctgg

SEQ ID NO: 849114 - DNA, 23 bp, Homo sapiens
tgcaagtgctggagtctcctgag

SEQ ID NO: 849115 - DNA, 23 bp, Homo sapiens
tgcaagtgtgtgcacatgtgtgc

SEQ ID NO: 849116 - DNA, 17 bp, Homo sapiens
tgcaagttagggtctat

SEQ ID NO: 849117 - DNA, 18 bp, Homo sapiens
tgcaagttattttatttg

SEQ ID NO: 849118 - DNA, 18 bp, Homo sapiens
tgcaagttgaggacttct

SEQ ID NO: 849119 - DNA, 16 bp, Homo sapiens
tgcaagtttatcagta

SEQ ID NO: 849120 - DNA, 12 bp, Homo sapiens
tgcaataacagc

SEQ ID NO: 849121 - DNA, 14 bp, Homo sapiens
tgcaataacagctg

SEQ ID NO: 849122 - DNA, 17 bp, Homo sapiens
tgcaataacagctgcaa

SEQ ID NO: 849123 - DNA, 18 bp, Homo sapiens
tgcaataacagctgcaat

SEQ ID NO: 849124 - DNA, 17 bp, Homo sapiens
tgcaataacttctatat

SEQ ID NO: 849125 - DNA, 20 bp, Homo sapiens
tgcaataagattggtgttcg

SEQ ID NO: 849126 - DNA, 18 bp, Homo sapiens
tgcaataatatcaaaaca

SEQ ID NO: 849127 - DNA, 19 bp, Homo sapiens
tgcaataatatcaaaacaa

SEQ ID NO: 849128 - DNA, 21 bp, Homo sapiens
tgcaataatatcaaaacaagt

SEQ ID NO: 849129 - DNA, 15 bp, Homo sapiens
tgcaataatttgtac

SEQ ID NO: 849130 - DNA, 16 bp, Homo sapiens
tgcaataatttgtaca

SEQ ID NO: 849131 - DNA, 17 bp, Homo sapiens
tgcaataatttgtacaa

SEQ ID NO: 849132 - DNA, 16 bp, Homo sapiens
tgcaatagaaggtgat

SEQ ID NO: 849133 - DNA, 20 bp, Homo sapiens
tgcaatagattactgatgtg

SEQ ID NO: 849134 - DNA, 20 bp, Homo sapiens
tgcaatagtgcaacatctct

SEQ ID NO: 849135 - DNA, 22 bp, Homo sapiens
tgcaatagtgcaacatctctga

SEQ ID NO: 849136 - DNA, 18 bp, Homo sapiens
tgcaatattaatgccttt

SEQ ID NO: 849137 - DNA, 14 bp, Homo sapiens
tgcaatatttgaat

SEQ ID NO: 849138 - DNA, 24 bp, Homo sapiens
tgcaatcacagctcactgcagcct

SEQ ID NO: 849139 - DNA, 14 bp, Homo sapiens
tgcaatcagacaag

SEQ ID NO: 849140 - DNA, 16 bp, Homo sapiens
tgcaatctaatctgaa

SEQ ID NO: 849141 - DNA, 12 bp, Homo sapiens
tgcaatctactg

SEQ ID NO: 849142 - DNA, 15 bp, Homo sapiens
tgcaatctactggaa

SEQ ID NO: 849143 - DNA, 21 bp, Homo sapiens
tgcaatgacacagtcttggct

SEQ ID NO: 849144 - DNA, 15 bp, Homo sapiens
tgcaatgcttgtaga

SEQ ID NO: 849145 - DNA, 16 bp, Homo sapiens
tgcaatgcttgtagaa

SEQ ID NO: 849146 - DNA, 18 bp, Homo sapiens
tgcaatggctatatggca

SEQ ID NO: 849147 - DNA, 15 bp, Homo sapiens
tgcaatgggcactgg

SEQ ID NO: 849148 - DNA, 17 bp, Homo sapiens
tgcaatgtatagtgtct

SEQ ID NO: 849149 - DNA, 20 bp, Homo sapiens
tgcaatgtcttaaataaaac

SEQ ID NO: 849150 - DNA, 21 bp, Homo sapiens
tgcaatgtcttaaataaaact

SEQ ID NO: 849151 - DNA, 17 bp, Homo sapiens
tgcaatgtgaaaaatct

SEQ ID NO: 849152 - DNA, 21 bp, Homo sapiens
tgcaatgtggtgacacctccc

SEQ ID NO: 849153 - DNA, 23 bp, Homo sapiens
tgcaattaggtttttccttattt

SEQ ID NO: 849154 - DNA, 22 bp, Homo sapiens
tgcaattcatgtaacagttgtg

SEQ ID NO: 849155 - DNA, 17 bp, Homo sapiens
tgcaattccaagaaaat

SEQ ID NO: 849156 - DNA, 19 bp, Homo sapiens
tgcaattccaagaaaatat

SEQ ID NO: 849157 - DNA, 21 bp, Homo sapiens
tgcaattgctcttctccacgt

SEQ ID NO: 849158 - DNA, 23 bp, Homo sapiens
tgcaatttaatggatatttctca

SEQ ID NO: 849159 - DNA, 14 bp, Homo sapiens
tgcaatttattaaa

SEQ ID NO: 849160 - DNA, 14 bp, Homo sapiens
tgcaatttctacta

SEQ ID NO: 849161 - DNA, 18 bp, Homo sapiens
tgcacaaaacccagacct

SEQ ID NO: 849162 - DNA, 19 bp, Homo sapiens
tgcacaaaacccagacctg

SEQ ID NO: 849163 - DNA, 15 bp, Homo sapiens
tgcacaaagcccttc

SEQ ID NO: 849164 - DNA, 17 bp, Homo sapiens
tgcacaaagcccttcca

SEQ ID NO: 849165 - DNA, 16 bp, Homo sapiens
tgcacaacagccctgc

SEQ ID NO: 849166 - DNA, 22 bp, Homo sapiens
tgcacaacagccctgcctgaga

SEQ ID NO: 849167 - DNA, 16 bp, Homo sapiens
tgcacaagaatggatc

SEQ ID NO: 849168 - DNA, 20 bp, Homo sapiens
tgcacaagaatggatcacaa

SEQ ID NO: 849169 - DNA, 15 bp, Homo sapiens
tgcacaagctgcacc

SEQ ID NO: 849170 - DNA, 20 bp, Homo sapiens
tgcacaataaaaatgtttaa

SEQ ID NO: 849171 - DNA, 16 bp, Homo sapiens
tgcacttttttatgaa

SEQ ID NO: 849172 - DNA, 20 bp, Homo sapiens
tgcacttttttatgaagaaa

SEQ ID NO: 849173 - DNA, 22 bp, Homo sapiens
tgcactttttttataagcaaaa

SEQ ID NO: 849174 - DNA, 16 bp, Homo sapiens
tgcagaaaagcacctg

SEQ ID NO: 849175 - DNA, 18 bp, Homo sapiens
tgcagaaaagcacctgcc

SEQ ID NO: 849176 - DNA, 20 bp, Homo sapiens
tgcagaaaagcacctgccga

SEQ ID NO: 849177 - DNA, 22 bp, Homo sapiens
tgcagaaaagcacctgccgacc

SEQ ID NO: 849178 - DNA, 17 bp, Homo sapiens
tgcagaaaagctcagag

SEQ ID NO: 849179 - DNA, 18 bp, Homo sapiens
tgcagaaaagctcagagt

SEQ ID NO: 849180 - DNA, 16 bp, Homo sapiens
tgcagaaatagacaaa

SEQ ID NO: 849181 - DNA, 17 bp, Homo sapiens
tgcagaaatagacaaaa

SEQ ID NO: 849182 - DNA, 19 bp, Homo sapiens
tgcagaaatagacaaaaag

SEQ ID NO: 849183 - DNA, 24 bp, Homo sapiens
tgcagaacatcgatatgtatatca

SEQ ID NO: 849184 - DNA, 17 bp, Homo sapiens
tgcagaacgtatttagc

SEQ ID NO: 849185 - DNA, 12 bp, Homo sapiens
tgcagaactgcc

SEQ ID NO: 849186 - DNA, 20 bp, Homo sapiens
tgcagaactgccattatttt

SEQ ID NO: 849187 - DNA, 23 bp, Homo sapiens
tgcagaactgccattattttctg

SEQ ID NO: 849188 - DNA, 14 bp, Homo sapiens
tgcagaagcatatt

SEQ ID NO: 849189 - DNA, 14 bp, Homo sapiens
tgcagaagccagaa

SEQ ID NO: 849190 - DNA, 20 bp, Homo sapiens
tgcagaaggaaaaatgtgta

SEQ ID NO: 849191 - DNA, 22 bp, Homo sapiens
tgcagaaggaaaaatgtgtaat

SEQ ID NO: 849192 - DNA, 13 bp, Homo sapiens
tgcagaaggaaat

SEQ ID NO: 849193 - DNA, 19 bp, Homo sapiens
tgcagaaggaaatgatgga

SEQ ID NO: 849194 - DNA, 13 bp, Homo sapiens
tgcagaagtaagc

SEQ ID NO: 849195 - DNA, 14 bp, Homo sapiens
tgcagaataatgga

SEQ ID NO: 849196 - DNA, 15 bp, Homo sapiens
tgcagaataatggaa

SEQ ID NO: 849197 - DNA, 20 bp, Homo sapiens
tgcagaataatggaaacatt

SEQ ID NO: 849198 - DNA, 18 bp, Homo sapiens
tgcagaatggcatttgca

SEQ ID NO: 849199 - DNA, 18 bp, Homo sapiens
tgcagacacctggactga

SEQ ID NO: 849200 - DNA, 15 bp, Homo sapiens
tgcagacagaatata

SEQ ID NO: 849201 - DNA, 17 bp, Homo sapiens
tgcagacagaatataaa

SEQ ID NO: 849202 - DNA, 15 bp, Homo sapiens
tgcagacagccatgc

SEQ ID NO: 849203 - DNA, 20 bp, Homo sapiens
tgcagacagccatgcgtggc

SEQ ID NO: 849204 - DNA, 22 bp, Homo sapiens
tgcagacaggctctgaggggca

SEQ ID NO: 849205 - DNA, 23 bp, Homo sapiens
tgcagacaggctctgaggggcac

SEQ ID NO: 849206 - DNA, 21 bp, Homo sapiens
tgcagacaggctggcattcta

SEQ ID NO: 849207 - DNA, 18 bp, Homo sapiens
tgcagacagtctgttatg

SEQ ID NO: 849208 - DNA, 23 bp, Homo sapiens
tgcagacagtctgttatgcactg

SEQ ID NO: 849209 - DNA, 18 bp, Homo sapiens
tgcagacatctctggagc

SEQ ID NO: 849210 - DNA, 19 bp, Homo sapiens
tgcagacatctctggagcc

SEQ ID NO: 849211 - DNA, 16 bp, Homo sapiens
tgcagacattctcaaa

SEQ ID NO: 849212 - DNA, 17 bp, Homo sapiens
tgcagacattctcaaag

SEQ ID NO: 849213 - DNA, 16 bp, Homo sapiens
tgcagaccatgccaga

SEQ ID NO: 849214 - DNA, 16 bp, Homo sapiens
tgcagacccagtccca

SEQ ID NO: 849215 - DNA, 17 bp, Homo sapiens
tgcagacctgtcaccct

SEQ ID NO: 849216 - DNA, 17 bp, Homo sapiens
tgcagacgggaatgcct

SEQ ID NO: 849217 - DNA, 14 bp, Homo sapiens
tgcagactagaatt

SEQ ID NO: 849218 - DNA, 15 bp, Homo sapiens
tgcagactcagtttg

SEQ ID NO: 849219 - DNA, 15 bp, Homo sapiens
tgcagacttcccagc

SEQ ID NO: 849220 - DNA, 13 bp, Homo sapiens
tgcagagactcat

SEQ ID NO: 849221 - DNA, 15 bp, Homo sapiens
tgcagagagaagcct

SEQ ID NO: 849222 - DNA, 13 bp, Homo sapiens
tgcagagatttcc

SEQ ID NO: 849223 - DNA, 19 bp, Homo sapiens
tgcagagatttcctccatg

SEQ ID NO: 849224 - DNA, 13 bp, Homo sapiens
tgcagagcaataa

SEQ ID NO: 849225 - DNA, 14 bp, Homo sapiens
tgcagagcaataac

SEQ ID NO: 849226 - DNA, 15 bp, Homo sapiens
tgcagagcaataaca

SEQ ID NO: 849227 - DNA, 19 bp, Homo sapiens
tgcagagcaataacactat

SEQ ID NO: 849228 - DNA, 23 bp, Homo sapiens
tgcagagcaataacactatattt

SEQ ID NO: 849229 - DNA, 12 bp, Homo sapiens
tgcagagcacaa

SEQ ID NO: 849230 - DNA, 14 bp, Homo sapiens
tgcagagcacaaac

SEQ ID NO: 849231 - DNA, 21 bp, Homo sapiens
tgcagagcaggaaacatgact

SEQ ID NO: 849232 - DNA, 17 bp, Homo sapiens
tgcagagcccggcccca

SEQ ID NO: 849233 - DNA, 11 bp, Homo sapiens
tgcagagcctt

SEQ ID NO: 849234 - DNA, 16 bp, Homo sapiens
tgcagagccttctcag

SEQ ID NO: 849235 - DNA, 19 bp, Homo sapiens
tgcagagccttctcagaag

SEQ ID NO: 849236 - DNA, 19 bp, Homo sapiens
tgcagagctatggtgaggt

SEQ ID NO: 849237 - DNA, 22 bp, Homo sapiens
tgcagagctggggctgccagcc

SEQ ID NO: 849238 - DNA, 16 bp, Homo sapiens
tgcagaggagcccagt

SEQ ID NO: 849239 - DNA, 14 bp, Homo sapiens
tgcagaggccagag

SEQ ID NO: 849240 - DNA, 23 bp, Homo sapiens
tgcagaggctcttgatggtggac

SEQ ID NO: 849241 - DNA, 15 bp, Homo sapiens
tgcagaggctgtggc

SEQ ID NO: 849242 - DNA, 22 bp, Homo sapiens
tgcagaggctgtggctggtgag

SEQ ID NO: 849243 - DNA, 20 bp, Homo sapiens
tgcagagggagacggccctg

SEQ ID NO: 849244 - DNA, 21 bp, Homo sapiens
tgcagagggtttgtgcccagt

SEQ ID NO: 849245 - DNA, 19 bp, Homo sapiens
tgcagaggtccacaacaca

SEQ ID NO: 849246 - DNA, 15 bp, Homo sapiens
tgcagaggtctccaa

SEQ ID NO: 849247 - DNA, 12 bp, Homo sapiens
tgcagaggtttc

SEQ ID NO: 849248 - DNA, 20 bp, Homo sapiens
tgcagagtccatttcccaca

SEQ ID NO: 849249 - DNA, 16 bp, Homo sapiens
tgcagataattctgga

SEQ ID NO: 849250 - DNA, 20 bp, Homo sapiens
tgcagataattctggaccag

SEQ ID NO: 849251 - DNA, 22 bp, Homo sapiens
tgcagataattctggaccagag

SEQ ID NO: 849252 - DNA, 14 bp, Homo sapiens
tgcagatagcccag

SEQ ID NO: 849253 - DNA, 16 bp, Homo sapiens
tgcagatagcccagga

SEQ ID NO: 849254 - DNA, 23 bp, Homo sapiens
tgcagatagcccaggagcaacag

SEQ ID NO: 849255 - DNA, 16 bp, Homo sapiens
tgcagatatctgcatg

SEQ ID NO: 849256 - DNA, 18 bp, Homo sapiens
tgcagatatctgcatgtg

SEQ ID NO: 849257 - DNA, 18 bp, Homo sapiens
tgcagatgctgctgaaga

SEQ ID NO: 849258 - DNA, 22 bp, Homo sapiens
tgcagatggggctcccgcccgt

SEQ ID NO: 849259 - DNA, 19 bp, Homo sapiens
tgcagatggtactgctgag

SEQ ID NO: 849260 - DNA, 20 bp, Homo sapiens
tgcagatggtactgctgagg

SEQ ID NO: 849261 - DNA, 16 bp, Homo sapiens
tgcagatgtgagccac

SEQ ID NO: 849262 - DNA, 15 bp, Homo sapiens
tgcagattacactga

SEQ ID NO: 849263 - DNA, 17 bp, Homo sapiens
tgcagattacactgatc

SEQ ID NO: 849264 - DNA, 14 bp, Homo sapiens
tgcagattcctggg

SEQ ID NO: 849265 - DNA, 18 bp, Homo sapiens
tgcagattcctgggcctg

SEQ ID NO: 849266 - DNA, 20 bp, Homo sapiens
tgcagattcctgggcctgtc

SEQ ID NO: 849267 - DNA, 15 bp, Homo sapiens
tgcagattttcttaa

SEQ ID NO: 849268 - DNA, 18 bp, Homo sapiens
tgcagcaaacactccacc

SEQ ID NO: 849269 - DNA, 14 bp, Homo sapiens
tgcagcaataaagc

SEQ ID NO: 849270 - DNA, 16 bp, Homo sapiens
tgcagcaataaagcag

SEQ ID NO: 849271 - DNA, 18 bp, Homo sapiens
tgcagcacatgcgggctc

SEQ ID NO: 849272 - DNA, 18 bp, Homo sapiens
tgcagcacctccaggcct

SEQ ID NO: 849273 - DNA, 17 bp, Homo sapiens
tgcagcactcacacagg

SEQ ID NO: 849274 - DNA, 20 bp, Homo sapiens
tgcagcactcacacaggacc

SEQ ID NO: 849275 - DNA, 11 bp, Homo sapiens
tgcagcacttt

SEQ ID NO: 849276 - DNA, 22 bp, Homo sapiens
tgcagcactttaaccctctctt

SEQ ID NO: 849277 - DNA, 11 bp, Homo sapiens
tgcagcagccc

SEQ ID NO: 849278 - DNA, 23 bp, Homo sapiens
tgcagcaggaatatatgtgtgcc

SEQ ID NO: 849279 - DNA, 14 bp, Homo sapiens
tgcagcaggagtgg

SEQ ID NO: 849280 - DNA, 23 bp, Homo sapiens
tgcagcaggagtggtgcagacag

SEQ ID NO: 849281 - DNA, 17 bp, Homo sapiens
tgcagcagggatgccct

SEQ ID NO: 849282 - DNA, 19 bp, Homo sapiens
tgcagcagggatgccctgg

SEQ ID NO: 849283 - DNA, 22 bp, Homo sapiens
tgcagcagggcaggaaggggaa

SEQ ID NO: 849284 - DNA, 18 bp, Homo sapiens
tgcagcagggctgggcct

SEQ ID NO: 849285 - DNA, 18 bp, Homo sapiens
tgcagcaggtgctgggct

SEQ ID NO: 849286 - DNA, 20 bp, Homo sapiens
tgcagcaggtgctgggctgg

SEQ ID NO: 849287 - DNA, 23 bp, Homo sapiens
tgcagcaggtgctgggctggact

SEQ ID NO: 849288 - DNA, 13 bp, Homo sapiens
tgcagcatgacct

SEQ ID NO: 849289 - DNA, 22 bp, Homo sapiens
tgcagcatgacctgtgaccagc

SEQ ID NO: 849290 - DNA, 20 bp, Homo sapiens
tgcagcatgttgctgaggag

SEQ ID NO: 849291 - DNA, 21 bp, Homo sapiens
tgcagccaaaggggagccaga

SEQ ID NO: 849292 - DNA, 21 bp, Homo sapiens
tgcagccaagtagcctctcct

SEQ ID NO: 849293 - DNA, 20 bp, Homo sapiens
tgcagccacgattggagaat

SEQ ID NO: 849294 - DNA, 21 bp, Homo sapiens
tgcagccacgattggagaata

SEQ ID NO: 849295 - DNA, 12 bp, Homo sapiens
tgcagccagccc

SEQ ID NO: 849296 - DNA, 13 bp, Homo sapiens
tgcagccagccca

SEQ ID NO: 849297 - DNA, 16 bp, Homo sapiens
tgcagccagcccagcc

SEQ ID NO: 849298 - DNA, 17 bp, Homo sapiens
tgcagccagcccagccc

SEQ ID NO: 849299 - DNA, 21 bp, Homo sapiens
tgcagccatcccgcttagcct

SEQ ID NO: 849300 - DNA, 13 bp, Homo sapiens
tgcagcccaccag

SEQ ID NO: 849301 - DNA, 22 bp, Homo sapiens
tgcagcccaccagacgtcaggc

SEQ ID NO: 849302 - DNA, 15 bp, Homo sapiens
tgcagcccaccagga

SEQ ID NO: 849303 - DNA, 16 bp, Homo sapiens
tgcagcccaccaggag

SEQ ID NO: 849304 - DNA, 13 bp, Homo sapiens
tgcagcccatgcc

SEQ ID NO: 849305 - DNA, 17 bp, Homo sapiens
tgcagcccctgggccct

SEQ ID NO: 849306 - DNA, 19 bp, Homo sapiens
tgcagcccctgggcccttg

SEQ ID NO: 849307 - DNA, 12 bp, Homo sapiens
tgcagccctctt

SEQ ID NO: 849308 - DNA, 14 bp, Homo sapiens
tgcagcccttgggc

SEQ ID NO: 849309 - DNA, 17 bp, Homo sapiens
tgcagcccttgggcagt

SEQ ID NO: 849310 - DNA, 19 bp, Homo sapiens
tgcagccggaggaggagat

SEQ ID NO: 849311 - DNA, 19 bp, Homo sapiens
tgcagccggcacagggtct

SEQ ID NO: 849312 - DNA, 12 bp, Homo sapiens
tgcagcctgctc

SEQ ID NO: 849313 - DNA, 14 bp, Homo sapiens
tgcagcctgctggg

SEQ ID NO: 849314 - DNA, 15 bp, Homo sapiens
tgcagcctgctgggg

SEQ ID NO: 849315 - DNA, 10 bp, Homo sapiens
tgcagcctgg

SEQ ID NO: 849316 - DNA, 11 bp, Homo sapiens
tgcagcctggg

SEQ ID NO: 849317 - DNA, 23 bp, Homo sapiens
tgcagcctgggctccctcttgtg

SEQ ID NO: 849318 - DNA, 13 bp, Homo sapiens
tgcagcctggtca

SEQ ID NO: 849319 - DNA, 12 bp, Homo sapiens
tgcagccttccc

SEQ ID NO: 849320 - DNA, 12 bp, Homo sapiens
tgcagccttgcg

SEQ ID NO: 849321 - DNA, 15 bp, Homo sapiens
tgcagcgacccttgg

SEQ ID NO: 849322 - DNA, 16 bp, Homo sapiens
tgcagcgacccttggt

SEQ ID NO: 849323 - DNA, 22 bp, Homo sapiens
tgcagcgacccttggtgtttcc

SEQ ID NO: 849324 - DNA, 19 bp, Homo sapiens
tgcagcgcagctggactct

SEQ ID NO: 849325 - DNA, 16 bp, Homo sapiens
tgcagcgcctcccttg

SEQ ID NO: 849326 - DNA, 16 bp, Homo sapiens
tgcagctactggaatg

SEQ ID NO: 849327 - DNA, 14 bp, Homo sapiens
tgcagctcctcagc

SEQ ID NO: 849328 - DNA, 16 bp, Homo sapiens
tgcagctgatgttgga

SEQ ID NO: 849329 - DNA, 15 bp, Homo sapiens
tgcagctgattttaa

SEQ ID NO: 849330 - DNA, 18 bp, Homo sapiens
tgcagctgcctggggccc

SEQ ID NO: 849331 - DNA, 20 bp, Homo sapiens
tgcagctgctgaagttctga

SEQ ID NO: 849332 - DNA, 13 bp, Homo sapiens
tgcagctggacag

SEQ ID NO: 849333 - DNA, 16 bp, Homo sapiens
tgcagctggacagagg

SEQ ID NO: 849334 - DNA, 18 bp, Homo sapiens
tgcagctggacagagggg

SEQ ID NO: 849335 - DNA, 14 bp, Homo sapiens
tgcagctgggcccc

SEQ ID NO: 849336 - DNA, 19 bp, Homo sapiens
tgcagctgggccccatgct

SEQ ID NO: 849337 - DNA, 24 bp, Homo sapiens
tgcagctgggccccatgctctgcc

SEQ ID NO: 849338 - DNA, 20 bp, Homo sapiens
tgcagctgtggcagagttac

SEQ ID NO: 849339 - DNA, 22 bp, Homo sapiens
tgcagctgtggcagagttacag

SEQ ID NO: 849340 - DNA, 14 bp, Homo sapiens
tgcagctgttgaga

SEQ ID NO: 849341 - DNA, 15 bp, Homo sapiens
tgcagctgttgagaa

SEQ ID NO: 849342 - DNA, 19 bp, Homo sapiens
tgcagctgttttcaaagcc

SEQ ID NO: 849343 - DNA, 23 bp, Homo sapiens
tgcagctgttttgttgacattct

SEQ ID NO: 849344 - DNA, 18 bp, Homo sapiens
tgcagcttcgaggacagg

SEQ ID NO: 849345 - DNA, 16 bp, Homo sapiens
tgcagctttacatgca

SEQ ID NO: 849346 - DNA, 15 bp, Homo sapiens
tgcagctttatgttc

SEQ ID NO: 849347 - DNA, 22 bp, Homo sapiens
tgcaggaaacatttctgacacc

SEQ ID NO: 849348 - DNA, 15 bp, Homo sapiens
tgcaggaagaggccc

SEQ ID NO: 849349 - DNA, 16 bp, Homo sapiens
tgcaggaagaggccca

SEQ ID NO: 849350 - DNA, 17 bp, Homo sapiens
tgcaggaagaggcccac

SEQ ID NO: 849351 - DNA, 20 bp, Homo sapiens
tgcaggaccctgtcctgcag

SEQ ID NO: 849352 - DNA, 16 bp, Homo sapiens
tgcaggacctcaggtg

SEQ ID NO: 849353 - DNA, 23 bp, Homo sapiens
tgcaggaccttgggcacatctgc

SEQ ID NO: 849354 - DNA, 15 bp, Homo sapiens
tgcaggacttgagaa

SEQ ID NO: 849355 - DNA, 15 bp, Homo sapiens
tgcaggagagagcag

SEQ ID NO: 849356 - DNA, 17 bp, Homo sapiens
tgcaggagagagcagca

SEQ ID NO: 849357 - DNA, 22 bp, Homo sapiens
tgcaggagcctccctgcacggc

SEQ ID NO: 849358 - DNA, 23 bp, Homo sapiens
tgcaggagcctccctgcacggcc

SEQ ID NO: 849359 - DNA, 15 bp, Homo sapiens
tgcaggagggcactg

SEQ ID NO: 849360 - DNA, 22 bp, Homo sapiens
tgcaggcacagaggaggtcagc

SEQ ID NO: 849361 - DNA, 14 bp, Homo sapiens
tgcaggcagagctg

SEQ ID NO: 849362 - DNA, 16 bp, Homo sapiens
tgcaggcagagctgga

SEQ ID NO: 849363 - DNA, 19 bp, Homo sapiens
tgcaggcagagctggagcc

SEQ ID NO: 849364 - DNA, 21 bp, Homo sapiens
tgcaggcagagctggagcccc

SEQ ID NO: 849365 - DNA, 20 bp, Homo sapiens
tgcaggccaagagcagaggc

SEQ ID NO: 849366 - DNA, 19 bp, Homo sapiens
tgcaggccctggcctcccc

SEQ ID NO: 849367 - DNA, 11 bp, Homo sapiens
tgcaggccctt

SEQ ID NO: 849368 - DNA, 21 bp, Homo sapiens
tgcaggcgatggggcaagaca

SEQ ID NO: 849369 - DNA, 14 bp, Homo sapiens
tgcaggcggccctc

SEQ ID NO: 849370 - DNA, 16 bp, Homo sapiens
tgcaggcggccctcag

SEQ ID NO: 849371 - DNA, 17 bp, Homo sapiens
tgcaggctctgggctca

SEQ ID NO: 849372 - DNA, 20 bp, Homo sapiens
tgcaggctctgggctcaggg

SEQ ID NO: 849373 - DNA, 22 bp, Homo sapiens
tgcaggctctgggctcagggct

SEQ ID NO: 849374 - DNA, 17 bp, Homo sapiens
tgcaggctgcaggaggg

SEQ ID NO: 849375 - DNA, 18 bp, Homo sapiens
tgcaggctgcaggagggc

SEQ ID NO: 849376 - DNA, 22 bp, Homo sapiens
tgcaggctgcaggagggcactg

SEQ ID NO: 849377 - DNA, 18 bp, Homo sapiens
tgcaggctggagactgga

SEQ ID NO: 849378 - DNA, 18 bp, Homo sapiens
tgcaggctggcaccgcct

SEQ ID NO: 849379 - DNA, 14 bp, Homo sapiens
tgcaggctggggag

SEQ ID NO: 849380 - DNA, 15 bp, Homo sapiens
tgcaggctggggagg

SEQ ID NO: 849381 - DNA, 23 bp, Homo sapiens
tgcaggctggggaggtgctgggg

SEQ ID NO: 849382 - DNA, 13 bp, Homo sapiens
tgcagggaagagg

SEQ ID NO: 849383 - DNA, 18 bp, Homo sapiens
tgcagggaagagggcagt

SEQ ID NO: 849384 - DNA, 20 bp, Homo sapiens
tgcagggaagagggcagtac

SEQ ID NO: 849385 - DNA, 15 bp, Homo sapiens
tgcagggagcactgt

SEQ ID NO: 849386 - DNA, 14 bp, Homo sapiens
tgcagggagctcaa

SEQ ID NO: 849387 - DNA, 13 bp, Homo sapiens
tgcagggagggga

SEQ ID NO: 849388 - DNA, 18 bp, Homo sapiens
tgcagggaggggaggcag

SEQ ID NO: 849389 - DNA, 18 bp, Homo sapiens
tgcagggatattgcctta

SEQ ID NO: 849390 - DNA, 16 bp, Homo sapiens
tgcagggcacagatga

SEQ ID NO: 849391 - DNA, 14 bp, Homo sapiens
tgcagggcacgggg

SEQ ID NO: 849392 - DNA, 17 bp, Homo sapiens
tgcagggcacggggacc

SEQ ID NO: 849393 - DNA, 19 bp, Homo sapiens
tgcagggcacggggacctg

SEQ ID NO: 849394 - DNA, 21 bp, Homo sapiens
tgcagggcacggggacctgga

SEQ ID NO: 849395 - DNA, 19 bp, Homo sapiens
tgcagggctaaggccccca

SEQ ID NO: 849396 - DNA, 13 bp, Homo sapiens
tgcagggctccca

SEQ ID NO: 849397 - DNA, 17 bp, Homo sapiens
tgcagggctcccatggg

SEQ ID NO: 849398 - DNA, 19 bp, Homo sapiens
tgcagggctcccatgggct

SEQ ID NO: 849399 - DNA, 19 bp, Homo sapiens
tgcaggggccactccaaac

SEQ ID NO: 849400 - DNA, 20 bp, Homo sapiens
tgcaggggccactccaaact

SEQ ID NO: 849401 - DNA, 21 bp, Homo sapiens
tgcaggggccactccaaactc

SEQ ID NO: 849402 - DNA, 16 bp, Homo sapiens
tgcagggggctcctgg

SEQ ID NO: 849403 - DNA, 16 bp, Homo sapiens
tgcaggggtccctgct

SEQ ID NO: 849404 - DNA, 15 bp, Homo sapiens
tgcagggtcctcttc

SEQ ID NO: 849405 - DNA, 19 bp, Homo sapiens
tgcagggtcctcttctggg

SEQ ID NO: 849406 - DNA, 20 bp, Homo sapiens
tgcagggtggaaggtaagag

SEQ ID NO: 849407 - DNA, 20 bp, Homo sapiens
tgcagggtggtgctgggact

SEQ ID NO: 849408 - DNA, 22 bp, Homo sapiens
tgcaggtacttcctcctgatgg

SEQ ID NO: 849409 - DNA, 17 bp, Homo sapiens
tgcaggtgggctgggcc

SEQ ID NO: 849410 - DNA, 19 bp, Homo sapiens
tgcaggtggtgggacactg

SEQ ID NO: 849411 - DNA, 14 bp, Homo sapiens
tgcaggtttctatt

SEQ ID NO: 849412 - DNA, 16 bp, Homo sapiens
tgcagtaactgttttt

SEQ ID NO: 849413 - DNA, 14 bp, Homo sapiens
tgcagtacaggcaa

SEQ ID NO: 849414 - DNA, 16 bp, Homo sapiens
tgcattcttctctgtt

SEQ ID NO: 849415 - DNA, 16 bp, Homo sapiens
tgcattcttctgagca

SEQ ID NO: 849416 - DNA, 14 bp, Homo sapiens
tgcattctttggta

SEQ ID NO: 849417 - DNA, 16 bp, Homo sapiens
tgcattcttttaaaag

SEQ ID NO: 849418 - DNA, 13 bp, Homo sapiens
tgcattgaatata

SEQ ID NO: 849419 - DNA, 15 bp, Homo sapiens
tgcattgaatatatt

SEQ ID NO: 849420 - DNA, 16 bp, Homo sapiens
tgcattgaatatatta

SEQ ID NO: 849421 - DNA, 17 bp, Homo sapiens
tgcattgagcatatttt

SEQ ID NO: 849422 - DNA, 15 bp, Homo sapiens
tgcattgatggtttt

SEQ ID NO: 849423 - DNA, 12 bp, Homo sapiens
tgcattgccttg

SEQ ID NO: 849424 - DNA, 11 bp, Homo sapiens
tgcattgctgg

SEQ ID NO: 849425 - DNA, 12 bp, Homo sapiens
tgcattgtaaat

SEQ ID NO: 849426 - DNA, 11 bp, Homo sapiens
tgcattgtctg

SEQ ID NO: 849427 - DNA, 16 bp, Homo sapiens
tgcattgtcttgtgga

SEQ ID NO: 849428 - DNA, 17 bp, Homo sapiens
tgcattgtcttgtggag

SEQ ID NO: 849429 - DNA, 17 bp, Homo sapiens
tgcatttaaaacagaca

SEQ ID NO: 849430 - DNA, 16 bp, Homo sapiens
tgcatttaaactctgc

SEQ ID NO: 849431 - DNA, 14 bp, Homo sapiens
tgcatttaaagtat

SEQ ID NO: 849432 - DNA, 22 bp, Homo sapiens
tgcatttaaatacagtcttcca

SEQ ID NO: 849433 - DNA, 14 bp, Homo sapiens
tgcatttaaggaga

SEQ ID NO: 849434 - DNA, 12 bp, Homo sapiens
tgcatttaataa

SEQ ID NO: 849435 - DNA, 13 bp, Homo sapiens
tgcatttaataaa

SEQ ID NO: 849436 - DNA, 21 bp, Homo sapiens
tgcatttagaactttctgctt

SEQ ID NO: 849437 - DNA, 13 bp, Homo sapiens
tgcatttatatgt

SEQ ID NO: 849438 - DNA, 16 bp, Homo sapiens
tgcatttatatgtacc

SEQ ID NO: 849439 - DNA, 18 bp, Homo sapiens
tgcatttcacctgtgaca

SEQ ID NO: 849440 - DNA, 19 bp, Homo sapiens
tgcatttcacctgtgacaa

SEQ ID NO: 849441 - DNA, 15 bp, Homo sapiens
tgcatttccagaaat

SEQ ID NO: 849442 - DNA, 12 bp, Homo sapiens
tgcatttctctt

SEQ ID NO: 849443 - DNA, 22 bp, Homo sapiens
tgcatttctcttctcagctctt

SEQ ID NO: 849444 - DNA, 19 bp, Homo sapiens
tgcatttgaaaattttgat

SEQ ID NO: 849445 - DNA, 23 bp, Homo sapiens
tgcatttgaaaattttgatgttt

SEQ ID NO: 849446 - DNA, 13 bp, Homo sapiens
tgcatttgaggtc

SEQ ID NO: 849447 - DNA, 20 bp, Homo sapiens
tgcatttgaggtctgttctt

SEQ ID NO: 849448 - DNA, 16 bp, Homo sapiens
tgcatttgatacattt

SEQ ID NO: 849449 - DNA, 17 bp, Homo sapiens
tgcatttgtaaaaatga

SEQ ID NO: 849450 - DNA, 19 bp, Homo sapiens
tgcatttgtaaaaatgaga

SEQ ID NO: 849451 - DNA, 13 bp, Homo sapiens
tgcatttgtttat

SEQ ID NO: 849452 - DNA, 19 bp, Homo sapiens
tgcatttgtttatgtaatt

SEQ ID NO: 849453 - DNA, 20 bp, Homo sapiens
tgcatttgtttatgtaattt

SEQ ID NO: 849454 - DNA, 21 bp, Homo sapiens
tgcattttaaagttaaacatt

SEQ ID NO: 849455 - DNA, 13 bp, Homo sapiens
tgcattttacaca

SEQ ID NO: 849456 - DNA, 17 bp, Homo sapiens
tgcattttcaccccacc

SEQ ID NO: 849457 - DNA, 23 bp, Homo sapiens
tgcattttcctcttgtcctggcc

SEQ ID NO: 849458 - DNA, 18 bp, Homo sapiens
tgcattttctgatgtatt

SEQ ID NO: 849459 - DNA, 16 bp, Homo sapiens
tgcattttcttcacag

SEQ ID NO: 849460 - DNA, 19 bp, Homo sapiens
tgcattttcttcagaatta

SEQ ID NO: 849461 - DNA, 20 bp, Homo sapiens
tgcattttcttcagaattat

SEQ ID NO: 849462 - DNA, 18 bp, Homo sapiens
tgcattttgcagcagtga

SEQ ID NO: 849463 - DNA, 22 bp, Homo sapiens
tgcattttgctattgtaaatat

SEQ ID NO: 849464 - DNA, 20 bp, Homo sapiens
tgcattttgtttctgtatat

SEQ ID NO: 849465 - DNA, 13 bp, Homo sapiens
tgcattttgtttg

SEQ ID NO: 849466 - DNA, 21 bp, Homo sapiens
tgcatttttaaacttgaaata

SEQ ID NO: 849467 - DNA, 16 bp, Homo sapiens
tgccaaaaaaaaatac

SEQ ID NO: 849468 - DNA, 20 bp, Homo sapiens
tgccaaaaaaagacagggct

SEQ ID NO: 849469 - DNA, 19 bp, Homo sapiens
tgccaaaaaggatacataa

SEQ ID NO: 849470 - DNA, 21 bp, Homo sapiens
tgccaaaaaggatacataatg

SEQ ID NO: 849471 - DNA, 14 bp, Homo sapiens
tgccaaaaccaaga

SEQ ID NO: 849472 - DNA, 15 bp, Homo sapiens
tgccaaaaccacatg

SEQ ID NO: 849473 - DNA, 20 bp, Homo sapiens
tgccaaaaccacatgggctg

SEQ ID NO: 849474 - DNA, 17 bp, Homo sapiens
tgccaaaatgctctagt

SEQ ID NO: 849475 - DNA, 19 bp, Homo sapiens
tgccaaaatgttggctgcg

SEQ ID NO: 849476 - DNA, 19 bp, Homo sapiens
tgccaaaattcatttctaa

SEQ ID NO: 849477 - DNA, 17 bp, Homo sapiens
tgccaaaccacaagact

SEQ ID NO: 849478 - DNA, 17 bp, Homo sapiens
tgccaaagatgtttgaa

SEQ ID NO: 849479 - DNA, 18 bp, Homo sapiens
tgccaaagatgtttgaaa

SEQ ID NO: 849480 - DNA, 14 bp, Homo sapiens
tgccaaagctttac

SEQ ID NO: 849481 - DNA, 17 bp, Homo sapiens
tgccaaaggatgtgata

SEQ ID NO: 849482 - DNA, 11 bp, Homo sapiens
tgccaaagtac

SEQ ID NO: 849483 - DNA, 22 bp, Homo sapiens
tgccaaagtacagaatttgaat

SEQ ID NO: 849484 - DNA, 15 bp, Homo sapiens
tgccaaagtgcctgg

SEQ ID NO: 849485 - DNA, 17 bp, Homo sapiens
tgccaaatagccccaga

SEQ ID NO: 849486 - DNA, 19 bp, Homo sapiens
tgccaaatagccccagact

SEQ ID NO: 849487 - DNA, 16 bp, Homo sapiens
tgccaaatatgtcctg

SEQ ID NO: 849488 - DNA, 18 bp, Homo sapiens
tgccaaatatgtcctggg

SEQ ID NO: 849489 - DNA, 22 bp, Homo sapiens
tgccaacaaagcttacaacatt

SEQ ID NO: 849490 - DNA, 23 bp, Homo sapiens
tgccaacaccttcttggcttctg

SEQ ID NO: 849491 - DNA, 15 bp, Homo sapiens
tgccaacatggtgaa

SEQ ID NO: 849492 - DNA, 22 bp, Homo sapiens
tgccaaccataccttccttccc

SEQ ID NO: 849493 - DNA, 18 bp, Homo sapiens
tgccaaccccacccagct

SEQ ID NO: 849494 - DNA, 21 bp, Homo sapiens
tgccaaccccacccagctcca

SEQ ID NO: 849495 - DNA, 23 bp, Homo sapiens
tgccaaccccacccagctccagg

SEQ ID NO: 849496 - DNA, 12 bp, Homo sapiens
tgccaacctaaa

SEQ ID NO: 849497 - DNA, 23 bp, Homo sapiens
tgccaacctgatgccccttcccc

SEQ ID NO: 849498 - DNA, 24 bp, Homo sapiens
tgccaactgaagccttcttctgcc

SEQ ID NO: 849499 - DNA, 16 bp, Homo sapiens
tgccaacttgatgttc

SEQ ID NO: 849500 - DNA, 13 bp, Homo sapiens
tgccaacttgcca

SEQ ID NO: 849501 - DNA, 14 bp, Homo sapiens
tgccaagaaaatga

SEQ ID NO: 849502 - DNA, 18 bp, Homo sapiens
tgccaagattctactctt

SEQ ID NO: 849503 - DNA, 14 bp, Homo sapiens
tgccaagcagcaga

SEQ ID NO: 849504 - DNA, 22 bp, Homo sapiens
tgccaagcccctgccctgggga

SEQ ID NO: 849505 - DNA, 23 bp, Homo sapiens
tgccaagcccctgccctggggag

SEQ ID NO: 849506 - DNA, 12 bp, Homo sapiens
tgccaagccttc

SEQ ID NO: 849507 - DNA, 17 bp, Homo sapiens
tgccaagccttctgtga

SEQ ID NO: 849508 - DNA, 18 bp, Homo sapiens
tgccaagctaatctgcct

SEQ ID NO: 849509 - DNA, 22 bp, Homo sapiens
tgccaagctaatttatagcaag

SEQ ID NO: 849510 - DNA, 13 bp, Homo sapiens
tgccaagctccaa

SEQ ID NO: 849511 - DNA, 18 bp, Homo sapiens
tgccaaggcagaggcctg

SEQ ID NO: 849512 - DNA, 19 bp, Homo sapiens
tgccaaggcagaggcctgg

SEQ ID NO: 849513 - DNA, 16 bp, Homo sapiens
tgccaaggccagagtg

SEQ ID NO: 849514 - DNA, 20 bp, Homo sapiens
tgccaaggccagagtggcct

SEQ ID NO: 849515 - DNA, 22 bp, Homo sapiens
tgccaaggccagagtggcctgg

SEQ ID NO: 849516 - DNA, 13 bp, Homo sapiens
tgccaaggctctc

SEQ ID NO: 849517 - DNA, 16 bp, Homo sapiens
tgccaagggaggcgga

SEQ ID NO: 849518 - DNA, 17 bp, Homo sapiens
tgccaagggccccaggg

SEQ ID NO: 849519 - DNA, 21 bp, Homo sapiens
tgccaagggccccaggggcag

SEQ ID NO: 849520 - DNA, 19 bp, Homo sapiens
tgccaagggggtgactgga

SEQ ID NO: 849521 - DNA, 20 bp, Homo sapiens
tgccaagggggtgactggaa

SEQ ID NO: 849522 - DNA, 19 bp, Homo sapiens
tgccaaggtggagggaagg

SEQ ID NO: 849523 - DNA, 20 bp, Homo sapiens
tgccaataaagtgatctgtg

SEQ ID NO: 849524 - DNA, 18 bp, Homo sapiens
tgccaatattaaatctgc

SEQ ID NO: 849525 - DNA, 19 bp, Homo sapiens
tgccaatattaaatctgct

SEQ ID NO: 849526 - DNA, 14 bp, Homo sapiens
tgccaatcaatagc

SEQ ID NO: 849527 - DNA, 16 bp, Homo sapiens
tgccaatctcaacacc

SEQ ID NO: 849528 - DNA, 18 bp, Homo sapiens
tgccaatgatgtgaccct

SEQ ID NO: 849529 - DNA, 22 bp, Homo sapiens
tgccaatgctacagtaataaat

SEQ ID NO: 849530 - DNA, 16 bp, Homo sapiens
tgccaatgctccagct

SEQ ID NO: 849531 - DNA, 22 bp, Homo sapiens
tgccaatgctccagctgtcgtc

SEQ ID NO: 849532 - DNA, 20 bp, Homo sapiens
tgccaatgtgggctgcccct

SEQ ID NO: 849533 - DNA, 13 bp, Homo sapiens
tgccaatttcaag

SEQ ID NO: 849534 - DNA, 23 bp, Homo sapiens
tgccaatttcctctccactgctg

SEQ ID NO: 849535 - DNA, 17 bp, Homo sapiens
tgccacaaccagccagg

SEQ ID NO: 849536 - DNA, 19 bp, Homo sapiens
tgccacaccaatcagagag

SEQ ID NO: 849537 - DNA, 21 bp, Homo sapiens
tgccacaccaatcagagagcc

SEQ ID NO: 849538 - DNA, 12 bp, Homo sapiens
tgccacacccag

SEQ ID NO: 849539 - DNA, 13 bp, Homo sapiens
tgccacaccccat

SEQ ID NO: 849540 - DNA, 20 bp, Homo sapiens
tgccacacgcatgggcattg

SEQ ID NO: 849541 - DNA, 21 bp, Homo sapiens
tgccacactcagtcccccacc

SEQ ID NO: 849542 - DNA, 15 bp, Homo sapiens
tgccacactgatggc

SEQ ID NO: 849543 - DNA, 15 bp, Homo sapiens
tgccacacttcaggc

SEQ ID NO: 849544 - DNA, 23 bp, Homo sapiens
tgccacacttcaggctcttctcc

SEQ ID NO: 849545 - DNA, 23 bp, Homo sapiens
tgccacagagaagtttgtagcca

SEQ ID NO: 849546 - DNA, 14 bp, Homo sapiens
tgccacagcaagga

SEQ ID NO: 849547 - DNA, 14 bp, Homo sapiens
tgccacagccagag

SEQ ID NO: 849548 - DNA, 22 bp, Homo sapiens
tgccacagcctcccctgccagg

SEQ ID NO: 849549 - DNA, 13 bp, Homo sapiens
tgccacagcctgc

SEQ ID NO: 849550 - DNA, 20 bp, Homo sapiens
tgccacagcctgctggcagg

SEQ ID NO: 849551 - DNA, 13 bp, Homo sapiens
tgccacagctcaa

SEQ ID NO: 849552 - DNA, 17 bp, Homo sapiens
tgccacaggcttaggga

SEQ ID NO: 849553 - DNA, 21 bp, Homo sapiens
tgccacaggcttagggacagg

SEQ ID NO: 849554 - DNA, 15 bp, Homo sapiens
tgccacatccagctt

SEQ ID NO: 849555 - DNA, 19 bp, Homo sapiens
tgccacatggtgtctccca

SEQ ID NO: 849556 - DNA, 20 bp, Homo sapiens
tgccacatggtgtctcccaa

SEQ ID NO: 849557 - DNA, 22 bp, Homo sapiens
tgccacatggtgtctcccaaca

SEQ ID NO: 849558 - DNA, 22 bp, Homo sapiens
tgccacatttatttttatatct

SEQ ID NO: 849559 - DNA, 18 bp, Homo sapiens
tgccaccacctctgtggc

SEQ ID NO: 849560 - DNA, 19 bp, Homo sapiens
tgccaccacctctgtggca

SEQ ID NO: 849561 - DNA, 23 bp, Homo sapiens
tgccaccacgtctgccaggccca

SEQ ID NO: 849562 - DNA, 16 bp, Homo sapiens
tgccaccactagagct

SEQ ID NO: 849563 - DNA, 15 bp, Homo sapiens
tgccaccagcatcca

SEQ ID NO: 849564 - DNA, 12 bp, Homo sapiens
tgccaccaggag

SEQ ID NO: 849565 - DNA, 17 bp, Homo sapiens
tgccaccaggccacctc

SEQ ID NO: 849566 - DNA, 18 bp, Homo sapiens
tgccaccaggccacctcc

SEQ ID NO: 849567 - DNA, 22 bp, Homo sapiens
tgccaccagggagcttcctggc

SEQ ID NO: 849568 - DNA, 19 bp, Homo sapiens
tgccaccatcctgctgctg

SEQ ID NO: 849569 - DNA, 18 bp, Homo sapiens
tgccacccacctccctgc

SEQ ID NO: 849570 - DNA, 20 bp, Homo sapiens
tgccacccacctccctgcct

SEQ ID NO: 849571 - DNA, 12 bp, Homo sapiens
tgccacccactc

SEQ ID NO: 849572 - DNA, 17 bp, Homo sapiens
tgccacccactcaggat

SEQ ID NO: 849573 - DNA, 19 bp, Homo sapiens
tgccacccactcaggattg

SEQ ID NO: 849574 - DNA, 14 bp, Homo sapiens
tgccaccccatgtg

SEQ ID NO: 849575 - DNA, 17 bp, Homo sapiens
tgccaccccatgtgcct

SEQ ID NO: 849576 - DNA, 19 bp, Homo sapiens
tgccaccccatgtgccttt

SEQ ID NO: 849577 - DNA, 17 bp, Homo sapiens
tgccacccccaggtctt

SEQ ID NO: 849578 - DNA, 22 bp, Homo sapiens
tgccacccccagttcctatgac

SEQ ID NO: 849579 - DNA, 19 bp, Homo sapiens
tgccacccccgctggagga

SEQ ID NO: 849580 - DNA, 23 bp, Homo sapiens
tgccacccccgctggaggatgtg

SEQ ID NO: 849581 - DNA, 18 bp, Homo sapiens
tgccacccctcttctgct

SEQ ID NO: 849582 - DNA, 16 bp, Homo sapiens
tgccaccccttcctcc

SEQ ID NO: 849583 - DNA, 19 bp, Homo sapiens
tgccaccccttcctcccca

SEQ ID NO: 849584 - DNA, 13 bp, Homo sapiens
tgccaccctcaca

SEQ ID NO: 849585 - DNA, 17 bp, Homo sapiens
tgccaccctcacacaca

SEQ ID NO: 849586 - DNA, 20 bp, Homo sapiens
tgccaccctcctccctccaa

SEQ ID NO: 849587 - DNA, 24 bp, Homo sapiens
tgccaccctcctccctccaagcct

SEQ ID NO: 849588 - DNA, 14 bp, Homo sapiens
tgccaccctctggg

SEQ ID NO: 849589 - DNA, 15 bp, Homo sapiens
tgccaccctctggga

SEQ ID NO: 849590 - DNA, 21 bp, Homo sapiens
tgccaccgactgcccagccac

SEQ ID NO: 849591 - DNA, 23 bp, Homo sapiens
tgccaccgactgcccagccactc

SEQ ID NO: 849592 - DNA, 15 bp, Homo sapiens
tgccaccggcctgtg

SEQ ID NO: 849593 - DNA, 19 bp, Homo sapiens
tgccaccgtgggggaactg

SEQ ID NO: 849594 - DNA, 21 bp, Homo sapiens
tgccaccgtgggggaactgac

SEQ ID NO: 849595 - DNA, 15 bp, Homo sapiens
tgccacctatgcctg

SEQ ID NO: 849596 - DNA, 19 bp, Homo sapiens
tgccacctatgcctgtggt

SEQ ID NO: 849597 - DNA, 18 bp, Homo sapiens
tgccacctcccctatcca

SEQ ID NO: 849598 - DNA, 16 bp, Homo sapiens
tgccaccttgtggccg

SEQ ID NO: 849599 - DNA, 18 bp, Homo sapiens
tgccacgcacttcctctc

SEQ ID NO: 849600 - DNA, 14 bp, Homo sapiens
tgccacgcaggcca

SEQ ID NO: 849601 - DNA, 22 bp, Homo sapiens
tgccacgcaggccacccgggct

SEQ ID NO: 849602 - DNA, 14 bp, Homo sapiens
tgccacgctttgct

SEQ ID NO: 849603 - DNA, 22 bp, Homo sapiens
tgccacgtcccgctgcctcctg

SEQ ID NO: 849604 - DNA, 14 bp, Homo sapiens
tgccactcaccctt

SEQ ID NO: 849605 - DNA, 13 bp, Homo sapiens
tgccactcactag

SEQ ID NO: 849606 - DNA, 14 bp, Homo sapiens
tgccactcactagg

SEQ ID NO: 849607 - DNA, 15 bp, Homo sapiens
tgccactcactaggc

SEQ ID NO: 849608 - DNA, 17 bp, Homo sapiens
tgccactcactaggccc

SEQ ID NO: 849609 - DNA, 18 bp, Homo sapiens
tgccactcactaggcccc

SEQ ID NO: 849610 - DNA, 20 bp, Homo sapiens
tgccactcactaggccccca

SEQ ID NO: 849611 - DNA, 19 bp, Homo sapiens
tgccactcccctaaactcc

SEQ ID NO: 849612 - DNA, 12 bp, Homo sapiens
tgccactcccta

SEQ ID NO: 849613 - DNA, 14 bp, Homo sapiens
tgccactccctacc

SEQ ID NO: 849614 - DNA, 17 bp, Homo sapiens
tgccactccctgagctt

SEQ ID NO: 849615 - DNA, 18 bp, Homo sapiens
tgccactgcacaccagcc

SEQ ID NO: 849616 - DNA, 13 bp, Homo sapiens
tgccactgcactc

SEQ ID NO: 849617 - DNA, 13 bp, Homo sapiens
tgccactgccagg

SEQ ID NO: 849618 - DNA, 14 bp, Homo sapiens
tgccactgccaggc

SEQ ID NO: 849619 - DNA, 18 bp, Homo sapiens
tgccactgcccgagctgg

SEQ ID NO: 849620 - DNA, 17 bp, Homo sapiens
tgccactgcctcttcct

SEQ ID NO: 849621 - DNA, 18 bp, Homo sapiens
tgccactgcctcttcctc

SEQ ID NO: 849622 - DNA, 19 bp, Homo sapiens
tgccactgcctcttcctcc

SEQ ID NO: 849623 - DNA, 18 bp, Homo sapiens
tgccactgggctctggac

SEQ ID NO: 849624 - DNA, 20 bp, Homo sapiens
tgccactgggctctggacct

SEQ ID NO: 849625 - DNA, 16 bp, Homo sapiens
tgccacttctcactca

SEQ ID NO: 849626 - DNA, 19 bp, Homo sapiens
tgccacttctgcgggctcc

SEQ ID NO: 849627 - DNA, 22 bp, Homo sapiens
tgccacttctgcgggctccctc

SEQ ID NO: 849628 - DNA, 22 bp, Homo sapiens
tgccacttcttaaaggcctgga

SEQ ID NO: 849629 - DNA, 23 bp, Homo sapiens
tgccacttcttaaaggcctggaa

SEQ ID NO: 849630 - DNA, 19 bp, Homo sapiens
tgccactttgcaaaggagc

SEQ ID NO: 849631 - DNA, 21 bp, Homo sapiens
tgccactttgcagctaaaata

SEQ ID NO: 849632 - DNA, 19 bp, Homo sapiens
tgccactttggcttctcct

SEQ ID NO: 849633 - DNA, 19 bp, Homo sapiens
tgccagaaaaaaataacta

SEQ ID NO: 849634 - DNA, 21 bp, Homo sapiens
tgccagaaaaaaataactatt

SEQ ID NO: 849635 - DNA, 24 bp, Homo sapiens
tgccagaaacagtgggagccctga

SEQ ID NO: 849636 - DNA, 14 bp, Homo sapiens
tgccagaaggaagg

SEQ ID NO: 849637 - DNA, 15 bp, Homo sapiens
tgccagaaggaaggt

SEQ ID NO: 849638 - DNA, 21 bp, Homo sapiens
tgccagacaaataggagtgag

SEQ ID NO: 849639 - DNA, 22 bp, Homo sapiens
tgccagacaaataggagtgagt

SEQ ID NO: 849640 - DNA, 23 bp, Homo sapiens
tgccagacactgagcttctgaga

SEQ ID NO: 849641 - DNA, 13 bp, Homo sapiens
tgccagacatgtg

SEQ ID NO: 849642 - DNA, 20 bp, Homo sapiens
tgccagaccgcagagaggct

SEQ ID NO: 849643 - DNA, 17 bp, Homo sapiens
tgccagacgtgctcctg

SEQ ID NO: 849644 - DNA, 22 bp, Homo sapiens
tgccagactctaggttatacaa

SEQ ID NO: 849645 - DNA, 20 bp, Homo sapiens
tgccagagaaactaacttgg

SEQ ID NO: 849646 - DNA, 19 bp, Homo sapiens
tgccagagcaggagcccct

SEQ ID NO: 849647 - DNA, 20 bp, Homo sapiens
tgccagaggaatcctggcag

SEQ ID NO: 849648 - DNA, 22 bp, Homo sapiens
tgccagaggaatcctggcagcc

SEQ ID NO: 849649 - DNA, 12 bp, Homo sapiens
tgccagagggcc

SEQ ID NO: 849650 - DNA, 16 bp, Homo sapiens
tgccagagggccagca

SEQ ID NO: 849651 - DNA, 22 bp, Homo sapiens
tgccagagggccagcaggctcc

SEQ ID NO: 849652 - DNA, 15 bp, Homo sapiens
tgccagaggtgggca

SEQ ID NO: 849653 - DNA, 22 bp, Homo sapiens
tgccagatataactgtcttgtt

SEQ ID NO: 849654 - DNA, 21 bp, Homo sapiens
tgccagattctgcctctctgg

SEQ ID NO: 849655 - DNA, 12 bp, Homo sapiens
tgccagcaaata

SEQ ID NO: 849656 - DNA, 15 bp, Homo sapiens
tgccagcaaataaat

SEQ ID NO: 849657 - DNA, 12 bp, Homo sapiens
tgcccaggccct

SEQ ID NO: 849658 - DNA, 13 bp, Homo sapiens
tgcccaggccctt

SEQ ID NO: 849659 - DNA, 21 bp, Homo sapiens
tgcccaggcccttggctgcag

SEQ ID NO: 849660 - DNA, 18 bp, Homo sapiens
tgcccaggctggaatgca

SEQ ID NO: 849661 - DNA, 20 bp, Homo sapiens
tgcccaggctggagtacaat

SEQ ID NO: 849662 - DNA, 16 bp, Homo sapiens
tgcccaggctggagtg

SEQ ID NO: 849663 - DNA, 20 bp, Homo sapiens
tgcccaggctggagtgcaat

SEQ ID NO: 849664 - DNA, 16 bp, Homo sapiens
tgcccagggctcagcc

SEQ ID NO: 849665 - DNA, 20 bp, Homo sapiens
tgcccaggggcccacaggga

SEQ ID NO: 849666 - DNA, 19 bp, Homo sapiens
tgcccaggggtgccccctc

SEQ ID NO: 849667 - DNA, 22 bp, Homo sapiens
tgcccaggggtgccccctcctc

SEQ ID NO: 849668 - DNA, 19 bp, Homo sapiens
tgcccagggtgcagtgtga

SEQ ID NO: 849669 - DNA, 19 bp, Homo sapiens
tgcccagggtggctgccag

SEQ ID NO: 849670 - DNA, 21 bp, Homo sapiens
tgcccagggtggctgccagcc

SEQ ID NO: 849671 - DNA, 21 bp, Homo sapiens
tgcccaggtggcctcctggcc

SEQ ID NO: 849672 - DNA, 14 bp, Homo sapiens
tgcccagtcctggg

SEQ ID NO: 849673 - DNA, 17 bp, Homo sapiens
tgcccagtcctgggttg

SEQ ID NO: 849674 - DNA, 20 bp, Homo sapiens
tgcccagtgttgtttgtaaa

SEQ ID NO: 849675 - DNA, 21 bp, Homo sapiens
tgcccagtgttgtttgtaaat

SEQ ID NO: 849676 - DNA, 15 bp, Homo sapiens
tgcccatcctgactg

SEQ ID NO: 849677 - DNA, 14 bp, Homo sapiens
tgcccatgtgtaca

SEQ ID NO: 849678 - DNA, 21 bp, Homo sapiens
tgcccatgtgtacattctgcc

SEQ ID NO: 849679 - DNA, 18 bp, Homo sapiens
tgcccatgtgtcccctca

SEQ ID NO: 849680 - DNA, 12 bp, Homo sapiens
tgcccattccta

SEQ ID NO: 849681 - DNA, 21 bp, Homo sapiens
tgcccatttcgaagatataca

SEQ ID NO: 849682 - DNA, 14 bp, Homo sapiens
tgcccattttgaat

SEQ ID NO: 849683 - DNA, 14 bp, Homo sapiens
tgccccaaacaaat

SEQ ID NO: 849684 - DNA, 20 bp, Homo sapiens
tgccccaaacaaatatgcaa

SEQ ID NO: 849685 - DNA, 23 bp, Homo sapiens
tgccccaaataacttcagtcctg

SEQ ID NO: 849686 - DNA, 16 bp, Homo sapiens
tgccccaacctgctga

SEQ ID NO: 849687 - DNA, 16 bp, Homo sapiens
tgccccaactcctgga

SEQ ID NO: 849688 - DNA, 16 bp, Homo sapiens
tgccccaagcagccag

SEQ ID NO: 849689 - DNA, 14 bp, Homo sapiens
tgccccaagtcctc

SEQ ID NO: 849690 - DNA, 15 bp, Homo sapiens
tgccccaagtcctca

SEQ ID NO: 849691 - DNA, 16 bp, Homo sapiens
tgccccacacggactc

SEQ ID NO: 849692 - DNA, 22 bp, Homo sapiens
tgccccacacggactcccgggc

SEQ ID NO: 849693 - DNA, 18 bp, Homo sapiens
tgccccacatgtggccat

SEQ ID NO: 849694 - DNA, 15 bp, Homo sapiens
tgccccaccacgtct

SEQ ID NO: 849695 - DNA, 15 bp, Homo sapiens
tgccccacccacccc

SEQ ID NO: 849696 - DNA, 21 bp, Homo sapiens
tgccccaccccatccagccag

SEQ ID NO: 849697 - DNA, 12 bp, Homo sapiens
tgccccacctcc

SEQ ID NO: 849698 - DNA, 18 bp, Homo sapiens
tgccccacctcccgccct

SEQ ID NO: 849699 - DNA, 20 bp, Homo sapiens
tgccccacctcccgccctca

SEQ ID NO: 849700 - DNA, 21 bp, Homo sapiens
tgccccacctcccgccctcac

SEQ ID NO: 849701 - DNA, 23 bp, Homo sapiens
tgccccacctgccgcatgctccc

SEQ ID NO: 849702 - DNA, 19 bp, Homo sapiens
tgccccactctgcctgcct

SEQ ID NO: 849703 - DNA, 16 bp, Homo sapiens
tgccccacttctggcc

SEQ ID NO: 849704 - DNA, 19 bp, Homo sapiens
tgccccacttctggccaca

SEQ ID NO: 849705 - DNA, 21 bp, Homo sapiens
tgccccagactgagctctcca

SEQ ID NO: 849706 - DNA, 13 bp, Homo sapiens
tgccccagagccc

SEQ ID NO: 849707 - DNA, 13 bp, Homo sapiens
tgccccagccaac

SEQ ID NO: 849708 - DNA, 13 bp, Homo sapiens
tgccccagcccct

SEQ ID NO: 849709 - DNA, 18 bp, Homo sapiens
tgccccagcccctaagcc

SEQ ID NO: 849710 - DNA, 19 bp, Homo sapiens
tgccccagctctggcttcc

SEQ ID NO: 849711 - DNA, 16 bp, Homo sapiens
tgccccagctgccagg

SEQ ID NO: 849712 - DNA, 17 bp, Homo sapiens
tgccccaggactctggc

SEQ ID NO: 849713 - DNA, 18 bp, Homo sapiens
tgccccaggactctggca

SEQ ID NO: 849714 - DNA, 13 bp, Homo sapiens
tgccccaggccag

SEQ ID NO: 849715 - DNA, 15 bp, Homo sapiens
tgccccaggccaggt

SEQ ID NO: 849716 - DNA, 12 bp, Homo sapiens
tgccccaggccg

SEQ ID NO: 849717 - DNA, 20 bp, Homo sapiens
tgccccaggccggagcccag

SEQ ID NO: 849718 - DNA, 14 bp, Homo sapiens
tgccccaggcctga

SEQ ID NO: 849719 - DNA, 17 bp, Homo sapiens
tgccccagggagtccag

SEQ ID NO: 849720 - DNA, 12 bp, Homo sapiens
tgccccaggggg

SEQ ID NO: 849721 - DNA, 22 bp, Homo sapiens
tgccccagtcggccccatctct

SEQ ID NO: 849722 - DNA, 23 bp, Homo sapiens
tgccccagtttggggtgccaaga

SEQ ID NO: 849723 - DNA, 18 bp, Homo sapiens
tgccccatcagtgctccc

SEQ ID NO: 849724 - DNA, 19 bp, Homo sapiens
tgccccatcctccagcagg

SEQ ID NO: 849725 - DNA, 23 bp, Homo sapiens
tgccccatgcctgtccagcctgg

SEQ ID NO: 849726 - DNA, 22 bp, Homo sapiens
tgccccattccttgcgcctcag

SEQ ID NO: 849727 - DNA, 13 bp, Homo sapiens
tgcccccagaaag

SEQ ID NO: 849728 - DNA, 19 bp, Homo sapiens
tgcccccagaaagcctcct

SEQ ID NO: 849729 - DNA, 20 bp, Homo sapiens
tgcccccagaaagcctcctg

SEQ ID NO: 849730 - DNA, 12 bp, Homo sapiens
tgcccccagagt

SEQ ID NO: 849731 - DNA, 14 bp, Homo sapiens
tgcccccagcccaa

SEQ ID NO: 849732 - DNA, 14 bp, Homo sapiens
tgcccccagccccg

SEQ ID NO: 849733 - DNA, 19 bp, Homo sapiens
tgcccccagcctcagccca

SEQ ID NO: 849734 - DNA, 13 bp, Homo sapiens
tgcccccagctgg

SEQ ID NO: 849735 - DNA, 18 bp, Homo sapiens
tgcccccaggcagccacc

SEQ ID NO: 849736 - DNA, 21 bp, Homo sapiens
tgcccccaggcagccaccagt

SEQ ID NO: 849737 - DNA, 16 bp, Homo sapiens
tgcccccatcacctct

SEQ ID NO: 849738 - DNA, 23 bp, Homo sapiens
tgcccccatccagccacggaggg

SEQ ID NO: 849739 - DNA, 15 bp, Homo sapiens
tgcccccatccctcg

SEQ ID NO: 849740 - DNA, 17 bp, Homo sapiens
tgcccccatctccccag

SEQ ID NO: 849741 - DNA, 21 bp, Homo sapiens
tgcccccatctccccaggcct

SEQ ID NO: 849742 - DNA, 21 bp, Homo sapiens
tgccccccaaggttctggttc

SEQ ID NO: 849743 - DNA, 12 bp, Homo sapiens
tgccccccaccc

SEQ ID NO: 849744 - DNA, 13 bp, Homo sapiens
tgccccccacccc

SEQ ID NO: 849745 - DNA, 13 bp, Homo sapiens
tgccccccagtct

SEQ ID NO: 849746 - DNA, 14 bp, Homo sapiens
tgccccccagtctc

SEQ ID NO: 849747 - DNA, 18 bp, Homo sapiens
tgccccccgaggctgcta

SEQ ID NO: 849748 - DNA, 17 bp, Homo sapiens
tgccccccgccctcatg

SEQ ID NO: 849749 - DNA, 18 bp, Homo sapiens
tgcccccctcctccagta

SEQ ID NO: 849750 - DNA, 21 bp, Homo sapiens
tgcccccgcgggttctagacg

SEQ ID NO: 849751 - DNA, 19 bp, Homo sapiens
tgcccccgcttagccccgc

SEQ ID NO: 849752 - DNA, 22 bp, Homo sapiens
tgcccccgcttagccccgctga

SEQ ID NO: 849753 - DNA, 18 bp, Homo sapiens
tgccccctccaggagaga

SEQ ID NO: 849754 - DNA, 19 bp, Homo sapiens
tgccccctcccttcacagg

SEQ ID NO: 849755 - DNA, 11 bp, Homo sapiens
tgccccctcct

SEQ ID NO: 849756 - DNA, 17 bp, Homo sapiens
tgccccctcctctccca

SEQ ID NO: 849757 - DNA, 14 bp, Homo sapiens
tgccccctgccagt

SEQ ID NO: 849758 - DNA, 13 bp, Homo sapiens
tgccccctgctta

SEQ ID NO: 849759 - DNA, 12 bp, Homo sapiens
tgccccctggtg

SEQ ID NO: 849760 - DNA, 21 bp, Homo sapiens
tgccccctggtggacagtcct

SEQ ID NO: 849761 - DNA, 19 bp, Homo sapiens
tgcccccttccccagccct

SEQ ID NO: 849762 - DNA, 17 bp, Homo sapiens
tgcccccttcgctcctc

SEQ ID NO: 849763 - DNA, 15 bp, Homo sapiens
tgcccccttctccca

SEQ ID NO: 849764 - DNA, 20 bp, Homo sapiens
tgcccccttctcccacactg

SEQ ID NO: 849765 - DNA, 20 bp, Homo sapiens
tgccccctttgaccttcccc

SEQ ID NO: 849766 - DNA, 18 bp, Homo sapiens
tgccccgcctgagtcagt

SEQ ID NO: 849767 - DNA, 17 bp, Homo sapiens
tgccccggacctacctc

SEQ ID NO: 849768 - DNA, 14 bp, Homo sapiens
tgccccggaggaag

SEQ ID NO: 849769 - DNA, 21 bp, Homo sapiens
tgccccgtcggactgccccca

SEQ ID NO: 849770 - DNA, 17 bp, Homo sapiens
tgccccgtgtgaatgta

SEQ ID NO: 849771 - DNA, 18 bp, Homo sapiens
tgccccgttccctgtcag

SEQ ID NO: 849772 - DNA, 21 bp, Homo sapiens
tgcccctaatctctgtaggaa

SEQ ID NO: 849773 - DNA, 21 bp, Homo sapiens
tgcccctaggatgctgcagca

SEQ ID NO: 849774 - DNA, 14 bp, Homo sapiens
tgcccctcaggggg

SEQ ID NO: 849775 - DNA, 17 bp, Homo sapiens
tgcccctcagggggcca

SEQ ID NO: 849776 - DNA, 20 bp, Homo sapiens
tgcccctcagggggccagct

SEQ ID NO: 849777 - DNA, 12 bp, Homo sapiens
tgcccctccccc

SEQ ID NO: 849778 - DNA, 17 bp, Homo sapiens
tgcccctcccccagctg

SEQ ID NO: 849779 - DNA, 18 bp, Homo sapiens
tgcccctcccccagctgc

SEQ ID NO: 849780 - DNA, 13 bp, Homo sapiens
tgcccctcccttc

SEQ ID NO: 849781 - DNA, 16 bp, Homo sapiens
tgcccctcccttcaac

SEQ ID NO: 849782 - DNA, 16 bp, Homo sapiens
tgcccctcgcacacag

SEQ ID NO: 849783 - DNA, 19 bp, Homo sapiens
tgcccctcgcacacagggc

SEQ ID NO: 849784 - DNA, 23 bp, Homo sapiens
tgcccctcgcacacagggctcac

SEQ ID NO: 849785 - DNA, 18 bp, Homo sapiens
tgcccctctactgttgca

SEQ ID NO: 849786 - DNA, 14 bp, Homo sapiens
tgcccctctgttct

SEQ ID NO: 849787 - DNA, 17 bp, Homo sapiens
tgcccctctgttctctc

SEQ ID NO: 849788 - DNA, 15 bp, Homo sapiens
tgcccctctttctct

SEQ ID NO: 849789 - DNA, 16 bp, Homo sapiens
tgcccctctttctctt

SEQ ID NO: 849790 - DNA, 23 bp, Homo sapiens
tgcccctgagcaatgtctgtgct

SEQ ID NO: 849791 - DNA, 22 bp, Homo sapiens
tgcccctgatgcagcctgtggc

SEQ ID NO: 849792 - DNA, 20 bp, Homo sapiens
tgcccctgctgtgctgctca

SEQ ID NO: 849793 - DNA, 21 bp, Homo sapiens
tgcccctgctgtgctgctcaa

SEQ ID NO: 849794 - DNA, 17 bp, Homo sapiens
tgcccctggacctggga

SEQ ID NO: 849795 - DNA, 22 bp, Homo sapiens
tgcccctggcccatctcagcct

SEQ ID NO: 849796 - DNA, 19 bp, Homo sapiens
tgcccctggtgccctgaga

SEQ ID NO: 849797 - DNA, 17 bp, Homo sapiens
tgcccctgtcccacctg

SEQ ID NO: 849798 - DNA, 21 bp, Homo sapiens
tgcccctgtcccacctggctc

SEQ ID NO: 849799 - DNA, 23 bp, Homo sapiens
tgcccctgtctggaagacgtggc

SEQ ID NO: 849800 - DNA, 20 bp, Homo sapiens
tgcccctgtgctgcggggcc

SEQ ID NO: 849801 - DNA, 12 bp, Homo sapiens
tgccccttccac

SEQ ID NO: 849802 - DNA, 16 bp, Homo sapiens
tgccccttccccaaga

SEQ ID NO: 849803 - DNA, 15 bp, Homo sapiens
tgccccttcttgggc

SEQ ID NO: 849804 - DNA, 13 bp, Homo sapiens
tgccccttgggca

SEQ ID NO: 849805 - DNA, 18 bp, Homo sapiens
tgccccttgggcatccac

SEQ ID NO: 849806 - DNA, 19 bp, Homo sapiens
tgcccctttataaatccaa

SEQ ID NO: 849807 - DNA, 13 bp, Homo sapiens
tgcccgagctggt

SEQ ID NO: 849808 - DNA, 17 bp, Homo sapiens
tgcccgagtccgcccat

SEQ ID NO: 849809 - DNA, 23 bp, Homo sapiens
tgcccgataccgggacacagaat

SEQ ID NO: 849810 - DNA, 14 bp, Homo sapiens
tgcccgcagagccc

SEQ ID NO: 849811 - DNA, 21 bp, Homo sapiens
tgcccgcatgtgtgcctggcc

SEQ ID NO: 849812 - DNA, 23 bp, Homo sapiens
tgcccgccagcctcagtgccact

SEQ ID NO: 849813 - DNA, 16 bp, Homo sapiens
tgcccgctcccaaccc

SEQ ID NO: 849814 - DNA, 19 bp, Homo sapiens
tgcccgctcccacagcttc

SEQ ID NO: 849815 - DNA, 22 bp, Homo sapiens
tgcccgctgcaatgcctagact

SEQ ID NO: 849816 - DNA, 17 bp, Homo sapiens
tgcccggaggccgggcc

SEQ ID NO: 849817 - DNA, 22 bp, Homo sapiens
tgcccggattctgggaggaagc

SEQ ID NO: 849818 - DNA, 16 bp, Homo sapiens
tgcccggcgccgggca

SEQ ID NO: 849819 - DNA, 17 bp, Homo sapiens
tgcccggcgccgggcac

SEQ ID NO: 849820 - DNA, 15 bp, Homo sapiens
tgcccggcgcctgcc

SEQ ID NO: 849821 - DNA, 19 bp, Homo sapiens
tgcccggcgcctgccctgc

SEQ ID NO: 849822 - DNA, 20 bp, Homo sapiens
tgcccggctaatttttgtaa

SEQ ID NO: 849823 - DNA, 23 bp, Homo sapiens
tgcccggggcagcagcagccctg

SEQ ID NO: 849824 - DNA, 20 bp, Homo sapiens
tgcccggggtggggtgcact

SEQ ID NO: 849825 - DNA, 20 bp, Homo sapiens
tgcccggtggtttgccatgt

SEQ ID NO: 849826 - DNA, 20 bp, Homo sapiens
tgcccgtcggccctgcgtcg

SEQ ID NO: 849827 - DNA, 13 bp, Homo sapiens
tgcccgtcttcag

SEQ ID NO: 849828 - DNA, 19 bp, Homo sapiens
tgcccgtcttcagcctagc

SEQ ID NO: 849829 - DNA, 19 bp, Homo sapiens
tgcccgttttaccaataaa

SEQ ID NO: 849830 - DNA, 19 bp, Homo sapiens
tgccctaaagtgtattttt

SEQ ID NO: 849831 - DNA, 14 bp, Homo sapiens
tgccctaactctgc

SEQ ID NO: 849832 - DNA, 21 bp, Homo sapiens
tgccctaactctgcccaccct

SEQ ID NO: 849833 - DNA, 15 bp, Homo sapiens
tgccctaagccccca

SEQ ID NO: 849834 - DNA, 17 bp, Homo sapiens
tgccctaagcccccagg

SEQ ID NO: 849835 - DNA, 20 bp, Homo sapiens
tgccctaagcccccagggcc

SEQ ID NO: 849836 - DNA, 22 bp, Homo sapiens
tgccctaagtgatttccacagg

SEQ ID NO: 849837 - DNA, 15 bp, Homo sapiens
tgccctactcactct

SEQ ID NO: 849838 - DNA, 23 bp, Homo sapiens
tgccctagcccagactctgagct

SEQ ID NO: 849839 - DNA, 14 bp, Homo sapiens
tgccctagctgacc

SEQ ID NO: 849840 - DNA, 16 bp, Homo sapiens
tgccctagctgacccc

SEQ ID NO: 849841 - DNA, 21 bp, Homo sapiens
tgccctatggatttgaagttt

SEQ ID NO: 849842 - DNA, 14 bp, Homo sapiens
tgccctcaagcaat

SEQ ID NO: 849843 - DNA, 14 bp, Homo sapiens
tgccctcaccacca

SEQ ID NO: 849844 - DNA, 19 bp, Homo sapiens
tgccctcaccaccacacta

SEQ ID NO: 849845 - DNA, 14 bp, Homo sapiens
tgccctcaccccaa

SEQ ID NO: 849846 - DNA, 22 bp, Homo sapiens
tgccctcaccccaatccctgcc

SEQ ID NO: 849847 - DNA, 12 bp, Homo sapiens
tgccctcactcc

SEQ ID NO: 849848 - DNA, 19 bp, Homo sapiens
tgccctcagggactgcacc

SEQ ID NO: 849849 - DNA, 21 bp, Homo sapiens
tgccctcatggcccctctgac

SEQ ID NO: 849850 - DNA, 18 bp, Homo sapiens
tgccctcattactgggcc

SEQ ID NO: 849851 - DNA, 19 bp, Homo sapiens
tgccctcattactgggcct

SEQ ID NO: 849852 - DNA, 21 bp, Homo sapiens
tgccctccacagccgcagcct

SEQ ID NO: 849853 - DNA, 16 bp, Homo sapiens
tgccctcccaggaccc

SEQ ID NO: 849854 - DNA, 18 bp, Homo sapiens
tgccctcccaggaccctc

SEQ ID NO: 849855 - DNA, 22 bp, Homo sapiens
tgccctcccatgttgcatgcct

SEQ ID NO: 849856 - DNA, 15 bp, Homo sapiens
tgccctccccagagc

SEQ ID NO: 849857 - DNA, 17 bp, Homo sapiens
tgccctccccagagcac

SEQ ID NO: 849858 - DNA, 19 bp, Homo sapiens
tgccctccccagagcactg

SEQ ID NO: 849859 - DNA, 15 bp, Homo sapiens
tgccctcccctcagc

SEQ ID NO: 849860 - DNA, 17 bp, Homo sapiens
tgccctcccctcagcgc

SEQ ID NO: 849861 - DNA, 14 bp, Homo sapiens
tgccctcccctctc

SEQ ID NO: 849862 - DNA, 17 bp, Homo sapiens
tgccctcccctctctgc

SEQ ID NO: 849863 - DNA, 21 bp, Homo sapiens
tgccctcccctctctgcaccg

SEQ ID NO: 849864 - DNA, 21 bp, Homo sapiens
tgccctcccgcaccttcctcc

SEQ ID NO: 849865 - DNA, 20 bp, Homo sapiens
tgccctccctcggccccacc

SEQ ID NO: 849866 - DNA, 19 bp, Homo sapiens
tgccctcccttctccctgg

SEQ ID NO: 849867 - DNA, 12 bp, Homo sapiens
tgccctccggag

SEQ ID NO: 849868 - DNA, 20 bp, Homo sapiens
tgccctccggaggagcagcc

SEQ ID NO: 849869 - DNA, 13 bp, Homo sapiens
tgccctcgctgct

SEQ ID NO: 849870 - DNA, 21 bp, Homo sapiens
tgccctcgtggccagcccggc

SEQ ID NO: 849871 - DNA, 13 bp, Homo sapiens
tgccctctccctg

SEQ ID NO: 849872 - DNA, 17 bp, Homo sapiens
tgccctctgctctgcct

SEQ ID NO: 849873 - DNA, 18 bp, Homo sapiens
tgccctctgctgctgccc

SEQ ID NO: 849874 - DNA, 19 bp, Homo sapiens
tgccctctgctgctgcccg

SEQ ID NO: 849875 - DNA, 17 bp, Homo sapiens
tgccctcttctccttgc

SEQ ID NO: 849876 - DNA, 17 bp, Homo sapiens
tgccctgaaagggccct

SEQ ID NO: 849877 - DNA, 21 bp, Homo sapiens
tgccctgaaagggcccttccc

SEQ ID NO: 849878 - DNA, 12 bp, Homo sapiens
tgccctgacctc

SEQ ID NO: 849879 - DNA, 20 bp, Homo sapiens
tgccctgagaagctgctcca

SEQ ID NO: 849880 - DNA, 22 bp, Homo sapiens
tgccctgcacgtcatgggaggg

SEQ ID NO: 849881 - DNA, 16 bp, Homo sapiens
tgccctgcagagcaat

SEQ ID NO: 849882 - DNA, 17 bp, Homo sapiens
tgccctgcagagcaata

SEQ ID NO: 849883 - DNA, 12 bp, Homo sapiens
tgccctgcaggc

SEQ ID NO: 849884 - DNA, 11 bp, Homo sapiens
tgccctgccca

SEQ ID NO: 849885 - DNA, 12 bp, Homo sapiens
tgccctgcccaa

SEQ ID NO: 849886 - DNA, 15 bp, Homo sapiens
tgccctgcccaagtg

SEQ ID NO: 849887 - DNA, 21 bp, Homo sapiens
tgccctgcccaggtggcctcc

SEQ ID NO: 849888 - DNA, 12 bp, Homo sapiens
tgccctgcccat

SEQ ID NO: 849889 - DNA, 16 bp, Homo sapiens
tgccctgcctcccttt

SEQ ID NO: 849890 - DNA, 15 bp, Homo sapiens
tgccctgcctgagga

SEQ ID NO: 849891 - DNA, 13 bp, Homo sapiens
tgccctgcctgcc

SEQ ID NO: 849892 - DNA, 14 bp, Homo sapiens
tgccctgcctgccc

SEQ ID NO: 849893 - DNA, 14 bp, Homo sapiens
tgccctgccttgcc

SEQ ID NO: 849894 - DNA, 21 bp, Homo sapiens
tgccctgccttgccgctcccc

SEQ ID NO: 849895 - DNA, 22 bp, Homo sapiens
tgccctgctgagtcccaggctg

SEQ ID NO: 849896 - DNA, 13 bp, Homo sapiens
tgccctgctgcca

SEQ ID NO: 849897 - DNA, 21 bp, Homo sapiens
tgccctgctgccgcctcccag

SEQ ID NO: 849898 - DNA, 19 bp, Homo sapiens
tgccctggaggctgacaca

SEQ ID NO: 849899 - DNA, 15 bp, Homo sapiens
tgccctggagggagg

SEQ ID NO: 849900 - DNA, 15 bp, Homo sapiens
tgcctgaactccaga

SEQ ID NO: 849901 - DNA, 16 bp, Homo sapiens
tgcctgaactccagag

SEQ ID NO: 849902 - DNA, 13 bp, Homo sapiens
tgcctgaataaag

SEQ ID NO: 849903 - DNA, 17 bp, Homo sapiens
tgcctgaataaagagcc

SEQ ID NO: 849904 - DNA, 22 bp, Homo sapiens
tgcctgacactgagccccacct

SEQ ID NO: 849905 - DNA, 20 bp, Homo sapiens
tgcctgacagccttccccag

SEQ ID NO: 849906 - DNA, 21 bp, Homo sapiens
tgcctgacagccttccccagc

SEQ ID NO: 849907 - DNA, 16 bp, Homo sapiens
tgcctgactcctgggt

SEQ ID NO: 849908 - DNA, 21 bp, Homo sapiens
tgcctgactgcccgctcctcg

SEQ ID NO: 849909 - DNA, 21 bp, Homo sapiens
tgcctgagaagaagtggctgc

SEQ ID NO: 849910 - DNA, 19 bp, Homo sapiens
tgcctgagaggcaggcata

SEQ ID NO: 849911 - DNA, 15 bp, Homo sapiens
tgcctgagggcccct

SEQ ID NO: 849912 - DNA, 19 bp, Homo sapiens
tgcctgagggcccctctgc

SEQ ID NO: 849913 - DNA, 15 bp, Homo sapiens
tgcctgaggtctgta

SEQ ID NO: 849914 - DNA, 16 bp, Homo sapiens
tgcctgaggtctgtac

SEQ ID NO: 849915 - DNA, 19 bp, Homo sapiens
tgcctgattcggacggcca

SEQ ID NO: 849916 - DNA, 19 bp, Homo sapiens
tgcctgcactccctggcct

SEQ ID NO: 849917 - DNA, 22 bp, Homo sapiens
tgcctgcactgagagggcaagg

SEQ ID NO: 849918 - DNA, 16 bp, Homo sapiens
tgcctgcactgggaag

SEQ ID NO: 849919 - DNA, 20 bp, Homo sapiens
tgcctgcactgggaaggaaa

SEQ ID NO: 849920 - DNA, 15 bp, Homo sapiens
tgcctgcagagagaa

SEQ ID NO: 849921 - DNA, 18 bp, Homo sapiens
tgcctgcagagagaagcc

SEQ ID NO: 849922 - DNA, 11 bp, Homo sapiens
tgcctgcagcc

SEQ ID NO: 849923 - DNA, 15 bp, Homo sapiens
tgcctgcagccccgc

SEQ ID NO: 849924 - DNA, 22 bp, Homo sapiens
tgcctgcagccccgcgcctcct

SEQ ID NO: 849925 - DNA, 22 bp, Homo sapiens
tgcctgccaaagtagtcctggc

SEQ ID NO: 849926 - DNA, 11 bp, Homo sapiens
tgcctgccact

SEQ ID NO: 849927 - DNA, 17 bp, Homo sapiens
tgcctgccactctctgg

SEQ ID NO: 849928 - DNA, 18 bp, Homo sapiens
tgcctgccactctctggg

SEQ ID NO: 849929 - DNA, 20 bp, Homo sapiens
tgcctgccactctctgggac

SEQ ID NO: 849930 - DNA, 12 bp, Homo sapiens
tgcctgccatgt

SEQ ID NO: 849931 - DNA, 14 bp, Homo sapiens
tgcctgcccacccg

SEQ ID NO: 849932 - DNA, 15 bp, Homo sapiens
tgcctgcccacccgt

SEQ ID NO: 849933 - DNA, 18 bp, Homo sapiens
tgcctgccccaaacaaat

SEQ ID NO: 849934 - DNA, 12 bp, Homo sapiens
tgcctgccccgc

SEQ ID NO: 849935 - DNA, 11 bp, Homo sapiens
tgcctgcccct

SEQ ID NO: 849936 - DNA, 16 bp, Homo sapiens
tgcctgcccctgctgc

SEQ ID NO: 849937 - DNA, 17 bp, Homo sapiens
tgcctgcccctgctgct

SEQ ID NO: 849938 - DNA, 17 bp, Homo sapiens
tgcctgccctggaggga

SEQ ID NO: 849939 - DNA, 16 bp, Homo sapiens
tgcctgcctccacccg

SEQ ID NO: 849940 - DNA, 12 bp, Homo sapiens
tgcctgcctcct

SEQ ID NO: 849941 - DNA, 13 bp, Homo sapiens
tgcctgcctccta

SEQ ID NO: 849942 - DNA, 15 bp, Homo sapiens
tgcctgcctcctagg

SEQ ID NO: 849943 - DNA, 16 bp, Homo sapiens
tgcctgcctcctaggc

SEQ ID NO: 849944 - DNA, 19 bp, Homo sapiens
tgcctgcctcttggcctca

SEQ ID NO: 849945 - DNA, 22 bp, Homo sapiens
tgcctgcctcttggcctcacgg

SEQ ID NO: 849946 - DNA, 15 bp, Homo sapiens
tgcctgcctgtctgt

SEQ ID NO: 849947 - DNA, 20 bp, Homo sapiens
tgcctgcctgtctgtctctc

SEQ ID NO: 849948 - DNA, 18 bp, Homo sapiens
tgcctgcctttgtgtcag

SEQ ID NO: 849949 - DNA, 19 bp, Homo sapiens
tgcctgcgcctgctgcctg

SEQ ID NO: 849950 - DNA, 15 bp, Homo sapiens
tgcctgcgtcttccg

SEQ ID NO: 849951 - DNA, 17 bp, Homo sapiens
tgcctgcgtcttccgcc

SEQ ID NO: 849952 - DNA, 19 bp, Homo sapiens
tgcctgcgtcttccgcccc

SEQ ID NO: 849953 - DNA, 17 bp, Homo sapiens
tgcctgctatttgaagt

SEQ ID NO: 849954 - DNA, 18 bp, Homo sapiens
tgcctgctcagcagccag

SEQ ID NO: 849955 - DNA, 15 bp, Homo sapiens
tgcctgctcaggtgc

SEQ ID NO: 849956 - DNA, 13 bp, Homo sapiens
tgcctgctccatc

SEQ ID NO: 849957 - DNA, 11 bp, Homo sapiens
tgcctgctcct

SEQ ID NO: 849958 - DNA, 23 bp, Homo sapiens
tgcctgctgaatgatttccaaag

SEQ ID NO: 849959 - DNA, 13 bp, Homo sapiens
tgcctgctgtatt

SEQ ID NO: 849960 - DNA, 19 bp, Homo sapiens
tgcctgctgtatttatagt

SEQ ID NO: 849961 - DNA, 13 bp, Homo sapiens
tgcctgcttctgt

SEQ ID NO: 849962 - DNA, 17 bp, Homo sapiens
tgcctgcttctgtgtac

SEQ ID NO: 849963 - DNA, 14 bp, Homo sapiens
tgcctgcttgataa

SEQ ID NO: 849964 - DNA, 13 bp, Homo sapiens
tgcctgctttgaa

SEQ ID NO: 849965 - DNA, 14 bp, Homo sapiens
tgcctgcttttgat

SEQ ID NO: 849966 - DNA, 21 bp, Homo sapiens
tgcctgctttttggaaagtca

SEQ ID NO: 849967 - DNA, 22 bp, Homo sapiens
tgcctgctttttggaaagtcag

SEQ ID NO: 849968 - DNA, 23 bp, Homo sapiens
tgcctggagacaaggtgctaaca

SEQ ID NO: 849969 - DNA, 15 bp, Homo sapiens
tgcctggagacagat

SEQ ID NO: 849970 - DNA, 18 bp, Homo sapiens
tgcctggaggtgtgggag

SEQ ID NO: 849971 - DNA, 23 bp, Homo sapiens
tgcctggagtgtatgactgcaca

SEQ ID NO: 849972 - DNA, 20 bp, Homo sapiens
tgcctggatgaggcacttct

SEQ ID NO: 849973 - DNA, 23 bp, Homo sapiens
tgcctggccactgctccctaagc

SEQ ID NO: 849974 - DNA, 16 bp, Homo sapiens
tgcctggccatgctgt

SEQ ID NO: 849975 - DNA, 20 bp, Homo sapiens
tgcctggccccagcctgggc

SEQ ID NO: 849976 - DNA, 12 bp, Homo sapiens
tgcctggcctgg

SEQ ID NO: 849977 - DNA, 14 bp, Homo sapiens
tgcctggcctggct

SEQ ID NO: 849978 - DNA, 15 bp, Homo sapiens
tgcctggcctggctc

SEQ ID NO: 849979 - DNA, 16 bp, Homo sapiens
tgcctggcctggctcc

SEQ ID NO: 849980 - DNA, 13 bp, Homo sapiens
tgcctggctgtgg

SEQ ID NO: 849981 - DNA, 15 bp, Homo sapiens
tgcctggctgtggag

SEQ ID NO: 849982 - DNA, 14 bp, Homo sapiens
tgcctgggcccctc

SEQ ID NO: 849983 - DNA, 20 bp, Homo sapiens
tgcctgggcccctcccctca

SEQ ID NO: 849984 - DNA, 21 bp, Homo sapiens
tgcctgggcccggaagggctt

SEQ ID NO: 849985 - DNA, 14 bp, Homo sapiens
tgcctgggccctgg

SEQ ID NO: 849986 - DNA, 22 bp, Homo sapiens
tgcctgggccgtggcacagctg

SEQ ID NO: 849987 - DNA, 23 bp, Homo sapiens
tgcctgggccgtggcacagctgg

SEQ ID NO: 849988 - DNA, 14 bp, Homo sapiens
tgcctgggcctgtg

SEQ ID NO: 849989 - DNA, 16 bp, Homo sapiens
tgcctgggccttggct

SEQ ID NO: 849990 - DNA, 21 bp, Homo sapiens
tgcctgggccttggctgggcc

SEQ ID NO: 849991 - DNA, 22 bp, Homo sapiens
tgcctgggccttggctgggcct

SEQ ID NO: 849992 - DNA, 17 bp, Homo sapiens
tgcctgggctctggaag

SEQ ID NO: 849993 - DNA, 22 bp, Homo sapiens
tgcctgggctgggcagccttgg

SEQ ID NO: 849994 - DNA, 22 bp, Homo sapiens
tgcctggggcccaagttgcagt

SEQ ID NO: 849995 - DNA, 17 bp, Homo sapiens
tgcctggggcggcatga

SEQ ID NO: 849996 - DNA, 22 bp, Homo sapiens
tgcctggggcggcatgaaccct

SEQ ID NO: 849997 - DNA, 14 bp, Homo sapiens
tgcctgggggagtt

SEQ ID NO: 849998 - DNA, 12 bp, Homo sapiens
tgcctggggtct

SEQ ID NO: 849999 - DNA, 23 bp, Homo sapiens
tgcctgggtggccatcctaccca

SEQ ID NO: 850000 - DNA, 16 bp, Homo sapiens
tgcctgggtggggctg

SEQ ID NO: 850001 - DNA, 17 bp, Homo sapiens
tgcctgggtggggctgc

SEQ ID NO: 850002 - DNA, 19 bp, Homo sapiens
tgcctgggtggggctgctc

SEQ ID NO: 850003 - DNA, 14 bp, Homo sapiens
tgcctggtcccaag

SEQ ID NO: 850004 - DNA, 17 bp, Homo sapiens
tgcctggtctgtctgga

SEQ ID NO: 850005 - DNA, 16 bp, Homo sapiens
tgcctggtgttctgaa

SEQ ID NO: 850006 - DNA, 22 bp, Homo sapiens
tgcctgtagagacaatacagta

SEQ ID NO: 850007 - DNA, 22 bp, Homo sapiens
tgcctgtagcaatggccagagc

SEQ ID NO: 850008 - DNA, 22 bp, Homo sapiens
tgcctgtagccccagtgacagc

SEQ ID NO: 850009 - DNA, 17 bp, Homo sapiens
tgcctgtagttaggaaa

SEQ ID NO: 850010 - DNA, 18 bp, Homo sapiens
tgcctgtagttaggaaat

SEQ ID NO: 850011 - DNA, 21 bp, Homo sapiens
tgcctgtagttaggaaataaa

SEQ ID NO: 850012 - DNA, 17 bp, Homo sapiens
tgcctgtcacctgggag

SEQ ID NO: 850013 - DNA, 20 bp, Homo sapiens
tgcctgtcagtttcatggag

SEQ ID NO: 850014 - DNA, 15 bp, Homo sapiens
tgcctgtccagcctg

SEQ ID NO: 850015 - DNA, 13 bp, Homo sapiens
tgcctgtctaaag

SEQ ID NO: 850016 - DNA, 14 bp, Homo sapiens
tgcctgtctccatg

SEQ ID NO: 850017 - DNA, 12 bp, Homo sapiens
tgcctgtctctg

SEQ ID NO: 850018 - DNA, 14 bp, Homo sapiens
tgcctgtctctgtt

SEQ ID NO: 850019 - DNA, 15 bp, Homo sapiens
tgcctgtctggctca

SEQ ID NO: 850020 - DNA, 16 bp, Homo sapiens
tgcctgtctggctcag

SEQ ID NO: 850021 - DNA, 14 bp, Homo sapiens
tgcctgtgaggcag

SEQ ID NO: 850022 - DNA, 23 bp, Homo sapiens
tgctaaaagaagagaggggaaga

SEQ ID NO: 850023 - DNA, 16 bp, Homo sapiens
tgctaaaagtgcattt

SEQ ID NO: 850024 - DNA, 22 bp, Homo sapiens
tgctaaaatattttagatgtta

SEQ ID NO: 850025 - DNA, 23 bp, Homo sapiens
tgctaaacaagtaagaaaaataa

SEQ ID NO: 850026 - DNA, 22 bp, Homo sapiens
tgctaaacatggcttaatctta

SEQ ID NO: 850027 - DNA, 17 bp, Homo sapiens
tgctaaagcactttgca

SEQ ID NO: 850028 - DNA, 19 bp, Homo sapiens
tgctaaagccaaccagcct

SEQ ID NO: 850029 - DNA, 17 bp, Homo sapiens
tgctaaatgccatgttt

SEQ ID NO: 850030 - DNA, 21 bp, Homo sapiens
tgctaaatggtcgcccaggag

SEQ ID NO: 850031 - DNA, 15 bp, Homo sapiens
tgctaaatgtgaatg

SEQ ID NO: 850032 - DNA, 23 bp, Homo sapiens
tgctaacaaagacaaaagtctgt

SEQ ID NO: 850033 - DNA, 15 bp, Homo sapiens
tgctaacctggaaag

SEQ ID NO: 850034 - DNA, 14 bp, Homo sapiens
tgctaaccttttca

SEQ ID NO: 850035 - DNA, 22 bp, Homo sapiens
tgctaagaaatgctgaaaatca

SEQ ID NO: 850036 - DNA, 22 bp, Homo sapiens
tgctaagaagcgagcactgacc

SEQ ID NO: 850037 - DNA, 19 bp, Homo sapiens
tgctaagaatgcattattg

SEQ ID NO: 850038 - DNA, 22 bp, Homo sapiens
tgctaagagaagtagaaatcat

SEQ ID NO: 850039 - DNA, 14 bp, Homo sapiens
tgctaagagggccc

SEQ ID NO: 850040 - DNA, 13 bp, Homo sapiens
tgctaaggctgct

SEQ ID NO: 850041 - DNA, 17 bp, Homo sapiens
tgctaaggctgctggct

SEQ ID NO: 850042 - DNA, 18 bp, Homo sapiens
tgctaaggctgctggctt

SEQ ID NO: 850043 - DNA, 21 bp, Homo sapiens
tgctaagtaatttagaagata

SEQ ID NO: 850044 - DNA, 21 bp, Homo sapiens
tgctaagtggacctggaatct

SEQ ID NO: 850045 - DNA, 22 bp, Homo sapiens
tgctaatcagggaggtcatttt

SEQ ID NO: 850046 - DNA, 18 bp, Homo sapiens
tgctaatgcaaattaaaa

SEQ ID NO: 850047 - DNA, 16 bp, Homo sapiens
tgctaattaaataata

SEQ ID NO: 850048 - DNA, 18 bp, Homo sapiens
tgctaattcccaacattt

SEQ ID NO: 850049 - DNA, 18 bp, Homo sapiens
tgctaatttatcctgaaa

SEQ ID NO: 850050 - DNA, 13 bp, Homo sapiens
tgctaatttgttt

SEQ ID NO: 850051 - DNA, 20 bp, Homo sapiens
tgctacaaatttatgcattt

SEQ ID NO: 850052 - DNA, 21 bp, Homo sapiens
tgctacaaatttatgcatttc

SEQ ID NO: 850053 - DNA, 22 bp, Homo sapiens
tgctacaaatttatgcatttca

SEQ ID NO: 850054 - DNA, 19 bp, Homo sapiens
tgctacaagtgttttagat

SEQ ID NO: 850055 - DNA, 21 bp, Homo sapiens
tgctacaatcccaaagcgctc

SEQ ID NO: 850056 - DNA, 12 bp, Homo sapiens
tgctacaatgtc

SEQ ID NO: 850057 - DNA, 19 bp, Homo sapiens
tgctacacagacattaaga

SEQ ID NO: 850058 - DNA, 18 bp, Homo sapiens
tgctacatcagactctag

SEQ ID NO: 850059 - DNA, 22 bp, Homo sapiens
tgctaccagcgccaaatgttca

SEQ ID NO: 850060 - DNA, 22 bp, Homo sapiens
tgctaccagtatttagaagcca

SEQ ID NO: 850061 - DNA, 23 bp, Homo sapiens
tgctacccatgactttatatgga

SEQ ID NO: 850062 - DNA, 16 bp, Homo sapiens
tgctaccgccctgggc

SEQ ID NO: 850063 - DNA, 17 bp, Homo sapiens
tgctaccgccctgggct

SEQ ID NO: 850064 - DNA, 18 bp, Homo sapiens
tgctaccgttgacttcca

SEQ ID NO: 850065 - DNA, 18 bp, Homo sapiens
tgctacctcccttgcctt

SEQ ID NO: 850066 - DNA, 19 bp, Homo sapiens
tgctacctgggtccttttc

SEQ ID NO: 850067 - DNA, 21 bp, Homo sapiens
tgctactacccgagcccagct

SEQ ID NO: 850068 - DNA, 20 bp, Homo sapiens
tgctactgattgtttcattg

SEQ ID NO: 850069 - DNA, 18 bp, Homo sapiens
tgctactgcccctctccg

SEQ ID NO: 850070 - DNA, 19 bp, Homo sapiens
tgctactgcccctctccga

SEQ ID NO: 850071 - DNA, 22 bp, Homo sapiens
tgctactgtctcactgaaacat

SEQ ID NO: 850072 - DNA, 22 bp, Homo sapiens
tgctacttaattcctttctcat

SEQ ID NO: 850073 - DNA, 15 bp, Homo sapiens
tgctacttatcattt

SEQ ID NO: 850074 - DNA, 14 bp, Homo sapiens
tgctagaaattttc

SEQ ID NO: 850075 - DNA, 19 bp, Homo sapiens
tgctagactctagacaaga

SEQ ID NO: 850076 - DNA, 16 bp, Homo sapiens
tgctagagcagacagg

SEQ ID NO: 850077 - DNA, 17 bp, Homo sapiens
tgctagaggttgcagca

SEQ ID NO: 850078 - DNA, 13 bp, Homo sapiens
tgctagattttaa

SEQ ID NO: 850079 - DNA, 19 bp, Homo sapiens
tgctagcaggccccctagg

SEQ ID NO: 850080 - DNA, 22 bp, Homo sapiens
tgctagcagtaaaagatgaagt

SEQ ID NO: 850081 - DNA, 21 bp, Homo sapiens
tgctagcctgttcttttacca

SEQ ID NO: 850082 - DNA, 15 bp, Homo sapiens
tgctagctgtagaaa

SEQ ID NO: 850083 - DNA, 16 bp, Homo sapiens
tgctagctgtagaaat

SEQ ID NO: 850084 - DNA, 17 bp, Homo sapiens
tgctaggcgagtgccag

SEQ ID NO: 850085 - DNA, 18 bp, Homo sapiens
tgctaggcgagtgccagg

SEQ ID NO: 850086 - DNA, 21 bp, Homo sapiens
tgctaggcgagtgccaggact

SEQ ID NO: 850087 - DNA, 16 bp, Homo sapiens
tgctagggagagggaa

SEQ ID NO: 850088 - DNA, 15 bp, Homo sapiens
tgctaggggatgagg

SEQ ID NO: 850089 - DNA, 21 bp, Homo sapiens
tgctagggttaggaggtcctt

SEQ ID NO: 850090 - DNA, 21 bp, Homo sapiens
tgctaggtgggccagcccctc

SEQ ID NO: 850091 - DNA, 22 bp, Homo sapiens
tgctagtctagtttcctttttg

SEQ ID NO: 850092 - DNA, 11 bp, Homo sapiens
tgctagtgtga

SEQ ID NO: 850093 - DNA, 16 bp, Homo sapiens
tgctagttagcgcccc

SEQ ID NO: 850094 - DNA, 21 bp, Homo sapiens
tgctagttttttgcttctctt

SEQ ID NO: 850095 - DNA, 17 bp, Homo sapiens
tgctataatctgttttt

SEQ ID NO: 850096 - DNA, 21 bp, Homo sapiens
tgctataatctgtttttacgt

SEQ ID NO: 850097 - DNA, 21 bp, Homo sapiens
tgctatagcctaagcggctgt

SEQ ID NO: 850098 - DNA, 20 bp, Homo sapiens
tgctataggctggagaagct

SEQ ID NO: 850099 - DNA, 12 bp, Homo sapiens
tgctatataatt

SEQ ID NO: 850100 - DNA, 23 bp, Homo sapiens
tgctatatttgtgatataggaat

SEQ ID NO: 850101 - DNA, 14 bp, Homo sapiens
tgctatcacatgtg

SEQ ID NO: 850102 - DNA, 17 bp, Homo sapiens
tgctatcgccctccttt

SEQ ID NO: 850103 - DNA, 21 bp, Homo sapiens
tgctatcgccctcctttccct

SEQ ID NO: 850104 - DNA, 23 bp, Homo sapiens
tgctatcgccctcctttccctta

SEQ ID NO: 850105 - DNA, 16 bp, Homo sapiens
tgctatctctgtgtgc

SEQ ID NO: 850106 - DNA, 20 bp, Homo sapiens
tgctatctctgtgtgcacaa

SEQ ID NO: 850107 - DNA, 20 bp, Homo sapiens
tgctatctggaggccttcca

SEQ ID NO: 850108 - DNA, 19 bp, Homo sapiens
tgctatgaaaatgagcatc

SEQ ID NO: 850109 - DNA, 13 bp, Homo sapiens
tgctatgaatgat

SEQ ID NO: 850110 - DNA, 22 bp, Homo sapiens
tgctatgcaaaaaattctttag

SEQ ID NO: 850111 - DNA, 16 bp, Homo sapiens
tgctatgcattttctt

SEQ ID NO: 850112 - DNA, 18 bp, Homo sapiens
tgctatgcattttcttca

SEQ ID NO: 850113 - DNA, 16 bp, Homo sapiens
tgctatggatggcttc

SEQ ID NO: 850114 - DNA, 21 bp, Homo sapiens
tgctatgtcccaagagccata

SEQ ID NO: 850115 - DNA, 16 bp, Homo sapiens
tgctatgttactattt

SEQ ID NO: 850116 - DNA, 16 bp, Homo sapiens
tgctatgttctgtctt

SEQ ID NO: 850117 - DNA, 19 bp, Homo sapiens
tgctatgttctgtcttccc

SEQ ID NO: 850118 - DNA, 22 bp, Homo sapiens
tgctatgttctgtcttcccaaa

SEQ ID NO: 850119 - DNA, 13 bp, Homo sapiens
tgctatgttgccc

SEQ ID NO: 850120 - DNA, 20 bp, Homo sapiens
tgctatgttgcccaagctgg

SEQ ID NO: 850121 - DNA, 12 bp, Homo sapiens
tgctattaatat

SEQ ID NO: 850122 - DNA, 13 bp, Homo sapiens
tgctattaatatt

SEQ ID NO: 850123 - DNA, 21 bp, Homo sapiens
tgctattatgtaacatccaga

SEQ ID NO: 850124 - DNA, 13 bp, Homo sapiens
tgctattctgtgt

SEQ ID NO: 850125 - DNA, 21 bp, Homo sapiens
tgctattctgtgttgaacaca

SEQ ID NO: 850126 - DNA, 13 bp, Homo sapiens
tgctattgacaat

SEQ ID NO: 850127 - DNA, 20 bp, Homo sapiens
tgctattgacaataaaatat

SEQ ID NO: 850128 - DNA, 16 bp, Homo sapiens
tgctattgtaaggtct

SEQ ID NO: 850129 - DNA, 20 bp, Homo sapiens
tgctattgtaaggtctttgt

SEQ ID NO: 850130 - DNA, 12 bp, Homo sapiens
tgctatttatgc

SEQ ID NO: 850131 - DNA, 13 bp, Homo sapiens
tgctatttatgca

SEQ ID NO: 850132 - DNA, 19 bp, Homo sapiens
tgctatttattttcctaaa

SEQ ID NO: 850133 - DNA, 18 bp, Homo sapiens
tgctatttcaataacaga

SEQ ID NO: 850134 - DNA, 19 bp, Homo sapiens
tgctatttcaataacagat

SEQ ID NO: 850135 - DNA, 20 bp, Homo sapiens
tgctatttgaacaagtgggc

SEQ ID NO: 850136 - DNA, 16 bp, Homo sapiens
tgctatttgaagaaaa

SEQ ID NO: 850137 - DNA, 13 bp, Homo sapiens
tgctatttgaagt

SEQ ID NO: 850138 - DNA, 15 bp, Homo sapiens
tgctcaaaaagaaat

SEQ ID NO: 850139 - DNA, 15 bp, Homo sapiens
tgctcaacccccctc

SEQ ID NO: 850140 - DNA, 19 bp, Homo sapiens
tgctcaacccccctcccag

SEQ ID NO: 850141 - DNA, 22 bp, Homo sapiens
tgctcaactaattttatttcta

SEQ ID NO: 850142 - DNA, 23 bp, Homo sapiens
tgctcaactctacccctgctccc

SEQ ID NO: 850143 - DNA, 14 bp, Homo sapiens
tgctcaagaagaca

SEQ ID NO: 850144 - DNA, 14 bp, Homo sapiens
tgctcaatttcagc

SEQ ID NO: 850145 - DNA, 15 bp, Homo sapiens
tgctcaatttcagca

SEQ ID NO: 850146 - DNA, 15 bp, Homo sapiens
tgctcacaccccatt

SEQ ID NO: 850147 - DNA, 20 bp, Homo sapiens
tgctcacagggatgctggtg

SEQ ID NO: 850148 - DNA, 21 bp, Homo sapiens
tgctcacagggatgctggtgg

SEQ ID NO: 850149 - DNA, 14 bp, Homo sapiens
tgctcacatgtctt

SEQ ID NO: 850150 - DNA, 15 bp, Homo sapiens
tgctcacatgtcttt

SEQ ID NO: 850151 - DNA, 23 bp, Homo sapiens
tgctcaccgcccatcagggttct

SEQ ID NO: 850152 - DNA, 20 bp, Homo sapiens
tgctcacgactcttcctgca

SEQ ID NO: 850153 - DNA, 22 bp, Homo sapiens
tgctcacggaccccatgttgga

SEQ ID NO: 850154 - DNA, 23 bp, Homo sapiens
tgctcactcactcactccaagac

SEQ ID NO: 850155 - DNA, 24 bp, Homo sapiens
tgctcactcactcactccaagacc

SEQ ID NO: 850156 - DNA, 16 bp, Homo sapiens
tgctcagaacttgctg

SEQ ID NO: 850157 - DNA, 20 bp, Homo sapiens
tgctcagaacttgctgctgt

SEQ ID NO: 850158 - DNA, 22 bp, Homo sapiens
tgctcagaacttgctgctgtct

SEQ ID NO: 850159 - DNA, 16 bp, Homo sapiens
tgctcagaagaggaaa

SEQ ID NO: 850160 - DNA, 14 bp, Homo sapiens
tgctcagaccagct

SEQ ID NO: 850161 - DNA, 16 bp, Homo sapiens
tgctcagaccagctct

SEQ ID NO: 850162 - DNA, 14 bp, Homo sapiens
tgctcagagaagga

SEQ ID NO: 850163 - DNA, 21 bp, Homo sapiens
tgctcagcaattcagacccct

SEQ ID NO: 850164 - DNA, 19 bp, Homo sapiens
tgctcagcacactctcctg

SEQ ID NO: 850165 - DNA, 16 bp, Homo sapiens
tgctcagcagccagtc

SEQ ID NO: 850166 - DNA, 17 bp, Homo sapiens
tgctcagcagccagtct

SEQ ID NO: 850167 - DNA, 19 bp, Homo sapiens
tgctcagcagccagtctca

SEQ ID NO: 850168 - DNA, 20 bp, Homo sapiens
tgctcagcagccagtctcag

SEQ ID NO: 850169 - DNA, 23 bp, Homo sapiens
tgctcagcagccagtctcagaga

SEQ ID NO: 850170 - DNA, 17 bp, Homo sapiens
tgctcagccaaatttcc

SEQ ID NO: 850171 - DNA, 13 bp, Homo sapiens
tgctcagccctga

SEQ ID NO: 850172 - DNA, 12 bp, Homo sapiens
tgctcaggcctc

SEQ ID NO: 850173 - DNA, 13 bp, Homo sapiens
tgctcaggcctcc

SEQ ID NO: 850174 - DNA, 18 bp, Homo sapiens
tgctcaggctgcagctgg

SEQ ID NO: 850175 - DNA, 19 bp, Homo sapiens
tgctcaggcttgaaatgca

SEQ ID NO: 850176 - DNA, 19 bp, Homo sapiens
tgctcagggaaaagcagct

SEQ ID NO: 850177 - DNA, 16 bp, Homo sapiens
tgctcagggtcactga

SEQ ID NO: 850178 - DNA, 17 bp, Homo sapiens
tgctcagggtcactgaa

SEQ ID NO: 850179 - DNA, 18 bp, Homo sapiens
tgctcagggtcactgaac

SEQ ID NO: 850180 - DNA, 12 bp, Homo sapiens
tgctcagtgcct

SEQ ID NO: 850181 - DNA, 21 bp, Homo sapiens
tgctcagtgcttgggctccac

SEQ ID NO: 850182 - DNA, 20 bp, Homo sapiens
tgctcagtgtccagcttcca

SEQ ID NO: 850183 - DNA, 23 bp, Homo sapiens
tgctcagtgtccagcttccaaag

SEQ ID NO: 850184 - DNA, 22 bp, Homo sapiens
tgctcatacacagttaaataaa

SEQ ID NO: 850185 - DNA, 22 bp, Homo sapiens
tgctcatattgtgattctgcct

SEQ ID NO: 850186 - DNA, 23 bp, Homo sapiens
tgctcatcattctctgtctcatc

SEQ ID NO: 850187 - DNA, 17 bp, Homo sapiens
tgctcatccactctact

SEQ ID NO: 850188 - DNA, 14 bp, Homo sapiens
tgctcatctgctgg

SEQ ID NO: 850189 - DNA, 16 bp, Homo sapiens
tgctcatctgctggtc

SEQ ID NO: 850190 - DNA, 16 bp, Homo sapiens
tgctcatgggaagaac

SEQ ID NO: 850191 - DNA, 16 bp, Homo sapiens
tgctcatgggtggctg

SEQ ID NO: 850192 - DNA, 16 bp, Homo sapiens
tgctcattaaactgat

SEQ ID NO: 850193 - DNA, 22 bp, Homo sapiens
tgctcattacagttctttcctc

SEQ ID NO: 850194 - DNA, 14 bp, Homo sapiens
tgctccaaatttaa

SEQ ID NO: 850195 - DNA, 17 bp, Homo sapiens
tgctccaagatgttctc

SEQ ID NO: 850196 - DNA, 19 bp, Homo sapiens
tgctccaagatgttctcct

SEQ ID NO: 850197 - DNA, 21 bp, Homo sapiens
tgctccaagatgttctcctga

SEQ ID NO: 850198 - DNA, 16 bp, Homo sapiens
tgctccaagggacagg

SEQ ID NO: 850199 - DNA, 20 bp, Homo sapiens
tgctccaagggacaggtggg

SEQ ID NO: 850200 - DNA, 15 bp, Homo sapiens
tgctccaccagcagc

SEQ ID NO: 850201 - DNA, 18 bp, Homo sapiens
tgctccaccagcagcatg

SEQ ID NO: 850202 - DNA, 16 bp, Homo sapiens
tgctccacccttggcc

SEQ ID NO: 850203 - DNA, 18 bp, Homo sapiens
tgctccacccttggcctg

SEQ ID NO: 850204 - DNA, 19 bp, Homo sapiens
tgctccacccttggcctgt

SEQ ID NO: 850205 - DNA, 22 bp, Homo sapiens
tgctccacccttggcctgtctc

SEQ ID NO: 850206 - DNA, 20 bp, Homo sapiens
tgctccagaagatgccagct

SEQ ID NO: 850207 - DNA, 14 bp, Homo sapiens
tgctccagaatttg

SEQ ID NO: 850208 - DNA, 19 bp, Homo sapiens
tgctccagaatttggaaat

SEQ ID NO: 850209 - DNA, 20 bp, Homo sapiens
tgctccagaatttggaaatc

SEQ ID NO: 850210 - DNA, 22 bp, Homo sapiens
tgctccagataactctctttcc

SEQ ID NO: 850211 - DNA, 15 bp, Homo sapiens
tgctccagccaaccc

SEQ ID NO: 850212 - DNA, 13 bp, Homo sapiens
tgctccagcctgg

SEQ ID NO: 850213 - DNA, 21 bp, Homo sapiens
tgctccagctgttcagctggt

SEQ ID NO: 850214 - DNA, 16 bp, Homo sapiens
tgctccaggcctgcag

SEQ ID NO: 850215 - DNA, 18 bp, Homo sapiens
tgctccaggcctgcagca

SEQ ID NO: 850216 - DNA, 19 bp, Homo sapiens
tgctccagggatgattcaa

SEQ ID NO: 850217 - DNA, 15 bp, Homo sapiens
tgctccagggcagcc

SEQ ID NO: 850218 - DNA, 23 bp, Homo sapiens
tgctccatagacatcagtattct

SEQ ID NO: 850219 - DNA, 20 bp, Homo sapiens
tgctccatttttaaccactt

SEQ ID NO: 850220 - DNA, 22 bp, Homo sapiens
tgctcccacacttgtgccagcc

SEQ ID NO: 850221 - DNA, 13 bp, Homo sapiens
tgctcccacccca

SEQ ID NO: 850222 - DNA, 15 bp, Homo sapiens
tgctcccaccccaga

SEQ ID NO: 850223 - DNA, 20 bp, Homo sapiens
tgctcccaccccagaaatca

SEQ ID NO: 850224 - DNA, 21 bp, Homo sapiens
tgctcccagatgccttctaga

SEQ ID NO: 850225 - DNA, 13 bp, Homo sapiens
tgctcccagcagc

SEQ ID NO: 850226 - DNA, 22 bp, Homo sapiens
tgctcccagcctgctgagagcc

SEQ ID NO: 850227 - DNA, 19 bp, Homo sapiens
tgctcccatcctcacccag

SEQ ID NO: 850228 - DNA, 18 bp, Homo sapiens
tgctccccaacacctgcc

SEQ ID NO: 850229 - DNA, 11 bp, Homo sapiens
tgctccccaca

SEQ ID NO: 850230 - DNA, 17 bp, Homo sapiens
tgctccccagccctggc

SEQ ID NO: 850231 - DNA, 14 bp, Homo sapiens
tgctcccccacccc

SEQ ID NO: 850232 - DNA, 15 bp, Homo sapiens
tgctcccccatcctc

SEQ ID NO: 850233 - DNA, 21 bp, Homo sapiens
tgctcccccatcctccccttc

SEQ ID NO: 850234 - DNA, 22 bp, Homo sapiens
tgctcccccatcctccccttcc

SEQ ID NO: 850235 - DNA, 23 bp, Homo sapiens
tgctcccctgccacactgatggc

SEQ ID NO: 850236 - DNA, 15 bp, Homo sapiens
tgctcccctttgggg

SEQ ID NO: 850237 - DNA, 20 bp, Homo sapiens
tgctcccggcccgcctgccc

SEQ ID NO: 850238 - DNA, 19 bp, Homo sapiens
tgctccctaagccagcctg

SEQ ID NO: 850239 - DNA, 15 bp, Homo sapiens
tgctccctcccctgc

SEQ ID NO: 850240 - DNA, 22 bp, Homo sapiens
tgctccctggggttctctacag

SEQ ID NO: 850241 - DNA, 22 bp, Homo sapiens
tgctcccttttacattctgtgt

SEQ ID NO: 850242 - DNA, 20 bp, Homo sapiens
tgctccgaggacccaggaaa

SEQ ID NO: 850243 - DNA, 19 bp, Homo sapiens
tgctccgaggactggactg

SEQ ID NO: 850244 - DNA, 20 bp, Homo sapiens
tgctccgaggactggactgt

SEQ ID NO: 850245 - DNA, 15 bp, Homo sapiens
tgctccgccaggaaa

SEQ ID NO: 850246 - DNA, 15 bp, Homo sapiens
tgctccgccatggtg

SEQ ID NO: 850247 - DNA, 15 bp, Homo sapiens
tgctccgctcccacc

SEQ ID NO: 850248 - DNA, 17 bp, Homo sapiens
tgctccgctcccaccgc

SEQ ID NO: 850249 - DNA, 23 bp, Homo sapiens
tgctccgctgctccttggcttac

SEQ ID NO: 850250 - DNA, 14 bp, Homo sapiens
tgctccgtgcctcc

SEQ ID NO: 850251 - DNA, 16 bp, Homo sapiens
tgctccgtgcctccac

SEQ ID NO: 850252 - DNA, 19 bp, Homo sapiens
tgctccgttggtcagcgtt

SEQ ID NO: 850253 - DNA, 18 bp, Homo sapiens
tgctcctacatccagctc

SEQ ID NO: 850254 - DNA, 17 bp, Homo sapiens
tgctcctcactggagga

SEQ ID NO: 850255 - DNA, 23 bp, Homo sapiens
tgctcctcactggaggagcagct

SEQ ID NO: 850256 - DNA, 14 bp, Homo sapiens
tgctcctccagccc

SEQ ID NO: 850257 - DNA, 12 bp, Homo sapiens
tgctcctccagg

SEQ ID NO: 850258 - DNA, 16 bp, Homo sapiens
tgctcctccagggcca

SEQ ID NO: 850259 - DNA, 18 bp, Homo sapiens
tgctcctcccacttctca

SEQ ID NO: 850260 - DNA, 16 bp, Homo sapiens
tgctcctccctgcccc

SEQ ID NO: 850261 - DNA, 19 bp, Homo sapiens
tgctcctccctgcccccca

SEQ ID NO: 850262 - DNA, 13 bp, Homo sapiens
tgctcctccctgg

SEQ ID NO: 850263 - DNA, 14 bp, Homo sapiens
tgctgccagggctt

SEQ ID NO: 850264 - DNA, 17 bp, Homo sapiens
tgctgccagtgcagcca

SEQ ID NO: 850265 - DNA, 13 bp, Homo sapiens
tgctgccatgcca

SEQ ID NO: 850266 - DNA, 20 bp, Homo sapiens
tgctgccatgccactgccag

SEQ ID NO: 850267 - DNA, 21 bp, Homo sapiens
tgctgccatgccactgccagg

SEQ ID NO: 850268 - DNA, 22 bp, Homo sapiens
tgctgccatgccactgccaggc

SEQ ID NO: 850269 - DNA, 15 bp, Homo sapiens
tgctgccccagctga

SEQ ID NO: 850270 - DNA, 20 bp, Homo sapiens
tgctgcccccttccccagcc

SEQ ID NO: 850271 - DNA, 14 bp, Homo sapiens
tgctgcccctgtct

SEQ ID NO: 850272 - DNA, 20 bp, Homo sapiens
tgctgcccctgtctggaaga

SEQ ID NO: 850273 - DNA, 19 bp, Homo sapiens
tgctgccccttgcaagcca

SEQ ID NO: 850274 - DNA, 21 bp, Homo sapiens
tgctgccccttgcaagccata

SEQ ID NO: 850275 - DNA, 17 bp, Homo sapiens
tgctgcccgtcttcagc

SEQ ID NO: 850276 - DNA, 13 bp, Homo sapiens
tgctgccctccat

SEQ ID NO: 850277 - DNA, 14 bp, Homo sapiens
tgctgccctgcccc

SEQ ID NO: 850278 - DNA, 20 bp, Homo sapiens
tgctgcctaggttctgttac

SEQ ID NO: 850279 - DNA, 19 bp, Homo sapiens
tgctgcctccccaaccctg

SEQ ID NO: 850280 - DNA, 13 bp, Homo sapiens
tgctgcctctgtg

SEQ ID NO: 850281 - DNA, 16 bp, Homo sapiens
tgctgcctctgtggaa

SEQ ID NO: 850282 - DNA, 19 bp, Homo sapiens
tgctgcctctttccctagg

SEQ ID NO: 850283 - DNA, 13 bp, Homo sapiens
tgctgcctgcctg

SEQ ID NO: 850284 - DNA, 15 bp, Homo sapiens
tgctgcctgcctgtc

SEQ ID NO: 850285 - DNA, 16 bp, Homo sapiens
tgctgcctgctgagat

SEQ ID NO: 850286 - DNA, 14 bp, Homo sapiens
tgctgcctggccac

SEQ ID NO: 850287 - DNA, 14 bp, Homo sapiens
tgctgccttcaggg

SEQ ID NO: 850288 - DNA, 16 bp, Homo sapiens
tgctgccttcagggag

SEQ ID NO: 850289 - DNA, 22 bp, Homo sapiens
tgctgccttcagggagacaggc

SEQ ID NO: 850290 - DNA, 21 bp, Homo sapiens
tgctgcctttattagggtact

SEQ ID NO: 850291 - DNA, 12 bp, Homo sapiens
tgctgccttttc

SEQ ID NO: 850292 - DNA, 14 bp, Homo sapiens
tgctgccttttctg

SEQ ID NO: 850293 - DNA, 15 bp, Homo sapiens
tgctgccttttctgg

SEQ ID NO: 850294 - DNA, 16 bp, Homo sapiens
tgctgcgcccttacct

SEQ ID NO: 850295 - DNA, 20 bp, Homo sapiens
tgctgcgcccttaccttccc

SEQ ID NO: 850296 - DNA, 22 bp, Homo sapiens
tgctgctaattcccaacatttc

SEQ ID NO: 850297 - DNA, 15 bp, Homo sapiens
tgctgctaccagcgc

SEQ ID NO: 850298 - DNA, 16 bp, Homo sapiens
tgctgctaccagcgcc

SEQ ID NO: 850299 - DNA, 16 bp, Homo sapiens
tgctgctaccgccctg

SEQ ID NO: 850300 - DNA, 18 bp, Homo sapiens
tgctgctaccgccctggg

SEQ ID NO: 850301 - DNA, 13 bp, Homo sapiens
tgctgctactacc

SEQ ID NO: 850302 - DNA, 16 bp, Homo sapiens
tgctgctattgctgtc

SEQ ID NO: 850303 - DNA, 13 bp, Homo sapiens
tgctgctcctctt

SEQ ID NO: 850304 - DNA, 12 bp, Homo sapiens
tgctgctcctgt

SEQ ID NO: 850305 - DNA, 17 bp, Homo sapiens
tgctgctctagggcagg

SEQ ID NO: 850306 - DNA, 14 bp, Homo sapiens
tgctgctctcagcc

SEQ ID NO: 850307 - DNA, 13 bp, Homo sapiens
tgctgctctcagg

SEQ ID NO: 850308 - DNA, 13 bp, Homo sapiens
tgctgctctgacc

SEQ ID NO: 850309 - DNA, 13 bp, Homo sapiens
tgctgctgaagag

SEQ ID NO: 850310 - DNA, 11 bp, Homo sapiens
tgctgctgccc

SEQ ID NO: 850311 - DNA, 14 bp, Homo sapiens
tgctgctgccccag

SEQ ID NO: 850312 - DNA, 13 bp, Homo sapiens
tgctgctgctctc

SEQ ID NO: 850313 - DNA, 17 bp, Homo sapiens
tgctgctgctgccccag

SEQ ID NO: 850314 - DNA, 13 bp, Homo sapiens
tgctgctggccaa

SEQ ID NO: 850315 - DNA, 14 bp, Homo sapiens
tgctgctggccaaa

SEQ ID NO: 850316 - DNA, 18 bp, Homo sapiens
tgctgctgtaactgctga

SEQ ID NO: 850317 - DNA, 22 bp, Homo sapiens
tgctgctgtaactgctgagcca

SEQ ID NO: 850318 - DNA, 12 bp, Homo sapiens
tgctgctgtgaa

SEQ ID NO: 850319 - DNA, 14 bp, Homo sapiens
tgctgctgtgaatt

SEQ ID NO: 850320 - DNA, 14 bp, Homo sapiens
tgctgctgtgcctg

SEQ ID NO: 850321 - DNA, 14 bp, Homo sapiens
tgctgcttctcttg

SEQ ID NO: 850322 - DNA, 21 bp, Homo sapiens
tgctgcttctgaatacaaatt

SEQ ID NO: 850323 - DNA, 17 bp, Homo sapiens
tgctgcttctgctccag

SEQ ID NO: 850324 - DNA, 21 bp, Homo sapiens
tgctgcttctgctccagcccc

SEQ ID NO: 850325 - DNA, 14 bp, Homo sapiens
tgctgcttggattt

SEQ ID NO: 850326 - DNA, 16 bp, Homo sapiens
tgctgctttcccctgt

SEQ ID NO: 850327 - DNA, 18 bp, Homo sapiens
tgctgctttcccctgtgg

SEQ ID NO: 850328 - DNA, 21 bp, Homo sapiens
tgctgctttgcttttcatcac

SEQ ID NO: 850329 - DNA, 15 bp, Homo sapiens
tgctgctttgtccag

SEQ ID NO: 850330 - DNA, 17 bp, Homo sapiens
tgctgctttgtccaggt

SEQ ID NO: 850331 - DNA, 22 bp, Homo sapiens
tgctggaacccaggaggtggag

SEQ ID NO: 850332 - DNA, 17 bp, Homo sapiens
tgctggaagaaactaaa

SEQ ID NO: 850333 - DNA, 18 bp, Homo sapiens
tgctggaagaaactaaaa

SEQ ID NO: 850334 - DNA, 14 bp, Homo sapiens
tgctggaagaggtg

SEQ ID NO: 850335 - DNA, 11 bp, Homo sapiens
tgctggaagtc

SEQ ID NO: 850336 - DNA, 19 bp, Homo sapiens
tgctggaagtctccatgaa

SEQ ID NO: 850337 - DNA, 20 bp, Homo sapiens
tgctggaagtctccatgaag

SEQ ID NO: 850338 - DNA, 17 bp, Homo sapiens
tgctggaataagttcaa

SEQ ID NO: 850339 - DNA, 15 bp, Homo sapiens
tgctggaccagctgg

SEQ ID NO: 850340 - DNA, 19 bp, Homo sapiens
tgctggaccagctggcctg

SEQ ID NO: 850341 - DNA, 11 bp, Homo sapiens
tgctggactgt

SEQ ID NO: 850342 - DNA, 17 bp, Homo sapiens
tgctggactgttccagg

SEQ ID NO: 850343 - DNA, 21 bp, Homo sapiens
tgctggactttaaaaaaacaa

SEQ ID NO: 850344 - DNA, 12 bp, Homo sapiens
tgctggagaggt

SEQ ID NO: 850345 - DNA, 14 bp, Homo sapiens
tgctggagaggtta

SEQ ID NO: 850346 - DNA, 18 bp, Homo sapiens
tgctggaggaggggaagc

SEQ ID NO: 850347 - DNA, 11 bp, Homo sapiens
tgctggagggg

SEQ ID NO: 850348 - DNA, 15 bp, Homo sapiens
tgctggaggggctgt

SEQ ID NO: 850349 - DNA, 17 bp, Homo sapiens
tgctggaggggctgtcc

SEQ ID NO: 850350 - DNA, 19 bp, Homo sapiens
tgctggaggggctgtcctc

SEQ ID NO: 850351 - DNA, 17 bp, Homo sapiens
tgctggagtctccagat

SEQ ID NO: 850352 - DNA, 18 bp, Homo sapiens
tgctggagtctcctgagg

SEQ ID NO: 850353 - DNA, 19 bp, Homo sapiens
tgctggagtgcagtggcac

SEQ ID NO: 850354 - DNA, 21 bp, Homo sapiens
tgctggagtgcagtggcacaa

SEQ ID NO: 850355 - DNA, 20 bp, Homo sapiens
tgctggagtttcatgtacaa

SEQ ID NO: 850356 - DNA, 18 bp, Homo sapiens
tgctggatactggacaca

SEQ ID NO: 850357 - DNA, 16 bp, Homo sapiens
tgctggatattttcaa

SEQ ID NO: 850358 - DNA, 16 bp, Homo sapiens
tgctggcagggccagg

SEQ ID NO: 850359 - DNA, 23 bp, Homo sapiens
tgctggcatcaggtctgggcaag

SEQ ID NO: 850360 - DNA, 19 bp, Homo sapiens
tgctggccagcaccctctc

SEQ ID NO: 850361 - DNA, 21 bp, Homo sapiens
tgctggccatgaatctctgcc

SEQ ID NO: 850362 - DNA, 21 bp, Homo sapiens
tgctggccccagccctgctgg

SEQ ID NO: 850363 - DNA, 13 bp, Homo sapiens
tgctggcccccag

SEQ ID NO: 850364 - DNA, 20 bp, Homo sapiens
tgctggcccctcacctgggc

SEQ ID NO: 850365 - DNA, 19 bp, Homo sapiens
tgctggcctgactggttgt

SEQ ID NO: 850366 - DNA, 12 bp, Homo sapiens
tgctggcctgga

SEQ ID NO: 850367 - DNA, 16 bp, Homo sapiens
tgctggcctggatctc

SEQ ID NO: 850368 - DNA, 18 bp, Homo sapiens
tgctggcctggatctccc

SEQ ID NO: 850369 - DNA, 21 bp, Homo sapiens
tgctggccttggtatgtgcca

SEQ ID NO: 850370 - DNA, 22 bp, Homo sapiens
tgctggccttggtatgtgccag

SEQ ID NO: 850371 - DNA, 17 bp, Homo sapiens
tgctggcgacactcagg

SEQ ID NO: 850372 - DNA, 19 bp, Homo sapiens
tgctggcgacactcagggc

SEQ ID NO: 850373 - DNA, 23 bp, Homo sapiens
tgctggcgacactcagggcagct

SEQ ID NO: 850374 - DNA, 17 bp, Homo sapiens
tgctggcggcgcagagg

SEQ ID NO: 850375 - DNA, 20 bp, Homo sapiens
tgctggctcacgccccgctg

SEQ ID NO: 850376 - DNA, 17 bp, Homo sapiens
tgctggctctgagaatc

SEQ ID NO: 850377 - DNA, 13 bp, Homo sapiens
tgctggctgccca

SEQ ID NO: 850378 - DNA, 21 bp, Homo sapiens
tgctggctgccttagaacctt

SEQ ID NO: 850379 - DNA, 20 bp, Homo sapiens
tgctgggaaccccgcagccc

SEQ ID NO: 850380 - DNA, 17 bp, Homo sapiens
tgctgggactgagccag

SEQ ID NO: 850381 - DNA, 14 bp, Homo sapiens
tgctgggagcagaa

SEQ ID NO: 850382 - DNA, 17 bp, Homo sapiens
tgctgggagctccactc

SEQ ID NO: 850383 - DNA, 23 bp, Homo sapiens
tgctgggagctccactctgcttc

SEQ ID NO: 850384 - DNA, 18 bp, Homo sapiens
tgctgggattacaggtgt

SEQ ID NO: 850385 - DNA, 11 bp, Homo sapiens
tgctgggcagc

SEQ ID NO: 850386 - DNA, 14 bp, Homo sapiens
tgcttttcagctga

SEQ ID NO: 850387 - DNA, 23 bp, Homo sapiens
tgcttttcatgtagaactcagca

SEQ ID NO: 850388 - DNA, 18 bp, Homo sapiens
tgcttttcattagcagtt

SEQ ID NO: 850389 - DNA, 13 bp, Homo sapiens
tgcttttccagga

SEQ ID NO: 850390 - DNA, 22 bp, Homo sapiens
tgcttttccaggatcctgcagg

SEQ ID NO: 850391 - DNA, 17 bp, Homo sapiens
tgcttttcctcaagcaa

SEQ ID NO: 850392 - DNA, 12 bp, Homo sapiens
tgcttttctcca

SEQ ID NO: 850393 - DNA, 15 bp, Homo sapiens
tgcttttctgccctg

SEQ ID NO: 850394 - DNA, 17 bp, Homo sapiens
tgcttttctgtcctggg

SEQ ID NO: 850395 - DNA, 17 bp, Homo sapiens
tgcttttgatgatgtct

SEQ ID NO: 850396 - DNA, 20 bp, Homo sapiens
tgcttttgatgtgaaaatca

SEQ ID NO: 850397 - DNA, 21 bp, Homo sapiens
tgcttttgccactttggcttc

SEQ ID NO: 850398 - DNA, 12 bp, Homo sapiens
tgcttttgccca

SEQ ID NO: 850399 - DNA, 18 bp, Homo sapiens
tgcttttgcccattttga

SEQ ID NO: 850400 - DNA, 16 bp, Homo sapiens
tgcttttgctgctgct

SEQ ID NO: 850401 - DNA, 17 bp, Homo sapiens
tgcttttgctgctgctt

SEQ ID NO: 850402 - DNA, 18 bp, Homo sapiens
tgcttttgctgctgctta

SEQ ID NO: 850403 - DNA, 14 bp, Homo sapiens
tgcttttgcttcta

SEQ ID NO: 850404 - DNA, 21 bp, Homo sapiens
tgcttttggcaaaactctact

SEQ ID NO: 850405 - DNA, 19 bp, Homo sapiens
tgcttttgtatatcctata

SEQ ID NO: 850406 - DNA, 13 bp, Homo sapiens
tgcttttgttttt

SEQ ID NO: 850407 - DNA, 23 bp, Homo sapiens
tgctttttaaagagattatttgt

SEQ ID NO: 850408 - DNA, 16 bp, Homo sapiens
tgctttttagaaagca

SEQ ID NO: 850409 - DNA, 15 bp, Homo sapiens
tgctttttatttctg

SEQ ID NO: 850410 - DNA, 15 bp, Homo sapiens
tgctttttcaccaga

SEQ ID NO: 850411 - DNA, 14 bp, Homo sapiens
tgctttttccaact

SEQ ID NO: 850412 - DNA, 13 bp, Homo sapiens
tgctttttctaat

SEQ ID NO: 850413 - DNA, 17 bp, Homo sapiens
tgctttttgagtttcat

SEQ ID NO: 850414 - DNA, 20 bp, Homo sapiens
tgctttttgagtttcatgtt

SEQ ID NO: 850415 - DNA, 15 bp, Homo sapiens
tgctttttggcacag

SEQ ID NO: 850416 - DNA, 16 bp, Homo sapiens
tgctttttgtgttttt

SEQ ID NO: 850417 - DNA, 23 bp, Homo sapiens
tgcttttttaaccaaggaggggc

SEQ ID NO: 850418 - DNA, 20 bp, Homo sapiens
tgcttttttccaaaacaaaa

SEQ ID NO: 850419 - DNA, 13 bp, Homo sapiens
tgcttttttgtat

SEQ ID NO: 850420 - DNA, 17 bp, Homo sapiens
tgcttttttgttttggc

SEQ ID NO: 850421 - DNA, 14 bp, Homo sapiens
tgcttttttttcct

SEQ ID NO: 850422 - DNA, 17 bp, Homo sapiens
tgcttttttttccttct

SEQ ID NO: 850423 - DNA, 20 bp, Homo sapiens
tggaaaaaaacataaaaagc

SEQ ID NO: 850424 - DNA, 15 bp, Homo sapiens
tggaaaaaactctga

SEQ ID NO: 850425 - DNA, 22 bp, Homo sapiens
tggaaaaaactctgaaggagag

SEQ ID NO: 850426 - DNA, 16 bp, Homo sapiens
tggaaaaacagcatgt

SEQ ID NO: 850427 - DNA, 20 bp, Homo sapiens
tggaaaaatagcctgcctct

SEQ ID NO: 850428 - DNA, 18 bp, Homo sapiens
tggaaaaatccagaaaga

SEQ ID NO: 850429 - DNA, 19 bp, Homo sapiens
tggaaaaatccagaaagaa

SEQ ID NO: 850430 - DNA, 16 bp, Homo sapiens
tggaaaaattccagaa

SEQ ID NO: 850431 - DNA, 21 bp, Homo sapiens
tggaaaacaaagccaaacaaa

SEQ ID NO: 850432 - DNA, 23 bp, Homo sapiens
tggaaaacaaagccaaacaaaac

SEQ ID NO: 850433 - DNA, 19 bp, Homo sapiens
tggaaaacagaacacttat

SEQ ID NO: 850434 - DNA, 14 bp, Homo sapiens
tggaaaacagagta

SEQ ID NO: 850435 - DNA, 15 bp, Homo sapiens
tggaaaacagggtgc

SEQ ID NO: 850436 - DNA, 20 bp, Homo sapiens
tggaaaactgtgttgccaca

SEQ ID NO: 850437 - DNA, 12 bp, Homo sapiens
tggaaaagaaga

SEQ ID NO: 850438 - DNA, 16 bp, Homo sapiens
tggaaaagaagaaact

SEQ ID NO: 850439 - DNA, 18 bp, Homo sapiens
tggaaaagaagaaacttt

SEQ ID NO: 850440 - DNA, 21 bp, Homo sapiens
tggaaaagaagaaactttgcc

SEQ ID NO: 850441 - DNA, 14 bp, Homo sapiens
tggaaaagaataca

SEQ ID NO: 850442 - DNA, 19 bp, Homo sapiens
tggaaaagaatacagaaag

SEQ ID NO: 850443 - DNA, 22 bp, Homo sapiens
tggaaaagaatccctgcagcct

SEQ ID NO: 850444 - DNA, 16 bp, Homo sapiens
tggaaaagaggagttt

SEQ ID NO: 850445 - DNA, 18 bp, Homo sapiens
tggaaaagcaacttcatt

SEQ ID NO: 850446 - DNA, 19 bp, Homo sapiens
tggaaaagggtcttgggaa

SEQ ID NO: 850447 - DNA, 22 bp, Homo sapiens
tggaaaatagtttgcaacatat

SEQ ID NO: 850448 - DNA, 13 bp, Homo sapiens
tggaaaatgtata

SEQ ID NO: 850449 - DNA, 17 bp, Homo sapiens
tggaaaatgtcctgtgg

SEQ ID NO: 850450 - DNA, 15 bp, Homo sapiens
tggaaaattcatttt

SEQ ID NO: 850451 - DNA, 16 bp, Homo sapiens
tggaaaattttctcct

SEQ ID NO: 850452 - DNA, 20 bp, Homo sapiens
tggaaaattttctccttggt

SEQ ID NO: 850453 - DNA, 22 bp, Homo sapiens
tggaaacaagtgaccccagggc

SEQ ID NO: 850454 - DNA, 23 bp, Homo sapiens
tggaaacaagtgaccccagggcc

SEQ ID NO: 850455 - DNA, 15 bp, Homo sapiens
tggaaacagcatgaa

SEQ ID NO: 850456 - DNA, 18 bp, Homo sapiens
tggaaacagcatgaataa

SEQ ID NO: 850457 - DNA, 19 bp, Homo sapiens
tggaaacagcatgaataaa

SEQ ID NO: 850458 - DNA, 15 bp, Homo sapiens
tggaaacattttctt

SEQ ID NO: 850459 - DNA, 20 bp, Homo sapiens
tggaaaccacacttcttgaa

SEQ ID NO: 850460 - DNA, 17 bp, Homo sapiens
tggaaacctaactgcaa

SEQ ID NO: 850461 - DNA, 14 bp, Homo sapiens
tggaaacctgccct

SEQ ID NO: 850462 - DNA, 17 bp, Homo sapiens
tggaaacctgtcattgt

SEQ ID NO: 850463 - DNA, 14 bp, Homo sapiens
tggaaacgcactta

SEQ ID NO: 850464 - DNA, 14 bp, Homo sapiens
tggaaactgctaaa

SEQ ID NO: 850465 - DNA, 15 bp, Homo sapiens
tggaaactgctaaat

SEQ ID NO: 850466 - DNA, 16 bp, Homo sapiens
tggaaagaatctaata

SEQ ID NO: 850467 - DNA, 16 bp, Homo sapiens
tggaaagacaggaaga

SEQ ID NO: 850468 - DNA, 10 bp, Homo sapiens
tggaaagaga

SEQ ID NO: 850469 - DNA, 12 bp, Homo sapiens
tggaaagagacc

SEQ ID NO: 850470 - DNA, 17 bp, Homo sapiens
tggaaagaggctctgga

SEQ ID NO: 850471 - DNA, 21 bp, Homo sapiens
tggaaagcatcacctcaggcc

SEQ ID NO: 850472 - DNA, 17 bp, Homo sapiens
tggaaaggggagagcct

SEQ ID NO: 850473 - DNA, 23 bp, Homo sapiens
tggaaaggggagagcctgctggc

SEQ ID NO: 850474 - DNA, 19 bp, Homo sapiens
tggaaaggggggagctggg

SEQ ID NO: 850475 - DNA, 22 bp, Homo sapiens
tggaaaggtgtgagactgggaa

SEQ ID NO: 850476 - DNA, 19 bp, Homo sapiens
tggaaagtaactcatttgt

SEQ ID NO: 850477 - DNA, 12 bp, Homo sapiens
tggaaataaaaa

SEQ ID NO: 850478 - DNA, 13 bp, Homo sapiens
tggaaataaaaag

SEQ ID NO: 850479 - DNA, 15 bp, Homo sapiens
tggaaataaaaatgt

SEQ ID NO: 850480 - DNA, 14 bp, Homo sapiens
tggaaataaagtca

SEQ ID NO: 850481 - DNA, 16 bp, Homo sapiens
tggaaataaagtcaga

SEQ ID NO: 850482 - DNA, 23 bp, Homo sapiens
tggaaataaatgtatcatagaaa

SEQ ID NO: 850483 - DNA, 14 bp, Homo sapiens
tggaaatacacagt

SEQ ID NO: 850484 - DNA, 18 bp, Homo sapiens
tggaaatacagttgttgg

SEQ ID NO: 850485 - DNA, 14 bp, Homo sapiens
tggaaatagaaaga

SEQ ID NO: 850486 - DNA, 21 bp, Homo sapiens
tggaaatagaaagaagccata

SEQ ID NO: 850487 - DNA, 22 bp, Homo sapiens
tggaaatatcagttactcagcc

SEQ ID NO: 850488 - DNA, 20 bp, Homo sapiens
tggaaatcagccaagtttta

SEQ ID NO: 850489 - DNA, 15 bp, Homo sapiens
tggaaatcttttaca

SEQ ID NO: 850490 - DNA, 15 bp, Homo sapiens
tggaaatgctgggct

SEQ ID NO: 850491 - DNA, 16 bp, Homo sapiens
tggaaatgctgggctg

SEQ ID NO: 850492 - DNA, 20 bp, Homo sapiens
tggaaatgctgggctgacgg

SEQ ID NO: 850493 - DNA, 13 bp, Homo sapiens
tggaaatggtttc

SEQ ID NO: 850494 - DNA, 14 bp, Homo sapiens
tggaaatgtacttt

SEQ ID NO: 850495 - DNA, 16 bp, Homo sapiens
tggaaatgtacttttg

SEQ ID NO: 850496 - DNA, 19 bp, Homo sapiens
tggaaatgtgaatcgcagc

SEQ ID NO: 850497 - DNA, 14 bp, Homo sapiens
tggaaatgtgagaa

SEQ ID NO: 850498 - DNA, 15 bp, Homo sapiens
tggaaatgtgagaaa

SEQ ID NO: 850499 - DNA, 17 bp, Homo sapiens
tggaaatgtgagaaatg

SEQ ID NO: 850500 - DNA, 23 bp, Homo sapiens
tggaaatgtgagaaatgtctaat

SEQ ID NO: 850501 - DNA, 18 bp, Homo sapiens
tggaaattaagaagaaac

SEQ ID NO: 850502 - DNA, 17 bp, Homo sapiens
tggaaattggaagagca

SEQ ID NO: 850503 - DNA, 12 bp, Homo sapiens
tggaaatttaaa

SEQ ID NO: 850504 - DNA, 16 bp, Homo sapiens
tggaaatttaaagcag

SEQ ID NO: 850505 - DNA, 18 bp, Homo sapiens
tggaaatttagagttcta

SEQ ID NO: 850506 - DNA, 15 bp, Homo sapiens
tggaaatttttggtt

SEQ ID NO: 850507 - DNA, 20 bp, Homo sapiens
tggaacaacttgtagcagct

SEQ ID NO: 850508 - DNA, 18 bp, Homo sapiens
tggaccagctggcctggg

SEQ ID NO: 850509 - DNA, 14 bp, Homo sapiens
tggaccaggacagg

SEQ ID NO: 850510 - DNA, 18 bp, Homo sapiens
tggaccaggacaggacca

SEQ ID NO: 850511 - DNA, 19 bp, Homo sapiens
tggaccaggacaggaccag

SEQ ID NO: 850512 - DNA, 13 bp, Homo sapiens
tggaccaggcctg

SEQ ID NO: 850513 - DNA, 14 bp, Homo sapiens
tggaccaggcctgg

SEQ ID NO: 850514 - DNA, 21 bp, Homo sapiens
tggaccaggcctggagggcac

SEQ ID NO: 850515 - DNA, 15 bp, Homo sapiens
tggaccagtttgcag

SEQ ID NO: 850516 - DNA, 15 bp, Homo sapiens
tggaccatctctgta

SEQ ID NO: 850517 - DNA, 15 bp, Homo sapiens
tggaccattcctgtc

SEQ ID NO: 850518 - DNA, 22 bp, Homo sapiens
tggacccacgaacgctcttagc

SEQ ID NO: 850519 - DNA, 20 bp, Homo sapiens
tggacccagggatgacatgt

SEQ ID NO: 850520 - DNA, 16 bp, Homo sapiens
tggacccagggcctga

SEQ ID NO: 850521 - DNA, 24 bp, Homo sapiens
tggacccagggcctgacttgagcc

SEQ ID NO: 850522 - DNA, 15 bp, Homo sapiens
tggaccccactggct

SEQ ID NO: 850523 - DNA, 19 bp, Homo sapiens
tggaccccagctgggaggc

SEQ ID NO: 850524 - DNA, 20 bp, Homo sapiens
tggaccccatctgtgaataa

SEQ ID NO: 850525 - DNA, 15 bp, Homo sapiens
tggaccccctgcccg

SEQ ID NO: 850526 - DNA, 19 bp, Homo sapiens
tggacccctgaattcaatg

SEQ ID NO: 850527 - DNA, 13 bp, Homo sapiens
tggacccctggac

SEQ ID NO: 850528 - DNA, 15 bp, Homo sapiens
tggacccctggaccg

SEQ ID NO: 850529 - DNA, 13 bp, Homo sapiens
tggacccctgggg

SEQ ID NO: 850530 - DNA, 23 bp, Homo sapiens
tggacccctggggtggccagggc

SEQ ID NO: 850531 - DNA, 16 bp, Homo sapiens
tggacccgctctggac

SEQ ID NO: 850532 - DNA, 20 bp, Homo sapiens
tggaccctggtgacctcctg

SEQ ID NO: 850533 - DNA, 21 bp, Homo sapiens
tggaccctggtgacctcctgt

SEQ ID NO: 850534 - DNA, 18 bp, Homo sapiens
tggaccgaaatctgtatt

SEQ ID NO: 850535 - DNA, 21 bp, Homo sapiens
tggaccgagatgtgagtcctg

SEQ ID NO: 850536 - DNA, 18 bp, Homo sapiens
tggaccgggtgggcctgg

SEQ ID NO: 850537 - DNA, 20 bp, Homo sapiens
tggaccgggtgggcctggcc

SEQ ID NO: 850538 - DNA, 17 bp, Homo sapiens
tggacctaaatggcctc

SEQ ID NO: 850539 - DNA, 17 bp, Homo sapiens
tggacctagcctggatg

SEQ ID NO: 850540 - DNA, 13 bp, Homo sapiens
tggacctagcttg

SEQ ID NO: 850541 - DNA, 20 bp, Homo sapiens
tggacctatgcagggaggcc

SEQ ID NO: 850542 - DNA, 21 bp, Homo sapiens
tggacctcaggagggcaggct

SEQ ID NO: 850543 - DNA, 15 bp, Homo sapiens
tggacctccaggggc

SEQ ID NO: 850544 - DNA, 18 bp, Homo sapiens
tggacctccaggggctcc

SEQ ID NO: 850545 - DNA, 22 bp, Homo sapiens
tggacctccaggggctcctggg

SEQ ID NO: 850546 - DNA, 18 bp, Homo sapiens
tggacctccatccctgct

SEQ ID NO: 850547 - DNA, 13 bp, Homo sapiens
tggacctctgctc

SEQ ID NO: 850548 - DNA, 22 bp, Homo sapiens
tggacctgccccggacctacct

SEQ ID NO: 850549 - DNA, 16 bp, Homo sapiens
tggacctgcctcctgc

SEQ ID NO: 850550 - DNA, 23 bp, Homo sapiens
tggacctgggaacgactggactg

SEQ ID NO: 850551 - DNA, 14 bp, Homo sapiens
tggaccttcctgcc

SEQ ID NO: 850552 - DNA, 22 bp, Homo sapiens
tggacgaatatgaatgtcacat

SEQ ID NO: 850553 - DNA, 18 bp, Homo sapiens
tggacgcaggccctgtcc

SEQ ID NO: 850554 - DNA, 14 bp, Homo sapiens
tggacggaggtccc

SEQ ID NO: 850555 - DNA, 21 bp, Homo sapiens
tggacggcaggctcactgcca

SEQ ID NO: 850556 - DNA, 19 bp, Homo sapiens
tggacggcgctgcctcagg

SEQ ID NO: 850557 - DNA, 19 bp, Homo sapiens
tggacggtttctagcctct

SEQ ID NO: 850558 - DNA, 18 bp, Homo sapiens
tggacgtcacgctccctg

SEQ ID NO: 850559 - DNA, 14 bp, Homo sapiens
tggacgtgcactga

SEQ ID NO: 850560 - DNA, 19 bp, Homo sapiens
tggactacacccaagcctg

SEQ ID NO: 850561 - DNA, 21 bp, Homo sapiens
tggactagagggacctctccc

SEQ ID NO: 850562 - DNA, 14 bp, Homo sapiens
tggactatctgtct

SEQ ID NO: 850563 - DNA, 18 bp, Homo sapiens
tggactattataatttaa

SEQ ID NO: 850564 - DNA, 17 bp, Homo sapiens
tggactcaatccctagg

SEQ ID NO: 850565 - DNA, 18 bp, Homo sapiens
tggactcacctcccccat

SEQ ID NO: 850566 - DNA, 20 bp, Homo sapiens
tggactcacctcccccatct

SEQ ID NO: 850567 - DNA, 15 bp, Homo sapiens
tggactcaggaactt

SEQ ID NO: 850568 - DNA, 20 bp, Homo sapiens
tggactccagcctgcctggc

SEQ ID NO: 850569 - DNA, 23 bp, Homo sapiens
tggactccagcctgcctggcagg

SEQ ID NO: 850570 - DNA, 13 bp, Homo sapiens
tggactcctccca

SEQ ID NO: 850571 - DNA, 14 bp, Homo sapiens
tggactcctcccac

SEQ ID NO: 850572 - DNA, 15 bp, Homo sapiens
tggactcctctgtcc

SEQ ID NO: 850573 - DNA, 14 bp, Homo sapiens
tggactcctcttgg

SEQ ID NO: 850574 - DNA, 21 bp, Homo sapiens
tggactctacactgtgaactt

SEQ ID NO: 850575 - DNA, 15 bp, Homo sapiens
tggactctcagtctc

SEQ ID NO: 850576 - DNA, 20 bp, Homo sapiens
tggactctgaggactcctga

SEQ ID NO: 850577 - DNA, 16 bp, Homo sapiens
tggactctgcatccca

SEQ ID NO: 850578 - DNA, 18 bp, Homo sapiens
tggactctggactttctc

SEQ ID NO: 850579 - DNA, 12 bp, Homo sapiens
tggactcttgct

SEQ ID NO: 850580 - DNA, 13 bp, Homo sapiens
tggactgacattt

SEQ ID NO: 850581 - DNA, 22 bp, Homo sapiens
tggactgagccaaggaggcctg

SEQ ID NO: 850582 - DNA, 14 bp, Homo sapiens
tggactgcagaagc

SEQ ID NO: 850583 - DNA, 18 bp, Homo sapiens
tggactgcagtcggcatg

SEQ ID NO: 850584 - DNA, 20 bp, Homo sapiens
tggactgcagtcggcatgcc

SEQ ID NO: 850585 - DNA, 20 bp, Homo sapiens
tggactgcatggggaggcag

SEQ ID NO: 850586 - DNA, 22 bp, Homo sapiens
tggactgcatggggaggcagca

SEQ ID NO: 850587 - DNA, 18 bp, Homo sapiens
tggactggaggtgggcat

SEQ ID NO: 850588 - DNA, 22 bp, Homo sapiens
tggactggccatttttctgggg

SEQ ID NO: 850589 - DNA, 21 bp, Homo sapiens
tggactggcgttcacctccct

SEQ ID NO: 850590 - DNA, 22 bp, Homo sapiens
tggactggcgttcacctccctg

SEQ ID NO: 850591 - DNA, 17 bp, Homo sapiens
tggactggttggttttg

SEQ ID NO: 850592 - DNA, 21 bp, Homo sapiens
tggactgtcacggggttccct

SEQ ID NO: 850593 - DNA, 14 bp, Homo sapiens
tggactgtctttat

SEQ ID NO: 850594 - DNA, 18 bp, Homo sapiens
tggactgtgaatttcaaa

SEQ ID NO: 850595 - DNA, 17 bp, Homo sapiens
tggactgttccaggccc

SEQ ID NO: 850596 - DNA, 15 bp, Homo sapiens
tggactgttttcaat

SEQ ID NO: 850597 - DNA, 22 bp, Homo sapiens
tggactgttttcaataacaaag

SEQ ID NO: 850598 - DNA, 22 bp, Homo sapiens
tggactgttttctctcggctcc

SEQ ID NO: 850599 - DNA, 16 bp, Homo sapiens
tggacttacctggcag

SEQ ID NO: 850600 - DNA, 22 bp, Homo sapiens
tggacttcacataagctcagaa

SEQ ID NO: 850601 - DNA, 17 bp, Homo sapiens
tggacttctacctgccc

SEQ ID NO: 850602 - DNA, 19 bp, Homo sapiens
tggacttctggatgcccat

SEQ ID NO: 850603 - DNA, 14 bp, Homo sapiens
tggacttggagctg

SEQ ID NO: 850604 - DNA, 18 bp, Homo sapiens
tggacttggtcaccagct

SEQ ID NO: 850605 - DNA, 13 bp, Homo sapiens
tggacttgtatat

SEQ ID NO: 850606 - DNA, 22 bp, Homo sapiens
tggacttgtatatttgtacaaa

SEQ ID NO: 850607 - DNA, 19 bp, Homo sapiens
tggactttccaccccctcc

SEQ ID NO: 850608 - DNA, 20 bp, Homo sapiens
tggactttccaccccctccc

SEQ ID NO: 850609 - DNA, 23 bp, Homo sapiens
tggactttggtactgctgtcttc

SEQ ID NO: 850610 - DNA, 18 bp, Homo sapiens
tggacttttcgttaacat

SEQ ID NO: 850611 - DNA, 19 bp, Homo sapiens
tggacttttcgttaacatt

SEQ ID NO: 850612 - DNA, 21 bp, Homo sapiens
tggacttttcgttaacattga

SEQ ID NO: 850613 - DNA, 17 bp, Homo sapiens
tggagaaaataacaaga

SEQ ID NO: 850614 - DNA, 14 bp, Homo sapiens
tggagaaagaagtg

SEQ ID NO: 850615 - DNA, 15 bp, Homo sapiens
tggagaaagaagtgg

SEQ ID NO: 850616 - DNA, 18 bp, Homo sapiens
tggagaaagaagtggaga

SEQ ID NO: 850617 - DNA, 14 bp, Homo sapiens
tggagaaagcactg

SEQ ID NO: 850618 - DNA, 17 bp, Homo sapiens
tggagaaagcactgacc

SEQ ID NO: 850619 - DNA, 18 bp, Homo sapiens
tggagaaagcactgacct

SEQ ID NO: 850620 - DNA, 14 bp, Homo sapiens
tggagaaagtaagt

SEQ ID NO: 850621 - DNA, 11 bp, Homo sapiens
tggagaaatta

SEQ ID NO: 850622 - DNA, 15 bp, Homo sapiens
tggagaaattattta

SEQ ID NO: 850623 - DNA, 17 bp, Homo sapiens
tggagaaattatttaat

SEQ ID NO: 850624 - DNA, 22 bp, Homo sapiens
tggagaaccagggctcttctca

SEQ ID NO: 850625 - DNA, 16 bp, Homo sapiens
tggagaagaatatcaa

SEQ ID NO: 850626 - DNA, 17 bp, Homo sapiens
tggagaagaccctcccc

SEQ ID NO: 850627 - DNA, 13 bp, Homo sapiens
tggagaagcggct

SEQ ID NO: 850628 - DNA, 22 bp, Homo sapiens
tggagaagcggctggcagccca

SEQ ID NO: 850629 - DNA, 20 bp, Homo sapiens
tggagtgttttagttcttgg

SEQ ID NO: 850630 - DNA, 15 bp, Homo sapiens
tggagttaaaatgca

SEQ ID NO: 850631 - DNA, 17 bp, Homo sapiens
tggagttcaccttggaa

SEQ ID NO: 850632 - DNA, 19 bp, Homo sapiens
tggagttcttagctatcct

SEQ ID NO: 850633 - DNA, 18 bp, Homo sapiens
tggagttgaaactgctat

SEQ ID NO: 850634 - DNA, 23 bp, Homo sapiens
tggagtttaatacagtgagctct

SEQ ID NO: 850635 - DNA, 21 bp, Homo sapiens
tggagtttcatgtacaagatg

SEQ ID NO: 850636 - DNA, 14 bp, Homo sapiens
tggagtttctctaa

SEQ ID NO: 850637 - DNA, 17 bp, Homo sapiens
tggagtttgtgtctgtt

SEQ ID NO: 850638 - DNA, 20 bp, Homo sapiens
tggagtttgtgtctgttgct

SEQ ID NO: 850639 - DNA, 20 bp, Homo sapiens
tggataaaactgtgtaaacc

SEQ ID NO: 850640 - DNA, 12 bp, Homo sapiens
tggataaaccac

SEQ ID NO: 850641 - DNA, 18 bp, Homo sapiens
tggataaaccaccctctg

SEQ ID NO: 850642 - DNA, 21 bp, Homo sapiens
tggataaaccaccctctgggg

SEQ ID NO: 850643 - DNA, 14 bp, Homo sapiens
tggataaactgagc

SEQ ID NO: 850644 - DNA, 13 bp, Homo sapiens
tggataaatcatt

SEQ ID NO: 850645 - DNA, 20 bp, Homo sapiens
tggataaatcatttcagtat

SEQ ID NO: 850646 - DNA, 23 bp, Homo sapiens
tggataagctatccgtgttgcag

SEQ ID NO: 850647 - DNA, 16 bp, Homo sapiens
tggatacagagccacg

SEQ ID NO: 850648 - DNA, 13 bp, Homo sapiens
tggatacataaag

SEQ ID NO: 850649 - DNA, 14 bp, Homo sapiens
tggatataatgtat

SEQ ID NO: 850650 - DNA, 21 bp, Homo sapiens
tggatatagctaggtgacata

SEQ ID NO: 850651 - DNA, 16 bp, Homo sapiens
tggatatagttttact

SEQ ID NO: 850652 - DNA, 19 bp, Homo sapiens
tggatatataggctatttt

SEQ ID NO: 850653 - DNA, 14 bp, Homo sapiens
tggatatcagggta

SEQ ID NO: 850654 - DNA, 17 bp, Homo sapiens
tggatatgtaaaacatt

SEQ ID NO: 850655 - DNA, 16 bp, Homo sapiens
tggatattattagaaa

SEQ ID NO: 850656 - DNA, 17 bp, Homo sapiens
tggatattattagaaat

SEQ ID NO: 850657 - DNA, 21 bp, Homo sapiens
tggatatttgtactgtttaat

SEQ ID NO: 850658 - DNA, 12 bp, Homo sapiens
tggatcaagctt

SEQ ID NO: 850659 - DNA, 23 bp, Homo sapiens
tggatcacagaggcttcttcaga

SEQ ID NO: 850660 - DNA, 16 bp, Homo sapiens
tggatcaccattatat

SEQ ID NO: 850661 - DNA, 17 bp, Homo sapiens
tggatcactcaccattc

SEQ ID NO: 850662 - DNA, 16 bp, Homo sapiens
tggatcagatgaactc

SEQ ID NO: 850663 - DNA, 23 bp, Homo sapiens
tggatccatcttgagccacagtc

SEQ ID NO: 850664 - DNA, 13 bp, Homo sapiens
tggatcctagcct

SEQ ID NO: 850665 - DNA, 14 bp, Homo sapiens
tggatccttccatc

SEQ ID NO: 850666 - DNA, 23 bp, Homo sapiens
tggatcgagtgtagctgtgaaat

SEQ ID NO: 850667 - DNA, 18 bp, Homo sapiens
tggatcgctaagctggct

SEQ ID NO: 850668 - DNA, 17 bp, Homo sapiens
tggatctacctggaggg

SEQ ID NO: 850669 - DNA, 14 bp, Homo sapiens
tggatctatttcat

SEQ ID NO: 850670 - DNA, 15 bp, Homo sapiens
tggatctccaaggac

SEQ ID NO: 850671 - DNA, 15 bp, Homo sapiens
tggatctccccactc

SEQ ID NO: 850672 - DNA, 17 bp, Homo sapiens
tggatctcctgctgcct

SEQ ID NO: 850673 - DNA, 18 bp, Homo sapiens
tggatctgaccctcccag

SEQ ID NO: 850674 - DNA, 17 bp, Homo sapiens
tggatctggatctgtta

SEQ ID NO: 850675 - DNA, 15 bp, Homo sapiens
tggatctggggactg

SEQ ID NO: 850676 - DNA, 18 bp, Homo sapiens
tggatctgtccaaggaaa

SEQ ID NO: 850677 - DNA, 15 bp, Homo sapiens
tggatctttttaaaa

SEQ ID NO: 850678 - DNA, 19 bp, Homo sapiens
tggatgaagattctcctgt

SEQ ID NO: 850679 - DNA, 13 bp, Homo sapiens
tggatgaaggcaa

SEQ ID NO: 850680 - DNA, 20 bp, Homo sapiens
tggatgaccagaacaaggtt

SEQ ID NO: 850681 - DNA, 12 bp, Homo sapiens
tggatgactgtt

SEQ ID NO: 850682 - DNA, 17 bp, Homo sapiens
tggatgactgttgatga

SEQ ID NO: 850683 - DNA, 20 bp, Homo sapiens
tggatgagacttccaaacct

SEQ ID NO: 850684 - DNA, 16 bp, Homo sapiens
tggatgaggagacaga

SEQ ID NO: 850685 - DNA, 15 bp, Homo sapiens
tggatgcccagagga

SEQ ID NO: 850686 - DNA, 18 bp, Homo sapiens
tggatgcggccattcaag

SEQ ID NO: 850687 - DNA, 20 bp, Homo sapiens
tggatgctcgccatcaaggt

SEQ ID NO: 850688 - DNA, 23 bp, Homo sapiens
tggatggaacgggcatgggcctc

SEQ ID NO: 850689 - DNA, 11 bp, Homo sapiens
tggatggacag

SEQ ID NO: 850690 - DNA, 17 bp, Homo sapiens
tggatggacagacacct

SEQ ID NO: 850691 - DNA, 19 bp, Homo sapiens
tggatggacagacacctcc

SEQ ID NO: 850692 - DNA, 20 bp, Homo sapiens
tggatggacttgtatagtga

SEQ ID NO: 850693 - DNA, 15 bp, Homo sapiens
tggatggcacaatga

SEQ ID NO: 850694 - DNA, 20 bp, Homo sapiens
tggatggcacaatgaatgta

SEQ ID NO: 850695 - DNA, 16 bp, Homo sapiens
tggatggcacctcagg

SEQ ID NO: 850696 - DNA, 21 bp, Homo sapiens
tggatggcacctcaggctgag

SEQ ID NO: 850697 - DNA, 18 bp, Homo sapiens
tggatggcccagcaggca

SEQ ID NO: 850698 - DNA, 19 bp, Homo sapiens
tggatggcccagcaggcag

SEQ ID NO: 850699 - DNA, 20 bp, Homo sapiens
tggatggcccagcaggcagg

SEQ ID NO: 850700 - DNA, 22 bp, Homo sapiens
tggatggcccagcaggcaggca

SEQ ID NO: 850701 - DNA, 15 bp, Homo sapiens
tggatgggaggagag

SEQ ID NO: 850702 - DNA, 23 bp, Homo sapiens
tggatgggaggagagccactggg

SEQ ID NO: 850703 - DNA, 18 bp, Homo sapiens
tggatgggcaaagcttgt

SEQ ID NO: 850704 - DNA, 19 bp, Homo sapiens
tggatgggcattgggctga

SEQ ID NO: 850705 - DNA, 14 bp, Homo sapiens
tggatgtcttcctt

SEQ ID NO: 850706 - DNA, 23 bp, Homo sapiens
tggatgtggggtccccatcatcc

SEQ ID NO: 850707 - DNA, 18 bp, Homo sapiens
tggatgttatgaacagct

SEQ ID NO: 850708 - DNA, 21 bp, Homo sapiens
tggatgttatgaacagctgtg

SEQ ID NO: 850709 - DNA, 18 bp, Homo sapiens
tggatgtttaccgtgtgt

SEQ ID NO: 850710 - DNA, 22 bp, Homo sapiens
tggattaaacttaatctaaatg

SEQ ID NO: 850711 - DNA, 19 bp, Homo sapiens
tggattaaattctgggtga

SEQ ID NO: 850712 - DNA, 22 bp, Homo sapiens
tggattaatagagttggagttt

SEQ ID NO: 850713 - DNA, 22 bp, Homo sapiens
tggattatgttatacaaggcaa

SEQ ID NO: 850714 - DNA, 20 bp, Homo sapiens
tggattattcatttaaaatg

SEQ ID NO: 850715 - DNA, 17 bp, Homo sapiens
tggattcagccttcttt

SEQ ID NO: 850716 - DNA, 23 bp, Homo sapiens
tggattcagccttctttttctgg

SEQ ID NO: 850717 - DNA, 13 bp, Homo sapiens
tggattcatcagc

SEQ ID NO: 850718 - DNA, 18 bp, Homo sapiens
tggattcattacagctta

SEQ ID NO: 850719 - DNA, 22 bp, Homo sapiens
tggattcccccccctttcctaa

SEQ ID NO: 850720 - DNA, 21 bp, Homo sapiens
tggattcctaaatattttcaa

SEQ ID NO: 850721 - DNA, 15 bp, Homo sapiens
tggattctcagatat

SEQ ID NO: 850722 - DNA, 16 bp, Homo sapiens
tggattctcagatatt

SEQ ID NO: 850723 - DNA, 21 bp, Homo sapiens
tggattgcacgtggcctcttg

SEQ ID NO: 850724 - DNA, 15 bp, Homo sapiens
tggattgccacagct

SEQ ID NO: 850725 - DNA, 17 bp, Homo sapiens
tggattgccacagctca

SEQ ID NO: 850726 - DNA, 15 bp, Homo sapiens
tggattggccaaaca

SEQ ID NO: 850727 - DNA, 14 bp, Homo sapiens
tggattgggctgca

SEQ ID NO: 850728 - DNA, 13 bp, Homo sapiens
tggattgtgcttt

SEQ ID NO: 850729 - DNA, 21 bp, Homo sapiens
tggattgttctagtactgtat

SEQ ID NO: 850730 - DNA, 22 bp, Homo sapiens
tggattgttctagtactgtatt

SEQ ID NO: 850731 - DNA, 19 bp, Homo sapiens
tggatttaaaaatgccaaa

SEQ ID NO: 850732 - DNA, 18 bp, Homo sapiens
tggatttaaaagcctgct

SEQ ID NO: 850733 - DNA, 17 bp, Homo sapiens
tggatttaacagaaatg

SEQ ID NO: 850734 - DNA, 23 bp, Homo sapiens
tggatttaagagtattttaagaa

SEQ ID NO: 850735 - DNA, 16 bp, Homo sapiens
tggatttagtttcagt

SEQ ID NO: 850736 - DNA, 21 bp, Homo sapiens
tggatttatagtatgtgactt

SEQ ID NO: 850737 - DNA, 13 bp, Homo sapiens
tggatttcagaag

SEQ ID NO: 850738 - DNA, 21 bp, Homo sapiens
tggatttcctaatactgtcat

SEQ ID NO: 850739 - DNA, 20 bp, Homo sapiens
tggatttccttctaacatgt

SEQ ID NO: 850740 - DNA, 18 bp, Homo sapiens
tggatttctttgaaaaaa

SEQ ID NO: 850741 - DNA, 19 bp, Homo sapiens
tggatttgaagtttgccaa

SEQ ID NO: 850742 - DNA, 13 bp, Homo sapiens
tggatttgatgct

SEQ ID NO: 850743 - DNA, 17 bp, Homo sapiens
tggatttgattcatttt

SEQ ID NO: 850744 - DNA, 21 bp, Homo sapiens
tggatttgattcattttcctg

SEQ ID NO: 850745 - DNA, 17 bp, Homo sapiens
tggatttgcctgtgcca

SEQ ID NO: 850746 - DNA, 18 bp, Homo sapiens
tggatttgcctgtgccac

SEQ ID NO: 850747 - DNA, 19 bp, Homo sapiens
tggatttgctcattgctgt

SEQ ID NO: 850748 - DNA, 14 bp, Homo sapiens
tggattttaaaaaa

SEQ ID NO: 850749 - DNA, 18 bp, Homo sapiens
tggattttaaaaaatcaa

SEQ ID NO: 850750 - DNA, 15 bp, Homo sapiens
tggccacccctcccc

SEQ ID NO: 850751 - DNA, 11 bp, Homo sapiens
tggccaccctg

SEQ ID NO: 850752 - DNA, 22 bp, Homo sapiens
tggccacctgaggtgggcccag

SEQ ID NO: 850753 - DNA, 16 bp, Homo sapiens
tggccaccttgcttga

SEQ ID NO: 850754 - DNA, 20 bp, Homo sapiens
tggccaccttgcttgaggga

SEQ ID NO: 850755 - DNA, 17 bp, Homo sapiens
tggccacgttcagggag

SEQ ID NO: 850756 - DNA, 19 bp, Homo sapiens
tggccacgttcagggaggg

SEQ ID NO: 850757 - DNA, 22 bp, Homo sapiens
tggccacgttcagggaggggcc

SEQ ID NO: 850758 - DNA, 18 bp, Homo sapiens
tggccactaagcagagga

SEQ ID NO: 850759 - DNA, 17 bp, Homo sapiens
tggccactccagacccc

SEQ ID NO: 850760 - DNA, 20 bp, Homo sapiens
tggccactccagacccctgg

SEQ ID NO: 850761 - DNA, 22 bp, Homo sapiens
tggccactccagacccctggct

SEQ ID NO: 850762 - DNA, 23 bp, Homo sapiens
tggccactccgagaggtgggcca

SEQ ID NO: 850763 - DNA, 19 bp, Homo sapiens
tggccactgctccctaagc

SEQ ID NO: 850764 - DNA, 23 bp, Homo sapiens
tggccactgggtctcactcctga

SEQ ID NO: 850765 - DNA, 13 bp, Homo sapiens
tggccactgtcaa

SEQ ID NO: 850766 - DNA, 15 bp, Homo sapiens
tggccagacaagaag

SEQ ID NO: 850767 - DNA, 16 bp, Homo sapiens
tggccagacaagaaga

SEQ ID NO: 850768 - DNA, 19 bp, Homo sapiens
tggccagacgctgccgctg

SEQ ID NO: 850769 - DNA, 17 bp, Homo sapiens
tggccagagagggccca

SEQ ID NO: 850770 - DNA, 21 bp, Homo sapiens
tggccagagagggcccagctg

SEQ ID NO: 850771 - DNA, 22 bp, Homo sapiens
tggccagagagggcccagctgt

SEQ ID NO: 850772 - DNA, 15 bp, Homo sapiens
tggccagagcctctg

SEQ ID NO: 850773 - DNA, 12 bp, Homo sapiens
tggccagagctg

SEQ ID NO: 850774 - DNA, 14 bp, Homo sapiens
tggccagagctgga

SEQ ID NO: 850775 - DNA, 20 bp, Homo sapiens
tggccagagctgggaggcat

SEQ ID NO: 850776 - DNA, 24 bp, Homo sapiens
tggccagagctgggaggcatggcc

SEQ ID NO: 850777 - DNA, 14 bp, Homo sapiens
tggccagatgcggg

SEQ ID NO: 850778 - DNA, 17 bp, Homo sapiens
tggccagcaaaaactgt

SEQ ID NO: 850779 - DNA, 16 bp, Homo sapiens
tggccagcaaggcagg

SEQ ID NO: 850780 - DNA, 17 bp, Homo sapiens
tggccagcaaggcaggt

SEQ ID NO: 850781 - DNA, 15 bp, Homo sapiens
tggccagcaccctct

SEQ ID NO: 850782 - DNA, 21 bp, Homo sapiens
tggccagccaatttcccggag

SEQ ID NO: 850783 - DNA, 13 bp, Homo sapiens
tggccagcccggc

SEQ ID NO: 850784 - DNA, 17 bp, Homo sapiens
tggccagcccggctggt

SEQ ID NO: 850785 - DNA, 17 bp, Homo sapiens
tggccagcgccagggcc

SEQ ID NO: 850786 - DNA, 22 bp, Homo sapiens
tggccagcgccagggcccaggc

SEQ ID NO: 850787 - DNA, 14 bp, Homo sapiens
tggccagctctgag

SEQ ID NO: 850788 - DNA, 11 bp, Homo sapiens
tggccaggagc

SEQ ID NO: 850789 - DNA, 22 bp, Homo sapiens
tggccaggagcaggcacgggtg

SEQ ID NO: 850790 - DNA, 15 bp, Homo sapiens
tggccaggagctctt

SEQ ID NO: 850791 - DNA, 22 bp, Homo sapiens
tggccaggagctcttcaggcct

SEQ ID NO: 850792 - DNA, 16 bp, Homo sapiens
tggccaggaggttccc

SEQ ID NO: 850793 - DNA, 21 bp, Homo sapiens
tggccaggaggttggtgactg

SEQ ID NO: 850794 - DNA, 14 bp, Homo sapiens
tggccaggatggag

SEQ ID NO: 850795 - DNA, 21 bp, Homo sapiens
tggccaggcactgccttctcc

SEQ ID NO: 850796 - DNA, 19 bp, Homo sapiens
tggccaggcctcttggcag

SEQ ID NO: 850797 - DNA, 20 bp, Homo sapiens
tggccaggctggtctcgaac

SEQ ID NO: 850798 - DNA, 10 bp, Homo sapiens
tggccaggga

SEQ ID NO: 850799 - DNA, 17 bp, Homo sapiens
tggccagggaggcgcag

SEQ ID NO: 850800 - DNA, 18 bp, Homo sapiens
tggccagggaggcgcagg

SEQ ID NO: 850801 - DNA, 19 bp, Homo sapiens
tggccagggaggcgcaggg

SEQ ID NO: 850802 - DNA, 21 bp, Homo sapiens
tggccagggaggcgcagggac

SEQ ID NO: 850803 - DNA, 23 bp, Homo sapiens
tggccagggaggcgcagggacat

SEQ ID NO: 850804 - DNA, 11 bp, Homo sapiens
tggccagggct

SEQ ID NO: 850805 - DNA, 12 bp, Homo sapiens
tggccagggtga

SEQ ID NO: 850806 - DNA, 18 bp, Homo sapiens
tggccagggtgagagctg

SEQ ID NO: 850807 - DNA, 15 bp, Homo sapiens
tggccagtccaggct

SEQ ID NO: 850808 - DNA, 16 bp, Homo sapiens
tggccagtgagaagct

SEQ ID NO: 850809 - DNA, 21 bp, Homo sapiens
tggccagtgagaagctgaggc

SEQ ID NO: 850810 - DNA, 12 bp, Homo sapiens
tggccagtgctg

SEQ ID NO: 850811 - DNA, 15 bp, Homo sapiens
tggccagtgctgctt

SEQ ID NO: 850812 - DNA, 18 bp, Homo sapiens
tggccagtgtttaaaact

SEQ ID NO: 850813 - DNA, 16 bp, Homo sapiens
tggccagttgaatata

SEQ ID NO: 850814 - DNA, 16 bp, Homo sapiens
tggccatactgtgtcc

SEQ ID NO: 850815 - DNA, 14 bp, Homo sapiens
tggccatagaggcc

SEQ ID NO: 850816 - DNA, 19 bp, Homo sapiens
tggccatagaggcccaggc

SEQ ID NO: 850817 - DNA, 20 bp, Homo sapiens
tggccatagaggcccaggca

SEQ ID NO: 850818 - DNA, 17 bp, Homo sapiens
tggccatatatgctgta

SEQ ID NO: 850819 - DNA, 20 bp, Homo sapiens
tggccatcactcagccccta

SEQ ID NO: 850820 - DNA, 17 bp, Homo sapiens
tggccatccctgggccc

SEQ ID NO: 850821 - DNA, 19 bp, Homo sapiens
tggccatccctgggcccct

SEQ ID NO: 850822 - DNA, 22 bp, Homo sapiens
tggccatccctgggcccctcca

SEQ ID NO: 850823 - DNA, 15 bp, Homo sapiens
tggccatcctaccca

SEQ ID NO: 850824 - DNA, 18 bp, Homo sapiens
tggccatcctacccagcg

SEQ ID NO: 850825 - DNA, 16 bp, Homo sapiens
tggccatctccctccc

SEQ ID NO: 850826 - DNA, 16 bp, Homo sapiens
tggccatcttaaaaag

SEQ ID NO: 850827 - DNA, 19 bp, Homo sapiens
tggccatgcaggaggtgga

SEQ ID NO: 850828 - DNA, 21 bp, Homo sapiens
tggccatgcaggaggtggaga

SEQ ID NO: 850829 - DNA, 12 bp, Homo sapiens
tggccatgccct

SEQ ID NO: 850830 - DNA, 22 bp, Homo sapiens
tggccatgccctagaccctccc

SEQ ID NO: 850831 - DNA, 18 bp, Homo sapiens
tggccatgctcaaccccc

SEQ ID NO: 850832 - DNA, 17 bp, Homo sapiens
tggccatgctgtccctg

SEQ ID NO: 850833 - DNA, 21 bp, Homo sapiens
tggccatgctgtccctgcact

SEQ ID NO: 850834 - DNA, 20 bp, Homo sapiens
tggccatggacgaatatgaa

SEQ ID NO: 850835 - DNA, 16 bp, Homo sapiens
tggccatggcctctgc

SEQ ID NO: 850836 - DNA, 17 bp, Homo sapiens
tggccatggcctctgca

SEQ ID NO: 850837 - DNA, 18 bp, Homo sapiens
tggccatggcctctgcaa

SEQ ID NO: 850838 - DNA, 19 bp, Homo sapiens
tggccatgttatgctggtg

SEQ ID NO: 850839 - DNA, 15 bp, Homo sapiens
tggccatttgctttt

SEQ ID NO: 850840 - DNA, 15 bp, Homo sapiens
tggcccaagggatgg

SEQ ID NO: 850841 - DNA, 17 bp, Homo sapiens
tggcccaagggatggca

SEQ ID NO: 850842 - DNA, 22 bp, Homo sapiens
tggcccaagggatggcaccact

SEQ ID NO: 850843 - DNA, 13 bp, Homo sapiens
tggcccacgcact

SEQ ID NO: 850844 - DNA, 19 bp, Homo sapiens
tggcccacgcacttcggga

SEQ ID NO: 850845 - DNA, 23 bp, Homo sapiens
tggcccacgtagggggctctggg

SEQ ID NO: 850846 - DNA, 14 bp, Homo sapiens
tggcccagaaagcc

SEQ ID NO: 850847 - DNA, 23 bp, Homo sapiens
tggcccagaaagcctctctctcc

SEQ ID NO: 850848 - DNA, 13 bp, Homo sapiens
tggcccagagcct

SEQ ID NO: 850849 - DNA, 16 bp, Homo sapiens
tggcccagcaggcagg

SEQ ID NO: 850850 - DNA, 11 bp, Homo sapiens
tggcccagccg

SEQ ID NO: 850851 - DNA, 15 bp, Homo sapiens
tggcccagccggcct

SEQ ID NO: 850852 - DNA, 23 bp, Homo sapiens
tggcccagccggcctctctggcc

SEQ ID NO: 850853 - DNA, 17 bp, Homo sapiens
tggcccagcggcccctc

SEQ ID NO: 850854 - DNA, 15 bp, Homo sapiens
tggcccagctcccca

SEQ ID NO: 850855 - DNA, 18 bp, Homo sapiens
tggcccaggagctctgcg

SEQ ID NO: 850856 - DNA, 22 bp, Homo sapiens
tggcccaggagctctgcgccag

SEQ ID NO: 850857 - DNA, 13 bp, Homo sapiens
tggcccaggcagc

SEQ ID NO: 850858 - DNA, 14 bp, Homo sapiens
tggcccaggcagcc

SEQ ID NO: 850859 - DNA, 16 bp, Homo sapiens
tggcccaggcagcctc

SEQ ID NO: 850860 - DNA, 11 bp, Homo sapiens
tggcccaggcc

SEQ ID NO: 850861 - DNA, 14 bp, Homo sapiens
tggcccaggccccc

SEQ ID NO: 850862 - DNA, 20 bp, Homo sapiens
tggcccatctcagcctcctg

SEQ ID NO: 850863 - DNA, 23 bp, Homo sapiens
tggcccattggagcacctgggcc

SEQ ID NO: 850864 - DNA, 15 bp, Homo sapiens
tggccccaccctggg

SEQ ID NO: 850865 - DNA, 18 bp, Homo sapiens
tggccccaccctgggccc

SEQ ID NO: 850866 - DNA, 14 bp, Homo sapiens
tggccccagaggac

SEQ ID NO: 850867 - DNA, 15 bp, Homo sapiens
tggccccagaggacc

SEQ ID NO: 850868 - DNA, 14 bp, Homo sapiens
tggccccagcacag

SEQ ID NO: 850869 - DNA, 13 bp, Homo sapiens
tggccccagccct

SEQ ID NO: 850870 - DNA, 18 bp, Homo sapiens
tggccccagccctgctgg

SEQ ID NO: 850871 - DNA, 13 bp, Homo sapiens
tggccccagggga

SEQ ID NO: 850872 - DNA, 16 bp, Homo sapiens
tggctagtcagagaga

SEQ ID NO: 850873 - DNA, 13 bp, Homo sapiens
tggctataaatat

SEQ ID NO: 850874 - DNA, 19 bp, Homo sapiens
tggctataaatatataaaa

SEQ ID NO: 850875 - DNA, 22 bp, Homo sapiens
tggctataacatgtctttcagc

SEQ ID NO: 850876 - DNA, 17 bp, Homo sapiens
tggctataagtgctcaa

SEQ ID NO: 850877 - DNA, 19 bp, Homo sapiens
tggctatagatgtcttttc

SEQ ID NO: 850878 - DNA, 14 bp, Homo sapiens
tggctatcctgatt

SEQ ID NO: 850879 - DNA, 23 bp, Homo sapiens
tggctatctactaccagaagggc

SEQ ID NO: 850880 - DNA, 21 bp, Homo sapiens
tggctatctatacctgccttt

SEQ ID NO: 850881 - DNA, 15 bp, Homo sapiens
tggctatgccttgca

SEQ ID NO: 850882 - DNA, 13 bp, Homo sapiens
tggctatgttttt

SEQ ID NO: 850883 - DNA, 15 bp, Homo sapiens
tggctatttaaaact

SEQ ID NO: 850884 - DNA, 16 bp, Homo sapiens
tggctatttaaagaca

SEQ ID NO: 850885 - DNA, 18 bp, Homo sapiens
tggctcaagacaaggctg

SEQ ID NO: 850886 - DNA, 17 bp, Homo sapiens
tggctcaagtagaaaag

SEQ ID NO: 850887 - DNA, 24 bp, Homo sapiens
tggctcacagtacagcatgtgcct

SEQ ID NO: 850888 - DNA, 15 bp, Homo sapiens
tggctcacccaagca

SEQ ID NO: 850889 - DNA, 20 bp, Homo sapiens
tggctcacgccccgctgtgt

SEQ ID NO: 850890 - DNA, 13 bp, Homo sapiens
tggctcacgcctg

SEQ ID NO: 850891 - DNA, 14 bp, Homo sapiens
tggctcacgcctgt

SEQ ID NO: 850892 - DNA, 16 bp, Homo sapiens
tggctcacgcctgtaa

SEQ ID NO: 850893 - DNA, 16 bp, Homo sapiens
tggctcacgtgtgtga

SEQ ID NO: 850894 - DNA, 17 bp, Homo sapiens
tggctcactactgaaca

SEQ ID NO: 850895 - DNA, 13 bp, Homo sapiens
tggctcactgcag

SEQ ID NO: 850896 - DNA, 13 bp, Homo sapiens
tggctcactggct

SEQ ID NO: 850897 - DNA, 15 bp, Homo sapiens
tggctcactggctgg

SEQ ID NO: 850898 - DNA, 18 bp, Homo sapiens
tggctcagacatgttttc

SEQ ID NO: 850899 - DNA, 19 bp, Homo sapiens
tggctcagagcttgaagat

SEQ ID NO: 850900 - DNA, 22 bp, Homo sapiens
tggctcagatcggccacagggc

SEQ ID NO: 850901 - DNA, 12 bp, Homo sapiens
tggctcagccag

SEQ ID NO: 850902 - DNA, 16 bp, Homo sapiens
tggctcagccagcact

SEQ ID NO: 850903 - DNA, 19 bp, Homo sapiens
tggctcagcctgtctcggg

SEQ ID NO: 850904 - DNA, 20 bp, Homo sapiens
tggctcagcttctaatccca

SEQ ID NO: 850905 - DNA, 13 bp, Homo sapiens
tggctcaggcaga

SEQ ID NO: 850906 - DNA, 14 bp, Homo sapiens
tggctcaggcagac

SEQ ID NO: 850907 - DNA, 20 bp, Homo sapiens
tggctcagtgccacctatgc

SEQ ID NO: 850908 - DNA, 14 bp, Homo sapiens
tggctcagtgcctt

SEQ ID NO: 850909 - DNA, 14 bp, Homo sapiens
tggctcatgcccct

SEQ ID NO: 850910 - DNA, 18 bp, Homo sapiens
tggctcatgccccttggg

SEQ ID NO: 850911 - DNA, 17 bp, Homo sapiens
tggctcattgtagcaca

SEQ ID NO: 850912 - DNA, 15 bp, Homo sapiens
tggctccagaaatgt

SEQ ID NO: 850913 - DNA, 16 bp, Homo sapiens
tggctcccaaggttcc

SEQ ID NO: 850914 - DNA, 14 bp, Homo sapiens
tggctcccacaggc

SEQ ID NO: 850915 - DNA, 14 bp, Homo sapiens
tggctcccatgacc

SEQ ID NO: 850916 - DNA, 17 bp, Homo sapiens
tggctcccattcactct

SEQ ID NO: 850917 - DNA, 18 bp, Homo sapiens
tggctcccattcactctt

SEQ ID NO: 850918 - DNA, 17 bp, Homo sapiens
tggctccccacctggac

SEQ ID NO: 850919 - DNA, 22 bp, Homo sapiens
tggctccccacgagtcacctgc

SEQ ID NO: 850920 - DNA, 23 bp, Homo sapiens
tggctccccacgagtcacctgca

SEQ ID NO: 850921 - DNA, 16 bp, Homo sapiens
tggctccccctcccca

SEQ ID NO: 850922 - DNA, 17 bp, Homo sapiens
tggctccccctccccag

SEQ ID NO: 850923 - DNA, 17 bp, Homo sapiens
tggctccccctctgctt

SEQ ID NO: 850924 - DNA, 22 bp, Homo sapiens
tggctccccgagggctcagaag

SEQ ID NO: 850925 - DNA, 15 bp, Homo sapiens
tggctccctcctcca

SEQ ID NO: 850926 - DNA, 17 bp, Homo sapiens
tggctcctaccagcaaa

SEQ ID NO: 850927 - DNA, 14 bp, Homo sapiens
tggctcctcaaaca

SEQ ID NO: 850928 - DNA, 22 bp, Homo sapiens
tggctcctcaaacagtaggttg

SEQ ID NO: 850929 - DNA, 14 bp, Homo sapiens
tggctcctcccggt

SEQ ID NO: 850930 - DNA, 18 bp, Homo sapiens
tggctcctcccggtgccc

SEQ ID NO: 850931 - DNA, 14 bp, Homo sapiens
tggctcctctcagt

SEQ ID NO: 850932 - DNA, 12 bp, Homo sapiens
tggctcctgatc

SEQ ID NO: 850933 - DNA, 15 bp, Homo sapiens
tggctcctgtctggc

SEQ ID NO: 850934 - DNA, 18 bp, Homo sapiens
tggctccttgcagcaggg

SEQ ID NO: 850935 - DNA, 19 bp, Homo sapiens
tggctccttgcagcagggc

SEQ ID NO: 850936 - DNA, 21 bp, Homo sapiens
tggctccttgcagcagggctg

SEQ ID NO: 850937 - DNA, 21 bp, Homo sapiens
tggctcgaatctctgtgcctt

SEQ ID NO: 850938 - DNA, 19 bp, Homo sapiens
tggctcgatgtttgccatg

SEQ ID NO: 850939 - DNA, 22 bp, Homo sapiens
tggctcgcagggtgcaggagcg

SEQ ID NO: 850940 - DNA, 15 bp, Homo sapiens
tggctcgctccctgt

SEQ ID NO: 850941 - DNA, 19 bp, Homo sapiens
tggctcggacccaccccaa

SEQ ID NO: 850942 - DNA, 19 bp, Homo sapiens
tggctctaccttcctgtcc

SEQ ID NO: 850943 - DNA, 14 bp, Homo sapiens
tggctctcagagca

SEQ ID NO: 850944 - DNA, 18 bp, Homo sapiens
tggctctcagagcagcag

SEQ ID NO: 850945 - DNA, 13 bp, Homo sapiens
tggctctccaagt

SEQ ID NO: 850946 - DNA, 14 bp, Homo sapiens
tggctctccaagtg

SEQ ID NO: 850947 - DNA, 16 bp, Homo sapiens
tggctctccaccttgt

SEQ ID NO: 850948 - DNA, 13 bp, Homo sapiens
tggctctcccacc

SEQ ID NO: 850949 - DNA, 13 bp, Homo sapiens
tggctctctccag

SEQ ID NO: 850950 - DNA, 14 bp, Homo sapiens
tggctctctccagg

SEQ ID NO: 850951 - DNA, 14 bp, Homo sapiens
tggctctgagaatc

SEQ ID NO: 850952 - DNA, 19 bp, Homo sapiens
tggctctgagcgcctccat

SEQ ID NO: 850953 - DNA, 22 bp, Homo sapiens
tggctctgaggtgcctgtccca

SEQ ID NO: 850954 - DNA, 12 bp, Homo sapiens
tggctctgcccc

SEQ ID NO: 850955 - DNA, 15 bp, Homo sapiens
tggctctgccccgca

SEQ ID NO: 850956 - DNA, 14 bp, Homo sapiens
tggctctgcccctc

SEQ ID NO: 850957 - DNA, 15 bp, Homo sapiens
tggctctgcccctca

SEQ ID NO: 850958 - DNA, 13 bp, Homo sapiens
tggctctgggaga

SEQ ID NO: 850959 - DNA, 21 bp, Homo sapiens
tggctctgggagagccagctt

SEQ ID NO: 850960 - DNA, 18 bp, Homo sapiens
tggctctgggatcctggg

SEQ ID NO: 850961 - DNA, 11 bp, Homo sapiens
tggctctgggg

SEQ ID NO: 850962 - DNA, 23 bp, Homo sapiens
tggctctgggggacccaggtggg

SEQ ID NO: 850963 - DNA, 24 bp, Homo sapiens
tggctctgggggacccaggtggga

SEQ ID NO: 850964 - DNA, 13 bp, Homo sapiens
tggctctggggta

SEQ ID NO: 850965 - DNA, 23 bp, Homo sapiens
tggctcttgatacccccctctgt

SEQ ID NO: 850966 - DNA, 17 bp, Homo sapiens
tggctcttggcttccag

SEQ ID NO: 850967 - DNA, 22 bp, Homo sapiens
tggctgaaattctcctggaggt

SEQ ID NO: 850968 - DNA, 15 bp, Homo sapiens
tggctgaactacaag

SEQ ID NO: 850969 - DNA, 13 bp, Homo sapiens
tggctgaagctgg

SEQ ID NO: 850970 - DNA, 19 bp, Homo sapiens
tggctgaagctggagcagc

SEQ ID NO: 850971 - DNA, 13 bp, Homo sapiens
tggctgacccctc

SEQ ID NO: 850972 - DNA, 13 bp, Homo sapiens
tggctgactgggg

SEQ ID NO: 850973 - DNA, 19 bp, Homo sapiens
tggctgactggggctgggg

SEQ ID NO: 850974 - DNA, 20 bp, Homo sapiens
tggctgaggatttcaagcct

SEQ ID NO: 850975 - DNA, 17 bp, Homo sapiens
tggctgaggccacccag

SEQ ID NO: 850976 - DNA, 17 bp, Homo sapiens
tggctgaggttcctctg

SEQ ID NO: 850977 - DNA, 24 bp, Homo sapiens
tggctgaggttcctctgcctgccc

SEQ ID NO: 850978 - DNA, 13 bp, Homo sapiens
tggctgccacacc

SEQ ID NO: 850979 - DNA, 11 bp, Homo sapiens
tggctgccagc

SEQ ID NO: 850980 - DNA, 21 bp, Homo sapiens
tggctgccagcccactgcctc

SEQ ID NO: 850981 - DNA, 13 bp, Homo sapiens
tggctgccaggcg

SEQ ID NO: 850982 - DNA, 13 bp, Homo sapiens
tggctgccctggc

SEQ ID NO: 850983 - DNA, 15 bp, Homo sapiens
tggctgccctggccc

SEQ ID NO: 850984 - DNA, 20 bp, Homo sapiens
tggctgcctttgatcacagg

SEQ ID NO: 850985 - DNA, 21 bp, Homo sapiens
tggctgcctttgatcacagga

SEQ ID NO: 850986 - DNA, 21 bp, Homo sapiens
tggctgcggtgtttggcaatg

SEQ ID NO: 850987 - DNA, 16 bp, Homo sapiens
tggctgcgtactccac

SEQ ID NO: 850988 - DNA, 19 bp, Homo sapiens
tggctgcgtactccactgg

SEQ ID NO: 850989 - DNA, 14 bp, Homo sapiens
tggctgctagcact

SEQ ID NO: 850990 - DNA, 15 bp, Homo sapiens
tggctgctaggccag

SEQ ID NO: 850991 - DNA, 14 bp, Homo sapiens
tggctgctgactga

SEQ ID NO: 850992 - DNA, 16 bp, Homo sapiens
tggctgcttcctgtga

SEQ ID NO: 850993 - DNA, 15 bp, Homo sapiens
tggctgcttctctct

SEQ ID NO: 850994 - DNA, 21 bp, Homo sapiens
tggctgcttgcagccaggaga

SEQ ID NO: 850995 - DNA, 13 bp, Homo sapiens
tgggagcactgga

SEQ ID NO: 850996 - DNA, 12 bp, Homo sapiens
tgggagcagctt

SEQ ID NO: 850997 - DNA, 17 bp, Homo sapiens
tgggagcagcttcttgg

SEQ ID NO: 850998 - DNA, 21 bp, Homo sapiens
tgggagcagcttcttgggctg

SEQ ID NO: 850999 - DNA, 22 bp, Homo sapiens
tgggagcagcttcttgggctga

SEQ ID NO: 851000 - DNA, 24 bp, Homo sapiens
tgggagcagcttcttgggctgagt

SEQ ID NO: 851001 - DNA, 13 bp, Homo sapiens
tgggagccagcct

SEQ ID NO: 851002 - DNA, 14 bp, Homo sapiens
tgggagcccagagg

SEQ ID NO: 851003 - DNA, 16 bp, Homo sapiens
tgggagccccagggtc

SEQ ID NO: 851004 - DNA, 20 bp, Homo sapiens
tgggagcccccaccacaaac

SEQ ID NO: 851005 - DNA, 13 bp, Homo sapiens
tgggagcctagct

SEQ ID NO: 851006 - DNA, 22 bp, Homo sapiens
tgggagcctagctcctgccaca

SEQ ID NO: 851007 - DNA, 17 bp, Homo sapiens
tgggagcctgaggcagg

SEQ ID NO: 851008 - DNA, 20 bp, Homo sapiens
tgggagcctgcaaactcact

SEQ ID NO: 851009 - DNA, 20 bp, Homo sapiens
tgggagcctggttcagacac

SEQ ID NO: 851010 - DNA, 16 bp, Homo sapiens
tgggagctccactctg

SEQ ID NO: 851011 - DNA, 21 bp, Homo sapiens
tgggagctgagctggaagggg

SEQ ID NO: 851012 - DNA, 20 bp, Homo sapiens
tgggagctgaggccacactc

SEQ ID NO: 851013 - DNA, 14 bp, Homo sapiens
tgggagctgctggg

SEQ ID NO: 851014 - DNA, 16 bp, Homo sapiens
tgggagctgctgggct

SEQ ID NO: 851015 - DNA, 16 bp, Homo sapiens
tgggagcttgggaatg

SEQ ID NO: 851016 - DNA, 12 bp, Homo sapiens
tgggaggaaaag

SEQ ID NO: 851017 - DNA, 22 bp, Homo sapiens
tgggaggaaagggcctggccag

SEQ ID NO: 851018 - DNA, 13 bp, Homo sapiens
tgggaggaaggac

SEQ ID NO: 851019 - DNA, 13 bp, Homo sapiens
tgggaggaattca

SEQ ID NO: 851020 - DNA, 12 bp, Homo sapiens
tgggaggacagg

SEQ ID NO: 851021 - DNA, 14 bp, Homo sapiens
tgggaggacaggca

SEQ ID NO: 851022 - DNA, 16 bp, Homo sapiens
tgggaggagaccagcg

SEQ ID NO: 851023 - DNA, 15 bp, Homo sapiens
tgggaggagagccac

SEQ ID NO: 851024 - DNA, 21 bp, Homo sapiens
tgggaggagagccactgggcc

SEQ ID NO: 851025 - DNA, 22 bp, Homo sapiens
tgggaggagagccactgggccc

SEQ ID NO: 851026 - DNA, 15 bp, Homo sapiens
tgggaggaggaaaag

SEQ ID NO: 851027 - DNA, 18 bp, Homo sapiens
tgggaggaggaaaagaaa

SEQ ID NO: 851028 - DNA, 15 bp, Homo sapiens
tgggaggagggagag

SEQ ID NO: 851029 - DNA, 19 bp, Homo sapiens
tgggaggagggagagggag

SEQ ID NO: 851030 - DNA, 18 bp, Homo sapiens
tgggaggatacagaggag

SEQ ID NO: 851031 - DNA, 15 bp, Homo sapiens
tgggaggatcatttg

SEQ ID NO: 851032 - DNA, 15 bp, Homo sapiens
tgggaggatcctgag

SEQ ID NO: 851033 - DNA, 20 bp, Homo sapiens
tgggaggatctcttgagcct

SEQ ID NO: 851034 - DNA, 22 bp, Homo sapiens
tgggaggatctcttgagcctgg

SEQ ID NO: 851035 - DNA, 18 bp, Homo sapiens
tgggaggattgcttgagc

SEQ ID NO: 851036 - DNA, 14 bp, Homo sapiens
tgggaggcaagaaa

SEQ ID NO: 851037 - DNA, 17 bp, Homo sapiens
tgggaggcaagaaaagg

SEQ ID NO: 851038 - DNA, 18 bp, Homo sapiens
tgggaggcaagaaaagga

SEQ ID NO: 851039 - DNA, 23 bp, Homo sapiens
tgggaggcaagaaaaggacaaat

SEQ ID NO: 851040 - DNA, 19 bp, Homo sapiens
tgggaggcaagaggggtgg

SEQ ID NO: 851041 - DNA, 20 bp, Homo sapiens
tgggaggcagaggttgcagt

SEQ ID NO: 851042 - DNA, 16 bp, Homo sapiens
tgggaggcatggccct

SEQ ID NO: 851043 - DNA, 15 bp, Homo sapiens
tgggaggccaaggca

SEQ ID NO: 851044 - DNA, 19 bp, Homo sapiens
tgggaggccaaggtgggcg

SEQ ID NO: 851045 - DNA, 16 bp, Homo sapiens
tgggaggccaggcgag

SEQ ID NO: 851046 - DNA, 20 bp, Homo sapiens
tgggaggccaggcgagcctg

SEQ ID NO: 851047 - DNA, 17 bp, Homo sapiens
tgggaggcgtgcccccc

SEQ ID NO: 851048 - DNA, 20 bp, Homo sapiens
tgggaggctcacccccttct

SEQ ID NO: 851049 - DNA, 22 bp, Homo sapiens
tgggaggctcacccccttctcc

SEQ ID NO: 851050 - DNA, 11 bp, Homo sapiens
tgggaggctga

SEQ ID NO: 851051 - DNA, 15 bp, Homo sapiens
tgggaggctgaggca

SEQ ID NO: 851052 - DNA, 16 bp, Homo sapiens
tgggaggctgaggcag

SEQ ID NO: 851053 - DNA, 14 bp, Homo sapiens
tgggaggctgtgga

SEQ ID NO: 851054 - DNA, 17 bp, Homo sapiens
tgggaggctgtggagag

SEQ ID NO: 851055 - DNA, 23 bp, Homo sapiens
tgggaggctgtggagagaagtga

SEQ ID NO: 851056 - DNA, 18 bp, Homo sapiens
tgggagggaaaagggaag

SEQ ID NO: 851057 - DNA, 16 bp, Homo sapiens
tgggagggaggctcag

SEQ ID NO: 851058 - DNA, 17 bp, Homo sapiens
tgggagggcagcagggc

SEQ ID NO: 851059 - DNA, 18 bp, Homo sapiens
tgggagggcagcagggct

SEQ ID NO: 851060 - DNA, 14 bp, Homo sapiens
tgggagggcgtcag

SEQ ID NO: 851061 - DNA, 15 bp, Homo sapiens
tgggagggcgtcagg

SEQ ID NO: 851062 - DNA, 20 bp, Homo sapiens
tgggagggcgtcaggcagag

SEQ ID NO: 851063 - DNA, 11 bp, Homo sapiens
tgggaggggca

SEQ ID NO: 851064 - DNA, 12 bp, Homo sapiens
tgggaggggcag

SEQ ID NO: 851065 - DNA, 14 bp, Homo sapiens
tgggaggggcaggc

SEQ ID NO: 851066 - DNA, 15 bp, Homo sapiens
tgggaggggcaggct

SEQ ID NO: 851067 - DNA, 20 bp, Homo sapiens
tgggagggggttggggtggt

SEQ ID NO: 851068 - DNA, 18 bp, Homo sapiens
tgggagggttcccctggc

SEQ ID NO: 851069 - DNA, 15 bp, Homo sapiens
tgggaggtaaggaaa

SEQ ID NO: 851070 - DNA, 19 bp, Homo sapiens
tgggaggtaggctgtgggg

SEQ ID NO: 851071 - DNA, 19 bp, Homo sapiens
tgggaggtcaaggctgcag

SEQ ID NO: 851072 - DNA, 20 bp, Homo sapiens
tgggaggtcaaggctgcagt

SEQ ID NO: 851073 - DNA, 23 bp, Homo sapiens
tgggaggtcaaggctgcagtgag

SEQ ID NO: 851074 - DNA, 13 bp, Homo sapiens
tgggaggtcgagg

SEQ ID NO: 851075 - DNA, 21 bp, Homo sapiens
tgggaggtgcgtgttcagcag

SEQ ID NO: 851076 - DNA, 15 bp, Homo sapiens
tgggaggtggggcct

SEQ ID NO: 851077 - DNA, 16 bp, Homo sapiens
tgggaggttgggaggc

SEQ ID NO: 851078 - DNA, 14 bp, Homo sapiens
tgggagtatgttgt

SEQ ID NO: 851079 - DNA, 15 bp, Homo sapiens
tgggagtcacacagt

SEQ ID NO: 851080 - DNA, 17 bp, Homo sapiens
tgggagtcagagccctg

SEQ ID NO: 851081 - DNA, 18 bp, Homo sapiens
tgggagtcagagccctgg

SEQ ID NO: 851082 - DNA, 20 bp, Homo sapiens
tgggagtcaggcctgggcag

SEQ ID NO: 851083 - DNA, 17 bp, Homo sapiens
tgggagtccaggcacag

SEQ ID NO: 851084 - DNA, 18 bp, Homo sapiens
tgggagtccaggcacagg

SEQ ID NO: 851085 - DNA, 13 bp, Homo sapiens
tgggagtcccctt

SEQ ID NO: 851086 - DNA, 14 bp, Homo sapiens
tgggagtcctctag

SEQ ID NO: 851087 - DNA, 17 bp, Homo sapiens
tgggagtccttacctcg

SEQ ID NO: 851088 - DNA, 11 bp, Homo sapiens
tgggagtgagg

SEQ ID NO: 851089 - DNA, 12 bp, Homo sapiens
tgggagtgaggg

SEQ ID NO: 851090 - DNA, 16 bp, Homo sapiens
tgggagtgcagagaaa

SEQ ID NO: 851091 - DNA, 14 bp, Homo sapiens
tgggagtgtgtctg

SEQ ID NO: 851092 - DNA, 19 bp, Homo sapiens
tgggagtgtgtctgctgag

SEQ ID NO: 851093 - DNA, 21 bp, Homo sapiens
tgggagtgttctgtgggcttg

SEQ ID NO: 851094 - DNA, 18 bp, Homo sapiens
tgggagtttttgtttgtt

SEQ ID NO: 851095 - DNA, 14 bp, Homo sapiens
tgggataaacatca

SEQ ID NO: 851096 - DNA, 20 bp, Homo sapiens
tgggataaaggcccagactc

SEQ ID NO: 851097 - DNA, 18 bp, Homo sapiens
tgggataagagtgtgaga

SEQ ID NO: 851098 - DNA, 16 bp, Homo sapiens
tgggataattccttgg

SEQ ID NO: 851099 - DNA, 12 bp, Homo sapiens
tgggatagagaa

SEQ ID NO: 851100 - DNA, 21 bp, Homo sapiens
tgggataggaaaaatgagtaa

SEQ ID NO: 851101 - DNA, 20 bp, Homo sapiens
tgggatagtgttctgctcct

SEQ ID NO: 851102 - DNA, 20 bp, Homo sapiens
tgggatataagaggcagcgt

SEQ ID NO: 851103 - DNA, 14 bp, Homo sapiens
tgggatatcatttt

SEQ ID NO: 851104 - DNA, 21 bp, Homo sapiens
tgggatatcattttaaaaact

SEQ ID NO: 851105 - DNA, 16 bp, Homo sapiens
tgggatatgtggtgta

SEQ ID NO: 851106 - DNA, 13 bp, Homo sapiens
tgggatcaggagc

SEQ ID NO: 851107 - DNA, 14 bp, Homo sapiens
tgggatcaggagcc

SEQ ID NO: 851108 - DNA, 15 bp, Homo sapiens
tgggatcaggagccc

SEQ ID NO: 851109 - DNA, 20 bp, Homo sapiens
tgggatcatgatagacttgt

SEQ ID NO: 851110 - DNA, 15 bp, Homo sapiens
tgggatcattgcatt

SEQ ID NO: 851111 - DNA, 19 bp, Homo sapiens
tgggatcatttttccagga

SEQ ID NO: 851112 - DNA, 21 bp, Homo sapiens
tgggatcatttttccaggact

SEQ ID NO: 851113 - DNA, 23 bp, Homo sapiens
tgggatcatttttccaggactct

SEQ ID NO: 851114 - DNA, 19 bp, Homo sapiens
tgggatccacttcttggtt

SEQ ID NO: 851115 - DNA, 20 bp, Homo sapiens
tgggatcctctccaccctcc

SEQ ID NO: 851116 - DNA, 15 bp, Homo sapiens
tgggatccttcagca

SEQ ID NO: 851117 - DNA, 17 bp, Homo sapiens
tgggcgccgtgctgggc

SEQ ID NO: 851118 - DNA, 19 bp, Homo sapiens
tgggcgccgtgctgggcag

SEQ ID NO: 851119 - DNA, 17 bp, Homo sapiens
tgggcgctgcttccagg

SEQ ID NO: 851120 - DNA, 16 bp, Homo sapiens
tgggcggtgtgtcttt

SEQ ID NO: 851121 - DNA, 18 bp, Homo sapiens
tgggcgtccagctcagcc

SEQ ID NO: 851122 - DNA, 22 bp, Homo sapiens
tgggcgtccagctcagccctgg

SEQ ID NO: 851123 - DNA, 13 bp, Homo sapiens
tgggcgtctgttc

SEQ ID NO: 851124 - DNA, 15 bp, Homo sapiens
tgggcgtctgttctt

SEQ ID NO: 851125 - DNA, 23 bp, Homo sapiens
tgggcgtgctagaggttgcagca

SEQ ID NO: 851126 - DNA, 22 bp, Homo sapiens
tgggcgtgtgtgacactgatga

SEQ ID NO: 851127 - DNA, 17 bp, Homo sapiens
tgggcgttgggagccta

SEQ ID NO: 851128 - DNA, 15 bp, Homo sapiens
tgggcgtttggggcc

SEQ ID NO: 851129 - DNA, 20 bp, Homo sapiens
tgggcgtttggggccctcta

SEQ ID NO: 851130 - DNA, 18 bp, Homo sapiens
tgggctaccctaaaggga

SEQ ID NO: 851131 - DNA, 20 bp, Homo sapiens
tgggctaccctaaagggaga

SEQ ID NO: 851132 - DNA, 15 bp, Homo sapiens
tgggctactggcagc

SEQ ID NO: 851133 - DNA, 18 bp, Homo sapiens
tgggctactggcagctcc

SEQ ID NO: 851134 - DNA, 16 bp, Homo sapiens
tgggctactttgtcct

SEQ ID NO: 851135 - DNA, 22 bp, Homo sapiens
tgggctagggagaatgcagaga

SEQ ID NO: 851136 - DNA, 17 bp, Homo sapiens
tgggctatagcacacag

SEQ ID NO: 851137 - DNA, 21 bp, Homo sapiens
tgggctatggacacagggtga

SEQ ID NO: 851138 - DNA, 18 bp, Homo sapiens
tgggctcaaccagaaaag

SEQ ID NO: 851139 - DNA, 20 bp, Homo sapiens
tgggctcaagcaatcctcct

SEQ ID NO: 851140 - DNA, 21 bp, Homo sapiens
tgggctcactgtgctggggca

SEQ ID NO: 851141 - DNA, 14 bp, Homo sapiens
tgggctcagggttg

SEQ ID NO: 851142 - DNA, 15 bp, Homo sapiens
tgggctcagggttgg

SEQ ID NO: 851143 - DNA, 17 bp, Homo sapiens
tgggctccaggcctgta

SEQ ID NO: 851144 - DNA, 12 bp, Homo sapiens
tgggctccctct

SEQ ID NO: 851145 - DNA, 15 bp, Homo sapiens
tgggctcctccaggg

SEQ ID NO: 851146 - DNA, 11 bp, Homo sapiens
tgggctcctgg

SEQ ID NO: 851147 - DNA, 20 bp, Homo sapiens
tgggctcctggctgccaggc

SEQ ID NO: 851148 - DNA, 14 bp, Homo sapiens
tgggctctccacct

SEQ ID NO: 851149 - DNA, 19 bp, Homo sapiens
tgggctctccacctcagcc

SEQ ID NO: 851150 - DNA, 20 bp, Homo sapiens
tgggctctccacctcagcct

SEQ ID NO: 851151 - DNA, 14 bp, Homo sapiens
tgggctctccgggg

SEQ ID NO: 851152 - DNA, 20 bp, Homo sapiens
tgggctctctctagctcccc

SEQ ID NO: 851153 - DNA, 16 bp, Homo sapiens
tgggctctgaacacac

SEQ ID NO: 851154 - DNA, 23 bp, Homo sapiens
tgggctctgaacacacacgccag

SEQ ID NO: 851155 - DNA, 22 bp, Homo sapiens
tgggctctgcaattcccctctg

SEQ ID NO: 851156 - DNA, 13 bp, Homo sapiens
tgggctctgccac

SEQ ID NO: 851157 - DNA, 15 bp, Homo sapiens
tgggctctgccaccc

SEQ ID NO: 851158 - DNA, 17 bp, Homo sapiens
tgggctctgccccagct

SEQ ID NO: 851159 - DNA, 20 bp, Homo sapiens
tgggctctgccccagctctg

SEQ ID NO: 851160 - DNA, 21 bp, Homo sapiens
tgggctctgccccagctctgg

SEQ ID NO: 851161 - DNA, 11 bp, Homo sapiens
tgggctctgga

SEQ ID NO: 851162 - DNA, 13 bp, Homo sapiens
tgggctctggacc

SEQ ID NO: 851163 - DNA, 22 bp, Homo sapiens
tgggctctggacctcaggaggg

SEQ ID NO: 851164 - DNA, 18 bp, Homo sapiens
tgggctctgttcttggct

SEQ ID NO: 851165 - DNA, 15 bp, Homo sapiens
tgggctgagactgga

SEQ ID NO: 851166 - DNA, 19 bp, Homo sapiens
tgggctgagcccctacccc

SEQ ID NO: 851167 - DNA, 16 bp, Homo sapiens
tgggctgagcccctgg

SEQ ID NO: 851168 - DNA, 15 bp, Homo sapiens
tgggctgagccctgg

SEQ ID NO: 851169 - DNA, 12 bp, Homo sapiens
tgggctgaggga

SEQ ID NO: 851170 - DNA, 12 bp, Homo sapiens
tgggctgagtga

SEQ ID NO: 851171 - DNA, 17 bp, Homo sapiens
tgggctgagtgcagcca

SEQ ID NO: 851172 - DNA, 15 bp, Homo sapiens
tgggctgatgctggg

SEQ ID NO: 851173 - DNA, 21 bp, Homo sapiens
tgggctgatggcctggctgcc

SEQ ID NO: 851174 - DNA, 20 bp, Homo sapiens
tgggctgcagagtctgcccc

SEQ ID NO: 851175 - DNA, 18 bp, Homo sapiens
tgggctgccaccagcccc

SEQ ID NO: 851176 - DNA, 15 bp, Homo sapiens
tgggctgccctggtg

SEQ ID NO: 851177 - DNA, 16 bp, Homo sapiens
tgggctgccctggtgc

SEQ ID NO: 851178 - DNA, 17 bp, Homo sapiens
tgggctgccctggtgct

SEQ ID NO: 851179 - DNA, 21 bp, Homo sapiens
tgggctgccctggtgctgcca

SEQ ID NO: 851180 - DNA, 15 bp, Homo sapiens
tgggctgcctgctgt

SEQ ID NO: 851181 - DNA, 16 bp, Homo sapiens
tgggctgcctgctgtg

SEQ ID NO: 851182 - DNA, 17 bp, Homo sapiens
tgggctgctacccagaa

SEQ ID NO: 851183 - DNA, 15 bp, Homo sapiens
tgggctgctggccat

SEQ ID NO: 851184 - DNA, 23 bp, Homo sapiens
tgggctggacttctacctgccct

SEQ ID NO: 851185 - DNA, 19 bp, Homo sapiens
tgggctggagtcctctcca

SEQ ID NO: 851186 - DNA, 19 bp, Homo sapiens
tgggctgggacttcttacc

SEQ ID NO: 851187 - DNA, 21 bp, Homo sapiens
tgggctgggcacctgacttgg

SEQ ID NO: 851188 - DNA, 14 bp, Homo sapiens
tgggctgggcagcc

SEQ ID NO: 851189 - DNA, 15 bp, Homo sapiens
tgggctgggcagcct

SEQ ID NO: 851190 - DNA, 19 bp, Homo sapiens
tgggctgggcagccttggg

SEQ ID NO: 851191 - DNA, 20 bp, Homo sapiens
tgggctgggccctctcttct

SEQ ID NO: 851192 - DNA, 16 bp, Homo sapiens
tgggctgggccctctt

SEQ ID NO: 851193 - DNA, 16 bp, Homo sapiens
tgggctgggctgggct

SEQ ID NO: 851194 - DNA, 17 bp, Homo sapiens
tgggctgggctgggctg

SEQ ID NO: 851195 - DNA, 16 bp, Homo sapiens
tgggctggggactctg

SEQ ID NO: 851196 - DNA, 18 bp, Homo sapiens
tgggctggggactctggc

SEQ ID NO: 851197 - DNA, 22 bp, Homo sapiens
tgggctggggactctggcacag

SEQ ID NO: 851198 - DNA, 19 bp, Homo sapiens
tgggctggggaggaggaga

SEQ ID NO: 851199 - DNA, 12 bp, Homo sapiens
tgggctggggca

SEQ ID NO: 851200 - DNA, 17 bp, Homo sapiens
tgggctggggcaggggc

SEQ ID NO: 851201 - DNA, 12 bp, Homo sapiens
tgggctgggggc

SEQ ID NO: 851202 - DNA, 23 bp, Homo sapiens
tgggctggtatctcagaaagtgc

SEQ ID NO: 851203 - DNA, 19 bp, Homo sapiens
tgggctggtattctctcta

SEQ ID NO: 851204 - DNA, 20 bp, Homo sapiens
tgggctgtaacgtggcactg

SEQ ID NO: 851205 - DNA, 15 bp, Homo sapiens
tgggctgtccagcct

SEQ ID NO: 851206 - DNA, 12 bp, Homo sapiens
tgggctgtctgt

SEQ ID NO: 851207 - DNA, 19 bp, Homo sapiens
tgggctgtctgtcaccagc

SEQ ID NO: 851208 - DNA, 21 bp, Homo sapiens
tgggctgtgttgactgctgct

SEQ ID NO: 851209 - DNA, 20 bp, Homo sapiens
tgggcttaaagcagaagccc

SEQ ID NO: 851210 - DNA, 21 bp, Homo sapiens
tgggcttatatctggcctctg

SEQ ID NO: 851211 - DNA, 13 bp, Homo sapiens
tgggcttcattct

SEQ ID NO: 851212 - DNA, 17 bp, Homo sapiens
tgggcttcattctggaa

SEQ ID NO: 851213 - DNA, 23 bp, Homo sapiens
tgggcttccatttgtgtgtgtgc

SEQ ID NO: 851214 - DNA, 15 bp, Homo sapiens
tgggcttcctgccct

SEQ ID NO: 851215 - DNA, 18 bp, Homo sapiens
tgggcttcctgcccttcc

SEQ ID NO: 851216 - DNA, 20 bp, Homo sapiens
tgggcttcctgcccttccct

SEQ ID NO: 851217 - DNA, 23 bp, Homo sapiens
tgggcttcctgcccttccctctg

SEQ ID NO: 851218 - DNA, 15 bp, Homo sapiens
tgggcttcctgctgg

SEQ ID NO: 851219 - DNA, 18 bp, Homo sapiens
tgggcttctgttctctgc

SEQ ID NO: 851220 - DNA, 20 bp, Homo sapiens
tgggcttcttcctcctccat

SEQ ID NO: 851221 - DNA, 14 bp, Homo sapiens
tgggcttgaccagg

SEQ ID NO: 851222 - DNA, 22 bp, Homo sapiens
tgggcttggacttcctggggcc

SEQ ID NO: 851223 - DNA, 19 bp, Homo sapiens
tgggcttggcctgctgtga

SEQ ID NO: 851224 - DNA, 17 bp, Homo sapiens
tgggcttggcctggaga

SEQ ID NO: 851225 - DNA, 20 bp, Homo sapiens
tgggcttggcctggagagga

SEQ ID NO: 851226 - DNA, 18 bp, Homo sapiens
tgggcttggctcttggct

SEQ ID NO: 851227 - DNA, 17 bp, Homo sapiens
tgggcttgtctgtagat

SEQ ID NO: 851228 - DNA, 14 bp, Homo sapiens
tgggcttgttttct

SEQ ID NO: 851229 - DNA, 15 bp, Homo sapiens
tgggctttctcctgg

SEQ ID NO: 851230 - DNA, 18 bp, Homo sapiens
tgggctttctcctggaga

SEQ ID NO: 851231 - DNA, 14 bp, Homo sapiens
tgggctttgcaggc

SEQ ID NO: 851232 - DNA, 16 bp, Homo sapiens
tgggctttgcaggctc

SEQ ID NO: 851233 - DNA, 17 bp, Homo sapiens
tgggctttgcaggctct

SEQ ID NO: 851234 - DNA, 21 bp, Homo sapiens
tgggctttgcaggctctgggc

SEQ ID NO: 851235 - DNA, 19 bp, Homo sapiens
tgggcttttgttctgaggg

SEQ ID NO: 851236 - DNA, 13 bp, Homo sapiens
tggggaaaatggc

SEQ ID NO: 851237 - DNA, 22 bp, Homo sapiens
tggggaaaatggccatgcagga

SEQ ID NO: 851238 - DNA, 23 bp, Homo sapiens
tggggaaaatggccatgcaggag

SEQ ID NO: 851239 - DNA, 21 bp, Homo sapiens
tggggcctgtggaatgagtgt

SEQ ID NO: 851240 - DNA, 18 bp, Homo sapiens
tggggcgggggtgtgtct

SEQ ID NO: 851241 - DNA, 20 bp, Homo sapiens
tggggctaagcggtggagga

SEQ ID NO: 851242 - DNA, 22 bp, Homo sapiens
tggggctcacttttcatccttc

SEQ ID NO: 851243 - DNA, 21 bp, Homo sapiens
tggggctcagccacagcctga

SEQ ID NO: 851244 - DNA, 13 bp, Homo sapiens
tggggctcccagc

SEQ ID NO: 851245 - DNA, 17 bp, Homo sapiens
tggggctcccagctcct

SEQ ID NO: 851246 - DNA, 14 bp, Homo sapiens
tggggctccctctc

SEQ ID NO: 851247 - DNA, 20 bp, Homo sapiens
tggggctcgccccacccagg

SEQ ID NO: 851248 - DNA, 22 bp, Homo sapiens
tggggctcgccccacccagggc

SEQ ID NO: 851249 - DNA, 14 bp, Homo sapiens
tggggctctctgac

SEQ ID NO: 851250 - DNA, 16 bp, Homo sapiens
tggggctctctgaccc

SEQ ID NO: 851251 - DNA, 19 bp, Homo sapiens
tggggctgaacatgcctgc

SEQ ID NO: 851252 - DNA, 14 bp, Homo sapiens
tggggctgcaggca

SEQ ID NO: 851253 - DNA, 18 bp, Homo sapiens
tggggctgccagcctgag

SEQ ID NO: 851254 - DNA, 19 bp, Homo sapiens
tggggctgccagcctgagc

SEQ ID NO: 851255 - DNA, 14 bp, Homo sapiens
tggggctggcctcc

SEQ ID NO: 851256 - DNA, 13 bp, Homo sapiens
tggggctgggcac

SEQ ID NO: 851257 - DNA, 23 bp, Homo sapiens
tggggctggggaagaggactgtg

SEQ ID NO: 851258 - DNA, 13 bp, Homo sapiens
tggggctggggtg

SEQ ID NO: 851259 - DNA, 20 bp, Homo sapiens
tggggctgtgttatgaaaat

SEQ ID NO: 851260 - DNA, 16 bp, Homo sapiens
tggggcttatgggtgg

SEQ ID NO: 851261 - DNA, 15 bp, Homo sapiens
tggggcttcaccagt

SEQ ID NO: 851262 - DNA, 15 bp, Homo sapiens
tggggcttctcctga

SEQ ID NO: 851263 - DNA, 16 bp, Homo sapiens
tggggcttctcctgac

SEQ ID NO: 851264 - DNA, 22 bp, Homo sapiens
tgggggaaacgggctccttccc

SEQ ID NO: 851265 - DNA, 14 bp, Homo sapiens
tgggggaaccagca

SEQ ID NO: 851266 - DNA, 23 bp, Homo sapiens
tgggggaagactttaaaccacct

SEQ ID NO: 851267 - DNA, 11 bp, Homo sapiens
tgggggaagat

SEQ ID NO: 851268 - DNA, 15 bp, Homo sapiens
tgggggaagccctgg

SEQ ID NO: 851269 - DNA, 17 bp, Homo sapiens
tgggggaaggcgctggg

SEQ ID NO: 851270 - DNA, 20 bp, Homo sapiens
tgggggaaggggaggagggg

SEQ ID NO: 851271 - DNA, 18 bp, Homo sapiens
tgggggaatgcacctccc

SEQ ID NO: 851272 - DNA, 20 bp, Homo sapiens
tgggggacagaaagagactc

SEQ ID NO: 851273 - DNA, 22 bp, Homo sapiens
tgggggagaaaaaatcactgtt

SEQ ID NO: 851274 - DNA, 15 bp, Homo sapiens
tgggggagagaggca

SEQ ID NO: 851275 - DNA, 19 bp, Homo sapiens
tgggggagagcaggctggc

SEQ ID NO: 851276 - DNA, 19 bp, Homo sapiens
tgggggaggagcctctggc

SEQ ID NO: 851277 - DNA, 15 bp, Homo sapiens
tgggggaggcagggc

SEQ ID NO: 851278 - DNA, 19 bp, Homo sapiens
tgggggaggcagggctgga

SEQ ID NO: 851279 - DNA, 21 bp, Homo sapiens
tgggggattcctgagctggcc

SEQ ID NO: 851280 - DNA, 18 bp, Homo sapiens
tgggggcacagctgtctg

SEQ ID NO: 851281 - DNA, 15 bp, Homo sapiens
tgggggcagggctgt

SEQ ID NO: 851282 - DNA, 19 bp, Homo sapiens
tgggggcagtgactggcag

SEQ ID NO: 851283 - DNA, 21 bp, Homo sapiens
tgggggcatctcttccccaga

SEQ ID NO: 851284 - DNA, 17 bp, Homo sapiens
tgggggccacctgcctg

SEQ ID NO: 851285 - DNA, 19 bp, Homo sapiens
tgggggccacctgcctgcg

SEQ ID NO: 851286 - DNA, 12 bp, Homo sapiens
tgggggccaggc

SEQ ID NO: 851287 - DNA, 15 bp, Homo sapiens
tgggggccagggctg

SEQ ID NO: 851288 - DNA, 22 bp, Homo sapiens
tgggggccagggctggatggac

SEQ ID NO: 851289 - DNA, 23 bp, Homo sapiens
tgggggccagggctggatggaca

SEQ ID NO: 851290 - DNA, 13 bp, Homo sapiens
tgggggccatgag

SEQ ID NO: 851291 - DNA, 23 bp, Homo sapiens
tgggggcccgacaggtgggcctg

SEQ ID NO: 851292 - DNA, 21 bp, Homo sapiens
tgggggcgccctctctgctcc

SEQ ID NO: 851293 - DNA, 18 bp, Homo sapiens
tgggggctggaggtgctg

SEQ ID NO: 851294 - DNA, 21 bp, Homo sapiens
tgggggctggctcccagggtg

SEQ ID NO: 851295 - DNA, 18 bp, Homo sapiens
tgggggctgtggccctgc

SEQ ID NO: 851296 - DNA, 19 bp, Homo sapiens
tgggggctgtggccctgcc

SEQ ID NO: 851297 - DNA, 19 bp, Homo sapiens
tgggggctttcggggaggg

SEQ ID NO: 851298 - DNA, 12 bp, Homo sapiens
tggggggaaaga

SEQ ID NO: 851299 - DNA, 18 bp, Homo sapiens
tggggggaaagagggagc

SEQ ID NO: 851300 - DNA, 19 bp, Homo sapiens
tggggggaaagagggagca

SEQ ID NO: 851301 - DNA, 18 bp, Homo sapiens
tggggggagagacacaga

SEQ ID NO: 851302 - DNA, 21 bp, Homo sapiens
tggggggaggaagcagaggtc

SEQ ID NO: 851303 - DNA, 20 bp, Homo sapiens
tggggggatggtaagagaaa

SEQ ID NO: 851304 - DNA, 11 bp, Homo sapiens
tggggggccaa

SEQ ID NO: 851305 - DNA, 15 bp, Homo sapiens
tggggggccaccatg

SEQ ID NO: 851306 - DNA, 19 bp, Homo sapiens
tggggggccaccatgaccc

SEQ ID NO: 851307 - DNA, 17 bp, Homo sapiens
tggggggccgggcaggt

SEQ ID NO: 851308 - DNA, 20 bp, Homo sapiens
tggggggccgggcaggtcct

SEQ ID NO: 851309 - DNA, 17 bp, Homo sapiens
tggggggcgggccaggg

SEQ ID NO: 851310 - DNA, 15 bp, Homo sapiens
tgggggggctgcctt

SEQ ID NO: 851311 - DNA, 13 bp, Homo sapiens
tgggggggtggcc

SEQ ID NO: 851312 - DNA, 15 bp, Homo sapiens
tgggggtagagctga

SEQ ID NO: 851313 - DNA, 17 bp, Homo sapiens
tgggggtagcagctgga

SEQ ID NO: 851314 - DNA, 18 bp, Homo sapiens
tgggggtagcagctggac

SEQ ID NO: 851315 - DNA, 14 bp, Homo sapiens
tgggggtagcctgg

SEQ ID NO: 851316 - DNA, 18 bp, Homo sapiens
tgggggtcaggcagccag

SEQ ID NO: 851317 - DNA, 15 bp, Homo sapiens
tgggggtgagggtcc

SEQ ID NO: 851318 - DNA, 16 bp, Homo sapiens
tgggggtgcaggcagc

SEQ ID NO: 851319 - DNA, 19 bp, Homo sapiens
tgggggtggaggcttcctg

SEQ ID NO: 851320 - DNA, 14 bp, Homo sapiens
tgggggtggccatc

SEQ ID NO: 851321 - DNA, 14 bp, Homo sapiens
tgggggtgggcagc

SEQ ID NO: 851322 - DNA, 17 bp, Homo sapiens
tgggggtgggcagcagc

SEQ ID NO: 851323 - DNA, 13 bp, Homo sapiens
tgggggtgggcca

SEQ ID NO: 851324 - DNA, 23 bp, Homo sapiens
tgggggtggggaggcccaaatga

SEQ ID NO: 851325 - DNA, 17 bp, Homo sapiens
tgggggttctggcagga

SEQ ID NO: 851326 - DNA, 20 bp, Homo sapiens
tgggggttctttcttcctct

SEQ ID NO: 851327 - DNA, 18 bp, Homo sapiens
tgggggttgtaaattggc

SEQ ID NO: 851328 - DNA, 20 bp, Homo sapiens
tgggggttttcaatgtgaaa

SEQ ID NO: 851329 - DNA, 16 bp, Homo sapiens
tggggtaagccagagc

SEQ ID NO: 851330 - DNA, 13 bp, Homo sapiens
tggggtacaggca

SEQ ID NO: 851331 - DNA, 15 bp, Homo sapiens
tggggtacaggcagt

SEQ ID NO: 851332 - DNA, 20 bp, Homo sapiens
tggggtacaggtttggggag

SEQ ID NO: 851333 - DNA, 20 bp, Homo sapiens
tggggtatggattctaaaat

SEQ ID NO: 851334 - DNA, 16 bp, Homo sapiens
tggggtatgtgtgtgt

SEQ ID NO: 851335 - DNA, 20 bp, Homo sapiens
tggggtatgtgtgtgtgggt

SEQ ID NO: 851336 - DNA, 24 bp, Homo sapiens
tggggtatttaccacagcagctga

SEQ ID NO: 851337 - DNA, 20 bp, Homo sapiens
tggggtcaagaaacagccag

SEQ ID NO: 851338 - DNA, 22 bp, Homo sapiens
tggggtcaagaaacagccagca

SEQ ID NO: 851339 - DNA, 13 bp, Homo sapiens
tggggtcagccag

SEQ ID NO: 851340 - DNA, 15 bp, Homo sapiens
tggggtcagccaggg

SEQ ID NO: 851341 - DNA, 19 bp, Homo sapiens
tggggtcagccagggccag

SEQ ID NO: 851342 - DNA, 18 bp, Homo sapiens
tggggtcagccccaaggg

SEQ ID NO: 851343 - DNA, 19 bp, Homo sapiens
tggggtcagccccaagggc

SEQ ID NO: 851344 - DNA, 21 bp, Homo sapiens
tggggtcatgaagggctggaa

SEQ ID NO: 851345 - DNA, 13 bp, Homo sapiens
tggggtcatgccc

SEQ ID NO: 851346 - DNA, 18 bp, Homo sapiens
tggggtcatgccctcctc

SEQ ID NO: 851347 - DNA, 20 bp, Homo sapiens
tggggtcatgccctcctctc

SEQ ID NO: 851348 - DNA, 14 bp, Homo sapiens
tggggtccagggag

SEQ ID NO: 851349 - DNA, 17 bp, Homo sapiens
tggggtccctccacccc

SEQ ID NO: 851350 - DNA, 19 bp, Homo sapiens
tggggtctccctctcctgc

SEQ ID NO: 851351 - DNA, 16 bp, Homo sapiens
tggggtctctctccct

SEQ ID NO: 851352 - DNA, 19 bp, Homo sapiens
tggggtctgagcatgatgg

SEQ ID NO: 851353 - DNA, 13 bp, Homo sapiens
tggggtctgggag

SEQ ID NO: 851354 - DNA, 14 bp, Homo sapiens
tggggtctgggcag

SEQ ID NO: 851355 - DNA, 19 bp, Homo sapiens
tggggtctgtgactggatc

SEQ ID NO: 851356 - DNA, 20 bp, Homo sapiens
tggggtctgtgactggatct

SEQ ID NO: 851357 - DNA, 16 bp, Homo sapiens
tggggtgaacagctgg

SEQ ID NO: 851358 - DNA, 20 bp, Homo sapiens
tggggtgaacagctggtgcc

SEQ ID NO: 851359 - DNA, 12 bp, Homo sapiens
tggggtgaatac

SEQ ID NO: 851360 - DNA, 15 bp, Homo sapiens
tggggtgaatactta

SEQ ID NO: 851361 - DNA, 16 bp, Homo sapiens
tgggtgggctctgtgc

SEQ ID NO: 851362 - DNA, 18 bp, Homo sapiens
tgggtggggaggccctgc

SEQ ID NO: 851363 - DNA, 20 bp, Homo sapiens
tgggtggggcagcacacctc

SEQ ID NO: 851364 - DNA, 21 bp, Homo sapiens
tgggtggggctgctcctccag

SEQ ID NO: 851365 - DNA, 20 bp, Homo sapiens
tgggtggggtgaggaccact

SEQ ID NO: 851366 - DNA, 13 bp, Homo sapiens
tgggtggtaccct

SEQ ID NO: 851367 - DNA, 14 bp, Homo sapiens
tgggtggtggatct

SEQ ID NO: 851368 - DNA, 14 bp, Homo sapiens
tgggtggttcctaa

SEQ ID NO: 851369 - DNA, 15 bp, Homo sapiens
tgggtggttcctaag

SEQ ID NO: 851370 - DNA, 16 bp, Homo sapiens
tgggtgtattctctgt

SEQ ID NO: 851371 - DNA, 17 bp, Homo sapiens
tgggtgtattctctgta

SEQ ID NO: 851372 - DNA, 20 bp, Homo sapiens
tgggtgtcatttcattccat

SEQ ID NO: 851373 - DNA, 20 bp, Homo sapiens
tgggtgtccgccatccaggg

SEQ ID NO: 851374 - DNA, 12 bp, Homo sapiens
tgggtgtcctgc

SEQ ID NO: 851375 - DNA, 15 bp, Homo sapiens
tgggtgtcctgcctg

SEQ ID NO: 851376 - DNA, 13 bp, Homo sapiens
tgggtgtctccct

SEQ ID NO: 851377 - DNA, 23 bp, Homo sapiens
tgggtgtctccctcgggggctct

SEQ ID NO: 851378 - DNA, 14 bp, Homo sapiens
tgggtgtggccagc

SEQ ID NO: 851379 - DNA, 14 bp, Homo sapiens
tgggtgtgtgcgcc

SEQ ID NO: 851380 - DNA, 14 bp, Homo sapiens
tgggtgttaatttt

SEQ ID NO: 851381 - DNA, 16 bp, Homo sapiens
tgggtgttctttcctg

SEQ ID NO: 851382 - DNA, 15 bp, Homo sapiens
tgggtgtttcagttt

SEQ ID NO: 851383 - DNA, 18 bp, Homo sapiens
tgggttaaacaaaatgaa

SEQ ID NO: 851384 - DNA, 23 bp, Homo sapiens
tgggttaaacaaaatgaaaatat

SEQ ID NO: 851385 - DNA, 14 bp, Homo sapiens
tgggttaagtatta

SEQ ID NO: 851386 - DNA, 14 bp, Homo sapiens
tgggttaatggcta

SEQ ID NO: 851387 - DNA, 23 bp, Homo sapiens
tgggttaatggctagtactgtat

SEQ ID NO: 851388 - DNA, 22 bp, Homo sapiens
tgggttagctaaaccaagaagg

SEQ ID NO: 851389 - DNA, 21 bp, Homo sapiens
tgggttcagaaatgctgcctg

SEQ ID NO: 851390 - DNA, 22 bp, Homo sapiens
tgggttcagaaatgctgcctgc

SEQ ID NO: 851391 - DNA, 16 bp, Homo sapiens
tgggttcattattgga

SEQ ID NO: 851392 - DNA, 18 bp, Homo sapiens
tgggttcattattggaat

SEQ ID NO: 851393 - DNA, 15 bp, Homo sapiens
tgggttccgggaggc

SEQ ID NO: 851394 - DNA, 14 bp, Homo sapiens
tgggttcctcctct

SEQ ID NO: 851395 - DNA, 21 bp, Homo sapiens
tgggttcctcttccccactcc

SEQ ID NO: 851396 - DNA, 15 bp, Homo sapiens
tgggttcgttgggga

SEQ ID NO: 851397 - DNA, 17 bp, Homo sapiens
tgggttctgatattgcc

SEQ ID NO: 851398 - DNA, 16 bp, Homo sapiens
tgggttcttgttttat

SEQ ID NO: 851399 - DNA, 22 bp, Homo sapiens
tgggttgatctcttagaagcca

SEQ ID NO: 851400 - DNA, 14 bp, Homo sapiens
tgggttggccagga

SEQ ID NO: 851401 - DNA, 15 bp, Homo sapiens
tgggttggtgcacag

SEQ ID NO: 851402 - DNA, 16 bp, Homo sapiens
tgggttgtttccagga

SEQ ID NO: 851403 - DNA, 17 bp, Homo sapiens
tgggttgtttccaggag

SEQ ID NO: 851404 - DNA, 17 bp, Homo sapiens
tgggtttctctgtgctc

SEQ ID NO: 851405 - DNA, 14 bp, Homo sapiens
tgggtttgagaaat

SEQ ID NO: 851406 - DNA, 18 bp, Homo sapiens
tgggtttgcccagtcctg

SEQ ID NO: 851407 - DNA, 22 bp, Homo sapiens
tgggtttggccagggaggcgca

SEQ ID NO: 851408 - DNA, 18 bp, Homo sapiens
tgggtttggggccatggt

SEQ ID NO: 851409 - DNA, 17 bp, Homo sapiens
tgggtttgggtgcctcc

SEQ ID NO: 851410 - DNA, 20 bp, Homo sapiens
tgggtttgggtgcctcctgc

SEQ ID NO: 851411 - DNA, 19 bp, Homo sapiens
tgggttttattgtccttca

SEQ ID NO: 851412 - DNA, 24 bp, Homo sapiens
tgggttttcttcccatcactggag

SEQ ID NO: 851413 - DNA, 19 bp, Homo sapiens
tgggttttgtattctctga

SEQ ID NO: 851414 - DNA, 21 bp, Homo sapiens
tgggttttgtattctctgagc

SEQ ID NO: 851415 - DNA, 15 bp, Homo sapiens
tgggtttttgttacc

SEQ ID NO: 851416 - DNA, 22 bp, Homo sapiens
tgggtttttgttacctttatgg

SEQ ID NO: 851417 - DNA, 16 bp, Homo sapiens
tggtaaaaatgctgct

SEQ ID NO: 851418 - DNA, 17 bp, Homo sapiens
tggtaaaaatgctgctc

SEQ ID NO: 851419 - DNA, 19 bp, Homo sapiens
tggtaaaaatgctgctctc

SEQ ID NO: 851420 - DNA, 15 bp, Homo sapiens
tggtaaaacattact

SEQ ID NO: 851421 - DNA, 18 bp, Homo sapiens
tggtaaacattcctccag

SEQ ID NO: 851422 - DNA, 24 bp, Homo sapiens
tggtaaacattcctccagcctccc

SEQ ID NO: 851423 - DNA, 16 bp, Homo sapiens
tggtaaagactggctt

SEQ ID NO: 851424 - DNA, 17 bp, Homo sapiens
tggtaaagactggcttt

SEQ ID NO: 851425 - DNA, 11 bp, Homo sapiens
tggtaaatatg

SEQ ID NO: 851426 - DNA, 20 bp, Homo sapiens
tggtaaattctggtatacat

SEQ ID NO: 851427 - DNA, 22 bp, Homo sapiens
tggtaaattctggtatacattg

SEQ ID NO: 851428 - DNA, 18 bp, Homo sapiens
tggtaaatttttgaaaaa

SEQ ID NO: 851429 - DNA, 13 bp, Homo sapiens
tggtaacataaca

SEQ ID NO: 851430 - DNA, 15 bp, Homo sapiens
tggtaaccaaatatt

SEQ ID NO: 851431 - DNA, 19 bp, Homo sapiens
tggtaacgtggctccacct

SEQ ID NO: 851432 - DNA, 16 bp, Homo sapiens
tggtaacttttgtgaa

SEQ ID NO: 851433 - DNA, 13 bp, Homo sapiens
tggtaagagaaaa

SEQ ID NO: 851434 - DNA, 20 bp, Homo sapiens
tggtaagagacagaatgtat

SEQ ID NO: 851435 - DNA, 18 bp, Homo sapiens
tggtaagatgactctgag

SEQ ID NO: 851436 - DNA, 19 bp, Homo sapiens
tggtaagatgactctgaga

SEQ ID NO: 851437 - DNA, 18 bp, Homo sapiens
tggtaagattgttattaa

SEQ ID NO: 851438 - DNA, 20 bp, Homo sapiens
tggtaagcgatttgaaacac

SEQ ID NO: 851439 - DNA, 14 bp, Homo sapiens
tggtaagctctggc

SEQ ID NO: 851440 - DNA, 13 bp, Homo sapiens
tggtaatatacaa

SEQ ID NO: 851441 - DNA, 14 bp, Homo sapiens
tggtaatattgact

SEQ ID NO: 851442 - DNA, 22 bp, Homo sapiens
tggtaatctttacctgtataca

SEQ ID NO: 851443 - DNA, 14 bp, Homo sapiens
tggtacaaaaataa

SEQ ID NO: 851444 - DNA, 18 bp, Homo sapiens
tggtacaaaaataaattt

SEQ ID NO: 851445 - DNA, 15 bp, Homo sapiens
tggtacaaatgtgat

SEQ ID NO: 851446 - DNA, 20 bp, Homo sapiens
tggtacagcagggtcttgct

SEQ ID NO: 851447 - DNA, 22 bp, Homo sapiens
tggtacagtatgggggttgtaa

SEQ ID NO: 851448 - DNA, 15 bp, Homo sapiens
tggtacatggccagt

SEQ ID NO: 851449 - DNA, 17 bp, Homo sapiens
tggtacccagccatctg

SEQ ID NO: 851450 - DNA, 18 bp, Homo sapiens
tggtacccagccatctgc

SEQ ID NO: 851451 - DNA, 21 bp, Homo sapiens
tggtacccagccatctgccca

SEQ ID NO: 851452 - DNA, 16 bp, Homo sapiens
tggtaccccccctttt

SEQ ID NO: 851453 - DNA, 17 bp, Homo sapiens
tggtaccttcagccctg

SEQ ID NO: 851454 - DNA, 21 bp, Homo sapiens
tggtaccttcagccctggcca

SEQ ID NO: 851455 - DNA, 18 bp, Homo sapiens
tggtacggagatgtttca

SEQ ID NO: 851456 - DNA, 20 bp, Homo sapiens
tggtactactagatgtcttt

SEQ ID NO: 851457 - DNA, 17 bp, Homo sapiens
tggtactcattaaaaaa

SEQ ID NO: 851458 - DNA, 19 bp, Homo sapiens
tggtactctaatcagtcct

SEQ ID NO: 851459 - DNA, 21 bp, Homo sapiens
tggtactgactttgcttgctt

SEQ ID NO: 851460 - DNA, 15 bp, Homo sapiens
tggtactgctgtctt

SEQ ID NO: 851461 - DNA, 19 bp, Homo sapiens
tggtactgctgtcttccaa

SEQ ID NO: 851462 - DNA, 24 bp, Homo sapiens
tggtacttagagtttctgtttgat

SEQ ID NO: 851463 - DNA, 19 bp, Homo sapiens
tggtacttattactgctaa

SEQ ID NO: 851464 - DNA, 19 bp, Homo sapiens
tggtactttattcttgctg

SEQ ID NO: 851465 - DNA, 21 bp, Homo sapiens
tggtactttattcttgctggg

SEQ ID NO: 851466 - DNA, 20 bp, Homo sapiens
tggtagaaaaaggggcctga

SEQ ID NO: 851467 - DNA, 23 bp, Homo sapiens
tggtagaagtgagagctttgctt

SEQ ID NO: 851468 - DNA, 22 bp, Homo sapiens
tggtagacgagctgtctgctgc

SEQ ID NO: 851469 - DNA, 23 bp, Homo sapiens
tggtagacgagctgtctgctgcc

SEQ ID NO: 851470 - DNA, 20 bp, Homo sapiens
tggtagagtgtgcctgaagt

SEQ ID NO: 851471 - DNA, 21 bp, Homo sapiens
tggtagatcttcaatttggat

SEQ ID NO: 851472 - DNA, 14 bp, Homo sapiens
tggtagctgagggg

SEQ ID NO: 851473 - DNA, 15 bp, Homo sapiens
tggtagctgagggga

SEQ ID NO: 851474 - DNA, 20 bp, Homo sapiens
tggtagcttgtatcaaatgt

SEQ ID NO: 851475 - DNA, 20 bp, Homo sapiens
tggtagcttttcccttcttt

SEQ ID NO: 851476 - DNA, 21 bp, Homo sapiens
tggtagcttttcccttctttt

SEQ ID NO: 851477 - DNA, 22 bp, Homo sapiens
tggtaggatcagccctcatttt

SEQ ID NO: 851478 - DNA, 13 bp, Homo sapiens
tggtaggattgct

SEQ ID NO: 851479 - DNA, 22 bp, Homo sapiens
tggtagggatgaggtctgataa

SEQ ID NO: 851480 - DNA, 17 bp, Homo sapiens
tggtaggggagggcagg

SEQ ID NO: 851481 - DNA, 16 bp, Homo sapiens
tggtaggggcagggag

SEQ ID NO: 851482 - DNA, 12 bp, Homo sapiens
tggtggtgcagc

SEQ ID NO: 851483 - DNA, 18 bp, Homo sapiens
tggtggttattttaaata

SEQ ID NO: 851484 - DNA, 14 bp, Homo sapiens
tggtggttgctgtt

SEQ ID NO: 851485 - DNA, 14 bp, Homo sapiens
tggtggttgtgcct

SEQ ID NO: 851486 - DNA, 18 bp, Homo sapiens
tggtggtttcagaaatgt

SEQ ID NO: 851487 - DNA, 19 bp, Homo sapiens
tggtggttttctgttcttt

SEQ ID NO: 851488 - DNA, 20 bp, Homo sapiens
tggtgtactgggttaatggc

SEQ ID NO: 851489 - DNA, 23 bp, Homo sapiens
tggtgtatatcatgaagccttgc

SEQ ID NO: 851490 - DNA, 23 bp, Homo sapiens
tggtgtatcccccccctgtatag

SEQ ID NO: 851491 - DNA, 17 bp, Homo sapiens
tggtgtattatcatttt

SEQ ID NO: 851492 - DNA, 17 bp, Homo sapiens
tggtgtcagcccctctt

SEQ ID NO: 851493 - DNA, 20 bp, Homo sapiens
tggtgtcagcccctcttccc

SEQ ID NO: 851494 - DNA, 23 bp, Homo sapiens
tggtgtcagcccctcttcccttc

SEQ ID NO: 851495 - DNA, 14 bp, Homo sapiens
tggtgtcaggcagg

SEQ ID NO: 851496 - DNA, 18 bp, Homo sapiens
tggtgtcagtatccaggc

SEQ ID NO: 851497 - DNA, 15 bp, Homo sapiens
tggtgtccacctggc

SEQ ID NO: 851498 - DNA, 17 bp, Homo sapiens
tggtgtccacctggccc

SEQ ID NO: 851499 - DNA, 17 bp, Homo sapiens
tggtgtccagctgagtt

SEQ ID NO: 851500 - DNA, 16 bp, Homo sapiens
tggtgtccccttcccc

SEQ ID NO: 851501 - DNA, 21 bp, Homo sapiens
tggtgtccccttcccctgctg

SEQ ID NO: 851502 - DNA, 22 bp, Homo sapiens
tggtgtcccggtaccttccata

SEQ ID NO: 851503 - DNA, 14 bp, Homo sapiens
tggtgtcctgacca

SEQ ID NO: 851504 - DNA, 15 bp, Homo sapiens
tggtgtcgggccctt

SEQ ID NO: 851505 - DNA, 22 bp, Homo sapiens
tggtgtctcccaacatgggagg

SEQ ID NO: 851506 - DNA, 15 bp, Homo sapiens
tggtgtctttgatca

SEQ ID NO: 851507 - DNA, 18 bp, Homo sapiens
tggtgtgaccatgttcat

SEQ ID NO: 851508 - DNA, 18 bp, Homo sapiens
tggtgtgaccctctgaat

SEQ ID NO: 851509 - DNA, 17 bp, Homo sapiens
tggtgtgattgcacaga

SEQ ID NO: 851510 - DNA, 17 bp, Homo sapiens
tggtgtggcccgtggcc

SEQ ID NO: 851511 - DNA, 17 bp, Homo sapiens
tggtgtgggtgtcctgc

SEQ ID NO: 851512 - DNA, 23 bp, Homo sapiens
tggtgtgggtgtcctgcctgtct

SEQ ID NO: 851513 - DNA, 19 bp, Homo sapiens
tggtgttaaagctgtacac

SEQ ID NO: 851514 - DNA, 23 bp, Homo sapiens
tggtgttacacagcccaagagga

SEQ ID NO: 851515 - DNA, 15 bp, Homo sapiens
tggtgttacattaaa

SEQ ID NO: 851516 - DNA, 20 bp, Homo sapiens
tggtgttcaccaaaaccaaa

SEQ ID NO: 851517 - DNA, 13 bp, Homo sapiens
tggtgttcctgga

SEQ ID NO: 851518 - DNA, 18 bp, Homo sapiens
tggtgttcgtttccatca

SEQ ID NO: 851519 - DNA, 16 bp, Homo sapiens
tggtgttgacatacat

SEQ ID NO: 851520 - DNA, 21 bp, Homo sapiens
tggtgttgggaaggggtcctg

SEQ ID NO: 851521 - DNA, 22 bp, Homo sapiens
tggtgttgggaaggggtcctgc

SEQ ID NO: 851522 - DNA, 16 bp, Homo sapiens
tggtgtttatgcacac

SEQ ID NO: 851523 - DNA, 20 bp, Homo sapiens
tggtgtttgtaggctgtggg

SEQ ID NO: 851524 - DNA, 17 bp, Homo sapiens
tggtgttttgtcagact

SEQ ID NO: 851525 - DNA, 19 bp, Homo sapiens
tggtgttttttgttactgt

SEQ ID NO: 851526 - DNA, 20 bp, Homo sapiens
tggttaaaaaaaagaataaa

SEQ ID NO: 851527 - DNA, 13 bp, Homo sapiens
tggttaaaaaggc

SEQ ID NO: 851528 - DNA, 18 bp, Homo sapiens
tggttaaaagggaacaca

SEQ ID NO: 851529 - DNA, 19 bp, Homo sapiens
tggttaaaagggaacacaa

SEQ ID NO: 851530 - DNA, 17 bp, Homo sapiens
tggttaaaataaagcct

SEQ ID NO: 851531 - DNA, 15 bp, Homo sapiens
tggttaaaatgtgat

SEQ ID NO: 851532 - DNA, 18 bp, Homo sapiens
tggttaaaatgtgatttt

SEQ ID NO: 851533 - DNA, 21 bp, Homo sapiens
tggttaagcaggcattgcttt

SEQ ID NO: 851534 - DNA, 15 bp, Homo sapiens
tggttaataaaactg

SEQ ID NO: 851535 - DNA, 19 bp, Homo sapiens
tggttaataaaactgcaca

SEQ ID NO: 851536 - DNA, 22 bp, Homo sapiens
tggttaatttttcctgcatgtt

SEQ ID NO: 851537 - DNA, 19 bp, Homo sapiens
tggttacagtgcagacagg

SEQ ID NO: 851538 - DNA, 16 bp, Homo sapiens
tggttaccactctttt

SEQ ID NO: 851539 - DNA, 16 bp, Homo sapiens
tggttaccgagtatct

SEQ ID NO: 851540 - DNA, 19 bp, Homo sapiens
tggttaccgagtatctgta

SEQ ID NO: 851541 - DNA, 21 bp, Homo sapiens
tggttaccgagtatctgtaac

SEQ ID NO: 851542 - DNA, 23 bp, Homo sapiens
tggttacctgacctaaattagat

SEQ ID NO: 851543 - DNA, 16 bp, Homo sapiens
tggttactagtacagg

SEQ ID NO: 851544 - DNA, 17 bp, Homo sapiens
tggttagtatttaacta

SEQ ID NO: 851545 - DNA, 14 bp, Homo sapiens
tggttagtgtgaaa

SEQ ID NO: 851546 - DNA, 17 bp, Homo sapiens
tggttagttaactgaat

SEQ ID NO: 851547 - DNA, 17 bp, Homo sapiens
tggttatcactttaagt

SEQ ID NO: 851548 - DNA, 14 bp, Homo sapiens
tggttatggagtct

SEQ ID NO: 851549 - DNA, 18 bp, Homo sapiens
tggttattcattattcct

SEQ ID NO: 851550 - DNA, 21 bp, Homo sapiens
tggttattcattattcctcag

SEQ ID NO: 851551 - DNA, 13 bp, Homo sapiens
tggttatttttct

SEQ ID NO: 851552 - DNA, 23 bp, Homo sapiens
tggttatttttctcttgtaccat

SEQ ID NO: 851553 - DNA, 20 bp, Homo sapiens
tggttcacttcaaagctaaa

SEQ ID NO: 851554 - DNA, 17 bp, Homo sapiens
tggttcagaataaattg

SEQ ID NO: 851555 - DNA, 21 bp, Homo sapiens
tggttcagaattaaactttta

SEQ ID NO: 851556 - DNA, 17 bp, Homo sapiens
tggttcagacacagctc

SEQ ID NO: 851557 - DNA, 18 bp, Homo sapiens
tggttcagacacagctct

SEQ ID NO: 851558 - DNA, 22 bp, Homo sapiens
tggttcagacacagctcttcca

SEQ ID NO: 851559 - DNA, 13 bp, Homo sapiens
tggttcataaatg

SEQ ID NO: 851560 - DNA, 16 bp, Homo sapiens
tggttcataaatgaat

SEQ ID NO: 851561 - DNA, 23 bp, Homo sapiens
tggttcatcagtgttaaaaaatt

SEQ ID NO: 851562 - DNA, 20 bp, Homo sapiens
tggttccaaaccagtttatt

SEQ ID NO: 851563 - DNA, 21 bp, Homo sapiens
tggttccaaaccagtttattc

SEQ ID NO: 851564 - DNA, 20 bp, Homo sapiens
tggttccaagaaagatccac

SEQ ID NO: 851565 - DNA, 22 bp, Homo sapiens
tggttccagggtccctctgtgt

SEQ ID NO: 851566 - DNA, 22 bp, Homo sapiens
tggttccatgcctgagggtgga

SEQ ID NO: 851567 - DNA, 15 bp, Homo sapiens
tggttcccaataaaa

SEQ ID NO: 851568 - DNA, 19 bp, Homo sapiens
tggttcccaataaaagtga

SEQ ID NO: 851569 - DNA, 23 bp, Homo sapiens
tggttcccctgttcactctactt

SEQ ID NO: 851570 - DNA, 17 bp, Homo sapiens
tggttcctaagcctgtt

SEQ ID NO: 851571 - DNA, 16 bp, Homo sapiens
tggttcctaagggaaa

SEQ ID NO: 851572 - DNA, 16 bp, Homo sapiens
tggttcctctctccca

SEQ ID NO: 851573 - DNA, 13 bp, Homo sapiens
tggttcctctgct

SEQ ID NO: 851574 - DNA, 16 bp, Homo sapiens
tggttcctgtttgaaa

SEQ ID NO: 851575 - DNA, 19 bp, Homo sapiens
tggttcctgtttgaaacta

SEQ ID NO: 851576 - DNA, 16 bp, Homo sapiens
tggttccttccctggg

SEQ ID NO: 851577 - DNA, 14 bp, Homo sapiens
tggttccttctctg

SEQ ID NO: 851578 - DNA, 16 bp, Homo sapiens
tggttccttctctggg

SEQ ID NO: 851579 - DNA, 17 bp, Homo sapiens
tggttccttctctgggt

SEQ ID NO: 851580 - DNA, 17 bp, Homo sapiens
tggttcctttctcagcc

SEQ ID NO: 851581 - DNA, 14 bp, Homo sapiens
tggttctatttaat

SEQ ID NO: 851582 - DNA, 11 bp, Homo sapiens
tggttctcaat

SEQ ID NO: 851583 - DNA, 22 bp, Homo sapiens
tggttctcatttggtctgccag

SEQ ID NO: 851584 - DNA, 16 bp, Homo sapiens
tggttctcttcatcca

SEQ ID NO: 851585 - DNA, 13 bp, Homo sapiens
tggttctgtgaac

SEQ ID NO: 851586 - DNA, 16 bp, Homo sapiens
tggttcttcctttccc

SEQ ID NO: 851587 - DNA, 18 bp, Homo sapiens
tggttcttgggtggtttt

SEQ ID NO: 851588 - DNA, 15 bp, Homo sapiens
tggttctttcagctg

SEQ ID NO: 851589 - DNA, 22 bp, Homo sapiens
tggttgaagacaccagactgaa

SEQ ID NO: 851590 - DNA, 12 bp, Homo sapiens
tggttgaataaa

SEQ ID NO: 851591 - DNA, 17 bp, Homo sapiens
tggttgagaaatgaata

SEQ ID NO: 851592 - DNA, 15 bp, Homo sapiens
tggttgatggaaaat

SEQ ID NO: 851593 - DNA, 18 bp, Homo sapiens
tggttgatggaaaataaa

SEQ ID NO: 851594 - DNA, 15 bp, Homo sapiens
tggttgatgggttct

SEQ ID NO: 851595 - DNA, 11 bp, Homo sapiens
tggttgcatgg

SEQ ID NO: 851596 - DNA, 12 bp, Homo sapiens
tggttgcctccc

SEQ ID NO: 851597 - DNA, 23 bp, Homo sapiens
tggttgcctctcttgccccttgt

SEQ ID NO: 851598 - DNA, 15 bp, Homo sapiens
tggttgcctgccctc

SEQ ID NO: 851599 - DNA, 23 bp, Homo sapiens
tggttggaagctaccagagctct

SEQ ID NO: 851600 - DNA, 15 bp, Homo sapiens
tggttggagagccct

SEQ ID NO: 851601 - DNA, 17 bp, Homo sapiens
tggttggctggttgttt

SEQ ID NO: 851602 - DNA, 22 bp, Homo sapiens
tggttgggtcaaggacagggct

SEQ ID NO: 851603 - DNA, 14 bp, Homo sapiens
tggttggtgtgaag

SEQ ID NO: 851604 - DNA, 24 bp, Homo sapiens
tggttggttttgacttcagattga

SEQ ID NO: 851605 - DNA, 17 bp, Homo sapiens
tggttgtaaatgctcgt

SEQ ID NO: 851606 - DNA, 12 bp, Homo sapiens
tggttgtatttc

SEQ ID NO: 851607 - DNA, 23 bp, Homo sapiens
tggttgtcatttttgcagtagag

SEQ ID NO: 851608 - DNA, 20 bp, Homo sapiens
tggttgtctagtcattgtca

SEQ ID NO: 851609 - DNA, 22 bp, Homo sapiens
tggttgttagttatagatgtct

SEQ ID NO: 851610 - DNA, 12 bp, Homo sapiens
tggttgttgcca

SEQ ID NO: 851611 - DNA, 17 bp, Homo sapiens
tggttgtttctgttcca

SEQ ID NO: 851612 - DNA, 22 bp, Homo sapiens
tggtttaaaaagtttcacgtct

SEQ ID NO: 851613 - DNA, 15 bp, Homo sapiens
tggtttaaagaaagt

SEQ ID NO: 851614 - DNA, 15 bp, Homo sapiens
tggtttaatttaaag

SEQ ID NO: 851615 - DNA, 20 bp, Homo sapiens
tggtttacaggccctgctcc

SEQ ID NO: 851616 - DNA, 21 bp, Homo sapiens
tggtttatagagggccaagac

SEQ ID NO: 851617 - DNA, 16 bp, Homo sapiens
tggtttatgactttgt

SEQ ID NO: 851618 - DNA, 18 bp, Homo sapiens
tggtttcaccttccctcg

SEQ ID NO: 851619 - DNA, 15 bp, Homo sapiens
tggtttcatgttagt

SEQ ID NO: 851620 - DNA, 20 bp, Homo sapiens
tggtttccacgatgaaaaac

SEQ ID NO: 851621 - DNA, 13 bp, Homo sapiens
tggtttcccaaga

SEQ ID NO: 851622 - DNA, 20 bp, Homo sapiens
tggtttcccccttctacatt

SEQ ID NO: 851623 - DNA, 15 bp, Homo sapiens
tggtttccctgcccc

SEQ ID NO: 851624 - DNA, 16 bp, Homo sapiens
tggtttccctgcccct

SEQ ID NO: 851625 - DNA, 16 bp, Homo sapiens
tggtttcggaaaaaaa

SEQ ID NO: 851626 - DNA, 24 bp, Homo sapiens
tggtttctacttcccctgggatgc

SEQ ID NO: 851627 - DNA, 17 bp, Homo sapiens
tggtttctcattaaact

SEQ ID NO: 851628 - DNA, 21 bp, Homo sapiens
tggtttctctctacagtgcca

SEQ ID NO: 851629 - DNA, 13 bp, Homo sapiens
tggtttctgaaaa

SEQ ID NO: 851630 - DNA, 14 bp, Homo sapiens
tggtttctgcttct

SEQ ID NO: 851631 - DNA, 22 bp, Homo sapiens
tggtttgaaagattatgatgca

SEQ ID NO: 851632 - DNA, 17 bp, Homo sapiens
tggtttgagcttagtga

SEQ ID NO: 851633 - DNA, 23 bp, Homo sapiens
tggtttgagcttagtgaaattac

SEQ ID NO: 851634 - DNA, 15 bp, Homo sapiens
tggtttgcagctgtt

SEQ ID NO: 851635 - DNA, 24 bp, Homo sapiens
tggtttgcagctgttttcaaagcc

SEQ ID NO: 851636 - DNA, 22 bp, Homo sapiens
tggtttggattactattgcaaa

SEQ ID NO: 851637 - DNA, 21 bp, Homo sapiens
tggtttggtcagttacaaagt

SEQ ID NO: 851638 - DNA, 15 bp, Homo sapiens
tggtttgtaaaatcc

SEQ ID NO: 851639 - DNA, 20 bp, Homo sapiens
tggtttgtatgagatggtta

SEQ ID NO: 851640 - DNA, 13 bp, Homo sapiens
tggtttgtcctga

SEQ ID NO: 851641 - DNA, 22 bp, Homo sapiens
tggtttgtgtcaaaactggttt

SEQ ID NO: 851642 - DNA, 13 bp, Homo sapiens
tggtttgtttgct

SEQ ID NO: 851643 - DNA, 22 bp, Homo sapiens
tggtttgtttgcttaatttcct

SEQ ID NO: 851644 - DNA, 23 bp, Homo sapiens
tggttttatactgaaggaaaaac

SEQ ID NO: 851645 - DNA, 17 bp, Homo sapiens
tggttttattacaaatg

SEQ ID NO: 851646 - DNA, 18 bp, Homo sapiens
tggttttcccctccctgg

SEQ ID NO: 851647 - DNA, 21 bp, Homo sapiens
tggttttcccctccctgggtt

SEQ ID NO: 851648 - DNA, 22 bp, Homo sapiens
tggttttcccctccctgggttc

SEQ ID NO: 851649 - DNA, 22 bp, Homo sapiens
tggttttcctaaatgcagtgaa

SEQ ID NO: 851650 - DNA, 21 bp, Homo sapiens
tggttttcttgccaccctctg

SEQ ID NO: 851651 - DNA, 23 bp, Homo sapiens
tggttttcttgccaccctctggg

SEQ ID NO: 851652 - DNA, 17 bp, Homo sapiens
tggttttggctctccca

SEQ ID NO: 851653 - DNA, 20 bp, Homo sapiens
tggttttggctctcccaccc

SEQ ID NO: 851654 - DNA, 18 bp, Homo sapiens
tggttttgtaagatgctg

SEQ ID NO: 851655 - DNA, 23 bp, Homo sapiens
tggtttttaaaaaactgctgact

SEQ ID NO: 851656 - DNA, 21 bp, Homo sapiens
tggtttttaaattttgtaatg

SEQ ID NO: 851657 - DNA, 15 bp, Homo sapiens
tggtttttacattca

SEQ ID NO: 851658 - DNA, 18 bp, Homo sapiens
tggtttttactgctctga

SEQ ID NO: 851659 - DNA, 22 bp, Homo sapiens
tggttttttaggtggagagaca

SEQ ID NO: 851660 - DNA, 20 bp, Homo sapiens
tggtttttttttttcttaaa

SEQ ID NO: 851661 - DNA, 12 bp, Homo sapiens
tgtaaaaaaagc

SEQ ID NO: 851662 - DNA, 15 bp, Homo sapiens
tgtaaaaaaagcaaa

SEQ ID NO: 851663 - DNA, 20 bp, Homo sapiens
tgtaaaaaaagcaaaaatga

SEQ ID NO: 851664 - DNA, 17 bp, Homo sapiens
tgtaaaaaagaaaaaca

SEQ ID NO: 851665 - DNA, 21 bp, Homo sapiens
tgtaaaaaatggaaaaaaaca

SEQ ID NO: 851666 - DNA, 16 bp, Homo sapiens
tgtaaaaaatggagct

SEQ ID NO: 851667 - DNA, 19 bp, Homo sapiens
tgtaaaaaatggagctcag

SEQ ID NO: 851668 - DNA, 20 bp, Homo sapiens
tgtaaaaacagcattgcttt

SEQ ID NO: 851669 - DNA, 23 bp, Homo sapiens
tgtaaaaacagcattgctttctg

SEQ ID NO: 851670 - DNA, 16 bp, Homo sapiens
tgtaaaaaggggagga

SEQ ID NO: 851671 - DNA, 19 bp, Homo sapiens
tgtaaaaaggggaggagaa

SEQ ID NO: 851672 - DNA, 14 bp, Homo sapiens
tgtaaaaatgcttc

SEQ ID NO: 851673 - DNA, 21 bp, Homo sapiens
tgtaaaaccatcagatatttc

SEQ ID NO: 851674 - DNA, 13 bp, Homo sapiens
tgtaaaactttat

SEQ ID NO: 851675 - DNA, 14 bp, Homo sapiens
tgtaaaactttatt

SEQ ID NO: 851676 - DNA, 12 bp, Homo sapiens
tgtaaaagaaat

SEQ ID NO: 851677 - DNA, 19 bp, Homo sapiens
tgtaaaagaacagtaaaca

SEQ ID NO: 851678 - DNA, 20 bp, Homo sapiens
tgtaaaagttataataactg

SEQ ID NO: 851679 - DNA, 22 bp, Homo sapiens
tgtaaaagttataataactgaa

SEQ ID NO: 851680 - DNA, 18 bp, Homo sapiens
tgtaaaataagaatgatt

SEQ ID NO: 851681 - DNA, 19 bp, Homo sapiens
tgtaaaatatagctgtaca

SEQ ID NO: 851682 - DNA, 21 bp, Homo sapiens
tgtaaaatattttgaatcaat

SEQ ID NO: 851683 - DNA, 15 bp, Homo sapiens
tgtaaaatccacagc

SEQ ID NO: 851684 - DNA, 22 bp, Homo sapiens
tgtaaaatcttgcagttttgta

SEQ ID NO: 851685 - DNA, 21 bp, Homo sapiens
tgtaaaatcttggcacagaaa

SEQ ID NO: 851686 - DNA, 15 bp, Homo sapiens
tgtaaaatgaaatta

SEQ ID NO: 851687 - DNA, 13 bp, Homo sapiens
tgtaaaatgagtt

SEQ ID NO: 851688 - DNA, 13 bp, Homo sapiens
tgtaaaatgtatt

SEQ ID NO: 851689 - DNA, 14 bp, Homo sapiens
tgtaaaatgtatta

SEQ ID NO: 851690 - DNA, 17 bp, Homo sapiens
tgtaaaattgttcctga

SEQ ID NO: 851691 - DNA, 22 bp, Homo sapiens
tgtaaaatttgtgtaaatttgt

SEQ ID NO: 851692 - DNA, 14 bp, Homo sapiens
tgtaaacaaactct

SEQ ID NO: 851693 - DNA, 17 bp, Homo sapiens
tgtaaacaaatcctgtt

SEQ ID NO: 851694 - DNA, 18 bp, Homo sapiens
tgtaaacacagtcaaaat

SEQ ID NO: 851695 - DNA, 13 bp, Homo sapiens
tgtaaacacatct

SEQ ID NO: 851696 - DNA, 14 bp, Homo sapiens
tgtaaacagaataa

SEQ ID NO: 851697 - DNA, 18 bp, Homo sapiens
tgtaaacagcctcttttt

SEQ ID NO: 851698 - DNA, 17 bp, Homo sapiens
tgtaaacagtgcctgct

SEQ ID NO: 851699 - DNA, 22 bp, Homo sapiens
tgtaaacatgtgttttaattcc

SEQ ID NO: 851700 - DNA, 11 bp, Homo sapiens
tgtaaacattt

SEQ ID NO: 851701 - DNA, 22 bp, Homo sapiens
tgtaaaccacaaggctgttgca

SEQ ID NO: 851702 - DNA, 16 bp, Homo sapiens
tgtaaaccattgtaac

SEQ ID NO: 851703 - DNA, 14 bp, Homo sapiens
tgtaaactgtgcac

SEQ ID NO: 851704 - DNA, 18 bp, Homo sapiens
tgtaaactgtgtattcca

SEQ ID NO: 851705 - DNA, 23 bp, Homo sapiens
tgtaaactgttgttttgtatgag

SEQ ID NO: 851706 - DNA, 12 bp, Homo sapiens
tgtaaacttctg

SEQ ID NO: 851707 - DNA, 15 bp, Homo sapiens
tgtaaacttctgaag

SEQ ID NO: 851708 - DNA, 18 bp, Homo sapiens
tgtaaacttggaatcaag

SEQ ID NO: 851709 - DNA, 19 bp, Homo sapiens
tgtaaactttatcacttaa

SEQ ID NO: 851710 - DNA, 12 bp, Homo sapiens
tgtaaactttgt

SEQ ID NO: 851711 - DNA, 20 bp, Homo sapiens
tgtaaactttttcaatggtt

SEQ ID NO: 851712 - DNA, 23 bp, Homo sapiens
tgtaaagacagagtgaatttcag

SEQ ID NO: 851713 - DNA, 11 bp, Homo sapiens
tgtaaagcaaa

SEQ ID NO: 851714 - DNA, 12 bp, Homo sapiens
tgtaaagcaaat

SEQ ID NO: 851715 - DNA, 12 bp, Homo sapiens
tgtaaagctaaa

SEQ ID NO: 851716 - DNA, 19 bp, Homo sapiens
tgtaaaggagtcaaaacta

SEQ ID NO: 851717 - DNA, 17 bp, Homo sapiens
tgtaaaggggcagctga

SEQ ID NO: 851718 - DNA, 20 bp, Homo sapiens
tgtaaagtatgtttttacat

SEQ ID NO: 851719 - DNA, 16 bp, Homo sapiens
tgtaaagtgtaaatcc

SEQ ID NO: 851720 - DNA, 14 bp, Homo sapiens
tgtaaataaaaaga

SEQ ID NO: 851721 - DNA, 15 bp, Homo sapiens
tgtaaataaaatgtg

SEQ ID NO: 851722 - DNA, 19 bp, Homo sapiens
tgtaaataaaatgtgtaca

SEQ ID NO: 851723 - DNA, 15 bp, Homo sapiens
tgtaaataagagatt

SEQ ID NO: 851724 - DNA, 11 bp, Homo sapiens
tgtacagaaca

SEQ ID NO: 851725 - DNA, 17 bp, Homo sapiens
tgtacagacatatttaa

SEQ ID NO: 851726 - DNA, 14 bp, Homo sapiens
tgtacagagctttc

SEQ ID NO: 851727 - DNA, 15 bp, Homo sapiens
tgtacagagctttct

SEQ ID NO: 851728 - DNA, 21 bp, Homo sapiens
tgtacagagtggaataagaca

SEQ ID NO: 851729 - DNA, 23 bp, Homo sapiens
tgtacagcaaggagatttacaac

SEQ ID NO: 851730 - DNA, 17 bp, Homo sapiens
tgtacagcgttttaaaa

SEQ ID NO: 851731 - DNA, 15 bp, Homo sapiens
tgtacagctctcccc

SEQ ID NO: 851732 - DNA, 14 bp, Homo sapiens
tgtacaggggccat

SEQ ID NO: 851733 - DNA, 17 bp, Homo sapiens
tgtacaggggccatgcc

SEQ ID NO: 851734 - DNA, 21 bp, Homo sapiens
tgtacaggggccatgccccac

SEQ ID NO: 851735 - DNA, 23 bp, Homo sapiens
tgtacagggtggctgtggtccta

SEQ ID NO: 851736 - DNA, 23 bp, Homo sapiens
tgtacagtctgtcatgaacatgt

SEQ ID NO: 851737 - DNA, 15 bp, Homo sapiens
tgtacagtcttgtat

SEQ ID NO: 851738 - DNA, 21 bp, Homo sapiens
tgtacagtcttgtattaagtt

SEQ ID NO: 851739 - DNA, 14 bp, Homo sapiens
tgtacagtgtcttt

SEQ ID NO: 851740 - DNA, 23 bp, Homo sapiens
tgtacagtgtctttttttgtata

SEQ ID NO: 851741 - DNA, 17 bp, Homo sapiens
tgtacagtgtgtaaagt

SEQ ID NO: 851742 - DNA, 18 bp, Homo sapiens
tgtacagttatctaagtt

SEQ ID NO: 851743 - DNA, 17 bp, Homo sapiens
tgtacagttatttatgc

SEQ ID NO: 851744 - DNA, 12 bp, Homo sapiens
tgtacagttttt

SEQ ID NO: 851745 - DNA, 13 bp, Homo sapiens
tgtacataaaaga

SEQ ID NO: 851746 - DNA, 14 bp, Homo sapiens
tgtacataactctg

SEQ ID NO: 851747 - DNA, 17 bp, Homo sapiens
tgtacataactgaaaat

SEQ ID NO: 851748 - DNA, 16 bp, Homo sapiens
tgtacatacattgtat

SEQ ID NO: 851749 - DNA, 21 bp, Homo sapiens
tgtacataccctggccgcccc

SEQ ID NO: 851750 - DNA, 21 bp, Homo sapiens
tgtacatacctccttgcacaa

SEQ ID NO: 851751 - DNA, 12 bp, Homo sapiens
tgtacatactgg

SEQ ID NO: 851752 - DNA, 16 bp, Homo sapiens
tgtacatactggcctc

SEQ ID NO: 851753 - DNA, 15 bp, Homo sapiens
tgtacatatgtaaaa

SEQ ID NO: 851754 - DNA, 21 bp, Homo sapiens
tgtacatatgtaaaataaaat

SEQ ID NO: 851755 - DNA, 23 bp, Homo sapiens
tgtacatattactgttgcattta

SEQ ID NO: 851756 - DNA, 20 bp, Homo sapiens
tgtacatatttgagactagt

SEQ ID NO: 851757 - DNA, 14 bp, Homo sapiens
tgtacatctatttt

SEQ ID NO: 851758 - DNA, 19 bp, Homo sapiens
tgtacatctattttggatt

SEQ ID NO: 851759 - DNA, 23 bp, Homo sapiens
tgtacatctattttggattgtat

SEQ ID NO: 851760 - DNA, 17 bp, Homo sapiens
tgtacatgaaaacacat

SEQ ID NO: 851761 - DNA, 22 bp, Homo sapiens
tgtacatgctatgctgaagaca

SEQ ID NO: 851762 - DNA, 17 bp, Homo sapiens
tgtacatggcagagttt

SEQ ID NO: 851763 - DNA, 18 bp, Homo sapiens
tgtacatgttcttgtcat

SEQ ID NO: 851764 - DNA, 21 bp, Homo sapiens
tgtacattctgcctagagtgt

SEQ ID NO: 851765 - DNA, 18 bp, Homo sapiens
tgtacattcttccatcat

SEQ ID NO: 851766 - DNA, 20 bp, Homo sapiens
tgtacatttaaaattgctat

SEQ ID NO: 851767 - DNA, 14 bp, Homo sapiens
tgtacatttaataa

SEQ ID NO: 851768 - DNA, 16 bp, Homo sapiens
tgtacatttattcata

SEQ ID NO: 851769 - DNA, 23 bp, Homo sapiens
tgtacatttatttattactgtcc

SEQ ID NO: 851770 - DNA, 22 bp, Homo sapiens
tgtacatttccaaattcacaag

SEQ ID NO: 851771 - DNA, 14 bp, Homo sapiens
tgtacattttgtaa

SEQ ID NO: 851772 - DNA, 21 bp, Homo sapiens
tgtacatttttggggggagag

SEQ ID NO: 851773 - DNA, 14 bp, Homo sapiens
tgtaccaaaacatc

SEQ ID NO: 851774 - DNA, 18 bp, Homo sapiens
tgtaccaacctcatagag

SEQ ID NO: 851775 - DNA, 17 bp, Homo sapiens
tgtaccacttctgtggg

SEQ ID NO: 851776 - DNA, 20 bp, Homo sapiens
tgtaccagcccagatgtttt

SEQ ID NO: 851777 - DNA, 23 bp, Homo sapiens
tgtaccagttaatttttccaact

SEQ ID NO: 851778 - DNA, 18 bp, Homo sapiens
tgtaccatagaaaaatgt

SEQ ID NO: 851779 - DNA, 12 bp, Homo sapiens
tgtaccatgtac

SEQ ID NO: 851780 - DNA, 17 bp, Homo sapiens
tgtaccatgtacatgaa

SEQ ID NO: 851781 - DNA, 20 bp, Homo sapiens
tgtaccattccttcaaataa

SEQ ID NO: 851782 - DNA, 12 bp, Homo sapiens
tgtacccagctc

SEQ ID NO: 851783 - DNA, 16 bp, Homo sapiens
tgtacccgagcacata

SEQ ID NO: 851784 - DNA, 20 bp, Homo sapiens
tgtacccttccacctcctag

SEQ ID NO: 851785 - DNA, 23 bp, Homo sapiens
tgtaccctttaagatatccatct

SEQ ID NO: 851786 - DNA, 22 bp, Homo sapiens
tgtaccgatgatactgtttctt

SEQ ID NO: 851787 - DNA, 20 bp, Homo sapiens
tgtacctatttctgatgatg

SEQ ID NO: 851788 - DNA, 13 bp, Homo sapiens
tgtacctcccctg

SEQ ID NO: 851789 - DNA, 17 bp, Homo sapiens
tgtacctcccctgcctt

SEQ ID NO: 851790 - DNA, 22 bp, Homo sapiens
tgtacctcccctgccttgctgt

SEQ ID NO: 851791 - DNA, 14 bp, Homo sapiens
tgtacctcttgagc

SEQ ID NO: 851792 - DNA, 23 bp, Homo sapiens
tgtacctcttgagccttgaactt

SEQ ID NO: 851793 - DNA, 19 bp, Homo sapiens
tgtacctgtgtacataact

SEQ ID NO: 851794 - DNA, 16 bp, Homo sapiens
tgtacctgttcctccc

SEQ ID NO: 851795 - DNA, 16 bp, Homo sapiens
tgtacgtttgtatgtg

SEQ ID NO: 851796 - DNA, 18 bp, Homo sapiens
tgtactaatctgagattg

SEQ ID NO: 851797 - DNA, 15 bp, Homo sapiens
tgtactataagtagt

SEQ ID NO: 851798 - DNA, 19 bp, Homo sapiens
tgtactataagtagttggt

SEQ ID NO: 851799 - DNA, 18 bp, Homo sapiens
tgtactatcctgtaaata

SEQ ID NO: 851800 - DNA, 22 bp, Homo sapiens
tgtactatgatgggcttctgtt

SEQ ID NO: 851801 - DNA, 14 bp, Homo sapiens
tgtactatgtctga

SEQ ID NO: 851802 - DNA, 18 bp, Homo sapiens
tgtactcaggaggctgag

SEQ ID NO: 851803 - DNA, 21 bp, Homo sapiens
tgtactccagagggacagggt

SEQ ID NO: 851804 - DNA, 15 bp, Homo sapiens
tgtactccagcctgg

SEQ ID NO: 851805 - DNA, 16 bp, Homo sapiens
tgtactcttgctgatg

SEQ ID NO: 851806 - DNA, 22 bp, Homo sapiens
tgtactgagccttgtaattcta

SEQ ID NO: 851807 - DNA, 12 bp, Homo sapiens
tgtactgataaa

SEQ ID NO: 851808 - DNA, 22 bp, Homo sapiens
tgtactgcaaagtcgccagtca

SEQ ID NO: 851809 - DNA, 15 bp, Homo sapiens
tgtactgctcaggct

SEQ ID NO: 851810 - DNA, 14 bp, Homo sapiens
tgtactgtacataa

SEQ ID NO: 851811 - DNA, 15 bp, Homo sapiens
tgtactgtacataaa

SEQ ID NO: 851812 - DNA, 15 bp, Homo sapiens
tgtactgtgcctggt

SEQ ID NO: 851813 - DNA, 15 bp, Homo sapiens
tgtactgttctgtgt

SEQ ID NO: 851814 - DNA, 13 bp, Homo sapiens
tgtactgttttta

SEQ ID NO: 851815 - DNA, 22 bp, Homo sapiens
tgtacttaaatgagttacttag

SEQ ID NO: 851816 - DNA, 16 bp, Homo sapiens
tgtacttaataaattc

SEQ ID NO: 851817 - DNA, 20 bp, Homo sapiens
tgtacttaataaattcagat

SEQ ID NO: 851818 - DNA, 21 bp, Homo sapiens
tgtacttaataaattcagata

SEQ ID NO: 851819 - DNA, 22 bp, Homo sapiens
tgtacttaataaattcagatat

SEQ ID NO: 851820 - DNA, 14 bp, Homo sapiens
tgtacttcaagtta

SEQ ID NO: 851821 - DNA, 13 bp, Homo sapiens
tgtacttcactgt

SEQ ID NO: 851822 - DNA, 17 bp, Homo sapiens
tgtacttcctgtgtact

SEQ ID NO: 851823 - DNA, 19 bp, Homo sapiens
tgtacttcctgtgtactct

SEQ ID NO: 851824 - DNA, 21 bp, Homo sapiens
tgtacttcgtcttctaatttc

SEQ ID NO: 851825 - DNA, 12 bp, Homo sapiens
tgtacttctctg

SEQ ID NO: 851826 - DNA, 16 bp, Homo sapiens
tgtacttcttattgca

SEQ ID NO: 851827 - DNA, 16 bp, Homo sapiens
tgtacttcttgaatat

SEQ ID NO: 851828 - DNA, 15 bp, Homo sapiens
tgtacttgatttgat

SEQ ID NO: 851829 - DNA, 12 bp, Homo sapiens
tgtacttggagt

SEQ ID NO: 851830 - DNA, 13 bp, Homo sapiens
tgtacttggagta

SEQ ID NO: 851831 - DNA, 15 bp, Homo sapiens
tgtacttgtcaaaga

SEQ ID NO: 851832 - DNA, 21 bp, Homo sapiens
tgtactttgccatttttctat

SEQ ID NO: 851833 - DNA, 17 bp, Homo sapiens
tgtacttttcattctct

SEQ ID NO: 851834 - DNA, 20 bp, Homo sapiens
tgtacttttctggttccaaa

SEQ ID NO: 851835 - DNA, 18 bp, Homo sapiens
tgtagaaaagaaaacatt

SEQ ID NO: 851836 - DNA, 19 bp, Homo sapiens
tgtagaaaagaaaacattt

SEQ ID NO: 851837 - DNA, 21 bp, Homo sapiens
tgtagaaaagggaactgaaca

SEQ ID NO: 851838 - DNA, 12 bp, Homo sapiens
tgtagaaaaggt

SEQ ID NO: 851839 - DNA, 21 bp, Homo sapiens
tgtagaaacacagttttgaaa

SEQ ID NO: 851840 - DNA, 20 bp, Homo sapiens
tgtagaactcactctgggct

SEQ ID NO: 851841 - DNA, 16 bp, Homo sapiens
tgtagaactcagcagt

SEQ ID NO: 851842 - DNA, 19 bp, Homo sapiens
tgtagaactcagcagttga

SEQ ID NO: 851843 - DNA, 16 bp, Homo sapiens
tgtagaagaaaatatc

SEQ ID NO: 851844 - DNA, 15 bp, Homo sapiens
tgtagaataaatgaa

SEQ ID NO: 851845 - DNA, 17 bp, Homo sapiens
tgtagaataaatgaaga

SEQ ID NO: 851846 - DNA, 17 bp, Homo sapiens
tgtatctagtgcagctg

SEQ ID NO: 851847 - DNA, 16 bp, Homo sapiens
tgtatctatgcaaagc

SEQ ID NO: 851848 - DNA, 15 bp, Homo sapiens
tgtatctatttgtac

SEQ ID NO: 851849 - DNA, 19 bp, Homo sapiens
tgtatctatttgtacaatt

SEQ ID NO: 851850 - DNA, 12 bp, Homo sapiens
tgtatctcctcc

SEQ ID NO: 851851 - DNA, 23 bp, Homo sapiens
tgtatctgagttgccaagacaaa

SEQ ID NO: 851852 - DNA, 17 bp, Homo sapiens
tgtatctgcaggcagac

SEQ ID NO: 851853 - DNA, 14 bp, Homo sapiens
tgtatctgtctttc

SEQ ID NO: 851854 - DNA, 15 bp, Homo sapiens
tgtatctgtctttcc

SEQ ID NO: 851855 - DNA, 22 bp, Homo sapiens
tgtatcttaatatatacatttt

SEQ ID NO: 851856 - DNA, 12 bp, Homo sapiens
tgtatcttcctt

SEQ ID NO: 851857 - DNA, 16 bp, Homo sapiens
tgtatcttgatgttta

SEQ ID NO: 851858 - DNA, 12 bp, Homo sapiens
tgtatctttatg

SEQ ID NO: 851859 - DNA, 17 bp, Homo sapiens
tgtatctttatgctgta

SEQ ID NO: 851860 - DNA, 14 bp, Homo sapiens
tgtatctttattaa

SEQ ID NO: 851861 - DNA, 16 bp, Homo sapiens
tgtatctttattaaaa

SEQ ID NO: 851862 - DNA, 22 bp, Homo sapiens
tgtatctttattaaaacaaaag

SEQ ID NO: 851863 - DNA, 16 bp, Homo sapiens
tgtatgaaatatatgt

SEQ ID NO: 851864 - DNA, 18 bp, Homo sapiens
tgtatgaataatgaaaat

SEQ ID NO: 851865 - DNA, 23 bp, Homo sapiens
tgtatgaataatgaaaataaaac

SEQ ID NO: 851866 - DNA, 22 bp, Homo sapiens
tgtatgacagtgaagcagcact

SEQ ID NO: 851867 - DNA, 20 bp, Homo sapiens
tgtatgactaaagagagaat

SEQ ID NO: 851868 - DNA, 21 bp, Homo sapiens
tgtatgactaaagagagaatg

SEQ ID NO: 851869 - DNA, 16 bp, Homo sapiens
tgtatgactgcacatg

SEQ ID NO: 851870 - DNA, 17 bp, Homo sapiens
tgtatgacttctgctga

SEQ ID NO: 851871 - DNA, 17 bp, Homo sapiens
tgtatgaggtcctcagg

SEQ ID NO: 851872 - DNA, 22 bp, Homo sapiens
tgtatgagttgcatttgtaaaa

SEQ ID NO: 851873 - DNA, 18 bp, Homo sapiens
tgtatgatgtgttgtgat

SEQ ID NO: 851874 - DNA, 16 bp, Homo sapiens
tgtatgcacacacata

SEQ ID NO: 851875 - DNA, 16 bp, Homo sapiens
tgtatgcacagtaaaa

SEQ ID NO: 851876 - DNA, 14 bp, Homo sapiens
tgtatgcactttgt

SEQ ID NO: 851877 - DNA, 18 bp, Homo sapiens
tgtatgcagctatctggt

SEQ ID NO: 851878 - DNA, 14 bp, Homo sapiens
tgtatgcagggagc

SEQ ID NO: 851879 - DNA, 12 bp, Homo sapiens
tgtatgcatcag

SEQ ID NO: 851880 - DNA, 12 bp, Homo sapiens
tgtatgcctttt

SEQ ID NO: 851881 - DNA, 15 bp, Homo sapiens
tgtatgctaaatgag

SEQ ID NO: 851882 - DNA, 15 bp, Homo sapiens
tgtatgctgatcatc

SEQ ID NO: 851883 - DNA, 16 bp, Homo sapiens
tgtatgctgcttttct

SEQ ID NO: 851884 - DNA, 19 bp, Homo sapiens
tgtatggaatacagtgtta

SEQ ID NO: 851885 - DNA, 13 bp, Homo sapiens
tgtatggatttaa

SEQ ID NO: 851886 - DNA, 16 bp, Homo sapiens
tgtatggcatgacaac

SEQ ID NO: 851887 - DNA, 20 bp, Homo sapiens
tgtatggcccaggcagcctc

SEQ ID NO: 851888 - DNA, 17 bp, Homo sapiens
tgtatggggaatctaag

SEQ ID NO: 851889 - DNA, 13 bp, Homo sapiens
tgtatggggaggc

SEQ ID NO: 851890 - DNA, 15 bp, Homo sapiens
tgtatggggcagctt

SEQ ID NO: 851891 - DNA, 17 bp, Homo sapiens
tgtatgtaaataccaag

SEQ ID NO: 851892 - DNA, 12 bp, Homo sapiens
tgtatgtacaat

SEQ ID NO: 851893 - DNA, 13 bp, Homo sapiens
tgtatgtacaata

SEQ ID NO: 851894 - DNA, 13 bp, Homo sapiens
tgtatgtataatt

SEQ ID NO: 851895 - DNA, 17 bp, Homo sapiens
tgtatgtatacacacat

SEQ ID NO: 851896 - DNA, 13 bp, Homo sapiens
tgtatgtattatt

SEQ ID NO: 851897 - DNA, 14 bp, Homo sapiens
tgtatgtattatta

SEQ ID NO: 851898 - DNA, 15 bp, Homo sapiens
tgtatgtcaaagctt

SEQ ID NO: 851899 - DNA, 17 bp, Homo sapiens
tgtatgtcaaagctttg

SEQ ID NO: 851900 - DNA, 22 bp, Homo sapiens
tgtatgtcaataaacaacagct

SEQ ID NO: 851901 - DNA, 17 bp, Homo sapiens
tgtatgtctaattgagt

SEQ ID NO: 851902 - DNA, 16 bp, Homo sapiens
tgtatgtgcactgtca

SEQ ID NO: 851903 - DNA, 17 bp, Homo sapiens
tgtatgtgcactgtcac

SEQ ID NO: 851904 - DNA, 16 bp, Homo sapiens
tgtatgtgtaataaat

SEQ ID NO: 851905 - DNA, 19 bp, Homo sapiens
tgtatgtgtgtttctgtcc

SEQ ID NO: 851906 - DNA, 20 bp, Homo sapiens
tgtatgtgtgtttctgtcct

SEQ ID NO: 851907 - DNA, 15 bp, Homo sapiens
tgtatgtgtgttttt

SEQ ID NO: 851908 - DNA, 19 bp, Homo sapiens
tgtatgttcagaagaaatt

SEQ ID NO: 851909 - DNA, 19 bp, Homo sapiens
tgtatgtttgctgattatt

SEQ ID NO: 851910 - DNA, 17 bp, Homo sapiens
tgtatgttttatatcaa

SEQ ID NO: 851911 - DNA, 22 bp, Homo sapiens
tgtatgtttttgactcttttga

SEQ ID NO: 851912 - DNA, 17 bp, Homo sapiens
tgtatgttttttttctg

SEQ ID NO: 851913 - DNA, 19 bp, Homo sapiens
tgtattaaaaaaaacaaaa

SEQ ID NO: 851914 - DNA, 21 bp, Homo sapiens
tgtattaaaaaaaacaaaaag

SEQ ID NO: 851915 - DNA, 18 bp, Homo sapiens
tgtattaaaaatagatat

SEQ ID NO: 851916 - DNA, 22 bp, Homo sapiens
tgtattaaatcttaaacaatgt

SEQ ID NO: 851917 - DNA, 16 bp, Homo sapiens
tgtattaagaaaggaa

SEQ ID NO: 851918 - DNA, 20 bp, Homo sapiens
tgtattaagaaaggaagcat

SEQ ID NO: 851919 - DNA, 14 bp, Homo sapiens
tgtattaagtgact

SEQ ID NO: 851920 - DNA, 21 bp, Homo sapiens
tgtattaagttgttaataaaa

SEQ ID NO: 851921 - DNA, 16 bp, Homo sapiens
tgtattaataaagcat

SEQ ID NO: 851922 - DNA, 19 bp, Homo sapiens
tgtattaataaagcattct

SEQ ID NO: 851923 - DNA, 18 bp, Homo sapiens
tgtattaatctctgtgtg

SEQ ID NO: 851924 - DNA, 19 bp, Homo sapiens
tgtattaatctgtttgtgc

SEQ ID NO: 851925 - DNA, 20 bp, Homo sapiens
tgtattaatctgtttgtgca

SEQ ID NO: 851926 - DNA, 10 bp, Homo sapiens
tgtattaatg

SEQ ID NO: 851927 - DNA, 14 bp, Homo sapiens
tgtattacagatgc

SEQ ID NO: 851928 - DNA, 20 bp, Homo sapiens
tgtattacatgactgtttct

SEQ ID NO: 851929 - DNA, 16 bp, Homo sapiens
tgtattaccattactt

SEQ ID NO: 851930 - DNA, 18 bp, Homo sapiens
tgtattactgaataatat

SEQ ID NO: 851931 - DNA, 21 bp, Homo sapiens
tgtattaggtgtcatttccat

SEQ ID NO: 851932 - DNA, 15 bp, Homo sapiens
tgtattataattgtt

SEQ ID NO: 851933 - DNA, 16 bp, Homo sapiens
tgtattatcacatcaa

SEQ ID NO: 851934 - DNA, 14 bp, Homo sapiens
tgtattatgagcca

SEQ ID NO: 851935 - DNA, 14 bp, Homo sapiens
tgtattcaagcaaa

SEQ ID NO: 851936 - DNA, 23 bp, Homo sapiens
tgtattcacatagtcctcagggc

SEQ ID NO: 851937 - DNA, 17 bp, Homo sapiens
tgtattcagtgagggtc

SEQ ID NO: 851938 - DNA, 21 bp, Homo sapiens
tgtattccaagacatgtctgt

SEQ ID NO: 851939 - DNA, 15 bp, Homo sapiens
tgtattcccttgtat

SEQ ID NO: 851940 - DNA, 19 bp, Homo sapiens
tgtattctctcctgtacct

SEQ ID NO: 851941 - DNA, 20 bp, Homo sapiens
tgtattctctgagctgtgca

SEQ ID NO: 851942 - DNA, 15 bp, Homo sapiens
tgtattctctgtaag

SEQ ID NO: 851943 - DNA, 14 bp, Homo sapiens
tgtattctttaaga

SEQ ID NO: 851944 - DNA, 18 bp, Homo sapiens
tgtattgaaaacacttag

SEQ ID NO: 851945 - DNA, 19 bp, Homo sapiens
tgtattgaaaacacttagt

SEQ ID NO: 851946 - DNA, 13 bp, Homo sapiens
tgtattgacttta

SEQ ID NO: 851947 - DNA, 15 bp, Homo sapiens
tgtattgagatttct

SEQ ID NO: 851948 - DNA, 20 bp, Homo sapiens
tgtattgagggccagtgatg

SEQ ID NO: 851949 - DNA, 19 bp, Homo sapiens
tgtattgagtcttaactgt

SEQ ID NO: 851950 - DNA, 16 bp, Homo sapiens
tgtattgatgcaatat

SEQ ID NO: 851951 - DNA, 21 bp, Homo sapiens
tgtattgattacaaataaaca

SEQ ID NO: 851952 - DNA, 15 bp, Homo sapiens
tgtattgcacattgt

SEQ ID NO: 851953 - DNA, 17 bp, Homo sapiens
tgtattggctctgtgaa

SEQ ID NO: 851954 - DNA, 18 bp, Homo sapiens
tgtattggttaaaactgt

SEQ ID NO: 851955 - DNA, 18 bp, Homo sapiens
tgtattgtaaatgtggat

SEQ ID NO: 851956 - DNA, 12 bp, Homo sapiens
tgtattgttaat

SEQ ID NO: 851957 - DNA, 18 bp, Homo sapiens
tgtattgttgaaaaagtt

SEQ ID NO: 851958 - DNA, 20 bp, Homo sapiens
tgtattgttgaaaaagtttg

SEQ ID NO: 851959 - DNA, 22 bp, Homo sapiens
tgtattgttgaaaaagtttgtt

SEQ ID NO: 851960 - DNA, 20 bp, Homo sapiens
tgtattgttttcccaagtgt

SEQ ID NO: 851961 - DNA, 16 bp, Homo sapiens
tgtatttaaaaacaaa

SEQ ID NO: 851962 - DNA, 22 bp, Homo sapiens
tgtatttaaaaagaaacagaaa

SEQ ID NO: 851963 - DNA, 14 bp, Homo sapiens
tgtatttaacagaa

SEQ ID NO: 851964 - DNA, 20 bp, Homo sapiens
tgtatttaattcttcacctt

SEQ ID NO: 851965 - DNA, 13 bp, Homo sapiens
tgtatttaccaaa

SEQ ID NO: 851966 - DNA, 23 bp, Homo sapiens
tgtatttacgctttgattcatag

SEQ ID NO: 851967 - DNA, 16 bp, Homo sapiens
tgtatttataatttaa

SEQ ID NO: 851968 - DNA, 18 bp, Homo sapiens
tgtatttatataagtctg

SEQ ID NO: 851969 - DNA, 14 bp, Homo sapiens
tgtatttatggatt

SEQ ID NO: 851970 - DNA, 16 bp, Homo sapiens
tgtatttatgtgtgag

SEQ ID NO: 851971 - DNA, 17 bp, Homo sapiens
tgtatttatttaaaact

SEQ ID NO: 851972 - DNA, 22 bp, Homo sapiens
tgtatttcagggacctcagggg

SEQ ID NO: 851973 - DNA, 23 bp, Homo sapiens
tgtatttcagggacctcaggggc

SEQ ID NO: 851974 - DNA, 14 bp, Homo sapiens
tgtatttcagtatt

SEQ ID NO: 851975 - DNA, 19 bp, Homo sapiens
tgtatttcagtattttcca

SEQ ID NO: 851976 - DNA, 20 bp, Homo sapiens
tgtatttcagtattttccag

SEQ ID NO: 851977 - DNA, 15 bp, Homo sapiens
tgtatttccagtgca

SEQ ID NO: 851978 - DNA, 18 bp, Homo sapiens
tgtatttcttatacgctt

SEQ ID NO: 851979 - DNA, 22 bp, Homo sapiens
tgtatttgaaaattacatgttt

SEQ ID NO: 851980 - DNA, 17 bp, Homo sapiens
tgtatttgaaataagaa

SEQ ID NO: 851981 - DNA, 12 bp, Homo sapiens
tgtatttgctaa

SEQ ID NO: 851982 - DNA, 13 bp, Homo sapiens
tgtatttgctaat

SEQ ID NO: 851983 - DNA, 23 bp, Homo sapiens
tgtatttggaatatttgaataat

SEQ ID NO: 851984 - DNA, 17 bp, Homo sapiens
tgtatttgtagtgttat

SEQ ID NO: 851985 - DNA, 13 bp, Homo sapiens
tgtatttgtatta

SEQ ID NO: 851986 - DNA, 15 bp, Homo sapiens
tgtatttgtattaat

SEQ ID NO: 851987 - DNA, 17 bp, Homo sapiens
tgtatttgtattaataa

SEQ ID NO: 851988 - DNA, 17 bp, Homo sapiens
tgtatttgtgactttta

SEQ ID NO: 851989 - DNA, 20 bp, Homo sapiens
tgtatttgttatttattaaa

SEQ ID NO: 851990 - DNA, 18 bp, Homo sapiens
tgtattttaacactttgt

SEQ ID NO: 851991 - DNA, 16 bp, Homo sapiens
tgtattttagcagaga

SEQ ID NO: 851992 - DNA, 12 bp, Homo sapiens
tgtattttcata

SEQ ID NO: 851993 - DNA, 15 bp, Homo sapiens
tgtattttcctaatg

SEQ ID NO: 851994 - DNA, 14 bp, Homo sapiens
tgtattttgtattg

SEQ ID NO: 851995 - DNA, 18 bp, Homo sapiens
tgtattttgtcacttttt

SEQ ID NO: 851996 - DNA, 21 bp, Homo sapiens
tgtattttgtccaagttcaca

SEQ ID NO: 851997 - DNA, 19 bp, Homo sapiens
tgtattttgtgtgaccaac

SEQ ID NO: 851998 - DNA, 12 bp, Homo sapiens
tgtattttgtta

SEQ ID NO: 851999 - DNA, 14 bp, Homo sapiens
tgtattttgttaaa

SEQ ID NO: 852000 - DNA, 16 bp, Homo sapiens
tgtatttttatataat

SEQ ID NO: 852001 - DNA, 21 bp, Homo sapiens
tgtatttttcaaggcatttat

SEQ ID NO: 852002 - DNA, 22 bp, Homo sapiens
tgtatttttcttgctgttcagt

SEQ ID NO: 852003 - DNA, 20 bp, Homo sapiens
tgtatttttgtcaattacca

SEQ ID NO: 852004 - DNA, 14 bp, Homo sapiens
tgtattttttaaaa

SEQ ID NO: 852005 - DNA, 22 bp, Homo sapiens
tgtattttttaaaacactaaaa

SEQ ID NO: 852006 - DNA, 21 bp, Homo sapiens
tgtattttttaaaattgattt

SEQ ID NO: 852007 - DNA, 22 bp, Homo sapiens
tgtatttttttaactacataaa

SEQ ID NO: 852008 - DNA, 16 bp, Homo sapiens
tgtatttttttactaa

SEQ ID NO: 852009 - DNA, 17 bp, Homo sapiens
tgtatttttttgcaagt

SEQ ID NO: 852010 - DNA, 20 bp, Homo sapiens
tgtatttttttgcaagtgaa

SEQ ID NO: 852011 - DNA, 14 bp, Homo sapiens
tgtcaaaaaaaaaa

SEQ ID NO: 852012 - DNA, 14 bp, Homo sapiens
tgtcaaaacactgt

SEQ ID NO: 852013 - DNA, 17 bp, Homo sapiens
tgtcaaaacactgtgga

SEQ ID NO: 852014 - DNA, 12 bp, Homo sapiens
tgtcaaaataaa

SEQ ID NO: 852015 - DNA, 13 bp, Homo sapiens
tgtcaaacaaata

SEQ ID NO: 852016 - DNA, 13 bp, Homo sapiens
tgtcaaagctttg

SEQ ID NO: 852017 - DNA, 13 bp, Homo sapiens
tgtcaaatgaact

SEQ ID NO: 852018 - DNA, 18 bp, Homo sapiens
tgtcaaatgatgtgcaaa

SEQ ID NO: 852019 - DNA, 18 bp, Homo sapiens
tgtcaaatgtttccttaa

SEQ ID NO: 852020 - DNA, 22 bp, Homo sapiens
tgtcaaatgtttccttaaacat

SEQ ID NO: 852021 - DNA, 23 bp, Homo sapiens
tgtcaacaaaccaagcatcaggg

SEQ ID NO: 852022 - DNA, 14 bp, Homo sapiens
tgtcaacattgtga

SEQ ID NO: 852023 - DNA, 17 bp, Homo sapiens
tgtcaacatttggaggc

SEQ ID NO: 852024 - DNA, 14 bp, Homo sapiens
tgtcaacttctggc

SEQ ID NO: 852025 - DNA, 15 bp, Homo sapiens
tgtcaacttctggct

SEQ ID NO: 852026 - DNA, 17 bp, Homo sapiens
tgtcaagagtagttata

SEQ ID NO: 852027 - DNA, 18 bp, Homo sapiens
tgtcaagcctgtgcaaaa

SEQ ID NO: 852028 - DNA, 14 bp, Homo sapiens
tgtcaagctgctct

SEQ ID NO: 852029 - DNA, 15 bp, Homo sapiens
tgtcaagctgctctg

SEQ ID NO: 852030 - DNA, 18 bp, Homo sapiens
tgtcaagctgctctgagc

SEQ ID NO: 852031 - DNA, 17 bp, Homo sapiens
tgtcaagcttactacag

SEQ ID NO: 852032 - DNA, 13 bp, Homo sapiens
tgtcaaggaagaa

SEQ ID NO: 852033 - DNA, 14 bp, Homo sapiens
tgtcaaggaagaag

SEQ ID NO: 852034 - DNA, 20 bp, Homo sapiens
tgtcaaggccgagggccagg

SEQ ID NO: 852035 - DNA, 22 bp, Homo sapiens
tgtcaaggccgagggccaggca

SEQ ID NO: 852036 - DNA, 18 bp, Homo sapiens
tgtcaagggcagaatgaa

SEQ ID NO: 852037 - DNA, 15 bp, Homo sapiens
tgtcaagtacaagca

SEQ ID NO: 852038 - DNA, 16 bp, Homo sapiens
tgtcaagttgtgcttg

SEQ ID NO: 852039 - DNA, 15 bp, Homo sapiens
tgtcaataaatgaca

SEQ ID NO: 852040 - DNA, 20 bp, Homo sapiens
tgtcaataaatgacacccag

SEQ ID NO: 852041 - DNA, 15 bp, Homo sapiens
tgtcaataaggagca

SEQ ID NO: 852042 - DNA, 18 bp, Homo sapiens
tgtcaatattaaatacag

SEQ ID NO: 852043 - DNA, 17 bp, Homo sapiens
tgtcaatatttaaacat

SEQ ID NO: 852044 - DNA, 17 bp, Homo sapiens
tgtcaatatttagtaaa

SEQ ID NO: 852045 - DNA, 17 bp, Homo sapiens
tgtcaatgagagcataa

SEQ ID NO: 852046 - DNA, 23 bp, Homo sapiens
tgtcaatgccaggatttctcatt

SEQ ID NO: 852047 - DNA, 12 bp, Homo sapiens
tgtcaatgtgtg

SEQ ID NO: 852048 - DNA, 15 bp, Homo sapiens
tgtcaatttctgtgt

SEQ ID NO: 852049 - DNA, 15 bp, Homo sapiens
tgtcaatttgtatat

SEQ ID NO: 852050 - DNA, 22 bp, Homo sapiens
tgtcaatttgtatatcatgaaa

SEQ ID NO: 852051 - DNA, 15 bp, Homo sapiens
tgtcacaaattgatc

SEQ ID NO: 852052 - DNA, 21 bp, Homo sapiens
tgtcacaaattgatcaagata

SEQ ID NO: 852053 - DNA, 17 bp, Homo sapiens
tgtcacaacctctctga

SEQ ID NO: 852054 - DNA, 11 bp, Homo sapiens
tgtcacaataa

SEQ ID NO: 852055 - DNA, 18 bp, Homo sapiens
tgtcacaataaagtttat

SEQ ID NO: 852056 - DNA, 16 bp, Homo sapiens
tgtcacaataaatggc

SEQ ID NO: 852057 - DNA, 14 bp, Homo sapiens
tgtcacaatcctaa

SEQ ID NO: 852058 - DNA, 16 bp, Homo sapiens
tgtcacaatgagattg

SEQ ID NO: 852059 - DNA, 19 bp, Homo sapiens
tgtcacaattatgtgcaaa

SEQ ID NO: 852060 - DNA, 13 bp, Homo sapiens
tgtcacacactgg

SEQ ID NO: 852061 - DNA, 18 bp, Homo sapiens
tgtcacagaaatcagagg

SEQ ID NO: 852062 - DNA, 12 bp, Homo sapiens
tgtcacagggcc

SEQ ID NO: 852063 - DNA, 17 bp, Homo sapiens
tgtcacagtaaaaataa

SEQ ID NO: 852064 - DNA, 19 bp, Homo sapiens
tgtcacagtccaaccagaa

SEQ ID NO: 852065 - DNA, 21 bp, Homo sapiens
tgtcacatcagcaatttcaga

SEQ ID NO: 852066 - DNA, 17 bp, Homo sapiens
tgtcacatggtgcccct

SEQ ID NO: 852067 - DNA, 14 bp, Homo sapiens
tgtcacattctatt

SEQ ID NO: 852068 - DNA, 18 bp, Homo sapiens
tgtcaccaccttcccagc

SEQ ID NO: 852069 - DNA, 19 bp, Homo sapiens
tgtcaccaccttcccagct

SEQ ID NO: 852070 - DNA, 17 bp, Homo sapiens
tgtcaccagcaacatct

SEQ ID NO: 852071 - DNA, 19 bp, Homo sapiens
tgtcaccagcaacatctcg

SEQ ID NO: 852072 - DNA, 14 bp, Homo sapiens
tgtcaccagctatc

SEQ ID NO: 852073 - DNA, 13 bp, Homo sapiens
tgtcacccaaagc

SEQ ID NO: 852074 - DNA, 14 bp, Homo sapiens
tgtcaccctgcaga

SEQ ID NO: 852075 - DNA, 16 bp, Homo sapiens
tgtcaccctgcagagc

SEQ ID NO: 852076 - DNA, 18 bp, Homo sapiens
tgtcaccctgcagagcta

SEQ ID NO: 852077 - DNA, 18 bp, Homo sapiens
tgtcaccggtcagtgcct

SEQ ID NO: 852078 - DNA, 16 bp, Homo sapiens
tgtcaccgtgagcagc

SEQ ID NO: 852079 - DNA, 23 bp, Homo sapiens
tgtcaccgtgagcagctttggaa

SEQ ID NO: 852080 - DNA, 18 bp, Homo sapiens
tgtcaccgtggaccttcc

SEQ ID NO: 852081 - DNA, 20 bp, Homo sapiens
tgtcaccgtggaccttcctg

SEQ ID NO: 852082 - DNA, 21 bp, Homo sapiens
tgtcaccgtggaccttcctgc

SEQ ID NO: 852083 - DNA, 22 bp, Homo sapiens
tgtcaccgtggaccttcctgcc

SEQ ID NO: 852084 - DNA, 13 bp, Homo sapiens
tgtcacctcagct

SEQ ID NO: 852085 - DNA, 19 bp, Homo sapiens
tgtcacctcagctgatatt

SEQ ID NO: 852086 - DNA, 15 bp, Homo sapiens
tgtcacctgctcaca

SEQ ID NO: 852087 - DNA, 18 bp, Homo sapiens
tgtcacctggcacattca

SEQ ID NO: 852088 - DNA, 15 bp, Homo sapiens
tgtcacctggctgct

SEQ ID NO: 852089 - DNA, 14 bp, Homo sapiens
tgtcacctgtgctt

SEQ ID NO: 852090 - DNA, 19 bp, Homo sapiens
tgtcactaaacaagaaatc

SEQ ID NO: 852091 - DNA, 22 bp, Homo sapiens
tgtccctaatttaacccagctc

SEQ ID NO: 852092 - DNA, 20 bp, Homo sapiens
tgtccctaccgagtctcttc

SEQ ID NO: 852093 - DNA, 15 bp, Homo sapiens
tgtccctctcaggca

SEQ ID NO: 852094 - DNA, 21 bp, Homo sapiens
tgtccctctcggaaggctggc

SEQ ID NO: 852095 - DNA, 16 bp, Homo sapiens
tgtccctctgccccat

SEQ ID NO: 852096 - DNA, 14 bp, Homo sapiens
tgtccctgcactgt

SEQ ID NO: 852097 - DNA, 11 bp, Homo sapiens
tgtccctgccc

SEQ ID NO: 852098 - DNA, 20 bp, Homo sapiens
tgtccctgccccgcccccca

SEQ ID NO: 852099 - DNA, 14 bp, Homo sapiens
tgtccctgggccag

SEQ ID NO: 852100 - DNA, 16 bp, Homo sapiens
tgtccctgtagctcag

SEQ ID NO: 852101 - DNA, 19 bp, Homo sapiens
tgtccctgtagctcagtca

SEQ ID NO: 852102 - DNA, 19 bp, Homo sapiens
tgtccctgtccccctcccc

SEQ ID NO: 852103 - DNA, 17 bp, Homo sapiens
tgtccctgtccctgccc

SEQ ID NO: 852104 - DNA, 13 bp, Homo sapiens
tgtccctgtcctt

SEQ ID NO: 852105 - DNA, 22 bp, Homo sapiens
tgtccctgtccttccctgttct

SEQ ID NO: 852106 - DNA, 15 bp, Homo sapiens
tgtccctgtccttct

SEQ ID NO: 852107 - DNA, 21 bp, Homo sapiens
tgtccctgtgttgtcccatct

SEQ ID NO: 852108 - DNA, 13 bp, Homo sapiens
tgtccctgttaga

SEQ ID NO: 852109 - DNA, 21 bp, Homo sapiens
tgtcccttccccttcaccgct

SEQ ID NO: 852110 - DNA, 21 bp, Homo sapiens
tgtcccttcgagtccaggaca

SEQ ID NO: 852111 - DNA, 17 bp, Homo sapiens
tgtcccttgatgcacag

SEQ ID NO: 852112 - DNA, 19 bp, Homo sapiens
tgtcccttgatgcacagag

SEQ ID NO: 852113 - DNA, 20 bp, Homo sapiens
tgtcccttgatgcacagaga

SEQ ID NO: 852114 - DNA, 22 bp, Homo sapiens
tgtcccttgcctcaatgccagt

SEQ ID NO: 852115 - DNA, 15 bp, Homo sapiens
tgtccctttccctac

SEQ ID NO: 852116 - DNA, 17 bp, Homo sapiens
tgtccctttccctacct

SEQ ID NO: 852117 - DNA, 16 bp, Homo sapiens
tgtccctttcttggcc

SEQ ID NO: 852118 - DNA, 13 bp, Homo sapiens
tgtccgagaacta

SEQ ID NO: 852119 - DNA, 16 bp, Homo sapiens
tgtccgccatccaggg

SEQ ID NO: 852120 - DNA, 13 bp, Homo sapiens
tgtccgcctctgc

SEQ ID NO: 852121 - DNA, 23 bp, Homo sapiens
tgtccgcctctgcccgcagagcc

SEQ ID NO: 852122 - DNA, 20 bp, Homo sapiens
tgtccggcccagtgccagct

SEQ ID NO: 852123 - DNA, 15 bp, Homo sapiens
tgtccgtccaccctt

SEQ ID NO: 852124 - DNA, 17 bp, Homo sapiens
tgtcctaagaacaatgc

SEQ ID NO: 852125 - DNA, 21 bp, Homo sapiens
tgtcctaagagatttatcttt

SEQ ID NO: 852126 - DNA, 19 bp, Homo sapiens
tgtcctaaggaaccttcct

SEQ ID NO: 852127 - DNA, 16 bp, Homo sapiens
tgtcctaaggacacac

SEQ ID NO: 852128 - DNA, 20 bp, Homo sapiens
tgtcctaaggacacactaat

SEQ ID NO: 852129 - DNA, 22 bp, Homo sapiens
tgtcctaataatatcccactgg

SEQ ID NO: 852130 - DNA, 14 bp, Homo sapiens
tgtcctacacttga

SEQ ID NO: 852131 - DNA, 13 bp, Homo sapiens
tgtcctacccgcc

SEQ ID NO: 852132 - DNA, 16 bp, Homo sapiens
tgtcctacccgcccgc

SEQ ID NO: 852133 - DNA, 22 bp, Homo sapiens
tgtcctacccgcccgcgtccaa

SEQ ID NO: 852134 - DNA, 15 bp, Homo sapiens
tgtcctacttctgac

SEQ ID NO: 852135 - DNA, 19 bp, Homo sapiens
tgtcctagaagttctttga

SEQ ID NO: 852136 - DNA, 20 bp, Homo sapiens
tgtcctatgtcaatttgtat

SEQ ID NO: 852137 - DNA, 12 bp, Homo sapiens
tgtcctcaccct

SEQ ID NO: 852138 - DNA, 14 bp, Homo sapiens
tgtcctcagccagt

SEQ ID NO: 852139 - DNA, 14 bp, Homo sapiens
tgtcctcagggagc

SEQ ID NO: 852140 - DNA, 14 bp, Homo sapiens
tgtcctcaggtggc

SEQ ID NO: 852141 - DNA, 19 bp, Homo sapiens
tgtcctcaggtggccatgc

SEQ ID NO: 852142 - DNA, 20 bp, Homo sapiens
tgtcctcccacagacctgca

SEQ ID NO: 852143 - DNA, 13 bp, Homo sapiens
tgtcctcccatcc

SEQ ID NO: 852144 - DNA, 17 bp, Homo sapiens
tgtcctcccatcccctc

SEQ ID NO: 852145 - DNA, 18 bp, Homo sapiens
tgtcctcccatcccctgg

SEQ ID NO: 852146 - DNA, 11 bp, Homo sapiens
tgtcctcctct

SEQ ID NO: 852147 - DNA, 15 bp, Homo sapiens
tgtcctcctctgagg

SEQ ID NO: 852148 - DNA, 18 bp, Homo sapiens
tgtcctcctctgaggaag

SEQ ID NO: 852149 - DNA, 13 bp, Homo sapiens
tgtcctcctggaa

SEQ ID NO: 852150 - DNA, 14 bp, Homo sapiens
tgtcctccttcctg

SEQ ID NO: 852151 - DNA, 17 bp, Homo sapiens
tgtcctccttcctggga

SEQ ID NO: 852152 - DNA, 11 bp, Homo sapiens
tgtcctccttt

SEQ ID NO: 852153 - DNA, 13 bp, Homo sapiens
tgtcctctccccc

SEQ ID NO: 852154 - DNA, 22 bp, Homo sapiens
tgtcctctcccccttcagctcc

SEQ ID NO: 852155 - DNA, 16 bp, Homo sapiens
tgtcctctcgagccca

SEQ ID NO: 852156 - DNA, 17 bp, Homo sapiens
tgtcctctgcctgggct

SEQ ID NO: 852157 - DNA, 23 bp, Homo sapiens
tgtcctcttctgcatcttgggga

SEQ ID NO: 852158 - DNA, 24 bp, Homo sapiens
tgtcctgaaccgactgaccctgag

SEQ ID NO: 852159 - DNA, 12 bp, Homo sapiens
tgtcctgaccac

SEQ ID NO: 852160 - DNA, 14 bp, Homo sapiens
tgtcctgaccaccc

SEQ ID NO: 852161 - DNA, 16 bp, Homo sapiens
tgtcctgaccaccctc

SEQ ID NO: 852162 - DNA, 19 bp, Homo sapiens
tgtcctgaccaccctcccc

SEQ ID NO: 852163 - DNA, 21 bp, Homo sapiens
tgtcctgaccaccctcccctc

SEQ ID NO: 852164 - DNA, 22 bp, Homo sapiens
tgtcctgaccaccctcccctct

SEQ ID NO: 852165 - DNA, 12 bp, Homo sapiens
tgtcctgatttc

SEQ ID NO: 852166 - DNA, 11 bp, Homo sapiens
tgtcctgcatg

SEQ ID NO: 852167 - DNA, 15 bp, Homo sapiens
tgtcctgccagctgc

SEQ ID NO: 852168 - DNA, 16 bp, Homo sapiens
tgtcctgcccacccta

SEQ ID NO: 852169 - DNA, 13 bp, Homo sapiens
tgtcctgcctcct

SEQ ID NO: 852170 - DNA, 22 bp, Homo sapiens
tgtcctgcctgcaatatttgaa

SEQ ID NO: 852171 - DNA, 21 bp, Homo sapiens
tgtcctgcctgtctgccccag

SEQ ID NO: 852172 - DNA, 19 bp, Homo sapiens
tgtcctgctctcttcagga

SEQ ID NO: 852173 - DNA, 17 bp, Homo sapiens
tgtcctggcccttcagt

SEQ ID NO: 852174 - DNA, 23 bp, Homo sapiens
tgtcctgggcatgggtccagggc

SEQ ID NO: 852175 - DNA, 17 bp, Homo sapiens
tgtcctgggcctgcccc

SEQ ID NO: 852176 - DNA, 21 bp, Homo sapiens
tgtcctgggcctgcccctgtg

SEQ ID NO: 852177 - DNA, 15 bp, Homo sapiens
tgtcctggtacagca

SEQ ID NO: 852178 - DNA, 18 bp, Homo sapiens
tgtcctggtacagcaggg

SEQ ID NO: 852179 - DNA, 19 bp, Homo sapiens
tgtcctggtacagcagggt

SEQ ID NO: 852180 - DNA, 13 bp, Homo sapiens
tgtcctggtgctc

SEQ ID NO: 852181 - DNA, 16 bp, Homo sapiens
tgtcctggtgctctct

SEQ ID NO: 852182 - DNA, 17 bp, Homo sapiens
tgtcctggtggtatttt

SEQ ID NO: 852183 - DNA, 18 bp, Homo sapiens
tgtcctggtggtattttc

SEQ ID NO: 852184 - DNA, 20 bp, Homo sapiens
tgtcctggtggtattttcaa

SEQ ID NO: 852185 - DNA, 15 bp, Homo sapiens
tgtcctgtcctgctc

SEQ ID NO: 852186 - DNA, 18 bp, Homo sapiens
tgtcctgtgagatgtgta

SEQ ID NO: 852187 - DNA, 20 bp, Homo sapiens
tgtcctgtgagatgtgtatc

SEQ ID NO: 852188 - DNA, 22 bp, Homo sapiens
tgtcctgtgatctgtgtacaat

SEQ ID NO: 852189 - DNA, 15 bp, Homo sapiens
tgtcctgtgctttct

SEQ ID NO: 852190 - DNA, 16 bp, Homo sapiens
tgtcctgtgtctatgt

SEQ ID NO: 852191 - DNA, 23 bp, Homo sapiens
tgtcctgtgtctatgtacctcta

SEQ ID NO: 852192 - DNA, 19 bp, Homo sapiens
tgtcctgttgattaatttc

SEQ ID NO: 852193 - DNA, 23 bp, Homo sapiens
tgtccttagactccttctcccca

SEQ ID NO: 852194 - DNA, 17 bp, Homo sapiens
tgtccttagtgtataaa

SEQ ID NO: 852195 - DNA, 18 bp, Homo sapiens
tgtccttcagagctcttc

SEQ ID NO: 852196 - DNA, 17 bp, Homo sapiens
tgtccttccctcaaaga

SEQ ID NO: 852197 - DNA, 16 bp, Homo sapiens
tgtccttccctgttct

SEQ ID NO: 852198 - DNA, 19 bp, Homo sapiens
tgtccttccctgttctccc

SEQ ID NO: 852199 - DNA, 14 bp, Homo sapiens
tgtccttcctccac

SEQ ID NO: 852200 - DNA, 22 bp, Homo sapiens
tgtccttctacagaacctgagg

SEQ ID NO: 852201 - DNA, 17 bp, Homo sapiens
tgtccttgcagacagaa

SEQ ID NO: 852202 - DNA, 13 bp, Homo sapiens
tgtccttgcccca

SEQ ID NO: 852203 - DNA, 18 bp, Homo sapiens
tgtccttggaagtttcat

SEQ ID NO: 852204 - DNA, 23 bp, Homo sapiens
tgtccttgtggtctttgctgctg

SEQ ID NO: 852205 - DNA, 15 bp, Homo sapiens
tgtccttgtgtgttt

SEQ ID NO: 852206 - DNA, 21 bp, Homo sapiens
tgtccttgttcatggagagct

SEQ ID NO: 852207 - DNA, 16 bp, Homo sapiens
tgtcctttaaaaaaga

SEQ ID NO: 852208 - DNA, 15 bp, Homo sapiens
tgtcctttccatctg

SEQ ID NO: 852209 - DNA, 14 bp, Homo sapiens
tgtcctttcttgca

SEQ ID NO: 852210 - DNA, 21 bp, Homo sapiens
tgtcctttgcaattgctcttc

SEQ ID NO: 852211 - DNA, 23 bp, Homo sapiens
tgtccttttatttctccatcttt

SEQ ID NO: 852212 - DNA, 18 bp, Homo sapiens
tgtcctttttcactttga

SEQ ID NO: 852213 - DNA, 13 bp, Homo sapiens
tgtctctggggca

SEQ ID NO: 852214 - DNA, 23 bp, Homo sapiens
tgtctctggggcagatccccact

SEQ ID NO: 852215 - DNA, 18 bp, Homo sapiens
tgtctctgtttcctgaaa

SEQ ID NO: 852216 - DNA, 12 bp, Homo sapiens
tgtctctgtttt

SEQ ID NO: 852217 - DNA, 13 bp, Homo sapiens
tgtctcttctgag

SEQ ID NO: 852218 - DNA, 17 bp, Homo sapiens
tgtctcttctttagaac

SEQ ID NO: 852219 - DNA, 20 bp, Homo sapiens
tgtctctttaagttttgatt

SEQ ID NO: 852220 - DNA, 13 bp, Homo sapiens
tgtctgaaacatt

SEQ ID NO: 852221 - DNA, 17 bp, Homo sapiens
tgtctgaagtacaaaca

SEQ ID NO: 852222 - DNA, 18 bp, Homo sapiens
tgtctgaagtacaaacat

SEQ ID NO: 852223 - DNA, 19 bp, Homo sapiens
tgtctgaagtacaaacatg

SEQ ID NO: 852224 - DNA, 19 bp, Homo sapiens
tgtctgaagtcactgcaca

SEQ ID NO: 852225 - DNA, 14 bp, Homo sapiens
tgtctgaattattc

SEQ ID NO: 852226 - DNA, 22 bp, Homo sapiens
tgtctgaattattctgcctacg

SEQ ID NO: 852227 - DNA, 14 bp, Homo sapiens
tgtctgacatgttt

SEQ ID NO: 852228 - DNA, 23 bp, Homo sapiens
tgtctgaggagtaagtgtacaat

SEQ ID NO: 852229 - DNA, 14 bp, Homo sapiens
tgtctgaggcctca

SEQ ID NO: 852230 - DNA, 18 bp, Homo sapiens
tgtctgaggcctcatccc

SEQ ID NO: 852231 - DNA, 17 bp, Homo sapiens
tgtctgcacagagggtc

SEQ ID NO: 852232 - DNA, 14 bp, Homo sapiens
tgtctgcacccagg

SEQ ID NO: 852233 - DNA, 16 bp, Homo sapiens
tgtctgcacccagggg

SEQ ID NO: 852234 - DNA, 11 bp, Homo sapiens
tgtctgcagct

SEQ ID NO: 852235 - DNA, 12 bp, Homo sapiens
tgtctgcagctg

SEQ ID NO: 852236 - DNA, 11 bp, Homo sapiens
tgtctgcaggt

SEQ ID NO: 852237 - DNA, 17 bp, Homo sapiens
tgtctgcaggtgtctga

SEQ ID NO: 852238 - DNA, 17 bp, Homo sapiens
tgtctgcaggtttctcc

SEQ ID NO: 852239 - DNA, 18 bp, Homo sapiens
tgtctgcaggtttctcct

SEQ ID NO: 852240 - DNA, 18 bp, Homo sapiens
tgtctgccagccagcagc

SEQ ID NO: 852241 - DNA, 15 bp, Homo sapiens
tgtctgccctctggg

SEQ ID NO: 852242 - DNA, 14 bp, Homo sapiens
tgtctgctaatgta

SEQ ID NO: 852243 - DNA, 16 bp, Homo sapiens
tgtctgctaatgtaaa

SEQ ID NO: 852244 - DNA, 16 bp, Homo sapiens
tgtctgctgactgttt

SEQ ID NO: 852245 - DNA, 23 bp, Homo sapiens
tgtctgctgactgtttcattcac

SEQ ID NO: 852246 - DNA, 23 bp, Homo sapiens
tgtctggaaacctgtcattgtat

SEQ ID NO: 852247 - DNA, 14 bp, Homo sapiens
tgtctggatcagta

SEQ ID NO: 852248 - DNA, 15 bp, Homo sapiens
tgtctggatcagtaa

SEQ ID NO: 852249 - DNA, 20 bp, Homo sapiens
tgtctggatcagtaaaatta

SEQ ID NO: 852250 - DNA, 21 bp, Homo sapiens
tgtctggatgatgctgtgcta

SEQ ID NO: 852251 - DNA, 14 bp, Homo sapiens
tgtctggcaaggac

SEQ ID NO: 852252 - DNA, 12 bp, Homo sapiens
tgtctggcctca

SEQ ID NO: 852253 - DNA, 23 bp, Homo sapiens
tgtctggcgttctcaagaatcta

SEQ ID NO: 852254 - DNA, 23 bp, Homo sapiens
tgtctggctgaggatttcaagcc

SEQ ID NO: 852255 - DNA, 17 bp, Homo sapiens
tgtctggcttctagaga

SEQ ID NO: 852256 - DNA, 15 bp, Homo sapiens
tgtctgggaattgtg

SEQ ID NO: 852257 - DNA, 16 bp, Homo sapiens
tgtctgggagagcctg

SEQ ID NO: 852258 - DNA, 19 bp, Homo sapiens
tgtctgggattaagggcaa

SEQ ID NO: 852259 - DNA, 14 bp, Homo sapiens
tgtctggggcagaa

SEQ ID NO: 852260 - DNA, 14 bp, Homo sapiens
tgtctggggcccca

SEQ ID NO: 852261 - DNA, 23 bp, Homo sapiens
tgtctggggctacagaatagggt

SEQ ID NO: 852262 - DNA, 14 bp, Homo sapiens
tgtctgggtgcagc

SEQ ID NO: 852263 - DNA, 16 bp, Homo sapiens
tgtctgggtgcagctg

SEQ ID NO: 852264 - DNA, 17 bp, Homo sapiens
tgtctgggtttgagaaa

SEQ ID NO: 852265 - DNA, 22 bp, Homo sapiens
tgtctgggtttggcccaagact

SEQ ID NO: 852266 - DNA, 17 bp, Homo sapiens
tgtctggtttctgtccc

SEQ ID NO: 852267 - DNA, 15 bp, Homo sapiens
tgtctgtaaaaaatg

SEQ ID NO: 852268 - DNA, 21 bp, Homo sapiens
tgtctgtaaatctaacattat

SEQ ID NO: 852269 - DNA, 22 bp, Homo sapiens
tgtctgtaaatctaacattatt

SEQ ID NO: 852270 - DNA, 13 bp, Homo sapiens
tgtctgtacatac

SEQ ID NO: 852271 - DNA, 20 bp, Homo sapiens
tgtctgtacatactggcctc

SEQ ID NO: 852272 - DNA, 23 bp, Homo sapiens
tgtctgtagctcctcaactcacc

SEQ ID NO: 852273 - DNA, 20 bp, Homo sapiens
tgtctgtaggtgtctctggg

SEQ ID NO: 852274 - DNA, 20 bp, Homo sapiens
tgtctgtatttcatgtggct

SEQ ID NO: 852275 - DNA, 16 bp, Homo sapiens
tgtctgtcaatcacag

SEQ ID NO: 852276 - DNA, 21 bp, Homo sapiens
tgtctgtcacaggctgggtca

SEQ ID NO: 852277 - DNA, 24 bp, Homo sapiens
tgtctgtcaccagctatctgtcat

SEQ ID NO: 852278 - DNA, 17 bp, Homo sapiens
tgtctgtccatctgtct

SEQ ID NO: 852279 - DNA, 21 bp, Homo sapiens
tgtctgtccttctgaagtgtg

SEQ ID NO: 852280 - DNA, 14 bp, Homo sapiens
tgtctgtcctttat

SEQ ID NO: 852281 - DNA, 19 bp, Homo sapiens
tgtctgtcgcccttctccc

SEQ ID NO: 852282 - DNA, 23 bp, Homo sapiens
tgtctgtctctccccctctgtct

SEQ ID NO: 852283 - DNA, 13 bp, Homo sapiens
tgtctgtctgcag

SEQ ID NO: 852284 - DNA, 18 bp, Homo sapiens
tgtctgtctttgtgggag

SEQ ID NO: 852285 - DNA, 15 bp, Homo sapiens
tgtctgtgccatggc

SEQ ID NO: 852286 - DNA, 17 bp, Homo sapiens
tgtctgtgccatggccc

SEQ ID NO: 852287 - DNA, 18 bp, Homo sapiens
tgtctgtgccatggcccc

SEQ ID NO: 852288 - DNA, 19 bp, Homo sapiens
tgtctgtgccctccaaaga

SEQ ID NO: 852289 - DNA, 21 bp, Homo sapiens
tgtctgtgctagggaaacttc

SEQ ID NO: 852290 - DNA, 20 bp, Homo sapiens
tgtctgtggatggtcattgc

SEQ ID NO: 852291 - DNA, 21 bp, Homo sapiens
tgtctgtggatggtcattgca

SEQ ID NO: 852292 - DNA, 19 bp, Homo sapiens
tgtctgtggcaaaagttta

SEQ ID NO: 852293 - DNA, 12 bp, Homo sapiens
tgtctgtgggct

SEQ ID NO: 852294 - DNA, 17 bp, Homo sapiens
tgtctgtgggcttcagc

SEQ ID NO: 852295 - DNA, 20 bp, Homo sapiens
tgtctgtgttttgaaagaat

SEQ ID NO: 852296 - DNA, 22 bp, Homo sapiens
tgtctgttaccatgtcactgtg

SEQ ID NO: 852297 - DNA, 13 bp, Homo sapiens
tgtctgttctaca

SEQ ID NO: 852298 - DNA, 22 bp, Homo sapiens
tgtctgtttatatattgaaagt

SEQ ID NO: 852299 - DNA, 15 bp, Homo sapiens
tgtctgtttttgtat

SEQ ID NO: 852300 - DNA, 15 bp, Homo sapiens
tgtcttaaaaaatgt

SEQ ID NO: 852301 - DNA, 20 bp, Homo sapiens
tgtcttaaactaaatgtgca

SEQ ID NO: 852302 - DNA, 17 bp, Homo sapiens
tgtcttaaataaaacta

SEQ ID NO: 852303 - DNA, 16 bp, Homo sapiens
tgtcttaaatgctcat

SEQ ID NO: 852304 - DNA, 17 bp, Homo sapiens
tgtcttaatactgtcct

SEQ ID NO: 852305 - DNA, 14 bp, Homo sapiens
tgtcttaattatta

SEQ ID NO: 852306 - DNA, 18 bp, Homo sapiens
tgtcttaattttctttca

SEQ ID NO: 852307 - DNA, 22 bp, Homo sapiens
tgtcttagaagaaattaatata

SEQ ID NO: 852308 - DNA, 22 bp, Homo sapiens
tgtcttatatatatttctttgt

SEQ ID NO: 852309 - DNA, 21 bp, Homo sapiens
tgtcttatcccccccagcctg

SEQ ID NO: 852310 - DNA, 16 bp, Homo sapiens
tgtcttatggtccaga

SEQ ID NO: 852311 - DNA, 14 bp, Homo sapiens
tgtcttattcttaa

SEQ ID NO: 852312 - DNA, 21 bp, Homo sapiens
tgtcttcaatttgtataaaat

SEQ ID NO: 852313 - DNA, 13 bp, Homo sapiens
tgtcttcacttaa

SEQ ID NO: 852314 - DNA, 20 bp, Homo sapiens
tgtcttcacttaatccattt

SEQ ID NO: 852315 - DNA, 21 bp, Homo sapiens
tgtcttcatcacttcttccac

SEQ ID NO: 852316 - DNA, 23 bp, Homo sapiens
tgtcttcatttcattgtatgatg

SEQ ID NO: 852317 - DNA, 16 bp, Homo sapiens
tgtcttccaaggagac

SEQ ID NO: 852318 - DNA, 15 bp, Homo sapiens
tgtcttccactttgc

SEQ ID NO: 852319 - DNA, 12 bp, Homo sapiens
tgtcttccataa

SEQ ID NO: 852320 - DNA, 18 bp, Homo sapiens
tgtcttccatgtgaacag

SEQ ID NO: 852321 - DNA, 14 bp, Homo sapiens
tgtcttcccccctc

SEQ ID NO: 852322 - DNA, 17 bp, Homo sapiens
tgtcttcccccctctcc

SEQ ID NO: 852323 - DNA, 18 bp, Homo sapiens
tgtcttcccccctctcct

SEQ ID NO: 852324 - DNA, 19 bp, Homo sapiens
tgtcttcccccctctcctc

SEQ ID NO: 852325 - DNA, 22 bp, Homo sapiens
tgtcttcccccctctcctccca

SEQ ID NO: 852326 - DNA, 23 bp, Homo sapiens
tgtcttcccccctctcctcccag

SEQ ID NO: 852327 - DNA, 12 bp, Homo sapiens
tgtcttccctgg

SEQ ID NO: 852328 - DNA, 13 bp, Homo sapiens
tgtcttccctggg

SEQ ID NO: 852329 - DNA, 23 bp, Homo sapiens
tgtcttccctgggctgccaccag

SEQ ID NO: 852330 - DNA, 21 bp, Homo sapiens
tgtcttccgatcaacatttat

SEQ ID NO: 852331 - DNA, 11 bp, Homo sapiens
tgtcttcctca

SEQ ID NO: 852332 - DNA, 18 bp, Homo sapiens
tgtcttctctatcctctc

SEQ ID NO: 852333 - DNA, 21 bp, Homo sapiens
tgtcttctctatcctctctct

SEQ ID NO: 852334 - DNA, 15 bp, Homo sapiens
tgtcttctctccact

SEQ ID NO: 852335 - DNA, 20 bp, Homo sapiens
tgtggagaccctgccacagc

SEQ ID NO: 852336 - DNA, 14 bp, Homo sapiens
tgtggagaggggtg

SEQ ID NO: 852337 - DNA, 19 bp, Homo sapiens
tgtggagcaaaaggcagct

SEQ ID NO: 852338 - DNA, 20 bp, Homo sapiens
tgtggagcaaaaggcagctc

SEQ ID NO: 852339 - DNA, 15 bp, Homo sapiens
tgtggagcagagctc

SEQ ID NO: 852340 - DNA, 15 bp, Homo sapiens
tgtggagcagcagcc

SEQ ID NO: 852341 - DNA, 16 bp, Homo sapiens
tgtggagccgaggcct

SEQ ID NO: 852342 - DNA, 15 bp, Homo sapiens
tgtggagctgccaca

SEQ ID NO: 852343 - DNA, 15 bp, Homo sapiens
tgtggaggaagagcc

SEQ ID NO: 852344 - DNA, 16 bp, Homo sapiens
tgtggaggaagagcca

SEQ ID NO: 852345 - DNA, 17 bp, Homo sapiens
tgtggaggaagagccac

SEQ ID NO: 852346 - DNA, 20 bp, Homo sapiens
tgtggaggaagagccacctg

SEQ ID NO: 852347 - DNA, 21 bp, Homo sapiens
tgtggaggaagagccacctgc

SEQ ID NO: 852348 - DNA, 13 bp, Homo sapiens
tgtggaggcctga

SEQ ID NO: 852349 - DNA, 21 bp, Homo sapiens
tgtggagggagggcagctggc

SEQ ID NO: 852350 - DNA, 22 bp, Homo sapiens
tgtggaggggcagcctgtgcct

SEQ ID NO: 852351 - DNA, 17 bp, Homo sapiens
tgtggaggtggaaaatg

SEQ ID NO: 852352 - DNA, 15 bp, Homo sapiens
tgtggagtccagctc

SEQ ID NO: 852353 - DNA, 21 bp, Homo sapiens
tgtggagttcaccttggaagg

SEQ ID NO: 852354 - DNA, 15 bp, Homo sapiens
tgtggagttcctgct

SEQ ID NO: 852355 - DNA, 22 bp, Homo sapiens
tgtggagttcctgctccgtgga

SEQ ID NO: 852356 - DNA, 18 bp, Homo sapiens
tgtggataaaactgtgta

SEQ ID NO: 852357 - DNA, 19 bp, Homo sapiens
tgtggataaaactgtgtaa

SEQ ID NO: 852358 - DNA, 15 bp, Homo sapiens
tgtggataagggaga

SEQ ID NO: 852359 - DNA, 16 bp, Homo sapiens
tgtggatacagtgccc

SEQ ID NO: 852360 - DNA, 17 bp, Homo sapiens
tgtggatacagtgccca

SEQ ID NO: 852361 - DNA, 14 bp, Homo sapiens
tgtggatcagagat

SEQ ID NO: 852362 - DNA, 19 bp, Homo sapiens
tgtggatgctccagggcag

SEQ ID NO: 852363 - DNA, 17 bp, Homo sapiens
tgtggattctgaggccc

SEQ ID NO: 852364 - DNA, 14 bp, Homo sapiens
tgtggattctttaa

SEQ ID NO: 852365 - DNA, 19 bp, Homo sapiens
tgtggatttaacagaaatg

SEQ ID NO: 852366 - DNA, 21 bp, Homo sapiens
tgtggattttctactgtaaga

SEQ ID NO: 852367 - DNA, 22 bp, Homo sapiens
tgtggattttttccttcaaagt

SEQ ID NO: 852368 - DNA, 14 bp, Homo sapiens
tgtggcaagtgaat

SEQ ID NO: 852369 - DNA, 15 bp, Homo sapiens
tgtggcaagtgaatt

SEQ ID NO: 852370 - DNA, 18 bp, Homo sapiens
tgtggcaatctgtgggct

SEQ ID NO: 852371 - DNA, 22 bp, Homo sapiens
tgtggcacagacttctggaagg

SEQ ID NO: 852372 - DNA, 20 bp, Homo sapiens
tgtggcagagttacagttct

SEQ ID NO: 852373 - DNA, 21 bp, Homo sapiens
tgtggcagccgtcccaggcca

SEQ ID NO: 852374 - DNA, 20 bp, Homo sapiens
tgtggcagggggccccgcca

SEQ ID NO: 852375 - DNA, 17 bp, Homo sapiens
tgtggcatctttgcctt

SEQ ID NO: 852376 - DNA, 15 bp, Homo sapiens
tgtggccaaccagga

SEQ ID NO: 852377 - DNA, 18 bp, Homo sapiens
tgtggccaaggagctgct

SEQ ID NO: 852378 - DNA, 20 bp, Homo sapiens
tgtggccaaggagctgctat

SEQ ID NO: 852379 - DNA, 22 bp, Homo sapiens
tgtggccacaactgctgtggcc

SEQ ID NO: 852380 - DNA, 15 bp, Homo sapiens
tgtggccacagcccc

SEQ ID NO: 852381 - DNA, 15 bp, Homo sapiens
tgtggccagagctgg

SEQ ID NO: 852382 - DNA, 22 bp, Homo sapiens
tgtggccagagctggaaggcag

SEQ ID NO: 852383 - DNA, 13 bp, Homo sapiens
tgtggccaggcct

SEQ ID NO: 852384 - DNA, 19 bp, Homo sapiens
tgtggccagggtgagagct

SEQ ID NO: 852385 - DNA, 19 bp, Homo sapiens
tgtggccatcactcagccc

SEQ ID NO: 852386 - DNA, 16 bp, Homo sapiens
tgtggcccagttctga

SEQ ID NO: 852387 - DNA, 17 bp, Homo sapiens
tgtggccccaagagggg

SEQ ID NO: 852388 - DNA, 12 bp, Homo sapiens
tgtggccccacc

SEQ ID NO: 852389 - DNA, 13 bp, Homo sapiens
tgtggccccaccc

SEQ ID NO: 852390 - DNA, 22 bp, Homo sapiens
tgtggcccctgaacaagaattg

SEQ ID NO: 852391 - DNA, 13 bp, Homo sapiens
tgtggccccttca

SEQ ID NO: 852392 - DNA, 13 bp, Homo sapiens
tgtggccctgcca

SEQ ID NO: 852393 - DNA, 23 bp, Homo sapiens
tgtggccctgccatcttcccagc

SEQ ID NO: 852394 - DNA, 13 bp, Homo sapiens
tgtggccctgccc

SEQ ID NO: 852395 - DNA, 19 bp, Homo sapiens
tgtggccctgcccttggca

SEQ ID NO: 852396 - DNA, 20 bp, Homo sapiens
tgtggccctgcccttggcac

SEQ ID NO: 852397 - DNA, 13 bp, Homo sapiens
tgtggccctggag

SEQ ID NO: 852398 - DNA, 15 bp, Homo sapiens
tgtggccctggccac

SEQ ID NO: 852399 - DNA, 22 bp, Homo sapiens
tgtggccctggccactaaagct

SEQ ID NO: 852400 - DNA, 14 bp, Homo sapiens
tgtggccctggcct

SEQ ID NO: 852401 - DNA, 16 bp, Homo sapiens
tgtggccgaggacttt

SEQ ID NO: 852402 - DNA, 15 bp, Homo sapiens
tgtggccgccatctg

SEQ ID NO: 852403 - DNA, 19 bp, Homo sapiens
tgtggccgtctcctccctc

SEQ ID NO: 852404 - DNA, 21 bp, Homo sapiens
tgtggcctagacttctgagta

SEQ ID NO: 852405 - DNA, 10 bp, Homo sapiens
tgtggcctca

SEQ ID NO: 852406 - DNA, 13 bp, Homo sapiens
tgtggcctcagcc

SEQ ID NO: 852407 - DNA, 18 bp, Homo sapiens
tgtggcctcagccctcag

SEQ ID NO: 852408 - DNA, 15 bp, Homo sapiens
tgtggcctccatgtg

SEQ ID NO: 852409 - DNA, 22 bp, Homo sapiens
tgtggcctccctggctcctccg

SEQ ID NO: 852410 - DNA, 11 bp, Homo sapiens
tgtggcctgca

SEQ ID NO: 852411 - DNA, 13 bp, Homo sapiens
tgtggcctgccca

SEQ ID NO: 852412 - DNA, 17 bp, Homo sapiens
tgtggcctggtgggtca

SEQ ID NO: 852413 - DNA, 20 bp, Homo sapiens
tgtggcctggtgggtcaggg

SEQ ID NO: 852414 - DNA, 15 bp, Homo sapiens
tgtggcctgtggcct

SEQ ID NO: 852415 - DNA, 16 bp, Homo sapiens
tgtggcctgtggcctg

SEQ ID NO: 852416 - DNA, 13 bp, Homo sapiens
tgtggcctgtgtc

SEQ ID NO: 852417 - DNA, 21 bp, Homo sapiens
tgtggcctgtgtccagcagct

SEQ ID NO: 852418 - DNA, 23 bp, Homo sapiens
tgtggcctgtgtccagcagctgc

SEQ ID NO: 852419 - DNA, 20 bp, Homo sapiens
tgtggccttccatttatatg

SEQ ID NO: 852420 - DNA, 21 bp, Homo sapiens
tgtggccttttttataactaa

SEQ ID NO: 852421 - DNA, 19 bp, Homo sapiens
tgtggcgccgtctccaggg

SEQ ID NO: 852422 - DNA, 23 bp, Homo sapiens
tgtggcgccgtctccaggggctg

SEQ ID NO: 852423 - DNA, 16 bp, Homo sapiens
tgtggcgtctccctcg

SEQ ID NO: 852424 - DNA, 10 bp, Homo sapiens
tgtggctcac

SEQ ID NO: 852425 - DNA, 20 bp, Homo sapiens
tgtggctcaggggagcaagc

SEQ ID NO: 852426 - DNA, 22 bp, Homo sapiens
tgtggctcaggggagcaagctt

SEQ ID NO: 852427 - DNA, 13 bp, Homo sapiens
tgtggctcccctc

SEQ ID NO: 852428 - DNA, 15 bp, Homo sapiens
tgtggctcctaccag

SEQ ID NO: 852429 - DNA, 13 bp, Homo sapiens
tgtggctgatgat

SEQ ID NO: 852430 - DNA, 14 bp, Homo sapiens
tgtggctgctagca

SEQ ID NO: 852431 - DNA, 12 bp, Homo sapiens
tgtggctggctc

SEQ ID NO: 852432 - DNA, 13 bp, Homo sapiens
tgtggctggctct

SEQ ID NO: 852433 - DNA, 13 bp, Homo sapiens
tgtggcttgggac

SEQ ID NO: 852434 - DNA, 21 bp, Homo sapiens
tgtggctttttgttcagaatt

SEQ ID NO: 852435 - DNA, 12 bp, Homo sapiens
tgtgggaacaga

SEQ ID NO: 852436 - DNA, 18 bp, Homo sapiens
tgtgggaacattattttt

SEQ ID NO: 852437 - DNA, 21 bp, Homo sapiens
tgtgggaacattatttttaga

SEQ ID NO: 852438 - DNA, 22 bp, Homo sapiens
tgtgggaagaccaaaggaagga

SEQ ID NO: 852439 - DNA, 15 bp, Homo sapiens
tgtgggaagggagag

SEQ ID NO: 852440 - DNA, 18 bp, Homo sapiens
tgtgggaccgcctggccc

SEQ ID NO: 852441 - DNA, 16 bp, Homo sapiens
tgtgggagacagcagc

SEQ ID NO: 852442 - DNA, 18 bp, Homo sapiens
tgtgggagacagcagcct

SEQ ID NO: 852443 - DNA, 21 bp, Homo sapiens
tgtgggagggagcagacagga

SEQ ID NO: 852444 - DNA, 13 bp, Homo sapiens
tgtgggagtgagg

SEQ ID NO: 852445 - DNA, 22 bp, Homo sapiens
tgtgggatacttagtggtatgt

SEQ ID NO: 852446 - DNA, 18 bp, Homo sapiens
tgtgggatcattgcattt

SEQ ID NO: 852447 - DNA, 21 bp, Homo sapiens
tgtgggatggagagtggggag

SEQ ID NO: 852448 - DNA, 14 bp, Homo sapiens
tgtgggcagcaccc

SEQ ID NO: 852449 - DNA, 15 bp, Homo sapiens
tgtgggcagcaccct

SEQ ID NO: 852450 - DNA, 16 bp, Homo sapiens
tgtgggcaggaagtga

SEQ ID NO: 852451 - DNA, 13 bp, Homo sapiens
tgtgggcagggtt

SEQ ID NO: 852452 - DNA, 21 bp, Homo sapiens
tgtgggccaagtccactgtcc

SEQ ID NO: 852453 - DNA, 22 bp, Homo sapiens
tgtgggcctcacctgcccctct

SEQ ID NO: 852454 - DNA, 17 bp, Homo sapiens
tgtggggaagaggggct

SEQ ID NO: 852455 - DNA, 20 bp, Homo sapiens
tgtggggatctcaggggctg

SEQ ID NO: 852456 - DNA, 16 bp, Homo sapiens
tgtggggattttcact

SEQ ID NO: 852457 - DNA, 16 bp, Homo sapiens
tgttaatgtcattgct

SEQ ID NO: 852458 - DNA, 21 bp, Homo sapiens
tgttaatgtcattgctaaaaa

SEQ ID NO: 852459 - DNA, 16 bp, Homo sapiens
tgttaattcctatgaa

SEQ ID NO: 852460 - DNA, 20 bp, Homo sapiens
tgttaattgcgtagaggcta

SEQ ID NO: 852461 - DNA, 17 bp, Homo sapiens
tgttaatttagaaaact

SEQ ID NO: 852462 - DNA, 23 bp, Homo sapiens
tgttaatttataatgtatttgaa

SEQ ID NO: 852463 - DNA, 14 bp, Homo sapiens
tgttaatttatttt

SEQ ID NO: 852464 - DNA, 21 bp, Homo sapiens
tgttaatttattttgctccct

SEQ ID NO: 852465 - DNA, 23 bp, Homo sapiens
tgttaatttattttgctccctct

SEQ ID NO: 852466 - DNA, 16 bp, Homo sapiens
tgttaatttttgatac

SEQ ID NO: 852467 - DNA, 22 bp, Homo sapiens
tgttaattttttggtacaaaaa

SEQ ID NO: 852468 - DNA, 20 bp, Homo sapiens
tgttacaaattttttaattt

SEQ ID NO: 852469 - DNA, 10 bp, Homo sapiens
tgttacaagt

SEQ ID NO: 852470 - DNA, 15 bp, Homo sapiens
tgttacaagtttgct

SEQ ID NO: 852471 - DNA, 22 bp, Homo sapiens
tgttacaagtttgctaaaagaa

SEQ ID NO: 852472 - DNA, 22 bp, Homo sapiens
tgttacacaatggtttttaaat

SEQ ID NO: 852473 - DNA, 17 bp, Homo sapiens
tgttacacagcccaaga

SEQ ID NO: 852474 - DNA, 20 bp, Homo sapiens
tgttacacagcccaagagga

SEQ ID NO: 852475 - DNA, 14 bp, Homo sapiens
tgttacagtaatgt

SEQ ID NO: 852476 - DNA, 19 bp, Homo sapiens
tgttacataagataaatgt

SEQ ID NO: 852477 - DNA, 20 bp, Homo sapiens
tgttacataaggatgacttt

SEQ ID NO: 852478 - DNA, 17 bp, Homo sapiens
tgttacattaaagccct

SEQ ID NO: 852479 - DNA, 14 bp, Homo sapiens
tgttacattattcc

SEQ ID NO: 852480 - DNA, 13 bp, Homo sapiens
tgttacattttta

SEQ ID NO: 852481 - DNA, 18 bp, Homo sapiens
tgttaccatactgtctct

SEQ ID NO: 852482 - DNA, 18 bp, Homo sapiens
tgttaccatgtatgtata

SEQ ID NO: 852483 - DNA, 18 bp, Homo sapiens
tgttaccatgtcactgtg

SEQ ID NO: 852484 - DNA, 16 bp, Homo sapiens
tgttacctactttgac

SEQ ID NO: 852485 - DNA, 22 bp, Homo sapiens
tgttacctgaaaacactgtgca

SEQ ID NO: 852486 - DNA, 13 bp, Homo sapiens
tgttacctgtgtg

SEQ ID NO: 852487 - DNA, 22 bp, Homo sapiens
tgttactattttctacaattaa

SEQ ID NO: 852488 - DNA, 22 bp, Homo sapiens
tgttactctcttgcaccaaatt

SEQ ID NO: 852489 - DNA, 17 bp, Homo sapiens
tgttactctggttcttt

SEQ ID NO: 852490 - DNA, 19 bp, Homo sapiens
tgttactgattcaattata

SEQ ID NO: 852491 - DNA, 15 bp, Homo sapiens
tgttactgcttcatt

SEQ ID NO: 852492 - DNA, 21 bp, Homo sapiens
tgttactgcttctctttgtgc

SEQ ID NO: 852493 - DNA, 16 bp, Homo sapiens
tgttactgctttgcaa

SEQ ID NO: 852494 - DNA, 18 bp, Homo sapiens
tgttactgctttgcaaag

SEQ ID NO: 852495 - DNA, 15 bp, Homo sapiens
tgttactgtaattcc

SEQ ID NO: 852496 - DNA, 18 bp, Homo sapiens
tgttacttacctaaacag

SEQ ID NO: 852497 - DNA, 18 bp, Homo sapiens
tgttacttccccacccct

SEQ ID NO: 852498 - DNA, 14 bp, Homo sapiens
tgttacttgcaggt

SEQ ID NO: 852499 - DNA, 22 bp, Homo sapiens
tgttactttctttcagatgttt

SEQ ID NO: 852500 - DNA, 18 bp, Homo sapiens
tgttagaaaatgacttat

SEQ ID NO: 852501 - DNA, 22 bp, Homo sapiens
tgttagaaaatgacttatttct

SEQ ID NO: 852502 - DNA, 23 bp, Homo sapiens
tgttagaaaatgacttatttctg

SEQ ID NO: 852503 - DNA, 19 bp, Homo sapiens
tgttagaaaatggacactg

SEQ ID NO: 852504 - DNA, 20 bp, Homo sapiens
tgttagaagaagaggaagaa

SEQ ID NO: 852505 - DNA, 20 bp, Homo sapiens
tgttagaccagaaagtgtgt

SEQ ID NO: 852506 - DNA, 15 bp, Homo sapiens
tgttagactcatggt

SEQ ID NO: 852507 - DNA, 16 bp, Homo sapiens
tgttagagagaaagag

SEQ ID NO: 852508 - DNA, 14 bp, Homo sapiens
tgttagagagcttt

SEQ ID NO: 852509 - DNA, 21 bp, Homo sapiens
tgttagagaggtagcgagctg

SEQ ID NO: 852510 - DNA, 22 bp, Homo sapiens
tgttagaggttttaaagtgatt

SEQ ID NO: 852511 - DNA, 12 bp, Homo sapiens
tgttagatgctg

SEQ ID NO: 852512 - DNA, 22 bp, Homo sapiens
tgttagatgctgaatatctgtt

SEQ ID NO: 852513 - DNA, 19 bp, Homo sapiens
tgttagcactgatagtcct

SEQ ID NO: 852514 - DNA, 13 bp, Homo sapiens
tgttagcactgtt

SEQ ID NO: 852515 - DNA, 16 bp, Homo sapiens
tgttagcactgttgat

SEQ ID NO: 852516 - DNA, 17 bp, Homo sapiens
tgttagcactgttgatg

SEQ ID NO: 852517 - DNA, 20 bp, Homo sapiens
tgttagcagacccagcttag

SEQ ID NO: 852518 - DNA, 17 bp, Homo sapiens
tgttagccccataattt

SEQ ID NO: 852519 - DNA, 15 bp, Homo sapiens
tgttagcccttcaga

SEQ ID NO: 852520 - DNA, 19 bp, Homo sapiens
tgttagcccttcagattgt

SEQ ID NO: 852521 - DNA, 16 bp, Homo sapiens
tgttagctacacagtg

SEQ ID NO: 852522 - DNA, 19 bp, Homo sapiens
tgttagctacacagtgcag

SEQ ID NO: 852523 - DNA, 21 bp, Homo sapiens
tgttaggattttcacattctt

SEQ ID NO: 852524 - DNA, 19 bp, Homo sapiens
tgttaggcttttctgcctg

SEQ ID NO: 852525 - DNA, 16 bp, Homo sapiens
tgttagggctgctttt

SEQ ID NO: 852526 - DNA, 19 bp, Homo sapiens
tgttagggctgcttttctt

SEQ ID NO: 852527 - DNA, 22 bp, Homo sapiens
tgttagggtataagttgctgta

SEQ ID NO: 852528 - DNA, 21 bp, Homo sapiens
tgttagggtcagccattttta

SEQ ID NO: 852529 - DNA, 20 bp, Homo sapiens
tgttagtagaaattttacaa

SEQ ID NO: 852530 - DNA, 17 bp, Homo sapiens
tgttagtatgaggcatt

SEQ ID NO: 852531 - DNA, 19 bp, Homo sapiens
tgttagtatgaggcatttg

SEQ ID NO: 852532 - DNA, 20 bp, Homo sapiens
tgttagtatgaggcatttgt

SEQ ID NO: 852533 - DNA, 14 bp, Homo sapiens
tgttagtgctggtc

SEQ ID NO: 852534 - DNA, 17 bp, Homo sapiens
tgttagtgctggtcaga

SEQ ID NO: 852535 - DNA, 15 bp, Homo sapiens
tgttagtgtctgtcc

SEQ ID NO: 852536 - DNA, 16 bp, Homo sapiens
tgttagtgtgtgtgca

SEQ ID NO: 852537 - DNA, 18 bp, Homo sapiens
tgttagtgtgtgtgcatg

SEQ ID NO: 852538 - DNA, 19 bp, Homo sapiens
tgttagtgtgtgtgcatgt

SEQ ID NO: 852539 - DNA, 23 bp, Homo sapiens
tgttagttaccttatagttactg

SEQ ID NO: 852540 - DNA, 21 bp, Homo sapiens
tgttagttttgtaaaaactga

SEQ ID NO: 852541 - DNA, 13 bp, Homo sapiens
tgttataaagaca

SEQ ID NO: 852542 - DNA, 14 bp, Homo sapiens
tgttataaataaaa

SEQ ID NO: 852543 - DNA, 14 bp, Homo sapiens
tgttataactctgc

SEQ ID NO: 852544 - DNA, 15 bp, Homo sapiens
tgttataactctgca

SEQ ID NO: 852545 - DNA, 17 bp, Homo sapiens
tgttataactctgcact

SEQ ID NO: 852546 - DNA, 17 bp, Homo sapiens
tgttatacaaccttcat

SEQ ID NO: 852547 - DNA, 20 bp, Homo sapiens
tgttatacaaccttcattta

SEQ ID NO: 852548 - DNA, 21 bp, Homo sapiens
tgttatacaaccttcatttaa

SEQ ID NO: 852549 - DNA, 13 bp, Homo sapiens
tgttatacttcaa

SEQ ID NO: 852550 - DNA, 19 bp, Homo sapiens
tgttatagaatagcctgag

SEQ ID NO: 852551 - DNA, 15 bp, Homo sapiens
tgttatataatttag

SEQ ID NO: 852552 - DNA, 21 bp, Homo sapiens
tgttatatatctcttttggtc

SEQ ID NO: 852553 - DNA, 16 bp, Homo sapiens
tgttatattaagcaga

SEQ ID NO: 852554 - DNA, 16 bp, Homo sapiens
tgttatattccaagga

SEQ ID NO: 852555 - DNA, 21 bp, Homo sapiens
tgttatattccaaggaaaatt

SEQ ID NO: 852556 - DNA, 23 bp, Homo sapiens
tgttatatttaatgcattaaacc

SEQ ID NO: 852557 - DNA, 17 bp, Homo sapiens
tgttatcaaccaactgc

SEQ ID NO: 852558 - DNA, 23 bp, Homo sapiens
tgttatcagctgggcagtgccag

SEQ ID NO: 852559 - DNA, 21 bp, Homo sapiens
tgttatcagtcaatattttta

SEQ ID NO: 852560 - DNA, 20 bp, Homo sapiens
tgttatcctcttgtatactt

SEQ ID NO: 852561 - DNA, 23 bp, Homo sapiens
tgttatcctgctagctgtagaaa

SEQ ID NO: 852562 - DNA, 15 bp, Homo sapiens
tgttatctcttgtta

SEQ ID NO: 852563 - DNA, 22 bp, Homo sapiens
tgttatcttatactgtacaata

SEQ ID NO: 852564 - DNA, 21 bp, Homo sapiens
tgttatgaaaatcctatatct

SEQ ID NO: 852565 - DNA, 23 bp, Homo sapiens
tgttatgaaaatcctatatctgt

SEQ ID NO: 852566 - DNA, 13 bp, Homo sapiens
tgttatgaaataa

SEQ ID NO: 852567 - DNA, 16 bp, Homo sapiens
tgttatgaaataaaga

SEQ ID NO: 852568 - DNA, 21 bp, Homo sapiens
tgttatgaaataaagaaattg

SEQ ID NO: 852569 - DNA, 24 bp, Homo sapiens
tgttatgaacagctgtgtctgcca

SEQ ID NO: 852570 - DNA, 13 bp, Homo sapiens
tgttatgaacatg

SEQ ID NO: 852571 - DNA, 17 bp, Homo sapiens
tgttatgactatgtaaa

SEQ ID NO: 852572 - DNA, 20 bp, Homo sapiens
tgttatgactatgtaaacta

SEQ ID NO: 852573 - DNA, 21 bp, Homo sapiens
tgttatgaggatataatgtgt

SEQ ID NO: 852574 - DNA, 18 bp, Homo sapiens
tgttatgatattgtttaa

SEQ ID NO: 852575 - DNA, 16 bp, Homo sapiens
tgttatgcactgtggt

SEQ ID NO: 852576 - DNA, 15 bp, Homo sapiens
tgttatgctgtgaca

SEQ ID NO: 852577 - DNA, 16 bp, Homo sapiens
tgtttaagtgtttaga

SEQ ID NO: 852578 - DNA, 15 bp, Homo sapiens
tgtttaatatttaaa

SEQ ID NO: 852579 - DNA, 14 bp, Homo sapiens
tgtttaatctgtta

SEQ ID NO: 852580 - DNA, 20 bp, Homo sapiens
tgtttaatctgttatgtact

SEQ ID NO: 852581 - DNA, 19 bp, Homo sapiens
tgtttaatgttcattttct

SEQ ID NO: 852582 - DNA, 19 bp, Homo sapiens
tgtttaatgttctgtgata

SEQ ID NO: 852583 - DNA, 18 bp, Homo sapiens
tgtttaatttttatttct

SEQ ID NO: 852584 - DNA, 19 bp, Homo sapiens
tgtttaatttttatttctt

SEQ ID NO: 852585 - DNA, 15 bp, Homo sapiens
tgtttacaaacatgg

SEQ ID NO: 852586 - DNA, 22 bp, Homo sapiens
tgtttacagcactactctgtgc

SEQ ID NO: 852587 - DNA, 22 bp, Homo sapiens
tgtttacagtatgatgaaaata

SEQ ID NO: 852588 - DNA, 12 bp, Homo sapiens
tgtttacatatc

SEQ ID NO: 852589 - DNA, 17 bp, Homo sapiens
tgtttaccgtgtgttat

SEQ ID NO: 852590 - DNA, 16 bp, Homo sapiens
tgtttactgattagag

SEQ ID NO: 852591 - DNA, 13 bp, Homo sapiens
tgtttactgcttt

SEQ ID NO: 852592 - DNA, 15 bp, Homo sapiens
tgtttacttgaatag

SEQ ID NO: 852593 - DNA, 22 bp, Homo sapiens
tgtttacttgaatagtattgtg

SEQ ID NO: 852594 - DNA, 13 bp, Homo sapiens
tgtttagaaacag

SEQ ID NO: 852595 - DNA, 18 bp, Homo sapiens
tgtttagaaacagaaata

SEQ ID NO: 852596 - DNA, 17 bp, Homo sapiens
tgtttagcagcagcctt

SEQ ID NO: 852597 - DNA, 16 bp, Homo sapiens
tgtttaggcctcattt

SEQ ID NO: 852598 - DNA, 18 bp, Homo sapiens
tgtttaggcctcatttct

SEQ ID NO: 852599 - DNA, 20 bp, Homo sapiens
tgtttaggcctcatttcttt

SEQ ID NO: 852600 - DNA, 21 bp, Homo sapiens
tgtttagtattctcttgtgca

SEQ ID NO: 852601 - DNA, 16 bp, Homo sapiens
tgtttagttcagcaaa

SEQ ID NO: 852602 - DNA, 19 bp, Homo sapiens
tgtttataaatcttatgct

SEQ ID NO: 852603 - DNA, 14 bp, Homo sapiens
tgtttataactcta

SEQ ID NO: 852604 - DNA, 14 bp, Homo sapiens
tgtttataattgtt

SEQ ID NO: 852605 - DNA, 15 bp, Homo sapiens
tgtttataattgttt

SEQ ID NO: 852606 - DNA, 17 bp, Homo sapiens
tgtttataattgtttat

SEQ ID NO: 852607 - DNA, 18 bp, Homo sapiens
tgtttataattgtttata

SEQ ID NO: 852608 - DNA, 19 bp, Homo sapiens
tgtttatagctcatttgta

SEQ ID NO: 852609 - DNA, 21 bp, Homo sapiens
tgtttatatacagtacacaga

SEQ ID NO: 852610 - DNA, 17 bp, Homo sapiens
tgtttatatggaagaaa

SEQ ID NO: 852611 - DNA, 15 bp, Homo sapiens
tgtttatcctttcat

SEQ ID NO: 852612 - DNA, 18 bp, Homo sapiens
tgtttatgaattataaat

SEQ ID NO: 852613 - DNA, 16 bp, Homo sapiens
tgtttatgagccagac

SEQ ID NO: 852614 - DNA, 21 bp, Homo sapiens
tgtttatgagccagacaaatg

SEQ ID NO: 852615 - DNA, 22 bp, Homo sapiens
tgtttatgatatttcttgcttt

SEQ ID NO: 852616 - DNA, 17 bp, Homo sapiens
tgtttatgccaaatgtt

SEQ ID NO: 852617 - DNA, 21 bp, Homo sapiens
tgtttatgccaaatgttaact

SEQ ID NO: 852618 - DNA, 17 bp, Homo sapiens
tgtttatggccacattt

SEQ ID NO: 852619 - DNA, 13 bp, Homo sapiens
tgtttatggcctc

SEQ ID NO: 852620 - DNA, 15 bp, Homo sapiens
tgtttatggcctcag

SEQ ID NO: 852621 - DNA, 16 bp, Homo sapiens
tgtttatggtaaaaaa

SEQ ID NO: 852622 - DNA, 14 bp, Homo sapiens
tgtttatgtaattt

SEQ ID NO: 852623 - DNA, 22 bp, Homo sapiens
tgtttatgtgctattaatattt

SEQ ID NO: 852624 - DNA, 19 bp, Homo sapiens
tgtttattaaaattctgaa

SEQ ID NO: 852625 - DNA, 13 bp, Homo sapiens
tgtttattaacaa

SEQ ID NO: 852626 - DNA, 16 bp, Homo sapiens
tgtttattaacaaatt

SEQ ID NO: 852627 - DNA, 17 bp, Homo sapiens
tgtttattaatcttagt

SEQ ID NO: 852628 - DNA, 17 bp, Homo sapiens
tgtttattccttctgta

SEQ ID NO: 852629 - DNA, 22 bp, Homo sapiens
tgtttattctagttaaggaaat

SEQ ID NO: 852630 - DNA, 19 bp, Homo sapiens
tgtttattctctgctgcat

SEQ ID NO: 852631 - DNA, 17 bp, Homo sapiens
tgtttattcttccagaa

SEQ ID NO: 852632 - DNA, 23 bp, Homo sapiens
tgtttattcttccagaatgctga

SEQ ID NO: 852633 - DNA, 22 bp, Homo sapiens
tgtttattgagctgtacatgca

SEQ ID NO: 852634 - DNA, 22 bp, Homo sapiens
tgtttatttataagcagattta

SEQ ID NO: 852635 - DNA, 13 bp, Homo sapiens
tgtttatttcagg

SEQ ID NO: 852636 - DNA, 14 bp, Homo sapiens
tgtttcaaaaccat

SEQ ID NO: 852637 - DNA, 19 bp, Homo sapiens
tgtttcaaaaccatgcctg

SEQ ID NO: 852638 - DNA, 21 bp, Homo sapiens
tgtttcaaatgtgcattttgt

SEQ ID NO: 852639 - DNA, 15 bp, Homo sapiens
tgtttcaacagaggg

SEQ ID NO: 852640 - DNA, 10 bp, Homo sapiens
tgtttcaaga

SEQ ID NO: 852641 - DNA, 19 bp, Homo sapiens
tgtttcaagaacctggaaa

SEQ ID NO: 852642 - DNA, 21 bp, Homo sapiens
tgtttcacagagtgtgctgct

SEQ ID NO: 852643 - DNA, 22 bp, Homo sapiens
tgtttcacagagtgtgctgcta

SEQ ID NO: 852644 - DNA, 15 bp, Homo sapiens
tgtttcactcctgct

SEQ ID NO: 852645 - DNA, 22 bp, Homo sapiens
tgtttcagaatctctctactca

SEQ ID NO: 852646 - DNA, 14 bp, Homo sapiens
tgtttcagaccccc

SEQ ID NO: 852647 - DNA, 15 bp, Homo sapiens
tgtttcagacccccc

SEQ ID NO: 852648 - DNA, 16 bp, Homo sapiens
tgtttcagagcataaa

SEQ ID NO: 852649 - DNA, 13 bp, Homo sapiens
tgtttcagtgtga

SEQ ID NO: 852650 - DNA, 19 bp, Homo sapiens
tgtttcatgttttgtgact

SEQ ID NO: 852651 - DNA, 17 bp, Homo sapiens
tgtttcattcatcctga

SEQ ID NO: 852652 - DNA, 15 bp, Homo sapiens
tgtttcatttctgca

SEQ ID NO: 852653 - DNA, 20 bp, Homo sapiens
tgtttccagaattggtaaaa

SEQ ID NO: 852654 - DNA, 23 bp, Homo sapiens
tgtttccagacttccttgagaca

SEQ ID NO: 852655 - DNA, 21 bp, Homo sapiens
tgtttccagcagaagacaaaa

SEQ ID NO: 852656 - DNA, 21 bp, Homo sapiens
tgtttccagtacacctttcag

SEQ ID NO: 852657 - DNA, 16 bp, Homo sapiens
tgtttccatcatttct

SEQ ID NO: 852658 - DNA, 14 bp, Homo sapiens
tgtttcccataatt

SEQ ID NO: 852659 - DNA, 20 bp, Homo sapiens
tgtttccctcgtccgtctgt

SEQ ID NO: 852660 - DNA, 15 bp, Homo sapiens
tgtttcccttcctcg

SEQ ID NO: 852661 - DNA, 17 bp, Homo sapiens
tgtttcctaatatcaaa

SEQ ID NO: 852662 - DNA, 16 bp, Homo sapiens
tgtttcctagctgtgt

SEQ ID NO: 852663 - DNA, 14 bp, Homo sapiens
tgtttcctcatctt

SEQ ID NO: 852664 - DNA, 14 bp, Homo sapiens
tgtttcctctgttc

SEQ ID NO: 852665 - DNA, 15 bp, Homo sapiens
tgtttcctcttccaa

SEQ ID NO: 852666 - DNA, 13 bp, Homo sapiens
tgtttcctcttga

SEQ ID NO: 852667 - DNA, 22 bp, Homo sapiens
tgtttccttgttggtcagagga

SEQ ID NO: 852668 - DNA, 19 bp, Homo sapiens
tgtttcgcattaagcacac

SEQ ID NO: 852669 - DNA, 23 bp, Homo sapiens
tgtttcgcgggtaactggggttg

SEQ ID NO: 852670 - DNA, 15 bp, Homo sapiens
tgtttcgtggggagg

SEQ ID NO: 852671 - DNA, 14 bp, Homo sapiens
tgtttctaagaaaa

SEQ ID NO: 852672 - DNA, 18 bp, Homo sapiens
tgtttctagctaaataaa

SEQ ID NO: 852673 - DNA, 19 bp, Homo sapiens
tgtttctagctaaataaat

SEQ ID NO: 852674 - DNA, 15 bp, Homo sapiens
tgtttctagggaaat

SEQ ID NO: 852675 - DNA, 19 bp, Homo sapiens
tgtttctattgacttcaat

SEQ ID NO: 852676 - DNA, 14 bp, Homo sapiens
tgtttctcaagtgt

SEQ ID NO: 852677 - DNA, 15 bp, Homo sapiens
tgtttctccccctgg

SEQ ID NO: 852678 - DNA, 13 bp, Homo sapiens
tgtttctctgctg

SEQ ID NO: 852679 - DNA, 14 bp, Homo sapiens
tgtttctctttcct

SEQ ID NO: 852680 - DNA, 22 bp, Homo sapiens
tgtttctctttgattatttgca

SEQ ID NO: 852681 - DNA, 14 bp, Homo sapiens
tgtttctgaaaatt

SEQ ID NO: 852682 - DNA, 16 bp, Homo sapiens
tgtttctgacacaaga

SEQ ID NO: 852683 - DNA, 17 bp, Homo sapiens
tgtttctgacccactga

SEQ ID NO: 852684 - DNA, 18 bp, Homo sapiens
tgtttctgagaccacagt

SEQ ID NO: 852685 - DNA, 12 bp, Homo sapiens
tgtttctgcagt

SEQ ID NO: 852686 - DNA, 21 bp, Homo sapiens
tgtttctgcagtagtctctgt

SEQ ID NO: 852687 - DNA, 22 bp, Homo sapiens
tgtttctgcagtagtctctgtg

SEQ ID NO: 852688 - DNA, 23 bp, Homo sapiens
tgtttctggaagactgctcccgg

SEQ ID NO: 852689 - DNA, 20 bp, Homo sapiens
tgtttctgggtcctgaagaa

SEQ ID NO: 852690 - DNA, 17 bp, Homo sapiens
tgtttctgtaacaaatt

SEQ ID NO: 852691 - DNA, 18 bp, Homo sapiens
tgtttctgtcctgtaact

SEQ ID NO: 852692 - DNA, 20 bp, Homo sapiens
tgtttctgtcctgtaactgt

SEQ ID NO: 852693 - DNA, 17 bp, Homo sapiens
tgtttctgtgccccggc

SEQ ID NO: 852694 - DNA, 19 bp, Homo sapiens
tgtttctgtttcttgctct

SEQ ID NO: 852695 - DNA, 16 bp, Homo sapiens
tgtttcttaaatggaa

SEQ ID NO: 852696 - DNA, 19 bp, Homo sapiens
tgtttcttatattattcca

SEQ ID NO: 852697 - DNA, 17 bp, Homo sapiens
tgtttcttcatttctct

SEQ ID NO: 852698 - DNA, 17 bp, Homo sapiens
tgtttcttccaaagcac

SEQ ID NO: 852699 - DNA, 19 bp, Homo sapiens
ttaaaccagattggagcaa

SEQ ID NO: 852700 - DNA, 21 bp, Homo sapiens
ttaaacccacaagctgcctct

SEQ ID NO: 852701 - DNA, 16 bp, Homo sapiens
ttaaaccgctaaaaga

SEQ ID NO: 852702 - DNA, 18 bp, Homo sapiens
ttaaacctctcttctacc

SEQ ID NO: 852703 - DNA, 20 bp, Homo sapiens
ttaaacctgtctccactgtg

SEQ ID NO: 852704 - DNA, 17 bp, Homo sapiens
ttaaacctttttcttga

SEQ ID NO: 852705 - DNA, 16 bp, Homo sapiens
ttaaacgagataatgt

SEQ ID NO: 852706 - DNA, 23 bp, Homo sapiens
ttaaacgctctaggtacgatgac

SEQ ID NO: 852707 - DNA, 20 bp, Homo sapiens
ttaaactaaaaaaaaaaagg

SEQ ID NO: 852708 - DNA, 15 bp, Homo sapiens
ttaaactaaataatg

SEQ ID NO: 852709 - DNA, 12 bp, Homo sapiens
ttaaactaaatt

SEQ ID NO: 852710 - DNA, 14 bp, Homo sapiens
ttaaactagtttaa

SEQ ID NO: 852711 - DNA, 15 bp, Homo sapiens
ttaaactcaaatgta

SEQ ID NO: 852712 - DNA, 16 bp, Homo sapiens
ttaaactcaagacaat

SEQ ID NO: 852713 - DNA, 14 bp, Homo sapiens
ttaaactcagggac

SEQ ID NO: 852714 - DNA, 13 bp, Homo sapiens
ttaaactctgcca

SEQ ID NO: 852715 - DNA, 19 bp, Homo sapiens
ttaaactctgttgtaagta

SEQ ID NO: 852716 - DNA, 15 bp, Homo sapiens
ttaaactgtacagtg

SEQ ID NO: 852717 - DNA, 17 bp, Homo sapiens
ttaaactgtacagtgtc

SEQ ID NO: 852718 - DNA, 21 bp, Homo sapiens
ttaaactgtacagtgtctttt

SEQ ID NO: 852719 - DNA, 19 bp, Homo sapiens
ttaaactgttagcactgtt

SEQ ID NO: 852720 - DNA, 22 bp, Homo sapiens
ttaaacttaatctaaatggaac

SEQ ID NO: 852721 - DNA, 13 bp, Homo sapiens
ttaaacttccaaa

SEQ ID NO: 852722 - DNA, 17 bp, Homo sapiens
ttaaacttccaaagctt

SEQ ID NO: 852723 - DNA, 12 bp, Homo sapiens
ttaaacttgaaa

SEQ ID NO: 852724 - DNA, 15 bp, Homo sapiens
ttaaacttgaaatat

SEQ ID NO: 852725 - DNA, 15 bp, Homo sapiens
ttaaacttgacccag

SEQ ID NO: 852726 - DNA, 17 bp, Homo sapiens
ttaaacttgcatcactt

SEQ ID NO: 852727 - DNA, 16 bp, Homo sapiens
ttaaacttgtcagaat

SEQ ID NO: 852728 - DNA, 20 bp, Homo sapiens
ttaaactttgtgcctttgac

SEQ ID NO: 852729 - DNA, 17 bp, Homo sapiens
ttaaacttttaattcat

SEQ ID NO: 852730 - DNA, 13 bp, Homo sapiens
ttaaactttttaa

SEQ ID NO: 852731 - DNA, 15 bp, Homo sapiens
ttaaacttttttaac

SEQ ID NO: 852732 - DNA, 14 bp, Homo sapiens
ttaaagaaacagct

SEQ ID NO: 852733 - DNA, 14 bp, Homo sapiens
ttaaagaaaggaaa

SEQ ID NO: 852734 - DNA, 16 bp, Homo sapiens
ttaaagaaaggaaaag

SEQ ID NO: 852735 - DNA, 17 bp, Homo sapiens
ttaaagaaaggaaaaga

SEQ ID NO: 852736 - DNA, 14 bp, Homo sapiens
ttaaagaagtattt

SEQ ID NO: 852737 - DNA, 13 bp, Homo sapiens
ttaaagaatgtta

SEQ ID NO: 852738 - DNA, 17 bp, Homo sapiens
ttaaagacagggtcttg

SEQ ID NO: 852739 - DNA, 12 bp, Homo sapiens
ttaaagacaggt

SEQ ID NO: 852740 - DNA, 14 bp, Homo sapiens
ttaaagacatacct

SEQ ID NO: 852741 - DNA, 23 bp, Homo sapiens
ttaaagagaaaagggaaaaaaga

SEQ ID NO: 852742 - DNA, 14 bp, Homo sapiens
ttaaagagaggtta

SEQ ID NO: 852743 - DNA, 20 bp, Homo sapiens
ttaaagagaggttatagagt

SEQ ID NO: 852744 - DNA, 18 bp, Homo sapiens
ttaaagagatagcttctc

SEQ ID NO: 852745 - DNA, 23 bp, Homo sapiens
ttaaagagcatggaaaaatactg

SEQ ID NO: 852746 - DNA, 21 bp, Homo sapiens
ttaaagaggagaaggaaaaca

SEQ ID NO: 852747 - DNA, 20 bp, Homo sapiens
ttaaagaggctgtgtggcca

SEQ ID NO: 852748 - DNA, 22 bp, Homo sapiens
ttaaagcaaaatagtattgctg

SEQ ID NO: 852749 - DNA, 17 bp, Homo sapiens
ttaaagcacacttttcc

SEQ ID NO: 852750 - DNA, 18 bp, Homo sapiens
ttaaagcagacagtcaca

SEQ ID NO: 852751 - DNA, 18 bp, Homo sapiens
ttaaagccattctgatta

SEQ ID NO: 852752 - DNA, 17 bp, Homo sapiens
ttaaagcccccttctcc

SEQ ID NO: 852753 - DNA, 21 bp, Homo sapiens
ttaaagccctgtgttaagtgt

SEQ ID NO: 852754 - DNA, 14 bp, Homo sapiens
ttaaagcctcctca

SEQ ID NO: 852755 - DNA, 15 bp, Homo sapiens
ttaaagcctggcttc

SEQ ID NO: 852756 - DNA, 19 bp, Homo sapiens
ttaaagctaaagtatctgt

SEQ ID NO: 852757 - DNA, 22 bp, Homo sapiens
ttaaagctcatgcatttcaagc

SEQ ID NO: 852758 - DNA, 17 bp, Homo sapiens
ttaaagctcttcatttc

SEQ ID NO: 852759 - DNA, 13 bp, Homo sapiens
ttaaagctgtaca

SEQ ID NO: 852760 - DNA, 14 bp, Homo sapiens
ttaaagcttatttt

SEQ ID NO: 852761 - DNA, 17 bp, Homo sapiens
ttaaaggatgttggtgt

SEQ ID NO: 852762 - DNA, 22 bp, Homo sapiens
ttaaaggcagtccagagctttt

SEQ ID NO: 852763 - DNA, 22 bp, Homo sapiens
ttaaaggccagaggctatggaa

SEQ ID NO: 852764 - DNA, 18 bp, Homo sapiens
ttaaaggcccagccccta

SEQ ID NO: 852765 - DNA, 20 bp, Homo sapiens
ttaaaggcccagcccctaga

SEQ ID NO: 852766 - DNA, 15 bp, Homo sapiens
ttaaaggctgtggta

SEQ ID NO: 852767 - DNA, 16 bp, Homo sapiens
ttaaaggtcctgccct

SEQ ID NO: 852768 - DNA, 20 bp, Homo sapiens
ttaaaggtttttgaaatcca

SEQ ID NO: 852769 - DNA, 14 bp, Homo sapiens
ttaaagtaaacttg

SEQ ID NO: 852770 - DNA, 15 bp, Homo sapiens
ttaaagtatgaatct

SEQ ID NO: 852771 - DNA, 23 bp, Homo sapiens
ttaaagtatgcattattaaattg

SEQ ID NO: 852772 - DNA, 13 bp, Homo sapiens
ttaaagtattctt

SEQ ID NO: 852773 - DNA, 18 bp, Homo sapiens
ttaaagtcaggtccaatt

SEQ ID NO: 852774 - DNA, 17 bp, Homo sapiens
ttaaagtgaaggaaata

SEQ ID NO: 852775 - DNA, 12 bp, Homo sapiens
ttaaagtgatta

SEQ ID NO: 852776 - DNA, 20 bp, Homo sapiens
ttaaagttagtatcttttga

SEQ ID NO: 852777 - DNA, 14 bp, Homo sapiens
ttaaagttcattgc

SEQ ID NO: 852778 - DNA, 20 bp, Homo sapiens
ttaaagttgattttgaactt

SEQ ID NO: 852779 - DNA, 21 bp, Homo sapiens
ttaaagttggtattaataaaa

SEQ ID NO: 852780 - DNA, 14 bp, Homo sapiens
ttaaagttgtaaca

SEQ ID NO: 852781 - DNA, 15 bp, Homo sapiens
ttaaagttgtttgtg

SEQ ID NO: 852782 - DNA, 14 bp, Homo sapiens
ttaaataaaaataa

SEQ ID NO: 852783 - DNA, 19 bp, Homo sapiens
ttaaataaaactttccaaa

SEQ ID NO: 852784 - DNA, 13 bp, Homo sapiens
ttaaataaaccta

SEQ ID NO: 852785 - DNA, 14 bp, Homo sapiens
ttaaataaactgtt

SEQ ID NO: 852786 - DNA, 21 bp, Homo sapiens
ttaaataaactgttttcaagt

SEQ ID NO: 852787 - DNA, 19 bp, Homo sapiens
ttaaataaagacctatgta

SEQ ID NO: 852788 - DNA, 17 bp, Homo sapiens
ttaaataaatagaaaga

SEQ ID NO: 852789 - DNA, 13 bp, Homo sapiens
ttaaataaatcat

SEQ ID NO: 852790 - DNA, 13 bp, Homo sapiens
ttaaataaattaa

SEQ ID NO: 852791 - DNA, 15 bp, Homo sapiens
ttaaataacctctgg

SEQ ID NO: 852792 - DNA, 14 bp, Homo sapiens
ttaaataactgtgt

SEQ ID NO: 852793 - DNA, 12 bp, Homo sapiens
ttaaataatttc

SEQ ID NO: 852794 - DNA, 15 bp, Homo sapiens
ttaaatacactgaat

SEQ ID NO: 852795 - DNA, 19 bp, Homo sapiens
ttaaatacagacactaagt

SEQ ID NO: 852796 - DNA, 21 bp, Homo sapiens
ttaaatacagataattcattt

SEQ ID NO: 852797 - DNA, 13 bp, Homo sapiens
ttaaatacagtct

SEQ ID NO: 852798 - DNA, 19 bp, Homo sapiens
ttaaatacgcactacatgt

SEQ ID NO: 852799 - DNA, 18 bp, Homo sapiens
ttaaatactgtgcagaat

SEQ ID NO: 852800 - DNA, 15 bp, Homo sapiens
ttaaatactttttca

SEQ ID NO: 852801 - DNA, 19 bp, Homo sapiens
ttaaatagagtatatgcac

SEQ ID NO: 852802 - DNA, 13 bp, Homo sapiens
ttaaatagataca

SEQ ID NO: 852803 - DNA, 17 bp, Homo sapiens
ttaaatagatacaaatg

SEQ ID NO: 852804 - DNA, 13 bp, Homo sapiens
ttaaatataaata

SEQ ID NO: 852805 - DNA, 13 bp, Homo sapiens
ttaaatataattc

SEQ ID NO: 852806 - DNA, 17 bp, Homo sapiens
ttaaatataattctgta

SEQ ID NO: 852807 - DNA, 18 bp, Homo sapiens
ttaaatataattctgtaa

SEQ ID NO: 852808 - DNA, 20 bp, Homo sapiens
ttaaatataattctgtaaat

SEQ ID NO: 852809 - DNA, 18 bp, Homo sapiens
ttaaatatccacagtact

SEQ ID NO: 852810 - DNA, 19 bp, Homo sapiens
ttaaatcatttggttaaat

SEQ ID NO: 852811 - DNA, 12 bp, Homo sapiens
ttaaatctcaaa

SEQ ID NO: 852812 - DNA, 18 bp, Homo sapiens
ttaaatctcaaatttatt

SEQ ID NO: 852813 - DNA, 14 bp, Homo sapiens
ttaaatctgtgatg

SEQ ID NO: 852814 - DNA, 19 bp, Homo sapiens
ttaaatcttaaacaatgta

SEQ ID NO: 852815 - DNA, 21 bp, Homo sapiens
ttaaatgaagtgattctaaga

SEQ ID NO: 852816 - DNA, 16 bp, Homo sapiens
ttaaatgacttgattg

SEQ ID NO: 852817 - DNA, 21 bp, Homo sapiens
ttaaatgacttgattgtactt

SEQ ID NO: 852818 - DNA, 16 bp, Homo sapiens
ttaaatgaggattatt

SEQ ID NO: 852819 - DNA, 13 bp, Homo sapiens
ttaaatgatattt

SEQ ID NO: 852820 - DNA, 15 bp, Homo sapiens
ttaaatgattccaaa

SEQ ID NO: 852821 - DNA, 16 bp, Homo sapiens
ttaaatgattccaaat

SEQ ID NO: 852822 - DNA, 22 bp, Homo sapiens
ttaatgatctcggatgaccaaa

SEQ ID NO: 852823 - DNA, 18 bp, Homo sapiens
ttaatgatgatcttcaga

SEQ ID NO: 852824 - DNA, 14 bp, Homo sapiens
ttaatgatggtgtt

SEQ ID NO: 852825 - DNA, 15 bp, Homo sapiens
ttaatgcactttcta

SEQ ID NO: 852826 - DNA, 18 bp, Homo sapiens
ttaatgcatctagattat

SEQ ID NO: 852827 - DNA, 16 bp, Homo sapiens
ttaatgcattttgctg

SEQ ID NO: 852828 - DNA, 18 bp, Homo sapiens
ttaatgcctgctttttgg

SEQ ID NO: 852829 - DNA, 15 bp, Homo sapiens
ttaatgcctttaaag

SEQ ID NO: 852830 - DNA, 16 bp, Homo sapiens
ttaatgctatttgaac

SEQ ID NO: 852831 - DNA, 21 bp, Homo sapiens
ttaatgctatttgaacaagtg

SEQ ID NO: 852832 - DNA, 16 bp, Homo sapiens
ttaatgctgtctttgt

SEQ ID NO: 852833 - DNA, 16 bp, Homo sapiens
ttaatgctgtttctaa

SEQ ID NO: 852834 - DNA, 22 bp, Homo sapiens
ttaatgctgtttctaagaaaat

SEQ ID NO: 852835 - DNA, 24 bp, Homo sapiens
ttaatgctgtttctaagaaaatgt

SEQ ID NO: 852836 - DNA, 22 bp, Homo sapiens
ttaatggacatgagataatgtt

SEQ ID NO: 852837 - DNA, 17 bp, Homo sapiens
ttaatggactgtgaatt

SEQ ID NO: 852838 - DNA, 20 bp, Homo sapiens
ttaatggactgtgaatttca

SEQ ID NO: 852839 - DNA, 20 bp, Homo sapiens
ttaatggggaccctccaaag

SEQ ID NO: 852840 - DNA, 19 bp, Homo sapiens
ttaatggggtctgtaaata

SEQ ID NO: 852841 - DNA, 20 bp, Homo sapiens
ttaatggtatcctactgagc

SEQ ID NO: 852842 - DNA, 14 bp, Homo sapiens
ttaatggttaagaa

SEQ ID NO: 852843 - DNA, 12 bp, Homo sapiens
ttaatggttttt

SEQ ID NO: 852844 - DNA, 22 bp, Homo sapiens
ttaatgtatctatttgtacaat

SEQ ID NO: 852845 - DNA, 17 bp, Homo sapiens
ttaatgtatgttaccaa

SEQ ID NO: 852846 - DNA, 17 bp, Homo sapiens
ttaatgtattaatctgt

SEQ ID NO: 852847 - DNA, 14 bp, Homo sapiens
ttaatgtcagtgac

SEQ ID NO: 852848 - DNA, 22 bp, Homo sapiens
ttaatgtcatggccttgaaaca

SEQ ID NO: 852849 - DNA, 17 bp, Homo sapiens
ttaatgtcattgctaaa

SEQ ID NO: 852850 - DNA, 18 bp, Homo sapiens
ttaatgtgaagacatttt

SEQ ID NO: 852851 - DNA, 22 bp, Homo sapiens
ttaatgtgatggatggcacaat

SEQ ID NO: 852852 - DNA, 13 bp, Homo sapiens
ttaatgttacaac

SEQ ID NO: 852853 - DNA, 13 bp, Homo sapiens
ttaatgttactca

SEQ ID NO: 852854 - DNA, 22 bp, Homo sapiens
ttaatgttctgaataatttctt

SEQ ID NO: 852855 - DNA, 13 bp, Homo sapiens
ttaatgttgaatg

SEQ ID NO: 852856 - DNA, 18 bp, Homo sapiens
ttaatgttgaatgtattt

SEQ ID NO: 852857 - DNA, 15 bp, Homo sapiens
ttaatgtttattcct

SEQ ID NO: 852858 - DNA, 16 bp, Homo sapiens
ttaatgtttcttaaat

SEQ ID NO: 852859 - DNA, 15 bp, Homo sapiens
ttaatgtttcttaga

SEQ ID NO: 852860 - DNA, 23 bp, Homo sapiens
ttaatgttttaaatgtacagaca

SEQ ID NO: 852861 - DNA, 17 bp, Homo sapiens
ttaatgttttgtacaat

SEQ ID NO: 852862 - DNA, 18 bp, Homo sapiens
ttaatgttttttgccaca

SEQ ID NO: 852863 - DNA, 13 bp, Homo sapiens
ttaattaaaaact

SEQ ID NO: 852864 - DNA, 23 bp, Homo sapiens
ttaattaaaaactttaaagataa

SEQ ID NO: 852865 - DNA, 13 bp, Homo sapiens
ttaattaaagcac

SEQ ID NO: 852866 - DNA, 13 bp, Homo sapiens
ttaattacaccat

SEQ ID NO: 852867 - DNA, 21 bp, Homo sapiens
ttaattactcagcagaatggt

SEQ ID NO: 852868 - DNA, 15 bp, Homo sapiens
ttaattactgctata

SEQ ID NO: 852869 - DNA, 16 bp, Homo sapiens
ttaattactgctataa

SEQ ID NO: 852870 - DNA, 20 bp, Homo sapiens
ttaattaggggttgctaaga

SEQ ID NO: 852871 - DNA, 20 bp, Homo sapiens
ttaattagttccagtttctc

SEQ ID NO: 852872 - DNA, 15 bp, Homo sapiens
ttaattatcttttct

SEQ ID NO: 852873 - DNA, 23 bp, Homo sapiens
ttaattcaacatcaaaacttaag

SEQ ID NO: 852874 - DNA, 14 bp, Homo sapiens
ttaattcacctcag

SEQ ID NO: 852875 - DNA, 14 bp, Homo sapiens
ttaattcaggtatg

SEQ ID NO: 852876 - DNA, 15 bp, Homo sapiens
ttaattcatgaggag

SEQ ID NO: 852877 - DNA, 19 bp, Homo sapiens
ttaattccatgtcagataa

SEQ ID NO: 852878 - DNA, 14 bp, Homo sapiens
ttaattcctatgaa

SEQ ID NO: 852879 - DNA, 17 bp, Homo sapiens
ttaattctctttcaaag

SEQ ID NO: 852880 - DNA, 15 bp, Homo sapiens
ttaattcttagctca

SEQ ID NO: 852881 - DNA, 18 bp, Homo sapiens
ttaattcttcacctgtta

SEQ ID NO: 852882 - DNA, 21 bp, Homo sapiens
ttaattcttcacctgttatgt

SEQ ID NO: 852883 - DNA, 17 bp, Homo sapiens
ttaattgccagcaaata

SEQ ID NO: 852884 - DNA, 15 bp, Homo sapiens
ttaattgcctgttaa

SEQ ID NO: 852885 - DNA, 18 bp, Homo sapiens
ttaattgcgtagaggcta

SEQ ID NO: 852886 - DNA, 13 bp, Homo sapiens
ttaattgctttga

SEQ ID NO: 852887 - DNA, 18 bp, Homo sapiens
ttaattgggcactattta

SEQ ID NO: 852888 - DNA, 15 bp, Homo sapiens
ttaattgtaaagtaa

SEQ ID NO: 852889 - DNA, 19 bp, Homo sapiens
ttaattgtagttctgtgta

SEQ ID NO: 852890 - DNA, 15 bp, Homo sapiens
ttaattgtcctgtgt

SEQ ID NO: 852891 - DNA, 15 bp, Homo sapiens
ttaattgtcttgcac

SEQ ID NO: 852892 - DNA, 12 bp, Homo sapiens
ttaattgtttaa

SEQ ID NO: 852893 - DNA, 21 bp, Homo sapiens
ttaatttaaaaaagcaaatgg

SEQ ID NO: 852894 - DNA, 14 bp, Homo sapiens
ttaatttaaatgat

SEQ ID NO: 852895 - DNA, 16 bp, Homo sapiens
ttaatttaaatgattt

SEQ ID NO: 852896 - DNA, 12 bp, Homo sapiens
ttaatttaatgt

SEQ ID NO: 852897 - DNA, 14 bp, Homo sapiens
ttaatttaatgtat

SEQ ID NO: 852898 - DNA, 15 bp, Homo sapiens
ttaatttaatgtatt

SEQ ID NO: 852899 - DNA, 14 bp, Homo sapiens
ttaatttacaaaaa

SEQ ID NO: 852900 - DNA, 22 bp, Homo sapiens
ttaatttataatgtatttgaaa

SEQ ID NO: 852901 - DNA, 15 bp, Homo sapiens
ttaatttcaggaaaa

SEQ ID NO: 852902 - DNA, 11 bp, Homo sapiens
ttaatttccag

SEQ ID NO: 852903 - DNA, 22 bp, Homo sapiens
ttaatttccaggaaaaaataaa

SEQ ID NO: 852904 - DNA, 15 bp, Homo sapiens
ttaatttccttctgt

SEQ ID NO: 852905 - DNA, 16 bp, Homo sapiens
ttaatttccttctgtt

SEQ ID NO: 852906 - DNA, 18 bp, Homo sapiens
ttaatttccttctgttaa

SEQ ID NO: 852907 - DNA, 12 bp, Homo sapiens
ttaatttccttt

SEQ ID NO: 852908 - DNA, 15 bp, Homo sapiens
ttaatttcctttttg

SEQ ID NO: 852909 - DNA, 18 bp, Homo sapiens
ttaatttcctttttgaca

SEQ ID NO: 852910 - DNA, 20 bp, Homo sapiens
ttaatttcctttttgacact

SEQ ID NO: 852911 - DNA, 23 bp, Homo sapiens
ttaatttcctttttgacactgaa

SEQ ID NO: 852912 - DNA, 20 bp, Homo sapiens
ttaatttctaagaagttact

SEQ ID NO: 852913 - DNA, 21 bp, Homo sapiens
ttaatttctgccatttcatgt

SEQ ID NO: 852914 - DNA, 15 bp, Homo sapiens
ttaatttgaaatatg

SEQ ID NO: 852915 - DNA, 22 bp, Homo sapiens
ttaatttggagcacaaaattca

SEQ ID NO: 852916 - DNA, 22 bp, Homo sapiens
ttaatttggataataaaaattg

SEQ ID NO: 852917 - DNA, 17 bp, Homo sapiens
ttaatttgtatgctaaa

SEQ ID NO: 852918 - DNA, 13 bp, Homo sapiens
ttaatttgtgtgt

SEQ ID NO: 852919 - DNA, 15 bp, Homo sapiens
ttaattttaactgat

SEQ ID NO: 852920 - DNA, 13 bp, Homo sapiens
ttaattttaatgc

SEQ ID NO: 852921 - DNA, 20 bp, Homo sapiens
ttaattttaatgctgtttct

SEQ ID NO: 852922 - DNA, 22 bp, Homo sapiens
ttaattttaccaagagtaactt

SEQ ID NO: 852923 - DNA, 17 bp, Homo sapiens
ttaattttattgcaaag

SEQ ID NO: 852924 - DNA, 23 bp, Homo sapiens
ttaattttgaagtgctgtttatt

SEQ ID NO: 852925 - DNA, 19 bp, Homo sapiens
ttaattttgatatacattg

SEQ ID NO: 852926 - DNA, 14 bp, Homo sapiens
ttaattttgtcttt

SEQ ID NO: 852927 - DNA, 15 bp, Homo sapiens
ttaattttgtgcatt

SEQ ID NO: 852928 - DNA, 18 bp, Homo sapiens
ttaatttttcttagtgtt

SEQ ID NO: 852929 - DNA, 12 bp, Homo sapiens
ttaatttttgat

SEQ ID NO: 852930 - DNA, 18 bp, Homo sapiens
ttaattttttggtacaaa

SEQ ID NO: 852931 - DNA, 17 bp, Homo sapiens
ttaattttttttaatgt

SEQ ID NO: 852932 - DNA, 19 bp, Homo sapiens
ttacaaaaacacttcgttc

SEQ ID NO: 852933 - DNA, 13 bp, Homo sapiens
ttacaaaactgcc

SEQ ID NO: 852934 - DNA, 23 bp, Homo sapiens
ttacaaaactgctttgtgcatat

SEQ ID NO: 852935 - DNA, 14 bp, Homo sapiens
ttacaaaagatgta

SEQ ID NO: 852936 - DNA, 17 bp, Homo sapiens
ttacaaaatgccaaggg

SEQ ID NO: 852937 - DNA, 20 bp, Homo sapiens
ttacaaacatggaaaacaga

SEQ ID NO: 852938 - DNA, 13 bp, Homo sapiens
ttacaaactgaag

SEQ ID NO: 852939 - DNA, 14 bp, Homo sapiens
ttacaaagtgtgta

SEQ ID NO: 852940 - DNA, 22 bp, Homo sapiens
ttacaaagtgtgtattaaaaaa

SEQ ID NO: 852941 - DNA, 21 bp, Homo sapiens
ttacaaagttaaaattgttat

SEQ ID NO: 852942 - DNA, 19 bp, Homo sapiens
ttacaaatattgtcatctt

SEQ ID NO: 852943 - DNA, 22 bp, Homo sapiens
ttacaaatcagaagtcatcttg

SEQ ID NO: 852944 - DNA, 20 bp, Homo sapiens
ttactcccaagacttcattg

SEQ ID NO: 852945 - DNA, 20 bp, Homo sapiens
ttactcccccaccactcagg

SEQ ID NO: 852946 - DNA, 18 bp, Homo sapiens
ttactcccttcctggcct

SEQ ID NO: 852947 - DNA, 20 bp, Homo sapiens
ttactcccttctgtagtttt

SEQ ID NO: 852948 - DNA, 13 bp, Homo sapiens
ttactcctcctgc

SEQ ID NO: 852949 - DNA, 20 bp, Homo sapiens
ttactcctcctgctcctcac

SEQ ID NO: 852950 - DNA, 22 bp, Homo sapiens
ttactcctctgaccctccttct

SEQ ID NO: 852951 - DNA, 11 bp, Homo sapiens
ttactcctggc

SEQ ID NO: 852952 - DNA, 12 bp, Homo sapiens
ttactcctggct

SEQ ID NO: 852953 - DNA, 15 bp, Homo sapiens
ttactctacactgaa

SEQ ID NO: 852954 - DNA, 15 bp, Homo sapiens
ttactctcattcttt

SEQ ID NO: 852955 - DNA, 23 bp, Homo sapiens
ttactctcttgcaccaaattatc

SEQ ID NO: 852956 - DNA, 18 bp, Homo sapiens
ttactctgagcccaggcc

SEQ ID NO: 852957 - DNA, 18 bp, Homo sapiens
ttactctgcctacagaac

SEQ ID NO: 852958 - DNA, 17 bp, Homo sapiens
ttactctgtgtaaagac

SEQ ID NO: 852959 - DNA, 21 bp, Homo sapiens
ttactcttaaatcatttggtt

SEQ ID NO: 852960 - DNA, 13 bp, Homo sapiens
ttactctttccta

SEQ ID NO: 852961 - DNA, 14 bp, Homo sapiens
ttactctttttcaa

SEQ ID NO: 852962 - DNA, 20 bp, Homo sapiens
ttactctttttcaataaatt

SEQ ID NO: 852963 - DNA, 18 bp, Homo sapiens
ttactgaaggtaaaattg

SEQ ID NO: 852964 - DNA, 19 bp, Homo sapiens
ttactgaaggtaaaattga

SEQ ID NO: 852965 - DNA, 13 bp, Homo sapiens
ttactgagcttct

SEQ ID NO: 852966 - DNA, 16 bp, Homo sapiens
ttactgagcttctctg

SEQ ID NO: 852967 - DNA, 17 bp, Homo sapiens
ttactgagcttctctgt

SEQ ID NO: 852968 - DNA, 18 bp, Homo sapiens
ttactgagcttctctgtg

SEQ ID NO: 852969 - DNA, 20 bp, Homo sapiens
ttactgaggaaatatttcca

SEQ ID NO: 852970 - DNA, 23 bp, Homo sapiens
ttactgatatattttacaatttt

SEQ ID NO: 852971 - DNA, 15 bp, Homo sapiens
ttactgatgtgatat

SEQ ID NO: 852972 - DNA, 18 bp, Homo sapiens
ttactgatgtgatattct

SEQ ID NO: 852973 - DNA, 20 bp, Homo sapiens
ttactgatgtgatattctgt

SEQ ID NO: 852974 - DNA, 15 bp, Homo sapiens
ttactgatttagaag

SEQ ID NO: 852975 - DNA, 15 bp, Homo sapiens
ttactgcagctttgt

SEQ ID NO: 852976 - DNA, 22 bp, Homo sapiens
ttactgcagtacatacgtctgc

SEQ ID NO: 852977 - DNA, 20 bp, Homo sapiens
ttactgctaagtatttccca

SEQ ID NO: 852978 - DNA, 21 bp, Homo sapiens
ttactgctaagtatttcccag

SEQ ID NO: 852979 - DNA, 15 bp, Homo sapiens
ttactgctctgagaa

SEQ ID NO: 852980 - DNA, 19 bp, Homo sapiens
ttactgctgattcttgtaa

SEQ ID NO: 852981 - DNA, 13 bp, Homo sapiens
ttactgcttcatt

SEQ ID NO: 852982 - DNA, 22 bp, Homo sapiens
ttactgcttcccattgagtaat

SEQ ID NO: 852983 - DNA, 18 bp, Homo sapiens
ttactgcttctctttgtg

SEQ ID NO: 852984 - DNA, 15 bp, Homo sapiens
ttactgctttgcaaa

SEQ ID NO: 852985 - DNA, 15 bp, Homo sapiens
ttactgcttttcatt

SEQ ID NO: 852986 - DNA, 20 bp, Homo sapiens
ttactgcttttcattagcag

SEQ ID NO: 852987 - DNA, 23 bp, Homo sapiens
ttactgggccttagtgggccagg

SEQ ID NO: 852988 - DNA, 22 bp, Homo sapiens
ttactggtaaagcctcatttga

SEQ ID NO: 852989 - DNA, 13 bp, Homo sapiens
ttactggttgcat

SEQ ID NO: 852990 - DNA, 19 bp, Homo sapiens
ttactgtaactgtcagtgt

SEQ ID NO: 852991 - DNA, 15 bp, Homo sapiens
ttactgtaattcctc

SEQ ID NO: 852992 - DNA, 14 bp, Homo sapiens
ttactgtacatgaa

SEQ ID NO: 852993 - DNA, 23 bp, Homo sapiens
ttactgtacatgaaaacacattt

SEQ ID NO: 852994 - DNA, 17 bp, Homo sapiens
ttactgtatatgtattc

SEQ ID NO: 852995 - DNA, 23 bp, Homo sapiens
ttactgtatatgtattcccttgt

SEQ ID NO: 852996 - DNA, 20 bp, Homo sapiens
ttactgtcaataaacagctt

SEQ ID NO: 852997 - DNA, 14 bp, Homo sapiens
ttactgtctttatt

SEQ ID NO: 852998 - DNA, 14 bp, Homo sapiens
ttactgtgaaactg

SEQ ID NO: 852999 - DNA, 19 bp, Homo sapiens
ttactgtgtaaatatatgt

SEQ ID NO: 853000 - DNA, 18 bp, Homo sapiens
ttactgttagtcatttgc

SEQ ID NO: 853001 - DNA, 16 bp, Homo sapiens
ttactgttatagaata

SEQ ID NO: 853002 - DNA, 20 bp, Homo sapiens
ttactgttgcatttactttt

SEQ ID NO: 853003 - DNA, 23 bp, Homo sapiens
ttactgtttattacttccatgaa

SEQ ID NO: 853004 - DNA, 17 bp, Homo sapiens
ttactgttttaattgta

SEQ ID NO: 853005 - DNA, 21 bp, Homo sapiens
ttactgttttaattgtagttc

SEQ ID NO: 853006 - DNA, 17 bp, Homo sapiens
ttactgttttatgttga

SEQ ID NO: 853007 - DNA, 18 bp, Homo sapiens
ttactgttttatgttgat

SEQ ID NO: 853008 - DNA, 21 bp, Homo sapiens
ttacttaaaccgccaaggctg

SEQ ID NO: 853009 - DNA, 14 bp, Homo sapiens
ttacttagaatgcc

SEQ ID NO: 853010 - DNA, 15 bp, Homo sapiens
ttacttagaggaaat

SEQ ID NO: 853011 - DNA, 21 bp, Homo sapiens
ttacttcccagtataagattt

SEQ ID NO: 853012 - DNA, 15 bp, Homo sapiens
ttacttcctggcctc

SEQ ID NO: 853013 - DNA, 15 bp, Homo sapiens
ttacttctctataaa

SEQ ID NO: 853014 - DNA, 23 bp, Homo sapiens
ttacttcttatacatttgataaa

SEQ ID NO: 853015 - DNA, 14 bp, Homo sapiens
ttacttgcttcagt

SEQ ID NO: 853016 - DNA, 13 bp, Homo sapiens
ttacttgcttctc

SEQ ID NO: 853017 - DNA, 15 bp, Homo sapiens
ttacttgctttcaat

SEQ ID NO: 853018 - DNA, 23 bp, Homo sapiens
ttacttgctttcaattgacaaat

SEQ ID NO: 853019 - DNA, 20 bp, Homo sapiens
ttacttgtctgtcaaatgtt

SEQ ID NO: 853020 - DNA, 14 bp, Homo sapiens
ttacttgtggtgtg

SEQ ID NO: 853021 - DNA, 18 bp, Homo sapiens
ttactttagaagcctgca

SEQ ID NO: 853022 - DNA, 15 bp, Homo sapiens
ttactttatgtttgt

SEQ ID NO: 853023 - DNA, 13 bp, Homo sapiens
ttactttattaga

SEQ ID NO: 853024 - DNA, 14 bp, Homo sapiens
ttactttcctctga

SEQ ID NO: 853025 - DNA, 13 bp, Homo sapiens
ttactttctgccg

SEQ ID NO: 853026 - DNA, 19 bp, Homo sapiens
ttactttcttcaccaagtg

SEQ ID NO: 853027 - DNA, 19 bp, Homo sapiens
ttactttgtacttgtgttt

SEQ ID NO: 853028 - DNA, 22 bp, Homo sapiens
ttacttttataataaaaggaaa

SEQ ID NO: 853029 - DNA, 13 bp, Homo sapiens
ttacttttgtaaa

SEQ ID NO: 853030 - DNA, 21 bp, Homo sapiens
ttactttttatatagcaaaat

SEQ ID NO: 853031 - DNA, 19 bp, Homo sapiens
ttactttttcttgtattca

SEQ ID NO: 853032 - DNA, 17 bp, Homo sapiens
ttacttttttaacatgt

SEQ ID NO: 853033 - DNA, 18 bp, Homo sapiens
ttacttttttatagctta

SEQ ID NO: 853034 - DNA, 17 bp, Homo sapiens
ttactttttttctgtga

SEQ ID NO: 853035 - DNA, 22 bp, Homo sapiens
ttactttttttctgtgacattt

SEQ ID NO: 853036 - DNA, 16 bp, Homo sapiens
ttagaaaaaaattact

SEQ ID NO: 853037 - DNA, 23 bp, Homo sapiens
ttagaaaaaagtttacaacataa

SEQ ID NO: 853038 - DNA, 14 bp, Homo sapiens
ttagaaaactttaa

SEQ ID NO: 853039 - DNA, 16 bp, Homo sapiens
ttagaaaactttaaag

SEQ ID NO: 853040 - DNA, 17 bp, Homo sapiens
ttagaaaagttaacatt

SEQ ID NO: 853041 - DNA, 19 bp, Homo sapiens
ttagaaaagttaacattta

SEQ ID NO: 853042 - DNA, 17 bp, Homo sapiens
ttagaaacatggttttg

SEQ ID NO: 853043 - DNA, 22 bp, Homo sapiens
ttagaaagctgacattgccaaa

SEQ ID NO: 853044 - DNA, 21 bp, Homo sapiens
ttagaaagtagccacgtatgg

SEQ ID NO: 853045 - DNA, 11 bp, Homo sapiens
ttagaaatata

SEQ ID NO: 853046 - DNA, 17 bp, Homo sapiens
ttagaaatgaccaatat

SEQ ID NO: 853047 - DNA, 17 bp, Homo sapiens
ttagaaatgtaaactgc

SEQ ID NO: 853048 - DNA, 21 bp, Homo sapiens
ttagaaatgtaaactgccata

SEQ ID NO: 853049 - DNA, 17 bp, Homo sapiens
ttagaaattgcatttcc

SEQ ID NO: 853050 - DNA, 17 bp, Homo sapiens
ttagaacacacacactt

SEQ ID NO: 853051 - DNA, 13 bp, Homo sapiens
ttagaacctttct

SEQ ID NO: 853052 - DNA, 18 bp, Homo sapiens
ttagaacgttaaactatt

SEQ ID NO: 853053 - DNA, 12 bp, Homo sapiens
ttagaagaaaga

SEQ ID NO: 853054 - DNA, 14 bp, Homo sapiens
ttagaagaaattaa

SEQ ID NO: 853055 - DNA, 12 bp, Homo sapiens
ttagaagagagc

SEQ ID NO: 853056 - DNA, 22 bp, Homo sapiens
ttagaagcaaggagaaaatata

SEQ ID NO: 853057 - DNA, 18 bp, Homo sapiens
ttagaaggcttaagaact

SEQ ID NO: 853058 - DNA, 16 bp, Homo sapiens
ttagaagggttcagga

SEQ ID NO: 853059 - DNA, 14 bp, Homo sapiens
ttagaagtctttca

SEQ ID NO: 853060 - DNA, 13 bp, Homo sapiens
ttagaataaagtt

SEQ ID NO: 853061 - DNA, 13 bp, Homo sapiens
ttagaataaattc

SEQ ID NO: 853062 - DNA, 16 bp, Homo sapiens
ttagaataaattccca

SEQ ID NO: 853063 - DNA, 18 bp, Homo sapiens
ttagaataagaatttgca

SEQ ID NO: 853064 - DNA, 21 bp, Homo sapiens
ttagaatagtgcctaaagtgc

SEQ ID NO: 853065 - DNA, 13 bp, Homo sapiens
ttagaatatcttt

SEQ ID NO: 853066 - DNA, 19 bp, Homo sapiens
ttatatgcttactgatata

SEQ ID NO: 853067 - DNA, 14 bp, Homo sapiens
ttatatggaaattc

SEQ ID NO: 853068 - DNA, 15 bp, Homo sapiens
ttatatggaagaaag

SEQ ID NO: 853069 - DNA, 22 bp, Homo sapiens
ttatatggatgattcagaaatt

SEQ ID NO: 853070 - DNA, 22 bp, Homo sapiens
ttatatggggttgttgtctcat

SEQ ID NO: 853071 - DNA, 17 bp, Homo sapiens
ttatattaaaaataggt

SEQ ID NO: 853072 - DNA, 20 bp, Homo sapiens
ttatattaaagtaaatggca

SEQ ID NO: 853073 - DNA, 24 bp, Homo sapiens
ttatattaaagtaaatggcatgga

SEQ ID NO: 853074 - DNA, 20 bp, Homo sapiens
ttatattaatagtaatttgt

SEQ ID NO: 853075 - DNA, 16 bp, Homo sapiens
ttatattacttttgta

SEQ ID NO: 853076 - DNA, 18 bp, Homo sapiens
ttatattacttttgtaaa

SEQ ID NO: 853077 - DNA, 19 bp, Homo sapiens
ttatattacttttgtaaat

SEQ ID NO: 853078 - DNA, 22 bp, Homo sapiens
ttatattacttttgtaaatatt

SEQ ID NO: 853079 - DNA, 21 bp, Homo sapiens
ttatattatccataggtttct

SEQ ID NO: 853080 - DNA, 14 bp, Homo sapiens
ttatattctaatag

SEQ ID NO: 853081 - DNA, 20 bp, Homo sapiens
ttatattctaatagtttttc

SEQ ID NO: 853082 - DNA, 20 bp, Homo sapiens
ttatattgaagacaatttga

SEQ ID NO: 853083 - DNA, 19 bp, Homo sapiens
ttatattggtgcgttttta

SEQ ID NO: 853084 - DNA, 22 bp, Homo sapiens
ttatattgtatattctggaaaa

SEQ ID NO: 853085 - DNA, 13 bp, Homo sapiens
ttatatttattgt

SEQ ID NO: 853086 - DNA, 11 bp, Homo sapiens
ttatatttcag

SEQ ID NO: 853087 - DNA, 23 bp, Homo sapiens
ttatatttcctgtattgctttag

SEQ ID NO: 853088 - DNA, 12 bp, Homo sapiens
ttatatttcctt

SEQ ID NO: 853089 - DNA, 16 bp, Homo sapiens
ttatattttatgaaca

SEQ ID NO: 853090 - DNA, 14 bp, Homo sapiens
ttatattttctatt

SEQ ID NO: 853091 - DNA, 18 bp, Homo sapiens
ttatattttgaaagaagc

SEQ ID NO: 853092 - DNA, 15 bp, Homo sapiens
ttatattttgcagtt

SEQ ID NO: 853093 - DNA, 13 bp, Homo sapiens
ttatatttttaaa

SEQ ID NO: 853094 - DNA, 15 bp, Homo sapiens
ttatatttttataga

SEQ ID NO: 853095 - DNA, 17 bp, Homo sapiens
ttatcaaaaagtattat

SEQ ID NO: 853096 - DNA, 16 bp, Homo sapiens
ttatcaaaaatttcat

SEQ ID NO: 853097 - DNA, 15 bp, Homo sapiens
ttatcaatatctaat

SEQ ID NO: 853098 - DNA, 16 bp, Homo sapiens
ttatcaatatctaata

SEQ ID NO: 853099 - DNA, 19 bp, Homo sapiens
ttatcaatatctaatatat

SEQ ID NO: 853100 - DNA, 23 bp, Homo sapiens
ttatcaatgtgtctttctaagaa

SEQ ID NO: 853101 - DNA, 16 bp, Homo sapiens
ttatcacagaaataaa

SEQ ID NO: 853102 - DNA, 18 bp, Homo sapiens
ttatcacattatttgcat

SEQ ID NO: 853103 - DNA, 18 bp, Homo sapiens
ttatcaccacagtaagtt

SEQ ID NO: 853104 - DNA, 19 bp, Homo sapiens
ttatcacccagaagaaaat

SEQ ID NO: 853105 - DNA, 23 bp, Homo sapiens
ttatcacctaagcacttctagaa

SEQ ID NO: 853106 - DNA, 19 bp, Homo sapiens
ttatcacctcattctgaac

SEQ ID NO: 853107 - DNA, 17 bp, Homo sapiens
ttatcacctctgatggc

SEQ ID NO: 853108 - DNA, 14 bp, Homo sapiens
ttatcagccatgtt

SEQ ID NO: 853109 - DNA, 21 bp, Homo sapiens
ttatcagtaagaaaaagaaga

SEQ ID NO: 853110 - DNA, 17 bp, Homo sapiens
ttatcagtgacagagtt

SEQ ID NO: 853111 - DNA, 14 bp, Homo sapiens
ttatcagtgcttcc

SEQ ID NO: 853112 - DNA, 22 bp, Homo sapiens
ttatcagttaaaatcacatttt

SEQ ID NO: 853113 - DNA, 14 bp, Homo sapiens
ttatcatcaagcag

SEQ ID NO: 853114 - DNA, 16 bp, Homo sapiens
ttatcatgcaaatgct

SEQ ID NO: 853115 - DNA, 20 bp, Homo sapiens
ttatcatgttttataatttg

SEQ ID NO: 853116 - DNA, 15 bp, Homo sapiens
ttatcattaaaaatt

SEQ ID NO: 853117 - DNA, 12 bp, Homo sapiens
ttatcattgctc

SEQ ID NO: 853118 - DNA, 16 bp, Homo sapiens
ttatcatttttgtata

SEQ ID NO: 853119 - DNA, 17 bp, Homo sapiens
ttatcatttttgtataa

SEQ ID NO: 853120 - DNA, 15 bp, Homo sapiens
ttatccaaaatgctt

SEQ ID NO: 853121 - DNA, 15 bp, Homo sapiens
ttatccaaaatgtgt

SEQ ID NO: 853122 - DNA, 16 bp, Homo sapiens
ttatccaaaatgtgta

SEQ ID NO: 853123 - DNA, 21 bp, Homo sapiens
ttatccaaaatgtgtatttct

SEQ ID NO: 853124 - DNA, 15 bp, Homo sapiens
ttatccaaatcttga

SEQ ID NO: 853125 - DNA, 23 bp, Homo sapiens
ttatccaaatcttgaatttctgc

SEQ ID NO: 853126 - DNA, 22 bp, Homo sapiens
ttatccaaggtgtaactctaat

SEQ ID NO: 853127 - DNA, 16 bp, Homo sapiens
ttatccacaaagtact

SEQ ID NO: 853128 - DNA, 21 bp, Homo sapiens
ttatccacttttcttcttcct

SEQ ID NO: 853129 - DNA, 12 bp, Homo sapiens
ttatccaggact

SEQ ID NO: 853130 - DNA, 18 bp, Homo sapiens
ttatccaggactctgtca

SEQ ID NO: 853131 - DNA, 17 bp, Homo sapiens
ttatccatattgagtca

SEQ ID NO: 853132 - DNA, 13 bp, Homo sapiens
ttatccatttctt

SEQ ID NO: 853133 - DNA, 17 bp, Homo sapiens
ttatccatttcttttac

SEQ ID NO: 853134 - DNA, 12 bp, Homo sapiens
ttatcccagctt

SEQ ID NO: 853135 - DNA, 14 bp, Homo sapiens
ttatcccatttagt

SEQ ID NO: 853136 - DNA, 20 bp, Homo sapiens
ttatccctcacctgtagcag

SEQ ID NO: 853137 - DNA, 14 bp, Homo sapiens
ttatccctttcctg

SEQ ID NO: 853138 - DNA, 15 bp, Homo sapiens
ttatcctcacataaa

SEQ ID NO: 853139 - DNA, 15 bp, Homo sapiens
ttatcctcctctcca

SEQ ID NO: 853140 - DNA, 18 bp, Homo sapiens
ttatcctctctctcttct

SEQ ID NO: 853141 - DNA, 15 bp, Homo sapiens
ttatcctctgatctc

SEQ ID NO: 853142 - DNA, 16 bp, Homo sapiens
ttatcctctggtttaa

SEQ ID NO: 853143 - DNA, 14 bp, Homo sapiens
ttatcctcttggtg

SEQ ID NO: 853144 - DNA, 21 bp, Homo sapiens
ttatcctgctagctgtagaaa

SEQ ID NO: 853145 - DNA, 18 bp, Homo sapiens
ttatcctgtattcttgtt

SEQ ID NO: 853146 - DNA, 20 bp, Homo sapiens
ttatccttaggaaaatgctt

SEQ ID NO: 853147 - DNA, 22 bp, Homo sapiens
ttatcctttgtgagcctatgat

SEQ ID NO: 853148 - DNA, 24 bp, Homo sapiens
ttatccttttttaaaagtaaatgt

SEQ ID NO: 853149 - DNA, 17 bp, Homo sapiens
ttatcgccctgagaaga

SEQ ID NO: 853150 - DNA, 16 bp, Homo sapiens
ttatcggaagcagtgc

SEQ ID NO: 853151 - DNA, 16 bp, Homo sapiens
ttatcgggagcagtgt

SEQ ID NO: 853152 - DNA, 18 bp, Homo sapiens
ttatcgggagcagtgtct

SEQ ID NO: 853153 - DNA, 21 bp, Homo sapiens
ttatctacctgttctgtagct

SEQ ID NO: 853154 - DNA, 14 bp, Homo sapiens
ttatctataattta

SEQ ID NO: 853155 - DNA, 15 bp, Homo sapiens
ttatctataatttac

SEQ ID NO: 853156 - DNA, 22 bp, Homo sapiens
ttatctataatttacctaagat

SEQ ID NO: 853157 - DNA, 18 bp, Homo sapiens
ttatctatagctaagtac

SEQ ID NO: 853158 - DNA, 18 bp, Homo sapiens
ttatctatggaaatgtga

SEQ ID NO: 853159 - DNA, 23 bp, Homo sapiens
ttatctatgtggaaaacacaata

SEQ ID NO: 853160 - DNA, 17 bp, Homo sapiens
ttatctcagatgttaaa

SEQ ID NO: 853161 - DNA, 14 bp, Homo sapiens
ttatctctatttaa

SEQ ID NO: 853162 - DNA, 16 bp, Homo sapiens
ttatctgagcaataac

SEQ ID NO: 853163 - DNA, 15 bp, Homo sapiens
ttatctgatctgtga

SEQ ID NO: 853164 - DNA, 21 bp, Homo sapiens
ttatctgcctggcctggctcc

SEQ ID NO: 853165 - DNA, 22 bp, Homo sapiens
ttatctggaacaacttgtagca

SEQ ID NO: 853166 - DNA, 23 bp, Homo sapiens
ttatctgggattatggttttgtg

SEQ ID NO: 853167 - DNA, 12 bp, Homo sapiens
ttatctgggctt

SEQ ID NO: 853168 - DNA, 16 bp, Homo sapiens
ttatctggtgcctcct

SEQ ID NO: 853169 - DNA, 16 bp, Homo sapiens
ttatctgtcagctgca

SEQ ID NO: 853170 - DNA, 18 bp, Homo sapiens
ttatctgtgcgtgaaaca

SEQ ID NO: 853171 - DNA, 19 bp, Homo sapiens
ttatctgtgcgtgaaacac

SEQ ID NO: 853172 - DNA, 16 bp, Homo sapiens
ttatctgttgccttat

SEQ ID NO: 853173 - DNA, 12 bp, Homo sapiens
ttatctgtttcc

SEQ ID NO: 853174 - DNA, 18 bp, Homo sapiens
ttatcttatactgtacaa

SEQ ID NO: 853175 - DNA, 17 bp, Homo sapiens
ttatcttatgccacggg

SEQ ID NO: 853176 - DNA, 22 bp, Homo sapiens
ttatcttctggactatagctgt

SEQ ID NO: 853177 - DNA, 19 bp, Homo sapiens
ttatcttctttattattcc

SEQ ID NO: 853178 - DNA, 14 bp, Homo sapiens
ttatcttgatacat

SEQ ID NO: 853179 - DNA, 17 bp, Homo sapiens
ttatcttgatacattca

SEQ ID NO: 853180 - DNA, 16 bp, Homo sapiens
ttatcttggactgaca

SEQ ID NO: 853181 - DNA, 15 bp, Homo sapiens
ttatctttctaaaac

SEQ ID NO: 853182 - DNA, 15 bp, Homo sapiens
ttatctttctttcca

SEQ ID NO: 853183 - DNA, 13 bp, Homo sapiens
ttatcttttactt

SEQ ID NO: 853184 - DNA, 12 bp, Homo sapiens
ttatcttttcat

SEQ ID NO: 853185 - DNA, 15 bp, Homo sapiens
ttatcttttggcttc

SEQ ID NO: 853186 - DNA, 13 bp, Homo sapiens
ttatctttttaaa

SEQ ID NO: 853187 - DNA, 19 bp, Homo sapiens
ttatgaaaaaatatgaacc

SEQ ID NO: 853188 - DNA, 19 bp, Homo sapiens
ttattgttccaagacattg

SEQ ID NO: 853189 - DNA, 23 bp, Homo sapiens
ttattgttccaagacattgtcaa

SEQ ID NO: 853190 - DNA, 18 bp, Homo sapiens
ttattgttgccttttcac

SEQ ID NO: 853191 - DNA, 16 bp, Homo sapiens
ttattgtttgatgttt

SEQ ID NO: 853192 - DNA, 14 bp, Homo sapiens
ttatttaaaaatat

SEQ ID NO: 853193 - DNA, 21 bp, Homo sapiens
ttatttaaaaatatttcagat

SEQ ID NO: 853194 - DNA, 14 bp, Homo sapiens
ttatttaaaactct

SEQ ID NO: 853195 - DNA, 15 bp, Homo sapiens
ttatttaaaatagca

SEQ ID NO: 853196 - DNA, 11 bp, Homo sapiens
ttatttaaatg

SEQ ID NO: 853197 - DNA, 12 bp, Homo sapiens
ttatttaaatga

SEQ ID NO: 853198 - DNA, 13 bp, Homo sapiens
ttatttaaatgca

SEQ ID NO: 853199 - DNA, 15 bp, Homo sapiens
ttatttaaatgcatg

SEQ ID NO: 853200 - DNA, 18 bp, Homo sapiens
ttatttaacaaaaaatgt

SEQ ID NO: 853201 - DNA, 14 bp, Homo sapiens
ttatttaatgtttg

SEQ ID NO: 853202 - DNA, 17 bp, Homo sapiens
ttatttaattaaatgta

SEQ ID NO: 853203 - DNA, 13 bp, Homo sapiens
ttatttacattta

SEQ ID NO: 853204 - DNA, 17 bp, Homo sapiens
ttatttacccctcccct

SEQ ID NO: 853205 - DNA, 17 bp, Homo sapiens
ttatttactgagcttct

SEQ ID NO: 853206 - DNA, 22 bp, Homo sapiens
ttatttactgagcttctctgtg

SEQ ID NO: 853207 - DNA, 17 bp, Homo sapiens
ttatttagactcatctt

SEQ ID NO: 853208 - DNA, 18 bp, Homo sapiens
ttatttagggaactgctt

SEQ ID NO: 853209 - DNA, 20 bp, Homo sapiens
ttatttagggccttttctgt

SEQ ID NO: 853210 - DNA, 12 bp, Homo sapiens
ttatttataaac

SEQ ID NO: 853211 - DNA, 15 bp, Homo sapiens
ttatttatacactgt

SEQ ID NO: 853212 - DNA, 12 bp, Homo sapiens
ttatttatattc

SEQ ID NO: 853213 - DNA, 22 bp, Homo sapiens
ttatttatgaaaaaatatgaac

SEQ ID NO: 853214 - DNA, 14 bp, Homo sapiens
ttatttatgcctct

SEQ ID NO: 853215 - DNA, 20 bp, Homo sapiens
ttatttattaaaaatgttct

SEQ ID NO: 853216 - DNA, 21 bp, Homo sapiens
ttatttattaaaaatgttctc

SEQ ID NO: 853217 - DNA, 14 bp, Homo sapiens
ttatttattactgt

SEQ ID NO: 853218 - DNA, 22 bp, Homo sapiens
ttatttattcagcttcatttgt

SEQ ID NO: 853219 - DNA, 15 bp, Homo sapiens
ttatttattggagat

SEQ ID NO: 853220 - DNA, 12 bp, Homo sapiens
ttatttcaatgt

SEQ ID NO: 853221 - DNA, 15 bp, Homo sapiens
ttatttcaatgtaat

SEQ ID NO: 853222 - DNA, 20 bp, Homo sapiens
ttatttcactttagatgctg

SEQ ID NO: 853223 - DNA, 18 bp, Homo sapiens
ttatttcataaacaactt

SEQ ID NO: 853224 - DNA, 16 bp, Homo sapiens
ttatttcataccatta

SEQ ID NO: 853225 - DNA, 18 bp, Homo sapiens
ttatttcatatactataa

SEQ ID NO: 853226 - DNA, 23 bp, Homo sapiens
ttatttcatatactataattgta

SEQ ID NO: 853227 - DNA, 15 bp, Homo sapiens
ttatttccactaaaa

SEQ ID NO: 853228 - DNA, 18 bp, Homo sapiens
ttatttccactaaaaata

SEQ ID NO: 853229 - DNA, 19 bp, Homo sapiens
ttatttccactaaaaatat

SEQ ID NO: 853230 - DNA, 12 bp, Homo sapiens
ttatttctagca

SEQ ID NO: 853231 - DNA, 21 bp, Homo sapiens
ttatttctagcagagtgagga

SEQ ID NO: 853232 - DNA, 16 bp, Homo sapiens
ttatttctccatcccc

SEQ ID NO: 853233 - DNA, 19 bp, Homo sapiens
ttatttctccatcccctcc

SEQ ID NO: 853234 - DNA, 14 bp, Homo sapiens
ttatttctctgatt

SEQ ID NO: 853235 - DNA, 19 bp, Homo sapiens
ttatttctctggcaaactt

SEQ ID NO: 853236 - DNA, 15 bp, Homo sapiens
ttatttctgatttca

SEQ ID NO: 853237 - DNA, 22 bp, Homo sapiens
ttatttctgatttcataattca

SEQ ID NO: 853238 - DNA, 15 bp, Homo sapiens
ttatttctgcatatg

SEQ ID NO: 853239 - DNA, 22 bp, Homo sapiens
ttatttctgcatatgttgaata

SEQ ID NO: 853240 - DNA, 18 bp, Homo sapiens
ttatttctgtttgtttaa

SEQ ID NO: 853241 - DNA, 14 bp, Homo sapiens
ttatttgacaaaat

SEQ ID NO: 853242 - DNA, 15 bp, Homo sapiens
ttatttgactttaat

SEQ ID NO: 853243 - DNA, 15 bp, Homo sapiens
ttatttgcagagaca

SEQ ID NO: 853244 - DNA, 18 bp, Homo sapiens
ttatttgcagagacagga

SEQ ID NO: 853245 - DNA, 13 bp, Homo sapiens
ttatttgcatgtt

SEQ ID NO: 853246 - DNA, 15 bp, Homo sapiens
ttatttgcatgttat

SEQ ID NO: 853247 - DNA, 20 bp, Homo sapiens
ttatttggaaattttagtta

SEQ ID NO: 853248 - DNA, 21 bp, Homo sapiens
ttatttgggggggcgtgagac

SEQ ID NO: 853249 - DNA, 13 bp, Homo sapiens
ttatttgtaaatt

SEQ ID NO: 853250 - DNA, 19 bp, Homo sapiens
ttatttgtaaatttagtgt

SEQ ID NO: 853251 - DNA, 12 bp, Homo sapiens
ttatttgtaata

SEQ ID NO: 853252 - DNA, 17 bp, Homo sapiens
ttatttgtaatagatgt

SEQ ID NO: 853253 - DNA, 12 bp, Homo sapiens
ttatttgtcaaa

SEQ ID NO: 853254 - DNA, 13 bp, Homo sapiens
ttatttgtgtaat

SEQ ID NO: 853255 - DNA, 14 bp, Homo sapiens
ttatttgttgagag

SEQ ID NO: 853256 - DNA, 19 bp, Homo sapiens
ttatttgtttttcattcat

SEQ ID NO: 853257 - DNA, 14 bp, Homo sapiens
ttattttacattta

SEQ ID NO: 853258 - DNA, 17 bp, Homo sapiens
ttattttagcttcagtt

SEQ ID NO: 853259 - DNA, 15 bp, Homo sapiens
ttattttaggcactg

SEQ ID NO: 853260 - DNA, 13 bp, Homo sapiens
ttattttagtata

SEQ ID NO: 853261 - DNA, 12 bp, Homo sapiens
ttattttataac

SEQ ID NO: 853262 - DNA, 22 bp, Homo sapiens
ttattttataagaaaaactttt

SEQ ID NO: 853263 - DNA, 13 bp, Homo sapiens
ttattttcattgt

SEQ ID NO: 853264 - DNA, 16 bp, Homo sapiens
ttattttcctccccag

SEQ ID NO: 853265 - DNA, 17 bp, Homo sapiens
ttattttctttgaaatt

SEQ ID NO: 853266 - DNA, 13 bp, Homo sapiens
ttattttgaatgt

SEQ ID NO: 853267 - DNA, 15 bp, Homo sapiens
ttattttgacataaa

SEQ ID NO: 853268 - DNA, 13 bp, Homo sapiens
ttattttgatgta

SEQ ID NO: 853269 - DNA, 16 bp, Homo sapiens
ttattttgatgtaaag

SEQ ID NO: 853270 - DNA, 14 bp, Homo sapiens
ttattttgccagtt

SEQ ID NO: 853271 - DNA, 16 bp, Homo sapiens
ttattttgctccctct

SEQ ID NO: 853272 - DNA, 20 bp, Homo sapiens
ttattttgctccctctgtta

SEQ ID NO: 853273 - DNA, 15 bp, Homo sapiens
ttattttgctttggt

SEQ ID NO: 853274 - DNA, 23 bp, Homo sapiens
ttattttggcttcatttcaatca

SEQ ID NO: 853275 - DNA, 18 bp, Homo sapiens
ttattttgtattacatct

SEQ ID NO: 853276 - DNA, 14 bp, Homo sapiens
ttattttgtgaact

SEQ ID NO: 853277 - DNA, 14 bp, Homo sapiens
ttatttttacctaa

SEQ ID NO: 853278 - DNA, 21 bp, Homo sapiens
ttatttttataattaaagatg

SEQ ID NO: 853279 - DNA, 20 bp, Homo sapiens
ttatttttatatcagcctga

SEQ ID NO: 853280 - DNA, 14 bp, Homo sapiens
ttatttttcactct

SEQ ID NO: 853281 - DNA, 16 bp, Homo sapiens
ttatttttcatattgt

SEQ ID NO: 853282 - DNA, 19 bp, Homo sapiens
ttatttttcatattgtgcc

SEQ ID NO: 853283 - DNA, 23 bp, Homo sapiens
ttatttttcctcagaatgatttg

SEQ ID NO: 853284 - DNA, 16 bp, Homo sapiens
ttatttttctaagtgt

SEQ ID NO: 853285 - DNA, 20 bp, Homo sapiens
ttatttttctcttgtaccat

SEQ ID NO: 853286 - DNA, 21 bp, Homo sapiens
ttatttttctctttctccctt

SEQ ID NO: 853287 - DNA, 11 bp, Homo sapiens
ttatttttgaa

SEQ ID NO: 853288 - DNA, 23 bp, Homo sapiens
ttatttttgacagtgttgaaaat

SEQ ID NO: 853289 - DNA, 13 bp, Homo sapiens
ttatttttgcaaa

SEQ ID NO: 853290 - DNA, 12 bp, Homo sapiens
ttatttttgcca

SEQ ID NO: 853291 - DNA, 21 bp, Homo sapiens
ttatttttgggtttggccagg

SEQ ID NO: 853292 - DNA, 15 bp, Homo sapiens
ttatttttgtataaa

SEQ ID NO: 853293 - DNA, 21 bp, Homo sapiens
ttatttttgttagcaaagatt

SEQ ID NO: 853294 - DNA, 18 bp, Homo sapiens
ttattttttaagtattta

SEQ ID NO: 853295 - DNA, 16 bp, Homo sapiens
ttattttttctatgaa

SEQ ID NO: 853296 - DNA, 20 bp, Homo sapiens
ttattttttcttttgtaatt

SEQ ID NO: 853297 - DNA, 13 bp, Homo sapiens
ttattttttgggc

SEQ ID NO: 853298 - DNA, 14 bp, Homo sapiens
ttatttttttctac

SEQ ID NO: 853299 - DNA, 17 bp, Homo sapiens
ttatttttttgagactg

SEQ ID NO: 853300 - DNA, 14 bp, Homo sapiens
ttcaaaaaaacact

SEQ ID NO: 853301 - DNA, 17 bp, Homo sapiens
ttcaaaaaccagccagg

SEQ ID NO: 853302 - DNA, 12 bp, Homo sapiens
ttcaaaaataat

SEQ ID NO: 853303 - DNA, 13 bp, Homo sapiens
ttcaaaaatttca

SEQ ID NO: 853304 - DNA, 16 bp, Homo sapiens
ttcaaaacaaaatgaa

SEQ ID NO: 853305 - DNA, 19 bp, Homo sapiens
ttcaaaaccaaggaagcag

SEQ ID NO: 853306 - DNA, 17 bp, Homo sapiens
ttcaaaaccttttgaaa

SEQ ID NO: 853307 - DNA, 21 bp, Homo sapiens
ttcaaaagaatcagaaacagg

SEQ ID NO: 853308 - DNA, 19 bp, Homo sapiens
ttcaaaagtattgaaagcc

SEQ ID NO: 853309 - DNA, 16 bp, Homo sapiens
ttcaaaagttgaaatt

SEQ ID NO: 853310 - DNA, 20 bp, Homo sapiens
ttcaaaagtttgtttgctta

SEQ ID NO: 853311 - DNA, 15 bp, Homo sapiens
ttcactgagctcccc

SEQ ID NO: 853312 - DNA, 18 bp, Homo sapiens
ttcactgagctccccaga

SEQ ID NO: 853313 - DNA, 20 bp, Homo sapiens
ttcactgcatggctcccaca

SEQ ID NO: 853314 - DNA, 17 bp, Homo sapiens
ttcactgccagttgtct

SEQ ID NO: 853315 - DNA, 15 bp, Homo sapiens
ttcactgctgctcct

SEQ ID NO: 853316 - DNA, 16 bp, Homo sapiens
ttcactgctggctgcc

SEQ ID NO: 853317 - DNA, 19 bp, Homo sapiens
ttcactgctggctgcctta

SEQ ID NO: 853318 - DNA, 17 bp, Homo sapiens
ttcactggagttacatt

SEQ ID NO: 853319 - DNA, 22 bp, Homo sapiens
ttcactggcccctactttgtgg

SEQ ID NO: 853320 - DNA, 21 bp, Homo sapiens
ttcactggggcatgagatttt

SEQ ID NO: 853321 - DNA, 16 bp, Homo sapiens
ttcactggttttacac

SEQ ID NO: 853322 - DNA, 22 bp, Homo sapiens
ttcactgtagaatgatttcatg

SEQ ID NO: 853323 - DNA, 20 bp, Homo sapiens
ttcactgtcaccaccctgct

SEQ ID NO: 853324 - DNA, 16 bp, Homo sapiens
ttcactgttccctctg

SEQ ID NO: 853325 - DNA, 19 bp, Homo sapiens
ttcactgtttcatctaagt

SEQ ID NO: 853326 - DNA, 23 bp, Homo sapiens
ttcactgtttcatctaagtgcct

SEQ ID NO: 853327 - DNA, 14 bp, Homo sapiens
ttcacttaatccat

SEQ ID NO: 853328 - DNA, 12 bp, Homo sapiens
ttcacttcaaaa

SEQ ID NO: 853329 - DNA, 21 bp, Homo sapiens
ttcacttcaaagctaaaaaat

SEQ ID NO: 853330 - DNA, 20 bp, Homo sapiens
ttcacttctgggaaattgaa

SEQ ID NO: 853331 - DNA, 16 bp, Homo sapiens
ttcacttgagttggct

SEQ ID NO: 853332 - DNA, 13 bp, Homo sapiens
ttcacttgtcttg

SEQ ID NO: 853333 - DNA, 12 bp, Homo sapiens
ttcactttgaaa

SEQ ID NO: 853334 - DNA, 23 bp, Homo sapiens
ttcactttgtgtattaaatggtt

SEQ ID NO: 853335 - DNA, 19 bp, Homo sapiens
ttcactttgtttatgcata

SEQ ID NO: 853336 - DNA, 16 bp, Homo sapiens
ttcacttttgttctgc

SEQ ID NO: 853337 - DNA, 22 bp, Homo sapiens
ttcacttttgttgcccaggctg

SEQ ID NO: 853338 - DNA, 20 bp, Homo sapiens
ttcagaaaaattaaaaaaga

SEQ ID NO: 853339 - DNA, 19 bp, Homo sapiens
ttcagaaaacttcaagaca

SEQ ID NO: 853340 - DNA, 21 bp, Homo sapiens
ttcagaaacagggcagcagtg

SEQ ID NO: 853341 - DNA, 16 bp, Homo sapiens
ttcagaaagacttggt

SEQ ID NO: 853342 - DNA, 13 bp, Homo sapiens
ttcagaaatatgt

SEQ ID NO: 853343 - DNA, 17 bp, Homo sapiens
ttcagaaatgctgcctg

SEQ ID NO: 853344 - DNA, 21 bp, Homo sapiens
ttcagaaatgctgcctgcctg

SEQ ID NO: 853345 - DNA, 13 bp, Homo sapiens
ttcagaaatgtgt

SEQ ID NO: 853346 - DNA, 16 bp, Homo sapiens
ttcagaaatgtgttat

SEQ ID NO: 853347 - DNA, 14 bp, Homo sapiens
ttcagaaattaaaa

SEQ ID NO: 853348 - DNA, 20 bp, Homo sapiens
ttcagaaattggaacagaat

SEQ ID NO: 853349 - DNA, 23 bp, Homo sapiens
ttcagaacacacagactttctgt

SEQ ID NO: 853350 - DNA, 12 bp, Homo sapiens
ttcagaacctct

SEQ ID NO: 853351 - DNA, 15 bp, Homo sapiens
ttcagaacctcttcc

SEQ ID NO: 853352 - DNA, 16 bp, Homo sapiens
ttcagaacctcttccc

SEQ ID NO: 853353 - DNA, 18 bp, Homo sapiens
ttcagaactatttaaaat

SEQ ID NO: 853354 - DNA, 12 bp, Homo sapiens
ttcagaagaaaa

SEQ ID NO: 853355 - DNA, 14 bp, Homo sapiens
ttcagaagaaaaag

SEQ ID NO: 853356 - DNA, 16 bp, Homo sapiens
ttcagaagaaataaat

SEQ ID NO: 853357 - DNA, 13 bp, Homo sapiens
ttcagaagaaatt

SEQ ID NO: 853358 - DNA, 12 bp, Homo sapiens
ttcagaagagat

SEQ ID NO: 853359 - DNA, 20 bp, Homo sapiens
ttcagaagatggtgaagaca

SEQ ID NO: 853360 - DNA, 18 bp, Homo sapiens
ttcagaagcaagccagac

SEQ ID NO: 853361 - DNA, 20 bp, Homo sapiens
ttcagaaggtatcagttata

SEQ ID NO: 853362 - DNA, 23 bp, Homo sapiens
ttcagaaggttattttctttatc

SEQ ID NO: 853363 - DNA, 22 bp, Homo sapiens
ttcagaagtcacacattacaaa

SEQ ID NO: 853364 - DNA, 21 bp, Homo sapiens
ttcagaagtgagctttgctgc

SEQ ID NO: 853365 - DNA, 22 bp, Homo sapiens
ttcagaagtgagctttgctgct

SEQ ID NO: 853366 - DNA, 20 bp, Homo sapiens
ttcagaagttagtttgtata

SEQ ID NO: 853367 - DNA, 23 bp, Homo sapiens
ttcagaagtttggcaatagtttg

SEQ ID NO: 853368 - DNA, 17 bp, Homo sapiens
ttcagaatctttgttaa

SEQ ID NO: 853369 - DNA, 16 bp, Homo sapiens
ttcagaattaaacttt

SEQ ID NO: 853370 - DNA, 18 bp, Homo sapiens
ttcagaattttgtatatt

SEQ ID NO: 853371 - DNA, 20 bp, Homo sapiens
ttcagacaagcaacaggttt

SEQ ID NO: 853372 - DNA, 16 bp, Homo sapiens
ttcagacacaggaaaa

SEQ ID NO: 853373 - DNA, 15 bp, Homo sapiens
ttcagacacatgcta

SEQ ID NO: 853374 - DNA, 16 bp, Homo sapiens
ttcagacactttggaa

SEQ ID NO: 853375 - DNA, 20 bp, Homo sapiens
ttcagacatctgaggtttta

SEQ ID NO: 853376 - DNA, 23 bp, Homo sapiens
ttcagacccccccatttcccgca

SEQ ID NO: 853377 - DNA, 17 bp, Homo sapiens
ttcagaccctgggtcag

SEQ ID NO: 853378 - DNA, 13 bp, Homo sapiens
ttcagacctgaca

SEQ ID NO: 853379 - DNA, 13 bp, Homo sapiens
ttcagactcagac

SEQ ID NO: 853380 - DNA, 14 bp, Homo sapiens
ttcagactcagact

SEQ ID NO: 853381 - DNA, 21 bp, Homo sapiens
ttcagagacagctgatacttc

SEQ ID NO: 853382 - DNA, 20 bp, Homo sapiens
ttcagagactcagggcccca

SEQ ID NO: 853383 - DNA, 15 bp, Homo sapiens
ttcagagagctggta

SEQ ID NO: 853384 - DNA, 20 bp, Homo sapiens
ttcagagagggcagaggggt

SEQ ID NO: 853385 - DNA, 17 bp, Homo sapiens
ttcagagagtcaatgtc

SEQ ID NO: 853386 - DNA, 22 bp, Homo sapiens
ttcagagagtcaatgtcattac

SEQ ID NO: 853387 - DNA, 13 bp, Homo sapiens
ttcagagatcaag

SEQ ID NO: 853388 - DNA, 20 bp, Homo sapiens
ttcagagcataaaacctaaa

SEQ ID NO: 853389 - DNA, 16 bp, Homo sapiens
ttcagagccagcctgg

SEQ ID NO: 853390 - DNA, 18 bp, Homo sapiens
ttcagagcccccagccct

SEQ ID NO: 853391 - DNA, 22 bp, Homo sapiens
ttcagaggataaatatcaatgg

SEQ ID NO: 853392 - DNA, 22 bp, Homo sapiens
ttcagaggctcagattgtaata

SEQ ID NO: 853393 - DNA, 15 bp, Homo sapiens
ttcagagggtaagta

SEQ ID NO: 853394 - DNA, 23 bp, Homo sapiens
ttcagagggtaagtaaacagatt

SEQ ID NO: 853395 - DNA, 23 bp, Homo sapiens
ttcagagtcctcattataaaatg

SEQ ID NO: 853396 - DNA, 13 bp, Homo sapiens
ttcagagtggctc

SEQ ID NO: 853397 - DNA, 14 bp, Homo sapiens
ttcagagtggctca

SEQ ID NO: 853398 - DNA, 23 bp, Homo sapiens
ttcagagtggctcactggctggg

SEQ ID NO: 853399 - DNA, 15 bp, Homo sapiens
ttcagagtttgtgtg

SEQ ID NO: 853400 - DNA, 23 bp, Homo sapiens
ttcagagtttgtgtgtatttgta

SEQ ID NO: 853401 - DNA, 18 bp, Homo sapiens
ttcagatacagggtgctc

SEQ ID NO: 853402 - DNA, 22 bp, Homo sapiens
ttcagatataaaagactgacca

SEQ ID NO: 853403 - DNA, 14 bp, Homo sapiens
ttcagatatcaaaa

SEQ ID NO: 853404 - DNA, 18 bp, Homo sapiens
ttcagatatcaaaattct

SEQ ID NO: 853405 - DNA, 19 bp, Homo sapiens
ttcagatatcaaaattcta

SEQ ID NO: 853406 - DNA, 17 bp, Homo sapiens
ttcagatcagtgcttga

SEQ ID NO: 853407 - DNA, 19 bp, Homo sapiens
ttcagatcttaatataaat

SEQ ID NO: 853408 - DNA, 13 bp, Homo sapiens
ttcagatgtaatg

SEQ ID NO: 853409 - DNA, 14 bp, Homo sapiens
ttcagatgtaatgt

SEQ ID NO: 853410 - DNA, 17 bp, Homo sapiens
ttcagatgtcttctgcc

SEQ ID NO: 853411 - DNA, 18 bp, Homo sapiens
ttcagatgtgcaataatt

SEQ ID NO: 853412 - DNA, 22 bp, Homo sapiens
ttcagatgtgcaataatttgta

SEQ ID NO: 853413 - DNA, 23 bp, Homo sapiens
ttcagatgtgcaataatttgtac

SEQ ID NO: 853414 - DNA, 14 bp, Homo sapiens
ttcagatgtgcatt

SEQ ID NO: 853415 - DNA, 14 bp, Homo sapiens
ttcagatgtttcga

SEQ ID NO: 853416 - DNA, 12 bp, Homo sapiens
ttcagatttggc

SEQ ID NO: 853417 - DNA, 20 bp, Homo sapiens
ttcagattttaaaaagtctt

SEQ ID NO: 853418 - DNA, 19 bp, Homo sapiens
ttcagcaaactaaccagca

SEQ ID NO: 853419 - DNA, 19 bp, Homo sapiens
ttcagcacccccacccacc

SEQ ID NO: 853420 - DNA, 13 bp, Homo sapiens
ttcagcaccctgg

SEQ ID NO: 853421 - DNA, 16 bp, Homo sapiens
ttcagcactgtccctt

SEQ ID NO: 853422 - DNA, 19 bp, Homo sapiens
ttcagcagcaaattttcag

SEQ ID NO: 853423 - DNA, 16 bp, Homo sapiens
ttcagcagtcaataca

SEQ ID NO: 853424 - DNA, 16 bp, Homo sapiens
ttcagcattaggcttt

SEQ ID NO: 853425 - DNA, 19 bp, Homo sapiens
ttcagcattattcctccag

SEQ ID NO: 853426 - DNA, 16 bp, Homo sapiens
ttcagccaaagtccta

SEQ ID NO: 853427 - DNA, 10 bp, Homo sapiens
ttcagccaag

SEQ ID NO: 853428 - DNA, 17 bp, Homo sapiens
ttcagccagcttaaacc

SEQ ID NO: 853429 - DNA, 14 bp, Homo sapiens
ttcagcccctcctc

SEQ ID NO: 853430 - DNA, 16 bp, Homo sapiens
ttcagcccctcctctg

SEQ ID NO: 853431 - DNA, 17 bp, Homo sapiens
ttcagcccctcctctgc

SEQ ID NO: 853432 - DNA, 21 bp, Homo sapiens
ttccacctgtgccctcaccac

SEQ ID NO: 853433 - DNA, 17 bp, Homo sapiens
ttccaccttaaattaaa

SEQ ID NO: 853434 - DNA, 19 bp, Homo sapiens
ttccacgatgaaaaacttc

SEQ ID NO: 853435 - DNA, 14 bp, Homo sapiens
ttccacgtgcccct

SEQ ID NO: 853436 - DNA, 15 bp, Homo sapiens
ttccacgtgcccctt

SEQ ID NO: 853437 - DNA, 22 bp, Homo sapiens
ttccacgtgccccttgtcgcgc

SEQ ID NO: 853438 - DNA, 19 bp, Homo sapiens
ttccacgtgttttattcct

SEQ ID NO: 853439 - DNA, 18 bp, Homo sapiens
ttccactaaaaatattgt

SEQ ID NO: 853440 - DNA, 12 bp, Homo sapiens
ttccactccact

SEQ ID NO: 853441 - DNA, 16 bp, Homo sapiens
ttccactgaacaaaac

SEQ ID NO: 853442 - DNA, 12 bp, Homo sapiens
ttccactgagct

SEQ ID NO: 853443 - DNA, 15 bp, Homo sapiens
ttccactgagctcca

SEQ ID NO: 853444 - DNA, 13 bp, Homo sapiens
ttccactgcaaaa

SEQ ID NO: 853445 - DNA, 17 bp, Homo sapiens
ttccactgcgttgtcca

SEQ ID NO: 853446 - DNA, 13 bp, Homo sapiens
ttccactgtagct

SEQ ID NO: 853447 - DNA, 21 bp, Homo sapiens
ttccacttagaaattgcattt

SEQ ID NO: 853448 - DNA, 23 bp, Homo sapiens
ttccactttgttctttaggagat

SEQ ID NO: 853449 - DNA, 22 bp, Homo sapiens
ttccactttgttggcccttcca

SEQ ID NO: 853450 - DNA, 17 bp, Homo sapiens
ttccagaaaaccccagc

SEQ ID NO: 853451 - DNA, 18 bp, Homo sapiens
ttccagaaaaccccagca

SEQ ID NO: 853452 - DNA, 22 bp, Homo sapiens
ttccagaaaggatatttaagaa

SEQ ID NO: 853453 - DNA, 14 bp, Homo sapiens
ttccagaacagccc

SEQ ID NO: 853454 - DNA, 15 bp, Homo sapiens
ttccagaacagccct

SEQ ID NO: 853455 - DNA, 23 bp, Homo sapiens
ttccagaagaagagaagctgctg

SEQ ID NO: 853456 - DNA, 15 bp, Homo sapiens
ttccagaatcccaag

SEQ ID NO: 853457 - DNA, 22 bp, Homo sapiens
ttccagacattctcgcttccct

SEQ ID NO: 853458 - DNA, 18 bp, Homo sapiens
ttccagactcaggttcca

SEQ ID NO: 853459 - DNA, 23 bp, Homo sapiens
ttccagactcaggttccagaaca

SEQ ID NO: 853460 - DNA, 19 bp, Homo sapiens
ttccagagagtggctcctc

SEQ ID NO: 853461 - DNA, 16 bp, Homo sapiens
ttccagagcagagcct

SEQ ID NO: 853462 - DNA, 15 bp, Homo sapiens
ttccagaggacagct

SEQ ID NO: 853463 - DNA, 19 bp, Homo sapiens
ttccagaggacagctctgg

SEQ ID NO: 853464 - DNA, 16 bp, Homo sapiens
ttccagaggactctgc

SEQ ID NO: 853465 - DNA, 17 bp, Homo sapiens
ttccagaggactctgct

SEQ ID NO: 853466 - DNA, 20 bp, Homo sapiens
ttccagaggctattattttc

SEQ ID NO: 853467 - DNA, 19 bp, Homo sapiens
ttccagagttgttgtttgc

SEQ ID NO: 853468 - DNA, 23 bp, Homo sapiens
ttccagatatccacataaatgct

SEQ ID NO: 853469 - DNA, 14 bp, Homo sapiens
ttccagattcctat

SEQ ID NO: 853470 - DNA, 21 bp, Homo sapiens
ttccagcaaaatggaagcaaa

SEQ ID NO: 853471 - DNA, 17 bp, Homo sapiens
ttccagcaataagaaat

SEQ ID NO: 853472 - DNA, 23 bp, Homo sapiens
ttccagcaataagaaatgaacaa

SEQ ID NO: 853473 - DNA, 14 bp, Homo sapiens
ttccagcagctgca

SEQ ID NO: 853474 - DNA, 16 bp, Homo sapiens
ttccagcagtgaaact

SEQ ID NO: 853475 - DNA, 14 bp, Homo sapiens
ttccagccaggccc

SEQ ID NO: 853476 - DNA, 18 bp, Homo sapiens
ttccagccaggcccaggc

SEQ ID NO: 853477 - DNA, 21 bp, Homo sapiens
ttccagccaggcccaggccag

SEQ ID NO: 853478 - DNA, 14 bp, Homo sapiens
ttccagcctgggac

SEQ ID NO: 853479 - DNA, 15 bp, Homo sapiens
ttccagcctgggaca

SEQ ID NO: 853480 - DNA, 21 bp, Homo sapiens
ttccagccttatgtgttacat

SEQ ID NO: 853481 - DNA, 11 bp, Homo sapiens
ttccagctcct

SEQ ID NO: 853482 - DNA, 15 bp, Homo sapiens
ttccagctctgcccc

SEQ ID NO: 853483 - DNA, 21 bp, Homo sapiens
ttccagctctgcccccgcggg

SEQ ID NO: 853484 - DNA, 18 bp, Homo sapiens
ttccagctggatgagaat

SEQ ID NO: 853485 - DNA, 14 bp, Homo sapiens
ttccaggaaaaaat

SEQ ID NO: 853486 - DNA, 18 bp, Homo sapiens
ttccaggaaaaaataaaa

SEQ ID NO: 853487 - DNA, 21 bp, Homo sapiens
ttccaggaaactccacatctg

SEQ ID NO: 853488 - DNA, 24 bp, Homo sapiens
ttccaggaaactccacatctgcct

SEQ ID NO: 853489 - DNA, 16 bp, Homo sapiens
ttccaggaatgctggg

SEQ ID NO: 853490 - DNA, 15 bp, Homo sapiens
ttccaggagacatat

SEQ ID NO: 853491 - DNA, 18 bp, Homo sapiens
ttccaggagacatatata

SEQ ID NO: 853492 - DNA, 16 bp, Homo sapiens
ttccaggatcctgcag

SEQ ID NO: 853493 - DNA, 18 bp, Homo sapiens
ttccaggatcctgcagga

SEQ ID NO: 853494 - DNA, 16 bp, Homo sapiens
ttccaggcccctgagg

SEQ ID NO: 853495 - DNA, 17 bp, Homo sapiens
ttccaggcccctgagga

SEQ ID NO: 853496 - DNA, 13 bp, Homo sapiens
ttccaggccctcc

SEQ ID NO: 853497 - DNA, 21 bp, Homo sapiens
ttccaggctaaacatccaata

SEQ ID NO: 853498 - DNA, 20 bp, Homo sapiens
ttccaggctcacctttagaa

SEQ ID NO: 853499 - DNA, 11 bp, Homo sapiens
ttccaggctct

SEQ ID NO: 853500 - DNA, 19 bp, Homo sapiens
ttccaggcttccctgactt

SEQ ID NO: 853501 - DNA, 16 bp, Homo sapiens
ttccagggctggggtg

SEQ ID NO: 853502 - DNA, 14 bp, Homo sapiens
ttccaggggaacct

SEQ ID NO: 853503 - DNA, 20 bp, Homo sapiens
ttccagggtccctctgtgta

SEQ ID NO: 853504 - DNA, 21 bp, Homo sapiens
ttccaggtacccttctcgctt

SEQ ID NO: 853505 - DNA, 19 bp, Homo sapiens
ttccaggtatctccaggat

SEQ ID NO: 853506 - DNA, 21 bp, Homo sapiens
ttccaggtgtgcacagaaaac

SEQ ID NO: 853507 - DNA, 18 bp, Homo sapiens
ttccaggtttaagctgtt

SEQ ID NO: 853508 - DNA, 21 bp, Homo sapiens
ttccagtaaggaatgatattg

SEQ ID NO: 853509 - DNA, 19 bp, Homo sapiens
ttccagtacacctttcagc

SEQ ID NO: 853510 - DNA, 21 bp, Homo sapiens
ttccagtacagtattctttta

SEQ ID NO: 853511 - DNA, 19 bp, Homo sapiens
ttccagtacctttgtcaca

SEQ ID NO: 853512 - DNA, 13 bp, Homo sapiens
ttccagtattgaa

SEQ ID NO: 853513 - DNA, 18 bp, Homo sapiens
ttccagtattgaaaactt

SEQ ID NO: 853514 - DNA, 19 bp, Homo sapiens
ttccagtgaggaaccctga

SEQ ID NO: 853515 - DNA, 18 bp, Homo sapiens
ttccagtggatcataaga

SEQ ID NO: 853516 - DNA, 19 bp, Homo sapiens
ttccagttctgacacacgt

SEQ ID NO: 853517 - DNA, 17 bp, Homo sapiens
ttccagttgctgtggac

SEQ ID NO: 853518 - DNA, 13 bp, Homo sapiens
ttccagtttctcc

SEQ ID NO: 853519 - DNA, 16 bp, Homo sapiens
ttccagtttctccttg

SEQ ID NO: 853520 - DNA, 20 bp, Homo sapiens
ttccataaatttggactgtc

SEQ ID NO: 853521 - DNA, 19 bp, Homo sapiens
ttccataaggaatgtagct

SEQ ID NO: 853522 - DNA, 19 bp, Homo sapiens
ttccataatctggactcct

SEQ ID NO: 853523 - DNA, 14 bp, Homo sapiens
ttccataattatga

SEQ ID NO: 853524 - DNA, 18 bp, Homo sapiens
ttccataattatgacagt

SEQ ID NO: 853525 - DNA, 17 bp, Homo sapiens
ttccatacttctctcag

SEQ ID NO: 853526 - DNA, 13 bp, Homo sapiens
ttccatagcaaca

SEQ ID NO: 853527 - DNA, 17 bp, Homo sapiens
ttccatagcaacaggaa

SEQ ID NO: 853528 - DNA, 18 bp, Homo sapiens
ttccataggacatactgc

SEQ ID NO: 853529 - DNA, 22 bp, Homo sapiens
ttccatagtttaggtactcaaa

SEQ ID NO: 853530 - DNA, 13 bp, Homo sapiens
ttccatatagtct

SEQ ID NO: 853531 - DNA, 23 bp, Homo sapiens
ttccatatccctgcccagcctgt

SEQ ID NO: 853532 - DNA, 15 bp, Homo sapiens
ttccatatcctggtg

SEQ ID NO: 853533 - DNA, 23 bp, Homo sapiens
ttccatcagcgggtctcctccca

SEQ ID NO: 853534 - DNA, 15 bp, Homo sapiens
ttccatcatcactgt

SEQ ID NO: 853535 - DNA, 18 bp, Homo sapiens
ttccatcatcactgtaaa

SEQ ID NO: 853536 - DNA, 12 bp, Homo sapiens
ttccatcatgtc

SEQ ID NO: 853537 - DNA, 18 bp, Homo sapiens
ttccatcatgtctgtata

SEQ ID NO: 853538 - DNA, 17 bp, Homo sapiens
ttccatcccttcctgaa

SEQ ID NO: 853539 - DNA, 19 bp, Homo sapiens
ttccatctagcagctggcc

SEQ ID NO: 853540 - DNA, 14 bp, Homo sapiens
ttccatctctgact

SEQ ID NO: 853541 - DNA, 12 bp, Homo sapiens
ttccatcttgta

SEQ ID NO: 853542 - DNA, 13 bp, Homo sapiens
ttccatctttaca

SEQ ID NO: 853543 - DNA, 21 bp, Homo sapiens
ttccatgacctcccctcccca

SEQ ID NO: 853544 - DNA, 15 bp, Homo sapiens
ttccatgagctgctc

SEQ ID NO: 853545 - DNA, 17 bp, Homo sapiens
ttccatgattctattta

SEQ ID NO: 853546 - DNA, 17 bp, Homo sapiens
ttccatgcagccttggg

SEQ ID NO: 853547 - DNA, 15 bp, Homo sapiens
ttccatgccctggga

SEQ ID NO: 853548 - DNA, 23 bp, Homo sapiens
ttccatgctgtgcgcccagggct

SEQ ID NO: 853549 - DNA, 16 bp, Homo sapiens
ttccatggcaaatggg

SEQ ID NO: 853550 - DNA, 20 bp, Homo sapiens
ttccatggcaaatgggcagc

SEQ ID NO: 853551 - DNA, 17 bp, Homo sapiens
ttccatggcaattttgt

SEQ ID NO: 853552 - DNA, 12 bp, Homo sapiens
ttccatggcctc

SEQ ID NO: 853553 - DNA, 16 bp, Homo sapiens
ttccatggcctcttca

SEQ ID NO: 853554 - DNA, 20 bp, Homo sapiens
ttccctggggaaaacttgca

SEQ ID NO: 853555 - DNA, 13 bp, Homo sapiens
ttccctggggagc

SEQ ID NO: 853556 - DNA, 18 bp, Homo sapiens
ttccctgttctccctttc

SEQ ID NO: 853557 - DNA, 15 bp, Homo sapiens
ttccctgttcttcct

SEQ ID NO: 853558 - DNA, 17 bp, Homo sapiens
ttcccttaactccaaga

SEQ ID NO: 853559 - DNA, 16 bp, Homo sapiens
ttcccttaacttttcc

SEQ ID NO: 853560 - DNA, 21 bp, Homo sapiens
ttcccttagcctctcccaccc

SEQ ID NO: 853561 - DNA, 22 bp, Homo sapiens
ttcccttagcctctcccacccg

SEQ ID NO: 853562 - DNA, 15 bp, Homo sapiens
ttcccttatctttta

SEQ ID NO: 853563 - DNA, 18 bp, Homo sapiens
ttcccttatcttttactt

SEQ ID NO: 853564 - DNA, 20 bp, Homo sapiens
ttcccttcatttaaactaaa

SEQ ID NO: 853565 - DNA, 11 bp, Homo sapiens
ttcccttccaa

SEQ ID NO: 853566 - DNA, 12 bp, Homo sapiens
ttcccttccaaa

SEQ ID NO: 853567 - DNA, 13 bp, Homo sapiens
ttcccttccaaag

SEQ ID NO: 853568 - DNA, 14 bp, Homo sapiens
ttcccttccaaaga

SEQ ID NO: 853569 - DNA, 20 bp, Homo sapiens
ttcccttcctcggtggctct

SEQ ID NO: 853570 - DNA, 13 bp, Homo sapiens
ttcccttcctctt

SEQ ID NO: 853571 - DNA, 15 bp, Homo sapiens
ttcccttcctcttcc

SEQ ID NO: 853572 - DNA, 21 bp, Homo sapiens
ttcccttcctcttcctgccct

SEQ ID NO: 853573 - DNA, 21 bp, Homo sapiens
ttcccttcctgttccctcctg

SEQ ID NO: 853574 - DNA, 23 bp, Homo sapiens
ttcccttcctgttccctcctggt

SEQ ID NO: 853575 - DNA, 12 bp, Homo sapiens
ttcccttctccc

SEQ ID NO: 853576 - DNA, 13 bp, Homo sapiens
ttcccttctcccc

SEQ ID NO: 853577 - DNA, 13 bp, Homo sapiens
ttcccttctctca

SEQ ID NO: 853578 - DNA, 22 bp, Homo sapiens
ttcccttctgggcttcattctg

SEQ ID NO: 853579 - DNA, 14 bp, Homo sapiens
ttcccttgaccatt

SEQ ID NO: 853580 - DNA, 19 bp, Homo sapiens
ttcccttgccactttgcac

SEQ ID NO: 853581 - DNA, 17 bp, Homo sapiens
ttcccttgcttttccct

SEQ ID NO: 853582 - DNA, 18 bp, Homo sapiens
ttcccttgcttttccctc

SEQ ID NO: 853583 - DNA, 16 bp, Homo sapiens
ttcccttggagggaga

SEQ ID NO: 853584 - DNA, 17 bp, Homo sapiens
ttcccttggatgtagtc

SEQ ID NO: 853585 - DNA, 14 bp, Homo sapiens
ttcccttggcctca

SEQ ID NO: 853586 - DNA, 13 bp, Homo sapiens
ttcccttgtattt

SEQ ID NO: 853587 - DNA, 11 bp, Homo sapiens
ttccctttgcc

SEQ ID NO: 853588 - DNA, 13 bp, Homo sapiens
ttccctttgcctt

SEQ ID NO: 853589 - DNA, 15 bp, Homo sapiens
ttccctttgccttaa

SEQ ID NO: 853590 - DNA, 21 bp, Homo sapiens
ttccctttgccttaaacctga

SEQ ID NO: 853591 - DNA, 22 bp, Homo sapiens
ttccctttgtgagtcaatacat

SEQ ID NO: 853592 - DNA, 15 bp, Homo sapiens
ttccctttgtgcaca

SEQ ID NO: 853593 - DNA, 21 bp, Homo sapiens
ttcccttttacatactgctgt

SEQ ID NO: 853594 - DNA, 22 bp, Homo sapiens
ttcccttttgactcttccgtgc

SEQ ID NO: 853595 - DNA, 23 bp, Homo sapiens
ttccgacaaccgatgctccagcc

SEQ ID NO: 853596 - DNA, 18 bp, Homo sapiens
ttccgagatccccagggc

SEQ ID NO: 853597 - DNA, 17 bp, Homo sapiens
ttccgagcattccagta

SEQ ID NO: 853598 - DNA, 17 bp, Homo sapiens
ttccgcagcccctttcc

SEQ ID NO: 853599 - DNA, 22 bp, Homo sapiens
ttccgcccccgccccacagggc

SEQ ID NO: 853600 - DNA, 21 bp, Homo sapiens
ttccgcgcccagcgctcgcca

SEQ ID NO: 853601 - DNA, 13 bp, Homo sapiens
ttccgctctgagg

SEQ ID NO: 853602 - DNA, 12 bp, Homo sapiens
ttccgctgaggg

SEQ ID NO: 853603 - DNA, 23 bp, Homo sapiens
ttccggccacatcattctgtgtc

SEQ ID NO: 853604 - DNA, 19 bp, Homo sapiens
ttccgggaaaacagctatt

SEQ ID NO: 853605 - DNA, 16 bp, Homo sapiens
ttccgggaactggagt

SEQ ID NO: 853606 - DNA, 13 bp, Homo sapiens
ttccgggagctgg

SEQ ID NO: 853607 - DNA, 19 bp, Homo sapiens
ttccgggaggcagagagga

SEQ ID NO: 853608 - DNA, 19 bp, Homo sapiens
ttccgggcaaatgccaggg

SEQ ID NO: 853609 - DNA, 15 bp, Homo sapiens
ttccggggccatggg

SEQ ID NO: 853610 - DNA, 20 bp, Homo sapiens
ttccgtaggtagatgtgtaa

SEQ ID NO: 853611 - DNA, 23 bp, Homo sapiens
ttccgtatctccctggagaagca

SEQ ID NO: 853612 - DNA, 16 bp, Homo sapiens
ttccgtatttaaagtt

SEQ ID NO: 853613 - DNA, 21 bp, Homo sapiens
ttccgtcaccacgactggcca

SEQ ID NO: 853614 - DNA, 17 bp, Homo sapiens
ttccgtccatccccctt

SEQ ID NO: 853615 - DNA, 18 bp, Homo sapiens
ttccgtccccccccaggc

SEQ ID NO: 853616 - DNA, 19 bp, Homo sapiens
ttccgtccccccccaggcc

SEQ ID NO: 853617 - DNA, 17 bp, Homo sapiens
ttccgtgaaaacggagc

SEQ ID NO: 853618 - DNA, 18 bp, Homo sapiens
ttccgtgacgtcactgga

SEQ ID NO: 853619 - DNA, 21 bp, Homo sapiens
ttccgtgtgattgtctttgaa

SEQ ID NO: 853620 - DNA, 23 bp, Homo sapiens
ttccgtttttttttttttattgt

SEQ ID NO: 853621 - DNA, 14 bp, Homo sapiens
ttcctaaactccct

SEQ ID NO: 853622 - DNA, 15 bp, Homo sapiens
ttcctaaagccatca

SEQ ID NO: 853623 - DNA, 20 bp, Homo sapiens
ttcctaaagccatcatgcct

SEQ ID NO: 853624 - DNA, 23 bp, Homo sapiens
ttcctaaatatccaaagactgta

SEQ ID NO: 853625 - DNA, 14 bp, Homo sapiens
ttcctaaatgcagt

SEQ ID NO: 853626 - DNA, 14 bp, Homo sapiens
ttcctaacaaaatg

SEQ ID NO: 853627 - DNA, 16 bp, Homo sapiens
ttcctaacaaaatgag

SEQ ID NO: 853628 - DNA, 18 bp, Homo sapiens
ttcctaacacagcatgtg

SEQ ID NO: 853629 - DNA, 19 bp, Homo sapiens
ttcctaacacagcatgtgt

SEQ ID NO: 853630 - DNA, 15 bp, Homo sapiens
ttcctaacaggatga

SEQ ID NO: 853631 - DNA, 17 bp, Homo sapiens
ttcctaactagaattag

SEQ ID NO: 853632 - DNA, 16 bp, Homo sapiens
ttcctaacttccttta

SEQ ID NO: 853633 - DNA, 19 bp, Homo sapiens
ttcctaagagtggaggagg

SEQ ID NO: 853634 - DNA, 12 bp, Homo sapiens
ttcctaaggcat

SEQ ID NO: 853635 - DNA, 13 bp, Homo sapiens
ttcctaaggcatg

SEQ ID NO: 853636 - DNA, 17 bp, Homo sapiens
ttcctaagtataaatgg

SEQ ID NO: 853637 - DNA, 16 bp, Homo sapiens
ttcctaataaagttct

SEQ ID NO: 853638 - DNA, 16 bp, Homo sapiens
ttcctaatatcaaatg

SEQ ID NO: 853639 - DNA, 17 bp, Homo sapiens
ttcctaatcaaaaaggt

SEQ ID NO: 853640 - DNA, 13 bp, Homo sapiens
ttcctacaactta

SEQ ID NO: 853641 - DNA, 19 bp, Homo sapiens
ttcctacaacttaatggaa

SEQ ID NO: 853642 - DNA, 20 bp, Homo sapiens
ttcctacaagagcagcctgt

SEQ ID NO: 853643 - DNA, 22 bp, Homo sapiens
ttcctacagcactactgggtgt

SEQ ID NO: 853644 - DNA, 18 bp, Homo sapiens
ttcctacagccccttttt

SEQ ID NO: 853645 - DNA, 19 bp, Homo sapiens
ttcctacatgccccctccc

SEQ ID NO: 853646 - DNA, 16 bp, Homo sapiens
ttcctacccaaccact

SEQ ID NO: 853647 - DNA, 15 bp, Homo sapiens
ttcctaccctgcctc

SEQ ID NO: 853648 - DNA, 23 bp, Homo sapiens
ttcctaccgtactccctgcaccg

SEQ ID NO: 853649 - DNA, 16 bp, Homo sapiens
ttcctacctccctgca

SEQ ID NO: 853650 - DNA, 20 bp, Homo sapiens
ttcctactccctcttccaaa

SEQ ID NO: 853651 - DNA, 14 bp, Homo sapiens
ttcctactgtcctg

SEQ ID NO: 853652 - DNA, 15 bp, Homo sapiens
ttcctactgtcctgg

SEQ ID NO: 853653 - DNA, 16 bp, Homo sapiens
ttcctagaaattgaac

SEQ ID NO: 853654 - DNA, 19 bp, Homo sapiens
ttcctagaagcccctgtcg

SEQ ID NO: 853655 - DNA, 17 bp, Homo sapiens
ttcctagataaaaagat

SEQ ID NO: 853656 - DNA, 14 bp, Homo sapiens
ttcctagccctctc

SEQ ID NO: 853657 - DNA, 18 bp, Homo sapiens
ttcctagccctctcacat

SEQ ID NO: 853658 - DNA, 23 bp, Homo sapiens
ttcctaggaaatcacaggcttct

SEQ ID NO: 853659 - DNA, 20 bp, Homo sapiens
ttcctataatataataaata

SEQ ID NO: 853660 - DNA, 13 bp, Homo sapiens
ttcctatacgcag

SEQ ID NO: 853661 - DNA, 19 bp, Homo sapiens
ttcctatatagtttattga

SEQ ID NO: 853662 - DNA, 21 bp, Homo sapiens
ttcctatatagtttattgaca

SEQ ID NO: 853663 - DNA, 16 bp, Homo sapiens
ttcctatcataaaaat

SEQ ID NO: 853664 - DNA, 21 bp, Homo sapiens
ttcctatgaagttggcacatt

SEQ ID NO: 853665 - DNA, 22 bp, Homo sapiens
ttcctatgcccaggtaccaccc

SEQ ID NO: 853666 - DNA, 23 bp, Homo sapiens
ttcctatgcccaggtaccaccct

SEQ ID NO: 853667 - DNA, 13 bp, Homo sapiens
ttcctatggaaac

SEQ ID NO: 853668 - DNA, 14 bp, Homo sapiens
ttcctatgtaactg

SEQ ID NO: 853669 - DNA, 14 bp, Homo sapiens
ttcctattctcctg

SEQ ID NO: 853670 - DNA, 16 bp, Homo sapiens
ttcctattctcctgcc

SEQ ID NO: 853671 - DNA, 17 bp, Homo sapiens
ttcctattctgttgcca

SEQ ID NO: 853672 - DNA, 17 bp, Homo sapiens
ttcctattgtcattaaa

SEQ ID NO: 853673 - DNA, 18 bp, Homo sapiens
ttcctattgtcattaaag

SEQ ID NO: 853674 - DNA, 19 bp, Homo sapiens
ttcctatttgttttcatgg

SEQ ID NO: 853675 - DNA, 17 bp, Homo sapiens
ttcctattttcagccca

SEQ ID NO: 853676 - DNA, 14 bp, Homo sapiens
ttcctttacctttt

SEQ ID NO: 853677 - DNA, 23 bp, Homo sapiens
ttcctttaccttttctataagtt

SEQ ID NO: 853678 - DNA, 17 bp, Homo sapiens
ttcctttactttccctt

SEQ ID NO: 853679 - DNA, 20 bp, Homo sapiens
ttcctttactttcccttgct

SEQ ID NO: 853680 - DNA, 20 bp, Homo sapiens
ttcctttatttaggaaacac

SEQ ID NO: 853681 - DNA, 19 bp, Homo sapiens
ttcctttcatctctctacc

SEQ ID NO: 853682 - DNA, 23 bp, Homo sapiens
ttcctttcatctctctacctcca

SEQ ID NO: 853683 - DNA, 14 bp, Homo sapiens
ttcctttccctgga

SEQ ID NO: 853684 - DNA, 15 bp, Homo sapiens
ttcctttcccttcct

SEQ ID NO: 853685 - DNA, 11 bp, Homo sapiens
ttcctttccta

SEQ ID NO: 853686 - DNA, 22 bp, Homo sapiens
ttcctttctaatcctatctggg

SEQ ID NO: 853687 - DNA, 12 bp, Homo sapiens
ttcctttctccc

SEQ ID NO: 853688 - DNA, 22 bp, Homo sapiens
ttcctttctctttctctcttcc

SEQ ID NO: 853689 - DNA, 14 bp, Homo sapiens
ttcctttctggccc

SEQ ID NO: 853690 - DNA, 18 bp, Homo sapiens
ttcctttgaccaaatagt

SEQ ID NO: 853691 - DNA, 14 bp, Homo sapiens
ttcctttgcatatt

SEQ ID NO: 853692 - DNA, 15 bp, Homo sapiens
ttcctttgctctttc

SEQ ID NO: 853693 - DNA, 20 bp, Homo sapiens
ttccttttagcctagttcat

SEQ ID NO: 853694 - DNA, 14 bp, Homo sapiens
ttccttttcatctg

SEQ ID NO: 853695 - DNA, 17 bp, Homo sapiens
ttccttttccctgcttc

SEQ ID NO: 853696 - DNA, 14 bp, Homo sapiens
ttccttttctctgc

SEQ ID NO: 853697 - DNA, 17 bp, Homo sapiens
ttccttttctctgcttg

SEQ ID NO: 853698 - DNA, 14 bp, Homo sapiens
ttccttttcttaaa

SEQ ID NO: 853699 - DNA, 13 bp, Homo sapiens
ttccttttcttta

SEQ ID NO: 853700 - DNA, 23 bp, Homo sapiens
ttccttttgaaagaatcagtctt

SEQ ID NO: 853701 - DNA, 13 bp, Homo sapiens
ttccttttgaaat

SEQ ID NO: 853702 - DNA, 20 bp, Homo sapiens
ttccttttgaacgccccccc

SEQ ID NO: 853703 - DNA, 23 bp, Homo sapiens
ttccttttgaacgccccccccca

SEQ ID NO: 853704 - DNA, 20 bp, Homo sapiens
ttccttttgatggggagaaa

SEQ ID NO: 853705 - DNA, 21 bp, Homo sapiens
ttccttttgatggggagaaag

SEQ ID NO: 853706 - DNA, 18 bp, Homo sapiens
ttccttttggaacatttc

SEQ ID NO: 853707 - DNA, 13 bp, Homo sapiens
ttcctttttctat

SEQ ID NO: 853708 - DNA, 15 bp, Homo sapiens
ttccttttttcccat

SEQ ID NO: 853709 - DNA, 22 bp, Homo sapiens
ttccttttttcccataagacaa

SEQ ID NO: 853710 - DNA, 14 bp, Homo sapiens
ttcctttttttgta

SEQ ID NO: 853711 - DNA, 22 bp, Homo sapiens
ttcgaaacctgggattcaggaa

SEQ ID NO: 853712 - DNA, 12 bp, Homo sapiens
ttcgaaaggcct

SEQ ID NO: 853713 - DNA, 15 bp, Homo sapiens
ttcgaaaggccttca

SEQ ID NO: 853714 - DNA, 22 bp, Homo sapiens
ttcgaagccttgcctaaattta

SEQ ID NO: 853715 - DNA, 16 bp, Homo sapiens
ttcgaagctcagccca

SEQ ID NO: 853716 - DNA, 19 bp, Homo sapiens
ttcgaagggtcttaaagaa

SEQ ID NO: 853717 - DNA, 21 bp, Homo sapiens
ttcgaagggtcttaaagaatt

SEQ ID NO: 853718 - DNA, 22 bp, Homo sapiens
ttcgaatcttaatttattattt

SEQ ID NO: 853719 - DNA, 23 bp, Homo sapiens
ttcgaatcttaatttattatttt

SEQ ID NO: 853720 - DNA, 23 bp, Homo sapiens
ttcgaatgacggtaagtgttctc

SEQ ID NO: 853721 - DNA, 17 bp, Homo sapiens
ttcgaatggggtagaaa

SEQ ID NO: 853722 - DNA, 22 bp, Homo sapiens
ttcgacatccgtcattgctgct

SEQ ID NO: 853723 - DNA, 13 bp, Homo sapiens
ttcgactggtcca

SEQ ID NO: 853724 - DNA, 17 bp, Homo sapiens
ttcgactggtccagctc

SEQ ID NO: 853725 - DNA, 17 bp, Homo sapiens
ttcgacttgcatttttg

SEQ ID NO: 853726 - DNA, 11 bp, Homo sapiens
ttcgaggcctg

SEQ ID NO: 853727 - DNA, 13 bp, Homo sapiens
ttcgaggcctgaa

SEQ ID NO: 853728 - DNA, 15 bp, Homo sapiens
ttcgaggtgtcaccc

SEQ ID NO: 853729 - DNA, 20 bp, Homo sapiens
ttcgatacaccgggcctgga

SEQ ID NO: 853730 - DNA, 18 bp, Homo sapiens
ttcgatgcgtattctgtg

SEQ ID NO: 853731 - DNA, 22 bp, Homo sapiens
ttcgatgcgtattctgtggccg

SEQ ID NO: 853732 - DNA, 23 bp, Homo sapiens
ttcgcacctaccatcagggacag

SEQ ID NO: 853733 - DNA, 17 bp, Homo sapiens
ttcgcatggtcacacac

SEQ ID NO: 853734 - DNA, 19 bp, Homo sapiens
ttcgcatggtcacacactg

SEQ ID NO: 853735 - DNA, 20 bp, Homo sapiens
ttcgcatggtcacacactga

SEQ ID NO: 853736 - DNA, 19 bp, Homo sapiens
ttcgcccaaagccagacag

SEQ ID NO: 853737 - DNA, 15 bp, Homo sapiens
ttcgccctctgaaat

SEQ ID NO: 853738 - DNA, 13 bp, Homo sapiens
ttcgccttaaact

SEQ ID NO: 853739 - DNA, 20 bp, Homo sapiens
ttcgcctttgtcttgtactt

SEQ ID NO: 853740 - DNA, 22 bp, Homo sapiens
ttcgcgatggacagactcacaa

SEQ ID NO: 853741 - DNA, 22 bp, Homo sapiens
ttcgcgggtaactggggttgag

SEQ ID NO: 853742 - DNA, 19 bp, Homo sapiens
ttcgcgtgccctcgctgct

SEQ ID NO: 853743 - DNA, 16 bp, Homo sapiens
ttcgctatagatttta

SEQ ID NO: 853744 - DNA, 19 bp, Homo sapiens
ttcgctccatcgcccaggc

SEQ ID NO: 853745 - DNA, 17 bp, Homo sapiens
ttcgctgctagagaagg

SEQ ID NO: 853746 - DNA, 14 bp, Homo sapiens
ttcgctgctctagc

SEQ ID NO: 853747 - DNA, 22 bp, Homo sapiens
ttcgcttcttgcctctgtgctg

SEQ ID NO: 853748 - DNA, 12 bp, Homo sapiens
ttcggaaaaaaa

SEQ ID NO: 853749 - DNA, 19 bp, Homo sapiens
ttcggaaaaaaaaaaagaa

SEQ ID NO: 853750 - DNA, 20 bp, Homo sapiens
ttcggacagtttatttgttg

SEQ ID NO: 853751 - DNA, 16 bp, Homo sapiens
ttcggcctttgggtgt

SEQ ID NO: 853752 - DNA, 17 bp, Homo sapiens
ttcgggaccaatatata

SEQ ID NO: 853753 - DNA, 11 bp, Homo sapiens
ttcggggaggg

SEQ ID NO: 853754 - DNA, 20 bp, Homo sapiens
ttcgggggagcagagagagc

SEQ ID NO: 853755 - DNA, 16 bp, Homo sapiens
ttcgggtgctggaagt

SEQ ID NO: 853756 - DNA, 13 bp, Homo sapiens
ttcggtgtgaact

SEQ ID NO: 853757 - DNA, 13 bp, Homo sapiens
ttcggtttctgag

SEQ ID NO: 853758 - DNA, 20 bp, Homo sapiens
ttcgtacataataagtttca

SEQ ID NO: 853759 - DNA, 19 bp, Homo sapiens
ttcgtaccgcttccttaga

SEQ ID NO: 853760 - DNA, 16 bp, Homo sapiens
ttcgtaccttcccact

SEQ ID NO: 853761 - DNA, 19 bp, Homo sapiens
ttcgtagctttcccaaata

SEQ ID NO: 853762 - DNA, 18 bp, Homo sapiens
ttcgtcctgatccctcca

SEQ ID NO: 853763 - DNA, 18 bp, Homo sapiens
ttcgtgaacatagagttt

SEQ ID NO: 853764 - DNA, 20 bp, Homo sapiens
ttcgtgaacatagagtttgg

SEQ ID NO: 853765 - DNA, 17 bp, Homo sapiens
ttcgtgaagtatactgt

SEQ ID NO: 853766 - DNA, 18 bp, Homo sapiens
ttcgtgaagtatactgta

SEQ ID NO: 853767 - DNA, 16 bp, Homo sapiens
ttcgtgcactctgcta

SEQ ID NO: 853768 - DNA, 11 bp, Homo sapiens
ttcgtgctgga

SEQ ID NO: 853769 - DNA, 17 bp, Homo sapiens
ttcgtggtgatcaatta

SEQ ID NO: 853770 - DNA, 22 bp, Homo sapiens
ttcgtggtgatcaattaaatgt

SEQ ID NO: 853771 - DNA, 23 bp, Homo sapiens
ttcgtgtagtggaagagcagcct

SEQ ID NO: 853772 - DNA, 14 bp, Homo sapiens
ttcgtgtggctcct

SEQ ID NO: 853773 - DNA, 15 bp, Homo sapiens
ttcgtgttatgaatc

SEQ ID NO: 853774 - DNA, 14 bp, Homo sapiens
ttcgttctttttaa

SEQ ID NO: 853775 - DNA, 14 bp, Homo sapiens
ttcgtttccatcat

SEQ ID NO: 853776 - DNA, 20 bp, Homo sapiens
ttcgtttccatcatgtctgt

SEQ ID NO: 853777 - DNA, 16 bp, Homo sapiens
ttcgtttctgtataca

SEQ ID NO: 853778 - DNA, 15 bp, Homo sapiens
ttctaaaaagtcaga

SEQ ID NO: 853779 - DNA, 18 bp, Homo sapiens
ttctaaaacattcccctc

SEQ ID NO: 853780 - DNA, 17 bp, Homo sapiens
ttctaaaactgcctttc

SEQ ID NO: 853781 - DNA, 14 bp, Homo sapiens
ttctaaaatgcctt

SEQ ID NO: 853782 - DNA, 16 bp, Homo sapiens
ttctaaaggctacctt

SEQ ID NO: 853783 - DNA, 17 bp, Homo sapiens
ttctaaaggctaccttt

SEQ ID NO: 853784 - DNA, 22 bp, Homo sapiens
ttctaaaggtaccaaacaagga

SEQ ID NO: 853785 - DNA, 22 bp, Homo sapiens
ttctaaaggtgttgtcccttct

SEQ ID NO: 853786 - DNA, 15 bp, Homo sapiens
ttctaaagtaaaatt

SEQ ID NO: 853787 - DNA, 13 bp, Homo sapiens
ttctaaagtgttg

SEQ ID NO: 853788 - DNA, 21 bp, Homo sapiens
ttctaaataaggaatttcctc

SEQ ID NO: 853789 - DNA, 19 bp, Homo sapiens
ttctaaatccgacttgaat

SEQ ID NO: 853790 - DNA, 22 bp, Homo sapiens
ttctaaatccgacttgaatatt

SEQ ID NO: 853791 - DNA, 15 bp, Homo sapiens
ttctaaatgaatgtt

SEQ ID NO: 853792 - DNA, 18 bp, Homo sapiens
ttctaaatgaatgtttac

SEQ ID NO: 853793 - DNA, 17 bp, Homo sapiens
ttctaaattaatggtaa

SEQ ID NO: 853794 - DNA, 17 bp, Homo sapiens
ttctaaccaagaggctg

SEQ ID NO: 853795 - DNA, 18 bp, Homo sapiens
ttctaaccaagaggctgg

SEQ ID NO: 853796 - DNA, 18 bp, Homo sapiens
ttctaaccttgaatgctg

SEQ ID NO: 853797 - DNA, 21 bp, Homo sapiens
ttctaaccttgaatgctgcca

SEQ ID NO: 853798 - DNA, 22 bp, Homo sapiens
ttctctttgattatttgcatgt

SEQ ID NO: 853799 - DNA, 19 bp, Homo sapiens
ttctctttggaaatagcat

SEQ ID NO: 853800 - DNA, 20 bp, Homo sapiens
ttctctttggaaatagcatg

SEQ ID NO: 853801 - DNA, 20 bp, Homo sapiens
ttctctttgtttctgtttct

SEQ ID NO: 853802 - DNA, 16 bp, Homo sapiens
ttctcttttattctgt

SEQ ID NO: 853803 - DNA, 20 bp, Homo sapiens
ttctcttttcccctttcctg

SEQ ID NO: 853804 - DNA, 21 bp, Homo sapiens
ttctcttttcccctttcctgt

SEQ ID NO: 853805 - DNA, 19 bp, Homo sapiens
ttctgaaaacctaccagcc

SEQ ID NO: 853806 - DNA, 22 bp, Homo sapiens
ttctgaaaggaaatacacttct

SEQ ID NO: 853807 - DNA, 23 bp, Homo sapiens
ttctgaaaggagacattgctcta

SEQ ID NO: 853808 - DNA, 20 bp, Homo sapiens
ttctgaaatgtcagttctga

SEQ ID NO: 853809 - DNA, 17 bp, Homo sapiens
ttctgaactcaaactga

SEQ ID NO: 853810 - DNA, 22 bp, Homo sapiens
ttctgaactcaaactgaggaat

SEQ ID NO: 853811 - DNA, 18 bp, Homo sapiens
ttctgaagaaaaattact

SEQ ID NO: 853812 - DNA, 21 bp, Homo sapiens
ttctgaagatcaatttctccc

SEQ ID NO: 853813 - DNA, 22 bp, Homo sapiens
ttctgaagggcatacaatgaaa

SEQ ID NO: 853814 - DNA, 19 bp, Homo sapiens
ttctgaaggtagcattctt

SEQ ID NO: 853815 - DNA, 11 bp, Homo sapiens
ttctgaataaa

SEQ ID NO: 853816 - DNA, 17 bp, Homo sapiens
ttctgaataaaaaagat

SEQ ID NO: 853817 - DNA, 21 bp, Homo sapiens
ttctgaataaaaaagattcta

SEQ ID NO: 853818 - DNA, 16 bp, Homo sapiens
ttctgaataacttgaa

SEQ ID NO: 853819 - DNA, 19 bp, Homo sapiens
ttctgaatacaaagtgatg

SEQ ID NO: 853820 - DNA, 14 bp, Homo sapiens
ttctgaatcactgt

SEQ ID NO: 853821 - DNA, 16 bp, Homo sapiens
ttctgaatgctgctac

SEQ ID NO: 853822 - DNA, 21 bp, Homo sapiens
ttctgaatgggcaattccaga

SEQ ID NO: 853823 - DNA, 13 bp, Homo sapiens
ttctgaattaaaa

SEQ ID NO: 853824 - DNA, 21 bp, Homo sapiens
ttctgacagtttttctgtttt

SEQ ID NO: 853825 - DNA, 15 bp, Homo sapiens
ttctgacataaaatt

SEQ ID NO: 853826 - DNA, 18 bp, Homo sapiens
ttctgacatgtaagaaaa

SEQ ID NO: 853827 - DNA, 14 bp, Homo sapiens
ttctgacattaaca

SEQ ID NO: 853828 - DNA, 20 bp, Homo sapiens
ttctgaccacagcatcattt

SEQ ID NO: 853829 - DNA, 15 bp, Homo sapiens
ttctgacccaaagca

SEQ ID NO: 853830 - DNA, 18 bp, Homo sapiens
ttctgacccaaagcaaaa

SEQ ID NO: 853831 - DNA, 21 bp, Homo sapiens
ttctgacccaaagcaaaacat

SEQ ID NO: 853832 - DNA, 20 bp, Homo sapiens
ttctgacgtgccttttgcac

SEQ ID NO: 853833 - DNA, 11 bp, Homo sapiens
ttctgactgtc

SEQ ID NO: 853834 - DNA, 12 bp, Homo sapiens
ttctgactgtcc

SEQ ID NO: 853835 - DNA, 13 bp, Homo sapiens
ttctgactgtcca

SEQ ID NO: 853836 - DNA, 12 bp, Homo sapiens
ttctgacttgac

SEQ ID NO: 853837 - DNA, 19 bp, Homo sapiens
ttctgactttacttgtggt

SEQ ID NO: 853838 - DNA, 13 bp, Homo sapiens
ttctgagaccaaa

SEQ ID NO: 853839 - DNA, 23 bp, Homo sapiens
ttctgagagttggctcaggcaga

SEQ ID NO: 853840 - DNA, 16 bp, Homo sapiens
ttctgagatctgttga

SEQ ID NO: 853841 - DNA, 19 bp, Homo sapiens
ttctgagattcaatattga

SEQ ID NO: 853842 - DNA, 21 bp, Homo sapiens
ttctgagcaccgaatattgag

SEQ ID NO: 853843 - DNA, 19 bp, Homo sapiens
ttctgagcccgggctgcct

SEQ ID NO: 853844 - DNA, 22 bp, Homo sapiens
ttctgagcccggtaagagcaaa

SEQ ID NO: 853845 - DNA, 20 bp, Homo sapiens
ttctgagcttttcatggaag

SEQ ID NO: 853846 - DNA, 17 bp, Homo sapiens
ttctgagtaattaataa

SEQ ID NO: 853847 - DNA, 19 bp, Homo sapiens
ttctgagtttcattctcct

SEQ ID NO: 853848 - DNA, 20 bp, Homo sapiens
ttctgagtttcattctcctg

SEQ ID NO: 853849 - DNA, 14 bp, Homo sapiens
ttctgagttttgtg

SEQ ID NO: 853850 - DNA, 15 bp, Homo sapiens
ttctgagttttgtgt

SEQ ID NO: 853851 - DNA, 19 bp, Homo sapiens
ttctgagttttgtgtttgt

SEQ ID NO: 853852 - DNA, 18 bp, Homo sapiens
ttctgataaaagatggcc

SEQ ID NO: 853853 - DNA, 14 bp, Homo sapiens
ttctgatcctcagc

SEQ ID NO: 853854 - DNA, 20 bp, Homo sapiens
ttctgatcgtctcggcccct

SEQ ID NO: 853855 - DNA, 21 bp, Homo sapiens
ttctgatcgtctcggcccctc

SEQ ID NO: 853856 - DNA, 14 bp, Homo sapiens
ttctgatctgtact

SEQ ID NO: 853857 - DNA, 14 bp, Homo sapiens
ttctgatgagcaac

SEQ ID NO: 853858 - DNA, 14 bp, Homo sapiens
ttctgatggccaaa

SEQ ID NO: 853859 - DNA, 19 bp, Homo sapiens
ttctgatggccaaaatacc

SEQ ID NO: 853860 - DNA, 23 bp, Homo sapiens
ttctgatgtattacatgactgtt

SEQ ID NO: 853861 - DNA, 17 bp, Homo sapiens
ttctgatgttactgaga

SEQ ID NO: 853862 - DNA, 14 bp, Homo sapiens
ttctgattagaaat

SEQ ID NO: 853863 - DNA, 22 bp, Homo sapiens
ttctgattgattttttttcttg

SEQ ID NO: 853864 - DNA, 14 bp, Homo sapiens
ttctgatttcagtt

SEQ ID NO: 853865 - DNA, 17 bp, Homo sapiens
ttctgcaactagccaag

SEQ ID NO: 853866 - DNA, 19 bp, Homo sapiens
ttctgcaagaattaaaact

SEQ ID NO: 853867 - DNA, 16 bp, Homo sapiens
ttctgcaccctccacc

SEQ ID NO: 853868 - DNA, 17 bp, Homo sapiens
ttctgcaccctccaccc

SEQ ID NO: 853869 - DNA, 23 bp, Homo sapiens
ttctgcaccctccaccctgtccc

SEQ ID NO: 853870 - DNA, 22 bp, Homo sapiens
ttctgcagaaatttgcaactca

SEQ ID NO: 853871 - DNA, 21 bp, Homo sapiens
ttctgcagcatgacctgtgac

SEQ ID NO: 853872 - DNA, 20 bp, Homo sapiens
ttctgcagcccttgggcagt

SEQ ID NO: 853873 - DNA, 16 bp, Homo sapiens
ttctgcagcctcggcc

SEQ ID NO: 853874 - DNA, 15 bp, Homo sapiens
ttctgcagtaaatct

SEQ ID NO: 853875 - DNA, 17 bp, Homo sapiens
ttctgcattttgctatt

SEQ ID NO: 853876 - DNA, 21 bp, Homo sapiens
ttctgcattttgctattgtaa

SEQ ID NO: 853877 - DNA, 15 bp, Homo sapiens
ttctgccacataaaa

SEQ ID NO: 853878 - DNA, 17 bp, Homo sapiens
ttctgccacccctaaac

SEQ ID NO: 853879 - DNA, 23 bp, Homo sapiens
ttctgccaggcaacttttaaagc

SEQ ID NO: 853880 - DNA, 16 bp, Homo sapiens
ttctgccagggagctt

SEQ ID NO: 853881 - DNA, 21 bp, Homo sapiens
ttctgccatctagccagcccc

SEQ ID NO: 853882 - DNA, 16 bp, Homo sapiens
ttctgcccaaattatg

SEQ ID NO: 853883 - DNA, 19 bp, Homo sapiens
ttctgcccacattggaccc

SEQ ID NO: 853884 - DNA, 14 bp, Homo sapiens
ttctgcccccagcc

SEQ ID NO: 853885 - DNA, 16 bp, Homo sapiens
ttctgcccccagccca

SEQ ID NO: 853886 - DNA, 11 bp, Homo sapiens
ttctgccctgc

SEQ ID NO: 853887 - DNA, 22 bp, Homo sapiens
ttctgccctgccctcagcctgt

SEQ ID NO: 853888 - DNA, 16 bp, Homo sapiens
ttctgccctgcctgag

SEQ ID NO: 853889 - DNA, 18 bp, Homo sapiens
ttctgccctgcctgagga

SEQ ID NO: 853890 - DNA, 22 bp, Homo sapiens
ttctgccctgcctgaggaggag

SEQ ID NO: 853891 - DNA, 13 bp, Homo sapiens
ttctgccctggct

SEQ ID NO: 853892 - DNA, 22 bp, Homo sapiens
ttctgccgccccctcctgaacc

SEQ ID NO: 853893 - DNA, 15 bp, Homo sapiens
ttctgcctaacttgt

SEQ ID NO: 853894 - DNA, 16 bp, Homo sapiens
ttctgcctagagtgta

SEQ ID NO: 853895 - DNA, 20 bp, Homo sapiens
ttctgcctgcctcctccctc

SEQ ID NO: 853896 - DNA, 17 bp, Homo sapiens
ttctgcctgctccatcg

SEQ ID NO: 853897 - DNA, 14 bp, Homo sapiens
ttctgccttctcat

SEQ ID NO: 853898 - DNA, 13 bp, Homo sapiens
ttctgcctttaat

SEQ ID NO: 853899 - DNA, 21 bp, Homo sapiens
ttctgcctttaattttcttgt

SEQ ID NO: 853900 - DNA, 20 bp, Homo sapiens
ttctgcctttagcctggacc

SEQ ID NO: 853901 - DNA, 22 bp, Homo sapiens
ttctgcctttcccccctcacac

SEQ ID NO: 853902 - DNA, 16 bp, Homo sapiens
ttctgcctttgatgtt

SEQ ID NO: 853903 - DNA, 22 bp, Homo sapiens
ttctgcctttggggacttttct

SEQ ID NO: 853904 - DNA, 12 bp, Homo sapiens
ttctgccttttc

SEQ ID NO: 853905 - DNA, 16 bp, Homo sapiens
ttctgccttttcactg

SEQ ID NO: 853906 - DNA, 21 bp, Homo sapiens
ttctgcgtgatggctatgcct

SEQ ID NO: 853907 - DNA, 15 bp, Homo sapiens
ttctgctacctcact

SEQ ID NO: 853908 - DNA, 19 bp, Homo sapiens
ttctgctactggcaaaagg

SEQ ID NO: 853909 - DNA, 15 bp, Homo sapiens
ttctgctcagctctg

SEQ ID NO: 853910 - DNA, 20 bp, Homo sapiens
ttctgctcagctctgggcca

SEQ ID NO: 853911 - DNA, 13 bp, Homo sapiens
ttctgctcatcat

SEQ ID NO: 853912 - DNA, 20 bp, Homo sapiens
ttctgctcatcattctctgt

SEQ ID NO: 853913 - DNA, 13 bp, Homo sapiens
ttctgctccaccc

SEQ ID NO: 853914 - DNA, 15 bp, Homo sapiens
ttctgctccaccctt

SEQ ID NO: 853915 - DNA, 16 bp, Homo sapiens
ttctgctccacccttg

SEQ ID NO: 853916 - DNA, 18 bp, Homo sapiens
ttctgctcccaccccaga

SEQ ID NO: 853917 - DNA, 14 bp, Homo sapiens
ttctgctcctctcc

SEQ ID NO: 853918 - DNA, 18 bp, Homo sapiens
ttctgctcctctccaggc

SEQ ID NO: 853919 - DNA, 13 bp, Homo sapiens
ttctttgtttcct

SEQ ID NO: 853920 - DNA, 12 bp, Homo sapiens
ttctttgtttct

SEQ ID NO: 853921 - DNA, 14 bp, Homo sapiens
ttctttgtttcttt

SEQ ID NO: 853922 - DNA, 20 bp, Homo sapiens
ttcttttaaatatttgtgac

SEQ ID NO: 853923 - DNA, 19 bp, Homo sapiens
ttcttttaacttctttcta

SEQ ID NO: 853924 - DNA, 20 bp, Homo sapiens
ttcttttaacttctttctat

SEQ ID NO: 853925 - DNA, 21 bp, Homo sapiens
ttcttttaacttctttctatt

SEQ ID NO: 853926 - DNA, 17 bp, Homo sapiens
ttcttttaagaatcaat

SEQ ID NO: 853927 - DNA, 22 bp, Homo sapiens
ttcttttaagcatttgtatatt

SEQ ID NO: 853928 - DNA, 13 bp, Homo sapiens
ttcttttaagtat

SEQ ID NO: 853929 - DNA, 14 bp, Homo sapiens
ttcttttacagact

SEQ ID NO: 853930 - DNA, 13 bp, Homo sapiens
ttcttttactctg

SEQ ID NO: 853931 - DNA, 17 bp, Homo sapiens
ttcttttattatcagtt

SEQ ID NO: 853932 - DNA, 21 bp, Homo sapiens
ttcttttcacattaggctgtt

SEQ ID NO: 853933 - DNA, 11 bp, Homo sapiens
ttcttttcctt

SEQ ID NO: 853934 - DNA, 22 bp, Homo sapiens
ttcttttctcatgtgtttgcat

SEQ ID NO: 853935 - DNA, 12 bp, Homo sapiens
ttcttttctcct

SEQ ID NO: 853936 - DNA, 21 bp, Homo sapiens
ttcttttctggaatgtaatca

SEQ ID NO: 853937 - DNA, 15 bp, Homo sapiens
ttcttttctggccaa

SEQ ID NO: 853938 - DNA, 12 bp, Homo sapiens
ttcttttgcatt

SEQ ID NO: 853939 - DNA, 13 bp, Homo sapiens
ttcttttgcattt

SEQ ID NO: 853940 - DNA, 20 bp, Homo sapiens
ttcttttgccgttattaaaa

SEQ ID NO: 853941 - DNA, 14 bp, Homo sapiens
ttcttttggcttcc

SEQ ID NO: 853942 - DNA, 22 bp, Homo sapiens
ttcttttggtaaagactggctt

SEQ ID NO: 853943 - DNA, 23 bp, Homo sapiens
ttcttttggtaaagactggcttt

SEQ ID NO: 853944 - DNA, 12 bp, Homo sapiens
ttcttttgtaaa

SEQ ID NO: 853945 - DNA, 16 bp, Homo sapiens
ttcttttgtgtcctgc

SEQ ID NO: 853946 - DNA, 12 bp, Homo sapiens
ttctttttaaag

SEQ ID NO: 853947 - DNA, 19 bp, Homo sapiens
ttctttttaaagtttgttc

SEQ ID NO: 853948 - DNA, 13 bp, Homo sapiens
ttctttttacagc

SEQ ID NO: 853949 - DNA, 15 bp, Homo sapiens
ttctttttacagcat

SEQ ID NO: 853950 - DNA, 16 bp, Homo sapiens
ttctttttattttctt

SEQ ID NO: 853951 - DNA, 13 bp, Homo sapiens
ttctttttctgga

SEQ ID NO: 853952 - DNA, 14 bp, Homo sapiens
ttctttttctggaa

SEQ ID NO: 853953 - DNA, 15 bp, Homo sapiens
ttctttttctttctt

SEQ ID NO: 853954 - DNA, 19 bp, Homo sapiens
ttcttttttaaagtaaact

SEQ ID NO: 853955 - DNA, 20 bp, Homo sapiens
ttcttttttatcttgcactt

SEQ ID NO: 853956 - DNA, 14 bp, Homo sapiens
ttcttttttatgtg

SEQ ID NO: 853957 - DNA, 17 bp, Homo sapiens
ttcttttttcagttatt

SEQ ID NO: 853958 - DNA, 21 bp, Homo sapiens
ttctttttttttaagttctta

SEQ ID NO: 853959 - DNA, 21 bp, Homo sapiens
ttcttttttttttttttgaga

SEQ ID NO: 853960 - DNA, 21 bp, Homo sapiens
ttgaaaaatattgctaaaagt

SEQ ID NO: 853961 - DNA, 18 bp, Homo sapiens
ttgaaaactgtgcaactt

SEQ ID NO: 853962 - DNA, 16 bp, Homo sapiens
ttgaaaacttcaaagc

SEQ ID NO: 853963 - DNA, 16 bp, Homo sapiens
ttgaaaacttcagaag

SEQ ID NO: 853964 - DNA, 22 bp, Homo sapiens
ttgaaaataacctaattaatat

SEQ ID NO: 853965 - DNA, 21 bp, Homo sapiens
ttgaaaataagaatagaaata

SEQ ID NO: 853966 - DNA, 13 bp, Homo sapiens
ttgaaaatgcatt

SEQ ID NO: 853967 - DNA, 13 bp, Homo sapiens
ttgaaaatgctct

SEQ ID NO: 853968 - DNA, 16 bp, Homo sapiens
ttgaaaatgtccagga

SEQ ID NO: 853969 - DNA, 15 bp, Homo sapiens
ttgaaaatgtgtttg

SEQ ID NO: 853970 - DNA, 17 bp, Homo sapiens
ttgaaaattacatgttt

SEQ ID NO: 853971 - DNA, 16 bp, Homo sapiens
ttgaaaattatgcaaa

SEQ ID NO: 853972 - DNA, 15 bp, Homo sapiens
ttgaaaattatttta

SEQ ID NO: 853973 - DNA, 20 bp, Homo sapiens
ttgaaaattattttaaacaa

SEQ ID NO: 853974 - DNA, 22 bp, Homo sapiens
ttgaaaattattttaaacaaaa

SEQ ID NO: 853975 - DNA, 16 bp, Homo sapiens
ttgaaacaaagaaggt

SEQ ID NO: 853976 - DNA, 13 bp, Homo sapiens
ttgaaacctcagg

SEQ ID NO: 853977 - DNA, 14 bp, Homo sapiens
ttgaaacctcaggg

SEQ ID NO: 853978 - DNA, 14 bp, Homo sapiens
ttgaaactctctgt

SEQ ID NO: 853979 - DNA, 18 bp, Homo sapiens
ttgaaactgcatttgtgc

SEQ ID NO: 853980 - DNA, 14 bp, Homo sapiens
ttgaaactgctata

SEQ ID NO: 853981 - DNA, 12 bp, Homo sapiens
ttgaaagaactt

SEQ ID NO: 853982 - DNA, 16 bp, Homo sapiens
ttgaaagaattatcct

SEQ ID NO: 853983 - DNA, 14 bp, Homo sapiens
ttgaaagagatggc

SEQ ID NO: 853984 - DNA, 19 bp, Homo sapiens
ttgaaagagttaagaatgt

SEQ ID NO: 853985 - DNA, 23 bp, Homo sapiens
ttgaaagccaacaactctgcctt

SEQ ID NO: 853986 - DNA, 19 bp, Homo sapiens
ttgaaaggcattctctgaa

SEQ ID NO: 853987 - DNA, 20 bp, Homo sapiens
ttgaaaggcattctctgaag

SEQ ID NO: 853988 - DNA, 12 bp, Homo sapiens
ttgaaagtagag

SEQ ID NO: 853989 - DNA, 15 bp, Homo sapiens
ttgaaagtagagcta

SEQ ID NO: 853990 - DNA, 17 bp, Homo sapiens
ttgaaagtattcagaaa

SEQ ID NO: 853991 - DNA, 11 bp, Homo sapiens
ttgaaagtgtt

SEQ ID NO: 853992 - DNA, 15 bp, Homo sapiens
ttgaaagttgctttt

SEQ ID NO: 853993 - DNA, 23 bp, Homo sapiens
ttgaaagttttccagtattgaaa

SEQ ID NO: 853994 - DNA, 17 bp, Homo sapiens
ttgaaatagaaaatgta

SEQ ID NO: 853995 - DNA, 23 bp, Homo sapiens
ttgaaatagctttactgtttctc

SEQ ID NO: 853996 - DNA, 14 bp, Homo sapiens
ttgaaatatgcata

SEQ ID NO: 853997 - DNA, 21 bp, Homo sapiens
ttgaaatatgcatactaattt

SEQ ID NO: 853998 - DNA, 20 bp, Homo sapiens
ttgaaatatgtagtattaaa

SEQ ID NO: 853999 - DNA, 14 bp, Homo sapiens
ttgaaatccaggaa

SEQ ID NO: 854000 - DNA, 21 bp, Homo sapiens
ttgaaatgacatgttccttta

SEQ ID NO: 854001 - DNA, 18 bp, Homo sapiens
ttgaaatgcattgctctg

SEQ ID NO: 854002 - DNA, 20 bp, Homo sapiens
ttgaaatgcattgctctgga

SEQ ID NO: 854003 - DNA, 11 bp, Homo sapiens
ttgaaatgtaa

SEQ ID NO: 854004 - DNA, 22 bp, Homo sapiens
ttgaaatgtgaacgtccttcct

SEQ ID NO: 854005 - DNA, 18 bp, Homo sapiens
ttgaaattaacctctcac

SEQ ID NO: 854006 - DNA, 20 bp, Homo sapiens
ttgaaattaagaaggcaaaa

SEQ ID NO: 854007 - DNA, 17 bp, Homo sapiens
ttgaaattactgtgtaa

SEQ ID NO: 854008 - DNA, 17 bp, Homo sapiens
ttgaaattgtagtgcaa

SEQ ID NO: 854009 - DNA, 12 bp, Homo sapiens
ttgaaattttaa

SEQ ID NO: 854010 - DNA, 21 bp, Homo sapiens
ttgaaatttttattaaattat

SEQ ID NO: 854011 - DNA, 20 bp, Homo sapiens
ttgaacaaaaatgtttccac

SEQ ID NO: 854012 - DNA, 15 bp, Homo sapiens
ttgaacacaaactgt

SEQ ID NO: 854013 - DNA, 20 bp, Homo sapiens
ttgaacacaaactgtaaata

SEQ ID NO: 854014 - DNA, 23 bp, Homo sapiens
ttgaacactagtctgtgtaactt

SEQ ID NO: 854015 - DNA, 13 bp, Homo sapiens
ttgaacactgggg

SEQ ID NO: 854016 - DNA, 15 bp, Homo sapiens
ttgaacagctgtgag

SEQ ID NO: 854017 - DNA, 19 bp, Homo sapiens
ttgaacatgtgccttttct

SEQ ID NO: 854018 - DNA, 23 bp, Homo sapiens
ttgaacatttgggttactatttc

SEQ ID NO: 854019 - DNA, 16 bp, Homo sapiens
ttgaaccaacatcttt

SEQ ID NO: 854020 - DNA, 15 bp, Homo sapiens
ttgaacccctgtgtc

SEQ ID NO: 854021 - DNA, 17 bp, Homo sapiens
ttgaacctgcttcctgg

SEQ ID NO: 854022 - DNA, 21 bp, Homo sapiens
ttgaacgcttaagtcatcatt

SEQ ID NO: 854023 - DNA, 22 bp, Homo sapiens
ttgaacgcttaagtcatcatta

SEQ ID NO: 854024 - DNA, 13 bp, Homo sapiens
ttgaactccaaga

SEQ ID NO: 854025 - DNA, 19 bp, Homo sapiens
ttgaactcttcaatctctt

SEQ ID NO: 854026 - DNA, 18 bp, Homo sapiens
ttgaactgaaacttttct

SEQ ID NO: 854027 - DNA, 12 bp, Homo sapiens
ttgaactgaggc

SEQ ID NO: 854028 - DNA, 16 bp, Homo sapiens
ttgaactgataaagat

SEQ ID NO: 854029 - DNA, 20 bp, Homo sapiens
ttgaactggcaattgtctat

SEQ ID NO: 854030 - DNA, 23 bp, Homo sapiens
ttgaactggcaattgtctattta

SEQ ID NO: 854031 - DNA, 15 bp, Homo sapiens
ttgaactttgacctc

SEQ ID NO: 854032 - DNA, 13 bp, Homo sapiens
ttgaacttttgta

SEQ ID NO: 854033 - DNA, 23 bp, Homo sapiens
ttgaacttttgtactgaattttt

SEQ ID NO: 854034 - DNA, 21 bp, Homo sapiens
ttgaagaaaatgactttattt

SEQ ID NO: 854035 - DNA, 19 bp, Homo sapiens
ttgaagaaaggaacctggg

SEQ ID NO: 854036 - DNA, 20 bp, Homo sapiens
ttgaagaaaggaacctggga

SEQ ID NO: 854037 - DNA, 14 bp, Homo sapiens
ttgaagaactgcac

SEQ ID NO: 854038 - DNA, 19 bp, Homo sapiens
ttgaagaagaaccagccca

SEQ ID NO: 854039 - DNA, 16 bp, Homo sapiens
ttgaagaatctgcccc

SEQ ID NO: 854040 - DNA, 19 bp, Homo sapiens
ttgaagaatgttaagactt

SEQ ID NO: 854041 - DNA, 15 bp, Homo sapiens
ttgatgattttgtaa

SEQ ID NO: 854042 - DNA, 17 bp, Homo sapiens
ttgatgattttgtaatt

SEQ ID NO: 854043 - DNA, 24 bp, Homo sapiens
ttgatgattttgtaattcttatga

SEQ ID NO: 854044 - DNA, 18 bp, Homo sapiens
ttgatgcacagagaagct

SEQ ID NO: 854045 - DNA, 21 bp, Homo sapiens
ttgatgcacagagaagctggg

SEQ ID NO: 854046 - DNA, 14 bp, Homo sapiens
ttgatgccaaaaaa

SEQ ID NO: 854047 - DNA, 14 bp, Homo sapiens
ttgatgccagaggg

SEQ ID NO: 854048 - DNA, 14 bp, Homo sapiens
ttgatgctgtattt

SEQ ID NO: 854049 - DNA, 14 bp, Homo sapiens
ttgatggagatatt

SEQ ID NO: 854050 - DNA, 16 bp, Homo sapiens
ttgatggagtgtgagc

SEQ ID NO: 854051 - DNA, 14 bp, Homo sapiens
ttgatgggaaaagc

SEQ ID NO: 854052 - DNA, 13 bp, Homo sapiens
ttgatggggagaa

SEQ ID NO: 854053 - DNA, 14 bp, Homo sapiens
ttgatggggagaaa

SEQ ID NO: 854054 - DNA, 16 bp, Homo sapiens
ttgatggggagaaagg

SEQ ID NO: 854055 - DNA, 17 bp, Homo sapiens
ttgatggggcctgggtt

SEQ ID NO: 854056 - DNA, 19 bp, Homo sapiens
ttgatggggtccagagagc

SEQ ID NO: 854057 - DNA, 12 bp, Homo sapiens
ttgatgtaagga

SEQ ID NO: 854058 - DNA, 20 bp, Homo sapiens
ttgatgtacagtctgtcatg

SEQ ID NO: 854059 - DNA, 15 bp, Homo sapiens
ttgatgtacatgtgt

SEQ ID NO: 854060 - DNA, 13 bp, Homo sapiens
ttgatgtcagcct

SEQ ID NO: 854061 - DNA, 16 bp, Homo sapiens
ttgatgtcagccttgc

SEQ ID NO: 854062 - DNA, 16 bp, Homo sapiens
ttgatgtccccaaagt

SEQ ID NO: 854063 - DNA, 23 bp, Homo sapiens
ttgatgtgaagataatttgcata

SEQ ID NO: 854064 - DNA, 14 bp, Homo sapiens
ttgatgttacagat

SEQ ID NO: 854065 - DNA, 12 bp, Homo sapiens
ttgatgtttaga

SEQ ID NO: 854066 - DNA, 16 bp, Homo sapiens
ttgatgtttgtggcct

SEQ ID NO: 854067 - DNA, 17 bp, Homo sapiens
ttgatgtttgtggcctc

SEQ ID NO: 854068 - DNA, 23 bp, Homo sapiens
ttgatgttttaaggatgcttgta

SEQ ID NO: 854069 - DNA, 18 bp, Homo sapiens
ttgatgttttacgtgcaa

SEQ ID NO: 854070 - DNA, 14 bp, Homo sapiens
ttgattaaaatctc

SEQ ID NO: 854071 - DNA, 14 bp, Homo sapiens
ttgattaaagatga

SEQ ID NO: 854072 - DNA, 16 bp, Homo sapiens
ttgattaaattcttgc

SEQ ID NO: 854073 - DNA, 21 bp, Homo sapiens
ttgattaaattcttgcaaagt

SEQ ID NO: 854074 - DNA, 14 bp, Homo sapiens
ttgattaatttgag

SEQ ID NO: 854075 - DNA, 18 bp, Homo sapiens
ttgattacaaataaacag

SEQ ID NO: 854076 - DNA, 15 bp, Homo sapiens
ttgattataaatgtt

SEQ ID NO: 854077 - DNA, 21 bp, Homo sapiens
ttgattcagctcattatgaaa

SEQ ID NO: 854078 - DNA, 14 bp, Homo sapiens
ttgattcaggaggt

SEQ ID NO: 854079 - DNA, 14 bp, Homo sapiens
ttgattcagtatct

SEQ ID NO: 854080 - DNA, 16 bp, Homo sapiens
ttgattcagtatctta

SEQ ID NO: 854081 - DNA, 19 bp, Homo sapiens
ttgattcatagtaacttct

SEQ ID NO: 854082 - DNA, 21 bp, Homo sapiens
ttgattccaatccaattatca

SEQ ID NO: 854083 - DNA, 13 bp, Homo sapiens
ttgattcctggct

SEQ ID NO: 854084 - DNA, 18 bp, Homo sapiens
ttgattcctggtttgact

SEQ ID NO: 854085 - DNA, 23 bp, Homo sapiens
ttgattcggtatccccccatctt

SEQ ID NO: 854086 - DNA, 18 bp, Homo sapiens
ttgattctcgactgcttt

SEQ ID NO: 854087 - DNA, 11 bp, Homo sapiens
ttgattctgat

SEQ ID NO: 854088 - DNA, 19 bp, Homo sapiens
ttgattgaagtattcaatc

SEQ ID NO: 854089 - DNA, 19 bp, Homo sapiens
ttgattgactgcccattca

SEQ ID NO: 854090 - DNA, 15 bp, Homo sapiens
ttgattgatgtacag

SEQ ID NO: 854091 - DNA, 16 bp, Homo sapiens
ttgattgatgtacaga

SEQ ID NO: 854092 - DNA, 16 bp, Homo sapiens
ttgattgctttgctgc

SEQ ID NO: 854093 - DNA, 20 bp, Homo sapiens
ttgattgctttgctgcacag

SEQ ID NO: 854094 - DNA, 21 bp, Homo sapiens
ttgattggtgattaggtggtg

SEQ ID NO: 854095 - DNA, 17 bp, Homo sapiens
ttgattgtcagctacta

SEQ ID NO: 854096 - DNA, 21 bp, Homo sapiens
ttgattgtcagctactaatga

SEQ ID NO: 854097 - DNA, 20 bp, Homo sapiens
ttgattgttataaaataaca

SEQ ID NO: 854098 - DNA, 21 bp, Homo sapiens
ttgattgttataaaataacat

SEQ ID NO: 854099 - DNA, 22 bp, Homo sapiens
ttgattgttttattttggaatt

SEQ ID NO: 854100 - DNA, 17 bp, Homo sapiens
ttgatttaaacacacag

SEQ ID NO: 854101 - DNA, 18 bp, Homo sapiens
ttgatttaaacacacaga

SEQ ID NO: 854102 - DNA, 15 bp, Homo sapiens
ttgatttataaataa

SEQ ID NO: 854103 - DNA, 19 bp, Homo sapiens
ttgatttatgcatggaaac

SEQ ID NO: 854104 - DNA, 15 bp, Homo sapiens
ttgatttccatctta

SEQ ID NO: 854105 - DNA, 17 bp, Homo sapiens
ttgatttctttccagag

SEQ ID NO: 854106 - DNA, 18 bp, Homo sapiens
ttgatttgaagaacatgt

SEQ ID NO: 854107 - DNA, 20 bp, Homo sapiens
ttgatttgatctttgtttaa

SEQ ID NO: 854108 - DNA, 13 bp, Homo sapiens
ttgatttgcatgg

SEQ ID NO: 854109 - DNA, 14 bp, Homo sapiens
ttgattttctgttg

SEQ ID NO: 854110 - DNA, 16 bp, Homo sapiens
ttgatttttgaagttg

SEQ ID NO: 854111 - DNA, 15 bp, Homo sapiens
ttgatttttgtctca

SEQ ID NO: 854112 - DNA, 20 bp, Homo sapiens
ttgatttttgtttttgtaat

SEQ ID NO: 854113 - DNA, 23 bp, Homo sapiens
ttgcaaaacggatgagttattat

SEQ ID NO: 854114 - DNA, 17 bp, Homo sapiens
ttgcaaaagactaattt

SEQ ID NO: 854115 - DNA, 15 bp, Homo sapiens
ttgcaaaatgagttg

SEQ ID NO: 854116 - DNA, 21 bp, Homo sapiens
ttgcaaaatttccagtacctt

SEQ ID NO: 854117 - DNA, 21 bp, Homo sapiens
ttgcaaacaattttaatgatg

SEQ ID NO: 854118 - DNA, 20 bp, Homo sapiens
ttgcaaacccaactaagcca

SEQ ID NO: 854119 - DNA, 14 bp, Homo sapiens
ttgcaaaccctttg

SEQ ID NO: 854120 - DNA, 16 bp, Homo sapiens
ttgcaaaccctttgta

SEQ ID NO: 854121 - DNA, 17 bp, Homo sapiens
ttgcaaaccctttgtat

SEQ ID NO: 854122 - DNA, 19 bp, Homo sapiens
ttgcaaaccctttgtatta

SEQ ID NO: 854123 - DNA, 15 bp, Homo sapiens
ttgcaaagcaatgaa

SEQ ID NO: 854124 - DNA, 22 bp, Homo sapiens
ttgcaaaggagctcactgtggt

SEQ ID NO: 854125 - DNA, 17 bp, Homo sapiens
ttgcaaagggaaacagg

SEQ ID NO: 854126 - DNA, 22 bp, Homo sapiens
ttgcaaataagtgtattttgaa

SEQ ID NO: 854127 - DNA, 13 bp, Homo sapiens
ttgcaacatatta

SEQ ID NO: 854128 - DNA, 14 bp, Homo sapiens
ttgcaaccaggcag

SEQ ID NO: 854129 - DNA, 14 bp, Homo sapiens
ttgcaaccgtctgt

SEQ ID NO: 854130 - DNA, 20 bp, Homo sapiens
ttgcaacctcaccttcctgt

SEQ ID NO: 854131 - DNA, 14 bp, Homo sapiens
ttgcaactaaggac

SEQ ID NO: 854132 - DNA, 12 bp, Homo sapiens
ttgcaacttcat

SEQ ID NO: 854133 - DNA, 14 bp, Homo sapiens
ttgcaagatgtgaa

SEQ ID NO: 854134 - DNA, 15 bp, Homo sapiens
ttgcaagatgtgaat

SEQ ID NO: 854135 - DNA, 16 bp, Homo sapiens
ttgcaagatgtgaatt

SEQ ID NO: 854136 - DNA, 21 bp, Homo sapiens
ttgcaagatgtgaattattga

SEQ ID NO: 854137 - DNA, 23 bp, Homo sapiens
ttgcaagatgtgaattattgaca

SEQ ID NO: 854138 - DNA, 13 bp, Homo sapiens
ttgcaagccataa

SEQ ID NO: 854139 - DNA, 14 bp, Homo sapiens
ttgcaaggccgctg

SEQ ID NO: 854140 - DNA, 21 bp, Homo sapiens
ttgcaagtatgttttagcatg

SEQ ID NO: 854141 - DNA, 22 bp, Homo sapiens
ttgcaagtatgttttagcatgt

SEQ ID NO: 854142 - DNA, 18 bp, Homo sapiens
ttgcaagttatattagtg

SEQ ID NO: 854143 - DNA, 14 bp, Homo sapiens
ttgcaataacagct

SEQ ID NO: 854144 - DNA, 16 bp, Homo sapiens
ttgcaataacagctgc

SEQ ID NO: 854145 - DNA, 18 bp, Homo sapiens
ttgcaataacagctgcaa

SEQ ID NO: 854146 - DNA, 15 bp, Homo sapiens
ttgcaataacttcta

SEQ ID NO: 854147 - DNA, 16 bp, Homo sapiens
ttgcaatctaatctga

SEQ ID NO: 854148 - DNA, 18 bp, Homo sapiens
ttgcaatctaatctgaac

SEQ ID NO: 854149 - DNA, 21 bp, Homo sapiens
ttgcaatctaatctgaactga

SEQ ID NO: 854150 - DNA, 22 bp, Homo sapiens
ttgcaatgtcacaacctctctg

SEQ ID NO: 854151 - DNA, 13 bp, Homo sapiens
ttgcaattcatgt

SEQ ID NO: 854152 - DNA, 12 bp, Homo sapiens
ttgcacaatatt

SEQ ID NO: 854153 - DNA, 16 bp, Homo sapiens
ttgcacaatatttctt

SEQ ID NO: 854154 - DNA, 18 bp, Homo sapiens
ttgcacacactcagtgca

SEQ ID NO: 854155 - DNA, 18 bp, Homo sapiens
ttgcacacccactgcccc

SEQ ID NO: 854156 - DNA, 20 bp, Homo sapiens
ttgcacagagcacacttatt

SEQ ID NO: 854157 - DNA, 21 bp, Homo sapiens
ttgcacagccaacgagacaca

SEQ ID NO: 854158 - DNA, 18 bp, Homo sapiens
ttgcacaggatgctggcc

SEQ ID NO: 854159 - DNA, 22 bp, Homo sapiens
ttgcacagtgatatatttctat

SEQ ID NO: 854160 - DNA, 13 bp, Homo sapiens
ttgcacagtgtgt

SEQ ID NO: 854161 - DNA, 15 bp, Homo sapiens
ttgcacatcttggct

SEQ ID NO: 854162 - DNA, 13 bp, Homo sapiens
ttgcacatgtgac

SEQ ID NO: 854163 - DNA, 14 bp, Homo sapiens
ttgcctttcttctg

SEQ ID NO: 854164 - DNA, 18 bp, Homo sapiens
ttgcctttcttctgccct

SEQ ID NO: 854165 - DNA, 19 bp, Homo sapiens
ttgccttttgcaaccagga

SEQ ID NO: 854166 - DNA, 22 bp, Homo sapiens
ttgccttttttctatatcaaaa

SEQ ID NO: 854167 - DNA, 20 bp, Homo sapiens
ttgcgaatccaagctccctg

SEQ ID NO: 854168 - DNA, 20 bp, Homo sapiens
ttgcgacggagagaaaaaag

SEQ ID NO: 854169 - DNA, 15 bp, Homo sapiens
ttgcgacttgtcaca

SEQ ID NO: 854170 - DNA, 14 bp, Homo sapiens
ttgcgagtccaagg

SEQ ID NO: 854171 - DNA, 15 bp, Homo sapiens
ttgcgcagccctacc

SEQ ID NO: 854172 - DNA, 20 bp, Homo sapiens
ttgcgcctttgtattataaa

SEQ ID NO: 854173 - DNA, 22 bp, Homo sapiens
ttgcgctctcaagaccagagac

SEQ ID NO: 854174 - DNA, 16 bp, Homo sapiens
ttgcgctgtcccaggc

SEQ ID NO: 854175 - DNA, 12 bp, Homo sapiens
ttgcggaagcca

SEQ ID NO: 854176 - DNA, 21 bp, Homo sapiens
ttgcggaagccatagggggct

SEQ ID NO: 854177 - DNA, 16 bp, Homo sapiens
ttgcgtacttgtaata

SEQ ID NO: 854178 - DNA, 14 bp, Homo sapiens
ttgcgtatgtctgt

SEQ ID NO: 854179 - DNA, 20 bp, Homo sapiens
ttgcgtatgtctgttaccat

SEQ ID NO: 854180 - DNA, 16 bp, Homo sapiens
ttgcgtctgaggcctg

SEQ ID NO: 854181 - DNA, 17 bp, Homo sapiens
ttgcgtggatcaagctt

SEQ ID NO: 854182 - DNA, 12 bp, Homo sapiens
ttgctaaaagaa

SEQ ID NO: 854183 - DNA, 14 bp, Homo sapiens
ttgctaaaagaaga

SEQ ID NO: 854184 - DNA, 13 bp, Homo sapiens
ttgctaaactgat

SEQ ID NO: 854185 - DNA, 16 bp, Homo sapiens
ttgctaagaaatgtta

SEQ ID NO: 854186 - DNA, 13 bp, Homo sapiens
ttgctaatgttgc

SEQ ID NO: 854187 - DNA, 17 bp, Homo sapiens
ttgctaatttttattaa

SEQ ID NO: 854188 - DNA, 18 bp, Homo sapiens
ttgctacaaatttatgca

SEQ ID NO: 854189 - DNA, 22 bp, Homo sapiens
ttgctacaaatttatgcatttc

SEQ ID NO: 854190 - DNA, 23 bp, Homo sapiens
ttgctacaaatttatgcatttca

SEQ ID NO: 854191 - DNA, 13 bp, Homo sapiens
ttgctactgatgc

SEQ ID NO: 854192 - DNA, 19 bp, Homo sapiens
ttgctagaatgggaagggt

SEQ ID NO: 854193 - DNA, 23 bp, Homo sapiens
ttgctagcagtaaaagatgaagt

SEQ ID NO: 854194 - DNA, 13 bp, Homo sapiens
ttgctagctagcc

SEQ ID NO: 854195 - DNA, 17 bp, Homo sapiens
ttgctagctagccagcc

SEQ ID NO: 854196 - DNA, 19 bp, Homo sapiens
ttgctagctagccagccaa

SEQ ID NO: 854197 - DNA, 19 bp, Homo sapiens
ttgctaggcctcttgctga

SEQ ID NO: 854198 - DNA, 18 bp, Homo sapiens
ttgctagtctagtttcct

SEQ ID NO: 854199 - DNA, 20 bp, Homo sapiens
ttgctagtctagtttccttt

SEQ ID NO: 854200 - DNA, 15 bp, Homo sapiens
ttgctataatcatta

SEQ ID NO: 854201 - DNA, 17 bp, Homo sapiens
ttgctataatcattagt

SEQ ID NO: 854202 - DNA, 18 bp, Homo sapiens
ttgctataatcattagtt

SEQ ID NO: 854203 - DNA, 23 bp, Homo sapiens
ttgctatctggaggccttccagc

SEQ ID NO: 854204 - DNA, 23 bp, Homo sapiens
ttgctatggcaggataagaaagc

SEQ ID NO: 854205 - DNA, 14 bp, Homo sapiens
ttgctatgtaaggg

SEQ ID NO: 854206 - DNA, 17 bp, Homo sapiens
ttgctatgtaagggtct

SEQ ID NO: 854207 - DNA, 21 bp, Homo sapiens
ttgctatgtgccttatgttga

SEQ ID NO: 854208 - DNA, 12 bp, Homo sapiens
ttgctattgtaa

SEQ ID NO: 854209 - DNA, 15 bp, Homo sapiens
ttgctattttatttg

SEQ ID NO: 854210 - DNA, 18 bp, Homo sapiens
ttgctcaaaaaatgagct

SEQ ID NO: 854211 - DNA, 22 bp, Homo sapiens
ttgctcaagttcattgatgacc

SEQ ID NO: 854212 - DNA, 15 bp, Homo sapiens
ttgctcacagctgta

SEQ ID NO: 854213 - DNA, 17 bp, Homo sapiens
ttgctcactcactcact

SEQ ID NO: 854214 - DNA, 23 bp, Homo sapiens
ttgctcactcactcactccaaga

SEQ ID NO: 854215 - DNA, 20 bp, Homo sapiens
ttgctcagatagatctgtgt

SEQ ID NO: 854216 - DNA, 14 bp, Homo sapiens
ttgctcagtgcctc

SEQ ID NO: 854217 - DNA, 20 bp, Homo sapiens
ttgctcagtgcctcctggcc

SEQ ID NO: 854218 - DNA, 12 bp, Homo sapiens
ttgctccagata

SEQ ID NO: 854219 - DNA, 22 bp, Homo sapiens
ttgctccagataactctctttc

SEQ ID NO: 854220 - DNA, 17 bp, Homo sapiens
ttgctcccaacccattc

SEQ ID NO: 854221 - DNA, 17 bp, Homo sapiens
ttgctcccctgatagaa

SEQ ID NO: 854222 - DNA, 15 bp, Homo sapiens
ttgctccctctgtta

SEQ ID NO: 854223 - DNA, 15 bp, Homo sapiens
ttgctccgctcccac

SEQ ID NO: 854224 - DNA, 14 bp, Homo sapiens
ttgctcctagcaga

SEQ ID NO: 854225 - DNA, 21 bp, Homo sapiens
ttgctcctagcagacagaaac

SEQ ID NO: 854226 - DNA, 19 bp, Homo sapiens
ttgctcgcccagacaccat

SEQ ID NO: 854227 - DNA, 16 bp, Homo sapiens
ttgctctatgtctgcc

SEQ ID NO: 854228 - DNA, 16 bp, Homo sapiens
ttgctctcaattaaag

SEQ ID NO: 854229 - DNA, 13 bp, Homo sapiens
ttgctctcccggt

SEQ ID NO: 854230 - DNA, 21 bp, Homo sapiens
ttgctctcccggttcttccag

SEQ ID NO: 854231 - DNA, 13 bp, Homo sapiens
ttgctctccctct

SEQ ID NO: 854232 - DNA, 22 bp, Homo sapiens
ttgctctctctccctgccttta

SEQ ID NO: 854233 - DNA, 11 bp, Homo sapiens
ttgctctgagg

SEQ ID NO: 854234 - DNA, 24 bp, Homo sapiens
ttgctctggaggaagttctccagc

SEQ ID NO: 854235 - DNA, 20 bp, Homo sapiens
ttgctctgtcccccaggctg

SEQ ID NO: 854236 - DNA, 21 bp, Homo sapiens
ttgctctgtcccccaggctgg

SEQ ID NO: 854237 - DNA, 20 bp, Homo sapiens
ttgctctgtctcccaggctg

SEQ ID NO: 854238 - DNA, 12 bp, Homo sapiens
ttgctcttctcc

SEQ ID NO: 854239 - DNA, 16 bp, Homo sapiens
ttgctctttctactct

SEQ ID NO: 854240 - DNA, 13 bp, Homo sapiens
ttgctgaaagcca

SEQ ID NO: 854241 - DNA, 15 bp, Homo sapiens
ttgctgaactcagca

SEQ ID NO: 854242 - DNA, 19 bp, Homo sapiens
ttgctgaatacagaggcaa

SEQ ID NO: 854243 - DNA, 21 bp, Homo sapiens
ttgctgaatcccatcaggctg

SEQ ID NO: 854244 - DNA, 14 bp, Homo sapiens
ttgctgaatttcag

SEQ ID NO: 854245 - DNA, 23 bp, Homo sapiens
ttgctgacaaccattaaagtcag

SEQ ID NO: 854246 - DNA, 19 bp, Homo sapiens
ttgctgactactactctgc

SEQ ID NO: 854247 - DNA, 20 bp, Homo sapiens
ttgctgagcaccctctccgg

SEQ ID NO: 854248 - DNA, 14 bp, Homo sapiens
ttgctgagcctctg

SEQ ID NO: 854249 - DNA, 11 bp, Homo sapiens
ttgctgagggg

SEQ ID NO: 854250 - DNA, 15 bp, Homo sapiens
ttgctgagttgttct

SEQ ID NO: 854251 - DNA, 19 bp, Homo sapiens
ttgctgatgtttataaact

SEQ ID NO: 854252 - DNA, 20 bp, Homo sapiens
ttgctgatttctagtgtata

SEQ ID NO: 854253 - DNA, 15 bp, Homo sapiens
ttgctgcaaacctga

SEQ ID NO: 854254 - DNA, 19 bp, Homo sapiens
ttgctgcaaagagaaaccg

SEQ ID NO: 854255 - DNA, 16 bp, Homo sapiens
ttgctgcacagcagga

SEQ ID NO: 854256 - DNA, 20 bp, Homo sapiens
ttgctgcacagcaggacctg

SEQ ID NO: 854257 - DNA, 12 bp, Homo sapiens
ttgctgcagctt

SEQ ID NO: 854258 - DNA, 12 bp, Homo sapiens
ttgctgcaggcc

SEQ ID NO: 854259 - DNA, 22 bp, Homo sapiens
ttgctgcattcctttttcttca

SEQ ID NO: 854260 - DNA, 12 bp, Homo sapiens
ttgctgcatttt

SEQ ID NO: 854261 - DNA, 11 bp, Homo sapiens
ttgctgccaaa

SEQ ID NO: 854262 - DNA, 12 bp, Homo sapiens
ttgctgccaaaa

SEQ ID NO: 854263 - DNA, 14 bp, Homo sapiens
ttgctgccaaaacc

SEQ ID NO: 854264 - DNA, 16 bp, Homo sapiens
ttgctgccaaaaccac

SEQ ID NO: 854265 - DNA, 19 bp, Homo sapiens
ttgctgccaaaaccacatg

SEQ ID NO: 854266 - DNA, 18 bp, Homo sapiens
ttgctgccaaccatacct

SEQ ID NO: 854267 - DNA, 21 bp, Homo sapiens
ttgctgcccctgtctggaaga

SEQ ID NO: 854268 - DNA, 18 bp, Homo sapiens
ttgctgcccgcgggagac

SEQ ID NO: 854269 - DNA, 16 bp, Homo sapiens
ttgctgccctgcccca

SEQ ID NO: 854270 - DNA, 16 bp, Homo sapiens
ttgctgctatgaaaat

SEQ ID NO: 854271 - DNA, 15 bp, Homo sapiens
ttgctgcttgatgat

SEQ ID NO: 854272 - DNA, 15 bp, Homo sapiens
ttgctgcttggattt

SEQ ID NO: 854273 - DNA, 15 bp, Homo sapiens
ttgctgctttagtcc

SEQ ID NO: 854274 - DNA, 23 bp, Homo sapiens
ttgctggactgtcatagaaatta

SEQ ID NO: 854275 - DNA, 21 bp, Homo sapiens
ttgctggattaatgttttgta

SEQ ID NO: 854276 - DNA, 21 bp, Homo sapiens
ttgctgggagctgaaaaatca

SEQ ID NO: 854277 - DNA, 22 bp, Homo sapiens
ttgctgggagctgaaaaatcac

SEQ ID NO: 854278 - DNA, 22 bp, Homo sapiens
ttgctgggcatactttctctct

SEQ ID NO: 854279 - DNA, 12 bp, Homo sapiens
ttgctgggccag

SEQ ID NO: 854280 - DNA, 15 bp, Homo sapiens
ttgctgggccaggga

SEQ ID NO: 854281 - DNA, 16 bp, Homo sapiens
ttgctgggccagggaa

SEQ ID NO: 854282 - DNA, 12 bp, Homo sapiens
ttgctggggatt

SEQ ID NO: 854283 - DNA, 14 bp, Homo sapiens
ttgctggtcatcct

SEQ ID NO: 854284 - DNA, 14 bp, Homo sapiens
ttgctggtggtttt

SEQ ID NO: 854285 - DNA, 15 bp, Homo sapiens
ttgggctcaaagccc

SEQ ID NO: 854286 - DNA, 21 bp, Homo sapiens
ttgggctcctggctgccaggc

SEQ ID NO: 854287 - DNA, 16 bp, Homo sapiens
ttgggctgacccagca

SEQ ID NO: 854288 - DNA, 17 bp, Homo sapiens
ttgggctgacccagcat

SEQ ID NO: 854289 - DNA, 23 bp, Homo sapiens
ttgggctgagtgcagccaaaggg

SEQ ID NO: 854290 - DNA, 12 bp, Homo sapiens
ttgggctgtctt

SEQ ID NO: 854291 - DNA, 16 bp, Homo sapiens
ttggggaaaaagaatg

SEQ ID NO: 854292 - DNA, 18 bp, Homo sapiens
ttggggaagggcctgccc

SEQ ID NO: 854293 - DNA, 15 bp, Homo sapiens
ttggggaatttcctc

SEQ ID NO: 854294 - DNA, 19 bp, Homo sapiens
ttggggacatctctttgaa

SEQ ID NO: 854295 - DNA, 21 bp, Homo sapiens
ttggggagaaataaattttgt

SEQ ID NO: 854296 - DNA, 15 bp, Homo sapiens
ttggggagggagggg

SEQ ID NO: 854297 - DNA, 21 bp, Homo sapiens
ttggggagggaggggaaatgt

SEQ ID NO: 854298 - DNA, 20 bp, Homo sapiens
ttggggccctcttgccagcc

SEQ ID NO: 854299 - DNA, 21 bp, Homo sapiens
ttggggccctcttgccagcct

SEQ ID NO: 854300 - DNA, 13 bp, Homo sapiens
ttggggcctggct

SEQ ID NO: 854301 - DNA, 19 bp, Homo sapiens
ttggggctgtcgggggctg

SEQ ID NO: 854302 - DNA, 15 bp, Homo sapiens
ttggggcttcacagc

SEQ ID NO: 854303 - DNA, 13 bp, Homo sapiens
ttgggggaaaaaa

SEQ ID NO: 854304 - DNA, 20 bp, Homo sapiens
ttgggggaaaaaaaagaaaa

SEQ ID NO: 854305 - DNA, 11 bp, Homo sapiens
ttgggggaggc

SEQ ID NO: 854306 - DNA, 12 bp, Homo sapiens
ttgggggctggt

SEQ ID NO: 854307 - DNA, 20 bp, Homo sapiens
ttggggggagagacacagat

SEQ ID NO: 854308 - DNA, 16 bp, Homo sapiens
ttgggggtcagtgctg

SEQ ID NO: 854309 - DNA, 23 bp, Homo sapiens
ttggggtactcttgatgtgaaga

SEQ ID NO: 854310 - DNA, 16 bp, Homo sapiens
ttggggtctgccacca

SEQ ID NO: 854311 - DNA, 16 bp, Homo sapiens
ttggggtgagaggtga

SEQ ID NO: 854312 - DNA, 14 bp, Homo sapiens
ttggggtgggaggg

SEQ ID NO: 854313 - DNA, 15 bp, Homo sapiens
ttggggtgggagggc

SEQ ID NO: 854314 - DNA, 15 bp, Homo sapiens
ttggggtgggggcca

SEQ ID NO: 854315 - DNA, 20 bp, Homo sapiens
ttggggtgggggccaggcct

SEQ ID NO: 854316 - DNA, 18 bp, Homo sapiens
ttggggtgtggggtgggg

SEQ ID NO: 854317 - DNA, 16 bp, Homo sapiens
ttggggttaagtctcc

SEQ ID NO: 854318 - DNA, 23 bp, Homo sapiens
ttgggtagaaagagatacagagg

SEQ ID NO: 854319 - DNA, 17 bp, Homo sapiens
ttgggtatgtctacctg

SEQ ID NO: 854320 - DNA, 19 bp, Homo sapiens
ttgggtcacccctccagga

SEQ ID NO: 854321 - DNA, 19 bp, Homo sapiens
ttgggtcaggttcttgcct

SEQ ID NO: 854322 - DNA, 19 bp, Homo sapiens
ttgggtcctgggcaggtgg

SEQ ID NO: 854323 - DNA, 22 bp, Homo sapiens
ttgggtctacaagtatatgtga

SEQ ID NO: 854324 - DNA, 14 bp, Homo sapiens
ttgggtctcactct

SEQ ID NO: 854325 - DNA, 13 bp, Homo sapiens
ttgggtctgccct

SEQ ID NO: 854326 - DNA, 16 bp, Homo sapiens
ttgggtctgccctgcc

SEQ ID NO: 854327 - DNA, 13 bp, Homo sapiens
ttgggtgaaaggt

SEQ ID NO: 854328 - DNA, 18 bp, Homo sapiens
ttgggtgacacctccgag

SEQ ID NO: 854329 - DNA, 17 bp, Homo sapiens
ttgggtgcctcctgcag

SEQ ID NO: 854330 - DNA, 18 bp, Homo sapiens
ttgggtgcctcctgcagt

SEQ ID NO: 854331 - DNA, 21 bp, Homo sapiens
ttgggtgggattttttccctt

SEQ ID NO: 854332 - DNA, 19 bp, Homo sapiens
ttgggtgggggctgtggcc

SEQ ID NO: 854333 - DNA, 22 bp, Homo sapiens
ttgggtgggggctgtggccctg

SEQ ID NO: 854334 - DNA, 23 bp, Homo sapiens
ttgggtgtaacaggtctcctctt

SEQ ID NO: 854335 - DNA, 15 bp, Homo sapiens
ttgggtgtagatttc

SEQ ID NO: 854336 - DNA, 21 bp, Homo sapiens
ttgggttaaaagatggttgta

SEQ ID NO: 854337 - DNA, 16 bp, Homo sapiens
ttgggttcatctgagc

SEQ ID NO: 854338 - DNA, 19 bp, Homo sapiens
ttgggttctttctgggggg

SEQ ID NO: 854339 - DNA, 23 bp, Homo sapiens
ttgggttgatctcttagaagcca

SEQ ID NO: 854340 - DNA, 16 bp, Homo sapiens
ttgggtttggccaggg

SEQ ID NO: 854341 - DNA, 15 bp, Homo sapiens
ttgggtttggggcca

SEQ ID NO: 854342 - DNA, 16 bp, Homo sapiens
ttgggtttttgctgtt

SEQ ID NO: 854343 - DNA, 16 bp, Homo sapiens
ttgggttttttctgtt

SEQ ID NO: 854344 - DNA, 15 bp, Homo sapiens
ttgggtttttttcct

SEQ ID NO: 854345 - DNA, 18 bp, Homo sapiens
ttggtaaaactcactgtg

SEQ ID NO: 854346 - DNA, 20 bp, Homo sapiens
ttggtaaaactcactgtgat

SEQ ID NO: 854347 - DNA, 19 bp, Homo sapiens
ttggtaaagactggctttt

SEQ ID NO: 854348 - DNA, 21 bp, Homo sapiens
ttggtaaattctggtatacat

SEQ ID NO: 854349 - DNA, 12 bp, Homo sapiens
ttggtaaatttt

SEQ ID NO: 854350 - DNA, 20 bp, Homo sapiens
ttggtaagatgactctgaga

SEQ ID NO: 854351 - DNA, 19 bp, Homo sapiens
ttggtaaggcctctggact

SEQ ID NO: 854352 - DNA, 13 bp, Homo sapiens
ttggtaataacaa

SEQ ID NO: 854353 - DNA, 14 bp, Homo sapiens
ttggtaataacaaa

SEQ ID NO: 854354 - DNA, 14 bp, Homo sapiens
ttggtaattaaaag

SEQ ID NO: 854355 - DNA, 20 bp, Homo sapiens
ttggtacatggccagtgtga

SEQ ID NO: 854356 - DNA, 21 bp, Homo sapiens
ttggtacctttctagccttag

SEQ ID NO: 854357 - DNA, 23 bp, Homo sapiens
ttggtacctttctagccttagac

SEQ ID NO: 854358 - DNA, 22 bp, Homo sapiens
ttggtactactagatgtcttta

SEQ ID NO: 854359 - DNA, 21 bp, Homo sapiens
ttggtagacttggacatctct

SEQ ID NO: 854360 - DNA, 15 bp, Homo sapiens
ttggtagagattcat

SEQ ID NO: 854361 - DNA, 19 bp, Homo sapiens
ttggtagatgcatgacttg

SEQ ID NO: 854362 - DNA, 21 bp, Homo sapiens
ttggtagggtgagtgtttcca

SEQ ID NO: 854363 - DNA, 21 bp, Homo sapiens
ttggtataatgtttaaatcat

SEQ ID NO: 854364 - DNA, 13 bp, Homo sapiens
ttggtataggaat

SEQ ID NO: 854365 - DNA, 16 bp, Homo sapiens
ttggtataggaatgta

SEQ ID NO: 854366 - DNA, 18 bp, Homo sapiens
ttggtatgtgccaggctt

SEQ ID NO: 854367 - DNA, 18 bp, Homo sapiens
ttggtattaataaaaaga

SEQ ID NO: 854368 - DNA, 14 bp, Homo sapiens
ttggtcaaactttt

SEQ ID NO: 854369 - DNA, 23 bp, Homo sapiens
ttggtcactccagtagctcctgg

SEQ ID NO: 854370 - DNA, 15 bp, Homo sapiens
ttggtcagaggagtg

SEQ ID NO: 854371 - DNA, 18 bp, Homo sapiens
ttggtcaggctggtctca

SEQ ID NO: 854372 - DNA, 14 bp, Homo sapiens
ttggtccactgtgt

SEQ ID NO: 854373 - DNA, 17 bp, Homo sapiens
ttggtccactgtgttta

SEQ ID NO: 854374 - DNA, 22 bp, Homo sapiens
ttggtccagagcggaggctgtg

SEQ ID NO: 854375 - DNA, 23 bp, Homo sapiens
ttggtcccaagcctgatacttta

SEQ ID NO: 854376 - DNA, 19 bp, Homo sapiens
ttggtcccctccctcgtgg

SEQ ID NO: 854377 - DNA, 14 bp, Homo sapiens
ttggtcctctctct

SEQ ID NO: 854378 - DNA, 15 bp, Homo sapiens
ttggtcctctctctg

SEQ ID NO: 854379 - DNA, 18 bp, Homo sapiens
ttggtcgagtctttgtgt

SEQ ID NO: 854380 - DNA, 13 bp, Homo sapiens
ttggtctattttc

SEQ ID NO: 854381 - DNA, 17 bp, Homo sapiens
ttggtctcaggcagcac

SEQ ID NO: 854382 - DNA, 22 bp, Homo sapiens
ttggtctcccttctctacactc

SEQ ID NO: 854383 - DNA, 13 bp, Homo sapiens
ttggtctggactg

SEQ ID NO: 854384 - DNA, 15 bp, Homo sapiens
ttggtcttatttatt

SEQ ID NO: 854385 - DNA, 18 bp, Homo sapiens
ttggtcttgccccatcac

SEQ ID NO: 854386 - DNA, 22 bp, Homo sapiens
ttggtgaaataataaaatgcaa

SEQ ID NO: 854387 - DNA, 23 bp, Homo sapiens
ttggtgaaataataaaatgcaaa

SEQ ID NO: 854388 - DNA, 19 bp, Homo sapiens
ttggtgaaggatccaggaa

SEQ ID NO: 854389 - DNA, 13 bp, Homo sapiens
ttggtgaattcct

SEQ ID NO: 854390 - DNA, 21 bp, Homo sapiens
ttggtgaattttcaaggcctt

SEQ ID NO: 854391 - DNA, 15 bp, Homo sapiens
ttggtgactgggaaa

SEQ ID NO: 854392 - DNA, 18 bp, Homo sapiens
ttggtgactgggaaagtt

SEQ ID NO: 854393 - DNA, 21 bp, Homo sapiens
ttggtgagtcttggttctaaa

SEQ ID NO: 854394 - DNA, 16 bp, Homo sapiens
ttggtgcaacccttac

SEQ ID NO: 854395 - DNA, 21 bp, Homo sapiens
ttggtgcaacccttacccctt

SEQ ID NO: 854396 - DNA, 16 bp, Homo sapiens
ttggtgcacagcacaa

SEQ ID NO: 854397 - DNA, 22 bp, Homo sapiens
ttggtgcacagcacaaattagt

SEQ ID NO: 854398 - DNA, 20 bp, Homo sapiens
ttggtgcatgtctgttcttc

SEQ ID NO: 854399 - DNA, 21 bp, Homo sapiens
ttggtgccgatgttgaacttt

SEQ ID NO: 854400 - DNA, 17 bp, Homo sapiens
ttggtgccttttgtgtg

SEQ ID NO: 854401 - DNA, 20 bp, Homo sapiens
ttggtgcgggcacaataaat

SEQ ID NO: 854402 - DNA, 15 bp, Homo sapiens
ttggtgctatttgaa

SEQ ID NO: 854403 - DNA, 18 bp, Homo sapiens
ttggtggagcagccagag

SEQ ID NO: 854404 - DNA, 13 bp, Homo sapiens
ttggtggatgtga

SEQ ID NO: 854405 - DNA, 14 bp, Homo sapiens
ttggtggccacata

SEQ ID NO: 854406 - DNA, 21 bp, Homo sapiens
ttgtgagccctctagggcagg

SEQ ID NO: 854407 - DNA, 19 bp, Homo sapiens
ttgtgatagcactttctac

SEQ ID NO: 854408 - DNA, 17 bp, Homo sapiens
ttgtgatcagcattgtg

SEQ ID NO: 854409 - DNA, 20 bp, Homo sapiens
ttgtgatgaacatattcatg

SEQ ID NO: 854410 - DNA, 21 bp, Homo sapiens
ttgtgatgaatcaatgaaaaa

SEQ ID NO: 854411 - DNA, 16 bp, Homo sapiens
ttgtgatggagtgctg

SEQ ID NO: 854412 - DNA, 17 bp, Homo sapiens
ttgtgatggagtgctgt

SEQ ID NO: 854413 - DNA, 19 bp, Homo sapiens
ttgtgatgtaaggcactgt

SEQ ID NO: 854414 - DNA, 18 bp, Homo sapiens
ttgtgattagacagaaca

SEQ ID NO: 854415 - DNA, 17 bp, Homo sapiens
ttgtgattatttcactt

SEQ ID NO: 854416 - DNA, 23 bp, Homo sapiens
ttgtgattatttcactttagatg

SEQ ID NO: 854417 - DNA, 19 bp, Homo sapiens
ttgtgattcaatctgtaaa

SEQ ID NO: 854418 - DNA, 16 bp, Homo sapiens
ttgtgatttggttgca

SEQ ID NO: 854419 - DNA, 16 bp, Homo sapiens
ttgtgatttttataat

SEQ ID NO: 854420 - DNA, 21 bp, Homo sapiens
ttgtgcaaaagcttcaaatta

SEQ ID NO: 854421 - DNA, 16 bp, Homo sapiens
ttgtgcacatttattt

SEQ ID NO: 854422 - DNA, 19 bp, Homo sapiens
ttgtgcaccctctatccca

SEQ ID NO: 854423 - DNA, 11 bp, Homo sapiens
ttgtgcagaga

SEQ ID NO: 854424 - DNA, 20 bp, Homo sapiens
ttgtgcatatctgcctcccc

SEQ ID NO: 854425 - DNA, 21 bp, Homo sapiens
ttgtgcatatctgcctcccct

SEQ ID NO: 854426 - DNA, 14 bp, Homo sapiens
ttgtgcatatgtta

SEQ ID NO: 854427 - DNA, 14 bp, Homo sapiens
ttgtgcattctgga

SEQ ID NO: 854428 - DNA, 13 bp, Homo sapiens
ttgtgcattcttt

SEQ ID NO: 854429 - DNA, 13 bp, Homo sapiens
ttgtgcattgtgg

SEQ ID NO: 854430 - DNA, 17 bp, Homo sapiens
ttgtgccaagccttctg

SEQ ID NO: 854431 - DNA, 16 bp, Homo sapiens
ttgtgccaatatgtat

SEQ ID NO: 854432 - DNA, 19 bp, Homo sapiens
ttgtgccattatatttgca

SEQ ID NO: 854433 - DNA, 22 bp, Homo sapiens
ttgtgccctgcccccatctccc

SEQ ID NO: 854434 - DNA, 17 bp, Homo sapiens
ttgtgcctcccttccca

SEQ ID NO: 854435 - DNA, 22 bp, Homo sapiens
ttgtgcctgttgtgaagctaat

SEQ ID NO: 854436 - DNA, 16 bp, Homo sapiens
ttgtgctagaaatttt

SEQ ID NO: 854437 - DNA, 16 bp, Homo sapiens
ttgtgctcagagacac

SEQ ID NO: 854438 - DNA, 15 bp, Homo sapiens
ttgtgctcagcatga

SEQ ID NO: 854439 - DNA, 20 bp, Homo sapiens
ttgtgctcctcttgattcct

SEQ ID NO: 854440 - DNA, 11 bp, Homo sapiens
ttgtgctgcca

SEQ ID NO: 854441 - DNA, 21 bp, Homo sapiens
ttgtgctgtgggcagcaccct

SEQ ID NO: 854442 - DNA, 19 bp, Homo sapiens
ttgtgcttgtcattccaga

SEQ ID NO: 854443 - DNA, 15 bp, Homo sapiens
ttgtgctttgctctt

SEQ ID NO: 854444 - DNA, 16 bp, Homo sapiens
ttgtgcttttcctatt

SEQ ID NO: 854445 - DNA, 15 bp, Homo sapiens
ttgtgcttttcctga

SEQ ID NO: 854446 - DNA, 18 bp, Homo sapiens
ttgtggaaagataataaa

SEQ ID NO: 854447 - DNA, 18 bp, Homo sapiens
ttgtggaaagcctctgct

SEQ ID NO: 854448 - DNA, 22 bp, Homo sapiens
ttgtggaataaatccttcgtcc

SEQ ID NO: 854449 - DNA, 18 bp, Homo sapiens
ttgtggaatgttggataa

SEQ ID NO: 854450 - DNA, 14 bp, Homo sapiens
ttgtggactggctg

SEQ ID NO: 854451 - DNA, 18 bp, Homo sapiens
ttgtggatataaaatgtg

SEQ ID NO: 854452 - DNA, 14 bp, Homo sapiens
ttgtggatgtcttc

SEQ ID NO: 854453 - DNA, 20 bp, Homo sapiens
ttgtggattataaaaaatgt

SEQ ID NO: 854454 - DNA, 16 bp, Homo sapiens
ttgtggcaagtgaatt

SEQ ID NO: 854455 - DNA, 22 bp, Homo sapiens
ttgtggcaagtgaatttgcctg

SEQ ID NO: 854456 - DNA, 19 bp, Homo sapiens
ttgtggcacagatgcccac

SEQ ID NO: 854457 - DNA, 18 bp, Homo sapiens
ttgtggcataaattacag

SEQ ID NO: 854458 - DNA, 15 bp, Homo sapiens
ttgtgggagacagca

SEQ ID NO: 854459 - DNA, 13 bp, Homo sapiens
ttgtgggataatg

SEQ ID NO: 854460 - DNA, 18 bp, Homo sapiens
ttgtgggataatgggaga

SEQ ID NO: 854461 - DNA, 21 bp, Homo sapiens
ttgtgggcatgagctgctgtg

SEQ ID NO: 854462 - DNA, 11 bp, Homo sapiens
ttgtgggcgct

SEQ ID NO: 854463 - DNA, 23 bp, Homo sapiens
ttgtgggcttcctgctgggactg

SEQ ID NO: 854464 - DNA, 15 bp, Homo sapiens
ttgtggggtgcagct

SEQ ID NO: 854465 - DNA, 20 bp, Homo sapiens
ttgtggggtgcagctgggtg

SEQ ID NO: 854466 - DNA, 18 bp, Homo sapiens
ttgtggtctaaagtgttt

SEQ ID NO: 854467 - DNA, 20 bp, Homo sapiens
ttgtggtgtgaccatgttca

SEQ ID NO: 854468 - DNA, 22 bp, Homo sapiens
ttgtggtgtgaccatgttcatt

SEQ ID NO: 854469 - DNA, 17 bp, Homo sapiens
ttgtggttccatgcagc

SEQ ID NO: 854470 - DNA, 15 bp, Homo sapiens
ttgtggttctatttt

SEQ ID NO: 854471 - DNA, 14 bp, Homo sapiens
ttgtggtttggaat

SEQ ID NO: 854472 - DNA, 16 bp, Homo sapiens
ttgtgtaaaaaatgga

SEQ ID NO: 854473 - DNA, 18 bp, Homo sapiens
ttgtgtaaaaaatggaaa

SEQ ID NO: 854474 - DNA, 14 bp, Homo sapiens
ttgtgtaagaaata

SEQ ID NO: 854475 - DNA, 13 bp, Homo sapiens
ttgtgtagatttg

SEQ ID NO: 854476 - DNA, 16 bp, Homo sapiens
ttgtgtagatttgaaa

SEQ ID NO: 854477 - DNA, 22 bp, Homo sapiens
ttgtgtagtcttcaactggtta

SEQ ID NO: 854478 - DNA, 14 bp, Homo sapiens
ttgtgtatatatct

SEQ ID NO: 854479 - DNA, 21 bp, Homo sapiens
ttgtgtatatattataaaaat

SEQ ID NO: 854480 - DNA, 12 bp, Homo sapiens
ttgtgtatctgt

SEQ ID NO: 854481 - DNA, 10 bp, Homo sapiens
ttgtgtatgg

SEQ ID NO: 854482 - DNA, 11 bp, Homo sapiens
ttgtgtatgta

SEQ ID NO: 854483 - DNA, 11 bp, Homo sapiens
ttgtgtatgtt

SEQ ID NO: 854484 - DNA, 22 bp, Homo sapiens
ttgtgtattgagtcttaactgt

SEQ ID NO: 854485 - DNA, 15 bp, Homo sapiens
ttgtgtattgatgca

SEQ ID NO: 854486 - DNA, 14 bp, Homo sapiens
ttgtgtatttaaca

SEQ ID NO: 854487 - DNA, 21 bp, Homo sapiens
ttgtgtatttaacagggaggg

SEQ ID NO: 854488 - DNA, 20 bp, Homo sapiens
ttgtgtatttacgctttgat

SEQ ID NO: 854489 - DNA, 20 bp, Homo sapiens
ttgtgtcataaattacacaa

SEQ ID NO: 854490 - DNA, 16 bp, Homo sapiens
ttgtgtccattttgca

SEQ ID NO: 854491 - DNA, 17 bp, Homo sapiens
ttgtgtgaccaactgtg

SEQ ID NO: 854492 - DNA, 16 bp, Homo sapiens
ttgtgtgatccagccc

SEQ ID NO: 854493 - DNA, 23 bp, Homo sapiens
ttgtgtggctaattataattcag

SEQ ID NO: 854494 - DNA, 13 bp, Homo sapiens
ttgtgtggctcct

SEQ ID NO: 854495 - DNA, 16 bp, Homo sapiens
ttgtgtggctcctggt

SEQ ID NO: 854496 - DNA, 13 bp, Homo sapiens
ttgtgtgtactca

SEQ ID NO: 854497 - DNA, 16 bp, Homo sapiens
ttgtgtgtatttgcta

SEQ ID NO: 854498 - DNA, 16 bp, Homo sapiens
ttgtgtgtcaggccct

SEQ ID NO: 854499 - DNA, 23 bp, Homo sapiens
ttgtgtgtcaggccctctgcctg

SEQ ID NO: 854500 - DNA, 19 bp, Homo sapiens
ttgtgtgtcttaattatta

SEQ ID NO: 854501 - DNA, 17 bp, Homo sapiens
ttgtgtgtgccctgggc

SEQ ID NO: 854502 - DNA, 12 bp, Homo sapiens
ttgtgtgtgtgc

SEQ ID NO: 854503 - DNA, 20 bp, Homo sapiens
ttgtgtgttatttaaatgag

SEQ ID NO: 854504 - DNA, 13 bp, Homo sapiens
ttgtgtgttgtct

SEQ ID NO: 854505 - DNA, 17 bp, Homo sapiens
ttgtgtgttgtctcttg

SEQ ID NO: 854506 - DNA, 17 bp, Homo sapiens
ttgtgtgtttaaagaag

SEQ ID NO: 854507 - DNA, 18 bp, Homo sapiens
ttgtgtgtttatttcact

SEQ ID NO: 854508 - DNA, 20 bp, Homo sapiens
ttgtgtgttttgtacactta

SEQ ID NO: 854509 - DNA, 13 bp, Homo sapiens
ttgtgttactaag

SEQ ID NO: 854510 - DNA, 15 bp, Homo sapiens
ttgtgttactaagtt

SEQ ID NO: 854511 - DNA, 20 bp, Homo sapiens
ttgtgttcctacagacactt

SEQ ID NO: 854512 - DNA, 20 bp, Homo sapiens
ttgtgttcctggctgatgat

SEQ ID NO: 854513 - DNA, 14 bp, Homo sapiens
ttgtgttgaagaag

SEQ ID NO: 854514 - DNA, 17 bp, Homo sapiens
ttgtgttgaaggaactt

SEQ ID NO: 854515 - DNA, 17 bp, Homo sapiens
ttgtgttgcactgaaca

SEQ ID NO: 854516 - DNA, 18 bp, Homo sapiens
ttgtgttgtcactaaact

SEQ ID NO: 854517 - DNA, 18 bp, Homo sapiens
ttgtgtttagctaccttt

SEQ ID NO: 854518 - DNA, 17 bp, Homo sapiens
ttgtgtttgcttaaaca

SEQ ID NO: 854519 - DNA, 15 bp, Homo sapiens
ttgtgttttaaaaaa

SEQ ID NO: 854520 - DNA, 22 bp, Homo sapiens
ttgtgttttaaaaaaactgaag

SEQ ID NO: 854521 - DNA, 16 bp, Homo sapiens
ttgtgttttcttgtaa

SEQ ID NO: 854522 - DNA, 17 bp, Homo sapiens
ttgtgtttttaatttat

SEQ ID NO: 854523 - DNA, 15 bp, Homo sapiens
ttgtgttttttaaga

SEQ ID NO: 854524 - DNA, 21 bp, Homo sapiens
ttgtgttttttaagatagtgt

SEQ ID NO: 854525 - DNA, 15 bp, Homo sapiens
ttgttaaaaatgtca

SEQ ID NO: 854526 - DNA, 18 bp, Homo sapiens
ttgttaaaatctactttt

SEQ ID NO: 854527 - DNA, 12 bp, Homo sapiens
ttgttaaacacg

SEQ ID NO: 854528 - DNA, 19 bp, Homo sapiens
tttaaggtagcttcagcta

SEQ ID NO: 854529 - DNA, 15 bp, Homo sapiens
tttaaggtgaatgaa

SEQ ID NO: 854530 - DNA, 21 bp, Homo sapiens
tttaagtaacttaaggacctt

SEQ ID NO: 854531 - DNA, 14 bp, Homo sapiens
tttaagtagatttc

SEQ ID NO: 854532 - DNA, 16 bp, Homo sapiens
tttaagtatatagtat

SEQ ID NO: 854533 - DNA, 13 bp, Homo sapiens
tttaagtgaagga

SEQ ID NO: 854534 - DNA, 16 bp, Homo sapiens
tttaagtgcaacattt

SEQ ID NO: 854535 - DNA, 23 bp, Homo sapiens
tttaagtgcaacatttctgtata

SEQ ID NO: 854536 - DNA, 16 bp, Homo sapiens
tttaagtgctgcattt

SEQ ID NO: 854537 - DNA, 18 bp, Homo sapiens
tttaagtgctttgtaatg

SEQ ID NO: 854538 - DNA, 20 bp, Homo sapiens
tttaagtggggttgataaca

SEQ ID NO: 854539 - DNA, 14 bp, Homo sapiens
tttaagtgtaactg

SEQ ID NO: 854540 - DNA, 22 bp, Homo sapiens
tttaagtgtaactggcagtttt

SEQ ID NO: 854541 - DNA, 14 bp, Homo sapiens
tttaagttgtcaaa

SEQ ID NO: 854542 - DNA, 18 bp, Homo sapiens
tttaagttgtcaaagaag

SEQ ID NO: 854543 - DNA, 22 bp, Homo sapiens
tttaagtttcaaacttactatt

SEQ ID NO: 854544 - DNA, 21 bp, Homo sapiens
tttaagttttgattaatgttt

SEQ ID NO: 854545 - DNA, 11 bp, Homo sapiens
tttaataaaac

SEQ ID NO: 854546 - DNA, 12 bp, Homo sapiens
tttaataaaaca

SEQ ID NO: 854547 - DNA, 21 bp, Homo sapiens
tttaataaaactgcgaggaca

SEQ ID NO: 854548 - DNA, 19 bp, Homo sapiens
tttaataaaagatttacat

SEQ ID NO: 854549 - DNA, 19 bp, Homo sapiens
tttaataaactactctttg

SEQ ID NO: 854550 - DNA, 20 bp, Homo sapiens
tttaataaactactctttga

SEQ ID NO: 854551 - DNA, 23 bp, Homo sapiens
tttaataaagaaatatttaccta

SEQ ID NO: 854552 - DNA, 16 bp, Homo sapiens
tttaataaagcttgtg

SEQ ID NO: 854553 - DNA, 23 bp, Homo sapiens
tttaataaattgcttactgatat

SEQ ID NO: 854554 - DNA, 14 bp, Homo sapiens
tttaatacaggaaa

SEQ ID NO: 854555 - DNA, 15 bp, Homo sapiens
tttaatagaaataaa

SEQ ID NO: 854556 - DNA, 17 bp, Homo sapiens
tttaatagaagttttat

SEQ ID NO: 854557 - DNA, 21 bp, Homo sapiens
tttaatagaatataattatcg

SEQ ID NO: 854558 - DNA, 22 bp, Homo sapiens
tttaataggtagcattgaaaaa

SEQ ID NO: 854559 - DNA, 18 bp, Homo sapiens
tttaatagtcaccttcat

SEQ ID NO: 854560 - DNA, 13 bp, Homo sapiens
tttaatagtgctt

SEQ ID NO: 854561 - DNA, 16 bp, Homo sapiens
tttaatagtgcttttt

SEQ ID NO: 854562 - DNA, 21 bp, Homo sapiens
tttaatatctggcactgttaa

SEQ ID NO: 854563 - DNA, 12 bp, Homo sapiens
tttaatcagaaa

SEQ ID NO: 854564 - DNA, 21 bp, Homo sapiens
tttaatcccattgcaaacatt

SEQ ID NO: 854565 - DNA, 22 bp, Homo sapiens
tttaatcccattgcaaacatta

SEQ ID NO: 854566 - DNA, 21 bp, Homo sapiens
tttaatccttctagtttccca

SEQ ID NO: 854567 - DNA, 21 bp, Homo sapiens
tttaatgaatttaaggcaaaa

SEQ ID NO: 854568 - DNA, 20 bp, Homo sapiens
tttaatgcattaaacctgtc

SEQ ID NO: 854569 - DNA, 13 bp, Homo sapiens
tttaatgctgcct

SEQ ID NO: 854570 - DNA, 21 bp, Homo sapiens
tttaatggacatgagataatg

SEQ ID NO: 854571 - DNA, 17 bp, Homo sapiens
tttaatggactgtgaat

SEQ ID NO: 854572 - DNA, 20 bp, Homo sapiens
tttaatgggggtagcagctg

SEQ ID NO: 854573 - DNA, 23 bp, Homo sapiens
tttaatggggtctgtaaatactg

SEQ ID NO: 854574 - DNA, 21 bp, Homo sapiens
tttaatgtaaagaacttaaat

SEQ ID NO: 854575 - DNA, 18 bp, Homo sapiens
tttaatgtatctatttgt

SEQ ID NO: 854576 - DNA, 17 bp, Homo sapiens
tttaatgtattaatctg

SEQ ID NO: 854577 - DNA, 15 bp, Homo sapiens
tttaatgtctgttta

SEQ ID NO: 854578 - DNA, 11 bp, Homo sapiens
tttaatgtgaa

SEQ ID NO: 854579 - DNA, 12 bp, Homo sapiens
tttaatgtgaag

SEQ ID NO: 854580 - DNA, 13 bp, Homo sapiens
tttaatgtgaaga

SEQ ID NO: 854581 - DNA, 13 bp, Homo sapiens
tttaatgtgaatt

SEQ ID NO: 854582 - DNA, 15 bp, Homo sapiens
tttaatgttcacatt

SEQ ID NO: 854583 - DNA, 12 bp, Homo sapiens
tttaatgttcat

SEQ ID NO: 854584 - DNA, 12 bp, Homo sapiens
tttaatgtttat

SEQ ID NO: 854585 - DNA, 20 bp, Homo sapiens
tttaatgtttattatttaca

SEQ ID NO: 854586 - DNA, 19 bp, Homo sapiens
tttaatgttttaaatgtac

SEQ ID NO: 854587 - DNA, 18 bp, Homo sapiens
tttaatgtttttttgtag

SEQ ID NO: 854588 - DNA, 19 bp, Homo sapiens
tttaattaaaaactttaaa

SEQ ID NO: 854589 - DNA, 14 bp, Homo sapiens
tttaattaagcaaa

SEQ ID NO: 854590 - DNA, 22 bp, Homo sapiens
tttaattatgaaaactagcatt

SEQ ID NO: 854591 - DNA, 23 bp, Homo sapiens
tttaattattattcttcataaca

SEQ ID NO: 854592 - DNA, 23 bp, Homo sapiens
tttaattattatttatatatgta

SEQ ID NO: 854593 - DNA, 18 bp, Homo sapiens
tttaattatttaagattt

SEQ ID NO: 854594 - DNA, 15 bp, Homo sapiens
tttaattattttaaa

SEQ ID NO: 854595 - DNA, 17 bp, Homo sapiens
tttaattattttaaaat

SEQ ID NO: 854596 - DNA, 20 bp, Homo sapiens
tttaattattttaaaatatt

SEQ ID NO: 854597 - DNA, 16 bp, Homo sapiens
tttaattcagtacaac

SEQ ID NO: 854598 - DNA, 19 bp, Homo sapiens
tttaattcagtacaaccca

SEQ ID NO: 854599 - DNA, 14 bp, Homo sapiens
tttaattctagtat

SEQ ID NO: 854600 - DNA, 17 bp, Homo sapiens
tttaattcttcaccttt

SEQ ID NO: 854601 - DNA, 16 bp, Homo sapiens
tttaattgcatttaaa

SEQ ID NO: 854602 - DNA, 12 bp, Homo sapiens
tttaattgcttt

SEQ ID NO: 854603 - DNA, 15 bp, Homo sapiens
tttaattgctttgaa

SEQ ID NO: 854604 - DNA, 15 bp, Homo sapiens
tttaattgtaaagta

SEQ ID NO: 854605 - DNA, 14 bp, Homo sapiens
tttaattgtataag

SEQ ID NO: 854606 - DNA, 20 bp, Homo sapiens
tttaattgtccagtttgtct

SEQ ID NO: 854607 - DNA, 13 bp, Homo sapiens
tttaattgtttaa

SEQ ID NO: 854608 - DNA, 19 bp, Homo sapiens
tttaatttagtaaatgtta

SEQ ID NO: 854609 - DNA, 16 bp, Homo sapiens
tttaatttatatcagg

SEQ ID NO: 854610 - DNA, 22 bp, Homo sapiens
tttaatttatatcaggtgtata

SEQ ID NO: 854611 - DNA, 16 bp, Homo sapiens
tttaatttatgagttt

SEQ ID NO: 854612 - DNA, 20 bp, Homo sapiens
tttaatttatgtaacttgaa

SEQ ID NO: 854613 - DNA, 16 bp, Homo sapiens
tttaatttcaaatgta

SEQ ID NO: 854614 - DNA, 12 bp, Homo sapiens
tttaatttcagg

SEQ ID NO: 854615 - DNA, 21 bp, Homo sapiens
tttaatttctacaaaataaca

SEQ ID NO: 854616 - DNA, 22 bp, Homo sapiens
tttaatttgatgaaagctgatt

SEQ ID NO: 854617 - DNA, 21 bp, Homo sapiens
tttaattttttactttcagtt

SEQ ID NO: 854618 - DNA, 15 bp, Homo sapiens
tttacaaaaatataa

SEQ ID NO: 854619 - DNA, 17 bp, Homo sapiens
tttacaaaactgctttg

SEQ ID NO: 854620 - DNA, 13 bp, Homo sapiens
tttacaaaattgc

SEQ ID NO: 854621 - DNA, 22 bp, Homo sapiens
tttacaaacatggaaaacagag

SEQ ID NO: 854622 - DNA, 14 bp, Homo sapiens
tttacaaactgaag

SEQ ID NO: 854623 - DNA, 16 bp, Homo sapiens
tttacaaagtgtgtat

SEQ ID NO: 854624 - DNA, 18 bp, Homo sapiens
tttacaaagtgtgtatta

SEQ ID NO: 854625 - DNA, 12 bp, Homo sapiens
tttacaaatgtt

SEQ ID NO: 854626 - DNA, 21 bp, Homo sapiens
tttacaagaaaaaatgaattt

SEQ ID NO: 854627 - DNA, 16 bp, Homo sapiens
tttacaagaagtttat

SEQ ID NO: 854628 - DNA, 14 bp, Homo sapiens
tttacaataaagaa

SEQ ID NO: 854629 - DNA, 15 bp, Homo sapiens
tttacaataaagaat

SEQ ID NO: 854630 - DNA, 17 bp, Homo sapiens
tttacaataaatattct

SEQ ID NO: 854631 - DNA, 19 bp, Homo sapiens
tttacaataaatattctgc

SEQ ID NO: 854632 - DNA, 15 bp, Homo sapiens
tttacaatgtcatat

SEQ ID NO: 854633 - DNA, 19 bp, Homo sapiens
tttacacacttgcatgaat

SEQ ID NO: 854634 - DNA, 23 bp, Homo sapiens
tttacacagagaaatacaaaata

SEQ ID NO: 854635 - DNA, 18 bp, Homo sapiens
tttacacgtatctcttgg

SEQ ID NO: 854636 - DNA, 18 bp, Homo sapiens
tttacactaatatatgga

SEQ ID NO: 854637 - DNA, 17 bp, Homo sapiens
tttacagaatgcattaa

SEQ ID NO: 854638 - DNA, 19 bp, Homo sapiens
tttacagaatgcattaaaa

SEQ ID NO: 854639 - DNA, 22 bp, Homo sapiens
tttacagagaggatacatttaa

SEQ ID NO: 854640 - DNA, 23 bp, Homo sapiens
tttacagagaggatacatttaat

SEQ ID NO: 854641 - DNA, 17 bp, Homo sapiens
tttacagatccagaatt

SEQ ID NO: 854642 - DNA, 17 bp, Homo sapiens
tttacagatgaatgtat

SEQ ID NO: 854643 - DNA, 21 bp, Homo sapiens
tttacagcactactctgtgcc

SEQ ID NO: 854644 - DNA, 15 bp, Homo sapiens
tttacagcattgtct

SEQ ID NO: 854645 - DNA, 17 bp, Homo sapiens
tttacagcattgtcttt

SEQ ID NO: 854646 - DNA, 22 bp, Homo sapiens
tttacagcattgtctttgctgt

SEQ ID NO: 854647 - DNA, 23 bp, Homo sapiens
tttacagccagtgggagatgtta

SEQ ID NO: 854648 - DNA, 15 bp, Homo sapiens
tttacagctgcctgc

SEQ ID NO: 854649 - DNA, 14 bp, Homo sapiens
tttatattactctc

SEQ ID NO: 854650 - DNA, 13 bp, Homo sapiens
tttatattacttt

SEQ ID NO: 854651 - DNA, 22 bp, Homo sapiens
tttatattccgtatttaaagtt

SEQ ID NO: 854652 - DNA, 12 bp, Homo sapiens
tttatattctaa

SEQ ID NO: 854653 - DNA, 14 bp, Homo sapiens
tttatattgtaaat

SEQ ID NO: 854654 - DNA, 17 bp, Homo sapiens
tttatattgtatattct

SEQ ID NO: 854655 - DNA, 22 bp, Homo sapiens
tttatattgtatattctggaaa

SEQ ID NO: 854656 - DNA, 19 bp, Homo sapiens
tttatatttaaaaattgtt

SEQ ID NO: 854657 - DNA, 20 bp, Homo sapiens
tttatatttaaaaattgttt

SEQ ID NO: 854658 - DNA, 13 bp, Homo sapiens
tttatatttagat

SEQ ID NO: 854659 - DNA, 15 bp, Homo sapiens
tttatatttattgtt

SEQ ID NO: 854660 - DNA, 19 bp, Homo sapiens
tttatatttattgttagaa

SEQ ID NO: 854661 - DNA, 17 bp, Homo sapiens
tttatatttcctttatg

SEQ ID NO: 854662 - DNA, 19 bp, Homo sapiens
tttatatttcctttatgtg

SEQ ID NO: 854663 - DNA, 21 bp, Homo sapiens
tttatatttcctttatgtgaa

SEQ ID NO: 854664 - DNA, 13 bp, Homo sapiens
tttatatttggaa

SEQ ID NO: 854665 - DNA, 14 bp, Homo sapiens
tttatatttggaaa

SEQ ID NO: 854666 - DNA, 16 bp, Homo sapiens
tttatatttggaaaga

SEQ ID NO: 854667 - DNA, 21 bp, Homo sapiens
tttatatttggaaagagacca

SEQ ID NO: 854668 - DNA, 12 bp, Homo sapiens
tttatattttta

SEQ ID NO: 854669 - DNA, 19 bp, Homo sapiens
tttatcaatttttcccagt

SEQ ID NO: 854670 - DNA, 18 bp, Homo sapiens
tttatcagtgacagagtt

SEQ ID NO: 854671 - DNA, 14 bp, Homo sapiens
tttatcatgacatg

SEQ ID NO: 854672 - DNA, 15 bp, Homo sapiens
tttatcatgacatgt

SEQ ID NO: 854673 - DNA, 15 bp, Homo sapiens
tttatcattaaaaat

SEQ ID NO: 854674 - DNA, 17 bp, Homo sapiens
tttatcattcctttcca

SEQ ID NO: 854675 - DNA, 17 bp, Homo sapiens
tttatccaaaatgtgta

SEQ ID NO: 854676 - DNA, 20 bp, Homo sapiens
tttatccaaaatgtgtattt

SEQ ID NO: 854677 - DNA, 22 bp, Homo sapiens
tttatccaaaatgtgtatttct

SEQ ID NO: 854678 - DNA, 15 bp, Homo sapiens
tttatccaaatcttg

SEQ ID NO: 854679 - DNA, 14 bp, Homo sapiens
tttatccatttctt

SEQ ID NO: 854680 - DNA, 16 bp, Homo sapiens
tttatccctcacctgt

SEQ ID NO: 854681 - DNA, 14 bp, Homo sapiens
tttatccctttcct

SEQ ID NO: 854682 - DNA, 19 bp, Homo sapiens
tttatcctgaaatttcaga

SEQ ID NO: 854683 - DNA, 17 bp, Homo sapiens
tttatcctgacatattc

SEQ ID NO: 854684 - DNA, 16 bp, Homo sapiens
tttatcgcagaccttt

SEQ ID NO: 854685 - DNA, 20 bp, Homo sapiens
tttatctataatttacctaa

SEQ ID NO: 854686 - DNA, 20 bp, Homo sapiens
tttatctatataaaataact

SEQ ID NO: 854687 - DNA, 18 bp, Homo sapiens
tttatctcagatgttaaa

SEQ ID NO: 854688 - DNA, 13 bp, Homo sapiens
tttatctctattt

SEQ ID NO: 854689 - DNA, 11 bp, Homo sapiens
tttatctgaag

SEQ ID NO: 854690 - DNA, 16 bp, Homo sapiens
tttatctgaattttta

SEQ ID NO: 854691 - DNA, 16 bp, Homo sapiens
tttatctgtaattgta

SEQ ID NO: 854692 - DNA, 23 bp, Homo sapiens
tttatcttgcttcattctgaacc

SEQ ID NO: 854693 - DNA, 15 bp, Homo sapiens
tttatcttgggactg

SEQ ID NO: 854694 - DNA, 14 bp, Homo sapiens
tttatctttaccaa

SEQ ID NO: 854695 - DNA, 18 bp, Homo sapiens
tttatctttaccaaaaac

SEQ ID NO: 854696 - DNA, 20 bp, Homo sapiens
tttatctttaccaaaaacca

SEQ ID NO: 854697 - DNA, 14 bp, Homo sapiens
tttatctttataca

SEQ ID NO: 854698 - DNA, 15 bp, Homo sapiens
tttatgaacattgta

SEQ ID NO: 854699 - DNA, 17 bp, Homo sapiens
tttatgaacattgtact

SEQ ID NO: 854700 - DNA, 14 bp, Homo sapiens
tttatgaagcagat

SEQ ID NO: 854701 - DNA, 17 bp, Homo sapiens
tttatgaaggcaaaaaa

SEQ ID NO: 854702 - DNA, 17 bp, Homo sapiens
tttatgaatatcattga

SEQ ID NO: 854703 - DNA, 14 bp, Homo sapiens
tttatgaatgggtg

SEQ ID NO: 854704 - DNA, 16 bp, Homo sapiens
tttatgagatttactg

SEQ ID NO: 854705 - DNA, 17 bp, Homo sapiens
tttatgagccagacaaa

SEQ ID NO: 854706 - DNA, 12 bp, Homo sapiens
tttatgaggaaa

SEQ ID NO: 854707 - DNA, 19 bp, Homo sapiens
tttatgatttactcattat

SEQ ID NO: 854708 - DNA, 15 bp, Homo sapiens
tttatgcaaggaagg

SEQ ID NO: 854709 - DNA, 17 bp, Homo sapiens
tttatgcaaggaaggaa

SEQ ID NO: 854710 - DNA, 18 bp, Homo sapiens
tttatgcaaggaaggaaa

SEQ ID NO: 854711 - DNA, 12 bp, Homo sapiens
tttatgcagaca

SEQ ID NO: 854712 - DNA, 18 bp, Homo sapiens
tttatgcagacagtctgt

SEQ ID NO: 854713 - DNA, 19 bp, Homo sapiens
tttatgccttcttattgct

SEQ ID NO: 854714 - DNA, 23 bp, Homo sapiens
tttatgctcttgaaatattcaga

SEQ ID NO: 854715 - DNA, 20 bp, Homo sapiens
tttatgctgtattttaacac

SEQ ID NO: 854716 - DNA, 22 bp, Homo sapiens
tttatggaaaaattgacaaaaa

SEQ ID NO: 854717 - DNA, 22 bp, Homo sapiens
tttatggagtttgtgggaaata

SEQ ID NO: 854718 - DNA, 18 bp, Homo sapiens
tttatggattaaaaactg

SEQ ID NO: 854719 - DNA, 15 bp, Homo sapiens
tttatggcatgattt

SEQ ID NO: 854720 - DNA, 23 bp, Homo sapiens
tttatggcatgatttatatatgg

SEQ ID NO: 854721 - DNA, 13 bp, Homo sapiens
tttatggcctcag

SEQ ID NO: 854722 - DNA, 16 bp, Homo sapiens
tttatggcttttgtgc

SEQ ID NO: 854723 - DNA, 22 bp, Homo sapiens
tttatggggctgaacggggaga

SEQ ID NO: 854724 - DNA, 23 bp, Homo sapiens
tttatggtaactgctttctgttc

SEQ ID NO: 854725 - DNA, 16 bp, Homo sapiens
tttatggttatgtttt

SEQ ID NO: 854726 - DNA, 21 bp, Homo sapiens
tttatggtttcccccttctac

SEQ ID NO: 854727 - DNA, 14 bp, Homo sapiens
tttatgtaatttgt

SEQ ID NO: 854728 - DNA, 16 bp, Homo sapiens
tttatgtacaaccctg

SEQ ID NO: 854729 - DNA, 17 bp, Homo sapiens
tttatgtacaaccctga

SEQ ID NO: 854730 - DNA, 16 bp, Homo sapiens
tttatgtattttgaaa

SEQ ID NO: 854731 - DNA, 19 bp, Homo sapiens
tttatgtctgtggattttt

SEQ ID NO: 854732 - DNA, 15 bp, Homo sapiens
tttatgtgaattttt

SEQ ID NO: 854733 - DNA, 20 bp, Homo sapiens
tttatgtgaatttttaagct

SEQ ID NO: 854734 - DNA, 16 bp, Homo sapiens
tttatgtgagatttcc

SEQ ID NO: 854735 - DNA, 21 bp, Homo sapiens
tttatgtgatgccaaagatgt

SEQ ID NO: 854736 - DNA, 22 bp, Homo sapiens
tttatgtgatgccaaagatgtt

SEQ ID NO: 854737 - DNA, 16 bp, Homo sapiens
tttatgtgctattaat

SEQ ID NO: 854738 - DNA, 22 bp, Homo sapiens
tttatgtgtgaggagctgctgg

SEQ ID NO: 854739 - DNA, 16 bp, Homo sapiens
tttatgtgttatgaac

SEQ ID NO: 854740 - DNA, 17 bp, Homo sapiens
tttatgtgttatgaaca

SEQ ID NO: 854741 - DNA, 15 bp, Homo sapiens
tttatgttatgagga

SEQ ID NO: 854742 - DNA, 22 bp, Homo sapiens
tttatgttcagcttataatgaa

SEQ ID NO: 854743 - DNA, 16 bp, Homo sapiens
tttatgttgtatgatt

SEQ ID NO: 854744 - DNA, 16 bp, Homo sapiens
tttattaaaaatgttc

SEQ ID NO: 854745 - DNA, 21 bp, Homo sapiens
tttattaaaaatgttctcaaa

SEQ ID NO: 854746 - DNA, 12 bp, Homo sapiens
tttattaaaaca

SEQ ID NO: 854747 - DNA, 14 bp, Homo sapiens
tttattaaaatatt

SEQ ID NO: 854748 - DNA, 13 bp, Homo sapiens
tttattaaaatct

SEQ ID NO: 854749 - DNA, 21 bp, Homo sapiens
tttattaaaatgattgtaaaa

SEQ ID NO: 854750 - DNA, 17 bp, Homo sapiens
tttattaaacagatttt

SEQ ID NO: 854751 - DNA, 13 bp, Homo sapiens
tttattaaatttg

SEQ ID NO: 854752 - DNA, 23 bp, Homo sapiens
tttattaagccaggaaacatgaa

SEQ ID NO: 854753 - DNA, 19 bp, Homo sapiens
tttattaatcttagtgtat

SEQ ID NO: 854754 - DNA, 17 bp, Homo sapiens
tttattaattgctttga

SEQ ID NO: 854755 - DNA, 23 bp, Homo sapiens
tttattacaaattttcactgctg

SEQ ID NO: 854756 - DNA, 18 bp, Homo sapiens
tttattacaatgtatctt

SEQ ID NO: 854757 - DNA, 18 bp, Homo sapiens
tttattacagaaatgttt

SEQ ID NO: 854758 - DNA, 14 bp, Homo sapiens
tttattaccagtgg

SEQ ID NO: 854759 - DNA, 13 bp, Homo sapiens
tttattacctctg

SEQ ID NO: 854760 - DNA, 21 bp, Homo sapiens
tttattactgtttattacttc

SEQ ID NO: 854761 - DNA, 13 bp, Homo sapiens
tttattacttttt

SEQ ID NO: 854762 - DNA, 20 bp, Homo sapiens
tttattatatatttacagaa

SEQ ID NO: 854763 - DNA, 13 bp, Homo sapiens
tttattattgttt

SEQ ID NO: 854764 - DNA, 17 bp, Homo sapiens
tttattcaattcctctg

SEQ ID NO: 854765 - DNA, 15 bp, Homo sapiens
tttattcactgtaag

SEQ ID NO: 854766 - DNA, 23 bp, Homo sapiens
tttattcagctagaatttctggt

SEQ ID NO: 854767 - DNA, 14 bp, Homo sapiens
tttattcataatga

SEQ ID NO: 854768 - DNA, 19 bp, Homo sapiens
tttattccagaatgctgta

SEQ ID NO: 854769 - DNA, 22 bp, Homo sapiens
tttattccagaatgctgtacat

SEQ ID NO: 854770 - DNA, 23 bp, Homo sapiens
tttattccagaatgctgtacatc

SEQ ID NO: 854771 - DNA, 16 bp, Homo sapiens
tttcccagttaaagat

SEQ ID NO: 854772 - DNA, 12 bp, Homo sapiens
tttcccatctgc

SEQ ID NO: 854773 - DNA, 18 bp, Homo sapiens
tttcccatgactcttgga

SEQ ID NO: 854774 - DNA, 20 bp, Homo sapiens
tttccccagaggctcccaat

SEQ ID NO: 854775 - DNA, 22 bp, Homo sapiens
tttccccagaggctcccaatca

SEQ ID NO: 854776 - DNA, 21 bp, Homo sapiens
tttccccagggaaggaaaaat

SEQ ID NO: 854777 - DNA, 15 bp, Homo sapiens
tttccccatctctgt

SEQ ID NO: 854778 - DNA, 17 bp, Homo sapiens
tttccccccactctccc

SEQ ID NO: 854779 - DNA, 23 bp, Homo sapiens
tttccccccactctccccacact

SEQ ID NO: 854780 - DNA, 13 bp, Homo sapiens
tttccccctcctc

SEQ ID NO: 854781 - DNA, 13 bp, Homo sapiens
tttcccccttccc

SEQ ID NO: 854782 - DNA, 14 bp, Homo sapiens
tttcccccttcccg

SEQ ID NO: 854783 - DNA, 16 bp, Homo sapiens
tttcccccttctacat

SEQ ID NO: 854784 - DNA, 22 bp, Homo sapiens
tttcccccttgaggattgtgga

SEQ ID NO: 854785 - DNA, 17 bp, Homo sapiens
tttcccctcctttgtct

SEQ ID NO: 854786 - DNA, 16 bp, Homo sapiens
tttcccctgcactccc

SEQ ID NO: 854787 - DNA, 14 bp, Homo sapiens
tttcccctggcctc

SEQ ID NO: 854788 - DNA, 21 bp, Homo sapiens
tttcccctggcctcagttccc

SEQ ID NO: 854789 - DNA, 22 bp, Homo sapiens
tttcccctgtcagtttcccctc

SEQ ID NO: 854790 - DNA, 21 bp, Homo sapiens
tttcccctgtggggatctcag

SEQ ID NO: 854791 - DNA, 15 bp, Homo sapiens
tttcccctgttaaac

SEQ ID NO: 854792 - DNA, 23 bp, Homo sapiens
tttccccttggtcccaagcctga

SEQ ID NO: 854793 - DNA, 14 bp, Homo sapiens
tttcccctttcctg

SEQ ID NO: 854794 - DNA, 16 bp, Homo sapiens
tttcccctttcctgtc

SEQ ID NO: 854795 - DNA, 21 bp, Homo sapiens
tttcccggagccatcaccctc

SEQ ID NO: 854796 - DNA, 22 bp, Homo sapiens
tttccctagaaagccatattcc

SEQ ID NO: 854797 - DNA, 16 bp, Homo sapiens
tttccctattagagaa

SEQ ID NO: 854798 - DNA, 13 bp, Homo sapiens
tttccctctctag

SEQ ID NO: 854799 - DNA, 22 bp, Homo sapiens
tttccctcttttcttactcctc

SEQ ID NO: 854800 - DNA, 14 bp, Homo sapiens
tttccctgactcct

SEQ ID NO: 854801 - DNA, 12 bp, Homo sapiens
tttccctgagga

SEQ ID NO: 854802 - DNA, 16 bp, Homo sapiens
tttccctgcagacctc

SEQ ID NO: 854803 - DNA, 18 bp, Homo sapiens
tttccctgcagacctcaa

SEQ ID NO: 854804 - DNA, 11 bp, Homo sapiens
tttccctgcca

SEQ ID NO: 854805 - DNA, 20 bp, Homo sapiens
tttccctgccacatccagct

SEQ ID NO: 854806 - DNA, 13 bp, Homo sapiens
tttccctgcccct

SEQ ID NO: 854807 - DNA, 12 bp, Homo sapiens
tttccctggagc

SEQ ID NO: 854808 - DNA, 16 bp, Homo sapiens
tttccctggagctgag

SEQ ID NO: 854809 - DNA, 22 bp, Homo sapiens
tttccctggctaacagtctagt

SEQ ID NO: 854810 - DNA, 20 bp, Homo sapiens
tttcccttcagtaccctctc

SEQ ID NO: 854811 - DNA, 21 bp, Homo sapiens
tttcccttcatttaaactaaa

SEQ ID NO: 854812 - DNA, 14 bp, Homo sapiens
tttcccttccaaag

SEQ ID NO: 854813 - DNA, 19 bp, Homo sapiens
tttcccttgcttttccctc

SEQ ID NO: 854814 - DNA, 15 bp, Homo sapiens
tttccctttgccttc

SEQ ID NO: 854815 - DNA, 19 bp, Homo sapiens
tttccctttttaaaaaata

SEQ ID NO: 854816 - DNA, 24 bp, Homo sapiens
tttccgctgtcgccccaggccctc

SEQ ID NO: 854817 - DNA, 22 bp, Homo sapiens
tttcctaaagccaaagtttctg

SEQ ID NO: 854818 - DNA, 14 bp, Homo sapiens
tttcctaaatgttt

SEQ ID NO: 854819 - DNA, 15 bp, Homo sapiens
tttcctaatatcaaa

SEQ ID NO: 854820 - DNA, 16 bp, Homo sapiens
tttcctacagaaatac

SEQ ID NO: 854821 - DNA, 17 bp, Homo sapiens
tttcctacagaaatact

SEQ ID NO: 854822 - DNA, 15 bp, Homo sapiens
tttcctactgtcctg

SEQ ID NO: 854823 - DNA, 17 bp, Homo sapiens
tttcctactgtcctgga

SEQ ID NO: 854824 - DNA, 23 bp, Homo sapiens
tttcctatctagcatttatttct

SEQ ID NO: 854825 - DNA, 20 bp, Homo sapiens
tttcctcaagcaataattgt

SEQ ID NO: 854826 - DNA, 19 bp, Homo sapiens
tttcctcaagtatcttcta

SEQ ID NO: 854827 - DNA, 21 bp, Homo sapiens
tttcctcaagtatcttctatt

SEQ ID NO: 854828 - DNA, 22 bp, Homo sapiens
tttcctcaagtatcttctattt

SEQ ID NO: 854829 - DNA, 11 bp, Homo sapiens
tttcctcagtg

SEQ ID NO: 854830 - DNA, 19 bp, Homo sapiens
tttcctcatctttaaaatg

SEQ ID NO: 854831 - DNA, 15 bp, Homo sapiens
tttcctcatgtaaca

SEQ ID NO: 854832 - DNA, 17 bp, Homo sapiens
tttcctcatgtaacatt

SEQ ID NO: 854833 - DNA, 19 bp, Homo sapiens
tttcctcattcctgaaaga

SEQ ID NO: 854834 - DNA, 14 bp, Homo sapiens
tttcctcccaattc

SEQ ID NO: 854835 - DNA, 19 bp, Homo sapiens
tttcctccccaccttcccc

SEQ ID NO: 854836 - DNA, 12 bp, Homo sapiens
tttcctccccag

SEQ ID NO: 854837 - DNA, 13 bp, Homo sapiens
tttcctccccata

SEQ ID NO: 854838 - DNA, 21 bp, Homo sapiens
tttcctccccatacacacaca

SEQ ID NO: 854839 - DNA, 20 bp, Homo sapiens
tttcctccctctgcccctcc

SEQ ID NO: 854840 - DNA, 19 bp, Homo sapiens
tttcctcccttctgctact

SEQ ID NO: 854841 - DNA, 17 bp, Homo sapiens
tttcctccggagcctca

SEQ ID NO: 854842 - DNA, 15 bp, Homo sapiens
tttcctcctctgcct

SEQ ID NO: 854843 - DNA, 19 bp, Homo sapiens
tttcctcgcagatgataaa

SEQ ID NO: 854844 - DNA, 22 bp, Homo sapiens
tttcctcgcagcctctcagtgc

SEQ ID NO: 854845 - DNA, 14 bp, Homo sapiens
tttcctcggtctcc

SEQ ID NO: 854846 - DNA, 17 bp, Homo sapiens
tttcctctagcttttct

SEQ ID NO: 854847 - DNA, 19 bp, Homo sapiens
tttcctctccactgctgga

SEQ ID NO: 854848 - DNA, 16 bp, Homo sapiens
tttcctctctgtctgt

SEQ ID NO: 854849 - DNA, 19 bp, Homo sapiens
tttcctctgttaaaaacct

SEQ ID NO: 854850 - DNA, 22 bp, Homo sapiens
tttcctcttctattttgtaaac

SEQ ID NO: 854851 - DNA, 17 bp, Homo sapiens
tttcctctttctgctct

SEQ ID NO: 854852 - DNA, 18 bp, Homo sapiens
tttcctgaaccatgtgga

SEQ ID NO: 854853 - DNA, 14 bp, Homo sapiens
tttcctgcatctct

SEQ ID NO: 854854 - DNA, 16 bp, Homo sapiens
tttcctgccctgtcca

SEQ ID NO: 854855 - DNA, 18 bp, Homo sapiens
tttcctggagtgccctgc

SEQ ID NO: 854856 - DNA, 20 bp, Homo sapiens
tttcctggagtgccctgcag

SEQ ID NO: 854857 - DNA, 17 bp, Homo sapiens
tttcctggcagctgctg

SEQ ID NO: 854858 - DNA, 19 bp, Homo sapiens
tttcctgggaatggaataa

SEQ ID NO: 854859 - DNA, 23 bp, Homo sapiens
tttcctgggaatggaataactat

SEQ ID NO: 854860 - DNA, 16 bp, Homo sapiens
tttcctggtgccaatt

SEQ ID NO: 854861 - DNA, 19 bp, Homo sapiens
tttcctggtgccaatttca

SEQ ID NO: 854862 - DNA, 22 bp, Homo sapiens
tttcctgtaaagaaacatttcc

SEQ ID NO: 854863 - DNA, 19 bp, Homo sapiens
tttcctgtagccttctgta

SEQ ID NO: 854864 - DNA, 21 bp, Homo sapiens
tttcctgtttgaaatatcatg

SEQ ID NO: 854865 - DNA, 19 bp, Homo sapiens
tttccttaaattatctaaa

SEQ ID NO: 854866 - DNA, 13 bp, Homo sapiens
tttccttaatcca

SEQ ID NO: 854867 - DNA, 14 bp, Homo sapiens
tttccttaccatac

SEQ ID NO: 854868 - DNA, 18 bp, Homo sapiens
tttccttcaaagtttaat

SEQ ID NO: 854869 - DNA, 19 bp, Homo sapiens
tttccttcccttttctgtt

SEQ ID NO: 854870 - DNA, 18 bp, Homo sapiens
tttccttccttccctggc

SEQ ID NO: 854871 - DNA, 15 bp, Homo sapiens
tttccttctcatctg

SEQ ID NO: 854872 - DNA, 21 bp, Homo sapiens
tttccttctgttaagaaagga

SEQ ID NO: 854873 - DNA, 23 bp, Homo sapiens
tttccttggctcccattcactct

SEQ ID NO: 854874 - DNA, 17 bp, Homo sapiens
tttccttgtatgtgggt

SEQ ID NO: 854875 - DNA, 19 bp, Homo sapiens
tttccttgtgcctgctcct

SEQ ID NO: 854876 - DNA, 23 bp, Homo sapiens
tttcctttaccttttctataagt

SEQ ID NO: 854877 - DNA, 13 bp, Homo sapiens
tttcctttatgtg

SEQ ID NO: 854878 - DNA, 14 bp, Homo sapiens
tttcctttatgtga

SEQ ID NO: 854879 - DNA, 11 bp, Homo sapiens
tttcctttctt

SEQ ID NO: 854880 - DNA, 13 bp, Homo sapiens
tttcctttgctct

SEQ ID NO: 854881 - DNA, 23 bp, Homo sapiens
tttcctttgtcatcattgtatat

SEQ ID NO: 854882 - DNA, 21 bp, Homo sapiens
tttccttttaaaacacttcca

SEQ ID NO: 854883 - DNA, 13 bp, Homo sapiens
tttccttttcatt

SEQ ID NO: 854884 - DNA, 14 bp, Homo sapiens
tttccttttctctg

SEQ ID NO: 854885 - DNA, 15 bp, Homo sapiens
tttccttttcttaaa

SEQ ID NO: 854886 - DNA, 13 bp, Homo sapiens
tttccttttgggg

SEQ ID NO: 854887 - DNA, 22 bp, Homo sapiens
tttcctttttaatatgcttaaa

SEQ ID NO: 854888 - DNA, 17 bp, Homo sapiens
tttcctttttgacactg

SEQ ID NO: 854889 - DNA, 17 bp, Homo sapiens
tttcctttttggggagt

SEQ ID NO: 854890 - DNA, 14 bp, Homo sapiens
tttcgaaaatcaaa

SEQ ID NO: 854891 - DNA, 15 bp, Homo sapiens
tttcgaaactgccaa

SEQ ID NO: 854892 - DNA, 20 bp, Homo sapiens
tttcgactggtccagctctg

SEQ ID NO: 854893 - DNA, 20 bp, Homo sapiens
tttgaagataataatcttgg

SEQ ID NO: 854894 - DNA, 16 bp, Homo sapiens
tttgaagcagttgtgt

SEQ ID NO: 854895 - DNA, 18 bp, Homo sapiens
tttgaagctactgtgtgt

SEQ ID NO: 854896 - DNA, 13 bp, Homo sapiens
tttgaaggaaacc

SEQ ID NO: 854897 - DNA, 19 bp, Homo sapiens
tttgaaggaggtgagggat

SEQ ID NO: 854898 - DNA, 18 bp, Homo sapiens
tttgaagtaaattaaaca

SEQ ID NO: 854899 - DNA, 19 bp, Homo sapiens
tttgaagtaaattaaacat

SEQ ID NO: 854900 - DNA, 22 bp, Homo sapiens
tttgaagtaggtggcttgagct

SEQ ID NO: 854901 - DNA, 23 bp, Homo sapiens
tttgaagtaggtggcttgagcta

SEQ ID NO: 854902 - DNA, 10 bp, Homo sapiens
tttgaagtgt

SEQ ID NO: 854903 - DNA, 13 bp, Homo sapiens
tttgaagtgtaat

SEQ ID NO: 854904 - DNA, 20 bp, Homo sapiens
tttgaagtgtacctgtgtac

SEQ ID NO: 854905 - DNA, 18 bp, Homo sapiens
tttgaagtgtaggcagac

SEQ ID NO: 854906 - DNA, 20 bp, Homo sapiens
tttgaagtgtaggcagacac

SEQ ID NO: 854907 - DNA, 22 bp, Homo sapiens
tttgaagtgtaggcagacacag

SEQ ID NO: 854908 - DNA, 16 bp, Homo sapiens
tttgaagttagcttta

SEQ ID NO: 854909 - DNA, 17 bp, Homo sapiens
tttgaagttagctttaa

SEQ ID NO: 854910 - DNA, 16 bp, Homo sapiens
tttgaataaaaagtga

SEQ ID NO: 854911 - DNA, 23 bp, Homo sapiens
tttgaataaaaagtgaacttttg

SEQ ID NO: 854912 - DNA, 21 bp, Homo sapiens
tttgaataatgacagatggtg

SEQ ID NO: 854913 - DNA, 22 bp, Homo sapiens
tttgaataccattaaaactgct

SEQ ID NO: 854914 - DNA, 14 bp, Homo sapiens
tttgaatatgtagt

SEQ ID NO: 854915 - DNA, 16 bp, Homo sapiens
tttgaatattttttga

SEQ ID NO: 854916 - DNA, 14 bp, Homo sapiens
tttgaatgaaaaca

SEQ ID NO: 854917 - DNA, 16 bp, Homo sapiens
tttgaatgcttcctga

SEQ ID NO: 854918 - DNA, 19 bp, Homo sapiens
tttgaatgtaaaacaggaa

SEQ ID NO: 854919 - DNA, 16 bp, Homo sapiens
tttgaatgtatttgat

SEQ ID NO: 854920 - DNA, 21 bp, Homo sapiens
tttgaatgtatttgatttata

SEQ ID NO: 854921 - DNA, 14 bp, Homo sapiens
tttgaatgtggata

SEQ ID NO: 854922 - DNA, 21 bp, Homo sapiens
tttgaatgtgtgaattcaata

SEQ ID NO: 854923 - DNA, 11 bp, Homo sapiens
tttgaatgtta

SEQ ID NO: 854924 - DNA, 19 bp, Homo sapiens
tttgaatgttaattttttg

SEQ ID NO: 854925 - DNA, 15 bp, Homo sapiens
tttgaattgttacat

SEQ ID NO: 854926 - DNA, 18 bp, Homo sapiens
tttgaattgttttcttta

SEQ ID NO: 854927 - DNA, 19 bp, Homo sapiens
tttgaatttaaataaagtt

SEQ ID NO: 854928 - DNA, 17 bp, Homo sapiens
tttgaattttaaatcta

SEQ ID NO: 854929 - DNA, 15 bp, Homo sapiens
tttgaattttgtttt

SEQ ID NO: 854930 - DNA, 16 bp, Homo sapiens
tttgacaaaagtaaat

SEQ ID NO: 854931 - DNA, 17 bp, Homo sapiens
tttgacaaaagtaaatg

SEQ ID NO: 854932 - DNA, 17 bp, Homo sapiens
tttgacaactaaaatta

SEQ ID NO: 854933 - DNA, 19 bp, Homo sapiens
tttgacaatcaaagaaaag

SEQ ID NO: 854934 - DNA, 22 bp, Homo sapiens
tttgacacaaagcttctaaagc

SEQ ID NO: 854935 - DNA, 20 bp, Homo sapiens
tttgacacctcttttttcgt

SEQ ID NO: 854936 - DNA, 15 bp, Homo sapiens
tttgacaccttagag

SEQ ID NO: 854937 - DNA, 15 bp, Homo sapiens
tttgacactaagaaa

SEQ ID NO: 854938 - DNA, 12 bp, Homo sapiens
tttgacactgaa

SEQ ID NO: 854939 - DNA, 13 bp, Homo sapiens
tttgacactgaaa

SEQ ID NO: 854940 - DNA, 18 bp, Homo sapiens
tttgacactgaaagtttt

SEQ ID NO: 854941 - DNA, 14 bp, Homo sapiens
tttgacacttccca

SEQ ID NO: 854942 - DNA, 13 bp, Homo sapiens
tttgacagtgttt

SEQ ID NO: 854943 - DNA, 16 bp, Homo sapiens
tttgacatggaaatga

SEQ ID NO: 854944 - DNA, 21 bp, Homo sapiens
tttgaccagatctttctcttc

SEQ ID NO: 854945 - DNA, 16 bp, Homo sapiens
tttgaccccgatatat

SEQ ID NO: 854946 - DNA, 19 bp, Homo sapiens
tttgacctctgcagcaata

SEQ ID NO: 854947 - DNA, 13 bp, Homo sapiens
tttgaccttcccc

SEQ ID NO: 854948 - DNA, 21 bp, Homo sapiens
tttgacctttgtcttctataa

SEQ ID NO: 854949 - DNA, 18 bp, Homo sapiens
tttgacggccttcttggt

SEQ ID NO: 854950 - DNA, 14 bp, Homo sapiens
tttgactaagaatt

SEQ ID NO: 854951 - DNA, 16 bp, Homo sapiens
tttgactaattttaca

SEQ ID NO: 854952 - DNA, 21 bp, Homo sapiens
tttgactagggattcaggctg

SEQ ID NO: 854953 - DNA, 19 bp, Homo sapiens
tttgactctggcaaagctt

SEQ ID NO: 854954 - DNA, 20 bp, Homo sapiens
tttgactctttcaaagaaat

SEQ ID NO: 854955 - DNA, 18 bp, Homo sapiens
tttgactgtctcactttt

SEQ ID NO: 854956 - DNA, 16 bp, Homo sapiens
tttgacttaatgtgat

SEQ ID NO: 854957 - DNA, 23 bp, Homo sapiens
tttgacttaatgtgattactgct

SEQ ID NO: 854958 - DNA, 19 bp, Homo sapiens
tttgacttaggtttttagg

SEQ ID NO: 854959 - DNA, 13 bp, Homo sapiens
tttgacttcagct

SEQ ID NO: 854960 - DNA, 19 bp, Homo sapiens
tttgacttcagctgcctga

SEQ ID NO: 854961 - DNA, 17 bp, Homo sapiens
tttgacttgcatgaaga

SEQ ID NO: 854962 - DNA, 14 bp, Homo sapiens
tttgacttggaaaa

SEQ ID NO: 854963 - DNA, 17 bp, Homo sapiens
tttgactttcttctgaa

SEQ ID NO: 854964 - DNA, 12 bp, Homo sapiens
tttgactttgta

SEQ ID NO: 854965 - DNA, 15 bp, Homo sapiens
tttgacttttctgta

SEQ ID NO: 854966 - DNA, 21 bp, Homo sapiens
tttgactttttggaattcagc

SEQ ID NO: 854967 - DNA, 20 bp, Homo sapiens
tttgagaaaaaggaaaaaaa

SEQ ID NO: 854968 - DNA, 13 bp, Homo sapiens
tttgagaaaaata

SEQ ID NO: 854969 - DNA, 14 bp, Homo sapiens
tttgagaaaatata

SEQ ID NO: 854970 - DNA, 18 bp, Homo sapiens
tttgagaaaatataataa

SEQ ID NO: 854971 - DNA, 20 bp, Homo sapiens
tttgagaaatgaaatattgt

SEQ ID NO: 854972 - DNA, 22 bp, Homo sapiens
tttgagaaccccctaacctcta

SEQ ID NO: 854973 - DNA, 17 bp, Homo sapiens
tttgagacaagccctgg

SEQ ID NO: 854974 - DNA, 16 bp, Homo sapiens
tttgagaccagcctgg

SEQ ID NO: 854975 - DNA, 21 bp, Homo sapiens
tttgagagaaatatgaagaac

SEQ ID NO: 854976 - DNA, 18 bp, Homo sapiens
tttgagattaagaatgcc

SEQ ID NO: 854977 - DNA, 23 bp, Homo sapiens
tttgagcatgcacagctgcttgt

SEQ ID NO: 854978 - DNA, 12 bp, Homo sapiens
tttgagcatttt

SEQ ID NO: 854979 - DNA, 20 bp, Homo sapiens
tttgagctactggattctta

SEQ ID NO: 854980 - DNA, 15 bp, Homo sapiens
tttgagcttaatctt

SEQ ID NO: 854981 - DNA, 15 bp, Homo sapiens
tttgaggatatattt

SEQ ID NO: 854982 - DNA, 22 bp, Homo sapiens
tttgaggatatattttcacttt

SEQ ID NO: 854983 - DNA, 18 bp, Homo sapiens
tttgaggccaaaacagat

SEQ ID NO: 854984 - DNA, 21 bp, Homo sapiens
tttgaggctctgtcactgagc

SEQ ID NO: 854985 - DNA, 23 bp, Homo sapiens
tttgagggcccagccaggagcag

SEQ ID NO: 854986 - DNA, 11 bp, Homo sapiens
tttgaggggct

SEQ ID NO: 854987 - DNA, 19 bp, Homo sapiens
tttgaggtctacattcttg

SEQ ID NO: 854988 - DNA, 17 bp, Homo sapiens
tttgaggtctgttcttt

SEQ ID NO: 854989 - DNA, 17 bp, Homo sapiens
tttgagtatggctatct

SEQ ID NO: 854990 - DNA, 20 bp, Homo sapiens
tttgagtcctaggacttaaa

SEQ ID NO: 854991 - DNA, 21 bp, Homo sapiens
tttgagtcctaggacttaaaa

SEQ ID NO: 854992 - DNA, 20 bp, Homo sapiens
tttgagtggatgatgtttcg

SEQ ID NO: 854993 - DNA, 21 bp, Homo sapiens
tttgagtggatgatgtttcgt

SEQ ID NO: 854994 - DNA, 15 bp, Homo sapiens
tttgagtgtactgtg

SEQ ID NO: 854995 - DNA, 16 bp, Homo sapiens
tttgagtttgcctcag

SEQ ID NO: 854996 - DNA, 16 bp, Homo sapiens
tttgagtttttcctcc

SEQ ID NO: 854997 - DNA, 19 bp, Homo sapiens
tttgagtttttcctcccag

SEQ ID NO: 854998 - DNA, 13 bp, Homo sapiens
tttgataaaaacc

SEQ ID NO: 854999 - DNA, 14 bp, Homo sapiens
tttgataaacattc

SEQ ID NO: 855000 - DNA, 22 bp, Homo sapiens
tttgataaagtaattcatacaa

SEQ ID NO: 855001 - DNA, 21 bp, Homo sapiens
tttgatacagttttcagaaaa

SEQ ID NO: 855002 - DNA, 16 bp, Homo sapiens
tttgatagaggtaact

SEQ ID NO: 855003 - DNA, 22 bp, Homo sapiens
tttgatataccaaattaaaaaa

SEQ ID NO: 855004 - DNA, 23 bp, Homo sapiens
tttgatatccaaagctgaataca

SEQ ID NO: 855005 - DNA, 18 bp, Homo sapiens
tttgatatgggtagtatt

SEQ ID NO: 855006 - DNA, 21 bp, Homo sapiens
tttgatattatacaggaaagc

SEQ ID NO: 855007 - DNA, 14 bp, Homo sapiens
tttgatattatcta

SEQ ID NO: 855008 - DNA, 17 bp, Homo sapiens
tttgatatttatttcct

SEQ ID NO: 855009 - DNA, 14 bp, Homo sapiens
tttgatcaagaatg

SEQ ID NO: 855010 - DNA, 21 bp, Homo sapiens
tttgatcacattgtttcttga

SEQ ID NO: 855011 - DNA, 16 bp, Homo sapiens
tttgatcatccctttc

SEQ ID NO: 855012 - DNA, 21 bp, Homo sapiens
tttgatcatttctgccatgat

SEQ ID NO: 855013 - DNA, 14 bp, Homo sapiens
tttgatccttggaa

SEQ ID NO: 855014 - DNA, 20 bp, Homo sapiens
tttgcctcagtagatactaa

SEQ ID NO: 855015 - DNA, 11 bp, Homo sapiens
tttgcctctgt

SEQ ID NO: 855016 - DNA, 13 bp, Homo sapiens
tttgcctctgtcc

SEQ ID NO: 855017 - DNA, 21 bp, Homo sapiens
tttgcctgtaacaagccagat

SEQ ID NO: 855018 - DNA, 14 bp, Homo sapiens
tttgcctgtaagaa

SEQ ID NO: 855019 - DNA, 17 bp, Homo sapiens
tttgccttcctttctcc

SEQ ID NO: 855020 - DNA, 12 bp, Homo sapiens
tttgccttctct

SEQ ID NO: 855021 - DNA, 15 bp, Homo sapiens
tttgccttctggtta

SEQ ID NO: 855022 - DNA, 14 bp, Homo sapiens
tttgcctttaacag

SEQ ID NO: 855023 - DNA, 14 bp, Homo sapiens
tttgcggacgggct

SEQ ID NO: 855024 - DNA, 15 bp, Homo sapiens
tttgcgtacacagag

SEQ ID NO: 855025 - DNA, 17 bp, Homo sapiens
tttgcgtgcccggggca

SEQ ID NO: 855026 - DNA, 19 bp, Homo sapiens
tttgctaaaagaagagagg

SEQ ID NO: 855027 - DNA, 19 bp, Homo sapiens
tttgctaagtgtatgatgt

SEQ ID NO: 855028 - DNA, 21 bp, Homo sapiens
tttgctacaaatttatgcatt

SEQ ID NO: 855029 - DNA, 19 bp, Homo sapiens
tttgctagactctagacaa

SEQ ID NO: 855030 - DNA, 15 bp, Homo sapiens
tttgctagatggaat

SEQ ID NO: 855031 - DNA, 20 bp, Homo sapiens
tttgctataatcattagttt

SEQ ID NO: 855032 - DNA, 22 bp, Homo sapiens
tttgctataatcattagtttta

SEQ ID NO: 855033 - DNA, 16 bp, Homo sapiens
tttgctatctgggctg

SEQ ID NO: 855034 - DNA, 12 bp, Homo sapiens
tttgctatgtaa

SEQ ID NO: 855035 - DNA, 16 bp, Homo sapiens
tttgctcatgtaatgt

SEQ ID NO: 855036 - DNA, 15 bp, Homo sapiens
tttgctccctccccg

SEQ ID NO: 855037 - DNA, 14 bp, Homo sapiens
tttgctccctctgt

SEQ ID NO: 855038 - DNA, 14 bp, Homo sapiens
tttgctccgaagct

SEQ ID NO: 855039 - DNA, 17 bp, Homo sapiens
tttgctccgctcccacc

SEQ ID NO: 855040 - DNA, 23 bp, Homo sapiens
tttgctctattaagattggaaat

SEQ ID NO: 855041 - DNA, 21 bp, Homo sapiens
tttgctctgaccgattccttt

SEQ ID NO: 855042 - DNA, 19 bp, Homo sapiens
tttgctctgatttccttcc

SEQ ID NO: 855043 - DNA, 17 bp, Homo sapiens
tttgctcttgtttttat

SEQ ID NO: 855044 - DNA, 17 bp, Homo sapiens
tttgctcttttaagcag

SEQ ID NO: 855045 - DNA, 19 bp, Homo sapiens
tttgctcttttaagcagtc

SEQ ID NO: 855046 - DNA, 17 bp, Homo sapiens
tttgctgaattccttta

SEQ ID NO: 855047 - DNA, 18 bp, Homo sapiens
tttgctgaattcctttac

SEQ ID NO: 855048 - DNA, 23 bp, Homo sapiens
tttgctgacaaccattaaagtca

SEQ ID NO: 855049 - DNA, 14 bp, Homo sapiens
tttgctgagttgtt

SEQ ID NO: 855050 - DNA, 19 bp, Homo sapiens
tttgctgagttgttctaac

SEQ ID NO: 855051 - DNA, 18 bp, Homo sapiens
tttgctgcaaagagaaac

SEQ ID NO: 855052 - DNA, 17 bp, Homo sapiens
tttgctgcacagcagga

SEQ ID NO: 855053 - DNA, 17 bp, Homo sapiens
tttgctgctatgaaaat

SEQ ID NO: 855054 - DNA, 14 bp, Homo sapiens
tttgctggaagaaa

SEQ ID NO: 855055 - DNA, 15 bp, Homo sapiens
tttgctggaataagt

SEQ ID NO: 855056 - DNA, 21 bp, Homo sapiens
tttgctgtactcttgctgatg

SEQ ID NO: 855057 - DNA, 13 bp, Homo sapiens
tttgctgtagaag

SEQ ID NO: 855058 - DNA, 21 bp, Homo sapiens
tttgctgtctttctctaaata

SEQ ID NO: 855059 - DNA, 21 bp, Homo sapiens
tttgctgttgattcagacttt

SEQ ID NO: 855060 - DNA, 22 bp, Homo sapiens
tttgctgttgggtttttgctgt

SEQ ID NO: 855061 - DNA, 12 bp, Homo sapiens
tttgcttaacat

SEQ ID NO: 855062 - DNA, 22 bp, Homo sapiens
tttgcttaacattagatgtcat

SEQ ID NO: 855063 - DNA, 16 bp, Homo sapiens
tttgcttaccttttcc

SEQ ID NO: 855064 - DNA, 12 bp, Homo sapiens
tttgcttagaaa

SEQ ID NO: 855065 - DNA, 16 bp, Homo sapiens
tttgcttagaaaagaa

SEQ ID NO: 855066 - DNA, 16 bp, Homo sapiens
tttgcttataaactgg

SEQ ID NO: 855067 - DNA, 17 bp, Homo sapiens
tttgcttattgttccaa

SEQ ID NO: 855068 - DNA, 15 bp, Homo sapiens
tttgcttcaaaaaca

SEQ ID NO: 855069 - DNA, 20 bp, Homo sapiens
tttgcttcattgtactacct

SEQ ID NO: 855070 - DNA, 16 bp, Homo sapiens
tttgcttgatccagaa

SEQ ID NO: 855071 - DNA, 16 bp, Homo sapiens
tttgctttaaaacaag

SEQ ID NO: 855072 - DNA, 19 bp, Homo sapiens
tttgctttcggtactgtaa

SEQ ID NO: 855073 - DNA, 12 bp, Homo sapiens
tttgctttctgt

SEQ ID NO: 855074 - DNA, 16 bp, Homo sapiens
tttgctttgtgatttt

SEQ ID NO: 855075 - DNA, 20 bp, Homo sapiens
tttgctttttgcgtacacag

SEQ ID NO: 855076 - DNA, 14 bp, Homo sapiens
tttggaaagaaatt

SEQ ID NO: 855077 - DNA, 16 bp, Homo sapiens
tttggaaagactggac

SEQ ID NO: 855078 - DNA, 23 bp, Homo sapiens
tttggaaagagcaccctcgagaa

SEQ ID NO: 855079 - DNA, 13 bp, Homo sapiens
tttggaaagtaca

SEQ ID NO: 855080 - DNA, 14 bp, Homo sapiens
tttggaaccaaagt

SEQ ID NO: 855081 - DNA, 18 bp, Homo sapiens
tttggaagaagtttttta

SEQ ID NO: 855082 - DNA, 22 bp, Homo sapiens
tttggaagcagccccctgtggc

SEQ ID NO: 855083 - DNA, 13 bp, Homo sapiens
tttggaagttaaa

SEQ ID NO: 855084 - DNA, 17 bp, Homo sapiens
tttggaatactttttgt

SEQ ID NO: 855085 - DNA, 15 bp, Homo sapiens
tttggaatattaaaa

SEQ ID NO: 855086 - DNA, 19 bp, Homo sapiens
tttggaatatttgaataat

SEQ ID NO: 855087 - DNA, 13 bp, Homo sapiens
tttggaatctaac

SEQ ID NO: 855088 - DNA, 21 bp, Homo sapiens
tttggaattgaacgactgtat

SEQ ID NO: 855089 - DNA, 13 bp, Homo sapiens
tttggacagttta

SEQ ID NO: 855090 - DNA, 16 bp, Homo sapiens
tttggacccagggcct

SEQ ID NO: 855091 - DNA, 19 bp, Homo sapiens
tttggacctaaatggcctc

SEQ ID NO: 855092 - DNA, 16 bp, Homo sapiens
tttggactgttttgtt

SEQ ID NO: 855093 - DNA, 22 bp, Homo sapiens
tttggagaaattatttaataaa

SEQ ID NO: 855094 - DNA, 16 bp, Homo sapiens
tttggagagtttgcct

SEQ ID NO: 855095 - DNA, 22 bp, Homo sapiens
tttggaggctggagtaatcaga

SEQ ID NO: 855096 - DNA, 23 bp, Homo sapiens
tttggaggggaaatggggaaagc

SEQ ID NO: 855097 - DNA, 14 bp, Homo sapiens
tttggaggtgctta

SEQ ID NO: 855098 - DNA, 21 bp, Homo sapiens
tttggagtcagtaggtccaag

SEQ ID NO: 855099 - DNA, 16 bp, Homo sapiens
tttggataataaaaat

SEQ ID NO: 855100 - DNA, 15 bp, Homo sapiens
tttggatacatctgc

SEQ ID NO: 855101 - DNA, 19 bp, Homo sapiens
tttggatatgtaaaacatt

SEQ ID NO: 855102 - DNA, 19 bp, Homo sapiens
tttggatgggagtgagaca

SEQ ID NO: 855103 - DNA, 23 bp, Homo sapiens
tttggattctcttagctactgta

SEQ ID NO: 855104 - DNA, 20 bp, Homo sapiens
tttggattcttatgtagcag

SEQ ID NO: 855105 - DNA, 20 bp, Homo sapiens
tttggattggggtccctcta

SEQ ID NO: 855106 - DNA, 20 bp, Homo sapiens
tttggatttaaaagcctgct

SEQ ID NO: 855107 - DNA, 21 bp, Homo sapiens
tttggcaaaatgtcttaacaa

SEQ ID NO: 855108 - DNA, 19 bp, Homo sapiens
tttggcaaacgctaaagag

SEQ ID NO: 855109 - DNA, 14 bp, Homo sapiens
tttggcaaggaaag

SEQ ID NO: 855110 - DNA, 14 bp, Homo sapiens
tttggcacttgtat

SEQ ID NO: 855111 - DNA, 21 bp, Homo sapiens
tttggcaggaagatgtatgct

SEQ ID NO: 855112 - DNA, 17 bp, Homo sapiens
tttggcatgggacagac

SEQ ID NO: 855113 - DNA, 12 bp, Homo sapiens
tttggccaggga

SEQ ID NO: 855114 - DNA, 20 bp, Homo sapiens
tttggcccaagactgggctg

SEQ ID NO: 855115 - DNA, 11 bp, Homo sapiens
tttggccctgg

SEQ ID NO: 855116 - DNA, 14 bp, Homo sapiens
tttggccctggagc

SEQ ID NO: 855117 - DNA, 17 bp, Homo sapiens
tttggcctgcactaatt

SEQ ID NO: 855118 - DNA, 16 bp, Homo sapiens
tttggccttaagaact

SEQ ID NO: 855119 - DNA, 14 bp, Homo sapiens
tttggcgggccaag

SEQ ID NO: 855120 - DNA, 23 bp, Homo sapiens
tttggctctcctcagaagaaaga

SEQ ID NO: 855121 - DNA, 15 bp, Homo sapiens
tttggctctttcaga

SEQ ID NO: 855122 - DNA, 22 bp, Homo sapiens
tttggctgagacctgggatttg

SEQ ID NO: 855123 - DNA, 21 bp, Homo sapiens
tttggctgagtactggaataa

SEQ ID NO: 855124 - DNA, 13 bp, Homo sapiens
tttggctgtgtct

SEQ ID NO: 855125 - DNA, 15 bp, Homo sapiens
tttggctgtgtctaa

SEQ ID NO: 855126 - DNA, 14 bp, Homo sapiens
tttggcttcatttc

SEQ ID NO: 855127 - DNA, 16 bp, Homo sapiens
tttggcttctcctgtg

SEQ ID NO: 855128 - DNA, 21 bp, Homo sapiens
tttgggagacatgtgacattt

SEQ ID NO: 855129 - DNA, 17 bp, Homo sapiens
tttgggcccctcagagc

SEQ ID NO: 855130 - DNA, 21 bp, Homo sapiens
tttgggcctccatgccccagc

SEQ ID NO: 855131 - DNA, 16 bp, Homo sapiens
tttgggcctgttcctt

SEQ ID NO: 855132 - DNA, 15 bp, Homo sapiens
tttggggaagtttat

SEQ ID NO: 855133 - DNA, 20 bp, Homo sapiens
tttggggagcagagacacta

SEQ ID NO: 855134 - DNA, 23 bp, Homo sapiens
tttggggagggaggggaaatgta

SEQ ID NO: 855135 - DNA, 20 bp, Homo sapiens
tttggggagggggaagagaa

SEQ ID NO: 855136 - DNA, 21 bp, Homo sapiens
tttgttactctcttccacatg

SEQ ID NO: 855137 - DNA, 16 bp, Homo sapiens
tttgttactgtatttt

SEQ ID NO: 855138 - DNA, 22 bp, Homo sapiens
tttgttactttacttttgctgt

SEQ ID NO: 855139 - DNA, 20 bp, Homo sapiens
tttgttagcaaagattaaat

SEQ ID NO: 855140 - DNA, 15 bp, Homo sapiens
tttgttagggctgct

SEQ ID NO: 855141 - DNA, 14 bp, Homo sapiens
tttgttattcctag

SEQ ID NO: 855142 - DNA, 15 bp, Homo sapiens
tttgttattttgcaa

SEQ ID NO: 855143 - DNA, 14 bp, Homo sapiens
tttgttcaaagttg

SEQ ID NO: 855144 - DNA, 18 bp, Homo sapiens
tttgttcataataaaagt

SEQ ID NO: 855145 - DNA, 12 bp, Homo sapiens
tttgttcatctg

SEQ ID NO: 855146 - DNA, 21 bp, Homo sapiens
tttgttctagacttccccatc

SEQ ID NO: 855147 - DNA, 16 bp, Homo sapiens
tttgttctagttttca

SEQ ID NO: 855148 - DNA, 13 bp, Homo sapiens
tttgttctctggg

SEQ ID NO: 855149 - DNA, 21 bp, Homo sapiens
tttgttctctgggagaaaatc

SEQ ID NO: 855150 - DNA, 15 bp, Homo sapiens
tttgttctgttctgg

SEQ ID NO: 855151 - DNA, 12 bp, Homo sapiens
tttgttcttaca

SEQ ID NO: 855152 - DNA, 14 bp, Homo sapiens
tttgttctttttat

SEQ ID NO: 855153 - DNA, 21 bp, Homo sapiens
tttgttgacagcaaaatgttg

SEQ ID NO: 855154 - DNA, 13 bp, Homo sapiens
tttgttgacatta

SEQ ID NO: 855155 - DNA, 14 bp, Homo sapiens
tttgttgacattag

SEQ ID NO: 855156 - DNA, 15 bp, Homo sapiens
tttgttgacattctg

SEQ ID NO: 855157 - DNA, 18 bp, Homo sapiens
tttgttgacattctgaat

SEQ ID NO: 855158 - DNA, 18 bp, Homo sapiens
tttgttgcaagatgtgaa

SEQ ID NO: 855159 - DNA, 19 bp, Homo sapiens
tttgttgcaagatgtgaat

SEQ ID NO: 855160 - DNA, 22 bp, Homo sapiens
tttgttgcgttcctttcttttc

SEQ ID NO: 855161 - DNA, 15 bp, Homo sapiens
tttgttgtaaaacaa

SEQ ID NO: 855162 - DNA, 16 bp, Homo sapiens
tttgttgtactttata

SEQ ID NO: 855163 - DNA, 16 bp, Homo sapiens
tttgttgtcagctgaa

SEQ ID NO: 855164 - DNA, 16 bp, Homo sapiens
tttgttgtgttctgtt

SEQ ID NO: 855165 - DNA, 18 bp, Homo sapiens
tttgtttaaaattctctt

SEQ ID NO: 855166 - DNA, 22 bp, Homo sapiens
tttgtttaaatgccaaaatgta

SEQ ID NO: 855167 - DNA, 19 bp, Homo sapiens
tttgtttagaaaaaaaact

SEQ ID NO: 855168 - DNA, 21 bp, Homo sapiens
tttgtttatggtaaaaaattt

SEQ ID NO: 855169 - DNA, 15 bp, Homo sapiens
tttgtttatgtaatt

SEQ ID NO: 855170 - DNA, 17 bp, Homo sapiens
tttgtttattaaatagt

SEQ ID NO: 855171 - DNA, 21 bp, Homo sapiens
tttgtttcaaagggattgctt

SEQ ID NO: 855172 - DNA, 22 bp, Homo sapiens
tttgtttcaatgaggtgtccaa

SEQ ID NO: 855173 - DNA, 13 bp, Homo sapiens
tttgtttcatatt

SEQ ID NO: 855174 - DNA, 21 bp, Homo sapiens
tttgttttaaaataagttaaa

SEQ ID NO: 855175 - DNA, 12 bp, Homo sapiens
tttgttttactt

SEQ ID NO: 855176 - DNA, 12 bp, Homo sapiens
tttgttttgctt

SEQ ID NO: 855177 - DNA, 18 bp, Homo sapiens
tttgttttggtagatctt

SEQ ID NO: 855178 - DNA, 19 bp, Homo sapiens
tttgtttttaaactgtaca

SEQ ID NO: 855179 - DNA, 12 bp, Homo sapiens
tttgtttttcat

SEQ ID NO: 855180 - DNA, 17 bp, Homo sapiens
tttgtttttgcattttt

SEQ ID NO: 855181 - DNA, 19 bp, Homo sapiens
tttgttttttgtaactaca

SEQ ID NO: 855182 - DNA, 16 bp, Homo sapiens
tttgtttttttccaac

SEQ ID NO: 855183 - DNA, 14 bp, Homo sapiens
tttgtttttttcct

SEQ ID NO: 855184 - DNA, 19 bp, Homo sapiens
tttgttttttttgactaaa

SEQ ID NO: 855185 - DNA, 14 bp, Homo sapiens
ttttaaaaaaactg

SEQ ID NO: 855186 - DNA, 17 bp, Homo sapiens
ttttaaaaaaactgaag

SEQ ID NO: 855187 - DNA, 14 bp, Homo sapiens
ttttaaaaaagctt

SEQ ID NO: 855188 - DNA, 17 bp, Homo sapiens
ttttaaaaaagcttaaa

SEQ ID NO: 855189 - DNA, 22 bp, Homo sapiens
ttttaaaaaagcttaaaacttt

SEQ ID NO: 855190 - DNA, 14 bp, Homo sapiens
ttttaaaaaatatt

SEQ ID NO: 855191 - DNA, 14 bp, Homo sapiens
ttttaaaaaatcaa

SEQ ID NO: 855192 - DNA, 18 bp, Homo sapiens
ttttaaaaaatcaatcaa

SEQ ID NO: 855193 - DNA, 19 bp, Homo sapiens
ttttaaaaaatcaatcaat

SEQ ID NO: 855194 - DNA, 21 bp, Homo sapiens
ttttaaaaaatcaatcaatgg

SEQ ID NO: 855195 - DNA, 15 bp, Homo sapiens
ttttaaaaactcctt

SEQ ID NO: 855196 - DNA, 15 bp, Homo sapiens
ttttaaaaagcaaat

SEQ ID NO: 855197 - DNA, 14 bp, Homo sapiens
ttttaaaaatacat

SEQ ID NO: 855198 - DNA, 14 bp, Homo sapiens
ttttaaaacactaa

SEQ ID NO: 855199 - DNA, 22 bp, Homo sapiens
ttttaaaacacttccataatct

SEQ ID NO: 855200 - DNA, 13 bp, Homo sapiens
ttttaaaactgaa

SEQ ID NO: 855201 - DNA, 18 bp, Homo sapiens
ttttaaaaggccctgtgg

SEQ ID NO: 855202 - DNA, 15 bp, Homo sapiens
ttttaaaaggtagag

SEQ ID NO: 855203 - DNA, 18 bp, Homo sapiens
ttttaaaagtaaatgtac

SEQ ID NO: 855204 - DNA, 12 bp, Homo sapiens
ttttaaaagttt

SEQ ID NO: 855205 - DNA, 18 bp, Homo sapiens
ttttaaaagtttcaatgt

SEQ ID NO: 855206 - DNA, 19 bp, Homo sapiens
ttttaaaagtttcaatgtg

SEQ ID NO: 855207 - DNA, 10 bp, Homo sapiens
ttttaaaata

SEQ ID NO: 855208 - DNA, 23 bp, Homo sapiens
ttttaaaataagctttctcagaa

SEQ ID NO: 855209 - DNA, 21 bp, Homo sapiens
ttttaaaatagaaattttgta

SEQ ID NO: 855210 - DNA, 15 bp, Homo sapiens
ttttaaaatatatgt

SEQ ID NO: 855211 - DNA, 17 bp, Homo sapiens
ttttaaaatatcctgta

SEQ ID NO: 855212 - DNA, 16 bp, Homo sapiens
ttttaaaatcaactta

SEQ ID NO: 855213 - DNA, 13 bp, Homo sapiens
ttttaaaatctga

SEQ ID NO: 855214 - DNA, 20 bp, Homo sapiens
ttttaaaatctgagggaaat

SEQ ID NO: 855215 - DNA, 15 bp, Homo sapiens
ttttaaaatctgatt

SEQ ID NO: 855216 - DNA, 16 bp, Homo sapiens
ttttaaaatgaataat

SEQ ID NO: 855217 - DNA, 18 bp, Homo sapiens
ttttaaaatgaataattt

SEQ ID NO: 855218 - DNA, 11 bp, Homo sapiens
ttttaaaattt

SEQ ID NO: 855219 - DNA, 17 bp, Homo sapiens
ttttaaacaaaatttca

SEQ ID NO: 855220 - DNA, 19 bp, Homo sapiens
ttttaaacaaaatttcaca

SEQ ID NO: 855221 - DNA, 20 bp, Homo sapiens
ttttaaacataacaatgtta

SEQ ID NO: 855222 - DNA, 23 bp, Homo sapiens
ttttaaacattaatagcagcctt

SEQ ID NO: 855223 - DNA, 22 bp, Homo sapiens
ttttaaacctttaatgagaaaa

SEQ ID NO: 855224 - DNA, 14 bp, Homo sapiens
ttttaaactgtaca

SEQ ID NO: 855225 - DNA, 13 bp, Homo sapiens
ttttaaacttgaa

SEQ ID NO: 855226 - DNA, 16 bp, Homo sapiens
ttttaaacttgaaata

SEQ ID NO: 855227 - DNA, 11 bp, Homo sapiens
ttttaaagaag

SEQ ID NO: 855228 - DNA, 11 bp, Homo sapiens
ttttaaagaat

SEQ ID NO: 855229 - DNA, 23 bp, Homo sapiens
ttttaaagaatatgactttttat

SEQ ID NO: 855230 - DNA, 15 bp, Homo sapiens
ttttaaagaatgtta

SEQ ID NO: 855231 - DNA, 18 bp, Homo sapiens
ttttaaaggaatgtgaaa

SEQ ID NO: 855232 - DNA, 19 bp, Homo sapiens
ttttaaagtaaacttgtgt

SEQ ID NO: 855233 - DNA, 23 bp, Homo sapiens
ttttaaagtagttcctattttct

SEQ ID NO: 855234 - DNA, 16 bp, Homo sapiens
ttttaaagtatatatt

SEQ ID NO: 855235 - DNA, 21 bp, Homo sapiens
ttttaaataaaagcacaagta

SEQ ID NO: 855236 - DNA, 17 bp, Homo sapiens
ttttaaataaaagcagc

SEQ ID NO: 855237 - DNA, 13 bp, Homo sapiens
ttttaaataacct

SEQ ID NO: 855238 - DNA, 17 bp, Homo sapiens
ttttaaataacctctgg

SEQ ID NO: 855239 - DNA, 15 bp, Homo sapiens
ttttaaatattttct

SEQ ID NO: 855240 - DNA, 14 bp, Homo sapiens
ttttaaatgacttg

SEQ ID NO: 855241 - DNA, 13 bp, Homo sapiens
ttttaaatgttca

SEQ ID NO: 855242 - DNA, 19 bp, Homo sapiens
ttttaaattagaaaatatt

SEQ ID NO: 855243 - DNA, 20 bp, Homo sapiens
ttttaaattatactgtagct

SEQ ID NO: 855244 - DNA, 12 bp, Homo sapiens
ttttaaattcca

SEQ ID NO: 855245 - DNA, 19 bp, Homo sapiens
ttttaaattccactgaaaa

SEQ ID NO: 855246 - DNA, 21 bp, Homo sapiens
ttttaaattccactgaaaatt

SEQ ID NO: 855247 - DNA, 15 bp, Homo sapiens
ttttaaattgtttca

SEQ ID NO: 855248 - DNA, 11 bp, Homo sapiens
ttttaaatttg

SEQ ID NO: 855249 - DNA, 19 bp, Homo sapiens
ttttaacaataactactgt

SEQ ID NO: 855250 - DNA, 15 bp, Homo sapiens
ttttaacactttgta

SEQ ID NO: 855251 - DNA, 16 bp, Homo sapiens
ttttaaccatccttaa

SEQ ID NO: 855252 - DNA, 15 bp, Homo sapiens
ttttaacgtggcttg

SEQ ID NO: 855253 - DNA, 15 bp, Homo sapiens
ttttaactacataaa

SEQ ID NO: 855254 - DNA, 19 bp, Homo sapiens
ttttaactgccaatcctta

SEQ ID NO: 855255 - DNA, 15 bp, Homo sapiens
ttttaacttctttct

SEQ ID NO: 855256 - DNA, 12 bp, Homo sapiens
ttttaactttct

SEQ ID NO: 855257 - DNA, 20 bp, Homo sapiens
ttttaagaaaaattcacaag

SEQ ID NO: 855258 - DNA, 18 bp, Homo sapiens
ttttaagaacttcatttt

SEQ ID NO: 855259 - DNA, 21 bp, Homo sapiens
ttttctgtaccagttaatttt

SEQ ID NO: 855260 - DNA, 12 bp, Homo sapiens
ttttctgtactt

SEQ ID NO: 855261 - DNA, 17 bp, Homo sapiens
ttttctgtgcctgaata

SEQ ID NO: 855262 - DNA, 23 bp, Homo sapiens
ttttctgttactttgttttttaa

SEQ ID NO: 855263 - DNA, 21 bp, Homo sapiens
ttttctgttgtacgtaaagct

SEQ ID NO: 855264 - DNA, 21 bp, Homo sapiens
ttttctgtttataattgttta

SEQ ID NO: 855265 - DNA, 9 bp, Homo sapiens
ttttcttaa

SEQ ID NO: 855266 - DNA, 16 bp, Homo sapiens
ttttcttaaagtgcca

SEQ ID NO: 855267 - DNA, 18 bp, Homo sapiens
ttttcttaaagtgccagt

SEQ ID NO: 855268 - DNA, 17 bp, Homo sapiens
ttttcttaaccatcttt

SEQ ID NO: 855269 - DNA, 14 bp, Homo sapiens
ttttcttactttta

SEQ ID NO: 855270 - DNA, 13 bp, Homo sapiens
ttttcttgctgtt

SEQ ID NO: 855271 - DNA, 17 bp, Homo sapiens
ttttcttggtttctgga

SEQ ID NO: 855272 - DNA, 21 bp, Homo sapiens
ttttcttggtttctggataaa

SEQ ID NO: 855273 - DNA, 15 bp, Homo sapiens
ttttcttgtaaatgt

SEQ ID NO: 855274 - DNA, 18 bp, Homo sapiens
ttttcttgttgcatcttt

SEQ ID NO: 855275 - DNA, 19 bp, Homo sapiens
ttttctttaatatgattct

SEQ ID NO: 855276 - DNA, 16 bp, Homo sapiens
ttttctttaatgcttt

SEQ ID NO: 855277 - DNA, 13 bp, Homo sapiens
ttttctttacaca

SEQ ID NO: 855278 - DNA, 17 bp, Homo sapiens
ttttctttctttttctg

SEQ ID NO: 855279 - DNA, 14 bp, Homo sapiens
ttttctttgaaatt

SEQ ID NO: 855280 - DNA, 19 bp, Homo sapiens
ttttctttgaccagatctt

SEQ ID NO: 855281 - DNA, 15 bp, Homo sapiens
ttttctttgcaaagt

SEQ ID NO: 855282 - DNA, 16 bp, Homo sapiens
ttttctttgtgtagct

SEQ ID NO: 855283 - DNA, 12 bp, Homo sapiens
ttttctttgttt

SEQ ID NO: 855284 - DNA, 22 bp, Homo sapiens
ttttcttttattatcagttaaa

SEQ ID NO: 855285 - DNA, 16 bp, Homo sapiens
ttttctttttgaaaca

SEQ ID NO: 855286 - DNA, 21 bp, Homo sapiens
ttttgaaaaatattgctaaaa

SEQ ID NO: 855287 - DNA, 18 bp, Homo sapiens
ttttgaaaatgtttatgc

SEQ ID NO: 855288 - DNA, 13 bp, Homo sapiens
ttttgaaacaaag

SEQ ID NO: 855289 - DNA, 15 bp, Homo sapiens
ttttgaaactgcatt

SEQ ID NO: 855290 - DNA, 13 bp, Homo sapiens
ttttgaaatgggc

SEQ ID NO: 855291 - DNA, 12 bp, Homo sapiens
ttttgaaattgt

SEQ ID NO: 855292 - DNA, 18 bp, Homo sapiens
ttttgaaccaacatcttt

SEQ ID NO: 855293 - DNA, 14 bp, Homo sapiens
ttttgaacttgtca

SEQ ID NO: 855294 - DNA, 16 bp, Homo sapiens
ttttgaacttgtcacg

SEQ ID NO: 855295 - DNA, 16 bp, Homo sapiens
ttttgaagtcttccct

SEQ ID NO: 855296 - DNA, 10 bp, Homo sapiens
ttttgaagtg

SEQ ID NO: 855297 - DNA, 14 bp, Homo sapiens
ttttgaataaaaag

SEQ ID NO: 855298 - DNA, 21 bp, Homo sapiens
ttttgaataaaaagtgaactt

SEQ ID NO: 855299 - DNA, 22 bp, Homo sapiens
ttttgaatgcttcctgacaatc

SEQ ID NO: 855300 - DNA, 14 bp, Homo sapiens
ttttgaatgtcaca

SEQ ID NO: 855301 - DNA, 13 bp, Homo sapiens
ttttgaatgttat

SEQ ID NO: 855302 - DNA, 20 bp, Homo sapiens
ttttgacaaggggcagtggt

SEQ ID NO: 855303 - DNA, 23 bp, Homo sapiens
ttttgacaatcaaagaaaagact

SEQ ID NO: 855304 - DNA, 18 bp, Homo sapiens
ttttgacacctagattat

SEQ ID NO: 855305 - DNA, 12 bp, Homo sapiens
ttttgacactga

SEQ ID NO: 855306 - DNA, 18 bp, Homo sapiens
ttttgacactgaaagttt

SEQ ID NO: 855307 - DNA, 22 bp, Homo sapiens
ttttgacacttttaaaaaacaa

SEQ ID NO: 855308 - DNA, 20 bp, Homo sapiens
ttttgactaaagctatgtta

SEQ ID NO: 855309 - DNA, 22 bp, Homo sapiens
ttttgactaagtttttatacca

SEQ ID NO: 855310 - DNA, 17 bp, Homo sapiens
ttttgacttaatgtgat

SEQ ID NO: 855311 - DNA, 15 bp, Homo sapiens
ttttgagacagtctt

SEQ ID NO: 855312 - DNA, 15 bp, Homo sapiens
ttttgagacatggga

SEQ ID NO: 855313 - DNA, 21 bp, Homo sapiens
ttttgagctactggattctta

SEQ ID NO: 855314 - DNA, 22 bp, Homo sapiens
ttttgagctgaaatgctgcatt

SEQ ID NO: 855315 - DNA, 15 bp, Homo sapiens
ttttgagtaattcaa

SEQ ID NO: 855316 - DNA, 19 bp, Homo sapiens
ttttgagtatttttaaaaa

SEQ ID NO: 855317 - DNA, 18 bp, Homo sapiens
ttttgagtggatgatgtt

SEQ ID NO: 855318 - DNA, 19 bp, Homo sapiens
ttttgagtgtactgtgcct

SEQ ID NO: 855319 - DNA, 14 bp, Homo sapiens
ttttgagtttgcct

SEQ ID NO: 855320 - DNA, 21 bp, Homo sapiens
ttttgagtttgcctcagtaga

SEQ ID NO: 855321 - DNA, 13 bp, Homo sapiens
ttttgataacaat

SEQ ID NO: 855322 - DNA, 21 bp, Homo sapiens
ttttgatgactacctcagaac

SEQ ID NO: 855323 - DNA, 20 bp, Homo sapiens
ttttgatgacttcagtgaaa

SEQ ID NO: 855324 - DNA, 16 bp, Homo sapiens
ttttgatgtaaagatg

SEQ ID NO: 855325 - DNA, 17 bp, Homo sapiens
ttttgatgtatatatct

SEQ ID NO: 855326 - DNA, 20 bp, Homo sapiens
ttttgatgtttgtggcctca

SEQ ID NO: 855327 - DNA, 22 bp, Homo sapiens
ttttgatgtttgtggcctcaga

SEQ ID NO: 855328 - DNA, 22 bp, Homo sapiens
ttttgattaagtggttactttg

SEQ ID NO: 855329 - DNA, 20 bp, Homo sapiens
ttttgattcagctcattatg

SEQ ID NO: 855330 - DNA, 20 bp, Homo sapiens
ttttgatttgtactgaaaaa

SEQ ID NO: 855331 - DNA, 17 bp, Homo sapiens
ttttgcaaagatttaat

SEQ ID NO: 855332 - DNA, 21 bp, Homo sapiens
ttttgcaacctcgctggactc

SEQ ID NO: 855333 - DNA, 19 bp, Homo sapiens
ttttgcaataacttctata

SEQ ID NO: 855334 - DNA, 13 bp, Homo sapiens
ttttgcacccctc

SEQ ID NO: 855335 - DNA, 16 bp, Homo sapiens
ttttgcacccctccca

SEQ ID NO: 855336 - DNA, 16 bp, Homo sapiens
ttttgcacgtcttgct

SEQ ID NO: 855337 - DNA, 23 bp, Homo sapiens
ttttgcacgtcttgctatttgag

SEQ ID NO: 855338 - DNA, 21 bp, Homo sapiens
ttttgcactgaggatattcag

SEQ ID NO: 855339 - DNA, 13 bp, Homo sapiens
ttttgcagtaact

SEQ ID NO: 855340 - DNA, 14 bp, Homo sapiens
ttttgcagtaactg

SEQ ID NO: 855341 - DNA, 18 bp, Homo sapiens
ttttgcatgtcgcacaat

SEQ ID NO: 855342 - DNA, 15 bp, Homo sapiens
ttttgcattccagaa

SEQ ID NO: 855343 - DNA, 20 bp, Homo sapiens
ttttgcattccagaatcttg

SEQ ID NO: 855344 - DNA, 13 bp, Homo sapiens
ttttgcatttatg

SEQ ID NO: 855345 - DNA, 11 bp, Homo sapiens
ttttgcatttc

SEQ ID NO: 855346 - DNA, 16 bp, Homo sapiens
ttttgccacagctttt

SEQ ID NO: 855347 - DNA, 20 bp, Homo sapiens
ttttgccacagcttttgcaa

SEQ ID NO: 855348 - DNA, 22 bp, Homo sapiens
ttttgccactaattttagtatt

SEQ ID NO: 855349 - DNA, 19 bp, Homo sapiens
ttttgccagtattatgcat

SEQ ID NO: 855350 - DNA, 17 bp, Homo sapiens
ttttgcccattttgaat

SEQ ID NO: 855351 - DNA, 14 bp, Homo sapiens
ttttgccctcctgc

SEQ ID NO: 855352 - DNA, 13 bp, Homo sapiens
ttttgccctttga

SEQ ID NO: 855353 - DNA, 12 bp, Homo sapiens
ttttgcctggct

SEQ ID NO: 855354 - DNA, 13 bp, Homo sapiens
ttttgcctggctg

SEQ ID NO: 855355 - DNA, 22 bp, Homo sapiens
ttttgcctggctgtggaggcct

SEQ ID NO: 855356 - DNA, 15 bp, Homo sapiens
ttttgccttttgcaa

SEQ ID NO: 855357 - DNA, 13 bp, Homo sapiens
ttttgctagatgg

SEQ ID NO: 855358 - DNA, 17 bp, Homo sapiens
ttttgctattgtaaata

SEQ ID NO: 855359 - DNA, 11 bp, Homo sapiens
ttttgctccct

SEQ ID NO: 855360 - DNA, 14 bp, Homo sapiens
ttttgctgaattcc

SEQ ID NO: 855361 - DNA, 20 bp, Homo sapiens
ttttgctgaattcctttaca

SEQ ID NO: 855362 - DNA, 16 bp, Homo sapiens
ttttgctggagggaag

SEQ ID NO: 855363 - DNA, 12 bp, Homo sapiens
ttttgctgtata

SEQ ID NO: 855364 - DNA, 11 bp, Homo sapiens
ttttgctgtct

SEQ ID NO: 855365 - DNA, 15 bp, Homo sapiens
ttttgctgtctttct

SEQ ID NO: 855366 - DNA, 23 bp, Homo sapiens
ttttgcttaccttttcctattct

SEQ ID NO: 855367 - DNA, 16 bp, Homo sapiens
ttttgcttgcaatgta

SEQ ID NO: 855368 - DNA, 21 bp, Homo sapiens
ttttgctttcgaactgctagt

SEQ ID NO: 855369 - DNA, 13 bp, Homo sapiens
ttttgcttttcct

SEQ ID NO: 855370 - DNA, 11 bp, Homo sapiens
ttttggaaact

SEQ ID NO: 855371 - DNA, 13 bp, Homo sapiens
ttttggaaactgc

SEQ ID NO: 855372 - DNA, 18 bp, Homo sapiens
ttttggaaattcagaagc

SEQ ID NO: 855373 - DNA, 11 bp, Homo sapiens
ttttggaatca

SEQ ID NO: 855374 - DNA, 17 bp, Homo sapiens
ttttggactccatctct

SEQ ID NO: 855375 - DNA, 16 bp, Homo sapiens
ttttggagtgttatgt

SEQ ID NO: 855376 - DNA, 19 bp, Homo sapiens
ttttggcactgagatattt

SEQ ID NO: 855377 - DNA, 19 bp, Homo sapiens
ttttggcatctctgtccca

SEQ ID NO: 855378 - DNA, 15 bp, Homo sapiens
ttttggccaaagtgt

SEQ ID NO: 855379 - DNA, 16 bp, Homo sapiens
ttttggccaaagtgtt

SEQ ID NO: 855380 - DNA, 15 bp, Homo sapiens
ttttggcctgtttga

SEQ ID NO: 855381 - DNA, 15 bp, Homo sapiens
ttttggctagagttt

SEQ ID NO: 855382 - DNA, 16 bp, Homo sapiens
acttgtttgtcttcca

SEQ ID NO: 855383 - DNA, 16 bp, Homo sapiens
actttaaaaaggaaat

SEQ ID NO: 855384 - DNA, 16 bp, Homo sapiens
actttaaaaccagtta

SEQ ID NO: 855385 - DNA, 13 bp, Homo sapiens
attttatatgatg

SEQ ID NO: 855386 - DNA, 16 bp, Homo sapiens
attttatatgcttact

SEQ ID NO: 855387 - DNA, 23 bp, Homo sapiens
attttatatgcttactgatatat

SEQ ID NO: 855388 - DNA, 20 bp, Homo sapiens
attttatatgtaaatgtgtt

SEQ ID NO: 855389 - DNA, 20 bp, Homo sapiens
attttatatttaaaaattgt

SEQ ID NO: 855390 - DNA, 17 bp, Homo sapiens
attttatcattaaaaat

SEQ ID NO: 855391 - DNA, 20 bp, Homo sapiens
attttatcattaaaaattac

SEQ ID NO: 855392 - DNA, 12 bp, Homo sapiens
attttatcctgt

SEQ ID NO: 855393 - DNA, 14 bp, Homo sapiens
attttatcctgtat

SEQ ID NO: 855394 - DNA, 16 bp, Homo sapiens
attttatcctgtattc

SEQ ID NO: 855395 - DNA, 22 bp, Homo sapiens
attttatcctgtattcttgttt

SEQ ID NO: 855396 - DNA, 15 bp, Homo sapiens
attttatctggaaca

SEQ ID NO: 855397 - DNA, 22 bp, Homo sapiens
attttatctggaacaacttgta

SEQ ID NO: 855398 - DNA, 22 bp, Homo sapiens
attttatctgtttcctgacatt

SEQ ID NO: 855399 - DNA, 21 bp, Homo sapiens
attttatgaacattgtactgt

SEQ ID NO: 855400 - DNA, 19 bp, Homo sapiens
attttatgagagtttggaa

SEQ ID NO: 855401 - DNA, 18 bp, Homo sapiens
attttatgatcagtgttg

SEQ ID NO: 855402 - DNA, 15 bp, Homo sapiens
attttatggtggaaa

SEQ ID NO: 855403 - DNA, 16 bp, Homo sapiens
attttatggttatgtt

SEQ ID NO: 855404 - DNA, 18 bp, Homo sapiens
attttatggttatgtttt

SEQ ID NO: 855405 - DNA, 22 bp, Homo sapiens
attttatgtattctttctgcct

SEQ ID NO: 855406 - DNA, 20 bp, Homo sapiens
attttattaaacaattttgt

SEQ ID NO: 855407 - DNA, 22 bp, Homo sapiens
attttattaaacaattttgtta

SEQ ID NO: 855408 - DNA, 22 bp, Homo sapiens
attttattaagctttttggaat

SEQ ID NO: 855409 - DNA, 19 bp, Homo sapiens
attttattacagaaatgtt

SEQ ID NO: 855410 - DNA, 22 bp, Homo sapiens
attttattatgagctacaacaa

SEQ ID NO: 855411 - DNA, 13 bp, Homo sapiens
attttattcagta

SEQ ID NO: 855412 - DNA, 19 bp, Homo sapiens
attttattcagtagtttga

SEQ ID NO: 855413 - DNA, 17 bp, Homo sapiens
attttattgaaatgtat

SEQ ID NO: 855414 - DNA, 19 bp, Homo sapiens
attttattgaaatgtataa

SEQ ID NO: 855415 - DNA, 14 bp, Homo sapiens
attttattgactgg

SEQ ID NO: 855416 - DNA, 23 bp, Homo sapiens
attttattgactgggcaacactg

SEQ ID NO: 855417 - DNA, 13 bp, Homo sapiens
attttattgtata

SEQ ID NO: 855418 - DNA, 23 bp, Homo sapiens
attttattgtataaaaagtttca

SEQ ID NO: 855419 - DNA, 22 bp, Homo sapiens
attttatttagacaagagatgg

SEQ ID NO: 855420 - DNA, 13 bp, Homo sapiens
attttatttatgg

SEQ ID NO: 855421 - DNA, 16 bp, Homo sapiens
attttatttcaatgta

SEQ ID NO: 855422 - DNA, 19 bp, Homo sapiens
attttatttcaatgtaatt

SEQ ID NO: 855423 - DNA, 21 bp, Homo sapiens
attttatttcaatgtaattaa

SEQ ID NO: 855424 - DNA, 23 bp, Homo sapiens
attttatttcctggacatcctct

SEQ ID NO: 855425 - DNA, 14 bp, Homo sapiens
attttatttgctta

SEQ ID NO: 855426 - DNA, 12 bp, Homo sapiens
attttatttgta

SEQ ID NO: 855427 - DNA, 15 bp, Homo sapiens
attttatttgtattc

SEQ ID NO: 855428 - DNA, 22 bp, Homo sapiens
attttatttgttctttttctga

SEQ ID NO: 855429 - DNA, 14 bp, Homo sapiens
attttattttcatg

SEQ ID NO: 855430 - DNA, 16 bp, Homo sapiens
attttattttgctgag

SEQ ID NO: 855431 - DNA, 19 bp, Homo sapiens
attttattttgctgagttg

SEQ ID NO: 855432 - DNA, 23 bp, Homo sapiens
attttattttgtgctcatttaag

SEQ ID NO: 855433 - DNA, 20 bp, Homo sapiens
attttatttttaaaatatta

SEQ ID NO: 855434 - DNA, 15 bp, Homo sapiens
attttatttttctgt

SEQ ID NO: 855435 - DNA, 14 bp, Homo sapiens
attttatttttgca

SEQ ID NO: 855436 - DNA, 19 bp, Homo sapiens
attttattttttccctcct

SEQ ID NO: 855437 - DNA, 17 bp, Homo sapiens
attttatttttttctac

SEQ ID NO: 855438 - DNA, 15 bp, Homo sapiens
attttcaaacaaaat

SEQ ID NO: 855439 - DNA, 22 bp, Homo sapiens
attttcaaagctttttccagag

SEQ ID NO: 855440 - DNA, 15 bp, Homo sapiens
attttcaaatcctta

SEQ ID NO: 855441 - DNA, 21 bp, Homo sapiens
attttcaaccataaaagaagt

SEQ ID NO: 855442 - DNA, 22 bp, Homo sapiens
attttcaaccataaaagaagtt

SEQ ID NO: 855443 - DNA, 20 bp, Homo sapiens
attttcaactgtcttcctca

SEQ ID NO: 855444 - DNA, 14 bp, Homo sapiens
attttcaagaaact

SEQ ID NO: 855445 - DNA, 16 bp, Homo sapiens
attttcaagaaactga

SEQ ID NO: 855446 - DNA, 24 bp, Homo sapiens
attttcaagaataatcacgctttc

SEQ ID NO: 855447 - DNA, 17 bp, Homo sapiens
attttcaaggccctcag

SEQ ID NO: 855448 - DNA, 15 bp, Homo sapiens
attttcaagtttaca

SEQ ID NO: 855449 - DNA, 17 bp, Homo sapiens
attttcacactggtaaa

SEQ ID NO: 855450 - DNA, 15 bp, Homo sapiens
attttcactgctgct

SEQ ID NO: 855451 - DNA, 14 bp, Homo sapiens
attttcactttgtg

SEQ ID NO: 855452 - DNA, 22 bp, Homo sapiens
attttcacttttggcaatgact

SEQ ID NO: 855453 - DNA, 17 bp, Homo sapiens
attttcagcaaactctt

SEQ ID NO: 855454 - DNA, 18 bp, Homo sapiens
attttcagcaaactcttt

SEQ ID NO: 855455 - DNA, 12 bp, Homo sapiens
attttcagcatt

SEQ ID NO: 855456 - DNA, 23 bp, Homo sapiens
attttcagcccatatttcatcgt

SEQ ID NO: 855457 - DNA, 21 bp, Homo sapiens
attttcagctcaattgttaat

SEQ ID NO: 855458 - DNA, 18 bp, Homo sapiens
attttcagtatactgtgt

SEQ ID NO: 855459 - DNA, 14 bp, Homo sapiens
attttcagtatttt

SEQ ID NO: 855460 - DNA, 22 bp, Homo sapiens
attttcagtcccctctctctgg

SEQ ID NO: 855461 - DNA, 23 bp, Homo sapiens
attttcagtcccctctctctggg

SEQ ID NO: 855462 - DNA, 15 bp, Homo sapiens
attttcagtcttgta

SEQ ID NO: 855463 - DNA, 20 bp, Homo sapiens
attttcataagtatttcaaa

SEQ ID NO: 855464 - DNA, 22 bp, Homo sapiens
attttcataagtatttcaaatt

SEQ ID NO: 855465 - DNA, 16 bp, Homo sapiens
attttcatagatgtgt

SEQ ID NO: 855466 - DNA, 18 bp, Homo sapiens
attttcatagatgtgtta

SEQ ID NO: 855467 - DNA, 13 bp, Homo sapiens
attttcatagtga

SEQ ID NO: 855468 - DNA, 18 bp, Homo sapiens
attttcatgcaaaagttc

SEQ ID NO: 855469 - DNA, 17 bp, Homo sapiens
attttcatgtatatgtg

SEQ ID NO: 855470 - DNA, 13 bp, Homo sapiens
attttcatgtgtg

SEQ ID NO: 855471 - DNA, 18 bp, Homo sapiens
attttcattaaacttgaa

SEQ ID NO: 855472 - DNA, 14 bp, Homo sapiens
attttcattgtgat

SEQ ID NO: 855473 - DNA, 19 bp, Homo sapiens
atttcttatcaccacagta

SEQ ID NO: 855474 - DNA, 14 bp, Homo sapiens
atttcttatgtgac

SEQ ID NO: 855475 - DNA, 15 bp, Homo sapiens
atttcttcaaatctc

SEQ ID NO: 855476 - DNA, 13 bp, Homo sapiens
atttcttcactgt

SEQ ID NO: 855477 - DNA, 15 bp, Homo sapiens
atttcttcagagttt

SEQ ID NO: 855478 - DNA, 21 bp, Homo sapiens
atttcttcataggtagaaaca

SEQ ID NO: 855479 - DNA, 22 bp, Homo sapiens
atttcttcatgtgatgtcatga

SEQ ID NO: 855480 - DNA, 15 bp, Homo sapiens
atttcttcctctgca

SEQ ID NO: 855481 - DNA, 16 bp, Homo sapiens
atttcttcctctgcat

SEQ ID NO: 855482 - DNA, 16 bp, Homo sapiens
atttcttcgctgctct

SEQ ID NO: 855483 - DNA, 17 bp, Homo sapiens
atttcttcgctgctcta

SEQ ID NO: 855484 - DNA, 23 bp, Homo sapiens
atttcttcgctgctctagctggc

SEQ ID NO: 855485 - DNA, 19 bp, Homo sapiens
atttcttcgttctttttaa

SEQ ID NO: 855486 - DNA, 15 bp, Homo sapiens
atttcttctctctgt

SEQ ID NO: 855487 - DNA, 20 bp, Homo sapiens
atttcttctcttatcctctc

SEQ ID NO: 855488 - DNA, 20 bp, Homo sapiens
atttcttcttttcctgcagg

SEQ ID NO: 855489 - DNA, 21 bp, Homo sapiens
atttcttgagttttgttttaa

SEQ ID NO: 855490 - DNA, 14 bp, Homo sapiens
atttcttgcgagcc

SEQ ID NO: 855491 - DNA, 12 bp, Homo sapiens
atttcttgcttt

SEQ ID NO: 855492 - DNA, 12 bp, Homo sapiens
atttcttggcat

SEQ ID NO: 855493 - DNA, 16 bp, Homo sapiens
atttcttggcattgga

SEQ ID NO: 855494 - DNA, 17 bp, Homo sapiens
atttcttggcattggaa

SEQ ID NO: 855495 - DNA, 19 bp, Homo sapiens
atttcttggcattggaatt

SEQ ID NO: 855496 - DNA, 20 bp, Homo sapiens
atttcttgggccctcctgaa

SEQ ID NO: 855497 - DNA, 16 bp, Homo sapiens
atttcttggtattatt

SEQ ID NO: 855498 - DNA, 14 bp, Homo sapiens
atttcttgtttgtt

SEQ ID NO: 855499 - DNA, 20 bp, Homo sapiens
atttctttaaaagaatgact

SEQ ID NO: 855500 - DNA, 21 bp, Homo sapiens
atttctttattttcttctcca

SEQ ID NO: 855501 - DNA, 15 bp, Homo sapiens
atttctttctaactg

SEQ ID NO: 855502 - DNA, 14 bp, Homo sapiens
atttctttctcgaa

SEQ ID NO: 855503 - DNA, 13 bp, Homo sapiens
atttctttcttcc

SEQ ID NO: 855504 - DNA, 21 bp, Homo sapiens
atttctttctttgcaccaaag

SEQ ID NO: 855505 - DNA, 22 bp, Homo sapiens
atttctttctttgcaccaaaga

SEQ ID NO: 855506 - DNA, 12 bp, Homo sapiens
atttctttgaaa

SEQ ID NO: 855507 - DNA, 16 bp, Homo sapiens
atttctttgaaaaaaa

SEQ ID NO: 855508 - DNA, 22 bp, Homo sapiens
atttctttgaaaaaaaataaat

SEQ ID NO: 855509 - DNA, 21 bp, Homo sapiens
atttctttgatctggacagaa

SEQ ID NO: 855510 - DNA, 21 bp, Homo sapiens
atttctttgtctttttcctac

SEQ ID NO: 855511 - DNA, 22 bp, Homo sapiens
atttctttgttatcaaacttca

SEQ ID NO: 855512 - DNA, 22 bp, Homo sapiens
atttcttttccttcattcatag

SEQ ID NO: 855513 - DNA, 20 bp, Homo sapiens
atttcttttgttgtacttta

SEQ ID NO: 855514 - DNA, 21 bp, Homo sapiens
atttcttttgttgtactttat

SEQ ID NO: 855515 - DNA, 18 bp, Homo sapiens
atttctttttaattattt

SEQ ID NO: 855516 - DNA, 15 bp, Homo sapiens
atttcttttttatgt

SEQ ID NO: 855517 - DNA, 14 bp, Homo sapiens
atttgaaaaaaact

SEQ ID NO: 855518 - DNA, 16 bp, Homo sapiens
atttgaaaaaaacttc

SEQ ID NO: 855519 - DNA, 15 bp, Homo sapiens
atttgaaaaaaagca

SEQ ID NO: 855520 - DNA, 15 bp, Homo sapiens
atttgaaaaactttt

SEQ ID NO: 855521 - DNA, 22 bp, Homo sapiens
atttgaaaaagttccatagaaa

SEQ ID NO: 855522 - DNA, 18 bp, Homo sapiens
atttgaaaataattgttc

SEQ ID NO: 855523 - DNA, 12 bp, Homo sapiens
atttgaaaattg

SEQ ID NO: 855524 - DNA, 13 bp, Homo sapiens
atttgaaaattgt

SEQ ID NO: 855525 - DNA, 15 bp, Homo sapiens
atttgaaaattgtat

SEQ ID NO: 855526 - DNA, 15 bp, Homo sapiens
atttgaaataagaat

SEQ ID NO: 855527 - DNA, 16 bp, Homo sapiens
atttgaaatcgttgga

SEQ ID NO: 855528 - DNA, 15 bp, Homo sapiens
atttgaaatttagct

SEQ ID NO: 855529 - DNA, 18 bp, Homo sapiens
atttgaacaaagcagaag

SEQ ID NO: 855530 - DNA, 14 bp, Homo sapiens
atttgaacacatta

SEQ ID NO: 855531 - DNA, 16 bp, Homo sapiens
atttgaagaaaaaaat

SEQ ID NO: 855532 - DNA, 16 bp, Homo sapiens
atttgaagatgtggat

SEQ ID NO: 855533 - DNA, 16 bp, Homo sapiens
atttgaagcaaagcac

SEQ ID NO: 855534 - DNA, 17 bp, Homo sapiens
atttgaagtgtacctgt

SEQ ID NO: 855535 - DNA, 22 bp, Homo sapiens
atttgaagtgtacctgtgtaca

SEQ ID NO: 855536 - DNA, 18 bp, Homo sapiens
atttgaataaatgagaaa

SEQ ID NO: 855537 - DNA, 15 bp, Homo sapiens
atttgaatgaaaaat

SEQ ID NO: 855538 - DNA, 16 bp, Homo sapiens
atttgaatgaaaaatt

SEQ ID NO: 855539 - DNA, 15 bp, Homo sapiens
atttgaatgaaaaca

SEQ ID NO: 855540 - DNA, 20 bp, Homo sapiens
atttgaatgatttttcttta

SEQ ID NO: 855541 - DNA, 18 bp, Homo sapiens
atttgaatgggtccattt

SEQ ID NO: 855542 - DNA, 22 bp, Homo sapiens
atttgaatgtgtgaattcaata

SEQ ID NO: 855543 - DNA, 20 bp, Homo sapiens
atttgaattcttgatctcta

SEQ ID NO: 855544 - DNA, 19 bp, Homo sapiens
atttgacacaaagcttcta

SEQ ID NO: 855545 - DNA, 19 bp, Homo sapiens
atttgacgttgttgtcatt

SEQ ID NO: 855546 - DNA, 13 bp, Homo sapiens
atttgactaattt

SEQ ID NO: 855547 - DNA, 12 bp, Homo sapiens
attttctaaata

SEQ ID NO: 855548 - DNA, 22 bp, Homo sapiens
attttctaagacagtttttata

SEQ ID NO: 855549 - DNA, 15 bp, Homo sapiens
attttctacaattaa

SEQ ID NO: 855550 - DNA, 21 bp, Homo sapiens
attttctacgtcatgtatttt

SEQ ID NO: 855551 - DNA, 16 bp, Homo sapiens
attttctactgtaaga

SEQ ID NO: 855552 - DNA, 18 bp, Homo sapiens
attttctagaaatgttta

SEQ ID NO: 855553 - DNA, 19 bp, Homo sapiens
attttctagactttctgtt

SEQ ID NO: 855554 - DNA, 22 bp, Homo sapiens
attttctatcccccttaaagaa

SEQ ID NO: 855555 - DNA, 23 bp, Homo sapiens
attttctcccaggaagctttgat

SEQ ID NO: 855556 - DNA, 12 bp, Homo sapiens
attttctctcca

SEQ ID NO: 855557 - DNA, 18 bp, Homo sapiens
attttctgatgtattaca

SEQ ID NO: 855558 - DNA, 22 bp, Homo sapiens
attttctggaatacatgaaata

SEQ ID NO: 855559 - DNA, 14 bp, Homo sapiens
attttctgtcagat

SEQ ID NO: 855560 - DNA, 16 bp, Homo sapiens
attttctgtgcctgaa

SEQ ID NO: 855561 - DNA, 18 bp, Homo sapiens
attttctgtgcctgaata

SEQ ID NO: 855562 - DNA, 20 bp, Homo sapiens
attttctgtgcctgaatatt

SEQ ID NO: 855563 - DNA, 19 bp, Homo sapiens
attttctgtgggcaggcct

SEQ ID NO: 855564 - DNA, 21 bp, Homo sapiens
attttcttacccaatttccca

SEQ ID NO: 855565 - DNA, 10 bp, Homo sapiens
attttcttca

SEQ ID NO: 855566 - DNA, 16 bp, Homo sapiens
attttcttcacagtgc

SEQ ID NO: 855567 - DNA, 22 bp, Homo sapiens
attttcttcacagtgcagcttg

SEQ ID NO: 855568 - DNA, 17 bp, Homo sapiens
attttcttcatctttgc

SEQ ID NO: 855569 - DNA, 19 bp, Homo sapiens
attttctttaatgctttta

SEQ ID NO: 855570 - DNA, 14 bp, Homo sapiens
attttctttatgga

SEQ ID NO: 855571 - DNA, 21 bp, Homo sapiens
attttctttctttttctggaa

SEQ ID NO: 855572 - DNA, 23 bp, Homo sapiens
attttctttgtgtagctttgctc

SEQ ID NO: 855573 - DNA, 15 bp, Homo sapiens
attttcttttattat

SEQ ID NO: 855574 - DNA, 16 bp, Homo sapiens
attttcttttgtaaat

SEQ ID NO: 855575 - DNA, 17 bp, Homo sapiens
attttctttttaaattt

SEQ ID NO: 855576 - DNA, 22 bp, Homo sapiens
attttcttttttatcttgcact

SEQ ID NO: 855577 - DNA, 22 bp, Homo sapiens
attttgaaacaaagtactcttt

SEQ ID NO: 855578 - DNA, 13 bp, Homo sapiens
attttgaaattgt

SEQ ID NO: 855579 - DNA, 18 bp, Homo sapiens
attttgaacgcttaagtc

SEQ ID NO: 855580 - DNA, 13 bp, Homo sapiens
attttgaaggaaa

SEQ ID NO: 855581 - DNA, 22 bp, Homo sapiens
attttgaataccattaaaactg

SEQ ID NO: 855582 - DNA, 14 bp, Homo sapiens
attttgaatcaata

SEQ ID NO: 855583 - DNA, 16 bp, Homo sapiens
attttgacaaagtgcc

SEQ ID NO: 855584 - DNA, 18 bp, Homo sapiens
attttgacactgaaataa

SEQ ID NO: 855585 - DNA, 24 bp, Homo sapiens
attttgacagttattttgataaca

SEQ ID NO: 855586 - DNA, 17 bp, Homo sapiens
attttgacataaagttg

SEQ ID NO: 855587 - DNA, 24 bp, Homo sapiens
attttgacataaagttgataaaga

SEQ ID NO: 855588 - DNA, 18 bp, Homo sapiens
attttgacctactctcat

SEQ ID NO: 855589 - DNA, 18 bp, Homo sapiens
attttgacggacactgtg

SEQ ID NO: 855590 - DNA, 21 bp, Homo sapiens
attttgagtcctaggacttaa

SEQ ID NO: 855591 - DNA, 22 bp, Homo sapiens
attttgagtcctaggacttaaa

SEQ ID NO: 855592 - DNA, 13 bp, Homo sapiens
attttgagtgaat

SEQ ID NO: 855593 - DNA, 19 bp, Homo sapiens
attttgatacaaatgttta

SEQ ID NO: 855594 - DNA, 19 bp, Homo sapiens
attttgataccagaaggga

SEQ ID NO: 855595 - DNA, 18 bp, Homo sapiens
attttgatatacattgtg

SEQ ID NO: 855596 - DNA, 19 bp, Homo sapiens
attttgatatacattgtgt

SEQ ID NO: 855597 - DNA, 15 bp, Homo sapiens
attttgatgttttaa

SEQ ID NO: 855598 - DNA, 19 bp, Homo sapiens
attttgcaaaatttccagt

SEQ ID NO: 855599 - DNA, 13 bp, Homo sapiens
attttgcaaagat

SEQ ID NO: 855600 - DNA, 21 bp, Homo sapiens
attttgcaaagatttaatctg

SEQ ID NO: 855601 - DNA, 18 bp, Homo sapiens
attttgcaaggtgcattt

SEQ ID NO: 855602 - DNA, 21 bp, Homo sapiens
attttgcaatcccttaatatc

SEQ ID NO: 855603 - DNA, 14 bp, Homo sapiens
attttgcagaagga

SEQ ID NO: 855604 - DNA, 17 bp, Homo sapiens
attttgcagaaggaaat

SEQ ID NO: 855605 - DNA, 18 bp, Homo sapiens
attttgcagaaggaaatg

SEQ ID NO: 855606 - DNA, 14 bp, Homo sapiens
attttgcagcagtg

SEQ ID NO: 855607 - DNA, 15 bp, Homo sapiens
attttgcattcaaat

SEQ ID NO: 855608 - DNA, 15 bp, Homo sapiens
attttgcattccaga

SEQ ID NO: 855609 - DNA, 12 bp, Homo sapiens
attttgcattta

SEQ ID NO: 855610 - DNA, 15 bp, Homo sapiens
attttgccagactta

SEQ ID NO: 855611 - DNA, 16 bp, Homo sapiens
attttgccagttggac

SEQ ID NO: 855612 - DNA, 14 bp, Homo sapiens
attttgccctcctg

SEQ ID NO: 855613 - DNA, 17 bp, Homo sapiens
attttgccctcctgccc

SEQ ID NO: 855614 - DNA, 18 bp, Homo sapiens
attttgcctcttttctct

SEQ ID NO: 855615 - DNA, 21 bp, Homo sapiens
attttgctattgtaaatatgt

SEQ ID NO: 855616 - DNA, 22 bp, Homo sapiens
attttgctattgtaaatatgtt

SEQ ID NO: 855617 - DNA, 14 bp, Homo sapiens
attttgctccctct

SEQ ID NO: 855618 - DNA, 17 bp, Homo sapiens
attttgctccctctgtt

SEQ ID NO: 855619 - DNA, 16 bp, Homo sapiens
attttgctgagttgtt

SEQ ID NO: 855620 - DNA, 19 bp, Homo sapiens
attttgctgagttgttcta

SEQ ID NO: 855621 - DNA, 18 bp, Homo sapiens
attttgcttctctttcta

SEQ ID NO: 855622 - DNA, 13 bp, Homo sapiens
attttgctttggt

SEQ ID NO: 855623 - DNA, 22 bp, Homo sapiens
attttgctttgtctttctctcc

SEQ ID NO: 855624 - DNA, 18 bp, Homo sapiens
attttgctttgtgatttt

SEQ ID NO: 855625 - DNA, 16 bp, Homo sapiens
attttggaaactgcta

SEQ ID NO: 855626 - DNA, 19 bp, Homo sapiens
attttggaaactgctaaat

SEQ ID NO: 855627 - DNA, 22 bp, Homo sapiens
attttggaagaagttttttact

SEQ ID NO: 855628 - DNA, 21 bp, Homo sapiens
attttggaataagcattgttt

SEQ ID NO: 855629 - DNA, 20 bp, Homo sapiens
attttggaatatttgcttta

SEQ ID NO: 855630 - DNA, 19 bp, Homo sapiens
attttggataaatcatttc

SEQ ID NO: 855631 - DNA, 15 bp, Homo sapiens
attttggatgtcatt

SEQ ID NO: 855632 - DNA, 22 bp, Homo sapiens
attttggcgaatctcaaaatta

SEQ ID NO: 855633 - DNA, 19 bp, Homo sapiens
attttggcttcatttcaat

SEQ ID NO: 855634 - DNA, 20 bp, Homo sapiens
attttggcttcatttcaatc

SEQ ID NO: 855635 - DNA, 19 bp, Homo sapiens
attttggctttctccctgt

SEQ ID NO: 855636 - DNA, 15 bp, Homo sapiens
attttgggaatcttt

SEQ ID NO: 855637 - DNA, 18 bp, Homo sapiens
attttgggcctgttcctt

SEQ ID NO: 855638 - DNA, 23 bp, Homo sapiens
attttggggaagggtttgaattg

SEQ ID NO: 855639 - DNA, 18 bp, Homo sapiens
attttggggattttcaaa

SEQ ID NO: 855640 - DNA, 21 bp, Homo sapiens
attttggtaagagacagaatg

SEQ ID NO: 855641 - DNA, 13 bp, Homo sapiens
attttggtaatga

SEQ ID NO: 855642 - DNA, 21 bp, Homo sapiens
attttggtaatgatgttgata

SEQ ID NO: 855643 - DNA, 13 bp, Homo sapiens
attcattgtctct

SEQ ID NO: 855644 - DNA, 16 bp, Homo sapiens
attcatttaaaatgat

SEQ ID NO: 855645 - DNA, 12 bp, Homo sapiens
attcatttcctg

SEQ ID NO: 855646 - DNA, 12 bp, Homo sapiens
attcatttctaa

SEQ ID NO: 855647 - DNA, 13 bp, Homo sapiens
attcatttctaga

SEQ ID NO: 855648 - DNA, 19 bp, Homo sapiens
attcatttgagttatttta

SEQ ID NO: 855649 - DNA, 12 bp, Homo sapiens
attcatttgtat

SEQ ID NO: 855650 - DNA, 18 bp, Homo sapiens
attcatttgtattgctta

SEQ ID NO: 855651 - DNA, 23 bp, Homo sapiens
attcatttgtattgcttatttta

SEQ ID NO: 855652 - DNA, 14 bp, Homo sapiens
attcattttcctgt

SEQ ID NO: 855653 - DNA, 15 bp, Homo sapiens
attcattttcctgtt

SEQ ID NO: 855654 - DNA, 24 bp, Homo sapiens
attcattttcctgttcagtgagat

SEQ ID NO: 855655 - DNA, 21 bp, Homo sapiens
attcattttctagatacaata

SEQ ID NO: 855656 - DNA, 22 bp, Homo sapiens
attcattttctagatacaataa

SEQ ID NO: 855657 - DNA, 16 bp, Homo sapiens
attcatttttaccttg

SEQ ID NO: 855658 - DNA, 17 bp, Homo sapiens
attcattttttaaattc

SEQ ID NO: 855659 - DNA, 17 bp, Homo sapiens
attccaaaaagcacata

SEQ ID NO: 855660 - DNA, 13 bp, Homo sapiens
attccaaaatatt

SEQ ID NO: 855661 - DNA, 14 bp, Homo sapiens
attccaaaatatta

SEQ ID NO: 855662 - DNA, 20 bp, Homo sapiens
attccaaagagtagaattgc

SEQ ID NO: 855663 - DNA, 23 bp, Homo sapiens
attccaaagctttattaccagtg

SEQ ID NO: 855664 - DNA, 14 bp, Homo sapiens
attccaacagctca

SEQ ID NO: 855665 - DNA, 15 bp, Homo sapiens
attccaacagtgagt

SEQ ID NO: 855666 - DNA, 16 bp, Homo sapiens
attccaacttgaagga

SEQ ID NO: 855667 - DNA, 19 bp, Homo sapiens
attccaacttgaaggattg

SEQ ID NO: 855668 - DNA, 14 bp, Homo sapiens
attccaagaaaata

SEQ ID NO: 855669 - DNA, 16 bp, Homo sapiens
attccaagaaaatatc

SEQ ID NO: 855670 - DNA, 19 bp, Homo sapiens
attccaagcttcatattaa

SEQ ID NO: 855671 - DNA, 13 bp, Homo sapiens
attccaaggaaaa

SEQ ID NO: 855672 - DNA, 21 bp, Homo sapiens
attccaaggaaaattgaaagt

SEQ ID NO: 855673 - DNA, 21 bp, Homo sapiens
attccaaggctttaaagctga

SEQ ID NO: 855674 - DNA, 22 bp, Homo sapiens
attccaaggctttaaagctgag

SEQ ID NO: 855675 - DNA, 22 bp, Homo sapiens
attccaagtgcatttttcttat

SEQ ID NO: 855676 - DNA, 17 bp, Homo sapiens
attccaatatgatgact

SEQ ID NO: 855677 - DNA, 14 bp, Homo sapiens
attccaattctaaa

SEQ ID NO: 855678 - DNA, 21 bp, Homo sapiens
attggcttaaagtgaaggaaa

SEQ ID NO: 855679 - DNA, 22 bp, Homo sapiens
attggcttaaagtgaaggaaat

SEQ ID NO: 855680 - DNA, 23 bp, Homo sapiens
attggctttgggttgcaggacct

SEQ ID NO: 855681 - DNA, 14 bp, Homo sapiens
attggctttgtgct

SEQ ID NO: 855682 - DNA, 17 bp, Homo sapiens
attgggaagctggggga

SEQ ID NO: 855683 - DNA, 20 bp, Homo sapiens
attgggagtccaggcacagg

SEQ ID NO: 855684 - DNA, 22 bp, Homo sapiens
attgggagtccaggcacaggat

SEQ ID NO: 855685 - DNA, 14 bp, Homo sapiens
attgggatctgtct

SEQ ID NO: 855686 - DNA, 22 bp, Homo sapiens
attgggcacagtccagacccaa

SEQ ID NO: 855687 - DNA, 19 bp, Homo sapiens
attggggaagactgtggct

SEQ ID NO: 855688 - DNA, 16 bp, Homo sapiens
attggggaattaaata

SEQ ID NO: 855689 - DNA, 18 bp, Homo sapiens
attggggaattaaatagt

SEQ ID NO: 855690 - DNA, 20 bp, Homo sapiens
attggggaattaaatagtgt

SEQ ID NO: 855691 - DNA, 14 bp, Homo sapiens
attggggaggaggg

SEQ ID NO: 855692 - DNA, 14 bp, Homo sapiens
attggggagggaga

SEQ ID NO: 855693 - DNA, 19 bp, Homo sapiens
attgggggctggtgccagc

SEQ ID NO: 855694 - DNA, 20 bp, Homo sapiens
attggggtgataaggggcct

SEQ ID NO: 855695 - DNA, 18 bp, Homo sapiens
attgggtcatagaaattc

SEQ ID NO: 855696 - DNA, 22 bp, Homo sapiens
attgggtcccgcttagttcttg

SEQ ID NO: 855697 - DNA, 22 bp, Homo sapiens
attgggtgaatatggtggaaaa

SEQ ID NO: 855698 - DNA, 18 bp, Homo sapiens
attgggtgggtaaattca

SEQ ID NO: 855699 - DNA, 13 bp, Homo sapiens
attgggtgtagat

SEQ ID NO: 855700 - DNA, 19 bp, Homo sapiens
attgggtttggggccatgg

SEQ ID NO: 855701 - DNA, 18 bp, Homo sapiens
attgggtttttattgttg

SEQ ID NO: 855702 - DNA, 19 bp, Homo sapiens
attggtaaaaacagcagct

SEQ ID NO: 855703 - DNA, 22 bp, Homo sapiens
attggtaaaaacagcagctcat

SEQ ID NO: 855704 - DNA, 21 bp, Homo sapiens
attggtaaaactcactgtgat

SEQ ID NO: 855705 - DNA, 21 bp, Homo sapiens
attggtaactaggatatgtat

SEQ ID NO: 855706 - DNA, 13 bp, Homo sapiens
attggtaattaaa

SEQ ID NO: 855707 - DNA, 15 bp, Homo sapiens
attggtaattacctg

SEQ ID NO: 855708 - DNA, 22 bp, Homo sapiens
attggtaattacctggagaaga

SEQ ID NO: 855709 - DNA, 15 bp, Homo sapiens
attggtccagcttgc

SEQ ID NO: 855710 - DNA, 14 bp, Homo sapiens
attggtctaattta

SEQ ID NO: 855711 - DNA, 15 bp, Homo sapiens
attggtctctatctc

SEQ ID NO: 855712 - DNA, 23 bp, Homo sapiens
attggtctctatctcctgaatct

SEQ ID NO: 855713 - DNA, 19 bp, Homo sapiens
attggtgacgatgggtgtt

SEQ ID NO: 855714 - DNA, 12 bp, Homo sapiens
attggtgactca

SEQ ID NO: 855715 - DNA, 22 bp, Homo sapiens
attggtgcttcagccctggccc

SEQ ID NO: 855716 - DNA, 22 bp, Homo sapiens
attggtgttcgtttccatcatg

SEQ ID NO: 855717 - DNA, 17 bp, Homo sapiens
attggttaaaatgtgat

SEQ ID NO: 855718 - DNA, 13 bp, Homo sapiens
attggttaatttt

SEQ ID NO: 855719 - DNA, 15 bp, Homo sapiens
attggttaattttta

SEQ ID NO: 855720 - DNA, 23 bp, Homo sapiens
attggttactggtgatgttgaaa

SEQ ID NO: 855721 - DNA, 15 bp, Homo sapiens
attggttagtattta

SEQ ID NO: 855722 - DNA, 19 bp, Homo sapiens
attggttctgttttcgtac

SEQ ID NO: 855723 - DNA, 21 bp, Homo sapiens
attggttcttcccctcatagt

SEQ ID NO: 855724 - DNA, 23 bp, Homo sapiens
attggttcttcctttccctggag

SEQ ID NO: 855725 - DNA, 17 bp, Homo sapiens
attggttgtttaacact

SEQ ID NO: 855726 - DNA, 17 bp, Homo sapiens
attggtttaaagaaagt

SEQ ID NO: 855727 - DNA, 22 bp, Homo sapiens
attgtaaaaaaggttttctata

SEQ ID NO: 855728 - DNA, 18 bp, Homo sapiens
attgtaaaacattcacac

SEQ ID NO: 855729 - DNA, 15 bp, Homo sapiens
attgtaaaatagctt

SEQ ID NO: 855730 - DNA, 19 bp, Homo sapiens
attgtaaaatagcttgtat

SEQ ID NO: 855731 - DNA, 15 bp, Homo sapiens
attgtaaacatgtgt

SEQ ID NO: 855732 - DNA, 12 bp, Homo sapiens
attgtaaagtaa

SEQ ID NO: 855733 - DNA, 14 bp, Homo sapiens
attgtaaagtatgt

SEQ ID NO: 855734 - DNA, 16 bp, Homo sapiens
attgtaaagtatgtga

SEQ ID NO: 855735 - DNA, 14 bp, Homo sapiens
attgtaaatactgg

SEQ ID NO: 855736 - DNA, 19 bp, Homo sapiens
attgtaaatactggactca

SEQ ID NO: 855737 - DNA, 17 bp, Homo sapiens
attgtaaatattttgat

SEQ ID NO: 855738 - DNA, 16 bp, Homo sapiens
attgtaaatctgaaga

SEQ ID NO: 855739 - DNA, 17 bp, Homo sapiens
attgtaaatctgaagaa

SEQ ID NO: 855740 - DNA, 18 bp, Homo sapiens
attgtaaatctgaagaaa

SEQ ID NO: 855741 - DNA, 14 bp, Homo sapiens
attgtaaatgtgga

SEQ ID NO: 855742 - DNA, 17 bp, Homo sapiens
attgtaaattgaatcag

SEQ ID NO: 855743 - DNA, 19 bp, Homo sapiens
attgtaaattttagagcat

SEQ ID NO: 855744 - DNA, 20 bp, Homo sapiens
attgtaaattttagagcata

SEQ ID NO: 855745 - DNA, 18 bp, Homo sapiens
attgtaacctgcattttt

SEQ ID NO: 855746 - DNA, 19 bp, Homo sapiens
attgtaactattaaccttt

SEQ ID NO: 855747 - DNA, 16 bp, Homo sapiens
attgtaaggtctttgt

SEQ ID NO: 855748 - DNA, 13 bp, Homo sapiens
attgtaatctttc

SEQ ID NO: 855749 - DNA, 20 bp, Homo sapiens
attgtacaaatgtaagcaaa

SEQ ID NO: 855750 - DNA, 20 bp, Homo sapiens
attgtacagaatcattgctt

SEQ ID NO: 855751 - DNA, 17 bp, Homo sapiens
attgtacagactgtttt

SEQ ID NO: 855752 - DNA, 22 bp, Homo sapiens
attgtacagactgttttactgt

SEQ ID NO: 855753 - DNA, 19 bp, Homo sapiens
attgtacatagcatgttta

SEQ ID NO: 855754 - DNA, 15 bp, Homo sapiens
attgtacatatttgt

SEQ ID NO: 855755 - DNA, 20 bp, Homo sapiens
attgtacattttgtaaaata

SEQ ID NO: 855756 - DNA, 16 bp, Homo sapiens
attgtacctatttctg

SEQ ID NO: 855757 - DNA, 18 bp, Homo sapiens
attgtacctatttctgat

SEQ ID NO: 855758 - DNA, 22 bp, Homo sapiens
attgtacctatttctgatgatg

SEQ ID NO: 855759 - DNA, 18 bp, Homo sapiens
attgtacctctcttatag

SEQ ID NO: 855760 - DNA, 16 bp, Homo sapiens
attgtactaatctgag

SEQ ID NO: 855761 - DNA, 18 bp, Homo sapiens
attgtactcaatggattt

SEQ ID NO: 855762 - DNA, 17 bp, Homo sapiens
attgtactccagcctgg

SEQ ID NO: 855763 - DNA, 19 bp, Homo sapiens
attgtactgttgctttaat

SEQ ID NO: 855764 - DNA, 22 bp, Homo sapiens
attgtacttagccagttcaaag

SEQ ID NO: 855765 - DNA, 15 bp, Homo sapiens
attgtagcatttctt

SEQ ID NO: 855766 - DNA, 18 bp, Homo sapiens
attgtagctttttattaa

SEQ ID NO: 855767 - DNA, 19 bp, Homo sapiens
attgtagggttattagtcc

SEQ ID NO: 855768 - DNA, 18 bp, Homo sapiens
attgtagtgcaaaatggt

SEQ ID NO: 855769 - DNA, 14 bp, Homo sapiens
attgtagttaatga

SEQ ID NO: 855770 - DNA, 16 bp, Homo sapiens
attgtagttctgtgta

SEQ ID NO: 855771 - DNA, 17 bp, Homo sapiens
attgtataccaatgtgt

SEQ ID NO: 855772 - DNA, 19 bp, Homo sapiens
attgtataccaatgtgttt

SEQ ID NO: 855773 - DNA, 18 bp, Homo sapiens
attgtatagatataatga

SEQ ID NO: 855774 - DNA, 13 bp, Homo sapiens
attgtataggcca

SEQ ID NO: 855775 - DNA, 23 bp, Homo sapiens
attgtataggccatctgtaaata

SEQ ID NO: 855776 - DNA, 17 bp, Homo sapiens
attgtatattacaatga

SEQ ID NO: 855777 - DNA, 20 bp, Homo sapiens
attgtatattacaatgatca

SEQ ID NO: 855778 - DNA, 14 bp, Homo sapiens
attgtatattctgg

SEQ ID NO: 855779 - DNA, 16 bp, Homo sapiens
attgtatattctggaa

SEQ ID NO: 855780 - DNA, 18 bp, Homo sapiens
attgtatattctggaaaa

SEQ ID NO: 855781 - DNA, 17 bp, Homo sapiens
attgtatattgtgtttg

SEQ ID NO: 855782 - DNA, 18 bp, Homo sapiens
attgtatatttttatcta

SEQ ID NO: 855783 - DNA, 14 bp, Homo sapiens
attgtatctagtgc

SEQ ID NO: 855784 - DNA, 12 bp, Homo sapiens
attgtatgatgt

SEQ ID NO: 855785 - DNA, 15 bp, Homo sapiens
attgtatttatgtgt

SEQ ID NO: 855786 - DNA, 22 bp, Homo sapiens
attgtattttatatgagagaat

SEQ ID NO: 855787 - DNA, 13 bp, Homo sapiens
attgtcacttttt

SEQ ID NO: 855788 - DNA, 19 bp, Homo sapiens
attgttttctttttctacc

SEQ ID NO: 855789 - DNA, 15 bp, Homo sapiens
attgttttgcacttt

SEQ ID NO: 855790 - DNA, 15 bp, Homo sapiens
attgttttttaaaga

SEQ ID NO: 855791 - DNA, 14 bp, Homo sapiens
atttaaaaaaaatc

SEQ ID NO: 855792 - DNA, 14 bp, Homo sapiens
atttaaaaaaatca

SEQ ID NO: 855793 - DNA, 21 bp, Homo sapiens
atttaaaaaaatcacaaaaat

SEQ ID NO: 855794 - DNA, 17 bp, Homo sapiens
atttaaaaaactaaaaa

SEQ ID NO: 855795 - DNA, 13 bp, Homo sapiens
atttaaaaacaac

SEQ ID NO: 855796 - DNA, 15 bp, Homo sapiens
atttaaaaactggaa

SEQ ID NO: 855797 - DNA, 13 bp, Homo sapiens
atttaaaaacttg

SEQ ID NO: 855798 - DNA, 14 bp, Homo sapiens
atttaaaaacttgt

SEQ ID NO: 855799 - DNA, 21 bp, Homo sapiens
atttaaaaaggtttaaaacta

SEQ ID NO: 855800 - DNA, 21 bp, Homo sapiens
atttaaaaagtgctatactaa

SEQ ID NO: 855801 - DNA, 15 bp, Homo sapiens
atttaaaaatatatt

SEQ ID NO: 855802 - DNA, 15 bp, Homo sapiens
atttaaaaatgtctt

SEQ ID NO: 855803 - DNA, 18 bp, Homo sapiens
atttaaaacagacactgg

SEQ ID NO: 855804 - DNA, 12 bp, Homo sapiens
atttaaaacatt

SEQ ID NO: 855805 - DNA, 13 bp, Homo sapiens
atttaaaactctg

SEQ ID NO: 855806 - DNA, 13 bp, Homo sapiens
atttaaaactgtt

SEQ ID NO: 855807 - DNA, 11 bp, Homo sapiens
atttaaaactt

SEQ ID NO: 855808 - DNA, 15 bp, Homo sapiens
atttaaaagacactg

SEQ ID NO: 855809 - DNA, 13 bp, Homo sapiens
atttaaaagatac

SEQ ID NO: 855810 - DNA, 16 bp, Homo sapiens
atttaaaagatacagt

SEQ ID NO: 855811 - DNA, 14 bp, Homo sapiens
atttaaaagcctgc

SEQ ID NO: 855812 - DNA, 15 bp, Homo sapiens
atttaaaagctccta

SEQ ID NO: 855813 - DNA, 16 bp, Homo sapiens
atttaaaataattata

SEQ ID NO: 855814 - DNA, 13 bp, Homo sapiens
atttaaaatagca

SEQ ID NO: 855815 - DNA, 18 bp, Homo sapiens
atttaaaatagcaaaaga

SEQ ID NO: 855816 - DNA, 23 bp, Homo sapiens
atttaaaatagcaaaagaagaag

SEQ ID NO: 855817 - DNA, 16 bp, Homo sapiens
atttaaaatgattaga

SEQ ID NO: 855818 - DNA, 20 bp, Homo sapiens
atttaaaatgctcaatttca

SEQ ID NO: 855819 - DNA, 19 bp, Homo sapiens
atttaaaattaagtagaac

SEQ ID NO: 855820 - DNA, 12 bp, Homo sapiens
atttaaaattat

SEQ ID NO: 855821 - DNA, 21 bp, Homo sapiens
atttaaaattgctatgttact

SEQ ID NO: 855822 - DNA, 13 bp, Homo sapiens
atttaaaattggc

SEQ ID NO: 855823 - DNA, 16 bp, Homo sapiens
atttaaaattggcacc

SEQ ID NO: 855824 - DNA, 15 bp, Homo sapiens
atttaaacacacaga

SEQ ID NO: 855825 - DNA, 19 bp, Homo sapiens
atttaaacaggcccagcat

SEQ ID NO: 855826 - DNA, 24 bp, Homo sapiens
atttaaaccgctaaaagaaacttt

SEQ ID NO: 855827 - DNA, 11 bp, Homo sapiens
atttaaacctt

SEQ ID NO: 855828 - DNA, 14 bp, Homo sapiens
atttaaacctttta

SEQ ID NO: 855829 - DNA, 16 bp, Homo sapiens
atttaaacctttttct

SEQ ID NO: 855830 - DNA, 21 bp, Homo sapiens
atttaaactaaattactgttt

SEQ ID NO: 855831 - DNA, 20 bp, Homo sapiens
atttaaactataagcaagaa

SEQ ID NO: 855832 - DNA, 16 bp, Homo sapiens
atttaaactttttaaa

SEQ ID NO: 855833 - DNA, 19 bp, Homo sapiens
atttaaagaacaccctata

SEQ ID NO: 855834 - DNA, 15 bp, Homo sapiens
atttaaagcaggttc

SEQ ID NO: 855835 - DNA, 20 bp, Homo sapiens
atttaaagcaggttcttgtt

SEQ ID NO: 855836 - DNA, 17 bp, Homo sapiens
atttaaagctaaatttt

SEQ ID NO: 855837 - DNA, 21 bp, Homo sapiens
atttaaagctttcaacatgta

SEQ ID NO: 855838 - DNA, 18 bp, Homo sapiens
atttaaagggaaaaccct

SEQ ID NO: 855839 - DNA, 18 bp, Homo sapiens
atttaaataaaatcacca

SEQ ID NO: 855840 - DNA, 13 bp, Homo sapiens
atttaaatataat

SEQ ID NO: 855841 - DNA, 15 bp, Homo sapiens
atttaaatataattc

SEQ ID NO: 855842 - DNA, 18 bp, Homo sapiens
atttaaatataattctgt

SEQ ID NO: 855843 - DNA, 22 bp, Homo sapiens
atttaaatataattctgtaaat

SEQ ID NO: 855844 - DNA, 23 bp, Homo sapiens
atttaaatataattctgtaaatg

SEQ ID NO: 855845 - DNA, 20 bp, Homo sapiens
atttaaatcctgaagagcat

SEQ ID NO: 855846 - DNA, 15 bp, Homo sapiens
atttaaatgaaagga

SEQ ID NO: 855847 - DNA, 12 bp, Homo sapiens
atttaaatgcat

SEQ ID NO: 855848 - DNA, 16 bp, Homo sapiens
atttaaatgcatgtct

SEQ ID NO: 855849 - DNA, 20 bp, Homo sapiens
atttaaatgcatgtcttaaa

SEQ ID NO: 855850 - DNA, 18 bp, Homo sapiens
atttaaatgtaacttatt

SEQ ID NO: 855851 - DNA, 14 bp, Homo sapiens
atttaaattggtca

SEQ ID NO: 855852 - DNA, 16 bp, Homo sapiens
atttaaatttaagtaa

SEQ ID NO: 855853 - DNA, 17 bp, Homo sapiens
atttaacaaaaaatgta

SEQ ID NO: 855854 - DNA, 19 bp, Homo sapiens
atttaacaaaaaatgtaat

SEQ ID NO: 855855 - DNA, 13 bp, Homo sapiens
atttaacagaaat

SEQ ID NO: 855856 - DNA, 16 bp, Homo sapiens
atttaacagaaattgt

SEQ ID NO: 855857 - DNA, 22 bp, Homo sapiens
atttaacagaaattgtatattg

SEQ ID NO: 855858 - DNA, 21 bp, Homo sapiens
atttaacagctgaattatcta

SEQ ID NO: 855859 - DNA, 22 bp, Homo sapiens
atttaacagctgaattatctat

SEQ ID NO: 855860 - DNA, 15 bp, Homo sapiens
atttaacagtcattt

SEQ ID NO: 855861 - DNA, 16 bp, Homo sapiens
atttaacagtcattta

SEQ ID NO: 855862 - DNA, 16 bp, Homo sapiens
atttaacattatttat

SEQ ID NO: 855863 - DNA, 20 bp, Homo sapiens
atttaacattatttatatgg

SEQ ID NO: 855864 - DNA, 16 bp, Homo sapiens
atttaaccataaatca

SEQ ID NO: 855865 - DNA, 14 bp, Homo sapiens
atttaacccagctc

SEQ ID NO: 855866 - DNA, 20 bp, Homo sapiens
atttaacccccctgtacaca

SEQ ID NO: 855867 - DNA, 21 bp, Homo sapiens
atttaactggtgcactttgta

SEQ ID NO: 855868 - DNA, 22 bp, Homo sapiens
atttaactggtgcactttgtaa

SEQ ID NO: 855869 - DNA, 22 bp, Homo sapiens
atttaacttaagaaaatttaca

SEQ ID NO: 855870 - DNA, 19 bp, Homo sapiens
atttaacttacatttgtac

SEQ ID NO: 855871 - DNA, 12 bp, Homo sapiens
atttaacttttt

SEQ ID NO: 855872 - DNA, 20 bp, Homo sapiens
atttaagaaaatacaataaa

SEQ ID NO: 855873 - DNA, 22 bp, Homo sapiens
atttaagaattgccagtctttt

SEQ ID NO: 855874 - DNA, 16 bp, Homo sapiens
atttaagacactgaaa

SEQ ID NO: 855875 - DNA, 23 bp, Homo sapiens
atttaagactgataattttacaa

SEQ ID NO: 855876 - DNA, 13 bp, Homo sapiens
atttaagatatat

SEQ ID NO: 855877 - DNA, 15 bp, Homo sapiens
atttaagatgtacat

SEQ ID NO: 855878 - DNA, 19 bp, Homo sapiens
atttaagatgtacatttaa

SEQ ID NO: 855879 - DNA, 22 bp, Homo sapiens
atttaagatgtacatttaataa

SEQ ID NO: 855880 - DNA, 14 bp, Homo sapiens
atttaagcaaacgt

SEQ ID NO: 855881 - DNA, 16 bp, Homo sapiens
atttaaggcaaaaaag

SEQ ID NO: 855882 - DNA, 15 bp, Homo sapiens
atttaagggaaaaat

SEQ ID NO: 855883 - DNA, 23 bp, Homo sapiens
atttaagggggaaaaagtgtcaa

SEQ ID NO: 855884 - DNA, 13 bp, Homo sapiens
atttaagtatata

SEQ ID NO: 855885 - DNA, 21 bp, Homo sapiens
atttaagtatatagtatattt

SEQ ID NO: 855886 - DNA, 23 bp, Homo sapiens
atttaagtatatagtatatttat

SEQ ID NO: 855887 - DNA, 16 bp, Homo sapiens
atttaagtatcttgtg

SEQ ID NO: 855888 - DNA, 16 bp, Homo sapiens
atttaagtatggaata

SEQ ID NO: 855889 - DNA, 14 bp, Homo sapiens
atttaagtgcaatt

SEQ ID NO: 855890 - DNA, 17 bp, Homo sapiens
atttaagtgcaattaac

SEQ ID NO: 855891 - DNA, 18 bp, Homo sapiens
atttaagtgttggaaaaa

SEQ ID NO: 855892 - DNA, 22 bp, Homo sapiens
atttaagtgttggaaaaaattt

SEQ ID NO: 855893 - DNA, 16 bp, Homo sapiens
atttaataaaaaaaca

SEQ ID NO: 855894 - DNA, 15 bp, Homo sapiens
atttaataaaaagga

SEQ ID NO: 855895 - DNA, 18 bp, Homo sapiens
atttaataaaaaggaata

SEQ ID NO: 855896 - DNA, 22 bp, Homo sapiens
atttaataaagaaatatttacc

SEQ ID NO: 855897 - DNA, 14 bp, Homo sapiens
atttaataaagatg

SEQ ID NO: 855898 - DNA, 15 bp, Homo sapiens
atttaataaagatga

SEQ ID NO: 855899 - DNA, 16 bp, Homo sapiens
atttaataacaattgt

SEQ ID NO: 855900 - DNA, 15 bp, Homo sapiens
atttaataatctgta

SEQ ID NO: 855901 - DNA, 14 bp, Homo sapiens
atttaatatattga

SEQ ID NO: 855902 - DNA, 13 bp, Homo sapiens
atttaatatttat

SEQ ID NO: 855903 - DNA, 18 bp, Homo sapiens
atttaatcttttttatgt

SEQ ID NO: 855904 - DNA, 16 bp, Homo sapiens
atttaatgaaagactg

SEQ ID NO: 855905 - DNA, 20 bp, Homo sapiens
atttaatgaaagactgtaca

SEQ ID NO: 855906 - DNA, 18 bp, Homo sapiens
atttaatgatgattatgg

SEQ ID NO: 855907 - DNA, 17 bp, Homo sapiens
atttaatgcattaaacc

SEQ ID NO: 855908 - DNA, 17 bp, Homo sapiens
atttacaaagtgtgtat

SEQ ID NO: 855909 - DNA, 19 bp, Homo sapiens
atttacaaagtgtgtatta

SEQ ID NO: 855910 - DNA, 19 bp, Homo sapiens
atttacaagagctgttcat

SEQ ID NO: 855911 - DNA, 18 bp, Homo sapiens
atttacaagatggactta

SEQ ID NO: 855912 - DNA, 14 bp, Homo sapiens
atttacaataaata

SEQ ID NO: 855913 - DNA, 15 bp, Homo sapiens
atttacaatatatga

SEQ ID NO: 855914 - DNA, 13 bp, Homo sapiens
atttacaatgtat

SEQ ID NO: 855915 - DNA, 14 bp, Homo sapiens
atttacaatgtatt

SEQ ID NO: 855916 - DNA, 18 bp, Homo sapiens
atttacactatgataaag

SEQ ID NO: 855917 - DNA, 14 bp, Homo sapiens
atttacactgccat

SEQ ID NO: 855918 - DNA, 12 bp, Homo sapiens
atttacactggt

SEQ ID NO: 855919 - DNA, 14 bp, Homo sapiens
atttacactggtct

SEQ ID NO: 855920 - DNA, 14 bp, Homo sapiens
atttacagaacaaa

SEQ ID NO: 855921 - DNA, 11 bp, Homo sapiens
atttacagaag

SEQ ID NO: 855922 - DNA, 13 bp, Homo sapiens
atttacagaagaa

SEQ ID NO: 855923 - DNA, 21 bp, Homo sapiens
atttacagcctcacttgaatg

SEQ ID NO: 855924 - DNA, 13 bp, Homo sapiens
atttacaggaggg

SEQ ID NO: 855925 - DNA, 16 bp, Homo sapiens
atttacagtctctttc

SEQ ID NO: 855926 - DNA, 19 bp, Homo sapiens
atttacagtctctttcttc

SEQ ID NO: 855927 - DNA, 17 bp, Homo sapiens
atttacataaagactgt

SEQ ID NO: 855928 - DNA, 16 bp, Homo sapiens
atttacatcactttgt

SEQ ID NO: 855929 - DNA, 17 bp, Homo sapiens
atttacatcactttgtg

SEQ ID NO: 855930 - DNA, 18 bp, Homo sapiens
atttacatgaattgcatt

SEQ ID NO: 855931 - DNA, 12 bp, Homo sapiens
atttacatttta

SEQ ID NO: 855932 - DNA, 20 bp, Homo sapiens
atttaccaaagagatattga

SEQ ID NO: 855933 - DNA, 14 bp, Homo sapiens
atttaccacttttt

SEQ ID NO: 855934 - DNA, 15 bp, Homo sapiens
atttaccatctgaaa

SEQ ID NO: 855935 - DNA, 18 bp, Homo sapiens
atttacctaagattacaa

SEQ ID NO: 855936 - DNA, 14 bp, Homo sapiens
atttaccttgaaaa

SEQ ID NO: 855937 - DNA, 15 bp, Homo sapiens
atttacgctttgatt

SEQ ID NO: 855938 - DNA, 17 bp, Homo sapiens
atttacgctttgattca

SEQ ID NO: 855939 - DNA, 16 bp, Homo sapiens
atttactaactaaata

SEQ ID NO: 855940 - DNA, 15 bp, Homo sapiens
atttactaagccaca

SEQ ID NO: 855941 - DNA, 16 bp, Homo sapiens
atttactcctcctgct

SEQ ID NO: 855942 - DNA, 16 bp, Homo sapiens
atttactctaaaaact

SEQ ID NO: 855943 - DNA, 16 bp, Homo sapiens
atttactcttcttcat

SEQ ID NO: 855944 - DNA, 21 bp, Homo sapiens
atttactgagcttctctgtga

SEQ ID NO: 855945 - DNA, 21 bp, Homo sapiens
atttactgctagtcttaagaa

SEQ ID NO: 855946 - DNA, 13 bp, Homo sapiens
atttactgctcta

SEQ ID NO: 855947 - DNA, 17 bp, Homo sapiens
atttactgtgagactgt

SEQ ID NO: 855948 - DNA, 14 bp, Homo sapiens
atttacttcttata

SEQ ID NO: 855949 - DNA, 16 bp, Homo sapiens
atttacttcttataca

SEQ ID NO: 855950 - DNA, 15 bp, Homo sapiens
atttacttttaataa

SEQ ID NO: 855951 - DNA, 19 bp, Homo sapiens
atttagaaaaaaacatgaa

SEQ ID NO: 855952 - DNA, 14 bp, Homo sapiens
atttagaaaacttt

SEQ ID NO: 855953 - DNA, 18 bp, Homo sapiens
atttagaaaactttaaag

SEQ ID NO: 855954 - DNA, 21 bp, Homo sapiens
atttagaaaatagagctttta

SEQ ID NO: 855955 - DNA, 13 bp, Homo sapiens
atttagaaacaat

SEQ ID NO: 855956 - DNA, 18 bp, Homo sapiens
atttagaaactaattgac

SEQ ID NO: 855957 - DNA, 23 bp, Homo sapiens
atttagaaactgatttcttcaga

SEQ ID NO: 855958 - DNA, 15 bp, Homo sapiens
atttagaactttaag

SEQ ID NO: 855959 - DNA, 12 bp, Homo sapiens
atttagaagata

SEQ ID NO: 855960 - DNA, 17 bp, Homo sapiens
atttagaagatattatt

SEQ ID NO: 855961 - DNA, 23 bp, Homo sapiens
atttagaagcaaagatttcagta

SEQ ID NO: 855962 - DNA, 21 bp, Homo sapiens
atttagaagccaactatgatt

SEQ ID NO: 855963 - DNA, 23 bp, Homo sapiens
atttagaagccaactatgattat

SEQ ID NO: 855964 - DNA, 18 bp, Homo sapiens
atttagacaacctgaaat

SEQ ID NO: 855965 - DNA, 23 bp, Homo sapiens
atttagacaacctgaaatttatt

SEQ ID NO: 855966 - DNA, 18 bp, Homo sapiens
atttagagcgtttggtta

SEQ ID NO: 855967 - DNA, 16 bp, Homo sapiens
atttagagtatttaca

SEQ ID NO: 855968 - DNA, 18 bp, Homo sapiens
atttagagtatttacact

SEQ ID NO: 855969 - DNA, 19 bp, Homo sapiens
atttagagtcaatttgctg

SEQ ID NO: 855970 - DNA, 21 bp, Homo sapiens
atttagagtcaatttgctgaa

SEQ ID NO: 855971 - DNA, 16 bp, Homo sapiens
atttagatctcctgta

SEQ ID NO: 855972 - DNA, 17 bp, Homo sapiens
atttagcaaactgatgc

SEQ ID NO: 855973 - DNA, 18 bp, Homo sapiens
atttagcaaataatttcc

SEQ ID NO: 855974 - DNA, 13 bp, Homo sapiens
atttagcactatt

SEQ ID NO: 855975 - DNA, 16 bp, Homo sapiens
atttagccattaccca

SEQ ID NO: 855976 - DNA, 16 bp, Homo sapiens
atttagccctcacatt

SEQ ID NO: 855977 - DNA, 18 bp, Homo sapiens
atttagccctttaaaacg

SEQ ID NO: 855978 - DNA, 21 bp, Homo sapiens
atttagctaaacggattccaa

SEQ ID NO: 855979 - DNA, 18 bp, Homo sapiens
atttagggccttttctgt

SEQ ID NO: 855980 - DNA, 20 bp, Homo sapiens
atttagggccttttctgtgc

SEQ ID NO: 855981 - DNA, 18 bp, Homo sapiens
atttaggtttttattagt

SEQ ID NO: 855982 - DNA, 21 bp, Homo sapiens
atttagtaaagtttgttgaaa

SEQ ID NO: 855983 - DNA, 15 bp, Homo sapiens
atttagtaaatgtta

SEQ ID NO: 855984 - DNA, 16 bp, Homo sapiens
atttagtcatgtgacc

SEQ ID NO: 855985 - DNA, 20 bp, Homo sapiens
atttagtgaaagctagagat

SEQ ID NO: 855986 - DNA, 21 bp, Homo sapiens
atttagtgatcaaattgtgca

SEQ ID NO: 855987 - DNA, 13 bp, Homo sapiens
atttagtgtgaat

SEQ ID NO: 855988 - DNA, 22 bp, Homo sapiens
atttagtgtttttttatttcta

SEQ ID NO: 855989 - DNA, 23 bp, Homo sapiens
atttagtgtttttttatttctac

SEQ ID NO: 855990 - DNA, 14 bp, Homo sapiens
atttagttatagtt

SEQ ID NO: 855991 - DNA, 16 bp, Homo sapiens
atttagttgtaaacca

SEQ ID NO: 855992 - DNA, 23 bp, Homo sapiens
atttagtttcagtagattgcaga

SEQ ID NO: 855993 - DNA, 22 bp, Homo sapiens
atttagtttgattattcagtgt

SEQ ID NO: 855994 - DNA, 19 bp, Homo sapiens
atttagttttatggcatga

SEQ ID NO: 855995 - DNA, 21 bp, Homo sapiens
atttagttttatggcatgatt

SEQ ID NO: 855996 - DNA, 19 bp, Homo sapiens
atttagtttttgtaattta

SEQ ID NO: 855997 - DNA, 20 bp, Homo sapiens
atttagtttttgtaatttat

SEQ ID NO: 855998 - DNA, 16 bp, Homo sapiens
atttataaaaatataa

SEQ ID NO: 855999 - DNA, 19 bp, Homo sapiens
atttataaaaatataaatt

SEQ ID NO: 856000 - DNA, 15 bp, Homo sapiens
atttataaaacttct

SEQ ID NO: 856001 - DNA, 23 bp, Homo sapiens
atttataaacagacaatatgtga

SEQ ID NO: 856002 - DNA, 17 bp, Homo sapiens
atttataaactaatttt

SEQ ID NO: 856003 - DNA, 18 bp, Homo sapiens
atttccgtccccccccag

SEQ ID NO: 856004 - DNA, 23 bp, Homo sapiens
atttccgtccccccccaggccct

SEQ ID NO: 856005 - DNA, 20 bp, Homo sapiens
atttcctaaacataattgtg

SEQ ID NO: 856006 - DNA, 17 bp, Homo sapiens
atttcctaatactgtca

SEQ ID NO: 856007 - DNA, 19 bp, Homo sapiens
atttcctacacaaatgata

SEQ ID NO: 856008 - DNA, 24 bp, Homo sapiens
atttcctcaacgttgctccccatc

SEQ ID NO: 856009 - DNA, 15 bp, Homo sapiens
atttcctcatctggg

SEQ ID NO: 856010 - DNA, 14 bp, Homo sapiens
atttcctccatggt

SEQ ID NO: 856011 - DNA, 11 bp, Homo sapiens
atttcctcctt

SEQ ID NO: 856012 - DNA, 15 bp, Homo sapiens
atttcctctaaagaa

SEQ ID NO: 856013 - DNA, 18 bp, Homo sapiens
atttcctctattgatgta

SEQ ID NO: 856014 - DNA, 19 bp, Homo sapiens
atttcctctattgatgtac

SEQ ID NO: 856015 - DNA, 17 bp, Homo sapiens
atttcctctccactgct

SEQ ID NO: 856016 - DNA, 11 bp, Homo sapiens
atttcctgcta

SEQ ID NO: 856017 - DNA, 22 bp, Homo sapiens
atttcctgctacttaaatttga

SEQ ID NO: 856018 - DNA, 17 bp, Homo sapiens
atttcctggagtgccct

SEQ ID NO: 856019 - DNA, 22 bp, Homo sapiens
atttcctggagtgccctgcagg

SEQ ID NO: 856020 - DNA, 14 bp, Homo sapiens
atttcctggatgtt

SEQ ID NO: 856021 - DNA, 19 bp, Homo sapiens
atttcctgtacaatcatga

SEQ ID NO: 856022 - DNA, 19 bp, Homo sapiens
atttcctgtgtgtgttgcc

SEQ ID NO: 856023 - DNA, 12 bp, Homo sapiens
atttcctgtgtt

SEQ ID NO: 856024 - DNA, 23 bp, Homo sapiens
atttcctgtgtttgtcctgggtt

SEQ ID NO: 856025 - DNA, 21 bp, Homo sapiens
atttccttaaaatctctaata

SEQ ID NO: 856026 - DNA, 16 bp, Homo sapiens
atttccttatcacaga

SEQ ID NO: 856027 - DNA, 11 bp, Homo sapiens
atttccttcca

SEQ ID NO: 856028 - DNA, 23 bp, Homo sapiens
atttccttccaaggtcactcttg

SEQ ID NO: 856029 - DNA, 19 bp, Homo sapiens
atttccttccactgtagct

SEQ ID NO: 856030 - DNA, 13 bp, Homo sapiens
atttccttctgtt

SEQ ID NO: 856031 - DNA, 14 bp, Homo sapiens
atttccttctgtta

SEQ ID NO: 856032 - DNA, 18 bp, Homo sapiens
atttccttctgttaagaa

SEQ ID NO: 856033 - DNA, 10 bp, Homo sapiens
atttccttta

SEQ ID NO: 856034 - DNA, 16 bp, Homo sapiens
atttcctttatgtgaa

SEQ ID NO: 856035 - DNA, 20 bp, Homo sapiens
atttcctttatgtgaatttt

SEQ ID NO: 856036 - DNA, 17 bp, Homo sapiens
atttcctttttgacact

SEQ ID NO: 856037 - DNA, 18 bp, Homo sapiens
atttccttttttcttttc

SEQ ID NO: 856038 - DNA, 14 bp, Homo sapiens
atttcgaagatata

SEQ ID NO: 856039 - DNA, 16 bp, Homo sapiens
atttcgccttaaactc

SEQ ID NO: 856040 - DNA, 18 bp, Homo sapiens
atttcgccttaaactctg

SEQ ID NO: 856041 - DNA, 17 bp, Homo sapiens
atttcggattttttcca

SEQ ID NO: 856042 - DNA, 20 bp, Homo sapiens
atttctaaaaaacagaggcc

SEQ ID NO: 856043 - DNA, 21 bp, Homo sapiens
atttctaaagtaaaattgaag

SEQ ID NO: 856044 - DNA, 23 bp, Homo sapiens
atttctaaataaggaatttcctc

SEQ ID NO: 856045 - DNA, 12 bp, Homo sapiens
atttctaaatct

SEQ ID NO: 856046 - DNA, 13 bp, Homo sapiens
atttctaaatctc

SEQ ID NO: 856047 - DNA, 15 bp, Homo sapiens
atttctaacagtcct

SEQ ID NO: 856048 - DNA, 20 bp, Homo sapiens
atttctaacagtccttgctt

SEQ ID NO: 856049 - DNA, 19 bp, Homo sapiens
atttctaacatatgtatta

SEQ ID NO: 856050 - DNA, 14 bp, Homo sapiens
atttctaactatat

SEQ ID NO: 856051 - DNA, 22 bp, Homo sapiens
atttctaagaagttgtttgagg

SEQ ID NO: 856052 - DNA, 21 bp, Homo sapiens
atttctaagcgcctattgttt

SEQ ID NO: 856053 - DNA, 16 bp, Homo sapiens
atttctaagtatttaa

SEQ ID NO: 856054 - DNA, 12 bp, Homo sapiens
atttctaattgt

SEQ ID NO: 856055 - DNA, 16 bp, Homo sapiens
atttctaattgtaagt

SEQ ID NO: 856056 - DNA, 16 bp, Homo sapiens
atttctacagagaaaa

SEQ ID NO: 856057 - DNA, 14 bp, Homo sapiens
atttctaccagatg

SEQ ID NO: 856058 - DNA, 18 bp, Homo sapiens
atttctactgtgactgat

SEQ ID NO: 856059 - DNA, 21 bp, Homo sapiens
atttctagacagtattgccac

SEQ ID NO: 856060 - DNA, 13 bp, Homo sapiens
atttctagcagag

SEQ ID NO: 856061 - DNA, 15 bp, Homo sapiens
atttctagcaggcag

SEQ ID NO: 856062 - DNA, 18 bp, Homo sapiens
atttctagcttatctact

SEQ ID NO: 856063 - DNA, 21 bp, Homo sapiens
atttctagcttatctacttcc

SEQ ID NO: 856064 - DNA, 16 bp, Homo sapiens
atttctagctttttaa

SEQ ID NO: 856065 - DNA, 15 bp, Homo sapiens
atttctagtaggcag

SEQ ID NO: 856066 - DNA, 17 bp, Homo sapiens
atttctagtaggcagca

SEQ ID NO: 856067 - DNA, 20 bp, Homo sapiens
atttctagtaggcagcaaaa

SEQ ID NO: 856068 - DNA, 21 bp, Homo sapiens
atttctagttctttcctcccc

SEQ ID NO: 856069 - DNA, 16 bp, Homo sapiens
atttctatactttaca

SEQ ID NO: 856070 - DNA, 19 bp, Homo sapiens
atttctatgacaaattcaa

SEQ ID NO: 856071 - DNA, 20 bp, Homo sapiens
atttctatgatccttttttg

SEQ ID NO: 856072 - DNA, 11 bp, Homo sapiens
atttctatgtc

SEQ ID NO: 856073 - DNA, 13 bp, Homo sapiens
atttctatgtcat

SEQ ID NO: 856074 - DNA, 15 bp, Homo sapiens
atttctatgtcattt

SEQ ID NO: 856075 - DNA, 23 bp, Homo sapiens
atttctatgtcatttttaatgta

SEQ ID NO: 856076 - DNA, 15 bp, Homo sapiens
atttctattaatatc

SEQ ID NO: 856077 - DNA, 23 bp, Homo sapiens
atttctattcaaggtggccaaat

SEQ ID NO: 856078 - DNA, 14 bp, Homo sapiens
atttctattcctta

SEQ ID NO: 856079 - DNA, 15 bp, Homo sapiens
atttctattccttat

SEQ ID NO: 856080 - DNA, 13 bp, Homo sapiens
atttctatttatt

SEQ ID NO: 856081 - DNA, 20 bp, Homo sapiens
atttctatttctcctccatg

SEQ ID NO: 856082 - DNA, 20 bp, Homo sapiens
atttctcaacaaagcacagt

SEQ ID NO: 856083 - DNA, 16 bp, Homo sapiens
atttctcaatcagtgc

SEQ ID NO: 856084 - DNA, 14 bp, Homo sapiens
atgggatcctctcc

SEQ ID NO: 856085 - DNA, 20 bp, Homo sapiens
atgggatctttctgggagct

SEQ ID NO: 856086 - DNA, 23 bp, Homo sapiens
atgggcaactggctgaaaggtta

SEQ ID NO: 856087 - DNA, 14 bp, Homo sapiens
atgggcacacacac

SEQ ID NO: 856088 - DNA, 18 bp, Homo sapiens
atgggcagatcttttctt

SEQ ID NO: 856089 - DNA, 18 bp, Homo sapiens
atgggcagctccatcctc

SEQ ID NO: 856090 - DNA, 16 bp, Homo sapiens
atgggcattgggctga

SEQ ID NO: 856091 - DNA, 23 bp, Homo sapiens
atgggccactgaaatctgtcaag

SEQ ID NO: 856092 - DNA, 23 bp, Homo sapiens
atgggccagggtttacccagtgg

SEQ ID NO: 856093 - DNA, 18 bp, Homo sapiens
atgggccccgccttcctg

SEQ ID NO: 856094 - DNA, 14 bp, Homo sapiens
atgggcccctggcc

SEQ ID NO: 856095 - DNA, 19 bp, Homo sapiens
atgggcccgctgcctcttg

SEQ ID NO: 856096 - DNA, 16 bp, Homo sapiens
atgggccgtcccctct

SEQ ID NO: 856097 - DNA, 17 bp, Homo sapiens
atgggccgtcccctctc

SEQ ID NO: 856098 - DNA, 20 bp, Homo sapiens
atgggccgtcccctctcccc

SEQ ID NO: 856099 - DNA, 22 bp, Homo sapiens
atgggccgtcccctctcccctt

SEQ ID NO: 856100 - DNA, 14 bp, Homo sapiens
atgggcctctctgg

SEQ ID NO: 856101 - DNA, 14 bp, Homo sapiens
atgggcctgcctgc

SEQ ID NO: 856102 - DNA, 19 bp, Homo sapiens
atgggcctgcctgcctcca

SEQ ID NO: 856103 - DNA, 20 bp, Homo sapiens
atgggcctggccacctctct

SEQ ID NO: 856104 - DNA, 16 bp, Homo sapiens
atgggcctgggcctgc

SEQ ID NO: 856105 - DNA, 15 bp, Homo sapiens
atgggccttgctttg

SEQ ID NO: 856106 - DNA, 15 bp, Homo sapiens
atgggcgcaggccca

SEQ ID NO: 856107 - DNA, 18 bp, Homo sapiens
atgggcgcaggcccagtg

SEQ ID NO: 856108 - DNA, 16 bp, Homo sapiens
atgggctaatgaagat

SEQ ID NO: 856109 - DNA, 21 bp, Homo sapiens
atgggctagtgtgagtggcag

SEQ ID NO: 856110 - DNA, 20 bp, Homo sapiens
atgggctcccaccctcccct

SEQ ID NO: 856111 - DNA, 19 bp, Homo sapiens
atgggctctacctctcttt

SEQ ID NO: 856112 - DNA, 14 bp, Homo sapiens
atgggctcttccaa

SEQ ID NO: 856113 - DNA, 22 bp, Homo sapiens
atgggctggggcaggggcctgg

SEQ ID NO: 856114 - DNA, 23 bp, Homo sapiens
atgggctgggggccagggctgga

SEQ ID NO: 856115 - DNA, 14 bp, Homo sapiens
atgggctgtgtcct

SEQ ID NO: 856116 - DNA, 17 bp, Homo sapiens
atgggctgtgtcctaag

SEQ ID NO: 856117 - DNA, 23 bp, Homo sapiens
atgggctgtgtcctaaggcccat

SEQ ID NO: 856118 - DNA, 19 bp, Homo sapiens
atgggcttctgttctctgc

SEQ ID NO: 856119 - DNA, 18 bp, Homo sapiens
atgggcttggacttcctg

SEQ ID NO: 856120 - DNA, 19 bp, Homo sapiens
atgggcttggacttcctgg

SEQ ID NO: 856121 - DNA, 20 bp, Homo sapiens
atgggcttggacttcctggg

SEQ ID NO: 856122 - DNA, 22 bp, Homo sapiens
atgggcttggacttcctggggc

SEQ ID NO: 856123 - DNA, 18 bp, Homo sapiens
atgggcttgttttcttgc

SEQ ID NO: 856124 - DNA, 17 bp, Homo sapiens
atgggcttttgttctga

SEQ ID NO: 856125 - DNA, 22 bp, Homo sapiens
atggggaaaccctggagccatc

SEQ ID NO: 856126 - DNA, 20 bp, Homo sapiens
atggggaaggcagaggctgg

SEQ ID NO: 856127 - DNA, 13 bp, Homo sapiens
atggggaccctcc

SEQ ID NO: 856128 - DNA, 13 bp, Homo sapiens
atggggaggacaa

SEQ ID NO: 856129 - DNA, 15 bp, Homo sapiens
atggggaggcagcag

SEQ ID NO: 856130 - DNA, 17 bp, Homo sapiens
atggggaggccctgcct

SEQ ID NO: 856131 - DNA, 20 bp, Homo sapiens
atggggatctggggggtggg

SEQ ID NO: 856132 - DNA, 20 bp, Homo sapiens
atggggattcaggggctttg

SEQ ID NO: 856133 - DNA, 13 bp, Homo sapiens
atggggcaagcca

SEQ ID NO: 856134 - DNA, 16 bp, Homo sapiens
atggggcaagccaggg

SEQ ID NO: 856135 - DNA, 22 bp, Homo sapiens
atggggcaagccagggcccaga

SEQ ID NO: 856136 - DNA, 16 bp, Homo sapiens
atggggcagaagagaa

SEQ ID NO: 856137 - DNA, 22 bp, Homo sapiens
atggggctgaacggggagaaaa

SEQ ID NO: 856138 - DNA, 23 bp, Homo sapiens
atgggggaagattttatgcacag

SEQ ID NO: 856139 - DNA, 15 bp, Homo sapiens
atgggggagagaagg

SEQ ID NO: 856140 - DNA, 13 bp, Homo sapiens
atgggggagaggg

SEQ ID NO: 856141 - DNA, 16 bp, Homo sapiens
atgggggatgcttcat

SEQ ID NO: 856142 - DNA, 16 bp, Homo sapiens
atgggggatgggccag

SEQ ID NO: 856143 - DNA, 23 bp, Homo sapiens
atgggggcaggaaagccacatct

SEQ ID NO: 856144 - DNA, 14 bp, Homo sapiens
atgggggcagggct

SEQ ID NO: 856145 - DNA, 15 bp, Homo sapiens
atgggggcagggctg

SEQ ID NO: 856146 - DNA, 23 bp, Homo sapiens
atgggggcatctcttccccagag

SEQ ID NO: 856147 - DNA, 16 bp, Homo sapiens
atgggggcttcttcct

SEQ ID NO: 856148 - DNA, 12 bp, Homo sapiens
atgggggctttc

SEQ ID NO: 856149 - DNA, 22 bp, Homo sapiens
atgggggctttcggggagggcg

SEQ ID NO: 856150 - DNA, 19 bp, Homo sapiens
atggggtcagccccaaggg

SEQ ID NO: 856151 - DNA, 17 bp, Homo sapiens
atggggtcctggccatc

SEQ ID NO: 856152 - DNA, 11 bp, Homo sapiens
atggggtgggg

SEQ ID NO: 856153 - DNA, 14 bp, Homo sapiens
atggggttcctgct

SEQ ID NO: 856154 - DNA, 18 bp, Homo sapiens
atggggttggctgggccc

SEQ ID NO: 856155 - DNA, 21 bp, Homo sapiens
atggggttggctgggcccaga

SEQ ID NO: 856156 - DNA, 18 bp, Homo sapiens
atgggtaatataaagtgt

SEQ ID NO: 856157 - DNA, 16 bp, Homo sapiens
atgggtagggtaaatc

SEQ ID NO: 856158 - DNA, 17 bp, Homo sapiens
atgggtagtacctgtac

SEQ ID NO: 856159 - DNA, 16 bp, Homo sapiens
atgggtccaagagaca

SEQ ID NO: 856160 - DNA, 18 bp, Homo sapiens
atgggtccaagagacatg

SEQ ID NO: 856161 - DNA, 14 bp, Homo sapiens
atgggtccagggcc

SEQ ID NO: 856162 - DNA, 15 bp, Homo sapiens
atgggtccagggcct

SEQ ID NO: 856163 - DNA, 20 bp, Homo sapiens
atgggtcctagcccttccct

SEQ ID NO: 856164 - DNA, 22 bp, Homo sapiens
atgggtcctagcccttccctga

SEQ ID NO: 856165 - DNA, 16 bp, Homo sapiens
atgggtgcaaggaaaa

SEQ ID NO: 856166 - DNA, 23 bp, Homo sapiens
atgggtggcaccaaccttgctgg

SEQ ID NO: 856167 - DNA, 14 bp, Homo sapiens
atgggtgtgggagt

SEQ ID NO: 856168 - DNA, 21 bp, Homo sapiens
atgggtgttgtatggggaggc

SEQ ID NO: 856169 - DNA, 18 bp, Homo sapiens
atgggtgtttttaataaa

SEQ ID NO: 856170 - DNA, 22 bp, Homo sapiens
atgggttatttttattaaatgt

SEQ ID NO: 856171 - DNA, 22 bp, Homo sapiens
atggtaaccgagccagcagctg

SEQ ID NO: 856172 - DNA, 22 bp, Homo sapiens
atggtaactgcacctgggcagc

SEQ ID NO: 856173 - DNA, 14 bp, Homo sapiens
atggtaactgcttt

SEQ ID NO: 856174 - DNA, 23 bp, Homo sapiens
atggtaactgctttctgttccaa

SEQ ID NO: 856175 - DNA, 20 bp, Homo sapiens
atggtaatctttacctgtat

SEQ ID NO: 856176 - DNA, 14 bp, Homo sapiens
atggtaattgttgc

SEQ ID NO: 856177 - DNA, 19 bp, Homo sapiens
atggtacatttatcactga

SEQ ID NO: 856178 - DNA, 23 bp, Homo sapiens
atggtactaaggaagtcctgttt

SEQ ID NO: 856179 - DNA, 14 bp, Homo sapiens
atggtactacccca

SEQ ID NO: 856180 - DNA, 16 bp, Homo sapiens
atggtggccacagact

SEQ ID NO: 856181 - DNA, 17 bp, Homo sapiens
atggtggccacagactg

SEQ ID NO: 856182 - DNA, 14 bp, Homo sapiens
atggtggcctcaag

SEQ ID NO: 856183 - DNA, 21 bp, Homo sapiens
atggtggcgctttctcctgtg

SEQ ID NO: 856184 - DNA, 22 bp, Homo sapiens
atggtggcgctttctcctgtgc

SEQ ID NO: 856185 - DNA, 17 bp, Homo sapiens
atggtggctgtgtctct

SEQ ID NO: 856186 - DNA, 23 bp, Homo sapiens
atggtggtgatgtccaaaagata

SEQ ID NO: 856187 - DNA, 13 bp, Homo sapiens
atggtgtacataa

SEQ ID NO: 856188 - DNA, 18 bp, Homo sapiens
atggtgtacataatgtat

SEQ ID NO: 856189 - DNA, 22 bp, Homo sapiens
atggtgtagccctcccactttg

SEQ ID NO: 856190 - DNA, 14 bp, Homo sapiens
atggtgtccttccc

SEQ ID NO: 856191 - DNA, 16 bp, Homo sapiens
atggtgtccttccctg

SEQ ID NO: 856192 - DNA, 13 bp, Homo sapiens
atggtgtctccca

SEQ ID NO: 856193 - DNA, 19 bp, Homo sapiens
atggtgtctcccaacatgg

SEQ ID NO: 856194 - DNA, 18 bp, Homo sapiens
atggtgtctcttctttag

SEQ ID NO: 856195 - DNA, 13 bp, Homo sapiens
atggtgtggccat

SEQ ID NO: 856196 - DNA, 18 bp, Homo sapiens
atggtgtgggtgtcctgc

SEQ ID NO: 856197 - DNA, 20 bp, Homo sapiens
atggtgttaaagctgtacac

SEQ ID NO: 856198 - DNA, 16 bp, Homo sapiens
atggtgttttcatgta

SEQ ID NO: 856199 - DNA, 22 bp, Homo sapiens
atggttaaaaaggccaaagata

SEQ ID NO: 856200 - DNA, 19 bp, Homo sapiens
atggttaataaaactgcac

SEQ ID NO: 856201 - DNA, 21 bp, Homo sapiens
atggttaatttttcctgcatg

SEQ ID NO: 856202 - DNA, 19 bp, Homo sapiens
atggttacaatcattgctg

SEQ ID NO: 856203 - DNA, 20 bp, Homo sapiens
atggttacaatcattgctga

SEQ ID NO: 856204 - DNA, 15 bp, Homo sapiens
atggttcaagattgt

SEQ ID NO: 856205 - DNA, 23 bp, Homo sapiens
atggttcaccatgcagtgggccc

SEQ ID NO: 856206 - DNA, 20 bp, Homo sapiens
atggttcagaattaaacttt

SEQ ID NO: 856207 - DNA, 21 bp, Homo sapiens
atggttcagaattaaactttt

SEQ ID NO: 856208 - DNA, 18 bp, Homo sapiens
atggttccatgcctgagg

SEQ ID NO: 856209 - DNA, 18 bp, Homo sapiens
atggttcccaataaaagt

SEQ ID NO: 856210 - DNA, 19 bp, Homo sapiens
atggttcccaataaaagtg

SEQ ID NO: 856211 - DNA, 19 bp, Homo sapiens
atggttcccctgttcactc

SEQ ID NO: 856212 - DNA, 20 bp, Homo sapiens
atggttcccctgttcactct

SEQ ID NO: 856213 - DNA, 13 bp, Homo sapiens
atggttccttccc

SEQ ID NO: 856214 - DNA, 18 bp, Homo sapiens
atggttccttccctggga

SEQ ID NO: 856215 - DNA, 20 bp, Homo sapiens
atggttccttccctgggaag

SEQ ID NO: 856216 - DNA, 17 bp, Homo sapiens
atggttgatgatacttc

SEQ ID NO: 856217 - DNA, 13 bp, Homo sapiens
atggttgatggaa

SEQ ID NO: 856218 - DNA, 19 bp, Homo sapiens
atggttgatggaaaataaa

SEQ ID NO: 856219 - DNA, 15 bp, Homo sapiens
atggttgccacccca

SEQ ID NO: 856220 - DNA, 15 bp, Homo sapiens
atggttgccttaaag

SEQ ID NO: 856221 - DNA, 19 bp, Homo sapiens
atggttggagagccctgga

SEQ ID NO: 856222 - DNA, 16 bp, Homo sapiens
atggttgggggaatgc

SEQ ID NO: 856223 - DNA, 15 bp, Homo sapiens
atggttgtatacaca

SEQ ID NO: 856224 - DNA, 12 bp, Homo sapiens
atggttgtgaaa

SEQ ID NO: 856225 - DNA, 17 bp, Homo sapiens
atggttgtgaaatgtaa

SEQ ID NO: 856226 - DNA, 23 bp, Homo sapiens
atggttgtgaaatgtaacatgaa

SEQ ID NO: 856227 - DNA, 22 bp, Homo sapiens
atggtttattcccaagtatgcc

SEQ ID NO: 856228 - DNA, 18 bp, Homo sapiens
atggtttcaagttattca

SEQ ID NO: 856229 - DNA, 17 bp, Homo sapiens
atggtttccatttacta

SEQ ID NO: 856230 - DNA, 13 bp, Homo sapiens
atggtttcctctg

SEQ ID NO: 856231 - DNA, 16 bp, Homo sapiens
atggtttcctctggat

SEQ ID NO: 856232 - DNA, 16 bp, Homo sapiens
atggtttggtttttct

SEQ ID NO: 856233 - DNA, 22 bp, Homo sapiens
atggtttgttgttctgcctgga

SEQ ID NO: 856234 - DNA, 15 bp, Homo sapiens
atggttttaaacttt

SEQ ID NO: 856235 - DNA, 21 bp, Homo sapiens
atggttttctccaagagctac

SEQ ID NO: 856236 - DNA, 19 bp, Homo sapiens
atggttttggctctcccac

SEQ ID NO: 856237 - DNA, 21 bp, Homo sapiens
atggttttggctctcccaccc

SEQ ID NO: 856238 - DNA, 21 bp, Homo sapiens
atggtttttaaattttgtaat

SEQ ID NO: 856239 - DNA, 20 bp, Homo sapiens
atgtaaaacatttattttga

SEQ ID NO: 856240 - DNA, 17 bp, Homo sapiens
atgtaaaagaaaatcca

SEQ ID NO: 856241 - DNA, 22 bp, Homo sapiens
atgtaaaagaacttactgatta

SEQ ID NO: 856242 - DNA, 15 bp, Homo sapiens
atgtaaaaggattat

SEQ ID NO: 856243 - DNA, 20 bp, Homo sapiens
atgtaaaaggattattacta

SEQ ID NO: 856244 - DNA, 17 bp, Homo sapiens
atgtaaaatatgtaaaa

SEQ ID NO: 856245 - DNA, 16 bp, Homo sapiens
atgtaaaatgttgaat

SEQ ID NO: 856246 - DNA, 16 bp, Homo sapiens
atgtaaagcttgtctg

SEQ ID NO: 856247 - DNA, 21 bp, Homo sapiens
atgtaaaggtatattgtgaac

SEQ ID NO: 856248 - DNA, 16 bp, Homo sapiens
atgtaaagtaagacat

SEQ ID NO: 856249 - DNA, 15 bp, Homo sapiens
atgtaaagtatgttt

SEQ ID NO: 856250 - DNA, 12 bp, Homo sapiens
atgtaaatagtg

SEQ ID NO: 856251 - DNA, 15 bp, Homo sapiens
atgtaaatattctat

SEQ ID NO: 856252 - DNA, 13 bp, Homo sapiens
atgtaaatatttt

SEQ ID NO: 856253 - DNA, 12 bp, Homo sapiens
atgtaaatgtta

SEQ ID NO: 856254 - DNA, 17 bp, Homo sapiens
atgtaaattattgtaaa

SEQ ID NO: 856255 - DNA, 18 bp, Homo sapiens
atgtaaattattgtaaac

SEQ ID NO: 856256 - DNA, 20 bp, Homo sapiens
atgtaaattattgtaaactt

SEQ ID NO: 856257 - DNA, 17 bp, Homo sapiens
atgtaaattgactgtac

SEQ ID NO: 856258 - DNA, 21 bp, Homo sapiens
atgtaacagccaggagtgtta

SEQ ID NO: 856259 - DNA, 16 bp, Homo sapiens
atgtaacagttgtgtc

SEQ ID NO: 856260 - DNA, 18 bp, Homo sapiens
atgtaacatcataattac

SEQ ID NO: 856261 - DNA, 20 bp, Homo sapiens
atgtaacatcataattacat

SEQ ID NO: 856262 - DNA, 14 bp, Homo sapiens
atgtaaccaagctg

SEQ ID NO: 856263 - DNA, 16 bp, Homo sapiens
atgtaactccagatag

SEQ ID NO: 856264 - DNA, 22 bp, Homo sapiens
atgtaactccagatagagaaat

SEQ ID NO: 856265 - DNA, 14 bp, Homo sapiens
atgtaacttttgta

SEQ ID NO: 856266 - DNA, 16 bp, Homo sapiens
atgtaacttttgtaag

SEQ ID NO: 856267 - DNA, 16 bp, Homo sapiens
atgtaagaaaacaaaa

SEQ ID NO: 856268 - DNA, 21 bp, Homo sapiens
atgtaagaaaacaaaatctaa

SEQ ID NO: 856269 - DNA, 22 bp, Homo sapiens
atgtaagaaaacaaaatctaaa

SEQ ID NO: 856270 - DNA, 19 bp, Homo sapiens
atgtaagaattcagaagac

SEQ ID NO: 856271 - DNA, 12 bp, Homo sapiens
atgtaagcaaag

SEQ ID NO: 856272 - DNA, 19 bp, Homo sapiens
atgtaagcatactttgtaa

SEQ ID NO: 856273 - DNA, 15 bp, Homo sapiens
atgtaaggactgtaa

SEQ ID NO: 856274 - DNA, 14 bp, Homo sapiens
atgtaaggatgagg

SEQ ID NO: 856275 - DNA, 12 bp, Homo sapiens
atgtaaggcact

SEQ ID NO: 856276 - DNA, 14 bp, Homo sapiens
atgtaaggcactgt

SEQ ID NO: 856277 - DNA, 21 bp, Homo sapiens
atgtaatactggaataatttg

SEQ ID NO: 856278 - DNA, 22 bp, Homo sapiens
atgtaatactggaataatttgt

SEQ ID NO: 856279 - DNA, 14 bp, Homo sapiens
atgtaatagtttat

SEQ ID NO: 856280 - DNA, 13 bp, Homo sapiens
atgtaatataaat

SEQ ID NO: 856281 - DNA, 20 bp, Homo sapiens
atgtcctgcctattatctgt

SEQ ID NO: 856282 - DNA, 13 bp, Homo sapiens
atgtcctgccttt

SEQ ID NO: 856283 - DNA, 15 bp, Homo sapiens
atgtcctgcctttta

SEQ ID NO: 856284 - DNA, 16 bp, Homo sapiens
atgtccttctgagccc

SEQ ID NO: 856285 - DNA, 18 bp, Homo sapiens
atgtccttggactccatc

SEQ ID NO: 856286 - DNA, 14 bp, Homo sapiens
atgtcgagagctgg

SEQ ID NO: 856287 - DNA, 15 bp, Homo sapiens
atgtcgatcaagaga

SEQ ID NO: 856288 - DNA, 17 bp, Homo sapiens
atgtcgatcaagagaat

SEQ ID NO: 856289 - DNA, 15 bp, Homo sapiens
atgtcgatgcacagt

SEQ ID NO: 856290 - DNA, 14 bp, Homo sapiens
atgtcgcacaatgt

SEQ ID NO: 856291 - DNA, 14 bp, Homo sapiens
atgtcgccaaaaat

SEQ ID NO: 856292 - DNA, 18 bp, Homo sapiens
atgtcgccaaaaatacag

SEQ ID NO: 856293 - DNA, 12 bp, Homo sapiens
atgtcgcttttg

SEQ ID NO: 856294 - DNA, 18 bp, Homo sapiens
atgtcgcttttgggcctc

SEQ ID NO: 856295 - DNA, 14 bp, Homo sapiens
atgtcggggttggg

SEQ ID NO: 856296 - DNA, 22 bp, Homo sapiens
atgtcggggttggggtgggagg

SEQ ID NO: 856297 - DNA, 23 bp, Homo sapiens
atgtcggggttggggtgggaggg

SEQ ID NO: 856298 - DNA, 21 bp, Homo sapiens
atgtcggtcatagtttcctga

SEQ ID NO: 856299 - DNA, 19 bp, Homo sapiens
atgtcgtagaattccttcg

SEQ ID NO: 856300 - DNA, 22 bp, Homo sapiens
atgtcgtgttttcaaggaagaa

SEQ ID NO: 856301 - DNA, 23 bp, Homo sapiens
atgtcgtgttttcaaggaagaaa

SEQ ID NO: 856302 - DNA, 13 bp, Homo sapiens
atgtctaattttc

SEQ ID NO: 856303 - DNA, 14 bp, Homo sapiens
atgtctacagaaaa

SEQ ID NO: 856304 - DNA, 18 bp, Homo sapiens
atgtctacagaaaatgct

SEQ ID NO: 856305 - DNA, 19 bp, Homo sapiens
atgtctacagaaaatgctg

SEQ ID NO: 856306 - DNA, 20 bp, Homo sapiens
atgtctacagaaaatgctgg

SEQ ID NO: 856307 - DNA, 22 bp, Homo sapiens
atgtctacagaaaatgctggct

SEQ ID NO: 856308 - DNA, 19 bp, Homo sapiens
atgtctactcagcatttga

SEQ ID NO: 856309 - DNA, 23 bp, Homo sapiens
atgtctagtttctagtgtcactg

SEQ ID NO: 856310 - DNA, 22 bp, Homo sapiens
atgtctataatcccagcacttt

SEQ ID NO: 856311 - DNA, 16 bp, Homo sapiens
atgtctattcagcttc

SEQ ID NO: 856312 - DNA, 13 bp, Homo sapiens
atgtctattgtcc

SEQ ID NO: 856313 - DNA, 14 bp, Homo sapiens
atgtctattgtcca

SEQ ID NO: 856314 - DNA, 13 bp, Homo sapiens
atgtctatttaag

SEQ ID NO: 856315 - DNA, 20 bp, Homo sapiens
atgtctcaatagtaaaagat

SEQ ID NO: 856316 - DNA, 19 bp, Homo sapiens
atgtctcactgttctgcaa

SEQ ID NO: 856317 - DNA, 19 bp, Homo sapiens
atgtctcagagccttccat

SEQ ID NO: 856318 - DNA, 22 bp, Homo sapiens
atgtctcaggtccctgcagggc

SEQ ID NO: 856319 - DNA, 20 bp, Homo sapiens
atgtctcatgtaatttgcat

SEQ ID NO: 856320 - DNA, 22 bp, Homo sapiens
atgtctccagattggcacccct

SEQ ID NO: 856321 - DNA, 13 bp, Homo sapiens
atgtctcccacac

SEQ ID NO: 856322 - DNA, 19 bp, Homo sapiens
atgtctcctcaagcctgtg

SEQ ID NO: 856323 - DNA, 16 bp, Homo sapiens
atgtctctcagaattc

SEQ ID NO: 856324 - DNA, 16 bp, Homo sapiens
atgtctctgctcctac

SEQ ID NO: 856325 - DNA, 12 bp, Homo sapiens
atgtctctgggg

SEQ ID NO: 856326 - DNA, 13 bp, Homo sapiens
atgtctctggggc

SEQ ID NO: 856327 - DNA, 16 bp, Homo sapiens
atgtctcttctgagct

SEQ ID NO: 856328 - DNA, 21 bp, Homo sapiens
atgtctcttgagcatcaatct

SEQ ID NO: 856329 - DNA, 20 bp, Homo sapiens
atgtctgaaaagggactgtg

SEQ ID NO: 856330 - DNA, 14 bp, Homo sapiens
atgtctgcaggtgt

SEQ ID NO: 856331 - DNA, 18 bp, Homo sapiens
atgtctgcaggtttctcc

SEQ ID NO: 856332 - DNA, 15 bp, Homo sapiens
atgtctgccatgttg

SEQ ID NO: 856333 - DNA, 20 bp, Homo sapiens
atgtctgctgaataataaac

SEQ ID NO: 856334 - DNA, 18 bp, Homo sapiens
atgtctgctggtatttct

SEQ ID NO: 856335 - DNA, 20 bp, Homo sapiens
atgtctgtaatcatgtactt

SEQ ID NO: 856336 - DNA, 16 bp, Homo sapiens
atgtctgtagctcctc

SEQ ID NO: 856337 - DNA, 17 bp, Homo sapiens
atgtctgtatactcctg

SEQ ID NO: 856338 - DNA, 24 bp, Homo sapiens
atgtctgtgtgtgtgtgtgtatgt

SEQ ID NO: 856339 - DNA, 23 bp, Homo sapiens
atgtctgttaccatgtcactgtg

SEQ ID NO: 856340 - DNA, 21 bp, Homo sapiens
atgtctgttttagttggaatg

SEQ ID NO: 856341 - DNA, 15 bp, Homo sapiens
atgtcttaaatgctc

SEQ ID NO: 856342 - DNA, 23 bp, Homo sapiens
atgtcttcagtggaacacaaatg

SEQ ID NO: 856343 - DNA, 17 bp, Homo sapiens
atgtcttcatttcattg

SEQ ID NO: 856344 - DNA, 19 bp, Homo sapiens
atgtcttcatttcattgta

SEQ ID NO: 856345 - DNA, 18 bp, Homo sapiens
atgtcttccatgtatctt

SEQ ID NO: 856346 - DNA, 22 bp, Homo sapiens
atgtcttccatgtatcttttga

SEQ ID NO: 856347 - DNA, 16 bp, Homo sapiens
atgtcttccctgggct

SEQ ID NO: 856348 - DNA, 15 bp, Homo sapiens
atgtcttctgcctgt

SEQ ID NO: 856349 - DNA, 13 bp, Homo sapiens
atgtcttctgctg

SEQ ID NO: 856350 - DNA, 23 bp, Homo sapiens
atgtcttctgctgttcttcactt

SEQ ID NO: 856351 - DNA, 13 bp, Homo sapiens
atgtcttgagagg

SEQ ID NO: 856352 - DNA, 19 bp, Homo sapiens
atgtcttgggtaggcggga

SEQ ID NO: 856353 - DNA, 21 bp, Homo sapiens
atgtctttccaaattatttct

SEQ ID NO: 856354 - DNA, 13 bp, Homo sapiens
atgtcttttaaaa

SEQ ID NO: 856355 - DNA, 16 bp, Homo sapiens
atgtcttttcccattt

SEQ ID NO: 856356 - DNA, 22 bp, Homo sapiens
atgtctttttattaaaatattt

SEQ ID NO: 856357 - DNA, 18 bp, Homo sapiens
atgtgaaaaattaacttt

SEQ ID NO: 856358 - DNA, 20 bp, Homo sapiens
atgtgaaaaattaacttttt

SEQ ID NO: 856359 - DNA, 12 bp, Homo sapiens
atgtgaaaagca

SEQ ID NO: 856360 - DNA, 23 bp, Homo sapiens
atgtgaaaagcacagctgtatat

SEQ ID NO: 856361 - DNA, 16 bp, Homo sapiens
atgtgaaaggaacatt

SEQ ID NO: 856362 - DNA, 16 bp, Homo sapiens
atgtgaaatctcagaa

SEQ ID NO: 856363 - DNA, 13 bp, Homo sapiens
atgtgaaatgctt

SEQ ID NO: 856364 - DNA, 16 bp, Homo sapiens
atgtgaaatttaaata

SEQ ID NO: 856365 - DNA, 19 bp, Homo sapiens
atgtgaacagcataagttt

SEQ ID NO: 856366 - DNA, 16 bp, Homo sapiens
atgtgaacccgggacg

SEQ ID NO: 856367 - DNA, 16 bp, Homo sapiens
atgtgaagaaaaagac

SEQ ID NO: 856368 - DNA, 18 bp, Homo sapiens
atgtgaagataatttgca

SEQ ID NO: 856369 - DNA, 19 bp, Homo sapiens
atgtgaagataatttgcat

SEQ ID NO: 856370 - DNA, 20 bp, Homo sapiens
atgtgaagataatttgcata

SEQ ID NO: 856371 - DNA, 13 bp, Homo sapiens
atgtgaagcatgc

SEQ ID NO: 856372 - DNA, 14 bp, Homo sapiens
atgtgaagcatgct

SEQ ID NO: 856373 - DNA, 16 bp, Homo sapiens
atgtgaagcatgcttt

SEQ ID NO: 856374 - DNA, 12 bp, Homo sapiens
atgtgaagtttt

SEQ ID NO: 856375 - DNA, 15 bp, Homo sapiens
atgtgaatcgcagct

SEQ ID NO: 856376 - DNA, 19 bp, Homo sapiens
atgtgaattattgacactg

SEQ ID NO: 856377 - DNA, 20 bp, Homo sapiens
atgtgaattattgacactga

SEQ ID NO: 856378 - DNA, 21 bp, Homo sapiens
atgtgaattattgacactgaa

SEQ ID NO: 856379 - DNA, 14 bp, Homo sapiens
atgtgaatttcaac

SEQ ID NO: 856380 - DNA, 18 bp, Homo sapiens
atgtgaatttttatttct

SEQ ID NO: 856381 - DNA, 13 bp, Homo sapiens
atgtgaatttttg

SEQ ID NO: 856382 - DNA, 21 bp, Homo sapiens
atgtgacattccatgacgaca

SEQ ID NO: 856383 - DNA, 22 bp, Homo sapiens
atgtgacattccatgacgacat

SEQ ID NO: 856384 - DNA, 19 bp, Homo sapiens
atgtgacatttatatattg

SEQ ID NO: 856385 - DNA, 15 bp, Homo sapiens
atgtgaccattctgc

SEQ ID NO: 856386 - DNA, 18 bp, Homo sapiens
atgtgaccattctgcctc

SEQ ID NO: 856387 - DNA, 14 bp, Homo sapiens
atgtgaccctccaa

SEQ ID NO: 856388 - DNA, 17 bp, Homo sapiens
atgtgactagcgcctgg

SEQ ID NO: 856389 - DNA, 17 bp, Homo sapiens
atgtgacttgcaataaa

SEQ ID NO: 856390 - DNA, 14 bp, Homo sapiens
atgtgacttttctg

SEQ ID NO: 856391 - DNA, 16 bp, Homo sapiens
atgtgacttttctgat

SEQ ID NO: 856392 - DNA, 17 bp, Homo sapiens
atgtgacttttctgatt

SEQ ID NO: 856393 - DNA, 12 bp, Homo sapiens
atgtgagaaatc

SEQ ID NO: 856394 - DNA, 14 bp, Homo sapiens
atgtgagaagccag

SEQ ID NO: 856395 - DNA, 15 bp, Homo sapiens
atgtgagagaaagtg

SEQ ID NO: 856396 - DNA, 16 bp, Homo sapiens
atgtgagatttcctta

SEQ ID NO: 856397 - DNA, 17 bp, Homo sapiens
atgtgagatttccttat

SEQ ID NO: 856398 - DNA, 18 bp, Homo sapiens
atgtgagcacatgcgtat

SEQ ID NO: 856399 - DNA, 19 bp, Homo sapiens
atgtgagccaccgctgcca

SEQ ID NO: 856400 - DNA, 21 bp, Homo sapiens
atgtgagccaccgctgccagc

SEQ ID NO: 856401 - DNA, 22 bp, Homo sapiens
atgtgagccaccgtgcctggcc

SEQ ID NO: 856402 - DNA, 17 bp, Homo sapiens
atgtgagcctcgtgtca

SEQ ID NO: 856403 - DNA, 17 bp, Homo sapiens
atgtgaggaggaaaagg

SEQ ID NO: 856404 - DNA, 20 bp, Homo sapiens
atgtgagtagtcttatgtaa

SEQ ID NO: 856405 - DNA, 21 bp, Homo sapiens
atgtgagtagtcttatgtaaa

SEQ ID NO: 856406 - DNA, 19 bp, Homo sapiens
atgtgagtcctgttgaaga

SEQ ID NO: 856407 - DNA, 21 bp, Homo sapiens
atgtgagtcctgttgaagact

SEQ ID NO: 856408 - DNA, 23 bp, Homo sapiens
atgtgagtcctgttgaagacttc

SEQ ID NO: 856409 - DNA, 20 bp, Homo sapiens
atgtgagtgccttttgcaga

SEQ ID NO: 856410 - DNA, 19 bp, Homo sapiens
atgtgagtttcctgctata

SEQ ID NO: 856411 - DNA, 17 bp, Homo sapiens
atgtgagtttggtctgg

SEQ ID NO: 856412 - DNA, 17 bp, Homo sapiens
atgtgataatatattgc

SEQ ID NO: 856413 - DNA, 21 bp, Homo sapiens
atgtgataatatattgctaaa

SEQ ID NO: 856414 - DNA, 13 bp, Homo sapiens
atgtgatatataa

SEQ ID NO: 856415 - DNA, 23 bp, Homo sapiens
atgtgatatataagtgtacatat

SEQ ID NO: 856416 - DNA, 13 bp, Homo sapiens
atgtgatattctg

SEQ ID NO: 856417 - DNA, 22 bp, Homo sapiens
atgtgatgccaaagatgtttga

SEQ ID NO: 856418 - DNA, 23 bp, Homo sapiens
atgtgatgccaaagatgtttgaa

SEQ ID NO: 856419 - DNA, 18 bp, Homo sapiens
atgtgatggacactccag

SEQ ID NO: 856420 - DNA, 17 bp, Homo sapiens
atgtgatggactgggga

SEQ ID NO: 856421 - DNA, 18 bp, Homo sapiens
atgtgatggatggcacaa

SEQ ID NO: 856422 - DNA, 20 bp, Homo sapiens
atgtgatggatggcacaatg

SEQ ID NO: 856423 - DNA, 18 bp, Homo sapiens
atgtgatgtcatgaaact

SEQ ID NO: 856424 - DNA, 21 bp, Homo sapiens
atgtgatgtcatgaaactgta

SEQ ID NO: 856425 - DNA, 23 bp, Homo sapiens
atgtgattaatgttttcattatg

SEQ ID NO: 856426 - DNA, 23 bp, Homo sapiens
atgtgattcactgccttcctctc

SEQ ID NO: 856427 - DNA, 16 bp, Homo sapiens
atgtgattccttttga

SEQ ID NO: 856428 - DNA, 16 bp, Homo sapiens
atgtgattcttctaaa

SEQ ID NO: 856429 - DNA, 14 bp, Homo sapiens
atgtgattgtggaa

SEQ ID NO: 856430 - DNA, 15 bp, Homo sapiens
atgtgatttttctga

SEQ ID NO: 856431 - DNA, 18 bp, Homo sapiens
atgtgcaaaaccttttac

SEQ ID NO: 856432 - DNA, 15 bp, Homo sapiens
atgtgcaaattttgc

SEQ ID NO: 856433 - DNA, 20 bp, Homo sapiens
atgtgcaacctgtggctcag

SEQ ID NO: 856434 - DNA, 16 bp, Homo sapiens
atgtgcaagtgtatgc

SEQ ID NO: 856435 - DNA, 22 bp, Homo sapiens
atgtgcactgtcactttgctct

SEQ ID NO: 856436 - DNA, 21 bp, Homo sapiens
atgtgcagactgattggcctg

SEQ ID NO: 856437 - DNA, 17 bp, Homo sapiens
atgtgcaggtttgttac

SEQ ID NO: 856438 - DNA, 13 bp, Homo sapiens
atgtgcatataaa

SEQ ID NO: 856439 - DNA, 14 bp, Homo sapiens
atgtgcatataaag

SEQ ID NO: 856440 - DNA, 16 bp, Homo sapiens
atgtgcatctggtgta

SEQ ID NO: 856441 - DNA, 17 bp, Homo sapiens
atgtgcattctccagcc

SEQ ID NO: 856442 - DNA, 18 bp, Homo sapiens
atgtgcatttcacctgtg

SEQ ID NO: 856443 - DNA, 21 bp, Homo sapiens
atgtgcatttcacctgtgaca

SEQ ID NO: 856444 - DNA, 23 bp, Homo sapiens
atgtgccaccaacataaaacaaa

SEQ ID NO: 856445 - DNA, 13 bp, Homo sapiens
atgtgccacctgt

SEQ ID NO: 856446 - DNA, 21 bp, Homo sapiens
atgtgccacctgtccggccca

SEQ ID NO: 856447 - DNA, 22 bp, Homo sapiens
atgtgccacctgtccggcccag

SEQ ID NO: 856448 - DNA, 14 bp, Homo sapiens
atgtgccaggcttg

SEQ ID NO: 856449 - DNA, 17 bp, Homo sapiens
atgtgccatttttcaga

SEQ ID NO: 856450 - DNA, 13 bp, Homo sapiens
atgtgcccctggc

SEQ ID NO: 856451 - DNA, 22 bp, Homo sapiens
atgtgccccttcgcagctgaag

SEQ ID NO: 856452 - DNA, 17 bp, Homo sapiens
atgtgccctcctgaggg

SEQ ID NO: 856453 - DNA, 18 bp, Homo sapiens
atgtgccgaatgtgcagg

SEQ ID NO: 856454 - DNA, 21 bp, Homo sapiens
atgtgccgtgttattgtatta

SEQ ID NO: 856455 - DNA, 16 bp, Homo sapiens
atgtgcctaattttct

SEQ ID NO: 856456 - DNA, 15 bp, Homo sapiens
atgtgcctgtgggag

SEQ ID NO: 856457 - DNA, 21 bp, Homo sapiens
atgtgccttgattgattagat

SEQ ID NO: 856458 - DNA, 16 bp, Homo sapiens
atgtgccttgtccagg

SEQ ID NO: 856459 - DNA, 14 bp, Homo sapiens
atgtgcggctgaac

SEQ ID NO: 856460 - DNA, 20 bp, Homo sapiens
atgtgcgtctctctttctcc

SEQ ID NO: 856461 - DNA, 14 bp, Homo sapiens
atgtgcgtgtgtgc

SEQ ID NO: 856462 - DNA, 15 bp, Homo sapiens
atgtgctatacacac

SEQ ID NO: 856463 - DNA, 17 bp, Homo sapiens
atgtgctatacacacac

SEQ ID NO: 856464 - DNA, 18 bp, Homo sapiens
atgtgctatactgcatac

SEQ ID NO: 856465 - DNA, 19 bp, Homo sapiens
atgtgctattaatatttgt

SEQ ID NO: 856466 - DNA, 12 bp, Homo sapiens
atgtgctcagaa

SEQ ID NO: 856467 - DNA, 13 bp, Homo sapiens
atgtgctcagaag

SEQ ID NO: 856468 - DNA, 18 bp, Homo sapiens
atgtgctcagccaaattt

SEQ ID NO: 856469 - DNA, 19 bp, Homo sapiens
atgtgctgggtgcctccca

SEQ ID NO: 856470 - DNA, 22 bp, Homo sapiens
atgtgctggtgaacactgtgac

SEQ ID NO: 856471 - DNA, 18 bp, Homo sapiens
atgtgctgtgaccattta

SEQ ID NO: 856472 - DNA, 14 bp, Homo sapiens
atgtgctttgagaa

SEQ ID NO: 856473 - DNA, 17 bp, Homo sapiens
atgtgcttttctccaat

SEQ ID NO: 856474 - DNA, 15 bp, Homo sapiens
atgtggaaagtgaat

SEQ ID NO: 856475 - DNA, 17 bp, Homo sapiens
atgtggaaagtgaattt

SEQ ID NO: 856476 - DNA, 22 bp, Homo sapiens
atgtggaaggaaaatatttcat

SEQ ID NO: 856477 - DNA, 23 bp, Homo sapiens
atgtggaaggaaaatatttcatt

SEQ ID NO: 856478 - DNA, 20 bp, Homo sapiens
atgtggacgtgcactgacag

SEQ ID NO: 856479 - DNA, 15 bp, Homo sapiens
atgtggactaaatat

SEQ ID NO: 856480 - DNA, 16 bp, Homo sapiens
atgtggactaaatatc

SEQ ID NO: 856481 - DNA, 16 bp, Homo sapiens
atgtggagcagcagcc

SEQ ID NO: 856482 - DNA, 18 bp, Homo sapiens
atgtggaggaagagccac

SEQ ID NO: 856483 - DNA, 19 bp, Homo sapiens
atgtggaggaagagccacc

SEQ ID NO: 856484 - DNA, 22 bp, Homo sapiens
atgtggaggaagagccacctgc

SEQ ID NO: 856485 - DNA, 18 bp, Homo sapiens
atgtggataaaactgtgt

SEQ ID NO: 856486 - DNA, 19 bp, Homo sapiens
atgtggataaaactgtgta

SEQ ID NO: 856487 - DNA, 14 bp, Homo sapiens
atgtggatctgggg

SEQ ID NO: 856488 - DNA, 17 bp, Homo sapiens
atgtggattttgtagat

SEQ ID NO: 856489 - DNA, 14 bp, Homo sapiens
atgtggcagcccat

SEQ ID NO: 856490 - DNA, 23 bp, Homo sapiens
atgtggccacaactgctgtggcc

SEQ ID NO: 856491 - DNA, 14 bp, Homo sapiens
atgtggccccaccc

SEQ ID NO: 856492 - DNA, 18 bp, Homo sapiens
atgtggcccctgaacaag

SEQ ID NO: 856493 - DNA, 20 bp, Homo sapiens
atgtggcccctgaacaagaa

SEQ ID NO: 856494 - DNA, 22 bp, Homo sapiens
atgtggcccctgaacaagaatt

SEQ ID NO: 856495 - DNA, 13 bp, Homo sapiens
atgtggccctggc

SEQ ID NO: 856496 - DNA, 14 bp, Homo sapiens
atgtggccctggcc

SEQ ID NO: 856497 - DNA, 19 bp, Homo sapiens
atgtggccctggcctgctg

SEQ ID NO: 856498 - DNA, 17 bp, Homo sapiens
atgtggccgaggacttt

SEQ ID NO: 856499 - DNA, 17 bp, Homo sapiens
atgtggcctccatgtgg

SEQ ID NO: 856500 - DNA, 14 bp, Homo sapiens
atgtggcctgccca

SEQ ID NO: 856501 - DNA, 16 bp, Homo sapiens
atgtggcctgcccagc

SEQ ID NO: 856502 - DNA, 20 bp, Homo sapiens
atgtggcctgcccagcctca

SEQ ID NO: 856503 - DNA, 23 bp, Homo sapiens
atgtggctcagtgccttcctctc

SEQ ID NO: 856504 - DNA, 14 bp, Homo sapiens
atgtggctgaagac

SEQ ID NO: 856505 - DNA, 13 bp, Homo sapiens
atgtggctggaag

SEQ ID NO: 856506 - DNA, 20 bp, Homo sapiens
atgtggctggaagatcctgc

SEQ ID NO: 856507 - DNA, 22 bp, Homo sapiens
atgtggctgtatcttgtttttc

SEQ ID NO: 856508 - DNA, 17 bp, Homo sapiens
atgtggcttctctgtct

SEQ ID NO: 856509 - DNA, 16 bp, Homo sapiens
atgtggcttgagaaat

SEQ ID NO: 856510 - DNA, 11 bp, Homo sapiens
atgtgggaggg

SEQ ID NO: 856511 - DNA, 12 bp, Homo sapiens
atgtgggcagct

SEQ ID NO: 856512 - DNA, 13 bp, Homo sapiens
atgtggggccagg

SEQ ID NO: 856513 - DNA, 23 bp, Homo sapiens
atgtggggttgctgaagatgcct

SEQ ID NO: 856514 - DNA, 14 bp, Homo sapiens
atgtgtataaattg

SEQ ID NO: 856515 - DNA, 19 bp, Homo sapiens
atgtgtataaattgtcttt

SEQ ID NO: 856516 - DNA, 21 bp, Homo sapiens
atgtgtatcagtgtttatgtg

SEQ ID NO: 856517 - DNA, 14 bp, Homo sapiens
atgtgtcacttgtg

SEQ ID NO: 856518 - DNA, 19 bp, Homo sapiens
atgtgtcagaataggaaaa

SEQ ID NO: 856519 - DNA, 23 bp, Homo sapiens
atgtgtcagaataggaaaacatt

SEQ ID NO: 856520 - DNA, 17 bp, Homo sapiens
atgtgtcagagtgttgt

SEQ ID NO: 856521 - DNA, 21 bp, Homo sapiens
atgtgtcatttccggctgctg

SEQ ID NO: 856522 - DNA, 14 bp, Homo sapiens
atgtgtccaagaca

SEQ ID NO: 856523 - DNA, 16 bp, Homo sapiens
atgtgtccaagacaca

SEQ ID NO: 856524 - DNA, 18 bp, Homo sapiens
atgtgtcccccccaggcc

SEQ ID NO: 856525 - DNA, 13 bp, Homo sapiens
atgtgtcccctca

SEQ ID NO: 856526 - DNA, 22 bp, Homo sapiens
atgtgtcccctcactctgtcag

SEQ ID NO: 856527 - DNA, 20 bp, Homo sapiens
atgtgtcccgaatccacagt

SEQ ID NO: 856528 - DNA, 18 bp, Homo sapiens
atgtgtcctatctatctt

SEQ ID NO: 856529 - DNA, 22 bp, Homo sapiens
atgtgtcctatctatcttccaa

SEQ ID NO: 856530 - DNA, 14 bp, Homo sapiens
atgtgtctcccaga

SEQ ID NO: 856531 - DNA, 14 bp, Homo sapiens
atgtgtctctgctt

SEQ ID NO: 856532 - DNA, 21 bp, Homo sapiens
atgtgtctgctaatgtaaact

SEQ ID NO: 856533 - DNA, 21 bp, Homo sapiens
atgtgtctgggagagcctggc

SEQ ID NO: 856534 - DNA, 18 bp, Homo sapiens
atgtgtctgtatttcatg

SEQ ID NO: 856535 - DNA, 13 bp, Homo sapiens
atgtgtcttcaat

SEQ ID NO: 856536 - DNA, 15 bp, Homo sapiens
atgtgtgaaacaatg

SEQ ID NO: 856537 - DNA, 16 bp, Homo sapiens
atgtgtgaaacaatgt

SEQ ID NO: 856538 - DNA, 18 bp, Homo sapiens
atgtgtgagcatcctgca

SEQ ID NO: 856539 - DNA, 22 bp, Homo sapiens
atgtgtgaggagctgctggctt

SEQ ID NO: 856540 - DNA, 14 bp, Homo sapiens
atgtgtgcaggagc

SEQ ID NO: 856541 - DNA, 12 bp, Homo sapiens
atgtgtgcatgt

SEQ ID NO: 856542 - DNA, 11 bp, Homo sapiens
atgtgtgccat

SEQ ID NO: 856543 - DNA, 18 bp, Homo sapiens
atgtgtgccatagagttt

SEQ ID NO: 856544 - DNA, 22 bp, Homo sapiens
atgtgtgccatagagtttaaca

SEQ ID NO: 856545 - DNA, 12 bp, Homo sapiens
atgtgtgcctgt

SEQ ID NO: 856546 - DNA, 15 bp, Homo sapiens
atgtgtgcctgtggc

SEQ ID NO: 856547 - DNA, 17 bp, Homo sapiens
atgtgtgcctgtggcag

SEQ ID NO: 856548 - DNA, 18 bp, Homo sapiens
atgtgtgcgagtgtgtgc

SEQ ID NO: 856549 - DNA, 19 bp, Homo sapiens
atgtgtggctgtgggtgtg

SEQ ID NO: 856550 - DNA, 20 bp, Homo sapiens
atgtgtgggatcattgcatt

SEQ ID NO: 856551 - DNA, 15 bp, Homo sapiens
atgtgtgggtgctga

SEQ ID NO: 856552 - DNA, 16 bp, Homo sapiens
atgtgtggtggcctca

SEQ ID NO: 856553 - DNA, 17 bp, Homo sapiens
atgtgtggtggcctcag

SEQ ID NO: 856554 - DNA, 16 bp, Homo sapiens
atgtgtgtagactgta

SEQ ID NO: 856555 - DNA, 23 bp, Homo sapiens
atgtgtgtaggttatctttttaa

SEQ ID NO: 856556 - DNA, 16 bp, Homo sapiens
atgtgtgtatgtgtgt

SEQ ID NO: 856557 - DNA, 13 bp, Homo sapiens
atgtgtgtgcatg

SEQ ID NO: 856558 - DNA, 15 bp, Homo sapiens
atgtgtgtgctcagg

SEQ ID NO: 856559 - DNA, 14 bp, Homo sapiens
atgtgtgtgtgggt

SEQ ID NO: 856560 - DNA, 15 bp, Homo sapiens
atgtgtgtgtgggtg

SEQ ID NO: 856561 - DNA, 21 bp, Homo sapiens
atgtgtgtgtgggtgtgtgcg

SEQ ID NO: 856562 - DNA, 12 bp, Homo sapiens
atgtgtgtgtgt

SEQ ID NO: 856563 - DNA, 20 bp, Homo sapiens
atgtgttaaacatgctaaat

SEQ ID NO: 856564 - DNA, 13 bp, Homo sapiens
atgtgttaatctt

SEQ ID NO: 856565 - DNA, 21 bp, Homo sapiens
atgtgttatagacggtgctca

SEQ ID NO: 856566 - DNA, 16 bp, Homo sapiens
atgtgttatgaacatc

SEQ ID NO: 856567 - DNA, 21 bp, Homo sapiens
atgtgttcattcaagctattt

SEQ ID NO: 856568 - DNA, 12 bp, Homo sapiens
atgtgttcctcc

SEQ ID NO: 856569 - DNA, 23 bp, Homo sapiens
atgtgttcctccattttcttatc

SEQ ID NO: 856570 - DNA, 19 bp, Homo sapiens
atgtgtttctgacacaaga

SEQ ID NO: 856571 - DNA, 18 bp, Homo sapiens
atgtgtttctgtaacaaa

SEQ ID NO: 856572 - DNA, 13 bp, Homo sapiens
atgtgtttgctgc

SEQ ID NO: 856573 - DNA, 23 bp, Homo sapiens
atgtgtttggatacatctgctgt

SEQ ID NO: 856574 - DNA, 18 bp, Homo sapiens
atgtgtttggttctgggg

SEQ ID NO: 856575 - DNA, 16 bp, Homo sapiens
atgtgttttataaaat

SEQ ID NO: 856576 - DNA, 19 bp, Homo sapiens
atgtgttttcatcatttca

SEQ ID NO: 856577 - DNA, 14 bp, Homo sapiens
atgtgttttctgaa

SEQ ID NO: 856578 - DNA, 15 bp, Homo sapiens
atgtgttttctgtag

SEQ ID NO: 856579 - DNA, 20 bp, Homo sapiens
atgtgtttttctatatagtt

SEQ ID NO: 856580 - DNA, 22 bp, Homo sapiens
atgtgtttttctatatagttcc

SEQ ID NO: 856581 - DNA, 19 bp, Homo sapiens
atgttaaaaaaataagaag

SEQ ID NO: 856582 - DNA, 22 bp, Homo sapiens
atgttaaaaaaataagaagaat

SEQ ID NO: 856583 - DNA, 18 bp, Homo sapiens
atgttaaaaagaaatcca

SEQ ID NO: 856584 - DNA, 12 bp, Homo sapiens
atgttaaagcat

SEQ ID NO: 856585 - DNA, 18 bp, Homo sapiens
atgttaaagcatcagaga

SEQ ID NO: 856586 - DNA, 12 bp, Homo sapiens
atgttaaatact

SEQ ID NO: 856587 - DNA, 15 bp, Homo sapiens
atgttaaatactgtg

SEQ ID NO: 856588 - DNA, 19 bp, Homo sapiens
atgttaaatactgtgcaga

SEQ ID NO: 856589 - DNA, 14 bp, Homo sapiens
atgttaaatgactt

SEQ ID NO: 856590 - DNA, 14 bp, Homo sapiens
atgttaaatgttat

SEQ ID NO: 856591 - DNA, 22 bp, Homo sapiens
atgttaacaatgcctattgtaa

SEQ ID NO: 856592 - DNA, 23 bp, Homo sapiens
atgttaacaatgcctattgtaat

SEQ ID NO: 856593 - DNA, 16 bp, Homo sapiens
atgttaacctctgctt

SEQ ID NO: 856594 - DNA, 19 bp, Homo sapiens
atgttaacctctgctttta

SEQ ID NO: 856595 - DNA, 16 bp, Homo sapiens
atgttaagacttgaca

SEQ ID NO: 856596 - DNA, 18 bp, Homo sapiens
atgttaagataacttact

SEQ ID NO: 856597 - DNA, 20 bp, Homo sapiens
atgttaagataacttactgt

SEQ ID NO: 856598 - DNA, 16 bp, Homo sapiens
atgttaagcatggatt

SEQ ID NO: 856599 - DNA, 15 bp, Homo sapiens
atgttaagcatttat

SEQ ID NO: 856600 - DNA, 13 bp, Homo sapiens
atgttaagctctt

SEQ ID NO: 856601 - DNA, 20 bp, Homo sapiens
atgttaagggaagaattcca

SEQ ID NO: 856602 - DNA, 23 bp, Homo sapiens
atgttaagtgccattactactgt

SEQ ID NO: 856603 - DNA, 14 bp, Homo sapiens
atgttaagttatat

SEQ ID NO: 856604 - DNA, 20 bp, Homo sapiens
atgttaatggatttcagaag

SEQ ID NO: 856605 - DNA, 15 bp, Homo sapiens
atgttacaagtttgc

SEQ ID NO: 856606 - DNA, 20 bp, Homo sapiens
atgttacaagtttgctaaaa

SEQ ID NO: 856607 - DNA, 17 bp, Homo sapiens
atgttacgtgaagaaat

SEQ ID NO: 856608 - DNA, 21 bp, Homo sapiens
atgttactattttctacaatt

SEQ ID NO: 856609 - DNA, 13 bp, Homo sapiens
atgttactgacca

SEQ ID NO: 856610 - DNA, 12 bp, Homo sapiens
atgttactgaga

SEQ ID NO: 856611 - DNA, 13 bp, Homo sapiens
atgttactgatca

SEQ ID NO: 856612 - DNA, 16 bp, Homo sapiens
atgttactgatcatgc

SEQ ID NO: 856613 - DNA, 18 bp, Homo sapiens
atgttactgatcatgcat

SEQ ID NO: 856614 - DNA, 20 bp, Homo sapiens
atgttactgatcatgcattg

SEQ ID NO: 856615 - DNA, 16 bp, Homo sapiens
atgttagaagaagagg

SEQ ID NO: 856616 - DNA, 22 bp, Homo sapiens
atgttagactcatggtgtgtta

SEQ ID NO: 856617 - DNA, 22 bp, Homo sapiens
atgttagaggttttaaagtgat

SEQ ID NO: 856618 - DNA, 15 bp, Homo sapiens
atgttagcaaagagt

SEQ ID NO: 856619 - DNA, 17 bp, Homo sapiens
atgttagggtataagtt

SEQ ID NO: 856620 - DNA, 19 bp, Homo sapiens
atgttagggtataagttgc

SEQ ID NO: 856621 - DNA, 21 bp, Homo sapiens
attaatttggagcacaaaatt

SEQ ID NO: 856622 - DNA, 19 bp, Homo sapiens
attaatttgtgaatttgca

SEQ ID NO: 856623 - DNA, 21 bp, Homo sapiens
attaattttcttggttctttc

SEQ ID NO: 856624 - DNA, 14 bp, Homo sapiens
attaattttgtgca

SEQ ID NO: 856625 - DNA, 14 bp, Homo sapiens
attacaaaagagac

SEQ ID NO: 856626 - DNA, 24 bp, Homo sapiens
attacaaagttaaaattgttatca

SEQ ID NO: 856627 - DNA, 16 bp, Homo sapiens
attacaaatcagaagt

SEQ ID NO: 856628 - DNA, 21 bp, Homo sapiens
attacaaatgcaaatttctat

SEQ ID NO: 856629 - DNA, 20 bp, Homo sapiens
attacaaattttcactgctg

SEQ ID NO: 856630 - DNA, 20 bp, Homo sapiens
attacaacaatctggagata

SEQ ID NO: 856631 - DNA, 22 bp, Homo sapiens
attacaagtggctccccacctg

SEQ ID NO: 856632 - DNA, 23 bp, Homo sapiens
attacaagtggctccccacctgg

SEQ ID NO: 856633 - DNA, 15 bp, Homo sapiens
attacaatgtatctt

SEQ ID NO: 856634 - DNA, 18 bp, Homo sapiens
attacaatgtatctttat

SEQ ID NO: 856635 - DNA, 18 bp, Homo sapiens
attacaattttatctgtt

SEQ ID NO: 856636 - DNA, 13 bp, Homo sapiens
attacaattttta

SEQ ID NO: 856637 - DNA, 16 bp, Homo sapiens
attacacaataaagca

SEQ ID NO: 856638 - DNA, 20 bp, Homo sapiens
attacactgtatttgtatct

SEQ ID NO: 856639 - DNA, 16 bp, Homo sapiens
attacactgtgccttt

SEQ ID NO: 856640 - DNA, 19 bp, Homo sapiens
attacagagaggagaaaca

SEQ ID NO: 856641 - DNA, 19 bp, Homo sapiens
attacagatgggcaaatta

SEQ ID NO: 856642 - DNA, 13 bp, Homo sapiens
attacagcttcac

SEQ ID NO: 856643 - DNA, 22 bp, Homo sapiens
attacaggcacctgccaccatg

SEQ ID NO: 856644 - DNA, 15 bp, Homo sapiens
attacaggcttgagc

SEQ ID NO: 856645 - DNA, 22 bp, Homo sapiens
attacataaataaattaaataa

SEQ ID NO: 856646 - DNA, 15 bp, Homo sapiens
attacataatttagt

SEQ ID NO: 856647 - DNA, 22 bp, Homo sapiens
attacataatttagttgtttct

SEQ ID NO: 856648 - DNA, 22 bp, Homo sapiens
attacatagatcagccattaaa

SEQ ID NO: 856649 - DNA, 15 bp, Homo sapiens
attacatctttcaca

SEQ ID NO: 856650 - DNA, 23 bp, Homo sapiens
attacatgttttttcatttgtaa

SEQ ID NO: 856651 - DNA, 16 bp, Homo sapiens
attacattattaaacg

SEQ ID NO: 856652 - DNA, 17 bp, Homo sapiens
attacattattaaacga

SEQ ID NO: 856653 - DNA, 19 bp, Homo sapiens
attacattgctttttcttg

SEQ ID NO: 856654 - DNA, 15 bp, Homo sapiens
attacatttatacat

SEQ ID NO: 856655 - DNA, 16 bp, Homo sapiens
attacatttatacatc

SEQ ID NO: 856656 - DNA, 15 bp, Homo sapiens
attacatttctgaat

SEQ ID NO: 856657 - DNA, 10 bp, Homo sapiens
attacatttt

SEQ ID NO: 856658 - DNA, 12 bp, Homo sapiens
attaccaaaata

SEQ ID NO: 856659 - DNA, 14 bp, Homo sapiens
attaccaacctgtt

SEQ ID NO: 856660 - DNA, 15 bp, Homo sapiens
attaccattaattac

SEQ ID NO: 856661 - DNA, 17 bp, Homo sapiens
attaccattaattacat

SEQ ID NO: 856662 - DNA, 19 bp, Homo sapiens
attaccgcgttgtaaaata

SEQ ID NO: 856663 - DNA, 20 bp, Homo sapiens
attaccgcgttgtaaaatat

SEQ ID NO: 856664 - DNA, 15 bp, Homo sapiens
attacctagaaatct

SEQ ID NO: 856665 - DNA, 19 bp, Homo sapiens
attacctggatgttctttt

SEQ ID NO: 856666 - DNA, 11 bp, Homo sapiens
attacctgtac

SEQ ID NO: 856667 - DNA, 19 bp, Homo sapiens
attaccttctattggtctc

SEQ ID NO: 856668 - DNA, 16 bp, Homo sapiens
attacctttaatttta

SEQ ID NO: 856669 - DNA, 16 bp, Homo sapiens
attacgtgagccaggt

SEQ ID NO: 856670 - DNA, 13 bp, Homo sapiens
attacgtgcattt

SEQ ID NO: 856671 - DNA, 14 bp, Homo sapiens
attacgtgcattta

SEQ ID NO: 856672 - DNA, 20 bp, Homo sapiens
attacgtgcatttaaactct

SEQ ID NO: 856673 - DNA, 23 bp, Homo sapiens
attacgtgcatttaaactctgcc

SEQ ID NO: 856674 - DNA, 20 bp, Homo sapiens
attacgtgtatgtttcttct

SEQ ID NO: 856675 - DNA, 21 bp, Homo sapiens
attacgtgtatgtttcttctt

SEQ ID NO: 856676 - DNA, 13 bp, Homo sapiens
attactaaattgt

SEQ ID NO: 856677 - DNA, 18 bp, Homo sapiens
attactaattctatttct

SEQ ID NO: 856678 - DNA, 19 bp, Homo sapiens
attactaattctatttctc

SEQ ID NO: 856679 - DNA, 15 bp, Homo sapiens
attactaattttaca

SEQ ID NO: 856680 - DNA, 19 bp, Homo sapiens
attactaattttacacatt

SEQ ID NO: 856681 - DNA, 15 bp, Homo sapiens
attactactcctttg

SEQ ID NO: 856682 - DNA, 16 bp, Homo sapiens
attactaggtgacatg

SEQ ID NO: 856683 - DNA, 18 bp, Homo sapiens
attactatgactgctccc

SEQ ID NO: 856684 - DNA, 13 bp, Homo sapiens
attactcaggttt

SEQ ID NO: 856685 - DNA, 11 bp, Homo sapiens
attactccaag

SEQ ID NO: 856686 - DNA, 15 bp, Homo sapiens
attactccaaggttt

SEQ ID NO: 856687 - DNA, 18 bp, Homo sapiens
attactccaaggtttata

SEQ ID NO: 856688 - DNA, 19 bp, Homo sapiens
attactctagtttattcta

SEQ ID NO: 856689 - DNA, 21 bp, Homo sapiens
attactctcattctttgaaca

SEQ ID NO: 856690 - DNA, 16 bp, Homo sapiens
attactcttcctctaa

SEQ ID NO: 856691 - DNA, 19 bp, Homo sapiens
attactgaggggattctct

SEQ ID NO: 856692 - DNA, 21 bp, Homo sapiens
attactgaggggattctctac

SEQ ID NO: 856693 - DNA, 15 bp, Homo sapiens
attactgatgtgata

SEQ ID NO: 856694 - DNA, 13 bp, Homo sapiens
attactgccattc

SEQ ID NO: 856695 - DNA, 20 bp, Homo sapiens
attactgccattcacttcat

SEQ ID NO: 856696 - DNA, 21 bp, Homo sapiens
attactgctaagtatttccca

SEQ ID NO: 856697 - DNA, 18 bp, Homo sapiens
attactgctttaatcaga

SEQ ID NO: 856698 - DNA, 17 bp, Homo sapiens
attactggatctcttaa

SEQ ID NO: 856699 - DNA, 17 bp, Homo sapiens
attactggcctttttca

SEQ ID NO: 856700 - DNA, 23 bp, Homo sapiens
attactgggccttagtgggccag

SEQ ID NO: 856701 - DNA, 15 bp, Homo sapiens
attactggtccaaaa

SEQ ID NO: 856702 - DNA, 15 bp, Homo sapiens
attactgtcaataaa

SEQ ID NO: 856703 - DNA, 12 bp, Homo sapiens
attactgtcccc

SEQ ID NO: 856704 - DNA, 13 bp, Homo sapiens
attactgtcttta

SEQ ID NO: 856705 - DNA, 14 bp, Homo sapiens
attactgttccaga

SEQ ID NO: 856706 - DNA, 19 bp, Homo sapiens
attactgttccagattcct

SEQ ID NO: 856707 - DNA, 14 bp, Homo sapiens
attactgttgcatt

SEQ ID NO: 856708 - DNA, 20 bp, Homo sapiens
attactgttgcatttacttt

SEQ ID NO: 856709 - DNA, 17 bp, Homo sapiens
attactgttttatgttg

SEQ ID NO: 856710 - DNA, 18 bp, Homo sapiens
attactgttttgggcctc

SEQ ID NO: 856711 - DNA, 17 bp, Homo sapiens
attacttaagatgttta

SEQ ID NO: 856712 - DNA, 20 bp, Homo sapiens
attacttaggttattttgct

SEQ ID NO: 856713 - DNA, 23 bp, Homo sapiens
attacttaggttattttgctttg

SEQ ID NO: 856714 - DNA, 21 bp, Homo sapiens
attacttatttaactgattaa

SEQ ID NO: 856715 - DNA, 20 bp, Homo sapiens
attacttctgtttgggagac

SEQ ID NO: 856716 - DNA, 16 bp, Homo sapiens
attacttgtgcactta

SEQ ID NO: 856717 - DNA, 18 bp, Homo sapiens
attacttgtgcacttagt

SEQ ID NO: 856718 - DNA, 19 bp, Homo sapiens
attacttgtgttacttgcc

SEQ ID NO: 856719 - DNA, 21 bp, Homo sapiens
attactttaaaataaaaaagt

SEQ ID NO: 856720 - DNA, 21 bp, Homo sapiens
attactttggggctaatttaa

SEQ ID NO: 856721 - DNA, 23 bp, Homo sapiens
attactttggggctaatttaaca

SEQ ID NO: 856722 - DNA, 15 bp, Homo sapiens
attactttgtcccgc

SEQ ID NO: 856723 - DNA, 18 bp, Homo sapiens
attacttttgcaaactgt

SEQ ID NO: 856724 - DNA, 18 bp, Homo sapiens
attacttttgtaaatatt

SEQ ID NO: 856725 - DNA, 20 bp, Homo sapiens
attagaaaaatatatgctta

SEQ ID NO: 856726 - DNA, 21 bp, Homo sapiens
attagaaaaatatatgcttac

SEQ ID NO: 856727 - DNA, 18 bp, Homo sapiens
attagaaaatgttattta

SEQ ID NO: 856728 - DNA, 13 bp, Homo sapiens
attagaaaattag

SEQ ID NO: 856729 - DNA, 20 bp, Homo sapiens
attagaaacccaaattggga

SEQ ID NO: 856730 - DNA, 22 bp, Homo sapiens
attagaaatagacagtatattt

SEQ ID NO: 856731 - DNA, 11 bp, Homo sapiens
attagaaatga

SEQ ID NO: 856732 - DNA, 19 bp, Homo sapiens
attagaaatttaatttctt

SEQ ID NO: 856733 - DNA, 17 bp, Homo sapiens
attagaacattcacttt

SEQ ID NO: 856734 - DNA, 19 bp, Homo sapiens
attagaagtataaggtgct

SEQ ID NO: 856735 - DNA, 15 bp, Homo sapiens
attagaagtctttca

SEQ ID NO: 856736 - DNA, 14 bp, Homo sapiens
attagaatgtgatt

SEQ ID NO: 856737 - DNA, 17 bp, Homo sapiens
attagaattaccatttg

SEQ ID NO: 856738 - DNA, 19 bp, Homo sapiens
attagtctttttctttttt

SEQ ID NO: 856739 - DNA, 23 bp, Homo sapiens
attagtgattctgatttcagttt

SEQ ID NO: 856740 - DNA, 16 bp, Homo sapiens
attagtgccacttaat

SEQ ID NO: 856741 - DNA, 18 bp, Homo sapiens
attagtgccacttaatgt

SEQ ID NO: 856742 - DNA, 16 bp, Homo sapiens
attagtgccagaattt

SEQ ID NO: 856743 - DNA, 18 bp, Homo sapiens
attagtgccagaatttta

SEQ ID NO: 856744 - DNA, 22 bp, Homo sapiens
attagtgccagaattttaggaa

SEQ ID NO: 856745 - DNA, 18 bp, Homo sapiens
attagtgtcaacttttaa

SEQ ID NO: 856746 - DNA, 21 bp, Homo sapiens
attagtgtgacagtttccaaa

SEQ ID NO: 856747 - DNA, 18 bp, Homo sapiens
attagttacaaagttata

SEQ ID NO: 856748 - DNA, 19 bp, Homo sapiens
attagttccccaaatacaa

SEQ ID NO: 856749 - DNA, 22 bp, Homo sapiens
attagttgaaaggcctcaagaa

SEQ ID NO: 856750 - DNA, 20 bp, Homo sapiens
attagtttaccacttgcctt

SEQ ID NO: 856751 - DNA, 18 bp, Homo sapiens
attagtttatattactct

SEQ ID NO: 856752 - DNA, 19 bp, Homo sapiens
attagttttaatctcttaa

SEQ ID NO: 856753 - DNA, 11 bp, Homo sapiens
attataaaagc

SEQ ID NO: 856754 - DNA, 13 bp, Homo sapiens
attataaactata

SEQ ID NO: 856755 - DNA, 15 bp, Homo sapiens
attataaactataaa

SEQ ID NO: 856756 - DNA, 15 bp, Homo sapiens
attataaatgacaac

SEQ ID NO: 856757 - DNA, 12 bp, Homo sapiens
attataaatgtt

SEQ ID NO: 856758 - DNA, 13 bp, Homo sapiens
attataaatgttt

SEQ ID NO: 856759 - DNA, 18 bp, Homo sapiens
attataaatgtttggaaa

SEQ ID NO: 856760 - DNA, 19 bp, Homo sapiens
attataaatgtttggaaag

SEQ ID NO: 856761 - DNA, 17 bp, Homo sapiens
attataacaagtgtgtc

SEQ ID NO: 856762 - DNA, 22 bp, Homo sapiens
attataaccttaatttattatt

SEQ ID NO: 856763 - DNA, 12 bp, Homo sapiens
attataactgta

SEQ ID NO: 856764 - DNA, 22 bp, Homo sapiens
attataagggagagctgagcca

SEQ ID NO: 856765 - DNA, 21 bp, Homo sapiens
attataagggccctgccctgt

SEQ ID NO: 856766 - DNA, 15 bp, Homo sapiens
attataagtcttaca

SEQ ID NO: 856767 - DNA, 15 bp, Homo sapiens
attataataagcaaa

SEQ ID NO: 856768 - DNA, 18 bp, Homo sapiens
attataatactaaaactc

SEQ ID NO: 856769 - DNA, 22 bp, Homo sapiens
attataatatactatatttatg

SEQ ID NO: 856770 - DNA, 19 bp, Homo sapiens
attataatctcaaaggaga

SEQ ID NO: 856771 - DNA, 13 bp, Homo sapiens
attataatgaatt

SEQ ID NO: 856772 - DNA, 20 bp, Homo sapiens
attataattgtaatggattt

SEQ ID NO: 856773 - DNA, 17 bp, Homo sapiens
attataattgttgatat

SEQ ID NO: 856774 - DNA, 15 bp, Homo sapiens
attataatttaatgc

SEQ ID NO: 856775 - DNA, 14 bp, Homo sapiens
attataatttgggt

SEQ ID NO: 856776 - DNA, 13 bp, Homo sapiens
attatacaggaaa

SEQ ID NO: 856777 - DNA, 14 bp, Homo sapiens
attataccatgtgt

SEQ ID NO: 856778 - DNA, 23 bp, Homo sapiens
attatacttgagattttcctcca

SEQ ID NO: 856779 - DNA, 19 bp, Homo sapiens
attatagaaggctgtctta

SEQ ID NO: 856780 - DNA, 14 bp, Homo sapiens
attatataaatata

SEQ ID NO: 856781 - DNA, 15 bp, Homo sapiens
attatataactcttt

SEQ ID NO: 856782 - DNA, 17 bp, Homo sapiens
attatataactgtattt

SEQ ID NO: 856783 - DNA, 16 bp, Homo sapiens
attatatatttacaga

SEQ ID NO: 856784 - DNA, 20 bp, Homo sapiens
attatatatttttctgagat

SEQ ID NO: 856785 - DNA, 19 bp, Homo sapiens
attatatcagcttttctga

SEQ ID NO: 856786 - DNA, 13 bp, Homo sapiens
attatatgaagtt

SEQ ID NO: 856787 - DNA, 18 bp, Homo sapiens
attatatgttcagattat

SEQ ID NO: 856788 - DNA, 13 bp, Homo sapiens
attatattatgtt

SEQ ID NO: 856789 - DNA, 16 bp, Homo sapiens
attatattatgtttaa

SEQ ID NO: 856790 - DNA, 16 bp, Homo sapiens
attcagaaagcttcaa

SEQ ID NO: 856791 - DNA, 16 bp, Homo sapiens
attcagaaattaaaat

SEQ ID NO: 856792 - DNA, 21 bp, Homo sapiens
attcagaaattaaaatattat

SEQ ID NO: 856793 - DNA, 16 bp, Homo sapiens
attcagaactatttaa

SEQ ID NO: 856794 - DNA, 19 bp, Homo sapiens
attcagaactatttaaaat

SEQ ID NO: 856795 - DNA, 20 bp, Homo sapiens
attcagaactatttaaaata

SEQ ID NO: 856796 - DNA, 14 bp, Homo sapiens
attcagaagaaaaa

SEQ ID NO: 856797 - DNA, 17 bp, Homo sapiens
attcagaagaaaaagaa

SEQ ID NO: 856798 - DNA, 18 bp, Homo sapiens
attcagaagcttctgaaa

SEQ ID NO: 856799 - DNA, 13 bp, Homo sapiens
attcagacaaaat

SEQ ID NO: 856800 - DNA, 19 bp, Homo sapiens
attcagactttcacaccat

SEQ ID NO: 856801 - DNA, 12 bp, Homo sapiens
attcagaggaag

SEQ ID NO: 856802 - DNA, 20 bp, Homo sapiens
attcagaggcagtgatgact

SEQ ID NO: 856803 - DNA, 18 bp, Homo sapiens
attcagatatatttttca

SEQ ID NO: 856804 - DNA, 21 bp, Homo sapiens
attcagatatatttttcacag

SEQ ID NO: 856805 - DNA, 19 bp, Homo sapiens
attcagatcactgaattta

SEQ ID NO: 856806 - DNA, 20 bp, Homo sapiens
attcagcaccctgggtgcca

SEQ ID NO: 856807 - DNA, 20 bp, Homo sapiens
attcagcactgatttcacaa

SEQ ID NO: 856808 - DNA, 20 bp, Homo sapiens
attcagcagcaaattttcag

SEQ ID NO: 856809 - DNA, 17 bp, Homo sapiens
attcagccaacatgtga

SEQ ID NO: 856810 - DNA, 15 bp, Homo sapiens
attcagctcattatg

SEQ ID NO: 856811 - DNA, 19 bp, Homo sapiens
attcagctcattatgaaaa

SEQ ID NO: 856812 - DNA, 22 bp, Homo sapiens
attcagctcattatgaaaaaca

SEQ ID NO: 856813 - DNA, 14 bp, Homo sapiens
attcagctctgcaa

SEQ ID NO: 856814 - DNA, 15 bp, Homo sapiens
attcaggcagcactg

SEQ ID NO: 856815 - DNA, 14 bp, Homo sapiens
attcaggccagccc

SEQ ID NO: 856816 - DNA, 16 bp, Homo sapiens
attcaggctactcatt

SEQ ID NO: 856817 - DNA, 14 bp, Homo sapiens
attcaggggctttg

SEQ ID NO: 856818 - DNA, 17 bp, Homo sapiens
attcaggtaatacaaac

SEQ ID NO: 856819 - DNA, 18 bp, Homo sapiens
attcaggtacagaaaaca

SEQ ID NO: 856820 - DNA, 20 bp, Homo sapiens
attcaggtatgttgccttta

SEQ ID NO: 856821 - DNA, 23 bp, Homo sapiens
attcaggtatgttgcctttatgg

SEQ ID NO: 856822 - DNA, 12 bp, Homo sapiens
attcaggttttt

SEQ ID NO: 856823 - DNA, 15 bp, Homo sapiens
attcaggtttttcct

SEQ ID NO: 856824 - DNA, 23 bp, Homo sapiens
attcaggtttttcctttttttgt

SEQ ID NO: 856825 - DNA, 19 bp, Homo sapiens
attcagtaataactctacc

SEQ ID NO: 856826 - DNA, 15 bp, Homo sapiens
attcagtagtttgag

SEQ ID NO: 856827 - DNA, 21 bp, Homo sapiens
attcagtctctgaatacacag

SEQ ID NO: 856828 - DNA, 14 bp, Homo sapiens
attcagtgaaaaga

SEQ ID NO: 856829 - DNA, 15 bp, Homo sapiens
attcagtgaatttgt

SEQ ID NO: 856830 - DNA, 18 bp, Homo sapiens
attcagtgaatttgtcca

SEQ ID NO: 856831 - DNA, 17 bp, Homo sapiens
attcagtgattactgtc

SEQ ID NO: 856832 - DNA, 21 bp, Homo sapiens
attcagtgctgtggcctgggc

SEQ ID NO: 856833 - DNA, 19 bp, Homo sapiens
attcagtgcttcttaaaga

SEQ ID NO: 856834 - DNA, 16 bp, Homo sapiens
attcagtggtcttatt

SEQ ID NO: 856835 - DNA, 21 bp, Homo sapiens
attcagttgctttgcccaaga

SEQ ID NO: 856836 - DNA, 17 bp, Homo sapiens
attcagtttcataaaag

SEQ ID NO: 856837 - DNA, 18 bp, Homo sapiens
attcagtttctaaaattg

SEQ ID NO: 856838 - DNA, 20 bp, Homo sapiens
attcagtttctaaaattgag

SEQ ID NO: 856839 - DNA, 13 bp, Homo sapiens
attcagttttcat

SEQ ID NO: 856840 - DNA, 19 bp, Homo sapiens
attcagtttttgtatcttg

SEQ ID NO: 856841 - DNA, 19 bp, Homo sapiens
attcagtttttttccagtt

SEQ ID NO: 856842 - DNA, 13 bp, Homo sapiens
attcataatgaat

SEQ ID NO: 856843 - DNA, 18 bp, Homo sapiens
attcataatgaattataa

SEQ ID NO: 856844 - DNA, 13 bp, Homo sapiens
attcatacttaaa

SEQ ID NO: 856845 - DNA, 14 bp, Homo sapiens
attcatacttaaaa

SEQ ID NO: 856846 - DNA, 23 bp, Homo sapiens
attcatagggaaaggttttgtat

SEQ ID NO: 856847 - DNA, 16 bp, Homo sapiens
attcatagtaacttct

SEQ ID NO: 856848 - DNA, 21 bp, Homo sapiens
attcatagtggattaatgcat

SEQ ID NO: 856849 - DNA, 14 bp, Homo sapiens
attcatattaagac

SEQ ID NO: 856850 - DNA, 19 bp, Homo sapiens
attcatattaagacagtgt

SEQ ID NO: 856851 - DNA, 19 bp, Homo sapiens
attcatattctgttggaag

SEQ ID NO: 856852 - DNA, 14 bp, Homo sapiens
attcatattgaata

SEQ ID NO: 856853 - DNA, 19 bp, Homo sapiens
attcatatttacttcttat

SEQ ID NO: 856854 - DNA, 20 bp, Homo sapiens
attcatatttacttcttata

SEQ ID NO: 856855 - DNA, 23 bp, Homo sapiens
attcatcaatatccctcttgtaa

SEQ ID NO: 856856 - DNA, 20 bp, Homo sapiens
attcatcactccaaaaacag

SEQ ID NO: 856857 - DNA, 12 bp, Homo sapiens
attcatcagaat

SEQ ID NO: 856858 - DNA, 16 bp, Homo sapiens
attcatcccaactgtc

SEQ ID NO: 856859 - DNA, 17 bp, Homo sapiens
attcatcccaactgtct

SEQ ID NO: 856860 - DNA, 13 bp, Homo sapiens
attcatcccctcc

SEQ ID NO: 856861 - DNA, 19 bp, Homo sapiens
attcatctaataaatcagt

SEQ ID NO: 856862 - DNA, 20 bp, Homo sapiens
attcatgccatctgttttca

SEQ ID NO: 856863 - DNA, 20 bp, Homo sapiens
attcatggcatgcttaaatt

SEQ ID NO: 856864 - DNA, 16 bp, Homo sapiens
attcatgtaacagttg

SEQ ID NO: 856865 - DNA, 15 bp, Homo sapiens
attcatgtaactctc

SEQ ID NO: 856866 - DNA, 23 bp, Homo sapiens
attcatgtaactctccagccatt

SEQ ID NO: 856867 - DNA, 13 bp, Homo sapiens
attcattaatata

SEQ ID NO: 856868 - DNA, 15 bp, Homo sapiens
attcattataatttg

SEQ ID NO: 856869 - DNA, 16 bp, Homo sapiens
attcattattcctcag

SEQ ID NO: 856870 - DNA, 23 bp, Homo sapiens
attcattattcctcagattgctg

SEQ ID NO: 856871 - DNA, 12 bp, Homo sapiens
attcattatttg

SEQ ID NO: 856872 - DNA, 22 bp, Homo sapiens
attcattctcataattcctaca

SEQ ID NO: 856873 - DNA, 17 bp, Homo sapiens
caaaactccgcccccag

SEQ ID NO: 856874 - DNA, 18 bp, Homo sapiens
caaaactccgcccccagc

SEQ ID NO: 856875 - DNA, 11 bp, Homo sapiens
caaaactgcca

SEQ ID NO: 856876 - DNA, 19 bp, Homo sapiens
caaaactgctttgtgcata

SEQ ID NO: 856877 - DNA, 18 bp, Homo sapiens
caaaactggaagcacagc

SEQ ID NO: 856878 - DNA, 11 bp, Homo sapiens
caaaactgttc

SEQ ID NO: 856879 - DNA, 18 bp, Homo sapiens
caaaacttaaaagtattc

SEQ ID NO: 856880 - DNA, 14 bp, Homo sapiens
caaaacttaagatg

SEQ ID NO: 856881 - DNA, 15 bp, Homo sapiens
caaaacttaagatgg

SEQ ID NO: 856882 - DNA, 16 bp, Homo sapiens
caaaacttcctgtttg

SEQ ID NO: 856883 - DNA, 21 bp, Homo sapiens
caaaacttcttagaaaattaa

SEQ ID NO: 856884 - DNA, 16 bp, Homo sapiens
caaaagaaaccatgac

SEQ ID NO: 856885 - DNA, 14 bp, Homo sapiens
caaaagaagaagtt

SEQ ID NO: 856886 - DNA, 14 bp, Homo sapiens
caaaagaagagttt

SEQ ID NO: 856887 - DNA, 12 bp, Homo sapiens
caaaagaagtaa

SEQ ID NO: 856888 - DNA, 17 bp, Homo sapiens
caaaagaagtaaaagca

SEQ ID NO: 856889 - DNA, 15 bp, Homo sapiens
caaaagaatcagaaa

SEQ ID NO: 856890 - DNA, 20 bp, Homo sapiens
caaaagaatttttgtttgga

SEQ ID NO: 856891 - DNA, 13 bp, Homo sapiens
caaaagacaaaaa

SEQ ID NO: 856892 - DNA, 19 bp, Homo sapiens
caaaagaccaaatctcagt

SEQ ID NO: 856893 - DNA, 22 bp, Homo sapiens
caactaaatgagattatatgtg

SEQ ID NO: 856894 - DNA, 13 bp, Homo sapiens
caactaagccctc

SEQ ID NO: 856895 - DNA, 14 bp, Homo sapiens
caactaagccctcg

SEQ ID NO: 856896 - DNA, 16 bp, Homo sapiens
caactaaggacaaatt

SEQ ID NO: 856897 - DNA, 16 bp, Homo sapiens
caactacaacttctcc

SEQ ID NO: 856898 - DNA, 15 bp, Homo sapiens
caactacagtctaaa

SEQ ID NO: 856899 - DNA, 11 bp, Homo sapiens
caactacctga

SEQ ID NO: 856900 - DNA, 18 bp, Homo sapiens
caactagatttgtccttt

SEQ ID NO: 856901 - DNA, 15 bp, Homo sapiens
caactagccaaggct

SEQ ID NO: 856902 - DNA, 18 bp, Homo sapiens
caactagcccctggggtg

SEQ ID NO: 856903 - DNA, 15 bp, Homo sapiens
caactagctgggact

SEQ ID NO: 856904 - DNA, 19 bp, Homo sapiens
caactataagcccactgtt

SEQ ID NO: 856905 - DNA, 18 bp, Homo sapiens
caactatattatcatgca

SEQ ID NO: 856906 - DNA, 19 bp, Homo sapiens
caactatattatcatgcaa

SEQ ID NO: 856907 - DNA, 16 bp, Homo sapiens
caactatggatcagaa

SEQ ID NO: 856908 - DNA, 15 bp, Homo sapiens
caactcaaagatgat

SEQ ID NO: 856909 - DNA, 18 bp, Homo sapiens
caactcactccttttaaa

SEQ ID NO: 856910 - DNA, 21 bp, Homo sapiens
caactcactccttttaaagaa

SEQ ID NO: 856911 - DNA, 23 bp, Homo sapiens
caactcactccttttaaagaaaa

SEQ ID NO: 856912 - DNA, 19 bp, Homo sapiens
caactcagaatgggggctt

SEQ ID NO: 856913 - DNA, 14 bp, Homo sapiens
caactccaacctct

SEQ ID NO: 856914 - DNA, 22 bp, Homo sapiens
caactccagcaacttcttctcc

SEQ ID NO: 856915 - DNA, 13 bp, Homo sapiens
caactccaggggc

SEQ ID NO: 856916 - DNA, 14 bp, Homo sapiens
caactccaggggca

SEQ ID NO: 856917 - DNA, 22 bp, Homo sapiens
caactccatggggttcgagact

SEQ ID NO: 856918 - DNA, 21 bp, Homo sapiens
caactccctgccccccagccc

SEQ ID NO: 856919 - DNA, 15 bp, Homo sapiens
caactccgcccagcc

SEQ ID NO: 856920 - DNA, 18 bp, Homo sapiens
caactccgtgtgcctggg

SEQ ID NO: 856921 - DNA, 11 bp, Homo sapiens
caactcctggc

SEQ ID NO: 856922 - DNA, 14 bp, Homo sapiens
caactcctggctcc

SEQ ID NO: 856923 - DNA, 16 bp, Homo sapiens
caactcgcctgtggac

SEQ ID NO: 856924 - DNA, 15 bp, Homo sapiens
caactctacccctgc

SEQ ID NO: 856925 - DNA, 16 bp, Homo sapiens
caactctacccctgct

SEQ ID NO: 856926 - DNA, 13 bp, Homo sapiens
caactctagctgg

SEQ ID NO: 856927 - DNA, 11 bp, Homo sapiens
caactctcccc

SEQ ID NO: 856928 - DNA, 23 bp, Homo sapiens
caactctccccagtgcctgccac

SEQ ID NO: 856929 - DNA, 13 bp, Homo sapiens
caactctgagccc

SEQ ID NO: 856930 - DNA, 12 bp, Homo sapiens
caactctgcact

SEQ ID NO: 856931 - DNA, 17 bp, Homo sapiens
caactctgcactccatg

SEQ ID NO: 856932 - DNA, 18 bp, Homo sapiens
caactcttcctcccctct

SEQ ID NO: 856933 - DNA, 20 bp, Homo sapiens
caactcttcctcccctctca

SEQ ID NO: 856934 - DNA, 19 bp, Homo sapiens
caactcttcgaagccttgc

SEQ ID NO: 856935 - DNA, 12 bp, Homo sapiens
caactcttgatt

SEQ ID NO: 856936 - DNA, 13 bp, Homo sapiens
caactctttgaga

SEQ ID NO: 856937 - DNA, 15 bp, Homo sapiens
caactctttgagaaa

SEQ ID NO: 856938 - DNA, 14 bp, Homo sapiens
caactgaaaagact

SEQ ID NO: 856939 - DNA, 22 bp, Homo sapiens
caactgaaaagactcagtgttc

SEQ ID NO: 856940 - DNA, 20 bp, Homo sapiens
caactgaacaaaagctcagg

SEQ ID NO: 856941 - DNA, 22 bp, Homo sapiens
caactgaaggctaaaaagcaac

SEQ ID NO: 856942 - DNA, 16 bp, Homo sapiens
caactgaataaattca

SEQ ID NO: 856943 - DNA, 17 bp, Homo sapiens
caactgacattgctcca

SEQ ID NO: 856944 - DNA, 19 bp, Homo sapiens
caactgaccagcctccatg

SEQ ID NO: 856945 - DNA, 13 bp, Homo sapiens
caactgacctgcc

SEQ ID NO: 856946 - DNA, 17 bp, Homo sapiens
caactgacctgccagcc

SEQ ID NO: 856947 - DNA, 16 bp, Homo sapiens
caactgaggcagacag

SEQ ID NO: 856948 - DNA, 21 bp, Homo sapiens
caactgaggcagacagcagct

SEQ ID NO: 856949 - DNA, 15 bp, Homo sapiens
caactgattttgtat

SEQ ID NO: 856950 - DNA, 16 bp, Homo sapiens
caactgattttgtatg

SEQ ID NO: 856951 - DNA, 19 bp, Homo sapiens
caactgcaaaaaaagcctc

SEQ ID NO: 856952 - DNA, 20 bp, Homo sapiens
caactgcaaaaaaagcctcc

SEQ ID NO: 856953 - DNA, 22 bp, Homo sapiens
caactgcaaaaaaagcctccaa

SEQ ID NO: 856954 - DNA, 21 bp, Homo sapiens
caactgcaagaaaggggaccc

SEQ ID NO: 856955 - DNA, 14 bp, Homo sapiens
caactgccccaggg

SEQ ID NO: 856956 - DNA, 12 bp, Homo sapiens
caactgccctaa

SEQ ID NO: 856957 - DNA, 22 bp, Homo sapiens
caactgccctaagcccccaggg

SEQ ID NO: 856958 - DNA, 21 bp, Homo sapiens
caactgcctaaggccctttgt

SEQ ID NO: 856959 - DNA, 18 bp, Homo sapiens
caactgcctactccaaaa

SEQ ID NO: 856960 - DNA, 22 bp, Homo sapiens
caactgcctactccaaaatgtt

SEQ ID NO: 856961 - DNA, 13 bp, Homo sapiens
caactgcctgcct

SEQ ID NO: 856962 - DNA, 15 bp, Homo sapiens
caactgctaatgcaa

SEQ ID NO: 856963 - DNA, 17 bp, Homo sapiens
caactgctcagctctgg

SEQ ID NO: 856964 - DNA, 12 bp, Homo sapiens
caactgctctta

SEQ ID NO: 856965 - DNA, 20 bp, Homo sapiens
caactgctgtggccccctgt

SEQ ID NO: 856966 - DNA, 22 bp, Homo sapiens
caactgctgtggccccctgtcc

SEQ ID NO: 856967 - DNA, 11 bp, Homo sapiens
caactgctttg

SEQ ID NO: 856968 - DNA, 16 bp, Homo sapiens
caactggctggccagt

SEQ ID NO: 856969 - DNA, 16 bp, Homo sapiens
caactgtaaagcaaat

SEQ ID NO: 856970 - DNA, 20 bp, Homo sapiens
caactgtctctcttctcaga

SEQ ID NO: 856971 - DNA, 16 bp, Homo sapiens
caactgtgttcattag

SEQ ID NO: 856972 - DNA, 17 bp, Homo sapiens
caactgtgttgtattaa

SEQ ID NO: 856973 - DNA, 24 bp, Homo sapiens
caactttcactataatgtgaaatg

SEQ ID NO: 856974 - DNA, 17 bp, Homo sapiens
caactttcacttcttcc

SEQ ID NO: 856975 - DNA, 13 bp, Homo sapiens
caactttcagtgg

SEQ ID NO: 856976 - DNA, 13 bp, Homo sapiens
caactttgcaaat

SEQ ID NO: 856977 - DNA, 14 bp, Homo sapiens
caactttgtgcttt

SEQ ID NO: 856978 - DNA, 17 bp, Homo sapiens
caactttgtgctttcct

SEQ ID NO: 856979 - DNA, 22 bp, Homo sapiens
caactttgtggatgtcttcctt

SEQ ID NO: 856980 - DNA, 14 bp, Homo sapiens
caacttttaaagct

SEQ ID NO: 856981 - DNA, 20 bp, Homo sapiens
caacttttgtgtaatgaaaa

SEQ ID NO: 856982 - DNA, 15 bp, Homo sapiens
caactttttaaagta

SEQ ID NO: 856983 - DNA, 12 bp, Homo sapiens
caagaaaatctt

SEQ ID NO: 856984 - DNA, 12 bp, Homo sapiens
caagaaacagcc

SEQ ID NO: 856985 - DNA, 13 bp, Homo sapiens
caagaaacagcca

SEQ ID NO: 856986 - DNA, 14 bp, Homo sapiens
caagaaacagccag

SEQ ID NO: 856987 - DNA, 15 bp, Homo sapiens
caagaaacagccagc

SEQ ID NO: 856988 - DNA, 20 bp, Homo sapiens
caagaaaccaaagtctgccg

SEQ ID NO: 856989 - DNA, 21 bp, Homo sapiens
caagaaaccaagtgggctggt

SEQ ID NO: 856990 - DNA, 18 bp, Homo sapiens
caagaaactgaggaattt

SEQ ID NO: 856991 - DNA, 19 bp, Homo sapiens
caagaaactgaggaatttt

SEQ ID NO: 856992 - DNA, 14 bp, Homo sapiens
caagaaagagggtc

SEQ ID NO: 856993 - DNA, 16 bp, Homo sapiens
caagaaagagggtccc

SEQ ID NO: 856994 - DNA, 19 bp, Homo sapiens
caagaaagagggtcccagg

SEQ ID NO: 856995 - DNA, 23 bp, Homo sapiens
caagaaagagggtcccagggctg

SEQ ID NO: 856996 - DNA, 18 bp, Homo sapiens
caagaaaggaggggagaa

SEQ ID NO: 856997 - DNA, 22 bp, Homo sapiens
caagaaagggccaggagatgga

SEQ ID NO: 856998 - DNA, 20 bp, Homo sapiens
caagaaaggggacccaagaa

SEQ ID NO: 856999 - DNA, 12 bp, Homo sapiens
caagaaagtcca

SEQ ID NO: 857000 - DNA, 20 bp, Homo sapiens
caagaaataaaaggaagcca

SEQ ID NO: 857001 - DNA, 21 bp, Homo sapiens
caagaaataaaaggaagccaa

SEQ ID NO: 857002 - DNA, 18 bp, Homo sapiens
caagaaataaatcagaga

SEQ ID NO: 857003 - DNA, 14 bp, Homo sapiens
caagaaatccctgt

SEQ ID NO: 857004 - DNA, 12 bp, Homo sapiens
caagaaatgctt

SEQ ID NO: 857005 - DNA, 12 bp, Homo sapiens
caagaaatggcg

SEQ ID NO: 857006 - DNA, 16 bp, Homo sapiens
caagaacactggacct

SEQ ID NO: 857007 - DNA, 17 bp, Homo sapiens
caagaacattatcttag

SEQ ID NO: 857008 - DNA, 17 bp, Homo sapiens
caagaacccaagtgcct

SEQ ID NO: 857009 - DNA, 14 bp, Homo sapiens
caagaactctgggc

SEQ ID NO: 857010 - DNA, 19 bp, Homo sapiens
caagaactgcatggaccta

SEQ ID NO: 857011 - DNA, 23 bp, Homo sapiens
caagaactgcatggacctaacat

SEQ ID NO: 857012 - DNA, 20 bp, Homo sapiens
caagaagaaatatgaaattc

SEQ ID NO: 857013 - DNA, 14 bp, Homo sapiens
caagaagaatttat

SEQ ID NO: 857014 - DNA, 17 bp, Homo sapiens
caagaagaatttgaaga

SEQ ID NO: 857015 - DNA, 18 bp, Homo sapiens
caagaagacatggagact

SEQ ID NO: 857016 - DNA, 23 bp, Homo sapiens
caagaagcaattatttaaagaaa

SEQ ID NO: 857017 - DNA, 15 bp, Homo sapiens
caagaagcagcctgt

SEQ ID NO: 857018 - DNA, 22 bp, Homo sapiens
caagaagctttaatatttaaat

SEQ ID NO: 857019 - DNA, 12 bp, Homo sapiens
caagaaggaaga

SEQ ID NO: 857020 - DNA, 23 bp, Homo sapiens
caagaagggttttccaccctgga

SEQ ID NO: 857021 - DNA, 20 bp, Homo sapiens
caagaagtagcagtgtctgt

SEQ ID NO: 857022 - DNA, 14 bp, Homo sapiens
caagaagtttattc

SEQ ID NO: 857023 - DNA, 18 bp, Homo sapiens
caagaataatcacgcttt

SEQ ID NO: 857024 - DNA, 13 bp, Homo sapiens
caagaatacttga

SEQ ID NO: 857025 - DNA, 18 bp, Homo sapiens
caagaatagatgctgact

SEQ ID NO: 857026 - DNA, 19 bp, Homo sapiens
caagaatagcattgtaaaa

SEQ ID NO: 857027 - DNA, 18 bp, Homo sapiens
caagaatattgcaaaata

SEQ ID NO: 857028 - DNA, 23 bp, Homo sapiens
caagaatattgcaaaatacatga

SEQ ID NO: 857029 - DNA, 17 bp, Homo sapiens
caagaatctagaagatg

SEQ ID NO: 857030 - DNA, 18 bp, Homo sapiens
caagaatctagaagatgt

SEQ ID NO: 857031 - DNA, 14 bp, Homo sapiens
caagaatgaaaaat

SEQ ID NO: 857032 - DNA, 19 bp, Homo sapiens
caagaatgaaaaatataat

SEQ ID NO: 857033 - DNA, 18 bp, Homo sapiens
caagaatgcattccctga

SEQ ID NO: 857034 - DNA, 12 bp, Homo sapiens
caagaattaaaa

SEQ ID NO: 857035 - DNA, 14 bp, Homo sapiens
caagaattaaaact

SEQ ID NO: 857036 - DNA, 22 bp, Homo sapiens
caagaattgaagcaggactaaa

SEQ ID NO: 857037 - DNA, 21 bp, Homo sapiens
caagaattggaagctgccctg

SEQ ID NO: 857038 - DNA, 18 bp, Homo sapiens
caagacaaatcaacagaa

SEQ ID NO: 857039 - DNA, 13 bp, Homo sapiens
caagacacagtga

SEQ ID NO: 857040 - DNA, 13 bp, Homo sapiens
caagacactgtgg

SEQ ID NO: 857041 - DNA, 21 bp, Homo sapiens
caagacagagacgcaggaatg

SEQ ID NO: 857042 - DNA, 22 bp, Homo sapiens
caagacagagacgcaggaatgg

SEQ ID NO: 857043 - DNA, 16 bp, Homo sapiens
caagacagatgcccca

SEQ ID NO: 857044 - DNA, 17 bp, Homo sapiens
caagacagatggacact

SEQ ID NO: 857045 - DNA, 14 bp, Homo sapiens
caagacagccttca

SEQ ID NO: 857046 - DNA, 15 bp, Homo sapiens
caagacatgtctgtt

SEQ ID NO: 857047 - DNA, 13 bp, Homo sapiens
caagacattgtca

SEQ ID NO: 857048 - DNA, 17 bp, Homo sapiens
caagacattgtcaataa

SEQ ID NO: 857049 - DNA, 18 bp, Homo sapiens
caagacattgtcaataaa

SEQ ID NO: 857050 - DNA, 15 bp, Homo sapiens
caagacatttgctga

SEQ ID NO: 857051 - DNA, 16 bp, Homo sapiens
caagacatttgctgaa

SEQ ID NO: 857052 - DNA, 21 bp, Homo sapiens
caagaccaccagggtcccagg

SEQ ID NO: 857053 - DNA, 14 bp, Homo sapiens
caagaccatccctg

SEQ ID NO: 857054 - DNA, 23 bp, Homo sapiens
caagaccccaagaggaagttcag

SEQ ID NO: 857055 - DNA, 13 bp, Homo sapiens
caagacccccagc

SEQ ID NO: 857056 - DNA, 21 bp, Homo sapiens
caagacccccatttgtcccag

SEQ ID NO: 857057 - DNA, 15 bp, Homo sapiens
caagacccctgtctt

SEQ ID NO: 857058 - DNA, 15 bp, Homo sapiens
caagaccctgtctct

SEQ ID NO: 857059 - DNA, 20 bp, Homo sapiens
caagacctagtcccctttcc

SEQ ID NO: 857060 - DNA, 17 bp, Homo sapiens
caagacctcatctgtgg

SEQ ID NO: 857061 - DNA, 20 bp, Homo sapiens
caagacctcatctgtggagc

SEQ ID NO: 857062 - DNA, 23 bp, Homo sapiens
caagacctcatctgtggagctgc

SEQ ID NO: 857063 - DNA, 14 bp, Homo sapiens
caagacgtaaagaa

SEQ ID NO: 857064 - DNA, 19 bp, Homo sapiens
caagactatctacaaaaat

SEQ ID NO: 857065 - DNA, 17 bp, Homo sapiens
caagactgaagatggct

SEQ ID NO: 857066 - DNA, 22 bp, Homo sapiens
caagactgagccagcttagcaa

SEQ ID NO: 857067 - DNA, 13 bp, Homo sapiens
caagactgcaaac

SEQ ID NO: 857068 - DNA, 23 bp, Homo sapiens
caagactgcaaacttttttatat

SEQ ID NO: 857069 - DNA, 15 bp, Homo sapiens
caagactgcctccct

SEQ ID NO: 857070 - DNA, 16 bp, Homo sapiens
caagactgttagccct

SEQ ID NO: 857071 - DNA, 19 bp, Homo sapiens
caagacttatggaacaggg

SEQ ID NO: 857072 - DNA, 16 bp, Homo sapiens
caagacttcagtatgt

SEQ ID NO: 857073 - DNA, 21 bp, Homo sapiens
caagacttcagtatgttgtca

SEQ ID NO: 857074 - DNA, 19 bp, Homo sapiens
caagactttagcttttcct

SEQ ID NO: 857075 - DNA, 22 bp, Homo sapiens
caagactttgatccttggaaac

SEQ ID NO: 857076 - DNA, 15 bp, Homo sapiens
caagacttttctttg

SEQ ID NO: 857077 - DNA, 17 bp, Homo sapiens
caagacttttctttgaa

SEQ ID NO: 857078 - DNA, 12 bp, Homo sapiens
caagagaactaa

SEQ ID NO: 857079 - DNA, 12 bp, Homo sapiens
caagagaatcaa

SEQ ID NO: 857080 - DNA, 16 bp, Homo sapiens
caagagacatggaaga

SEQ ID NO: 857081 - DNA, 18 bp, Homo sapiens
caagagacatggaagaga

SEQ ID NO: 857082 - DNA, 14 bp, Homo sapiens
caagagagaaagaa

SEQ ID NO: 857083 - DNA, 20 bp, Homo sapiens
caagagagcagcgcccaggc

SEQ ID NO: 857084 - DNA, 22 bp, Homo sapiens
caagagagcagcgcccaggcct

SEQ ID NO: 857085 - DNA, 14 bp, Homo sapiens
caagagaggaagga

SEQ ID NO: 857086 - DNA, 12 bp, Homo sapiens
caagagaggaga

SEQ ID NO: 857087 - DNA, 13 bp, Homo sapiens
caagagataactg

SEQ ID NO: 857088 - DNA, 17 bp, Homo sapiens
caagagatagagaccat

SEQ ID NO: 857089 - DNA, 16 bp, Homo sapiens
caagagatgggaatga

SEQ ID NO: 857090 - DNA, 16 bp, Homo sapiens
caagagcagaggcagc

SEQ ID NO: 857091 - DNA, 16 bp, Homo sapiens
caagagcagagtctgg

SEQ ID NO: 857092 - DNA, 18 bp, Homo sapiens
caagcatttttccatctg

SEQ ID NO: 857093 - DNA, 21 bp, Homo sapiens
caagccaaagagcctcccacc

SEQ ID NO: 857094 - DNA, 23 bp, Homo sapiens
caagccaaagtggcatgttttgt

SEQ ID NO: 857095 - DNA, 21 bp, Homo sapiens
caagccaagggaacctgtgtc

SEQ ID NO: 857096 - DNA, 15 bp, Homo sapiens
caagccaatcccctc

SEQ ID NO: 857097 - DNA, 19 bp, Homo sapiens
caagccacaagtcttccag

SEQ ID NO: 857098 - DNA, 11 bp, Homo sapiens
caagccacaga

SEQ ID NO: 857099 - DNA, 19 bp, Homo sapiens
caagccacagaagccagga

SEQ ID NO: 857100 - DNA, 16 bp, Homo sapiens
caagccagaggctggg

SEQ ID NO: 857101 - DNA, 15 bp, Homo sapiens
caagccagatttttt

SEQ ID NO: 857102 - DNA, 13 bp, Homo sapiens
caagccagcctgt

SEQ ID NO: 857103 - DNA, 14 bp, Homo sapiens
caagccagctggag

SEQ ID NO: 857104 - DNA, 11 bp, Homo sapiens
caagccagggc

SEQ ID NO: 857105 - DNA, 12 bp, Homo sapiens
caagccagggcc

SEQ ID NO: 857106 - DNA, 14 bp, Homo sapiens
caagccagggccca

SEQ ID NO: 857107 - DNA, 16 bp, Homo sapiens
caagccagggcccaga

SEQ ID NO: 857108 - DNA, 17 bp, Homo sapiens
caagccagggcccagag

SEQ ID NO: 857109 - DNA, 13 bp, Homo sapiens
caagccagttctc

SEQ ID NO: 857110 - DNA, 12 bp, Homo sapiens
caagccataacg

SEQ ID NO: 857111 - DNA, 19 bp, Homo sapiens
caagccataacgtgccccc

SEQ ID NO: 857112 - DNA, 20 bp, Homo sapiens
caagccatcttgagtggtca

SEQ ID NO: 857113 - DNA, 13 bp, Homo sapiens
caagccccaggca

SEQ ID NO: 857114 - DNA, 15 bp, Homo sapiens
caagccccaggcagg

SEQ ID NO: 857115 - DNA, 17 bp, Homo sapiens
caagccccaggcaggct

SEQ ID NO: 857116 - DNA, 21 bp, Homo sapiens
caagccccatctcatcctggc

SEQ ID NO: 857117 - DNA, 14 bp, Homo sapiens
caagccccatttcc

SEQ ID NO: 857118 - DNA, 16 bp, Homo sapiens
caagcccccccttcca

SEQ ID NO: 857119 - DNA, 18 bp, Homo sapiens
caagcccccccttccact

SEQ ID NO: 857120 - DNA, 14 bp, Homo sapiens
caagccccctggca

SEQ ID NO: 857121 - DNA, 20 bp, Homo sapiens
caagccccctggcagctgcc

SEQ ID NO: 857122 - DNA, 23 bp, Homo sapiens
caagccccctggcagctgcccct

SEQ ID NO: 857123 - DNA, 19 bp, Homo sapiens
caagcccgcctccagcacc

SEQ ID NO: 857124 - DNA, 19 bp, Homo sapiens
caagcccgtgacagatgcc

SEQ ID NO: 857125 - DNA, 17 bp, Homo sapiens
caagccctacagagctg

SEQ ID NO: 857126 - DNA, 12 bp, Homo sapiens
caagccctggca

SEQ ID NO: 857127 - DNA, 21 bp, Homo sapiens
caagccggccccccctctttt

SEQ ID NO: 857128 - DNA, 18 bp, Homo sapiens
caagccgtggcttcccgc

SEQ ID NO: 857129 - DNA, 13 bp, Homo sapiens
caagcctccacag

SEQ ID NO: 857130 - DNA, 16 bp, Homo sapiens
caagcctccacagcga

SEQ ID NO: 857131 - DNA, 17 bp, Homo sapiens
caagcctccacagcgag

SEQ ID NO: 857132 - DNA, 13 bp, Homo sapiens
caagcctcctgta

SEQ ID NO: 857133 - DNA, 19 bp, Homo sapiens
caagcctcttattccagga

SEQ ID NO: 857134 - DNA, 14 bp, Homo sapiens
caagcctcttctga

SEQ ID NO: 857135 - DNA, 16 bp, Homo sapiens
caagcctcttctgaag

SEQ ID NO: 857136 - DNA, 16 bp, Homo sapiens
caagcctgctggctgc

SEQ ID NO: 857137 - DNA, 20 bp, Homo sapiens
caagcctgctggctgcggcc

SEQ ID NO: 857138 - DNA, 17 bp, Homo sapiens
caagcctggcacccacc

SEQ ID NO: 857139 - DNA, 21 bp, Homo sapiens
caagcctggcacccaccgtct

SEQ ID NO: 857140 - DNA, 16 bp, Homo sapiens
caagcctgtgaataaa

SEQ ID NO: 857141 - DNA, 16 bp, Homo sapiens
caagcctgtgcaaaaa

SEQ ID NO: 857142 - DNA, 19 bp, Homo sapiens
caagcctgtgcaaaaaaat

SEQ ID NO: 857143 - DNA, 14 bp, Homo sapiens
caagcctgtgggag

SEQ ID NO: 857144 - DNA, 16 bp, Homo sapiens
caagcctgtgggcagc

SEQ ID NO: 857145 - DNA, 12 bp, Homo sapiens
caagcggccctg

SEQ ID NO: 857146 - DNA, 18 bp, Homo sapiens
caagcgggtggctctggg

SEQ ID NO: 857147 - DNA, 16 bp, Homo sapiens
caagctaagtaaaaat

SEQ ID NO: 857148 - DNA, 19 bp, Homo sapiens
caagctaagtaaaaatatg

SEQ ID NO: 857149 - DNA, 23 bp, Homo sapiens
caagctaattgggagtccaggca

SEQ ID NO: 857150 - DNA, 22 bp, Homo sapiens
caagctagccagagggtgggag

SEQ ID NO: 857151 - DNA, 16 bp, Homo sapiens
caagctagtgtttcta

SEQ ID NO: 857152 - DNA, 17 bp, Homo sapiens
caagctagtgtttctag

SEQ ID NO: 857153 - DNA, 15 bp, Homo sapiens
caagctatctaaagt

SEQ ID NO: 857154 - DNA, 17 bp, Homo sapiens
caagctatctaaagttt

SEQ ID NO: 857155 - DNA, 19 bp, Homo sapiens
caagctattcctttccctt

SEQ ID NO: 857156 - DNA, 23 bp, Homo sapiens
caagctatttaatatctggcact

SEQ ID NO: 857157 - DNA, 13 bp, Homo sapiens
caagctccaagcc

SEQ ID NO: 857158 - DNA, 20 bp, Homo sapiens
caagctccctggagccctgt

SEQ ID NO: 857159 - DNA, 20 bp, Homo sapiens
caagctccgcctcccgggtt

SEQ ID NO: 857160 - DNA, 14 bp, Homo sapiens
caagctcctcctcc

SEQ ID NO: 857161 - DNA, 22 bp, Homo sapiens
caagctcctcctccctgcatct

SEQ ID NO: 857162 - DNA, 23 bp, Homo sapiens
caagctcctcctccctgcatctg

SEQ ID NO: 857163 - DNA, 19 bp, Homo sapiens
caagctcctcctcggaacc

SEQ ID NO: 857164 - DNA, 20 bp, Homo sapiens
caagctcctcctcggaaccg

SEQ ID NO: 857165 - DNA, 13 bp, Homo sapiens
caagctctctgca

SEQ ID NO: 857166 - DNA, 19 bp, Homo sapiens
caagctctggggatgggtg

SEQ ID NO: 857167 - DNA, 14 bp, Homo sapiens
caagctgaaatttt

SEQ ID NO: 857168 - DNA, 20 bp, Homo sapiens
caagctgaaattttagaaat

SEQ ID NO: 857169 - DNA, 15 bp, Homo sapiens
caagctgacttggca

SEQ ID NO: 857170 - DNA, 14 bp, Homo sapiens
caagctgagaaaag

SEQ ID NO: 857171 - DNA, 12 bp, Homo sapiens
caagctgagcag

SEQ ID NO: 857172 - DNA, 14 bp, Homo sapiens
caagctgagtttcc

SEQ ID NO: 857173 - DNA, 9 bp, Homo sapiens
caagctgca

SEQ ID NO: 857174 - DNA, 14 bp, Homo sapiens
caagctgcaccctc

SEQ ID NO: 857175 - DNA, 18 bp, Homo sapiens
caagctgcaccctcaggc

SEQ ID NO: 857176 - DNA, 22 bp, Homo sapiens
caagctgcaccctcaggcaggt

SEQ ID NO: 857177 - DNA, 13 bp, Homo sapiens
caagctgcactgt

SEQ ID NO: 857178 - DNA, 15 bp, Homo sapiens
caagctgcactgtga

SEQ ID NO: 857179 - DNA, 15 bp, Homo sapiens
caagctgcctctgac

SEQ ID NO: 857180 - DNA, 20 bp, Homo sapiens
caagctgcctctgacagcag

SEQ ID NO: 857181 - DNA, 13 bp, Homo sapiens
caagctggaagca

SEQ ID NO: 857182 - DNA, 18 bp, Homo sapiens
caagctggaagcacatgt

SEQ ID NO: 857183 - DNA, 16 bp, Homo sapiens
caagctggcttctgtg

SEQ ID NO: 857184 - DNA, 22 bp, Homo sapiens
caagctgtgagacagtgggaaa

SEQ ID NO: 857185 - DNA, 12 bp, Homo sapiens
caagctgtggca

SEQ ID NO: 857186 - DNA, 18 bp, Homo sapiens
caagctgtggcagccgtc

SEQ ID NO: 857187 - DNA, 15 bp, Homo sapiens
caagcttcctgtgcc

SEQ ID NO: 857188 - DNA, 19 bp, Homo sapiens
caagcttggtcaaactttt

SEQ ID NO: 857189 - DNA, 23 bp, Homo sapiens
caagctttgaggctctgtcactg

SEQ ID NO: 857190 - DNA, 16 bp, Homo sapiens
caaggaccaagagcaa

SEQ ID NO: 857191 - DNA, 14 bp, Homo sapiens
caaggaccaggact

SEQ ID NO: 857192 - DNA, 15 bp, Homo sapiens
caaggaccaggactc

SEQ ID NO: 857193 - DNA, 21 bp, Homo sapiens
caaggaccaggactccctcct

SEQ ID NO: 857194 - DNA, 17 bp, Homo sapiens
caaggacccctcacctt

SEQ ID NO: 857195 - DNA, 20 bp, Homo sapiens
caaggacgaatttgcacagt

SEQ ID NO: 857196 - DNA, 18 bp, Homo sapiens
caaggactgactttgcca

SEQ ID NO: 857197 - DNA, 12 bp, Homo sapiens
caaggactgagc

SEQ ID NO: 857198 - DNA, 13 bp, Homo sapiens
caaggactgagca

SEQ ID NO: 857199 - DNA, 15 bp, Homo sapiens
caaggactgcaggga

SEQ ID NO: 857200 - DNA, 16 bp, Homo sapiens
caaggacttgaaagca

SEQ ID NO: 857201 - DNA, 15 bp, Homo sapiens
caaggactttgcagc

SEQ ID NO: 857202 - DNA, 15 bp, Homo sapiens
caaggactttgtaca

SEQ ID NO: 857203 - DNA, 19 bp, Homo sapiens
caaggagaaacagagacag

SEQ ID NO: 857204 - DNA, 20 bp, Homo sapiens
caaggagaaacagagacagg

SEQ ID NO: 857205 - DNA, 22 bp, Homo sapiens
caaggagaccaagtcctggcta

SEQ ID NO: 857206 - DNA, 16 bp, Homo sapiens
caaggagatttacaac

SEQ ID NO: 857207 - DNA, 14 bp, Homo sapiens
caaggagatttctt

SEQ ID NO: 857208 - DNA, 15 bp, Homo sapiens
caaggagatttctta

SEQ ID NO: 857209 - DNA, 21 bp, Homo sapiens
caaggagcaaacactgaaata

SEQ ID NO: 857210 - DNA, 22 bp, Homo sapiens
caaggagcacaggtcccacctc

SEQ ID NO: 857211 - DNA, 16 bp, Homo sapiens
caaggagcagagaggt

SEQ ID NO: 857212 - DNA, 15 bp, Homo sapiens
caaggagctcaccct

SEQ ID NO: 857213 - DNA, 22 bp, Homo sapiens
caaggagctcaccctgcccgct

SEQ ID NO: 857214 - DNA, 22 bp, Homo sapiens
caaggagctgctatagcctggg

SEQ ID NO: 857215 - DNA, 22 bp, Homo sapiens
caaggaggaaataactaagaga

SEQ ID NO: 857216 - DNA, 22 bp, Homo sapiens
caaggaggcctggggaggccct

SEQ ID NO: 857217 - DNA, 16 bp, Homo sapiens
caaggaggggccagtg

SEQ ID NO: 857218 - DNA, 20 bp, Homo sapiens
caaggagggtgagtgcaagg

SEQ ID NO: 857219 - DNA, 17 bp, Homo sapiens
caaggagtcactgagac

SEQ ID NO: 857220 - DNA, 16 bp, Homo sapiens
caaggagtcagacatt

SEQ ID NO: 857221 - DNA, 14 bp, Homo sapiens
caaggagtgtaaaa

SEQ ID NO: 857222 - DNA, 22 bp, Homo sapiens
caaggagtgtaaaatgtatatt

SEQ ID NO: 857223 - DNA, 21 bp, Homo sapiens
caaggagttccatgaagacca

SEQ ID NO: 857224 - DNA, 18 bp, Homo sapiens
caaggagtttattacaat

SEQ ID NO: 857225 - DNA, 22 bp, Homo sapiens
caaggagtttattacaatgtat

SEQ ID NO: 857226 - DNA, 18 bp, Homo sapiens
caaggataccttcttatt

SEQ ID NO: 857227 - DNA, 16 bp, Homo sapiens
caaggatatactgcag

SEQ ID NO: 857228 - DNA, 13 bp, Homo sapiens
caaggatcctctc

SEQ ID NO: 857229 - DNA, 16 bp, Homo sapiens
caaggatcctctccac

SEQ ID NO: 857230 - DNA, 17 bp, Homo sapiens
caaggatcctctccact

SEQ ID NO: 857231 - DNA, 18 bp, Homo sapiens
caaggatcggactctgcc

SEQ ID NO: 857232 - DNA, 22 bp, Homo sapiens
caaggatcggactctgcccctg

SEQ ID NO: 857233 - DNA, 17 bp, Homo sapiens
caaggatgaccacaccc

SEQ ID NO: 857234 - DNA, 18 bp, Homo sapiens
caaggatgccttagcatg

SEQ ID NO: 857235 - DNA, 13 bp, Homo sapiens
caaggatgttttt

SEQ ID NO: 857236 - DNA, 14 bp, Homo sapiens
caaggatttttcca

SEQ ID NO: 857237 - DNA, 22 bp, Homo sapiens
caaggatttttccatgtgtggt

SEQ ID NO: 857238 - DNA, 14 bp, Homo sapiens
caaggcaaggcagg

SEQ ID NO: 857239 - DNA, 15 bp, Homo sapiens
caaggcagaggcctg

SEQ ID NO: 857240 - DNA, 15 bp, Homo sapiens
caaggcagcctccag

SEQ ID NO: 857241 - DNA, 18 bp, Homo sapiens
caaggcagcctccagagc

SEQ ID NO: 857242 - DNA, 17 bp, Homo sapiens
caaggcaggtgcctcca

SEQ ID NO: 857243 - DNA, 18 bp, Homo sapiens
caaggcaggtgcctccag

SEQ ID NO: 857244 - DNA, 14 bp, Homo sapiens
caaggcagtgcatg

SEQ ID NO: 857245 - DNA, 20 bp, Homo sapiens
caaggcattcctcatcacca

SEQ ID NO: 857246 - DNA, 17 bp, Homo sapiens
caaggccacaaaaacaa

SEQ ID NO: 857247 - DNA, 18 bp, Homo sapiens
caaggccaccttggagga

SEQ ID NO: 857248 - DNA, 14 bp, Homo sapiens
caaggccagagtgg

SEQ ID NO: 857249 - DNA, 20 bp, Homo sapiens
caaggccagagtggcctggc

SEQ ID NO: 857250 - DNA, 17 bp, Homo sapiens
caaggccatctgggctc

SEQ ID NO: 857251 - DNA, 14 bp, Homo sapiens
caaggccccagaga

SEQ ID NO: 857252 - DNA, 17 bp, Homo sapiens
caaggccccagagactc

SEQ ID NO: 857253 - DNA, 21 bp, Homo sapiens
caaggccccagagactcagag

SEQ ID NO: 857254 - DNA, 21 bp, Homo sapiens
caaggccccagggacagaggc

SEQ ID NO: 857255 - DNA, 22 bp, Homo sapiens
caaggccccagggacagaggcc

SEQ ID NO: 857256 - DNA, 23 bp, Homo sapiens
caaggccccagggacagaggcca

SEQ ID NO: 857257 - DNA, 22 bp, Homo sapiens
caaggccccgagctcagggcag

SEQ ID NO: 857258 - DNA, 19 bp, Homo sapiens
caaggccctttcctttgga

SEQ ID NO: 857259 - DNA, 20 bp, Homo sapiens
caaggccgaagctctggctg

SEQ ID NO: 857260 - DNA, 15 bp, Homo sapiens
caaggccgagggcca

SEQ ID NO: 857261 - DNA, 17 bp, Homo sapiens
caaggccgagggccagg

SEQ ID NO: 857262 - DNA, 15 bp, Homo sapiens
caaggccgccagcgt

SEQ ID NO: 857263 - DNA, 16 bp, Homo sapiens
caaggccgcggcccag

SEQ ID NO: 857264 - DNA, 22 bp, Homo sapiens
caaggccgctgttcacccacag

SEQ ID NO: 857265 - DNA, 20 bp, Homo sapiens
caaggcctctcaccccactt

SEQ ID NO: 857266 - DNA, 13 bp, Homo sapiens
caaggcctctcag

SEQ ID NO: 857267 - DNA, 12 bp, Homo sapiens
caaggccttcag

SEQ ID NO: 857268 - DNA, 13 bp, Homo sapiens
caaggccttcagt

SEQ ID NO: 857269 - DNA, 12 bp, Homo sapiens
caaggccttcca

SEQ ID NO: 857270 - DNA, 22 bp, Homo sapiens
caaggccttggtggagcagcca

SEQ ID NO: 857271 - DNA, 21 bp, Homo sapiens
caaggctgaccaagagagaaa

SEQ ID NO: 857272 - DNA, 12 bp, Homo sapiens
caaggctgcagt

SEQ ID NO: 857273 - DNA, 14 bp, Homo sapiens
caaggctgctgccg

SEQ ID NO: 857274 - DNA, 16 bp, Homo sapiens
caaggctgcttagaat

SEQ ID NO: 857275 - DNA, 15 bp, Homo sapiens
caaggctggccagca

SEQ ID NO: 857276 - DNA, 22 bp, Homo sapiens
caaggctggccagcaaggcagg

SEQ ID NO: 857277 - DNA, 14 bp, Homo sapiens
caaggctgggagga

SEQ ID NO: 857278 - DNA, 18 bp, Homo sapiens
caaggctggggcatggca

SEQ ID NO: 857279 - DNA, 18 bp, Homo sapiens
caaggctttaaagctgag

SEQ ID NO: 857280 - DNA, 20 bp, Homo sapiens
caagggaaggggcctccctc

SEQ ID NO: 857281 - DNA, 15 bp, Homo sapiens
caagggacctgctca

SEQ ID NO: 857282 - DNA, 19 bp, Homo sapiens
caagggactagtgagtcag

SEQ ID NO: 857283 - DNA, 22 bp, Homo sapiens
caagggactagtgagtcagcac

SEQ ID NO: 857284 - DNA, 14 bp, Homo sapiens
caagggagaaaaga

SEQ ID NO: 857285 - DNA, 20 bp, Homo sapiens
caagggagaaaagagaaacc

SEQ ID NO: 857286 - DNA, 15 bp, Homo sapiens
caagggagagacctc

SEQ ID NO: 857287 - DNA, 14 bp, Homo sapiens
caagggaggcagtg

SEQ ID NO: 857288 - DNA, 17 bp, Homo sapiens
caagggaggcagtggct

SEQ ID NO: 857289 - DNA, 14 bp, Homo sapiens
caagggagggaagg

SEQ ID NO: 857290 - DNA, 20 bp, Homo sapiens
caagggagggtgcagccctc

SEQ ID NO: 857291 - DNA, 21 bp, Homo sapiens
caagggatctggtcctaccca

SEQ ID NO: 857292 - DNA, 23 bp, Homo sapiens
caagtccctgttttctgagcccg

SEQ ID NO: 857293 - DNA, 17 bp, Homo sapiens
caagtcccttgttttgt

SEQ ID NO: 857294 - DNA, 16 bp, Homo sapiens
caagtccgcagaagcc

SEQ ID NO: 857295 - DNA, 24 bp, Homo sapiens
caagtcctccctctctactggagt

SEQ ID NO: 857296 - DNA, 15 bp, Homo sapiens
caagtcctgaagagg

SEQ ID NO: 857297 - DNA, 19 bp, Homo sapiens
caagtcctggatgttgtgt

SEQ ID NO: 857298 - DNA, 12 bp, Homo sapiens
caagtcctggct

SEQ ID NO: 857299 - DNA, 17 bp, Homo sapiens
caagtcctggctacatc

SEQ ID NO: 857300 - DNA, 15 bp, Homo sapiens
caagtccttacctct

SEQ ID NO: 857301 - DNA, 23 bp, Homo sapiens
caagtccttacctcttccggaga

SEQ ID NO: 857302 - DNA, 20 bp, Homo sapiens
caagtccttgacctctataa

SEQ ID NO: 857303 - DNA, 18 bp, Homo sapiens
caagtcggggcctgggac

SEQ ID NO: 857304 - DNA, 23 bp, Homo sapiens
caagtctaaaaagacctggcctt

SEQ ID NO: 857305 - DNA, 22 bp, Homo sapiens
caagtctctgctggcccagcca

SEQ ID NO: 857306 - DNA, 18 bp, Homo sapiens
caagtctggatctgggac

SEQ ID NO: 857307 - DNA, 19 bp, Homo sapiens
caagtctggatctgggacc

SEQ ID NO: 857308 - DNA, 14 bp, Homo sapiens
caagtcttccctga

SEQ ID NO: 857309 - DNA, 22 bp, Homo sapiens
caagtgaaaaaggaggaagaga

SEQ ID NO: 857310 - DNA, 22 bp, Homo sapiens
caagtgaatacattttataatt

SEQ ID NO: 857311 - DNA, 15 bp, Homo sapiens
caagtgaatctttct

SEQ ID NO: 857312 - DNA, 19 bp, Homo sapiens
caagtgaatctttctcctg

SEQ ID NO: 857313 - DNA, 19 bp, Homo sapiens
caagtgaatttttctctaa

SEQ ID NO: 857314 - DNA, 16 bp, Homo sapiens
caagtgaccagggaag

SEQ ID NO: 857315 - DNA, 17 bp, Homo sapiens
caagtgaccccagggcc

SEQ ID NO: 857316 - DNA, 20 bp, Homo sapiens
caagtgaccccagggcctgt

SEQ ID NO: 857317 - DNA, 22 bp, Homo sapiens
caagtgaccccagggcctgtct

SEQ ID NO: 857318 - DNA, 23 bp, Homo sapiens
caagtgaccccagggcctgtctc

SEQ ID NO: 857319 - DNA, 18 bp, Homo sapiens
caagtgactctcctgcct

SEQ ID NO: 857320 - DNA, 19 bp, Homo sapiens
caagtgactctcctgcctc

SEQ ID NO: 857321 - DNA, 13 bp, Homo sapiens
caagtgagagggg

SEQ ID NO: 857322 - DNA, 15 bp, Homo sapiens
caagtgagaggggag

SEQ ID NO: 857323 - DNA, 17 bp, Homo sapiens
caagtgagaggggaggg

SEQ ID NO: 857324 - DNA, 21 bp, Homo sapiens
caagtgagaggggagggaggg

SEQ ID NO: 857325 - DNA, 12 bp, Homo sapiens
caagtgagcaga

SEQ ID NO: 857326 - DNA, 22 bp, Homo sapiens
caagtgagtctggtggaggagc

SEQ ID NO: 857327 - DNA, 22 bp, Homo sapiens
caagtgatccttccacctcagt

SEQ ID NO: 857328 - DNA, 16 bp, Homo sapiens
caagtgattctcctgc

SEQ ID NO: 857329 - DNA, 15 bp, Homo sapiens
caagtgccagaggtg

SEQ ID NO: 857330 - DNA, 16 bp, Homo sapiens
caagtgccagggctgg

SEQ ID NO: 857331 - DNA, 14 bp, Homo sapiens
caagtgcctcacct

SEQ ID NO: 857332 - DNA, 22 bp, Homo sapiens
caagtgcctcacctcgaaagga

SEQ ID NO: 857333 - DNA, 14 bp, Homo sapiens
caagtgcctgctta

SEQ ID NO: 857334 - DNA, 16 bp, Homo sapiens
caagtgcctgctttta

SEQ ID NO: 857335 - DNA, 13 bp, Homo sapiens
caagtgccttaat

SEQ ID NO: 857336 - DNA, 16 bp, Homo sapiens
caagtgctgaacagtg

SEQ ID NO: 857337 - DNA, 17 bp, Homo sapiens
caagtgctgaacagtgg

SEQ ID NO: 857338 - DNA, 18 bp, Homo sapiens
caagtgctgaacagtgga

SEQ ID NO: 857339 - DNA, 20 bp, Homo sapiens
caagtgctgaacagtggagg

SEQ ID NO: 857340 - DNA, 14 bp, Homo sapiens
caagtgctgtgcaa

SEQ ID NO: 857341 - DNA, 23 bp, Homo sapiens
caagtggaccttaggccttcctc

SEQ ID NO: 857342 - DNA, 19 bp, Homo sapiens
caagtggaccttgagacca

SEQ ID NO: 857343 - DNA, 15 bp, Homo sapiens
caagtggacttggag

SEQ ID NO: 857344 - DNA, 17 bp, Homo sapiens
caagtggatgtttttaa

SEQ ID NO: 857345 - DNA, 17 bp, Homo sapiens
caagtggcatgtgctgt

SEQ ID NO: 857346 - DNA, 12 bp, Homo sapiens
caagtggctccc

SEQ ID NO: 857347 - DNA, 19 bp, Homo sapiens
caagtggctcccacaccct

SEQ ID NO: 857348 - DNA, 17 bp, Homo sapiens
caagtggctccccacct

SEQ ID NO: 857349 - DNA, 18 bp, Homo sapiens
caagtggctccccacctg

SEQ ID NO: 857350 - DNA, 20 bp, Homo sapiens
caagtggctccccacctgga

SEQ ID NO: 857351 - DNA, 21 bp, Homo sapiens
caagtggctccccacctggac

SEQ ID NO: 857352 - DNA, 19 bp, Homo sapiens
caagtgggcagtcaccacc

SEQ ID NO: 857353 - DNA, 22 bp, Homo sapiens
caagtgggcagtcaccacccag

SEQ ID NO: 857354 - DNA, 19 bp, Homo sapiens
caagtgggctggtattctc

SEQ ID NO: 857355 - DNA, 15 bp, Homo sapiens
caagtggggtgctgg

SEQ ID NO: 857356 - DNA, 19 bp, Homo sapiens
caagtggggtgctgggagg

SEQ ID NO: 857357 - DNA, 19 bp, Homo sapiens
caagtggtgaccaaaattt

SEQ ID NO: 857358 - DNA, 19 bp, Homo sapiens
caagtggttctccttcctc

SEQ ID NO: 857359 - DNA, 16 bp, Homo sapiens
caagtgtaaaatattt

SEQ ID NO: 857360 - DNA, 16 bp, Homo sapiens
caagtgtatatcagaa

SEQ ID NO: 857361 - DNA, 16 bp, Homo sapiens
caagtgtgctaaaaat

SEQ ID NO: 857362 - DNA, 22 bp, Homo sapiens
caagtgtggtagggacttaaaa

SEQ ID NO: 857363 - DNA, 11 bp, Homo sapiens
caagtgtgtgc

SEQ ID NO: 857364 - DNA, 19 bp, Homo sapiens
caagtgtgtgcacatgtgt

SEQ ID NO: 857365 - DNA, 20 bp, Homo sapiens
caagtgtgtgcacatgtgtg

SEQ ID NO: 857366 - DNA, 16 bp, Homo sapiens
caagtgtgtgcatgtg

SEQ ID NO: 857367 - DNA, 17 bp, Homo sapiens
caagtgtgtgcatgtgt

SEQ ID NO: 857368 - DNA, 17 bp, Homo sapiens
caagtgtgtgtgcgtgt

SEQ ID NO: 857369 - DNA, 23 bp, Homo sapiens
caagtgttaaggcaacattcctt

SEQ ID NO: 857370 - DNA, 16 bp, Homo sapiens
caagtgttcactgctc

SEQ ID NO: 857371 - DNA, 18 bp, Homo sapiens
caagtgttcactgctcct

SEQ ID NO: 857372 - DNA, 15 bp, Homo sapiens
caagtgttttggaaa

SEQ ID NO: 857373 - DNA, 14 bp, Homo sapiens
caagtgttttggag

SEQ ID NO: 857374 - DNA, 16 bp, Homo sapiens
caagtgttttggagaa

SEQ ID NO: 857375 - DNA, 14 bp, Homo sapiens
caagttagctcagg

SEQ ID NO: 857376 - DNA, 16 bp, Homo sapiens
caagttagggtctatg

SEQ ID NO: 857377 - DNA, 20 bp, Homo sapiens
caagttatattgaatatatc

SEQ ID NO: 857378 - DNA, 16 bp, Homo sapiens
caagttattctcttca

SEQ ID NO: 857379 - DNA, 19 bp, Homo sapiens
caagttattttatttgctt

SEQ ID NO: 857380 - DNA, 22 bp, Homo sapiens
caagttattttatttgcttatt

SEQ ID NO: 857381 - DNA, 14 bp, Homo sapiens
caagttatttttct

SEQ ID NO: 857382 - DNA, 17 bp, Homo sapiens
caagttcatgcagctgt

SEQ ID NO: 857383 - DNA, 21 bp, Homo sapiens
caagttccatgcttgagcaat

SEQ ID NO: 857384 - DNA, 16 bp, Homo sapiens
caagttctagagaaga

SEQ ID NO: 857385 - DNA, 18 bp, Homo sapiens
caagttctagagaagagg

SEQ ID NO: 857386 - DNA, 19 bp, Homo sapiens
caagttctagagaagaggc

SEQ ID NO: 857387 - DNA, 23 bp, Homo sapiens
caagttctagagaagaggctggt

SEQ ID NO: 857388 - DNA, 19 bp, Homo sapiens
caagttctggcaagagcag

SEQ ID NO: 857389 - DNA, 19 bp, Homo sapiens
caagttcttcacctctatc

SEQ ID NO: 857390 - DNA, 19 bp, Homo sapiens
caagttgaggacttcttgc

SEQ ID NO: 857391 - DNA, 13 bp, Homo sapiens
caagttgaggaga

SEQ ID NO: 857392 - DNA, 17 bp, Homo sapiens
caagttgcagtgagcag

SEQ ID NO: 857393 - DNA, 23 bp, Homo sapiens
caagttgggttcacttgccatgc

SEQ ID NO: 857394 - DNA, 20 bp, Homo sapiens
caagttgtaaaaatgaaagt

SEQ ID NO: 857395 - DNA, 15 bp, Homo sapiens
caagttgtaaataat

SEQ ID NO: 857396 - DNA, 18 bp, Homo sapiens
caagttgtgccaaattat

SEQ ID NO: 857397 - DNA, 18 bp, Homo sapiens
caagttgtgcttgagcca

SEQ ID NO: 857398 - DNA, 18 bp, Homo sapiens
caagttgtgcttttctgt

SEQ ID NO: 857399 - DNA, 17 bp, Homo sapiens
caagttgttattgttga

SEQ ID NO: 857400 - DNA, 18 bp, Homo sapiens
caagttgttattgttgaa

SEQ ID NO: 857401 - DNA, 14 bp, Homo sapiens
caagttgttgactg

SEQ ID NO: 857402 - DNA, 18 bp, Homo sapiens
caagttgtttatgtatca

SEQ ID NO: 857403 - DNA, 21 bp, Homo sapiens
caatttcggattttttccaaa

SEQ ID NO: 857404 - DNA, 21 bp, Homo sapiens
caatttctactttgaagtcat

SEQ ID NO: 857405 - DNA, 22 bp, Homo sapiens
caatttctgtccttcagatgga

SEQ ID NO: 857406 - DNA, 9 bp, Homo sapiens
caatttctt

SEQ ID NO: 857407 - DNA, 23 bp, Homo sapiens
caatttcttctaataaagtcatt

SEQ ID NO: 857408 - DNA, 17 bp, Homo sapiens
caatttcttggtattat

SEQ ID NO: 857409 - DNA, 21 bp, Homo sapiens
caatttgaatttatctttcat

SEQ ID NO: 857410 - DNA, 15 bp, Homo sapiens
caatttgagactgaa

SEQ ID NO: 857411 - DNA, 18 bp, Homo sapiens
caatttgagactgaaatt

SEQ ID NO: 857412 - DNA, 14 bp, Homo sapiens
caatttgatacata

SEQ ID NO: 857413 - DNA, 15 bp, Homo sapiens
caatttgatacataa

SEQ ID NO: 857414 - DNA, 14 bp, Homo sapiens
caatttgcacaata

SEQ ID NO: 857415 - DNA, 20 bp, Homo sapiens
caatttgcacaatatttctt

SEQ ID NO: 857416 - DNA, 23 bp, Homo sapiens
caatttgcacatcttggctatgt

SEQ ID NO: 857417 - DNA, 21 bp, Homo sapiens
caatttgcactaaatcagaga

SEQ ID NO: 857418 - DNA, 19 bp, Homo sapiens
caatttgtatatcatgaaa

SEQ ID NO: 857419 - DNA, 19 bp, Homo sapiens
caatttgttaattcctatg

SEQ ID NO: 857420 - DNA, 15 bp, Homo sapiens
caatttgtttaaaga

SEQ ID NO: 857421 - DNA, 17 bp, Homo sapiens
caatttgtttaaagaat

SEQ ID NO: 857422 - DNA, 18 bp, Homo sapiens
caatttgtttaaagaata

SEQ ID NO: 857423 - DNA, 16 bp, Homo sapiens
caatttgtttttgcat

SEQ ID NO: 857424 - DNA, 17 bp, Homo sapiens
caatttgtttttgcatt

SEQ ID NO: 857425 - DNA, 22 bp, Homo sapiens
caatttgtttttgcatttttgt

SEQ ID NO: 857426 - DNA, 13 bp, Homo sapiens
caattttaaacat

SEQ ID NO: 857427 - DNA, 19 bp, Homo sapiens
caattttaaagttcttatt

SEQ ID NO: 857428 - DNA, 21 bp, Homo sapiens
caattttatccctcacctgta

SEQ ID NO: 857429 - DNA, 13 bp, Homo sapiens
caattttctccca

SEQ ID NO: 857430 - DNA, 14 bp, Homo sapiens
caatttttaataaa

SEQ ID NO: 857431 - DNA, 13 bp, Homo sapiens
caatttttactca

SEQ ID NO: 857432 - DNA, 11 bp, Homo sapiens
caatttttcca

SEQ ID NO: 857433 - DNA, 13 bp, Homo sapiens
caatttttcccag

SEQ ID NO: 857434 - DNA, 19 bp, Homo sapiens
caatttttcccagtatttt

SEQ ID NO: 857435 - DNA, 18 bp, Homo sapiens
caatttttggttgaataa

SEQ ID NO: 857436 - DNA, 16 bp, Homo sapiens
caatttttgtctcaga

SEQ ID NO: 857437 - DNA, 14 bp, Homo sapiens
caatttttgttttc

SEQ ID NO: 857438 - DNA, 21 bp, Homo sapiens
caattttttatcatgcatgtc

SEQ ID NO: 857439 - DNA, 17 bp, Homo sapiens
caattttttttattagt

SEQ ID NO: 857440 - DNA, 23 bp, Homo sapiens
caattttttttattagtattgtt

SEQ ID NO: 857441 - DNA, 16 bp, Homo sapiens
caattttttttttcct

SEQ ID NO: 857442 - DNA, 21 bp, Homo sapiens
caattttttttttcctcttca

SEQ ID NO: 857443 - DNA, 14 bp, Homo sapiens
cacaaaaaaacaag

SEQ ID NO: 857444 - DNA, 22 bp, Homo sapiens
cacaaaaaaagttgaaggcctt

SEQ ID NO: 857445 - DNA, 13 bp, Homo sapiens
cacaaaaaagaag

SEQ ID NO: 857446 - DNA, 23 bp, Homo sapiens
cacaaaaaatgaggaatagcaaa

SEQ ID NO: 857447 - DNA, 19 bp, Homo sapiens
cacaaaaacaaaaaaacta

SEQ ID NO: 857448 - DNA, 15 bp, Homo sapiens
cacaaaaaggagcgg

SEQ ID NO: 857449 - DNA, 21 bp, Homo sapiens
cacaaaaaggagcgggcaggg

SEQ ID NO: 857450 - DNA, 17 bp, Homo sapiens
cacaaaaaggcaaatat

SEQ ID NO: 857451 - DNA, 18 bp, Homo sapiens
cacaaaacattcatgtaa

SEQ ID NO: 857452 - DNA, 21 bp, Homo sapiens
cacaaaactccgcccccagcc

SEQ ID NO: 857453 - DNA, 13 bp, Homo sapiens
cacaaaagcagat

SEQ ID NO: 857454 - DNA, 15 bp, Homo sapiens
cacaaaatatacaaa

SEQ ID NO: 857455 - DNA, 22 bp, Homo sapiens
cacaaaatatattttgtttaca

SEQ ID NO: 857456 - DNA, 15 bp, Homo sapiens
cacaaaatctgtcca

SEQ ID NO: 857457 - DNA, 16 bp, Homo sapiens
cacaaaccctgctgaa

SEQ ID NO: 857458 - DNA, 15 bp, Homo sapiens
cacaaactgcagctg

SEQ ID NO: 857459 - DNA, 18 bp, Homo sapiens
cacaaactgcagctgtga

SEQ ID NO: 857460 - DNA, 20 bp, Homo sapiens
cacaaactgtgaaaatagtg

SEQ ID NO: 857461 - DNA, 19 bp, Homo sapiens
cacaaacttttatactctt

SEQ ID NO: 857462 - DNA, 18 bp, Homo sapiens
cacaaagagaaaaagaaa

SEQ ID NO: 857463 - DNA, 15 bp, Homo sapiens
cacaaagcaaaggca

SEQ ID NO: 857464 - DNA, 22 bp, Homo sapiens
cacaaagcacagtttgaacaaa

SEQ ID NO: 857465 - DNA, 11 bp, Homo sapiens
cacaaagccca

SEQ ID NO: 857466 - DNA, 12 bp, Homo sapiens
cacaaagcccaa

SEQ ID NO: 857467 - DNA, 13 bp, Homo sapiens
cacaaagccttat

SEQ ID NO: 857468 - DNA, 20 bp, Homo sapiens
cacaaagccttatcaagtgt

SEQ ID NO: 857469 - DNA, 16 bp, Homo sapiens
cacaaagcttctaaag

SEQ ID NO: 857470 - DNA, 16 bp, Homo sapiens
cacaaagggactttgg

SEQ ID NO: 857471 - DNA, 15 bp, Homo sapiens
cacaaagttctcaga

SEQ ID NO: 857472 - DNA, 14 bp, Homo sapiens
cacaaatattattt

SEQ ID NO: 857473 - DNA, 23 bp, Homo sapiens
cacaaatatttattttctttctg

SEQ ID NO: 857474 - DNA, 16 bp, Homo sapiens
cacaaatccttcaaaa

SEQ ID NO: 857475 - DNA, 11 bp, Homo sapiens
cacaaatgaaa

SEQ ID NO: 857476 - DNA, 15 bp, Homo sapiens
cacaaatgaaaatga

SEQ ID NO: 857477 - DNA, 17 bp, Homo sapiens
cacaaatgcagtatata

SEQ ID NO: 857478 - DNA, 15 bp, Homo sapiens
cacaaatgtcattgt

SEQ ID NO: 857479 - DNA, 18 bp, Homo sapiens
cacaaatgtctagtttct

SEQ ID NO: 857480 - DNA, 23 bp, Homo sapiens
cacaaatgtctagtttctagtgt

SEQ ID NO: 857481 - DNA, 13 bp, Homo sapiens
cacaaattagtta

SEQ ID NO: 857482 - DNA, 12 bp, Homo sapiens
cacaaattcagt

SEQ ID NO: 857483 - DNA, 13 bp, Homo sapiens
cacaaattttcaa

SEQ ID NO: 857484 - DNA, 22 bp, Homo sapiens
cacaaattttcaagtttacact

SEQ ID NO: 857485 - DNA, 15 bp, Homo sapiens
cacaacagcctgggg

SEQ ID NO: 857486 - DNA, 19 bp, Homo sapiens
cacaacatttgcagatgtt

SEQ ID NO: 857487 - DNA, 16 bp, Homo sapiens
cacaacctcaccaaac

SEQ ID NO: 857488 - DNA, 17 bp, Homo sapiens
cacaacctcaccaaact

SEQ ID NO: 857489 - DNA, 22 bp, Homo sapiens
cacaacctgtggggtctgatgt

SEQ ID NO: 857490 - DNA, 16 bp, Homo sapiens
cacaaccttcggctcc

SEQ ID NO: 857491 - DNA, 23 bp, Homo sapiens
cacaaccttctgtggctcacaga

SEQ ID NO: 857492 - DNA, 22 bp, Homo sapiens
cacaactcactccttttaaaga

SEQ ID NO: 857493 - DNA, 22 bp, Homo sapiens
cacaactcccttaaggtctcca

SEQ ID NO: 857494 - DNA, 15 bp, Homo sapiens
cacacagtcacccct

SEQ ID NO: 857495 - DNA, 19 bp, Homo sapiens
cacacagtggatggacgga

SEQ ID NO: 857496 - DNA, 18 bp, Homo sapiens
cacacagtgttagtgctg

SEQ ID NO: 857497 - DNA, 17 bp, Homo sapiens
cacacagtttaaaaaat

SEQ ID NO: 857498 - DNA, 12 bp, Homo sapiens
cacacatacaga

SEQ ID NO: 857499 - DNA, 20 bp, Homo sapiens
cacacatacgtgcacagggt

SEQ ID NO: 857500 - DNA, 23 bp, Homo sapiens
cacacatataaacatcacacaca

SEQ ID NO: 857501 - DNA, 14 bp, Homo sapiens
cacacatatacata

SEQ ID NO: 857502 - DNA, 15 bp, Homo sapiens
cacacatatacatat

SEQ ID NO: 857503 - DNA, 17 bp, Homo sapiens
cacacatctggccctga

SEQ ID NO: 857504 - DNA, 14 bp, Homo sapiens
cacacatcttacct

SEQ ID NO: 857505 - DNA, 14 bp, Homo sapiens
cacacatgccctcc

SEQ ID NO: 857506 - DNA, 15 bp, Homo sapiens
cacacatgccctcct

SEQ ID NO: 857507 - DNA, 17 bp, Homo sapiens
cacacatgccctcctgg

SEQ ID NO: 857508 - DNA, 10 bp, Homo sapiens
cacacatttt

SEQ ID NO: 857509 - DNA, 12 bp, Homo sapiens
cacacatttttt

SEQ ID NO: 857510 - DNA, 19 bp, Homo sapiens
cacacattttttaaatgca

SEQ ID NO: 857511 - DNA, 20 bp, Homo sapiens
cacacattttttaaatgcac

SEQ ID NO: 857512 - DNA, 13 bp, Homo sapiens
cacaccaagtggc

SEQ ID NO: 857513 - DNA, 16 bp, Homo sapiens
cacaccaatcagagag

SEQ ID NO: 857514 - DNA, 20 bp, Homo sapiens
cacaccaatcagagagccta

SEQ ID NO: 857515 - DNA, 22 bp, Homo sapiens
cacaccaatcagagagcctaga

SEQ ID NO: 857516 - DNA, 15 bp, Homo sapiens
cacaccacgtcctgg

SEQ ID NO: 857517 - DNA, 21 bp, Homo sapiens
cacaccactaaccatccccaa

SEQ ID NO: 857518 - DNA, 20 bp, Homo sapiens
cacaccactgccctgcctgc

SEQ ID NO: 857519 - DNA, 19 bp, Homo sapiens
cacaccactgtactccagc

SEQ ID NO: 857520 - DNA, 18 bp, Homo sapiens
cacaccactgttgccttt

SEQ ID NO: 857521 - DNA, 14 bp, Homo sapiens
cacaccagccgctg

SEQ ID NO: 857522 - DNA, 16 bp, Homo sapiens
cacaccagccgctgca

SEQ ID NO: 857523 - DNA, 18 bp, Homo sapiens
cacaccagccgctgcagg

SEQ ID NO: 857524 - DNA, 13 bp, Homo sapiens
cacaccaggctgt

SEQ ID NO: 857525 - DNA, 22 bp, Homo sapiens
cacaccaggctgtgggcctcaa

SEQ ID NO: 857526 - DNA, 12 bp, Homo sapiens
cacaccagtggc

SEQ ID NO: 857527 - DNA, 20 bp, Homo sapiens
cacaccatcttaaatgacag

SEQ ID NO: 857528 - DNA, 21 bp, Homo sapiens
cacacccaccgtccgccctgc

SEQ ID NO: 857529 - DNA, 22 bp, Homo sapiens
cacacccaccgtccgccctgct

SEQ ID NO: 857530 - DNA, 14 bp, Homo sapiens
cacacccaggaagg

SEQ ID NO: 857531 - DNA, 15 bp, Homo sapiens
cacacccaggtctct

SEQ ID NO: 857532 - DNA, 16 bp, Homo sapiens
cacacccgaagtcctg

SEQ ID NO: 857533 - DNA, 18 bp, Homo sapiens
cacacccgaagtcctgtc

SEQ ID NO: 857534 - DNA, 12 bp, Homo sapiens
cacaccctgagg

SEQ ID NO: 857535 - DNA, 22 bp, Homo sapiens
cacaccctgaggtcagggagtg

SEQ ID NO: 857536 - DNA, 21 bp, Homo sapiens
cacaccctgtactgttctgtg

SEQ ID NO: 857537 - DNA, 14 bp, Homo sapiens
cacaccctgtttta

SEQ ID NO: 857538 - DNA, 20 bp, Homo sapiens
cacaccgtgtaaaccaaagc

SEQ ID NO: 857539 - DNA, 22 bp, Homo sapiens
cacacctactagtcaccagaga

SEQ ID NO: 857540 - DNA, 19 bp, Homo sapiens
cacacctcacgctctggac

SEQ ID NO: 857541 - DNA, 15 bp, Homo sapiens
cacacctcagtggga

SEQ ID NO: 857542 - DNA, 22 bp, Homo sapiens
cacacctcagttcccttggcct

SEQ ID NO: 857543 - DNA, 12 bp, Homo sapiens
cacacctcctct

SEQ ID NO: 857544 - DNA, 12 bp, Homo sapiens
cacacctcgtgg

SEQ ID NO: 857545 - DNA, 14 bp, Homo sapiens
cacacctctgggct

SEQ ID NO: 857546 - DNA, 18 bp, Homo sapiens
cacagtggactcagcagt

SEQ ID NO: 857547 - DNA, 20 bp, Homo sapiens
cacagtggcacaaaaaaata

SEQ ID NO: 857548 - DNA, 20 bp, Homo sapiens
cacagtgggatgaaccagcc

SEQ ID NO: 857549 - DNA, 18 bp, Homo sapiens
cacagtggggctgcaggc

SEQ ID NO: 857550 - DNA, 20 bp, Homo sapiens
cacagtgggtggcacctcct

SEQ ID NO: 857551 - DNA, 20 bp, Homo sapiens
cacagtgtaatccaggggtg

SEQ ID NO: 857552 - DNA, 16 bp, Homo sapiens
cacagtgtctgttcag

SEQ ID NO: 857553 - DNA, 13 bp, Homo sapiens
cacagtgtgtttg

SEQ ID NO: 857554 - DNA, 17 bp, Homo sapiens
cacagtgttatgctctg

SEQ ID NO: 857555 - DNA, 16 bp, Homo sapiens
cacagtgttggaggtt

SEQ ID NO: 857556 - DNA, 10 bp, Homo sapiens
cacagtgttt

SEQ ID NO: 857557 - DNA, 23 bp, Homo sapiens
cacagttcaaaattctaaatgta

SEQ ID NO: 857558 - DNA, 20 bp, Homo sapiens
cacagttcctcgccctgggt

SEQ ID NO: 857559 - DNA, 12 bp, Homo sapiens
cacagttgccac

SEQ ID NO: 857560 - DNA, 22 bp, Homo sapiens
cacagttgccaccacctctgtg

SEQ ID NO: 857561 - DNA, 23 bp, Homo sapiens
cacagttgccaccacctctgtgg

SEQ ID NO: 857562 - DNA, 15 bp, Homo sapiens
cacagttggccttca

SEQ ID NO: 857563 - DNA, 18 bp, Homo sapiens
cacagtttagaacagagg

SEQ ID NO: 857564 - DNA, 20 bp, Homo sapiens
cacagtttagtgctttacat

SEQ ID NO: 857565 - DNA, 20 bp, Homo sapiens
cacagtttcaggcttttatg

SEQ ID NO: 857566 - DNA, 12 bp, Homo sapiens
cacagtttgaac

SEQ ID NO: 857567 - DNA, 14 bp, Homo sapiens
cacagttttaataa

SEQ ID NO: 857568 - DNA, 19 bp, Homo sapiens
cacagttttaataagaaca

SEQ ID NO: 857569 - DNA, 22 bp, Homo sapiens
cacagttttgaaagaaaaatac

SEQ ID NO: 857570 - DNA, 23 bp, Homo sapiens
cacataaaaaagaagcactttga

SEQ ID NO: 857571 - DNA, 17 bp, Homo sapiens
cacataaatgctccttg

SEQ ID NO: 857572 - DNA, 18 bp, Homo sapiens
cacataactggattttga

SEQ ID NO: 857573 - DNA, 15 bp, Homo sapiens
cacataagagagatg

SEQ ID NO: 857574 - DNA, 19 bp, Homo sapiens
cacataatttttgtacatc

SEQ ID NO: 857575 - DNA, 15 bp, Homo sapiens
cacatacagaaagaa

SEQ ID NO: 857576 - DNA, 17 bp, Homo sapiens
cacatacagaaagaagc

SEQ ID NO: 857577 - DNA, 18 bp, Homo sapiens
cacatacagaaagaagca

SEQ ID NO: 857578 - DNA, 16 bp, Homo sapiens
cacatacatacacata

SEQ ID NO: 857579 - DNA, 22 bp, Homo sapiens
cacatacatacacatacataca

SEQ ID NO: 857580 - DNA, 15 bp, Homo sapiens
cacatacatacatac

SEQ ID NO: 857581 - DNA, 15 bp, Homo sapiens
cacataccctccccc

SEQ ID NO: 857582 - DNA, 16 bp, Homo sapiens
cacatacgtgcacagg

SEQ ID NO: 857583 - DNA, 16 bp, Homo sapiens
cacatacgtgttagga

SEQ ID NO: 857584 - DNA, 20 bp, Homo sapiens
cacatagagctttttaatag

SEQ ID NO: 857585 - DNA, 22 bp, Homo sapiens
cacatagattcacctgtaaaac

SEQ ID NO: 857586 - DNA, 21 bp, Homo sapiens
cacatagcaggggcaccttcc

SEQ ID NO: 857587 - DNA, 15 bp, Homo sapiens
cacatagcatgcttc

SEQ ID NO: 857588 - DNA, 22 bp, Homo sapiens
cacatagcatgcttcctttctc

SEQ ID NO: 857589 - DNA, 21 bp, Homo sapiens
cacatagcccacttacattta

SEQ ID NO: 857590 - DNA, 23 bp, Homo sapiens
cacatagcgccgtgctgtaaata

SEQ ID NO: 857591 - DNA, 20 bp, Homo sapiens
cacatggccatagaggccca

SEQ ID NO: 857592 - DNA, 14 bp, Homo sapiens
cacatgggctgggg

SEQ ID NO: 857593 - DNA, 18 bp, Homo sapiens
cacatggtgcccctagct

SEQ ID NO: 857594 - DNA, 21 bp, Homo sapiens
cacatggtgtctcccaacatg

SEQ ID NO: 857595 - DNA, 15 bp, Homo sapiens
cacatggtgtggcca

SEQ ID NO: 857596 - DNA, 17 bp, Homo sapiens
cacatggtgtggccatc

SEQ ID NO: 857597 - DNA, 14 bp, Homo sapiens
cacatgtaaaatat

SEQ ID NO: 857598 - DNA, 15 bp, Homo sapiens
cacatgtaaaatatg

SEQ ID NO: 857599 - DNA, 21 bp, Homo sapiens
cacatgtacataaactgtcac

SEQ ID NO: 857600 - DNA, 22 bp, Homo sapiens
cacatgtcaccgtggaccttcc

SEQ ID NO: 857601 - DNA, 19 bp, Homo sapiens
cacatgtctgtcctcagag

SEQ ID NO: 857602 - DNA, 20 bp, Homo sapiens
cacatgtctgtcctcagagc

SEQ ID NO: 857603 - DNA, 22 bp, Homo sapiens
cacatgtctgtcctcagagcag

SEQ ID NO: 857604 - DNA, 21 bp, Homo sapiens
cacatgtgctgatgtttacaa

SEQ ID NO: 857605 - DNA, 19 bp, Homo sapiens
cacatgtggcaaaatatgg

SEQ ID NO: 857606 - DNA, 15 bp, Homo sapiens
cacatgtttcctcta

SEQ ID NO: 857607 - DNA, 16 bp, Homo sapiens
cacattaaaaaatgaa

SEQ ID NO: 857608 - DNA, 19 bp, Homo sapiens
cacattaaaaaatgaaata

SEQ ID NO: 857609 - DNA, 20 bp, Homo sapiens
cacattaaaaaatgaaatat

SEQ ID NO: 857610 - DNA, 20 bp, Homo sapiens
cacattaaagaagacctgag

SEQ ID NO: 857611 - DNA, 18 bp, Homo sapiens
cacattaatcagattagc

SEQ ID NO: 857612 - DNA, 16 bp, Homo sapiens
cacattaatctcaaag

SEQ ID NO: 857613 - DNA, 15 bp, Homo sapiens
cacattagaattagt

SEQ ID NO: 857614 - DNA, 15 bp, Homo sapiens
cacattaggctgttg

SEQ ID NO: 857615 - DNA, 17 bp, Homo sapiens
cacattatcgggagcag

SEQ ID NO: 857616 - DNA, 23 bp, Homo sapiens
cacattatcgggagcagtgtctt

SEQ ID NO: 857617 - DNA, 21 bp, Homo sapiens
cacattatgttagagaggtag

SEQ ID NO: 857618 - DNA, 14 bp, Homo sapiens
cacattatttgcat

SEQ ID NO: 857619 - DNA, 14 bp, Homo sapiens
cacattccagccag

SEQ ID NO: 857620 - DNA, 15 bp, Homo sapiens
cacattccagccagg

SEQ ID NO: 857621 - DNA, 18 bp, Homo sapiens
cacattccagccaggccc

SEQ ID NO: 857622 - DNA, 24 bp, Homo sapiens
cacattccagccaggcccaggcca

SEQ ID NO: 857623 - DNA, 17 bp, Homo sapiens
cacattccagggctggg

SEQ ID NO: 857624 - DNA, 19 bp, Homo sapiens
cacattcccatggtggcct

SEQ ID NO: 857625 - DNA, 13 bp, Homo sapiens
cacattcctggcc

SEQ ID NO: 857626 - DNA, 23 bp, Homo sapiens
cacattcctggccccgggctctg

SEQ ID NO: 857627 - DNA, 18 bp, Homo sapiens
cacattcgggaccaatat

SEQ ID NO: 857628 - DNA, 12 bp, Homo sapiens
cacattctactt

SEQ ID NO: 857629 - DNA, 17 bp, Homo sapiens
cacattctacttcagct

SEQ ID NO: 857630 - DNA, 18 bp, Homo sapiens
cacattctatagccataa

SEQ ID NO: 857631 - DNA, 16 bp, Homo sapiens
cacattctcttcccag

SEQ ID NO: 857632 - DNA, 13 bp, Homo sapiens
cacattcttggct

SEQ ID NO: 857633 - DNA, 13 bp, Homo sapiens
cacattctttata

SEQ ID NO: 857634 - DNA, 13 bp, Homo sapiens
cacattgaagaat

SEQ ID NO: 857635 - DNA, 13 bp, Homo sapiens
cacattgcctcat

SEQ ID NO: 857636 - DNA, 15 bp, Homo sapiens
cacattgcctgttct

SEQ ID NO: 857637 - DNA, 16 bp, Homo sapiens
cacattgcctgttctg

SEQ ID NO: 857638 - DNA, 18 bp, Homo sapiens
cacattgcctgttctgct

SEQ ID NO: 857639 - DNA, 19 bp, Homo sapiens
cacattgcctgttctgctt

SEQ ID NO: 857640 - DNA, 20 bp, Homo sapiens
cacattgcctgttctgcttc

SEQ ID NO: 857641 - DNA, 17 bp, Homo sapiens
cacattggaccagatga

SEQ ID NO: 857642 - DNA, 23 bp, Homo sapiens
cacattgtgtgaatactggaagc

SEQ ID NO: 857643 - DNA, 21 bp, Homo sapiens
cacattgttgtttttttaata

SEQ ID NO: 857644 - DNA, 13 bp, Homo sapiens
cacatttaaaaca

SEQ ID NO: 857645 - DNA, 14 bp, Homo sapiens
cacatttaaaacat

SEQ ID NO: 857646 - DNA, 15 bp, Homo sapiens
cacatttatatatat

SEQ ID NO: 857647 - DNA, 18 bp, Homo sapiens
cacatttatatatatatg

SEQ ID NO: 857648 - DNA, 16 bp, Homo sapiens
cacatttcatagccta

SEQ ID NO: 857649 - DNA, 21 bp, Homo sapiens
cacatttccagggcagcagcc

SEQ ID NO: 857650 - DNA, 21 bp, Homo sapiens
cacatttcctctgttcttttc

SEQ ID NO: 857651 - DNA, 15 bp, Homo sapiens
cacatttctggattg

SEQ ID NO: 857652 - DNA, 20 bp, Homo sapiens
cacatttgatgtacatgtgt

SEQ ID NO: 857653 - DNA, 17 bp, Homo sapiens
cacatttggaatacttt

SEQ ID NO: 857654 - DNA, 19 bp, Homo sapiens
cacatttgggatgttcctt

SEQ ID NO: 857655 - DNA, 15 bp, Homo sapiens
cacattttatgagag

SEQ ID NO: 857656 - DNA, 17 bp, Homo sapiens
cacattttattttatta

SEQ ID NO: 857657 - DNA, 20 bp, Homo sapiens
cacattttattttattatgc

SEQ ID NO: 857658 - DNA, 21 bp, Homo sapiens
cacattttattttattatgca

SEQ ID NO: 857659 - DNA, 18 bp, Homo sapiens
cacattttccttttcaaa

SEQ ID NO: 857660 - DNA, 21 bp, Homo sapiens
cacattttgcctttctcgtgg

SEQ ID NO: 857661 - DNA, 14 bp, Homo sapiens
cacatttttcagat

SEQ ID NO: 857662 - DNA, 13 bp, Homo sapiens
cacatttttctta

SEQ ID NO: 857663 - DNA, 14 bp, Homo sapiens
caccaaaaccaaac

SEQ ID NO: 857664 - DNA, 15 bp, Homo sapiens
caccaaaagaagtaa

SEQ ID NO: 857665 - DNA, 18 bp, Homo sapiens
caccaaaataagaaaaga

SEQ ID NO: 857666 - DNA, 19 bp, Homo sapiens
caccaaaataagaaaagat

SEQ ID NO: 857667 - DNA, 13 bp, Homo sapiens
caccaaagagaat

SEQ ID NO: 857668 - DNA, 14 bp, Homo sapiens
caccaaagatgtcc

SEQ ID NO: 857669 - DNA, 15 bp, Homo sapiens
caccaaagtattttt

SEQ ID NO: 857670 - DNA, 13 bp, Homo sapiens
caccaaatgtgct

SEQ ID NO: 857671 - DNA, 13 bp, Homo sapiens
caccaacccagga

SEQ ID NO: 857672 - DNA, 18 bp, Homo sapiens
caccaaccccgcggccca

SEQ ID NO: 857673 - DNA, 13 bp, Homo sapiens
caccaaccctcag

SEQ ID NO: 857674 - DNA, 15 bp, Homo sapiens
caccaacttacaaaa

SEQ ID NO: 857675 - DNA, 16 bp, Homo sapiens
caccaagcacagcagc

SEQ ID NO: 857676 - DNA, 18 bp, Homo sapiens
caccaagcacagcagcct

SEQ ID NO: 857677 - DNA, 21 bp, Homo sapiens
caccaagcaggaaatgaaaat

SEQ ID NO: 857678 - DNA, 13 bp, Homo sapiens
caccaagccaagg

SEQ ID NO: 857679 - DNA, 20 bp, Homo sapiens
caccaagcccgcctccagca

SEQ ID NO: 857680 - DNA, 16 bp, Homo sapiens
caccaagctaggtgct

SEQ ID NO: 857681 - DNA, 19 bp, Homo sapiens
caccaagctcacagttcct

SEQ ID NO: 857682 - DNA, 16 bp, Homo sapiens
caccaaggcagtgcat

SEQ ID NO: 857683 - DNA, 20 bp, Homo sapiens
caccaaggcagtgcatgcat

SEQ ID NO: 857684 - DNA, 15 bp, Homo sapiens
caccaaggtcttcag

SEQ ID NO: 857685 - DNA, 15 bp, Homo sapiens
caccaagtgcaatag

SEQ ID NO: 857686 - DNA, 19 bp, Homo sapiens
caccaagtggctgggtgcc

SEQ ID NO: 857687 - DNA, 23 bp, Homo sapiens
caccaagttggaacatccttgga

SEQ ID NO: 857688 - DNA, 14 bp, Homo sapiens
caccaataaatgtt

SEQ ID NO: 857689 - DNA, 15 bp, Homo sapiens
caccaataaatgttt

SEQ ID NO: 857690 - DNA, 17 bp, Homo sapiens
caccaatcagagagcct

SEQ ID NO: 857691 - DNA, 15 bp, Homo sapiens
caccaatctgccctt

SEQ ID NO: 857692 - DNA, 13 bp, Homo sapiens
caccagcttcact

SEQ ID NO: 857693 - DNA, 16 bp, Homo sapiens
caccagcttctccagg

SEQ ID NO: 857694 - DNA, 18 bp, Homo sapiens
caccaggaagtgtttatg

SEQ ID NO: 857695 - DNA, 12 bp, Homo sapiens
caccaggaatgt

SEQ ID NO: 857696 - DNA, 16 bp, Homo sapiens
caccaggactggctgt

SEQ ID NO: 857697 - DNA, 23 bp, Homo sapiens
caccaggacttggggtcaggaac

SEQ ID NO: 857698 - DNA, 17 bp, Homo sapiens
caccaggagcacctgga

SEQ ID NO: 857699 - DNA, 12 bp, Homo sapiens
caccaggagcag

SEQ ID NO: 857700 - DNA, 14 bp, Homo sapiens
caccaggagcagca

SEQ ID NO: 857701 - DNA, 15 bp, Homo sapiens
caccaggagcagcag

SEQ ID NO: 857702 - DNA, 17 bp, Homo sapiens
caccaggagcagcagcc

SEQ ID NO: 857703 - DNA, 19 bp, Homo sapiens
caccaggagcagcagccag

SEQ ID NO: 857704 - DNA, 21 bp, Homo sapiens
caccaggagcagcagccagca

SEQ ID NO: 857705 - DNA, 23 bp, Homo sapiens
caccaggagcagcagccagcacc

SEQ ID NO: 857706 - DNA, 14 bp, Homo sapiens
caccaggccacctc

SEQ ID NO: 857707 - DNA, 19 bp, Homo sapiens
caccaggccacctccccag

SEQ ID NO: 857708 - DNA, 23 bp, Homo sapiens
caccaggcccacgaggagcagca

SEQ ID NO: 857709 - DNA, 16 bp, Homo sapiens
caccaggccgtcctcc

SEQ ID NO: 857710 - DNA, 17 bp, Homo sapiens
caccaggccgtgccttg

SEQ ID NO: 857711 - DNA, 17 bp, Homo sapiens
caccaggcgctaattca

SEQ ID NO: 857712 - DNA, 13 bp, Homo sapiens
caccaggctggcg

SEQ ID NO: 857713 - DNA, 15 bp, Homo sapiens
caccaggctggcgca

SEQ ID NO: 857714 - DNA, 20 bp, Homo sapiens
caccaggctggcgcagccaa

SEQ ID NO: 857715 - DNA, 16 bp, Homo sapiens
caccagggatggtact

SEQ ID NO: 857716 - DNA, 16 bp, Homo sapiens
caccaggggaaggaag

SEQ ID NO: 857717 - DNA, 19 bp, Homo sapiens
caccaggggaaggaaggag

SEQ ID NO: 857718 - DNA, 14 bp, Homo sapiens
caccagggtcccag

SEQ ID NO: 857719 - DNA, 16 bp, Homo sapiens
caccagggtcccagga

SEQ ID NO: 857720 - DNA, 17 bp, Homo sapiens
caccagggtcccaggaa

SEQ ID NO: 857721 - DNA, 16 bp, Homo sapiens
caccagggtggaccag

SEQ ID NO: 857722 - DNA, 17 bp, Homo sapiens
caccagggtggaccagg

SEQ ID NO: 857723 - DNA, 23 bp, Homo sapiens
caccagggtttagtttgcattta

SEQ ID NO: 857724 - DNA, 19 bp, Homo sapiens
caccaggtgcctttcaaat

SEQ ID NO: 857725 - DNA, 18 bp, Homo sapiens
caccagtcacctcgtctc

SEQ ID NO: 857726 - DNA, 19 bp, Homo sapiens
caccagtcacctcgtctcc

SEQ ID NO: 857727 - DNA, 21 bp, Homo sapiens
caccagtcacctcgtctccct

SEQ ID NO: 857728 - DNA, 19 bp, Homo sapiens
caccagtggacctagcctg

SEQ ID NO: 857729 - DNA, 17 bp, Homo sapiens
caccagtggcctcgtgg

SEQ ID NO: 857730 - DNA, 20 bp, Homo sapiens
caccagtgtagcatcttcct

SEQ ID NO: 857731 - DNA, 21 bp, Homo sapiens
caccagtgtagcatcttcctc

SEQ ID NO: 857732 - DNA, 23 bp, Homo sapiens
caccagtgtagcatcttcctctg

SEQ ID NO: 857733 - DNA, 13 bp, Homo sapiens
caccagtgtcccc

SEQ ID NO: 857734 - DNA, 16 bp, Homo sapiens
caccagtgtcccctcc

SEQ ID NO: 857735 - DNA, 21 bp, Homo sapiens
caccagtgtgtgggggagatt

SEQ ID NO: 857736 - DNA, 14 bp, Homo sapiens
caccagtgttcctg

SEQ ID NO: 857737 - DNA, 19 bp, Homo sapiens
caccagttaaaagcatttt

SEQ ID NO: 857738 - DNA, 11 bp, Homo sapiens
caccagttctc

SEQ ID NO: 857739 - DNA, 19 bp, Homo sapiens
caccatagttttgtttaat

SEQ ID NO: 857740 - DNA, 23 bp, Homo sapiens
caccatagttttgtttaatttgc

SEQ ID NO: 857741 - DNA, 17 bp, Homo sapiens
caccatcactcactcac

SEQ ID NO: 857742 - DNA, 16 bp, Homo sapiens
caccatccctttttga

SEQ ID NO: 857743 - DNA, 21 bp, Homo sapiens
caccatccctttttgaagtgt

SEQ ID NO: 857744 - DNA, 14 bp, Homo sapiens
caccatcctcagag

SEQ ID NO: 857745 - DNA, 15 bp, Homo sapiens
caccatcctgcagcc

SEQ ID NO: 857746 - DNA, 13 bp, Homo sapiens
caccatcctgctg

SEQ ID NO: 857747 - DNA, 13 bp, Homo sapiens
caccatctcaggc

SEQ ID NO: 857748 - DNA, 19 bp, Homo sapiens
caccatctcaggccacctg

SEQ ID NO: 857749 - DNA, 12 bp, Homo sapiens
caccatctttta

SEQ ID NO: 857750 - DNA, 15 bp, Homo sapiens
caccatgaccccttc

SEQ ID NO: 857751 - DNA, 18 bp, Homo sapiens
caccatgaccccttctct

SEQ ID NO: 857752 - DNA, 22 bp, Homo sapiens
caccatgcaaatgtcttccagg

SEQ ID NO: 857753 - DNA, 16 bp, Homo sapiens
caccatgcccagctag

SEQ ID NO: 857754 - DNA, 21 bp, Homo sapiens
caccatgcccggctaattttt

SEQ ID NO: 857755 - DNA, 20 bp, Homo sapiens
caccatgcttgcctgaagct

SEQ ID NO: 857756 - DNA, 14 bp, Homo sapiens
caccatggaccagc

SEQ ID NO: 857757 - DNA, 23 bp, Homo sapiens
caccatggagacgtggtgggact

SEQ ID NO: 857758 - DNA, 12 bp, Homo sapiens
caccatggccag

SEQ ID NO: 857759 - DNA, 16 bp, Homo sapiens
caccatggccagccaa

SEQ ID NO: 857760 - DNA, 23 bp, Homo sapiens
caccatgggaaactgttgtgggc

SEQ ID NO: 857761 - DNA, 23 bp, Homo sapiens
caccatgggaggtggggcctcaa

SEQ ID NO: 857762 - DNA, 22 bp, Homo sapiens
caccatgtgccatctgtacata

SEQ ID NO: 857763 - DNA, 19 bp, Homo sapiens
caccatgtgggcacggagg

SEQ ID NO: 857764 - DNA, 23 bp, Homo sapiens
caccatgttggccaggctgttct

SEQ ID NO: 857765 - DNA, 19 bp, Homo sapiens
caccatgttggtcaggctg

SEQ ID NO: 857766 - DNA, 18 bp, Homo sapiens
caccatgtttgagctcag

SEQ ID NO: 857767 - DNA, 19 bp, Homo sapiens
caccatgtttgagctcaga

SEQ ID NO: 857768 - DNA, 13 bp, Homo sapiens
caccattataaaa

SEQ ID NO: 857769 - DNA, 12 bp, Homo sapiens
caccattcctgc

SEQ ID NO: 857770 - DNA, 15 bp, Homo sapiens
caccattcctgcctt

SEQ ID NO: 857771 - DNA, 13 bp, Homo sapiens
caccattctgact

SEQ ID NO: 857772 - DNA, 14 bp, Homo sapiens
caccattctgactc

SEQ ID NO: 857773 - DNA, 13 bp, Homo sapiens
caccattgaaggc

SEQ ID NO: 857774 - DNA, 21 bp, Homo sapiens
caccattgtgaagcacctact

SEQ ID NO: 857775 - DNA, 14 bp, Homo sapiens
caccatttaaaaat

SEQ ID NO: 857776 - DNA, 15 bp, Homo sapiens
cacccaaacacttct

SEQ ID NO: 857777 - DNA, 20 bp, Homo sapiens
cacccaaacacttctgcttt

SEQ ID NO: 857778 - DNA, 16 bp, Homo sapiens
cacccaaagcctgtcc

SEQ ID NO: 857779 - DNA, 20 bp, Homo sapiens
cacccaaagcctgtcccagg

SEQ ID NO: 857780 - DNA, 20 bp, Homo sapiens
cacccaaatgtgtacacctg

SEQ ID NO: 857781 - DNA, 22 bp, Homo sapiens
cacccaaccctatctcctgaca

SEQ ID NO: 857782 - DNA, 15 bp, Homo sapiens
cacccaagcctgctg

SEQ ID NO: 857783 - DNA, 18 bp, Homo sapiens
cacccaagcctgctggct

SEQ ID NO: 857784 - DNA, 13 bp, Homo sapiens
cacccaagcttgg

SEQ ID NO: 857785 - DNA, 21 bp, Homo sapiens
cacccaagcttggcagccgag

SEQ ID NO: 857786 - DNA, 23 bp, Homo sapiens
cacccaataaacattaagattga

SEQ ID NO: 857787 - DNA, 17 bp, Homo sapiens
cacccaattcaaaacat

SEQ ID NO: 857788 - DNA, 13 bp, Homo sapiens
cacccacaagccc

SEQ ID NO: 857789 - DNA, 15 bp, Homo sapiens
cacccacacactcgc

SEQ ID NO: 857790 - DNA, 17 bp, Homo sapiens
cacccacacactcgccc

SEQ ID NO: 857791 - DNA, 13 bp, Homo sapiens
cacccacagcacc

SEQ ID NO: 857792 - DNA, 19 bp, Homo sapiens
cacccaccagctccacaca

SEQ ID NO: 857793 - DNA, 21 bp, Homo sapiens
cacccaccagctccacacatt

SEQ ID NO: 857794 - DNA, 15 bp, Homo sapiens
cacccaccagggcga

SEQ ID NO: 857795 - DNA, 13 bp, Homo sapiens
cacccaccatgga

SEQ ID NO: 857796 - DNA, 17 bp, Homo sapiens
cacccaccatggaccag

SEQ ID NO: 857797 - DNA, 15 bp, Homo sapiens
cacccaccctctggt

SEQ ID NO: 857798 - DNA, 20 bp, Homo sapiens
cacccaccgtccgccctgct

SEQ ID NO: 857799 - DNA, 23 bp, Homo sapiens
cacccaccgtccgccctgctcct

SEQ ID NO: 857800 - DNA, 23 bp, Homo sapiens
cacccaccgtctcggccctgaac

SEQ ID NO: 857801 - DNA, 22 bp, Homo sapiens
cacccacctccacccagcccct

SEQ ID NO: 857802 - DNA, 18 bp, Homo sapiens
cacccacctccctgcctc

SEQ ID NO: 857803 - DNA, 23 bp, Homo sapiens
cacccacctccctgcctccagga

SEQ ID NO: 857804 - DNA, 15 bp, Homo sapiens
cacccacctcctgcg

SEQ ID NO: 857805 - DNA, 17 bp, Homo sapiens
cacccacctcctgcggc

SEQ ID NO: 857806 - DNA, 13 bp, Homo sapiens
cacccacctctgg

SEQ ID NO: 857807 - DNA, 19 bp, Homo sapiens
cacccacctgttttctgaa

SEQ ID NO: 857808 - DNA, 19 bp, Homo sapiens
cacccaccttgacgtttct

SEQ ID NO: 857809 - DNA, 22 bp, Homo sapiens
cacccaccttgacgtttcttct

SEQ ID NO: 857810 - DNA, 13 bp, Homo sapiens
cacccactcacca

SEQ ID NO: 857811 - DNA, 15 bp, Homo sapiens
cacccactcaccagg

SEQ ID NO: 857812 - DNA, 13 bp, Homo sapiens
caccctgccccta

SEQ ID NO: 857813 - DNA, 14 bp, Homo sapiens
caccctgcccctaa

SEQ ID NO: 857814 - DNA, 15 bp, Homo sapiens
caccctgcccctaag

SEQ ID NO: 857815 - DNA, 13 bp, Homo sapiens
caccctgcccgct

SEQ ID NO: 857816 - DNA, 16 bp, Homo sapiens
caccctgcctgcacct

SEQ ID NO: 857817 - DNA, 12 bp, Homo sapiens
caccctgcctta

SEQ ID NO: 857818 - DNA, 19 bp, Homo sapiens
caccctgccttatcttgca

SEQ ID NO: 857819 - DNA, 19 bp, Homo sapiens
caccctgcgcctccagagg

SEQ ID NO: 857820 - DNA, 14 bp, Homo sapiens
caccctgcgggcca

SEQ ID NO: 857821 - DNA, 16 bp, Homo sapiens
caccctgcgggccagg

SEQ ID NO: 857822 - DNA, 17 bp, Homo sapiens
caccctgcgggccaggg

SEQ ID NO: 857823 - DNA, 13 bp, Homo sapiens
caccctgcttctc

SEQ ID NO: 857824 - DNA, 21 bp, Homo sapiens
caccctggaggatttcatctc

SEQ ID NO: 857825 - DNA, 21 bp, Homo sapiens
caccctggattgatcggagcc

SEQ ID NO: 857826 - DNA, 16 bp, Homo sapiens
caccctggcccgcccc

SEQ ID NO: 857827 - DNA, 17 bp, Homo sapiens
caccctggcccgcccct

SEQ ID NO: 857828 - DNA, 19 bp, Homo sapiens
caccctggcccgcccctcg

SEQ ID NO: 857829 - DNA, 21 bp, Homo sapiens
caccctggccgagtccaagct

SEQ ID NO: 857830 - DNA, 22 bp, Homo sapiens
caccctggccgagtccaagctg

SEQ ID NO: 857831 - DNA, 12 bp, Homo sapiens
caccctgggagc

SEQ ID NO: 857832 - DNA, 19 bp, Homo sapiens
caccctgggatggaacctc

SEQ ID NO: 857833 - DNA, 17 bp, Homo sapiens
caccctgggccctgggc

SEQ ID NO: 857834 - DNA, 21 bp, Homo sapiens
caccctgggccctgggctgga

SEQ ID NO: 857835 - DNA, 14 bp, Homo sapiens
caccctggggcctg

SEQ ID NO: 857836 - DNA, 13 bp, Homo sapiens
caccctggggctg

SEQ ID NO: 857837 - DNA, 12 bp, Homo sapiens
caccctgggtgc

SEQ ID NO: 857838 - DNA, 16 bp, Homo sapiens
caccctgtactgttct

SEQ ID NO: 857839 - DNA, 13 bp, Homo sapiens
caccctgtcaagt

SEQ ID NO: 857840 - DNA, 18 bp, Homo sapiens
caccctgtcccccagctc

SEQ ID NO: 857841 - DNA, 22 bp, Homo sapiens
caccctgtgaccctctcacttt

SEQ ID NO: 857842 - DNA, 11 bp, Homo sapiens
caccctgtggg

SEQ ID NO: 857843 - DNA, 15 bp, Homo sapiens
caccctgtgggaccg

SEQ ID NO: 857844 - DNA, 21 bp, Homo sapiens
caccctgtgggtgtctccctc

SEQ ID NO: 857845 - DNA, 14 bp, Homo sapiens
cacccttagaaaat

SEQ ID NO: 857846 - DNA, 14 bp, Homo sapiens
cacccttcagaccc

SEQ ID NO: 857847 - DNA, 16 bp, Homo sapiens
cacccttcagacccca

SEQ ID NO: 857848 - DNA, 22 bp, Homo sapiens
cacccttcccctccttctccct

SEQ ID NO: 857849 - DNA, 13 bp, Homo sapiens
cacccttcctggc

SEQ ID NO: 857850 - DNA, 13 bp, Homo sapiens
cacccttctttcc

SEQ ID NO: 857851 - DNA, 15 bp, Homo sapiens
cacccttctttcctc

SEQ ID NO: 857852 - DNA, 18 bp, Homo sapiens
cacccttctttcctcttc

SEQ ID NO: 857853 - DNA, 20 bp, Homo sapiens
cacccttctttcctcttccc

SEQ ID NO: 857854 - DNA, 22 bp, Homo sapiens
cacccttgcaccgtcctcagca

SEQ ID NO: 857855 - DNA, 12 bp, Homo sapiens
cacccttggcct

SEQ ID NO: 857856 - DNA, 17 bp, Homo sapiens
cacccttggcctgtcca

SEQ ID NO: 857857 - DNA, 22 bp, Homo sapiens
caccctttcatagagaggcctg

SEQ ID NO: 857858 - DNA, 21 bp, Homo sapiens
cacccttttccagctggatga

SEQ ID NO: 857859 - DNA, 19 bp, Homo sapiens
caccctttttttggggtgc

SEQ ID NO: 857860 - DNA, 17 bp, Homo sapiens
caccgaatatattactg

SEQ ID NO: 857861 - DNA, 14 bp, Homo sapiens
caccgacagcggcc

SEQ ID NO: 857862 - DNA, 14 bp, Homo sapiens
caccgaccccgggc

SEQ ID NO: 857863 - DNA, 18 bp, Homo sapiens
caccgaccccgggccgga

SEQ ID NO: 857864 - DNA, 15 bp, Homo sapiens
caccgacccgaggcc

SEQ ID NO: 857865 - DNA, 17 bp, Homo sapiens
caccgacgcgtctcctg

SEQ ID NO: 857866 - DNA, 15 bp, Homo sapiens
caccgactagccagg

SEQ ID NO: 857867 - DNA, 15 bp, Homo sapiens
caccgactgaaaata

SEQ ID NO: 857868 - DNA, 13 bp, Homo sapiens
caccgactgccca

SEQ ID NO: 857869 - DNA, 20 bp, Homo sapiens
caccgactgcccagccactc

SEQ ID NO: 857870 - DNA, 18 bp, Homo sapiens
caccgagagtagccgaga

SEQ ID NO: 857871 - DNA, 15 bp, Homo sapiens
caccgaggttcccag

SEQ ID NO: 857872 - DNA, 14 bp, Homo sapiens
caccgcatatgcat

SEQ ID NO: 857873 - DNA, 17 bp, Homo sapiens
caccgcatatgcatgcc

SEQ ID NO: 857874 - DNA, 20 bp, Homo sapiens
caccgcatatgcatgccagg

SEQ ID NO: 857875 - DNA, 21 bp, Homo sapiens
caccgcatatgcatgccaggc

SEQ ID NO: 857876 - DNA, 14 bp, Homo sapiens
caccgcccccaccc

SEQ ID NO: 857877 - DNA, 15 bp, Homo sapiens
caccgcccccacccc

SEQ ID NO: 857878 - DNA, 16 bp, Homo sapiens
caccgcccccacccct

SEQ ID NO: 857879 - DNA, 16 bp, Homo sapiens
cacctcgagaagtaat

SEQ ID NO: 857880 - DNA, 16 bp, Homo sapiens
cacctcgctcccctct

SEQ ID NO: 857881 - DNA, 18 bp, Homo sapiens
cacctcgctcccctctgg

SEQ ID NO: 857882 - DNA, 22 bp, Homo sapiens
cacctcgctcccctctggaatc

SEQ ID NO: 857883 - DNA, 13 bp, Homo sapiens
cacctcggaggga

SEQ ID NO: 857884 - DNA, 20 bp, Homo sapiens
cacctcggagggatggagaa

SEQ ID NO: 857885 - DNA, 15 bp, Homo sapiens
cacctcggcacacac

SEQ ID NO: 857886 - DNA, 13 bp, Homo sapiens
cacctcggcctcc

SEQ ID NO: 857887 - DNA, 14 bp, Homo sapiens
cacctcggcctccc

SEQ ID NO: 857888 - DNA, 19 bp, Homo sapiens
cacctctaatagaggcagt

SEQ ID NO: 857889 - DNA, 19 bp, Homo sapiens
cacctctactgtctcctcc

SEQ ID NO: 857890 - DNA, 14 bp, Homo sapiens
cacctctagcctta

SEQ ID NO: 857891 - DNA, 19 bp, Homo sapiens
cacctctcacgggccctgc

SEQ ID NO: 857892 - DNA, 12 bp, Homo sapiens
cacctctccctc

SEQ ID NO: 857893 - DNA, 19 bp, Homo sapiens
cacctctccctcaacaagg

SEQ ID NO: 857894 - DNA, 19 bp, Homo sapiens
cacctctccctgaccctgt

SEQ ID NO: 857895 - DNA, 13 bp, Homo sapiens
cacctctccctgc

SEQ ID NO: 857896 - DNA, 14 bp, Homo sapiens
cacctctccctgca

SEQ ID NO: 857897 - DNA, 16 bp, Homo sapiens
cacctctccctgcatc

SEQ ID NO: 857898 - DNA, 20 bp, Homo sapiens
cacctctccctgcatcctga

SEQ ID NO: 857899 - DNA, 23 bp, Homo sapiens
cacctctccctgcatcctgaggc

SEQ ID NO: 857900 - DNA, 24 bp, Homo sapiens
cacctctccctgcatcctgaggcc

SEQ ID NO: 857901 - DNA, 22 bp, Homo sapiens
cacctctcgcaagagggtctct

SEQ ID NO: 857902 - DNA, 12 bp, Homo sapiens
cacctctcttca

SEQ ID NO: 857903 - DNA, 12 bp, Homo sapiens
cacctctcttcc

SEQ ID NO: 857904 - DNA, 14 bp, Homo sapiens
cacctctcttttcc

SEQ ID NO: 857905 - DNA, 21 bp, Homo sapiens
cacctctcttttcctctctgt

SEQ ID NO: 857906 - DNA, 21 bp, Homo sapiens
cacctctgacgcaccactgcc

SEQ ID NO: 857907 - DNA, 13 bp, Homo sapiens
cacctctgaggac

SEQ ID NO: 857908 - DNA, 20 bp, Homo sapiens
cacctctgatagactttgtg

SEQ ID NO: 857909 - DNA, 19 bp, Homo sapiens
cacctctgcacaagctgca

SEQ ID NO: 857910 - DNA, 15 bp, Homo sapiens
cacctctgcccttcc

SEQ ID NO: 857911 - DNA, 18 bp, Homo sapiens
cacctctgcccttcccct

SEQ ID NO: 857912 - DNA, 11 bp, Homo sapiens
cacctctgctc

SEQ ID NO: 857913 - DNA, 13 bp, Homo sapiens
cacctctggactg

SEQ ID NO: 857914 - DNA, 23 bp, Homo sapiens
cacctctggccaaatatgcactt

SEQ ID NO: 857915 - DNA, 14 bp, Homo sapiens
cacctctgggggga

SEQ ID NO: 857916 - DNA, 22 bp, Homo sapiens
cacctctgggtccttggctccc

SEQ ID NO: 857917 - DNA, 18 bp, Homo sapiens
cacctctggtggctcctc

SEQ ID NO: 857918 - DNA, 12 bp, Homo sapiens
cacctcttccac

SEQ ID NO: 857919 - DNA, 12 bp, Homo sapiens
cacctcttccga

SEQ ID NO: 857920 - DNA, 12 bp, Homo sapiens
cacctcttcctc

SEQ ID NO: 857921 - DNA, 13 bp, Homo sapiens
cacctcttcctct

SEQ ID NO: 857922 - DNA, 15 bp, Homo sapiens
cacctcttcctctgg

SEQ ID NO: 857923 - DNA, 24 bp, Homo sapiens
cacctcttcctctggttcctttca

SEQ ID NO: 857924 - DNA, 17 bp, Homo sapiens
cacctcttctcttcctg

SEQ ID NO: 857925 - DNA, 18 bp, Homo sapiens
cacctcttctcttcctgt

SEQ ID NO: 857926 - DNA, 16 bp, Homo sapiens
cacctcttctgcgtgc

SEQ ID NO: 857927 - DNA, 23 bp, Homo sapiens
cacctcttgtgcaaggtggcctt

SEQ ID NO: 857928 - DNA, 16 bp, Homo sapiens
cacctcttgtttctgg

SEQ ID NO: 857929 - DNA, 18 bp, Homo sapiens
cacctctttaaaaactca

SEQ ID NO: 857930 - DNA, 18 bp, Homo sapiens
aggctttgccatgggcct

SEQ ID NO: 857931 - DNA, 22 bp, Homo sapiens
aggctttgccatgggcctgctg

SEQ ID NO: 857932 - DNA, 13 bp, Homo sapiens
aggctttggccca

SEQ ID NO: 857933 - DNA, 22 bp, Homo sapiens
aggctttgggagagcaggaatg

SEQ ID NO: 857934 - DNA, 22 bp, Homo sapiens
aggctttgggtggctcactact

SEQ ID NO: 857935 - DNA, 21 bp, Homo sapiens
aggcttttatatatgaagttg

SEQ ID NO: 857936 - DNA, 15 bp, Homo sapiens
aggcttttatttctg

SEQ ID NO: 857937 - DNA, 15 bp, Homo sapiens
aggcttttcactgcc

SEQ ID NO: 857938 - DNA, 10 bp, Homo sapiens
agggaaaaaa

SEQ ID NO: 857939 - DNA, 20 bp, Homo sapiens
agggaaaaaagaaagaaaaa

SEQ ID NO: 857940 - DNA, 16 bp, Homo sapiens
agggaaaaggggctcc

SEQ ID NO: 857941 - DNA, 17 bp, Homo sapiens
agggaaaaggggctcct

SEQ ID NO: 857942 - DNA, 20 bp, Homo sapiens
agggaaaataggcaggaagc

SEQ ID NO: 857943 - DNA, 17 bp, Homo sapiens
agggaaaccttggagag

SEQ ID NO: 857944 - DNA, 18 bp, Homo sapiens
agggaaaccttggagagg

SEQ ID NO: 857945 - DNA, 15 bp, Homo sapiens
agggaaactaagatt

SEQ ID NO: 857946 - DNA, 22 bp, Homo sapiens
agggaaactaagattcttttaa

SEQ ID NO: 857947 - DNA, 13 bp, Homo sapiens
agggaaagaaaat

SEQ ID NO: 857948 - DNA, 16 bp, Homo sapiens
agggaaagaattgagg

SEQ ID NO: 857949 - DNA, 21 bp, Homo sapiens
agggaaagcgggcagccccgt

SEQ ID NO: 857950 - DNA, 21 bp, Homo sapiens
agggaaataatagggaaaata

SEQ ID NO: 857951 - DNA, 20 bp, Homo sapiens
agggaaatctgtaaagccag

SEQ ID NO: 857952 - DNA, 13 bp, Homo sapiens
agggaaatgtttt

SEQ ID NO: 857953 - DNA, 17 bp, Homo sapiens
agggaaatgttttgtaa

SEQ ID NO: 857954 - DNA, 20 bp, Homo sapiens
agggaacaaaactgttcttt

SEQ ID NO: 857955 - DNA, 21 bp, Homo sapiens
agggaacaatttggcaatttt

SEQ ID NO: 857956 - DNA, 15 bp, Homo sapiens
agggaacagggcgga

SEQ ID NO: 857957 - DNA, 18 bp, Homo sapiens
agggaaccaccagcgttc

SEQ ID NO: 857958 - DNA, 19 bp, Homo sapiens
agggaaccccagggggcaa

SEQ ID NO: 857959 - DNA, 16 bp, Homo sapiens
agggaacctgttagtc

SEQ ID NO: 857960 - DNA, 14 bp, Homo sapiens
agggaactagaggt

SEQ ID NO: 857961 - DNA, 14 bp, Homo sapiens
agggaactctgggg

SEQ ID NO: 857962 - DNA, 15 bp, Homo sapiens
agggaactctggggt

SEQ ID NO: 857963 - DNA, 15 bp, Homo sapiens
agggaactgcttgcc

SEQ ID NO: 857964 - DNA, 23 bp, Homo sapiens
agggaactgcttgcccagggtgc

SEQ ID NO: 857965 - DNA, 15 bp, Homo sapiens
agggaagaaaaagca

SEQ ID NO: 857966 - DNA, 19 bp, Homo sapiens
agggaagaaaaagcaagtg

SEQ ID NO: 857967 - DNA, 15 bp, Homo sapiens
agggaagaactattg

SEQ ID NO: 857968 - DNA, 18 bp, Homo sapiens
agggaagaaggaggaatg

SEQ ID NO: 857969 - DNA, 19 bp, Homo sapiens
agggaagagacagcccagg

SEQ ID NO: 857970 - DNA, 12 bp, Homo sapiens
agggaagagggc

SEQ ID NO: 857971 - DNA, 20 bp, Homo sapiens
agggaagagtcttccaaggc

SEQ ID NO: 857972 - DNA, 19 bp, Homo sapiens
agggaagagtggaggtgga

SEQ ID NO: 857973 - DNA, 13 bp, Homo sapiens
agggaagagtttt

SEQ ID NO: 857974 - DNA, 18 bp, Homo sapiens
agggaagatcttgatggt

SEQ ID NO: 857975 - DNA, 19 bp, Homo sapiens
agggaagcaagcctgtcct

SEQ ID NO: 857976 - DNA, 16 bp, Homo sapiens
agggaagcgtatatac

SEQ ID NO: 857977 - DNA, 16 bp, Homo sapiens
agggaagctggccgag

SEQ ID NO: 857978 - DNA, 13 bp, Homo sapiens
agggaaggaaaaa

SEQ ID NO: 857979 - DNA, 18 bp, Homo sapiens
agggaaggaactctggct

SEQ ID NO: 857980 - DNA, 16 bp, Homo sapiens
agggaaggagcccagc

SEQ ID NO: 857981 - DNA, 20 bp, Homo sapiens
agggaaggataaagccactt

SEQ ID NO: 857982 - DNA, 22 bp, Homo sapiens
agggaaggatacaaaagcatgt

SEQ ID NO: 857983 - DNA, 14 bp, Homo sapiens
agggaaggatttaa

SEQ ID NO: 857984 - DNA, 15 bp, Homo sapiens
agggaagggccaccc

SEQ ID NO: 857985 - DNA, 16 bp, Homo sapiens
agggaagggccaccct

SEQ ID NO: 857986 - DNA, 21 bp, Homo sapiens
agggaagggccaccctgctgc

SEQ ID NO: 857987 - DNA, 21 bp, Homo sapiens
agggaaggggaggcagccggc

SEQ ID NO: 857988 - DNA, 21 bp, Homo sapiens
agggaaggggatggaggccag

SEQ ID NO: 857989 - DNA, 17 bp, Homo sapiens
agggaagggtttctcta

SEQ ID NO: 857990 - DNA, 21 bp, Homo sapiens
agggaaggtggccacagcaag

SEQ ID NO: 857991 - DNA, 16 bp, Homo sapiens
agggaaggtggggccc

SEQ ID NO: 857992 - DNA, 19 bp, Homo sapiens
agggaaggtggggccctgc

SEQ ID NO: 857993 - DNA, 22 bp, Homo sapiens
agggaaggtggggccctgcccc

SEQ ID NO: 857994 - DNA, 17 bp, Homo sapiens
agggaagtaacagacac

SEQ ID NO: 857995 - DNA, 17 bp, Homo sapiens
agggaagtgaggcccaa

SEQ ID NO: 857996 - DNA, 20 bp, Homo sapiens
agggaagttgtctccttcca

SEQ ID NO: 857997 - DNA, 23 bp, Homo sapiens
agggaataaaatcctaagacaca

SEQ ID NO: 857998 - DNA, 19 bp, Homo sapiens
agggaataaggtacaagaa

SEQ ID NO: 857999 - DNA, 19 bp, Homo sapiens
agggaatactcacattttg

SEQ ID NO: 858000 - DNA, 16 bp, Homo sapiens
agggaatccaagcctc

SEQ ID NO: 858001 - DNA, 15 bp, Homo sapiens
agggaatcctcctcc

SEQ ID NO: 858002 - DNA, 16 bp, Homo sapiens
agggaatcctcctcca

SEQ ID NO: 858003 - DNA, 16 bp, Homo sapiens
agggaatctggattat

SEQ ID NO: 858004 - DNA, 13 bp, Homo sapiens
agggaatgcctgg

SEQ ID NO: 858005 - DNA, 17 bp, Homo sapiens
agggaatgcctggaggg

SEQ ID NO: 858006 - DNA, 17 bp, Homo sapiens
agggaatgttccctgca

SEQ ID NO: 858007 - DNA, 22 bp, Homo sapiens
agggaatgttccctgcaccctg

SEQ ID NO: 858008 - DNA, 15 bp, Homo sapiens
agggaattcctgggg

SEQ ID NO: 858009 - DNA, 12 bp, Homo sapiens
agggaattgctc

SEQ ID NO: 858010 - DNA, 15 bp, Homo sapiens
agggaatttcaggaa

SEQ ID NO: 858011 - DNA, 19 bp, Homo sapiens
agggacaagtggactcagg

SEQ ID NO: 858012 - DNA, 22 bp, Homo sapiens
agggacaagtggactcagggca

SEQ ID NO: 858013 - DNA, 19 bp, Homo sapiens
agggacacacagcctagca

SEQ ID NO: 858014 - DNA, 19 bp, Homo sapiens
agggacagcaagtgagcag

SEQ ID NO: 858015 - DNA, 14 bp, Homo sapiens
agggacagcatgcc

SEQ ID NO: 858016 - DNA, 20 bp, Homo sapiens
agggacagcccactgagaag

SEQ ID NO: 858017 - DNA, 21 bp, Homo sapiens
agggacagcccactgagaagt

SEQ ID NO: 858018 - DNA, 17 bp, Homo sapiens
agggacaggaccccagc

SEQ ID NO: 858019 - DNA, 20 bp, Homo sapiens
agggacaggaccccagctct

SEQ ID NO: 858020 - DNA, 16 bp, Homo sapiens
agggacaggctgaaga

SEQ ID NO: 858021 - DNA, 17 bp, Homo sapiens
agggacaggctgaagag

SEQ ID NO: 858022 - DNA, 19 bp, Homo sapiens
agggacaggctgaagagag

SEQ ID NO: 858023 - DNA, 13 bp, Homo sapiens
agggacagggcag

SEQ ID NO: 858024 - DNA, 20 bp, Homo sapiens
agggacaggtgggcctggcg

SEQ ID NO: 858025 - DNA, 21 bp, Homo sapiens
agggacaggtgggcctggcgg

SEQ ID NO: 858026 - DNA, 23 bp, Homo sapiens
agggacaggtgggcctggcggcc

SEQ ID NO: 858027 - DNA, 20 bp, Homo sapiens
agggacatgaaatttacaaa

SEQ ID NO: 858028 - DNA, 18 bp, Homo sapiens
agggacatgccctgtgtg

SEQ ID NO: 858029 - DNA, 22 bp, Homo sapiens
agggacatgccctgtgtggctg

SEQ ID NO: 858030 - DNA, 14 bp, Homo sapiens
agggacatggggca

SEQ ID NO: 858031 - DNA, 17 bp, Homo sapiens
agggacatggggcaagc

SEQ ID NO: 858032 - DNA, 19 bp, Homo sapiens
agggacatggggcaagcca

SEQ ID NO: 858033 - DNA, 20 bp, Homo sapiens
agggacatggggcaagccag

SEQ ID NO: 858034 - DNA, 23 bp, Homo sapiens
agggacatggggcaagccagggc

SEQ ID NO: 858035 - DNA, 19 bp, Homo sapiens
agggaccaaggacccctca

SEQ ID NO: 858036 - DNA, 12 bp, Homo sapiens
agggaccaaggc

SEQ ID NO: 858037 - DNA, 18 bp, Homo sapiens
agggaccacaccctgtac

SEQ ID NO: 858038 - DNA, 16 bp, Homo sapiens
agggaccactgggtga

SEQ ID NO: 858039 - DNA, 16 bp, Homo sapiens
agggaccaggggagag

SEQ ID NO: 858040 - DNA, 15 bp, Homo sapiens
agggacccaaagcag

SEQ ID NO: 858041 - DNA, 16 bp, Homo sapiens
agggacccccccccaa

SEQ ID NO: 858042 - DNA, 22 bp, Homo sapiens
agggacccggggtctcctggac

SEQ ID NO: 858043 - DNA, 20 bp, Homo sapiens
agggacccttgcctgcctcc

SEQ ID NO: 858044 - DNA, 21 bp, Homo sapiens
agggacccttgcctgcctcct

SEQ ID NO: 858045 - DNA, 16 bp, Homo sapiens
agggaccctttggggg

SEQ ID NO: 858046 - DNA, 14 bp, Homo sapiens
agggaccggcggac

SEQ ID NO: 858047 - DNA, 22 bp, Homo sapiens
agggaccggcggaccccagcca

SEQ ID NO: 858048 - DNA, 18 bp, Homo sapiens
agggaccggtgctgcagg

SEQ ID NO: 858049 - DNA, 22 bp, Homo sapiens
agggaccggtgctgcaggagtg

SEQ ID NO: 858050 - DNA, 13 bp, Homo sapiens
agggacctctccc

SEQ ID NO: 858051 - DNA, 14 bp, Homo sapiens
agggaccttgaagg

SEQ ID NO: 858052 - DNA, 15 bp, Homo sapiens
agggacgcctggggg

SEQ ID NO: 858053 - DNA, 18 bp, Homo sapiens
agggacgcctgggggtgc

SEQ ID NO: 858054 - DNA, 23 bp, Homo sapiens
agggacgcctgggggtgccagga

SEQ ID NO: 858055 - DNA, 17 bp, Homo sapiens
agggacgcggaggagga

SEQ ID NO: 858056 - DNA, 19 bp, Homo sapiens
agggacgcggaggaggaag

SEQ ID NO: 858057 - DNA, 19 bp, Homo sapiens
agggactagtgagtcagca

SEQ ID NO: 858058 - DNA, 20 bp, Homo sapiens
agggactgcagctgcaccag

SEQ ID NO: 858059 - DNA, 13 bp, Homo sapiens
agggacttaaaaa

SEQ ID NO: 858060 - DNA, 16 bp, Homo sapiens
agggacttgaagttgt

SEQ ID NO: 858061 - DNA, 16 bp, Homo sapiens
agggacttgcctccac

SEQ ID NO: 858062 - DNA, 18 bp, Homo sapiens
agggacttgcctccactc

SEQ ID NO: 858063 - DNA, 23 bp, Homo sapiens
agggacttggctgtccttcccct

SEQ ID NO: 858064 - DNA, 12 bp, Homo sapiens
agggagaaaaga

SEQ ID NO: 858065 - DNA, 13 bp, Homo sapiens
agggagaaaagag

SEQ ID NO: 858066 - DNA, 16 bp, Homo sapiens
agggagaaaagagaaa

SEQ ID NO: 858067 - DNA, 20 bp, Homo sapiens
agggagaaaatccaggtcat

SEQ ID NO: 858068 - DNA, 12 bp, Homo sapiens
agggagaaagga

SEQ ID NO: 858069 - DNA, 15 bp, Homo sapiens
agggagaaaggagaa

SEQ ID NO: 858070 - DNA, 21 bp, Homo sapiens
agggagaaaggagaaattttg

SEQ ID NO: 858071 - DNA, 19 bp, Homo sapiens
agggagaacatgaatttgc

SEQ ID NO: 858072 - DNA, 15 bp, Homo sapiens
agggagaaggatcta

SEQ ID NO: 858073 - DNA, 18 bp, Homo sapiens
agggagaagggatggagg

SEQ ID NO: 858074 - DNA, 20 bp, Homo sapiens
agggagacactggcccctca

SEQ ID NO: 858075 - DNA, 22 bp, Homo sapiens
agggagacaggcagggagggct

SEQ ID NO: 858076 - DNA, 15 bp, Homo sapiens
agggagacagggtag

SEQ ID NO: 858077 - DNA, 16 bp, Homo sapiens
agggagacagggtagg

SEQ ID NO: 858078 - DNA, 16 bp, Homo sapiens
agggagactcctgggc

SEQ ID NO: 858079 - DNA, 23 bp, Homo sapiens
agggagactgtggtaggggcagg

SEQ ID NO: 858080 - DNA, 15 bp, Homo sapiens
agggagagccagctc

SEQ ID NO: 858081 - DNA, 14 bp, Homo sapiens
agggagagcggggc

SEQ ID NO: 858082 - DNA, 16 bp, Homo sapiens
agggagaggaagagaa

SEQ ID NO: 858083 - DNA, 13 bp, Homo sapiens
agggagagggaag

SEQ ID NO: 858084 - DNA, 14 bp, Homo sapiens
agggagagggaggt

SEQ ID NO: 858085 - DNA, 20 bp, Homo sapiens
agggagaggtcaccagctgc

SEQ ID NO: 858086 - DNA, 21 bp, Homo sapiens
agggagaggtcaccagctgct

SEQ ID NO: 858087 - DNA, 16 bp, Homo sapiens
agggagcagatgactg

SEQ ID NO: 858088 - DNA, 14 bp, Homo sapiens
agggagcagccccc

SEQ ID NO: 858089 - DNA, 21 bp, Homo sapiens
agggagccatggaaggtgcca

SEQ ID NO: 858090 - DNA, 23 bp, Homo sapiens
agggagccatggaaggtgccaga

SEQ ID NO: 858091 - DNA, 22 bp, Homo sapiens
agggagcctccccatctgtcca

SEQ ID NO: 858092 - DNA, 23 bp, Homo sapiens
agggagcctccccatctgtccag

SEQ ID NO: 858093 - DNA, 14 bp, Homo sapiens
agggagcctggccc

SEQ ID NO: 858094 - DNA, 20 bp, Homo sapiens
agggagcgatccaggggaag

SEQ ID NO: 858095 - DNA, 22 bp, Homo sapiens
agggagcgatccaggggaagcc

SEQ ID NO: 858096 - DNA, 21 bp, Homo sapiens
agggagcggccggccagcccc

SEQ ID NO: 858097 - DNA, 16 bp, Homo sapiens
agggagcttcctggct

SEQ ID NO: 858098 - DNA, 17 bp, Homo sapiens
agggagcttcctggctc

SEQ ID NO: 858099 - DNA, 18 bp, Homo sapiens
agggagcttcctggctct

SEQ ID NO: 858100 - DNA, 19 bp, Homo sapiens
agggagcttcctggctctg

SEQ ID NO: 858101 - DNA, 16 bp, Homo sapiens
agggaggaaggccttt

SEQ ID NO: 858102 - DNA, 21 bp, Homo sapiens
agggaggaatcgaggaaccag

SEQ ID NO: 858103 - DNA, 14 bp, Homo sapiens
agggaggacctggg

SEQ ID NO: 858104 - DNA, 15 bp, Homo sapiens
agggaggaggccacc

SEQ ID NO: 858105 - DNA, 17 bp, Homo sapiens
agggaggaggccacctc

SEQ ID NO: 858106 - DNA, 20 bp, Homo sapiens
agggaggaggccacctctcc

SEQ ID NO: 858107 - DNA, 21 bp, Homo sapiens
agggaggaggccacctctcca

SEQ ID NO: 858108 - DNA, 16 bp, Homo sapiens
agggaggagtggaggt

SEQ ID NO: 858109 - DNA, 18 bp, Homo sapiens
agggaggcaacactgctg

SEQ ID NO: 858110 - DNA, 13 bp, Homo sapiens
agggaggcactag

SEQ ID NO: 858111 - DNA, 19 bp, Homo sapiens
agggaggcactagtcaccg

SEQ ID NO: 858112 - DNA, 17 bp, Homo sapiens
agggaggcagcgtgggc

SEQ ID NO: 858113 - DNA, 20 bp, Homo sapiens
agggaggccacgtcccaccc

SEQ ID NO: 858114 - DNA, 22 bp, Homo sapiens
agggaggccacgtcccacccca

SEQ ID NO: 858115 - DNA, 14 bp, Homo sapiens
agggaggcccagcc

SEQ ID NO: 858116 - DNA, 13 bp, Homo sapiens
agggaggcgcagg

SEQ ID NO: 858117 - DNA, 15 bp, Homo sapiens
agggaggcgcaggga

SEQ ID NO: 858118 - DNA, 18 bp, Homo sapiens
agggaggcgcagggacat

SEQ ID NO: 858119 - DNA, 15 bp, Homo sapiens
agggaggcggggagg

SEQ ID NO: 858120 - DNA, 19 bp, Homo sapiens
agggagggaagggccaccc

SEQ ID NO: 858121 - DNA, 19 bp, Homo sapiens
agggagggaaggggatgga

SEQ ID NO: 858122 - DNA, 13 bp, Homo sapiens
agggagggaattt

SEQ ID NO: 858123 - DNA, 15 bp, Homo sapiens
agggagggagccatg

SEQ ID NO: 858124 - DNA, 16 bp, Homo sapiens
agggagggcagctggc

SEQ ID NO: 858125 - DNA, 20 bp, Homo sapiens
agggagggccagggaggcag

SEQ ID NO: 858126 - DNA, 20 bp, Homo sapiens
agggagggccggcggctctg

SEQ ID NO: 858127 - DNA, 21 bp, Homo sapiens
agggaggggaaaagcattttt

SEQ ID NO: 858128 - DNA, 16 bp, Homo sapiens
agggaggggaaatgta

SEQ ID NO: 858129 - DNA, 18 bp, Homo sapiens
agggaggggaaatgtaat

SEQ ID NO: 858130 - DNA, 14 bp, Homo sapiens
agggaggggacaga

SEQ ID NO: 858131 - DNA, 12 bp, Homo sapiens
agggaggggcct

SEQ ID NO: 858132 - DNA, 17 bp, Homo sapiens
agggaggggctggggca

SEQ ID NO: 858133 - DNA, 20 bp, Homo sapiens
agggagggggcgctcaggac

SEQ ID NO: 858134 - DNA, 15 bp, Homo sapiens
agggagggtgcagcc

SEQ ID NO: 858135 - DNA, 18 bp, Homo sapiens
agggagggtgcagccctc

SEQ ID NO: 858136 - DNA, 23 bp, Homo sapiens
agggaggtgtttaaagagaggtt

SEQ ID NO: 858137 - DNA, 12 bp, Homo sapiens
agggagtccagg

SEQ ID NO: 858138 - DNA, 22 bp, Homo sapiens
agggagtcccctccccggccct

SEQ ID NO: 858139 - DNA, 20 bp, Homo sapiens
agggagtctcaggaggaggc

SEQ ID NO: 858140 - DNA, 16 bp, Homo sapiens
agggagtgagcagcta

SEQ ID NO: 858141 - DNA, 21 bp, Homo sapiens
agggagtgcagaacacctggc

SEQ ID NO: 858142 - DNA, 15 bp, Homo sapiens
agggagtgctggctc

SEQ ID NO: 858143 - DNA, 16 bp, Homo sapiens
agggagtgctggctca

SEQ ID NO: 858144 - DNA, 17 bp, Homo sapiens
agggagtgctggctcac

SEQ ID NO: 858145 - DNA, 18 bp, Homo sapiens
agggagtgctggctcaca

SEQ ID NO: 858146 - DNA, 20 bp, Homo sapiens
agggagtgctggctcacagt

SEQ ID NO: 858147 - DNA, 21 bp, Homo sapiens
agggagtggcacttctgcctt

SEQ ID NO: 858148 - DNA, 16 bp, Homo sapiens
agggagttttgtctgt

SEQ ID NO: 858149 - DNA, 19 bp, Homo sapiens
agggagttttgtctgtctc

SEQ ID NO: 858150 - DNA, 16 bp, Homo sapiens
agggatacaagagagg

SEQ ID NO: 858151 - DNA, 17 bp, Homo sapiens
agggatatggcaggact

SEQ ID NO: 858152 - DNA, 18 bp, Homo sapiens
agggatatggcaggactc

SEQ ID NO: 858153 - DNA, 14 bp, Homo sapiens
agggatattgcctt

SEQ ID NO: 858154 - DNA, 19 bp, Homo sapiens
agggatattgccttatttg

SEQ ID NO: 858155 - DNA, 13 bp, Homo sapiens
agggatcacaggg

SEQ ID NO: 858156 - DNA, 14 bp, Homo sapiens
agggatcacagggc

SEQ ID NO: 858157 - DNA, 17 bp, Homo sapiens
agggatcacagggcccc

SEQ ID NO: 858158 - DNA, 21 bp, Homo sapiens
agggatcagccccgcctgtca

SEQ ID NO: 858159 - DNA, 16 bp, Homo sapiens
agggatccctcatctg

SEQ ID NO: 858160 - DNA, 19 bp, Homo sapiens
agggatccctcatctgtcc

SEQ ID NO: 858161 - DNA, 16 bp, Homo sapiens
agggatcgtagatttt

SEQ ID NO: 858162 - DNA, 22 bp, Homo sapiens
agggatgactaaaatatttatt

SEQ ID NO: 858163 - DNA, 18 bp, Homo sapiens
agggatgatggcagagcc

SEQ ID NO: 858164 - DNA, 19 bp, Homo sapiens
agggatgatggcagagcca

SEQ ID NO: 858165 - DNA, 13 bp, Homo sapiens
agggatgcccgct

SEQ ID NO: 858166 - DNA, 21 bp, Homo sapiens
agggatgccctggaggtggct

SEQ ID NO: 858167 - DNA, 16 bp, Homo sapiens
agggatgctgcctgag

SEQ ID NO: 858168 - DNA, 13 bp, Homo sapiens
agggatgctgggc

SEQ ID NO: 858169 - DNA, 17 bp, Homo sapiens
agggattctcacaatag

SEQ ID NO: 858170 - DNA, 23 bp, Homo sapiens
agggattctgggcttggggtgtg

SEQ ID NO: 858171 - DNA, 14 bp, Homo sapiens
agggattgtccctg

SEQ ID NO: 858172 - DNA, 14 bp, Homo sapiens
agggcaaattattt

SEQ ID NO: 858173 - DNA, 13 bp, Homo sapiens
agggcaagaaatg

SEQ ID NO: 858174 - DNA, 22 bp, Homo sapiens
agggcaagaattcttatgctta

SEQ ID NO: 858175 - DNA, 14 bp, Homo sapiens
agggcaaggagttt

SEQ ID NO: 858176 - DNA, 13 bp, Homo sapiens
agggcaagggcca

SEQ ID NO: 858177 - DNA, 22 bp, Homo sapiens
agggcaagggccatgctgaagg

SEQ ID NO: 858178 - DNA, 19 bp, Homo sapiens
agggcaagggtgcctcagg

SEQ ID NO: 858179 - DNA, 23 bp, Homo sapiens
agggcaagggtgcctcaggacct

SEQ ID NO: 858180 - DNA, 21 bp, Homo sapiens
agggcaagtggatgggaattt

SEQ ID NO: 858181 - DNA, 13 bp, Homo sapiens
agggcaatgccat

SEQ ID NO: 858182 - DNA, 14 bp, Homo sapiens
agggcaatgccatc

SEQ ID NO: 858183 - DNA, 21 bp, Homo sapiens
agggcaatgccatcagcccct

SEQ ID NO: 858184 - DNA, 18 bp, Homo sapiens
agggcacaaactgcagct

SEQ ID NO: 858185 - DNA, 19 bp, Homo sapiens
agggcacagcaggggagcc

SEQ ID NO: 858186 - DNA, 21 bp, Homo sapiens
agggcacattaactccctcca

SEQ ID NO: 858187 - DNA, 21 bp, Homo sapiens
agggcacattgcccatggctg

SEQ ID NO: 858188 - DNA, 18 bp, Homo sapiens
agggcacggggacctgga

SEQ ID NO: 858189 - DNA, 17 bp, Homo sapiens
agggcactcccaaccct

SEQ ID NO: 858190 - DNA, 21 bp, Homo sapiens
agggcactcccaaccctgggc

SEQ ID NO: 858191 - DNA, 18 bp, Homo sapiens
agggcactggagctggga

SEQ ID NO: 858192 - DNA, 15 bp, Homo sapiens
agggcactgggctgt

SEQ ID NO: 858193 - DNA, 16 bp, Homo sapiens
agggcactgggctgtt

SEQ ID NO: 858194 - DNA, 18 bp, Homo sapiens
agggcactgggctgttgt

SEQ ID NO: 858195 - DNA, 16 bp, Homo sapiens
agggcactggtggccc

SEQ ID NO: 858196 - DNA, 17 bp, Homo sapiens
agggcactggtggcccg

SEQ ID NO: 858197 - DNA, 16 bp, Homo sapiens
agggcacttaatttgt

SEQ ID NO: 858198 - DNA, 17 bp, Homo sapiens
agggcacttaatttgta

SEQ ID NO: 858199 - DNA, 21 bp, Homo sapiens
agggcacttcaggtccgtggg

SEQ ID NO: 858200 - DNA, 15 bp, Homo sapiens
agggcacttcctcca

SEQ ID NO: 858201 - DNA, 21 bp, Homo sapiens
agggcagacatgccttggtgc

SEQ ID NO: 858202 - DNA, 15 bp, Homo sapiens
agggcagactggggc

SEQ ID NO: 858203 - DNA, 19 bp, Homo sapiens
agggcagagaatggctggg

SEQ ID NO: 858204 - DNA, 12 bp, Homo sapiens
agggcagagcca

SEQ ID NO: 858205 - DNA, 13 bp, Homo sapiens
agggcagagccat

SEQ ID NO: 858206 - DNA, 18 bp, Homo sapiens
agggcagagccatgggcc

SEQ ID NO: 858207 - DNA, 15 bp, Homo sapiens
agggcagagccggga

SEQ ID NO: 858208 - DNA, 17 bp, Homo sapiens
agggcagaggaagagac

SEQ ID NO: 858209 - DNA, 20 bp, Homo sapiens
agggcagaggctggaggcag

SEQ ID NO: 858210 - DNA, 22 bp, Homo sapiens
agggcagaggctggaggcaggg

SEQ ID NO: 858211 - DNA, 16 bp, Homo sapiens
agggcagatgtgggga

SEQ ID NO: 858212 - DNA, 17 bp, Homo sapiens
agggcagattttcatgc

SEQ ID NO: 858213 - DNA, 13 bp, Homo sapiens
agggcagcagccg

SEQ ID NO: 858214 - DNA, 15 bp, Homo sapiens
agggcagcagggcta

SEQ ID NO: 858215 - DNA, 14 bp, Homo sapiens
agggcagccctcca

SEQ ID NO: 858216 - DNA, 19 bp, Homo sapiens
agggcagcctggatccctg

SEQ ID NO: 858217 - DNA, 13 bp, Homo sapiens
agggcagctgcta

SEQ ID NO: 858218 - DNA, 18 bp, Homo sapiens
agggcagcttgccccggc

SEQ ID NO: 858219 - DNA, 19 bp, Homo sapiens
agggcaggaaggagagcct

SEQ ID NO: 858220 - DNA, 21 bp, Homo sapiens
agggcaggaaggagagcctgc

SEQ ID NO: 858221 - DNA, 23 bp, Homo sapiens
agggcaggaaggagagcctgctg

SEQ ID NO: 858222 - DNA, 22 bp, Homo sapiens
agggcaggatggcctttccttc

SEQ ID NO: 858223 - DNA, 16 bp, Homo sapiens
agggcaggccttgctg

SEQ ID NO: 858224 - DNA, 20 bp, Homo sapiens
agggcaggccttgctggggt

SEQ ID NO: 858225 - DNA, 21 bp, Homo sapiens
agggcaggccttgctggggtc

SEQ ID NO: 858226 - DNA, 14 bp, Homo sapiens
agggcaggctgagg

SEQ ID NO: 858227 - DNA, 18 bp, Homo sapiens
agggcaggctgaggtggg

SEQ ID NO: 858228 - DNA, 14 bp, Homo sapiens
agggcaggcttggg

SEQ ID NO: 858229 - DNA, 22 bp, Homo sapiens
agggcagggaccacaccctgta

SEQ ID NO: 858230 - DNA, 23 bp, Homo sapiens
agggcagggcccacgtgtatagt

SEQ ID NO: 858231 - DNA, 17 bp, Homo sapiens
agggcagggccccaggc

SEQ ID NO: 858232 - DNA, 23 bp, Homo sapiens
agggcaggggatgcccagaagag

SEQ ID NO: 858233 - DNA, 11 bp, Homo sapiens
agggcagggtc

SEQ ID NO: 858234 - DNA, 22 bp, Homo sapiens
agggcagggtccacgcctctgc

SEQ ID NO: 858235 - DNA, 18 bp, Homo sapiens
agggcagggtgggcagcc

SEQ ID NO: 858236 - DNA, 23 bp, Homo sapiens
agggcagtccttactcccccacc

SEQ ID NO: 858237 - DNA, 21 bp, Homo sapiens
agggcagtgcccatgtgtaca

SEQ ID NO: 858238 - DNA, 22 bp, Homo sapiens
agggcagtgcccatgtgtacat

SEQ ID NO: 858239 - DNA, 13 bp, Homo sapiens
agggcagtgtttc

SEQ ID NO: 858240 - DNA, 17 bp, Homo sapiens
agggcagtgtttccttt

SEQ ID NO: 858241 - DNA, 19 bp, Homo sapiens
agggcataaagtaaataca

SEQ ID NO: 858242 - DNA, 22 bp, Homo sapiens
agggcatcaggcactggtggca

SEQ ID NO: 858243 - DNA, 17 bp, Homo sapiens
agggcatcatgcatctt

SEQ ID NO: 858244 - DNA, 12 bp, Homo sapiens
agggcatctcct

SEQ ID NO: 858245 - DNA, 19 bp, Homo sapiens
agggcatgtgcggctgaac

SEQ ID NO: 858246 - DNA, 21 bp, Homo sapiens
agggcattccatcccttcctg

SEQ ID NO: 858247 - DNA, 20 bp, Homo sapiens
agggccaaaatatttggaat

SEQ ID NO: 858248 - DNA, 15 bp, Homo sapiens
agggccaaacccact

SEQ ID NO: 858249 - DNA, 23 bp, Homo sapiens
agggccaaagaaccaaagaagaa

SEQ ID NO: 858250 - DNA, 16 bp, Homo sapiens
agggccaacccttctc

SEQ ID NO: 858251 - DNA, 24 bp, Homo sapiens
agggccacactattaccatgagaa

SEQ ID NO: 858252 - DNA, 21 bp, Homo sapiens
agggccacatgggaggctcac

SEQ ID NO: 858253 - DNA, 15 bp, Homo sapiens
agggccaccctgctg

SEQ ID NO: 858254 - DNA, 20 bp, Homo sapiens
agggccaccctgctgcacta

SEQ ID NO: 858255 - DNA, 16 bp, Homo sapiens
agggccacctgcagga

SEQ ID NO: 858256 - DNA, 16 bp, Homo sapiens
agggccacgctccagc

SEQ ID NO: 858257 - DNA, 19 bp, Homo sapiens
agggccactttttttttat

SEQ ID NO: 858258 - DNA, 16 bp, Homo sapiens
agggccagaaggaggg

SEQ ID NO: 858259 - DNA, 17 bp, Homo sapiens
agggccagactggaaga

SEQ ID NO: 858260 - DNA, 13 bp, Homo sapiens
agggccagcaggc

SEQ ID NO: 858261 - DNA, 16 bp, Homo sapiens
agggccagcaggctcc

SEQ ID NO: 858262 - DNA, 17 bp, Homo sapiens
agggccagctaattttt

SEQ ID NO: 858263 - DNA, 16 bp, Homo sapiens
agggccaggagatgga

SEQ ID NO: 858264 - DNA, 12 bp, Homo sapiens
agggccaggcag

SEQ ID NO: 858265 - DNA, 13 bp, Homo sapiens
agggccaggcaga

SEQ ID NO: 858266 - DNA, 14 bp, Homo sapiens
agggccaggcaggt

SEQ ID NO: 858267 - DNA, 21 bp, Homo sapiens
agggccagggcaatgccatca

SEQ ID NO: 858268 - DNA, 15 bp, Homo sapiens
agggccagggccctg

SEQ ID NO: 858269 - DNA, 15 bp, Homo sapiens
agggccaggtgcaga

SEQ ID NO: 858270 - DNA, 22 bp, Homo sapiens
agggccaggtgcagaccttggg

SEQ ID NO: 858271 - DNA, 19 bp, Homo sapiens
agggccagtcctgcctggc

SEQ ID NO: 858272 - DNA, 23 bp, Homo sapiens
agggctctcaaagtataatcttt

SEQ ID NO: 858273 - DNA, 21 bp, Homo sapiens
agggctctgatattccatgaa

SEQ ID NO: 858274 - DNA, 17 bp, Homo sapiens
agggctctgcaggccac

SEQ ID NO: 858275 - DNA, 19 bp, Homo sapiens
agggctctgtttgtgggac

SEQ ID NO: 858276 - DNA, 18 bp, Homo sapiens
agggctctttctctctgc

SEQ ID NO: 858277 - DNA, 15 bp, Homo sapiens
agggctgaggagcag

SEQ ID NO: 858278 - DNA, 20 bp, Homo sapiens
agggctgaggagcagccagg

SEQ ID NO: 858279 - DNA, 22 bp, Homo sapiens
agggctgaggagcagccaggac

SEQ ID NO: 858280 - DNA, 19 bp, Homo sapiens
agggctgaggggcctgcgc

SEQ ID NO: 858281 - DNA, 17 bp, Homo sapiens
agggctgatggaggaaa

SEQ ID NO: 858282 - DNA, 13 bp, Homo sapiens
agggctgcagtca

SEQ ID NO: 858283 - DNA, 15 bp, Homo sapiens
agggctgcagtcaca

SEQ ID NO: 858284 - DNA, 13 bp, Homo sapiens
agggctgccctga

SEQ ID NO: 858285 - DNA, 15 bp, Homo sapiens
agggctgctgcttct

SEQ ID NO: 858286 - DNA, 12 bp, Homo sapiens
agggctgctggg

SEQ ID NO: 858287 - DNA, 23 bp, Homo sapiens
agggctgctgggggcaactggcc

SEQ ID NO: 858288 - DNA, 17 bp, Homo sapiens
agggctggagcctgggg

SEQ ID NO: 858289 - DNA, 18 bp, Homo sapiens
agggctggagcctggggt

SEQ ID NO: 858290 - DNA, 15 bp, Homo sapiens
agggctggaggccca

SEQ ID NO: 858291 - DNA, 17 bp, Homo sapiens
agggctggaggcccagg

SEQ ID NO: 858292 - DNA, 19 bp, Homo sapiens
agggctggaggcccaggct

SEQ ID NO: 858293 - DNA, 15 bp, Homo sapiens
agggctggatggaca

SEQ ID NO: 858294 - DNA, 16 bp, Homo sapiens
agggctggatggacag

SEQ ID NO: 858295 - DNA, 22 bp, Homo sapiens
agggctggatggacagacacct

SEQ ID NO: 858296 - DNA, 21 bp, Homo sapiens
agggctggcacgtgacaggct

SEQ ID NO: 858297 - DNA, 14 bp, Homo sapiens
agggctggctcctg

SEQ ID NO: 858298 - DNA, 17 bp, Homo sapiens
agggctggctcctgatc

SEQ ID NO: 858299 - DNA, 16 bp, Homo sapiens
agggctgggaggaagg

SEQ ID NO: 858300 - DNA, 12 bp, Homo sapiens
agggctgggccc

SEQ ID NO: 858301 - DNA, 13 bp, Homo sapiens
agggctgggcctg

SEQ ID NO: 858302 - DNA, 23 bp, Homo sapiens
agggctgggctagaaagaccact

SEQ ID NO: 858303 - DNA, 10 bp, Homo sapiens
agggctgggg

SEQ ID NO: 858304 - DNA, 17 bp, Homo sapiens
aggtccaagccccccac

SEQ ID NO: 858305 - DNA, 14 bp, Homo sapiens
aggtccaagggcca

SEQ ID NO: 858306 - DNA, 15 bp, Homo sapiens
aggtccaagggccat

SEQ ID NO: 858307 - DNA, 16 bp, Homo sapiens
aggtccaatttgtaaa

SEQ ID NO: 858308 - DNA, 17 bp, Homo sapiens
aggtccacaacacacag

SEQ ID NO: 858309 - DNA, 19 bp, Homo sapiens
aggtccacaacacacagat

SEQ ID NO: 858310 - DNA, 23 bp, Homo sapiens
aggtccacagacctactgcactg

SEQ ID NO: 858311 - DNA, 17 bp, Homo sapiens
aggtccaccggcccctg

SEQ ID NO: 858312 - DNA, 19 bp, Homo sapiens
aggtccaccggcccctggc

SEQ ID NO: 858313 - DNA, 15 bp, Homo sapiens
aggtccagacccact

SEQ ID NO: 858314 - DNA, 19 bp, Homo sapiens
aggtccagatccgctccag

SEQ ID NO: 858315 - DNA, 13 bp, Homo sapiens
aggtccagctctg

SEQ ID NO: 858316 - DNA, 15 bp, Homo sapiens
aggtccagctctgga

SEQ ID NO: 858317 - DNA, 23 bp, Homo sapiens
aggtccagctctggaggggaggg

SEQ ID NO: 858318 - DNA, 11 bp, Homo sapiens
aggtccatttt

SEQ ID NO: 858319 - DNA, 19 bp, Homo sapiens
aggtcccacctccagcccg

SEQ ID NO: 858320 - DNA, 14 bp, Homo sapiens
aggtcccagcccca

SEQ ID NO: 858321 - DNA, 20 bp, Homo sapiens
aggtcccagccccaggcctg

SEQ ID NO: 858322 - DNA, 16 bp, Homo sapiens
aggtcccagcgagcca

SEQ ID NO: 858323 - DNA, 11 bp, Homo sapiens
aggtcccaggc

SEQ ID NO: 858324 - DNA, 12 bp, Homo sapiens
aggtcccaggca

SEQ ID NO: 858325 - DNA, 14 bp, Homo sapiens
aggtccccaaactt

SEQ ID NO: 858326 - DNA, 20 bp, Homo sapiens
aggtccccccacagctccag

SEQ ID NO: 858327 - DNA, 19 bp, Homo sapiens
aggtccccccaccgctcag

SEQ ID NO: 858328 - DNA, 23 bp, Homo sapiens
aggtcccccgaccaatccccagc

SEQ ID NO: 858329 - DNA, 15 bp, Homo sapiens
aggtcccccgactgc

SEQ ID NO: 858330 - DNA, 17 bp, Homo sapiens
aggtcccccgactgcct

SEQ ID NO: 858331 - DNA, 22 bp, Homo sapiens
aggtccccggttgctggtcagg

SEQ ID NO: 858332 - DNA, 13 bp, Homo sapiens
aggtccctggggg

SEQ ID NO: 858333 - DNA, 21 bp, Homo sapiens
aggtcccttcccgacccagcc

SEQ ID NO: 858334 - DNA, 23 bp, Homo sapiens
aggtcccttcccgacccagccag

SEQ ID NO: 858335 - DNA, 14 bp, Homo sapiens
aggtcccttgtttc

SEQ ID NO: 858336 - DNA, 21 bp, Homo sapiens
aggtcctcaggtcagctggga

SEQ ID NO: 858337 - DNA, 21 bp, Homo sapiens
aggtcctccgtagggtctttc

SEQ ID NO: 858338 - DNA, 12 bp, Homo sapiens
aggtcctctcag

SEQ ID NO: 858339 - DNA, 20 bp, Homo sapiens
aggtcctgcccatgtgtccc

SEQ ID NO: 858340 - DNA, 13 bp, Homo sapiens
aggtcctgccctc

SEQ ID NO: 858341 - DNA, 14 bp, Homo sapiens
aggtcctgtctctg

SEQ ID NO: 858342 - DNA, 20 bp, Homo sapiens
aggtcctgtctctgcacaga

SEQ ID NO: 858343 - DNA, 16 bp, Homo sapiens
aggtccttctgctgga

SEQ ID NO: 858344 - DNA, 15 bp, Homo sapiens
aggtccttgcctcct

SEQ ID NO: 858345 - DNA, 21 bp, Homo sapiens
aggtccttgcctgaactccag

SEQ ID NO: 858346 - DNA, 23 bp, Homo sapiens
aggtccttgcctgaactccagag

SEQ ID NO: 858347 - DNA, 12 bp, Homo sapiens
aggtccttggtt

SEQ ID NO: 858348 - DNA, 18 bp, Homo sapiens
aggtctaagcaagtgagt

SEQ ID NO: 858349 - DNA, 20 bp, Homo sapiens
aggtctacattcttggttgt

SEQ ID NO: 858350 - DNA, 15 bp, Homo sapiens
aggtctagactttct

SEQ ID NO: 858351 - DNA, 17 bp, Homo sapiens
aggtctagactttctca

SEQ ID NO: 858352 - DNA, 20 bp, Homo sapiens
aggtctagactttctcagtg

SEQ ID NO: 858353 - DNA, 14 bp, Homo sapiens
aggtctcatctctt

SEQ ID NO: 858354 - DNA, 21 bp, Homo sapiens
aggtctcatctcttcaggttc

SEQ ID NO: 858355 - DNA, 18 bp, Homo sapiens
aggtctcatgctgttgct

SEQ ID NO: 858356 - DNA, 12 bp, Homo sapiens
aggtctccaagg

SEQ ID NO: 858357 - DNA, 14 bp, Homo sapiens
aggtctccaaggga

SEQ ID NO: 858358 - DNA, 19 bp, Homo sapiens
aggtctcctcagggtgggg

SEQ ID NO: 858359 - DNA, 11 bp, Homo sapiens
aggtctcctct

SEQ ID NO: 858360 - DNA, 12 bp, Homo sapiens
aggtctcctctt

SEQ ID NO: 858361 - DNA, 15 bp, Homo sapiens
aggtctcctcttaaa

SEQ ID NO: 858362 - DNA, 17 bp, Homo sapiens
aggtctcctcttaaaaa

SEQ ID NO: 858363 - DNA, 19 bp, Homo sapiens
aggtctccttactctgagc

SEQ ID NO: 858364 - DNA, 20 bp, Homo sapiens
aggtctccttactctgagcc

SEQ ID NO: 858365 - DNA, 21 bp, Homo sapiens
aggtctccttactctgagccc

SEQ ID NO: 858366 - DNA, 23 bp, Homo sapiens
aggtctccttactctgagcccag

SEQ ID NO: 858367 - DNA, 19 bp, Homo sapiens
aggtctctgccggctcttt

SEQ ID NO: 858368 - DNA, 18 bp, Homo sapiens
aggtctcttcctttgctc

SEQ ID NO: 858369 - DNA, 18 bp, Homo sapiens
aggtctcttctcccagaa

SEQ ID NO: 858370 - DNA, 22 bp, Homo sapiens
aggtctcttctcccagaatccc

SEQ ID NO: 858371 - DNA, 16 bp, Homo sapiens
aggtctcttgagggag

SEQ ID NO: 858372 - DNA, 12 bp, Homo sapiens
aggtctgagccc

SEQ ID NO: 858373 - DNA, 18 bp, Homo sapiens
aggtctgcaagggcccag

SEQ ID NO: 858374 - DNA, 14 bp, Homo sapiens
aggtctgctcggcc

SEQ ID NO: 858375 - DNA, 23 bp, Homo sapiens
aggtctggagaagctcccaggaa

SEQ ID NO: 858376 - DNA, 13 bp, Homo sapiens
aggtctgtaactg

SEQ ID NO: 858377 - DNA, 19 bp, Homo sapiens
aggtctgtaactgcccagc

SEQ ID NO: 858378 - DNA, 20 bp, Homo sapiens
aggtctgtaactgcccagcc

SEQ ID NO: 858379 - DNA, 21 bp, Homo sapiens
aggtctgtaactgcccagccc

SEQ ID NO: 858380 - DNA, 17 bp, Homo sapiens
aggtctgtatggctgta

SEQ ID NO: 858381 - DNA, 23 bp, Homo sapiens
aggtctgtcataggactctggac

SEQ ID NO: 858382 - DNA, 15 bp, Homo sapiens
aggtctgttctttcc

SEQ ID NO: 858383 - DNA, 16 bp, Homo sapiens
aggtctgttctttcca

SEQ ID NO: 858384 - DNA, 23 bp, Homo sapiens
aggtctgttctttccaaagtaca

SEQ ID NO: 858385 - DNA, 16 bp, Homo sapiens
aggtcttcagccatca

SEQ ID NO: 858386 - DNA, 20 bp, Homo sapiens
aggtcttcatcgaatctact

SEQ ID NO: 858387 - DNA, 18 bp, Homo sapiens
aggtggccgctcctccct

SEQ ID NO: 858388 - DNA, 19 bp, Homo sapiens
aggtggccgctcctccctg

SEQ ID NO: 858389 - DNA, 20 bp, Homo sapiens
aggtggccgctcctccctgc

SEQ ID NO: 858390 - DNA, 16 bp, Homo sapiens
aggtggcctcctggcc

SEQ ID NO: 858391 - DNA, 13 bp, Homo sapiens
aggtggcctttgt

SEQ ID NO: 858392 - DNA, 20 bp, Homo sapiens
aggtggcctttgtgctgcgc

SEQ ID NO: 858393 - DNA, 18 bp, Homo sapiens
aggtggctcagtgccacc

SEQ ID NO: 858394 - DNA, 23 bp, Homo sapiens
aggtggctcagtgccacctatgc

SEQ ID NO: 858395 - DNA, 20 bp, Homo sapiens
aggtggctgacccagtccct

SEQ ID NO: 858396 - DNA, 21 bp, Homo sapiens
aggtggctgacccagtccctg

SEQ ID NO: 858397 - DNA, 22 bp, Homo sapiens
aggtggctgacccagtccctgg

SEQ ID NO: 858398 - DNA, 15 bp, Homo sapiens
aggtggctgagcccc

SEQ ID NO: 858399 - DNA, 17 bp, Homo sapiens
aggtggctgagcccctg

SEQ ID NO: 858400 - DNA, 17 bp, Homo sapiens
aggtggctgcgccccca

SEQ ID NO: 858401 - DNA, 20 bp, Homo sapiens
aggtggctgcgcccccagct

SEQ ID NO: 858402 - DNA, 21 bp, Homo sapiens
aggtggctgcgcccccagctt

SEQ ID NO: 858403 - DNA, 15 bp, Homo sapiens
aggtggcttcatgtg

SEQ ID NO: 858404 - DNA, 16 bp, Homo sapiens
aggtggcttgagctag

SEQ ID NO: 858405 - DNA, 16 bp, Homo sapiens
aggtgggaaacattag

SEQ ID NO: 858406 - DNA, 23 bp, Homo sapiens
aggtgggaaatggtatgagctga

SEQ ID NO: 858407 - DNA, 13 bp, Homo sapiens
aggtgggaggcca

SEQ ID NO: 858408 - DNA, 14 bp, Homo sapiens
aggtgggaggccag

SEQ ID NO: 858409 - DNA, 16 bp, Homo sapiens
aggtgggaggccaggc

SEQ ID NO: 858410 - DNA, 13 bp, Homo sapiens
aggtgggcagctg

SEQ ID NO: 858411 - DNA, 14 bp, Homo sapiens
aggtgggcagctgg

SEQ ID NO: 858412 - DNA, 15 bp, Homo sapiens
aggtgggcagctggg

SEQ ID NO: 858413 - DNA, 15 bp, Homo sapiens
aggttcagccaaggt

SEQ ID NO: 858414 - DNA, 18 bp, Homo sapiens
aggttccacagaggacac

SEQ ID NO: 858415 - DNA, 18 bp, Homo sapiens
aggttccagaacagccct

SEQ ID NO: 858416 - DNA, 19 bp, Homo sapiens
aggttccagaggccctagg

SEQ ID NO: 858417 - DNA, 14 bp, Homo sapiens
aggttcccaagctc

SEQ ID NO: 858418 - DNA, 13 bp, Homo sapiens
aggttccccagag

SEQ ID NO: 858419 - DNA, 15 bp, Homo sapiens
aggttccccagagag

SEQ ID NO: 858420 - DNA, 23 bp, Homo sapiens
aggttccccagagagcaggcagg

SEQ ID NO: 858421 - DNA, 16 bp, Homo sapiens
aggttccctctgagaa

SEQ ID NO: 858422 - DNA, 11 bp, Homo sapiens
aggttccctgt

SEQ ID NO: 858423 - DNA, 18 bp, Homo sapiens
aggttccgcttggagcag

SEQ ID NO: 858424 - DNA, 21 bp, Homo sapiens
aggttccgcttggagcagagg

SEQ ID NO: 858425 - DNA, 23 bp, Homo sapiens
aggttccgtatctccctggagaa

SEQ ID NO: 858426 - DNA, 14 bp, Homo sapiens
aggttcctctgcct

SEQ ID NO: 858427 - DNA, 16 bp, Homo sapiens
aggttcctctgcctgc

SEQ ID NO: 858428 - DNA, 20 bp, Homo sapiens
aggttcctggggccgcctgc

SEQ ID NO: 858429 - DNA, 22 bp, Homo sapiens
aggttcctggggccgcctgccc

SEQ ID NO: 858430 - DNA, 16 bp, Homo sapiens
aggttcctttttcaaa

SEQ ID NO: 858431 - DNA, 16 bp, Homo sapiens
agtataatttcaagga

SEQ ID NO: 858432 - DNA, 21 bp, Homo sapiens
agtatacaacaggagagagat

SEQ ID NO: 858433 - DNA, 15 bp, Homo sapiens
agtatacagacagga

SEQ ID NO: 858434 - DNA, 17 bp, Homo sapiens
agtatacagacaggaag

SEQ ID NO: 858435 - DNA, 15 bp, Homo sapiens
agtatacctgatttt

SEQ ID NO: 858436 - DNA, 22 bp, Homo sapiens
agtatacctggctttttaaaat

SEQ ID NO: 858437 - DNA, 12 bp, Homo sapiens
agtatactgtgt

SEQ ID NO: 858438 - DNA, 16 bp, Homo sapiens
agtatagaaaatcttc

SEQ ID NO: 858439 - DNA, 15 bp, Homo sapiens
agtatagatggccaa

SEQ ID NO: 858440 - DNA, 16 bp, Homo sapiens
agtatagcattgaaca

SEQ ID NO: 858441 - DNA, 13 bp, Homo sapiens
agtatttatatat

SEQ ID NO: 858442 - DNA, 14 bp, Homo sapiens
agtatttatatatt

SEQ ID NO: 858443 - DNA, 15 bp, Homo sapiens
agtatttatatattt

SEQ ID NO: 858444 - DNA, 19 bp, Homo sapiens
agtatttatatatttataa

SEQ ID NO: 858445 - DNA, 23 bp, Homo sapiens
agtatttatgtaatttgtacagg

SEQ ID NO: 858446 - DNA, 14 bp, Homo sapiens
agtatttattgtca

SEQ ID NO: 858447 - DNA, 20 bp, Homo sapiens
agtatttatttaatgttatg

SEQ ID NO: 858448 - DNA, 19 bp, Homo sapiens
agtatttcattgcctgtgt

SEQ ID NO: 858449 - DNA, 13 bp, Homo sapiens
agtatttcccagc

SEQ ID NO: 858450 - DNA, 12 bp, Homo sapiens
agtatttccttc

SEQ ID NO: 858451 - DNA, 18 bp, Homo sapiens
agtatttccttccactgt

SEQ ID NO: 858452 - DNA, 23 bp, Homo sapiens
agtatttgattcaaaatatttaa

SEQ ID NO: 858453 - DNA, 14 bp, Homo sapiens
agtatttgttaatt

SEQ ID NO: 858454 - DNA, 13 bp, Homo sapiens
agtattttaaaaa

SEQ ID NO: 858455 - DNA, 17 bp, Homo sapiens
agtattttggttcttag

SEQ ID NO: 858456 - DNA, 18 bp, Homo sapiens
agtattttggttcttagt

SEQ ID NO: 858457 - DNA, 23 bp, Homo sapiens
agtattttggttcttagttctca

SEQ ID NO: 858458 - DNA, 19 bp, Homo sapiens
agtatttttatacaaacct

SEQ ID NO: 858459 - DNA, 15 bp, Homo sapiens
agtatttttttctta

SEQ ID NO: 858460 - DNA, 16 bp, Homo sapiens
agtatttttttcttac

SEQ ID NO: 858461 - DNA, 14 bp, Homo sapiens
agtcaaaaaattat

SEQ ID NO: 858462 - DNA, 21 bp, Homo sapiens
agtcaaaaaattatttgctat

SEQ ID NO: 858463 - DNA, 14 bp, Homo sapiens
agtcaaaacagaga

SEQ ID NO: 858464 - DNA, 23 bp, Homo sapiens
agtcaaatggtaggcatttccta

SEQ ID NO: 858465 - DNA, 20 bp, Homo sapiens
agtcaacagtaaaccactga

SEQ ID NO: 858466 - DNA, 22 bp, Homo sapiens
agtcaacagtaaaccactgaaa

SEQ ID NO: 858467 - DNA, 15 bp, Homo sapiens
agtcaacctgggcaa

SEQ ID NO: 858468 - DNA, 12 bp, Homo sapiens
agtcaactggct

SEQ ID NO: 858469 - DNA, 18 bp, Homo sapiens
agtcaactggctggccag

SEQ ID NO: 858470 - DNA, 20 bp, Homo sapiens
agtcaactggctggccagtc

SEQ ID NO: 858471 - DNA, 14 bp, Homo sapiens
agtcaagaagaaaa

SEQ ID NO: 858472 - DNA, 22 bp, Homo sapiens
agtcaagaagcaattatttaaa

SEQ ID NO: 858473 - DNA, 15 bp, Homo sapiens
agtcaagctcctcct

SEQ ID NO: 858474 - DNA, 16 bp, Homo sapiens
agtcaagtgaaaaagg

SEQ ID NO: 858475 - DNA, 21 bp, Homo sapiens
agtcaataaaagagctgtctg

SEQ ID NO: 858476 - DNA, 17 bp, Homo sapiens
agtcaatatttttagat

SEQ ID NO: 858477 - DNA, 16 bp, Homo sapiens
agtcaatcagccttta

SEQ ID NO: 858478 - DNA, 15 bp, Homo sapiens
agtcaatgtgcagtg

SEQ ID NO: 858479 - DNA, 18 bp, Homo sapiens
agtcaattaaacagctgg

SEQ ID NO: 858480 - DNA, 19 bp, Homo sapiens
agtcaattaaacagctggt

SEQ ID NO: 858481 - DNA, 12 bp, Homo sapiens
agtcaatttgct

SEQ ID NO: 858482 - DNA, 14 bp, Homo sapiens
agtcaatttgctga

SEQ ID NO: 858483 - DNA, 20 bp, Homo sapiens
agtcaatttgctgaaaacat

SEQ ID NO: 858484 - DNA, 18 bp, Homo sapiens
agtcacaacagagtgaaa

SEQ ID NO: 858485 - DNA, 22 bp, Homo sapiens
agtcacaccatcttaaatgaca

SEQ ID NO: 858486 - DNA, 13 bp, Homo sapiens
agtcacagctgca

SEQ ID NO: 858487 - DNA, 15 bp, Homo sapiens
agtcacagctgcagc

SEQ ID NO: 858488 - DNA, 20 bp, Homo sapiens
agtcacagctgcagctgggc

SEQ ID NO: 858489 - DNA, 16 bp, Homo sapiens
agtcacaggtgtggga

SEQ ID NO: 858490 - DNA, 16 bp, Homo sapiens
agtcacatctcttcct

SEQ ID NO: 858491 - DNA, 19 bp, Homo sapiens
agtcacattgccatcactc

SEQ ID NO: 858492 - DNA, 20 bp, Homo sapiens
agtcaccaaatagtgtgaaa

SEQ ID NO: 858493 - DNA, 17 bp, Homo sapiens
agtcaccacccagccct

SEQ ID NO: 858494 - DNA, 13 bp, Homo sapiens
agtcaccaggaat

SEQ ID NO: 858495 - DNA, 19 bp, Homo sapiens
agtcaccaggaatgttaaa

SEQ ID NO: 858496 - DNA, 17 bp, Homo sapiens
agtcaccaggacttggg

SEQ ID NO: 858497 - DNA, 14 bp, Homo sapiens
agtcacccaaacac

SEQ ID NO: 858498 - DNA, 16 bp, Homo sapiens
agtcacccaaacactt

SEQ ID NO: 858499 - DNA, 23 bp, Homo sapiens
agtcacccaaacacttctgcttt

SEQ ID NO: 858500 - DNA, 15 bp, Homo sapiens
agtcacccagagcac

SEQ ID NO: 858501 - DNA, 16 bp, Homo sapiens
agtcacccatgaagac

SEQ ID NO: 858502 - DNA, 21 bp, Homo sapiens
agtcacccctccctccctctt

SEQ ID NO: 858503 - DNA, 20 bp, Homo sapiens
agtcaccctacctgtgcctg

SEQ ID NO: 858504 - DNA, 24 bp, Homo sapiens
agtcacccttccaccattgtccta

SEQ ID NO: 858505 - DNA, 14 bp, Homo sapiens
agtcacccttctgg

SEQ ID NO: 858506 - DNA, 20 bp, Homo sapiens
agtcacctcctccactcact

SEQ ID NO: 858507 - DNA, 18 bp, Homo sapiens
agtcacctcgtctccctg

SEQ ID NO: 858508 - DNA, 17 bp, Homo sapiens
agtcacctgcaagcccc

SEQ ID NO: 858509 - DNA, 14 bp, Homo sapiens
agtcacctgctcca

SEQ ID NO: 858510 - DNA, 16 bp, Homo sapiens
agtcacctgctccaga

SEQ ID NO: 858511 - DNA, 16 bp, Homo sapiens
agtcaccttcccttgc

SEQ ID NO: 858512 - DNA, 17 bp, Homo sapiens
agtcaccttctgggcaa

SEQ ID NO: 858513 - DNA, 22 bp, Homo sapiens
agtcaccttctgggcaagggct

SEQ ID NO: 858514 - DNA, 19 bp, Homo sapiens
agtcaccttttctgtggct

SEQ ID NO: 858515 - DNA, 22 bp, Homo sapiens
agtcactatgggatgagaaaat

SEQ ID NO: 858516 - DNA, 15 bp, Homo sapiens
agtcactcctctcta

SEQ ID NO: 858517 - DNA, 21 bp, Homo sapiens
agtcactcctctctagggcag

SEQ ID NO: 858518 - DNA, 22 bp, Homo sapiens
agtcactcctctctagggcaga

SEQ ID NO: 858519 - DNA, 13 bp, Homo sapiens
agtcactgagacc

SEQ ID NO: 858520 - DNA, 11 bp, Homo sapiens
agtcactgcct

SEQ ID NO: 858521 - DNA, 12 bp, Homo sapiens
agtcactgctct

SEQ ID NO: 858522 - DNA, 21 bp, Homo sapiens
agtcactggaggttgaagcca

SEQ ID NO: 858523 - DNA, 22 bp, Homo sapiens
agtcactggaggttgaagccaa

SEQ ID NO: 858524 - DNA, 11 bp, Homo sapiens
agtcactgtga

SEQ ID NO: 858525 - DNA, 14 bp, Homo sapiens
agtcacttaactat

SEQ ID NO: 858526 - DNA, 15 bp, Homo sapiens
agtcacttaatcttt

SEQ ID NO: 858527 - DNA, 20 bp, Homo sapiens
agtcacttgggagctgctgg

SEQ ID NO: 858528 - DNA, 22 bp, Homo sapiens
agtcacttgggagctgctgggc

SEQ ID NO: 858529 - DNA, 12 bp, Homo sapiens
agtcagaaaaca

SEQ ID NO: 858530 - DNA, 12 bp, Homo sapiens
agtcagaacagc

SEQ ID NO: 858531 - DNA, 21 bp, Homo sapiens
agtcagaatgtgaaaaaggaa

SEQ ID NO: 858532 - DNA, 13 bp, Homo sapiens
agtcagagacaga

SEQ ID NO: 858533 - DNA, 17 bp, Homo sapiens
agtcagagacagatacc

SEQ ID NO: 858534 - DNA, 17 bp, Homo sapiens
agtcagagagagtgttt

SEQ ID NO: 858535 - DNA, 23 bp, Homo sapiens
agtcagagcccctacagcattgt

SEQ ID NO: 858536 - DNA, 15 bp, Homo sapiens
agtcagaggagaaga

SEQ ID NO: 858537 - DNA, 20 bp, Homo sapiens
agtcagaggagaagagacat

SEQ ID NO: 858538 - DNA, 14 bp, Homo sapiens
agtcagatgaggca

SEQ ID NO: 858539 - DNA, 20 bp, Homo sapiens
agtcagatgaggcaaacagc

SEQ ID NO: 858540 - DNA, 22 bp, Homo sapiens
agtcagatggaaaattcatttt

SEQ ID NO: 858541 - DNA, 21 bp, Homo sapiens
agtcagatggtagacgagctg

SEQ ID NO: 858542 - DNA, 22 bp, Homo sapiens
agtcagcaccttggcccaggag

SEQ ID NO: 858543 - DNA, 19 bp, Homo sapiens
agtcagcccgaatgcctgt

SEQ ID NO: 858544 - DNA, 22 bp, Homo sapiens
agtcagccttccccctcccagg

SEQ ID NO: 858545 - DNA, 18 bp, Homo sapiens
agtcagctctctgccctg

SEQ ID NO: 858546 - DNA, 23 bp, Homo sapiens
agtcaggagttttactgcctgta

SEQ ID NO: 858547 - DNA, 21 bp, Homo sapiens
agtcaggcctgggcaggaccc

SEQ ID NO: 858548 - DNA, 15 bp, Homo sapiens
agtcagggcacagct

SEQ ID NO: 858549 - DNA, 14 bp, Homo sapiens
agtcaggggctctg

SEQ ID NO: 858550 - DNA, 21 bp, Homo sapiens
agtcaggggtcaggtgtcagg

SEQ ID NO: 858551 - DNA, 17 bp, Homo sapiens
agtcagggtgaattgtg

SEQ ID NO: 858552 - DNA, 22 bp, Homo sapiens
agtcagggtgggaagaaagaat

SEQ ID NO: 858553 - DNA, 21 bp, Homo sapiens
agtcaggttcaggagttagtg

SEQ ID NO: 858554 - DNA, 19 bp, Homo sapiens
agtcagtaggtccaagggc

SEQ ID NO: 858555 - DNA, 18 bp, Homo sapiens
agtggatctccaaggacc

SEQ ID NO: 858556 - DNA, 23 bp, Homo sapiens
agtggatctccaaggaccaggtt

SEQ ID NO: 858557 - DNA, 16 bp, Homo sapiens
agtggatctgcttctc

SEQ ID NO: 858558 - DNA, 15 bp, Homo sapiens
agtggatctgtagaa

SEQ ID NO: 858559 - DNA, 20 bp, Homo sapiens
agtggatgatgtttcgtgaa

SEQ ID NO: 858560 - DNA, 22 bp, Homo sapiens
agtggatggcccagcaggcagg

SEQ ID NO: 858561 - DNA, 23 bp, Homo sapiens
agtggatggcccagcaggcaggc

SEQ ID NO: 858562 - DNA, 12 bp, Homo sapiens
agtggatgggaa

SEQ ID NO: 858563 - DNA, 18 bp, Homo sapiens
agtggatgggaatttgtc

SEQ ID NO: 858564 - DNA, 17 bp, Homo sapiens
agtggattggctttgtg

SEQ ID NO: 858565 - DNA, 15 bp, Homo sapiens
agtggcagccatgcc

SEQ ID NO: 858566 - DNA, 16 bp, Homo sapiens
agtggcaggtgggctg

SEQ ID NO: 858567 - DNA, 20 bp, Homo sapiens
agtggcaggtgggctgcctg

SEQ ID NO: 858568 - DNA, 21 bp, Homo sapiens
agtggcaggtgggctgcctgc

SEQ ID NO: 858569 - DNA, 13 bp, Homo sapiens
agtggcagttctt

SEQ ID NO: 858570 - DNA, 15 bp, Homo sapiens
agtggcatggctcca

SEQ ID NO: 858571 - DNA, 14 bp, Homo sapiens
agtggccaagcctg

SEQ ID NO: 858572 - DNA, 20 bp, Homo sapiens
agtggccactaagcagagga

SEQ ID NO: 858573 - DNA, 14 bp, Homo sapiens
agtggccagcgcca

SEQ ID NO: 858574 - DNA, 15 bp, Homo sapiens
agtggccagcgccag

SEQ ID NO: 858575 - DNA, 19 bp, Homo sapiens
agtggccagcgccagggcc

SEQ ID NO: 858576 - DNA, 22 bp, Homo sapiens
agtggccatttggggttgggac

SEQ ID NO: 858577 - DNA, 21 bp, Homo sapiens
agtggcccctcacctgggcct

SEQ ID NO: 858578 - DNA, 22 bp, Homo sapiens
agtggcccctcacctgggcctt

SEQ ID NO: 858579 - DNA, 15 bp, Homo sapiens
agtggccctccctca

SEQ ID NO: 858580 - DNA, 18 bp, Homo sapiens
agtggcctacaaatcagt

SEQ ID NO: 858581 - DNA, 22 bp, Homo sapiens
agtggcctacaaatcagtaatt

SEQ ID NO: 858582 - DNA, 14 bp, Homo sapiens
agtggcctagagca

SEQ ID NO: 858583 - DNA, 15 bp, Homo sapiens
agtggcctcaaccct

SEQ ID NO: 858584 - DNA, 22 bp, Homo sapiens
agtggcctcaaccctccctcag

SEQ ID NO: 858585 - DNA, 13 bp, Homo sapiens
agtggcctggcca

SEQ ID NO: 858586 - DNA, 20 bp, Homo sapiens
agtggcctggccaggagctc

SEQ ID NO: 858587 - DNA, 19 bp, Homo sapiens
agtggccttccccagcatg

SEQ ID NO: 858588 - DNA, 14 bp, Homo sapiens
agtggcgtggcctc

SEQ ID NO: 858589 - DNA, 18 bp, Homo sapiens
agtggcgtggcctcccca

SEQ ID NO: 858590 - DNA, 19 bp, Homo sapiens
agtggcgtggcctccccat

SEQ ID NO: 858591 - DNA, 15 bp, Homo sapiens
agtggcgttgttgca

SEQ ID NO: 858592 - DNA, 16 bp, Homo sapiens
agtggctcacacctgt

SEQ ID NO: 858593 - DNA, 15 bp, Homo sapiens
agtggctcactggct

SEQ ID NO: 858594 - DNA, 18 bp, Homo sapiens
agtggctcactggctggg

SEQ ID NO: 858595 - DNA, 17 bp, Homo sapiens
agtggctccccacctgg

SEQ ID NO: 858596 - DNA, 16 bp, Homo sapiens
agtggctcgctccctg

SEQ ID NO: 858597 - DNA, 20 bp, Homo sapiens
agtggctctcagagcagcag

SEQ ID NO: 858598 - DNA, 18 bp, Homo sapiens
agtggctgacaagggact

SEQ ID NO: 858599 - DNA, 18 bp, Homo sapiens
agtggctgccacacccag

SEQ ID NO: 858600 - DNA, 20 bp, Homo sapiens
agtggctgccacacccaggg

SEQ ID NO: 858601 - DNA, 23 bp, Homo sapiens
agtggctgcctcatatagcactt

SEQ ID NO: 858602 - DNA, 14 bp, Homo sapiens
agtggctgctgact

SEQ ID NO: 858603 - DNA, 13 bp, Homo sapiens
agtggctggtgcc

SEQ ID NO: 858604 - DNA, 16 bp, Homo sapiens
agtggctgtccctgtg

SEQ ID NO: 858605 - DNA, 14 bp, Homo sapiens
agtggctgttcatg

SEQ ID NO: 858606 - DNA, 15 bp, Homo sapiens
agtggcttcccagct

SEQ ID NO: 858607 - DNA, 14 bp, Homo sapiens
agtggcttctttcc

SEQ ID NO: 858608 - DNA, 12 bp, Homo sapiens
agtggcttttca

SEQ ID NO: 858609 - DNA, 20 bp, Homo sapiens
agtgggaacgtgactgcccc

SEQ ID NO: 858610 - DNA, 14 bp, Homo sapiens
agtgggaactgtgc

SEQ ID NO: 858611 - DNA, 12 bp, Homo sapiens
agtgggaagccc

SEQ ID NO: 858612 - DNA, 15 bp, Homo sapiens
agtgggacaaaccag

SEQ ID NO: 858613 - DNA, 21 bp, Homo sapiens
agtgggacaaaccagagcaga

SEQ ID NO: 858614 - DNA, 15 bp, Homo sapiens
agtgggacccataga

SEQ ID NO: 858615 - DNA, 21 bp, Homo sapiens
agtgggacccatagatcttct

SEQ ID NO: 858616 - DNA, 18 bp, Homo sapiens
agtgggacttggagagca

SEQ ID NO: 858617 - DNA, 24 bp, Homo sapiens
agtgggacttggagagcaaaggcc

SEQ ID NO: 858618 - DNA, 14 bp, Homo sapiens
agtgggagaaaaca

SEQ ID NO: 858619 - DNA, 14 bp, Homo sapiens
agtgggagaaggca

SEQ ID NO: 858620 - DNA, 13 bp, Homo sapiens
agtgggagcagct

SEQ ID NO: 858621 - DNA, 14 bp, Homo sapiens
agtgggagcagctt

SEQ ID NO: 858622 - DNA, 13 bp, Homo sapiens
agtgggagccctg

SEQ ID NO: 858623 - DNA, 18 bp, Homo sapiens
agtgggaggcgtgccccc

SEQ ID NO: 858624 - DNA, 11 bp, Homo sapiens
agtgggagggg

SEQ ID NO: 858625 - DNA, 12 bp, Homo sapiens
agtgggaggggc

SEQ ID NO: 858626 - DNA, 15 bp, Homo sapiens
agtgggaggggcagg

SEQ ID NO: 858627 - DNA, 18 bp, Homo sapiens
agtgggaggggcaggctg

SEQ ID NO: 858628 - DNA, 16 bp, Homo sapiens
agtgggatgggctcta

SEQ ID NO: 858629 - DNA, 19 bp, Homo sapiens
agtgggatgggctctacct

SEQ ID NO: 858630 - DNA, 20 bp, Homo sapiens
agtgggatgggctctacctc

SEQ ID NO: 858631 - DNA, 14 bp, Homo sapiens
agtgggcacctcag

SEQ ID NO: 858632 - DNA, 13 bp, Homo sapiens
agtgggcaggggt

SEQ ID NO: 858633 - DNA, 17 bp, Homo sapiens
agtgggcagtcaccacc

SEQ ID NO: 858634 - DNA, 20 bp, Homo sapiens
agtgggccaggacaggcccg

SEQ ID NO: 858635 - DNA, 14 bp, Homo sapiens
agtgggcctgctga

SEQ ID NO: 858636 - DNA, 12 bp, Homo sapiens
agtgggcgcagt

SEQ ID NO: 858637 - DNA, 18 bp, Homo sapiens
agtgggcgttgggagcct

SEQ ID NO: 858638 - DNA, 11 bp, Homo sapiens
agtgggctgca

SEQ ID NO: 858639 - DNA, 12 bp, Homo sapiens
agtgggctgcac

SEQ ID NO: 858640 - DNA, 17 bp, Homo sapiens
agtgggctgcagcagcc

SEQ ID NO: 858641 - DNA, 17 bp, Homo sapiens
agtgggctgcatctggg

SEQ ID NO: 858642 - DNA, 14 bp, Homo sapiens
agtgggctggtatt

SEQ ID NO: 858643 - DNA, 11 bp, Homo sapiens
agtggggacag

SEQ ID NO: 858644 - DNA, 14 bp, Homo sapiens
agtggggacagatt

SEQ ID NO: 858645 - DNA, 15 bp, Homo sapiens
agtggggacagattc

SEQ ID NO: 858646 - DNA, 23 bp, Homo sapiens
agtggggagcagttttcccctgg

SEQ ID NO: 858647 - DNA, 21 bp, Homo sapiens
agtggggccagggtgggaggg

SEQ ID NO: 858648 - DNA, 14 bp, Homo sapiens
agtggggcctgtgg

SEQ ID NO: 858649 - DNA, 18 bp, Homo sapiens
agtggggctaaatgaagt

SEQ ID NO: 858650 - DNA, 15 bp, Homo sapiens
agtggggctcgccat

SEQ ID NO: 858651 - DNA, 19 bp, Homo sapiens
agtgggggagagcaggctg

SEQ ID NO: 858652 - DNA, 15 bp, Homo sapiens
agtggggggacagag

SEQ ID NO: 858653 - DNA, 14 bp, Homo sapiens
agtggggggaggaa

SEQ ID NO: 858654 - DNA, 19 bp, Homo sapiens
agtggggtagactgaggga

SEQ ID NO: 858655 - DNA, 16 bp, Homo sapiens
agtggggtgaacagct

SEQ ID NO: 858656 - DNA, 17 bp, Homo sapiens
agtggggtgaacagctg

SEQ ID NO: 858657 - DNA, 19 bp, Homo sapiens
agtggggttgcaaccactg

SEQ ID NO: 858658 - DNA, 13 bp, Homo sapiens
agtgggtgaataa

SEQ ID NO: 858659 - DNA, 16 bp, Homo sapiens
agtgggtgacaagagc

SEQ ID NO: 858660 - DNA, 23 bp, Homo sapiens
agtgggtgatgcttttgctgctg

SEQ ID NO: 858661 - DNA, 22 bp, Homo sapiens
agtgggttttattgtccttcag

SEQ ID NO: 858662 - DNA, 15 bp, Homo sapiens
agtggtaaatactgt

SEQ ID NO: 858663 - DNA, 16 bp, Homo sapiens
agtggtagctctggct

SEQ ID NO: 858664 - DNA, 16 bp, Homo sapiens
agtggtatagaaatgc

SEQ ID NO: 858665 - DNA, 22 bp, Homo sapiens
agtggtcaaaccgcactcaccc

SEQ ID NO: 858666 - DNA, 20 bp, Homo sapiens
agtggtcactggtcagggca

SEQ ID NO: 858667 - DNA, 23 bp, Homo sapiens
agtggtcaggagttgtttctgac

SEQ ID NO: 858668 - DNA, 19 bp, Homo sapiens
agtggtctcacctggaggc

SEQ ID NO: 858669 - DNA, 16 bp, Homo sapiens
agtggtctctgctggg

SEQ ID NO: 858670 - DNA, 20 bp, Homo sapiens
agtggtctctgctggggaag

SEQ ID NO: 858671 - DNA, 22 bp, Homo sapiens
agtggtctctgctggggaaggg

SEQ ID NO: 858672 - DNA, 16 bp, Homo sapiens
agtggtctggaaacag

SEQ ID NO: 858673 - DNA, 13 bp, Homo sapiens
agtggtgagtgga

SEQ ID NO: 858674 - DNA, 16 bp, Homo sapiens
agtggtgagtggaagg

SEQ ID NO: 858675 - DNA, 16 bp, Homo sapiens
agtggtgggcggggag

SEQ ID NO: 858676 - DNA, 18 bp, Homo sapiens
agtggtggtaaccctggt

SEQ ID NO: 858677 - DNA, 19 bp, Homo sapiens
agtggtggtatgtaatgga

SEQ ID NO: 858678 - DNA, 15 bp, Homo sapiens
agtggtgtgatctca

SEQ ID NO: 858679 - DNA, 15 bp, Homo sapiens
agtggttactttgtg

SEQ ID NO: 858680 - DNA, 16 bp, Homo sapiens
agtggttactttgtgt

SEQ ID NO: 858681 - DNA, 13 bp, Homo sapiens
agtggttctcatt

SEQ ID NO: 858682 - DNA, 19 bp, Homo sapiens
agtggttgttagttataga

SEQ ID NO: 858683 - DNA, 23 bp, Homo sapiens
agtggtttaggctatttgtaaat

SEQ ID NO: 858684 - DNA, 19 bp, Homo sapiens
agtggtttctacttcccct

SEQ ID NO: 858685 - DNA, 23 bp, Homo sapiens
agtggtttctacttcccctggga

SEQ ID NO: 858686 - DNA, 18 bp, Homo sapiens
agtggttttatactgaag

SEQ ID NO: 858687 - DNA, 20 bp, Homo sapiens
agtggttttatactgaagga

SEQ ID NO: 858688 - DNA, 21 bp, Homo sapiens
agtggttttatactgaaggaa

SEQ ID NO: 858689 - DNA, 21 bp, Homo sapiens
agtgtaaaatattttgaatca

SEQ ID NO: 858690 - DNA, 15 bp, Homo sapiens
agtgtaaaatgtata

SEQ ID NO: 858691 - DNA, 19 bp, Homo sapiens
agtgtaaaatgtatatttt

SEQ ID NO: 858692 - DNA, 22 bp, Homo sapiens
agtgtaaatagaagagtttaaa

SEQ ID NO: 858693 - DNA, 13 bp, Homo sapiens
agtgtaaatgaag

SEQ ID NO: 858694 - DNA, 13 bp, Homo sapiens
agtgtaacctcag

SEQ ID NO: 858695 - DNA, 14 bp, Homo sapiens
agtgtaacctcagt

SEQ ID NO: 858696 - DNA, 23 bp, Homo sapiens
agtgtaacctcagtatttatgta

SEQ ID NO: 858697 - DNA, 16 bp, Homo sapiens
agtgtaacttgcttaa

SEQ ID NO: 858698 - DNA, 13 bp, Homo sapiens
agtgtaagtgtga

SEQ ID NO: 858699 - DNA, 16 bp, Homo sapiens
agtgtacaaaactgta

SEQ ID NO: 858700 - DNA, 17 bp, Homo sapiens
agtgtacacgtctggac

SEQ ID NO: 858701 - DNA, 16 bp, Homo sapiens
agtgtacagattttat

SEQ ID NO: 858702 - DNA, 17 bp, Homo sapiens
agtgtacagtcttgtat

SEQ ID NO: 858703 - DNA, 17 bp, Homo sapiens
agtgtacatcatgttat

SEQ ID NO: 858704 - DNA, 22 bp, Homo sapiens
agtgtacatggaataacatgta

SEQ ID NO: 858705 - DNA, 13 bp, Homo sapiens
agtgtacctgtgt

SEQ ID NO: 858706 - DNA, 17 bp, Homo sapiens
agtgtactgtgcctggt

SEQ ID NO: 858707 - DNA, 15 bp, Homo sapiens
agtgtagaacctaat

SEQ ID NO: 858708 - DNA, 14 bp, Homo sapiens
agtgtagaagaaaa

SEQ ID NO: 858709 - DNA, 18 bp, Homo sapiens
agtgtagcccacacttga

SEQ ID NO: 858710 - DNA, 12 bp, Homo sapiens
agtgtagcctaa

SEQ ID NO: 858711 - DNA, 18 bp, Homo sapiens
agtgtagcctaaagggca

SEQ ID NO: 858712 - DNA, 20 bp, Homo sapiens
agtgtagcctaaagggcagg

SEQ ID NO: 858713 - DNA, 13 bp, Homo sapiens
agtgtagccttgc

SEQ ID NO: 858714 - DNA, 15 bp, Homo sapiens
agtgtagcgggagga

SEQ ID NO: 858715 - DNA, 19 bp, Homo sapiens
agtgtagctgccacattga

SEQ ID NO: 858716 - DNA, 23 bp, Homo sapiens
agtgtagctgtaagggcagtgcc

SEQ ID NO: 858717 - DNA, 14 bp, Homo sapiens
agtgtagctgtgaa

SEQ ID NO: 858718 - DNA, 13 bp, Homo sapiens
agtgtaggcagac

SEQ ID NO: 858719 - DNA, 14 bp, Homo sapiens
agtgtaggcagaca

SEQ ID NO: 858720 - DNA, 15 bp, Homo sapiens
agtgtaggcagacac

SEQ ID NO: 858721 - DNA, 18 bp, Homo sapiens
agtgtaggcagacacagg

SEQ ID NO: 858722 - DNA, 23 bp, Homo sapiens
agtgtaggcagacacagggactt

SEQ ID NO: 858723 - DNA, 21 bp, Homo sapiens
agtgtataaatccaatatcat

SEQ ID NO: 858724 - DNA, 22 bp, Homo sapiens
agtgtatacatgtgtgggtgct

SEQ ID NO: 858725 - DNA, 17 bp, Homo sapiens
agtgtataccacctgta

SEQ ID NO: 858726 - DNA, 20 bp, Homo sapiens
agtgtataccacctgtacat

SEQ ID NO: 858727 - DNA, 13 bp, Homo sapiens
agtgtatatatat

SEQ ID NO: 858728 - DNA, 14 bp, Homo sapiens
agtgtatatcagaa

SEQ ID NO: 858729 - DNA, 14 bp, Homo sapiens
agtgtatctccttt

SEQ ID NO: 858730 - DNA, 19 bp, Homo sapiens
agtgtatgagagggccctg

SEQ ID NO: 858731 - DNA, 18 bp, Homo sapiens
agtgtatgagtgtgagtg

SEQ ID NO: 858732 - DNA, 16 bp, Homo sapiens
agtgtatggaaataaa

SEQ ID NO: 858733 - DNA, 21 bp, Homo sapiens
agtgtatggaaataaatgtat

SEQ ID NO: 858734 - DNA, 22 bp, Homo sapiens
agtgtatggaaataaatgtatc

SEQ ID NO: 858735 - DNA, 15 bp, Homo sapiens
agtgtattaatcata

SEQ ID NO: 858736 - DNA, 17 bp, Homo sapiens
agtgtattaatcataga

SEQ ID NO: 858737 - DNA, 17 bp, Homo sapiens
agtgtattaggaagtgt

SEQ ID NO: 858738 - DNA, 17 bp, Homo sapiens
agtgtatttttttacta

SEQ ID NO: 858739 - DNA, 18 bp, Homo sapiens
agtgtatttttttactaa

SEQ ID NO: 858740 - DNA, 22 bp, Homo sapiens
agtgtcaagttgtgcttgttta

SEQ ID NO: 858741 - DNA, 15 bp, Homo sapiens
agtgtcagcgggtga

SEQ ID NO: 858742 - DNA, 19 bp, Homo sapiens
agtgtcagggtccaggaga

SEQ ID NO: 858743 - DNA, 16 bp, Homo sapiens
agtgtcatcagaagat

SEQ ID NO: 858744 - DNA, 20 bp, Homo sapiens
agtgtcatcagaagataact

SEQ ID NO: 858745 - DNA, 23 bp, Homo sapiens
agtgtcattttattttttccctc

SEQ ID NO: 858746 - DNA, 15 bp, Homo sapiens
agtgtcccaggcagc

SEQ ID NO: 858747 - DNA, 15 bp, Homo sapiens
agtgtcccagggccc

SEQ ID NO: 858748 - DNA, 19 bp, Homo sapiens
agtgtcccagggccctgga

SEQ ID NO: 858749 - DNA, 23 bp, Homo sapiens
agtgtccccccttgaagcaataa

SEQ ID NO: 858750 - DNA, 13 bp, Homo sapiens
agtgtcccctcca

SEQ ID NO: 858751 - DNA, 17 bp, Homo sapiens
agtgtcccctccactgt

SEQ ID NO: 858752 - DNA, 14 bp, Homo sapiens
agtgtcctgcccac

SEQ ID NO: 858753 - DNA, 15 bp, Homo sapiens
agtgtcctgcccatg

SEQ ID NO: 858754 - DNA, 16 bp, Homo sapiens
agtgtcctgcccatgc

SEQ ID NO: 858755 - DNA, 18 bp, Homo sapiens
agtgtcctgtgctttctg

SEQ ID NO: 858756 - DNA, 22 bp, Homo sapiens
agtgtcctgtgctttctgcatg

SEQ ID NO: 858757 - DNA, 14 bp, Homo sapiens
agtgtccttagaac

SEQ ID NO: 858758 - DNA, 14 bp, Homo sapiens
agtgtccttagtgt

SEQ ID NO: 858759 - DNA, 16 bp, Homo sapiens
agtgtccttagtgtat

SEQ ID NO: 858760 - DNA, 18 bp, Homo sapiens
agtgtccttagtgtataa

SEQ ID NO: 858761 - DNA, 17 bp, Homo sapiens
agtgtccttcttgctcc

SEQ ID NO: 858762 - DNA, 16 bp, Homo sapiens
agtgtctacatgtgcc

SEQ ID NO: 858763 - DNA, 19 bp, Homo sapiens
agtgtctagagtcatgtga

SEQ ID NO: 858764 - DNA, 17 bp, Homo sapiens
agtgtctataaaagaaa

SEQ ID NO: 858765 - DNA, 10 bp, Homo sapiens
agtgtctctg

SEQ ID NO: 858766 - DNA, 18 bp, Homo sapiens
agtgtctggatcagtaaa

SEQ ID NO: 858767 - DNA, 13 bp, Homo sapiens
agtgtctgtccat

SEQ ID NO: 858768 - DNA, 18 bp, Homo sapiens
agtgtctgtccatctgtc

SEQ ID NO: 858769 - DNA, 18 bp, Homo sapiens
agtgtctgtgagaggcag

SEQ ID NO: 858770 - DNA, 16 bp, Homo sapiens
agtgtctgtgccatgg

SEQ ID NO: 858771 - DNA, 13 bp, Homo sapiens
agtgtctgtgtgc

SEQ ID NO: 858772 - DNA, 16 bp, Homo sapiens
agtgtctgtgttttga

SEQ ID NO: 858773 - DNA, 13 bp, Homo sapiens
agtgtcttccata

SEQ ID NO: 858774 - DNA, 19 bp, Homo sapiens
agtgtcttctgttcccaag

SEQ ID NO: 858775 - DNA, 13 bp, Homo sapiens
agtgtctttccac

SEQ ID NO: 858776 - DNA, 21 bp, Homo sapiens
agtgtctttctggtgttttat

SEQ ID NO: 858777 - DNA, 16 bp, Homo sapiens
agtgtcttttgacatt

SEQ ID NO: 858778 - DNA, 15 bp, Homo sapiens
agtgtctttttttgt

SEQ ID NO: 858779 - DNA, 17 bp, Homo sapiens
agtgtctttttttgtat

SEQ ID NO: 858780 - DNA, 20 bp, Homo sapiens
agtgtctttttttgtatagt

SEQ ID NO: 858781 - DNA, 22 bp, Homo sapiens
agtgtctttttttgtatagtta

SEQ ID NO: 858782 - DNA, 15 bp, Homo sapiens
agtgtgaaatagaca

SEQ ID NO: 858783 - DNA, 16 bp, Homo sapiens
agtgtgaaatatatta

SEQ ID NO: 858784 - DNA, 15 bp, Homo sapiens
agtgtgaagctttgc

SEQ ID NO: 858785 - DNA, 17 bp, Homo sapiens
agtgtgaatagcctggc

SEQ ID NO: 858786 - DNA, 18 bp, Homo sapiens
agtgtgaatagcctggcc

SEQ ID NO: 858787 - DNA, 17 bp, Homo sapiens
agtgtgagaacttccaa

SEQ ID NO: 858788 - DNA, 16 bp, Homo sapiens
agtgtgagcagtgagt

SEQ ID NO: 858789 - DNA, 22 bp, Homo sapiens
agtgtgagcatcttgccagcct

SEQ ID NO: 858790 - DNA, 21 bp, Homo sapiens
agtgtgaggacctccctgtct

SEQ ID NO: 858791 - DNA, 19 bp, Homo sapiens
agtgtgagtaagagctggt

SEQ ID NO: 858792 - DNA, 15 bp, Homo sapiens
agtgtgagtggcagc

SEQ ID NO: 858793 - DNA, 20 bp, Homo sapiens
agtgtgagtggcagccatgc

SEQ ID NO: 858794 - DNA, 18 bp, Homo sapiens
agtgtgatgtatgtgtaa

SEQ ID NO: 858795 - DNA, 22 bp, Homo sapiens
agtgtgatgtatgtgtaataaa

SEQ ID NO: 858796 - DNA, 19 bp, Homo sapiens
agtgtgatttgaattctgt

SEQ ID NO: 858797 - DNA, 17 bp, Homo sapiens
agtgtgcacgcctgcag

SEQ ID NO: 858798 - DNA, 17 bp, Homo sapiens
agtgtgcactaaggggc

SEQ ID NO: 858799 - DNA, 15 bp, Homo sapiens
agtgtgcagactgat

SEQ ID NO: 858800 - DNA, 19 bp, Homo sapiens
agtgtgcatggaggccctc

SEQ ID NO: 858801 - DNA, 19 bp, Homo sapiens
agtgtgctctttttttaaa

SEQ ID NO: 858802 - DNA, 13 bp, Homo sapiens
agtgtgctgctat

SEQ ID NO: 858803 - DNA, 21 bp, Homo sapiens
agtgtgctgtatggcccaggc

SEQ ID NO: 858804 - DNA, 22 bp, Homo sapiens
agtgtgcttctgttatcaaaca

SEQ ID NO: 858805 - DNA, 17 bp, Homo sapiens
agtgtggaaattaagaa

SEQ ID NO: 858806 - DNA, 21 bp, Homo sapiens
agtgtggagaccctgccacag

SEQ ID NO: 858807 - DNA, 21 bp, Homo sapiens
agtgtggagaggggtgcaccc

SEQ ID NO: 858808 - DNA, 12 bp, Homo sapiens
agtgtggagtgg

SEQ ID NO: 858809 - DNA, 22 bp, Homo sapiens
agtgtggagtgggtaatccagg

SEQ ID NO: 858810 - DNA, 21 bp, Homo sapiens
agtgtggctcccctctattta

SEQ ID NO: 858811 - DNA, 13 bp, Homo sapiens
agtgtggctggtg

SEQ ID NO: 858812 - DNA, 14 bp, Homo sapiens
agtgtggctggtgt

SEQ ID NO: 858813 - DNA, 18 bp, Homo sapiens
agtgtggctggtgtcccc

SEQ ID NO: 858814 - DNA, 17 bp, Homo sapiens
agtgtgggaagggagag

SEQ ID NO: 858815 - DNA, 16 bp, Homo sapiens
agtgtgggcttgacca

SEQ ID NO: 858816 - DNA, 21 bp, Homo sapiens
agtgtggtagggacttaaaaa

SEQ ID NO: 858817 - DNA, 16 bp, Homo sapiens
agtgtggtgtcttgcg

SEQ ID NO: 858818 - DNA, 22 bp, Homo sapiens
agtgtggttatgaactttatag

SEQ ID NO: 858819 - DNA, 20 bp, Homo sapiens
agtgtggttttgtaatttaa

SEQ ID NO: 858820 - DNA, 22 bp, Homo sapiens
agtgtgtaaataatttgcactg

SEQ ID NO: 858821 - DNA, 23 bp, Homo sapiens
agtgtgtaaataatttgcactga

SEQ ID NO: 858822 - DNA, 19 bp, Homo sapiens
agtgtgtatgtgcgtgtgt

SEQ ID NO: 858823 - DNA, 19 bp, Homo sapiens
agtgtgtattaaaaaaaac

SEQ ID NO: 858824 - DNA, 22 bp, Homo sapiens
agtgtgtattaaaaaaaacaaa

SEQ ID NO: 858825 - DNA, 19 bp, Homo sapiens
agttacagaaatgattact

SEQ ID NO: 858826 - DNA, 20 bp, Homo sapiens
agttacagcctgttagtaac

SEQ ID NO: 858827 - DNA, 22 bp, Homo sapiens
agttacagcgagaggcagagaa

SEQ ID NO: 858828 - DNA, 20 bp, Homo sapiens
agttcatattccatatttat

SEQ ID NO: 858829 - DNA, 13 bp, Homo sapiens
agttcatgagaat

SEQ ID NO: 858830 - DNA, 21 bp, Homo sapiens
agttcatgagaatctatattt

SEQ ID NO: 858831 - DNA, 17 bp, Homo sapiens
agttcatggtgatcagt

SEQ ID NO: 858832 - DNA, 15 bp, Homo sapiens
agttcatgtttgtaa

SEQ ID NO: 858833 - DNA, 17 bp, Homo sapiens
agttcattattttgtgg

SEQ ID NO: 858834 - DNA, 15 bp, Homo sapiens
agttcattgcaatta

SEQ ID NO: 858835 - DNA, 15 bp, Homo sapiens
agttccactgagctc

SEQ ID NO: 858836 - DNA, 21 bp, Homo sapiens
agttccactgagctccatgtg

SEQ ID NO: 858837 - DNA, 17 bp, Homo sapiens
agttccagtttctcctt

SEQ ID NO: 858838 - DNA, 18 bp, Homo sapiens
agttccagtttctccttg

SEQ ID NO: 858839 - DNA, 19 bp, Homo sapiens
agttccatcaggtcccccc

SEQ ID NO: 858840 - DNA, 19 bp, Homo sapiens
agttccatggcaattttgt

SEQ ID NO: 858841 - DNA, 13 bp, Homo sapiens
agttcccaactga

SEQ ID NO: 858842 - DNA, 14 bp, Homo sapiens
agttcccaagaaag

SEQ ID NO: 858843 - DNA, 21 bp, Homo sapiens
agttcccagctccccccgccc

SEQ ID NO: 858844 - DNA, 19 bp, Homo sapiens
agttcccatggtgtatgtg

SEQ ID NO: 858845 - DNA, 20 bp, Homo sapiens
agttcccatggtgtatgtgg

SEQ ID NO: 858846 - DNA, 21 bp, Homo sapiens
agttcccatggtgtatgtggt

SEQ ID NO: 858847 - DNA, 19 bp, Homo sapiens
agttcccattattatttct

SEQ ID NO: 858848 - DNA, 22 bp, Homo sapiens
agttcccattattatttctgtt

SEQ ID NO: 858849 - DNA, 18 bp, Homo sapiens
agttcccccaacctcaga

SEQ ID NO: 858850 - DNA, 19 bp, Homo sapiens
agttcccccagtacctcca

SEQ ID NO: 858851 - DNA, 23 bp, Homo sapiens
agttcccccatcagttcccccag

SEQ ID NO: 858852 - DNA, 19 bp, Homo sapiens
agttcccggagcacagccc

SEQ ID NO: 858853 - DNA, 22 bp, Homo sapiens
agttccctcctgcccaggactg

SEQ ID NO: 858854 - DNA, 14 bp, Homo sapiens
agttccctgaaaac

SEQ ID NO: 858855 - DNA, 17 bp, Homo sapiens
agttccgcctcccgggt

SEQ ID NO: 858856 - DNA, 18 bp, Homo sapiens
agttcctcctaaggaaat

SEQ ID NO: 858857 - DNA, 18 bp, Homo sapiens
agttcctctcccttccct

SEQ ID NO: 858858 - DNA, 11 bp, Homo sapiens
agttcctctgc

SEQ ID NO: 858859 - DNA, 22 bp, Homo sapiens
agttcctcttttgtgctgcttc

SEQ ID NO: 858860 - DNA, 20 bp, Homo sapiens
agttcctgctctctgctcat

SEQ ID NO: 858861 - DNA, 18 bp, Homo sapiens
agttcctgtaacaggtgt

SEQ ID NO: 858862 - DNA, 20 bp, Homo sapiens
agttcctgtcccttctctta

SEQ ID NO: 858863 - DNA, 15 bp, Homo sapiens
agttcctgtggctcc

SEQ ID NO: 858864 - DNA, 18 bp, Homo sapiens
agttccttaggttttctt

SEQ ID NO: 858865 - DNA, 20 bp, Homo sapiens
agttccttgccttaataaat

SEQ ID NO: 858866 - DNA, 13 bp, Homo sapiens
agttcgagaccaa

SEQ ID NO: 858867 - DNA, 13 bp, Homo sapiens
agttcgtctgttg

SEQ ID NO: 858868 - DNA, 15 bp, Homo sapiens
agttctacaagcata

SEQ ID NO: 858869 - DNA, 23 bp, Homo sapiens
agttctacaagcatatttgagaa

SEQ ID NO: 858870 - DNA, 20 bp, Homo sapiens
agttctacctcaggcagctc

SEQ ID NO: 858871 - DNA, 23 bp, Homo sapiens
agttctacctcaggcagctcaag

SEQ ID NO: 858872 - DNA, 16 bp, Homo sapiens
agttctagagaagagg

SEQ ID NO: 858873 - DNA, 19 bp, Homo sapiens
agttctagtctctctgggg

SEQ ID NO: 858874 - DNA, 13 bp, Homo sapiens
agttctataagaa

SEQ ID NO: 858875 - DNA, 18 bp, Homo sapiens
agttctataagtgaggaa

SEQ ID NO: 858876 - DNA, 19 bp, Homo sapiens
agttctatcagttatcctt

SEQ ID NO: 858877 - DNA, 20 bp, Homo sapiens
agttctatccttttgcctgc

SEQ ID NO: 858878 - DNA, 21 bp, Homo sapiens
agttctatccttttgcctgca

SEQ ID NO: 858879 - DNA, 19 bp, Homo sapiens
agttctcactgttccctct

SEQ ID NO: 858880 - DNA, 11 bp, Homo sapiens
agttctcccag

SEQ ID NO: 858881 - DNA, 21 bp, Homo sapiens
agttctcctggaggcaggggc

SEQ ID NO: 858882 - DNA, 17 bp, Homo sapiens
agttctccttttgaact

SEQ ID NO: 858883 - DNA, 20 bp, Homo sapiens
agttctccttttgaacttgt

SEQ ID NO: 858884 - DNA, 15 bp, Homo sapiens
agttctctgatgcag

SEQ ID NO: 858885 - DNA, 16 bp, Homo sapiens
agttctctttggaaat

SEQ ID NO: 858886 - DNA, 17 bp, Homo sapiens
agttctctttggaaata

SEQ ID NO: 858887 - DNA, 13 bp, Homo sapiens
agttctgaaagct

SEQ ID NO: 858888 - DNA, 13 bp, Homo sapiens
agttctgaagaat

SEQ ID NO: 858889 - DNA, 18 bp, Homo sapiens
agttctgagctgtaattt

SEQ ID NO: 858890 - DNA, 15 bp, Homo sapiens
agttctgagtcctga

SEQ ID NO: 858891 - DNA, 18 bp, Homo sapiens
agttctgcaaatagaaaa

SEQ ID NO: 858892 - DNA, 12 bp, Homo sapiens
agttctgcaggt

SEQ ID NO: 858893 - DNA, 18 bp, Homo sapiens
agttctgccacctctgac

SEQ ID NO: 858894 - DNA, 14 bp, Homo sapiens
agttctgccaggca

SEQ ID NO: 858895 - DNA, 14 bp, Homo sapiens
agttctgctcctct

SEQ ID NO: 858896 - DNA, 12 bp, Homo sapiens
agttctgctcta

SEQ ID NO: 858897 - DNA, 15 bp, Homo sapiens
agttctgctgccctc

SEQ ID NO: 858898 - DNA, 19 bp, Homo sapiens
agttctgctgccctcttaa

SEQ ID NO: 858899 - DNA, 18 bp, Homo sapiens
agttctggcaagagcaga

SEQ ID NO: 858900 - DNA, 20 bp, Homo sapiens
agttctggcaagagcagata

SEQ ID NO: 858901 - DNA, 22 bp, Homo sapiens
agttctggcaagagcagatact

SEQ ID NO: 858902 - DNA, 15 bp, Homo sapiens
agttctgtaatgtag

SEQ ID NO: 858903 - DNA, 14 bp, Homo sapiens
agttctgtgaagag

SEQ ID NO: 858904 - DNA, 14 bp, Homo sapiens
agttctgtgcctcc

SEQ ID NO: 858905 - DNA, 22 bp, Homo sapiens
agttctgtggtttcatgttagt

SEQ ID NO: 858906 - DNA, 19 bp, Homo sapiens
agttctgttgacctgtgca

SEQ ID NO: 858907 - DNA, 18 bp, Homo sapiens
agttctgttgttttgtgt

SEQ ID NO: 858908 - DNA, 15 bp, Homo sapiens
agttcttaactgctg

SEQ ID NO: 858909 - DNA, 22 bp, Homo sapiens
agttcttaaggattgtgatatt

SEQ ID NO: 858910 - DNA, 21 bp, Homo sapiens
agttcttagattcaggggaag

SEQ ID NO: 858911 - DNA, 19 bp, Homo sapiens
agttcttagctttgaaact

SEQ ID NO: 858912 - DNA, 20 bp, Homo sapiens
agttcttagttgctgtatgt

SEQ ID NO: 858913 - DNA, 14 bp, Homo sapiens
agttcttcacctct

SEQ ID NO: 858914 - DNA, 18 bp, Homo sapiens
agttcttcacctctatcc

SEQ ID NO: 858915 - DNA, 14 bp, Homo sapiens
agttcttcctgtaa

SEQ ID NO: 858916 - DNA, 15 bp, Homo sapiens
agttcttctatttca

SEQ ID NO: 858917 - DNA, 13 bp, Homo sapiens
agttcttgaattg

SEQ ID NO: 858918 - DNA, 15 bp, Homo sapiens
agttcttgaattgtt

SEQ ID NO: 858919 - DNA, 17 bp, Homo sapiens
agttcttgaattgttat

SEQ ID NO: 858920 - DNA, 17 bp, Homo sapiens
agttcttggacccctga

SEQ ID NO: 858921 - DNA, 20 bp, Homo sapiens
agttcttggtgactgtccca

SEQ ID NO: 858922 - DNA, 22 bp, Homo sapiens
agttcttggtgctctgtgttcc

SEQ ID NO: 858923 - DNA, 18 bp, Homo sapiens
agttcttgtgcatgttta

SEQ ID NO: 858924 - DNA, 18 bp, Homo sapiens
agttctttcctccccctg

SEQ ID NO: 858925 - DNA, 20 bp, Homo sapiens
agttctttcctctttctgct

SEQ ID NO: 858926 - DNA, 17 bp, Homo sapiens
agttctttgatttgtac

SEQ ID NO: 858927 - DNA, 18 bp, Homo sapiens
agttctttgatttgtacc

SEQ ID NO: 858928 - DNA, 18 bp, Homo sapiens
agttctttgctgcccctg

SEQ ID NO: 858929 - DNA, 21 bp, Homo sapiens
agttctttgttcatagcccag

SEQ ID NO: 858930 - DNA, 22 bp, Homo sapiens
agttctttgttcatagcccagt

SEQ ID NO: 858931 - DNA, 14 bp, Homo sapiens
agttgaaaaaggaa

SEQ ID NO: 858932 - DNA, 19 bp, Homo sapiens
agttgaaaaaggaaatatt

SEQ ID NO: 858933 - DNA, 16 bp, Homo sapiens
agttgaaaataaagtg

SEQ ID NO: 858934 - DNA, 20 bp, Homo sapiens
agttgaaaatggatttttaa

SEQ ID NO: 858935 - DNA, 15 bp, Homo sapiens
agttgaaactgctat

SEQ ID NO: 858936 - DNA, 23 bp, Homo sapiens
agttgaaactgctatagcctaag

SEQ ID NO: 858937 - DNA, 18 bp, Homo sapiens
agttgaaaggcctcaaga

SEQ ID NO: 858938 - DNA, 20 bp, Homo sapiens
agttgaacactagtctgtgt

SEQ ID NO: 858939 - DNA, 20 bp, Homo sapiens
agttgaactatgactggagt

SEQ ID NO: 858940 - DNA, 19 bp, Homo sapiens
agttgaagttagtggaaat

SEQ ID NO: 858941 - DNA, 15 bp, Homo sapiens
agttgaagtttagga

SEQ ID NO: 858942 - DNA, 21 bp, Homo sapiens
agtttttttcatttttttgaa

SEQ ID NO: 858943 - DNA, 18 bp, Homo sapiens
agtttttttctgtttata

SEQ ID NO: 858944 - DNA, 15 bp, Homo sapiens
agttttttttgtttg

SEQ ID NO: 858945 - DNA, 21 bp, Homo sapiens
agttttttttgtttgcctctt

SEQ ID NO: 858946 - DNA, 19 bp, Homo sapiens
agttttttttttcttgtct

SEQ ID NO: 858947 - DNA, 17 bp, Homo sapiens
ataaaaaaaagaaatga

SEQ ID NO: 858948 - DNA, 19 bp, Homo sapiens
ataaaaaaacaatcatttg

SEQ ID NO: 858949 - DNA, 17 bp, Homo sapiens
ataaaaaacagaaaccg

SEQ ID NO: 858950 - DNA, 18 bp, Homo sapiens
ataaaaaagaagcacttt

SEQ ID NO: 858951 - DNA, 21 bp, Homo sapiens
ataaaaaataatctatttcta

SEQ ID NO: 858952 - DNA, 20 bp, Homo sapiens
ataaaaaatatgtatttacc

SEQ ID NO: 858953 - DNA, 13 bp, Homo sapiens
ataaaaaatcatg

SEQ ID NO: 858954 - DNA, 19 bp, Homo sapiens
ataaaaaatcctcaacact

SEQ ID NO: 858955 - DNA, 13 bp, Homo sapiens
ataaaaaatgaaa

SEQ ID NO: 858956 - DNA, 13 bp, Homo sapiens
ataaaaaatgtaa

SEQ ID NO: 858957 - DNA, 18 bp, Homo sapiens
ataaaaacaactttcact

SEQ ID NO: 858958 - DNA, 23 bp, Homo sapiens
ataaaaacattgcctttgaatgt

SEQ ID NO: 858959 - DNA, 13 bp, Homo sapiens
ataaaaaccctgt

SEQ ID NO: 858960 - DNA, 16 bp, Homo sapiens
ataaaaactaatttca

SEQ ID NO: 858961 - DNA, 13 bp, Homo sapiens
ataaaaacttgaa

SEQ ID NO: 858962 - DNA, 20 bp, Homo sapiens
ataaaaacttgaaaatatat

SEQ ID NO: 858963 - DNA, 13 bp, Homo sapiens
ataaaaagaatga

SEQ ID NO: 858964 - DNA, 18 bp, Homo sapiens
ataaaaagcagaatttta

SEQ ID NO: 858965 - DNA, 20 bp, Homo sapiens
ataaaaagcagaattttaat

SEQ ID NO: 858966 - DNA, 23 bp, Homo sapiens
ataaaaagcatttggtgcctatt

SEQ ID NO: 858967 - DNA, 15 bp, Homo sapiens
ataaaaaggaaatta

SEQ ID NO: 858968 - DNA, 13 bp, Homo sapiens
ataaaaaggaata

SEQ ID NO: 858969 - DNA, 11 bp, Homo sapiens
ataaaaaggac

SEQ ID NO: 858970 - DNA, 19 bp, Homo sapiens
ataaaaaggacatcagcaa

SEQ ID NO: 858971 - DNA, 17 bp, Homo sapiens
ataaaaagtaatgactt

SEQ ID NO: 858972 - DNA, 17 bp, Homo sapiens
ataaaaagtatgttgta

SEQ ID NO: 858973 - DNA, 20 bp, Homo sapiens
ataaaaagtgaacttttgta

SEQ ID NO: 858974 - DNA, 17 bp, Homo sapiens
ataaaaagtgacacagc

SEQ ID NO: 858975 - DNA, 20 bp, Homo sapiens
ataaaaagtgacacagcagc

SEQ ID NO: 858976 - DNA, 13 bp, Homo sapiens
ataaaaataaatt

SEQ ID NO: 858977 - DNA, 14 bp, Homo sapiens
ataaaaatactgac

SEQ ID NO: 858978 - DNA, 14 bp, Homo sapiens
ataaaaatatatat

SEQ ID NO: 858979 - DNA, 17 bp, Homo sapiens
ataaaaatgatctaaac

SEQ ID NO: 858980 - DNA, 17 bp, Homo sapiens
ataaaaattacatatat

SEQ ID NO: 858981 - DNA, 15 bp, Homo sapiens
ataaaaattctgaat

SEQ ID NO: 858982 - DNA, 15 bp, Homo sapiens
ataaaacaactctga

SEQ ID NO: 858983 - DNA, 15 bp, Homo sapiens
ataaaacatagcaaa

SEQ ID NO: 858984 - DNA, 14 bp, Homo sapiens
ataaaacattaaga

SEQ ID NO: 858985 - DNA, 22 bp, Homo sapiens
ataaaacattaagaaaatcata

SEQ ID NO: 858986 - DNA, 13 bp, Homo sapiens
ataaaacattaat

SEQ ID NO: 858987 - DNA, 18 bp, Homo sapiens
ataaaaccctatacaagt

SEQ ID NO: 858988 - DNA, 12 bp, Homo sapiens
ataaaaccctta

SEQ ID NO: 858989 - DNA, 11 bp, Homo sapiens
ataaaaccttt

SEQ ID NO: 858990 - DNA, 15 bp, Homo sapiens
ataaaactaaatata

SEQ ID NO: 858991 - DNA, 12 bp, Homo sapiens
ataaaactattt

SEQ ID NO: 858992 - DNA, 14 bp, Homo sapiens
ataaaactatttaa

SEQ ID NO: 858993 - DNA, 23 bp, Homo sapiens
ataaaactatttaaaattggcac

SEQ ID NO: 858994 - DNA, 22 bp, Homo sapiens
ataaaactatttattgtgctgg

SEQ ID NO: 858995 - DNA, 11 bp, Homo sapiens
ataaaactgaa

SEQ ID NO: 858996 - DNA, 12 bp, Homo sapiens
ataaaactgaat

SEQ ID NO: 858997 - DNA, 12 bp, Homo sapiens
ataaaactgcac

SEQ ID NO: 858998 - DNA, 15 bp, Homo sapiens
ataaaactgcgagga

SEQ ID NO: 858999 - DNA, 22 bp, Homo sapiens
ataaaactgcgaggacatcaaa

SEQ ID NO: 859000 - DNA, 15 bp, Homo sapiens
ataaaactgtgtaaa

SEQ ID NO: 859001 - DNA, 16 bp, Homo sapiens
ataaaactgtgtaaac

SEQ ID NO: 859002 - DNA, 13 bp, Homo sapiens
ataaaactttaaa

SEQ ID NO: 859003 - DNA, 13 bp, Homo sapiens
ataaaagaaacac

SEQ ID NO: 859004 - DNA, 12 bp, Homo sapiens
ataaaagaacat

SEQ ID NO: 859005 - DNA, 16 bp, Homo sapiens
ataaaagaacatgctt

SEQ ID NO: 859006 - DNA, 19 bp, Homo sapiens
ataaaagaatatttagaaa

SEQ ID NO: 859007 - DNA, 12 bp, Homo sapiens
ataaaagagctt

SEQ ID NO: 859008 - DNA, 14 bp, Homo sapiens
ataaaagatcacct

SEQ ID NO: 859009 - DNA, 12 bp, Homo sapiens
ataaaagcaatt

SEQ ID NO: 859010 - DNA, 14 bp, Homo sapiens
ataaaagccttggg

SEQ ID NO: 859011 - DNA, 21 bp, Homo sapiens
ataaaagctagatactggaaa

SEQ ID NO: 859012 - DNA, 17 bp, Homo sapiens
ataaaagctcagatgac

SEQ ID NO: 859013 - DNA, 19 bp, Homo sapiens
ataaaagctgaagttactt

SEQ ID NO: 859014 - DNA, 20 bp, Homo sapiens
ataaaagctttgactccctg

SEQ ID NO: 859015 - DNA, 12 bp, Homo sapiens
ataaaaggaaaa

SEQ ID NO: 859016 - DNA, 20 bp, Homo sapiens
ataaaaggaagccaaagagt

SEQ ID NO: 859017 - DNA, 17 bp, Homo sapiens
ataaaaggaatctggca

SEQ ID NO: 859018 - DNA, 17 bp, Homo sapiens
ataaaaggatgttacaa

SEQ ID NO: 859019 - DNA, 22 bp, Homo sapiens
ataaaaggatgttacaagtttg

SEQ ID NO: 859020 - DNA, 20 bp, Homo sapiens
ataaaagggggtccgtggaa

SEQ ID NO: 859021 - DNA, 20 bp, Homo sapiens
ataaaaggtggagtttctct

SEQ ID NO: 859022 - DNA, 13 bp, Homo sapiens
ataaaagtgatca

SEQ ID NO: 859023 - DNA, 17 bp, Homo sapiens
ataaaagtgatcaataa

SEQ ID NO: 859024 - DNA, 18 bp, Homo sapiens
ataaaagtgatcaataaa

SEQ ID NO: 859025 - DNA, 15 bp, Homo sapiens
ataaaagttgcgttt

SEQ ID NO: 859026 - DNA, 13 bp, Homo sapiens
ataaaataaactt

SEQ ID NO: 859027 - DNA, 14 bp, Homo sapiens
ataaaataaacttc

SEQ ID NO: 859028 - DNA, 15 bp, Homo sapiens
ataaaataaacttct

SEQ ID NO: 859029 - DNA, 16 bp, Homo sapiens
ataaaataaacttctt

SEQ ID NO: 859030 - DNA, 14 bp, Homo sapiens
ataaaataaagtat

SEQ ID NO: 859031 - DNA, 14 bp, Homo sapiens
ataaaataaataat

SEQ ID NO: 859032 - DNA, 15 bp, Homo sapiens
ataaaataaataatt

SEQ ID NO: 859033 - DNA, 20 bp, Homo sapiens
ataaaataaataattttaat

SEQ ID NO: 859034 - DNA, 15 bp, Homo sapiens
ataaaataaatatat

SEQ ID NO: 859035 - DNA, 17 bp, Homo sapiens
ataaaatactctagcct

SEQ ID NO: 859036 - DNA, 19 bp, Homo sapiens
ataaaatagtcgtgaatct

SEQ ID NO: 859037 - DNA, 21 bp, Homo sapiens
ataaaatataaaactgaaata

SEQ ID NO: 859038 - DNA, 16 bp, Homo sapiens
ataaaatatcataaag

SEQ ID NO: 859039 - DNA, 14 bp, Homo sapiens
ataaaatatcctca

SEQ ID NO: 859040 - DNA, 15 bp, Homo sapiens
ataaaatatcctcag

SEQ ID NO: 859041 - DNA, 16 bp, Homo sapiens
ataaaatcaagtttta

SEQ ID NO: 859042 - DNA, 17 bp, Homo sapiens
ataaaatccaaaatgaa

SEQ ID NO: 859043 - DNA, 21 bp, Homo sapiens
ataaaatcctaagacacaaat

SEQ ID NO: 859044 - DNA, 18 bp, Homo sapiens
ataaaatgaaaattgtat

SEQ ID NO: 859045 - DNA, 16 bp, Homo sapiens
ataaaatgaaatgcta

SEQ ID NO: 859046 - DNA, 18 bp, Homo sapiens
ataaaatgaacatctctt

SEQ ID NO: 859047 - DNA, 14 bp, Homo sapiens
ataaaatgcaaatg

SEQ ID NO: 859048 - DNA, 15 bp, Homo sapiens
ataaaatgcaaatga

SEQ ID NO: 859049 - DNA, 17 bp, Homo sapiens
ataaaatgcaaatgaat

SEQ ID NO: 859050 - DNA, 23 bp, Homo sapiens
ataaaatgcaaatgaatcattgt

SEQ ID NO: 859051 - DNA, 12 bp, Homo sapiens
ataaaatgcctc

SEQ ID NO: 859052 - DNA, 21 bp, Homo sapiens
ataaaatggtgttttcatgta

SEQ ID NO: 859053 - DNA, 17 bp, Homo sapiens
ataaaatgtaattactt

SEQ ID NO: 859054 - DNA, 13 bp, Homo sapiens
ataaaatgtgtac

SEQ ID NO: 859055 - DNA, 19 bp, Homo sapiens
ataaaatgtgtacagtgaa

SEQ ID NO: 859056 - DNA, 15 bp, Homo sapiens
ataaaattaaaagtt

SEQ ID NO: 859057 - DNA, 15 bp, Homo sapiens
ataaaattaaatgcc

SEQ ID NO: 859058 - DNA, 11 bp, Homo sapiens
ataaagacaag

SEQ ID NO: 859059 - DNA, 12 bp, Homo sapiens
ataaagacagag

SEQ ID NO: 859060 - DNA, 17 bp, Homo sapiens
ataaagaccagaaattc

SEQ ID NO: 859061 - DNA, 21 bp, Homo sapiens
ataaagaccgtacaaactcag

SEQ ID NO: 859062 - DNA, 11 bp, Homo sapiens
ataaagactgt

SEQ ID NO: 859063 - DNA, 14 bp, Homo sapiens
ataaagacttttat

SEQ ID NO: 859064 - DNA, 23 bp, Homo sapiens
ataaagacttttatgtgagattt

SEQ ID NO: 859065 - DNA, 16 bp, Homo sapiens
ataaagaggcatcttt

SEQ ID NO: 859066 - DNA, 21 bp, Homo sapiens
ataaagatatatagagatgca

SEQ ID NO: 859067 - DNA, 14 bp, Homo sapiens
ataaagatgagttg

SEQ ID NO: 859068 - DNA, 15 bp, Homo sapiens
ataaagatgagttgg

SEQ ID NO: 859069 - DNA, 20 bp, Homo sapiens
ataaagatgatctactcaga

SEQ ID NO: 859070 - DNA, 23 bp, Homo sapiens
ataaagatgatctactcagaaat

SEQ ID NO: 859071 - DNA, 14 bp, Homo sapiens
ataaagatgctctt

SEQ ID NO: 859072 - DNA, 19 bp, Homo sapiens
ataaagattattttttgat

SEQ ID NO: 859073 - DNA, 15 bp, Homo sapiens
ataaagattgtactt

SEQ ID NO: 859074 - DNA, 20 bp, Homo sapiens
ataaagatttcttgagtttt

SEQ ID NO: 859075 - DNA, 21 bp, Homo sapiens
ataaagattttttaataattt

SEQ ID NO: 859076 - DNA, 18 bp, Homo sapiens
ataaagcaaatagacaca

SEQ ID NO: 859077 - DNA, 15 bp, Homo sapiens
ataaagcaaattact

SEQ ID NO: 859078 - DNA, 22 bp, Homo sapiens
ataaagcaactgttatgaaata

SEQ ID NO: 859079 - DNA, 16 bp, Homo sapiens
ataaagcaatgtgttt

SEQ ID NO: 859080 - DNA, 15 bp, Homo sapiens
ataaagcagagccaa

SEQ ID NO: 859081 - DNA, 22 bp, Homo sapiens
ataaagcagagccaaggccacc

SEQ ID NO: 859082 - DNA, 21 bp, Homo sapiens
ataaagcagcctcattctgag

SEQ ID NO: 859083 - DNA, 18 bp, Homo sapiens
ataaagcagcgtttctat

SEQ ID NO: 859084 - DNA, 19 bp, Homo sapiens
ataaagcagcgtttctatg

SEQ ID NO: 859085 - DNA, 15 bp, Homo sapiens
ataaagcagtagaca

SEQ ID NO: 859086 - DNA, 22 bp, Homo sapiens
ataaagcagtcctgttcaaatt

SEQ ID NO: 859087 - DNA, 17 bp, Homo sapiens
ataaagcattactcttt

SEQ ID NO: 859088 - DNA, 14 bp, Homo sapiens
ataaagcatttaac

SEQ ID NO: 859089 - DNA, 14 bp, Homo sapiens
ataaagccctggga

SEQ ID NO: 859090 - DNA, 20 bp, Homo sapiens
ataaagccctgggatcactg

SEQ ID NO: 859091 - DNA, 14 bp, Homo sapiens
ataaagcctatttt

SEQ ID NO: 859092 - DNA, 17 bp, Homo sapiens
ataaagccttttaaatc

SEQ ID NO: 859093 - DNA, 20 bp, Homo sapiens
ataaagccttttaaatcatc

SEQ ID NO: 859094 - DNA, 22 bp, Homo sapiens
ataaagctcaaatgaaatgtat

SEQ ID NO: 859095 - DNA, 16 bp, Homo sapiens
ataaagctcccttgaa

SEQ ID NO: 859096 - DNA, 17 bp, Homo sapiens
ataaagcttgtggcccc

SEQ ID NO: 859097 - DNA, 18 bp, Homo sapiens
ataaaggaccctgtttct

SEQ ID NO: 859098 - DNA, 14 bp, Homo sapiens
ataaaggactgtaa

SEQ ID NO: 859099 - DNA, 20 bp, Homo sapiens
ataaaggataactctgtatt

SEQ ID NO: 859100 - DNA, 13 bp, Homo sapiens
ataaaggatgtga

SEQ ID NO: 859101 - DNA, 12 bp, Homo sapiens
ataaaggcagct

SEQ ID NO: 859102 - DNA, 14 bp, Homo sapiens
ataaaggcagctgc

SEQ ID NO: 859103 - DNA, 20 bp, Homo sapiens
ataaaggcagctgcctctgc

SEQ ID NO: 859104 - DNA, 18 bp, Homo sapiens
ataaaggcagttttctaa

SEQ ID NO: 859105 - DNA, 17 bp, Homo sapiens
ataaaggccacaggaga

SEQ ID NO: 859106 - DNA, 18 bp, Homo sapiens
ataaaggccacaggagac

SEQ ID NO: 859107 - DNA, 19 bp, Homo sapiens
ataaaggccccaaatacca

SEQ ID NO: 859108 - DNA, 19 bp, Homo sapiens
ataaagggagaatggtgct

SEQ ID NO: 859109 - DNA, 17 bp, Homo sapiens
ataaaggtaaaatcact

SEQ ID NO: 859110 - DNA, 18 bp, Homo sapiens
ataaaggtaaaatcactt

SEQ ID NO: 859111 - DNA, 16 bp, Homo sapiens
ataaaggtacacatgg

SEQ ID NO: 859112 - DNA, 21 bp, Homo sapiens
ataaaggtctgcactccttta

SEQ ID NO: 859113 - DNA, 18 bp, Homo sapiens
ataaaggtcttaaataat

SEQ ID NO: 859114 - DNA, 14 bp, Homo sapiens
ataaaggttatgaa

SEQ ID NO: 859115 - DNA, 17 bp, Homo sapiens
ataaaggttatgaaaca

SEQ ID NO: 859116 - DNA, 21 bp, Homo sapiens
ataaaggttgacaataaatgt

SEQ ID NO: 859117 - DNA, 12 bp, Homo sapiens
ataataaagttg

SEQ ID NO: 859118 - DNA, 17 bp, Homo sapiens
ataataaagttgtttta

SEQ ID NO: 859119 - DNA, 13 bp, Homo sapiens
ataataaattcat

SEQ ID NO: 859120 - DNA, 14 bp, Homo sapiens
ataataaattgatt

SEQ ID NO: 859121 - DNA, 15 bp, Homo sapiens
ataataactgaactg

SEQ ID NO: 859122 - DNA, 13 bp, Homo sapiens
ataataactttat

SEQ ID NO: 859123 - DNA, 14 bp, Homo sapiens
ataataactttatt

SEQ ID NO: 859124 - DNA, 17 bp, Homo sapiens
ataataactttattgca

SEQ ID NO: 859125 - DNA, 20 bp, Homo sapiens
ataataactttattgcatat

SEQ ID NO: 859126 - DNA, 22 bp, Homo sapiens
ataataactttattgcatatag

SEQ ID NO: 859127 - DNA, 13 bp, Homo sapiens
ataataagcaaaa

SEQ ID NO: 859128 - DNA, 15 bp, Homo sapiens
ataataagctaaaga

SEQ ID NO: 859129 - DNA, 12 bp, Homo sapiens
ataataagtttt

SEQ ID NO: 859130 - DNA, 23 bp, Homo sapiens
ataatacaccactacattctgtt

SEQ ID NO: 859131 - DNA, 21 bp, Homo sapiens
ataatacagaatcttgttttg

SEQ ID NO: 859132 - DNA, 17 bp, Homo sapiens
ataatacagccaaagat

SEQ ID NO: 859133 - DNA, 17 bp, Homo sapiens
ataatacataaatgata

SEQ ID NO: 859134 - DNA, 17 bp, Homo sapiens
ataatactctgttgtac

SEQ ID NO: 859135 - DNA, 12 bp, Homo sapiens
ataatacttgac

SEQ ID NO: 859136 - DNA, 17 bp, Homo sapiens
ataatacttgacctctg

SEQ ID NO: 859137 - DNA, 18 bp, Homo sapiens
ataatactttgtatacaa

SEQ ID NO: 859138 - DNA, 12 bp, Homo sapiens
ataatagaagaa

SEQ ID NO: 859139 - DNA, 12 bp, Homo sapiens
ataatagacata

SEQ ID NO: 859140 - DNA, 21 bp, Homo sapiens
ataatagactcgctagtcagt

SEQ ID NO: 859141 - DNA, 21 bp, Homo sapiens
ataatagcaacttttgtgtaa

SEQ ID NO: 859142 - DNA, 15 bp, Homo sapiens
ataataggaattcaa

SEQ ID NO: 859143 - DNA, 20 bp, Homo sapiens
ataataggaatttgtataaa

SEQ ID NO: 859144 - DNA, 23 bp, Homo sapiens
ataataggtagcctgctgtgggg

SEQ ID NO: 859145 - DNA, 23 bp, Homo sapiens
ataataggtgggggaaaatgaat

SEQ ID NO: 859146 - DNA, 20 bp, Homo sapiens
ataatagtttacatgtagta

SEQ ID NO: 859147 - DNA, 17 bp, Homo sapiens
ataatataaaaagcaga

SEQ ID NO: 859148 - DNA, 15 bp, Homo sapiens
ataatatataaacaa

SEQ ID NO: 859149 - DNA, 23 bp, Homo sapiens
ataatatattctatttttatact

SEQ ID NO: 859150 - DNA, 13 bp, Homo sapiens
ataatatattgct

SEQ ID NO: 859151 - DNA, 16 bp, Homo sapiens
ataatatattgctaaa

SEQ ID NO: 859152 - DNA, 16 bp, Homo sapiens
ataatatatttgcaga

SEQ ID NO: 859153 - DNA, 13 bp, Homo sapiens
ataatatcaaata

SEQ ID NO: 859154 - DNA, 14 bp, Homo sapiens
ataatatctaaagt

SEQ ID NO: 859155 - DNA, 21 bp, Homo sapiens
ataatatgctgccaaattttg

SEQ ID NO: 859156 - DNA, 23 bp, Homo sapiens
ataatatggctatgcttaaaagg

SEQ ID NO: 859157 - DNA, 14 bp, Homo sapiens
ataatatgtcacct

SEQ ID NO: 859158 - DNA, 21 bp, Homo sapiens
ataatatgtttagttttacat

SEQ ID NO: 859159 - DNA, 21 bp, Homo sapiens
ataatattcagccagcttaaa

SEQ ID NO: 859160 - DNA, 15 bp, Homo sapiens
ataatatttcttaat

SEQ ID NO: 859161 - DNA, 18 bp, Homo sapiens
ataatatttcttaatttg

SEQ ID NO: 859162 - DNA, 15 bp, Homo sapiens
ataatatttttgtat

SEQ ID NO: 859163 - DNA, 14 bp, Homo sapiens
ataatcaagatttt

SEQ ID NO: 859164 - DNA, 20 bp, Homo sapiens
ataatcaattattacattta

SEQ ID NO: 859165 - DNA, 16 bp, Homo sapiens
ataatcacgctttcct

SEQ ID NO: 859166 - DNA, 16 bp, Homo sapiens
ataatcactactagtt

SEQ ID NO: 859167 - DNA, 21 bp, Homo sapiens
ataatcacttggggtttgtac

SEQ ID NO: 859168 - DNA, 16 bp, Homo sapiens
ataatcagcctcttaa

SEQ ID NO: 859169 - DNA, 15 bp, Homo sapiens
ataatcaggaaaaat

SEQ ID NO: 859170 - DNA, 13 bp, Homo sapiens
ataatcagtaaat

SEQ ID NO: 859171 - DNA, 19 bp, Homo sapiens
ataatcatgtaaatgctca

SEQ ID NO: 859172 - DNA, 14 bp, Homo sapiens
ataatcattgctta

SEQ ID NO: 859173 - DNA, 15 bp, Homo sapiens
ataatccacccccag

SEQ ID NO: 859174 - DNA, 20 bp, Homo sapiens
ataatccattccaaaataca

SEQ ID NO: 859175 - DNA, 17 bp, Homo sapiens
ataatcctagagtctta

SEQ ID NO: 859176 - DNA, 20 bp, Homo sapiens
ataatcctgtgaaaatatga

SEQ ID NO: 859177 - DNA, 18 bp, Homo sapiens
ataatcgctcttttccac

SEQ ID NO: 859178 - DNA, 14 bp, Homo sapiens
ataatctagtttac

SEQ ID NO: 859179 - DNA, 17 bp, Homo sapiens
ataatctatattaaatg

SEQ ID NO: 859180 - DNA, 13 bp, Homo sapiens
ataatctcaaagg

SEQ ID NO: 859181 - DNA, 14 bp, Homo sapiens
ataatctcaaagga

SEQ ID NO: 859182 - DNA, 18 bp, Homo sapiens
ataatctctccattcccg

SEQ ID NO: 859183 - DNA, 14 bp, Homo sapiens
ataatctgaagata

SEQ ID NO: 859184 - DNA, 17 bp, Homo sapiens
ataatctgaagatatat

SEQ ID NO: 859185 - DNA, 18 bp, Homo sapiens
ataatctggactcctctg

SEQ ID NO: 859186 - DNA, 19 bp, Homo sapiens
ataatctggactcctctgt

SEQ ID NO: 859187 - DNA, 17 bp, Homo sapiens
ataatctggtgacaaat

SEQ ID NO: 859188 - DNA, 13 bp, Homo sapiens
ataatctgtcaaa

SEQ ID NO: 859189 - DNA, 18 bp, Homo sapiens
ataatcttaaattttgac

SEQ ID NO: 859190 - DNA, 17 bp, Homo sapiens
ataatcttataattgtt

SEQ ID NO: 859191 - DNA, 13 bp, Homo sapiens
ataatcttataca

SEQ ID NO: 859192 - DNA, 14 bp, Homo sapiens
ataatcttatacaa

SEQ ID NO: 859193 - DNA, 20 bp, Homo sapiens
ataatcttcaggtgaacact

SEQ ID NO: 859194 - DNA, 19 bp, Homo sapiens
ataatcttggcttcttaaa

SEQ ID NO: 859195 - DNA, 20 bp, Homo sapiens
ataatcttggcttcttaaaa

SEQ ID NO: 859196 - DNA, 22 bp, Homo sapiens
ataatgaaaataaaacacacct

SEQ ID NO: 859197 - DNA, 15 bp, Homo sapiens
ataatgaaatctgtt

SEQ ID NO: 859198 - DNA, 16 bp, Homo sapiens
ataatgaaatctgttt

SEQ ID NO: 859199 - DNA, 17 bp, Homo sapiens
ataatgaacagaacata

SEQ ID NO: 859200 - DNA, 14 bp, Homo sapiens
ataatgaagacata

SEQ ID NO: 859201 - DNA, 13 bp, Homo sapiens
ataatgaattata

SEQ ID NO: 859202 - DNA, 17 bp, Homo sapiens
ataatgaattataacag

SEQ ID NO: 859203 - DNA, 18 bp, Homo sapiens
ataatgaggagtttatga

SEQ ID NO: 859204 - DNA, 20 bp, Homo sapiens
ataatgatcgaaaaaataat

SEQ ID NO: 859205 - DNA, 15 bp, Homo sapiens
ataatgcctttgtaa

SEQ ID NO: 859206 - DNA, 16 bp, Homo sapiens
ataatgcctttgtaac

SEQ ID NO: 859207 - DNA, 15 bp, Homo sapiens
ataatgcgtgcatac

SEQ ID NO: 859208 - DNA, 20 bp, Homo sapiens
ataatgcgtgcataccactt

SEQ ID NO: 859209 - DNA, 17 bp, Homo sapiens
ataatgctaatttaaag

SEQ ID NO: 859210 - DNA, 21 bp, Homo sapiens
ataatgctaatttaaagagac

SEQ ID NO: 859211 - DNA, 15 bp, Homo sapiens
ataatgctactgtct

SEQ ID NO: 859212 - DNA, 13 bp, Homo sapiens
ataatgctttctg

SEQ ID NO: 859213 - DNA, 15 bp, Homo sapiens
ataatgctttctgag

SEQ ID NO: 859214 - DNA, 16 bp, Homo sapiens
ataatggaaaaatagt

SEQ ID NO: 859215 - DNA, 17 bp, Homo sapiens
ataatggaaacatttac

SEQ ID NO: 859216 - DNA, 15 bp, Homo sapiens
ataatggtgatgtca

SEQ ID NO: 859217 - DNA, 16 bp, Homo sapiens
ataatggtgatgtcat

SEQ ID NO: 859218 - DNA, 15 bp, Homo sapiens
atagttcaaagccaa

SEQ ID NO: 859219 - DNA, 18 bp, Homo sapiens
atagttcagaatttagtg

SEQ ID NO: 859220 - DNA, 15 bp, Homo sapiens
atagttcagtagaat

SEQ ID NO: 859221 - DNA, 21 bp, Homo sapiens
atagttgaattagtgagtata

SEQ ID NO: 859222 - DNA, 13 bp, Homo sapiens
atagttgagcccc

SEQ ID NO: 859223 - DNA, 20 bp, Homo sapiens
atagttgcatagcagtatat

SEQ ID NO: 859224 - DNA, 20 bp, Homo sapiens
atagttgtgttaagcttgcg

SEQ ID NO: 859225 - DNA, 14 bp, Homo sapiens
atagtttacatgta

SEQ ID NO: 859226 - DNA, 14 bp, Homo sapiens
atagtttaggaaaa

SEQ ID NO: 859227 - DNA, 21 bp, Homo sapiens
atagtttcagatatatatcat

SEQ ID NO: 859228 - DNA, 21 bp, Homo sapiens
atagttttacttttaaactgt

SEQ ID NO: 859229 - DNA, 22 bp, Homo sapiens
atagttttacttttaaactgtg

SEQ ID NO: 859230 - DNA, 20 bp, Homo sapiens
atagttttcatccataactg

SEQ ID NO: 859231 - DNA, 23 bp, Homo sapiens
atagttttgtaagtaacaatatg

SEQ ID NO: 859232 - DNA, 21 bp, Homo sapiens
atagtttttaccttttatgta

SEQ ID NO: 859233 - DNA, 14 bp, Homo sapiens
atataaaaaacttt

SEQ ID NO: 859234 - DNA, 18 bp, Homo sapiens
atataaaaacagattctg

SEQ ID NO: 859235 - DNA, 20 bp, Homo sapiens
atataaaaacagattctgat

SEQ ID NO: 859236 - DNA, 23 bp, Homo sapiens
atataaaaaccccaaactgttga

SEQ ID NO: 859237 - DNA, 18 bp, Homo sapiens
atataaaaagaaaagata

SEQ ID NO: 859238 - DNA, 20 bp, Homo sapiens
atataaaaagaaaagataaa

SEQ ID NO: 859239 - DNA, 14 bp, Homo sapiens
atataaaaagcagc

SEQ ID NO: 859240 - DNA, 15 bp, Homo sapiens
atataaaacagtcat

SEQ ID NO: 859241 - DNA, 16 bp, Homo sapiens
atataaaacagtcatg

SEQ ID NO: 859242 - DNA, 16 bp, Homo sapiens
atataaaagactgacc

SEQ ID NO: 859243 - DNA, 21 bp, Homo sapiens
atataaaagttgcgtttaagt

SEQ ID NO: 859244 - DNA, 13 bp, Homo sapiens
atataaaataact

SEQ ID NO: 859245 - DNA, 15 bp, Homo sapiens
atataaaatgtattc

SEQ ID NO: 859246 - DNA, 22 bp, Homo sapiens
atataaacactccacagtgttt

SEQ ID NO: 859247 - DNA, 14 bp, Homo sapiens
atataaacctaaaa

SEQ ID NO: 859248 - DNA, 21 bp, Homo sapiens
atataaacctaaaaaagatat

SEQ ID NO: 859249 - DNA, 18 bp, Homo sapiens
atataaagacctataaat

SEQ ID NO: 859250 - DNA, 17 bp, Homo sapiens
atataaagtattcaaca

SEQ ID NO: 859251 - DNA, 20 bp, Homo sapiens
atataaagtattctttttct

SEQ ID NO: 859252 - DNA, 17 bp, Homo sapiens
atataaatacatgcaca

SEQ ID NO: 859253 - DNA, 21 bp, Homo sapiens
atataaatagctgaaaactaa

SEQ ID NO: 859254 - DNA, 12 bp, Homo sapiens
atataaatatat

SEQ ID NO: 859255 - DNA, 15 bp, Homo sapiens
atataaatatatatt

SEQ ID NO: 859256 - DNA, 22 bp, Homo sapiens
atataaatgcaatattaatgcc

SEQ ID NO: 859257 - DNA, 15 bp, Homo sapiens
atataaatggctggt

SEQ ID NO: 859258 - DNA, 14 bp, Homo sapiens
atataaatgtgtgt

SEQ ID NO: 859259 - DNA, 16 bp, Homo sapiens
atataaatgtgtgtat

SEQ ID NO: 859260 - DNA, 20 bp, Homo sapiens
atataaattgggataaacat

SEQ ID NO: 859261 - DNA, 14 bp, Homo sapiens
atataaattgtaca

SEQ ID NO: 859262 - DNA, 22 bp, Homo sapiens
atataaattgtacattttgtaa

SEQ ID NO: 859263 - DNA, 16 bp, Homo sapiens
atataaccctaggaat

SEQ ID NO: 859264 - DNA, 13 bp, Homo sapiens
atataactgtctt

SEQ ID NO: 859265 - DNA, 15 bp, Homo sapiens
atataactgtcttgt

SEQ ID NO: 859266 - DNA, 16 bp, Homo sapiens
atataactgtcttgtt

SEQ ID NO: 859267 - DNA, 18 bp, Homo sapiens
atataactgtcttgtttc

SEQ ID NO: 859268 - DNA, 16 bp, Homo sapiens
atataacttatattgt

SEQ ID NO: 859269 - DNA, 22 bp, Homo sapiens
atataacttatattgtaagaaa

SEQ ID NO: 859270 - DNA, 14 bp, Homo sapiens
atataactttagaa

SEQ ID NO: 859271 - DNA, 23 bp, Homo sapiens
atataagaagcaatctttgaaat

SEQ ID NO: 859272 - DNA, 21 bp, Homo sapiens
atataagagaagtctcattcg

SEQ ID NO: 859273 - DNA, 23 bp, Homo sapiens
atataaggaaagcaataaatgaa

SEQ ID NO: 859274 - DNA, 17 bp, Homo sapiens
atataagtttgaaggaa

SEQ ID NO: 859275 - DNA, 18 bp, Homo sapiens
atataataaagctactga

SEQ ID NO: 859276 - DNA, 15 bp, Homo sapiens
atataataaagtatt

SEQ ID NO: 859277 - DNA, 12 bp, Homo sapiens
atataataactt

SEQ ID NO: 859278 - DNA, 14 bp, Homo sapiens
atataataacttta

SEQ ID NO: 859279 - DNA, 16 bp, Homo sapiens
atataataatgatgat

SEQ ID NO: 859280 - DNA, 23 bp, Homo sapiens
atataatatgcacacagtgcttt

SEQ ID NO: 859281 - DNA, 14 bp, Homo sapiens
atataatatgtcac

SEQ ID NO: 859282 - DNA, 13 bp, Homo sapiens
atataatattcag

SEQ ID NO: 859283 - DNA, 17 bp, Homo sapiens
atataatcatcaagtaa

SEQ ID NO: 859284 - DNA, 21 bp, Homo sapiens
atataatgttgttatttaaag

SEQ ID NO: 859285 - DNA, 14 bp, Homo sapiens
atataattatcgga

SEQ ID NO: 859286 - DNA, 16 bp, Homo sapiens
atataattctgtaaat

SEQ ID NO: 859287 - DNA, 18 bp, Homo sapiens
atataattgttttatctg

SEQ ID NO: 859288 - DNA, 13 bp, Homo sapiens
atatctgcaaaaa

SEQ ID NO: 859289 - DNA, 14 bp, Homo sapiens
atatctgcatgtgt

SEQ ID NO: 859290 - DNA, 17 bp, Homo sapiens
atatctgcatgtgtcat

SEQ ID NO: 859291 - DNA, 13 bp, Homo sapiens
atatctgcttcag

SEQ ID NO: 859292 - DNA, 14 bp, Homo sapiens
atatctggcactgt

SEQ ID NO: 859293 - DNA, 17 bp, Homo sapiens
atatctgggattctact

SEQ ID NO: 859294 - DNA, 21 bp, Homo sapiens
atatctgggattctactttaa

SEQ ID NO: 859295 - DNA, 20 bp, Homo sapiens
atatctggtatatgtcatta

SEQ ID NO: 859296 - DNA, 13 bp, Homo sapiens
atatctgtgaaat

SEQ ID NO: 859297 - DNA, 21 bp, Homo sapiens
atatctgttcaacctcagtat

SEQ ID NO: 859298 - DNA, 15 bp, Homo sapiens
atatctgtttgtata

SEQ ID NO: 859299 - DNA, 22 bp, Homo sapiens
atatcttaattctttgttctgt

SEQ ID NO: 859300 - DNA, 17 bp, Homo sapiens
atatcttcacattgtgt

SEQ ID NO: 859301 - DNA, 19 bp, Homo sapiens
atatcttcacattgtgtga

SEQ ID NO: 859302 - DNA, 17 bp, Homo sapiens
atatcttcccatttaac

SEQ ID NO: 859303 - DNA, 14 bp, Homo sapiens
atatcttcctttgg

SEQ ID NO: 859304 - DNA, 18 bp, Homo sapiens
atatcttcgttagtaatc

SEQ ID NO: 859305 - DNA, 15 bp, Homo sapiens
atatcttgaaatgaa

SEQ ID NO: 859306 - DNA, 17 bp, Homo sapiens
atatcttgcgaatccaa

SEQ ID NO: 859307 - DNA, 13 bp, Homo sapiens
atatctttatgta

SEQ ID NO: 859308 - DNA, 13 bp, Homo sapiens
atatctttattaa

SEQ ID NO: 859309 - DNA, 16 bp, Homo sapiens
atatctttattaatca

SEQ ID NO: 859310 - DNA, 14 bp, Homo sapiens
atatctttctctta

SEQ ID NO: 859311 - DNA, 19 bp, Homo sapiens
atatctttctcttacctgt

SEQ ID NO: 859312 - DNA, 17 bp, Homo sapiens
atatctttgacctcaat

SEQ ID NO: 859313 - DNA, 16 bp, Homo sapiens
atatcttttggttatt

SEQ ID NO: 859314 - DNA, 17 bp, Homo sapiens
atatgaaaaatgtaaat

SEQ ID NO: 859315 - DNA, 23 bp, Homo sapiens
atatgaaaatacaacttaaataa

SEQ ID NO: 859316 - DNA, 16 bp, Homo sapiens
atatgaaattccagca

SEQ ID NO: 859317 - DNA, 17 bp, Homo sapiens
atatgaacagggcccag

SEQ ID NO: 859318 - DNA, 20 bp, Homo sapiens
atatgaacagggcccaggcc

SEQ ID NO: 859319 - DNA, 20 bp, Homo sapiens
atatgaacatattgttgaaa

SEQ ID NO: 859320 - DNA, 17 bp, Homo sapiens
atatgaacctattttca

SEQ ID NO: 859321 - DNA, 15 bp, Homo sapiens
atatgaagacataaa

SEQ ID NO: 859322 - DNA, 14 bp, Homo sapiens
atatgaagcctttg

SEQ ID NO: 859323 - DNA, 12 bp, Homo sapiens
atatgaatctat

SEQ ID NO: 859324 - DNA, 12 bp, Homo sapiens
atatgaatgtca

SEQ ID NO: 859325 - DNA, 21 bp, Homo sapiens
atatgaatttaaatataattc

SEQ ID NO: 859326 - DNA, 17 bp, Homo sapiens
atatgacacaaaggtgg

SEQ ID NO: 859327 - DNA, 21 bp, Homo sapiens
atatgacagctgtccctgtca

SEQ ID NO: 859328 - DNA, 18 bp, Homo sapiens
atatgacccacactgcca

SEQ ID NO: 859329 - DNA, 22 bp, Homo sapiens
atatgacccacactgccagaag

SEQ ID NO: 859330 - DNA, 16 bp, Homo sapiens
atatgacggaagaaca

SEQ ID NO: 859331 - DNA, 18 bp, Homo sapiens
atatgacggaagaacata

SEQ ID NO: 859332 - DNA, 21 bp, Homo sapiens
atatgactgtttttcggacag

SEQ ID NO: 859333 - DNA, 22 bp, Homo sapiens
atatgactgtttttcggacagt

SEQ ID NO: 859334 - DNA, 15 bp, Homo sapiens
atatgactttttata

SEQ ID NO: 859335 - DNA, 20 bp, Homo sapiens
atatgagcttcaatataaga

SEQ ID NO: 859336 - DNA, 24 bp, Homo sapiens
atatgagcttcaatataagaagca

SEQ ID NO: 859337 - DNA, 13 bp, Homo sapiens
atatgataaaaca

SEQ ID NO: 859338 - DNA, 18 bp, Homo sapiens
atatgatcattgaaatac

SEQ ID NO: 859339 - DNA, 19 bp, Homo sapiens
atatgatcattgaaatact

SEQ ID NO: 859340 - DNA, 20 bp, Homo sapiens
atatgatccagagcagagtt

SEQ ID NO: 859341 - DNA, 19 bp, Homo sapiens
atatgatccctaatgtgtt

SEQ ID NO: 859342 - DNA, 16 bp, Homo sapiens
atatgatctgtctgtg

SEQ ID NO: 859343 - DNA, 15 bp, Homo sapiens
atatgatgttaaaaa

SEQ ID NO: 859344 - DNA, 21 bp, Homo sapiens
atatgatgttaaaaaaataag

SEQ ID NO: 859345 - DNA, 13 bp, Homo sapiens
atatgattctagt

SEQ ID NO: 859346 - DNA, 21 bp, Homo sapiens
atatgattctagtacataatt

SEQ ID NO: 859347 - DNA, 15 bp, Homo sapiens
atatgattctgcttt

SEQ ID NO: 859348 - DNA, 16 bp, Homo sapiens
atatgcacacattttt

SEQ ID NO: 859349 - DNA, 15 bp, Homo sapiens
atatgcatatatttt

SEQ ID NO: 859350 - DNA, 14 bp, Homo sapiens
atatgcatgccagg

SEQ ID NO: 859351 - DNA, 17 bp, Homo sapiens
atatgccaagctaattt

SEQ ID NO: 859352 - DNA, 23 bp, Homo sapiens
atatgccccttcttgggccccag

SEQ ID NO: 859353 - DNA, 20 bp, Homo sapiens
atatgcctgaccccttgctc

SEQ ID NO: 859354 - DNA, 14 bp, Homo sapiens
atatgccttgtata

SEQ ID NO: 859355 - DNA, 16 bp, Homo sapiens
atatgctctgctttta

SEQ ID NO: 859356 - DNA, 19 bp, Homo sapiens
atatgctgaacgcagaaga

SEQ ID NO: 859357 - DNA, 15 bp, Homo sapiens
atatgctgatctttt

SEQ ID NO: 859358 - DNA, 18 bp, Homo sapiens
atatgcttaaaataagca

SEQ ID NO: 859359 - DNA, 14 bp, Homo sapiens
atatgcttactgat

SEQ ID NO: 859360 - DNA, 14 bp, Homo sapiens
atatgcttatacac

SEQ ID NO: 859361 - DNA, 21 bp, Homo sapiens
atatgcttatacacttacact

SEQ ID NO: 859362 - DNA, 15 bp, Homo sapiens
atatggaaaagattg

SEQ ID NO: 859363 - DNA, 12 bp, Homo sapiens
atatggaacctt

SEQ ID NO: 859364 - DNA, 13 bp, Homo sapiens
atatggaaccttc

SEQ ID NO: 859365 - DNA, 19 bp, Homo sapiens
atatggaacttacattgtt

SEQ ID NO: 859366 - DNA, 21 bp, Homo sapiens
atatgtatatatatatatgca

SEQ ID NO: 859367 - DNA, 17 bp, Homo sapiens
atatgtatatgacattt

SEQ ID NO: 859368 - DNA, 13 bp, Homo sapiens
atatgtatatgta

SEQ ID NO: 859369 - DNA, 14 bp, Homo sapiens
atatgtatatgtat

SEQ ID NO: 859370 - DNA, 23 bp, Homo sapiens
atatgtatctacaatacatatat

SEQ ID NO: 859371 - DNA, 10 bp, Homo sapiens
atatgtatgc

SEQ ID NO: 859372 - DNA, 13 bp, Homo sapiens
atatgtatgcttt

SEQ ID NO: 859373 - DNA, 13 bp, Homo sapiens
atatgtatgtcta

SEQ ID NO: 859374 - DNA, 19 bp, Homo sapiens
atatgtatgtctaattgag

SEQ ID NO: 859375 - DNA, 17 bp, Homo sapiens
atatgtattaagccaaa

SEQ ID NO: 859376 - DNA, 22 bp, Homo sapiens
atatgtattaagccaaacatga

SEQ ID NO: 859377 - DNA, 16 bp, Homo sapiens
atatgtattatttata

SEQ ID NO: 859378 - DNA, 22 bp, Homo sapiens
atatgtattatttataattcct

SEQ ID NO: 859379 - DNA, 23 bp, Homo sapiens
atatgtattatttataattccta

SEQ ID NO: 859380 - DNA, 14 bp, Homo sapiens
atatgtattgtaaa

SEQ ID NO: 859381 - DNA, 22 bp, Homo sapiens
atatgtatttaagatgtacatt

SEQ ID NO: 859382 - DNA, 23 bp, Homo sapiens
atatgtatttaagatgtacattt

SEQ ID NO: 859383 - DNA, 15 bp, Homo sapiens
atatgtatttaccaa

SEQ ID NO: 859384 - DNA, 18 bp, Homo sapiens
atatgtatttaccaaaaa

SEQ ID NO: 859385 - DNA, 16 bp, Homo sapiens
atatgtattttcctaa

SEQ ID NO: 859386 - DNA, 17 bp, Homo sapiens
atatgtatttttatata

SEQ ID NO: 859387 - DNA, 14 bp, Homo sapiens
atatgtcaagccat

SEQ ID NO: 859388 - DNA, 21 bp, Homo sapiens
atatgtcattatttattgtta

SEQ ID NO: 859389 - DNA, 16 bp, Homo sapiens
atatgtctgcaggttt

SEQ ID NO: 859390 - DNA, 17 bp, Homo sapiens
atatgtctgcaggtttc

SEQ ID NO: 859391 - DNA, 11 bp, Homo sapiens
atatgtgaaga

SEQ ID NO: 859392 - DNA, 22 bp, Homo sapiens
atatgtgaagttttccttgcta

SEQ ID NO: 859393 - DNA, 11 bp, Homo sapiens
atatgtgaatc

SEQ ID NO: 859394 - DNA, 21 bp, Homo sapiens
atatgtgaatcctcttcttta

SEQ ID NO: 859395 - DNA, 19 bp, Homo sapiens
atatgtgccaatcaatagc

SEQ ID NO: 859396 - DNA, 21 bp, Homo sapiens
atatgtgtgcctatttgtgtg

SEQ ID NO: 859397 - DNA, 22 bp, Homo sapiens
atatgtgtttttcacatttgcg

SEQ ID NO: 859398 - DNA, 14 bp, Homo sapiens
atatgttcactgtc

SEQ ID NO: 859399 - DNA, 17 bp, Homo sapiens
atatgttgagtgttcat

SEQ ID NO: 859400 - DNA, 20 bp, Homo sapiens
atatgttgctataataaaga

SEQ ID NO: 859401 - DNA, 13 bp, Homo sapiens
atatgttgctcag

SEQ ID NO: 859402 - DNA, 11 bp, Homo sapiens
atatgttgtaa

SEQ ID NO: 859403 - DNA, 19 bp, Homo sapiens
atatgtttccccatctctg

SEQ ID NO: 859404 - DNA, 20 bp, Homo sapiens
atatgtttccccatctctgt

SEQ ID NO: 859405 - DNA, 21 bp, Homo sapiens
atatgtttccccatctctgtc

SEQ ID NO: 859406 - DNA, 13 bp, Homo sapiens
atatgtttccttg

SEQ ID NO: 859407 - DNA, 18 bp, Homo sapiens
atatgtttccttgtttat

SEQ ID NO: 859408 - DNA, 17 bp, Homo sapiens
atatgttttttagatca

SEQ ID NO: 859409 - DNA, 17 bp, Homo sapiens
atattaaaaaagagaca

SEQ ID NO: 859410 - DNA, 17 bp, Homo sapiens
atattaaaaatataaaa

SEQ ID NO: 859411 - DNA, 23 bp, Homo sapiens
atattaaaaatatggaacttcta

SEQ ID NO: 859412 - DNA, 15 bp, Homo sapiens
atattaaaagagacc

SEQ ID NO: 859413 - DNA, 16 bp, Homo sapiens
atattaaaatagcata

SEQ ID NO: 859414 - DNA, 23 bp, Homo sapiens
atattaaaatagcatactgtgta

SEQ ID NO: 859415 - DNA, 18 bp, Homo sapiens
atattaaaatctgatgta

SEQ ID NO: 859416 - DNA, 13 bp, Homo sapiens
atattaaaatgtc

SEQ ID NO: 859417 - DNA, 22 bp, Homo sapiens
atattaaaattccaaattcatg

SEQ ID NO: 859418 - DNA, 15 bp, Homo sapiens
atattaaaatttggt

SEQ ID NO: 859419 - DNA, 21 bp, Homo sapiens
atattaaacaaaaacaaagaa

SEQ ID NO: 859420 - DNA, 20 bp, Homo sapiens
atattaaacaaagtttcaga

SEQ ID NO: 859421 - DNA, 17 bp, Homo sapiens
atattaaacgtgtaaat

SEQ ID NO: 859422 - DNA, 21 bp, Homo sapiens
atattaaagattctctttaaa

SEQ ID NO: 859423 - DNA, 16 bp, Homo sapiens
atattaaagatttctt

SEQ ID NO: 859424 - DNA, 19 bp, Homo sapiens
atattaaagatttcttttc

SEQ ID NO: 859425 - DNA, 23 bp, Homo sapiens
atattaaatatgttagcaaagag

SEQ ID NO: 859426 - DNA, 12 bp, Homo sapiens
atattaaatctg

SEQ ID NO: 859427 - DNA, 13 bp, Homo sapiens
atattaaatgagg

SEQ ID NO: 859428 - DNA, 18 bp, Homo sapiens
atattaaattttttgttg

SEQ ID NO: 859429 - DNA, 24 bp, Homo sapiens
atattaagaaagactatctaaatg

SEQ ID NO: 859430 - DNA, 13 bp, Homo sapiens
atattaagacagt

SEQ ID NO: 859431 - DNA, 17 bp, Homo sapiens
atattaagacagtgtac

SEQ ID NO: 859432 - DNA, 18 bp, Homo sapiens
atattaagacagtgtaca

SEQ ID NO: 859433 - DNA, 19 bp, Homo sapiens
atattaagacagtgtacaa

SEQ ID NO: 859434 - DNA, 15 bp, Homo sapiens
atattaagcacttta

SEQ ID NO: 859435 - DNA, 20 bp, Homo sapiens
atattaagcactttaagctc

SEQ ID NO: 859436 - DNA, 18 bp, Homo sapiens
atattaagtgtgccaaat

SEQ ID NO: 859437 - DNA, 19 bp, Homo sapiens
atattaatagtaatttgta

SEQ ID NO: 859438 - DNA, 12 bp, Homo sapiens
atattaatcaaa

SEQ ID NO: 859439 - DNA, 14 bp, Homo sapiens
atattaatcaaaat

SEQ ID NO: 859440 - DNA, 14 bp, Homo sapiens
atattaatgccttt

SEQ ID NO: 859441 - DNA, 23 bp, Homo sapiens
atattaatgcctttaaagtatga

SEQ ID NO: 859442 - DNA, 14 bp, Homo sapiens
atattaattgcctg

SEQ ID NO: 859443 - DNA, 22 bp, Homo sapiens
atattacaaaaacaaaataaaa

SEQ ID NO: 859444 - DNA, 15 bp, Homo sapiens
atattacaatgatca

SEQ ID NO: 859445 - DNA, 15 bp, Homo sapiens
atattacactacaca

SEQ ID NO: 859446 - DNA, 23 bp, Homo sapiens
atattactctagtttattctaat

SEQ ID NO: 859447 - DNA, 13 bp, Homo sapiens
atattactgattt

SEQ ID NO: 859448 - DNA, 15 bp, Homo sapiens
atattactgatttag

SEQ ID NO: 859449 - DNA, 19 bp, Homo sapiens
atattttatttcaatgtaa

SEQ ID NO: 859450 - DNA, 15 bp, Homo sapiens
atattttcaaagaga

SEQ ID NO: 859451 - DNA, 19 bp, Homo sapiens
atattttcacactggtaaa

SEQ ID NO: 859452 - DNA, 22 bp, Homo sapiens
atattttcacactggtaaatgt

SEQ ID NO: 859453 - DNA, 21 bp, Homo sapiens
atattttcaccatttgattat

SEQ ID NO: 859454 - DNA, 20 bp, Homo sapiens
atattttcatcctataagct

SEQ ID NO: 859455 - DNA, 18 bp, Homo sapiens
atattttcattaaaagct

SEQ ID NO: 859456 - DNA, 22 bp, Homo sapiens
atattttccataaatttggact

SEQ ID NO: 859457 - DNA, 13 bp, Homo sapiens
atattttcctata

SEQ ID NO: 859458 - DNA, 14 bp, Homo sapiens
atattttcctctta

SEQ ID NO: 859459 - DNA, 13 bp, Homo sapiens
atattttctattt

SEQ ID NO: 859460 - DNA, 13 bp, Homo sapiens
atattttctctag

SEQ ID NO: 859461 - DNA, 13 bp, Homo sapiens
atattttctgttt

SEQ ID NO: 859462 - DNA, 13 bp, Homo sapiens
atattttgaatca

SEQ ID NO: 859463 - DNA, 19 bp, Homo sapiens
atattttgaatcaataata

SEQ ID NO: 859464 - DNA, 13 bp, Homo sapiens
atattttgataca

SEQ ID NO: 859465 - DNA, 16 bp, Homo sapiens
atattttgatacaaat

SEQ ID NO: 859466 - DNA, 18 bp, Homo sapiens
atattttgatgcagataa

SEQ ID NO: 859467 - DNA, 14 bp, Homo sapiens
atattttggaaact

SEQ ID NO: 859468 - DNA, 20 bp, Homo sapiens
atattttgtaaaatgtatta

SEQ ID NO: 859469 - DNA, 13 bp, Homo sapiens
atattttgtatat

SEQ ID NO: 859470 - DNA, 19 bp, Homo sapiens
atattttgttaacttttgt

SEQ ID NO: 859471 - DNA, 22 bp, Homo sapiens
atatttttaaaatatttaactt

SEQ ID NO: 859472 - DNA, 20 bp, Homo sapiens
atatttttaaagaatgttag

SEQ ID NO: 859473 - DNA, 13 bp, Homo sapiens
atatttttagata

SEQ ID NO: 859474 - DNA, 17 bp, Homo sapiens
atatttttatactttat

SEQ ID NO: 859475 - DNA, 18 bp, Homo sapiens
atatttttatactttatt

SEQ ID NO: 859476 - DNA, 19 bp, Homo sapiens
atatttttatagacaaata

SEQ ID NO: 859477 - DNA, 22 bp, Homo sapiens
atatttttatctttatatgaag

SEQ ID NO: 859478 - DNA, 15 bp, Homo sapiens
atatttttatgtgca

SEQ ID NO: 859479 - DNA, 14 bp, Homo sapiens
atatttttccattt

SEQ ID NO: 859480 - DNA, 17 bp, Homo sapiens
atatttttccatttatt

SEQ ID NO: 859481 - DNA, 16 bp, Homo sapiens
atatttttctaaagaa

SEQ ID NO: 859482 - DNA, 18 bp, Homo sapiens
atatttttctaaagaaat

SEQ ID NO: 859483 - DNA, 14 bp, Homo sapiens
atatttttgatcat

SEQ ID NO: 859484 - DNA, 18 bp, Homo sapiens
atatttttggttgtcaat

SEQ ID NO: 859485 - DNA, 10 bp, Homo sapiens
atatttttgt

SEQ ID NO: 859486 - DNA, 12 bp, Homo sapiens
atatttttgtac

SEQ ID NO: 859487 - DNA, 14 bp, Homo sapiens
atatttttgtacat

SEQ ID NO: 859488 - DNA, 14 bp, Homo sapiens
atatttttgtactt

SEQ ID NO: 859489 - DNA, 17 bp, Homo sapiens
atattttttaaaataag

SEQ ID NO: 859490 - DNA, 23 bp, Homo sapiens
atattttttaaaataagtctgat

SEQ ID NO: 859491 - DNA, 21 bp, Homo sapiens
atattttttaatgtattccct

SEQ ID NO: 859492 - DNA, 21 bp, Homo sapiens
atattttttaatttaaagctt

SEQ ID NO: 859493 - DNA, 18 bp, Homo sapiens
atattttttcagaaatat

SEQ ID NO: 859494 - DNA, 19 bp, Homo sapiens
atattttttgaaggtttca

SEQ ID NO: 859495 - DNA, 15 bp, Homo sapiens
atattttttgtctgt

SEQ ID NO: 859496 - DNA, 16 bp, Homo sapiens
atcaaaaaaacaagtt

SEQ ID NO: 859497 - DNA, 22 bp, Homo sapiens
atcaaaacctgtgccaggctga

SEQ ID NO: 859498 - DNA, 18 bp, Homo sapiens
atcaaaagggccaaagaa

SEQ ID NO: 859499 - DNA, 15 bp, Homo sapiens
atcaaaataaaaagt

SEQ ID NO: 859500 - DNA, 20 bp, Homo sapiens
atcaaaatcttaatcattat

SEQ ID NO: 859501 - DNA, 12 bp, Homo sapiens
atcaaaatgctt

SEQ ID NO: 859502 - DNA, 22 bp, Homo sapiens
atcaaaatgctttttatttctg

SEQ ID NO: 859503 - DNA, 14 bp, Homo sapiens
atcaaaattacata

SEQ ID NO: 859504 - DNA, 22 bp, Homo sapiens
atcaaacagccccagtcttcct

SEQ ID NO: 859505 - DNA, 15 bp, Homo sapiens
atcaaacatgcacac

SEQ ID NO: 859506 - DNA, 18 bp, Homo sapiens
atcaaacatgggtttagt

SEQ ID NO: 859507 - DNA, 17 bp, Homo sapiens
atcaaacatttgccaag

SEQ ID NO: 859508 - DNA, 14 bp, Homo sapiens
atcaaacattttga

SEQ ID NO: 859509 - DNA, 15 bp, Homo sapiens
atcaaacattttgaa

SEQ ID NO: 859510 - DNA, 18 bp, Homo sapiens
atcaaaccctagccttgc

SEQ ID NO: 859511 - DNA, 21 bp, Homo sapiens
atcaaaccctagccttgcttg

SEQ ID NO: 859512 - DNA, 14 bp, Homo sapiens
atcaaactgaagcc

SEQ ID NO: 859513 - DNA, 15 bp, Homo sapiens
atcaaactgaagcca

SEQ ID NO: 859514 - DNA, 16 bp, Homo sapiens
atcaaagaaaagactt

SEQ ID NO: 859515 - DNA, 23 bp, Homo sapiens
atcaaagaaaagacttttgttga

SEQ ID NO: 859516 - DNA, 17 bp, Homo sapiens
atcaaagaaattcagaa

SEQ ID NO: 859517 - DNA, 18 bp, Homo sapiens
atcaaagaaattcagaac

SEQ ID NO: 859518 - DNA, 14 bp, Homo sapiens
atcaaagaacagat

SEQ ID NO: 859519 - DNA, 16 bp, Homo sapiens
atcaaagaattacagt

SEQ ID NO: 859520 - DNA, 17 bp, Homo sapiens
atcaaagaattacagta

SEQ ID NO: 859521 - DNA, 19 bp, Homo sapiens
atcaaagaggttttaaaaa

SEQ ID NO: 859522 - DNA, 23 bp, Homo sapiens
atcaaagaggttttaaaaaaatc

SEQ ID NO: 859523 - DNA, 23 bp, Homo sapiens
atcaaagcacttggactcttgct

SEQ ID NO: 859524 - DNA, 16 bp, Homo sapiens
atcaaaggaatataag

SEQ ID NO: 859525 - DNA, 21 bp, Homo sapiens
atcaaagtggtaaatactgtg

SEQ ID NO: 859526 - DNA, 22 bp, Homo sapiens
atcaaagtggtaaatactgtga

SEQ ID NO: 859527 - DNA, 19 bp, Homo sapiens
atcaaataaaaattctaga

SEQ ID NO: 859528 - DNA, 21 bp, Homo sapiens
atcaaataaaatatcataaag

SEQ ID NO: 859529 - DNA, 14 bp, Homo sapiens
atcaaataaatttc

SEQ ID NO: 859530 - DNA, 17 bp, Homo sapiens
atcaaataagtatttat

SEQ ID NO: 859531 - DNA, 20 bp, Homo sapiens
atcaaataagtatttataat

SEQ ID NO: 859532 - DNA, 13 bp, Homo sapiens
atcaaatacattt

SEQ ID NO: 859533 - DNA, 14 bp, Homo sapiens
atcaaatacattta

SEQ ID NO: 859534 - DNA, 11 bp, Homo sapiens
atcaaatactt

SEQ ID NO: 859535 - DNA, 15 bp, Homo sapiens
atcaaatactttaaa

SEQ ID NO: 859536 - DNA, 20 bp, Homo sapiens
atcaaatagaaccactatga

SEQ ID NO: 859537 - DNA, 15 bp, Homo sapiens
atcaaatatagaaag

SEQ ID NO: 859538 - DNA, 16 bp, Homo sapiens
atcaaatatagaaagt

SEQ ID NO: 859539 - DNA, 14 bp, Homo sapiens
atcaaatctcctgc

SEQ ID NO: 859540 - DNA, 17 bp, Homo sapiens
atcaaatgcagtatatt

SEQ ID NO: 859541 - DNA, 18 bp, Homo sapiens
atcaaatggtatcttttg

SEQ ID NO: 859542 - DNA, 15 bp, Homo sapiens
atcaaatgttacagt

SEQ ID NO: 859543 - DNA, 18 bp, Homo sapiens
atcaaatgttacagttta

SEQ ID NO: 859544 - DNA, 18 bp, Homo sapiens
atcaaattctacaacttt

SEQ ID NO: 859545 - DNA, 12 bp, Homo sapiens
atcaaattctat

SEQ ID NO: 859546 - DNA, 16 bp, Homo sapiens
atcaacaaaaattgtc

SEQ ID NO: 859547 - DNA, 17 bp, Homo sapiens
atcaacaataaaatttt

SEQ ID NO: 859548 - DNA, 19 bp, Homo sapiens
atcaacaccttaatatgct

SEQ ID NO: 859549 - DNA, 17 bp, Homo sapiens
atcaacagaagcatttg

SEQ ID NO: 859550 - DNA, 22 bp, Homo sapiens
atcaacagaagcatttgtattt

SEQ ID NO: 859551 - DNA, 18 bp, Homo sapiens
atattactgttgcattta

SEQ ID NO: 859552 - DNA, 16 bp, Homo sapiens
atattacttttgtaaa

SEQ ID NO: 859553 - DNA, 20 bp, Homo sapiens
atattacttttgtaaatatt

SEQ ID NO: 859554 - DNA, 22 bp, Homo sapiens
atattacttttgtaaatattct

SEQ ID NO: 859555 - DNA, 15 bp, Homo sapiens
atattagacatcaat

SEQ ID NO: 859556 - DNA, 17 bp, Homo sapiens
atattagcaaagaagct

SEQ ID NO: 859557 - DNA, 15 bp, Homo sapiens
atattagctgaaaca

SEQ ID NO: 859558 - DNA, 19 bp, Homo sapiens
atattaggggggaaagtca

SEQ ID NO: 859559 - DNA, 14 bp, Homo sapiens
atattagtgattct

SEQ ID NO: 859560 - DNA, 15 bp, Homo sapiens
atattagtgattctg

SEQ ID NO: 859561 - DNA, 16 bp, Homo sapiens
atattagtgattctga

SEQ ID NO: 859562 - DNA, 21 bp, Homo sapiens
atattataactctgtataata

SEQ ID NO: 859563 - DNA, 17 bp, Homo sapiens
atattataagggagagc

SEQ ID NO: 859564 - DNA, 22 bp, Homo sapiens
atattataccagatgaacattt

SEQ ID NO: 859565 - DNA, 23 bp, Homo sapiens
atattataccagatgaacatttc

SEQ ID NO: 859566 - DNA, 20 bp, Homo sapiens
atattatactaagaaaagat

SEQ ID NO: 859567 - DNA, 11 bp, Homo sapiens
atattatagaa

SEQ ID NO: 859568 - DNA, 13 bp, Homo sapiens
atattatagaaaa

SEQ ID NO: 859569 - DNA, 22 bp, Homo sapiens
atattatagaaaattatttgta

SEQ ID NO: 859570 - DNA, 21 bp, Homo sapiens
atattatctacctgttctgta

SEQ ID NO: 859571 - DNA, 16 bp, Homo sapiens
atattatggaagattt

SEQ ID NO: 859572 - DNA, 12 bp, Homo sapiens
atattatgtctt

SEQ ID NO: 859573 - DNA, 13 bp, Homo sapiens
atattatgtcttc

SEQ ID NO: 859574 - DNA, 15 bp, Homo sapiens
atattattccaaagt

SEQ ID NO: 859575 - DNA, 14 bp, Homo sapiens
atattatttcttct

SEQ ID NO: 859576 - DNA, 22 bp, Homo sapiens
atattatttgcagtgcagtata

SEQ ID NO: 859577 - DNA, 18 bp, Homo sapiens
atattatttgtgtttcct

SEQ ID NO: 859578 - DNA, 23 bp, Homo sapiens
atattattttagcttcagttgtt

SEQ ID NO: 859579 - DNA, 15 bp, Homo sapiens
atattcaaggcttta

SEQ ID NO: 859580 - DNA, 14 bp, Homo sapiens
atattcaagtaaca

SEQ ID NO: 859581 - DNA, 15 bp, Homo sapiens
atattcaagtaacac

SEQ ID NO: 859582 - DNA, 20 bp, Homo sapiens
atattcaagtaacactttaa

SEQ ID NO: 859583 - DNA, 16 bp, Homo sapiens
atattcacagactgat

SEQ ID NO: 859584 - DNA, 19 bp, Homo sapiens
atattcactggttttacac

SEQ ID NO: 859585 - DNA, 21 bp, Homo sapiens
atattcactggttttacacag

SEQ ID NO: 859586 - DNA, 22 bp, Homo sapiens
atattcagacaaaatggataca

SEQ ID NO: 859587 - DNA, 14 bp, Homo sapiens
atattcagacatca

SEQ ID NO: 859588 - DNA, 12 bp, Homo sapiens
atcaacagcagt

SEQ ID NO: 859589 - DNA, 16 bp, Homo sapiens
atcaacagcagtgagt

SEQ ID NO: 859590 - DNA, 17 bp, Homo sapiens
atcaaccaactgcacaa

SEQ ID NO: 859591 - DNA, 23 bp, Homo sapiens
atcaaccacctatttttgacatg

SEQ ID NO: 859592 - DNA, 19 bp, Homo sapiens
atcaaccccagacactggt

SEQ ID NO: 859593 - DNA, 20 bp, Homo sapiens
atcaaccctgcaatcacttt

SEQ ID NO: 859594 - DNA, 21 bp, Homo sapiens
atcaactaggtatttaagact

SEQ ID NO: 859595 - DNA, 19 bp, Homo sapiens
atcaactctcactcctgaa

SEQ ID NO: 859596 - DNA, 13 bp, Homo sapiens
atcaactgaatga

SEQ ID NO: 859597 - DNA, 21 bp, Homo sapiens
atcaactggagtctatgctta

SEQ ID NO: 859598 - DNA, 18 bp, Homo sapiens
atcaacttcgctagaaaa

SEQ ID NO: 859599 - DNA, 21 bp, Homo sapiens
atcaactttaatcaagttgta

SEQ ID NO: 859600 - DNA, 15 bp, Homo sapiens
atcaagaaagtgttg

SEQ ID NO: 859601 - DNA, 20 bp, Homo sapiens
atcaagaagggctgcatgat

SEQ ID NO: 859602 - DNA, 12 bp, Homo sapiens
atcaagagaaac

SEQ ID NO: 859603 - DNA, 21 bp, Homo sapiens
atcacctttttgacttttcca

SEQ ID NO: 859604 - DNA, 21 bp, Homo sapiens
atcacgacacatttgccttca

SEQ ID NO: 859605 - DNA, 19 bp, Homo sapiens
atcacgagatcttccttcc

SEQ ID NO: 859606 - DNA, 22 bp, Homo sapiens
atcacggatggtgcatgggctc

SEQ ID NO: 859607 - DNA, 19 bp, Homo sapiens
atcacggtggtaaagaaag

SEQ ID NO: 859608 - DNA, 21 bp, Homo sapiens
atcacgtaaagctagaaatga

SEQ ID NO: 859609 - DNA, 21 bp, Homo sapiens
atcacgttagaggaaaaatat

SEQ ID NO: 859610 - DNA, 22 bp, Homo sapiens
atcacgttagaggaaaaatatt

SEQ ID NO: 859611 - DNA, 12 bp, Homo sapiens
atcactaaactt

SEQ ID NO: 859612 - DNA, 13 bp, Homo sapiens
atcactaaacttt

SEQ ID NO: 859613 - DNA, 22 bp, Homo sapiens
atcagcctgagtctcctgtgcc

SEQ ID NO: 859614 - DNA, 20 bp, Homo sapiens
atcagcctgggcaatgtgat

SEQ ID NO: 859615 - DNA, 17 bp, Homo sapiens
atcagcctttaggtctt
